United States Patent 7,655,785 (BIOINFORMATICALLY DETECTABLE GROUP OF NOVEL REGULATORY OLIGONUCLEOTIDES AND USES THEREOF) - sequence listing, part 41

SEQ ID NO: 1691417 - RNA, 13 nt, Homo sapiens
cauguuuccucuu

SEQ ID NO: 1691418 - RNA, 12 nt, Homo sapiens
ccuaaguacugu

SEQ ID NO: 1691419 - RNA, 17 nt, Homo sapiens
ccuaagucucugugaau

SEQ ID NO: 1691420 - RNA, 13 nt, Homo sapiens
ccuaauacaacau

SEQ ID NO: 1691421 - RNA, 17 nt, Homo sapiens
ccuaauacaacauguag

SEQ ID NO: 1691422 - RNA, 16 nt, Homo sapiens
ccuaaucucauaccuc

SEQ ID NO: 1691423 - RNA, 21 nt, Homo sapiens
ccuacccccuaagagccauuu

SEQ ID NO: 1691424 - RNA, 21 nt, Homo sapiens
ccuaccucacagagugcauug

SEQ ID NO: 1691425 - RNA, 16 nt, Homo sapiens
ccuacguauccugcag

SEQ ID NO: 1691426 - RNA, 22 nt, Homo sapiens
ccuacuaucacugaacaaacua

SEQ ID NO: 1691427 - RNA, 20 nt, Homo sapiens
ccuacuuuucuuuccucaga

SEQ ID NO: 1691428 - RNA, 18 nt, Homo sapiens
ccuagaagaagcuauguc

SEQ ID NO: 1691429 - RNA, 17 nt, Homo sapiens
ccuagaccuggugcuga

SEQ ID NO: 1691430 - RNA, 15 nt, Homo sapiens
ccuagccaauucaca

SEQ ID NO: 1691431 - RNA, 19 nt, Homo sapiens
ccuagccagcacuuguaua

SEQ ID NO: 1691432 - RNA, 19 nt, Homo sapiens
ccuagccucgcucuuggca

SEQ ID NO: 1691433 - RNA, 15 nt, Homo sapiens
ccuaggaacucaguc

SEQ ID NO: 1691434 - RNA, 15 nt, Homo sapiens
ccuauaaucugucaa

SEQ ID NO: 1691435 - RNA, 23 nt, Homo sapiens
ccuaucagaaguuucucagcucc

SEQ ID NO: 1691436 - RNA, 19 nt, Homo sapiens
ccuaucuccugacagaagg

SEQ ID NO: 1691437 - RNA, 20 nt, Homo sapiens
ccuauguagcucugcaucuc

SEQ ID NO: 1691438 - RNA, 17 nt, Homo sapiens
ccuauguugugguccau

SEQ ID NO: 1691439 - RNA, 19 nt, Homo sapiens
ccuauuuuuguaaacugga

SEQ ID NO: 1691440 - RNA, 18 nt, Homo sapiens
ccucaaccuccugggcua

SEQ ID NO: 1691441 - RNA, 19 nt, Homo sapiens
ccucaauuuuugucucaga

SEQ ID NO: 1691442 - RNA, 17 nt, Homo sapiens
ccucagaauugaucauu

SEQ ID NO: 1691443 - RNA, 12 nt, Homo sapiens
ccucagacaucc

SEQ ID NO: 1691444 - RNA, 13 nt, Homo sapiens
ccucagacauccc

SEQ ID NO: 1691445 - RNA, 20 nt, Homo sapiens
ccucagcugccucacuuccu

SEQ ID NO: 1691446 - RNA, 14 nt, Homo sapiens
ccucaggcagcuca

SEQ ID NO: 1691447 - RNA, 18 nt, Homo sapiens
ccucagggagcagggaag

SEQ ID NO: 1691448 - RNA, 13 nt, Homo sapiens
ccucaggugaucc

SEQ ID NO: 1691449 - RNA, 20 nt, Homo sapiens
ccucaguucccucuugcuca

SEQ ID NO: 1691450 - RNA, 17 nt, Homo sapiens
ccucauccaggcuacca

SEQ ID NO: 1691451 - RNA, 21 nt, Homo sapiens
ccucauuacugggccuuagug

SEQ ID NO: 1691452 - RNA, 14 nt, Homo sapiens
ccuccaacacaagg

SEQ ID NO: 1691453 - RNA, 22 nt, Homo sapiens
ccucccaggaacugggccaacu

SEQ ID NO: 1691454 - RNA, 14 nt, Homo sapiens
ccucccgggcucaa

SEQ ID NO: 1691455 - RNA, 18 nt, Homo sapiens
ccucccuggcucccauga

SEQ ID NO: 1691456 - RNA, 13 nt, Homo sapiens
ccuccguccagcc

SEQ ID NO: 1691457 - RNA, 23 nt, Homo sapiens
ccuccucccaccugccaccaggc

SEQ ID NO: 1691458 - RNA, 14 nt, Homo sapiens
ccuccucuagcugu

SEQ ID NO: 1691459 - RNA, 21 nt, Homo sapiens
ccuccucuccuacuuugggac

SEQ ID NO: 1691460 - RNA, 16 nt, Homo sapiens
ccuccugugaaccaac

SEQ ID NO: 1691461 - RNA, 14 nt, Homo sapiens
ccuccuucgggaca

SEQ ID NO: 1691462 - RNA, 23 nt, Homo sapiens
ccucgcccuuucuuaaagugcag

SEQ ID NO: 1691463 - RNA, 13 nt, Homo sapiens
ccucuacauauuu

SEQ ID NO: 1691464 - RNA, 14 nt, Homo sapiens
ccucuacuuuccag

SEQ ID NO: 1691465 - RNA, 12 nt, Homo sapiens
ccucucaccaaa

SEQ ID NO: 1691466 - RNA, 17 nt, Homo sapiens
ccucuccuuccuuaccc

SEQ ID NO: 1691467 - RNA, 23 nt, Homo sapiens
ccucucuagcacaauuugcacua

SEQ ID NO: 1691468 - RNA, 22 nt, Homo sapiens
ccucugcggaccccagcuguga

SEQ ID NO: 1691469 - RNA, 18 nt, Homo sapiens
ccucugggaaggugaccu

SEQ ID NO: 1691470 - RNA, 22 nt, Homo sapiens
ccucugggagccuaaaccaggc

SEQ ID NO: 1691471 - RNA, 21 nt, Homo sapiens
ccucugucauucgcucccaca

SEQ ID NO: 1691472 - RNA, 14 nt, Homo sapiens
ccucuguccaggca

SEQ ID NO: 1691473 - RNA, 17 nt, Homo sapiens
ccucuucaccuuauuca

SEQ ID NO: 1691474 - RNA, 14 nt, Homo sapiens
ccucuuccccagaa

SEQ ID NO: 1691475 - RNA, 22 nt, Homo sapiens
ccucuuccccagaaaggagacu

SEQ ID NO: 1691476 - RNA, 21 nt, Homo sapiens
ccucuuccuccucgcugccag

SEQ ID NO: 1691477 - RNA, 14 nt, Homo sapiens
ccucuuuaaaaaca

SEQ ID NO: 1691478 - RNA, 18 nt, Homo sapiens
ccucuuuucucugugcuu

SEQ ID NO: 1691479 - RNA, 14 nt, Homo sapiens
ccugaagucacaca

SEQ ID NO: 1691480 - RNA, 14 nt, Homo sapiens
ccugaauccauuaa

SEQ ID NO: 1691481 - RNA, 22 nt, Homo sapiens
ccugacagaaggugccacuuua

SEQ ID NO: 1691482 - RNA, 16 nt, Homo sapiens
ccugaccaucgcacac

SEQ ID NO: 1691483 - RNA, 20 nt, Homo sapiens
ccugaccaucgcacaccggc

SEQ ID NO: 1691484 - RNA, 12 nt, Homo sapiens
ccugaccucacu

SEQ ID NO: 1691485 - RNA, 18 nt, Homo sapiens
ccugacucuugcaggggu

SEQ ID NO: 1691486 - RNA, 20 nt, Homo sapiens
ccugaguucauccaggccca

SEQ ID NO: 1691487 - RNA, 19 nt, Homo sapiens
ccugauacaggcauggcag

SEQ ID NO: 1691488 - RNA, 18 nt, Homo sapiens
ccugaugaaaacauagca

SEQ ID NO: 1691489 - RNA, 23 nt, Homo sapiens
ccugauuagaugacucucagucc

SEQ ID NO: 1691490 - RNA, 16 nt, Homo sapiens
ccugcacuaaagccag

SEQ ID NO: 1691491 - RNA, 13 nt, Homo sapiens
ccugccacucuca

SEQ ID NO: 1691492 - RNA, 14 nt, Homo sapiens
ccugccuacuuccu

SEQ ID NO: 1691493 - RNA, 13 nt, Homo sapiens
ccugccuggucac

SEQ ID NO: 1691494 - RNA, 20 nt, Homo sapiens
ccugccuguagcagugagaa

SEQ ID NO: 1691495 - RNA, 19 nt, Homo sapiens
ccugccuuaggguagugcu

SEQ ID NO: 1691496 - RNA, 18 nt, Homo sapiens
ccugcucccucacccagg

SEQ ID NO: 1691497 - RNA, 17 nt, Homo sapiens
ccugcuccgcugcuccu

SEQ ID NO: 1691498 - RNA, 18 nt, Homo sapiens
ccugcugcccaaucucca

SEQ ID NO: 1691499 - RNA, 18 nt, Homo sapiens
ccugcuggcucuucugcc

SEQ ID NO: 1691500 - RNA, 22 nt, Homo sapiens
ccuggacaguaucccacaucca

SEQ ID NO: 1691501 - RNA, 21 nt, Homo sapiens
ccuggagacguggaaccucug

SEQ ID NO: 1691502 - RNA, 20 nt, Homo sapiens
ccuggagaugcugccuggug

SEQ ID NO: 1691503 - RNA, 17 nt, Homo sapiens
ccuggaggcggcaaagg

SEQ ID NO: 1691504 - RNA, 16 nt, Homo sapiens
ccuggcacaggacuga

SEQ ID NO: 1691505 - RNA, 14 nt, Homo sapiens
ccuggccaggagcu

SEQ ID NO: 1691506 - RNA, 22 nt, Homo sapiens
ccugggacaguuuaucaugaag

SEQ ID NO: 1691507 - RNA, 15 nt, Homo sapiens
ccugguacaaaugca

SEQ ID NO: 1691508 - RNA, 20 nt, Homo sapiens
ccuguaccccagcacuugug

SEQ ID NO: 1691509 - RNA, 21 nt, Homo sapiens
ccuguacucuggggugcugcc

SEQ ID NO: 1691510 - RNA, 15 nt, Homo sapiens
ccuguagcgccagug

SEQ ID NO: 1691511 - RNA, 18 nt, Homo sapiens
ccuguagcgccaguguaa

SEQ ID NO: 1691512 - RNA, 19 nt, Homo sapiens
ccuguagcgccaguguaau

SEQ ID NO: 1691513 - RNA, 17 nt, Homo sapiens
ccuguagguucuugaua

SEQ ID NO: 1691514 - RNA, 19 nt, Homo sapiens
ccugucccauggacacucc

SEQ ID NO: 1691515 - RNA, 15 nt, Homo sapiens
ccugucuuuaaggaa

SEQ ID NO: 1691516 - RNA, 16 nt, Homo sapiens
ccugugaagcugaaaa

SEQ ID NO: 1691517 - RNA, 13 nt, Homo sapiens
ccugugcacacac

SEQ ID NO: 1691518 - RNA, 22 nt, Homo sapiens
ccuguggaacccagcaguucug

SEQ ID NO: 1691519 - RNA, 14 nt, Homo sapiens
ccuguggagcucag

SEQ ID NO: 1691520 - RNA, 21 nt, Homo sapiens
ccuguguccaccugugggugu

SEQ ID NO: 1691521 - RNA, 14 nt, Homo sapiens
ccuguucacucuac

SEQ ID NO: 1691522 - RNA, 22 nt, Homo sapiens
ccuguucugggugcagcugaga

SEQ ID NO: 1691523 - RNA, 19 nt, Homo sapiens
ccuguuggcucacagggcu

SEQ ID NO: 1691524 - RNA, 17 nt, Homo sapiens
ccuguugguuagauuca

SEQ ID NO: 1691525 - RNA, 21 nt, Homo sapiens
ccuguuuuauaaugaacccau

SEQ ID NO: 1691526 - RNA, 18 nt, Homo sapiens
ccuguuuucgcaccuacc

SEQ ID NO: 1691527 - RNA, 15 nt, Homo sapiens
gcauauguugaauac

SEQ ID NO: 1691528 - RNA, 18 nt, Homo sapiens
gcauauuuuaaugcaguu

SEQ ID NO: 1691529 - RNA, 12 nt, Homo sapiens
gcaucacugggu

SEQ ID NO: 1691530 - RNA, 21 nt, Homo sapiens
gcaucaggcagggugagcucc

SEQ ID NO: 1691531 - RNA, 13 nt, Homo sapiens
gcaucaucuaugg

SEQ ID NO: 1691532 - RNA, 18 nt, Homo sapiens
gcaucccggaggaaaucu

SEQ ID NO: 1691533 - RNA, 21 nt, Homo sapiens
gcaucuaaguuauaagacucu

SEQ ID NO: 1691534 - RNA, 13 nt, Homo sapiens
gcaucucagccua

SEQ ID NO: 1691535 - RNA, 19 nt, Homo sapiens
gcaucugaaauaggaaaca

SEQ ID NO: 1691536 - RNA, 16 nt, Homo sapiens
gcaucugauuugcaua

SEQ ID NO: 1691537 - RNA, 16 nt, Homo sapiens
gcaucuuuagugcuuu

SEQ ID NO: 1691538 - RNA, 22 nt, Homo sapiens
gcaucuuuagugcuuucuuguc

SEQ ID NO: 1691539 - RNA, 15 nt, Homo sapiens
gcaugaaccuggacc

SEQ ID NO: 1691540 - RNA, 17 nt, Homo sapiens
gcaugccuggucuuucc

SEQ ID NO: 1691541 - RNA, 22 nt, Homo sapiens
gcauggauccagaacugcacuc

SEQ ID NO: 1691542 - RNA, 20 nt, Homo sapiens
gcauggccccaguccaugcu

SEQ ID NO: 1691543 - RNA, 22 nt, Homo sapiens
gcauguccuuugcgccugugac

SEQ ID NO: 1691544 - RNA, 21 nt, Homo sapiens
gcaugugcccuccugagggag

SEQ ID NO: 1691545 - RNA, 21 nt, Homo sapiens
gcauuagcucuuagacccaca

SEQ ID NO: 1691546 - RNA, 17 nt, Homo sapiens
gcauuauguccacugug

SEQ ID NO: 1691547 - RNA, 16 nt, Homo sapiens
gcauucccucccauca

SEQ ID NO: 1691548 - RNA, 16 nt, Homo sapiens
gcauugaaaugagcac

SEQ ID NO: 1691549 - RNA, 23 nt, Homo sapiens
gcauugauggccucaauguggca

SEQ ID NO: 1691550 - RNA, 14 nt, Homo sapiens
gcauuuaagaguga

SEQ ID NO: 1691551 - RNA, 19 nt, Homo sapiens
gcauuuccaacaccacaga

SEQ ID NO: 1691552 - RNA, 19 nt, Homo sapiens
gcauuucuuuucuggccaa

SEQ ID NO: 1691553 - RNA, 16 nt, Homo sapiens
gcauuugauuuugccc

SEQ ID NO: 1691554 - RNA, 14 nt, Homo sapiens
gcauuuuucuggga

SEQ ID NO: 1691555 - RNA, 19 nt, Homo sapiens
gccaaccagagaagcugcu

SEQ ID NO: 1691556 - RNA, 19 nt, Homo sapiens
gccaagaaacgucuucuaa

SEQ ID NO: 1691557 - RNA, 16 nt, Homo sapiens
gccaagagaaaggccu

SEQ ID NO: 1691558 - RNA, 22 nt, Homo sapiens
gccaagcuuguuaucagcuuuc

SEQ ID NO: 1691559 - RNA, 20 nt, Homo sapiens
gccaagguaggcagaucacc

SEQ ID NO: 1691560 - RNA, 14 nt, Homo sapiens
gccaauuagcaauu

SEQ ID NO: 1691561 - RNA, 14 nt, Homo sapiens
gccacacucuccau

SEQ ID NO: 1691562 - RNA, 17 nt, Homo sapiens
gccaccaaagcugccca

SEQ ID NO: 1691563 - RNA, 18 nt, Homo sapiens
gccaccagccacuuuagu

SEQ ID NO: 1691564 - RNA, 14 nt, Homo sapiens
gccaccaggccuca

SEQ ID NO: 1691565 - RNA, 19 nt, Homo sapiens
gccacgggaagaaccaagc

SEQ ID NO: 1691566 - RNA, 16 nt, Homo sapiens
gccacucauuccugua

SEQ ID NO: 1691567 - RNA, 12 nt, Homo sapiens
gccagaagugaa

SEQ ID NO: 1691568 - RNA, 13 nt, Homo sapiens
gccagaggcagcu

SEQ ID NO: 1691569 - RNA, 19 nt, Homo sapiens
gccagaugugaaaacaucu

SEQ ID NO: 1691570 - RNA, 20 nt, Homo sapiens
gccagccugguccaugcagg

SEQ ID NO: 1691571 - RNA, 11 nt, Homo sapiens
gccaggagcuc

SEQ ID NO: 1691572 - RNA, 18 nt, Homo sapiens
gccaggcaugguggcuca

SEQ ID NO: 1691573 - RNA, 21 nt, Homo sapiens
gccaggguggucuugaucucc

SEQ ID NO: 1691574 - RNA, 12 nt, Homo sapiens
gccagguggcca

SEQ ID NO: 1691575 - RNA, 23 nt, Homo sapiens
gccagugcuuuaauggcauguca

SEQ ID NO: 1691576 - RNA, 21 nt, Homo sapiens
gccaguggggccuguggaaug

SEQ ID NO: 1691577 - RNA, 14 nt, Homo sapiens
gccauaacagacca

SEQ ID NO: 1691578 - RNA, 16 nt, Homo sapiens
gccauaaugacucaga

SEQ ID NO: 1691579 - RNA, 14 nt, Homo sapiens
gccauacuuuacaa

SEQ ID NO: 1691580 - RNA, 14 nt, Homo sapiens
gccauauauauuuc

SEQ ID NO: 1691581 - RNA, 11 nt, Homo sapiens
gccauaugccu

SEQ ID NO: 1691582 - RNA, 18 nt, Homo sapiens
gccaucacaugaucuguu

SEQ ID NO: 1691583 - RNA, 13 nt, Homo sapiens
gccaugccaggaa

SEQ ID NO: 1691584 - RNA, 16 nt, Homo sapiens
gccauggcuccccuuu

SEQ ID NO: 1691585 - RNA, 20 nt, Homo sapiens
gccauguaccuccccugccu

SEQ ID NO: 1691586 - RNA, 18 nt, Homo sapiens
gccauuauuuucugucag

SEQ ID NO: 1691587 - RNA, 17 nt, Homo sapiens
gccauucucccccucag

SEQ ID NO: 1691588 - RNA, 15 nt, Homo sapiens
gcccaacugcgcaga

SEQ ID NO: 1691589 - RNA, 16 nt, Homo sapiens
gcccacuucugccaua

SEQ ID NO: 1691590 - RNA, 21 nt, Homo sapiens
gcccagccuccaagcuccauc

SEQ ID NO: 1691591 - RNA, 17 nt, Homo sapiens
gcccaggccugccuguu

SEQ ID NO: 1691592 - RNA, 19 nt, Homo sapiens
gcccaggcuggagugcagu

SEQ ID NO: 1691593 - RNA, 17 nt, Homo sapiens
gcccaggcugugcagcg

SEQ ID NO: 1691594 - RNA, 14 nt, Homo sapiens
gcccauaucuguga

SEQ ID NO: 1691595 - RNA, 19 nt, Homo sapiens
gcccaugcccaccugccca

SEQ ID NO: 1691596 - RNA, 14 nt, Homo sapiens
gccccacaacuuua

SEQ ID NO: 1691597 - RNA, 12 nt, Homo sapiens
gccccacugcca

SEQ ID NO: 1691598 - RNA, 17 nt, Homo sapiens
gccccagagcagggugu

SEQ ID NO: 1691599 - RNA, 16 nt, Homo sapiens
gccccaguccaugcuu

SEQ ID NO: 1691600 - RNA, 15 nt, Homo sapiens
gccccaugccugucc

SEQ ID NO: 1691601 - RNA, 18 nt, Homo sapiens
gccccugccccauuuccu

SEQ ID NO: 1691602 - RNA, 15 nt, Homo sapiens
gccccugcccggcug

SEQ ID NO: 1691603 - RNA, 23 nt, Homo sapiens
gccccugucauccucaugcugcu

SEQ ID NO: 1691604 - RNA, 18 nt, Homo sapiens
gcccgacagccuggcaca

SEQ ID NO: 1691605 - RNA, 17 nt, Homo sapiens
gcccgggagccuaggac

SEQ ID NO: 1691606 - RNA, 16 nt, Homo sapiens
gcccguucuugaaaug

SEQ ID NO: 1691607 - RNA, 19 nt, Homo sapiens
gcccuccccaucccaugua

SEQ ID NO: 1691608 - RNA, 15 nt, Homo sapiens
gcccucgacacucac

SEQ ID NO: 1691609 - RNA, 14 nt, Homo sapiens
gcccucgcugcuuc

SEQ ID NO: 1691610 - RNA, 23 nt, Homo sapiens
gcccucuuccugacgaaacuggc

SEQ ID NO: 1691611 - RNA, 20 nt, Homo sapiens
gcccugauguguccucaggg

SEQ ID NO: 1691612 - RNA, 20 nt, Homo sapiens
gcccuggaauugcagcugua

SEQ ID NO: 1691613 - RNA, 18 nt, Homo sapiens
gcccuggcagggggcaug

SEQ ID NO: 1691614 - RNA, 16 nt, Homo sapiens
gcccuggcucugcugu

SEQ ID NO: 1691615 - RNA, 18 nt, Homo sapiens
gcccuguucugggugcag

SEQ ID NO: 1691616 - RNA, 19 nt, Homo sapiens
gcccuuggcuucugugaug

SEQ ID NO: 1691617 - RNA, 16 nt, Homo sapiens
gcccuuuccuuccaga

SEQ ID NO: 1691618 - RNA, 19 nt, Homo sapiens
gcccuuugcuaaaauauaa

SEQ ID NO: 1691619 - RNA, 16 nt, Homo sapiens
gccgacagcucuccaa

SEQ ID NO: 1691620 - RNA, 21 nt, Homo sapiens
gccgagaucacgccacugcac

SEQ ID NO: 1691621 - RNA, 14 nt, Homo sapiens
gccgauggagacac

SEQ ID NO: 1691622 - RNA, 13 nt, Homo sapiens
gccgggaaccaag

SEQ ID NO: 1691623 - RNA, 19 nt, Homo sapiens
gccgggccuagaccuggug

SEQ ID NO: 1691624 - RNA, 18 nt, Homo sapiens
gccguuguacuccagccu

SEQ ID NO: 1691625 - RNA, 17 nt, Homo sapiens
gccuaauacaacaugua

SEQ ID NO: 1691626 - RNA, 17 nt, Homo sapiens
gccuaccuccacaccac

SEQ ID NO: 1691627 - RNA, 14 nt, Homo sapiens
gccucagcuaccca

SEQ ID NO: 1691628 - RNA, 13 nt, Homo sapiens
gccucagugccac

SEQ ID NO: 1691629 - RNA, 17 nt, Homo sapiens
gccuccagcuucaggca

SEQ ID NO: 1691630 - RNA, 21 nt, Homo sapiens
gccuccaucucauguaucauc

SEQ ID NO: 1691631 - RNA, 14 nt, Homo sapiens
gccuccaugcugcc

SEQ ID NO: 1691632 - RNA, 20 nt, Homo sapiens
gccuccuggcuucacgccau

SEQ ID NO: 1691633 - RNA, 18 nt, Homo sapiens
gccucgcagccuccggaa

SEQ ID NO: 1691634 - RNA, 9 nt, Homo sapiens
gccucggga

SEQ ID NO: 1691635 - RNA, 19 nt, Homo sapiens
gccucugaccccuccucac

SEQ ID NO: 1691636 - RNA, 19 nt, Homo sapiens
gccucuuccucccucauuc

SEQ ID NO: 1691637 - RNA, 20 nt, Homo sapiens
gggaggcagaguuugccuuc

SEQ ID NO: 1691638 - RNA, 17 nt, Homo sapiens
gggaggcgggggcugcc

SEQ ID NO: 1691639 - RNA, 20 nt, Homo sapiens
gggaguaggacauaccagcu

SEQ ID NO: 1691640 - RNA, 18 nt, Homo sapiens
gggagugcucaccgccuc

SEQ ID NO: 1691641 - RNA, 15 nt, Homo sapiens
gggauucaggcugcu

SEQ ID NO: 1691642 - RNA, 12 nt, Homo sapiens
gggcaacagagc

SEQ ID NO: 1691643 - RNA, 22 nt, Homo sapiens
gggcacacucugccagcaaaga

SEQ ID NO: 1691644 - RNA, 22 nt, Homo sapiens
gggcacucccuugguggcaaga

SEQ ID NO: 1691645 - RNA, 13 nt, Homo sapiens
gggcacugguggc

SEQ ID NO: 1691646 - RNA, 17 nt, Homo sapiens
gggcagcauagcaagac

SEQ ID NO: 1691647 - RNA, 21 nt, Homo sapiens
gggcaggcugggccaugucca

SEQ ID NO: 1691648 - RNA, 14 nt, Homo sapiens
gggcauccauacca

SEQ ID NO: 1691649 - RNA, 21 nt, Homo sapiens
gggcaugccuugugcuguuaa

SEQ ID NO: 1691650 - RNA, 12 nt, Homo sapiens
gggccaccagcc

SEQ ID NO: 1691651 - RNA, 15 nt, Homo sapiens
gggccgaauccccuc

SEQ ID NO: 1691652 - RNA, 16 nt, Homo sapiens
gggccucgggaccuca

SEQ ID NO: 1691653 - RNA, 20 nt, Homo sapiens
gggccucuucugccucuuaa

SEQ ID NO: 1691654 - RNA, 14 nt, Homo sapiens
gggccuggaccugc

SEQ ID NO: 1691655 - RNA, 18 nt, Homo sapiens
gggccuggccaccucucu

SEQ ID NO: 1691656 - RNA, 22 nt, Homo sapiens
gggcucuuccaacaaggaagaa

SEQ ID NO: 1691657 - RNA, 18 nt, Homo sapiens
ggggaacugcguggugcu

SEQ ID NO: 1691658 - RNA, 18 nt, Homo sapiens
ggggcaggcugggccaug

SEQ ID NO: 1691659 - RNA, 13 nt, Homo sapiens
ggggccuccagaa

SEQ ID NO: 1691660 - RNA, 11 nt, Homo sapiens
ggggugcugcc

SEQ ID NO: 1691661 - RNA, 17 nt, Homo sapiens
gggguuucuggggucca

SEQ ID NO: 1691662 - RNA, 16 nt, Homo sapiens
ggguaccaaugcugca

SEQ ID NO: 1691663 - RNA, 13 nt, Homo sapiens
ggguagaucucaa

SEQ ID NO: 1691664 - RNA, 15 nt, Homo sapiens
ggguauuuuggucac

SEQ ID NO: 1691665 - RNA, 13 nt, Homo sapiens
gggucaacaucuu

SEQ ID NO: 1691666 - RNA, 15 nt, Homo sapiens
ggguccccaccuggg

SEQ ID NO: 1691667 - RNA, 16 nt, Homo sapiens
gggucccuucaccucc

SEQ ID NO: 1691668 - RNA, 13 nt, Homo sapiens
gggucgucugccc

SEQ ID NO: 1691669 - RNA, 20 nt, Homo sapiens
gggucucacaguguugccca

SEQ ID NO: 1691670 - RNA, 20 nt, Homo sapiens
gggucucacuauguugccca

SEQ ID NO: 1691671 - RNA, 20 nt, Homo sapiens
gggucucgcuuuguugccca

SEQ ID NO: 1691672 - RNA, 22 nt, Homo sapiens
gggugagcuccagcugcugcgc

SEQ ID NO: 1691673 - RNA, 11 nt, Homo sapiens
gggugcagcug

SEQ ID NO: 1691674 - RNA, 14 nt, Homo sapiens
gggugugucugcuc

SEQ ID NO: 1691675 - RNA, 14 nt, Homo sapiens
ggguuacuuucaca

SEQ ID NO: 1691676 - RNA, 18 nt, Homo sapiens
ggguuauguaucagaaga

SEQ ID NO: 1691677 - RNA, 20 nt, Homo sapiens
ggguucaugaugcagucucc

SEQ ID NO: 1691678 - RNA, 21 nt, Homo sapiens
ggguucuuggugaugcuggca

SEQ ID NO: 1691679 - RNA, 14 nt, Homo sapiens
ggguugauccugca

SEQ ID NO: 1691680 - RNA, 15 nt, Homo sapiens
gguaagggggugcag

SEQ ID NO: 1691681 - RNA, 21 nt, Homo sapiens
gguacuauuuagauauaacac

SEQ ID NO: 1691682 - RNA, 20 nt, Homo sapiens
gguacuucaggggcacuuca

SEQ ID NO: 1691683 - RNA, 20 nt, Homo sapiens
gguagaaaaggcuagguaca

SEQ ID NO: 1691684 - RNA, 20 nt, Homo sapiens
gguaucuguuuaacauuucc

SEQ ID NO: 1691685 - RNA, 23 nt, Homo sapiens
gguaugaucacggcucacugcag

SEQ ID NO: 1691686 - RNA, 11 nt, Homo sapiens
ggucacagcua

SEQ ID NO: 1691687 - RNA, 17 nt, Homo sapiens
ggucaccccuccaggaa

SEQ ID NO: 1691688 - RNA, 21 nt, Homo sapiens
ggucaggcccuggugcgaaug

SEQ ID NO: 1691689 - RNA, 14 nt, Homo sapiens
ggucauacaugcau

SEQ ID NO: 1691690 - RNA, 16 nt, Homo sapiens
ggucauccugccccug

SEQ ID NO: 1691691 - RNA, 21 nt, Homo sapiens
ggucucauuuagaacuugcag

SEQ ID NO: 1691692 - RNA, 21 nt, Homo sapiens
ggucugacaugaacacuuuuu

SEQ ID NO: 1691693 - RNA, 20 nt, Homo sapiens
ggucuuugcaagaaucauua

SEQ ID NO: 1691694 - RNA, 18 nt, Homo sapiens
ggucuuuguaucuuccau

SEQ ID NO: 1691695 - RNA, 18 nt, Homo sapiens
ggugaaaaccccaucucu

SEQ ID NO: 1691696 - RNA, 17 nt, Homo sapiens
ggugaaaauccaucuca

SEQ ID NO: 1691697 - RNA, 15 nt, Homo sapiens
ggugcaugaugcugc

SEQ ID NO: 1691698 - RNA, 16 nt, Homo sapiens
ggugcaugaugcugcc

SEQ ID NO: 1691699 - RNA, 16 nt, Homo sapiens
gguggaaggcagacag

SEQ ID NO: 1691700 - RNA, 20 nt, Homo sapiens
gguggaggguggggggcgcu

SEQ ID NO: 1691701 - RNA, 21 nt, Homo sapiens
gguggaugccugguggcagcu

SEQ ID NO: 1691702 - RNA, 11 nt, Homo sapiens
ggugggguccu

SEQ ID NO: 1691703 - RNA, 16 nt, Homo sapiens
gguguauguaugagua

SEQ ID NO: 1691704 - RNA, 19 nt, Homo sapiens
ggugugcugagguguuaga

SEQ ID NO: 1691705 - RNA, 21 nt, Homo sapiens
gguucaauuucagaaguaaug

SEQ ID NO: 1691706 - RNA, 20 nt, Homo sapiens
gguuggggccgggcacauug

SEQ ID NO: 1691707 - RNA, 21 nt, Homo sapiens
gguuucacccuuaacccaagg

SEQ ID NO: 1691708 - RNA, 13 nt, Homo sapiens
gguuucuugcaag

SEQ ID NO: 1691709 - RNA, 22 nt, Homo sapiens
gguuugagaauguuuuuagcug

SEQ ID NO: 1691710 - RNA, 23 nt, Homo sapiens
gguuugucgggcaccagccagcg

SEQ ID NO: 1691711 - RNA, 23 nt, Homo sapiens
gguuuuagacgaggccacagcug

SEQ ID NO: 1691712 - RNA, 20 nt, Homo sapiens
guaaagccuuaaguggcaga

SEQ ID NO: 1691713 - RNA, 21 nt, Homo sapiens
guaaaucauucuacuuuugca

SEQ ID NO: 1691714 - RNA, 20 nt, Homo sapiens
guaaaugcuagguuaauucc

SEQ ID NO: 1691715 - RNA, 15 nt, Homo sapiens
guaaauguccugcua

SEQ ID NO: 1691716 - RNA, 18 nt, Homo sapiens
guaacaacuguggucaau

SEQ ID NO: 1691717 - RNA, 18 nt, Homo sapiens
guaacuauagacuggaaa

SEQ ID NO: 1691718 - RNA, 14 nt, Homo sapiens
guaagacucauucc

SEQ ID NO: 1691719 - RNA, 15 nt, Homo sapiens
guaagugcugcuaua

SEQ ID NO: 1691720 - RNA, 19 nt, Homo sapiens
guaaguuucaggugacaug

SEQ ID NO: 1691721 - RNA, 17 nt, Homo sapiens
guaaucccagcuacuca

SEQ ID NO: 1691722 - RNA, 24 nt, Homo sapiens
guaaucccccaggagaacaucuuu

SEQ ID NO: 1691723 - RNA, 16 nt, Homo sapiens
guaaucuguacauuuu

SEQ ID NO: 1691724 - RNA, 13 nt, Homo sapiens
guacaaugacacu

SEQ ID NO: 1691725 - RNA, 20 nt, Homo sapiens
guacaaugacacuuuuugca

SEQ ID NO: 1691726 - RNA, 19 nt, Homo sapiens
guacacacugguacuuaga

SEQ ID NO: 1691727 - RNA, 17 nt, Homo sapiens
guacacguguccuguag

SEQ ID NO: 1691728 - RNA, 21 nt, Homo sapiens
guacaguucugggguacaugu

SEQ ID NO: 1691729 - RNA, 23 nt, Homo sapiens
guacaguucugggguacauguua

SEQ ID NO: 1691730 - RNA, 12 nt, Homo sapiens
guacaucuggcc

SEQ ID NO: 1691731 - RNA, 11 nt, Homo sapiens
guacaugagaa

SEQ ID NO: 1691732 - RNA, 10 nt, Homo sapiens
guacauguau

SEQ ID NO: 1691733 - RNA, 22 nt, Homo sapiens
guacauucaauguuuaugcaag

SEQ ID NO: 1691734 - RNA, 14 nt, Homo sapiens
guacccagugccua

SEQ ID NO: 1691735 - RNA, 14 nt, Homo sapiens
guacccucucagcu

SEQ ID NO: 1691736 - RNA, 21 nt, Homo sapiens
guacccuuucaaacuauuuau

SEQ ID NO: 1691737 - RNA, 18 nt, Homo sapiens
guaccugaaagcacugua

SEQ ID NO: 1691738 - RNA, 17 nt, Homo sapiens
guaccugcuggcacuau

SEQ ID NO: 1691739 - RNA, 20 nt, Homo sapiens
guaccugguggauaucuagc

SEQ ID NO: 1691740 - RNA, 18 nt, Homo sapiens
guacguaacuauuuccaa

SEQ ID NO: 1691741 - RNA, 14 nt, Homo sapiens
guacucaauggagu

SEQ ID NO: 1691742 - RNA, 16 nt, Homo sapiens
guacucagcgaaugaa

SEQ ID NO: 1691743 - RNA, 21 nt, Homo sapiens
guacucuggggugcugccuga

SEQ ID NO: 1691744 - RNA, 22 nt, Homo sapiens
guacucuuaucugggugccuua

SEQ ID NO: 1691745 - RNA, 13 nt, Homo sapiens
guacuguacuaau

SEQ ID NO: 1691746 - RNA, 14 nt, Homo sapiens
guagaaagccaaau

SEQ ID NO: 1691747 - RNA, 19 nt, Homo sapiens
uaauguauuuguuugcaau

SEQ ID NO: 1691748 - RNA, 22 nt, Homo sapiens
uaaugucauagguaagaaacac

SEQ ID NO: 1691749 - RNA, 19 nt, Homo sapiens
uaaugugugguggccucag

SEQ ID NO: 1691750 - RNA, 22 nt, Homo sapiens
uaauguuguaauucaugccagg

SEQ ID NO: 1691751 - RNA, 22 nt, Homo sapiens
uaauuagcauggccccagucca

SEQ ID NO: 1691752 - RNA, 19 nt, Homo sapiens
uaauucaagaaaacaacuu

SEQ ID NO: 1691753 - RNA, 20 nt, Homo sapiens
uaauucacucaagcacugau

SEQ ID NO: 1691754 - RNA, 16 nt, Homo sapiens
uaauucauggcauuga

SEQ ID NO: 1691755 - RNA, 14 nt, Homo sapiens
uaauucucuuucaa

SEQ ID NO: 1691756 - RNA, 20 nt, Homo sapiens
uaauucuuacacugccugua

SEQ ID NO: 1691757 - RNA, 20 nt, Homo sapiens
uaauucuuauuuaaguuauu

SEQ ID NO: 1691758 - RNA, 20 nt, Homo sapiens
uaauugcuuuuucacaguca

SEQ ID NO: 1691759 - RNA, 17 nt, Homo sapiens
uaauuuaaacaccuccu

SEQ ID NO: 1691760 - RNA, 18 nt, Homo sapiens
uaauuugaaaacauaauc

SEQ ID NO: 1691761 - RNA, 23 nt, Homo sapiens
uaauuuuguuuauauuuucccau

SEQ ID NO: 1691762 - RNA, 17 nt, Homo sapiens
uaauuuuugaaaacugg

SEQ ID NO: 1691763 - RNA, 16 nt, Homo sapiens
uacaaaccuaccaaaa

SEQ ID NO: 1691764 - RNA, 21 nt, Homo sapiens
uacaaagucagggcguucaua

SEQ ID NO: 1691765 - RNA, 16 nt, Homo sapiens
uacaaccucccucuug

SEQ ID NO: 1691766 - RNA, 20 nt, Homo sapiens
uacaacugcaccugucauca

SEQ ID NO: 1691767 - RNA, 14 nt, Homo sapiens
uacaagaaagcaau

SEQ ID NO: 1691768 - RNA, 14 nt, Homo sapiens
uacaaggcuuuauc

SEQ ID NO: 1691769 - RNA, 19 nt, Homo sapiens
uacaaggcuuuaucucagg

SEQ ID NO: 1691770 - RNA, 20 nt, Homo sapiens
uacaaucagccacauucuag

SEQ ID NO: 1691771 - RNA, 21 nt, Homo sapiens
uacacacacacgcgugcacac

SEQ ID NO: 1691772 - RNA, 18 nt, Homo sapiens
uacacauacaggauuuga

SEQ ID NO: 1691773 - RNA, 17 nt, Homo sapiens
uacacauuagauuuuau

SEQ ID NO: 1691774 - RNA, 22 nt, Homo sapiens
uacaccaaugcccaacugccug

SEQ ID NO: 1691775 - RNA, 15 nt, Homo sapiens
uacacguguccugua

SEQ ID NO: 1691776 - RNA, 23 nt, Homo sapiens
uacacuaagcgaauguguacaaa

SEQ ID NO: 1691777 - RNA, 16 nt, Homo sapiens
uacacugacuugagac

SEQ ID NO: 1691778 - RNA, 13 nt, Homo sapiens
uacacugccaucu

SEQ ID NO: 1691779 - RNA, 19 nt, Homo sapiens
uacacuggguucugcuacu

SEQ ID NO: 1691780 - RNA, 20 nt, Homo sapiens
uacacuuauuuuacuaguuu

SEQ ID NO: 1691781 - RNA, 13 nt, Homo sapiens
uacagacauacau

SEQ ID NO: 1691782 - RNA, 23 nt, Homo sapiens
uacagaccugcuuuuugaaauga

SEQ ID NO: 1691783 - RNA, 18 nt, Homo sapiens
uacagagccgagcaauau

SEQ ID NO: 1691784 - RNA, 21 nt, Homo sapiens
uacagauagaaaauaugauau

SEQ ID NO: 1691785 - RNA, 16 nt, Homo sapiens
uacagcaggugcucaa

SEQ ID NO: 1691786 - RNA, 17 nt, Homo sapiens
uacaggaagcaccccau

SEQ ID NO: 1691787 - RNA, 23 nt, Homo sapiens
uacaggaagcaccccaugccaaa

SEQ ID NO: 1691788 - RNA, 15 nt, Homo sapiens
uacaggagugagcac

SEQ ID NO: 1691789 - RNA, 19 nt, Homo sapiens
uacaggccauacuuuacaa

SEQ ID NO: 1691790 - RNA, 20 nt, Homo sapiens
uacaggggcccgccaccaca

SEQ ID NO: 1691791 - RNA, 20 nt, Homo sapiens
uacaggguuuuuaccuguca

SEQ ID NO: 1691792 - RNA, 14 nt, Homo sapiens
uacaggugugaguc

SEQ ID NO: 1691793 - RNA, 18 nt, Homo sapiens
uacaggugugugccacca

SEQ ID NO: 1691794 - RNA, 22 nt, Homo sapiens
uacaguauuguggcugcacuug

SEQ ID NO: 1691795 - RNA, 13 nt, Homo sapiens
uacagugcuauuu

SEQ ID NO: 1691796 - RNA, 20 nt, Homo sapiens
uacaguuaggcaccagaaga

SEQ ID NO: 1691797 - RNA, 20 nt, Homo sapiens
uacaguucugggguacaugu

SEQ ID NO: 1691798 - RNA, 14 nt, Homo sapiens
uacauaacaagaaa

SEQ ID NO: 1691799 - RNA, 22 nt, Homo sapiens
uacauaacuaaauuugauacuu

SEQ ID NO: 1691800 - RNA, 22 nt, Homo sapiens
uacauauguauuauauaaacuu

SEQ ID NO: 1691801 - RNA, 17 nt, Homo sapiens
uacauauuuguggaaua

SEQ ID NO: 1691802 - RNA, 19 nt, Homo sapiens
uacaucacugcuugaugaa

SEQ ID NO: 1691803 - RNA, 17 nt, Homo sapiens
uacaucucuacuaaaaa

SEQ ID NO: 1691804 - RNA, 11 nt, Homo sapiens
uacaucuggcc

SEQ ID NO: 1691805 - RNA, 14 nt, Homo sapiens
uacaucugucaugg

SEQ ID NO: 1691806 - RNA, 21 nt, Homo sapiens
uacaugagaaggaacuuccag

SEQ ID NO: 1691807 - RNA, 11 nt, Homo sapiens
uacaugugauu

SEQ ID NO: 1691808 - RNA, 17 nt, Homo sapiens
uacauugaguagacaca

SEQ ID NO: 1691809 - RNA, 14 nt, Homo sapiens
uacauuguaaauag

SEQ ID NO: 1691810 - RNA, 13 nt, Homo sapiens
uacauuuaugcac

SEQ ID NO: 1691811 - RNA, 23 nt, Homo sapiens
uacauuuuuugggcagcaauuua

SEQ ID NO: 1691812 - RNA, 24 nt, Homo sapiens
uacauuuuuugggcagcaauuuaa

SEQ ID NO: 1691813 - RNA, 22 nt, Homo sapiens
uacauuuuuuucuuugucuuau

SEQ ID NO: 1691814 - RNA, 18 nt, Homo sapiens
uaccaagacaaauucaaa

SEQ ID NO: 1691815 - RNA, 18 nt, Homo sapiens
uaccacuaacuccugaga

SEQ ID NO: 1691816 - RNA, 14 nt, Homo sapiens
uaccacucacauga

SEQ ID NO: 1691817 - RNA, 16 nt, Homo sapiens
uaccagcgcucuaaaa

SEQ ID NO: 1691818 - RNA, 17 nt, Homo sapiens
uaccaucuuguauacac

SEQ ID NO: 1691819 - RNA, 23 nt, Homo sapiens
uaccaucuuguauacacauauau

SEQ ID NO: 1691820 - RNA, 15 nt, Homo sapiens
uaccauuuauuugcu

SEQ ID NO: 1691821 - RNA, 13 nt, Homo sapiens
uacccaaacccua

SEQ ID NO: 1691822 - RNA, 21 nt, Homo sapiens
uaccccuggcuguacugcuca

SEQ ID NO: 1691823 - RNA, 11 nt, Homo sapiens
uacccucucag

SEQ ID NO: 1691824 - RNA, 18 nt, Homo sapiens
uacccugcgauuuugccu

SEQ ID NO: 1691825 - RNA, 18 nt, Homo sapiens
uacccuuuagacuguagc

SEQ ID NO: 1691826 - RNA, 22 nt, Homo sapiens
uaccuauaauguguguaugugu

SEQ ID NO: 1691827 - RNA, 17 nt, Homo sapiens
uaccucaucccaugaga

SEQ ID NO: 1691828 - RNA, 16 nt, Homo sapiens
uaccuguacacugacu

SEQ ID NO: 1691829 - RNA, 22 nt, Homo sapiens
uaccuuccccacaucugagaga

SEQ ID NO: 1691830 - RNA, 14 nt, Homo sapiens
uaccuucuuucacu

SEQ ID NO: 1691831 - RNA, 16 nt, Homo sapiens
uacuaagcauagcaaa

SEQ ID NO: 1691832 - RNA, 15 nt, Homo sapiens
uacuacacugaggag

SEQ ID NO: 1691833 - RNA, 13 nt, Homo sapiens
uacuaccuugaaa

SEQ ID NO: 1691834 - RNA, 22 nt, Homo sapiens
uacuaguuuuaguuuucucuua

SEQ ID NO: 1691835 - RNA, 14 nt, Homo sapiens
uacuaguuuucaau

SEQ ID NO: 1691836 - RNA, 12 nt, Homo sapiens
uacuauaugauu

SEQ ID NO: 1691837 - RNA, 19 nt, Homo sapiens
uacuaucacugaacaaacu

SEQ ID NO: 1691838 - RNA, 15 nt, Homo sapiens
uacuauucaaaaccu

SEQ ID NO: 1691839 - RNA, 16 nt, Homo sapiens
uacuauucaaaaccuc

SEQ ID NO: 1691840 - RNA, 23 nt, Homo sapiens
uacucaaggaauuugcauuuagu

SEQ ID NO: 1691841 - RNA, 13 nt, Homo sapiens
uacucaauggagu

SEQ ID NO: 1691842 - RNA, 14 nt, Homo sapiens
uacucaauggagua

SEQ ID NO: 1691843 - RNA, 13 nt, Homo sapiens
uacucauauuccu

SEQ ID NO: 1691844 - RNA, 15 nt, Homo sapiens
uacuccaagacagag

SEQ ID NO: 1691845 - RNA, 20 nt, Homo sapiens
uacucuuucuaaugcugaua

SEQ ID NO: 1691846 - RNA, 19 nt, Homo sapiens
uacugacuuaggcaauaca

SEQ ID NO: 1691847 - RNA, 17 nt, Homo sapiens
uacugggugucauuuca

SEQ ID NO: 1691848 - RNA, 18 nt, Homo sapiens
uacuggucuuguggaauu

SEQ ID NO: 1691849 - RNA, 16 nt, Homo sapiens
uacuguaauaauaccu

SEQ ID NO: 1691850 - RNA, 13 nt, Homo sapiens
uacuguacaugaa

SEQ ID NO: 1691851 - RNA, 17 nt, Homo sapiens
uacugucucacugaaac

SEQ ID NO: 1691852 - RNA, 17 nt, Homo sapiens
uacugugaaacuggcac

SEQ ID NO: 1691853 - RNA, 19 nt, Homo sapiens
uacugugaaacuggcacug

SEQ ID NO: 1691854 - RNA, 20 nt, Homo sapiens
uacugugucauaaacagaug

SEQ ID NO: 1691855 - RNA, 18 nt, Homo sapiens
uacuguucuaaagcucug

SEQ ID NO: 1691856 - RNA, 14 nt, Homo sapiens
uguugcacacucac

SEQ ID NO: 1691857 - RNA, 19 nt, Homo sapiens
uguugcaccaggcacugcu

SEQ ID NO: 1691858 - RNA, 14 nt, Homo sapiens
uguugccuuuaugg

SEQ ID NO: 1691859 - RNA, 21 nt, Homo sapiens
uguugcuggacugucauagaa

SEQ ID NO: 1691860 - RNA, 18 nt, Homo sapiens
uguuggcaaggagccagg

SEQ ID NO: 1691861 - RNA, 16 nt, Homo sapiens
uguuggcucacagggc

SEQ ID NO: 1691862 - RNA, 19 nt, Homo sapiens
uguuguagugaaauuauac

SEQ ID NO: 1691863 - RNA, 13 nt, Homo sapiens
uguuguaugggga

SEQ ID NO: 1691864 - RNA, 22 nt, Homo sapiens
uguuuauacuccaguguacaua

SEQ ID NO: 1691865 - RNA, 20 nt, Homo sapiens
uguuucaaggcacucuagau

SEQ ID NO: 1691866 - RNA, 14 nt, Homo sapiens
uguuugcauaaagu

SEQ ID NO: 1691867 - RNA, 21 nt, Homo sapiens
uguuuuaaacucuccuaguca

SEQ ID NO: 1691868 - RNA, 14 nt, Homo sapiens
uguuuuaaguacua

SEQ ID NO: 1691869 - RNA, 19 nt, Homo sapiens
uguuuuaaguacuacacau

SEQ ID NO: 1691870 - RNA, 13 nt, Homo sapiens
uguuuuaaguuua

SEQ ID NO: 1691871 - RNA, 22 nt, Homo sapiens
uguuuuaauccuuaacacauuc

SEQ ID NO: 1691872 - RNA, 21 nt, Homo sapiens
uguuuucugacuaauuaggca

SEQ ID NO: 1691873 - RNA, 20 nt, Homo sapiens
uguuuuguaagugcugcuau

SEQ ID NO: 1691874 - RNA, 14 nt, Homo sapiens
uguuuuguauacaa

SEQ ID NO: 1691875 - RNA, 14 nt, Homo sapiens
uguuuuuaaacuaa

SEQ ID NO: 1691876 - RNA, 20 nt, Homo sapiens
uguuuuuccuuuaauccagu

SEQ ID NO: 1691877 - RNA, 13 nt, Homo sapiens
uguuuuuuuccaa

SEQ ID NO: 1691878 - RNA, 19 nt, Homo sapiens
uuaaaaagauguauguucc

SEQ ID NO: 1691879 - RNA, 20 nt, Homo sapiens
uuaaaacaacacucacauuu

SEQ ID NO: 1691880 - RNA, 22 nt, Homo sapiens
uuaaaacaacacucacauuuau

SEQ ID NO: 1691881 - RNA, 22 nt, Homo sapiens
uuaaaauaaugaacacuacaga

SEQ ID NO: 1691882 - RNA, 22 nt, Homo sapiens
uuaaaauauuuaucugauuaag

SEQ ID NO: 1691883 - RNA, 14 nt, Homo sapiens
uuaaaaucaguauu

SEQ ID NO: 1691884 - RNA, 20 nt, Homo sapiens
uuaaaauugcuauguuacua

SEQ ID NO: 1691885 - RNA, 14 nt, Homo sapiens
uuaaacacaaagug

SEQ ID NO: 1691886 - RNA, 11 nt, Homo sapiens
uuaaacacauu

SEQ ID NO: 1691887 - RNA, 21 nt, Homo sapiens
uuaaacagaugaugagaauuu

SEQ ID NO: 1691888 - RNA, 20 nt, Homo sapiens
uuaaacauugugaucauuag

SEQ ID NO: 1691889 - RNA, 22 nt, Homo sapiens
uuaaaccugucuccacugugcc

SEQ ID NO: 1691890 - RNA, 13 nt, Homo sapiens
uuaaacucaggga

SEQ ID NO: 1691891 - RNA, 16 nt, Homo sapiens
uuaaacucagggacag

SEQ ID NO: 1691892 - RNA, 21 nt, Homo sapiens
uuaaacucagggacagagcca

SEQ ID NO: 1691893 - RNA, 15 nt, Homo sapiens
uuaaagagucuagau

SEQ ID NO: 1691894 - RNA, 17 nt, Homo sapiens
uuaaaguguaauaauau

SEQ ID NO: 1691895 - RNA, 15 nt, Homo sapiens
uuaaauaagauucua

SEQ ID NO: 1691896 - RNA, 16 nt, Homo sapiens
uuaaauauagauuaga

SEQ ID NO: 1691897 - RNA, 16 nt, Homo sapiens
uuaaaugaacuugaua

SEQ ID NO: 1691898 - RNA, 14 nt, Homo sapiens
uuaaauguauacua

SEQ ID NO: 1691899 - RNA, 18 nt, Homo sapiens
uuaaauguccguguaaaa

SEQ ID NO: 1691900 - RNA, 19 nt, Homo sapiens
uuaacagagauugaacucc

SEQ ID NO: 1691901 - RNA, 21 nt, Homo sapiens
uuaacagagauugaacuccaa

SEQ ID NO: 1691902 - RNA, 11 nt, Homo sapiens
uuaacaucuca

SEQ ID NO: 1691903 - RNA, 11 nt, Homo sapiens
uuaacaugucg

SEQ ID NO: 1691904 - RNA, 17 nt, Homo sapiens
uuaagacugaaaauaua

SEQ ID NO: 1691905 - RNA, 14 nt, Homo sapiens
uuaagagugaaguc

SEQ ID NO: 1691906 - RNA, 17 nt, Homo sapiens
uuaagagugaagucaug

SEQ ID NO: 1691907 - RNA, 19 nt, Homo sapiens
uuaagauuuuacaaaagag

SEQ ID NO: 1691908 - RNA, 20 nt, Homo sapiens
uuaagcagauggaaugcugu

SEQ ID NO: 1691909 - RNA, 16 nt, Homo sapiens
uuaagcgugucuguau

SEQ ID NO: 1691910 - RNA, 14 nt, Homo sapiens
uuaagcugauccug

SEQ ID NO: 1691911 - RNA, 17 nt, Homo sapiens
uuaagguagaaccucac

SEQ ID NO: 1691912 - RNA, 16 nt, Homo sapiens
uuaagucaccuguaua

SEQ ID NO: 1691913 - RNA, 19 nt, Homo sapiens
uuaauaaagaauuaacaga

SEQ ID NO: 1691914 - RNA, 18 nt, Homo sapiens
uuaauaaagacgauuugu

SEQ ID NO: 1691915 - RNA, 23 nt, Homo sapiens
uuaauaauaaucuaggcaugaag

SEQ ID NO: 1691916 - RNA, 14 nt, Homo sapiens
uuaauauaucccag

SEQ ID NO: 1691917 - RNA, 19 nt, Homo sapiens
uuaauccuuaacacauuca

SEQ ID NO: 1691918 - RNA, 14 nt, Homo sapiens
uuaaugacaaugaa

SEQ ID NO: 1691919 - RNA, 15 nt, Homo sapiens
uuaaugcuucauuca

SEQ ID NO: 1691920 - RNA, 14 nt, Homo sapiens
uuaauggcacugau

SEQ ID NO: 1691921 - RNA, 12 nt, Homo sapiens
uuaaugugauga

SEQ ID NO: 1691922 - RNA, 13 nt, Homo sapiens
uuaauugucaugg

SEQ ID NO: 1691923 - RNA, 20 nt, Homo sapiens
uuacaaucagccacauucua

SEQ ID NO: 1691924 - RNA, 20 nt, Homo sapiens
uuacacccuuucuugacaaa

SEQ ID NO: 1691925 - RNA, 18 nt, Homo sapiens
uuacauaacugccuugaa

SEQ ID NO: 1691926 - RNA, 21 nt, Homo sapiens
uuacauuuuuugggcagcaau

SEQ ID NO: 1691927 - RNA, 19 nt, Homo sapiens
uuaccaacuuucuguaaac

SEQ ID NO: 1691928 - RNA, 17 nt, Homo sapiens
uuaccagaagcuuccau

SEQ ID NO: 1691929 - RNA, 14 nt, Homo sapiens
uuaccagcaagaau

SEQ ID NO: 1691930 - RNA, 20 nt, Homo sapiens
uuaccgccugucucuuuaag

SEQ ID NO: 1691931 - RNA, 21 nt, Homo sapiens
uuaccugucacauugcauucu

SEQ ID NO: 1691932 - RNA, 19 nt, Homo sapiens
uuacuaugacugcucccca

SEQ ID NO: 1691933 - RNA, 16 nt, Homo sapiens
uuacuauucauuaaau

SEQ ID NO: 1691934 - RNA, 17 nt, Homo sapiens
uuacuggacauaacauu

SEQ ID NO: 1691935 - RNA, 17 nt, Homo sapiens
uuacugugaaacuggca

SEQ ID NO: 1691936 - RNA, 23 nt, Homo sapiens
uuacugugaaacuggcacugaau

SEQ ID NO: 1691937 - RNA, 14 nt, Homo sapiens
uuacuuugaauuua

SEQ ID NO: 1691938 - RNA, 17 nt, Homo sapiens
uuagaaaauagagcuuu

SEQ ID NO: 1691939 - RNA, 22 nt, Homo sapiens
uuagaaacuccaaugaaagaca

SEQ ID NO: 1691940 - RNA, 19 nt, Homo sapiens
uuagaagauagaugcacuu

SEQ ID NO: 1691941 - RNA, 13 nt, Homo sapiens
uuagacauaacaa

SEQ ID NO: 1691942 - RNA, 14 nt, Homo sapiens
uuagacauaacaaa

SEQ ID NO: 1691943 - RNA, 21 nt, Homo sapiens
uuagacccgcccuccccuuuu

SEQ ID NO: 1691944 - RNA, 20 nt, Homo sapiens
uuagaugaggaaaugauccc

SEQ ID NO: 1691945 - RNA, 22 nt, Homo sapiens
uuagauucucugugucuaagau

SEQ ID NO: 1691946 - RNA, 20 nt, Homo sapiens
uuagcugguggcaauaaaua

SEQ ID NO: 1691947 - RNA, 12 nt, Homo sapiens
uuagcuuuacaa

SEQ ID NO: 1691948 - RNA, 23 nt, Homo sapiens
uuagcuuuguguuugguuuacau

SEQ ID NO: 1691949 - RNA, 20 nt, Homo sapiens
uuaggcaggaucuguacaau

SEQ ID NO: 1691950 - RNA, 16 nt, Homo sapiens
uuagucucaagggcua

SEQ ID NO: 1691951 - RNA, 21 nt, Homo sapiens
uuauaagugaagugauacuau

SEQ ID NO: 1691952 - RNA, 19 nt, Homo sapiens
uuauacaaaauaagaacga

SEQ ID NO: 1691953 - RNA, 15 nt, Homo sapiens
uuauagaaguagcaa

SEQ ID NO: 1691954 - RNA, 20 nt, Homo sapiens
uuauagaaguagcaaaaagu

SEQ ID NO: 1691955 - RNA, 13 nt, Homo sapiens
uuauagauucuaa

SEQ ID NO: 1691956 - RNA, 16 nt, Homo sapiens
uuauauggaugauuca

SEQ ID NO: 1691957 - RNA, 19 nt, Homo sapiens
uuaucacacuucugugaga

SEQ ID NO: 1691958 - RNA, 18 nt, Homo sapiens
uuaucacuucauucacau

SEQ ID NO: 1691959 - RNA, 20 nt, Homo sapiens
uuaucacuucauucacauuc

SEQ ID NO: 1691960 - RNA, 21 nt, Homo sapiens
uuaucacuuuuugaacuaaga

SEQ ID NO: 1691961 - RNA, 18 nt, Homo sapiens
uuaucuagagaauacaaa

SEQ ID NO: 1691962 - RNA, 21 nt, Homo sapiens
uuaucuauagcuaaguacaca

SEQ ID NO: 1691963 - RNA, 16 nt, Homo sapiens
uuaucuaucaacuaua

SEQ ID NO: 1691964 - RNA, 21 nt, Homo sapiens
uuaucuggcccucgacacuca

SEQ ID NO: 1691965 - RNA, 17 nt, Homo sapiens
uuaucugucucuucuac

SEQ ID NO: 1691966 - RNA, 18 nt, Homo sapiens
aaauuccucuuacuguaa

SEQ ID NO: 1691967 - RNA, 15 nt, Homo sapiens
aaauuuaaugcugcc

SEQ ID NO: 1691968 - RNA, 19 nt, Homo sapiens
aaauuucaaaagacauguu

SEQ ID NO: 1691969 - RNA, 16 nt, Homo sapiens
aaauuucuagccugca

SEQ ID NO: 1691970 - RNA, 17 nt, Homo sapiens
aaauuuggggacagauu

SEQ ID NO: 1691971 - RNA, 15 nt, Homo sapiens
aacaaaaaaaccaca

SEQ ID NO: 1691972 - RNA, 23 nt, Homo sapiens
aacaaacuggcugcuuuguucaa

SEQ ID NO: 1691973 - RNA, 12 nt, Homo sapiens
aacaaaguaaua

SEQ ID NO: 1691974 - RNA, 13 nt, Homo sapiens
aacaaauaugcaa

SEQ ID NO: 1691975 - RNA, 15 nt, Homo sapiens
aacaaccuggucaca

SEQ ID NO: 1691976 - RNA, 20 nt, Homo sapiens
aacaacguugacaaguuuug

SEQ ID NO: 1691977 - RNA, 13 nt, Homo sapiens
aacaauagcacaa

SEQ ID NO: 1691978 - RNA, 15 nt, Homo sapiens
aacaaugaagauaaa

SEQ ID NO: 1691979 - RNA, 20 nt, Homo sapiens
aacaaugcugauuuggugac

SEQ ID NO: 1691980 - RNA, 16 nt, Homo sapiens
aacaauuacuggcuca

SEQ ID NO: 1691981 - RNA, 22 nt, Homo sapiens
aacacaaaccacaacugacaca

SEQ ID NO: 1691982 - RNA, 23 nt, Homo sapiens
aacacagagaagcggauuuccag

SEQ ID NO: 1691983 - RNA, 23 nt, Homo sapiens
aacacagcuuacaaucgcaaauc

SEQ ID NO: 1691984 - RNA, 16 nt, Homo sapiens
aacacaugaacauuga

SEQ ID NO: 1691985 - RNA, 20 nt, Homo sapiens
aacacauugccuaacuacua

SEQ ID NO: 1691986 - RNA, 21 nt, Homo sapiens
aacaccacgguagugccugaa

SEQ ID NO: 1691987 - RNA, 20 nt, Homo sapiens
aacaccacuaauuguguaca

SEQ ID NO: 1691988 - RNA, 13 nt, Homo sapiens
aacaccuccucau

SEQ ID NO: 1691989 - RNA, 17 nt, Homo sapiens
aacacucaguuguucaa

SEQ ID NO: 1691990 - RNA, 11 nt, Homo sapiens
aacacuggcau

SEQ ID NO: 1691991 - RNA, 18 nt, Homo sapiens
aacacuggugugaccuga

SEQ ID NO: 1691992 - RNA, 18 nt, Homo sapiens
aacagaacaucauuagaa

SEQ ID NO: 1691993 - RNA, 14 nt, Homo sapiens
aacagaagcaguug

SEQ ID NO: 1691994 - RNA, 16 nt, Homo sapiens
aacagaagcauuugua

SEQ ID NO: 1691995 - RNA, 20 nt, Homo sapiens
aacagacaagugacuguauc

SEQ ID NO: 1691996 - RNA, 15 nt, Homo sapiens
aacagacuggcucca

SEQ ID NO: 1691997 - RNA, 21 nt, Homo sapiens
aacagccuaucuuugugugac

SEQ ID NO: 1691998 - RNA, 22 nt, Homo sapiens
aacagcguguucuaaguauuug

SEQ ID NO: 1691999 - RNA, 16 nt, Homo sapiens
aacagcugcauuagaa

SEQ ID NO: 1692000 - RNA, 12 nt, Homo sapiens
aacaggcauuug

SEQ ID NO: 1692001 - RNA, 13 nt, Homo sapiens
aacaguaucuuug

SEQ ID NO: 1692002 - RNA, 18 nt, Homo sapiens
aacaguaucuuugcacuc

SEQ ID NO: 1692003 - RNA, 13 nt, Homo sapiens
aacaguugugaac

SEQ ID NO: 1692004 - RNA, 16 nt, Homo sapiens
aacaguuuuugcuaau

SEQ ID NO: 1692005 - RNA, 21 nt, Homo sapiens
aacauaaauuucuuuaaucau

SEQ ID NO: 1692006 - RNA, 15 nt, Homo sapiens
aacauaaucuaguuu

SEQ ID NO: 1692007 - RNA, 17 nt, Homo sapiens
aacauagcaucucagga

SEQ ID NO: 1692008 - RNA, 16 nt, Homo sapiens
aacaucucaauaacaa

SEQ ID NO: 1692009 - RNA, 19 nt, Homo sapiens
aacaucuuaagauccacaa

SEQ ID NO: 1692010 - RNA, 17 nt, Homo sapiens
aacaucuuuuacauucu

SEQ ID NO: 1692011 - RNA, 14 nt, Homo sapiens
aacauuaugccuua

SEQ ID NO: 1692012 - RNA, 18 nt, Homo sapiens
aacauuauuuauucagcu

SEQ ID NO: 1692013 - RNA, 18 nt, Homo sapiens
aacauugauuauaagcau

SEQ ID NO: 1692014 - RNA, 13 nt, Homo sapiens
aacauugugauca

SEQ ID NO: 1692015 - RNA, 18 nt, Homo sapiens
aacauuucuguaaauacc

SEQ ID NO: 1692016 - RNA, 20 nt, Homo sapiens
aacauuuuguucuuacacau

SEQ ID NO: 1692017 - RNA, 19 nt, Homo sapiens
aaccaaguggcucccacac

SEQ ID NO: 1692018 - RNA, 22 nt, Homo sapiens
aaccacaaagcacaguuugaac

SEQ ID NO: 1692019 - RNA, 13 nt, Homo sapiens
aaccagacuucuc

SEQ ID NO: 1692020 - RNA, 14 nt, Homo sapiens
aaccagccaggcag

SEQ ID NO: 1692021 - RNA, 18 nt, Homo sapiens
aaccaucacccccaggac

SEQ ID NO: 1692022 - RNA, 20 nt, Homo sapiens
aaccauccauaguaguauga

SEQ ID NO: 1692023 - RNA, 12 nt, Homo sapiens
aaccauuugcac

SEQ ID NO: 1692024 - RNA, 21 nt, Homo sapiens
aacccacugaaccuucugagc

SEQ ID NO: 1692025 - RNA, 14 nt, Homo sapiens
aaccccaucucuac

SEQ ID NO: 1692026 - RNA, 15 nt, Homo sapiens
aaccccauguccuca

SEQ ID NO: 1692027 - RNA, 18 nt, Homo sapiens
aacccucuggggagcuca

SEQ ID NO: 1692028 - RNA, 12 nt, Homo sapiens
aacccugucuga

SEQ ID NO: 1692029 - RNA, 14 nt, Homo sapiens
aacccuugcuugca

SEQ ID NO: 1692030 - RNA, 20 nt, Homo sapiens
aaccgacacuccuacaagau

SEQ ID NO: 1692031 - RNA, 14 nt, Homo sapiens
aaccgagcaauuuu

SEQ ID NO: 1692032 - RNA, 16 nt, Homo sapiens
aaccgcacaugcacac

SEQ ID NO: 1692033 - RNA, 23 nt, Homo sapiens
aaccuaguacugccccccaugag

SEQ ID NO: 1692034 - RNA, 13 nt, Homo sapiens
aaccucaaaaugu

SEQ ID NO: 1692035 - RNA, 16 nt, Homo sapiens
aaccucauugcagcua

SEQ ID NO: 1692036 - RNA, 23 nt, Homo sapiens
aaccucauuuuaguugccuaagc

SEQ ID NO: 1692037 - RNA, 15 nt, Homo sapiens
aaccucccucuuguu

SEQ ID NO: 1692038 - RNA, 15 nt, Homo sapiens
aaccuccuguggaac

SEQ ID NO: 1692039 - RNA, 21 nt, Homo sapiens
aaccugcagggacuccaugcu

SEQ ID NO: 1692040 - RNA, 15 nt, Homo sapiens
aaccugcaucuuuag

SEQ ID NO: 1692041 - RNA, 13 nt, Homo sapiens
aaccugcucuccu

SEQ ID NO: 1692042 - RNA, 18 nt, Homo sapiens
aaccugucuccacugugc

SEQ ID NO: 1692043 - RNA, 13 nt, Homo sapiens
aaccugugaagcu

SEQ ID NO: 1692044 - RNA, 16 nt, Homo sapiens
aaccugugaagcugaa

SEQ ID NO: 1692045 - RNA, 19 nt, Homo sapiens
aaccugugaagcugaaaag

SEQ ID NO: 1692046 - RNA, 17 nt, Homo sapiens
aaccuguugcuguguuu

SEQ ID NO: 1692047 - RNA, 20 nt, Homo sapiens
aaccuugaaugcugccagug

SEQ ID NO: 1692048 - RNA, 16 nt, Homo sapiens
aaccuuucaaauuuca

SEQ ID NO: 1692049 - RNA, 23 nt, Homo sapiens
aaccuuuuuuaagauuuuucuca

SEQ ID NO: 1692050 - RNA, 19 nt, Homo sapiens
aacgauuuuaugaaaugac

SEQ ID NO: 1692051 - RNA, 23 nt, Homo sapiens
aacgauuuuaugaaaugaccucu

SEQ ID NO: 1692052 - RNA, 12 nt, Homo sapiens
aacgcacaggaa

SEQ ID NO: 1692053 - RNA, 14 nt, Homo sapiens
aacguaaauacaca

SEQ ID NO: 1692054 - RNA, 21 nt, Homo sapiens
aacguagcuucuaccaugaac

SEQ ID NO: 1692055 - RNA, 15 nt, Homo sapiens
aacguugacaaguuu

SEQ ID NO: 1692056 - RNA, 12 nt, Homo sapiens
aacuaaugauaa

SEQ ID NO: 1692057 - RNA, 20 nt, Homo sapiens
aacuagacauuaccaaagug

SEQ ID NO: 1692058 - RNA, 15 nt, Homo sapiens
aacuaggcucagaga

SEQ ID NO: 1692059 - RNA, 19 nt, Homo sapiens
aacuauaaauauguacaau

SEQ ID NO: 1692060 - RNA, 21 nt, Homo sapiens
aacuauacauuuauuguuacg

SEQ ID NO: 1692061 - RNA, 16 nt, Homo sapiens
aacuauuguuaauucu

SEQ ID NO: 1692062 - RNA, 15 nt, Homo sapiens
aacucaagacaaugc

SEQ ID NO: 1692063 - RNA, 16 nt, Homo sapiens
aacucacaagugcuca

SEQ ID NO: 1692064 - RNA, 20 nt, Homo sapiens
aacucaccagccccacugcc

SEQ ID NO: 1692065 - RNA, 13 nt, Homo sapiens
aacucagcugucu

SEQ ID NO: 1692066 - RNA, 22 nt, Homo sapiens
aacucaguccuguacucugggg

SEQ ID NO: 1692067 - RNA, 13 nt, Homo sapiens
aacuccaaugaaa

SEQ ID NO: 1692068 - RNA, 15 nt, Homo sapiens
aacucccucugggaa

SEQ ID NO: 1692069 - RNA, 21 nt, Homo sapiens
aacucuccaucuuauuuucau

SEQ ID NO: 1692070 - RNA, 18 nt, Homo sapiens
aacucugacaagggcuga

SEQ ID NO: 1692071 - RNA, 14 nt, Homo sapiens
aacugaacucacuu

SEQ ID NO: 1692072 - RNA, 18 nt, Homo sapiens
aacugacugccuugcuaa

SEQ ID NO: 1692073 - RNA, 23 nt, Homo sapiens
aacugacugccuugcuaaaagau

SEQ ID NO: 1692074 - RNA, 19 nt, Homo sapiens
aacugaguguuauuugcac

SEQ ID NO: 1692075 - RNA, 18 nt, Homo sapiens
aacugauuuuuagcuuua

SEQ ID NO: 1692076 - RNA, 11 nt, Homo sapiens
aauuguugcua

SEQ ID NO: 1692077 - RNA, 19 nt, Homo sapiens
aauuuaaacuuguuuacaa

SEQ ID NO: 1692078 - RNA, 15 nt, Homo sapiens
aauuuaacugcuuaa

SEQ ID NO: 1692079 - RNA, 14 nt, Homo sapiens
aauuuacacugcca

SEQ ID NO: 1692080 - RNA, 12 nt, Homo sapiens
aauuuacuugau

SEQ ID NO: 1692081 - RNA, 12 nt, Homo sapiens
aauuuagucauu

SEQ ID NO: 1692082 - RNA, 22 nt, Homo sapiens
aauuuauaguuaaggcuaaaaa

SEQ ID NO: 1692083 - RNA, 18 nt, Homo sapiens
aauuuaucaaagcauaga

SEQ ID NO: 1692084 - RNA, 13 nt, Homo sapiens
aauuucgagauuu

SEQ ID NO: 1692085 - RNA, 22 nt, Homo sapiens
aauuucuagccugcacuuugau

SEQ ID NO: 1692086 - RNA, 21 nt, Homo sapiens
aauuucugucagaaugcuauu

SEQ ID NO: 1692087 - RNA, 21 nt, Homo sapiens
aauuugauguuuacaggugga

SEQ ID NO: 1692088 - RNA, 17 nt, Homo sapiens
aauuugcuagcaguaaa

SEQ ID NO: 1692089 - RNA, 20 nt, Homo sapiens
aauuuuauaacagaauuaaa

SEQ ID NO: 1692090 - RNA, 16 nt, Homo sapiens
aauuuucaauuugaga

SEQ ID NO: 1692091 - RNA, 13 nt, Homo sapiens
aauuuucauucau

SEQ ID NO: 1692092 - RNA, 18 nt, Homo sapiens
aauuuucauucauucacu

SEQ ID NO: 1692093 - RNA, 16 nt, Homo sapiens
aauuuucugaaaguua

SEQ ID NO: 1692094 - RNA, 15 nt, Homo sapiens
aauuuuuacugagaa

SEQ ID NO: 1692095 - RNA, 21 nt, Homo sapiens
aauuuuugaaaaaaguacaua

SEQ ID NO: 1692096 - RNA, 16 nt, Homo sapiens
acaaaaccuaacuugc

SEQ ID NO: 1692097 - RNA, 11 nt, Homo sapiens
acaaaacuaca

SEQ ID NO: 1692098 - RNA, 23 nt, Homo sapiens
acaaaauuuuauuuugugcucau

SEQ ID NO: 1692099 - RNA, 15 nt, Homo sapiens
acaaaccuaccaaaa

SEQ ID NO: 1692100 - RNA, 16 nt, Homo sapiens
acaaaccuaccaaaau

SEQ ID NO: 1692101 - RNA, 23 nt, Homo sapiens
acaaacuggcugcuuuguucaau

SEQ ID NO: 1692102 - RNA, 21 nt, Homo sapiens
acaaagaauuuaaaauaacac

SEQ ID NO: 1692103 - RNA, 15 nt, Homo sapiens
acaaagcacuagaga

SEQ ID NO: 1692104 - RNA, 18 nt, Homo sapiens
acaaaggacagaguauga

SEQ ID NO: 1692105 - RNA, 13 nt, Homo sapiens
acaaaguguauac

SEQ ID NO: 1692106 - RNA, 19 nt, Homo sapiens
acaaauagugcaacuauga

SEQ ID NO: 1692107 - RNA, 15 nt, Homo sapiens
acaaauaugucaguu

SEQ ID NO: 1692108 - RNA, 23 nt, Homo sapiens
acaaaucaacagaagcauuugua

SEQ ID NO: 1692109 - RNA, 14 nt, Homo sapiens
acaaaugaugccau

SEQ ID NO: 1692110 - RNA, 17 nt, Homo sapiens
acaaaugcacgucacag

SEQ ID NO: 1692111 - RNA, 22 nt, Homo sapiens
acaaaugucuaucaacuuuaau

SEQ ID NO: 1692112 - RNA, 14 nt, Homo sapiens
acaacauuugcaga

SEQ ID NO: 1692113 - RNA, 17 nt, Homo sapiens
acaacgccugucacaga

SEQ ID NO: 1692114 - RNA, 16 nt, Homo sapiens
acaacuauuuuuccaa

SEQ ID NO: 1692115 - RNA, 23 nt, Homo sapiens
acaacugccggggguucaggguu

SEQ ID NO: 1692116 - RNA, 12 nt, Homo sapiens
acaacugugacu

SEQ ID NO: 1692117 - RNA, 13 nt, Homo sapiens
acaacugugacug

SEQ ID NO: 1692118 - RNA, 12 nt, Homo sapiens
acaacugugguc

SEQ ID NO: 1692119 - RNA, 17 nt, Homo sapiens
acaacuuaguguaauau

SEQ ID NO: 1692120 - RNA, 15 nt, Homo sapiens
acaagaccaccacuu

SEQ ID NO: 1692121 - RNA, 17 nt, Homo sapiens
acaagaccccgucucaa

SEQ ID NO: 1692122 - RNA, 12 nt, Homo sapiens
acaagauuagaa

SEQ ID NO: 1692123 - RNA, 19 nt, Homo sapiens
acaagccacaagucuucca

SEQ ID NO: 1692124 - RNA, 23 nt, Homo sapiens
acaagcccacagcacagcucccu

SEQ ID NO: 1692125 - RNA, 14 nt, Homo sapiens
acaaggaaauaccc

SEQ ID NO: 1692126 - RNA, 15 nt, Homo sapiens
acaaggaaauacccu

SEQ ID NO: 1692127 - RNA, 16 nt, Homo sapiens
acaaggaugacaagaa

SEQ ID NO: 1692128 - RNA, 14 nt, Homo sapiens
acaauaaaccuccg

SEQ ID NO: 1692129 - RNA, 23 nt, Homo sapiens
acaauaaaccuccgccaaugcac

SEQ ID NO: 1692130 - RNA, 17 nt, Homo sapiens
acaauaugggcacuuua

SEQ ID NO: 1692131 - RNA, 19 nt, Homo sapiens
acaaucaugaaauaugcau

SEQ ID NO: 1692132 - RNA, 20 nt, Homo sapiens
acaaucauuguuuugaauau

SEQ ID NO: 1692133 - RNA, 15 nt, Homo sapiens
acaaugaacacuuau

SEQ ID NO: 1692134 - RNA, 20 nt, Homo sapiens
acaaugaagugacacuuuga

SEQ ID NO: 1692135 - RNA, 12 nt, Homo sapiens
acaaugauccag

SEQ ID NO: 1692136 - RNA, 12 nt, Homo sapiens
acaaugcugauu

SEQ ID NO: 1692137 - RNA, 16 nt, Homo sapiens
acaauuggaauugucu

SEQ ID NO: 1692138 - RNA, 15 nt, Homo sapiens
acaauuucauucagu

SEQ ID NO: 1692139 - RNA, 20 nt, Homo sapiens
acacaaggcuccaagaccua

SEQ ID NO: 1692140 - RNA, 12 nt, Homo sapiens
acacacacaaac

SEQ ID NO: 1692141 - RNA, 16 nt, Homo sapiens
acacacacacacaucc

SEQ ID NO: 1692142 - RNA, 13 nt, Homo sapiens
acacacacaucca

SEQ ID NO: 1692143 - RNA, 22 nt, Homo sapiens
acacacacucuacccuauacaa

SEQ ID NO: 1692144 - RNA, 10 nt, Homo sapiens
acacacaucc

SEQ ID NO: 1692145 - RNA, 13 nt, Homo sapiens
acacaccugguga

SEQ ID NO: 1692146 - RNA, 13 nt, Homo sapiens
acacagcuguucu

SEQ ID NO: 1692147 - RNA, 18 nt, Homo sapiens
acacaggcaaaauccuug

SEQ ID NO: 1692148 - RNA, 21 nt, Homo sapiens
acacaggcccggcuccaggcu

SEQ ID NO: 1692149 - RNA, 15 nt, Homo sapiens
acacagucaccuucu

SEQ ID NO: 1692150 - RNA, 13 nt, Homo sapiens
acacauaugcacc

SEQ ID NO: 1692151 - RNA, 23 nt, Homo sapiens
acacauccgccuuuuguauacau

SEQ ID NO: 1692152 - RNA, 14 nt, Homo sapiens
acaccaaccgacag

SEQ ID NO: 1692153 - RNA, 22 nt, Homo sapiens
acaccagagcagaugcagagag

SEQ ID NO: 1692154 - RNA, 14 nt, Homo sapiens
acaccauauacugu

SEQ ID NO: 1692155 - RNA, 14 nt, Homo sapiens
acaccauuuaucua

SEQ ID NO: 1692156 - RNA, 17 nt, Homo sapiens
acacccaaagcauggac

SEQ ID NO: 1692157 - RNA, 14 nt, Homo sapiens
acacccaagcagag

SEQ ID NO: 1692158 - RNA, 13 nt, Homo sapiens
acacccagccuca

SEQ ID NO: 1692159 - RNA, 21 nt, Homo sapiens
acacccagccucaguccuccc

SEQ ID NO: 1692160 - RNA, 13 nt, Homo sapiens
acacccuguacug

SEQ ID NO: 1692161 - RNA, 16 nt, Homo sapiens
acaccucaguucccuu

SEQ ID NO: 1692162 - RNA, 18 nt, Homo sapiens
acaccuguagucccagcu

SEQ ID NO: 1692163 - RNA, 16 nt, Homo sapiens
acacgcgcgcgcacac

SEQ ID NO: 1692164 - RNA, 14 nt, Homo sapiens
acacgcgugcacac

SEQ ID NO: 1692165 - RNA, 14 nt, Homo sapiens
acacuaacucacca

SEQ ID NO: 1692166 - RNA, 18 nt, Homo sapiens
acacuagaaaacuugacu

SEQ ID NO: 1692167 - RNA, 20 nt, Homo sapiens
acacucacuccacaacccaa

SEQ ID NO: 1692168 - RNA, 21 nt, Homo sapiens
acacuccagugccagcaauga

SEQ ID NO: 1692169 - RNA, 20 nt, Homo sapiens
acacuccuacaagauuuaga

SEQ ID NO: 1692170 - RNA, 22 nt, Homo sapiens
acacucugcagacugcuagugu

SEQ ID NO: 1692171 - RNA, 16 nt, Homo sapiens
acacugccuguauacu

SEQ ID NO: 1692172 - RNA, 12 nt, Homo sapiens
acacuguacaag

SEQ ID NO: 1692173 - RNA, 16 nt, Homo sapiens
acacuuacagaauuau

SEQ ID NO: 1692174 - RNA, 14 nt, Homo sapiens
acacuuggaugcag

SEQ ID NO: 1692175 - RNA, 14 nt, Homo sapiens
acacuuguauaaau

SEQ ID NO: 1692176 - RNA, 23 nt, Homo sapiens
acagaaaaguaauguaaaaucca

SEQ ID NO: 1692177 - RNA, 14 nt, Homo sapiens
acagaaacacugcc

SEQ ID NO: 1692178 - RNA, 20 nt, Homo sapiens
acagaaauauauauacauau

SEQ ID NO: 1692179 - RNA, 15 nt, Homo sapiens
acagaagucuccuca

SEQ ID NO: 1692180 - RNA, 16 nt, Homo sapiens
acagaagucuccucaa

SEQ ID NO: 1692181 - RNA, 20 nt, Homo sapiens
acagaauguuuuacugugaa

SEQ ID NO: 1692182 - RNA, 14 nt, Homo sapiens
acagaauuugucag

SEQ ID NO: 1692183 - RNA, 15 nt, Homo sapiens
acagacauacauuua

SEQ ID NO: 1692184 - RNA, 16 nt, Homo sapiens
acagacugauguguau

SEQ ID NO: 1692185 - RNA, 16 nt, Homo sapiens
acagacuggaagcaca

SEQ ID NO: 1692186 - RNA, 19 nt, Homo sapiens
acagagaagcggauuucca

SEQ ID NO: 1692187 - RNA, 22 nt, Homo sapiens
acugcugcccagccuccaagcu

SEQ ID NO: 1692188 - RNA, 18 nt, Homo sapiens
acugcuggacgucuuucu

SEQ ID NO: 1692189 - RNA, 21 nt, Homo sapiens
acuggaauaagaagcaaauaa

SEQ ID NO: 1692190 - RNA, 19 nt, Homo sapiens
acuggacagucacugccac

SEQ ID NO: 1692191 - RNA, 19 nt, Homo sapiens
acuggcuucucuugaguca

SEQ ID NO: 1692192 - RNA, 21 nt, Homo sapiens
acuggcuucucuugagucaca

SEQ ID NO: 1692193 - RNA, 14 nt, Homo sapiens
acugggaccugagu

SEQ ID NO: 1692194 - RNA, 19 nt, Homo sapiens
acugggaccugagucaaug

SEQ ID NO: 1692195 - RNA, 17 nt, Homo sapiens
acuguaacugacugccu

SEQ ID NO: 1692196 - RNA, 18 nt, Homo sapiens
acuguaauaauaccucaa

SEQ ID NO: 1692197 - RNA, 15 nt, Homo sapiens
acuguacauuucaca

SEQ ID NO: 1692198 - RNA, 15 nt, Homo sapiens
acuguauagacaguu

SEQ ID NO: 1692199 - RNA, 12 nt, Homo sapiens
acugucacuguu

SEQ ID NO: 1692200 - RNA, 19 nt, Homo sapiens
acuguccccacgccgggaa

SEQ ID NO: 1692201 - RNA, 23 nt, Homo sapiens
acuguccccacgccgggaaccaa

SEQ ID NO: 1692202 - RNA, 19 nt, Homo sapiens
acugucuccuuucucuuau

SEQ ID NO: 1692203 - RNA, 23 nt, Homo sapiens
acugugagcaaggagcacaagcc

SEQ ID NO: 1692204 - RNA, 14 nt, Homo sapiens
acuguggagcucag

SEQ ID NO: 1692205 - RNA, 14 nt, Homo sapiens
acuguguacuguau

SEQ ID NO: 1692206 - RNA, 18 nt, Homo sapiens
acuguuaagaagcagcca

SEQ ID NO: 1692207 - RNA, 17 nt, Homo sapiens
acuguuagcacuguuga

SEQ ID NO: 1692208 - RNA, 16 nt, Homo sapiens
acuguucuugcugcua

SEQ ID NO: 1692209 - RNA, 19 nt, Homo sapiens
acuguucuugcugcuagaa

SEQ ID NO: 1692210 - RNA, 19 nt, Homo sapiens
acuguugcaaacucagugc

SEQ ID NO: 1692211 - RNA, 13 nt, Homo sapiens
acuguugcccagg

SEQ ID NO: 1692212 - RNA, 21 nt, Homo sapiens
acuguuucuccuguuggcuca

SEQ ID NO: 1692213 - RNA, 20 nt, Homo sapiens
acuguuuuguaagugcugcu

SEQ ID NO: 1692214 - RNA, 14 nt, Homo sapiens
acuuaaccuuuuaa

SEQ ID NO: 1692215 - RNA, 18 nt, Homo sapiens
acuuaauguucuuaugca

SEQ ID NO: 1692216 - RNA, 18 nt, Homo sapiens
acuuacuauucauuaaau

SEQ ID NO: 1692217 - RNA, 22 nt, Homo sapiens
acuuagaaauugcauuuccuga

SEQ ID NO: 1692218 - RNA, 17 nt, Homo sapiens
acuuagaucaucaguca

SEQ ID NO: 1692219 - RNA, 14 nt, Homo sapiens
acuuagcauccuaa

SEQ ID NO: 1692220 - RNA, 21 nt, Homo sapiens
acuuauaaaucauauugauga

SEQ ID NO: 1692221 - RNA, 22 nt, Homo sapiens
acuuauauugaagacaauuuga

SEQ ID NO: 1692222 - RNA, 13 nt, Homo sapiens
acuucaauaucca

SEQ ID NO: 1692223 - RNA, 18 nt, Homo sapiens
acuucaaugggcucuucc

SEQ ID NO: 1692224 - RNA, 20 nt, Homo sapiens
acuucacugaaagacaccau

SEQ ID NO: 1692225 - RNA, 20 nt, Homo sapiens
acuucacuuauuagucuuag

SEQ ID NO: 1692226 - RNA, 19 nt, Homo sapiens
acuucauucucgugaguca

SEQ ID NO: 1692227 - RNA, 17 nt, Homo sapiens
acuucauugucccucuu

SEQ ID NO: 1692228 - RNA, 23 nt, Homo sapiens
acuuccaagcuggcuuuucccau

SEQ ID NO: 1692229 - RNA, 16 nt, Homo sapiens
acuuccucaugaaucu

SEQ ID NO: 1692230 - RNA, 19 nt, Homo sapiens
acuuccugugacuucagcu

SEQ ID NO: 1692231 - RNA, 16 nt, Homo sapiens
acuucgaaaccuggga

SEQ ID NO: 1692232 - RNA, 11 nt, Homo sapiens
acuucucacca

SEQ ID NO: 1692233 - RNA, 19 nt, Homo sapiens
acuucucccgugagccagg

SEQ ID NO: 1692234 - RNA, 18 nt, Homo sapiens
acuucucucuaaggagaa

SEQ ID NO: 1692235 - RNA, 21 nt, Homo sapiens
acuucucugccuuugacauuu

SEQ ID NO: 1692236 - RNA, 23 nt, Homo sapiens
acuucuuauggaauugauuugca

SEQ ID NO: 1692237 - RNA, 14 nt, Homo sapiens
acuucuugucagac

SEQ ID NO: 1692238 - RNA, 15 nt, Homo sapiens
acuucuugucagaca

SEQ ID NO: 1692239 - RNA, 22 nt, Homo sapiens
acuugaacaaaaucuguugcca

SEQ ID NO: 1692240 - RNA, 14 nt, Homo sapiens
acuugagauguaug

SEQ ID NO: 1692241 - RNA, 20 nt, Homo sapiens
acuugaugacccccaaccaa

SEQ ID NO: 1692242 - RNA, 21 nt, Homo sapiens
acuugcauccaacuccaggau

SEQ ID NO: 1692243 - RNA, 16 nt, Homo sapiens
acuuguagcauauucu

SEQ ID NO: 1692244 - RNA, 19 nt, Homo sapiens
acuuguauuauuaaugcca

SEQ ID NO: 1692245 - RNA, 17 nt, Homo sapiens
acuugugaaacacagcu

SEQ ID NO: 1692246 - RNA, 19 nt, Homo sapiens
acuuguuugcugugaacaa

SEQ ID NO: 1692247 - RNA, 20 nt, Homo sapiens
acuuucccguuuuauuccag

SEQ ID NO: 1692248 - RNA, 14 nt, Homo sapiens
acuuugacauuucc

SEQ ID NO: 1692249 - RNA, 20 nt, Homo sapiens
acuuugcuugcucauaugca

SEQ ID NO: 1692250 - RNA, 21 nt, Homo sapiens
acuuuggaguccccucaccuc

SEQ ID NO: 1692251 - RNA, 11 nt, Homo sapiens
acuuugggacg

SEQ ID NO: 1692252 - RNA, 16 nt, Homo sapiens
acuuuguauacuuuaa

SEQ ID NO: 1692253 - RNA, 23 nt, Homo sapiens
acuuuguauuuguucaguaugca

SEQ ID NO: 1692254 - RNA, 20 nt, Homo sapiens
agaaaaaauaacacacauau

SEQ ID NO: 1692255 - RNA, 12 nt, Homo sapiens
agaaaacgggaa

SEQ ID NO: 1692256 - RNA, 15 nt, Homo sapiens
agaaaacuguuaaua

SEQ ID NO: 1692257 - RNA, 20 nt, Homo sapiens
agaaaaggcagcuaaaggaa

SEQ ID NO: 1692258 - RNA, 13 nt, Homo sapiens
agaaaaguauuuu

SEQ ID NO: 1692259 - RNA, 16 nt, Homo sapiens
agaaaaugagacaaaa

SEQ ID NO: 1692260 - RNA, 16 nt, Homo sapiens
agaaaauguguccuau

SEQ ID NO: 1692261 - RNA, 22 nt, Homo sapiens
agaaaauguugagaaucccaaa

SEQ ID NO: 1692262 - RNA, 14 nt, Homo sapiens
agaaacagcuuuca

SEQ ID NO: 1692263 - RNA, 16 nt, Homo sapiens
agaaacaugacacuga

SEQ ID NO: 1692264 - RNA, 17 nt, Homo sapiens
agaaacaugacacugac

SEQ ID NO: 1692265 - RNA, 19 nt, Homo sapiens
agaaacaugacacugaccu

SEQ ID NO: 1692266 - RNA, 20 nt, Homo sapiens
agaaaccaagagaaguuuug

SEQ ID NO: 1692267 - RNA, 12 nt, Homo sapiens
agaaacccaagc

SEQ ID NO: 1692268 - RNA, 22 nt, Homo sapiens
agaaacuuuauacauuaguaaa

SEQ ID NO: 1692269 - RNA, 14 nt, Homo sapiens
agaaaguacuucuc

SEQ ID NO: 1692270 - RNA, 23 nt, Homo sapiens
agaaaucauaguuuaaacugcau

SEQ ID NO: 1692271 - RNA, 16 nt, Homo sapiens
agaaaucuggucuugu

SEQ ID NO: 1692272 - RNA, 14 nt, Homo sapiens
agaaaugaacauuc

SEQ ID NO: 1692273 - RNA, 16 nt, Homo sapiens
agaacuauguacuuua

SEQ ID NO: 1692274 - RNA, 12 nt, Homo sapiens
agaacucuccau

SEQ ID NO: 1692275 - RNA, 22 nt, Homo sapiens
agaacucuccaucuuauuuuca

SEQ ID NO: 1692276 - RNA, 18 nt, Homo sapiens
agaacucugggcugcuac

SEQ ID NO: 1692277 - RNA, 17 nt, Homo sapiens
agaacuuuucgacauau

SEQ ID NO: 1692278 - RNA, 18 nt, Homo sapiens
agaacuuuucgacauauu

SEQ ID NO: 1692279 - RNA, 18 nt, Homo sapiens
agaagacaccagagcaga

SEQ ID NO: 1692280 - RNA, 19 nt, Homo sapiens
agaagacacugaugggcaa

SEQ ID NO: 1692281 - RNA, 21 nt, Homo sapiens
agaagauagaugcacuuaugc

SEQ ID NO: 1692282 - RNA, 20 nt, Homo sapiens
agaagcacccaggacuucca

SEQ ID NO: 1692283 - RNA, 16 nt, Homo sapiens
agaagcagaaacuggc

SEQ ID NO: 1692284 - RNA, 12 nt, Homo sapiens
agaagcccugau

SEQ ID NO: 1692285 - RNA, 22 nt, Homo sapiens
agaaggugccacuuuacccacc

SEQ ID NO: 1692286 - RNA, 23 nt, Homo sapiens
agaagguggaccuuuuaaagugu

SEQ ID NO: 1692287 - RNA, 14 nt, Homo sapiens
agaaguaauuugaa

SEQ ID NO: 1692288 - RNA, 22 nt, Homo sapiens
agaagucaugaagcccaaguga

SEQ ID NO: 1692289 - RNA, 17 nt, Homo sapiens
agaaguuucccuuccuc

SEQ ID NO: 1692290 - RNA, 17 nt, Homo sapiens
agaauaaggcaggcauu

SEQ ID NO: 1692291 - RNA, 18 nt, Homo sapiens
agaaucauuaauacaaag

SEQ ID NO: 1692292 - RNA, 20 nt, Homo sapiens
agaaugagcacccauuccaa

SEQ ID NO: 1692293 - RNA, 14 nt, Homo sapiens
agaaugaguuauga

SEQ ID NO: 1692294 - RNA, 16 nt, Homo sapiens
agaauggugaucacuc

SEQ ID NO: 1692295 - RNA, 20 nt, Homo sapiens
agaauguucuccuaaaagac

SEQ ID NO: 1692296 - RNA, 20 nt, Homo sapiens
agguacuauauuugcuagac

SEQ ID NO: 1692297 - RNA, 20 nt, Homo sapiens
agguagccagggggacuagc

SEQ ID NO: 1692298 - RNA, 14 nt, Homo sapiens
agguagcuuaccug

SEQ ID NO: 1692299 - RNA, 18 nt, Homo sapiens
agguagcuuuagggcaau

SEQ ID NO: 1692300 - RNA, 19 nt, Homo sapiens
agguaucuguuuaacauuu

SEQ ID NO: 1692301 - RNA, 22 nt, Homo sapiens
aggucagagccugcaguuauua

SEQ ID NO: 1692302 - RNA, 15 nt, Homo sapiens
aggucccaggaagug

SEQ ID NO: 1692303 - RNA, 16 nt, Homo sapiens
agguccgguguucuaa

SEQ ID NO: 1692304 - RNA, 18 nt, Homo sapiens
agguccgguguucuaaga

SEQ ID NO: 1692305 - RNA, 21 nt, Homo sapiens
aggucucacgggcaugggcac

SEQ ID NO: 1692306 - RNA, 17 nt, Homo sapiens
aggucucauucuuccaa

SEQ ID NO: 1692307 - RNA, 18 nt, Homo sapiens
aggugaaaauccaucuca

SEQ ID NO: 1692308 - RNA, 19 nt, Homo sapiens
aggugaaaauccaucucau

SEQ ID NO: 1692309 - RNA, 13 nt, Homo sapiens
aggugacagagug

SEQ ID NO: 1692310 - RNA, 21 nt, Homo sapiens
aggugacaugugaaaccuuuu

SEQ ID NO: 1692311 - RNA, 22 nt, Homo sapiens
aggugaccuggccagagccaag

SEQ ID NO: 1692312 - RNA, 16 nt, Homo sapiens
aggugauccacccacc

SEQ ID NO: 1692313 - RNA, 14 nt, Homo sapiens
aggugcacugcuuu

SEQ ID NO: 1692314 - RNA, 16 nt, Homo sapiens
agguggaacucaguca

SEQ ID NO: 1692315 - RNA, 11 nt, Homo sapiens
agguggcaagc

SEQ ID NO: 1692316 - RNA, 22 nt, Homo sapiens
agguggccccaguucaaucucc

SEQ ID NO: 1692317 - RNA, 22 nt, Homo sapiens
aggugguaugugacaccaaagc

SEQ ID NO: 1692318 - RNA, 22 nt, Homo sapiens
agguucauugcgugauucaaug

SEQ ID NO: 1692319 - RNA, 20 nt, Homo sapiens
agguucuaaaguucuaagau

SEQ ID NO: 1692320 - RNA, 20 nt, Homo sapiens
agguucuagguuucaaagau

SEQ ID NO: 1692321 - RNA, 15 nt, Homo sapiens
agguuuuuacuguga

SEQ ID NO: 1692322 - RNA, 16 nt, Homo sapiens
aguaaaaauacaagca

SEQ ID NO: 1692323 - RNA, 13 nt, Homo sapiens
aguaaagccucaa

SEQ ID NO: 1692324 - RNA, 17 nt, Homo sapiens
aguaaaguuagauuaaa

SEQ ID NO: 1692325 - RNA, 17 nt, Homo sapiens
aguaaauaacaggcauu

SEQ ID NO: 1692326 - RNA, 22 nt, Homo sapiens
aguaaaugcuagguuaauucca

SEQ ID NO: 1692327 - RNA, 18 nt, Homo sapiens
aguaacuucacauuaaaa

SEQ ID NO: 1692328 - RNA, 20 nt, Homo sapiens
aguacagcaugugccuuaau

SEQ ID NO: 1692329 - RNA, 12 nt, Homo sapiens
aguacaucucua

SEQ ID NO: 1692330 - RNA, 17 nt, Homo sapiens
aguacaucucuacuaaa

SEQ ID NO: 1692331 - RNA, 15 nt, Homo sapiens
aguacuugugaaaca

SEQ ID NO: 1692332 - RNA, 15 nt, Homo sapiens
aguacuuuaccuccu

SEQ ID NO: 1692333 - RNA, 17 nt, Homo sapiens
aguagacacacuaucau

SEQ ID NO: 1692334 - RNA, 18 nt, Homo sapiens
aguagagcaaaucuauga

SEQ ID NO: 1692335 - RNA, 12 nt, Homo sapiens
aguagagccagc

SEQ ID NO: 1692336 - RNA, 13 nt, Homo sapiens
aguaguagcugaa

SEQ ID NO: 1692337 - RNA, 16 nt, Homo sapiens
aguauauuuaaacuca

SEQ ID NO: 1692338 - RNA, 16 nt, Homo sapiens
aguauccaggcuuugu

SEQ ID NO: 1692339 - RNA, 19 nt, Homo sapiens
aguauguuuguacaguaug

SEQ ID NO: 1692340 - RNA, 17 nt, Homo sapiens
aguauucauucugcauu

SEQ ID NO: 1692341 - RNA, 16 nt, Homo sapiens
aguauucuugucaaaa

SEQ ID NO: 1692342 - RNA, 15 nt, Homo sapiens
aguauuguggcugca

SEQ ID NO: 1692343 - RNA, 17 nt, Homo sapiens
agucaaaacuacaaauc

SEQ ID NO: 1692344 - RNA, 21 nt, Homo sapiens
agucacaguuagguagcuuua

SEQ ID NO: 1692345 - RNA, 16 nt, Homo sapiens
agucaccgaagguccu

SEQ ID NO: 1692346 - RNA, 17 nt, Homo sapiens
agucacugccacuuugc

SEQ ID NO: 1692347 - RNA, 21 nt, Homo sapiens
agucacuuugccagagccuga

SEQ ID NO: 1692348 - RNA, 13 nt, Homo sapiens
agucagcucucuc

SEQ ID NO: 1692349 - RNA, 20 nt, Homo sapiens
agucaugaagcccaagugaa

SEQ ID NO: 1692350 - RNA, 12 nt, Homo sapiens
aguccaaaaagc

SEQ ID NO: 1692351 - RNA, 17 nt, Homo sapiens
aguccaaaccacuccac

SEQ ID NO: 1692352 - RNA, 22 nt, Homo sapiens
aguccaagguuuaaagagucua

SEQ ID NO: 1692353 - RNA, 13 nt, Homo sapiens
aguccaugcauga

SEQ ID NO: 1692354 - RNA, 13 nt, Homo sapiens
aguccaugcuucu

SEQ ID NO: 1692355 - RNA, 19 nt, Homo sapiens
agucccccuauccuuggca

SEQ ID NO: 1692356 - RNA, 17 nt, Homo sapiens
aguccuagccacucagg

SEQ ID NO: 1692357 - RNA, 18 nt, Homo sapiens
aguccugcuccagaauuu

SEQ ID NO: 1692358 - RNA, 17 nt, Homo sapiens
aguccuguacucugggg

SEQ ID NO: 1692359 - RNA, 12 nt, Homo sapiens
aguccuuuccaa

SEQ ID NO: 1692360 - RNA, 15 nt, Homo sapiens
agucggaacagcaga

SEQ ID NO: 1692361 - RNA, 15 nt, Homo sapiens
agucucccacuaaaa

SEQ ID NO: 1692362 - RNA, 19 nt, Homo sapiens
agucucucucuuccucaca

SEQ ID NO: 1692363 - RNA, 19 nt, Homo sapiens
agucucuuguacagcguuu

SEQ ID NO: 1692364 - RNA, 17 nt, Homo sapiens
agucugauucccaagcu

SEQ ID NO: 1692365 - RNA, 20 nt, Homo sapiens
agucugcucacaguaaccca

SEQ ID NO: 1692366 - RNA, 17 nt, Homo sapiens
agucuuugaagcugaaa

SEQ ID NO: 1692367 - RNA, 22 nt, Homo sapiens
agugaaauaauagaaugagcac

SEQ ID NO: 1692368 - RNA, 16 nt, Homo sapiens
agugacaaaccaucca

SEQ ID NO: 1692369 - RNA, 17 nt, Homo sapiens
agugacaaggcccugag

SEQ ID NO: 1692370 - RNA, 14 nt, Homo sapiens
agugacacagcagc

SEQ ID NO: 1692371 - RNA, 15 nt, Homo sapiens
agugacacagcagcu

SEQ ID NO: 1692372 - RNA, 11 nt, Homo sapiens
agugacagagg

SEQ ID NO: 1692373 - RNA, 18 nt, Homo sapiens
agugacagcagucaggga

SEQ ID NO: 1692374 - RNA, 20 nt, Homo sapiens
agugaccccugaccucacug

SEQ ID NO: 1692375 - RNA, 18 nt, Homo sapiens
agugacuguaucugugua

SEQ ID NO: 1692376 - RNA, 20 nt, Homo sapiens
agugagauauuugguaccau

SEQ ID NO: 1692377 - RNA, 18 nt, Homo sapiens
agugagcagugagcagaa

SEQ ID NO: 1692378 - RNA, 14 nt, Homo sapiens
agugauugcagcuu

SEQ ID NO: 1692379 - RNA, 17 nt, Homo sapiens
agugauugcagcuuuau

SEQ ID NO: 1692380 - RNA, 14 nt, Homo sapiens
agugcacagcuguc

SEQ ID NO: 1692381 - RNA, 15 nt, Homo sapiens
agugcacagcugucc

SEQ ID NO: 1692382 - RNA, 16 nt, Homo sapiens
agugcacagcugucca

SEQ ID NO: 1692383 - RNA, 15 nt, Homo sapiens
agugcagggcaaaau

SEQ ID NO: 1692384 - RNA, 20 nt, Homo sapiens
agugcaguggcgugaucucg

SEQ ID NO: 1692385 - RNA, 14 nt, Homo sapiens
agugcaucucagcc

SEQ ID NO: 1692386 - RNA, 9 nt, Homo sapiens
agugcccua

SEQ ID NO: 1692387 - RNA, 19 nt, Homo sapiens
agugccgacagcucuccaa

SEQ ID NO: 1692388 - RNA, 14 nt, Homo sapiens
agugcggcugccau

SEQ ID NO: 1692389 - RNA, 15 nt, Homo sapiens
agugcguguguagag

SEQ ID NO: 1692390 - RNA, 11 nt, Homo sapiens
agugcugcuau

SEQ ID NO: 1692391 - RNA, 14 nt, Homo sapiens
aguggaaggcauca

SEQ ID NO: 1692392 - RNA, 22 nt, Homo sapiens
aguggccccaucauagccugca

SEQ ID NO: 1692393 - RNA, 13 nt, Homo sapiens
agugggacccaua

SEQ ID NO: 1692394 - RNA, 20 nt, Homo sapiens
agugggagaaggcagugauu

SEQ ID NO: 1692395 - RNA, 16 nt, Homo sapiens
agugguuuccagucau

SEQ ID NO: 1692396 - RNA, 18 nt, Homo sapiens
aguguacauaguguaaug

SEQ ID NO: 1692397 - RNA, 21 nt, Homo sapiens
agugucucugccuugagucau

SEQ ID NO: 1692398 - RNA, 17 nt, Homo sapiens
agugugacagggccagu

SEQ ID NO: 1692399 - RNA, 22 nt, Homo sapiens
agugugacagggccaguggggc

SEQ ID NO: 1692400 - RNA, 14 nt, Homo sapiens
agugugcaugauug

SEQ ID NO: 1692401 - RNA, 16 nt, Homo sapiens
aguguggaaagaaaga

SEQ ID NO: 1692402 - RNA, 16 nt, Homo sapiens
aguguggaaccacuga

SEQ ID NO: 1692403 - RNA, 16 nt, Homo sapiens
aguguguaugccaaga

SEQ ID NO: 1692404 - RNA, 17 nt, Homo sapiens
aguguuauuugcacacu

SEQ ID NO: 1692405 - RNA, 22 nt, Homo sapiens
aguguugcccaggcuggucuca

SEQ ID NO: 1692406 - RNA, 16 nt, Homo sapiens
cauuaaguaaucaaua

SEQ ID NO: 1692407 - RNA, 19 nt, Homo sapiens
cauuagaacacugcauuag

SEQ ID NO: 1692408 - RNA, 19 nt, Homo sapiens
cauuagcuuccugccccag

SEQ ID NO: 1692409 - RNA, 16 nt, Homo sapiens
cauuauuuucugucag

SEQ ID NO: 1692410 - RNA, 17 nt, Homo sapiens
cauuauuuucugucaga

SEQ ID NO: 1692411 - RNA, 14 nt, Homo sapiens
cauucaauauugac

SEQ ID NO: 1692412 - RNA, 22 nt, Homo sapiens
cauucaauguuuaugcaaggaa

SEQ ID NO: 1692413 - RNA, 14 nt, Homo sapiens
cauucacuagcuuu

SEQ ID NO: 1692414 - RNA, 17 nt, Homo sapiens
cauucacuugcauuucu

SEQ ID NO: 1692415 - RNA, 19 nt, Homo sapiens
cauucaguuaaaaauccag

SEQ ID NO: 1692416 - RNA, 14 nt, Homo sapiens
cauuccaccuuccc

SEQ ID NO: 1692417 - RNA, 19 nt, Homo sapiens
cauuccauugccuagcucu

SEQ ID NO: 1692418 - RNA, 15 nt, Homo sapiens
cauucccaucuguca

SEQ ID NO: 1692419 - RNA, 23 nt, Homo sapiens
cauuccuguagucaaaaucuggu

SEQ ID NO: 1692420 - RNA, 17 nt, Homo sapiens
cauucugcauugcuaga

SEQ ID NO: 1692421 - RNA, 13 nt, Homo sapiens
cauucuuccaaaa

SEQ ID NO: 1692422 - RNA, 14 nt, Homo sapiens
cauucuuccaaaaa

SEQ ID NO: 1692423 - RNA, 23 nt, Homo sapiens
cauucuuguuuuaagugccuuua

SEQ ID NO: 1692424 - RNA, 13 nt, Homo sapiens
cauugaugacccu

SEQ ID NO: 1692425 - RNA, 20 nt, Homo sapiens
cauugaugacccucugaccc

SEQ ID NO: 1692426 - RNA, 21 nt, Homo sapiens
cauugccuaacuacuaguuuu

SEQ ID NO: 1692427 - RNA, 23 nt, Homo sapiens
cauuggucuaauuuauucaaagg

SEQ ID NO: 1692428 - RNA, 18 nt, Homo sapiens
cauuguacuaccugugua

SEQ ID NO: 1692429 - RNA, 12 nt, Homo sapiens
cauugucugugg

SEQ ID NO: 1692430 - RNA, 14 nt, Homo sapiens
cauuguuagcacua

SEQ ID NO: 1692431 - RNA, 22 nt, Homo sapiens
cauuuaaaauugcuauguuacu

SEQ ID NO: 1692432 - RNA, 17 nt, Homo sapiens
cauuuaaauguguacaa

SEQ ID NO: 1692433 - RNA, 18 nt, Homo sapiens
cauuuaaauuuuacccuu

SEQ ID NO: 1692434 - RNA, 15 nt, Homo sapiens
cauuuaauuuaguga

SEQ ID NO: 1692435 - RNA, 15 nt, Homo sapiens
cauuuagaacuugca

SEQ ID NO: 1692436 - RNA, 18 nt, Homo sapiens
cauuuagaacuugcagcu

SEQ ID NO: 1692437 - RNA, 17 nt, Homo sapiens
cauuuauccacaggaaa

SEQ ID NO: 1692438 - RNA, 21 nt, Homo sapiens
cauuuaugauuuaauaaaaua

SEQ ID NO: 1692439 - RNA, 12 nt, Homo sapiens
cauuuaugcaca

SEQ ID NO: 1692440 - RNA, 22 nt, Homo sapiens
cauuucacaggcuaaugggaua

SEQ ID NO: 1692441 - RNA, 23 nt, Homo sapiens
cauuucagagaggccuuuuggaa

SEQ ID NO: 1692442 - RNA, 22 nt, Homo sapiens
cauuucauuguaugauguguug

SEQ ID NO: 1692443 - RNA, 17 nt, Homo sapiens
cauuucuguaaauacca

SEQ ID NO: 1692444 - RNA, 20 nt, Homo sapiens
cauuucuguaaauaccauug

SEQ ID NO: 1692445 - RNA, 19 nt, Homo sapiens
cauuugaggggaaaacacc

SEQ ID NO: 1692446 - RNA, 20 nt, Homo sapiens
cauuugaguugcccaucuug

SEQ ID NO: 1692447 - RNA, 15 nt, Homo sapiens
cauuugcaccuaccu

SEQ ID NO: 1692448 - RNA, 16 nt, Homo sapiens
cauuugcaccuaccuc

SEQ ID NO: 1692449 - RNA, 17 nt, Homo sapiens
cauuugccaacucgaac

SEQ ID NO: 1692450 - RNA, 21 nt, Homo sapiens
cauuuggaccaauagcccaca

SEQ ID NO: 1692451 - RNA, 23 nt, Homo sapiens
cauuugugggucuguguggcagg

SEQ ID NO: 1692452 - RNA, 19 nt, Homo sapiens
cauuuuacaggugcgaaug

SEQ ID NO: 1692453 - RNA, 22 nt, Homo sapiens
cauuuuacccuuggcucaaucc

SEQ ID NO: 1692454 - RNA, 16 nt, Homo sapiens
cauuuuaguccagaga

SEQ ID NO: 1692455 - RNA, 14 nt, Homo sapiens
cauuuucaccccac

SEQ ID NO: 1692456 - RNA, 16 nt, Homo sapiens
cauuuucucuaccuuc

SEQ ID NO: 1692457 - RNA, 17 nt, Homo sapiens
cauuuugacagcaucuu

SEQ ID NO: 1692458 - RNA, 14 nt, Homo sapiens
cauuuuucugggag

SEQ ID NO: 1692459 - RNA, 20 nt, Homo sapiens
ccaaaaagggauccguacau

SEQ ID NO: 1692460 - RNA, 17 nt, Homo sapiens
ccaaaaauaugguugau

SEQ ID NO: 1692461 - RNA, 13 nt, Homo sapiens
ccaaaaugcauuu

SEQ ID NO: 1692462 - RNA, 14 nt, Homo sapiens
ccaaaccacuccac

SEQ ID NO: 1692463 - RNA, 15 nt, Homo sapiens
ccaaaccucaaguaa

SEQ ID NO: 1692464 - RNA, 15 nt, Homo sapiens
ccaaagcauggacua

SEQ ID NO: 1692465 - RNA, 20 nt, Homo sapiens
ccaaaguaaauguccugcua

SEQ ID NO: 1692466 - RNA, 17 nt, Homo sapiens
ccaaagugcugggauua

SEQ ID NO: 1692467 - RNA, 23 nt, Homo sapiens
ccaaauaaacucuaaacauuaau

SEQ ID NO: 1692468 - RNA, 12 nt, Homo sapiens
ccaaauugcagc

SEQ ID NO: 1692469 - RNA, 14 nt, Homo sapiens
ccaaauuuggcuaa

SEQ ID NO: 1692470 - RNA, 13 nt, Homo sapiens
ccaacaaaccauc

SEQ ID NO: 1692471 - RNA, 12 nt, Homo sapiens
ccaacaccacag

SEQ ID NO: 1692472 - RNA, 22 nt, Homo sapiens
ccaacaggcuguucugcacuga

SEQ ID NO: 1692473 - RNA, 23 nt, Homo sapiens
ccaacaggcuguucugcacugaa

SEQ ID NO: 1692474 - RNA, 22 nt, Homo sapiens
ccaacugaguguuauuugcaca

SEQ ID NO: 1692475 - RNA, 19 nt, Homo sapiens
ccaacuucucuugcuuucu

SEQ ID NO: 1692476 - RNA, 14 nt, Homo sapiens
ccaacuugagaugu

SEQ ID NO: 1692477 - RNA, 21 nt, Homo sapiens
ccaacuugagggcccagagca

SEQ ID NO: 1692478 - RNA, 17 nt, Homo sapiens
ccaagaaacacuuucag

SEQ ID NO: 1692479 - RNA, 16 nt, Homo sapiens
ccaagacagagacaga

SEQ ID NO: 1692480 - RNA, 16 nt, Homo sapiens
ccaagagucuaaagau

SEQ ID NO: 1692481 - RNA, 14 nt, Homo sapiens
ccaagccuccacag

SEQ ID NO: 1692482 - RNA, 12 nt, Homo sapiens
ccaagcucugcu

SEQ ID NO: 1692483 - RNA, 18 nt, Homo sapiens
ccaagcuuguuaucagcu

SEQ ID NO: 1692484 - RNA, 21 nt, Homo sapiens
ccaagcuuguuaucagcuuuc

SEQ ID NO: 1692485 - RNA, 16 nt, Homo sapiens
ccaaggcucugagcaa

SEQ ID NO: 1692486 - RNA, 14 nt, Homo sapiens
ccaagguaggcaga

SEQ ID NO: 1692487 - RNA, 16 nt, Homo sapiens
ccaagucggaacagca

SEQ ID NO: 1692488 - RNA, 15 nt, Homo sapiens
ccaagugugaacaaa

SEQ ID NO: 1692489 - RNA, 16 nt, Homo sapiens
ccaaguuuccauagca

SEQ ID NO: 1692490 - RNA, 23 nt, Homo sapiens
ccaaucccuuuauuacccccucc

SEQ ID NO: 1692491 - RNA, 18 nt, Homo sapiens
ccaaugcacauccauucc

SEQ ID NO: 1692492 - RNA, 16 nt, Homo sapiens
ccaauggaaaccucac

SEQ ID NO: 1692493 - RNA, 22 nt, Homo sapiens
ccaauuauuguuacacauuaag

SEQ ID NO: 1692494 - RNA, 9 nt, Homo sapiens
ccacaaagg

SEQ ID NO: 1692495 - RNA, 17 nt, Homo sapiens
ccacaacugacacagga

SEQ ID NO: 1692496 - RNA, 19 nt, Homo sapiens
ccacaacugacacaggaaa

SEQ ID NO: 1692497 - RNA, 14 nt, Homo sapiens
ccacaagucuucca

SEQ ID NO: 1692498 - RNA, 18 nt, Homo sapiens
ccacaccguuguuuaggg

SEQ ID NO: 1692499 - RNA, 11 nt, Homo sapiens
ccacaccucag

SEQ ID NO: 1692500 - RNA, 16 nt, Homo sapiens
ccacacucugacgcaa

SEQ ID NO: 1692501 - RNA, 17 nt, Homo sapiens
ccacagcacagcucccu

SEQ ID NO: 1692502 - RNA, 20 nt, Homo sapiens
ccacagccaaacuaggacac

SEQ ID NO: 1692503 - RNA, 12 nt, Homo sapiens
ccacagccaugg

SEQ ID NO: 1692504 - RNA, 21 nt, Homo sapiens
ccacaucuugcucugcugaca

SEQ ID NO: 1692505 - RNA, 18 nt, Homo sapiens
ccacaugggagcagucca

SEQ ID NO: 1692506 - RNA, 22 nt, Homo sapiens
ccacaugggagcaguccaugca

SEQ ID NO: 1692507 - RNA, 23 nt, Homo sapiens
ccacauuaucaguugacagugua

SEQ ID NO: 1692508 - RNA, 20 nt, Homo sapiens
ccaccacugcuuaagugccu

SEQ ID NO: 1692509 - RNA, 14 nt, Homo sapiens
ccaccagccacuuu

SEQ ID NO: 1692510 - RNA, 16 nt, Homo sapiens
ccaccagccacuuuag

SEQ ID NO: 1692511 - RNA, 13 nt, Homo sapiens
ccacccacaugug

SEQ ID NO: 1692512 - RNA, 14 nt, Homo sapiens
ccacccccagcuca

SEQ ID NO: 1692513 - RNA, 20 nt, Homo sapiens
ccacccuccuuucaccacau

SEQ ID NO: 1692514 - RNA, 21 nt, Homo sapiens
ccacccuguucccagucuucu

SEQ ID NO: 1692515 - RNA, 22 nt, Homo sapiens
ccaccgaaguggacuggccccu

SEQ ID NO: 1692516 - RNA, 13 nt, Homo sapiens
ccuuuuauacuga

SEQ ID NO: 1692517 - RNA, 19 nt, Homo sapiens
ccuuuucuuuuguuacugu

SEQ ID NO: 1692518 - RNA, 16 nt, Homo sapiens
ccuuuuguauacaucc

SEQ ID NO: 1692519 - RNA, 22 nt, Homo sapiens
ccuuuuuuaagauuuuucucaa

SEQ ID NO: 1692520 - RNA, 22 nt, Homo sapiens
ccuuuuuucaaaauccaaaaag

SEQ ID NO: 1692521 - RNA, 21 nt, Homo sapiens
cgaaaccugggauucaggaau

SEQ ID NO: 1692522 - RNA, 17 nt, Homo sapiens
cgaaagagagagaaaca

SEQ ID NO: 1692523 - RNA, 18 nt, Homo sapiens
cgaaauaacaauguuaag

SEQ ID NO: 1692524 - RNA, 20 nt, Homo sapiens
cgaaauaacaauguuaagga

SEQ ID NO: 1692525 - RNA, 17 nt, Homo sapiens
cgaaauuggauuaugca

SEQ ID NO: 1692526 - RNA, 18 nt, Homo sapiens
cgaccuggagacugacaa

SEQ ID NO: 1692527 - RNA, 16 nt, Homo sapiens
cgagagaggagccaga

SEQ ID NO: 1692528 - RNA, 17 nt, Homo sapiens
cgagaugggaaggcaca

SEQ ID NO: 1692529 - RNA, 18 nt, Homo sapiens
cgaggggcucucagcuca

SEQ ID NO: 1692530 - RNA, 19 nt, Homo sapiens
cgagucucuucuccacugg

SEQ ID NO: 1692531 - RNA, 20 nt, Homo sapiens
cgaguggauuguaggugcaa

SEQ ID NO: 1692532 - RNA, 18 nt, Homo sapiens
cgaucuggguucacugca

SEQ ID NO: 1692533 - RNA, 23 nt, Homo sapiens
cgaugaggaccaagggcaccugg

SEQ ID NO: 1692534 - RNA, 16 nt, Homo sapiens
cgaugcugcuauggaa

SEQ ID NO: 1692535 - RNA, 12 nt, Homo sapiens
cgauggagacac

SEQ ID NO: 1692536 - RNA, 23 nt, Homo sapiens
cgcacaccggcuuaacacuauca

SEQ ID NO: 1692537 - RNA, 13 nt, Homo sapiens
cgcacaugcacac

SEQ ID NO: 1692538 - RNA, 22 nt, Homo sapiens
cgcacccaguuugauaccugca

SEQ ID NO: 1692539 - RNA, 14 nt, Homo sapiens
cgcaugaaccugga

SEQ ID NO: 1692540 - RNA, 14 nt, Homo sapiens
cgccacacagacca

SEQ ID NO: 1692541 - RNA, 20 nt, Homo sapiens
cgcccuuggcuucugugaug

SEQ ID NO: 1692542 - RNA, 20 nt, Homo sapiens
cgccucucccaccccaugca

SEQ ID NO: 1692543 - RNA, 13 nt, Homo sapiens
cgccugagcucac

SEQ ID NO: 1692544 - RNA, 13 nt, Homo sapiens
cgccugugcacac

SEQ ID NO: 1692545 - RNA, 15 nt, Homo sapiens
cgccuuuuguauaca

SEQ ID NO: 1692546 - RNA, 18 nt, Homo sapiens
cgccuuuuguauacaucc

SEQ ID NO: 1692547 - RNA, 17 nt, Homo sapiens
cgcuagagcagcccaaa

SEQ ID NO: 1692548 - RNA, 15 nt, Homo sapiens
cgcuaugugcacuga

SEQ ID NO: 1692549 - RNA, 19 nt, Homo sapiens
cgcucagaacaguaucuuu

SEQ ID NO: 1692550 - RNA, 19 nt, Homo sapiens
cgcuccacguuucaggcag

SEQ ID NO: 1692551 - RNA, 17 nt, Homo sapiens
cgcucuguggaugccag

SEQ ID NO: 1692552 - RNA, 15 nt, Homo sapiens
cgcuggagugcagug

SEQ ID NO: 1692553 - RNA, 20 nt, Homo sapiens
cgcuggguauuggaaaugga

SEQ ID NO: 1692554 - RNA, 21 nt, Homo sapiens
cgcuucgacuuuucuuaacaa

SEQ ID NO: 1692555 - RNA, 13 nt, Homo sapiens
cgcuugcuuuagc

SEQ ID NO: 1692556 - RNA, 23 nt, Homo sapiens
cggagacggagucccaccuuggc

SEQ ID NO: 1692557 - RNA, 13 nt, Homo sapiens
cggaggcaccugg

SEQ ID NO: 1692558 - RNA, 16 nt, Homo sapiens
cggauuccagcccaca

SEQ ID NO: 1692559 - RNA, 19 nt, Homo sapiens
cggccacauuugguucuaa

SEQ ID NO: 1692560 - RNA, 16 nt, Homo sapiens
cggccuccaugaccug

SEQ ID NO: 1692561 - RNA, 14 nt, Homo sapiens
cggccucccaaagu

SEQ ID NO: 1692562 - RNA, 18 nt, Homo sapiens
cggcugcggggggcacca

SEQ ID NO: 1692563 - RNA, 17 nt, Homo sapiens
cgggagccuaggaccac

SEQ ID NO: 1692564 - RNA, 20 nt, Homo sapiens
cgggaggaggaggagcaccu

SEQ ID NO: 1692565 - RNA, 21 nt, Homo sapiens
cgggccuggagaacuagagaa

SEQ ID NO: 1692566 - RNA, 12 nt, Homo sapiens
cggucucaggcu

SEQ ID NO: 1692567 - RNA, 19 nt, Homo sapiens
cguacugauucuaaugggg

SEQ ID NO: 1692568 - RNA, 12 nt, Homo sapiens
cgucccuaccuc

SEQ ID NO: 1692569 - RNA, 14 nt, Homo sapiens
cgucuaugcugcuu

SEQ ID NO: 1692570 - RNA, 16 nt, Homo sapiens
cgugaacugugcauag

SEQ ID NO: 1692571 - RNA, 17 nt, Homo sapiens
cgugaggucccaggaag

SEQ ID NO: 1692572 - RNA, 14 nt, Homo sapiens
cgugauacauuugg

SEQ ID NO: 1692573 - RNA, 17 nt, Homo sapiens
cgugcauuagcacagau

SEQ ID NO: 1692574 - RNA, 20 nt, Homo sapiens
cgugcucccgaugcugcuau

SEQ ID NO: 1692575 - RNA, 13 nt, Homo sapiens
cguggacucugca

SEQ ID NO: 1692576 - RNA, 21 nt, Homo sapiens
cguggacucugcacaugucuu

SEQ ID NO: 1692577 - RNA, 14 nt, Homo sapiens
cguguaaauuaugu

SEQ ID NO: 1692578 - RNA, 22 nt, Homo sapiens
cguuggccggaggucaugauga

SEQ ID NO: 1692579 - RNA, 15 nt, Homo sapiens
cguuuagaccaagga

SEQ ID NO: 1692580 - RNA, 23 nt, Homo sapiens
cguuuccugagaagugucuaaaa

SEQ ID NO: 1692581 - RNA, 18 nt, Homo sapiens
cguuugugagcucccagc

SEQ ID NO: 1692582 - RNA, 13 nt, Homo sapiens
cguuuuauuccag

SEQ ID NO: 1692583 - RNA, 22 nt, Homo sapiens
cuaaaaaacagaggccauggca

SEQ ID NO: 1692584 - RNA, 17 nt, Homo sapiens
cuaaaacuggccugacu

SEQ ID NO: 1692585 - RNA, 22 nt, Homo sapiens
cuaaaagcguuggauguagcau

SEQ ID NO: 1692586 - RNA, 18 nt, Homo sapiens
cuaaaagugggcuugauu

SEQ ID NO: 1692587 - RNA, 17 nt, Homo sapiens
cuaaaauuuuaggcacu

SEQ ID NO: 1692588 - RNA, 16 nt, Homo sapiens
cuaaacccaauccaaa

SEQ ID NO: 1692589 - RNA, 16 nt, Homo sapiens
cuaaaccccuguccca

SEQ ID NO: 1692590 - RNA, 16 nt, Homo sapiens
cuaaacggauuccaaa

SEQ ID NO: 1692591 - RNA, 19 nt, Homo sapiens
cuaaagguccacaggucua

SEQ ID NO: 1692592 - RNA, 15 nt, Homo sapiens
cuaaaggugcacugc

SEQ ID NO: 1692593 - RNA, 16 nt, Homo sapiens
cuaaaggugcacugcu

SEQ ID NO: 1692594 - RNA, 22 nt, Homo sapiens
cuaaagguuuuaaccgcacaug

SEQ ID NO: 1692595 - RNA, 20 nt, Homo sapiens
cuaaauaauguuaucugugu

SEQ ID NO: 1692596 - RNA, 15 nt, Homo sapiens
cuaaaucuucagcau

SEQ ID NO: 1692597 - RNA, 21 nt, Homo sapiens
cuaaaugaaaaucgugacaac

SEQ ID NO: 1692598 - RNA, 19 nt, Homo sapiens
cuaacacgcacagcugaaa

SEQ ID NO: 1692599 - RNA, 17 nt, Homo sapiens
cuaaccaguuaccacac

SEQ ID NO: 1692600 - RNA, 15 nt, Homo sapiens
cuaacuauauuugcu

SEQ ID NO: 1692601 - RNA, 18 nt, Homo sapiens
cuaagaauucaaacuggg

SEQ ID NO: 1692602 - RNA, 16 nt, Homo sapiens
cuaagacacaaaugca

SEQ ID NO: 1692603 - RNA, 18 nt, Homo sapiens
cuaagaugugauauucua

SEQ ID NO: 1692604 - RNA, 21 nt, Homo sapiens
cuaaggaugucacagggccaa

SEQ ID NO: 1692605 - RNA, 22 nt, Homo sapiens
cuaagggucgaaagcucuagaa

SEQ ID NO: 1692606 - RNA, 18 nt, Homo sapiens
cuaagggugggugcucag

SEQ ID NO: 1692607 - RNA, 11 nt, Homo sapiens
cuaaguacugu

SEQ ID NO: 1692608 - RNA, 13 nt, Homo sapiens
cuaaguacuguaa

SEQ ID NO: 1692609 - RNA, 15 nt, Homo sapiens
cuaagucucugugaa

SEQ ID NO: 1692610 - RNA, 23 nt, Homo sapiens
cuaagugauccucccaccucagc

SEQ ID NO: 1692611 - RNA, 18 nt, Homo sapiens
cuaauaauguuaaccaag

SEQ ID NO: 1692612 - RNA, 15 nt, Homo sapiens
cuaauaccucugugu

SEQ ID NO: 1692613 - RNA, 14 nt, Homo sapiens
cuaauacuacugca

SEQ ID NO: 1692614 - RNA, 14 nt, Homo sapiens
cuaauauggcaaaa

SEQ ID NO: 1692615 - RNA, 17 nt, Homo sapiens
cuaaucagcauucucac

SEQ ID NO: 1692616 - RNA, 22 nt, Homo sapiens
cuaaucagcauucucacuccua

SEQ ID NO: 1692617 - RNA, 22 nt, Homo sapiens
cuaaucucauaccucugaccaa

SEQ ID NO: 1692618 - RNA, 21 nt, Homo sapiens
cuaaucuucuuaugcaauuuc

SEQ ID NO: 1692619 - RNA, 16 nt, Homo sapiens
cuaaugagacugacca

SEQ ID NO: 1692620 - RNA, 12 nt, Homo sapiens
cuaaugggacac

SEQ ID NO: 1692621 - RNA, 19 nt, Homo sapiens
cuaauggggacacagauca

SEQ ID NO: 1692622 - RNA, 13 nt, Homo sapiens
cuaauuaggguac

SEQ ID NO: 1692623 - RNA, 19 nt, Homo sapiens
cuaauuaggguacauuuau

SEQ ID NO: 1692624 - RNA, 16 nt, Homo sapiens
cuaauuccauccauaa

SEQ ID NO: 1692625 - RNA, 23 nt, Homo sapiens
cuaauugucuuuguucugugauu

SEQ ID NO: 1692626 - RNA, 13 nt, Homo sapiens
cuggauccaucag

SEQ ID NO: 1692627 - RNA, 24 nt, Homo sapiens
cuggaugauacgaaugaugucaga

SEQ ID NO: 1692628 - RNA, 19 nt, Homo sapiens
cuggauuucugguucugau

SEQ ID NO: 1692629 - RNA, 17 nt, Homo sapiens
cuggcagggcccaguga

SEQ ID NO: 1692630 - RNA, 19 nt, Homo sapiens
cuggcauuugcaccuaccu

SEQ ID NO: 1692631 - RNA, 15 nt, Homo sapiens
cuggccacagacucc

SEQ ID NO: 1692632 - RNA, 23 nt, Homo sapiens
cuggccaguuggaaccacggaga

SEQ ID NO: 1692633 - RNA, 16 nt, Homo sapiens
cuggccauauuuacua

SEQ ID NO: 1692634 - RNA, 14 nt, Homo sapiens
cuggcccaaccaga

SEQ ID NO: 1692635 - RNA, 14 nt, Homo sapiens
cuggcccagccaaa

SEQ ID NO: 1692636 - RNA, 21 nt, Homo sapiens
cuggccuuuccugguuuucau

SEQ ID NO: 1692637 - RNA, 16 nt, Homo sapiens
cuggcgacugccccug

SEQ ID NO: 1692638 - RNA, 22 nt, Homo sapiens
cuggcuagaguccucacuccca

SEQ ID NO: 1692639 - RNA, 19 nt, Homo sapiens
cuggcuuauuuuaauguga

SEQ ID NO: 1692640 - RNA, 13 nt, Homo sapiens
cugggaaggugac

SEQ ID NO: 1692641 - RNA, 19 nt, Homo sapiens
cugggagggggcgggaaau

SEQ ID NO: 1692642 - RNA, 23 nt, Homo sapiens
cugggauuacaggcgugagccac

SEQ ID NO: 1692643 - RNA, 15 nt, Homo sapiens
cugggauuacaggug

SEQ ID NO: 1692644 - RNA, 22 nt, Homo sapiens
cugggcagcauagcaagacaca

SEQ ID NO: 1692645 - RNA, 14 nt, Homo sapiens
cugggccaugucca

SEQ ID NO: 1692646 - RNA, 16 nt, Homo sapiens
cugggcccaagacaga

SEQ ID NO: 1692647 - RNA, 18 nt, Homo sapiens
cugggcgucuaugcugcu

SEQ ID NO: 1692648 - RNA, 20 nt, Homo sapiens
cuggggccuacagcuuugau

SEQ ID NO: 1692649 - RNA, 16 nt, Homo sapiens
cuggggucuccgaaga

SEQ ID NO: 1692650 - RNA, 21 nt, Homo sapiens
cugggucugcuggcuucuaca

SEQ ID NO: 1692651 - RNA, 20 nt, Homo sapiens
cuggguucccuuuccuucca

SEQ ID NO: 1692652 - RNA, 21 nt, Homo sapiens
cugguaacaguucauguuugc

SEQ ID NO: 1692653 - RNA, 20 nt, Homo sapiens
cugguauauguaaguguuca

SEQ ID NO: 1692654 - RNA, 15 nt, Homo sapiens
cuggucucaaacucc

SEQ ID NO: 1692655 - RNA, 23 nt, Homo sapiens
cuggucucaaacuccugggcuca

SEQ ID NO: 1692656 - RNA, 13 nt, Homo sapiens
cuggucuugugga

SEQ ID NO: 1692657 - RNA, 19 nt, Homo sapiens
cugguggggaucagacaga

SEQ ID NO: 1692658 - RNA, 18 nt, Homo sapiens
cuggugguggcaccaucu

SEQ ID NO: 1692659 - RNA, 21 nt, Homo sapiens
cugguguuuuacuacacucca

SEQ ID NO: 1692660 - RNA, 15 nt, Homo sapiens
cuguaaagugccuua

SEQ ID NO: 1692661 - RNA, 21 nt, Homo sapiens
cuguaaauaccauugacacau

SEQ ID NO: 1692662 - RNA, 12 nt, Homo sapiens
cuguaaauaugu

SEQ ID NO: 1692663 - RNA, 17 nt, Homo sapiens
cuguaccgacuuugaua

SEQ ID NO: 1692664 - RNA, 16 nt, Homo sapiens
cuguacugacuugagg

SEQ ID NO: 1692665 - RNA, 22 nt, Homo sapiens
cuguagaaugauuucaugcuau

SEQ ID NO: 1692666 - RNA, 16 nt, Homo sapiens
cuguagauaaaguggu

SEQ ID NO: 1692667 - RNA, 20 nt, Homo sapiens
cuguagauaaagugguuuga

SEQ ID NO: 1692668 - RNA, 13 nt, Homo sapiens
cuguauacuuuag

SEQ ID NO: 1692669 - RNA, 14 nt, Homo sapiens
cuguaugaacuuua

SEQ ID NO: 1692670 - RNA, 16 nt, Homo sapiens
cuguaugaacuuuauc

SEQ ID NO: 1692671 - RNA, 15 nt, Homo sapiens
cugucaaagcuguca

SEQ ID NO: 1692672 - RNA, 15 nt, Homo sapiens
cugucagaaugcuau

SEQ ID NO: 1692673 - RNA, 16 nt, Homo sapiens
cugucauuuguuguga

SEQ ID NO: 1692674 - RNA, 17 nt, Homo sapiens
cuguccacugggccauu

SEQ ID NO: 1692675 - RNA, 17 nt, Homo sapiens
cugucccaccugcacac

SEQ ID NO: 1692676 - RNA, 18 nt, Homo sapiens
cuguccugaccaucgcac

SEQ ID NO: 1692677 - RNA, 17 nt, Homo sapiens
cuguccugaucugugau

SEQ ID NO: 1692678 - RNA, 17 nt, Homo sapiens
cugucucugaaguacua

SEQ ID NO: 1692679 - RNA, 13 nt, Homo sapiens
cugucucuuuaag

SEQ ID NO: 1692680 - RNA, 15 nt, Homo sapiens
cugucugggggccag

SEQ ID NO: 1692681 - RNA, 21 nt, Homo sapiens
cugugaaaguacauuuggaga

SEQ ID NO: 1692682 - RNA, 21 nt, Homo sapiens
cugugaaaugcuggcauuugc

SEQ ID NO: 1692683 - RNA, 22 nt, Homo sapiens
cugugaaaugcuggcauuugca

SEQ ID NO: 1692684 - RNA, 18 nt, Homo sapiens
cugugaaauucacaguaa

SEQ ID NO: 1692685 - RNA, 18 nt, Homo sapiens
cugugacuucuccagguc

SEQ ID NO: 1692686 - RNA, 18 nt, Homo sapiens
cugugaggccccuggaca

SEQ ID NO: 1692687 - RNA, 22 nt, Homo sapiens
cugugaggccccuggacaagca

SEQ ID NO: 1692688 - RNA, 16 nt, Homo sapiens
cugugcaguagcauca

SEQ ID NO: 1692689 - RNA, 13 nt, Homo sapiens
cuguggaaugagu

SEQ ID NO: 1692690 - RNA, 20 nt, Homo sapiens
cuguggaaugagugugcaug

SEQ ID NO: 1692691 - RNA, 13 nt, Homo sapiens
cuguggaugcuuc

SEQ ID NO: 1692692 - RNA, 19 nt, Homo sapiens
cuguggcuucccaugucuu

SEQ ID NO: 1692693 - RNA, 16 nt, Homo sapiens
cugugguuaacaucuc

SEQ ID NO: 1692694 - RNA, 17 nt, Homo sapiens
cugugguuaacaucuca

SEQ ID NO: 1692695 - RNA, 18 nt, Homo sapiens
cuguguauauuauuuggc

SEQ ID NO: 1692696 - RNA, 15 nt, Homo sapiens
cuguuaauauucuau

SEQ ID NO: 1692697 - RNA, 17 nt, Homo sapiens
cuguuacugaaaguggu

SEQ ID NO: 1692698 - RNA, 20 nt, Homo sapiens
cuguuauguacuguacuaau

SEQ ID NO: 1692699 - RNA, 14 nt, Homo sapiens
cuguuauuaacaaa

SEQ ID NO: 1692700 - RNA, 14 nt, Homo sapiens
cuguucugcacuga

SEQ ID NO: 1692701 - RNA, 12 nt, Homo sapiens
cuguucuuccuc

SEQ ID NO: 1692702 - RNA, 22 nt, Homo sapiens
cuguucuugcuacccaugacuu

SEQ ID NO: 1692703 - RNA, 19 nt, Homo sapiens
cuguugagacugauucaga

SEQ ID NO: 1692704 - RNA, 22 nt, Homo sapiens
cuguugauguaucugaguugcc

SEQ ID NO: 1692705 - RNA, 16 nt, Homo sapiens
cuguuggccaguguga

SEQ ID NO: 1692706 - RNA, 17 nt, Homo sapiens
cuguuggcucacagggc

SEQ ID NO: 1692707 - RNA, 14 nt, Homo sapiens
cuguuuaacauuuc

SEQ ID NO: 1692708 - RNA, 21 nt, Homo sapiens
cuguuuuauaaugaacccauc

SEQ ID NO: 1692709 - RNA, 20 nt, Homo sapiens
cuguuuuguaagugcugcua

SEQ ID NO: 1692710 - RNA, 19 nt, Homo sapiens
cuuaaaauguaagauuaua

SEQ ID NO: 1692711 - RNA, 22 nt, Homo sapiens
cuuaaagcccgccugacagaaa

SEQ ID NO: 1692712 - RNA, 21 nt, Homo sapiens
cuuaaaggcaccaucuaauag

SEQ ID NO: 1692713 - RNA, 17 nt, Homo sapiens
cuuaaaucucacucuag

SEQ ID NO: 1692714 - RNA, 22 nt, Homo sapiens
cuuaaaugaucugccucuaaaa

SEQ ID NO: 1692715 - RNA, 22 nt, Homo sapiens
cuuaaauguagcaauggcacug

SEQ ID NO: 1692716 - RNA, 13 nt, Homo sapiens
cuuaacacauuca

SEQ ID NO: 1692717 - RNA, 16 nt, Homo sapiens
cuuaacacauucaaua

SEQ ID NO: 1692718 - RNA, 18 nt, Homo sapiens
cuuaacacuaucauggac

SEQ ID NO: 1692719 - RNA, 17 nt, Homo sapiens
cuuaagauuuugcaccu

SEQ ID NO: 1692720 - RNA, 20 nt, Homo sapiens
cuuaaggaagaagaguauua

SEQ ID NO: 1692721 - RNA, 12 nt, Homo sapiens
cuuaagugccua

SEQ ID NO: 1692722 - RNA, 18 nt, Homo sapiens
cuuaauacuaccuugaaa

SEQ ID NO: 1692723 - RNA, 20 nt, Homo sapiens
cuuacaauuggcacuaaaga

SEQ ID NO: 1692724 - RNA, 14 nt, Homo sapiens
cuuaccgcucuguu

SEQ ID NO: 1692725 - RNA, 18 nt, Homo sapiens
cuuacuaagcauagcaaa

SEQ ID NO: 1692726 - RNA, 14 nt, Homo sapiens
cuuacuauuacaua

SEQ ID NO: 1692727 - RNA, 16 nt, Homo sapiens
cuuacucuaagaucuu

SEQ ID NO: 1692728 - RNA, 14 nt, Homo sapiens
cuuacuguaacgga

SEQ ID NO: 1692729 - RNA, 21 nt, Homo sapiens
cuuagaaauguaaacugccau

SEQ ID NO: 1692730 - RNA, 15 nt, Homo sapiens
cuuagagacuaucaa

SEQ ID NO: 1692731 - RNA, 13 nt, Homo sapiens
cuuagcauguccc

SEQ ID NO: 1692732 - RNA, 18 nt, Homo sapiens
cuuaggcccuagcggcag

SEQ ID NO: 1692733 - RNA, 13 nt, Homo sapiens
cuuaguaucucau

SEQ ID NO: 1692734 - RNA, 16 nt, Homo sapiens
cuuauauuucccuaaa

SEQ ID NO: 1692735 - RNA, 22 nt, Homo sapiens
cuuaucauuagaaucuuaccuu

SEQ ID NO: 1692736 - RNA, 17 nt, Homo sapiens
gaccacugggcaaugau

SEQ ID NO: 1692737 - RNA, 15 nt, Homo sapiens
gaccacuuccagggg

SEQ ID NO: 1692738 - RNA, 15 nt, Homo sapiens
gaccauucauaccca

SEQ ID NO: 1692739 - RNA, 17 nt, Homo sapiens
gaccauuguaacaauag

SEQ ID NO: 1692740 - RNA, 14 nt, Homo sapiens
gacccacagacugg

SEQ ID NO: 1692741 - RNA, 14 nt, Homo sapiens
gaccccuccucacu

SEQ ID NO: 1692742 - RNA, 20 nt, Homo sapiens
gaccccuccucacuggccau

SEQ ID NO: 1692743 - RNA, 15 nt, Homo sapiens
gaccccugaccucac

SEQ ID NO: 1692744 - RNA, 21 nt, Homo sapiens
gacccuacuucuuuugcucuu

SEQ ID NO: 1692745 - RNA, 15 nt, Homo sapiens
gacccuagcucuuuc

SEQ ID NO: 1692746 - RNA, 15 nt, Homo sapiens
gacccugccacucuc

SEQ ID NO: 1692747 - RNA, 17 nt, Homo sapiens
gaccggugcaugaugcu

SEQ ID NO: 1692748 - RNA, 13 nt, Homo sapiens
gaccuacuguucu

SEQ ID NO: 1692749 - RNA, 15 nt, Homo sapiens
gaccuagagacuuca

SEQ ID NO: 1692750 - RNA, 14 nt, Homo sapiens
gaccuaggcucaug

SEQ ID NO: 1692751 - RNA, 15 nt, Homo sapiens
gaccucaagugaucu

SEQ ID NO: 1692752 - RNA, 18 nt, Homo sapiens
gaccucugccugaaguca

SEQ ID NO: 1692753 - RNA, 23 nt, Homo sapiens
gaccucuuccuccucgcugccag

SEQ ID NO: 1692754 - RNA, 16 nt, Homo sapiens
gaccugagccagaccu

SEQ ID NO: 1692755 - RNA, 20 nt, Homo sapiens
gaccugagucugcaugugca

SEQ ID NO: 1692756 - RNA, 16 nt, Homo sapiens
gaccugccuccugccu

SEQ ID NO: 1692757 - RNA, 17 nt, Homo sapiens
gaccuggagacugacaa

SEQ ID NO: 1692758 - RNA, 23 nt, Homo sapiens
gaccuggagacugacaaccucau

SEQ ID NO: 1692759 - RNA, 18 nt, Homo sapiens
gaccuuaggccuuccucu

SEQ ID NO: 1692760 - RNA, 13 nt, Homo sapiens
gacgacagaugcu

SEQ ID NO: 1692761 - RNA, 23 nt, Homo sapiens
gacgcacggcauuagcuuccugc

SEQ ID NO: 1692762 - RNA, 21 nt, Homo sapiens
gacggguuggggccgggcaca

SEQ ID NO: 1692763 - RNA, 18 nt, Homo sapiens
gacgguuaaauacugugu

SEQ ID NO: 1692764 - RNA, 20 nt, Homo sapiens
gacguggagcgggguaugaa

SEQ ID NO: 1692765 - RNA, 15 nt, Homo sapiens
gacuaagcauugagc

SEQ ID NO: 1692766 - RNA, 14 nt, Homo sapiens
gacuaauuucaaaa

SEQ ID NO: 1692767 - RNA, 22 nt, Homo sapiens
gacuaauuucaaaaugcuuuuu

SEQ ID NO: 1692768 - RNA, 15 nt, Homo sapiens
gacuacuauuuucuu

SEQ ID NO: 1692769 - RNA, 16 nt, Homo sapiens
gacuagaugauggaug

SEQ ID NO: 1692770 - RNA, 17 nt, Homo sapiens
gacuauauacaugugug

SEQ ID NO: 1692771 - RNA, 21 nt, Homo sapiens
gacuauauacauguguguaua

SEQ ID NO: 1692772 - RNA, 12 nt, Homo sapiens
gacuauggagcc

SEQ ID NO: 1692773 - RNA, 17 nt, Homo sapiens
gacuauuaggugcaauu

SEQ ID NO: 1692774 - RNA, 17 nt, Homo sapiens
gacucaggccagugugu

SEQ ID NO: 1692775 - RNA, 13 nt, Homo sapiens
gacucccacaaca

SEQ ID NO: 1692776 - RNA, 20 nt, Homo sapiens
gacucugcacaugucuugua

SEQ ID NO: 1692777 - RNA, 21 nt, Homo sapiens
gacucuggggaggugaacugg

SEQ ID NO: 1692778 - RNA, 17 nt, Homo sapiens
gacucuugcagggguag

SEQ ID NO: 1692779 - RNA, 14 nt, Homo sapiens
gacugaaaauauau

SEQ ID NO: 1692780 - RNA, 15 nt, Homo sapiens
gacugacaaccucau

SEQ ID NO: 1692781 - RNA, 18 nt, Homo sapiens
gacugauacugcagugac

SEQ ID NO: 1692782 - RNA, 14 nt, Homo sapiens
gacugcaacaggcu

SEQ ID NO: 1692783 - RNA, 15 nt, Homo sapiens
gacugccgcugagaa

SEQ ID NO: 1692784 - RNA, 13 nt, Homo sapiens
gacugcuaguguu

SEQ ID NO: 1692785 - RNA, 21 nt, Homo sapiens
gacuggaaguucauaccuaag

SEQ ID NO: 1692786 - RNA, 14 nt, Homo sapiens
gacugugcuacugu

SEQ ID NO: 1692787 - RNA, 17 nt, Homo sapiens
gacuuaguugcguuaca

SEQ ID NO: 1692788 - RNA, 22 nt, Homo sapiens
gacuucaugacaagcauuuugu

SEQ ID NO: 1692789 - RNA, 20 nt, Homo sapiens
gacuucauugucccucuuca

SEQ ID NO: 1692790 - RNA, 14 nt, Homo sapiens
gacuuccacuuugu

SEQ ID NO: 1692791 - RNA, 15 nt, Homo sapiens
gacuuccagugcuca

SEQ ID NO: 1692792 - RNA, 22 nt, Homo sapiens
gacuuccccucaacaugcugcc

SEQ ID NO: 1692793 - RNA, 21 nt, Homo sapiens
gacuugaaugugcaccugagg

SEQ ID NO: 1692794 - RNA, 14 nt, Homo sapiens
gacuugauagcaaa

SEQ ID NO: 1692795 - RNA, 20 nt, Homo sapiens
gacuuguuuuaugcucaggg

SEQ ID NO: 1692796 - RNA, 14 nt, Homo sapiens
gagaaaagccucuc

SEQ ID NO: 1692797 - RNA, 15 nt, Homo sapiens
gagaaauacuuucag

SEQ ID NO: 1692798 - RNA, 16 nt, Homo sapiens
gagaaauuucugugaa

SEQ ID NO: 1692799 - RNA, 22 nt, Homo sapiens
gagaacgcggggaccccagaaa

SEQ ID NO: 1692800 - RNA, 14 nt, Homo sapiens
gagaagcugcugac

SEQ ID NO: 1692801 - RNA, 18 nt, Homo sapiens
gagaaggguugauccugc

SEQ ID NO: 1692802 - RNA, 21 nt, Homo sapiens
gagacaccaaccgacaggccc

SEQ ID NO: 1692803 - RNA, 22 nt, Homo sapiens
gagacagcugauacuucauuua

SEQ ID NO: 1692804 - RNA, 22 nt, Homo sapiens
gagacccaagggcagagcauuu

SEQ ID NO: 1692805 - RNA, 14 nt, Homo sapiens
gagaccguccucac

SEQ ID NO: 1692806 - RNA, 15 nt, Homo sapiens
gagaccguccucacc

SEQ ID NO: 1692807 - RNA, 13 nt, Homo sapiens
gagaccugagucu

SEQ ID NO: 1692808 - RNA, 13 nt, Homo sapiens
gagacugggucuc

SEQ ID NO: 1692809 - RNA, 14 nt, Homo sapiens
gagagaaagccagg

SEQ ID NO: 1692810 - RNA, 14 nt, Homo sapiens
gagagagaugacaa

SEQ ID NO: 1692811 - RNA, 14 nt, Homo sapiens
gagaggaagccuga

SEQ ID NO: 1692812 - RNA, 14 nt, Homo sapiens
gagaggaugugcaa

SEQ ID NO: 1692813 - RNA, 22 nt, Homo sapiens
gagaggcccugggguucucccc

SEQ ID NO: 1692814 - RNA, 18 nt, Homo sapiens
gagaggccuuuuggaaug

SEQ ID NO: 1692815 - RNA, 14 nt, Homo sapiens
gagaguuucuguua

SEQ ID NO: 1692816 - RNA, 16 nt, Homo sapiens
gagaguuuugucuuga

SEQ ID NO: 1692817 - RNA, 16 nt, Homo sapiens
gagauauuugguacca

SEQ ID NO: 1692818 - RNA, 17 nt, Homo sapiens
gagauauuugguaccau

SEQ ID NO: 1692819 - RNA, 21 nt, Homo sapiens
gagaucacgccacugcacuau

SEQ ID NO: 1692820 - RNA, 14 nt, Homo sapiens
gagaugcuggagaa

SEQ ID NO: 1692821 - RNA, 16 nt, Homo sapiens
gagaugucaucagagc

SEQ ID NO: 1692822 - RNA, 12 nt, Homo sapiens
gagauuuccucc

SEQ ID NO: 1692823 - RNA, 21 nt, Homo sapiens
gagauuugucuaauugcaucu

SEQ ID NO: 1692824 - RNA, 18 nt, Homo sapiens
gagcaaauguggcuccug

SEQ ID NO: 1692825 - RNA, 16 nt, Homo sapiens
gagcacagaaggaaua

SEQ ID NO: 1692826 - RNA, 21 nt, Homo sapiens
gagcacaggucccaccuccag

SEQ ID NO: 1692827 - RNA, 20 nt, Homo sapiens
gagcaccuuugcacaggaug

SEQ ID NO: 1692828 - RNA, 13 nt, Homo sapiens
gagcacuuccaaa

SEQ ID NO: 1692829 - RNA, 21 nt, Homo sapiens
gagcagcuuuaaacucaggga

SEQ ID NO: 1692830 - RNA, 16 nt, Homo sapiens
gagcaggaacaaugac

SEQ ID NO: 1692831 - RNA, 22 nt, Homo sapiens
gagcauaauaaauuauauuaaa

SEQ ID NO: 1692832 - RNA, 18 nt, Homo sapiens
gagcaugggccuggccac

SEQ ID NO: 1692833 - RNA, 21 nt, Homo sapiens
gagcauuuaagagugaaguca

SEQ ID NO: 1692834 - RNA, 15 nt, Homo sapiens
gagccagcucccucu

SEQ ID NO: 1692835 - RNA, 21 nt, Homo sapiens
gagccagcuuggggccaccaa

SEQ ID NO: 1692836 - RNA, 16 nt, Homo sapiens
gagccaggacccagga

SEQ ID NO: 1692837 - RNA, 17 nt, Homo sapiens
gagccauuuugugaaug

SEQ ID NO: 1692838 - RNA, 18 nt, Homo sapiens
gagccccagggugcccag

SEQ ID NO: 1692839 - RNA, 17 nt, Homo sapiens
gagccccgcagaccucc

SEQ ID NO: 1692840 - RNA, 16 nt, Homo sapiens
gagccuccacugccuc

SEQ ID NO: 1692841 - RNA, 16 nt, Homo sapiens
gagccuggcacaggac

SEQ ID NO: 1692842 - RNA, 20 nt, Homo sapiens
gagccuuggcuguuggcagu

SEQ ID NO: 1692843 - RNA, 20 nt, Homo sapiens
gagcuggccucucuagcaca

SEQ ID NO: 1692844 - RNA, 18 nt, Homo sapiens
gagcuuccuucugugaaa

SEQ ID NO: 1692845 - RNA, 20 nt, Homo sapiens
gagcuuuuaaaaauguccug

SEQ ID NO: 1692846 - RNA, 13 nt, Homo sapiens
uaucgaucucuua

SEQ ID NO: 1692847 - RNA, 17 nt, Homo sapiens
uaucggcucacaaagag

SEQ ID NO: 1692848 - RNA, 20 nt, Homo sapiens
uaucuaauauauaugaauaa

SEQ ID NO: 1692849 - RNA, 21 nt, Homo sapiens
uaucuauaguagacacacuau

SEQ ID NO: 1692850 - RNA, 22 nt, Homo sapiens
uaucucaggggccaacuaggca

SEQ ID NO: 1692851 - RNA, 14 nt, Homo sapiens
uaucugaauggaag

SEQ ID NO: 1692852 - RNA, 22 nt, Homo sapiens
uaucugugaaaugcuggcauuu

SEQ ID NO: 1692853 - RNA, 14 nt, Homo sapiens
uaucuguucuugcu

SEQ ID NO: 1692854 - RNA, 21 nt, Homo sapiens
uaucuuagugaauuuagucau

SEQ ID NO: 1692855 - RNA, 20 nt, Homo sapiens
uaucuuccaaaugcaauuug

SEQ ID NO: 1692856 - RNA, 16 nt, Homo sapiens
uaucuugauaaacuag

SEQ ID NO: 1692857 - RNA, 16 nt, Homo sapiens
uaugaaauccuugacu

SEQ ID NO: 1692858 - RNA, 16 nt, Homo sapiens
uaugacgcugauacau

SEQ ID NO: 1692859 - RNA, 18 nt, Homo sapiens
uaugagggaaaaugagua

SEQ ID NO: 1692860 - RNA, 16 nt, Homo sapiens
uaugauauauugcugu

SEQ ID NO: 1692861 - RNA, 14 nt, Homo sapiens
uaugaugaaaaccu

SEQ ID NO: 1692862 - RNA, 18 nt, Homo sapiens
uaugauguguugugauag

SEQ ID NO: 1692863 - RNA, 19 nt, Homo sapiens
uaugauuguuucucaaauc

SEQ ID NO: 1692864 - RNA, 16 nt, Homo sapiens
uaugcaauuagguuuu

SEQ ID NO: 1692865 - RNA, 21 nt, Homo sapiens
uaugcaccuugugucuguaca

SEQ ID NO: 1692866 - RNA, 14 nt, Homo sapiens
uaugcagaauguuu

SEQ ID NO: 1692867 - RNA, 22 nt, Homo sapiens
uaugcaguaaauuaucuuggga

SEQ ID NO: 1692868 - RNA, 23 nt, Homo sapiens
uaugcauuaagaguaaaauuccu

SEQ ID NO: 1692869 - RNA, 17 nt, Homo sapiens
uaugccaauaaaguuug

SEQ ID NO: 1692870 - RNA, 14 nt, Homo sapiens
uaugccuucacuuu

SEQ ID NO: 1692871 - RNA, 14 nt, Homo sapiens
uaugcugugcuaaa

SEQ ID NO: 1692872 - RNA, 19 nt, Homo sapiens
uaugcuuggcuaacuauau

SEQ ID NO: 1692873 - RNA, 14 nt, Homo sapiens
uauggacucugcac

SEQ ID NO: 1692874 - RNA, 15 nt, Homo sapiens
uauggacucugcaca

SEQ ID NO: 1692875 - RNA, 14 nt, Homo sapiens
uauguacaugagaa

SEQ ID NO: 1692876 - RNA, 12 nt, Homo sapiens
uauguaccauau

SEQ ID NO: 1692877 - RNA, 16 nt, Homo sapiens
uauguacuguacuaau

SEQ ID NO: 1692878 - RNA, 13 nt, Homo sapiens
uauguacuuuuau

SEQ ID NO: 1692879 - RNA, 15 nt, Homo sapiens
uauguagauauuugg

SEQ ID NO: 1692880 - RNA, 16 nt, Homo sapiens
uauguauuugcaguuc

SEQ ID NO: 1692881 - RNA, 19 nt, Homo sapiens
uaugucacuagaauggaua

SEQ ID NO: 1692882 - RNA, 20 nt, Homo sapiens
uauguggacguaaucuccac

SEQ ID NO: 1692883 - RNA, 12 nt, Homo sapiens
uauguugcccag

SEQ ID NO: 1692884 - RNA, 17 nt, Homo sapiens
uauguuuacuucucacc

SEQ ID NO: 1692885 - RNA, 15 nt, Homo sapiens
uauuaaaacauugga

SEQ ID NO: 1692886 - RNA, 13 nt, Homo sapiens
uauuagcuuauau

SEQ ID NO: 1692887 - RNA, 19 nt, Homo sapiens
uauuauaaacuguaugcuc

SEQ ID NO: 1692888 - RNA, 13 nt, Homo sapiens
uauuauaagcauu

SEQ ID NO: 1692889 - RNA, 14 nt, Homo sapiens
uauucaaaaccuca

SEQ ID NO: 1692890 - RNA, 14 nt, Homo sapiens
uauucaagcacuua

SEQ ID NO: 1692891 - RNA, 10 nt, Homo sapiens
uauucauugg

SEQ ID NO: 1692892 - RNA, 16 nt, Homo sapiens
uauucuaaaaccauuc

SEQ ID NO: 1692893 - RNA, 22 nt, Homo sapiens
uauucuguuggccagugugaca

SEQ ID NO: 1692894 - RNA, 14 nt, Homo sapiens
uauucuugucaaaa

SEQ ID NO: 1692895 - RNA, 16 nt, Homo sapiens
uauugcaagaguuuaa

SEQ ID NO: 1692896 - RNA, 21 nt, Homo sapiens
uauugccgccagaagauccaa

SEQ ID NO: 1692897 - RNA, 14 nt, Homo sapiens
uauuguacauaaaa

SEQ ID NO: 1692898 - RNA, 23 nt, Homo sapiens
uauugucauaggauuaagcaguu

SEQ ID NO: 1692899 - RNA, 19 nt, Homo sapiens
uauugugccaauauguauu

SEQ ID NO: 1692900 - RNA, 23 nt, Homo sapiens
uauuuaaaaugcauaauucacau

SEQ ID NO: 1692901 - RNA, 18 nt, Homo sapiens
uauuuaaagccuccucau

SEQ ID NO: 1692902 - RNA, 14 nt, Homo sapiens
uauuuaaguucaua

SEQ ID NO: 1692903 - RNA, 18 nt, Homo sapiens
uauuuagacucaucuuac

SEQ ID NO: 1692904 - RNA, 22 nt, Homo sapiens
uauuuagaucuagaaacagauc

SEQ ID NO: 1692905 - RNA, 17 nt, Homo sapiens
uauuuauaaaugagcaa

SEQ ID NO: 1692906 - RNA, 18 nt, Homo sapiens
uauuuauaaaugagcaaa

SEQ ID NO: 1692907 - RNA, 16 nt, Homo sapiens
uauuuauccacuacuc

SEQ ID NO: 1692908 - RNA, 15 nt, Homo sapiens
uauuuaugugugagg

SEQ ID NO: 1692909 - RNA, 19 nt, Homo sapiens
uauuuccauucaacaagag

SEQ ID NO: 1692910 - RNA, 13 nt, Homo sapiens
uauuugcaauauu

SEQ ID NO: 1692911 - RNA, 24 nt, Homo sapiens
uauuugcuuuuugcuaacaaugcu

SEQ ID NO: 1692912 - RNA, 13 nt, Homo sapiens
uauuuuaagcacu

SEQ ID NO: 1692913 - RNA, 21 nt, Homo sapiens
uauuuucagccuacaguuaug

SEQ ID NO: 1692914 - RNA, 19 nt, Homo sapiens
uauuuucuuuucuuucaac

SEQ ID NO: 1692915 - RNA, 17 nt, Homo sapiens
uauuuuggucacagggu

SEQ ID NO: 1692916 - RNA, 17 nt, Homo sapiens
uauuuuguaaugcugca

SEQ ID NO: 1692917 - RNA, 19 nt, Homo sapiens
uauuuuguauuauugcugu

SEQ ID NO: 1692918 - RNA, 16 nt, Homo sapiens
uauuuuuagacagagu

SEQ ID NO: 1692919 - RNA, 23 nt, Homo sapiens
ucaaaaaagaaaaaagaaaagaa

SEQ ID NO: 1692920 - RNA, 13 nt, Homo sapiens
ucaaaaauacaaa

SEQ ID NO: 1692921 - RNA, 16 nt, Homo sapiens
ucaaaaauauuugcug

SEQ ID NO: 1692922 - RNA, 23 nt, Homo sapiens
ucaaaaauuaucuauagcuaagu

SEQ ID NO: 1692923 - RNA, 18 nt, Homo sapiens
ucaaaagccagaugugaa

SEQ ID NO: 1692924 - RNA, 18 nt, Homo sapiens
ucaaaauaaaaagugaca

SEQ ID NO: 1692925 - RNA, 24 nt, Homo sapiens
ucaaaaugucuaagauaguaacaa

SEQ ID NO: 1692926 - RNA, 19 nt, Homo sapiens
ucaaacagggcaaaguguu

SEQ ID NO: 1692927 - RNA, 18 nt, Homo sapiens
ucaaaccccgaccaccug

SEQ ID NO: 1692928 - RNA, 21 nt, Homo sapiens
ucaaacugcaugauucaugcc

SEQ ID NO: 1692929 - RNA, 12 nt, Homo sapiens
ucaaacugugaa

SEQ ID NO: 1692930 - RNA, 19 nt, Homo sapiens
ucaaagagguauauuugaa

SEQ ID NO: 1692931 - RNA, 23 nt, Homo sapiens
ucaaagauguguugcuauccuga

SEQ ID NO: 1692932 - RNA, 20 nt, Homo sapiens
ucaaagcacagaauuuguca

SEQ ID NO: 1692933 - RNA, 17 nt, Homo sapiens
ucaaaguacuacagcaa

SEQ ID NO: 1692934 - RNA, 13 nt, Homo sapiens
ucaaauauuucaa

SEQ ID NO: 1692935 - RNA, 15 nt, Homo sapiens
ucaaaucguccagcg

SEQ ID NO: 1692936 - RNA, 18 nt, Homo sapiens
ucaaaugggcugcugcuu

SEQ ID NO: 1692937 - RNA, 17 nt, Homo sapiens
ucaaauuggacuuucaa

SEQ ID NO: 1692938 - RNA, 18 nt, Homo sapiens
ucaaauuuuuacugagaa

SEQ ID NO: 1692939 - RNA, 14 nt, Homo sapiens
ucaacaagauuucc

SEQ ID NO: 1692940 - RNA, 12 nt, Homo sapiens
ucaacagaauug

SEQ ID NO: 1692941 - RNA, 16 nt, Homo sapiens
ucaacagcuaugcugg

SEQ ID NO: 1692942 - RNA, 19 nt, Homo sapiens
ucaacaugccauaucucau

SEQ ID NO: 1692943 - RNA, 21 nt, Homo sapiens
ucaaccuccugggcuaaguga

SEQ ID NO: 1692944 - RNA, 21 nt, Homo sapiens
ucaacuacuauucaaaaccuc

SEQ ID NO: 1692945 - RNA, 21 nt, Homo sapiens
ucaacugaggauguggcuuau

SEQ ID NO: 1692946 - RNA, 16 nt, Homo sapiens
ucaagaaaacaacuuc

SEQ ID NO: 1692947 - RNA, 15 nt, Homo sapiens
ucaagacaaugcacc

SEQ ID NO: 1692948 - RNA, 20 nt, Homo sapiens
ucaagccccacgaugacugc

SEQ ID NO: 1692949 - RNA, 16 nt, Homo sapiens
ucaagccugugcaaug

SEQ ID NO: 1692950 - RNA, 20 nt, Homo sapiens
ucaaggaguacaaugcccag

SEQ ID NO: 1692951 - RNA, 23 nt, Homo sapiens
ucaaggaguacuccaagacagag

SEQ ID NO: 1692952 - RNA, 21 nt, Homo sapiens
ucaagggcuagcaucccugag

SEQ ID NO: 1692953 - RNA, 17 nt, Homo sapiens
ucaagguucuaacccua

SEQ ID NO: 1692954 - RNA, 15 nt, Homo sapiens
ucaaguagaggcaau

SEQ ID NO: 1692955 - RNA, 18 nt, Homo sapiens
ucaagucaacaugcauau

SEQ ID NO: 1692956 - RNA, 14 nt, Homo sapiens
ucucauaauuccua

SEQ ID NO: 1692957 - RNA, 15 nt, Homo sapiens
ucucauuugucacac

SEQ ID NO: 1692958 - RNA, 20 nt, Homo sapiens
ucuccagcaauaauguuuuc

SEQ ID NO: 1692959 - RNA, 19 nt, Homo sapiens
ucuccaucccucuaaugag

SEQ ID NO: 1692960 - RNA, 20 nt, Homo sapiens
ucuccaucccucuaaugaga

SEQ ID NO: 1692961 - RNA, 21 nt, Homo sapiens
ucucccaccuuucgggccaug

SEQ ID NO: 1692962 - RNA, 12 nt, Homo sapiens
ucuccccagaau

SEQ ID NO: 1692963 - RNA, 22 nt, Homo sapiens
ucuccccaguguaugucuugua

SEQ ID NO: 1692964 - RNA, 16 nt, Homo sapiens
ucuccccgcuaaggaa

SEQ ID NO: 1692965 - RNA, 14 nt, Homo sapiens
ucuccccuccagcc

SEQ ID NO: 1692966 - RNA, 19 nt, Homo sapiens
ucucccuccccugccauuu

SEQ ID NO: 1692967 - RNA, 23 nt, Homo sapiens
ucucccuguuggucgguggguug

SEQ ID NO: 1692968 - RNA, 21 nt, Homo sapiens
ucucccuuugaagaaacuaua

SEQ ID NO: 1692969 - RNA, 13 nt, Homo sapiens
ucuccuacucacu

SEQ ID NO: 1692970 - RNA, 14 nt, Homo sapiens
ucuccuucugaaag

SEQ ID NO: 1692971 - RNA, 13 nt, Homo sapiens
ucuccuugcccua

SEQ ID NO: 1692972 - RNA, 12 nt, Homo sapiens
ucucgcaaaaac

SEQ ID NO: 1692973 - RNA, 23 nt, Homo sapiens
ucucuacaaacucccacuuguca

SEQ ID NO: 1692974 - RNA, 23 nt, Homo sapiens
ucucuacagugccaacuccucac

SEQ ID NO: 1692975 - RNA, 13 nt, Homo sapiens
ucucuagcacaau

SEQ ID NO: 1692976 - RNA, 22 nt, Homo sapiens
ucucuagcacaauuugcacuaa

SEQ ID NO: 1692977 - RNA, 21 nt, Homo sapiens
ucucugaacacaggcagcuuu

SEQ ID NO: 1692978 - RNA, 17 nt, Homo sapiens
ucucugaagcauguuuc

SEQ ID NO: 1692979 - RNA, 17 nt, Homo sapiens
ucucugucucagacuuu

SEQ ID NO: 1692980 - RNA, 23 nt, Homo sapiens
ucucuucccugcgccugugaugc

SEQ ID NO: 1692981 - RNA, 22 nt, Homo sapiens
ucucuuccucauauuucagcag

SEQ ID NO: 1692982 - RNA, 18 nt, Homo sapiens
ucugaauggaagaguguu

SEQ ID NO: 1692983 - RNA, 19 nt, Homo sapiens
ucugacuuaagcaaaagaa

SEQ ID NO: 1692984 - RNA, 14 nt, Homo sapiens
ucugagacucacag

SEQ ID NO: 1692985 - RNA, 14 nt, Homo sapiens
ucugaguaagcccu

SEQ ID NO: 1692986 - RNA, 20 nt, Homo sapiens
ucugaguaagcccucaggag

SEQ ID NO: 1692987 - RNA, 20 nt, Homo sapiens
ucugauuuuggccaucagga

SEQ ID NO: 1692988 - RNA, 20 nt, Homo sapiens
ucugcaaaaauggauauuau

SEQ ID NO: 1692989 - RNA, 24 nt, Homo sapiens
ucugcaccuuguccccucauagga

SEQ ID NO: 1692990 - RNA, 11 nt, Homo sapiens
ucugcacggga

SEQ ID NO: 1692991 - RNA, 23 nt, Homo sapiens
ucugcagggggugugucugcuca

SEQ ID NO: 1692992 - RNA, 12 nt, Homo sapiens
ucugcaucccag

SEQ ID NO: 1692993 - RNA, 16 nt, Homo sapiens
ucugccccagucguua

SEQ ID NO: 1692994 - RNA, 15 nt, Homo sapiens
ucugcccucauuacu

SEQ ID NO: 1692995 - RNA, 16 nt, Homo sapiens
ucugccucaccgcuuc

SEQ ID NO: 1692996 - RNA, 17 nt, Homo sapiens
ucugccugaagucacac

SEQ ID NO: 1692997 - RNA, 13 nt, Homo sapiens
ucugcggaucuca

SEQ ID NO: 1692998 - RNA, 18 nt, Homo sapiens
ucugcugacagacacagg

SEQ ID NO: 1692999 - RNA, 17 nt, Homo sapiens
ucugcugggccaccagc

SEQ ID NO: 1693000 - RNA, 19 nt, Homo sapiens
ucugcugggccaccagcca

SEQ ID NO: 1693001 - RNA, 23 nt, Homo sapiens
ucugcuuacugacuuaggcaaua

SEQ ID NO: 1693002 - RNA, 14 nt, Homo sapiens
ucuggaaaagcaaa

SEQ ID NO: 1693003 - RNA, 14 nt, Homo sapiens
ucuggaauugcuca

SEQ ID NO: 1693004 - RNA, 18 nt, Homo sapiens
ucuggccccugucauccu

SEQ ID NO: 1693005 - RNA, 20 nt, Homo sapiens
ucuggccuugaaaccaccuu

SEQ ID NO: 1693006 - RNA, 20 nt, Homo sapiens
ucugggaagcugagggcaaa

SEQ ID NO: 1693007 - RNA, 16 nt, Homo sapiens
ucugggcuauggacac

SEQ ID NO: 1693008 - RNA, 17 nt, Homo sapiens
ucuggggagcucaggaa

SEQ ID NO: 1693009 - RNA, 22 nt, Homo sapiens
ucugggguccauucucugaguc

SEQ ID NO: 1693010 - RNA, 23 nt, Homo sapiens
ucugggguccauucucugaguca

SEQ ID NO: 1693011 - RNA, 13 nt, Homo sapiens
ucuguaaauacca

SEQ ID NO: 1693012 - RNA, 18 nt, Homo sapiens
ucuguaaguaacuucaca

SEQ ID NO: 1693013 - RNA, 18 nt, Homo sapiens
ucuguacgucugacaggc

SEQ ID NO: 1693014 - RNA, 19 nt, Homo sapiens
ucuguagcuuguucccugu

SEQ ID NO: 1693015 - RNA, 20 nt, Homo sapiens
ucuguauugggguacaggaa

SEQ ID NO: 1693016 - RNA, 18 nt, Homo sapiens
ucugucacaccagccaua

SEQ ID NO: 1693017 - RNA, 13 nt, Homo sapiens
ucugucaccaacu

SEQ ID NO: 1693018 - RNA, 18 nt, Homo sapiens
ucugucaccaacugaagu

SEQ ID NO: 1693019 - RNA, 17 nt, Homo sapiens
ucugucucagacuuuug

SEQ ID NO: 1693020 - RNA, 14 nt, Homo sapiens
ucugucuuguaaua

SEQ ID NO: 1693021 - RNA, 14 nt, Homo sapiens
ucugugaaaguaca

SEQ ID NO: 1693022 - RNA, 16 nt, Homo sapiens
ucugugaccucaggca

SEQ ID NO: 1693023 - RNA, 18 nt, Homo sapiens
ucugugcccuacucauug

SEQ ID NO: 1693024 - RNA, 14 nt, Homo sapiens
ucuguggaugccag

SEQ ID NO: 1693025 - RNA, 15 nt, Homo sapiens
ucuguuaaaugaacu

SEQ ID NO: 1693026 - RNA, 18 nt, Homo sapiens
ucuguuauguacuguacu

SEQ ID NO: 1693027 - RNA, 16 nt, Homo sapiens
ucuguuauuaacaaac

SEQ ID NO: 1693028 - RNA, 19 nt, Homo sapiens
ucuguucuguuucaaggca

SEQ ID NO: 1693029 - RNA, 16 nt, Homo sapiens
ucuguugugugucaug

SEQ ID NO: 1693030 - RNA, 23 nt, Homo sapiens
ucuuaaauguagcaauggcacug

SEQ ID NO: 1693031 - RNA, 23 nt, Homo sapiens
ucuuaaauuugauuuacauauau

SEQ ID NO: 1693032 - RNA, 22 nt, Homo sapiens
ucuuaacuauaaauauguacaa

SEQ ID NO: 1693033 - RNA, 23 nt, Homo sapiens
ucuuacuguaccuguuccuuaga

SEQ ID NO: 1693034 - RNA, 17 nt, Homo sapiens
ucuuagcugucugcuca

SEQ ID NO: 1693035 - RNA, 14 nt, Homo sapiens
ucuucaaaauguau

SEQ ID NO: 1693036 - RNA, 17 nt, Homo sapiens
ucuucaaccucauugac

SEQ ID NO: 1693037 - RNA, 22 nt, Homo sapiens
ucuucaaccucauugacaagaa

SEQ ID NO: 1693038 - RNA, 15 nt, Homo sapiens
ucuucacugugguca

SEQ ID NO: 1693039 - RNA, 18 nt, Homo sapiens
ucuucagauacaaacugc

SEQ ID NO: 1693040 - RNA, 14 nt, Homo sapiens
ucuucauggccaua

SEQ ID NO: 1693041 - RNA, 17 nt, Homo sapiens
ucuucauuucauuguau

SEQ ID NO: 1693042 - RNA, 12 nt, Homo sapiens
ucuuccaugacc

SEQ ID NO: 1693043 - RNA, 11 nt, Homo sapiens
ucuucccuacc

SEQ ID NO: 1693044 - RNA, 13 nt, Homo sapiens
ucuucccuaccuc

SEQ ID NO: 1693045 - RNA, 14 nt, Homo sapiens
ucuucccuaccuca

SEQ ID NO: 1693046 - RNA, 17 nt, Homo sapiens
ucuuccuguuaauguau

SEQ ID NO: 1693047 - RNA, 16 nt, Homo sapiens
ucuucuaccauuugaa

SEQ ID NO: 1693048 - RNA, 23 nt, Homo sapiens
ucuucuccaggcuguaucccaug

SEQ ID NO: 1693049 - RNA, 20 nt, Homo sapiens
ucuucuccuaaaacuuuaaa

SEQ ID NO: 1693050 - RNA, 15 nt, Homo sapiens
ucuucuucauucuau

SEQ ID NO: 1693051 - RNA, 22 nt, Homo sapiens
ucuugaccucaggugauccacc

SEQ ID NO: 1693052 - RNA, 13 nt, Homo sapiens
ucuugcaaaagau

SEQ ID NO: 1693053 - RNA, 19 nt, Homo sapiens
ucuugcugcuagaacuuuu

SEQ ID NO: 1693054 - RNA, 19 nt, Homo sapiens
ucuugcuuucuaugcuguu

SEQ ID NO: 1693055 - RNA, 13 nt, Homo sapiens
ucuuggcaaaagc

SEQ ID NO: 1693056 - RNA, 17 nt, Homo sapiens
ucuugggauaguuccca

SEQ ID NO: 1693057 - RNA, 17 nt, Homo sapiens
ucuuggugaacacacau

SEQ ID NO: 1693058 - RNA, 17 nt, Homo sapiens
ucuuguauacacauaua

SEQ ID NO: 1693059 - RNA, 20 nt, Homo sapiens
ucuuguauacacauauauac

SEQ ID NO: 1693060 - RNA, 22 nt, Homo sapiens
ucuugucagacauaaagccaug

SEQ ID NO: 1693061 - RNA, 12 nt, Homo sapiens
ucuuguggucau

SEQ ID NO: 1693062 - RNA, 20 nt, Homo sapiens
ucuuguggucaucauggcca

SEQ ID NO: 1693063 - RNA, 21 nt, Homo sapiens
ucuuucuaaugcugauaugau

SEQ ID NO: 1693064 - RNA, 20 nt, Homo sapiens
ucuuugaagcugaaaauaua

SEQ ID NO: 1693065 - RNA, 20 nt, Homo sapiens
ucuuugcagacaggcaagca

SEQ ID NO: 1693066 - RNA, 20 nt, Homo sapiens
uggugcgcccugucucugug

SEQ ID NO: 1693067 - RNA, 15 nt, Homo sapiens
ugguggagaaccaca

SEQ ID NO: 1693068 - RNA, 13 nt, Homo sapiens
ugguuaugaaaga

SEQ ID NO: 1693069 - RNA, 14 nt, Homo sapiens
ugguucaggguugg

SEQ ID NO: 1693070 - RNA, 17 nt, Homo sapiens
ugguuuauugaauguga

SEQ ID NO: 1693071 - RNA, 18 nt, Homo sapiens
uguaaaaagaaaaaccac

SEQ ID NO: 1693072 - RNA, 17 nt, Homo sapiens
uguaaaacgcugucaaa

SEQ ID NO: 1693073 - RNA, 22 nt, Homo sapiens
uguaaacgacaagaauaauuca

SEQ ID NO: 1693074 - RNA, 21 nt, Homo sapiens
uguaacacuguccaucuugca

SEQ ID NO: 1693075 - RNA, 16 nt, Homo sapiens
uguaacuuauauugaa

SEQ ID NO: 1693076 - RNA, 17 nt, Homo sapiens
uguaaguuucaggugac

SEQ ID NO: 1693077 - RNA, 23 nt, Homo sapiens
uguaauaauugcucauaagcaau

SEQ ID NO: 1693078 - RNA, 22 nt, Homo sapiens
uguaaucaaggccagugcuaaa

SEQ ID NO: 1693079 - RNA, 22 nt, Homo sapiens
uguacauguguagccugugcau

SEQ ID NO: 1693080 - RNA, 14 nt, Homo sapiens
uguaccauaugauc

SEQ ID NO: 1693081 - RNA, 18 nt, Homo sapiens
uguacucaauggauuuga

SEQ ID NO: 1693082 - RNA, 19 nt, Homo sapiens
uguacucuggggugcugcc

SEQ ID NO: 1693083 - RNA, 18 nt, Homo sapiens
uguacugcauguuaccau

SEQ ID NO: 1693084 - RNA, 23 nt, Homo sapiens
uguacuguucugugucuuucaca

SEQ ID NO: 1693085 - RNA, 14 nt, Homo sapiens
uguagaacugagaa

SEQ ID NO: 1693086 - RNA, 20 nt, Homo sapiens
uguagaaugauuucaugcua

SEQ ID NO: 1693087 - RNA, 15 nt, Homo sapiens
uguagagaaaagcac

SEQ ID NO: 1693088 - RNA, 20 nt, Homo sapiens
uguagagauggggucucaca

SEQ ID NO: 1693089 - RNA, 22 nt, Homo sapiens
uguagcgccaguguaauccccc

SEQ ID NO: 1693090 - RNA, 16 nt, Homo sapiens
uguagcguguuuacau

SEQ ID NO: 1693091 - RNA, 17 nt, Homo sapiens
uguaggcaucaugcaug

SEQ ID NO: 1693092 - RNA, 18 nt, Homo sapiens
uguaguccuagccacuca

SEQ ID NO: 1693093 - RNA, 22 nt, Homo sapiens
uguauaagcacugaaaaacaac

SEQ ID NO: 1693094 - RNA, 20 nt, Homo sapiens
uguauaauuggaguagauau

SEQ ID NO: 1693095 - RNA, 20 nt, Homo sapiens
uguauaguuuugaauccuuu

SEQ ID NO: 1693096 - RNA, 17 nt, Homo sapiens
uguauauauauauacuu

SEQ ID NO: 1693097 - RNA, 23 nt, Homo sapiens
uguaugugagagauucugugauc

SEQ ID NO: 1693098 - RNA, 13 nt, Homo sapiens
uguaugugccauu

SEQ ID NO: 1693099 - RNA, 17 nt, Homo sapiens
uguauguguguagacaa

SEQ ID NO: 1693100 - RNA, 17 nt, Homo sapiens
uguauguuccucuauga

SEQ ID NO: 1693101 - RNA, 19 nt, Homo sapiens
uguauucuagcuaauguaa

SEQ ID NO: 1693102 - RNA, 14 nt, Homo sapiens
ugucaaaagccaga

SEQ ID NO: 1693103 - RNA, 12 nt, Homo sapiens
ugucacacaaaa

SEQ ID NO: 1693104 - RNA, 19 nt, Homo sapiens
ugucacauagagugaucuu

SEQ ID NO: 1693105 - RNA, 19 nt, Homo sapiens
ugucagaugagaacaaagc

SEQ ID NO: 1693106 - RNA, 17 nt, Homo sapiens
ugucagauuaccaguua

SEQ ID NO: 1693107 - RNA, 15 nt, Homo sapiens
ugucagcaauuuaac

SEQ ID NO: 1693108 - RNA, 21 nt, Homo sapiens
ugucaguauuauucuacuaua

SEQ ID NO: 1693109 - RNA, 23 nt, Homo sapiens
ugucauaggauuaagcaguuuaa

SEQ ID NO: 1693110 - RNA, 23 nt, Homo sapiens
ugucauuaaauggggcucacaaa

SEQ ID NO: 1693111 - RNA, 16 nt, Homo sapiens
ugucauuaauguguug

SEQ ID NO: 1693112 - RNA, 20 nt, Homo sapiens
ugucauucgcucccacauuc

SEQ ID NO: 1693113 - RNA, 15 nt, Homo sapiens
ugucauuguaaacaa

SEQ ID NO: 1693114 - RNA, 22 nt, Homo sapiens
uguccaucagccaggacaguca

SEQ ID NO: 1693115 - RNA, 17 nt, Homo sapiens
ugucccccaacuugaga

SEQ ID NO: 1693116 - RNA, 18 nt, Homo sapiens
ugucccccaacuugagau

SEQ ID NO: 1693117 - RNA, 15 nt, Homo sapiens
uguccccuccacugu

SEQ ID NO: 1693118 - RNA, 16 nt, Homo sapiens
uguccccuccacuguc

SEQ ID NO: 1693119 - RNA, 13 nt, Homo sapiens
uguccucagcauu

SEQ ID NO: 1693120 - RNA, 17 nt, Homo sapiens
uguccugaucugugaua

SEQ ID NO: 1693121 - RNA, 23 nt, Homo sapiens
ugucuacaccaaugcccaacugc

SEQ ID NO: 1693122 - RNA, 14 nt, Homo sapiens
ugucucagccuccc

SEQ ID NO: 1693123 - RNA, 18 nt, Homo sapiens
ugucuccuacuccugacu

SEQ ID NO: 1693124 - RNA, 21 nt, Homo sapiens
ugucuccuccccuucccccac

SEQ ID NO: 1693125 - RNA, 18 nt, Homo sapiens
ugucucuuuaaugucaca

SEQ ID NO: 1693126 - RNA, 14 nt, Homo sapiens
ugucugacaaccuc

SEQ ID NO: 1693127 - RNA, 17 nt, Homo sapiens
ugucugcucaguaauuu

SEQ ID NO: 1693128 - RNA, 16 nt, Homo sapiens
ugucuucaaacuguga

SEQ ID NO: 1693129 - RNA, 18 nt, Homo sapiens
ugucuuggacacuguaca

SEQ ID NO: 1693130 - RNA, 18 nt, Homo sapiens
ugucuuuguuguagugaa

SEQ ID NO: 1693131 - RNA, 18 nt, Homo sapiens
ugucuuuuuucacuacau

SEQ ID NO: 1693132 - RNA, 15 nt, Homo sapiens
ugugaaccaccacac

SEQ ID NO: 1693133 - RNA, 21 nt, Homo sapiens
ugugaagugaaugaaacacuc

SEQ ID NO: 1693134 - RNA, 18 nt, Homo sapiens
ugugaaguuugcuuugua

SEQ ID NO: 1693135 - RNA, 13 nt, Homo sapiens
ugugaauggauug

SEQ ID NO: 1693136 - RNA, 13 nt, Homo sapiens
ugugacacauaug

SEQ ID NO: 1693137 - RNA, 19 nt, Homo sapiens
ugugaccaacuguguugua

SEQ ID NO: 1693138 - RNA, 12 nt, Homo sapiens
ugugauaugauu

SEQ ID NO: 1693139 - RNA, 16 nt, Homo sapiens
ugugaucaucccaucu

SEQ ID NO: 1693140 - RNA, 22 nt, Homo sapiens
ugugauggauuggacguuguga

SEQ ID NO: 1693141 - RNA, 23 nt, Homo sapiens
ugugcaagcgacgacagaugcua

SEQ ID NO: 1693142 - RNA, 11 nt, Homo sapiens
ugugcacacac

SEQ ID NO: 1693143 - RNA, 20 nt, Homo sapiens
ugugcagguuuugaaaaugu

SEQ ID NO: 1693144 - RNA, 15 nt, Homo sapiens
ugugcgccuacagga

SEQ ID NO: 1693145 - RNA, 23 nt, Homo sapiens
ugugcucucuuuaaaucaagucc

SEQ ID NO: 1693146 - RNA, 11 nt, Homo sapiens
ugugcugccau

SEQ ID NO: 1693147 - RNA, 23 nt, Homo sapiens
uguggaacuuuuauuagauaaca

SEQ ID NO: 1693148 - RNA, 18 nt, Homo sapiens
uguggaguggguaaucca

SEQ ID NO: 1693149 - RNA, 13 nt, Homo sapiens
uguggcagagcca

SEQ ID NO: 1693150 - RNA, 15 nt, Homo sapiens
uguggccccaacaca

SEQ ID NO: 1693151 - RNA, 19 nt, Homo sapiens
ugugguaggccuuuuaaca

SEQ ID NO: 1693152 - RNA, 20 nt, Homo sapiens
uguggucaauccgaaguaug

SEQ ID NO: 1693153 - RNA, 13 nt, Homo sapiens
uguggucucagga

SEQ ID NO: 1693154 - RNA, 17 nt, Homo sapiens
ugugguuaacaucucag

SEQ ID NO: 1693155 - RNA, 23 nt, Homo sapiens
uguguaacacuguccaucuugca

SEQ ID NO: 1693156 - RNA, 22 nt, Homo sapiens
uguguaacuguaaaacauugaa

SEQ ID NO: 1693157 - RNA, 15 nt, Homo sapiens
uguguagccugugca

SEQ ID NO: 1693158 - RNA, 17 nt, Homo sapiens
uguguauauauguguau

SEQ ID NO: 1693159 - RNA, 13 nt, Homo sapiens
uguguauguguau

SEQ ID NO: 1693160 - RNA, 16 nt, Homo sapiens
ugugucuguacacgug

SEQ ID NO: 1693161 - RNA, 15 nt, Homo sapiens
ugugugaaaauguga

SEQ ID NO: 1693162 - RNA, 20 nt, Homo sapiens
uguguguauaagugcacaca

SEQ ID NO: 1693163 - RNA, 21 nt, Homo sapiens
uguguuccuuuuuaugaggca

SEQ ID NO: 1693164 - RNA, 13 nt, Homo sapiens
uguguucugucac

SEQ ID NO: 1693165 - RNA, 18 nt, Homo sapiens
uguguucugucaccaacu

SEQ ID NO: 1693166 - RNA, 22 nt, Homo sapiens
uguguucugucaccaacugaag

SEQ ID NO: 1693167 - RNA, 15 nt, Homo sapiens
uguuaaggaaacucu

SEQ ID NO: 1693168 - RNA, 17 nt, Homo sapiens
uguuauuuuucaaggaa

SEQ ID NO: 1693169 - RNA, 12 nt, Homo sapiens
uguucaaagcac

SEQ ID NO: 1693170 - RNA, 14 nt, Homo sapiens
uguucaaugcuaga

SEQ ID NO: 1693171 - RNA, 15 nt, Homo sapiens
uguucaaugguucug

SEQ ID NO: 1693172 - RNA, 18 nt, Homo sapiens
uguucuaauggcacuuau

SEQ ID NO: 1693173 - RNA, 14 nt, Homo sapiens
uguucuauuguggg

SEQ ID NO: 1693174 - RNA, 13 nt, Homo sapiens
uguucugggacac

SEQ ID NO: 1693175 - RNA, 16 nt, Homo sapiens
uguucugggacacagu

SEQ ID NO: 1693176 - RNA, 14 nt, Homo sapiens
uuccuuucugccac

SEQ ID NO: 1693177 - RNA, 18 nt, Homo sapiens
uuccuuuguguguacuca

SEQ ID NO: 1693178 - RNA, 21 nt, Homo sapiens
uuccuuuuaaaacacuuccau

SEQ ID NO: 1693179 - RNA, 18 nt, Homo sapiens
uucgaggacuacaaccaa

SEQ ID NO: 1693180 - RNA, 21 nt, Homo sapiens
uucgcgcccgccccugcagca

SEQ ID NO: 1693181 - RNA, 19 nt, Homo sapiens
uucggcagcuacucagagg

SEQ ID NO: 1693182 - RNA, 23 nt, Homo sapiens
uucguggggaacugcguggugcu

SEQ ID NO: 1693183 - RNA, 22 nt, Homo sapiens
uucuaaagauucuauaguucua

SEQ ID NO: 1693184 - RNA, 21 nt, Homo sapiens
uucuaaccuugaaugcugcca

SEQ ID NO: 1693185 - RNA, 23 nt, Homo sapiens
uucuaagacucaaauguucuaag

SEQ ID NO: 1693186 - RNA, 21 nt, Homo sapiens
uucuaagaugugauauucuaa

SEQ ID NO: 1693187 - RNA, 13 nt, Homo sapiens
uucuaagauucua

SEQ ID NO: 1693188 - RNA, 22 nt, Homo sapiens
uucuaagguccgguguucuaag

SEQ ID NO: 1693189 - RNA, 18 nt, Homo sapiens
uucuaaguauuuuauucc

SEQ ID NO: 1693190 - RNA, 14 nt, Homo sapiens
uucuaaugucuuca

SEQ ID NO: 1693191 - RNA, 20 nt, Homo sapiens
uucuacgggauggccagaga

SEQ ID NO: 1693192 - RNA, 21 nt, Homo sapiens
uucuagccuauuuaccugcag

SEQ ID NO: 1693193 - RNA, 15 nt, Homo sapiens
uucuauaaggccaua

SEQ ID NO: 1693194 - RNA, 15 nt, Homo sapiens
uucuaugcauuaaga

SEQ ID NO: 1693195 - RNA, 14 nt, Homo sapiens
uucuauuaacuuua

SEQ ID NO: 1693196 - RNA, 14 nt, Homo sapiens
uucuauugccuucu

SEQ ID NO: 1693197 - RNA, 18 nt, Homo sapiens
uucuauugccuucuuuga

SEQ ID NO: 1693198 - RNA, 21 nt, Homo sapiens
uucuauuuauauguacaugag

SEQ ID NO: 1693199 - RNA, 15 nt, Homo sapiens
uucucaaaguuuuga

SEQ ID NO: 1693200 - RNA, 22 nt, Homo sapiens
uucucaagcugagauugagcag

SEQ ID NO: 1693201 - RNA, 13 nt, Homo sapiens
uucucaucugcaa

SEQ ID NO: 1693202 - RNA, 19 nt, Homo sapiens
uucucaucuuuuuacuaaa

SEQ ID NO: 1693203 - RNA, 15 nt, Homo sapiens
uucucauuugucaca

SEQ ID NO: 1693204 - RNA, 16 nt, Homo sapiens
uucucuccaacucccu

SEQ ID NO: 1693205 - RNA, 21 nt, Homo sapiens
uucucugccaucaacuacuau

SEQ ID NO: 1693206 - RNA, 18 nt, Homo sapiens
uucucugugcaguagcau

SEQ ID NO: 1693207 - RNA, 21 nt, Homo sapiens
uucugaaauaaacuucacuga

SEQ ID NO: 1693208 - RNA, 22 nt, Homo sapiens
uucugaaauaaacuucacugaa

SEQ ID NO: 1693209 - RNA, 17 nt, Homo sapiens
uucugagacauguguca

SEQ ID NO: 1693210 - RNA, 18 nt, Homo sapiens
uucugagcauacucaaca

SEQ ID NO: 1693211 - RNA, 23 nt, Homo sapiens
uucugcaacaucuuaagauccac

SEQ ID NO: 1693212 - RNA, 20 nt, Homo sapiens
uucugccgcccccuccugaa

SEQ ID NO: 1693213 - RNA, 17 nt, Homo sapiens
uucuggagugagcacuc

SEQ ID NO: 1693214 - RNA, 19 nt, Homo sapiens
uucuggggaaagacacugc

SEQ ID NO: 1693215 - RNA, 16 nt, Homo sapiens
uucuggguccugaaga

SEQ ID NO: 1693216 - RNA, 14 nt, Homo sapiens
uucugggugcagcu

SEQ ID NO: 1693217 - RNA, 19 nt, Homo sapiens
uucuggguggccucgggac

SEQ ID NO: 1693218 - RNA, 15 nt, Homo sapiens
uucugguuacugugg

SEQ ID NO: 1693219 - RNA, 23 nt, Homo sapiens
uucuguaucuuucauccuugacu

SEQ ID NO: 1693220 - RNA, 10 nt, Homo sapiens
uucugucacc

SEQ ID NO: 1693221 - RNA, 16 nt, Homo sapiens
uucugucuggagugac

SEQ ID NO: 1693222 - RNA, 24 nt, Homo sapiens
uucugugaucuuuuaaaguguuac

SEQ ID NO: 1693223 - RNA, 12 nt, Homo sapiens
uucuguggcuca

SEQ ID NO: 1693224 - RNA, 17 nt, Homo sapiens
uucuguuuccaucugcu

SEQ ID NO: 1693225 - RNA, 13 nt, Homo sapiens
uucuuaagacaug

SEQ ID NO: 1693226 - RNA, 21 nt, Homo sapiens
uucuucagauacaaacugcag

SEQ ID NO: 1693227 - RNA, 15 nt, Homo sapiens
uucuucauauccuuc

SEQ ID NO: 1693228 - RNA, 19 nt, Homo sapiens
uucuucaucugugacuccu

SEQ ID NO: 1693229 - RNA, 11 nt, Homo sapiens
uucuuccaaaa

SEQ ID NO: 1693230 - RNA, 15 nt, Homo sapiens
uucuuccacuuguaa

SEQ ID NO: 1693231 - RNA, 13 nt, Homo sapiens
uucuucuauucca

SEQ ID NO: 1693232 - RNA, 18 nt, Homo sapiens
uucuugcuacccaugacu

SEQ ID NO: 1693233 - RNA, 20 nt, Homo sapiens
uucuugcucgggucccuuca

SEQ ID NO: 1693234 - RNA, 15 nt, Homo sapiens
uucuugcugcuagaa

SEQ ID NO: 1693235 - RNA, 22 nt, Homo sapiens
uucuuggagggcccacuuguau

SEQ ID NO: 1693236 - RNA, 13 nt, Homo sapiens
uucuuuauacugu

SEQ ID NO: 1693237 - RNA, 13 nt, Homo sapiens
uucuuugaaguuu

SEQ ID NO: 1693238 - RNA, 13 nt, Homo sapiens
uucuuuuauguga

SEQ ID NO: 1693239 - RNA, 19 nt, Homo sapiens
uucuuuuggcuuccaugau

SEQ ID NO: 1693240 - RNA, 16 nt, Homo sapiens
uugaaaaaaguacaua

SEQ ID NO: 1693241 - RNA, 16 nt, Homo sapiens
uugaaagaaccagaga

SEQ ID NO: 1693242 - RNA, 19 nt, Homo sapiens
uugaaauuauaucuguggu

SEQ ID NO: 1693243 - RNA, 18 nt, Homo sapiens
uugaaauuugccuugagu

SEQ ID NO: 1693244 - RNA, 14 nt, Homo sapiens
uugaagagauuuua

SEQ ID NO: 1693245 - RNA, 22 nt, Homo sapiens
uugaagauuuaugaugcacuua

SEQ ID NO: 1693246 - RNA, 14 nt, Homo sapiens
uugaagucuuguau

SEQ ID NO: 1693247 - RNA, 21 nt, Homo sapiens
uugaaguuuuagcggucaauu

SEQ ID NO: 1693248 - RNA, 12 nt, Homo sapiens
uugaaugugauu

SEQ ID NO: 1693249 - RNA, 14 nt, Homo sapiens
uugacaacacagcc

SEQ ID NO: 1693250 - RNA, 11 nt, Homo sapiens
uugacaaugau

SEQ ID NO: 1693251 - RNA, 20 nt, Homo sapiens
uugacaccacaccaucaggc

SEQ ID NO: 1693252 - RNA, 22 nt, Homo sapiens
uugaccacgucaucgggccaga

SEQ ID NO: 1693253 - RNA, 12 nt, Homo sapiens
uugaccucaggu

SEQ ID NO: 1693254 - RNA, 13 nt, Homo sapiens
uugagacagaguu

SEQ ID NO: 1693255 - RNA, 19 nt, Homo sapiens
uugagcagaagaucaagga

SEQ ID NO: 1693256 - RNA, 22 nt, Homo sapiens
uugagcgugaaucuguaucuug

SEQ ID NO: 1693257 - RNA, 21 nt, Homo sapiens
uugagcugauauaaauucugu

SEQ ID NO: 1693258 - RNA, 13 nt, Homo sapiens
uugauagauuucu

SEQ ID NO: 1693259 - RNA, 22 nt, Homo sapiens
uugaucauaaacugacuaucau

SEQ ID NO: 1693260 - RNA, 15 nt, Homo sapiens
uugaugccauaugcc

SEQ ID NO: 1693261 - RNA, 18 nt, Homo sapiens
uugaugccauaugccuug

SEQ ID NO: 1693262 - RNA, 16 nt, Homo sapiens
uugauuaaaacauuau

SEQ ID NO: 1693263 - RNA, 16 nt, Homo sapiens
uugcacacugcacugu

SEQ ID NO: 1693264 - RNA, 14 nt, Homo sapiens
uugcagacaggcaa

SEQ ID NO: 1693265 - RNA, 18 nt, Homo sapiens
uugcagcuuuauguucau

SEQ ID NO: 1693266 - RNA, 13 nt, Homo sapiens
uugccauguguuu

SEQ ID NO: 1693267 - RNA, 17 nt, Homo sapiens
uugccguuugacauuuu

SEQ ID NO: 1693268 - RNA, 15 nt, Homo sapiens
uugccuaagcauugc

SEQ ID NO: 1693269 - RNA, 19 nt, Homo sapiens
uugccuaauaaacauccuu

SEQ ID NO: 1693270 - RNA, 20 nt, Homo sapiens
uugccugccuggugugccuc

SEQ ID NO: 1693271 - RNA, 23 nt, Homo sapiens
uugcuaaaagauuauagaaguag

SEQ ID NO: 1693272 - RNA, 22 nt, Homo sapiens
uugcuacagaggaaacaauauu

SEQ ID NO: 1693273 - RNA, 12 nt, Homo sapiens
uugcuacauucu

SEQ ID NO: 1693274 - RNA, 11 nt, Homo sapiens
uugcuacugua

SEQ ID NO: 1693275 - RNA, 23 nt, Homo sapiens
uugcucauaagcaauaccagcaa

SEQ ID NO: 1693276 - RNA, 19 nt, Homo sapiens
uugcuguccugaucuguga

SEQ ID NO: 1693277 - RNA, 18 nt, Homo sapiens
uugcuugggacauugcaa

SEQ ID NO: 1693278 - RNA, 18 nt, Homo sapiens
uugcuugugccacacccu

SEQ ID NO: 1693279 - RNA, 21 nt, Homo sapiens
uuggaacaacugauacuucac

SEQ ID NO: 1693280 - RNA, 21 nt, Homo sapiens
uuggaagaaaaaaaucuucuc

SEQ ID NO: 1693281 - RNA, 23 nt, Homo sapiens
uuggacaaucaugaaauaugcau

SEQ ID NO: 1693282 - RNA, 17 nt, Homo sapiens
uuggagagaagggcauu

SEQ ID NO: 1693283 - RNA, 21 nt, Homo sapiens
uuggagagucagaucuuucuc

SEQ ID NO: 1693284 - RNA, 19 nt, Homo sapiens
uuggccuagcccacccugc

SEQ ID NO: 1693285 - RNA, 17 nt, Homo sapiens
gcaauuuucgaacauuc

SEQ ID NO: 1693286 - RNA, 16 nt, Homo sapiens
gcaauuuucuaagcaa

SEQ ID NO: 1693287 - RNA, 13 nt, Homo sapiens
gcacaaccugcau

SEQ ID NO: 1693288 - RNA, 16 nt, Homo sapiens
gcacaaccugcaucuu

SEQ ID NO: 1693289 - RNA, 20 nt, Homo sapiens
gcacacacacacacaugcac

SEQ ID NO: 1693290 - RNA, 19 nt, Homo sapiens
gcacacgcguuauaguaac

SEQ ID NO: 1693291 - RNA, 14 nt, Homo sapiens
gcacacugcacugu

SEQ ID NO: 1693292 - RNA, 17 nt, Homo sapiens
gcacagaaauuuucaau

SEQ ID NO: 1693293 - RNA, 18 nt, Homo sapiens
gcacaguggccccaucau

SEQ ID NO: 1693294 - RNA, 12 nt, Homo sapiens
gcacaguuugaa

SEQ ID NO: 1693295 - RNA, 17 nt, Homo sapiens
gcacauccauucccaag

SEQ ID NO: 1693296 - RNA, 12 nt, Homo sapiens
gcacaugcacac

SEQ ID NO: 1693297 - RNA, 15 nt, Homo sapiens
gcacaugucuuguac

SEQ ID NO: 1693298 - RNA, 20 nt, Homo sapiens
gcacaugucuuguacaugug

SEQ ID NO: 1693299 - RNA, 20 nt, Homo sapiens
gcaccacugcacuccagccu

SEQ ID NO: 1693300 - RNA, 19 nt, Homo sapiens
gcaccagagcaaccucuca

SEQ ID NO: 1693301 - RNA, 13 nt, Homo sapiens
gcaccaucucuga

SEQ ID NO: 1693302 - RNA, 22 nt, Homo sapiens
gcacccaggacuuccauuugcu

SEQ ID NO: 1693303 - RNA, 18 nt, Homo sapiens
gcaccccacacuggagcc

SEQ ID NO: 1693304 - RNA, 19 nt, Homo sapiens
gcacccuaguucuaccuca

SEQ ID NO: 1693305 - RNA, 23 nt, Homo sapiens
gcacccuggggccuggaccugcc

SEQ ID NO: 1693306 - RNA, 18 nt, Homo sapiens
gcaccuaccaucagggac

SEQ ID NO: 1693307 - RNA, 13 nt, Homo sapiens
gcaccuaccucac

SEQ ID NO: 1693308 - RNA, 17 nt, Homo sapiens
gcaccugcaugugcugu

SEQ ID NO: 1693309 - RNA, 21 nt, Homo sapiens
gcaccuuaagauuuugcaccu

SEQ ID NO: 1693310 - RNA, 18 nt, Homo sapiens
gcaccuuaccaacuuucu

SEQ ID NO: 1693311 - RNA, 24 nt, Homo sapiens
gcaccuugugucuguacacguguc

SEQ ID NO: 1693312 - RNA, 12 nt, Homo sapiens
gcacggacaaua

SEQ ID NO: 1693313 - RNA, 20 nt, Homo sapiens
gcacuaaagaauacauuuaa

SEQ ID NO: 1693314 - RNA, 13 nt, Homo sapiens
gcacuaaagccag

SEQ ID NO: 1693315 - RNA, 22 nt, Homo sapiens
gcacuacugggugucauuucau

SEQ ID NO: 1693316 - RNA, 18 nt, Homo sapiens
gcacuagagaaugcacag

SEQ ID NO: 1693317 - RNA, 19 nt, Homo sapiens
gcacugaaaauaccaucag

SEQ ID NO: 1693318 - RNA, 16 nt, Homo sapiens
gcacugaggaccagcc

SEQ ID NO: 1693319 - RNA, 17 nt, Homo sapiens
gcacugaggaccagcca

SEQ ID NO: 1693320 - RNA, 22 nt, Homo sapiens
gcacuggggagcccgucucagu

SEQ ID NO: 1693321 - RNA, 21 nt, Homo sapiens
gcacugguggccguggugggg

SEQ ID NO: 1693322 - RNA, 16 nt, Homo sapiens
gcacuugugcuuucag

SEQ ID NO: 1693323 - RNA, 17 nt, Homo sapiens
gcacuuuaaaugaagcu

SEQ ID NO: 1693324 - RNA, 19 nt, Homo sapiens
gcagaaauuuaucuuucaa

SEQ ID NO: 1693325 - RNA, 23 nt, Homo sapiens
gcagaaauuuaucuuucaaagag

SEQ ID NO: 1693326 - RNA, 13 nt, Homo sapiens
gcagaacugccau

SEQ ID NO: 1693327 - RNA, 16 nt, Homo sapiens
gcagaagcccugaugu

SEQ ID NO: 1693328 - RNA, 17 nt, Homo sapiens
gcagacaguagacagaa

SEQ ID NO: 1693329 - RNA, 14 nt, Homo sapiens
gcagagaaccaaag

SEQ ID NO: 1693330 - RNA, 23 nt, Homo sapiens
gcagagaagggcauaaaacagcu

SEQ ID NO: 1693331 - RNA, 22 nt, Homo sapiens
gcagagagccauuuugugaaug

SEQ ID NO: 1693332 - RNA, 21 nt, Homo sapiens
gcagagccucccaaggagaac

SEQ ID NO: 1693333 - RNA, 14 nt, Homo sapiens
gcagaggaugucuc

SEQ ID NO: 1693334 - RNA, 16 nt, Homo sapiens
gcagaggaugucucaa

SEQ ID NO: 1693335 - RNA, 15 nt, Homo sapiens
gcagaguuugccuuc

SEQ ID NO: 1693336 - RNA, 23 nt, Homo sapiens
gcagaguuuguguguugucuuga

SEQ ID NO: 1693337 - RNA, 16 nt, Homo sapiens
gcagauuuuugcaaua

SEQ ID NO: 1693338 - RNA, 12 nt, Homo sapiens
gcagcaaggccc

SEQ ID NO: 1693339 - RNA, 18 nt, Homo sapiens
gcagcagagggucuccaa

SEQ ID NO: 1693340 - RNA, 13 nt, Homo sapiens
gcagccaccagcg

SEQ ID NO: 1693341 - RNA, 21 nt, Homo sapiens
gcagccuaacacggugcucau

SEQ ID NO: 1693342 - RNA, 19 nt, Homo sapiens
gcagccugagcaacucuug

SEQ ID NO: 1693343 - RNA, 15 nt, Homo sapiens
gcagcuacucagagg

SEQ ID NO: 1693344 - RNA, 13 nt, Homo sapiens
gcagcucugugac

SEQ ID NO: 1693345 - RNA, 15 nt, Homo sapiens
gcagcuucaccagag

SEQ ID NO: 1693346 - RNA, 21 nt, Homo sapiens
gcagcuucaccagagcauuuc

SEQ ID NO: 1693347 - RNA, 19 nt, Homo sapiens
gcagcuuuaaacucaggga

SEQ ID NO: 1693348 - RNA, 20 nt, Homo sapiens
gcagcuuuauguucauuugu

SEQ ID NO: 1693349 - RNA, 21 nt, Homo sapiens
gcaggacuugagaagaccuca

SEQ ID NO: 1693350 - RNA, 17 nt, Homo sapiens
gcaggagauuugcuuga

SEQ ID NO: 1693351 - RNA, 17 nt, Homo sapiens
gcaggaggauugcuuga

SEQ ID NO: 1693352 - RNA, 20 nt, Homo sapiens
gcaggaguggugcagacaga

SEQ ID NO: 1693353 - RNA, 15 nt, Homo sapiens
gcaggcugggccaug

SEQ ID NO: 1693354 - RNA, 15 nt, Homo sapiens
gcagggcugcccuga

SEQ ID NO: 1693355 - RNA, 22 nt, Homo sapiens
gcaggggcuggagggaggcggg

SEQ ID NO: 1693356 - RNA, 17 nt, Homo sapiens
gcagggugaucgcacaa

SEQ ID NO: 1693357 - RNA, 19 nt, Homo sapiens
gcagggugguguaccugcu

SEQ ID NO: 1693358 - RNA, 18 nt, Homo sapiens
gcaguaaaagaugaaguu

SEQ ID NO: 1693359 - RNA, 19 nt, Homo sapiens
gcaguagaaauaauaugca

SEQ ID NO: 1693360 - RNA, 23 nt, Homo sapiens
gcaguauccaauaggcauuugau

SEQ ID NO: 1693361 - RNA, 12 nt, Homo sapiens
gcaguccuuugu

SEQ ID NO: 1693362 - RNA, 14 nt, Homo sapiens
gcagugacugccgu

SEQ ID NO: 1693363 - RNA, 14 nt, Homo sapiens
gcagugagugagcc

SEQ ID NO: 1693364 - RNA, 17 nt, Homo sapiens
gcaguggcgugaucucg

SEQ ID NO: 1693365 - RNA, 21 nt, Homo sapiens
gcagugucuguaaaagagccu

SEQ ID NO: 1693366 - RNA, 20 nt, Homo sapiens
gcaguucuggaauggaaggg

SEQ ID NO: 1693367 - RNA, 20 nt, Homo sapiens
gcauaaauaugcagugauau

SEQ ID NO: 1693368 - RNA, 16 nt, Homo sapiens
gcauagaacuggguaa

SEQ ID NO: 1693369 - RNA, 14 nt, Homo sapiens
gcauagcaaacaga

SEQ ID NO: 1693370 - RNA, 14 nt, Homo sapiens
gcauaucacagaga

SEQ ID NO: 1693371 - RNA, 22 nt, Homo sapiens
gcauaugucacuagaauggaua

SEQ ID NO: 1693372 - RNA, 13 nt, Homo sapiens
gcaucaaggucag

SEQ ID NO: 1693373 - RNA, 16 nt, Homo sapiens
gcaucaaggugcugaa

SEQ ID NO: 1693374 - RNA, 15 nt, Homo sapiens
gcaucaucaaaaacu

SEQ ID NO: 1693375 - RNA, 19 nt, Homo sapiens
gcauccccuuggcugugag

SEQ ID NO: 1693376 - RNA, 19 nt, Homo sapiens
gcaugccuugugcuguuaa

SEQ ID NO: 1693377 - RNA, 13 nt, Homo sapiens
gcauguccuuugc

SEQ ID NO: 1693378 - RNA, 21 nt, Homo sapiens
gcauuaaaaaaaaaaucaaug

SEQ ID NO: 1693379 - RNA, 13 nt, Homo sapiens
gcauuaaauucac

SEQ ID NO: 1693380 - RNA, 13 nt, Homo sapiens
gcauucaaauggg

SEQ ID NO: 1693381 - RNA, 15 nt, Homo sapiens
gcauucaaaugggcu

SEQ ID NO: 1693382 - RNA, 21 nt, Homo sapiens
gcauucauuucucuugcaaua

SEQ ID NO: 1693383 - RNA, 17 nt, Homo sapiens
gcauugcuucagaauga

SEQ ID NO: 1693384 - RNA, 19 nt, Homo sapiens
gcauuuacuuuguguucac

SEQ ID NO: 1693385 - RNA, 12 nt, Homo sapiens
gcauuucuugcg

SEQ ID NO: 1693386 - RNA, 14 nt, Homo sapiens
gcauuuuacaggug

SEQ ID NO: 1693387 - RNA, 20 nt, Homo sapiens
gccaaacccaugaggcaaug

SEQ ID NO: 1693388 - RNA, 21 nt, Homo sapiens
gccaaagaaaugaacauucca

SEQ ID NO: 1693389 - RNA, 13 nt, Homo sapiens
gccaacuguccua

SEQ ID NO: 1693390 - RNA, 18 nt, Homo sapiens
gccaacuguccuacucau

SEQ ID NO: 1693391 - RNA, 20 nt, Homo sapiens
gccaacuuucucugcaacua

SEQ ID NO: 1693392 - RNA, 15 nt, Homo sapiens
gccacaagucuucca

SEQ ID NO: 1693393 - RNA, 18 nt, Homo sapiens
gccacaguccuucuuuga

SEQ ID NO: 1693394 - RNA, 18 nt, Homo sapiens
gccacauuuggaauacuu

SEQ ID NO: 1693395 - RNA, 22 nt, Homo sapiens
gaguuuuccucuauacaucucu

SEQ ID NO: 1693396 - RNA, 15 nt, Homo sapiens
gauaaacaacauuga

SEQ ID NO: 1693397 - RNA, 16 nt, Homo sapiens
gauaaagaugcaagga

SEQ ID NO: 1693398 - RNA, 19 nt, Homo sapiens
gauaacccuacacccagac

SEQ ID NO: 1693399 - RNA, 13 nt, Homo sapiens
gauaacucaggaa

SEQ ID NO: 1693400 - RNA, 14 nt, Homo sapiens
gauacaaacugcag

SEQ ID NO: 1693401 - RNA, 15 nt, Homo sapiens
gauacauuuggauaa

SEQ ID NO: 1693402 - RNA, 21 nt, Homo sapiens
gauacauuuggauaaacaaca

SEQ ID NO: 1693403 - RNA, 13 nt, Homo sapiens
gauaccugcacug

SEQ ID NO: 1693404 - RNA, 13 nt, Homo sapiens
gauaguucccaaa

SEQ ID NO: 1693405 - RNA, 12 nt, Homo sapiens
gauaguuuaccu

SEQ ID NO: 1693406 - RNA, 21 nt, Homo sapiens
gauaugaagagcaacugggac

SEQ ID NO: 1693407 - RNA, 13 nt, Homo sapiens
gauaugggacuga

SEQ ID NO: 1693408 - RNA, 14 nt, Homo sapiens
gauaugggacugag

SEQ ID NO: 1693409 - RNA, 16 nt, Homo sapiens
gauaugggacugagcc

SEQ ID NO: 1693410 - RNA, 16 nt, Homo sapiens
gauauuugguaccaug

SEQ ID NO: 1693411 - RNA, 21 nt, Homo sapiens
gaucaaaauaaaaagugacac

SEQ ID NO: 1693412 - RNA, 14 nt, Homo sapiens
gaucacugccacac

SEQ ID NO: 1693413 - RNA, 14 nt, Homo sapiens
gaucagaugaacuc

SEQ ID NO: 1693414 - RNA, 18 nt, Homo sapiens
gaucauagguauuucaaa

SEQ ID NO: 1693415 - RNA, 13 nt, Homo sapiens
gaucaucagucac

SEQ ID NO: 1693416 - RNA, 20 nt, Homo sapiens
gauccaagcagccugagcaa

SEQ ID NO: 1693417 - RNA, 17 nt, Homo sapiens
gauccagaacugcacuc

SEQ ID NO: 1693418 - RNA, 23 nt, Homo sapiens
gauccccaaguggugaaugacac

SEQ ID NO: 1693419 - RNA, 20 nt, Homo sapiens
gauccuggccccucaaccuc

SEQ ID NO: 1693420 - RNA, 18 nt, Homo sapiens
gauccuuagagguccucu

SEQ ID NO: 1693421 - RNA, 21 nt, Homo sapiens
gaucuaaggaugucacagggc

SEQ ID NO: 1693422 - RNA, 21 nt, Homo sapiens
gaucucuucuuuuggcuucca

SEQ ID NO: 1693423 - RNA, 17 nt, Homo sapiens
gaucuggucccuugcag

SEQ ID NO: 1693424 - RNA, 19 nt, Homo sapiens
gaugaaaaccuacauauuc

SEQ ID NO: 1693425 - RNA, 21 nt, Homo sapiens
gaugagauuggcauggcuuua

SEQ ID NO: 1693426 - RNA, 22 nt, Homo sapiens
gaugaggaccaagggcaccugg

SEQ ID NO: 1693427 - RNA, 15 nt, Homo sapiens
gaugaguuacuugaa

SEQ ID NO: 1693428 - RNA, 19 nt, Homo sapiens
gaugauacgaaugauguca

SEQ ID NO: 1693429 - RNA, 12 nt, Homo sapiens
gaugcagcauuu

SEQ ID NO: 1693430 - RNA, 15 nt, Homo sapiens
gaugcguucacucca

SEQ ID NO: 1693431 - RNA, 19 nt, Homo sapiens
gaugcuccagcaacacagc

SEQ ID NO: 1693432 - RNA, 16 nt, Homo sapiens
gaugcuggacuugccu

SEQ ID NO: 1693433 - RNA, 17 nt, Homo sapiens
gauggaauaacucugug

SEQ ID NO: 1693434 - RNA, 19 nt, Homo sapiens
gauggaccagugguuucca

SEQ ID NO: 1693435 - RNA, 19 nt, Homo sapiens
gauggaggucacacuggua

SEQ ID NO: 1693436 - RNA, 21 nt, Homo sapiens
gauggccucucucaaaagaga

SEQ ID NO: 1693437 - RNA, 14 nt, Homo sapiens
gauggcucguggga

SEQ ID NO: 1693438 - RNA, 19 nt, Homo sapiens
gauggcuggaaggggucca

SEQ ID NO: 1693439 - RNA, 13 nt, Homo sapiens
gauggggcacuga

SEQ ID NO: 1693440 - RNA, 14 nt, Homo sapiens
gauguuuccagacu

SEQ ID NO: 1693441 - RNA, 18 nt, Homo sapiens
gauguuuccagacuuccu

SEQ ID NO: 1693442 - RNA, 19 nt, Homo sapiens
gauguuuccagacuuccuu

SEQ ID NO: 1693443 - RNA, 23 nt, Homo sapiens
gauuacaaggcuuuaucucaggg

SEQ ID NO: 1693444 - RNA, 19 nt, Homo sapiens
gauuacaggcgugagccac

SEQ ID NO: 1693445 - RNA, 17 nt, Homo sapiens
gauuagaugacucucag

SEQ ID NO: 1693446 - RNA, 13 nt, Homo sapiens
gauuagcuuugug

SEQ ID NO: 1693447 - RNA, 13 nt, Homo sapiens
gauuauaaacuga

SEQ ID NO: 1693448 - RNA, 14 nt, Homo sapiens
gauuauaaacugac

SEQ ID NO: 1693449 - RNA, 17 nt, Homo sapiens
gauuauuuaaaugggaa

SEQ ID NO: 1693450 - RNA, 22 nt, Homo sapiens
gauuauuuaauaacauuaccuu

SEQ ID NO: 1693451 - RNA, 23 nt, Homo sapiens
gauucaccaaaauagucuucuca

SEQ ID NO: 1693452 - RNA, 20 nt, Homo sapiens
gauucacugcauggcuccca

SEQ ID NO: 1693453 - RNA, 16 nt, Homo sapiens
gauucccaacugagug

SEQ ID NO: 1693454 - RNA, 23 nt, Homo sapiens
gauucuaaaaugugauguucuaa

SEQ ID NO: 1693455 - RNA, 18 nt, Homo sapiens
gauucuaaugucuucauu

SEQ ID NO: 1693456 - RNA, 22 nt, Homo sapiens
gauucuauuuauuaugcuuuau

SEQ ID NO: 1693457 - RNA, 18 nt, Homo sapiens
gauucucugugucuaaga

SEQ ID NO: 1693458 - RNA, 16 nt, Homo sapiens
gauugaaagaaccaga

SEQ ID NO: 1693459 - RNA, 16 nt, Homo sapiens
gauugauuaaugaacu

SEQ ID NO: 1693460 - RNA, 13 nt, Homo sapiens
gauuggcacagac

SEQ ID NO: 1693461 - RNA, 18 nt, Homo sapiens
gauuguauauggaacaaa

SEQ ID NO: 1693462 - RNA, 15 nt, Homo sapiens
gauuguuguuugcca

SEQ ID NO: 1693463 - RNA, 20 nt, Homo sapiens
gauuguuuauacuccagugu

SEQ ID NO: 1693464 - RNA, 12 nt, Homo sapiens
gauuuacauaua

SEQ ID NO: 1693465 - RNA, 16 nt, Homo sapiens
gauuuaugaugcacuu

SEQ ID NO: 1693466 - RNA, 12 nt, Homo sapiens
gauuuccaggga

SEQ ID NO: 1693467 - RNA, 19 nt, Homo sapiens
gauuugaagaacaugugag

SEQ ID NO: 1693468 - RNA, 14 nt, Homo sapiens
gauuugcauauuca

SEQ ID NO: 1693469 - RNA, 20 nt, Homo sapiens
gauuugguacuuuugagugu

SEQ ID NO: 1693470 - RNA, 15 nt, Homo sapiens
gauuuggugaccaac

SEQ ID NO: 1693471 - RNA, 19 nt, Homo sapiens
gauuuuaugaaaugaccuc

SEQ ID NO: 1693472 - RNA, 13 nt, Homo sapiens
gauuuuugcaaua

SEQ ID NO: 1693473 - RNA, 13 nt, Homo sapiens
gcaaaaaguauug

SEQ ID NO: 1693474 - RNA, 19 nt, Homo sapiens
gcaaaaauggauauuauua

SEQ ID NO: 1693475 - RNA, 12 nt, Homo sapiens
gcaaaauauuca

SEQ ID NO: 1693476 - RNA, 20 nt, Homo sapiens
gcaaaauuugaugccaggac

SEQ ID NO: 1693477 - RNA, 22 nt, Homo sapiens
gcaaaauuugaugccaggacac

SEQ ID NO: 1693478 - RNA, 12 nt, Homo sapiens
gcaaacaaguug

SEQ ID NO: 1693479 - RNA, 14 nt, Homo sapiens
gcaaaccauuuuua

SEQ ID NO: 1693480 - RNA, 23 nt, Homo sapiens
gcaaaggaaauugucaucugcca

SEQ ID NO: 1693481 - RNA, 14 nt, Homo sapiens
gcaaauaaauauca

SEQ ID NO: 1693482 - RNA, 21 nt, Homo sapiens
gcaaauaucauacuguucaau

SEQ ID NO: 1693483 - RNA, 19 nt, Homo sapiens
gcaaauggcagaaccaaag

SEQ ID NO: 1693484 - RNA, 22 nt, Homo sapiens
gcaacaagaccaccacuucgaa

SEQ ID NO: 1693485 - RNA, 14 nt, Homo sapiens
gcaacaagaucuga

SEQ ID NO: 1693486 - RNA, 13 nt, Homo sapiens
gcaacaaugacuu

SEQ ID NO: 1693487 - RNA, 17 nt, Homo sapiens
gcaacagacaagugacu

SEQ ID NO: 1693488 - RNA, 23 nt, Homo sapiens
gcaacagagcaagacccaucuca

SEQ ID NO: 1693489 - RNA, 16 nt, Homo sapiens
gcaaccacacaccuca

SEQ ID NO: 1693490 - RNA, 13 nt, Homo sapiens
gcaaccugacuca

SEQ ID NO: 1693491 - RNA, 18 nt, Homo sapiens
gcaacuucuucuccaucc

SEQ ID NO: 1693492 - RNA, 21 nt, Homo sapiens
gcaagaaguagcagugucugu

SEQ ID NO: 1693493 - RNA, 14 nt, Homo sapiens
gcaagacccaucuc

SEQ ID NO: 1693494 - RNA, 22 nt, Homo sapiens
gcaagagaggaugacacaucaa

SEQ ID NO: 1693495 - RNA, 19 nt, Homo sapiens
gcaagagcccccuugacac

SEQ ID NO: 1693496 - RNA, 19 nt, Homo sapiens
gcaagagugauugcagcuu

SEQ ID NO: 1693497 - RNA, 15 nt, Homo sapiens
gcaagcacaucugca

SEQ ID NO: 1693498 - RNA, 20 nt, Homo sapiens
gcaagcuaaccuuauccugc

SEQ ID NO: 1693499 - RNA, 17 nt, Homo sapiens
gcaaggagccagggaau

SEQ ID NO: 1693500 - RNA, 12 nt, Homo sapiens
gcaaguuugcac

SEQ ID NO: 1693501 - RNA, 15 nt, Homo sapiens
gcaaugacaucucag

SEQ ID NO: 1693502 - RNA, 13 nt, Homo sapiens
gcaauucauccca

SEQ ID NO: 1693503 - RNA, 14 nt, Homo sapiens
gcaauugacuguca

SEQ ID NO: 1693504 - RNA, 22 nt, Homo sapiens
gcaauuucauaugcuguauauc

SEQ ID NO: 1693505 - RNA, 13 nt, Homo sapiens
gacuccuaccugc

SEQ ID NO: 1693506 - RNA, 15 nt, Homo sapiens
gacuccuccuccaaa

SEQ ID NO: 1693507 - RNA, 15 nt, Homo sapiens
gacucuauucucaaa

SEQ ID NO: 1693508 - RNA, 20 nt, Homo sapiens
gacucuccuccuugagcccu

SEQ ID NO: 1693509 - RNA, 15 nt, Homo sapiens
gacucugcacauguc

SEQ ID NO: 1693510 - RNA, 20 nt, Homo sapiens
gacucugguuucucauucuu

SEQ ID NO: 1693511 - RNA, 18 nt, Homo sapiens
gacugacaaccucaucca

SEQ ID NO: 1693512 - RNA, 17 nt, Homo sapiens
gacugaccauauugugc

SEQ ID NO: 1693513 - RNA, 17 nt, Homo sapiens
gacugccccugccuuuu

SEQ ID NO: 1693514 - RNA, 16 nt, Homo sapiens
gacugccgcugagaag

SEQ ID NO: 1693515 - RNA, 22 nt, Homo sapiens
gacugccucugccacacucuga

SEQ ID NO: 1693516 - RNA, 19 nt, Homo sapiens
gacugcuucaucugcugua

SEQ ID NO: 1693517 - RNA, 18 nt, Homo sapiens
gacuguggcacuugccug

SEQ ID NO: 1693518 - RNA, 21 nt, Homo sapiens
gacuguugaugaaagggacag

SEQ ID NO: 1693519 - RNA, 17 nt, Homo sapiens
gacuguugccacuuaac

SEQ ID NO: 1693520 - RNA, 14 nt, Homo sapiens
gacuucaaugauag

SEQ ID NO: 1693521 - RNA, 18 nt, Homo sapiens
gacuucuaauaucauuca

SEQ ID NO: 1693522 - RNA, 20 nt, Homo sapiens
gacuucucccgugagccagg

SEQ ID NO: 1693523 - RNA, 17 nt, Homo sapiens
gacuugauuagugccuu

SEQ ID NO: 1693524 - RNA, 18 nt, Homo sapiens
gacuugauuagugccuuc

SEQ ID NO: 1693525 - RNA, 15 nt, Homo sapiens
gagaaacaauggcua

SEQ ID NO: 1693526 - RNA, 16 nt, Homo sapiens
gagaaagcagccauug

SEQ ID NO: 1693527 - RNA, 23 nt, Homo sapiens
gagaaauacuuucaggcacuaag

SEQ ID NO: 1693528 - RNA, 16 nt, Homo sapiens
gagaacaucuuugaca

SEQ ID NO: 1693529 - RNA, 20 nt, Homo sapiens
gagaaccccucugggaaaau

SEQ ID NO: 1693530 - RNA, 20 nt, Homo sapiens
gagaagccuucagcuccagg

SEQ ID NO: 1693531 - RNA, 14 nt, Homo sapiens
gagaauuggcucaa

SEQ ID NO: 1693532 - RNA, 19 nt, Homo sapiens
gagacaagggcaucaucua

SEQ ID NO: 1693533 - RNA, 15 nt, Homo sapiens
gagacaccaaccgac

SEQ ID NO: 1693534 - RNA, 19 nt, Homo sapiens
gagacagaguuuucacucu

SEQ ID NO: 1693535 - RNA, 19 nt, Homo sapiens
gagacagcugauacuucau

SEQ ID NO: 1693536 - RNA, 17 nt, Homo sapiens
gagacaggguuucacug

SEQ ID NO: 1693537 - RNA, 15 nt, Homo sapiens
gagacauaggccaug

SEQ ID NO: 1693538 - RNA, 14 nt, Homo sapiens
gagacgacaggcga

SEQ ID NO: 1693539 - RNA, 22 nt, Homo sapiens
gagacggagucuugcucuguca

SEQ ID NO: 1693540 - RNA, 17 nt, Homo sapiens
gagacguggaaccucug

SEQ ID NO: 1693541 - RNA, 16 nt, Homo sapiens
gagacuauggagccug

SEQ ID NO: 1693542 - RNA, 12 nt, Homo sapiens
gagacucuaggg

SEQ ID NO: 1693543 - RNA, 13 nt, Homo sapiens
gagacucuagggu

SEQ ID NO: 1693544 - RNA, 22 nt, Homo sapiens
gagacugacaaccucauccagg

SEQ ID NO: 1693545 - RNA, 18 nt, Homo sapiens
gagacugcguucugcaag

SEQ ID NO: 1693546 - RNA, 14 nt, Homo sapiens
gagagaaaucugaa

SEQ ID NO: 1693547 - RNA, 16 nt, Homo sapiens
gagagaggagccagac

SEQ ID NO: 1693548 - RNA, 15 nt, Homo sapiens
gagaggcucugagaa

SEQ ID NO: 1693549 - RNA, 19 nt, Homo sapiens
gagagggaccaugugucac

SEQ ID NO: 1693550 - RNA, 13 nt, Homo sapiens
gagauaaacuaca

SEQ ID NO: 1693551 - RNA, 18 nt, Homo sapiens
gagauauuugguaccaug

SEQ ID NO: 1693552 - RNA, 22 nt, Homo sapiens
gagauauuugguaccauggugu

SEQ ID NO: 1693553 - RNA, 19 nt, Homo sapiens
gagaucuaaggaugucaca

SEQ ID NO: 1693554 - RNA, 14 nt, Homo sapiens
gagaugacagggaa

SEQ ID NO: 1693555 - RNA, 18 nt, Homo sapiens
gagaugagggaugggccu

SEQ ID NO: 1693556 - RNA, 19 nt, Homo sapiens
gagaugcuggacuugccua

SEQ ID NO: 1693557 - RNA, 13 nt, Homo sapiens
gagauggaguucu

SEQ ID NO: 1693558 - RNA, 16 nt, Homo sapiens
gagauucugugaucuu

SEQ ID NO: 1693559 - RNA, 17 nt, Homo sapiens
gagauuuaccagggaug

SEQ ID NO: 1693560 - RNA, 12 nt, Homo sapiens
gagcaaauauca

SEQ ID NO: 1693561 - RNA, 14 nt, Homo sapiens
gagcacaagccaca

SEQ ID NO: 1693562 - RNA, 23 nt, Homo sapiens
gagcacaagccacaagucuucca

SEQ ID NO: 1693563 - RNA, 15 nt, Homo sapiens
gagcacagcucagga

SEQ ID NO: 1693564 - RNA, 16 nt, Homo sapiens
gagcacccauuccaaa

SEQ ID NO: 1693565 - RNA, 20 nt, Homo sapiens
gagcaccuacuacaugcaag

SEQ ID NO: 1693566 - RNA, 17 nt, Homo sapiens
gagcaggaagcauucag

SEQ ID NO: 1693567 - RNA, 16 nt, Homo sapiens
gagcauaguccaaaaa

SEQ ID NO: 1693568 - RNA, 22 nt, Homo sapiens
gagcauaucaaaaaguauuaaa

SEQ ID NO: 1693569 - RNA, 22 nt, Homo sapiens
gagcauuuccaacaccacagac

SEQ ID NO: 1693570 - RNA, 17 nt, Homo sapiens
gagccacagcagcauuu

SEQ ID NO: 1693571 - RNA, 20 nt, Homo sapiens
gagccaccacguccagcugg

SEQ ID NO: 1693572 - RNA, 18 nt, Homo sapiens
gagccacugcaccgggcc

SEQ ID NO: 1693573 - RNA, 17 nt, Homo sapiens
gagcccagcuuccugaa

SEQ ID NO: 1693574 - RNA, 16 nt, Homo sapiens
gagcccauacucagcc

SEQ ID NO: 1693575 - RNA, 21 nt, Homo sapiens
gagcccauuucaauucucaaa

SEQ ID NO: 1693576 - RNA, 14 nt, Homo sapiens
gagccgcugugagc

SEQ ID NO: 1693577 - RNA, 20 nt, Homo sapiens
gagcgcaagauagauuugga

SEQ ID NO: 1693578 - RNA, 16 nt, Homo sapiens
gagcgucacggccaag

SEQ ID NO: 1693579 - RNA, 14 nt, Homo sapiens
gagcgucaggguug

SEQ ID NO: 1693580 - RNA, 20 nt, Homo sapiens
gagcugaugaaacucacaaa

SEQ ID NO: 1693581 - RNA, 22 nt, Homo sapiens
gagcuggccucucuagcacaau

SEQ ID NO: 1693582 - RNA, 19 nt, Homo sapiens
gagcugucccaccugcaca

SEQ ID NO: 1693583 - RNA, 16 nt, Homo sapiens
gagcuguuaccauuca

SEQ ID NO: 1693584 - RNA, 18 nt, Homo sapiens
gagcuuuguccugaagga

SEQ ID NO: 1693585 - RNA, 22 nt, Homo sapiens
gaggaagaacuacagcucuuaa

SEQ ID NO: 1693586 - RNA, 18 nt, Homo sapiens
gaggacucgcuuguaaau

SEQ ID NO: 1693587 - RNA, 16 nt, Homo sapiens
gaggagcacaguuugu

SEQ ID NO: 1693588 - RNA, 14 nt, Homo sapiens
gaggaggccuccau

SEQ ID NO: 1693589 - RNA, 16 nt, Homo sapiens
gaggauuucaucucuu

SEQ ID NO: 1693590 - RNA, 22 nt, Homo sapiens
gaggcagccccauucugccugc

SEQ ID NO: 1693591 - RNA, 18 nt, Homo sapiens
gaggcugccccucucacc

SEQ ID NO: 1693592 - RNA, 13 nt, Homo sapiens
gagggacugccuc

SEQ ID NO: 1693593 - RNA, 19 nt, Homo sapiens
gagggcaccuugugaucau

SEQ ID NO: 1693594 - RNA, 14 nt, Homo sapiens
gagggcagggacca

SEQ ID NO: 1693595 - RNA, 14 nt, Homo sapiens
gagggcggcacagg

SEQ ID NO: 1693596 - RNA, 17 nt, Homo sapiens
gaggggcucucagcuca

SEQ ID NO: 1693597 - RNA, 21 nt, Homo sapiens
gaggguccuuuaguaccugaa

SEQ ID NO: 1693598 - RNA, 15 nt, Homo sapiens
gaggguuuugcucuu

SEQ ID NO: 1693599 - RNA, 16 nt, Homo sapiens
gaguaaauacagguag

SEQ ID NO: 1693600 - RNA, 17 nt, Homo sapiens
gaguagggacucagggc

SEQ ID NO: 1693601 - RNA, 16 nt, Homo sapiens
gagucagaucuuucuc

SEQ ID NO: 1693602 - RNA, 22 nt, Homo sapiens
gagucaucuauucaagcacuua

SEQ ID NO: 1693603 - RNA, 13 nt, Homo sapiens
gagucuagauucu

SEQ ID NO: 1693604 - RNA, 19 nt, Homo sapiens
gagucuagcacucauuuuc

SEQ ID NO: 1693605 - RNA, 18 nt, Homo sapiens
gagucucuucuccacugg

SEQ ID NO: 1693606 - RNA, 15 nt, Homo sapiens
gagugagcacucacg

SEQ ID NO: 1693607 - RNA, 15 nt, Homo sapiens
gagugauugcagcuu

SEQ ID NO: 1693608 - RNA, 19 nt, Homo sapiens
gagugcaguggcgugaucu

SEQ ID NO: 1693609 - RNA, 16 nt, Homo sapiens
gaguguaguuuacaga

SEQ ID NO: 1693610 - RNA, 12 nt, Homo sapiens
gagugugacagg

SEQ ID NO: 1693611 - RNA, 21 nt, Homo sapiens
gagugugugacauuccagggg

SEQ ID NO: 1693612 - RNA, 19 nt, Homo sapiens
gaguguuucuuccacaaca

SEQ ID NO: 1693613 - RNA, 13 nt, Homo sapiens
gaguuagugccau

SEQ ID NO: 1693614 - RNA, 17 nt, Homo sapiens
gaguuugccuguacucu

SEQ ID NO: 1693615 - RNA, 19 nt, Homo sapiens
gaaggugaaagugcaguuc

SEQ ID NO: 1693616 - RNA, 16 nt, Homo sapiens
gaagguucucugugcu

SEQ ID NO: 1693617 - RNA, 20 nt, Homo sapiens
gaagguucucugugcuccuc

SEQ ID NO: 1693618 - RNA, 23 nt, Homo sapiens
gaaguaacaaaagaagugacauc

SEQ ID NO: 1693619 - RNA, 16 nt, Homo sapiens
gaaguacuccuauugc

SEQ ID NO: 1693620 - RNA, 22 nt, Homo sapiens
gaaguaugagggaaaaugagua

SEQ ID NO: 1693621 - RNA, 16 nt, Homo sapiens
gaaguauuucugugga

SEQ ID NO: 1693622 - RNA, 16 nt, Homo sapiens
gaagucacugcacagu

SEQ ID NO: 1693623 - RNA, 22 nt, Homo sapiens
gaagugacacuuugacauuucc

SEQ ID NO: 1693624 - RNA, 15 nt, Homo sapiens
gaagugcgugaaugu

SEQ ID NO: 1693625 - RNA, 19 nt, Homo sapiens
gaaguuccaguguucucuc

SEQ ID NO: 1693626 - RNA, 17 nt, Homo sapiens
gaaguugacuuauagua

SEQ ID NO: 1693627 - RNA, 19 nt, Homo sapiens
gaaguuuucuguagucauu

SEQ ID NO: 1693628 - RNA, 21 nt, Homo sapiens
gaaguuuucuguagucauuua

SEQ ID NO: 1693629 - RNA, 20 nt, Homo sapiens
gaauaacuguguuuccuacc

SEQ ID NO: 1693630 - RNA, 13 nt, Homo sapiens
gaauaagaagcaa

SEQ ID NO: 1693631 - RNA, 19 nt, Homo sapiens
gaauauaaaugggaaauca

SEQ ID NO: 1693632 - RNA, 13 nt, Homo sapiens
gaauauagagggu

SEQ ID NO: 1693633 - RNA, 14 nt, Homo sapiens
gaauauccauguac

SEQ ID NO: 1693634 - RNA, 12 nt, Homo sapiens
gaauauucccaa

SEQ ID NO: 1693635 - RNA, 18 nt, Homo sapiens
gaauauucccaagcccau

SEQ ID NO: 1693636 - RNA, 21 nt, Homo sapiens
gaauauuuauaaaugagcaaa

SEQ ID NO: 1693637 - RNA, 16 nt, Homo sapiens
gaauccagacccggcu

SEQ ID NO: 1693638 - RNA, 18 nt, Homo sapiens
gaauccaugaagaauucc

SEQ ID NO: 1693639 - RNA, 16 nt, Homo sapiens
gaaugaacaaagucca

SEQ ID NO: 1693640 - RNA, 18 nt, Homo sapiens
gaaugagagguuccuaag

SEQ ID NO: 1693641 - RNA, 18 nt, Homo sapiens
gaaugaggucccaggcag

SEQ ID NO: 1693642 - RNA, 15 nt, Homo sapiens
gaaugauucauguua

SEQ ID NO: 1693643 - RNA, 22 nt, Homo sapiens
gaaugcaaaguagcaauuucca

SEQ ID NO: 1693644 - RNA, 16 nt, Homo sapiens
gaaugcagugguauga

SEQ ID NO: 1693645 - RNA, 16 nt, Homo sapiens
gaaugccuccuguggg

SEQ ID NO: 1693646 - RNA, 21 nt, Homo sapiens
gaaugggcuugaaacauuaua

SEQ ID NO: 1693647 - RNA, 20 nt, Homo sapiens
gaauggguguuguaugggga

SEQ ID NO: 1693648 - RNA, 17 nt, Homo sapiens
gaauguauguaaugugu

SEQ ID NO: 1693649 - RNA, 20 nt, Homo sapiens
gaaugugcugaucauuugag

SEQ ID NO: 1693650 - RNA, 18 nt, Homo sapiens
gaauguggaauaccuaag

SEQ ID NO: 1693651 - RNA, 15 nt, Homo sapiens
gaauguuaagcagau

SEQ ID NO: 1693652 - RNA, 20 nt, Homo sapiens
gaauguugguuuacuuucaa

SEQ ID NO: 1693653 - RNA, 15 nt, Homo sapiens
gaauuaacagagauu

SEQ ID NO: 1693654 - RNA, 23 nt, Homo sapiens
gaauuaucccccaaaaugcauuu

SEQ ID NO: 1693655 - RNA, 19 nt, Homo sapiens
gaauucuuuuucauuugag

SEQ ID NO: 1693656 - RNA, 17 nt, Homo sapiens
gaauuuggccugcacua

SEQ ID NO: 1693657 - RNA, 20 nt, Homo sapiens
gaauuuguuaucaguaagaa

SEQ ID NO: 1693658 - RNA, 13 nt, Homo sapiens
gaauuuuguugcu

SEQ ID NO: 1693659 - RNA, 14 nt, Homo sapiens
gacaaaagcaguuu

SEQ ID NO: 1693660 - RNA, 16 nt, Homo sapiens
gacaaaauauuuccca

SEQ ID NO: 1693661 - RNA, 13 nt, Homo sapiens
gacaaacugugua

SEQ ID NO: 1693662 - RNA, 17 nt, Homo sapiens
gacaaagguuuuccucu

SEQ ID NO: 1693663 - RNA, 21 nt, Homo sapiens
gacaaagguuuuccucuucua

SEQ ID NO: 1693664 - RNA, 17 nt, Homo sapiens
gacaagcugcauuucag

SEQ ID NO: 1693665 - RNA, 19 nt, Homo sapiens
gacaaucaugaaauaugca

SEQ ID NO: 1693666 - RNA, 19 nt, Homo sapiens
gacaauuaucugugucaaa

SEQ ID NO: 1693667 - RNA, 18 nt, Homo sapiens
gacacaacuauuuuucca

SEQ ID NO: 1693668 - RNA, 16 nt, Homo sapiens
gacacaggcccggcuc

SEQ ID NO: 1693669 - RNA, 17 nt, Homo sapiens
gacaccuugacagggca

SEQ ID NO: 1693670 - RNA, 17 nt, Homo sapiens
gacacgccuaaggucac

SEQ ID NO: 1693671 - RNA, 16 nt, Homo sapiens
gacacuauucauuuga

SEQ ID NO: 1693672 - RNA, 14 nt, Homo sapiens
gacacuuaauacua

SEQ ID NO: 1693673 - RNA, 14 nt, Homo sapiens
gacagagucucacu

SEQ ID NO: 1693674 - RNA, 19 nt, Homo sapiens
gacagcaucuuccucccuc

SEQ ID NO: 1693675 - RNA, 22 nt, Homo sapiens
gacagccacggccaggccagag

SEQ ID NO: 1693676 - RNA, 13 nt, Homo sapiens
gacagccuggcac

SEQ ID NO: 1693677 - RNA, 22 nt, Homo sapiens
gacagcugcugggucaggccac

SEQ ID NO: 1693678 - RNA, 19 nt, Homo sapiens
gacaggaggaaucauguca

SEQ ID NO: 1693679 - RNA, 18 nt, Homo sapiens
gacaggcuccucugggga

SEQ ID NO: 1693680 - RNA, 14 nt, Homo sapiens
gacaucacagcagc

SEQ ID NO: 1693681 - RNA, 12 nt, Homo sapiens
gacaucaucaag

SEQ ID NO: 1693682 - RNA, 13 nt, Homo sapiens
gacaucucagggg

SEQ ID NO: 1693683 - RNA, 18 nt, Homo sapiens
gacaucucaggggccaga

SEQ ID NO: 1693684 - RNA, 16 nt, Homo sapiens
gacaugugaaaccuuu

SEQ ID NO: 1693685 - RNA, 13 nt, Homo sapiens
gacauuccagggg

SEQ ID NO: 1693686 - RNA, 20 nt, Homo sapiens
gacauucuggaaaagcaaaa

SEQ ID NO: 1693687 - RNA, 16 nt, Homo sapiens
gacauuggacuuccuc

SEQ ID NO: 1693688 - RNA, 22 nt, Homo sapiens
gacauuuaauuuagugaucuua

SEQ ID NO: 1693689 - RNA, 23 nt, Homo sapiens
gacauuuggugggcuuuggagcu

SEQ ID NO: 1693690 - RNA, 14 nt, Homo sapiens
gaccacaucuuuau

SEQ ID NO: 1693691 - RNA, 23 nt, Homo sapiens
gaccacuuccaggggaaccugcc

SEQ ID NO: 1693692 - RNA, 17 nt, Homo sapiens
gaccagccugaccaaca

SEQ ID NO: 1693693 - RNA, 20 nt, Homo sapiens
gaccagcucugggguuugua

SEQ ID NO: 1693694 - RNA, 18 nt, Homo sapiens
gaccaugguauauuccua

SEQ ID NO: 1693695 - RNA, 13 nt, Homo sapiens
gacccacauguaa

SEQ ID NO: 1693696 - RNA, 21 nt, Homo sapiens
gaccccugccuacuuccuucc

SEQ ID NO: 1693697 - RNA, 20 nt, Homo sapiens
gacccggaggggccuggcag

SEQ ID NO: 1693698 - RNA, 18 nt, Homo sapiens
gacccucgcccaacucca

SEQ ID NO: 1693699 - RNA, 15 nt, Homo sapiens
gaccgugaccaucuu

SEQ ID NO: 1693700 - RNA, 20 nt, Homo sapiens
gaccuaagggacucccacaa

SEQ ID NO: 1693701 - RNA, 19 nt, Homo sapiens
gaccucagggacaacugcc

SEQ ID NO: 1693702 - RNA, 20 nt, Homo sapiens
gaccucaggugauccaccca

SEQ ID NO: 1693703 - RNA, 20 nt, Homo sapiens
gaccuccagggagccuagaa

SEQ ID NO: 1693704 - RNA, 22 nt, Homo sapiens
gaccuccucuucccccuuccaa

SEQ ID NO: 1693705 - RNA, 19 nt, Homo sapiens
gaccucucauaaauuuacu

SEQ ID NO: 1693706 - RNA, 14 nt, Homo sapiens
gaccugagucaaug

SEQ ID NO: 1693707 - RNA, 15 nt, Homo sapiens
gaccugccuccuucc

SEQ ID NO: 1693708 - RNA, 16 nt, Homo sapiens
gaccuggagacugaca

SEQ ID NO: 1693709 - RNA, 19 nt, Homo sapiens
gaccuggccagagccaaga

SEQ ID NO: 1693710 - RNA, 23 nt, Homo sapiens
gaccugguacaaaugcacgucac

SEQ ID NO: 1693711 - RNA, 18 nt, Homo sapiens
gaccuguauuuaagcaaa

SEQ ID NO: 1693712 - RNA, 15 nt, Homo sapiens
gaccuuccucaucca

SEQ ID NO: 1693713 - RNA, 15 nt, Homo sapiens
gaccuuggcagccca

SEQ ID NO: 1693714 - RNA, 22 nt, Homo sapiens
gacggcgugccuggacacugua

SEQ ID NO: 1693715 - RNA, 19 nt, Homo sapiens
gacgugugagggaggacag

SEQ ID NO: 1693716 - RNA, 19 nt, Homo sapiens
gacguucauuauguaugaa

SEQ ID NO: 1693717 - RNA, 13 nt, Homo sapiens
gacuacaaccaau

SEQ ID NO: 1693718 - RNA, 20 nt, Homo sapiens
gacuacaaccaauuuacacu

SEQ ID NO: 1693719 - RNA, 22 nt, Homo sapiens
gacuacuuagcauccuaagaaa

SEQ ID NO: 1693720 - RNA, 18 nt, Homo sapiens
gacuauuugcuuauuuaa

SEQ ID NO: 1693721 - RNA, 17 nt, Homo sapiens
gacucagggccaugccu

SEQ ID NO: 1693722 - RNA, 13 nt, Homo sapiens
gacuccaucucaa

SEQ ID NO: 1693723 - RNA, 21 nt, Homo sapiens
gacucccacaacaacaaaagc

SEQ ID NO: 1693724 - RNA, 22 nt, Homo sapiens
cuuuuaaaaacuagagcacaga

SEQ ID NO: 1693725 - RNA, 18 nt, Homo sapiens
cuuuuaaaacacuuccau

SEQ ID NO: 1693726 - RNA, 12 nt, Homo sapiens
cuuuuacauucu

SEQ ID NO: 1693727 - RNA, 13 nt, Homo sapiens
cuuuuacauucug

SEQ ID NO: 1693728 - RNA, 23 nt, Homo sapiens
cuuuuauaggugagaaaaaaaca

SEQ ID NO: 1693729 - RNA, 16 nt, Homo sapiens
cuuuuauaguggaaaa

SEQ ID NO: 1693730 - RNA, 13 nt, Homo sapiens
cuuuuaugcagau

SEQ ID NO: 1693731 - RNA, 17 nt, Homo sapiens
cuuuuauucauuagcug

SEQ ID NO: 1693732 - RNA, 18 nt, Homo sapiens
cuuuuauugacacagaaa

SEQ ID NO: 1693733 - RNA, 23 nt, Homo sapiens
cuuuuauuuuacacagaaacacu

SEQ ID NO: 1693734 - RNA, 22 nt, Homo sapiens
cuuuucaagacuuccucaugaa

SEQ ID NO: 1693735 - RNA, 15 nt, Homo sapiens
cuuuuccuuucugcc

SEQ ID NO: 1693736 - RNA, 16 nt, Homo sapiens
cuuuucugaucugcag

SEQ ID NO: 1693737 - RNA, 19 nt, Homo sapiens
cuuuucuguacuuccugag

SEQ ID NO: 1693738 - RNA, 16 nt, Homo sapiens
cuuuucuuuuucuccc

SEQ ID NO: 1693739 - RNA, 23 nt, Homo sapiens
cuuuugguguguuggacagagaa

SEQ ID NO: 1693740 - RNA, 18 nt, Homo sapiens
cuuuuguuuugaguuacu

SEQ ID NO: 1693741 - RNA, 13 nt, Homo sapiens
cuuuuuaguuuac

SEQ ID NO: 1693742 - RNA, 12 nt, Homo sapiens
cuuuuuccagag

SEQ ID NO: 1693743 - RNA, 16 nt, Homo sapiens
cuuuuuccuccuggaa

SEQ ID NO: 1693744 - RNA, 13 nt, Homo sapiens
cuuuuucuuugag

SEQ ID NO: 1693745 - RNA, 22 nt, Homo sapiens
gaaaaaacugugccuuguuuca

SEQ ID NO: 1693746 - RNA, 16 nt, Homo sapiens
gaaaaaccacucccag

SEQ ID NO: 1693747 - RNA, 13 nt, Homo sapiens
gaaaaauaaaucu

SEQ ID NO: 1693748 - RNA, 18 nt, Homo sapiens
gaaaaauguaacuuagag

SEQ ID NO: 1693749 - RNA, 17 nt, Homo sapiens
gaaaaauguuugucuca

SEQ ID NO: 1693750 - RNA, 16 nt, Homo sapiens
gaaaacaucucaauaa

SEQ ID NO: 1693751 - RNA, 11 nt, Homo sapiens
gaaaaccuaaa

SEQ ID NO: 1693752 - RNA, 16 nt, Homo sapiens
gaaaaccuacauauuc

SEQ ID NO: 1693753 - RNA, 16 nt, Homo sapiens
gaaaacuguuaccuaa

SEQ ID NO: 1693754 - RNA, 23 nt, Homo sapiens
gaaaagaacacuagagucuguca

SEQ ID NO: 1693755 - RNA, 17 nt, Homo sapiens
gaaaagauuuaagcaca

SEQ ID NO: 1693756 - RNA, 17 nt, Homo sapiens
gaaaagcuauuagccag

SEQ ID NO: 1693757 - RNA, 19 nt, Homo sapiens
gaaaagguucuucaucccu

SEQ ID NO: 1693758 - RNA, 12 nt, Homo sapiens
gaaaauaugccu

SEQ ID NO: 1693759 - RNA, 15 nt, Homo sapiens
gaaaaucuauuccug

SEQ ID NO: 1693760 - RNA, 17 nt, Homo sapiens
gaaaaucuauuccugcc

SEQ ID NO: 1693761 - RNA, 12 nt, Homo sapiens
gaaaauguucau

SEQ ID NO: 1693762 - RNA, 21 nt, Homo sapiens
gaaaauguugagaaucccaaa

SEQ ID NO: 1693763 - RNA, 22 nt, Homo sapiens
gaaacacaaaccacaacugaca

SEQ ID NO: 1693764 - RNA, 13 nt, Homo sapiens
gaaacacugccuu

SEQ ID NO: 1693765 - RNA, 10 nt, Homo sapiens
gaaacauuua

SEQ ID NO: 1693766 - RNA, 20 nt, Homo sapiens
gaaaccccccagagcucuuu

SEQ ID NO: 1693767 - RNA, 18 nt, Homo sapiens
gaaaccgccuaguuuacu

SEQ ID NO: 1693768 - RNA, 21 nt, Homo sapiens
gaaacgucuucuaaacuuccc

SEQ ID NO: 1693769 - RNA, 15 nt, Homo sapiens
gaaacuauacauuua

SEQ ID NO: 1693770 - RNA, 13 nt, Homo sapiens
gaaagaaccagag

SEQ ID NO: 1693771 - RNA, 15 nt, Homo sapiens
gaaagacacugccug

SEQ ID NO: 1693772 - RNA, 13 nt, Homo sapiens
gaaagacacuguu

SEQ ID NO: 1693773 - RNA, 21 nt, Homo sapiens
gaaagaccaucuccccaggcu

SEQ ID NO: 1693774 - RNA, 21 nt, Homo sapiens
gaaagauugauuaaugaacua

SEQ ID NO: 1693775 - RNA, 14 nt, Homo sapiens
gaaagccucacuga

SEQ ID NO: 1693776 - RNA, 17 nt, Homo sapiens
gaaagcuggugucugau

SEQ ID NO: 1693777 - RNA, 18 nt, Homo sapiens
gaaagcuucaaacugcau

SEQ ID NO: 1693778 - RNA, 23 nt, Homo sapiens
gaaaggaaaaccugaagacugag

SEQ ID NO: 1693779 - RNA, 17 nt, Homo sapiens
gaaaggaagcuccacug

SEQ ID NO: 1693780 - RNA, 16 nt, Homo sapiens
gaaaguacauuuggag

SEQ ID NO: 1693781 - RNA, 16 nt, Homo sapiens
gaaauaaacuucacug

SEQ ID NO: 1693782 - RNA, 19 nt, Homo sapiens
gaaauaaaggaugugauug

SEQ ID NO: 1693783 - RNA, 15 nt, Homo sapiens
gaaauaacaauguua

SEQ ID NO: 1693784 - RNA, 13 nt, Homo sapiens
gaaauagugacau

SEQ ID NO: 1693785 - RNA, 14 nt, Homo sapiens
gaaaucaaugcaag

SEQ ID NO: 1693786 - RNA, 16 nt, Homo sapiens
gaaaucaguguuuuag

SEQ ID NO: 1693787 - RNA, 22 nt, Homo sapiens
gaaaugauccccaaguggugaa

SEQ ID NO: 1693788 - RNA, 21 nt, Homo sapiens
gaaauggaugcaaaguacaau

SEQ ID NO: 1693789 - RNA, 17 nt, Homo sapiens
gaaauguaccuucuuuc

SEQ ID NO: 1693790 - RNA, 18 nt, Homo sapiens
gaaauuuauuuaauguga

SEQ ID NO: 1693791 - RNA, 13 nt, Homo sapiens
gaacaaauauuca

SEQ ID NO: 1693792 - RNA, 18 nt, Homo sapiens
gaacaacuccaaaaccca

SEQ ID NO: 1693793 - RNA, 15 nt, Homo sapiens
gaacacacauuauua

SEQ ID NO: 1693794 - RNA, 18 nt, Homo sapiens
gaacacucuuuugcuuua

SEQ ID NO: 1693795 - RNA, 19 nt, Homo sapiens
gaacagaaggaugaaugag

SEQ ID NO: 1693796 - RNA, 20 nt, Homo sapiens
gaacagaccggagaggacag

SEQ ID NO: 1693797 - RNA, 15 nt, Homo sapiens
gaacagcacugggga

SEQ ID NO: 1693798 - RNA, 20 nt, Homo sapiens
gaacauaaaaaggacaucag

SEQ ID NO: 1693799 - RNA, 23 nt, Homo sapiens
gaacauuucuguaaauaccauug

SEQ ID NO: 1693800 - RNA, 22 nt, Homo sapiens
gaaccaacacagacacccaagc

SEQ ID NO: 1693801 - RNA, 16 nt, Homo sapiens
gaacuaaauguucuau

SEQ ID NO: 1693802 - RNA, 16 nt, Homo sapiens
gaacuacagcucuuaa

SEQ ID NO: 1693803 - RNA, 15 nt, Homo sapiens
gaacuagagaaggac

SEQ ID NO: 1693804 - RNA, 16 nt, Homo sapiens
gaacuaggguaaggug

SEQ ID NO: 1693805 - RNA, 14 nt, Homo sapiens
gaacuauguacuuu

SEQ ID NO: 1693806 - RNA, 20 nt, Homo sapiens
gaacuauuucuacacagugg

SEQ ID NO: 1693807 - RNA, 22 nt, Homo sapiens
gaacugggagcagcucugugac

SEQ ID NO: 1693808 - RNA, 23 nt, Homo sapiens
gaacuguacacuuguuuggugcu

SEQ ID NO: 1693809 - RNA, 15 nt, Homo sapiens
gaacuguccagagag

SEQ ID NO: 1693810 - RNA, 16 nt, Homo sapiens
gaacugugcauagugc

SEQ ID NO: 1693811 - RNA, 23 nt, Homo sapiens
gaacugugcauagugcugggaug

SEQ ID NO: 1693812 - RNA, 19 nt, Homo sapiens
gaacuucuuugaauuuacu

SEQ ID NO: 1693813 - RNA, 14 nt, Homo sapiens
gaagaagcuauguc

SEQ ID NO: 1693814 - RNA, 12 nt, Homo sapiens
gaagaauggaga

SEQ ID NO: 1693815 - RNA, 14 nt, Homo sapiens
gaagagaagcugcu

SEQ ID NO: 1693816 - RNA, 16 nt, Homo sapiens
gaagagaagcugcuga

SEQ ID NO: 1693817 - RNA, 20 nt, Homo sapiens
gaagagaagcugcugaccaa

SEQ ID NO: 1693818 - RNA, 14 nt, Homo sapiens
gaagagggucccuc

SEQ ID NO: 1693819 - RNA, 23 nt, Homo sapiens
gaagaguguuucuuccacaacag

SEQ ID NO: 1693820 - RNA, 16 nt, Homo sapiens
gaagauagaugcacuu

SEQ ID NO: 1693821 - RNA, 23 nt, Homo sapiens
gaagauauuacuacuuaccauuu

SEQ ID NO: 1693822 - RNA, 20 nt, Homo sapiens
gaagcaggagauuugcuuga

SEQ ID NO: 1693823 - RNA, 23 nt, Homo sapiens
gaagcaguuuaugagacagcuga

SEQ ID NO: 1693824 - RNA, 17 nt, Homo sapiens
gaagcauuuacuuugug

SEQ ID NO: 1693825 - RNA, 13 nt, Homo sapiens
gaagccuugccua

SEQ ID NO: 1693826 - RNA, 15 nt, Homo sapiens
gaagcuccacuguca

SEQ ID NO: 1693827 - RNA, 13 nt, Homo sapiens
gaagcugcugacc

SEQ ID NO: 1693828 - RNA, 22 nt, Homo sapiens
gaagcuggggaggagcuuuguu

SEQ ID NO: 1693829 - RNA, 16 nt, Homo sapiens
gaagcuggugcgcccu

SEQ ID NO: 1693830 - RNA, 14 nt, Homo sapiens
gaaggaguucacug

SEQ ID NO: 1693831 - RNA, 12 nt, Homo sapiens
gaaggcaaaauu

SEQ ID NO: 1693832 - RNA, 16 nt, Homo sapiens
gaaggcagccaccagc

SEQ ID NO: 1693833 - RNA, 19 nt, Homo sapiens
gaagggggggcuacauuau

SEQ ID NO: 1693834 - RNA, 18 nt, Homo sapiens
cuucagcaugauguguug

SEQ ID NO: 1693835 - RNA, 22 nt, Homo sapiens
cuucaucgaaucuacuaauucc

SEQ ID NO: 1693836 - RNA, 12 nt, Homo sapiens
cuucaucuguga

SEQ ID NO: 1693837 - RNA, 20 nt, Homo sapiens
cuucauucuccuuguuguug

SEQ ID NO: 1693838 - RNA, 14 nt, Homo sapiens
cuucauuuguguca

SEQ ID NO: 1693839 - RNA, 19 nt, Homo sapiens
cuucauuuuauuaauauuu

SEQ ID NO: 1693840 - RNA, 14 nt, Homo sapiens
cuuccaacaaggaa

SEQ ID NO: 1693841 - RNA, 13 nt, Homo sapiens
cuuccacugccuc

SEQ ID NO: 1693842 - RNA, 13 nt, Homo sapiens
cuuccagauccug

SEQ ID NO: 1693843 - RNA, 21 nt, Homo sapiens
cuuccagggggaaggccaagg

SEQ ID NO: 1693844 - RNA, 23 nt, Homo sapiens
cuuccagguguuacuguaauucc

SEQ ID NO: 1693845 - RNA, 16 nt, Homo sapiens
cuuccauauuuggaag

SEQ ID NO: 1693846 - RNA, 22 nt, Homo sapiens
cuuccaucccaaccagugccaa

SEQ ID NO: 1693847 - RNA, 17 nt, Homo sapiens
cuuccaugacccuuugc

SEQ ID NO: 1693848 - RNA, 16 nt, Homo sapiens
cuuccccaucuucuaa

SEQ ID NO: 1693849 - RNA, 12 nt, Homo sapiens
cuucccugauug

SEQ ID NO: 1693850 - RNA, 13 nt, Homo sapiens
cuucccugcauuu

SEQ ID NO: 1693851 - RNA, 22 nt, Homo sapiens
cuucccuugcuggaaaacccaa

SEQ ID NO: 1693852 - RNA, 20 nt, Homo sapiens
cuucccuuucugcuuguguu

SEQ ID NO: 1693853 - RNA, 16 nt, Homo sapiens
cuuccugugacuucag

SEQ ID NO: 1693854 - RNA, 15 nt, Homo sapiens
cuuccugugauccac

SEQ ID NO: 1693855 - RNA, 20 nt, Homo sapiens
cuuccugugauccacccaac

SEQ ID NO: 1693856 - RNA, 22 nt, Homo sapiens
cuuccuuccacucccuuugcca

SEQ ID NO: 1693857 - RNA, 20 nt, Homo sapiens
cuuccuuuaaagaugaacuc

SEQ ID NO: 1693858 - RNA, 20 nt, Homo sapiens
cuuccuuucccaagccuucg

SEQ ID NO: 1693859 - RNA, 23 nt, Homo sapiens
cuucgauacaccgggccuggaga

SEQ ID NO: 1693860 - RNA, 22 nt, Homo sapiens
cuucuauuccauggcuaacugg

SEQ ID NO: 1693861 - RNA, 16 nt, Homo sapiens
cuucucaucuugugaa

SEQ ID NO: 1693862 - RNA, 15 nt, Homo sapiens
cuucuccaucuccug

SEQ ID NO: 1693863 - RNA, 16 nt, Homo sapiens
cuucuccuaugcauuu

SEQ ID NO: 1693864 - RNA, 10 nt, Homo sapiens
cuucucucac

SEQ ID NO: 1693865 - RNA, 23 nt, Homo sapiens
cuucucuucccugcgccugugau

SEQ ID NO: 1693866 - RNA, 19 nt, Homo sapiens
cuucugacacugaaacuuc

SEQ ID NO: 1693867 - RNA, 23 nt, Homo sapiens
cuucuggggcaggcugggccaug

SEQ ID NO: 1693868 - RNA, 19 nt, Homo sapiens
cuucuggggguagaucuca

SEQ ID NO: 1693869 - RNA, 20 nt, Homo sapiens
cuucuggggguagaucucaa

SEQ ID NO: 1693870 - RNA, 17 nt, Homo sapiens
cuucuugucagacauaa

SEQ ID NO: 1693871 - RNA, 13 nt, Homo sapiens
cuucuuguucccc

SEQ ID NO: 1693872 - RNA, 13 nt, Homo sapiens
cuucuuuucucau

SEQ ID NO: 1693873 - RNA, 18 nt, Homo sapiens
cuugaaauguaggcauca

SEQ ID NO: 1693874 - RNA, 15 nt, Homo sapiens
cuugaaugcugccag

SEQ ID NO: 1693875 - RNA, 20 nt, Homo sapiens
cuugaccucaggugauccac

SEQ ID NO: 1693876 - RNA, 23 nt, Homo sapiens
cuugaccucucauaaauuuacuu

SEQ ID NO: 1693877 - RNA, 15 nt, Homo sapiens
cuugagcgugaaucu

SEQ ID NO: 1693878 - RNA, 19 nt, Homo sapiens
cuugauagcaaacacuggg

SEQ ID NO: 1693879 - RNA, 20 nt, Homo sapiens
cuugaugccauaugccuugg

SEQ ID NO: 1693880 - RNA, 23 nt, Homo sapiens
cuugauuaagauuuuacaaaaga

SEQ ID NO: 1693881 - RNA, 20 nt, Homo sapiens
cuugauuagugccuucugcc

SEQ ID NO: 1693882 - RNA, 16 nt, Homo sapiens
cuugcagaacugccau

SEQ ID NO: 1693883 - RNA, 18 nt, Homo sapiens
cuugcagcugauguugga

SEQ ID NO: 1693884 - RNA, 17 nt, Homo sapiens
cuugcaguuaaggguua

SEQ ID NO: 1693885 - RNA, 18 nt, Homo sapiens
cuugcaguuaaggguuag

SEQ ID NO: 1693886 - RNA, 18 nt, Homo sapiens
cuugcuaauuuucucaaa

SEQ ID NO: 1693887 - RNA, 16 nt, Homo sapiens
cuugcuggacggggac

SEQ ID NO: 1693888 - RNA, 14 nt, Homo sapiens
cuuggacaagacaa

SEQ ID NO: 1693889 - RNA, 21 nt, Homo sapiens
cuuggacuguguuuuuccucc

SEQ ID NO: 1693890 - RNA, 23 nt, Homo sapiens
cuuggauagcuaauaaugagcua

SEQ ID NO: 1693891 - RNA, 16 nt, Homo sapiens
cuuggcuucugugaug

SEQ ID NO: 1693892 - RNA, 16 nt, Homo sapiens
cuuggcuuuucuagcc

SEQ ID NO: 1693893 - RNA, 17 nt, Homo sapiens
cuugggacauugcaauu

SEQ ID NO: 1693894 - RNA, 14 nt, Homo sapiens
cuugggaugaucuu

SEQ ID NO: 1693895 - RNA, 22 nt, Homo sapiens
cuugggucucauuuagaacuug

SEQ ID NO: 1693896 - RNA, 23 nt, Homo sapiens
cuuguaaauagcucagguguccc

SEQ ID NO: 1693897 - RNA, 12 nt, Homo sapiens
cuuguagcauau

SEQ ID NO: 1693898 - RNA, 15 nt, Homo sapiens
cuuguagcuguaaaa

SEQ ID NO: 1693899 - RNA, 19 nt, Homo sapiens
cuuguaggauaagugaaau

SEQ ID NO: 1693900 - RNA, 16 nt, Homo sapiens
cuuguauaguguaaaa

SEQ ID NO: 1693901 - RNA, 19 nt, Homo sapiens
cuugucacugacacaaagg

SEQ ID NO: 1693902 - RNA, 15 nt, Homo sapiens
cuuguguuaugaagc

SEQ ID NO: 1693903 - RNA, 16 nt, Homo sapiens
cuuguuugucuuccau

SEQ ID NO: 1693904 - RNA, 16 nt, Homo sapiens
cuuguuuuaugcucag

SEQ ID NO: 1693905 - RNA, 14 nt, Homo sapiens
cuuuaaacauugac

SEQ ID NO: 1693906 - RNA, 15 nt, Homo sapiens
cuuuaaagauguaau

SEQ ID NO: 1693907 - RNA, 22 nt, Homo sapiens
cuuuaaccccaaauuuggcuaa

SEQ ID NO: 1693908 - RNA, 21 nt, Homo sapiens
cuuuaagggcaugccuugugc

SEQ ID NO: 1693909 - RNA, 22 nt, Homo sapiens
cuuuaauaguuuugauccuaaa

SEQ ID NO: 1693910 - RNA, 15 nt, Homo sapiens
cuuuacaaauauguc

SEQ ID NO: 1693911 - RNA, 20 nt, Homo sapiens
cuuuauagagugucucaggg

SEQ ID NO: 1693912 - RNA, 22 nt, Homo sapiens
cuuuauagagugucucagggug

SEQ ID NO: 1693913 - RNA, 19 nt, Homo sapiens
cuuucaccacaugugcaca

SEQ ID NO: 1693914 - RNA, 14 nt, Homo sapiens
cuuucacucuguca

SEQ ID NO: 1693915 - RNA, 18 nt, Homo sapiens
cuuucaucacaaauccaa

SEQ ID NO: 1693916 - RNA, 22 nt, Homo sapiens
cuuucccagaaaaaaaaaaacu

SEQ ID NO: 1693917 - RNA, 16 nt, Homo sapiens
cuuuccccuaagcaga

SEQ ID NO: 1693918 - RNA, 20 nt, Homo sapiens
cuuucccucgcuaugugcac

SEQ ID NO: 1693919 - RNA, 14 nt, Homo sapiens
cuuuccugcucugg

SEQ ID NO: 1693920 - RNA, 21 nt, Homo sapiens
cuuuccugguuuucaucagga

SEQ ID NO: 1693921 - RNA, 13 nt, Homo sapiens
cuuuccuuccuaa

SEQ ID NO: 1693922 - RNA, 20 nt, Homo sapiens
cuuucuaaugcugauaugau

SEQ ID NO: 1693923 - RNA, 15 nt, Homo sapiens
cuuucuaauguuucu

SEQ ID NO: 1693924 - RNA, 22 nt, Homo sapiens
cuuucuaggagggagacacugg

SEQ ID NO: 1693925 - RNA, 23 nt, Homo sapiens
cuuucuaggagggagacacuggc

SEQ ID NO: 1693926 - RNA, 18 nt, Homo sapiens
cuuucuccaggaccaaua

SEQ ID NO: 1693927 - RNA, 17 nt, Homo sapiens
cuuucucucagccuuac

SEQ ID NO: 1693928 - RNA, 18 nt, Homo sapiens
cuuucugccaacuuuguu

SEQ ID NO: 1693929 - RNA, 18 nt, Homo sapiens
cuuucuuuagcaugcuac

SEQ ID NO: 1693930 - RNA, 13 nt, Homo sapiens
cuuugaauguggc

SEQ ID NO: 1693931 - RNA, 13 nt, Homo sapiens
cuuugacauuucc

SEQ ID NO: 1693932 - RNA, 21 nt, Homo sapiens
cuuugagaagccuucagcucc

SEQ ID NO: 1693933 - RNA, 17 nt, Homo sapiens
cuuugagacugggucuc

SEQ ID NO: 1693934 - RNA, 13 nt, Homo sapiens
cuuugauucuccu

SEQ ID NO: 1693935 - RNA, 18 nt, Homo sapiens
cuuugcaaaucaguguuu

SEQ ID NO: 1693936 - RNA, 18 nt, Homo sapiens
cuuugcacaggaugcugg

SEQ ID NO: 1693937 - RNA, 21 nt, Homo sapiens
cuuugccccuggggcuuccau

SEQ ID NO: 1693938 - RNA, 15 nt, Homo sapiens
cuuugcucuuuggua

SEQ ID NO: 1693939 - RNA, 21 nt, Homo sapiens
cuuuggggucuacacugcaau

SEQ ID NO: 1693940 - RNA, 17 nt, Homo sapiens
cuuugucccggggcucc

SEQ ID NO: 1693941 - RNA, 13 nt, Homo sapiens
cuuuguggaccaa

SEQ ID NO: 1693942 - RNA, 13 nt, Homo sapiens
cuuuguguagaaa

SEQ ID NO: 1693943 - RNA, 17 nt, Homo sapiens
cugggacuacaggugug

SEQ ID NO: 1693944 - RNA, 18 nt, Homo sapiens
cugggauggaggggagug

SEQ ID NO: 1693945 - RNA, 15 nt, Homo sapiens
cugggauguuuugag

SEQ ID NO: 1693946 - RNA, 20 nt, Homo sapiens
cugggauuacaggugugaac

SEQ ID NO: 1693947 - RNA, 22 nt, Homo sapiens
cugggcauauccaccaccuccc

SEQ ID NO: 1693948 - RNA, 17 nt, Homo sapiens
cugggccauguccaaag

SEQ ID NO: 1693949 - RNA, 15 nt, Homo sapiens
cuggggagcucagga

SEQ ID NO: 1693950 - RNA, 14 nt, Homo sapiens
cuggggaggugaac

SEQ ID NO: 1693951 - RNA, 16 nt, Homo sapiens
cuggggaggugaacug

SEQ ID NO: 1693952 - RNA, 15 nt, Homo sapiens
cuggggcaaugggag

SEQ ID NO: 1693953 - RNA, 18 nt, Homo sapiens
cuggggcuuccaucccaa

SEQ ID NO: 1693954 - RNA, 23 nt, Homo sapiens
cuggggggcguggagagcccggc

SEQ ID NO: 1693955 - RNA, 23 nt, Homo sapiens
cuggguacugaaagccuuaggga

SEQ ID NO: 1693956 - RNA, 12 nt, Homo sapiens
cuggguggugga

SEQ ID NO: 1693957 - RNA, 15 nt, Homo sapiens
cuggguucugcuacu

SEQ ID NO: 1693958 - RNA, 20 nt, Homo sapiens
cugguaauuuaagauuccag

SEQ ID NO: 1693959 - RNA, 16 nt, Homo sapiens
cuggucuuggugaaca

SEQ ID NO: 1693960 - RNA, 15 nt, Homo sapiens
cuggugugaccugag

SEQ ID NO: 1693961 - RNA, 15 nt, Homo sapiens
cuggugugcucucuu

SEQ ID NO: 1693962 - RNA, 15 nt, Homo sapiens
cugguuagaaaugca

SEQ ID NO: 1693963 - RNA, 12 nt, Homo sapiens
cugguuuuaaca

SEQ ID NO: 1693964 - RNA, 14 nt, Homo sapiens
cuguaaacuuccaa

SEQ ID NO: 1693965 - RNA, 20 nt, Homo sapiens
cuguaaauaccauugacaca

SEQ ID NO: 1693966 - RNA, 21 nt, Homo sapiens
cuguaagauuguccagugcaa

SEQ ID NO: 1693967 - RNA, 13 nt, Homo sapiens
cuguaagcuccuu

SEQ ID NO: 1693968 - RNA, 23 nt, Homo sapiens
cuguaaguaacuucacauuaaaa

SEQ ID NO: 1693969 - RNA, 16 nt, Homo sapiens
cuguacaaugacacuu

SEQ ID NO: 1693970 - RNA, 14 nt, Homo sapiens
cuguacauuucaca

SEQ ID NO: 1693971 - RNA, 16 nt, Homo sapiens
cuguaccgacuuugau

SEQ ID NO: 1693972 - RNA, 18 nt, Homo sapiens
cuguaccucaucccauga

SEQ ID NO: 1693973 - RNA, 12 nt, Homo sapiens
cuguacugagga

SEQ ID NO: 1693974 - RNA, 20 nt, Homo sapiens
cuguagcgccaguguaaucc

SEQ ID NO: 1693975 - RNA, 17 nt, Homo sapiens
cuguauaagcacugaaa

SEQ ID NO: 1693976 - RNA, 20 nt, Homo sapiens
cuguauacuuuaguaugacg

SEQ ID NO: 1693977 - RNA, 15 nt, Homo sapiens
cuguaugcucacaac

SEQ ID NO: 1693978 - RNA, 23 nt, Homo sapiens
cugucacagaguagaaacucaaa

SEQ ID NO: 1693979 - RNA, 23 nt, Homo sapiens
cugucacugaugguggcucuggu

SEQ ID NO: 1693980 - RNA, 18 nt, Homo sapiens
cugucauucaaaugggug

SEQ ID NO: 1693981 - RNA, 20 nt, Homo sapiens
cugucauuucagauauucca

SEQ ID NO: 1693982 - RNA, 22 nt, Homo sapiens
cuguccaucagccaggacaguc

SEQ ID NO: 1693983 - RNA, 17 nt, Homo sapiens
cuguccugaccaucgca

SEQ ID NO: 1693984 - RNA, 12 nt, Homo sapiens
cuguccuugccc

SEQ ID NO: 1693985 - RNA, 17 nt, Homo sapiens
cugucuccuuucucagc

SEQ ID NO: 1693986 - RNA, 14 nt, Homo sapiens
cugucugacaaccu

SEQ ID NO: 1693987 - RNA, 20 nt, Homo sapiens
cugugaaauucacaguaaua

SEQ ID NO: 1693988 - RNA, 16 nt, Homo sapiens
cugugaacccacugaa

SEQ ID NO: 1693989 - RNA, 21 nt, Homo sapiens
cugugacucccccucuuucac

SEQ ID NO: 1693990 - RNA, 22 nt, Homo sapiens
cugugacucgagucacacucaa

SEQ ID NO: 1693991 - RNA, 17 nt, Homo sapiens
cugugccucugccuguc

SEQ ID NO: 1693992 - RNA, 14 nt, Homo sapiens
cugugcguuacuaa

SEQ ID NO: 1693993 - RNA, 23 nt, Homo sapiens
cugugcugugacucgagucacac

SEQ ID NO: 1693994 - RNA, 18 nt, Homo sapiens
cuguggaacauaaaaagg

SEQ ID NO: 1693995 - RNA, 16 nt, Homo sapiens
cuguggauacccuuac

SEQ ID NO: 1693996 - RNA, 20 nt, Homo sapiens
cuguggaugaugguugcaaa

SEQ ID NO: 1693997 - RNA, 13 nt, Homo sapiens
cugugguggagaa

SEQ ID NO: 1693998 - RNA, 18 nt, Homo sapiens
cuguguagacuauuugcu

SEQ ID NO: 1693999 - RNA, 16 nt, Homo sapiens
cugugucaaaagccag

SEQ ID NO: 1694000 - RNA, 15 nt, Homo sapiens
cugugucuguauaca

SEQ ID NO: 1694001 - RNA, 20 nt, Homo sapiens
cugugucuugcaauggcagc

SEQ ID NO: 1694002 - RNA, 20 nt, Homo sapiens
cuguuagcacuguugaugua

SEQ ID NO: 1694003 - RNA, 16 nt, Homo sapiens
cuguucuugcugcuag

SEQ ID NO: 1694004 - RNA, 22 nt, Homo sapiens
cuguugaaaauuauuuuaaaca

SEQ ID NO: 1694005 - RNA, 11 nt, Homo sapiens
cuguugcuuga

SEQ ID NO: 1694006 - RNA, 19 nt, Homo sapiens
cuguugcuugaauagcaau

SEQ ID NO: 1694007 - RNA, 12 nt, Homo sapiens
cuguuggaugau

SEQ ID NO: 1694008 - RNA, 17 nt, Homo sapiens
cuguuggauuccaugcu

SEQ ID NO: 1694009 - RNA, 19 nt, Homo sapiens
cuguuggccagugugacaa

SEQ ID NO: 1694010 - RNA, 16 nt, Homo sapiens
cuguugguuagauuca

SEQ ID NO: 1694011 - RNA, 17 nt, Homo sapiens
cuguuugguguguccca

SEQ ID NO: 1694012 - RNA, 23 nt, Homo sapiens
cuuaaaauagaaauaagugguua

SEQ ID NO: 1694013 - RNA, 14 nt, Homo sapiens
cuuaaagugcaguu

SEQ ID NO: 1694014 - RNA, 14 nt, Homo sapiens
cuuaacacauucaa

SEQ ID NO: 1694015 - RNA, 21 nt, Homo sapiens
cuuaacacauucaauagcaua

SEQ ID NO: 1694016 - RNA, 16 nt, Homo sapiens
cuuaacccaaggagca

SEQ ID NO: 1694017 - RNA, 12 nt, Homo sapiens
cuuaagauuugg

SEQ ID NO: 1694018 - RNA, 19 nt, Homo sapiens
cuuaagauuuugcaccugu

SEQ ID NO: 1694019 - RNA, 16 nt, Homo sapiens
cuuaauacuaccuuga

SEQ ID NO: 1694020 - RNA, 16 nt, Homo sapiens
cuuaauuaaauaucaa

SEQ ID NO: 1694021 - RNA, 17 nt, Homo sapiens
cuuaauuucuaaagaua

SEQ ID NO: 1694022 - RNA, 21 nt, Homo sapiens
cuuacacuacauuagaacacu

SEQ ID NO: 1694023 - RNA, 12 nt, Homo sapiens
cuuacagaauua

SEQ ID NO: 1694024 - RNA, 14 nt, Homo sapiens
cuuaccugacacaa

SEQ ID NO: 1694025 - RNA, 13 nt, Homo sapiens
cuuacuacacuga

SEQ ID NO: 1694026 - RNA, 16 nt, Homo sapiens
cuuacuacacugagga

SEQ ID NO: 1694027 - RNA, 12 nt, Homo sapiens
cuuacuauucau

SEQ ID NO: 1694028 - RNA, 20 nt, Homo sapiens
cuuacucuaagaucuuagau

SEQ ID NO: 1694029 - RNA, 13 nt, Homo sapiens
cuuacuggugcua

SEQ ID NO: 1694030 - RNA, 15 nt, Homo sapiens
cuuacuuaugccaua

SEQ ID NO: 1694031 - RNA, 14 nt, Homo sapiens
cuuagacauaacaa

SEQ ID NO: 1694032 - RNA, 15 nt, Homo sapiens
cuuagggugaaccac

SEQ ID NO: 1694033 - RNA, 12 nt, Homo sapiens
cuuagugacaaa

SEQ ID NO: 1694034 - RNA, 16 nt, Homo sapiens
cuuagugacaaaauag

SEQ ID NO: 1694035 - RNA, 22 nt, Homo sapiens
cuuauagcacuuugaaauaccu

SEQ ID NO: 1694036 - RNA, 19 nt, Homo sapiens
cuuauauuuucguaugaaa

SEQ ID NO: 1694037 - RNA, 13 nt, Homo sapiens
cuuaugauucaga

SEQ ID NO: 1694038 - RNA, 16 nt, Homo sapiens
cuuaugcaaucuaugu

SEQ ID NO: 1694039 - RNA, 21 nt, Homo sapiens
cuuauucacugaaguucuccu

SEQ ID NO: 1694040 - RNA, 23 nt, Homo sapiens
cuuauuuaaugccgauauacucu

SEQ ID NO: 1694041 - RNA, 21 nt, Homo sapiens
cuucaaaacggggcagccaaa

SEQ ID NO: 1694042 - RNA, 22 nt, Homo sapiens
cuucaaggcccauaucugugaa

SEQ ID NO: 1694043 - RNA, 14 nt, Homo sapiens
cuucaaggcuucca

SEQ ID NO: 1694044 - RNA, 22 nt, Homo sapiens
cuucaaugggcucuuccaacaa

SEQ ID NO: 1694045 - RNA, 20 nt, Homo sapiens
cuucacaguagagccagcuu

SEQ ID NO: 1694046 - RNA, 16 nt, Homo sapiens
cuucacucacugucaa

SEQ ID NO: 1694047 - RNA, 13 nt, Homo sapiens
cuucacuuuacaa

SEQ ID NO: 1694048 - RNA, 14 nt, Homo sapiens
cuucagaauuccau

SEQ ID NO: 1694049 - RNA, 15 nt, Homo sapiens
cuucagaauuccaua

SEQ ID NO: 1694050 - RNA, 23 nt, Homo sapiens
cuucagagacuucguaauuaaag

SEQ ID NO: 1694051 - RNA, 17 nt, Homo sapiens
cuucagauacaaacugc

SEQ ID NO: 1694052 - RNA, 24 nt, Homo sapiens
cuucagauggugaagcauucuccc

SEQ ID NO: 1694053 - RNA, 22 nt, Homo sapiens
ccuccugugaaccaacacagac

SEQ ID NO: 1694054 - RNA, 20 nt, Homo sapiens
ccuccuuccccccaccagac

SEQ ID NO: 1694055 - RNA, 12 nt, Homo sapiens
ccucgcuaugug

SEQ ID NO: 1694056 - RNA, 13 nt, Homo sapiens
ccucuaagguugg

SEQ ID NO: 1694057 - RNA, 12 nt, Homo sapiens
ccucuaaugaga

SEQ ID NO: 1694058 - RNA, 18 nt, Homo sapiens
ccucucccaaguccacac

SEQ ID NO: 1694059 - RNA, 11 nt, Homo sapiens
ccucucuagca

SEQ ID NO: 1694060 - RNA, 19 nt, Homo sapiens
ccucucucuucugcuccac

SEQ ID NO: 1694061 - RNA, 19 nt, Homo sapiens
ccucugacccuagcucuuu

SEQ ID NO: 1694062 - RNA, 13 nt, Homo sapiens
ccucuggacaaag

SEQ ID NO: 1694063 - RNA, 15 nt, Homo sapiens
ccucugguucuucau

SEQ ID NO: 1694064 - RNA, 22 nt, Homo sapiens
ccucugucaaugaaaaaaagua

SEQ ID NO: 1694065 - RNA, 24 nt, Homo sapiens
ccucuuccccagaaaggagacuag

SEQ ID NO: 1694066 - RNA, 20 nt, Homo sapiens
ccucuucccuucaacaugaa

SEQ ID NO: 1694067 - RNA, 21 nt, Homo sapiens
ccucuuccgugacgucacugg

SEQ ID NO: 1694068 - RNA, 13 nt, Homo sapiens
ccucuugcugucu

SEQ ID NO: 1694069 - RNA, 15 nt, Homo sapiens
ccucuuuucucugug

SEQ ID NO: 1694070 - RNA, 13 nt, Homo sapiens
ccugaaacacgaa

SEQ ID NO: 1694071 - RNA, 21 nt, Homo sapiens
ccugaacuacauaacuuccua

SEQ ID NO: 1694072 - RNA, 22 nt, Homo sapiens
ccugaagacugaggacaaagug

SEQ ID NO: 1694073 - RNA, 24 nt, Homo sapiens
ccugaagacugaggacaaagugga

SEQ ID NO: 1694074 - RNA, 22 nt, Homo sapiens
ccugaauucuuuuucauuugag

SEQ ID NO: 1694075 - RNA, 14 nt, Homo sapiens
ccugacacuauuca

SEQ ID NO: 1694076 - RNA, 17 nt, Homo sapiens
ccugacccuacuucuuu

SEQ ID NO: 1694077 - RNA, 22 nt, Homo sapiens
ccugagccaagaggaacuugac

SEQ ID NO: 1694078 - RNA, 20 nt, Homo sapiens
ccugaggaugggcaaccccc

SEQ ID NO: 1694079 - RNA, 18 nt, Homo sapiens
ccugagucugcaugugca

SEQ ID NO: 1694080 - RNA, 14 nt, Homo sapiens
ccugauguguccuc

SEQ ID NO: 1694081 - RNA, 22 nt, Homo sapiens
ccugcacuaaagccagccugac

SEQ ID NO: 1694082 - RNA, 20 nt, Homo sapiens
ccugcacuguccugaccauc

SEQ ID NO: 1694083 - RNA, 21 nt, Homo sapiens
ccugcacuguccugaccaucg

SEQ ID NO: 1694084 - RNA, 16 nt, Homo sapiens
ccugcagaauccagcu

SEQ ID NO: 1694085 - RNA, 18 nt, Homo sapiens
ccugcagccucaucauuu

SEQ ID NO: 1694086 - RNA, 20 nt, Homo sapiens
ccugcagggacuccaugcug

SEQ ID NO: 1694087 - RNA, 21 nt, Homo sapiens
ccugcaguuauuaacacuaac

SEQ ID NO: 1694088 - RNA, 19 nt, Homo sapiens
ccugcaucuuuagugcuuu

SEQ ID NO: 1694089 - RNA, 14 nt, Homo sapiens
ccugcccacugcug

SEQ ID NO: 1694090 - RNA, 18 nt, Homo sapiens
ccugccccccucaucuca

SEQ ID NO: 1694091 - RNA, 17 nt, Homo sapiens
ccugccugcgucuuccg

SEQ ID NO: 1694092 - RNA, 20 nt, Homo sapiens
ccugcuccuccaggaauucc

SEQ ID NO: 1694093 - RNA, 22 nt, Homo sapiens
ccugcugaccucccagugaccc

SEQ ID NO: 1694094 - RNA, 18 nt, Homo sapiens
ccuggaauugcagcugua

SEQ ID NO: 1694095 - RNA, 21 nt, Homo sapiens
ccuggacacgcugguggugcu

SEQ ID NO: 1694096 - RNA, 13 nt, Homo sapiens
ccuggacugggag

SEQ ID NO: 1694097 - RNA, 23 nt, Homo sapiens
ccuggagagaaagugugugauuu

SEQ ID NO: 1694098 - RNA, 21 nt, Homo sapiens
ccuggaugaucacuaauacua

SEQ ID NO: 1694099 - RNA, 15 nt, Homo sapiens
ccuggccgaugguac

SEQ ID NO: 1694100 - RNA, 14 nt, Homo sapiens
ccuggccucaagug

SEQ ID NO: 1694101 - RNA, 18 nt, Homo sapiens
ccuggccuggcacacauc

SEQ ID NO: 1694102 - RNA, 17 nt, Homo sapiens
ccuggcucugcaauggg

SEQ ID NO: 1694103 - RNA, 13 nt, Homo sapiens
ccugggaggcaga

SEQ ID NO: 1694104 - RNA, 17 nt, Homo sapiens
ccugggcaauuccgcau

SEQ ID NO: 1694105 - RNA, 21 nt, Homo sapiens
ccuggggccuggaccugccuc

SEQ ID NO: 1694106 - RNA, 24 nt, Homo sapiens
ccuggucaggcccuggugcgaaug

SEQ ID NO: 1694107 - RNA, 22 nt, Homo sapiens
ccugguuuuagacgaggccaca

SEQ ID NO: 1694108 - RNA, 12 nt, Homo sapiens
ccuguacauaug

SEQ ID NO: 1694109 - RNA, 21 nt, Homo sapiens
ccuguauacuuuaguaugacg

SEQ ID NO: 1694110 - RNA, 17 nt, Homo sapiens
ccuguauuuaagcaaau

SEQ ID NO: 1694111 - RNA, 22 nt, Homo sapiens
ccugucauccucaugcugcuca

SEQ ID NO: 1694112 - RNA, 13 nt, Homo sapiens
ccugucccaugca

SEQ ID NO: 1694113 - RNA, 16 nt, Homo sapiens
ccuguccuugcccuuu

SEQ ID NO: 1694114 - RNA, 12 nt, Homo sapiens
ccugugaagcug

SEQ ID NO: 1694115 - RNA, 11 nt, Homo sapiens
ccugugacugu

SEQ ID NO: 1694116 - RNA, 12 nt, Homo sapiens
ccugugacuguc

SEQ ID NO: 1694117 - RNA, 18 nt, Homo sapiens
ccugugguuaacaucuca

SEQ ID NO: 1694118 - RNA, 18 nt, Homo sapiens
ccuguucugggugcagcu

SEQ ID NO: 1694119 - RNA, 23 nt, Homo sapiens
ccuguucuuccuccagcugcacc

SEQ ID NO: 1694120 - RNA, 22 nt, Homo sapiens
ccuguugcuguguuuaauuuga

SEQ ID NO: 1694121 - RNA, 18 nt, Homo sapiens
ccuuaagauuuugcaccu

SEQ ID NO: 1694122 - RNA, 17 nt, Homo sapiens
ccuuaaguauaucaugu

SEQ ID NO: 1694123 - RNA, 15 nt, Homo sapiens
ccuuagaagucacac

SEQ ID NO: 1694124 - RNA, 20 nt, Homo sapiens
ccuuagcagggaaacagcua

SEQ ID NO: 1694125 - RNA, 22 nt, Homo sapiens
ccuuagcuggcauuacagcugg

SEQ ID NO: 1694126 - RNA, 22 nt, Homo sapiens
ccuucaccccaguggccacuca

SEQ ID NO: 1694127 - RNA, 17 nt, Homo sapiens
ccuucagcuccagggaa

SEQ ID NO: 1694128 - RNA, 14 nt, Homo sapiens
ccuuccacugccuc

SEQ ID NO: 1694129 - RNA, 20 nt, Homo sapiens
ccuucccuugccacuuugca

SEQ ID NO: 1694130 - RNA, 15 nt, Homo sapiens
ccuuccuucuguaaa

SEQ ID NO: 1694131 - RNA, 22 nt, Homo sapiens
ccuucucagaccugcgcacucc

SEQ ID NO: 1694132 - RNA, 16 nt, Homo sapiens
ccuucuccaccaaaga

SEQ ID NO: 1694133 - RNA, 22 nt, Homo sapiens
ccuucuccaccaaagacaguug

SEQ ID NO: 1694134 - RNA, 19 nt, Homo sapiens
ccuucugacggcccugcaa

SEQ ID NO: 1694135 - RNA, 23 nt, Homo sapiens
ccuucugauugauggugcuauuu

SEQ ID NO: 1694136 - RNA, 20 nt, Homo sapiens
ccuucuuugauaauguuaaa

SEQ ID NO: 1694137 - RNA, 16 nt, Homo sapiens
ccuugaguguguuacc

SEQ ID NO: 1694138 - RNA, 18 nt, Homo sapiens
ccuugcagaacugccauu

SEQ ID NO: 1694139 - RNA, 15 nt, Homo sapiens
ccuuggcucaauccu

SEQ ID NO: 1694140 - RNA, 16 nt, Homo sapiens
ccuuggggaggacaaa

SEQ ID NO: 1694141 - RNA, 17 nt, Homo sapiens
ccuuggguagugagcag

SEQ ID NO: 1694142 - RNA, 24 nt, Homo sapiens
ccuuguccacccaccuaugugcca

SEQ ID NO: 1694143 - RNA, 24 nt, Homo sapiens
ccuugugaccuucucuauaucaug

SEQ ID NO: 1694144 - RNA, 21 nt, Homo sapiens
ccuuuaaagaugaacucugaa

SEQ ID NO: 1694145 - RNA, 22 nt, Homo sapiens
ccuuucaaauuuuuacugagaa

SEQ ID NO: 1694146 - RNA, 19 nt, Homo sapiens
ccuuuccuuccaucccuac

SEQ ID NO: 1694147 - RNA, 18 nt, Homo sapiens
ccuuugacauuuaauuua

SEQ ID NO: 1694148 - RNA, 13 nt, Homo sapiens
ccuuugcuucaaa

SEQ ID NO: 1694149 - RNA, 15 nt, Homo sapiens
ccuuuggcucuggag

SEQ ID NO: 1694150 - RNA, 12 nt, Homo sapiens
ccccaaccugcu

SEQ ID NO: 1694151 - RNA, 13 nt, Homo sapiens
ccccacaacuuua

SEQ ID NO: 1694152 - RNA, 22 nt, Homo sapiens
ccccacacagcuacagcuuucu

SEQ ID NO: 1694153 - RNA, 23 nt, Homo sapiens
ccccacacuggagccaucucuuc

SEQ ID NO: 1694154 - RNA, 23 nt, Homo sapiens
ccccaccugcagggcugcccuga

SEQ ID NO: 1694155 - RNA, 14 nt, Homo sapiens
ccccagagcucuuu

SEQ ID NO: 1694156 - RNA, 15 nt, Homo sapiens
ccccagaucugcucc

SEQ ID NO: 1694157 - RNA, 17 nt, Homo sapiens
ccccaggggucccagcc

SEQ ID NO: 1694158 - RNA, 15 nt, Homo sapiens
ccccaggucugggaa

SEQ ID NO: 1694159 - RNA, 15 nt, Homo sapiens
ccccagugcccacag

SEQ ID NO: 1694160 - RNA, 23 nt, Homo sapiens
ccccaguucaaucucccgcugcu

SEQ ID NO: 1694161 - RNA, 13 nt, Homo sapiens
ccccucaucucau

SEQ ID NO: 1694162 - RNA, 12 nt, Homo sapiens
ccccuccacugu

SEQ ID NO: 1694163 - RNA, 17 nt, Homo sapiens
ccccuggacugggaggu

SEQ ID NO: 1694164 - RNA, 14 nt, Homo sapiens
ccccuggcuuuuca

SEQ ID NO: 1694165 - RNA, 17 nt, Homo sapiens
ccccuggucucuggucc

SEQ ID NO: 1694166 - RNA, 23 nt, Homo sapiens
ccccugucauccucaugcugcuc

SEQ ID NO: 1694167 - RNA, 15 nt, Homo sapiens
ccccuucggcagcua

SEQ ID NO: 1694168 - RNA, 14 nt, Homo sapiens
ccccuuggcuguga

SEQ ID NO: 1694169 - RNA, 18 nt, Homo sapiens
cccgagcuguuaccauuc

SEQ ID NO: 1694170 - RNA, 18 nt, Homo sapiens
cccgaugcugcuauggaa

SEQ ID NO: 1694171 - RNA, 20 nt, Homo sapiens
cccgcuuuuccuuucugcca

SEQ ID NO: 1694172 - RNA, 21 nt, Homo sapiens
cccgguggcggccccagcacc

SEQ ID NO: 1694173 - RNA, 11 nt, Homo sapiens
cccgugacugc

SEQ ID NO: 1694174 - RNA, 21 nt, Homo sapiens
cccuaaaaauccagacucuuu

SEQ ID NO: 1694175 - RNA, 18 nt, Homo sapiens
cccuaagcgcacauucau

SEQ ID NO: 1694176 - RNA, 18 nt, Homo sapiens
cccuacuauucaguggcg

SEQ ID NO: 1694177 - RNA, 22 nt, Homo sapiens
cccuacucccugcagaugccac

SEQ ID NO: 1694178 - RNA, 16 nt, Homo sapiens
cccuagccaaugucuc

SEQ ID NO: 1694179 - RNA, 14 nt, Homo sapiens
cccuaggaacucag

SEQ ID NO: 1694180 - RNA, 13 nt, Homo sapiens
cccucaaccuccu

SEQ ID NO: 1694181 - RNA, 20 nt, Homo sapiens
cccucaggagccucugcucc

SEQ ID NO: 1694182 - RNA, 17 nt, Homo sapiens
cccucaucuaugaggaa

SEQ ID NO: 1694183 - RNA, 13 nt, Homo sapiens
cccucaucuugaa

SEQ ID NO: 1694184 - RNA, 14 nt, Homo sapiens
cccuccacugucac

SEQ ID NO: 1694185 - RNA, 14 nt, Homo sapiens
cccuccgaccacuu

SEQ ID NO: 1694186 - RNA, 19 nt, Homo sapiens
cccuccugugcugggggaa

SEQ ID NO: 1694187 - RNA, 19 nt, Homo sapiens
cccucugcucagccaagcu

SEQ ID NO: 1694188 - RNA, 19 nt, Homo sapiens
cccucuguagccacuagua

SEQ ID NO: 1694189 - RNA, 15 nt, Homo sapiens
cccucugucuuguga

SEQ ID NO: 1694190 - RNA, 22 nt, Homo sapiens
cccucuuuucugaucugcaguu

SEQ ID NO: 1694191 - RNA, 19 nt, Homo sapiens
cccugauuguguauauuca

SEQ ID NO: 1694192 - RNA, 12 nt, Homo sapiens
cccugauuucuu

SEQ ID NO: 1694193 - RNA, 14 nt, Homo sapiens
cccugcacaaagcc

SEQ ID NO: 1694194 - RNA, 17 nt, Homo sapiens
cccugcacuaaagccag

SEQ ID NO: 1694195 - RNA, 23 nt, Homo sapiens
cccugcagaugccacccuagcca

SEQ ID NO: 1694196 - RNA, 21 nt, Homo sapiens
cccugccucgaggacugauac

SEQ ID NO: 1694197 - RNA, 19 nt, Homo sapiens
cccugcgcaugaaccugga

SEQ ID NO: 1694198 - RNA, 13 nt, Homo sapiens
cccuggaaaugga

SEQ ID NO: 1694199 - RNA, 14 nt, Homo sapiens
cccugggccagggu

SEQ ID NO: 1694200 - RNA, 22 nt, Homo sapiens
cccuggggccuagacucuguaa

SEQ ID NO: 1694201 - RNA, 16 nt, Homo sapiens
cccuguccuugcccuu

SEQ ID NO: 1694202 - RNA, 13 nt, Homo sapiens
cccuuaacccaag

SEQ ID NO: 1694203 - RNA, 18 nt, Homo sapiens
cccuucccuguccuugcc

SEQ ID NO: 1694204 - RNA, 19 nt, Homo sapiens
cccuuccggagucuuugaa

SEQ ID NO: 1694205 - RNA, 22 nt, Homo sapiens
cccuuggaauaaaaacauuucu

SEQ ID NO: 1694206 - RNA, 20 nt, Homo sapiens
cccuuucuguaccauuuauu

SEQ ID NO: 1694207 - RNA, 14 nt, Homo sapiens
cccuuugcuucaaa

SEQ ID NO: 1694208 - RNA, 19 nt, Homo sapiens
cccuuuuucuccagcuggg

SEQ ID NO: 1694209 - RNA, 18 nt, Homo sapiens
ccgaaggguuuugcuaca

SEQ ID NO: 1694210 - RNA, 12 nt, Homo sapiens
ccgagcaaagau

SEQ ID NO: 1694211 - RNA, 20 nt, Homo sapiens
ccgagucucuucuccacugg

SEQ ID NO: 1694212 - RNA, 15 nt, Homo sapiens
ccgaugguacuauuu

SEQ ID NO: 1694213 - RNA, 23 nt, Homo sapiens
ccgcagaagcccugauguguccu

SEQ ID NO: 1694214 - RNA, 19 nt, Homo sapiens
ccgccacugggccugucac

SEQ ID NO: 1694215 - RNA, 20 nt, Homo sapiens
ccgcguuuagaccaaggaac

SEQ ID NO: 1694216 - RNA, 16 nt, Homo sapiens
ccgcuuguggggaccc

SEQ ID NO: 1694217 - RNA, 17 nt, Homo sapiens
ccggccgauggagacac

SEQ ID NO: 1694218 - RNA, 24 nt, Homo sapiens
ccggccgauggagacaccaaccga

SEQ ID NO: 1694219 - RNA, 16 nt, Homo sapiens
ccggcgccccugccac

SEQ ID NO: 1694220 - RNA, 20 nt, Homo sapiens
ccgggcugggagcucugcag

SEQ ID NO: 1694221 - RNA, 12 nt, Homo sapiens
ccguaacaacug

SEQ ID NO: 1694222 - RNA, 13 nt, Homo sapiens
ccgugaccaucuu

SEQ ID NO: 1694223 - RNA, 11 nt, Homo sapiens
ccgugccuuca

SEQ ID NO: 1694224 - RNA, 17 nt, Homo sapiens
ccguuuaccuagaagaa

SEQ ID NO: 1694225 - RNA, 18 nt, Homo sapiens
ccuaaaaggaaaucucac

SEQ ID NO: 1694226 - RNA, 19 nt, Homo sapiens
ccuaaaauccacaccaaag

SEQ ID NO: 1694227 - RNA, 11 nt, Homo sapiens
ccuaaaaucuu

SEQ ID NO: 1694228 - RNA, 16 nt, Homo sapiens
ccuaacacggugcuca

SEQ ID NO: 1694229 - RNA, 17 nt, Homo sapiens
ccuaagacuuauguauu

SEQ ID NO: 1694230 - RNA, 22 nt, Homo sapiens
ccuaagagacugcguucugcaa

SEQ ID NO: 1694231 - RNA, 18 nt, Homo sapiens
ccuaagcagaaaacuggc

SEQ ID NO: 1694232 - RNA, 13 nt, Homo sapiens
ccuaaguacugua

SEQ ID NO: 1694233 - RNA, 16 nt, Homo sapiens
ccuaagucacuuugag

SEQ ID NO: 1694234 - RNA, 19 nt, Homo sapiens
ccuacacccagaccccagg

SEQ ID NO: 1694235 - RNA, 19 nt, Homo sapiens
ccuacagcacuacugggug

SEQ ID NO: 1694236 - RNA, 15 nt, Homo sapiens
ccuacagggccacaa

SEQ ID NO: 1694237 - RNA, 18 nt, Homo sapiens
ccuaguucccucugcuca

SEQ ID NO: 1694238 - RNA, 17 nt, Homo sapiens
ccuauagaaacaccagu

SEQ ID NO: 1694239 - RNA, 21 nt, Homo sapiens
ccuauagaaacaccaguaccu

SEQ ID NO: 1694240 - RNA, 14 nt, Homo sapiens
ccuaucuccugaca

SEQ ID NO: 1694241 - RNA, 20 nt, Homo sapiens
ccuauuagaguauuuuccac

SEQ ID NO: 1694242 - RNA, 12 nt, Homo sapiens
ccuauuugccau

SEQ ID NO: 1694243 - RNA, 23 nt, Homo sapiens
ccucacagagugcauugugaggg

SEQ ID NO: 1694244 - RNA, 20 nt, Homo sapiens
ccucacccccagcuuugcua

SEQ ID NO: 1694245 - RNA, 22 nt, Homo sapiens
ccucagccucccaaagugcugg

SEQ ID NO: 1694246 - RNA, 14 nt, Homo sapiens
ccucagggacaacu

SEQ ID NO: 1694247 - RNA, 23 nt, Homo sapiens
caggaucuguacaauaauaauua

SEQ ID NO: 1694248 - RNA, 22 nt, Homo sapiens
caggcaauuucaccaccaaaug

SEQ ID NO: 1694249 - RNA, 14 nt, Homo sapiens
caggcacugcugca

SEQ ID NO: 1694250 - RNA, 20 nt, Homo sapiens
caggcagaucugugccccau

SEQ ID NO: 1694251 - RNA, 15 nt, Homo sapiens
caggcagggugagcu

SEQ ID NO: 1694252 - RNA, 14 nt, Homo sapiens
caggcauugaggaa

SEQ ID NO: 1694253 - RNA, 22 nt, Homo sapiens
caggcauuuguucacugaaggu

SEQ ID NO: 1694254 - RNA, 15 nt, Homo sapiens
caggccauacuuuac

SEQ ID NO: 1694255 - RNA, 19 nt, Homo sapiens
caggccuuaccgcucuguu

SEQ ID NO: 1694256 - RNA, 13 nt, Homo sapiens
caggcuccgcccu

SEQ ID NO: 1694257 - RNA, 17 nt, Homo sapiens
caggcuggagugcagug

SEQ ID NO: 1694258 - RNA, 19 nt, Homo sapiens
caggcugggccauguccaa

SEQ ID NO: 1694259 - RNA, 23 nt, Homo sapiens
caggcugggccauguccaaagag

SEQ ID NO: 1694260 - RNA, 13 nt, Homo sapiens
caggcuggucuca

SEQ ID NO: 1694261 - RNA, 15 nt, Homo sapiens
cagggacagagccau

SEQ ID NO: 1694262 - RNA, 19 nt, Homo sapiens
cagggacuccaugcugcca

SEQ ID NO: 1694263 - RNA, 14 nt, Homo sapiens
cagggaggugaccc

SEQ ID NO: 1694264 - RNA, 14 nt, Homo sapiens
cagggcauuuuaca

SEQ ID NO: 1694265 - RNA, 13 nt, Homo sapiens
cagggccacaacu

SEQ ID NO: 1694266 - RNA, 18 nt, Homo sapiens
cagggcuuaccuguacac

SEQ ID NO: 1694267 - RNA, 14 nt, Homo sapiens
caggggcucuggag

SEQ ID NO: 1694268 - RNA, 18 nt, Homo sapiens
caggguaacugugcugaa

SEQ ID NO: 1694269 - RNA, 21 nt, Homo sapiens
cagggucucacuauguugccc

SEQ ID NO: 1694270 - RNA, 16 nt, Homo sapiens
cagggucugugugaau

SEQ ID NO: 1694271 - RNA, 17 nt, Homo sapiens
cagggucugugugaaug

SEQ ID NO: 1694272 - RNA, 19 nt, Homo sapiens
caggguggucuugaucucc

SEQ ID NO: 1694273 - RNA, 20 nt, Homo sapiens
caggguuucaccauguugcc

SEQ ID NO: 1694274 - RNA, 23 nt, Homo sapiens
cagguacaguaggauaagccacu

SEQ ID NO: 1694275 - RNA, 21 nt, Homo sapiens
cagguaccaucuuguauacac

SEQ ID NO: 1694276 - RNA, 23 nt, Homo sapiens
cagguaccaucuuguauacacau

SEQ ID NO: 1694277 - RNA, 12 nt, Homo sapiens
cagguccuccau

SEQ ID NO: 1694278 - RNA, 21 nt, Homo sapiens
caggucucacgggcaugggca

SEQ ID NO: 1694279 - RNA, 22 nt, Homo sapiens
caggucugcagcuccagguaca

SEQ ID NO: 1694280 - RNA, 14 nt, Homo sapiens
caggugaaaaucca

SEQ ID NO: 1694281 - RNA, 19 nt, Homo sapiens
caggugaaaauccaucuca

SEQ ID NO: 1694282 - RNA, 17 nt, Homo sapiens
cagguggccccaguuca

SEQ ID NO: 1694283 - RNA, 20 nt, Homo sapiens
cagguguuacuguaauuccu

SEQ ID NO: 1694284 - RNA, 22 nt, Homo sapiens
cagguucaugccaccauggcca

SEQ ID NO: 1694285 - RNA, 21 nt, Homo sapiens
caguaaacuuuggcuuauaaa

SEQ ID NO: 1694286 - RNA, 22 nt, Homo sapiens
caguaaauaacaggcauuuguu

SEQ ID NO: 1694287 - RNA, 22 nt, Homo sapiens
caguaaucccagcuacucagga

SEQ ID NO: 1694288 - RNA, 18 nt, Homo sapiens
caguacccucucagcucc

SEQ ID NO: 1694289 - RNA, 21 nt, Homo sapiens
caguacuugugaaacacagcu

SEQ ID NO: 1694290 - RNA, 23 nt, Homo sapiens
caguagagcaaaucuaugagauu

SEQ ID NO: 1694291 - RNA, 21 nt, Homo sapiens
caguaggggaggagcacaguu

SEQ ID NO: 1694292 - RNA, 20 nt, Homo sapiens
caguauccaggcuuuguaca

SEQ ID NO: 1694293 - RNA, 16 nt, Homo sapiens
cagucaaguucagagu

SEQ ID NO: 1694294 - RNA, 19 nt, Homo sapiens
caguccugccucagccucc

SEQ ID NO: 1694295 - RNA, 14 nt, Homo sapiens
caguccugcuccag

SEQ ID NO: 1694296 - RNA, 17 nt, Homo sapiens
caguccuguacucuggg

SEQ ID NO: 1694297 - RNA, 13 nt, Homo sapiens
cagucucacuuug

SEQ ID NO: 1694298 - RNA, 14 nt, Homo sapiens
cagugaaagccaga

SEQ ID NO: 1694299 - RNA, 23 nt, Homo sapiens
cagugaccccugaccucacugug

SEQ ID NO: 1694300 - RNA, 20 nt, Homo sapiens
cagugacugccgucagcucc

SEQ ID NO: 1694301 - RNA, 17 nt, Homo sapiens
cagugacuggugccagu

SEQ ID NO: 1694302 - RNA, 16 nt, Homo sapiens
cagugauauggcagaa

SEQ ID NO: 1694303 - RNA, 14 nt, Homo sapiens
cagugcaaccacac

SEQ ID NO: 1694304 - RNA, 23 nt, Homo sapiens
cagugcgugcucccgaugcugcu

SEQ ID NO: 1694305 - RNA, 23 nt, Homo sapiens
caguggccccaucauagccugca

SEQ ID NO: 1694306 - RNA, 16 nt, Homo sapiens
caguggcgugaucucg

SEQ ID NO: 1694307 - RNA, 20 nt, Homo sapiens
caguguccccuccacuguca

SEQ ID NO: 1694308 - RNA, 22 nt, Homo sapiens
caguguggcccagggaagccaa

SEQ ID NO: 1694309 - RNA, 18 nt, Homo sapiens
caguguuccccaucuggg

SEQ ID NO: 1694310 - RNA, 16 nt, Homo sapiens
caguuagguagcuuua

SEQ ID NO: 1694311 - RNA, 16 nt, Homo sapiens
caguuauuaaucugga

SEQ ID NO: 1694312 - RNA, 21 nt, Homo sapiens
caguucaggagucccaaggaa

SEQ ID NO: 1694313 - RNA, 15 nt, Homo sapiens
caguucccucuugcu

SEQ ID NO: 1694314 - RNA, 21 nt, Homo sapiens
caguucuuagcccucuagaaa

SEQ ID NO: 1694315 - RNA, 21 nt, Homo sapiens
caguugaauaaaagugcacac

SEQ ID NO: 1694316 - RNA, 18 nt, Homo sapiens
caguuguauggagccucu

SEQ ID NO: 1694317 - RNA, 14 nt, Homo sapiens
caguuucucuccaa

SEQ ID NO: 1694318 - RNA, 18 nt, Homo sapiens
caguuucucuccaacucc

SEQ ID NO: 1694319 - RNA, 15 nt, Homo sapiens
caguuugauaccugc

SEQ ID NO: 1694320 - RNA, 12 nt, Homo sapiens
caguuuuugccu

SEQ ID NO: 1694321 - RNA, 16 nt, Homo sapiens
cauaaagugucuauaa

SEQ ID NO: 1694322 - RNA, 19 nt, Homo sapiens
cauaaaugaagcagcuuua

SEQ ID NO: 1694323 - RNA, 15 nt, Homo sapiens
cauaacccacuuguc

SEQ ID NO: 1694324 - RNA, 19 nt, Homo sapiens
cauaacuaguggcucucag

SEQ ID NO: 1694325 - RNA, 17 nt, Homo sapiens
cauaacucauugucugu

SEQ ID NO: 1694326 - RNA, 16 nt, Homo sapiens
cauaaggcuucaaaau

SEQ ID NO: 1694327 - RNA, 23 nt, Homo sapiens
cauaagggguuugccauuugaua

SEQ ID NO: 1694328 - RNA, 16 nt, Homo sapiens
cauaauaaauaauuaa

SEQ ID NO: 1694329 - RNA, 19 nt, Homo sapiens
cauacaggauuugaacuca

SEQ ID NO: 1694330 - RNA, 18 nt, Homo sapiens
cauacaugcauacaaaga

SEQ ID NO: 1694331 - RNA, 16 nt, Homo sapiens
cauaccuaaguacugu

SEQ ID NO: 1694332 - RNA, 13 nt, Homo sapiens
cauaccucugacc

SEQ ID NO: 1694333 - RNA, 14 nt, Homo sapiens
cauacuguucaaug

SEQ ID NO: 1694334 - RNA, 15 nt, Homo sapiens
cauacuuaucucucu

SEQ ID NO: 1694335 - RNA, 23 nt, Homo sapiens
cauagaaaaauucagcaaaccau

SEQ ID NO: 1694336 - RNA, 19 nt, Homo sapiens
cauagaaauuacacccaaa

SEQ ID NO: 1694337 - RNA, 21 nt, Homo sapiens
cauagaaauuacacccaaaga

SEQ ID NO: 1694338 - RNA, 19 nt, Homo sapiens
cauagauuaauggcacuga

SEQ ID NO: 1694339 - RNA, 16 nt, Homo sapiens
cauagcaaacagagga

SEQ ID NO: 1694340 - RNA, 20 nt, Homo sapiens
cauagcucaccaggacuguu

SEQ ID NO: 1694341 - RNA, 17 nt, Homo sapiens
cauaguuuaaacugcau

SEQ ID NO: 1694342 - RNA, 18 nt, Homo sapiens
cauaguuuaaacugcauu

SEQ ID NO: 1694343 - RNA, 22 nt, Homo sapiens
cauauaacuaagacauaugcau

SEQ ID NO: 1694344 - RNA, 16 nt, Homo sapiens
cauauagaaugcagag

SEQ ID NO: 1694345 - RNA, 20 nt, Homo sapiens
cauauauacaggcauaaaau

SEQ ID NO: 1694346 - RNA, 19 nt, Homo sapiens
cauauauacccacauguac

SEQ ID NO: 1694347 - RNA, 20 nt, Homo sapiens
cauauauauugaaaugcaaa

SEQ ID NO: 1694348 - RNA, 18 nt, Homo sapiens
cauaucggcucacaaaga

SEQ ID NO: 1694349 - RNA, 16 nt, Homo sapiens
cauaugacuugaucuu

SEQ ID NO: 1694350 - RNA, 22 nt, Homo sapiens
cauaugaggaggaugucccugg

SEQ ID NO: 1694351 - RNA, 22 nt, Homo sapiens
cauaugccuuggggaggacaaa

SEQ ID NO: 1694352 - RNA, 14 nt, Homo sapiens
cauauguacauaaa

SEQ ID NO: 1694353 - RNA, 15 nt, Homo sapiens
cauauucuaaaacca

SEQ ID NO: 1694354 - RNA, 17 nt, Homo sapiens
caucaauucccauugca

SEQ ID NO: 1694355 - RNA, 23 nt, Homo sapiens
cacucuuguggucaucauggcca

SEQ ID NO: 1694356 - RNA, 16 nt, Homo sapiens
cacugaugcuguucuc

SEQ ID NO: 1694357 - RNA, 17 nt, Homo sapiens
cacugaugcuguucucu

SEQ ID NO: 1694358 - RNA, 22 nt, Homo sapiens
cacugaugcuuagauguuccag

SEQ ID NO: 1694359 - RNA, 20 nt, Homo sapiens
cacugcacagugcaucucag

SEQ ID NO: 1694360 - RNA, 19 nt, Homo sapiens
cacugcacuauagccuagg

SEQ ID NO: 1694361 - RNA, 11 nt, Homo sapiens
cacugcacugu

SEQ ID NO: 1694362 - RNA, 12 nt, Homo sapiens
cacugcucccua

SEQ ID NO: 1694363 - RNA, 22 nt, Homo sapiens
cacuggccccucaaaucgucca

SEQ ID NO: 1694364 - RNA, 17 nt, Homo sapiens
cacugggccugucacug

SEQ ID NO: 1694365 - RNA, 16 nt, Homo sapiens
cacuggguucugcuac

SEQ ID NO: 1694366 - RNA, 20 nt, Homo sapiens
cacuguacaagguaccccuu

SEQ ID NO: 1694367 - RNA, 16 nt, Homo sapiens
cacugucugacuuuag

SEQ ID NO: 1694368 - RNA, 22 nt, Homo sapiens
cacuguugcaaacucagugcaa

SEQ ID NO: 1694369 - RNA, 14 nt, Homo sapiens
cacuguugcccagg

SEQ ID NO: 1694370 - RNA, 17 nt, Homo sapiens
cacuguugcccaggcug

SEQ ID NO: 1694371 - RNA, 14 nt, Homo sapiens
cacuuacagaauua

SEQ ID NO: 1694372 - RNA, 18 nt, Homo sapiens
cacuuagucuguacuuca

SEQ ID NO: 1694373 - RNA, 13 nt, Homo sapiens
cacuucagaauuc

SEQ ID NO: 1694374 - RNA, 17 nt, Homo sapiens
cacuucagaauuccaua

SEQ ID NO: 1694375 - RNA, 12 nt, Homo sapiens
cacuuccagggg

SEQ ID NO: 1694376 - RNA, 18 nt, Homo sapiens
auauacugguucacaucc

SEQ ID NO: 1694377 - RNA, 16 nt, Homo sapiens
auauagcguucccaac

SEQ ID NO: 1694378 - RNA, 13 nt, Homo sapiens
auauauacaggca

SEQ ID NO: 1694379 - RNA, 14 nt, Homo sapiens
auauauaccacuuu

SEQ ID NO: 1694380 - RNA, 21 nt, Homo sapiens
auauauaucaguuugaucaca

SEQ ID NO: 1694381 - RNA, 21 nt, Homo sapiens
auauaucuaugucuauaucau

SEQ ID NO: 1694382 - RNA, 12 nt, Homo sapiens
auauauggacau

SEQ ID NO: 1694383 - RNA, 16 nt, Homo sapiens
auaucauacuguucaa

SEQ ID NO: 1694384 - RNA, 17 nt, Homo sapiens
auaucauacuguucaau

SEQ ID NO: 1694385 - RNA, 13 nt, Homo sapiens
auaucauacuucc

SEQ ID NO: 1694386 - RNA, 22 nt, Homo sapiens
auaucauuggaacaacugauac

SEQ ID NO: 1694387 - RNA, 18 nt, Homo sapiens
auauccuagacuagacau

SEQ ID NO: 1694388 - RNA, 19 nt, Homo sapiens
auauccuuucuaacaaaaa

SEQ ID NO: 1694389 - RNA, 21 nt, Homo sapiens
auaucugaauggaagaguguu

SEQ ID NO: 1694390 - RNA, 17 nt, Homo sapiens
auaucuguggucuucaa

SEQ ID NO: 1694391 - RNA, 22 nt, Homo sapiens
auaugagcuuccuucugugaaa

SEQ ID NO: 1694392 - RNA, 14 nt, Homo sapiens
auaugaguauacaa

SEQ ID NO: 1694393 - RNA, 17 nt, Homo sapiens
auaugauuguuucucaa

SEQ ID NO: 1694394 - RNA, 22 nt, Homo sapiens
auaugcagugauauggcagaag

SEQ ID NO: 1694395 - RNA, 17 nt, Homo sapiens
auaugccugcaaucuga

SEQ ID NO: 1694396 - RNA, 19 nt, Homo sapiens
auaugcugacuucacuuau

SEQ ID NO: 1694397 - RNA, 16 nt, Homo sapiens
auauggacucugcaca

SEQ ID NO: 1694398 - RNA, 19 nt, Homo sapiens
auauggaguucuuacuuga

SEQ ID NO: 1694399 - RNA, 23 nt, Homo sapiens
auauggaugauucagaaauugga

SEQ ID NO: 1694400 - RNA, 20 nt, Homo sapiens
auauggggaaaaaacugugc

SEQ ID NO: 1694401 - RNA, 20 nt, Homo sapiens
auauguccgcagaauggacu

SEQ ID NO: 1694402 - RNA, 20 nt, Homo sapiens
auaugucucaggucccugca

SEQ ID NO: 1694403 - RNA, 17 nt, Homo sapiens
auauguguauauauaca

SEQ ID NO: 1694404 - RNA, 16 nt, Homo sapiens
auauguguucauuaaa

SEQ ID NO: 1694405 - RNA, 16 nt, Homo sapiens
auauguuuccaucacu

SEQ ID NO: 1694406 - RNA, 21 nt, Homo sapiens
auauuacuuguuuucacuuua

SEQ ID NO: 1694407 - RNA, 18 nt, Homo sapiens
auauuauuugcuaauuaa

SEQ ID NO: 1694408 - RNA, 16 nt, Homo sapiens
auauucuucauauccu

SEQ ID NO: 1694409 - RNA, 13 nt, Homo sapiens
auauucuugucaa

SEQ ID NO: 1694410 - RNA, 17 nt, Homo sapiens
auauuggaaaaaucaca

SEQ ID NO: 1694411 - RNA, 15 nt, Homo sapiens
auauuguacauaaaa

SEQ ID NO: 1694412 - RNA, 21 nt, Homo sapiens
auauuguugacaacugugacu

SEQ ID NO: 1694413 - RNA, 14 nt, Homo sapiens
auauuuaaugcauu

SEQ ID NO: 1694414 - RNA, 19 nt, Homo sapiens
auauuuauuuaaagcauug

SEQ ID NO: 1694415 - RNA, 21 nt, Homo sapiens
auauuugaauuuuaaaucuaa

SEQ ID NO: 1694416 - RNA, 15 nt, Homo sapiens
auauuugacuugcau

SEQ ID NO: 1694417 - RNA, 18 nt, Homo sapiens
auauuugcugagugaaug

SEQ ID NO: 1694418 - RNA, 17 nt, Homo sapiens
auauuuuuccacuuaaa

SEQ ID NO: 1694419 - RNA, 18 nt, Homo sapiens
aucaaaagcuuauucauc

SEQ ID NO: 1694420 - RNA, 21 nt, Homo sapiens
aucaaaauaaaaagugacaca

SEQ ID NO: 1694421 - RNA, 16 nt, Homo sapiens
aucaaugcaagaguga

SEQ ID NO: 1694422 - RNA, 23 nt, Homo sapiens
aucaauguucacgcaacuugaaa

SEQ ID NO: 1694423 - RNA, 17 nt, Homo sapiens
aucacgacgcugcagag

SEQ ID NO: 1694424 - RNA, 17 nt, Homo sapiens
aucacggcucacugcag

SEQ ID NO: 1694425 - RNA, 22 nt, Homo sapiens
aucacggcucacugcagccuca

SEQ ID NO: 1694426 - RNA, 18 nt, Homo sapiens
aucacgggucacuugaaa

SEQ ID NO: 1694427 - RNA, 22 nt, Homo sapiens
aucacgucacugcacuccagcu

SEQ ID NO: 1694428 - RNA, 14 nt, Homo sapiens
aucacugccacacu

SEQ ID NO: 1694429 - RNA, 16 nt, Homo sapiens
aucacugggucugcug

SEQ ID NO: 1694430 - RNA, 17 nt, Homo sapiens
aucagaaggacauggug

SEQ ID NO: 1694431 - RNA, 19 nt, Homo sapiens
aucagaauagccacauuug

SEQ ID NO: 1694432 - RNA, 14 nt, Homo sapiens
aucagacagagauu

SEQ ID NO: 1694433 - RNA, 15 nt, Homo sapiens
aucagagggugacug

SEQ ID NO: 1694434 - RNA, 12 nt, Homo sapiens
aucagcacugaa

SEQ ID NO: 1694435 - RNA, 14 nt, Homo sapiens
aucagcacugaaaa

SEQ ID NO: 1694436 - RNA, 15 nt, Homo sapiens
aucagccacauucua

SEQ ID NO: 1694437 - RNA, 20 nt, Homo sapiens
aucaggccuggcacgguggc

SEQ ID NO: 1694438 - RNA, 14 nt, Homo sapiens
aucaguguuuuaga

SEQ ID NO: 1694439 - RNA, 14 nt, Homo sapiens
aucaguuaacuauu

SEQ ID NO: 1694440 - RNA, 19 nt, Homo sapiens
aucauaaacugacuaucau

SEQ ID NO: 1694441 - RNA, 13 nt, Homo sapiens
aucauacuuccau

SEQ ID NO: 1694442 - RNA, 13 nt, Homo sapiens
aucauaugugauc

SEQ ID NO: 1694443 - RNA, 18 nt, Homo sapiens
aucauauugaauguuucc

SEQ ID NO: 1694444 - RNA, 21 nt, Homo sapiens
aucauauugguauucacuaau

SEQ ID NO: 1694445 - RNA, 13 nt, Homo sapiens
aucauccaagaca

SEQ ID NO: 1694446 - RNA, 19 nt, Homo sapiens
aucauccagaaguuccuca

SEQ ID NO: 1694447 - RNA, 22 nt, Homo sapiens
aucauccugcagacagacaaua

SEQ ID NO: 1694448 - RNA, 18 nt, Homo sapiens
aucauccugccuucaugg

SEQ ID NO: 1694449 - RNA, 16 nt, Homo sapiens
aucauuagaaucuuac

SEQ ID NO: 1694450 - RNA, 19 nt, Homo sapiens
aucauuuuuaaauauaggu

SEQ ID NO: 1694451 - RNA, 15 nt, Homo sapiens
auccaccccauccaa

SEQ ID NO: 1694452 - RNA, 15 nt, Homo sapiens
auccacuuacauaua

SEQ ID NO: 1694453 - RNA, 15 nt, Homo sapiens
auccagacccggcug

SEQ ID NO: 1694454 - RNA, 18 nt, Homo sapiens
auccagaggguugugauu

SEQ ID NO: 1694455 - RNA, 19 nt, Homo sapiens
auccagaggguugugauuu

SEQ ID NO: 1694456 - RNA, 16 nt, Homo sapiens
auccagcaauuccuga

SEQ ID NO: 1694457 - RNA, 16 nt, Homo sapiens
auccagcuaugaauau

SEQ ID NO: 1694458 - RNA, 19 nt, Homo sapiens
aucgaaucuacuaauucca

SEQ ID NO: 1694459 - RNA, 23 nt, Homo sapiens
aucgccugaguugcuuuuacuuc

SEQ ID NO: 1694460 - RNA, 15 nt, Homo sapiens
aucggccuccaugac

SEQ ID NO: 1694461 - RNA, 23 nt, Homo sapiens
aucuaacgcuuuaaauggcuacu

SEQ ID NO: 1694462 - RNA, 17 nt, Homo sapiens
aucuaaggaugucacag

SEQ ID NO: 1694463 - RNA, 18 nt, Homo sapiens
aucuacccugcugaccuc

SEQ ID NO: 1694464 - RNA, 16 nt, Homo sapiens
aucuacuaauuccaca

SEQ ID NO: 1694465 - RNA, 22 nt, Homo sapiens
aucuaguguuggggauccuggc

SEQ ID NO: 1694466 - RNA, 13 nt, Homo sapiens
aucuaguuuacag

SEQ ID NO: 1694467 - RNA, 18 nt, Homo sapiens
aucuauaguagacacacu

SEQ ID NO: 1694468 - RNA, 14 nt, Homo sapiens
aucuaucaacuaua

SEQ ID NO: 1694469 - RNA, 15 nt, Homo sapiens
aucuauucuguguug

SEQ ID NO: 1694470 - RNA, 21 nt, Homo sapiens
aucuauucuguguugcauuau

SEQ ID NO: 1694471 - RNA, 13 nt, Homo sapiens
aucuauuuauuaa

SEQ ID NO: 1694472 - RNA, 17 nt, Homo sapiens
aucuauuuucuauguac

SEQ ID NO: 1694473 - RNA, 14 nt, Homo sapiens
aucucaaacuauga

SEQ ID NO: 1694474 - RNA, 14 nt, Homo sapiens
aucucaauuugcag

SEQ ID NO: 1694475 - RNA, 15 nt, Homo sapiens
aucucagaugcaguu

SEQ ID NO: 1694476 - RNA, 15 nt, Homo sapiens
aucucagcuuugaga

SEQ ID NO: 1694477 - RNA, 20 nt, Homo sapiens
aucucccacccuguaccuca

SEQ ID NO: 1694478 - RNA, 19 nt, Homo sapiens
aucuccuauaaucugucaa

SEQ ID NO: 1694479 - RNA, 13 nt, Homo sapiens
aucuccugacaga

SEQ ID NO: 1694480 - RNA, 20 nt, Homo sapiens
aucucuaauuccauccauaa

SEQ ID NO: 1694481 - RNA, 18 nt, Homo sapiens
aucucucugcagcugccg

SEQ ID NO: 1694482 - RNA, 16 nt, Homo sapiens
aucucuuauuuuacaa

SEQ ID NO: 1694483 - RNA, 17 nt, Homo sapiens
aucucuuauuuuacaau

SEQ ID NO: 1694484 - RNA, 23 nt, Homo sapiens
aucucuuguauaugaugaucugg

SEQ ID NO: 1694485 - RNA, 19 nt, Homo sapiens
aucugagagaugacaggga

SEQ ID NO: 1694486 - RNA, 15 nt, Homo sapiens
aucugaucugaguga

SEQ ID NO: 1694487 - RNA, 18 nt, Homo sapiens
aucugcauuuucacccca

SEQ ID NO: 1694488 - RNA, 20 nt, Homo sapiens
aucugcugggccaccagcca

SEQ ID NO: 1694489 - RNA, 19 nt, Homo sapiens
aucuggaaaccucuacaua

SEQ ID NO: 1694490 - RNA, 20 nt, Homo sapiens
aucuggaaaccucuacauau

SEQ ID NO: 1694491 - RNA, 19 nt, Homo sapiens
aucuggcccucgacacuca

SEQ ID NO: 1694492 - RNA, 22 nt, Homo sapiens
aucuggcuuauuuuaaugugau

SEQ ID NO: 1694493 - RNA, 17 nt, Homo sapiens
aucuggguuuguuuaca

SEQ ID NO: 1694494 - RNA, 16 nt, Homo sapiens
aucuggucccuugcag

SEQ ID NO: 1694495 - RNA, 11 nt, Homo sapiens
aucuguacaau

SEQ ID NO: 1694496 - RNA, 14 nt, Homo sapiens
aucuguacaaugac

SEQ ID NO: 1694497 - RNA, 15 nt, Homo sapiens
aucugucuccuguau

SEQ ID NO: 1694498 - RNA, 22 nt, Homo sapiens
aucuuaccuugugcagucauca

SEQ ID NO: 1694499 - RNA, 15 nt, Homo sapiens
aucuuacuguaccug

SEQ ID NO: 1694500 - RNA, 17 nt, Homo sapiens
aucuuagauguuucaca

SEQ ID NO: 1694501 - RNA, 17 nt, Homo sapiens
aucuuccaaaugcaauu

SEQ ID NO: 1694502 - RNA, 15 nt, Homo sapiens
aucuucuuaugcaau

SEQ ID NO: 1694503 - RNA, 18 nt, Homo sapiens
aucuugggauaguuccca

SEQ ID NO: 1694504 - RNA, 16 nt, Homo sapiens
aucuuuagugcuuucu

SEQ ID NO: 1694505 - RNA, 14 nt, Homo sapiens
aucuuucauccuug

SEQ ID NO: 1694506 - RNA, 17 nt, Homo sapiens
aucuuucauccuugacu

SEQ ID NO: 1694507 - RNA, 18 nt, Homo sapiens
aucuuugaccacgucauc

SEQ ID NO: 1694508 - RNA, 21 nt, Homo sapiens
augaaaacauagcaucucagg

SEQ ID NO: 1694509 - RNA, 15 nt, Homo sapiens
augaaaaccuacaua

SEQ ID NO: 1694510 - RNA, 23 nt, Homo sapiens
augaaaacucauuacuuuuccau

SEQ ID NO: 1694511 - RNA, 19 nt, Homo sapiens
augaaaauaagugaauaau

SEQ ID NO: 1694512 - RNA, 21 nt, Homo sapiens
augaaaauuuauuuuuaguga

SEQ ID NO: 1694513 - RNA, 23 nt, Homo sapiens
augaaagguacuauauuugcuag

SEQ ID NO: 1694514 - RNA, 16 nt, Homo sapiens
augaaauuauuuguca

SEQ ID NO: 1694515 - RNA, 20 nt, Homo sapiens
augaaauuguaaaaccuguc

SEQ ID NO: 1694516 - RNA, 13 nt, Homo sapiens
augaacacuuuuu

SEQ ID NO: 1694517 - RNA, 16 nt, Homo sapiens
augaacaugguguuca

SEQ ID NO: 1694518 - RNA, 18 nt, Homo sapiens
augaacaugugaaguuau

SEQ ID NO: 1694519 - RNA, 22 nt, Homo sapiens
augaacccuuccugagcuuuau

SEQ ID NO: 1694520 - RNA, 20 nt, Homo sapiens
augaauauuuuguaacuauu

SEQ ID NO: 1694521 - RNA, 12 nt, Homo sapiens
augacacugacc

SEQ ID NO: 1694522 - RNA, 15 nt, Homo sapiens
augacaucucagggg

SEQ ID NO: 1694523 - RNA, 15 nt, Homo sapiens
augacaugcacugac

SEQ ID NO: 1694524 - RNA, 15 nt, Homo sapiens
augacauuuauucaa

SEQ ID NO: 1694525 - RNA, 15 nt, Homo sapiens
augaccauccugcca

SEQ ID NO: 1694526 - RNA, 13 nt, Homo sapiens
augacccacuguc

SEQ ID NO: 1694527 - RNA, 23 nt, Homo sapiens
augacccccgcaaguuugcacuc

SEQ ID NO: 1694528 - RNA, 17 nt, Homo sapiens
augacccuuugccuguu

SEQ ID NO: 1694529 - RNA, 22 nt, Homo sapiens
augaccuuggacaaucaugaaa

SEQ ID NO: 1694530 - RNA, 15 nt, Homo sapiens
augacgucaucauca

SEQ ID NO: 1694531 - RNA, 16 nt, Homo sapiens
augacugaugacauau

SEQ ID NO: 1694532 - RNA, 12 nt, Homo sapiens
augacugugcua

SEQ ID NO: 1694533 - RNA, 15 nt, Homo sapiens
augacuuaaccauau

SEQ ID NO: 1694534 - RNA, 18 nt, Homo sapiens
augagaacaaagcuguua

SEQ ID NO: 1694535 - RNA, 19 nt, Homo sapiens
augagacccuggugccugg

SEQ ID NO: 1694536 - RNA, 19 nt, Homo sapiens
augagauguuaaauacuuu

SEQ ID NO: 1694537 - RNA, 17 nt, Homo sapiens
augagcacccauuccaa

SEQ ID NO: 1694538 - RNA, 22 nt, Homo sapiens
augagcagaaggaaacaaaaaa

SEQ ID NO: 1694539 - RNA, 18 nt, Homo sapiens
augagccgugaacugugc

SEQ ID NO: 1694540 - RNA, 17 nt, Homo sapiens
augagcugacaucucag

SEQ ID NO: 1694541 - RNA, 14 nt, Homo sapiens
caauuccugugauu

SEQ ID NO: 1694542 - RNA, 18 nt, Homo sapiens
caauuccugugauuuaug

SEQ ID NO: 1694543 - RNA, 15 nt, Homo sapiens
caauuguaacgacuu

SEQ ID NO: 1694544 - RNA, 20 nt, Homo sapiens
caauugucuauuuaucuuuu

SEQ ID NO: 1694545 - RNA, 11 nt, Homo sapiens
caauuuaguuc

SEQ ID NO: 1694546 - RNA, 16 nt, Homo sapiens
caauuucaagguucua

SEQ ID NO: 1694547 - RNA, 22 nt, Homo sapiens
caauuucaccaccaaaugccaa

SEQ ID NO: 1694548 - RNA, 21 nt, Homo sapiens
caauuuggacuggugugcucu

SEQ ID NO: 1694549 - RNA, 12 nt, Homo sapiens
cacaaaccacaa

SEQ ID NO: 1694550 - RNA, 13 nt, Homo sapiens
cacaaaguguaua

SEQ ID NO: 1694551 - RNA, 21 nt, Homo sapiens
cacaaaucagaccuggcugcu

SEQ ID NO: 1694552 - RNA, 16 nt, Homo sapiens
cacaacugacacagga

SEQ ID NO: 1694553 - RNA, 18 nt, Homo sapiens
cacaacugacacaggaaa

SEQ ID NO: 1694554 - RNA, 18 nt, Homo sapiens
cacaacugcaauaacuuc

SEQ ID NO: 1694555 - RNA, 18 nt, Homo sapiens
cacaagaagugguccauc

SEQ ID NO: 1694556 - RNA, 19 nt, Homo sapiens
cacaagaggaauaagaaug

SEQ ID NO: 1694557 - RNA, 17 nt, Homo sapiens
cacaagcagagugcaca

SEQ ID NO: 1694558 - RNA, 17 nt, Homo sapiens
cacaaggugcaaaucaa

SEQ ID NO: 1694559 - RNA, 13 nt, Homo sapiens
cacaagucuucca

SEQ ID NO: 1694560 - RNA, 14 nt, Homo sapiens
cacaagucuuccag

SEQ ID NO: 1694561 - RNA, 21 nt, Homo sapiens
cacacaaaaagugucucugcc

SEQ ID NO: 1694562 - RNA, 14 nt, Homo sapiens
cacacaagcccaca

SEQ ID NO: 1694563 - RNA, 14 nt, Homo sapiens
agguuaucgaaaua

SEQ ID NO: 1694564 - RNA, 14 nt, Homo sapiens
agguuuacauucau

SEQ ID NO: 1694565 - RNA, 15 nt, Homo sapiens
agguuuacauuguca

SEQ ID NO: 1694566 - RNA, 14 nt, Homo sapiens
aguaaaagaugaag

SEQ ID NO: 1694567 - RNA, 18 nt, Homo sapiens
aguaaauauugaggcuuu

SEQ ID NO: 1694568 - RNA, 20 nt, Homo sapiens
aguaaaucuuuuacaacugc

SEQ ID NO: 1694569 - RNA, 23 nt, Homo sapiens
aguaaaugcuagguuaauuccaa

SEQ ID NO: 1694570 - RNA, 14 nt, Homo sapiens
aguaacacacuucc

SEQ ID NO: 1694571 - RNA, 13 nt, Homo sapiens
aguaacccaaacc

SEQ ID NO: 1694572 - RNA, 16 nt, Homo sapiens
aguaacccaaaccuca

SEQ ID NO: 1694573 - RNA, 22 nt, Homo sapiens
aguaauagagcaaaauugaugu

SEQ ID NO: 1694574 - RNA, 19 nt, Homo sapiens
aguaaucuaauauggccac

SEQ ID NO: 1694575 - RNA, 14 nt, Homo sapiens
aguaaucuguacau

SEQ ID NO: 1694576 - RNA, 15 nt, Homo sapiens
aguaaugagcaugau

SEQ ID NO: 1694577 - RNA, 15 nt, Homo sapiens
aguacaucucuacua

SEQ ID NO: 1694578 - RNA, 22 nt, Homo sapiens
aguacaugauaaaugauagaca

SEQ ID NO: 1694579 - RNA, 18 nt, Homo sapiens
aguaccuacaucagucaa

SEQ ID NO: 1694580 - RNA, 19 nt, Homo sapiens
aguacuccaagacagagac

SEQ ID NO: 1694581 - RNA, 13 nt, Homo sapiens
aguacugaugaaa

SEQ ID NO: 1694582 - RNA, 19 nt, Homo sapiens
aguagaaauaaaagugaau

SEQ ID NO: 1694583 - RNA, 14 nt, Homo sapiens
aguagaauccuaaa

SEQ ID NO: 1694584 - RNA, 14 nt, Homo sapiens
aguagagacagggu

SEQ ID NO: 1694585 - RNA, 16 nt, Homo sapiens
aguagaggcuauggac

SEQ ID NO: 1694586 - RNA, 17 nt, Homo sapiens
aguagaugauuuccuua

SEQ ID NO: 1694587 - RNA, 12 nt, Homo sapiens
aguagcaauuuc

SEQ ID NO: 1694588 - RNA, 16 nt, Homo sapiens
aguagcagugucugua

SEQ ID NO: 1694589 - RNA, 20 nt, Homo sapiens
aguagcugggacuacaggca

SEQ ID NO: 1694590 - RNA, 13 nt, Homo sapiens
aguagguuuacau

SEQ ID NO: 1694591 - RNA, 20 nt, Homo sapiens
aguaguccuuggcauagaca

SEQ ID NO: 1694592 - RNA, 15 nt, Homo sapiens
aguauccaggcuuug

SEQ ID NO: 1694593 - RNA, 14 nt, Homo sapiens
aguaucccacaucc

SEQ ID NO: 1694594 - RNA, 15 nt, Homo sapiens
aguaucccacaucca

SEQ ID NO: 1694595 - RNA, 11 nt, Homo sapiens
aguaucuauau

SEQ ID NO: 1694596 - RNA, 12 nt, Homo sapiens
aguaucuuccau

SEQ ID NO: 1694597 - RNA, 18 nt, Homo sapiens
aguaucuuugcacuccaa

SEQ ID NO: 1694598 - RNA, 18 nt, Homo sapiens
aguauggcuccuccauau

SEQ ID NO: 1694599 - RNA, 22 nt, Homo sapiens
aguauucauucugcauugcuag

SEQ ID NO: 1694600 - RNA, 18 nt, Homo sapiens
aguauuggcugaguccau

SEQ ID NO: 1694601 - RNA, 15 nt, Homo sapiens
aguauuucuguggau

SEQ ID NO: 1694602 - RNA, 19 nt, Homo sapiens
aguauuuuuauccaugaca

SEQ ID NO: 1694603 - RNA, 21 nt, Homo sapiens
agucacauggccuaugcacau

SEQ ID NO: 1694604 - RNA, 17 nt, Homo sapiens
agucaccccaaguaguc

SEQ ID NO: 1694605 - RNA, 13 nt, Homo sapiens
agucaccuuccag

SEQ ID NO: 1694606 - RNA, 14 nt, Homo sapiens
agucacugcacagu

SEQ ID NO: 1694607 - RNA, 14 nt, Homo sapiens
agucaguauggucu

SEQ ID NO: 1694608 - RNA, 17 nt, Homo sapiens
agucaucagaaauucca

SEQ ID NO: 1694609 - RNA, 21 nt, Homo sapiens
aguccaggcacaggaugcugu

SEQ ID NO: 1694610 - RNA, 17 nt, Homo sapiens
aguccaguaaagccuua

SEQ ID NO: 1694611 - RNA, 23 nt, Homo sapiens
agucccccaacucugagcccaug

SEQ ID NO: 1694612 - RNA, 20 nt, Homo sapiens
aguccccucaccuccucuaa

SEQ ID NO: 1694613 - RNA, 23 nt, Homo sapiens
aguccuguaguuuuauuuuaugu

SEQ ID NO: 1694614 - RNA, 19 nt, Homo sapiens
aguccuuucuaaguauuuu

SEQ ID NO: 1694615 - RNA, 23 nt, Homo sapiens
agucgaggacagggaggugaccc

SEQ ID NO: 1694616 - RNA, 23 nt, Homo sapiens
agucgauuauuuccaguguucua

SEQ ID NO: 1694617 - RNA, 13 nt, Homo sapiens
agucucaaaaaua

SEQ ID NO: 1694618 - RNA, 16 nt, Homo sapiens
agucucacuguugccc

SEQ ID NO: 1694619 - RNA, 22 nt, Homo sapiens
agucucucucuuccucacaguc

SEQ ID NO: 1694620 - RNA, 13 nt, Homo sapiens
agucucugugaau

SEQ ID NO: 1694621 - RNA, 15 nt, Homo sapiens
agucucugugaauug

SEQ ID NO: 1694622 - RNA, 23 nt, Homo sapiens
agucugaaugcugccacaaccag

SEQ ID NO: 1694623 - RNA, 19 nt, Homo sapiens
agucugcaugugcacggug

SEQ ID NO: 1694624 - RNA, 22 nt, Homo sapiens
agucuguugugugucaugccag

SEQ ID NO: 1694625 - RNA, 13 nt, Homo sapiens
agucuuccaugac

SEQ ID NO: 1694626 - RNA, 21 nt, Homo sapiens
agugaaaaucuuggagacccu

SEQ ID NO: 1694627 - RNA, 14 nt, Homo sapiens
agugaacuaugaag

SEQ ID NO: 1694628 - RNA, 14 nt, Homo sapiens
agugaagacuggaa

SEQ ID NO: 1694629 - RNA, 16 nt, Homo sapiens
agugaaugaacaaaug

SEQ ID NO: 1694630 - RNA, 12 nt, Homo sapiens
agugacauuugu

SEQ ID NO: 1694631 - RNA, 22 nt, Homo sapiens
agugaccccugaccucacugug

SEQ ID NO: 1694632 - RNA, 21 nt, Homo sapiens
agugaccccugccuacuuccu

SEQ ID NO: 1694633 - RNA, 20 nt, Homo sapiens
agugacuggugccaguguca

SEQ ID NO: 1694634 - RNA, 22 nt, Homo sapiens
agugagcacucacgcccuaagc

SEQ ID NO: 1694635 - RNA, 19 nt, Homo sapiens
agugagucgaggacaggga

SEQ ID NO: 1694636 - RNA, 19 nt, Homo sapiens
agugauccucccaccucag

SEQ ID NO: 1694637 - RNA, 21 nt, Homo sapiens
agugcagugagccgagaucac

SEQ ID NO: 1694638 - RNA, 14 nt, Homo sapiens
agugccagcaauga

SEQ ID NO: 1694639 - RNA, 16 nt, Homo sapiens
agugccagcaaugaca

SEQ ID NO: 1694640 - RNA, 21 nt, Homo sapiens
agugccguaacaacugugguc

SEQ ID NO: 1694641 - RNA, 14 nt, Homo sapiens
agugccuuuaguuu

SEQ ID NO: 1694642 - RNA, 17 nt, Homo sapiens
aggagucagaaacuguu

SEQ ID NO: 1694643 - RNA, 13 nt, Homo sapiens
aggauaagccacu

SEQ ID NO: 1694644 - RNA, 15 nt, Homo sapiens
aggauauuaacaaca

SEQ ID NO: 1694645 - RNA, 17 nt, Homo sapiens
aggauccaagcuaagca

SEQ ID NO: 1694646 - RNA, 23 nt, Homo sapiens
aggaugagagcccagagguaaca

SEQ ID NO: 1694647 - RNA, 23 nt, Homo sapiens
aggaugaggugguggaguggagu

SEQ ID NO: 1694648 - RNA, 21 nt, Homo sapiens
aggaugucccugggccagggu

SEQ ID NO: 1694649 - RNA, 13 nt, Homo sapiens
aggauguggcuua

SEQ ID NO: 1694650 - RNA, 15 nt, Homo sapiens
aggauuuugauccaa

SEQ ID NO: 1694651 - RNA, 18 nt, Homo sapiens
aggcaaaggaaauuguca

SEQ ID NO: 1694652 - RNA, 14 nt, Homo sapiens
aggcaacauccaaa

SEQ ID NO: 1694653 - RNA, 15 nt, Homo sapiens
aggcaacauccaaaa

SEQ ID NO: 1694654 - RNA, 12 nt, Homo sapiens
aggcacugcuga

SEQ ID NO: 1694655 - RNA, 18 nt, Homo sapiens
aggcacugggcaagugaa

SEQ ID NO: 1694656 - RNA, 19 nt, Homo sapiens
aggcacuguaguucuaaga

SEQ ID NO: 1694657 - RNA, 16 nt, Homo sapiens
aggcagagaaucauac

SEQ ID NO: 1694658 - RNA, 20 nt, Homo sapiens
aggcagagaaucauacuuag

SEQ ID NO: 1694659 - RNA, 15 nt, Homo sapiens
aggcagaguuugccu

SEQ ID NO: 1694660 - RNA, 12 nt, Homo sapiens
aggcagaucugu

SEQ ID NO: 1694661 - RNA, 18 nt, Homo sapiens
aggcagcagagggucucc

SEQ ID NO: 1694662 - RNA, 15 nt, Homo sapiens
aggcagccagggcuu

SEQ ID NO: 1694663 - RNA, 17 nt, Homo sapiens
aggcaggagaaucucuu

SEQ ID NO: 1694664 - RNA, 14 nt, Homo sapiens
aggcagggucucac

SEQ ID NO: 1694665 - RNA, 20 nt, Homo sapiens
aggcagggucucacucuguc

SEQ ID NO: 1694666 - RNA, 16 nt, Homo sapiens
aggcagguccacagag

SEQ ID NO: 1694667 - RNA, 18 nt, Homo sapiens
aggcagguccacagagag

SEQ ID NO: 1694668 - RNA, 22 nt, Homo sapiens
aggcagugacagcagucaggga

SEQ ID NO: 1694669 - RNA, 20 nt, Homo sapiens
aggcauuaauguuucuaucu

SEQ ID NO: 1694670 - RNA, 13 nt, Homo sapiens
aggccacauggga

SEQ ID NO: 1694671 - RNA, 12 nt, Homo sapiens
aggccagugcua

SEQ ID NO: 1694672 - RNA, 20 nt, Homo sapiens
aggccaugaaaaaaaugauc

SEQ ID NO: 1694673 - RNA, 22 nt, Homo sapiens
aggcccuggugcgaauggacuu

SEQ ID NO: 1694674 - RNA, 22 nt, Homo sapiens
aggcccuuccucuccacugccu

SEQ ID NO: 1694675 - RNA, 22 nt, Homo sapiens
aggccuauaaccccagcucccu

SEQ ID NO: 1694676 - RNA, 21 nt, Homo sapiens
aggccucccuagccagcacuu

SEQ ID NO: 1694677 - RNA, 18 nt, Homo sapiens
aggccuggccagaugcac

SEQ ID NO: 1694678 - RNA, 17 nt, Homo sapiens
aggccuuuuaacauuuu

SEQ ID NO: 1694679 - RNA, 22 nt, Homo sapiens
aggcgauccaccugucucagcc

SEQ ID NO: 1694680 - RNA, 23 nt, Homo sapiens
aggcgcccuuggcuucugugaug

SEQ ID NO: 1694681 - RNA, 17 nt, Homo sapiens
aggcgggagcaucucuu

SEQ ID NO: 1694682 - RNA, 13 nt, Homo sapiens
aggcuaugccauc

SEQ ID NO: 1694683 - RNA, 18 nt, Homo sapiens
aggcucaacugaggaugu

SEQ ID NO: 1694684 - RNA, 16 nt, Homo sapiens
aggcucuagaucauaa

SEQ ID NO: 1694685 - RNA, 12 nt, Homo sapiens
aggcucuucucc

SEQ ID NO: 1694686 - RNA, 18 nt, Homo sapiens
aggcugaggcaggaggau

SEQ ID NO: 1694687 - RNA, 15 nt, Homo sapiens
aggcugccccucuca

SEQ ID NO: 1694688 - RNA, 19 nt, Homo sapiens
aggcugccccucucaccaa

SEQ ID NO: 1694689 - RNA, 16 nt, Homo sapiens
aggcugggccaugucc

SEQ ID NO: 1694690 - RNA, 17 nt, Homo sapiens
aggcugggccaugucca

SEQ ID NO: 1694691 - RNA, 13 nt, Homo sapiens
aggcuggucucaa

SEQ ID NO: 1694692 - RNA, 16 nt, Homo sapiens
aggcuuuaucucaggg

SEQ ID NO: 1694693 - RNA, 12 nt, Homo sapiens
agggaaaacugc

SEQ ID NO: 1694694 - RNA, 13 nt, Homo sapiens
agggaaaacugca

SEQ ID NO: 1694695 - RNA, 13 nt, Homo sapiens
agggaaagugcau

SEQ ID NO: 1694696 - RNA, 21 nt, Homo sapiens
agggaaccugguacauccagu

SEQ ID NO: 1694697 - RNA, 19 nt, Homo sapiens
agggaagcuggccgagggu

SEQ ID NO: 1694698 - RNA, 19 nt, Homo sapiens
agggaaguaguccuuggca

SEQ ID NO: 1694699 - RNA, 22 nt, Homo sapiens
agggaauccugaccugagccag

SEQ ID NO: 1694700 - RNA, 13 nt, Homo sapiens
agggaaugcucag

SEQ ID NO: 1694701 - RNA, 21 nt, Homo sapiens
agggaccacacccuguacugu

SEQ ID NO: 1694702 - RNA, 16 nt, Homo sapiens
agggaccaugugucac

SEQ ID NO: 1694703 - RNA, 14 nt, Homo sapiens
agggacuccaugcu

SEQ ID NO: 1694704 - RNA, 16 nt, Homo sapiens
agggacugccucugcc

SEQ ID NO: 1694705 - RNA, 21 nt, Homo sapiens
agggagcuaucaggaacagcu

SEQ ID NO: 1694706 - RNA, 14 nt, Homo sapiens
agggagguggcaag

SEQ ID NO: 1694707 - RNA, 17 nt, Homo sapiens
agggauccguacauuca

SEQ ID NO: 1694708 - RNA, 14 nt, Homo sapiens
agggaucuugcaaa

SEQ ID NO: 1694709 - RNA, 22 nt, Homo sapiens
agggcaaaaagucuacauacuu

SEQ ID NO: 1694710 - RNA, 22 nt, Homo sapiens
agggcaaaugacaugcacugac

SEQ ID NO: 1694711 - RNA, 12 nt, Homo sapiens
agggccaggacu

SEQ ID NO: 1694712 - RNA, 16 nt, Homo sapiens
agggccaggacugagc

SEQ ID NO: 1694713 - RNA, 15 nt, Homo sapiens
agggcccacuuguau

SEQ ID NO: 1694714 - RNA, 22 nt, Homo sapiens
agggcccagugacaaggcccug

SEQ ID NO: 1694715 - RNA, 14 nt, Homo sapiens
agggcccuaccuga

SEQ ID NO: 1694716 - RNA, 18 nt, Homo sapiens
agggcuagcaucccugag

SEQ ID NO: 1694717 - RNA, 18 nt, Homo sapiens
agggcuagggaaagggau

SEQ ID NO: 1694718 - RNA, 13 nt, Homo sapiens
agggcugacauuu

SEQ ID NO: 1694719 - RNA, 14 nt, Homo sapiens
agggcugcccugag

SEQ ID NO: 1694720 - RNA, 18 nt, Homo sapiens
agggcugcccugagcgcc

SEQ ID NO: 1694721 - RNA, 13 nt, Homo sapiens
aggggcacuggug

SEQ ID NO: 1694722 - RNA, 13 nt, Homo sapiens
aggggcucuggag

SEQ ID NO: 1694723 - RNA, 15 nt, Homo sapiens
agggggagaaugggu

SEQ ID NO: 1694724 - RNA, 18 nt, Homo sapiens
agggggcugcccucucca

SEQ ID NO: 1694725 - RNA, 18 nt, Homo sapiens
agggguuggauugcaaua

SEQ ID NO: 1694726 - RNA, 20 nt, Homo sapiens
agggguuugagaugcuguag

SEQ ID NO: 1694727 - RNA, 23 nt, Homo sapiens
agggguuugagaugcuguaggug

SEQ ID NO: 1694728 - RNA, 20 nt, Homo sapiens
agggucaaggaguacuccaa

SEQ ID NO: 1694729 - RNA, 13 nt, Homo sapiens
aggguccagugga

SEQ ID NO: 1694730 - RNA, 15 nt, Homo sapiens
agggucggccuguac

SEQ ID NO: 1694731 - RNA, 23 nt, Homo sapiens
agggugacccugaagugagcaca

SEQ ID NO: 1694732 - RNA, 22 nt, Homo sapiens
agggugaucgcacaaccugcau

SEQ ID NO: 1694733 - RNA, 15 nt, Homo sapiens
aggguggacuuagaa

SEQ ID NO: 1694734 - RNA, 18 nt, Homo sapiens
aggguggcccuugcaguu

SEQ ID NO: 1694735 - RNA, 20 nt, Homo sapiens
agggugggggccaccugccu

SEQ ID NO: 1694736 - RNA, 17 nt, Homo sapiens
aggguggucuugaucuc

SEQ ID NO: 1694737 - RNA, 19 nt, Homo sapiens
agguacuucaggggcacuu

SEQ ID NO: 1694738 - RNA, 19 nt, Homo sapiens
agguaggggcccacuucac

SEQ ID NO: 1694739 - RNA, 13 nt, Homo sapiens
agguauguugccu

SEQ ID NO: 1694740 - RNA, 16 nt, Homo sapiens
aggucaaggcugcagu

SEQ ID NO: 1694741 - RNA, 20 nt, Homo sapiens
agguccuccaucccaacagc

SEQ ID NO: 1694742 - RNA, 21 nt, Homo sapiens
aggucgaccccaaagccccuu

SEQ ID NO: 1694743 - RNA, 18 nt, Homo sapiens
aggucuagaaaaccagcu

SEQ ID NO: 1694744 - RNA, 23 nt, Homo sapiens
aggucugagccacagcagcauuu

SEQ ID NO: 1694745 - RNA, 20 nt, Homo sapiens
aggucuguuuaaaguggcaa

SEQ ID NO: 1694746 - RNA, 22 nt, Homo sapiens
aggugacagaggcgaaggcaga

SEQ ID NO: 1694747 - RNA, 21 nt, Homo sapiens
aggugcgaaugacaguagcau

SEQ ID NO: 1694748 - RNA, 24 nt, Homo sapiens
agguggcaagcugugacuucucca

SEQ ID NO: 1694749 - RNA, 15 nt, Homo sapiens
agguggccacuccag

SEQ ID NO: 1694750 - RNA, 20 nt, Homo sapiens
agguguaccaggaaaggauu

SEQ ID NO: 1694751 - RNA, 12 nt, Homo sapiens
agaucacgccac

SEQ ID NO: 1694752 - RNA, 15 nt, Homo sapiens
agaucacgccacugc

SEQ ID NO: 1694753 - RNA, 10 nt, Homo sapiens
agaucacugc

SEQ ID NO: 1694754 - RNA, 12 nt, Homo sapiens
agaucacugcca

SEQ ID NO: 1694755 - RNA, 19 nt, Homo sapiens
agaucagaugcuccaagau

SEQ ID NO: 1694756 - RNA, 11 nt, Homo sapiens
agaucagucag

SEQ ID NO: 1694757 - RNA, 17 nt, Homo sapiens
agauccaagaggcccug

SEQ ID NO: 1694758 - RNA, 22 nt, Homo sapiens
agaucuggucccuugcagcuag

SEQ ID NO: 1694759 - RNA, 20 nt, Homo sapiens
agaugacaaccuccauucua

SEQ ID NO: 1694760 - RNA, 15 nt, Homo sapiens
agaugagaacaaagc

SEQ ID NO: 1694761 - RNA, 22 nt, Homo sapiens
agaugagaacaaagcuguuaaa

SEQ ID NO: 1694762 - RNA, 20 nt, Homo sapiens
agaugagauuggcauggcuu

SEQ ID NO: 1694763 - RNA, 17 nt, Homo sapiens
agaugauggaugccaau

SEQ ID NO: 1694764 - RNA, 19 nt, Homo sapiens
agaugcaaggaccaggacu

SEQ ID NO: 1694765 - RNA, 18 nt, Homo sapiens
agaugccccagagcuguu

SEQ ID NO: 1694766 - RNA, 16 nt, Homo sapiens
agaugcuccaagauuc

SEQ ID NO: 1694767 - RNA, 17 nt, Homo sapiens
agaugcuggacuugccu

SEQ ID NO: 1694768 - RNA, 20 nt, Homo sapiens
agauggaguucuugugccau

SEQ ID NO: 1694769 - RNA, 14 nt, Homo sapiens
agauggcacuuuga

SEQ ID NO: 1694770 - RNA, 21 nt, Homo sapiens
agauggggucucacaguguug

SEQ ID NO: 1694771 - RNA, 16 nt, Homo sapiens
agaugguuucuugcaa

SEQ ID NO: 1694772 - RNA, 18 nt, Homo sapiens
agaugucuuuuauagugg

SEQ ID NO: 1694773 - RNA, 18 nt, Homo sapiens
agaugugaaaacaucuca

SEQ ID NO: 1694774 - RNA, 19 nt, Homo sapiens
agaugugauauucuaagac

SEQ ID NO: 1694775 - RNA, 12 nt, Homo sapiens
agauuacccaaa

SEQ ID NO: 1694776 - RNA, 16 nt, Homo sapiens
agauuauaaacugacu

SEQ ID NO: 1694777 - RNA, 21 nt, Homo sapiens
agauuauauuggugguucuca

SEQ ID NO: 1694778 - RNA, 14 nt, Homo sapiens
agauucagucuugc

SEQ ID NO: 1694779 - RNA, 15 nt, Homo sapiens
agauucagucuugcc

SEQ ID NO: 1694780 - RNA, 13 nt, Homo sapiens
agauucuaaagau

SEQ ID NO: 1694781 - RNA, 17 nt, Homo sapiens
agauucuaaagauucua

SEQ ID NO: 1694782 - RNA, 16 nt, Homo sapiens
agauucuaaugaugau

SEQ ID NO: 1694783 - RNA, 20 nt, Homo sapiens
agauucucaaaauuccuaca

SEQ ID NO: 1694784 - RNA, 17 nt, Homo sapiens
agauucucugugucuaa

SEQ ID NO: 1694785 - RNA, 13 nt, Homo sapiens
agauugauacuuu

SEQ ID NO: 1694786 - RNA, 14 nt, Homo sapiens
agauugcuuucuuc

SEQ ID NO: 1694787 - RNA, 18 nt, Homo sapiens
agauuggcauggcuuuau

SEQ ID NO: 1694788 - RNA, 22 nt, Homo sapiens
agauuguguucuuccucucuca

SEQ ID NO: 1694789 - RNA, 17 nt, Homo sapiens
agauuuaugaugcacuu

SEQ ID NO: 1694790 - RNA, 18 nt, Homo sapiens
agauuuccuccuggccuu

SEQ ID NO: 1694791 - RNA, 18 nt, Homo sapiens
agauuugucuaauugcau

SEQ ID NO: 1694792 - RNA, 19 nt, Homo sapiens
agauuuucauguucuugca

SEQ ID NO: 1694793 - RNA, 20 nt, Homo sapiens
agauuuucauguucuugcag

SEQ ID NO: 1694794 - RNA, 23 nt, Homo sapiens
agauuuucauguucuugcaguca

SEQ ID NO: 1694795 - RNA, 13 nt, Homo sapiens
agauuuugcaccu

SEQ ID NO: 1694796 - RNA, 22 nt, Homo sapiens
agauuuuucggaggccccacug

SEQ ID NO: 1694797 - RNA, 17 nt, Homo sapiens
agauuuuuuauugcuag

SEQ ID NO: 1694798 - RNA, 23 nt, Homo sapiens
agauuuuuuauugcuaguauuug

SEQ ID NO: 1694799 - RNA, 16 nt, Homo sapiens
agcaaaaaguauugaa

SEQ ID NO: 1694800 - RNA, 16 nt, Homo sapiens
agcaaagcugaugaca

SEQ ID NO: 1694801 - RNA, 17 nt, Homo sapiens
agcaaauaaauaucauc

SEQ ID NO: 1694802 - RNA, 14 nt, Homo sapiens
agcaaaucuaugag

SEQ ID NO: 1694803 - RNA, 15 nt, Homo sapiens
agcaacaagaccacc

SEQ ID NO: 1694804 - RNA, 14 nt, Homo sapiens
agcaacugucuuau

SEQ ID NO: 1694805 - RNA, 17 nt, Homo sapiens
agcaagacccaucucaa

SEQ ID NO: 1694806 - RNA, 13 nt, Homo sapiens
agcaaggagcaca

SEQ ID NO: 1694807 - RNA, 17 nt, Homo sapiens
agcaaggcccugcugcc

SEQ ID NO: 1694808 - RNA, 15 nt, Homo sapiens
agcaaggucauuucu

SEQ ID NO: 1694809 - RNA, 23 nt, Homo sapiens
agcaaggucauuucuucagucag

SEQ ID NO: 1694810 - RNA, 17 nt, Homo sapiens
agcaaugacaucucagg

SEQ ID NO: 1694811 - RNA, 19 nt, Homo sapiens
agcaaugcccguaaugcuu

SEQ ID NO: 1694812 - RNA, 22 nt, Homo sapiens
agcacaagccacaagucuucca

SEQ ID NO: 1694813 - RNA, 15 nt, Homo sapiens
agcacaauuugcacu

SEQ ID NO: 1694814 - RNA, 19 nt, Homo sapiens
agcacagaauuugucagaa

SEQ ID NO: 1694815 - RNA, 21 nt, Homo sapiens
agcacagauuuuaauugucau

SEQ ID NO: 1694816 - RNA, 13 nt, Homo sapiens
agcacaguuugaa

SEQ ID NO: 1694817 - RNA, 15 nt, Homo sapiens
agcaccacccuaguc

SEQ ID NO: 1694818 - RNA, 14 nt, Homo sapiens
agcaccccaugcca

SEQ ID NO: 1694819 - RNA, 14 nt, Homo sapiens
agcacggacaauaa

SEQ ID NO: 1694820 - RNA, 24 nt, Homo sapiens
agcacgugucucagacugcaugua

SEQ ID NO: 1694821 - RNA, 23 nt, Homo sapiens
agcacuaaggugugcucugauca

SEQ ID NO: 1694822 - RNA, 17 nt, Homo sapiens
agcagaggcggucuuca

SEQ ID NO: 1694823 - RNA, 16 nt, Homo sapiens
agcagauaacaaugca

SEQ ID NO: 1694824 - RNA, 15 nt, Homo sapiens
agcagauuuuugcaa

SEQ ID NO: 1694825 - RNA, 14 nt, Homo sapiens
agcagccccgggag

SEQ ID NO: 1694826 - RNA, 19 nt, Homo sapiens
acaacccaccccgcuuucg

SEQ ID NO: 1694827 - RNA, 17 nt, Homo sapiens
acaacuguggucaaucc

SEQ ID NO: 1694828 - RNA, 18 nt, Homo sapiens
acaacuguggucaauccg

SEQ ID NO: 1694829 - RNA, 19 nt, Homo sapiens
acaagauauuguacauaaa

SEQ ID NO: 1694830 - RNA, 12 nt, Homo sapiens
acaagauugaaa

SEQ ID NO: 1694831 - RNA, 20 nt, Homo sapiens
acaagcgugagccacugcac

SEQ ID NO: 1694832 - RNA, 16 nt, Homo sapiens
acaaggcccugagcuu

SEQ ID NO: 1694833 - RNA, 17 nt, Homo sapiens
acaaggcccugagcuuu

SEQ ID NO: 1694834 - RNA, 18 nt, Homo sapiens
acaaggcuccaagaccua

SEQ ID NO: 1694835 - RNA, 18 nt, Homo sapiens
acaaggcuuuaucucagg

SEQ ID NO: 1694836 - RNA, 18 nt, Homo sapiens
acaaguauggcuccucca

SEQ ID NO: 1694837 - RNA, 18 nt, Homo sapiens
acaaguauguugagaguu

SEQ ID NO: 1694838 - RNA, 12 nt, Homo sapiens
acaagucuucca

SEQ ID NO: 1694839 - RNA, 12 nt, Homo sapiens
acaagugucagg

SEQ ID NO: 1694840 - RNA, 14 nt, Homo sapiens
acaauaacacuaaa

SEQ ID NO: 1694841 - RNA, 17 nt, Homo sapiens
acaauaauucauauucu

SEQ ID NO: 1694842 - RNA, 18 nt, Homo sapiens
acaauacagauaacauua

SEQ ID NO: 1694843 - RNA, 13 nt, Homo sapiens
acaaucacacuca

SEQ ID NO: 1694844 - RNA, 23 nt, Homo sapiens
acaauugggagauuaucuuucaa

SEQ ID NO: 1694845 - RNA, 16 nt, Homo sapiens
acaauuugauacauaa

SEQ ID NO: 1694846 - RNA, 13 nt, Homo sapiens
acacaaagacauu

SEQ ID NO: 1694847 - RNA, 13 nt, Homo sapiens
acacaaaugcaug

SEQ ID NO: 1694848 - RNA, 15 nt, Homo sapiens
acacaaauuuguaaa

SEQ ID NO: 1694849 - RNA, 19 nt, Homo sapiens
acacaagcccacagcacag

SEQ ID NO: 1694850 - RNA, 14 nt, Homo sapiens
acacacacaucuca

SEQ ID NO: 1694851 - RNA, 12 nt, Homo sapiens
acacacagcucu

SEQ ID NO: 1694852 - RNA, 17 nt, Homo sapiens
acacacauacaaaaugu

SEQ ID NO: 1694853 - RNA, 16 nt, Homo sapiens
acacacccugagguca

SEQ ID NO: 1694854 - RNA, 13 nt, Homo sapiens
acacagaccacca

SEQ ID NO: 1694855 - RNA, 15 nt, Homo sapiens
acacagacugcgauu

SEQ ID NO: 1694856 - RNA, 17 nt, Homo sapiens
acacagcuacagcuuuc

SEQ ID NO: 1694857 - RNA, 21 nt, Homo sapiens
acacagcucuucuccaggcug

SEQ ID NO: 1694858 - RNA, 13 nt, Homo sapiens
acacaggcuucau

SEQ ID NO: 1694859 - RNA, 17 nt, Homo sapiens
acacaguauuacuucug

SEQ ID NO: 1694860 - RNA, 16 nt, Homo sapiens
acaccacaccaucagg

SEQ ID NO: 1694861 - RNA, 23 nt, Homo sapiens
acaccagccauacuuaucucucu

SEQ ID NO: 1694862 - RNA, 15 nt, Homo sapiens
acaccaguaccugaa

SEQ ID NO: 1694863 - RNA, 16 nt, Homo sapiens
acacccuuucuugaca

SEQ ID NO: 1694864 - RNA, 16 nt, Homo sapiens
acaccgcugcacucaa

SEQ ID NO: 1694865 - RNA, 15 nt, Homo sapiens
acaccuugacagggc

SEQ ID NO: 1694866 - RNA, 16 nt, Homo sapiens
acacgaccggggccag

SEQ ID NO: 1694867 - RNA, 20 nt, Homo sapiens
acacuaaccuggguucccuu

SEQ ID NO: 1694868 - RNA, 15 nt, Homo sapiens
acacuaucauggacu

SEQ ID NO: 1694869 - RNA, 15 nt, Homo sapiens
acacucacauuuauu

SEQ ID NO: 1694870 - RNA, 14 nt, Homo sapiens
acacucaccaugaa

SEQ ID NO: 1694871 - RNA, 22 nt, Homo sapiens
acacuccagugccagcaaugac

SEQ ID NO: 1694872 - RNA, 12 nt, Homo sapiens
acacucucugga

SEQ ID NO: 1694873 - RNA, 16 nt, Homo sapiens
acacugaugcuuagau

SEQ ID NO: 1694874 - RNA, 16 nt, Homo sapiens
acacuggugugaccug

SEQ ID NO: 1694875 - RNA, 22 nt, Homo sapiens
acacuguaccgacuuugauaga

SEQ ID NO: 1694876 - RNA, 19 nt, Homo sapiens
acacugugcccagcccgga

SEQ ID NO: 1694877 - RNA, 18 nt, Homo sapiens
acacuuuuaugagcuucc

SEQ ID NO: 1694878 - RNA, 22 nt, Homo sapiens
acagaaauggggaauucucuaa

SEQ ID NO: 1694879 - RNA, 23 nt, Homo sapiens
acagaacagggucauguuugcag

SEQ ID NO: 1694880 - RNA, 18 nt, Homo sapiens
acagaacuauguacuuua

SEQ ID NO: 1694881 - RNA, 12 nt, Homo sapiens
acagaacuugaa

SEQ ID NO: 1694882 - RNA, 16 nt, Homo sapiens
acagaagacagcugcu

SEQ ID NO: 1694883 - RNA, 16 nt, Homo sapiens
acagaaggaugaauga

SEQ ID NO: 1694884 - RNA, 20 nt, Homo sapiens
acagaauuuuaaagagcaua

SEQ ID NO: 1694885 - RNA, 20 nt, Homo sapiens
acagacaagugacuguaucu

SEQ ID NO: 1694886 - RNA, 12 nt, Homo sapiens
acagacagccac

SEQ ID NO: 1694887 - RNA, 20 nt, Homo sapiens
acagacauacauuuaugcac

SEQ ID NO: 1694888 - RNA, 12 nt, Homo sapiens
acagacgugugc

SEQ ID NO: 1694889 - RNA, 22 nt, Homo sapiens
acagagauuggagagaagggca

SEQ ID NO: 1694890 - RNA, 13 nt, Homo sapiens
acagagugcauug

SEQ ID NO: 1694891 - RNA, 17 nt, Homo sapiens
acagcaaccucuucaug

SEQ ID NO: 1694892 - RNA, 16 nt, Homo sapiens
acagcacuacugggug

SEQ ID NO: 1694893 - RNA, 21 nt, Homo sapiens
acagcacuggggagucuuugu

SEQ ID NO: 1694894 - RNA, 21 nt, Homo sapiens
agagcaguaccagcgcucuaa

SEQ ID NO: 1694895 - RNA, 15 nt, Homo sapiens
agagcccccuugaca

SEQ ID NO: 1694896 - RNA, 18 nt, Homo sapiens
agagccccuacagcauug

SEQ ID NO: 1694897 - RNA, 21 nt, Homo sapiens
agagcccggcgccccugccac

SEQ ID NO: 1694898 - RNA, 22 nt, Homo sapiens
agagcucuuuaccaaggaugaa

SEQ ID NO: 1694899 - RNA, 16 nt, Homo sapiens
agagcugggugucaag

SEQ ID NO: 1694900 - RNA, 12 nt, Homo sapiens
agagcugucacu

SEQ ID NO: 1694901 - RNA, 19 nt, Homo sapiens
agaggaauaagaauggagc

SEQ ID NO: 1694902 - RNA, 19 nt, Homo sapiens
agaggaauuuauaccucaa

SEQ ID NO: 1694903 - RNA, 13 nt, Homo sapiens
agaggagccagac

SEQ ID NO: 1694904 - RNA, 17 nt, Homo sapiens
agaggagccagacagac

SEQ ID NO: 1694905 - RNA, 14 nt, Homo sapiens
agaggagugugaag

SEQ ID NO: 1694906 - RNA, 18 nt, Homo sapiens
agaggaucuccuguccau

SEQ ID NO: 1694907 - RNA, 20 nt, Homo sapiens
agaggaucuccuguccauca

SEQ ID NO: 1694908 - RNA, 13 nt, Homo sapiens
agaggaugugcaa

SEQ ID NO: 1694909 - RNA, 14 nt, Homo sapiens
agaggccauggcag

SEQ ID NO: 1694910 - RNA, 22 nt, Homo sapiens
agaggcuauuauuuucacugua

SEQ ID NO: 1694911 - RNA, 18 nt, Homo sapiens
agaggcugccccucucac

SEQ ID NO: 1694912 - RNA, 12 nt, Homo sapiens
agagucaucuga

SEQ ID NO: 1694913 - RNA, 16 nt, Homo sapiens
agagugacuaguacaa

SEQ ID NO: 1694914 - RNA, 15 nt, Homo sapiens
agagugauugcagcu

SEQ ID NO: 1694915 - RNA, 21 nt, Homo sapiens
agaguggccuggccaggagcu

SEQ ID NO: 1694916 - RNA, 22 nt, Homo sapiens
agaguguuucuuccacaacaga

SEQ ID NO: 1694917 - RNA, 18 nt, Homo sapiens
agaguucuggaaaagaac

SEQ ID NO: 1694918 - RNA, 23 nt, Homo sapiens
agauaaaagaaccgagcaauuuu

SEQ ID NO: 1694919 - RNA, 15 nt, Homo sapiens
agauaaaauguguaa

SEQ ID NO: 1694920 - RNA, 14 nt, Homo sapiens
agauaagacauauc

SEQ ID NO: 1694921 - RNA, 19 nt, Homo sapiens
agauaaucagugugucuaa

SEQ ID NO: 1694922 - RNA, 14 nt, Homo sapiens
agauaauuggcaac

SEQ ID NO: 1694923 - RNA, 12 nt, Homo sapiens
agauacauuucc

SEQ ID NO: 1694924 - RNA, 19 nt, Homo sapiens
agauagaugcacuuaugca

SEQ ID NO: 1694925 - RNA, 14 nt, Homo sapiens
agauagauuuggaa

SEQ ID NO: 1694926 - RNA, 15 nt, Homo sapiens
agauagguaaauacc

SEQ ID NO: 1694927 - RNA, 23 nt, Homo sapiens
agauauaucccggaugaggcuga

SEQ ID NO: 1694928 - RNA, 15 nt, Homo sapiens
agauauuguacauaa

SEQ ID NO: 1694929 - RNA, 19 nt, Homo sapiens
agauauuugguaccauggu

SEQ ID NO: 1694930 - RNA, 22 nt, Homo sapiens
aaguugacuuauaguacaugau

SEQ ID NO: 1694931 - RNA, 16 nt, Homo sapiens
aaguuuacccaugaag

SEQ ID NO: 1694932 - RNA, 18 nt, Homo sapiens
aaguuucccuuccuccau

SEQ ID NO: 1694933 - RNA, 14 nt, Homo sapiens
aaguuuuacauugu

SEQ ID NO: 1694934 - RNA, 20 nt, Homo sapiens
aauaaaaagugacacagcag

SEQ ID NO: 1694935 - RNA, 20 nt, Homo sapiens
aauaaaacagcugucucuaa

SEQ ID NO: 1694936 - RNA, 16 nt, Homo sapiens
aauaaaagauucaccu

SEQ ID NO: 1694937 - RNA, 19 nt, Homo sapiens
aauaaaccuccgccaaugc

SEQ ID NO: 1694938 - RNA, 12 nt, Homo sapiens
aauaaaccuccu

SEQ ID NO: 1694939 - RNA, 20 nt, Homo sapiens
aauaaacuguguuuacucag

SEQ ID NO: 1694940 - RNA, 13 nt, Homo sapiens
aauaaauaauuaa

SEQ ID NO: 1694941 - RNA, 18 nt, Homo sapiens
aauaaauauuuaaugaau

SEQ ID NO: 1694942 - RNA, 18 nt, Homo sapiens
aauaaauucccaacuucu

SEQ ID NO: 1694943 - RNA, 13 nt, Homo sapiens
aauaacacuaaaa

SEQ ID NO: 1694944 - RNA, 12 nt, Homo sapiens
aauaacacuguc

SEQ ID NO: 1694945 - RNA, 20 nt, Homo sapiens
aauaaguuugcuccuucaua

SEQ ID NO: 1694946 - RNA, 14 nt, Homo sapiens
aauaauacacuaau

SEQ ID NO: 1694947 - RNA, 15 nt, Homo sapiens
aauaaugagcuauua

SEQ ID NO: 1694948 - RNA, 17 nt, Homo sapiens
aauaauucuucaccuaa

SEQ ID NO: 1694949 - RNA, 16 nt, Homo sapiens
aauacacaacacacac

SEQ ID NO: 1694950 - RNA, 13 nt, Homo sapiens
aauacauguucau

SEQ ID NO: 1694951 - RNA, 18 nt, Homo sapiens
aauaccauuaaaacugcu

SEQ ID NO: 1694952 - RNA, 11 nt, Homo sapiens
aauacuuucag

SEQ ID NO: 1694953 - RNA, 18 nt, Homo sapiens
aauagaucuuagggugaa

SEQ ID NO: 1694954 - RNA, 20 nt, Homo sapiens
aauagcaauagcauggauag

SEQ ID NO: 1694955 - RNA, 17 nt, Homo sapiens
aauagccacauuuggaa

SEQ ID NO: 1694956 - RNA, 21 nt, Homo sapiens
aauagcugggacuacaggugu

SEQ ID NO: 1694957 - RNA, 23 nt, Homo sapiens
aauagcugggacuacagguguga

SEQ ID NO: 1694958 - RNA, 22 nt, Homo sapiens
aauaggcuguguauuuacauga

SEQ ID NO: 1694959 - RNA, 14 nt, Homo sapiens
aauaguauuugcau

SEQ ID NO: 1694960 - RNA, 14 nt, Homo sapiens
aauagucauuccaa

SEQ ID NO: 1694961 - RNA, 15 nt, Homo sapiens
aauauaaaacuuaca

SEQ ID NO: 1694962 - RNA, 12 nt, Homo sapiens
aauauaagccuu

SEQ ID NO: 1694963 - RNA, 22 nt, Homo sapiens
aauauagagggcuuaugauuca

SEQ ID NO: 1694964 - RNA, 21 nt, Homo sapiens
aauauagcguucccaacaaca

SEQ ID NO: 1694965 - RNA, 17 nt, Homo sapiens
aauauauauacauaugu

SEQ ID NO: 1694966 - RNA, 17 nt, Homo sapiens
aauauauuccugagauu

SEQ ID NO: 1694967 - RNA, 16 nt, Homo sapiens
aauaucauacuguuca

SEQ ID NO: 1694968 - RNA, 23 nt, Homo sapiens
aauaucauucacuagcuuugccu

SEQ ID NO: 1694969 - RNA, 21 nt, Homo sapiens
aauaugagaugcguuguuaca

SEQ ID NO: 1694970 - RNA, 14 nt, Homo sapiens
aauaugggcacuuu

SEQ ID NO: 1694971 - RNA, 12 nt, Homo sapiens
aauauguacaag

SEQ ID NO: 1694972 - RNA, 22 nt, Homo sapiens
aauauguauuguaaacaugugu

SEQ ID NO: 1694973 - RNA, 14 nt, Homo sapiens
aauaugucaguuug

SEQ ID NO: 1694974 - RNA, 17 nt, Homo sapiens
aauauuaguuaauggau

SEQ ID NO: 1694975 - RNA, 17 nt, Homo sapiens
aauauucacugggccaa

SEQ ID NO: 1694976 - RNA, 20 nt, Homo sapiens
aauauuucccauuugugcca

SEQ ID NO: 1694977 - RNA, 20 nt, Homo sapiens
aauauuuuguaacuauuaca

SEQ ID NO: 1694978 - RNA, 16 nt, Homo sapiens
aauauuuuuuacagau

SEQ ID NO: 1694979 - RNA, 12 nt, Homo sapiens
aaucaagggcaa

SEQ ID NO: 1694980 - RNA, 22 nt, Homo sapiens
aaucaauaagaagguagaauga

SEQ ID NO: 1694981 - RNA, 12 nt, Homo sapiens
aaucaauguuca

SEQ ID NO: 1694982 - RNA, 14 nt, Homo sapiens
aaucacucuguccu

SEQ ID NO: 1694983 - RNA, 16 nt, Homo sapiens
aaucagcaaccugacu

SEQ ID NO: 1694984 - RNA, 14 nt, Homo sapiens
aaucagcauucuca

SEQ ID NO: 1694985 - RNA, 15 nt, Homo sapiens
aaucagccacauucu

SEQ ID NO: 1694986 - RNA, 16 nt, Homo sapiens
aaucauacuuagcaaa

SEQ ID NO: 1694987 - RNA, 21 nt, Homo sapiens
aaucauaguuuaaacugcauu

SEQ ID NO: 1694988 - RNA, 22 nt, Homo sapiens
aaucaucuauuuugaugcagca

SEQ ID NO: 1694989 - RNA, 14 nt, Homo sapiens
aauccaacauccag

SEQ ID NO: 1694990 - RNA, 19 nt, Homo sapiens
aauccaugcuucucaucug

SEQ ID NO: 1694991 - RNA, 17 nt, Homo sapiens
aaucccacccacaugug

SEQ ID NO: 1694992 - RNA, 14 nt, Homo sapiens
aauccuaagacaca

SEQ ID NO: 1694993 - RNA, 22 nt, Homo sapiens
aauccucuucuuuauacuguaa

SEQ ID NO: 1694994 - RNA, 17 nt, Homo sapiens
aauccuuaacacauuca

SEQ ID NO: 1694995 - RNA, 17 nt, Homo sapiens
aauuggaacaaagugaa

SEQ ID NO: 1694996 - RNA, 16 nt, Homo sapiens
aauugucuuuugucau

SEQ ID NO: 1694997 - RNA, 15 nt, Homo sapiens
aauuuacacugccau

SEQ ID NO: 1694998 - RNA, 22 nt, Homo sapiens
aauuuagugaucuuagcauagc

SEQ ID NO: 1694999 - RNA, 22 nt, Homo sapiens
aauuuaguuauugauguauaaa

SEQ ID NO: 1695000 - RNA, 14 nt, Homo sapiens
aauuuaucuuucaa

SEQ ID NO: 1695001 - RNA, 18 nt, Homo sapiens
aauuuauuaaaaugauug

SEQ ID NO: 1695002 - RNA, 18 nt, Homo sapiens
aauuucaauuucucccuu

SEQ ID NO: 1695003 - RNA, 12 nt, Homo sapiens
aauuuccagggu

SEQ ID NO: 1695004 - RNA, 23 nt, Homo sapiens
aauuucccuucuugcauccuucc

SEQ ID NO: 1695005 - RNA, 17 nt, Homo sapiens
aauuucuaaaaaacaga

SEQ ID NO: 1695006 - RNA, 24 nt, Homo sapiens
aauuucuagccugcacuuugaugu

SEQ ID NO: 1695007 - RNA, 11 nt, Homo sapiens
aauuucuguca

SEQ ID NO: 1695008 - RNA, 13 nt, Homo sapiens
aauuucugugaaa

SEQ ID NO: 1695009 - RNA, 21 nt, Homo sapiens
aauuucugugaaaccugugaa

SEQ ID NO: 1695010 - RNA, 14 nt, Homo sapiens
aauuugauacauaa

SEQ ID NO: 1695011 - RNA, 15 nt, Homo sapiens
aauuugaugccagga

SEQ ID NO: 1695012 - RNA, 16 nt, Homo sapiens
aauuugauuuacauau

SEQ ID NO: 1695013 - RNA, 18 nt, Homo sapiens
aauuuggccugcacuaau

SEQ ID NO: 1695014 - RNA, 12 nt, Homo sapiens
aauuuuacccuu

SEQ ID NO: 1695015 - RNA, 20 nt, Homo sapiens
aauuuuagugucauuuccau

SEQ ID NO: 1695016 - RNA, 14 nt, Homo sapiens
aauuuucuacaaau

SEQ ID NO: 1695017 - RNA, 11 nt, Homo sapiens
aauuuuuccau

SEQ ID NO: 1695018 - RNA, 22 nt, Homo sapiens
aauuuuugaaaaaaguacauau

SEQ ID NO: 1695019 - RNA, 15 nt, Homo sapiens
aauuuuugucucaga

SEQ ID NO: 1695020 - RNA, 14 nt, Homo sapiens
acaaaaaaaccaca

SEQ ID NO: 1695021 - RNA, 16 nt, Homo sapiens
acaaaacuacaugaga

SEQ ID NO: 1695022 - RNA, 16 nt, Homo sapiens
acaaaacuucuuguca

SEQ ID NO: 1695023 - RNA, 17 nt, Homo sapiens
acaaaacuucuugucag

SEQ ID NO: 1695024 - RNA, 11 nt, Homo sapiens
acaaaagcuau

SEQ ID NO: 1695025 - RNA, 22 nt, Homo sapiens
acaaaauaacucuccaguaaca

SEQ ID NO: 1695026 - RNA, 19 nt, Homo sapiens
acaaaauagacaauuugca

SEQ ID NO: 1695027 - RNA, 18 nt, Homo sapiens
acaaaaugauuuugaaga

SEQ ID NO: 1695028 - RNA, 16 nt, Homo sapiens
acaaagagguguacag

SEQ ID NO: 1695029 - RNA, 19 nt, Homo sapiens
acaaagagguguacaggua

SEQ ID NO: 1695030 - RNA, 15 nt, Homo sapiens
acaaagcacaguguu

SEQ ID NO: 1695031 - RNA, 15 nt, Homo sapiens
acaaagcccuuccau

SEQ ID NO: 1695032 - RNA, 17 nt, Homo sapiens
acaaauaaucacauuga

SEQ ID NO: 1695033 - RNA, 12 nt, Homo sapiens
acaaauaugcaa

SEQ ID NO: 1695034 - RNA, 11 nt, Homo sapiens
acaaaugugaa

SEQ ID NO: 1695035 - RNA, 16 nt, Homo sapiens
acaaauucaagccuua

SEQ ID NO: 1695036 - RNA, 23 nt, Homo sapiens
acaacagaaguauuucuguggau

SEQ ID NO: 1695037 - RNA, 22 nt, Homo sapiens
acaacauaaucuaguuuacaga

SEQ ID NO: 1695038 - RNA, 21 nt, Homo sapiens
aauacauaucgcugacuucau

SEQ ID NO: 1695039 - RNA, 21 nt, Homo sapiens
aauacaucaaaauauacuggg

SEQ ID NO: 1695040 - RNA, 16 nt, Homo sapiens
aauagacaauuugcac

SEQ ID NO: 1695041 - RNA, 23 nt, Homo sapiens
aauagacauauuaacaugcuuau

SEQ ID NO: 1695042 - RNA, 16 nt, Homo sapiens
aauagccacauuugga

SEQ ID NO: 1695043 - RNA, 15 nt, Homo sapiens
aauagcgccucuuuu

SEQ ID NO: 1695044 - RNA, 16 nt, Homo sapiens
aauaggaacagcugaa

SEQ ID NO: 1695045 - RNA, 14 nt, Homo sapiens
aauaggcauuugau

SEQ ID NO: 1695046 - RNA, 22 nt, Homo sapiens
aauaggccaggggaguuuccaa

SEQ ID NO: 1695047 - RNA, 12 nt, Homo sapiens
aauagggagaaa

SEQ ID NO: 1695048 - RNA, 21 nt, Homo sapiens
aauaguauuugagaguucuaa

SEQ ID NO: 1695049 - RNA, 9 nt, Homo sapiens
aauagucau

SEQ ID NO: 1695050 - RNA, 13 nt, Homo sapiens
aauagucuucuca

SEQ ID NO: 1695051 - RNA, 22 nt, Homo sapiens
aauauaaaaggcaaauguguac

SEQ ID NO: 1695052 - RNA, 16 nt, Homo sapiens
aauauaaaaugaguag

SEQ ID NO: 1695053 - RNA, 16 nt, Homo sapiens
aauauaauuugaucuu

SEQ ID NO: 1695054 - RNA, 14 nt, Homo sapiens
aauauauaagcuca

SEQ ID NO: 1695055 - RNA, 19 nt, Homo sapiens
aauauauauaaagaauaua

SEQ ID NO: 1695056 - RNA, 22 nt, Homo sapiens
aauauauauauauaucaguuug

SEQ ID NO: 1695057 - RNA, 18 nt, Homo sapiens
aauauauuuuaccauaca

SEQ ID NO: 1695058 - RNA, 15 nt, Homo sapiens
aauauauuuugccau

SEQ ID NO: 1695059 - RNA, 14 nt, Homo sapiens
aauaugcagugaua

SEQ ID NO: 1695060 - RNA, 21 nt, Homo sapiens
aauaugggcacuuuaaaugaa

SEQ ID NO: 1695061 - RNA, 23 nt, Homo sapiens
aauaugguugauaguuuaccuga

SEQ ID NO: 1695062 - RNA, 16 nt, Homo sapiens
aauauuauguguuucc

SEQ ID NO: 1695063 - RNA, 22 nt, Homo sapiens
aauauucauauuggaaaaauca

SEQ ID NO: 1695064 - RNA, 22 nt, Homo sapiens
aauauugcuuuggucauaugag

SEQ ID NO: 1695065 - RNA, 13 nt, Homo sapiens
aauauuguugaca

SEQ ID NO: 1695066 - RNA, 14 nt, Homo sapiens
aauauuguugacaa

SEQ ID NO: 1695067 - RNA, 22 nt, Homo sapiens
aauauuguugacaacugugacu

SEQ ID NO: 1695068 - RNA, 18 nt, Homo sapiens
aauauuuaaacagcagug

SEQ ID NO: 1695069 - RNA, 20 nt, Homo sapiens
aauauuuauaaaugagcaaa

SEQ ID NO: 1695070 - RNA, 19 nt, Homo sapiens
aauauuuuguaaugcugca

SEQ ID NO: 1695071 - RNA, 14 nt, Homo sapiens
aaucaaacauauuc

SEQ ID NO: 1695072 - RNA, 14 nt, Homo sapiens
aaucaaagccaggg

SEQ ID NO: 1695073 - RNA, 15 nt, Homo sapiens
aaucaaagcugagga

SEQ ID NO: 1695074 - RNA, 17 nt, Homo sapiens
aaucaacagaagcauuu

SEQ ID NO: 1695075 - RNA, 14 nt, Homo sapiens
aaucaaugaauauu

SEQ ID NO: 1695076 - RNA, 17 nt, Homo sapiens
aaucaauguucacgcaa

SEQ ID NO: 1695077 - RNA, 13 nt, Homo sapiens
aaucagagacaaa

SEQ ID NO: 1695078 - RNA, 18 nt, Homo sapiens
aaucagcaaccugacuca

SEQ ID NO: 1695079 - RNA, 16 nt, Homo sapiens
aaucagccacauucua

SEQ ID NO: 1695080 - RNA, 13 nt, Homo sapiens
aaucagcugcuca

SEQ ID NO: 1695081 - RNA, 23 nt, Homo sapiens
aaucagugugucuaaauuugaau

SEQ ID NO: 1695082 - RNA, 23 nt, Homo sapiens
aaucaucuauaaagaagaacuug

SEQ ID NO: 1695083 - RNA, 21 nt, Homo sapiens
aaucaugaaauaugcaucuca

SEQ ID NO: 1695084 - RNA, 15 nt, Homo sapiens
aaucaugaaucuuug

SEQ ID NO: 1695085 - RNA, 19 nt, Homo sapiens
aaucauuucuagauuauaa

SEQ ID NO: 1695086 - RNA, 13 nt, Homo sapiens
aauccaagcuccc

SEQ ID NO: 1695087 - RNA, 16 nt, Homo sapiens
aauccagacccggcug

SEQ ID NO: 1695088 - RNA, 17 nt, Homo sapiens
aauccagacucuuucga

SEQ ID NO: 1695089 - RNA, 19 nt, Homo sapiens
aauccagcuacgaauauag

SEQ ID NO: 1695090 - RNA, 14 nt, Homo sapiens
aauccgaaguauga

SEQ ID NO: 1695091 - RNA, 15 nt, Homo sapiens
aauccgcauugaugg

SEQ ID NO: 1695092 - RNA, 15 nt, Homo sapiens
aauccugcaaugaaa

SEQ ID NO: 1695093 - RNA, 13 nt, Homo sapiens
aauccugccauuu

SEQ ID NO: 1695094 - RNA, 14 nt, Homo sapiens
aauccuugacugga

SEQ ID NO: 1695095 - RNA, 19 nt, Homo sapiens
aauccuuuuccuguucaua

SEQ ID NO: 1695096 - RNA, 15 nt, Homo sapiens
aaucuaaaucuucag

SEQ ID NO: 1695097 - RNA, 18 nt, Homo sapiens
aaucuauuccugccacca

SEQ ID NO: 1695098 - RNA, 16 nt, Homo sapiens
acacuaucauggacua

SEQ ID NO: 1695099 - RNA, 12 nt, Homo sapiens
acacuccagugc

SEQ ID NO: 1695100 - RNA, 20 nt, Homo sapiens
acacucucuggaagcccugg

SEQ ID NO: 1695101 - RNA, 19 nt, Homo sapiens
acacucugccagcaaagag

SEQ ID NO: 1695102 - RNA, 12 nt, Homo sapiens
acacucuucccu

SEQ ID NO: 1695103 - RNA, 14 nt, Homo sapiens
acacugacuugaga

SEQ ID NO: 1695104 - RNA, 16 nt, Homo sapiens
acacuggagccaucuc

SEQ ID NO: 1695105 - RNA, 15 nt, Homo sapiens
acacuggguucugcu

SEQ ID NO: 1695106 - RNA, 18 nt, Homo sapiens
acacuguuacuuucguac

SEQ ID NO: 1695107 - RNA, 17 nt, Homo sapiens
acacuucugacuucacu

SEQ ID NO: 1695108 - RNA, 19 nt, Homo sapiens
acacuucugugagaccccc

SEQ ID NO: 1695109 - RNA, 16 nt, Homo sapiens
acacuuggaugcaggg

SEQ ID NO: 1695110 - RNA, 18 nt, Homo sapiens
acacuuguuguccaguug

SEQ ID NO: 1695111 - RNA, 15 nt, Homo sapiens
acagaaacgcaucca

SEQ ID NO: 1695112 - RNA, 19 nt, Homo sapiens
acagaaagcagauaccuca

SEQ ID NO: 1695113 - RNA, 18 nt, Homo sapiens
acagaaauauauauacau

SEQ ID NO: 1695114 - RNA, 22 nt, Homo sapiens
acagaacuuuuccucuguauca

SEQ ID NO: 1695115 - RNA, 19 nt, Homo sapiens
acagaauguaucugugaag

SEQ ID NO: 1695116 - RNA, 17 nt, Homo sapiens
acagaauuugucagaaa

SEQ ID NO: 1695117 - RNA, 21 nt, Homo sapiens
acagacagccacccugagaac

SEQ ID NO: 1695118 - RNA, 18 nt, Homo sapiens
acagaccggagaggacag

SEQ ID NO: 1695119 - RNA, 23 nt, Homo sapiens
acagacuggcuccaacacugcaa

SEQ ID NO: 1695120 - RNA, 23 nt, Homo sapiens
acagagaagcggauuuccaggga

SEQ ID NO: 1695121 - RNA, 20 nt, Homo sapiens
acagagcaagacuccaucuc

SEQ ID NO: 1695122 - RNA, 22 nt, Homo sapiens
acagagcacuagguucaauucc

SEQ ID NO: 1695123 - RNA, 20 nt, Homo sapiens
acagagugagacucugucuc

SEQ ID NO: 1695124 - RNA, 12 nt, Homo sapiens
acagauaaaaca

SEQ ID NO: 1695125 - RNA, 13 nt, Homo sapiens
acagaugccccag

SEQ ID NO: 1695126 - RNA, 17 nt, Homo sapiens
acagaugugggcuuuga

SEQ ID NO: 1695127 - RNA, 23 nt, Homo sapiens
acagcagcuucaccagagcauuu

SEQ ID NO: 1695128 - RNA, 23 nt, Homo sapiens
acagccucccacccccaucucuc

SEQ ID NO: 1695129 - RNA, 18 nt, Homo sapiens
acagcgagggcagcugcu

SEQ ID NO: 1695130 - RNA, 16 nt, Homo sapiens
acagcuacagcuuucu

SEQ ID NO: 1695131 - RNA, 18 nt, Homo sapiens
acagcucuucuccaggcu

SEQ ID NO: 1695132 - RNA, 21 nt, Homo sapiens
acagcugccaucgaccuggag

SEQ ID NO: 1695133 - RNA, 13 nt, Homo sapiens
acaggaaaccacu

SEQ ID NO: 1695134 - RNA, 20 nt, Homo sapiens
acaggaauggaacacacuug

SEQ ID NO: 1695135 - RNA, 20 nt, Homo sapiens
acaggaggcaagcaagcucu

SEQ ID NO: 1695136 - RNA, 13 nt, Homo sapiens
acaggagugggaa

SEQ ID NO: 1695137 - RNA, 23 nt, Homo sapiens
acaggcaaugcuggcuguuggcu

SEQ ID NO: 1695138 - RNA, 13 nt, Homo sapiens
acaggcacccacc

SEQ ID NO: 1695139 - RNA, 18 nt, Homo sapiens
acaggccauacuuuacaa

SEQ ID NO: 1695140 - RNA, 21 nt, Homo sapiens
acaggcccccuugaguggggu

SEQ ID NO: 1695141 - RNA, 22 nt, Homo sapiens
acaggcccuuccucuccacugc

SEQ ID NO: 1695142 - RNA, 19 nt, Homo sapiens
acaggcuguucugcacuga

SEQ ID NO: 1695143 - RNA, 22 nt, Homo sapiens
acagggagaagggauaacccua

SEQ ID NO: 1695144 - RNA, 15 nt, Homo sapiens
acagggcauggccag

SEQ ID NO: 1695145 - RNA, 14 nt, Homo sapiens
acagggcauucaaa

SEQ ID NO: 1695146 - RNA, 17 nt, Homo sapiens
acagggucauguuugca

SEQ ID NO: 1695147 - RNA, 18 nt, Homo sapiens
acagggucauguuugcag

SEQ ID NO: 1695148 - RNA, 19 nt, Homo sapiens
acaggucccaccuccagcc

SEQ ID NO: 1695149 - RNA, 16 nt, Homo sapiens
acaggugucugagaug

SEQ ID NO: 1695150 - RNA, 13 nt, Homo sapiens
acaggugugaacc

SEQ ID NO: 1695151 - RNA, 19 nt, Homo sapiens
acaguaacuuuauguguaa

SEQ ID NO: 1695152 - RNA, 14 nt, Homo sapiens
acaguagcauuaug

SEQ ID NO: 1695153 - RNA, 18 nt, Homo sapiens
acaguaggauaagccacu

SEQ ID NO: 1695154 - RNA, 23 nt, Homo sapiens
acaguauuucauugccuguguau

SEQ ID NO: 1695155 - RNA, 13 nt, Homo sapiens
acaguauuuccac

SEQ ID NO: 1695156 - RNA, 22 nt, Homo sapiens
acagucacugauguacaauuaa

SEQ ID NO: 1695157 - RNA, 22 nt, Homo sapiens
acaguccaggaacaagcuaauu

SEQ ID NO: 1695158 - RNA, 12 nt, Homo sapiens
acagugaugccg

SEQ ID NO: 1695159 - RNA, 18 nt, Homo sapiens
acagugggaacucugaca

SEQ ID NO: 1695160 - RNA, 17 nt, Homo sapiens
aauguuaugacuaugua

SEQ ID NO: 1695161 - RNA, 18 nt, Homo sapiens
aauguuaugacuauguaa

SEQ ID NO: 1695162 - RNA, 19 nt, Homo sapiens
aauguucaucaauucccau

SEQ ID NO: 1695163 - RNA, 21 nt, Homo sapiens
aauguuggacaccuuuagguu

SEQ ID NO: 1695164 - RNA, 14 nt, Homo sapiens
aauguugggagaaa

SEQ ID NO: 1695165 - RNA, 20 nt, Homo sapiens
aauguuuaaagaucaugaca

SEQ ID NO: 1695166 - RNA, 23 nt, Homo sapiens
aauguuuccaaccuggaguauaa

SEQ ID NO: 1695167 - RNA, 14 nt, Homo sapiens
aauguuugcauaaa

SEQ ID NO: 1695168 - RNA, 22 nt, Homo sapiens
aauguuuucuagucacuuccuc

SEQ ID NO: 1695169 - RNA, 22 nt, Homo sapiens
aauuaaaaauaccaacuguaca

SEQ ID NO: 1695170 - RNA, 16 nt, Homo sapiens
aauuaaaacuucuuaa

SEQ ID NO: 1695171 - RNA, 19 nt, Homo sapiens
aauuaagacuugugcauga

SEQ ID NO: 1695172 - RNA, 13 nt, Homo sapiens
aauuaaucacaaa

SEQ ID NO: 1695173 - RNA, 13 nt, Homo sapiens
aauuaugaccaug

SEQ ID NO: 1695174 - RNA, 18 nt, Homo sapiens
aauuauugcuguauguaa

SEQ ID NO: 1695175 - RNA, 17 nt, Homo sapiens
aauucagacaagcugca

SEQ ID NO: 1695176 - RNA, 13 nt, Homo sapiens
aauuccgcauuua

SEQ ID NO: 1695177 - RNA, 12 nt, Homo sapiens
aauuccuaguca

SEQ ID NO: 1695178 - RNA, 22 nt, Homo sapiens
aauuccuauauccugugacugu

SEQ ID NO: 1695179 - RNA, 17 nt, Homo sapiens
aauucuaaagagcacuu

SEQ ID NO: 1695180 - RNA, 19 nt, Homo sapiens
aauucuaaagagcacuuac

SEQ ID NO: 1695181 - RNA, 13 nt, Homo sapiens
aauucuaugcaau

SEQ ID NO: 1695182 - RNA, 20 nt, Homo sapiens
aauucucauuugucacacac

SEQ ID NO: 1695183 - RNA, 21 nt, Homo sapiens
aauucuuacacugccuguaua

SEQ ID NO: 1695184 - RNA, 23 nt, Homo sapiens
aauugauguugcuggacugucau

SEQ ID NO: 1695185 - RNA, 16 nt, Homo sapiens
aauugauuugcauuga

SEQ ID NO: 1695186 - RNA, 16 nt, Homo sapiens
aauugcaaaucuugaa

SEQ ID NO: 1695187 - RNA, 18 nt, Homo sapiens
aauugcagcuguacugag

SEQ ID NO: 1695188 - RNA, 19 nt, Homo sapiens
aauugcauacuacucucaa

SEQ ID NO: 1695189 - RNA, 13 nt, Homo sapiens
aauugcaugacuu

SEQ ID NO: 1695190 - RNA, 13 nt, Homo sapiens
aauuguccguguu

SEQ ID NO: 1695191 - RNA, 19 nt, Homo sapiens
aauugucgaaaagagucuu

SEQ ID NO: 1695192 - RNA, 14 nt, Homo sapiens
aauuuaaugcugcc

SEQ ID NO: 1695193 - RNA, 21 nt, Homo sapiens
aauuuauaccucaaacuaucu

SEQ ID NO: 1695194 - RNA, 21 nt, Homo sapiens
aauuucaguccuguaguuuua

SEQ ID NO: 1695195 - RNA, 22 nt, Homo sapiens
aauuuccacaagcauugcuuca

SEQ ID NO: 1695196 - RNA, 23 nt, Homo sapiens
aauuuccaggguugcuugaucau

SEQ ID NO: 1695197 - RNA, 21 nt, Homo sapiens
aauuucuagccugcacuuuga

SEQ ID NO: 1695198 - RNA, 22 nt, Homo sapiens
aauuugaaaacauaaucugcaa

SEQ ID NO: 1695199 - RNA, 18 nt, Homo sapiens
aauuugagauucuacagu

SEQ ID NO: 1695200 - RNA, 13 nt, Homo sapiens
aauuugauacuua

SEQ ID NO: 1695201 - RNA, 20 nt, Homo sapiens
aauuuuacuccauaaacaga

SEQ ID NO: 1695202 - RNA, 15 nt, Homo sapiens
aauuuuaguauucau

SEQ ID NO: 1695203 - RNA, 23 nt, Homo sapiens
acaaaaaaauauauuuaaugaua

SEQ ID NO: 1695204 - RNA, 15 nt, Homo sapiens
acaaaagcaguuucu

SEQ ID NO: 1695205 - RNA, 16 nt, Homo sapiens
acaaaauggacauggu

SEQ ID NO: 1695206 - RNA, 21 nt, Homo sapiens
acaaaauuuuauuuugugcuc

SEQ ID NO: 1695207 - RNA, 18 nt, Homo sapiens
acaaaccacaacugacac

SEQ ID NO: 1695208 - RNA, 14 nt, Homo sapiens
acaaacccaagggc

SEQ ID NO: 1695209 - RNA, 19 nt, Homo sapiens
acaaaggacagaguaugaa

SEQ ID NO: 1695210 - RNA, 14 nt, Homo sapiens
acaaaguauuugcu

SEQ ID NO: 1695211 - RNA, 17 nt, Homo sapiens
acaaaguguauacaugu

SEQ ID NO: 1695212 - RNA, 22 nt, Homo sapiens
acaaauauggggaaaaaacugu

SEQ ID NO: 1695213 - RNA, 19 nt, Homo sapiens
acaaaucaacagaagcauu

SEQ ID NO: 1695214 - RNA, 17 nt, Homo sapiens
acaaauuaauuuuacuc

SEQ ID NO: 1695215 - RNA, 15 nt, Homo sapiens
acaaauuucacuuau

SEQ ID NO: 1695216 - RNA, 23 nt, Homo sapiens
acaacaaaggcaaguuaagagaa

SEQ ID NO: 1695217 - RNA, 17 nt, Homo sapiens
acaacaaccuggucaca

SEQ ID NO: 1695218 - RNA, 15 nt, Homo sapiens
acaacacaauaacac

SEQ ID NO: 1695219 - RNA, 14 nt, Homo sapiens
acaacagaagucau

SEQ ID NO: 1695220 - RNA, 18 nt, Homo sapiens
acaacauccauguccuau

SEQ ID NO: 1695221 - RNA, 12 nt, Homo sapiens
augaaccuggac

SEQ ID NO: 1695222 - RNA, 15 nt, Homo sapiens
augaacuauuguuaa

SEQ ID NO: 1695223 - RNA, 20 nt, Homo sapiens
augaagcaagccccacuuau

SEQ ID NO: 1695224 - RNA, 20 nt, Homo sapiens
augaagcgaaacacagagaa

SEQ ID NO: 1695225 - RNA, 23 nt, Homo sapiens
augaagcugcucugaaaucuccu

SEQ ID NO: 1695226 - RNA, 13 nt, Homo sapiens
augaauacaaauu

SEQ ID NO: 1695227 - RNA, 21 nt, Homo sapiens
augaaucccacccacauguga

SEQ ID NO: 1695228 - RNA, 18 nt, Homo sapiens
augaaucucccacuccag

SEQ ID NO: 1695229 - RNA, 19 nt, Homo sapiens
augaaugaggucccaggca

SEQ ID NO: 1695230 - RNA, 19 nt, Homo sapiens
augacaaccuccauucuau

SEQ ID NO: 1695231 - RNA, 16 nt, Homo sapiens
augacaguagcauuau

SEQ ID NO: 1695232 - RNA, 13 nt, Homo sapiens
augacaugcacug

SEQ ID NO: 1695233 - RNA, 15 nt, Homo sapiens
augacauugaacuga

SEQ ID NO: 1695234 - RNA, 15 nt, Homo sapiens
augacugugcuacug

SEQ ID NO: 1695235 - RNA, 17 nt, Homo sapiens
augagaacaaacagauc

SEQ ID NO: 1695236 - RNA, 23 nt, Homo sapiens
augagaguuucuguuaaucaugu

SEQ ID NO: 1695237 - RNA, 18 nt, Homo sapiens
augagcugacaucucagu

SEQ ID NO: 1695238 - RNA, 13 nt, Homo sapiens
augagcuuccuuc

SEQ ID NO: 1695239 - RNA, 18 nt, Homo sapiens
augaggacagaccacaga

SEQ ID NO: 1695240 - RNA, 23 nt, Homo sapiens
augaggaccaagggcaccuggag

SEQ ID NO: 1695241 - RNA, 13 nt, Homo sapiens
augagggaaaaug

SEQ ID NO: 1695242 - RNA, 23 nt, Homo sapiens
augaggucuguuuaaaguggcaa

SEQ ID NO: 1695243 - RNA, 24 nt, Homo sapiens
augaggucuguuuaaaguggcaau

SEQ ID NO: 1695244 - RNA, 20 nt, Homo sapiens
augaggugguggaguggagu

SEQ ID NO: 1695245 - RNA, 16 nt, Homo sapiens
augaguaguguggaau

SEQ ID NO: 1695246 - RNA, 14 nt, Homo sapiens
augauaaaguaaug

SEQ ID NO: 1695247 - RNA, 19 nt, Homo sapiens
augaucagcaucugugaug

SEQ ID NO: 1695248 - RNA, 18 nt, Homo sapiens
augauccccaagugugaa

SEQ ID NO: 1695249 - RNA, 18 nt, Homo sapiens
augaugagccuucgugcc

SEQ ID NO: 1695250 - RNA, 13 nt, Homo sapiens
augaugcacuuau

SEQ ID NO: 1695251 - RNA, 18 nt, Homo sapiens
augauuacuauaugcaaa

SEQ ID NO: 1695252 - RNA, 23 nt, Homo sapiens
augauuuguaguggaaacauuua

SEQ ID NO: 1695253 - RNA, 21 nt, Homo sapiens
augcacacacacacaucucau

SEQ ID NO: 1695254 - RNA, 14 nt, Homo sapiens
augcacauauggac

SEQ ID NO: 1695255 - RNA, 19 nt, Homo sapiens
augcacauccauucccaag

SEQ ID NO: 1695256 - RNA, 17 nt, Homo sapiens
augcacauuucuggauu

SEQ ID NO: 1695257 - RNA, 13 nt, Homo sapiens
augcagacuuccu

SEQ ID NO: 1695258 - RNA, 21 nt, Homo sapiens
augcagcucacuacccuauuc

SEQ ID NO: 1695259 - RNA, 17 nt, Homo sapiens
augccaagaaaguauuu

SEQ ID NO: 1695260 - RNA, 20 nt, Homo sapiens
augccaauaaaguuugccca

SEQ ID NO: 1695261 - RNA, 23 nt, Homo sapiens
augccaauacuagucaccccaag

SEQ ID NO: 1695262 - RNA, 14 nt, Homo sapiens
augccagcuacuuc

SEQ ID NO: 1695263 - RNA, 19 nt, Homo sapiens
augccagggacugacaaaa

SEQ ID NO: 1695264 - RNA, 16 nt, Homo sapiens
augccauaugccuugg

SEQ ID NO: 1695265 - RNA, 16 nt, Homo sapiens
augccaucuguguccu

SEQ ID NO: 1695266 - RNA, 22 nt, Homo sapiens
augccuaauaaacaauucaagu

SEQ ID NO: 1695267 - RNA, 21 nt, Homo sapiens
augccugagagacauggcuuu

SEQ ID NO: 1695268 - RNA, 21 nt, Homo sapiens
augccugccccccucaucuca

SEQ ID NO: 1695269 - RNA, 22 nt, Homo sapiens
augccuuagaaauguaaacugc

SEQ ID NO: 1695270 - RNA, 17 nt, Homo sapiens
augccuucacuuuacaa

SEQ ID NO: 1695271 - RNA, 15 nt, Homo sapiens
augcguucacuccaa

SEQ ID NO: 1695272 - RNA, 12 nt, Homo sapiens
augcuccaagau

SEQ ID NO: 1695273 - RNA, 13 nt, Homo sapiens
augcugacuguac

SEQ ID NO: 1695274 - RNA, 18 nt, Homo sapiens
augcugcaggacuugaga

SEQ ID NO: 1695275 - RNA, 21 nt, Homo sapiens
augcugcuuuaggaauucugc

SEQ ID NO: 1695276 - RNA, 19 nt, Homo sapiens
augcuguggcuccuuccua

SEQ ID NO: 1695277 - RNA, 21 nt, Homo sapiens
augcuguuaguaccuacauca

SEQ ID NO: 1695278 - RNA, 14 nt, Homo sapiens
augcuucaugugcu

SEQ ID NO: 1695279 - RNA, 12 nt, Homo sapiens
augcuucuagcc

SEQ ID NO: 1695280 - RNA, 14 nt, Homo sapiens
augcuugauuccag

SEQ ID NO: 1695281 - RNA, 15 nt, Homo sapiens
augcuugauuccagu

SEQ ID NO: 1695282 - RNA, 14 nt, Homo sapiens
auggaaggugcuac

SEQ ID NO: 1695283 - RNA, 22 nt, Homo sapiens
auggaagguucucugugcuccu

SEQ ID NO: 1695284 - RNA, 23 nt, Homo sapiens
auggaccacuguuucuugcuugu

SEQ ID NO: 1695285 - RNA, 13 nt, Homo sapiens
auuccaaagucuc

SEQ ID NO: 1695286 - RNA, 15 nt, Homo sapiens
auuccaaagucucua

SEQ ID NO: 1695287 - RNA, 17 nt, Homo sapiens
auuccaaaugucuuuua

SEQ ID NO: 1695288 - RNA, 13 nt, Homo sapiens
auuccagaagaag

SEQ ID NO: 1695289 - RNA, 17 nt, Homo sapiens
auuccagaaugcuguac

SEQ ID NO: 1695290 - RNA, 21 nt, Homo sapiens
auuccagugguucugcuucaa

SEQ ID NO: 1695291 - RNA, 23 nt, Homo sapiens
auucccaagccaaaaaccuuagc

SEQ ID NO: 1695292 - RNA, 19 nt, Homo sapiens
auuccuauauccugugacu

SEQ ID NO: 1695293 - RNA, 19 nt, Homo sapiens
auuccuauuggaaacagag

SEQ ID NO: 1695294 - RNA, 14 nt, Homo sapiens
auuccuuagucuca

SEQ ID NO: 1695295 - RNA, 21 nt, Homo sapiens
auuccuuccacuaacucauag

SEQ ID NO: 1695296 - RNA, 16 nt, Homo sapiens
auucuaaugucuucau

SEQ ID NO: 1695297 - RNA, 20 nt, Homo sapiens
auucuaaugucuucauuuca

SEQ ID NO: 1695298 - RNA, 17 nt, Homo sapiens
auucuacuauacuguac

SEQ ID NO: 1695299 - RNA, 15 nt, Homo sapiens
auucuaucaagccca

SEQ ID NO: 1695300 - RNA, 13 nt, Homo sapiens
auucuauugccuu

SEQ ID NO: 1695301 - RNA, 17 nt, Homo sapiens
auucucauuugucacac

SEQ ID NO: 1695302 - RNA, 13 nt, Homo sapiens
auucucugaguca

SEQ ID NO: 1695303 - RNA, 17 nt, Homo sapiens
auucucuuuuaucuguu

SEQ ID NO: 1695304 - RNA, 17 nt, Homo sapiens
auucugagcauacucaa

SEQ ID NO: 1695305 - RNA, 23 nt, Homo sapiens
auucugcaguaaaucuuuuacaa

SEQ ID NO: 1695306 - RNA, 18 nt, Homo sapiens
auucuguuggccagugug

SEQ ID NO: 1695307 - RNA, 19 nt, Homo sapiens
auucuuaagggaacuucca

SEQ ID NO: 1695308 - RNA, 20 nt, Homo sapiens
auucuucaaccucauugaca

SEQ ID NO: 1695309 - RNA, 21 nt, Homo sapiens
auucuucagauacaaacugca

SEQ ID NO: 1695310 - RNA, 17 nt, Homo sapiens
auucuuuggaguuguca

SEQ ID NO: 1695311 - RNA, 17 nt, Homo sapiens
auugaaagaaccagaga

SEQ ID NO: 1695312 - RNA, 17 nt, Homo sapiens
auugaaagcuuuuguua

SEQ ID NO: 1695313 - RNA, 17 nt, Homo sapiens
auugaaaucaagcuuau

SEQ ID NO: 1695314 - RNA, 18 nt, Homo sapiens
auugaaauguuugcauaa

SEQ ID NO: 1695315 - RNA, 12 nt, Homo sapiens
auugaaugaaac

SEQ ID NO: 1695316 - RNA, 12 nt, Homo sapiens
auugacauuugu

SEQ ID NO: 1695317 - RNA, 17 nt, Homo sapiens
auugacugucacuguuc

SEQ ID NO: 1695318 - RNA, 22 nt, Homo sapiens
auugacuuucaguaaacauaaa

SEQ ID NO: 1695319 - RNA, 20 nt, Homo sapiens
auugagaaaaauauauacua

SEQ ID NO: 1695320 - RNA, 18 nt, Homo sapiens
auugagcagaagaucaag

SEQ ID NO: 1695321 - RNA, 19 nt, Homo sapiens
auugaucaaauauuucaac

SEQ ID NO: 1695322 - RNA, 16 nt, Homo sapiens
auugauuaaugaacua

SEQ ID NO: 1695323 - RNA, 19 nt, Homo sapiens
auugauuauaagcauguau

SEQ ID NO: 1695324 - RNA, 17 nt, Homo sapiens
auugauuuuuacuucaa

SEQ ID NO: 1695325 - RNA, 15 nt, Homo sapiens
auugcaaagguucca

SEQ ID NO: 1695326 - RNA, 21 nt, Homo sapiens
auugcagguggaacucaguca

SEQ ID NO: 1695327 - RNA, 15 nt, Homo sapiens
auugcauuuauaugu

SEQ ID NO: 1695328 - RNA, 21 nt, Homo sapiens
auugcuucaauaauauuagcu

SEQ ID NO: 1695329 - RNA, 14 nt, Homo sapiens
auuggcacugugga

SEQ ID NO: 1695330 - RNA, 18 nt, Homo sapiens
auuggcacuguggagcuc

SEQ ID NO: 1695331 - RNA, 20 nt, Homo sapiens
acauugcuugugccacaccc

SEQ ID NO: 1695332 - RNA, 21 nt, Homo sapiens
acauuggagaugccauccucu

SEQ ID NO: 1695333 - RNA, 16 nt, Homo sapiens
acauuuaaaauucaau

SEQ ID NO: 1695334 - RNA, 19 nt, Homo sapiens
acauuuaaagcauugcugu

SEQ ID NO: 1695335 - RNA, 18 nt, Homo sapiens
acauuuauucugcucaca

SEQ ID NO: 1695336 - RNA, 18 nt, Homo sapiens
acauuucucauaccuucc

SEQ ID NO: 1695337 - RNA, 13 nt, Homo sapiens
acauuucuguaaa

SEQ ID NO: 1695338 - RNA, 14 nt, Homo sapiens
acauuuuacauuaa

SEQ ID NO: 1695339 - RNA, 14 nt, Homo sapiens
acauuuucuuucau

SEQ ID NO: 1695340 - RNA, 15 nt, Homo sapiens
acauuuuuugggcag

SEQ ID NO: 1695341 - RNA, 13 nt, Homo sapiens
accaaaaccacag

SEQ ID NO: 1695342 - RNA, 14 nt, Homo sapiens
accaacacagacac

SEQ ID NO: 1695343 - RNA, 19 nt, Homo sapiens
accaagcauuuagugcaca

SEQ ID NO: 1695344 - RNA, 16 nt, Homo sapiens
accaagggcaccugga

SEQ ID NO: 1695345 - RNA, 16 nt, Homo sapiens
accaauccaacaucca

SEQ ID NO: 1695346 - RNA, 21 nt, Homo sapiens
accaaugccaagauaauucac

SEQ ID NO: 1695347 - RNA, 16 nt, Homo sapiens
accaauugugcugcca

SEQ ID NO: 1695348 - RNA, 20 nt, Homo sapiens
accacaaaaaagaaacuugc

SEQ ID NO: 1695349 - RNA, 20 nt, Homo sapiens
accacaaaaauugacucaaa

SEQ ID NO: 1695350 - RNA, 21 nt, Homo sapiens
accacaacugacacaggaaac

SEQ ID NO: 1695351 - RNA, 18 nt, Homo sapiens
accacaugugcacaugca

SEQ ID NO: 1695352 - RNA, 23 nt, Homo sapiens
accacuacaugcagcccaugccc

SEQ ID NO: 1695353 - RNA, 15 nt, Homo sapiens
accacuccacuggcc

SEQ ID NO: 1695354 - RNA, 19 nt, Homo sapiens
accacugggcaaacagaag

SEQ ID NO: 1695355 - RNA, 12 nt, Homo sapiens
accacuuccagg

SEQ ID NO: 1695356 - RNA, 17 nt, Homo sapiens
accacuucgaaaccugg

SEQ ID NO: 1695357 - RNA, 13 nt, Homo sapiens
accagacaaggaa

SEQ ID NO: 1695358 - RNA, 20 nt, Homo sapiens
accagagaggcucugagaaa

SEQ ID NO: 1695359 - RNA, 15 nt, Homo sapiens
accagagcauuucca

SEQ ID NO: 1695360 - RNA, 15 nt, Homo sapiens
accagaggagccuuu

SEQ ID NO: 1695361 - RNA, 18 nt, Homo sapiens
accagccauacuuaucuc

SEQ ID NO: 1695362 - RNA, 13 nt, Homo sapiens
accagcuacccug

SEQ ID NO: 1695363 - RNA, 16 nt, Homo sapiens
accagcuugcgaauaa

SEQ ID NO: 1695364 - RNA, 22 nt, Homo sapiens
accagggccgaggaggugccug

SEQ ID NO: 1695365 - RNA, 13 nt, Homo sapiens
accaguaccugaa

SEQ ID NO: 1695366 - RNA, 22 nt, Homo sapiens
accaguguccccuccacuguca

SEQ ID NO: 1695367 - RNA, 20 nt, Homo sapiens
accaguugaauaaaagugca

SEQ ID NO: 1695368 - RNA, 15 nt, Homo sapiens
accauauaccaucuc

SEQ ID NO: 1695369 - RNA, 23 nt, Homo sapiens
accauauugugcuucacaguaga

SEQ ID NO: 1695370 - RNA, 17 nt, Homo sapiens
accaucagggacaggau

SEQ ID NO: 1695371 - RNA, 16 nt, Homo sapiens
accaugaagacaggau

SEQ ID NO: 1695372 - RNA, 19 nt, Homo sapiens
accauucagaucacugaau

SEQ ID NO: 1695373 - RNA, 20 nt, Homo sapiens
accauugcugucaaguuccu

SEQ ID NO: 1695374 - RNA, 21 nt, Homo sapiens
accauuuugggguacccacug

SEQ ID NO: 1695375 - RNA, 15 nt, Homo sapiens
acccaaacccuaggu

SEQ ID NO: 1695376 - RNA, 16 nt, Homo sapiens
acccaagggcaggggc

SEQ ID NO: 1695377 - RNA, 12 nt, Homo sapiens
acccaccucagc

SEQ ID NO: 1695378 - RNA, 14 nt, Homo sapiens
acccacuuugucca

SEQ ID NO: 1695379 - RNA, 19 nt, Homo sapiens
acccagaaaucauuuuacc

SEQ ID NO: 1695380 - RNA, 24 nt, Homo sapiens
acccagagaguccugugcugaaug

SEQ ID NO: 1695381 - RNA, 21 nt, Homo sapiens
acccauccgguuugccauguu

SEQ ID NO: 1695382 - RNA, 13 nt, Homo sapiens
acccaugacuuua

SEQ ID NO: 1695383 - RNA, 15 nt, Homo sapiens
acccaugaggcaaug

SEQ ID NO: 1695384 - RNA, 16 nt, Homo sapiens
acccauuaaauuaaga

SEQ ID NO: 1695385 - RNA, 20 nt, Homo sapiens
accccaggcucaacugagga

SEQ ID NO: 1695386 - RNA, 15 nt, Homo sapiens
accccaucucuacua

SEQ ID NO: 1695387 - RNA, 20 nt, Homo sapiens
acccccagguggaaggcaga

SEQ ID NO: 1695388 - RNA, 18 nt, Homo sapiens
acccccgcaaguuugcac

SEQ ID NO: 1695389 - RNA, 18 nt, Homo sapiens
accccgcuguaagcuccu

SEQ ID NO: 1695390 - RNA, 18 nt, Homo sapiens
accccucccucuguccac

SEQ ID NO: 1695391 - RNA, 17 nt, Homo sapiens
accccugccuacuuccu

SEQ ID NO: 1695392 - RNA, 14 nt, Homo sapiens
accccuuagccucc

SEQ ID NO: 1695393 - RNA, 15 nt, Homo sapiens
accccuuagccuccc

SEQ ID NO: 1695394 - RNA, 21 nt, Homo sapiens
accccuuccagaucacugcca

SEQ ID NO: 1695395 - RNA, 13 nt, Homo sapiens
accccuuugcacu

SEQ ID NO: 1695396 - RNA, 17 nt, Homo sapiens
acccuaguuucccugaa

SEQ ID NO: 1695397 - RNA, 20 nt, Homo sapiens
acccuauacuguaguauucu

SEQ ID NO: 1695398 - RNA, 16 nt, Homo sapiens
acccuaucuccugaca

SEQ ID NO: 1695399 - RNA, 15 nt, Homo sapiens
acccucacucugcca

SEQ ID NO: 1695400 - RNA, 16 nt, Homo sapiens
acccucacucugccag

SEQ ID NO: 1695401 - RNA, 21 nt, Homo sapiens
acccucccuggaguguggcug

SEQ ID NO: 1695402 - RNA, 13 nt, Homo sapiens
acccucuccagca

SEQ ID NO: 1695403 - RNA, 16 nt, Homo sapiens
acccugaguucaucca

SEQ ID NO: 1695404 - RNA, 15 nt, Homo sapiens
acccugcgauuuugc

SEQ ID NO: 1695405 - RNA, 18 nt, Homo sapiens
acccugcuacacauacag

SEQ ID NO: 1695406 - RNA, 19 nt, Homo sapiens
acccugucuaaaaaacaua

SEQ ID NO: 1695407 - RNA, 21 nt, Homo sapiens
acccuucccaaucagcacuga

SEQ ID NO: 1695408 - RNA, 17 nt, Homo sapiens
acccuuggacaagacaa

SEQ ID NO: 1695409 - RNA, 14 nt, Homo sapiens
accgguccagcugg

SEQ ID NO: 1695410 - RNA, 19 nt, Homo sapiens
accggugcaugaugcugcc

SEQ ID NO: 1695411 - RNA, 21 nt, Homo sapiens
accguuuugaagcuacugugu

SEQ ID NO: 1695412 - RNA, 17 nt, Homo sapiens
accuaagucucugugaa

SEQ ID NO: 1695413 - RNA, 19 nt, Homo sapiens
accuacuuuucuuuccuca

SEQ ID NO: 1695414 - RNA, 12 nt, Homo sapiens
accucacaguga

SEQ ID NO: 1695415 - RNA, 22 nt, Homo sapiens
accucaccagaauugugcaaau

SEQ ID NO: 1695416 - RNA, 21 nt, Homo sapiens
accucaccccguuacagcucc

SEQ ID NO: 1695417 - RNA, 18 nt, Homo sapiens
accucaggcacuagccuu

SEQ ID NO: 1695418 - RNA, 13 nt, Homo sapiens
accucagggacaa

SEQ ID NO: 1695419 - RNA, 21 nt, Homo sapiens
accucaggugauccaccugcc

SEQ ID NO: 1695420 - RNA, 17 nt, Homo sapiens
accuccagacaccagug

SEQ ID NO: 1695421 - RNA, 21 nt, Homo sapiens
accucccugacccgucuaaua

SEQ ID NO: 1695422 - RNA, 15 nt, Homo sapiens
accuccgccaaugca

SEQ ID NO: 1695423 - RNA, 18 nt, Homo sapiens
accuccgccagauccugc

SEQ ID NO: 1695424 - RNA, 20 nt, Homo sapiens
accuccgccagauccugcag

SEQ ID NO: 1695425 - RNA, 20 nt, Homo sapiens
accuccuuccccccaccaga

SEQ ID NO: 1695426 - RNA, 19 nt, Homo sapiens
accucggccucccaaagug

SEQ ID NO: 1695427 - RNA, 13 nt, Homo sapiens
accucuacuuucc

SEQ ID NO: 1695428 - RNA, 17 nt, Homo sapiens
accucuggacuggcuag

SEQ ID NO: 1695429 - RNA, 20 nt, Homo sapiens
accugaaaaaaaguuuacaa

SEQ ID NO: 1695430 - RNA, 16 nt, Homo sapiens
accugaagacugagga

SEQ ID NO: 1695431 - RNA, 21 nt, Homo sapiens
accugaaggacagcugaaccc

SEQ ID NO: 1695432 - RNA, 14 nt, Homo sapiens
accugacacaagag

SEQ ID NO: 1695433 - RNA, 13 nt, Homo sapiens
accugacucuugc

SEQ ID NO: 1695434 - RNA, 14 nt, Homo sapiens
accugacucuugca

SEQ ID NO: 1695435 - RNA, 15 nt, Homo sapiens
accugacucuugcag

SEQ ID NO: 1695436 - RNA, 21 nt, Homo sapiens
accugagggugcuuuguguaa

SEQ ID NO: 1695437 - RNA, 20 nt, Homo sapiens
accugagucugcaugugcac

SEQ ID NO: 1695438 - RNA, 21 nt, Homo sapiens
accugagucugcaugugcacg

SEQ ID NO: 1695439 - RNA, 22 nt, Homo sapiens
accugaucacuagccugucauc

SEQ ID NO: 1695440 - RNA, 13 nt, Homo sapiens
accugcacugucc

SEQ ID NO: 1695441 - RNA, 23 nt, Homo sapiens
agucacugcacagugcaucucag

SEQ ID NO: 1695442 - RNA, 19 nt, Homo sapiens
agucacugccacuuugcac

SEQ ID NO: 1695443 - RNA, 20 nt, Homo sapiens
agucacugccacuuugcaca

SEQ ID NO: 1695444 - RNA, 17 nt, Homo sapiens
agucaucaucagggccu

SEQ ID NO: 1695445 - RNA, 14 nt, Homo sapiens
agucaucuauucaa

SEQ ID NO: 1695446 - RNA, 21 nt, Homo sapiens
aguccaagaggguccuuuagu

SEQ ID NO: 1695447 - RNA, 18 nt, Homo sapiens
agucccaccuuggcugca

SEQ ID NO: 1695448 - RNA, 17 nt, Homo sapiens
aguccgcagaagcccug

SEQ ID NO: 1695449 - RNA, 14 nt, Homo sapiens
aguccucccuggug

SEQ ID NO: 1695450 - RNA, 18 nt, Homo sapiens
aguccugacacuauucau

SEQ ID NO: 1695451 - RNA, 13 nt, Homo sapiens
aguccugggagac

SEQ ID NO: 1695452 - RNA, 19 nt, Homo sapiens
aguccuugcccacuuccca

SEQ ID NO: 1695453 - RNA, 21 nt, Homo sapiens
agucuaaagauggaguuucua

SEQ ID NO: 1695454 - RNA, 18 nt, Homo sapiens
agucucaaaaauacaaaa

SEQ ID NO: 1695455 - RNA, 18 nt, Homo sapiens
agucugaaugcugccaca

SEQ ID NO: 1695456 - RNA, 22 nt, Homo sapiens
agucugcuacccucauuucuca

SEQ ID NO: 1695457 - RNA, 20 nt, Homo sapiens
agucuuccacuucaaugcac

SEQ ID NO: 1695458 - RNA, 14 nt, Homo sapiens
agucuuccaugacc

SEQ ID NO: 1695459 - RNA, 13 nt, Homo sapiens
agucuucuguaua

SEQ ID NO: 1695460 - RNA, 15 nt, Homo sapiens
agucuugcucuguca

SEQ ID NO: 1695461 - RNA, 16 nt, Homo sapiens
agugaaagccagauuc

SEQ ID NO: 1695462 - RNA, 23 nt, Homo sapiens
agugaacuauuucuacacagugg

SEQ ID NO: 1695463 - RNA, 19 nt, Homo sapiens
agugaagucaugaccucca

SEQ ID NO: 1695464 - RNA, 16 nt, Homo sapiens
agugaauaaacuucag

SEQ ID NO: 1695465 - RNA, 14 nt, Homo sapiens
agugaaucuguauu

SEQ ID NO: 1695466 - RNA, 19 nt, Homo sapiens
agugaaugaaacacucagu

SEQ ID NO: 1695467 - RNA, 20 nt, Homo sapiens
agugaauuuagucauuuuac

SEQ ID NO: 1695468 - RNA, 14 nt, Homo sapiens
agugacaaggcccu

SEQ ID NO: 1695469 - RNA, 19 nt, Homo sapiens
agugacauaauauauucua

SEQ ID NO: 1695470 - RNA, 23 nt, Homo sapiens
agugaccccugaccucacuguga

SEQ ID NO: 1695471 - RNA, 16 nt, Homo sapiens
agugaccccuucccug

SEQ ID NO: 1695472 - RNA, 21 nt, Homo sapiens
agugaccgaaagguuauguua

SEQ ID NO: 1695473 - RNA, 15 nt, Homo sapiens
agugacuaugaacuu

SEQ ID NO: 1695474 - RNA, 19 nt, Homo sapiens
agugacugccgucagcucc

SEQ ID NO: 1695475 - RNA, 13 nt, Homo sapiens
agugacuggugcc

SEQ ID NO: 1695476 - RNA, 17 nt, Homo sapiens
agugagaaaaagcuccu

SEQ ID NO: 1695477 - RNA, 22 nt, Homo sapiens
agugaggagcccauacucagcc

SEQ ID NO: 1695478 - RNA, 19 nt, Homo sapiens
agugaucugcccaccucag

SEQ ID NO: 1695479 - RNA, 20 nt, Homo sapiens
agugaucuuucccaagagaa

SEQ ID NO: 1695480 - RNA, 19 nt, Homo sapiens
agugcaaccacacaccuca

SEQ ID NO: 1695481 - RNA, 20 nt, Homo sapiens
agugcagggcaaaauauuca

SEQ ID NO: 1695482 - RNA, 19 nt, Homo sapiens
agugcaguggcgugaucuc

SEQ ID NO: 1695483 - RNA, 16 nt, Homo sapiens
agugcaguggugcaau

SEQ ID NO: 1695484 - RNA, 16 nt, Homo sapiens
agugccaacuccucac

SEQ ID NO: 1695485 - RNA, 20 nt, Homo sapiens
agugccuucugcccucccug

SEQ ID NO: 1695486 - RNA, 23 nt, Homo sapiens
agugcugcuauaucuauccauuu

SEQ ID NO: 1695487 - RNA, 14 nt, Homo sapiens
agugcuggcucaca

SEQ ID NO: 1695488 - RNA, 18 nt, Homo sapiens
agugcuguccaugcuucu

SEQ ID NO: 1695489 - RNA, 20 nt, Homo sapiens
gaacacucuuuugcuuuauu

SEQ ID NO: 1695490 - RNA, 22 nt, Homo sapiens
gaacagcacuggggagucuuug

SEQ ID NO: 1695491 - RNA, 17 nt, Homo sapiens
gaacagccgacuuugag

SEQ ID NO: 1695492 - RNA, 15 nt, Homo sapiens
gaacagcuucagguu

SEQ ID NO: 1695493 - RNA, 15 nt, Homo sapiens
gaacauuauuuaaua

SEQ ID NO: 1695494 - RNA, 15 nt, Homo sapiens
gaaccaacacagaca

SEQ ID NO: 1695495 - RNA, 16 nt, Homo sapiens
gaaccaacacagacac

SEQ ID NO: 1695496 - RNA, 19 nt, Homo sapiens
gaacccagcaguucuguua

SEQ ID NO: 1695497 - RNA, 15 nt, Homo sapiens
gaaccccucugggaa

SEQ ID NO: 1695498 - RNA, 21 nt, Homo sapiens
gaaccgagcaauuuucugcua

SEQ ID NO: 1695499 - RNA, 17 nt, Homo sapiens
gaaccgcacagcucagg

SEQ ID NO: 1695500 - RNA, 21 nt, Homo sapiens
gaaccuggaaaaauuccagaa

SEQ ID NO: 1695501 - RNA, 16 nt, Homo sapiens
gaaccuguccuaagga

SEQ ID NO: 1695502 - RNA, 15 nt, Homo sapiens
gaaccuugcuguccu

SEQ ID NO: 1695503 - RNA, 15 nt, Homo sapiens
gaacuauuucuacac

SEQ ID NO: 1695504 - RNA, 14 nt, Homo sapiens
gaacucacuggggc

SEQ ID NO: 1695505 - RNA, 19 nt, Homo sapiens
gaacucagcugucuguggc

SEQ ID NO: 1695506 - RNA, 16 nt, Homo sapiens
gaacuggcaauugucu

SEQ ID NO: 1695507 - RNA, 22 nt, Homo sapiens
gaacuguuuuguaagugcugcu

SEQ ID NO: 1695508 - RNA, 23 nt, Homo sapiens
gaacuguuuuguaagugcugcua

SEQ ID NO: 1695509 - RNA, 24 nt, Homo sapiens
gaacuuuaagcaacaagaccacca

SEQ ID NO: 1695510 - RNA, 20 nt, Homo sapiens
gaacuuuggagagugagcua

SEQ ID NO: 1695511 - RNA, 13 nt, Homo sapiens
gaagaacuacagc

SEQ ID NO: 1695512 - RNA, 23 nt, Homo sapiens
gaagaaugaucagcaucugugau

SEQ ID NO: 1695513 - RNA, 13 nt, Homo sapiens
gaagacacacuca

SEQ ID NO: 1695514 - RNA, 12 nt, Homo sapiens
gaagacaggaug

SEQ ID NO: 1695515 - RNA, 17 nt, Homo sapiens
gaagaccacacuuggug

SEQ ID NO: 1695516 - RNA, 16 nt, Homo sapiens
gaagaccguuuaccua

SEQ ID NO: 1695517 - RNA, 13 nt, Homo sapiens
gaagagggucccu

SEQ ID NO: 1695518 - RNA, 17 nt, Homo sapiens
gaagauuuaugaugcac

SEQ ID NO: 1695519 - RNA, 13 nt, Homo sapiens
gaagcaacauuuu

SEQ ID NO: 1695520 - RNA, 16 nt, Homo sapiens
gaagcaccccaugcca

SEQ ID NO: 1695521 - RNA, 15 nt, Homo sapiens
gaagcauuuacuuug

SEQ ID NO: 1695522 - RNA, 13 nt, Homo sapiens
gaagccucagcua

SEQ ID NO: 1695523 - RNA, 20 nt, Homo sapiens
gaagccuguggaugaucaau

SEQ ID NO: 1695524 - RNA, 18 nt, Homo sapiens
gaagcgaaacacagagaa

SEQ ID NO: 1695525 - RNA, 14 nt, Homo sapiens
gaagcuccacuguc

SEQ ID NO: 1695526 - RNA, 16 nt, Homo sapiens
gaagcugagacacaaa

SEQ ID NO: 1695527 - RNA, 22 nt, Homo sapiens
gaagcugcugaccaauugugcu

SEQ ID NO: 1695528 - RNA, 18 nt, Homo sapiens
gaagcuguuguacauuua

SEQ ID NO: 1695529 - RNA, 22 nt, Homo sapiens
gaaggaacagcaauggugucag

SEQ ID NO: 1695530 - RNA, 13 nt, Homo sapiens
gaaggcagccgcc

SEQ ID NO: 1695531 - RNA, 19 nt, Homo sapiens
gaagggacacacaagaaga

SEQ ID NO: 1695532 - RNA, 21 nt, Homo sapiens
gaaggguuuugcuacauucua

SEQ ID NO: 1695533 - RNA, 15 nt, Homo sapiens
gaaggucccucagac

SEQ ID NO: 1695534 - RNA, 18 nt, Homo sapiens
gaaggugcaggugacaga

SEQ ID NO: 1695535 - RNA, 20 nt, Homo sapiens
gaagguuauggucaauccca

SEQ ID NO: 1695536 - RNA, 12 nt, Homo sapiens
gaaguaaagccu

SEQ ID NO: 1695537 - RNA, 18 nt, Homo sapiens
gaaguagcagugucugua

SEQ ID NO: 1695538 - RNA, 14 nt, Homo sapiens
gaaguaugagggaa

SEQ ID NO: 1695539 - RNA, 14 nt, Homo sapiens
gaagucacacagua

SEQ ID NO: 1695540 - RNA, 21 nt, Homo sapiens
gaaguccuugcccacuuccca

SEQ ID NO: 1695541 - RNA, 21 nt, Homo sapiens
gaaguuuacauuuuuauuuau

SEQ ID NO: 1695542 - RNA, 15 nt, Homo sapiens
gaaguuucccuuccu

SEQ ID NO: 1695543 - RNA, 18 nt, Homo sapiens
gaaguuugcuuuguacug

SEQ ID NO: 1695544 - RNA, 15 nt, Homo sapiens
gaauaaaaacauuuc

SEQ ID NO: 1695545 - RNA, 20 nt, Homo sapiens
gaauaaaaauauguacaagu

SEQ ID NO: 1695546 - RNA, 22 nt, Homo sapiens
gaauaaaacuuuucugcugaua

SEQ ID NO: 1695547 - RNA, 15 nt, Homo sapiens
gaauaaaagugcaca

SEQ ID NO: 1695548 - RNA, 16 nt, Homo sapiens
gaauaagaauggagca

SEQ ID NO: 1695549 - RNA, 15 nt, Homo sapiens
gaauacaaagaccca

SEQ ID NO: 1695550 - RNA, 15 nt, Homo sapiens
gaauagaugcugacu

SEQ ID NO: 1695551 - RNA, 20 nt, Homo sapiens
gaauagauggguuauuucaa

SEQ ID NO: 1695552 - RNA, 21 nt, Homo sapiens
gaauauugcuuuggucauaug

SEQ ID NO: 1695553 - RNA, 20 nt, Homo sapiens
gaaucccacccacaugugac

SEQ ID NO: 1695554 - RNA, 16 nt, Homo sapiens
gaaucccccuugccac

SEQ ID NO: 1695555 - RNA, 21 nt, Homo sapiens
gaaucccccuugccaccccac

SEQ ID NO: 1695556 - RNA, 18 nt, Homo sapiens
gaauccccgaaggugcug

SEQ ID NO: 1695557 - RNA, 19 nt, Homo sapiens
gaauccccgaaggugcugg

SEQ ID NO: 1695558 - RNA, 18 nt, Homo sapiens
gaauccugaccugagcca

SEQ ID NO: 1695559 - RNA, 23 nt, Homo sapiens
gaauccuuuggugccaacuggug

SEQ ID NO: 1695560 - RNA, 17 nt, Homo sapiens
gaaucuacuaauuccac

SEQ ID NO: 1695561 - RNA, 15 nt, Homo sapiens
gaaugacaacagaag

SEQ ID NO: 1695562 - RNA, 14 nt, Homo sapiens
gaaugcuguguuaa

SEQ ID NO: 1695563 - RNA, 19 nt, Homo sapiens
gaauggacauccuguauaa

SEQ ID NO: 1695564 - RNA, 20 nt, Homo sapiens
gaaugggcuugaaacauuau

SEQ ID NO: 1695565 - RNA, 14 nt, Homo sapiens
gaauguacucuguu

SEQ ID NO: 1695566 - RNA, 14 nt, Homo sapiens
gaauguauaauauc

SEQ ID NO: 1695567 - RNA, 16 nt, Homo sapiens
gaauguggucucagga

SEQ ID NO: 1695568 - RNA, 14 nt, Homo sapiens
gaauguuugccucu

SEQ ID NO: 1695569 - RNA, 16 nt, Homo sapiens
gaauuaaaacuucuua

SEQ ID NO: 1695570 - RNA, 17 nt, Homo sapiens
gaauuaaaacuucuuaa

SEQ ID NO: 1695571 - RNA, 23 nt, Homo sapiens
gaauuaagacgguuaaauacugu

SEQ ID NO: 1695572 - RNA, 14 nt, Homo sapiens
gaauucgcuguuac

SEQ ID NO: 1695573 - RNA, 20 nt, Homo sapiens
gaauuucuaaaaaacagagg

SEQ ID NO: 1695574 - RNA, 15 nt, Homo sapiens
gaauuucuuguuucu

SEQ ID NO: 1695575 - RNA, 19 nt, Homo sapiens
gaauuuucucuaacuucaa

SEQ ID NO: 1695576 - RNA, 18 nt, Homo sapiens
gaauuuuguuuguugaug

SEQ ID NO: 1695577 - RNA, 20 nt, Homo sapiens
gaauuuuugcuaugcuguaa

SEQ ID NO: 1695578 - RNA, 19 nt, Homo sapiens
gaauuuuuuuuaacauucc

SEQ ID NO: 1695579 - RNA, 17 nt, Homo sapiens
gacaaaacuucuuguca

SEQ ID NO: 1695580 - RNA, 11 nt, Homo sapiens
gacaaacugug

SEQ ID NO: 1695581 - RNA, 18 nt, Homo sapiens
gacaaccucauccaggcu

SEQ ID NO: 1695582 - RNA, 21 nt, Homo sapiens
gacaagaauaauucaauuuua

SEQ ID NO: 1695583 - RNA, 14 nt, Homo sapiens
gacaauaaaccucc

SEQ ID NO: 1695584 - RNA, 20 nt, Homo sapiens
gacaaucaugaaauaugcau

SEQ ID NO: 1695585 - RNA, 13 nt, Homo sapiens
gacaaugacugug

SEQ ID NO: 1695586 - RNA, 14 nt, Homo sapiens
gacaaugauccagu

SEQ ID NO: 1695587 - RNA, 13 nt, Homo sapiens
gacacaaaacucc

SEQ ID NO: 1695588 - RNA, 21 nt, Homo sapiens
gacacaacuauuuuuccaaaa

SEQ ID NO: 1695589 - RNA, 22 nt, Homo sapiens
gacacagcgucccuagcaguga

SEQ ID NO: 1695590 - RNA, 21 nt, Homo sapiens
gacacagcucuucuccaggcu

SEQ ID NO: 1695591 - RNA, 11 nt, Homo sapiens
gacaccaaagc

SEQ ID NO: 1695592 - RNA, 22 nt, Homo sapiens
gacacuuaauacuaccuugaaa

SEQ ID NO: 1695593 - RNA, 13 nt, Homo sapiens
gacagacagccac

SEQ ID NO: 1695594 - RNA, 17 nt, Homo sapiens
gacagccacccugagaa

SEQ ID NO: 1695595 - RNA, 15 nt, Homo sapiens
gaggacgggacagau

SEQ ID NO: 1695596 - RNA, 19 nt, Homo sapiens
cuaaucaaagccagggucu

SEQ ID NO: 1695597 - RNA, 14 nt, Homo sapiens
cuaaucaccaaagg

SEQ ID NO: 1695598 - RNA, 17 nt, Homo sapiens
cuaaugagacugaccau

SEQ ID NO: 1695599 - RNA, 19 nt, Homo sapiens
cuaaugagacugaccauau

SEQ ID NO: 1695600 - RNA, 13 nt, Homo sapiens
cuaauuaggcaag

SEQ ID NO: 1695601 - RNA, 21 nt, Homo sapiens
cuaauuuauccugaaauuuca

SEQ ID NO: 1695602 - RNA, 14 nt, Homo sapiens
cuacaaaggccaug

SEQ ID NO: 1695603 - RNA, 22 nt, Homo sapiens
cuacacagugggaacucugaca

SEQ ID NO: 1695604 - RNA, 21 nt, Homo sapiens
cuacacucuugacuagugcaa

SEQ ID NO: 1695605 - RNA, 12 nt, Homo sapiens
cuacaguuauua

SEQ ID NO: 1695606 - RNA, 14 nt, Homo sapiens
cuacauaaguaauu

SEQ ID NO: 1695607 - RNA, 21 nt, Homo sapiens
cuaccaaagcaccuuagcugg

SEQ ID NO: 1695608 - RNA, 13 nt, Homo sapiens
cuacccuguguau

SEQ ID NO: 1695609 - RNA, 23 nt, Homo sapiens
cuacccuuccagugcccuaggcc

SEQ ID NO: 1695610 - RNA, 21 nt, Homo sapiens
cuacccuuuuccuuugugguu

SEQ ID NO: 1695611 - RNA, 15 nt, Homo sapiens
cuaccguuguuugca

SEQ ID NO: 1695612 - RNA, 22 nt, Homo sapiens
cuaccugauggaaguaaagccu

SEQ ID NO: 1695613 - RNA, 13 nt, Homo sapiens
cuacuacaaugau

SEQ ID NO: 1695614 - RNA, 21 nt, Homo sapiens
cuacuaucacugaacaaacua

SEQ ID NO: 1695615 - RNA, 20 nt, Homo sapiens
cuacuccccagaccucaggg

SEQ ID NO: 1695616 - RNA, 18 nt, Homo sapiens
cuacugcucuguguuuac

SEQ ID NO: 1695617 - RNA, 23 nt, Homo sapiens
cuacugggugucauuucauucca

SEQ ID NO: 1695618 - RNA, 19 nt, Homo sapiens
cuacuuccugugacuucag

SEQ ID NO: 1695619 - RNA, 17 nt, Homo sapiens
cuacuucuuuugcucuu

SEQ ID NO: 1695620 - RNA, 14 nt, Homo sapiens
cuacuugaccuaag

SEQ ID NO: 1695621 - RNA, 14 nt, Homo sapiens
cuccagacaccagu

SEQ ID NO: 1695622 - RNA, 23 nt, Homo sapiens
cuccagagggugcgcucagagac

SEQ ID NO: 1695623 - RNA, 20 nt, Homo sapiens
cuccagauguuuccagacuu

SEQ ID NO: 1695624 - RNA, 20 nt, Homo sapiens
cuccagccaaccucauugca

SEQ ID NO: 1695625 - RNA, 21 nt, Homo sapiens
cuccagccugacuuggggaga

SEQ ID NO: 1695626 - RNA, 19 nt, Homo sapiens
cuccaucccaacagccaug

SEQ ID NO: 1695627 - RNA, 17 nt, Homo sapiens
cuccaucuccacuccag

SEQ ID NO: 1695628 - RNA, 15 nt, Homo sapiens
cucccaaggcucuga

SEQ ID NO: 1695629 - RNA, 19 nt, Homo sapiens
cucccaaguagcugggauu

SEQ ID NO: 1695630 - RNA, 19 nt, Homo sapiens
cucccacaacaacaaaagc

SEQ ID NO: 1695631 - RNA, 19 nt, Homo sapiens
cucccacccuguaccucau

SEQ ID NO: 1695632 - RNA, 12 nt, Homo sapiens
cucccacuccag

SEQ ID NO: 1695633 - RNA, 11 nt, Homo sapiens
cucccagugac

SEQ ID NO: 1695634 - RNA, 12 nt, Homo sapiens
cucccaugaagc

SEQ ID NO: 1695635 - RNA, 16 nt, Homo sapiens
cuccccacacuaaccu

SEQ ID NO: 1695636 - RNA, 16 nt, Homo sapiens
cuccccacuagcauuu

SEQ ID NO: 1695637 - RNA, 23 nt, Homo sapiens
cuccccagcccuggcucugcaau

SEQ ID NO: 1695638 - RNA, 19 nt, Homo sapiens
cuccccuuuuucuuccuca

SEQ ID NO: 1695639 - RNA, 21 nt, Homo sapiens
cucccuaggcugcccacucuc

SEQ ID NO: 1695640 - RNA, 15 nt, Homo sapiens
cucccucauuccacc

SEQ ID NO: 1695641 - RNA, 18 nt, Homo sapiens
cucccuccagacaaugcc

SEQ ID NO: 1695642 - RNA, 14 nt, Homo sapiens
cucccucuguccac

SEQ ID NO: 1695643 - RNA, 23 nt, Homo sapiens
cucccugcagaugccacccuagc

SEQ ID NO: 1695644 - RNA, 17 nt, Homo sapiens
cucccuugcccuagaua

SEQ ID NO: 1695645 - RNA, 18 nt, Homo sapiens
cucccuuugccagugccu

SEQ ID NO: 1695646 - RNA, 21 nt, Homo sapiens
cuccuacccuuccagugcccu

SEQ ID NO: 1695647 - RNA, 17 nt, Homo sapiens
cuccuauaaucugucaa

SEQ ID NO: 1695648 - RNA, 14 nt, Homo sapiens
cuccucgcugccag

SEQ ID NO: 1695649 - RNA, 16 nt, Homo sapiens
cuccucgcugccagau

SEQ ID NO: 1695650 - RNA, 14 nt, Homo sapiens
cuccucuugccacu

SEQ ID NO: 1695651 - RNA, 21 nt, Homo sapiens
cuccugauaaaacaacagcuc

SEQ ID NO: 1695652 - RNA, 14 nt, Homo sapiens
cuccuggaaccuug

SEQ ID NO: 1695653 - RNA, 15 nt, Homo sapiens
cuccuggaaccuugc

SEQ ID NO: 1695654 - RNA, 20 nt, Homo sapiens
cuccuggaaccuugcugucc

SEQ ID NO: 1695655 - RNA, 13 nt, Homo sapiens
cuccugggcucag

SEQ ID NO: 1695656 - RNA, 18 nt, Homo sapiens
cuccugugucuugcaaug

SEQ ID NO: 1695657 - RNA, 20 nt, Homo sapiens
cuccuugaauaucuuucgau

SEQ ID NO: 1695658 - RNA, 14 nt, Homo sapiens
cuccuuucucuuau

SEQ ID NO: 1695659 - RNA, 14 nt, Homo sapiens
cucgaaacacagaa

SEQ ID NO: 1695660 - RNA, 20 nt, Homo sapiens
cucgaggacugauacugcag

SEQ ID NO: 1695661 - RNA, 21 nt, Homo sapiens
cucgggaaacuuagaucauca

SEQ ID NO: 1695662 - RNA, 20 nt, Homo sapiens
cucguauaugucucaggucc

SEQ ID NO: 1695663 - RNA, 15 nt, Homo sapiens
cucuaagaucuuaga

SEQ ID NO: 1695664 - RNA, 14 nt, Homo sapiens
cucuacagugccaa

SEQ ID NO: 1695665 - RNA, 20 nt, Homo sapiens
cucuaugaaaauuauaucuc

SEQ ID NO: 1695666 - RNA, 21 nt, Homo sapiens
cucuauuuguaauugaacuua

SEQ ID NO: 1695667 - RNA, 19 nt, Homo sapiens
cucucaugggguccaaguu

SEQ ID NO: 1695668 - RNA, 18 nt, Homo sapiens
cucuccaagucucagugg

SEQ ID NO: 1695669 - RNA, 17 nt, Homo sapiens
cucuccaauacucaggu

SEQ ID NO: 1695670 - RNA, 15 nt, Homo sapiens
cucuccccuccagcc

SEQ ID NO: 1695671 - RNA, 15 nt, Homo sapiens
cucuccgaccagaca

SEQ ID NO: 1695672 - RNA, 19 nt, Homo sapiens
cucuccuuccuuacccaaa

SEQ ID NO: 1695673 - RNA, 14 nt, Homo sapiens
cucuccuucuuagc

SEQ ID NO: 1695674 - RNA, 15 nt, Homo sapiens
cucucuacagugcca

SEQ ID NO: 1695675 - RNA, 11 nt, Homo sapiens
cucucuagcac

SEQ ID NO: 1695676 - RNA, 16 nt, Homo sapiens
cucugaagcauguuuc

SEQ ID NO: 1695677 - RNA, 23 nt, Homo sapiens
cucugaagucacaucacaggaca

SEQ ID NO: 1695678 - RNA, 21 nt, Homo sapiens
cucugacaagggcugaccugc

SEQ ID NO: 1695679 - RNA, 18 nt, Homo sapiens
cucugacgcaaaaccacu

SEQ ID NO: 1695680 - RNA, 23 nt, Homo sapiens
cucugacgcaaaaccacuuuccu

SEQ ID NO: 1695681 - RNA, 14 nt, Homo sapiens
cucugagaucuaag

SEQ ID NO: 1695682 - RNA, 16 nt, Homo sapiens
cucugauaugggacug

SEQ ID NO: 1695683 - RNA, 12 nt, Homo sapiens
cucugcaaaagg

SEQ ID NO: 1695684 - RNA, 14 nt, Homo sapiens
cucugcacaugucu

SEQ ID NO: 1695685 - RNA, 20 nt, Homo sapiens
cucugcacaugucuuguaca

SEQ ID NO: 1695686 - RNA, 19 nt, Homo sapiens
cucugcaucuccugucuuu

SEQ ID NO: 1695687 - RNA, 17 nt, Homo sapiens
cucugccuccucuucaa

SEQ ID NO: 1695688 - RNA, 19 nt, Homo sapiens
cucugccuuugacauuuaa

SEQ ID NO: 1695689 - RNA, 13 nt, Homo sapiens
cucugcugcauuu

SEQ ID NO: 1695690 - RNA, 15 nt, Homo sapiens
cucuggaggccugug

SEQ ID NO: 1695691 - RNA, 16 nt, Homo sapiens
cucuggcucucauggg

SEQ ID NO: 1695692 - RNA, 21 nt, Homo sapiens
cucuggggucuuuuuaugcau

SEQ ID NO: 1695693 - RNA, 15 nt, Homo sapiens
cucuggggugcugcc

SEQ ID NO: 1695694 - RNA, 11 nt, Homo sapiens
cucuguaaaac

SEQ ID NO: 1695695 - RNA, 15 nt, Homo sapiens
cucuguaaacuucca

SEQ ID NO: 1695696 - RNA, 17 nt, Homo sapiens
cucugugcccuccagca

SEQ ID NO: 1695697 - RNA, 14 nt, Homo sapiens
cucugugucaggug

SEQ ID NO: 1695698 - RNA, 16 nt, Homo sapiens
cucuguuauguacugu

SEQ ID NO: 1695699 - RNA, 16 nt, Homo sapiens
cucuuccugugaucca

SEQ ID NO: 1695700 - RNA, 14 nt, Homo sapiens
cucuucuuacuggu

SEQ ID NO: 1695701 - RNA, 22 nt, Homo sapiens
cucuucuucauucuaucaagcc

SEQ ID NO: 1695702 - RNA, 21 nt, Homo sapiens
cucuuguauaugaugaucugg

SEQ ID NO: 1695703 - RNA, 20 nt, Homo sapiens
cucuuguuucuuuucacaua

SEQ ID NO: 1695704 - RNA, 12 nt, Homo sapiens
cucuuugcugca

SEQ ID NO: 1695705 - RNA, 22 nt, Homo sapiens
cucuuuggcuccccuguaccuu

SEQ ID NO: 1695706 - RNA, 14 nt, Homo sapiens
cucuuuuagcugau

SEQ ID NO: 1695707 - RNA, 15 nt, Homo sapiens
cugaaaaucuaauau

SEQ ID NO: 1695708 - RNA, 12 nt, Homo sapiens
cugaaagcacug

SEQ ID NO: 1695709 - RNA, 14 nt, Homo sapiens
cugaaagcacugua

SEQ ID NO: 1695710 - RNA, 15 nt, Homo sapiens
cugaaaguucuugcu

SEQ ID NO: 1695711 - RNA, 14 nt, Homo sapiens
cugaacaaacuaaa

SEQ ID NO: 1695712 - RNA, 14 nt, Homo sapiens
caugauaggauuug

SEQ ID NO: 1695713 - RNA, 23 nt, Homo sapiens
caugauuguauauggaacaaaua

SEQ ID NO: 1695714 - RNA, 15 nt, Homo sapiens
caugauuguuuacag

SEQ ID NO: 1695715 - RNA, 12 nt, Homo sapiens
caugcacugacc

SEQ ID NO: 1695716 - RNA, 16 nt, Homo sapiens
caugcauguuugguua

SEQ ID NO: 1695717 - RNA, 22 nt, Homo sapiens
caugcucugcaaaaggagagac

SEQ ID NO: 1695718 - RNA, 12 nt, Homo sapiens
caugcugcucaa

SEQ ID NO: 1695719 - RNA, 21 nt, Homo sapiens
cauggacacuccagugccagc

SEQ ID NO: 1695720 - RNA, 16 nt, Homo sapiens
cauggaggucauacau

SEQ ID NO: 1695721 - RNA, 21 nt, Homo sapiens
cauggcaacauaauucacuuu

SEQ ID NO: 1695722 - RNA, 17 nt, Homo sapiens
cauggcaagucacaugc

SEQ ID NO: 1695723 - RNA, 23 nt, Homo sapiens
cauggcagaguuuguguguuguc

SEQ ID NO: 1695724 - RNA, 14 nt, Homo sapiens
cauggccauggcag

SEQ ID NO: 1695725 - RNA, 20 nt, Homo sapiens
cauggccccaguccaugcuu

SEQ ID NO: 1695726 - RNA, 18 nt, Homo sapiens
cauggcccugugcuaauc

SEQ ID NO: 1695727 - RNA, 17 nt, Homo sapiens
cauggccuaugcacaua

SEQ ID NO: 1695728 - RNA, 20 nt, Homo sapiens
cauggcuccagaaaugucua

SEQ ID NO: 1695729 - RNA, 19 nt, Homo sapiens
cauggcucuggacucuaaa

SEQ ID NO: 1695730 - RNA, 14 nt, Homo sapiens
cauggcugaaguca

SEQ ID NO: 1695731 - RNA, 18 nt, Homo sapiens
caugggcaccaaccugca

SEQ ID NO: 1695732 - RNA, 20 nt, Homo sapiens
cauggggacauuugccaacu

SEQ ID NO: 1695733 - RNA, 16 nt, Homo sapiens
cauggguuuaccacua

SEQ ID NO: 1695734 - RNA, 21 nt, Homo sapiens
cauggugaaaaccccaucucu

SEQ ID NO: 1695735 - RNA, 16 nt, Homo sapiens
cauggugaaaauguac

SEQ ID NO: 1695736 - RNA, 17 nt, Homo sapiens
cauguacagacauacau

SEQ ID NO: 1695737 - RNA, 16 nt, Homo sapiens
caugucgccucugcau

SEQ ID NO: 1695738 - RNA, 15 nt, Homo sapiens
caugugacacauaug

SEQ ID NO: 1695739 - RNA, 15 nt, Homo sapiens
caugugauugugauu

SEQ ID NO: 1695740 - RNA, 17 nt, Homo sapiens
caugugcacaugcacgu

SEQ ID NO: 1695741 - RNA, 17 nt, Homo sapiens
caugugcacgguggcga

SEQ ID NO: 1695742 - RNA, 17 nt, Homo sapiens
cauguggcuaaaugccu

SEQ ID NO: 1695743 - RNA, 13 nt, Homo sapiens
cauguucaugggu

SEQ ID NO: 1695744 - RNA, 22 nt, Homo sapiens
cauguuggccaggcuggucuca

SEQ ID NO: 1695745 - RNA, 17 nt, Homo sapiens
cauguuugcagggguga

SEQ ID NO: 1695746 - RNA, 14 nt, Homo sapiens
cauguuuuuauaca

SEQ ID NO: 1695747 - RNA, 23 nt, Homo sapiens
cauuaaaccugucuccacugugc

SEQ ID NO: 1695748 - RNA, 20 nt, Homo sapiens
cauuaaauguuugacacaau

SEQ ID NO: 1695749 - RNA, 18 nt, Homo sapiens
cauuaaauucacaaacuu

SEQ ID NO: 1695750 - RNA, 12 nt, Homo sapiens
cauuaccacuca

SEQ ID NO: 1695751 - RNA, 15 nt, Homo sapiens
cauuauacauuugau

SEQ ID NO: 1695752 - RNA, 15 nt, Homo sapiens
cauuaucaguugaca

SEQ ID NO: 1695753 - RNA, 13 nt, Homo sapiens
cauuauucauuua

SEQ ID NO: 1695754 - RNA, 19 nt, Homo sapiens
cauucaauagcauaucaca

SEQ ID NO: 1695755 - RNA, 21 nt, Homo sapiens
cauucaauauugacauuugua

SEQ ID NO: 1695756 - RNA, 12 nt, Homo sapiens
cauucacauuca

SEQ ID NO: 1695757 - RNA, 17 nt, Homo sapiens
cauucaugugggcauuu

SEQ ID NO: 1695758 - RNA, 19 nt, Homo sapiens
cauucaugugggcauuucu

SEQ ID NO: 1695759 - RNA, 18 nt, Homo sapiens
cauuccaagacucuagag

SEQ ID NO: 1695760 - RNA, 17 nt, Homo sapiens
cauuccuguagucaaaa

SEQ ID NO: 1695761 - RNA, 17 nt, Homo sapiens
cauuccuuugucuucaa

SEQ ID NO: 1695762 - RNA, 16 nt, Homo sapiens
cauugacaagaacuga

SEQ ID NO: 1695763 - RNA, 16 nt, Homo sapiens
cauugacgauuccuuc

SEQ ID NO: 1695764 - RNA, 17 nt, Homo sapiens
cauugcuugugccacac

SEQ ID NO: 1695765 - RNA, 17 nt, Homo sapiens
cauuggaacaacugaua

SEQ ID NO: 1695766 - RNA, 12 nt, Homo sapiens
cauuggcacugu

SEQ ID NO: 1695767 - RNA, 19 nt, Homo sapiens
cauuggguuguagccaaag

SEQ ID NO: 1695768 - RNA, 14 nt, Homo sapiens
cauugguccaagau

SEQ ID NO: 1695769 - RNA, 16 nt, Homo sapiens
cauugguccaagauuc

SEQ ID NO: 1695770 - RNA, 13 nt, Homo sapiens
cauuguauguauc

SEQ ID NO: 1695771 - RNA, 17 nt, Homo sapiens
cauugugcugcaccugg

SEQ ID NO: 1695772 - RNA, 22 nt, Homo sapiens
cauuuacagaaacgcauccagc

SEQ ID NO: 1695773 - RNA, 21 nt, Homo sapiens
cauuuagaacuugcagcugau

SEQ ID NO: 1695774 - RNA, 20 nt, Homo sapiens
cauuuauucaaaguuaaaag

SEQ ID NO: 1695775 - RNA, 17 nt, Homo sapiens
cauuuauuuacauguga

SEQ ID NO: 1695776 - RNA, 17 nt, Homo sapiens
cauuucagaaaugcugu

SEQ ID NO: 1695777 - RNA, 16 nt, Homo sapiens
cauuucagauauucca

SEQ ID NO: 1695778 - RNA, 21 nt, Homo sapiens
cauuucaugcucugcaaaagg

SEQ ID NO: 1695779 - RNA, 19 nt, Homo sapiens
cauuucucauaccuucccc

SEQ ID NO: 1695780 - RNA, 23 nt, Homo sapiens
cauuucucauaccuuccccacau

SEQ ID NO: 1695781 - RNA, 18 nt, Homo sapiens
cauuucuguaaauaccau

SEQ ID NO: 1695782 - RNA, 17 nt, Homo sapiens
cauuucuucagucagaa

SEQ ID NO: 1695783 - RNA, 15 nt, Homo sapiens
cauuucuugugaugu

SEQ ID NO: 1695784 - RNA, 10 nt, Homo sapiens
cauuugauac

SEQ ID NO: 1695785 - RNA, 14 nt, Homo sapiens
cauuugcuuugucc

SEQ ID NO: 1695786 - RNA, 21 nt, Homo sapiens
cauuuguuggaaugaauuaaa

SEQ ID NO: 1695787 - RNA, 15 nt, Homo sapiens
cauuuuaagaguuac

SEQ ID NO: 1695788 - RNA, 17 nt, Homo sapiens
cauuuuaugucauuaaa

SEQ ID NO: 1695789 - RNA, 18 nt, Homo sapiens
cauuuuguucuuacacau

SEQ ID NO: 1695790 - RNA, 17 nt, Homo sapiens
cauuuuuauguuauuac

SEQ ID NO: 1695791 - RNA, 13 nt, Homo sapiens
ccaaaaacuaaau

SEQ ID NO: 1695792 - RNA, 22 nt, Homo sapiens
ccaaaagggccauguuucaaga

SEQ ID NO: 1695793 - RNA, 21 nt, Homo sapiens
ccaaaauuaguuuguguuacu

SEQ ID NO: 1695794 - RNA, 22 nt, Homo sapiens
ccaaagaguagaauugcauuga

SEQ ID NO: 1695795 - RNA, 19 nt, Homo sapiens
ccaaagauguggguggcaa

SEQ ID NO: 1695796 - RNA, 14 nt, Homo sapiens
ccaaaguaaauguc

SEQ ID NO: 1695797 - RNA, 14 nt, Homo sapiens
ccaaauaacuucag

SEQ ID NO: 1695798 - RNA, 14 nt, Homo sapiens
ccaaauaugagaug

SEQ ID NO: 1695799 - RNA, 20 nt, Homo sapiens
ccaaaucaauaagaagguag

SEQ ID NO: 1695800 - RNA, 14 nt, Homo sapiens
ccaaaucucuucca

SEQ ID NO: 1695801 - RNA, 20 nt, Homo sapiens
ccaacacaaggcuccaagac

SEQ ID NO: 1695802 - RNA, 12 nt, Homo sapiens
ccaacaugguga

SEQ ID NO: 1695803 - RNA, 22 nt, Homo sapiens
ccaaccuggaguauaauauuca

SEQ ID NO: 1695804 - RNA, 15 nt, Homo sapiens
ccaacgggaagcaac

SEQ ID NO: 1695805 - RNA, 21 nt, Homo sapiens
ccaacuaagcgaggcaugccu

SEQ ID NO: 1695806 - RNA, 22 nt, Homo sapiens
ccaacucugagcccauguucug

SEQ ID NO: 1695807 - RNA, 13 nt, Homo sapiens
ccaacuuuugcau

SEQ ID NO: 1695808 - RNA, 16 nt, Homo sapiens
ccaagaaacacuuuca

SEQ ID NO: 1695809 - RNA, 13 nt, Homo sapiens
ccaagacaaauca

SEQ ID NO: 1695810 - RNA, 22 nt, Homo sapiens
ccaagagaaaggccugcacaca

SEQ ID NO: 1695811 - RNA, 21 nt, Homo sapiens
ccaagagagggccaugcaauu

SEQ ID NO: 1695812 - RNA, 11 nt, Homo sapiens
ccaagcauuua

SEQ ID NO: 1695813 - RNA, 18 nt, Homo sapiens
ccaagcauuuagugcaca

SEQ ID NO: 1695814 - RNA, 14 nt, Homo sapiens
ccaaggaagagcca

SEQ ID NO: 1695815 - RNA, 21 nt, Homo sapiens
ccaaggaguuggaagugaagu

SEQ ID NO: 1695816 - RNA, 21 nt, Homo sapiens
ccaaggccuucuccuccccac

SEQ ID NO: 1695817 - RNA, 16 nt, Homo sapiens
ccaagggcaccuggag

SEQ ID NO: 1695818 - RNA, 14 nt, Homo sapiens
ccaauaaaauuucu

SEQ ID NO: 1695819 - RNA, 19 nt, Homo sapiens
ccaaucccaccaacccuca

SEQ ID NO: 1695820 - RNA, 15 nt, Homo sapiens
ccaaucuaucuagua

SEQ ID NO: 1695821 - RNA, 23 nt, Homo sapiens
ccaaugcauugcuaaaauauuau

SEQ ID NO: 1695822 - RNA, 17 nt, Homo sapiens
auaucuauaguagacac

SEQ ID NO: 1695823 - RNA, 17 nt, Homo sapiens
auaucuguacaaugaca

SEQ ID NO: 1695824 - RNA, 16 nt, Homo sapiens
auaugaaaacuauaca

SEQ ID NO: 1695825 - RNA, 19 nt, Homo sapiens
auaugaagagcaacuggga

SEQ ID NO: 1695826 - RNA, 20 nt, Homo sapiens
auaugaugaucuggauccac

SEQ ID NO: 1695827 - RNA, 20 nt, Homo sapiens
auaugcuuggcuaacuauau

SEQ ID NO: 1695828 - RNA, 17 nt, Homo sapiens
auauggacucugcacau

SEQ ID NO: 1695829 - RNA, 17 nt, Homo sapiens
auauguacaauuguggg

SEQ ID NO: 1695830 - RNA, 21 nt, Homo sapiens
auauguguauauauacauaca

SEQ ID NO: 1695831 - RNA, 15 nt, Homo sapiens
auauguucccuccag

SEQ ID NO: 1695832 - RNA, 21 nt, Homo sapiens
auauguuuuaagaggcagggu

SEQ ID NO: 1695833 - RNA, 22 nt, Homo sapiens
auauguuuuuaaagguggauuu

SEQ ID NO: 1695834 - RNA, 21 nt, Homo sapiens
auauuaacaacaauaacacug

SEQ ID NO: 1695835 - RNA, 23 nt, Homo sapiens
auauuacuuguuuucacuuuauc

SEQ ID NO: 1695836 - RNA, 11 nt, Homo sapiens
auauuacuuua

SEQ ID NO: 1695837 - RNA, 18 nt, Homo sapiens
auauuacuuuaucacuuu

SEQ ID NO: 1695838 - RNA, 21 nt, Homo sapiens
auauucacugggccaauucaa

SEQ ID NO: 1695839 - RNA, 20 nt, Homo sapiens
auauucagauauaaaacagu

SEQ ID NO: 1695840 - RNA, 17 nt, Homo sapiens
auauucauuuccacucu

SEQ ID NO: 1695841 - RNA, 18 nt, Homo sapiens
auauuccugcauuuguga

SEQ ID NO: 1695842 - RNA, 17 nt, Homo sapiens
auauucugcaacacugu

SEQ ID NO: 1695843 - RNA, 16 nt, Homo sapiens
auauucuuuucugcaa

SEQ ID NO: 1695844 - RNA, 23 nt, Homo sapiens
auauugaaauuuauuuaauguga

SEQ ID NO: 1695845 - RNA, 19 nt, Homo sapiens
auauuguuugugauggauu

SEQ ID NO: 1695846 - RNA, 14 nt, Homo sapiens
auauuucuagacau

SEQ ID NO: 1695847 - RNA, 13 nt, Homo sapiens
auauuuggaagaa

SEQ ID NO: 1695848 - RNA, 15 nt, Homo sapiens
auauuugguaccaug

SEQ ID NO: 1695849 - RNA, 16 nt, Homo sapiens
auauuugguaccaugg

SEQ ID NO: 1695850 - RNA, 23 nt, Homo sapiens
auauuuguauauuacacauuugu

SEQ ID NO: 1695851 - RNA, 20 nt, Homo sapiens
auauuuuaccauacauuuaa

SEQ ID NO: 1695852 - RNA, 23 nt, Homo sapiens
auauuuucuggguuaaaacccca

SEQ ID NO: 1695853 - RNA, 18 nt, Homo sapiens
auauuuuguaacuauuac

SEQ ID NO: 1695854 - RNA, 22 nt, Homo sapiens
auauuuuuaguagagacagggu

SEQ ID NO: 1695855 - RNA, 14 nt, Homo sapiens
auauuuuugccaua

SEQ ID NO: 1695856 - RNA, 19 nt, Homo sapiens
auauuuuugccauaaugac

SEQ ID NO: 1695857 - RNA, 20 nt, Homo sapiens
aucaaaagggagagaacaaa

SEQ ID NO: 1695858 - RNA, 20 nt, Homo sapiens
aucaaaauaaaaagugacac

SEQ ID NO: 1695859 - RNA, 20 nt, Homo sapiens
aucaacagaagcauuuguau

SEQ ID NO: 1695860 - RNA, 13 nt, Homo sapiens
aucaagagcugcc

SEQ ID NO: 1695861 - RNA, 22 nt, Homo sapiens
aucaagcuuuuaaaaacuagag

SEQ ID NO: 1695862 - RNA, 13 nt, Homo sapiens
aucaagguucagc

SEQ ID NO: 1695863 - RNA, 20 nt, Homo sapiens
aucaauaaagaaaacuucca

SEQ ID NO: 1695864 - RNA, 18 nt, Homo sapiens
aucacaaauuucacuuau

SEQ ID NO: 1695865 - RNA, 23 nt, Homo sapiens
aucacaugaauauaaaugggaaa

SEQ ID NO: 1695866 - RNA, 16 nt, Homo sapiens
aucacuagccugucau

SEQ ID NO: 1695867 - RNA, 12 nt, Homo sapiens
aucacugaacaa

SEQ ID NO: 1695868 - RNA, 19 nt, Homo sapiens
cccaguguaugucuuguau

SEQ ID NO: 1695869 - RNA, 19 nt, Homo sapiens
cccaguucauugcacuuug

SEQ ID NO: 1695870 - RNA, 19 nt, Homo sapiens
cccaucuaagcugcagcuu

SEQ ID NO: 1695871 - RNA, 12 nt, Homo sapiens
cccaugagauuc

SEQ ID NO: 1695872 - RNA, 16 nt, Homo sapiens
cccaugcaggcccuuu

SEQ ID NO: 1695873 - RNA, 19 nt, Homo sapiens
cccaugcaggcccuuugaa

SEQ ID NO: 1695874 - RNA, 20 nt, Homo sapiens
cccaugcccuggauccauca

SEQ ID NO: 1695875 - RNA, 16 nt, Homo sapiens
cccauggacacuccag

SEQ ID NO: 1695876 - RNA, 23 nt, Homo sapiens
cccauguauuuaucucuauuuaa

SEQ ID NO: 1695877 - RNA, 18 nt, Homo sapiens
cccauguccucagcauuu

SEQ ID NO: 1695878 - RNA, 17 nt, Homo sapiens
cccauuucaauuccugu

SEQ ID NO: 1695879 - RNA, 20 nt, Homo sapiens
ccccaacaaaccauccagug

SEQ ID NO: 1695880 - RNA, 21 nt, Homo sapiens
ccccauagguggcugagcauc

SEQ ID NO: 1695881 - RNA, 15 nt, Homo sapiens
ccccaugccugucca

SEQ ID NO: 1695882 - RNA, 17 nt, Homo sapiens
cccccaaaguucacaau

SEQ ID NO: 1695883 - RNA, 14 nt, Homo sapiens
cccccagagcucuu

SEQ ID NO: 1695884 - RNA, 15 nt, Homo sapiens
cccccaggagaacau

SEQ ID NO: 1695885 - RNA, 15 nt, Homo sapiens
ccccgugacugcaau

SEQ ID NO: 1695886 - RNA, 21 nt, Homo sapiens
ccccguuccugacaucacagc

SEQ ID NO: 1695887 - RNA, 15 nt, Homo sapiens
ccccuccaggaauga

SEQ ID NO: 1695888 - RNA, 15 nt, Homo sapiens
ccccucccccaucuc

SEQ ID NO: 1695889 - RNA, 12 nt, Homo sapiens
ccccucugggaa

SEQ ID NO: 1695890 - RNA, 18 nt, Homo sapiens
ccccugaccucacuguga

SEQ ID NO: 1695891 - RNA, 16 nt, Homo sapiens
ccccuggcugugcucu

SEQ ID NO: 1695892 - RNA, 14 nt, Homo sapiens
ccccuuguccuuuc

SEQ ID NO: 1695893 - RNA, 15 nt, Homo sapiens
cccgaagaauggaga

SEQ ID NO: 1695894 - RNA, 20 nt, Homo sapiens
cccgccagagggcuugugaa

SEQ ID NO: 1695895 - RNA, 19 nt, Homo sapiens
cccggagguugggugggcc

SEQ ID NO: 1695896 - RNA, 17 nt, Homo sapiens
cccggggcuggugggcc

SEQ ID NO: 1695897 - RNA, 19 nt, Homo sapiens
cccucaaccuccuguggaa

SEQ ID NO: 1695898 - RNA, 21 nt, Homo sapiens
cccucaggggaaaacuguuac

SEQ ID NO: 1695899 - RNA, 21 nt, Homo sapiens
cccuccaaaggucugaugucu

SEQ ID NO: 1695900 - RNA, 13 nt, Homo sapiens
cccuccaauccca

SEQ ID NO: 1695901 - RNA, 19 nt, Homo sapiens
gaggacuugugucucugug

SEQ ID NO: 1695902 - RNA, 20 nt, Homo sapiens
gaggagcaccuccgccagau

SEQ ID NO: 1695903 - RNA, 17 nt, Homo sapiens
gccagaggaacugucca

SEQ ID NO: 1695904 - RNA, 18 nt, Homo sapiens
gccagaugauuguucaaa

SEQ ID NO: 1695905 - RNA, 14 nt, Homo sapiens
gccagcaaugacau

SEQ ID NO: 1695906 - RNA, 18 nt, Homo sapiens
gccagcaaugacaucuca

SEQ ID NO: 1695907 - RNA, 13 nt, Homo sapiens
gccagccuggucc

SEQ ID NO: 1695908 - RNA, 21 nt, Homo sapiens
gccagccugucccauggacac

SEQ ID NO: 1695909 - RNA, 21 nt, Homo sapiens
gccagccuucuuccaucccag

SEQ ID NO: 1695910 - RNA, 16 nt, Homo sapiens
gccagcucagucccau

SEQ ID NO: 1695911 - RNA, 21 nt, Homo sapiens
gccagcuuggggccaccaaag

SEQ ID NO: 1695912 - RNA, 17 nt, Homo sapiens
gccaggauccucuccuu

SEQ ID NO: 1695913 - RNA, 23 nt, Homo sapiens
gccaggccagagggagugacaga

SEQ ID NO: 1695914 - RNA, 13 nt, Homo sapiens
gccaggcucaggc

SEQ ID NO: 1695915 - RNA, 14 nt, Homo sapiens
gccagggucucacu

SEQ ID NO: 1695916 - RNA, 11 nt, Homo sapiens
gccaguauuuu

SEQ ID NO: 1695917 - RNA, 14 nt, Homo sapiens
gccagugccucuca

SEQ ID NO: 1695918 - RNA, 14 nt, Homo sapiens
gccagugucauccg

SEQ ID NO: 1695919 - RNA, 12 nt, Homo sapiens
gccauacuucug

SEQ ID NO: 1695920 - RNA, 19 nt, Homo sapiens
gccauacuucuguuuccau

SEQ ID NO: 1695921 - RNA, 22 nt, Homo sapiens
gccauacuucuguuuccaucug

SEQ ID NO: 1695922 - RNA, 16 nt, Homo sapiens
gccauauaaguuugaa

SEQ ID NO: 1695923 - RNA, 22 nt, Homo sapiens
gccauccuugacuuugaacuaa

SEQ ID NO: 1695924 - RNA, 18 nt, Homo sapiens
gccaugggccuccugugu

SEQ ID NO: 1695925 - RNA, 20 nt, Homo sapiens
gccauguauaaaugugauau

SEQ ID NO: 1695926 - RNA, 15 nt, Homo sapiens
gccauguccaaagag

SEQ ID NO: 1695927 - RNA, 21 nt, Homo sapiens
gcccagagcaggaagcauuca

SEQ ID NO: 1695928 - RNA, 21 nt, Homo sapiens
gcccaggccggccagccucac

SEQ ID NO: 1695929 - RNA, 20 nt, Homo sapiens
gcccaggcuggagugcagug

SEQ ID NO: 1695930 - RNA, 16 nt, Homo sapiens
gcccagggaagccaaa

SEQ ID NO: 1695931 - RNA, 14 nt, Homo sapiens
gcccaggugccagc

SEQ ID NO: 1695932 - RNA, 18 nt, Homo sapiens
gcccaguuggguggaugc

SEQ ID NO: 1695933 - RNA, 18 nt, Homo sapiens
gcccauaucugugaaaug

SEQ ID NO: 1695934 - RNA, 18 nt, Homo sapiens
gcccauggcccugugcua

SEQ ID NO: 1695935 - RNA, 16 nt, Homo sapiens
gccccaaccugcugaa

SEQ ID NO: 1695936 - RNA, 14 nt, Homo sapiens
gccccaguccaugc

SEQ ID NO: 1695937 - RNA, 16 nt, Homo sapiens
gcccccgccacaaccc

SEQ ID NO: 1695938 - RNA, 21 nt, Homo sapiens
gcccccuucaagccugugcaa

SEQ ID NO: 1695939 - RNA, 20 nt, Homo sapiens
gccccuauagaaacaccagu

SEQ ID NO: 1695940 - RNA, 16 nt, Homo sapiens
gccccugccucgagga

SEQ ID NO: 1695941 - RNA, 23 nt, Homo sapiens
gccccugguuaagggagaucugg

SEQ ID NO: 1695942 - RNA, 17 nt, Homo sapiens
gcccuaaccccuuccag

SEQ ID NO: 1695943 - RNA, 15 nt, Homo sapiens
gcccuacauugugcu

SEQ ID NO: 1695944 - RNA, 16 nt, Homo sapiens
gcccuacucccugcag

SEQ ID NO: 1695945 - RNA, 11 nt, Homo sapiens
gcccucaggag

SEQ ID NO: 1695946 - RNA, 17 nt, Homo sapiens
gcccucaucuugaaggg

SEQ ID NO: 1695947 - RNA, 11 nt, Homo sapiens
gcccucgcugc

SEQ ID NO: 1695948 - RNA, 19 nt, Homo sapiens
gcccugagcuuuguccuga

SEQ ID NO: 1695949 - RNA, 14 nt, Homo sapiens
gcccuggauccauc

SEQ ID NO: 1695950 - RNA, 20 nt, Homo sapiens
gccgauauuuucuugcugga

SEQ ID NO: 1695951 - RNA, 11 nt, Homo sapiens
gccgcacuggg

SEQ ID NO: 1695952 - RNA, 23 nt, Homo sapiens
gccgggccuagaccuggugcuga

SEQ ID NO: 1695953 - RNA, 19 nt, Homo sapiens
gccgugugagugugacagg

SEQ ID NO: 1695954 - RNA, 16 nt, Homo sapiens
gccguuguacuccagc

SEQ ID NO: 1695955 - RNA, 19 nt, Homo sapiens
gccuaaauuuaaugcugcc

SEQ ID NO: 1695956 - RNA, 21 nt, Homo sapiens
gccuacuuucacacuaagaaa

SEQ ID NO: 1695957 - RNA, 21 nt, Homo sapiens
gccuagacucuguaacaucac

SEQ ID NO: 1695958 - RNA, 14 nt, Homo sapiens
gccuaggugacaga

SEQ ID NO: 1695959 - RNA, 21 nt, Homo sapiens
gccuauguugugguccaucag

SEQ ID NO: 1695960 - RNA, 17 nt, Homo sapiens
gccucacucaccaucug

SEQ ID NO: 1695961 - RNA, 23 nt, Homo sapiens
gccucauauuuaaagacagggaa

SEQ ID NO: 1695962 - RNA, 16 nt, Homo sapiens
gccuccaagcuccauc

SEQ ID NO: 1695963 - RNA, 20 nt, Homo sapiens
gccuccaugaccugcgcucu

SEQ ID NO: 1695964 - RNA, 21 nt, Homo sapiens
gccuccuucccucggggccau

SEQ ID NO: 1695965 - RNA, 16 nt, Homo sapiens
gccucgaaacacagaa

SEQ ID NO: 1695966 - RNA, 17 nt, Homo sapiens
gccucgcagccuccgga

SEQ ID NO: 1695967 - RNA, 18 nt, Homo sapiens
gccucgggaccucaggug

SEQ ID NO: 1695968 - RNA, 18 nt, Homo sapiens
gccucuggaauugcucaa

SEQ ID NO: 1695969 - RNA, 15 nt, Homo sapiens
gccucuggcucucau

SEQ ID NO: 1695970 - RNA, 12 nt, Homo sapiens
gccugacagaaa

SEQ ID NO: 1695971 - RNA, 18 nt, Homo sapiens
gccugaugcucccucccc

SEQ ID NO: 1695972 - RNA, 21 nt, Homo sapiens
gccugcagcaggaguggugca

SEQ ID NO: 1695973 - RNA, 15 nt, Homo sapiens
gccugcaucugugaa

SEQ ID NO: 1695974 - RNA, 16 nt, Homo sapiens
gccugcaucugugaaa

SEQ ID NO: 1695975 - RNA, 22 nt, Homo sapiens
gccuggacuguuuucucucggc

SEQ ID NO: 1695976 - RNA, 18 nt, Homo sapiens
gccuggcacaggacugau

SEQ ID NO: 1695977 - RNA, 20 nt, Homo sapiens
gccuggcagccgugccuuca

SEQ ID NO: 1695978 - RNA, 17 nt, Homo sapiens
gccuggccagcacccca

SEQ ID NO: 1695979 - RNA, 23 nt, Homo sapiens
gccugggucccacucaggugaaa

SEQ ID NO: 1695980 - RNA, 13 nt, Homo sapiens
gccuguaauccca

SEQ ID NO: 1695981 - RNA, 15 nt, Homo sapiens
gccugugcugugacu

SEQ ID NO: 1695982 - RNA, 20 nt, Homo sapiens
gccuguggaaugagugugca

SEQ ID NO: 1695983 - RNA, 15 nt, Homo sapiens
gccugugguuaacau

SEQ ID NO: 1695984 - RNA, 18 nt, Homo sapiens
gccugugguuaacaucuc

SEQ ID NO: 1695985 - RNA, 19 nt, Homo sapiens
gccugugguuaacaucuca

SEQ ID NO: 1695986 - RNA, 20 nt, Homo sapiens
gccuguuccgcauccuggag

SEQ ID NO: 1695987 - RNA, 14 nt, Homo sapiens
gccuguugcccuuu

SEQ ID NO: 1695988 - RNA, 15 nt, Homo sapiens
gccuuaaugcuucau

SEQ ID NO: 1695989 - RNA, 20 nt, Homo sapiens
gccuuacacaaaggggauca

SEQ ID NO: 1695990 - RNA, 20 nt, Homo sapiens
gccuuagaaauguaaacugc

SEQ ID NO: 1695991 - RNA, 20 nt, Homo sapiens
gccuuccagcugcugucuuc

SEQ ID NO: 1695992 - RNA, 19 nt, Homo sapiens
gccuuccugaggaugggca

SEQ ID NO: 1695993 - RNA, 18 nt, Homo sapiens
gccuugaugccauaugcc

SEQ ID NO: 1695994 - RNA, 18 nt, Homo sapiens
gccuugggcuccugauga

SEQ ID NO: 1695995 - RNA, 18 nt, Homo sapiens
gccuuugcaaaucagugu

SEQ ID NO: 1695996 - RNA, 15 nt, Homo sapiens
gccuuuucacugugu

SEQ ID NO: 1695997 - RNA, 22 nt, Homo sapiens
gccuuuuuauuuauauguacug

SEQ ID NO: 1695998 - RNA, 15 nt, Homo sapiens
gcgaauaacaguccc

SEQ ID NO: 1695999 - RNA, 20 nt, Homo sapiens
gcgagcccugguggcagugg

SEQ ID NO: 1696000 - RNA, 17 nt, Homo sapiens
gcgagucuuacuuugag

SEQ ID NO: 1696001 - RNA, 20 nt, Homo sapiens
gcgaucuggguucacugcaa

SEQ ID NO: 1696002 - RNA, 17 nt, Homo sapiens
gcgauugaaagggcaau

SEQ ID NO: 1696003 - RNA, 15 nt, Homo sapiens
gcgcccgccccugca

SEQ ID NO: 1696004 - RNA, 19 nt, Homo sapiens
gcgccuggaggacgggaca

SEQ ID NO: 1696005 - RNA, 19 nt, Homo sapiens
gcgcuaccggccgggccua

SEQ ID NO: 1696006 - RNA, 13 nt, Homo sapiens
gcgcuauuacaaa

SEQ ID NO: 1696007 - RNA, 16 nt, Homo sapiens
aacucuguaaaaccuc

SEQ ID NO: 1696008 - RNA, 13 nt, Homo sapiens
aacucuuaucuca

SEQ ID NO: 1696009 - RNA, 21 nt, Homo sapiens
aacucuucgaagccuugccua

SEQ ID NO: 1696010 - RNA, 10 nt, Homo sapiens
aacugacaca

SEQ ID NO: 1696011 - RNA, 19 nt, Homo sapiens
aacugccucgaaacacaga

SEQ ID NO: 1696012 - RNA, 19 nt, Homo sapiens
aacugggccuguugcccuu

SEQ ID NO: 1696013 - RNA, 23 nt, Homo sapiens
aacuguacauuuaaaauugcuau

SEQ ID NO: 1696014 - RNA, 16 nt, Homo sapiens
aacuguacauuucaca

SEQ ID NO: 1696015 - RNA, 22 nt, Homo sapiens
aacugugaaguuuacauuguaa

SEQ ID NO: 1696016 - RNA, 15 nt, Homo sapiens
aacuguggucaaucc

SEQ ID NO: 1696017 - RNA, 18 nt, Homo sapiens
aacuguuagcacuguuga

SEQ ID NO: 1696018 - RNA, 22 nt, Homo sapiens
aacuguuuugguaguuggauuu

SEQ ID NO: 1696019 - RNA, 20 nt, Homo sapiens
aacuuagaucaucagucacc

SEQ ID NO: 1696020 - RNA, 13 nt, Homo sapiens
aacuuagugacaa

SEQ ID NO: 1696021 - RNA, 20 nt, Homo sapiens
aacuuauguagauauuuggc

SEQ ID NO: 1696022 - RNA, 13 nt, Homo sapiens
aacuucuugucag

SEQ ID NO: 1696023 - RNA, 18 nt, Homo sapiens
aacuucuuucuauuugac

SEQ ID NO: 1696024 - RNA, 16 nt, Homo sapiens
aacuugaaaauauaug

SEQ ID NO: 1696025 - RNA, 15 nt, Homo sapiens
aacuugcauauguca

SEQ ID NO: 1696026 - RNA, 16 nt, Homo sapiens
aacuuguagcuguaaa

SEQ ID NO: 1696027 - RNA, 19 nt, Homo sapiens
aacuuguuugcugugaaca

SEQ ID NO: 1696028 - RNA, 23 nt, Homo sapiens
aacuuuaaacauugacgauuccu

SEQ ID NO: 1696029 - RNA, 16 nt, Homo sapiens
aacuuuaucuaaagaa

SEQ ID NO: 1696030 - RNA, 19 nt, Homo sapiens
aacuuugaacaagguuuca

SEQ ID NO: 1696031 - RNA, 23 nt, Homo sapiens
aacuuugacgagucaccuuccag

SEQ ID NO: 1696032 - RNA, 12 nt, Homo sapiens
aacuuuuaucua

SEQ ID NO: 1696033 - RNA, 18 nt, Homo sapiens
aagaaaaaaaucuucucc

SEQ ID NO: 1696034 - RNA, 16 nt, Homo sapiens
aagaaaaacaccgcuu

SEQ ID NO: 1696035 - RNA, 14 nt, Homo sapiens
aagaaaacuuccau

SEQ ID NO: 1696036 - RNA, 14 nt, Homo sapiens
aagaaaaugagaca

SEQ ID NO: 1696037 - RNA, 21 nt, Homo sapiens
aagaaacacagcaacaaugac

SEQ ID NO: 1696038 - RNA, 15 nt, Homo sapiens
aagaaacacuuucag

SEQ ID NO: 1696039 - RNA, 22 nt, Homo sapiens
aagaaacagauaccauacucau

SEQ ID NO: 1696040 - RNA, 16 nt, Homo sapiens
aagaaacagcuuucaa

SEQ ID NO: 1696041 - RNA, 16 nt, Homo sapiens
aagaaacccucuguca

SEQ ID NO: 1696042 - RNA, 18 nt, Homo sapiens
aagaaacccucugucauu

SEQ ID NO: 1696043 - RNA, 15 nt, Homo sapiens
aagaaacgucuucua

SEQ ID NO: 1696044 - RNA, 23 nt, Homo sapiens
aagaaaguuuagaagcugagaca

SEQ ID NO: 1696045 - RNA, 13 nt, Homo sapiens
aagaaaucaaaga

SEQ ID NO: 1696046 - RNA, 22 nt, Homo sapiens
aagaauaaaaaagaaauccaua

SEQ ID NO: 1696047 - RNA, 13 nt, Homo sapiens
aagaauaauucaa

SEQ ID NO: 1696048 - RNA, 13 nt, Homo sapiens
aagaaucuaauag

SEQ ID NO: 1696049 - RNA, 23 nt, Homo sapiens
aagaauucaaacuggggccucca

SEQ ID NO: 1696050 - RNA, 13 nt, Homo sapiens
aagacaaaccaag

SEQ ID NO: 1696051 - RNA, 13 nt, Homo sapiens
aagacaacauaac

SEQ ID NO: 1696052 - RNA, 22 nt, Homo sapiens
aagacaagaaaaucagguauua

SEQ ID NO: 1696053 - RNA, 13 nt, Homo sapiens
aagacaaugcacc

SEQ ID NO: 1696054 - RNA, 21 nt, Homo sapiens
aagacaauuugauacauaaua

SEQ ID NO: 1696055 - RNA, 12 nt, Homo sapiens
aagacaccauuu

SEQ ID NO: 1696056 - RNA, 16 nt, Homo sapiens
aagacagcugcugggu

SEQ ID NO: 1696057 - RNA, 18 nt, Homo sapiens
aagacagcugcuggguca

SEQ ID NO: 1696058 - RNA, 15 nt, Homo sapiens
aagacauaugcauuu

SEQ ID NO: 1696059 - RNA, 14 nt, Homo sapiens
aagacauucuucca

SEQ ID NO: 1696060 - RNA, 13 nt, Homo sapiens
aagaccaccacuu

SEQ ID NO: 1696061 - RNA, 21 nt, Homo sapiens
aagacgauuugucaguuauuu

SEQ ID NO: 1696062 - RNA, 21 nt, Homo sapiens
aagacucauucccuagaucuu

SEQ ID NO: 1696063 - RNA, 21 nt, Homo sapiens
aagacuggaagcuaauuugca

SEQ ID NO: 1696064 - RNA, 20 nt, Homo sapiens
aagacuuccucaugaaucuc

SEQ ID NO: 1696065 - RNA, 18 nt, Homo sapiens
aagagagaaaucugaaaa

SEQ ID NO: 1696066 - RNA, 18 nt, Homo sapiens
aagagauuguuguuugcc

SEQ ID NO: 1696067 - RNA, 19 nt, Homo sapiens
aagagccauauaaguuuga

SEQ ID NO: 1696068 - RNA, 23 nt, Homo sapiens
aagagcuuugugauauacugguu

SEQ ID NO: 1696069 - RNA, 14 nt, Homo sapiens
aagaggaacagcac

SEQ ID NO: 1696070 - RNA, 18 nt, Homo sapiens
aagaggcugccccucuca

SEQ ID NO: 1696071 - RNA, 17 nt, Homo sapiens
aagagggagaagggaug

SEQ ID NO: 1696072 - RNA, 18 nt, Homo sapiens
aagagugauugcagcuuu

SEQ ID NO: 1696073 - RNA, 15 nt, Homo sapiens
aagauaauucacucu

SEQ ID NO: 1696074 - RNA, 19 nt, Homo sapiens
aagauaccaaaaccacagu

SEQ ID NO: 1696075 - RNA, 19 nt, Homo sapiens
aagauagaugcacuuaugc

SEQ ID NO: 1696076 - RNA, 16 nt, Homo sapiens
aagauaguuuucuccu

SEQ ID NO: 1696077 - RNA, 22 nt, Homo sapiens
aagauccuagauccuaaggguc

SEQ ID NO: 1696078 - RNA, 20 nt, Homo sapiens
aagaucuguuuugaaggcaa

SEQ ID NO: 1696079 - RNA, 14 nt, Homo sapiens
aagaugaaguuuua

SEQ ID NO: 1696080 - RNA, 15 nt, Homo sapiens
aagaugaaguuuuau

SEQ ID NO: 1696081 - RNA, 19 nt, Homo sapiens
aagaugacggaugccuaga

SEQ ID NO: 1696082 - RNA, 19 nt, Homo sapiens
aagauggcucagaggggga

SEQ ID NO: 1696083 - RNA, 20 nt, Homo sapiens
aagauuauagaaguagcaaa

SEQ ID NO: 1696084 - RNA, 20 nt, Homo sapiens
aagauucuauaguucuagac

SEQ ID NO: 1696085 - RNA, 19 nt, Homo sapiens
aagauuuaugaugcacuua

SEQ ID NO: 1696086 - RNA, 19 nt, Homo sapiens
aagauuuugcaccuguaaa

SEQ ID NO: 1696087 - RNA, 22 nt, Homo sapiens
aagcaaacacuuacagaauuau

SEQ ID NO: 1696088 - RNA, 18 nt, Homo sapiens
aagcaauuucuugcucua

SEQ ID NO: 1696089 - RNA, 22 nt, Homo sapiens
aagcacaucuuugaccacguca

SEQ ID NO: 1696090 - RNA, 22 nt, Homo sapiens
aagcagaaauccugcaaugaaa

SEQ ID NO: 1696091 - RNA, 18 nt, Homo sapiens
aagcauucuccccagugu

SEQ ID NO: 1696092 - RNA, 23 nt, Homo sapiens
aagccagaugugaaaacaucuca

SEQ ID NO: 1696093 - RNA, 16 nt, Homo sapiens
aagccauguuuccucu

SEQ ID NO: 1696094 - RNA, 15 nt, Homo sapiens
aagcccacagcacag

SEQ ID NO: 1696095 - RNA, 21 nt, Homo sapiens
aagccucguuuugaugccauu

SEQ ID NO: 1696096 - RNA, 12 nt, Homo sapiens
aagccuuaggga

SEQ ID NO: 1696097 - RNA, 17 nt, Homo sapiens
aagccuuuaguaucagu

SEQ ID NO: 1696098 - RNA, 17 nt, Homo sapiens
aagcggugccagccacg

SEQ ID NO: 1696099 - RNA, 17 nt, Homo sapiens
aagcgugagccacugca

SEQ ID NO: 1696100 - RNA, 15 nt, Homo sapiens
aagcuagacagaucc

SEQ ID NO: 1696101 - RNA, 20 nt, Homo sapiens
aagcuauuagccaggaucau

SEQ ID NO: 1696102 - RNA, 22 nt, Homo sapiens
aagcuauuauaaaacuugaauu

SEQ ID NO: 1696103 - RNA, 13 nt, Homo sapiens
aagcucauuucau

SEQ ID NO: 1696104 - RNA, 12 nt, Homo sapiens
aagcuccacugu

SEQ ID NO: 1696105 - RNA, 14 nt, Homo sapiens
aagcucugaaguca

SEQ ID NO: 1696106 - RNA, 16 nt, Homo sapiens
aagcucugaagucaca

SEQ ID NO: 1696107 - RNA, 14 nt, Homo sapiens
aagcucuguugcaa

SEQ ID NO: 1696108 - RNA, 17 nt, Homo sapiens
aagcugauuaccugaag

SEQ ID NO: 1696109 - RNA, 19 nt, Homo sapiens
aagcugcagcuugggagag

SEQ ID NO: 1696110 - RNA, 22 nt, Homo sapiens
aagcugcuccaggccugcagca

SEQ ID NO: 1696111 - RNA, 13 nt, Homo sapiens
aagcugcuuuaaa

SEQ ID NO: 1696112 - RNA, 19 nt, Homo sapiens
aagcuggcuuuucccauuu

SEQ ID NO: 1696113 - RNA, 16 nt, Homo sapiens
aagcuuccauaguggu

SEQ ID NO: 1696114 - RNA, 22 nt, Homo sapiens
aaggaacauuccuuagucucaa

SEQ ID NO: 1696115 - RNA, 12 nt, Homo sapiens
aaggaacuucca

SEQ ID NO: 1696116 - RNA, 18 nt, Homo sapiens
aaggaagaagaguauuaa

SEQ ID NO: 1696117 - RNA, 13 nt, Homo sapiens
aauaugcagugau

SEQ ID NO: 1696118 - RNA, 23 nt, Homo sapiens
aauauuaucacgcagaucacuaa

SEQ ID NO: 1696119 - RNA, 15 nt, Homo sapiens
aauauuauuugcuaa

SEQ ID NO: 1696120 - RNA, 17 nt, Homo sapiens
aauauuauuugcuaauu

SEQ ID NO: 1696121 - RNA, 15 nt, Homo sapiens
aauauucagauauaa

SEQ ID NO: 1696122 - RNA, 19 nt, Homo sapiens
aauauucuauaugaauuua

SEQ ID NO: 1696123 - RNA, 18 nt, Homo sapiens
aauauuguguugugaaug

SEQ ID NO: 1696124 - RNA, 19 nt, Homo sapiens
aauauuuaaacagcagugu

SEQ ID NO: 1696125 - RNA, 15 nt, Homo sapiens
aauauuuaucugauu

SEQ ID NO: 1696126 - RNA, 18 nt, Homo sapiens
aauauuuuuccacuuaaa

SEQ ID NO: 1696127 - RNA, 15 nt, Homo sapiens
aaucaaaacucacaa

SEQ ID NO: 1696128 - RNA, 23 nt, Homo sapiens
aaucaaaacucacaagugcucau

SEQ ID NO: 1696129 - RNA, 18 nt, Homo sapiens
aaucaaggccagugcuaa

SEQ ID NO: 1696130 - RNA, 13 nt, Homo sapiens
aaucaaguccuuu

SEQ ID NO: 1696131 - RNA, 20 nt, Homo sapiens
aaucaaguuguaacuuauau

SEQ ID NO: 1696132 - RNA, 19 nt, Homo sapiens
aaucaaugcaagagugauu

SEQ ID NO: 1696133 - RNA, 14 nt, Homo sapiens
aaucagagacaaaa

SEQ ID NO: 1696134 - RNA, 17 nt, Homo sapiens
aaucagcauucucacuc

SEQ ID NO: 1696135 - RNA, 15 nt, Homo sapiens
aaucagucagccgcu

SEQ ID NO: 1696136 - RNA, 16 nt, Homo sapiens
aaucauauugaugaaa

SEQ ID NO: 1696137 - RNA, 18 nt, Homo sapiens
aaucauccaagacaguua

SEQ ID NO: 1696138 - RNA, 24 nt, Homo sapiens
aaucaucuauaaagaagaacuugc

SEQ ID NO: 1696139 - RNA, 16 nt, Homo sapiens
aaucauuaauacucuu

SEQ ID NO: 1696140 - RNA, 22 nt, Homo sapiens
aaucauuuauuuacaugugauu

SEQ ID NO: 1696141 - RNA, 23 nt, Homo sapiens
aaucauuuauuuacaugugauug

SEQ ID NO: 1696142 - RNA, 11 nt, Homo sapiens
aaucauuuccc

SEQ ID NO: 1696143 - RNA, 16 nt, Homo sapiens
aaucauuuugccucuu

SEQ ID NO: 1696144 - RNA, 12 nt, Homo sapiens
aauccaaaaaga

SEQ ID NO: 1696145 - RNA, 23 nt, Homo sapiens
aauccagucccaaugguccugac

SEQ ID NO: 1696146 - RNA, 20 nt, Homo sapiens
aauccuaagacacaaaugca

SEQ ID NO: 1696147 - RNA, 23 nt, Homo sapiens
aauccuaagacacaaaugcauga

SEQ ID NO: 1696148 - RNA, 14 nt, Homo sapiens
aauccugaccugag

SEQ ID NO: 1696149 - RNA, 14 nt, Homo sapiens
aaucuacuaauucc

SEQ ID NO: 1696150 - RNA, 22 nt, Homo sapiens
aaucuagguucaggaagaccac

SEQ ID NO: 1696151 - RNA, 14 nt, Homo sapiens
aaucuaguuuacag

SEQ ID NO: 1696152 - RNA, 15 nt, Homo sapiens
aaucuauccauugaa

SEQ ID NO: 1696153 - RNA, 13 nt, Homo sapiens
aaucuauucugug

SEQ ID NO: 1696154 - RNA, 18 nt, Homo sapiens
aaucucaccccaucccac

SEQ ID NO: 1696155 - RNA, 15 nt, Homo sapiens
aaucucccacuccag

SEQ ID NO: 1696156 - RNA, 23 nt, Homo sapiens
aaucuccucuuuuagcugaugaa

SEQ ID NO: 1696157 - RNA, 20 nt, Homo sapiens
aaucucuguuauguacugua

SEQ ID NO: 1696158 - RNA, 21 nt, Homo sapiens
aaucugaagaagaaaugaaua

SEQ ID NO: 1696159 - RNA, 23 nt, Homo sapiens
aaucugucccugagagugucucu

SEQ ID NO: 1696160 - RNA, 18 nt, Homo sapiens
aaucuuuuacaacugccu

SEQ ID NO: 1696161 - RNA, 20 nt, Homo sapiens
aaugaaaauaagugaauaau

SEQ ID NO: 1696162 - RNA, 22 nt, Homo sapiens
aaugaacacucuuuugcuuuau

SEQ ID NO: 1696163 - RNA, 14 nt, Homo sapiens
aaugaaccacaaaa

SEQ ID NO: 1696164 - RNA, 19 nt, Homo sapiens
aaugaacuaauaauagcau

SEQ ID NO: 1696165 - RNA, 15 nt, Homo sapiens
aaugaaugacauuga

SEQ ID NO: 1696166 - RNA, 14 nt, Homo sapiens
aaugacauagccau

SEQ ID NO: 1696167 - RNA, 20 nt, Homo sapiens
aaugacaucucaggggccag

SEQ ID NO: 1696168 - RNA, 20 nt, Homo sapiens
aaugagaaggcagccaccag

SEQ ID NO: 1696169 - RNA, 18 nt, Homo sapiens
aaugagcacccauuccaa

SEQ ID NO: 1696170 - RNA, 15 nt, Homo sapiens
aaugaggacauguuu

SEQ ID NO: 1696171 - RNA, 22 nt, Homo sapiens
aaugaggauuauugauaguacu

SEQ ID NO: 1696172 - RNA, 20 nt, Homo sapiens
aaugaucagcaucugugaug

SEQ ID NO: 1696173 - RNA, 17 nt, Homo sapiens
aaugcaccuagcugugc

SEQ ID NO: 1696174 - RNA, 22 nt, Homo sapiens
aaugcaccuagcugugcaagac

SEQ ID NO: 1696175 - RNA, 15 nt, Homo sapiens
aaugcauagcauuau

SEQ ID NO: 1696176 - RNA, 16 nt, Homo sapiens
aaugcauugcuaaaau

SEQ ID NO: 1696177 - RNA, 20 nt, Homo sapiens
aaugccaaucuucaguauuu

SEQ ID NO: 1696178 - RNA, 13 nt, Homo sapiens
aaugccagcauaa

SEQ ID NO: 1696179 - RNA, 23 nt, Homo sapiens
aaugccagcauaaauccauccau

SEQ ID NO: 1696180 - RNA, 19 nt, Homo sapiens
aaugcuacugucucacuga

SEQ ID NO: 1696181 - RNA, 12 nt, Homo sapiens
aaugcugcacuu

SEQ ID NO: 1696182 - RNA, 17 nt, Homo sapiens
aaugcuggcauuugcac

SEQ ID NO: 1696183 - RNA, 22 nt, Homo sapiens
aaugcuucagauauuauugcuu

SEQ ID NO: 1696184 - RNA, 17 nt, Homo sapiens
aaugcuucauaugagga

SEQ ID NO: 1696185 - RNA, 14 nt, Homo sapiens
aauggacuuuggaa

SEQ ID NO: 1696186 - RNA, 20 nt, Homo sapiens
aauggcaaguuuugauauga

SEQ ID NO: 1696187 - RNA, 24 nt, Homo sapiens
aaugggaauauuuuauacugacag

SEQ ID NO: 1696188 - RNA, 15 nt, Homo sapiens
aauggggaauucucu

SEQ ID NO: 1696189 - RNA, 14 nt, Homo sapiens
aaugggugauaucc

SEQ ID NO: 1696190 - RNA, 20 nt, Homo sapiens
aaugggugauauccugaaaa

SEQ ID NO: 1696191 - RNA, 14 nt, Homo sapiens
aauguaucugugaa

SEQ ID NO: 1696192 - RNA, 17 nt, Homo sapiens
aaugucaggaacagaag

SEQ ID NO: 1696193 - RNA, 13 nt, Homo sapiens
aauguccauuuau

SEQ ID NO: 1696194 - RNA, 21 nt, Homo sapiens
aaugucuuuugaauauuccca

SEQ ID NO: 1696195 - RNA, 12 nt, Homo sapiens
aaugugaacuua

SEQ ID NO: 1696196 - RNA, 18 nt, Homo sapiens
aauguggacucaaucccu

SEQ ID NO: 1696197 - RNA, 16 nt, Homo sapiens
aauguuuaaagaucau

SEQ ID NO: 1696198 - RNA, 20 nt, Homo sapiens
aauguuuucuucaucuguga

SEQ ID NO: 1696199 - RNA, 22 nt, Homo sapiens
aauuauacagauagaguuccau

SEQ ID NO: 1696200 - RNA, 14 nt, Homo sapiens
aauuauaguuucaa

SEQ ID NO: 1696201 - RNA, 19 nt, Homo sapiens
aauucaaaaguuccaagag

SEQ ID NO: 1696202 - RNA, 13 nt, Homo sapiens
aauucaaacuggg

SEQ ID NO: 1696203 - RNA, 22 nt, Homo sapiens
aauucacucaagcacugauauc

SEQ ID NO: 1696204 - RNA, 15 nt, Homo sapiens
aauucagaugcuguu

SEQ ID NO: 1696205 - RNA, 13 nt, Homo sapiens
aauucauauucuu

SEQ ID NO: 1696206 - RNA, 22 nt, Homo sapiens
aauuccacaccuuuuauugaca

SEQ ID NO: 1696207 - RNA, 13 nt, Homo sapiens
aauuccuuugugu

SEQ ID NO: 1696208 - RNA, 19 nt, Homo sapiens
aauucgugauuuucaagca

SEQ ID NO: 1696209 - RNA, 18 nt, Homo sapiens
aauucuaaagagcacuua

SEQ ID NO: 1696210 - RNA, 21 nt, Homo sapiens
aauucuuacccuguacauaug

SEQ ID NO: 1696211 - RNA, 13 nt, Homo sapiens
aauugacaaugau

SEQ ID NO: 1696212 - RNA, 13 nt, Homo sapiens
aauugacaugugc

SEQ ID NO: 1696213 - RNA, 21 nt, Homo sapiens
aauugauucuuagacauugca

SEQ ID NO: 1696214 - RNA, 11 nt, Homo sapiens
aauugcucaag

SEQ ID NO: 1696215 - RNA, 17 nt, Homo sapiens
aauuggccgcugucacu

SEQ ID NO: 1696216 - RNA, 20 nt, Homo sapiens
aauugggaguccaggcacag

SEQ ID NO: 1696217 - RNA, 21 nt, Homo sapiens
aauugucuuuguucugugauu

SEQ ID NO: 1696218 - RNA, 20 nt, Homo sapiens
aauugucuuuugucaugugg

SEQ ID NO: 1696219 - RNA, 19 nt, Homo sapiens
aauugugaacucauugcuc

SEQ ID NO: 1696220 - RNA, 12 nt, Homo sapiens
aauugugcaaau

SEQ ID NO: 1696221 - RNA, 15 nt, Homo sapiens
aauuguuuggggaug

SEQ ID NO: 1696222 - RNA, 15 nt, Homo sapiens
aauuguuuugcacuu

SEQ ID NO: 1696223 - RNA, 20 nt, Homo sapiens
aauuucaaaaauauaacuua

SEQ ID NO: 1696224 - RNA, 20 nt, Homo sapiens
aauuucaccaccaaaugcca

SEQ ID NO: 1696225 - RNA, 19 nt, Homo sapiens
aauuucuaaaaaacagagg

SEQ ID NO: 1696226 - RNA, 13 nt, Homo sapiens
aucaaggugcuga

SEQ ID NO: 1696227 - RNA, 17 nt, Homo sapiens
aucaaguccuuuaauua

SEQ ID NO: 1696228 - RNA, 21 nt, Homo sapiens
aucaaugcaagagugauugca

SEQ ID NO: 1696229 - RNA, 15 nt, Homo sapiens
aucacaaauuucacu

SEQ ID NO: 1696230 - RNA, 22 nt, Homo sapiens
aucacacucauaacucauuguc

SEQ ID NO: 1696231 - RNA, 20 nt, Homo sapiens
aucacccucuuccugugauc

SEQ ID NO: 1696232 - RNA, 17 nt, Homo sapiens
aucacgcagaucacuaa

SEQ ID NO: 1696233 - RNA, 14 nt, Homo sapiens
aucacgccuggcua

SEQ ID NO: 1696234 - RNA, 17 nt, Homo sapiens
aucacgcgcacagccug

SEQ ID NO: 1696235 - RNA, 23 nt, Homo sapiens
aucacggcucacugcagccucaa

SEQ ID NO: 1696236 - RNA, 21 nt, Homo sapiens
aucacgucacugcacuccagc

SEQ ID NO: 1696237 - RNA, 23 nt, Homo sapiens
aucacuccccaaggaagagccaa

SEQ ID NO: 1696238 - RNA, 12 nt, Homo sapiens
aucacugaauuu

SEQ ID NO: 1696239 - RNA, 19 nt, Homo sapiens
aucacugccacacucucca

SEQ ID NO: 1696240 - RNA, 22 nt, Homo sapiens
aucacugccacacucuccauca

SEQ ID NO: 1696241 - RNA, 19 nt, Homo sapiens
aucacuucauucacauuca

SEQ ID NO: 1696242 - RNA, 17 nt, Homo sapiens
aucagcaaccugacuca

SEQ ID NO: 1696243 - RNA, 14 nt, Homo sapiens
aucagcacauauuu

SEQ ID NO: 1696244 - RNA, 11 nt, Homo sapiens
aucagccagga

SEQ ID NO: 1696245 - RNA, 15 nt, Homo sapiens
aucagggacaggaug

SEQ ID NO: 1696246 - RNA, 12 nt, Homo sapiens
aucaggucuccc

SEQ ID NO: 1696247 - RNA, 14 nt, Homo sapiens
aucauacuuccauc

SEQ ID NO: 1696248 - RNA, 20 nt, Homo sapiens
aucaucaaagcucacaccaa

SEQ ID NO: 1696249 - RNA, 23 nt, Homo sapiens
aucaucaaagcucacaccaaauu

SEQ ID NO: 1696250 - RNA, 19 nt, Homo sapiens
aucaucaacaagauuuccu

SEQ ID NO: 1696251 - RNA, 23 nt, Homo sapiens
aucaucacauugagcugauauaa

SEQ ID NO: 1696252 - RNA, 15 nt, Homo sapiens
aucauuugaggaaua

SEQ ID NO: 1696253 - RNA, 14 nt, Homo sapiens
auccaacauccaga

SEQ ID NO: 1696254 - RNA, 13 nt, Homo sapiens
auccaacuccagc

SEQ ID NO: 1696255 - RNA, 19 nt, Homo sapiens
auccaccaagaacauaaga

SEQ ID NO: 1696256 - RNA, 24 nt, Homo sapiens
auccaccacugcuuaagugccuau

SEQ ID NO: 1696257 - RNA, 21 nt, Homo sapiens
auccacccaacccuaucuccu

SEQ ID NO: 1696258 - RNA, 22 nt, Homo sapiens
auccacccaacccuaucuccug

SEQ ID NO: 1696259 - RNA, 14 nt, Homo sapiens
auccacccaccuca

SEQ ID NO: 1696260 - RNA, 15 nt, Homo sapiens
auccacugugccaug

SEQ ID NO: 1696261 - RNA, 14 nt, Homo sapiens
auccagaacugcac

SEQ ID NO: 1696262 - RNA, 17 nt, Homo sapiens
auccagaacugcacucu

SEQ ID NO: 1696263 - RNA, 14 nt, Homo sapiens
auccaggcuuugua

SEQ ID NO: 1696264 - RNA, 13 nt, Homo sapiens
auccauccaaagg

SEQ ID NO: 1696265 - RNA, 16 nt, Homo sapiens
auccauuaaaaauggg

SEQ ID NO: 1696266 - RNA, 15 nt, Homo sapiens
auccauugaacuaaa

SEQ ID NO: 1696267 - RNA, 12 nt, Homo sapiens
aucccaaccagu

SEQ ID NO: 1696268 - RNA, 13 nt, Homo sapiens
aucccaacuuccu

SEQ ID NO: 1696269 - RNA, 16 nt, Homo sapiens
aucccagcaccugccu

SEQ ID NO: 1696270 - RNA, 14 nt, Homo sapiens
aucccagcuacuca

SEQ ID NO: 1696271 - RNA, 15 nt, Homo sapiens
aucccaugagccuca

SEQ ID NO: 1696272 - RNA, 15 nt, Homo sapiens
aucccauguauuuau

SEQ ID NO: 1696273 - RNA, 18 nt, Homo sapiens
auccccaagugugaacaa

SEQ ID NO: 1696274 - RNA, 18 nt, Homo sapiens
aucccccaaaaugcauuu

SEQ ID NO: 1696275 - RNA, 12 nt, Homo sapiens
auccccugcuac

SEQ ID NO: 1696276 - RNA, 17 nt, Homo sapiens
auccccuggacugggag

SEQ ID NO: 1696277 - RNA, 17 nt, Homo sapiens
aucccgaagaauggaga

SEQ ID NO: 1696278 - RNA, 21 nt, Homo sapiens
aucccgaagaauggagaggaa

SEQ ID NO: 1696279 - RNA, 18 nt, Homo sapiens
aucccuucucacagcaca

SEQ ID NO: 1696280 - RNA, 19 nt, Homo sapiens
auccgaaguaugagggaaa

SEQ ID NO: 1696281 - RNA, 15 nt, Homo sapiens
auccuaagacacaaa

SEQ ID NO: 1696282 - RNA, 21 nt, Homo sapiens
auccuaccccuuugcacuugu

SEQ ID NO: 1696283 - RNA, 15 nt, Homo sapiens
auccugcaucugggu

SEQ ID NO: 1696284 - RNA, 23 nt, Homo sapiens
auccugccauccuugacuuugaa

SEQ ID NO: 1696285 - RNA, 17 nt, Homo sapiens
auccugugacugucuca

SEQ ID NO: 1696286 - RNA, 18 nt, Homo sapiens
auccuuaacacauucaau

SEQ ID NO: 1696287 - RNA, 18 nt, Homo sapiens
auccuucuccaccaaaga

SEQ ID NO: 1696288 - RNA, 22 nt, Homo sapiens
auccuucuccaccaaagacagu

SEQ ID NO: 1696289 - RNA, 18 nt, Homo sapiens
auccuucuggcagauuca

SEQ ID NO: 1696290 - RNA, 13 nt, Homo sapiens
aucgaacuucaca

SEQ ID NO: 1696291 - RNA, 16 nt, Homo sapiens
aucggccuccaugacc

SEQ ID NO: 1696292 - RNA, 13 nt, Homo sapiens
aucuaaaucuuca

SEQ ID NO: 1696293 - RNA, 22 nt, Homo sapiens
aucuaauauggccacaguaguc

SEQ ID NO: 1696294 - RNA, 16 nt, Homo sapiens
aucuaaugugaaguag

SEQ ID NO: 1696295 - RNA, 15 nt, Homo sapiens
aucuagguucaggaa

SEQ ID NO: 1696296 - RNA, 16 nt, Homo sapiens
aucuaguacuucccag

SEQ ID NO: 1696297 - RNA, 18 nt, Homo sapiens
aucuagugcuagauguau

SEQ ID NO: 1696298 - RNA, 13 nt, Homo sapiens
aucuauacauacc

SEQ ID NO: 1696299 - RNA, 19 nt, Homo sapiens
aucuauagcuaaguacaca

SEQ ID NO: 1696300 - RNA, 12 nt, Homo sapiens
aucuauuccugc

SEQ ID NO: 1696301 - RNA, 23 nt, Homo sapiens
aucuauuccugccaccacugggc

SEQ ID NO: 1696302 - RNA, 15 nt, Homo sapiens
aucuauuucacuuau

SEQ ID NO: 1696303 - RNA, 18 nt, Homo sapiens
aucuauuuugaugcagca

SEQ ID NO: 1696304 - RNA, 15 nt, Homo sapiens
aucucaauaacaaac

SEQ ID NO: 1696305 - RNA, 16 nt, Homo sapiens
aucucaccccauccca

SEQ ID NO: 1696306 - RNA, 21 nt, Homo sapiens
aucucacuggaugcaaagaaa

SEQ ID NO: 1696307 - RNA, 15 nt, Homo sapiens
aucucagccuaccau

SEQ ID NO: 1696308 - RNA, 18 nt, Homo sapiens
aucuccuauaaucuguca

SEQ ID NO: 1696309 - RNA, 13 nt, Homo sapiens
aucucugacuuaa

SEQ ID NO: 1696310 - RNA, 20 nt, Homo sapiens
aucucugguuuugcuuuguu

SEQ ID NO: 1696311 - RNA, 19 nt, Homo sapiens
aucucuguuauguacugua

SEQ ID NO: 1696312 - RNA, 20 nt, Homo sapiens
aucucuguuauguacuguac

SEQ ID NO: 1696313 - RNA, 20 nt, Homo sapiens
aucugaguugccaagacaaa

SEQ ID NO: 1696314 - RNA, 23 nt, Homo sapiens
aucugaguugccaagacaaauca

SEQ ID NO: 1696315 - RNA, 14 nt, Homo sapiens
aucugcaauucaaa

SEQ ID NO: 1696316 - RNA, 21 nt, Homo sapiens
aucugccaacuguccuacuca

SEQ ID NO: 1696317 - RNA, 20 nt, Homo sapiens
aucuggacauucgaggaauu

SEQ ID NO: 1696318 - RNA, 18 nt, Homo sapiens
aucuggcccucgacacuc

SEQ ID NO: 1696319 - RNA, 17 nt, Homo sapiens
aucuggguucacugcaa

SEQ ID NO: 1696320 - RNA, 22 nt, Homo sapiens
aucugguauauguaaguguuca

SEQ ID NO: 1696321 - RNA, 16 nt, Homo sapiens
aucuguggucuucaaa

SEQ ID NO: 1696322 - RNA, 20 nt, Homo sapiens
aucugugucaaaagccagau

SEQ ID NO: 1696323 - RNA, 15 nt, Homo sapiens
aucuguucuugcuac

SEQ ID NO: 1696324 - RNA, 16 nt, Homo sapiens
aucuuaagauccacaa

SEQ ID NO: 1696325 - RNA, 12 nt, Homo sapiens
aucuuacuguac

SEQ ID NO: 1696326 - RNA, 17 nt, Homo sapiens
aucuuagggugaaccac

SEQ ID NO: 1696327 - RNA, 18 nt, Homo sapiens
aucuuauagcacuuugaa

SEQ ID NO: 1696328 - RNA, 15 nt, Homo sapiens
aucuuauuuaggaag

SEQ ID NO: 1696329 - RNA, 18 nt, Homo sapiens
aucuucacugucugacuu

SEQ ID NO: 1696330 - RNA, 24 nt, Homo sapiens
aucuucagcucuuuuuguggauau

SEQ ID NO: 1696331 - RNA, 18 nt, Homo sapiens
aucuuccaaaugcaauuu

SEQ ID NO: 1696332 - RNA, 13 nt, Homo sapiens
aucuucugaauuu

SEQ ID NO: 1696333 - RNA, 15 nt, Homo sapiens
aucuucugccuuagu

SEQ ID NO: 1696334 - RNA, 22 nt, Homo sapiens
aucuugaaauuaagaaggcaaa

SEQ ID NO: 1696335 - RNA, 20 nt, Homo sapiens
aucuuggagacccugcaaac

SEQ ID NO: 1696336 - RNA, 16 nt, Homo sapiens
auugaaagaaccagag

SEQ ID NO: 1696337 - RNA, 15 nt, Homo sapiens
auugaacacaaacug

SEQ ID NO: 1696338 - RNA, 22 nt, Homo sapiens
auugacacagaaaauguugaga

SEQ ID NO: 1696339 - RNA, 24 nt, Homo sapiens
auugacaugugccagggcaaugau

SEQ ID NO: 1696340 - RNA, 20 nt, Homo sapiens
auugagcagaagaucaagga

SEQ ID NO: 1696341 - RNA, 15 nt, Homo sapiens
auugaggcccugcug

SEQ ID NO: 1696342 - RNA, 15 nt, Homo sapiens
auugauuaaugaacu

SEQ ID NO: 1696343 - RNA, 22 nt, Homo sapiens
auugauuaaugaacuauuguua

SEQ ID NO: 1696344 - RNA, 22 nt, Homo sapiens
auugcagcuagaggcaucuucu

SEQ ID NO: 1696345 - RNA, 18 nt, Homo sapiens
auugcuaaucaccaaagg

SEQ ID NO: 1696346 - RNA, 17 nt, Homo sapiens
auugcuaugaaugauac

SEQ ID NO: 1696347 - RNA, 18 nt, Homo sapiens
auugcuucaauaauauua

SEQ ID NO: 1696348 - RNA, 15 nt, Homo sapiens
auugcuuuuaugaua

SEQ ID NO: 1696349 - RNA, 19 nt, Homo sapiens
auugcuuuuuuaaauauua

SEQ ID NO: 1696350 - RNA, 19 nt, Homo sapiens
auuggaacagaauguuuua

SEQ ID NO: 1696351 - RNA, 16 nt, Homo sapiens
auuggaaucugauaua

SEQ ID NO: 1696352 - RNA, 13 nt, Homo sapiens
auuggcacugugg

SEQ ID NO: 1696353 - RNA, 15 nt, Homo sapiens
auuggcugaguccau

SEQ ID NO: 1696354 - RNA, 13 nt, Homo sapiens
auugguccaagau

SEQ ID NO: 1696355 - RNA, 14 nt, Homo sapiens
auuguaaacaugug

SEQ ID NO: 1696356 - RNA, 18 nt, Homo sapiens
auuguaacaauagcacaa

SEQ ID NO: 1696357 - RNA, 14 nt, Homo sapiens
auuguacauaaaag

SEQ ID NO: 1696358 - RNA, 24 nt, Homo sapiens
auugucaugguuacaaacuacaga

SEQ ID NO: 1696359 - RNA, 20 nt, Homo sapiens
auugugaaugauucauguua

SEQ ID NO: 1696360 - RNA, 15 nt, Homo sapiens
auugugagccaccac

SEQ ID NO: 1696361 - RNA, 22 nt, Homo sapiens
auugugcuccuucggauaugau

SEQ ID NO: 1696362 - RNA, 17 nt, Homo sapiens
auugugcugauugugga

SEQ ID NO: 1696363 - RNA, 13 nt, Homo sapiens
auugugcugccau

SEQ ID NO: 1696364 - RNA, 21 nt, Homo sapiens
auuguggaucuuuucauucuc

SEQ ID NO: 1696365 - RNA, 23 nt, Homo sapiens
auugugguuuauugaaugugauu

SEQ ID NO: 1696366 - RNA, 16 nt, Homo sapiens
auuguuaucuaucaac

SEQ ID NO: 1696367 - RNA, 17 nt, Homo sapiens
auuguucaaagcacaga

SEQ ID NO: 1696368 - RNA, 18 nt, Homo sapiens
auuguucaaagcacagaa

SEQ ID NO: 1696369 - RNA, 17 nt, Homo sapiens
auuguugacaacuguga

SEQ ID NO: 1696370 - RNA, 19 nt, Homo sapiens
auuguugacaacugugacu

SEQ ID NO: 1696371 - RNA, 21 nt, Homo sapiens
auuguugaugggcacuugaga

SEQ ID NO: 1696372 - RNA, 15 nt, Homo sapiens
auuuaaaauucaauu

SEQ ID NO: 1696373 - RNA, 23 nt, Homo sapiens
auuuaaauguguacaauguacac

SEQ ID NO: 1696374 - RNA, 20 nt, Homo sapiens
auuuaacaugaacacccuua

SEQ ID NO: 1696375 - RNA, 12 nt, Homo sapiens
auuuaagcacaa

SEQ ID NO: 1696376 - RNA, 12 nt, Homo sapiens
auuuaauaacau

SEQ ID NO: 1696377 - RNA, 19 nt, Homo sapiens
auuuaaugaauacuugcua

SEQ ID NO: 1696378 - RNA, 13 nt, Homo sapiens
auuuaaugcugcc

SEQ ID NO: 1696379 - RNA, 15 nt, Homo sapiens
auuuaauuuccaggg

SEQ ID NO: 1696380 - RNA, 12 nt, Homo sapiens
auuuagaacuug

SEQ ID NO: 1696381 - RNA, 21 nt, Homo sapiens
auuuagacucaucuuacugua

SEQ ID NO: 1696382 - RNA, 12 nt, Homo sapiens
auuuaucaagga

SEQ ID NO: 1696383 - RNA, 15 nt, Homo sapiens
auuuaugaaguuuaa

SEQ ID NO: 1696384 - RNA, 22 nt, Homo sapiens
auuuaugaugcacuuauucaau

SEQ ID NO: 1696385 - RNA, 22 nt, Homo sapiens
auuuaugugaguguguguuugu

SEQ ID NO: 1696386 - RNA, 15 nt, Homo sapiens
auuuauuaacaggau

SEQ ID NO: 1696387 - RNA, 13 nt, Homo sapiens
auuuauucugcuc

SEQ ID NO: 1696388 - RNA, 14 nt, Homo sapiens
auuuauugagcacc

SEQ ID NO: 1696389 - RNA, 16 nt, Homo sapiens
auuuauuuucaauuaa

SEQ ID NO: 1696390 - RNA, 18 nt, Homo sapiens
auuuauuuuccuaaagag

SEQ ID NO: 1696391 - RNA, 19 nt, Homo sapiens
auuucaaaugugcugucaa

SEQ ID NO: 1696392 - RNA, 15 nt, Homo sapiens
auuucaccaccaaau

SEQ ID NO: 1696393 - RNA, 18 nt, Homo sapiens
auuucagauauuccaggu

SEQ ID NO: 1696394 - RNA, 15 nt, Homo sapiens
auuucagcagggaug

SEQ ID NO: 1696395 - RNA, 15 nt, Homo sapiens
auuuccaacaccaca

SEQ ID NO: 1696396 - RNA, 16 nt, Homo sapiens
auuuccaacaccacag

SEQ ID NO: 1696397 - RNA, 23 nt, Homo sapiens
auuuccaagcacuuucaguccaa

SEQ ID NO: 1696398 - RNA, 21 nt, Homo sapiens
auuuccacaaaaucuguccaa

SEQ ID NO: 1696399 - RNA, 19 nt, Homo sapiens
auuuccagagccagcucaa

SEQ ID NO: 1696400 - RNA, 15 nt, Homo sapiens
auuuccuccucaucu

SEQ ID NO: 1696401 - RNA, 14 nt, Homo sapiens
auuuccuguucccu

SEQ ID NO: 1696402 - RNA, 20 nt, Homo sapiens
auuucugucagaaugcuauu

SEQ ID NO: 1696403 - RNA, 17 nt, Homo sapiens
auuucuuuucuggccaa

SEQ ID NO: 1696404 - RNA, 20 nt, Homo sapiens
auuugaaaacauaaucugca

SEQ ID NO: 1696405 - RNA, 16 nt, Homo sapiens
auuugauacauaauaa

SEQ ID NO: 1696406 - RNA, 23 nt, Homo sapiens
auuugauucuccagccaaccuca

SEQ ID NO: 1696407 - RNA, 16 nt, Homo sapiens
auuugcacuaaaucag

SEQ ID NO: 1696408 - RNA, 23 nt, Homo sapiens
auuugcauuugcucuuucaucuc

SEQ ID NO: 1696409 - RNA, 15 nt, Homo sapiens
auuugcuagcaguaa

SEQ ID NO: 1696410 - RNA, 18 nt, Homo sapiens
auuugcucuuucaucucu

SEQ ID NO: 1696411 - RNA, 15 nt, Homo sapiens
auuugcuuuuugcua

SEQ ID NO: 1696412 - RNA, 17 nt, Homo sapiens
auuuguaauugaacuua

SEQ ID NO: 1696413 - RNA, 14 nt, Homo sapiens
auuuguuucaaugg

SEQ ID NO: 1696414 - RNA, 16 nt, Homo sapiens
auuuguuugcaauuuu

SEQ ID NO: 1696415 - RNA, 18 nt, Homo sapiens
auuuuaaagacucaaggu

SEQ ID NO: 1696416 - RNA, 19 nt, Homo sapiens
auuuuaaguaacauaacua

SEQ ID NO: 1696417 - RNA, 18 nt, Homo sapiens
auuuuacaggugcgaaug

SEQ ID NO: 1696418 - RNA, 12 nt, Homo sapiens
auuuuaccauac

SEQ ID NO: 1696419 - RNA, 17 nt, Homo sapiens
auuuuacccuuuagacu

SEQ ID NO: 1696420 - RNA, 23 nt, Homo sapiens
auuuuaguauucauucugcauug

SEQ ID NO: 1696421 - RNA, 21 nt, Homo sapiens
auuuuaugcuggacucuggac

SEQ ID NO: 1696422 - RNA, 19 nt, Homo sapiens
auuuucaacauaacugaag

SEQ ID NO: 1696423 - RNA, 21 nt, Homo sapiens
auuuucacuagguuugaauga

SEQ ID NO: 1696424 - RNA, 15 nt, Homo sapiens
auuuucagccuacag

SEQ ID NO: 1696425 - RNA, 16 nt, Homo sapiens
auuuucauguauaugu

SEQ ID NO: 1696426 - RNA, 15 nt, Homo sapiens
auuuucauucauuca

SEQ ID NO: 1696427 - RNA, 18 nt, Homo sapiens
auuuuccccuagcuuucc

SEQ ID NO: 1696428 - RNA, 14 nt, Homo sapiens
auuuucuacaauua

SEQ ID NO: 1696429 - RNA, 11 nt, Homo sapiens
auuuucuugcu

SEQ ID NO: 1696430 - RNA, 14 nt, Homo sapiens
auuuugaaguuuac

SEQ ID NO: 1696431 - RNA, 20 nt, Homo sapiens
auuuugagaucaucagugau

SEQ ID NO: 1696432 - RNA, 16 nt, Homo sapiens
auuuugcaccuguaaa

SEQ ID NO: 1696433 - RNA, 14 nt, Homo sapiens
auuuuggcgcuauu

SEQ ID NO: 1696434 - RNA, 18 nt, Homo sapiens
auuuugggguaagacuuu

SEQ ID NO: 1696435 - RNA, 21 nt, Homo sapiens
auuuugggguuguguugucac

SEQ ID NO: 1696436 - RNA, 16 nt, Homo sapiens
auuuuggucacagggu

SEQ ID NO: 1696437 - RNA, 15 nt, Homo sapiens
auuuuguauuguggu

SEQ ID NO: 1696438 - RNA, 19 nt, Homo sapiens
auuuuguuuuaauccuuaa

SEQ ID NO: 1696439 - RNA, 21 nt, Homo sapiens
auuuuuauacaaaccuaccaa

SEQ ID NO: 1696440 - RNA, 16 nt, Homo sapiens
auuuuucuaucaaaua

SEQ ID NO: 1696441 - RNA, 12 nt, Homo sapiens
auuuuucugcac

SEQ ID NO: 1696442 - RNA, 19 nt, Homo sapiens
auuuuuguagagccagggu

SEQ ID NO: 1696443 - RNA, 14 nt, Homo sapiens
auuuuugucuuaua

SEQ ID NO: 1696444 - RNA, 19 nt, Homo sapiens
auuuuugugaaaaugucaa

SEQ ID NO: 1696445 - RNA, 21 nt, Homo sapiens
auuuuuuacagcugccugcag

SEQ ID NO: 1696446 - RNA, 16 nt, Homo sapiens
cacaguagucuugaug

SEQ ID NO: 1696447 - RNA, 11 nt, Homo sapiens
cacauaccugg

SEQ ID NO: 1696448 - RNA, 13 nt, Homo sapiens
cacauauggacuc

SEQ ID NO: 1696449 - RNA, 22 nt, Homo sapiens
cacauauggacucugcacauga

SEQ ID NO: 1696450 - RNA, 22 nt, Homo sapiens
cacauccgccuuuuguauacau

SEQ ID NO: 1696451 - RNA, 13 nt, Homo sapiens
cacaucugcauuu

SEQ ID NO: 1696452 - RNA, 16 nt, Homo sapiens
cacaugaauauaaaug

SEQ ID NO: 1696453 - RNA, 17 nt, Homo sapiens
cacaugaccugaucacu

SEQ ID NO: 1696454 - RNA, 19 nt, Homo sapiens
cacaugaccugaucacuag

SEQ ID NO: 1696455 - RNA, 15 nt, Homo sapiens
cacaugcacacacac

SEQ ID NO: 1696456 - RNA, 19 nt, Homo sapiens
cacaugcacgugugugcac

SEQ ID NO: 1696457 - RNA, 9 nt, Homo sapiens
cacaugcua

SEQ ID NO: 1696458 - RNA, 18 nt, Homo sapiens
cacaugcuaggaugcgga

SEQ ID NO: 1696459 - RNA, 14 nt, Homo sapiens
cacauggugccccu

SEQ ID NO: 1696460 - RNA, 16 nt, Homo sapiens
cacaugucuuguacau

SEQ ID NO: 1696461 - RNA, 19 nt, Homo sapiens
cacaugucuuguacaugug

SEQ ID NO: 1696462 - RNA, 17 nt, Homo sapiens
cacaugugcacaugcac

SEQ ID NO: 1696463 - RNA, 20 nt, Homo sapiens
cacauuagaauaaaagguag

SEQ ID NO: 1696464 - RNA, 15 nt, Homo sapiens
cacauugugccuuuu

SEQ ID NO: 1696465 - RNA, 13 nt, Homo sapiens
caccacaccauca

SEQ ID NO: 1696466 - RNA, 16 nt, Homo sapiens
caccacaccaucaggc

SEQ ID NO: 1696467 - RNA, 16 nt, Homo sapiens
caccacaccuggcuaa

SEQ ID NO: 1696468 - RNA, 16 nt, Homo sapiens
caccacagacacacac

SEQ ID NO: 1696469 - RNA, 18 nt, Homo sapiens
caccacgguagugccuga

SEQ ID NO: 1696470 - RNA, 16 nt, Homo sapiens
caccauccuauugcaa

SEQ ID NO: 1696471 - RNA, 13 nt, Homo sapiens
cacccaaagcaug

SEQ ID NO: 1696472 - RNA, 22 nt, Homo sapiens
cacccaacccuaucuccugaca

SEQ ID NO: 1696473 - RNA, 20 nt, Homo sapiens
cacccaggcuggaguacagc

SEQ ID NO: 1696474 - RNA, 18 nt, Homo sapiens
cacccaggcuggagugca

SEQ ID NO: 1696475 - RNA, 15 nt, Homo sapiens
cacccaggugauguu

SEQ ID NO: 1696476 - RNA, 20 nt, Homo sapiens
cacccccuucucugcuccac

SEQ ID NO: 1696477 - RNA, 16 nt, Homo sapiens
caccccuguccucacu

SEQ ID NO: 1696478 - RNA, 18 nt, Homo sapiens
cacccucuuccugugauc

SEQ ID NO: 1696479 - RNA, 16 nt, Homo sapiens
cacccuggaggauuuc

SEQ ID NO: 1696480 - RNA, 21 nt, Homo sapiens
cacccuuccccuccuucuccc

SEQ ID NO: 1696481 - RNA, 14 nt, Homo sapiens
caccgacuagccag

SEQ ID NO: 1696482 - RNA, 19 nt, Homo sapiens
caccuaagucucugugaau

SEQ ID NO: 1696483 - RNA, 16 nt, Homo sapiens
caccuagaacacuaac

SEQ ID NO: 1696484 - RNA, 19 nt, Homo sapiens
caccuagaacacuaacuca

SEQ ID NO: 1696485 - RNA, 21 nt, Homo sapiens
caccuagcugugcaagaccua

SEQ ID NO: 1696486 - RNA, 12 nt, Homo sapiens
caccuagcuuua

SEQ ID NO: 1696487 - RNA, 13 nt, Homo sapiens
caccuaugugcca

SEQ ID NO: 1696488 - RNA, 17 nt, Homo sapiens
caccuaugugguccaga

SEQ ID NO: 1696489 - RNA, 12 nt, Homo sapiens
caccuauuucca

SEQ ID NO: 1696490 - RNA, 18 nt, Homo sapiens
caccucaccccguuacag

SEQ ID NO: 1696491 - RNA, 11 nt, Homo sapiens
caccuccucau

SEQ ID NO: 1696492 - RNA, 15 nt, Homo sapiens
caccugacucuugca

SEQ ID NO: 1696493 - RNA, 19 nt, Homo sapiens
caccugccugcgucuuccg

SEQ ID NO: 1696494 - RNA, 21 nt, Homo sapiens
caccugggaaaauaccagaaa

SEQ ID NO: 1696495 - RNA, 14 nt, Homo sapiens
caccugugaguuua

SEQ ID NO: 1696496 - RNA, 13 nt, Homo sapiens
caccuugucacau

SEQ ID NO: 1696497 - RNA, 11 nt, Homo sapiens
caccuugugau

SEQ ID NO: 1696498 - RNA, 15 nt, Homo sapiens
caccuugugucugua

SEQ ID NO: 1696499 - RNA, 17 nt, Homo sapiens
caccuugugucuguaca

SEQ ID NO: 1696500 - RNA, 15 nt, Homo sapiens
caccuuuagguucuu

SEQ ID NO: 1696501 - RNA, 16 nt, Homo sapiens
caccuuugcacaggau

SEQ ID NO: 1696502 - RNA, 17 nt, Homo sapiens
caccuuuuauugacaca

SEQ ID NO: 1696503 - RNA, 13 nt, Homo sapiens
cacgaaacuuguu

SEQ ID NO: 1696504 - RNA, 13 nt, Homo sapiens
cacgaacuggccu

SEQ ID NO: 1696505 - RNA, 12 nt, Homo sapiens
cacgcacgcaca

SEQ ID NO: 1696506 - RNA, 23 nt, Homo sapiens
cacgccgcucuucacugugguca

SEQ ID NO: 1696507 - RNA, 18 nt, Homo sapiens
cacgcggauuaauuugca

SEQ ID NO: 1696508 - RNA, 12 nt, Homo sapiens
cacggggcacag

SEQ ID NO: 1696509 - RNA, 20 nt, Homo sapiens
cacgucacugcacuccagcu

SEQ ID NO: 1696510 - RNA, 13 nt, Homo sapiens
cacguguccugua

SEQ ID NO: 1696511 - RNA, 20 nt, Homo sapiens
cacuaaccaaaucucucaaa

SEQ ID NO: 1696512 - RNA, 16 nt, Homo sapiens
cacuaaccacgcugga

SEQ ID NO: 1696513 - RNA, 20 nt, Homo sapiens
cacuaagaauucaaacuggg

SEQ ID NO: 1696514 - RNA, 16 nt, Homo sapiens
cacuaaggugugcucu

SEQ ID NO: 1696515 - RNA, 17 nt, Homo sapiens
cacuaccguaaaugucc

SEQ ID NO: 1696516 - RNA, 12 nt, Homo sapiens
cacuagcauuuu

SEQ ID NO: 1696517 - RNA, 21 nt, Homo sapiens
cacuauagccuaggugacaga

SEQ ID NO: 1696518 - RNA, 22 nt, Homo sapiens
cacuaugaggaauaauuauuua

SEQ ID NO: 1696519 - RNA, 14 nt, Homo sapiens
cacuauuuacauac

SEQ ID NO: 1696520 - RNA, 14 nt, Homo sapiens
cacucaagcacuga

SEQ ID NO: 1696521 - RNA, 14 nt, Homo sapiens
cacucaggugaaaa

SEQ ID NO: 1696522 - RNA, 14 nt, Homo sapiens
cacuccagugccag

SEQ ID NO: 1696523 - RNA, 14 nt, Homo sapiens
cacucccaguccaa

SEQ ID NO: 1696524 - RNA, 14 nt, Homo sapiens
cacuccugaacccc

SEQ ID NO: 1696525 - RNA, 13 nt, Homo sapiens
cacucuacccuau

SEQ ID NO: 1696526 - RNA, 14 nt, Homo sapiens
cacucugaaacuga

SEQ ID NO: 1696527 - RNA, 13 nt, Homo sapiens
cacucugccaggg

SEQ ID NO: 1696528 - RNA, 12 nt, Homo sapiens
cacucugucauc

SEQ ID NO: 1696529 - RNA, 22 nt, Homo sapiens
cacucuuauugcccacgcugga

SEQ ID NO: 1696530 - RNA, 18 nt, Homo sapiens
cacugaaaauaccaucag

SEQ ID NO: 1696531 - RNA, 17 nt, Homo sapiens
cacugaggaccagccau

SEQ ID NO: 1696532 - RNA, 21 nt, Homo sapiens
cacugcaccgggccacagaga

SEQ ID NO: 1696533 - RNA, 21 nt, Homo sapiens
cacugcacucaaccuuaagac

SEQ ID NO: 1696534 - RNA, 13 nt, Homo sapiens
cacugcacuccag

SEQ ID NO: 1696535 - RNA, 15 nt, Homo sapiens
cacugcacuccagcu

SEQ ID NO: 1696536 - RNA, 17 nt, Homo sapiens
cacugccauggggccau

SEQ ID NO: 1696537 - RNA, 22 nt, Homo sapiens
cacugggaugagccgcugugag

SEQ ID NO: 1696538 - RNA, 11 nt, Homo sapiens
cacuguacaag

SEQ ID NO: 1696539 - RNA, 18 nt, Homo sapiens
cacuguaccgacuuugau

SEQ ID NO: 1696540 - RNA, 14 nt, Homo sapiens
cacuguccugacca

SEQ ID NO: 1696541 - RNA, 19 nt, Homo sapiens
cacuguuaauauucuauua

SEQ ID NO: 1696542 - RNA, 23 nt, Homo sapiens
cacuguuacuuucguacauuggc

SEQ ID NO: 1696543 - RNA, 13 nt, Homo sapiens
cacuguuagcuuu

SEQ ID NO: 1696544 - RNA, 16 nt, Homo sapiens
cacuguugauguaucu

SEQ ID NO: 1696545 - RNA, 18 nt, Homo sapiens
cacuguuucuugcuugua

SEQ ID NO: 1696546 - RNA, 13 nt, Homo sapiens
cacuuacagaauu

SEQ ID NO: 1696547 - RNA, 15 nt, Homo sapiens
cacuuacagaauuau

SEQ ID NO: 1696548 - RNA, 12 nt, Homo sapiens
cacuucaucuga

SEQ ID NO: 1696549 - RNA, 12 nt, Homo sapiens
cacuuccagugu

SEQ ID NO: 1696550 - RNA, 21 nt, Homo sapiens
cacuucuuguuccccacugac

SEQ ID NO: 1696551 - RNA, 18 nt, Homo sapiens
cacuuugaaauaccucau

SEQ ID NO: 1696552 - RNA, 15 nt, Homo sapiens
cacuuuguccauuug

SEQ ID NO: 1696553 - RNA, 22 nt, Homo sapiens
cagaaacuagaaaugugaauga

SEQ ID NO: 1696554 - RNA, 16 nt, Homo sapiens
cagaaagcauccuaaa

SEQ ID NO: 1696555 - RNA, 17 nt, Homo sapiens
cagaaagggaacagaaa

SEQ ID NO: 1696556 - RNA, 16 nt, Homo sapiens
cagaaauccugcaaug

SEQ ID NO: 1696557 - RNA, 20 nt, Homo sapiens
cagaacaagaccccgucuca

SEQ ID NO: 1696558 - RNA, 15 nt, Homo sapiens
cccagacuacuauuu

SEQ ID NO: 1696559 - RNA, 15 nt, Homo sapiens
cccagagcagggugu

SEQ ID NO: 1696560 - RNA, 16 nt, Homo sapiens
cccagagucaucugau

SEQ ID NO: 1696561 - RNA, 22 nt, Homo sapiens
cccagagugcugggauuacaau

SEQ ID NO: 1696562 - RNA, 15 nt, Homo sapiens
cccagcccaaagggg

SEQ ID NO: 1696563 - RNA, 17 nt, Homo sapiens
cccaggaccaagccaca

SEQ ID NO: 1696564 - RNA, 16 nt, Homo sapiens
cccaggacggggcaca

SEQ ID NO: 1696565 - RNA, 21 nt, Homo sapiens
cccaggcccugcucuuccuca

SEQ ID NO: 1696566 - RNA, 19 nt, Homo sapiens
cccagucuggaaugcagug

SEQ ID NO: 1696567 - RNA, 11 nt, Homo sapiens
cccagugccua

SEQ ID NO: 1696568 - RNA, 22 nt, Homo sapiens
cccaguuugauaccugcacugu

SEQ ID NO: 1696569 - RNA, 17 nt, Homo sapiens
cccauagaaacaugaca

SEQ ID NO: 1696570 - RNA, 21 nt, Homo sapiens
cccauagaaacaugacacuga

SEQ ID NO: 1696571 - RNA, 12 nt, Homo sapiens
cccaucaccucu

SEQ ID NO: 1696572 - RNA, 21 nt, Homo sapiens
cccauccuucuccaccaaaga

SEQ ID NO: 1696573 - RNA, 18 nt, Homo sapiens
cccauuccaaagcuuuau

SEQ ID NO: 1696574 - RNA, 22 nt, Homo sapiens
cccauugaaacaaaacauugau

SEQ ID NO: 1696575 - RNA, 23 nt, Homo sapiens
cccauugguguugucauuguaaa

SEQ ID NO: 1696576 - RNA, 17 nt, Homo sapiens
ccccaacuaguagcuaa

SEQ ID NO: 1696577 - RNA, 12 nt, Homo sapiens
ccccaacuugag

SEQ ID NO: 1696578 - RNA, 19 nt, Homo sapiens
ccccaaguagucugcucac

SEQ ID NO: 1696579 - RNA, 14 nt, Homo sapiens
ccccacaacuuuaa

SEQ ID NO: 1696580 - RNA, 13 nt, Homo sapiens
ccccacacagcua

SEQ ID NO: 1696581 - RNA, 21 nt, Homo sapiens
ccccaccugggacccuugaga

SEQ ID NO: 1696582 - RNA, 23 nt, Homo sapiens
ccccacgagggucaggacuguga

SEQ ID NO: 1696583 - RNA, 10 nt, Homo sapiens
ccccagagau

SEQ ID NO: 1696584 - RNA, 15 nt, Homo sapiens
ccccagcaguugaau

SEQ ID NO: 1696585 - RNA, 17 nt, Homo sapiens
ccccagccccuagccca

SEQ ID NO: 1696586 - RNA, 12 nt, Homo sapiens
ccccagcucaau

SEQ ID NO: 1696587 - RNA, 14 nt, Homo sapiens
ccccaguccaugcu

SEQ ID NO: 1696588 - RNA, 21 nt, Homo sapiens
ccccauccuucuccaccaaag

SEQ ID NO: 1696589 - RNA, 18 nt, Homo sapiens
ccccaugccuguccagcc

SEQ ID NO: 1696590 - RNA, 21 nt, Homo sapiens
ccccauuuccuccucaucuga

SEQ ID NO: 1696591 - RNA, 15 nt, Homo sapiens
cccccaaaguucaca

SEQ ID NO: 1696592 - RNA, 16 nt, Homo sapiens
ccccgcuaaggaagau

SEQ ID NO: 1696593 - RNA, 21 nt, Homo sapiens
ccccgucgaggggcucucagc

SEQ ID NO: 1696594 - RNA, 14 nt, Homo sapiens
ccccuaagagccau

SEQ ID NO: 1696595 - RNA, 22 nt, Homo sapiens
ccccuauccuuggcaccaaaga

SEQ ID NO: 1696596 - RNA, 16 nt, Homo sapiens
ccccuccccugcugca

SEQ ID NO: 1696597 - RNA, 17 nt, Homo sapiens
ccccuccucacuggcca

SEQ ID NO: 1696598 - RNA, 14 nt, Homo sapiens
ccccucucaccaaa

SEQ ID NO: 1696599 - RNA, 22 nt, Homo sapiens
ccccugcuggcucuucugccca

SEQ ID NO: 1696600 - RNA, 14 nt, Homo sapiens
ccccuguaccuuuu

SEQ ID NO: 1696601 - RNA, 22 nt, Homo sapiens
ccccuuccagaucacugccaca

SEQ ID NO: 1696602 - RNA, 14 nt, Homo sapiens
ccccuugggugacc

SEQ ID NO: 1696603 - RNA, 13 nt, Homo sapiens
cccgacagccugg

SEQ ID NO: 1696604 - RNA, 15 nt, Homo sapiens
cccgcaucaagguca

SEQ ID NO: 1696605 - RNA, 21 nt, Homo sapiens
cccggccgcuccaccagcauc

SEQ ID NO: 1696606 - RNA, 17 nt, Homo sapiens
cccggggcuccacugaa

SEQ ID NO: 1696607 - RNA, 19 nt, Homo sapiens
cccgugagcgccugugcac

SEQ ID NO: 1696608 - RNA, 16 nt, Homo sapiens
cccguguguugcacca

SEQ ID NO: 1696609 - RNA, 19 nt, Homo sapiens
cccguuccugacaucacag

SEQ ID NO: 1696610 - RNA, 15 nt, Homo sapiens
cccuagaaacccaag

SEQ ID NO: 1696611 - RNA, 13 nt, Homo sapiens
cccuagcagugaa

SEQ ID NO: 1696612 - RNA, 16 nt, Homo sapiens
cccuagccaauucaca

SEQ ID NO: 1696613 - RNA, 17 nt, Homo sapiens
cccuauccuuggcacca

SEQ ID NO: 1696614 - RNA, 15 nt, Homo sapiens
cccuauuuuugcaau

SEQ ID NO: 1696615 - RNA, 18 nt, Homo sapiens
cccucaaccuccugugga

SEQ ID NO: 1696616 - RNA, 17 nt, Homo sapiens
cccucaacuaccauuau

SEQ ID NO: 1696617 - RNA, 14 nt, Homo sapiens
cccucagacauccc

SEQ ID NO: 1696618 - RNA, 16 nt, Homo sapiens
cccuccagacaaugcc

SEQ ID NO: 1696619 - RNA, 13 nt, Homo sapiens
cccucgacacuca

SEQ ID NO: 1696620 - RNA, 17 nt, Homo sapiens
cccucucccgccagacu

SEQ ID NO: 1696621 - RNA, 22 nt, Homo sapiens
cccucuccuuccuuacccaaac

SEQ ID NO: 1696622 - RNA, 21 nt, Homo sapiens
cccucuggccgccuaggcuca

SEQ ID NO: 1696623 - RNA, 14 nt, Homo sapiens
cccucugggaaccu

SEQ ID NO: 1696624 - RNA, 15 nt, Homo sapiens
cccucuuccugugau

SEQ ID NO: 1696625 - RNA, 17 nt, Homo sapiens
cccucuuucacuucaua

SEQ ID NO: 1696626 - RNA, 23 nt, Homo sapiens
cccucuuuucugaucugcaguuu

SEQ ID NO: 1696627 - RNA, 13 nt, Homo sapiens
cccugaagccagc

SEQ ID NO: 1696628 - RNA, 19 nt, Homo sapiens
cccugagaaccccucuggg

SEQ ID NO: 1696629 - RNA, 17 nt, Homo sapiens
cccugauacaggcaugg

SEQ ID NO: 1696630 - RNA, 15 nt, Homo sapiens
cccugauugaccugc

SEQ ID NO: 1696631 - RNA, 20 nt, Homo sapiens
cccugcaaacagaacagggu

SEQ ID NO: 1696632 - RNA, 20 nt, Homo sapiens
cccugcagcacggacaauaa

SEQ ID NO: 1696633 - RNA, 14 nt, Homo sapiens
cccugccacucuca

SEQ ID NO: 1696634 - RNA, 13 nt, Homo sapiens
cccugcccggcug

SEQ ID NO: 1696635 - RNA, 23 nt, Homo sapiens
cccugccuguuaaggaaacuuua

SEQ ID NO: 1696636 - RNA, 14 nt, Homo sapiens
cccugcugaccucc

SEQ ID NO: 1696637 - RNA, 22 nt, Homo sapiens
cccugcugaccucccagugacc

SEQ ID NO: 1696638 - RNA, 16 nt, Homo sapiens
cccuggcugugcucua

SEQ ID NO: 1696639 - RNA, 20 nt, Homo sapiens
cccugggggcugugauauua

SEQ ID NO: 1696640 - RNA, 19 nt, Homo sapiens
cccuguaaccugacugguu

SEQ ID NO: 1696641 - RNA, 12 nt, Homo sapiens
cccugucauccu

SEQ ID NO: 1696642 - RNA, 15 nt, Homo sapiens
cccugucccaugcag

SEQ ID NO: 1696643 - RNA, 22 nt, Homo sapiens
cccugucccucccaccucugug

SEQ ID NO: 1696644 - RNA, 16 nt, Homo sapiens
cccuguucuaaggggg

SEQ ID NO: 1696645 - RNA, 14 nt, Homo sapiens
cccuuauacagugg

SEQ ID NO: 1696646 - RNA, 12 nt, Homo sapiens
cccuucacccca

SEQ ID NO: 1696647 - RNA, 13 nt, Homo sapiens
cccuuccagauca

SEQ ID NO: 1696648 - RNA, 14 nt, Homo sapiens
cccuuccagugccc

SEQ ID NO: 1696649 - RNA, 16 nt, Homo sapiens
cccuucccaaucagca

SEQ ID NO: 1696650 - RNA, 15 nt, Homo sapiens
cccuuggcugugagg

SEQ ID NO: 1696651 - RNA, 15 nt, Homo sapiens
cccuuugaagccuca

SEQ ID NO: 1696652 - RNA, 14 nt, Homo sapiens
ccgaagaauggaga

SEQ ID NO: 1696653 - RNA, 15 nt, Homo sapiens
ccgaccggugcauga

SEQ ID NO: 1696654 - RNA, 14 nt, Homo sapiens
ccgaggacuuugau

SEQ ID NO: 1696655 - RNA, 16 nt, Homo sapiens
ccgcccucuuccugac

SEQ ID NO: 1696656 - RNA, 22 nt, Homo sapiens
ccggaucagagcaggaccuccc

SEQ ID NO: 1696657 - RNA, 14 nt, Homo sapiens
ccggaucauucacu

SEQ ID NO: 1696658 - RNA, 18 nt, Homo sapiens
ccggaucauucacuguga

SEQ ID NO: 1696659 - RNA, 23 nt, Homo sapiens
ccggcgaaauaaaaucagaguug

SEQ ID NO: 1696660 - RNA, 13 nt, Homo sapiens
ccgguuugccaug

SEQ ID NO: 1696661 - RNA, 16 nt, Homo sapiens
ccgugaacugugcaua

SEQ ID NO: 1696662 - RNA, 13 nt, Homo sapiens
ccgugacugcaau

SEQ ID NO: 1696663 - RNA, 18 nt, Homo sapiens
ccgugagccaggcaaagg

SEQ ID NO: 1696664 - RNA, 15 nt, Homo sapiens
ccguguugcaugaag

SEQ ID NO: 1696665 - RNA, 13 nt, Homo sapiens
ccuaaaagcaaaa

SEQ ID NO: 1696666 - RNA, 19 nt, Homo sapiens
ccuaaauaauguuaucugu

SEQ ID NO: 1696667 - RNA, 20 nt, Homo sapiens
ccuaacuuuucuacguauaa

SEQ ID NO: 1696668 - RNA, 16 nt, Homo sapiens
ccuaaggaaccuuccu

SEQ ID NO: 1696669 - RNA, 18 nt, Homo sapiens
gauuuauuuucaauuaau

SEQ ID NO: 1696670 - RNA, 14 nt, Homo sapiens
gauuucaugccugg

SEQ ID NO: 1696671 - RNA, 18 nt, Homo sapiens
gauuucugguucugaugc

SEQ ID NO: 1696672 - RNA, 15 nt, Homo sapiens
gauuuguacaggagu

SEQ ID NO: 1696673 - RNA, 20 nt, Homo sapiens
gauuuuauaugcacauuucu

SEQ ID NO: 1696674 - RNA, 23 nt, Homo sapiens
gauuuucaaccagauaacauacc

SEQ ID NO: 1696675 - RNA, 18 nt, Homo sapiens
gauuuugaagagauuuua

SEQ ID NO: 1696676 - RNA, 23 nt, Homo sapiens
gauuuuggccaucaggacucuga

SEQ ID NO: 1696677 - RNA, 21 nt, Homo sapiens
gauuuuucucaaaguuuugaa

SEQ ID NO: 1696678 - RNA, 17 nt, Homo sapiens
gauuuuucugcacuaau

SEQ ID NO: 1696679 - RNA, 20 nt, Homo sapiens
gauuuuuuucccaauugaga

SEQ ID NO: 1696680 - RNA, 15 nt, Homo sapiens
gcaaaaaaugaaugu

SEQ ID NO: 1696681 - RNA, 18 nt, Homo sapiens
gcaaaauagacauauuaa

SEQ ID NO: 1696682 - RNA, 12 nt, Homo sapiens
gcaaaauugcaa

SEQ ID NO: 1696683 - RNA, 20 nt, Homo sapiens
gcaaacacugggggcaccuu

SEQ ID NO: 1696684 - RNA, 15 nt, Homo sapiens
gcaaagugcacauga

SEQ ID NO: 1696685 - RNA, 20 nt, Homo sapiens
gcaaauaucauacuguucaa

SEQ ID NO: 1696686 - RNA, 19 nt, Homo sapiens
gcaaaucuaugagauuuug

SEQ ID NO: 1696687 - RNA, 21 nt, Homo sapiens
gcaacaagaccaccacuucga

SEQ ID NO: 1696688 - RNA, 21 nt, Homo sapiens
gcaacagagcaagacuccauc

SEQ ID NO: 1696689 - RNA, 19 nt, Homo sapiens
gcaaccucuucaugagcuu

SEQ ID NO: 1696690 - RNA, 17 nt, Homo sapiens
gcaagaauauugucccu

SEQ ID NO: 1696691 - RNA, 19 nt, Homo sapiens
gcaagcaugccucuucccu

SEQ ID NO: 1696692 - RNA, 15 nt, Homo sapiens
gcaagcuauucaaug

SEQ ID NO: 1696693 - RNA, 13 nt, Homo sapiens
gcaagcugagcug

SEQ ID NO: 1696694 - RNA, 18 nt, Homo sapiens
gcaagucuuccaugaccc

SEQ ID NO: 1696695 - RNA, 17 nt, Homo sapiens
gcaauaaauaccagaca

SEQ ID NO: 1696696 - RNA, 14 nt, Homo sapiens
gcaauacaccaagg

SEQ ID NO: 1696697 - RNA, 17 nt, Homo sapiens
gcaaucuauguuugcac

SEQ ID NO: 1696698 - RNA, 18 nt, Homo sapiens
gcaaugacuguucuugcg

SEQ ID NO: 1696699 - RNA, 21 nt, Homo sapiens
gcaauuaggauuuugauguga

SEQ ID NO: 1696700 - RNA, 14 nt, Homo sapiens
gcacaagccacaag

SEQ ID NO: 1696701 - RNA, 22 nt, Homo sapiens
gcacaagggcacgugaagucau

SEQ ID NO: 1696702 - RNA, 15 nt, Homo sapiens
gcacaauaugggcac

SEQ ID NO: 1696703 - RNA, 19 nt, Homo sapiens
gcacacacacacaucucau

SEQ ID NO: 1696704 - RNA, 20 nt, Homo sapiens
gcacacacacacgcuuucuu

SEQ ID NO: 1696705 - RNA, 14 nt, Homo sapiens
gcacacagucaccu

SEQ ID NO: 1696706 - RNA, 21 nt, Homo sapiens
gcacaccggcuuaacacuauc

SEQ ID NO: 1696707 - RNA, 13 nt, Homo sapiens
gcacacugcacug

SEQ ID NO: 1696708 - RNA, 16 nt, Homo sapiens
gcacagaauuugucag

SEQ ID NO: 1696709 - RNA, 21 nt, Homo sapiens
gcacagagucaggaucucaca

SEQ ID NO: 1696710 - RNA, 21 nt, Homo sapiens
gcacagcugaguuaugaugua

SEQ ID NO: 1696711 - RNA, 19 nt, Homo sapiens
gcacaguuuguggcuuaua

SEQ ID NO: 1696712 - RNA, 21 nt, Homo sapiens
gcacauauggacucugcacau

SEQ ID NO: 1696713 - RNA, 14 nt, Homo sapiens
gcaccacccuaguc

SEQ ID NO: 1696714 - RNA, 22 nt, Homo sapiens
gcacccuucuuuucucaugugu

SEQ ID NO: 1696715 - RNA, 19 nt, Homo sapiens
gcaccuaccaucagggaca

SEQ ID NO: 1696716 - RNA, 15 nt, Homo sapiens
gcaccuagcugugca

SEQ ID NO: 1696717 - RNA, 16 nt, Homo sapiens
gcaccuagcugugcaa

SEQ ID NO: 1696718 - RNA, 20 nt, Homo sapiens
gcaccugagggugcuuugug

SEQ ID NO: 1696719 - RNA, 23 nt, Homo sapiens
gcaccugagggugcuuuguguaa

SEQ ID NO: 1696720 - RNA, 17 nt, Homo sapiens
gcaccuuugcacaggau

SEQ ID NO: 1696721 - RNA, 12 nt, Homo sapiens
gcacgugucuca

SEQ ID NO: 1696722 - RNA, 16 nt, Homo sapiens
gcacuaaaucagagac

SEQ ID NO: 1696723 - RNA, 18 nt, Homo sapiens
gcacuacugggugucauu

SEQ ID NO: 1696724 - RNA, 12 nt, Homo sapiens
gcacugggauga

SEQ ID NO: 1696725 - RNA, 12 nt, Homo sapiens
gcacuguuuuca

SEQ ID NO: 1696726 - RNA, 14 nt, Homo sapiens
gcacuucagaauuc

SEQ ID NO: 1696727 - RNA, 15 nt, Homo sapiens
gcacuucagaauucc

SEQ ID NO: 1696728 - RNA, 13 nt, Homo sapiens
gcacuuuccacuu

SEQ ID NO: 1696729 - RNA, 10 nt, Homo sapiens
gcacuuugaa

SEQ ID NO: 1696730 - RNA, 18 nt, Homo sapiens
gcacuuugaaauaccuca

SEQ ID NO: 1696731 - RNA, 21 nt, Homo sapiens
gcacuuugaaggggccucacc

SEQ ID NO: 1696732 - RNA, 12 nt, Homo sapiens
gcagaaagggaa

SEQ ID NO: 1696733 - RNA, 17 nt, Homo sapiens
gcagaaccaaagcucaa

SEQ ID NO: 1696734 - RNA, 14 nt, Homo sapiens
gcagaauccagcua

SEQ ID NO: 1696735 - RNA, 13 nt, Homo sapiens
gcagaauggacuu

SEQ ID NO: 1696736 - RNA, 21 nt, Homo sapiens
gcagacucuacagaggccaug

SEQ ID NO: 1696737 - RNA, 24 nt, Homo sapiens
gcagacugcuaguguucugucuaa

SEQ ID NO: 1696738 - RNA, 23 nt, Homo sapiens
gcagagcaccuuugcacaggaug

SEQ ID NO: 1696739 - RNA, 21 nt, Homo sapiens
gcagagggucuccaagggcau

SEQ ID NO: 1696740 - RNA, 16 nt, Homo sapiens
gcagagugcacagcug

SEQ ID NO: 1696741 - RNA, 17 nt, Homo sapiens
gcagaguuugccuuccu

SEQ ID NO: 1696742 - RNA, 19 nt, Homo sapiens
gcagauacaggaaaagcug

SEQ ID NO: 1696743 - RNA, 19 nt, Homo sapiens
gcagaugccacccuagcca

SEQ ID NO: 1696744 - RNA, 12 nt, Homo sapiens
gcagccaccagc

SEQ ID NO: 1696745 - RNA, 13 nt, Homo sapiens
gcagcccagagac

SEQ ID NO: 1696746 - RNA, 14 nt, Homo sapiens
gcagcccaugccca

SEQ ID NO: 1696747 - RNA, 14 nt, Homo sapiens
gcagccucaucauu

SEQ ID NO: 1696748 - RNA, 17 nt, Homo sapiens
gcagccuccaacacaag

SEQ ID NO: 1696749 - RNA, 18 nt, Homo sapiens
gcagcggaggcgugcguu

SEQ ID NO: 1696750 - RNA, 20 nt, Homo sapiens
gcagcuaaaggaagugaauc

SEQ ID NO: 1696751 - RNA, 19 nt, Homo sapiens
gcagcugagaaaaugagug

SEQ ID NO: 1696752 - RNA, 20 nt, Homo sapiens
gcagcuucaccagagcauuu

SEQ ID NO: 1696753 - RNA, 21 nt, Homo sapiens
gcagcuuuaaacucagggaca

SEQ ID NO: 1696754 - RNA, 21 nt, Homo sapiens
gcaggaaaguuuacccaugaa

SEQ ID NO: 1696755 - RNA, 23 nt, Homo sapiens
gcaggaagcauucagagagcagc

SEQ ID NO: 1696756 - RNA, 15 nt, Homo sapiens
gcaggcccugcagug

SEQ ID NO: 1696757 - RNA, 15 nt, Homo sapiens
gcagggacuccaugc

SEQ ID NO: 1696758 - RNA, 16 nt, Homo sapiens
gcagggacugccaguc

SEQ ID NO: 1696759 - RNA, 17 nt, Homo sapiens
gcagggcccagugacaa

SEQ ID NO: 1696760 - RNA, 15 nt, Homo sapiens
gcagguguucugggc

SEQ ID NO: 1696761 - RNA, 20 nt, Homo sapiens
gcaguagaaauaauaugcau

SEQ ID NO: 1696762 - RNA, 19 nt, Homo sapiens
gcaguccuccgguugcaua

SEQ ID NO: 1696763 - RNA, 21 nt, Homo sapiens
gcaguccuuuguaaacagugu

SEQ ID NO: 1696764 - RNA, 13 nt, Homo sapiens
gcagugagcagaa

SEQ ID NO: 1696765 - RNA, 14 nt, Homo sapiens
gcaguggugcaauc

SEQ ID NO: 1696766 - RNA, 19 nt, Homo sapiens
gcaguuuaugagacagcug

SEQ ID NO: 1696767 - RNA, 21 nt, Homo sapiens
gcaguuucucuccaacucccu

SEQ ID NO: 1696768 - RNA, 21 nt, Homo sapiens
gcaguuugcuuuguaugcacu

SEQ ID NO: 1696769 - RNA, 16 nt, Homo sapiens
gcauaaaaacauuuua

SEQ ID NO: 1696770 - RNA, 19 nt, Homo sapiens
gcauaaauaugcagugaua

SEQ ID NO: 1696771 - RNA, 22 nt, Homo sapiens
gcauaaauccauccauccaaag

SEQ ID NO: 1696772 - RNA, 13 nt, Homo sapiens
gcauaaaugcauu

SEQ ID NO: 1696773 - RNA, 23 nt, Homo sapiens
gcauacaaagagguguacaggua

SEQ ID NO: 1696774 - RNA, 23 nt, Homo sapiens
gcauacuggacucuucaaaaacu

SEQ ID NO: 1696775 - RNA, 16 nt, Homo sapiens
gcauagcaagacacau

SEQ ID NO: 1696776 - RNA, 16 nt, Homo sapiens
gcauaguccaaaaagc

SEQ ID NO: 1696777 - RNA, 18 nt, Homo sapiens
gcauaucaaaaaguauua

SEQ ID NO: 1696778 - RNA, 19 nt, Homo sapiens
ggagcaugggccuggccac

SEQ ID NO: 1696779 - RNA, 21 nt, Homo sapiens
ggagccuggcuccguccagga

SEQ ID NO: 1696780 - RNA, 19 nt, Homo sapiens
ggagcugccuguucagcuc

SEQ ID NO: 1696781 - RNA, 11 nt, Homo sapiens
ggaggacaaaa

SEQ ID NO: 1696782 - RNA, 14 nt, Homo sapiens
ggaggacauuuggu

SEQ ID NO: 1696783 - RNA, 18 nt, Homo sapiens
ggaggaccuggggcacag

SEQ ID NO: 1696784 - RNA, 23 nt, Homo sapiens
ggaggaugucccugggccagggu

SEQ ID NO: 1696785 - RNA, 23 nt, Homo sapiens
ggaggauugcagguggaacucag

SEQ ID NO: 1696786 - RNA, 18 nt, Homo sapiens
ggaggccuuccagcugcu

SEQ ID NO: 1696787 - RNA, 20 nt, Homo sapiens
ggaggcggagguugcaauga

SEQ ID NO: 1696788 - RNA, 18 nt, Homo sapiens
ggagggggaggcgccaag

SEQ ID NO: 1696789 - RNA, 16 nt, Homo sapiens
ggaggucauacaugca

SEQ ID NO: 1696790 - RNA, 11 nt, Homo sapiens
ggaguccaggc

SEQ ID NO: 1696791 - RNA, 21 nt, Homo sapiens
ggagucugccuccaugcugca

SEQ ID NO: 1696792 - RNA, 20 nt, Homo sapiens
ggaguucgaggcugcaguca

SEQ ID NO: 1696793 - RNA, 18 nt, Homo sapiens
ggauaaaaugacuacuua

SEQ ID NO: 1696794 - RNA, 19 nt, Homo sapiens
ggauaacuuagguggcaag

SEQ ID NO: 1696795 - RNA, 21 nt, Homo sapiens
ggauauccuuaucagagcuaa

SEQ ID NO: 1696796 - RNA, 17 nt, Homo sapiens
ggaucaugguguaauaa

SEQ ID NO: 1696797 - RNA, 13 nt, Homo sapiens
ggauccucuccuu

SEQ ID NO: 1696798 - RNA, 23 nt, Homo sapiens
ggauccuggccccucaaccuccu

SEQ ID NO: 1696799 - RNA, 22 nt, Homo sapiens
ggaucuugaauguggucucagg

SEQ ID NO: 1696800 - RNA, 24 nt, Homo sapiens
ggaucuugcaaaagaugucugauc

SEQ ID NO: 1696801 - RNA, 17 nt, Homo sapiens
ggaucuuuucauucuca

SEQ ID NO: 1696802 - RNA, 16 nt, Homo sapiens
ggaugaugguugcaaa

SEQ ID NO: 1696803 - RNA, 22 nt, Homo sapiens
ggaugcaggguuugagaauguu

SEQ ID NO: 1696804 - RNA, 21 nt, Homo sapiens
ggauggcaucaaacagggcaa

SEQ ID NO: 1696805 - RNA, 15 nt, Homo sapiens
ggauggggguacuca

SEQ ID NO: 1696806 - RNA, 18 nt, Homo sapiens
ggaugucccugggccagg

SEQ ID NO: 1696807 - RNA, 18 nt, Homo sapiens
ggauguccuacuaucacu

SEQ ID NO: 1696808 - RNA, 19 nt, Homo sapiens
ggauguccuacuaucacug

SEQ ID NO: 1696809 - RNA, 16 nt, Homo sapiens
ggauuauuuaauaaca

SEQ ID NO: 1696810 - RNA, 15 nt, Homo sapiens
ggauuuccagggaua

SEQ ID NO: 1696811 - RNA, 20 nt, Homo sapiens
ggcaaaaccacuagaacucu

SEQ ID NO: 1696812 - RNA, 13 nt, Homo sapiens
ggcaaaguguuuu

SEQ ID NO: 1696813 - RNA, 19 nt, Homo sapiens
ggcaacagagcaagaccca

SEQ ID NO: 1696814 - RNA, 18 nt, Homo sapiens
ggcaacagagcaagaucc

SEQ ID NO: 1696815 - RNA, 22 nt, Homo sapiens
ggcaaccuugucucuaugccag

SEQ ID NO: 1696816 - RNA, 22 nt, Homo sapiens
ggcaacuucaguccugggagac

SEQ ID NO: 1696817 - RNA, 17 nt, Homo sapiens
ggcaagucuuccaugac

SEQ ID NO: 1696818 - RNA, 18 nt, Homo sapiens
ggcaagucuuccaugacc

SEQ ID NO: 1696819 - RNA, 19 nt, Homo sapiens
ggcaauuucaccaccaaau

SEQ ID NO: 1696820 - RNA, 22 nt, Homo sapiens
ggcaauuucaccaccaaaugcc

SEQ ID NO: 1696821 - RNA, 18 nt, Homo sapiens
ggcacaggacugauucug

SEQ ID NO: 1696822 - RNA, 14 nt, Homo sapiens
ggcaccaaccugca

SEQ ID NO: 1696823 - RNA, 17 nt, Homo sapiens
ggcaccaaccugcauuu

SEQ ID NO: 1696824 - RNA, 14 nt, Homo sapiens
ggcaccugggucca

SEQ ID NO: 1696825 - RNA, 18 nt, Homo sapiens
ggcacucagaagacacug

SEQ ID NO: 1696826 - RNA, 13 nt, Homo sapiens
ggcacucaggggg

SEQ ID NO: 1696827 - RNA, 21 nt, Homo sapiens
ggcacugaauuaaucaucuau

SEQ ID NO: 1696828 - RNA, 22 nt, Homo sapiens
ggcagagccaccugacucuugc

SEQ ID NO: 1696829 - RNA, 15 nt, Homo sapiens
ggcagccauggccau

SEQ ID NO: 1696830 - RNA, 14 nt, Homo sapiens
ggcagcgccaagug

SEQ ID NO: 1696831 - RNA, 22 nt, Homo sapiens
ggcaucaaacagggcaaagugu

SEQ ID NO: 1696832 - RNA, 16 nt, Homo sapiens
ggcauccauaccagcu

SEQ ID NO: 1696833 - RNA, 18 nt, Homo sapiens
ggcauggccagguggcca

SEQ ID NO: 1696834 - RNA, 19 nt, Homo sapiens
ggcauucuuguacagugua

SEQ ID NO: 1696835 - RNA, 17 nt, Homo sapiens
ggccaccgccagagcuc

SEQ ID NO: 1696836 - RNA, 23 nt, Homo sapiens
ggccaccugccugcgucuuccgc

SEQ ID NO: 1696837 - RNA, 19 nt, Homo sapiens
ggccagcaagcucuucacu

SEQ ID NO: 1696838 - RNA, 21 nt, Homo sapiens
ggccauacuucuguuuccauc

SEQ ID NO: 1696839 - RNA, 23 nt, Homo sapiens
ggccauacuucuguuuccaucug

SEQ ID NO: 1696840 - RNA, 22 nt, Homo sapiens
ggccauggaagguucucugugc

SEQ ID NO: 1696841 - RNA, 14 nt, Homo sapiens
ggccauguccaaag

SEQ ID NO: 1696842 - RNA, 14 nt, Homo sapiens
ggcccacccacuaa

SEQ ID NO: 1696843 - RNA, 17 nt, Homo sapiens
ggcccagagcaggaagc

SEQ ID NO: 1696844 - RNA, 17 nt, Homo sapiens
ggccccaccggggucua

SEQ ID NO: 1696845 - RNA, 16 nt, Homo sapiens
ggccccaucauagccu

SEQ ID NO: 1696846 - RNA, 19 nt, Homo sapiens
ggcccgacagccuggcaca

SEQ ID NO: 1696847 - RNA, 22 nt, Homo sapiens
ggcccuggaauugcagcuguac

SEQ ID NO: 1696848 - RNA, 12 nt, Homo sapiens
ggccgcacuggg

SEQ ID NO: 1696849 - RNA, 18 nt, Homo sapiens
ggccuaaucucauaccuc

SEQ ID NO: 1696850 - RNA, 14 nt, Homo sapiens
ggccuccaugaccu

SEQ ID NO: 1696851 - RNA, 16 nt, Homo sapiens
ggccucucucaaaaga

SEQ ID NO: 1696852 - RNA, 16 nt, Homo sapiens
ggccucuggcucucau

SEQ ID NO: 1696853 - RNA, 15 nt, Homo sapiens
ggccugcacacaagc

SEQ ID NO: 1696854 - RNA, 23 nt, Homo sapiens
ggccuggacuuccagugcucaga

SEQ ID NO: 1696855 - RNA, 14 nt, Homo sapiens
ggccugugugugaa

SEQ ID NO: 1696856 - RNA, 19 nt, Homo sapiens
ggccuuccucucuccagau

SEQ ID NO: 1696857 - RNA, 15 nt, Homo sapiens
ggccuuugcucuuac

SEQ ID NO: 1696858 - RNA, 20 nt, Homo sapiens
ggcgccccugccaccucccu

SEQ ID NO: 1696859 - RNA, 12 nt, Homo sapiens
ggcucacaaaga

SEQ ID NO: 1696860 - RNA, 11 nt, Homo sapiens
ggcucagagau

SEQ ID NO: 1696861 - RNA, 18 nt, Homo sapiens
ggcucucuuaggcaugua

SEQ ID NO: 1696862 - RNA, 15 nt, Homo sapiens
ggcucugaggcugca

SEQ ID NO: 1696863 - RNA, 20 nt, Homo sapiens
ggcucugcuucuccaaggaa

SEQ ID NO: 1696864 - RNA, 21 nt, Homo sapiens
ggcugagcaucggaguggagu

SEQ ID NO: 1696865 - RNA, 20 nt, Homo sapiens
ggcugaggcaggcagaucac

SEQ ID NO: 1696866 - RNA, 18 nt, Homo sapiens
ggcugccccucucaccaa

SEQ ID NO: 1696867 - RNA, 15 nt, Homo sapiens
ggcugcccucuccac

SEQ ID NO: 1696868 - RNA, 19 nt, Homo sapiens
ggcugcugaaaaccaucug

SEQ ID NO: 1696869 - RNA, 19 nt, Homo sapiens
ggcuggaguggaguggcgu

SEQ ID NO: 1696870 - RNA, 20 nt, Homo sapiens
ggcuuaacacuaucauggac

SEQ ID NO: 1696871 - RNA, 18 nt, Homo sapiens
ggcuucacuguauaaaua

SEQ ID NO: 1696872 - RNA, 15 nt, Homo sapiens
ggcuucuacacuggg

SEQ ID NO: 1696873 - RNA, 19 nt, Homo sapiens
ggcuucucuugagucacac

SEQ ID NO: 1696874 - RNA, 13 nt, Homo sapiens
ggcuucugugaug

SEQ ID NO: 1696875 - RNA, 20 nt, Homo sapiens
ggcuuuacaguguaaacugu

SEQ ID NO: 1696876 - RNA, 14 nt, Homo sapiens
ggcuuucuugacau

SEQ ID NO: 1696877 - RNA, 16 nt, Homo sapiens
gggaaagagauccagg

SEQ ID NO: 1696878 - RNA, 15 nt, Homo sapiens
gggaaaggaggcaug

SEQ ID NO: 1696879 - RNA, 22 nt, Homo sapiens
gggaagcugcagcuugggagag

SEQ ID NO: 1696880 - RNA, 12 nt, Homo sapiens
gggaaggugacc

SEQ ID NO: 1696881 - RNA, 15 nt, Homo sapiens
gggaauggauccugg

SEQ ID NO: 1696882 - RNA, 20 nt, Homo sapiens
gggacaggaugaccuggaua

SEQ ID NO: 1696883 - RNA, 22 nt, Homo sapiens
gggaccaacugggcccaagaca

SEQ ID NO: 1696884 - RNA, 13 nt, Homo sapiens
gggagaaggcagu

SEQ ID NO: 1696885 - RNA, 11 nt, Homo sapiens
gggaggacaaa

SEQ ID NO: 1696886 - RNA, 23 nt, Homo sapiens
gggaggauugcuugaacccaaga

SEQ ID NO: 1696887 - RNA, 18 nt, Homo sapiens
uaaacucaagacaaugca

SEQ ID NO: 1696888 - RNA, 21 nt, Homo sapiens
uaaacucagggacagagccau

SEQ ID NO: 1696889 - RNA, 17 nt, Homo sapiens
uaaacuguuagcacugu

SEQ ID NO: 1696890 - RNA, 19 nt, Homo sapiens
uaaacuuuuuuucaaugug

SEQ ID NO: 1696891 - RNA, 15 nt, Homo sapiens
uaaagaaauugcaau

SEQ ID NO: 1696892 - RNA, 15 nt, Homo sapiens
uaaagccucaagguu

SEQ ID NO: 1696893 - RNA, 18 nt, Homo sapiens
uaaagcucaucagcuauc

SEQ ID NO: 1696894 - RNA, 17 nt, Homo sapiens
uaaagcuuaacacuuga

SEQ ID NO: 1696895 - RNA, 22 nt, Homo sapiens
uaaagguccacaggucuagacu

SEQ ID NO: 1696896 - RNA, 15 nt, Homo sapiens
uaaagugcuaagguu

SEQ ID NO: 1696897 - RNA, 19 nt, Homo sapiens
uaaauaauguuaucugugu

SEQ ID NO: 1696898 - RNA, 19 nt, Homo sapiens
uaaauaauuuaacuacccu

SEQ ID NO: 1696899 - RNA, 17 nt, Homo sapiens
uaaauaccagacacgua

SEQ ID NO: 1696900 - RNA, 21 nt, Homo sapiens
uaaauagaguauaugcacuuu

SEQ ID NO: 1696901 - RNA, 13 nt, Homo sapiens
uaaauaugcagug

SEQ ID NO: 1696902 - RNA, 17 nt, Homo sapiens
uaaauauuagaagccug

SEQ ID NO: 1696903 - RNA, 17 nt, Homo sapiens
uaaauccauccauccaa

SEQ ID NO: 1696904 - RNA, 21 nt, Homo sapiens
uaaaucuuucuuuugauucuu

SEQ ID NO: 1696905 - RNA, 15 nt, Homo sapiens
uaaaugaagcagcuu

SEQ ID NO: 1696906 - RNA, 18 nt, Homo sapiens
uaaaugauagacaauuga

SEQ ID NO: 1696907 - RNA, 20 nt, Homo sapiens
uaaaugauagacaauugagg

SEQ ID NO: 1696908 - RNA, 22 nt, Homo sapiens
uaaaugguaguaaucacaguug

SEQ ID NO: 1696909 - RNA, 21 nt, Homo sapiens
uaaauguauacuauaguacca

SEQ ID NO: 1696910 - RNA, 13 nt, Homo sapiens
uaaauguauauac

SEQ ID NO: 1696911 - RNA, 11 nt, Homo sapiens
uaaaugugcag

SEQ ID NO: 1696912 - RNA, 19 nt, Homo sapiens
uaaauguuaugacuaugua

SEQ ID NO: 1696913 - RNA, 14 nt, Homo sapiens
uaaauuauugcugu

SEQ ID NO: 1696914 - RNA, 18 nt, Homo sapiens
uaaauucccaacuucucu

SEQ ID NO: 1696915 - RNA, 11 nt, Homo sapiens
uaaauucugug

SEQ ID NO: 1696916 - RNA, 16 nt, Homo sapiens
uaaauuuaaugcugcc

SEQ ID NO: 1696917 - RNA, 17 nt, Homo sapiens
uaaauuuuacccuuuag

SEQ ID NO: 1696918 - RNA, 18 nt, Homo sapiens
uaaauuuuauaacagaau

SEQ ID NO: 1696919 - RNA, 20 nt, Homo sapiens
uaacaacaauaacacugucu

SEQ ID NO: 1696920 - RNA, 16 nt, Homo sapiens
uaacacagcugaacua

SEQ ID NO: 1696921 - RNA, 24 nt, Homo sapiens
uaacacauucaauagcauaucaca

SEQ ID NO: 1696922 - RNA, 16 nt, Homo sapiens
uaacacggugcucauu

SEQ ID NO: 1696923 - RNA, 19 nt, Homo sapiens
uaacagaauuaaaguagau

SEQ ID NO: 1696924 - RNA, 18 nt, Homo sapiens
uaacaggauauuuaauga

SEQ ID NO: 1696925 - RNA, 14 nt, Homo sapiens
uaacaggcauuugu

SEQ ID NO: 1696926 - RNA, 14 nt, Homo sapiens
uaacaguucacuuu

SEQ ID NO: 1696927 - RNA, 19 nt, Homo sapiens
uaacaguucacuuuuuaca

SEQ ID NO: 1696928 - RNA, 21 nt, Homo sapiens
uaacaguucauguuugcuuca

SEQ ID NO: 1696929 - RNA, 21 nt, Homo sapiens
uaacaucacuauccaugcacc

SEQ ID NO: 1696930 - RNA, 22 nt, Homo sapiens
uaacauuaccuuacuguggagg

SEQ ID NO: 1696931 - RNA, 11 nt, Homo sapiens
uaacauuugcc

SEQ ID NO: 1696932 - RNA, 21 nt, Homo sapiens
uaacauuuuguucuuacacau

SEQ ID NO: 1696933 - RNA, 17 nt, Homo sapiens
uaaccuugaaugcugcc

SEQ ID NO: 1696934 - RNA, 12 nt, Homo sapiens
uaacuacauuua

SEQ ID NO: 1696935 - RNA, 22 nt, Homo sapiens
uaacuagacaccaaaguucuaa

SEQ ID NO: 1696936 - RNA, 14 nt, Homo sapiens
uaacuauauuugcu

SEQ ID NO: 1696937 - RNA, 18 nt, Homo sapiens
uaacuauauuugcuuuuu

SEQ ID NO: 1696938 - RNA, 22 nt, Homo sapiens
uaacucaccagccccacugcca

SEQ ID NO: 1696939 - RNA, 14 nt, Homo sapiens
uaacucacucaguu

SEQ ID NO: 1696940 - RNA, 22 nt, Homo sapiens
uaacucaggaagccucuggguu

SEQ ID NO: 1696941 - RNA, 15 nt, Homo sapiens
uaacucggauuccag

SEQ ID NO: 1696942 - RNA, 15 nt, Homo sapiens
uaacugauuugcaau

SEQ ID NO: 1696943 - RNA, 14 nt, Homo sapiens
uaacugugaaguuu

SEQ ID NO: 1696944 - RNA, 16 nt, Homo sapiens
uaacugugcugaaugc

SEQ ID NO: 1696945 - RNA, 19 nt, Homo sapiens
uaacuuauauugaagacaa

SEQ ID NO: 1696946 - RNA, 15 nt, Homo sapiens
uaacuuuauguguaa

SEQ ID NO: 1696947 - RNA, 17 nt, Homo sapiens
uaagaaauguaguugau

SEQ ID NO: 1696948 - RNA, 17 nt, Homo sapiens
uaagaagcuucuaauaa

SEQ ID NO: 1696949 - RNA, 22 nt, Homo sapiens
uaagaauguugguuuacuuuca

SEQ ID NO: 1696950 - RNA, 15 nt, Homo sapiens
uaagagaaugaauua

SEQ ID NO: 1696951 - RNA, 17 nt, Homo sapiens
uaagagccauuuagggg

SEQ ID NO: 1696952 - RNA, 21 nt, Homo sapiens
uaagaggcugcugaaaaccau

SEQ ID NO: 1696953 - RNA, 18 nt, Homo sapiens
uaagaguaaaauuccucu

SEQ ID NO: 1696954 - RNA, 14 nt, Homo sapiens
uaagauccacaaau

SEQ ID NO: 1696955 - RNA, 17 nt, Homo sapiens
uaagauuauagauucua

SEQ ID NO: 1696956 - RNA, 13 nt, Homo sapiens
uaagauucuagau

SEQ ID NO: 1696957 - RNA, 23 nt, Homo sapiens
uaagauuguccagugcaaccaca

SEQ ID NO: 1696958 - RNA, 14 nt, Homo sapiens
uaagauuuugcacc

SEQ ID NO: 1696959 - RNA, 14 nt, Homo sapiens
uaagcccacuguua

SEQ ID NO: 1696960 - RNA, 20 nt, Homo sapiens
uaagggggugcagcagugag

SEQ ID NO: 1696961 - RNA, 18 nt, Homo sapiens
uaagggucgaaagcucua

SEQ ID NO: 1696962 - RNA, 17 nt, Homo sapiens
uaagguaauucauggca

SEQ ID NO: 1696963 - RNA, 17 nt, Homo sapiens
uaagguucuaaggccua

SEQ ID NO: 1696964 - RNA, 13 nt, Homo sapiens
uaaguaauuauuc

SEQ ID NO: 1696965 - RNA, 23 nt, Homo sapiens
uaagucacuuugaggugucucaa

SEQ ID NO: 1696966 - RNA, 18 nt, Homo sapiens
uaagugaagugauacuau

SEQ ID NO: 1696967 - RNA, 14 nt, Homo sapiens
uaagugcugcuaua

SEQ ID NO: 1696968 - RNA, 14 nt, Homo sapiens
uaaguucagcacuu

SEQ ID NO: 1696969 - RNA, 17 nt, Homo sapiens
uaaguuucaggugacau

SEQ ID NO: 1696970 - RNA, 17 nt, Homo sapiens
uaauaaacauccuucaa

SEQ ID NO: 1696971 - RNA, 18 nt, Homo sapiens
uaauaaauauuuuugcca

SEQ ID NO: 1696972 - RNA, 21 nt, Homo sapiens
uaauaacugugaaguuuacau

SEQ ID NO: 1696973 - RNA, 21 nt, Homo sapiens
uaauaauagaaaaauacucau

SEQ ID NO: 1696974 - RNA, 15 nt, Homo sapiens
uaauacuacugcaca

SEQ ID NO: 1696975 - RNA, 18 nt, Homo sapiens
uaauacuugaugcaugca

SEQ ID NO: 1696976 - RNA, 22 nt, Homo sapiens
uaauagccuaauacaacaugua

SEQ ID NO: 1696977 - RNA, 16 nt, Homo sapiens
uaauagucauuccaaa

SEQ ID NO: 1696978 - RNA, 18 nt, Homo sapiens
uaauaguuuugauccuaa

SEQ ID NO: 1696979 - RNA, 15 nt, Homo sapiens
uaauauggacauuua

SEQ ID NO: 1696980 - RNA, 13 nt, Homo sapiens
uaauauggcaaaa

SEQ ID NO: 1696981 - RNA, 22 nt, Homo sapiens
uaauauuuuguauuauugcugu

SEQ ID NO: 1696982 - RNA, 19 nt, Homo sapiens
uaaucaaggccagugcuaa

SEQ ID NO: 1696983 - RNA, 21 nt, Homo sapiens
uaaucagacaaaguaauuccu

SEQ ID NO: 1696984 - RNA, 12 nt, Homo sapiens
uaauccaggcac

SEQ ID NO: 1696985 - RNA, 14 nt, Homo sapiens
uaaucccaggauua

SEQ ID NO: 1696986 - RNA, 11 nt, Homo sapiens
uaauccuuaac

SEQ ID NO: 1696987 - RNA, 16 nt, Homo sapiens
uaaucucucugcagcu

SEQ ID NO: 1696988 - RNA, 21 nt, Homo sapiens
uaaucucuguuauguacugua

SEQ ID NO: 1696989 - RNA, 14 nt, Homo sapiens
uaaucugaaauucu

SEQ ID NO: 1696990 - RNA, 19 nt, Homo sapiens
uaaugaaggaguucacugu

SEQ ID NO: 1696991 - RNA, 18 nt, Homo sapiens
uaaugacaaugaagugac

SEQ ID NO: 1696992 - RNA, 15 nt, Homo sapiens
uaaugauagcuacug

SEQ ID NO: 1696993 - RNA, 20 nt, Homo sapiens
uaaugaucucaaacuaugac

SEQ ID NO: 1696994 - RNA, 20 nt, Homo sapiens
uaaugcuacugucucacuga

SEQ ID NO: 1696995 - RNA, 17 nt, Homo sapiens
uaauggggacacagauc

SEQ ID NO: 1696996 - RNA, 19 nt, Homo sapiens
uaauguaaaauccauccaa

SEQ ID NO: 1696997 - RNA, 15 nt, Homo sapiens
uguaagugcugcuau

SEQ ID NO: 1696998 - RNA, 16 nt, Homo sapiens
uguaauaauaccucaa

SEQ ID NO: 1696999 - RNA, 17 nt, Homo sapiens
uguaaucccccaggaga

SEQ ID NO: 1697000 - RNA, 21 nt, Homo sapiens
uguaaucgcccuacuauucag

SEQ ID NO: 1697001 - RNA, 21 nt, Homo sapiens
uguaaucucucugcagcugcc

SEQ ID NO: 1697002 - RNA, 18 nt, Homo sapiens
uguaaugaaaaugaauau

SEQ ID NO: 1697003 - RNA, 12 nt, Homo sapiens
uguaaugcugca

SEQ ID NO: 1697004 - RNA, 20 nt, Homo sapiens
uguaaugugugguggccuca

SEQ ID NO: 1697005 - RNA, 18 nt, Homo sapiens
uguacaaaauaacucucc

SEQ ID NO: 1697006 - RNA, 17 nt, Homo sapiens
uguacacugacuugaga

SEQ ID NO: 1697007 - RNA, 15 nt, Homo sapiens
uguacagagugcuuu

SEQ ID NO: 1697008 - RNA, 11 nt, Homo sapiens
uguacagguac

SEQ ID NO: 1697009 - RNA, 17 nt, Homo sapiens
uguacccccagguggaa

SEQ ID NO: 1697010 - RNA, 20 nt, Homo sapiens
uguacuccagccugggcaac

SEQ ID NO: 1697011 - RNA, 12 nt, Homo sapiens
uguacuguacua

SEQ ID NO: 1697012 - RNA, 10 nt, Homo sapiens
uguacuugug

SEQ ID NO: 1697013 - RNA, 19 nt, Homo sapiens
uguacuuuaaaaagaugua

SEQ ID NO: 1697014 - RNA, 21 nt, Homo sapiens
uguagcauauucuuuucugca

SEQ ID NO: 1697015 - RNA, 15 nt, Homo sapiens
uguagcugugucaug

SEQ ID NO: 1697016 - RNA, 20 nt, Homo sapiens
uguauaaagcaacuguuaug

SEQ ID NO: 1697017 - RNA, 19 nt, Homo sapiens
uguauaaaugugauaugau

SEQ ID NO: 1697018 - RNA, 19 nt, Homo sapiens
uguaucguaaccagccaga

SEQ ID NO: 1697019 - RNA, 17 nt, Homo sapiens
uguaugaaaaguaacug

SEQ ID NO: 1697020 - RNA, 23 nt, Homo sapiens
uguaugaguaucuguauguauau

SEQ ID NO: 1697021 - RNA, 14 nt, Homo sapiens
uguaugauguguug

SEQ ID NO: 1697022 - RNA, 22 nt, Homo sapiens
uguaugcaaaucaaacauauuc

SEQ ID NO: 1697023 - RNA, 16 nt, Homo sapiens
uguauggaaaaaccau

SEQ ID NO: 1697024 - RNA, 17 nt, Homo sapiens
uguauucuucaaccuca

SEQ ID NO: 1697025 - RNA, 20 nt, Homo sapiens
uguauugugcugauugugga

SEQ ID NO: 1697026 - RNA, 19 nt, Homo sapiens
uguauuuuucuguuagcug

SEQ ID NO: 1697027 - RNA, 21 nt, Homo sapiens
ugucaacaccccuguguggau

SEQ ID NO: 1697028 - RNA, 20 nt, Homo sapiens
ugucacaccagccauacuua

SEQ ID NO: 1697029 - RNA, 20 nt, Homo sapiens
ugucacauagagugaucuuu

SEQ ID NO: 1697030 - RNA, 13 nt, Homo sapiens
ugucacauugcau

SEQ ID NO: 1697031 - RNA, 18 nt, Homo sapiens
ugucacugacacaaagga

SEQ ID NO: 1697032 - RNA, 17 nt, Homo sapiens
ugucagaaugcuauuga

SEQ ID NO: 1697033 - RNA, 14 nt, Homo sapiens
ugucauccucaugc

SEQ ID NO: 1697034 - RNA, 13 nt, Homo sapiens
ugucaucugccaa

SEQ ID NO: 1697035 - RNA, 12 nt, Homo sapiens
uguccaaagagg

SEQ ID NO: 1697036 - RNA, 17 nt, Homo sapiens
uguccaaagaggcugcc

SEQ ID NO: 1697037 - RNA, 21 nt, Homo sapiens
uguccacccaccuaugugcca

SEQ ID NO: 1697038 - RNA, 12 nt, Homo sapiens
ugucccaugcag

SEQ ID NO: 1697039 - RNA, 17 nt, Homo sapiens
uguccccucauaggaug

SEQ ID NO: 1697040 - RNA, 20 nt, Homo sapiens
ugucccggggcuccacugaa

SEQ ID NO: 1697041 - RNA, 16 nt, Homo sapiens
ugucccucacuguuga

SEQ ID NO: 1697042 - RNA, 16 nt, Homo sapiens
ugucccugcacuugca

SEQ ID NO: 1697043 - RNA, 16 nt, Homo sapiens
uguccugaucugugau

SEQ ID NO: 1697044 - RNA, 16 nt, Homo sapiens
ugucgccucugcauuc

SEQ ID NO: 1697045 - RNA, 16 nt, Homo sapiens
ugucucacugaaacau

SEQ ID NO: 1697046 - RNA, 18 nt, Homo sapiens
ugucucagacugcaugua

SEQ ID NO: 1697047 - RNA, 14 nt, Homo sapiens
ugucuccacugugc

SEQ ID NO: 1697048 - RNA, 21 nt, Homo sapiens
ugucugaguaagcccucagga

SEQ ID NO: 1697049 - RNA, 19 nt, Homo sapiens
ugucuguaaaagagccuag

SEQ ID NO: 1697050 - RNA, 19 nt, Homo sapiens
ugucuguuuguuucaagaa

SEQ ID NO: 1697051 - RNA, 19 nt, Homo sapiens
ugucuuggacacuguacaa

SEQ ID NO: 1697052 - RNA, 18 nt, Homo sapiens
ugucuuuaauuucuguca

SEQ ID NO: 1697053 - RNA, 13 nt, Homo sapiens
ugucuuucuccaa

SEQ ID NO: 1697054 - RNA, 22 nt, Homo sapiens
ugucuuuucuuggcaaaagccu

SEQ ID NO: 1697055 - RNA, 15 nt, Homo sapiens
ugugaaaacaucuca

SEQ ID NO: 1697056 - RNA, 23 nt, Homo sapiens
ugugaaaggaagcuccacuguca

SEQ ID NO: 1697057 - RNA, 16 nt, Homo sapiens
ugugaagcaaggagcu

SEQ ID NO: 1697058 - RNA, 19 nt, Homo sapiens
ugugaaguuugcuuuguac

SEQ ID NO: 1697059 - RNA, 14 nt, Homo sapiens
ugugacacauaugc

SEQ ID NO: 1697060 - RNA, 20 nt, Homo sapiens
ugugaccaacuguguuguau

SEQ ID NO: 1697061 - RNA, 12 nt, Homo sapiens
ugugaccuugac

SEQ ID NO: 1697062 - RNA, 20 nt, Homo sapiens
ugugacuucuccaggucuca

SEQ ID NO: 1697063 - RNA, 16 nt, Homo sapiens
ugugagccaccacguc

SEQ ID NO: 1697064 - RNA, 23 nt, Homo sapiens
ugugagggugacguuagcauuac

SEQ ID NO: 1697065 - RNA, 15 nt, Homo sapiens
ugugauuacaaggcu

SEQ ID NO: 1697066 - RNA, 22 nt, Homo sapiens
ugugauuuuucugcacuaauau

SEQ ID NO: 1697067 - RNA, 13 nt, Homo sapiens
ugugcaguagcau

SEQ ID NO: 1697068 - RNA, 13 nt, Homo sapiens
ugugcuggggucu

SEQ ID NO: 1697069 - RNA, 21 nt, Homo sapiens
uguggaaagaaagaccaucuc

SEQ ID NO: 1697070 - RNA, 20 nt, Homo sapiens
uguggaccucuacuuuccag

SEQ ID NO: 1697071 - RNA, 18 nt, Homo sapiens
uguggcuucccaugucuu

SEQ ID NO: 1697072 - RNA, 18 nt, Homo sapiens
ugugguggccucagcuga

SEQ ID NO: 1697073 - RNA, 20 nt, Homo sapiens
ugugguuaacaucucagaaa

SEQ ID NO: 1697074 - RNA, 13 nt, Homo sapiens
uguguacaaagug

SEQ ID NO: 1697075 - RNA, 17 nt, Homo sapiens
uguguacuguauagaca

SEQ ID NO: 1697076 - RNA, 14 nt, Homo sapiens
uguguauauauaca

SEQ ID NO: 1697077 - RNA, 16 nt, Homo sapiens
ugugucuaagauucua

SEQ ID NO: 1697078 - RNA, 17 nt, Homo sapiens
ugugugaccaacugugu

SEQ ID NO: 1697079 - RNA, 17 nt, Homo sapiens
uguguuccaaguuucca

SEQ ID NO: 1697080 - RNA, 22 nt, Homo sapiens
uguguucuuccucucucagggg

SEQ ID NO: 1697081 - RNA, 20 nt, Homo sapiens
uguguuguauuaacaaaagu

SEQ ID NO: 1697082 - RNA, 17 nt, Homo sapiens
uguguuuauuucacuug

SEQ ID NO: 1697083 - RNA, 22 nt, Homo sapiens
uguuaaaaucuauucuguguug

SEQ ID NO: 1697084 - RNA, 19 nt, Homo sapiens
uguuaacauuccaagacuc

SEQ ID NO: 1697085 - RNA, 22 nt, Homo sapiens
uguuaaggaaacucuuaucuca

SEQ ID NO: 1697086 - RNA, 13 nt, Homo sapiens
uguuaccuaaagu

SEQ ID NO: 1697087 - RNA, 15 nt, Homo sapiens
uguuacuguucuugc

SEQ ID NO: 1697088 - RNA, 19 nt, Homo sapiens
uguuagauagaauuuccaa

SEQ ID NO: 1697089 - RNA, 20 nt, Homo sapiens
uguuauauuuaaugcauuaa

SEQ ID NO: 1697090 - RNA, 18 nt, Homo sapiens
uguuaucuaucaacuaua

SEQ ID NO: 1697091 - RNA, 15 nt, Homo sapiens
uguuauuuagacuca

SEQ ID NO: 1697092 - RNA, 14 nt, Homo sapiens
uguuauuugcacac

SEQ ID NO: 1697093 - RNA, 22 nt, Homo sapiens
uguuauuugcacacugcacugu

SEQ ID NO: 1697094 - RNA, 16 nt, Homo sapiens
uguucacugaagguga

SEQ ID NO: 1697095 - RNA, 24 nt, Homo sapiens
uguucauggguuuaccacuaacuc

SEQ ID NO: 1697096 - RNA, 19 nt, Homo sapiens
uguuccucuuggugucaua

SEQ ID NO: 1697097 - RNA, 19 nt, Homo sapiens
uguucuacccguuccaaaa

SEQ ID NO: 1697098 - RNA, 14 nt, Homo sapiens
uguucuacugagaa

SEQ ID NO: 1697099 - RNA, 16 nt, Homo sapiens
uguucuaugaacaacu

SEQ ID NO: 1697100 - RNA, 15 nt, Homo sapiens
uguucuguggcauag

SEQ ID NO: 1697101 - RNA, 19 nt, Homo sapiens
uguucuucuucauauucua

SEQ ID NO: 1697102 - RNA, 19 nt, Homo sapiens
uguucuugcagucaucaga

SEQ ID NO: 1697103 - RNA, 14 nt, Homo sapiens
uguucuugcugcua

SEQ ID NO: 1697104 - RNA, 15 nt, Homo sapiens
uguucuugcugcuag

SEQ ID NO: 1697105 - RNA, 17 nt, Homo sapiens
uguugaaaauguucaga

SEQ ID NO: 1697106 - RNA, 22 nt, Homo sapiens
uguugaguucuguagagccuuc

SEQ ID NO: 1697107 - RNA, 14 nt, Homo sapiens
uuucuggccaaaag

SEQ ID NO: 1697108 - RNA, 20 nt, Homo sapiens
uuucuggccaaaagcaguaa

SEQ ID NO: 1697109 - RNA, 21 nt, Homo sapiens
uuucuggggaaagacacugcc

SEQ ID NO: 1697110 - RNA, 13 nt, Homo sapiens
uuucuguaaacuc

SEQ ID NO: 1697111 - RNA, 14 nt, Homo sapiens
uuucugucuuugga

SEQ ID NO: 1697112 - RNA, 18 nt, Homo sapiens
uuugaaaaaaguacauau

SEQ ID NO: 1697113 - RNA, 16 nt, Homo sapiens
uuugaaaacauaaucu

SEQ ID NO: 1697114 - RNA, 17 nt, Homo sapiens
uuugaaaagucacuuac

SEQ ID NO: 1697115 - RNA, 20 nt, Homo sapiens
uuugaaaucaaugcaagagu

SEQ ID NO: 1697116 - RNA, 21 nt, Homo sapiens
uuugaaaugaaauuuaaacau

SEQ ID NO: 1697117 - RNA, 18 nt, Homo sapiens
uuugaagaacaugugaga

SEQ ID NO: 1697118 - RNA, 14 nt, Homo sapiens
uuugaaguuuacau

SEQ ID NO: 1697119 - RNA, 22 nt, Homo sapiens
uuugacugaauguuuuauggaa

SEQ ID NO: 1697120 - RNA, 15 nt, Homo sapiens
uuugagcgcgcugag

SEQ ID NO: 1697121 - RNA, 21 nt, Homo sapiens
uuugaguagauauuacuuuau

SEQ ID NO: 1697122 - RNA, 22 nt, Homo sapiens
uuugagucccccagagauguca

SEQ ID NO: 1697123 - RNA, 23 nt, Homo sapiens
uuugagugugugugugcaugugu

SEQ ID NO: 1697124 - RNA, 13 nt, Homo sapiens
uuugauugcacau

SEQ ID NO: 1697125 - RNA, 14 nt, Homo sapiens
uuugauuuacauau

SEQ ID NO: 1697126 - RNA, 18 nt, Homo sapiens
uuugcaauaaaaaugaua

SEQ ID NO: 1697127 - RNA, 14 nt, Homo sapiens
uuugcagacaggca

SEQ ID NO: 1697128 - RNA, 17 nt, Homo sapiens
uuugcauaugagccgug

SEQ ID NO: 1697129 - RNA, 10 nt, Homo sapiens
uuugccuucc

SEQ ID NO: 1697130 - RNA, 18 nt, Homo sapiens
uuugccuuuguaccauau

SEQ ID NO: 1697131 - RNA, 14 nt, Homo sapiens
uuugcuacauucua

SEQ ID NO: 1697132 - RNA, 23 nt, Homo sapiens
uuugcuacuaaguucacauuaga

SEQ ID NO: 1697133 - RNA, 19 nt, Homo sapiens
uuugcuagacucuagacaa

SEQ ID NO: 1697134 - RNA, 17 nt, Homo sapiens
uuugcuagcaguaaaag

SEQ ID NO: 1697135 - RNA, 12 nt, Homo sapiens
uuuggaaacaca

SEQ ID NO: 1697136 - RNA, 19 nt, Homo sapiens
uuugggagggaaaagggaa

SEQ ID NO: 1697137 - RNA, 12 nt, Homo sapiens
uuuggugcuaau

SEQ ID NO: 1697138 - RNA, 19 nt, Homo sapiens
uuuguaaaaauguccccac

SEQ ID NO: 1697139 - RNA, 21 nt, Homo sapiens
uuuguagagccagggucucac

SEQ ID NO: 1697140 - RNA, 17 nt, Homo sapiens
uuuguaggagacuugcc

SEQ ID NO: 1697141 - RNA, 20 nt, Homo sapiens
uuuguaggagacuugccaga

SEQ ID NO: 1697142 - RNA, 22 nt, Homo sapiens
uuuguauagaguucaucccagc

SEQ ID NO: 1697143 - RNA, 12 nt, Homo sapiens
uuugucagaaac

SEQ ID NO: 1697144 - RNA, 21 nt, Homo sapiens
uuuguguaucguaaccagcca

SEQ ID NO: 1697145 - RNA, 15 nt, Homo sapiens
uuuguucuuacacau

SEQ ID NO: 1697146 - RNA, 12 nt, Homo sapiens
uuuguugcccag

SEQ ID NO: 1697147 - RNA, 14 nt, Homo sapiens
uuuguuuuaaauac

SEQ ID NO: 1697148 - RNA, 13 nt, Homo sapiens
uuuuaacauucca

SEQ ID NO: 1697149 - RNA, 20 nt, Homo sapiens
uuuuaauccuuaacacauuc

SEQ ID NO: 1697150 - RNA, 18 nt, Homo sapiens
uuuuaauuaugggaauaa

SEQ ID NO: 1697151 - RNA, 19 nt, Homo sapiens
uuuuacauaacugccuuga

SEQ ID NO: 1697152 - RNA, 17 nt, Homo sapiens
uuuuacuucucuauaca

SEQ ID NO: 1697153 - RNA, 18 nt, Homo sapiens
uuuuagccauaaauugcu

SEQ ID NO: 1697154 - RNA, 14 nt, Homo sapiens
uuuuagcuuuacaa

SEQ ID NO: 1697155 - RNA, 23 nt, Homo sapiens
uuuuagguagaaaaacauauucu

SEQ ID NO: 1697156 - RNA, 20 nt, Homo sapiens
uuuuauacaaaccuaccaaa

SEQ ID NO: 1697157 - RNA, 22 nt, Homo sapiens
uuuuauggacaguaaguccagu

SEQ ID NO: 1697158 - RNA, 19 nt, Homo sapiens
uuuucaauuugagauucua

SEQ ID NO: 1697159 - RNA, 13 nt, Homo sapiens
uuuucaccccacc

SEQ ID NO: 1697160 - RNA, 10 nt, Homo sapiens
uuuucacugc

SEQ ID NO: 1697161 - RNA, 22 nt, Homo sapiens
uuuucagaaaauauuauguguu

SEQ ID NO: 1697162 - RNA, 12 nt, Homo sapiens
uuuucauuugag

SEQ ID NO: 1697163 - RNA, 16 nt, Homo sapiens
uuuucauuuuccaaua

SEQ ID NO: 1697164 - RNA, 13 nt, Homo sapiens
uuuucgaacauuc

SEQ ID NO: 1697165 - RNA, 22 nt, Homo sapiens
uuuucgcaccuaccaucaggga

SEQ ID NO: 1697166 - RNA, 15 nt, Homo sapiens
uuuucucuaccuuca

SEQ ID NO: 1697167 - RNA, 20 nt, Homo sapiens
uuuucucuuagaacauugua

SEQ ID NO: 1697168 - RNA, 17 nt, Homo sapiens
uuuucuuugagucuguu

SEQ ID NO: 1697169 - RNA, 13 nt, Homo sapiens
uuuugaaggcaaa

SEQ ID NO: 1697170 - RNA, 22 nt, Homo sapiens
uuuugauaacaaugacacuaga

SEQ ID NO: 1697171 - RNA, 17 nt, Homo sapiens
uuuugcaaaacauaucu

SEQ ID NO: 1697172 - RNA, 19 nt, Homo sapiens
uuuugguauuacacuguau

SEQ ID NO: 1697173 - RNA, 15 nt, Homo sapiens
uuuuguauuauugcu

SEQ ID NO: 1697174 - RNA, 19 nt, Homo sapiens
uuuugucuaugggacucaa

SEQ ID NO: 1697175 - RNA, 21 nt, Homo sapiens
uuuuuaugaagugcgugaaug

SEQ ID NO: 1697176 - RNA, 13 nt, Homo sapiens
uuuuuauuuauga

SEQ ID NO: 1697177 - RNA, 17 nt, Homo sapiens
uuuuucccagacuacua

SEQ ID NO: 1697178 - RNA, 21 nt, Homo sapiens
uuuuugaaaaaaguacauauu

SEQ ID NO: 1697179 - RNA, 22 nt, Homo sapiens
uuuuugacucccagaucaguca

SEQ ID NO: 1697180 - RNA, 13 nt, Homo sapiens
uuuuugguguaua

SEQ ID NO: 1697181 - RNA, 16 nt, Homo sapiens
uuuuuguaaacuggaa

SEQ ID NO: 1697182 - RNA, 12 nt, Homo sapiens
uuuuugugucaa

SEQ ID NO: 1697183 - RNA, 13 nt, Homo sapiens
uuuuuuaaacuag

SEQ ID NO: 1697184 - RNA, 20 nt, Homo sapiens
uauuuagauauaacacuaug

SEQ ID NO: 1697185 - RNA, 21 nt, Homo sapiens
uauuucaaaacacaucuuucc

SEQ ID NO: 1697186 - RNA, 15 nt, Homo sapiens
uauuucacuugauga

SEQ ID NO: 1697187 - RNA, 19 nt, Homo sapiens
uauuucauugccuguguau

SEQ ID NO: 1697188 - RNA, 19 nt, Homo sapiens
uauuucccauuugugccag

SEQ ID NO: 1697189 - RNA, 19 nt, Homo sapiens
uauuugcaguucaccugca

SEQ ID NO: 1697190 - RNA, 21 nt, Homo sapiens
uauuugcaguucaccugcacu

SEQ ID NO: 1697191 - RNA, 14 nt, Homo sapiens
uauuugguaccaug

SEQ ID NO: 1697192 - RNA, 15 nt, Homo sapiens
uauuugguaccaugg

SEQ ID NO: 1697193 - RNA, 19 nt, Homo sapiens
uauuugguaccauggugua

SEQ ID NO: 1697194 - RNA, 17 nt, Homo sapiens
uauuuguuugcaauuuu

SEQ ID NO: 1697195 - RNA, 18 nt, Homo sapiens
uauuuuaagcacucuuaa

SEQ ID NO: 1697196 - RNA, 21 nt, Homo sapiens
uauuuuuagacagagucucac

SEQ ID NO: 1697197 - RNA, 22 nt, Homo sapiens
uauuuuuauaaauauaagccuu

SEQ ID NO: 1697198 - RNA, 20 nt, Homo sapiens
uauuuuuauaauaaacauaa

SEQ ID NO: 1697199 - RNA, 16 nt, Homo sapiens
uauuuuuauccaugac

SEQ ID NO: 1697200 - RNA, 16 nt, Homo sapiens
uauuuuuuauauauac

SEQ ID NO: 1697201 - RNA, 14 nt, Homo sapiens
ucaaaacacugugg

SEQ ID NO: 1697202 - RNA, 13 nt, Homo sapiens
uagugcauccagu

SEQ ID NO: 1697203 - RNA, 13 nt, Homo sapiens
uaguggucuuugu

SEQ ID NO: 1697204 - RNA, 13 nt, Homo sapiens
uaguuaaaguaau

SEQ ID NO: 1697205 - RNA, 14 nt, Homo sapiens
uaguuaaaguaaug

SEQ ID NO: 1697206 - RNA, 23 nt, Homo sapiens
uaguugaucuacaaaggccaugg

SEQ ID NO: 1697207 - RNA, 18 nt, Homo sapiens
uauaaaauauaaacaaag

SEQ ID NO: 1697208 - RNA, 21 nt, Homo sapiens
uauaaagaagaacuugcaugg

SEQ ID NO: 1697209 - RNA, 16 nt, Homo sapiens
uauaaauauaagccuu

SEQ ID NO: 1697210 - RNA, 14 nt, Homo sapiens
uauaaaugagcaaa

SEQ ID NO: 1697211 - RNA, 23 nt, Homo sapiens
uauaagugaagugauacuaucca

SEQ ID NO: 1697212 - RNA, 13 nt, Homo sapiens
uauacacauauau

SEQ ID NO: 1697213 - RNA, 23 nt, Homo sapiens
uauacauguguguauauaugugu

SEQ ID NO: 1697214 - RNA, 18 nt, Homo sapiens
uauacauuugauguauug

SEQ ID NO: 1697215 - RNA, 20 nt, Homo sapiens
uauacccacauguacagaca

SEQ ID NO: 1697216 - RNA, 15 nt, Homo sapiens
uauacgcaucuauaa

SEQ ID NO: 1697217 - RNA, 15 nt, Homo sapiens
uauagaaacaccagu

SEQ ID NO: 1697218 - RNA, 14 nt, Homo sapiens
uauagacaguuugu

SEQ ID NO: 1697219 - RNA, 17 nt, Homo sapiens
uauagacuggaaaaaau

SEQ ID NO: 1697220 - RNA, 12 nt, Homo sapiens
uauagauucuaa

SEQ ID NO: 1697221 - RNA, 13 nt, Homo sapiens
uauagcuaaguac

SEQ ID NO: 1697222 - RNA, 17 nt, Homo sapiens
uauagcuaaguacacaa

SEQ ID NO: 1697223 - RNA, 21 nt, Homo sapiens
uauaggaaaaguuauugugau

SEQ ID NO: 1697224 - RNA, 17 nt, Homo sapiens
uauaguagacacacuau

SEQ ID NO: 1697225 - RNA, 20 nt, Homo sapiens
uauauacaguaacuuuaugu

SEQ ID NO: 1697226 - RNA, 23 nt, Homo sapiens
uauauauguacccacuuagucau

SEQ ID NO: 1697227 - RNA, 13 nt, Homo sapiens
uauauauucccaa

SEQ ID NO: 1697228 - RNA, 15 nt, Homo sapiens
uauaucccauugaaa

SEQ ID NO: 1697229 - RNA, 17 nt, Homo sapiens
uauauccccugcuaccc

SEQ ID NO: 1697230 - RNA, 12 nt, Homo sapiens
uauauccuguga

SEQ ID NO: 1697231 - RNA, 11 nt, Homo sapiens
uauauuugcua

SEQ ID NO: 1697232 - RNA, 22 nt, Homo sapiens
uauauuugugugaaaaugugac

SEQ ID NO: 1697233 - RNA, 13 nt, Homo sapiens
uaucaagcuuuua

SEQ ID NO: 1697234 - RNA, 15 nt, Homo sapiens
uaucaagucauggca

SEQ ID NO: 1697235 - RNA, 15 nt, Homo sapiens
uaucaauaucuaaua

SEQ ID NO: 1697236 - RNA, 23 nt, Homo sapiens
uaucacaugaauauaaaugggaa

SEQ ID NO: 1697237 - RNA, 21 nt, Homo sapiens
uaucacgcgcacagccuggca

SEQ ID NO: 1697238 - RNA, 17 nt, Homo sapiens
uaucacugaacaaacua

SEQ ID NO: 1697239 - RNA, 19 nt, Homo sapiens
uaucacugaacaaacuaaa

SEQ ID NO: 1697240 - RNA, 14 nt, Homo sapiens
uaucaggugcugcc

SEQ ID NO: 1697241 - RNA, 16 nt, Homo sapiens
uaucaguugacagugu

SEQ ID NO: 1697242 - RNA, 18 nt, Homo sapiens
uauccaauaggcauuuga

SEQ ID NO: 1697243 - RNA, 13 nt, Homo sapiens
uauccaccaagaa

SEQ ID NO: 1697244 - RNA, 14 nt, Homo sapiens
uauccaccaccucc

SEQ ID NO: 1697245 - RNA, 13 nt, Homo sapiens
uauccacuacucc

SEQ ID NO: 1697246 - RNA, 19 nt, Homo sapiens
uauccagauggaggcacca

SEQ ID NO: 1697247 - RNA, 12 nt, Homo sapiens
uauccauggcaa

SEQ ID NO: 1697248 - RNA, 18 nt, Homo sapiens
uauccugacuucuaauau

SEQ ID NO: 1697249 - RNA, 18 nt, Homo sapiens
uauccuuucuaacaaaaa

SEQ ID NO: 1697250 - RNA, 16 nt, Homo sapiens
uaucggcucacaaaga

SEQ ID NO: 1697251 - RNA, 21 nt, Homo sapiens
uaucuacccaagggcagaaag

SEQ ID NO: 1697252 - RNA, 15 nt, Homo sapiens
uaucuauagcugcua

SEQ ID NO: 1697253 - RNA, 23 nt, Homo sapiens
uaucucaggggccaacuaggcag

SEQ ID NO: 1697254 - RNA, 21 nt, Homo sapiens
uaucuggccuaaaaucuugga

SEQ ID NO: 1697255 - RNA, 16 nt, Homo sapiens
uaucugggugccuuaa

SEQ ID NO: 1697256 - RNA, 19 nt, Homo sapiens
uaucugugucaaaagccag

SEQ ID NO: 1697257 - RNA, 22 nt, Homo sapiens
uaucuuagugguuccccaccga

SEQ ID NO: 1697258 - RNA, 19 nt, Homo sapiens
uaucuugggauaguuccca

SEQ ID NO: 1697259 - RNA, 18 nt, Homo sapiens
uaucuuucgauaaacaac

SEQ ID NO: 1697260 - RNA, 14 nt, Homo sapiens
uaucuuugugauaa

SEQ ID NO: 1697261 - RNA, 13 nt, Homo sapiens
uaugaaacuauug

SEQ ID NO: 1697262 - RNA, 16 nt, Homo sapiens
uaugaaaugaccucug

SEQ ID NO: 1697263 - RNA, 16 nt, Homo sapiens
uaugaacuucucucag

SEQ ID NO: 1697264 - RNA, 19 nt, Homo sapiens
uaugagcuugcucauuaau

SEQ ID NO: 1697265 - RNA, 12 nt, Homo sapiens
uaugagggaaaa

SEQ ID NO: 1697266 - RNA, 17 nt, Homo sapiens
uaugaguaguguggaau

SEQ ID NO: 1697267 - RNA, 17 nt, Homo sapiens
uaugaucacggcucacu

SEQ ID NO: 1697268 - RNA, 15 nt, Homo sapiens
uaugauguaaucucu

SEQ ID NO: 1697269 - RNA, 23 nt, Homo sapiens
uaugauguaaucucucugcagcu

SEQ ID NO: 1697270 - RNA, 18 nt, Homo sapiens
uaugcauuugcauuugcu

SEQ ID NO: 1697271 - RNA, 13 nt, Homo sapiens
uaugccuucuuau

SEQ ID NO: 1697272 - RNA, 22 nt, Homo sapiens
uaugcuggacucuggaccauau

SEQ ID NO: 1697273 - RNA, 12 nt, Homo sapiens
uauggacucugc

SEQ ID NO: 1697274 - RNA, 14 nt, Homo sapiens
uauggcuccuccau

SEQ ID NO: 1697275 - RNA, 16 nt, Homo sapiens
uauggcuccuccauau

SEQ ID NO: 1697276 - RNA, 20 nt, Homo sapiens
uaugggggcacugaggacca

SEQ ID NO: 1697277 - RNA, 22 nt, Homo sapiens
uauguaaucucaccucaccugg

SEQ ID NO: 1697278 - RNA, 16 nt, Homo sapiens
uauguacaauuguggg

SEQ ID NO: 1697279 - RNA, 18 nt, Homo sapiens
uauguagacuauauacau

SEQ ID NO: 1697280 - RNA, 16 nt, Homo sapiens
uauguagauauuuggc

SEQ ID NO: 1697281 - RNA, 13 nt, Homo sapiens
uauguauauauac

SEQ ID NO: 1697282 - RNA, 14 nt, Homo sapiens
uaugucuuggacac

SEQ ID NO: 1697283 - RNA, 18 nt, Homo sapiens
uaugucuuggacacugua

SEQ ID NO: 1697284 - RNA, 19 nt, Homo sapiens
uaugucuuggacacuguac

SEQ ID NO: 1697285 - RNA, 20 nt, Homo sapiens
uaugugacauuuuacauuaa

SEQ ID NO: 1697286 - RNA, 18 nt, Homo sapiens
uaugugcuuucaucacaa

SEQ ID NO: 1697287 - RNA, 17 nt, Homo sapiens
uauguguauauauacau

SEQ ID NO: 1697288 - RNA, 22 nt, Homo sapiens
uaugugucccgaauccacaguc

SEQ ID NO: 1697289 - RNA, 18 nt, Homo sapiens
uaugugugaggagcugcu

SEQ ID NO: 1697290 - RNA, 22 nt, Homo sapiens
uauuaaucuuggauagcuaaua

SEQ ID NO: 1697291 - RNA, 14 nt, Homo sapiens
uauuagaaauuaga

SEQ ID NO: 1697292 - RNA, 16 nt, Homo sapiens
uauuagcuuauauauu

SEQ ID NO: 1697293 - RNA, 15 nt, Homo sapiens
uauuaggccauauau

SEQ ID NO: 1697294 - RNA, 15 nt, Homo sapiens
uauuaguacugcucu

SEQ ID NO: 1697295 - RNA, 15 nt, Homo sapiens
uauuaguaucuucca

SEQ ID NO: 1697296 - RNA, 17 nt, Homo sapiens
uauuauucuacuauacu

SEQ ID NO: 1697297 - RNA, 13 nt, Homo sapiens
uauuauuguggaa

SEQ ID NO: 1697298 - RNA, 23 nt, Homo sapiens
uauucagauauaaaacaguuuug

SEQ ID NO: 1697299 - RNA, 18 nt, Homo sapiens
uauucauuagcugugauu

SEQ ID NO: 1697300 - RNA, 22 nt, Homo sapiens
uauuccauggcuaacuggcgag

SEQ ID NO: 1697301 - RNA, 17 nt, Homo sapiens
uauucugguuacugugg

SEQ ID NO: 1697302 - RNA, 15 nt, Homo sapiens
uauucugugcgcuac

SEQ ID NO: 1697303 - RNA, 15 nt, Homo sapiens
uauugacuucaauga

SEQ ID NO: 1697304 - RNA, 16 nt, Homo sapiens
uauuggaaaaaucaca

SEQ ID NO: 1697305 - RNA, 15 nt, Homo sapiens
uauuguauaaacuau

SEQ ID NO: 1697306 - RNA, 15 nt, Homo sapiens
uauuguuacacauua

SEQ ID NO: 1697307 - RNA, 14 nt, Homo sapiens
uauuguugcugaaa

SEQ ID NO: 1697308 - RNA, 19 nt, Homo sapiens
uauuuaaacucaagacaau

SEQ ID NO: 1697309 - RNA, 13 nt, Homo sapiens
uauuuaaagcauu

SEQ ID NO: 1697310 - RNA, 16 nt, Homo sapiens
uauuuaauucacuuaa

SEQ ID NO: 1697311 - RNA, 15 nt, Homo sapiens
uauuuacaugugauu

SEQ ID NO: 1697312 - RNA, 14 nt, Homo sapiens
uacccaugaagauu

SEQ ID NO: 1697313 - RNA, 16 nt, Homo sapiens
uaccccuuugcacuug

SEQ ID NO: 1697314 - RNA, 14 nt, Homo sapiens
uacccuauacaucc

SEQ ID NO: 1697315 - RNA, 18 nt, Homo sapiens
uacccuuuuucuccagcu

SEQ ID NO: 1697316 - RNA, 16 nt, Homo sapiens
uaccuaacauuauuua

SEQ ID NO: 1697317 - RNA, 16 nt, Homo sapiens
uaccuaaguacuguaa

SEQ ID NO: 1697318 - RNA, 22 nt, Homo sapiens
uaccucaguucccucuugcuca

SEQ ID NO: 1697319 - RNA, 20 nt, Homo sapiens
uaccuccuccucuggacaaa

SEQ ID NO: 1697320 - RNA, 22 nt, Homo sapiens
uaccuguaagggcaaagucaau

SEQ ID NO: 1697321 - RNA, 17 nt, Homo sapiens
uacgacuucauuccuuc

SEQ ID NO: 1697322 - RNA, 17 nt, Homo sapiens
uacgcaggcaucugauu

SEQ ID NO: 1697323 - RNA, 17 nt, Homo sapiens
uacgguuuucauugaca

SEQ ID NO: 1697324 - RNA, 23 nt, Homo sapiens
uacuaagccacaagaaauuugau

SEQ ID NO: 1697325 - RNA, 20 nt, Homo sapiens
uacuaauucuuacacugccu

SEQ ID NO: 1697326 - RNA, 14 nt, Homo sapiens
uacuaccuguguau

SEQ ID NO: 1697327 - RNA, 21 nt, Homo sapiens
uacucagguuaaugcugaaaa

SEQ ID NO: 1697328 - RNA, 22 nt, Homo sapiens
uacuccagccugggcaacagag

SEQ ID NO: 1697329 - RNA, 20 nt, Homo sapiens
uacuccccagaccucaggga

SEQ ID NO: 1697330 - RNA, 15 nt, Homo sapiens
uacucuuaucugggu

SEQ ID NO: 1697331 - RNA, 19 nt, Homo sapiens
uacucuucuuacuggugcu

SEQ ID NO: 1697332 - RNA, 14 nt, Homo sapiens
uacugaguaugugg

SEQ ID NO: 1697333 - RNA, 16 nt, Homo sapiens
uacugaguauguggaa

SEQ ID NO: 1697334 - RNA, 14 nt, Homo sapiens
uacugauucacugc

SEQ ID NO: 1697335 - RNA, 16 nt, Homo sapiens
uacugauucacugcau

SEQ ID NO: 1697336 - RNA, 13 nt, Homo sapiens
uacugccauguac

SEQ ID NO: 1697337 - RNA, 13 nt, Homo sapiens
uacuguaauuccu

SEQ ID NO: 1697338 - RNA, 17 nt, Homo sapiens
uacuguagugauucaaa

SEQ ID NO: 1697339 - RNA, 15 nt, Homo sapiens
uacuguucuugcugc

SEQ ID NO: 1697340 - RNA, 19 nt, Homo sapiens
uacuuaacuauucaggaga

SEQ ID NO: 1697341 - RNA, 19 nt, Homo sapiens
uacuuacuccccacugaug

SEQ ID NO: 1697342 - RNA, 12 nt, Homo sapiens
uacuuccaucug

SEQ ID NO: 1697343 - RNA, 14 nt, Homo sapiens
uacuucuccacugu

SEQ ID NO: 1697344 - RNA, 14 nt, Homo sapiens
uacuuguggacaca

SEQ ID NO: 1697345 - RNA, 24 nt, Homo sapiens
uacuuugggacgcccacguggcag

SEQ ID NO: 1697346 - RNA, 20 nt, Homo sapiens
uagaaacaccaguaccugaa

SEQ ID NO: 1697347 - RNA, 14 nt, Homo sapiens
uagaaagggccuug

SEQ ID NO: 1697348 - RNA, 12 nt, Homo sapiens
uagaaauggauu

SEQ ID NO: 1697349 - RNA, 18 nt, Homo sapiens
uagaaauguaaacugcca

SEQ ID NO: 1697350 - RNA, 19 nt, Homo sapiens
uagaaauguaaacugccau

SEQ ID NO: 1697351 - RNA, 16 nt, Homo sapiens
uagaacacugcauuag

SEQ ID NO: 1697352 - RNA, 17 nt, Homo sapiens
uagaacacugcauuaga

SEQ ID NO: 1697353 - RNA, 18 nt, Homo sapiens
uagaagauagaugcacuu

SEQ ID NO: 1697354 - RNA, 21 nt, Homo sapiens
uagaaggcacaauaugggcac

SEQ ID NO: 1697355 - RNA, 19 nt, Homo sapiens
uagaaguagcaaaaaguau

SEQ ID NO: 1697356 - RNA, 22 nt, Homo sapiens
uagaaguuaaugauuuuacuua

SEQ ID NO: 1697357 - RNA, 18 nt, Homo sapiens
uagaauaggcuguguauu

SEQ ID NO: 1697358 - RNA, 21 nt, Homo sapiens
uagaaugagcacccauuccaa

SEQ ID NO: 1697359 - RNA, 12 nt, Homo sapiens
uagaauugcauu

SEQ ID NO: 1697360 - RNA, 13 nt, Homo sapiens
uagacaauuugca

SEQ ID NO: 1697361 - RNA, 22 nt, Homo sapiens
uagacaugucuagccacugauc

SEQ ID NO: 1697362 - RNA, 19 nt, Homo sapiens
uagacuauauacaugugug

SEQ ID NO: 1697363 - RNA, 16 nt, Homo sapiens
uagagacuucacccgg

SEQ ID NO: 1697364 - RNA, 16 nt, Homo sapiens
uagagagagaacuuuu

SEQ ID NO: 1697365 - RNA, 14 nt, Homo sapiens
uagagagagacuau

SEQ ID NO: 1697366 - RNA, 18 nt, Homo sapiens
uagagauagcuacagugu

SEQ ID NO: 1697367 - RNA, 18 nt, Homo sapiens
uagagccagggucucacu

SEQ ID NO: 1697368 - RNA, 22 nt, Homo sapiens
uagagccuucugaugucucuaa

SEQ ID NO: 1697369 - RNA, 18 nt, Homo sapiens
uagaggcugggggcucca

SEQ ID NO: 1697370 - RNA, 14 nt, Homo sapiens
uagauauaugccuu

SEQ ID NO: 1697371 - RNA, 15 nt, Homo sapiens
uagaucaaagucaaa

SEQ ID NO: 1697372 - RNA, 16 nt, Homo sapiens
uagaucagaagacuac

SEQ ID NO: 1697373 - RNA, 19 nt, Homo sapiens
uagaucagaagacuacaaa

SEQ ID NO: 1697374 - RNA, 22 nt, Homo sapiens
uagaugauuaaauaagauucua

SEQ ID NO: 1697375 - RNA, 14 nt, Homo sapiens
uagauguugccaug

SEQ ID NO: 1697376 - RNA, 21 nt, Homo sapiens
uagauguuuauucuucuagag

SEQ ID NO: 1697377 - RNA, 20 nt, Homo sapiens
uagauuaaauaaaacuuaaa

SEQ ID NO: 1697378 - RNA, 18 nt, Homo sapiens
uagauuaauggcacugau

SEQ ID NO: 1697379 - RNA, 18 nt, Homo sapiens
uagauucucugugucuaa

SEQ ID NO: 1697380 - RNA, 13 nt, Homo sapiens
uagcaaauucaaa

SEQ ID NO: 1697381 - RNA, 17 nt, Homo sapiens
uagcaagacacaucccu

SEQ ID NO: 1697382 - RNA, 16 nt, Homo sapiens
uagcaauugacuguca

SEQ ID NO: 1697383 - RNA, 14 nt, Homo sapiens
uagcacuaggcacc

SEQ ID NO: 1697384 - RNA, 21 nt, Homo sapiens
uagcacuuugaaauaccucau

SEQ ID NO: 1697385 - RNA, 12 nt, Homo sapiens
uagcaucucagg

SEQ ID NO: 1697386 - RNA, 17 nt, Homo sapiens
uagcauucauaaccaaa

SEQ ID NO: 1697387 - RNA, 20 nt, Homo sapiens
uagcauuuucucuaccuuca

SEQ ID NO: 1697388 - RNA, 15 nt, Homo sapiens
uagccaaugucuccu

SEQ ID NO: 1697389 - RNA, 15 nt, Homo sapiens
uagccagggggacua

SEQ ID NO: 1697390 - RNA, 19 nt, Homo sapiens
uagccagugcuccaggcac

SEQ ID NO: 1697391 - RNA, 13 nt, Homo sapiens
uagcccaggagag

SEQ ID NO: 1697392 - RNA, 21 nt, Homo sapiens
uagccugcagccucaucauuu

SEQ ID NO: 1697393 - RNA, 22 nt, Homo sapiens
uagccuggauauuauucuugua

SEQ ID NO: 1697394 - RNA, 17 nt, Homo sapiens
uagcggucaauuugccu

SEQ ID NO: 1697395 - RNA, 20 nt, Homo sapiens
uagcuauggaaucaauucaa

SEQ ID NO: 1697396 - RNA, 17 nt, Homo sapiens
uagcugggacuacaggc

SEQ ID NO: 1697397 - RNA, 12 nt, Homo sapiens
uagcuguaaaac

SEQ ID NO: 1697398 - RNA, 22 nt, Homo sapiens
uagcuguaaaacgcugucaaaa

SEQ ID NO: 1697399 - RNA, 18 nt, Homo sapiens
uagcugugcaagaccuag

SEQ ID NO: 1697400 - RNA, 23 nt, Homo sapiens
uagcugugucauguauauaccuu

SEQ ID NO: 1697401 - RNA, 16 nt, Homo sapiens
uagcuugcaccuuguc

SEQ ID NO: 1697402 - RNA, 23 nt, Homo sapiens
uagcuuuagggcaauauugccau

SEQ ID NO: 1697403 - RNA, 19 nt, Homo sapiens
uagcuuuauauauggacau

SEQ ID NO: 1697404 - RNA, 20 nt, Homo sapiens
uagcuuucccaaauaaacuc

SEQ ID NO: 1697405 - RNA, 17 nt, Homo sapiens
uaggagggagacacugg

SEQ ID NO: 1697406 - RNA, 14 nt, Homo sapiens
uaggauaagccacu

SEQ ID NO: 1697407 - RNA, 19 nt, Homo sapiens
uaggcucagagaugugcac

SEQ ID NO: 1697408 - RNA, 19 nt, Homo sapiens
uagggcaauauugccaugg

SEQ ID NO: 1697409 - RNA, 13 nt, Homo sapiens
uaggggcaaaaau

SEQ ID NO: 1697410 - RNA, 17 nt, Homo sapiens
uaggguagugcuaagag

SEQ ID NO: 1697411 - RNA, 16 nt, Homo sapiens
uaggguggcccuugca

SEQ ID NO: 1697412 - RNA, 12 nt, Homo sapiens
uagguagcuuua

SEQ ID NO: 1697413 - RNA, 14 nt, Homo sapiens
uagguugugcaaau

SEQ ID NO: 1697414 - RNA, 20 nt, Homo sapiens
uagguuuacauucaucucau

SEQ ID NO: 1697415 - RNA, 15 nt, Homo sapiens
uaguaaucacaguug

SEQ ID NO: 1697416 - RNA, 15 nt, Homo sapiens
uaguagacacacuau

SEQ ID NO: 1697417 - RNA, 13 nt, Homo sapiens
uaguauacuuugu

SEQ ID NO: 1697418 - RNA, 20 nt, Homo sapiens
uagucacauggccuaugcac

SEQ ID NO: 1697419 - RNA, 17 nt, Homo sapiens
uagucccagcuacuccg

SEQ ID NO: 1697420 - RNA, 18 nt, Homo sapiens
uaguccggacccaccuca

SEQ ID NO: 1697421 - RNA, 21 nt, Homo sapiens
uagugaccccugccuacuucc

SEQ ID NO: 1697422 - RNA, 13 nt, Homo sapiens
uaagauccacaaa

SEQ ID NO: 1697423 - RNA, 11 nt, Homo sapiens
uaagauucuaa

SEQ ID NO: 1697424 - RNA, 15 nt, Homo sapiens
uaagcaauaccagca

SEQ ID NO: 1697425 - RNA, 19 nt, Homo sapiens
uaagccaaagaaaugaaca

SEQ ID NO: 1697426 - RNA, 14 nt, Homo sapiens
uaagcccucaggag

SEQ ID NO: 1697427 - RNA, 16 nt, Homo sapiens
uaaggaugucacaggg

SEQ ID NO: 1697428 - RNA, 18 nt, Homo sapiens
uaagggacucccacaaca

SEQ ID NO: 1697429 - RNA, 15 nt, Homo sapiens
uaagggggugcagca

SEQ ID NO: 1697430 - RNA, 15 nt, Homo sapiens
uaagggguuugccau

SEQ ID NO: 1697431 - RNA, 17 nt, Homo sapiens
uaagggugggugcucag

SEQ ID NO: 1697432 - RNA, 15 nt, Homo sapiens
uaaguaacauaacua

SEQ ID NO: 1697433 - RNA, 16 nt, Homo sapiens
uaagucacaaagaguu

SEQ ID NO: 1697434 - RNA, 11 nt, Homo sapiens
uaagugcugcu

SEQ ID NO: 1697435 - RNA, 12 nt, Homo sapiens
uaagugcugcua

SEQ ID NO: 1697436 - RNA, 13 nt, Homo sapiens
uaagugcugcuau

SEQ ID NO: 1697437 - RNA, 11 nt, Homo sapiens
uaagugucacc

SEQ ID NO: 1697438 - RNA, 21 nt, Homo sapiens
uaaguucagcacuugucucau

SEQ ID NO: 1697439 - RNA, 19 nt, Homo sapiens
uaaguuccagcagaugcca

SEQ ID NO: 1697440 - RNA, 21 nt, Homo sapiens
uaauaaaaaauauucuuguca

SEQ ID NO: 1697441 - RNA, 22 nt, Homo sapiens
uaauaaaaaauauucuugucaa

SEQ ID NO: 1697442 - RNA, 19 nt, Homo sapiens
uaauaaaacuuaacuucca

SEQ ID NO: 1697443 - RNA, 16 nt, Homo sapiens
uaauaaagucuaugga

SEQ ID NO: 1697444 - RNA, 13 nt, Homo sapiens
uaauaacugugaa

SEQ ID NO: 1697445 - RNA, 13 nt, Homo sapiens
uaauaauaccuca

SEQ ID NO: 1697446 - RNA, 14 nt, Homo sapiens
uaauaauaccucaa

SEQ ID NO: 1697447 - RNA, 11 nt, Homo sapiens
uaauaccucaa

SEQ ID NO: 1697448 - RNA, 18 nt, Homo sapiens
uaauacuccuaagacuua

SEQ ID NO: 1697449 - RNA, 22 nt, Homo sapiens
uaauagcuauggaaucaauuca

SEQ ID NO: 1697450 - RNA, 17 nt, Homo sapiens
uaauauaagcugccaua

SEQ ID NO: 1697451 - RNA, 15 nt, Homo sapiens
uaauauauuguacac

SEQ ID NO: 1697452 - RNA, 15 nt, Homo sapiens
uaauaugacaaaaca

SEQ ID NO: 1697453 - RNA, 19 nt, Homo sapiens
uaauauuuuuccacuuaaa

SEQ ID NO: 1697454 - RNA, 20 nt, Homo sapiens
uaaucaaaaugaaggcuuag

SEQ ID NO: 1697455 - RNA, 17 nt, Homo sapiens
uaaucacaaauuucacu

SEQ ID NO: 1697456 - RNA, 18 nt, Homo sapiens
uaauccuuaacacauuca

SEQ ID NO: 1697457 - RNA, 14 nt, Homo sapiens
uaaucuaguuuaca

SEQ ID NO: 1697458 - RNA, 17 nt, Homo sapiens
uaaucucauaccucuga

SEQ ID NO: 1697459 - RNA, 17 nt, Homo sapiens
uaaucucucugcagcug

SEQ ID NO: 1697460 - RNA, 19 nt, Homo sapiens
uaaucucucugcagcugcc

SEQ ID NO: 1697461 - RNA, 16 nt, Homo sapiens
uaaucuggacuccucu

SEQ ID NO: 1697462 - RNA, 22 nt, Homo sapiens
uaaucuggacuccucuguccag

SEQ ID NO: 1697463 - RNA, 19 nt, Homo sapiens
uaaucuucuuaugcaauuu

SEQ ID NO: 1697464 - RNA, 18 nt, Homo sapiens
uaaucuuggauagcuaau

SEQ ID NO: 1697465 - RNA, 15 nt, Homo sapiens
uaaugaaaaugaaua

SEQ ID NO: 1697466 - RNA, 20 nt, Homo sapiens
uaaugaaaaugaauaucuau

SEQ ID NO: 1697467 - RNA, 23 nt, Homo sapiens
uaaugaaaaugaauaucuauuaa

SEQ ID NO: 1697468 - RNA, 14 nt, Homo sapiens
uaaugaaacacagc

SEQ ID NO: 1697469 - RNA, 13 nt, Homo sapiens
uaaugaacaugug

SEQ ID NO: 1697470 - RNA, 13 nt, Homo sapiens
uaaugaaugacau

SEQ ID NO: 1697471 - RNA, 17 nt, Homo sapiens
uaaugacaaugaaguga

SEQ ID NO: 1697472 - RNA, 15 nt, Homo sapiens
uaaugagacaugaau

SEQ ID NO: 1697473 - RNA, 16 nt, Homo sapiens
uaaugagacugaccau

SEQ ID NO: 1697474 - RNA, 17 nt, Homo sapiens
uaaugauuuuacuuaac

SEQ ID NO: 1697475 - RNA, 19 nt, Homo sapiens
uaaugccauuaucccugaa

SEQ ID NO: 1697476 - RNA, 18 nt, Homo sapiens
uaauggggacacagauca

SEQ ID NO: 1697477 - RNA, 14 nt, Homo sapiens
uaaugguguuuuaa

SEQ ID NO: 1697478 - RNA, 17 nt, Homo sapiens
uaauguagcguguuuac

SEQ ID NO: 1697479 - RNA, 21 nt, Homo sapiens
uaauguauuuguuugcaauuu

SEQ ID NO: 1697480 - RNA, 21 nt, Homo sapiens
uaaugucuucauaaaguacuu

SEQ ID NO: 1697481 - RNA, 23 nt, Homo sapiens
uaaugugaaguagaauccuaaau

SEQ ID NO: 1697482 - RNA, 22 nt, Homo sapiens
uaauguggaagaaaaugguuua

SEQ ID NO: 1697483 - RNA, 20 nt, Homo sapiens
uaauuaugaguuugcuuaug

SEQ ID NO: 1697484 - RNA, 12 nt, Homo sapiens
uaauuauugcuu

SEQ ID NO: 1697485 - RNA, 17 nt, Homo sapiens
uaauucacucaagcacu

SEQ ID NO: 1697486 - RNA, 13 nt, Homo sapiens
uaauucauggcau

SEQ ID NO: 1697487 - RNA, 19 nt, Homo sapiens
uaauuccaauuauaugaga

SEQ ID NO: 1697488 - RNA, 19 nt, Homo sapiens
uaauuuaaaaaauaacuac

SEQ ID NO: 1697489 - RNA, 22 nt, Homo sapiens
uaauuuuuucccagacuacuau

SEQ ID NO: 1697490 - RNA, 20 nt, Homo sapiens
uaauuuuuuugagacagagu

SEQ ID NO: 1697491 - RNA, 17 nt, Homo sapiens
uacaaacucccacuugu

SEQ ID NO: 1697492 - RNA, 20 nt, Homo sapiens
uacaaagacccacauguaaa

SEQ ID NO: 1697493 - RNA, 17 nt, Homo sapiens
uacaaauauauuguuaa

SEQ ID NO: 1697494 - RNA, 21 nt, Homo sapiens
uacaacauaaucuaguuuaca

SEQ ID NO: 1697495 - RNA, 18 nt, Homo sapiens
uacaacugccucgaaaca

SEQ ID NO: 1697496 - RNA, 14 nt, Homo sapiens
uacaagcgugagcc

SEQ ID NO: 1697497 - RNA, 11 nt, Homo sapiens
uacaauuguga

SEQ ID NO: 1697498 - RNA, 14 nt, Homo sapiens
uacacaauaagcaa

SEQ ID NO: 1697499 - RNA, 17 nt, Homo sapiens
uacacagaaacacugcc

SEQ ID NO: 1697500 - RNA, 18 nt, Homo sapiens
uacacagaaacacugccu

SEQ ID NO: 1697501 - RNA, 15 nt, Homo sapiens
uacacuaaccaaauc

SEQ ID NO: 1697502 - RNA, 23 nt, Homo sapiens
uacacucuugacuagugcaauuu

SEQ ID NO: 1697503 - RNA, 16 nt, Homo sapiens
uacacugccuguauac

SEQ ID NO: 1697504 - RNA, 17 nt, Homo sapiens
uacacuggguucugcua

SEQ ID NO: 1697505 - RNA, 23 nt, Homo sapiens
uacagacauacauuuaugcacau

SEQ ID NO: 1697506 - RNA, 22 nt, Homo sapiens
uacagcuaaucagcauucucac

SEQ ID NO: 1697507 - RNA, 18 nt, Homo sapiens
uacagggcauucaaaugg

SEQ ID NO: 1697508 - RNA, 20 nt, Homo sapiens
uacauacaggccauacuuua

SEQ ID NO: 1697509 - RNA, 23 nt, Homo sapiens
uacauacaggccauacuuuacaa

SEQ ID NO: 1697510 - RNA, 20 nt, Homo sapiens
uacauccagucacuuugcca

SEQ ID NO: 1697511 - RNA, 14 nt, Homo sapiens
uacaugcaauuuau

SEQ ID NO: 1697512 - RNA, 18 nt, Homo sapiens
uacaugcagcccaugccc

SEQ ID NO: 1697513 - RNA, 14 nt, Homo sapiens
uacaugcauacaaa

SEQ ID NO: 1697514 - RNA, 23 nt, Homo sapiens
uacaugugauugugauucaucau

SEQ ID NO: 1697515 - RNA, 22 nt, Homo sapiens
uacauucugcaagcacaucugc

SEQ ID NO: 1697516 - RNA, 16 nt, Homo sapiens
uacauugaguagacac

SEQ ID NO: 1697517 - RNA, 17 nt, Homo sapiens
uacauuuaugcacauuc

SEQ ID NO: 1697518 - RNA, 18 nt, Homo sapiens
uacauuucuuagacuaca

SEQ ID NO: 1697519 - RNA, 18 nt, Homo sapiens
uacauuugugaacaaaaa

SEQ ID NO: 1697520 - RNA, 15 nt, Homo sapiens
uaccaaaagggccau

SEQ ID NO: 1697521 - RNA, 15 nt, Homo sapiens
uaccacucagagaaa

SEQ ID NO: 1697522 - RNA, 17 nt, Homo sapiens
uaccagggauguagauu

SEQ ID NO: 1697523 - RNA, 23 nt, Homo sapiens
uaccauuuuuuaaggaaacaaua

SEQ ID NO: 1697524 - RNA, 14 nt, Homo sapiens
uacccaauuuccca

SEQ ID NO: 1697525 - RNA, 13 nt, Homo sapiens
uacccacauguac

SEQ ID NO: 1697526 - RNA, 14 nt, Homo sapiens
uacccacauguaca

SEQ ID NO: 1697527 - RNA, 22 nt, Homo sapiens
uacccacugaagcccauuucuc

SEQ ID NO: 1697528 - RNA, 14 nt, Homo sapiens
uacccagagagucc

SEQ ID NO: 1697529 - RNA, 18 nt, Homo sapiens
uacccagagaguccugug

SEQ ID NO: 1697530 - RNA, 22 nt, Homo sapiens
uacccagagaguccugugcuga

SEQ ID NO: 1697531 - RNA, 17 nt, Homo sapiens
uacccaucuaguacuug

SEQ ID NO: 1697532 - RNA, 23 nt, Homo sapiens
guuuugaaggcaaaauugcaaau

SEQ ID NO: 1697533 - RNA, 15 nt, Homo sapiens
guuuugcuacauucu

SEQ ID NO: 1697534 - RNA, 16 nt, Homo sapiens
guuuugcuacauucua

SEQ ID NO: 1697535 - RNA, 23 nt, Homo sapiens
guuuuggaagcucugaagucaca

SEQ ID NO: 1697536 - RNA, 23 nt, Homo sapiens
guuuuggguagcugccacuugaa

SEQ ID NO: 1697537 - RNA, 21 nt, Homo sapiens
guuuuguaggagacuugccag

SEQ ID NO: 1697538 - RNA, 22 nt, Homo sapiens
guuuuuaaauagaguuugcuau

SEQ ID NO: 1697539 - RNA, 21 nt, Homo sapiens
guuuuucaccacuucacugaa

SEQ ID NO: 1697540 - RNA, 17 nt, Homo sapiens
guuuuugcuuguuauau

SEQ ID NO: 1697541 - RNA, 17 nt, Homo sapiens
guuuuuguuuuuuucca

SEQ ID NO: 1697542 - RNA, 16 nt, Homo sapiens
guuuuuuaaauguaua

SEQ ID NO: 1697543 - RNA, 21 nt, Homo sapiens
guuuuuugaaauuaugugaca

SEQ ID NO: 1697544 - RNA, 18 nt, Homo sapiens
uaaaaaaaaaaaaaagcu

SEQ ID NO: 1697545 - RNA, 14 nt, Homo sapiens
uaaaaaaacuucca

SEQ ID NO: 1697546 - RNA, 14 nt, Homo sapiens
uaaaaaaucuuaau

SEQ ID NO: 1697547 - RNA, 20 nt, Homo sapiens
uaaaaacaccaaaaagggau

SEQ ID NO: 1697548 - RNA, 18 nt, Homo sapiens
uaaaaagugacacagcag

SEQ ID NO: 1697549 - RNA, 17 nt, Homo sapiens
uaaaaaguuaaucuuca

SEQ ID NO: 1697550 - RNA, 16 nt, Homo sapiens
uaaaaauaugcuucua

SEQ ID NO: 1697551 - RNA, 17 nt, Homo sapiens
uaaaaaugauacugaug

SEQ ID NO: 1697552 - RNA, 13 nt, Homo sapiens
uaaaaauguccug

SEQ ID NO: 1697553 - RNA, 17 nt, Homo sapiens
uaaaaauguccugccuu

SEQ ID NO: 1697554 - RNA, 19 nt, Homo sapiens
uaaaacauugaaugaaacu

SEQ ID NO: 1697555 - RNA, 22 nt, Homo sapiens
uaaaagguuaaauauugucaua

SEQ ID NO: 1697556 - RNA, 16 nt, Homo sapiens
uaaaagugaucuacau

SEQ ID NO: 1697557 - RNA, 13 nt, Homo sapiens
uaaaauaacacuu

SEQ ID NO: 1697558 - RNA, 17 nt, Homo sapiens
uaaaauaagaaugauuu

SEQ ID NO: 1697559 - RNA, 16 nt, Homo sapiens
uaaaauaaugaacacu

SEQ ID NO: 1697560 - RNA, 19 nt, Homo sapiens
uaaaauauuccugcauuug

SEQ ID NO: 1697561 - RNA, 22 nt, Homo sapiens
uaaaauauuuaucugauuaagu

SEQ ID NO: 1697562 - RNA, 21 nt, Homo sapiens
uaaaaucuuauaguucuaggc

SEQ ID NO: 1697563 - RNA, 14 nt, Homo sapiens
uaaaauguguugaa

SEQ ID NO: 1697564 - RNA, 18 nt, Homo sapiens
uaaaauuaucaauaucua

SEQ ID NO: 1697565 - RNA, 20 nt, Homo sapiens
uaaaauuaucaauaucuaau

SEQ ID NO: 1697566 - RNA, 23 nt, Homo sapiens
uaaaauuaugaaucugauuuuua

SEQ ID NO: 1697567 - RNA, 15 nt, Homo sapiens
uaaaauuauuuuucc

SEQ ID NO: 1697568 - RNA, 19 nt, Homo sapiens
uaaaauucagaugcuguua

SEQ ID NO: 1697569 - RNA, 12 nt, Homo sapiens
uaaaauugcuau

SEQ ID NO: 1697570 - RNA, 17 nt, Homo sapiens
uaaaauuuccacaagca

SEQ ID NO: 1697571 - RNA, 17 nt, Homo sapiens
uaaacagauggcacuuu

SEQ ID NO: 1697572 - RNA, 20 nt, Homo sapiens
uaaacagauggcacuuugaa

SEQ ID NO: 1697573 - RNA, 16 nt, Homo sapiens
uaaacauaugauuuca

SEQ ID NO: 1697574 - RNA, 14 nt, Homo sapiens
uaaacauccuucaa

SEQ ID NO: 1697575 - RNA, 13 nt, Homo sapiens
uaaacauguguuu

SEQ ID NO: 1697576 - RNA, 22 nt, Homo sapiens
uaaaccaaaggacauuaugugu

SEQ ID NO: 1697577 - RNA, 20 nt, Homo sapiens
uaaaccuccgccaaugcacg

SEQ ID NO: 1697578 - RNA, 14 nt, Homo sapiens
uaaacuaggaauuu

SEQ ID NO: 1697579 - RNA, 14 nt, Homo sapiens
uaaacucaagacaa

SEQ ID NO: 1697580 - RNA, 16 nt, Homo sapiens
uaaacugaaaauggac

SEQ ID NO: 1697581 - RNA, 14 nt, Homo sapiens
uaaacuguacaugu

SEQ ID NO: 1697582 - RNA, 23 nt, Homo sapiens
uaaacuguuagcacuguugaugu

SEQ ID NO: 1697583 - RNA, 14 nt, Homo sapiens
uaaacuuguuugcu

SEQ ID NO: 1697584 - RNA, 11 nt, Homo sapiens
uaaagaccaaa

SEQ ID NO: 1697585 - RNA, 14 nt, Homo sapiens
uaaagacucaaggu

SEQ ID NO: 1697586 - RNA, 18 nt, Homo sapiens
uaaagauaauugcuauuu

SEQ ID NO: 1697587 - RNA, 10 nt, Homo sapiens
uaaagauaug

SEQ ID NO: 1697588 - RNA, 21 nt, Homo sapiens
uaaagauggaguuucuaaggu

SEQ ID NO: 1697589 - RNA, 11 nt, Homo sapiens
uaaagccucaa

SEQ ID NO: 1697590 - RNA, 14 nt, Homo sapiens
uaaagccuccucau

SEQ ID NO: 1697591 - RNA, 16 nt, Homo sapiens
uaaagucacagaauua

SEQ ID NO: 1697592 - RNA, 16 nt, Homo sapiens
uaaagugcaguucuua

SEQ ID NO: 1697593 - RNA, 18 nt, Homo sapiens
uaaagugccuuacagggu

SEQ ID NO: 1697594 - RNA, 21 nt, Homo sapiens
uaaauaaaacuuaaaucucac

SEQ ID NO: 1697595 - RNA, 23 nt, Homo sapiens
uaaauacacaacacacacacucu

SEQ ID NO: 1697596 - RNA, 11 nt, Homo sapiens
uaaauacaggu

SEQ ID NO: 1697597 - RNA, 23 nt, Homo sapiens
uaaauaguauuugagaguucuaa

SEQ ID NO: 1697598 - RNA, 16 nt, Homo sapiens
uaaauauagagaugug

SEQ ID NO: 1697599 - RNA, 21 nt, Homo sapiens
uaaauaugccuaaaauacuua

SEQ ID NO: 1697600 - RNA, 21 nt, Homo sapiens
uaaauauuagaagccugcaga

SEQ ID NO: 1697601 - RNA, 20 nt, Homo sapiens
uaaaucuguuauuuugcuau

SEQ ID NO: 1697602 - RNA, 17 nt, Homo sapiens
uaaaugagcaaauauca

SEQ ID NO: 1697603 - RNA, 15 nt, Homo sapiens
uaaaugaucacucca

SEQ ID NO: 1697604 - RNA, 21 nt, Homo sapiens
uaaaugauucuuagugacuuu

SEQ ID NO: 1697605 - RNA, 12 nt, Homo sapiens
uaaaugcauuag

SEQ ID NO: 1697606 - RNA, 13 nt, Homo sapiens
uaaaugccuaaua

SEQ ID NO: 1697607 - RNA, 22 nt, Homo sapiens
uaaauguagcaauggcacuguu

SEQ ID NO: 1697608 - RNA, 17 nt, Homo sapiens
uaaauguauacuauagu

SEQ ID NO: 1697609 - RNA, 18 nt, Homo sapiens
uaaauguauacuauagua

SEQ ID NO: 1697610 - RNA, 22 nt, Homo sapiens
uaaaugucucuuuaaugucaca

SEQ ID NO: 1697611 - RNA, 13 nt, Homo sapiens
uaaauuccacacu

SEQ ID NO: 1697612 - RNA, 22 nt, Homo sapiens
uaaauuuaaagauauuguucaa

SEQ ID NO: 1697613 - RNA, 14 nt, Homo sapiens
uaaauuugcuagca

SEQ ID NO: 1697614 - RNA, 19 nt, Homo sapiens
uaacaacaauaacacuguc

SEQ ID NO: 1697615 - RNA, 19 nt, Homo sapiens
uaacacaaguccugugaau

SEQ ID NO: 1697616 - RNA, 14 nt, Homo sapiens
uaacacauucaaua

SEQ ID NO: 1697617 - RNA, 14 nt, Homo sapiens
uaacacggugcuca

SEQ ID NO: 1697618 - RNA, 19 nt, Homo sapiens
uaacagaacagcuucaggu

SEQ ID NO: 1697619 - RNA, 13 nt, Homo sapiens
uaacaugcuuaug

SEQ ID NO: 1697620 - RNA, 13 nt, Homo sapiens
uaacauuaccuua

SEQ ID NO: 1697621 - RNA, 21 nt, Homo sapiens
uaaccacaaagcacaguuuga

SEQ ID NO: 1697622 - RNA, 14 nt, Homo sapiens
uaaccauuugcacu

SEQ ID NO: 1697623 - RNA, 14 nt, Homo sapiens
uaacccaaaccuca

SEQ ID NO: 1697624 - RNA, 16 nt, Homo sapiens
uaacgugauacauuug

SEQ ID NO: 1697625 - RNA, 15 nt, Homo sapiens
uaacuauauuugcuu

SEQ ID NO: 1697626 - RNA, 20 nt, Homo sapiens
uaacuaugagcuugcucauu

SEQ ID NO: 1697627 - RNA, 23 nt, Homo sapiens
uaacucaccagccccacugccag

SEQ ID NO: 1697628 - RNA, 16 nt, Homo sapiens
uaacuguacauuucac

SEQ ID NO: 1697629 - RNA, 16 nt, Homo sapiens
uaacuuagguggcaag

SEQ ID NO: 1697630 - RNA, 21 nt, Homo sapiens
uaacuuauauugaagacaauu

SEQ ID NO: 1697631 - RNA, 18 nt, Homo sapiens
uaacuuauuuuauuucca

SEQ ID NO: 1697632 - RNA, 17 nt, Homo sapiens
uaagaaacccucuguca

SEQ ID NO: 1697633 - RNA, 19 nt, Homo sapiens
uaagaagcagccaucacau

SEQ ID NO: 1697634 - RNA, 14 nt, Homo sapiens
uaagaauagaaaua

SEQ ID NO: 1697635 - RNA, 18 nt, Homo sapiens
uaagacaugauuuccuug

SEQ ID NO: 1697636 - RNA, 21 nt, Homo sapiens
uaagacaugauuuccuugaau

SEQ ID NO: 1697637 - RNA, 19 nt, Homo sapiens
uaagacugugacaacuguc

SEQ ID NO: 1697638 - RNA, 23 nt, Homo sapiens
uaagacuuccccucaacaugcug

SEQ ID NO: 1697639 - RNA, 21 nt, Homo sapiens
uaagagccauauaaguuugaa

SEQ ID NO: 1697640 - RNA, 13 nt, Homo sapiens
uaagaguuacuua

SEQ ID NO: 1697641 - RNA, 17 nt, Homo sapiens
guggcuaaaugccuaau

SEQ ID NO: 1697642 - RNA, 11 nt, Homo sapiens
gugggccacag

SEQ ID NO: 1697643 - RNA, 19 nt, Homo sapiens
guggggccuguggaaugag

SEQ ID NO: 1697644 - RNA, 19 nt, Homo sapiens
gugguaggaaagccucacu

SEQ ID NO: 1697645 - RNA, 13 nt, Homo sapiens
gugguaugugaca

SEQ ID NO: 1697646 - RNA, 15 nt, Homo sapiens
guggucuugaucucc

SEQ ID NO: 1697647 - RNA, 16 nt, Homo sapiens
gugguuaacaucucag

SEQ ID NO: 1697648 - RNA, 15 nt, Homo sapiens
gugguuguuuuguca

SEQ ID NO: 1697649 - RNA, 20 nt, Homo sapiens
gugguuuccacaugcucuga

SEQ ID NO: 1697650 - RNA, 14 nt, Homo sapiens
guguacaaugccuu

SEQ ID NO: 1697651 - RNA, 14 nt, Homo sapiens
guguagccugugca

SEQ ID NO: 1697652 - RNA, 21 nt, Homo sapiens
guguauauuuguauauuacac

SEQ ID NO: 1697653 - RNA, 23 nt, Homo sapiens
guguaugugagagauucugugau

SEQ ID NO: 1697654 - RNA, 14 nt, Homo sapiens
gugucaaaagccag

SEQ ID NO: 1697655 - RNA, 16 nt, Homo sapiens
gugucaaaagccagau

SEQ ID NO: 1697656 - RNA, 17 nt, Homo sapiens
guguccccuccacuguc

SEQ ID NO: 1697657 - RNA, 17 nt, Homo sapiens
gugucuuacgugccacc

SEQ ID NO: 1697658 - RNA, 20 nt, Homo sapiens
gugugccauagaguuuaaca

SEQ ID NO: 1697659 - RNA, 11 nt, Homo sapiens
gugugcucucu

SEQ ID NO: 1697660 - RNA, 22 nt, Homo sapiens
guguggcccagggaagccaaaa

SEQ ID NO: 1697661 - RNA, 19 nt, Homo sapiens
guguguauauauguguaua

SEQ ID NO: 1697662 - RNA, 22 nt, Homo sapiens
guguguccaccugggcauaucc

SEQ ID NO: 1697663 - RNA, 22 nt, Homo sapiens
gugugugcacguacacacacau

SEQ ID NO: 1697664 - RNA, 15 nt, Homo sapiens
guguucauacauuug

SEQ ID NO: 1697665 - RNA, 15 nt, Homo sapiens
guguugcaccaggca

SEQ ID NO: 1697666 - RNA, 20 nt, Homo sapiens
guguugcaccaggcacugcu

SEQ ID NO: 1697667 - RNA, 22 nt, Homo sapiens
guguugcaccaggcacugcugc

SEQ ID NO: 1697668 - RNA, 13 nt, Homo sapiens
guguuuaauuuga

SEQ ID NO: 1697669 - RNA, 13 nt, Homo sapiens
guguuugugcuga

SEQ ID NO: 1697670 - RNA, 19 nt, Homo sapiens
guuaaacccacagccaaac

SEQ ID NO: 1697671 - RNA, 19 nt, Homo sapiens
guuaaacuguuagcacugu

SEQ ID NO: 1697672 - RNA, 18 nt, Homo sapiens
guuaaauaauauggcuau

SEQ ID NO: 1697673 - RNA, 14 nt, Homo sapiens
guuaaaugaacuug

SEQ ID NO: 1697674 - RNA, 18 nt, Homo sapiens
guuaaccccauguccuca

SEQ ID NO: 1697675 - RNA, 17 nt, Homo sapiens
guuaaucauguauuaaa

SEQ ID NO: 1697676 - RNA, 18 nt, Homo sapiens
guuaauuacaacugcuau

SEQ ID NO: 1697677 - RNA, 16 nt, Homo sapiens
guuaccacacaucuau

SEQ ID NO: 1697678 - RNA, 20 nt, Homo sapiens
guuacuguggccaguauuuu

SEQ ID NO: 1697679 - RNA, 21 nt, Homo sapiens
guuacuguguuuaucuugaua

SEQ ID NO: 1697680 - RNA, 15 nt, Homo sapiens
guuacuguucuugcu

SEQ ID NO: 1697681 - RNA, 22 nt, Homo sapiens
guuagaagcaaugaauguauau

SEQ ID NO: 1697682 - RNA, 13 nt, Homo sapiens
guuagaccacuuu

SEQ ID NO: 1697683 - RNA, 16 nt, Homo sapiens
guuagcacuguugaug

SEQ ID NO: 1697684 - RNA, 20 nt, Homo sapiens
guuaggggaauggagggaau

SEQ ID NO: 1697685 - RNA, 23 nt, Homo sapiens
guuauuugaaaauuugauuuuga

SEQ ID NO: 1697686 - RNA, 15 nt, Homo sapiens
guuauuugcacacug

SEQ ID NO: 1697687 - RNA, 20 nt, Homo sapiens
guuauuugcacacugcacug

SEQ ID NO: 1697688 - RNA, 21 nt, Homo sapiens
guucacaaaauggugcccuau

SEQ ID NO: 1697689 - RNA, 17 nt, Homo sapiens
guucacucuacuuagca

SEQ ID NO: 1697690 - RNA, 16 nt, Homo sapiens
guucagguaacaggca

SEQ ID NO: 1697691 - RNA, 19 nt, Homo sapiens
guucauggguuuaccacua

SEQ ID NO: 1697692 - RNA, 16 nt, Homo sapiens
guucauguuugcuuca

SEQ ID NO: 1697693 - RNA, 12 nt, Homo sapiens
guucauguuugg

SEQ ID NO: 1697694 - RNA, 15 nt, Homo sapiens
guuccaaguuuccaa

SEQ ID NO: 1697695 - RNA, 14 nt, Homo sapiens
guuccccacugaca

SEQ ID NO: 1697696 - RNA, 16 nt, Homo sapiens
guucccuuggccucag

SEQ ID NO: 1697697 - RNA, 19 nt, Homo sapiens
guuccgcacuuuccacuuc

SEQ ID NO: 1697698 - RNA, 19 nt, Homo sapiens
guuccuguagaacugagaa

SEQ ID NO: 1697699 - RNA, 17 nt, Homo sapiens
guucuaaaguucuaaga

SEQ ID NO: 1697700 - RNA, 21 nt, Homo sapiens
guucugcuacuccccagaccu

SEQ ID NO: 1697701 - RNA, 15 nt, Homo sapiens
guucugggacacagu

SEQ ID NO: 1697702 - RNA, 16 nt, Homo sapiens
guucugggugcagcug

SEQ ID NO: 1697703 - RNA, 15 nt, Homo sapiens
guucuuccucucuca

SEQ ID NO: 1697704 - RNA, 14 nt, Homo sapiens
guucuucuaucuca

SEQ ID NO: 1697705 - RNA, 13 nt, Homo sapiens
guucuugcugcua

SEQ ID NO: 1697706 - RNA, 14 nt, Homo sapiens
guucuugcugcuag

SEQ ID NO: 1697707 - RNA, 16 nt, Homo sapiens
guucuugcugcuagaa

SEQ ID NO: 1697708 - RNA, 20 nt, Homo sapiens
guucuuugagggacugccuc

SEQ ID NO: 1697709 - RNA, 14 nt, Homo sapiens
guugaauaaaugaa

SEQ ID NO: 1697710 - RNA, 19 nt, Homo sapiens
guugacuuauaguacauga

SEQ ID NO: 1697711 - RNA, 16 nt, Homo sapiens
guugagcuauugcugu

SEQ ID NO: 1697712 - RNA, 14 nt, Homo sapiens
guugcacugauauu

SEQ ID NO: 1697713 - RNA, 15 nt, Homo sapiens
guugcauuccuuugu

SEQ ID NO: 1697714 - RNA, 17 nt, Homo sapiens
guugccaugugugcuga

SEQ ID NO: 1697715 - RNA, 21 nt, Homo sapiens
guugccuuuuucauuuuccaa

SEQ ID NO: 1697716 - RNA, 16 nt, Homo sapiens
guugcgcgccugcucc

SEQ ID NO: 1697717 - RNA, 15 nt, Homo sapiens
guugcuggacuguca

SEQ ID NO: 1697718 - RNA, 14 nt, Homo sapiens
guugcuguuucaca

SEQ ID NO: 1697719 - RNA, 12 nt, Homo sapiens
guugcuugaaua

SEQ ID NO: 1697720 - RNA, 14 nt, Homo sapiens
guuggaagcuuguu

SEQ ID NO: 1697721 - RNA, 18 nt, Homo sapiens
guuggacuaaaugccuag

SEQ ID NO: 1697722 - RNA, 18 nt, Homo sapiens
guuggccugcacuggugu

SEQ ID NO: 1697723 - RNA, 22 nt, Homo sapiens
guuggucaugugggucuuccag

SEQ ID NO: 1697724 - RNA, 16 nt, Homo sapiens
guuguauuaacaaaag

SEQ ID NO: 1697725 - RNA, 19 nt, Homo sapiens
guuuaaaguggcaaucuca

SEQ ID NO: 1697726 - RNA, 17 nt, Homo sapiens
guuuaacauuuccucag

SEQ ID NO: 1697727 - RNA, 18 nt, Homo sapiens
guuuacagcaauuccugg

SEQ ID NO: 1697728 - RNA, 22 nt, Homo sapiens
guuuacaggcccugcuccugca

SEQ ID NO: 1697729 - RNA, 14 nt, Homo sapiens
guuuacaugugaug

SEQ ID NO: 1697730 - RNA, 15 nt, Homo sapiens
guuuaccacuaacuc

SEQ ID NO: 1697731 - RNA, 16 nt, Homo sapiens
guuuaccuagaagaag

SEQ ID NO: 1697732 - RNA, 21 nt, Homo sapiens
guuuacuucucaccauuugag

SEQ ID NO: 1697733 - RNA, 14 nt, Homo sapiens
guuuagaccaagga

SEQ ID NO: 1697734 - RNA, 19 nt, Homo sapiens
guuuagaccaaggaacaaa

SEQ ID NO: 1697735 - RNA, 16 nt, Homo sapiens
guuuaggggguuuguu

SEQ ID NO: 1697736 - RNA, 15 nt, Homo sapiens
guuuauaauuuucug

SEQ ID NO: 1697737 - RNA, 16 nt, Homo sapiens
guuuauugaaugugau

SEQ ID NO: 1697738 - RNA, 19 nt, Homo sapiens
guuuauuuuuauacuuuca

SEQ ID NO: 1697739 - RNA, 18 nt, Homo sapiens
guuucacacuagucacau

SEQ ID NO: 1697740 - RNA, 18 nt, Homo sapiens
guuuccaaagaugugggu

SEQ ID NO: 1697741 - RNA, 22 nt, Homo sapiens
guuuccaauaaacgcaagcuga

SEQ ID NO: 1697742 - RNA, 20 nt, Homo sapiens
guuucccccuucuacauuuc

SEQ ID NO: 1697743 - RNA, 22 nt, Homo sapiens
guuucuguauacaacccuggca

SEQ ID NO: 1697744 - RNA, 18 nt, Homo sapiens
guuugaaaauaugccugc

SEQ ID NO: 1697745 - RNA, 22 nt, Homo sapiens
guuuguugaugugaaacauuau

SEQ ID NO: 1697746 - RNA, 11 nt, Homo sapiens
guuuguuguuu

SEQ ID NO: 1697747 - RNA, 17 nt, Homo sapiens
guuuguuuuuuugccac

SEQ ID NO: 1697748 - RNA, 18 nt, Homo sapiens
guuuuauaaguucacaaa

SEQ ID NO: 1697749 - RNA, 13 nt, Homo sapiens
guuuuauuuugaa

SEQ ID NO: 1697750 - RNA, 14 nt, Homo sapiens
guuuugaaaaccua

SEQ ID NO: 1697751 - RNA, 18 nt, Homo sapiens
gucaauccgaaguaugag

SEQ ID NO: 1697752 - RNA, 12 nt, Homo sapiens
gucacacacuga

SEQ ID NO: 1697753 - RNA, 20 nt, Homo sapiens
gucacaucagauaagacaua

SEQ ID NO: 1697754 - RNA, 20 nt, Homo sapiens
gucacccuuggacaagacaa

SEQ ID NO: 1697755 - RNA, 21 nt, Homo sapiens
gucacgcacaagggcacguga

SEQ ID NO: 1697756 - RNA, 16 nt, Homo sapiens
gucacugacacaaagg

SEQ ID NO: 1697757 - RNA, 20 nt, Homo sapiens
gucaucuuucuuuucuuuga

SEQ ID NO: 1697758 - RNA, 20 nt, Homo sapiens
gucaugcauaaauaugcagu

SEQ ID NO: 1697759 - RNA, 17 nt, Homo sapiens
gucaugugggucuucca

SEQ ID NO: 1697760 - RNA, 20 nt, Homo sapiens
gucauuccaaauaugagaug

SEQ ID NO: 1697761 - RNA, 14 nt, Homo sapiens
gucauuguauguua

SEQ ID NO: 1697762 - RNA, 11 nt, Homo sapiens
guccaaaaagc

SEQ ID NO: 1697763 - RNA, 14 nt, Homo sapiens
guccaaucggagac

SEQ ID NO: 1697764 - RNA, 12 nt, Homo sapiens
guccagcccauc

SEQ ID NO: 1697765 - RNA, 14 nt, Homo sapiens
guccaugcuucuag

SEQ ID NO: 1697766 - RNA, 19 nt, Homo sapiens
guccaugugguucuucaaa

SEQ ID NO: 1697767 - RNA, 11 nt, Homo sapiens
guccauucucu

SEQ ID NO: 1697768 - RNA, 21 nt, Homo sapiens
gucccaagauguugauuuuua

SEQ ID NO: 1697769 - RNA, 17 nt, Homo sapiens
gucccaaugguccugac

SEQ ID NO: 1697770 - RNA, 23 nt, Homo sapiens
guccccaccccagcgcagcagcc

SEQ ID NO: 1697771 - RNA, 21 nt, Homo sapiens
guccccagcccuucacauuuu

SEQ ID NO: 1697772 - RNA, 20 nt, Homo sapiens
gucccggggcuccacugaac

SEQ ID NO: 1697773 - RNA, 22 nt, Homo sapiens
gucccugaaaccuaguacugcc

SEQ ID NO: 1697774 - RNA, 22 nt, Homo sapiens
gucccuuugagcagaaauuuau

SEQ ID NO: 1697775 - RNA, 17 nt, Homo sapiens
guccucacucccagucc

SEQ ID NO: 1697776 - RNA, 21 nt, Homo sapiens
guccucuccccuccagccuuu

SEQ ID NO: 1697777 - RNA, 20 nt, Homo sapiens
guccugaaggaaaaugacuc

SEQ ID NO: 1697778 - RNA, 15 nt, Homo sapiens
guccugaucugugau

SEQ ID NO: 1697779 - RNA, 17 nt, Homo sapiens
guccuuggaaguuucau

SEQ ID NO: 1697780 - RNA, 11 nt, Homo sapiens
guccuuuaugu

SEQ ID NO: 1697781 - RNA, 16 nt, Homo sapiens
gucgaaagcucuagaa

SEQ ID NO: 1697782 - RNA, 16 nt, Homo sapiens
gucgacuucaugacaa

SEQ ID NO: 1697783 - RNA, 16 nt, Homo sapiens
gucgaggggcucucag

SEQ ID NO: 1697784 - RNA, 17 nt, Homo sapiens
gucuagguacuucaggg

SEQ ID NO: 1697785 - RNA, 13 nt, Homo sapiens
gucucaaucugau

SEQ ID NO: 1697786 - RNA, 20 nt, Homo sapiens
gucucaguggcuucaucugu

SEQ ID NO: 1697787 - RNA, 14 nt, Homo sapiens
gucucauucuucca

SEQ ID NO: 1697788 - RNA, 16 nt, Homo sapiens
gucucauuuagaacuu

SEQ ID NO: 1697789 - RNA, 18 nt, Homo sapiens
gucuccaagggcaucacu

SEQ ID NO: 1697790 - RNA, 20 nt, Homo sapiens
gucuccaagggcaucacugg

SEQ ID NO: 1697791 - RNA, 15 nt, Homo sapiens
gucuccuacuccuga

SEQ ID NO: 1697792 - RNA, 18 nt, Homo sapiens
gucugagacucacaggaa

SEQ ID NO: 1697793 - RNA, 14 nt, Homo sapiens
gucugcaugugcac

SEQ ID NO: 1697794 - RNA, 20 nt, Homo sapiens
gucugcaugugcacgguggc

SEQ ID NO: 1697795 - RNA, 20 nt, Homo sapiens
gucugcuuaguaucucauca

SEQ ID NO: 1697796 - RNA, 16 nt, Homo sapiens
gucuggaaugcagugg

SEQ ID NO: 1697797 - RNA, 19 nt, Homo sapiens
gucuguaaaagagccuagu

SEQ ID NO: 1697798 - RNA, 15 nt, Homo sapiens
gucuguacacguguc

SEQ ID NO: 1697799 - RNA, 21 nt, Homo sapiens
gucugugugcgcucuguggau

SEQ ID NO: 1697800 - RNA, 13 nt, Homo sapiens
gucuucaacaucc

SEQ ID NO: 1697801 - RNA, 18 nt, Homo sapiens
gucuucaacauccugcca

SEQ ID NO: 1697802 - RNA, 20 nt, Homo sapiens
gucuucaacauccugccagc

SEQ ID NO: 1697803 - RNA, 17 nt, Homo sapiens
gucuugcaauggcagcc

SEQ ID NO: 1697804 - RNA, 20 nt, Homo sapiens
gucuuucacagcuccuccca

SEQ ID NO: 1697805 - RNA, 14 nt, Homo sapiens
gucuuugaacccuu

SEQ ID NO: 1697806 - RNA, 21 nt, Homo sapiens
gucuuuucaaaauauuacuca

SEQ ID NO: 1697807 - RNA, 17 nt, Homo sapiens
gugaaaauccaucucau

SEQ ID NO: 1697808 - RNA, 16 nt, Homo sapiens
gugaaccaacacagac

SEQ ID NO: 1697809 - RNA, 18 nt, Homo sapiens
gugaaccacuucauucug

SEQ ID NO: 1697810 - RNA, 20 nt, Homo sapiens
gugaaccacuucauucugca

SEQ ID NO: 1697811 - RNA, 14 nt, Homo sapiens
gugaacugugcaua

SEQ ID NO: 1697812 - RNA, 23 nt, Homo sapiens
gugaagcauucuccccaguguau

SEQ ID NO: 1697813 - RNA, 15 nt, Homo sapiens
gugaauuucuucacu

SEQ ID NO: 1697814 - RNA, 19 nt, Homo sapiens
gugacaacacuuguguuau

SEQ ID NO: 1697815 - RNA, 17 nt, Homo sapiens
gugacaugugaaaccuu

SEQ ID NO: 1697816 - RNA, 14 nt, Homo sapiens
gugaccaacugugu

SEQ ID NO: 1697817 - RNA, 23 nt, Homo sapiens
gugaccccugaccucacugugac

SEQ ID NO: 1697818 - RNA, 14 nt, Homo sapiens
gugaccuugagcaa

SEQ ID NO: 1697819 - RNA, 14 nt, Homo sapiens
gugacuaugaacuu

SEQ ID NO: 1697820 - RNA, 12 nt, Homo sapiens
gugacugcaaua

SEQ ID NO: 1697821 - RNA, 19 nt, Homo sapiens
gugacuucuccaggucuca

SEQ ID NO: 1697822 - RNA, 18 nt, Homo sapiens
gugagaaauuucugugaa

SEQ ID NO: 1697823 - RNA, 15 nt, Homo sapiens
gugagaugcuggaga

SEQ ID NO: 1697824 - RNA, 21 nt, Homo sapiens
gugagcacuaaggugugcucu

SEQ ID NO: 1697825 - RNA, 13 nt, Homo sapiens
gugagugugacag

SEQ ID NO: 1697826 - RNA, 21 nt, Homo sapiens
gugauacuaagguggaugcca

SEQ ID NO: 1697827 - RNA, 19 nt, Homo sapiens
gugauauacugguucacau

SEQ ID NO: 1697828 - RNA, 23 nt, Homo sapiens
gugauauacugguucacauccua

SEQ ID NO: 1697829 - RNA, 21 nt, Homo sapiens
gugaucgcacaaccugcaucu

SEQ ID NO: 1697830 - RNA, 16 nt, Homo sapiens
gugaucugucuuguaa

SEQ ID NO: 1697831 - RNA, 13 nt, Homo sapiens
gugauucaaugaa

SEQ ID NO: 1697832 - RNA, 17 nt, Homo sapiens
gugauugcagcuuuaug

SEQ ID NO: 1697833 - RNA, 19 nt, Homo sapiens
gugcaaauggaagacaaaa

SEQ ID NO: 1697834 - RNA, 20 nt, Homo sapiens
gugcaguuguaggcauguag

SEQ ID NO: 1697835 - RNA, 20 nt, Homo sapiens
gugccaauauguauuguaaa

SEQ ID NO: 1697836 - RNA, 14 nt, Homo sapiens
gugccacucauucc

SEQ ID NO: 1697837 - RNA, 20 nt, Homo sapiens
gugccagcaaugacaucuca

SEQ ID NO: 1697838 - RNA, 16 nt, Homo sapiens
gugccagccacgagac

SEQ ID NO: 1697839 - RNA, 18 nt, Homo sapiens
gugccagcccuggcagac

SEQ ID NO: 1697840 - RNA, 18 nt, Homo sapiens
gugccgugugagugugac

SEQ ID NO: 1697841 - RNA, 21 nt, Homo sapiens
gugccugaaauuucaccauug

SEQ ID NO: 1697842 - RNA, 13 nt, Homo sapiens
gugcucagagggc

SEQ ID NO: 1697843 - RNA, 14 nt, Homo sapiens
guggaacucaguca

SEQ ID NO: 1697844 - RNA, 15 nt, Homo sapiens
guggaacucagucau

SEQ ID NO: 1697845 - RNA, 22 nt, Homo sapiens
guggaacuuuuauuagauaaca

SEQ ID NO: 1697846 - RNA, 20 nt, Homo sapiens
guggaaggcaucagucccua

SEQ ID NO: 1697847 - RNA, 12 nt, Homo sapiens
guggaaugagug

SEQ ID NO: 1697848 - RNA, 16 nt, Homo sapiens
guggaaugagugugca

SEQ ID NO: 1697849 - RNA, 18 nt, Homo sapiens
guggaccucuacuuucca

SEQ ID NO: 1697850 - RNA, 18 nt, Homo sapiens
guggacucucauguggcc

SEQ ID NO: 1697851 - RNA, 13 nt, Homo sapiens
guggagcucagcc

SEQ ID NO: 1697852 - RNA, 15 nt, Homo sapiens
guggaggauugcuau

SEQ ID NO: 1697853 - RNA, 12 nt, Homo sapiens
guggagggccac

SEQ ID NO: 1697854 - RNA, 22 nt, Homo sapiens
guggaggguggggggcgcugag

SEQ ID NO: 1697855 - RNA, 21 nt, Homo sapiens
guggcagcugcuuuugucuau

SEQ ID NO: 1697856 - RNA, 18 nt, Homo sapiens
guggcauguuuugugcau

SEQ ID NO: 1697857 - RNA, 19 nt, Homo sapiens
guggcccuggcucugcugu

SEQ ID NO: 1697858 - RNA, 22 nt, Homo sapiens
guggcgagaaauaaaguuugcu

SEQ ID NO: 1697859 - RNA, 18 nt, Homo sapiens
guggcgagaaggugggga

SEQ ID NO: 1697860 - RNA, 16 nt, Homo sapiens
gccaccacugggcaaa

SEQ ID NO: 1697861 - RNA, 14 nt, Homo sapiens
gccacccuagccaa

SEQ ID NO: 1697862 - RNA, 21 nt, Homo sapiens
gccacucaggaggcugaggca

SEQ ID NO: 1697863 - RNA, 16 nt, Homo sapiens
gccacucuuagcuaaa

SEQ ID NO: 1697864 - RNA, 21 nt, Homo sapiens
gccacugggccugucacugau

SEQ ID NO: 1697865 - RNA, 21 nt, Homo sapiens
uuucauuugguucauuaauuc

SEQ ID NO: 1697866 - RNA, 23 nt, Homo sapiens
uuuccacgcuagggcggggcaca

SEQ ID NO: 1697867 - RNA, 10 nt, Homo sapiens
uuuccaggga

SEQ ID NO: 1697868 - RNA, 12 nt, Homo sapiens
uuuccagggaua

SEQ ID NO: 1697869 - RNA, 16 nt, Homo sapiens
uuucccucgcuaugug

SEQ ID NO: 1697870 - RNA, 23 nt, Homo sapiens
uuucccuucccuuccacugccuc

SEQ ID NO: 1697871 - RNA, 22 nt, Homo sapiens
uuucccuuccugggucuaccac

SEQ ID NO: 1697872 - RNA, 19 nt, Homo sapiens
uuuccuacaggcagucucu

SEQ ID NO: 1697873 - RNA, 12 nt, Homo sapiens
uuuccuccugag

SEQ ID NO: 1697874 - RNA, 16 nt, Homo sapiens
uuuccuuucugccacc

SEQ ID NO: 1697875 - RNA, 14 nt, Homo sapiens
uuucuacacugagg

SEQ ID NO: 1697876 - RNA, 15 nt, Homo sapiens
uuucuauaccugucu

SEQ ID NO: 1697877 - RNA, 21 nt, Homo sapiens
uuucucagcucccaaggcucu

SEQ ID NO: 1697878 - RNA, 16 nt, Homo sapiens
uuucuccguugaguca

SEQ ID NO: 1697879 - RNA, 20 nt, Homo sapiens
uuucuccuguuggcucacag

SEQ ID NO: 1697880 - RNA, 14 nt, Homo sapiens
uuucucuuaugcuu

SEQ ID NO: 1697881 - RNA, 14 nt, Homo sapiens
uuucugaguuucau

SEQ ID NO: 1697882 - RNA, 15 nt, Homo sapiens
uuucuggcucuccca

SEQ ID NO: 1697883 - RNA, 21 nt, Homo sapiens
uuucugggucuuuugcuacua

SEQ ID NO: 1697884 - RNA, 18 nt, Homo sapiens
uuucugguucugaugcca

SEQ ID NO: 1697885 - RNA, 21 nt, Homo sapiens
uuucugucagaugagaacaaa

SEQ ID NO: 1697886 - RNA, 22 nt, Homo sapiens
uuucuguuagcuggguuuacau

SEQ ID NO: 1697887 - RNA, 18 nt, Homo sapiens
uuucuuccuuuacuuucc

SEQ ID NO: 1697888 - RNA, 22 nt, Homo sapiens
uuucuuggcaaaagccuugugu

SEQ ID NO: 1697889 - RNA, 22 nt, Homo sapiens
uuucuuuaauaguuuugauccu

SEQ ID NO: 1697890 - RNA, 17 nt, Homo sapiens
uuugaaacugaauguuu

SEQ ID NO: 1697891 - RNA, 15 nt, Homo sapiens
uugccuugggcugcu

SEQ ID NO: 1697892 - RNA, 15 nt, Homo sapiens
uugcgauagagucuc

SEQ ID NO: 1697893 - RNA, 21 nt, Homo sapiens
uugcggaagcuguuggaugau

SEQ ID NO: 1697894 - RNA, 15 nt, Homo sapiens
uugcuaaaagauuau

SEQ ID NO: 1697895 - RNA, 16 nt, Homo sapiens
uugcuaaaauauaauu

SEQ ID NO: 1697896 - RNA, 17 nt, Homo sapiens
uugcuaacaaugcucug

SEQ ID NO: 1697897 - RNA, 14 nt, Homo sapiens
uugcuacauucuaa

SEQ ID NO: 1697898 - RNA, 18 nt, Homo sapiens
uugcucuuacuacacuga

SEQ ID NO: 1697899 - RNA, 16 nt, Homo sapiens
uugcucuuucaucucu

SEQ ID NO: 1697900 - RNA, 13 nt, Homo sapiens
uugcucuuuggua

SEQ ID NO: 1697901 - RNA, 16 nt, Homo sapiens
uugcugguagcacuug

SEQ ID NO: 1697902 - RNA, 23 nt, Homo sapiens
uugcuucccggcgucccuaccuc

SEQ ID NO: 1697903 - RNA, 17 nt, Homo sapiens
uugcuugggacauugca

SEQ ID NO: 1697904 - RNA, 15 nt, Homo sapiens
uugcuuuauuccaga

SEQ ID NO: 1697905 - RNA, 21 nt, Homo sapiens
uuggaaaaauguuugucucag

SEQ ID NO: 1697906 - RNA, 14 nt, Homo sapiens
uuggaacagaaugu

SEQ ID NO: 1697907 - RNA, 12 nt, Homo sapiens
uuggaauucacc

SEQ ID NO: 1697908 - RNA, 21 nt, Homo sapiens
uuggagccaauguguggcuca

SEQ ID NO: 1697909 - RNA, 20 nt, Homo sapiens
uuggagggcccacuuguauc

SEQ ID NO: 1697910 - RNA, 12 nt, Homo sapiens
uuggaguuuucu

SEQ ID NO: 1697911 - RNA, 13 nt, Homo sapiens
uuggcaacagaag

SEQ ID NO: 1697912 - RNA, 11 nt, Homo sapiens
uuggcacugug

SEQ ID NO: 1697913 - RNA, 16 nt, Homo sapiens
uuggcacuguggagcu

SEQ ID NO: 1697914 - RNA, 15 nt, Homo sapiens
uuggcauggcuuuau

SEQ ID NO: 1697915 - RNA, 17 nt, Homo sapiens
uuggccuucagaaccau

SEQ ID NO: 1697916 - RNA, 11 nt, Homo sapiens
uuggcugugag

SEQ ID NO: 1697917 - RNA, 21 nt, Homo sapiens
uugggaaaaaggccucugucc

SEQ ID NO: 1697918 - RNA, 14 nt, Homo sapiens
uugggacauugcaa

SEQ ID NO: 1697919 - RNA, 14 nt, Homo sapiens
uucaaugaaccaca

SEQ ID NO: 1697920 - RNA, 15 nt, Homo sapiens
uucaaugaaccacaa

SEQ ID NO: 1697921 - RNA, 18 nt, Homo sapiens
uucaaugggcucuuccaa

SEQ ID NO: 1697922 - RNA, 22 nt, Homo sapiens
uucaauucucauuugucacaca

SEQ ID NO: 1697923 - RNA, 19 nt, Homo sapiens
uucacaguaauaugguucc

SEQ ID NO: 1697924 - RNA, 15 nt, Homo sapiens
uucacagucacugau

SEQ ID NO: 1697925 - RNA, 16 nt, Homo sapiens
uucacauuuguauuaa

SEQ ID NO: 1697926 - RNA, 13 nt, Homo sapiens
uucaccaccaaau

SEQ ID NO: 1697927 - RNA, 14 nt, Homo sapiens
uucaccagagcauu

SEQ ID NO: 1697928 - RNA, 15 nt, Homo sapiens
uucaccagagcauuu

SEQ ID NO: 1697929 - RNA, 17 nt, Homo sapiens
uucacccuuaacccaag

SEQ ID NO: 1697930 - RNA, 19 nt, Homo sapiens
uucaccuaagucucuguga

SEQ ID NO: 1697931 - RNA, 16 nt, Homo sapiens
uucacucccaaccuga

SEQ ID NO: 1697932 - RNA, 17 nt, Homo sapiens
uucacugaaagacacca

SEQ ID NO: 1697933 - RNA, 18 nt, Homo sapiens
uucacuguagaaugauuu

SEQ ID NO: 1697934 - RNA, 20 nt, Homo sapiens
uucacuguagaaugauuuca

SEQ ID NO: 1697935 - RNA, 14 nt, Homo sapiens
uucacuuuacaaau

SEQ ID NO: 1697936 - RNA, 17 nt, Homo sapiens
uucagaagguugcucua

SEQ ID NO: 1697937 - RNA, 23 nt, Homo sapiens
uucagaauauucauauuggaaaa

SEQ ID NO: 1697938 - RNA, 17 nt, Homo sapiens
uucagauacaaacugca

SEQ ID NO: 1697939 - RNA, 22 nt, Homo sapiens
uucagcaguaacaggaaaccac

SEQ ID NO: 1697940 - RNA, 14 nt, Homo sapiens
uucagcuccaggga

SEQ ID NO: 1697941 - RNA, 20 nt, Homo sapiens
uucagucacacacacauaca

SEQ ID NO: 1697942 - RNA, 13 nt, Homo sapiens
uucauaacuuauu

SEQ ID NO: 1697943 - RNA, 19 nt, Homo sapiens
uucauaccuaaguacugua

SEQ ID NO: 1697944 - RNA, 18 nt, Homo sapiens
uucauaugcuguauaucc

SEQ ID NO: 1697945 - RNA, 20 nt, Homo sapiens
uucaucaggaaggaaaugac

SEQ ID NO: 1697946 - RNA, 15 nt, Homo sapiens
uucauccuugacuaa

SEQ ID NO: 1697947 - RNA, 14 nt, Homo sapiens
uucaucuaauguga

SEQ ID NO: 1697948 - RNA, 18 nt, Homo sapiens
uucaugugcugccugcaa

SEQ ID NO: 1697949 - RNA, 13 nt, Homo sapiens
uucauucacauuc

SEQ ID NO: 1697950 - RNA, 19 nt, Homo sapiens
uucauuccuuccacuaacu

SEQ ID NO: 1697951 - RNA, 16 nt, Homo sapiens
uucauuguaugaugug

SEQ ID NO: 1697952 - RNA, 21 nt, Homo sapiens
uuccaaagcuuuauuaccagu

SEQ ID NO: 1697953 - RNA, 14 nt, Homo sapiens
uuccaacaccacag

SEQ ID NO: 1697954 - RNA, 15 nt, Homo sapiens
uuccaacaccacaga

SEQ ID NO: 1697955 - RNA, 23 nt, Homo sapiens
uuccaagacucuagaguccaagg

SEQ ID NO: 1697956 - RNA, 13 nt, Homo sapiens
uuccaaugcauug

SEQ ID NO: 1697957 - RNA, 23 nt, Homo sapiens
uuccacguguuuuauuccuguau

SEQ ID NO: 1697958 - RNA, 12 nt, Homo sapiens
uuccacugccuc

SEQ ID NO: 1697959 - RNA, 23 nt, Homo sapiens
uuccacuuagaaauugcauuucc

SEQ ID NO: 1697960 - RNA, 13 nt, Homo sapiens
uuccacuucuucc

SEQ ID NO: 1697961 - RNA, 14 nt, Homo sapiens
uuccacuuugcaua

SEQ ID NO: 1697962 - RNA, 19 nt, Homo sapiens
uuccagacuuccuugagac

SEQ ID NO: 1697963 - RNA, 16 nt, Homo sapiens
uuccagaucacugcca

SEQ ID NO: 1697964 - RNA, 18 nt, Homo sapiens
uuccaguguucuaugaac

SEQ ID NO: 1697965 - RNA, 19 nt, Homo sapiens
uuccauaaucuggacuccu

SEQ ID NO: 1697966 - RNA, 17 nt, Homo sapiens
uuccauauguuauauca

SEQ ID NO: 1697967 - RNA, 23 nt, Homo sapiens
uuccaugucgccucugcauucag

SEQ ID NO: 1697968 - RNA, 16 nt, Homo sapiens
uuccauugccuagcuc

SEQ ID NO: 1697969 - RNA, 16 nt, Homo sapiens
uuccauugguccaaga

SEQ ID NO: 1697970 - RNA, 17 nt, Homo sapiens
uucccaacaacauccau

SEQ ID NO: 1697971 - RNA, 19 nt, Homo sapiens
uucccaagaguauccuacc

SEQ ID NO: 1697972 - RNA, 16 nt, Homo sapiens
uucccaagcccaugag

SEQ ID NO: 1697973 - RNA, 17 nt, Homo sapiens
uucccagagucaucuga

SEQ ID NO: 1697974 - RNA, 23 nt, Homo sapiens
uuccccagcgucccagucucugg

SEQ ID NO: 1697975 - RNA, 19 nt, Homo sapiens
uucccccaccgguccagcu

SEQ ID NO: 1697976 - RNA, 19 nt, Homo sapiens
uucccggcgucccuaccuc

SEQ ID NO: 1697977 - RNA, 19 nt, Homo sapiens
uucccuaaaauacauuuaa

SEQ ID NO: 1697978 - RNA, 15 nt, Homo sapiens
uucccucuugcucag

SEQ ID NO: 1697979 - RNA, 15 nt, Homo sapiens
uucccuuccacugcc

SEQ ID NO: 1697980 - RNA, 16 nt, Homo sapiens
uucccuuccacugccu

SEQ ID NO: 1697981 - RNA, 14 nt, Homo sapiens
uucccuugcuggaa

SEQ ID NO: 1697982 - RNA, 23 nt, Homo sapiens
uucccuuugucuuucaaacucca

SEQ ID NO: 1697983 - RNA, 19 nt, Homo sapiens
uucccuuuuguauucucuu

SEQ ID NO: 1697984 - RNA, 16 nt, Homo sapiens
uuccucagcugugugg

SEQ ID NO: 1697985 - RNA, 18 nt, Homo sapiens
uuccuccucgcugccaga

SEQ ID NO: 1697986 - RNA, 22 nt, Homo sapiens
uuccucuaugaaaauuauaucu

SEQ ID NO: 1697987 - RNA, 14 nt, Homo sapiens
uuccucuuacugua

SEQ ID NO: 1697988 - RNA, 18 nt, Homo sapiens
uuccucuuggugucauau

SEQ ID NO: 1697989 - RNA, 16 nt, Homo sapiens
uuccugacaucacagc

SEQ ID NO: 1697990 - RNA, 18 nt, Homo sapiens
uuccugagaggaagccug

SEQ ID NO: 1697991 - RNA, 20 nt, Homo sapiens
uuccugagaggaagccugag

SEQ ID NO: 1697992 - RNA, 16 nt, Homo sapiens
uuccugagcuuuaugg

SEQ ID NO: 1697993 - RNA, 20 nt, Homo sapiens
uuccugccaccacugggcaa

SEQ ID NO: 1697994 - RNA, 11 nt, Homo sapiens
uuccugugauu

SEQ ID NO: 1697995 - RNA, 13 nt, Homo sapiens
uuccuuagucuca

SEQ ID NO: 1697996 - RNA, 15 nt, Homo sapiens
uuccuuagucucaag

SEQ ID NO: 1697997 - RNA, 13 nt, Homo sapiens
uuccuucuggccu

SEQ ID NO: 1697998 - RNA, 20 nt, Homo sapiens
uuaagaggcagggucucacu

SEQ ID NO: 1697999 - RNA, 15 nt, Homo sapiens
uuaagaguuacuuaa

SEQ ID NO: 1698000 - RNA, 17 nt, Homo sapiens
uuaagauacaaauuaau

SEQ ID NO: 1698001 - RNA, 21 nt, Homo sapiens
uuaagcaaauacuuagcaaaa

SEQ ID NO: 1698002 - RNA, 22 nt, Homo sapiens
uuaaguaacauaacuaguggcu

SEQ ID NO: 1698003 - RNA, 20 nt, Homo sapiens
uuaaguuauugauguuuuaa

SEQ ID NO: 1698004 - RNA, 15 nt, Homo sapiens
uuaaguuuaucuuuc

SEQ ID NO: 1698005 - RNA, 15 nt, Homo sapiens
uuaauaaacuacucu

SEQ ID NO: 1698006 - RNA, 17 nt, Homo sapiens
uuaauaaagaauuaaca

SEQ ID NO: 1698007 - RNA, 20 nt, Homo sapiens
uuaauacgcaggcaucugau

SEQ ID NO: 1698008 - RNA, 17 nt, Homo sapiens
uuaauagucauuccaaa

SEQ ID NO: 1698009 - RNA, 20 nt, Homo sapiens
uuaauauuuuuccacuuaaa

SEQ ID NO: 1698010 - RNA, 21 nt, Homo sapiens
uuaaucucuguuauguacugu

SEQ ID NO: 1698011 - RNA, 16 nt, Homo sapiens
uuaaugacaaugaagu

SEQ ID NO: 1698012 - RNA, 15 nt, Homo sapiens
uuaaugagacaugaa

SEQ ID NO: 1698013 - RNA, 17 nt, Homo sapiens
uuaaugucuggugcuuu

SEQ ID NO: 1698014 - RNA, 20 nt, Homo sapiens
uuaauguuuuuuaaacuagu

SEQ ID NO: 1698015 - RNA, 20 nt, Homo sapiens
uuaauuaagucaccuguaua

SEQ ID NO: 1698016 - RNA, 13 nt, Homo sapiens
uuaauuauugcuu

SEQ ID NO: 1698017 - RNA, 19 nt, Homo sapiens
uuaauuccaauaugaugac

SEQ ID NO: 1698018 - RNA, 18 nt, Homo sapiens
uuaauuguuuugcacuuu

SEQ ID NO: 1698019 - RNA, 19 nt, Homo sapiens
uuacaaucagccacauucu

SEQ ID NO: 1698020 - RNA, 13 nt, Homo sapiens
uuacaauugugag

SEQ ID NO: 1698021 - RNA, 16 nt, Homo sapiens
uuacacugccuguaua

SEQ ID NO: 1698022 - RNA, 11 nt, Homo sapiens
uuacagcugcc

SEQ ID NO: 1698023 - RNA, 20 nt, Homo sapiens
uuacaggaagucccuugcca

SEQ ID NO: 1698024 - RNA, 12 nt, Homo sapiens
uuacaugugauu

SEQ ID NO: 1698025 - RNA, 15 nt, Homo sapiens
uuaccacuaacuccu

SEQ ID NO: 1698026 - RNA, 18 nt, Homo sapiens
uuaccaucuuacuugagc

SEQ ID NO: 1698027 - RNA, 17 nt, Homo sapiens
uuaccgccugucucuuu

SEQ ID NO: 1698028 - RNA, 20 nt, Homo sapiens
uuaccugaaggacagcugaa

SEQ ID NO: 1698029 - RNA, 13 nt, Homo sapiens
uuaccugacacaa

SEQ ID NO: 1698030 - RNA, 14 nt, Homo sapiens
uuaccugaccucuu

SEQ ID NO: 1698031 - RNA, 20 nt, Homo sapiens
uuaccuguuuucgcaccuac

SEQ ID NO: 1698032 - RNA, 20 nt, Homo sapiens
uuacuaaacauaugauuuca

SEQ ID NO: 1698033 - RNA, 17 nt, Homo sapiens
uuacugaucuuacucac

SEQ ID NO: 1698034 - RNA, 24 nt, Homo sapiens
uuacuguuuauuucuguuucucau

SEQ ID NO: 1698035 - RNA, 22 nt, Homo sapiens
uuacuucaaugggcucuuccaa

SEQ ID NO: 1698036 - RNA, 13 nt, Homo sapiens
uuagaaaacuaga

SEQ ID NO: 1698037 - RNA, 17 nt, Homo sapiens
uuagaaacuccaaugaa

SEQ ID NO: 1698038 - RNA, 19 nt, Homo sapiens
uuagaagcugagacacaaa

SEQ ID NO: 1698039 - RNA, 14 nt, Homo sapiens
uuagaagucacaca

SEQ ID NO: 1698040 - RNA, 16 nt, Homo sapiens
uuagaagucacacagu

SEQ ID NO: 1698041 - RNA, 17 nt, Homo sapiens
uuagacagagucucacu

SEQ ID NO: 1698042 - RNA, 22 nt, Homo sapiens
uuagacaugacugaugacauau

SEQ ID NO: 1698043 - RNA, 14 nt, Homo sapiens
uuagacuacauuua

SEQ ID NO: 1698044 - RNA, 13 nt, Homo sapiens
uuagagaauguuc

SEQ ID NO: 1698045 - RNA, 23 nt, Homo sapiens
uuagagcccauuucaauucucaa

SEQ ID NO: 1698046 - RNA, 13 nt, Homo sapiens
uuagauaacgcuu

SEQ ID NO: 1698047 - RNA, 17 nt, Homo sapiens
uuagcaugcuacaguua

SEQ ID NO: 1698048 - RNA, 15 nt, Homo sapiens
uuagcugucugcuca

SEQ ID NO: 1698049 - RNA, 14 nt, Homo sapiens
uuagcuuuacaaau

SEQ ID NO: 1698050 - RNA, 16 nt, Homo sapiens
uuaggcaccagaagaa

SEQ ID NO: 1698051 - RNA, 13 nt, Homo sapiens
uuaguaaucugua

SEQ ID NO: 1698052 - RNA, 13 nt, Homo sapiens
uuagucauguaag

SEQ ID NO: 1698053 - RNA, 22 nt, Homo sapiens
uuagugaccccugccuacuucc

SEQ ID NO: 1698054 - RNA, 11 nt, Homo sapiens
uuagugcuugu

SEQ ID NO: 1698055 - RNA, 14 nt, Homo sapiens
uuauaacagaauua

SEQ ID NO: 1698056 - RNA, 19 nt, Homo sapiens
uuauaauaaaauugguguu

SEQ ID NO: 1698057 - RNA, 14 nt, Homo sapiens
uuauaauugcaucu

SEQ ID NO: 1698058 - RNA, 18 nt, Homo sapiens
uuauacaaaccuaccaaa

SEQ ID NO: 1698059 - RNA, 23 nt, Homo sapiens
uuauaccugcucuuguucuacug

SEQ ID NO: 1698060 - RNA, 12 nt, Homo sapiens
uuauacuuucag

SEQ ID NO: 1698061 - RNA, 12 nt, Homo sapiens
uuauagauucua

SEQ ID NO: 1698062 - RNA, 21 nt, Homo sapiens
uuauagcacuuugaaauaccu

SEQ ID NO: 1698063 - RNA, 22 nt, Homo sapiens
uuauagcacuuugaaauaccuc

SEQ ID NO: 1698064 - RNA, 13 nt, Homo sapiens
uuauaguacauga

SEQ ID NO: 1698065 - RNA, 18 nt, Homo sapiens
uuauauagguugugcaaa

SEQ ID NO: 1698066 - RNA, 16 nt, Homo sapiens
uuauauauuacuuguu

SEQ ID NO: 1698067 - RNA, 13 nt, Homo sapiens
uuauauggaugau

SEQ ID NO: 1698068 - RNA, 21 nt, Homo sapiens
uuaucacuucauucacauuca

SEQ ID NO: 1698069 - RNA, 23 nt, Homo sapiens
uuaucacuucauucacauucaga

SEQ ID NO: 1698070 - RNA, 14 nt, Homo sapiens
uuaucagcuuucag

SEQ ID NO: 1698071 - RNA, 13 nt, Homo sapiens
uuaucauuuauca

SEQ ID NO: 1698072 - RNA, 21 nt, Homo sapiens
uuauccagaggguugugauuu

SEQ ID NO: 1698073 - RNA, 20 nt, Homo sapiens
uuaucccccaaaaugcauuu

SEQ ID NO: 1698074 - RNA, 17 nt, Homo sapiens
uuaucgaaauaacaaug

SEQ ID NO: 1698075 - RNA, 21 nt, Homo sapiens
uuaucuauuccugaaauuucu

SEQ ID NO: 1698076 - RNA, 16 nt, Homo sapiens
uuaucuauucugagaa

SEQ ID NO: 1698077 - RNA, 18 nt, Homo sapiens
ucagcacagauaaaaagu

SEQ ID NO: 1698078 - RNA, 22 nt, Homo sapiens
ucagcagccgccuuaagcugau

SEQ ID NO: 1698079 - RNA, 16 nt, Homo sapiens
ucagcagugaaguaua

SEQ ID NO: 1698080 - RNA, 13 nt, Homo sapiens
ucagcaucuguga

SEQ ID NO: 1698081 - RNA, 14 nt, Homo sapiens
ucagcaucugugau

SEQ ID NO: 1698082 - RNA, 21 nt, Homo sapiens
ucagcaugccugaacuacaua

SEQ ID NO: 1698083 - RNA, 12 nt, Homo sapiens
ucagcccagaag

SEQ ID NO: 1698084 - RNA, 22 nt, Homo sapiens
ucagcccagccccuccaaaggu

SEQ ID NO: 1698085 - RNA, 15 nt, Homo sapiens
ucagccuuacauuug

SEQ ID NO: 1698086 - RNA, 12 nt, Homo sapiens
ucagcugaccau

SEQ ID NO: 1698087 - RNA, 19 nt, Homo sapiens
ucaggcagggugagcucca

SEQ ID NO: 1698088 - RNA, 23 nt, Homo sapiens
ucaggcgauccaccugucucagc

SEQ ID NO: 1698089 - RNA, 20 nt, Homo sapiens
ucagggggauaacuaccaga

SEQ ID NO: 1698090 - RNA, 12 nt, Homo sapiens
ucaggugacaug

SEQ ID NO: 1698091 - RNA, 22 nt, Homo sapiens
ucaggugucccugcacuugcag

SEQ ID NO: 1698092 - RNA, 17 nt, Homo sapiens
ucaguaggcuaauguca

SEQ ID NO: 1698093 - RNA, 14 nt, Homo sapiens
ucagucaacaacuu

SEQ ID NO: 1698094 - RNA, 17 nt, Homo sapiens
ucagucuaguugccaaa

SEQ ID NO: 1698095 - RNA, 18 nt, Homo sapiens
ucaguguugagaugggga

SEQ ID NO: 1698096 - RNA, 16 nt, Homo sapiens
ucaguuaacuauugca

SEQ ID NO: 1698097 - RNA, 15 nt, Homo sapiens
ugugacacauaugca

SEQ ID NO: 1698098 - RNA, 16 nt, Homo sapiens
ugugacaccaaagcca

SEQ ID NO: 1698099 - RNA, 18 nt, Homo sapiens
ugugacauuuuacauuaa

SEQ ID NO: 1698100 - RNA, 13 nt, Homo sapiens
ugugaccuugacu

SEQ ID NO: 1698101 - RNA, 20 nt, Homo sapiens
ugugacucccccucuuucac

SEQ ID NO: 1698102 - RNA, 15 nt, Homo sapiens
ugugagagauucugu

SEQ ID NO: 1698103 - RNA, 20 nt, Homo sapiens
ugugaugucuuuucuuggca

SEQ ID NO: 1698104 - RNA, 21 nt, Homo sapiens
ugugcacacacacacacaugc

SEQ ID NO: 1698105 - RNA, 17 nt, Homo sapiens
ugugcauguaugucuug

SEQ ID NO: 1698106 - RNA, 14 nt, Homo sapiens
ugugccaugugcca

SEQ ID NO: 1698107 - RNA, 22 nt, Homo sapiens
ugugcgcucuguggaugccagg

SEQ ID NO: 1698108 - RNA, 24 nt, Homo sapiens
ugugcucugaucauccacugugcc

SEQ ID NO: 1698109 - RNA, 19 nt, Homo sapiens
ugugcugcaccuggucaua

SEQ ID NO: 1698110 - RNA, 11 nt, Homo sapiens
ugugcugugac

SEQ ID NO: 1698111 - RNA, 12 nt, Homo sapiens
ugugcugugacu

SEQ ID NO: 1698112 - RNA, 21 nt, Homo sapiens
uguggaacauaaaaaggacau

SEQ ID NO: 1698113 - RNA, 13 nt, Homo sapiens
uguggacacagcu

SEQ ID NO: 1698114 - RNA, 20 nt, Homo sapiens
uguggagggggaggcgccaa

SEQ ID NO: 1698115 - RNA, 21 nt, Homo sapiens
uguggcaugauguuucuucca

SEQ ID NO: 1698116 - RNA, 14 nt, Homo sapiens
uguggcccaagaca

SEQ ID NO: 1698117 - RNA, 15 nt, Homo sapiens
uguggcccaagacaa

SEQ ID NO: 1698118 - RNA, 19 nt, Homo sapiens
uguggcccagggaagccaa

SEQ ID NO: 1698119 - RNA, 16 nt, Homo sapiens
uguggcuaaaugccua

SEQ ID NO: 1698120 - RNA, 18 nt, Homo sapiens
uguggggaagaguggucu

SEQ ID NO: 1698121 - RNA, 13 nt, Homo sapiens
uguggucaauccg

SEQ ID NO: 1698122 - RNA, 12 nt, Homo sapiens
uguggucauccu

SEQ ID NO: 1698123 - RNA, 16 nt, Homo sapiens
uguguauuuacaugaa

SEQ ID NO: 1698124 - RNA, 16 nt, Homo sapiens
ugugucaaaagccaga

SEQ ID NO: 1698125 - RNA, 15 nt, Homo sapiens
ugugucacaaagaau

SEQ ID NO: 1698126 - RNA, 14 nt, Homo sapiens
ugugucaugccagu

SEQ ID NO: 1698127 - RNA, 13 nt, Homo sapiens
ugugucauguaua

SEQ ID NO: 1698128 - RNA, 23 nt, Homo sapiens
ugugugaaaggaagcuccacugu

SEQ ID NO: 1698129 - RNA, 16 nt, Homo sapiens
ugugugcacguacaca

SEQ ID NO: 1698130 - RNA, 21 nt, Homo sapiens
ugugugcacguacacacacau

SEQ ID NO: 1698131 - RNA, 20 nt, Homo sapiens
uguguguuccaaguuuccaa

SEQ ID NO: 1698132 - RNA, 14 nt, Homo sapiens
uguguucugucacc

SEQ ID NO: 1698133 - RNA, 20 nt, Homo sapiens
uguguugccaugugugcuga

SEQ ID NO: 1698134 - RNA, 18 nt, Homo sapiens
uguguuguaauucuucag

SEQ ID NO: 1698135 - RNA, 16 nt, Homo sapiens
uguuaauuacaccaua

SEQ ID NO: 1698136 - RNA, 22 nt, Homo sapiens
uguuacaggaagucccuugcca

SEQ ID NO: 1698137 - RNA, 15 nt, Homo sapiens
uguuaccauucacaa

SEQ ID NO: 1698138 - RNA, 14 nt, Homo sapiens
uguuacuguaauuc

SEQ ID NO: 1698139 - RNA, 23 nt, Homo sapiens
uguuacuguucuugcugcuagaa

SEQ ID NO: 1698140 - RNA, 17 nt, Homo sapiens
uguuaggagaagcugca

SEQ ID NO: 1698141 - RNA, 16 nt, Homo sapiens
uguuaucaguaagaaa

SEQ ID NO: 1698142 - RNA, 20 nt, Homo sapiens
uguuaucuguguagcaagcu

SEQ ID NO: 1698143 - RNA, 14 nt, Homo sapiens
uguuauguacugua

SEQ ID NO: 1698144 - RNA, 23 nt, Homo sapiens
uguuauuauauuccguagguaga

SEQ ID NO: 1698145 - RNA, 17 nt, Homo sapiens
uguucagcuccagcuca

SEQ ID NO: 1698146 - RNA, 19 nt, Homo sapiens
uguuccuugucacugguag

SEQ ID NO: 1698147 - RNA, 14 nt, Homo sapiens
uguucuaaguauuu

SEQ ID NO: 1698148 - RNA, 15 nt, Homo sapiens
uguucuaaguauuug

SEQ ID NO: 1698149 - RNA, 16 nt, Homo sapiens
uguucucugaggacac

SEQ ID NO: 1698150 - RNA, 13 nt, Homo sapiens
uguucugcacuga

SEQ ID NO: 1698151 - RNA, 16 nt, Homo sapiens
uguucuggaagccaua

SEQ ID NO: 1698152 - RNA, 13 nt, Homo sapiens
uguucuuacacau

SEQ ID NO: 1698153 - RNA, 13 nt, Homo sapiens
uguucuugcuacc

SEQ ID NO: 1698154 - RNA, 21 nt, Homo sapiens
uguugagacugauucagagga

SEQ ID NO: 1698155 - RNA, 15 nt, Homo sapiens
uguugauuuccucug

SEQ ID NO: 1698156 - RNA, 17 nt, Homo sapiens
uguugcaaacucagugc

SEQ ID NO: 1698157 - RNA, 11 nt, Homo sapiens
uguuggcucac

SEQ ID NO: 1698158 - RNA, 18 nt, Homo sapiens
uguugucacccaagagau

SEQ ID NO: 1698159 - RNA, 19 nt, Homo sapiens
uguuuaagaaaaaauaaca

SEQ ID NO: 1698160 - RNA, 14 nt, Homo sapiens
uguuuacagugaug

SEQ ID NO: 1698161 - RNA, 22 nt, Homo sapiens
uguuuauuugugucacaaagaa

SEQ ID NO: 1698162 - RNA, 17 nt, Homo sapiens
uguuucaguucagauaa

SEQ ID NO: 1698163 - RNA, 15 nt, Homo sapiens
uguuucuguuauuaa

SEQ ID NO: 1698164 - RNA, 16 nt, Homo sapiens
uguuugaaauucuaga

SEQ ID NO: 1698165 - RNA, 17 nt, Homo sapiens
uguuugacacaauugga

SEQ ID NO: 1698166 - RNA, 18 nt, Homo sapiens
uguuugacacaauuggaa

SEQ ID NO: 1698167 - RNA, 21 nt, Homo sapiens
uguuugggggacguuucucau

SEQ ID NO: 1698168 - RNA, 17 nt, Homo sapiens
uguuugguuuacauuua

SEQ ID NO: 1698169 - RNA, 14 nt, Homo sapiens
uguuugucuuccau

SEQ ID NO: 1698170 - RNA, 16 nt, Homo sapiens
uguuuguuucauauau

SEQ ID NO: 1698171 - RNA, 17 nt, Homo sapiens
uguuuguuuuugcuugu

SEQ ID NO: 1698172 - RNA, 13 nt, Homo sapiens
uguuuuaucacuu

SEQ ID NO: 1698173 - RNA, 20 nt, Homo sapiens
uguuuucgcaccuaccauca

SEQ ID NO: 1698174 - RNA, 21 nt, Homo sapiens
uguuuucucuggaaugguaca

SEQ ID NO: 1698175 - RNA, 23 nt, Homo sapiens
uguuuugaaaaccuaaaagacag

SEQ ID NO: 1698176 - RNA, 21 nt, Homo sapiens
uguuuuguaagugcugcuaua

SEQ ID NO: 1698177 - RNA, 20 nt, Homo sapiens
aauaguuugagaaaugcaua

SEQ ID NO: 1698178 - RNA, 18 nt, Homo sapiens
aauaguuuugauccuaaa

SEQ ID NO: 1698179 - RNA, 18 nt, Homo sapiens
aauauaagcugccauaua

SEQ ID NO: 1698180 - RNA, 16 nt, Homo sapiens
aauaucuuugugauaa

SEQ ID NO: 1698181 - RNA, 14 nt, Homo sapiens
aauaugaguacaaa

SEQ ID NO: 1698182 - RNA, 20 nt, Homo sapiens
aauaugaguacaaaugccuu

SEQ ID NO: 1698183 - RNA, 16 nt, Homo sapiens
aauaugggcacuuuaa

SEQ ID NO: 1698184 - RNA, 18 nt, Homo sapiens
aauauuagaagccugcag

SEQ ID NO: 1698185 - RNA, 23 nt, Homo sapiens
aauauuguugacaacugugacug

SEQ ID NO: 1698186 - RNA, 17 nt, Homo sapiens
aauauuuaucugauuaa

SEQ ID NO: 1698187 - RNA, 21 nt, Homo sapiens
aauauuuuguaaugcugcaca

SEQ ID NO: 1698188 - RNA, 22 nt, Homo sapiens
aaucaaguauuugggaagugaa

SEQ ID NO: 1698189 - RNA, 12 nt, Homo sapiens
aaucagcacuga

SEQ ID NO: 1698190 - RNA, 18 nt, Homo sapiens
aaucagguccucagagaa

SEQ ID NO: 1698191 - RNA, 11 nt, Homo sapiens
aauccaaaaag

SEQ ID NO: 1698192 - RNA, 20 nt, Homo sapiens
aauccaaauggcgucuggaa

SEQ ID NO: 1698193 - RNA, 13 nt, Homo sapiens
aauccaacaucca

SEQ ID NO: 1698194 - RNA, 19 nt, Homo sapiens
aauccauccaaucuauuau

SEQ ID NO: 1698195 - RNA, 18 nt, Homo sapiens
aaucccagcuacucagga

SEQ ID NO: 1698196 - RNA, 15 nt, Homo sapiens
aauccccagcccuuu

SEQ ID NO: 1698197 - RNA, 20 nt, Homo sapiens
aaucccuccccgugacugca

SEQ ID NO: 1698198 - RNA, 20 nt, Homo sapiens
aaucccuguuuaauauuuaa

SEQ ID NO: 1698199 - RNA, 20 nt, Homo sapiens
aauccgcauugauggccuca

SEQ ID NO: 1698200 - RNA, 17 nt, Homo sapiens
aauccuaaauaauguua

SEQ ID NO: 1698201 - RNA, 20 nt, Homo sapiens
aauccuuaacacauucaaua

SEQ ID NO: 1698202 - RNA, 17 nt, Homo sapiens
aaucuagacaauauaca

SEQ ID NO: 1698203 - RNA, 21 nt, Homo sapiens
aaucuauccauugaacuaaaa

SEQ ID NO: 1698204 - RNA, 19 nt, Homo sapiens
aaucucaaugaagccagcu

SEQ ID NO: 1698205 - RNA, 17 nt, Homo sapiens
aaucucagcgugggcca

SEQ ID NO: 1698206 - RNA, 16 nt, Homo sapiens
aaucucucugcagcug

SEQ ID NO: 1698207 - RNA, 21 nt, Homo sapiens
aaucucuguuauguacuguac

SEQ ID NO: 1698208 - RNA, 22 nt, Homo sapiens
aaucugaagauugcgguuuaca

SEQ ID NO: 1698209 - RNA, 13 nt, Homo sapiens
aaucugagccagu

SEQ ID NO: 1698210 - RNA, 21 nt, Homo sapiens
aaucuggcaggaaucuaucca

SEQ ID NO: 1698211 - RNA, 21 nt, Homo sapiens
aaucuguacauuuuguuguaa

SEQ ID NO: 1698212 - RNA, 17 nt, Homo sapiens
aaucuguguaacuguaa

SEQ ID NO: 1698213 - RNA, 20 nt, Homo sapiens
aaucuuuggguaacuucaaa

SEQ ID NO: 1698214 - RNA, 21 nt, Homo sapiens
aaugaaaaaaaguacauguau

SEQ ID NO: 1698215 - RNA, 15 nt, Homo sapiens
aaugaaaaacaacca

SEQ ID NO: 1698216 - RNA, 13 nt, Homo sapiens
aaugaaacacagc

SEQ ID NO: 1698217 - RNA, 16 nt, Homo sapiens
aaugaaauuuaaacau

SEQ ID NO: 1698218 - RNA, 16 nt, Homo sapiens
aaugaaccuucugcaa

SEQ ID NO: 1698219 - RNA, 22 nt, Homo sapiens
aaugaaccuucugcaacaucuu

SEQ ID NO: 1698220 - RNA, 22 nt, Homo sapiens
aaugaagacuacauuugugaac

SEQ ID NO: 1698221 - RNA, 16 nt, Homo sapiens
aaugaagcagcuuuaa

SEQ ID NO: 1698222 - RNA, 13 nt, Homo sapiens
aaugacaaugaag

SEQ ID NO: 1698223 - RNA, 21 nt, Homo sapiens
aaugacacgccuaaggucaca

SEQ ID NO: 1698224 - RNA, 15 nt, Homo sapiens
aaugacuacuuagca

SEQ ID NO: 1698225 - RNA, 15 nt, Homo sapiens
aaugagcaccuccau

SEQ ID NO: 1698226 - RNA, 11 nt, Homo sapiens
aaugagugugc

SEQ ID NO: 1698227 - RNA, 15 nt, Homo sapiens
aaugauacuaucauu

SEQ ID NO: 1698228 - RNA, 14 nt, Homo sapiens
aaugauacugaugg

SEQ ID NO: 1698229 - RNA, 18 nt, Homo sapiens
aaugaucagcaucuguga

SEQ ID NO: 1698230 - RNA, 23 nt, Homo sapiens
aaugauuucaugcuaucucugug

SEQ ID NO: 1698231 - RNA, 17 nt, Homo sapiens
aaugcacauccauuccc

SEQ ID NO: 1698232 - RNA, 15 nt, Homo sapiens
aaugccaaauugcag

SEQ ID NO: 1698233 - RNA, 20 nt, Homo sapiens
aaugcugcaggacuugagaa

SEQ ID NO: 1698234 - RNA, 16 nt, Homo sapiens
aaugcuggcauuugca

SEQ ID NO: 1698235 - RNA, 19 nt, Homo sapiens
aauggacuauuuguuccac

SEQ ID NO: 1698236 - RNA, 22 nt, Homo sapiens
aauggagaauuaaaaauaccaa

SEQ ID NO: 1698237 - RNA, 16 nt, Homo sapiens
aauggcagaaccaaag

SEQ ID NO: 1698238 - RNA, 18 nt, Homo sapiens
aauggcccaguccucucc

SEQ ID NO: 1698239 - RNA, 20 nt, Homo sapiens
aauguaccuucuuucacucu

SEQ ID NO: 1698240 - RNA, 15 nt, Homo sapiens
aauguaguugaugua

SEQ ID NO: 1698241 - RNA, 20 nt, Homo sapiens
aauguauauacacauauacc

SEQ ID NO: 1698242 - RNA, 16 nt, Homo sapiens
aauguaucauagaaau

SEQ ID NO: 1698243 - RNA, 15 nt, Homo sapiens
aauguauuuguucau

SEQ ID NO: 1698244 - RNA, 21 nt, Homo sapiens
aauguauuuguuugcaauuuu

SEQ ID NO: 1698245 - RNA, 13 nt, Homo sapiens
aaugucuaagaua

SEQ ID NO: 1698246 - RNA, 20 nt, Homo sapiens
aaugugaaggggagagacag

SEQ ID NO: 1698247 - RNA, 20 nt, Homo sapiens
aauguggccgaggacuuuga

SEQ ID NO: 1698248 - RNA, 22 nt, Homo sapiens
aauguguuuuaucacuucauuc

SEQ ID NO: 1698249 - RNA, 13 nt, Homo sapiens
aauguuugucuca

SEQ ID NO: 1698250 - RNA, 15 nt, Homo sapiens
aauuaaaaaccugau

SEQ ID NO: 1698251 - RNA, 21 nt, Homo sapiens
aauuaaaaaguuaaucuucau

SEQ ID NO: 1698252 - RNA, 19 nt, Homo sapiens
aauuaaacgguaacaucca

SEQ ID NO: 1698253 - RNA, 11 nt, Homo sapiens
aauuaaaggaa

SEQ ID NO: 1698254 - RNA, 21 nt, Homo sapiens
aauuaacagagauugaacucc

SEQ ID NO: 1698255 - RNA, 14 nt, Homo sapiens
aauuagacuaagug

SEQ ID NO: 1698256 - RNA, 23 nt, Homo sapiens
aauuagcaauugacugucacugu

SEQ ID NO: 1698257 - RNA, 21 nt, Homo sapiens
aauuauauuaaagaaccaaaa

SEQ ID NO: 1698258 - RNA, 16 nt, Homo sapiens
aauuaugcacuaaaua

SEQ ID NO: 1698259 - RNA, 18 nt, Homo sapiens
aauuauuuaaaaugcaua

SEQ ID NO: 1698260 - RNA, 14 nt, Homo sapiens
aauucaagccuuag

SEQ ID NO: 1698261 - RNA, 19 nt, Homo sapiens
aauucacuuaacucugucu

SEQ ID NO: 1698262 - RNA, 13 nt, Homo sapiens
aauucagugaaga

SEQ ID NO: 1698263 - RNA, 14 nt, Homo sapiens
aauucccaagcuuu

SEQ ID NO: 1698264 - RNA, 16 nt, Homo sapiens
aauuccuagucacaau

SEQ ID NO: 1698265 - RNA, 16 nt, Homo sapiens
aauuccucuuacugua

SEQ ID NO: 1698266 - RNA, 13 nt, Homo sapiens
aauuccugugauu

SEQ ID NO: 1698267 - RNA, 14 nt, Homo sapiens
aauucgcuguuacc

SEQ ID NO: 1698268 - RNA, 17 nt, Homo sapiens
aauucuauucugaucuu

SEQ ID NO: 1698269 - RNA, 20 nt, Homo sapiens
aauucugagacaugugucaa

SEQ ID NO: 1698270 - RNA, 18 nt, Homo sapiens
aauucuuccuuagacuua

SEQ ID NO: 1698271 - RNA, 21 nt, Homo sapiens
aauucuugaaagaauuuuccu

SEQ ID NO: 1698272 - RNA, 15 nt, Homo sapiens
aauugacaacacagc

SEQ ID NO: 1698273 - RNA, 13 nt, Homo sapiens
aauugacaaugac

SEQ ID NO: 1698274 - RNA, 14 nt, Homo sapiens
aauugauguugcug

SEQ ID NO: 1698275 - RNA, 13 nt, Homo sapiens
aauugauuugcau

SEQ ID NO: 1698276 - RNA, 23 nt, Homo sapiens
aauugcacacacucagugcagca

SEQ ID NO: 1698277 - RNA, 12 nt, Homo sapiens
aauugcauuucc

SEQ ID NO: 1698278 - RNA, 22 nt, Homo sapiens
aauugccauuggacaguugucu

SEQ ID NO: 1698279 - RNA, 15 nt, Homo sapiens
aauuggcacuaaaga

SEQ ID NO: 1698280 - RNA, 15 nt, Homo sapiens
aauugggaguccagg

SEQ ID NO: 1698281 - RNA, 19 nt, Homo sapiens
aauugggaguccaggcaca

SEQ ID NO: 1698282 - RNA, 23 nt, Homo sapiens
aauuguaacgacuucuccaucuc

SEQ ID NO: 1698283 - RNA, 20 nt, Homo sapiens
aauugucuuuguucugugau

SEQ ID NO: 1698284 - RNA, 22 nt, Homo sapiens
aauugugguuuauugaauguga

SEQ ID NO: 1698285 - RNA, 21 nt, Homo sapiens
aauuguugacaguucugaaga

SEQ ID NO: 1698286 - RNA, 12 nt, Homo sapiens
acagagaagcug

SEQ ID NO: 1698287 - RNA, 21 nt, Homo sapiens
acagagcaagacuccaucuca

SEQ ID NO: 1698288 - RNA, 15 nt, Homo sapiens
acagaggcgaaggca

SEQ ID NO: 1698289 - RNA, 16 nt, Homo sapiens
acagaguagaaacuca

SEQ ID NO: 1698290 - RNA, 19 nt, Homo sapiens
acagaguagaaacucaaaa

SEQ ID NO: 1698291 - RNA, 18 nt, Homo sapiens
acagagucaggaucucac

SEQ ID NO: 1698292 - RNA, 16 nt, Homo sapiens
acagauggacagacag

SEQ ID NO: 1698293 - RNA, 13 nt, Homo sapiens
acagcaacaauga

SEQ ID NO: 1698294 - RNA, 21 nt, Homo sapiens
acagcaaccucuucaugagcu

SEQ ID NO: 1698295 - RNA, 22 nt, Homo sapiens
acagcaaccucuucaugagcuu

SEQ ID NO: 1698296 - RNA, 17 nt, Homo sapiens
acagcaauggugucagu

SEQ ID NO: 1698297 - RNA, 14 nt, Homo sapiens
acagcaauuccugg

SEQ ID NO: 1698298 - RNA, 22 nt, Homo sapiens
acagccucugaccccuccucac

SEQ ID NO: 1698299 - RNA, 14 nt, Homo sapiens
acagccuggcacag

SEQ ID NO: 1698300 - RNA, 19 nt, Homo sapiens
acagcgucccuagcaguga

SEQ ID NO: 1698301 - RNA, 19 nt, Homo sapiens
acagcuaucgaacuucaca

SEQ ID NO: 1698302 - RNA, 20 nt, Homo sapiens
acagcucuagacacugccac

SEQ ID NO: 1698303 - RNA, 20 nt, Homo sapiens
acagcucuuaaauguagcaa

SEQ ID NO: 1698304 - RNA, 15 nt, Homo sapiens
acagcugaacuauuu

SEQ ID NO: 1698305 - RNA, 15 nt, Homo sapiens
acagcugaguuauga

SEQ ID NO: 1698306 - RNA, 16 nt, Homo sapiens
acagcugauacuucau

SEQ ID NO: 1698307 - RNA, 22 nt, Homo sapiens
acaggaagccugcaguccugga

SEQ ID NO: 1698308 - RNA, 16 nt, Homo sapiens
acaggacaacuuuaca

SEQ ID NO: 1698309 - RNA, 13 nt, Homo sapiens
acaggacugauuc

SEQ ID NO: 1698310 - RNA, 23 nt, Homo sapiens
acaggaggcccccaucuaugagc

SEQ ID NO: 1698311 - RNA, 17 nt, Homo sapiens
acaggaugaccuggaua

SEQ ID NO: 1698312 - RNA, 18 nt, Homo sapiens
acaggauuuguaauuccu

SEQ ID NO: 1698313 - RNA, 14 nt, Homo sapiens
acaggcaagcaccu

SEQ ID NO: 1698314 - RNA, 19 nt, Homo sapiens
acaggcauuuguucacuga

SEQ ID NO: 1698315 - RNA, 19 nt, Homo sapiens
acaggcccggcuccaggcu

SEQ ID NO: 1698316 - RNA, 18 nt, Homo sapiens
acaggcgcugaguaugga

SEQ ID NO: 1698317 - RNA, 18 nt, Homo sapiens
acaggguaacugugcuga

SEQ ID NO: 1698318 - RNA, 22 nt, Homo sapiens
acaggguuuugccauguuggcc

SEQ ID NO: 1698319 - RNA, 23 nt, Homo sapiens
acagguaauauaaaaagcuucca

SEQ ID NO: 1698320 - RNA, 14 nt, Homo sapiens
acagguaccaucuu

SEQ ID NO: 1698321 - RNA, 18 nt, Homo sapiens
acaguaacccaaaccuca

SEQ ID NO: 1698322 - RNA, 13 nt, Homo sapiens
acaguagagccag

SEQ ID NO: 1698323 - RNA, 16 nt, Homo sapiens
acaguaucccacaucc

SEQ ID NO: 1698324 - RNA, 11 nt, Homo sapiens
acagucacuga

SEQ ID NO: 1698325 - RNA, 16 nt, Homo sapiens
acagucacugauguac

SEQ ID NO: 1698326 - RNA, 17 nt, Homo sapiens
acagugacuggugccag

SEQ ID NO: 1698327 - RNA, 21 nt, Homo sapiens
acagugagucgaggacaggga

SEQ ID NO: 1698328 - RNA, 19 nt, Homo sapiens
acagugccgacagcucucc

SEQ ID NO: 1698329 - RNA, 18 nt, Homo sapiens
acaguggccccaucauag

SEQ ID NO: 1698330 - RNA, 12 nt, Homo sapiens
acaguguauauu

SEQ ID NO: 1698331 - RNA, 18 nt, Homo sapiens
acaguuagguagcuuuag

SEQ ID NO: 1698332 - RNA, 21 nt, Homo sapiens
acaguuauugcaagaguuuaa

SEQ ID NO: 1698333 - RNA, 22 nt, Homo sapiens
acaguucaauucucauuuguca

SEQ ID NO: 1698334 - RNA, 14 nt, Homo sapiens
acaguucugaagaa

SEQ ID NO: 1698335 - RNA, 17 nt, Homo sapiens
acaguuuguggcuuaua

SEQ ID NO: 1698336 - RNA, 21 nt, Homo sapiens
acauaaaagaauuuuuuuguc

SEQ ID NO: 1698337 - RNA, 20 nt, Homo sapiens
acauaacucuguaaaaacac

SEQ ID NO: 1698338 - RNA, 19 nt, Homo sapiens
acauacaggccauacuuua

SEQ ID NO: 1698339 - RNA, 22 nt, Homo sapiens
acauacaggccauacuuuacaa

SEQ ID NO: 1698340 - RNA, 18 nt, Homo sapiens
acauagagugaucuuucc

SEQ ID NO: 1698341 - RNA, 20 nt, Homo sapiens
acauaucacgcgcacagccu

SEQ ID NO: 1698342 - RNA, 14 nt, Homo sapiens
acauaugacuugau

SEQ ID NO: 1698343 - RNA, 19 nt, Homo sapiens
acauaugauuucacuagaa

SEQ ID NO: 1698344 - RNA, 17 nt, Homo sapiens
acauauggacucugcac

SEQ ID NO: 1698345 - RNA, 17 nt, Homo sapiens
acauauguaaacauaag

SEQ ID NO: 1698346 - RNA, 15 nt, Homo sapiens
acaucaggaguucaa

SEQ ID NO: 1698347 - RNA, 19 nt, Homo sapiens
acauccauguccuaugugu

SEQ ID NO: 1698348 - RNA, 14 nt, Homo sapiens
acauccauucccaa

SEQ ID NO: 1698349 - RNA, 22 nt, Homo sapiens
acauccuaccccuuugcacuug

SEQ ID NO: 1698350 - RNA, 14 nt, Homo sapiens
acaucggccuccau

SEQ ID NO: 1698351 - RNA, 19 nt, Homo sapiens
acaucucagaaaacucugg

SEQ ID NO: 1698352 - RNA, 17 nt, Homo sapiens
acaucucaggggccaga

SEQ ID NO: 1698353 - RNA, 20 nt, Homo sapiens
acaucugagagaugacaggg

SEQ ID NO: 1698354 - RNA, 15 nt, Homo sapiens
acaucuuuaaacagu

SEQ ID NO: 1698355 - RNA, 14 nt, Homo sapiens
acaucuuuccuguc

SEQ ID NO: 1698356 - RNA, 17 nt, Homo sapiens
acaucuuuuacauucug

SEQ ID NO: 1698357 - RNA, 14 nt, Homo sapiens
acaugacacccgug

SEQ ID NO: 1698358 - RNA, 21 nt, Homo sapiens
acaugaccugaucacuagccu

SEQ ID NO: 1698359 - RNA, 22 nt, Homo sapiens
acaugagauguguggacugugg

SEQ ID NO: 1698360 - RNA, 20 nt, Homo sapiens
acaugaucuguuuuucacca

SEQ ID NO: 1698361 - RNA, 22 nt, Homo sapiens
acaugcaaaaagaaaugacuaa

SEQ ID NO: 1698362 - RNA, 16 nt, Homo sapiens
acaugggagcagucca

SEQ ID NO: 1698363 - RNA, 17 nt, Homo sapiens
acauggugccccuagcu

SEQ ID NO: 1698364 - RNA, 23 nt, Homo sapiens
acauguaucacgggucacuugaa

SEQ ID NO: 1698365 - RNA, 20 nt, Homo sapiens
acaugucuagccacugauca

SEQ ID NO: 1698366 - RNA, 17 nt, Homo sapiens
acaugugacacauaugc

SEQ ID NO: 1698367 - RNA, 11 nt, Homo sapiens
acaugugaugu

SEQ ID NO: 1698368 - RNA, 13 nt, Homo sapiens
acaugugcacaug

SEQ ID NO: 1698369 - RNA, 16 nt, Homo sapiens
acaugugcacaugcac

SEQ ID NO: 1698370 - RNA, 22 nt, Homo sapiens
acauguguuuuaauuccaauau

SEQ ID NO: 1698371 - RNA, 12 nt, Homo sapiens
acauuagaauaa

SEQ ID NO: 1698372 - RNA, 14 nt, Homo sapiens
acauuaugccuuaa

SEQ ID NO: 1698373 - RNA, 13 nt, Homo sapiens
acauuaugugguu

SEQ ID NO: 1698374 - RNA, 15 nt, Homo sapiens
acauucaauagcaua

SEQ ID NO: 1698375 - RNA, 17 nt, Homo sapiens
acauucugaugagcaac

SEQ ID NO: 1698376 - RNA, 23 nt, Homo sapiens
acauucugcaagcacaucugcau

SEQ ID NO: 1698377 - RNA, 22 nt, Homo sapiens
acauuucucauaccuuccccac

SEQ ID NO: 1698378 - RNA, 15 nt, Homo sapiens
acauuuuacauuaaa

SEQ ID NO: 1698379 - RNA, 15 nt, Homo sapiens
acauuuuuccaguaa

SEQ ID NO: 1698380 - RNA, 23 nt, Homo sapiens
acauuuuuugggcagcaauuuaa

SEQ ID NO: 1698381 - RNA, 13 nt, Homo sapiens
accaaaaagggau

SEQ ID NO: 1698382 - RNA, 16 nt, Homo sapiens
accaaaaccacagugc

SEQ ID NO: 1698383 - RNA, 15 nt, Homo sapiens
accaaagcugcccac

SEQ ID NO: 1698384 - RNA, 21 nt, Homo sapiens
accaaaggacauuaugugugc

SEQ ID NO: 1698385 - RNA, 23 nt, Homo sapiens
accaaaucuucuccuaugcauuu

SEQ ID NO: 1698386 - RNA, 13 nt, Homo sapiens
accaacaugguga

SEQ ID NO: 1698387 - RNA, 22 nt, Homo sapiens
accaacugaaguggcuaaagag

SEQ ID NO: 1698388 - RNA, 11 nt, Homo sapiens
accaacugugu

SEQ ID NO: 1698389 - RNA, 21 nt, Homo sapiens
accaagaaaacaugcaacuca

SEQ ID NO: 1698390 - RNA, 16 nt, Homo sapiens
accaaguauagccuau

SEQ ID NO: 1698391 - RNA, 15 nt, Homo sapiens
accaaguggcuccca

SEQ ID NO: 1698392 - RNA, 18 nt, Homo sapiens
accaauugugcugccauu

SEQ ID NO: 1698393 - RNA, 20 nt, Homo sapiens
accaauugugcugccauuug

SEQ ID NO: 1698394 - RNA, 22 nt, Homo sapiens
accacaaccaccuucaccugga

SEQ ID NO: 1698395 - RNA, 13 nt, Homo sapiens
accacaacugaca

SEQ ID NO: 1698396 - RNA, 15 nt, Homo sapiens
agaauuaacagagau

SEQ ID NO: 1698397 - RNA, 16 nt, Homo sapiens
agaauucuuauacaca

SEQ ID NO: 1698398 - RNA, 13 nt, Homo sapiens
agaauugugcaaa

SEQ ID NO: 1698399 - RNA, 18 nt, Homo sapiens
agacaaaucaacagaagc

SEQ ID NO: 1698400 - RNA, 16 nt, Homo sapiens
agacaacagaagucau

SEQ ID NO: 1698401 - RNA, 15 nt, Homo sapiens
agacaaggaaauacc

SEQ ID NO: 1698402 - RNA, 19 nt, Homo sapiens
agacaaguuccaugggaua

SEQ ID NO: 1698403 - RNA, 20 nt, Homo sapiens
agacaauauacaagccaaag

SEQ ID NO: 1698404 - RNA, 13 nt, Homo sapiens
agacaauuugcac

SEQ ID NO: 1698405 - RNA, 18 nt, Homo sapiens
agacacaaaugcaugaac

SEQ ID NO: 1698406 - RNA, 22 nt, Homo sapiens
agacaccagagcagaugcagag

SEQ ID NO: 1698407 - RNA, 17 nt, Homo sapiens
agacaccuugacagggc

SEQ ID NO: 1698408 - RNA, 14 nt, Homo sapiens
agacacugugcuau

SEQ ID NO: 1698409 - RNA, 18 nt, Homo sapiens
agacagaauguaucugug

SEQ ID NO: 1698410 - RNA, 20 nt, Homo sapiens
agacagccccagagcagggu

SEQ ID NO: 1698411 - RNA, 19 nt, Homo sapiens
agacaggguuuugccaugu

SEQ ID NO: 1698412 - RNA, 15 nt, Homo sapiens
agacagugacuggug

SEQ ID NO: 1698413 - RNA, 16 nt, Homo sapiens
agacaguuauugcaag

SEQ ID NO: 1698414 - RNA, 14 nt, Homo sapiens
agacaguucaagaa

SEQ ID NO: 1698415 - RNA, 13 nt, Homo sapiens
agacauacauuuc

SEQ ID NO: 1698416 - RNA, 14 nt, Homo sapiens
agacauaucucuaa

SEQ ID NO: 1698417 - RNA, 20 nt, Homo sapiens
agacaugcacuaugaggaau

SEQ ID NO: 1698418 - RNA, 19 nt, Homo sapiens
agacauucuuccaaaaaga

SEQ ID NO: 1698419 - RNA, 21 nt, Homo sapiens
agaccacaaaaauugacucaa

SEQ ID NO: 1698420 - RNA, 19 nt, Homo sapiens
agaccagggugguugggac

SEQ ID NO: 1698421 - RNA, 13 nt, Homo sapiens
agaccaguccaug

SEQ ID NO: 1698422 - RNA, 19 nt, Homo sapiens
agacccaccccaccugcag

SEQ ID NO: 1698423 - RNA, 16 nt, Homo sapiens
agaccccggcuuccuu

SEQ ID NO: 1698424 - RNA, 14 nt, Homo sapiens
agacccgcccuccc

SEQ ID NO: 1698425 - RNA, 12 nt, Homo sapiens
agacccggcugc

SEQ ID NO: 1698426 - RNA, 13 nt, Homo sapiens
agacccuggaaaa

SEQ ID NO: 1698427 - RNA, 20 nt, Homo sapiens
agaccguuuaccuagaagaa

SEQ ID NO: 1698428 - RNA, 12 nt, Homo sapiens
agaccuacccuc

SEQ ID NO: 1698429 - RNA, 20 nt, Homo sapiens
agaccugaagugugcacguu

SEQ ID NO: 1698430 - RNA, 13 nt, Homo sapiens
agaccuggugcug

SEQ ID NO: 1698431 - RNA, 17 nt, Homo sapiens
agaccuuuggagcaaag

SEQ ID NO: 1698432 - RNA, 14 nt, Homo sapiens
agacgguuaaauac

SEQ ID NO: 1698433 - RNA, 20 nt, Homo sapiens
agacuauggagccuggcaca

SEQ ID NO: 1698434 - RNA, 23 nt, Homo sapiens
agacuauuaauaaauaagacugu

SEQ ID NO: 1698435 - RNA, 23 nt, Homo sapiens
agacucauucccuagaucuuucu

SEQ ID NO: 1698436 - RNA, 14 nt, Homo sapiens
agacucuauucuca

SEQ ID NO: 1698437 - RNA, 15 nt, Homo sapiens
agacugacaaccuca

SEQ ID NO: 1698438 - RNA, 17 nt, Homo sapiens
agacugacaaccucauc

SEQ ID NO: 1698439 - RNA, 20 nt, Homo sapiens
agacugaccauauugugcuu

SEQ ID NO: 1698440 - RNA, 23 nt, Homo sapiens
agacugacuuguuugucuuccau

SEQ ID NO: 1698441 - RNA, 21 nt, Homo sapiens
agacuggaaguucauaccuaa

SEQ ID NO: 1698442 - RNA, 22 nt, Homo sapiens
agacuggaaguucauaccuaag

SEQ ID NO: 1698443 - RNA, 21 nt, Homo sapiens
agacugggucucgcuuuguug

SEQ ID NO: 1698444 - RNA, 20 nt, Homo sapiens
agacugugacaacugucuaa

SEQ ID NO: 1698445 - RNA, 17 nt, Homo sapiens
agacuguugccacuuaa

SEQ ID NO: 1698446 - RNA, 18 nt, Homo sapiens
agacuguugccacuuaac

SEQ ID NO: 1698447 - RNA, 17 nt, Homo sapiens
agacuuauguauuagcu

SEQ ID NO: 1698448 - RNA, 23 nt, Homo sapiens
agacuuccccucaacaugcugcc

SEQ ID NO: 1698449 - RNA, 22 nt, Homo sapiens
agacuuccucaugaaucucuca

SEQ ID NO: 1698450 - RNA, 21 nt, Homo sapiens
agagaaaaaaaauuaagacaa

SEQ ID NO: 1698451 - RNA, 13 nt, Homo sapiens
agagaaauucugu

SEQ ID NO: 1698452 - RNA, 17 nt, Homo sapiens
agagaaccgagcaaaga

SEQ ID NO: 1698453 - RNA, 14 nt, Homo sapiens
agagaaucauacuu

SEQ ID NO: 1698454 - RNA, 21 nt, Homo sapiens
agagacagaggcgcccugggu

SEQ ID NO: 1698455 - RNA, 21 nt, Homo sapiens
agagacaggguuucacugugu

SEQ ID NO: 1698456 - RNA, 21 nt, Homo sapiens
agagacaggguuuugccaugu

SEQ ID NO: 1698457 - RNA, 15 nt, Homo sapiens
agagagaaagccagg

SEQ ID NO: 1698458 - RNA, 12 nt, Homo sapiens
agagagaacuuu

SEQ ID NO: 1698459 - RNA, 20 nt, Homo sapiens
agagagaaguucauacaaag

SEQ ID NO: 1698460 - RNA, 16 nt, Homo sapiens
agagagauauaucuga

SEQ ID NO: 1698461 - RNA, 22 nt, Homo sapiens
agagaguauuuuuauacaaacc

SEQ ID NO: 1698462 - RNA, 13 nt, Homo sapiens
agagaguggcucc

SEQ ID NO: 1698463 - RNA, 20 nt, Homo sapiens
agagaugacaaggagcacaa

SEQ ID NO: 1698464 - RNA, 15 nt, Homo sapiens
agagaugucaucaga

SEQ ID NO: 1698465 - RNA, 16 nt, Homo sapiens
agagauucccaagcca

SEQ ID NO: 1698466 - RNA, 17 nt, Homo sapiens
agagcaagacccaucuc

SEQ ID NO: 1698467 - RNA, 19 nt, Homo sapiens
agagcaagacuccaucuca

SEQ ID NO: 1698468 - RNA, 20 nt, Homo sapiens
agagcaagacuccaucucaa

SEQ ID NO: 1698469 - RNA, 13 nt, Homo sapiens
agagcaauuguaa

SEQ ID NO: 1698470 - RNA, 16 nt, Homo sapiens
agagcacaccuaucuu

SEQ ID NO: 1698471 - RNA, 14 nt, Homo sapiens
agagcagaugcaga

SEQ ID NO: 1698472 - RNA, 17 nt, Homo sapiens
agagcaggaagcauuca

SEQ ID NO: 1698473 - RNA, 16 nt, Homo sapiens
agagccagggcugaug

SEQ ID NO: 1698474 - RNA, 13 nt, Homo sapiens
agagccucugggc

SEQ ID NO: 1698475 - RNA, 16 nt, Homo sapiens
agaggaacagcacugg

SEQ ID NO: 1698476 - RNA, 22 nt, Homo sapiens
agaggaacuccuuggccuagcc

SEQ ID NO: 1698477 - RNA, 22 nt, Homo sapiens
agaggauaaggaggcacugcug

SEQ ID NO: 1698478 - RNA, 19 nt, Homo sapiens
agaggcagggucucacucu

SEQ ID NO: 1698479 - RNA, 14 nt, Homo sapiens
agaggcagugacag

SEQ ID NO: 1698480 - RNA, 21 nt, Homo sapiens
agaggcugccccucucaccaa

SEQ ID NO: 1698481 - RNA, 20 nt, Homo sapiens
agaggggaacagacuggaag

SEQ ID NO: 1698482 - RNA, 14 nt, Homo sapiens
agaggguguuugca

SEQ ID NO: 1698483 - RNA, 18 nt, Homo sapiens
agaggucagacuaagaaa

SEQ ID NO: 1698484 - RNA, 13 nt, Homo sapiens
agagguccagccc

SEQ ID NO: 1698485 - RNA, 20 nt, Homo sapiens
agaguauaugcacuuuccaa

SEQ ID NO: 1698486 - RNA, 17 nt, Homo sapiens
agagugacuaguacaaa

SEQ ID NO: 1698487 - RNA, 20 nt, Homo sapiens
agagugagacucugucucaa

SEQ ID NO: 1698488 - RNA, 14 nt, Homo sapiens
agagugauugcagc

SEQ ID NO: 1698489 - RNA, 22 nt, Homo sapiens
agagugccguaacaacuguggu

SEQ ID NO: 1698490 - RNA, 14 nt, Homo sapiens
agagugucucaggg

SEQ ID NO: 1698491 - RNA, 20 nt, Homo sapiens
agagugucucagggugcaga

SEQ ID NO: 1698492 - RNA, 18 nt, Homo sapiens
agaguuuguguguugucu

SEQ ID NO: 1698493 - RNA, 14 nt, Homo sapiens
agauaaacuacaua

SEQ ID NO: 1698494 - RNA, 18 nt, Homo sapiens
agauaaucagugugucua

SEQ ID NO: 1698495 - RNA, 12 nt, Homo sapiens
agauacaaacug

SEQ ID NO: 1698496 - RNA, 14 nt, Homo sapiens
agauacaucacugc

SEQ ID NO: 1698497 - RNA, 15 nt, Homo sapiens
agauagcuacagugu

SEQ ID NO: 1698498 - RNA, 17 nt, Homo sapiens
agauauucagaaguaua

SEQ ID NO: 1698499 - RNA, 13 nt, Homo sapiens
agauauuguucaa

SEQ ID NO: 1698500 - RNA, 21 nt, Homo sapiens
agauauuugguaccauggugu

SEQ ID NO: 1698501 - RNA, 22 nt, Homo sapiens
agauauuugguaccauggugua

SEQ ID NO: 1698502 - RNA, 17 nt, Homo sapiens
agaucacgaggucagga

SEQ ID NO: 1698503 - RNA, 22 nt, Homo sapiens
agaucacugccacacucuccau

SEQ ID NO: 1698504 - RNA, 20 nt, Homo sapiens
agaucauccagaaguuccuc

SEQ ID NO: 1698505 - RNA, 19 nt, Homo sapiens
agaucaugacauaugacuu

SEQ ID NO: 1698506 - RNA, 22 nt, Homo sapiens
aggacauucuggaaaagcaaaa

SEQ ID NO: 1698507 - RNA, 19 nt, Homo sapiens
aggaccaagggcaccugga

SEQ ID NO: 1698508 - RNA, 19 nt, Homo sapiens
aggaccccauccuguucuc

SEQ ID NO: 1698509 - RNA, 19 nt, Homo sapiens
aggacucccuccucaccuc

SEQ ID NO: 1698510 - RNA, 23 nt, Homo sapiens
aggacugcgggacuugggucuca

SEQ ID NO: 1698511 - RNA, 14 nt, Homo sapiens
aggacuguaaucuu

SEQ ID NO: 1698512 - RNA, 21 nt, Homo sapiens
aggacuguuuuauaaacugcu

SEQ ID NO: 1698513 - RNA, 19 nt, Homo sapiens
aggacuugugucucugugc

SEQ ID NO: 1698514 - RNA, 17 nt, Homo sapiens
aggacuuguuuacaaag

SEQ ID NO: 1698515 - RNA, 14 nt, Homo sapiens
aggagaacaucuuu

SEQ ID NO: 1698516 - RNA, 14 nt, Homo sapiens
aggagaagcugcau

SEQ ID NO: 1698517 - RNA, 12 nt, Homo sapiens
aggagaccaagg

SEQ ID NO: 1698518 - RNA, 17 nt, Homo sapiens
aggagcacaggucccac

SEQ ID NO: 1698519 - RNA, 21 nt, Homo sapiens
aggagcagccugaacccgggg

SEQ ID NO: 1698520 - RNA, 22 nt, Homo sapiens
aggagccaggccuugggcuccu

SEQ ID NO: 1698521 - RNA, 23 nt, Homo sapiens
aggagccgaccgggaauaaccuu

SEQ ID NO: 1698522 - RNA, 21 nt, Homo sapiens
aggagcugcuggcuugcagug

SEQ ID NO: 1698523 - RNA, 14 nt, Homo sapiens
aggaggagcaccuc

SEQ ID NO: 1698524 - RNA, 23 nt, Homo sapiens
aggaggagcaccuccgccagauc

SEQ ID NO: 1698525 - RNA, 13 nt, Homo sapiens
aggaggcaagcaa

SEQ ID NO: 1698526 - RNA, 20 nt, Homo sapiens
aggaggcucccgaggggaag

SEQ ID NO: 1698527 - RNA, 16 nt, Homo sapiens
aggagggcccuaccug

SEQ ID NO: 1698528 - RNA, 19 nt, Homo sapiens
aggaguacuccaagacaga

SEQ ID NO: 1698529 - RNA, 16 nt, Homo sapiens
aggagucaaaacuaca

SEQ ID NO: 1698530 - RNA, 23 nt, Homo sapiens
aggagugugugacauuccagggg

SEQ ID NO: 1698531 - RNA, 19 nt, Homo sapiens
aggauaaggaggcacugcu

SEQ ID NO: 1698532 - RNA, 13 nt, Homo sapiens
aggauauuaacaa

SEQ ID NO: 1698533 - RNA, 16 nt, Homo sapiens
aggaucucacauuuca

SEQ ID NO: 1698534 - RNA, 17 nt, Homo sapiens
aggaugauguuauucac

SEQ ID NO: 1698535 - RNA, 13 nt, Homo sapiens
aggaugcugucaa

SEQ ID NO: 1698536 - RNA, 19 nt, Homo sapiens
aggaugcugucaagcaccu

SEQ ID NO: 1698537 - RNA, 18 nt, Homo sapiens
aggaugucacagggccaa

SEQ ID NO: 1698538 - RNA, 19 nt, Homo sapiens
aggaugugauuguggaaug

SEQ ID NO: 1698539 - RNA, 17 nt, Homo sapiens
aggauguucugggacac

SEQ ID NO: 1698540 - RNA, 21 nt, Homo sapiens
aggauuuggggcagagggaca

SEQ ID NO: 1698541 - RNA, 17 nt, Homo sapiens
aggauuuuuauugauug

SEQ ID NO: 1698542 - RNA, 22 nt, Homo sapiens
aggcaaccugauuguaaacuuc

SEQ ID NO: 1698543 - RNA, 17 nt, Homo sapiens
aggcaagcaagcucucu

SEQ ID NO: 1698544 - RNA, 21 nt, Homo sapiens
aggcaagcaagcucucuugcc

SEQ ID NO: 1698545 - RNA, 19 nt, Homo sapiens
aggcaaggcuaugugauua

SEQ ID NO: 1698546 - RNA, 19 nt, Homo sapiens
aggcacagcugaguuauga

SEQ ID NO: 1698547 - RNA, 19 nt, Homo sapiens
aggcaccugccaccaugcc

SEQ ID NO: 1698548 - RNA, 20 nt, Homo sapiens
aggcacuagccuuuggcucu

SEQ ID NO: 1698549 - RNA, 13 nt, Homo sapiens
aggcacugcugau

SEQ ID NO: 1698550 - RNA, 22 nt, Homo sapiens
aggcacugcugcccagccucca

SEQ ID NO: 1698551 - RNA, 11 nt, Homo sapiens
aggcacugggc

SEQ ID NO: 1698552 - RNA, 20 nt, Homo sapiens
aggcacuguaguucuaagac

SEQ ID NO: 1698553 - RNA, 17 nt, Homo sapiens
aggcagaaaaaugucau

SEQ ID NO: 1698554 - RNA, 13 nt, Homo sapiens
aggcagccacuuc

SEQ ID NO: 1698555 - RNA, 19 nt, Homo sapiens
aggcagcccugccauguca

SEQ ID NO: 1698556 - RNA, 13 nt, Homo sapiens
aggcagccuccag

SEQ ID NO: 1698557 - RNA, 12 nt, Homo sapiens
aggcagcucaag

SEQ ID NO: 1698558 - RNA, 20 nt, Homo sapiens
aggcaggaggauugcuugag

SEQ ID NO: 1698559 - RNA, 18 nt, Homo sapiens
aggcagggcaaaugacau

SEQ ID NO: 1698560 - RNA, 18 nt, Homo sapiens
aggcagggugguguaccu

SEQ ID NO: 1698561 - RNA, 17 nt, Homo sapiens
aggcaucucuguacuuu

SEQ ID NO: 1698562 - RNA, 16 nt, Homo sapiens
aggcauuaacacaaag

SEQ ID NO: 1698563 - RNA, 21 nt, Homo sapiens
aggccagagggagugacagag

SEQ ID NO: 1698564 - RNA, 17 nt, Homo sapiens
aggccaguaugauuuau

SEQ ID NO: 1698565 - RNA, 18 nt, Homo sapiens
aggccauaggaguccuaa

SEQ ID NO: 1698566 - RNA, 21 nt, Homo sapiens
aggcccaacugugagcaagga

SEQ ID NO: 1698567 - RNA, 15 nt, Homo sapiens
aggcccgcucuacau

SEQ ID NO: 1698568 - RNA, 20 nt, Homo sapiens
aggcccuagcggcagaaagg

SEQ ID NO: 1698569 - RNA, 17 nt, Homo sapiens
aggcccugcccaaugag

SEQ ID NO: 1698570 - RNA, 19 nt, Homo sapiens
aggcccuuauuuucaagaa

SEQ ID NO: 1698571 - RNA, 12 nt, Homo sapiens
aggccugccugu

SEQ ID NO: 1698572 - RNA, 20 nt, Homo sapiens
aggccuggccagaugcacca

SEQ ID NO: 1698573 - RNA, 19 nt, Homo sapiens
aggcgagagaggagccaga

SEQ ID NO: 1698574 - RNA, 15 nt, Homo sapiens
aggcgauccaccugu

SEQ ID NO: 1698575 - RNA, 17 nt, Homo sapiens
aggcucaggccauggcu

SEQ ID NO: 1698576 - RNA, 21 nt, Homo sapiens
aggcuccugccaguguggaac

SEQ ID NO: 1698577 - RNA, 16 nt, Homo sapiens
aggcucugcuucucca

SEQ ID NO: 1698578 - RNA, 17 nt, Homo sapiens
aggcucugcuucuccaa

SEQ ID NO: 1698579 - RNA, 17 nt, Homo sapiens
aggcugcugaaaaccau

SEQ ID NO: 1698580 - RNA, 20 nt, Homo sapiens
aggcuggagugcaguggugu

SEQ ID NO: 1698581 - RNA, 12 nt, Homo sapiens
aggcugggccau

SEQ ID NO: 1698582 - RNA, 23 nt, Homo sapiens
aggcugggccauguccaaagagg

SEQ ID NO: 1698583 - RNA, 17 nt, Homo sapiens
aggcuguucugcacuga

SEQ ID NO: 1698584 - RNA, 18 nt, Homo sapiens
aggcuguucugcacugaa

SEQ ID NO: 1698585 - RNA, 14 nt, Homo sapiens
aggcuuuacagugu

SEQ ID NO: 1698586 - RNA, 14 nt, Homo sapiens
agggaaaaugagua

SEQ ID NO: 1698587 - RNA, 18 nt, Homo sapiens
agggaagcugucccucac

SEQ ID NO: 1698588 - RNA, 21 nt, Homo sapiens
agggaagcugucccucacugu

SEQ ID NO: 1698589 - RNA, 19 nt, Homo sapiens
agggaaguugaacgagcau

SEQ ID NO: 1698590 - RNA, 20 nt, Homo sapiens
agggacaggcuccucugggg

SEQ ID NO: 1698591 - RNA, 23 nt, Homo sapiens
agggacggggaagccgagcucca

SEQ ID NO: 1698592 - RNA, 19 nt, Homo sapiens
agggacuccaugcugccag

SEQ ID NO: 1698593 - RNA, 20 nt, Homo sapiens
agggacugacaaaagacuug

SEQ ID NO: 1698594 - RNA, 16 nt, Homo sapiens
agggacuuugcugauu

SEQ ID NO: 1698595 - RNA, 20 nt, Homo sapiens
agggaggcgggggcugcccu

SEQ ID NO: 1698596 - RNA, 15 nt, Homo sapiens
agggauaagccagcu

SEQ ID NO: 1698597 - RNA, 18 nt, Homo sapiens
agggaucaucaugcagcu

SEQ ID NO: 1698598 - RNA, 14 nt, Homo sapiens
agggcaucacuggg

SEQ ID NO: 1698599 - RNA, 17 nt, Homo sapiens
agggcauggccaggugg

SEQ ID NO: 1698600 - RNA, 20 nt, Homo sapiens
agggcauucuuucccaguga

SEQ ID NO: 1698601 - RNA, 23 nt, Homo sapiens
agggcauuugugggucugugugg

SEQ ID NO: 1698602 - RNA, 21 nt, Homo sapiens
agggcugaccugccucucaca

SEQ ID NO: 1698603 - RNA, 19 nt, Homo sapiens
agggcuggcagaaagggaa

SEQ ID NO: 1698604 - RNA, 20 nt, Homo sapiens
aggggacucagcccugaggu

SEQ ID NO: 1698605 - RNA, 21 nt, Homo sapiens
aggggauagagagagaccacu

SEQ ID NO: 1698606 - RNA, 17 nt, Homo sapiens
agggggaagaagcagag

SEQ ID NO: 1698607 - RNA, 21 nt, Homo sapiens
agggggacuagccccugugga

SEQ ID NO: 1698608 - RNA, 18 nt, Homo sapiens
agggggagaauggguguu

SEQ ID NO: 1698609 - RNA, 14 nt, Homo sapiens
agggguccagccuc

SEQ ID NO: 1698610 - RNA, 19 nt, Homo sapiens
agggugacguuagcauuac

SEQ ID NO: 1698611 - RNA, 14 nt, Homo sapiens
agggugauagucaa

SEQ ID NO: 1698612 - RNA, 22 nt, Homo sapiens
aggguugauccugcaucugggu

SEQ ID NO: 1698613 - RNA, 19 nt, Homo sapiens
aggguugggcuggugucac

SEQ ID NO: 1698614 - RNA, 20 nt, Homo sapiens
aggguuucaccauguugccc

SEQ ID NO: 1698615 - RNA, 22 nt, Homo sapiens
cauagaacuggguaaaugcaaa

SEQ ID NO: 1698616 - RNA, 15 nt, Homo sapiens
cauagcuacccaaaa

SEQ ID NO: 1698617 - RNA, 22 nt, Homo sapiens
cauagcugucuagaguagcuua

SEQ ID NO: 1698618 - RNA, 21 nt, Homo sapiens
cauaggaugguaccaagcauu

SEQ ID NO: 1698619 - RNA, 21 nt, Homo sapiens
cauaguaugguggcuggguug

SEQ ID NO: 1698620 - RNA, 22 nt, Homo sapiens
cauagucacauggccuaugcac

SEQ ID NO: 1698621 - RNA, 21 nt, Homo sapiens
cauauagagaugaaguuugua

SEQ ID NO: 1698622 - RNA, 15 nt, Homo sapiens
cauauagaggcaaga

SEQ ID NO: 1698623 - RNA, 21 nt, Homo sapiens
cauauauacccacauguacag

SEQ ID NO: 1698624 - RNA, 18 nt, Homo sapiens
cauauauauugaaaugca

SEQ ID NO: 1698625 - RNA, 16 nt, Homo sapiens
cauaucaucacauuga

SEQ ID NO: 1698626 - RNA, 22 nt, Homo sapiens
cauaugagcuuccuucugugaa

SEQ ID NO: 1698627 - RNA, 21 nt, Homo sapiens
cauaugaggaggaugucccug

SEQ ID NO: 1698628 - RNA, 18 nt, Homo sapiens
cauaugaucuguuuugua

SEQ ID NO: 1698629 - RNA, 19 nt, Homo sapiens
cauauggacucugcacaug

SEQ ID NO: 1698630 - RNA, 15 nt, Homo sapiens
cauauuaacaugcuu

SEQ ID NO: 1698631 - RNA, 17 nt, Homo sapiens
cauauuaacaugcuuau

SEQ ID NO: 1698632 - RNA, 17 nt, Homo sapiens
cauauucuguucacuug

SEQ ID NO: 1698633 - RNA, 16 nt, Homo sapiens
cauauugugccaauau

SEQ ID NO: 1698634 - RNA, 18 nt, Homo sapiens
cauauugugccaauaugu

SEQ ID NO: 1698635 - RNA, 23 nt, Homo sapiens
cauauuuggaagaaaaaaaucuu

SEQ ID NO: 1698636 - RNA, 12 nt, Homo sapiens
caucaaggucag

SEQ ID NO: 1698637 - RNA, 16 nt, Homo sapiens
caucacagcagccucc

SEQ ID NO: 1698638 - RNA, 16 nt, Homo sapiens
caucacugggucugcu

SEQ ID NO: 1698639 - RNA, 19 nt, Homo sapiens
caucaggaaggaaaugaca

SEQ ID NO: 1698640 - RNA, 15 nt, Homo sapiens
caucagggacaggau

SEQ ID NO: 1698641 - RNA, 18 nt, Homo sapiens
caucaucaaaaacuuugg

SEQ ID NO: 1698642 - RNA, 12 nt, Homo sapiens
caucaucuaugg

SEQ ID NO: 1698643 - RNA, 22 nt, Homo sapiens
caucauggaggucauacaugca

SEQ ID NO: 1698644 - RNA, 16 nt, Homo sapiens
caucaugggcuggaca

SEQ ID NO: 1698645 - RNA, 14 nt, Homo sapiens
caucaugucuggcu

SEQ ID NO: 1698646 - RNA, 13 nt, Homo sapiens
caucauuacccuu

SEQ ID NO: 1698647 - RNA, 19 nt, Homo sapiens
cauccaauuuaucaaggaa

SEQ ID NO: 1698648 - RNA, 14 nt, Homo sapiens
cauccaggcugccc

SEQ ID NO: 1698649 - RNA, 15 nt, Homo sapiens
cauccauaccagcuc

SEQ ID NO: 1698650 - RNA, 19 nt, Homo sapiens
caucccagcaccugccucc

SEQ ID NO: 1698651 - RNA, 23 nt, Homo sapiens
cauccuaagaaauaugugagauu

SEQ ID NO: 1698652 - RNA, 18 nt, Homo sapiens
cauccuaccccuuugcac

SEQ ID NO: 1698653 - RNA, 17 nt, Homo sapiens
cauccucaugcugcuca

SEQ ID NO: 1698654 - RNA, 21 nt, Homo sapiens
cauccuguauaagcacugaaa

SEQ ID NO: 1698655 - RNA, 15 nt, Homo sapiens
cauccuuuacguguu

SEQ ID NO: 1698656 - RNA, 19 nt, Homo sapiens
caucuauaaagaagaacuu

SEQ ID NO: 1698657 - RNA, 18 nt, Homo sapiens
caucuauucaagcacuua

SEQ ID NO: 1698658 - RNA, 22 nt, Homo sapiens
caucuauuuugaugcagcauuu

SEQ ID NO: 1698659 - RNA, 12 nt, Homo sapiens
caucucagccua

SEQ ID NO: 1698660 - RNA, 15 nt, Homo sapiens
caucucaggggccag

SEQ ID NO: 1698661 - RNA, 13 nt, Homo sapiens
caucuccagcuau

SEQ ID NO: 1698662 - RNA, 19 nt, Homo sapiens
caucuccuauaaucuguca

SEQ ID NO: 1698663 - RNA, 12 nt, Homo sapiens
caucucuacuaa

SEQ ID NO: 1698664 - RNA, 18 nt, Homo sapiens
caucucuccccaacccua

SEQ ID NO: 1698665 - RNA, 23 nt, Homo sapiens
caucuggcuuauuuuaaugugau

SEQ ID NO: 1698666 - RNA, 14 nt, Homo sapiens
caucuuacuugagc

SEQ ID NO: 1698667 - RNA, 19 nt, Homo sapiens
caucuuauagcacuuugaa

SEQ ID NO: 1698668 - RNA, 22 nt, Homo sapiens
caucuugcucugcugacagaca

SEQ ID NO: 1698669 - RNA, 14 nt, Homo sapiens
caucuugugaaaug

SEQ ID NO: 1698670 - RNA, 20 nt, Homo sapiens
caucuuuaucuguucuugcu

SEQ ID NO: 1698671 - RNA, 18 nt, Homo sapiens
caucuuugacacucugca

SEQ ID NO: 1698672 - RNA, 18 nt, Homo sapiens
caucuuuuacauucugca

SEQ ID NO: 1698673 - RNA, 14 nt, Homo sapiens
caugaaauaugcau

SEQ ID NO: 1698674 - RNA, 18 nt, Homo sapiens
caugaagcccaagugaaa

SEQ ID NO: 1698675 - RNA, 21 nt, Homo sapiens
caugaagccuguggaugauca

SEQ ID NO: 1698676 - RNA, 19 nt, Homo sapiens
caugaauauaaaugggaaa

SEQ ID NO: 1698677 - RNA, 21 nt, Homo sapiens
caugaauauaaaugggaaauc

SEQ ID NO: 1698678 - RNA, 14 nt, Homo sapiens
caugacacugaccu

SEQ ID NO: 1698679 - RNA, 18 nt, Homo sapiens
caugacacugaccuugga

SEQ ID NO: 1698680 - RNA, 18 nt, Homo sapiens
caugaccugcgcucucag

SEQ ID NO: 1698681 - RNA, 22 nt, Homo sapiens
caugacuuguagcauauucuuu

SEQ ID NO: 1698682 - RNA, 18 nt, Homo sapiens
caugacuuuauauggaug

SEQ ID NO: 1698683 - RNA, 23 nt, Homo sapiens
caugacuuuauauggaugauuca

SEQ ID NO: 1698684 - RNA, 19 nt, Homo sapiens
caugagauucauucaguua

SEQ ID NO: 1698685 - RNA, 23 nt, Homo sapiens
caugauggcaccacugcacucca

SEQ ID NO: 1698686 - RNA, 17 nt, Homo sapiens
caugauguuucuuccac

SEQ ID NO: 1698687 - RNA, 17 nt, Homo sapiens
caugauuuccuugaaug

SEQ ID NO: 1698688 - RNA, 14 nt, Homo sapiens
caugcacacacaca

SEQ ID NO: 1698689 - RNA, 21 nt, Homo sapiens
caugcacacacacacaucuca

SEQ ID NO: 1698690 - RNA, 22 nt, Homo sapiens
caugcacacacacacaucucau

SEQ ID NO: 1698691 - RNA, 23 nt, Homo sapiens
caugcaggcccuuugaagccuca

SEQ ID NO: 1698692 - RNA, 19 nt, Homo sapiens
caugcauaaauaugcagug

SEQ ID NO: 1698693 - RNA, 13 nt, Homo sapiens
caugccucugaua

SEQ ID NO: 1698694 - RNA, 20 nt, Homo sapiens
caugccucugauaugggacu

SEQ ID NO: 1698695 - RNA, 16 nt, Homo sapiens
caugccuggucuuucc

SEQ ID NO: 1698696 - RNA, 14 nt, Homo sapiens
caugccuugugcug

SEQ ID NO: 1698697 - RNA, 15 nt, Homo sapiens
caugcuacaguuauu

SEQ ID NO: 1698698 - RNA, 22 nt, Homo sapiens
cauggaacucagcugucugugg

SEQ ID NO: 1698699 - RNA, 13 nt, Homo sapiens
cauggacacucca

SEQ ID NO: 1698700 - RNA, 14 nt, Homo sapiens
cauggacuacacca

SEQ ID NO: 1698701 - RNA, 15 nt, Homo sapiens
cauggcauugaacug

SEQ ID NO: 1698702 - RNA, 15 nt, Homo sapiens
cauggccuaugcaca

SEQ ID NO: 1698703 - RNA, 15 nt, Homo sapiens
caugggagcagucca

SEQ ID NO: 1698704 - RNA, 13 nt, Homo sapiens
caugggcucugac

SEQ ID NO: 1698705 - RNA, 23 nt, Homo sapiens
cauggguuauguguaugugccau

SEQ ID NO: 1698706 - RNA, 18 nt, Homo sapiens
cauggugaaaauguacug

SEQ ID NO: 1698707 - RNA, 22 nt, Homo sapiens
cauggugcaguuuuggugugua

SEQ ID NO: 1698708 - RNA, 20 nt, Homo sapiens
cauguacagacauacauuua

SEQ ID NO: 1698709 - RNA, 16 nt, Homo sapiens
cauguacauacccugg

SEQ ID NO: 1698710 - RNA, 17 nt, Homo sapiens
cauguagagaaaagcac

SEQ ID NO: 1698711 - RNA, 14 nt, Homo sapiens
cauguaugugcgaa

SEQ ID NO: 1698712 - RNA, 18 nt, Homo sapiens
caugugacacauaugcac

SEQ ID NO: 1698713 - RNA, 20 nt, Homo sapiens
caugugacacauaugcaccu

SEQ ID NO: 1698714 - RNA, 22 nt, Homo sapiens
caugugacacauaugcaccuug

SEQ ID NO: 1698715 - RNA, 17 nt, Homo sapiens
caugugccagggcaaug

SEQ ID NO: 1698716 - RNA, 22 nt, Homo sapiens
caugugccagguuuuuggucug

SEQ ID NO: 1698717 - RNA, 14 nt, Homo sapiens
caugugccucuuug

SEQ ID NO: 1698718 - RNA, 22 nt, Homo sapiens
cauguggcuaaaugccuaauaa

SEQ ID NO: 1698719 - RNA, 16 nt, Homo sapiens
caugugucacuugugc

SEQ ID NO: 1698720 - RNA, 21 nt, Homo sapiens
cauguuaccaucuuacuugag

SEQ ID NO: 1698721 - RNA, 17 nt, Homo sapiens
cauguuguaaugcugca

SEQ ID NO: 1698722 - RNA, 21 nt, Homo sapiens
cauguuuuccgugaaaacgga

SEQ ID NO: 1698723 - RNA, 16 nt, Homo sapiens
cauguuuuguauacaa

SEQ ID NO: 1698724 - RNA, 23 nt, Homo sapiens
ccucagacgagacccaagggcag

SEQ ID NO: 1698725 - RNA, 19 nt, Homo sapiens
ccucaggggaaaacuguua

SEQ ID NO: 1698726 - RNA, 13 nt, Homo sapiens
ccucaguauauuu

SEQ ID NO: 1698727 - RNA, 20 nt, Homo sapiens
ccucagugagauauuuggua

SEQ ID NO: 1698728 - RNA, 19 nt, Homo sapiens
ccucaugcugcucaauucc

SEQ ID NO: 1698729 - RNA, 20 nt, Homo sapiens
ccucauugcagcuagaggca

SEQ ID NO: 1698730 - RNA, 19 nt, Homo sapiens
ccuccacugccucuggaau

SEQ ID NO: 1698731 - RNA, 13 nt, Homo sapiens
ccuccagaacuca

SEQ ID NO: 1698732 - RNA, 22 nt, Homo sapiens
ccuccagcccgggagccuagga

SEQ ID NO: 1698733 - RNA, 11 nt, Homo sapiens
ccuccaucuca

SEQ ID NO: 1698734 - RNA, 11 nt, Homo sapiens
ccuccaugacc

SEQ ID NO: 1698735 - RNA, 20 nt, Homo sapiens
ccucccaaagugcugagauu

SEQ ID NO: 1698736 - RNA, 23 nt, Homo sapiens
ccucccagugaccccugaccuca

SEQ ID NO: 1698737 - RNA, 13 nt, Homo sapiens
ccuccccaguuca

SEQ ID NO: 1698738 - RNA, 22 nt, Homo sapiens
ccucccucucucuucugcucca

SEQ ID NO: 1698739 - RNA, 13 nt, Homo sapiens
ccuccucaccucu

SEQ ID NO: 1698740 - RNA, 13 nt, Homo sapiens
ccuccugugggga

SEQ ID NO: 1698741 - RNA, 15 nt, Homo sapiens
ccuccuuggugccug

SEQ ID NO: 1698742 - RNA, 22 nt, Homo sapiens
ccucgaggacugauacugcagu

SEQ ID NO: 1698743 - RNA, 22 nt, Homo sapiens
ccucguuggaagaggaacagca

SEQ ID NO: 1698744 - RNA, 16 nt, Homo sapiens
ccucucccuaggagaa

SEQ ID NO: 1698745 - RNA, 19 nt, Homo sapiens
ccucucucccggagguugg

SEQ ID NO: 1698746 - RNA, 17 nt, Homo sapiens
ccucugggaaaaucuau

SEQ ID NO: 1698747 - RNA, 16 nt, Homo sapiens
ccucugggaaggugac

SEQ ID NO: 1698748 - RNA, 18 nt, Homo sapiens
ccucugucucauccuccu

SEQ ID NO: 1698749 - RNA, 14 nt, Homo sapiens
ccucuuaagccugc

SEQ ID NO: 1698750 - RNA, 16 nt, Homo sapiens
ccugaaagcacuguag

SEQ ID NO: 1698751 - RNA, 13 nt, Homo sapiens
ccugaagucacac

SEQ ID NO: 1698752 - RNA, 18 nt, Homo sapiens
ccugacagaaggacucag

SEQ ID NO: 1698753 - RNA, 16 nt, Homo sapiens
ccugaccucacuguga

SEQ ID NO: 1698754 - RNA, 15 nt, Homo sapiens
ccugaccugagccag

SEQ ID NO: 1698755 - RNA, 13 nt, Homo sapiens
ccugacucaggcc

SEQ ID NO: 1698756 - RNA, 20 nt, Homo sapiens
ccugagcccuacucccugca

SEQ ID NO: 1698757 - RNA, 14 nt, Homo sapiens
ccugagcuuuaugg

SEQ ID NO: 1698758 - RNA, 15 nt, Homo sapiens
ccugaggguccccac

SEQ ID NO: 1698759 - RNA, 16 nt, Homo sapiens
ccugaggucagggagu

SEQ ID NO: 1698760 - RNA, 21 nt, Homo sapiens
ccugagucugcaugugcacgg

SEQ ID NO: 1698761 - RNA, 14 nt, Homo sapiens
ccugaucugugaua

SEQ ID NO: 1698762 - RNA, 19 nt, Homo sapiens
ccugcacuguccugaccau

SEQ ID NO: 1698763 - RNA, 17 nt, Homo sapiens
ccugcagaauccagcua

SEQ ID NO: 1698764 - RNA, 13 nt, Homo sapiens
ccugcagaugcca

SEQ ID NO: 1698765 - RNA, 18 nt, Homo sapiens
ccugcaggcugagccacu

SEQ ID NO: 1698766 - RNA, 15 nt, Homo sapiens
ccugcaucuggguuu

SEQ ID NO: 1698767 - RNA, 15 nt, Homo sapiens
ccugcaucugugaaa

SEQ ID NO: 1698768 - RNA, 18 nt, Homo sapiens
ccugcauuguuagcacua

SEQ ID NO: 1698769 - RNA, 14 nt, Homo sapiens
ccugcccaaugaga

SEQ ID NO: 1698770 - RNA, 22 nt, Homo sapiens
ccugccccaaacaaauaugcaa

SEQ ID NO: 1698771 - RNA, 20 nt, Homo sapiens
ccugccccagacagacuuca

SEQ ID NO: 1698772 - RNA, 17 nt, Homo sapiens
ccugcccccuuggguga

SEQ ID NO: 1698773 - RNA, 17 nt, Homo sapiens
ccugccccucucccgcc

SEQ ID NO: 1698774 - RNA, 16 nt, Homo sapiens
ccugccccugccccau

SEQ ID NO: 1698775 - RNA, 21 nt, Homo sapiens
ccugccugcaucugugaaaag

SEQ ID NO: 1698776 - RNA, 14 nt, Homo sapiens
ccugcgauuuugcc

SEQ ID NO: 1698777 - RNA, 15 nt, Homo sapiens
ccugcuccagaauuu

SEQ ID NO: 1698778 - RNA, 15 nt, Homo sapiens
ccugcuccugcagca

SEQ ID NO: 1698779 - RNA, 18 nt, Homo sapiens
ccugcucuccucuugcca

SEQ ID NO: 1698780 - RNA, 23 nt, Homo sapiens
ccugcugcaggggcucuggagag

SEQ ID NO: 1698781 - RNA, 23 nt, Homo sapiens
ccugcuggcacuauccagaugga

SEQ ID NO: 1698782 - RNA, 13 nt, Homo sapiens
ccuggaaauggac

SEQ ID NO: 1698783 - RNA, 16 nt, Homo sapiens
ccuggaacauccuuug

SEQ ID NO: 1698784 - RNA, 16 nt, Homo sapiens
ccuggacacgcuggug

SEQ ID NO: 1698785 - RNA, 16 nt, Homo sapiens
ccuggacacucagacc

SEQ ID NO: 1698786 - RNA, 18 nt, Homo sapiens
ccuggagaugcugccugg

SEQ ID NO: 1698787 - RNA, 17 nt, Homo sapiens
ccuggagccuccacugc

SEQ ID NO: 1698788 - RNA, 17 nt, Homo sapiens
ccuggcagggcccagug

SEQ ID NO: 1698789 - RNA, 17 nt, Homo sapiens
ccuggccaggagcucuu

SEQ ID NO: 1698790 - RNA, 15 nt, Homo sapiens
ccuggcugagggcag

SEQ ID NO: 1698791 - RNA, 12 nt, Homo sapiens
ccugggagacag

SEQ ID NO: 1698792 - RNA, 13 nt, Homo sapiens
ccugggagacaga

SEQ ID NO: 1698793 - RNA, 14 nt, Homo sapiens
ccugggagacagac

SEQ ID NO: 1698794 - RNA, 12 nt, Homo sapiens
ccuggggaccau

SEQ ID NO: 1698795 - RNA, 16 nt, Homo sapiens
ccuggggcacagucca

SEQ ID NO: 1698796 - RNA, 12 nt, Homo sapiens
ccuguaccucau

SEQ ID NO: 1698797 - RNA, 20 nt, Homo sapiens
ccuguaccucaucccaugag

SEQ ID NO: 1698798 - RNA, 14 nt, Homo sapiens
ccugucccaugcag

SEQ ID NO: 1698799 - RNA, 13 nt, Homo sapiens
ccugucccaugga

SEQ ID NO: 1698800 - RNA, 15 nt, Homo sapiens
ccugugauccaccca

SEQ ID NO: 1698801 - RNA, 19 nt, Homo sapiens
ccuguuccuuuaaccccaa

SEQ ID NO: 1698802 - RNA, 12 nt, Homo sapiens
ccuguugcccuu

SEQ ID NO: 1698803 - RNA, 15 nt, Homo sapiens
ccuuaacacauucaa

SEQ ID NO: 1698804 - RNA, 16 nt, Homo sapiens
ccuuaacacauucaau

SEQ ID NO: 1698805 - RNA, 21 nt, Homo sapiens
ccuuagaaauguaaacugcca

SEQ ID NO: 1698806 - RNA, 12 nt, Homo sapiens
ccuucacuuuac

SEQ ID NO: 1698807 - RNA, 21 nt, Homo sapiens
ccuucagcaugccugaacuac

SEQ ID NO: 1698808 - RNA, 18 nt, Homo sapiens
ccuuccagaucacugcca

SEQ ID NO: 1698809 - RNA, 21 nt, Homo sapiens
ccuucccaaucagcacugaaa

SEQ ID NO: 1698810 - RNA, 20 nt, Homo sapiens
ccuuccugaggaugggcaac

SEQ ID NO: 1698811 - RNA, 15 nt, Homo sapiens
ccuucggcagcuacu

SEQ ID NO: 1698812 - RNA, 17 nt, Homo sapiens
ccuucggcagcuacuca

SEQ ID NO: 1698813 - RNA, 18 nt, Homo sapiens
ccuucuccacacccacuu

SEQ ID NO: 1698814 - RNA, 20 nt, Homo sapiens
ccuucucugcuccaccacau

SEQ ID NO: 1698815 - RNA, 23 nt, Homo sapiens
ccuucuuuuaugagcagaaggaa

SEQ ID NO: 1698816 - RNA, 12 nt, Homo sapiens
ccuugaccuucc

SEQ ID NO: 1698817 - RNA, 17 nt, Homo sapiens
ccuugagcaaauuaccc

SEQ ID NO: 1698818 - RNA, 23 nt, Homo sapiens
ccuugcaagguuaagcaaggugg

SEQ ID NO: 1698819 - RNA, 17 nt, Homo sapiens
ccuugcuaaaagauuau

SEQ ID NO: 1698820 - RNA, 23 nt, Homo sapiens
ccuugcuggacggggacugggga

SEQ ID NO: 1698821 - RNA, 17 nt, Homo sapiens
ccuuggcuucugugaug

SEQ ID NO: 1698822 - RNA, 19 nt, Homo sapiens
ccuuggggaggacaaaacu

SEQ ID NO: 1698823 - RNA, 13 nt, Homo sapiens
ccuuguccaccca

SEQ ID NO: 1698824 - RNA, 20 nt, Homo sapiens
ccuuuaaagaugaacucuga

SEQ ID NO: 1698825 - RNA, 18 nt, Homo sapiens
ccuuuauagagugucuca

SEQ ID NO: 1698826 - RNA, 19 nt, Homo sapiens
ccuuuauguggaaaacaga

SEQ ID NO: 1698827 - RNA, 18 nt, Homo sapiens
ccuuuccuuuucuuuaaa

SEQ ID NO: 1698828 - RNA, 21 nt, Homo sapiens
ccuuucucagccacaaaauaa

SEQ ID NO: 1698829 - RNA, 21 nt, Homo sapiens
ccuuucucuccagccugacuu

SEQ ID NO: 1698830 - RNA, 15 nt, Homo sapiens
ccuuugagacaguuu

SEQ ID NO: 1698831 - RNA, 12 nt, Homo sapiens
ccuuugccagug

SEQ ID NO: 1698832 - RNA, 16 nt, Homo sapiens
ccuuugcuucaaauaa

SEQ ID NO: 1698833 - RNA, 16 nt, Homo sapiens
ccuuuuaccugcccaa

SEQ ID NO: 1698834 - RNA, 17 nt, Homo sapiens
cucuuuucaaaacauuu

SEQ ID NO: 1698835 - RNA, 14 nt, Homo sapiens
cugaaacacacuga

SEQ ID NO: 1698836 - RNA, 15 nt, Homo sapiens
cugaaaguuacccac

SEQ ID NO: 1698837 - RNA, 21 nt, Homo sapiens
cugaaaucuccuuuagccauc

SEQ ID NO: 1698838 - RNA, 20 nt, Homo sapiens
cugaaauugaagaagaauga

SEQ ID NO: 1698839 - RNA, 20 nt, Homo sapiens
cugaacuacauaacuuccua

SEQ ID NO: 1698840 - RNA, 15 nt, Homo sapiens
cugaacuacuaaagu

SEQ ID NO: 1698841 - RNA, 21 nt, Homo sapiens
cugaacuuuaucuguucuguu

SEQ ID NO: 1698842 - RNA, 11 nt, Homo sapiens
cugaagauauu

SEQ ID NO: 1698843 - RNA, 22 nt, Homo sapiens
cugaagcaggagauuugcuuga

SEQ ID NO: 1698844 - RNA, 20 nt, Homo sapiens
cugaaggugauucaccaaaa

SEQ ID NO: 1698845 - RNA, 12 nt, Homo sapiens
cugaagugcuua

SEQ ID NO: 1698846 - RNA, 19 nt, Homo sapiens
cugaauuugauucuccagc

SEQ ID NO: 1698847 - RNA, 12 nt, Homo sapiens
cugacaaccuca

SEQ ID NO: 1698848 - RNA, 22 nt, Homo sapiens
cugacagaaagcagauaccuca

SEQ ID NO: 1698849 - RNA, 20 nt, Homo sapiens
cugaccaauugugcugccau

SEQ ID NO: 1698850 - RNA, 18 nt, Homo sapiens
cugaccaucgcacaccgg

SEQ ID NO: 1698851 - RNA, 16 nt, Homo sapiens
cugacuaauuaggcaa

SEQ ID NO: 1698852 - RNA, 19 nt, Homo sapiens
cugacuuguuugucuucca

SEQ ID NO: 1698853 - RNA, 18 nt, Homo sapiens
cugagaaauguuaaaggu

SEQ ID NO: 1698854 - RNA, 17 nt, Homo sapiens
cugagaaggguugaucc

SEQ ID NO: 1698855 - RNA, 12 nt, Homo sapiens
cugagacacaaa

SEQ ID NO: 1698856 - RNA, 15 nt, Homo sapiens
cugagacucacagga

SEQ ID NO: 1698857 - RNA, 16 nt, Homo sapiens
cugagagaccugaguc

SEQ ID NO: 1698858 - RNA, 22 nt, Homo sapiens
cugagaggaagccugagguuga

SEQ ID NO: 1698859 - RNA, 18 nt, Homo sapiens
cugagauuuccuccuggc

SEQ ID NO: 1698860 - RNA, 16 nt, Homo sapiens
cugagccacagcagca

SEQ ID NO: 1698861 - RNA, 22 nt, Homo sapiens
cugagcuagaauuauucucuua

SEQ ID NO: 1698862 - RNA, 20 nt, Homo sapiens
cugagcuuuguccugaagga

SEQ ID NO: 1698863 - RNA, 22 nt, Homo sapiens
cugaggcaggaggauugcuuga

SEQ ID NO: 1698864 - RNA, 17 nt, Homo sapiens
cugagggaaagugcaua

SEQ ID NO: 1698865 - RNA, 18 nt, Homo sapiens
cugagucugcaugugcac

SEQ ID NO: 1698866 - RNA, 17 nt, Homo sapiens
cugaguguuauuugcac

SEQ ID NO: 1698867 - RNA, 19 nt, Homo sapiens
cugaguguuauuugcacac

SEQ ID NO: 1698868 - RNA, 16 nt, Homo sapiens
cugauaggaaugugaa

SEQ ID NO: 1698869 - RNA, 21 nt, Homo sapiens
cugaucauccacugugccaug

SEQ ID NO: 1698870 - RNA, 23 nt, Homo sapiens
cugaucccccauagguggcugag

SEQ ID NO: 1698871 - RNA, 20 nt, Homo sapiens
cugaucugcaguuuuugccu

SEQ ID NO: 1698872 - RNA, 12 nt, Homo sapiens
cugaucugugau

SEQ ID NO: 1698873 - RNA, 13 nt, Homo sapiens
cugaucugugaua

SEQ ID NO: 1698874 - RNA, 19 nt, Homo sapiens
cugaucuuauucuguggug

SEQ ID NO: 1698875 - RNA, 14 nt, Homo sapiens
cugaugacaacuuc

SEQ ID NO: 1698876 - RNA, 17 nt, Homo sapiens
cugaugccaauacuagu

SEQ ID NO: 1698877 - RNA, 21 nt, Homo sapiens
cugauggaaguaaagccucaa

SEQ ID NO: 1698878 - RNA, 17 nt, Homo sapiens
cugaugguggcucuggu

SEQ ID NO: 1698879 - RNA, 19 nt, Homo sapiens
cugaugucuccacuuucac

SEQ ID NO: 1698880 - RNA, 13 nt, Homo sapiens
cugauuugcaaua

SEQ ID NO: 1698881 - RNA, 16 nt, Homo sapiens
cugauuugcauauuca

SEQ ID NO: 1698882 - RNA, 20 nt, Homo sapiens
cugcaaaauagacauauuaa

SEQ ID NO: 1698883 - RNA, 17 nt, Homo sapiens
cugcaagccugucugag

SEQ ID NO: 1698884 - RNA, 19 nt, Homo sapiens
cugcaaucugagccagugc

SEQ ID NO: 1698885 - RNA, 15 nt, Homo sapiens
cugcacagagucagg

SEQ ID NO: 1698886 - RNA, 20 nt, Homo sapiens
cugcaccagagcaaccucuc

SEQ ID NO: 1698887 - RNA, 19 nt, Homo sapiens
cugcaccccucugcccuca

SEQ ID NO: 1698888 - RNA, 23 nt, Homo sapiens
cugcacuaauuugauguuuacag

SEQ ID NO: 1698889 - RNA, 15 nt, Homo sapiens
cugcacuauuugccg

SEQ ID NO: 1698890 - RNA, 20 nt, Homo sapiens
cugcacuccagccugggcaa

SEQ ID NO: 1698891 - RNA, 18 nt, Homo sapiens
cugcagacugcuaguguu

SEQ ID NO: 1698892 - RNA, 18 nt, Homo sapiens
cugcagagcaccuuugca

SEQ ID NO: 1698893 - RNA, 20 nt, Homo sapiens
cugcagaguaggcagcugcc

SEQ ID NO: 1698894 - RNA, 21 nt, Homo sapiens
cugcagccagcucacguccag

SEQ ID NO: 1698895 - RNA, 18 nt, Homo sapiens
cugcagggacuccaugcu

SEQ ID NO: 1698896 - RNA, 22 nt, Homo sapiens
cugcagggggugugucugcuca

SEQ ID NO: 1698897 - RNA, 22 nt, Homo sapiens
cugcaucuuauagcacuuugaa

SEQ ID NO: 1698898 - RNA, 15 nt, Homo sapiens
cugcaugugcuguca

SEQ ID NO: 1698899 - RNA, 23 nt, Homo sapiens
cugcauuagagcccauuucaauu

SEQ ID NO: 1698900 - RNA, 17 nt, Homo sapiens
cugccacacucuccauc

SEQ ID NO: 1698901 - RNA, 23 nt, Homo sapiens
cugccaccacugggcaaacagaa

SEQ ID NO: 1698902 - RNA, 12 nt, Homo sapiens
cugccacuuugc

SEQ ID NO: 1698903 - RNA, 20 nt, Homo sapiens
cugccauuauuuucugucag

SEQ ID NO: 1698904 - RNA, 16 nt, Homo sapiens
cugcccaaucuccauc

SEQ ID NO: 1698905 - RNA, 21 nt, Homo sapiens
cugccccaaacaaauaugcaa

SEQ ID NO: 1698906 - RNA, 15 nt, Homo sapiens
cugccccccaugagg

SEQ ID NO: 1698907 - RNA, 15 nt, Homo sapiens
cugcccgcacacccu

SEQ ID NO: 1698908 - RNA, 22 nt, Homo sapiens
cugcccgggaaggucaccagca

SEQ ID NO: 1698909 - RNA, 17 nt, Homo sapiens
cugcccuccuuguccac

SEQ ID NO: 1698910 - RNA, 17 nt, Homo sapiens
cugccgaaccaaaagaa

SEQ ID NO: 1698911 - RNA, 19 nt, Homo sapiens
cugccgcccccuccugaac

SEQ ID NO: 1698912 - RNA, 23 nt, Homo sapiens
cugccggggguucaggguuggua

SEQ ID NO: 1698913 - RNA, 15 nt, Homo sapiens
cugccuccucuucaa

SEQ ID NO: 1698914 - RNA, 16 nt, Homo sapiens
cugccugaagucacac

SEQ ID NO: 1698915 - RNA, 22 nt, Homo sapiens
cugccuguauacuuuaguauga

SEQ ID NO: 1698916 - RNA, 22 nt, Homo sapiens
cugccuuaggguagugcuaaga

SEQ ID NO: 1698917 - RNA, 16 nt, Homo sapiens
cugccuuggacugugu

SEQ ID NO: 1698918 - RNA, 13 nt, Homo sapiens
cugcuagaacuuu

SEQ ID NO: 1698919 - RNA, 17 nt, Homo sapiens
cugcuagugaagaaugc

SEQ ID NO: 1698920 - RNA, 21 nt, Homo sapiens
cugcuagugaagaaugcaugu

SEQ ID NO: 1698921 - RNA, 16 nt, Homo sapiens
cugcuccacgcgcuuc

SEQ ID NO: 1698922 - RNA, 14 nt, Homo sapiens
cugcugacaguguu

SEQ ID NO: 1698923 - RNA, 11 nt, Homo sapiens
cugcugaccaa

SEQ ID NO: 1698924 - RNA, 22 nt, Homo sapiens
cugcugaccaauugugcugcca

SEQ ID NO: 1698925 - RNA, 23 nt, Homo sapiens
cugcugaccaauugugcugccau

SEQ ID NO: 1698926 - RNA, 14 nt, Homo sapiens
cugcuuaguaucuc

SEQ ID NO: 1698927 - RNA, 13 nt, Homo sapiens
cugcuuccugucu

SEQ ID NO: 1698928 - RNA, 19 nt, Homo sapiens
cugcuuuaggaauucugca

SEQ ID NO: 1698929 - RNA, 17 nt, Homo sapiens
cuggaaaaaaugagccg

SEQ ID NO: 1698930 - RNA, 19 nt, Homo sapiens
cuggaaaaauuccagaaga

SEQ ID NO: 1698931 - RNA, 13 nt, Homo sapiens
cuggaaauggacu

SEQ ID NO: 1698932 - RNA, 16 nt, Homo sapiens
cuggaaguucauaccu

SEQ ID NO: 1698933 - RNA, 16 nt, Homo sapiens
cuggacaguaucccac

SEQ ID NO: 1698934 - RNA, 16 nt, Homo sapiens
cuggacauucgaggaa

SEQ ID NO: 1698935 - RNA, 20 nt, Homo sapiens
cuggaccugccuccugccug

SEQ ID NO: 1698936 - RNA, 16 nt, Homo sapiens
cuggacucuucaaaaa

SEQ ID NO: 1698937 - RNA, 21 nt, Homo sapiens
cuggagaccagggagccuuug

SEQ ID NO: 1698938 - RNA, 14 nt, Homo sapiens
cuggagaugcugcc

SEQ ID NO: 1698939 - RNA, 17 nt, Homo sapiens
cuggagaugcugccugg

SEQ ID NO: 1698940 - RNA, 23 nt, Homo sapiens
cuggaggcggcaaagggugaaau

SEQ ID NO: 1698941 - RNA, 20 nt, Homo sapiens
cuggagugcaguggcgugau

SEQ ID NO: 1698942 - RNA, 21 nt, Homo sapiens
cuggaguuucauguacaagau

SEQ ID NO: 1698943 - RNA, 14 nt, Homo sapiens
gaacgaggauuuua

SEQ ID NO: 1698944 - RNA, 13 nt, Homo sapiens
gaacuacuaaagu

SEQ ID NO: 1698945 - RNA, 12 nt, Homo sapiens
gaacucaguccu

SEQ ID NO: 1698946 - RNA, 13 nt, Homo sapiens
gaacucuguaaaa

SEQ ID NO: 1698947 - RNA, 15 nt, Homo sapiens
gaacugcauugacuu

SEQ ID NO: 1698948 - RNA, 16 nt, Homo sapiens
gaacuggguacuugug

SEQ ID NO: 1698949 - RNA, 15 nt, Homo sapiens
gaacuugagcgugaa

SEQ ID NO: 1698950 - RNA, 14 nt, Homo sapiens
gaacuuuaagcaac

SEQ ID NO: 1698951 - RNA, 13 nt, Homo sapiens
gaagaaacacuuu

SEQ ID NO: 1698952 - RNA, 16 nt, Homo sapiens
gaagaagcuaugucaa

SEQ ID NO: 1698953 - RNA, 16 nt, Homo sapiens
gaagagagauauaucu

SEQ ID NO: 1698954 - RNA, 21 nt, Homo sapiens
gaagauagaugcacuuaugca

SEQ ID NO: 1698955 - RNA, 21 nt, Homo sapiens
gaagauugcgguuuacagcua

SEQ ID NO: 1698956 - RNA, 17 nt, Homo sapiens
gaagcaaauaaauauca

SEQ ID NO: 1698957 - RNA, 19 nt, Homo sapiens
gaagcaacaggaaucaaga

SEQ ID NO: 1698958 - RNA, 12 nt, Homo sapiens
gaagcaaccucc

SEQ ID NO: 1698959 - RNA, 12 nt, Homo sapiens
gaagcacagcuu

SEQ ID NO: 1698960 - RNA, 18 nt, Homo sapiens
gaagcauuccuucuuuga

SEQ ID NO: 1698961 - RNA, 15 nt, Homo sapiens
gaagcauucucccca

SEQ ID NO: 1698962 - RNA, 21 nt, Homo sapiens
gaagccggcagggaagggccu

SEQ ID NO: 1698963 - RNA, 21 nt, Homo sapiens
gaagcggauuuccagggauau

SEQ ID NO: 1698964 - RNA, 18 nt, Homo sapiens
gaagcuacuucuccacug

SEQ ID NO: 1698965 - RNA, 13 nt, Homo sapiens
gaagcuccacugu

SEQ ID NO: 1698966 - RNA, 16 nt, Homo sapiens
gaagcuccacugucac

SEQ ID NO: 1698967 - RNA, 16 nt, Homo sapiens
gaagcuggccugagag

SEQ ID NO: 1698968 - RNA, 14 nt, Homo sapiens
gaaggaaaaugaua

SEQ ID NO: 1698969 - RNA, 13 nt, Homo sapiens
gaaggaaaugaca

SEQ ID NO: 1698970 - RNA, 13 nt, Homo sapiens
gaaggaagugaag

SEQ ID NO: 1698971 - RNA, 13 nt, Homo sapiens
gaaggaugaauga

SEQ ID NO: 1698972 - RNA, 16 nt, Homo sapiens
gaagggcauuaaccug

SEQ ID NO: 1698973 - RNA, 13 nt, Homo sapiens
gaagguugcucua

SEQ ID NO: 1698974 - RNA, 19 nt, Homo sapiens
gaaguagauuaagagccau

SEQ ID NO: 1698975 - RNA, 21 nt, Homo sapiens
gaaguagauuaagagccauau

SEQ ID NO: 1698976 - RNA, 19 nt, Homo sapiens
gaagucacacaguauuacu

SEQ ID NO: 1698977 - RNA, 13 nt, Homo sapiens
gaagucacaucac

SEQ ID NO: 1698978 - RNA, 13 nt, Homo sapiens
gaagucuccucaa

SEQ ID NO: 1698979 - RNA, 19 nt, Homo sapiens
gaagugcuggcaaccacua

SEQ ID NO: 1698980 - RNA, 16 nt, Homo sapiens
gaagugguccaucucc

SEQ ID NO: 1698981 - RNA, 21 nt, Homo sapiens
gaaguuuaaaacaguauuuau

SEQ ID NO: 1698982 - RNA, 19 nt, Homo sapiens
gaaguuuauucucauuugg

SEQ ID NO: 1698983 - RNA, 13 nt, Homo sapiens
gaaguuuggcaau

SEQ ID NO: 1698984 - RNA, 14 nt, Homo sapiens
gaauaaauucccaa

SEQ ID NO: 1698985 - RNA, 15 nt, Homo sapiens
gaauaaauucccaac

SEQ ID NO: 1698986 - RNA, 17 nt, Homo sapiens
gaauaaauugcuccuug

SEQ ID NO: 1698987 - RNA, 19 nt, Homo sapiens
gaauacugaguauguggaa

SEQ ID NO: 1698988 - RNA, 23 nt, Homo sapiens
gaauagaaauaaaggaugugauu

SEQ ID NO: 1698989 - RNA, 15 nt, Homo sapiens
gaauaggcuguguau

SEQ ID NO: 1698990 - RNA, 14 nt, Homo sapiens
gaauauuacuccua

SEQ ID NO: 1698991 - RNA, 16 nt, Homo sapiens
gaaucaaaaauugaag

SEQ ID NO: 1698992 - RNA, 15 nt, Homo sapiens
gaauccaagccucca

SEQ ID NO: 1698993 - RNA, 16 nt, Homo sapiens
gaauccuggcagccca

SEQ ID NO: 1698994 - RNA, 14 nt, Homo sapiens
gaaucuauuucacu

SEQ ID NO: 1698995 - RNA, 13 nt, Homo sapiens
gaaucucucccuc

SEQ ID NO: 1698996 - RNA, 14 nt, Homo sapiens
gaaucuggagacca

SEQ ID NO: 1698997 - RNA, 13 nt, Homo sapiens
gaaugacauugaa

SEQ ID NO: 1698998 - RNA, 19 nt, Homo sapiens
gaaugagcacccauuccaa

SEQ ID NO: 1698999 - RNA, 20 nt, Homo sapiens
gaaugaucagcaucugugau

SEQ ID NO: 1699000 - RNA, 19 nt, Homo sapiens
gaaugcaaaguagcaauuu

SEQ ID NO: 1699001 - RNA, 15 nt, Homo sapiens
gaaugcugcacuaau

SEQ ID NO: 1699002 - RNA, 12 nt, Homo sapiens
gaaugcugccag

SEQ ID NO: 1699003 - RNA, 19 nt, Homo sapiens
gaaugggaagggucauaga

SEQ ID NO: 1699004 - RNA, 11 nt, Homo sapiens
gaaugugauuu

SEQ ID NO: 1699005 - RNA, 18 nt, Homo sapiens
gaaugugggucugcaccu

SEQ ID NO: 1699006 - RNA, 15 nt, Homo sapiens
gaauguggucucagg

SEQ ID NO: 1699007 - RNA, 18 nt, Homo sapiens
gaauguugguuuacuuuc

SEQ ID NO: 1699008 - RNA, 17 nt, Homo sapiens
gaauguuuuacugugaa

SEQ ID NO: 1699009 - RNA, 20 nt, Homo sapiens
gaauuauuuaaacaaaaacu

SEQ ID NO: 1699010 - RNA, 16 nt, Homo sapiens
gaauucaaacuggggc

SEQ ID NO: 1699011 - RNA, 15 nt, Homo sapiens
gaauucacgccucuc

SEQ ID NO: 1699012 - RNA, 21 nt, Homo sapiens
gaauuugauuuauauuuugca

SEQ ID NO: 1699013 - RNA, 11 nt, Homo sapiens
gaauuugcacc

SEQ ID NO: 1699014 - RNA, 20 nt, Homo sapiens
gaauuuucucuaacuucaag

SEQ ID NO: 1699015 - RNA, 16 nt, Homo sapiens
gacaaaucaacagaag

SEQ ID NO: 1699016 - RNA, 21 nt, Homo sapiens
gacaaaucaacagaagcauuu

SEQ ID NO: 1699017 - RNA, 22 nt, Homo sapiens
gacaacugccggggguucaggg

SEQ ID NO: 1699018 - RNA, 16 nt, Homo sapiens
gacaacugugacugua

SEQ ID NO: 1699019 - RNA, 13 nt, Homo sapiens
gacaaggcccuga

SEQ ID NO: 1699020 - RNA, 16 nt, Homo sapiens
gacaagggcugaccug

SEQ ID NO: 1699021 - RNA, 15 nt, Homo sapiens
gacaaguauggcucc

SEQ ID NO: 1699022 - RNA, 21 nt, Homo sapiens
gacaagugacuguaucugugu

SEQ ID NO: 1699023 - RNA, 22 nt, Homo sapiens
gacaauaaaccuccgccaaugc

SEQ ID NO: 1699024 - RNA, 23 nt, Homo sapiens
gacaauaaaccuccgccaaugca

SEQ ID NO: 1699025 - RNA, 16 nt, Homo sapiens
gacaaugaagugacac

SEQ ID NO: 1699026 - RNA, 22 nt, Homo sapiens
gacaaugcaccuagcugugcaa

SEQ ID NO: 1699027 - RNA, 18 nt, Homo sapiens
gacacaaaacuccgcccc

SEQ ID NO: 1699028 - RNA, 11 nt, Homo sapiens
gacacaaagga

SEQ ID NO: 1699029 - RNA, 13 nt, Homo sapiens
gacacaaaugcau

SEQ ID NO: 1699030 - RNA, 14 nt, Homo sapiens
gacacaaaugcaug

SEQ ID NO: 1699031 - RNA, 21 nt, Homo sapiens
gacacagcagcuucaccagag

SEQ ID NO: 1699032 - RNA, 13 nt, Homo sapiens
gacacauaugcac

SEQ ID NO: 1699033 - RNA, 19 nt, Homo sapiens
gacacauaugcaccuugug

SEQ ID NO: 1699034 - RNA, 21 nt, Homo sapiens
gacaccagagcagaugcagag

SEQ ID NO: 1699035 - RNA, 22 nt, Homo sapiens
gacaccagagcagaugcagaga

SEQ ID NO: 1699036 - RNA, 14 nt, Homo sapiens
gacacugugcuaua

SEQ ID NO: 1699037 - RNA, 20 nt, Homo sapiens
gacacuuaauacuaccuuga

SEQ ID NO: 1699038 - RNA, 17 nt, Homo sapiens
gacacuuugacauuucc

SEQ ID NO: 1699039 - RNA, 17 nt, Homo sapiens
gacagaaggugccacuu

SEQ ID NO: 1699040 - RNA, 14 nt, Homo sapiens
gacagacauacauu

SEQ ID NO: 1699041 - RNA, 19 nt, Homo sapiens
gacagagugagacucuguc

SEQ ID NO: 1699042 - RNA, 12 nt, Homo sapiens
gacagcaugugc

SEQ ID NO: 1699043 - RNA, 16 nt, Homo sapiens
gacagucacugccacu

SEQ ID NO: 1699044 - RNA, 16 nt, Homo sapiens
gacauaaagccauguu

SEQ ID NO: 1699045 - RNA, 14 nt, Homo sapiens
gacauaacagugca

SEQ ID NO: 1699046 - RNA, 14 nt, Homo sapiens
gacauacauuucuc

SEQ ID NO: 1699047 - RNA, 13 nt, Homo sapiens
gacauaugcauuu

SEQ ID NO: 1699048 - RNA, 19 nt, Homo sapiens
gacaucggccuccaugacc

SEQ ID NO: 1699049 - RNA, 15 nt, Homo sapiens
gacaugugaaaccuu

SEQ ID NO: 1699050 - RNA, 21 nt, Homo sapiens
gacauuaugugugcaugugug

SEQ ID NO: 1699051 - RNA, 13 nt, Homo sapiens
gacauugaacuga

SEQ ID NO: 1699052 - RNA, 14 nt, Homo sapiens
gacauuuauucaaa

SEQ ID NO: 1699053 - RNA, 19 nt, Homo sapiens
gaccaauugugcugccauu

SEQ ID NO: 1699054 - RNA, 21 nt, Homo sapiens
uacaauaaaacuuugcugcca

SEQ ID NO: 1699055 - RNA, 13 nt, Homo sapiens
uacaauguagaug

SEQ ID NO: 1699056 - RNA, 17 nt, Homo sapiens
uacaauuaauaguuugu

SEQ ID NO: 1699057 - RNA, 18 nt, Homo sapiens
uacacacuuuuuaagaaa

SEQ ID NO: 1699058 - RNA, 19 nt, Homo sapiens
uacacagaaacacugccuu

SEQ ID NO: 1699059 - RNA, 20 nt, Homo sapiens
uacacagugggaacucugac

SEQ ID NO: 1699060 - RNA, 13 nt, Homo sapiens
uacacauauaccu

SEQ ID NO: 1699061 - RNA, 18 nt, Homo sapiens
uacacccuuucuugacaa

SEQ ID NO: 1699062 - RNA, 16 nt, Homo sapiens
uacaccgacuagccag

SEQ ID NO: 1699063 - RNA, 17 nt, Homo sapiens
uacacugaggagagauu

SEQ ID NO: 1699064 - RNA, 21 nt, Homo sapiens
uacacugcaaucauaugugau

SEQ ID NO: 1699065 - RNA, 21 nt, Homo sapiens
uacacugccuguauacuuuag

SEQ ID NO: 1699066 - RNA, 13 nt, Homo sapiens
uacacuuguauaa

SEQ ID NO: 1699067 - RNA, 17 nt, Homo sapiens
uacagaaaguagugcug

SEQ ID NO: 1699068 - RNA, 12 nt, Homo sapiens
uacagacauaca

SEQ ID NO: 1699069 - RNA, 11 nt, Homo sapiens
uacagcuuucu

SEQ ID NO: 1699070 - RNA, 14 nt, Homo sapiens
uacaggcauaaaau

SEQ ID NO: 1699071 - RNA, 14 nt, Homo sapiens
uacaggugcgaaug

SEQ ID NO: 1699072 - RNA, 17 nt, Homo sapiens
uacaggugugagucacc

SEQ ID NO: 1699073 - RNA, 17 nt, Homo sapiens
uacauaacuaaauuuga

SEQ ID NO: 1699074 - RNA, 23 nt, Homo sapiens
uacauaauaaaaaauuaugacaa

SEQ ID NO: 1699075 - RNA, 18 nt, Homo sapiens
uacauauguaaacauaag

SEQ ID NO: 1699076 - RNA, 15 nt, Homo sapiens
uacauauguagacua

SEQ ID NO: 1699077 - RNA, 13 nt, Homo sapiens
uacaucaucucca

SEQ ID NO: 1699078 - RNA, 19 nt, Homo sapiens
uacaugcagcccaugccca

SEQ ID NO: 1699079 - RNA, 16 nt, Homo sapiens
uacaugugauugugau

SEQ ID NO: 1699080 - RNA, 16 nt, Homo sapiens
uacauguguagccugu

SEQ ID NO: 1699081 - RNA, 11 nt, Homo sapiens
uacauguuaag

SEQ ID NO: 1699082 - RNA, 20 nt, Homo sapiens
uacauucugcaagcacaucu

SEQ ID NO: 1699083 - RNA, 18 nt, Homo sapiens
uacauuuuguuguaaaaa

SEQ ID NO: 1699084 - RNA, 13 nt, Homo sapiens
uaccaagcauuua

SEQ ID NO: 1699085 - RNA, 14 nt, Homo sapiens
uaccaaguauuuau

SEQ ID NO: 1699086 - RNA, 16 nt, Homo sapiens
uaccacucacaugaca

SEQ ID NO: 1699087 - RNA, 13 nt, Homo sapiens
uaccauacauuua

SEQ ID NO: 1699088 - RNA, 14 nt, Homo sapiens
uaccauacauuuaa

SEQ ID NO: 1699089 - RNA, 21 nt, Homo sapiens
uaccauacauuuaaaguuuug

SEQ ID NO: 1699090 - RNA, 21 nt, Homo sapiens
uaccauuugcuacuguacaua

SEQ ID NO: 1699091 - RNA, 21 nt, Homo sapiens
uacccacauguacagacauac

SEQ ID NO: 1699092 - RNA, 19 nt, Homo sapiens
uacccaccuagaacacuaa

SEQ ID NO: 1699093 - RNA, 12 nt, Homo sapiens
uacccacugaag

SEQ ID NO: 1699094 - RNA, 16 nt, Homo sapiens
uacccuauacauccac

SEQ ID NO: 1699095 - RNA, 21 nt, Homo sapiens
uaccgaguucaagugauuuuc

SEQ ID NO: 1699096 - RNA, 18 nt, Homo sapiens
uaccgccugucucuuuaa

SEQ ID NO: 1699097 - RNA, 15 nt, Homo sapiens
uaccuacaucaguca

SEQ ID NO: 1699098 - RNA, 20 nt, Homo sapiens
uaccuagagcaggcacuuga

SEQ ID NO: 1699099 - RNA, 19 nt, Homo sapiens
uaccucacagagugcauug

SEQ ID NO: 1699100 - RNA, 23 nt, Homo sapiens
uaccucacagagugcauugugag

SEQ ID NO: 1699101 - RNA, 23 nt, Homo sapiens
uaccugauggaaguaaagccuca

SEQ ID NO: 1699102 - RNA, 20 nt, Homo sapiens
uaccugcuguggaugcuuca

SEQ ID NO: 1699103 - RNA, 11 nt, Homo sapiens
uaccuguguac

SEQ ID NO: 1699104 - RNA, 17 nt, Homo sapiens
uaccuucaagaaccagg

SEQ ID NO: 1699105 - RNA, 16 nt, Homo sapiens
uaccuuuuauguagca

SEQ ID NO: 1699106 - RNA, 21 nt, Homo sapiens
uacguuaauacgcaggcaucu

SEQ ID NO: 1699107 - RNA, 14 nt, Homo sapiens
uacguucuuuucaa

SEQ ID NO: 1699108 - RNA, 20 nt, Homo sapiens
uacguuuccugagaaguguc

SEQ ID NO: 1699109 - RNA, 18 nt, Homo sapiens
uacuaaaguuuuacagaa

SEQ ID NO: 1699110 - RNA, 21 nt, Homo sapiens
uacuaauuccacaccuuuuau

SEQ ID NO: 1699111 - RNA, 13 nt, Homo sapiens
uacuacacuccau

SEQ ID NO: 1699112 - RNA, 16 nt, Homo sapiens
uacuaguuuucaauca

SEQ ID NO: 1699113 - RNA, 16 nt, Homo sapiens
uacuauaguaccagua

SEQ ID NO: 1699114 - RNA, 21 nt, Homo sapiens
uacucagggcuccucccagcu

SEQ ID NO: 1699115 - RNA, 14 nt, Homo sapiens
uacuccagccuggg

SEQ ID NO: 1699116 - RNA, 18 nt, Homo sapiens
uacuguaauaauaccuca

SEQ ID NO: 1699117 - RNA, 19 nt, Homo sapiens
uacuguaauaauaccucaa

SEQ ID NO: 1699118 - RNA, 17 nt, Homo sapiens
uacuguacuaauucuua

SEQ ID NO: 1699119 - RNA, 14 nt, Homo sapiens
uacuuagcaaaaag

SEQ ID NO: 1699120 - RNA, 16 nt, Homo sapiens
uacuugaaaaaguaaa

SEQ ID NO: 1699121 - RNA, 15 nt, Homo sapiens
uacuugaacaaaagg

SEQ ID NO: 1699122 - RNA, 15 nt, Homo sapiens
uacuugagccuuuaa

SEQ ID NO: 1699123 - RNA, 18 nt, Homo sapiens
uacuugugaaacacagcu

SEQ ID NO: 1699124 - RNA, 21 nt, Homo sapiens
uacuugugaaacacagcuguu

SEQ ID NO: 1699125 - RNA, 17 nt, Homo sapiens
uacuuguuuucacuuua

SEQ ID NO: 1699126 - RNA, 19 nt, Homo sapiens
uacuuugaguuagugccau

SEQ ID NO: 1699127 - RNA, 16 nt, Homo sapiens
uacuuuugcacuuuga

SEQ ID NO: 1699128 - RNA, 17 nt, Homo sapiens
uacuuuugcacuuugaa

SEQ ID NO: 1699129 - RNA, 21 nt, Homo sapiens
uagaaaaggcagcuaaaggaa

SEQ ID NO: 1699130 - RNA, 15 nt, Homo sapiens
uagaaacaugacacu

SEQ ID NO: 1699131 - RNA, 16 nt, Homo sapiens
uagaaaccccucugua

SEQ ID NO: 1699132 - RNA, 13 nt, Homo sapiens
uagaaaguagcca

SEQ ID NO: 1699133 - RNA, 23 nt, Homo sapiens
uagaaauaaaagugaaugaaaga

SEQ ID NO: 1699134 - RNA, 22 nt, Homo sapiens
uagaacaaaggacagaguauga

SEQ ID NO: 1699135 - RNA, 11 nt, Homo sapiens
uagaaccucac

SEQ ID NO: 1699136 - RNA, 19 nt, Homo sapiens
uagaacuuacuauucauua

SEQ ID NO: 1699137 - RNA, 19 nt, Homo sapiens
uagaacuugcagcugaugu

SEQ ID NO: 1699138 - RNA, 21 nt, Homo sapiens
uagaagaggguuuuagguaga

SEQ ID NO: 1699139 - RNA, 22 nt, Homo sapiens
uagaagggccaguccugccugg

SEQ ID NO: 1699140 - RNA, 22 nt, Homo sapiens
uagaaguagcaaaaaguauuga

SEQ ID NO: 1699141 - RNA, 23 nt, Homo sapiens
uagaaguuaaugauuuuacuuaa

SEQ ID NO: 1699142 - RNA, 15 nt, Homo sapiens
uagaauaaauuccca

SEQ ID NO: 1699143 - RNA, 16 nt, Homo sapiens
uagaauaaauucccaa

SEQ ID NO: 1699144 - RNA, 16 nt, Homo sapiens
uagaauauaggucucu

SEQ ID NO: 1699145 - RNA, 19 nt, Homo sapiens
uagaauuauaagucacaaa

SEQ ID NO: 1699146 - RNA, 15 nt, Homo sapiens
uagacaauuugcaca

SEQ ID NO: 1699147 - RNA, 20 nt, Homo sapiens
uagaccaggauuucuaauca

SEQ ID NO: 1699148 - RNA, 18 nt, Homo sapiens
uagacgaggccacagcug

SEQ ID NO: 1699149 - RNA, 22 nt, Homo sapiens
uagacgaggccacagcugccau

SEQ ID NO: 1699150 - RNA, 14 nt, Homo sapiens
uagacuacauuuag

SEQ ID NO: 1699151 - RNA, 15 nt, Homo sapiens
uagacuauuugcuua

SEQ ID NO: 1699152 - RNA, 17 nt, Homo sapiens
uagacuggaaguucaua

SEQ ID NO: 1699153 - RNA, 22 nt, Homo sapiens
uagacuugccaacaccacagaa

SEQ ID NO: 1699154 - RNA, 22 nt, Homo sapiens
uagagacaggguuucacugugu

SEQ ID NO: 1699155 - RNA, 21 nt, Homo sapiens
uagagacaggguuuugccaug

SEQ ID NO: 1699156 - RNA, 15 nt, Homo sapiens
uagagagagaacuuu

SEQ ID NO: 1699157 - RNA, 22 nt, Homo sapiens
uagagauggggucucacagugu

SEQ ID NO: 1699158 - RNA, 12 nt, Homo sapiens
uagagccagcuu

SEQ ID NO: 1699159 - RNA, 16 nt, Homo sapiens
uagagcucgccacgaa

SEQ ID NO: 1699160 - RNA, 22 nt, Homo sapiens
uagaggcaagaaagagauacca

SEQ ID NO: 1699161 - RNA, 21 nt, Homo sapiens
uagagguagguaggaucaucc

SEQ ID NO: 1699162 - RNA, 14 nt, Homo sapiens
uagaguauaugcac

SEQ ID NO: 1699163 - RNA, 17 nt, Homo sapiens
uagagugucucagggug

SEQ ID NO: 1699164 - RNA, 13 nt, Homo sapiens
ucaugacauauga

SEQ ID NO: 1699165 - RNA, 16 nt, Homo sapiens
ucaugacauguuauau

SEQ ID NO: 1699166 - RNA, 19 nt, Homo sapiens
ucaugagcguuagacugac

SEQ ID NO: 1699167 - RNA, 23 nt, Homo sapiens
ucaugccaccauggccagccaac

SEQ ID NO: 1699168 - RNA, 21 nt, Homo sapiens
ucaugccuucacgugucuguu

SEQ ID NO: 1699169 - RNA, 20 nt, Homo sapiens
ucaugguuacaaacuacaga

SEQ ID NO: 1699170 - RNA, 23 nt, Homo sapiens
ucaugucuauaaucccagcacuu

SEQ ID NO: 1699171 - RNA, 11 nt, Homo sapiens
ucauguuauau

SEQ ID NO: 1699172 - RNA, 13 nt, Homo sapiens
ucauguucuugca

SEQ ID NO: 1699173 - RNA, 19 nt, Homo sapiens
ucauguuugcuucauaaau

SEQ ID NO: 1699174 - RNA, 15 nt, Homo sapiens
ucauuaaauguuuga

SEQ ID NO: 1699175 - RNA, 17 nt, Homo sapiens
ucauuaaauguuugaca

SEQ ID NO: 1699176 - RNA, 21 nt, Homo sapiens
ucauuacccuucccugcacua

SEQ ID NO: 1699177 - RNA, 17 nt, Homo sapiens
ucauuauaucauuggaa

SEQ ID NO: 1699178 - RNA, 22 nt, Homo sapiens
ucauucaauauugacauuugua

SEQ ID NO: 1699179 - RNA, 14 nt, Homo sapiens
ucauucacauucag

SEQ ID NO: 1699180 - RNA, 14 nt, Homo sapiens
ucauucauucacuc

SEQ ID NO: 1699181 - RNA, 17 nt, Homo sapiens
ucauugcugagccucug

SEQ ID NO: 1699182 - RNA, 17 nt, Homo sapiens
ucauuguaaacaaacuc

SEQ ID NO: 1699183 - RNA, 22 nt, Homo sapiens
ucauugucccucuucacucccc

SEQ ID NO: 1699184 - RNA, 15 nt, Homo sapiens
uccaaagaggcugcc

SEQ ID NO: 1699185 - RNA, 18 nt, Homo sapiens
uccaaagugccacucauu

SEQ ID NO: 1699186 - RNA, 14 nt, Homo sapiens
uccaacaccacaga

SEQ ID NO: 1699187 - RNA, 19 nt, Homo sapiens
uccaacagugagucuguca

SEQ ID NO: 1699188 - RNA, 15 nt, Homo sapiens
uccaaccuucccaaa

SEQ ID NO: 1699189 - RNA, 13 nt, Homo sapiens
uccaagaacaauu

SEQ ID NO: 1699190 - RNA, 15 nt, Homo sapiens
uccaagacagagaca

SEQ ID NO: 1699191 - RNA, 17 nt, Homo sapiens
uccaauaggcauuugau

SEQ ID NO: 1699192 - RNA, 13 nt, Homo sapiens
uccaauauuucug

SEQ ID NO: 1699193 - RNA, 16 nt, Homo sapiens
uccacaugcucugaga

SEQ ID NO: 1699194 - RNA, 16 nt, Homo sapiens
uccaccacugcuuaag

SEQ ID NO: 1699195 - RNA, 22 nt, Homo sapiens
uccaccacugcuuaagugccua

SEQ ID NO: 1699196 - RNA, 17 nt, Homo sapiens
uccaccuaccacucaca

SEQ ID NO: 1699197 - RNA, 21 nt, Homo sapiens
uccaccuaccacucacaugac

SEQ ID NO: 1699198 - RNA, 23 nt, Homo sapiens
uccaccuguggguguagccaggu

SEQ ID NO: 1699199 - RNA, 16 nt, Homo sapiens
uccacucuugugguca

SEQ ID NO: 1699200 - RNA, 14 nt, Homo sapiens
uccacugugccuuu

SEQ ID NO: 1699201 - RNA, 15 nt, Homo sapiens
uccacuuacauauau

SEQ ID NO: 1699202 - RNA, 20 nt, Homo sapiens
uccacuuagaaauugcauuu

SEQ ID NO: 1699203 - RNA, 14 nt, Homo sapiens
uccacuucuuccuu

SEQ ID NO: 1699204 - RNA, 14 nt, Homo sapiens
uccagaacugcacu

SEQ ID NO: 1699205 - RNA, 21 nt, Homo sapiens
uccagacaaugccagcauaaa

SEQ ID NO: 1699206 - RNA, 20 nt, Homo sapiens
uccagacuuccuugagacac

SEQ ID NO: 1699207 - RNA, 16 nt, Homo sapiens
uccagagggugcgcuc

SEQ ID NO: 1699208 - RNA, 17 nt, Homo sapiens
uccagccgccauugcca

SEQ ID NO: 1699209 - RNA, 17 nt, Homo sapiens
uccagccucauaaagua

SEQ ID NO: 1699210 - RNA, 20 nt, Homo sapiens
uccagccugggcaacagagc

SEQ ID NO: 1699211 - RNA, 20 nt, Homo sapiens
uccaggaugaguuacuugaa

SEQ ID NO: 1699212 - RNA, 16 nt, Homo sapiens
uccaggccugcagcag

SEQ ID NO: 1699213 - RNA, 17 nt, Homo sapiens
uccaguauccacuuugc

SEQ ID NO: 1699214 - RNA, 13 nt, Homo sapiens
uccagucucaaaa

SEQ ID NO: 1699215 - RNA, 19 nt, Homo sapiens
uccagugccagcaaugaca

SEQ ID NO: 1699216 - RNA, 22 nt, Homo sapiens
uccaguuuuauaaaaaguggag

SEQ ID NO: 1699217 - RNA, 23 nt, Homo sapiens
uccaguuuuauaaaaaguggaga

SEQ ID NO: 1699218 - RNA, 23 nt, Homo sapiens
uccauauguuauaucaacagaua

SEQ ID NO: 1699219 - RNA, 22 nt, Homo sapiens
uccaucacccguacaggcaauu

SEQ ID NO: 1699220 - RNA, 19 nt, Homo sapiens
uccaucccaaccagugcca

SEQ ID NO: 1699221 - RNA, 15 nt, Homo sapiens
uccaucuccacucca

SEQ ID NO: 1699222 - RNA, 12 nt, Homo sapiens
uccauguacuug

SEQ ID NO: 1699223 - RNA, 12 nt, Homo sapiens
uccauucccaag

SEQ ID NO: 1699224 - RNA, 15 nt, Homo sapiens
uccauuuauauauga

SEQ ID NO: 1699225 - RNA, 16 nt, Homo sapiens
ucccaaucagcacuga

SEQ ID NO: 1699226 - RNA, 17 nt, Homo sapiens
ucccaaucagcacugaa

SEQ ID NO: 1699227 - RNA, 18 nt, Homo sapiens
ucccaaucagcacugaaa

SEQ ID NO: 1699228 - RNA, 19 nt, Homo sapiens
ucccaaucagcacugaaaa

SEQ ID NO: 1699229 - RNA, 17 nt, Homo sapiens
ucccaaugcacauccau

SEQ ID NO: 1699230 - RNA, 21 nt, Homo sapiens
ucccaaugcacauccauuccc

SEQ ID NO: 1699231 - RNA, 18 nt, Homo sapiens
ucccacaacaacaaaagc

SEQ ID NO: 1699232 - RNA, 16 nt, Homo sapiens
ucccacaggcccuucc

SEQ ID NO: 1699233 - RNA, 17 nt, Homo sapiens
ucccacccacaugugac

SEQ ID NO: 1699234 - RNA, 19 nt, Homo sapiens
ucccacccacaugugacac

SEQ ID NO: 1699235 - RNA, 21 nt, Homo sapiens
ucccacccacaugugacacau

SEQ ID NO: 1699236 - RNA, 23 nt, Homo sapiens
ucccacccccacccccagcucaa

SEQ ID NO: 1699237 - RNA, 15 nt, Homo sapiens
ucccacucaguccau

SEQ ID NO: 1699238 - RNA, 15 nt, Homo sapiens
ucccagaucagucag

SEQ ID NO: 1699239 - RNA, 16 nt, Homo sapiens
ucccagcuacucagga

SEQ ID NO: 1699240 - RNA, 23 nt, Homo sapiens
ucccaggccagcaagcucuucac

SEQ ID NO: 1699241 - RNA, 15 nt, Homo sapiens
ucccaucauuacccu

SEQ ID NO: 1699242 - RNA, 20 nt, Homo sapiens
ucccauccccuggacuggga

SEQ ID NO: 1699243 - RNA, 16 nt, Homo sapiens
ucccaucgcugucaca

SEQ ID NO: 1699244 - RNA, 12 nt, Homo sapiens
ucccaugaagcc

SEQ ID NO: 1699245 - RNA, 17 nt, Homo sapiens
ucccauggacacuccag

SEQ ID NO: 1699246 - RNA, 22 nt, Homo sapiens
ucccauuucaauuccugugauu

SEQ ID NO: 1699247 - RNA, 20 nt, Homo sapiens
ucccauuuccugagaccaca

SEQ ID NO: 1699248 - RNA, 17 nt, Homo sapiens
uccccaaggaagagcca

SEQ ID NO: 1699249 - RNA, 19 nt, Homo sapiens
uccccagcccuuuuguuga

SEQ ID NO: 1699250 - RNA, 21 nt, Homo sapiens
uccccaguucauugcacuuug

SEQ ID NO: 1699251 - RNA, 14 nt, Homo sapiens
uccccccauguugu

SEQ ID NO: 1699252 - RNA, 15 nt, Homo sapiens
ucccccgccacuccu

SEQ ID NO: 1699253 - RNA, 22 nt, Homo sapiens
uccccuagcuuuccccagacac

SEQ ID NO: 1699254 - RNA, 15 nt, Homo sapiens
uccccuccagccuuu

SEQ ID NO: 1699255 - RNA, 16 nt, Homo sapiens
uccccuuuuucuuccu

SEQ ID NO: 1699256 - RNA, 20 nt, Homo sapiens
ucccgaagaauggagaggaa

SEQ ID NO: 1699257 - RNA, 14 nt, Homo sapiens
ucccgaugcugcua

SEQ ID NO: 1699258 - RNA, 15 nt, Homo sapiens
ucccgaugcugcuau

SEQ ID NO: 1699259 - RNA, 16 nt, Homo sapiens
ucccgaugcugcuaug

SEQ ID NO: 1699260 - RNA, 22 nt, Homo sapiens
ucccuagccagcacuuguauau

SEQ ID NO: 1699261 - RNA, 18 nt, Homo sapiens
ucccucacuguugaauuu

SEQ ID NO: 1699262 - RNA, 20 nt, Homo sapiens
ucccucggggccauacuucu

SEQ ID NO: 1699263 - RNA, 14 nt, Homo sapiens
ucccugaagccagc

SEQ ID NO: 1699264 - RNA, 15 nt, Homo sapiens
ucccugcuaaucucc

SEQ ID NO: 1699265 - RNA, 21 nt, Homo sapiens
ucccuggaucacgacgcugca

SEQ ID NO: 1699266 - RNA, 19 nt, Homo sapiens
ucccuucccuaaagugaug

SEQ ID NO: 1699267 - RNA, 19 nt, Homo sapiens
ucccuuuguugcacacuca

SEQ ID NO: 1699268 - RNA, 16 nt, Homo sapiens
uccgccagauccugca

SEQ ID NO: 1699269 - RNA, 18 nt, Homo sapiens
uccgccuuuuguauacau

SEQ ID NO: 1699270 - RNA, 12 nt, Homo sapiens
uccguacauuca

SEQ ID NO: 1699271 - RNA, 20 nt, Homo sapiens
uccgugguuugaacacgaaa

SEQ ID NO: 1699272 - RNA, 17 nt, Homo sapiens
uccuaagacacaaaugc

SEQ ID NO: 1699273 - RNA, 17 nt, Homo sapiens
uccuaccccuuugcacu

SEQ ID NO: 1699274 - RNA, 20 nt, Homo sapiens
ugagagcaauuguaacgguu

SEQ ID NO: 1699275 - RNA, 18 nt, Homo sapiens
ugagagugucucugauaa

SEQ ID NO: 1699276 - RNA, 20 nt, Homo sapiens
ugagauauuugguaccaugg

SEQ ID NO: 1699277 - RNA, 17 nt, Homo sapiens
ugagaucaucagugaua

SEQ ID NO: 1699278 - RNA, 21 nt, Homo sapiens
ugagauuaugaugaaaaccua

SEQ ID NO: 1699279 - RNA, 21 nt, Homo sapiens
ugagauuuccuccuggccuuu

SEQ ID NO: 1699280 - RNA, 22 nt, Homo sapiens
ugagauuuugaaaaucuaccaa

SEQ ID NO: 1699281 - RNA, 16 nt, Homo sapiens
ugagcagaagaucaag

SEQ ID NO: 1699282 - RNA, 23 nt, Homo sapiens
ugagcgugaaucuguaucuugcc

SEQ ID NO: 1699283 - RNA, 15 nt, Homo sapiens
ugagcugacaucuca

SEQ ID NO: 1699284 - RNA, 17 nt, Homo sapiens
ugaggaagucacuuuac

SEQ ID NO: 1699285 - RNA, 16 nt, Homo sapiens
ugaggaagugaacauu

SEQ ID NO: 1699286 - RNA, 15 nt, Homo sapiens
ugaggagccucccag

SEQ ID NO: 1699287 - RNA, 20 nt, Homo sapiens
ugaggauuuugauccaagcu

SEQ ID NO: 1699288 - RNA, 19 nt, Homo sapiens
ugaggcagggcaaaugaca

SEQ ID NO: 1699289 - RNA, 19 nt, Homo sapiens
ugaggccuccagcuucagg

SEQ ID NO: 1699290 - RNA, 13 nt, Homo sapiens
ugagggacucuga

SEQ ID NO: 1699291 - RNA, 14 nt, Homo sapiens
ugagggacugccuc

SEQ ID NO: 1699292 - RNA, 16 nt, Homo sapiens
ugagggcccagagcag

SEQ ID NO: 1699293 - RNA, 19 nt, Homo sapiens
ugaggugguggaguggagu

SEQ ID NO: 1699294 - RNA, 18 nt, Homo sapiens
ugaguaagcccucaggag

SEQ ID NO: 1699295 - RNA, 19 nt, Homo sapiens
ugaguagauauuacuuuau

SEQ ID NO: 1699296 - RNA, 20 nt, Homo sapiens
ugagucaccaagcccaguua

SEQ ID NO: 1699297 - RNA, 23 nt, Homo sapiens
ugagucauuuaaauguguacaau

SEQ ID NO: 1699298 - RNA, 18 nt, Homo sapiens
ugaguccaucuaacauca

SEQ ID NO: 1699299 - RNA, 14 nt, Homo sapiens
ugaguccauuagcu

SEQ ID NO: 1699300 - RNA, 19 nt, Homo sapiens
ugagucuguugugugucau

SEQ ID NO: 1699301 - RNA, 14 nt, Homo sapiens
ugagugacuagacg

SEQ ID NO: 1699302 - RNA, 12 nt, Homo sapiens
ugaguuacuuga

SEQ ID NO: 1699303 - RNA, 19 nt, Homo sapiens
ugaguuaugaguuauucau

SEQ ID NO: 1699304 - RNA, 18 nt, Homo sapiens
ugaguucuggucaaagaa

SEQ ID NO: 1699305 - RNA, 20 nt, Homo sapiens
ugaguuguuuaaacagucaa

SEQ ID NO: 1699306 - RNA, 12 nt, Homo sapiens
ugauaaguaaau

SEQ ID NO: 1699307 - RNA, 21 nt, Homo sapiens
ugauaaugauaaaacaccuca

SEQ ID NO: 1699308 - RNA, 16 nt, Homo sapiens
ugauacaguacuuuga

SEQ ID NO: 1699309 - RNA, 15 nt, Homo sapiens
ugauaccugcacugu

SEQ ID NO: 1699310 - RNA, 22 nt, Homo sapiens
ugauacuuauauuuucguauga

SEQ ID NO: 1699311 - RNA, 16 nt, Homo sapiens
ugauacuucacuacuu

SEQ ID NO: 1699312 - RNA, 12 nt, Homo sapiens
ugauacuuuuaa

SEQ ID NO: 1699313 - RNA, 19 nt, Homo sapiens
ugauagauuucuacacuga

SEQ ID NO: 1699314 - RNA, 18 nt, Homo sapiens
ugauagguauuaucucca

SEQ ID NO: 1699315 - RNA, 14 nt, Homo sapiens
ugauauauauaugc

SEQ ID NO: 1699316 - RNA, 18 nt, Homo sapiens
ugauaucuggccuaaaau

SEQ ID NO: 1699317 - RNA, 19 nt, Homo sapiens
ugauauggcagaagacacc

SEQ ID NO: 1699318 - RNA, 14 nt, Homo sapiens
ugauaugggacuga

SEQ ID NO: 1699319 - RNA, 16 nt, Homo sapiens
ugaucaaauauuucaa

SEQ ID NO: 1699320 - RNA, 17 nt, Homo sapiens
ugaucaauuauaguuuc

SEQ ID NO: 1699321 - RNA, 23 nt, Homo sapiens
ugaucauuuuccccccacucucc

SEQ ID NO: 1699322 - RNA, 23 nt, Homo sapiens
ugaucucuucuuuuggcuuccau

SEQ ID NO: 1699323 - RNA, 12 nt, Homo sapiens
ugaucugugaua

SEQ ID NO: 1699324 - RNA, 19 nt, Homo sapiens
ugaucuuaauauauuugaa

SEQ ID NO: 1699325 - RNA, 17 nt, Homo sapiens
ugaucuugauugugggu

SEQ ID NO: 1699326 - RNA, 12 nt, Homo sapiens
ugaugaaugaga

SEQ ID NO: 1699327 - RNA, 15 nt, Homo sapiens
ugaugacccucugac

SEQ ID NO: 1699328 - RNA, 13 nt, Homo sapiens
ugaugcagcauuu

SEQ ID NO: 1699329 - RNA, 15 nt, Homo sapiens
ugaugcaggcacuua

SEQ ID NO: 1699330 - RNA, 16 nt, Homo sapiens
ugaugcaggcacuuau

SEQ ID NO: 1699331 - RNA, 15 nt, Homo sapiens
ugaugccauaugccu

SEQ ID NO: 1699332 - RNA, 14 nt, Homo sapiens
ugaugccauggcag

SEQ ID NO: 1699333 - RNA, 20 nt, Homo sapiens
ugaugugaaacacuuugccu

SEQ ID NO: 1699334 - RNA, 18 nt, Homo sapiens
ugauguguccucagggag

SEQ ID NO: 1699335 - RNA, 20 nt, Homo sapiens
ugauguuuguggccucagaa

SEQ ID NO: 1699336 - RNA, 15 nt, Homo sapiens
ugauuacugcucuau

SEQ ID NO: 1699337 - RNA, 21 nt, Homo sapiens
ugauuauccauauugagucaa

SEQ ID NO: 1699338 - RNA, 23 nt, Homo sapiens
ugauuauccauauugagucaaau

SEQ ID NO: 1699339 - RNA, 13 nt, Homo sapiens
ugauucacugcau

SEQ ID NO: 1699340 - RNA, 22 nt, Homo sapiens
ugauugagaagaggacauugga

SEQ ID NO: 1699341 - RNA, 12 nt, Homo sapiens
ugauugcagcuu

SEQ ID NO: 1699342 - RNA, 17 nt, Homo sapiens
ugauuggaccaggccau

SEQ ID NO: 1699343 - RNA, 17 nt, Homo sapiens
ugauuguggaauggaga

SEQ ID NO: 1699344 - RNA, 14 nt, Homo sapiens
ugauuucucuccca

SEQ ID NO: 1699345 - RNA, 14 nt, Homo sapiens
ugcaaaacauaucu

SEQ ID NO: 1699346 - RNA, 15 nt, Homo sapiens
ugcaaaaggagagac

SEQ ID NO: 1699347 - RNA, 16 nt, Homo sapiens
ugcaaaauagacauau

SEQ ID NO: 1699348 - RNA, 18 nt, Homo sapiens
ugcaaaauauuugacuau

SEQ ID NO: 1699349 - RNA, 18 nt, Homo sapiens
ugcaaaucaaacauauuc

SEQ ID NO: 1699350 - RNA, 17 nt, Homo sapiens
ugcaaauggaagacaaa

SEQ ID NO: 1699351 - RNA, 17 nt, Homo sapiens
ugcaaccacacaccuca

SEQ ID NO: 1699352 - RNA, 17 nt, Homo sapiens
ugcaagaccuagugcuc

SEQ ID NO: 1699353 - RNA, 21 nt, Homo sapiens
ugcaagaccuagugcucuuaa

SEQ ID NO: 1699354 - RNA, 15 nt, Homo sapiens
ugcaagagugacagu

SEQ ID NO: 1699355 - RNA, 19 nt, Homo sapiens
ugcaagcacaucugcauuu

SEQ ID NO: 1699356 - RNA, 12 nt, Homo sapiens
ugcaagccuguc

SEQ ID NO: 1699357 - RNA, 19 nt, Homo sapiens
ugcaauaucugaagcccuc

SEQ ID NO: 1699358 - RNA, 17 nt, Homo sapiens
ugcaaucauaugugauc

SEQ ID NO: 1699359 - RNA, 16 nt, Homo sapiens
ugcacaaagcccuucc

SEQ ID NO: 1699360 - RNA, 16 nt, Homo sapiens
ugcacaggaugcuggc

SEQ ID NO: 1699361 - RNA, 15 nt, Homo sapiens
ugcacauccauuccc

SEQ ID NO: 1699362 - RNA, 13 nt, Homo sapiens
ugcacaugaaucc

SEQ ID NO: 1699363 - RNA, 20 nt, Homo sapiens
ugcacaugucuuguacaugu

SEQ ID NO: 1699364 - RNA, 19 nt, Homo sapiens
ugcaccccucugcccucau

SEQ ID NO: 1699365 - RNA, 14 nt, Homo sapiens
ugcacgugugugca

SEQ ID NO: 1699366 - RNA, 20 nt, Homo sapiens
ugcacuccagccugggcaac

SEQ ID NO: 1699367 - RNA, 20 nt, Homo sapiens
ugcagacucuacagaggcca

SEQ ID NO: 1699368 - RNA, 12 nt, Homo sapiens
ugcagagcaaug

SEQ ID NO: 1699369 - RNA, 20 nt, Homo sapiens
ugcagcuagaggcaucuucu

SEQ ID NO: 1699370 - RNA, 22 nt, Homo sapiens
ugcagcuuccugucaacacuuc

SEQ ID NO: 1699371 - RNA, 13 nt, Homo sapiens
ugcagggacucca

SEQ ID NO: 1699372 - RNA, 22 nt, Homo sapiens
ugcaguaaauuaucuugggaua

SEQ ID NO: 1699373 - RNA, 13 nt, Homo sapiens
ugcagugagccaa

SEQ ID NO: 1699374 - RNA, 23 nt, Homo sapiens
ugcagugguaugaucacggcuca

SEQ ID NO: 1699375 - RNA, 19 nt, Homo sapiens
ugcaguucaccugcacuua

SEQ ID NO: 1699376 - RNA, 22 nt, Homo sapiens
ugcaguuuuugccuggguccca

SEQ ID NO: 1699377 - RNA, 21 nt, Homo sapiens
ugcauguaccauuugcauggc

SEQ ID NO: 1699378 - RNA, 24 nt, Homo sapiens
ugcauguagucacuuuauaaguca

SEQ ID NO: 1699379 - RNA, 15 nt, Homo sapiens
ugcauuaaaccuguc

SEQ ID NO: 1699380 - RNA, 16 nt, Homo sapiens
ugcauuuccuuucuac

SEQ ID NO: 1699381 - RNA, 14 nt, Homo sapiens
ugcauuugugucau

SEQ ID NO: 1699382 - RNA, 18 nt, Homo sapiens
ugccaaagggaaauauca

SEQ ID NO: 1699383 - RNA, 18 nt, Homo sapiens
ugccaacuguccuacuca

SEQ ID NO: 1699384 - RNA, 19 nt, Homo sapiens
uguugacaaaauuuucuca

SEQ ID NO: 1699385 - RNA, 13 nt, Homo sapiens
uguugauguaucu

SEQ ID NO: 1699386 - RNA, 18 nt, Homo sapiens
uguugcaccaggcacugc

SEQ ID NO: 1699387 - RNA, 21 nt, Homo sapiens
uguugcccaggcuggucucaa

SEQ ID NO: 1699388 - RNA, 20 nt, Homo sapiens
uguuggauaucauacuucca

SEQ ID NO: 1699389 - RNA, 20 nt, Homo sapiens
uguuggccaaagccaaagcu

SEQ ID NO: 1699390 - RNA, 15 nt, Homo sapiens
uguuggccaguguga

SEQ ID NO: 1699391 - RNA, 22 nt, Homo sapiens
uguuguaaaaagaaaaaccacu

SEQ ID NO: 1699392 - RNA, 21 nt, Homo sapiens
uguugucauuguaaacaaacu

SEQ ID NO: 1699393 - RNA, 15 nt, Homo sapiens
uguuuaaaguggcaa

SEQ ID NO: 1699394 - RNA, 16 nt, Homo sapiens
uguuuaagaaaaguau

SEQ ID NO: 1699395 - RNA, 17 nt, Homo sapiens
uguuuacaaggugacaa

SEQ ID NO: 1699396 - RNA, 13 nt, Homo sapiens
uguuuacagcaau

SEQ ID NO: 1699397 - RNA, 18 nt, Homo sapiens
uguuucacaauaccucau

SEQ ID NO: 1699398 - RNA, 19 nt, Homo sapiens
uguuucccuucccuuccac

SEQ ID NO: 1699399 - RNA, 12 nt, Homo sapiens
uguuucucauau

SEQ ID NO: 1699400 - RNA, 19 nt, Homo sapiens
uguuugauaugaaguguua

SEQ ID NO: 1699401 - RNA, 18 nt, Homo sapiens
uguuugucucaguuggaa

SEQ ID NO: 1699402 - RNA, 23 nt, Homo sapiens
uguuuuaauccuuaacacauuca

SEQ ID NO: 1699403 - RNA, 20 nt, Homo sapiens
uguuuuacccuauacaucca

SEQ ID NO: 1699404 - RNA, 14 nt, Homo sapiens
uguuuugaaaaccu

SEQ ID NO: 1699405 - RNA, 24 nt, Homo sapiens
uuaaaacuaaaaaggaccagagaa

SEQ ID NO: 1699406 - RNA, 19 nt, Homo sapiens
uuaaaaguugugauuccag

SEQ ID NO: 1699407 - RNA, 20 nt, Homo sapiens
uuaaaauaacacuugcccau

SEQ ID NO: 1699408 - RNA, 13 nt, Homo sapiens
uuaaaauucaauu

SEQ ID NO: 1699409 - RNA, 13 nt, Homo sapiens
uuaaaauucucau

SEQ ID NO: 1699410 - RNA, 21 nt, Homo sapiens
uuaaacaaaauagaagcugua

SEQ ID NO: 1699411 - RNA, 15 nt, Homo sapiens
uuaaacaccuccuca

SEQ ID NO: 1699412 - RNA, 12 nt, Homo sapiens
uuaaacucaggg

SEQ ID NO: 1699413 - RNA, 14 nt, Homo sapiens
uuaaagaaccaaaa

SEQ ID NO: 1699414 - RNA, 18 nt, Homo sapiens
uuaaagaugaacucugaa

SEQ ID NO: 1699415 - RNA, 12 nt, Homo sapiens
uuaaagcaaaaa

SEQ ID NO: 1699416 - RNA, 13 nt, Homo sapiens
uuaaagccuccuc

SEQ ID NO: 1699417 - RNA, 14 nt, Homo sapiens
uuaaagccuccuca

SEQ ID NO: 1699418 - RNA, 22 nt, Homo sapiens
uuaaaggguauacuaagugaua

SEQ ID NO: 1699419 - RNA, 22 nt, Homo sapiens
uuaaauaaaacuuaaaucucac

SEQ ID NO: 1699420 - RNA, 19 nt, Homo sapiens
uuaaauaaaucauuaauac

SEQ ID NO: 1699421 - RNA, 19 nt, Homo sapiens
uuaaauaaugcuucagaua

SEQ ID NO: 1699422 - RNA, 20 nt, Homo sapiens
uuaaaugaacuugauagcua

SEQ ID NO: 1699423 - RNA, 22 nt, Homo sapiens
uuaaauguagcaauggcacugu

SEQ ID NO: 1699424 - RNA, 15 nt, Homo sapiens
uuaacaacaauaaca

SEQ ID NO: 1699425 - RNA, 13 nt, Homo sapiens
uuaacacauucaa

SEQ ID NO: 1699426 - RNA, 13 nt, Homo sapiens
uuaacaucucaga

SEQ ID NO: 1699427 - RNA, 18 nt, Homo sapiens
uuaacaugggcucuucac

SEQ ID NO: 1699428 - RNA, 18 nt, Homo sapiens
uuaaccgcacaugcacac

SEQ ID NO: 1699429 - RNA, 19 nt, Homo sapiens
uuaacuuuuuuucuucuac

SEQ ID NO: 1699430 - RNA, 19 nt, Homo sapiens
uuaagaauguugguuuacu

SEQ ID NO: 1699431 - RNA, 19 nt, Homo sapiens
uuaagaccuacuguucuaa

SEQ ID NO: 1699432 - RNA, 22 nt, Homo sapiens
uuaagacgguuaaauacugugu

SEQ ID NO: 1699433 - RNA, 14 nt, Homo sapiens
uuaagagccauaua

SEQ ID NO: 1699434 - RNA, 14 nt, Homo sapiens
uuaagaguccaaga

SEQ ID NO: 1699435 - RNA, 18 nt, Homo sapiens
uuaagauuuugcaccugu

SEQ ID NO: 1699436 - RNA, 22 nt, Homo sapiens
uuaagggcaugccuugugcugu

SEQ ID NO: 1699437 - RNA, 23 nt, Homo sapiens
uuaaguaucuuuuuucaaaaaca

SEQ ID NO: 1699438 - RNA, 21 nt, Homo sapiens
uuaauaaagaauuaacagaga

SEQ ID NO: 1699439 - RNA, 13 nt, Homo sapiens
uuaauacaaagaa

SEQ ID NO: 1699440 - RNA, 17 nt, Homo sapiens
uuaauagcuauggaauc

SEQ ID NO: 1699441 - RNA, 21 nt, Homo sapiens
uuaauaguuuugauccuaaau

SEQ ID NO: 1699442 - RNA, 22 nt, Homo sapiens
uuaauauaguaacacacuucca

SEQ ID NO: 1699443 - RNA, 18 nt, Homo sapiens
uuaaucuguuauguacua

SEQ ID NO: 1699444 - RNA, 19 nt, Homo sapiens
uuaaugaaugagucuguug

SEQ ID NO: 1699445 - RNA, 10 nt, Homo sapiens
uuaaugacaa

SEQ ID NO: 1699446 - RNA, 13 nt, Homo sapiens
uuaaugcuucauu

SEQ ID NO: 1699447 - RNA, 15 nt, Homo sapiens
uuaauguuuuuaccc

SEQ ID NO: 1699448 - RNA, 19 nt, Homo sapiens
uuaauucucuuucaaagcu

SEQ ID NO: 1699449 - RNA, 14 nt, Homo sapiens
uuaauuuccagggu

SEQ ID NO: 1699450 - RNA, 23 nt, Homo sapiens
uuaauuugaaaacauaaucugca

SEQ ID NO: 1699451 - RNA, 23 nt, Homo sapiens
uuacaaaacaugauuguuuacag

SEQ ID NO: 1699452 - RNA, 22 nt, Homo sapiens
uuacacugccuguauacuuuag

SEQ ID NO: 1699453 - RNA, 12 nt, Homo sapiens
uuacagaauuau

SEQ ID NO: 1699454 - RNA, 17 nt, Homo sapiens
uuacaugugauugugau

SEQ ID NO: 1699455 - RNA, 14 nt, Homo sapiens
uuacauucaucuca

SEQ ID NO: 1699456 - RNA, 22 nt, Homo sapiens
uuaccuagaagaagcuauguca

SEQ ID NO: 1699457 - RNA, 20 nt, Homo sapiens
uuaccuguacacugacuuga

SEQ ID NO: 1699458 - RNA, 23 nt, Homo sapiens
uuacucaaggaauuugcauuuag

SEQ ID NO: 1699459 - RNA, 23 nt, Homo sapiens
uuacucuaagaucuuagauucuc

SEQ ID NO: 1699460 - RNA, 15 nt, Homo sapiens
uuacuuuuauuugca

SEQ ID NO: 1699461 - RNA, 20 nt, Homo sapiens
uuagaaauguaaacugccau

SEQ ID NO: 1699462 - RNA, 15 nt, Homo sapiens
uuagaaauugcauuu

SEQ ID NO: 1699463 - RNA, 18 nt, Homo sapiens
uuagacauaacaaaacac

SEQ ID NO: 1699464 - RNA, 15 nt, Homo sapiens
uuagaccgcucucuu

SEQ ID NO: 1699465 - RNA, 22 nt, Homo sapiens
uuagacuggaaguucauaccua

SEQ ID NO: 1699466 - RNA, 15 nt, Homo sapiens
uuagagagagaacuu

SEQ ID NO: 1699467 - RNA, 21 nt, Homo sapiens
uuagagccagccacacuugaa

SEQ ID NO: 1699468 - RNA, 22 nt, Homo sapiens
uuagauacagagacuuggggaa

SEQ ID NO: 1699469 - RNA, 14 nt, Homo sapiens
uuagauguuucaca

SEQ ID NO: 1699470 - RNA, 21 nt, Homo sapiens
uuagauuaaauaaaacuuaaa

SEQ ID NO: 1699471 - RNA, 18 nt, Homo sapiens
uuagcacuauuuacauac

SEQ ID NO: 1699472 - RNA, 16 nt, Homo sapiens
uuagccauaaauugcu

SEQ ID NO: 1699473 - RNA, 23 nt, Homo sapiens
uuaggaaguuuucuguagucauu

SEQ ID NO: 1699474 - RNA, 16 nt, Homo sapiens
uuaggcaauacaccaa

SEQ ID NO: 1699475 - RNA, 16 nt, Homo sapiens
uuaguagagacagggu

SEQ ID NO: 1699476 - RNA, 13 nt, Homo sapiens
uuaguaucucauc

SEQ ID NO: 1699477 - RNA, 23 nt, Homo sapiens
uuagugaccccugccuacuuccu

SEQ ID NO: 1699478 - RNA, 20 nt, Homo sapiens
uuaguuuacaaucagccaca

SEQ ID NO: 1699479 - RNA, 22 nt, Homo sapiens
uuauaacagaauuaaaguagau

SEQ ID NO: 1699480 - RNA, 13 nt, Homo sapiens
uuauaaguucaca

SEQ ID NO: 1699481 - RNA, 19 nt, Homo sapiens
uuauacaaaccuaccaaaa

SEQ ID NO: 1699482 - RNA, 20 nt, Homo sapiens
uuauacagauagaguuccau

SEQ ID NO: 1699483 - RNA, 23 nt, Homo sapiens
uuauacagauagaguuccauaua

SEQ ID NO: 1699484 - RNA, 13 nt, Homo sapiens
uuauacauuugau

SEQ ID NO: 1699485 - RNA, 19 nt, Homo sapiens
uuauacuguggcuaugcaa

SEQ ID NO: 1699486 - RNA, 23 nt, Homo sapiens
uuauaggaaaaguuauugugaua

SEQ ID NO: 1699487 - RNA, 22 nt, Homo sapiens
uuauaguaacucccaucaccuc

SEQ ID NO: 1699488 - RNA, 22 nt, Homo sapiens
uuauauauacaguaacuuuaug

SEQ ID NO: 1699489 - RNA, 17 nt, Homo sapiens
uuauauuaauguacuug

SEQ ID NO: 1699490 - RNA, 20 nt, Homo sapiens
uuaucaaacuucagcuguac

SEQ ID NO: 1699491 - RNA, 12 nt, Homo sapiens
uuaucagcuuuc

SEQ ID NO: 1699492 - RNA, 15 nt, Homo sapiens
uuaucaucaccucaa

SEQ ID NO: 1699493 - RNA, 13 nt, Homo sapiens
gauuuccuugaau

SEQ ID NO: 1699494 - RNA, 16 nt, Homo sapiens
gauuuccuugugcaaa

SEQ ID NO: 1699495 - RNA, 17 nt, Homo sapiens
gauuugggaaccaagcu

SEQ ID NO: 1699496 - RNA, 20 nt, Homo sapiens
gauuuggggcagagggacag

SEQ ID NO: 1699497 - RNA, 17 nt, Homo sapiens
gauuuuuagcuuuacaa

SEQ ID NO: 1699498 - RNA, 16 nt, Homo sapiens
gauuuuuaugaugaug

SEQ ID NO: 1699499 - RNA, 20 nt, Homo sapiens
gcaaaaagucuacauacuuu

SEQ ID NO: 1699500 - RNA, 19 nt, Homo sapiens
gcaaaaccacuagaacucu

SEQ ID NO: 1699501 - RNA, 23 nt, Homo sapiens
gcaaaagcagugggcuccuggca

SEQ ID NO: 1699502 - RNA, 19 nt, Homo sapiens
gcaaaauuuuuuuaaucuu

SEQ ID NO: 1699503 - RNA, 22 nt, Homo sapiens
gcaaagccuagccugcauauca

SEQ ID NO: 1699504 - RNA, 19 nt, Homo sapiens
gcaaauaucauacuguuca

SEQ ID NO: 1699505 - RNA, 23 nt, Homo sapiens
gcaaauccagucccaaugguccu

SEQ ID NO: 1699506 - RNA, 15 nt, Homo sapiens
gcaaaugacaugcac

SEQ ID NO: 1699507 - RNA, 18 nt, Homo sapiens
gcaacaagaccaccacuu

SEQ ID NO: 1699508 - RNA, 21 nt, Homo sapiens
gcaacagauaaguuugcaguu

SEQ ID NO: 1699509 - RNA, 17 nt, Homo sapiens
gcaaccacacaccucac

SEQ ID NO: 1699510 - RNA, 14 nt, Homo sapiens
gcaaccacuaagaa

SEQ ID NO: 1699511 - RNA, 19 nt, Homo sapiens
gcaaccucccaacccagag

SEQ ID NO: 1699512 - RNA, 16 nt, Homo sapiens
gcaaccugauuguaaa

SEQ ID NO: 1699513 - RNA, 16 nt, Homo sapiens
gcaacucugagaucua

SEQ ID NO: 1699514 - RNA, 11 nt, Homo sapiens
gcaacugggac

SEQ ID NO: 1699515 - RNA, 22 nt, Homo sapiens
gcaacugggaccugagucaaug

SEQ ID NO: 1699516 - RNA, 23 nt, Homo sapiens
gcaacugggucugacaugaacac

SEQ ID NO: 1699517 - RNA, 16 nt, Homo sapiens
gcaagacccaucucaa

SEQ ID NO: 1699518 - RNA, 18 nt, Homo sapiens
gcaagagaggaugacaca

SEQ ID NO: 1699519 - RNA, 17 nt, Homo sapiens
gcaagcguugugcagag

SEQ ID NO: 1699520 - RNA, 22 nt, Homo sapiens
gcaaggacugcagggacugcca

SEQ ID NO: 1699521 - RNA, 16 nt, Homo sapiens
gcaaggcccugcugcc

SEQ ID NO: 1699522 - RNA, 14 nt, Homo sapiens
gcaauaaauauuag

SEQ ID NO: 1699523 - RNA, 13 nt, Homo sapiens
gcaauagaacccu

SEQ ID NO: 1699524 - RNA, 16 nt, Homo sapiens
gcaaucucagaugcag

SEQ ID NO: 1699525 - RNA, 22 nt, Homo sapiens
gcaaugccaaucuucaguauuu

SEQ ID NO: 1699526 - RNA, 17 nt, Homo sapiens
gcaaugggcacugggau

SEQ ID NO: 1699527 - RNA, 22 nt, Homo sapiens
gcaauuccgcauuuaauucaug

SEQ ID NO: 1699528 - RNA, 13 nt, Homo sapiens
gcaauuuuuccau

SEQ ID NO: 1699529 - RNA, 18 nt, Homo sapiens
gcacaauuugcacuaaau

SEQ ID NO: 1699530 - RNA, 17 nt, Homo sapiens
gcacacacacaaacaca

SEQ ID NO: 1699531 - RNA, 16 nt, Homo sapiens
gcacagaccaguuuca

SEQ ID NO: 1699532 - RNA, 14 nt, Homo sapiens
gcacagccuggcag

SEQ ID NO: 1699533 - RNA, 20 nt, Homo sapiens
gcacauccauucccaagaaa

SEQ ID NO: 1699534 - RNA, 22 nt, Homo sapiens
gcacaucugcauuuucacccca

SEQ ID NO: 1699535 - RNA, 20 nt, Homo sapiens
gcacauuccccuugccuaaa

SEQ ID NO: 1699536 - RNA, 13 nt, Homo sapiens
gcaccccacugca

SEQ ID NO: 1699537 - RNA, 17 nt, Homo sapiens
gcaccccccaagcuguu

SEQ ID NO: 1699538 - RNA, 18 nt, Homo sapiens
gcaccgggccacagagaa

SEQ ID NO: 1699539 - RNA, 17 nt, Homo sapiens
gcaccuguaaagugccu

SEQ ID NO: 1699540 - RNA, 18 nt, Homo sapiens
gcaccuuaagauuuugca

SEQ ID NO: 1699541 - RNA, 12 nt, Homo sapiens
gcacgcacacac

SEQ ID NO: 1699542 - RNA, 13 nt, Homo sapiens
gcacuauuugccg

SEQ ID NO: 1699543 - RNA, 23 nt, Homo sapiens
gcacucaaagucuggguauucau

SEQ ID NO: 1699544 - RNA, 13 nt, Homo sapiens
gcacucacgcccu

SEQ ID NO: 1699545 - RNA, 9 nt, Homo sapiens
gcacuguuu

SEQ ID NO: 1699546 - RNA, 20 nt, Homo sapiens
gcacuuacagcucuggccac

SEQ ID NO: 1699547 - RNA, 13 nt, Homo sapiens
gcacuucaucuga

SEQ ID NO: 1699548 - RNA, 15 nt, Homo sapiens
gcacuuuaaaugaag

SEQ ID NO: 1699549 - RNA, 20 nt, Homo sapiens
gcagaaauccugcaaugaaa

SEQ ID NO: 1699550 - RNA, 23 nt, Homo sapiens
gcagaagaucaaggaguacaaug

SEQ ID NO: 1699551 - RNA, 13 nt, Homo sapiens
gcagaauaaucuu

SEQ ID NO: 1699552 - RNA, 17 nt, Homo sapiens
gcagacuacacaggaug

SEQ ID NO: 1699553 - RNA, 13 nt, Homo sapiens
gcagagcauuuaa

SEQ ID NO: 1699554 - RNA, 24 nt, Homo sapiens
gcagagcgaucucggcucacugca

SEQ ID NO: 1699555 - RNA, 15 nt, Homo sapiens
gcagaggucagacua

SEQ ID NO: 1699556 - RNA, 17 nt, Homo sapiens
gcagaggucagacuaag

SEQ ID NO: 1699557 - RNA, 21 nt, Homo sapiens
gcagaggucagacuaagaaau

SEQ ID NO: 1699558 - RNA, 21 nt, Homo sapiens
gcagcacggacaauaaaccuc

SEQ ID NO: 1699559 - RNA, 23 nt, Homo sapiens
gcagcagcccuccccgcagcuag

SEQ ID NO: 1699560 - RNA, 17 nt, Homo sapiens
gcagcauggucccugcc

SEQ ID NO: 1699561 - RNA, 15 nt, Homo sapiens
gcagcauuugauaau

SEQ ID NO: 1699562 - RNA, 18 nt, Homo sapiens
gcagccaaacccaugagg

SEQ ID NO: 1699563 - RNA, 15 nt, Homo sapiens
gcagccgccuuccuu

SEQ ID NO: 1699564 - RNA, 15 nt, Homo sapiens
gcagcucacuacccu

SEQ ID NO: 1699565 - RNA, 16 nt, Homo sapiens
gcaggaguggugcaga

SEQ ID NO: 1699566 - RNA, 15 nt, Homo sapiens
gcaggcaauuucacc

SEQ ID NO: 1699567 - RNA, 16 nt, Homo sapiens
gcaggcgguggggaga

SEQ ID NO: 1699568 - RNA, 21 nt, Homo sapiens
gcaggcuaugaaguugcaaug

SEQ ID NO: 1699569 - RNA, 19 nt, Homo sapiens
gcaggcugggccaugucca

SEQ ID NO: 1699570 - RNA, 16 nt, Homo sapiens
gcagggacuccaugcu

SEQ ID NO: 1699571 - RNA, 23 nt, Homo sapiens
gcagggcaaaugacaugcacuga

SEQ ID NO: 1699572 - RNA, 18 nt, Homo sapiens
gcagggcccagugacaag

SEQ ID NO: 1699573 - RNA, 20 nt, Homo sapiens
gcagggggugugucugcuca

SEQ ID NO: 1699574 - RNA, 16 nt, Homo sapiens
gcaggugacauuugcu

SEQ ID NO: 1699575 - RNA, 17 nt, Homo sapiens
gcaguacuuuaccuccu

SEQ ID NO: 1699576 - RNA, 21 nt, Homo sapiens
gcagucgaugcguucacucca

SEQ ID NO: 1699577 - RNA, 23 nt, Homo sapiens
gcagucuccucuuuaaaacaaaa

SEQ ID NO: 1699578 - RNA, 13 nt, Homo sapiens
gcagugaaguaua

SEQ ID NO: 1699579 - RNA, 15 nt, Homo sapiens
gcaguuuaugagaca

SEQ ID NO: 1699580 - RNA, 13 nt, Homo sapiens
gcaguuuccaaua

SEQ ID NO: 1699581 - RNA, 23 nt, Homo sapiens
gcaguuuccaauaaacgcaagcu

SEQ ID NO: 1699582 - RNA, 21 nt, Homo sapiens
gcaguuugguccuggggacca

SEQ ID NO: 1699583 - RNA, 16 nt, Homo sapiens
gcauaaauaugcagug

SEQ ID NO: 1699584 - RNA, 21 nt, Homo sapiens
gcauauccaccaccucccuca

SEQ ID NO: 1699585 - RNA, 17 nt, Homo sapiens
gcaucaaacagggcaaa

SEQ ID NO: 1699586 - RNA, 15 nt, Homo sapiens
gcaucaaggugcuga

SEQ ID NO: 1699587 - RNA, 16 nt, Homo sapiens
gcaucagguccuuugg

SEQ ID NO: 1699588 - RNA, 19 nt, Homo sapiens
gcaucaucaaaaacuuugg

SEQ ID NO: 1699589 - RNA, 17 nt, Homo sapiens
gcaucccagcaccugcc

SEQ ID NO: 1699590 - RNA, 21 nt, Homo sapiens
gcaucucaaaauuauucugcc

SEQ ID NO: 1699591 - RNA, 20 nt, Homo sapiens
gcaucuucugguuuaaacuu

SEQ ID NO: 1699592 - RNA, 13 nt, Homo sapiens
gcaugggcacucc

SEQ ID NO: 1699593 - RNA, 24 nt, Homo sapiens
gcauguaugucuuggacacuguac

SEQ ID NO: 1699594 - RNA, 21 nt, Homo sapiens
gcaugucagacagaacuugaa

SEQ ID NO: 1699595 - RNA, 22 nt, Homo sapiens
gcauuaaaccugucuccacugu

SEQ ID NO: 1699596 - RNA, 14 nt, Homo sapiens
gcauuaaccugucu

SEQ ID NO: 1699597 - RNA, 18 nt, Homo sapiens
cuacuuuucuuuccucag

SEQ ID NO: 1699598 - RNA, 18 nt, Homo sapiens
cuagaaaaccagcuugcg

SEQ ID NO: 1699599 - RNA, 18 nt, Homo sapiens
cuagaaacccaagcuccu

SEQ ID NO: 1699600 - RNA, 20 nt, Homo sapiens
cuagaauuauaagucacaaa

SEQ ID NO: 1699601 - RNA, 16 nt, Homo sapiens
cuagaccuggugcuga

SEQ ID NO: 1699602 - RNA, 19 nt, Homo sapiens
cuagagauuacaauuaaau

SEQ ID NO: 1699603 - RNA, 15 nt, Homo sapiens
cuagagccagaccaa

SEQ ID NO: 1699604 - RNA, 19 nt, Homo sapiens
cuagaugauggaugccaau

SEQ ID NO: 1699605 - RNA, 15 nt, Homo sapiens
cuagauucaaagguu

SEQ ID NO: 1699606 - RNA, 18 nt, Homo sapiens
cuagauucaaagguucua

SEQ ID NO: 1699607 - RNA, 19 nt, Homo sapiens
cuagauuuucuacuuuauu

SEQ ID NO: 1699608 - RNA, 23 nt, Homo sapiens
cuagcacaauuugcacuaaauca

SEQ ID NO: 1699609 - RNA, 14 nt, Homo sapiens
cuagcaucccugag

SEQ ID NO: 1699610 - RNA, 13 nt, Homo sapiens
cuagccaauucac

SEQ ID NO: 1699611 - RNA, 20 nt, Homo sapiens
cuagccaggaaguacuucca

SEQ ID NO: 1699612 - RNA, 19 nt, Homo sapiens
cuagccuauuuaccugcag

SEQ ID NO: 1699613 - RNA, 22 nt, Homo sapiens
cuagggaaagggauauggaguu

SEQ ID NO: 1699614 - RNA, 19 nt, Homo sapiens
cuaguaaguaauuaugcac

SEQ ID NO: 1699615 - RNA, 16 nt, Homo sapiens
cuaguagcuaaccauc

SEQ ID NO: 1699616 - RNA, 18 nt, Homo sapiens
cuaguguucuguuuguua

SEQ ID NO: 1699617 - RNA, 14 nt, Homo sapiens
cuaguuuucaauca

SEQ ID NO: 1699618 - RNA, 16 nt, Homo sapiens
cuauaaagaagaacuu

SEQ ID NO: 1699619 - RNA, 22 nt, Homo sapiens
cuauaaagaagaacuugcaugg

SEQ ID NO: 1699620 - RNA, 16 nt, Homo sapiens
cuauaaauauguacaa

SEQ ID NO: 1699621 - RNA, 18 nt, Homo sapiens
cuauaaggccauaaaaca

SEQ ID NO: 1699622 - RNA, 17 nt, Homo sapiens
cuauaauaaaacuaaac

SEQ ID NO: 1699623 - RNA, 19 nt, Homo sapiens
cuauaaucccagcacuuug

SEQ ID NO: 1699624 - RNA, 13 nt, Homo sapiens
cuauaaucuguca

SEQ ID NO: 1699625 - RNA, 12 nt, Homo sapiens
cuauaaugugug

SEQ ID NO: 1699626 - RNA, 15 nt, Homo sapiens
cuauauacaugugug

SEQ ID NO: 1699627 - RNA, 15 nt, Homo sapiens
cuauauccugugacu

SEQ ID NO: 1699628 - RNA, 14 nt, Homo sapiens
cuauauuugcuaga

SEQ ID NO: 1699629 - RNA, 21 nt, Homo sapiens
cuauauuugcuuuuugcuaac

SEQ ID NO: 1699630 - RNA, 21 nt, Homo sapiens
cuaucauacuacugaaacaga

SEQ ID NO: 1699631 - RNA, 14 nt, Homo sapiens
cuaucgaacuucac

SEQ ID NO: 1699632 - RNA, 12 nt, Homo sapiens
cuaugagucuag

SEQ ID NO: 1699633 - RNA, 19 nt, Homo sapiens
cuaugcaacagcucucacc

SEQ ID NO: 1699634 - RNA, 18 nt, Homo sapiens
cuaugcauuaagaguaaa

SEQ ID NO: 1699635 - RNA, 14 nt, Homo sapiens
cuauggacagggcu

SEQ ID NO: 1699636 - RNA, 13 nt, Homo sapiens
cuauguacuuuaa

SEQ ID NO: 1699637 - RNA, 21 nt, Homo sapiens
cuaugucaagaggcugaauua

SEQ ID NO: 1699638 - RNA, 15 nt, Homo sapiens
cuaugugauuacaag

SEQ ID NO: 1699639 - RNA, 14 nt, Homo sapiens
cuauguugcccagg

SEQ ID NO: 1699640 - RNA, 18 nt, Homo sapiens
cuauucaggagaguagaa

SEQ ID NO: 1699641 - RNA, 22 nt, Homo sapiens
cuauuccauggcuaacuggcga

SEQ ID NO: 1699642 - RNA, 21 nt, Homo sapiens
cuauucgaaugaaaagacaag

SEQ ID NO: 1699643 - RNA, 18 nt, Homo sapiens
cuauucugagaaaacaag

SEQ ID NO: 1699644 - RNA, 23 nt, Homo sapiens
cuauucugagcauacucaacaaa

SEQ ID NO: 1699645 - RNA, 16 nt, Homo sapiens
cuauugacuucaauga

SEQ ID NO: 1699646 - RNA, 13 nt, Homo sapiens
cucaaacuaucug

SEQ ID NO: 1699647 - RNA, 22 nt, Homo sapiens
cucaaacucuugaccucaggug

SEQ ID NO: 1699648 - RNA, 13 nt, Homo sapiens
cucaaaucuccag

SEQ ID NO: 1699649 - RNA, 19 nt, Homo sapiens
cucaacaauaaaacauuau

SEQ ID NO: 1699650 - RNA, 13 nt, Homo sapiens
cucaacugaggau

SEQ ID NO: 1699651 - RNA, 12 nt, Homo sapiens
cucaagcacuga

SEQ ID NO: 1699652 - RNA, 17 nt, Homo sapiens
cucaaggaauuugcauu

SEQ ID NO: 1699653 - RNA, 19 nt, Homo sapiens
cucaagguggucaguaaau

SEQ ID NO: 1699654 - RNA, 22 nt, Homo sapiens
cucaagugauucuccugccuca

SEQ ID NO: 1699655 - RNA, 20 nt, Homo sapiens
cucaaguucauugaugaccc

SEQ ID NO: 1699656 - RNA, 19 nt, Homo sapiens
cucaauaaaugauucuuag

SEQ ID NO: 1699657 - RNA, 10 nt, Homo sapiens
cucaauguuu

SEQ ID NO: 1699658 - RNA, 14 nt, Homo sapiens
cucaauuugcagua

SEQ ID NO: 1699659 - RNA, 16 nt, Homo sapiens
cucaauuuuugucuca

SEQ ID NO: 1699660 - RNA, 18 nt, Homo sapiens
cucacaaaccaugcaaau

SEQ ID NO: 1699661 - RNA, 14 nt, Homo sapiens
cucacaaagagaua

SEQ ID NO: 1699662 - RNA, 14 nt, Homo sapiens
cucacacacauaga

SEQ ID NO: 1699663 - RNA, 20 nt, Homo sapiens
cucacagaugugacuguaua

SEQ ID NO: 1699664 - RNA, 22 nt, Homo sapiens
cucacaguaacccaaaccucaa

SEQ ID NO: 1699665 - RNA, 19 nt, Homo sapiens
cucacauuuauucugcuca

SEQ ID NO: 1699666 - RNA, 19 nt, Homo sapiens
cucaccagccccacugcca

SEQ ID NO: 1699667 - RNA, 23 nt, Homo sapiens
cucacccccagcuuugcuaccaa

SEQ ID NO: 1699668 - RNA, 13 nt, Homo sapiens
cucacugauauau

SEQ ID NO: 1699669 - RNA, 22 nt, Homo sapiens
cucagaagacacugaugggcaa

SEQ ID NO: 1699670 - RNA, 23 nt, Homo sapiens
cucagacagaaccccuacaugaa

SEQ ID NO: 1699671 - RNA, 12 nt, Homo sapiens
cucagaccugaa

SEQ ID NO: 1699672 - RNA, 20 nt, Homo sapiens
cucagagaccugaagugugc

SEQ ID NO: 1699673 - RNA, 23 nt, Homo sapiens
cucagcauuucuuuucuggccaa

SEQ ID NO: 1699674 - RNA, 20 nt, Homo sapiens
cucagccacacccaggcacu

SEQ ID NO: 1699675 - RNA, 21 nt, Homo sapiens
cucagccacacccaggcacuu

SEQ ID NO: 1699676 - RNA, 16 nt, Homo sapiens
cucagcucggggagcc

SEQ ID NO: 1699677 - RNA, 18 nt, Homo sapiens
cucaggaagccucugggu

SEQ ID NO: 1699678 - RNA, 17 nt, Homo sapiens
cucagggacagagccau

SEQ ID NO: 1699679 - RNA, 17 nt, Homo sapiens
cucagggcagccucccc

SEQ ID NO: 1699680 - RNA, 20 nt, Homo sapiens
cucaggggccaacuaggcag

SEQ ID NO: 1699681 - RNA, 22 nt, Homo sapiens
cucaggugaaaauccaucucau

SEQ ID NO: 1699682 - RNA, 15 nt, Homo sapiens
cucaguaaaaguaaa

SEQ ID NO: 1699683 - RNA, 15 nt, Homo sapiens
cucagucaugcauaa

SEQ ID NO: 1699684 - RNA, 11 nt, Homo sapiens
gacagggccag

SEQ ID NO: 1699685 - RNA, 17 nt, Homo sapiens
gacagggucggccugua

SEQ ID NO: 1699686 - RNA, 21 nt, Homo sapiens
gacagucacugccacuuugca

SEQ ID NO: 1699687 - RNA, 23 nt, Homo sapiens
gacagugacuggugccaguguca

SEQ ID NO: 1699688 - RNA, 15 nt, Homo sapiens
ccucaucauuuccca

SEQ ID NO: 1699689 - RNA, 22 nt, Homo sapiens
ccucaucauuucccaucuggac

SEQ ID NO: 1699690 - RNA, 22 nt, Homo sapiens
ccucauugcagcuagaggcauc

SEQ ID NO: 1699691 - RNA, 20 nt, Homo sapiens
ccuccaagcuccaucuccac

SEQ ID NO: 1699692 - RNA, 22 nt, Homo sapiens
ccuccagcuucaggcaggccaa

SEQ ID NO: 1699693 - RNA, 22 nt, Homo sapiens
ccuccaggaugaguuacuugaa

SEQ ID NO: 1699694 - RNA, 18 nt, Homo sapiens
ccucccaaggagaacaaa

SEQ ID NO: 1699695 - RNA, 16 nt, Homo sapiens
ccucccaccucuguga

SEQ ID NO: 1699696 - RNA, 15 nt, Homo sapiens
ccucccucaccaaca

SEQ ID NO: 1699697 - RNA, 16 nt, Homo sapiens
ccuccgaccacuucca

SEQ ID NO: 1699698 - RNA, 15 nt, Homo sapiens
ccuccgccaaugcac

SEQ ID NO: 1699699 - RNA, 18 nt, Homo sapiens
ccuccgccagauccugca

SEQ ID NO: 1699700 - RNA, 20 nt, Homo sapiens
ccuccuacccuuccagugcc

SEQ ID NO: 1699701 - RNA, 14 nt, Homo sapiens
ccuccuggugccca

SEQ ID NO: 1699702 - RNA, 19 nt, Homo sapiens
ccucgcugccagaugauug

SEQ ID NO: 1699703 - RNA, 13 nt, Homo sapiens
ccucuaauugcau

SEQ ID NO: 1699704 - RNA, 12 nt, Homo sapiens
ccucucucaaaa

SEQ ID NO: 1699705 - RNA, 14 nt, Homo sapiens
ccucucucaggggu

SEQ ID NO: 1699706 - RNA, 17 nt, Homo sapiens
ccucugaccugcacugg

SEQ ID NO: 1699707 - RNA, 16 nt, Homo sapiens
ccucuggagcccuaac

SEQ ID NO: 1699708 - RNA, 13 nt, Homo sapiens
ccucuggcucuca

SEQ ID NO: 1699709 - RNA, 16 nt, Homo sapiens
ccucugggaaccuccc

SEQ ID NO: 1699710 - RNA, 19 nt, Homo sapiens
ccucuuaaagcugccugua

SEQ ID NO: 1699711 - RNA, 14 nt, Homo sapiens
ccucuuauugcaaa

SEQ ID NO: 1699712 - RNA, 21 nt, Homo sapiens
ccucuucccccuuccaaauaa

SEQ ID NO: 1699713 - RNA, 15 nt, Homo sapiens
ccugaaaauucugua

SEQ ID NO: 1699714 - RNA, 13 nt, Homo sapiens
ccugaagacugag

SEQ ID NO: 1699715 - RNA, 20 nt, Homo sapiens
ccugaaggaaaauaaacuga

SEQ ID NO: 1699716 - RNA, 18 nt, Homo sapiens
ccugaaggaaaaugacuc

SEQ ID NO: 1699717 - RNA, 20 nt, Homo sapiens
ccugaagucacacagugagu

SEQ ID NO: 1699718 - RNA, 21 nt, Homo sapiens
ccugaauucuuuuucauuuga

SEQ ID NO: 1699719 - RNA, 19 nt, Homo sapiens
cgaggacugauacugcagu

SEQ ID NO: 1699720 - RNA, 18 nt, Homo sapiens
cgagggucaggacuguga

SEQ ID NO: 1699721 - RNA, 15 nt, Homo sapiens
cgagucacacucaag

SEQ ID NO: 1699722 - RNA, 14 nt, Homo sapiens
cgagucucuucucc

SEQ ID NO: 1699723 - RNA, 12 nt, Homo sapiens
cgaucuggguuc

SEQ ID NO: 1699724 - RNA, 17 nt, Homo sapiens
cgaugcguucacuccaa

SEQ ID NO: 1699725 - RNA, 13 nt, Homo sapiens
cgaugcugcuaug

SEQ ID NO: 1699726 - RNA, 15 nt, Homo sapiens
cgauguguccaaucg

SEQ ID NO: 1699727 - RNA, 16 nt, Homo sapiens
cgauugaaagaaccag

SEQ ID NO: 1699728 - RNA, 17 nt, Homo sapiens
cgauuugggaaccaagc

SEQ ID NO: 1699729 - RNA, 13 nt, Homo sapiens
cgcacgcacacac

SEQ ID NO: 1699730 - RNA, 15 nt, Homo sapiens
cgcacuucagaauuc

SEQ ID NO: 1699731 - RNA, 21 nt, Homo sapiens
cgcagaaaacaagaugagauu

SEQ ID NO: 1699732 - RNA, 20 nt, Homo sapiens
cgcagcccuggcagggggca

SEQ ID NO: 1699733 - RNA, 13 nt, Homo sapiens
cgccacucgcuuc

SEQ ID NO: 1699734 - RNA, 20 nt, Homo sapiens
cgcccaggcuggagugcagu

SEQ ID NO: 1699735 - RNA, 19 nt, Homo sapiens
cgcccuuggcuucugugau

SEQ ID NO: 1699736 - RNA, 21 nt, Homo sapiens
cgccuguaaucccaacacuuu

SEQ ID NO: 1699737 - RNA, 22 nt, Homo sapiens
cgcgccccacgagaccccggcu

SEQ ID NO: 1699738 - RNA, 14 nt, Homo sapiens
cgcguacagaucuc

SEQ ID NO: 1699739 - RNA, 12 nt, Homo sapiens
cgcuauugauuu

SEQ ID NO: 1699740 - RNA, 17 nt, Homo sapiens
cgcucucagcugaccau

SEQ ID NO: 1699741 - RNA, 12 nt, Homo sapiens
cgcucuguggau

SEQ ID NO: 1699742 - RNA, 22 nt, Homo sapiens
cgcucuuggcagguacucagcg

SEQ ID NO: 1699743 - RNA, 21 nt, Homo sapiens
cgcugagugggagaaggcagu

SEQ ID NO: 1699744 - RNA, 16 nt, Homo sapiens
cgcuuaguuaucagcu

SEQ ID NO: 1699745 - RNA, 16 nt, Homo sapiens
cggacccaucuuugcu

SEQ ID NO: 1699746 - RNA, 16 nt, Homo sapiens
cggagacaaaagcagu

SEQ ID NO: 1699747 - RNA, 20 nt, Homo sapiens
cggagacaaaagcaguuucu

SEQ ID NO: 1699748 - RNA, 16 nt, Homo sapiens
cggagaucuccuugcc

SEQ ID NO: 1699749 - RNA, 15 nt, Homo sapiens
cggaucauucacugu

SEQ ID NO: 1699750 - RNA, 16 nt, Homo sapiens
cggauccagcaauucc

SEQ ID NO: 1699751 - RNA, 12 nt, Homo sapiens
cggcacauuccc

SEQ ID NO: 1699752 - RNA, 17 nt, Homo sapiens
cgggaagcgcucagaac

SEQ ID NO: 1699753 - RNA, 20 nt, Homo sapiens
cgggacagauggacagacag

SEQ ID NO: 1699754 - RNA, 21 nt, Homo sapiens
cgggcgcggccagccccggcc

SEQ ID NO: 1699755 - RNA, 15 nt, Homo sapiens
cggggcuccacugaa

SEQ ID NO: 1699756 - RNA, 11 nt, Homo sapiens
cgguccagcug

SEQ ID NO: 1699757 - RNA, 11 nt, Homo sapiens
cgguguucuaa

SEQ ID NO: 1699758 - RNA, 14 nt, Homo sapiens
cgguuaaauacugu

SEQ ID NO: 1699759 - RNA, 21 nt, Homo sapiens
cgguuaaauacuguguggaac

SEQ ID NO: 1699760 - RNA, 22 nt, Homo sapiens
cgguuuacagcuaucgaacuuc

SEQ ID NO: 1699761 - RNA, 20 nt, Homo sapiens
cgguuugaaaauaugccugc

SEQ ID NO: 1699762 - RNA, 13 nt, Homo sapiens
cgguuuucauuga

SEQ ID NO: 1699763 - RNA, 14 nt, Homo sapiens
cguaacaacugugg

SEQ ID NO: 1699764 - RNA, 12 nt, Homo sapiens
cguacauucaau

SEQ ID NO: 1699765 - RNA, 19 nt, Homo sapiens
cguagcuucuaccaugaac

SEQ ID NO: 1699766 - RNA, 18 nt, Homo sapiens
cguagcuuucccaaauaa

SEQ ID NO: 1699767 - RNA, 19 nt, Homo sapiens
cguaucccgagucugggac

SEQ ID NO: 1699768 - RNA, 20 nt, Homo sapiens
cguaugguggcucaugucua

SEQ ID NO: 1699769 - RNA, 17 nt, Homo sapiens
cgucuccgaagauuugg

SEQ ID NO: 1699770 - RNA, 15 nt, Homo sapiens
cgugaggucccagga

SEQ ID NO: 1699771 - RNA, 13 nt, Homo sapiens
cgugauaaugcag

SEQ ID NO: 1699772 - RNA, 20 nt, Homo sapiens
cgugauaaugcagacuuccu

SEQ ID NO: 1699773 - RNA, 18 nt, Homo sapiens
cgugcccgugugcauguc

SEQ ID NO: 1699774 - RNA, 21 nt, Homo sapiens
cguguguugcaccaggcacug

SEQ ID NO: 1699775 - RNA, 20 nt, Homo sapiens
cguguugcaugaaggagcag

SEQ ID NO: 1699776 - RNA, 16 nt, Homo sapiens
cguucugcaagcauca

SEQ ID NO: 1699777 - RNA, 13 nt, Homo sapiens
cguuguacuccag

SEQ ID NO: 1699778 - RNA, 21 nt, Homo sapiens
cguuucccagagucaucugau

SEQ ID NO: 1699779 - RNA, 22 nt, Homo sapiens
cguuucuccaccuagacuguaa

SEQ ID NO: 1699780 - RNA, 13 nt, Homo sapiens
cuaaaaauccaga

SEQ ID NO: 1699781 - RNA, 14 nt, Homo sapiens
cuaaaacugcauuu

SEQ ID NO: 1699782 - RNA, 21 nt, Homo sapiens
cuaaaauaauuuuauuaugca

SEQ ID NO: 1699783 - RNA, 18 nt, Homo sapiens
cuaaaauauauuccugag

SEQ ID NO: 1699784 - RNA, 16 nt, Homo sapiens
cuaaagccagccugac

SEQ ID NO: 1699785 - RNA, 17 nt, Homo sapiens
cuaaaguauaucuuuaa

SEQ ID NO: 1699786 - RNA, 21 nt, Homo sapiens
cuaaauaauguuaucugugua

SEQ ID NO: 1699787 - RNA, 18 nt, Homo sapiens
cuaaaucugccuuuucau

SEQ ID NO: 1699788 - RNA, 11 nt, Homo sapiens
cuaaaugccuu

SEQ ID NO: 1699789 - RNA, 17 nt, Homo sapiens
cuaaauuuaaugcugcc

SEQ ID NO: 1699790 - RNA, 21 nt, Homo sapiens
cuaaauuuggggacagauuca

SEQ ID NO: 1699791 - RNA, 11 nt, Homo sapiens
cuaacaaaaga

SEQ ID NO: 1699792 - RNA, 17 nt, Homo sapiens
cuaacaggucuagaaaa

SEQ ID NO: 1699793 - RNA, 19 nt, Homo sapiens
cuaacuauauuugcuuuuu

SEQ ID NO: 1699794 - RNA, 16 nt, Homo sapiens
cuaacuguacauuuca

SEQ ID NO: 1699795 - RNA, 22 nt, Homo sapiens
cuaagcgaauguguacaaagug

SEQ ID NO: 1699796 - RNA, 23 nt, Homo sapiens
cuaagcgaauguguacaaagugu

SEQ ID NO: 1699797 - RNA, 21 nt, Homo sapiens
cuaagcgaggcaugccugaga

SEQ ID NO: 1699798 - RNA, 15 nt, Homo sapiens
cuaagcgcacauuca

SEQ ID NO: 1699799 - RNA, 21 nt, Homo sapiens
cuaaggaagauaucuaguguu

SEQ ID NO: 1699800 - RNA, 15 nt, Homo sapiens
cuaaguauuaaaaca

SEQ ID NO: 1699801 - RNA, 16 nt, Homo sapiens
cuaagucucugugaau

SEQ ID NO: 1699802 - RNA, 13 nt, Homo sapiens
cuaauaaacaauu

SEQ ID NO: 1699803 - RNA, 23 nt, Homo sapiens
cuaauacuacugcacagagucag

SEQ ID NO: 1699804 - RNA, 20 nt, Homo sapiens
ccagcugccuuggacugugu

SEQ ID NO: 1699805 - RNA, 21 nt, Homo sapiens
ccagcuggccuggacaguauc

SEQ ID NO: 1699806 - RNA, 22 nt, Homo sapiens
ccagcugugggacaauuaucug

SEQ ID NO: 1699807 - RNA, 21 nt, Homo sapiens
ccagcuuaugagcucaaagua

SEQ ID NO: 1699808 - RNA, 16 nt, Homo sapiens
ccagcuuguaggagcu

SEQ ID NO: 1699809 - RNA, 22 nt, Homo sapiens
ccaggacggggcacaaguguca

SEQ ID NO: 1699810 - RNA, 22 nt, Homo sapiens
ccaggaguucgaggcugcaguc

SEQ ID NO: 1699811 - RNA, 19 nt, Homo sapiens
ccaggaucaugguguaaua

SEQ ID NO: 1699812 - RNA, 20 nt, Homo sapiens
ccaggaucaugguguaauaa

SEQ ID NO: 1699813 - RNA, 13 nt, Homo sapiens
ccaggcauggugg

SEQ ID NO: 1699814 - RNA, 21 nt, Homo sapiens
ccaggcccugcucuuccucag

SEQ ID NO: 1699815 - RNA, 13 nt, Homo sapiens
ccaggcuaccauc

SEQ ID NO: 1699816 - RNA, 15 nt, Homo sapiens
ccaggcuaugccauc

SEQ ID NO: 1699817 - RNA, 20 nt, Homo sapiens
ccaggcuggagugcaguggu

SEQ ID NO: 1699818 - RNA, 15 nt, Homo sapiens
ccaggcugugcagcg

SEQ ID NO: 1699819 - RNA, 14 nt, Homo sapiens
ccaggcuuuguaca

SEQ ID NO: 1699820 - RNA, 17 nt, Homo sapiens
ccagggcucugccccag

SEQ ID NO: 1699821 - RNA, 18 nt, Homo sapiens
ccaggggaaccugccaug

SEQ ID NO: 1699822 - RNA, 13 nt, Homo sapiens
ccagggucucacu

SEQ ID NO: 1699823 - RNA, 20 nt, Homo sapiens
ccagggugggagggcuaggg

SEQ ID NO: 1699824 - RNA, 15 nt, Homo sapiens
ccaggucucacgggc

SEQ ID NO: 1699825 - RNA, 18 nt, Homo sapiens
ccaggucugcagcuccag

SEQ ID NO: 1699826 - RNA, 14 nt, Homo sapiens
ccaguaacuuuucu

SEQ ID NO: 1699827 - RNA, 20 nt, Homo sapiens
ccaguaccugaaagcacugu

SEQ ID NO: 1699828 - RNA, 23 nt, Homo sapiens
ccagucaugagcguuagacugac

SEQ ID NO: 1699829 - RNA, 12 nt, Homo sapiens
ccaguccaugag

SEQ ID NO: 1699830 - RNA, 15 nt, Homo sapiens
ccagucccaaugcac

SEQ ID NO: 1699831 - RNA, 13 nt, Homo sapiens
ccagucucuggca

SEQ ID NO: 1699832 - RNA, 14 nt, Homo sapiens
ccagucucuggcag

SEQ ID NO: 1699833 - RNA, 19 nt, Homo sapiens
ccagugagauuacagagga

SEQ ID NO: 1699834 - RNA, 13 nt, Homo sapiens
ccagugccaagga

SEQ ID NO: 1699835 - RNA, 22 nt, Homo sapiens
ccaguguccccuccacugucac

SEQ ID NO: 1699836 - RNA, 14 nt, Homo sapiens
ccaguguucuauga

SEQ ID NO: 1699837 - RNA, 18 nt, Homo sapiens
ccaguguucuaugaacaa

SEQ ID NO: 1699838 - RNA, 23 nt, Homo sapiens
ccaguucuacuauggcugaguuc

SEQ ID NO: 1699839 - RNA, 14 nt, Homo sapiens
auuuguuaucucaa

SEQ ID NO: 1699840 - RNA, 18 nt, Homo sapiens
auuuuaaaucauuaggaa

SEQ ID NO: 1699841 - RNA, 14 nt, Homo sapiens
auuuuaaggacugc

SEQ ID NO: 1699842 - RNA, 23 nt, Homo sapiens
auuuuacuauuggaaucugauau

SEQ ID NO: 1699843 - RNA, 20 nt, Homo sapiens
auuuuagaauaaauucccaa

SEQ ID NO: 1699844 - RNA, 13 nt, Homo sapiens
auuuuauuauaau

SEQ ID NO: 1699845 - RNA, 17 nt, Homo sapiens
auuuucaaaagcauuaa

SEQ ID NO: 1699846 - RNA, 20 nt, Homo sapiens
auuuucagaaaauauuaugu

SEQ ID NO: 1699847 - RNA, 22 nt, Homo sapiens
auuuuccccccacucuccccac

SEQ ID NO: 1699848 - RNA, 15 nt, Homo sapiens
auuuucuagacuuuc

SEQ ID NO: 1699849 - RNA, 12 nt, Homo sapiens
auuuucugucag

SEQ ID NO: 1699850 - RNA, 20 nt, Homo sapiens
auuuucuuuacaauuucacu

SEQ ID NO: 1699851 - RNA, 14 nt, Homo sapiens
auuuugagaucauc

SEQ ID NO: 1699852 - RNA, 15 nt, Homo sapiens
auuuugauccaagcu

SEQ ID NO: 1699853 - RNA, 17 nt, Homo sapiens
auuuugggaaguugcau

SEQ ID NO: 1699854 - RNA, 20 nt, Homo sapiens
auuuugggguacccacugcu

SEQ ID NO: 1699855 - RNA, 13 nt, Homo sapiens
auuuuggucacag

SEQ ID NO: 1699856 - RNA, 13 nt, Homo sapiens
auuuugugcaaaa

SEQ ID NO: 1699857 - RNA, 13 nt, Homo sapiens
auuuuuacugugu

SEQ ID NO: 1699858 - RNA, 16 nt, Homo sapiens
auuuuuagacagaguc

SEQ ID NO: 1699859 - RNA, 20 nt, Homo sapiens
auuuuuauaauaaacauaau

SEQ ID NO: 1699860 - RNA, 16 nt, Homo sapiens
auuuuuauacuuucag

SEQ ID NO: 1699861 - RNA, 15 nt, Homo sapiens
auuuuuccacuuaaa

SEQ ID NO: 1699862 - RNA, 13 nt, Homo sapiens
auuuuucuaucaa

SEQ ID NO: 1699863 - RNA, 23 nt, Homo sapiens
auuuuuucucuguaaacuuccaa

SEQ ID NO: 1699864 - RNA, 15 nt, Homo sapiens
auuuuuuugagacag

SEQ ID NO: 1699865 - RNA, 13 nt, Homo sapiens
caaaaaaaccaca

SEQ ID NO: 1699866 - RNA, 17 nt, Homo sapiens
caaaaaaaccacaaagg

SEQ ID NO: 1699867 - RNA, 13 nt, Homo sapiens
caaaaacuuugga

SEQ ID NO: 1699868 - RNA, 21 nt, Homo sapiens
caaaaauggauauuauuagaa

SEQ ID NO: 1699869 - RNA, 14 nt, Homo sapiens
caaaaauuaucuau

SEQ ID NO: 1699870 - RNA, 22 nt, Homo sapiens
caaaaauugaagagagauauau

SEQ ID NO: 1699871 - RNA, 15 nt, Homo sapiens
caaaacuacaugaga

SEQ ID NO: 1699872 - RNA, 17 nt, Homo sapiens
caaaagaugccauucau

SEQ ID NO: 1699873 - RNA, 18 nt, Homo sapiens
caaaagaugccauucaua

SEQ ID NO: 1699874 - RNA, 14 nt, Homo sapiens
caaaaggaaaaagc

SEQ ID NO: 1699875 - RNA, 17 nt, Homo sapiens
caaaagggccauguuuc

SEQ ID NO: 1699876 - RNA, 18 nt, Homo sapiens
caaaauaaaaagugacac

SEQ ID NO: 1699877 - RNA, 19 nt, Homo sapiens
caaaaugucuaagauagua

SEQ ID NO: 1699878 - RNA, 19 nt, Homo sapiens
caaaauugcaaaucuugaa

SEQ ID NO: 1699879 - RNA, 20 nt, Homo sapiens
caaaauuugaugccaggaca

SEQ ID NO: 1699880 - RNA, 19 nt, Homo sapiens
caaaauuuuauaagcaaau

SEQ ID NO: 1699881 - RNA, 14 nt, Homo sapiens
caaacaaauaugca

SEQ ID NO: 1699882 - RNA, 18 nt, Homo sapiens
caaacacaggauuuguaa

SEQ ID NO: 1699883 - RNA, 15 nt, Homo sapiens
caaaccuaccaaaau

SEQ ID NO: 1699884 - RNA, 13 nt, Homo sapiens
caaacuaaaagac

SEQ ID NO: 1699885 - RNA, 13 nt, Homo sapiens
caaacuaaaggug

SEQ ID NO: 1699886 - RNA, 18 nt, Homo sapiens
auggaccagugguuucca

SEQ ID NO: 1699887 - RNA, 13 nt, Homo sapiens
auggacucugcac

SEQ ID NO: 1699888 - RNA, 21 nt, Homo sapiens
auggagcagccuggagaccca

SEQ ID NO: 1699889 - RNA, 17 nt, Homo sapiens
auggagcaggacucuau

SEQ ID NO: 1699890 - RNA, 22 nt, Homo sapiens
auggauaaaauaaugcugcaaa

SEQ ID NO: 1699891 - RNA, 22 nt, Homo sapiens
auggauccagaacugcacucuu

SEQ ID NO: 1699892 - RNA, 20 nt, Homo sapiens
auggaucccgaagaauggag

SEQ ID NO: 1699893 - RNA, 18 nt, Homo sapiens
auggauugggggggccaa

SEQ ID NO: 1699894 - RNA, 16 nt, Homo sapiens
auggauuugaugcugu

SEQ ID NO: 1699895 - RNA, 16 nt, Homo sapiens
auggcagaaccaaagc

SEQ ID NO: 1699896 - RNA, 15 nt, Homo sapiens
auggcagaagacacc

SEQ ID NO: 1699897 - RNA, 23 nt, Homo sapiens
auggcauugaacugguucaugaa

SEQ ID NO: 1699898 - RNA, 22 nt, Homo sapiens
auggccauagcuuuuauucauu

SEQ ID NO: 1699899 - RNA, 18 nt, Homo sapiens
auggccccaguccaugcu

SEQ ID NO: 1699900 - RNA, 21 nt, Homo sapiens
auggcuacuuugguuucuguc

SEQ ID NO: 1699901 - RNA, 14 nt, Homo sapiens
auggcuccagaaau

SEQ ID NO: 1699902 - RNA, 17 nt, Homo sapiens
auggcuccuccauaucu

SEQ ID NO: 1699903 - RNA, 16 nt, Homo sapiens
augggacucaaugcac

SEQ ID NO: 1699904 - RNA, 13 nt, Homo sapiens
augggacugagcc

SEQ ID NO: 1699905 - RNA, 13 nt, Homo sapiens
auggggacacaga

SEQ ID NO: 1699906 - RNA, 21 nt, Homo sapiens
auggggacacagaucauggua

SEQ ID NO: 1699907 - RNA, 18 nt, Homo sapiens
augguacuauguuagccc

SEQ ID NO: 1699908 - RNA, 19 nt, Homo sapiens
auggugaagaacuagcaua

SEQ ID NO: 1699909 - RNA, 14 nt, Homo sapiens
augguuuuacucau

SEQ ID NO: 1699910 - RNA, 19 nt, Homo sapiens
augguuuuacucaugugca

SEQ ID NO: 1699911 - RNA, 16 nt, Homo sapiens
auguaaaauccaucca

SEQ ID NO: 1699912 - RNA, 17 nt, Homo sapiens
auguaaaauccauccaa

SEQ ID NO: 1699913 - RNA, 16 nt, Homo sapiens
auguaaucucaccuca

SEQ ID NO: 1699914 - RNA, 16 nt, Homo sapiens
auguaauuuaggguac

SEQ ID NO: 1699915 - RNA, 23 nt, Homo sapiens
auguacagacauacauuuaugca

SEQ ID NO: 1699916 - RNA, 18 nt, Homo sapiens
auguaccguaggcuuugu

SEQ ID NO: 1699917 - RNA, 23 nt, Homo sapiens
auguaccuucuuucacucuguca

SEQ ID NO: 1699918 - RNA, 16 nt, Homo sapiens
auguacuuguuugcaa

SEQ ID NO: 1699919 - RNA, 18 nt, Homo sapiens
auguaggcaucaugcaug

SEQ ID NO: 1699920 - RNA, 18 nt, Homo sapiens
auguaguugauguaucca

SEQ ID NO: 1699921 - RNA, 17 nt, Homo sapiens
auguaucugaguugcca

SEQ ID NO: 1699922 - RNA, 22 nt, Homo sapiens
auguaugucuuggacacuguac

SEQ ID NO: 1699923 - RNA, 21 nt, Homo sapiens
auguauuuauuugggagaccg

SEQ ID NO: 1699924 - RNA, 15 nt, Homo sapiens
auguccugccuuuua

SEQ ID NO: 1699925 - RNA, 22 nt, Homo sapiens
augucuauaaucccagcacuuu

SEQ ID NO: 1699926 - RNA, 22 nt, Homo sapiens
augucuccacuuucacccgcag

SEQ ID NO: 1699927 - RNA, 17 nt, Homo sapiens
augucuuguacaugugu

SEQ ID NO: 1699928 - RNA, 16 nt, Homo sapiens
augugaaaaauguguc

SEQ ID NO: 1699929 - RNA, 13 nt, Homo sapiens
augugaggauuuu

SEQ ID NO: 1699930 - RNA, 13 nt, Homo sapiens
augugccauuuau

SEQ ID NO: 1699931 - RNA, 20 nt, Homo sapiens
aucuaaggaugucacagggc

SEQ ID NO: 1699932 - RNA, 14 nt, Homo sapiens
aucuacuaauucca

SEQ ID NO: 1699933 - RNA, 22 nt, Homo sapiens
aucuagguucaggaagaccaca

SEQ ID NO: 1699934 - RNA, 22 nt, Homo sapiens
aucuauagcuaaguacacaaua

SEQ ID NO: 1699935 - RNA, 20 nt, Homo sapiens
aucuauauauguguauguac

SEQ ID NO: 1699936 - RNA, 10 nt, Homo sapiens
aucuauccaa

SEQ ID NO: 1699937 - RNA, 19 nt, Homo sapiens
aucuaugagcugacaucuc

SEQ ID NO: 1699938 - RNA, 15 nt, Homo sapiens
aucucaaacuaugac

SEQ ID NO: 1699939 - RNA, 18 nt, Homo sapiens
aucucagcgugggccaga

SEQ ID NO: 1699940 - RNA, 13 nt, Homo sapiens
aucucagcuuuga

SEQ ID NO: 1699941 - RNA, 17 nt, Homo sapiens
aucucauagguugccaa

SEQ ID NO: 1699942 - RNA, 20 nt, Homo sapiens
aucuccaguauucuugucaa

SEQ ID NO: 1699943 - RNA, 20 nt, Homo sapiens
aucuccaucugucaacaggg

SEQ ID NO: 1699944 - RNA, 21 nt, Homo sapiens
aucucccacccuguaccucau

SEQ ID NO: 1699945 - RNA, 15 nt, Homo sapiens
aucuccuguccauca

SEQ ID NO: 1699946 - RNA, 17 nt, Homo sapiens
aucuccuguccaucagc

SEQ ID NO: 1699947 - RNA, 15 nt, Homo sapiens
aucucuacuaaaaau

SEQ ID NO: 1699948 - RNA, 16 nt, Homo sapiens
aucucucaaaucuguu

SEQ ID NO: 1699949 - RNA, 17 nt, Homo sapiens
aucugaguugccaagac

SEQ ID NO: 1699950 - RNA, 23 nt, Homo sapiens
aucugaucgggggcguagcauca

SEQ ID NO: 1699951 - RNA, 15 nt, Homo sapiens
aucugauuugcauau

SEQ ID NO: 1699952 - RNA, 18 nt, Homo sapiens
aucugauuugcauauuca

SEQ ID NO: 1699953 - RNA, 14 nt, Homo sapiens
aucuguaucuugcc

SEQ ID NO: 1699954 - RNA, 16 nt, Homo sapiens
aucugucacaccagcc

SEQ ID NO: 1699955 - RNA, 16 nt, Homo sapiens
aucugucucuucuaca

SEQ ID NO: 1699956 - RNA, 19 nt, Homo sapiens
aucugugaaguaguucugu

SEQ ID NO: 1699957 - RNA, 19 nt, Homo sapiens
aucuguuuuucaccacuuc

SEQ ID NO: 1699958 - RNA, 14 nt, Homo sapiens
aucuuaagauccac

SEQ ID NO: 1699959 - RNA, 16 nt, Homo sapiens
aucuucucaaguucua

SEQ ID NO: 1699960 - RNA, 21 nt, Homo sapiens
aucuucugggagcaggaacaa

SEQ ID NO: 1699961 - RNA, 17 nt, Homo sapiens
aucuugcucugcugaca

SEQ ID NO: 1699962 - RNA, 15 nt, Homo sapiens
aucuuggaaguacau

SEQ ID NO: 1699963 - RNA, 15 nt, Homo sapiens
aucuuuaucuguucu

SEQ ID NO: 1699964 - RNA, 13 nt, Homo sapiens
aucuuucuaggag

SEQ ID NO: 1699965 - RNA, 16 nt, Homo sapiens
aucuuucuccuugaau

SEQ ID NO: 1699966 - RNA, 14 nt, Homo sapiens
aucuuugcacucca

SEQ ID NO: 1699967 - RNA, 22 nt, Homo sapiens
aucuuugcacuccaaucauuca

SEQ ID NO: 1699968 - RNA, 12 nt, Homo sapiens
aucuuugcagac

SEQ ID NO: 1699969 - RNA, 20 nt, Homo sapiens
augaaaaaaaguacauguau

SEQ ID NO: 1699970 - RNA, 17 nt, Homo sapiens
augaaacaaauaaucac

SEQ ID NO: 1699971 - RNA, 18 nt, Homo sapiens
augaaacaaauaaucaca

SEQ ID NO: 1699972 - RNA, 19 nt, Homo sapiens
augaaacuauuuuaccuga

SEQ ID NO: 1699973 - RNA, 13 nt, Homo sapiens
augaaauaugcau

SEQ ID NO: 1699974 - RNA, 22 nt, Homo sapiens
augaaaugaggucagagccugc

SEQ ID NO: 1699975 - RNA, 15 nt, Homo sapiens
acaguguacaaugcc

SEQ ID NO: 1699976 - RNA, 17 nt, Homo sapiens
acaguuagguagcuuua

SEQ ID NO: 1699977 - RNA, 21 nt, Homo sapiens
acaguucauguuugcuucaua

SEQ ID NO: 1699978 - RNA, 20 nt, Homo sapiens
acauaaaggcuaacuaugag

SEQ ID NO: 1699979 - RNA, 21 nt, Homo sapiens
acauaacagugcagggcaaaa

SEQ ID NO: 1699980 - RNA, 20 nt, Homo sapiens
acauaacguuuuuccuuuaa

SEQ ID NO: 1699981 - RNA, 18 nt, Homo sapiens
acauaacuaaauuugaua

SEQ ID NO: 1699982 - RNA, 23 nt, Homo sapiens
acauaacuaguggcucucaguua

SEQ ID NO: 1699983 - RNA, 13 nt, Homo sapiens
acauaacugccuu

SEQ ID NO: 1699984 - RNA, 13 nt, Homo sapiens
acauaacuuccua

SEQ ID NO: 1699985 - RNA, 22 nt, Homo sapiens
acauaagggguuugccauuuga

SEQ ID NO: 1699986 - RNA, 15 nt, Homo sapiens
acauaaguaauucaa

SEQ ID NO: 1699987 - RNA, 17 nt, Homo sapiens
acauaaucuaguuuaca

SEQ ID NO: 1699988 - RNA, 15 nt, Homo sapiens
acauacaggauuuga

SEQ ID NO: 1699989 - RNA, 22 nt, Homo sapiens
acauacuuucauccugacucug

SEQ ID NO: 1699990 - RNA, 15 nt, Homo sapiens
acauagcaucucagg

SEQ ID NO: 1699991 - RNA, 18 nt, Homo sapiens
acauaucgcugacuucau

SEQ ID NO: 1699992 - RNA, 12 nt, Homo sapiens
acauaugcauuu

SEQ ID NO: 1699993 - RNA, 16 nt, Homo sapiens
acauauggacucugca

SEQ ID NO: 1699994 - RNA, 20 nt, Homo sapiens
acauauggacucugcacaug

SEQ ID NO: 1699995 - RNA, 15 nt, Homo sapiens
acaucacucugcugc

SEQ ID NO: 1699996 - RNA, 20 nt, Homo sapiens
acaucacuuguacaaaauaa

SEQ ID NO: 1699997 - RNA, 17 nt, Homo sapiens
acaucagcaaacaggau

SEQ ID NO: 1699998 - RNA, 19 nt, Homo sapiens
acaucagcaaacaggauca

SEQ ID NO: 1699999 - RNA, 22 nt, Homo sapiens
acaucauuagaacaaaggacag

SEQ ID NO: 1700000 - RNA, 21 nt, Homo sapiens
acauccuguauaagcacugaa

SEQ ID NO: 1700001 - RNA, 17 nt, Homo sapiens
acaucggccuccaugac

SEQ ID NO: 1700002 - RNA, 15 nt, Homo sapiens
acaucugcauuuuca

SEQ ID NO: 1700003 - RNA, 22 nt, Homo sapiens
acaucuuugaccacgucaucgg

SEQ ID NO: 1700004 - RNA, 19 nt, Homo sapiens
acaucuuuuacauucugca

SEQ ID NO: 1700005 - RNA, 19 nt, Homo sapiens
acaugaacacuuuuuauca

SEQ ID NO: 1700006 - RNA, 23 nt, Homo sapiens
acaugaaucccacccacauguga

SEQ ID NO: 1700007 - RNA, 19 nt, Homo sapiens
acaugagaaggaacuucca

SEQ ID NO: 1700008 - RNA, 14 nt, Homo sapiens
acaugcacugaccc

SEQ ID NO: 1700009 - RNA, 14 nt, Homo sapiens
acauggaacuuuag

SEQ ID NO: 1700010 - RNA, 22 nt, Homo sapiens
acaugggagcaguccaugcaug

SEQ ID NO: 1700011 - RNA, 19 nt, Homo sapiens
acaugucuuguacaugugu

SEQ ID NO: 1700012 - RNA, 11 nt, Homo sapiens
acaugugauug

SEQ ID NO: 1700013 - RNA, 18 nt, Homo sapiens
acauuaccuuacugugga

SEQ ID NO: 1700014 - RNA, 20 nt, Homo sapiens
acauuauaaaaauugacaau

SEQ ID NO: 1700015 - RNA, 19 nt, Homo sapiens
acauuaugugugcaugugu

SEQ ID NO: 1700016 - RNA, 20 nt, Homo sapiens
acauucaauagcauaucaca

SEQ ID NO: 1700017 - RNA, 12 nt, Homo sapiens
acauuccagggg

SEQ ID NO: 1700018 - RNA, 22 nt, Homo sapiens
acauucuuguuuuaagugccuu

SEQ ID NO: 1700019 - RNA, 20 nt, Homo sapiens
acauugaguagacacauuua

SEQ ID NO: 1700020 - RNA, 16 nt, Homo sapiens
acauugcuugugccac

SEQ ID NO: 1700021 - RNA, 22 nt, Homo sapiens
auaaaacuuaacuuccaaugaa

SEQ ID NO: 1700022 - RNA, 18 nt, Homo sapiens
auaaaagauguacuugug

SEQ ID NO: 1700023 - RNA, 13 nt, Homo sapiens
auaaaagguagua

SEQ ID NO: 1700024 - RNA, 23 nt, Homo sapiens
auaaaauauuuuugaaaggcaug

SEQ ID NO: 1700025 - RNA, 15 nt, Homo sapiens
auaaaaucagaguug

SEQ ID NO: 1700026 - RNA, 17 nt, Homo sapiens
auaaaaugacuacuuag

SEQ ID NO: 1700027 - RNA, 15 nt, Homo sapiens
auaaacauccuucaa

SEQ ID NO: 1700028 - RNA, 20 nt, Homo sapiens
auaaacauuaaaugucuuau

SEQ ID NO: 1700029 - RNA, 15 nt, Homo sapiens
auaaagaaauugcaa

SEQ ID NO: 1700030 - RNA, 16 nt, Homo sapiens
auaaagauaauacugu

SEQ ID NO: 1700031 - RNA, 18 nt, Homo sapiens
auaaaguaaugaucucaa

SEQ ID NO: 1700032 - RNA, 17 nt, Homo sapiens
auaaaguuagaaucuau

SEQ ID NO: 1700033 - RNA, 17 nt, Homo sapiens
auaaauauagagaugug

SEQ ID NO: 1700034 - RNA, 13 nt, Homo sapiens
auaaauaugcagu

SEQ ID NO: 1700035 - RNA, 16 nt, Homo sapiens
auaaaugagcaaauau

SEQ ID NO: 1700036 - RNA, 17 nt, Homo sapiens
auaaccauaugauacua

SEQ ID NO: 1700037 - RNA, 20 nt, Homo sapiens
auaaccccagcucccuagga

SEQ ID NO: 1700038 - RNA, 15 nt, Homo sapiens
auaacccuaacacac

SEQ ID NO: 1700039 - RNA, 14 nt, Homo sapiens
auaaccuagccuua

SEQ ID NO: 1700040 - RNA, 18 nt, Homo sapiens
auaacuaaauuugauacu

SEQ ID NO: 1700041 - RNA, 19 nt, Homo sapiens
auaacuaaauuugauacuu

SEQ ID NO: 1700042 - RNA, 17 nt, Homo sapiens
auaacucggauuccagc

SEQ ID NO: 1700043 - RNA, 13 nt, Homo sapiens
auaagacauaacg

SEQ ID NO: 1700044 - RNA, 20 nt, Homo sapiens
auaagauugacuuugaaucu

SEQ ID NO: 1700045 - RNA, 19 nt, Homo sapiens
auaagcaaaaacaaaaaga

SEQ ID NO: 1700046 - RNA, 16 nt, Homo sapiens
auaaguagaaagaauu

SEQ ID NO: 1700047 - RNA, 22 nt, Homo sapiens
auaagugaagugauacuaucca

SEQ ID NO: 1700048 - RNA, 21 nt, Homo sapiens
auaauaaaacuaaacuuucau

SEQ ID NO: 1700049 - RNA, 12 nt, Homo sapiens
auaaucugucaa

SEQ ID NO: 1700050 - RNA, 21 nt, Homo sapiens
auaaucugucaaaacacugug

SEQ ID NO: 1700051 - RNA, 22 nt, Homo sapiens
auaaucugucaaaacacugugg

SEQ ID NO: 1700052 - RNA, 22 nt, Homo sapiens
auaauguuaucuguguagcaag

SEQ ID NO: 1700053 - RNA, 20 nt, Homo sapiens
auaauucuggagauacuggu

SEQ ID NO: 1700054 - RNA, 15 nt, Homo sapiens
auaauucuucaccua

SEQ ID NO: 1700055 - RNA, 23 nt, Homo sapiens
auaauugcuuuuucacagucacu

SEQ ID NO: 1700056 - RNA, 12 nt, Homo sapiens
auacaaacaauc

SEQ ID NO: 1700057 - RNA, 19 nt, Homo sapiens
auacaagaaagcaaugcca

SEQ ID NO: 1700058 - RNA, 22 nt, Homo sapiens
auacacacacacgcgugcacac

SEQ ID NO: 1700059 - RNA, 23 nt, Homo sapiens
auacacauauauacccacaugua

SEQ ID NO: 1700060 - RNA, 21 nt, Homo sapiens
auacagauagaguuccauaua

SEQ ID NO: 1700061 - RNA, 22 nt, Homo sapiens
auacagcccugacgcaaugaaa

SEQ ID NO: 1700062 - RNA, 23 nt, Homo sapiens
auacauaagcggcguaaguuuaa

SEQ ID NO: 1700063 - RNA, 18 nt, Homo sapiens
auacauacacuuguauaa

SEQ ID NO: 1700064 - RNA, 19 nt, Homo sapiens
auacauaucgcugacuuca

SEQ ID NO: 1700065 - RNA, 20 nt, Homo sapiens
auacauaucgcugacuucau

SEQ ID NO: 1700066 - RNA, 14 nt, Homo sapiens
auacauguguguau

SEQ ID NO: 1700067 - RNA, 22 nt, Homo sapiens
acaacgccugucacagaguaga

SEQ ID NO: 1700068 - RNA, 20 nt, Homo sapiens
acaacugauacuucacuacu

SEQ ID NO: 1700069 - RNA, 17 nt, Homo sapiens
acaacugucuaacuuua

SEQ ID NO: 1700070 - RNA, 22 nt, Homo sapiens
acaagaauuucuugguaagaag

SEQ ID NO: 1700071 - RNA, 13 nt, Homo sapiens
acaagaugagauu

SEQ ID NO: 1700072 - RNA, 15 nt, Homo sapiens
acaagcugcauuuca

SEQ ID NO: 1700073 - RNA, 12 nt, Homo sapiens
acaaggcuccaa

SEQ ID NO: 1700074 - RNA, 16 nt, Homo sapiens
acaaggcuccaagacc

SEQ ID NO: 1700075 - RNA, 15 nt, Homo sapiens
acaagggcugaccug

SEQ ID NO: 1700076 - RNA, 14 nt, Homo sapiens
acaagucuuccaga

SEQ ID NO: 1700077 - RNA, 13 nt, Homo sapiens
acaagugacugua

SEQ ID NO: 1700078 - RNA, 16 nt, Homo sapiens
acaaguuggaauucac

SEQ ID NO: 1700079 - RNA, 13 nt, Homo sapiens
acaauaaaagcuu

SEQ ID NO: 1700080 - RNA, 22 nt, Homo sapiens
acaauaaaccuccgccaaugca

SEQ ID NO: 1700081 - RNA, 17 nt, Homo sapiens
acaauuggcacuaaaga

SEQ ID NO: 1700082 - RNA, 17 nt, Homo sapiens
acaauuugauacauaau

SEQ ID NO: 1700083 - RNA, 18 nt, Homo sapiens
acacaaagacauugauuc

SEQ ID NO: 1700084 - RNA, 18 nt, Homo sapiens
acacaaggcuccaagacc

SEQ ID NO: 1700085 - RNA, 13 nt, Homo sapiens
acacacacaugca

SEQ ID NO: 1700086 - RNA, 14 nt, Homo sapiens
acacacaugcacac

SEQ ID NO: 1700087 - RNA, 16 nt, Homo sapiens
acacacggaggcaucc

SEQ ID NO: 1700088 - RNA, 14 nt, Homo sapiens
acacagaccaccau

SEQ ID NO: 1700089 - RNA, 16 nt, Homo sapiens
acacagcaacaaugac

SEQ ID NO: 1700090 - RNA, 17 nt, Homo sapiens
acacagcaacaaugacu

SEQ ID NO: 1700091 - RNA, 16 nt, Homo sapiens
acacagcuacagcuuu

SEQ ID NO: 1700092 - RNA, 20 nt, Homo sapiens
acacagcucuucuccaggcu

SEQ ID NO: 1700093 - RNA, 14 nt, Homo sapiens
acacaggaaaccaa

SEQ ID NO: 1700094 - RNA, 23 nt, Homo sapiens
acacaggaaaccaacacccaaag

SEQ ID NO: 1700095 - RNA, 12 nt, Homo sapiens
acacaggaugag

SEQ ID NO: 1700096 - RNA, 14 nt, Homo sapiens
acacaggcaaaauc

SEQ ID NO: 1700097 - RNA, 17 nt, Homo sapiens
acacaucaggaguucaa

SEQ ID NO: 1700098 - RNA, 12 nt, Homo sapiens
acacaugcacac

SEQ ID NO: 1700099 - RNA, 14 nt, Homo sapiens
acacauuuguacag

SEQ ID NO: 1700100 - RNA, 19 nt, Homo sapiens
acaccaaugcccaacugcc

SEQ ID NO: 1700101 - RNA, 17 nt, Homo sapiens
acaccacgguagugccu

SEQ ID NO: 1700102 - RNA, 21 nt, Homo sapiens
acaccacgguagugccugaaa

SEQ ID NO: 1700103 - RNA, 19 nt, Homo sapiens
acaccagagcagaugcaga

SEQ ID NO: 1700104 - RNA, 15 nt, Homo sapiens
acaccaguaauccca

SEQ ID NO: 1700105 - RNA, 12 nt, Homo sapiens
acacccugcaag

SEQ ID NO: 1700106 - RNA, 17 nt, Homo sapiens
acacccuuccuucugua

SEQ ID NO: 1700107 - RNA, 15 nt, Homo sapiens
acaccuacucuauca

SEQ ID NO: 1700108 - RNA, 15 nt, Homo sapiens
acaccuagcuuuauu

SEQ ID NO: 1700109 - RNA, 23 nt, Homo sapiens
acaccucaguucccuuggccuca

SEQ ID NO: 1700110 - RNA, 19 nt, Homo sapiens
acaccuugacagggcacac

SEQ ID NO: 1700111 - RNA, 18 nt, Homo sapiens
acaccuuuuauugacaca

SEQ ID NO: 1700112 - RNA, 15 nt, Homo sapiens
acacggggcaguggc

SEQ ID NO: 1700113 - RNA, 23 nt, Homo sapiens
acacuaacgauuuguuaaugaua

SEQ ID NO: 1700114 - RNA, 12 nt, Homo sapiens
acacuaccacau

SEQ ID NO: 1700115 - RNA, 19 nt, Homo sapiens
aaucucagaugcaguuugg

SEQ ID NO: 1700116 - RNA, 23 nt, Homo sapiens
aaucuguugccacccaggugaug

SEQ ID NO: 1700117 - RNA, 16 nt, Homo sapiens
aaucuucuuaugcaau

SEQ ID NO: 1700118 - RNA, 19 nt, Homo sapiens
aaucuuuggguaacuucaa

SEQ ID NO: 1700119 - RNA, 13 nt, Homo sapiens
aaugaaacuuuaa

SEQ ID NO: 1700120 - RNA, 13 nt, Homo sapiens
aaugaaagacacu

SEQ ID NO: 1700121 - RNA, 20 nt, Homo sapiens
aaugacaauaaaaauuccaa

SEQ ID NO: 1700122 - RNA, 21 nt, Homo sapiens
aaugacaaugaagugacacuu

SEQ ID NO: 1700123 - RNA, 14 nt, Homo sapiens
aaugacaucucagg

SEQ ID NO: 1700124 - RNA, 17 nt, Homo sapiens
aaugacaugcacugacc

SEQ ID NO: 1700125 - RNA, 18 nt, Homo sapiens
aaugacauugaacugaau

SEQ ID NO: 1700126 - RNA, 13 nt, Homo sapiens
aaugacugugcua

SEQ ID NO: 1700127 - RNA, 16 nt, Homo sapiens
aaugacuuaaccauau

SEQ ID NO: 1700128 - RNA, 19 nt, Homo sapiens
aaugagaaggagucagaaa

SEQ ID NO: 1700129 - RNA, 17 nt, Homo sapiens
aaugagccgagaucacg

SEQ ID NO: 1700130 - RNA, 17 nt, Homo sapiens
aaugaggucuguuuaaa

SEQ ID NO: 1700131 - RNA, 21 nt, Homo sapiens
aaugaugaguauuaguucccu

SEQ ID NO: 1700132 - RNA, 12 nt, Homo sapiens
aaugcauagcau

SEQ ID NO: 1700133 - RNA, 16 nt, Homo sapiens
aaugcaugaacaaguu

SEQ ID NO: 1700134 - RNA, 13 nt, Homo sapiens
aaugcuacugucu

SEQ ID NO: 1700135 - RNA, 13 nt, Homo sapiens
aaugcugcauuuu

SEQ ID NO: 1700136 - RNA, 16 nt, Homo sapiens
aaugcuguguugggua

SEQ ID NO: 1700137 - RNA, 21 nt, Homo sapiens
aauggauuguuaauuucaguc

SEQ ID NO: 1700138 - RNA, 21 nt, Homo sapiens
aauggauuugaugcuguuuga

SEQ ID NO: 1700139 - RNA, 13 nt, Homo sapiens
aauggcaugucag

SEQ ID NO: 1700140 - RNA, 14 nt, Homo sapiens
aaugggcucuucca

SEQ ID NO: 1700141 - RNA, 15 nt, Homo sapiens
aaugggcucuuccaa

SEQ ID NO: 1700142 - RNA, 16 nt, Homo sapiens
aaugguaauuguugcu

SEQ ID NO: 1700143 - RNA, 17 nt, Homo sapiens
aauggucgcccaggaga

SEQ ID NO: 1700144 - RNA, 21 nt, Homo sapiens
aauggugaagaacuagcauau

SEQ ID NO: 1700145 - RNA, 15 nt, Homo sapiens
aauguaaacugccau

SEQ ID NO: 1700146 - RNA, 20 nt, Homo sapiens
aauguaaauuaaaauuucca

SEQ ID NO: 1700147 - RNA, 23 nt, Homo sapiens
aauguaauacuccuaagacuuau

SEQ ID NO: 1700148 - RNA, 17 nt, Homo sapiens
aauguauuuguuugcaa

SEQ ID NO: 1700149 - RNA, 20 nt, Homo sapiens
aauguauuuguuugcaauuu

SEQ ID NO: 1700150 - RNA, 19 nt, Homo sapiens
aaugucaauacuuacuucu

SEQ ID NO: 1700151 - RNA, 14 nt, Homo sapiens
aaugucauagguaa

SEQ ID NO: 1700152 - RNA, 19 nt, Homo sapiens
aauguccccacgguacuua

SEQ ID NO: 1700153 - RNA, 22 nt, Homo sapiens
aaugucccuuucagagacagcu

SEQ ID NO: 1700154 - RNA, 21 nt, Homo sapiens
aaugucuucauaaaguacuug

SEQ ID NO: 1700155 - RNA, 20 nt, Homo sapiens
aaugucuuuugaauauuccc

SEQ ID NO: 1700156 - RNA, 18 nt, Homo sapiens
aaugugaauugcaugacu

SEQ ID NO: 1700157 - RNA, 23 nt, Homo sapiens
aaugugauuacugcucuauucca

SEQ ID NO: 1700158 - RNA, 18 nt, Homo sapiens
aaugugcagaugcaauug

SEQ ID NO: 1700159 - RNA, 23 nt, Homo sapiens
aaugugucaggugacccugauga

SEQ ID NO: 1700160 - RNA, 20 nt, Homo sapiens
aauguguuuuaucacuucau

SEQ ID NO: 1700161 - RNA, 13 nt, Homo sapiens
aauguuaagcaga

SEQ ID NO: 1700162 - RNA, 18 nt, Homo sapiens
aauguuagucauuguuau

SEQ ID NO: 1700163 - RNA, 20 nt, Homo sapiens
aaguaauguaaaauccaucc

SEQ ID NO: 1700164 - RNA, 16 nt, Homo sapiens
aaguacaauaauucau

SEQ ID NO: 1700165 - RNA, 23 nt, Homo sapiens
aaguacuccuauugccgccagaa

SEQ ID NO: 1700166 - RNA, 21 nt, Homo sapiens
aaguacuguaauaauaccuca

SEQ ID NO: 1700167 - RNA, 17 nt, Homo sapiens
aaguagguuuacauuca

SEQ ID NO: 1700168 - RNA, 15 nt, Homo sapiens
aaguauacaguucaa

SEQ ID NO: 1700169 - RNA, 12 nt, Homo sapiens
aagucacacagu

SEQ ID NO: 1700170 - RNA, 13 nt, Homo sapiens
aagucauagaaau

SEQ ID NO: 1700171 - RNA, 13 nt, Homo sapiens
aagucucugugaa

SEQ ID NO: 1700172 - RNA, 14 nt, Homo sapiens
aagucuuccaugac

SEQ ID NO: 1700173 - RNA, 13 nt, Homo sapiens
aagugaacuauga

SEQ ID NO: 1700174 - RNA, 22 nt, Homo sapiens
aagugaagagugacuaguacaa

SEQ ID NO: 1700175 - RNA, 19 nt, Homo sapiens
aagugauccucccaccuca

SEQ ID NO: 1700176 - RNA, 21 nt, Homo sapiens
aagugcgugccgugugagugu

SEQ ID NO: 1700177 - RNA, 20 nt, Homo sapiens
aagugcugagauuacaggca

SEQ ID NO: 1700178 - RNA, 21 nt, Homo sapiens
aagugcugcuauaucuaucca

SEQ ID NO: 1700179 - RNA, 18 nt, Homo sapiens
aagugguaggaaagccuc

SEQ ID NO: 1700180 - RNA, 15 nt, Homo sapiens
aaguguaccugugua

SEQ ID NO: 1700181 - RNA, 15 nt, Homo sapiens
aaguguuucuguuau

SEQ ID NO: 1700182 - RNA, 16 nt, Homo sapiens
aaguguuucuguuauu

SEQ ID NO: 1700183 - RNA, 16 nt, Homo sapiens
aaguuaaucuucaugg

SEQ ID NO: 1700184 - RNA, 18 nt, Homo sapiens
aaguuccaguguucucuc

SEQ ID NO: 1700185 - RNA, 22 nt, Homo sapiens
aaguucccuacuuccugugacu

SEQ ID NO: 1700186 - RNA, 14 nt, Homo sapiens
aaguuuaucuuuca

SEQ ID NO: 1700187 - RNA, 16 nt, Homo sapiens
aaguuucugucuuccu

SEQ ID NO: 1700188 - RNA, 12 nt, Homo sapiens
aaguuugaacuu

SEQ ID NO: 1700189 - RNA, 19 nt, Homo sapiens
aaguuuuggccaccacaug

SEQ ID NO: 1700190 - RNA, 18 nt, Homo sapiens
aauaaaacuuaacuucca

SEQ ID NO: 1700191 - RNA, 17 nt, Homo sapiens
aauaaaauccuaagaca

SEQ ID NO: 1700192 - RNA, 22 nt, Homo sapiens
aauaaacaguugugaaccaaga

SEQ ID NO: 1700193 - RNA, 22 nt, Homo sapiens
aauaaaccuccgccaaugcacg

SEQ ID NO: 1700194 - RNA, 13 nt, Homo sapiens
aauaaacuacucu

SEQ ID NO: 1700195 - RNA, 18 nt, Homo sapiens
aauaaacugaaaauggac

SEQ ID NO: 1700196 - RNA, 17 nt, Homo sapiens
aauaaagaaauugcaau

SEQ ID NO: 1700197 - RNA, 17 nt, Homo sapiens
aauaaaguauagguuua

SEQ ID NO: 1700198 - RNA, 16 nt, Homo sapiens
aauaaauauuuaauga

SEQ ID NO: 1700199 - RNA, 15 nt, Homo sapiens
aauaaaucuuuggaa

SEQ ID NO: 1700200 - RNA, 14 nt, Homo sapiens
aauaacaggcauuu

SEQ ID NO: 1700201 - RNA, 23 nt, Homo sapiens
aauaagacuuagauugugcuccu

SEQ ID NO: 1700202 - RNA, 15 nt, Homo sapiens
aauaauauuagcuua

SEQ ID NO: 1700203 - RNA, 20 nt, Homo sapiens
aauaaugcugcaaacuuaau

SEQ ID NO: 1700204 - RNA, 18 nt, Homo sapiens
aauaauggguuucuuuca

SEQ ID NO: 1700205 - RNA, 16 nt, Homo sapiens
aauaauguacaucugg

SEQ ID NO: 1700206 - RNA, 20 nt, Homo sapiens
aauaauguuguaauucaugc

SEQ ID NO: 1700207 - RNA, 21 nt, Homo sapiens
aauaauuaaccaccaauccaa

SEQ ID NO: 1700208 - RNA, 12 nt, Homo sapiens
aauaauugcuca

SEQ ID NO: 1700209 - RNA, 18 nt, Homo sapiens
aauaauugcucauaagca

SEQ ID NO: 1700210 - RNA, 20 nt, Homo sapiens
aauaauugcucauaagcaau

SEQ ID NO: 1700211 - RNA, 18 nt, Homo sapiens
aauaauuuuauuaugcaa

SEQ ID NO: 1700212 - RNA, 13 nt, Homo sapiens
aauacaacaugua

SEQ ID NO: 1700213 - RNA, 20 nt, Homo sapiens
uugaaccauccacuuacaua

SEQ ID NO: 1700214 - RNA, 22 nt, Homo sapiens
uugaacuucauaagguaauuca

SEQ ID NO: 1700215 - RNA, 22 nt, Homo sapiens
uugaagacaauuugauacauaa

SEQ ID NO: 1700216 - RNA, 21 nt, Homo sapiens
uugaauaccauuaaaacugcu

SEQ ID NO: 1700217 - RNA, 15 nt, Homo sapiens
uugaauauuacuccu

SEQ ID NO: 1700218 - RNA, 19 nt, Homo sapiens
uugaaucuauuucacuuau

SEQ ID NO: 1700219 - RNA, 14 nt, Homo sapiens
uugaaugcugccag

SEQ ID NO: 1700220 - RNA, 17 nt, Homo sapiens
uugacaaaguuacugau

SEQ ID NO: 1700221 - RNA, 15 nt, Homo sapiens
uugacaacugugacu

SEQ ID NO: 1700222 - RNA, 21 nt, Homo sapiens
uugacacucugcagacugcua

SEQ ID NO: 1700223 - RNA, 11 nt, Homo sapiens
uugaccacaga

SEQ ID NO: 1700224 - RNA, 12 nt, Homo sapiens
uugaccacagag

SEQ ID NO: 1700225 - RNA, 15 nt, Homo sapiens
uugaccagcucuggg

SEQ ID NO: 1700226 - RNA, 22 nt, Homo sapiens
uugacuagggauucaggcugcu

SEQ ID NO: 1700227 - RNA, 15 nt, Homo sapiens
uugagaaaugcauag

SEQ ID NO: 1700228 - RNA, 17 nt, Homo sapiens
uugagacaggaugguua

SEQ ID NO: 1700229 - RNA, 15 nt, Homo sapiens
uugagggacugccuc

SEQ ID NO: 1700230 - RNA, 15 nt, Homo sapiens
uugagggguggaccc

SEQ ID NO: 1700231 - RNA, 21 nt, Homo sapiens
uugauagauuucuacacugag

SEQ ID NO: 1700232 - RNA, 16 nt, Homo sapiens
uugaucaaauauuuca

SEQ ID NO: 1700233 - RNA, 11 nt, Homo sapiens
uugauccugca

SEQ ID NO: 1700234 - RNA, 12 nt, Homo sapiens
uugauguaucug

SEQ ID NO: 1700235 - RNA, 21 nt, Homo sapiens
uugauuuuauuuuuucucugu

SEQ ID NO: 1700236 - RNA, 14 nt, Homo sapiens
uugauuuugugaua

SEQ ID NO: 1700237 - RNA, 19 nt, Homo sapiens
uugcaaagguuccaacugu

SEQ ID NO: 1700238 - RNA, 21 nt, Homo sapiens
uugcaaagguuccaacuguau

SEQ ID NO: 1700239 - RNA, 14 nt, Homo sapiens
uugcaauggcagcc

SEQ ID NO: 1700240 - RNA, 23 nt, Homo sapiens
uugcaccaggcacugcugcacaa

SEQ ID NO: 1700241 - RNA, 17 nt, Homo sapiens
uugcacuccaaucauuc

SEQ ID NO: 1700242 - RNA, 20 nt, Homo sapiens
uugcaguucaccugcacuua

SEQ ID NO: 1700243 - RNA, 13 nt, Homo sapiens
uugcauaugucau

SEQ ID NO: 1700244 - RNA, 21 nt, Homo sapiens
uugcaugaagagaagcaauuu

SEQ ID NO: 1700245 - RNA, 17 nt, Homo sapiens
uugccaacucgaacaaa

SEQ ID NO: 1700246 - RNA, 24 nt, Homo sapiens
uugccaagacaaaucaacagaagc

SEQ ID NO: 1700247 - RNA, 16 nt, Homo sapiens
uugccacccaggugau

SEQ ID NO: 1700248 - RNA, 12 nt, Homo sapiens
uugccacuuaac

SEQ ID NO: 1700249 - RNA, 14 nt, Homo sapiens
uugccauguuggcc

SEQ ID NO: 1700250 - RNA, 23 nt, Homo sapiens
uugccucccgggcucaagcgauu

SEQ ID NO: 1700251 - RNA, 20 nt, Homo sapiens
uugcgagccucgcagccucc

SEQ ID NO: 1700252 - RNA, 13 nt, Homo sapiens
uugcggacagcca

SEQ ID NO: 1700253 - RNA, 15 nt, Homo sapiens
uugcgugauucaaug

SEQ ID NO: 1700254 - RNA, 17 nt, Homo sapiens
uugcguggacucugcac

SEQ ID NO: 1700255 - RNA, 15 nt, Homo sapiens
uugcuaaaauauuau

SEQ ID NO: 1700256 - RNA, 13 nt, Homo sapiens
uugcuguguuuaa

SEQ ID NO: 1700257 - RNA, 15 nt, Homo sapiens
uugcuguuugcaauu

SEQ ID NO: 1700258 - RNA, 17 nt, Homo sapiens
uugcuuauguaaucuca

SEQ ID NO: 1700259 - RNA, 14 nt, Homo sapiens
uugcuuauugcuua

SEQ ID NO: 1700260 - RNA, 11 nt, Homo sapiens
uugcuuucuau

SEQ ID NO: 1700261 - RNA, 18 nt, Homo sapiens
uuggaaaaaauguuguaa

SEQ ID NO: 1700262 - RNA, 13 nt, Homo sapiens
uuggaaacagaga

SEQ ID NO: 1700263 - RNA, 12 nt, Homo sapiens
uuggaaauggau

SEQ ID NO: 1700264 - RNA, 14 nt, Homo sapiens
uuggaauucgugca

SEQ ID NO: 1700265 - RNA, 19 nt, Homo sapiens
uuggacuggauaagugcua

SEQ ID NO: 1700266 - RNA, 18 nt, Homo sapiens
uuggauaucauacuucca

SEQ ID NO: 1700267 - RNA, 12 nt, Homo sapiens
uuggaucuugaa

SEQ ID NO: 1700268 - RNA, 15 nt, Homo sapiens
uuggauucccuuaaa

SEQ ID NO: 1700269 - RNA, 20 nt, Homo sapiens
uuggcaacagaagcaguuga

SEQ ID NO: 1700270 - RNA, 15 nt, Homo sapiens
uuggccagugugaca

SEQ ID NO: 1700271 - RNA, 14 nt, Homo sapiens
uuggccggcugugc

SEQ ID NO: 1700272 - RNA, 15 nt, Homo sapiens
uuggcuuccaugaug

SEQ ID NO: 1700273 - RNA, 12 nt, Homo sapiens
uugggagauuca

SEQ ID NO: 1700274 - RNA, 12 nt, Homo sapiens
uugggcauguga

SEQ ID NO: 1700275 - RNA, 19 nt, Homo sapiens
uuuaauccuuaacacauuc

SEQ ID NO: 1700276 - RNA, 20 nt, Homo sapiens
uuuaauccuuaacacauuca

SEQ ID NO: 1700277 - RNA, 16 nt, Homo sapiens
uuuaaugacaaugaag

SEQ ID NO: 1700278 - RNA, 23 nt, Homo sapiens
uuuaauuuagugaucuuagcaua

SEQ ID NO: 1700279 - RNA, 17 nt, Homo sapiens
uuuacaaaguauuugcu

SEQ ID NO: 1700280 - RNA, 21 nt, Homo sapiens
uuuacacagaaacacugccuu

SEQ ID NO: 1700281 - RNA, 19 nt, Homo sapiens
uuuacagauaucugaaugg

SEQ ID NO: 1700282 - RNA, 13 nt, Homo sapiens
uuuacaugugaug

SEQ ID NO: 1700283 - RNA, 21 nt, Homo sapiens
uuuagaagauagaugcacuua

SEQ ID NO: 1700284 - RNA, 18 nt, Homo sapiens
uuuagauaugacauuuau

SEQ ID NO: 1700285 - RNA, 22 nt, Homo sapiens
uuuaggaaaaucacuuugucua

SEQ ID NO: 1700286 - RNA, 19 nt, Homo sapiens
uuuauacugauuaugucuu

SEQ ID NO: 1700287 - RNA, 14 nt, Homo sapiens
uuuaucaaagcaua

SEQ ID NO: 1700288 - RNA, 18 nt, Homo sapiens
uuuaucacuucauucaca

SEQ ID NO: 1700289 - RNA, 22 nt, Homo sapiens
uuuaucacuucauucacauuca

SEQ ID NO: 1700290 - RNA, 20 nt, Homo sapiens
uuuaucuaaauuaaagccuu

SEQ ID NO: 1700291 - RNA, 11 nt, Homo sapiens
uuuaugaaaug

SEQ ID NO: 1700292 - RNA, 13 nt, Homo sapiens
uuuaugagacagc

SEQ ID NO: 1700293 - RNA, 14 nt, Homo sapiens
uuuauuccuguaug

SEQ ID NO: 1700294 - RNA, 22 nt, Homo sapiens
uuuauuucugguaacucacuca

SEQ ID NO: 1700295 - RNA, 12 nt, Homo sapiens
uuucaaaacaca

SEQ ID NO: 1700296 - RNA, 15 nt, Homo sapiens
uuucaaaacacaucu

SEQ ID NO: 1700297 - RNA, 21 nt, Homo sapiens
uuucaaagagguauauuugaa

SEQ ID NO: 1700298 - RNA, 18 nt, Homo sapiens
uuucaauuugagauucua

SEQ ID NO: 1700299 - RNA, 16 nt, Homo sapiens
uuucacaacauuugca

SEQ ID NO: 1700300 - RNA, 16 nt, Homo sapiens
uuucacaauaccucau

SEQ ID NO: 1700301 - RNA, 15 nt, Homo sapiens
uuucacauaaaaccu

SEQ ID NO: 1700302 - RNA, 23 nt, Homo sapiens
uuucagauuuuuuauuugaaggu

SEQ ID NO: 1700303 - RNA, 19 nt, Homo sapiens
uuucauccugacucugccc

SEQ ID NO: 1700304 - RNA, 15 nt, Homo sapiens
uuucauccuugacua

SEQ ID NO: 1700305 - RNA, 15 nt, Homo sapiens
uuucaucuaauguga

SEQ ID NO: 1700306 - RNA, 20 nt, Homo sapiens
uuucauggguuauguguaug

SEQ ID NO: 1700307 - RNA, 21 nt, Homo sapiens
uuucauguggcuguagauccc

SEQ ID NO: 1700308 - RNA, 19 nt, Homo sapiens
uuucauguuuugugacuau

SEQ ID NO: 1700309 - RNA, 15 nt, Homo sapiens
uuucauugacacucu

SEQ ID NO: 1700310 - RNA, 13 nt, Homo sapiens
uuucgaacauucu

SEQ ID NO: 1700311 - RNA, 17 nt, Homo sapiens
uuucuccuguuggcuca

SEQ ID NO: 1700312 - RNA, 22 nt, Homo sapiens
uuucucuaccuucaagaaccag

SEQ ID NO: 1700313 - RNA, 23 nt, Homo sapiens
uuucucuccaacucccucuggga

SEQ ID NO: 1700314 - RNA, 19 nt, Homo sapiens
uuucucuguuguaagaaua

SEQ ID NO: 1700315 - RNA, 11 nt, Homo sapiens
uuucugucaag

SEQ ID NO: 1700316 - RNA, 22 nt, Homo sapiens
uuucugugggaggagaagggga

SEQ ID NO: 1700317 - RNA, 19 nt, Homo sapiens
uuucuguuauuaacaaaca

SEQ ID NO: 1700318 - RNA, 14 nt, Homo sapiens
uuucuuacauuagc

SEQ ID NO: 1700319 - RNA, 14 nt, Homo sapiens
uuucuuacuccucc

SEQ ID NO: 1700320 - RNA, 15 nt, Homo sapiens
uuucuucuuaaccua

SEQ ID NO: 1700321 - RNA, 18 nt, Homo sapiens
uuucuuuagcaugcuaca

SEQ ID NO: 1700322 - RNA, 13 nt, Homo sapiens
uuucuuuccucag

SEQ ID NO: 1700323 - RNA, 14 nt, Homo sapiens
uuucuuuucacaua

SEQ ID NO: 1700324 - RNA, 15 nt, Homo sapiens
uuugaaacugaaugu

SEQ ID NO: 1700325 - RNA, 20 nt, Homo sapiens
uuugaaauagucugugugaa

SEQ ID NO: 1700326 - RNA, 19 nt, Homo sapiens
uuugaacccuugcuugcaa

SEQ ID NO: 1700327 - RNA, 12 nt, Homo sapiens
uuugaaggcaaa

SEQ ID NO: 1700328 - RNA, 22 nt, Homo sapiens
uuugaauagccuguuccuuuaa

SEQ ID NO: 1700329 - RNA, 23 nt, Homo sapiens
uuugaaugaugagccuucgugcc

SEQ ID NO: 1700330 - RNA, 12 nt, Homo sapiens
uuugacauuucc

SEQ ID NO: 1700331 - RNA, 23 nt, Homo sapiens
uuugacuuugguuguguuuaaau

SEQ ID NO: 1700332 - RNA, 19 nt, Homo sapiens
uuugagaucaucagugaua

SEQ ID NO: 1700333 - RNA, 20 nt, Homo sapiens
uuugaggaacauuauuuaau

SEQ ID NO: 1700334 - RNA, 14 nt, Homo sapiens
uuugaggagcaugu

SEQ ID NO: 1700335 - RNA, 20 nt, Homo sapiens
uuugaguagauauuacuuua

SEQ ID NO: 1700336 - RNA, 15 nt, Homo sapiens
uuugaguugaauuua

SEQ ID NO: 1700337 - RNA, 13 nt, Homo sapiens
uuugaugaacugu

SEQ ID NO: 1700338 - RNA, 12 nt, Homo sapiens
uuugaugccauu

SEQ ID NO: 1700339 - RNA, 23 nt, Homo sapiens
uuugauuuuucuaaccuugaaug

SEQ ID NO: 1700340 - RNA, 21 nt, Homo sapiens
uuugcaauggcuauauggcaa

SEQ ID NO: 1700341 - RNA, 14 nt, Homo sapiens
uuugcacacugcac

SEQ ID NO: 1700342 - RNA, 13 nt, Homo sapiens
uuugccagugccu

SEQ ID NO: 1700343 - RNA, 19 nt, Homo sapiens
uuugcuauuagagcauuga

SEQ ID NO: 1700344 - RNA, 16 nt, Homo sapiens
uuugcuuuucaggguu

SEQ ID NO: 1700345 - RNA, 15 nt, Homo sapiens
uuuggauaaacaaca

SEQ ID NO: 1700346 - RNA, 14 nt, Homo sapiens
uuuggccauguaaa

SEQ ID NO: 1700347 - RNA, 12 nt, Homo sapiens
uuuggcuaaaau

SEQ ID NO: 1700348 - RNA, 20 nt, Homo sapiens
uuugggguugaaaauucaaa

SEQ ID NO: 1700349 - RNA, 15 nt, Homo sapiens
uuuggguaacuucaa

SEQ ID NO: 1700350 - RNA, 14 nt, Homo sapiens
uuuguaaugcugca

SEQ ID NO: 1700351 - RNA, 15 nt, Homo sapiens
uuuguaaugcugcac

SEQ ID NO: 1700352 - RNA, 16 nt, Homo sapiens
uuuguaaugcugcaca

SEQ ID NO: 1700353 - RNA, 20 nt, Homo sapiens
uuuguauacauccuggguaa

SEQ ID NO: 1700354 - RNA, 22 nt, Homo sapiens
uuuguauucucuuccucaucca

SEQ ID NO: 1700355 - RNA, 21 nt, Homo sapiens
uuuguccuccugggucaggga

SEQ ID NO: 1700356 - RNA, 13 nt, Homo sapiens
uuugucucagaag

SEQ ID NO: 1700357 - RNA, 23 nt, Homo sapiens
uuugugccagaggaauccuggca

SEQ ID NO: 1700358 - RNA, 14 nt, Homo sapiens
uuuguguauucuuc

SEQ ID NO: 1700359 - RNA, 22 nt, Homo sapiens
uuuguucaaugcuagaacaacg

SEQ ID NO: 1700360 - RNA, 14 nt, Homo sapiens
uuuguugagccagg

SEQ ID NO: 1700361 - RNA, 12 nt, Homo sapiens
uuuguuguaaaa

SEQ ID NO: 1700362 - RNA, 13 nt, Homo sapiens
uuuguuuuaaucc

SEQ ID NO: 1700363 - RNA, 22 nt, Homo sapiens
uuuguuuugauguuuguggccu

SEQ ID NO: 1700364 - RNA, 15 nt, Homo sapiens
uuuuaaaaguuucaa

SEQ ID NO: 1700365 - RNA, 23 nt, Homo sapiens
uuuuaaauaaaaauaaguguaca

SEQ ID NO: 1700366 - RNA, 17 nt, Homo sapiens
uuuuaaaucaaguauuu

SEQ ID NO: 1700367 - RNA, 22 nt, Homo sapiens
uuuuaacuucuugucuauaguu

SEQ ID NO: 1700368 - RNA, 23 nt, Homo sapiens
uuuuaacuucuuucuauuugacu

SEQ ID NO: 1700369 - RNA, 21 nt, Homo sapiens
uuuuaauccuuaacacauuca

SEQ ID NO: 1700370 - RNA, 21 nt, Homo sapiens
uuuuaauuuaaacaccuccuc

SEQ ID NO: 1700371 - RNA, 23 nt, Homo sapiens
uuuuacaauaaaacuuugcugcc

SEQ ID NO: 1700372 - RNA, 18 nt, Homo sapiens
uuuuaccugcccaaggau

SEQ ID NO: 1700373 - RNA, 18 nt, Homo sapiens
uuuuacuucucuauacaa

SEQ ID NO: 1700374 - RNA, 18 nt, Homo sapiens
uuuuagggagaacgggaa

SEQ ID NO: 1700375 - RNA, 22 nt, Homo sapiens
uuuuaucacuucauucacauuc

SEQ ID NO: 1700376 - RNA, 21 nt, Homo sapiens
uuuuaugccuucacuuuacaa

SEQ ID NO: 1700377 - RNA, 14 nt, Homo sapiens
uuuuauuuauaugu

SEQ ID NO: 1700378 - RNA, 21 nt, Homo sapiens
uuuucaaaauauuacucaguu

SEQ ID NO: 1700379 - RNA, 17 nt, Homo sapiens
uuuucaaaauccaaaaa

SEQ ID NO: 1700380 - RNA, 18 nt, Homo sapiens
uuuucaaaauccaaaaag

SEQ ID NO: 1700381 - RNA, 21 nt, Homo sapiens
uuuucaaagauguguugcuau

SEQ ID NO: 1700382 - RNA, 18 nt, Homo sapiens
uuuucagucuaguugcca

SEQ ID NO: 1700383 - RNA, 11 nt, Homo sapiens
uuuucauucau

SEQ ID NO: 1700384 - RNA, 20 nt, Homo sapiens
ugugagcuucagauggugaa

SEQ ID NO: 1700385 - RNA, 13 nt, Homo sapiens
ugugauguucuaa

SEQ ID NO: 1700386 - RNA, 14 nt, Homo sapiens
ugugauugugauuc

SEQ ID NO: 1700387 - RNA, 22 nt, Homo sapiens
ugugcauggaggcccuccugug

SEQ ID NO: 1700388 - RNA, 16 nt, Homo sapiens
ugugccccaugccugu

SEQ ID NO: 1700389 - RNA, 23 nt, Homo sapiens
ugugccugugguuaacaucucag

SEQ ID NO: 1700390 - RNA, 18 nt, Homo sapiens
ugugccuuugcaaaucag

SEQ ID NO: 1700391 - RNA, 13 nt, Homo sapiens
ugugcuacagaug

SEQ ID NO: 1700392 - RNA, 22 nt, Homo sapiens
ugugcuccuccuacccuuccag

SEQ ID NO: 1700393 - RNA, 19 nt, Homo sapiens
uguggacuguggcacuugc

SEQ ID NO: 1700394 - RNA, 16 nt, Homo sapiens
uguggaggauugcuau

SEQ ID NO: 1700395 - RNA, 20 nt, Homo sapiens
uguggaggcuaucaacaaag

SEQ ID NO: 1700396 - RNA, 23 nt, Homo sapiens
uguggcccagggaagccaaaaga

SEQ ID NO: 1700397 - RNA, 16 nt, Homo sapiens
uguggccccaacacaa

SEQ ID NO: 1700398 - RNA, 14 nt, Homo sapiens
ugugggggaaaaau

SEQ ID NO: 1700399 - RNA, 13 nt, Homo sapiens
ugugggggguccu

SEQ ID NO: 1700400 - RNA, 20 nt, Homo sapiens
ugugggucuguguggcagga

SEQ ID NO: 1700401 - RNA, 13 nt, Homo sapiens
ugugggucuucca

SEQ ID NO: 1700402 - RNA, 18 nt, Homo sapiens
uguggguguacauuuugu

SEQ ID NO: 1700403 - RNA, 21 nt, Homo sapiens
uguggucaauccgaaguauga

SEQ ID NO: 1700404 - RNA, 14 nt, Homo sapiens
uguggucaucaugg

SEQ ID NO: 1700405 - RNA, 14 nt, Homo sapiens
uguggucauccugc

SEQ ID NO: 1700406 - RNA, 15 nt, Homo sapiens
uguggucauccugcc

SEQ ID NO: 1700407 - RNA, 12 nt, Homo sapiens
uguggucucagg

SEQ ID NO: 1700408 - RNA, 22 nt, Homo sapiens
uguggugagcagaaguggagcu

SEQ ID NO: 1700409 - RNA, 13 nt, Homo sapiens
uguguaugugcca

SEQ ID NO: 1700410 - RNA, 21 nt, Homo sapiens
uguguauuuacgcuuugauuc

SEQ ID NO: 1700411 - RNA, 15 nt, Homo sapiens
ugugucagcuacugc

SEQ ID NO: 1700412 - RNA, 21 nt, Homo sapiens
ugugucccgaauccacagucg

SEQ ID NO: 1700413 - RNA, 15 nt, Homo sapiens
uguguccucagggag

SEQ ID NO: 1700414 - RNA, 12 nt, Homo sapiens
ugugucuguaca

SEQ ID NO: 1700415 - RNA, 13 nt, Homo sapiens
ugugucuguacac

SEQ ID NO: 1700416 - RNA, 13 nt, Homo sapiens
ugugugacauucc

SEQ ID NO: 1700417 - RNA, 18 nt, Homo sapiens
ugugugacauuccagggg

SEQ ID NO: 1700418 - RNA, 16 nt, Homo sapiens
ugugugaccaacugug

SEQ ID NO: 1700419 - RNA, 16 nt, Homo sapiens
uguguggcagagccag

SEQ ID NO: 1700420 - RNA, 22 nt, Homo sapiens
uguguugucaacaaaccaagca

SEQ ID NO: 1700421 - RNA, 18 nt, Homo sapiens
uguguuucuauugacuuc

SEQ ID NO: 1700422 - RNA, 16 nt, Homo sapiens
uguuacuguucuugcu

SEQ ID NO: 1700423 - RNA, 15 nt, Homo sapiens
uguuagcacuguuga

SEQ ID NO: 1700424 - RNA, 15 nt, Homo sapiens
uguuagcuuccuuaa

SEQ ID NO: 1700425 - RNA, 15 nt, Homo sapiens
uguuaucagucaaua

SEQ ID NO: 1700426 - RNA, 19 nt, Homo sapiens
uguuauuugcacacugcac

SEQ ID NO: 1700427 - RNA, 14 nt, Homo sapiens
uguuccccacugac

SEQ ID NO: 1700428 - RNA, 17 nt, Homo sapiens
uguucucgcaaaaacgu

SEQ ID NO: 1700429 - RNA, 14 nt, Homo sapiens
uguucugcacugaa

SEQ ID NO: 1700430 - RNA, 20 nt, Homo sapiens
uguucuuaugcaaaauggaa

SEQ ID NO: 1700431 - RNA, 17 nt, Homo sapiens
uguugaaucuauuucac

SEQ ID NO: 1700432 - RNA, 21 nt, Homo sapiens
uguugaaucuauuucacuuau

SEQ ID NO: 1700433 - RNA, 18 nt, Homo sapiens
uguugauaaaccauaaau

SEQ ID NO: 1700434 - RNA, 13 nt, Homo sapiens
uguugcaaacuca

SEQ ID NO: 1700435 - RNA, 20 nt, Homo sapiens
uguugcaaacucagugcaaa

SEQ ID NO: 1700436 - RNA, 18 nt, Homo sapiens
uguuuacagacgugugca

SEQ ID NO: 1700437 - RNA, 21 nt, Homo sapiens
uguuuacuucucaccauuuga

SEQ ID NO: 1700438 - RNA, 20 nt, Homo sapiens
uguuucuccuguuggcucac

SEQ ID NO: 1700439 - RNA, 13 nt, Homo sapiens
uguuucuguuauu

SEQ ID NO: 1700440 - RNA, 22 nt, Homo sapiens
uguuugaaauucuagagccagc

SEQ ID NO: 1700441 - RNA, 23 nt, Homo sapiens
uguuuuaauuccaauaugaugac

SEQ ID NO: 1700442 - RNA, 14 nt, Homo sapiens
uguuuugcacuuuu

SEQ ID NO: 1700443 - RNA, 21 nt, Homo sapiens
uguuuuguaggagacuugcca

SEQ ID NO: 1700444 - RNA, 19 nt, Homo sapiens
uguuuuuuuuuuccacuua

SEQ ID NO: 1700445 - RNA, 13 nt, Homo sapiens
uuaaaaaaucuca

SEQ ID NO: 1700446 - RNA, 16 nt, Homo sapiens
uuaaaacaguauuuau

SEQ ID NO: 1700447 - RNA, 17 nt, Homo sapiens
uuaaaacuugaaguagg

SEQ ID NO: 1700448 - RNA, 22 nt, Homo sapiens
uuaaaagguuaaauauugucau

SEQ ID NO: 1700449 - RNA, 16 nt, Homo sapiens
uuaaaauaaugaacac

SEQ ID NO: 1700450 - RNA, 19 nt, Homo sapiens
uuaaaauuaucaauaucua

SEQ ID NO: 1700451 - RNA, 15 nt, Homo sapiens
uuaaaauucaauuag

SEQ ID NO: 1700452 - RNA, 15 nt, Homo sapiens
uuaaacaaaaacuag

SEQ ID NO: 1700453 - RNA, 14 nt, Homo sapiens
uuaaacucagggac

SEQ ID NO: 1700454 - RNA, 18 nt, Homo sapiens
uuaaacuguuagcacugu

SEQ ID NO: 1700455 - RNA, 18 nt, Homo sapiens
uuaaagacguucccuuuu

SEQ ID NO: 1700456 - RNA, 18 nt, Homo sapiens
uuaaagacucaagguggu

SEQ ID NO: 1700457 - RNA, 19 nt, Homo sapiens
uuaaagcaagcaacacaga

SEQ ID NO: 1700458 - RNA, 19 nt, Homo sapiens
uuaaagcauauuggugcua

SEQ ID NO: 1700459 - RNA, 17 nt, Homo sapiens
uuaaagccuuuaguauc

SEQ ID NO: 1700460 - RNA, 15 nt, Homo sapiens
uuaaauaaaccucaa

SEQ ID NO: 1700461 - RNA, 14 nt, Homo sapiens
uuaaaucaaaaggg

SEQ ID NO: 1700462 - RNA, 15 nt, Homo sapiens
uuaaauuaagacuug

SEQ ID NO: 1700463 - RNA, 16 nt, Homo sapiens
uuaaauuuuuuuuaca

SEQ ID NO: 1700464 - RNA, 14 nt, Homo sapiens
uuaacacauucaau

SEQ ID NO: 1700465 - RNA, 21 nt, Homo sapiens
uuaacaugcuuaugacaauga

SEQ ID NO: 1700466 - RNA, 13 nt, Homo sapiens
uuaacauuugccu

SEQ ID NO: 1700467 - RNA, 17 nt, Homo sapiens
uuaaccccauguccuca

SEQ ID NO: 1700468 - RNA, 18 nt, Homo sapiens
uuaaccccauguccucag

SEQ ID NO: 1700469 - RNA, 15 nt, Homo sapiens
uuaagacaugcacua

SEQ ID NO: 1700470 - RNA, 20 nt, Homo sapiens
uuaagacgguuaaauacugu

SEQ ID NO: 1700471 - RNA, 19 nt, Homo sapiens
uuaagauccacaaaugaag

SEQ ID NO: 1700472 - RNA, 21 nt, Homo sapiens
uuaagauuuuacaaaagagga

SEQ ID NO: 1700473 - RNA, 13 nt, Homo sapiens
uuaagcacaagca

SEQ ID NO: 1700474 - RNA, 18 nt, Homo sapiens
uuaagccuaaaugccuua

SEQ ID NO: 1700475 - RNA, 19 nt, Homo sapiens
uuaagccuaaaugccuuag

SEQ ID NO: 1700476 - RNA, 21 nt, Homo sapiens
uuaaggaaacucuuaucucag

SEQ ID NO: 1700477 - RNA, 12 nt, Homo sapiens
uuaagugccuuu

SEQ ID NO: 1700478 - RNA, 13 nt, Homo sapiens
uuaaguggcagaa

SEQ ID NO: 1700479 - RNA, 13 nt, Homo sapiens
uuaauacuguuua

SEQ ID NO: 1700480 - RNA, 17 nt, Homo sapiens
uuaauauaguaacacac

SEQ ID NO: 1700481 - RNA, 17 nt, Homo sapiens
uuaauaugacaaaacaa

SEQ ID NO: 1700482 - RNA, 22 nt, Homo sapiens
uuaauauuuaaacagcaguguu

SEQ ID NO: 1700483 - RNA, 23 nt, Homo sapiens
uuaaucauuuccccauaacucaa

SEQ ID NO: 1700484 - RNA, 20 nt, Homo sapiens
uuaauccaguguuacugugu

SEQ ID NO: 1700485 - RNA, 18 nt, Homo sapiens
uuaauccuuaacacauuc

SEQ ID NO: 1700486 - RNA, 20 nt, Homo sapiens
uuaaucuuggauagcuaaua

SEQ ID NO: 1700487 - RNA, 20 nt, Homo sapiens
uuaaugaacaugugaaguua

SEQ ID NO: 1700488 - RNA, 14 nt, Homo sapiens
uuaaugaaugaguc

SEQ ID NO: 1700489 - RNA, 21 nt, Homo sapiens
uuaauguauuuguuugcaauu

SEQ ID NO: 1700490 - RNA, 23 nt, Homo sapiens
uuaauguuuuuuaaacuaguuua

SEQ ID NO: 1700491 - RNA, 18 nt, Homo sapiens
uuaauuaauggaaucuuc

SEQ ID NO: 1700492 - RNA, 17 nt, Homo sapiens
uuaauuacaacugcuau

SEQ ID NO: 1700493 - RNA, 14 nt, Homo sapiens
uuaauuucuaaaga

SEQ ID NO: 1700494 - RNA, 13 nt, Homo sapiens
gcauuacuuugaa

SEQ ID NO: 1700495 - RNA, 20 nt, Homo sapiens
gcauuauguccacuguguau

SEQ ID NO: 1700496 - RNA, 19 nt, Homo sapiens
gcauucccucccaucaugc

SEQ ID NO: 1700497 - RNA, 13 nt, Homo sapiens
gcauuuguucacu

SEQ ID NO: 1700498 - RNA, 19 nt, Homo sapiens
gccaaagaaaugaacauuc

SEQ ID NO: 1700499 - RNA, 15 nt, Homo sapiens
gccaaauaaaaucua

SEQ ID NO: 1700500 - RNA, 18 nt, Homo sapiens
gccaaucuucaguauuuu

SEQ ID NO: 1700501 - RNA, 21 nt, Homo sapiens
uguacaaugacacuuuuugca

SEQ ID NO: 1700502 - RNA, 22 nt, Homo sapiens
uguacacugacuugagaccagu

SEQ ID NO: 1700503 - RNA, 15 nt, Homo sapiens
uguacagacauacau

SEQ ID NO: 1700504 - RNA, 20 nt, Homo sapiens
uguacauguguagccugugc

SEQ ID NO: 1700505 - RNA, 16 nt, Homo sapiens
uguaccauuugcaugg

SEQ ID NO: 1700506 - RNA, 13 nt, Homo sapiens
uguaccuguguac

SEQ ID NO: 1700507 - RNA, 16 nt, Homo sapiens
uguacuaccuguguau

SEQ ID NO: 1700508 - RNA, 17 nt, Homo sapiens
uguagaugacaaccucc

SEQ ID NO: 1700509 - RNA, 13 nt, Homo sapiens
uguagcagugaga

SEQ ID NO: 1700510 - RNA, 14 nt, Homo sapiens
uguauaagcacuga

SEQ ID NO: 1700511 - RNA, 16 nt, Homo sapiens
uguauacacauauaua

SEQ ID NO: 1700512 - RNA, 19 nt, Homo sapiens
uguauacuauaguaccagu

SEQ ID NO: 1700513 - RNA, 15 nt, Homo sapiens
uguauauuauuuggc

SEQ ID NO: 1700514 - RNA, 18 nt, Homo sapiens
uguauguacguuuguaug

SEQ ID NO: 1700515 - RNA, 18 nt, Homo sapiens
uguauguuccucuaugaa

SEQ ID NO: 1700516 - RNA, 18 nt, Homo sapiens
uguauucuucaaccucau

SEQ ID NO: 1700517 - RNA, 15 nt, Homo sapiens
uguauuuaagcaaau

SEQ ID NO: 1700518 - RNA, 15 nt, Homo sapiens
ugucaaaagccagau

SEQ ID NO: 1700519 - RNA, 17 nt, Homo sapiens
ugucaaaagccagaugu

SEQ ID NO: 1700520 - RNA, 15 nt, Homo sapiens
ugucacagggccaac

SEQ ID NO: 1700521 - RNA, 23 nt, Homo sapiens
ugucaccaacugaaguggcuaaa

SEQ ID NO: 1700522 - RNA, 23 nt, Homo sapiens
ugucaguauuauucuacuauacu

SEQ ID NO: 1700523 - RNA, 18 nt, Homo sapiens
ugucauucgcucccacau

SEQ ID NO: 1700524 - RNA, 19 nt, Homo sapiens
uguccaaucggagacaaaa

SEQ ID NO: 1700525 - RNA, 18 nt, Homo sapiens
uguccagugcaaccacac

SEQ ID NO: 1700526 - RNA, 15 nt, Homo sapiens
uguccauuugcaaau

SEQ ID NO: 1700527 - RNA, 19 nt, Homo sapiens
ugucccacgugucuuccac

SEQ ID NO: 1700528 - RNA, 23 nt, Homo sapiens
ugucccacgugucuuccacuuug

SEQ ID NO: 1700529 - RNA, 12 nt, Homo sapiens
ugucccauuugc

SEQ ID NO: 1700530 - RNA, 17 nt, Homo sapiens
uguccccuccacuguca

SEQ ID NO: 1700531 - RNA, 18 nt, Homo sapiens
uguccccuccacugucac

SEQ ID NO: 1700532 - RNA, 14 nt, Homo sapiens
ugucccucuuccau

SEQ ID NO: 1700533 - RNA, 16 nt, Homo sapiens
ugucccugaaaccuag

SEQ ID NO: 1700534 - RNA, 17 nt, Homo sapiens
uguccuacccacccucc

SEQ ID NO: 1700535 - RNA, 17 nt, Homo sapiens
uguccuacucuguguca

SEQ ID NO: 1700536 - RNA, 18 nt, Homo sapiens
uguccucaaaaggaauaa

SEQ ID NO: 1700537 - RNA, 15 nt, Homo sapiens
ugucucagaagugaa

SEQ ID NO: 1700538 - RNA, 13 nt, Homo sapiens
ugucuccacugug

SEQ ID NO: 1700539 - RNA, 15 nt, Homo sapiens
ugucuccuacuccug

SEQ ID NO: 1700540 - RNA, 23 nt, Homo sapiens
ugucucuuuaagggcaugccuug

SEQ ID NO: 1700541 - RNA, 17 nt, Homo sapiens
ugucugauuuuggccau

SEQ ID NO: 1700542 - RNA, 19 nt, Homo sapiens
ugucuggagugacagacca

SEQ ID NO: 1700543 - RNA, 13 nt, Homo sapiens
ugucuuccacuuu

SEQ ID NO: 1700544 - RNA, 18 nt, Homo sapiens
ugucuuuaacucauaaaa

SEQ ID NO: 1700545 - RNA, 18 nt, Homo sapiens
ugucuuuguucugugauu

SEQ ID NO: 1700546 - RNA, 18 nt, Homo sapiens
ugucuuuucaaaauauua

SEQ ID NO: 1700547 - RNA, 21 nt, Homo sapiens
ugugaaaggaagcuccacugu

SEQ ID NO: 1700548 - RNA, 20 nt, Homo sapiens
ugugaaauucacaguaauau

SEQ ID NO: 1700549 - RNA, 21 nt, Homo sapiens
ugugaaggggagagacagggg

SEQ ID NO: 1700550 - RNA, 16 nt, Homo sapiens
ugugaaguacaauaau

SEQ ID NO: 1700551 - RNA, 22 nt, Homo sapiens
ugugaaucucuucucccuuuga

SEQ ID NO: 1700552 - RNA, 22 nt, Homo sapiens
ugugagauuuuuuauugcuagu

SEQ ID NO: 1700553 - RNA, 20 nt, Homo sapiens
uuuucggaggccccacugau

SEQ ID NO: 1700554 - RNA, 13 nt, Homo sapiens
uuuucuacaaaua

SEQ ID NO: 1700555 - RNA, 14 nt, Homo sapiens
uuuucuaucaaaua

SEQ ID NO: 1700556 - RNA, 14 nt, Homo sapiens
uuuucucaauugua

SEQ ID NO: 1700557 - RNA, 21 nt, Homo sapiens
uuuucuccugccugugcugug

SEQ ID NO: 1700558 - RNA, 22 nt, Homo sapiens
uuuucucuggaaugguacaugu

SEQ ID NO: 1700559 - RNA, 15 nt, Homo sapiens
uuuucucugugcuuc

SEQ ID NO: 1700560 - RNA, 16 nt, Homo sapiens
uuuucucugugcuuca

SEQ ID NO: 1700561 - RNA, 19 nt, Homo sapiens
uuuucuggaauacaugaaa

SEQ ID NO: 1700562 - RNA, 17 nt, Homo sapiens
uuuucuuauugcgcugc

SEQ ID NO: 1700563 - RNA, 14 nt, Homo sapiens
uuuugaaggcaaaa

SEQ ID NO: 1700564 - RNA, 13 nt, Homo sapiens
uuuugaagucuug

SEQ ID NO: 1700565 - RNA, 15 nt, Homo sapiens
uuuugcuacauucua

SEQ ID NO: 1700566 - RNA, 12 nt, Homo sapiens
uuuugucucaga

SEQ ID NO: 1700567 - RNA, 18 nt, Homo sapiens
uuuuuaauauaaagccug

SEQ ID NO: 1700568 - RNA, 12 nt, Homo sapiens
uuuuuagcuuua

SEQ ID NO: 1700569 - RNA, 18 nt, Homo sapiens
uuuuugaaaaaagcucau

SEQ ID NO: 1700570 - RNA, 11 nt, Homo sapiens
uuuuugcaaua

SEQ ID NO: 1700571 - RNA, 13 nt, Homo sapiens
uuuuuuaacauuc

SEQ ID NO: 1700572 - RNA, 13 nt, Homo sapiens
acaggacucugcc

SEQ ID NO: 1700573 - RNA, 18 nt, Homo sapiens
acaggaggaaucauguca

SEQ ID NO: 1700574 - RNA, 19 nt, Homo sapiens
acaggaugcuggccuuugc

SEQ ID NO: 1700575 - RNA, 13 nt, Homo sapiens
acaggcaccugcc

SEQ ID NO: 1700576 - RNA, 13 nt, Homo sapiens
acaggcagucucu

SEQ ID NO: 1700577 - RNA, 16 nt, Homo sapiens
acaggcccuuccucuc

SEQ ID NO: 1700578 - RNA, 22 nt, Homo sapiens
acaggcuguucugcacugaaaa

SEQ ID NO: 1700579 - RNA, 15 nt, Homo sapiens
acagggaggugaccc

SEQ ID NO: 1700580 - RNA, 17 nt, Homo sapiens
acagggccacaacugcc

SEQ ID NO: 1700581 - RNA, 23 nt, Homo sapiens
acagggccaguggggccugugga

SEQ ID NO: 1700582 - RNA, 21 nt, Homo sapiens
acaggggccgcccuuggcucc

SEQ ID NO: 1700583 - RNA, 19 nt, Homo sapiens
acagguggugagaaauuuc

SEQ ID NO: 1700584 - RNA, 14 nt, Homo sapiens
acaguaucccacau

SEQ ID NO: 1700585 - RNA, 14 nt, Homo sapiens
acagucagcucucu

SEQ ID NO: 1700586 - RNA, 15 nt, Homo sapiens
acagucagcucucuc

SEQ ID NO: 1700587 - RNA, 14 nt, Homo sapiens
acagucucacuuug

SEQ ID NO: 1700588 - RNA, 15 nt, Homo sapiens
acagugccaacuccu

SEQ ID NO: 1700589 - RNA, 17 nt, Homo sapiens
acagugccaacuccuca

SEQ ID NO: 1700590 - RNA, 20 nt, Homo sapiens
acagugccgacagcucucca

SEQ ID NO: 1700591 - RNA, 16 nt, Homo sapiens
acaguguacaaugccu

SEQ ID NO: 1700592 - RNA, 19 nt, Homo sapiens
acaguguugaaaauguuca

SEQ ID NO: 1700593 - RNA, 23 nt, Homo sapiens
acaguucaauucucauuugucac

SEQ ID NO: 1700594 - RNA, 13 nt, Homo sapiens
acauaaagccaug

SEQ ID NO: 1700595 - RNA, 14 nt, Homo sapiens
acauaaagccaugu

SEQ ID NO: 1700596 - RNA, 13 nt, Homo sapiens
acauaacucugua

SEQ ID NO: 1700597 - RNA, 16 nt, Homo sapiens
acauacauuucucaua

SEQ ID NO: 1700598 - RNA, 19 nt, Homo sapiens
acauacgaaacacaaacca

SEQ ID NO: 1700599 - RNA, 18 nt, Homo sapiens
acauacuggccuggacug

SEQ ID NO: 1700600 - RNA, 21 nt, Homo sapiens
acauagauuaauggcacugau

SEQ ID NO: 1700601 - RNA, 13 nt, Homo sapiens
acauagcaucuca

SEQ ID NO: 1700602 - RNA, 22 nt, Homo sapiens
acauaguuuauuucaacuauuu

SEQ ID NO: 1700603 - RNA, 19 nt, Homo sapiens
acauauaccuauaaugugu

SEQ ID NO: 1700604 - RNA, 22 nt, Homo sapiens
acauauauacccacauguacag

SEQ ID NO: 1700605 - RNA, 12 nt, Homo sapiens
acauaugcaccu

SEQ ID NO: 1700606 - RNA, 16 nt, Homo sapiens
acauauuaacaugcuu

SEQ ID NO: 1700607 - RNA, 16 nt, Homo sapiens
acauauuuguggaaua

SEQ ID NO: 1700608 - RNA, 21 nt, Homo sapiens
acauauuuguggaauaaugua

SEQ ID NO: 1700609 - RNA, 13 nt, Homo sapiens
acaucacagcagc

SEQ ID NO: 1700610 - RNA, 16 nt, Homo sapiens
acaucacagcagccuc

SEQ ID NO: 1700611 - RNA, 20 nt, Homo sapiens
acauccaaaagcaaccacaa

SEQ ID NO: 1700612 - RNA, 17 nt, Homo sapiens
acauccaaaauaguuaa

SEQ ID NO: 1700613 - RNA, 16 nt, Homo sapiens
acauccaacuccagca

SEQ ID NO: 1700614 - RNA, 17 nt, Homo sapiens
acauccaacuccagcaa

SEQ ID NO: 1700615 - RNA, 15 nt, Homo sapiens
acauccagucacuuu

SEQ ID NO: 1700616 - RNA, 13 nt, Homo sapiens
acauccauuccca

SEQ ID NO: 1700617 - RNA, 21 nt, Homo sapiens
acauccguugugcuugccugc

SEQ ID NO: 1700618 - RNA, 15 nt, Homo sapiens
acaucuaugauauaa

SEQ ID NO: 1700619 - RNA, 22 nt, Homo sapiens
acaucuauuuuggauuguauau

SEQ ID NO: 1700620 - RNA, 12 nt, Homo sapiens
acaucucagggg

SEQ ID NO: 1700621 - RNA, 23 nt, Homo sapiens
acaucuggcuuauuuuaauguga

SEQ ID NO: 1700622 - RNA, 23 nt, Homo sapiens
acaucuucugccuuagucucagu

SEQ ID NO: 1700623 - RNA, 18 nt, Homo sapiens
acaucuugcucugcugac

SEQ ID NO: 1700624 - RNA, 19 nt, Homo sapiens
acaucuugcucugcugaca

SEQ ID NO: 1700625 - RNA, 22 nt, Homo sapiens
acaugaucuguuuuucaccacu

SEQ ID NO: 1700626 - RNA, 23 nt, Homo sapiens
acaugcacacacacacaucucau

SEQ ID NO: 1700627 - RNA, 15 nt, Homo sapiens
acaugcacgugugug

SEQ ID NO: 1700628 - RNA, 15 nt, Homo sapiens
acaugcacugacccu

SEQ ID NO: 1700629 - RNA, 17 nt, Homo sapiens
acaugcagcccaugccc

SEQ ID NO: 1700630 - RNA, 14 nt, Homo sapiens
acauggccuaugca

SEQ ID NO: 1700631 - RNA, 16 nt, Homo sapiens
acauggccuaugcaca

SEQ ID NO: 1700632 - RNA, 17 nt, Homo sapiens
acauggccuaugcacau

SEQ ID NO: 1700633 - RNA, 13 nt, Homo sapiens
acauggcuuucag

SEQ ID NO: 1700634 - RNA, 20 nt, Homo sapiens
acaugggagcaguccaugca

SEQ ID NO: 1700635 - RNA, 17 nt, Homo sapiens
acaugggcucuucacua

SEQ ID NO: 1700636 - RNA, 24 nt, Homo sapiens
acauggugaaaaccccaucucuac

SEQ ID NO: 1700637 - RNA, 13 nt, Homo sapiens
acauguacagaca

SEQ ID NO: 1700638 - RNA, 15 nt, Homo sapiens
acaugugacacauau

SEQ ID NO: 1700639 - RNA, 12 nt, Homo sapiens
acaugugcacau

SEQ ID NO: 1700640 - RNA, 19 nt, Homo sapiens
acauguguagccugugcau

SEQ ID NO: 1700641 - RNA, 22 nt, Homo sapiens
acauguguagccugugcaugua

SEQ ID NO: 1700642 - RNA, 20 nt, Homo sapiens
acauguguguauauaugugu

SEQ ID NO: 1700643 - RNA, 22 nt, Homo sapiens
acauguguguauauauguguau

SEQ ID NO: 1700644 - RNA, 23 nt, Homo sapiens
acauuauagauuuucauguucuu

SEQ ID NO: 1700645 - RNA, 15 nt, Homo sapiens
acauuaugugugcau

SEQ ID NO: 1700646 - RNA, 19 nt, Homo sapiens
acauuauuuaauauaguaa

SEQ ID NO: 1700647 - RNA, 20 nt, Homo sapiens
acauuauuucuaguccaaaa

SEQ ID NO: 1700648 - RNA, 15 nt, Homo sapiens
acauucagaaguaau

SEQ ID NO: 1700649 - RNA, 14 nt, Homo sapiens
acauucagggcuau

SEQ ID NO: 1700650 - RNA, 20 nt, Homo sapiens
acauuccaaugcauugcuaa

SEQ ID NO: 1700651 - RNA, 19 nt, Homo sapiens
acauucuggaaaagcaaaa

SEQ ID NO: 1700652 - RNA, 23 nt, Homo sapiens
acauucuuguuuuaagugccuuu

SEQ ID NO: 1700653 - RNA, 21 nt, Homo sapiens
acauugaguagacacauuuaa

SEQ ID NO: 1700654 - RNA, 14 nt, Homo sapiens
acauugcauucuau

SEQ ID NO: 1700655 - RNA, 17 nt, Homo sapiens
acauuguauguaucuau

SEQ ID NO: 1700656 - RNA, 20 nt, Homo sapiens
acauuuaugaguaacuauua

SEQ ID NO: 1700657 - RNA, 17 nt, Homo sapiens
acauuuaugcacauuca

SEQ ID NO: 1700658 - RNA, 20 nt, Homo sapiens
acauuucaccccaggcucaa

SEQ ID NO: 1700659 - RNA, 17 nt, Homo sapiens
acauuuccucagucaag

SEQ ID NO: 1700660 - RNA, 21 nt, Homo sapiens
acauuugccaacucgaacaaa

SEQ ID NO: 1700661 - RNA, 13 nt, Homo sapiens
acauuuggugggc

SEQ ID NO: 1700662 - RNA, 18 nt, Homo sapiens
accaaaauagucuucuca

SEQ ID NO: 1700663 - RNA, 16 nt, Homo sapiens
accaaaaugacaucuu

SEQ ID NO: 1700664 - RNA, 15 nt, Homo sapiens
accaacccucagagc

SEQ ID NO: 1700665 - RNA, 15 nt, Homo sapiens
accaacuguacaaaa

SEQ ID NO: 1700666 - RNA, 12 nt, Homo sapiens
accaacuuucug

SEQ ID NO: 1700667 - RNA, 18 nt, Homo sapiens
accaagaacauaagaauu

SEQ ID NO: 1700668 - RNA, 16 nt, Homo sapiens
accaagaugccaucug

SEQ ID NO: 1700669 - RNA, 20 nt, Homo sapiens
accaagcauuuagugcacag

SEQ ID NO: 1700670 - RNA, 19 nt, Homo sapiens
accaagucggaacagcaga

SEQ ID NO: 1700671 - RNA, 22 nt, Homo sapiens
accacaaagcacaguuugaaca

SEQ ID NO: 1700672 - RNA, 18 nt, Homo sapiens
accacaucuugcucugcu

SEQ ID NO: 1700673 - RNA, 15 nt, Homo sapiens
accacaugugcacau

SEQ ID NO: 1700674 - RNA, 21 nt, Homo sapiens
accacggccacauuugguucu

SEQ ID NO: 1700675 - RNA, 15 nt, Homo sapiens
accacgguagugccu

SEQ ID NO: 1700676 - RNA, 18 nt, Homo sapiens
accacuacaugcagccca

SEQ ID NO: 1700677 - RNA, 17 nt, Homo sapiens
accacuagaacucucca

SEQ ID NO: 1700678 - RNA, 21 nt, Homo sapiens
accacucaggcauuugacuga

SEQ ID NO: 1700679 - RNA, 17 nt, Homo sapiens
accacugacuacuggcu

SEQ ID NO: 1700680 - RNA, 19 nt, Homo sapiens
accacugcuuaagugccua

SEQ ID NO: 1700681 - RNA, 17 nt, Homo sapiens
accacugggcaaacaga

SEQ ID NO: 1700682 - RNA, 18 nt, Homo sapiens
accacugggcaaacagaa

SEQ ID NO: 1700683 - RNA, 14 nt, Homo sapiens
accacuuaucacau

SEQ ID NO: 1700684 - RNA, 19 nt, Homo sapiens
accagagaccguccucacc

SEQ ID NO: 1700685 - RNA, 11 nt, Homo sapiens
accagaggcag

SEQ ID NO: 1700686 - RNA, 17 nt, Homo sapiens
accagcaucaccugccu

SEQ ID NO: 1700687 - RNA, 13 nt, Homo sapiens
accaguccaugag

SEQ ID NO: 1700688 - RNA, 15 nt, Homo sapiens
accaguggugccuug

SEQ ID NO: 1700689 - RNA, 20 nt, Homo sapiens
accaguguccccuccacugu

SEQ ID NO: 1700690 - RNA, 14 nt, Homo sapiens
accauacugaggga

SEQ ID NO: 1700691 - RNA, 16 nt, Homo sapiens
accauauaccaucucc

SEQ ID NO: 1700692 - RNA, 15 nt, Homo sapiens
accauccagugacaa

SEQ ID NO: 1700693 - RNA, 23 nt, Homo sapiens
accaucuccccaggcuaugccau

SEQ ID NO: 1700694 - RNA, 11 nt, Homo sapiens
accaugaagcg

SEQ ID NO: 1700695 - RNA, 22 nt, Homo sapiens
accauuccauuuccaagcacuu

SEQ ID NO: 1700696 - RNA, 14 nt, Homo sapiens
accauuucagagag

SEQ ID NO: 1700697 - RNA, 19 nt, Homo sapiens
accauuuugggguacccac

SEQ ID NO: 1700698 - RNA, 17 nt, Homo sapiens
accauuuuuuaaggaaa

SEQ ID NO: 1700699 - RNA, 13 nt, Homo sapiens
acccaagggcaga

SEQ ID NO: 1700700 - RNA, 18 nt, Homo sapiens
acccacaccucugccaga

SEQ ID NO: 1700701 - RNA, 16 nt, Homo sapiens
acccaccaucaugucu

SEQ ID NO: 1700702 - RNA, 20 nt, Homo sapiens
acccaccuagaacacuaacu

SEQ ID NO: 1700703 - RNA, 14 nt, Homo sapiens
acccaccucagccu

SEQ ID NO: 1700704 - RNA, 23 nt, Homo sapiens
acccacuguccgcgguggacucu

SEQ ID NO: 1700705 - RNA, 16 nt, Homo sapiens
acccagcaguucuguu

SEQ ID NO: 1700706 - RNA, 16 nt, Homo sapiens
acccaggaccaagcca

SEQ ID NO: 1700707 - RNA, 16 nt, Homo sapiens
acccaggcacugggca

SEQ ID NO: 1700708 - RNA, 23 nt, Homo sapiens
acccaggcacugggcaagugaag

SEQ ID NO: 1700709 - RNA, 20 nt, Homo sapiens
acccagugccuacagggcug

SEQ ID NO: 1700710 - RNA, 20 nt, Homo sapiens
acccauauguuaaaauucuc

SEQ ID NO: 1700711 - RNA, 17 nt, Homo sapiens
acccauucagagacugu

SEQ ID NO: 1700712 - RNA, 21 nt, Homo sapiens
accccaggcucaacugaggau

SEQ ID NO: 1700713 - RNA, 19 nt, Homo sapiens
accccaucuuuacuaaaaa

SEQ ID NO: 1700714 - RNA, 18 nt, Homo sapiens
accccauguccucagcau

SEQ ID NO: 1700715 - RNA, 14 nt, Homo sapiens
acccccagcucaau

SEQ ID NO: 1700716 - RNA, 15 nt, Homo sapiens
acccccagcucaaug

SEQ ID NO: 1700717 - RNA, 20 nt, Homo sapiens
acccccauucucaucugcac

SEQ ID NO: 1700718 - RNA, 21 nt, Homo sapiens
accccgucgaggggcucucag

SEQ ID NO: 1700719 - RNA, 20 nt, Homo sapiens
accccuccaggaaugaucuc

SEQ ID NO: 1700720 - RNA, 14 nt, Homo sapiens
accccucugggaaa

SEQ ID NO: 1700721 - RNA, 13 nt, Homo sapiens
accccugaccuca

SEQ ID NO: 1700722 - RNA, 18 nt, Homo sapiens
accccugaccucacugug

SEQ ID NO: 1700723 - RNA, 18 nt, Homo sapiens
accccugccuacuuccuu

SEQ ID NO: 1700724 - RNA, 15 nt, Homo sapiens
accccugucccaugc

SEQ ID NO: 1700725 - RNA, 18 nt, Homo sapiens
acccguacaggcaauucc

SEQ ID NO: 1700726 - RNA, 14 nt, Homo sapiens
acccguuaccauau

SEQ ID NO: 1700727 - RNA, 22 nt, Homo sapiens
acccuaacacaguauaucccaa

SEQ ID NO: 1700728 - RNA, 20 nt, Homo sapiens
acccuacuucuuuugcucuu

SEQ ID NO: 1700729 - RNA, 20 nt, Homo sapiens
acccuaguuucccugaagga

SEQ ID NO: 1700730 - RNA, 21 nt, Homo sapiens
acccuauuuagaaauggauuu

SEQ ID NO: 1700731 - RNA, 19 nt, Homo sapiens
acccucccccgccacuccu

SEQ ID NO: 1700732 - RNA, 18 nt, Homo sapiens
acccucgcccaacuccac

SEQ ID NO: 1700733 - RNA, 13 nt, Homo sapiens
acccucucagcuc

SEQ ID NO: 1700734 - RNA, 19 nt, Homo sapiens
acccucugggaaccuccca

SEQ ID NO: 1700735 - RNA, 24 nt, Homo sapiens
acccugcaaaauuugaugccagga

SEQ ID NO: 1700736 - RNA, 17 nt, Homo sapiens
acccugcucuccgacca

SEQ ID NO: 1700737 - RNA, 12 nt, Homo sapiens
acccuguaccuc

SEQ ID NO: 1700738 - RNA, 18 nt, Homo sapiens
acccuuggacaagacaaa

SEQ ID NO: 1700739 - RNA, 20 nt, Homo sapiens
acccuuuagacuguagccug

SEQ ID NO: 1700740 - RNA, 19 nt, Homo sapiens
acccuuucaaacuauuuau

SEQ ID NO: 1700741 - RNA, 13 nt, Homo sapiens
accgagcaauuuu

SEQ ID NO: 1700742 - RNA, 21 nt, Homo sapiens
accgggcacucagaagacacu

SEQ ID NO: 1700743 - RNA, 15 nt, Homo sapiens
accgggcugggagcu

SEQ ID NO: 1700744 - RNA, 18 nt, Homo sapiens
accggggccagcaccacu

SEQ ID NO: 1700745 - RNA, 22 nt, Homo sapiens
accggggccagcaccacuuccu

SEQ ID NO: 1700746 - RNA, 16 nt, Homo sapiens
accuaaaccaccagug

SEQ ID NO: 1700747 - RNA, 15 nt, Homo sapiens
accuaaguacuguaa

SEQ ID NO: 1700748 - RNA, 19 nt, Homo sapiens
accuaagucucugugaauu

SEQ ID NO: 1700749 - RNA, 17 nt, Homo sapiens
accuaauucgaugaagg

SEQ ID NO: 1700750 - RNA, 16 nt, Homo sapiens
accuacauauuccaug

SEQ ID NO: 1700751 - RNA, 16 nt, Homo sapiens
accuaccaucagggac

SEQ ID NO: 1700752 - RNA, 17 nt, Homo sapiens
accuacccuccacaggc

SEQ ID NO: 1700753 - RNA, 21 nt, Homo sapiens
accuacccuccacaggcacag

SEQ ID NO: 1700754 - RNA, 16 nt, Homo sapiens
accuagaacacuaacu

SEQ ID NO: 1700755 - RNA, 14 nt, Homo sapiens
accuagacuguaaa

SEQ ID NO: 1700756 - RNA, 21 nt, Homo sapiens
accuagccuuagaagucacac

SEQ ID NO: 1700757 - RNA, 20 nt, Homo sapiens
accuagcuuuauucuucaga

SEQ ID NO: 1700758 - RNA, 16 nt, Homo sapiens
accucaaaaugucuaa

SEQ ID NO: 1700759 - RNA, 13 nt, Homo sapiens
accucacugugac

SEQ ID NO: 1700760 - RNA, 21 nt, Homo sapiens
accucaguucccucuugcuca

SEQ ID NO: 1700761 - RNA, 18 nt, Homo sapiens
accucauguuuaugaaaa

SEQ ID NO: 1700762 - RNA, 11 nt, Homo sapiens
accucccugac

SEQ ID NO: 1700763 - RNA, 19 nt, Homo sapiens
accuccgccagauccugca

SEQ ID NO: 1700764 - RNA, 16 nt, Homo sapiens
accuccuccucuggac

SEQ ID NO: 1700765 - RNA, 17 nt, Homo sapiens
accuccuguggaaccca

SEQ ID NO: 1700766 - RNA, 13 nt, Homo sapiens
accucucauaaau

SEQ ID NO: 1700767 - RNA, 15 nt, Homo sapiens
accucuccauccugc

SEQ ID NO: 1700768 - RNA, 12 nt, Homo sapiens
accucugaccaa

SEQ ID NO: 1700769 - RNA, 14 nt, Homo sapiens
accucugaccaaca

SEQ ID NO: 1700770 - RNA, 20 nt, Homo sapiens
accucugccugaagucacac

SEQ ID NO: 1700771 - RNA, 23 nt, Homo sapiens
accucugccugaagucacacagu

SEQ ID NO: 1700772 - RNA, 20 nt, Homo sapiens
accucugucauuuguuguga

SEQ ID NO: 1700773 - RNA, 22 nt, Homo sapiens
accucugucauuuguugugaug

SEQ ID NO: 1700774 - RNA, 20 nt, Homo sapiens
accucugugaggaaagcaca

SEQ ID NO: 1700775 - RNA, 19 nt, Homo sapiens
accucuucaugagcuugaa

SEQ ID NO: 1700776 - RNA, 22 nt, Homo sapiens
accucuucaugagcuugaacaa

SEQ ID NO: 1700777 - RNA, 22 nt, Homo sapiens
accugauggaaguaaagccuca

SEQ ID NO: 1700778 - RNA, 21 nt, Homo sapiens
accugcagggacuccaugcug

SEQ ID NO: 1700779 - RNA, 13 nt, Homo sapiens
accugcaugugcu

SEQ ID NO: 1700780 - RNA, 13 nt, Homo sapiens
accugccaugcca

SEQ ID NO: 1700781 - RNA, 16 nt, Homo sapiens
accugcccugggccac

SEQ ID NO: 1700782 - RNA, 23 nt, Homo sapiens
accugcccugggccacacugacc

SEQ ID NO: 1700783 - RNA, 21 nt, Homo sapiens
accugcgcucucagcugacca

SEQ ID NO: 1700784 - RNA, 16 nt, Homo sapiens
accugcugaagggcag

SEQ ID NO: 1700785 - RNA, 19 nt, Homo sapiens
accuggggcacaguccagg

SEQ ID NO: 1700786 - RNA, 20 nt, Homo sapiens
accuggggcacaguccagga

SEQ ID NO: 1700787 - RNA, 23 nt, Homo sapiens
accugguggcuacgaaucuuccg

SEQ ID NO: 1700788 - RNA, 21 nt, Homo sapiens
accugucacauugcauucuau

SEQ ID NO: 1700789 - RNA, 21 nt, Homo sapiens
accugucaucauggaggucau

SEQ ID NO: 1700790 - RNA, 21 nt, Homo sapiens
accuuaagauuuugcaccugu

SEQ ID NO: 1700791 - RNA, 18 nt, Homo sapiens
accuuaccaacuuucugu

SEQ ID NO: 1700792 - RNA, 12 nt, Homo sapiens
accuuauccugc

SEQ ID NO: 1700793 - RNA, 14 nt, Homo sapiens
accuucaccuggau

SEQ ID NO: 1700794 - RNA, 15 nt, Homo sapiens
accuucccuugccac

SEQ ID NO: 1700795 - RNA, 20 nt, Homo sapiens
accuucuguggcucacagaa

SEQ ID NO: 1700796 - RNA, 21 nt, Homo sapiens
accuugacuugauuagugccu

SEQ ID NO: 1700797 - RNA, 17 nt, Homo sapiens
accuuucaaauuucaca

SEQ ID NO: 1700798 - RNA, 13 nt, Homo sapiens
acgaaaucuaggu

SEQ ID NO: 1700799 - RNA, 19 nt, Homo sapiens
acgaggccacagcugccau

SEQ ID NO: 1700800 - RNA, 11 nt, Homo sapiens
acgccacugca

SEQ ID NO: 1700801 - RNA, 16 nt, Homo sapiens
acgccaucuccacucu

SEQ ID NO: 1700802 - RNA, 14 nt, Homo sapiens
acgccugagcucac

SEQ ID NO: 1700803 - RNA, 20 nt, Homo sapiens
acgcgugcacacaccagagc

SEQ ID NO: 1700804 - RNA, 14 nt, Homo sapiens
acgcugguggugcu

SEQ ID NO: 1700805 - RNA, 16 nt, Homo sapiens
acgcuguuuguuucau

SEQ ID NO: 1700806 - RNA, 19 nt, Homo sapiens
acgcuugcuuuagcacagg

SEQ ID NO: 1700807 - RNA, 17 nt, Homo sapiens
acggacaauaaaccucc

SEQ ID NO: 1700808 - RNA, 18 nt, Homo sapiens
acggaggcauccuacccu

SEQ ID NO: 1700809 - RNA, 16 nt, Homo sapiens
acggcaucaaggugcu

SEQ ID NO: 1700810 - RNA, 14 nt, Homo sapiens
acggcccugcaaug

SEQ ID NO: 1700811 - RNA, 20 nt, Homo sapiens
acggcucacgcuuaccucaa

SEQ ID NO: 1700812 - RNA, 18 nt, Homo sapiens
acggggaagccgagcucc

SEQ ID NO: 1700813 - RNA, 21 nt, Homo sapiens
acgggggccgcguggugccau

SEQ ID NO: 1700814 - RNA, 14 nt, Homo sapiens
acgguaacauccaa

SEQ ID NO: 1700815 - RNA, 22 nt, Homo sapiens
acgguuaaauacuguguggaac

SEQ ID NO: 1700816 - RNA, 15 nt, Homo sapiens
acgucagacuuggcu

SEQ ID NO: 1700817 - RNA, 15 nt, Homo sapiens
acgugauacauuugg

SEQ ID NO: 1700818 - RNA, 15 nt, Homo sapiens
acgugucuuccacuu

SEQ ID NO: 1700819 - RNA, 17 nt, Homo sapiens
acuaaaacugcauuucc

SEQ ID NO: 1700820 - RNA, 17 nt, Homo sapiens
acuaaaggugcacugcu

SEQ ID NO: 1700821 - RNA, 14 nt, Homo sapiens
acuaagacaccuga

SEQ ID NO: 1700822 - RNA, 16 nt, Homo sapiens
acuaauaauagcauuc

SEQ ID NO: 1700823 - RNA, 20 nt, Homo sapiens
acuaaugauaaaguaaugau

SEQ ID NO: 1700824 - RNA, 13 nt, Homo sapiens
acuacaccagggu

SEQ ID NO: 1700825 - RNA, 19 nt, Homo sapiens
acuacauuugugaacaaaa

SEQ ID NO: 1700826 - RNA, 16 nt, Homo sapiens
acuacuucucuuguua

SEQ ID NO: 1700827 - RNA, 21 nt, Homo sapiens
acuagccaggaaguacuucca

SEQ ID NO: 1700828 - RNA, 16 nt, Homo sapiens
acuagugacagcuugu

SEQ ID NO: 1700829 - RNA, 17 nt, Homo sapiens
acuauaagcccacuguu

SEQ ID NO: 1700830 - RNA, 15 nt, Homo sapiens
acuauauuugcuaga

SEQ ID NO: 1700831 - RNA, 16 nt, Homo sapiens
acuauccaguuacugc

SEQ ID NO: 1700832 - RNA, 18 nt, Homo sapiens
acuauguugcccaggcag

SEQ ID NO: 1700833 - RNA, 18 nt, Homo sapiens
acuauuuaaagccuccuc

SEQ ID NO: 1700834 - RNA, 16 nt, Homo sapiens
acuauuuguuccacau

SEQ ID NO: 1700835 - RNA, 13 nt, Homo sapiens
acucaacaaccaa

SEQ ID NO: 1700836 - RNA, 12 nt, Homo sapiens
acucaccaucug

SEQ ID NO: 1700837 - RNA, 16 nt, Homo sapiens
acucagugcagcaaua

SEQ ID NO: 1700838 - RNA, 17 nt, Homo sapiens
acucagugcagcaauau

SEQ ID NO: 1700839 - RNA, 13 nt, Homo sapiens
acuccagugccag

SEQ ID NO: 1700840 - RNA, 17 nt, Homo sapiens
acuccaguguacauagu

SEQ ID NO: 1700841 - RNA, 20 nt, Homo sapiens
acucccuccucaccucugga

SEQ ID NO: 1700842 - RNA, 18 nt, Homo sapiens
acucccugcagaugccac

SEQ ID NO: 1700843 - RNA, 18 nt, Homo sapiens
acucuaggguccagugga

SEQ ID NO: 1700844 - RNA, 20 nt, Homo sapiens
acucuaggguccaguggaug

SEQ ID NO: 1700845 - RNA, 23 nt, Homo sapiens
acucucacccgaccggugcauga

SEQ ID NO: 1700846 - RNA, 14 nt, Homo sapiens
acucuccuagucaa

SEQ ID NO: 1700847 - RNA, 19 nt, Homo sapiens
acucugaaacacacugaaa

SEQ ID NO: 1700848 - RNA, 18 nt, Homo sapiens
acucugacgcaaaaccac

SEQ ID NO: 1700849 - RNA, 15 nt, Homo sapiens
acucugagaucuaag

SEQ ID NO: 1700850 - RNA, 18 nt, Homo sapiens
acucuggaccauauacca

SEQ ID NO: 1700851 - RNA, 19 nt, Homo sapiens
acucuggggugcugccuga

SEQ ID NO: 1700852 - RNA, 18 nt, Homo sapiens
acucuuguugaguucugu

SEQ ID NO: 1700853 - RNA, 15 nt, Homo sapiens
acugaagaugcagcu

SEQ ID NO: 1700854 - RNA, 19 nt, Homo sapiens
acugaaggcauaugcuggc

SEQ ID NO: 1700855 - RNA, 18 nt, Homo sapiens
acugaagugaacuaugaa

SEQ ID NO: 1700856 - RNA, 14 nt, Homo sapiens
acugaaguggcuaa

SEQ ID NO: 1700857 - RNA, 12 nt, Homo sapiens
acugacacagga

SEQ ID NO: 1700858 - RNA, 16 nt, Homo sapiens
acugacauuguuggcc

SEQ ID NO: 1700859 - RNA, 16 nt, Homo sapiens
acugaccagccuccau

SEQ ID NO: 1700860 - RNA, 19 nt, Homo sapiens
acugaccagccuccaugcu

SEQ ID NO: 1700861 - RNA, 20 nt, Homo sapiens
acugacccugauacaggcau

SEQ ID NO: 1700862 - RNA, 20 nt, Homo sapiens
acugacuuguuugucuucca

SEQ ID NO: 1700863 - RNA, 21 nt, Homo sapiens
acugacuuguuugucuuccau

SEQ ID NO: 1700864 - RNA, 20 nt, Homo sapiens
acugagauuuugguauuaca

SEQ ID NO: 1700865 - RNA, 23 nt, Homo sapiens
acugaggaugauguuauucacag

SEQ ID NO: 1700866 - RNA, 18 nt, Homo sapiens
acugaguguuauuugcac

SEQ ID NO: 1700867 - RNA, 18 nt, Homo sapiens
acugauacuucacuacuu

SEQ ID NO: 1700868 - RNA, 15 nt, Homo sapiens
acugaucuuacucac

SEQ ID NO: 1700869 - RNA, 19 nt, Homo sapiens
acugaugggcaacccccag

SEQ ID NO: 1700870 - RNA, 15 nt, Homo sapiens
acugauucacugcau

SEQ ID NO: 1700871 - RNA, 20 nt, Homo sapiens
acugauuuuuagcuuuacaa

SEQ ID NO: 1700872 - RNA, 18 nt, Homo sapiens
acugcacagugcaucuca

SEQ ID NO: 1700873 - RNA, 19 nt, Homo sapiens
acugcacagugcaucucag

SEQ ID NO: 1700874 - RNA, 20 nt, Homo sapiens
acugcaccgggccacagaga

SEQ ID NO: 1700875 - RNA, 13 nt, Homo sapiens
acugccaucuuag

SEQ ID NO: 1700876 - RNA, 14 nt, Homo sapiens
acugcccccgccac

SEQ ID NO: 1700877 - RNA, 21 nt, Homo sapiens
acugccggggguucaggguug

SEQ ID NO: 1700878 - RNA, 22 nt, Homo sapiens
acugccuggguuccaauccugg

SEQ ID NO: 1700879 - RNA, 14 nt, Homo sapiens
acugcguggugcuc

SEQ ID NO: 1700880 - RNA, 19 nt, Homo sapiens
acugcguggugcucuuugc

SEQ ID NO: 1700881 - RNA, 20 nt, Homo sapiens
acugcugcacaacaagauac

SEQ ID NO: 1700882 - RNA, 19 nt, Homo sapiens
acugcugcccagccuccaa

SEQ ID NO: 1700883 - RNA, 17 nt, Homo sapiens
acugcuucuccaaggac

SEQ ID NO: 1700884 - RNA, 15 nt, Homo sapiens
acuggaagcacagcu

SEQ ID NO: 1700885 - RNA, 20 nt, Homo sapiens
acuggaaguucauaccuaag

SEQ ID NO: 1700886 - RNA, 16 nt, Homo sapiens
acuggagccaucucuu

SEQ ID NO: 1700887 - RNA, 21 nt, Homo sapiens
acuggaguuuuggacuggaua

SEQ ID NO: 1700888 - RNA, 22 nt, Homo sapiens
acuggcaaacauuuuuccagua

SEQ ID NO: 1700889 - RNA, 16 nt, Homo sapiens
acugggacgccuucag

SEQ ID NO: 1700890 - RNA, 17 nt, Homo sapiens
acugggccuuagugggc

SEQ ID NO: 1700891 - RNA, 17 nt, Homo sapiens
acugggucugacaugaa

SEQ ID NO: 1700892 - RNA, 20 nt, Homo sapiens
acugggugaaucuggcagga

SEQ ID NO: 1700893 - RNA, 16 nt, Homo sapiens
acugggugucauuuca

SEQ ID NO: 1700894 - RNA, 22 nt, Homo sapiens
acugguagaacguaaccacgga

SEQ ID NO: 1700895 - RNA, 21 nt, Homo sapiens
acuggucuuguggaauuggga

SEQ ID NO: 1700896 - RNA, 16 nt, Homo sapiens
acugguucacauccua

SEQ ID NO: 1700897 - RNA, 23 nt, Homo sapiens
acuguaacguuuucuuucacaca

SEQ ID NO: 1700898 - RNA, 18 nt, Homo sapiens
acuguaacugacugccuu

SEQ ID NO: 1700899 - RNA, 23 nt, Homo sapiens
acuguacacuuguuuggugcuaa

SEQ ID NO: 1700900 - RNA, 17 nt, Homo sapiens
acuguaccgacuuugau

SEQ ID NO: 1700901 - RNA, 22 nt, Homo sapiens
acuguagcccuggaccugccuc

SEQ ID NO: 1700902 - RNA, 17 nt, Homo sapiens
acuguaucaagucaugg

SEQ ID NO: 1700903 - RNA, 14 nt, Homo sapiens
acugucauagaaau

SEQ ID NO: 1700904 - RNA, 21 nt, Homo sapiens
acuguccugaccaucgcacac

SEQ ID NO: 1700905 - RNA, 14 nt, Homo sapiens
acugugagcaagga

SEQ ID NO: 1700906 - RNA, 18 nt, Homo sapiens
acugugccaugugccagg

SEQ ID NO: 1700907 - RNA, 14 nt, Homo sapiens
acuguggucauccu

SEQ ID NO: 1700908 - RNA, 18 nt, Homo sapiens
acuguguuuuuccuccau

SEQ ID NO: 1700909 - RNA, 15 nt, Homo sapiens
acuguucuugcugcu

SEQ ID NO: 1700910 - RNA, 16 nt, Homo sapiens
acuguugcaaacucag

SEQ ID NO: 1700911 - RNA, 13 nt, Homo sapiens
acuguuucuugcu

SEQ ID NO: 1700912 - RNA, 21 nt, Homo sapiens
acuguuuuguaagugcugcua

SEQ ID NO: 1700913 - RNA, 19 nt, Homo sapiens
acuuaaagcccgccugaca

SEQ ID NO: 1700914 - RNA, 23 nt, Homo sapiens
acuuagaaauugcauuuccugac

SEQ ID NO: 1700915 - RNA, 17 nt, Homo sapiens
acuuagauugugcuccu

SEQ ID NO: 1700916 - RNA, 16 nt, Homo sapiens
acuuaguugcguuaca

SEQ ID NO: 1700917 - RNA, 15 nt, Homo sapiens
acuuauaguacauga

SEQ ID NO: 1700918 - RNA, 19 nt, Homo sapiens
acuucaaugggcucuucca

SEQ ID NO: 1700919 - RNA, 20 nt, Homo sapiens
acuucaaugggcucuuccaa

SEQ ID NO: 1700920 - RNA, 17 nt, Homo sapiens
acuucaggggcacuuca

SEQ ID NO: 1700921 - RNA, 16 nt, Homo sapiens
acuucauucacauuca

SEQ ID NO: 1700922 - RNA, 13 nt, Homo sapiens
acuuccacauuau

SEQ ID NO: 1700923 - RNA, 13 nt, Homo sapiens
acuuccacuuugu

SEQ ID NO: 1700924 - RNA, 19 nt, Homo sapiens
acuuccaggggaaccugcc

SEQ ID NO: 1700925 - RNA, 20 nt, Homo sapiens
acuuccaggggaaccugcca

SEQ ID NO: 1700926 - RNA, 14 nt, Homo sapiens
acuuccauuugcuu

SEQ ID NO: 1700927 - RNA, 14 nt, Homo sapiens
acuucccagugaau

SEQ ID NO: 1700928 - RNA, 13 nt, Homo sapiens
acuuccucaugaa

SEQ ID NO: 1700929 - RNA, 17 nt, Homo sapiens
acuucuaauaucauuca

SEQ ID NO: 1700930 - RNA, 16 nt, Homo sapiens
acuucuccaggucuca

SEQ ID NO: 1700931 - RNA, 11 nt, Homo sapiens
acuucuuguca

SEQ ID NO: 1700932 - RNA, 15 nt, Homo sapiens
acuucuugucuauag

SEQ ID NO: 1700933 - RNA, 16 nt, Homo sapiens
acuugacuugaaugug

SEQ ID NO: 1700934 - RNA, 17 nt, Homo sapiens
acuugagcgugaaucug

SEQ ID NO: 1700935 - RNA, 20 nt, Homo sapiens
acuugauagcaaacacuggg

SEQ ID NO: 1700936 - RNA, 13 nt, Homo sapiens
acuugauuccuug

SEQ ID NO: 1700937 - RNA, 16 nt, Homo sapiens
acuugcugauccauga

SEQ ID NO: 1700938 - RNA, 21 nt, Homo sapiens
acuugcuuuaugccuucuuau

SEQ ID NO: 1700939 - RNA, 23 nt, Homo sapiens
acuuggggagauggaguucuugu

SEQ ID NO: 1700940 - RNA, 16 nt, Homo sapiens
acuugucucauuuuaa

SEQ ID NO: 1700941 - RNA, 19 nt, Homo sapiens
acuugucuucccuucugau

SEQ ID NO: 1700942 - RNA, 14 nt, Homo sapiens
acuuguggacacag

SEQ ID NO: 1700943 - RNA, 18 nt, Homo sapiens
acuuguggacacagcucu

SEQ ID NO: 1700944 - RNA, 15 nt, Homo sapiens
acuuguuuuaugcuc

SEQ ID NO: 1700945 - RNA, 17 nt, Homo sapiens
acuuuaaaagugaucua

SEQ ID NO: 1700946 - RNA, 20 nt, Homo sapiens
acuuuaaacuugucuuuuca

SEQ ID NO: 1700947 - RNA, 21 nt, Homo sapiens
acuuuaucaaagagaaguuac

SEQ ID NO: 1700948 - RNA, 14 nt, Homo sapiens
acuuucucugccau

SEQ ID NO: 1700949 - RNA, 17 nt, Homo sapiens
acuuugaaauaccucau

SEQ ID NO: 1700950 - RNA, 15 nt, Homo sapiens
acuuugcacauuuug

SEQ ID NO: 1700951 - RNA, 19 nt, Homo sapiens
acuuuucggagacagugac

SEQ ID NO: 1700952 - RNA, 21 nt, Homo sapiens
acuuuucggagacagugacug

SEQ ID NO: 1700953 - RNA, 15 nt, Homo sapiens
acuuuucugcugaua

SEQ ID NO: 1700954 - RNA, 19 nt, Homo sapiens
acuuuuuaguuguucagca

SEQ ID NO: 1700955 - RNA, 15 nt, Homo sapiens
agaaaaaaguuuaca

SEQ ID NO: 1700956 - RNA, 17 nt, Homo sapiens
agaaaaacaccgcuucu

SEQ ID NO: 1700957 - RNA, 21 nt, Homo sapiens
agaaaaacaccgcuucugccu

SEQ ID NO: 1700958 - RNA, 12 nt, Homo sapiens
agaaaaaccacu

SEQ ID NO: 1700959 - RNA, 17 nt, Homo sapiens
agaaaaauauauacuaa

SEQ ID NO: 1700960 - RNA, 13 nt, Homo sapiens
agaaaacaacuuc

SEQ ID NO: 1700961 - RNA, 23 nt, Homo sapiens
agaaaacucugguaaaugaucac

SEQ ID NO: 1700962 - RNA, 17 nt, Homo sapiens
agaaaauagagcuuuua

SEQ ID NO: 1700963 - RNA, 22 nt, Homo sapiens
agaaaauauuauguguuuccau

SEQ ID NO: 1700964 - RNA, 16 nt, Homo sapiens
agaaaauucuccugau

SEQ ID NO: 1700965 - RNA, 13 nt, Homo sapiens
agaaaccucggga

SEQ ID NO: 1700966 - RNA, 21 nt, Homo sapiens
agaaacuagaaaugugaauga

SEQ ID NO: 1700967 - RNA, 23 nt, Homo sapiens
agaaagcacgugucucagacugc

SEQ ID NO: 1700968 - RNA, 23 nt, Homo sapiens
agaaagcagccauuggcacugug

SEQ ID NO: 1700969 - RNA, 20 nt, Homo sapiens
agaaagugggugagaugcug

SEQ ID NO: 1700970 - RNA, 13 nt, Homo sapiens
agaaauacuuuca

SEQ ID NO: 1700971 - RNA, 15 nt, Homo sapiens
agaaauauauauaca

SEQ ID NO: 1700972 - RNA, 14 nt, Homo sapiens
agaaauaugugaga

SEQ ID NO: 1700973 - RNA, 14 nt, Homo sapiens
agaaauauuccaaa

SEQ ID NO: 1700974 - RNA, 17 nt, Homo sapiens
agaaaucauaguuuaaa

SEQ ID NO: 1700975 - RNA, 12 nt, Homo sapiens
agaaaugaauau

SEQ ID NO: 1700976 - RNA, 12 nt, Homo sapiens
agaaaugucuaa

SEQ ID NO: 1700977 - RNA, 23 nt, Homo sapiens
agaaauguuaaagguucacaggg

SEQ ID NO: 1700978 - RNA, 22 nt, Homo sapiens
agaaauugacacaaguggaccu

SEQ ID NO: 1700979 - RNA, 20 nt, Homo sapiens
agaacaaaagcgacccauuc

SEQ ID NO: 1700980 - RNA, 22 nt, Homo sapiens
agaacaaaggacagaguaugaa

SEQ ID NO: 1700981 - RNA, 12 nt, Homo sapiens
agaacaggguca

SEQ ID NO: 1700982 - RNA, 21 nt, Homo sapiens
agaacagggucauguuugcag

SEQ ID NO: 1700983 - RNA, 12 nt, Homo sapiens
agaaccaaaggg

SEQ ID NO: 1700984 - RNA, 20 nt, Homo sapiens
agaaccagagaggcucugag

SEQ ID NO: 1700985 - RNA, 15 nt, Homo sapiens
agaaccccguggggu

SEQ ID NO: 1700986 - RNA, 20 nt, Homo sapiens
agaaccuggaaaaauuccag

SEQ ID NO: 1700987 - RNA, 16 nt, Homo sapiens
agaacuacagcucuua

SEQ ID NO: 1700988 - RNA, 16 nt, Homo sapiens
agaacuauaugugaau

SEQ ID NO: 1700989 - RNA, 15 nt, Homo sapiens
agaacucacuggggc

SEQ ID NO: 1700990 - RNA, 21 nt, Homo sapiens
agaacuucccugauugaccug

SEQ ID NO: 1700991 - RNA, 14 nt, Homo sapiens
agaagacagcugcu

SEQ ID NO: 1700992 - RNA, 15 nt, Homo sapiens
agaagagaagcugcu

SEQ ID NO: 1700993 - RNA, 19 nt, Homo sapiens
agaagauccaagaggcccu

SEQ ID NO: 1700994 - RNA, 18 nt, Homo sapiens
agaagcagagagaugcgg

SEQ ID NO: 1700995 - RNA, 18 nt, Homo sapiens
agaagcagccacaccguu

SEQ ID NO: 1700996 - RNA, 22 nt, Homo sapiens
agaagcagccaucacaugaucu

SEQ ID NO: 1700997 - RNA, 22 nt, Homo sapiens
agaagcccugauguguccucag

SEQ ID NO: 1700998 - RNA, 19 nt, Homo sapiens
agaagcggauuuccaggga

SEQ ID NO: 1700999 - RNA, 12 nt, Homo sapiens
agaagcuuccau

SEQ ID NO: 1701000 - RNA, 10 nt, Homo sapiens
agaagggaug

SEQ ID NO: 1701001 - RNA, 20 nt, Homo sapiens
agaaggucauaagggagcau

SEQ ID NO: 1701002 - RNA, 14 nt, Homo sapiens
agaagucuccucaa

SEQ ID NO: 1701003 - RNA, 16 nt, Homo sapiens
agaagugucuaaaaac

SEQ ID NO: 1701004 - RNA, 13 nt, Homo sapiens
agaaguuccucaa

SEQ ID NO: 1701005 - RNA, 15 nt, Homo sapiens
agaaguuuauucuca

SEQ ID NO: 1701006 - RNA, 21 nt, Homo sapiens
agaauaaaaaagaaauccaua

SEQ ID NO: 1701007 - RNA, 22 nt, Homo sapiens
agaauaaauucccaacuucucu

SEQ ID NO: 1701008 - RNA, 20 nt, Homo sapiens
agaauaagaaaacaaucaca

SEQ ID NO: 1701009 - RNA, 18 nt, Homo sapiens
agaauaaggaacaacguu

SEQ ID NO: 1701010 - RNA, 21 nt, Homo sapiens
agaaucugcagcuaacuuauu

SEQ ID NO: 1701011 - RNA, 23 nt, Homo sapiens
agaaugaucagcaucugugaugg

SEQ ID NO: 1701012 - RNA, 15 nt, Homo sapiens
agaauguaucuguga

SEQ ID NO: 1701013 - RNA, 19 nt, Homo sapiens
agaauguugguuuacuuuc

SEQ ID NO: 1701014 - RNA, 19 nt, Homo sapiens
agaauuuaaaauaacacuu

SEQ ID NO: 1701015 - RNA, 16 nt, Homo sapiens
agacaagugacuguau

SEQ ID NO: 1701016 - RNA, 13 nt, Homo sapiens
agacaaguuccau

SEQ ID NO: 1701017 - RNA, 17 nt, Homo sapiens
agacaaguuccauggga

SEQ ID NO: 1701018 - RNA, 13 nt, Homo sapiens
agacaauauacaa

SEQ ID NO: 1701019 - RNA, 20 nt, Homo sapiens
agacaaugcaccuagcugug

SEQ ID NO: 1701020 - RNA, 18 nt, Homo sapiens
agacaccuugacagggca

SEQ ID NO: 1701021 - RNA, 12 nt, Homo sapiens
agacagacccca

SEQ ID NO: 1701022 - RNA, 20 nt, Homo sapiens
agacagaguuuucacucuua

SEQ ID NO: 1701023 - RNA, 19 nt, Homo sapiens
agacaggaagguggugcuu

SEQ ID NO: 1701024 - RNA, 14 nt, Homo sapiens
agacagugacuggu

SEQ ID NO: 1701025 - RNA, 15 nt, Homo sapiens
agacauaaagccaug

SEQ ID NO: 1701026 - RNA, 15 nt, Homo sapiens
agacauacauuucuc

SEQ ID NO: 1701027 - RNA, 12 nt, Homo sapiens
agacaucaucaa

SEQ ID NO: 1701028 - RNA, 19 nt, Homo sapiens
agacaucggccuccaugac

SEQ ID NO: 1701029 - RNA, 17 nt, Homo sapiens
agacauggagguucuaa

SEQ ID NO: 1701030 - RNA, 22 nt, Homo sapiens
agaccaacguuacucagggcuc

SEQ ID NO: 1701031 - RNA, 23 nt, Homo sapiens
agaccaaggaacaaaaaaaccac

SEQ ID NO: 1701032 - RNA, 17 nt, Homo sapiens
agacccccacaccucag

SEQ ID NO: 1701033 - RNA, 13 nt, Homo sapiens
agaccucagggac

SEQ ID NO: 1701034 - RNA, 23 nt, Homo sapiens
agaccucugugaggaaagcacac

SEQ ID NO: 1701035 - RNA, 17 nt, Homo sapiens
agaccugaagugugcac

SEQ ID NO: 1701036 - RNA, 22 nt, Homo sapiens
agaccugagucugcaugugcac

SEQ ID NO: 1701037 - RNA, 23 nt, Homo sapiens
agacgaggccacagcugccaucg

SEQ ID NO: 1701038 - RNA, 18 nt, Homo sapiens
agacuacacaggaugagg

SEQ ID NO: 1701039 - RNA, 16 nt, Homo sapiens
agacuacauuugugaa

SEQ ID NO: 1701040 - RNA, 15 nt, Homo sapiens
agacuagauugccuu

SEQ ID NO: 1701041 - RNA, 13 nt, Homo sapiens
agacuauauacau

SEQ ID NO: 1701042 - RNA, 14 nt, Homo sapiens
agacuccaucucaa

SEQ ID NO: 1701043 - RNA, 15 nt, Homo sapiens
agacucuagagucca

SEQ ID NO: 1701044 - RNA, 15 nt, Homo sapiens
agacuggaagcacag

SEQ ID NO: 1701045 - RNA, 19 nt, Homo sapiens
agacuuacucuaagaucuu

SEQ ID NO: 1701046 - RNA, 16 nt, Homo sapiens
agagaaacuuuauaca

SEQ ID NO: 1701047 - RNA, 17 nt, Homo sapiens
agagaaagugugugauu

SEQ ID NO: 1701048 - RNA, 14 nt, Homo sapiens
agagaaauacuuuc

SEQ ID NO: 1701049 - RNA, 16 nt, Homo sapiens
agagaaauacuuucag

SEQ ID NO: 1701050 - RNA, 14 nt, Homo sapiens
agagaaccaaaggg

SEQ ID NO: 1701051 - RNA, 20 nt, Homo sapiens
agagaagcggauuuccaggg

SEQ ID NO: 1701052 - RNA, 14 nt, Homo sapiens
agagaaugaugaua

SEQ ID NO: 1701053 - RNA, 20 nt, Homo sapiens
agagacagaauguaucugug

SEQ ID NO: 1701054 - RNA, 15 nt, Homo sapiens
agagacuauggagcc

SEQ ID NO: 1701055 - RNA, 21 nt, Homo sapiens
agagacuuggggaaauugcuu

SEQ ID NO: 1701056 - RNA, 15 nt, Homo sapiens
agagagaaauucugu

SEQ ID NO: 1701057 - RNA, 21 nt, Homo sapiens
agagagcagcuuuaaacucag

SEQ ID NO: 1701058 - RNA, 16 nt, Homo sapiens
agagaugucaucagag

SEQ ID NO: 1701059 - RNA, 17 nt, Homo sapiens
agagcaaaucuaugaga

SEQ ID NO: 1701060 - RNA, 23 nt, Homo sapiens
agagcaccuuugcacaggaugcu

SEQ ID NO: 1701061 - RNA, 23 nt, Homo sapiens
agagcagcuuuaaacucagggac

SEQ ID NO: 1701062 - RNA, 17 nt, Homo sapiens
agagcccugugucugua

SEQ ID NO: 1701063 - RNA, 23 nt, Homo sapiens
agagcuaagggugggugcucaga

SEQ ID NO: 1701064 - RNA, 13 nt, Homo sapiens
agaggaauccugg

SEQ ID NO: 1701065 - RNA, 22 nt, Homo sapiens
agaggaugucucaaacuucaga

SEQ ID NO: 1701066 - RNA, 20 nt, Homo sapiens
agaggcgcccuggguggugg

SEQ ID NO: 1701067 - RNA, 14 nt, Homo sapiens
agaggcuccugucc

SEQ ID NO: 1701068 - RNA, 13 nt, Homo sapiens
agaggcucugaga

SEQ ID NO: 1701069 - RNA, 15 nt, Homo sapiens
agaggcucugagaaa

SEQ ID NO: 1701070 - RNA, 19 nt, Homo sapiens
agaggcugcugaaaaccau

SEQ ID NO: 1701071 - RNA, 20 nt, Homo sapiens
agaggucaaggcugcaguga

SEQ ID NO: 1701072 - RNA, 19 nt, Homo sapiens
agagguugcagugagccaa

SEQ ID NO: 1701073 - RNA, 22 nt, Homo sapiens
agaguagaacagauaaucagug

SEQ ID NO: 1701074 - RNA, 18 nt, Homo sapiens
agaguagaauugcauuga

SEQ ID NO: 1701075 - RNA, 16 nt, Homo sapiens
agaguauaugcacuuu

SEQ ID NO: 1701076 - RNA, 16 nt, Homo sapiens
agagucaggaucucac

SEQ ID NO: 1701077 - RNA, 13 nt, Homo sapiens
agagucuaaagau

SEQ ID NO: 1701078 - RNA, 21 nt, Homo sapiens
agagugccguaacaacugugg

SEQ ID NO: 1701079 - RNA, 16 nt, Homo sapiens
agaguguuucuuccac

SEQ ID NO: 1701080 - RNA, 21 nt, Homo sapiens
agaguuugcuauuagagcauu

SEQ ID NO: 1701081 - RNA, 17 nt, Homo sapiens
agauaaaagauguacuu

SEQ ID NO: 1701082 - RNA, 15 nt, Homo sapiens
agauaaacuacauag

SEQ ID NO: 1701083 - RNA, 15 nt, Homo sapiens
agauaauugcuauuu

SEQ ID NO: 1701084 - RNA, 13 nt, Homo sapiens
agauaauuggcaa

SEQ ID NO: 1701085 - RNA, 13 nt, Homo sapiens
agauacaaacugc

SEQ ID NO: 1701086 - RNA, 14 nt, Homo sapiens
agauauuacuuuau

SEQ ID NO: 1701087 - RNA, 16 nt, Homo sapiens
agauauuugguaccau

SEQ ID NO: 1701088 - RNA, 22 nt, Homo sapiens
agaucaaaauaaaaagugacac

SEQ ID NO: 1701089 - RNA, 20 nt, Homo sapiens
agaucaaggaguacaaugcc

SEQ ID NO: 1701090 - RNA, 17 nt, Homo sapiens
agaucacgccacugcac

SEQ ID NO: 1701091 - RNA, 18 nt, Homo sapiens
agaucacgucacugcacu

SEQ ID NO: 1701092 - RNA, 13 nt, Homo sapiens
agaucacugccac

SEQ ID NO: 1701093 - RNA, 14 nt, Homo sapiens
agaucaucagucac

SEQ ID NO: 1701094 - RNA, 11 nt, Homo sapiens
agaucaugaca

SEQ ID NO: 1701095 - RNA, 22 nt, Homo sapiens
agauccugcagaaguacuccua

SEQ ID NO: 1701096 - RNA, 18 nt, Homo sapiens
agaucuggucccuugcag

SEQ ID NO: 1701097 - RNA, 22 nt, Homo sapiens
agaucuguaaguaacuucacau

SEQ ID NO: 1701098 - RNA, 14 nt, Homo sapiens
agaugaacucugaa

SEQ ID NO: 1701099 - RNA, 20 nt, Homo sapiens
agaugaaggagaggcaacau

SEQ ID NO: 1701100 - RNA, 17 nt, Homo sapiens
agaugaaguuuuauaca

SEQ ID NO: 1701101 - RNA, 16 nt, Homo sapiens
agaugaauaaacugaa

SEQ ID NO: 1701102 - RNA, 22 nt, Homo sapiens
agaugacagggaaaacugcaaa

SEQ ID NO: 1701103 - RNA, 16 nt, Homo sapiens
agaugagaacaaagcu

SEQ ID NO: 1701104 - RNA, 14 nt, Homo sapiens
agaugauuguucaa

SEQ ID NO: 1701105 - RNA, 23 nt, Homo sapiens
agaugccgcggaaggucccucag

SEQ ID NO: 1701106 - RNA, 20 nt, Homo sapiens
agaugcugguuuucuaccca

SEQ ID NO: 1701107 - RNA, 19 nt, Homo sapiens
agauggacagacagccacc

SEQ ID NO: 1701108 - RNA, 14 nt, Homo sapiens
agauggaguucuug

SEQ ID NO: 1701109 - RNA, 16 nt, Homo sapiens
agauggcugugccucu

SEQ ID NO: 1701110 - RNA, 22 nt, Homo sapiens
agauggcugugccucugccugu

SEQ ID NO: 1701111 - RNA, 17 nt, Homo sapiens
agaugguuucuugcaag

SEQ ID NO: 1701112 - RNA, 22 nt, Homo sapiens
agauguaagaaauguucuugca

SEQ ID NO: 1701113 - RNA, 16 nt, Homo sapiens
agauuauagauucuaa

SEQ ID NO: 1701114 - RNA, 15 nt, Homo sapiens
agauuccggauccua

SEQ ID NO: 1701115 - RNA, 15 nt, Homo sapiens
agauucuaaagauuc

SEQ ID NO: 1701116 - RNA, 19 nt, Homo sapiens
agauucuaaugaugaucaa

SEQ ID NO: 1701117 - RNA, 17 nt, Homo sapiens
agauucuauaguucuag

SEQ ID NO: 1701118 - RNA, 14 nt, Homo sapiens
agauuguguucuuc

SEQ ID NO: 1701119 - RNA, 15 nt, Homo sapiens
agauuguguucuucc

SEQ ID NO: 1701120 - RNA, 22 nt, Homo sapiens
agauuuagaaaaaaguuuacaa

SEQ ID NO: 1701121 - RNA, 16 nt, Homo sapiens
agauuucaugccuggu

SEQ ID NO: 1701122 - RNA, 17 nt, Homo sapiens
agauuuuacaaaagagg

SEQ ID NO: 1701123 - RNA, 18 nt, Homo sapiens
agauuuugcaccuguaaa

SEQ ID NO: 1701124 - RNA, 13 nt, Homo sapiens
agauuuuugcaau

SEQ ID NO: 1701125 - RNA, 16 nt, Homo sapiens
agauuuuuuauugcua

SEQ ID NO: 1701126 - RNA, 17 nt, Homo sapiens
agcaaaguuuuaccugu

SEQ ID NO: 1701127 - RNA, 20 nt, Homo sapiens
agcaaauaucauacuguuca

SEQ ID NO: 1701128 - RNA, 18 nt, Homo sapiens
agcaaccucccaacccag

SEQ ID NO: 1701129 - RNA, 19 nt, Homo sapiens
agcaacucugagaucuaag

SEQ ID NO: 1701130 - RNA, 21 nt, Homo sapiens
agcaacucugagaucuaagga

SEQ ID NO: 1701131 - RNA, 18 nt, Homo sapiens
agcaagaauaccaagaca

SEQ ID NO: 1701132 - RNA, 18 nt, Homo sapiens
agcaagcucuucacugaa

SEQ ID NO: 1701133 - RNA, 15 nt, Homo sapiens
agcaaguucugagag

SEQ ID NO: 1701134 - RNA, 19 nt, Homo sapiens
agcaaguucugagagccag

SEQ ID NO: 1701135 - RNA, 14 nt, Homo sapiens
agcaaugacaucuc

SEQ ID NO: 1701136 - RNA, 18 nt, Homo sapiens
agcaaugacaucucaggg

SEQ ID NO: 1701137 - RNA, 17 nt, Homo sapiens
agcaauggcacuguugc

SEQ ID NO: 1701138 - RNA, 20 nt, Homo sapiens
agcaauugacugucacuguu

SEQ ID NO: 1701139 - RNA, 13 nt, Homo sapiens
agcacaaacauuu

SEQ ID NO: 1701140 - RNA, 22 nt, Homo sapiens
agcacaaacuuuaggguaaaaa

SEQ ID NO: 1701141 - RNA, 19 nt, Homo sapiens
agcacaagcagagugcaca

SEQ ID NO: 1701142 - RNA, 22 nt, Homo sapiens
agcacaagcaggugaacuggga

SEQ ID NO: 1701143 - RNA, 20 nt, Homo sapiens
agcacagcagccccugcaca

SEQ ID NO: 1701144 - RNA, 13 nt, Homo sapiens
agcacggacaaua

SEQ ID NO: 1701145 - RNA, 15 nt, Homo sapiens
agcacgugucucaga

SEQ ID NO: 1701146 - RNA, 20 nt, Homo sapiens
agcacuagagaaugcacaga

SEQ ID NO: 1701147 - RNA, 18 nt, Homo sapiens
agcacuguugauguaucu

SEQ ID NO: 1701148 - RNA, 22 nt, Homo sapiens
agcacuuacagcucuggccaca

SEQ ID NO: 1701149 - RNA, 20 nt, Homo sapiens
agcagacucuggaggccugu

SEQ ID NO: 1701150 - RNA, 13 nt, Homo sapiens
agcagagcaggca

SEQ ID NO: 1701151 - RNA, 18 nt, Homo sapiens
agcagauggaaugcugug

SEQ ID NO: 1701152 - RNA, 23 nt, Homo sapiens
agcagcgagggcaccuugugauc

SEQ ID NO: 1701153 - RNA, 13 nt, Homo sapiens
agcagcucuguga

SEQ ID NO: 1701154 - RNA, 19 nt, Homo sapiens
agcagcuuuaaacucaggg

SEQ ID NO: 1701155 - RNA, 16 nt, Homo sapiens
agcaggagauugagaa

SEQ ID NO: 1701156 - RNA, 21 nt, Homo sapiens
agcaggccaaggucugagcca

SEQ ID NO: 1701157 - RNA, 17 nt, Homo sapiens
agcaguaaauuugcuag

SEQ ID NO: 1701158 - RNA, 19 nt, Homo sapiens
agcaguaaauuugcuagca

SEQ ID NO: 1701159 - RNA, 13 nt, Homo sapiens
agcaguagcauca

SEQ ID NO: 1701160 - RNA, 15 nt, Homo sapiens
agcagugaaguauaa

SEQ ID NO: 1701161 - RNA, 22 nt, Homo sapiens
agcaguuugcuuuguaugcacu

SEQ ID NO: 1701162 - RNA, 19 nt, Homo sapiens
agcauauuuuaaugcaguu

SEQ ID NO: 1701163 - RNA, 20 nt, Homo sapiens
agcaucccccaaaguucaca

SEQ ID NO: 1701164 - RNA, 13 nt, Homo sapiens
agcaucugugaug

SEQ ID NO: 1701165 - RNA, 23 nt, Homo sapiens
agcaugaggacagaccacagagc

SEQ ID NO: 1701166 - RNA, 16 nt, Homo sapiens
agcaugccucuucccu

SEQ ID NO: 1701167 - RNA, 15 nt, Homo sapiens
agcaugccugaacua

SEQ ID NO: 1701168 - RNA, 21 nt, Homo sapiens
agcauggccccaguccaugcu

SEQ ID NO: 1701169 - RNA, 20 nt, Homo sapiens
agcaugugccuuaaugcuuc

SEQ ID NO: 1701170 - RNA, 18 nt, Homo sapiens
agcauguuuuguauacaa

SEQ ID NO: 1701171 - RNA, 14 nt, Homo sapiens
agcauugagcauaa

SEQ ID NO: 1701172 - RNA, 15 nt, Homo sapiens
agcauuuagugcaca

SEQ ID NO: 1701173 - RNA, 20 nt, Homo sapiens
agcauuuccaacaccacaga

SEQ ID NO: 1701174 - RNA, 23 nt, Homo sapiens
agcauuuccaacaccacagacac

SEQ ID NO: 1701175 - RNA, 23 nt, Homo sapiens
agccaaggaggugaggagcagag

SEQ ID NO: 1701176 - RNA, 16 nt, Homo sapiens
agccaaugucuccucc

SEQ ID NO: 1701177 - RNA, 21 nt, Homo sapiens
agccaauguuuuccacccaua

SEQ ID NO: 1701178 - RNA, 16 nt, Homo sapiens
agccacaagucuucca

SEQ ID NO: 1701179 - RNA, 22 nt, Homo sapiens
agccagaugugaaaacaucuca

SEQ ID NO: 1701180 - RNA, 13 nt, Homo sapiens
agccagauucaaa

SEQ ID NO: 1701181 - RNA, 16 nt, Homo sapiens
agccagccacacuuga

SEQ ID NO: 1701182 - RNA, 16 nt, Homo sapiens
agccaggcugccaagg

SEQ ID NO: 1701183 - RNA, 14 nt, Homo sapiens
agccagggggacua

SEQ ID NO: 1701184 - RNA, 17 nt, Homo sapiens
agccagggggacuagcc

SEQ ID NO: 1701185 - RNA, 13 nt, Homo sapiens
agccauaaauugc

SEQ ID NO: 1701186 - RNA, 17 nt, Homo sapiens
agccauuaaaugaauau

SEQ ID NO: 1701187 - RNA, 17 nt, Homo sapiens
agccauugaucauaaac

SEQ ID NO: 1701188 - RNA, 22 nt, Homo sapiens
agcccaaaggggacaggccuca

SEQ ID NO: 1701189 - RNA, 16 nt, Homo sapiens
agcccagagacuuugu

SEQ ID NO: 1701190 - RNA, 22 nt, Homo sapiens
agcccagcuuggcccuuuccuu

SEQ ID NO: 1701191 - RNA, 12 nt, Homo sapiens
agcccagggugg

SEQ ID NO: 1701192 - RNA, 16 nt, Homo sapiens
agccccacaacuuuaa

SEQ ID NO: 1701193 - RNA, 19 nt, Homo sapiens
agccccaggccucuguguc

SEQ ID NO: 1701194 - RNA, 14 nt, Homo sapiens
agccccuccaaagg

SEQ ID NO: 1701195 - RNA, 17 nt, Homo sapiens
agccccugccucgagga

SEQ ID NO: 1701196 - RNA, 13 nt, Homo sapiens
agcccgucucagu

SEQ ID NO: 1701197 - RNA, 23 nt, Homo sapiens
agcccuacauugugcugcaccug

SEQ ID NO: 1701198 - RNA, 19 nt, Homo sapiens
agcccuuugcuaaaauaua

SEQ ID NO: 1701199 - RNA, 12 nt, Homo sapiens
agccuaacacgg

SEQ ID NO: 1701200 - RNA, 19 nt, Homo sapiens
agccuaauacaacauguag

SEQ ID NO: 1701201 - RNA, 24 nt, Homo sapiens
agccuacaguuauguucagucaca

SEQ ID NO: 1701202 - RNA, 19 nt, Homo sapiens
agccuauaggccaaugcau

SEQ ID NO: 1701203 - RNA, 15 nt, Homo sapiens
agccucaucauuucc

SEQ ID NO: 1701204 - RNA, 12 nt, Homo sapiens
agccuccaacac

SEQ ID NO: 1701205 - RNA, 19 nt, Homo sapiens
agccuccuauccaccacug

SEQ ID NO: 1701206 - RNA, 16 nt, Homo sapiens
agccucuggcauuaga

SEQ ID NO: 1701207 - RNA, 13 nt, Homo sapiens
agccucuggcuag

SEQ ID NO: 1701208 - RNA, 20 nt, Homo sapiens
agccugaggcagccacuucg

SEQ ID NO: 1701209 - RNA, 15 nt, Homo sapiens
agccugagucagggc

SEQ ID NO: 1701210 - RNA, 20 nt, Homo sapiens
agccugcuuugcuuuacugc

SEQ ID NO: 1701211 - RNA, 21 nt, Homo sapiens
agccuggcacagggcaguggg

SEQ ID NO: 1701212 - RNA, 15 nt, Homo sapiens
agccugucccaugga

SEQ ID NO: 1701213 - RNA, 16 nt, Homo sapiens
agccugugcaaugcau

SEQ ID NO: 1701214 - RNA, 17 nt, Homo sapiens
agccuuuggcucuggag

SEQ ID NO: 1701215 - RNA, 18 nt, Homo sapiens
agcgcaucaggccuggca

SEQ ID NO: 1701216 - RNA, 21 nt, Homo sapiens
agcggacuggugaggagcaca

SEQ ID NO: 1701217 - RNA, 22 nt, Homo sapiens
agcggcccuaagggagugucua

SEQ ID NO: 1701218 - RNA, 15 nt, Homo sapiens
agcgucccagucucu

SEQ ID NO: 1701219 - RNA, 19 nt, Homo sapiens
agcgucccagucucuggca

SEQ ID NO: 1701220 - RNA, 16 nt, Homo sapiens
agcgugagccacugca

SEQ ID NO: 1701221 - RNA, 17 nt, Homo sapiens
agcguguuuacaugugu

SEQ ID NO: 1701222 - RNA, 12 nt, Homo sapiens
agcguucccaac

SEQ ID NO: 1701223 - RNA, 12 nt, Homo sapiens
agcuaaccauca

SEQ ID NO: 1701224 - RNA, 20 nt, Homo sapiens
agcuaaguacacaauaagca

SEQ ID NO: 1701225 - RNA, 13 nt, Homo sapiens
agcuacagcuuuc

SEQ ID NO: 1701226 - RNA, 13 nt, Homo sapiens
agcuacaggacau

SEQ ID NO: 1701227 - RNA, 11 nt, Homo sapiens
agcuacagugu

SEQ ID NO: 1701228 - RNA, 12 nt, Homo sapiens
agcuacucagga

SEQ ID NO: 1701229 - RNA, 18 nt, Homo sapiens
agcuaggccuggccagau

SEQ ID NO: 1701230 - RNA, 17 nt, Homo sapiens
agcuaguuaggagccca

SEQ ID NO: 1701231 - RNA, 23 nt, Homo sapiens
agcucaggaaggggugugcugag

SEQ ID NO: 1701232 - RNA, 22 nt, Homo sapiens
agcucaggugucccugcacuug

SEQ ID NO: 1701233 - RNA, 17 nt, Homo sapiens
agcucagucccaucaga

SEQ ID NO: 1701234 - RNA, 16 nt, Homo sapiens
agcucaguguguucug

SEQ ID NO: 1701235 - RNA, 20 nt, Homo sapiens
agcucgcgggacccgacccc

SEQ ID NO: 1701236 - RNA, 19 nt, Homo sapiens
agcucugcuccucucccca

SEQ ID NO: 1701237 - RNA, 21 nt, Homo sapiens
agcucugggguuuguaaggca

SEQ ID NO: 1701238 - RNA, 15 nt, Homo sapiens
agcucuguguugcca

SEQ ID NO: 1701239 - RNA, 20 nt, Homo sapiens
agcucuuacacuacauuaga

SEQ ID NO: 1701240 - RNA, 21 nt, Homo sapiens
agcucuucaggccucccucuc

SEQ ID NO: 1701241 - RNA, 16 nt, Homo sapiens
agcugaaagauugauu

SEQ ID NO: 1701242 - RNA, 17 nt, Homo sapiens
agcugaaaguucuugcu

SEQ ID NO: 1701243 - RNA, 18 nt, Homo sapiens
agcugaacaauaggcugu

SEQ ID NO: 1701244 - RNA, 18 nt, Homo sapiens
agcugaucauaagugaau

SEQ ID NO: 1701245 - RNA, 15 nt, Homo sapiens
agcugauuaccugaa

SEQ ID NO: 1701246 - RNA, 13 nt, Homo sapiens
agcugcauuucag

SEQ ID NO: 1701247 - RNA, 19 nt, Homo sapiens
agcugccaucgaccuggag

SEQ ID NO: 1701248 - RNA, 14 nt, Homo sapiens
agcugccucacuuc

SEQ ID NO: 1701249 - RNA, 20 nt, Homo sapiens
agcugcucugaaaucuccuu

SEQ ID NO: 1701250 - RNA, 19 nt, Homo sapiens
agcugcugucuucuggaca

SEQ ID NO: 1701251 - RNA, 23 nt, Homo sapiens
agcuggaagggucaacaucuuuu

SEQ ID NO: 1701252 - RNA, 21 nt, Homo sapiens
agcuguaguagcccuuucugu

SEQ ID NO: 1701253 - RNA, 17 nt, Homo sapiens
agcugucaggcugauua

SEQ ID NO: 1701254 - RNA, 17 nt, Homo sapiens
agcugucccaccugcac

SEQ ID NO: 1701255 - RNA, 19 nt, Homo sapiens
agcugucccaccugcacac

SEQ ID NO: 1701256 - RNA, 15 nt, Homo sapiens
agcugucgacuucau

SEQ ID NO: 1701257 - RNA, 13 nt, Homo sapiens
agcugucugcuca

SEQ ID NO: 1701258 - RNA, 15 nt, Homo sapiens
agcugugaacaggcu

SEQ ID NO: 1701259 - RNA, 19 nt, Homo sapiens
agcugugacuucuccaggu

SEQ ID NO: 1701260 - RNA, 17 nt, Homo sapiens
agcugugggacaauuau

SEQ ID NO: 1701261 - RNA, 22 nt, Homo sapiens
agcuguuguacauuuaugauuu

SEQ ID NO: 1701262 - RNA, 15 nt, Homo sapiens
agcuuacaaucgcaa

SEQ ID NO: 1701263 - RNA, 17 nt, Homo sapiens
agcuuaccugacacaag

SEQ ID NO: 1701264 - RNA, 17 nt, Homo sapiens
agcuucauuuugguaag

SEQ ID NO: 1701265 - RNA, 15 nt, Homo sapiens
agcuuccugucaaca

SEQ ID NO: 1701266 - RNA, 20 nt, Homo sapiens
agcuuccuuaaguauaucau

SEQ ID NO: 1701267 - RNA, 17 nt, Homo sapiens
agcuuccuucugugaaa

SEQ ID NO: 1701268 - RNA, 18 nt, Homo sapiens
agcuuggggccaccaaag

SEQ ID NO: 1701269 - RNA, 17 nt, Homo sapiens
agcuuguaaauagcuca

SEQ ID NO: 1701270 - RNA, 21 nt, Homo sapiens
agcuuuaaacucagggacaga

SEQ ID NO: 1701271 - RNA, 15 nt, Homo sapiens
aggaaaacgugcuuu

SEQ ID NO: 1701272 - RNA, 20 nt, Homo sapiens
aggaaaaguuauugugauaa

SEQ ID NO: 1701273 - RNA, 12 nt, Homo sapiens
aggaaacaguua

SEQ ID NO: 1701274 - RNA, 18 nt, Homo sapiens
aggaacaaaaaaaccaca

SEQ ID NO: 1701275 - RNA, 13 nt, Homo sapiens
aggaacagcacug

SEQ ID NO: 1701276 - RNA, 13 nt, Homo sapiens
aggaacauuccuu

SEQ ID NO: 1701277 - RNA, 13 nt, Homo sapiens
aggaaccuuccuu

SEQ ID NO: 1701278 - RNA, 15 nt, Homo sapiens
aggaagaaugaaacu

SEQ ID NO: 1701279 - RNA, 22 nt, Homo sapiens
aggaagcuccacugucacccuc

SEQ ID NO: 1701280 - RNA, 15 nt, Homo sapiens
aggaaggaacagcaa

SEQ ID NO: 1701281 - RNA, 21 nt, Homo sapiens
aggaaggaacagcaauggugu

SEQ ID NO: 1701282 - RNA, 17 nt, Homo sapiens
aggaaggucucauucuu

SEQ ID NO: 1701283 - RNA, 16 nt, Homo sapiens
aggaaguagaagucau

SEQ ID NO: 1701284 - RNA, 17 nt, Homo sapiens
aggaaguucaacuucca

SEQ ID NO: 1701285 - RNA, 19 nt, Homo sapiens
aggacaaaacuucuuguca

SEQ ID NO: 1701286 - RNA, 21 nt, Homo sapiens
aggacagggaggugaccccag

SEQ ID NO: 1701287 - RNA, 20 nt, Homo sapiens
aggacauugcggacagccac

SEQ ID NO: 1701288 - RNA, 15 nt, Homo sapiens
aggaccacucagccc

SEQ ID NO: 1701289 - RNA, 14 nt, Homo sapiens
aggacuacaaccaa

SEQ ID NO: 1701290 - RNA, 21 nt, Homo sapiens
aggacucuauuuuaaggacug

SEQ ID NO: 1701291 - RNA, 18 nt, Homo sapiens
aggacugaccucuuccuc

SEQ ID NO: 1701292 - RNA, 16 nt, Homo sapiens
aggacuuccauuugcu

SEQ ID NO: 1701293 - RNA, 22 nt, Homo sapiens
aggacuuuaucuaauaccucug

SEQ ID NO: 1701294 - RNA, 21 nt, Homo sapiens
aggagaaccacuacaugcagc

SEQ ID NO: 1701295 - RNA, 14 nt, Homo sapiens
aggagaaggggaag

SEQ ID NO: 1701296 - RNA, 16 nt, Homo sapiens
aggagacgacaggcga

SEQ ID NO: 1701297 - RNA, 18 nt, Homo sapiens
aggagagagaaagccagg

SEQ ID NO: 1701298 - RNA, 16 nt, Homo sapiens
aggagcacagguccca

SEQ ID NO: 1701299 - RNA, 16 nt, Homo sapiens
aggagccgaccgggaa

SEQ ID NO: 1701300 - RNA, 17 nt, Homo sapiens
aggagcugagguuucac

SEQ ID NO: 1701301 - RNA, 18 nt, Homo sapiens
aggaggcgcccuuggcuu

SEQ ID NO: 1701302 - RNA, 17 nt, Homo sapiens
aggaggcuggcagguau

SEQ ID NO: 1701303 - RNA, 23 nt, Homo sapiens
aggagucugccuccaugcugcag

SEQ ID NO: 1701304 - RNA, 19 nt, Homo sapiens
aggagugugugacauucca

SEQ ID NO: 1701305 - RNA, 18 nt, Homo sapiens
aggaguucgagaccagcc

SEQ ID NO: 1701306 - RNA, 19 nt, Homo sapiens
aggauauuaacaacaauaa

SEQ ID NO: 1701307 - RNA, 17 nt, Homo sapiens
aggaucaguuaacuauu

SEQ ID NO: 1701308 - RNA, 22 nt, Homo sapiens
aggaucuccuguccaucagcca

SEQ ID NO: 1701309 - RNA, 13 nt, Homo sapiens
aggaugugcaagc

SEQ ID NO: 1701310 - RNA, 14 nt, Homo sapiens
aggcaaauguguac

SEQ ID NO: 1701311 - RNA, 21 nt, Homo sapiens
aggcacuagccuuuggcucug

SEQ ID NO: 1701312 - RNA, 19 nt, Homo sapiens
aggcagaguuugccuuccu

SEQ ID NO: 1701313 - RNA, 16 nt, Homo sapiens
aggcagcccugccaug

SEQ ID NO: 1701314 - RNA, 20 nt, Homo sapiens
aggcagcccugccaugucac

SEQ ID NO: 1701315 - RNA, 17 nt, Homo sapiens
aggcagcucgugugccu

SEQ ID NO: 1701316 - RNA, 15 nt, Homo sapiens
aggcaggcagaucac

SEQ ID NO: 1701317 - RNA, 17 nt, Homo sapiens
aggcagggcaaaugaca

SEQ ID NO: 1701318 - RNA, 23 nt, Homo sapiens
aggcagggugagcuccagcugcu

SEQ ID NO: 1701319 - RNA, 13 nt, Homo sapiens
aggcauggcagaa

SEQ ID NO: 1701320 - RNA, 15 nt, Homo sapiens
aggcaugggugcaag

SEQ ID NO: 1701321 - RNA, 16 nt, Homo sapiens
aggcaugguggcucac

SEQ ID NO: 1701322 - RNA, 21 nt, Homo sapiens
aggcauguagcuacaggacau

SEQ ID NO: 1701323 - RNA, 22 nt, Homo sapiens
aggccaccccuaggaacucagu

SEQ ID NO: 1701324 - RNA, 20 nt, Homo sapiens
aggccacuugaugaccccca

SEQ ID NO: 1701325 - RNA, 16 nt, Homo sapiens
aggccagcaagcucuu

SEQ ID NO: 1701326 - RNA, 14 nt, Homo sapiens
aggcccaacuguga

SEQ ID NO: 1701327 - RNA, 20 nt, Homo sapiens
aggcccugcugcccaaucuc

SEQ ID NO: 1701328 - RNA, 17 nt, Homo sapiens
aggcccuggaacucuau

SEQ ID NO: 1701329 - RNA, 14 nt, Homo sapiens
aggcccuggcugag

SEQ ID NO: 1701330 - RNA, 19 nt, Homo sapiens
aggccucucucaccucucc

SEQ ID NO: 1701331 - RNA, 23 nt, Homo sapiens
aggccuggccagaugcaccagcc

SEQ ID NO: 1701332 - RNA, 16 nt, Homo sapiens
aggccuuccagcugcu

SEQ ID NO: 1701333 - RNA, 21 nt, Homo sapiens
aggccuuugugucuguguccu

SEQ ID NO: 1701334 - RNA, 19 nt, Homo sapiens
aggcgauccaccugucuca

SEQ ID NO: 1701335 - RNA, 16 nt, Homo sapiens
aggcuaucaacaaaga

SEQ ID NO: 1701336 - RNA, 16 nt, Homo sapiens
aggcucaacugaggau

SEQ ID NO: 1701337 - RNA, 14 nt, Homo sapiens
aggcugaggacuua

SEQ ID NO: 1701338 - RNA, 18 nt, Homo sapiens
aggcugcccacucuccau

SEQ ID NO: 1701339 - RNA, 16 nt, Homo sapiens
aggcugccccucucac

SEQ ID NO: 1701340 - RNA, 18 nt, Homo sapiens
aggcugccccucucacca

SEQ ID NO: 1701341 - RNA, 18 nt, Homo sapiens
aggcugggccauguccaa

SEQ ID NO: 1701342 - RNA, 21 nt, Homo sapiens
aggcugggccauguccaaaga

SEQ ID NO: 1701343 - RNA, 15 nt, Homo sapiens
aggcuuuaugauaau

SEQ ID NO: 1701344 - RNA, 20 nt, Homo sapiens
aggcuuuguacagagugcuu

SEQ ID NO: 1701345 - RNA, 22 nt, Homo sapiens
agggaaagugcauaugaaaucc

SEQ ID NO: 1701346 - RNA, 13 nt, Homo sapiens
agggaagccaaaa

SEQ ID NO: 1701347 - RNA, 15 nt, Homo sapiens
agggaagcucagggg

SEQ ID NO: 1701348 - RNA, 22 nt, Homo sapiens
agggaagcugucccucacuguu

SEQ ID NO: 1701349 - RNA, 16 nt, Homo sapiens
agggacucccacaaca

SEQ ID NO: 1701350 - RNA, 14 nt, Homo sapiens
agggagaagggaug

SEQ ID NO: 1701351 - RNA, 13 nt, Homo sapiens
agggcaccuggag

SEQ ID NO: 1701352 - RNA, 15 nt, Homo sapiens
agggcagaaagguuc

SEQ ID NO: 1701353 - RNA, 14 nt, Homo sapiens
agggcagaggugga

SEQ ID NO: 1701354 - RNA, 16 nt, Homo sapiens
agggcauaucggcuca

SEQ ID NO: 1701355 - RNA, 14 nt, Homo sapiens
agggcaucaucuau

SEQ ID NO: 1701356 - RNA, 18 nt, Homo sapiens
agggccaagcaccuagcc

SEQ ID NO: 1701357 - RNA, 17 nt, Homo sapiens
agggccgaggaggugcc

SEQ ID NO: 1701358 - RNA, 19 nt, Homo sapiens
agggcugccaccaagguga

SEQ ID NO: 1701359 - RNA, 16 nt, Homo sapiens
aggggcacuucauuga

SEQ ID NO: 1701360 - RNA, 16 nt, Homo sapiens
agggggaagaagcaga

SEQ ID NO: 1701361 - RNA, 22 nt, Homo sapiens
agggggcaagaaguagcagugu

SEQ ID NO: 1701362 - RNA, 18 nt, Homo sapiens
aggggugauaacucagga

SEQ ID NO: 1701363 - RNA, 14 nt, Homo sapiens
aggggugugcugag

SEQ ID NO: 1701364 - RNA, 23 nt, Homo sapiens
agggucugugugaaugugggcac

SEQ ID NO: 1701365 - RNA, 18 nt, Homo sapiens
agggucuucccuaccuca

SEQ ID NO: 1701366 - RNA, 17 nt, Homo sapiens
agggucuuugcaagaau

SEQ ID NO: 1701367 - RNA, 23 nt, Homo sapiens
aggguggacuuagaaagcagggg

SEQ ID NO: 1701368 - RNA, 23 nt, Homo sapiens
agggugggguaaccaaauguugg

SEQ ID NO: 1701369 - RNA, 13 nt, Homo sapiens
aggguggugaccu

SEQ ID NO: 1701370 - RNA, 16 nt, Homo sapiens
aggguugauccugcau

SEQ ID NO: 1701371 - RNA, 20 nt, Homo sapiens
aggguugggcccagaucugg

SEQ ID NO: 1701372 - RNA, 19 nt, Homo sapiens
agguaauuuuuacccuaau

SEQ ID NO: 1701373 - RNA, 22 nt, Homo sapiens
agguacuucaggggcacuucau

SEQ ID NO: 1701374 - RNA, 20 nt, Homo sapiens
agguagaccaggauuucuaa

SEQ ID NO: 1701375 - RNA, 16 nt, Homo sapiens
agguauggcucugcac

SEQ ID NO: 1701376 - RNA, 22 nt, Homo sapiens
aggucaaggcugcagugagcca

SEQ ID NO: 1701377 - RNA, 18 nt, Homo sapiens
aggucacauugugccuuu

SEQ ID NO: 1701378 - RNA, 12 nt, Homo sapiens
aggucaccagca

SEQ ID NO: 1701379 - RNA, 21 nt, Homo sapiens
aggucagcccagccccuccaa

SEQ ID NO: 1701380 - RNA, 22 nt, Homo sapiens
aggucagggagugcuggcucac

SEQ ID NO: 1701381 - RNA, 19 nt, Homo sapiens
aggucauacaugcauacaa

SEQ ID NO: 1701382 - RNA, 20 nt, Homo sapiens
aggucucacgggcaugggca

SEQ ID NO: 1701383 - RNA, 17 nt, Homo sapiens
aggugaacugggagcag

SEQ ID NO: 1701384 - RNA, 23 nt, Homo sapiens
aggugaacugggagcagcucugu

SEQ ID NO: 1701385 - RNA, 15 nt, Homo sapiens
aggugauagcauugc

SEQ ID NO: 1701386 - RNA, 20 nt, Homo sapiens
aggugauccacccaccucag

SEQ ID NO: 1701387 - RNA, 20 nt, Homo sapiens
aggugcuggaggugggagca

SEQ ID NO: 1701388 - RNA, 23 nt, Homo sapiens
aggugucugagaugggcccguac

SEQ ID NO: 1701389 - RNA, 16 nt, Homo sapiens
agguucagcugaagcu

SEQ ID NO: 1701390 - RNA, 22 nt, Homo sapiens
agguucccuguucuuccuccag

SEQ ID NO: 1701391 - RNA, 23 nt, Homo sapiens
agguugucugaagucacugcaca

SEQ ID NO: 1701392 - RNA, 13 nt, Homo sapiens
agguuuacauuca

SEQ ID NO: 1701393 - RNA, 22 nt, Homo sapiens
agguuucacccuuaacccaagg

SEQ ID NO: 1701394 - RNA, 16 nt, Homo sapiens
agguuuuuggucugac

SEQ ID NO: 1701395 - RNA, 22 nt, Homo sapiens
agguuuuuggucugacccacug

SEQ ID NO: 1701396 - RNA, 19 nt, Homo sapiens
aguaacacacuuccagugu

SEQ ID NO: 1701397 - RNA, 17 nt, Homo sapiens
aguaacaggaaaccacu

SEQ ID NO: 1701398 - RNA, 19 nt, Homo sapiens
aguaacaggaaaccacuua

SEQ ID NO: 1701399 - RNA, 16 nt, Homo sapiens
aguaaccauuugcacu

SEQ ID NO: 1701400 - RNA, 21 nt, Homo sapiens
aguaacucccaucaccucuaa

SEQ ID NO: 1701401 - RNA, 15 nt, Homo sapiens
aguaauagagcaaaa

SEQ ID NO: 1701402 - RNA, 19 nt, Homo sapiens
aguaauagcgccucuuuua

SEQ ID NO: 1701403 - RNA, 19 nt, Homo sapiens
aguaaucccagcuacucag

SEQ ID NO: 1701404 - RNA, 13 nt, Homo sapiens
aguaaucuguaca

SEQ ID NO: 1701405 - RNA, 16 nt, Homo sapiens
aguaaugaucucaaac

SEQ ID NO: 1701406 - RNA, 21 nt, Homo sapiens
aguaauguaaaauccauccaa

SEQ ID NO: 1701407 - RNA, 16 nt, Homo sapiens
aguaauguuaauucuu

SEQ ID NO: 1701408 - RNA, 15 nt, Homo sapiens
aguaauuaugcacua

SEQ ID NO: 1701409 - RNA, 22 nt, Homo sapiens
aguacacuuuuaugagcuucca

SEQ ID NO: 1701410 - RNA, 21 nt, Homo sapiens
aguaccaaagaaauuauaaac

SEQ ID NO: 1701411 - RNA, 15 nt, Homo sapiens
aguacccagugccua

SEQ ID NO: 1701412 - RNA, 14 nt, Homo sapiens
aguacuccaagaca

SEQ ID NO: 1701413 - RNA, 21 nt, Homo sapiens
aguacuugugaaacacagcug

SEQ ID NO: 1701414 - RNA, 19 nt, Homo sapiens
aguagagcuguguauuaaa

SEQ ID NO: 1701415 - RNA, 23 nt, Homo sapiens
aguagcuuaccagaagcuuccau

SEQ ID NO: 1701416 - RNA, 22 nt, Homo sapiens
aguagguuuacauucaucucau

SEQ ID NO: 1701417 - RNA, 9 nt, Homo sapiens
aguaguccu

SEQ ID NO: 1701418 - RNA, 17 nt, Homo sapiens
aguaguccuuggcauag

SEQ ID NO: 1701419 - RNA, 21 nt, Homo sapiens
aguaucaggucucccacgugg

SEQ ID NO: 1701420 - RNA, 13 nt, Homo sapiens
aguauccacuuug

SEQ ID NO: 1701421 - RNA, 23 nt, Homo sapiens
aguaucuguauguauauauacac

SEQ ID NO: 1701422 - RNA, 13 nt, Homo sapiens
aguauugagauac

SEQ ID NO: 1701423 - RNA, 16 nt, Homo sapiens
aguauugguguaugua

SEQ ID NO: 1701424 - RNA, 22 nt, Homo sapiens
aguauuugcugaauggggaccu

SEQ ID NO: 1701425 - RNA, 23 nt, Homo sapiens
aguauuugggaagugaagacugg

SEQ ID NO: 1701426 - RNA, 19 nt, Homo sapiens
aguauuuugaaguuuacau

SEQ ID NO: 1701427 - RNA, 20 nt, Homo sapiens
agucacacacacauacaaaa

SEQ ID NO: 1701428 - RNA, 12 nt, Homo sapiens
agucacaugacc

SEQ ID NO: 1701429 - RNA, 21 nt, Homo sapiens
agucacaugcguaaacgacac

SEQ ID NO: 1701430 - RNA, 21 nt, Homo sapiens
agucaccacuccauucccaac

SEQ ID NO: 1701431 - RNA, 18 nt, Homo sapiens
agucaucuuguaauuucc

SEQ ID NO: 1701432 - RNA, 15 nt, Homo sapiens
agucauugaggcccu

SEQ ID NO: 1701433 - RNA, 18 nt, Homo sapiens
agucauugaggcccugcu

SEQ ID NO: 1701434 - RNA, 22 nt, Homo sapiens
aguccaaauaacaaguaccaaa

SEQ ID NO: 1701435 - RNA, 18 nt, Homo sapiens
aguccaucuaacaucaua

SEQ ID NO: 1701436 - RNA, 19 nt, Homo sapiens
agucccaaugguccugacu

SEQ ID NO: 1701437 - RNA, 18 nt, Homo sapiens
aguccuccgguugcauac

SEQ ID NO: 1701438 - RNA, 17 nt, Homo sapiens
aguccugacacuauuca

SEQ ID NO: 1701439 - RNA, 19 nt, Homo sapiens
aguccugacacuauucauu

SEQ ID NO: 1701440 - RNA, 20 nt, Homo sapiens
agucuauaccauagcaaugu

SEQ ID NO: 1701441 - RNA, 12 nt, Homo sapiens
agucucugugaa

SEQ ID NO: 1701442 - RNA, 21 nt, Homo sapiens
agucugcuacccucauuucuc

SEQ ID NO: 1701443 - RNA, 16 nt, Homo sapiens
agucuguacuucauca

SEQ ID NO: 1701444 - RNA, 20 nt, Homo sapiens
agucuucaacauaacccacu

SEQ ID NO: 1701445 - RNA, 23 nt, Homo sapiens
agucuugguuucucucuacagug

SEQ ID NO: 1701446 - RNA, 22 nt, Homo sapiens
agucuuuuguucgcauggucac

SEQ ID NO: 1701447 - RNA, 18 nt, Homo sapiens
agugaaauuauacagaua

SEQ ID NO: 1701448 - RNA, 22 nt, Homo sapiens
ccuguuuucgcaccuaccauca

SEQ ID NO: 1701449 - RNA, 22 nt, Homo sapiens
ccuuacgcuuugucacacaaaa

SEQ ID NO: 1701450 - RNA, 23 nt, Homo sapiens
ccuuagaaauguaaacugccaua

SEQ ID NO: 1701451 - RNA, 14 nt, Homo sapiens
ccuuagagguccuc

SEQ ID NO: 1701452 - RNA, 13 nt, Homo sapiens
ccuucaccuggau

SEQ ID NO: 1701453 - RNA, 14 nt, Homo sapiens
ccuucacuuuacaa

SEQ ID NO: 1701454 - RNA, 14 nt, Homo sapiens
ccuuccagcugcug

SEQ ID NO: 1701455 - RNA, 15 nt, Homo sapiens
ccuuccugagcuuua

SEQ ID NO: 1701456 - RNA, 17 nt, Homo sapiens
ccuuccuuucuccagga

SEQ ID NO: 1701457 - RNA, 13 nt, Homo sapiens
ccuucggcagcua

SEQ ID NO: 1701458 - RNA, 23 nt, Homo sapiens
ccuucucacagcacaugcuggcc

SEQ ID NO: 1701459 - RNA, 15 nt, Homo sapiens
ccuucuccaccaaag

SEQ ID NO: 1701460 - RNA, 15 nt, Homo sapiens
ccuucucugcuccac

SEQ ID NO: 1701461 - RNA, 22 nt, Homo sapiens
ccuucuuuugaaggacuccuua

SEQ ID NO: 1701462 - RNA, 23 nt, Homo sapiens
ccuugacauuguagagcuucugg

SEQ ID NO: 1701463 - RNA, 14 nt, Homo sapiens
ccuugacuaaauuc

SEQ ID NO: 1701464 - RNA, 16 nt, Homo sapiens
ccuugcagaacugcca

SEQ ID NO: 1701465 - RNA, 22 nt, Homo sapiens
ccuugccuaaauuuaaugcugc

SEQ ID NO: 1701466 - RNA, 19 nt, Homo sapiens
ccuugcuguccugaucugu

SEQ ID NO: 1701467 - RNA, 20 nt, Homo sapiens
ccuuggcuuaccugaccucu

SEQ ID NO: 1701468 - RNA, 19 nt, Homo sapiens
ccuuggcuuuucuagccua

SEQ ID NO: 1701469 - RNA, 16 nt, Homo sapiens
ccuuucaaauuucaca

SEQ ID NO: 1701470 - RNA, 14 nt, Homo sapiens
ccuuucagggccaa

SEQ ID NO: 1701471 - RNA, 22 nt, Homo sapiens
ccuuuccaagcuccucgugaua

SEQ ID NO: 1701472 - RNA, 13 nt, Homo sapiens
ccuuuccuuccag

SEQ ID NO: 1701473 - RNA, 20 nt, Homo sapiens
ccuuucuccaggaccaauaa

SEQ ID NO: 1701474 - RNA, 15 nt, Homo sapiens
ccuuucuuacauuag

SEQ ID NO: 1701475 - RNA, 18 nt, Homo sapiens
ccuuucuugacaaaaccu

SEQ ID NO: 1701476 - RNA, 17 nt, Homo sapiens
ccuuugaagccucagcu

SEQ ID NO: 1701477 - RNA, 23 nt, Homo sapiens
ccuuugcuaaaauauaauuuuca

SEQ ID NO: 1701478 - RNA, 14 nt, Homo sapiens
ccuuuguaccauau

SEQ ID NO: 1701479 - RNA, 18 nt, Homo sapiens
ccuuuguguauucaucuu

SEQ ID NO: 1701480 - RNA, 13 nt, Homo sapiens
cgaaaacagucaa

SEQ ID NO: 1701481 - RNA, 15 nt, Homo sapiens
cgaacauucuuugcc

SEQ ID NO: 1701482 - RNA, 11 nt, Homo sapiens
cgaaggugcug

SEQ ID NO: 1701483 - RNA, 11 nt, Homo sapiens
cgacccauuca

SEQ ID NO: 1701484 - RNA, 22 nt, Homo sapiens
cgacuaauuucaaaaugcuuuu

SEQ ID NO: 1701485 - RNA, 20 nt, Homo sapiens
cgacuucaugacaagcauuu

SEQ ID NO: 1701486 - RNA, 19 nt, Homo sapiens
cgacuuuucuuaacaaccu

SEQ ID NO: 1701487 - RNA, 19 nt, Homo sapiens
cgagaucacgccacugcac

SEQ ID NO: 1701488 - RNA, 20 nt, Homo sapiens
cgagcuguuaccauucacaa

SEQ ID NO: 1701489 - RNA, 21 nt, Homo sapiens
cgagcuguuuacagugaugcc

SEQ ID NO: 1701490 - RNA, 22 nt, Homo sapiens
cgaggcaggccgacuguacuaa

SEQ ID NO: 1701491 - RNA, 20 nt, Homo sapiens
cgaucuggguucacugcaac

SEQ ID NO: 1701492 - RNA, 12 nt, Homo sapiens
cgaugcugcuau

SEQ ID NO: 1701493 - RNA, 20 nt, Homo sapiens
cgauucaucuacccugcuga

SEQ ID NO: 1701494 - RNA, 18 nt, Homo sapiens
cgcaccuaccaucaggga

SEQ ID NO: 1701495 - RNA, 13 nt, Homo sapiens
cgccagacuguua

SEQ ID NO: 1701496 - RNA, 21 nt, Homo sapiens
cgcccacguggcagaccguga

SEQ ID NO: 1701497 - RNA, 21 nt, Homo sapiens
cgcccagucuggaaugcagug

SEQ ID NO: 1701498 - RNA, 21 nt, Homo sapiens
cgcccuuggcuucugugauga

SEQ ID NO: 1701499 - RNA, 11 nt, Homo sapiens
cgcgugcacac

SEQ ID NO: 1701500 - RNA, 22 nt, Homo sapiens
cgcuaaaugaaaaucgugacaa

SEQ ID NO: 1701501 - RNA, 20 nt, Homo sapiens
cgcuaccagcagacucugga

SEQ ID NO: 1701502 - RNA, 12 nt, Homo sapiens
cgcuauuacaaa

SEQ ID NO: 1701503 - RNA, 20 nt, Homo sapiens
cgcuucugccuuuucacugu

SEQ ID NO: 1701504 - RNA, 22 nt, Homo sapiens
cgcuuggcuccaugcuccucac

SEQ ID NO: 1701505 - RNA, 18 nt, Homo sapiens
cggaagcugucgacuuca

SEQ ID NO: 1701506 - RNA, 20 nt, Homo sapiens
cggaaugaaccacaucuugc

SEQ ID NO: 1701507 - RNA, 17 nt, Homo sapiens
cggagcugcugcugcuc

SEQ ID NO: 1701508 - RNA, 17 nt, Homo sapiens
cggaggccccacugaug

SEQ ID NO: 1701509 - RNA, 14 nt, Homo sapiens
cggcagcuacucag

SEQ ID NO: 1701510 - RNA, 17 nt, Homo sapiens
cggcaggcccugcagug

SEQ ID NO: 1701511 - RNA, 16 nt, Homo sapiens
cggcccucagaugucc

SEQ ID NO: 1701512 - RNA, 19 nt, Homo sapiens
cggcuaagaggcugcugaa

SEQ ID NO: 1701513 - RNA, 13 nt, Homo sapiens
cggcucacaaaga

SEQ ID NO: 1701514 - RNA, 22 nt, Homo sapiens
cgggaggauguucugggacaca

SEQ ID NO: 1701515 - RNA, 17 nt, Homo sapiens
cgggauggccagagaug

SEQ ID NO: 1701516 - RNA, 19 nt, Homo sapiens
cgggcacucagaagacacu

SEQ ID NO: 1701517 - RNA, 18 nt, Homo sapiens
cgggcugggagcucugca

SEQ ID NO: 1701518 - RNA, 21 nt, Homo sapiens
cggggaccccagaaaggucag

SEQ ID NO: 1701519 - RNA, 17 nt, Homo sapiens
cggggccagcaccacuu

SEQ ID NO: 1701520 - RNA, 14 nt, Homo sapiens
cgguagugccugaa

SEQ ID NO: 1701521 - RNA, 16 nt, Homo sapiens
cggugcaugaugcugc

SEQ ID NO: 1701522 - RNA, 22 nt, Homo sapiens
cgguggacucucauguggccaa

SEQ ID NO: 1701523 - RNA, 16 nt, Homo sapiens
cguaagggaucuuccu

SEQ ID NO: 1701524 - RNA, 17 nt, Homo sapiens
cgucaucaucacauuca

SEQ ID NO: 1701525 - RNA, 18 nt, Homo sapiens
cgugaaucuguaucuugc

SEQ ID NO: 1701526 - RNA, 18 nt, Homo sapiens
cgugagccaggcaaagga

SEQ ID NO: 1701527 - RNA, 20 nt, Homo sapiens
cgugauucaaugaaccacaa

SEQ ID NO: 1701528 - RNA, 16 nt, Homo sapiens
cgugcacacaccagag

SEQ ID NO: 1701529 - RNA, 17 nt, Homo sapiens
cgugcacacaccagagc

SEQ ID NO: 1701530 - RNA, 19 nt, Homo sapiens
cgugcugcaugccuggucu

SEQ ID NO: 1701531 - RNA, 15 nt, Homo sapiens
cgugggccgcacugg

SEQ ID NO: 1701532 - RNA, 19 nt, Homo sapiens
cgugguccccaacagcgac

SEQ ID NO: 1701533 - RNA, 20 nt, Homo sapiens
cgugucucagacugcaugua

SEQ ID NO: 1701534 - RNA, 15 nt, Homo sapiens
cguguguagaguuaa

SEQ ID NO: 1701535 - RNA, 23 nt, Homo sapiens
cguuaguguauuuuauguguggc

SEQ ID NO: 1701536 - RNA, 13 nt, Homo sapiens
cguucacucccaa

SEQ ID NO: 1701537 - RNA, 22 nt, Homo sapiens
cguugacaaguuuuguggggcu

SEQ ID NO: 1701538 - RNA, 13 nt, Homo sapiens
cguuuauuucaca

SEQ ID NO: 1701539 - RNA, 14 nt, Homo sapiens
cguuucuguauaca

SEQ ID NO: 1701540 - RNA, 14 nt, Homo sapiens
cuaaaaaacagagg

SEQ ID NO: 1701541 - RNA, 18 nt, Homo sapiens
cuaaaaaacagaggccau

SEQ ID NO: 1701542 - RNA, 15 nt, Homo sapiens
cuaaaaagauuagca

SEQ ID NO: 1701543 - RNA, 21 nt, Homo sapiens
cuaaaagcguuggauguagca

SEQ ID NO: 1701544 - RNA, 20 nt, Homo sapiens
cuaaaauauauauagaaaua

SEQ ID NO: 1701545 - RNA, 13 nt, Homo sapiens
cuaaaauauuauu

SEQ ID NO: 1701546 - RNA, 20 nt, Homo sapiens
cuaaaaucuuauaguucuag

SEQ ID NO: 1701547 - RNA, 16 nt, Homo sapiens
cuaaacaaugcugauu

SEQ ID NO: 1701548 - RNA, 20 nt, Homo sapiens
cuaaacaaugcugauuuggu

SEQ ID NO: 1701549 - RNA, 14 nt, Homo sapiens
cuaaaggugcacug

SEQ ID NO: 1701550 - RNA, 15 nt, Homo sapiens
cuaaaucucuaauau

SEQ ID NO: 1701551 - RNA, 16 nt, Homo sapiens
cuaaauuuaaugcugc

SEQ ID NO: 1701552 - RNA, 11 nt, Homo sapiens
cuaaauuugaa

SEQ ID NO: 1701553 - RNA, 13 nt, Homo sapiens
cuaacacuggcau

SEQ ID NO: 1701554 - RNA, 18 nt, Homo sapiens
cuaaccaaaucucucaaa

SEQ ID NO: 1701555 - RNA, 16 nt, Homo sapiens
cuaaccccuuccagau

SEQ ID NO: 1701556 - RNA, 18 nt, Homo sapiens
cuaaccuugaaugcugcc

SEQ ID NO: 1701557 - RNA, 20 nt, Homo sapiens
cuaacuuauuuuauuuccau

SEQ ID NO: 1701558 - RNA, 17 nt, Homo sapiens
cuaacuucaaggcccau

SEQ ID NO: 1701559 - RNA, 17 nt, Homo sapiens
cuaagauaauuuacuua

SEQ ID NO: 1701560 - RNA, 15 nt, Homo sapiens
cuaagauaguaacaa

SEQ ID NO: 1701561 - RNA, 16 nt, Homo sapiens
cuaagcgcacauucau

SEQ ID NO: 1701562 - RNA, 13 nt, Homo sapiens
cuaaggaaccuuc

SEQ ID NO: 1701563 - RNA, 17 nt, Homo sapiens
cuaaggaagauaucuag

SEQ ID NO: 1701564 - RNA, 20 nt, Homo sapiens
cuaaggcucuaugagucuag

SEQ ID NO: 1701565 - RNA, 20 nt, Homo sapiens
cuaaggcucugagagucuag

SEQ ID NO: 1701566 - RNA, 21 nt, Homo sapiens
cuaaguauauuuaauucacuu

SEQ ID NO: 1701567 - RNA, 14 nt, Homo sapiens
cuaauacuaauuca

SEQ ID NO: 1701568 - RNA, 22 nt, Homo sapiens
cuaauagagugguacagcacug

SEQ ID NO: 1701569 - RNA, 16 nt, Homo sapiens
cuaaucagcauucuca

SEQ ID NO: 1701570 - RNA, 15 nt, Homo sapiens
cuaauuuucucaaaa

SEQ ID NO: 1701571 - RNA, 14 nt, Homo sapiens
cuacagaggccaug

SEQ ID NO: 1701572 - RNA, 20 nt, Homo sapiens
cuacagcaaagccuagccug

SEQ ID NO: 1701573 - RNA, 20 nt, Homo sapiens
cuacagcucuuaaauguagc

SEQ ID NO: 1701574 - RNA, 20 nt, Homo sapiens
cuacaggaagcaccccaugc

SEQ ID NO: 1701575 - RNA, 15 nt, Homo sapiens
cuacauaacuuccua

SEQ ID NO: 1701576 - RNA, 22 nt, Homo sapiens
cuacaucaucuccaaccgguca

SEQ ID NO: 1701577 - RNA, 15 nt, Homo sapiens
cuacauucuaaugca

SEQ ID NO: 1701578 - RNA, 12 nt, Homo sapiens
cuaccacucaca

SEQ ID NO: 1701579 - RNA, 13 nt, Homo sapiens
cuaccaucaggga

SEQ ID NO: 1701580 - RNA, 19 nt, Homo sapiens
cuacccuuccagugcccua

SEQ ID NO: 1701581 - RNA, 23 nt, Homo sapiens
cuaccgagucucuucuccacugg

SEQ ID NO: 1701582 - RNA, 15 nt, Homo sapiens
cuaccguaaaugucc

SEQ ID NO: 1701583 - RNA, 18 nt, Homo sapiens
cuaccucaggcagcucaa

SEQ ID NO: 1701584 - RNA, 20 nt, Homo sapiens
cuaccuucaagaaccaggca

SEQ ID NO: 1701585 - RNA, 13 nt, Homo sapiens
cuacuaucacuga

SEQ ID NO: 1701586 - RNA, 14 nt, Homo sapiens
cuacugcucugugu

SEQ ID NO: 1701587 - RNA, 15 nt, Homo sapiens
cuacugucucacuga

SEQ ID NO: 1701588 - RNA, 21 nt, Homo sapiens
cuacuuugguuucugucugua

SEQ ID NO: 1701589 - RNA, 18 nt, Homo sapiens
cuagaaaaggcagcuaaa

SEQ ID NO: 1701590 - RNA, 18 nt, Homo sapiens
cuagaacaacgccuguca

SEQ ID NO: 1701591 - RNA, 12 nt, Homo sapiens
cuagaauuauuc

SEQ ID NO: 1701592 - RNA, 15 nt, Homo sapiens
cuagacagauccccg

SEQ ID NO: 1701593 - RNA, 16 nt, Homo sapiens
cuagacucuagacaag

SEQ ID NO: 1701594 - RNA, 12 nt, Homo sapiens
cuagacuuucug

SEQ ID NO: 1701595 - RNA, 19 nt, Homo sapiens
cuagagaaggacccggagg

SEQ ID NO: 1701596 - RNA, 13 nt, Homo sapiens
cuagaugagccca

SEQ ID NO: 1701597 - RNA, 21 nt, Homo sapiens
cuagaugagcccagcccuguu

SEQ ID NO: 1701598 - RNA, 23 nt, Homo sapiens
cuagccugcauaucauucaccca

SEQ ID NO: 1701599 - RNA, 14 nt, Homo sapiens
cuagcugugggggu

SEQ ID NO: 1701600 - RNA, 15 nt, Homo sapiens
cuaggagaccaaggc

SEQ ID NO: 1701601 - RNA, 15 nt, Homo sapiens
cuagguaggggccca

SEQ ID NO: 1701602 - RNA, 13 nt, Homo sapiens
cuagguucaggaa

SEQ ID NO: 1701603 - RNA, 17 nt, Homo sapiens
cuagugaagaaugcaug

SEQ ID NO: 1701604 - RNA, 14 nt, Homo sapiens
cuaguuucccugaa

SEQ ID NO: 1701605 - RNA, 20 nt, Homo sapiens
cuaguuugaccucacaguga

SEQ ID NO: 1701606 - RNA, 20 nt, Homo sapiens
cuauaaagaagaacuugcau

SEQ ID NO: 1701607 - RNA, 17 nt, Homo sapiens
cuauaagcccacuguua

SEQ ID NO: 1701608 - RNA, 18 nt, Homo sapiens
cuauacaaaaugauuuug

SEQ ID NO: 1701609 - RNA, 16 nt, Homo sapiens
cuauagaaacaccagu

SEQ ID NO: 1701610 - RNA, 20 nt, Homo sapiens
cuauagcuaaguacacaaua

SEQ ID NO: 1701611 - RNA, 18 nt, Homo sapiens
cuauaggccaaugcauga

SEQ ID NO: 1701612 - RNA, 20 nt, Homo sapiens
cuaucauggacuacaccagg

SEQ ID NO: 1701613 - RNA, 13 nt, Homo sapiens
cuaucuccugaca

SEQ ID NO: 1701614 - RNA, 16 nt, Homo sapiens
cuaugaacuucucuca

SEQ ID NO: 1701615 - RNA, 15 nt, Homo sapiens
cuaugaugugaaaca

SEQ ID NO: 1701616 - RNA, 23 nt, Homo sapiens
cuaugcacauauggacucugcac

SEQ ID NO: 1701617 - RNA, 16 nt, Homo sapiens
cuaugcagccacauca

SEQ ID NO: 1701618 - RNA, 22 nt, Homo sapiens
cuaugucagcaguauuggcuga

SEQ ID NO: 1701619 - RNA, 15 nt, Homo sapiens
cuaugugcacugaua

SEQ ID NO: 1701620 - RNA, 14 nt, Homo sapiens
cuauguuacuauuu

SEQ ID NO: 1701621 - RNA, 19 nt, Homo sapiens
cuauguugcccaggcaggu

SEQ ID NO: 1701622 - RNA, 23 nt, Homo sapiens
cuauuaacuuuaauucucuuuca

SEQ ID NO: 1701623 - RNA, 16 nt, Homo sapiens
cuauuagagcauugaa

SEQ ID NO: 1701624 - RNA, 14 nt, Homo sapiens
cuauucaaaaccuc

SEQ ID NO: 1701625 - RNA, 18 nt, Homo sapiens
cuauucugagcauacuca

SEQ ID NO: 1701626 - RNA, 21 nt, Homo sapiens
cuauugugggacuuauuacaa

SEQ ID NO: 1701627 - RNA, 21 nt, Homo sapiens
cuauuuagaaauggauuuauc

SEQ ID NO: 1701628 - RNA, 12 nt, Homo sapiens
cuauuuccagag

SEQ ID NO: 1701629 - RNA, 16 nt, Homo sapiens
cuauuuuaaugaauga

SEQ ID NO: 1701630 - RNA, 21 nt, Homo sapiens
cuauuuucaacauaacugaag

SEQ ID NO: 1701631 - RNA, 20 nt, Homo sapiens
cuauuuugaugcagcauuug

SEQ ID NO: 1701632 - RNA, 13 nt, Homo sapiens
cucaaaacuuaac

SEQ ID NO: 1701633 - RNA, 20 nt, Homo sapiens
cucaaacucuugaccucagg

SEQ ID NO: 1701634 - RNA, 19 nt, Homo sapiens
cucaaaucaggguccagug

SEQ ID NO: 1701635 - RNA, 23 nt, Homo sapiens
cucaaauugucagcaauuuaacu

SEQ ID NO: 1701636 - RNA, 20 nt, Homo sapiens
cucaacaaaacccaugcauu

SEQ ID NO: 1701637 - RNA, 13 nt, Homo sapiens
cucaacaaccaag

SEQ ID NO: 1701638 - RNA, 21 nt, Homo sapiens
cucaagcacugauaucuggcc

SEQ ID NO: 1701639 - RNA, 19 nt, Homo sapiens
cucaagguuuuagguucua

SEQ ID NO: 1701640 - RNA, 19 nt, Homo sapiens
cucaaguucuaagauucua

SEQ ID NO: 1701641 - RNA, 20 nt, Homo sapiens
cucaauggauuugaugcugu

SEQ ID NO: 1701642 - RNA, 20 nt, Homo sapiens
cucacauagcuacccaaaag

SEQ ID NO: 1701643 - RNA, 17 nt, Homo sapiens
cucacauaucugucauu

SEQ ID NO: 1701644 - RNA, 12 nt, Homo sapiens
cucacaugacac

SEQ ID NO: 1701645 - RNA, 18 nt, Homo sapiens
cucacauuucaccccagg

SEQ ID NO: 1701646 - RNA, 20 nt, Homo sapiens
cucagaauaaggcaggcauu

SEQ ID NO: 1701647 - RNA, 14 nt, Homo sapiens
cucagccccuagga

SEQ ID NO: 1701648 - RNA, 18 nt, Homo sapiens
cucagccccuaggaguau

SEQ ID NO: 1701649 - RNA, 23 nt, Homo sapiens
cucagccuacuuucacacuaaga

SEQ ID NO: 1701650 - RNA, 16 nt, Homo sapiens
cucaggcuggugggag

SEQ ID NO: 1701651 - RNA, 17 nt, Homo sapiens
cucagggagcagggaag

SEQ ID NO: 1701652 - RNA, 22 nt, Homo sapiens
cucagggagcagggaaggccug

SEQ ID NO: 1701653 - RNA, 22 nt, Homo sapiens
cucaggggugauaacucaggaa

SEQ ID NO: 1701654 - RNA, 14 nt, Homo sapiens
cucaggucccugca

SEQ ID NO: 1701655 - RNA, 21 nt, Homo sapiens
cucaggugaaaauccaucuca

SEQ ID NO: 1701656 - RNA, 20 nt, Homo sapiens
cucagugggggcagagccac

SEQ ID NO: 1701657 - RNA, 10 nt, Homo sapiens
cucauaauag

SEQ ID NO: 1701658 - RNA, 18 nt, Homo sapiens
cucauccuccuggaaccu

SEQ ID NO: 1701659 - RNA, 17 nt, Homo sapiens
cucaugguccuuggagg

SEQ ID NO: 1701660 - RNA, 13 nt, Homo sapiens
cucauuccuguag

SEQ ID NO: 1701661 - RNA, 13 nt, Homo sapiens
cucauugacaaga

SEQ ID NO: 1701662 - RNA, 17 nt, Homo sapiens
cucauuuagaacuugca

SEQ ID NO: 1701663 - RNA, 23 nt, Homo sapiens
cucauuuguuuuucucacuccuu

SEQ ID NO: 1701664 - RNA, 14 nt, Homo sapiens
cucauuuuaaugua

SEQ ID NO: 1701665 - RNA, 22 nt, Homo sapiens
cuccaacacaaggcuccaagac

SEQ ID NO: 1701666 - RNA, 18 nt, Homo sapiens
cuccaacucccucuggga

SEQ ID NO: 1701667 - RNA, 15 nt, Homo sapiens
cuccaaggacaucua

SEQ ID NO: 1701668 - RNA, 20 nt, Homo sapiens
cuccaagggcaucacugggu

SEQ ID NO: 1701669 - RNA, 17 nt, Homo sapiens
cuccaccuagacuguaa

SEQ ID NO: 1701670 - RNA, 15 nt, Homo sapiens
cuccaccucaccucc

SEQ ID NO: 1701671 - RNA, 14 nt, Homo sapiens
cuccaccucuucac

SEQ ID NO: 1701672 - RNA, 13 nt, Homo sapiens
cuccacuccagau

SEQ ID NO: 1701673 - RNA, 12 nt, Homo sapiens
cuccacugccuc

SEQ ID NO: 1701674 - RNA, 20 nt, Homo sapiens
cuccagaauuuggaaauccu

SEQ ID NO: 1701675 - RNA, 16 nt, Homo sapiens
cuccagcucaccagcc

SEQ ID NO: 1701676 - RNA, 22 nt, Homo sapiens
cuccagcucaccagccccagug

SEQ ID NO: 1701677 - RNA, 16 nt, Homo sapiens
cuccaggaucuauuga

SEQ ID NO: 1701678 - RNA, 20 nt, Homo sapiens
cuccaggaugaguuacuuga

SEQ ID NO: 1701679 - RNA, 17 nt, Homo sapiens
cuccaguauucuuguca

SEQ ID NO: 1701680 - RNA, 18 nt, Homo sapiens
cuccagucccccuauccu

SEQ ID NO: 1701681 - RNA, 14 nt, Homo sapiens
cuccaguguacaua

SEQ ID NO: 1701682 - RNA, 20 nt, Homo sapiens
cuccauaaacagacuguuaa

SEQ ID NO: 1701683 - RNA, 18 nt, Homo sapiens
cuccaucccaacagccau

SEQ ID NO: 1701684 - RNA, 16 nt, Homo sapiens
cuccaucucaaaaaag

SEQ ID NO: 1701685 - RNA, 17 nt, Homo sapiens
cuccaucucauguauca

SEQ ID NO: 1701686 - RNA, 22 nt, Homo sapiens
cuccaucuuauuuucauguaua

SEQ ID NO: 1701687 - RNA, 14 nt, Homo sapiens
cuccaugcugccag

SEQ ID NO: 1701688 - RNA, 20 nt, Homo sapiens
cuccauuaaagucugaauca

SEQ ID NO: 1701689 - RNA, 20 nt, Homo sapiens
cucccaccucugugaccuca

SEQ ID NO: 1701690 - RNA, 16 nt, Homo sapiens
cucccagaaucccagc

SEQ ID NO: 1701691 - RNA, 22 nt, Homo sapiens
cucccagugaccccugaccuca

SEQ ID NO: 1701692 - RNA, 18 nt, Homo sapiens
cuccccagcaagugagag

SEQ ID NO: 1701693 - RNA, 17 nt, Homo sapiens
cuccccaggcuaugcca

SEQ ID NO: 1701694 - RNA, 21 nt, Homo sapiens
cuccccaguucauugcacuuu

SEQ ID NO: 1701695 - RNA, 18 nt, Homo sapiens
cuccccugcccuggucca

SEQ ID NO: 1701696 - RNA, 16 nt, Homo sapiens
cucccuaggagaccaa

SEQ ID NO: 1701697 - RNA, 17 nt, Homo sapiens
cucccuaggcugcccac

SEQ ID NO: 1701698 - RNA, 24 nt, Homo sapiens
cucccuccaccuaccacucacaug

SEQ ID NO: 1701699 - RNA, 22 nt, Homo sapiens
cucccucucucuucugcuccac

SEQ ID NO: 1701700 - RNA, 19 nt, Homo sapiens
cucccucuguccaccagcc

SEQ ID NO: 1701701 - RNA, 21 nt, Homo sapiens
cuccgaccacuuccaggggaa

SEQ ID NO: 1701702 - RNA, 16 nt, Homo sapiens
cuccuauaaucuguca

SEQ ID NO: 1701703 - RNA, 20 nt, Homo sapiens
cuccuccaccucaccuccau

SEQ ID NO: 1701704 - RNA, 16 nt, Homo sapiens
cuccucuccccagcaa

SEQ ID NO: 1701705 - RNA, 20 nt, Homo sapiens
cuccucuuuaaaacaaaaca

SEQ ID NO: 1701706 - RNA, 16 nt, Homo sapiens
cuccugauagucuuuc

SEQ ID NO: 1701707 - RNA, 18 nt, Homo sapiens
cuccugggcuaagugauc

SEQ ID NO: 1701708 - RNA, 15 nt, Homo sapiens
cuccuggugcccacu

SEQ ID NO: 1701709 - RNA, 18 nt, Homo sapiens
cuccuggugcucuaucca

SEQ ID NO: 1701710 - RNA, 19 nt, Homo sapiens
cuccuuagcaggcuaugaa

SEQ ID NO: 1701711 - RNA, 15 nt, Homo sapiens
cuccuugagcccuug

SEQ ID NO: 1701712 - RNA, 21 nt, Homo sapiens
cuccuugcccuagaugagccc

SEQ ID NO: 1701713 - RNA, 16 nt, Homo sapiens
cuccuuggcuuaccug

SEQ ID NO: 1701714 - RNA, 11 nt, Homo sapiens
cuccuuuacaa

SEQ ID NO: 1701715 - RNA, 15 nt, Homo sapiens
cuccuuuacaaaaga

SEQ ID NO: 1701716 - RNA, 16 nt, Homo sapiens
cuccuuuacaaaagaa

SEQ ID NO: 1701717 - RNA, 18 nt, Homo sapiens
cuccuuugaaaccugcuc

SEQ ID NO: 1701718 - RNA, 15 nt, Homo sapiens
cucgaaacacagaaa

SEQ ID NO: 1701719 - RNA, 23 nt, Homo sapiens
cucgagcuguuuacagugaugcc

SEQ ID NO: 1701720 - RNA, 16 nt, Homo sapiens
cucgccacgaacuagg

SEQ ID NO: 1701721 - RNA, 15 nt, Homo sapiens
cucgccccaccggcg

SEQ ID NO: 1701722 - RNA, 23 nt, Homo sapiens
cucgcccuccuuucugugcccua

SEQ ID NO: 1701723 - RNA, 17 nt, Homo sapiens
cucgcuuuguugcccag

SEQ ID NO: 1701724 - RNA, 12 nt, Homo sapiens
cucuaacuucaa

SEQ ID NO: 1701725 - RNA, 18 nt, Homo sapiens
cucuagugucuuuugccu

SEQ ID NO: 1701726 - RNA, 15 nt, Homo sapiens
cucuaguucuuaaca

SEQ ID NO: 1701727 - RNA, 16 nt, Homo sapiens
cucuaugccccaaaua

SEQ ID NO: 1701728 - RNA, 15 nt, Homo sapiens
cucuauuccaaaaag

SEQ ID NO: 1701729 - RNA, 17 nt, Homo sapiens
cucuauugauacucuuu

SEQ ID NO: 1701730 - RNA, 10 nt, Homo sapiens
cucucagggg

SEQ ID NO: 1701731 - RNA, 23 nt, Homo sapiens
cucuccccaacccccauucucau

SEQ ID NO: 1701732 - RNA, 17 nt, Homo sapiens
cucuccccuccagccuu

SEQ ID NO: 1701733 - RNA, 18 nt, Homo sapiens
cucucccgccagacuguu

SEQ ID NO: 1701734 - RNA, 13 nt, Homo sapiens
cucucccuaggcu

SEQ ID NO: 1701735 - RNA, 18 nt, Homo sapiens
cucuccuacucacuuaaa

SEQ ID NO: 1701736 - RNA, 22 nt, Homo sapiens
cucucucaaaagagaaaaacaa

SEQ ID NO: 1701737 - RNA, 11 nt, Homo sapiens
cucugaaguca

SEQ ID NO: 1701738 - RNA, 12 nt, Homo sapiens
cucugaagucac

SEQ ID NO: 1701739 - RNA, 15 nt, Homo sapiens
cucugaccugcacug

SEQ ID NO: 1701740 - RNA, 22 nt, Homo sapiens
cucugagcgggaggcagaguuu

SEQ ID NO: 1701741 - RNA, 18 nt, Homo sapiens
cucugcagacugcuagug

SEQ ID NO: 1701742 - RNA, 14 nt, Homo sapiens
cucugccugaaguc

SEQ ID NO: 1701743 - RNA, 18 nt, Homo sapiens
cucugccuuugacauuua

SEQ ID NO: 1701744 - RNA, 14 nt, Homo sapiens
cucugcugaaggaa

SEQ ID NO: 1701745 - RNA, 18 nt, Homo sapiens
cucugcuucuccaaggaa

SEQ ID NO: 1701746 - RNA, 20 nt, Homo sapiens
cucuggacaggcauguucuc

SEQ ID NO: 1701747 - RNA, 21 nt, Homo sapiens
cucuggacucuaaagaccaaa

SEQ ID NO: 1701748 - RNA, 23 nt, Homo sapiens
cucuggccucagccgacugcaca

SEQ ID NO: 1701749 - RNA, 19 nt, Homo sapiens
cucugggaaaaucuauucc

SEQ ID NO: 1701750 - RNA, 17 nt, Homo sapiens
cucuggggucuuuuuau

SEQ ID NO: 1701751 - RNA, 18 nt, Homo sapiens
cucugguaaaugaucacu

SEQ ID NO: 1701752 - RNA, 12 nt, Homo sapiens
cucuuaagccua

SEQ ID NO: 1701753 - RNA, 19 nt, Homo sapiens
cucuuaagccuaaaugccu

SEQ ID NO: 1701754 - RNA, 16 nt, Homo sapiens
cucuuagacccacaga

SEQ ID NO: 1701755 - RNA, 19 nt, Homo sapiens
cucuuaucugggugccuua

SEQ ID NO: 1701756 - RNA, 13 nt, Homo sapiens
cucuuauugcaaa

SEQ ID NO: 1701757 - RNA, 19 nt, Homo sapiens
cucuucaacugaccagccu

SEQ ID NO: 1701758 - RNA, 22 nt, Homo sapiens
cucuucccuuuccccagcauca

SEQ ID NO: 1701759 - RNA, 22 nt, Homo sapiens
cucuuccuccucgcugccagau

SEQ ID NO: 1701760 - RNA, 12 nt, Homo sapiens
cucuuccugacg

SEQ ID NO: 1701761 - RNA, 13 nt, Homo sapiens
cucuucuguggac

SEQ ID NO: 1701762 - RNA, 17 nt, Homo sapiens
cucuuguauaugaugau

SEQ ID NO: 1701763 - RNA, 17 nt, Homo sapiens
cucuuugcugcacuauu

SEQ ID NO: 1701764 - RNA, 15 nt, Homo sapiens
cugaaaacuggaaua

SEQ ID NO: 1701765 - RNA, 20 nt, Homo sapiens
cugaaagauugauuaaugaa

SEQ ID NO: 1701766 - RNA, 16 nt, Homo sapiens
cugaacaaacuaaagg

SEQ ID NO: 1701767 - RNA, 19 nt, Homo sapiens
cugaaccccugggguagcc

SEQ ID NO: 1701768 - RNA, 14 nt, Homo sapiens
cugaacuauuucag

SEQ ID NO: 1701769 - RNA, 22 nt, Homo sapiens
cugaagaggaacugggccuguu

SEQ ID NO: 1701770 - RNA, 22 nt, Homo sapiens
cugaaggugauucaccaaaaua

SEQ ID NO: 1701771 - RNA, 17 nt, Homo sapiens
cugaagugaacuaugaa

SEQ ID NO: 1701772 - RNA, 11 nt, Homo sapiens
cugacacaaga

SEQ ID NO: 1701773 - RNA, 15 nt, Homo sapiens
cugacacaagaggaa

SEQ ID NO: 1701774 - RNA, 18 nt, Homo sapiens
cugacacacagcucuguc

SEQ ID NO: 1701775 - RNA, 18 nt, Homo sapiens
cugacagaaggacucagg

SEQ ID NO: 1701776 - RNA, 22 nt, Homo sapiens
cugacagacaaugauccaguca

SEQ ID NO: 1701777 - RNA, 16 nt, Homo sapiens
cugacaucacagcagc

SEQ ID NO: 1701778 - RNA, 22 nt, Homo sapiens
cugacaucacagcagccuccaa

SEQ ID NO: 1701779 - RNA, 17 nt, Homo sapiens
cugaccucacugugacc

SEQ ID NO: 1701780 - RNA, 19 nt, Homo sapiens
cugaccucaggugauccac

SEQ ID NO: 1701781 - RNA, 19 nt, Homo sapiens
cugaccuggagaugcugcc

SEQ ID NO: 1701782 - RNA, 16 nt, Homo sapiens
cugacgcaaaaccacu

SEQ ID NO: 1701783 - RNA, 20 nt, Homo sapiens
cugacuggauucauucucau

SEQ ID NO: 1701784 - RNA, 13 nt, Homo sapiens
cugagaaaccucg

SEQ ID NO: 1701785 - RNA, 21 nt, Homo sapiens
cugagaaauguuaaagguuca

SEQ ID NO: 1701786 - RNA, 15 nt, Homo sapiens
cugagaaauguucag

SEQ ID NO: 1701787 - RNA, 14 nt, Homo sapiens
cugagaagaucuga

SEQ ID NO: 1701788 - RNA, 19 nt, Homo sapiens
cugagccacagcagcauuu

SEQ ID NO: 1701789 - RNA, 22 nt, Homo sapiens
cugagcccuacucccugcagau

SEQ ID NO: 1701790 - RNA, 23 nt, Homo sapiens
cugagcgggaggcagaguuugcc

SEQ ID NO: 1701791 - RNA, 14 nt, Homo sapiens
cugaggacaaagug

SEQ ID NO: 1701792 - RNA, 13 nt, Homo sapiens
cugaggaccagcc

SEQ ID NO: 1701793 - RNA, 14 nt, Homo sapiens
cugaggaugggcaa

SEQ ID NO: 1701794 - RNA, 18 nt, Homo sapiens
cugaggcaggaggauugc

SEQ ID NO: 1701795 - RNA, 22 nt, Homo sapiens
cugaggccuccagcuucaggca

SEQ ID NO: 1701796 - RNA, 22 nt, Homo sapiens
cugagggaggaccuggggcaca

SEQ ID NO: 1701797 - RNA, 22 nt, Homo sapiens
cugagggcagaaagguucugcc

SEQ ID NO: 1701798 - RNA, 16 nt, Homo sapiens
cugaggggcaucugcc

SEQ ID NO: 1701799 - RNA, 21 nt, Homo sapiens
cugaggguccccaccugggac

SEQ ID NO: 1701800 - RNA, 19 nt, Homo sapiens
cugagggugcuuuguguaa

SEQ ID NO: 1701801 - RNA, 16 nt, Homo sapiens
cugaggugaaagggag

SEQ ID NO: 1701802 - RNA, 17 nt, Homo sapiens
cugagguugaccagcuc

SEQ ID NO: 1701803 - RNA, 19 nt, Homo sapiens
cugagugaaugaacaaaug

SEQ ID NO: 1701804 - RNA, 18 nt, Homo sapiens
cugaguuaugauguaauc

SEQ ID NO: 1701805 - RNA, 14 nt, Homo sapiens
cugaguugcuuuua

SEQ ID NO: 1701806 - RNA, 16 nt, Homo sapiens
cugauacauaacuaaa

SEQ ID NO: 1701807 - RNA, 17 nt, Homo sapiens
cugauaccuuuacacua

SEQ ID NO: 1701808 - RNA, 19 nt, Homo sapiens
cugauauuuuaccucuuau

SEQ ID NO: 1701809 - RNA, 16 nt, Homo sapiens
cugaucauuugaggaa

SEQ ID NO: 1701810 - RNA, 22 nt, Homo sapiens
cugaucccccauagguggcuga

SEQ ID NO: 1701811 - RNA, 11 nt, Homo sapiens
cugaucugcag

SEQ ID NO: 1701812 - RNA, 16 nt, Homo sapiens
cugaugcuuuggugug

SEQ ID NO: 1701813 - RNA, 20 nt, Homo sapiens
cugauggaaguaaagccuca

SEQ ID NO: 1701814 - RNA, 19 nt, Homo sapiens
cugauggagcucagaauuc

SEQ ID NO: 1701815 - RNA, 18 nt, Homo sapiens
cugauguguccucaggga

SEQ ID NO: 1701816 - RNA, 19 nt, Homo sapiens
cugauugaagacacacuca

SEQ ID NO: 1701817 - RNA, 13 nt, Homo sapiens
cugauuucuugcu

SEQ ID NO: 1701818 - RNA, 19 nt, Homo sapiens
cugauuuuggccaucagga

SEQ ID NO: 1701819 - RNA, 21 nt, Homo sapiens
cugcacaaagcccuuccaugu

SEQ ID NO: 1701820 - RNA, 20 nt, Homo sapiens
cugcacagaaauuuucaauu

SEQ ID NO: 1701821 - RNA, 18 nt, Homo sapiens
cugcacagugcaucucag

SEQ ID NO: 1701822 - RNA, 21 nt, Homo sapiens
cugcaccagagcaaccucuca

SEQ ID NO: 1701823 - RNA, 20 nt, Homo sapiens
cugcaccccucugcccucau

SEQ ID NO: 1701824 - RNA, 14 nt, Homo sapiens
cugcacuaauauaa

SEQ ID NO: 1701825 - RNA, 20 nt, Homo sapiens
cugcacuaauuugauguuua

SEQ ID NO: 1701826 - RNA, 16 nt, Homo sapiens
cugcacuuugauguca

SEQ ID NO: 1701827 - RNA, 13 nt, Homo sapiens
cugcagaauccag

SEQ ID NO: 1701828 - RNA, 15 nt, Homo sapiens
cugcagagcaccuuu

SEQ ID NO: 1701829 - RNA, 17 nt, Homo sapiens
cugcagcaggaguggug

SEQ ID NO: 1701830 - RNA, 12 nt, Homo sapiens
cugcagccagcu

SEQ ID NO: 1701831 - RNA, 15 nt, Homo sapiens
cugcaggucaacagc

SEQ ID NO: 1701832 - RNA, 21 nt, Homo sapiens
cugcaucuuauagcacuuuga

SEQ ID NO: 1701833 - RNA, 12 nt, Homo sapiens
cugccaaacuga

SEQ ID NO: 1701834 - RNA, 13 nt, Homo sapiens
cugccaacugucc

SEQ ID NO: 1701835 - RNA, 14 nt, Homo sapiens
cugccaacuguccu

SEQ ID NO: 1701836 - RNA, 16 nt, Homo sapiens
cugccacuuugcacau

SEQ ID NO: 1701837 - RNA, 22 nt, Homo sapiens
cugccaucgaccuggagacuga

SEQ ID NO: 1701838 - RNA, 15 nt, Homo sapiens
cugccauggggccau

SEQ ID NO: 1701839 - RNA, 15 nt, Homo sapiens
cugccaugucacaau

SEQ ID NO: 1701840 - RNA, 13 nt, Homo sapiens
cugcccaaugaga

SEQ ID NO: 1701841 - RNA, 20 nt, Homo sapiens
cugccccaaacaaauaugca

SEQ ID NO: 1701842 - RNA, 21 nt, Homo sapiens
cugcccccuugggugaccucu

SEQ ID NO: 1701843 - RNA, 16 nt, Homo sapiens
cugcccuaacuguaca

SEQ ID NO: 1701844 - RNA, 18 nt, Homo sapiens
cugccggggguucagggu

SEQ ID NO: 1701845 - RNA, 20 nt, Homo sapiens
cugccggggguucaggguug

SEQ ID NO: 1701846 - RNA, 14 nt, Homo sapiens
cugccgucagcucc

SEQ ID NO: 1701847 - RNA, 13 nt, Homo sapiens
cugccuacuuccu

SEQ ID NO: 1701848 - RNA, 21 nt, Homo sapiens
cugccucggccucccaaagug

SEQ ID NO: 1701849 - RNA, 20 nt, Homo sapiens
cugccuuaggguagugcuaa

SEQ ID NO: 1701850 - RNA, 19 nt, Homo sapiens
cugccuuugcuuaagccau

SEQ ID NO: 1701851 - RNA, 14 nt, Homo sapiens
cugcuccaccacau

SEQ ID NO: 1701852 - RNA, 19 nt, Homo sapiens
cugcucccucacccaggca

SEQ ID NO: 1701853 - RNA, 18 nt, Homo sapiens
cugcucccugaagccagc

SEQ ID NO: 1701854 - RNA, 18 nt, Homo sapiens
cugcucuccgaccagaca

SEQ ID NO: 1701855 - RNA, 17 nt, Homo sapiens
cugcucuuguucuacug

SEQ ID NO: 1701856 - RNA, 13 nt, Homo sapiens
cugcugacagugu

SEQ ID NO: 1701857 - RNA, 19 nt, Homo sapiens
cugcugccuggccacugcu

SEQ ID NO: 1701858 - RNA, 18 nt, Homo sapiens
cugcuuagacauaacaaa

SEQ ID NO: 1701859 - RNA, 17 nt, Homo sapiens
cuggaacagaagacagc

SEQ ID NO: 1701860 - RNA, 13 nt, Homo sapiens
cuggaaccuugcu

SEQ ID NO: 1701861 - RNA, 17 nt, Homo sapiens
cuggaagcuaauuugca

SEQ ID NO: 1701862 - RNA, 14 nt, Homo sapiens
cuggaauacaugaa

SEQ ID NO: 1701863 - RNA, 17 nt, Homo sapiens
cuggaaucuggagacca

SEQ ID NO: 1701864 - RNA, 23 nt, Homo sapiens
cuggacaaaggaguaguagcuga

SEQ ID NO: 1701865 - RNA, 22 nt, Homo sapiens
cuggacaccgggccaguaucua

SEQ ID NO: 1701866 - RNA, 22 nt, Homo sapiens
cuggacaggcucugcuucucca

SEQ ID NO: 1701867 - RNA, 17 nt, Homo sapiens
cuggacagucacugcca

SEQ ID NO: 1701868 - RNA, 15 nt, Homo sapiens
cuggaccacugggca

SEQ ID NO: 1701869 - RNA, 22 nt, Homo sapiens
cuggagacccaccccaccugca

SEQ ID NO: 1701870 - RNA, 21 nt, Homo sapiens
cuggagcccuaaccccuucca

SEQ ID NO: 1701871 - RNA, 19 nt, Homo sapiens
cuggagccuccacugccuc

SEQ ID NO: 1701872 - RNA, 17 nt, Homo sapiens
cuggaggccuuccagcu

SEQ ID NO: 1701873 - RNA, 16 nt, Homo sapiens
cuggaguguggcugag

SEQ ID NO: 1701874 - RNA, 13 nt, Homo sapiens
cuggauucauucu

SEQ ID NO: 1701875 - RNA, 18 nt, Homo sapiens
cuggauuucugguucuga

SEQ ID NO: 1701876 - RNA, 15 nt, Homo sapiens
cuggcacaggacuga

SEQ ID NO: 1701877 - RNA, 19 nt, Homo sapiens
cuggcacugaauuaaucau

SEQ ID NO: 1701878 - RNA, 22 nt, Homo sapiens
cuggcacugaauuaaucaucua

SEQ ID NO: 1701879 - RNA, 15 nt, Homo sapiens
cuggcagacugagga

SEQ ID NO: 1701880 - RNA, 19 nt, Homo sapiens
cuggcagccgugccuucag

SEQ ID NO: 1701881 - RNA, 12 nt, Homo sapiens
cuggccaaaagc

SEQ ID NO: 1701882 - RNA, 20 nt, Homo sapiens
cuggccagagccaagaaaca

SEQ ID NO: 1701883 - RNA, 19 nt, Homo sapiens
cuggccagaugcaccagcc

SEQ ID NO: 1701884 - RNA, 17 nt, Homo sapiens
cuggcccucgacacuca

SEQ ID NO: 1701885 - RNA, 22 nt, Homo sapiens
cuggccucagccgacugcacag

SEQ ID NO: 1701886 - RNA, 15 nt, Homo sapiens
cuggcucacaguaca

SEQ ID NO: 1701887 - RNA, 17 nt, Homo sapiens
cuggcugcuuuguucaa

SEQ ID NO: 1701888 - RNA, 22 nt, Homo sapiens
cugggaagacgccugagcucac

SEQ ID NO: 1701889 - RNA, 23 nt, Homo sapiens
cugggacaguuuaucaugaagcc

SEQ ID NO: 1701890 - RNA, 21 nt, Homo sapiens
cugggauguuuugagggucuu

SEQ ID NO: 1701891 - RNA, 18 nt, Homo sapiens
cugggauuacagguguga

SEQ ID NO: 1701892 - RNA, 14 nt, Homo sapiens
cugggcagcauagc

SEQ ID NO: 1701893 - RNA, 13 nt, Homo sapiens
cugggccaccagc

SEQ ID NO: 1701894 - RNA, 14 nt, Homo sapiens
cugggccagggucu

SEQ ID NO: 1701895 - RNA, 10 nt, Homo sapiens
cugggccaug

SEQ ID NO: 1701896 - RNA, 18 nt, Homo sapiens
cugggccauguccaaaga

SEQ ID NO: 1701897 - RNA, 14 nt, Homo sapiens
cugggccauugugg

SEQ ID NO: 1701898 - RNA, 20 nt, Homo sapiens
cugggcuccguuguaccaag

SEQ ID NO: 1701899 - RNA, 17 nt, Homo sapiens
cugggcugaccccggug

SEQ ID NO: 1701900 - RNA, 11 nt, Homo sapiens
cuggggaccau

SEQ ID NO: 1701901 - RNA, 14 nt, Homo sapiens
cuggggcaauggga

SEQ ID NO: 1701902 - RNA, 15 nt, Homo sapiens
cuggggccuccagaa

SEQ ID NO: 1701903 - RNA, 16 nt, Homo sapiens
cugggggccucagugc

SEQ ID NO: 1701904 - RNA, 20 nt, Homo sapiens
cuggggucacccucuccagc

SEQ ID NO: 1701905 - RNA, 16 nt, Homo sapiens
cugggguccauucucu

SEQ ID NO: 1701906 - RNA, 17 nt, Homo sapiens
cuggggugcugccugaa

SEQ ID NO: 1701907 - RNA, 20 nt, Homo sapiens
cugggucuaccacucagaga

SEQ ID NO: 1701908 - RNA, 21 nt, Homo sapiens
cugggucucgcuuuguugccc

SEQ ID NO: 1701909 - RNA, 23 nt, Homo sapiens
cugggucucgcuuuguugcccag

SEQ ID NO: 1701910 - RNA, 16 nt, Homo sapiens
cuggguggaucggccu

SEQ ID NO: 1701911 - RNA, 19 nt, Homo sapiens
cuggguggccucgggacac

SEQ ID NO: 1701912 - RNA, 20 nt, Homo sapiens
cuggguuuguuuacagcaau

SEQ ID NO: 1701913 - RNA, 17 nt, Homo sapiens
cugguacuuagaguuuc

SEQ ID NO: 1701914 - RNA, 21 nt, Homo sapiens
cuggucaggcccuggugcgaa

SEQ ID NO: 1701915 - RNA, 21 nt, Homo sapiens
cugguccaugcagggggcucc

SEQ ID NO: 1701916 - RNA, 16 nt, Homo sapiens
cuggucccacucaguc

SEQ ID NO: 1701917 - RNA, 15 nt, Homo sapiens
cuggucccuugcagc

SEQ ID NO: 1701918 - RNA, 22 nt, Homo sapiens
cuggugaggagcacagcucagg

SEQ ID NO: 1701919 - RNA, 19 nt, Homo sapiens
cugguggcccgacagccug

SEQ ID NO: 1701920 - RNA, 13 nt, Homo sapiens
cugguggugcugc

SEQ ID NO: 1701921 - RNA, 16 nt, Homo sapiens
cugguggugcugcacc

SEQ ID NO: 1701922 - RNA, 13 nt, Homo sapiens
cugguuagguaga

SEQ ID NO: 1701923 - RNA, 17 nt, Homo sapiens
cugguuagguagaggga

SEQ ID NO: 1701924 - RNA, 14 nt, Homo sapiens
cuguaagauugucc

SEQ ID NO: 1701925 - RNA, 16 nt, Homo sapiens
cuguaaggcucuagau

SEQ ID NO: 1701926 - RNA, 15 nt, Homo sapiens
cuguaaucccaacac

SEQ ID NO: 1701927 - RNA, 19 nt, Homo sapiens
cuguaaucccaacacuuug

SEQ ID NO: 1701928 - RNA, 20 nt, Homo sapiens
cuguacaaaauaacucucca

SEQ ID NO: 1701929 - RNA, 11 nt, Homo sapiens
cuguaccucau

SEQ ID NO: 1701930 - RNA, 16 nt, Homo sapiens
cuguaccuguuccuua

SEQ ID NO: 1701931 - RNA, 20 nt, Homo sapiens
cuguacuguucugugucuuu

SEQ ID NO: 1701932 - RNA, 15 nt, Homo sapiens
cuguaguagcccuuu

SEQ ID NO: 1701933 - RNA, 22 nt, Homo sapiens
cuguaguugcguggacucugca

SEQ ID NO: 1701934 - RNA, 23 nt, Homo sapiens
cuguaguugcguggacucugcac

SEQ ID NO: 1701935 - RNA, 23 nt, Homo sapiens
cuguauaguuaggauagcauuuu

SEQ ID NO: 1701936 - RNA, 13 nt, Homo sapiens
cuguaucugugua

SEQ ID NO: 1701937 - RNA, 15 nt, Homo sapiens
cugucaaaacacugu

SEQ ID NO: 1701938 - RNA, 21 nt, Homo sapiens
cugucaacacuucucacaucu

SEQ ID NO: 1701939 - RNA, 16 nt, Homo sapiens
cugucacagaguagaa

SEQ ID NO: 1701940 - RNA, 14 nt, Homo sapiens
cugucccaccugca

SEQ ID NO: 1701941 - RNA, 19 nt, Homo sapiens
cuguccuaaggaaccuucc

SEQ ID NO: 1701942 - RNA, 23 nt, Homo sapiens
cuguccugcuucugaaugugcug

SEQ ID NO: 1701943 - RNA, 14 nt, Homo sapiens
cugucucagccucc

SEQ ID NO: 1701944 - RNA, 18 nt, Homo sapiens
cugucuccuguauguggg

SEQ ID NO: 1701945 - RNA, 13 nt, Homo sapiens
cugugaagcauuu

SEQ ID NO: 1701946 - RNA, 16 nt, Homo sapiens
cugugauuuaugccaa

SEQ ID NO: 1701947 - RNA, 19 nt, Homo sapiens
cugugcugggggaaugagc

SEQ ID NO: 1701948 - RNA, 14 nt, Homo sapiens
cuguggaugccagg

SEQ ID NO: 1701949 - RNA, 12 nt, Homo sapiens
cuguggaugcuu

SEQ ID NO: 1701950 - RNA, 23 nt, Homo sapiens
cuguguaacuguaaaacauugaa

SEQ ID NO: 1701951 - RNA, 17 nt, Homo sapiens
cuguguauuuacaugaa

SEQ ID NO: 1701952 - RNA, 19 nt, Homo sapiens
cuguguccuacuccuugca

SEQ ID NO: 1701953 - RNA, 20 nt, Homo sapiens
cugugucuuuuuucacuaca

SEQ ID NO: 1701954 - RNA, 15 nt, Homo sapiens
cugugugaaggugaa

SEQ ID NO: 1701955 - RNA, 20 nt, Homo sapiens
cugugugaaugugggcacug

SEQ ID NO: 1701956 - RNA, 12 nt, Homo sapiens
cugugugccauu

SEQ ID NO: 1701957 - RNA, 23 nt, Homo sapiens
cugugugccauuuuaagaguuac

SEQ ID NO: 1701958 - RNA, 22 nt, Homo sapiens
cuguguugucaacaaaccaagc

SEQ ID NO: 1701959 - RNA, 23 nt, Homo sapiens
cuguuacauaacaagaaaaucaa

SEQ ID NO: 1701960 - RNA, 20 nt, Homo sapiens
cuguuaccauucacaauaaa

SEQ ID NO: 1701961 - RNA, 15 nt, Homo sapiens
cuguuauguacugua

SEQ ID NO: 1701962 - RNA, 18 nt, Homo sapiens
cuguuauuaacaaacauc

SEQ ID NO: 1701963 - RNA, 20 nt, Homo sapiens
cuguuauuaacaaacaucac

SEQ ID NO: 1701964 - RNA, 20 nt, Homo sapiens
cuguucucuugggaacugaa

SEQ ID NO: 1701965 - RNA, 15 nt, Homo sapiens
cuguucugcacugaa

SEQ ID NO: 1701966 - RNA, 16 nt, Homo sapiens
cuguucugcacugaaa

SEQ ID NO: 1701967 - RNA, 20 nt, Homo sapiens
cuguucugggcucuuuccuc

SEQ ID NO: 1701968 - RNA, 15 nt, Homo sapiens
cuguucuugcugcua

SEQ ID NO: 1701969 - RNA, 18 nt, Homo sapiens
cuguugcaaacucagugc

SEQ ID NO: 1701970 - RNA, 21 nt, Homo sapiens
cuguuggccagugugacaagg

SEQ ID NO: 1701971 - RNA, 20 nt, Homo sapiens
cuguugugugucaugccagu

SEQ ID NO: 1701972 - RNA, 17 nt, Homo sapiens
cuguuuaaaguggcaau

SEQ ID NO: 1701973 - RNA, 15 nt, Homo sapiens
cuguuuaacauuucc

SEQ ID NO: 1701974 - RNA, 19 nt, Homo sapiens
cuguuuaacauuuccucag

SEQ ID NO: 1701975 - RNA, 20 nt, Homo sapiens
cuguuucccuucccuuccac

SEQ ID NO: 1701976 - RNA, 12 nt, Homo sapiens
cuguuucuugcu

SEQ ID NO: 1701977 - RNA, 17 nt, Homo sapiens
cuguuuucuccuaggcc

SEQ ID NO: 1701978 - RNA, 15 nt, Homo sapiens
cuguuuucucucggc

SEQ ID NO: 1701979 - RNA, 19 nt, Homo sapiens
cuguuuuguaagugcugcu

SEQ ID NO: 1701980 - RNA, 22 nt, Homo sapiens
cuguuuuguaagugcugcuaua

SEQ ID NO: 1701981 - RNA, 22 nt, Homo sapiens
cuguuuuuuuuuuuuagccaua

SEQ ID NO: 1701982 - RNA, 20 nt, Homo sapiens
cuuaaaaaagcccuuugcua

SEQ ID NO: 1701983 - RNA, 11 nt, Homo sapiens
cuuaaacacau

SEQ ID NO: 1701984 - RNA, 16 nt, Homo sapiens
cuuaaagaaguucccc

SEQ ID NO: 1701985 - RNA, 21 nt, Homo sapiens
cuuaaauuugauuuacauaua

SEQ ID NO: 1701986 - RNA, 14 nt, Homo sapiens
cuuaacacuugacc

SEQ ID NO: 1701987 - RNA, 18 nt, Homo sapiens
cuuaacaugggcucuuca

SEQ ID NO: 1701988 - RNA, 18 nt, Homo sapiens
cuuaaccuuuuaauacug

SEQ ID NO: 1701989 - RNA, 23 nt, Homo sapiens
cuuaagaauaugcugacuucacu

SEQ ID NO: 1701990 - RNA, 19 nt, Homo sapiens
cuuaagacuuuugggacau

SEQ ID NO: 1701991 - RNA, 14 nt, Homo sapiens
cuuaagcaaaagaa

SEQ ID NO: 1701992 - RNA, 23 nt, Homo sapiens
cuuaaguuccagcagaugccaca

SEQ ID NO: 1701993 - RNA, 12 nt, Homo sapiens
cuuacacugccu

SEQ ID NO: 1701994 - RNA, 15 nt, Homo sapiens
cuuaccaacuuucug

SEQ ID NO: 1701995 - RNA, 17 nt, Homo sapiens
cuuaccugaccucuugc

SEQ ID NO: 1701996 - RNA, 18 nt, Homo sapiens
cuuaccugaccucuugcu

SEQ ID NO: 1701997 - RNA, 18 nt, Homo sapiens
cuuagaaauugcauuucc

SEQ ID NO: 1701998 - RNA, 19 nt, Homo sapiens
cuuagauguuccaguaauc

SEQ ID NO: 1701999 - RNA, 12 nt, Homo sapiens
cuuaguaaaauu

SEQ ID NO: 1702000 - RNA, 22 nt, Homo sapiens
cuuaguaucucaucaacaaaga

SEQ ID NO: 1702001 - RNA, 15 nt, Homo sapiens
cuuauagcacuuuga

SEQ ID NO: 1702002 - RNA, 17 nt, Homo sapiens
cuuauagcacuuugaaa

SEQ ID NO: 1702003 - RNA, 22 nt, Homo sapiens
cuuaucucagucaugcauaaau

SEQ ID NO: 1702004 - RNA, 22 nt, Homo sapiens
cuuaucuggcccucgacacuca

SEQ ID NO: 1702005 - RNA, 17 nt, Homo sapiens
cuuaugacuugcuacuu

SEQ ID NO: 1702006 - RNA, 18 nt, Homo sapiens
cuuaugacuugcuacuuu

SEQ ID NO: 1702007 - RNA, 18 nt, Homo sapiens
cuuauggaauugauuugc

SEQ ID NO: 1702008 - RNA, 18 nt, Homo sapiens
cuuaugggcccagccagc

SEQ ID NO: 1702009 - RNA, 21 nt, Homo sapiens
cuuauguggguugccugguga

SEQ ID NO: 1702010 - RNA, 23 nt, Homo sapiens
cuucaaauugucuuuugucaugu

SEQ ID NO: 1702011 - RNA, 15 nt, Homo sapiens
cuucaacauccugcc

SEQ ID NO: 1702012 - RNA, 16 nt, Homo sapiens
cuucaagaacucuggg

SEQ ID NO: 1702013 - RNA, 17 nt, Homo sapiens
cuucaagaacuuucucu

SEQ ID NO: 1702014 - RNA, 20 nt, Homo sapiens
cuucaagucaacaugcauau

SEQ ID NO: 1702015 - RNA, 18 nt, Homo sapiens
cuucaaugggcucuucca

SEQ ID NO: 1702016 - RNA, 18 nt, Homo sapiens
cuucacuguggucauccu

SEQ ID NO: 1702017 - RNA, 12 nt, Homo sapiens
cuucagacaccc

SEQ ID NO: 1702018 - RNA, 18 nt, Homo sapiens
cuucagauacaaacugca

SEQ ID NO: 1702019 - RNA, 22 nt, Homo sapiens
cuucauaagguaauucauggca

SEQ ID NO: 1702020 - RNA, 18 nt, Homo sapiens
cuucauuccuuccacuaa

SEQ ID NO: 1702021 - RNA, 18 nt, Homo sapiens
cuuccagugucugucauu

SEQ ID NO: 1702022 - RNA, 20 nt, Homo sapiens
cuuccaucccaggacaccac

SEQ ID NO: 1702023 - RNA, 22 nt, Homo sapiens
cuucccggcgucccuaccuccu

SEQ ID NO: 1702024 - RNA, 12 nt, Homo sapiens
cuucccuuccac

SEQ ID NO: 1702025 - RNA, 14 nt, Homo sapiens
cuuccucaugaauc

SEQ ID NO: 1702026 - RNA, 17 nt, Homo sapiens
cuuccuccucgcugcca

SEQ ID NO: 1702027 - RNA, 19 nt, Homo sapiens
cuuccugaggaugggcaac

SEQ ID NO: 1702028 - RNA, 12 nt, Homo sapiens
cuuccugugauc

SEQ ID NO: 1702029 - RNA, 15 nt, Homo sapiens
cuuccuuacccaaac

SEQ ID NO: 1702030 - RNA, 14 nt, Homo sapiens
cuuccuuuacuuuc

SEQ ID NO: 1702031 - RNA, 17 nt, Homo sapiens
cuucggcagcuacucag

SEQ ID NO: 1702032 - RNA, 21 nt, Homo sapiens
cuucuaaacccaauccaaaug

SEQ ID NO: 1702033 - RNA, 14 nt, Homo sapiens
cuucuacacugggu

SEQ ID NO: 1702034 - RNA, 19 nt, Homo sapiens
cuucuacgggauggccaga

SEQ ID NO: 1702035 - RNA, 17 nt, Homo sapiens
cuucucaaguucuaaga

SEQ ID NO: 1702036 - RNA, 15 nt, Homo sapiens
cuucucaucugcaaa

SEQ ID NO: 1702037 - RNA, 14 nt, Homo sapiens
cuucuccacuggau

SEQ ID NO: 1702038 - RNA, 20 nt, Homo sapiens
cuucuccaucccucuaauga

SEQ ID NO: 1702039 - RNA, 22 nt, Homo sapiens
cuucucccgugagccaggcaaa

SEQ ID NO: 1702040 - RNA, 17 nt, Homo sapiens
cuucugcaacaucuuaa

SEQ ID NO: 1702041 - RNA, 15 nt, Homo sapiens
cuucugccuucucag

SEQ ID NO: 1702042 - RNA, 18 nt, Homo sapiens
cuucugccuucucaggaa

SEQ ID NO: 1702043 - RNA, 15 nt, Homo sapiens
cuucuguccuacucu

SEQ ID NO: 1702044 - RNA, 22 nt, Homo sapiens
cuucuguggaccacugcaugag

SEQ ID NO: 1702045 - RNA, 14 nt, Homo sapiens
cuucuucauauucu

SEQ ID NO: 1702046 - RNA, 23 nt, Homo sapiens
cuucuugucagacauaaagccau

SEQ ID NO: 1702047 - RNA, 20 nt, Homo sapiens
cuucuuuuggcuuccaugau

SEQ ID NO: 1702048 - RNA, 13 nt, Homo sapiens
cuugaaaguuuuc

SEQ ID NO: 1702049 - RNA, 12 nt, Homo sapiens
cuugaaaucuga

SEQ ID NO: 1702050 - RNA, 16 nt, Homo sapiens
cuugaaccugugagua

SEQ ID NO: 1702051 - RNA, 15 nt, Homo sapiens
cuugaagcuguggag

SEQ ID NO: 1702052 - RNA, 17 nt, Homo sapiens
cuugaaugcugccagug

SEQ ID NO: 1702053 - RNA, 16 nt, Homo sapiens
cuugacucaggauuua

SEQ ID NO: 1702054 - RNA, 14 nt, Homo sapiens
cuugaguguguuac

SEQ ID NO: 1702055 - RNA, 23 nt, Homo sapiens
cuugaguuguuuaaacagucaaa

SEQ ID NO: 1702056 - RNA, 14 nt, Homo sapiens
cuugauaaacuagg

SEQ ID NO: 1702057 - RNA, 15 nt, Homo sapiens
cuugaugcaugcaca

SEQ ID NO: 1702058 - RNA, 12 nt, Homo sapiens
cuugauuccagu

SEQ ID NO: 1702059 - RNA, 18 nt, Homo sapiens
cuugauuguauccuugcc

SEQ ID NO: 1702060 - RNA, 15 nt, Homo sapiens
cuugcagaacugcca

SEQ ID NO: 1702061 - RNA, 23 nt, Homo sapiens
cuugccaccccacccucccugga

SEQ ID NO: 1702062 - RNA, 23 nt, Homo sapiens
cuugcucgggucccuucaccucc

SEQ ID NO: 1702063 - RNA, 20 nt, Homo sapiens
cuugcuggaaaacccaaagu

SEQ ID NO: 1702064 - RNA, 22 nt, Homo sapiens
cuugcuuaugacaucacuugua

SEQ ID NO: 1702065 - RNA, 16 nt, Homo sapiens
cuugcuuauucacuga

SEQ ID NO: 1702066 - RNA, 22 nt, Homo sapiens
cuuggcuuacugcagccuuugc

SEQ ID NO: 1702067 - RNA, 16 nt, Homo sapiens
cuuggggccaccaaag

SEQ ID NO: 1702068 - RNA, 17 nt, Homo sapiens
cuuggucccuccagaac

SEQ ID NO: 1702069 - RNA, 17 nt, Homo sapiens
cuuggucuuuguaucuu

SEQ ID NO: 1702070 - RNA, 14 nt, Homo sapiens
cuuggugaugcugg

SEQ ID NO: 1702071 - RNA, 14 nt, Homo sapiens
cuuggugguggaug

SEQ ID NO: 1702072 - RNA, 16 nt, Homo sapiens
cuugguuccuucugcc

SEQ ID NO: 1702073 - RNA, 13 nt, Homo sapiens
cuugucagacaua

SEQ ID NO: 1702074 - RNA, 14 nt, Homo sapiens
cuugucagacauaa

SEQ ID NO: 1702075 - RNA, 20 nt, Homo sapiens
cuugucagacauaaagccau

SEQ ID NO: 1702076 - RNA, 22 nt, Homo sapiens
cuuguccacccaccuaugugcc

SEQ ID NO: 1702077 - RNA, 15 nt, Homo sapiens
cuugugaaaaugugu

SEQ ID NO: 1702078 - RNA, 16 nt, Homo sapiens
cuugugaccauuguaa

SEQ ID NO: 1702079 - RNA, 16 nt, Homo sapiens
cuugugccauagucac

SEQ ID NO: 1702080 - RNA, 23 nt, Homo sapiens
cuuguuccccacugacagccucc

SEQ ID NO: 1702081 - RNA, 13 nt, Homo sapiens
cuuguucuacuga

SEQ ID NO: 1702082 - RNA, 15 nt, Homo sapiens
cuuguuugucuucca

SEQ ID NO: 1702083 - RNA, 15 nt, Homo sapiens
cuuguuuuccagucu

SEQ ID NO: 1702084 - RNA, 15 nt, Homo sapiens
cuuuaaacucaggga

SEQ ID NO: 1702085 - RNA, 16 nt, Homo sapiens
cuuuaaacucagggac

SEQ ID NO: 1702086 - RNA, 15 nt, Homo sapiens
cuuuaaaucaagucc

SEQ ID NO: 1702087 - RNA, 15 nt, Homo sapiens
cuuuaacucauaaaa

SEQ ID NO: 1702088 - RNA, 16 nt, Homo sapiens
cuuuaauccaguguua

SEQ ID NO: 1702089 - RNA, 22 nt, Homo sapiens
cuuuacaaaagaaauaccuuga

SEQ ID NO: 1702090 - RNA, 17 nt, Homo sapiens
cuuuacccaccuagaac

SEQ ID NO: 1702091 - RNA, 13 nt, Homo sapiens
cuuuagcaugcua

SEQ ID NO: 1702092 - RNA, 15 nt, Homo sapiens
cuuuagcgcccaguu

SEQ ID NO: 1702093 - RNA, 19 nt, Homo sapiens
cuuuagugcuuucuuguca

SEQ ID NO: 1702094 - RNA, 15 nt, Homo sapiens
cuuuauauauggaca

SEQ ID NO: 1702095 - RNA, 12 nt, Homo sapiens
cuuuaucaaaga

SEQ ID NO: 1702096 - RNA, 18 nt, Homo sapiens
cuuuaucuaauaccucug

SEQ ID NO: 1702097 - RNA, 18 nt, Homo sapiens
cuuucaaagcuaaauucc

SEQ ID NO: 1702098 - RNA, 16 nt, Homo sapiens
cuuucaccuuugugua

SEQ ID NO: 1702099 - RNA, 16 nt, Homo sapiens
cuuucagaaaacggga

SEQ ID NO: 1702100 - RNA, 21 nt, Homo sapiens
cuuucauuauuaguacugcuc

SEQ ID NO: 1702101 - RNA, 16 nt, Homo sapiens
cuuuccucagaucauc

SEQ ID NO: 1702102 - RNA, 22 nt, Homo sapiens
cuuuccugguuuucaucaggaa

SEQ ID NO: 1702103 - RNA, 14 nt, Homo sapiens
cuuucuaaugcuga

SEQ ID NO: 1702104 - RNA, 14 nt, Homo sapiens
cuuucuacccagcg

SEQ ID NO: 1702105 - RNA, 14 nt, Homo sapiens
cuuucuauuugacu

SEQ ID NO: 1702106 - RNA, 17 nt, Homo sapiens
cuuucuccaggaccaau

SEQ ID NO: 1702107 - RNA, 19 nt, Homo sapiens
cuuucuccccgcuaaggaa

SEQ ID NO: 1702108 - RNA, 11 nt, Homo sapiens
cuuucucucag

SEQ ID NO: 1702109 - RNA, 16 nt, Homo sapiens
cuuucugacaaaaagu

SEQ ID NO: 1702110 - RNA, 20 nt, Homo sapiens
cuuucugccgaccccuaguu

SEQ ID NO: 1702111 - RNA, 21 nt, Homo sapiens
cuuucuguuggauuccaugcu

SEQ ID NO: 1702112 - RNA, 16 nt, Homo sapiens
cuuugaaauaccucau

SEQ ID NO: 1702113 - RNA, 17 nt, Homo sapiens
cuuugaacaagguuuca

SEQ ID NO: 1702114 - RNA, 19 nt, Homo sapiens
cuuugaagcaguuguguca

SEQ ID NO: 1702115 - RNA, 14 nt, Homo sapiens
cuuugaagccucag

SEQ ID NO: 1702116 - RNA, 22 nt, Homo sapiens
cuuugaggugucucaaucugau

SEQ ID NO: 1702117 - RNA, 15 nt, Homo sapiens
cuuugcacauuuuga

SEQ ID NO: 1702118 - RNA, 11 nt, Homo sapiens
cuuugcacuug

SEQ ID NO: 1702119 - RNA, 15 nt, Homo sapiens
cuuugcugauuuccc

SEQ ID NO: 1702120 - RNA, 18 nt, Homo sapiens
cuuuggucauaugagcuu

SEQ ID NO: 1702121 - RNA, 13 nt, Homo sapiens
cuuuguauacuuu

SEQ ID NO: 1702122 - RNA, 15 nt, Homo sapiens
cuuuguaugcacuuu

SEQ ID NO: 1702123 - RNA, 19 nt, Homo sapiens
cuuuguguuugguuuacau

SEQ ID NO: 1702124 - RNA, 15 nt, Homo sapiens
cuuuguucugugauu

SEQ ID NO: 1702125 - RNA, 17 nt, Homo sapiens
cuuuguuuuggggguca

SEQ ID NO: 1702126 - RNA, 15 nt, Homo sapiens
cuuuuaaaaaugucc

SEQ ID NO: 1702127 - RNA, 22 nt, Homo sapiens
cuuuuaaaaauucaaaugauuu

SEQ ID NO: 1702128 - RNA, 16 nt, Homo sapiens
cuuuuaaaugcauaaa

SEQ ID NO: 1702129 - RNA, 14 nt, Homo sapiens
cuuuuaugccuuca

SEQ ID NO: 1702130 - RNA, 14 nt, Homo sapiens
cuuuuauguagcac

SEQ ID NO: 1702131 - RNA, 19 nt, Homo sapiens
cuuuuauguagcacauaaa

SEQ ID NO: 1702132 - RNA, 17 nt, Homo sapiens
cuuuuauugacacagaa

SEQ ID NO: 1702133 - RNA, 16 nt, Homo sapiens
cuuuuauuugcaacau

SEQ ID NO: 1702134 - RNA, 19 nt, Homo sapiens
cuuuuauuuuacacagaaa

SEQ ID NO: 1702135 - RNA, 23 nt, Homo sapiens
cuuuuauuuuuuaagguaacaaa

SEQ ID NO: 1702136 - RNA, 23 nt, Homo sapiens
cuuuucacugcuggcugccuuag

SEQ ID NO: 1702137 - RNA, 13 nt, Homo sapiens
cuuuucaggguuu

SEQ ID NO: 1702138 - RNA, 24 nt, Homo sapiens
cuuuucuagccuauuuaccugcag

SEQ ID NO: 1702139 - RNA, 15 nt, Homo sapiens
cuuuucuuuccucag

SEQ ID NO: 1702140 - RNA, 18 nt, Homo sapiens
cuuuugaauuuuugguua

SEQ ID NO: 1702141 - RNA, 20 nt, Homo sapiens
cuuuugagugugugugugca

SEQ ID NO: 1702142 - RNA, 20 nt, Homo sapiens
cuuuuggugaaagcugagaa

SEQ ID NO: 1702143 - RNA, 20 nt, Homo sapiens
cuuuuguaaaaaugucccca

SEQ ID NO: 1702144 - RNA, 16 nt, Homo sapiens
cuuuugucauguggcu

SEQ ID NO: 1702145 - RNA, 16 nt, Homo sapiens
cuuuuuacaauuaaaa

SEQ ID NO: 1702146 - RNA, 13 nt, Homo sapiens
cuuuuuaugcauu

SEQ ID NO: 1702147 - RNA, 13 nt, Homo sapiens
cuuuuucuuugaa

SEQ ID NO: 1702148 - RNA, 15 nt, Homo sapiens
cuuuuuucuaguaca

SEQ ID NO: 1702149 - RNA, 18 nt, Homo sapiens
cuuuuuuucuuguaugca

SEQ ID NO: 1702150 - RNA, 14 nt, Homo sapiens
gaaaaaaauuacua

SEQ ID NO: 1702151 - RNA, 19 nt, Homo sapiens
gaaaaaaguuccuuccuaa

SEQ ID NO: 1702152 - RNA, 19 nt, Homo sapiens
gaaaaaauuagcugggcau

SEQ ID NO: 1702153 - RNA, 12 nt, Homo sapiens
gaaaaacaacca

SEQ ID NO: 1702154 - RNA, 19 nt, Homo sapiens
gaaaaacaccgcuucugcc

SEQ ID NO: 1702155 - RNA, 17 nt, Homo sapiens
gaaaaaggccucugucc

SEQ ID NO: 1702156 - RNA, 18 nt, Homo sapiens
gaaaacaucucaauaaca

SEQ ID NO: 1702157 - RNA, 22 nt, Homo sapiens
gaaaaccugaagacugaggaca

SEQ ID NO: 1702158 - RNA, 22 nt, Homo sapiens
gaaaacuagauugcuaguuuau

SEQ ID NO: 1702159 - RNA, 23 nt, Homo sapiens
gaaaagcuauuagccaggaucau

SEQ ID NO: 1702160 - RNA, 15 nt, Homo sapiens
gaaaagggaucugcu

SEQ ID NO: 1702161 - RNA, 16 nt, Homo sapiens
gaaaagggcugacauu

SEQ ID NO: 1702162 - RNA, 22 nt, Homo sapiens
gaaaagguagcuuaccugacac

SEQ ID NO: 1702163 - RNA, 14 nt, Homo sapiens
gaaaaguagacaau

SEQ ID NO: 1702164 - RNA, 22 nt, Homo sapiens
gaaaaguagacaaucauuguuu

SEQ ID NO: 1702165 - RNA, 18 nt, Homo sapiens
gaaaauaccaucaggccu

SEQ ID NO: 1702166 - RNA, 17 nt, Homo sapiens
gaaaauauaaaacaaau

SEQ ID NO: 1702167 - RNA, 15 nt, Homo sapiens
gaaaauccaucucau

SEQ ID NO: 1702168 - RNA, 22 nt, Homo sapiens
gaaaaucgugacaacacuugug

SEQ ID NO: 1702169 - RNA, 15 nt, Homo sapiens
gaaaaugacucuggg

SEQ ID NO: 1702170 - RNA, 21 nt, Homo sapiens
gaaaaugagggccgcuuugag

SEQ ID NO: 1702171 - RNA, 14 nt, Homo sapiens
gaaaauuauaucuc

SEQ ID NO: 1702172 - RNA, 20 nt, Homo sapiens
gaaaauucaaaaaguguuua

SEQ ID NO: 1702173 - RNA, 18 nt, Homo sapiens
gaaaauuuuaccagcaga

SEQ ID NO: 1702174 - RNA, 17 nt, Homo sapiens
gaaacacagaaaccuuu

SEQ ID NO: 1702175 - RNA, 14 nt, Homo sapiens
gaaacacuuugccu

SEQ ID NO: 1702176 - RNA, 22 nt, Homo sapiens
gaaacagcaggacuuguuuaca

SEQ ID NO: 1702177 - RNA, 19 nt, Homo sapiens
gaaacaugacacugaccuu

SEQ ID NO: 1702178 - RNA, 16 nt, Homo sapiens
gaaacauuaugccuua

SEQ ID NO: 1702179 - RNA, 16 nt, Homo sapiens
gaaaccucuacauauu

SEQ ID NO: 1702180 - RNA, 17 nt, Homo sapiens
gaaaccucuacauauuu

SEQ ID NO: 1702181 - RNA, 14 nt, Homo sapiens
gaaacggauccagc

SEQ ID NO: 1702182 - RNA, 21 nt, Homo sapiens
gaaacucuuaucucagucaug

SEQ ID NO: 1702183 - RNA, 14 nt, Homo sapiens
gaaacuggcacuga

SEQ ID NO: 1702184 - RNA, 10 nt, Homo sapiens
gaaagccagg

SEQ ID NO: 1702185 - RNA, 23 nt, Homo sapiens
gaaaggggccccaccggggucua

SEQ ID NO: 1702186 - RNA, 21 nt, Homo sapiens
gaaagggguuggggugacagu

SEQ ID NO: 1702187 - RNA, 17 nt, Homo sapiens
gaaaguaagugguagcu

SEQ ID NO: 1702188 - RNA, 21 nt, Homo sapiens
gaaaguagaacuuacuauuca

SEQ ID NO: 1702189 - RNA, 14 nt, Homo sapiens
gaaagugcauauga

SEQ ID NO: 1702190 - RNA, 19 nt, Homo sapiens
gaaaguucuugguggugga

SEQ ID NO: 1702191 - RNA, 12 nt, Homo sapiens
gaaauaccucau

SEQ ID NO: 1702192 - RNA, 16 nt, Homo sapiens
gaaauacuauaacaua

SEQ ID NO: 1702193 - RNA, 13 nt, Homo sapiens
gaaauacuuucag

SEQ ID NO: 1702194 - RNA, 13 nt, Homo sapiens
gaaauaguuugag

SEQ ID NO: 1702195 - RNA, 21 nt, Homo sapiens
gaaaucauaguuuaaacugca

SEQ ID NO: 1702196 - RNA, 23 nt, Homo sapiens
gaaaucauuuuacccuuggcuca

SEQ ID NO: 1702197 - RNA, 15 nt, Homo sapiens
gaaaugaacauucca

SEQ ID NO: 1702198 - RNA, 15 nt, Homo sapiens
gaaauggaugcaaag

SEQ ID NO: 1702199 - RNA, 16 nt, Homo sapiens
gaaauguaaacugcca

SEQ ID NO: 1702200 - RNA, 18 nt, Homo sapiens
gaaauguaaacugccaua

SEQ ID NO: 1702201 - RNA, 22 nt, Homo sapiens
gaaaugucacguacugucugau

SEQ ID NO: 1702202 - RNA, 22 nt, Homo sapiens
gaaauguuaaagguucacaggg

SEQ ID NO: 1702203 - RNA, 17 nt, Homo sapiens
gaaauuaugugacauuu

SEQ ID NO: 1702204 - RNA, 20 nt, Homo sapiens
gaaauucuaaagagcacuua

SEQ ID NO: 1702205 - RNA, 11 nt, Homo sapiens
gaaauugcaau

SEQ ID NO: 1702206 - RNA, 14 nt, Homo sapiens
gaacaaaaaaacca

SEQ ID NO: 1702207 - RNA, 21 nt, Homo sapiens
gaacaaaaaaaccacaaaggc

SEQ ID NO: 1702208 - RNA, 19 nt, Homo sapiens
gaacaaaguccacaguuua

SEQ ID NO: 1702209 - RNA, 12 nt, Homo sapiens
gaacaacacuuc

SEQ ID NO: 1702210 - RNA, 13 nt, Homo sapiens
gaacaagguuuca

SEQ ID NO: 1702211 - RNA, 17 nt, Homo sapiens
gaacacaggcagcuuuc

SEQ ID NO: 1702212 - RNA, 13 nt, Homo sapiens
gaacagaaggaug

SEQ ID NO: 1702213 - RNA, 16 nt, Homo sapiens
gaacagacaacagaag

SEQ ID NO: 1702214 - RNA, 22 nt, Homo sapiens
gaacagauaaucagugugucua

SEQ ID NO: 1702215 - RNA, 19 nt, Homo sapiens
gaacagcaauggugucagu

SEQ ID NO: 1702216 - RNA, 17 nt, Homo sapiens
gaacauccaaccuuccc

SEQ ID NO: 1702217 - RNA, 19 nt, Homo sapiens
gaacauggggaguguuuca

SEQ ID NO: 1702218 - RNA, 19 nt, Homo sapiens
gaaccaaaagaauuugcac

SEQ ID NO: 1702219 - RNA, 23 nt, Homo sapiens
gaaccaagcggugccagccacga

SEQ ID NO: 1702220 - RNA, 22 nt, Homo sapiens
gaacccaagcuuagaacuuuaa

SEQ ID NO: 1702221 - RNA, 23 nt, Homo sapiens
gaaccccgucgaggggcucucag

SEQ ID NO: 1702222 - RNA, 22 nt, Homo sapiens
gaacccuuggagccaauggaga

SEQ ID NO: 1702223 - RNA, 15 nt, Homo sapiens
gaacccuuguccucc

SEQ ID NO: 1702224 - RNA, 13 nt, Homo sapiens
gaaccgcacagcu

SEQ ID NO: 1702225 - RNA, 13 nt, Homo sapiens
gaaccguuuugaa

SEQ ID NO: 1702226 - RNA, 23 nt, Homo sapiens
gaacuaauaaauacauacgguca

SEQ ID NO: 1702227 - RNA, 16 nt, Homo sapiens
gaacuagcauauagcc

SEQ ID NO: 1702228 - RNA, 14 nt, Homo sapiens
gaacuauaugugaa

SEQ ID NO: 1702229 - RNA, 11 nt, Homo sapiens
gaacucuccau

SEQ ID NO: 1702230 - RNA, 14 nt, Homo sapiens
gaacucucuccacc

SEQ ID NO: 1702231 - RNA, 18 nt, Homo sapiens
gaacucuguaaaaccuca

SEQ ID NO: 1702232 - RNA, 17 nt, Homo sapiens
gaacugcguggugcucu

SEQ ID NO: 1702233 - RNA, 16 nt, Homo sapiens
gaacuuacuauucauu

SEQ ID NO: 1702234 - RNA, 22 nt, Homo sapiens
gaacuugagcgugaaucuguau

SEQ ID NO: 1702235 - RNA, 13 nt, Homo sapiens
gaagaacuugcau

SEQ ID NO: 1702236 - RNA, 14 nt, Homo sapiens
gaagaacuugcaug

SEQ ID NO: 1702237 - RNA, 15 nt, Homo sapiens
gaagaagcuauguca

SEQ ID NO: 1702238 - RNA, 22 nt, Homo sapiens
gaagacacacucagcaaccaca

SEQ ID NO: 1702239 - RNA, 19 nt, Homo sapiens
gaagacagcugcuggguca

SEQ ID NO: 1702240 - RNA, 17 nt, Homo sapiens
gaagagaaagcacgugu

SEQ ID NO: 1702241 - RNA, 19 nt, Homo sapiens
gaagcagccaucacaugau

SEQ ID NO: 1702242 - RNA, 20 nt, Homo sapiens
gaagcagggugaucgcacaa

SEQ ID NO: 1702243 - RNA, 12 nt, Homo sapiens
gaagcauuuacu

SEQ ID NO: 1702244 - RNA, 22 nt, Homo sapiens
gaagcauuuguauuuuguguga

SEQ ID NO: 1702245 - RNA, 19 nt, Homo sapiens
gaagcccugauguguccuc

SEQ ID NO: 1702246 - RNA, 23 nt, Homo sapiens
gaagcccugauguguccucaggg

SEQ ID NO: 1702247 - RNA, 16 nt, Homo sapiens
gaagccucuggcuaga

SEQ ID NO: 1702248 - RNA, 19 nt, Homo sapiens
gaagccuucagcuccaggg

SEQ ID NO: 1702249 - RNA, 18 nt, Homo sapiens
gaagcggauuuccaggga

SEQ ID NO: 1702250 - RNA, 16 nt, Homo sapiens
gaagcucugaagucac

SEQ ID NO: 1702251 - RNA, 14 nt, Homo sapiens
gaaggaacuuccag

SEQ ID NO: 1702252 - RNA, 13 nt, Homo sapiens
gaaggucaccagc

SEQ ID NO: 1702253 - RNA, 14 nt, Homo sapiens
gaaggucaccagca

SEQ ID NO: 1702254 - RNA, 16 nt, Homo sapiens
gaaggucccucagaca

SEQ ID NO: 1702255 - RNA, 23 nt, Homo sapiens
gaagguuggcccccacgugggga

SEQ ID NO: 1702256 - RNA, 18 nt, Homo sapiens
gaaguaaacagauggcac

SEQ ID NO: 1702257 - RNA, 18 nt, Homo sapiens
gaaguaaccauuugcacu

SEQ ID NO: 1702258 - RNA, 12 nt, Homo sapiens
gaaguacaugaa

SEQ ID NO: 1702259 - RNA, 15 nt, Homo sapiens
gaaguagcagugucu

SEQ ID NO: 1702260 - RNA, 22 nt, Homo sapiens
gaaguaguucuguuuggugugu

SEQ ID NO: 1702261 - RNA, 15 nt, Homo sapiens
gaaguaugagggaaa

SEQ ID NO: 1702262 - RNA, 20 nt, Homo sapiens
gaagugaaugaaacacucag

SEQ ID NO: 1702263 - RNA, 18 nt, Homo sapiens
gaagugguaggaaagccu

SEQ ID NO: 1702264 - RNA, 16 nt, Homo sapiens
gaaguuccaguguucu

SEQ ID NO: 1702265 - RNA, 12 nt, Homo sapiens
gaaguuccucaa

SEQ ID NO: 1702266 - RNA, 17 nt, Homo sapiens
gaauaagaaaacaauca

SEQ ID NO: 1702267 - RNA, 23 nt, Homo sapiens
gaauaagcucuaguucuuaacaa

SEQ ID NO: 1702268 - RNA, 20 nt, Homo sapiens
gaauagcaugguuuuggcca

SEQ ID NO: 1702269 - RNA, 19 nt, Homo sapiens
gaauagcuuugaauguggc

SEQ ID NO: 1702270 - RNA, 14 nt, Homo sapiens
gaauauaggucucu

SEQ ID NO: 1702271 - RNA, 17 nt, Homo sapiens
gaaucaagagcugcccu

SEQ ID NO: 1702272 - RNA, 13 nt, Homo sapiens
gaaucaauucaau

SEQ ID NO: 1702273 - RNA, 16 nt, Homo sapiens
gaaucaauucaauuug

SEQ ID NO: 1702274 - RNA, 15 nt, Homo sapiens
gaaucagaccugguu

SEQ ID NO: 1702275 - RNA, 23 nt, Homo sapiens
gaaucaucaaagcucacaccaaa

SEQ ID NO: 1702276 - RNA, 18 nt, Homo sapiens
gaaucauuaauacaaaga

SEQ ID NO: 1702277 - RNA, 12 nt, Homo sapiens
gaauccaagcuc

SEQ ID NO: 1702278 - RNA, 21 nt, Homo sapiens
gaaucuauccauugaacuaaa

SEQ ID NO: 1702279 - RNA, 17 nt, Homo sapiens
gaaucuauuucacuuau

SEQ ID NO: 1702280 - RNA, 22 nt, Homo sapiens
gaaucuggcaggaaucuaucca

SEQ ID NO: 1702281 - RNA, 13 nt, Homo sapiens
gaaugaaacugau

SEQ ID NO: 1702282 - RNA, 23 nt, Homo sapiens
gaaugaaagauuaaacagaugau

SEQ ID NO: 1702283 - RNA, 15 nt, Homo sapiens
gaaugacauugaacu

SEQ ID NO: 1702284 - RNA, 21 nt, Homo sapiens
gaaugaucagcaucugugaug

SEQ ID NO: 1702285 - RNA, 21 nt, Homo sapiens
gaauggagggaaugcucagaa

SEQ ID NO: 1702286 - RNA, 22 nt, Homo sapiens
gaauggcccaguccucucccaa

SEQ ID NO: 1702287 - RNA, 20 nt, Homo sapiens
gaaugguacaugucuuccau

SEQ ID NO: 1702288 - RNA, 23 nt, Homo sapiens
gaauguguggccugcacagugaa

SEQ ID NO: 1702289 - RNA, 17 nt, Homo sapiens
gaauguuuaaagaucau

SEQ ID NO: 1702290 - RNA, 12 nt, Homo sapiens
gaauuaagacgg

SEQ ID NO: 1702291 - RNA, 17 nt, Homo sapiens
gaauuauaagucacaaa

SEQ ID NO: 1702292 - RNA, 13 nt, Homo sapiens
gaauucaaacugg

SEQ ID NO: 1702293 - RNA, 18 nt, Homo sapiens
gaauuggccgcugucacu

SEQ ID NO: 1702294 - RNA, 14 nt, Homo sapiens
gaauuuggaaaucc

SEQ ID NO: 1702295 - RNA, 21 nt, Homo sapiens
gacaaaacuucuugucagaca

SEQ ID NO: 1702296 - RNA, 21 nt, Homo sapiens
gacaaaggaguaguagcugaa

SEQ ID NO: 1702297 - RNA, 16 nt, Homo sapiens
gacaaccuccauucua

SEQ ID NO: 1702298 - RNA, 13 nt, Homo sapiens
gacaacugugacu

SEQ ID NO: 1702299 - RNA, 15 nt, Homo sapiens
gacaacugugacugu

SEQ ID NO: 1702300 - RNA, 17 nt, Homo sapiens
gacaagaauaauucaau

SEQ ID NO: 1702301 - RNA, 22 nt, Homo sapiens
gacaaugaagugacacuuugac

SEQ ID NO: 1702302 - RNA, 22 nt, Homo sapiens
gacacaauuggaauugucuuua

SEQ ID NO: 1702303 - RNA, 13 nt, Homo sapiens
gacacagaaaaug

SEQ ID NO: 1702304 - RNA, 15 nt, Homo sapiens
gacacauaugcaccu

SEQ ID NO: 1702305 - RNA, 15 nt, Homo sapiens
gacaccauuuaucua

SEQ ID NO: 1702306 - RNA, 16 nt, Homo sapiens
gacaccuuuagguucu

SEQ ID NO: 1702307 - RNA, 19 nt, Homo sapiens
gacacuccccgaagucuuu

SEQ ID NO: 1702308 - RNA, 13 nt, Homo sapiens
gacacucuucccu

SEQ ID NO: 1702309 - RNA, 19 nt, Homo sapiens
gacacuuugacauuuccua

SEQ ID NO: 1702310 - RNA, 23 nt, Homo sapiens
gacagaaggugccacuuuaccca

SEQ ID NO: 1702311 - RNA, 19 nt, Homo sapiens
gacagaauguaucugugaa

SEQ ID NO: 1702312 - RNA, 15 nt, Homo sapiens
gacagacagccaccc

SEQ ID NO: 1702313 - RNA, 21 nt, Homo sapiens
gacagacagccacccugagaa

SEQ ID NO: 1702314 - RNA, 22 nt, Homo sapiens
gacagaccacagagcugucacu

SEQ ID NO: 1702315 - RNA, 19 nt, Homo sapiens
gacagauccccguuccuga

SEQ ID NO: 1702316 - RNA, 13 nt, Homo sapiens
gacagcucuccaa

SEQ ID NO: 1702317 - RNA, 18 nt, Homo sapiens
gacagcuuguggcuuuuu

SEQ ID NO: 1702318 - RNA, 23 nt, Homo sapiens
gacaggcgagagaggagccagac

SEQ ID NO: 1702319 - RNA, 20 nt, Homo sapiens
gacaggcucugcuucuccaa

SEQ ID NO: 1702320 - RNA, 10 nt, Homo sapiens
gacagucauc

SEQ ID NO: 1702321 - RNA, 20 nt, Homo sapiens
gacaguccaaaccacuccac

SEQ ID NO: 1702322 - RNA, 20 nt, Homo sapiens
gacaguuuguaaauguuauu

SEQ ID NO: 1702323 - RNA, 21 nt, Homo sapiens
gacauaacagugcagggcaaa

SEQ ID NO: 1702324 - RNA, 20 nt, Homo sapiens
gacauagauauuuucacaau

SEQ ID NO: 1702325 - RNA, 14 nt, Homo sapiens
gacaucucaggggc

SEQ ID NO: 1702326 - RNA, 16 nt, Homo sapiens
gacaugauuuccuuga

SEQ ID NO: 1702327 - RNA, 20 nt, Homo sapiens
ucagugaaagccagauucaa

SEQ ID NO: 1702328 - RNA, 14 nt, Homo sapiens
ucaguguugagaug

SEQ ID NO: 1702329 - RNA, 20 nt, Homo sapiens
ucaguucccuuggccucaga

SEQ ID NO: 1702330 - RNA, 20 nt, Homo sapiens
ucauaaaguuagaaucuauu

SEQ ID NO: 1702331 - RNA, 20 nt, Homo sapiens
ucauacaaagcgugcacaag

SEQ ID NO: 1702332 - RNA, 13 nt, Homo sapiens
ucauacaugcaua

SEQ ID NO: 1702333 - RNA, 20 nt, Homo sapiens
ucauacaugcauacaaagag

SEQ ID NO: 1702334 - RNA, 24 nt, Homo sapiens
ucauaccguguaccucaguucccu

SEQ ID NO: 1702335 - RNA, 20 nt, Homo sapiens
ucauaccucugaccaacagg

SEQ ID NO: 1702336 - RNA, 14 nt, Homo sapiens
ucauacuacauuga

SEQ ID NO: 1702337 - RNA, 16 nt, Homo sapiens
ucauacuguucaaugg

SEQ ID NO: 1702338 - RNA, 22 nt, Homo sapiens
ucauaguggcuuaaaacaacac

SEQ ID NO: 1702339 - RNA, 20 nt, Homo sapiens
ucauauucuucauauccuuc

SEQ ID NO: 1702340 - RNA, 15 nt, Homo sapiens
ucauauugaauguuu

SEQ ID NO: 1702341 - RNA, 20 nt, Homo sapiens
ucauauuuuguauauaucug

SEQ ID NO: 1702342 - RNA, 17 nt, Homo sapiens
ucaucaaaaacuuugga

SEQ ID NO: 1702343 - RNA, 20 nt, Homo sapiens
ucaucacagggauuuagacu

SEQ ID NO: 1702344 - RNA, 15 nt, Homo sapiens
ucaucacauucaggg

SEQ ID NO: 1702345 - RNA, 12 nt, Homo sapiens
ucaucauggcaa

SEQ ID NO: 1702346 - RNA, 17 nt, Homo sapiens
ucaucauugugcuagcu

SEQ ID NO: 1702347 - RNA, 19 nt, Homo sapiens
ucaucccuuuccaguuaag

SEQ ID NO: 1702348 - RNA, 17 nt, Homo sapiens
ucauccuuggucuuugu

SEQ ID NO: 1702349 - RNA, 20 nt, Homo sapiens
ucaucuauucaagcacuuac

SEQ ID NO: 1702350 - RNA, 14 nt, Homo sapiens
ucaucucauuccaa

SEQ ID NO: 1702351 - RNA, 20 nt, Homo sapiens
ucaucugccaacuguccuac

SEQ ID NO: 1702352 - RNA, 16 nt, Homo sapiens
ucaucuguuguagauu

SEQ ID NO: 1702353 - RNA, 13 nt, Homo sapiens
ucaucuguuguuu

SEQ ID NO: 1702354 - RNA, 21 nt, Homo sapiens
ucaucuuguugccauggaguu

SEQ ID NO: 1702355 - RNA, 13 nt, Homo sapiens
ucaugagcuugaa

SEQ ID NO: 1702356 - RNA, 14 nt, Homo sapiens
ucaugcagcucaac

SEQ ID NO: 1702357 - RNA, 17 nt, Homo sapiens
ucaugcguguguguugu

SEQ ID NO: 1702358 - RNA, 17 nt, Homo sapiens
ucaugcucugcaaaagg

SEQ ID NO: 1702359 - RNA, 22 nt, Homo sapiens
ucauggaccacuguuucuugcu

SEQ ID NO: 1702360 - RNA, 23 nt, Homo sapiens
ucauggccauagcuuuuauucau

SEQ ID NO: 1702361 - RNA, 16 nt, Homo sapiens
ucaugugggucuucca

SEQ ID NO: 1702362 - RNA, 20 nt, Homo sapiens
ucauguucuugcagucauca

SEQ ID NO: 1702363 - RNA, 13 nt, Homo sapiens
ucauuauguauga

SEQ ID NO: 1702364 - RNA, 13 nt, Homo sapiens
ucauucacauuca

SEQ ID NO: 1702365 - RNA, 18 nt, Homo sapiens
ucauucauucaaguaaua

SEQ ID NO: 1702366 - RNA, 13 nt, Homo sapiens
ucauuccaccuuc

SEQ ID NO: 1702367 - RNA, 15 nt, Homo sapiens
ucauuccauugccua

SEQ ID NO: 1702368 - RNA, 19 nt, Homo sapiens
ucauucccuagaucuuucu

SEQ ID NO: 1702369 - RNA, 18 nt, Homo sapiens
ucauugacaagaacugaa

SEQ ID NO: 1702370 - RNA, 14 nt, Homo sapiens
ucauugcacuuuga

SEQ ID NO: 1702371 - RNA, 20 nt, Homo sapiens
ucauugcgugauucaaugaa

SEQ ID NO: 1702372 - RNA, 11 nt, Homo sapiens
ucauugcugag

SEQ ID NO: 1702373 - RNA, 14 nt, Homo sapiens
ucauugucugugga

SEQ ID NO: 1702374 - RNA, 14 nt, Homo sapiens
ucauuuagaacuug

SEQ ID NO: 1702375 - RNA, 17 nt, Homo sapiens
ucauuucagauauucca

SEQ ID NO: 1702376 - RNA, 12 nt, Homo sapiens
ucauuucauucc

SEQ ID NO: 1702377 - RNA, 16 nt, Homo sapiens
ucauuugugugcucau

SEQ ID NO: 1702378 - RNA, 15 nt, Homo sapiens
ucauuuuaguugccu

SEQ ID NO: 1702379 - RNA, 22 nt, Homo sapiens
uccaaaaauuauuauaagcauu

SEQ ID NO: 1702380 - RNA, 22 nt, Homo sapiens
uccaaagaggcugccccucuca

SEQ ID NO: 1702381 - RNA, 14 nt, Homo sapiens
uccaaagcuuuauu

SEQ ID NO: 1702382 - RNA, 17 nt, Homo sapiens
uccaaauauuguugaca

SEQ ID NO: 1702383 - RNA, 22 nt, Homo sapiens
uccaacucagauugagcccuac

SEQ ID NO: 1702384 - RNA, 14 nt, Homo sapiens
uccaacuccaggau

SEQ ID NO: 1702385 - RNA, 17 nt, Homo sapiens
uccaacuguacuuuuaa

SEQ ID NO: 1702386 - RNA, 12 nt, Homo sapiens
uccaacuguaua

SEQ ID NO: 1702387 - RNA, 16 nt, Homo sapiens
uccaacuucccaguuc

SEQ ID NO: 1702388 - RNA, 21 nt, Homo sapiens
uccaagaaggccuucauggcc

SEQ ID NO: 1702389 - RNA, 16 nt, Homo sapiens
uccaagagguggguaa

SEQ ID NO: 1702390 - RNA, 12 nt, Homo sapiens
uccaauaugaug

SEQ ID NO: 1702391 - RNA, 16 nt, Homo sapiens
uccaaucggagacaaa

SEQ ID NO: 1702392 - RNA, 16 nt, Homo sapiens
uccaaugcauugcuaa

SEQ ID NO: 1702393 - RNA, 19 nt, Homo sapiens
uccaaugucugcugaggag

SEQ ID NO: 1702394 - RNA, 22 nt, Homo sapiens
uccacaaugaugaugauuucag

SEQ ID NO: 1702395 - RNA, 14 nt, Homo sapiens
uccacacuaccaca

SEQ ID NO: 1702396 - RNA, 18 nt, Homo sapiens
uccacauuauacauuuga

SEQ ID NO: 1702397 - RNA, 12 nt, Homo sapiens
uccaccaagaaa

SEQ ID NO: 1702398 - RNA, 21 nt, Homo sapiens
uccaccagcaucaccugccug

SEQ ID NO: 1702399 - RNA, 16 nt, Homo sapiens
uccaccgccacugggc

SEQ ID NO: 1702400 - RNA, 19 nt, Homo sapiens
uccaccucgggcacauuuu

SEQ ID NO: 1702401 - RNA, 16 nt, Homo sapiens
uccacucccuuugcca

SEQ ID NO: 1702402 - RNA, 19 nt, Homo sapiens
uccacucuuguggucauca

SEQ ID NO: 1702403 - RNA, 14 nt, Homo sapiens
uccagacccggcug

SEQ ID NO: 1702404 - RNA, 15 nt, Homo sapiens
uccagagaguggcuc

SEQ ID NO: 1702405 - RNA, 12 nt, Homo sapiens
uccagauggcaa

SEQ ID NO: 1702406 - RNA, 20 nt, Homo sapiens
uccagcaauuccugagccaa

SEQ ID NO: 1702407 - RNA, 19 nt, Homo sapiens
uccagcagaagacaaaaag

SEQ ID NO: 1702408 - RNA, 22 nt, Homo sapiens
uccagccuuuggccuuggcuuu

SEQ ID NO: 1702409 - RNA, 14 nt, Homo sapiens
uccagcugcugucu

SEQ ID NO: 1702410 - RNA, 19 nt, Homo sapiens
uccagcuugggcaacagag

SEQ ID NO: 1702411 - RNA, 20 nt, Homo sapiens
uccagcuugggcaacagagc

SEQ ID NO: 1702412 - RNA, 15 nt, Homo sapiens
uccagguacauauca

SEQ ID NO: 1702413 - RNA, 21 nt, Homo sapiens
uccaguguacauaguguaaug

SEQ ID NO: 1702414 - RNA, 20 nt, Homo sapiens
uccagugucugucauuucag

SEQ ID NO: 1702415 - RNA, 13 nt, Homo sapiens
uccauauguuaua

SEQ ID NO: 1702416 - RNA, 23 nt, Homo sapiens
uccaucacccucuuccugugauc

SEQ ID NO: 1702417 - RNA, 21 nt, Homo sapiens
uccaucagagaaggugcaggu

SEQ ID NO: 1702418 - RNA, 21 nt, Homo sapiens
uccaucagccaggacagucag

SEQ ID NO: 1702419 - RNA, 14 nt, Homo sapiens
uccauccaaucuau

SEQ ID NO: 1702420 - RNA, 22 nt, Homo sapiens
uccauccauaaauccaguucua

SEQ ID NO: 1702421 - RNA, 14 nt, Homo sapiens
uccaucccuacccc

SEQ ID NO: 1702422 - RNA, 20 nt, Homo sapiens
uccauccuuuacguguuuaa

SEQ ID NO: 1702423 - RNA, 15 nt, Homo sapiens
uccaucucaaaaaag

SEQ ID NO: 1702424 - RNA, 16 nt, Homo sapiens
uccaucucugacuuaa

SEQ ID NO: 1702425 - RNA, 22 nt, Homo sapiens
uccaugaaguuugaacuucaua

SEQ ID NO: 1702426 - RNA, 13 nt, Homo sapiens
uccaugcugccag

SEQ ID NO: 1702427 - RNA, 18 nt, Homo sapiens
uccaugcugccagccuuc

SEQ ID NO: 1702428 - RNA, 14 nt, Homo sapiens
uccaugggauacaa

SEQ ID NO: 1702429 - RNA, 15 nt, Homo sapiens
uccauguuuguaaaa

SEQ ID NO: 1702430 - RNA, 16 nt, Homo sapiens
uccauuugcaaauaua

SEQ ID NO: 1702431 - RNA, 15 nt, Homo sapiens
uccauuugcuuuguc

SEQ ID NO: 1702432 - RNA, 16 nt, Homo sapiens
ucccaaaucaauaaga

SEQ ID NO: 1702433 - RNA, 16 nt, Homo sapiens
ucccaaauuugauuga

SEQ ID NO: 1702434 - RNA, 15 nt, Homo sapiens
ucccaagaguauccu

SEQ ID NO: 1702435 - RNA, 13 nt, Homo sapiens
ucccacacaggcu

SEQ ID NO: 1702436 - RNA, 18 nt, Homo sapiens
ucccacacccuguuuuac

SEQ ID NO: 1702437 - RNA, 17 nt, Homo sapiens
ucccacauccaacucca

SEQ ID NO: 1702438 - RNA, 14 nt, Homo sapiens
ucccacauucugau

SEQ ID NO: 1702439 - RNA, 18 nt, Homo sapiens
ucccacccccaucucucc

SEQ ID NO: 1702440 - RNA, 16 nt, Homo sapiens
ucccacuaaaacugca

SEQ ID NO: 1702441 - RNA, 17 nt, Homo sapiens
ucccacucaggugaaaa

SEQ ID NO: 1702442 - RNA, 15 nt, Homo sapiens
ucccacuugucaugu

SEQ ID NO: 1702443 - RNA, 19 nt, Homo sapiens
ucccacuuuucggagacag

SEQ ID NO: 1702444 - RNA, 17 nt, Homo sapiens
ucccagcuacucaggag

SEQ ID NO: 1702445 - RNA, 23 nt, Homo sapiens
ucccaggaaguggccaaaagcua

SEQ ID NO: 1702446 - RNA, 22 nt, Homo sapiens
ucccagugaccccugaccucac

SEQ ID NO: 1702447 - RNA, 19 nt, Homo sapiens
ucccaucuggaccugguac

SEQ ID NO: 1702448 - RNA, 18 nt, Homo sapiens
ucccaucugucaccaauu

SEQ ID NO: 1702449 - RNA, 14 nt, Homo sapiens
ucccaucuuuacuc

SEQ ID NO: 1702450 - RNA, 23 nt, Homo sapiens
uccccaagugguuuccacaugcu

SEQ ID NO: 1702451 - RNA, 18 nt, Homo sapiens
uccccagaccucagggac

SEQ ID NO: 1702452 - RNA, 20 nt, Homo sapiens
uccccagaccucagggacaa

SEQ ID NO: 1702453 - RNA, 19 nt, Homo sapiens
ucccccaccgguccagcug

SEQ ID NO: 1702454 - RNA, 22 nt, Homo sapiens
ucccccuaaaccccugucccau

SEQ ID NO: 1702455 - RNA, 17 nt, Homo sapiens
uccccucaacaugcugc

SEQ ID NO: 1702456 - RNA, 19 nt, Homo sapiens
uccccucccuggcucccau

SEQ ID NO: 1702457 - RNA, 16 nt, Homo sapiens
uccccuggacugggag

SEQ ID NO: 1702458 - RNA, 15 nt, Homo sapiens
uccccuuucacaggu

SEQ ID NO: 1702459 - RNA, 21 nt, Homo sapiens
uccccuuuguguagaaagcca

SEQ ID NO: 1702460 - RNA, 14 nt, Homo sapiens
ucccgaauccacag

SEQ ID NO: 1702461 - RNA, 20 nt, Homo sapiens
ucccggcgucccuaccuccu

SEQ ID NO: 1702462 - RNA, 18 nt, Homo sapiens
ucccgugagccaggcaaa

SEQ ID NO: 1702463 - RNA, 12 nt, Homo sapiens
ucccuaccucag

SEQ ID NO: 1702464 - RNA, 14 nt, Homo sapiens
ucccuagcagugaa

SEQ ID NO: 1702465 - RNA, 14 nt, Homo sapiens
ucccucuaaugaga

SEQ ID NO: 1702466 - RNA, 13 nt, Homo sapiens
ucccucuguccac

SEQ ID NO: 1702467 - RNA, 21 nt, Homo sapiens
ucccugaaucccccuugccac

SEQ ID NO: 1702468 - RNA, 15 nt, Homo sapiens
ucccugcagaugcca

SEQ ID NO: 1702469 - RNA, 17 nt, Homo sapiens
ucccugcagaugccacc

SEQ ID NO: 1702470 - RNA, 19 nt, Homo sapiens
ucccugcgccugugaugcu

SEQ ID NO: 1702471 - RNA, 22 nt, Homo sapiens
ucccuggagagaaaguguguga

SEQ ID NO: 1702472 - RNA, 16 nt, Homo sapiens
ucccuguccuugcccu

SEQ ID NO: 1702473 - RNA, 16 nt, Homo sapiens
ucccuuccacugccuc

SEQ ID NO: 1702474 - RNA, 22 nt, Homo sapiens
ucccuuccacugccucugccuu

SEQ ID NO: 1702475 - RNA, 15 nt, Homo sapiens
ucccuucccuuccac

SEQ ID NO: 1702476 - RNA, 19 nt, Homo sapiens
ucccuuccggagucuuuga

SEQ ID NO: 1702477 - RNA, 20 nt, Homo sapiens
ucccuucucacagcacaugc

SEQ ID NO: 1702478 - RNA, 15 nt, Homo sapiens
ucccuugguggcaag

SEQ ID NO: 1702479 - RNA, 17 nt, Homo sapiens
ucccuuuguugcacacu

SEQ ID NO: 1702480 - RNA, 23 nt, Homo sapiens
ucccuuuuuauaucccauuuuua

SEQ ID NO: 1702481 - RNA, 19 nt, Homo sapiens
uccgacugccgcugagaag

SEQ ID NO: 1702482 - RNA, 14 nt, Homo sapiens
uccgaggugguuuu

SEQ ID NO: 1702483 - RNA, 17 nt, Homo sapiens
uccgcacccaguuugau

SEQ ID NO: 1702484 - RNA, 20 nt, Homo sapiens
uccgcagaauggacuugaua

SEQ ID NO: 1702485 - RNA, 21 nt, Homo sapiens
uccggaagcugucgacuucau

SEQ ID NO: 1702486 - RNA, 13 nt, Homo sapiens
uccuaacaaaaga

SEQ ID NO: 1702487 - RNA, 14 nt, Homo sapiens
uccuaauuaccagu

SEQ ID NO: 1702488 - RNA, 14 nt, Homo sapiens
uccuacaaggccua

SEQ ID NO: 1702489 - RNA, 19 nt, Homo sapiens
uccuacagcacuacugggu

SEQ ID NO: 1702490 - RNA, 16 nt, Homo sapiens
uccuacccacaccucu

SEQ ID NO: 1702491 - RNA, 22 nt, Homo sapiens
uccucacacacccugaggucag

SEQ ID NO: 1702492 - RNA, 20 nt, Homo sapiens
uccucaccucuggacuggcu

SEQ ID NO: 1702493 - RNA, 22 nt, Homo sapiens
uccucagagaauuucuaccauu

SEQ ID NO: 1702494 - RNA, 14 nt, Homo sapiens
uccucaugcugcuc

SEQ ID NO: 1702495 - RNA, 14 nt, Homo sapiens
uccucccaccucag

SEQ ID NO: 1702496 - RNA, 15 nt, Homo sapiens
uccucccucauucca

SEQ ID NO: 1702497 - RNA, 14 nt, Homo sapiens
uccucucucagggg

SEQ ID NO: 1702498 - RNA, 16 nt, Homo sapiens
uccucuggagcccuaa

SEQ ID NO: 1702499 - RNA, 16 nt, Homo sapiens
uccucuuggugucaua

SEQ ID NO: 1702500 - RNA, 19 nt, Homo sapiens
uccugacagaaggacucag

SEQ ID NO: 1702501 - RNA, 19 nt, Homo sapiens
uccugacagaaggugccac

SEQ ID NO: 1702502 - RNA, 17 nt, Homo sapiens
uccugacuccuaccugc

SEQ ID NO: 1702503 - RNA, 23 nt, Homo sapiens
uccugaggcuuuggauuugacau

SEQ ID NO: 1702504 - RNA, 19 nt, Homo sapiens
uccugaggggcaucugccc

SEQ ID NO: 1702505 - RNA, 16 nt, Homo sapiens
uccugagugcccucag

SEQ ID NO: 1702506 - RNA, 19 nt, Homo sapiens
uccugcagaaguacuccua

SEQ ID NO: 1702507 - RNA, 17 nt, Homo sapiens
uccugccaguguggaac

SEQ ID NO: 1702508 - RNA, 14 nt, Homo sapiens
uccugccuggccag

SEQ ID NO: 1702509 - RNA, 15 nt, Homo sapiens
uccugccuucaugga

SEQ ID NO: 1702510 - RNA, 16 nt, Homo sapiens
uccuggccucaaguga

SEQ ID NO: 1702511 - RNA, 16 nt, Homo sapiens
uccuggguacugaaag

SEQ ID NO: 1702512 - RNA, 18 nt, Homo sapiens
uccugggucuaccacuca

SEQ ID NO: 1702513 - RNA, 15 nt, Homo sapiens
uccuguacucugggg

SEQ ID NO: 1702514 - RNA, 20 nt, Homo sapiens
uccugugacugucucacuua

SEQ ID NO: 1702515 - RNA, 18 nt, Homo sapiens
uccugugauuuaugccaa

SEQ ID NO: 1702516 - RNA, 23 nt, Homo sapiens
uccuguggaacccagcaguucug

SEQ ID NO: 1702517 - RNA, 20 nt, Homo sapiens
uccugugucuugcaauggca

SEQ ID NO: 1702518 - RNA, 15 nt, Homo sapiens
uccuuaacacauuca

SEQ ID NO: 1702519 - RNA, 16 nt, Homo sapiens
uccuuaacacauucaa

SEQ ID NO: 1702520 - RNA, 19 nt, Homo sapiens
uccuuagucucaagggcua

SEQ ID NO: 1702521 - RNA, 12 nt, Homo sapiens
uccuuccauccc

SEQ ID NO: 1702522 - RNA, 16 nt, Homo sapiens
uccuuccaucccuacc

SEQ ID NO: 1702523 - RNA, 22 nt, Homo sapiens
uccuucuucaacgccaucucca

SEQ ID NO: 1702524 - RNA, 13 nt, Homo sapiens
uccuucuuugaua

SEQ ID NO: 1702525 - RNA, 14 nt, Homo sapiens
uccuugacuuugaa

SEQ ID NO: 1702526 - RNA, 16 nt, Homo sapiens
uccuuggcaccaaaga

SEQ ID NO: 1702527 - RNA, 15 nt, Homo sapiens
uccuuggcuuaccug

SEQ ID NO: 1702528 - RNA, 20 nt, Homo sapiens
uccuuggcuuaccugaccuc

SEQ ID NO: 1702529 - RNA, 18 nt, Homo sapiens
uccuugggaugaucuuga

SEQ ID NO: 1702530 - RNA, 20 nt, Homo sapiens
uccuuggucuuuguaucuuc

SEQ ID NO: 1702531 - RNA, 16 nt, Homo sapiens
uccuuguaaauuacau

SEQ ID NO: 1702532 - RNA, 14 nt, Homo sapiens
uccuugucacuuua

SEQ ID NO: 1702533 - RNA, 19 nt, Homo sapiens
uccuugugaagaugauaua

SEQ ID NO: 1702534 - RNA, 23 nt, Homo sapiens
uccuuuaaaaaacuuagugacaa

SEQ ID NO: 1702535 - RNA, 17 nt, Homo sapiens
uccuuuagcgcccaguu

SEQ ID NO: 1702536 - RNA, 23 nt, Homo sapiens
uccuuuccaagcuccucgugaua

SEQ ID NO: 1702537 - RNA, 16 nt, Homo sapiens
ucgaaagaaaaugggc

SEQ ID NO: 1702538 - RNA, 15 nt, Homo sapiens
ucgaaagcucuagaa

SEQ ID NO: 1702539 - RNA, 11 nt, Homo sapiens
ucgaacaaagg

SEQ ID NO: 1702540 - RNA, 18 nt, Homo sapiens
ucgaaugaacaaagucca

SEQ ID NO: 1702541 - RNA, 20 nt, Homo sapiens
ucgacuuuucuuaacaaccu

SEQ ID NO: 1702542 - RNA, 14 nt, Homo sapiens
ucgaggggcucuca

SEQ ID NO: 1702543 - RNA, 21 nt, Homo sapiens
ucgauccaaauugugcuucuc

SEQ ID NO: 1702544 - RNA, 15 nt, Homo sapiens
ucgcccaacuccacc

SEQ ID NO: 1702545 - RNA, 20 nt, Homo sapiens
ucgcccuuucuuaaagugca

SEQ ID NO: 1702546 - RNA, 23 nt, Homo sapiens
ucgcuauugauuuuuacuucaau

SEQ ID NO: 1702547 - RNA, 15 nt, Homo sapiens
ucgcugccagaugau

SEQ ID NO: 1702548 - RNA, 22 nt, Homo sapiens
ucgcugccagaugauuguucaa

SEQ ID NO: 1702549 - RNA, 23 nt, Homo sapiens
ucggaacagcagauaacaaugca

SEQ ID NO: 1702550 - RNA, 12 nt, Homo sapiens
ucggauaugauu

SEQ ID NO: 1702551 - RNA, 16 nt, Homo sapiens
ucggcagcuacucaga

SEQ ID NO: 1702552 - RNA, 17 nt, Homo sapiens
ucggcucacaaagagau

SEQ ID NO: 1702553 - RNA, 20 nt, Homo sapiens
ucggcuccccauguguccug

SEQ ID NO: 1702554 - RNA, 15 nt, Homo sapiens
ucgggccagaaggcg

SEQ ID NO: 1702555 - RNA, 20 nt, Homo sapiens
ucguaucccgagucugggac

SEQ ID NO: 1702556 - RNA, 15 nt, Homo sapiens
ucgugacaacacuug

SEQ ID NO: 1702557 - RNA, 22 nt, Homo sapiens
ucuaaaagcguuggauguagca

SEQ ID NO: 1702558 - RNA, 21 nt, Homo sapiens
ucuaaacagugggaguaccaa

SEQ ID NO: 1702559 - RNA, 22 nt, Homo sapiens
ucuaaacagugggaguaccaaa

SEQ ID NO: 1702560 - RNA, 13 nt, Homo sapiens
ucuaaaguucuaa

SEQ ID NO: 1702561 - RNA, 23 nt, Homo sapiens
ucuaacacgcacagcugaaaguu

SEQ ID NO: 1702562 - RNA, 21 nt, Homo sapiens
ucuaaggccuaggauucuaaa

SEQ ID NO: 1702563 - RNA, 13 nt, Homo sapiens
ucuaaguauuuga

SEQ ID NO: 1702564 - RNA, 21 nt, Homo sapiens
ucuacaaacucccacuuguca

SEQ ID NO: 1702565 - RNA, 23 nt, Homo sapiens
ucuacacagugggaacucugaca

SEQ ID NO: 1702566 - RNA, 14 nt, Homo sapiens
ucuacagaggccau

SEQ ID NO: 1702567 - RNA, 13 nt, Homo sapiens
ucuaccucaggca

SEQ ID NO: 1702568 - RNA, 20 nt, Homo sapiens
ucuaccucaggcagcucaag

SEQ ID NO: 1702569 - RNA, 12 nt, Homo sapiens
ucuacuaauucc

SEQ ID NO: 1702570 - RNA, 22 nt, Homo sapiens
ucuagaacacaggcaaaauccu

SEQ ID NO: 1702571 - RNA, 23 nt, Homo sapiens
ucuagacaagauauuguacauaa

SEQ ID NO: 1702572 - RNA, 19 nt, Homo sapiens
ucuagacuauuaggugcaa

SEQ ID NO: 1702573 - RNA, 12 nt, Homo sapiens
ucuagauucaaa

SEQ ID NO: 1702574 - RNA, 15 nt, Homo sapiens
ucuagcugugggggu

SEQ ID NO: 1702575 - RNA, 18 nt, Homo sapiens
ucuagugucuuuugccuu

SEQ ID NO: 1702576 - RNA, 20 nt, Homo sapiens
ucuaguuucuugugggcuaa

SEQ ID NO: 1702577 - RNA, 20 nt, Homo sapiens
ucuauaaagaagaacuugca

SEQ ID NO: 1702578 - RNA, 12 nt, Homo sapiens
ucuauccaaauc

SEQ ID NO: 1702579 - RNA, 17 nt, Homo sapiens
ucuaugaacaacuccaa

SEQ ID NO: 1702580 - RNA, 13 nt, Homo sapiens
ucuauguuugcac

SEQ ID NO: 1702581 - RNA, 23 nt, Homo sapiens
ucuauuaaauaguuauauaauuc

SEQ ID NO: 1702582 - RNA, 14 nt, Homo sapiens
ucuauucucaaagu

SEQ ID NO: 1702583 - RNA, 20 nt, Homo sapiens
ucuauugagugaacagaauu

SEQ ID NO: 1702584 - RNA, 21 nt, Homo sapiens
ucuauugagugaacagaauug

SEQ ID NO: 1702585 - RNA, 22 nt, Homo sapiens
ucucaaauuauuuaaaaugcau

SEQ ID NO: 1702586 - RNA, 17 nt, Homo sapiens
ucucaaugaagccagcu

SEQ ID NO: 1702587 - RNA, 14 nt, Homo sapiens
ucucaauuugcagu

SEQ ID NO: 1702588 - RNA, 21 nt, Homo sapiens
ucucacccgaccggugcauga

SEQ ID NO: 1702589 - RNA, 20 nt, Homo sapiens
ucucacucugucgcccaguc

SEQ ID NO: 1702590 - RNA, 13 nt, Homo sapiens
ucucagaccccac

SEQ ID NO: 1702591 - RNA, 14 nt, Homo sapiens
ucucagcccagaag

SEQ ID NO: 1702592 - RNA, 21 nt, Homo sapiens
ucucaggggccagaggaacug

SEQ ID NO: 1702593 - RNA, 21 nt, Homo sapiens
ucucaguggcuucaucuguca

SEQ ID NO: 1702594 - RNA, 17 nt, Homo sapiens
ucucauaccucugacca

SEQ ID NO: 1702595 - RNA, 17 nt, Homo sapiens
ucucauagguugccaau

SEQ ID NO: 1702596 - RNA, 23 nt, Homo sapiens
ucucaucaacaaagaaauauuau

SEQ ID NO: 1702597 - RNA, 16 nt, Homo sapiens
ucucauuuagaacuug

SEQ ID NO: 1702598 - RNA, 18 nt, Homo sapiens
ucucauuuagaacuugca

SEQ ID NO: 1702599 - RNA, 13 nt, Homo sapiens
ucuccaaacauua

SEQ ID NO: 1702600 - RNA, 18 nt, Homo sapiens
ucuccacacccacuuugu

SEQ ID NO: 1702601 - RNA, 16 nt, Homo sapiens
ucuccagccaaccuca

SEQ ID NO: 1702602 - RNA, 19 nt, Homo sapiens
ucuccagcucagaacccag

SEQ ID NO: 1702603 - RNA, 13 nt, Homo sapiens
ucuccaggucuca

SEQ ID NO: 1702604 - RNA, 21 nt, Homo sapiens
ucucccacuaaaacugcauuu

SEQ ID NO: 1702605 - RNA, 19 nt, Homo sapiens
ucucccuuugaagaaacua

SEQ ID NO: 1702606 - RNA, 22 nt, Homo sapiens
ucuccuaaaacuuuaaaacuug

SEQ ID NO: 1702607 - RNA, 13 nt, Homo sapiens
ucuccuccuugag

SEQ ID NO: 1702608 - RNA, 18 nt, Homo sapiens
ucuccugaagaggaacug

SEQ ID NO: 1702609 - RNA, 21 nt, Homo sapiens
ucuccuguuggcucacagggc

SEQ ID NO: 1702610 - RNA, 21 nt, Homo sapiens
ucuccuuucucuuaugcuuaa

SEQ ID NO: 1702611 - RNA, 23 nt, Homo sapiens
ucuccuuugaaaccugcucugua

SEQ ID NO: 1702612 - RNA, 22 nt, Homo sapiens
ucucuccaacucccucugggaa

SEQ ID NO: 1702613 - RNA, 16 nt, Homo sapiens
ucucucucucuacaaa

SEQ ID NO: 1702614 - RNA, 17 nt, Homo sapiens
ucucugaggacacuaac

SEQ ID NO: 1702615 - RNA, 18 nt, Homo sapiens
ucucugcuccaccacauc

SEQ ID NO: 1702616 - RNA, 16 nt, Homo sapiens
ucucugcugcauuugu

SEQ ID NO: 1702617 - RNA, 16 nt, Homo sapiens
ucucuuauuacaaaga

SEQ ID NO: 1702618 - RNA, 23 nt, Homo sapiens
ucucuuccuguuuuguacauaga

SEQ ID NO: 1702619 - RNA, 13 nt, Homo sapiens
ucucuucugccuu

SEQ ID NO: 1702620 - RNA, 12 nt, Homo sapiens
ucucuuuggucu

SEQ ID NO: 1702621 - RNA, 18 nt, Homo sapiens
ucugaaauaggaaacaag

SEQ ID NO: 1702622 - RNA, 14 nt, Homo sapiens
ucugaacacaggca

SEQ ID NO: 1702623 - RNA, 15 nt, Homo sapiens
ucugaagacagucuu

SEQ ID NO: 1702624 - RNA, 19 nt, Homo sapiens
ucugaaguacuaacacaag

SEQ ID NO: 1702625 - RNA, 23 nt, Homo sapiens
ucugaagucacaucacaggacac

SEQ ID NO: 1702626 - RNA, 20 nt, Homo sapiens
ucugaaugcugccacaacca

SEQ ID NO: 1702627 - RNA, 12 nt, Homo sapiens
ucugacacugaa

SEQ ID NO: 1702628 - RNA, 22 nt, Homo sapiens
ucugacgcaaaaccacuuuccu

SEQ ID NO: 1702629 - RNA, 11 nt, Homo sapiens
ucugacugcug

SEQ ID NO: 1702630 - RNA, 17 nt, Homo sapiens
ucugagaaggugagaua

SEQ ID NO: 1702631 - RNA, 13 nt, Homo sapiens
ucugagacucaca

SEQ ID NO: 1702632 - RNA, 20 nt, Homo sapiens
ucugaguaagaaacagaauc

SEQ ID NO: 1702633 - RNA, 19 nt, Homo sapiens
ucugaguaagcccucagga

SEQ ID NO: 1702634 - RNA, 17 nt, Homo sapiens
ucugaucguuuauucuc

SEQ ID NO: 1702635 - RNA, 13 nt, Homo sapiens
ucugcaagcauca

SEQ ID NO: 1702636 - RNA, 18 nt, Homo sapiens
ucugcaaggucuuugguu

SEQ ID NO: 1702637 - RNA, 23 nt, Homo sapiens
ucugcacagccuagacauccagg

SEQ ID NO: 1702638 - RNA, 15 nt, Homo sapiens
ucugcagacugcuag

SEQ ID NO: 1702639 - RNA, 21 nt, Homo sapiens
ucugcagggggugugucugcu

SEQ ID NO: 1702640 - RNA, 23 nt, Homo sapiens
ucugccagggcagugcuagugag

SEQ ID NO: 1702641 - RNA, 17 nt, Homo sapiens
ucugccaucaacuacua

SEQ ID NO: 1702642 - RNA, 14 nt, Homo sapiens
ucugccccagucgu

SEQ ID NO: 1702643 - RNA, 23 nt, Homo sapiens
ucugcccgggaaggucaccagca

SEQ ID NO: 1702644 - RNA, 14 nt, Homo sapiens
ucugccucugacac

SEQ ID NO: 1702645 - RNA, 19 nt, Homo sapiens
ucugccucugacacacagc

SEQ ID NO: 1702646 - RNA, 15 nt, Homo sapiens
ucugccuucucagga

SEQ ID NO: 1702647 - RNA, 18 nt, Homo sapiens
ucugcggaucucagcuuu

SEQ ID NO: 1702648 - RNA, 10 nt, Homo sapiens
ucugcuccac

SEQ ID NO: 1702649 - RNA, 20 nt, Homo sapiens
ucuggaaaccucuacauauu

SEQ ID NO: 1702650 - RNA, 16 nt, Homo sapiens
ucuggaauacaugaaa

SEQ ID NO: 1702651 - RNA, 18 nt, Homo sapiens
ucuggaaucuggagacca

SEQ ID NO: 1702652 - RNA, 18 nt, Homo sapiens
ucuggccaaaagcaguaa

SEQ ID NO: 1702653 - RNA, 23 nt, Homo sapiens
ucuggccauauuuacuaccuuau

SEQ ID NO: 1702654 - RNA, 18 nt, Homo sapiens
ucuggcccucgacacuca

SEQ ID NO: 1702655 - RNA, 23 nt, Homo sapiens
ucugggagaaaugagauaaaaga

SEQ ID NO: 1702656 - RNA, 15 nt, Homo sapiens
ucugggccauucaga

SEQ ID NO: 1702657 - RNA, 18 nt, Homo sapiens
ucuggggugcugccugaa

SEQ ID NO: 1702658 - RNA, 14 nt, Homo sapiens
ucuggguccuugca

SEQ ID NO: 1702659 - RNA, 13 nt, Homo sapiens
ucugggugcagcu

SEQ ID NO: 1702660 - RNA, 19 nt, Homo sapiens
ucuguaaaaacacugaaaa

SEQ ID NO: 1702661 - RNA, 15 nt, Homo sapiens
ucuguaaacuuccaa

SEQ ID NO: 1702662 - RNA, 22 nt, Homo sapiens
ucuguaaauaccauugacacau

SEQ ID NO: 1702663 - RNA, 22 nt, Homo sapiens
ucuguacauuuuguuguaaaaa

SEQ ID NO: 1702664 - RNA, 15 nt, Homo sapiens
ucuguagucauuuac

SEQ ID NO: 1702665 - RNA, 20 nt, Homo sapiens
ucuguauauauauauacuua

SEQ ID NO: 1702666 - RNA, 18 nt, Homo sapiens
ucugucaaaacacugugg

SEQ ID NO: 1702667 - RNA, 19 nt, Homo sapiens
ucugucagaaugcuauuga

SEQ ID NO: 1702668 - RNA, 18 nt, Homo sapiens
ucuguccauuuauccaca

SEQ ID NO: 1702669 - RNA, 14 nt, Homo sapiens
ucugugcuguggaa

SEQ ID NO: 1702670 - RNA, 17 nt, Homo sapiens
ucuguggaccacugcau

SEQ ID NO: 1702671 - RNA, 21 nt, Homo sapiens
ucuguguagcaagcuauucaa

SEQ ID NO: 1702672 - RNA, 21 nt, Homo sapiens
ucugugugcgcucuguggaug

SEQ ID NO: 1702673 - RNA, 13 nt, Homo sapiens
ucuguucacuuuu

SEQ ID NO: 1702674 - RNA, 18 nt, Homo sapiens
ucuguuggauuccaugcu

SEQ ID NO: 1702675 - RNA, 20 nt, Homo sapiens
ucuguuggccagugugacaa

SEQ ID NO: 1702676 - RNA, 23 nt, Homo sapiens
ucuguuugaaauucuagagccag

SEQ ID NO: 1702677 - RNA, 15 nt, Homo sapiens
ucuuaaagugcaguu

SEQ ID NO: 1702678 - RNA, 16 nt, Homo sapiens
ucuuaaccuauuuauu

SEQ ID NO: 1702679 - RNA, 22 nt, Homo sapiens
ucuuaagauccacaaaugaagg

SEQ ID NO: 1702680 - RNA, 22 nt, Homo sapiens
ucuuacauaauuuuuuauucaa

SEQ ID NO: 1702681 - RNA, 21 nt, Homo sapiens
ucuuacuaauguaaaaugauu

SEQ ID NO: 1702682 - RNA, 14 nt, Homo sapiens
ucuuacuacacuga

SEQ ID NO: 1702683 - RNA, 18 nt, Homo sapiens
ucuuauaauacucuguug

SEQ ID NO: 1702684 - RNA, 16 nt, Homo sapiens
ucuuaucucagucaug

SEQ ID NO: 1702685 - RNA, 12 nt, Homo sapiens
ucuuauugcaaa

SEQ ID NO: 1702686 - RNA, 14 nt, Homo sapiens
ucuucauacuuaaa

SEQ ID NO: 1702687 - RNA, 21 nt, Homo sapiens
ucuucauauucuaaaaccauu

SEQ ID NO: 1702688 - RNA, 13 nt, Homo sapiens
ucuucaugagcuu

SEQ ID NO: 1702689 - RNA, 11 nt, Homo sapiens
ucuucauggcc

SEQ ID NO: 1702690 - RNA, 11 nt, Homo sapiens
ucuuccaugac

SEQ ID NO: 1702691 - RNA, 15 nt, Homo sapiens
ucuucccuaccucag

SEQ ID NO: 1702692 - RNA, 15 nt, Homo sapiens
ucuucuaaacuuccc

SEQ ID NO: 1702693 - RNA, 14 nt, Homo sapiens
ucuucuccacugga

SEQ ID NO: 1702694 - RNA, 17 nt, Homo sapiens
ucuucuccuaugcauuu

SEQ ID NO: 1702695 - RNA, 23 nt, Homo sapiens
ucuucugacaaacuguguacaua

SEQ ID NO: 1702696 - RNA, 22 nt, Homo sapiens
ucuucuuuuggcuuccaugaug

SEQ ID NO: 1702697 - RNA, 23 nt, Homo sapiens
ucuugaaaaaugcccauuugccu

SEQ ID NO: 1702698 - RNA, 21 nt, Homo sapiens
ucuugaaauuaagaaggcaaa

SEQ ID NO: 1702699 - RNA, 15 nt, Homo sapiens
ucuugaauguggucu

SEQ ID NO: 1702700 - RNA, 14 nt, Homo sapiens
ucuuguauacacau

SEQ ID NO: 1702701 - RNA, 18 nt, Homo sapiens
ucuuguauacacauauau

SEQ ID NO: 1702702 - RNA, 13 nt, Homo sapiens
ucuugugcuggau

SEQ ID NO: 1702703 - RNA, 18 nt, Homo sapiens
ucuuguuuuaagugccuu

SEQ ID NO: 1702704 - RNA, 22 nt, Homo sapiens
ucuuguuuuuuuuuuccacuua

SEQ ID NO: 1702705 - RNA, 17 nt, Homo sapiens
ucuuuaaugucacaggc

SEQ ID NO: 1702706 - RNA, 20 nt, Homo sapiens
ucuuuacaaaacuacaugag

SEQ ID NO: 1702707 - RNA, 17 nt, Homo sapiens
ucuuuagcaugcuacag

SEQ ID NO: 1702708 - RNA, 16 nt, Homo sapiens
ucuuuagugcuuucuu

SEQ ID NO: 1702709 - RNA, 15 nt, Homo sapiens
ucuuuauagugcaca

SEQ ID NO: 1702710 - RNA, 16 nt, Homo sapiens
ucuuucaucucugcuu

SEQ ID NO: 1702711 - RNA, 12 nt, Homo sapiens
ucuuucucucag

SEQ ID NO: 1702712 - RNA, 21 nt, Homo sapiens
ucuuucucuccccaaccccca

SEQ ID NO: 1702713 - RNA, 13 nt, Homo sapiens
ucuuucuuucugc

SEQ ID NO: 1702714 - RNA, 20 nt, Homo sapiens
ucuuugaacccuugcuugca

SEQ ID NO: 1702715 - RNA, 18 nt, Homo sapiens
ucuuugagggacugccuc

SEQ ID NO: 1702716 - RNA, 17 nt, Homo sapiens
ucuuugucuuaucuggc

SEQ ID NO: 1702717 - RNA, 22 nt, Homo sapiens
ucuuuuacccggcacauucccc

SEQ ID NO: 1702718 - RNA, 14 nt, Homo sapiens
ucuuuucauucuca

SEQ ID NO: 1702719 - RNA, 19 nt, Homo sapiens
ucuuuuggggaagcuuucu

SEQ ID NO: 1702720 - RNA, 19 nt, Homo sapiens
ucuuuuuacauaacugccu

SEQ ID NO: 1702721 - RNA, 21 nt, Homo sapiens
ucuuuuuuaauaaacuacucu

SEQ ID NO: 1702722 - RNA, 17 nt, Homo sapiens
ugaaaaaaaguacaugu

SEQ ID NO: 1702723 - RNA, 22 nt, Homo sapiens
ugaaaaacagaaagcauccuaa

SEQ ID NO: 1702724 - RNA, 21 nt, Homo sapiens
ugaaaaaugguaauuguugcu

SEQ ID NO: 1702725 - RNA, 22 nt, Homo sapiens
ugaaaaaugguaauuguugcua

SEQ ID NO: 1702726 - RNA, 21 nt, Homo sapiens
ugaaaacauagcaucucagga

SEQ ID NO: 1702727 - RNA, 10 nt, Homo sapiens
ugaaaaccua

SEQ ID NO: 1702728 - RNA, 14 nt, Homo sapiens
ugaaaaccuacaua

SEQ ID NO: 1702729 - RNA, 16 nt, Homo sapiens
ugaaaaccuacauauu

SEQ ID NO: 1702730 - RNA, 22 nt, Homo sapiens
ugaaaagauucuucuguguuua

SEQ ID NO: 1702731 - RNA, 16 nt, Homo sapiens
ugaaaauaauguugua

SEQ ID NO: 1702732 - RNA, 14 nt, Homo sapiens
ugaaaaugaaugcu

SEQ ID NO: 1702733 - RNA, 20 nt, Homo sapiens
ugaaaauguuguuaugcuau

SEQ ID NO: 1702734 - RNA, 21 nt, Homo sapiens
ugaaacacucaguuguucaau

SEQ ID NO: 1702735 - RNA, 19 nt, Homo sapiens
ugaaacuacuacaaugaua

SEQ ID NO: 1702736 - RNA, 17 nt, Homo sapiens
ugaaacuaggguuugaa

SEQ ID NO: 1702737 - RNA, 14 nt, Homo sapiens
ugaaagaaccagag

SEQ ID NO: 1702738 - RNA, 15 nt, Homo sapiens
ugaaagaaccagaga

SEQ ID NO: 1702739 - RNA, 20 nt, Homo sapiens
ugaaagacaccauuuaucua

SEQ ID NO: 1702740 - RNA, 13 nt, Homo sapiens
ugaaagacacugu

SEQ ID NO: 1702741 - RNA, 22 nt, Homo sapiens
ugaaaggaagcuccacugucac

SEQ ID NO: 1702742 - RNA, 13 nt, Homo sapiens
ugaaagggcaaua

SEQ ID NO: 1702743 - RNA, 19 nt, Homo sapiens
ugaaaguagcagugugaag

SEQ ID NO: 1702744 - RNA, 19 nt, Homo sapiens
ugaaauaaaacuacauggu

SEQ ID NO: 1702745 - RNA, 17 nt, Homo sapiens
ugaaauagacuaagaua

SEQ ID NO: 1702746 - RNA, 20 nt, Homo sapiens
ugaaaugagcaccuccauua

SEQ ID NO: 1702747 - RNA, 16 nt, Homo sapiens
ugaaaugcuggcauuu

SEQ ID NO: 1702748 - RNA, 19 nt, Homo sapiens
ugaaaugcuggcauuugca

SEQ ID NO: 1702749 - RNA, 22 nt, Homo sapiens
ugaaauguaggcaucaugcaug

SEQ ID NO: 1702750 - RNA, 23 nt, Homo sapiens
ugaaauucuuucagcuaucagua

SEQ ID NO: 1702751 - RNA, 15 nt, Homo sapiens
ugaacaaacuaaagg

SEQ ID NO: 1702752 - RNA, 20 nt, Homo sapiens
ugaacacucuuuugcuuuau

SEQ ID NO: 1702753 - RNA, 21 nt, Homo sapiens
ugaacacucuuuugcuuuauu

SEQ ID NO: 1702754 - RNA, 11 nt, Homo sapiens
ugaacauuuca

SEQ ID NO: 1702755 - RNA, 14 nt, Homo sapiens
ugaaccgcacagcu

SEQ ID NO: 1702756 - RNA, 10 nt, Homo sapiens
ugaaccuaau

SEQ ID NO: 1702757 - RNA, 14 nt, Homo sapiens
ugaacuaaugauaa

SEQ ID NO: 1702758 - RNA, 20 nt, Homo sapiens
ugaacuucuuugaauuuacu

SEQ ID NO: 1702759 - RNA, 15 nt, Homo sapiens
ugaagacacacucag

SEQ ID NO: 1702760 - RNA, 14 nt, Homo sapiens
ugaagagagauaua

SEQ ID NO: 1702761 - RNA, 20 nt, Homo sapiens
ugaagagugacuaguacaaa

SEQ ID NO: 1702762 - RNA, 10 nt, Homo sapiens
ugaagccagc

SEQ ID NO: 1702763 - RNA, 22 nt, Homo sapiens
ugaagccagcugcaggaaucaa

SEQ ID NO: 1702764 - RNA, 17 nt, Homo sapiens
ugaagccucagcuaccc

SEQ ID NO: 1702765 - RNA, 15 nt, Homo sapiens
ugaagcuaauaauuc

SEQ ID NO: 1702766 - RNA, 15 nt, Homo sapiens
ugaaggaacauuccu

SEQ ID NO: 1702767 - RNA, 18 nt, Homo sapiens
ugaaggaacauuccuuag

SEQ ID NO: 1702768 - RNA, 13 nt, Homo sapiens
ugaaggugauuca

SEQ ID NO: 1702769 - RNA, 20 nt, Homo sapiens
ugaagguuuuaagugguuug

SEQ ID NO: 1702770 - RNA, 17 nt, Homo sapiens
ugaaguacaauaauuca

SEQ ID NO: 1702771 - RNA, 13 nt, Homo sapiens
ugaaguagaaucc

SEQ ID NO: 1702772 - RNA, 15 nt, Homo sapiens
ugaagucacacagug

SEQ ID NO: 1702773 - RNA, 21 nt, Homo sapiens
ugaagugaaugaaacacucag

SEQ ID NO: 1702774 - RNA, 15 nt, Homo sapiens
ugaauaaaguguaag

SEQ ID NO: 1702775 - RNA, 22 nt, Homo sapiens
ugaauaaaguguaaguucacaa

SEQ ID NO: 1702776 - RNA, 14 nt, Homo sapiens
ugaauacuugcuau

SEQ ID NO: 1702777 - RNA, 21 nt, Homo sapiens
ugaauauaaaugggaaaucag

SEQ ID NO: 1702778 - RNA, 15 nt, Homo sapiens
ugaauauuacuccua

SEQ ID NO: 1702779 - RNA, 18 nt, Homo sapiens
ugaaucgagugagacaaa

SEQ ID NO: 1702780 - RNA, 20 nt, Homo sapiens
ugaaugaacacucuuuugcu

SEQ ID NO: 1702781 - RNA, 21 nt, Homo sapiens
ugaaugacacgccuaagguca

SEQ ID NO: 1702782 - RNA, 15 nt, Homo sapiens
ugaaugauacccuga

SEQ ID NO: 1702783 - RNA, 16 nt, Homo sapiens
ugaaugcugccacaac

SEQ ID NO: 1702784 - RNA, 13 nt, Homo sapiens
ugaaugcugccag

SEQ ID NO: 1702785 - RNA, 15 nt, Homo sapiens
ugaauguggacucaa

SEQ ID NO: 1702786 - RNA, 13 nt, Homo sapiens
ugaauguuuccaa

SEQ ID NO: 1702787 - RNA, 21 nt, Homo sapiens
ugaauucuaccuuuaaggguu

SEQ ID NO: 1702788 - RNA, 15 nt, Homo sapiens
ugaauucuuaugcuu

SEQ ID NO: 1702789 - RNA, 15 nt, Homo sapiens
ugaauuucuaaaaaa

SEQ ID NO: 1702790 - RNA, 21 nt, Homo sapiens
ugaauuuggccugcacuaauu

SEQ ID NO: 1702791 - RNA, 14 nt, Homo sapiens
ugaauuuucccuga

SEQ ID NO: 1702792 - RNA, 12 nt, Homo sapiens
ugacaaaccauc

SEQ ID NO: 1702793 - RNA, 12 nt, Homo sapiens
ugacaaccucuu

SEQ ID NO: 1702794 - RNA, 15 nt, Homo sapiens
ugacaaggagcacaa

SEQ ID NO: 1702795 - RNA, 16 nt, Homo sapiens
ugacaaugaagugaca

SEQ ID NO: 1702796 - RNA, 19 nt, Homo sapiens
ugacaaugaagugacacuu

SEQ ID NO: 1702797 - RNA, 14 nt, Homo sapiens
ugacacaauuggaa

SEQ ID NO: 1702798 - RNA, 12 nt, Homo sapiens
ugacacuauuca

SEQ ID NO: 1702799 - RNA, 16 nt, Homo sapiens
ugacagaaaaguaaug

SEQ ID NO: 1702800 - RNA, 12 nt, Homo sapiens
ugacagaacaag

SEQ ID NO: 1702801 - RNA, 18 nt, Homo sapiens
ugacagaagcuucugccc

SEQ ID NO: 1702802 - RNA, 12 nt, Homo sapiens
ugacagccuccc

SEQ ID NO: 1702803 - RNA, 17 nt, Homo sapiens
ugacagggaaaacugca

SEQ ID NO: 1702804 - RNA, 16 nt, Homo sapiens
ugacauaacagugcag

SEQ ID NO: 1702805 - RNA, 14 nt, Homo sapiens
ugacaucacagcag

SEQ ID NO: 1702806 - RNA, 15 nt, Homo sapiens
ugacaucacagcagc

SEQ ID NO: 1702807 - RNA, 23 nt, Homo sapiens
ugacauucacccuucaacauaaa

SEQ ID NO: 1702808 - RNA, 23 nt, Homo sapiens
ugacauugcguuugaccuuuuau

SEQ ID NO: 1702809 - RNA, 19 nt, Homo sapiens
ugaccaauugugcugccau

SEQ ID NO: 1702810 - RNA, 18 nt, Homo sapiens
ugaccacgucaucgggcc

SEQ ID NO: 1702811 - RNA, 14 nt, Homo sapiens
ugaccccuccucac

SEQ ID NO: 1702812 - RNA, 15 nt, Homo sapiens
ugacccugaugaaaa

SEQ ID NO: 1702813 - RNA, 14 nt, Homo sapiens
ugaccucacaguga

SEQ ID NO: 1702814 - RNA, 14 nt, Homo sapiens
ugaccucaggugau

SEQ ID NO: 1702815 - RNA, 22 nt, Homo sapiens
ugaccuggccagagccaagaaa

SEQ ID NO: 1702816 - RNA, 21 nt, Homo sapiens
ugacggcccucaucuaugagg

SEQ ID NO: 1702817 - RNA, 15 nt, Homo sapiens
ugacggcccugcaau

SEQ ID NO: 1702818 - RNA, 14 nt, Homo sapiens
ugacucagaauauu

SEQ ID NO: 1702819 - RNA, 22 nt, Homo sapiens
ugacuccacgauccugccaccc

SEQ ID NO: 1702820 - RNA, 18 nt, Homo sapiens
ugacucccaaguuuccau

SEQ ID NO: 1702821 - RNA, 19 nt, Homo sapiens
ugacugaagugaacuauga

SEQ ID NO: 1702822 - RNA, 17 nt, Homo sapiens
ugacuguaucuguguag

SEQ ID NO: 1702823 - RNA, 15 nt, Homo sapiens
ugacuuaaccauaua

SEQ ID NO: 1702824 - RNA, 14 nt, Homo sapiens
ugacuucaaugaua

SEQ ID NO: 1702825 - RNA, 19 nt, Homo sapiens
ugacuucuccaggucucac

SEQ ID NO: 1702826 - RNA, 20 nt, Homo sapiens
ugacuugugguugaauuaaa

SEQ ID NO: 1702827 - RNA, 19 nt, Homo sapiens
ugacuuguuugucuuccau

SEQ ID NO: 1702828 - RNA, 21 nt, Homo sapiens
ugacuuuauauggaugauuca

SEQ ID NO: 1702829 - RNA, 20 nt, Homo sapiens
ugacuuucaguaaacauaaa

SEQ ID NO: 1702830 - RNA, 20 nt, Homo sapiens
ugagaaauauggacacuuaa

SEQ ID NO: 1702831 - RNA, 16 nt, Homo sapiens
ugagaaauuucuguga

SEQ ID NO: 1702832 - RNA, 13 nt, Homo sapiens
ugagaacuccuga

SEQ ID NO: 1702833 - RNA, 14 nt, Homo sapiens
ugagaacuuuccau

SEQ ID NO: 1702834 - RNA, 16 nt, Homo sapiens
ugagaaggaacuucca

SEQ ID NO: 1702835 - RNA, 18 nt, Homo sapiens
ugagaaggagucagaaac

SEQ ID NO: 1702836 - RNA, 20 nt, Homo sapiens
ugagaaggcagccaccagcg

SEQ ID NO: 1702837 - RNA, 21 nt, Homo sapiens
ugagaaggguugauccugcau

SEQ ID NO: 1702838 - RNA, 14 nt, Homo sapiens
ugagacauguguca

SEQ ID NO: 1702839 - RNA, 18 nt, Homo sapiens
ugagacccuggugccugg

SEQ ID NO: 1702840 - RNA, 17 nt, Homo sapiens
ugagacucuagggucca

SEQ ID NO: 1702841 - RNA, 23 nt, Homo sapiens
ugagacucuaggguccaguggau

SEQ ID NO: 1702842 - RNA, 16 nt, Homo sapiens
ugagaggaagccugag

SEQ ID NO: 1702843 - RNA, 18 nt, Homo sapiens
ugagaggggaacagacug

SEQ ID NO: 1702844 - RNA, 17 nt, Homo sapiens
ugagaugcguuguuaca

SEQ ID NO: 1702845 - RNA, 23 nt, Homo sapiens
ugagauuaugaugaaaaccuaca

SEQ ID NO: 1702846 - RNA, 20 nt, Homo sapiens
ugagauuuaccagggaugua

SEQ ID NO: 1702847 - RNA, 18 nt, Homo sapiens
ugagauuucuuaaauaau

SEQ ID NO: 1702848 - RNA, 15 nt, Homo sapiens
ugagcagaagaucaa

SEQ ID NO: 1702849 - RNA, 18 nt, Homo sapiens
ugagccaguuagacuagu

SEQ ID NO: 1702850 - RNA, 20 nt, Homo sapiens
ugagccccuggaggcacuga

SEQ ID NO: 1702851 - RNA, 21 nt, Homo sapiens
ugagccccuggaggcacugaa

SEQ ID NO: 1702852 - RNA, 21 nt, Homo sapiens
ugagccuggcccauagaaaca

SEQ ID NO: 1702853 - RNA, 16 nt, Homo sapiens
ugagcgccugugcaca

SEQ ID NO: 1702854 - RNA, 18 nt, Homo sapiens
ugagcuauugcuguucuc

SEQ ID NO: 1702855 - RNA, 14 nt, Homo sapiens
ugagcucaaaguac

SEQ ID NO: 1702856 - RNA, 16 nt, Homo sapiens
ugagcucaaaguacua

SEQ ID NO: 1702857 - RNA, 14 nt, Homo sapiens
ugagcuggggaccu

SEQ ID NO: 1702858 - RNA, 18 nt, Homo sapiens
ugaggaaaugauccccaa

SEQ ID NO: 1702859 - RNA, 16 nt, Homo sapiens
ugaggaaggaacagca

SEQ ID NO: 1702860 - RNA, 16 nt, Homo sapiens
ugaggcccugcccaau

SEQ ID NO: 1702861 - RNA, 15 nt, Homo sapiens
ugagggaaaaugagu

SEQ ID NO: 1702862 - RNA, 15 nt, Homo sapiens
ugagggccgcuuuga

SEQ ID NO: 1702863 - RNA, 11 nt, Homo sapiens
ugagggucccc

SEQ ID NO: 1702864 - RNA, 23 nt, Homo sapiens
ugaguaaauauugaggcuuugug

SEQ ID NO: 1702865 - RNA, 13 nt, Homo sapiens
ugaguagggacuc

SEQ ID NO: 1702866 - RNA, 17 nt, Homo sapiens
ugaguagggacucaggg

SEQ ID NO: 1702867 - RNA, 19 nt, Homo sapiens
ugaguaucuguauguauau

SEQ ID NO: 1702868 - RNA, 24 nt, Homo sapiens
ugagucccccagagaugucaucag

SEQ ID NO: 1702869 - RNA, 20 nt, Homo sapiens
ugagucuuugguucuaagga

SEQ ID NO: 1702870 - RNA, 17 nt, Homo sapiens
ugagugucuuagcauau

SEQ ID NO: 1702871 - RNA, 14 nt, Homo sapiens
ugaguucuacauaa

SEQ ID NO: 1702872 - RNA, 17 nt, Homo sapiens
ugaguucuauaauauaa

SEQ ID NO: 1702873 - RNA, 18 nt, Homo sapiens
ugaguuugcuguuugcaa

SEQ ID NO: 1702874 - RNA, 17 nt, Homo sapiens
ugauaaaugauagacaa

SEQ ID NO: 1702875 - RNA, 14 nt, Homo sapiens
ugauaacucaggaa

SEQ ID NO: 1702876 - RNA, 16 nt, Homo sapiens
ugauaaugcagacuuc

SEQ ID NO: 1702877 - RNA, 14 nt, Homo sapiens
ugauacauaacuaa

SEQ ID NO: 1702878 - RNA, 15 nt, Homo sapiens
ugauacauaacuaaa

SEQ ID NO: 1702879 - RNA, 21 nt, Homo sapiens
ugauacauaacuaaauuugau

SEQ ID NO: 1702880 - RNA, 23 nt, Homo sapiens
ugauacauuuaagguauauugcu

SEQ ID NO: 1702881 - RNA, 16 nt, Homo sapiens
ugauacugcagugacu

SEQ ID NO: 1702882 - RNA, 19 nt, Homo sapiens
ugauaucuauaguagacac

SEQ ID NO: 1702883 - RNA, 14 nt, Homo sapiens
ugauaugaguauac

SEQ ID NO: 1702884 - RNA, 17 nt, Homo sapiens
ugauccugcaucugggu

SEQ ID NO: 1702885 - RNA, 13 nt, Homo sapiens
ugaucuuacucac

SEQ ID NO: 1702886 - RNA, 14 nt, Homo sapiens
ugaucuuugcagac

SEQ ID NO: 1702887 - RNA, 20 nt, Homo sapiens
ugaugaaaaccuacauauuc

SEQ ID NO: 1702888 - RNA, 23 nt, Homo sapiens
ugaugaaauaaaacuacaugguc

SEQ ID NO: 1702889 - RNA, 16 nt, Homo sapiens
ugaugagaauuucuaa

SEQ ID NO: 1702890 - RNA, 13 nt, Homo sapiens
ugaugaucuuugc

SEQ ID NO: 1702891 - RNA, 19 nt, Homo sapiens
ugaugccaauacuagucac

SEQ ID NO: 1702892 - RNA, 15 nt, Homo sapiens
ugaugccauucuucc

SEQ ID NO: 1702893 - RNA, 19 nt, Homo sapiens
ugaugcuuagauguuccag

SEQ ID NO: 1702894 - RNA, 15 nt, Homo sapiens
ugauggcaccacugc

SEQ ID NO: 1702895 - RNA, 14 nt, Homo sapiens
ugaugguugcaaaa

SEQ ID NO: 1702896 - RNA, 23 nt, Homo sapiens
ugauguauaaagcaacuguuaug

SEQ ID NO: 1702897 - RNA, 15 nt, Homo sapiens
ugaugucagauuugg

SEQ ID NO: 1702898 - RNA, 19 nt, Homo sapiens
ugaugugaaacacuuugcc

SEQ ID NO: 1702899 - RNA, 16 nt, Homo sapiens
ugauguguccucaggg

SEQ ID NO: 1702900 - RNA, 14 nt, Homo sapiens
ugauguucuaaggc

SEQ ID NO: 1702901 - RNA, 17 nt, Homo sapiens
ugauguuucacauaaaa

SEQ ID NO: 1702902 - RNA, 15 nt, Homo sapiens
ugauuaaaacauuau

SEQ ID NO: 1702903 - RNA, 13 nt, Homo sapiens
ugauuaacuuauu

SEQ ID NO: 1702904 - RNA, 23 nt, Homo sapiens
ugauucaaaagaugccauucaua

SEQ ID NO: 1702905 - RNA, 19 nt, Homo sapiens
ugauucauaguaacuucuu

SEQ ID NO: 1702906 - RNA, 22 nt, Homo sapiens
ugauucuccugccucagccucc

SEQ ID NO: 1702907 - RNA, 23 nt, Homo sapiens
ugauugagaagaggacauuggag

SEQ ID NO: 1702908 - RNA, 23 nt, Homo sapiens
ugauuggaccaggccauucugcc

SEQ ID NO: 1702909 - RNA, 12 nt, Homo sapiens
ugauuucuugcu

SEQ ID NO: 1702910 - RNA, 19 nt, Homo sapiens
ugauuuuacuuaacucauu

SEQ ID NO: 1702911 - RNA, 14 nt, Homo sapiens
ugauuuuuacuuca

SEQ ID NO: 1702912 - RNA, 16 nt, Homo sapiens
ugcaaaacacuaaaga

SEQ ID NO: 1702913 - RNA, 17 nt, Homo sapiens
ugcaaaacauaucuuga

SEQ ID NO: 1702914 - RNA, 22 nt, Homo sapiens
ugcaaacccgaaaauaaaagac

SEQ ID NO: 1702915 - RNA, 17 nt, Homo sapiens
ugcaaaucaaacauauu

SEQ ID NO: 1702916 - RNA, 18 nt, Homo sapiens
ugcaagagugauugcagc

SEQ ID NO: 1702917 - RNA, 17 nt, Homo sapiens
ugcacaaagcccuucca

SEQ ID NO: 1702918 - RNA, 9 nt, Homo sapiens
ugcacacaa

SEQ ID NO: 1702919 - RNA, 23 nt, Homo sapiens
ugcacacacacacacaugcacac

SEQ ID NO: 1702920 - RNA, 16 nt, Homo sapiens
ugcacacucacuugua

SEQ ID NO: 1702921 - RNA, 21 nt, Homo sapiens
ugcacacucacuuguaagaaa

SEQ ID NO: 1702922 - RNA, 15 nt, Homo sapiens
ugcacacugcacugu

SEQ ID NO: 1702923 - RNA, 22 nt, Homo sapiens
ugcacauauggacucugcacau

SEQ ID NO: 1702924 - RNA, 20 nt, Homo sapiens
ugcacauccauucccaagaa

SEQ ID NO: 1702925 - RNA, 15 nt, Homo sapiens
ugcaccaggcacugc

SEQ ID NO: 1702926 - RNA, 18 nt, Homo sapiens
ugcaccuguaaagugccu

SEQ ID NO: 1702927 - RNA, 20 nt, Homo sapiens
ugcaccuuaccaacuuucug

SEQ ID NO: 1702928 - RNA, 19 nt, Homo sapiens
ugcacuaaagccagccuga

SEQ ID NO: 1702929 - RNA, 23 nt, Homo sapiens
ugcacuaaaucagagacaaaaua

SEQ ID NO: 1702930 - RNA, 20 nt, Homo sapiens
ugcacuccagcuugggcaac

SEQ ID NO: 1702931 - RNA, 16 nt, Homo sapiens
ugcacuguccugacca

SEQ ID NO: 1702932 - RNA, 15 nt, Homo sapiens
ugcacuuauucaaua

SEQ ID NO: 1702933 - RNA, 18 nt, Homo sapiens
ugcagaauccaaaguaaa

SEQ ID NO: 1702934 - RNA, 21 nt, Homo sapiens
ugcagacagaagucuccucaa

SEQ ID NO: 1702935 - RNA, 21 nt, Homo sapiens
ugcagaggauaaggaggcacu

SEQ ID NO: 1702936 - RNA, 13 nt, Homo sapiens
ugcagccagcuca

SEQ ID NO: 1702937 - RNA, 19 nt, Homo sapiens
ugcagcccagaauagcuuu

SEQ ID NO: 1702938 - RNA, 14 nt, Homo sapiens
ugcagcccaugccc

SEQ ID NO: 1702939 - RNA, 16 nt, Homo sapiens
ugcagccucaaccucc

SEQ ID NO: 1702940 - RNA, 15 nt, Homo sapiens
ugcagcucaacuuuc

SEQ ID NO: 1702941 - RNA, 16 nt, Homo sapiens
ugcagggccagccacu

SEQ ID NO: 1702942 - RNA, 21 nt, Homo sapiens
ugcaggggugacggcccucau

SEQ ID NO: 1702943 - RNA, 18 nt, Homo sapiens
ugcagugguaugaucacg

SEQ ID NO: 1702944 - RNA, 18 nt, Homo sapiens
ugcaguucagcaccaccc

SEQ ID NO: 1702945 - RNA, 13 nt, Homo sapiens
ugcauaugaaauc

SEQ ID NO: 1702946 - RNA, 17 nt, Homo sapiens
ugcauaugucacuagaa

SEQ ID NO: 1702947 - RNA, 19 nt, Homo sapiens
ugcaugacuuguagcauau

SEQ ID NO: 1702948 - RNA, 19 nt, Homo sapiens
ugcauguaccauuugcaug

SEQ ID NO: 1702949 - RNA, 19 nt, Homo sapiens
ugcauuagcacagauuuua

SEQ ID NO: 1702950 - RNA, 22 nt, Homo sapiens
ugcauuucauaaacuaauagaa

SEQ ID NO: 1702951 - RNA, 20 nt, Homo sapiens
ugccaaaucuggcuccuuua

SEQ ID NO: 1702952 - RNA, 16 nt, Homo sapiens
ugccaagacaaaucaa

SEQ ID NO: 1702953 - RNA, 17 nt, Homo sapiens
ugccaccacugggcaaa

SEQ ID NO: 1702954 - RNA, 20 nt, Homo sapiens
ugccaccauggccagccaac

SEQ ID NO: 1702955 - RNA, 11 nt, Homo sapiens
ugccacuaauu

SEQ ID NO: 1702956 - RNA, 15 nt, Homo sapiens
ugccacuggggaaaa

SEQ ID NO: 1702957 - RNA, 15 nt, Homo sapiens
ugccacuuugcacau

SEQ ID NO: 1702958 - RNA, 23 nt, Homo sapiens
ugccaucaccauacacaguggca

SEQ ID NO: 1702959 - RNA, 15 nt, Homo sapiens
ugccauggggccauc

SEQ ID NO: 1702960 - RNA, 16 nt, Homo sapiens
ugccaugugugcugaa

SEQ ID NO: 1702961 - RNA, 21 nt, Homo sapiens
ugcccaaccugcucuccucuu

SEQ ID NO: 1702962 - RNA, 22 nt, Homo sapiens
ugcccaauuagggccuagccuu

SEQ ID NO: 1702963 - RNA, 15 nt, Homo sapiens
ugcccacucccgcca

SEQ ID NO: 1702964 - RNA, 20 nt, Homo sapiens
ugcccacucuccauccuccc

SEQ ID NO: 1702965 - RNA, 12 nt, Homo sapiens
ugcccagaucaa

SEQ ID NO: 1702966 - RNA, 18 nt, Homo sapiens
ugcccaggaccaucuucc

SEQ ID NO: 1702967 - RNA, 19 nt, Homo sapiens
ugcccaggaccaucuuccc

SEQ ID NO: 1702968 - RNA, 17 nt, Homo sapiens
ugcccaggcuggucuca

SEQ ID NO: 1702969 - RNA, 15 nt, Homo sapiens
ugccccagagcuguu

SEQ ID NO: 1702970 - RNA, 17 nt, Homo sapiens
ugccccccaugaggaag

SEQ ID NO: 1702971 - RNA, 23 nt, Homo sapiens
ugccccuauagaaacaccaguac

SEQ ID NO: 1702972 - RNA, 14 nt, Homo sapiens
ugccccucucacca

SEQ ID NO: 1702973 - RNA, 12 nt, Homo sapiens
ugccccugccuu

SEQ ID NO: 1702974 - RNA, 24 nt, Homo sapiens
ugcccguucuugaaauguaggcau

SEQ ID NO: 1702975 - RNA, 17 nt, Homo sapiens
ugcccugaguccaagag

SEQ ID NO: 1702976 - RNA, 22 nt, Homo sapiens
ugccgaaccaaaagaauuugca

SEQ ID NO: 1702977 - RNA, 17 nt, Homo sapiens
ugccguaacaacugugg

SEQ ID NO: 1702978 - RNA, 22 nt, Homo sapiens
ugccucagccucccaaagugcu

SEQ ID NO: 1702979 - RNA, 18 nt, Homo sapiens
ugccucagccucccgagu

SEQ ID NO: 1702980 - RNA, 23 nt, Homo sapiens
ugccucgaggacugauacugcag

SEQ ID NO: 1702981 - RNA, 18 nt, Homo sapiens
ugccucugacacacagcu

SEQ ID NO: 1702982 - RNA, 20 nt, Homo sapiens
ugccugccccccucaucuca

SEQ ID NO: 1702983 - RNA, 15 nt, Homo sapiens
ugccuggacacugua

SEQ ID NO: 1702984 - RNA, 16 nt, Homo sapiens
ugccuggacacuguac

SEQ ID NO: 1702985 - RNA, 20 nt, Homo sapiens
ugccuggccaggcagaucug

SEQ ID NO: 1702986 - RNA, 13 nt, Homo sapiens
ugccuggugaaug

SEQ ID NO: 1702987 - RNA, 20 nt, Homo sapiens
ugccugugguuaacaucuca

SEQ ID NO: 1702988 - RNA, 15 nt, Homo sapiens
ugccuuaaaauggaa

SEQ ID NO: 1702989 - RNA, 14 nt, Homo sapiens
ugccuucucaggaa

SEQ ID NO: 1702990 - RNA, 21 nt, Homo sapiens
ugcgaucuggguucacugcaa

SEQ ID NO: 1702991 - RNA, 14 nt, Homo sapiens
ugcgcucuguggau

SEQ ID NO: 1702992 - RNA, 11 nt, Homo sapiens
ugcggccaaga

SEQ ID NO: 1702993 - RNA, 18 nt, Homo sapiens
ugcggggggcaccagagg

SEQ ID NO: 1702994 - RNA, 20 nt, Homo sapiens
ugcgugcucccgaugcugcu

SEQ ID NO: 1702995 - RNA, 16 nt, Homo sapiens
ugcguggacucugcac

SEQ ID NO: 1702996 - RNA, 21 nt, Homo sapiens
ugcguggugcucuuugcugca

SEQ ID NO: 1702997 - RNA, 23 nt, Homo sapiens
ugcguuacacccuuucuugacaa

SEQ ID NO: 1702998 - RNA, 12 nt, Homo sapiens
ugcuaacaaugc

SEQ ID NO: 1702999 - RNA, 22 nt, Homo sapiens
ugcuaagcaagcuaaccuuauc

SEQ ID NO: 1703000 - RNA, 17 nt, Homo sapiens
ugcuacacauacaggau

SEQ ID NO: 1703001 - RNA, 20 nt, Homo sapiens
ugcuacaguuauuaaucugg

SEQ ID NO: 1703002 - RNA, 20 nt, Homo sapiens
ugcuacccugaguucaucca

SEQ ID NO: 1703003 - RNA, 14 nt, Homo sapiens
ugcuaggucucgga

SEQ ID NO: 1703004 - RNA, 16 nt, Homo sapiens
ugcuaugaaugauacc

SEQ ID NO: 1703005 - RNA, 11 nt, Homo sapiens
ugcuauggaag

SEQ ID NO: 1703006 - RNA, 19 nt, Homo sapiens
ugcuauuuauuuuccuaaa

SEQ ID NO: 1703007 - RNA, 19 nt, Homo sapiens
ugcucacauaucugucauu

SEQ ID NO: 1703008 - RNA, 20 nt, Homo sapiens
ugcucaccaugcuuccagcu

SEQ ID NO: 1703009 - RNA, 16 nt, Homo sapiens
ugcuccgcugcuccuu

SEQ ID NO: 1703010 - RNA, 18 nt, Homo sapiens
ugcucuccaagucucagu

SEQ ID NO: 1703011 - RNA, 15 nt, Homo sapiens
ugcucuuugcugcac

SEQ ID NO: 1703012 - RNA, 18 nt, Homo sapiens
ugcucuuugcugcacuau

SEQ ID NO: 1703013 - RNA, 13 nt, Homo sapiens
ugcugaaaaagua

SEQ ID NO: 1703014 - RNA, 17 nt, Homo sapiens
ugcugaaaaaucaucca

SEQ ID NO: 1703015 - RNA, 13 nt, Homo sapiens
ugcugaagggcag

SEQ ID NO: 1703016 - RNA, 14 nt, Homo sapiens
ugcugaccaauugu

SEQ ID NO: 1703017 - RNA, 19 nt, Homo sapiens
ugcugaccucccagugacc

SEQ ID NO: 1703018 - RNA, 17 nt, Homo sapiens
ugcugaggcucugaccc

SEQ ID NO: 1703019 - RNA, 19 nt, Homo sapiens
ugcugagugaaugaacaaa

SEQ ID NO: 1703020 - RNA, 16 nt, Homo sapiens
ugcugauugaagacac

SEQ ID NO: 1703021 - RNA, 23 nt, Homo sapiens
ugcugcacagaaauuuucaauuu

SEQ ID NO: 1703022 - RNA, 17 nt, Homo sapiens
ugcugcaccuggucaua

SEQ ID NO: 1703023 - RNA, 18 nt, Homo sapiens
ugcugcaucuuauagcac

SEQ ID NO: 1703024 - RNA, 14 nt, Homo sapiens
ugcugcuccucuag

SEQ ID NO: 1703025 - RNA, 14 nt, Homo sapiens
ugcugcuuagcuug

SEQ ID NO: 1703026 - RNA, 13 nt, Homo sapiens
ugcuggacuugcc

SEQ ID NO: 1703027 - RNA, 19 nt, Homo sapiens
ugcuggacuugccuaaaau

SEQ ID NO: 1703028 - RNA, 18 nt, Homo sapiens
ugcuggcagccauggcca

SEQ ID NO: 1703029 - RNA, 20 nt, Homo sapiens
ugcuguccugaucugugaua

SEQ ID NO: 1703030 - RNA, 13 nt, Homo sapiens
ugcuuaagccauc

SEQ ID NO: 1703031 - RNA, 19 nt, Homo sapiens
ugcuuagacauaacaaaac

SEQ ID NO: 1703032 - RNA, 14 nt, Homo sapiens
ugcuuaguaucuca

SEQ ID NO: 1703033 - RNA, 18 nt, Homo sapiens
ugcuuaguaucucaucaa

SEQ ID NO: 1703034 - RNA, 19 nt, Homo sapiens
ugcuucacaguagagccag

SEQ ID NO: 1703035 - RNA, 16 nt, Homo sapiens
ugcuucaguacuugug

SEQ ID NO: 1703036 - RNA, 17 nt, Homo sapiens
ugcuucaguacuuguga

SEQ ID NO: 1703037 - RNA, 18 nt, Homo sapiens
ugcuugaacccaagaggu

SEQ ID NO: 1703038 - RNA, 14 nt, Homo sapiens
ugcuugaaccuggg

SEQ ID NO: 1703039 - RNA, 18 nt, Homo sapiens
ugcuuuagcacaggacaa

SEQ ID NO: 1703040 - RNA, 17 nt, Homo sapiens
ugcuuucaugaccaucc

SEQ ID NO: 1703041 - RNA, 22 nt, Homo sapiens
ugcuuugggauuuaauuuccag

SEQ ID NO: 1703042 - RNA, 14 nt, Homo sapiens
ugcuuuuaaaugca

SEQ ID NO: 1703043 - RNA, 14 nt, Homo sapiens
ugcuuuucaggguu

SEQ ID NO: 1703044 - RNA, 16 nt, Homo sapiens
uggaaaaagucacauu

SEQ ID NO: 1703045 - RNA, 16 nt, Homo sapiens
uggaaaccucuacaua

SEQ ID NO: 1703046 - RNA, 14 nt, Homo sapiens
uggaaagcugcuuc

SEQ ID NO: 1703047 - RNA, 18 nt, Homo sapiens
uggaacauauagaaugca

SEQ ID NO: 1703048 - RNA, 20 nt, Homo sapiens
uggaacauauagaaugcaga

SEQ ID NO: 1703049 - RNA, 16 nt, Homo sapiens
uggaacauccuuugca

SEQ ID NO: 1703050 - RNA, 14 nt, Homo sapiens
uggaaccuugcugu

SEQ ID NO: 1703051 - RNA, 16 nt, Homo sapiens
uggaacuguacacuug

SEQ ID NO: 1703052 - RNA, 16 nt, Homo sapiens
uggaagaggaacagca

SEQ ID NO: 1703053 - RNA, 17 nt, Homo sapiens
uggaagaggaacagcac

SEQ ID NO: 1703054 - RNA, 17 nt, Homo sapiens
uggaagaguaguaauag

SEQ ID NO: 1703055 - RNA, 20 nt, Homo sapiens
uggaagaguguuucuuccac

SEQ ID NO: 1703056 - RNA, 15 nt, Homo sapiens
uggaagcacagcuuc

SEQ ID NO: 1703057 - RNA, 18 nt, Homo sapiens
uggaagcuaauuugcauu

SEQ ID NO: 1703058 - RNA, 15 nt, Homo sapiens
uggaagcucugaagu

SEQ ID NO: 1703059 - RNA, 17 nt, Homo sapiens
uggaagcucugaaguca

SEQ ID NO: 1703060 - RNA, 14 nt, Homo sapiens
uggaaggugcuacu

SEQ ID NO: 1703061 - RNA, 23 nt, Homo sapiens
uggaaguccuugcccacuuccca

SEQ ID NO: 1703062 - RNA, 15 nt, Homo sapiens
uggaauaacucugug

SEQ ID NO: 1703063 - RNA, 16 nt, Homo sapiens
uggaaugcuguguuaa

SEQ ID NO: 1703064 - RNA, 17 nt, Homo sapiens
uggaauugcagcuguac

SEQ ID NO: 1703065 - RNA, 21 nt, Homo sapiens
uggaauugcagcuguacugag

SEQ ID NO: 1703066 - RNA, 14 nt, Homo sapiens
uggaauugcucaag

SEQ ID NO: 1703067 - RNA, 22 nt, Homo sapiens
uggacaaucaugaaauaugcau

SEQ ID NO: 1703068 - RNA, 10 nt, Homo sapiens
uggacacugu

SEQ ID NO: 1703069 - RNA, 16 nt, Homo sapiens
uggacagacagccacc

SEQ ID NO: 1703070 - RNA, 22 nt, Homo sapiens
uggacaggaggcccccaucuau

SEQ ID NO: 1703071 - RNA, 16 nt, Homo sapiens
uggacaggcucugcuu

SEQ ID NO: 1703072 - RNA, 23 nt, Homo sapiens
uggacagucacugccacuuugca

SEQ ID NO: 1703073 - RNA, 14 nt, Homo sapiens
uggacauuugccuu

SEQ ID NO: 1703074 - RNA, 19 nt, Homo sapiens
uggaccacuguuucuugcu

SEQ ID NO: 1703075 - RNA, 14 nt, Homo sapiens
uggaccaggccauu

SEQ ID NO: 1703076 - RNA, 21 nt, Homo sapiens
uggaccugcccugggccacac

SEQ ID NO: 1703077 - RNA, 15 nt, Homo sapiens
uggacucaaucccua

SEQ ID NO: 1703078 - RNA, 18 nt, Homo sapiens
uggacucuaaagaccaaa

SEQ ID NO: 1703079 - RNA, 15 nt, Homo sapiens
uggacucugcacaug

SEQ ID NO: 1703080 - RNA, 11 nt, Homo sapiens
uggacugggag

SEQ ID NO: 1703081 - RNA, 15 nt, Homo sapiens
uggacugucauagaa

SEQ ID NO: 1703082 - RNA, 21 nt, Homo sapiens
uggacuguggcacuugccugg

SEQ ID NO: 1703083 - RNA, 21 nt, Homo sapiens
uggagacccaccccaccugca

SEQ ID NO: 1703084 - RNA, 18 nt, Homo sapiens
uggagacccugcaaacag

SEQ ID NO: 1703085 - RNA, 12 nt, Homo sapiens
uggagacugaca

SEQ ID NO: 1703086 - RNA, 13 nt, Homo sapiens
uggagacugacaa

SEQ ID NO: 1703087 - RNA, 19 nt, Homo sapiens
uggagacugacaaccucau

SEQ ID NO: 1703088 - RNA, 20 nt, Homo sapiens
uggagaguauuuuagaaacu

SEQ ID NO: 1703089 - RNA, 22 nt, Homo sapiens
uggagcccuaaccccuuccaga

SEQ ID NO: 1703090 - RNA, 20 nt, Homo sapiens
uggaggacgggacagaugga

SEQ ID NO: 1703091 - RNA, 14 nt, Homo sapiens
uggaggauugcuau

SEQ ID NO: 1703092 - RNA, 19 nt, Homo sapiens
uggagggaaugcucagaaa

SEQ ID NO: 1703093 - RNA, 21 nt, Homo sapiens
uggagggauaagccagcugca

SEQ ID NO: 1703094 - RNA, 20 nt, Homo sapiens
uggaggucauacaugcauac

SEQ ID NO: 1703095 - RNA, 18 nt, Homo sapiens
uggagguucuaaggccua

SEQ ID NO: 1703096 - RNA, 19 nt, Homo sapiens
uggaguagagguacuagaa

SEQ ID NO: 1703097 - RNA, 16 nt, Homo sapiens
uggaguauaauauuca

SEQ ID NO: 1703098 - RNA, 21 nt, Homo sapiens
uggaguaugucugauggaucc

SEQ ID NO: 1703099 - RNA, 17 nt, Homo sapiens
uggaguucuugugccau

SEQ ID NO: 1703100 - RNA, 19 nt, Homo sapiens
uggaguugugaucauccca

SEQ ID NO: 1703101 - RNA, 17 nt, Homo sapiens
uggauagcuaauaauga

SEQ ID NO: 1703102 - RNA, 12 nt, Homo sapiens
uggaucagaaua

SEQ ID NO: 1703103 - RNA, 20 nt, Homo sapiens
uggaugauucagaaauugga

SEQ ID NO: 1703104 - RNA, 14 nt, Homo sapiens
uggaugcaggguuu

SEQ ID NO: 1703105 - RNA, 17 nt, Homo sapiens
uggauuguuuauacucc

SEQ ID NO: 1703106 - RNA, 18 nt, Homo sapiens
uggcaaggagccagggaa

SEQ ID NO: 1703107 - RNA, 18 nt, Homo sapiens
uggcaagucuuccaugac

SEQ ID NO: 1703108 - RNA, 23 nt, Homo sapiens
uggcaaucucagaugcaguuugg

SEQ ID NO: 1703109 - RNA, 17 nt, Homo sapiens
uggcacuguggagcuca

SEQ ID NO: 1703110 - RNA, 19 nt, Homo sapiens
uggcacuguggagcucagu

SEQ ID NO: 1703111 - RNA, 19 nt, Homo sapiens
uggcacuuugaaggggccu

SEQ ID NO: 1703112 - RNA, 14 nt, Homo sapiens
uggcagaaagggaa

SEQ ID NO: 1703113 - RNA, 20 nt, Homo sapiens
uggcagaccgugaccaucuu

SEQ ID NO: 1703114 - RNA, 16 nt, Homo sapiens
uggcagccgugccuuc

SEQ ID NO: 1703115 - RNA, 16 nt, Homo sapiens
uggcagcggguggcau

SEQ ID NO: 1703116 - RNA, 17 nt, Homo sapiens
uggcaggaaucuaucca

SEQ ID NO: 1703117 - RNA, 21 nt, Homo sapiens
uggcagugggagcugccuguu

SEQ ID NO: 1703118 - RNA, 23 nt, Homo sapiens
uggcaucaaacagggcaaagugu

SEQ ID NO: 1703119 - RNA, 16 nt, Homo sapiens
uggccaucccugugag

SEQ ID NO: 1703120 - RNA, 14 nt, Homo sapiens
uggcccaaccagac

SEQ ID NO: 1703121 - RNA, 19 nt, Homo sapiens
uggcccauagaaacaugac

SEQ ID NO: 1703122 - RNA, 17 nt, Homo sapiens
uggccccaguccaugcu

SEQ ID NO: 1703123 - RNA, 18 nt, Homo sapiens
uggcccugcccugaggaa

SEQ ID NO: 1703124 - RNA, 22 nt, Homo sapiens
uggccuaugcacauauggacuc

SEQ ID NO: 1703125 - RNA, 17 nt, Homo sapiens
uggccucuggcucucau

SEQ ID NO: 1703126 - RNA, 13 nt, Homo sapiens
uggccuggcacac

SEQ ID NO: 1703127 - RNA, 18 nt, Homo sapiens
uggccuggcacacaucag

SEQ ID NO: 1703128 - RNA, 18 nt, Homo sapiens
uggccuugaaaccaccuu

SEQ ID NO: 1703129 - RNA, 15 nt, Homo sapiens
uggcuaagauaccaa

SEQ ID NO: 1703130 - RNA, 15 nt, Homo sapiens
uggcuagacuugcca

SEQ ID NO: 1703131 - RNA, 13 nt, Homo sapiens
uggcuaugcaaca

SEQ ID NO: 1703132 - RNA, 12 nt, Homo sapiens
uggcucacuggc

SEQ ID NO: 1703133 - RNA, 22 nt, Homo sapiens
uggcucugcuguccccuuggca

SEQ ID NO: 1703134 - RNA, 23 nt, Homo sapiens
uggcucuggugugaaguuugcuu

SEQ ID NO: 1703135 - RNA, 14 nt, Homo sapiens
uggcugccuuagaa

SEQ ID NO: 1703136 - RNA, 19 nt, Homo sapiens
uggcugguaacaguucaug

SEQ ID NO: 1703137 - RNA, 15 nt, Homo sapiens
uggcuguacugcuca

SEQ ID NO: 1703138 - RNA, 20 nt, Homo sapiens
uggcuuucagaaaacgggaa

SEQ ID NO: 1703139 - RNA, 16 nt, Homo sapiens
uggcuuucuggcugcu

SEQ ID NO: 1703140 - RNA, 22 nt, Homo sapiens
ugggaaaaauucagagaguuag

SEQ ID NO: 1703141 - RNA, 16 nt, Homo sapiens
ugggaaaacacugcca

SEQ ID NO: 1703142 - RNA, 12 nt, Homo sapiens
ugggaaccaagc

SEQ ID NO: 1703143 - RNA, 15 nt, Homo sapiens
ugggaauaauugcuu

SEQ ID NO: 1703144 - RNA, 22 nt, Homo sapiens
ugggacuacaggugugagucac

SEQ ID NO: 1703145 - RNA, 15 nt, Homo sapiens
ugggagaaggcagug

SEQ ID NO: 1703146 - RNA, 16 nt, Homo sapiens
ugggagauucaugcga

SEQ ID NO: 1703147 - RNA, 17 nt, Homo sapiens
ugggagcaguccaugca

SEQ ID NO: 1703148 - RNA, 20 nt, Homo sapiens
ugggagcaguccaugcauga

SEQ ID NO: 1703149 - RNA, 17 nt, Homo sapiens
ugggaguccaggcacag

SEQ ID NO: 1703150 - RNA, 15 nt, Homo sapiens
ugggauggggguacu

SEQ ID NO: 1703151 - RNA, 21 nt, Homo sapiens
ugggauguccuacuaucacug

SEQ ID NO: 1703152 - RNA, 17 nt, Homo sapiens
ugggauuacagguguga

SEQ ID NO: 1703153 - RNA, 16 nt, Homo sapiens
ugggcaccccacugca

SEQ ID NO: 1703154 - RNA, 18 nt, Homo sapiens
ugggcagcauagcaagac

SEQ ID NO: 1703155 - RNA, 14 nt, Homo sapiens
ugggccacagccau

SEQ ID NO: 1703156 - RNA, 13 nt, Homo sapiens
ugggccagggucu

SEQ ID NO: 1703157 - RNA, 17 nt, Homo sapiens
ugggccauguccaaaga

SEQ ID NO: 1703158 - RNA, 23 nt, Homo sapiens
ugggccuagggacagacugcaag

SEQ ID NO: 1703159 - RNA, 16 nt, Homo sapiens
ugggccucuucugccu

SEQ ID NO: 1703160 - RNA, 16 nt, Homo sapiens
uggggaaaaaaaucau

SEQ ID NO: 1703161 - RNA, 17 nt, Homo sapiens
uggggaaaaaacugugc

SEQ ID NO: 1703162 - RNA, 20 nt, Homo sapiens
uggggaaacagaugccucag

SEQ ID NO: 1703163 - RNA, 19 nt, Homo sapiens
uggggaacugcguggugcu

SEQ ID NO: 1703164 - RNA, 15 nt, Homo sapiens
uggggagauggaguu

SEQ ID NO: 1703165 - RNA, 14 nt, Homo sapiens
uggggagguggagu

SEQ ID NO: 1703166 - RNA, 15 nt, Homo sapiens
uggggcucucucuuc

SEQ ID NO: 1703167 - RNA, 12 nt, Homo sapiens
uggggcuuccau

SEQ ID NO: 1703168 - RNA, 23 nt, Homo sapiens
ugggggaaaguguugaccacaga

SEQ ID NO: 1703169 - RNA, 21 nt, Homo sapiens
uggggugcugccugaauccau

SEQ ID NO: 1703170 - RNA, 15 nt, Homo sapiens
ugggguuauguauca

SEQ ID NO: 1703171 - RNA, 18 nt, Homo sapiens
ugggguuucuggggucca

SEQ ID NO: 1703172 - RNA, 18 nt, Homo sapiens
ugggucaaguacaccagc

SEQ ID NO: 1703173 - RNA, 12 nt, Homo sapiens
ugggucagggag

SEQ ID NO: 1703174 - RNA, 15 nt, Homo sapiens
uggguccaucagaga

SEQ ID NO: 1703175 - RNA, 14 nt, Homo sapiens
uggguguacauuuu

SEQ ID NO: 1703176 - RNA, 19 nt, Homo sapiens
ugggugucauuucauucca

SEQ ID NO: 1703177 - RNA, 20 nt, Homo sapiens
uggguuauguguaugugcca

SEQ ID NO: 1703178 - RNA, 15 nt, Homo sapiens
uggguucugcuacuc

SEQ ID NO: 1703179 - RNA, 22 nt, Homo sapiens
ugguagaacguaaccacggaaa

SEQ ID NO: 1703180 - RNA, 12 nt, Homo sapiens
ugguccaugcag

SEQ ID NO: 1703181 - RNA, 20 nt, Homo sapiens
uggucuuguggaauugggag

SEQ ID NO: 1703182 - RNA, 16 nt, Homo sapiens
uggugaaaauguacug

SEQ ID NO: 1703183 - RNA, 12 nt, Homo sapiens
uggugaaugaca

SEQ ID NO: 1703184 - RNA, 20 nt, Homo sapiens
uggugagaaauuucugugaa

SEQ ID NO: 1703185 - RNA, 12 nt, Homo sapiens
uggugcagacag

SEQ ID NO: 1703186 - RNA, 20 nt, Homo sapiens
uggugcauagaacuggguaa

SEQ ID NO: 1703187 - RNA, 16 nt, Homo sapiens
uggugcuuaaguucca

SEQ ID NO: 1703188 - RNA, 22 nt, Homo sapiens
ugguguaaagccaacacccugu

SEQ ID NO: 1703189 - RNA, 14 nt, Homo sapiens
ugguguaccugcug

SEQ ID NO: 1703190 - RNA, 15 nt, Homo sapiens
ugguguauguaugag

SEQ ID NO: 1703191 - RNA, 20 nt, Homo sapiens
ugguguggccagcacucuga

SEQ ID NO: 1703192 - RNA, 15 nt, Homo sapiens
ugguuaacaucucag

SEQ ID NO: 1703193 - RNA, 17 nt, Homo sapiens
ugguucauuaauucuau

SEQ ID NO: 1703194 - RNA, 12 nt, Homo sapiens
ugguucuaagaa

SEQ ID NO: 1703195 - RNA, 11 nt, Homo sapiens
ugguucugcuu

SEQ ID NO: 1703196 - RNA, 19 nt, Homo sapiens
ugguuuacauuuaaagcau

SEQ ID NO: 1703197 - RNA, 16 nt, Homo sapiens
ugguuucucucuacag

SEQ ID NO: 1703198 - RNA, 20 nt, Homo sapiens
uguaaaaugugaagugaaug

SEQ ID NO: 1703199 - RNA, 14 nt, Homo sapiens
uguaaaugcauuag

SEQ ID NO: 1703200 - RNA, 21 nt, Homo sapiens
uguaacaucacuauccaugca

SEQ ID NO: 1703201 - RNA, 19 nt, Homo sapiens
uguaacuguaaaacauuga

SEQ ID NO: 1703202 - RNA, 23 nt, Homo sapiens
uguaacuuauguagauauuuggc

SEQ ID NO: 1703203 - RNA, 15 nt, Homo sapiens
uguaagacucauucc

SEQ ID NO: 1703204 - RNA, 14 nt, Homo sapiens
uguaagugcugcua

SEQ ID NO: 1703205 - RNA, 17 nt, Homo sapiens
ucuguuggccaguguga

SEQ ID NO: 1703206 - RNA, 14 nt, Homo sapiens
ucuguuuaacauuu

SEQ ID NO: 1703207 - RNA, 20 nt, Homo sapiens
ucuguuuauggccacauuua

SEQ ID NO: 1703208 - RNA, 19 nt, Homo sapiens
ucuguuucuucagcacauu

SEQ ID NO: 1703209 - RNA, 23 nt, Homo sapiens
ucuguuuuucaccacuucacuga

SEQ ID NO: 1703210 - RNA, 19 nt, Homo sapiens
ucuuaaauuugauuuacau

SEQ ID NO: 1703211 - RNA, 18 nt, Homo sapiens
ucuuaagccuaaaugccu

SEQ ID NO: 1703212 - RNA, 14 nt, Homo sapiens
ucuuacacuacauu

SEQ ID NO: 1703213 - RNA, 19 nt, Homo sapiens
ucuuacccuguacauaugu

SEQ ID NO: 1703214 - RNA, 22 nt, Homo sapiens
ucuuacuuugaguuagugccau

SEQ ID NO: 1703215 - RNA, 15 nt, Homo sapiens
ucuuagaaaugaagg

SEQ ID NO: 1703216 - RNA, 22 nt, Homo sapiens
ucuucaaacugugaagcauuua

SEQ ID NO: 1703217 - RNA, 18 nt, Homo sapiens
ucuucaacgccaucucca

SEQ ID NO: 1703218 - RNA, 15 nt, Homo sapiens
ucuucaccuuauuca

SEQ ID NO: 1703219 - RNA, 21 nt, Homo sapiens
ucuucacuguggucauccugc

SEQ ID NO: 1703220 - RNA, 12 nt, Homo sapiens
ucuuccauucca

SEQ ID NO: 1703221 - RNA, 21 nt, Homo sapiens
ucuuccucccucauuccaccu

SEQ ID NO: 1703222 - RNA, 15 nt, Homo sapiens
ucuuccuuagacuua

SEQ ID NO: 1703223 - RNA, 16 nt, Homo sapiens
ucuuccuuagacuuac

SEQ ID NO: 1703224 - RNA, 14 nt, Homo sapiens
ucuucuaaacuucc

SEQ ID NO: 1703225 - RNA, 16 nt, Homo sapiens
ucuucucaaguucuaa

SEQ ID NO: 1703226 - RNA, 23 nt, Homo sapiens
ucuucucaaguucuaagauucua

SEQ ID NO: 1703227 - RNA, 13 nt, Homo sapiens
ucuucuccacugg

SEQ ID NO: 1703228 - RNA, 15 nt, Homo sapiens
ucuucucccuuugaa

SEQ ID NO: 1703229 - RNA, 20 nt, Homo sapiens
ucuucugcaaaaauggauau

SEQ ID NO: 1703230 - RNA, 18 nt, Homo sapiens
ucuaccaugaacagaaaa

SEQ ID NO: 1703231 - RNA, 18 nt, Homo sapiens
ucuacccguuccaaaagc

SEQ ID NO: 1703232 - RNA, 17 nt, Homo sapiens
ucuaccuucaagaacca

SEQ ID NO: 1703233 - RNA, 18 nt, Homo sapiens
ucuacuggucuuguggaa

SEQ ID NO: 1703234 - RNA, 15 nt, Homo sapiens
ucuacuuuccaggcu

SEQ ID NO: 1703235 - RNA, 15 nt, Homo sapiens
ucuagaaaaccagcu

SEQ ID NO: 1703236 - RNA, 15 nt, Homo sapiens
ucuagaacacaggca

SEQ ID NO: 1703237 - RNA, 21 nt, Homo sapiens
ucuagaauuauaagucacaaa

SEQ ID NO: 1703238 - RNA, 24 nt, Homo sapiens
ucuagaauuauaagucacaaagag

SEQ ID NO: 1703239 - RNA, 23 nt, Homo sapiens
ucuagacauggagguucuaaggc

SEQ ID NO: 1703240 - RNA, 18 nt, Homo sapiens
ucuagcuaguaauauauu

SEQ ID NO: 1703241 - RNA, 22 nt, Homo sapiens
ucuagguaggggcccacuucac

SEQ ID NO: 1703242 - RNA, 20 nt, Homo sapiens
ucuaguacuucccaggcaaa

SEQ ID NO: 1703243 - RNA, 20 nt, Homo sapiens
ucuagugucuuuugccuuua

SEQ ID NO: 1703244 - RNA, 21 nt, Homo sapiens
ucuauaaagaagaacuugcau

SEQ ID NO: 1703245 - RNA, 23 nt, Homo sapiens
ucuaugcucucgcaccuuuccaa

SEQ ID NO: 1703246 - RNA, 18 nt, Homo sapiens
ucuaugggacucaaugca

SEQ ID NO: 1703247 - RNA, 11 nt, Homo sapiens
ucuauguuaau

SEQ ID NO: 1703248 - RNA, 15 nt, Homo sapiens
ucucaaauuagaaag

SEQ ID NO: 1703249 - RNA, 23 nt, Homo sapiens
ucucaauaacaaacuggcugcuu

SEQ ID NO: 1703250 - RNA, 13 nt, Homo sapiens
ucucacacacaua

SEQ ID NO: 1703251 - RNA, 20 nt, Homo sapiens
ucucaccucuccuacucacu

SEQ ID NO: 1703252 - RNA, 17 nt, Homo sapiens
ucccccaaaaugcauuu

SEQ ID NO: 1703253 - RNA, 23 nt, Homo sapiens
ucccccaccgguccagcuggccu

SEQ ID NO: 1703254 - RNA, 16 nt, Homo sapiens
ucccccgccacuccug

SEQ ID NO: 1703255 - RNA, 14 nt, Homo sapiens
ucccccucuuucac

SEQ ID NO: 1703256 - RNA, 22 nt, Homo sapiens
uccccucccuggcucccaugac

SEQ ID NO: 1703257 - RNA, 23 nt, Homo sapiens
uccccuucucugugcaguagcau

SEQ ID NO: 1703258 - RNA, 18 nt, Homo sapiens
uccccuuuguguagaaag

SEQ ID NO: 1703259 - RNA, 18 nt, Homo sapiens
ucccgaauucgcuguuac

SEQ ID NO: 1703260 - RNA, 19 nt, Homo sapiens
ucccgauucccaacugagu

SEQ ID NO: 1703261 - RNA, 18 nt, Homo sapiens
ucccggggcuccacugaa

SEQ ID NO: 1703262 - RNA, 21 nt, Homo sapiens
ucccucacccaggcacugggc

SEQ ID NO: 1703263 - RNA, 20 nt, Homo sapiens
ucccuccccaguucauugca

SEQ ID NO: 1703264 - RNA, 23 nt, Homo sapiens
ucccugaaaauguuuuucugcca

SEQ ID NO: 1703265 - RNA, 23 nt, Homo sapiens
ucccugcacuaaagccagccuga

SEQ ID NO: 1703266 - RNA, 24 nt, Homo sapiens
ucccugcacuaaagccagccugac

SEQ ID NO: 1703267 - RNA, 22 nt, Homo sapiens
ucccugccagaggggaaggagg

SEQ ID NO: 1703268 - RNA, 21 nt, Homo sapiens
ucccuuccgacccucugggaa

SEQ ID NO: 1703269 - RNA, 21 nt, Homo sapiens
ucccuugcuggaaaacccaaa

SEQ ID NO: 1703270 - RNA, 16 nt, Homo sapiens
ucccuuggccucagaa

SEQ ID NO: 1703271 - RNA, 13 nt, Homo sapiens
ucccuuugccagu

SEQ ID NO: 1703272 - RNA, 23 nt, Homo sapiens
ucccuuuggagauuuuuuaaucc

SEQ ID NO: 1703273 - RNA, 21 nt, Homo sapiens
ucccuuuguugcacacucacu

SEQ ID NO: 1703274 - RNA, 23 nt, Homo sapiens
uccgcacccaguuugauaccugc

SEQ ID NO: 1703275 - RNA, 11 nt, Homo sapiens
uccgcacuuuc

SEQ ID NO: 1703276 - RNA, 23 nt, Homo sapiens
uccgcagaagcccugaugugucc

SEQ ID NO: 1703277 - RNA, 19 nt, Homo sapiens
uccgcaggcagacuacaca

SEQ ID NO: 1703278 - RNA, 22 nt, Homo sapiens
uccgcaggcagacuacacagga

SEQ ID NO: 1703279 - RNA, 14 nt, Homo sapiens
uccgccagauccug

SEQ ID NO: 1703280 - RNA, 18 nt, Homo sapiens
uccgguuugccauguugc

SEQ ID NO: 1703281 - RNA, 18 nt, Homo sapiens
uccguccaggagccugug

SEQ ID NO: 1703282 - RNA, 12 nt, Homo sapiens
uccguguaaaau

SEQ ID NO: 1703283 - RNA, 14 nt, Homo sapiens
uccuaacaaaagau

SEQ ID NO: 1703284 - RNA, 18 nt, Homo sapiens
uccuaagacacaaaugca

SEQ ID NO: 1703285 - RNA, 21 nt, Homo sapiens
uccuaagggucgaaagcucua

SEQ ID NO: 1703286 - RNA, 17 nt, Homo sapiens
uccuacccacaccucug

SEQ ID NO: 1703287 - RNA, 20 nt, Homo sapiens
uccuacccuccugcacuguu

SEQ ID NO: 1703288 - RNA, 19 nt, Homo sapiens
uccuacgauacgcuacuau

SEQ ID NO: 1703289 - RNA, 15 nt, Homo sapiens
uccuacucacuuaaa

SEQ ID NO: 1703290 - RNA, 15 nt, Homo sapiens
uccuauaaucuguca

SEQ ID NO: 1703291 - RNA, 16 nt, Homo sapiens
uccuauaaucugucaa

SEQ ID NO: 1703292 - RNA, 14 nt, Homo sapiens
uccuauauccugug

SEQ ID NO: 1703293 - RNA, 20 nt, Homo sapiens
uccucaauuuuugucucaga

SEQ ID NO: 1703294 - RNA, 21 nt, Homo sapiens
uccucacccugauuucuugcu

SEQ ID NO: 1703295 - RNA, 11 nt, Homo sapiens
uccucagggag

SEQ ID NO: 1703296 - RNA, 18 nt, Homo sapiens
uccuccccacuagcauuu

SEQ ID NO: 1703297 - RNA, 19 nt, Homo sapiens
uccuccuggaacagaagac

SEQ ID NO: 1703298 - RNA, 20 nt, Homo sapiens
uccuccuggaacagaagaca

SEQ ID NO: 1703299 - RNA, 14 nt, Homo sapiens
uccucgcugccaga

SEQ ID NO: 1703300 - RNA, 19 nt, Homo sapiens
uccucuagcugugggggug

SEQ ID NO: 1703301 - RNA, 16 nt, Homo sapiens
uccucuccacugccuu

SEQ ID NO: 1703302 - RNA, 19 nt, Homo sapiens
uccucuccccagcaaguga

SEQ ID NO: 1703303 - RNA, 11 nt, Homo sapiens
uccucuucuau

SEQ ID NO: 1703304 - RNA, 14 nt, Homo sapiens
uccucuugccacug

SEQ ID NO: 1703305 - RNA, 19 nt, Homo sapiens
uccugaacucuucugcaaa

SEQ ID NO: 1703306 - RNA, 22 nt, Homo sapiens
uccugaaggaaaauaaacugac

SEQ ID NO: 1703307 - RNA, 14 nt, Homo sapiens
uccugacacuauuc

SEQ ID NO: 1703308 - RNA, 18 nt, Homo sapiens
uccugacaucacagcagc

SEQ ID NO: 1703309 - RNA, 22 nt, Homo sapiens
uccugagacaaauuuuaacuuc

SEQ ID NO: 1703310 - RNA, 14 nt, Homo sapiens
uccugaucugugau

SEQ ID NO: 1703311 - RNA, 21 nt, Homo sapiens
uccugaugaggagaaaggggc

SEQ ID NO: 1703312 - RNA, 20 nt, Homo sapiens
uccugccagccccacacagc

SEQ ID NO: 1703313 - RNA, 16 nt, Homo sapiens
uccugccuucauggaa

SEQ ID NO: 1703314 - RNA, 22 nt, Homo sapiens
uccugcugcccuuaggccacau

SEQ ID NO: 1703315 - RNA, 19 nt, Homo sapiens
uccuggcacuaacguugag

SEQ ID NO: 1703316 - RNA, 16 nt, Homo sapiens
uccugggagugagcug

SEQ ID NO: 1703317 - RNA, 16 nt, Homo sapiens
uccuggugcccacucc

SEQ ID NO: 1703318 - RNA, 17 nt, Homo sapiens
uccuggugcucuaucca

SEQ ID NO: 1703319 - RNA, 13 nt, Homo sapiens
uccuguauaagca

SEQ ID NO: 1703320 - RNA, 21 nt, Homo sapiens
uccuguaugaaagauuguggg

SEQ ID NO: 1703321 - RNA, 14 nt, Homo sapiens
uccugugaauuucu

SEQ ID NO: 1703322 - RNA, 12 nt, Homo sapiens
uccuuaaguaua

SEQ ID NO: 1703323 - RNA, 20 nt, Homo sapiens
uccuuacuaagcauagcaaa

SEQ ID NO: 1703324 - RNA, 13 nt, Homo sapiens
uccuucuggccuu

SEQ ID NO: 1703325 - RNA, 11 nt, Homo sapiens
uccuugcccac

SEQ ID NO: 1703326 - RNA, 22 nt, Homo sapiens
uccuugugcaaaauauuugacu

SEQ ID NO: 1703327 - RNA, 23 nt, Homo sapiens
uccuuguggcagaggaugucuca

SEQ ID NO: 1703328 - RNA, 22 nt, Homo sapiens
uccuuuaaagaugaacucugaa

SEQ ID NO: 1703329 - RNA, 19 nt, Homo sapiens
uccuuucuccaggaccaau

SEQ ID NO: 1703330 - RNA, 20 nt, Homo sapiens
uccuuucugugcccuacuca

SEQ ID NO: 1703331 - RNA, 19 nt, Homo sapiens
uccuuuucuuuuguuacug

SEQ ID NO: 1703332 - RNA, 23 nt, Homo sapiens
uccuuuuucugauuagcuuugug

SEQ ID NO: 1703333 - RNA, 17 nt, Homo sapiens
ucgaaauacaagccauu

SEQ ID NO: 1703334 - RNA, 15 nt, Homo sapiens
ucgaacuucacaacu

SEQ ID NO: 1703335 - RNA, 22 nt, Homo sapiens
ucgaggacugauacugcaguga

SEQ ID NO: 1703336 - RNA, 20 nt, Homo sapiens
ucgcaaaaacguaucuccua

SEQ ID NO: 1703337 - RNA, 23 nt, Homo sapiens
ucgccaggaggccacgggccacg

SEQ ID NO: 1703338 - RNA, 14 nt, Homo sapiens
ucgccuguggagcu

SEQ ID NO: 1703339 - RNA, 22 nt, Homo sapiens
ucgcuauugauuuuuacuucaa

SEQ ID NO: 1703340 - RNA, 22 nt, Homo sapiens
ucgcuccugugucuugcaaugg

SEQ ID NO: 1703341 - RNA, 16 nt, Homo sapiens
ucggccuccaugaccu

SEQ ID NO: 1703342 - RNA, 20 nt, Homo sapiens
ucgguagaggauuucuaguu

SEQ ID NO: 1703343 - RNA, 16 nt, Homo sapiens
ucguuuugaugccauu

SEQ ID NO: 1703344 - RNA, 20 nt, Homo sapiens
ucuaaaaaccagacaaggaa

SEQ ID NO: 1703345 - RNA, 22 nt, Homo sapiens
ucuaaaaagauuagcaagguca

SEQ ID NO: 1703346 - RNA, 14 nt, Homo sapiens
ucuaaagauucuau

SEQ ID NO: 1703347 - RNA, 23 nt, Homo sapiens
ucuaaauuugaauguuaagcaga

SEQ ID NO: 1703348 - RNA, 22 nt, Homo sapiens
ucuaaauuuugucuuuaacuca

SEQ ID NO: 1703349 - RNA, 20 nt, Homo sapiens
ucuaagaucuuagauucucu

SEQ ID NO: 1703350 - RNA, 14 nt, Homo sapiens
ucuaagauucuaaa

SEQ ID NO: 1703351 - RNA, 14 nt, Homo sapiens
ucuaauauggccac

SEQ ID NO: 1703352 - RNA, 13 nt, Homo sapiens
ucuaaucaaaagg

SEQ ID NO: 1703353 - RNA, 19 nt, Homo sapiens
ucuaauggggacacagauc

SEQ ID NO: 1703354 - RNA, 12 nt, Homo sapiens
ucuaaugucuuc

SEQ ID NO: 1703355 - RNA, 22 nt, Homo sapiens
ucuaauucuauuaaagugcuaa

SEQ ID NO: 1703356 - RNA, 19 nt, Homo sapiens
ucuacaaacucccacuugu

SEQ ID NO: 1703357 - RNA, 22 nt, Homo sapiens
ucuacaaauggugaaauuuaau

SEQ ID NO: 1703358 - RNA, 17 nt, Homo sapiens
ucuacauaaguaauuca

SEQ ID NO: 1703359 - RNA, 21 nt, Homo sapiens
ucuacauaaguaauucaagaa

SEQ ID NO: 1703360 - RNA, 15 nt, Homo sapiens
gcuuagagacuauca

SEQ ID NO: 1703361 - RNA, 14 nt, Homo sapiens
gcuuaguaucucau

SEQ ID NO: 1703362 - RNA, 12 nt, Homo sapiens
gcuuaugauuca

SEQ ID NO: 1703363 - RNA, 23 nt, Homo sapiens
gcuucauaaaugaagcagcuuua

SEQ ID NO: 1703364 - RNA, 16 nt, Homo sapiens
gcuucaucugucaagu

SEQ ID NO: 1703365 - RNA, 16 nt, Homo sapiens
gcuucauuuccugugu

SEQ ID NO: 1703366 - RNA, 18 nt, Homo sapiens
gcuucauuugugucaaug

SEQ ID NO: 1703367 - RNA, 20 nt, Homo sapiens
gcuuccuacccacaccucug

SEQ ID NO: 1703368 - RNA, 16 nt, Homo sapiens
gcuuccuucugugaaa

SEQ ID NO: 1703369 - RNA, 21 nt, Homo sapiens
cugagaagaggagcccucauc

SEQ ID NO: 1703370 - RNA, 19 nt, Homo sapiens
cugagacaaauuuuaacuu

SEQ ID NO: 1703371 - RNA, 17 nt, Homo sapiens
cugagagaauuggcuca

SEQ ID NO: 1703372 - RNA, 16 nt, Homo sapiens
cugagaggaagccuga

SEQ ID NO: 1703373 - RNA, 12 nt, Homo sapiens
cugagagucuag

SEQ ID NO: 1703374 - RNA, 20 nt, Homo sapiens
cugagcccccacugcuucua

SEQ ID NO: 1703375 - RNA, 18 nt, Homo sapiens
cugaguaagcccucagga

SEQ ID NO: 1703376 - RNA, 19 nt, Homo sapiens
cugaguaagcccucaggag

SEQ ID NO: 1703377 - RNA, 23 nt, Homo sapiens
cugaguguuauuugcacacugca

SEQ ID NO: 1703378 - RNA, 17 nt, Homo sapiens
cugauaugggacugagc

SEQ ID NO: 1703379 - RNA, 18 nt, Homo sapiens
cugauaugggacugagcc

SEQ ID NO: 1703380 - RNA, 17 nt, Homo sapiens
cugaucugcggaucuca

SEQ ID NO: 1703381 - RNA, 24 nt, Homo sapiens
cugaucugcggaucucagcuuuga

SEQ ID NO: 1703382 - RNA, 22 nt, Homo sapiens
cugaugaaaacauagcaucuca

SEQ ID NO: 1703383 - RNA, 16 nt, Homo sapiens
cugaugagaauacuga

SEQ ID NO: 1703384 - RNA, 15 nt, Homo sapiens
cugaugauacaugca

SEQ ID NO: 1703385 - RNA, 19 nt, Homo sapiens
cugauggaaguaaagccuc

SEQ ID NO: 1703386 - RNA, 20 nt, Homo sapiens
cugauggacaggugucugag

SEQ ID NO: 1703387 - RNA, 13 nt, Homo sapiens
cugauggaucccg

SEQ ID NO: 1703388 - RNA, 22 nt, Homo sapiens
cugauuaccugaaggacagcug

SEQ ID NO: 1703389 - RNA, 15 nt, Homo sapiens
cugauucacugcaug

SEQ ID NO: 1703390 - RNA, 17 nt, Homo sapiens
cugauuuuuagcuuuac

SEQ ID NO: 1703391 - RNA, 19 nt, Homo sapiens
cugauuuuuagcuuuacaa

SEQ ID NO: 1703392 - RNA, 16 nt, Homo sapiens
cugcaagcacaucugc

SEQ ID NO: 1703393 - RNA, 15 nt, Homo sapiens
cugcacaacaagaua

SEQ ID NO: 1703394 - RNA, 23 nt, Homo sapiens
cugcacagccuagacauccaggu

SEQ ID NO: 1703395 - RNA, 17 nt, Homo sapiens
cugcacagugcaucuca

SEQ ID NO: 1703396 - RNA, 23 nt, Homo sapiens
cugcacaugucuuguacaugugu

SEQ ID NO: 1703397 - RNA, 12 nt, Homo sapiens
cugcaccuguca

SEQ ID NO: 1703398 - RNA, 23 nt, Homo sapiens
cugcacuauagccuaggugacag

SEQ ID NO: 1703399 - RNA, 22 nt, Homo sapiens
cugcacuguccugaccaucgca

SEQ ID NO: 1703400 - RNA, 15 nt, Homo sapiens
cugcacuguuuucaa

SEQ ID NO: 1703401 - RNA, 21 nt, Homo sapiens
cugcagaugccacccuagcca

SEQ ID NO: 1703402 - RNA, 15 nt, Homo sapiens
cugcaggaaucaaaa

SEQ ID NO: 1703403 - RNA, 20 nt, Homo sapiens
cugcagggacuccaugcugc

SEQ ID NO: 1703404 - RNA, 21 nt, Homo sapiens
cugcauccccuuggcugugag

SEQ ID NO: 1703405 - RNA, 15 nt, Homo sapiens
cugcaucugugaaaa

SEQ ID NO: 1703406 - RNA, 18 nt, Homo sapiens
cugcaucuuauagcacuu

SEQ ID NO: 1703407 - RNA, 21 nt, Homo sapiens
cugcauguaccauuugcaugg

SEQ ID NO: 1703408 - RNA, 19 nt, Homo sapiens
cugcauuugugucaucuug

SEQ ID NO: 1703409 - RNA, 14 nt, Homo sapiens
cugccaccacuggg

SEQ ID NO: 1703410 - RNA, 16 nt, Homo sapiens
cugccacccuggggag

SEQ ID NO: 1703411 - RNA, 16 nt, Homo sapiens
cugccaccucccugac

SEQ ID NO: 1703412 - RNA, 13 nt, Homo sapiens
cugccagggagcu

SEQ ID NO: 1703413 - RNA, 20 nt, Homo sapiens
cugccauccuugacuuugaa

SEQ ID NO: 1703414 - RNA, 20 nt, Homo sapiens
cugcccacuguuucucuuga

SEQ ID NO: 1703415 - RNA, 19 nt, Homo sapiens
cugcccauucaccaaaauu

SEQ ID NO: 1703416 - RNA, 14 nt, Homo sapiens
cugccccagacaga

SEQ ID NO: 1703417 - RNA, 21 nt, Homo sapiens
cugcccgggaaggucaccagc

SEQ ID NO: 1703418 - RNA, 18 nt, Homo sapiens
cugcccugguccagggaa

SEQ ID NO: 1703419 - RNA, 13 nt, Homo sapiens
cugccgaccccua

SEQ ID NO: 1703420 - RNA, 18 nt, Homo sapiens
cugccuagcugccuagca

SEQ ID NO: 1703421 - RNA, 23 nt, Homo sapiens
cugccuccagaauggucuuucua

SEQ ID NO: 1703422 - RNA, 20 nt, Homo sapiens
cugccucuggaauugcucaa

SEQ ID NO: 1703423 - RNA, 17 nt, Homo sapiens
cugccugaagucacaca

SEQ ID NO: 1703424 - RNA, 13 nt, Homo sapiens
cugccuguauacu

SEQ ID NO: 1703425 - RNA, 15 nt, Homo sapiens
cugcggcgucugucu

SEQ ID NO: 1703426 - RNA, 19 nt, Homo sapiens
cugcggggggcaccagagg

SEQ ID NO: 1703427 - RNA, 23 nt, Homo sapiens
cugcuagcaaauggcagaaccaa

SEQ ID NO: 1703428 - RNA, 17 nt, Homo sapiens
cugcuccgcugcuccuu

SEQ ID NO: 1703429 - RNA, 22 nt, Homo sapiens
cugcuccuccccuuucacaggu

SEQ ID NO: 1703430 - RNA, 22 nt, Homo sapiens
cugcugaccucccagugacccc

SEQ ID NO: 1703431 - RNA, 20 nt, Homo sapiens
cugcugcccuuaggccacau

SEQ ID NO: 1703432 - RNA, 16 nt, Homo sapiens
cugcugcuccacggcg

SEQ ID NO: 1703433 - RNA, 18 nt, Homo sapiens
cugcuguccccuuggcag

SEQ ID NO: 1703434 - RNA, 13 nt, Homo sapiens
cugcuuaagugcc

SEQ ID NO: 1703435 - RNA, 15 nt, Homo sapiens
cugcuuaagugccua

SEQ ID NO: 1703436 - RNA, 16 nt, Homo sapiens
cugcuuagacauaaca

SEQ ID NO: 1703437 - RNA, 20 nt, Homo sapiens
cugcuugaugaagcaaggaa

SEQ ID NO: 1703438 - RNA, 13 nt, Homo sapiens
cugcuuuguucaa

SEQ ID NO: 1703439 - RNA, 21 nt, Homo sapiens
cugcuuuuuuuuuuccagcaa

SEQ ID NO: 1703440 - RNA, 18 nt, Homo sapiens
cuggaaaaauuccagaag

SEQ ID NO: 1703441 - RNA, 18 nt, Homo sapiens
cuggaacuccuaaaccuu

SEQ ID NO: 1703442 - RNA, 23 nt, Homo sapiens
cuggaauaagaagcaaauaaaua

SEQ ID NO: 1703443 - RNA, 13 nt, Homo sapiens
cuggaauugcuca

SEQ ID NO: 1703444 - RNA, 22 nt, Homo sapiens
cuggacaaaugaugccauggca

SEQ ID NO: 1703445 - RNA, 21 nt, Homo sapiens
cuggacaguaucccacaucca

SEQ ID NO: 1703446 - RNA, 18 nt, Homo sapiens
cuggacggggacugggga

SEQ ID NO: 1703447 - RNA, 19 nt, Homo sapiens
cuggacucuaaagaccaaa

SEQ ID NO: 1703448 - RNA, 12 nt, Homo sapiens
cuggacugggag

SEQ ID NO: 1703449 - RNA, 11 nt, Homo sapiens
cuggacuguca

SEQ ID NO: 1703450 - RNA, 22 nt, Homo sapiens
cuggacuuuccuguugucuaca

SEQ ID NO: 1703451 - RNA, 17 nt, Homo sapiens
cuggagacguggaaccu

SEQ ID NO: 1703452 - RNA, 21 nt, Homo sapiens
cuggagccaucucuuccucau

SEQ ID NO: 1703453 - RNA, 20 nt, Homo sapiens
cuggagccuccacugccucu

SEQ ID NO: 1703454 - RNA, 18 nt, Homo sapiens
cuggaggacgggacagau

SEQ ID NO: 1703455 - RNA, 20 nt, Homo sapiens
cuggagugcaguggugcaau

SEQ ID NO: 1703456 - RNA, 21 nt, Homo sapiens
cuggagugcaguggugcaauc

SEQ ID NO: 1703457 - RNA, 20 nt, Homo sapiens
cuggagugcaguggugugau

SEQ ID NO: 1703458 - RNA, 21 nt, Homo sapiens
cuggauccccucugucuacaa

SEQ ID NO: 1703459 - RNA, 22 nt, Homo sapiens
cuggauccccucugucuacaaa

SEQ ID NO: 1703460 - RNA, 18 nt, Homo sapiens
cuggcaagucuuccauga

SEQ ID NO: 1703461 - RNA, 21 nt, Homo sapiens
cuggcagccauggccauggca

SEQ ID NO: 1703462 - RNA, 13 nt, Homo sapiens
cuggcaggcaaga

SEQ ID NO: 1703463 - RNA, 21 nt, Homo sapiens
cuggcagggcccagugacaag

SEQ ID NO: 1703464 - RNA, 13 nt, Homo sapiens
cuggccacagacu

SEQ ID NO: 1703465 - RNA, 18 nt, Homo sapiens
cuggccacagacucccuc

SEQ ID NO: 1703466 - RNA, 22 nt, Homo sapiens
cuggcccaagugguuugugcua

SEQ ID NO: 1703467 - RNA, 23 nt, Homo sapiens
cuggcccucgacacucaccauga

SEQ ID NO: 1703468 - RNA, 20 nt, Homo sapiens
cuggccuaaaaucuuggaag

SEQ ID NO: 1703469 - RNA, 20 nt, Homo sapiens
cuggccucucuagcacaauu

SEQ ID NO: 1703470 - RNA, 17 nt, Homo sapiens
cuggccuuugcucuuac

SEQ ID NO: 1703471 - RNA, 13 nt, Homo sapiens
cuggcgugcagug

SEQ ID NO: 1703472 - RNA, 16 nt, Homo sapiens
cuccacaggcacaggu

SEQ ID NO: 1703473 - RNA, 14 nt, Homo sapiens
cuccaccacauccu

SEQ ID NO: 1703474 - RNA, 16 nt, Homo sapiens
cuccaccuagacugua

SEQ ID NO: 1703475 - RNA, 18 nt, Homo sapiens
cuccaccuagacuguaaa

SEQ ID NO: 1703476 - RNA, 16 nt, Homo sapiens
cuccacugccuucgau

SEQ ID NO: 1703477 - RNA, 13 nt, Homo sapiens
cuccacugucaca

SEQ ID NO: 1703478 - RNA, 23 nt, Homo sapiens
cuccagaauggucuuucuaaugu

SEQ ID NO: 1703479 - RNA, 22 nt, Homo sapiens
cuccagguggcucugaggugcc

SEQ ID NO: 1703480 - RNA, 16 nt, Homo sapiens
cuccaguaacagccua

SEQ ID NO: 1703481 - RNA, 18 nt, Homo sapiens
cuccagugcuguccaugc

SEQ ID NO: 1703482 - RNA, 19 nt, Homo sapiens
cucccaaagugcugggauu

SEQ ID NO: 1703483 - RNA, 13 nt, Homo sapiens
cucccacauucug

SEQ ID NO: 1703484 - RNA, 14 nt, Homo sapiens
cucccaucaccucu

SEQ ID NO: 1703485 - RNA, 20 nt, Homo sapiens
cuccccacuuguccgcuggg

SEQ ID NO: 1703486 - RNA, 13 nt, Homo sapiens
cuccccaggggag

SEQ ID NO: 1703487 - RNA, 17 nt, Homo sapiens
cuccccugcccuggucc

SEQ ID NO: 1703488 - RNA, 15 nt, Homo sapiens
cuccccuguaccuuu

SEQ ID NO: 1703489 - RNA, 16 nt, Homo sapiens
cuccccuuucacaggu

SEQ ID NO: 1703490 - RNA, 22 nt, Homo sapiens
cuccccuuuuauaccugcucuu

SEQ ID NO: 1703491 - RNA, 13 nt, Homo sapiens
cucccucugggaa

SEQ ID NO: 1703492 - RNA, 15 nt, Homo sapiens
cuccgccaaugcacg

SEQ ID NO: 1703493 - RNA, 19 nt, Homo sapiens
cuccgcuuucuacccagcg

SEQ ID NO: 1703494 - RNA, 14 nt, Homo sapiens
cuccuacaugaugu

SEQ ID NO: 1703495 - RNA, 10 nt, Homo sapiens
cuccuaggcc

SEQ ID NO: 1703496 - RNA, 18 nt, Homo sapiens
cuccuccaaaggcccccu

SEQ ID NO: 1703497 - RNA, 14 nt, Homo sapiens
cuccuccccuuuca

SEQ ID NO: 1703498 - RNA, 15 nt, Homo sapiens
cuccucuaggccuca

SEQ ID NO: 1703499 - RNA, 22 nt, Homo sapiens
cuccucuguccaggcacugcug

SEQ ID NO: 1703500 - RNA, 23 nt, Homo sapiens
cuccugaggcuuuggauuugaca

SEQ ID NO: 1703501 - RNA, 16 nt, Homo sapiens
cuccugcacuguuuaa

SEQ ID NO: 1703502 - RNA, 20 nt, Homo sapiens
cuccuggccucaagugauuc

SEQ ID NO: 1703503 - RNA, 22 nt, Homo sapiens
cuccuuacgcuuugucacacaa

SEQ ID NO: 1703504 - RNA, 15 nt, Homo sapiens
cuccuucagacaccc

SEQ ID NO: 1703505 - RNA, 21 nt, Homo sapiens
cuccuuccuacccuccugcac

SEQ ID NO: 1703506 - RNA, 14 nt, Homo sapiens
cuccuuggugccug

SEQ ID NO: 1703507 - RNA, 13 nt, Homo sapiens
cuccuuuagccau

SEQ ID NO: 1703508 - RNA, 15 nt, Homo sapiens
cucgugagucauuua

SEQ ID NO: 1703509 - RNA, 13 nt, Homo sapiens
cucguggucccca

SEQ ID NO: 1703510 - RNA, 12 nt, Homo sapiens
cucgugugcaac

SEQ ID NO: 1703511 - RNA, 14 nt, Homo sapiens
cucuaaagaccaaa

SEQ ID NO: 1703512 - RNA, 18 nt, Homo sapiens
cucuaaugagacugacca

SEQ ID NO: 1703513 - RNA, 19 nt, Homo sapiens
cucuacaucuucugccuua

SEQ ID NO: 1703514 - RNA, 21 nt, Homo sapiens
cucuagugucuuuugccuuua

SEQ ID NO: 1703515 - RNA, 19 nt, Homo sapiens
cucuaugccagcucagucc

SEQ ID NO: 1703516 - RNA, 13 nt, Homo sapiens
cucuauucucaaa

SEQ ID NO: 1703517 - RNA, 20 nt, Homo sapiens
cucucaaaagagaaaaacaa

SEQ ID NO: 1703518 - RNA, 15 nt, Homo sapiens
cucucaauaugcuua

SEQ ID NO: 1703519 - RNA, 23 nt, Homo sapiens
cucucaccccaacuaguagcuaa

SEQ ID NO: 1703520 - RNA, 17 nt, Homo sapiens
cucucacccgaccggug

SEQ ID NO: 1703521 - RNA, 19 nt, Homo sapiens
cucucaccuaaaaaaagag

SEQ ID NO: 1703522 - RNA, 17 nt, Homo sapiens
cucucagcugaccauca

SEQ ID NO: 1703523 - RNA, 22 nt, Homo sapiens
cucucaguccuucuugggggua

SEQ ID NO: 1703524 - RNA, 19 nt, Homo sapiens
cucuccccuccagccuuug

SEQ ID NO: 1703525 - RNA, 20 nt, Homo sapiens
cucuccuguaagccaaagaa

SEQ ID NO: 1703526 - RNA, 15 nt, Homo sapiens
cucucuccacccuau

SEQ ID NO: 1703527 - RNA, 22 nt, Homo sapiens
cucucuccuuucagggccaauc

SEQ ID NO: 1703528 - RNA, 17 nt, Homo sapiens
cucugaaacggauccag

SEQ ID NO: 1703529 - RNA, 13 nt, Homo sapiens
cucugaacuggau

SEQ ID NO: 1703530 - RNA, 19 nt, Homo sapiens
cucugaagucacaucacag

SEQ ID NO: 1703531 - RNA, 21 nt, Homo sapiens
cucugaggacacuaaccacgc

SEQ ID NO: 1703532 - RNA, 21 nt, Homo sapiens
cucugcaaugggcacugggau

SEQ ID NO: 1703533 - RNA, 12 nt, Homo sapiens
cucugcacaugu

SEQ ID NO: 1703534 - RNA, 13 nt, Homo sapiens
cucugcacauguc

SEQ ID NO: 1703535 - RNA, 13 nt, Homo sapiens
cucugccaccaga

SEQ ID NO: 1703536 - RNA, 22 nt, Homo sapiens
cucugccugaagucacacagug

SEQ ID NO: 1703537 - RNA, 17 nt, Homo sapiens
cucugcuccccugugaa

SEQ ID NO: 1703538 - RNA, 14 nt, Homo sapiens
cucugcuucuccaa

SEQ ID NO: 1703539 - RNA, 22 nt, Homo sapiens
cucuggcucucaugggguccaa

SEQ ID NO: 1703540 - RNA, 16 nt, Homo sapiens
cucugggcuauggaca

SEQ ID NO: 1703541 - RNA, 17 nt, Homo sapiens
cucugggcuauggacac

SEQ ID NO: 1703542 - RNA, 22 nt, Homo sapiens
cucuggggucuuuuuaugcauu

SEQ ID NO: 1703543 - RNA, 22 nt, Homo sapiens
cucugguaaaugaucacuccag

SEQ ID NO: 1703544 - RNA, 20 nt, Homo sapiens
cucuguaacaucacuaucca

SEQ ID NO: 1703545 - RNA, 13 nt, Homo sapiens
cucuguauguacu

SEQ ID NO: 1703546 - RNA, 20 nt, Homo sapiens
cucugugcugacauggcucu

SEQ ID NO: 1703547 - RNA, 15 nt, Homo sapiens
cucuguuauguacug

SEQ ID NO: 1703548 - RNA, 16 nt, Homo sapiens
cucuuaaacuugugaa

SEQ ID NO: 1703549 - RNA, 21 nt, Homo sapiens
cucuuaucucagucaugcaua

SEQ ID NO: 1703550 - RNA, 16 nt, Homo sapiens
cucuucccccuuccaa

SEQ ID NO: 1703551 - RNA, 13 nt, Homo sapiens
cucuuccugugau

SEQ ID NO: 1703552 - RNA, 14 nt, Homo sapiens
cucuuccugugauc

SEQ ID NO: 1703553 - RNA, 16 nt, Homo sapiens
cucuucugccuucuca

SEQ ID NO: 1703554 - RNA, 22 nt, Homo sapiens
cucuucuuuuggcuuccaugau

SEQ ID NO: 1703555 - RNA, 13 nt, Homo sapiens
cucuugaggccag

SEQ ID NO: 1703556 - RNA, 12 nt, Homo sapiens
cucuugcugucu

SEQ ID NO: 1703557 - RNA, 18 nt, Homo sapiens
cucuuguauaugaugauc

SEQ ID NO: 1703558 - RNA, 18 nt, Homo sapiens
cucuuucucucuucccuc

SEQ ID NO: 1703559 - RNA, 18 nt, Homo sapiens
cucuuucuguauauacuu

SEQ ID NO: 1703560 - RNA, 23 nt, Homo sapiens
cugaaaaaugguaauuguugcua

SEQ ID NO: 1703561 - RNA, 13 nt, Homo sapiens
cugaaaauucugu

SEQ ID NO: 1703562 - RNA, 16 nt, Homo sapiens
cugaaagccuuaggga

SEQ ID NO: 1703563 - RNA, 17 nt, Homo sapiens
cugaaagccuuagggaa

SEQ ID NO: 1703564 - RNA, 15 nt, Homo sapiens
cugaaagugguuuga

SEQ ID NO: 1703565 - RNA, 23 nt, Homo sapiens
cugaagauugcgguuuacagcua

SEQ ID NO: 1703566 - RNA, 21 nt, Homo sapiens
cugaagcccucccagguguua

SEQ ID NO: 1703567 - RNA, 16 nt, Homo sapiens
cugaagucacaucaca

SEQ ID NO: 1703568 - RNA, 21 nt, Homo sapiens
cugaauguuuaaagaucauga

SEQ ID NO: 1703569 - RNA, 20 nt, Homo sapiens
cugaauuuggccugcacuaa

SEQ ID NO: 1703570 - RNA, 17 nt, Homo sapiens
cugacacaggaaaccaa

SEQ ID NO: 1703571 - RNA, 21 nt, Homo sapiens
cugacauuaugugguuuuaga

SEQ ID NO: 1703572 - RNA, 22 nt, Homo sapiens
cugaccauauugugcuucacag

SEQ ID NO: 1703573 - RNA, 13 nt, Homo sapiens
cugacccacugcu

SEQ ID NO: 1703574 - RNA, 17 nt, Homo sapiens
cugaccucgugauccac

SEQ ID NO: 1703575 - RNA, 12 nt, Homo sapiens
auuucaucucuu

SEQ ID NO: 1703576 - RNA, 17 nt, Homo sapiens
auuucauuguaugaugu

SEQ ID NO: 1703577 - RNA, 23 nt, Homo sapiens
auuucccauuugugccagaggaa

SEQ ID NO: 1703578 - RNA, 23 nt, Homo sapiens
auuuccuuucuacaauuucaauu

SEQ ID NO: 1703579 - RNA, 14 nt, Homo sapiens
auuucuacacugag

SEQ ID NO: 1703580 - RNA, 15 nt, Homo sapiens
auuucuaguccaaaa

SEQ ID NO: 1703581 - RNA, 12 nt, Homo sapiens
auuucuauucaa

SEQ ID NO: 1703582 - RNA, 16 nt, Homo sapiens
auuucuguaaauacca

SEQ ID NO: 1703583 - RNA, 22 nt, Homo sapiens
auuucuucaaauccuuccaaaa

SEQ ID NO: 1703584 - RNA, 13 nt, Homo sapiens
auuucuugugaug

SEQ ID NO: 1703585 - RNA, 15 nt, Homo sapiens
auuucuuuguuauca

SEQ ID NO: 1703586 - RNA, 21 nt, Homo sapiens
auuucuuuucuggccaaaagc

SEQ ID NO: 1703587 - RNA, 13 nt, Homo sapiens
auuugaacacugg

SEQ ID NO: 1703588 - RNA, 21 nt, Homo sapiens
auuugacugaagaugcagcuc

SEQ ID NO: 1703589 - RNA, 13 nt, Homo sapiens
auuugauacuuau

SEQ ID NO: 1703590 - RNA, 16 nt, Homo sapiens
auuugauuaacaaaua

SEQ ID NO: 1703591 - RNA, 15 nt, Homo sapiens
auuugauuuugccca

SEQ ID NO: 1703592 - RNA, 13 nt, Homo sapiens
auuugcacacugc

SEQ ID NO: 1703593 - RNA, 16 nt, Homo sapiens
auuugcacacugcacu

SEQ ID NO: 1703594 - RNA, 17 nt, Homo sapiens
auuugcacacugcacug

SEQ ID NO: 1703595 - RNA, 19 nt, Homo sapiens
auuugccaacucgaacaaa

SEQ ID NO: 1703596 - RNA, 20 nt, Homo sapiens
auuugcggcgucagucuuuu

SEQ ID NO: 1703597 - RNA, 15 nt, Homo sapiens
auuuggccugcacua

SEQ ID NO: 1703598 - RNA, 20 nt, Homo sapiens
auuugggaaccaagcuauuc

SEQ ID NO: 1703599 - RNA, 17 nt, Homo sapiens
auuugguaccauggugu

SEQ ID NO: 1703600 - RNA, 21 nt, Homo sapiens
auuuguaauuccuuacuguaa

SEQ ID NO: 1703601 - RNA, 20 nt, Homo sapiens
auuuguaauugaacuuaucc

SEQ ID NO: 1703602 - RNA, 17 nt, Homo sapiens
auuugucauucauucaa

SEQ ID NO: 1703603 - RNA, 19 nt, Homo sapiens
auuugugucaaugggcaau

SEQ ID NO: 1703604 - RNA, 15 nt, Homo sapiens
auuugugucacaaag

SEQ ID NO: 1703605 - RNA, 16 nt, Homo sapiens
auuugugucacaaaga

SEQ ID NO: 1703606 - RNA, 18 nt, Homo sapiens
auuuguuaaaauuaucaa

SEQ ID NO: 1703607 - RNA, 14 nt, Homo sapiens
auuuuaaaaacaua

SEQ ID NO: 1703608 - RNA, 23 nt, Homo sapiens
auuuuaauuuuuuuuaguauuua

SEQ ID NO: 1703609 - RNA, 18 nt, Homo sapiens
auuuuacuaccaaugcca

SEQ ID NO: 1703610 - RNA, 20 nt, Homo sapiens
auuuuaggagcuaaggcucu

SEQ ID NO: 1703611 - RNA, 18 nt, Homo sapiens
auuuuauaacagaauuaa

SEQ ID NO: 1703612 - RNA, 16 nt, Homo sapiens
auuuuauuuuacuauu

SEQ ID NO: 1703613 - RNA, 19 nt, Homo sapiens
auuuucaagaaacugagga

SEQ ID NO: 1703614 - RNA, 22 nt, Homo sapiens
auuuucacaggugugguguaau

SEQ ID NO: 1703615 - RNA, 22 nt, Homo sapiens
auuuucauguucuugcagucau

SEQ ID NO: 1703616 - RNA, 21 nt, Homo sapiens
auuuucuagauuuucuacuuu

SEQ ID NO: 1703617 - RNA, 19 nt, Homo sapiens
auuuucuggaauacaugaa

SEQ ID NO: 1703618 - RNA, 17 nt, Homo sapiens
auuuucuuuacagguau

SEQ ID NO: 1703619 - RNA, 17 nt, Homo sapiens
auuuugagaucaucagu

SEQ ID NO: 1703620 - RNA, 15 nt, Homo sapiens
auuuugaguucuaca

SEQ ID NO: 1703621 - RNA, 20 nt, Homo sapiens
auuuugaguucuacauaagu

SEQ ID NO: 1703622 - RNA, 17 nt, Homo sapiens
auuuugaugugacaaua

SEQ ID NO: 1703623 - RNA, 12 nt, Homo sapiens
auuuugcaaaua

SEQ ID NO: 1703624 - RNA, 19 nt, Homo sapiens
auuuuggcgcuauuacaaa

SEQ ID NO: 1703625 - RNA, 19 nt, Homo sapiens
auuuugggguuguguuguc

SEQ ID NO: 1703626 - RNA, 19 nt, Homo sapiens
auuuuguaacgaagacaca

SEQ ID NO: 1703627 - RNA, 21 nt, Homo sapiens
auuuuguagaauaaggaacaa

SEQ ID NO: 1703628 - RNA, 23 nt, Homo sapiens
auuuugucugcuuaguaucucau

SEQ ID NO: 1703629 - RNA, 23 nt, Homo sapiens
auuuuugaaaaaaguacauauuu

SEQ ID NO: 1703630 - RNA, 20 nt, Homo sapiens
auuuuuuaagguaacaaaua

SEQ ID NO: 1703631 - RNA, 15 nt, Homo sapiens
auuuuuuagugcauc

SEQ ID NO: 1703632 - RNA, 20 nt, Homo sapiens
auuuuuuuuaacauuccaau

SEQ ID NO: 1703633 - RNA, 13 nt, Homo sapiens
auuuuuuuuacau

SEQ ID NO: 1703634 - RNA, 16 nt, Homo sapiens
caaaaacguaucuccu

SEQ ID NO: 1703635 - RNA, 22 nt, Homo sapiens
caaaaaucuguguaacuguaaa

SEQ ID NO: 1703636 - RNA, 21 nt, Homo sapiens
caaaaaugaagcugcucugaa

SEQ ID NO: 1703637 - RNA, 19 nt, Homo sapiens
caaaaauggauauuauuag

SEQ ID NO: 1703638 - RNA, 19 nt, Homo sapiens
caaaacacucggcauuuca

SEQ ID NO: 1703639 - RNA, 13 nt, Homo sapiens
caaaacacugugg

SEQ ID NO: 1703640 - RNA, 18 nt, Homo sapiens
caaaaccacuagaacucu

SEQ ID NO: 1703641 - RNA, 19 nt, Homo sapiens
caaaacccaugcauuucau

SEQ ID NO: 1703642 - RNA, 16 nt, Homo sapiens
caaaagaugccauuca

SEQ ID NO: 1703643 - RNA, 14 nt, Homo sapiens
caaaagcaguaaau

SEQ ID NO: 1703644 - RNA, 20 nt, Homo sapiens
caaaagcaguaaauuugcua

SEQ ID NO: 1703645 - RNA, 16 nt, Homo sapiens
caaaagccuuguguau

SEQ ID NO: 1703646 - RNA, 18 nt, Homo sapiens
caaaagcuagacagaucc

SEQ ID NO: 1703647 - RNA, 18 nt, Homo sapiens
caaaaggagagacuccca

SEQ ID NO: 1703648 - RNA, 21 nt, Homo sapiens
caaaagucaccacuccauucc

SEQ ID NO: 1703649 - RNA, 17 nt, Homo sapiens
caaaauagucuucucaa

SEQ ID NO: 1703650 - RNA, 23 nt, Homo sapiens
caaaauagucuucucaaauuaga

SEQ ID NO: 1703651 - RNA, 15 nt, Homo sapiens
caaaauccaaaaaga

SEQ ID NO: 1703652 - RNA, 15 nt, Homo sapiens
caaaaugauuuugaa

SEQ ID NO: 1703653 - RNA, 13 nt, Homo sapiens
caaaaugcagcuu

SEQ ID NO: 1703654 - RNA, 14 nt, Homo sapiens
caaacaaugugcug

SEQ ID NO: 1703655 - RNA, 16 nt, Homo sapiens
caaaccacaacugaca

SEQ ID NO: 1703656 - RNA, 23 nt, Homo sapiens
caaacuggggccuccagaacuca

SEQ ID NO: 1703657 - RNA, 18 nt, Homo sapiens
caaacugugaagcauuua

SEQ ID NO: 1703658 - RNA, 15 nt, Homo sapiens
caaacuugcuuuaug

SEQ ID NO: 1703659 - RNA, 16 nt, Homo sapiens
caaacuuuuauacucu

SEQ ID NO: 1703660 - RNA, 18 nt, Homo sapiens
caaagaaugggcuugaaa

SEQ ID NO: 1703661 - RNA, 14 nt, Homo sapiens
ccuuuuaaaacacu

SEQ ID NO: 1703662 - RNA, 23 nt, Homo sapiens
ccuuuuuucaaaauccaaaaaga

SEQ ID NO: 1703663 - RNA, 16 nt, Homo sapiens
ccuuuuuuguuauuau

SEQ ID NO: 1703664 - RNA, 16 nt, Homo sapiens
cgaaggugcuggaggu

SEQ ID NO: 1703665 - RNA, 21 nt, Homo sapiens
cgaauauuuucaguaauguua

SEQ ID NO: 1703666 - RNA, 17 nt, Homo sapiens
cgaaucuacuaauucca

SEQ ID NO: 1703667 - RNA, 17 nt, Homo sapiens
cgaauucgcuguuaccg

SEQ ID NO: 1703668 - RNA, 19 nt, Homo sapiens
cgaccacuuccaggggaac

SEQ ID NO: 1703669 - RNA, 13 nt, Homo sapiens
cgaccagacaccu

SEQ ID NO: 1703670 - RNA, 18 nt, Homo sapiens
cgaccagaggagccuuuu

SEQ ID NO: 1703671 - RNA, 14 nt, Homo sapiens
cgagaccccggcuu

SEQ ID NO: 1703672 - RNA, 23 nt, Homo sapiens
cuacaucuucugccuuagucuca

SEQ ID NO: 1703673 - RNA, 15 nt, Homo sapiens
cuacauugugcugca

SEQ ID NO: 1703674 - RNA, 17 nt, Homo sapiens
cuacccaaacccuaggu

SEQ ID NO: 1703675 - RNA, 17 nt, Homo sapiens
cuacccaugacuuuaua

SEQ ID NO: 1703676 - RNA, 21 nt, Homo sapiens
cuacuccccagaccucaggga

SEQ ID NO: 1703677 - RNA, 14 nt, Homo sapiens
cuacugagccuuca

SEQ ID NO: 1703678 - RNA, 13 nt, Homo sapiens
cuagaaacccaag

SEQ ID NO: 1703679 - RNA, 16 nt, Homo sapiens
cuagaaaucuauuuau

SEQ ID NO: 1703680 - RNA, 17 nt, Homo sapiens
cuagaacacuaacucac

SEQ ID NO: 1703681 - RNA, 23 nt, Homo sapiens
cuagacguucauuugugugcuca

SEQ ID NO: 1703682 - RNA, 20 nt, Homo sapiens
cuagacuauuaggugcaauu

SEQ ID NO: 1703683 - RNA, 19 nt, Homo sapiens
cuagacucuucacuguuag

SEQ ID NO: 1703684 - RNA, 17 nt, Homo sapiens
cuagaguccucacuccc

SEQ ID NO: 1703685 - RNA, 15 nt, Homo sapiens
cuagaugagcccagc

SEQ ID NO: 1703686 - RNA, 23 nt, Homo sapiens
cuagcaaauggcagaaccaaagc

SEQ ID NO: 1703687 - RNA, 18 nt, Homo sapiens
cuagcccucucacauuua

SEQ ID NO: 1703688 - RNA, 15 nt, Homo sapiens
cuagcugugcaagac

SEQ ID NO: 1703689 - RNA, 18 nt, Homo sapiens
cuaggcugcccacucucc

SEQ ID NO: 1703690 - RNA, 19 nt, Homo sapiens
cuagggauucaggcugcuu

SEQ ID NO: 1703691 - RNA, 17 nt, Homo sapiens
cuagguaggggcccacu

SEQ ID NO: 1703692 - RNA, 15 nt, Homo sapiens
cuagguuucaaagau

SEQ ID NO: 1703693 - RNA, 19 nt, Homo sapiens
cuaguacugccccccauga

SEQ ID NO: 1703694 - RNA, 17 nt, Homo sapiens
cuaguggcucucaguua

SEQ ID NO: 1703695 - RNA, 16 nt, Homo sapiens
cuaguggucuuuguaa

SEQ ID NO: 1703696 - RNA, 16 nt, Homo sapiens
cuagugucuuuugccu

SEQ ID NO: 1703697 - RNA, 17 nt, Homo sapiens
cuaguuaggagcccacc

SEQ ID NO: 1703698 - RNA, 13 nt, Homo sapiens
cuaguucuaccuc

SEQ ID NO: 1703699 - RNA, 23 nt, Homo sapiens
cuaguuugcucauacuacauuga

SEQ ID NO: 1703700 - RNA, 19 nt, Homo sapiens
cuauaaagaagaacuugca

SEQ ID NO: 1703701 - RNA, 22 nt, Homo sapiens
cuauaacuugaugcaugugguu

SEQ ID NO: 1703702 - RNA, 14 nt, Homo sapiens
cuauaaucugucaa

SEQ ID NO: 1703703 - RNA, 9 nt, Homo sapiens
cuauacuug

SEQ ID NO: 1703704 - RNA, 14 nt, Homo sapiens
cuauacuugaacaa

SEQ ID NO: 1703705 - RNA, 23 nt, Homo sapiens
cuauagaaacaccaguaccugaa

SEQ ID NO: 1703706 - RNA, 18 nt, Homo sapiens
cuauagccuaggugacag

SEQ ID NO: 1703707 - RNA, 18 nt, Homo sapiens
cuauauguaguauaaaga

SEQ ID NO: 1703708 - RNA, 12 nt, Homo sapiens
cuauauuugcuu

SEQ ID NO: 1703709 - RNA, 18 nt, Homo sapiens
cuauccaccacugcuuaa

SEQ ID NO: 1703710 - RNA, 18 nt, Homo sapiens
cuaucuaucuuccaaaug

SEQ ID NO: 1703711 - RNA, 23 nt, Homo sapiens
cuaucuccugacagaaggugcca

SEQ ID NO: 1703712 - RNA, 13 nt, Homo sapiens
cuaugaacaacuc

SEQ ID NO: 1703713 - RNA, 16 nt, Homo sapiens
cuauggaaucaauuca

SEQ ID NO: 1703714 - RNA, 15 nt, Homo sapiens
cuaugggggcacuga

SEQ ID NO: 1703715 - RNA, 13 nt, Homo sapiens
cuaugugauuaca

SEQ ID NO: 1703716 - RNA, 14 nt, Homo sapiens
cuaugugauuacaa

SEQ ID NO: 1703717 - RNA, 21 nt, Homo sapiens
cuaugugcacugauauggguu

SEQ ID NO: 1703718 - RNA, 13 nt, Homo sapiens
cuaugugccccag

SEQ ID NO: 1703719 - RNA, 22 nt, Homo sapiens
cuauuaaagugcuaagguucua

SEQ ID NO: 1703720 - RNA, 23 nt, Homo sapiens
cuauuaggugcaauuucaagguu

SEQ ID NO: 1703721 - RNA, 18 nt, Homo sapiens
cuauuauaaaacuugaau

SEQ ID NO: 1703722 - RNA, 14 nt, Homo sapiens
cuauucagaauuga

SEQ ID NO: 1703723 - RNA, 14 nt, Homo sapiens
cuauuccaaaaagg

SEQ ID NO: 1703724 - RNA, 14 nt, Homo sapiens
cuauuccaaagugc

SEQ ID NO: 1703725 - RNA, 16 nt, Homo sapiens
cuauuccuucuggccu

SEQ ID NO: 1703726 - RNA, 18 nt, Homo sapiens
cuauucucaaaguuuccu

SEQ ID NO: 1703727 - RNA, 16 nt, Homo sapiens
cuauucugagaaaaca

SEQ ID NO: 1703728 - RNA, 19 nt, Homo sapiens
cuauuuauauguacaugag

SEQ ID NO: 1703729 - RNA, 14 nt, Homo sapiens
cuauuuguuuucau

SEQ ID NO: 1703730 - RNA, 21 nt, Homo sapiens
cuauuuuuguuaagcgugucu

SEQ ID NO: 1703731 - RNA, 21 nt, Homo sapiens
cucaaauguucuaaguuucua

SEQ ID NO: 1703732 - RNA, 21 nt, Homo sapiens
cucaaccuccuguggaaccca

SEQ ID NO: 1703733 - RNA, 14 nt, Homo sapiens
cucaagguuuuagg

SEQ ID NO: 1703734 - RNA, 15 nt, Homo sapiens
cucaaugcacugaca

SEQ ID NO: 1703735 - RNA, 12 nt, Homo sapiens
cucaauguuuga

SEQ ID NO: 1703736 - RNA, 16 nt, Homo sapiens
cucacagaacuaugua

SEQ ID NO: 1703737 - RNA, 14 nt, Homo sapiens
cucacagagugcau

SEQ ID NO: 1703738 - RNA, 21 nt, Homo sapiens
cucacagagugcauugugagg

SEQ ID NO: 1703739 - RNA, 15 nt, Homo sapiens
cucacauaucuguca

SEQ ID NO: 1703740 - RNA, 15 nt, Homo sapiens
cucaccagccccacu

SEQ ID NO: 1703741 - RNA, 20 nt, Homo sapiens
cucaccagccccacugccag

SEQ ID NO: 1703742 - RNA, 20 nt, Homo sapiens
cucaccuccaugacagcgcu

SEQ ID NO: 1703743 - RNA, 15 nt, Homo sapiens
cucacucccagucca

SEQ ID NO: 1703744 - RNA, 17 nt, Homo sapiens
cucacuguugaauuuuc

SEQ ID NO: 1703745 - RNA, 23 nt, Homo sapiens
cucagaauauugcuuuggucaua

SEQ ID NO: 1703746 - RNA, 20 nt, Homo sapiens
cucagaauugaucauuuucc

SEQ ID NO: 1703747 - RNA, 14 nt, Homo sapiens
cucagagaugugca

SEQ ID NO: 1703748 - RNA, 18 nt, Homo sapiens
cucagagguagggcugcc

SEQ ID NO: 1703749 - RNA, 18 nt, Homo sapiens
cucagaucaguguaccau

SEQ ID NO: 1703750 - RNA, 23 nt, Homo sapiens
cucagccacacccaggcacuuaa

SEQ ID NO: 1703751 - RNA, 20 nt, Homo sapiens
cucagcucggggagccuuag

SEQ ID NO: 1703752 - RNA, 17 nt, Homo sapiens
cucaggacugcaacagg

SEQ ID NO: 1703753 - RNA, 21 nt, Homo sapiens
cucaggggugauaacucagga

SEQ ID NO: 1703754 - RNA, 14 nt, Homo sapiens
cucagggugcagag

SEQ ID NO: 1703755 - RNA, 16 nt, Homo sapiens
cucagguagauuuugu

SEQ ID NO: 1703756 - RNA, 12 nt, Homo sapiens
cucaguccuccc

SEQ ID NO: 1703757 - RNA, 13 nt, Homo sapiens
cucaguccucccc

SEQ ID NO: 1703758 - RNA, 23 nt, Homo sapiens
cucagugcagcaauauauuacca

SEQ ID NO: 1703759 - RNA, 11 nt, Homo sapiens
cucagugccac

SEQ ID NO: 1703760 - RNA, 17 nt, Homo sapiens
cucaguucccucuugcu

SEQ ID NO: 1703761 - RNA, 13 nt, Homo sapiens
cucauaguauggu

SEQ ID NO: 1703762 - RNA, 19 nt, Homo sapiens
cucauaugcauguagucac

SEQ ID NO: 1703763 - RNA, 14 nt, Homo sapiens
cucaucaacaaaga

SEQ ID NO: 1703764 - RNA, 22 nt, Homo sapiens
cucaucaacaaagaaauauuau

SEQ ID NO: 1703765 - RNA, 13 nt, Homo sapiens
cucaucaaucaaa

SEQ ID NO: 1703766 - RNA, 20 nt, Homo sapiens
cucauccaggcuaccauccg

SEQ ID NO: 1703767 - RNA, 14 nt, Homo sapiens
cucaucccaugaga

SEQ ID NO: 1703768 - RNA, 15 nt, Homo sapiens
cucaugaccuugaaa

SEQ ID NO: 1703769 - RNA, 17 nt, Homo sapiens
cucauguguuugcauaa

SEQ ID NO: 1703770 - RNA, 20 nt, Homo sapiens
cucauuacucuuaaggaaua

SEQ ID NO: 1703771 - RNA, 10 nt, Homo sapiens
cucauuccac

SEQ ID NO: 1703772 - RNA, 16 nt, Homo sapiens
cucauuccaccuuccc

SEQ ID NO: 1703773 - RNA, 18 nt, Homo sapiens
cucauuccuguagucaaa

SEQ ID NO: 1703774 - RNA, 21 nt, Homo sapiens
auguuuucuagucacuuccuc

SEQ ID NO: 1703775 - RNA, 19 nt, Homo sapiens
auguuuuuaugauaucccu

SEQ ID NO: 1703776 - RNA, 15 nt, Homo sapiens
auuaaaacuucuuaa

SEQ ID NO: 1703777 - RNA, 19 nt, Homo sapiens
auuaaauaguuauauaauu

SEQ ID NO: 1703778 - RNA, 14 nt, Homo sapiens
auuaaauucacaaa

SEQ ID NO: 1703779 - RNA, 23 nt, Homo sapiens
auuaacaugcuuaugacaaugac

SEQ ID NO: 1703780 - RNA, 18 nt, Homo sapiens
auuaacuuuaauucucuu

SEQ ID NO: 1703781 - RNA, 21 nt, Homo sapiens
auuaagcagaaauccugcaau

SEQ ID NO: 1703782 - RNA, 20 nt, Homo sapiens
auuaauaaagauggcacuuu

SEQ ID NO: 1703783 - RNA, 22 nt, Homo sapiens
auuaaucacaaauuucacuuau

SEQ ID NO: 1703784 - RNA, 12 nt, Homo sapiens
auuaaugaacua

SEQ ID NO: 1703785 - RNA, 16 nt, Homo sapiens
auuaauugacaaugac

SEQ ID NO: 1703786 - RNA, 17 nt, Homo sapiens
auuaauugacaaugacc

SEQ ID NO: 1703787 - RNA, 19 nt, Homo sapiens
auuaauuguuuugcacuuu

SEQ ID NO: 1703788 - RNA, 21 nt, Homo sapiens
auuaccacucaggcauuugac

SEQ ID NO: 1703789 - RNA, 23 nt, Homo sapiens
auuacuacuuaccauuugcuacu

SEQ ID NO: 1703790 - RNA, 22 nt, Homo sapiens
auuagaagccugcagaauccag

SEQ ID NO: 1703791 - RNA, 13 nt, Homo sapiens
auuagcugugauu

SEQ ID NO: 1703792 - RNA, 12 nt, Homo sapiens
auuauacagaua

SEQ ID NO: 1703793 - RNA, 21 nt, Homo sapiens
auuauagaauucuguacuuga

SEQ ID NO: 1703794 - RNA, 23 nt, Homo sapiens
auuauauuugugugaaaauguga

SEQ ID NO: 1703795 - RNA, 20 nt, Homo sapiens
auuauucuuguaguuuaccu

SEQ ID NO: 1703796 - RNA, 22 nt, Homo sapiens
auuauuuuuauuuuuaaacagg

SEQ ID NO: 1703797 - RNA, 21 nt, Homo sapiens
auucaaaguuaaaagcaaaca

SEQ ID NO: 1703798 - RNA, 19 nt, Homo sapiens
auucaauuuuaaagacuca

SEQ ID NO: 1703799 - RNA, 17 nt, Homo sapiens
auucacaaaauuuccac

SEQ ID NO: 1703800 - RNA, 20 nt, Homo sapiens
auucacaauaaaagcuuaaa

SEQ ID NO: 1703801 - RNA, 14 nt, Homo sapiens
auucacaguaauau

SEQ ID NO: 1703802 - RNA, 21 nt, Homo sapiens
auucacaguaauaugguuccc

SEQ ID NO: 1703803 - RNA, 16 nt, Homo sapiens
auucagagagcagcuu

SEQ ID NO: 1703804 - RNA, 16 nt, Homo sapiens
auucaggauuacaugc

SEQ ID NO: 1703805 - RNA, 21 nt, Homo sapiens
auucagguauaaggcagggug

SEQ ID NO: 1703806 - RNA, 14 nt, Homo sapiens
auucaggugaaaau

SEQ ID NO: 1703807 - RNA, 21 nt, Homo sapiens
auucauaaaaacugcuuacuu

SEQ ID NO: 1703808 - RNA, 22 nt, Homo sapiens
auucauaaccaaacacaaugau

SEQ ID NO: 1703809 - RNA, 20 nt, Homo sapiens
auucauggaccacuguuucu

SEQ ID NO: 1703810 - RNA, 18 nt, Homo sapiens
auucauuagcugugauuu

SEQ ID NO: 1703811 - RNA, 19 nt, Homo sapiens
auucauucugcauugcuag

SEQ ID NO: 1703812 - RNA, 22 nt, Homo sapiens
auucauugaucaaauauuucaa

SEQ ID NO: 1703813 - RNA, 13 nt, Homo sapiens
auucauuuaguga

SEQ ID NO: 1703814 - RNA, 20 nt, Homo sapiens
auuccaagacucuagagucc

SEQ ID NO: 1703815 - RNA, 14 nt, Homo sapiens
auuccacacuacca

SEQ ID NO: 1703816 - RNA, 18 nt, Homo sapiens
auuccacacuaccacauu

SEQ ID NO: 1703817 - RNA, 20 nt, Homo sapiens
auuccaggggucguuugcuu

SEQ ID NO: 1703818 - RNA, 12 nt, Homo sapiens
auuccauugccu

SEQ ID NO: 1703819 - RNA, 14 nt, Homo sapiens
auucccaagcuuuu

SEQ ID NO: 1703820 - RNA, 18 nt, Homo sapiens
auucccaagcuuuuggag

SEQ ID NO: 1703821 - RNA, 23 nt, Homo sapiens
auucccaucuuuacucccaagac

SEQ ID NO: 1703822 - RNA, 20 nt, Homo sapiens
auucccucccaucaugcccg

SEQ ID NO: 1703823 - RNA, 20 nt, Homo sapiens
auuccggauccuaagcaucu

SEQ ID NO: 1703824 - RNA, 20 nt, Homo sapiens
auuccuacagcacuacuggg

SEQ ID NO: 1703825 - RNA, 15 nt, Homo sapiens
auuccuuagucucaa

SEQ ID NO: 1703826 - RNA, 16 nt, Homo sapiens
auuccuuugucuucaa

SEQ ID NO: 1703827 - RNA, 14 nt, Homo sapiens
auucucacuccuac

SEQ ID NO: 1703828 - RNA, 22 nt, Homo sapiens
auucuuacacugccuguauacu

SEQ ID NO: 1703829 - RNA, 15 nt, Homo sapiens
auucuuagugacuuu

SEQ ID NO: 1703830 - RNA, 20 nt, Homo sapiens
auucuuauuuaaguuauuga

SEQ ID NO: 1703831 - RNA, 19 nt, Homo sapiens
auucuucaaccucauugac

SEQ ID NO: 1703832 - RNA, 22 nt, Homo sapiens
auucuucagauacaaacugcag

SEQ ID NO: 1703833 - RNA, 21 nt, Homo sapiens
auucuucagcguaaaauggug

SEQ ID NO: 1703834 - RNA, 15 nt, Homo sapiens
auucuuguaguuuac

SEQ ID NO: 1703835 - RNA, 14 nt, Homo sapiens
auugaaaauaugau

SEQ ID NO: 1703836 - RNA, 19 nt, Homo sapiens
auugaaauguuugcauaaa

SEQ ID NO: 1703837 - RNA, 21 nt, Homo sapiens
auugaaugauuacuauaugca

SEQ ID NO: 1703838 - RNA, 14 nt, Homo sapiens
auugaaugugauuu

SEQ ID NO: 1703839 - RNA, 21 nt, Homo sapiens
auugaauguuuccaaccugga

SEQ ID NO: 1703840 - RNA, 22 nt, Homo sapiens
auugaccgcgacuaauuucaaa

SEQ ID NO: 1703841 - RNA, 14 nt, Homo sapiens
auugaggcuuugug

SEQ ID NO: 1703842 - RNA, 24 nt, Homo sapiens
auugaucauaaacugacuaucaua

SEQ ID NO: 1703843 - RNA, 12 nt, Homo sapiens
auugauguugcu

SEQ ID NO: 1703844 - RNA, 13 nt, Homo sapiens
auugauguugcug

SEQ ID NO: 1703845 - RNA, 13 nt, Homo sapiens
auugcaauaacug

SEQ ID NO: 1703846 - RNA, 12 nt, Homo sapiens
auugcaugacuu

SEQ ID NO: 1703847 - RNA, 16 nt, Homo sapiens
auugccuagcucuuuu

SEQ ID NO: 1703848 - RNA, 16 nt, Homo sapiens
auugcgugauucaaug

SEQ ID NO: 1703849 - RNA, 15 nt, Homo sapiens
auugcuagauaaaag

SEQ ID NO: 1703850 - RNA, 15 nt, Homo sapiens
auugcuaguuuauuu

SEQ ID NO: 1703851 - RNA, 14 nt, Homo sapiens
auugcuaugaauga

SEQ ID NO: 1703852 - RNA, 20 nt, Homo sapiens
auugcugauuuuaauggauu

SEQ ID NO: 1703853 - RNA, 15 nt, Homo sapiens
auugcuugugccaca

SEQ ID NO: 1703854 - RNA, 13 nt, Homo sapiens
auuggaaauggau

SEQ ID NO: 1703855 - RNA, 12 nt, Homo sapiens
auuggcacugug

SEQ ID NO: 1703856 - RNA, 19 nt, Homo sapiens
auuggccugguauggcugc

SEQ ID NO: 1703857 - RNA, 19 nt, Homo sapiens
auuggucuaauuuauucaa

SEQ ID NO: 1703858 - RNA, 13 nt, Homo sapiens
auuguaacgacuu

SEQ ID NO: 1703859 - RNA, 15 nt, Homo sapiens
gggucaaagugcggc

SEQ ID NO: 1703860 - RNA, 20 nt, Homo sapiens
gggucuuguuucacauuugu

SEQ ID NO: 1703861 - RNA, 16 nt, Homo sapiens
gggucuuugaacccuu

SEQ ID NO: 1703862 - RNA, 18 nt, Homo sapiens
gggugacccugaagugag

SEQ ID NO: 1703863 - RNA, 17 nt, Homo sapiens
ggguggagcaugggccu

SEQ ID NO: 1703864 - RNA, 13 nt, Homo sapiens
ggguucacugcaa

SEQ ID NO: 1703865 - RNA, 23 nt, Homo sapiens
ggguuuuuguucuggaagccaua

SEQ ID NO: 1703866 - RNA, 15 nt, Homo sapiens
gguaccaagcauuua

SEQ ID NO: 1703867 - RNA, 20 nt, Homo sapiens
gguagaggcugggggcucca

SEQ ID NO: 1703868 - RNA, 15 nt, Homo sapiens
gguagccuccuaucc

SEQ ID NO: 1703869 - RNA, 21 nt, Homo sapiens
gguagcuuaccugacacaaga

SEQ ID NO: 1703870 - RNA, 20 nt, Homo sapiens
ggcauggcccugggguccca

SEQ ID NO: 1703871 - RNA, 14 nt, Homo sapiens
ggccacaacagggc

SEQ ID NO: 1703872 - RNA, 17 nt, Homo sapiens
ggccaccagccacuuua

SEQ ID NO: 1703873 - RNA, 24 nt, Homo sapiens
ggccagagccaagaaacacuuuca

SEQ ID NO: 1703874 - RNA, 18 nt, Homo sapiens
ggccagagggagugacag

SEQ ID NO: 1703875 - RNA, 19 nt, Homo sapiens
ggccagggcugcccugaga

SEQ ID NO: 1703876 - RNA, 18 nt, Homo sapiens
ggccaggggaguuuccaa

SEQ ID NO: 1703877 - RNA, 23 nt, Homo sapiens
ggccagggucugugugaaugugg

SEQ ID NO: 1703878 - RNA, 11 nt, Homo sapiens
ggccaguguga

SEQ ID NO: 1703879 - RNA, 12 nt, Homo sapiens
ggccauacuucu

SEQ ID NO: 1703880 - RNA, 17 nt, Homo sapiens
guacacaauaagcaaaa

SEQ ID NO: 1703881 - RNA, 22 nt, Homo sapiens
guacacuuuuaugagcuuccaa

SEQ ID NO: 1703882 - RNA, 19 nt, Homo sapiens
guacaggaaugaaccuucu

SEQ ID NO: 1703883 - RNA, 23 nt, Homo sapiens
guacagucuguaucaaacccacg

SEQ ID NO: 1703884 - RNA, 22 nt, Homo sapiens
guacauaucacgcgcacagccu

SEQ ID NO: 1703885 - RNA, 23 nt, Homo sapiens
guacaugauaaaugauagacaau

SEQ ID NO: 1703886 - RNA, 21 nt, Homo sapiens
guacauuggcugguaacaguu

SEQ ID NO: 1703887 - RNA, 19 nt, Homo sapiens
guacauuuaaaauugcuau

SEQ ID NO: 1703888 - RNA, 13 nt, Homo sapiens
guaccaagcauuu

SEQ ID NO: 1703889 - RNA, 12 nt, Homo sapiens
guacucaaugga

SEQ ID NO: 1703890 - RNA, 20 nt, Homo sapiens
guacuugugaaacacagcug

SEQ ID NO: 1703891 - RNA, 18 nt, Homo sapiens
guacuugugaccauugua

SEQ ID NO: 1703892 - RNA, 15 nt, Homo sapiens
guagaauugcauuga

SEQ ID NO: 1703893 - RNA, 18 nt, Homo sapiens
guagagguuuuguuguuu

SEQ ID NO: 1703894 - RNA, 17 nt, Homo sapiens
guagcagggaguaccca

SEQ ID NO: 1703895 - RNA, 16 nt, Homo sapiens
guagccugugcaugua

SEQ ID NO: 1703896 - RNA, 14 nt, Homo sapiens
guagcgccagugua

SEQ ID NO: 1703897 - RNA, 16 nt, Homo sapiens
guagcuacaggacauu

SEQ ID NO: 1703898 - RNA, 10 nt, Homo sapiens
guagcucucc

SEQ ID NO: 1703899 - RNA, 17 nt, Homo sapiens
guagcuugcucccugug

SEQ ID NO: 1703900 - RNA, 21 nt, Homo sapiens
guaggcuuuguauucaaaaau

SEQ ID NO: 1703901 - RNA, 20 nt, Homo sapiens
guagugaaauuauacagaua

SEQ ID NO: 1703902 - RNA, 21 nt, Homo sapiens
guaguuuuuacagcuguguua

SEQ ID NO: 1703903 - RNA, 12 nt, Homo sapiens
guauaaacauua

SEQ ID NO: 1703904 - RNA, 15 nt, Homo sapiens
guauaaacuaucagu

SEQ ID NO: 1703905 - RNA, 16 nt, Homo sapiens
guauaagcacugaaaa

SEQ ID NO: 1703906 - RNA, 22 nt, Homo sapiens
guauaagcacugaaaaacaaca

SEQ ID NO: 1703907 - RNA, 11 nt, Homo sapiens
guauacuauag

SEQ ID NO: 1703908 - RNA, 15 nt, Homo sapiens
guauauauacauaca

SEQ ID NO: 1703909 - RNA, 15 nt, Homo sapiens
guaucaaacccacga

SEQ ID NO: 1703910 - RNA, 16 nt, Homo sapiens
guaucaacacuguuac

SEQ ID NO: 1703911 - RNA, 14 nt, Homo sapiens
guaucaguguuuua

SEQ ID NO: 1703912 - RNA, 17 nt, Homo sapiens
guaucuuccauauuugg

SEQ ID NO: 1703913 - RNA, 18 nt, Homo sapiens
guaucuuugcacuccaau

SEQ ID NO: 1703914 - RNA, 23 nt, Homo sapiens
guaucuuuugaacuggcaauugu

SEQ ID NO: 1703915 - RNA, 20 nt, Homo sapiens
guauggaaaaaccauuugaa

SEQ ID NO: 1703916 - RNA, 19 nt, Homo sapiens
guaugucuuggacacugua

SEQ ID NO: 1703917 - RNA, 16 nt, Homo sapiens
guauuggaaauggaug

SEQ ID NO: 1703918 - RNA, 19 nt, Homo sapiens
guauuugaaaacucacaga

SEQ ID NO: 1703919 - RNA, 21 nt, Homo sapiens
gucaaaacacuguggaacuaa

SEQ ID NO: 1703920 - RNA, 15 nt, Homo sapiens
gucaacaacuuacac

SEQ ID NO: 1703921 - RNA, 23 nt, Homo sapiens
gucaagaagaaaaagguuugcau

SEQ ID NO: 1703922 - RNA, 18 nt, Homo sapiens
gucaagugggaucuguca

SEQ ID NO: 1703923 - RNA, 19 nt, Homo sapiens
gucacagccuccucugucu

SEQ ID NO: 1703924 - RNA, 21 nt, Homo sapiens
gucacagggccaacuugaggg

SEQ ID NO: 1703925 - RNA, 11 nt, Homo sapiens
gucacaugacc

SEQ ID NO: 1703926 - RNA, 15 nt, Homo sapiens
gucaccuuccaggac

SEQ ID NO: 1703927 - RNA, 17 nt, Homo sapiens
gucaccuucccuugcca

SEQ ID NO: 1703928 - RNA, 16 nt, Homo sapiens
gucacggccaagugua

SEQ ID NO: 1703929 - RNA, 16 nt, Homo sapiens
gucacguacugucuga

SEQ ID NO: 1703930 - RNA, 23 nt, Homo sapiens
gucaggaacagaaggaugaauga

SEQ ID NO: 1703931 - RNA, 13 nt, Homo sapiens
gucaggacuguga

SEQ ID NO: 1703932 - RNA, 14 nt, Homo sapiens
gucaggacugugac

SEQ ID NO: 1703933 - RNA, 21 nt, Homo sapiens
gucaguauuucaguguaguua

SEQ ID NO: 1703934 - RNA, 14 nt, Homo sapiens
gucaucaucacauu

SEQ ID NO: 1703935 - RNA, 15 nt, Homo sapiens
gucaucgggccagaa

SEQ ID NO: 1703936 - RNA, 21 nt, Homo sapiens
gucaugcauaaauaugcagug

SEQ ID NO: 1703937 - RNA, 14 nt, Homo sapiens
gucauucauucaag

SEQ ID NO: 1703938 - RNA, 14 nt, Homo sapiens
guccaggcacagga

SEQ ID NO: 1703939 - RNA, 13 nt, Homo sapiens
guccagugcaacc

SEQ ID NO: 1703940 - RNA, 15 nt, Homo sapiens
gucccaccugcacac

SEQ ID NO: 1703941 - RNA, 19 nt, Homo sapiens
gucccccugcuugucuuca

SEQ ID NO: 1703942 - RNA, 17 nt, Homo sapiens
guccccucaccuccucu

SEQ ID NO: 1703943 - RNA, 15 nt, Homo sapiens
guccccucauaggau

SEQ ID NO: 1703944 - RNA, 23 nt, Homo sapiens
guccccuccacugucacauugua

SEQ ID NO: 1703945 - RNA, 19 nt, Homo sapiens
gucccucccaccucuguga

SEQ ID NO: 1703946 - RNA, 13 nt, Homo sapiens
gucccucuuccau

SEQ ID NO: 1703947 - RNA, 17 nt, Homo sapiens
guccuacuaucacugaa

SEQ ID NO: 1703948 - RNA, 18 nt, Homo sapiens
guccuacucauauuccuc

SEQ ID NO: 1703949 - RNA, 15 nt, Homo sapiens
guccuacuccuugca

SEQ ID NO: 1703950 - RNA, 18 nt, Homo sapiens
guccuacucugugucagg

SEQ ID NO: 1703951 - RNA, 20 nt, Homo sapiens
guccucaccccuguccucac

SEQ ID NO: 1703952 - RNA, 14 nt, Homo sapiens
guccuggggaccau

SEQ ID NO: 1703953 - RNA, 21 nt, Homo sapiens
guccuugugaguccaucuaac

SEQ ID NO: 1703954 - RNA, 21 nt, Homo sapiens
guccuuuaauuaagacugaaa

SEQ ID NO: 1703955 - RNA, 18 nt, Homo sapiens
gucgaugcguucacucca

SEQ ID NO: 1703956 - RNA, 16 nt, Homo sapiens
gucuaaaaacaccaaa

SEQ ID NO: 1703957 - RNA, 19 nt, Homo sapiens
gucuaacuuuagaagugca

SEQ ID NO: 1703958 - RNA, 21 nt, Homo sapiens
gucuacauacuuucauccuga

SEQ ID NO: 1703959 - RNA, 14 nt, Homo sapiens
gucuagauucucug

SEQ ID NO: 1703960 - RNA, 17 nt, Homo sapiens
gucucacaguguugccc

SEQ ID NO: 1703961 - RNA, 17 nt, Homo sapiens
gucucaguggcuucauc

SEQ ID NO: 1703962 - RNA, 13 nt, Homo sapiens
gucucauuuagaa

SEQ ID NO: 1703963 - RNA, 21 nt, Homo sapiens
gucuccacugugccuuugcaa

SEQ ID NO: 1703964 - RNA, 17 nt, Homo sapiens
gucuccuacuccugacu

SEQ ID NO: 1703965 - RNA, 23 nt, Homo sapiens
gucugcuggcuucuacacugggu

SEQ ID NO: 1703966 - RNA, 17 nt, Homo sapiens
gucuggacugacagcau

SEQ ID NO: 1703967 - RNA, 18 nt, Homo sapiens
gucuuccaauuaaugcuu

SEQ ID NO: 1703968 - RNA, 14 nt, Homo sapiens
gucuuccaugaccc

SEQ ID NO: 1703969 - RNA, 20 nt, Homo sapiens
gucuucccuucugauugaug

SEQ ID NO: 1703970 - RNA, 17 nt, Homo sapiens
gucuucuggacaggcuc

SEQ ID NO: 1703971 - RNA, 18 nt, Homo sapiens
gucuuggacacuguacaa

SEQ ID NO: 1703972 - RNA, 17 nt, Homo sapiens
gucuuguugauuuccuc

SEQ ID NO: 1703973 - RNA, 17 nt, Homo sapiens
gucuuuguucugugauu

SEQ ID NO: 1703974 - RNA, 15 nt, Homo sapiens
gucuuuuauauuugu

SEQ ID NO: 1703975 - RNA, 13 nt, Homo sapiens
gugaaaaugugac

SEQ ID NO: 1703976 - RNA, 19 nt, Homo sapiens
gugaaagcacggacucuua

SEQ ID NO: 1703977 - RNA, 20 nt, Homo sapiens
gugaaaugcuggcauuugca

SEQ ID NO: 1703978 - RNA, 12 nt, Homo sapiens
gugaacaucccc

SEQ ID NO: 1703979 - RNA, 19 nt, Homo sapiens
gugaacuagggaagcucag

SEQ ID NO: 1703980 - RNA, 15 nt, Homo sapiens
gugaacugugcauag

SEQ ID NO: 1703981 - RNA, 17 nt, Homo sapiens
gugaaugaaacacucag

SEQ ID NO: 1703982 - RNA, 16 nt, Homo sapiens
gugaaugaacacucuu

SEQ ID NO: 1703983 - RNA, 12 nt, Homo sapiens
gugaaugcuucu

SEQ ID NO: 1703984 - RNA, 18 nt, Homo sapiens
gugaauggccuuccuucc

SEQ ID NO: 1703985 - RNA, 17 nt, Homo sapiens
gugaaugggacuauuca

SEQ ID NO: 1703986 - RNA, 12 nt, Homo sapiens
gugacacauaug

SEQ ID NO: 1703987 - RNA, 13 nt, Homo sapiens
gugacacauaugc

SEQ ID NO: 1703988 - RNA, 15 nt, Homo sapiens
gugacagggccagug

SEQ ID NO: 1703989 - RNA, 16 nt, Homo sapiens
gugaccccugaccuca

SEQ ID NO: 1703990 - RNA, 21 nt, Homo sapiens
gggauggccagagaugcugga

SEQ ID NO: 1703991 - RNA, 13 nt, Homo sapiens
gggcaaagaagaa

SEQ ID NO: 1703992 - RNA, 14 nt, Homo sapiens
gggcauaaacuguu

SEQ ID NO: 1703993 - RNA, 18 nt, Homo sapiens
gggcaucugccccucccc

SEQ ID NO: 1703994 - RNA, 15 nt, Homo sapiens
gggccaaaaggaaaa

SEQ ID NO: 1703995 - RNA, 19 nt, Homo sapiens
gggccagaggaacugucca

SEQ ID NO: 1703996 - RNA, 14 nt, Homo sapiens
gggccauguccaaa

SEQ ID NO: 1703997 - RNA, 14 nt, Homo sapiens
gggcccagccagcc

SEQ ID NO: 1703998 - RNA, 20 nt, Homo sapiens
gggccuagaccuggugcuga

SEQ ID NO: 1703999 - RNA, 14 nt, Homo sapiens
gggccucagacgag

SEQ ID NO: 1704000 - RNA, 15 nt, Homo sapiens
gggccugucacugau

SEQ ID NO: 1704001 - RNA, 19 nt, Homo sapiens
gggcuuaccuguacacuga

SEQ ID NO: 1704002 - RNA, 20 nt, Homo sapiens
ggggaagcggcccuaaggga

SEQ ID NO: 1704003 - RNA, 16 nt, Homo sapiens
ggggcucucagcucag

SEQ ID NO: 1704004 - RNA, 22 nt, Homo sapiens
ggggcuggccucuggcucucau

SEQ ID NO: 1704005 - RNA, 13 nt, Homo sapiens
gggggacguuucu

SEQ ID NO: 1704006 - RNA, 14 nt, Homo sapiens
ggggugcagcagug

SEQ ID NO: 1704007 - RNA, 12 nt, Homo sapiens
ggggugggccac

SEQ ID NO: 1704008 - RNA, 20 nt, Homo sapiens
ggguaaaugcaaaguucugu

SEQ ID NO: 1704009 - RNA, 19 nt, Homo sapiens
ggguaaccaaauguuggcc

SEQ ID NO: 1704010 - RNA, 17 nt, Homo sapiens
ggguacucaauggagua

SEQ ID NO: 1704011 - RNA, 22 nt, Homo sapiens
gggucaaguacaccagccaccu

SEQ ID NO: 1704012 - RNA, 12 nt, Homo sapiens
gggucgucugcc

SEQ ID NO: 1704013 - RNA, 19 nt, Homo sapiens
gggucucgcuuuguugccc

SEQ ID NO: 1704014 - RNA, 21 nt, Homo sapiens
gggucucgcuuuguugcccag

SEQ ID NO: 1704015 - RNA, 16 nt, Homo sapiens
gggugacggcccucau

SEQ ID NO: 1704016 - RNA, 14 nt, Homo sapiens
ggguggcauccagg

SEQ ID NO: 1704017 - RNA, 14 nt, Homo sapiens
gggugguacccucu

SEQ ID NO: 1704018 - RNA, 17 nt, Homo sapiens
gggugguggaaggcagc

SEQ ID NO: 1704019 - RNA, 21 nt, Homo sapiens
ggguuaguuuacaaucagcca

SEQ ID NO: 1704020 - RNA, 18 nt, Homo sapiens
ggguucugcuacucccca

SEQ ID NO: 1704021 - RNA, 23 nt, Homo sapiens
ggguugguagcagggaguaccca

SEQ ID NO: 1704022 - RNA, 14 nt, Homo sapiens
ggguuuugcuacau

SEQ ID NO: 1704023 - RNA, 13 nt, Homo sapiens
gguaaaauguauu

SEQ ID NO: 1704024 - RNA, 23 nt, Homo sapiens
gguaacuuuuuuuuaaagcucau

SEQ ID NO: 1704025 - RNA, 14 nt, Homo sapiens
gguaauuguugcua

SEQ ID NO: 1704026 - RNA, 14 nt, Homo sapiens
gguaccauggugua

SEQ ID NO: 1704027 - RNA, 18 nt, Homo sapiens
gguagcugccacuugaac

SEQ ID NO: 1704028 - RNA, 23 nt, Homo sapiens
gguaguaaauaugaaacuagggu

SEQ ID NO: 1704029 - RNA, 17 nt, Homo sapiens
gguauccugggggaccc

SEQ ID NO: 1704030 - RNA, 21 nt, Homo sapiens
ggucaagagaguucugaccug

SEQ ID NO: 1704031 - RNA, 17 nt, Homo sapiens
ggucacccucuccagca

SEQ ID NO: 1704032 - RNA, 20 nt, Homo sapiens
ggucaccggccgauggagac

SEQ ID NO: 1704033 - RNA, 19 nt, Homo sapiens
ggucaggaguucgagacca

SEQ ID NO: 1704034 - RNA, 19 nt, Homo sapiens
ggucaguaaauaacaggca

SEQ ID NO: 1704035 - RNA, 19 nt, Homo sapiens
ggucaugugggucuuccag

SEQ ID NO: 1704036 - RNA, 14 nt, Homo sapiens
gguccagugggaac

SEQ ID NO: 1704037 - RNA, 21 nt, Homo sapiens
ggucuccaagggcaucacugg

SEQ ID NO: 1704038 - RNA, 11 nt, Homo sapiens
ggucugcagcu

SEQ ID NO: 1704039 - RNA, 18 nt, Homo sapiens
ggucugugugaauguggg

SEQ ID NO: 1704040 - RNA, 14 nt, Homo sapiens
ggucugugugauga

SEQ ID NO: 1704041 - RNA, 14 nt, Homo sapiens
ggugaaagugcagu

SEQ ID NO: 1704042 - RNA, 21 nt, Homo sapiens
ggugcccagaacuucccugau

SEQ ID NO: 1704043 - RNA, 15 nt, Homo sapiens
ggugcgcucagagac

SEQ ID NO: 1704044 - RNA, 17 nt, Homo sapiens
ggugcucuuugcugcac

SEQ ID NO: 1704045 - RNA, 18 nt, Homo sapiens
ggugcucuuugcugcacu

SEQ ID NO: 1704046 - RNA, 19 nt, Homo sapiens
gguggcccuugcaguucag

SEQ ID NO: 1704047 - RNA, 15 nt, Homo sapiens
ggugguaugugacac

SEQ ID NO: 1704048 - RNA, 19 nt, Homo sapiens
ggugucacauggugccccu

SEQ ID NO: 1704049 - RNA, 13 nt, Homo sapiens
ggugucugcccug

SEQ ID NO: 1704050 - RNA, 16 nt, Homo sapiens
gguuauguaucagaag

SEQ ID NO: 1704051 - RNA, 16 nt, Homo sapiens
gguugacuuaugggcc

SEQ ID NO: 1704052 - RNA, 13 nt, Homo sapiens
gguugauccugca

SEQ ID NO: 1704053 - RNA, 16 nt, Homo sapiens
gguugauccugcaucu

SEQ ID NO: 1704054 - RNA, 18 nt, Homo sapiens
gguuggcccccacguggg

SEQ ID NO: 1704055 - RNA, 18 nt, Homo sapiens
gguuggggugacagucau

SEQ ID NO: 1704056 - RNA, 22 nt, Homo sapiens
gguugguagcagggaguaccca

SEQ ID NO: 1704057 - RNA, 15 nt, Homo sapiens
gguuucuggggucca

SEQ ID NO: 1704058 - RNA, 12 nt, Homo sapiens
guaaacaaacuc

SEQ ID NO: 1704059 - RNA, 21 nt, Homo sapiens
guaaacagauggcacuuugaa

SEQ ID NO: 1704060 - RNA, 16 nt, Homo sapiens
guaaacauguguuuua

SEQ ID NO: 1704061 - RNA, 12 nt, Homo sapiens
guaaacugccau

SEQ ID NO: 1704062 - RNA, 19 nt, Homo sapiens
guaaauccugccauuuaaa

SEQ ID NO: 1704063 - RNA, 22 nt, Homo sapiens
guaaaugaucacuccaggauau

SEQ ID NO: 1704064 - RNA, 15 nt, Homo sapiens
guaaauguccauuua

SEQ ID NO: 1704065 - RNA, 13 nt, Homo sapiens
guaacaacugugg

SEQ ID NO: 1704066 - RNA, 19 nt, Homo sapiens
guaacaacuguggucaauc

SEQ ID NO: 1704067 - RNA, 16 nt, Homo sapiens
guaacaguucauguuu

SEQ ID NO: 1704068 - RNA, 22 nt, Homo sapiens
guaacauauucuguaugaacuu

SEQ ID NO: 1704069 - RNA, 16 nt, Homo sapiens
guaaccaaauguuggc

SEQ ID NO: 1704070 - RNA, 15 nt, Homo sapiens
guaacccaaaccuca

SEQ ID NO: 1704071 - RNA, 19 nt, Homo sapiens
guaacuauuacaccaaaua

SEQ ID NO: 1704072 - RNA, 17 nt, Homo sapiens
guaacucccaucaccuc

SEQ ID NO: 1704073 - RNA, 18 nt, Homo sapiens
guaacucccaucaccucu

SEQ ID NO: 1704074 - RNA, 15 nt, Homo sapiens
guaagacucauuccc

SEQ ID NO: 1704075 - RNA, 18 nt, Homo sapiens
guaagcugauuaccugaa

SEQ ID NO: 1704076 - RNA, 13 nt, Homo sapiens
guaagugcugcua

SEQ ID NO: 1704077 - RNA, 14 nt, Homo sapiens
guaagugcugcuau

SEQ ID NO: 1704078 - RNA, 13 nt, Homo sapiens
guaauaauaccuc

SEQ ID NO: 1704079 - RNA, 16 nt, Homo sapiens
guaauaauucuaugca

SEQ ID NO: 1704080 - RNA, 13 nt, Homo sapiens
guaauauaaugga

SEQ ID NO: 1704081 - RNA, 15 nt, Homo sapiens
guaaucccaacacuu

SEQ ID NO: 1704082 - RNA, 11 nt, Homo sapiens
guaaugcugca

SEQ ID NO: 1704083 - RNA, 13 nt, Homo sapiens
guacaauaauuca

SEQ ID NO: 1704084 - RNA, 21 nt, Homo sapiens
ugacauggcucuggacucuaa

SEQ ID NO: 1704085 - RNA, 16 nt, Homo sapiens
ugacauuguauguauc

SEQ ID NO: 1704086 - RNA, 15 nt, Homo sapiens
ugacauuugcucuga

SEQ ID NO: 1704087 - RNA, 13 nt, Homo sapiens
ugaccaacugugu

SEQ ID NO: 1704088 - RNA, 17 nt, Homo sapiens
ugaccaucugcuuuuau

SEQ ID NO: 1704089 - RNA, 16 nt, Homo sapiens
ugaccccugaccucac

SEQ ID NO: 1704090 - RNA, 16 nt, Homo sapiens
ugacccuuccagacau

SEQ ID NO: 1704091 - RNA, 20 nt, Homo sapiens
ugaccucaagugaucugccc

SEQ ID NO: 1704092 - RNA, 23 nt, Homo sapiens
ugaccucagugagauauuuggua

SEQ ID NO: 1704093 - RNA, 20 nt, Homo sapiens
ugaccucucauaaauuuacu

SEQ ID NO: 1704094 - RNA, 21 nt, Homo sapiens
ugaccucuugcugucucugcu

SEQ ID NO: 1704095 - RNA, 15 nt, Homo sapiens
ugaccugagccagac

SEQ ID NO: 1704096 - RNA, 21 nt, Homo sapiens
ugaccuuggagagacacagcg

SEQ ID NO: 1704097 - RNA, 14 nt, Homo sapiens
ugacgcaaaaccac

SEQ ID NO: 1704098 - RNA, 21 nt, Homo sapiens
ugacggcccugcaauguaucc

SEQ ID NO: 1704099 - RNA, 19 nt, Homo sapiens
ugacuaauuaggcaaggcu

SEQ ID NO: 1704100 - RNA, 15 nt, Homo sapiens
ugacucaggauuuaa

SEQ ID NO: 1704101 - RNA, 13 nt, Homo sapiens
ugacuccuaccug

SEQ ID NO: 1704102 - RNA, 17 nt, Homo sapiens
ugacugaugcugagauu

SEQ ID NO: 1704103 - RNA, 21 nt, Homo sapiens
ugacugguuuacaggcccugc

SEQ ID NO: 1704104 - RNA, 21 nt, Homo sapiens
ugacuguaacauauucuguau

SEQ ID NO: 1704105 - RNA, 15 nt, Homo sapiens
ugacuguaucugugu

SEQ ID NO: 1704106 - RNA, 20 nt, Homo sapiens
ugacuuccucgccucuccca

SEQ ID NO: 1704107 - RNA, 16 nt, Homo sapiens
ugacuuugaacuaaug

SEQ ID NO: 1704108 - RNA, 18 nt, Homo sapiens
ugagaaaagccucuccag

SEQ ID NO: 1704109 - RNA, 14 nt, Homo sapiens
ugagaagccuucag

SEQ ID NO: 1704110 - RNA, 19 nt, Homo sapiens
ugagaagccuucagcucca

SEQ ID NO: 1704111 - RNA, 13 nt, Homo sapiens
ugagaaggguuga

SEQ ID NO: 1704112 - RNA, 20 nt, Homo sapiens
ugagacaguuucuuagcuuu

SEQ ID NO: 1704113 - RNA, 22 nt, Homo sapiens
ugagaccagccugggcagcaua

SEQ ID NO: 1704114 - RNA, 14 nt, Homo sapiens
ugagacucacagga

SEQ ID NO: 1704115 - RNA, 17 nt, Homo sapiens
ugagacucugucucaaa

SEQ ID NO: 1704116 - RNA, 12 nt, Homo sapiens
ugagagaccuga

SEQ ID NO: 1704117 - RNA, 13 nt, Homo sapiens
ugagagaccugag

SEQ ID NO: 1704118 - RNA, 21 nt, Homo sapiens
ugagaugcuguaggugguaug

SEQ ID NO: 1704119 - RNA, 22 nt, Homo sapiens
ugagauguguggacuguggcac

SEQ ID NO: 1704120 - RNA, 13 nt, Homo sapiens
ugagauucuucag

SEQ ID NO: 1704121 - RNA, 19 nt, Homo sapiens
ugagauuuuuuauugcuag

SEQ ID NO: 1704122 - RNA, 14 nt, Homo sapiens
ugagcaaauaucau

SEQ ID NO: 1704123 - RNA, 12 nt, Homo sapiens
ugagcaacucuu

SEQ ID NO: 1704124 - RNA, 19 nt, Homo sapiens
ugagcaacucuugauuauc

SEQ ID NO: 1704125 - RNA, 22 nt, Homo sapiens
ugagcaaggagcacaagccaca

SEQ ID NO: 1704126 - RNA, 14 nt, Homo sapiens
ugagcacacuuuag

SEQ ID NO: 1704127 - RNA, 16 nt, Homo sapiens
ugagcacccauuccaa

SEQ ID NO: 1704128 - RNA, 14 nt, Homo sapiens
ugagccgcugugag

SEQ ID NO: 1704129 - RNA, 20 nt, Homo sapiens
ugagccgugaacugugcaua

SEQ ID NO: 1704130 - RNA, 18 nt, Homo sapiens
ugagcgggaggcagaguu

SEQ ID NO: 1704131 - RNA, 20 nt, Homo sapiens
ugagcgucacggccaagugu

SEQ ID NO: 1704132 - RNA, 14 nt, Homo sapiens
ugagcuugcucauu

SEQ ID NO: 1704133 - RNA, 18 nt, Homo sapiens
ugaggaaagcacacaguc

SEQ ID NO: 1704134 - RNA, 18 nt, Homo sapiens
ugaggacagaccacagag

SEQ ID NO: 1704135 - RNA, 21 nt, Homo sapiens
ugcccagcccggaccuuggca

SEQ ID NO: 1704136 - RNA, 20 nt, Homo sapiens
ugcccaggcuggcgugcagu

SEQ ID NO: 1704137 - RNA, 19 nt, Homo sapiens
ugccccccacucugcacag

SEQ ID NO: 1704138 - RNA, 14 nt, Homo sapiens
ugccccccaugagg

SEQ ID NO: 1704139 - RNA, 16 nt, Homo sapiens
ugccccuagcuuuaua

SEQ ID NO: 1704140 - RNA, 16 nt, Homo sapiens
ugcccgcacacccuca

SEQ ID NO: 1704141 - RNA, 19 nt, Homo sapiens
ugcccucauuacugggccu

SEQ ID NO: 1704142 - RNA, 17 nt, Homo sapiens
ugcccuggauccaucag

SEQ ID NO: 1704143 - RNA, 13 nt, Homo sapiens
ugcccuuaggcca

SEQ ID NO: 1704144 - RNA, 20 nt, Homo sapiens
ugccgccuccuugugcacaa

SEQ ID NO: 1704145 - RNA, 13 nt, Homo sapiens
ugccgcugagaag

SEQ ID NO: 1704146 - RNA, 18 nt, Homo sapiens
ugccggggguucaggguu

SEQ ID NO: 1704147 - RNA, 18 nt, Homo sapiens
ugccuccuucccucgggg

SEQ ID NO: 1704148 - RNA, 20 nt, Homo sapiens
ugccucugacacacagcucu

SEQ ID NO: 1704149 - RNA, 17 nt, Homo sapiens
ugccucugccucugaca

SEQ ID NO: 1704150 - RNA, 16 nt, Homo sapiens
ugccucuuaagccugc

SEQ ID NO: 1704151 - RNA, 21 nt, Homo sapiens
ugccugaaaugcuucuguuuu

SEQ ID NO: 1704152 - RNA, 13 nt, Homo sapiens
ugccugauuagau

SEQ ID NO: 1704153 - RNA, 23 nt, Homo sapiens
ugccugccccaaacaaauaugca

SEQ ID NO: 1704154 - RNA, 21 nt, Homo sapiens
ugccuggcuucuuucucucag

SEQ ID NO: 1704155 - RNA, 19 nt, Homo sapiens
ugccuggugaauggccuuc

SEQ ID NO: 1704156 - RNA, 17 nt, Homo sapiens
ugccuggugugccucag

SEQ ID NO: 1704157 - RNA, 16 nt, Homo sapiens
ugccuguauacuuuag

SEQ ID NO: 1704158 - RNA, 21 nt, Homo sapiens
ugccuuacaggguaacugugc

SEQ ID NO: 1704159 - RNA, 15 nt, Homo sapiens
ugccuuagucucagu

SEQ ID NO: 1704160 - RNA, 16 nt, Homo sapiens
ugccuucacuuuacaa

SEQ ID NO: 1704161 - RNA, 12 nt, Homo sapiens
ugccuucugacg

SEQ ID NO: 1704162 - RNA, 22 nt, Homo sapiens
ugccuugcuagcugaccuggag

SEQ ID NO: 1704163 - RNA, 17 nt, Homo sapiens
ugccuuuuuaaugaaca

SEQ ID NO: 1704164 - RNA, 23 nt, Homo sapiens
ugccuuuuuauuuauauguacug

SEQ ID NO: 1704165 - RNA, 18 nt, Homo sapiens
ugccuuuuucauuuucca

SEQ ID NO: 1704166 - RNA, 16 nt, Homo sapiens
ugcgaauaacaguccc

SEQ ID NO: 1704167 - RNA, 21 nt, Homo sapiens
ugcgaaugacaguagcauuau

SEQ ID NO: 1704168 - RNA, 17 nt, Homo sapiens
ugcgaucuggguucacu

SEQ ID NO: 1704169 - RNA, 20 nt, Homo sapiens
ugcggaaugaaccacaucuu

SEQ ID NO: 1704170 - RNA, 13 nt, Homo sapiens
ugcguuacuaauu

SEQ ID NO: 1704171 - RNA, 17 nt, Homo sapiens
ugcuaagguucuaaggc

SEQ ID NO: 1704172 - RNA, 20 nt, Homo sapiens
ugcuaaucuucuuaugcaau

SEQ ID NO: 1704173 - RNA, 12 nt, Homo sapiens
ugcuacuugacc

SEQ ID NO: 1704174 - RNA, 23 nt, Homo sapiens
ugcuagaacaacgccugucacag

SEQ ID NO: 1704175 - RNA, 12 nt, Homo sapiens
ugcuagaacuuu

SEQ ID NO: 1704176 - RNA, 22 nt, Homo sapiens
ugcuagcaaauggcagaaccaa

SEQ ID NO: 1704177 - RNA, 13 nt, Homo sapiens
ugcuagcaguaaa

SEQ ID NO: 1704178 - RNA, 12 nt, Homo sapiens
ugcuauuugccu

SEQ ID NO: 1704179 - RNA, 21 nt, Homo sapiens
ugcucaggcugcagcuggaca

SEQ ID NO: 1704180 - RNA, 17 nt, Homo sapiens
ugcucauguaugugcga

SEQ ID NO: 1704181 - RNA, 16 nt, Homo sapiens
ugcuccaagauucuag

SEQ ID NO: 1704182 - RNA, 17 nt, Homo sapiens
ugcucccgaugcugcua

SEQ ID NO: 1704183 - RNA, 19 nt, Homo sapiens
ugcucccgaugcugcuaug

SEQ ID NO: 1704184 - RNA, 14 nt, Homo sapiens
ugcuccgcaagagc

SEQ ID NO: 1704185 - RNA, 19 nt, Homo sapiens
ugcuccuuggcuuaccuga

SEQ ID NO: 1704186 - RNA, 22 nt, Homo sapiens
ugcucucgcaccuuuccaaagu

SEQ ID NO: 1704187 - RNA, 23 nt, Homo sapiens
ugcucuuuaugaaugaaaaaaca

SEQ ID NO: 1704188 - RNA, 14 nt, Homo sapiens
ugcucuuugcugca

SEQ ID NO: 1704189 - RNA, 23 nt, Homo sapiens
ugcugaaaaaucauccaagacag

SEQ ID NO: 1704190 - RNA, 21 nt, Homo sapiens
ugcugacuccacgauccugcc

SEQ ID NO: 1704191 - RNA, 16 nt, Homo sapiens
ugcugacuucacuuau

SEQ ID NO: 1704192 - RNA, 22 nt, Homo sapiens
gugccagugucauccgggccua

SEQ ID NO: 1704193 - RNA, 13 nt, Homo sapiens
gugccccaugccu

SEQ ID NO: 1704194 - RNA, 14 nt, Homo sapiens
gugcccuacucauu

SEQ ID NO: 1704195 - RNA, 20 nt, Homo sapiens
gugccgugugagugugacag

SEQ ID NO: 1704196 - RNA, 15 nt, Homo sapiens
gugccuggacauuug

SEQ ID NO: 1704197 - RNA, 24 nt, Homo sapiens
gugcuaaccacgucugucuucaca

SEQ ID NO: 1704198 - RNA, 19 nt, Homo sapiens
gugcucccgaugcugcuau

SEQ ID NO: 1704199 - RNA, 20 nt, Homo sapiens
gugcucuuugcugcacuauu

SEQ ID NO: 1704200 - RNA, 23 nt, Homo sapiens
gugcugcaucuuauagcacuuug

SEQ ID NO: 1704201 - RNA, 21 nt, Homo sapiens
gugcugggauuacagguguga

SEQ ID NO: 1704202 - RNA, 15 nt, Homo sapiens
gugcuucacaguaga

SEQ ID NO: 1704203 - RNA, 21 nt, Homo sapiens
guggauccucaaacaacacug

SEQ ID NO: 1704204 - RNA, 17 nt, Homo sapiens
guggccagcacucugaa

SEQ ID NO: 1704205 - RNA, 18 nt, Homo sapiens
guggcccagggaagccaa

SEQ ID NO: 1704206 - RNA, 15 nt, Homo sapiens
guggccccaacacaa

SEQ ID NO: 1704207 - RNA, 22 nt, Homo sapiens
guggcccugucccucccaccuc

SEQ ID NO: 1704208 - RNA, 17 nt, Homo sapiens
guggccgaggacuuuga

SEQ ID NO: 1704209 - RNA, 20 nt, Homo sapiens
gugggaaaaaaaugaaugag

SEQ ID NO: 1704210 - RNA, 16 nt, Homo sapiens
gugggagggacuuugc

SEQ ID NO: 1704211 - RNA, 15 nt, Homo sapiens
gugggccacagccau

SEQ ID NO: 1704212 - RNA, 17 nt, Homo sapiens
guggggaggugucacau

SEQ ID NO: 1704213 - RNA, 15 nt, Homo sapiens
guggggauuggggga

SEQ ID NO: 1704214 - RNA, 15 nt, Homo sapiens
guggguguacauuuu

SEQ ID NO: 1704215 - RNA, 24 nt, Homo sapiens
guggucaguaaauaacaggcauuu

SEQ ID NO: 1704216 - RNA, 18 nt, Homo sapiens
gugguggagaaccacagc

SEQ ID NO: 1704217 - RNA, 18 nt, Homo sapiens
gugguggcacacaccagu

SEQ ID NO: 1704218 - RNA, 15 nt, Homo sapiens
gugguuauuuugccg

SEQ ID NO: 1704219 - RNA, 16 nt, Homo sapiens
guguauauauguguau

SEQ ID NO: 1704220 - RNA, 15 nt, Homo sapiens
gugucuuaauuauua

SEQ ID NO: 1704221 - RNA, 15 nt, Homo sapiens
gugugaaugugggca

SEQ ID NO: 1704222 - RNA, 21 nt, Homo sapiens
gugugaucuuaauauauuuga

SEQ ID NO: 1704223 - RNA, 22 nt, Homo sapiens
gugugaucuuaauauauuugaa

SEQ ID NO: 1704224 - RNA, 14 nt, Homo sapiens
gugugggggguccu

SEQ ID NO: 1704225 - RNA, 20 nt, Homo sapiens
guguguauauauguguauau

SEQ ID NO: 1704226 - RNA, 13 nt, Homo sapiens
guguguguguaug

SEQ ID NO: 1704227 - RNA, 15 nt, Homo sapiens
guguguguugucuga

SEQ ID NO: 1704228 - RNA, 17 nt, Homo sapiens
guguguucuauccaaac

SEQ ID NO: 1704229 - RNA, 14 nt, Homo sapiens
guguuauuugcaca

SEQ ID NO: 1704230 - RNA, 21 nt, Homo sapiens
guguugcaccaggcacugcug

SEQ ID NO: 1704231 - RNA, 19 nt, Homo sapiens
guguuucuauugacuucaa

SEQ ID NO: 1704232 - RNA, 22 nt, Homo sapiens
guguuuuaaacucuccuaguca

SEQ ID NO: 1704233 - RNA, 23 nt, Homo sapiens
guguuuuguaggagacuugccag

SEQ ID NO: 1704234 - RNA, 20 nt, Homo sapiens
guuaaaauuaugaaucugau

SEQ ID NO: 1704235 - RNA, 18 nt, Homo sapiens
guuaaaugaaauuguaaa

SEQ ID NO: 1704236 - RNA, 13 nt, Homo sapiens
guuaaaugaacuu

SEQ ID NO: 1704237 - RNA, 16 nt, Homo sapiens
guuaacugauuugcaa

SEQ ID NO: 1704238 - RNA, 21 nt, Homo sapiens
guuaagcagauggaaugcugu

SEQ ID NO: 1704239 - RNA, 23 nt, Homo sapiens
guuaagcauuaccacucaggcau

SEQ ID NO: 1704240 - RNA, 21 nt, Homo sapiens
guuaauacgcaggcaucugau

SEQ ID NO: 1704241 - RNA, 18 nt, Homo sapiens
guuacacccuuucuugac

SEQ ID NO: 1704242 - RNA, 11 nt, Homo sapiens
guuacauauua

SEQ ID NO: 1704243 - RNA, 16 nt, Homo sapiens
guuaccauucacaaua

SEQ ID NO: 1704244 - RNA, 22 nt, Homo sapiens
guuacuauuuucuacaauuaau

SEQ ID NO: 1704245 - RNA, 18 nt, Homo sapiens
guuacugaucuuacucac

SEQ ID NO: 1704246 - RNA, 21 nt, Homo sapiens
guuagaaaauggacacugugc

SEQ ID NO: 1704247 - RNA, 20 nt, Homo sapiens
guuagcacuaggcacccagc

SEQ ID NO: 1704248 - RNA, 17 nt, Homo sapiens
guuauaguaacucccau

SEQ ID NO: 1704249 - RNA, 17 nt, Homo sapiens
guuaugauguaaucucu

SEQ ID NO: 1704250 - RNA, 15 nt, Homo sapiens
guuauugugaaugau

SEQ ID NO: 1704251 - RNA, 20 nt, Homo sapiens
guucaaucucccgcugcugc

SEQ ID NO: 1704252 - RNA, 21 nt, Homo sapiens
guucaggguugguagcaggga

SEQ ID NO: 1704253 - RNA, 23 nt, Homo sapiens
guucauaccuaaguacuguaaua

SEQ ID NO: 1704254 - RNA, 13 nt, Homo sapiens
guuccccacugac

SEQ ID NO: 1704255 - RNA, 20 nt, Homo sapiens
guuccccacugacagccucc

SEQ ID NO: 1704256 - RNA, 15 nt, Homo sapiens
guucccuguucuucc

SEQ ID NO: 1704257 - RNA, 21 nt, Homo sapiens
guuccgaagaagaugcuccag

SEQ ID NO: 1704258 - RNA, 18 nt, Homo sapiens
guuccucuuggugucaua

SEQ ID NO: 1704259 - RNA, 22 nt, Homo sapiens
guucuaagaaacccucugucau

SEQ ID NO: 1704260 - RNA, 18 nt, Homo sapiens
guucuacauaaguaauuc

SEQ ID NO: 1704261 - RNA, 23 nt, Homo sapiens
guucuacuauggcugaguucugg

SEQ ID NO: 1704262 - RNA, 15 nt, Homo sapiens
guucucuucuucauu

SEQ ID NO: 1704263 - RNA, 12 nt, Homo sapiens
guucuuacacau

SEQ ID NO: 1704264 - RNA, 15 nt, Homo sapiens
guugacaacugugac

SEQ ID NO: 1704265 - RNA, 19 nt, Homo sapiens
guugagaguugcuggugua

SEQ ID NO: 1704266 - RNA, 20 nt, Homo sapiens
guugagccaggccucucuca

SEQ ID NO: 1704267 - RNA, 19 nt, Homo sapiens
guugagucgucaucacuuu

SEQ ID NO: 1704268 - RNA, 17 nt, Homo sapiens
guugccuaaguauuaaa

SEQ ID NO: 1704269 - RNA, 10 nt, Homo sapiens
guuggaagag

SEQ ID NO: 1704270 - RNA, 15 nt, Homo sapiens
guuggauuccaugcu

SEQ ID NO: 1704271 - RNA, 20 nt, Homo sapiens
guuguaaaaagaaaaaccac

SEQ ID NO: 1704272 - RNA, 21 nt, Homo sapiens
guuguaaaaagaaaaaccacu

SEQ ID NO: 1704273 - RNA, 14 nt, Homo sapiens
guuguaaugcugca

SEQ ID NO: 1704274 - RNA, 22 nt, Homo sapiens
guuguauaauuucgagauuugu

SEQ ID NO: 1704275 - RNA, 18 nt, Homo sapiens
guugucaacaaaccaagc

SEQ ID NO: 1704276 - RNA, 20 nt, Homo sapiens
guugucuacaccaaugccca

SEQ ID NO: 1704277 - RNA, 16 nt, Homo sapiens
guuuaaaaauacaugu

SEQ ID NO: 1704278 - RNA, 18 nt, Homo sapiens
gaaauuuuuaaaaauaca

SEQ ID NO: 1704279 - RNA, 16 nt, Homo sapiens
gaacaaaaaaaccaca

SEQ ID NO: 1704280 - RNA, 15 nt, Homo sapiens
gaacaagcuaauugg

SEQ ID NO: 1704281 - RNA, 12 nt, Homo sapiens
gaacacacuugg

SEQ ID NO: 1704282 - RNA, 17 nt, Homo sapiens
gaacacccuugguggcu

SEQ ID NO: 1704283 - RNA, 19 nt, Homo sapiens
gaacacuaacucaccagcc

SEQ ID NO: 1704284 - RNA, 20 nt, Homo sapiens
aaacuugugaaugcuucuca

SEQ ID NO: 1704285 - RNA, 16 nt, Homo sapiens
aaacuuuuaacugaga

SEQ ID NO: 1704286 - RNA, 13 nt, Homo sapiens
aaagaaaaaccac

SEQ ID NO: 1704287 - RNA, 17 nt, Homo sapiens
aaagaaggaagugaaga

SEQ ID NO: 1704288 - RNA, 22 nt, Homo sapiens
aaagaauuggccaggcauggug

SEQ ID NO: 1704289 - RNA, 14 nt, Homo sapiens
aaagacaacauaac

SEQ ID NO: 1704290 - RNA, 14 nt, Homo sapiens
aaagaccuugcuua

SEQ ID NO: 1704291 - RNA, 15 nt, Homo sapiens
aaagacguucccuuu

SEQ ID NO: 1704292 - RNA, 20 nt, Homo sapiens
aaagagagcaggacucacag

SEQ ID NO: 1704293 - RNA, 16 nt, Homo sapiens
aaagaugaaguuuuau

SEQ ID NO: 1704294 - RNA, 17 nt, Homo sapiens
aaagauucaugauuuau

SEQ ID NO: 1704295 - RNA, 17 nt, Homo sapiens
aaagauuguuggaugaa

SEQ ID NO: 1704296 - RNA, 17 nt, Homo sapiens
aaagauuuaagcacaaa

SEQ ID NO: 1704297 - RNA, 23 nt, Homo sapiens
aaagcaaaauaaaaacuauucga

SEQ ID NO: 1704298 - RNA, 22 nt, Homo sapiens
aaagcaaacacuuacagaauua

SEQ ID NO: 1704299 - RNA, 12 nt, Homo sapiens
aaagcacagugu

SEQ ID NO: 1704300 - RNA, 12 nt, Homo sapiens
aaagcacaguuu

SEQ ID NO: 1704301 - RNA, 15 nt, Homo sapiens
aaagcacaguuugaa

SEQ ID NO: 1704302 - RNA, 16 nt, Homo sapiens
aaagcagauaccucac

SEQ ID NO: 1704303 - RNA, 20 nt, Homo sapiens
aaagcagugggcuccuggca

SEQ ID NO: 1704304 - RNA, 15 nt, Homo sapiens
aaagcccgccugaca

SEQ ID NO: 1704305 - RNA, 15 nt, Homo sapiens
aaagcccuuccaugu

SEQ ID NO: 1704306 - RNA, 13 nt, Homo sapiens
aaagccuuaggga

SEQ ID NO: 1704307 - RNA, 15 nt, Homo sapiens
aaagcuaaauuccac

SEQ ID NO: 1704308 - RNA, 18 nt, Homo sapiens
aaagcucauuucaugcuc

SEQ ID NO: 1704309 - RNA, 15 nt, Homo sapiens
aaagcucuguugcaa

SEQ ID NO: 1704310 - RNA, 15 nt, Homo sapiens
aaagcugcccacugu

SEQ ID NO: 1704311 - RNA, 13 nt, Homo sapiens
aaagcugccugua

SEQ ID NO: 1704312 - RNA, 20 nt, Homo sapiens
aaagcuuaccaaggggaaug

SEQ ID NO: 1704313 - RNA, 23 nt, Homo sapiens
aaagcuucaaauuaaaacagcug

SEQ ID NO: 1704314 - RNA, 22 nt, Homo sapiens
aaagcuuuauuaccaguggcgu

SEQ ID NO: 1704315 - RNA, 20 nt, Homo sapiens
aaaggagacaaguuccaugg

SEQ ID NO: 1704316 - RNA, 17 nt, Homo sapiens
aaaggagagacucccau

SEQ ID NO: 1704317 - RNA, 16 nt, Homo sapiens
aaaggaggcaugccuc

SEQ ID NO: 1704318 - RNA, 13 nt, Homo sapiens
aaagggaaguagu

SEQ ID NO: 1704319 - RNA, 22 nt, Homo sapiens
aaagggaucaucaugcagcuca

SEQ ID NO: 1704320 - RNA, 14 nt, Homo sapiens
aaaggggcacuggu

SEQ ID NO: 1704321 - RNA, 22 nt, Homo sapiens
aaaggguugggagcugaugaaa

SEQ ID NO: 1704322 - RNA, 18 nt, Homo sapiens
aaagguagcuuaccugac

SEQ ID NO: 1704323 - RNA, 19 nt, Homo sapiens
aaagguagcuuaccugaca

SEQ ID NO: 1704324 - RNA, 23 nt, Homo sapiens
aaagguauuaaauugauguugcu

SEQ ID NO: 1704325 - RNA, 16 nt, Homo sapiens
aaagguugaagcacca

SEQ ID NO: 1704326 - RNA, 14 nt, Homo sapiens
aaaguacuucucca

SEQ ID NO: 1704327 - RNA, 13 nt, Homo sapiens
aaaguagccacgu

SEQ ID NO: 1704328 - RNA, 19 nt, Homo sapiens
aaaguagguuuacauucau

SEQ ID NO: 1704329 - RNA, 12 nt, Homo sapiens
aaagucacuuac

SEQ ID NO: 1704330 - RNA, 16 nt, Homo sapiens
aaagucguuuuccaaa

SEQ ID NO: 1704331 - RNA, 10 nt, Homo sapiens
aaagugcaua

SEQ ID NO: 1704332 - RNA, 21 nt, Homo sapiens
aaagugcauaugaaauccuug

SEQ ID NO: 1704333 - RNA, 18 nt, Homo sapiens
aaagugcuaagguucuaa

SEQ ID NO: 1704334 - RNA, 17 nt, Homo sapiens
aaagugugucacccuuu

SEQ ID NO: 1704335 - RNA, 12 nt, Homo sapiens
aacuugcuacag

SEQ ID NO: 1704336 - RNA, 22 nt, Homo sapiens
aacuugguucugcuucaauaaa

SEQ ID NO: 1704337 - RNA, 15 nt, Homo sapiens
aacuuguagcuguaa

SEQ ID NO: 1704338 - RNA, 23 nt, Homo sapiens
aacuuucuguuggauuccaugcu

SEQ ID NO: 1704339 - RNA, 16 nt, Homo sapiens
aacuuuucgacauauu

SEQ ID NO: 1704340 - RNA, 15 nt, Homo sapiens
aagaaaaaauaucuu

SEQ ID NO: 1704341 - RNA, 21 nt, Homo sapiens
aagaaaaacaccgcuucugcc

SEQ ID NO: 1704342 - RNA, 17 nt, Homo sapiens
aagaaaaagguuugcau

SEQ ID NO: 1704343 - RNA, 18 nt, Homo sapiens
aagaaaacaccacuaauu

SEQ ID NO: 1704344 - RNA, 22 nt, Homo sapiens
aagaaaaguagguuuacauuca

SEQ ID NO: 1704345 - RNA, 13 nt, Homo sapiens
aagaaaauggauu

SEQ ID NO: 1704346 - RNA, 16 nt, Homo sapiens
aagaaaauggauuuaa

SEQ ID NO: 1704347 - RNA, 12 nt, Homo sapiens
aagaaacauaac

SEQ ID NO: 1704348 - RNA, 14 nt, Homo sapiens
aagaaauaccuuga

SEQ ID NO: 1704349 - RNA, 12 nt, Homo sapiens
aagaaaugaaua

SEQ ID NO: 1704350 - RNA, 12 nt, Homo sapiens
aagaacauguga

SEQ ID NO: 1704351 - RNA, 12 nt, Homo sapiens
aagaaccagaga

SEQ ID NO: 1704352 - RNA, 13 nt, Homo sapiens
aagaagagaagcu

SEQ ID NO: 1704353 - RNA, 18 nt, Homo sapiens
aagaagagacucuuugca

SEQ ID NO: 1704354 - RNA, 22 nt, Homo sapiens
aagaaugaucagcaucugugau

SEQ ID NO: 1704355 - RNA, 20 nt, Homo sapiens
aagaauguugguuuacuuuc

SEQ ID NO: 1704356 - RNA, 16 nt, Homo sapiens
aagacaauuugauaca

SEQ ID NO: 1704357 - RNA, 17 nt, Homo sapiens
aagacaccagagcagau

SEQ ID NO: 1704358 - RNA, 16 nt, Homo sapiens
aagacaccauuuaucu

SEQ ID NO: 1704359 - RNA, 13 nt, Homo sapiens
aagacacugccug

SEQ ID NO: 1704360 - RNA, 13 nt, Homo sapiens
aagaccaaacuuc

SEQ ID NO: 1704361 - RNA, 21 nt, Homo sapiens
aagaccacacuugguguuacc

SEQ ID NO: 1704362 - RNA, 15 nt, Homo sapiens
aagacuccaucucaa

SEQ ID NO: 1704363 - RNA, 15 nt, Homo sapiens
aagacucuauucuca

SEQ ID NO: 1704364 - RNA, 22 nt, Homo sapiens
aagacuggaagcuaauuugcau

SEQ ID NO: 1704365 - RNA, 14 nt, Homo sapiens
aagacuuguaauau

SEQ ID NO: 1704366 - RNA, 13 nt, Homo sapiens
aagacuugugcau

SEQ ID NO: 1704367 - RNA, 14 nt, Homo sapiens
aagagaagcaauuu

SEQ ID NO: 1704368 - RNA, 16 nt, Homo sapiens
aagagauaaacuacau

SEQ ID NO: 1704369 - RNA, 15 nt, Homo sapiens
aagaggaacuugacc

SEQ ID NO: 1704370 - RNA, 23 nt, Homo sapiens
aagaggcccugucuguaccuaac

SEQ ID NO: 1704371 - RNA, 21 nt, Homo sapiens
aagaggcugccccucucacca

SEQ ID NO: 1704372 - RNA, 14 nt, Homo sapiens
aagaguuacuuaau

SEQ ID NO: 1704373 - RNA, 16 nt, Homo sapiens
aagauaauuguugaaa

SEQ ID NO: 1704374 - RNA, 22 nt, Homo sapiens
aagauagaugcacuuaugcagu

SEQ ID NO: 1704375 - RNA, 22 nt, Homo sapiens
aagaucaaaauaaaaagugaca

SEQ ID NO: 1704376 - RNA, 21 nt, Homo sapiens
aagauccaagaaggccuucau

SEQ ID NO: 1704377 - RNA, 20 nt, Homo sapiens
aagauccaagaggcccugca

SEQ ID NO: 1704378 - RNA, 21 nt, Homo sapiens
aagauggcugugccucugccu

SEQ ID NO: 1704379 - RNA, 22 nt, Homo sapiens
aagauguguugcuauccugaaa

SEQ ID NO: 1704380 - RNA, 19 nt, Homo sapiens
aagauugauuaaugaacua

SEQ ID NO: 1704381 - RNA, 17 nt, Homo sapiens
aagauugcgguuuacag

SEQ ID NO: 1704382 - RNA, 22 nt, Homo sapiens
aagauuguaauuaaaaugauag

SEQ ID NO: 1704383 - RNA, 19 nt, Homo sapiens
aaauuuggggacagauuca

SEQ ID NO: 1704384 - RNA, 13 nt, Homo sapiens
aaauuuucaccug

SEQ ID NO: 1704385 - RNA, 21 nt, Homo sapiens
aaauuuugaguucuacauaag

SEQ ID NO: 1704386 - RNA, 22 nt, Homo sapiens
aacaaaagcuugaagcugugga

SEQ ID NO: 1704387 - RNA, 12 nt, Homo sapiens
aacaaaccaagc

SEQ ID NO: 1704388 - RNA, 21 nt, Homo sapiens
aacaaagauucaugauuuaua

SEQ ID NO: 1704389 - RNA, 20 nt, Homo sapiens
aacaaagugaaggacauaga

SEQ ID NO: 1704390 - RNA, 14 nt, Homo sapiens
aacaaauaugcaaa

SEQ ID NO: 1704391 - RNA, 20 nt, Homo sapiens
aacaaauucauauucugucu

SEQ ID NO: 1704392 - RNA, 18 nt, Homo sapiens
aacaacucuccagugccu

SEQ ID NO: 1704393 - RNA, 12 nt, Homo sapiens
aacaacuguggu

SEQ ID NO: 1704394 - RNA, 17 nt, Homo sapiens
aacaaguuuuucuguca

SEQ ID NO: 1704395 - RNA, 13 nt, Homo sapiens
aacaaugaagaua

SEQ ID NO: 1704396 - RNA, 22 nt, Homo sapiens
aacaauugggagauuaucuuuc

SEQ ID NO: 1704397 - RNA, 21 nt, Homo sapiens
aacacaaggcuccaagaccua

SEQ ID NO: 1704398 - RNA, 18 nt, Homo sapiens
aacacaaugaugauuauu

SEQ ID NO: 1704399 - RNA, 13 nt, Homo sapiens
aacacauucaaua

SEQ ID NO: 1704400 - RNA, 19 nt, Homo sapiens
aacacauuuuuuaacuaau

SEQ ID NO: 1704401 - RNA, 17 nt, Homo sapiens
aacaccaaaaagggauc

SEQ ID NO: 1704402 - RNA, 14 nt, Homo sapiens
aacaccacagacac

SEQ ID NO: 1704403 - RNA, 19 nt, Homo sapiens
aacacccaaagcauggacu

SEQ ID NO: 1704404 - RNA, 19 nt, Homo sapiens
aacaccgcuucugccuuuu

SEQ ID NO: 1704405 - RNA, 19 nt, Homo sapiens
aacaccuucuuauuauaua

SEQ ID NO: 1704406 - RNA, 14 nt, Homo sapiens
aacacggugcucau

SEQ ID NO: 1704407 - RNA, 23 nt, Homo sapiens
aacacucacauuuauucugcuca

SEQ ID NO: 1704408 - RNA, 19 nt, Homo sapiens
aacacuuauacugacuuuc

SEQ ID NO: 1704409 - RNA, 15 nt, Homo sapiens
aacagacaacagaag

SEQ ID NO: 1704410 - RNA, 21 nt, Homo sapiens
aacagagcaagacuccaucuc

SEQ ID NO: 1704411 - RNA, 22 nt, Homo sapiens
aacagaggaagaauuuguuauc

SEQ ID NO: 1704412 - RNA, 23 nt, Homo sapiens
aacagccgacuuugagcauuguu

SEQ ID NO: 1704413 - RNA, 17 nt, Homo sapiens
aacagcucgauccaaau

SEQ ID NO: 1704414 - RNA, 15 nt, Homo sapiens
aacaguaucuuugca

SEQ ID NO: 1704415 - RNA, 16 nt, Homo sapiens
aacaguaucuuugcac

SEQ ID NO: 1704416 - RNA, 18 nt, Homo sapiens
aacagucaaccaacccca

SEQ ID NO: 1704417 - RNA, 18 nt, Homo sapiens
aacauaaucuaguuuaca

SEQ ID NO: 1704418 - RNA, 15 nt, Homo sapiens
aacauagcaucucag

SEQ ID NO: 1704419 - RNA, 14 nt, Homo sapiens
aacauaugauuuca

SEQ ID NO: 1704420 - RNA, 18 nt, Homo sapiens
aacaucuuuuacauucug

SEQ ID NO: 1704421 - RNA, 18 nt, Homo sapiens
aacaugacacugaccuug

SEQ ID NO: 1704422 - RNA, 12 nt, Homo sapiens
aacaugcauauu

SEQ ID NO: 1704423 - RNA, 23 nt, Homo sapiens
aacauggugaaaaccccaucucu

SEQ ID NO: 1704424 - RNA, 19 nt, Homo sapiens
aacauuaccuuacugugga

SEQ ID NO: 1704425 - RNA, 16 nt, Homo sapiens
aacauuccaaugcauu

SEQ ID NO: 1704426 - RNA, 16 nt, Homo sapiens
aaccaaacacaaugau

SEQ ID NO: 1704427 - RNA, 14 nt, Homo sapiens
aaccacaaaccuag

SEQ ID NO: 1704428 - RNA, 17 nt, Homo sapiens
aaccacacaaagacauu

SEQ ID NO: 1704429 - RNA, 18 nt, Homo sapiens
aaccacagucuauaccau

SEQ ID NO: 1704430 - RNA, 14 nt, Homo sapiens
aaccaccaauccaa

SEQ ID NO: 1704431 - RNA, 22 nt, Homo sapiens
aaccacuaagaauucaaacugg

SEQ ID NO: 1704432 - RNA, 20 nt, Homo sapiens
aaugccuuugagacaguuuc

SEQ ID NO: 1704433 - RNA, 12 nt, Homo sapiens
aaugcugagaag

SEQ ID NO: 1704434 - RNA, 17 nt, Homo sapiens
aaugcugauaugaucuu

SEQ ID NO: 1704435 - RNA, 18 nt, Homo sapiens
aaugcugugguugauauu

SEQ ID NO: 1704436 - RNA, 20 nt, Homo sapiens
aaugcuuacggccaucucuu

SEQ ID NO: 1704437 - RNA, 14 nt, Homo sapiens
aaugcuucauucaa

SEQ ID NO: 1704438 - RNA, 19 nt, Homo sapiens
aaugcuuuuugaauguuau

SEQ ID NO: 1704439 - RNA, 17 nt, Homo sapiens
aauggaaaguaacucau

SEQ ID NO: 1704440 - RNA, 21 nt, Homo sapiens
aauggaagaguguuucuucca

SEQ ID NO: 1704441 - RNA, 15 nt, Homo sapiens
aauggcacuguugca

SEQ ID NO: 1704442 - RNA, 20 nt, Homo sapiens
aauggcuaagauaccaaaac

SEQ ID NO: 1704443 - RNA, 15 nt, Homo sapiens
aaugggaaaucagug

SEQ ID NO: 1704444 - RNA, 14 nt, Homo sapiens
aaugggcacuggga

SEQ ID NO: 1704445 - RNA, 22 nt, Homo sapiens
aaugguauggaacucucuccac

SEQ ID NO: 1704446 - RNA, 14 nt, Homo sapiens
aauguaaaauccau

SEQ ID NO: 1704447 - RNA, 18 nt, Homo sapiens
aauguaaaauguugaaua

SEQ ID NO: 1704448 - RNA, 16 nt, Homo sapiens
aauguacaacugcacc

SEQ ID NO: 1704449 - RNA, 19 nt, Homo sapiens
aauguaggcaucaugcaug

SEQ ID NO: 1704450 - RNA, 15 nt, Homo sapiens
aauguauauacacau

SEQ ID NO: 1704451 - RNA, 16 nt, Homo sapiens
aauguauuuuucuaca

SEQ ID NO: 1704452 - RNA, 17 nt, Homo sapiens
aaugucacguacugucu

SEQ ID NO: 1704453 - RNA, 12 nt, Homo sapiens
aaugucuaucaa

SEQ ID NO: 1704454 - RNA, 19 nt, Homo sapiens
aaugucuaucaacuuuaau

SEQ ID NO: 1704455 - RNA, 12 nt, Homo sapiens
aauguguacaaa

SEQ ID NO: 1704456 - RNA, 23 nt, Homo sapiens
aauguguccuaucuaucuuccaa

SEQ ID NO: 1704457 - RNA, 19 nt, Homo sapiens
aauguuaaggaaacucuua

SEQ ID NO: 1704458 - RNA, 14 nt, Homo sapiens
aauguuaugacuau

SEQ ID NO: 1704459 - RNA, 15 nt, Homo sapiens
aauguuguaauucau

SEQ ID NO: 1704460 - RNA, 22 nt, Homo sapiens
aauguuuuacugugaaacuggc

SEQ ID NO: 1704461 - RNA, 19 nt, Homo sapiens
aauuaaaaaguuaaucuuc

SEQ ID NO: 1704462 - RNA, 17 nt, Homo sapiens
aauuaaaggaacagagu

SEQ ID NO: 1704463 - RNA, 13 nt, Homo sapiens
aauuaauacauca

SEQ ID NO: 1704464 - RNA, 15 nt, Homo sapiens
aauuacaucugucau

SEQ ID NO: 1704465 - RNA, 16 nt, Homo sapiens
aauuagaaaguagcca

SEQ ID NO: 1704466 - RNA, 12 nt, Homo sapiens
aauuagcaauug

SEQ ID NO: 1704467 - RNA, 15 nt, Homo sapiens
aauuauaagucacaa

SEQ ID NO: 1704468 - RNA, 14 nt, Homo sapiens
aauuaucaagcuuu

SEQ ID NO: 1704469 - RNA, 14 nt, Homo sapiens
aauuaucuauagcu

SEQ ID NO: 1704470 - RNA, 14 nt, Homo sapiens
aauuauggcauuuu

SEQ ID NO: 1704471 - RNA, 15 nt, Homo sapiens
aauuauguaaugcaa

SEQ ID NO: 1704472 - RNA, 15 nt, Homo sapiens
aauucaaaaguucca

SEQ ID NO: 1704473 - RNA, 14 nt, Homo sapiens
aauucaaacugggg

SEQ ID NO: 1704474 - RNA, 21 nt, Homo sapiens
aauucacaaguuacacugcca

SEQ ID NO: 1704475 - RNA, 20 nt, Homo sapiens
aauucacccccuuuccugga

SEQ ID NO: 1704476 - RNA, 17 nt, Homo sapiens
aauucacucaagcacug

SEQ ID NO: 1704477 - RNA, 22 nt, Homo sapiens
aauucagacaagcugcauuuca

SEQ ID NO: 1704478 - RNA, 19 nt, Homo sapiens
aauucauaaaaacugcuua

SEQ ID NO: 1704479 - RNA, 13 nt, Homo sapiens
aauuccaauauga

SEQ ID NO: 1704480 - RNA, 15 nt, Homo sapiens
aauucccaagcuuuu

SEQ ID NO: 1704481 - RNA, 20 nt, Homo sapiens
aauuccuacacucuugacua

SEQ ID NO: 1704482 - RNA, 15 nt, Homo sapiens
aauucuagagccagc

SEQ ID NO: 1704483 - RNA, 23 nt, Homo sapiens
aauucucaaaagaaaaggcaaaa

SEQ ID NO: 1704484 - RNA, 17 nt, Homo sapiens
aauucucauuugucaca

SEQ ID NO: 1704485 - RNA, 18 nt, Homo sapiens
aauucucauuugucacac

SEQ ID NO: 1704486 - RNA, 14 nt, Homo sapiens
aauucucuuucaaa

SEQ ID NO: 1704487 - RNA, 15 nt, Homo sapiens
aauucugaacuuuau

SEQ ID NO: 1704488 - RNA, 19 nt, Homo sapiens
aauucuuacacugccugua

SEQ ID NO: 1704489 - RNA, 20 nt, Homo sapiens
aauucuuacccuguacauau

SEQ ID NO: 1704490 - RNA, 20 nt, Homo sapiens
aauucuuauuuuuccuaaca

SEQ ID NO: 1704491 - RNA, 23 nt, Homo sapiens
aauugaagagagauauaucugaa

SEQ ID NO: 1704492 - RNA, 17 nt, Homo sapiens
aauugacaaugauuuau

SEQ ID NO: 1704493 - RNA, 22 nt, Homo sapiens
aauugacuaccguuguuugcaa

SEQ ID NO: 1704494 - RNA, 13 nt, Homo sapiens
aauugacugucac

SEQ ID NO: 1704495 - RNA, 23 nt, Homo sapiens
aauugauggagccauugaugcaa

SEQ ID NO: 1704496 - RNA, 16 nt, Homo sapiens
aauugcaugacuugua

SEQ ID NO: 1704497 - RNA, 10 nt, Homo sapiens
aauugcucaa

SEQ ID NO: 1704498 - RNA, 17 nt, Homo sapiens
aauugcucauaagcaau

SEQ ID NO: 1704499 - RNA, 19 nt, Homo sapiens
agaaaaaaaccacacaaag

SEQ ID NO: 1704500 - RNA, 24 nt, Homo sapiens
agaaaaaaguuuacaacauaaucu

SEQ ID NO: 1704501 - RNA, 14 nt, Homo sapiens
agaaaaagaagaac

SEQ ID NO: 1704502 - RNA, 20 nt, Homo sapiens
agaaaaauauauacuaaaca

SEQ ID NO: 1704503 - RNA, 13 nt, Homo sapiens
agaaaaaugucau

SEQ ID NO: 1704504 - RNA, 19 nt, Homo sapiens
agaaaaguagguuuacauu

SEQ ID NO: 1704505 - RNA, 21 nt, Homo sapiens
agaaaaguagguuuacauuca

SEQ ID NO: 1704506 - RNA, 13 nt, Homo sapiens
agaaacacuuucu

SEQ ID NO: 1704507 - RNA, 18 nt, Homo sapiens
agaaacagagcaguacca

SEQ ID NO: 1704508 - RNA, 11 nt, Homo sapiens
agaaacccaag

SEQ ID NO: 1704509 - RNA, 14 nt, Homo sapiens
agaaacuccaauga

SEQ ID NO: 1704510 - RNA, 19 nt, Homo sapiens
agaaagaauuggccaggca

SEQ ID NO: 1704511 - RNA, 12 nt, Homo sapiens
agaaagccaaau

SEQ ID NO: 1704512 - RNA, 22 nt, Homo sapiens
agaaaguacuucuccacccugc

SEQ ID NO: 1704513 - RNA, 14 nt, Homo sapiens
agaaaguacuucuu

SEQ ID NO: 1704514 - RNA, 12 nt, Homo sapiens
agaaaguauuug

SEQ ID NO: 1704515 - RNA, 15 nt, Homo sapiens
agaaagucauuccuu

SEQ ID NO: 1704516 - RNA, 15 nt, Homo sapiens
agaaauaauaugcau

SEQ ID NO: 1704517 - RNA, 23 nt, Homo sapiens
agaaauacaauucuacauuguca

SEQ ID NO: 1704518 - RNA, 17 nt, Homo sapiens
agaaauacuuucaggca

SEQ ID NO: 1704519 - RNA, 16 nt, Homo sapiens
agaaauauauauacau

SEQ ID NO: 1704520 - RNA, 14 nt, Homo sapiens
agaaauauggacac

SEQ ID NO: 1704521 - RNA, 18 nt, Homo sapiens
agaaauauggacacuuaa

SEQ ID NO: 1704522 - RNA, 14 nt, Homo sapiens
agaaauccauaucu

SEQ ID NO: 1704523 - RNA, 18 nt, Homo sapiens
agaaaugcauagcauuau

SEQ ID NO: 1704524 - RNA, 16 nt, Homo sapiens
agaaauggauucuauu

SEQ ID NO: 1704525 - RNA, 11 nt, Homo sapiens
agaaauucugu

SEQ ID NO: 1704526 - RNA, 20 nt, Homo sapiens
agaacaagaccccgucucaa

SEQ ID NO: 1704527 - RNA, 13 nt, Homo sapiens
agaacaguaucuu

SEQ ID NO: 1704528 - RNA, 22 nt, Homo sapiens
agaacauuguaucacauuuuag

SEQ ID NO: 1704529 - RNA, 15 nt, Homo sapiens
agaaccccucuggga

SEQ ID NO: 1704530 - RNA, 16 nt, Homo sapiens
agaaccccucugggaa

SEQ ID NO: 1704531 - RNA, 16 nt, Homo sapiens
agaaccgagcaaagau

SEQ ID NO: 1704532 - RNA, 13 nt, Homo sapiens
agaacuccugacu

SEQ ID NO: 1704533 - RNA, 11 nt, Homo sapiens
agaacugccau

SEQ ID NO: 1704534 - RNA, 23 nt, Homo sapiens
agaacugccauuauuuucuguca

SEQ ID NO: 1704535 - RNA, 12 nt, Homo sapiens
agaacuggguaa

SEQ ID NO: 1704536 - RNA, 19 nt, Homo sapiens
agaacuugcagcugauguu

SEQ ID NO: 1704537 - RNA, 18 nt, Homo sapiens
aagauuguccagugcaac

SEQ ID NO: 1704538 - RNA, 22 nt, Homo sapiens
aagauuguccagugcaaccaca

SEQ ID NO: 1704539 - RNA, 15 nt, Homo sapiens
aagauuuaugaugca

SEQ ID NO: 1704540 - RNA, 15 nt, Homo sapiens
aagauuuucagaaaa

SEQ ID NO: 1704541 - RNA, 20 nt, Homo sapiens
aagcaaaaaaugaaugucua

SEQ ID NO: 1704542 - RNA, 18 nt, Homo sapiens
aagcaaaacaauaaacua

SEQ ID NO: 1704543 - RNA, 13 nt, Homo sapiens
aagcaagcucucu

SEQ ID NO: 1704544 - RNA, 15 nt, Homo sapiens
aagcaaggcuuuaaa

SEQ ID NO: 1704545 - RNA, 12 nt, Homo sapiens
aagcacaagcag

SEQ ID NO: 1704546 - RNA, 23 nt, Homo sapiens
aagcaccuagccucgcucuuggc

SEQ ID NO: 1704547 - RNA, 22 nt, Homo sapiens
aagcacugaaaaacaacaacac

SEQ ID NO: 1704548 - RNA, 21 nt, Homo sapiens
aagcacugauaucuggccuaa

SEQ ID NO: 1704549 - RNA, 17 nt, Homo sapiens
aagcaggugaacuggga

SEQ ID NO: 1704550 - RNA, 16 nt, Homo sapiens
aagcaguuucucucca

SEQ ID NO: 1704551 - RNA, 22 nt, Homo sapiens
aagcaucuguagugacccacug

SEQ ID NO: 1704552 - RNA, 19 nt, Homo sapiens
aagcauuaccacucaggca

SEQ ID NO: 1704553 - RNA, 21 nt, Homo sapiens
aagcauuccuucuuugauaau

SEQ ID NO: 1704554 - RNA, 16 nt, Homo sapiens
aagccaaagaaaugaa

SEQ ID NO: 1704555 - RNA, 20 nt, Homo sapiens
aagccacagcagguccucca

SEQ ID NO: 1704556 - RNA, 21 nt, Homo sapiens
aagccacagcagguccuccau

SEQ ID NO: 1704557 - RNA, 18 nt, Homo sapiens
aagccagccugguccaug

SEQ ID NO: 1704558 - RNA, 20 nt, Homo sapiens
aagccagcugcagcugggcu

SEQ ID NO: 1704559 - RNA, 12 nt, Homo sapiens
aagccagggucu

SEQ ID NO: 1704560 - RNA, 18 nt, Homo sapiens
aagcccaugaguccuuga

SEQ ID NO: 1704561 - RNA, 23 nt, Homo sapiens
aagccucagcuacccacuauccu

SEQ ID NO: 1704562 - RNA, 14 nt, Homo sapiens
aagccugugcaaug

SEQ ID NO: 1704563 - RNA, 17 nt, Homo sapiens
aagcgaauguguacaaa

SEQ ID NO: 1704564 - RNA, 22 nt, Homo sapiens
aagcgacccauucagagacugu

SEQ ID NO: 1704565 - RNA, 13 nt, Homo sapiens
aagcgcucagaac

SEQ ID NO: 1704566 - RNA, 18 nt, Homo sapiens
aagcgugagccacugcac

SEQ ID NO: 1704567 - RNA, 15 nt, Homo sapiens
aagcucaugagauga

SEQ ID NO: 1704568 - RNA, 13 nt, Homo sapiens
aagcuccucguga

SEQ ID NO: 1704569 - RNA, 22 nt, Homo sapiens
aagcuccuguccucccaucccc

SEQ ID NO: 1704570 - RNA, 23 nt, Homo sapiens
aagcucugcuccucuccccagca

SEQ ID NO: 1704571 - RNA, 14 nt, Homo sapiens
aagcugccauauau

SEQ ID NO: 1704572 - RNA, 22 nt, Homo sapiens
aagcugcuaccccuacaucauc

SEQ ID NO: 1704573 - RNA, 20 nt, Homo sapiens
aagcugcuccaggccugcag

SEQ ID NO: 1704574 - RNA, 22 nt, Homo sapiens
aagcugguaaacuauuugucuu

SEQ ID NO: 1704575 - RNA, 16 nt, Homo sapiens
aagcuuaacacuugac

SEQ ID NO: 1704576 - RNA, 11 nt, Homo sapiens
aagcuuuauga

SEQ ID NO: 1704577 - RNA, 14 nt, Homo sapiens
aagcuuuaugauuu

SEQ ID NO: 1704578 - RNA, 18 nt, Homo sapiens
aagcuuuaugauuuucau

SEQ ID NO: 1704579 - RNA, 12 nt, Homo sapiens
aaggaaaaagcu

SEQ ID NO: 1704580 - RNA, 18 nt, Homo sapiens
aaggaacaaaaaaaccac

SEQ ID NO: 1704581 - RNA, 17 nt, Homo sapiens
aaggaaccuuccuuccu

SEQ ID NO: 1704582 - RNA, 16 nt, Homo sapiens
aaggaauagaagcaaa

SEQ ID NO: 1704583 - RNA, 20 nt, Homo sapiens
aaggaaucuuuaagcagaga

SEQ ID NO: 1704584 - RNA, 18 nt, Homo sapiens
aaggacagugucuucuuu

SEQ ID NO: 1704585 - RNA, 15 nt, Homo sapiens
aaggacaucagcaaa

SEQ ID NO: 1704586 - RNA, 21 nt, Homo sapiens
aaggacaucagcaaacaggau

SEQ ID NO: 1704587 - RNA, 22 nt, Homo sapiens
aaggagagacucccaugaagcc

SEQ ID NO: 1704588 - RNA, 18 nt, Homo sapiens
aaggagaggcaacaucca

SEQ ID NO: 1704589 - RNA, 20 nt, Homo sapiens
aaggaggcaugccucugaua

SEQ ID NO: 1704590 - RNA, 17 nt, Homo sapiens
aaggaggggaagcugca

SEQ ID NO: 1704591 - RNA, 20 nt, Homo sapiens
aaggaguacaaugcccagau

SEQ ID NO: 1704592 - RNA, 17 nt, Homo sapiens
aaggaguacuccaagac

SEQ ID NO: 1704593 - RNA, 18 nt, Homo sapiens
aaggcccauaucugugaa

SEQ ID NO: 1704594 - RNA, 18 nt, Homo sapiens
aaggcccugcugcccaau

SEQ ID NO: 1704595 - RNA, 14 nt, Homo sapiens
aaggccugcacaca

SEQ ID NO: 1704596 - RNA, 22 nt, Homo sapiens
aaggcucugagcaaauguggcu

SEQ ID NO: 1704597 - RNA, 15 nt, Homo sapiens
aaggcuugaagcugu

SEQ ID NO: 1704598 - RNA, 21 nt, Homo sapiens
aaggcuuuuugguguauagaa

SEQ ID NO: 1704599 - RNA, 18 nt, Homo sapiens
aagggacggggaagccga

SEQ ID NO: 1704600 - RNA, 23 nt, Homo sapiens
cuggcuaaagauaauugcuauuu

SEQ ID NO: 1704601 - RNA, 16 nt, Homo sapiens
cuggcucacaguacag

SEQ ID NO: 1704602 - RNA, 20 nt, Homo sapiens
cuggcuucucuugagucaca

SEQ ID NO: 1704603 - RNA, 22 nt, Homo sapiens
cugggaaccucccagaggucca

SEQ ID NO: 1704604 - RNA, 18 nt, Homo sapiens
cugggaccugagucaaug

SEQ ID NO: 1704605 - RNA, 21 nt, Homo sapiens
ccucagguggccccaguucaa

SEQ ID NO: 1704606 - RNA, 23 nt, Homo sapiens
ccucaguaaauguacaacugcac

SEQ ID NO: 1704607 - RNA, 16 nt, Homo sapiens
ccucaguccauuuaua

SEQ ID NO: 1704608 - RNA, 16 nt, Homo sapiens
ccuccaaaggucugau

SEQ ID NO: 1704609 - RNA, 16 nt, Homo sapiens
ccuccaacacaaggcu

SEQ ID NO: 1704610 - RNA, 17 nt, Homo sapiens
ccuccagcuucaggcag

SEQ ID NO: 1704611 - RNA, 21 nt, Homo sapiens
ccucccaaagugcugggauua

SEQ ID NO: 1704612 - RNA, 18 nt, Homo sapiens
ccucccagagguccagcc

SEQ ID NO: 1704613 - RNA, 21 nt, Homo sapiens
ccucccuagccagcacuugua

SEQ ID NO: 1704614 - RNA, 14 nt, Homo sapiens
ccucccucauucca

SEQ ID NO: 1704615 - RNA, 16 nt, Homo sapiens
ccuccucacuggccau

SEQ ID NO: 1704616 - RNA, 12 nt, Homo sapiens
ccuccugaaccg

SEQ ID NO: 1704617 - RNA, 19 nt, Homo sapiens
ccuccugaaccgcacagcu

SEQ ID NO: 1704618 - RNA, 14 nt, Homo sapiens
ccagcuacucagga

SEQ ID NO: 1704619 - RNA, 15 nt, Homo sapiens
ccagcuauuuacaca

SEQ ID NO: 1704620 - RNA, 21 nt, Homo sapiens
ccagcucagucccaucagaga

SEQ ID NO: 1704621 - RNA, 13 nt, Homo sapiens
ccagcugcugucu

SEQ ID NO: 1704622 - RNA, 18 nt, Homo sapiens
ccagcuuaugagcucaaa

SEQ ID NO: 1704623 - RNA, 21 nt, Homo sapiens
ccagcuugcgaauaacagucc

SEQ ID NO: 1704624 - RNA, 13 nt, Homo sapiens
ccaggaacaagcu

SEQ ID NO: 1704625 - RNA, 15 nt, Homo sapiens
ccaggaccaagccac

SEQ ID NO: 1704626 - RNA, 17 nt, Homo sapiens
ccaggaguuugagacca

SEQ ID NO: 1704627 - RNA, 23 nt, Homo sapiens
ccaggauauugacaagaauacac

SEQ ID NO: 1704628 - RNA, 15 nt, Homo sapiens
ccaggaucauggugu

SEQ ID NO: 1704629 - RNA, 19 nt, Homo sapiens
ccaggaugaguuacuugaa

SEQ ID NO: 1704630 - RNA, 22 nt, Homo sapiens
ccaggcaaauaggccccuuuga

SEQ ID NO: 1704631 - RNA, 19 nt, Homo sapiens
ccaggcacaggaugcugug

SEQ ID NO: 1704632 - RNA, 14 nt, Homo sapiens
ccaggcacugcugc

SEQ ID NO: 1704633 - RNA, 16 nt, Homo sapiens
ccaggcaugguggcuc

SEQ ID NO: 1704634 - RNA, 18 nt, Homo sapiens
ccaggccggccagccuca

SEQ ID NO: 1704635 - RNA, 20 nt, Homo sapiens
ccaggcuggcgugcaguggu

SEQ ID NO: 1704636 - RNA, 13 nt, Homo sapiens
ccagggccaagag

SEQ ID NO: 1704637 - RNA, 20 nt, Homo sapiens
ccagguaagggggugcagca

SEQ ID NO: 1704638 - RNA, 14 nt, Homo sapiens
ccaguaaagccuua

SEQ ID NO: 1704639 - RNA, 17 nt, Homo sapiens
ccagucacuuugccaga

SEQ ID NO: 1704640 - RNA, 20 nt, Homo sapiens
ccagucucuuguacagcguu

SEQ ID NO: 1704641 - RNA, 19 nt, Homo sapiens
ccagugacaaggcccugag

SEQ ID NO: 1704642 - RNA, 11 nt, Homo sapiens
ccagugcaacc

SEQ ID NO: 1704643 - RNA, 16 nt, Homo sapiens
ccagugccuacagggc

SEQ ID NO: 1704644 - RNA, 23 nt, Homo sapiens
ccagugcuccaggcacccagcuu

SEQ ID NO: 1704645 - RNA, 17 nt, Homo sapiens
ccaguguaugucuugua

SEQ ID NO: 1704646 - RNA, 11 nt, Homo sapiens
ccagugucugu

SEQ ID NO: 1704647 - RNA, 22 nt, Homo sapiens
ccaguguggaguggguaaucca

SEQ ID NO: 1704648 - RNA, 19 nt, Homo sapiens
ccaguucauugcacuuuga

SEQ ID NO: 1704649 - RNA, 20 nt, Homo sapiens
ccaguucauugcacuuugau

SEQ ID NO: 1704650 - RNA, 18 nt, Homo sapiens
ccauacuuugucugaaaa

SEQ ID NO: 1704651 - RNA, 19 nt, Homo sapiens
ccauacuuugucugaaaaa

SEQ ID NO: 1704652 - RNA, 13 nt, Homo sapiens
ccauagaaacaug

SEQ ID NO: 1704653 - RNA, 23 nt, Homo sapiens
ccauauaccaucuccagcuauuu

SEQ ID NO: 1704654 - RNA, 22 nt, Homo sapiens
ccauaucuugcgaauccaagcu

SEQ ID NO: 1704655 - RNA, 15 nt, Homo sapiens
ccauauugagucaaa

SEQ ID NO: 1704656 - RNA, 17 nt, Homo sapiens
ccauauuugauaguaua

SEQ ID NO: 1704657 - RNA, 13 nt, Homo sapiens
ccauccaguggag

SEQ ID NO: 1704658 - RNA, 14 nt, Homo sapiens
ccauccccuggacu

SEQ ID NO: 1704659 - RNA, 16 nt, Homo sapiens
ccauccuugacuuuga

SEQ ID NO: 1704660 - RNA, 23 nt, Homo sapiens
ccaucgaccuggagacugacaac

SEQ ID NO: 1704661 - RNA, 14 nt, Homo sapiens
ccaucuaugagcug

SEQ ID NO: 1704662 - RNA, 20 nt, Homo sapiens
ccaucuccuauaaucuguca

SEQ ID NO: 1704663 - RNA, 15 nt, Homo sapiens
ccaucucgggcacag

SEQ ID NO: 1704664 - RNA, 20 nt, Homo sapiens
ccaugaggaaggaacagcaa

SEQ ID NO: 1704665 - RNA, 17 nt, Homo sapiens
ccaugaggcaaugucag

SEQ ID NO: 1704666 - RNA, 21 nt, Homo sapiens
ccaugccaggaaccuguccua

SEQ ID NO: 1704667 - RNA, 17 nt, Homo sapiens
ccaugcuaagcaagcua

SEQ ID NO: 1704668 - RNA, 11 nt, Homo sapiens
ccaugcuauuu

SEQ ID NO: 1704669 - RNA, 18 nt, Homo sapiens
ccauggaagguucucugu

SEQ ID NO: 1704670 - RNA, 13 nt, Homo sapiens
ccaugguuuuacu

SEQ ID NO: 1704671 - RNA, 17 nt, Homo sapiens
ccauguauuuaucucua

SEQ ID NO: 1704672 - RNA, 21 nt, Homo sapiens
ccaugucuuuggacaaccaug

SEQ ID NO: 1704673 - RNA, 20 nt, Homo sapiens
ccauguucacaccgcugcac

SEQ ID NO: 1704674 - RNA, 23 nt, Homo sapiens
ccauguucugcccccagcccaaa

SEQ ID NO: 1704675 - RNA, 17 nt, Homo sapiens
ccauguuggccaggcug

SEQ ID NO: 1704676 - RNA, 18 nt, Homo sapiens
ccauguuguaaugcugca

SEQ ID NO: 1704677 - RNA, 22 nt, Homo sapiens
ccauguuguaaugcugcacuuc

SEQ ID NO: 1704678 - RNA, 22 nt, Homo sapiens
ccauucacaauaaaagcuuaaa

SEQ ID NO: 1704679 - RNA, 15 nt, Homo sapiens
ccauucagagacugu

SEQ ID NO: 1704680 - RNA, 16 nt, Homo sapiens
ccauuccaaagcuuua

SEQ ID NO: 1704681 - RNA, 18 nt, Homo sapiens
ccauucuccugccucagc

SEQ ID NO: 1704682 - RNA, 17 nt, Homo sapiens
ccauugccuagcucuuu

SEQ ID NO: 1704683 - RNA, 15 nt, Homo sapiens
ccauuugugccagag

SEQ ID NO: 1704684 - RNA, 17 nt, Homo sapiens
ccauuuuuuaauaaaga

SEQ ID NO: 1704685 - RNA, 18 nt, Homo sapiens
cccaaacaaugugcugga

SEQ ID NO: 1704686 - RNA, 15 nt, Homo sapiens
cccaaggaagagcca

SEQ ID NO: 1704687 - RNA, 17 nt, Homo sapiens
cccaaucagcacugaaa

SEQ ID NO: 1704688 - RNA, 20 nt, Homo sapiens
cccacacagcuacagcuuuc

SEQ ID NO: 1704689 - RNA, 17 nt, Homo sapiens
cccacacuggagccauc

SEQ ID NO: 1704690 - RNA, 14 nt, Homo sapiens
cccacccacaugug

SEQ ID NO: 1704691 - RNA, 17 nt, Homo sapiens
cccacccccuucucugc

SEQ ID NO: 1704692 - RNA, 18 nt, Homo sapiens
cccacgagaccccggcuu

SEQ ID NO: 1704693 - RNA, 22 nt, Homo sapiens
cccacgagggucaggacuguga

SEQ ID NO: 1704694 - RNA, 18 nt, Homo sapiens
cccacuaaaacugcauuu

SEQ ID NO: 1704695 - RNA, 14 nt, Homo sapiens
cccacuagcauuuu

SEQ ID NO: 1704696 - RNA, 16 nt, Homo sapiens
cccacuccagcgcuga

SEQ ID NO: 1704697 - RNA, 13 nt, Homo sapiens
cccacugagauuu

SEQ ID NO: 1704698 - RNA, 17 nt, Homo sapiens
cccacuggggugugugg

SEQ ID NO: 1704699 - RNA, 23 nt, Homo sapiens
cccacuugucacugacacaaagg

SEQ ID NO: 1704700 - RNA, 20 nt, Homo sapiens
cccagaacuucccugauuga

SEQ ID NO: 1704701 - RNA, 13 nt, Homo sapiens
cccagcaguucug

SEQ ID NO: 1704702 - RNA, 14 nt, Homo sapiens
cccagccccuccaa

SEQ ID NO: 1704703 - RNA, 21 nt, Homo sapiens
cccagcccuguucugggugca

SEQ ID NO: 1704704 - RNA, 22 nt, Homo sapiens
cccagccggcaggccuggacuu

SEQ ID NO: 1704705 - RNA, 16 nt, Homo sapiens
cccaggaacugggcca

SEQ ID NO: 1704706 - RNA, 15 nt, Homo sapiens
cccaggaaguggcca

SEQ ID NO: 1704707 - RNA, 19 nt, Homo sapiens
cccaggagaacaucuuuga

SEQ ID NO: 1704708 - RNA, 21 nt, Homo sapiens
cccaggaggugugauuccuga

SEQ ID NO: 1704709 - RNA, 18 nt, Homo sapiens
cccaggcucaacugagga

SEQ ID NO: 1704710 - RNA, 19 nt, Homo sapiens
cccaggcuggagugcagug

SEQ ID NO: 1704711 - RNA, 13 nt, Homo sapiens
cccagggcuaccc

SEQ ID NO: 1704712 - RNA, 13 nt, Homo sapiens
cccagggggcaug

SEQ ID NO: 1704713 - RNA, 20 nt, Homo sapiens
cccagguggaaggcagacag

SEQ ID NO: 1704714 - RNA, 22 nt, Homo sapiens
cccaguccccagcccuucacau

SEQ ID NO: 1704715 - RNA, 21 nt, Homo sapiens
cccaguucauugcacuuugau

SEQ ID NO: 1704716 - RNA, 13 nt, Homo sapiens
cccauacucagcc

SEQ ID NO: 1704717 - RNA, 23 nt, Homo sapiens
cccauagguggcugagcaucgga

SEQ ID NO: 1704718 - RNA, 17 nt, Homo sapiens
cccauaucugugaaaug

SEQ ID NO: 1704719 - RNA, 23 nt, Homo sapiens
cccauaucugugaaaugcuggca

SEQ ID NO: 1704720 - RNA, 22 nt, Homo sapiens
cccaucccacacccuggaggau

SEQ ID NO: 1704721 - RNA, 18 nt, Homo sapiens
cccaucccugccugguca

SEQ ID NO: 1704722 - RNA, 16 nt, Homo sapiens
cccaucuuaucaagga

SEQ ID NO: 1704723 - RNA, 23 nt, Homo sapiens
cccaucuuguuucacacuaguca

SEQ ID NO: 1704724 - RNA, 12 nt, Homo sapiens
cccauucuugca

SEQ ID NO: 1704725 - RNA, 16 nt, Homo sapiens
cccauugguguuguca

SEQ ID NO: 1704726 - RNA, 20 nt, Homo sapiens
cccauuugugccagaggaau

SEQ ID NO: 1704727 - RNA, 19 nt, Homo sapiens
cauuuauuaguaucuucca

SEQ ID NO: 1704728 - RNA, 19 nt, Homo sapiens
cauuuauuuacaugugauu

SEQ ID NO: 1704729 - RNA, 17 nt, Homo sapiens
cauuucaauuccuguga

SEQ ID NO: 1704730 - RNA, 20 nt, Homo sapiens
cauuuccaacaccacagaca

SEQ ID NO: 1704731 - RNA, 19 nt, Homo sapiens
cauuuccugacagaaggac

SEQ ID NO: 1704732 - RNA, 16 nt, Homo sapiens
cauuuccuuccuucca

SEQ ID NO: 1704733 - RNA, 19 nt, Homo sapiens
cauuucuccguugagucau

SEQ ID NO: 1704734 - RNA, 19 nt, Homo sapiens
cauuucuuuucuuuuuaca

SEQ ID NO: 1704735 - RNA, 21 nt, Homo sapiens
cauuugacugaagaugcagcu

SEQ ID NO: 1704736 - RNA, 13 nt, Homo sapiens
cauuugcaccuac

SEQ ID NO: 1704737 - RNA, 14 nt, Homo sapiens
cauuugcauuugcu

SEQ ID NO: 1704738 - RNA, 19 nt, Homo sapiens
cauuugcucuuucaucucu

SEQ ID NO: 1704739 - RNA, 22 nt, Homo sapiens
cauuuggugggcuuuggagcug

SEQ ID NO: 1704740 - RNA, 15 nt, Homo sapiens
cauuugugucaaugg

SEQ ID NO: 1704741 - RNA, 17 nt, Homo sapiens
cauuuuuaauaugacaa

SEQ ID NO: 1704742 - RNA, 19 nt, Homo sapiens
cauuuuuugggcagcaauu

SEQ ID NO: 1704743 - RNA, 11 nt, Homo sapiens
ccaaaagcuag

SEQ ID NO: 1704744 - RNA, 19 nt, Homo sapiens
ccaaaauaguuaagacaug

SEQ ID NO: 1704745 - RNA, 14 nt, Homo sapiens
ccaaacacaaugau

SEQ ID NO: 1704746 - RNA, 22 nt, Homo sapiens
ccaaacccaugaggcaauguca

SEQ ID NO: 1704747 - RNA, 14 nt, Homo sapiens
ccaaacugacucaa

SEQ ID NO: 1704748 - RNA, 13 nt, Homo sapiens
ccaaagaaaugaa

SEQ ID NO: 1704749 - RNA, 10 nt, Homo sapiens
ccaaaggggc

SEQ ID NO: 1704750 - RNA, 20 nt, Homo sapiens
ccaaaguccuuuuuuuccau

SEQ ID NO: 1704751 - RNA, 20 nt, Homo sapiens
ccaaagugccacucauuccu

SEQ ID NO: 1704752 - RNA, 15 nt, Homo sapiens
ccaaauaaauauauu

SEQ ID NO: 1704753 - RNA, 13 nt, Homo sapiens
ccaacaccacaga

SEQ ID NO: 1704754 - RNA, 12 nt, Homo sapiens
ccaacuaggcag

SEQ ID NO: 1704755 - RNA, 17 nt, Homo sapiens
ccaacucccucugggaa

SEQ ID NO: 1704756 - RNA, 12 nt, Homo sapiens
ccaacuccucac

SEQ ID NO: 1704757 - RNA, 20 nt, Homo sapiens
ccaacugaguguuauuugca

SEQ ID NO: 1704758 - RNA, 19 nt, Homo sapiens
ccaacuguauauauuccca

SEQ ID NO: 1704759 - RNA, 20 nt, Homo sapiens
ccaagcuuguuaucagcuuu

SEQ ID NO: 1704760 - RNA, 15 nt, Homo sapiens
ccaaggaaaccgccu

SEQ ID NO: 1704761 - RNA, 22 nt, Homo sapiens
ccaaggaacaaaaaaaccacaa

SEQ ID NO: 1704762 - RNA, 15 nt, Homo sapiens
ccaaggaugcuguca

SEQ ID NO: 1704763 - RNA, 15 nt, Homo sapiens
ccaagguuuaaagag

SEQ ID NO: 1704764 - RNA, 16 nt, Homo sapiens
ccaaguuuccaaacaa

SEQ ID NO: 1704765 - RNA, 12 nt, Homo sapiens
ccaauagcuuua

SEQ ID NO: 1704766 - RNA, 17 nt, Homo sapiens
ccaauaggcauuugauu

SEQ ID NO: 1704767 - RNA, 15 nt, Homo sapiens
ccaaucagcacugaa

SEQ ID NO: 1704768 - RNA, 15 nt, Homo sapiens
ccaauccaacaucca

SEQ ID NO: 1704769 - RNA, 20 nt, Homo sapiens
ccaaugaaagacacuguuuc

SEQ ID NO: 1704770 - RNA, 15 nt, Homo sapiens
ccaaugguccugacu

SEQ ID NO: 1704771 - RNA, 15 nt, Homo sapiens
ccaauugugcugcca

SEQ ID NO: 1704772 - RNA, 22 nt, Homo sapiens
ccaauuuaaagaaaacuguuaa

SEQ ID NO: 1704773 - RNA, 21 nt, Homo sapiens
ccacaaaggccaaacugcugg

SEQ ID NO: 1704774 - RNA, 15 nt, Homo sapiens
ccacaagucuuccag

SEQ ID NO: 1704775 - RNA, 20 nt, Homo sapiens
ccacaccacaaccaccuuca

SEQ ID NO: 1704776 - RNA, 11 nt, Homo sapiens
ccacacuugaa

SEQ ID NO: 1704777 - RNA, 21 nt, Homo sapiens
ccacacuuguuccagcucuuu

SEQ ID NO: 1704778 - RNA, 18 nt, Homo sapiens
ccacagagagaggggaga

SEQ ID NO: 1704779 - RNA, 14 nt, Homo sapiens
ccacagcagcauuu

SEQ ID NO: 1704780 - RNA, 18 nt, Homo sapiens
ccacaggaggcaagcaag

SEQ ID NO: 1704781 - RNA, 17 nt, Homo sapiens
ccacaucuugcucugcu

SEQ ID NO: 1704782 - RNA, 19 nt, Homo sapiens
ccacauuauacauuugaug

SEQ ID NO: 1704783 - RNA, 18 nt, Homo sapiens
ccacauuugguucuaaga

SEQ ID NO: 1704784 - RNA, 16 nt, Homo sapiens
ccaccaaagacaguug

SEQ ID NO: 1704785 - RNA, 17 nt, Homo sapiens
ccaccaaagcugcccac

SEQ ID NO: 1704786 - RNA, 18 nt, Homo sapiens
ccaccaaagcugcccacu

SEQ ID NO: 1704787 - RNA, 22 nt, Homo sapiens
ccaccacugggcaaacagaaga

SEQ ID NO: 1704788 - RNA, 18 nt, Homo sapiens
ccacccaccuaugugcca

SEQ ID NO: 1704789 - RNA, 15 nt, Homo sapiens
ccacccacuaauacu

SEQ ID NO: 1704790 - RNA, 16 nt, Homo sapiens
ccacccccagcucaau

SEQ ID NO: 1704791 - RNA, 14 nt, Homo sapiens
ccacccugggagac

SEQ ID NO: 1704792 - RNA, 24 nt, Homo sapiens
ccaccuagagguagguaggaucau

SEQ ID NO: 1704793 - RNA, 15 nt, Homo sapiens
ccaccuaugugccaa

SEQ ID NO: 1704794 - RNA, 17 nt, Homo sapiens
ccaccugggcauaucca

SEQ ID NO: 1704795 - RNA, 16 nt, Homo sapiens
ccacgaccuuugaaga

SEQ ID NO: 1704796 - RNA, 21 nt, Homo sapiens
ccacgagggucaggacuguga

SEQ ID NO: 1704797 - RNA, 18 nt, Homo sapiens
ccacgauuuucuccagcu

SEQ ID NO: 1704798 - RNA, 23 nt, Homo sapiens
ccacgcuagggcggggcacagau

SEQ ID NO: 1704799 - RNA, 17 nt, Homo sapiens
ccacgggccacgggaag

SEQ ID NO: 1704800 - RNA, 16 nt, Homo sapiens
ccacgucaacagaauu

SEQ ID NO: 1704801 - RNA, 19 nt, Homo sapiens
ccacuaccguaaaugucca

SEQ ID NO: 1704802 - RNA, 15 nt, Homo sapiens
ccacucccuuugcca

SEQ ID NO: 1704803 - RNA, 16 nt, Homo sapiens
ccacucccuuugccag

SEQ ID NO: 1704804 - RNA, 24 nt, Homo sapiens
ccacugaugcuguucucuucuuca

SEQ ID NO: 1704805 - RNA, 14 nt, Homo sapiens
ccacugcaaaacac

SEQ ID NO: 1704806 - RNA, 20 nt, Homo sapiens
ccacugugguggcaguggag

SEQ ID NO: 1704807 - RNA, 16 nt, Homo sapiens
ccacuucuaaauagca

SEQ ID NO: 1704808 - RNA, 12 nt, Homo sapiens
ccacuucugcca

SEQ ID NO: 1704809 - RNA, 12 nt, Homo sapiens
ccagaaaugucu

SEQ ID NO: 1704810 - RNA, 18 nt, Homo sapiens
ccagaacugcacucuuca

SEQ ID NO: 1704811 - RNA, 19 nt, Homo sapiens
ccagaagauccccucagga

SEQ ID NO: 1704812 - RNA, 15 nt, Homo sapiens
ccagaaguuccucaa

SEQ ID NO: 1704813 - RNA, 13 nt, Homo sapiens
ccagaauagcuuu

SEQ ID NO: 1704814 - RNA, 19 nt, Homo sapiens
ccagaaugcugcaggacuu

SEQ ID NO: 1704815 - RNA, 22 nt, Homo sapiens
ccagaaugcugcaggacuugag

SEQ ID NO: 1704816 - RNA, 19 nt, Homo sapiens
ccagacaccagugcgugcu

SEQ ID NO: 1704817 - RNA, 14 nt, Homo sapiens
ccagaccucaggga

SEQ ID NO: 1704818 - RNA, 22 nt, Homo sapiens
ccagacugcagguuggacccca

SEQ ID NO: 1704819 - RNA, 10 nt, Homo sapiens
ccagacuguu

SEQ ID NO: 1704820 - RNA, 14 nt, Homo sapiens
ccagagaauucuua

SEQ ID NO: 1704821 - RNA, 18 nt, Homo sapiens
ccagagagcaacucugag

SEQ ID NO: 1704822 - RNA, 20 nt, Homo sapiens
ccagagaggguggugaccuc

SEQ ID NO: 1704823 - RNA, 16 nt, Homo sapiens
ccagagcagaugcaga

SEQ ID NO: 1704824 - RNA, 17 nt, Homo sapiens
ccagagcagaugcagag

SEQ ID NO: 1704825 - RNA, 15 nt, Homo sapiens
ccagagcauuuccaa

SEQ ID NO: 1704826 - RNA, 16 nt, Homo sapiens
ccagagccaagaaaca

SEQ ID NO: 1704827 - RNA, 20 nt, Homo sapiens
ccagaggcagcucgugugcc

SEQ ID NO: 1704828 - RNA, 22 nt, Homo sapiens
ccagaucacugccacacucucc

SEQ ID NO: 1704829 - RNA, 18 nt, Homo sapiens
ccagaugagaagucugcu

SEQ ID NO: 1704830 - RNA, 22 nt, Homo sapiens
ccagcacuaacguaaauacaca

SEQ ID NO: 1704831 - RNA, 13 nt, Homo sapiens
ccagcacucugaa

SEQ ID NO: 1704832 - RNA, 15 nt, Homo sapiens
ccagcagacucugga

SEQ ID NO: 1704833 - RNA, 19 nt, Homo sapiens
ccagcauccccaacugcga

SEQ ID NO: 1704834 - RNA, 15 nt, Homo sapiens
ccagccagauccucu

SEQ ID NO: 1704835 - RNA, 15 nt, Homo sapiens
ccagccccacacagc

SEQ ID NO: 1704836 - RNA, 21 nt, Homo sapiens
ccagccccacugccagcagca

SEQ ID NO: 1704837 - RNA, 16 nt, Homo sapiens
caucacccucuuccug

SEQ ID NO: 1704838 - RNA, 14 nt, Homo sapiens
caucacuuugccaa

SEQ ID NO: 1704839 - RNA, 15 nt, Homo sapiens
caucagauaagacau

SEQ ID NO: 1704840 - RNA, 12 nt, Homo sapiens
caucagcauuug

SEQ ID NO: 1704841 - RNA, 15 nt, Homo sapiens
caucaggacucugac

SEQ ID NO: 1704842 - RNA, 12 nt, Homo sapiens
caucagggacag

SEQ ID NO: 1704843 - RNA, 15 nt, Homo sapiens
caucagucaacaacu

SEQ ID NO: 1704844 - RNA, 16 nt, Homo sapiens
caucagucaacaacuu

SEQ ID NO: 1704845 - RNA, 12 nt, Homo sapiens
caucaguucuuu

SEQ ID NO: 1704846 - RNA, 21 nt, Homo sapiens
caucauagccugcagccucau

SEQ ID NO: 1704847 - RNA, 19 nt, Homo sapiens
caucauggaggucauacau

SEQ ID NO: 1704848 - RNA, 23 nt, Homo sapiens
caucauggaggucauacaugcau

SEQ ID NO: 1704849 - RNA, 16 nt, Homo sapiens
cauccacugugccaug

SEQ ID NO: 1704850 - RNA, 17 nt, Homo sapiens
cauccagaaguuccuca

SEQ ID NO: 1704851 - RNA, 17 nt, Homo sapiens
cauccaggcccaacugu

SEQ ID NO: 1704852 - RNA, 13 nt, Homo sapiens
cauccaggcugcc

SEQ ID NO: 1704853 - RNA, 13 nt, Homo sapiens
cauccagugacaa

SEQ ID NO: 1704854 - RNA, 17 nt, Homo sapiens
cauccaguucaugagaa

SEQ ID NO: 1704855 - RNA, 15 nt, Homo sapiens
cauccauccaaaggc

SEQ ID NO: 1704856 - RNA, 18 nt, Homo sapiens
caucccaaccagugccaa

SEQ ID NO: 1704857 - RNA, 17 nt, Homo sapiens
caucccaggacaccaca

SEQ ID NO: 1704858 - RNA, 18 nt, Homo sapiens
caucccucguggucccca

SEQ ID NO: 1704859 - RNA, 16 nt, Homo sapiens
cauccugaacugcuuc

SEQ ID NO: 1704860 - RNA, 17 nt, Homo sapiens
cauccuucaagaacucu

SEQ ID NO: 1704861 - RNA, 12 nt, Homo sapiens
cauccuuccuau

SEQ ID NO: 1704862 - RNA, 21 nt, Homo sapiens
cauccuuguuuugaaaaccua

SEQ ID NO: 1704863 - RNA, 17 nt, Homo sapiens
cauccuuugcuuugcaa

SEQ ID NO: 1704864 - RNA, 22 nt, Homo sapiens
caucgaaucuacuaauuccaca

SEQ ID NO: 1704865 - RNA, 17 nt, Homo sapiens
caucuacccugcugacc

SEQ ID NO: 1704866 - RNA, 20 nt, Homo sapiens
caucuacccugcugaccucc

SEQ ID NO: 1704867 - RNA, 21 nt, Homo sapiens
caucuagcaaccgccucaaaa

SEQ ID NO: 1704868 - RNA, 13 nt, Homo sapiens
caucuauucaagc

SEQ ID NO: 1704869 - RNA, 21 nt, Homo sapiens
caucucagaaaacucugguaa

SEQ ID NO: 1704870 - RNA, 13 nt, Homo sapiens
caucucauuccaa

SEQ ID NO: 1704871 - RNA, 20 nt, Homo sapiens
caucuccacucuugugguca

SEQ ID NO: 1704872 - RNA, 11 nt, Homo sapiens
caucucccacc

SEQ ID NO: 1704873 - RNA, 23 nt, Homo sapiens
caucucucccuccccugccauuu

SEQ ID NO: 1704874 - RNA, 22 nt, Homo sapiens
caucugccaacuguccuacuca

SEQ ID NO: 1704875 - RNA, 21 nt, Homo sapiens
caucuggaaaccucuacauau

SEQ ID NO: 1704876 - RNA, 17 nt, Homo sapiens
caucuggcugccuuugc

SEQ ID NO: 1704877 - RNA, 18 nt, Homo sapiens
caucuuacuguaccuguu

SEQ ID NO: 1704878 - RNA, 15 nt, Homo sapiens
caucuuauagcacuu

SEQ ID NO: 1704879 - RNA, 21 nt, Homo sapiens
caucuuguaauuuccagcuuu

SEQ ID NO: 1704880 - RNA, 22 nt, Homo sapiens
caucuuuacaaaacuacaugag

SEQ ID NO: 1704881 - RNA, 18 nt, Homo sapiens
caugaaaauaaacuugaa

SEQ ID NO: 1704882 - RNA, 14 nt, Homo sapiens
caugaaucucucaa

SEQ ID NO: 1704883 - RNA, 11 nt, Homo sapiens
caugacacuga

SEQ ID NO: 1704884 - RNA, 13 nt, Homo sapiens
caugacacugacc

SEQ ID NO: 1704885 - RNA, 19 nt, Homo sapiens
caugaccugcgcucucagc

SEQ ID NO: 1704886 - RNA, 23 nt, Homo sapiens
caugagauguguggacuguggca

SEQ ID NO: 1704887 - RNA, 21 nt, Homo sapiens
caugagccucagcauccuggc

SEQ ID NO: 1704888 - RNA, 17 nt, Homo sapiens
caugaggacagaccaca

SEQ ID NO: 1704889 - RNA, 14 nt, Homo sapiens
caugaugagaguuu

SEQ ID NO: 1704890 - RNA, 15 nt, Homo sapiens
caugaugcagucucc

SEQ ID NO: 1704891 - RNA, 22 nt, Homo sapiens
caugauuuuuuuuuuucagucc

SEQ ID NO: 1704892 - RNA, 18 nt, Homo sapiens
caugcaguugugggaccg

SEQ ID NO: 1704893 - RNA, 23 nt, Homo sapiens
caugcccuggauccaucaggcca

SEQ ID NO: 1704894 - RNA, 14 nt, Homo sapiens
caugcgaugugucc

SEQ ID NO: 1704895 - RNA, 16 nt, Homo sapiens
caugcuacaguuauua

SEQ ID NO: 1704896 - RNA, 18 nt, Homo sapiens
caugcugggaaugagaca

SEQ ID NO: 1704897 - RNA, 17 nt, Homo sapiens
cauggacacuccagugc

SEQ ID NO: 1704898 - RNA, 21 nt, Homo sapiens
cauggccagguggccacucca

SEQ ID NO: 1704899 - RNA, 14 nt, Homo sapiens
cauggcccugugcu

SEQ ID NO: 1704900 - RNA, 14 nt, Homo sapiens
cauggccuaugcac

SEQ ID NO: 1704901 - RNA, 16 nt, Homo sapiens
cauggccuaugcacau

SEQ ID NO: 1704902 - RNA, 19 nt, Homo sapiens
cauggccuaugcacauaug

SEQ ID NO: 1704903 - RNA, 19 nt, Homo sapiens
caugguuacaaacuacaga

SEQ ID NO: 1704904 - RNA, 17 nt, Homo sapiens
cauguacauacccuggc

SEQ ID NO: 1704905 - RNA, 20 nt, Homo sapiens
cauguaucuuuugaacuggc

SEQ ID NO: 1704906 - RNA, 13 nt, Homo sapiens
cauguaugucuug

SEQ ID NO: 1704907 - RNA, 17 nt, Homo sapiens
cauguaugucuuggaca

SEQ ID NO: 1704908 - RNA, 22 nt, Homo sapiens
cauguaugucuuggacacugua

SEQ ID NO: 1704909 - RNA, 19 nt, Homo sapiens
caugugacacauaugcacc

SEQ ID NO: 1704910 - RNA, 14 nt, Homo sapiens
caugugcacaugca

SEQ ID NO: 1704911 - RNA, 15 nt, Homo sapiens
caugugggucuucca

SEQ ID NO: 1704912 - RNA, 18 nt, Homo sapiens
cauguguagccugugcau

SEQ ID NO: 1704913 - RNA, 16 nt, Homo sapiens
cauguuguaaugcugc

SEQ ID NO: 1704914 - RNA, 15 nt, Homo sapiens
cauguuuuguauaca

SEQ ID NO: 1704915 - RNA, 17 nt, Homo sapiens
cauuaaaccugucucca

SEQ ID NO: 1704916 - RNA, 20 nt, Homo sapiens
cauuaaauaccuauaugaau

SEQ ID NO: 1704917 - RNA, 13 nt, Homo sapiens
cauuaaaugacaa

SEQ ID NO: 1704918 - RNA, 14 nt, Homo sapiens
cauuaaauguuuga

SEQ ID NO: 1704919 - RNA, 17 nt, Homo sapiens
cauuagaacaaaggaca

SEQ ID NO: 1704920 - RNA, 21 nt, Homo sapiens
cauuauagauuuucauguucu

SEQ ID NO: 1704921 - RNA, 22 nt, Homo sapiens
cauuauuuucugucagaugaga

SEQ ID NO: 1704922 - RNA, 12 nt, Homo sapiens
cauucacuguga

SEQ ID NO: 1704923 - RNA, 21 nt, Homo sapiens
cauucauggaccacuguuucu

SEQ ID NO: 1704924 - RNA, 15 nt, Homo sapiens
cauuccaaauaugag

SEQ ID NO: 1704925 - RNA, 16 nt, Homo sapiens
cauuccuuugucuuca

SEQ ID NO: 1704926 - RNA, 16 nt, Homo sapiens
cauucuacuuuugcac

SEQ ID NO: 1704927 - RNA, 13 nt, Homo sapiens
cauucucugaguc

SEQ ID NO: 1704928 - RNA, 11 nt, Homo sapiens
cauucugacca

SEQ ID NO: 1704929 - RNA, 16 nt, Homo sapiens
cauucugaugagcaac

SEQ ID NO: 1704930 - RNA, 18 nt, Homo sapiens
cauucugcaagcacaucu

SEQ ID NO: 1704931 - RNA, 18 nt, Homo sapiens
cauucugcauugcuagau

SEQ ID NO: 1704932 - RNA, 23 nt, Homo sapiens
cauucugccgcccccuccugaac

SEQ ID NO: 1704933 - RNA, 17 nt, Homo sapiens
cauucuggaaaagcaaa

SEQ ID NO: 1704934 - RNA, 14 nt, Homo sapiens
cauugaaaugucac

SEQ ID NO: 1704935 - RNA, 23 nt, Homo sapiens
cauugagcugauauaaauucugu

SEQ ID NO: 1704936 - RNA, 15 nt, Homo sapiens
cauugagcugugcaa

SEQ ID NO: 1704937 - RNA, 13 nt, Homo sapiens
cauugccuagcuc

SEQ ID NO: 1704938 - RNA, 21 nt, Homo sapiens
cauuggauucaucagcauuug

SEQ ID NO: 1704939 - RNA, 22 nt, Homo sapiens
cauuggauucaucagcauuugg

SEQ ID NO: 1704940 - RNA, 19 nt, Homo sapiens
cauuggcacuguggagcuc

SEQ ID NO: 1704941 - RNA, 13 nt, Homo sapiens
cauugguguuguc

SEQ ID NO: 1704942 - RNA, 22 nt, Homo sapiens
cauuguaugauguguugugaua

SEQ ID NO: 1704943 - RNA, 15 nt, Homo sapiens
cauugugaggguuaa

SEQ ID NO: 1704944 - RNA, 20 nt, Homo sapiens
cauuguuaagaaaguauuug

SEQ ID NO: 1704945 - RNA, 22 nt, Homo sapiens
cauuuagaaaauagagcuuuua

SEQ ID NO: 1704946 - RNA, 13 nt, Homo sapiens
cauuuagaacuug

SEQ ID NO: 1704947 - RNA, 19 nt, Homo sapiens
cacuuccuuuuaccugccc

SEQ ID NO: 1704948 - RNA, 22 nt, Homo sapiens
cacuuguaagaaaaugagacaa

SEQ ID NO: 1704949 - RNA, 14 nt, Homo sapiens
cacuuguauaaaug

SEQ ID NO: 1704950 - RNA, 21 nt, Homo sapiens
cacuugucacugacacaaagg

SEQ ID NO: 1704951 - RNA, 16 nt, Homo sapiens
cacuuguuuggugcua

SEQ ID NO: 1704952 - RNA, 13 nt, Homo sapiens
cacuuuacuacuc

SEQ ID NO: 1704953 - RNA, 20 nt, Homo sapiens
cacuuucagaaaaacaaaug

SEQ ID NO: 1704954 - RNA, 20 nt, Homo sapiens
cagaaaacaagaugagauug

SEQ ID NO: 1704955 - RNA, 13 nt, Homo sapiens
cagaaaagcauac

SEQ ID NO: 1704956 - RNA, 14 nt, Homo sapiens
cagaaaaugagggc

SEQ ID NO: 1704957 - RNA, 22 nt, Homo sapiens
cagaaaccugcagggacuccau

SEQ ID NO: 1704958 - RNA, 21 nt, Homo sapiens
cagaaauggugcucaccaugc

SEQ ID NO: 1704959 - RNA, 21 nt, Homo sapiens
cagaacaguaucuuugcacuc

SEQ ID NO: 1704960 - RNA, 16 nt, Homo sapiens
cagaaccaccccggcc

SEQ ID NO: 1704961 - RNA, 23 nt, Homo sapiens
cagaaccauccauaguaguauga

SEQ ID NO: 1704962 - RNA, 16 nt, Homo sapiens
cagaacccagggcucu

SEQ ID NO: 1704963 - RNA, 18 nt, Homo sapiens
cagaaccccuacaugaaa

SEQ ID NO: 1704964 - RNA, 18 nt, Homo sapiens
cagaagccagaugcucac

SEQ ID NO: 1704965 - RNA, 17 nt, Homo sapiens
cagaagggagcagcaca

SEQ ID NO: 1704966 - RNA, 14 nt, Homo sapiens
cagaaggugccacu

SEQ ID NO: 1704967 - RNA, 14 nt, Homo sapiens
cagaaguacuccua

SEQ ID NO: 1704968 - RNA, 17 nt, Homo sapiens
cagaauauaauucccaa

SEQ ID NO: 1704969 - RNA, 12 nt, Homo sapiens
cagaauccagcu

SEQ ID NO: 1704970 - RNA, 18 nt, Homo sapiens
cagaauuuggaaauccua

SEQ ID NO: 1704971 - RNA, 21 nt, Homo sapiens
cagacaaaguaauuccucuca

SEQ ID NO: 1704972 - RNA, 23 nt, Homo sapiens
cagacacugaccauccacucuac

SEQ ID NO: 1704973 - RNA, 20 nt, Homo sapiens
cagacauacauuucucauac

SEQ ID NO: 1704974 - RNA, 18 nt, Homo sapiens
cagaccacagagcuguca

SEQ ID NO: 1704975 - RNA, 13 nt, Homo sapiens
cagaccucaggga

SEQ ID NO: 1704976 - RNA, 21 nt, Homo sapiens
cagacuguuagaaaauggaca

SEQ ID NO: 1704977 - RNA, 16 nt, Homo sapiens
cagagaaauacuuuca

SEQ ID NO: 1704978 - RNA, 17 nt, Homo sapiens
cagagaaauacuuucag

SEQ ID NO: 1704979 - RNA, 19 nt, Homo sapiens
cagagaaauacuuucaggc

SEQ ID NO: 1704980 - RNA, 16 nt, Homo sapiens
cagagagcaacucuga

SEQ ID NO: 1704981 - RNA, 20 nt, Homo sapiens
cagagcaagacuccaucuca

SEQ ID NO: 1704982 - RNA, 22 nt, Homo sapiens
cagagcagaugcagagagccau

SEQ ID NO: 1704983 - RNA, 13 nt, Homo sapiens
cagagcagggugu

SEQ ID NO: 1704984 - RNA, 19 nt, Homo sapiens
cagagcauuuaagagugaa

SEQ ID NO: 1704985 - RNA, 19 nt, Homo sapiens
cagagcucuuuaccaagga

SEQ ID NO: 1704986 - RNA, 16 nt, Homo sapiens
cagaggaauccuggca

SEQ ID NO: 1704987 - RNA, 15 nt, Homo sapiens
cagaggcggucuuca

SEQ ID NO: 1704988 - RNA, 19 nt, Homo sapiens
cagagguugcagugagcca

SEQ ID NO: 1704989 - RNA, 20 nt, Homo sapiens
cagagugagacucugucuca

SEQ ID NO: 1704990 - RNA, 18 nt, Homo sapiens
cagagugcacagcugucc

SEQ ID NO: 1704991 - RNA, 13 nt, Homo sapiens
cagaguuugccuu

SEQ ID NO: 1704992 - RNA, 14 nt, Homo sapiens
cagauaauuggcaa

SEQ ID NO: 1704993 - RNA, 17 nt, Homo sapiens
cagauagaguuccauau

SEQ ID NO: 1704994 - RNA, 19 nt, Homo sapiens
cagaucacugccacacucu

SEQ ID NO: 1704995 - RNA, 15 nt, Homo sapiens
cagaugaaaugcauc

SEQ ID NO: 1704996 - RNA, 16 nt, Homo sapiens
cagaugaauaaacuga

SEQ ID NO: 1704997 - RNA, 15 nt, Homo sapiens
cagaugauuguucaa

SEQ ID NO: 1704998 - RNA, 21 nt, Homo sapiens
cagaugccucagccuacuuuc

SEQ ID NO: 1704999 - RNA, 15 nt, Homo sapiens
cagauggggcacuga

SEQ ID NO: 1705000 - RNA, 15 nt, Homo sapiens
cagcaacugucuuau

SEQ ID NO: 1705001 - RNA, 20 nt, Homo sapiens
cagcaacuucuucuccaucc

SEQ ID NO: 1705002 - RNA, 16 nt, Homo sapiens
cagcaaggcccugcug

SEQ ID NO: 1705003 - RNA, 21 nt, Homo sapiens
cagcaaugacaucucaggggc

SEQ ID NO: 1705004 - RNA, 21 nt, Homo sapiens
cagcaauggugucaguaucca

SEQ ID NO: 1705005 - RNA, 13 nt, Homo sapiens
cagcaauuccuga

SEQ ID NO: 1705006 - RNA, 14 nt, Homo sapiens
cagcacggacaaua

SEQ ID NO: 1705007 - RNA, 10 nt, Homo sapiens
cagcacuaac

SEQ ID NO: 1705008 - RNA, 17 nt, Homo sapiens
cagcacucugaaacuga

SEQ ID NO: 1705009 - RNA, 20 nt, Homo sapiens
cagcacucugaaacugagaa

SEQ ID NO: 1705010 - RNA, 23 nt, Homo sapiens
cagcagaggcggucuucaacauc

SEQ ID NO: 1705011 - RNA, 17 nt, Homo sapiens
cagcagcuucaccagag

SEQ ID NO: 1705012 - RNA, 22 nt, Homo sapiens
cagcaugaggacagaccacaga

SEQ ID NO: 1705013 - RNA, 17 nt, Homo sapiens
cagcauucucacuccua

SEQ ID NO: 1705014 - RNA, 20 nt, Homo sapiens
cagccaccauccuauugcaa

SEQ ID NO: 1705015 - RNA, 22 nt, Homo sapiens
cagccacgagacgucaccaaga

SEQ ID NO: 1705016 - RNA, 23 nt, Homo sapiens
cagccccuagaaacccaagcucc

SEQ ID NO: 1705017 - RNA, 16 nt, Homo sapiens
cagccccuccaaaggu

SEQ ID NO: 1705018 - RNA, 22 nt, Homo sapiens
cagcccuguucugggugcagcu

SEQ ID NO: 1705019 - RNA, 20 nt, Homo sapiens
cagccuacuuucacacuaag

SEQ ID NO: 1705020 - RNA, 16 nt, Homo sapiens
cagccucccccggcuc

SEQ ID NO: 1705021 - RNA, 19 nt, Homo sapiens
cagccuggccaacauggca

SEQ ID NO: 1705022 - RNA, 20 nt, Homo sapiens
cagccugggcaacagagcaa

SEQ ID NO: 1705023 - RNA, 19 nt, Homo sapiens
cagccugggcagcauagca

SEQ ID NO: 1705024 - RNA, 24 nt, Homo sapiens
cagccugggccccagcucgcggga

SEQ ID NO: 1705025 - RNA, 18 nt, Homo sapiens
cagccugucccauggaca

SEQ ID NO: 1705026 - RNA, 23 nt, Homo sapiens
cagccugucccauggacacucca

SEQ ID NO: 1705027 - RNA, 14 nt, Homo sapiens
cagcuaaugggaca

SEQ ID NO: 1705028 - RNA, 23 nt, Homo sapiens
cagcuacucaggaggcugaagca

SEQ ID NO: 1705029 - RNA, 19 nt, Homo sapiens
cagcuauuuucaacauaac

SEQ ID NO: 1705030 - RNA, 17 nt, Homo sapiens
cagcucucuccuuucag

SEQ ID NO: 1705031 - RNA, 19 nt, Homo sapiens
cagcugccuuggacugugu

SEQ ID NO: 1705032 - RNA, 21 nt, Homo sapiens
cagcuggaagggucaacaucu

SEQ ID NO: 1705033 - RNA, 15 nt, Homo sapiens
cagcuguacugagga

SEQ ID NO: 1705034 - RNA, 20 nt, Homo sapiens
cagcuguccacugggccauu

SEQ ID NO: 1705035 - RNA, 18 nt, Homo sapiens
cagcugugggacaauuau

SEQ ID NO: 1705036 - RNA, 19 nt, Homo sapiens
cagcuucaccagagcauuu

SEQ ID NO: 1705037 - RNA, 13 nt, Homo sapiens
cagcuucagguua

SEQ ID NO: 1705038 - RNA, 23 nt, Homo sapiens
cagcuucuggggguagaucucaa

SEQ ID NO: 1705039 - RNA, 13 nt, Homo sapiens
cagcuuucuugcu

SEQ ID NO: 1705040 - RNA, 23 nt, Homo sapiens
caggaaaaaaaaaaaucuaucca

SEQ ID NO: 1705041 - RNA, 21 nt, Homo sapiens
caggaaagcuggugucugauu

SEQ ID NO: 1705042 - RNA, 14 nt, Homo sapiens
caggaaaguguuau

SEQ ID NO: 1705043 - RNA, 17 nt, Homo sapiens
caggaagcauucagaga

SEQ ID NO: 1705044 - RNA, 21 nt, Homo sapiens
caggaagggcaggaaggagag

SEQ ID NO: 1705045 - RNA, 16 nt, Homo sapiens
caggaaggggugugcu

SEQ ID NO: 1705046 - RNA, 19 nt, Homo sapiens
caggaaguggccaaaagcu

SEQ ID NO: 1705047 - RNA, 12 nt, Homo sapiens
caggaccaauaa

SEQ ID NO: 1705048 - RNA, 15 nt, Homo sapiens
caggaccaucuuccc

SEQ ID NO: 1705049 - RNA, 14 nt, Homo sapiens
caggagaacaucuu

SEQ ID NO: 1705050 - RNA, 17 nt, Homo sapiens
caggagaaccacuacau

SEQ ID NO: 1705051 - RNA, 19 nt, Homo sapiens
caggagagagaaagccagg

SEQ ID NO: 1705052 - RNA, 19 nt, Homo sapiens
caggaguucaauaaauguc

SEQ ID NO: 1705053 - RNA, 19 nt, Homo sapiens
caggaguucgagaccagcc

SEQ ID NO: 1705054 - RNA, 22 nt, Homo sapiens
caggaucaaaccccgaccaccu

SEQ ID NO: 1705055 - RNA, 15 nt, Homo sapiens
caggaucauggugua

SEQ ID NO: 1705056 - RNA, 13 nt, Homo sapiens
cacacacacaugc

SEQ ID NO: 1705057 - RNA, 13 nt, Homo sapiens
cacacacaugcac

SEQ ID NO: 1705058 - RNA, 14 nt, Homo sapiens
cacacacaugcaca

SEQ ID NO: 1705059 - RNA, 14 nt, Homo sapiens
cacacaucucauuu

SEQ ID NO: 1705060 - RNA, 14 nt, Homo sapiens
cacacgcgugcaca

SEQ ID NO: 1705061 - RNA, 14 nt, Homo sapiens
cacacuuggaugca

SEQ ID NO: 1705062 - RNA, 20 nt, Homo sapiens
cacacuuggaugcaggguuu

SEQ ID NO: 1705063 - RNA, 14 nt, Homo sapiens
cacagagucaggau

SEQ ID NO: 1705064 - RNA, 14 nt, Homo sapiens
cacagagugcauug

SEQ ID NO: 1705065 - RNA, 15 nt, Homo sapiens
cacagcaacaaugac

SEQ ID NO: 1705066 - RNA, 11 nt, Homo sapiens
cacagccaaac

SEQ ID NO: 1705067 - RNA, 23 nt, Homo sapiens
cacagcgucccuagcagugaacu

SEQ ID NO: 1705068 - RNA, 13 nt, Homo sapiens
cacagcuacagcu

SEQ ID NO: 1705069 - RNA, 19 nt, Homo sapiens
cacaggaagccugcagucc

SEQ ID NO: 1705070 - RNA, 21 nt, Homo sapiens
cacaggauuuguaauuccuua

SEQ ID NO: 1705071 - RNA, 17 nt, Homo sapiens
cacagggccaacuugag

SEQ ID NO: 1705072 - RNA, 15 nt, Homo sapiens
cacagugcaucucag

SEQ ID NO: 1705073 - RNA, 22 nt, Homo sapiens
cacauagauuaauggcacugau

SEQ ID NO: 1705074 - RNA, 13 nt, Homo sapiens
cacauaugcaccu

SEQ ID NO: 1705075 - RNA, 17 nt, Homo sapiens
cacauauggacucugca

SEQ ID NO: 1705076 - RNA, 14 nt, Homo sapiens
cacauccauuccca

SEQ ID NO: 1705077 - RNA, 15 nt, Homo sapiens
cacaugaugugcaua

SEQ ID NO: 1705078 - RNA, 23 nt, Homo sapiens
cacaugcacacacacacaucuca

SEQ ID NO: 1705079 - RNA, 18 nt, Homo sapiens
cacauggccuaugcacau

SEQ ID NO: 1705080 - RNA, 19 nt, Homo sapiens
cacauggccuaugcacaua

SEQ ID NO: 1705081 - RNA, 21 nt, Homo sapiens
cacauggccuaugcacauaug

SEQ ID NO: 1705082 - RNA, 22 nt, Homo sapiens
cacaugucuuguacauguguag

SEQ ID NO: 1705083 - RNA, 18 nt, Homo sapiens
cacaugugacacauaugc

SEQ ID NO: 1705084 - RNA, 16 nt, Homo sapiens
cacaugugcacaugca

SEQ ID NO: 1705085 - RNA, 18 nt, Homo sapiens
cacauucccaucugucac

SEQ ID NO: 1705086 - RNA, 19 nt, Homo sapiens
cacauuuauucugcucaca

SEQ ID NO: 1705087 - RNA, 20 nt, Homo sapiens
cacauuuuuauaucuguaca

SEQ ID NO: 1705088 - RNA, 15 nt, Homo sapiens
caccaaaaagggauc

SEQ ID NO: 1705089 - RNA, 15 nt, Homo sapiens
caccaaccugcauuu

SEQ ID NO: 1705090 - RNA, 19 nt, Homo sapiens
caccaacugaaguggcuaa

SEQ ID NO: 1705091 - RNA, 14 nt, Homo sapiens
caccaagcccaguu

SEQ ID NO: 1705092 - RNA, 14 nt, Homo sapiens
caccacaugugcac

SEQ ID NO: 1705093 - RNA, 20 nt, Homo sapiens
caccagagcauuuccaacac

SEQ ID NO: 1705094 - RNA, 14 nt, Homo sapiens
caccagccacuuua

SEQ ID NO: 1705095 - RNA, 21 nt, Homo sapiens
caccagccauacuuaucucuc

SEQ ID NO: 1705096 - RNA, 18 nt, Homo sapiens
caccaggcacugcugcac

SEQ ID NO: 1705097 - RNA, 23 nt, Homo sapiens
caccaugaagcgaaacacagaga

SEQ ID NO: 1705098 - RNA, 17 nt, Homo sapiens
cacccaaagcauggacu

SEQ ID NO: 1705099 - RNA, 17 nt, Homo sapiens
cacccaagcagagcaau

SEQ ID NO: 1705100 - RNA, 15 nt, Homo sapiens
cacccacuuugucca

SEQ ID NO: 1705101 - RNA, 18 nt, Homo sapiens
cacccagaccccaggcug

SEQ ID NO: 1705102 - RNA, 13 nt, Homo sapiens
cacccaggcacuu

SEQ ID NO: 1705103 - RNA, 18 nt, Homo sapiens
caccccacccucccugga

SEQ ID NO: 1705104 - RNA, 14 nt, Homo sapiens
caccccagggccaa

SEQ ID NO: 1705105 - RNA, 14 nt, Homo sapiens
cacccccagcucaa

SEQ ID NO: 1705106 - RNA, 18 nt, Homo sapiens
caccccgccugcccucau

SEQ ID NO: 1705107 - RNA, 22 nt, Homo sapiens
cacccucccccgccacuccuga

SEQ ID NO: 1705108 - RNA, 22 nt, Homo sapiens
cacccuccuuucaccacaugug

SEQ ID NO: 1705109 - RNA, 16 nt, Homo sapiens
cacccucuuccuguga

SEQ ID NO: 1705110 - RNA, 23 nt, Homo sapiens
cacccugagaaccccucugggaa

SEQ ID NO: 1705111 - RNA, 16 nt, Homo sapiens
cacccuuaacccaagg

SEQ ID NO: 1705112 - RNA, 16 nt, Homo sapiens
cacccuucucauucca

SEQ ID NO: 1705113 - RNA, 12 nt, Homo sapiens
caccuaccacuc

SEQ ID NO: 1705114 - RNA, 15 nt, Homo sapiens
caccuagacuguaaa

SEQ ID NO: 1705115 - RNA, 12 nt, Homo sapiens
caccuagccucg

SEQ ID NO: 1705116 - RNA, 13 nt, Homo sapiens
caccuccauuaaa

SEQ ID NO: 1705117 - RNA, 23 nt, Homo sapiens
caccuccgccagauccugcagaa

SEQ ID NO: 1705118 - RNA, 15 nt, Homo sapiens
caccuccucuaaggu

SEQ ID NO: 1705119 - RNA, 20 nt, Homo sapiens
caccucugugaccucaggca

SEQ ID NO: 1705120 - RNA, 23 nt, Homo sapiens
caccugcucuucuaccauuugaa

SEQ ID NO: 1705121 - RNA, 20 nt, Homo sapiens
caccuggguccaucagagaa

SEQ ID NO: 1705122 - RNA, 18 nt, Homo sapiens
caccugucaucauggagg

SEQ ID NO: 1705123 - RNA, 14 nt, Homo sapiens
caccuucucggcaa

SEQ ID NO: 1705124 - RNA, 15 nt, Homo sapiens
cacgcagauuagcag

SEQ ID NO: 1705125 - RNA, 22 nt, Homo sapiens
cacgccuaaggucacagcuagu

SEQ ID NO: 1705126 - RNA, 22 nt, Homo sapiens
cacgccuguaaucccaacacuu

SEQ ID NO: 1705127 - RNA, 13 nt, Homo sapiens
cacgcgugcacac

SEQ ID NO: 1705128 - RNA, 18 nt, Homo sapiens
cacgggcaugggcacucc

SEQ ID NO: 1705129 - RNA, 21 nt, Homo sapiens
cacguaugguggcucaugucu

SEQ ID NO: 1705130 - RNA, 18 nt, Homo sapiens
cacuaauggggcggugag

SEQ ID NO: 1705131 - RNA, 21 nt, Homo sapiens
cacuaccguaaauguccauuu

SEQ ID NO: 1705132 - RNA, 19 nt, Homo sapiens
cacuacugggugucauuuc

SEQ ID NO: 1705133 - RNA, 19 nt, Homo sapiens
cacuauagccuaggugaca

SEQ ID NO: 1705134 - RNA, 20 nt, Homo sapiens
cacuauaguuuaaaacacau

SEQ ID NO: 1705135 - RNA, 15 nt, Homo sapiens
cacuaucauggacua

SEQ ID NO: 1705136 - RNA, 21 nt, Homo sapiens
cacuaucauggacuacaccag

SEQ ID NO: 1705137 - RNA, 21 nt, Homo sapiens
cacuauguuuauuuacuaauu

SEQ ID NO: 1705138 - RNA, 21 nt, Homo sapiens
cacucacuccacaacccaaga

SEQ ID NO: 1705139 - RNA, 17 nt, Homo sapiens
cacucagugcagcaaua

SEQ ID NO: 1705140 - RNA, 14 nt, Homo sapiens
cacuccacuggccu

SEQ ID NO: 1705141 - RNA, 16 nt, Homo sapiens
cacuccagcgcugagu

SEQ ID NO: 1705142 - RNA, 13 nt, Homo sapiens
cacuccagugcca

SEQ ID NO: 1705143 - RNA, 21 nt, Homo sapiens
cacucccuugguggcaagagc

SEQ ID NO: 1705144 - RNA, 14 nt, Homo sapiens
cacucugggcacac

SEQ ID NO: 1705145 - RNA, 19 nt, Homo sapiens
auccaggcccaacugugag

SEQ ID NO: 1705146 - RNA, 12 nt, Homo sapiens
auccagugacaa

SEQ ID NO: 1705147 - RNA, 17 nt, Homo sapiens
auccauauugagucaaa

SEQ ID NO: 1705148 - RNA, 18 nt, Homo sapiens
aucccaaccagugccaag

SEQ ID NO: 1705149 - RNA, 16 nt, Homo sapiens
aucccaagugcacuuu

SEQ ID NO: 1705150 - RNA, 17 nt, Homo sapiens
aucccacccacauguga

SEQ ID NO: 1705151 - RNA, 18 nt, Homo sapiens
aucccaggauuaggccau

SEQ ID NO: 1705152 - RNA, 21 nt, Homo sapiens
auccccguuccugacaucaca

SEQ ID NO: 1705153 - RNA, 17 nt, Homo sapiens
auccccuuuguguagaa

SEQ ID NO: 1705154 - RNA, 16 nt, Homo sapiens
aucccgagucugggac

SEQ ID NO: 1705155 - RNA, 12 nt, Homo sapiens
aucccuaccccc

SEQ ID NO: 1705156 - RNA, 18 nt, Homo sapiens
aucccucgugguccccaa

SEQ ID NO: 1705157 - RNA, 14 nt, Homo sapiens
aucccucuaaugag

SEQ ID NO: 1705158 - RNA, 13 nt, Homo sapiens
aucccuuccccag

SEQ ID NO: 1705159 - RNA, 17 nt, Homo sapiens
aucccuucucacagcac

SEQ ID NO: 1705160 - RNA, 13 nt, Homo sapiens
auccguacauuca

SEQ ID NO: 1705161 - RNA, 20 nt, Homo sapiens
auccuaagaaauaugugaga

SEQ ID NO: 1705162 - RNA, 19 nt, Homo sapiens
auccuacccuuuucugggg

SEQ ID NO: 1705163 - RNA, 14 nt, Homo sapiens
auccucaugcugcu

SEQ ID NO: 1705164 - RNA, 14 nt, Homo sapiens
auccucccaccuca

SEQ ID NO: 1705165 - RNA, 15 nt, Homo sapiens
auccucccaccucag

SEQ ID NO: 1705166 - RNA, 16 nt, Homo sapiens
auccugaccugagcca

SEQ ID NO: 1705167 - RNA, 20 nt, Homo sapiens
auccugcagaaguacuccua

SEQ ID NO: 1705168 - RNA, 17 nt, Homo sapiens
auccugccacccuguag

SEQ ID NO: 1705169 - RNA, 22 nt, Homo sapiens
auccugggggacccaauguagg

SEQ ID NO: 1705170 - RNA, 20 nt, Homo sapiens
auccuguauaagcacugaaa

SEQ ID NO: 1705171 - RNA, 13 nt, Homo sapiens
auccuuauuccuc

SEQ ID NO: 1705172 - RNA, 14 nt, Homo sapiens
auccuuccaaagaa

SEQ ID NO: 1705173 - RNA, 20 nt, Homo sapiens
agugcugcuauaucuaucca

SEQ ID NO: 1705174 - RNA, 17 nt, Homo sapiens
agugcugggauuacaau

SEQ ID NO: 1705175 - RNA, 21 nt, Homo sapiens
agugcugggauuacaggugug

SEQ ID NO: 1705176 - RNA, 14 nt, Homo sapiens
aguggaaaaacaca

SEQ ID NO: 1705177 - RNA, 15 nt, Homo sapiens
aguggccgaugauuu

SEQ ID NO: 1705178 - RNA, 20 nt, Homo sapiens
aguggcgugaucucggcuca

SEQ ID NO: 1705179 - RNA, 14 nt, Homo sapiens
aguggcuucaucug

SEQ ID NO: 1705180 - RNA, 11 nt, Homo sapiens
agugggagaag

SEQ ID NO: 1705181 - RNA, 20 nt, Homo sapiens
agugggaucugucacaccag

SEQ ID NO: 1705182 - RNA, 22 nt, Homo sapiens
agugggcaggauaaacugaaaa

SEQ ID NO: 1705183 - RNA, 18 nt, Homo sapiens
agugggcuccuggcagaa

SEQ ID NO: 1705184 - RNA, 15 nt, Homo sapiens
aguguaccauuugcc

SEQ ID NO: 1705185 - RNA, 23 nt, Homo sapiens
aguguauuuuauguguggcccaa

SEQ ID NO: 1705186 - RNA, 21 nt, Homo sapiens
aguguccccuccacugucaca

SEQ ID NO: 1705187 - RNA, 20 nt, Homo sapiens
aguguccccuuauacagugg

SEQ ID NO: 1705188 - RNA, 14 nt, Homo sapiens
agugugacagggcc

SEQ ID NO: 1705189 - RNA, 19 nt, Homo sapiens
aguguggaaccacugacua

SEQ ID NO: 1705190 - RNA, 16 nt, Homo sapiens
agugugggggguccuu

SEQ ID NO: 1705191 - RNA, 18 nt, Homo sapiens
agugugugacauuccagg

SEQ ID NO: 1705192 - RNA, 17 nt, Homo sapiens
aguguugccuaaguauu

SEQ ID NO: 1705193 - RNA, 13 nt, Homo sapiens
aguuaaucuucau

SEQ ID NO: 1705194 - RNA, 19 nt, Homo sapiens
aguuaaugauuuuacuuaa

SEQ ID NO: 1705195 - RNA, 14 nt, Homo sapiens
aguuacccacugaa

SEQ ID NO: 1705196 - RNA, 22 nt, Homo sapiens
aguuagguagcuuuagggcaau

SEQ ID NO: 1705197 - RNA, 21 nt, Homo sapiens
aguuauaggaacaauucucuu

SEQ ID NO: 1705198 - RNA, 17 nt, Homo sapiens
aguuaugauguaaucuc

SEQ ID NO: 1705199 - RNA, 16 nt, Homo sapiens
aguuauggugaaccca

SEQ ID NO: 1705200 - RNA, 14 nt, Homo sapiens
aguuauucauucug

SEQ ID NO: 1705201 - RNA, 20 nt, Homo sapiens
aguuccuguagaacugagaa

SEQ ID NO: 1705202 - RNA, 15 nt, Homo sapiens
aguucggcucugggu

SEQ ID NO: 1705203 - RNA, 15 nt, Homo sapiens
aguucuaagauucua

SEQ ID NO: 1705204 - RNA, 22 nt, Homo sapiens
aguucuaggcacuguaguucua

SEQ ID NO: 1705205 - RNA, 14 nt, Homo sapiens
aguucuaggcauag

SEQ ID NO: 1705206 - RNA, 16 nt, Homo sapiens
aguucuuuugucuuag

SEQ ID NO: 1705207 - RNA, 17 nt, Homo sapiens
aguugguuuaaugauug

SEQ ID NO: 1705208 - RNA, 21 nt, Homo sapiens
aguugugucagcuacugcgga

SEQ ID NO: 1705209 - RNA, 20 nt, Homo sapiens
aguuguuuguuuuugcuugu

SEQ ID NO: 1705210 - RNA, 12 nt, Homo sapiens
aguuuaccucuu

SEQ ID NO: 1705211 - RNA, 18 nt, Homo sapiens
aguuucaaacuuacuauu

SEQ ID NO: 1705212 - RNA, 15 nt, Homo sapiens
aguuucaaugugauu

SEQ ID NO: 1705213 - RNA, 21 nt, Homo sapiens
aguuucucagcucccaaggcu

SEQ ID NO: 1705214 - RNA, 22 nt, Homo sapiens
aguuugaacaaaaucuccucuu

SEQ ID NO: 1705215 - RNA, 14 nt, Homo sapiens
aguuugaccucaca

SEQ ID NO: 1705216 - RNA, 16 nt, Homo sapiens
aguuugccuuccuuuc

SEQ ID NO: 1705217 - RNA, 22 nt, Homo sapiens
aguuuuaaacaaaugugauaca

SEQ ID NO: 1705218 - RNA, 21 nt, Homo sapiens
aguuuuaauguauaguuuuga

SEQ ID NO: 1705219 - RNA, 19 nt, Homo sapiens
aguuuuaguuuucucuuag

SEQ ID NO: 1705220 - RNA, 20 nt, Homo sapiens
auaaaaaauuaugacaaugu

SEQ ID NO: 1705221 - RNA, 21 nt, Homo sapiens
auaaaaauauuguguugugaa

SEQ ID NO: 1705222 - RNA, 19 nt, Homo sapiens
auaaaacaugggaaucucc

SEQ ID NO: 1705223 - RNA, 23 nt, Homo sapiens
auaaacaacauugagauuaugau

SEQ ID NO: 1705224 - RNA, 20 nt, Homo sapiens
auaaaccaaaggacauuaug

SEQ ID NO: 1705225 - RNA, 18 nt, Homo sapiens
auaaacugaauuuguacu

SEQ ID NO: 1705226 - RNA, 18 nt, Homo sapiens
auaaacugacuaaacuua

SEQ ID NO: 1705227 - RNA, 20 nt, Homo sapiens
auaaacugacuaaacuuaca

SEQ ID NO: 1705228 - RNA, 20 nt, Homo sapiens
auaaacuguaugcucacaac

SEQ ID NO: 1705229 - RNA, 19 nt, Homo sapiens
auaaacuuuuuuucaaugu

SEQ ID NO: 1705230 - RNA, 11 nt, Homo sapiens
auaaagccaug

SEQ ID NO: 1705231 - RNA, 14 nt, Homo sapiens
auaaaggaugugau

SEQ ID NO: 1705232 - RNA, 21 nt, Homo sapiens
auaaagucuauggacagggcu

SEQ ID NO: 1705233 - RNA, 18 nt, Homo sapiens
auaaaguguaaguucaca

SEQ ID NO: 1705234 - RNA, 22 nt, Homo sapiens
auaaauccauccauccaaaggc

SEQ ID NO: 1705235 - RNA, 16 nt, Homo sapiens
auaaaugggaaaucag

SEQ ID NO: 1705236 - RNA, 14 nt, Homo sapiens
auaaaugugaacuu

SEQ ID NO: 1705237 - RNA, 14 nt, Homo sapiens
auaaauuauggcau

SEQ ID NO: 1705238 - RNA, 12 nt, Homo sapiens
auaaauucccaa

SEQ ID NO: 1705239 - RNA, 19 nt, Homo sapiens
auaaauugcauaaagcaua

SEQ ID NO: 1705240 - RNA, 18 nt, Homo sapiens
auaaauugcuccuugaca

SEQ ID NO: 1705241 - RNA, 20 nt, Homo sapiens
auaacaaaauggacauggug

SEQ ID NO: 1705242 - RNA, 12 nt, Homo sapiens
auaacagaauua

SEQ ID NO: 1705243 - RNA, 18 nt, Homo sapiens
auaacccuacacccagac

SEQ ID NO: 1705244 - RNA, 12 nt, Homo sapiens
auaacuguuuau

SEQ ID NO: 1705245 - RNA, 18 nt, Homo sapiens
auaagagugccguaacaa

SEQ ID NO: 1705246 - RNA, 17 nt, Homo sapiens
auaagccacucuguccc

SEQ ID NO: 1705247 - RNA, 17 nt, Homo sapiens
auaauaaaaaauauucu

SEQ ID NO: 1705248 - RNA, 14 nt, Homo sapiens
auaaucacauugac

SEQ ID NO: 1705249 - RNA, 16 nt, Homo sapiens
auaaucccagcacuuu

SEQ ID NO: 1705250 - RNA, 22 nt, Homo sapiens
auaaugcuuucacaacauuugc

SEQ ID NO: 1705251 - RNA, 20 nt, Homo sapiens
auaaugguuuuuaacaccuu

SEQ ID NO: 1705252 - RNA, 20 nt, Homo sapiens
auaauuaaccaccaauccaa

SEQ ID NO: 1705253 - RNA, 22 nt, Homo sapiens
auaauucacucaagcacugaua

SEQ ID NO: 1705254 - RNA, 22 nt, Homo sapiens
auaauuccuauauccugugacu

SEQ ID NO: 1705255 - RNA, 20 nt, Homo sapiens
auaauugcucauaagcaaua

SEQ ID NO: 1705256 - RNA, 12 nt, Homo sapiens
auaauuguugaa

SEQ ID NO: 1705257 - RNA, 14 nt, Homo sapiens
auaauuucuaaugu

SEQ ID NO: 1705258 - RNA, 16 nt, Homo sapiens
auaauuuuaugcugga

SEQ ID NO: 1705259 - RNA, 15 nt, Homo sapiens
auaauuuucauucau

SEQ ID NO: 1705260 - RNA, 16 nt, Homo sapiens
auacaagaaagcaaug

SEQ ID NO: 1705261 - RNA, 21 nt, Homo sapiens
auacacgguauuuauagagag

SEQ ID NO: 1705262 - RNA, 20 nt, Homo sapiens
auacacuuuuuaaaaucuca

SEQ ID NO: 1705263 - RNA, 21 nt, Homo sapiens
auacacuuuuuaaaaucucaa

SEQ ID NO: 1705264 - RNA, 16 nt, Homo sapiens
auacauacacuuguau

SEQ ID NO: 1705265 - RNA, 19 nt, Homo sapiens
auacauacggucagguuua

SEQ ID NO: 1705266 - RNA, 17 nt, Homo sapiens
auacaucaaaauauacu

SEQ ID NO: 1705267 - RNA, 15 nt, Homo sapiens
auacauguguguaua

SEQ ID NO: 1705268 - RNA, 17 nt, Homo sapiens
auacauguguguauaua

SEQ ID NO: 1705269 - RNA, 17 nt, Homo sapiens
auacauuugaggggaaa

SEQ ID NO: 1705270 - RNA, 21 nt, Homo sapiens
auaccaacuguacaaaauaac

SEQ ID NO: 1705271 - RNA, 14 nt, Homo sapiens
auaccauugacaca

SEQ ID NO: 1705272 - RNA, 19 nt, Homo sapiens
auaccuaaguacuguaaua

SEQ ID NO: 1705273 - RNA, 21 nt, Homo sapiens
auaccuguugagacugauuca

SEQ ID NO: 1705274 - RNA, 19 nt, Homo sapiens
auaccuuccccacaucuga

SEQ ID NO: 1705275 - RNA, 15 nt, Homo sapiens
auaccuuuuuguguc

SEQ ID NO: 1705276 - RNA, 21 nt, Homo sapiens
auacgccuguaguccuagcca

SEQ ID NO: 1705277 - RNA, 22 nt, Homo sapiens
auacuauuuaaagccuccucau

SEQ ID NO: 1705278 - RNA, 13 nt, Homo sapiens
auacucagguuaa

SEQ ID NO: 1705279 - RNA, 21 nt, Homo sapiens
auacugcagggccaggacuga

SEQ ID NO: 1705280 - RNA, 16 nt, Homo sapiens
auacuggacucuucaa

SEQ ID NO: 1705281 - RNA, 13 nt, Homo sapiens
auacuuuacaaag

SEQ ID NO: 1705282 - RNA, 13 nt, Homo sapiens
auacuuucaggca

SEQ ID NO: 1705283 - RNA, 16 nt, Homo sapiens
auacuuugucugaaaa

SEQ ID NO: 1705284 - RNA, 17 nt, Homo sapiens
auagaaacaugacacug

SEQ ID NO: 1705285 - RNA, 16 nt, Homo sapiens
auagaauuuccaauau

SEQ ID NO: 1705286 - RNA, 15 nt, Homo sapiens
auagacaauuugcac

SEQ ID NO: 1705287 - RNA, 15 nt, Homo sapiens
auagaguauaugcac

SEQ ID NO: 1705288 - RNA, 21 nt, Homo sapiens
auagagugguacagcacuguu

SEQ ID NO: 1705289 - RNA, 13 nt, Homo sapiens
auagaucuuaggg

SEQ ID NO: 1705290 - RNA, 21 nt, Homo sapiens
auagaugcacuuaugcaguaa

SEQ ID NO: 1705291 - RNA, 19 nt, Homo sapiens
auagauggguuauuucaac

SEQ ID NO: 1705292 - RNA, 16 nt, Homo sapiens
auagauuaauggcacu

SEQ ID NO: 1705293 - RNA, 19 nt, Homo sapiens
auagauuaauggcacugau

SEQ ID NO: 1705294 - RNA, 19 nt, Homo sapiens
auagauuucuacacugagg

SEQ ID NO: 1705295 - RNA, 15 nt, Homo sapiens
auagcaaacacuggg

SEQ ID NO: 1705296 - RNA, 12 nt, Homo sapiens
auagcacuuuga

SEQ ID NO: 1705297 - RNA, 22 nt, Homo sapiens
auagcacuuugaaauaccucau

SEQ ID NO: 1705298 - RNA, 13 nt, Homo sapiens
auagcaucucagg

SEQ ID NO: 1705299 - RNA, 15 nt, Homo sapiens
auaggagaggaugag

SEQ ID NO: 1705300 - RNA, 19 nt, Homo sapiens
auaggccaucaauaucaca

SEQ ID NO: 1705301 - RNA, 21 nt, Homo sapiens
auagucauuccaaauaugaga

SEQ ID NO: 1705302 - RNA, 14 nt, Homo sapiens
auaguuaagacaug

SEQ ID NO: 1705303 - RNA, 19 nt, Homo sapiens
auaguuauauaauucacuc

SEQ ID NO: 1705304 - RNA, 14 nt, Homo sapiens
auaguuauuaucca

SEQ ID NO: 1705305 - RNA, 23 nt, Homo sapiens
auaguuuucuccuuuuacuucac

SEQ ID NO: 1705306 - RNA, 16 nt, Homo sapiens
auauaagcugccauau

SEQ ID NO: 1705307 - RNA, 20 nt, Homo sapiens
auauaauucacucaagcacu

SEQ ID NO: 1705308 - RNA, 19 nt, Homo sapiens
auauacacauauaccuaua

SEQ ID NO: 1705309 - RNA, 13 nt, Homo sapiens
auauacagaggaa

SEQ ID NO: 1705310 - RNA, 16 nt, Homo sapiens
auauacaguaacuuua

SEQ ID NO: 1705311 - RNA, 17 nt, Homo sapiens
auauaccuauaaugugu

SEQ ID NO: 1705312 - RNA, 18 nt, Homo sapiens
auauacgaacaaaacaca

SEQ ID NO: 1705313 - RNA, 21 nt, Homo sapiens
aacugauuuuuagcuuuacaa

SEQ ID NO: 1705314 - RNA, 13 nt, Homo sapiens
aacugcauuuccu

SEQ ID NO: 1705315 - RNA, 19 nt, Homo sapiens
aacuggguacuuguggaca

SEQ ID NO: 1705316 - RNA, 14 nt, Homo sapiens
aacuguacauguga

SEQ ID NO: 1705317 - RNA, 14 nt, Homo sapiens
aacuguacauuuca

SEQ ID NO: 1705318 - RNA, 18 nt, Homo sapiens
aacuguagauaaaguggu

SEQ ID NO: 1705319 - RNA, 16 nt, Homo sapiens
aacuguagaugaugua

SEQ ID NO: 1705320 - RNA, 17 nt, Homo sapiens
aacuguauauauuccca

SEQ ID NO: 1705321 - RNA, 13 nt, Homo sapiens
aacuguaugcuca

SEQ ID NO: 1705322 - RNA, 14 nt, Homo sapiens
aacugucacucauu

SEQ ID NO: 1705323 - RNA, 20 nt, Homo sapiens
aacugucacucauugcugag

SEQ ID NO: 1705324 - RNA, 17 nt, Homo sapiens
aacuuaaaaauauccau

SEQ ID NO: 1705325 - RNA, 23 nt, Homo sapiens
aacuucccugauugaccugcucc

SEQ ID NO: 1705326 - RNA, 20 nt, Homo sapiens
aacuuccuacguauccugca

SEQ ID NO: 1705327 - RNA, 14 nt, Homo sapiens
aacuucuugucaga

SEQ ID NO: 1705328 - RNA, 22 nt, Homo sapiens
aacuugagcgugaaucuguauc

SEQ ID NO: 1705329 - RNA, 14 nt, Homo sapiens
aacuugcugaucca

SEQ ID NO: 1705330 - RNA, 16 nt, Homo sapiens
aacuuuaaacauugac

SEQ ID NO: 1705331 - RNA, 13 nt, Homo sapiens
aacuuuggcuuau

SEQ ID NO: 1705332 - RNA, 18 nt, Homo sapiens
aacuuuucugcugauaag

SEQ ID NO: 1705333 - RNA, 16 nt, Homo sapiens
aagaaaaaauaucuug

SEQ ID NO: 1705334 - RNA, 20 nt, Homo sapiens
aagaaagacucuauucucaa

SEQ ID NO: 1705335 - RNA, 21 nt, Homo sapiens
aagaaagacucuauucucaaa

SEQ ID NO: 1705336 - RNA, 15 nt, Homo sapiens
aagaaauaugugaga

SEQ ID NO: 1705337 - RNA, 16 nt, Homo sapiens
aagaaccgagcaauuu

SEQ ID NO: 1705338 - RNA, 18 nt, Homo sapiens
aagaacucugggcugcua

SEQ ID NO: 1705339 - RNA, 20 nt, Homo sapiens
aagaacuuucucugccauca

SEQ ID NO: 1705340 - RNA, 21 nt, Homo sapiens
aagaagacuguugccacuuaa

SEQ ID NO: 1705341 - RNA, 15 nt, Homo sapiens
aagaagcuaugucaa

SEQ ID NO: 1705342 - RNA, 19 nt, Homo sapiens
aagaaggugcuuucugcuu

SEQ ID NO: 1705343 - RNA, 13 nt, Homo sapiens
aagaaugaucagc

SEQ ID NO: 1705344 - RNA, 22 nt, Homo sapiens
aagaauguugguuuacuuucaa

SEQ ID NO: 1705345 - RNA, 13 nt, Homo sapiens
aagaauuaacaga

SEQ ID NO: 1705346 - RNA, 13 nt, Homo sapiens
aagaauuggccag

SEQ ID NO: 1705347 - RNA, 17 nt, Homo sapiens
aagaauuuaaaauaaca

SEQ ID NO: 1705348 - RNA, 15 nt, Homo sapiens
aagacacaaaugcau

SEQ ID NO: 1705349 - RNA, 14 nt, Homo sapiens
aagacaccauuuau

SEQ ID NO: 1705350 - RNA, 16 nt, Homo sapiens
aagacagaugccccag

SEQ ID NO: 1705351 - RNA, 22 nt, Homo sapiens
aagacauaacguuuuuccuuua

SEQ ID NO: 1705352 - RNA, 20 nt, Homo sapiens
aagacaugauuuccuugaau

SEQ ID NO: 1705353 - RNA, 17 nt, Homo sapiens
aagaccuagugcucuua

SEQ ID NO: 1705354 - RNA, 21 nt, Homo sapiens
aagacuaaucgaaugaacaaa

SEQ ID NO: 1705355 - RNA, 18 nt, Homo sapiens
aagagaaccgagcaaaga

SEQ ID NO: 1705356 - RNA, 13 nt, Homo sapiens
aagagcaaaaaua

SEQ ID NO: 1705357 - RNA, 22 nt, Homo sapiens
aagagcccccuugacaccgggg

SEQ ID NO: 1705358 - RNA, 18 nt, Homo sapiens
aagaggagcacuuccaaa

SEQ ID NO: 1705359 - RNA, 22 nt, Homo sapiens
aagaggagcacuuccaaaauuc

SEQ ID NO: 1705360 - RNA, 20 nt, Homo sapiens
aagaggaucuccuguccauc

SEQ ID NO: 1705361 - RNA, 14 nt, Homo sapiens
aagaggcagggucu

SEQ ID NO: 1705362 - RNA, 13 nt, Homo sapiens
aagaguaguaaua

SEQ ID NO: 1705363 - RNA, 14 nt, Homo sapiens
aagaguaguaauag

SEQ ID NO: 1705364 - RNA, 17 nt, Homo sapiens
aagaguccuuguuccag

SEQ ID NO: 1705365 - RNA, 16 nt, Homo sapiens
aagagugauugcagcu

SEQ ID NO: 1705366 - RNA, 11 nt, Homo sapiens
aagaguggucu

SEQ ID NO: 1705367 - RNA, 14 nt, Homo sapiens
aagaguucuggaaa

SEQ ID NO: 1705368 - RNA, 21 nt, Homo sapiens
aagaguuugccuguacucuua

SEQ ID NO: 1705369 - RNA, 14 nt, Homo sapiens
aagaguuuucuucc

SEQ ID NO: 1705370 - RNA, 22 nt, Homo sapiens
aagauauggagaauugcugaag

SEQ ID NO: 1705371 - RNA, 13 nt, Homo sapiens
aagauauuguaca

SEQ ID NO: 1705372 - RNA, 16 nt, Homo sapiens
aagauauuguacauaa

SEQ ID NO: 1705373 - RNA, 23 nt, Homo sapiens
aagaucaaaagcuuauucaucug

SEQ ID NO: 1705374 - RNA, 16 nt, Homo sapiens
aagaugggaacacugg

SEQ ID NO: 1705375 - RNA, 20 nt, Homo sapiens
aagaugugauauucuaagac

SEQ ID NO: 1705376 - RNA, 22 nt, Homo sapiens
aagauguugauuuuuacugugu

SEQ ID NO: 1705377 - RNA, 21 nt, Homo sapiens
aagauuauagauucuaaagau

SEQ ID NO: 1705378 - RNA, 21 nt, Homo sapiens
aagauucacauaguuuauuuc

SEQ ID NO: 1705379 - RNA, 15 nt, Homo sapiens
aagauucaccugaga

SEQ ID NO: 1705380 - RNA, 17 nt, Homo sapiens
aagauugauuaaugaac

SEQ ID NO: 1705381 - RNA, 14 nt, Homo sapiens
aagauugcugaaaa

SEQ ID NO: 1705382 - RNA, 23 nt, Homo sapiens
aagauuuagaaaaaaguuuacaa

SEQ ID NO: 1705383 - RNA, 17 nt, Homo sapiens
aagauuuugcaccugua

SEQ ID NO: 1705384 - RNA, 13 nt, Homo sapiens
aagcaaacacuua

SEQ ID NO: 1705385 - RNA, 11 nt, Homo sapiens
aagcaaccucc

SEQ ID NO: 1705386 - RNA, 14 nt, Homo sapiens
aagcaacuguuaug

SEQ ID NO: 1705387 - RNA, 19 nt, Homo sapiens
aagcaacuguuaugaaaua

SEQ ID NO: 1705388 - RNA, 18 nt, Homo sapiens
aagcaaggcuuuaaauga

SEQ ID NO: 1705389 - RNA, 18 nt, Homo sapiens
aagcacagaauuugucag

SEQ ID NO: 1705390 - RNA, 13 nt, Homo sapiens
aagcacaguuuga

SEQ ID NO: 1705391 - RNA, 15 nt, Homo sapiens
aagcaccccaugcca

SEQ ID NO: 1705392 - RNA, 19 nt, Homo sapiens
aagcaccugcaugugcugu

SEQ ID NO: 1705393 - RNA, 21 nt, Homo sapiens
aagcacucgugugcaacagac

SEQ ID NO: 1705394 - RNA, 22 nt, Homo sapiens
aagcacucuuaaagcaaaaaau

SEQ ID NO: 1705395 - RNA, 16 nt, Homo sapiens
aagcauggacuaaccc

SEQ ID NO: 1705396 - RNA, 14 nt, Homo sapiens
aagcauuuacuuug

SEQ ID NO: 1705397 - RNA, 21 nt, Homo sapiens
aagccacauuauuucuagucc

SEQ ID NO: 1705398 - RNA, 15 nt, Homo sapiens
aagccacucuguccc

SEQ ID NO: 1705399 - RNA, 20 nt, Homo sapiens
aagccacucugucccuuccu

SEQ ID NO: 1705400 - RNA, 19 nt, Homo sapiens
aagccagcugcaggaauca

SEQ ID NO: 1705401 - RNA, 18 nt, Homo sapiens
aagcccuccccaucccau

SEQ ID NO: 1705402 - RNA, 14 nt, Homo sapiens
aagccuaaaugccu

SEQ ID NO: 1705403 - RNA, 16 nt, Homo sapiens
aagccuaaaugccuua

SEQ ID NO: 1705404 - RNA, 18 nt, Homo sapiens
aagccucuccagcaauaa

SEQ ID NO: 1705405 - RNA, 13 nt, Homo sapiens
aagccucuggguu

SEQ ID NO: 1705406 - RNA, 18 nt, Homo sapiens
aagccugucugagacuca

SEQ ID NO: 1705407 - RNA, 13 nt, Homo sapiens
aagccuucagcuc

SEQ ID NO: 1705408 - RNA, 17 nt, Homo sapiens
aagcgcacauucaugug

SEQ ID NO: 1705409 - RNA, 19 nt, Homo sapiens
aagcggaaaguuagugcuu

SEQ ID NO: 1705410 - RNA, 18 nt, Homo sapiens
aagcguuggauguagcau

SEQ ID NO: 1705411 - RNA, 21 nt, Homo sapiens
aagcuaggguggcccuugcag

SEQ ID NO: 1705412 - RNA, 16 nt, Homo sapiens
aagcuccacugucacc

SEQ ID NO: 1705413 - RNA, 19 nt, Homo sapiens
aagcucuaguucuuaacaa

SEQ ID NO: 1705414 - RNA, 17 nt, Homo sapiens
aagcucuguugcaauua

SEQ ID NO: 1705415 - RNA, 21 nt, Homo sapiens
aagcugaucauaagugaauuu

SEQ ID NO: 1705416 - RNA, 20 nt, Homo sapiens
aagcugaugacaacuuccca

SEQ ID NO: 1705417 - RNA, 16 nt, Homo sapiens
aagcugauuaccugaa

SEQ ID NO: 1705418 - RNA, 14 nt, Homo sapiens
aagcugcauccaga

SEQ ID NO: 1705419 - RNA, 12 nt, Homo sapiens
aagcugcuccag

SEQ ID NO: 1705420 - RNA, 14 nt, Homo sapiens
aagcugcuuuagaa

SEQ ID NO: 1705421 - RNA, 21 nt, Homo sapiens
aagcuggauuauuuagaucua

SEQ ID NO: 1705422 - RNA, 23 nt, Homo sapiens
aagcuggugucugauuuuggcca

SEQ ID NO: 1705423 - RNA, 13 nt, Homo sapiens
acgcacaggaaaa

SEQ ID NO: 1705424 - RNA, 11 nt, Homo sapiens
acgcagaucac

SEQ ID NO: 1705425 - RNA, 16 nt, Homo sapiens
acgcauccagcaagaa

SEQ ID NO: 1705426 - RNA, 16 nt, Homo sapiens
acgccuggcuaauaag

SEQ ID NO: 1705427 - RNA, 13 nt, Homo sapiens
acgccuguagucc

SEQ ID NO: 1705428 - RNA, 19 nt, Homo sapiens
acgccuguaguccuagcca

SEQ ID NO: 1705429 - RNA, 16 nt, Homo sapiens
acgcgcgcgcacacac

SEQ ID NO: 1705430 - RNA, 12 nt, Homo sapiens
acgcgugcacac

SEQ ID NO: 1705431 - RNA, 22 nt, Homo sapiens
acgcuggguccuaauuaccagu

SEQ ID NO: 1705432 - RNA, 13 nt, Homo sapiens
acgcuuaaaggaa

SEQ ID NO: 1705433 - RNA, 17 nt, Homo sapiens
acggagaucuccuugcc

SEQ ID NO: 1705434 - RNA, 21 nt, Homo sapiens
acggcccucaucuaugaggaa

SEQ ID NO: 1705435 - RNA, 14 nt, Homo sapiens
acggcucacugcag

SEQ ID NO: 1705436 - RNA, 13 nt, Homo sapiens
acggggacugggg

SEQ ID NO: 1705437 - RNA, 21 nt, Homo sapiens
acgguuaaauacuguguggaa

SEQ ID NO: 1705438 - RNA, 12 nt, Homo sapiens
acguaacuauuu

SEQ ID NO: 1705439 - RNA, 21 nt, Homo sapiens
acguacaaaauccagcuauga

SEQ ID NO: 1705440 - RNA, 14 nt, Homo sapiens
acgucacugcacuc

SEQ ID NO: 1705441 - RNA, 14 nt, Homo sapiens
acgucugacaggca

SEQ ID NO: 1705442 - RNA, 16 nt, Homo sapiens
acgugugcaguuguag

SEQ ID NO: 1705443 - RNA, 20 nt, Homo sapiens
acuaaaauuuuaggcacucu

SEQ ID NO: 1705444 - RNA, 12 nt, Homo sapiens
acuaaacuuuca

SEQ ID NO: 1705445 - RNA, 12 nt, Homo sapiens
acuaaaguauau

SEQ ID NO: 1705446 - RNA, 14 nt, Homo sapiens
acuaaaguuuuaca

SEQ ID NO: 1705447 - RNA, 15 nt, Homo sapiens
acuaaauuugauacu

SEQ ID NO: 1705448 - RNA, 18 nt, Homo sapiens
acuaaauuugauacuuau

SEQ ID NO: 1705449 - RNA, 16 nt, Homo sapiens
acuaacuccugagaaa

SEQ ID NO: 1705450 - RNA, 16 nt, Homo sapiens
acuaagaaauauucca

SEQ ID NO: 1705451 - RNA, 19 nt, Homo sapiens
acuaagguggaugccaacc

SEQ ID NO: 1705452 - RNA, 22 nt, Homo sapiens
acuaaggugugcucugaucauc

SEQ ID NO: 1705453 - RNA, 23 nt, Homo sapiens
acuaauuaggcaaggcuauguga

SEQ ID NO: 1705454 - RNA, 16 nt, Homo sapiens
acuacauaacuuccua

SEQ ID NO: 1705455 - RNA, 20 nt, Homo sapiens
acuacuccgugaaggcuucu

SEQ ID NO: 1705456 - RNA, 21 nt, Homo sapiens
acuacuuuaauaaagaauuaa

SEQ ID NO: 1705457 - RNA, 14 nt, Homo sapiens
acuagaacucucca

SEQ ID NO: 1705458 - RNA, 13 nt, Homo sapiens
acuagacauuacc

SEQ ID NO: 1705459 - RNA, 20 nt, Homo sapiens
acuagccuuuggcucuggag

SEQ ID NO: 1705460 - RNA, 17 nt, Homo sapiens
acuaguuuuuauuccuu

SEQ ID NO: 1705461 - RNA, 18 nt, Homo sapiens
acuauacuguacaugaaa

SEQ ID NO: 1705462 - RNA, 14 nt, Homo sapiens
acuauauuugcuag

SEQ ID NO: 1705463 - RNA, 15 nt, Homo sapiens
acuaucacugaacaa

SEQ ID NO: 1705464 - RNA, 14 nt, Homo sapiens
acuauggaaaauca

SEQ ID NO: 1705465 - RNA, 14 nt, Homo sapiens
acuauggagccugg

SEQ ID NO: 1705466 - RNA, 16 nt, Homo sapiens
acuauuacaccaaaua

SEQ ID NO: 1705467 - RNA, 20 nt, Homo sapiens
acuauugaaaucaagcuuau

SEQ ID NO: 1705468 - RNA, 15 nt, Homo sapiens
acuauuuuaccugaa

SEQ ID NO: 1705469 - RNA, 13 nt, Homo sapiens
acucaagcacuga

SEQ ID NO: 1705470 - RNA, 23 nt, Homo sapiens
acucaauggaguaugucugaugg

SEQ ID NO: 1705471 - RNA, 13 nt, Homo sapiens
acucacaugacac

SEQ ID NO: 1705472 - RNA, 20 nt, Homo sapiens
acucaccagccccacugcca

SEQ ID NO: 1705473 - RNA, 23 nt, Homo sapiens
acucaccaguguccccuccacug

SEQ ID NO: 1705474 - RNA, 15 nt, Homo sapiens
acucacuuguaagaa

SEQ ID NO: 1705475 - RNA, 17 nt, Homo sapiens
acucagaagacacugau

SEQ ID NO: 1705476 - RNA, 23 nt, Homo sapiens
acucagauugagcccuacauugu

SEQ ID NO: 1705477 - RNA, 22 nt, Homo sapiens
acucauucuucuguacgucuga

SEQ ID NO: 1705478 - RNA, 17 nt, Homo sapiens
acucauugaaaugucac

SEQ ID NO: 1705479 - RNA, 13 nt, Homo sapiens
acucauugcugag

SEQ ID NO: 1705480 - RNA, 16 nt, Homo sapiens
acucauugucugugga

SEQ ID NO: 1705481 - RNA, 20 nt, Homo sapiens
acuccacuggccuccuggca

SEQ ID NO: 1705482 - RNA, 21 nt, Homo sapiens
acuccagcuugggcaacagag

SEQ ID NO: 1705483 - RNA, 22 nt, Homo sapiens
acuccagcuugggcaacagagc

SEQ ID NO: 1705484 - RNA, 18 nt, Homo sapiens
acuccaugcugccagccu

SEQ ID NO: 1705485 - RNA, 13 nt, Homo sapiens
acucccacuuuuc

SEQ ID NO: 1705486 - RNA, 19 nt, Homo sapiens
acuccccagaccucaggga

SEQ ID NO: 1705487 - RNA, 16 nt, Homo sapiens
acucccccucuuucac

SEQ ID NO: 1705488 - RNA, 15 nt, Homo sapiens
acucccucugggaag

SEQ ID NO: 1705489 - RNA, 17 nt, Homo sapiens
acucccuuugccagugc

SEQ ID NO: 1705490 - RNA, 19 nt, Homo sapiens
acuccuaaaccuuugcccc

SEQ ID NO: 1705491 - RNA, 19 nt, Homo sapiens
acuccucuguccaggcacu

SEQ ID NO: 1705492 - RNA, 21 nt, Homo sapiens
acuccuuaggcuuuguugaau

SEQ ID NO: 1705493 - RNA, 22 nt, Homo sapiens
acucggggguauuuuggucaca

SEQ ID NO: 1705494 - RNA, 13 nt, Homo sapiens
acucuagauucca

SEQ ID NO: 1705495 - RNA, 16 nt, Homo sapiens
acucuaggguccagug

SEQ ID NO: 1705496 - RNA, 13 nt, Homo sapiens
acucucauguggc

SEQ ID NO: 1705497 - RNA, 16 nt, Homo sapiens
acucugaaacugagaa

SEQ ID NO: 1705498 - RNA, 12 nt, Homo sapiens
acucugacucuc

SEQ ID NO: 1705499 - RNA, 16 nt, Homo sapiens
acucugcacagccuag

SEQ ID NO: 1705500 - RNA, 14 nt, Homo sapiens
acucugcacaugaa

SEQ ID NO: 1705501 - RNA, 19 nt, Homo sapiens
acucugcacaugucuugua

SEQ ID NO: 1705502 - RNA, 16 nt, Homo sapiens
acucugcagacugcua

SEQ ID NO: 1705503 - RNA, 18 nt, Homo sapiens
acucugguaaaugaucac

SEQ ID NO: 1705504 - RNA, 19 nt, Homo sapiens
acucuguaaaaacacugaa

SEQ ID NO: 1705505 - RNA, 20 nt, Homo sapiens
acucuucuuacuggugcuau

SEQ ID NO: 1705506 - RNA, 23 nt, Homo sapiens
acugaaaaaugguaauuguugcu

SEQ ID NO: 1705507 - RNA, 12 nt, Homo sapiens
acugaaacugga

SEQ ID NO: 1705508 - RNA, 13 nt, Homo sapiens
acugaaacuggaa

SEQ ID NO: 1705509 - RNA, 19 nt, Homo sapiens
acugacaaccucauccagg

SEQ ID NO: 1705510 - RNA, 21 nt, Homo sapiens
acugacaaccucauccaggcu

SEQ ID NO: 1705511 - RNA, 17 nt, Homo sapiens
acugacugccuugcuaa

SEQ ID NO: 1705512 - RNA, 18 nt, Homo sapiens
acugacugccuugcuaaa

SEQ ID NO: 1705513 - RNA, 21 nt, Homo sapiens
acugacuggauucauucucau

SEQ ID NO: 1705514 - RNA, 14 nt, Homo sapiens
acugaggaccagcc

SEQ ID NO: 1705515 - RNA, 12 nt, Homo sapiens
acugaugguuca

SEQ ID NO: 1705516 - RNA, 16 nt, Homo sapiens
acugauguacaauuaa

SEQ ID NO: 1705517 - RNA, 12 nt, Homo sapiens
acugauuugcaa

SEQ ID NO: 1705518 - RNA, 20 nt, Homo sapiens
acugcaaagcucggugcucc

SEQ ID NO: 1705519 - RNA, 13 nt, Homo sapiens
acugcaacauggg

SEQ ID NO: 1705520 - RNA, 16 nt, Homo sapiens
acugcacaguagagca

SEQ ID NO: 1705521 - RNA, 20 nt, Homo sapiens
acugcacuccagccugggca

SEQ ID NO: 1705522 - RNA, 15 nt, Homo sapiens
acugcacucuucagg

SEQ ID NO: 1705523 - RNA, 18 nt, Homo sapiens
acugcagguuggacccca

SEQ ID NO: 1705524 - RNA, 20 nt, Homo sapiens
acugccacacucuccaucac

SEQ ID NO: 1705525 - RNA, 13 nt, Homo sapiens
acugccacuuugc

SEQ ID NO: 1705526 - RNA, 13 nt, Homo sapiens
acugccagcagca

SEQ ID NO: 1705527 - RNA, 21 nt, Homo sapiens
acugccgugcauuagcacaga

SEQ ID NO: 1705528 - RNA, 14 nt, Homo sapiens
acugccucugccac

SEQ ID NO: 1705529 - RNA, 17 nt, Homo sapiens
acugccucugccuuaga

SEQ ID NO: 1705530 - RNA, 22 nt, Homo sapiens
acugccucuggaauugcucaag

SEQ ID NO: 1705531 - RNA, 20 nt, Homo sapiens
acugccucuuccucccucau

SEQ ID NO: 1705532 - RNA, 13 nt, Homo sapiens
acugcgacuguga

SEQ ID NO: 1705533 - RNA, 12 nt, Homo sapiens
acugcugcacaa

SEQ ID NO: 1705534 - RNA, 17 nt, Homo sapiens
agccccucacauuccua

SEQ ID NO: 1705535 - RNA, 18 nt, Homo sapiens
agcccuaaccccuuccag

SEQ ID NO: 1705536 - RNA, 18 nt, Homo sapiens
agcccugauguguccuca

SEQ ID NO: 1705537 - RNA, 16 nt, Homo sapiens
agcccugccaugucac

SEQ ID NO: 1705538 - RNA, 22 nt, Homo sapiens
agcccuguucugggugcagcug

SEQ ID NO: 1705539 - RNA, 15 nt, Homo sapiens
agccgccauugccac

SEQ ID NO: 1705540 - RNA, 12 nt, Homo sapiens
agccgcugugag

SEQ ID NO: 1705541 - RNA, 13 nt, Homo sapiens
agccgugaacugu

SEQ ID NO: 1705542 - RNA, 16 nt, Homo sapiens
agccuaggaccacuca

SEQ ID NO: 1705543 - RNA, 15 nt, Homo sapiens
agccuauuuaccugc

SEQ ID NO: 1705544 - RNA, 14 nt, Homo sapiens
agccuccaacacaa

SEQ ID NO: 1705545 - RNA, 22 nt, Homo sapiens
agccuccacagcgagggcagcu

SEQ ID NO: 1705546 - RNA, 21 nt, Homo sapiens
agccuccuccaccucaccucc

SEQ ID NO: 1705547 - RNA, 15 nt, Homo sapiens
agccucuauccuaca

SEQ ID NO: 1705548 - RNA, 15 nt, Homo sapiens
agccucugaccccuc

SEQ ID NO: 1705549 - RNA, 20 nt, Homo sapiens
agccucuggggcuguugaag

SEQ ID NO: 1705550 - RNA, 20 nt, Homo sapiens
agccugagguugaccagcuc

SEQ ID NO: 1705551 - RNA, 22 nt, Homo sapiens
agccugcacuuugaugucaugu

SEQ ID NO: 1705552 - RNA, 18 nt, Homo sapiens
agccugcagaauccagcu

SEQ ID NO: 1705553 - RNA, 14 nt, Homo sapiens
agccugcuggucac

SEQ ID NO: 1705554 - RNA, 14 nt, Homo sapiens
agccuggagaccca

SEQ ID NO: 1705555 - RNA, 14 nt, Homo sapiens
agccuggcccuccu

SEQ ID NO: 1705556 - RNA, 21 nt, Homo sapiens
agccugggcagcauagcaaga

SEQ ID NO: 1705557 - RNA, 20 nt, Homo sapiens
agccuggggccuggcaggga

SEQ ID NO: 1705558 - RNA, 14 nt, Homo sapiens
agccuuagaaguca

SEQ ID NO: 1705559 - RNA, 19 nt, Homo sapiens
agccuuagaagucacacag

SEQ ID NO: 1705560 - RNA, 16 nt, Homo sapiens
agccuuuuauacugau

SEQ ID NO: 1705561 - RNA, 18 nt, Homo sapiens
agcgcauccaaucucaag

SEQ ID NO: 1705562 - RNA, 20 nt, Homo sapiens
agcgcuaaacguuggugacg

SEQ ID NO: 1705563 - RNA, 17 nt, Homo sapiens
agcgggaggcagaguuu

SEQ ID NO: 1705564 - RNA, 23 nt, Homo sapiens
agcggggccaccgcgacguugca

SEQ ID NO: 1705565 - RNA, 16 nt, Homo sapiens
agcgucccuagcagug

SEQ ID NO: 1705566 - RNA, 18 nt, Homo sapiens
agcgucccuagcagugaa

SEQ ID NO: 1705567 - RNA, 15 nt, Homo sapiens
agcgugaaucuguau

SEQ ID NO: 1705568 - RNA, 13 nt, Homo sapiens
agcgugagccacu

SEQ ID NO: 1705569 - RNA, 21 nt, Homo sapiens
agcgugggccagaggcagcuc

SEQ ID NO: 1705570 - RNA, 18 nt, Homo sapiens
agcuacagcuuucuugcu

SEQ ID NO: 1705571 - RNA, 16 nt, Homo sapiens
agcuacaggacauuuu

SEQ ID NO: 1705572 - RNA, 22 nt, Homo sapiens
agcuacuguuuauuauuuuauu

SEQ ID NO: 1705573 - RNA, 22 nt, Homo sapiens
agcuauuuucaacauaacugaa

SEQ ID NO: 1705574 - RNA, 23 nt, Homo sapiens
agcucaaaguacuacagcaaagc

SEQ ID NO: 1705575 - RNA, 12 nt, Homo sapiens
agcucaccagcc

SEQ ID NO: 1705576 - RNA, 16 nt, Homo sapiens
agcucagaacccaggg

SEQ ID NO: 1705577 - RNA, 23 nt, Homo sapiens
agcucagcgccagccugucccau

SEQ ID NO: 1705578 - RNA, 14 nt, Homo sapiens
agcuccacugucac

SEQ ID NO: 1705579 - RNA, 18 nt, Homo sapiens
agcuccagguacauauca

SEQ ID NO: 1705580 - RNA, 18 nt, Homo sapiens
agcucccuaggagaccaa

SEQ ID NO: 1705581 - RNA, 18 nt, Homo sapiens
agcuccgcuuucuaccca

SEQ ID NO: 1705582 - RNA, 18 nt, Homo sapiens
agcuccuccccacuagca

SEQ ID NO: 1705583 - RNA, 21 nt, Homo sapiens
agcuccuccccacuagcauuu

SEQ ID NO: 1705584 - RNA, 22 nt, Homo sapiens
agcuccuccucggaaccgcuca

SEQ ID NO: 1705585 - RNA, 15 nt, Homo sapiens
agcuccucuccugga

SEQ ID NO: 1705586 - RNA, 19 nt, Homo sapiens
agcucuccccaaacuugcu

SEQ ID NO: 1705587 - RNA, 13 nt, Homo sapiens
agcucucuugccg

SEQ ID NO: 1705588 - RNA, 13 nt, Homo sapiens
agcucugaaguca

SEQ ID NO: 1705589 - RNA, 15 nt, Homo sapiens
agcugaaaguucuug

SEQ ID NO: 1705590 - RNA, 13 nt, Homo sapiens
agcugaaugccuc

SEQ ID NO: 1705591 - RNA, 20 nt, Homo sapiens
agcugaaugccuccuguggg

SEQ ID NO: 1705592 - RNA, 13 nt, Homo sapiens
agcugaccuggag

SEQ ID NO: 1705593 - RNA, 18 nt, Homo sapiens
agcugaguuuaacaugug

SEQ ID NO: 1705594 - RNA, 23 nt, Homo sapiens
agcugcaccagagcaaccucuca

SEQ ID NO: 1705595 - RNA, 14 nt, Homo sapiens
agcugcugcugcuc

SEQ ID NO: 1705596 - RNA, 16 nt, Homo sapiens
agcuggacagagggga

SEQ ID NO: 1705597 - RNA, 17 nt, Homo sapiens
agcuggaccaguggugc

SEQ ID NO: 1705598 - RNA, 18 nt, Homo sapiens
agcuggaccaguggugcc

SEQ ID NO: 1705599 - RNA, 18 nt, Homo sapiens
agcuggccuggacaguau

SEQ ID NO: 1705600 - RNA, 20 nt, Homo sapiens
agcuggcuuuucccauuuca

SEQ ID NO: 1705601 - RNA, 15 nt, Homo sapiens
agcugguggcaauaa

SEQ ID NO: 1705602 - RNA, 16 nt, Homo sapiens
agcugguggcaauaaa

SEQ ID NO: 1705603 - RNA, 15 nt, Homo sapiens
agcuguacugaggau

SEQ ID NO: 1705604 - RNA, 16 nt, Homo sapiens
agcugugacuucucca

SEQ ID NO: 1705605 - RNA, 15 nt, Homo sapiens
agcuguuaccauuca

SEQ ID NO: 1705606 - RNA, 22 nt, Homo sapiens
agcuuaaaauaaacaguuguga

SEQ ID NO: 1705607 - RNA, 15 nt, Homo sapiens
agcuuaccugacaca

SEQ ID NO: 1705608 - RNA, 14 nt, Homo sapiens
agcuucaaacugca

SEQ ID NO: 1705609 - RNA, 14 nt, Homo sapiens
agcuucaccagagc

SEQ ID NO: 1705610 - RNA, 15 nt, Homo sapiens
agcuucagaugguga

SEQ ID NO: 1705611 - RNA, 18 nt, Homo sapiens
agcuucugcccaccuacu

SEQ ID NO: 1705612 - RNA, 19 nt, Homo sapiens
agcuucuuaauuaauuuga

SEQ ID NO: 1705613 - RNA, 19 nt, Homo sapiens
agcuugggcaacagagcaa

SEQ ID NO: 1705614 - RNA, 14 nt, Homo sapiens
agcuuuauucuuca

SEQ ID NO: 1705615 - RNA, 12 nt, Homo sapiens
agcuuugcucuu

SEQ ID NO: 1705616 - RNA, 18 nt, Homo sapiens
agcuuuuggagggugaua

SEQ ID NO: 1705617 - RNA, 18 nt, Homo sapiens
agcuuuuuacucaaagag

SEQ ID NO: 1705618 - RNA, 15 nt, Homo sapiens
aggaaaaacaaacua

SEQ ID NO: 1705619 - RNA, 20 nt, Homo sapiens
aggaaaaaccaauagcuuua

SEQ ID NO: 1705620 - RNA, 17 nt, Homo sapiens
aggaaaauaaacugaca

SEQ ID NO: 1705621 - RNA, 13 nt, Homo sapiens
aggaaacaauaua

SEQ ID NO: 1705622 - RNA, 13 nt, Homo sapiens
aggaaacaguuaa

SEQ ID NO: 1705623 - RNA, 21 nt, Homo sapiens
aggaaagccucacugauauau

SEQ ID NO: 1705624 - RNA, 13 nt, Homo sapiens
aggaaauaaagua

SEQ ID NO: 1705625 - RNA, 15 nt, Homo sapiens
aggaaauaaaguaua

SEQ ID NO: 1705626 - RNA, 19 nt, Homo sapiens
aggaacaaaaaaaccacaa

SEQ ID NO: 1705627 - RNA, 21 nt, Homo sapiens
aggaacacaggcgcugaguau

SEQ ID NO: 1705628 - RNA, 14 nt, Homo sapiens
aggaagagccaaug

SEQ ID NO: 1705629 - RNA, 15 nt, Homo sapiens
aggaagccucugggu

SEQ ID NO: 1705630 - RNA, 19 nt, Homo sapiens
aggaagcuccacugucacc

SEQ ID NO: 1705631 - RNA, 21 nt, Homo sapiens
aggaaggaaagaaagaaggaa

SEQ ID NO: 1705632 - RNA, 22 nt, Homo sapiens
aggaagguggugcuuacauccu

SEQ ID NO: 1705633 - RNA, 17 nt, Homo sapiens
aggaagucccuugccau

SEQ ID NO: 1705634 - RNA, 22 nt, Homo sapiens
aggaaguugacuuauaguacau

SEQ ID NO: 1705635 - RNA, 20 nt, Homo sapiens
aggaauagaagcaaauuaaa

SEQ ID NO: 1705636 - RNA, 17 nt, Homo sapiens
aggaaucaaaaauugaa

SEQ ID NO: 1705637 - RNA, 23 nt, Homo sapiens
aggaauccuggcagcccagagac

SEQ ID NO: 1705638 - RNA, 13 nt, Homo sapiens
aggaauucugcaa

SEQ ID NO: 1705639 - RNA, 16 nt, Homo sapiens
aggacaaaacuucuug

SEQ ID NO: 1705640 - RNA, 21 nt, Homo sapiens
aggacaaccauuccagacugc

SEQ ID NO: 1705641 - RNA, 16 nt, Homo sapiens
aggacagaccacagag

SEQ ID NO: 1705642 - RNA, 15 nt, Homo sapiens
aggacagucagcucu

SEQ ID NO: 1705643 - RNA, 14 nt, Homo sapiens
aggacaucagcaaa

SEQ ID NO: 1705644 - RNA, 16 nt, Homo sapiens
auagcauuuguuuaag

SEQ ID NO: 1705645 - RNA, 23 nt, Homo sapiens
auagccaccccagaaauggugaa

SEQ ID NO: 1705646 - RNA, 17 nt, Homo sapiens
auagccuaggugacaga

SEQ ID NO: 1705647 - RNA, 23 nt, Homo sapiens
auagccuggacuuuccuguuguc

SEQ ID NO: 1705648 - RNA, 18 nt, Homo sapiens
auagcuaaguacacaaua

SEQ ID NO: 1705649 - RNA, 19 nt, Homo sapiens
auagcuaaguacacaauaa

SEQ ID NO: 1705650 - RNA, 17 nt, Homo sapiens
auagcuacaguguaaua

SEQ ID NO: 1705651 - RNA, 16 nt, Homo sapiens
auagcuacccaaaaga

SEQ ID NO: 1705652 - RNA, 21 nt, Homo sapiens
auagcuauggaaucaauucaa

SEQ ID NO: 1705653 - RNA, 18 nt, Homo sapiens
auaggcauuaacacaaag

SEQ ID NO: 1705654 - RNA, 18 nt, Homo sapiens
auaggcauuugauuuugc

SEQ ID NO: 1705655 - RNA, 19 nt, Homo sapiens
auaggcauuugauuuugcc

SEQ ID NO: 1705656 - RNA, 21 nt, Homo sapiens
auagguguugguuuugggggu

SEQ ID NO: 1705657 - RNA, 22 nt, Homo sapiens
auagucauuccaaauaugagau

SEQ ID NO: 1705658 - RNA, 23 nt, Homo sapiens
auagugacuaugaacuucucuca

SEQ ID NO: 1705659 - RNA, 14 nt, Homo sapiens
auagugcacaaaau

SEQ ID NO: 1705660 - RNA, 20 nt, Homo sapiens
auagugggcaccccacugca

SEQ ID NO: 1705661 - RNA, 21 nt, Homo sapiens
auagugggcaccccacugcaa

SEQ ID NO: 1705662 - RNA, 18 nt, Homo sapiens
auaguuaauuauuucaac

SEQ ID NO: 1705663 - RNA, 21 nt, Homo sapiens
auaguucuagacauggagguu

SEQ ID NO: 1705664 - RNA, 21 nt, Homo sapiens
auaguucuaggcacuguaguu

SEQ ID NO: 1705665 - RNA, 20 nt, Homo sapiens
auaguuuaaacugcauuaua

SEQ ID NO: 1705666 - RNA, 22 nt, Homo sapiens
auaguuuguuuuuaaacuaaua

SEQ ID NO: 1705667 - RNA, 16 nt, Homo sapiens
auaguuuugaauccuu

SEQ ID NO: 1705668 - RNA, 13 nt, Homo sapiens
auauaaaugggaa

SEQ ID NO: 1705669 - RNA, 13 nt, Homo sapiens
auauaaauucugu

SEQ ID NO: 1705670 - RNA, 19 nt, Homo sapiens
auauacagcaggugcucaa

SEQ ID NO: 1705671 - RNA, 20 nt, Homo sapiens
auauacauauguagacuaua

SEQ ID NO: 1705672 - RNA, 19 nt, Homo sapiens
auauaccuuuuugugucaa

SEQ ID NO: 1705673 - RNA, 15 nt, Homo sapiens
auauacugugugcuu

SEQ ID NO: 1705674 - RNA, 15 nt, Homo sapiens
auauagccauugauc

SEQ ID NO: 1705675 - RNA, 19 nt, Homo sapiens
auauaguaacacacuucca

SEQ ID NO: 1705676 - RNA, 16 nt, Homo sapiens
auauagugacuaugaa

SEQ ID NO: 1705677 - RNA, 15 nt, Homo sapiens
auauauacuaaacaa

SEQ ID NO: 1705678 - RNA, 15 nt, Homo sapiens
auauauagugcuaua

SEQ ID NO: 1705679 - RNA, 18 nt, Homo sapiens
auauaugccuucccccac

SEQ ID NO: 1705680 - RNA, 12 nt, Homo sapiens
auauauucccaa

SEQ ID NO: 1705681 - RNA, 23 nt, Homo sapiens
auaucauucacccaaaacaaagu

SEQ ID NO: 1705682 - RNA, 18 nt, Homo sapiens
auaucuaauauauaugaa

SEQ ID NO: 1705683 - RNA, 16 nt, Homo sapiens
auaucuguacaaugac

SEQ ID NO: 1705684 - RNA, 15 nt, Homo sapiens
auaucuguggucuuc

SEQ ID NO: 1705685 - RNA, 19 nt, Homo sapiens
auaucuuaaagaaacagcu

SEQ ID NO: 1705686 - RNA, 18 nt, Homo sapiens
auaugaaacuaggguuug

SEQ ID NO: 1705687 - RNA, 14 nt, Homo sapiens
auaugaaguguuag

SEQ ID NO: 1705688 - RNA, 19 nt, Homo sapiens
auaugagacguuuuuggaa

SEQ ID NO: 1705689 - RNA, 13 nt, Homo sapiens
auaugaguauaca

SEQ ID NO: 1705690 - RNA, 21 nt, Homo sapiens
auaugccuuggggaggacaaa

SEQ ID NO: 1705691 - RNA, 22 nt, Homo sapiens
auaugccuuggggaggacaaaa

SEQ ID NO: 1705692 - RNA, 21 nt, Homo sapiens
auauggacucugcacaugaau

SEQ ID NO: 1705693 - RNA, 18 nt, Homo sapiens
auauggggaaaaaacugu

SEQ ID NO: 1705694 - RNA, 18 nt, Homo sapiens
auaugguugauaguuuac

SEQ ID NO: 1705695 - RNA, 19 nt, Homo sapiens
auauguaaauagugcagaa

SEQ ID NO: 1705696 - RNA, 17 nt, Homo sapiens
auauguguauguacguu

SEQ ID NO: 1705697 - RNA, 12 nt, Homo sapiens
auauuacuuuau

SEQ ID NO: 1705698 - RNA, 12 nt, Homo sapiens
auauuauuuggc

SEQ ID NO: 1705699 - RNA, 21 nt, Homo sapiens
auauuccugcauuugugaaau

SEQ ID NO: 1705700 - RNA, 18 nt, Homo sapiens
auauucuauuaacuuuaa

SEQ ID NO: 1705701 - RNA, 20 nt, Homo sapiens
auauucuguaugaacuuuau

SEQ ID NO: 1705702 - RNA, 19 nt, Homo sapiens
auauuuauaaaugagcaaa

SEQ ID NO: 1705703 - RNA, 13 nt, Homo sapiens
auauuuaucugau

SEQ ID NO: 1705704 - RNA, 18 nt, Homo sapiens
auauuuaugucuauuuaa

SEQ ID NO: 1705705 - RNA, 14 nt, Homo sapiens
auauuucccauuug

SEQ ID NO: 1705706 - RNA, 13 nt, Homo sapiens
auauuugcuagac

SEQ ID NO: 1705707 - RNA, 20 nt, Homo sapiens
auauuugugugaaaauguga

SEQ ID NO: 1705708 - RNA, 16 nt, Homo sapiens
auauuuucacaggugu

SEQ ID NO: 1705709 - RNA, 18 nt, Homo sapiens
auauuuuuagauaguuag

SEQ ID NO: 1705710 - RNA, 16 nt, Homo sapiens
auauuuuuccacuuaa

SEQ ID NO: 1705711 - RNA, 14 nt, Homo sapiens
aucaagagggauaa

SEQ ID NO: 1705712 - RNA, 22 nt, Homo sapiens
aucaaggaguacaaugcccaga

SEQ ID NO: 1705713 - RNA, 13 nt, Homo sapiens
aucaaugcaagag

SEQ ID NO: 1705714 - RNA, 22 nt, Homo sapiens
aucaaugcaagagugauugcag

SEQ ID NO: 1705715 - RNA, 14 nt, Homo sapiens
aucacccucugggu

SEQ ID NO: 1705716 - RNA, 14 nt, Homo sapiens
aucacccucuuccu

SEQ ID NO: 1705717 - RNA, 15 nt, Homo sapiens
aucacgccacugcac

SEQ ID NO: 1705718 - RNA, 17 nt, Homo sapiens
aucacgggucacuugaa

SEQ ID NO: 1705719 - RNA, 23 nt, Homo sapiens
aucacgucacugcacuccagcuu

SEQ ID NO: 1705720 - RNA, 16 nt, Homo sapiens
aucacugccacacucu

SEQ ID NO: 1705721 - RNA, 20 nt, Homo sapiens
aucacugccacacucuccau

SEQ ID NO: 1705722 - RNA, 21 nt, Homo sapiens
aucacugccacacucuccauc

SEQ ID NO: 1705723 - RNA, 11 nt, Homo sapiens
aucacuggguc

SEQ ID NO: 1705724 - RNA, 14 nt, Homo sapiens
aucagaaauuccag

SEQ ID NO: 1705725 - RNA, 13 nt, Homo sapiens
aucagaccugguu

SEQ ID NO: 1705726 - RNA, 14 nt, Homo sapiens
aucagauacaucac

SEQ ID NO: 1705727 - RNA, 17 nt, Homo sapiens
aucagaugcuccaagau

SEQ ID NO: 1705728 - RNA, 18 nt, Homo sapiens
aucagcuuucagggccau

SEQ ID NO: 1705729 - RNA, 20 nt, Homo sapiens
aucaggaaggaaaugacacc

SEQ ID NO: 1705730 - RNA, 21 nt, Homo sapiens
aucaggacucugacgucucuu

SEQ ID NO: 1705731 - RNA, 23 nt, Homo sapiens
aucagucaacaacuuacacuuau

SEQ ID NO: 1705732 - RNA, 21 nt, Homo sapiens
aucaguucuacggaucaucaa

SEQ ID NO: 1705733 - RNA, 17 nt, Homo sapiens
aucaguuuccagucuca

SEQ ID NO: 1705734 - RNA, 19 nt, Homo sapiens
aucaucaaaaacuuuggag

SEQ ID NO: 1705735 - RNA, 14 nt, Homo sapiens
aucauccaagacag

SEQ ID NO: 1705736 - RNA, 19 nt, Homo sapiens
aucauccacugugccaugu

SEQ ID NO: 1705737 - RNA, 16 nt, Homo sapiens
aucaugggcuggacau

SEQ ID NO: 1705738 - RNA, 20 nt, Homo sapiens
aucauuaccuuuuaccagcu

SEQ ID NO: 1705739 - RNA, 12 nt, Homo sapiens
aucauuagaaca

SEQ ID NO: 1705740 - RNA, 14 nt, Homo sapiens
aucauuauaucauu

SEQ ID NO: 1705741 - RNA, 22 nt, Homo sapiens
aucauuucccaucuggaccugg

SEQ ID NO: 1705742 - RNA, 11 nt, Homo sapiens
auccaaaaaga

SEQ ID NO: 1705743 - RNA, 17 nt, Homo sapiens
auccaacuccagcaacu

SEQ ID NO: 1705744 - RNA, 16 nt, Homo sapiens
auccaacuccaggaua

SEQ ID NO: 1705745 - RNA, 23 nt, Homo sapiens
auccaagaaggccuucauggccc

SEQ ID NO: 1705746 - RNA, 21 nt, Homo sapiens
auccaauauguuuccaucacu

SEQ ID NO: 1705747 - RNA, 20 nt, Homo sapiens
auccacaaaugaagggauau

SEQ ID NO: 1705748 - RNA, 16 nt, Homo sapiens
auccacccaacccuau

SEQ ID NO: 1705749 - RNA, 16 nt, Homo sapiens
auccagccucauaaag

SEQ ID NO: 1705750 - RNA, 14 nt, Homo sapiens
auccagcuaugaau

SEQ ID NO: 1705751 - RNA, 14 nt, Homo sapiens
auccauccauccaa

SEQ ID NO: 1705752 - RNA, 16 nt, Homo sapiens
auccaugcuucucauc

SEQ ID NO: 1705753 - RNA, 12 nt, Homo sapiens
aucccacaucca

SEQ ID NO: 1705754 - RNA, 14 nt, Homo sapiens
cccauaucugugaa

SEQ ID NO: 1705755 - RNA, 15 nt, Homo sapiens
cccauaucugugaaa

SEQ ID NO: 1705756 - RNA, 12 nt, Homo sapiens
cccaucuaugag

SEQ ID NO: 1705757 - RNA, 16 nt, Homo sapiens
cccaugaguccuugaa

SEQ ID NO: 1705758 - RNA, 15 nt, Homo sapiens
cccauggacacucca

SEQ ID NO: 1705759 - RNA, 21 nt, Homo sapiens
cccauuucaauuccugugauu

SEQ ID NO: 1705760 - RNA, 17 nt, Homo sapiens
ccccaaauuuggcuaaa

SEQ ID NO: 1705761 - RNA, 21 nt, Homo sapiens
ccccaacagcgacauagccca

SEQ ID NO: 1705762 - RNA, 16 nt, Homo sapiens
ccccaaccugcugaag

SEQ ID NO: 1705763 - RNA, 14 nt, Homo sapiens
ccccacuagcauuu

SEQ ID NO: 1705764 - RNA, 11 nt, Homo sapiens
ccccacugaca

SEQ ID NO: 1705765 - RNA, 16 nt, Homo sapiens
ccccagaccucaggga

SEQ ID NO: 1705766 - RNA, 17 nt, Homo sapiens
ccccagagaugucauca

SEQ ID NO: 1705767 - RNA, 14 nt, Homo sapiens
ccccagagcuguuu

SEQ ID NO: 1705768 - RNA, 18 nt, Homo sapiens
ccccaggagaacaucuuu

SEQ ID NO: 1705769 - RNA, 14 nt, Homo sapiens
ccccaggcucaacu

SEQ ID NO: 1705770 - RNA, 22 nt, Homo sapiens
ccccaggucugcagcuccaggu

SEQ ID NO: 1705771 - RNA, 20 nt, Homo sapiens
cccccucugccccacgugcc

SEQ ID NO: 1705772 - RNA, 16 nt, Homo sapiens
cccccuguucuaaggg

SEQ ID NO: 1705773 - RNA, 12 nt, Homo sapiens
cccccuugaggg

SEQ ID NO: 1705774 - RNA, 22 nt, Homo sapiens
ccccgauugaaagaaccagaga

SEQ ID NO: 1705775 - RNA, 13 nt, Homo sapiens
ccccuacaugaaa

SEQ ID NO: 1705776 - RNA, 15 nt, Homo sapiens
ccccuccacugucac

SEQ ID NO: 1705777 - RNA, 21 nt, Homo sapiens
ccccucccaucauuacccuuc

SEQ ID NO: 1705778 - RNA, 13 nt, Homo sapiens
ccccucucaccaa

SEQ ID NO: 1705779 - RNA, 17 nt, Homo sapiens
ccccucugucuugugaa

SEQ ID NO: 1705780 - RNA, 15 nt, Homo sapiens
ccccuggcugugcuc

SEQ ID NO: 1705781 - RNA, 17 nt, Homo sapiens
ccccuggcugugcucua

SEQ ID NO: 1705782 - RNA, 23 nt, Homo sapiens
ccccuucccuguccuugcccuuu

SEQ ID NO: 1705783 - RNA, 16 nt, Homo sapiens
cccgggggugaagggg

SEQ ID NO: 1705784 - RNA, 18 nt, Homo sapiens
cccgucgaggggcucuca

SEQ ID NO: 1705785 - RNA, 10 nt, Homo sapiens
cccuaaggga

SEQ ID NO: 1705786 - RNA, 14 nt, Homo sapiens
cccuaggagaccaa

SEQ ID NO: 1705787 - RNA, 14 nt, Homo sapiens
cccucacucugcca

SEQ ID NO: 1705788 - RNA, 15 nt, Homo sapiens
cccucacuguugaau

SEQ ID NO: 1705789 - RNA, 15 nt, Homo sapiens
cccuccccugccauu

SEQ ID NO: 1705790 - RNA, 14 nt, Homo sapiens
cccuccugagggag

SEQ ID NO: 1705791 - RNA, 18 nt, Homo sapiens
cccuccuggcucuugaua

SEQ ID NO: 1705792 - RNA, 16 nt, Homo sapiens
cccucuuccugugauc

SEQ ID NO: 1705793 - RNA, 23 nt, Homo sapiens
cccugaaacacgaaacuuguuau

SEQ ID NO: 1705794 - RNA, 21 nt, Homo sapiens
cccugacaucuggaaucugga

SEQ ID NO: 1705795 - RNA, 19 nt, Homo sapiens
cccugaccucacugugacc

SEQ ID NO: 1705796 - RNA, 23 nt, Homo sapiens
cccugagcuuuguccugaaggaa

SEQ ID NO: 1705797 - RNA, 15 nt, Homo sapiens
cccugcccaaugaga

SEQ ID NO: 1705798 - RNA, 15 nt, Homo sapiens
cccugcccuggucca

SEQ ID NO: 1705799 - RNA, 20 nt, Homo sapiens
cccugcgcaugaaccuggac

SEQ ID NO: 1705800 - RNA, 13 nt, Homo sapiens
cccugcugaccuc

SEQ ID NO: 1705801 - RNA, 12 nt, Homo sapiens
cccugucuugcu

SEQ ID NO: 1705802 - RNA, 16 nt, Homo sapiens
cccuuauuuucaagaa

SEQ ID NO: 1705803 - RNA, 22 nt, Homo sapiens
cccuucaaccauuccccauggg

SEQ ID NO: 1705804 - RNA, 12 nt, Homo sapiens
cccuucaccucc

SEQ ID NO: 1705805 - RNA, 11 nt, Homo sapiens
cccuuccccag

SEQ ID NO: 1705806 - RNA, 21 nt, Homo sapiens
cccuucccugcacuaaagcca

SEQ ID NO: 1705807 - RNA, 20 nt, Homo sapiens
cccuugauuuaaacacacag

SEQ ID NO: 1705808 - RNA, 14 nt, Homo sapiens
cccuugccacccca

SEQ ID NO: 1705809 - RNA, 17 nt, Homo sapiens
cccuuggcuucugugau

SEQ ID NO: 1705810 - RNA, 18 nt, Homo sapiens
cccuuggcuucugugaug

SEQ ID NO: 1705811 - RNA, 20 nt, Homo sapiens
cccuuuccccagcaucacuc

SEQ ID NO: 1705812 - RNA, 12 nt, Homo sapiens
cccuuugcuaaa

SEQ ID NO: 1705813 - RNA, 22 nt, Homo sapiens
cccuuuuguauucucuuccuca

SEQ ID NO: 1705814 - RNA, 16 nt, Homo sapiens
ccgaaguaugagggaa

SEQ ID NO: 1705815 - RNA, 20 nt, Homo sapiens
ccgaagucuuuuguucgcau

SEQ ID NO: 1705816 - RNA, 12 nt, Homo sapiens
ccgaauccacag

SEQ ID NO: 1705817 - RNA, 14 nt, Homo sapiens
ccgaccacuuccag

SEQ ID NO: 1705818 - RNA, 12 nt, Homo sapiens
ccgcacaugcac

SEQ ID NO: 1705819 - RNA, 14 nt, Homo sapiens
ccgcacaugcacac

SEQ ID NO: 1705820 - RNA, 13 nt, Homo sapiens
ccgcagaauggac

SEQ ID NO: 1705821 - RNA, 17 nt, Homo sapiens
ccgcauugauggccuca

SEQ ID NO: 1705822 - RNA, 12 nt, Homo sapiens
ccggcugcgugg

SEQ ID NO: 1705823 - RNA, 17 nt, Homo sapiens
ccggggccagcaccacu

SEQ ID NO: 1705824 - RNA, 16 nt, Homo sapiens
ccggggcuccacugaa

SEQ ID NO: 1705825 - RNA, 22 nt, Homo sapiens
ccguccucaccccuguccucac

SEQ ID NO: 1705826 - RNA, 20 nt, Homo sapiens
ccgugagcgccugugcacac

SEQ ID NO: 1705827 - RNA, 15 nt, Homo sapiens
ccguuaaaaaaucaa

SEQ ID NO: 1705828 - RNA, 15 nt, Homo sapiens
ccguuccugacauca

SEQ ID NO: 1705829 - RNA, 13 nt, Homo sapiens
ccguuuaccuaga

SEQ ID NO: 1705830 - RNA, 22 nt, Homo sapiens
ccguuuaccuagaagaagcuau

SEQ ID NO: 1705831 - RNA, 14 nt, Homo sapiens
ccuaaaaaaagaga

SEQ ID NO: 1705832 - RNA, 15 nt, Homo sapiens
ccuaaaacuggcaaa

SEQ ID NO: 1705833 - RNA, 18 nt, Homo sapiens
ccuaaaauauauuccuga

SEQ ID NO: 1705834 - RNA, 12 nt, Homo sapiens
ccuaacaaaaga

SEQ ID NO: 1705835 - RNA, 13 nt, Homo sapiens
ccuaacaaaagau

SEQ ID NO: 1705836 - RNA, 19 nt, Homo sapiens
ccuaacacggugcucauuu

SEQ ID NO: 1705837 - RNA, 15 nt, Homo sapiens
ccuaagggagugucu

SEQ ID NO: 1705838 - RNA, 16 nt, Homo sapiens
ccuaaggucacagcua

SEQ ID NO: 1705839 - RNA, 14 nt, Homo sapiens
ccuaaguacuguaa

SEQ ID NO: 1705840 - RNA, 21 nt, Homo sapiens
ccuaaguacuguaauaauacc

SEQ ID NO: 1705841 - RNA, 16 nt, Homo sapiens
ccuaaguccuuuaugu

SEQ ID NO: 1705842 - RNA, 14 nt, Homo sapiens
ccuaauaaacaauu

SEQ ID NO: 1705843 - RNA, 23 nt, Homo sapiens
ccuaaugaaggaguucacuguaa

SEQ ID NO: 1705844 - RNA, 18 nt, Homo sapiens
ccuacagcacuacugggu

SEQ ID NO: 1705845 - RNA, 23 nt, Homo sapiens
ccuacauugugcugcaccugguc

SEQ ID NO: 1705846 - RNA, 15 nt, Homo sapiens
ccuaccaucagggac

SEQ ID NO: 1705847 - RNA, 13 nt, Homo sapiens
ccuacccuuccag

SEQ ID NO: 1705848 - RNA, 13 nt, Homo sapiens
ccuacuccugacu

SEQ ID NO: 1705849 - RNA, 19 nt, Homo sapiens
ccuacuuuucuuuccucag

SEQ ID NO: 1705850 - RNA, 14 nt, Homo sapiens
ccuagaagaagcua

SEQ ID NO: 1705851 - RNA, 20 nt, Homo sapiens
ccuagaagaagcuaugucaa

SEQ ID NO: 1705852 - RNA, 18 nt, Homo sapiens
ccuagccaaugucuccuc

SEQ ID NO: 1705853 - RNA, 17 nt, Homo sapiens
ccuagccugcauaucau

SEQ ID NO: 1705854 - RNA, 21 nt, Homo sapiens
ccuagccuuagaagucacaca

SEQ ID NO: 1705855 - RNA, 18 nt, Homo sapiens
ccuaguuucccugaagga

SEQ ID NO: 1705856 - RNA, 21 nt, Homo sapiens
ccuaguuugaccucacaguga

SEQ ID NO: 1705857 - RNA, 15 nt, Homo sapiens
ccuauaaugugugua

SEQ ID NO: 1705858 - RNA, 15 nt, Homo sapiens
ccuauacauccacag

SEQ ID NO: 1705859 - RNA, 22 nt, Homo sapiens
ccuauaugaauaugagaucuga

SEQ ID NO: 1705860 - RNA, 15 nt, Homo sapiens
ccuauuuguuuucau

SEQ ID NO: 1705861 - RNA, 13 nt, Homo sapiens
ccucaaacaacac

SEQ ID NO: 1705862 - RNA, 16 nt, Homo sapiens
ccucaaguaaacuccc

SEQ ID NO: 1705863 - RNA, 13 nt, Homo sapiens
ccucacaguccca

SEQ ID NO: 1705864 - RNA, 23 nt, Homo sapiens
ccucacucuuuauagugcacaaa

SEQ ID NO: 1705865 - RNA, 19 nt, Homo sapiens
cucauuugucacacacuuu

SEQ ID NO: 1705866 - RNA, 13 nt, Homo sapiens
cuccaaaacccau

SEQ ID NO: 1705867 - RNA, 17 nt, Homo sapiens
cuccaacucccucuggg

SEQ ID NO: 1705868 - RNA, 19 nt, Homo sapiens
cuccacagcgagggcagcu

SEQ ID NO: 1705869 - RNA, 12 nt, Homo sapiens
cuccacccuaua

SEQ ID NO: 1705870 - RNA, 19 nt, Homo sapiens
cuccacccuauauguagua

SEQ ID NO: 1705871 - RNA, 20 nt, Homo sapiens
cuccaccucaccuccaugac

SEQ ID NO: 1705872 - RNA, 12 nt, Homo sapiens
cuccacugucac

SEQ ID NO: 1705873 - RNA, 13 nt, Homo sapiens
cuccacugucacc

SEQ ID NO: 1705874 - RNA, 15 nt, Homo sapiens
cuccagcaacacagc

SEQ ID NO: 1705875 - RNA, 20 nt, Homo sapiens
cuccagcugggcucugcaau

SEQ ID NO: 1705876 - RNA, 20 nt, Homo sapiens
cuccagcuugggcaacagag

SEQ ID NO: 1705877 - RNA, 15 nt, Homo sapiens
cuccaggaaugaucu

SEQ ID NO: 1705878 - RNA, 17 nt, Homo sapiens
cuccaggaugaguuacu

SEQ ID NO: 1705879 - RNA, 21 nt, Homo sapiens
cuccaggaugaguuacuugaa

SEQ ID NO: 1705880 - RNA, 22 nt, Homo sapiens
cuccaggaugaguuacuugaaa

SEQ ID NO: 1705881 - RNA, 23 nt, Homo sapiens
cuccagggaauccaagccuccac

SEQ ID NO: 1705882 - RNA, 12 nt, Homo sapiens
cuccagugccag

SEQ ID NO: 1705883 - RNA, 13 nt, Homo sapiens
cuccagugccagc

SEQ ID NO: 1705884 - RNA, 18 nt, Homo sapiens
cuccagugccagcaauga

SEQ ID NO: 1705885 - RNA, 15 nt, Homo sapiens
cuccaucccaacagc

SEQ ID NO: 1705886 - RNA, 14 nt, Homo sapiens
cuccaucucaugua

SEQ ID NO: 1705887 - RNA, 12 nt, Homo sapiens
cuccaucuguca

SEQ ID NO: 1705888 - RNA, 19 nt, Homo sapiens
cuccaugcugccuccagaa

SEQ ID NO: 1705889 - RNA, 19 nt, Homo sapiens
cucccaaggcucugagcaa

SEQ ID NO: 1705890 - RNA, 14 nt, Homo sapiens
cucccaaguccaca

SEQ ID NO: 1705891 - RNA, 17 nt, Homo sapiens
cucccacaaugcugaau

SEQ ID NO: 1705892 - RNA, 22 nt, Homo sapiens
cucccaguccaaauguccucca

SEQ ID NO: 1705893 - RNA, 21 nt, Homo sapiens
cucccauccccuggacuggga

SEQ ID NO: 1705894 - RNA, 23 nt, Homo sapiens
cuccccaguucauugcacuuuga

SEQ ID NO: 1705895 - RNA, 20 nt, Homo sapiens
cuccccaugccacguuccac

SEQ ID NO: 1705896 - RNA, 12 nt, Homo sapiens
cuccccauggag

SEQ ID NO: 1705897 - RNA, 14 nt, Homo sapiens
cuccccuccagccu

SEQ ID NO: 1705898 - RNA, 15 nt, Homo sapiens
cucccgaugcugcua

SEQ ID NO: 1705899 - RNA, 16 nt, Homo sapiens
cucccgaugcugcuau

SEQ ID NO: 1705900 - RNA, 22 nt, Homo sapiens
cucccucacccaggcacugggc

SEQ ID NO: 1705901 - RNA, 13 nt, Homo sapiens
cucccucauucca

SEQ ID NO: 1705902 - RNA, 16 nt, Homo sapiens
cuccgccaaugcacgg

SEQ ID NO: 1705903 - RNA, 18 nt, Homo sapiens
cuccguuuggcagugcaa

SEQ ID NO: 1705904 - RNA, 18 nt, Homo sapiens
cuccucaguaaauguaca

SEQ ID NO: 1705905 - RNA, 19 nt, Homo sapiens
cuccucccaggaacugggc

SEQ ID NO: 1705906 - RNA, 21 nt, Homo sapiens
cuccucccaggaacugggcca

SEQ ID NO: 1705907 - RNA, 22 nt, Homo sapiens
cuccuccuacccuuccagugcc

SEQ ID NO: 1705908 - RNA, 17 nt, Homo sapiens
cuccucuaggccucacu

SEQ ID NO: 1705909 - RNA, 20 nt, Homo sapiens
cuccugaaccgcacagcuca

SEQ ID NO: 1705910 - RNA, 14 nt, Homo sapiens
cuccugacuguaac

SEQ ID NO: 1705911 - RNA, 16 nt, Homo sapiens
cuccugggucagggag

SEQ ID NO: 1705912 - RNA, 18 nt, Homo sapiens
cuccugugaaccaacaca

SEQ ID NO: 1705913 - RNA, 18 nt, Homo sapiens
cuccuuccccccaccaga

SEQ ID NO: 1705914 - RNA, 16 nt, Homo sapiens
cuccuugcaggugaca

SEQ ID NO: 1705915 - RNA, 17 nt, Homo sapiens
cuccuuguccacccacc

SEQ ID NO: 1705916 - RNA, 16 nt, Homo sapiens
cuccuuuaauuaaugg

SEQ ID NO: 1705917 - RNA, 24 nt, Homo sapiens
cuccuuucaccacaugugcacaug

SEQ ID NO: 1705918 - RNA, 16 nt, Homo sapiens
cucgagcaguccugcc

SEQ ID NO: 1705919 - RNA, 15 nt, Homo sapiens
cucgcccaacuccac

SEQ ID NO: 1705920 - RNA, 13 nt, Homo sapiens
cucggaggcugcc

SEQ ID NO: 1705921 - RNA, 13 nt, Homo sapiens
cucgugugccugg

SEQ ID NO: 1705922 - RNA, 15 nt, Homo sapiens
cucuacccuauacaa

SEQ ID NO: 1705923 - RNA, 22 nt, Homo sapiens
cucuacccuauacaacuggaca

SEQ ID NO: 1705924 - RNA, 19 nt, Homo sapiens
cucuagacaagauauugua

SEQ ID NO: 1705925 - RNA, 14 nt, Homo sapiens
cucuagauugagag

SEQ ID NO: 1705926 - RNA, 22 nt, Homo sapiens
cucuauacaaaaugauuuugaa

SEQ ID NO: 1705927 - RNA, 14 nt, Homo sapiens
cucuauacaucucu

SEQ ID NO: 1705928 - RNA, 14 nt, Homo sapiens
cucucagcugacca

SEQ ID NO: 1705929 - RNA, 15 nt, Homo sapiens
cucucagcugaccau

SEQ ID NO: 1705930 - RNA, 16 nt, Homo sapiens
cucucagcugaccauc

SEQ ID NO: 1705931 - RNA, 22 nt, Homo sapiens
cucucaggggugauaacucagg

SEQ ID NO: 1705932 - RNA, 15 nt, Homo sapiens
cucuccaacucccuc

SEQ ID NO: 1705933 - RNA, 14 nt, Homo sapiens
cucuccauccugcu

SEQ ID NO: 1705934 - RNA, 17 nt, Homo sapiens
cucuccccagcaaguga

SEQ ID NO: 1705935 - RNA, 14 nt, Homo sapiens
cucuccucuugcca

SEQ ID NO: 1705936 - RNA, 13 nt, Homo sapiens
cucucugcagcug

SEQ ID NO: 1705937 - RNA, 15 nt, Homo sapiens
cucucuucugcucca

SEQ ID NO: 1705938 - RNA, 23 nt, Homo sapiens
cucucuuuaaaucaaguccuuua

SEQ ID NO: 1705939 - RNA, 18 nt, Homo sapiens
cucugaagcauguuucau

SEQ ID NO: 1705940 - RNA, 15 nt, Homo sapiens
cucugacacacagcu

SEQ ID NO: 1705941 - RNA, 16 nt, Homo sapiens
cucugacccuagcucu

SEQ ID NO: 1705942 - RNA, 17 nt, Homo sapiens
cucugaccugcacuggg

SEQ ID NO: 1705943 - RNA, 15 nt, Homo sapiens
cucugagaucuaagg

SEQ ID NO: 1705944 - RNA, 20 nt, Homo sapiens
cucugagcaaauguggcucc

SEQ ID NO: 1705945 - RNA, 22 nt, Homo sapiens
cucugagucagugguuauuuga

SEQ ID NO: 1705946 - RNA, 15 nt, Homo sapiens
cucugauaugggacu

SEQ ID NO: 1705947 - RNA, 23 nt, Homo sapiens
cucugcaaugggcacugggauga

SEQ ID NO: 1705948 - RNA, 18 nt, Homo sapiens
cucugcacaugucuugua

SEQ ID NO: 1705949 - RNA, 22 nt, Homo sapiens
cucugcagacugcuaguguucu

SEQ ID NO: 1705950 - RNA, 16 nt, Homo sapiens
cucuggaccauauacc

SEQ ID NO: 1705951 - RNA, 17 nt, Homo sapiens
cucuggaccauauacca

SEQ ID NO: 1705952 - RNA, 19 nt, Homo sapiens
cucuguaaaaacacugaaa

SEQ ID NO: 1705953 - RNA, 20 nt, Homo sapiens
cucuguaaaaacacugaaaa

SEQ ID NO: 1705954 - RNA, 18 nt, Homo sapiens
cucugugaauugaaaugu

SEQ ID NO: 1705955 - RNA, 13 nt, Homo sapiens
cucugugacuccc

SEQ ID NO: 1705956 - RNA, 19 nt, Homo sapiens
cucugugaggaaagcacac

SEQ ID NO: 1705957 - RNA, 17 nt, Homo sapiens
cucuguuauguacugua

SEQ ID NO: 1705958 - RNA, 20 nt, Homo sapiens
cucuguuuauagugacccac

SEQ ID NO: 1705959 - RNA, 12 nt, Homo sapiens
cucuuaucucag

SEQ ID NO: 1705960 - RNA, 15 nt, Homo sapiens
cucuucaacugacca

SEQ ID NO: 1705961 - RNA, 18 nt, Homo sapiens
cucuucaacugaccagcc

SEQ ID NO: 1705962 - RNA, 21 nt, Homo sapiens
cucuucaacugaccagccucc

SEQ ID NO: 1705963 - RNA, 11 nt, Homo sapiens
cucuuccucau

SEQ ID NO: 1705964 - RNA, 15 nt, Homo sapiens
cucuuccugugaucc

SEQ ID NO: 1705965 - RNA, 14 nt, Homo sapiens
cucuucuccacugg

SEQ ID NO: 1705966 - RNA, 23 nt, Homo sapiens
cucuucuggggcaggcugggcca

SEQ ID NO: 1705967 - RNA, 14 nt, Homo sapiens
cucuugaaccacag

SEQ ID NO: 1705968 - RNA, 17 nt, Homo sapiens
cucuugagucacacugc

SEQ ID NO: 1705969 - RNA, 21 nt, Homo sapiens
cucuugggaacugaacucacu

SEQ ID NO: 1705970 - RNA, 15 nt, Homo sapiens
cucuuuaaugucaca

SEQ ID NO: 1705971 - RNA, 15 nt, Homo sapiens
cucuuucaaagcuaa

SEQ ID NO: 1705972 - RNA, 12 nt, Homo sapiens
cucuuucacuuc

SEQ ID NO: 1705973 - RNA, 15 nt, Homo sapiens
cucuuugcugcacua

SEQ ID NO: 1705974 - RNA, 17 nt, Homo sapiens
cucuuuuagcugaugaa

SEQ ID NO: 1705975 - RNA, 15 nt, Homo sapiens
cuuucaacuugcauc

SEQ ID NO: 1705976 - RNA, 14 nt, Homo sapiens
cuuucacacacaca

SEQ ID NO: 1705977 - RNA, 15 nt, Homo sapiens
cuuucagaaaaacaa

SEQ ID NO: 1705978 - RNA, 22 nt, Homo sapiens
cuuucagaaaaacaaaugugaa

SEQ ID NO: 1705979 - RNA, 13 nt, Homo sapiens
cuuucccagugag

SEQ ID NO: 1705980 - RNA, 16 nt, Homo sapiens
cuuuccccccauguug

SEQ ID NO: 1705981 - RNA, 19 nt, Homo sapiens
cuuucccuucaguacccuc

SEQ ID NO: 1705982 - RNA, 19 nt, Homo sapiens
cuuuccucagaucauccag

SEQ ID NO: 1705983 - RNA, 21 nt, Homo sapiens
cuuuccugucugcacaaguga

SEQ ID NO: 1705984 - RNA, 13 nt, Homo sapiens
cuuucuaacaaaa

SEQ ID NO: 1705985 - RNA, 19 nt, Homo sapiens
cuuucuccaggaccaauaa

SEQ ID NO: 1705986 - RNA, 20 nt, Homo sapiens
cuuucuccuguuuauuccca

SEQ ID NO: 1705987 - RNA, 13 nt, Homo sapiens
cuuugaaauaccu

SEQ ID NO: 1705988 - RNA, 18 nt, Homo sapiens
cuuugaaucuaguuguua

SEQ ID NO: 1705989 - RNA, 15 nt, Homo sapiens
cuuugacacucugca

SEQ ID NO: 1705990 - RNA, 22 nt, Homo sapiens
cuuugauagauuucuacacuga

SEQ ID NO: 1705991 - RNA, 13 nt, Homo sapiens
cuuugauuuccaa

SEQ ID NO: 1705992 - RNA, 12 nt, Homo sapiens
cuuugcuaaaau

SEQ ID NO: 1705993 - RNA, 23 nt, Homo sapiens
cuuugcucuuacuacacugagga

SEQ ID NO: 1705994 - RNA, 21 nt, Homo sapiens
cuuugggauugcuaugaauga

SEQ ID NO: 1705995 - RNA, 19 nt, Homo sapiens
cuuugguuucugucuguaa

SEQ ID NO: 1705996 - RNA, 18 nt, Homo sapiens
cuuuguaagaguguagaa

SEQ ID NO: 1705997 - RNA, 17 nt, Homo sapiens
cuuuguaugcacuuugu

SEQ ID NO: 1705998 - RNA, 13 nt, Homo sapiens
cuuugucugaaaa

SEQ ID NO: 1705999 - RNA, 12 nt, Homo sapiens
cuuugucugugg

SEQ ID NO: 1706000 - RNA, 18 nt, Homo sapiens
cuuuguguagaaagccaa

SEQ ID NO: 1706001 - RNA, 21 nt, Homo sapiens
cuuuguguagaaagccaaaua

SEQ ID NO: 1706002 - RNA, 11 nt, Homo sapiens
cuuuguugccc

SEQ ID NO: 1706003 - RNA, 20 nt, Homo sapiens
cuuuguuuggauguaauuua

SEQ ID NO: 1706004 - RNA, 15 nt, Homo sapiens
cuuuuaaaugcauaa

SEQ ID NO: 1706005 - RNA, 17 nt, Homo sapiens
cuuuuaaugcuucauuc

SEQ ID NO: 1706006 - RNA, 22 nt, Homo sapiens
cuuuuaauguauuuguuugcaa

SEQ ID NO: 1706007 - RNA, 21 nt, Homo sapiens
cuuuuacccggcacauucccc

SEQ ID NO: 1706008 - RNA, 21 nt, Homo sapiens
cuuuuauaguggaaaaacaca

SEQ ID NO: 1706009 - RNA, 13 nt, Homo sapiens
cuuuuauguagca

SEQ ID NO: 1706010 - RNA, 21 nt, Homo sapiens
cuuuuauguaguaauugacau

SEQ ID NO: 1706011 - RNA, 12 nt, Homo sapiens
cuuuuauuacau

SEQ ID NO: 1706012 - RNA, 22 nt, Homo sapiens
cuuuucaggguuuucugaggga

SEQ ID NO: 1706013 - RNA, 15 nt, Homo sapiens
cuuuucauaaccuag

SEQ ID NO: 1706014 - RNA, 19 nt, Homo sapiens
cuuuuccugauaaagcaca

SEQ ID NO: 1706015 - RNA, 16 nt, Homo sapiens
cuuuuccuuucugcca

SEQ ID NO: 1706016 - RNA, 15 nt, Homo sapiens
cuuuucuagccuauu

SEQ ID NO: 1706017 - RNA, 23 nt, Homo sapiens
cuuuucuggccaaaagcaguaaa

SEQ ID NO: 1706018 - RNA, 23 nt, Homo sapiens
cuuuuuaaaguguuucuguuauu

SEQ ID NO: 1706019 - RNA, 18 nt, Homo sapiens
cuuuuucauuuuccaaua

SEQ ID NO: 1706020 - RNA, 23 nt, Homo sapiens
cuuuuuugucccccaacuugaga

SEQ ID NO: 1706021 - RNA, 18 nt, Homo sapiens
gaaaaaaaccacacaaag

SEQ ID NO: 1706022 - RNA, 17 nt, Homo sapiens
gaaaaaaaguacaugua

SEQ ID NO: 1706023 - RNA, 20 nt, Homo sapiens
gaaaaagguuugcauucuca

SEQ ID NO: 1706024 - RNA, 18 nt, Homo sapiens
gaaaaaucauccaagaca

SEQ ID NO: 1706025 - RNA, 18 nt, Homo sapiens
gaaaacaaucacacucau

SEQ ID NO: 1706026 - RNA, 20 nt, Homo sapiens
gaaaacauagcaucucagga

SEQ ID NO: 1706027 - RNA, 12 nt, Homo sapiens
gaaaaccagcuu

SEQ ID NO: 1706028 - RNA, 20 nt, Homo sapiens
gaaaaccccaucucuacuaa

SEQ ID NO: 1706029 - RNA, 13 nt, Homo sapiens
gaaaacuauacaa

SEQ ID NO: 1706030 - RNA, 21 nt, Homo sapiens
gaaaagaaaaaaaaaagaaga

SEQ ID NO: 1706031 - RNA, 19 nt, Homo sapiens
gaaaagaccaguccaugag

SEQ ID NO: 1706032 - RNA, 15 nt, Homo sapiens
gaaaagagaagaaga

SEQ ID NO: 1706033 - RNA, 15 nt, Homo sapiens
gaaaagagucuucca

SEQ ID NO: 1706034 - RNA, 20 nt, Homo sapiens
gaaaagcugaucauaaguga

SEQ ID NO: 1706035 - RNA, 23 nt, Homo sapiens
gaaaagcuucuuaauuaauuuga

SEQ ID NO: 1706036 - RNA, 12 nt, Homo sapiens
gaaaauaaguga

SEQ ID NO: 1706037 - RNA, 17 nt, Homo sapiens
gaaaauaugauguuuca

SEQ ID NO: 1706038 - RNA, 14 nt, Homo sapiens
gaaaauguacaaua

SEQ ID NO: 1706039 - RNA, 17 nt, Homo sapiens
gaaacaccaguaccuga

SEQ ID NO: 1706040 - RNA, 17 nt, Homo sapiens
gaaacaguuaauaccau

SEQ ID NO: 1706041 - RNA, 17 nt, Homo sapiens
gaaacauacguucuuuu

SEQ ID NO: 1706042 - RNA, 18 nt, Homo sapiens
gaaacaugacacugaccu

SEQ ID NO: 1706043 - RNA, 16 nt, Homo sapiens
gaaaccaacacccaaa

SEQ ID NO: 1706044 - RNA, 14 nt, Homo sapiens
gaaacccucuguca

SEQ ID NO: 1706045 - RNA, 15 nt, Homo sapiens
gaaacccucugucau

SEQ ID NO: 1706046 - RNA, 16 nt, Homo sapiens
gaaacuauacauuuau

SEQ ID NO: 1706047 - RNA, 14 nt, Homo sapiens
gaaacucaaaaaua

SEQ ID NO: 1706048 - RNA, 19 nt, Homo sapiens
gaaacuuuaaaagacugaa

SEQ ID NO: 1706049 - RNA, 14 nt, Homo sapiens
gaaagacacuguuu

SEQ ID NO: 1706050 - RNA, 14 nt, Homo sapiens
gaaagcaggggcua

SEQ ID NO: 1706051 - RNA, 14 nt, Homo sapiens
gaaagccuuaggga

SEQ ID NO: 1706052 - RNA, 19 nt, Homo sapiens
gaaagcugagaacuccuga

SEQ ID NO: 1706053 - RNA, 13 nt, Homo sapiens
gaaaggggcccca

SEQ ID NO: 1706054 - RNA, 19 nt, Homo sapiens
gaaagggguuggggugaca

SEQ ID NO: 1706055 - RNA, 21 nt, Homo sapiens
gaaagguacuauauuugcuag

SEQ ID NO: 1706056 - RNA, 22 nt, Homo sapiens
gaaagguacuauauuugcuaga

SEQ ID NO: 1706057 - RNA, 16 nt, Homo sapiens
gaaagguuauguuagc

SEQ ID NO: 1706058 - RNA, 13 nt, Homo sapiens
gaaauaaaacuac

SEQ ID NO: 1706059 - RNA, 17 nt, Homo sapiens
gaaauccauaucuuaaa

SEQ ID NO: 1706060 - RNA, 23 nt, Homo sapiens
gaaaugauccccaaguggugaau

SEQ ID NO: 1706061 - RNA, 20 nt, Homo sapiens
gaaauggauuuaucaucacc

SEQ ID NO: 1706062 - RNA, 20 nt, Homo sapiens
gaaauggccaggauccucuc

SEQ ID NO: 1706063 - RNA, 17 nt, Homo sapiens
gaaauuaagaaggcaaa

SEQ ID NO: 1706064 - RNA, 17 nt, Homo sapiens
gaaauuauaucuguggu

SEQ ID NO: 1706065 - RNA, 18 nt, Homo sapiens
gaaauuauaucugugguc

SEQ ID NO: 1706066 - RNA, 15 nt, Homo sapiens
gaacaaaaaaaccac

SEQ ID NO: 1706067 - RNA, 13 nt, Homo sapiens
gaacaaaaucugu

SEQ ID NO: 1706068 - RNA, 14 nt, Homo sapiens
gaacaaaugaauaa

SEQ ID NO: 1706069 - RNA, 17 nt, Homo sapiens
gaacaacgccugucaca

SEQ ID NO: 1706070 - RNA, 22 nt, Homo sapiens
gaacacuaacucaccagcccca

SEQ ID NO: 1706071 - RNA, 17 nt, Homo sapiens
gaacagaaggaugaaug

SEQ ID NO: 1706072 - RNA, 23 nt, Homo sapiens
gaacagaauguuuuacugugaaa

SEQ ID NO: 1706073 - RNA, 20 nt, Homo sapiens
gaacagacaacagaagucau

SEQ ID NO: 1706074 - RNA, 21 nt, Homo sapiens
gaacagacaacagaagucaug

SEQ ID NO: 1706075 - RNA, 20 nt, Homo sapiens
gaacagggucauguuugcag

SEQ ID NO: 1706076 - RNA, 20 nt, Homo sapiens
gaacaguaucuuugcacucc

SEQ ID NO: 1706077 - RNA, 17 nt, Homo sapiens
gaacauaaaaaggacau

SEQ ID NO: 1706078 - RNA, 23 nt, Homo sapiens
gaacauuccuuagucucaagggc

SEQ ID NO: 1706079 - RNA, 16 nt, Homo sapiens
gaaccaagcaggagac

SEQ ID NO: 1706080 - RNA, 22 nt, Homo sapiens
gaaccaagcggugccagccacg

SEQ ID NO: 1706081 - RNA, 14 nt, Homo sapiens
gaaccaccccggcc

SEQ ID NO: 1706082 - RNA, 21 nt, Homo sapiens
gaaccagagaggcucugagaa

SEQ ID NO: 1706083 - RNA, 15 nt, Homo sapiens
gaaccucugucucau

SEQ ID NO: 1706084 - RNA, 22 nt, Homo sapiens
gaaccuguccuaaggaaccuuc

SEQ ID NO: 1706085 - RNA, 15 nt, Homo sapiens
gauuuuuuauugcua

SEQ ID NO: 1706086 - RNA, 17 nt, Homo sapiens
gcaaaauauuugacuau

SEQ ID NO: 1706087 - RNA, 20 nt, Homo sapiens
gcaaaaugaaaaugucaaua

SEQ ID NO: 1706088 - RNA, 14 nt, Homo sapiens
gcaaaaugcagcuu

SEQ ID NO: 1706089 - RNA, 18 nt, Homo sapiens
gcaaaauugauguguuua

SEQ ID NO: 1706090 - RNA, 20 nt, Homo sapiens
gcaaagcugaugacaacuuc

SEQ ID NO: 1706091 - RNA, 19 nt, Homo sapiens
gcaaaguucccuacuuccu

SEQ ID NO: 1706092 - RNA, 21 nt, Homo sapiens
gcaaaugacaugcacugaccc

SEQ ID NO: 1706093 - RNA, 15 nt, Homo sapiens
gcaacagagcaagac

SEQ ID NO: 1706094 - RNA, 18 nt, Homo sapiens
gcaacgccgugggcugcg

SEQ ID NO: 1706095 - RNA, 22 nt, Homo sapiens
gcaacguagcuucuaccaugaa

SEQ ID NO: 1706096 - RNA, 18 nt, Homo sapiens
gcaagccugucugagacu

SEQ ID NO: 1706097 - RNA, 13 nt, Homo sapiens
gcaagcuccugca

SEQ ID NO: 1706098 - RNA, 16 nt, Homo sapiens
gcaagucuuccaugac

SEQ ID NO: 1706099 - RNA, 17 nt, Homo sapiens
gcaagucuuccaugacc

SEQ ID NO: 1706100 - RNA, 15 nt, Homo sapiens
gcaaguuaagagaaa

SEQ ID NO: 1706101 - RNA, 14 nt, Homo sapiens
gcaauaaauaccag

SEQ ID NO: 1706102 - RNA, 23 nt, Homo sapiens
gcaauggugucaguauccaggcu

SEQ ID NO: 1706103 - RNA, 19 nt, Homo sapiens
gcaauguaucccuucucac

SEQ ID NO: 1706104 - RNA, 18 nt, Homo sapiens
gcaauuuucgaacauucu

SEQ ID NO: 1706105 - RNA, 20 nt, Homo sapiens
gcacaagaagugguccaucu

SEQ ID NO: 1706106 - RNA, 22 nt, Homo sapiens
gcacaagccacaagucuuccag

SEQ ID NO: 1706107 - RNA, 16 nt, Homo sapiens
gcacaagggcacguga

SEQ ID NO: 1706108 - RNA, 14 nt, Homo sapiens
gcacagagucagga

SEQ ID NO: 1706109 - RNA, 20 nt, Homo sapiens
gcacagcugaaaguucuugc

SEQ ID NO: 1706110 - RNA, 19 nt, Homo sapiens
gcacaguagagcaaaucua

SEQ ID NO: 1706111 - RNA, 15 nt, Homo sapiens
gcacauccauuccca

SEQ ID NO: 1706112 - RNA, 12 nt, Homo sapiens
gcacaucuuuga

SEQ ID NO: 1706113 - RNA, 13 nt, Homo sapiens
gcaccaaccugca

SEQ ID NO: 1706114 - RNA, 17 nt, Homo sapiens
gcaccaggcacugcugc

SEQ ID NO: 1706115 - RNA, 12 nt, Homo sapiens
gcacccauucca

SEQ ID NO: 1706116 - RNA, 13 nt, Homo sapiens
gcaccccaugcca

SEQ ID NO: 1706117 - RNA, 12 nt, Homo sapiens
gcaccuaccuca

SEQ ID NO: 1706118 - RNA, 19 nt, Homo sapiens
gcaccugcaugugcuguca

SEQ ID NO: 1706119 - RNA, 23 nt, Homo sapiens
gcaccugccuccucguuccuuuc

SEQ ID NO: 1706120 - RNA, 20 nt, Homo sapiens
gcaccuuaagauuuugcacc

SEQ ID NO: 1706121 - RNA, 16 nt, Homo sapiens
gcaccuuugcacagga

SEQ ID NO: 1706122 - RNA, 18 nt, Homo sapiens
gcacgguggcucaggccu

SEQ ID NO: 1706123 - RNA, 21 nt, Homo sapiens
gcacuacauucauuuagcuaa

SEQ ID NO: 1706124 - RNA, 20 nt, Homo sapiens
gcacucacgcccuaagcgca

SEQ ID NO: 1706125 - RNA, 19 nt, Homo sapiens
gcacucagaagacacugau

SEQ ID NO: 1706126 - RNA, 21 nt, Homo sapiens
gcacugacauuguuggccaaa

SEQ ID NO: 1706127 - RNA, 15 nt, Homo sapiens
gcacuguccugacca

SEQ ID NO: 1706128 - RNA, 17 nt, Homo sapiens
gcacuguugcaaacuca

SEQ ID NO: 1706129 - RNA, 11 nt, Homo sapiens
gcacuugccug

SEQ ID NO: 1706130 - RNA, 19 nt, Homo sapiens
gcacuuugaaauaccucau

SEQ ID NO: 1706131 - RNA, 20 nt, Homo sapiens
gcagaacauuguaucacauu

SEQ ID NO: 1706132 - RNA, 12 nt, Homo sapiens
gcagaagcccug

SEQ ID NO: 1706133 - RNA, 22 nt, Homo sapiens
gcagacaggaggaaucauguca

SEQ ID NO: 1706134 - RNA, 14 nt, Homo sapiens
gcagacaguagaca

SEQ ID NO: 1706135 - RNA, 21 nt, Homo sapiens
gcagacaucggccuccaugac

SEQ ID NO: 1706136 - RNA, 15 nt, Homo sapiens
gcagacuacacagga

SEQ ID NO: 1706137 - RNA, 20 nt, Homo sapiens
gcagagaaccaaaggggcca

SEQ ID NO: 1706138 - RNA, 17 nt, Homo sapiens
gcagaucugugccccau

SEQ ID NO: 1706139 - RNA, 16 nt, Homo sapiens
gcagauggggcacuga

SEQ ID NO: 1706140 - RNA, 18 nt, Homo sapiens
gcagcauagcaagacaca

SEQ ID NO: 1706141 - RNA, 14 nt, Homo sapiens
gcagcccagagacu

SEQ ID NO: 1706142 - RNA, 13 nt, Homo sapiens
gcagcccaugccc

SEQ ID NO: 1706143 - RNA, 23 nt, Homo sapiens
gcagcccaugcccaccugcccau

SEQ ID NO: 1706144 - RNA, 19 nt, Homo sapiens
gcagccccacaacuuuaaa

SEQ ID NO: 1706145 - RNA, 19 nt, Homo sapiens
gcagcuaaaggaagugaau

SEQ ID NO: 1706146 - RNA, 18 nt, Homo sapiens
gcaggaagcauucagaga

SEQ ID NO: 1706147 - RNA, 14 nt, Homo sapiens
gcaggaguggugca

SEQ ID NO: 1706148 - RNA, 18 nt, Homo sapiens
gcaggcauggauccagaa

SEQ ID NO: 1706149 - RNA, 21 nt, Homo sapiens
gcaggcccuuugaagccucag

SEQ ID NO: 1706150 - RNA, 14 nt, Homo sapiens
gcaggcugggccau

SEQ ID NO: 1706151 - RNA, 18 nt, Homo sapiens
gcaggcugggccaugucc

SEQ ID NO: 1706152 - RNA, 23 nt, Homo sapiens
gcaggcugggccauguccaaaga

SEQ ID NO: 1706153 - RNA, 15 nt, Homo sapiens
gcagggaaacagcua

SEQ ID NO: 1706154 - RNA, 15 nt, Homo sapiens
gcagggcaaaugaca

SEQ ID NO: 1706155 - RNA, 19 nt, Homo sapiens
gcagggcaaaugacaugca

SEQ ID NO: 1706156 - RNA, 15 nt, Homo sapiens
gcagguauggaaggg

SEQ ID NO: 1706157 - RNA, 20 nt, Homo sapiens
gcaggugacauuugcucuga

SEQ ID NO: 1706158 - RNA, 17 nt, Homo sapiens
gcagguuggaccccaga

SEQ ID NO: 1706159 - RNA, 13 nt, Homo sapiens
gcagucagggaca

SEQ ID NO: 1706160 - RNA, 19 nt, Homo sapiens
gcaguccugccucagccuc

SEQ ID NO: 1706161 - RNA, 16 nt, Homo sapiens
gcagugauuagcacuu

SEQ ID NO: 1706162 - RNA, 22 nt, Homo sapiens
gcaguuuccaauaaacgcaagc

SEQ ID NO: 1706163 - RNA, 13 nt, Homo sapiens
gcauaguccaaaa

SEQ ID NO: 1706164 - RNA, 15 nt, Homo sapiens
gcauaguccaaaaag

SEQ ID NO: 1706165 - RNA, 15 nt, Homo sapiens
gcauagugcugggau

SEQ ID NO: 1706166 - RNA, 17 nt, Homo sapiens
gcauccaacuccaggau

SEQ ID NO: 1706167 - RNA, 20 nt, Homo sapiens
gcauccccuuggcugugagg

SEQ ID NO: 1706168 - RNA, 18 nt, Homo sapiens
gcauccuggcacccggcc

SEQ ID NO: 1706169 - RNA, 15 nt, Homo sapiens
gcaucuggguuuguu

SEQ ID NO: 1706170 - RNA, 12 nt, Homo sapiens
gcaucugugaug

SEQ ID NO: 1706171 - RNA, 21 nt, Homo sapiens
gcauggcaagucacaugcgua

SEQ ID NO: 1706172 - RNA, 17 nt, Homo sapiens
gcauggucccugccuua

SEQ ID NO: 1706173 - RNA, 15 nt, Homo sapiens
gcauucauaaccaaa

SEQ ID NO: 1706174 - RNA, 14 nt, Homo sapiens
gcauucuauugccu

SEQ ID NO: 1706175 - RNA, 21 nt, Homo sapiens
gcauuuacagaaacgcaucca

SEQ ID NO: 1706176 - RNA, 22 nt, Homo sapiens
gcauuugacugaagaugcagcu

SEQ ID NO: 1706177 - RNA, 15 nt, Homo sapiens
gcauuugauuuugcc

SEQ ID NO: 1706178 - RNA, 18 nt, Homo sapiens
gcauuuuuauaaacaaaa

SEQ ID NO: 1706179 - RNA, 15 nt, Homo sapiens
gcauuuuucugggag

SEQ ID NO: 1706180 - RNA, 12 nt, Homo sapiens
gccaaaaggaaa

SEQ ID NO: 1706181 - RNA, 17 nt, Homo sapiens
gccaaacccaugaggca

SEQ ID NO: 1706182 - RNA, 13 nt, Homo sapiens
gccaacuccucac

SEQ ID NO: 1706183 - RNA, 12 nt, Homo sapiens
gccaacuuuguu

SEQ ID NO: 1706184 - RNA, 15 nt, Homo sapiens
gccaagaaacacuuu

SEQ ID NO: 1706185 - RNA, 18 nt, Homo sapiens
gccaagaaacacuuucag

SEQ ID NO: 1706186 - RNA, 20 nt, Homo sapiens
gccaagacaaaucaacagaa

SEQ ID NO: 1706187 - RNA, 13 nt, Homo sapiens
gccaagguaggca

SEQ ID NO: 1706188 - RNA, 16 nt, Homo sapiens
gccaauucacaaguua

SEQ ID NO: 1706189 - RNA, 11 nt, Homo sapiens
gccacagccau

SEQ ID NO: 1706190 - RNA, 14 nt, Homo sapiens
gccaccacauguau

SEQ ID NO: 1706191 - RNA, 16 nt, Homo sapiens
gccaccagccacuuua

SEQ ID NO: 1706192 - RNA, 18 nt, Homo sapiens
gccaccgccagagcuccu

SEQ ID NO: 1706193 - RNA, 20 nt, Homo sapiens
gccaccuccagacaccagug

SEQ ID NO: 1706194 - RNA, 23 nt, Homo sapiens
gccaccucucuccuuugcugagg

SEQ ID NO: 1706195 - RNA, 13 nt, Homo sapiens
ucaaguucauuga

SEQ ID NO: 1706196 - RNA, 21 nt, Homo sapiens
ucaaguuuuggguauguuuaa

SEQ ID NO: 1706197 - RNA, 16 nt, Homo sapiens
ucaauccgaaguauga

SEQ ID NO: 1706198 - RNA, 15 nt, Homo sapiens
ucaauggacuggaag

SEQ ID NO: 1706199 - RNA, 14 nt, Homo sapiens
ucaauggauuugau

SEQ ID NO: 1706200 - RNA, 18 nt, Homo sapiens
ucaaugggcucuuccaac

SEQ ID NO: 1706201 - RNA, 19 nt, Homo sapiens
ucacaaacuuuuauacucu

SEQ ID NO: 1706202 - RNA, 17 nt, Homo sapiens
ucacaaauuucacuuau

SEQ ID NO: 1706203 - RNA, 20 nt, Homo sapiens
ucacaauaccucaugcuuca

SEQ ID NO: 1706204 - RNA, 11 nt, Homo sapiens
ucacacacuga

SEQ ID NO: 1706205 - RNA, 17 nt, Homo sapiens
ucacacucauaacucau

SEQ ID NO: 1706206 - RNA, 18 nt, Homo sapiens
ucacagaguagaaacuca

SEQ ID NO: 1706207 - RNA, 15 nt, Homo sapiens
ucacagagugcauug

SEQ ID NO: 1706208 - RNA, 16 nt, Homo sapiens
ucacagagugcauugu

SEQ ID NO: 1706209 - RNA, 14 nt, Homo sapiens
ucacaugaccugau

SEQ ID NO: 1706210 - RNA, 22 nt, Homo sapiens
ucacaugcguaaacgacacucu

SEQ ID NO: 1706211 - RNA, 20 nt, Homo sapiens
ucacauggccuaugcacaua

SEQ ID NO: 1706212 - RNA, 23 nt, Homo sapiens
ucacauggccuaugcacauaugg

SEQ ID NO: 1706213 - RNA, 14 nt, Homo sapiens
ucacauugugccuu

SEQ ID NO: 1706214 - RNA, 21 nt, Homo sapiens
ucaccaaagcccacugccaug

SEQ ID NO: 1706215 - RNA, 20 nt, Homo sapiens
ucaccaacugaaguggcuaa

SEQ ID NO: 1706216 - RNA, 15 nt, Homo sapiens
ucaccaagcccaguu

SEQ ID NO: 1706217 - RNA, 17 nt, Homo sapiens
ucaccaccaaaugccaa

SEQ ID NO: 1706218 - RNA, 16 nt, Homo sapiens
ucaccacuccauuccc

SEQ ID NO: 1706219 - RNA, 14 nt, Homo sapiens
ucaccagagcauuu

SEQ ID NO: 1706220 - RNA, 18 nt, Homo sapiens
ucaccagccccacugcca

SEQ ID NO: 1706221 - RNA, 13 nt, Homo sapiens
ucaccauguugcc

SEQ ID NO: 1706222 - RNA, 16 nt, Homo sapiens
ucaccauugcugucaa

SEQ ID NO: 1706223 - RNA, 20 nt, Homo sapiens
ucacccaggcacugggcaag

SEQ ID NO: 1706224 - RNA, 18 nt, Homo sapiens
ucaccccaacuaguagcu

SEQ ID NO: 1706225 - RNA, 21 nt, Homo sapiens
ucaccccaaguagucugcuca

SEQ ID NO: 1706226 - RNA, 22 nt, Homo sapiens
ucaccccaaguagucugcucac

SEQ ID NO: 1706227 - RNA, 23 nt, Homo sapiens
ucaccccggcaggcccugcagug

SEQ ID NO: 1706228 - RNA, 14 nt, Homo sapiens
ucacccuaccugug

SEQ ID NO: 1706229 - RNA, 15 nt, Homo sapiens
ucacccuuaacccaa

SEQ ID NO: 1706230 - RNA, 18 nt, Homo sapiens
ucaccggccgauggagac

SEQ ID NO: 1706231 - RNA, 16 nt, Homo sapiens
ucaccuaaaaaaagag

SEQ ID NO: 1706232 - RNA, 18 nt, Homo sapiens
ucaccuaagucucuguga

SEQ ID NO: 1706233 - RNA, 21 nt, Homo sapiens
ucaccuaagucucugugaauu

SEQ ID NO: 1706234 - RNA, 20 nt, Homo sapiens
ucaccucuccuacucacuua

SEQ ID NO: 1706235 - RNA, 15 nt, Homo sapiens
ucaccuggaugugca

SEQ ID NO: 1706236 - RNA, 12 nt, Homo sapiens
ucaccuuauuca

SEQ ID NO: 1706237 - RNA, 21 nt, Homo sapiens
ucacggagauaugaagagcaa

SEQ ID NO: 1706238 - RNA, 17 nt, Homo sapiens
ucacuacccuauucucu

SEQ ID NO: 1706239 - RNA, 19 nt, Homo sapiens
ucacuacuuaaagugcuau

SEQ ID NO: 1706240 - RNA, 18 nt, Homo sapiens
ucacuacuuuaauaaaga

SEQ ID NO: 1706241 - RNA, 20 nt, Homo sapiens
ucacuccaggauauugacaa

SEQ ID NO: 1706242 - RNA, 22 nt, Homo sapiens
ucacuccccaaggaagagccaa

SEQ ID NO: 1706243 - RNA, 17 nt, Homo sapiens
ucacucuuuauagugca

SEQ ID NO: 1706244 - RNA, 19 nt, Homo sapiens
ucacucuuuauagugcaca

SEQ ID NO: 1706245 - RNA, 18 nt, Homo sapiens
ucacugauauauuuucca

SEQ ID NO: 1706246 - RNA, 18 nt, Homo sapiens
ucacugcuggcugccuua

SEQ ID NO: 1706247 - RNA, 15 nt, Homo sapiens
ucacugggucugcug

SEQ ID NO: 1706248 - RNA, 23 nt, Homo sapiens
ucacuguagaaugauuucaugcu

SEQ ID NO: 1706249 - RNA, 18 nt, Homo sapiens
ucacuucgggcuguguaa

SEQ ID NO: 1706250 - RNA, 13 nt, Homo sapiens
ucacuuguacaaa

SEQ ID NO: 1706251 - RNA, 14 nt, Homo sapiens
ucagaaaacucugg

SEQ ID NO: 1706252 - RNA, 19 nt, Homo sapiens
ucagaaacuagaaauguga

SEQ ID NO: 1706253 - RNA, 17 nt, Homo sapiens
ucagagaaauacuuuca

SEQ ID NO: 1706254 - RNA, 14 nt, Homo sapiens
ucagagaugugcac

SEQ ID NO: 1706255 - RNA, 15 nt, Homo sapiens
ucagagccaccccua

SEQ ID NO: 1706256 - RNA, 16 nt, Homo sapiens
ucagauaggagugaau

SEQ ID NO: 1706257 - RNA, 12 nt, Homo sapiens
ucagaugaacuc

SEQ ID NO: 1706258 - RNA, 15 nt, Homo sapiens
ucagauggugaagca

SEQ ID NO: 1706259 - RNA, 18 nt, Homo sapiens
ucagauuguuaucuauca

SEQ ID NO: 1706260 - RNA, 18 nt, Homo sapiens
ucagcaaccugacucagg

SEQ ID NO: 1706261 - RNA, 11 nt, Homo sapiens
ucagcacugaa

SEQ ID NO: 1706262 - RNA, 21 nt, Homo sapiens
ucagcaugauguguuguguau

SEQ ID NO: 1706263 - RNA, 18 nt, Homo sapiens
ucagcauucucacuccua

SEQ ID NO: 1706264 - RNA, 22 nt, Homo sapiens
ucagcauuucuuuucuggccaa

SEQ ID NO: 1706265 - RNA, 17 nt, Homo sapiens
ucagccaggacagucag

SEQ ID NO: 1706266 - RNA, 12 nt, Homo sapiens
ucagcugccuca

SEQ ID NO: 1706267 - RNA, 19 nt, Homo sapiens
ucagcuuguaaauagcuca

SEQ ID NO: 1706268 - RNA, 22 nt, Homo sapiens
ucaggauccaagcuaagcacug

SEQ ID NO: 1706269 - RNA, 14 nt, Homo sapiens
ucaggcccuggaac

SEQ ID NO: 1706270 - RNA, 15 nt, Homo sapiens
ucagggccaugccug

SEQ ID NO: 1706271 - RNA, 14 nt, Homo sapiens
ucaggggacucagc

SEQ ID NO: 1706272 - RNA, 21 nt, Homo sapiens
ucagggggucuggaaagaagg

SEQ ID NO: 1706273 - RNA, 18 nt, Homo sapiens
ucaggguuggugugcuga

SEQ ID NO: 1706274 - RNA, 19 nt, Homo sapiens
ucaggugaaaauccaucuc

SEQ ID NO: 1706275 - RNA, 23 nt, Homo sapiens
ucaguacuugugaaacacagcug

SEQ ID NO: 1706276 - RNA, 20 nt, Homo sapiens
ucaguauuucaguguaguua

SEQ ID NO: 1706277 - RNA, 20 nt, Homo sapiens
ucagucacacacacauacaa

SEQ ID NO: 1706278 - RNA, 17 nt, Homo sapiens
ucaguccuguacucugg

SEQ ID NO: 1706279 - RNA, 12 nt, Homo sapiens
ucagucuugccu

SEQ ID NO: 1706280 - RNA, 15 nt, Homo sapiens
ucagugaaagccaga

SEQ ID NO: 1706281 - RNA, 16 nt, Homo sapiens
ucagugagauauuugg

SEQ ID NO: 1706282 - RNA, 18 nt, Homo sapiens
ucagugagauauuuggua

SEQ ID NO: 1706283 - RNA, 17 nt, Homo sapiens
ucaguguaccauuugcc

SEQ ID NO: 1706284 - RNA, 19 nt, Homo sapiens
ucaguguuuuaaauucuga

SEQ ID NO: 1706285 - RNA, 21 nt, Homo sapiens
ucaguuauucauucugugauc

SEQ ID NO: 1706286 - RNA, 16 nt, Homo sapiens
ucaguuuuuuguuuua

SEQ ID NO: 1706287 - RNA, 20 nt, Homo sapiens
ucauaaaugaagcagcuuua

SEQ ID NO: 1706288 - RNA, 20 nt, Homo sapiens
ucauaaccaaacacaaugau

SEQ ID NO: 1706289 - RNA, 20 nt, Homo sapiens
ucauaauuccuacagcacua

SEQ ID NO: 1706290 - RNA, 14 nt, Homo sapiens
ucauacuacugaaa

SEQ ID NO: 1706291 - RNA, 14 nt, Homo sapiens
ucauaguaacuucu

SEQ ID NO: 1706292 - RNA, 15 nt, Homo sapiens
ucaucaaucaaauaa

SEQ ID NO: 1706293 - RNA, 19 nt, Homo sapiens
ucaucaauucccauugcau

SEQ ID NO: 1706294 - RNA, 21 nt, Homo sapiens
ucaucaggaaggaaaugacac

SEQ ID NO: 1706295 - RNA, 20 nt, Homo sapiens
ucauccaggcccaacuguga

SEQ ID NO: 1706296 - RNA, 19 nt, Homo sapiens
ucauccccaggggucccag

SEQ ID NO: 1706297 - RNA, 15 nt, Homo sapiens
ucauccucaugcugc

SEQ ID NO: 1706298 - RNA, 19 nt, Homo sapiens
ucauccugccuucauggaa

SEQ ID NO: 1706299 - RNA, 23 nt, Homo sapiens
ucaucgggaggagcagccugaac

SEQ ID NO: 1706300 - RNA, 16 nt, Homo sapiens
ucaucuacccugcuga

SEQ ID NO: 1706301 - RNA, 20 nt, Homo sapiens
ucaucucauuccaacuuccc

SEQ ID NO: 1706302 - RNA, 14 nt, Homo sapiens
ucaugaaauaugca

SEQ ID NO: 1706303 - RNA, 15 nt, Homo sapiens
ucaugaaauaugcau

SEQ ID NO: 1706304 - RNA, 17 nt, Homo sapiens
ucaugaagcccaaguga

SEQ ID NO: 1706305 - RNA, 16 nt, Homo sapiens
ucuuugcucauggcaa

SEQ ID NO: 1706306 - RNA, 16 nt, Homo sapiens
ucuuugguucuaagga

SEQ ID NO: 1706307 - RNA, 16 nt, Homo sapiens
ucuuuguaucuuccau

SEQ ID NO: 1706308 - RNA, 13 nt, Homo sapiens
ucuuugugugaca

SEQ ID NO: 1706309 - RNA, 16 nt, Homo sapiens
ucuuuuacauucugca

SEQ ID NO: 1706310 - RNA, 19 nt, Homo sapiens
ucuuuuccugaccaaucuu

SEQ ID NO: 1706311 - RNA, 15 nt, Homo sapiens
ucuuuuccugucccu

SEQ ID NO: 1706312 - RNA, 18 nt, Homo sapiens
ucuuuucugaucugcagu

SEQ ID NO: 1706313 - RNA, 18 nt, Homo sapiens
ucuuuugaaggacuccuu

SEQ ID NO: 1706314 - RNA, 11 nt, Homo sapiens
ucuuuugcucu

SEQ ID NO: 1706315 - RNA, 18 nt, Homo sapiens
ugaaaaaacaccuagcuu

SEQ ID NO: 1706316 - RNA, 11 nt, Homo sapiens
ugaaaaaagcu

SEQ ID NO: 1706317 - RNA, 13 nt, Homo sapiens
ugaaaaacuuaag

SEQ ID NO: 1706318 - RNA, 14 nt, Homo sapiens
ugaaaaauguauau

SEQ ID NO: 1706319 - RNA, 14 nt, Homo sapiens
ugaaaaccaucugg

SEQ ID NO: 1706320 - RNA, 17 nt, Homo sapiens
ugaaaaccaucuggccu

SEQ ID NO: 1706321 - RNA, 12 nt, Homo sapiens
ugaaaaccuaaa

SEQ ID NO: 1706322 - RNA, 22 nt, Homo sapiens
ugaaaacucacagaacuaugua

SEQ ID NO: 1706323 - RNA, 15 nt, Homo sapiens
ugaaaagcuucuuaa

SEQ ID NO: 1706324 - RNA, 17 nt, Homo sapiens
ugaaaagggggugggau

SEQ ID NO: 1706325 - RNA, 15 nt, Homo sapiens
ugaaaauaugauguu

SEQ ID NO: 1706326 - RNA, 16 nt, Homo sapiens
ugaaaauccaucucau

SEQ ID NO: 1706327 - RNA, 14 nt, Homo sapiens
ugaaaaucuaauau

SEQ ID NO: 1706328 - RNA, 22 nt, Homo sapiens
ugaaaaugugaauugcaugacu

SEQ ID NO: 1706329 - RNA, 12 nt, Homo sapiens
ugaaaauguuca

SEQ ID NO: 1706330 - RNA, 19 nt, Homo sapiens
ugaaaauguuuuucugcca

SEQ ID NO: 1706331 - RNA, 15 nt, Homo sapiens
ugaaacacuuugccu

SEQ ID NO: 1706332 - RNA, 15 nt, Homo sapiens
ugaaagcaguagcau

SEQ ID NO: 1706333 - RNA, 19 nt, Homo sapiens
ugaaagcugagaacuccug

SEQ ID NO: 1706334 - RNA, 18 nt, Homo sapiens
ugaaagugaauaaacuuc

SEQ ID NO: 1706335 - RNA, 18 nt, Homo sapiens
ugaaauaacaaaauggac

SEQ ID NO: 1706336 - RNA, 12 nt, Homo sapiens
ugaaauaccuca

SEQ ID NO: 1706337 - RNA, 12 nt, Homo sapiens
ugaaauaugcau

SEQ ID NO: 1706338 - RNA, 13 nt, Homo sapiens
ugaaaucuuuuaa

SEQ ID NO: 1706339 - RNA, 13 nt, Homo sapiens
ugaaaugaccucu

SEQ ID NO: 1706340 - RNA, 18 nt, Homo sapiens
ugaaaugcuggcauuugc

SEQ ID NO: 1706341 - RNA, 15 nt, Homo sapiens
ugaaauggccaggau

SEQ ID NO: 1706342 - RNA, 24 nt, Homo sapiens
ugaaauguaggcaucaugcauguc

SEQ ID NO: 1706343 - RNA, 15 nt, Homo sapiens
ugaaauuauaucugu

SEQ ID NO: 1706344 - RNA, 17 nt, Homo sapiens
ugaaauucacaguaaua

SEQ ID NO: 1706345 - RNA, 21 nt, Homo sapiens
ugaaauucacccccuuuccug

SEQ ID NO: 1706346 - RNA, 21 nt, Homo sapiens
ugaaauuuucuagacuuucug

SEQ ID NO: 1706347 - RNA, 16 nt, Homo sapiens
ugaacacaggcagcuu

SEQ ID NO: 1706348 - RNA, 18 nt, Homo sapiens
ugaacacuggcuaaagau

SEQ ID NO: 1706349 - RNA, 22 nt, Homo sapiens
ugaaccauccacuuacauauau

SEQ ID NO: 1706350 - RNA, 16 nt, Homo sapiens
ugaaccuucugcaaca

SEQ ID NO: 1706351 - RNA, 14 nt, Homo sapiens
ugaacuacuaaagu

SEQ ID NO: 1706352 - RNA, 21 nt, Homo sapiens
ugaacuccuggccucaaguga

SEQ ID NO: 1706353 - RNA, 22 nt, Homo sapiens
ugaacuggguacuuguggacac

SEQ ID NO: 1706354 - RNA, 14 nt, Homo sapiens
ugaacugugcauag

SEQ ID NO: 1706355 - RNA, 15 nt, Homo sapiens
ugaacuucucucaga

SEQ ID NO: 1706356 - RNA, 23 nt, Homo sapiens
ugaagaagagacucuuugcauau

SEQ ID NO: 1706357 - RNA, 13 nt, Homo sapiens
ugaagacaggaug

SEQ ID NO: 1706358 - RNA, 17 nt, Homo sapiens
ugaagacugaggacaaa

SEQ ID NO: 1706359 - RNA, 14 nt, Homo sapiens
ugaagagcaaaaau

SEQ ID NO: 1706360 - RNA, 18 nt, Homo sapiens
ugaagagcaaaaauaucc

SEQ ID NO: 1706361 - RNA, 18 nt, Homo sapiens
ugaagauauuacuacuua

SEQ ID NO: 1706362 - RNA, 20 nt, Homo sapiens
ugaagcuucacucacuguca

SEQ ID NO: 1706363 - RNA, 16 nt, Homo sapiens
ugaaggagcagcauug

SEQ ID NO: 1706364 - RNA, 20 nt, Homo sapiens
ugaaggcauccccaggcccu

SEQ ID NO: 1706365 - RNA, 18 nt, Homo sapiens
ugaaguacaauaauucau

SEQ ID NO: 1706366 - RNA, 16 nt, Homo sapiens
ugaaguagaauccuaa

SEQ ID NO: 1706367 - RNA, 20 nt, Homo sapiens
ugaagucaugaccuccaggg

SEQ ID NO: 1706368 - RNA, 16 nt, Homo sapiens
ugaaguuugaacuuca

SEQ ID NO: 1706369 - RNA, 20 nt, Homo sapiens
ugaauaaaaauauguacaag

SEQ ID NO: 1706370 - RNA, 16 nt, Homo sapiens
ugaauaaaagugcaca

SEQ ID NO: 1706371 - RNA, 15 nt, Homo sapiens
ugaauagaaauggga

SEQ ID NO: 1706372 - RNA, 22 nt, Homo sapiens
ugaauagauggguuauuucaac

SEQ ID NO: 1706373 - RNA, 14 nt, Homo sapiens
ugaauauuacuccu

SEQ ID NO: 1706374 - RNA, 15 nt, Homo sapiens
ugaaucuauuucacu

SEQ ID NO: 1706375 - RNA, 17 nt, Homo sapiens
ugaaucuguaucuugcc

SEQ ID NO: 1706376 - RNA, 20 nt, Homo sapiens
ugaaugacacgccuaagguc

SEQ ID NO: 1706377 - RNA, 15 nt, Homo sapiens
ugaaugacauugaac

SEQ ID NO: 1706378 - RNA, 14 nt, Homo sapiens
ugaaugcugccaca

SEQ ID NO: 1706379 - RNA, 12 nt, Homo sapiens
ugaaugcuucuc

SEQ ID NO: 1706380 - RNA, 11 nt, Homo sapiens
ugaaugugauu

SEQ ID NO: 1706381 - RNA, 11 nt, Homo sapiens
ugaaugugcug

SEQ ID NO: 1706382 - RNA, 18 nt, Homo sapiens
ugaauguugugauguauu

SEQ ID NO: 1706383 - RNA, 18 nt, Homo sapiens
ugaauugcaugacuugua

SEQ ID NO: 1706384 - RNA, 13 nt, Homo sapiens
ugaauuuucuuca

SEQ ID NO: 1706385 - RNA, 19 nt, Homo sapiens
ugacaaaucuguguauauu

SEQ ID NO: 1706386 - RNA, 17 nt, Homo sapiens
ugacaaugacugugcua

SEQ ID NO: 1706387 - RNA, 18 nt, Homo sapiens
ugacacaaguggaccuua

SEQ ID NO: 1706388 - RNA, 12 nt, Homo sapiens
ugacacagcagc

SEQ ID NO: 1706389 - RNA, 11 nt, Homo sapiens
ugacacuauuc

SEQ ID NO: 1706390 - RNA, 20 nt, Homo sapiens
ugacacucugcagacugcua

SEQ ID NO: 1706391 - RNA, 16 nt, Homo sapiens
ugacagacacaggccc

SEQ ID NO: 1706392 - RNA, 19 nt, Homo sapiens
ugacaucacagcagccucc

SEQ ID NO: 1706393 - RNA, 14 nt, Homo sapiens
ugacaucacuugua

SEQ ID NO: 1706394 - RNA, 14 nt, Homo sapiens
ugacaugcacugac

SEQ ID NO: 1706395 - RNA, 15 nt, Homo sapiens
ugacaugcacugacc

SEQ ID NO: 1706396 - RNA, 17 nt, Homo sapiens
ugacauugcguuugacc

SEQ ID NO: 1706397 - RNA, 20 nt, Homo sapiens
ugacccccgcaaguuugcac

SEQ ID NO: 1706398 - RNA, 18 nt, Homo sapiens
ugacccugauacaggcau

SEQ ID NO: 1706399 - RNA, 16 nt, Homo sapiens
ugaccucacugugacc

SEQ ID NO: 1706400 - RNA, 15 nt, Homo sapiens
ugaccucccagugac

SEQ ID NO: 1706401 - RNA, 14 nt, Homo sapiens
ugaccugagccaga

SEQ ID NO: 1706402 - RNA, 18 nt, Homo sapiens
ugaccuggagaugcugcc

SEQ ID NO: 1706403 - RNA, 18 nt, Homo sapiens
ugaccuuggguauuugca

SEQ ID NO: 1706404 - RNA, 20 nt, Homo sapiens
ugacgucaucaucacauuca

SEQ ID NO: 1706405 - RNA, 23 nt, Homo sapiens
ugacucaggauuuaaaaacugga

SEQ ID NO: 1706406 - RNA, 13 nt, Homo sapiens
ugacuccaagaac

SEQ ID NO: 1706407 - RNA, 15 nt, Homo sapiens
ugacuuauaguacau

SEQ ID NO: 1706408 - RNA, 15 nt, Homo sapiens
ugacuuccuuacuaa

SEQ ID NO: 1706409 - RNA, 17 nt, Homo sapiens
ugagaaaaugagugacu

SEQ ID NO: 1706410 - RNA, 14 nt, Homo sapiens
ugagaaaugcauag

SEQ ID NO: 1706411 - RNA, 23 nt, Homo sapiens
ugagaaauuucugugaaaccugu

SEQ ID NO: 1706412 - RNA, 20 nt, Homo sapiens
ugagaagugucuaaaaacac

SEQ ID NO: 1706413 - RNA, 22 nt, Homo sapiens
ugagacaaaauuuuaguccaaa

SEQ ID NO: 1706414 - RNA, 15 nt, Homo sapiens
ugagacucacaggaa

SEQ ID NO: 1706415 - RNA, 19 nt, Homo sapiens
ugagagacauggcuuucag

SEQ ID NO: 1706416 - RNA, 15 nt, Homo sapiens
ugccaauuagcaauu

SEQ ID NO: 1706417 - RNA, 23 nt, Homo sapiens
ugccaauuauuguuacacauuaa

SEQ ID NO: 1706418 - RNA, 12 nt, Homo sapiens
ugccacaaccag

SEQ ID NO: 1706419 - RNA, 13 nt, Homo sapiens
ugccacacucuga

SEQ ID NO: 1706420 - RNA, 14 nt, Homo sapiens
ugccacucauuccu

SEQ ID NO: 1706421 - RNA, 19 nt, Homo sapiens
ugccacuggggaaaacucc

SEQ ID NO: 1706422 - RNA, 19 nt, Homo sapiens
ugccacuuuacccaccuag

SEQ ID NO: 1706423 - RNA, 19 nt, Homo sapiens
ugccagaugauuguucaaa

SEQ ID NO: 1706424 - RNA, 15 nt, Homo sapiens
ugccagugccucuca

SEQ ID NO: 1706425 - RNA, 15 nt, Homo sapiens
ugccaugcucagaaa

SEQ ID NO: 1706426 - RNA, 16 nt, Homo sapiens
ugccauggcagacagu

SEQ ID NO: 1706427 - RNA, 23 nt, Homo sapiens
ugcccaaagagcacaaacauuuu

SEQ ID NO: 1706428 - RNA, 21 nt, Homo sapiens
ugcccacccugggagacagac

SEQ ID NO: 1706429 - RNA, 15 nt, Homo sapiens
ugcccagaacuuccc

SEQ ID NO: 1706430 - RNA, 21 nt, Homo sapiens
ugcccaggccggccagccuca

SEQ ID NO: 1706431 - RNA, 20 nt, Homo sapiens
ugcccaggcuggaguggagu

SEQ ID NO: 1706432 - RNA, 19 nt, Homo sapiens
ugccccuauagaaacacca

SEQ ID NO: 1706433 - RNA, 19 nt, Homo sapiens
ugcccuaacuguacauuuc

SEQ ID NO: 1706434 - RNA, 22 nt, Homo sapiens
ugcccucuccuuccuuacccaa

SEQ ID NO: 1706435 - RNA, 20 nt, Homo sapiens
ugcccugagaagcugcucca

SEQ ID NO: 1706436 - RNA, 17 nt, Homo sapiens
ugcccugcccaugggag

SEQ ID NO: 1706437 - RNA, 16 nt, Homo sapiens
ugcccugguccaggga

SEQ ID NO: 1706438 - RNA, 17 nt, Homo sapiens
ugcccuguaaccugacu

SEQ ID NO: 1706439 - RNA, 19 nt, Homo sapiens
ugcccuuucuguaccauuu

SEQ ID NO: 1706440 - RNA, 20 nt, Homo sapiens
ugccuaaauuuaaugcugcc

SEQ ID NO: 1706441 - RNA, 12 nt, Homo sapiens
ugccuacagggc

SEQ ID NO: 1706442 - RNA, 23 nt, Homo sapiens
ugccuaguuuuuaguaaucugua

SEQ ID NO: 1706443 - RNA, 12 nt, Homo sapiens
ugccucaguaua

SEQ ID NO: 1706444 - RNA, 16 nt, Homo sapiens
ugccuccugccugccc

SEQ ID NO: 1706445 - RNA, 16 nt, Homo sapiens
ugccucugccacacuc

SEQ ID NO: 1706446 - RNA, 15 nt, Homo sapiens
ugccugaagucacac

SEQ ID NO: 1706447 - RNA, 15 nt, Homo sapiens
ugccugcgucuuccg

SEQ ID NO: 1706448 - RNA, 15 nt, Homo sapiens
ugccuggccuggcac

SEQ ID NO: 1706449 - RNA, 16 nt, Homo sapiens
ugccugguggcagcug

SEQ ID NO: 1706450 - RNA, 23 nt, Homo sapiens
ugccugguggggaucagacagag

SEQ ID NO: 1706451 - RNA, 21 nt, Homo sapiens
ugccuguuaaggaaacuuuau

SEQ ID NO: 1706452 - RNA, 19 nt, Homo sapiens
ugccuuaggguagugcuaa

SEQ ID NO: 1706453 - RNA, 13 nt, Homo sapiens
ugccuucucagga

SEQ ID NO: 1706454 - RNA, 17 nt, Homo sapiens
ugccuuggggaggacaa

SEQ ID NO: 1706455 - RNA, 18 nt, Homo sapiens
ugccuuggggaggacaaa

SEQ ID NO: 1706456 - RNA, 16 nt, Homo sapiens
ugccuugugcuguuaa

SEQ ID NO: 1706457 - RNA, 15 nt, Homo sapiens
ugcgauagagucuca

SEQ ID NO: 1706458 - RNA, 22 nt, Homo sapiens
ugcgcagacccugccacucuca

SEQ ID NO: 1706459 - RNA, 21 nt, Homo sapiens
ugcggcugccauuggagccaa

SEQ ID NO: 1706460 - RNA, 22 nt, Homo sapiens
ugcgugauucaaugaaccacaa

SEQ ID NO: 1706461 - RNA, 22 nt, Homo sapiens
ugcgugcucccgaugcugcuau

SEQ ID NO: 1706462 - RNA, 15 nt, Homo sapiens
ugcguggacucugca

SEQ ID NO: 1706463 - RNA, 23 nt, Homo sapiens
ugcuaaauggucgcccaggagac

SEQ ID NO: 1706464 - RNA, 16 nt, Homo sapiens
ugcuaauuaauacauc

SEQ ID NO: 1706465 - RNA, 18 nt, Homo sapiens
ugcuacauucuaaugcau

SEQ ID NO: 1706466 - RNA, 19 nt, Homo sapiens
ugcuacccaugacuuuaua

SEQ ID NO: 1706467 - RNA, 23 nt, Homo sapiens
ugcuacuccccagaccucaggga

SEQ ID NO: 1706468 - RNA, 17 nt, Homo sapiens
ugcuacugucuuuggaa

SEQ ID NO: 1706469 - RNA, 19 nt, Homo sapiens
ugcuagacucuagacaaga

SEQ ID NO: 1706470 - RNA, 18 nt, Homo sapiens
ugcuaguguucugucuaa

SEQ ID NO: 1706471 - RNA, 22 nt, Homo sapiens
ugcuaguguucugucuaaaaac

SEQ ID NO: 1706472 - RNA, 22 nt, Homo sapiens
ugcuaucuggaggccuuccagc

SEQ ID NO: 1706473 - RNA, 15 nt, Homo sapiens
ugcucauguaugugc

SEQ ID NO: 1706474 - RNA, 15 nt, Homo sapiens
ugcuccaagauucua

SEQ ID NO: 1706475 - RNA, 14 nt, Homo sapiens
ugcuccccugugaa

SEQ ID NO: 1706476 - RNA, 22 nt, Homo sapiens
ugcuccuuggcuuaccugaccu

SEQ ID NO: 1706477 - RNA, 15 nt, Homo sapiens
ugcucugcaaaagga

SEQ ID NO: 1706478 - RNA, 21 nt, Homo sapiens
ugcucuguaggagcuacccuu

SEQ ID NO: 1706479 - RNA, 15 nt, Homo sapiens
ugcucuuaagccuaa

SEQ ID NO: 1706480 - RNA, 21 nt, Homo sapiens
ugcugaaaaaguagauugagu

SEQ ID NO: 1706481 - RNA, 15 nt, Homo sapiens
ugcugauuuggugac

SEQ ID NO: 1706482 - RNA, 13 nt, Homo sapiens
ugcuggacuguca

SEQ ID NO: 1706483 - RNA, 13 nt, Homo sapiens
ugcuggcauuugc

SEQ ID NO: 1706484 - RNA, 14 nt, Homo sapiens
ugcuggcauuugca

SEQ ID NO: 1706485 - RNA, 19 nt, Homo sapiens
ugcuggcccauaaacaccc

SEQ ID NO: 1706486 - RNA, 14 nt, Homo sapiens
ugcugguagcacuu

SEQ ID NO: 1706487 - RNA, 14 nt, Homo sapiens
ugcugucaaaacaa

SEQ ID NO: 1706488 - RNA, 17 nt, Homo sapiens
ugcugucaagcaccugc

SEQ ID NO: 1706489 - RNA, 17 nt, Homo sapiens
ugcuguccaugcuucuc

SEQ ID NO: 1706490 - RNA, 17 nt, Homo sapiens
ugcuuagagacuaucaa

SEQ ID NO: 1706491 - RNA, 15 nt, Homo sapiens
ugcuuaguaucucau

SEQ ID NO: 1706492 - RNA, 13 nt, Homo sapiens
ugcuucagccucc

SEQ ID NO: 1706493 - RNA, 21 nt, Homo sapiens
ugcuucauaaaugaagcagcu

SEQ ID NO: 1706494 - RNA, 23 nt, Homo sapiens
ugcuucccggcgucccuaccucc

SEQ ID NO: 1706495 - RNA, 23 nt, Homo sapiens
ugcuuccgguagggaggcagccu

SEQ ID NO: 1706496 - RNA, 18 nt, Homo sapiens
ugcuuccugucugaguaa

SEQ ID NO: 1706497 - RNA, 16 nt, Homo sapiens
ugcuucuccccagaau

SEQ ID NO: 1706498 - RNA, 13 nt, Homo sapiens
ugcuugauuccag

SEQ ID NO: 1706499 - RNA, 15 nt, Homo sapiens
ugcuugggacauugc

SEQ ID NO: 1706500 - RNA, 17 nt, Homo sapiens
ugcuugggacauugcaa

SEQ ID NO: 1706501 - RNA, 22 nt, Homo sapiens
ugcuugggacauugcaauuugc

SEQ ID NO: 1706502 - RNA, 12 nt, Homo sapiens
ugcuugugccac

SEQ ID NO: 1706503 - RNA, 15 nt, Homo sapiens
ugcuuguuauauuaa

SEQ ID NO: 1706504 - RNA, 16 nt, Homo sapiens
ugcuuuagaaguaaca

SEQ ID NO: 1706505 - RNA, 14 nt, Homo sapiens
ugcuuugaagcagu

SEQ ID NO: 1706506 - RNA, 15 nt, Homo sapiens
ugcuuuuacuucucu

SEQ ID NO: 1706507 - RNA, 13 nt, Homo sapiens
ugcuuuucagggu

SEQ ID NO: 1706508 - RNA, 12 nt, Homo sapiens
uggaaaaaucac

SEQ ID NO: 1706509 - RNA, 19 nt, Homo sapiens
uggaaaagcaaaacuguag

SEQ ID NO: 1706510 - RNA, 13 nt, Homo sapiens
uggaaacuaagac

SEQ ID NO: 1706511 - RNA, 16 nt, Homo sapiens
uggaaagaaagaccau

SEQ ID NO: 1706512 - RNA, 18 nt, Homo sapiens
uggaacucagcugucugu

SEQ ID NO: 1706513 - RNA, 15 nt, Homo sapiens
uggaacuucuaauau

SEQ ID NO: 1706514 - RNA, 22 nt, Homo sapiens
uggaagaaaaaaaccacacaaa

SEQ ID NO: 1706515 - RNA, 14 nt, Homo sapiens
uggaagaguaguaa

SEQ ID NO: 1706516 - RNA, 22 nt, Homo sapiens
uggaagcucugaagucacauca

SEQ ID NO: 1706517 - RNA, 17 nt, Homo sapiens
uggaagcuuguuuucca

SEQ ID NO: 1706518 - RNA, 15 nt, Homo sapiens
uggaaggcagacagc

SEQ ID NO: 1706519 - RNA, 14 nt, Homo sapiens
uggaaguaaagccu

SEQ ID NO: 1706520 - RNA, 16 nt, Homo sapiens
uggaaguaaagccuca

SEQ ID NO: 1706521 - RNA, 17 nt, Homo sapiens
uggaaguucauaccuaa

SEQ ID NO: 1706522 - RNA, 18 nt, Homo sapiens
uggaaguucauaccuaag

SEQ ID NO: 1706523 - RNA, 20 nt, Homo sapiens
uggaauaacucuguggcauu

SEQ ID NO: 1706524 - RNA, 17 nt, Homo sapiens
uggaauccuauauagaa

SEQ ID NO: 1706525 - RNA, 15 nt, Homo sapiens
uggaauggagauuca

SEQ ID NO: 1706526 - RNA, 20 nt, Homo sapiens
uuggccuagcccacccugcu

SEQ ID NO: 1706527 - RNA, 10 nt, Homo sapiens
uuggcuugac

SEQ ID NO: 1706528 - RNA, 18 nt, Homo sapiens
uugggacaauuguuuuaa

SEQ ID NO: 1706529 - RNA, 16 nt, Homo sapiens
uugguuccuucugccc

SEQ ID NO: 1706530 - RNA, 18 nt, Homo sapiens
uugguuuuggggguguga

SEQ ID NO: 1706531 - RNA, 17 nt, Homo sapiens
uuguaaauagcucaggu

SEQ ID NO: 1706532 - RNA, 17 nt, Homo sapiens
uuguaacaauagcacaa

SEQ ID NO: 1706533 - RNA, 22 nt, Homo sapiens
uuguaacgacuucuccaucucc

SEQ ID NO: 1706534 - RNA, 15 nt, Homo sapiens
uuguaagaguguaga

SEQ ID NO: 1706535 - RNA, 20 nt, Homo sapiens
uuguaagucaguguugagau

SEQ ID NO: 1706536 - RNA, 13 nt, Homo sapiens
uuguaaugcugca

SEQ ID NO: 1706537 - RNA, 14 nt, Homo sapiens
uuguacaauguaga

SEQ ID NO: 1706538 - RNA, 14 nt, Homo sapiens
uuguauugacuauu

SEQ ID NO: 1706539 - RNA, 17 nt, Homo sapiens
uuguauuuugugugacc

SEQ ID NO: 1706540 - RNA, 19 nt, Homo sapiens
uugucaacaaaccaagcau

SEQ ID NO: 1706541 - RNA, 16 nt, Homo sapiens
uugucagaaaccugca

SEQ ID NO: 1706542 - RNA, 19 nt, Homo sapiens
uugucaugguuacaaacua

SEQ ID NO: 1706543 - RNA, 13 nt, Homo sapiens
uuguccacccacc

SEQ ID NO: 1706544 - RNA, 21 nt, Homo sapiens
uugucuguuuguuucaagaac

SEQ ID NO: 1706545 - RNA, 17 nt, Homo sapiens
uugucuucaaacuguga

SEQ ID NO: 1706546 - RNA, 20 nt, Homo sapiens
uugucuuuccuggcacuaac

SEQ ID NO: 1706547 - RNA, 14 nt, Homo sapiens
uugugaucauccca

SEQ ID NO: 1706548 - RNA, 18 nt, Homo sapiens
uugugcaaaauauuugac

SEQ ID NO: 1706549 - RNA, 14 nt, Homo sapiens
uugugccaauaugu

SEQ ID NO: 1706550 - RNA, 16 nt, Homo sapiens
uugugcuccaaacaaa

SEQ ID NO: 1706551 - RNA, 21 nt, Homo sapiens
uugugcuucacaguagagcca

SEQ ID NO: 1706552 - RNA, 21 nt, Homo sapiens
uugugugcucauguaugugcg

SEQ ID NO: 1706553 - RNA, 15 nt, Homo sapiens
uugugugucaugcca

SEQ ID NO: 1706554 - RNA, 17 nt, Homo sapiens
uuguuacuguucuugcu

SEQ ID NO: 1706555 - RNA, 23 nt, Homo sapiens
uuguucaaacaauaucauaucau

SEQ ID NO: 1706556 - RNA, 17 nt, Homo sapiens
uuguucaaagcacagaa

SEQ ID NO: 1706557 - RNA, 14 nt, Homo sapiens
uuguucauguuugg

SEQ ID NO: 1706558 - RNA, 16 nt, Homo sapiens
uuguuccagcccuauu

SEQ ID NO: 1706559 - RNA, 16 nt, Homo sapiens
uuguuccccacugaca

SEQ ID NO: 1706560 - RNA, 16 nt, Homo sapiens
uuguuucaagaauuua

SEQ ID NO: 1706561 - RNA, 22 nt, Homo sapiens
uuguuuccucuuccaaaguaaa

SEQ ID NO: 1706562 - RNA, 21 nt, Homo sapiens
uuguuuuaugcucagggucaa

SEQ ID NO: 1706563 - RNA, 20 nt, Homo sapiens
uuuaaaaccugugugccauu

SEQ ID NO: 1706564 - RNA, 13 nt, Homo sapiens
uuuaaaagugauc

SEQ ID NO: 1706565 - RNA, 14 nt, Homo sapiens
uuuaaaauaacacu

SEQ ID NO: 1706566 - RNA, 17 nt, Homo sapiens
uuuaaacaaaugugaua

SEQ ID NO: 1706567 - RNA, 12 nt, Homo sapiens
uuuaaacaguga

SEQ ID NO: 1706568 - RNA, 17 nt, Homo sapiens
uuuaaagagcauaauaa

SEQ ID NO: 1706569 - RNA, 18 nt, Homo sapiens
uuuaaaguggguuauucu

SEQ ID NO: 1706570 - RNA, 18 nt, Homo sapiens
uuuaaauguguacaaugu

SEQ ID NO: 1706571 - RNA, 22 nt, Homo sapiens
uuuaagcaaauacuuagcaaaa

SEQ ID NO: 1706572 - RNA, 23 nt, Homo sapiens
uuuaagggcaugccuugugcugu

SEQ ID NO: 1706573 - RNA, 19 nt, Homo sapiens
uuuaagguuuuuacuguga

SEQ ID NO: 1706574 - RNA, 19 nt, Homo sapiens
uuuaaugccgauauacucu

SEQ ID NO: 1706575 - RNA, 23 nt, Homo sapiens
uuuaauggcaauaggacauugug

SEQ ID NO: 1706576 - RNA, 17 nt, Homo sapiens
uuuaauggcaugucaga

SEQ ID NO: 1706577 - RNA, 20 nt, Homo sapiens
uuuacaaaacuacaugagaa

SEQ ID NO: 1706578 - RNA, 15 nt, Homo sapiens
uuuacaaggugacaa

SEQ ID NO: 1706579 - RNA, 23 nt, Homo sapiens
uuuacauguauuuaaaguagcau

SEQ ID NO: 1706580 - RNA, 21 nt, Homo sapiens
uuuacgcuuaguuaucagcuu

SEQ ID NO: 1706581 - RNA, 23 nt, Homo sapiens
uuuagaaaaaaguuuacaacaua

SEQ ID NO: 1706582 - RNA, 20 nt, Homo sapiens
uuuagaaacuccaaugaaag

SEQ ID NO: 1706583 - RNA, 17 nt, Homo sapiens
uuuagaacuguauguca

SEQ ID NO: 1706584 - RNA, 12 nt, Homo sapiens
uuuagggagaac

SEQ ID NO: 1706585 - RNA, 23 nt, Homo sapiens
uuuagucaacaugccauaucuca

SEQ ID NO: 1706586 - RNA, 20 nt, Homo sapiens
uuuaguccagagauagaaua

SEQ ID NO: 1706587 - RNA, 21 nt, Homo sapiens
uuuagugcuuucuugucagug

SEQ ID NO: 1706588 - RNA, 16 nt, Homo sapiens
uuuauaagagcuaaag

SEQ ID NO: 1706589 - RNA, 16 nt, Homo sapiens
uuuauaagagugccgu

SEQ ID NO: 1706590 - RNA, 19 nt, Homo sapiens
uuuauaggacgaaugccaa

SEQ ID NO: 1706591 - RNA, 17 nt, Homo sapiens
uuuauaugcacauuucu

SEQ ID NO: 1706592 - RNA, 19 nt, Homo sapiens
uuuaucacacuucugugag

SEQ ID NO: 1706593 - RNA, 13 nt, Homo sapiens
uuuaucaugaagc

SEQ ID NO: 1706594 - RNA, 14 nt, Homo sapiens
uuuaucuguucuug

SEQ ID NO: 1706595 - RNA, 13 nt, Homo sapiens
uuuaugaguacuu

SEQ ID NO: 1706596 - RNA, 19 nt, Homo sapiens
uuuauggagaccucuccuu

SEQ ID NO: 1706597 - RNA, 23 nt, Homo sapiens
uuuaugguccuaaaagcaaaaua

SEQ ID NO: 1706598 - RNA, 17 nt, Homo sapiens
uuuauuaugcaaccagu

SEQ ID NO: 1706599 - RNA, 15 nt, Homo sapiens
uuuauugaaugcuua

SEQ ID NO: 1706600 - RNA, 15 nt, Homo sapiens
uuuauuuaaagcauu

SEQ ID NO: 1706601 - RNA, 18 nt, Homo sapiens
uuuauuuuguaauuauga

SEQ ID NO: 1706602 - RNA, 20 nt, Homo sapiens
uuuauuuuucauauugugcc

SEQ ID NO: 1706603 - RNA, 19 nt, Homo sapiens
uuuauuuuuguagagccag

SEQ ID NO: 1706604 - RNA, 17 nt, Homo sapiens
uuucaaaauccaaaaag

SEQ ID NO: 1706605 - RNA, 12 nt, Homo sapiens
uuucaacaaaua

SEQ ID NO: 1706606 - RNA, 17 nt, Homo sapiens
uuucaacuaauauaucu

SEQ ID NO: 1706607 - RNA, 22 nt, Homo sapiens
uuucaaggcacucuagauucca

SEQ ID NO: 1706608 - RNA, 15 nt, Homo sapiens
uuucaauuaauauua

SEQ ID NO: 1706609 - RNA, 13 nt, Homo sapiens
uuucacacacaca

SEQ ID NO: 1706610 - RNA, 21 nt, Homo sapiens
uuucacauuguuugcugcuau

SEQ ID NO: 1706611 - RNA, 15 nt, Homo sapiens
uuucacucugucauc

SEQ ID NO: 1706612 - RNA, 15 nt, Homo sapiens
uuucaugcgugugug

SEQ ID NO: 1706613 - RNA, 11 nt, Homo sapiens
uuucauuccau

SEQ ID NO: 1706614 - RNA, 16 nt, Homo sapiens
uuuccaguguuuacaa

SEQ ID NO: 1706615 - RNA, 14 nt, Homo sapiens
uuuccauagucaca

SEQ ID NO: 1706616 - RNA, 12 nt, Homo sapiens
uuucccauuuca

SEQ ID NO: 1706617 - RNA, 12 nt, Homo sapiens
uuuccuuccaga

SEQ ID NO: 1706618 - RNA, 21 nt, Homo sapiens
uuucggaggccccacugaugc

SEQ ID NO: 1706619 - RNA, 13 nt, Homo sapiens
uuucuaaauuccu

SEQ ID NO: 1706620 - RNA, 14 nt, Homo sapiens
uuucuaagauucua

SEQ ID NO: 1706621 - RNA, 21 nt, Homo sapiens
uuucuaguuucuugugggcua

SEQ ID NO: 1706622 - RNA, 15 nt, Homo sapiens
uuucucaaaagcauu

SEQ ID NO: 1706623 - RNA, 16 nt, Homo sapiens
uuucuccaggaccaau

SEQ ID NO: 1706624 - RNA, 22 nt, Homo sapiens
uuucucuccaacucccucuggg

SEQ ID NO: 1706625 - RNA, 15 nt, Homo sapiens
uuucugaaucucugg

SEQ ID NO: 1706626 - RNA, 19 nt, Homo sapiens
uuucugcuaaaaaguccuu

SEQ ID NO: 1706627 - RNA, 23 nt, Homo sapiens
uuucuggggaaagacacugccug

SEQ ID NO: 1706628 - RNA, 19 nt, Homo sapiens
uuucugggguccauucucu

SEQ ID NO: 1706629 - RNA, 21 nt, Homo sapiens
uuucuugacaaaaccuaacuu

SEQ ID NO: 1706630 - RNA, 13 nt, Homo sapiens
uuucuuucugcca

SEQ ID NO: 1706631 - RNA, 22 nt, Homo sapiens
uuugaaccauccacuuacauau

SEQ ID NO: 1706632 - RNA, 23 nt, Homo sapiens
uuugaaccauccacuuacauaua

SEQ ID NO: 1706633 - RNA, 21 nt, Homo sapiens
uuugaauguuaagcagaugga

SEQ ID NO: 1706634 - RNA, 13 nt, Homo sapiens
uuugagaauguuu

SEQ ID NO: 1706635 - RNA, 17 nt, Homo sapiens
uuugagguaaagauaug

SEQ ID NO: 1706636 - RNA, 20 nt, Homo sapiens
auuggccugguauggcugca

SEQ ID NO: 1706637 - RNA, 20 nt, Homo sapiens
auuggcugguaacaguucau

SEQ ID NO: 1706638 - RNA, 15 nt, Homo sapiens
auugggaguccaggc

SEQ ID NO: 1706639 - RNA, 21 nt, Homo sapiens
auugguggggcuggguaccaa

SEQ ID NO: 1706640 - RNA, 13 nt, Homo sapiens
auuguaggugcaa

SEQ ID NO: 1706641 - RNA, 17 nt, Homo sapiens
auugucauaucagcaca

SEQ ID NO: 1706642 - RNA, 22 nt, Homo sapiens
auugucauaucagcacauauuu

SEQ ID NO: 1706643 - RNA, 22 nt, Homo sapiens
auugucgaaaagagucuuccaa

SEQ ID NO: 1706644 - RNA, 20 nt, Homo sapiens
auugucuuuaauuucuguca

SEQ ID NO: 1706645 - RNA, 16 nt, Homo sapiens
auugugcuucacagua

SEQ ID NO: 1706646 - RNA, 12 nt, Homo sapiens
auuguggcugca

SEQ ID NO: 1706647 - RNA, 18 nt, Homo sapiens
auuguggugugagcuuca

SEQ ID NO: 1706648 - RNA, 18 nt, Homo sapiens
auuuaaaagcaucucagc

SEQ ID NO: 1706649 - RNA, 19 nt, Homo sapiens
auuuaaaauaacacuugcc

SEQ ID NO: 1706650 - RNA, 17 nt, Homo sapiens
auuuaaaauugcuaugu

SEQ ID NO: 1706651 - RNA, 18 nt, Homo sapiens
auuuaaacaccuccucau

SEQ ID NO: 1706652 - RNA, 17 nt, Homo sapiens
auuuaaacucaagacaa

SEQ ID NO: 1706653 - RNA, 15 nt, Homo sapiens
auuuaaagccuccuc

SEQ ID NO: 1706654 - RNA, 15 nt, Homo sapiens
auuuaacuacccuua

SEQ ID NO: 1706655 - RNA, 16 nt, Homo sapiens
auuuaauuuccagggu

SEQ ID NO: 1706656 - RNA, 14 nt, Homo sapiens
auuuacgcuuugau

SEQ ID NO: 1706657 - RNA, 20 nt, Homo sapiens
auuuagaaaaaaguuuacaa

SEQ ID NO: 1706658 - RNA, 22 nt, Homo sapiens
auuuagaaaauagagcuuuuaa

SEQ ID NO: 1706659 - RNA, 18 nt, Homo sapiens
auuuagaacuguauguca

SEQ ID NO: 1706660 - RNA, 18 nt, Homo sapiens
auuuagauauaacacuau

SEQ ID NO: 1706661 - RNA, 13 nt, Homo sapiens
auuuauaauugca

SEQ ID NO: 1706662 - RNA, 22 nt, Homo sapiens
auuuauauaugaaaacuauaca

SEQ ID NO: 1706663 - RNA, 14 nt, Homo sapiens
auuuauauguacug

SEQ ID NO: 1706664 - RNA, 13 nt, Homo sapiens
auuuaucauucuu

SEQ ID NO: 1706665 - RNA, 15 nt, Homo sapiens
auuuaugaugcacuu

SEQ ID NO: 1706666 - RNA, 18 nt, Homo sapiens
auuuauuuacaugugauu

SEQ ID NO: 1706667 - RNA, 13 nt, Homo sapiens
auuucaaaacaca

SEQ ID NO: 1706668 - RNA, 20 nt, Homo sapiens
auuucaaaugugcugucaaa

SEQ ID NO: 1706669 - RNA, 22 nt, Homo sapiens
auuucacuagaaaagcugauca

SEQ ID NO: 1706670 - RNA, 14 nt, Homo sapiens
auuuccaacaccac

SEQ ID NO: 1706671 - RNA, 18 nt, Homo sapiens
auuuccaacaccacagac

SEQ ID NO: 1706672 - RNA, 13 nt, Homo sapiens
auuuccacaaaau

SEQ ID NO: 1706673 - RNA, 22 nt, Homo sapiens
auuuccagcuuucuccccgcua

SEQ ID NO: 1706674 - RNA, 15 nt, Homo sapiens
auuucccaucuggac

SEQ ID NO: 1706675 - RNA, 21 nt, Homo sapiens
auuucccuaaaauacauuuaa

SEQ ID NO: 1706676 - RNA, 13 nt, Homo sapiens
auuuccucugggc

SEQ ID NO: 1706677 - RNA, 13 nt, Homo sapiens
auuuccugacaga

SEQ ID NO: 1706678 - RNA, 21 nt, Homo sapiens
auuuccugacagaaggacuca

SEQ ID NO: 1706679 - RNA, 23 nt, Homo sapiens
auuuccugugucuuuuuucacua

SEQ ID NO: 1706680 - RNA, 14 nt, Homo sapiens
auuucuaaucaaaa

SEQ ID NO: 1706681 - RNA, 15 nt, Homo sapiens
auuucuacacagugg

SEQ ID NO: 1706682 - RNA, 20 nt, Homo sapiens
auuucuccguugagucaucu

SEQ ID NO: 1706683 - RNA, 13 nt, Homo sapiens
auuucucuugcaa

SEQ ID NO: 1706684 - RNA, 14 nt, Homo sapiens
auuucugguucuga

SEQ ID NO: 1706685 - RNA, 17 nt, Homo sapiens
auuucugguucugaugc

SEQ ID NO: 1706686 - RNA, 15 nt, Homo sapiens
auuucuugcauucau

SEQ ID NO: 1706687 - RNA, 11 nt, Homo sapiens
auuucuuugcc

SEQ ID NO: 1706688 - RNA, 22 nt, Homo sapiens
auuucuuuucuggccaaaagca

SEQ ID NO: 1706689 - RNA, 22 nt, Homo sapiens
auuugaaaaaaacuucauucuc

SEQ ID NO: 1706690 - RNA, 23 nt, Homo sapiens
auuugaaaaaaacuucauucucg

SEQ ID NO: 1706691 - RNA, 17 nt, Homo sapiens
auuugaagaacauguga

SEQ ID NO: 1706692 - RNA, 15 nt, Homo sapiens
auuugcaacauuuac

SEQ ID NO: 1706693 - RNA, 22 nt, Homo sapiens
auuugccuugcagaacugccau

SEQ ID NO: 1706694 - RNA, 15 nt, Homo sapiens
auuugggaaccaagc

SEQ ID NO: 1706695 - RNA, 20 nt, Homo sapiens
auuugggagggaaaagggaa

SEQ ID NO: 1706696 - RNA, 17 nt, Homo sapiens
auuuggggacagauuca

SEQ ID NO: 1706697 - RNA, 17 nt, Homo sapiens
auuuggggauauuguca

SEQ ID NO: 1706698 - RNA, 20 nt, Homo sapiens
auuuguaguggaaacauuua

SEQ ID NO: 1706699 - RNA, 22 nt, Homo sapiens
caaacuggcugcuuuguucaau

SEQ ID NO: 1706700 - RNA, 19 nt, Homo sapiens
caaacugugaagcauuuac

SEQ ID NO: 1706701 - RNA, 14 nt, Homo sapiens
caaacuuacuauuu

SEQ ID NO: 1706702 - RNA, 20 nt, Homo sapiens
caaagaggacucgcuuguaa

SEQ ID NO: 1706703 - RNA, 14 nt, Homo sapiens
caaagagguauuua

SEQ ID NO: 1706704 - RNA, 16 nt, Homo sapiens
caaagcacaguuugaa

SEQ ID NO: 1706705 - RNA, 18 nt, Homo sapiens
caaagcacaguuugaaca

SEQ ID NO: 1706706 - RNA, 22 nt, Homo sapiens
caaagcugaugacaacuuccca

SEQ ID NO: 1706707 - RNA, 12 nt, Homo sapiens
caaagcuguuaa

SEQ ID NO: 1706708 - RNA, 22 nt, Homo sapiens
caaaggaaauugucaucugcca

SEQ ID NO: 1706709 - RNA, 11 nt, Homo sapiens
caaaguaauag

SEQ ID NO: 1706710 - RNA, 11 nt, Homo sapiens
caaagugcugg

SEQ ID NO: 1706711 - RNA, 15 nt, Homo sapiens
caaaguguauacaug

SEQ ID NO: 1706712 - RNA, 16 nt, Homo sapiens
caaauauauuuuggaa

SEQ ID NO: 1706713 - RNA, 22 nt, Homo sapiens
caaauaucauacuguucaaugg

SEQ ID NO: 1706714 - RNA, 16 nt, Homo sapiens
caaauauuguugacaa

SEQ ID NO: 1706715 - RNA, 19 nt, Homo sapiens
caaaucuggcuccuuuaca

SEQ ID NO: 1706716 - RNA, 20 nt, Homo sapiens
caaaugacaugcacugaccc

SEQ ID NO: 1706717 - RNA, 16 nt, Homo sapiens
caaauggcagaaccaa

SEQ ID NO: 1706718 - RNA, 14 nt, Homo sapiens
caaauguccuccag

SEQ ID NO: 1706719 - RNA, 14 nt, Homo sapiens
caaaugugaagggg

SEQ ID NO: 1706720 - RNA, 18 nt, Homo sapiens
caaauuaagugugcauga

SEQ ID NO: 1706721 - RNA, 15 nt, Homo sapiens
caaauuauaaaaagc

SEQ ID NO: 1706722 - RNA, 19 nt, Homo sapiens
caacaaaccauccagugac

SEQ ID NO: 1706723 - RNA, 20 nt, Homo sapiens
caacaaagaaugggcuugaa

SEQ ID NO: 1706724 - RNA, 19 nt, Homo sapiens
caacaacacaauaacacua

SEQ ID NO: 1706725 - RNA, 15 nt, Homo sapiens
caacaagaccaccac

SEQ ID NO: 1706726 - RNA, 21 nt, Homo sapiens
caacaagauuuccuugugcaa

SEQ ID NO: 1706727 - RNA, 20 nt, Homo sapiens
caacacaugucuagcuuuca

SEQ ID NO: 1706728 - RNA, 12 nt, Homo sapiens
caacacccaaag

SEQ ID NO: 1706729 - RNA, 24 nt, Homo sapiens
caacacucacauuuauucugcuca

SEQ ID NO: 1706730 - RNA, 19 nt, Homo sapiens
caacacuggugugaccuga

SEQ ID NO: 1706731 - RNA, 19 nt, Homo sapiens
caacacuucucacaucuua

SEQ ID NO: 1706732 - RNA, 20 nt, Homo sapiens
caacagagcaagacccaucu

SEQ ID NO: 1706733 - RNA, 22 nt, Homo sapiens
caacagccaugcccgcauuagc

SEQ ID NO: 1706734 - RNA, 23 nt, Homo sapiens
caacaggcuguucugcacugaaa

SEQ ID NO: 1706735 - RNA, 20 nt, Homo sapiens
caacauaacugaaggcauau

SEQ ID NO: 1706736 - RNA, 18 nt, Homo sapiens
caacaugcauauuacauu

SEQ ID NO: 1706737 - RNA, 13 nt, Homo sapiens
caacaugcugccc

SEQ ID NO: 1706738 - RNA, 21 nt, Homo sapiens
caacauggugaaaaccccauc

SEQ ID NO: 1706739 - RNA, 13 nt, Homo sapiens
caacccuaucucc

SEQ ID NO: 1706740 - RNA, 21 nt, Homo sapiens
caaccugcucuccucuugcca

SEQ ID NO: 1706741 - RNA, 23 nt, Homo sapiens
caaccuggucacaggacucugcc

SEQ ID NO: 1706742 - RNA, 21 nt, Homo sapiens
caacuaguagcuaaccaucac

SEQ ID NO: 1706743 - RNA, 20 nt, Homo sapiens
caacuauuuuuccaaaauaa

SEQ ID NO: 1706744 - RNA, 18 nt, Homo sapiens
caacucugagaucuaagg

SEQ ID NO: 1706745 - RNA, 16 nt, Homo sapiens
caacucuucgaagccu

SEQ ID NO: 1706746 - RNA, 12 nt, Homo sapiens
caacugacacag

SEQ ID NO: 1706747 - RNA, 20 nt, Homo sapiens
caacugaguguuauuugcac

SEQ ID NO: 1706748 - RNA, 20 nt, Homo sapiens
caacugccggggguucaggg

SEQ ID NO: 1706749 - RNA, 18 nt, Homo sapiens
caacugccugccuuaggg

SEQ ID NO: 1706750 - RNA, 15 nt, Homo sapiens
caacugcgacuguga

SEQ ID NO: 1706751 - RNA, 19 nt, Homo sapiens
caacugggucugacaugaa

SEQ ID NO: 1706752 - RNA, 13 nt, Homo sapiens
caacugugacugu

SEQ ID NO: 1706753 - RNA, 16 nt, Homo sapiens
caacuugagggcccag

SEQ ID NO: 1706754 - RNA, 19 nt, Homo sapiens
caacuugguucugcuucaa

SEQ ID NO: 1706755 - RNA, 15 nt, Homo sapiens
caagaaaacaacuuc

SEQ ID NO: 1706756 - RNA, 14 nt, Homo sapiens
caagaaacacuuuc

SEQ ID NO: 1706757 - RNA, 22 nt, Homo sapiens
caagaauaccaagacaaauuca

SEQ ID NO: 1706758 - RNA, 18 nt, Homo sapiens
caagacacaucccuacaa

SEQ ID NO: 1706759 - RNA, 14 nt, Homo sapiens
caagacccaucuca

SEQ ID NO: 1706760 - RNA, 13 nt, Homo sapiens
caagacugaaaca

SEQ ID NO: 1706761 - RNA, 19 nt, Homo sapiens
caagacuuccucaugaauc

SEQ ID NO: 1706762 - RNA, 16 nt, Homo sapiens
caagagggauaaaaca

SEQ ID NO: 1706763 - RNA, 22 nt, Homo sapiens
caagaggguccuuuaguaccug

SEQ ID NO: 1706764 - RNA, 17 nt, Homo sapiens
caagaucaaaaauuaga

SEQ ID NO: 1706765 - RNA, 15 nt, Homo sapiens
caagcaggagacgac

SEQ ID NO: 1706766 - RNA, 13 nt, Homo sapiens
caagcuaaccuua

SEQ ID NO: 1706767 - RNA, 17 nt, Homo sapiens
caagcucccugccccaa

SEQ ID NO: 1706768 - RNA, 21 nt, Homo sapiens
caagcugugacuucuccaggu

SEQ ID NO: 1706769 - RNA, 18 nt, Homo sapiens
caagcuuguuaucagcuu

SEQ ID NO: 1706770 - RNA, 19 nt, Homo sapiens
caaggaacaaaaaaaccac

SEQ ID NO: 1706771 - RNA, 19 nt, Homo sapiens
caaggaguacaaugcccag

SEQ ID NO: 1706772 - RNA, 14 nt, Homo sapiens
caaggcugcaguga

SEQ ID NO: 1706773 - RNA, 18 nt, Homo sapiens
caagggcacgugaaguca

SEQ ID NO: 1706774 - RNA, 16 nt, Homo sapiens
caaggggugggccaca

SEQ ID NO: 1706775 - RNA, 20 nt, Homo sapiens
caaggguucuuggugaugcu

SEQ ID NO: 1706776 - RNA, 15 nt, Homo sapiens
caaggucauuucuuc

SEQ ID NO: 1706777 - RNA, 12 nt, Homo sapiens
caaggugacaaa

SEQ ID NO: 1706778 - RNA, 19 nt, Homo sapiens
caaguagaggcaaugcaaa

SEQ ID NO: 1706779 - RNA, 21 nt, Homo sapiens
caaguauguugagaguugcug

SEQ ID NO: 1706780 - RNA, 15 nt, Homo sapiens
caagucuuccaugac

SEQ ID NO: 1706781 - RNA, 16 nt, Homo sapiens
caagugaaaucaaagg

SEQ ID NO: 1706782 - RNA, 19 nt, Homo sapiens
caagugcucaucuguugua

SEQ ID NO: 1706783 - RNA, 22 nt, Homo sapiens
caaguggaccuuaggccuuccu

SEQ ID NO: 1706784 - RNA, 14 nt, Homo sapiens
caagugugucuuac

SEQ ID NO: 1706785 - RNA, 23 nt, Homo sapiens
caaguucauugaugacccucuga

SEQ ID NO: 1706786 - RNA, 23 nt, Homo sapiens
caaguuccaugggauacaaccuc

SEQ ID NO: 1706787 - RNA, 20 nt, Homo sapiens
caaguuguaacuuauauuga

SEQ ID NO: 1706788 - RNA, 13 nt, Homo sapiens
caaguuuccauag

SEQ ID NO: 1706789 - RNA, 18 nt, Homo sapiens
caauaaaccuccgccaau

SEQ ID NO: 1706790 - RNA, 14 nt, Homo sapiens
caauaacacugucu

SEQ ID NO: 1706791 - RNA, 15 nt, Homo sapiens
caauaagcaaaaaca

SEQ ID NO: 1706792 - RNA, 15 nt, Homo sapiens
caauaggcauuugau

SEQ ID NO: 1706793 - RNA, 14 nt, Homo sapiens
caaucagcacugaa

SEQ ID NO: 1706794 - RNA, 17 nt, Homo sapiens
caaucaugaaauaugca

SEQ ID NO: 1706795 - RNA, 15 nt, Homo sapiens
caauccccagcccuu

SEQ ID NO: 1706796 - RNA, 15 nt, Homo sapiens
caaucuauguuugca

SEQ ID NO: 1706797 - RNA, 21 nt, Homo sapiens
caaucugagccagugcuuuaa

SEQ ID NO: 1706798 - RNA, 17 nt, Homo sapiens
caaugaaagacacuguu

SEQ ID NO: 1706799 - RNA, 14 nt, Homo sapiens
caaugacaucucag

SEQ ID NO: 1706800 - RNA, 21 nt, Homo sapiens
caaugacaucucaggggccag

SEQ ID NO: 1706801 - RNA, 12 nt, Homo sapiens
caaugaugcccu

SEQ ID NO: 1706802 - RNA, 19 nt, Homo sapiens
caaugcaaagauucacaua

SEQ ID NO: 1706803 - RNA, 17 nt, Homo sapiens
caaugcacauccauucc

SEQ ID NO: 1706804 - RNA, 15 nt, Homo sapiens
caaugcccagaucaa

SEQ ID NO: 1706805 - RNA, 17 nt, Homo sapiens
caaugcgcaaaaugcag

SEQ ID NO: 1706806 - RNA, 21 nt, Homo sapiens
caaugcugcaggucaacagcu

SEQ ID NO: 1706807 - RNA, 18 nt, Homo sapiens
caaugcuggcuuucuccc

SEQ ID NO: 1706808 - RNA, 18 nt, Homo sapiens
cccucugggaaggugacc

SEQ ID NO: 1706809 - RNA, 20 nt, Homo sapiens
cccugaccucacugugaccu

SEQ ID NO: 1706810 - RNA, 19 nt, Homo sapiens
cccugagcaggaaaguuua

SEQ ID NO: 1706811 - RNA, 16 nt, Homo sapiens
cccugaguucauccag

SEQ ID NO: 1706812 - RNA, 17 nt, Homo sapiens
cccugcaaacagaacag

SEQ ID NO: 1706813 - RNA, 18 nt, Homo sapiens
cccugcagggccaagcac

SEQ ID NO: 1706814 - RNA, 17 nt, Homo sapiens
cccugcauuucugaguu

SEQ ID NO: 1706815 - RNA, 15 nt, Homo sapiens
cccugccaugucaca

SEQ ID NO: 1706816 - RNA, 14 nt, Homo sapiens
cccugcuccugcag

SEQ ID NO: 1706817 - RNA, 20 nt, Homo sapiens
cccuguguccaccugugggu

SEQ ID NO: 1706818 - RNA, 17 nt, Homo sapiens
cccuuagccucccugaa

SEQ ID NO: 1706819 - RNA, 20 nt, Homo sapiens
cccuucaguacccucucagc

SEQ ID NO: 1706820 - RNA, 21 nt, Homo sapiens
cccuuccacugccucugccuu

SEQ ID NO: 1706821 - RNA, 21 nt, Homo sapiens
cccuuccaugucgccucugca

SEQ ID NO: 1706822 - RNA, 15 nt, Homo sapiens
cccuucccugcacua

SEQ ID NO: 1706823 - RNA, 14 nt, Homo sapiens
cccuucccuuccac

SEQ ID NO: 1706824 - RNA, 14 nt, Homo sapiens
cccuucggcagcua

SEQ ID NO: 1706825 - RNA, 17 nt, Homo sapiens
cccuucuuuacuuccca

SEQ ID NO: 1706826 - RNA, 13 nt, Homo sapiens
cccuugcagcuag

SEQ ID NO: 1706827 - RNA, 23 nt, Homo sapiens
cccuugccauccuaaaagccacc

SEQ ID NO: 1706828 - RNA, 16 nt, Homo sapiens
cccuuggagccaaugg

SEQ ID NO: 1706829 - RNA, 19 nt, Homo sapiens
cccuuugaagccucagcua

SEQ ID NO: 1706830 - RNA, 23 nt, Homo sapiens
cccuuuugggccuagaauucuga

SEQ ID NO: 1706831 - RNA, 22 nt, Homo sapiens
ccgaaggugcuggaggugggag

SEQ ID NO: 1706832 - RNA, 17 nt, Homo sapiens
ccgaauagcugggacua

SEQ ID NO: 1706833 - RNA, 21 nt, Homo sapiens
ccgacugccgcugagaagggu

SEQ ID NO: 1706834 - RNA, 15 nt, Homo sapiens
ccgagucucuucucc

SEQ ID NO: 1706835 - RNA, 19 nt, Homo sapiens
ccgauauacucuagaugaa

SEQ ID NO: 1706836 - RNA, 16 nt, Homo sapiens
ccgaugaacaaguuua

SEQ ID NO: 1706837 - RNA, 17 nt, Homo sapiens
ccgauguggaccucuac

SEQ ID NO: 1706838 - RNA, 18 nt, Homo sapiens
ccgauucccaacugagug

SEQ ID NO: 1706839 - RNA, 18 nt, Homo sapiens
ccgauuugggaaccaagc

SEQ ID NO: 1706840 - RNA, 12 nt, Homo sapiens
ccgcacuuccuu

SEQ ID NO: 1706841 - RNA, 14 nt, Homo sapiens
ccgcagaauggacu

SEQ ID NO: 1706842 - RNA, 20 nt, Homo sapiens
ccgcaggcagacuacacagg

SEQ ID NO: 1706843 - RNA, 21 nt, Homo sapiens
ccgccauugccaccaggagaa

SEQ ID NO: 1706844 - RNA, 16 nt, Homo sapiens
ccgcugcgggcccacg

SEQ ID NO: 1706845 - RNA, 21 nt, Homo sapiens
ccgcuuugagucccccagaga

SEQ ID NO: 1706846 - RNA, 13 nt, Homo sapiens
ccggaggucauga

SEQ ID NO: 1706847 - RNA, 18 nt, Homo sapiens
ccggcaggcccugcagug

SEQ ID NO: 1706848 - RNA, 17 nt, Homo sapiens
ccgggugugguggcaca

SEQ ID NO: 1706849 - RNA, 17 nt, Homo sapiens
ccggugcaugaugcugc

SEQ ID NO: 1706850 - RNA, 17 nt, Homo sapiens
ccguaacaacugugguc

SEQ ID NO: 1706851 - RNA, 18 nt, Homo sapiens
ccguaacaacugugguca

SEQ ID NO: 1706852 - RNA, 12 nt, Homo sapiens
ccguacauucaa

SEQ ID NO: 1706853 - RNA, 17 nt, Homo sapiens
ccgucgaggggcucuca

SEQ ID NO: 1706854 - RNA, 20 nt, Homo sapiens
ccgugugagugugacagggc

SEQ ID NO: 1706855 - RNA, 23 nt, Homo sapiens
ccguguugcaugaaggagcagca

SEQ ID NO: 1706856 - RNA, 21 nt, Homo sapiens
ccuaaaagccaccccacuucu

SEQ ID NO: 1706857 - RNA, 19 nt, Homo sapiens
ccuaaaagugggcuugauu

SEQ ID NO: 1706858 - RNA, 17 nt, Homo sapiens
ccuaaacuguacaugug

SEQ ID NO: 1706859 - RNA, 22 nt, Homo sapiens
ccuaaaucugccuuuucaucua

SEQ ID NO: 1706860 - RNA, 11 nt, Homo sapiens
ccuaacacagu

SEQ ID NO: 1706861 - RNA, 15 nt, Homo sapiens
ccuaaccccuuccag

SEQ ID NO: 1706862 - RNA, 18 nt, Homo sapiens
ccuaagacacaaaugcau

SEQ ID NO: 1706863 - RNA, 22 nt, Homo sapiens
ccuaauaaacauccuucaagaa

SEQ ID NO: 1706864 - RNA, 14 nt, Homo sapiens
ccuacaagauuuag

SEQ ID NO: 1706865 - RNA, 16 nt, Homo sapiens
ccuacaggcagucucu

SEQ ID NO: 1706866 - RNA, 15 nt, Homo sapiens
ccuaccaaaauggaa

SEQ ID NO: 1706867 - RNA, 20 nt, Homo sapiens
ccuaccccuggcuguacugc

SEQ ID NO: 1706868 - RNA, 15 nt, Homo sapiens
ccuacguauccugca

SEQ ID NO: 1706869 - RNA, 16 nt, Homo sapiens
ccuacuacaugcaagg

SEQ ID NO: 1706870 - RNA, 14 nt, Homo sapiens
ccuacucuguguca

SEQ ID NO: 1706871 - RNA, 16 nt, Homo sapiens
ccuacuucuuuugcuc

SEQ ID NO: 1706872 - RNA, 17 nt, Homo sapiens
ccuagaacacuaacuca

SEQ ID NO: 1706873 - RNA, 16 nt, Homo sapiens
ccuaggaacucagucc

SEQ ID NO: 1706874 - RNA, 22 nt, Homo sapiens
ccuaguacugccccccaugagg

SEQ ID NO: 1706875 - RNA, 13 nt, Homo sapiens
ccuauaaauauua

SEQ ID NO: 1706876 - RNA, 14 nt, Homo sapiens
ccuauaaucuguca

SEQ ID NO: 1706877 - RNA, 19 nt, Homo sapiens
ccuauauguaguauaaaga

SEQ ID NO: 1706878 - RNA, 14 nt, Homo sapiens
ccuaucacugauag

SEQ ID NO: 1706879 - RNA, 14 nt, Homo sapiens
ccuaugcacauaug

SEQ ID NO: 1706880 - RNA, 16 nt, Homo sapiens
ccuaugcacauaugga

SEQ ID NO: 1706881 - RNA, 19 nt, Homo sapiens
ccuauuuagaaauggauuu

SEQ ID NO: 1706882 - RNA, 20 nt, Homo sapiens
ccuauuuccauucaacaaga

SEQ ID NO: 1706883 - RNA, 18 nt, Homo sapiens
ccucaagggccaggacuu

SEQ ID NO: 1706884 - RNA, 20 nt, Homo sapiens
ccucacagagugcauuguga

SEQ ID NO: 1706885 - RNA, 15 nt, Homo sapiens
ccucacugauauauu

SEQ ID NO: 1706886 - RNA, 20 nt, Homo sapiens
ccucagguggccccaguuca

SEQ ID NO: 1706887 - RNA, 21 nt, Homo sapiens
ccuuugaaaccugcucuguag

SEQ ID NO: 1706888 - RNA, 13 nt, Homo sapiens
ccuuugcaaauca

SEQ ID NO: 1706889 - RNA, 22 nt, Homo sapiens
ccuuugggccucugcuucucuc

SEQ ID NO: 1706890 - RNA, 19 nt, Homo sapiens
ccuuuguguagaaagccaa

SEQ ID NO: 1706891 - RNA, 22 nt, Homo sapiens
ccuuuguguauuuuucaauaau

SEQ ID NO: 1706892 - RNA, 13 nt, Homo sapiens
ccuuuguugcaca

SEQ ID NO: 1706893 - RNA, 14 nt, Homo sapiens
ccuuuuauaccugc

SEQ ID NO: 1706894 - RNA, 23 nt, Homo sapiens
ccuuuuauuuuuuaagguaacaa

SEQ ID NO: 1706895 - RNA, 21 nt, Homo sapiens
ccuuuucuauuccuucuggcc

SEQ ID NO: 1706896 - RNA, 13 nt, Homo sapiens
ccuuuuguauaca

SEQ ID NO: 1706897 - RNA, 19 nt, Homo sapiens
ccuuuugucuucucugucu

SEQ ID NO: 1706898 - RNA, 15 nt, Homo sapiens
ccuuuuuaaaacaca

SEQ ID NO: 1706899 - RNA, 22 nt, Homo sapiens
ccuuuuuauuuauauguacugu

SEQ ID NO: 1706900 - RNA, 17 nt, Homo sapiens
ccuuuuuuauuccauaa

SEQ ID NO: 1706901 - RNA, 20 nt, Homo sapiens
cgaaaauucauuucacauua

SEQ ID NO: 1706902 - RNA, 15 nt, Homo sapiens
cgaaacuuguuauug

SEQ ID NO: 1706903 - RNA, 14 nt, Homo sapiens
cgaaguagcuugcu

SEQ ID NO: 1706904 - RNA, 23 nt, Homo sapiens
cgaaucuuccgauggaugaaucu

SEQ ID NO: 1706905 - RNA, 20 nt, Homo sapiens
cgacaucuuggcguggcagc

SEQ ID NO: 1706906 - RNA, 18 nt, Homo sapiens
cgaccccuaguucccucu

SEQ ID NO: 1706907 - RNA, 18 nt, Homo sapiens
cgaccgcccccuccucua

SEQ ID NO: 1706908 - RNA, 22 nt, Homo sapiens
cgaccuaauugucuuuguucug

SEQ ID NO: 1706909 - RNA, 17 nt, Homo sapiens
cgacuaauuucaaaaug

SEQ ID NO: 1706910 - RNA, 14 nt, Homo sapiens
cgacugaaacugga

SEQ ID NO: 1706911 - RNA, 21 nt, Homo sapiens
cgagaucacgucacugcacuc

SEQ ID NO: 1706912 - RNA, 18 nt, Homo sapiens
cgagcuccagagcaacga

SEQ ID NO: 1706913 - RNA, 19 nt, Homo sapiens
cgaggacagggaggugacc

SEQ ID NO: 1706914 - RNA, 16 nt, Homo sapiens
caaugucugcugagga

SEQ ID NO: 1706915 - RNA, 21 nt, Homo sapiens
caauguguggcucagugccug

SEQ ID NO: 1706916 - RNA, 15 nt, Homo sapiens
caauguuuaugcaag

SEQ ID NO: 1706917 - RNA, 23 nt, Homo sapiens
caauuccuucuucaacgccaucu

SEQ ID NO: 1706918 - RNA, 23 nt, Homo sapiens
caauugagaaaaauauauacuaa

SEQ ID NO: 1706919 - RNA, 22 nt, Homo sapiens
caauuguugacaguucugaaga

SEQ ID NO: 1706920 - RNA, 14 nt, Homo sapiens
caauuuacacugcc

SEQ ID NO: 1706921 - RNA, 10 nt, Homo sapiens
caauuucacu

SEQ ID NO: 1706922 - RNA, 12 nt, Homo sapiens
caauuuuuccau

SEQ ID NO: 1706923 - RNA, 16 nt, Homo sapiens
cacaaaaucuguccaa

SEQ ID NO: 1706924 - RNA, 23 nt, Homo sapiens
cacaaaggguugggagcugauga

SEQ ID NO: 1706925 - RNA, 18 nt, Homo sapiens
cacaaauuuguaaacuuu

SEQ ID NO: 1706926 - RNA, 14 nt, Homo sapiens
cacaacccaagaau

SEQ ID NO: 1706927 - RNA, 23 nt, Homo sapiens
cacaagaggaauaagaauggagc

SEQ ID NO: 1706928 - RNA, 19 nt, Homo sapiens
cacaauaugggcacuuuaa

SEQ ID NO: 1706929 - RNA, 15 nt, Homo sapiens
cacacaaggugcaaa

SEQ ID NO: 1706930 - RNA, 16 nt, Homo sapiens
cacacaaggugcaaau

SEQ ID NO: 1706931 - RNA, 18 nt, Homo sapiens
cacacacaugaguguaga

SEQ ID NO: 1706932 - RNA, 21 nt, Homo sapiens
cacacacccagcuugugccug

SEQ ID NO: 1706933 - RNA, 15 nt, Homo sapiens
cacacaucuaugaua

SEQ ID NO: 1706934 - RNA, 14 nt, Homo sapiens
cacacaugcacaca

SEQ ID NO: 1706935 - RNA, 18 nt, Homo sapiens
cacacaugcuaggaugcg

SEQ ID NO: 1706936 - RNA, 21 nt, Homo sapiens
cacaccagucacaugaccuga

SEQ ID NO: 1706937 - RNA, 22 nt, Homo sapiens
cacacccagcccacuucugcca

SEQ ID NO: 1706938 - RNA, 13 nt, Homo sapiens
cacacccagccuc

SEQ ID NO: 1706939 - RNA, 18 nt, Homo sapiens
cacacccucacucugcca

SEQ ID NO: 1706940 - RNA, 17 nt, Homo sapiens
cacacguuugugagcuc

SEQ ID NO: 1706941 - RNA, 14 nt, Homo sapiens
cacacugguacuua

SEQ ID NO: 1706942 - RNA, 14 nt, Homo sapiens
cacagaaacacugc

SEQ ID NO: 1706943 - RNA, 20 nt, Homo sapiens
cacagaaauauauauacaua

SEQ ID NO: 1706944 - RNA, 16 nt, Homo sapiens
cacagaaauuuucaau

SEQ ID NO: 1706945 - RNA, 19 nt, Homo sapiens
cacagaaggaauaagguca

SEQ ID NO: 1706946 - RNA, 23 nt, Homo sapiens
cacagagugcauugugaggguua

SEQ ID NO: 1706947 - RNA, 22 nt, Homo sapiens
cacagcagguccuccaucccaa

SEQ ID NO: 1706948 - RNA, 20 nt, Homo sapiens
cacagcugaguuaugaugua

SEQ ID NO: 1706949 - RNA, 20 nt, Homo sapiens
cacagcuucauuuccugugu

SEQ ID NO: 1706950 - RNA, 22 nt, Homo sapiens
cacaggaaaccaacacccaaag

SEQ ID NO: 1706951 - RNA, 18 nt, Homo sapiens
cacaggacaacuuuacaa

SEQ ID NO: 1706952 - RNA, 22 nt, Homo sapiens
cacaggagacacugugcuauaa

SEQ ID NO: 1706953 - RNA, 14 nt, Homo sapiens
cacaggauuuguaa

SEQ ID NO: 1706954 - RNA, 14 nt, Homo sapiens
cacaggcccggcuc

SEQ ID NO: 1706955 - RNA, 23 nt, Homo sapiens
cacaguauuacuucugcuacaua

SEQ ID NO: 1706956 - RNA, 20 nt, Homo sapiens
cacagucacugauguacaau

SEQ ID NO: 1706957 - RNA, 18 nt, Homo sapiens
cacaguccaggaacaagc

SEQ ID NO: 1706958 - RNA, 22 nt, Homo sapiens
cacagugagucgaggacaggga

SEQ ID NO: 1706959 - RNA, 13 nt, Homo sapiens
cacagugcaucuc

SEQ ID NO: 1706960 - RNA, 23 nt, Homo sapiens
cacaguuuauuuuuauacuuuca

SEQ ID NO: 1706961 - RNA, 19 nt, Homo sapiens
cacauagauuaauggcacu

SEQ ID NO: 1706962 - RNA, 18 nt, Homo sapiens
cacauccauucccaagaa

SEQ ID NO: 1706963 - RNA, 21 nt, Homo sapiens
cacauccgccuuuuguauaca

SEQ ID NO: 1706964 - RNA, 23 nt, Homo sapiens
cacaugaaucccacccacaugug

SEQ ID NO: 1706965 - RNA, 15 nt, Homo sapiens
cacaugacacccgug

SEQ ID NO: 1706966 - RNA, 21 nt, Homo sapiens
cacaugaucuguuuuucacca

SEQ ID NO: 1706967 - RNA, 15 nt, Homo sapiens
cacaugugacacaua

SEQ ID NO: 1706968 - RNA, 20 nt, Homo sapiens
cacaugugacacauaugcac

SEQ ID NO: 1706969 - RNA, 14 nt, Homo sapiens
cacaugugcacaug

SEQ ID NO: 1706970 - RNA, 22 nt, Homo sapiens
cacauuaucaguugacagugua

SEQ ID NO: 1706971 - RNA, 19 nt, Homo sapiens
cacauucaugugggcauuu

SEQ ID NO: 1706972 - RNA, 21 nt, Homo sapiens
cacauugcauucuauugccuu

SEQ ID NO: 1706973 - RNA, 20 nt, Homo sapiens
cacauuucaccccaggcuca

SEQ ID NO: 1706974 - RNA, 15 nt, Homo sapiens
caccaaagacaguug

SEQ ID NO: 1706975 - RNA, 20 nt, Homo sapiens
caccaaagccaccucuguca

SEQ ID NO: 1706976 - RNA, 13 nt, Homo sapiens
caccaaagcugcc

SEQ ID NO: 1706977 - RNA, 14 nt, Homo sapiens
gacauaaagccaug

SEQ ID NO: 1706978 - RNA, 19 nt, Homo sapiens
gacauaaagccauguuucc

SEQ ID NO: 1706979 - RNA, 13 nt, Homo sapiens
gacauaacauuuu

SEQ ID NO: 1706980 - RNA, 19 nt, Homo sapiens
gacauacauuuaugcacau

SEQ ID NO: 1706981 - RNA, 18 nt, Homo sapiens
gacaucggccuccaugac

SEQ ID NO: 1706982 - RNA, 14 nt, Homo sapiens
gacaugcacuauga

SEQ ID NO: 1706983 - RNA, 14 nt, Homo sapiens
gacaugcacugacc

SEQ ID NO: 1706984 - RNA, 14 nt, Homo sapiens
gacauggagguucu

SEQ ID NO: 1706985 - RNA, 18 nt, Homo sapiens
gaccaacuguguuguauu

SEQ ID NO: 1706986 - RNA, 23 nt, Homo sapiens
gaccaccaccccaacaaaccauc

SEQ ID NO: 1706987 - RNA, 24 nt, Homo sapiens
gaccacugggcaaugauggcaauu

SEQ ID NO: 1706988 - RNA, 17 nt, Homo sapiens
gaccacuuccaggggaa

SEQ ID NO: 1706989 - RNA, 19 nt, Homo sapiens
gacccccgcaaguuugcac

SEQ ID NO: 1706990 - RNA, 23 nt, Homo sapiens
gaccccuucccuguccuugcccu

SEQ ID NO: 1706991 - RNA, 23 nt, Homo sapiens
gaccccuucggcagcuacucaga

SEQ ID NO: 1706992 - RNA, 20 nt, Homo sapiens
gacccucugacccuagcucu

SEQ ID NO: 1706993 - RNA, 17 nt, Homo sapiens
gacccugauacaggcau

SEQ ID NO: 1706994 - RNA, 22 nt, Homo sapiens
gaccucacugugaccuugacuu

SEQ ID NO: 1706995 - RNA, 11 nt, Homo sapiens
gaccucaggug

SEQ ID NO: 1706996 - RNA, 22 nt, Homo sapiens
gaccucaggugauccacccacc

SEQ ID NO: 1706997 - RNA, 23 nt, Homo sapiens
gaccuccccagccccuagcccag

SEQ ID NO: 1706998 - RNA, 19 nt, Homo sapiens
gaccugccucucacacaca

SEQ ID NO: 1706999 - RNA, 17 nt, Homo sapiens
gaccuggagaugcugcc

SEQ ID NO: 1707000 - RNA, 14 nt, Homo sapiens
gaccuggugcugag

SEQ ID NO: 1707001 - RNA, 18 nt, Homo sapiens
gaccuuggaucagaugaa

SEQ ID NO: 1707002 - RNA, 23 nt, Homo sapiens
gaccuuuuuuuuuuuaauggcaa

SEQ ID NO: 1707003 - RNA, 21 nt, Homo sapiens
gacggcccucaucuaugagga

SEQ ID NO: 1707004 - RNA, 15 nt, Homo sapiens
gacguaaucuccaca

SEQ ID NO: 1707005 - RNA, 19 nt, Homo sapiens
gacgucagacuuggcucag

SEQ ID NO: 1707006 - RNA, 23 nt, Homo sapiens
gacuaaauuuggggacagauuca

SEQ ID NO: 1707007 - RNA, 23 nt, Homo sapiens
gacuaagccuaccugcucuccaa

SEQ ID NO: 1707008 - RNA, 12 nt, Homo sapiens
gacuacaaccaa

SEQ ID NO: 1707009 - RNA, 14 nt, Homo sapiens
gacuacacaggaug

SEQ ID NO: 1707010 - RNA, 12 nt, Homo sapiens
gacuacaggugu

SEQ ID NO: 1707011 - RNA, 12 nt, Homo sapiens
gacucaaugcac

SEQ ID NO: 1707012 - RNA, 17 nt, Homo sapiens
gacucaaugcacugaca

SEQ ID NO: 1707013 - RNA, 12 nt, Homo sapiens
gacuccaagaac

SEQ ID NO: 1707014 - RNA, 22 nt, Homo sapiens
gacuccuaccugcccuggaaca

SEQ ID NO: 1707015 - RNA, 14 nt, Homo sapiens
gacucugcacaugu

SEQ ID NO: 1707016 - RNA, 16 nt, Homo sapiens
gacucugcacaugucu

SEQ ID NO: 1707017 - RNA, 20 nt, Homo sapiens
gacucuggaggccugugccu

SEQ ID NO: 1707018 - RNA, 22 nt, Homo sapiens
gacucuguaacaucacuaucca

SEQ ID NO: 1707019 - RNA, 20 nt, Homo sapiens
gacugaagugaacuaugaag

SEQ ID NO: 1707020 - RNA, 14 nt, Homo sapiens
gacugauguguaua

SEQ ID NO: 1707021 - RNA, 21 nt, Homo sapiens
gacugcaacaggcuugugcaa

SEQ ID NO: 1707022 - RNA, 21 nt, Homo sapiens
gacuguccucuccccuccagc

SEQ ID NO: 1707023 - RNA, 16 nt, Homo sapiens
gacugucucacuuaau

SEQ ID NO: 1707024 - RNA, 16 nt, Homo sapiens
gacuguugccacuuaa

SEQ ID NO: 1707025 - RNA, 14 nt, Homo sapiens
gacuuaaugugauu

SEQ ID NO: 1707026 - RNA, 20 nt, Homo sapiens
gacuucaugacaagcauuuu

SEQ ID NO: 1707027 - RNA, 19 nt, Homo sapiens
gacuuccauuugcuuuguc

SEQ ID NO: 1707028 - RNA, 17 nt, Homo sapiens
gacuuccuuacuaagca

SEQ ID NO: 1707029 - RNA, 18 nt, Homo sapiens
gacuuguuugucuuccau

SEQ ID NO: 1707030 - RNA, 18 nt, Homo sapiens
gacuuucaguaaacauaa

SEQ ID NO: 1707031 - RNA, 13 nt, Homo sapiens
gacuuugcugauu

SEQ ID NO: 1707032 - RNA, 17 nt, Homo sapiens
gagaaaagccucuccag

SEQ ID NO: 1707033 - RNA, 22 nt, Homo sapiens
gagaagccuucagcuccaggga

SEQ ID NO: 1707034 - RNA, 20 nt, Homo sapiens
gagaagcggauuuccaggga

SEQ ID NO: 1707035 - RNA, 16 nt, Homo sapiens
gagaaggugcagguga

SEQ ID NO: 1707036 - RNA, 14 nt, Homo sapiens
gagacaaaagcagu

SEQ ID NO: 1707037 - RNA, 15 nt, Homo sapiens
gagacacugugcuau

SEQ ID NO: 1707038 - RNA, 14 nt, Homo sapiens
gagacaguucaaga

SEQ ID NO: 1707039 - RNA, 18 nt, Homo sapiens
gagacucuaggguccagu

SEQ ID NO: 1707040 - RNA, 16 nt, Homo sapiens
gagacugucccugaaa

SEQ ID NO: 1707041 - RNA, 21 nt, Homo sapiens
gagacugucucaagagggcac

SEQ ID NO: 1707042 - RNA, 20 nt, Homo sapiens
gagagauggagaagcuagaa

SEQ ID NO: 1707043 - RNA, 22 nt, Homo sapiens
gagagaugggagcuccucuccu

SEQ ID NO: 1707044 - RNA, 20 nt, Homo sapiens
gagaggaacacaggcgcuga

SEQ ID NO: 1707045 - RNA, 13 nt, Homo sapiens
gagaggagccaga

SEQ ID NO: 1707046 - RNA, 15 nt, Homo sapiens
gagaggaugugcaag

SEQ ID NO: 1707047 - RNA, 21 nt, Homo sapiens
gagaguauuuuagaaacucca

SEQ ID NO: 1707048 - RNA, 12 nt, Homo sapiens
gagaguccugug

SEQ ID NO: 1707049 - RNA, 16 nt, Homo sapiens
gagaguggcuccuccc

SEQ ID NO: 1707050 - RNA, 20 nt, Homo sapiens
gagaucacgucacugcacuc

SEQ ID NO: 1707051 - RNA, 15 nt, Homo sapiens
gagaugggaaggcac

SEQ ID NO: 1707052 - RNA, 20 nt, Homo sapiens
gagauugagcagaagaucaa

SEQ ID NO: 1707053 - RNA, 16 nt, Homo sapiens
gagauuucaugccugg

SEQ ID NO: 1707054 - RNA, 23 nt, Homo sapiens
gagauuuguaggaaggucucauu

SEQ ID NO: 1707055 - RNA, 22 nt, Homo sapiens
gagcaaauaucauacuguucaa

SEQ ID NO: 1707056 - RNA, 13 nt, Homo sapiens
gagcaagacucca

SEQ ID NO: 1707057 - RNA, 17 nt, Homo sapiens
gagcagaagaucaagga

SEQ ID NO: 1707058 - RNA, 12 nt, Homo sapiens
gagcagccugug

SEQ ID NO: 1707059 - RNA, 22 nt, Homo sapiens
gagcagcuuuaaacucagggac

SEQ ID NO: 1707060 - RNA, 15 nt, Homo sapiens
gagcaggaacaauga

SEQ ID NO: 1707061 - RNA, 13 nt, Homo sapiens
gagcaggacucac

SEQ ID NO: 1707062 - RNA, 13 nt, Homo sapiens
gagcaguccaugc

SEQ ID NO: 1707063 - RNA, 17 nt, Homo sapiens
gagcaguccugccucag

SEQ ID NO: 1707064 - RNA, 22 nt, Homo sapiens
gagcaucccccaaaguucacaa

SEQ ID NO: 1707065 - RNA, 12 nt, Homo sapiens
gagcauuuccaa

SEQ ID NO: 1707066 - RNA, 19 nt, Homo sapiens
gagccaccugacucuugca

SEQ ID NO: 1707067 - RNA, 12 nt, Homo sapiens
gagccagacaga

SEQ ID NO: 1707068 - RNA, 20 nt, Homo sapiens
gagccagcuuggggccacca

SEQ ID NO: 1707069 - RNA, 18 nt, Homo sapiens
gagccauauaaguuugaa

SEQ ID NO: 1707070 - RNA, 15 nt, Homo sapiens
gagccaugcugggaa

SEQ ID NO: 1707071 - RNA, 14 nt, Homo sapiens
gagcccccuugaca

SEQ ID NO: 1707072 - RNA, 20 nt, Homo sapiens
gagcccuaaaaauccagacu

SEQ ID NO: 1707073 - RNA, 18 nt, Homo sapiens
gagccgugaacugugcau

SEQ ID NO: 1707074 - RNA, 22 nt, Homo sapiens
gagccucccaaggagaacaaau

SEQ ID NO: 1707075 - RNA, 16 nt, Homo sapiens
gagccugcugcauggg

SEQ ID NO: 1707076 - RNA, 15 nt, Homo sapiens
gagccuggcacagga

SEQ ID NO: 1707077 - RNA, 17 nt, Homo sapiens
gagcgugaaucuguauc

SEQ ID NO: 1707078 - RNA, 20 nt, Homo sapiens
gagcugcccuccuuguccac

SEQ ID NO: 1707079 - RNA, 17 nt, Homo sapiens
gagcugcucucucauga

SEQ ID NO: 1707080 - RNA, 17 nt, Homo sapiens
gaggaacuguccagaga

SEQ ID NO: 1707081 - RNA, 18 nt, Homo sapiens
gaggaacuguccagagag

SEQ ID NO: 1707082 - RNA, 23 nt, Homo sapiens
gaggaagggcaaaaccacuagaa

SEQ ID NO: 1707083 - RNA, 23 nt, Homo sapiens
gaggaauaagaauggagcaguac

SEQ ID NO: 1707084 - RNA, 15 nt, Homo sapiens
gaggaauuggccgcu

SEQ ID NO: 1707085 - RNA, 22 nt, Homo sapiens
gaggagccaggcaacuucaguc

SEQ ID NO: 1707086 - RNA, 12 nt, Homo sapiens
gaggagccuuuu

SEQ ID NO: 1707087 - RNA, 17 nt, Homo sapiens
gaggaucuccuguccau

SEQ ID NO: 1707088 - RNA, 18 nt, Homo sapiens
gaggauugcuaucuggag

SEQ ID NO: 1707089 - RNA, 18 nt, Homo sapiens
gaggcaaagcuggcucac

SEQ ID NO: 1707090 - RNA, 21 nt, Homo sapiens
gaggcaagugugggggguccu

SEQ ID NO: 1707091 - RNA, 13 nt, Homo sapiens
gaggcacugcuga

SEQ ID NO: 1707092 - RNA, 20 nt, Homo sapiens
gaggcaggaggauugcuuga

SEQ ID NO: 1707093 - RNA, 18 nt, Homo sapiens
gaggccccacugaugcug

SEQ ID NO: 1707094 - RNA, 12 nt, Homo sapiens
gaggcuggccaa

SEQ ID NO: 1707095 - RNA, 15 nt, Homo sapiens
gaggcuuuacagugu

SEQ ID NO: 1707096 - RNA, 19 nt, Homo sapiens
gagggccgugagggguccc

SEQ ID NO: 1707097 - RNA, 20 nt, Homo sapiens
gagggcggggagaaucucag

SEQ ID NO: 1707098 - RNA, 18 nt, Homo sapiens
gagggugggguaaccaaa

SEQ ID NO: 1707099 - RNA, 22 nt, Homo sapiens
gagguaccagcaauauguaaau

SEQ ID NO: 1707100 - RNA, 15 nt, Homo sapiens
gaggucauacaugca

SEQ ID NO: 1707101 - RNA, 20 nt, Homo sapiens
gaggugggaggauugcuuga

SEQ ID NO: 1707102 - RNA, 14 nt, Homo sapiens
gagguguacaggua

SEQ ID NO: 1707103 - RNA, 16 nt, Homo sapiens
gagguguuggcuuugu

SEQ ID NO: 1707104 - RNA, 15 nt, Homo sapiens
gaguaaauacaggua

SEQ ID NO: 1707105 - RNA, 21 nt, Homo sapiens
gaguaauauagugacuaugaa

SEQ ID NO: 1707106 - RNA, 15 nt, Homo sapiens
gaguacaaacacagg

SEQ ID NO: 1707107 - RNA, 14 nt, Homo sapiens
gaguagaauugcau

SEQ ID NO: 1707108 - RNA, 20 nt, Homo sapiens
gaguagggacucagggccau

SEQ ID NO: 1707109 - RNA, 14 nt, Homo sapiens
gagucaccuuccag

SEQ ID NO: 1707110 - RNA, 15 nt, Homo sapiens
gaguccaagaaucca

SEQ ID NO: 1707111 - RNA, 17 nt, Homo sapiens
gagucgaggacagggag

SEQ ID NO: 1707112 - RNA, 13 nt, Homo sapiens
gagucuagauuca

SEQ ID NO: 1707113 - RNA, 17 nt, Homo sapiens
gagucucacuguugccc

SEQ ID NO: 1707114 - RNA, 19 nt, Homo sapiens
gagugagacucugucucaa

SEQ ID NO: 1707115 - RNA, 22 nt, Homo sapiens
gagugccguaacaacugugguc

SEQ ID NO: 1707116 - RNA, 12 nt, Homo sapiens
gaguguacuuaa

SEQ ID NO: 1707117 - RNA, 22 nt, Homo sapiens
gaguuauggugaacccacaacu

SEQ ID NO: 1707118 - RNA, 17 nt, Homo sapiens
gaguugucaagucucug

SEQ ID NO: 1707119 - RNA, 19 nt, Homo sapiens
gaguuguuuaaacagucaa

SEQ ID NO: 1707120 - RNA, 20 nt, Homo sapiens
gaguuguuuaaacagucaaa

SEQ ID NO: 1707121 - RNA, 15 nt, Homo sapiens
gaguuuaacaugugu

SEQ ID NO: 1707122 - RNA, 22 nt, Homo sapiens
gaguuuaauuuuugaaaacugg

SEQ ID NO: 1707123 - RNA, 11 nt, Homo sapiens
gauaaaacacc

SEQ ID NO: 1707124 - RNA, 10 nt, Homo sapiens
gauaaacuag

SEQ ID NO: 1707125 - RNA, 18 nt, Homo sapiens
gauaaaguaaugaucuca

SEQ ID NO: 1707126 - RNA, 16 nt, Homo sapiens
gauaaaugauagacaa

SEQ ID NO: 1707127 - RNA, 17 nt, Homo sapiens
gauaaaugauagacaau

SEQ ID NO: 1707128 - RNA, 16 nt, Homo sapiens
gauaacuuagguggca

SEQ ID NO: 1707129 - RNA, 20 nt, Homo sapiens
gauaagacacccccucaaac

SEQ ID NO: 1707130 - RNA, 19 nt, Homo sapiens
gauaagccacucugucccu

SEQ ID NO: 1707131 - RNA, 14 nt, Homo sapiens
gauaauaucuuugu

SEQ ID NO: 1707132 - RNA, 15 nt, Homo sapiens
gauaaucagccucuu

SEQ ID NO: 1707133 - RNA, 19 nt, Homo sapiens
gauaccaagaugccaucug

SEQ ID NO: 1707134 - RNA, 20 nt, Homo sapiens
gauacccaggaccaagccac

SEQ ID NO: 1707135 - RNA, 16 nt, Homo sapiens
gauaccugcacugucc

SEQ ID NO: 1707136 - RNA, 17 nt, Homo sapiens
gauagcaaacacugggg

SEQ ID NO: 1707137 - RNA, 18 nt, Homo sapiens
gauagcaaacacuggggg

SEQ ID NO: 1707138 - RNA, 14 nt, Homo sapiens
gauagcuacagugu

SEQ ID NO: 1707139 - RNA, 15 nt, Homo sapiens
gauaguaacaaugaa

SEQ ID NO: 1707140 - RNA, 16 nt, Homo sapiens
gauaguugauuuucaa

SEQ ID NO: 1707141 - RNA, 18 nt, Homo sapiens
gauauaaaaauaauguca

SEQ ID NO: 1707142 - RNA, 15 nt, Homo sapiens
gauauauaccacuuu

SEQ ID NO: 1707143 - RNA, 22 nt, Homo sapiens
gauauauauaugcuuggcuaac

SEQ ID NO: 1707144 - RNA, 23 nt, Homo sapiens
gauauauuuuccagggcaaucaa

SEQ ID NO: 1707145 - RNA, 22 nt, Homo sapiens
gaucaaaauaaaaagugacaca

SEQ ID NO: 1707146 - RNA, 18 nt, Homo sapiens
gaucacuagccugucauc

SEQ ID NO: 1707147 - RNA, 16 nt, Homo sapiens
gaucagcaucugugau

SEQ ID NO: 1707148 - RNA, 16 nt, Homo sapiens
gaucaucagugauacu

SEQ ID NO: 1707149 - RNA, 14 nt, Homo sapiens
gauccaagcugguc

SEQ ID NO: 1707150 - RNA, 18 nt, Homo sapiens
gaucccgaagaauggaga

SEQ ID NO: 1707151 - RNA, 21 nt, Homo sapiens
gaucucaauuugcaguauuca

SEQ ID NO: 1707152 - RNA, 18 nt, Homo sapiens
gaucucggcucacugcaa

SEQ ID NO: 1707153 - RNA, 14 nt, Homo sapiens
gaucugcaguuuuu

SEQ ID NO: 1707154 - RNA, 18 nt, Homo sapiens
gaucugcaguuuuugccu

SEQ ID NO: 1707155 - RNA, 16 nt, Homo sapiens
gaucugucuuguaaua

SEQ ID NO: 1707156 - RNA, 10 nt, Homo sapiens
gaucugugau

SEQ ID NO: 1707157 - RNA, 13 nt, Homo sapiens
gaucuuagauucu

SEQ ID NO: 1707158 - RNA, 17 nt, Homo sapiens
gaucuuucuauuccaaa

SEQ ID NO: 1707159 - RNA, 23 nt, Homo sapiens
gaugaaaacauagcaucucagga

SEQ ID NO: 1707160 - RNA, 16 nt, Homo sapiens
gaugaaagggacagau

SEQ ID NO: 1707161 - RNA, 17 nt, Homo sapiens
gaugaaauuauuuguca

SEQ ID NO: 1707162 - RNA, 20 nt, Homo sapiens
gaugaaauuuucuagacuuu

SEQ ID NO: 1707163 - RNA, 21 nt, Homo sapiens
gaugaaguuuuacauuguuga

SEQ ID NO: 1707164 - RNA, 14 nt, Homo sapiens
gaugacccacuguc

SEQ ID NO: 1707165 - RNA, 15 nt, Homo sapiens
gaugacccucugacc

SEQ ID NO: 1707166 - RNA, 16 nt, Homo sapiens
gaugagccgcugugag

SEQ ID NO: 1707167 - RNA, 21 nt, Homo sapiens
gaugaucuggauccaccaaga

SEQ ID NO: 1707168 - RNA, 16 nt, Homo sapiens
gaugcacuuaugcagu

SEQ ID NO: 1707169 - RNA, 13 nt, Homo sapiens
gaugccauaugcc

SEQ ID NO: 1707170 - RNA, 23 nt, Homo sapiens
gaugcuccuaguuugaccucaca

SEQ ID NO: 1707171 - RNA, 14 nt, Homo sapiens
gaugcuguuugaca

SEQ ID NO: 1707172 - RNA, 19 nt, Homo sapiens
gauggaaguaaagccucaa

SEQ ID NO: 1707173 - RNA, 15 nt, Homo sapiens
gauggugacuuccuc

SEQ ID NO: 1707174 - RNA, 16 nt, Homo sapiens
gaugucauuaaugugu

SEQ ID NO: 1707175 - RNA, 17 nt, Homo sapiens
gaugucccugggccagg

SEQ ID NO: 1707176 - RNA, 19 nt, Homo sapiens
gaugucccuugaugcacag

SEQ ID NO: 1707177 - RNA, 17 nt, Homo sapiens
gaugucuccacuuucac

SEQ ID NO: 1707178 - RNA, 22 nt, Homo sapiens
gaugugaaaacaucucaauaac

SEQ ID NO: 1707179 - RNA, 22 nt, Homo sapiens
gaugugcagccccuuccuggug

SEQ ID NO: 1707180 - RNA, 20 nt, Homo sapiens
gauguguauacguaggaauu

SEQ ID NO: 1707181 - RNA, 20 nt, Homo sapiens
gauguuuuuaaaaguuucaa

SEQ ID NO: 1707182 - RNA, 16 nt, Homo sapiens
gauuaaggugauguga

SEQ ID NO: 1707183 - RNA, 22 nt, Homo sapiens
gauuacaagcgugagccacugc

SEQ ID NO: 1707184 - RNA, 22 nt, Homo sapiens
gauuaccugaaggacagcugaa

SEQ ID NO: 1707185 - RNA, 20 nt, Homo sapiens
gauuaugaugaaaaccuaca

SEQ ID NO: 1707186 - RNA, 21 nt, Homo sapiens
gauucacauaguuuauuucaa

SEQ ID NO: 1707187 - RNA, 17 nt, Homo sapiens
gauucuaaugucuucau

SEQ ID NO: 1707188 - RNA, 19 nt, Homo sapiens
gauucuccagccaaccuca

SEQ ID NO: 1707189 - RNA, 23 nt, Homo sapiens
gauucugugaucuuuuaaagugu

SEQ ID NO: 1707190 - RNA, 21 nt, Homo sapiens
gauuguaaaaaaaaaugccuu

SEQ ID NO: 1707191 - RNA, 17 nt, Homo sapiens
gauuuaaaaacuggaac

SEQ ID NO: 1707192 - RNA, 21 nt, Homo sapiens
ggagcugaugaaacucacaaa

SEQ ID NO: 1707193 - RNA, 18 nt, Homo sapiens
ggagcugucccaccugca

SEQ ID NO: 1707194 - RNA, 16 nt, Homo sapiens
ggaggcaugccucuga

SEQ ID NO: 1707195 - RNA, 15 nt, Homo sapiens
ggaggcccuccugug

SEQ ID NO: 1707196 - RNA, 19 nt, Homo sapiens
ggaggucauacaugcauac

SEQ ID NO: 1707197 - RNA, 20 nt, Homo sapiens
ggaggugaccccagguuucu

SEQ ID NO: 1707198 - RNA, 21 nt, Homo sapiens
ggaguacaaugcccagaucaa

SEQ ID NO: 1707199 - RNA, 13 nt, Homo sapiens
ggaguacugauga

SEQ ID NO: 1707200 - RNA, 14 nt, Homo sapiens
ggaguacugaugaa

SEQ ID NO: 1707201 - RNA, 16 nt, Homo sapiens
ggagucagacauuuua

SEQ ID NO: 1707202 - RNA, 22 nt, Homo sapiens
ggagugcucaccgccucacuca

SEQ ID NO: 1707203 - RNA, 16 nt, Homo sapiens
ggagugugugacauuc

SEQ ID NO: 1707204 - RNA, 16 nt, Homo sapiens
ggaguuggaagugaag

SEQ ID NO: 1707205 - RNA, 21 nt, Homo sapiens
ggaguuuucuggagugagcac

SEQ ID NO: 1707206 - RNA, 19 nt, Homo sapiens
ggauauaaaaauaauguca

SEQ ID NO: 1707207 - RNA, 13 nt, Homo sapiens
ggauauugacaag

SEQ ID NO: 1707208 - RNA, 15 nt, Homo sapiens
ggauccagaacugca

SEQ ID NO: 1707209 - RNA, 19 nt, Homo sapiens
ggaucccgaagaauggaga

SEQ ID NO: 1707210 - RNA, 14 nt, Homo sapiens
ggaucucacauuuc

SEQ ID NO: 1707211 - RNA, 20 nt, Homo sapiens
ggaugauacgaaugauguca

SEQ ID NO: 1707212 - RNA, 19 nt, Homo sapiens
ggaugaucuugauuguggg

SEQ ID NO: 1707213 - RNA, 23 nt, Homo sapiens
ggaugauguuauucacagccccu

SEQ ID NO: 1707214 - RNA, 14 nt, Homo sapiens
ggauuaauuugcau

SEQ ID NO: 1707215 - RNA, 16 nt, Homo sapiens
ggauuacaggcuugag

SEQ ID NO: 1707216 - RNA, 12 nt, Homo sapiens
ggauucuauuua

SEQ ID NO: 1707217 - RNA, 21 nt, Homo sapiens
ggauugcuacuguccuaccca

SEQ ID NO: 1707218 - RNA, 17 nt, Homo sapiens
ggauugcuaugaaugau

SEQ ID NO: 1707219 - RNA, 14 nt, Homo sapiens
ggauuuccagggau

SEQ ID NO: 1707220 - RNA, 23 nt, Homo sapiens
ggcaaaggaaauugucaucugcc

SEQ ID NO: 1707221 - RNA, 15 nt, Homo sapiens
ggcaaaugacaugca

SEQ ID NO: 1707222 - RNA, 22 nt, Homo sapiens
ggcaaaugacaugcacugaccc

SEQ ID NO: 1707223 - RNA, 19 nt, Homo sapiens
ggcaacagagcaagacucc

SEQ ID NO: 1707224 - RNA, 20 nt, Homo sapiens
ggcaacagagcaagacucca

SEQ ID NO: 1707225 - RNA, 23 nt, Homo sapiens
ggcaagacgcgagugcuggugac

SEQ ID NO: 1707226 - RNA, 19 nt, Homo sapiens
ggcaagugugggggguccu

SEQ ID NO: 1707227 - RNA, 20 nt, Homo sapiens
ggcaagugugggggguccuu

SEQ ID NO: 1707228 - RNA, 23 nt, Homo sapiens
ggcaauaaauauuagaagccugc

SEQ ID NO: 1707229 - RNA, 15 nt, Homo sapiens
ggcacaacugcaaua

SEQ ID NO: 1707230 - RNA, 14 nt, Homo sapiens
ggcacaagugucag

SEQ ID NO: 1707231 - RNA, 17 nt, Homo sapiens
ggcacaggaugcugugu

SEQ ID NO: 1707232 - RNA, 19 nt, Homo sapiens
ggcacccggccccugcugg

SEQ ID NO: 1707233 - RNA, 22 nt, Homo sapiens
ggcaccuuaagauuuugcaccu

SEQ ID NO: 1707234 - RNA, 16 nt, Homo sapiens
ggcagaaaaaugucau

SEQ ID NO: 1707235 - RNA, 19 nt, Homo sapiens
ggcagaccgugaccaucuu

SEQ ID NO: 1707236 - RNA, 17 nt, Homo sapiens
ggcagacuacacaggau

SEQ ID NO: 1707237 - RNA, 18 nt, Homo sapiens
ggcagacuacacaggaug

SEQ ID NO: 1707238 - RNA, 14 nt, Homo sapiens
ggcagccaccagcg

SEQ ID NO: 1707239 - RNA, 14 nt, Homo sapiens
ggcagcuacucaga

SEQ ID NO: 1707240 - RNA, 22 nt, Homo sapiens
ggcaggaaucuauccauugaac

SEQ ID NO: 1707241 - RNA, 20 nt, Homo sapiens
ggcaggagaaucucuugaac

SEQ ID NO: 1707242 - RNA, 21 nt, Homo sapiens
ggcaggccuggacuuccagug

SEQ ID NO: 1707243 - RNA, 15 nt, Homo sapiens
ggcaggcugggccau

SEQ ID NO: 1707244 - RNA, 18 nt, Homo sapiens
ggcaggcugggccauguc

SEQ ID NO: 1707245 - RNA, 20 nt, Homo sapiens
ggcaggcugggccaugucca

SEQ ID NO: 1707246 - RNA, 16 nt, Homo sapiens
ggcagggcaaaugaca

SEQ ID NO: 1707247 - RNA, 14 nt, Homo sapiens
ggcagggucucacu

SEQ ID NO: 1707248 - RNA, 18 nt, Homo sapiens
ggcagguagccaggggga

SEQ ID NO: 1707249 - RNA, 15 nt, Homo sapiens
ggcagguccacagag

SEQ ID NO: 1707250 - RNA, 14 nt, Homo sapiens
ggcagugggaccca

SEQ ID NO: 1707251 - RNA, 21 nt, Homo sapiens
ggcauaucggcucacaaagag

SEQ ID NO: 1707252 - RNA, 13 nt, Homo sapiens
ggcauggauccag

SEQ ID NO: 1707253 - RNA, 14 nt, Homo sapiens
ggccaacuaggcag

SEQ ID NO: 1707254 - RNA, 17 nt, Homo sapiens
ggccaagacuuggcaac

SEQ ID NO: 1707255 - RNA, 18 nt, Homo sapiens
ggccaagcaccuagccuc

SEQ ID NO: 1707256 - RNA, 19 nt, Homo sapiens
ggccacaacagggcauuuu

SEQ ID NO: 1707257 - RNA, 18 nt, Homo sapiens
ggccaccagccacuuuag

SEQ ID NO: 1707258 - RNA, 18 nt, Homo sapiens
ggccagagccaagaaaca

SEQ ID NO: 1707259 - RNA, 19 nt, Homo sapiens
ggccagagggagugacaga

SEQ ID NO: 1707260 - RNA, 13 nt, Homo sapiens
ggccagguggcca

SEQ ID NO: 1707261 - RNA, 23 nt, Homo sapiens
ggccaguaucuauauauguguau

SEQ ID NO: 1707262 - RNA, 14 nt, Homo sapiens
ggccauauuuacua

SEQ ID NO: 1707263 - RNA, 15 nt, Homo sapiens
ggccauguccaaaga

SEQ ID NO: 1707264 - RNA, 18 nt, Homo sapiens
ggcccaaccagacuucuc

SEQ ID NO: 1707265 - RNA, 17 nt, Homo sapiens
ggcccacuucaccguac

SEQ ID NO: 1707266 - RNA, 17 nt, Homo sapiens
ggccccaguccaugcuu

SEQ ID NO: 1707267 - RNA, 17 nt, Homo sapiens
ggccccaguucaaucuc

SEQ ID NO: 1707268 - RNA, 22 nt, Homo sapiens
ggccccucccgccccuucccac

SEQ ID NO: 1707269 - RNA, 23 nt, Homo sapiens
ggcccuuccucuccacugccuuc

SEQ ID NO: 1707270 - RNA, 22 nt, Homo sapiens
ggccgggccuagaccuggugcu

SEQ ID NO: 1707271 - RNA, 15 nt, Homo sapiens
ggccuagaccuggug

SEQ ID NO: 1707272 - RNA, 10 nt, Homo sapiens
ggccucagaa

SEQ ID NO: 1707273 - RNA, 11 nt, Homo sapiens
ggccuccagaa

SEQ ID NO: 1707274 - RNA, 13 nt, Homo sapiens
ggccuccaugacc

SEQ ID NO: 1707275 - RNA, 16 nt, Homo sapiens
ggccuccugugugugc

SEQ ID NO: 1707276 - RNA, 18 nt, Homo sapiens
ggccugaaaugaucaaau

SEQ ID NO: 1707277 - RNA, 15 nt, Homo sapiens
ggccugcacuggugu

SEQ ID NO: 1707278 - RNA, 22 nt, Homo sapiens
ggcgccccugccaccucccuga

SEQ ID NO: 1707279 - RNA, 22 nt, Homo sapiens
ggcgcccuuggcuucugugaug

SEQ ID NO: 1707280 - RNA, 12 nt, Homo sapiens
ggcgugaucuug

SEQ ID NO: 1707281 - RNA, 12 nt, Homo sapiens
ggcuaagugauc

SEQ ID NO: 1707282 - RNA, 15 nt, Homo sapiens
ggcuccaagaccuag

SEQ ID NO: 1707283 - RNA, 20 nt, Homo sapiens
ggcucucagcucagcgccag

SEQ ID NO: 1707284 - RNA, 17 nt, Homo sapiens
ggcucucauggggucca

SEQ ID NO: 1707285 - RNA, 20 nt, Homo sapiens
ggcucuccucgcagguguuc

SEQ ID NO: 1707286 - RNA, 19 nt, Homo sapiens
ggcucugcuucuccaagga

SEQ ID NO: 1707287 - RNA, 12 nt, Homo sapiens
ggcucuggagac

SEQ ID NO: 1707288 - RNA, 23 nt, Homo sapiens
ggcugaccccgguggcggcccca

SEQ ID NO: 1707289 - RNA, 19 nt, Homo sapiens
ggcugccccaaccugcuga

SEQ ID NO: 1707290 - RNA, 17 nt, Homo sapiens
ggcugccccucucacca

SEQ ID NO: 1707291 - RNA, 18 nt, Homo sapiens
ggcugcuggggccucaga

SEQ ID NO: 1707292 - RNA, 20 nt, Homo sapiens
ggcugcuuggagcagccuaa

SEQ ID NO: 1707293 - RNA, 20 nt, Homo sapiens
ggcugggcgucuaugcugcu

SEQ ID NO: 1707294 - RNA, 12 nt, Homo sapiens
ggcuguacugcu

SEQ ID NO: 1707295 - RNA, 15 nt, Homo sapiens
ggcuguaucccauga

SEQ ID NO: 1707296 - RNA, 10 nt, Homo sapiens
ggcugugagg

SEQ ID NO: 1707297 - RNA, 16 nt, Homo sapiens
ggcuucaguggcagcu

SEQ ID NO: 1707298 - RNA, 10 nt, Homo sapiens
ggcuugacuc

SEQ ID NO: 1707299 - RNA, 14 nt, Homo sapiens
ggcuugcagugcgc

SEQ ID NO: 1707300 - RNA, 15 nt, Homo sapiens
ggcuuuaucucaggg

SEQ ID NO: 1707301 - RNA, 18 nt, Homo sapiens
gggaaagcuucauucucc

SEQ ID NO: 1707302 - RNA, 18 nt, Homo sapiens
gccaauggagacugucuc

SEQ ID NO: 1707303 - RNA, 14 nt, Homo sapiens
gccacaacugcccc

SEQ ID NO: 1707304 - RNA, 16 nt, Homo sapiens
gccacaagucuuccag

SEQ ID NO: 1707305 - RNA, 18 nt, Homo sapiens
gccacagcagguccucca

SEQ ID NO: 1707306 - RNA, 23 nt, Homo sapiens
gccacauaagggguuugccauuu

SEQ ID NO: 1707307 - RNA, 18 nt, Homo sapiens
gccaccacugggcaaaca

SEQ ID NO: 1707308 - RNA, 23 nt, Homo sapiens
gccaccagcgaaugcuaggucuc

SEQ ID NO: 1707309 - RNA, 13 nt, Homo sapiens
gccaccccagaaa

SEQ ID NO: 1707310 - RNA, 24 nt, Homo sapiens
gccacccugagaaccccucuggga

SEQ ID NO: 1707311 - RNA, 15 nt, Homo sapiens
gccacgagacgucac

SEQ ID NO: 1707312 - RNA, 20 nt, Homo sapiens
gccacgagacgucaccaaga

SEQ ID NO: 1707313 - RNA, 24 nt, Homo sapiens
gccacguaugguggcucaugucua

SEQ ID NO: 1707314 - RNA, 21 nt, Homo sapiens
gccacucuuagcuaaaucccu

SEQ ID NO: 1707315 - RNA, 15 nt, Homo sapiens
gccagagccaagaaa

SEQ ID NO: 1707316 - RNA, 13 nt, Homo sapiens
gccagagccucug

SEQ ID NO: 1707317 - RNA, 21 nt, Homo sapiens
gccagaggaauccuggcagcc

SEQ ID NO: 1707318 - RNA, 16 nt, Homo sapiens
gccagaugauuguuca

SEQ ID NO: 1707319 - RNA, 20 nt, Homo sapiens
gccagaugugaaaacaucuc

SEQ ID NO: 1707320 - RNA, 14 nt, Homo sapiens
gccagcacgccgcu

SEQ ID NO: 1707321 - RNA, 16 nt, Homo sapiens
gccagccacacuugaa

SEQ ID NO: 1707322 - RNA, 18 nt, Homo sapiens
gccagccccugccucgag

SEQ ID NO: 1707323 - RNA, 20 nt, Homo sapiens
gccagccuucuuccauccca

SEQ ID NO: 1707324 - RNA, 14 nt, Homo sapiens
gccagcuacuuccu

SEQ ID NO: 1707325 - RNA, 14 nt, Homo sapiens
gccagcugcagcug

SEQ ID NO: 1707326 - RNA, 22 nt, Homo sapiens
gccagcugugggacaauuaucu

SEQ ID NO: 1707327 - RNA, 22 nt, Homo sapiens
gccagcuuggggccaccaaagc

SEQ ID NO: 1707328 - RNA, 17 nt, Homo sapiens
gccaggaaguacuucca

SEQ ID NO: 1707329 - RNA, 14 nt, Homo sapiens
gccaggacugagcc

SEQ ID NO: 1707330 - RNA, 21 nt, Homo sapiens
gccaggcaaaggaaauuguca

SEQ ID NO: 1707331 - RNA, 20 nt, Homo sapiens
gccaggcugccaaggccaga

SEQ ID NO: 1707332 - RNA, 17 nt, Homo sapiens
gccaggggaguuuccaa

SEQ ID NO: 1707333 - RNA, 19 nt, Homo sapiens
gccaguccugccuggccag

SEQ ID NO: 1707334 - RNA, 20 nt, Homo sapiens
gccauacuucuguuuccauc

SEQ ID NO: 1707335 - RNA, 21 nt, Homo sapiens
gccauauaaguuugaaggaaa

SEQ ID NO: 1707336 - RNA, 14 nt, Homo sapiens
gccauaugccuugg

SEQ ID NO: 1707337 - RNA, 22 nt, Homo sapiens
gccauauucuguuggccagugu

SEQ ID NO: 1707338 - RNA, 18 nt, Homo sapiens
gccaucaaaaugcuuuuu

SEQ ID NO: 1707339 - RNA, 16 nt, Homo sapiens
gccaucucuuccucau

SEQ ID NO: 1707340 - RNA, 19 nt, Homo sapiens
gccaucugggccauucaga

SEQ ID NO: 1707341 - RNA, 22 nt, Homo sapiens
gccauggcagacaguagacaga

SEQ ID NO: 1707342 - RNA, 12 nt, Homo sapiens
gccauggcagcg

SEQ ID NO: 1707343 - RNA, 13 nt, Homo sapiens
gccauguccaaag

SEQ ID NO: 1707344 - RNA, 16 nt, Homo sapiens
gccauguccaaagagg

SEQ ID NO: 1707345 - RNA, 23 nt, Homo sapiens
gccauguuucaagaaaauggauu

SEQ ID NO: 1707346 - RNA, 16 nt, Homo sapiens
gcccacccugggagac

SEQ ID NO: 1707347 - RNA, 19 nt, Homo sapiens
gcccacuguuaauauucua

SEQ ID NO: 1707348 - RNA, 17 nt, Homo sapiens
gcccaggcaggucuuga

SEQ ID NO: 1707349 - RNA, 20 nt, Homo sapiens
gcccaggcuggaguggagug

SEQ ID NO: 1707350 - RNA, 20 nt, Homo sapiens
gcccaggcuggcgugcagug

SEQ ID NO: 1707351 - RNA, 22 nt, Homo sapiens
gcccaucacaggguugggccca

SEQ ID NO: 1707352 - RNA, 18 nt, Homo sapiens
gcccccuugggugaccuc

SEQ ID NO: 1707353 - RNA, 22 nt, Homo sapiens
gccccucaaccuccuguggaac

SEQ ID NO: 1707354 - RNA, 14 nt, Homo sapiens
gccccucucaccaa

SEQ ID NO: 1707355 - RNA, 14 nt, Homo sapiens
gccccucugaccug

SEQ ID NO: 1707356 - RNA, 17 nt, Homo sapiens
gccccucugaccugcac

SEQ ID NO: 1707357 - RNA, 16 nt, Homo sapiens
gccccugcacaaagcc

SEQ ID NO: 1707358 - RNA, 22 nt, Homo sapiens
gccccuggggccuagacucugu

SEQ ID NO: 1707359 - RNA, 19 nt, Homo sapiens
gccccuggggcuuccaucc

SEQ ID NO: 1707360 - RNA, 13 nt, Homo sapiens
gcccguacccagc

SEQ ID NO: 1707361 - RNA, 20 nt, Homo sapiens
gcccuaaaaauccagacucu

SEQ ID NO: 1707362 - RNA, 19 nt, Homo sapiens
gcccuaacuguacauuuca

SEQ ID NO: 1707363 - RNA, 21 nt, Homo sapiens
gcccuaccugauuggugcaac

SEQ ID NO: 1707364 - RNA, 13 nt, Homo sapiens
gcccuauucugcc

SEQ ID NO: 1707365 - RNA, 21 nt, Homo sapiens
gcccugauguguccucaggga

SEQ ID NO: 1707366 - RNA, 17 nt, Homo sapiens
gcccugcucuuccucag

SEQ ID NO: 1707367 - RNA, 20 nt, Homo sapiens
gcccugcugcccaaucucca

SEQ ID NO: 1707368 - RNA, 18 nt, Homo sapiens
gcccuuccucuccacugc

SEQ ID NO: 1707369 - RNA, 18 nt, Homo sapiens
gcccuuuccccccauguu

SEQ ID NO: 1707370 - RNA, 21 nt, Homo sapiens
gccgagaucacgucacugcac

SEQ ID NO: 1707371 - RNA, 24 nt, Homo sapiens
gccgcgcccuuuccccgacgccca

SEQ ID NO: 1707372 - RNA, 17 nt, Homo sapiens
gccggcugugcucagag

SEQ ID NO: 1707373 - RNA, 16 nt, Homo sapiens
gccgggaaccaagcag

SEQ ID NO: 1707374 - RNA, 19 nt, Homo sapiens
gccgugccuucagcucuac

SEQ ID NO: 1707375 - RNA, 20 nt, Homo sapiens
gccuaaaagugggcuugauu

SEQ ID NO: 1707376 - RNA, 21 nt, Homo sapiens
gccuaaaagugggcuugauuc

SEQ ID NO: 1707377 - RNA, 19 nt, Homo sapiens
gccuaaaauauauuccuga

SEQ ID NO: 1707378 - RNA, 15 nt, Homo sapiens
gccuaaaugccuuag

SEQ ID NO: 1707379 - RNA, 22 nt, Homo sapiens
gccuaaauuuaaugcugccuuu

SEQ ID NO: 1707380 - RNA, 19 nt, Homo sapiens
gccuacaggagugagcacu

SEQ ID NO: 1707381 - RNA, 12 nt, Homo sapiens
gccuacuuccuu

SEQ ID NO: 1707382 - RNA, 16 nt, Homo sapiens
gccuaugcacauaugg

SEQ ID NO: 1707383 - RNA, 21 nt, Homo sapiens
gccucaguccuccccucacag

SEQ ID NO: 1707384 - RNA, 21 nt, Homo sapiens
gccuccacagcgagggcagcu

SEQ ID NO: 1707385 - RNA, 23 nt, Homo sapiens
gccuccaucucauguaucaucug

SEQ ID NO: 1707386 - RNA, 13 nt, Homo sapiens
gccuccaugaccu

SEQ ID NO: 1707387 - RNA, 18 nt, Homo sapiens
gccuccuauccaccacug

SEQ ID NO: 1707388 - RNA, 21 nt, Homo sapiens
gccucgaggacugauacugca

SEQ ID NO: 1707389 - RNA, 20 nt, Homo sapiens
gccucugcuccccugugaac

SEQ ID NO: 1707390 - RNA, 18 nt, Homo sapiens
gccucuggcucucauggg

SEQ ID NO: 1707391 - RNA, 20 nt, Homo sapiens
gccucuggcucucauggggu

SEQ ID NO: 1707392 - RNA, 22 nt, Homo sapiens
gccucuuccgugacgucacugg

SEQ ID NO: 1707393 - RNA, 17 nt, Homo sapiens
gccugaaauuucaccau

SEQ ID NO: 1707394 - RNA, 16 nt, Homo sapiens
gccugaccuuccuucc

SEQ ID NO: 1707395 - RNA, 21 nt, Homo sapiens
gccugcaauuucauaugcugu

SEQ ID NO: 1707396 - RNA, 12 nt, Homo sapiens
gccugcacacaa

SEQ ID NO: 1707397 - RNA, 14 nt, Homo sapiens
gccugcacuuugau

SEQ ID NO: 1707398 - RNA, 23 nt, Homo sapiens
gccugccccaaacaaauaugcaa

SEQ ID NO: 1707399 - RNA, 15 nt, Homo sapiens
gccugccuggugugc

SEQ ID NO: 1707400 - RNA, 15 nt, Homo sapiens
gccuggacaguaucc

SEQ ID NO: 1707401 - RNA, 20 nt, Homo sapiens
gccuggagugcccacccugg

SEQ ID NO: 1707402 - RNA, 19 nt, Homo sapiens
gccugucccauggacacuc

SEQ ID NO: 1707403 - RNA, 13 nt, Homo sapiens
ccaauucaauaca

SEQ ID NO: 1707404 - RNA, 23 nt, Homo sapiens
ccacaaagcacaguuugaacaaa

SEQ ID NO: 1707405 - RNA, 15 nt, Homo sapiens
ccacaacaacaaaag

SEQ ID NO: 1707406 - RNA, 21 nt, Homo sapiens
ccacaaccaccuucaccugga

SEQ ID NO: 1707407 - RNA, 13 nt, Homo sapiens
ccacaacugacac

SEQ ID NO: 1707408 - RNA, 15 nt, Homo sapiens
ccacaacugacacag

SEQ ID NO: 1707409 - RNA, 18 nt, Homo sapiens
ccacaacugacacaggaa

SEQ ID NO: 1707410 - RNA, 12 nt, Homo sapiens
ccacaacuuuaa

SEQ ID NO: 1707411 - RNA, 13 nt, Homo sapiens
ccacaacuuuaaa

SEQ ID NO: 1707412 - RNA, 18 nt, Homo sapiens
ccacacagcuacagcuuu

SEQ ID NO: 1707413 - RNA, 22 nt, Homo sapiens
ccacacccuggaggauuucauc

SEQ ID NO: 1707414 - RNA, 21 nt, Homo sapiens
ccacagcgagggcagcugcua

SEQ ID NO: 1707415 - RNA, 21 nt, Homo sapiens
ccacaggagugggaaaacacu

SEQ ID NO: 1707416 - RNA, 22 nt, Homo sapiens
ccacaguccuucuuugacacca

SEQ ID NO: 1707417 - RNA, 14 nt, Homo sapiens
ccacauaccuggcc

SEQ ID NO: 1707418 - RNA, 18 nt, Homo sapiens
ccacauccaacuccagca

SEQ ID NO: 1707419 - RNA, 20 nt, Homo sapiens
ccacauguacagacauacau

SEQ ID NO: 1707420 - RNA, 19 nt, Homo sapiens
ccacaugugacacauaugc

SEQ ID NO: 1707421 - RNA, 22 nt, Homo sapiens
ccacaugugacacauaugcacc

SEQ ID NO: 1707422 - RNA, 14 nt, Homo sapiens
ccacaugugcacau

SEQ ID NO: 1707423 - RNA, 19 nt, Homo sapiens
ccacccaacccuaucuccu

SEQ ID NO: 1707424 - RNA, 13 nt, Homo sapiens
ccaccccacacuu

SEQ ID NO: 1707425 - RNA, 20 nt, Homo sapiens
ccaccccagaaauggugaaa

SEQ ID NO: 1707426 - RNA, 17 nt, Homo sapiens
ccaccccuaaagagaua

SEQ ID NO: 1707427 - RNA, 21 nt, Homo sapiens
ccacccuagccaaugucuccu

SEQ ID NO: 1707428 - RNA, 22 nt, Homo sapiens
ccaccucccugacccgucuaau

SEQ ID NO: 1707429 - RNA, 23 nt, Homo sapiens
ccaccuccuuccccccaccagac

SEQ ID NO: 1707430 - RNA, 19 nt, Homo sapiens
ccaccucuguggcauugaa

SEQ ID NO: 1707431 - RNA, 15 nt, Homo sapiens
ccaccugcccaucac

SEQ ID NO: 1707432 - RNA, 16 nt, Homo sapiens
ccaccugccugcaucu

SEQ ID NO: 1707433 - RNA, 22 nt, Homo sapiens
ccaccugccugcaucugugaaa

SEQ ID NO: 1707434 - RNA, 14 nt, Homo sapiens
ccaccugucccacu

SEQ ID NO: 1707435 - RNA, 13 nt, Homo sapiens
ccaccugucucag

SEQ ID NO: 1707436 - RNA, 17 nt, Homo sapiens
ccaccuuggcucaaguc

SEQ ID NO: 1707437 - RNA, 22 nt, Homo sapiens
ccacgauuuucuccagcucaga

SEQ ID NO: 1707438 - RNA, 18 nt, Homo sapiens
ccacgcuggagugcagug

SEQ ID NO: 1707439 - RNA, 24 nt, Homo sapiens
ccacucuuguggucaucauggcca

SEQ ID NO: 1707440 - RNA, 16 nt, Homo sapiens
ccacugggcaaacaga

SEQ ID NO: 1707441 - RNA, 13 nt, Homo sapiens
ccacuuacauaua

SEQ ID NO: 1707442 - RNA, 19 nt, Homo sapiens
ccagaaaaaaaaaaacuua

SEQ ID NO: 1707443 - RNA, 22 nt, Homo sapiens
ccagaagaaaauucuccugaua

SEQ ID NO: 1707444 - RNA, 23 nt, Homo sapiens
ccagaagcuuccauaguggugca

SEQ ID NO: 1707445 - RNA, 18 nt, Homo sapiens
ccagaaggcgugcuggca

SEQ ID NO: 1707446 - RNA, 15 nt, Homo sapiens
ccagaauugugcaaa

SEQ ID NO: 1707447 - RNA, 15 nt, Homo sapiens
ccagaccucagggac

SEQ ID NO: 1707448 - RNA, 20 nt, Homo sapiens
ccagacuucucccgugagcc

SEQ ID NO: 1707449 - RNA, 22 nt, Homo sapiens
ccagacuucucccgugagccag

SEQ ID NO: 1707450 - RNA, 15 nt, Homo sapiens
ccagagaguggcucc

SEQ ID NO: 1707451 - RNA, 13 nt, Homo sapiens
ccagagaugcugg

SEQ ID NO: 1707452 - RNA, 17 nt, Homo sapiens
ccagagaugcuggacuu

SEQ ID NO: 1707453 - RNA, 15 nt, Homo sapiens
ccagagcagaugcag

SEQ ID NO: 1707454 - RNA, 22 nt, Homo sapiens
ccagagccaagaaacacuuuca

SEQ ID NO: 1707455 - RNA, 20 nt, Homo sapiens
ccagaggggcucaggucaca

SEQ ID NO: 1707456 - RNA, 17 nt, Homo sapiens
ccagaucacugccacac

SEQ ID NO: 1707457 - RNA, 19 nt, Homo sapiens
ccagaugagaagucugcua

SEQ ID NO: 1707458 - RNA, 18 nt, Homo sapiens
ccagauguuuccagacuu

SEQ ID NO: 1707459 - RNA, 11 nt, Homo sapiens
ccagcacucug

SEQ ID NO: 1707460 - RNA, 20 nt, Homo sapiens
ccagccaucaaaaugcuuuu

SEQ ID NO: 1707461 - RNA, 17 nt, Homo sapiens
ccagcccaaaggggaca

SEQ ID NO: 1707462 - RNA, 22 nt, Homo sapiens
ccagccccucccccaucuccca

SEQ ID NO: 1707463 - RNA, 15 nt, Homo sapiens
ccagcccugcugcag

SEQ ID NO: 1707464 - RNA, 14 nt, Homo sapiens
ccagccuccaugcu

SEQ ID NO: 1707465 - RNA, 16 nt, Homo sapiens
ccagccuccaugcugc

SEQ ID NO: 1707466 - RNA, 19 nt, Homo sapiens
ccagccugaggcagccacu

SEQ ID NO: 1707467 - RNA, 20 nt, Homo sapiens
ccagccugaggcagccacuu

SEQ ID NO: 1707468 - RNA, 22 nt, Homo sapiens
ccagccugcuaauuccccagau

SEQ ID NO: 1707469 - RNA, 20 nt, Homo sapiens
ccagccuggccaacauggca

SEQ ID NO: 1707470 - RNA, 20 nt, Homo sapiens
ccagccugggcagcauagca

SEQ ID NO: 1707471 - RNA, 20 nt, Homo sapiens
ccagccugggcagccaggcu

SEQ ID NO: 1707472 - RNA, 15 nt, Homo sapiens
ccagcgucccagucu

SEQ ID NO: 1707473 - RNA, 15 nt, Homo sapiens
ccagcuacucaggag

SEQ ID NO: 1707474 - RNA, 17 nt, Homo sapiens
ccagcuacucaggaggc

SEQ ID NO: 1707475 - RNA, 19 nt, Homo sapiens
ccagcucccuaggagacca

SEQ ID NO: 1707476 - RNA, 19 nt, Homo sapiens
ccagcugcaggaaucaaaa

SEQ ID NO: 1707477 - RNA, 14 nt, Homo sapiens
uuacaaggugacaa

SEQ ID NO: 1707478 - RNA, 18 nt, Homo sapiens
uuacacccuuucuugaca

SEQ ID NO: 1707479 - RNA, 19 nt, Homo sapiens
uuacacccuuucuugacaa

SEQ ID NO: 1707480 - RNA, 18 nt, Homo sapiens
uuacacugccuguauacu

SEQ ID NO: 1707481 - RNA, 24 nt, Homo sapiens
uuacagcugccugcaguacuuuac

SEQ ID NO: 1707482 - RNA, 14 nt, Homo sapiens
uuacauuguugagc

SEQ ID NO: 1707483 - RNA, 19 nt, Homo sapiens
uuaccaaggaugaaagagg

SEQ ID NO: 1707484 - RNA, 20 nt, Homo sapiens
uuaccaaggaugaaagagga

SEQ ID NO: 1707485 - RNA, 14 nt, Homo sapiens
uuaccuccuaucag

SEQ ID NO: 1707486 - RNA, 23 nt, Homo sapiens
uuaccucuuuaaaaacaaaacaa

SEQ ID NO: 1707487 - RNA, 22 nt, Homo sapiens
uuacuaaagguuuuaaccgcac

SEQ ID NO: 1707488 - RNA, 16 nt, Homo sapiens
uuacuaagcauagcaa

SEQ ID NO: 1707489 - RNA, 21 nt, Homo sapiens
uuacucaugugcagguuuuga

SEQ ID NO: 1707490 - RNA, 12 nt, Homo sapiens
uuacugaaguua

SEQ ID NO: 1707491 - RNA, 18 nt, Homo sapiens
uuacuguucuugcugcua

SEQ ID NO: 1707492 - RNA, 13 nt, Homo sapiens
uuacuuaacucau

SEQ ID NO: 1707493 - RNA, 14 nt, Homo sapiens
uuacuugacuugaa

SEQ ID NO: 1707494 - RNA, 16 nt, Homo sapiens
uuacuuuguguucacc

SEQ ID NO: 1707495 - RNA, 17 nt, Homo sapiens
uuagaaaaaaguuuaca

SEQ ID NO: 1707496 - RNA, 14 nt, Homo sapiens
uuagaaaaauuccu

SEQ ID NO: 1707497 - RNA, 16 nt, Homo sapiens
uuagaaaaauuccuaa

SEQ ID NO: 1707498 - RNA, 13 nt, Homo sapiens
uuagaaacuccaa

SEQ ID NO: 1707499 - RNA, 12 nt, Homo sapiens
uuagaaauggau

SEQ ID NO: 1707500 - RNA, 12 nt, Homo sapiens
uuagaacuugca

SEQ ID NO: 1707501 - RNA, 18 nt, Homo sapiens
uuagacucaucuuacugu

SEQ ID NO: 1707502 - RNA, 16 nt, Homo sapiens
uuagagagggaccaug

SEQ ID NO: 1707503 - RNA, 14 nt, Homo sapiens
uuagaggagcccac

SEQ ID NO: 1707504 - RNA, 17 nt, Homo sapiens
uuagcaauugacuguca

SEQ ID NO: 1707505 - RNA, 22 nt, Homo sapiens
uuagcacagauuuuaauuguca

SEQ ID NO: 1707506 - RNA, 20 nt, Homo sapiens
uuagcauauuuuaaugcagu

SEQ ID NO: 1707507 - RNA, 18 nt, Homo sapiens
uuagccgcccaugcacug

SEQ ID NO: 1707508 - RNA, 19 nt, Homo sapiens
uuagcuggccauucaggua

SEQ ID NO: 1707509 - RNA, 22 nt, Homo sapiens
uuagcuuccugccccagacaga

SEQ ID NO: 1707510 - RNA, 16 nt, Homo sapiens
uuaggccauauauauu

SEQ ID NO: 1707511 - RNA, 13 nt, Homo sapiens
uuagguagcuuua

SEQ ID NO: 1707512 - RNA, 15 nt, Homo sapiens
uuaguaucucaucaa

SEQ ID NO: 1707513 - RNA, 16 nt, Homo sapiens
uuaguauucauucugc

SEQ ID NO: 1707514 - RNA, 13 nt, Homo sapiens
uuaguccaaauaa

SEQ ID NO: 1707515 - RNA, 11 nt, Homo sapiens
uuagucuccca

SEQ ID NO: 1707516 - RNA, 16 nt, Homo sapiens
uuauaaaauuaagcaa

SEQ ID NO: 1707517 - RNA, 14 nt, Homo sapiens
uuauaaaugagcaa

SEQ ID NO: 1707518 - RNA, 21 nt, Homo sapiens
uuauaaauuuuauaacagaau

SEQ ID NO: 1707519 - RNA, 13 nt, Homo sapiens
uuauaacaagugu

SEQ ID NO: 1707520 - RNA, 23 nt, Homo sapiens
uuauaagagugccguaacaacug

SEQ ID NO: 1707521 - RNA, 14 nt, Homo sapiens
uuauaagcauguau

SEQ ID NO: 1707522 - RNA, 18 nt, Homo sapiens
uuauaauuccuauauccu

SEQ ID NO: 1707523 - RNA, 21 nt, Homo sapiens
uuauacugauuaugucuuuua

SEQ ID NO: 1707524 - RNA, 16 nt, Homo sapiens
uuauagaaguagcaaa

SEQ ID NO: 1707525 - RNA, 23 nt, Homo sapiens
uuauagaguguacuuaacuauuc

SEQ ID NO: 1707526 - RNA, 18 nt, Homo sapiens
uuauaggacgaaugccaa

SEQ ID NO: 1707527 - RNA, 22 nt, Homo sapiens
uuauaguuucagauauauauca

SEQ ID NO: 1707528 - RNA, 18 nt, Homo sapiens
uuauaucuguggucuuca

SEQ ID NO: 1707529 - RNA, 16 nt, Homo sapiens
uuauaugcacauuucu

SEQ ID NO: 1707530 - RNA, 15 nt, Homo sapiens
uuauauguacuguuu

SEQ ID NO: 1707531 - RNA, 16 nt, Homo sapiens
uuauauuuugaucuga

SEQ ID NO: 1707532 - RNA, 19 nt, Homo sapiens
uuaucacgcagaucacuaa

SEQ ID NO: 1707533 - RNA, 17 nt, Homo sapiens
uuaucacuucauucaca

SEQ ID NO: 1707534 - RNA, 14 nt, Homo sapiens
uuaucaguaagaaa

SEQ ID NO: 1707535 - RNA, 20 nt, Homo sapiens
uuauccacaggaaaguguua

SEQ ID NO: 1707536 - RNA, 21 nt, Homo sapiens
uuauccaccaagaacauaaga

SEQ ID NO: 1707537 - RNA, 13 nt, Homo sapiens
uuaucccaaucau

SEQ ID NO: 1707538 - RNA, 14 nt, Homo sapiens
uuaugacaaugacu

SEQ ID NO: 1707539 - RNA, 22 nt, Homo sapiens
uuaugaugaaaaccuacauauu

SEQ ID NO: 1707540 - RNA, 13 nt, Homo sapiens
uuaugauguaauc

SEQ ID NO: 1707541 - RNA, 22 nt, Homo sapiens
uuaugcaguaaauuaucuuggg

SEQ ID NO: 1707542 - RNA, 14 nt, Homo sapiens
uuauguaaucucac

SEQ ID NO: 1707543 - RNA, 21 nt, Homo sapiens
uuauguaugaaaaguaacuga

SEQ ID NO: 1707544 - RNA, 23 nt, Homo sapiens
uuauguggaaaacagaacaucau

SEQ ID NO: 1707545 - RNA, 21 nt, Homo sapiens
uuauguguaguugucucucuu

SEQ ID NO: 1707546 - RNA, 18 nt, Homo sapiens
uuauuaccccacacaucc

SEQ ID NO: 1707547 - RNA, 14 nt, Homo sapiens
uuauugaaugugau

SEQ ID NO: 1707548 - RNA, 21 nt, Homo sapiens
uuauugaguucgaggacuaca

SEQ ID NO: 1707549 - RNA, 21 nt, Homo sapiens
uuauuuaggaaguugacuuau

SEQ ID NO: 1707550 - RNA, 20 nt, Homo sapiens
uuauuugcacacugcacugu

SEQ ID NO: 1707551 - RNA, 22 nt, Homo sapiens
uuauuugggagggaaaagggaa

SEQ ID NO: 1707552 - RNA, 18 nt, Homo sapiens
uucaaacugcaugauuca

SEQ ID NO: 1707553 - RNA, 13 nt, Homo sapiens
uucaaagcacaga

SEQ ID NO: 1707554 - RNA, 15 nt, Homo sapiens
uucaaccucauugac

SEQ ID NO: 1707555 - RNA, 14 nt, Homo sapiens
uucaagacuuccuc

SEQ ID NO: 1707556 - RNA, 14 nt, Homo sapiens
uucaagcagcaucu

SEQ ID NO: 1707557 - RNA, 21 nt, Homo sapiens
uucaaggccccgagcuguuac

SEQ ID NO: 1707558 - RNA, 18 nt, Homo sapiens
uucaagucaacaugcaua

SEQ ID NO: 1707559 - RNA, 19 nt, Homo sapiens
uucaagucaacaugcauau

SEQ ID NO: 1707560 - RNA, 14 nt, Homo sapiens
uucaauacaaacaa

SEQ ID NO: 1707561 - RNA, 21 nt, Homo sapiens
uucaaugcuagaacaacgccu

SEQ ID NO: 1707562 - RNA, 23 nt, Homo sapiens
uucaauuuggacuggugugcucu

SEQ ID NO: 1707563 - RNA, 14 nt, Homo sapiens
uucacacuaagaaa

SEQ ID NO: 1707564 - RNA, 20 nt, Homo sapiens
uucacaggcuaaugggauaa

SEQ ID NO: 1707565 - RNA, 18 nt, Homo sapiens
uucacauaaaaccucauu

SEQ ID NO: 1707566 - RNA, 18 nt, Homo sapiens
uucaccacaugugcacau

SEQ ID NO: 1707567 - RNA, 17 nt, Homo sapiens
uucaccagagcauuucc

SEQ ID NO: 1707568 - RNA, 18 nt, Homo sapiens
uucacccuuaacccaagg

SEQ ID NO: 1707569 - RNA, 14 nt, Homo sapiens
uucacgcaacuuga

SEQ ID NO: 1707570 - RNA, 15 nt, Homo sapiens
uucacugaaggugau

SEQ ID NO: 1707571 - RNA, 18 nt, Homo sapiens
uucacuguaagacucauu

SEQ ID NO: 1707572 - RNA, 12 nt, Homo sapiens
uucacuuuacaa

SEQ ID NO: 1707573 - RNA, 21 nt, Homo sapiens
uucacuuuuuacagugcuauu

SEQ ID NO: 1707574 - RNA, 22 nt, Homo sapiens
uucagagacagcugauacuuca

SEQ ID NO: 1707575 - RNA, 15 nt, Homo sapiens
uucagauauuccagg

SEQ ID NO: 1707576 - RNA, 18 nt, Homo sapiens
uucagauggugaagcauu

SEQ ID NO: 1707577 - RNA, 16 nt, Homo sapiens
uucagcucuguuuuac

SEQ ID NO: 1707578 - RNA, 22 nt, Homo sapiens
uucagcuguacuucgucuucua

SEQ ID NO: 1707579 - RNA, 19 nt, Homo sapiens
uucagcuucuaugcauuaa

SEQ ID NO: 1707580 - RNA, 18 nt, Homo sapiens
uucaggagcgcaagauag

SEQ ID NO: 1707581 - RNA, 18 nt, Homo sapiens
uucagugucaacuauuca

SEQ ID NO: 1707582 - RNA, 22 nt, Homo sapiens
uucaguuucuucugcgccucag

SEQ ID NO: 1707583 - RNA, 16 nt, Homo sapiens
uucauaagguaauuca

SEQ ID NO: 1707584 - RNA, 21 nt, Homo sapiens
uucauaagguaauucauggca

SEQ ID NO: 1707585 - RNA, 18 nt, Homo sapiens
uucauaccuaaguacugu

SEQ ID NO: 1707586 - RNA, 15 nt, Homo sapiens
uucauauauacaggc

SEQ ID NO: 1707587 - RNA, 15 nt, Homo sapiens
uucauaugcuguaua

SEQ ID NO: 1707588 - RNA, 21 nt, Homo sapiens
uucauccaggcccaacuguga

SEQ ID NO: 1707589 - RNA, 18 nt, Homo sapiens
uucauccugacucugccc

SEQ ID NO: 1707590 - RNA, 19 nt, Homo sapiens
uucauggcugaagucaccu

SEQ ID NO: 1707591 - RNA, 21 nt, Homo sapiens
uucauggguuuaccacuaacu

SEQ ID NO: 1707592 - RNA, 20 nt, Homo sapiens
uucauguuugcuucauaaau

SEQ ID NO: 1707593 - RNA, 14 nt, Homo sapiens
uucauuauguauga

SEQ ID NO: 1707594 - RNA, 15 nt, Homo sapiens
uucauucacauucag

SEQ ID NO: 1707595 - RNA, 13 nt, Homo sapiens
uucauugcacuuu

SEQ ID NO: 1707596 - RNA, 21 nt, Homo sapiens
uucauuguuuuuaacuuugcu

SEQ ID NO: 1707597 - RNA, 17 nt, Homo sapiens
uucauuugugugcucau

SEQ ID NO: 1707598 - RNA, 14 nt, Homo sapiens
uuccaagagucuaa

SEQ ID NO: 1707599 - RNA, 13 nt, Homo sapiens
uuccaauagcaaa

SEQ ID NO: 1707600 - RNA, 20 nt, Homo sapiens
uuccacucccuuugccagug

SEQ ID NO: 1707601 - RNA, 23 nt, Homo sapiens
uuccacucccuuugccagugccu

SEQ ID NO: 1707602 - RNA, 17 nt, Homo sapiens
uuccacuuugcauauga

SEQ ID NO: 1707603 - RNA, 23 nt, Homo sapiens
uuccagaagaagagaagcugcug

SEQ ID NO: 1707604 - RNA, 14 nt, Homo sapiens
uuccaggguugcuu

SEQ ID NO: 1707605 - RNA, 18 nt, Homo sapiens
uuccagguguuacuguaa

SEQ ID NO: 1707606 - RNA, 14 nt, Homo sapiens
uuccagugucuguc

SEQ ID NO: 1707607 - RNA, 20 nt, Homo sapiens
uuccagugucugucauuuca

SEQ ID NO: 1707608 - RNA, 16 nt, Homo sapiens
uuccauaagaagucgu

SEQ ID NO: 1707609 - RNA, 17 nt, Homo sapiens
uuccauaaugcuacugu

SEQ ID NO: 1707610 - RNA, 20 nt, Homo sapiens
uuccaucccaaccagugcca

SEQ ID NO: 1707611 - RNA, 14 nt, Homo sapiens
uuccaugaaguuug

SEQ ID NO: 1707612 - RNA, 14 nt, Homo sapiens
uuccaugauucuau

SEQ ID NO: 1707613 - RNA, 18 nt, Homo sapiens
uuccauuuccaagcacuu

SEQ ID NO: 1707614 - RNA, 18 nt, Homo sapiens
uucccaaaagauugcuga

SEQ ID NO: 1707615 - RNA, 20 nt, Homo sapiens
uucccaaucagcacugaaaa

SEQ ID NO: 1707616 - RNA, 11 nt, Homo sapiens
uucccacucac

SEQ ID NO: 1707617 - RNA, 18 nt, Homo sapiens
uucccaucuuuacuccca

SEQ ID NO: 1707618 - RNA, 15 nt, Homo sapiens
uuccccccauguugu

SEQ ID NO: 1707619 - RNA, 12 nt, Homo sapiens
uuccccucugcu

SEQ ID NO: 1707620 - RNA, 14 nt, Homo sapiens
uucccgaugaacaa

SEQ ID NO: 1707621 - RNA, 20 nt, Homo sapiens
uucccuaaagugaugggcuu

SEQ ID NO: 1707622 - RNA, 19 nt, Homo sapiens
uucccucuugcucaguggg

SEQ ID NO: 1707623 - RNA, 18 nt, Homo sapiens
uucccuucaacaugaaaa

SEQ ID NO: 1707624 - RNA, 17 nt, Homo sapiens
uucccuuccacugccuc

SEQ ID NO: 1707625 - RNA, 17 nt, Homo sapiens
uucccuucuugcauccu

SEQ ID NO: 1707626 - RNA, 21 nt, Homo sapiens
uuccgauggaugaaucuccca

SEQ ID NO: 1707627 - RNA, 20 nt, Homo sapiens
uuccuacagcacuacugggu

SEQ ID NO: 1707628 - RNA, 22 nt, Homo sapiens
uuccuacccacaccucugccag

SEQ ID NO: 1707629 - RNA, 15 nt, Homo sapiens
uuccucacaguccca

SEQ ID NO: 1707630 - RNA, 16 nt, Homo sapiens
uuccucagaucaucca

SEQ ID NO: 1707631 - RNA, 13 nt, Homo sapiens
uuccuccauaaau

SEQ ID NO: 1707632 - RNA, 16 nt, Homo sapiens
uuccucgccucuccca

SEQ ID NO: 1707633 - RNA, 16 nt, Homo sapiens
uuccucuauacaucuc

SEQ ID NO: 1707634 - RNA, 19 nt, Homo sapiens
uuccuggaguacaaacaca

SEQ ID NO: 1707635 - RNA, 22 nt, Homo sapiens
uuccuguggggggaaguccaug

SEQ ID NO: 1707636 - RNA, 15 nt, Homo sapiens
uuccuuagacuuacu

SEQ ID NO: 1707637 - RNA, 19 nt, Homo sapiens
uuccuuccagauccugggu

SEQ ID NO: 1707638 - RNA, 15 nt, Homo sapiens
uuccuugaccuuccu

SEQ ID NO: 1707639 - RNA, 17 nt, Homo sapiens
uuccuugggaugaucuu

SEQ ID NO: 1707640 - RNA, 18 nt, Homo sapiens
uuccuuucuacaauuuca

SEQ ID NO: 1707641 - RNA, 13 nt, Homo sapiens
uuccuuuggguua

SEQ ID NO: 1707642 - RNA, 20 nt, Homo sapiens
uuccuuuuaaaacacuucca

SEQ ID NO: 1707643 - RNA, 21 nt, Homo sapiens
uucgcaccuaccaucagggac

SEQ ID NO: 1707644 - RNA, 13 nt, Homo sapiens
uucuaaaaugugu

SEQ ID NO: 1707645 - RNA, 15 nt, Homo sapiens
uucuaaaguucuaag

SEQ ID NO: 1707646 - RNA, 21 nt, Homo sapiens
uucuaagacuuacucuaagau

SEQ ID NO: 1707647 - RNA, 14 nt, Homo sapiens
uucuaagauucuaa

SEQ ID NO: 1707648 - RNA, 21 nt, Homo sapiens
uucuaaggccuaggauucuaa

SEQ ID NO: 1707649 - RNA, 12 nt, Homo sapiens
uucuaaguauuu

SEQ ID NO: 1707650 - RNA, 17 nt, Homo sapiens
uucuaaguuucuaagau

SEQ ID NO: 1707651 - RNA, 15 nt, Homo sapiens
uucuaaugugugaau

SEQ ID NO: 1707652 - RNA, 21 nt, Homo sapiens
uucuaggcacuguaguucuaa

SEQ ID NO: 1707653 - RNA, 14 nt, Homo sapiens
uucuagucacuucc

SEQ ID NO: 1707654 - RNA, 19 nt, Homo sapiens
uucuauugccuucuuugaa

SEQ ID NO: 1707655 - RNA, 21 nt, Homo sapiens
uucucaaguucuaagauucua

SEQ ID NO: 1707656 - RNA, 18 nt, Homo sapiens
uucucauaccuuccccac

SEQ ID NO: 1707657 - RNA, 23 nt, Homo sapiens
uucuccccgcuaaggaagauauc

SEQ ID NO: 1707658 - RNA, 14 nt, Homo sapiens
uucuccuugaauau

SEQ ID NO: 1707659 - RNA, 23 nt, Homo sapiens
uucucucugugguggagaaccac

SEQ ID NO: 1707660 - RNA, 18 nt, Homo sapiens
uucucucuuauuccacuu

SEQ ID NO: 1707661 - RNA, 19 nt, Homo sapiens
uucucugccuuugacauuu

SEQ ID NO: 1707662 - RNA, 17 nt, Homo sapiens
uucucugcuccaccaca

SEQ ID NO: 1707663 - RNA, 16 nt, Homo sapiens
uucucugugucuaaga

SEQ ID NO: 1707664 - RNA, 16 nt, Homo sapiens
uucugacggcccugca

SEQ ID NO: 1707665 - RNA, 18 nt, Homo sapiens
uucugaugccaauacuag

SEQ ID NO: 1707666 - RNA, 11 nt, Homo sapiens
uucugcacuga

SEQ ID NO: 1707667 - RNA, 23 nt, Homo sapiens
uucugcccgggaaggucaccagc

SEQ ID NO: 1707668 - RNA, 16 nt, Homo sapiens
uucuggaaaagcaaaa

SEQ ID NO: 1707669 - RNA, 16 nt, Homo sapiens
uucugggacacaguuc

SEQ ID NO: 1707670 - RNA, 17 nt, Homo sapiens
uucugggugcagcugag

SEQ ID NO: 1707671 - RNA, 19 nt, Homo sapiens
uucugggugcagcugagaa

SEQ ID NO: 1707672 - RNA, 22 nt, Homo sapiens
uucuguagcuuguucccugucu

SEQ ID NO: 1707673 - RNA, 13 nt, Homo sapiens
uucugugaucuuu

SEQ ID NO: 1707674 - RNA, 18 nt, Homo sapiens
uucuguggaccacugcau

SEQ ID NO: 1707675 - RNA, 15 nt, Homo sapiens
uucuuacacauacag

SEQ ID NO: 1707676 - RNA, 19 nt, Homo sapiens
uucuuacccuguacauaug

SEQ ID NO: 1707677 - RNA, 13 nt, Homo sapiens
uucuucaaccuca

SEQ ID NO: 1707678 - RNA, 22 nt, Homo sapiens
uucuucaccuaagucucuguga

SEQ ID NO: 1707679 - RNA, 21 nt, Homo sapiens
uucuucaucccuuuccaguua

SEQ ID NO: 1707680 - RNA, 20 nt, Homo sapiens
uucuugaaauguaggcauca

SEQ ID NO: 1707681 - RNA, 18 nt, Homo sapiens
uucuugcucuaucucuca

SEQ ID NO: 1707682 - RNA, 12 nt, Homo sapiens
uucuugcugcua

SEQ ID NO: 1707683 - RNA, 21 nt, Homo sapiens
uucuuggagggcccacuugua

SEQ ID NO: 1707684 - RNA, 22 nt, Homo sapiens
uucuuuaaaaaacaacuaugga

SEQ ID NO: 1707685 - RNA, 12 nt, Homo sapiens
uucuuucucuca

SEQ ID NO: 1707686 - RNA, 20 nt, Homo sapiens
uucuuugggauugcuaugaa

SEQ ID NO: 1707687 - RNA, 14 nt, Homo sapiens
uucuuuucacuucg

SEQ ID NO: 1707688 - RNA, 20 nt, Homo sapiens
uucuuuuuaaaauggugcuu

SEQ ID NO: 1707689 - RNA, 21 nt, Homo sapiens
uugaaaaaaacuucauucucg

SEQ ID NO: 1707690 - RNA, 17 nt, Homo sapiens
uugaaaccugcucugua

SEQ ID NO: 1707691 - RNA, 15 nt, Homo sapiens
uugaaagaaccagag

SEQ ID NO: 1707692 - RNA, 21 nt, Homo sapiens
uugaaagugaauaaacuucag

SEQ ID NO: 1707693 - RNA, 14 nt, Homo sapiens
uugaaauaccucau

SEQ ID NO: 1707694 - RNA, 16 nt, Homo sapiens
uugaaauagucugugu

SEQ ID NO: 1707695 - RNA, 22 nt, Homo sapiens
uugaaaucaaugcaagagugau

SEQ ID NO: 1707696 - RNA, 23 nt, Homo sapiens
uuggggacagauucagucuugcc

SEQ ID NO: 1707697 - RNA, 13 nt, Homo sapiens
uuggggucucuuu

SEQ ID NO: 1707698 - RNA, 13 nt, Homo sapiens
uugguaagagaca

SEQ ID NO: 1707699 - RNA, 16 nt, Homo sapiens
uugguaccauggugua

SEQ ID NO: 1707700 - RNA, 20 nt, Homo sapiens
uuggucaugugggucuucca

SEQ ID NO: 1707701 - RNA, 16 nt, Homo sapiens
uugguccaagauuccg

SEQ ID NO: 1707702 - RNA, 23 nt, Homo sapiens
uugguccagagcggaggcugugu

SEQ ID NO: 1707703 - RNA, 14 nt, Homo sapiens
uuggugcauagaac

SEQ ID NO: 1707704 - RNA, 13 nt, Homo sapiens
uuggugcuagaaa

SEQ ID NO: 1707705 - RNA, 17 nt, Homo sapiens
uuguaacuaggcucaga

SEQ ID NO: 1707706 - RNA, 21 nt, Homo sapiens
uuguaagaaaaugagacaaaa

SEQ ID NO: 1707707 - RNA, 22 nt, Homo sapiens
uuguaagaguguagaagcauuc

SEQ ID NO: 1707708 - RNA, 15 nt, Homo sapiens
uuguaagugcugcua

SEQ ID NO: 1707709 - RNA, 16 nt, Homo sapiens
uuguaagugcugcuau

SEQ ID NO: 1707710 - RNA, 17 nt, Homo sapiens
uuguaaugcugcacaga

SEQ ID NO: 1707711 - RNA, 22 nt, Homo sapiens
uuguagagauggggucucacag

SEQ ID NO: 1707712 - RNA, 13 nt, Homo sapiens
uuguauaauuucg

SEQ ID NO: 1707713 - RNA, 15 nt, Homo sapiens
uuguaucaacacugu

SEQ ID NO: 1707714 - RNA, 20 nt, Homo sapiens
uugucagacauaaagccaug

SEQ ID NO: 1707715 - RNA, 22 nt, Homo sapiens
uugucaugguuacaaacuacag

SEQ ID NO: 1707716 - RNA, 22 nt, Homo sapiens
uugucauguggcuaaaugccua

SEQ ID NO: 1707717 - RNA, 14 nt, Homo sapiens
uugucccccaacuu

SEQ ID NO: 1707718 - RNA, 18 nt, Homo sapiens
uugucccccaacuugaga

SEQ ID NO: 1707719 - RNA, 21 nt, Homo sapiens
uugucuguuaaaugaacuuga

SEQ ID NO: 1707720 - RNA, 22 nt, Homo sapiens
uugucuguuaaaugaacuugau

SEQ ID NO: 1707721 - RNA, 20 nt, Homo sapiens
uugugaccuucucuauauca

SEQ ID NO: 1707722 - RNA, 18 nt, Homo sapiens
uugugauguuuugagagu

SEQ ID NO: 1707723 - RNA, 21 nt, Homo sapiens
uugugcugcaccuggucauac

SEQ ID NO: 1707724 - RNA, 14 nt, Homo sapiens
uugugucacaaaga

SEQ ID NO: 1707725 - RNA, 17 nt, Homo sapiens
uugugugcucauguaug

SEQ ID NO: 1707726 - RNA, 21 nt, Homo sapiens
uuguguguuuauuucacuuga

SEQ ID NO: 1707727 - RNA, 20 nt, Homo sapiens
uuguuacuguucuugcugcu

SEQ ID NO: 1707728 - RNA, 16 nt, Homo sapiens
uuguuaucagucaaua

SEQ ID NO: 1707729 - RNA, 15 nt, Homo sapiens
uuguuggaugaaauu

SEQ ID NO: 1707730 - RNA, 13 nt, Homo sapiens
uuguugugugugc

SEQ ID NO: 1707731 - RNA, 13 nt, Homo sapiens
uuguuguuugcca

SEQ ID NO: 1707732 - RNA, 13 nt, Homo sapiens
uuguuuacagcaa

SEQ ID NO: 1707733 - RNA, 15 nt, Homo sapiens
uuguuugucuuccau

SEQ ID NO: 1707734 - RNA, 17 nt, Homo sapiens
uuguuuugaaaaccuaa

SEQ ID NO: 1707735 - RNA, 15 nt, Homo sapiens
uuuaaaaaaucucaa

SEQ ID NO: 1707736 - RNA, 14 nt, Homo sapiens
uuuaaaaugcauaa

SEQ ID NO: 1707737 - RNA, 20 nt, Homo sapiens
uuuaaacuaucuugugugau

SEQ ID NO: 1707738 - RNA, 18 nt, Homo sapiens
uuuaaacuuguuugcugu

SEQ ID NO: 1707739 - RNA, 22 nt, Homo sapiens
uuuaaagcauauuggugcuaga

SEQ ID NO: 1707740 - RNA, 14 nt, Homo sapiens
uuuaacguuuucau

SEQ ID NO: 1707741 - RNA, 20 nt, Homo sapiens
uuuaacuucuuucuauuuga

SEQ ID NO: 1707742 - RNA, 17 nt, Homo sapiens
uuuaagauuuuucucaa

SEQ ID NO: 1707743 - RNA, 22 nt, Homo sapiens
uuuaagggcaugccuugugcug

SEQ ID NO: 1707744 - RNA, 15 nt, Homo sapiens
ucuugcucccuucag

SEQ ID NO: 1707745 - RNA, 17 nt, Homo sapiens
ucuugcucuaucucuca

SEQ ID NO: 1707746 - RNA, 18 nt, Homo sapiens
ucuugcugcuagaacuuu

SEQ ID NO: 1707747 - RNA, 13 nt, Homo sapiens
ucuuggacacugu

SEQ ID NO: 1707748 - RNA, 17 nt, Homo sapiens
ucuuguuccccacugac

SEQ ID NO: 1707749 - RNA, 16 nt, Homo sapiens
ucuuuaaaacaaaaca

SEQ ID NO: 1707750 - RNA, 21 nt, Homo sapiens
ucuuuaauuucugucagaaug

SEQ ID NO: 1707751 - RNA, 20 nt, Homo sapiens
ucuuuaauuuguuaucucaa

SEQ ID NO: 1707752 - RNA, 21 nt, Homo sapiens
ucuuuacaaaacuacaugaga

SEQ ID NO: 1707753 - RNA, 20 nt, Homo sapiens
ucuuuagugcuuucuuguca

SEQ ID NO: 1707754 - RNA, 20 nt, Homo sapiens
ucuuucacauuguuugcugc

SEQ ID NO: 1707755 - RNA, 15 nt, Homo sapiens
ucuuucauccuugac

SEQ ID NO: 1707756 - RNA, 20 nt, Homo sapiens
ucuuucaugggcaccaaccu

SEQ ID NO: 1707757 - RNA, 14 nt, Homo sapiens
ucuuuccuggcacu

SEQ ID NO: 1707758 - RNA, 23 nt, Homo sapiens
ucuuuccuggcacuaacguugag

SEQ ID NO: 1707759 - RNA, 15 nt, Homo sapiens
ucuuucugccaacuu

SEQ ID NO: 1707760 - RNA, 19 nt, Homo sapiens
ucuuuggaaaaauguuugu

SEQ ID NO: 1707761 - RNA, 16 nt, Homo sapiens
ucuuuggacaaccaug

SEQ ID NO: 1707762 - RNA, 21 nt, Homo sapiens
ucuuuggggguuagaccacuu

SEQ ID NO: 1707763 - RNA, 20 nt, Homo sapiens
ucuuuuaugagcagaaggaa

SEQ ID NO: 1707764 - RNA, 16 nt, Homo sapiens
ucuuuuauguuugaau

SEQ ID NO: 1707765 - RNA, 15 nt, Homo sapiens
ucuuuucucaugugu

SEQ ID NO: 1707766 - RNA, 20 nt, Homo sapiens
ucuuuuuaaagcuuauccau

SEQ ID NO: 1707767 - RNA, 19 nt, Homo sapiens
ucuuuuuaaguaaugugga

SEQ ID NO: 1707768 - RNA, 19 nt, Homo sapiens
ugaaaaaaaguacauguau

SEQ ID NO: 1707769 - RNA, 17 nt, Homo sapiens
ugaaaaacagaaagcau

SEQ ID NO: 1707770 - RNA, 15 nt, Homo sapiens
ugaaaaaucauccaa

SEQ ID NO: 1707771 - RNA, 17 nt, Homo sapiens
ugaaaacauaaucugca

SEQ ID NO: 1707772 - RNA, 21 nt, Homo sapiens
ugaaaaccaaaaugacaucuu

SEQ ID NO: 1707773 - RNA, 16 nt, Homo sapiens
ugaaaaugaauaucua

SEQ ID NO: 1707774 - RNA, 16 nt, Homo sapiens
ugaaaaugaguuguga

SEQ ID NO: 1707775 - RNA, 23 nt, Homo sapiens
ugaaaauuuauuuuuagugauaa

SEQ ID NO: 1707776 - RNA, 18 nt, Homo sapiens
ugaaacacgaaacuuguu

SEQ ID NO: 1707777 - RNA, 18 nt, Homo sapiens
ugaaacuggcacugaauu

SEQ ID NO: 1707778 - RNA, 20 nt, Homo sapiens
ugaaagauugauuaaugaac

SEQ ID NO: 1707779 - RNA, 11 nt, Homo sapiens
ugaaagcacag

SEQ ID NO: 1707780 - RNA, 23 nt, Homo sapiens
ugaaaggaagcuccacugucacc

SEQ ID NO: 1707781 - RNA, 16 nt, Homo sapiens
ugaaagggaucaucau

SEQ ID NO: 1707782 - RNA, 21 nt, Homo sapiens
ugaaauaaaacuacaugguca

SEQ ID NO: 1707783 - RNA, 13 nt, Homo sapiens
ugaaauaccucau

SEQ ID NO: 1707784 - RNA, 23 nt, Homo sapiens
ugaaauacuauuuaaagccuccu

SEQ ID NO: 1707785 - RNA, 14 nt, Homo sapiens
ugaaauaugcaucu

SEQ ID NO: 1707786 - RNA, 14 nt, Homo sapiens
ugaaauaugugaag

SEQ ID NO: 1707787 - RNA, 16 nt, Homo sapiens
ugaaauggauacuaca

SEQ ID NO: 1707788 - RNA, 22 nt, Homo sapiens
ugaaauuaugugacauuuuaca

SEQ ID NO: 1707789 - RNA, 13 nt, Homo sapiens
ugaaauuuuaccg

SEQ ID NO: 1707790 - RNA, 14 nt, Homo sapiens
ugaacaacuccaaa

SEQ ID NO: 1707791 - RNA, 17 nt, Homo sapiens
ugaacacaggcagcuuu

SEQ ID NO: 1707792 - RNA, 17 nt, Homo sapiens
ucucauguaucaucugg

SEQ ID NO: 1707793 - RNA, 18 nt, Homo sapiens
ucuccacucuugugguca

SEQ ID NO: 1707794 - RNA, 22 nt, Homo sapiens
ucuccagcaauaauguuuucua

SEQ ID NO: 1707795 - RNA, 21 nt, Homo sapiens
ucucccaccuccuucccccca

SEQ ID NO: 1707796 - RNA, 18 nt, Homo sapiens
ucuccuauaaucugucaa

SEQ ID NO: 1707797 - RNA, 14 nt, Homo sapiens
ucuccuuugcugag

SEQ ID NO: 1707798 - RNA, 15 nt, Homo sapiens
ucuccuuuuacuuca

SEQ ID NO: 1707799 - RNA, 23 nt, Homo sapiens
ucucuaugccagcucagucccau

SEQ ID NO: 1707800 - RNA, 15 nt, Homo sapiens
ucucuccagccugac

SEQ ID NO: 1707801 - RNA, 20 nt, Homo sapiens
ucucucggcuccccaugugu

SEQ ID NO: 1707802 - RNA, 11 nt, Homo sapiens
ucucucugugg

SEQ ID NO: 1707803 - RNA, 16 nt, Homo sapiens
ucucugaacacaggca

SEQ ID NO: 1707804 - RNA, 19 nt, Homo sapiens
ucucugaagcauguuucau

SEQ ID NO: 1707805 - RNA, 21 nt, Homo sapiens
ucucuggggcaggcugcuuca

SEQ ID NO: 1707806 - RNA, 12 nt, Homo sapiens
ucucuguacuuu

SEQ ID NO: 1707807 - RNA, 12 nt, Homo sapiens
ucucugugaauu

SEQ ID NO: 1707808 - RNA, 16 nt, Homo sapiens
ucucugugugcacaaa

SEQ ID NO: 1707809 - RNA, 19 nt, Homo sapiens
ucucuuaaaguuggaauuu

SEQ ID NO: 1707810 - RNA, 22 nt, Homo sapiens
ucucuuccugccccucuuucuc

SEQ ID NO: 1707811 - RNA, 19 nt, Homo sapiens
ucucuucuacaauuguggu

SEQ ID NO: 1707812 - RNA, 22 nt, Homo sapiens
ucucuucuuuuggcuuccauga

SEQ ID NO: 1707813 - RNA, 20 nt, Homo sapiens
ucucuuucacauuguuugcu

SEQ ID NO: 1707814 - RNA, 19 nt, Homo sapiens
ucugaaaucuccuuuagcc

SEQ ID NO: 1707815 - RNA, 22 nt, Homo sapiens
ucugaacacaggcagcuuucua

SEQ ID NO: 1707816 - RNA, 13 nt, Homo sapiens
ucugaagucacau

SEQ ID NO: 1707817 - RNA, 15 nt, Homo sapiens
ucugaagucacugca

SEQ ID NO: 1707818 - RNA, 20 nt, Homo sapiens
ucugaaucgagugagacaaa

SEQ ID NO: 1707819 - RNA, 18 nt, Homo sapiens
ucugaaugugcugaucau

SEQ ID NO: 1707820 - RNA, 14 nt, Homo sapiens
ucugacacacagcu

SEQ ID NO: 1707821 - RNA, 22 nt, Homo sapiens
ucugacagaaagcagauaccuc

SEQ ID NO: 1707822 - RNA, 15 nt, Homo sapiens
ucugacccacugcuu

SEQ ID NO: 1707823 - RNA, 16 nt, Homo sapiens
ucugaccccuccucac

SEQ ID NO: 1707824 - RNA, 16 nt, Homo sapiens
ucugacgcaaaaccac

SEQ ID NO: 1707825 - RNA, 19 nt, Homo sapiens
ucugagagaugacagggaa

SEQ ID NO: 1707826 - RNA, 17 nt, Homo sapiens
ucugagagccaggguuu

SEQ ID NO: 1707827 - RNA, 21 nt, Homo sapiens
ucugagcccccacugcuucua

SEQ ID NO: 1707828 - RNA, 20 nt, Homo sapiens
ucugaggcccugcccaauga

SEQ ID NO: 1707829 - RNA, 22 nt, Homo sapiens
ucugaucauccacugugccaug

SEQ ID NO: 1707830 - RNA, 14 nt, Homo sapiens
ucugaugucuccac

SEQ ID NO: 1707831 - RNA, 21 nt, Homo sapiens
ucugcaagcacaucugcauuu

SEQ ID NO: 1707832 - RNA, 16 nt, Homo sapiens
ucugccugaagucaca

SEQ ID NO: 1707833 - RNA, 20 nt, Homo sapiens
ucugcucacauaucugucau

SEQ ID NO: 1707834 - RNA, 12 nt, Homo sapiens
ucugcugaggag

SEQ ID NO: 1707835 - RNA, 16 nt, Homo sapiens
ucugcuucuccaagga

SEQ ID NO: 1707836 - RNA, 13 nt, Homo sapiens
ucuggaaguccaa

SEQ ID NO: 1707837 - RNA, 11 nt, Homo sapiens
ucuggacaaag

SEQ ID NO: 1707838 - RNA, 21 nt, Homo sapiens
ucuggaccauauaccaucucc

SEQ ID NO: 1707839 - RNA, 23 nt, Homo sapiens
ucuggagggguguggcuccuucc

SEQ ID NO: 1707840 - RNA, 12 nt, Homo sapiens
ucuggcucucau

SEQ ID NO: 1707841 - RNA, 23 nt, Homo sapiens
ucuggcugccccaaccugcugaa

SEQ ID NO: 1707842 - RNA, 22 nt, Homo sapiens
ucugggaaaaucuauuccugcc

SEQ ID NO: 1707843 - RNA, 21 nt, Homo sapiens
ucugggcuagguagaaaaagg

SEQ ID NO: 1707844 - RNA, 21 nt, Homo sapiens
ucugggguccauucucugagu

SEQ ID NO: 1707845 - RNA, 14 nt, Homo sapiens
ucugggugcagcug

SEQ ID NO: 1707846 - RNA, 17 nt, Homo sapiens
ucugggugcagcugaga

SEQ ID NO: 1707847 - RNA, 17 nt, Homo sapiens
ucugggugccuuaagga

SEQ ID NO: 1707848 - RNA, 17 nt, Homo sapiens
ucugguuugagcaauuu

SEQ ID NO: 1707849 - RNA, 19 nt, Homo sapiens
ucuguaacaucacuaucca

SEQ ID NO: 1707850 - RNA, 16 nt, Homo sapiens
ucugucaaaacacugu

SEQ ID NO: 1707851 - RNA, 14 nt, Homo sapiens
ucugucacaccagc

SEQ ID NO: 1707852 - RNA, 17 nt, Homo sapiens
ucuguccuacucugugu

SEQ ID NO: 1707853 - RNA, 24 nt, Homo sapiens
ucugucuaaaaaccagacaaggaa

SEQ ID NO: 1707854 - RNA, 22 nt, Homo sapiens
ucugugaaaagggaucugcucc

SEQ ID NO: 1707855 - RNA, 16 nt, Homo sapiens
ucugugaaaccuguga

SEQ ID NO: 1707856 - RNA, 21 nt, Homo sapiens
ucugugagacccccacaccuc

SEQ ID NO: 1707857 - RNA, 19 nt, Homo sapiens
ucuguguauauuauuuggc

SEQ ID NO: 1707858 - RNA, 14 nt, Homo sapiens
ucuguguuaggggu

SEQ ID NO: 1707859 - RNA, 15 nt, Homo sapiens
ucuguguuaggggua

SEQ ID NO: 1707860 - RNA, 14 nt, Homo sapiens
ucuguuugagauuu

SEQ ID NO: 1707861 - RNA, 17 nt, Homo sapiens
ucuguuuugaaggcaaa

SEQ ID NO: 1707862 - RNA, 21 nt, Homo sapiens
ucuuaaagugcaguucuuagc

SEQ ID NO: 1707863 - RNA, 20 nt, Homo sapiens
ucuuacacaggcuucaucaa

SEQ ID NO: 1707864 - RNA, 15 nt, Homo sapiens
ucuuacauuagcagu

SEQ ID NO: 1707865 - RNA, 16 nt, Homo sapiens
ucuuacccuguacaua

SEQ ID NO: 1707866 - RNA, 19 nt, Homo sapiens
ucuuaccuguaugucucca

SEQ ID NO: 1707867 - RNA, 15 nt, Homo sapiens
ucuuacuggugcuau

SEQ ID NO: 1707868 - RNA, 17 nt, Homo sapiens
ucuuacuugacuugaau

SEQ ID NO: 1707869 - RNA, 13 nt, Homo sapiens
ucuuagauucucu

SEQ ID NO: 1707870 - RNA, 11 nt, Homo sapiens
ucuuagcuguc

SEQ ID NO: 1707871 - RNA, 16 nt, Homo sapiens
ucuuagcugucugcuc

SEQ ID NO: 1707872 - RNA, 18 nt, Homo sapiens
ucuuagggugaaccacuu

SEQ ID NO: 1707873 - RNA, 16 nt, Homo sapiens
ucuuauagcacuuuga

SEQ ID NO: 1707874 - RNA, 22 nt, Homo sapiens
ucuuauauuuuuugaguugagu

SEQ ID NO: 1707875 - RNA, 17 nt, Homo sapiens
ucuuaugcaaucuaugu

SEQ ID NO: 1707876 - RNA, 14 nt, Homo sapiens
ucuucaaacuguga

SEQ ID NO: 1707877 - RNA, 12 nt, Homo sapiens
ucuucaacaucc

SEQ ID NO: 1707878 - RNA, 16 nt, Homo sapiens
ucuucaaccucauuga

SEQ ID NO: 1707879 - RNA, 18 nt, Homo sapiens
ucuucaccccccacucac

SEQ ID NO: 1707880 - RNA, 20 nt, Homo sapiens
ucuucacugucugacuuuag

SEQ ID NO: 1707881 - RNA, 16 nt, Homo sapiens
ucuucaggccucccuc

SEQ ID NO: 1707882 - RNA, 14 nt, Homo sapiens
ucuucaucugugac

SEQ ID NO: 1707883 - RNA, 13 nt, Homo sapiens
ucuuccaaaaaga

SEQ ID NO: 1707884 - RNA, 23 nt, Homo sapiens
ucuuccaucccaggacaccacac

SEQ ID NO: 1707885 - RNA, 13 nt, Homo sapiens
ucuuccaugaccc

SEQ ID NO: 1707886 - RNA, 15 nt, Homo sapiens
ucuucccccuuccaa

SEQ ID NO: 1707887 - RNA, 16 nt, Homo sapiens
ucuucccccuuccaaa

SEQ ID NO: 1707888 - RNA, 18 nt, Homo sapiens
ucuucccccuuccaaaua

SEQ ID NO: 1707889 - RNA, 18 nt, Homo sapiens
ucuucccuaccucaggca

SEQ ID NO: 1707890 - RNA, 19 nt, Homo sapiens
ucuucccucagaaacuaga

SEQ ID NO: 1707891 - RNA, 19 nt, Homo sapiens
ucuuccuauuuuaaugaau

SEQ ID NO: 1707892 - RNA, 19 nt, Homo sapiens
ucuuccuccucgcugccag

SEQ ID NO: 1707893 - RNA, 23 nt, Homo sapiens
ucuuccuccucgcugccagauga

SEQ ID NO: 1707894 - RNA, 20 nt, Homo sapiens
ucuuccuuacccugcgauuu

SEQ ID NO: 1707895 - RNA, 20 nt, Homo sapiens
ucuugaaauuaagaaggcaa

SEQ ID NO: 1707896 - RNA, 21 nt, Homo sapiens
ucuugaauguggucucaggau

SEQ ID NO: 1707897 - RNA, 15 nt, Homo sapiens
ucuugacuagugcaa

SEQ ID NO: 1707898 - RNA, 11 nt, Homo sapiens
ucuugaucucc

SEQ ID NO: 1707899 - RNA, 20 nt, Homo sapiens
ucuugauuugaguugauuga

SEQ ID NO: 1707900 - RNA, 17 nt, Homo sapiens
ucuugcagucaucagaa

SEQ ID NO: 1707901 - RNA, 22 nt, Homo sapiens
uccuggguacugaaagccuuag

SEQ ID NO: 1707902 - RNA, 16 nt, Homo sapiens
uccugggucagggaga

SEQ ID NO: 1707903 - RNA, 19 nt, Homo sapiens
uccugggucuucagcauuc

SEQ ID NO: 1707904 - RNA, 13 nt, Homo sapiens
uccugugacuguc

SEQ ID NO: 1707905 - RNA, 22 nt, Homo sapiens
uccugugugugcgccuacagga

SEQ ID NO: 1707906 - RNA, 20 nt, Homo sapiens
uccuguuggauaucauacuu

SEQ ID NO: 1707907 - RNA, 21 nt, Homo sapiens
uccuguuggauaucauacuuc

SEQ ID NO: 1707908 - RNA, 14 nt, Homo sapiens
uccuguugucuaca

SEQ ID NO: 1707909 - RNA, 16 nt, Homo sapiens
uccuuccacuaacuca

SEQ ID NO: 1707910 - RNA, 22 nt, Homo sapiens
uccuucccucggggccauacuu

SEQ ID NO: 1707911 - RNA, 23 nt, Homo sapiens
uccuucccucggggccauacuuc

SEQ ID NO: 1707912 - RNA, 14 nt, Homo sapiens
uccuucugugaaag

SEQ ID NO: 1707913 - RNA, 15 nt, Homo sapiens
uccuuucacaaccuu

SEQ ID NO: 1707914 - RNA, 15 nt, Homo sapiens
uccuuucuccaggac

SEQ ID NO: 1707915 - RNA, 14 nt, Homo sapiens
uccuuucugccgac

SEQ ID NO: 1707916 - RNA, 15 nt, Homo sapiens
uccuuugcagggcag

SEQ ID NO: 1707917 - RNA, 14 nt, Homo sapiens
uccuuuuuuauucc

SEQ ID NO: 1707918 - RNA, 23 nt, Homo sapiens
uccuuuuuucaaaauccaaaaag

SEQ ID NO: 1707919 - RNA, 18 nt, Homo sapiens
ucgaaaccugggauucag

SEQ ID NO: 1707920 - RNA, 12 nt, Homo sapiens
ucgcaccuacca

SEQ ID NO: 1707921 - RNA, 14 nt, Homo sapiens
ucgcaccuuuccaa

SEQ ID NO: 1707922 - RNA, 23 nt, Homo sapiens
ucgccucucccaccccaugcauu

SEQ ID NO: 1707923 - RNA, 14 nt, Homo sapiens
ucgcugccagauga

SEQ ID NO: 1707924 - RNA, 17 nt, Homo sapiens
ucgcuuguaaauaccag

SEQ ID NO: 1707925 - RNA, 16 nt, Homo sapiens
ucgcuuuguugcccag

SEQ ID NO: 1707926 - RNA, 20 nt, Homo sapiens
ucggagacagugacuggugc

SEQ ID NO: 1707927 - RNA, 13 nt, Homo sapiens
ucggcacccugca

SEQ ID NO: 1707928 - RNA, 19 nt, Homo sapiens
ucggcagcuacucagagga

SEQ ID NO: 1707929 - RNA, 14 nt, Homo sapiens
ucggccuccaugac

SEQ ID NO: 1707930 - RNA, 23 nt, Homo sapiens
ucggggccauacuucuguuucca

SEQ ID NO: 1707931 - RNA, 19 nt, Homo sapiens
ucuaaaauguguuuuauca

SEQ ID NO: 1707932 - RNA, 23 nt, Homo sapiens
ucuaaagauggaguuucuaaggu

SEQ ID NO: 1707933 - RNA, 24 nt, Homo sapiens
ucuaaauuugaauguuaagcagau

SEQ ID NO: 1707934 - RNA, 20 nt, Homo sapiens
ucuaagauaguaacaaugaa

SEQ ID NO: 1707935 - RNA, 21 nt, Homo sapiens
ucuaaucaaaagggaaaagaa

SEQ ID NO: 1707936 - RNA, 18 nt, Homo sapiens
ucuaaugagacugaccau

SEQ ID NO: 1707937 - RNA, 15 nt, Homo sapiens
ucuaaugcauguauu

SEQ ID NO: 1707938 - RNA, 22 nt, Homo sapiens
ucuacacugcaaucauauguga

SEQ ID NO: 1707939 - RNA, 13 nt, Homo sapiens
ucuacagugccaa

SEQ ID NO: 1707940 - RNA, 19 nt, Homo sapiens
ucuaccacaagggcucucu

SEQ ID NO: 1707941 - RNA, 13 nt, Homo sapiens
ucuaccauuugaa

SEQ ID NO: 1707942 - RNA, 16 nt, Homo sapiens
ucuaccauuugaauuu

SEQ ID NO: 1707943 - RNA, 15 nt, Homo sapiens
ucuacuaauuccaca

SEQ ID NO: 1707944 - RNA, 19 nt, Homo sapiens
ucuagaauuauaagucaca

SEQ ID NO: 1707945 - RNA, 22 nt, Homo sapiens
ucuagacacugccacacagggu

SEQ ID NO: 1707946 - RNA, 18 nt, Homo sapiens
ucuagauuauaaacugac

SEQ ID NO: 1707947 - RNA, 19 nt, Homo sapiens
ucuagccuauuuaccugca

SEQ ID NO: 1707948 - RNA, 20 nt, Homo sapiens
ucuagccuauuuaccugcag

SEQ ID NO: 1707949 - RNA, 13 nt, Homo sapiens
ucuaggguccagu

SEQ ID NO: 1707950 - RNA, 14 nt, Homo sapiens
ucuauaaggccaua

SEQ ID NO: 1707951 - RNA, 19 nt, Homo sapiens
ucuauagcugcuauagcaa

SEQ ID NO: 1707952 - RNA, 16 nt, Homo sapiens
ucuauaguugucagua

SEQ ID NO: 1707953 - RNA, 19 nt, Homo sapiens
ucuauaguugucaguauua

SEQ ID NO: 1707954 - RNA, 16 nt, Homo sapiens
ucuaugucagcaguau

SEQ ID NO: 1707955 - RNA, 22 nt, Homo sapiens
ucuauguuugcacuugugcuuu

SEQ ID NO: 1707956 - RNA, 15 nt, Homo sapiens
ucuauucaagcacuu

SEQ ID NO: 1707957 - RNA, 13 nt, Homo sapiens
ucucaaacuauga

SEQ ID NO: 1707958 - RNA, 20 nt, Homo sapiens
ucucaaacucuugaccucag

SEQ ID NO: 1707959 - RNA, 21 nt, Homo sapiens
ucucaaugugaaaaauguguc

SEQ ID NO: 1707960 - RNA, 18 nt, Homo sapiens
ucucacaguguugcccag

SEQ ID NO: 1707961 - RNA, 18 nt, Homo sapiens
ucucacuauguugcccag

SEQ ID NO: 1707962 - RNA, 17 nt, Homo sapiens
ucucacugaaacauuua

SEQ ID NO: 1707963 - RNA, 11 nt, Homo sapiens
ucucagacuuu

SEQ ID NO: 1707964 - RNA, 14 nt, Homo sapiens
ucucagcaagagaa

SEQ ID NO: 1707965 - RNA, 20 nt, Homo sapiens
ucucaggggccaacuaggca

SEQ ID NO: 1707966 - RNA, 20 nt, Homo sapiens
ucucaggggugauaacucag

SEQ ID NO: 1707967 - RNA, 22 nt, Homo sapiens
ucucaucugcacccuucuuuuc

SEQ ID NO: 1707968 - RNA, 16 nt, Homo sapiens
ucagaaugcuauugaa

SEQ ID NO: 1707969 - RNA, 21 nt, Homo sapiens
ucagagaaggugcaggugaca

SEQ ID NO: 1707970 - RNA, 14 nt, Homo sapiens
ucagaucugucuga

SEQ ID NO: 1707971 - RNA, 22 nt, Homo sapiens
ucagauuguuaucuaucaacua

SEQ ID NO: 1707972 - RNA, 23 nt, Homo sapiens
ucagcacugaaaauaccaucagg

SEQ ID NO: 1707973 - RNA, 15 nt, Homo sapiens
ucagcaucugugaug

SEQ ID NO: 1707974 - RNA, 23 nt, Homo sapiens
ucagcaugauguguuguguauaa

SEQ ID NO: 1707975 - RNA, 22 nt, Homo sapiens
ucagccaacugcccuaacugua

SEQ ID NO: 1707976 - RNA, 15 nt, Homo sapiens
ucagccaagcuuguu

SEQ ID NO: 1707977 - RNA, 23 nt, Homo sapiens
ucagccaagcuuguuaucagcuu

SEQ ID NO: 1707978 - RNA, 23 nt, Homo sapiens
ucagcccccagccccucccccau

SEQ ID NO: 1707979 - RNA, 14 nt, Homo sapiens
ucagccccuaggag

SEQ ID NO: 1707980 - RNA, 17 nt, Homo sapiens
ucagccccucacauucc

SEQ ID NO: 1707981 - RNA, 19 nt, Homo sapiens
ucagccgcuucugacugcu

SEQ ID NO: 1707982 - RNA, 14 nt, Homo sapiens
ucagccucccaaag

SEQ ID NO: 1707983 - RNA, 19 nt, Homo sapiens
ucagccucccgaauagcug

SEQ ID NO: 1707984 - RNA, 13 nt, Homo sapiens
ucagccugcacag

SEQ ID NO: 1707985 - RNA, 19 nt, Homo sapiens
ucagcgugggccagaggca

SEQ ID NO: 1707986 - RNA, 20 nt, Homo sapiens
ucagcuaagggaagacauuu

SEQ ID NO: 1707987 - RNA, 22 nt, Homo sapiens
ucagcuccgacugccgcugaga

SEQ ID NO: 1707988 - RNA, 19 nt, Homo sapiens
ucagcucggggagccuuag

SEQ ID NO: 1707989 - RNA, 16 nt, Homo sapiens
ucagcucucuguauaa

SEQ ID NO: 1707990 - RNA, 13 nt, Homo sapiens
ucaggagucccaa

SEQ ID NO: 1707991 - RNA, 18 nt, Homo sapiens
ucaggcaggcaccuagca

SEQ ID NO: 1707992 - RNA, 21 nt, Homo sapiens
ucaggccagugugucucugaa

SEQ ID NO: 1707993 - RNA, 19 nt, Homo sapiens
ucagggccuggggccugag

SEQ ID NO: 1707994 - RNA, 13 nt, Homo sapiens
ucaggguccagug

SEQ ID NO: 1707995 - RNA, 15 nt, Homo sapiens
ucaguauuauucuac

SEQ ID NO: 1707996 - RNA, 20 nt, Homo sapiens
ucagucaacaacuuacacuu

SEQ ID NO: 1707997 - RNA, 21 nt, Homo sapiens
ucagucaacaacuuacacuua

SEQ ID NO: 1707998 - RNA, 17 nt, Homo sapiens
ucagucauuagacuccu

SEQ ID NO: 1707999 - RNA, 23 nt, Homo sapiens
ucagucccuauguauuugcaguu

SEQ ID NO: 1708000 - RNA, 21 nt, Homo sapiens
ucagugagauauuugguacca

SEQ ID NO: 1708001 - RNA, 13 nt, Homo sapiens
ucagugugucuaa

SEQ ID NO: 1708002 - RNA, 15 nt, Homo sapiens
ucaguugacagugua

SEQ ID NO: 1708003 - RNA, 15 nt, Homo sapiens
ucauaccuaaguacu

SEQ ID NO: 1708004 - RNA, 17 nt, Homo sapiens
ucauaccuaaguacugu

SEQ ID NO: 1708005 - RNA, 19 nt, Homo sapiens
ucauaccucagaauguaaa

SEQ ID NO: 1708006 - RNA, 16 nt, Homo sapiens
ucauaccucugaccaa

SEQ ID NO: 1708007 - RNA, 14 nt, Homo sapiens
ucauacuuccaucu

SEQ ID NO: 1708008 - RNA, 20 nt, Homo sapiens
ucauaggauuaagcaguuua

SEQ ID NO: 1708009 - RNA, 15 nt, Homo sapiens
ucauauugugccaau

SEQ ID NO: 1708010 - RNA, 14 nt, Homo sapiens
ucauauuuuguaua

SEQ ID NO: 1708011 - RNA, 21 nt, Homo sapiens
ucaucaaagcucacaccaaau

SEQ ID NO: 1708012 - RNA, 19 nt, Homo sapiens
ucaucacagggauuuagac

SEQ ID NO: 1708013 - RNA, 19 nt, Homo sapiens
ucaucauggaggucauaca

SEQ ID NO: 1708014 - RNA, 16 nt, Homo sapiens
ucauccacugugccau

SEQ ID NO: 1708015 - RNA, 23 nt, Homo sapiens
ucaucccaucuaagcugcagcuu

SEQ ID NO: 1708016 - RNA, 21 nt, Homo sapiens
ucaucgaaaauucauuucaca

SEQ ID NO: 1708017 - RNA, 18 nt, Homo sapiens
ucaucgggccagaaggcg

SEQ ID NO: 1708018 - RNA, 13 nt, Homo sapiens
ucaugaaaucagc

SEQ ID NO: 1708019 - RNA, 14 nt, Homo sapiens
ucaugcuucacuua

SEQ ID NO: 1708020 - RNA, 20 nt, Homo sapiens
ucaugcuuuaaaguguaaua

SEQ ID NO: 1708021 - RNA, 15 nt, Homo sapiens
ucauggguuaugugu

SEQ ID NO: 1708022 - RNA, 21 nt, Homo sapiens
ucauggguuauguguaugugc

SEQ ID NO: 1708023 - RNA, 17 nt, Homo sapiens
ucaugguagagaaucuc

SEQ ID NO: 1708024 - RNA, 14 nt, Homo sapiens
ucauguauauaccu

SEQ ID NO: 1708025 - RNA, 19 nt, Homo sapiens
ucaugugcugccugcaagc

SEQ ID NO: 1708026 - RNA, 17 nt, Homo sapiens
ucauguggcuguagauc

SEQ ID NO: 1708027 - RNA, 16 nt, Homo sapiens
ucauguguucccuuug

SEQ ID NO: 1708028 - RNA, 16 nt, Homo sapiens
ucauuagcugugauuu

SEQ ID NO: 1708029 - RNA, 16 nt, Homo sapiens
ucauucaauauugaca

SEQ ID NO: 1708030 - RNA, 16 nt, Homo sapiens
ucauuccaccuuccca

SEQ ID NO: 1708031 - RNA, 17 nt, Homo sapiens
ucauucucauaauuccu

SEQ ID NO: 1708032 - RNA, 16 nt, Homo sapiens
ucauucugcauugcua

SEQ ID NO: 1708033 - RNA, 17 nt, Homo sapiens
ucauugcuuugaagcag

SEQ ID NO: 1708034 - RNA, 22 nt, Homo sapiens
ucauuguaaacaaacucuugaa

SEQ ID NO: 1708035 - RNA, 20 nt, Homo sapiens
ucauuuauuuacaugugauu

SEQ ID NO: 1708036 - RNA, 23 nt, Homo sapiens
ucauuucauuguaugauguguug

SEQ ID NO: 1708037 - RNA, 18 nt, Homo sapiens
ucauuuccccauaacuca

SEQ ID NO: 1708038 - RNA, 10 nt, Homo sapiens
uccaaaaaga

SEQ ID NO: 1708039 - RNA, 17 nt, Homo sapiens
uccaaaggucugauguc

SEQ ID NO: 1708040 - RNA, 21 nt, Homo sapiens
uauuucaacuaauauaucuau

SEQ ID NO: 1708041 - RNA, 13 nt, Homo sapiens
uauuucauuuuaa

SEQ ID NO: 1708042 - RNA, 14 nt, Homo sapiens
uauuucuacacagu

SEQ ID NO: 1708043 - RNA, 17 nt, Homo sapiens
uauuucucaacaaagca

SEQ ID NO: 1708044 - RNA, 21 nt, Homo sapiens
uauuucucaacaaagcacagu

SEQ ID NO: 1708045 - RNA, 16 nt, Homo sapiens
uauuucucugaauuca

SEQ ID NO: 1708046 - RNA, 16 nt, Homo sapiens
uauuucugucauucaa

SEQ ID NO: 1708047 - RNA, 15 nt, Homo sapiens
uauuucuugcauuca

SEQ ID NO: 1708048 - RNA, 19 nt, Homo sapiens
uauuugcacacugcacugu

SEQ ID NO: 1708049 - RNA, 16 nt, Homo sapiens
uauuugcuuuuugcua

SEQ ID NO: 1708050 - RNA, 21 nt, Homo sapiens
uauuugggagggaaaagggaa

SEQ ID NO: 1708051 - RNA, 17 nt, Homo sapiens
uauuugugucacaaaga

SEQ ID NO: 1708052 - RNA, 16 nt, Homo sapiens
uauuuuaagcacucuu

SEQ ID NO: 1708053 - RNA, 13 nt, Homo sapiens
uauuuuacacaga

SEQ ID NO: 1708054 - RNA, 13 nt, Homo sapiens
uauuuuacuuuaa

SEQ ID NO: 1708055 - RNA, 19 nt, Homo sapiens
uauuuuccccuagcuuucc

SEQ ID NO: 1708056 - RNA, 22 nt, Homo sapiens
uauuuucuuacccaauuuccca

SEQ ID NO: 1708057 - RNA, 21 nt, Homo sapiens
uauuuuuauacaaaccuacca

SEQ ID NO: 1708058 - RNA, 23 nt, Homo sapiens
uauuuuugcccugaguccaagag

SEQ ID NO: 1708059 - RNA, 18 nt, Homo sapiens
ucaaaaccucaaauccac

SEQ ID NO: 1708060 - RNA, 14 nt, Homo sapiens
ucaaaauccaaaaa

SEQ ID NO: 1708061 - RNA, 18 nt, Homo sapiens
ucaaaauccuuccaaaga

SEQ ID NO: 1708062 - RNA, 19 nt, Homo sapiens
ucaaaauccuuccaaagaa

SEQ ID NO: 1708063 - RNA, 14 nt, Homo sapiens
ucaaaaugcuuuuu

SEQ ID NO: 1708064 - RNA, 17 nt, Homo sapiens
ucaaacugcaugauuca

SEQ ID NO: 1708065 - RNA, 21 nt, Homo sapiens
ucaaagcuuuuuccagaggcu

SEQ ID NO: 1708066 - RNA, 14 nt, Homo sapiens
ucaaauauuucaac

SEQ ID NO: 1708067 - RNA, 21 nt, Homo sapiens
ucaaaucaggguccaguggga

SEQ ID NO: 1708068 - RNA, 12 nt, Homo sapiens
ucaaaucuccag

SEQ ID NO: 1708069 - RNA, 16 nt, Homo sapiens
ucaaauggguuuucca

SEQ ID NO: 1708070 - RNA, 17 nt, Homo sapiens
ucaaauuaagugugcau

SEQ ID NO: 1708071 - RNA, 23 nt, Homo sapiens
ucaacaagauuuccuugugcaaa

SEQ ID NO: 1708072 - RNA, 14 nt, Homo sapiens
ucaacagcuaugcu

SEQ ID NO: 1708073 - RNA, 20 nt, Homo sapiens
ucaacaucuuuuacauucug

SEQ ID NO: 1708074 - RNA, 17 nt, Homo sapiens
ucaaccagauaacauac

SEQ ID NO: 1708075 - RNA, 19 nt, Homo sapiens
ucaacucguuuuuauauua

SEQ ID NO: 1708076 - RNA, 15 nt, Homo sapiens
ucaagaaacugagga

SEQ ID NO: 1708077 - RNA, 18 nt, Homo sapiens
ucaagacuuccucaugaa

SEQ ID NO: 1708078 - RNA, 18 nt, Homo sapiens
ucaagcaccugcaugugc

SEQ ID NO: 1708079 - RNA, 17 nt, Homo sapiens
ucaagcacuuacagcuc

SEQ ID NO: 1708080 - RNA, 14 nt, Homo sapiens
ucaaggaauuugca

SEQ ID NO: 1708081 - RNA, 17 nt, Homo sapiens
ucaagguggucaguaaa

SEQ ID NO: 1708082 - RNA, 16 nt, Homo sapiens
ucaaguacaccagcca

SEQ ID NO: 1708083 - RNA, 18 nt, Homo sapiens
ucaaguggagagaaauca

SEQ ID NO: 1708084 - RNA, 19 nt, Homo sapiens
ucaauaaagauuucaagau

SEQ ID NO: 1708085 - RNA, 17 nt, Homo sapiens
ucaauaauauuagcuua

SEQ ID NO: 1708086 - RNA, 12 nt, Homo sapiens
ucaauagcuguc

SEQ ID NO: 1708087 - RNA, 20 nt, Homo sapiens
ucaauauccaccccauccaa

SEQ ID NO: 1708088 - RNA, 23 nt, Homo sapiens
ucaaugaaaaaaaguacauguau

SEQ ID NO: 1708089 - RNA, 24 nt, Homo sapiens
ucaaugaagccagcucacagugcu

SEQ ID NO: 1708090 - RNA, 21 nt, Homo sapiens
ucaaugauuauuuucauuaca

SEQ ID NO: 1708091 - RNA, 10 nt, Homo sapiens
ucaauggagu

SEQ ID NO: 1708092 - RNA, 21 nt, Homo sapiens
ucaauggaguaugucugaugg

SEQ ID NO: 1708093 - RNA, 20 nt, Homo sapiens
ucaaugggcucuuccaacaa

SEQ ID NO: 1708094 - RNA, 12 nt, Homo sapiens
ucaaugugaaaa

SEQ ID NO: 1708095 - RNA, 23 nt, Homo sapiens
ucaauguuuguaauaauugcuca

SEQ ID NO: 1708096 - RNA, 22 nt, Homo sapiens
ucaauucccacguagacucuua

SEQ ID NO: 1708097 - RNA, 23 nt, Homo sapiens
ucacaaagaguucuggaaaagaa

SEQ ID NO: 1708098 - RNA, 18 nt, Homo sapiens
ucacaauagauuucucaa

SEQ ID NO: 1708099 - RNA, 19 nt, Homo sapiens
ucacaaugucaguauuuca

SEQ ID NO: 1708100 - RNA, 18 nt, Homo sapiens
ucacacauccgcuucaua

SEQ ID NO: 1708101 - RNA, 20 nt, Homo sapiens
ucacacccugcaaggcccac

SEQ ID NO: 1708102 - RNA, 16 nt, Homo sapiens
ucacacucauaacuca

SEQ ID NO: 1708103 - RNA, 18 nt, Homo sapiens
ucacagagugcauuguga

SEQ ID NO: 1708104 - RNA, 12 nt, Homo sapiens
ucacagggccaa

SEQ ID NO: 1708105 - RNA, 22 nt, Homo sapiens
ucacagggguucccuucucuca

SEQ ID NO: 1708106 - RNA, 21 nt, Homo sapiens
ucacaguaacccaaaccucaa

SEQ ID NO: 1708107 - RNA, 19 nt, Homo sapiens
ucacaguuagguagcuuua

SEQ ID NO: 1708108 - RNA, 18 nt, Homo sapiens
ucacaguugacaaaaagc

SEQ ID NO: 1708109 - RNA, 23 nt, Homo sapiens
ucacaucuuaugcuaacuguaga

SEQ ID NO: 1708110 - RNA, 15 nt, Homo sapiens
ucacaugaccugauc

SEQ ID NO: 1708111 - RNA, 17 nt, Homo sapiens
ucacaugaccugaucac

SEQ ID NO: 1708112 - RNA, 17 nt, Homo sapiens
ucacauggccuaugcac

SEQ ID NO: 1708113 - RNA, 18 nt, Homo sapiens
ucacauggccuaugcaca

SEQ ID NO: 1708114 - RNA, 16 nt, Homo sapiens
gcugggauuacaggug

SEQ ID NO: 1708115 - RNA, 18 nt, Homo sapiens
gcugggcaugguggcgca

SEQ ID NO: 1708116 - RNA, 19 nt, Homo sapiens
gcugggccauguccaaaga

SEQ ID NO: 1708117 - RNA, 19 nt, Homo sapiens
gcuggguauuggaaaugga

SEQ ID NO: 1708118 - RNA, 16 nt, Homo sapiens
gcugucaagcaccugc

SEQ ID NO: 1708119 - RNA, 19 nt, Homo sapiens
gcugugaggccccuggaca

SEQ ID NO: 1708120 - RNA, 19 nt, Homo sapiens
gcuguggaggauugcuauc

SEQ ID NO: 1708121 - RNA, 17 nt, Homo sapiens
gcuguucucuucuucau

SEQ ID NO: 1708122 - RNA, 14 nt, Homo sapiens
gcuguuuguuucau

SEQ ID NO: 1708123 - RNA, 21 nt, Homo sapiens
gcuguuuugauuuguacugaa

SEQ ID NO: 1708124 - RNA, 20 nt, Homo sapiens
gcuuaagugccuaugggaau

SEQ ID NO: 1708125 - RNA, 16 nt, Homo sapiens
gcuuacuuaugccaua

SEQ ID NO: 1708126 - RNA, 16 nt, Homo sapiens
gcuuaguuaucagcuu

SEQ ID NO: 1708127 - RNA, 15 nt, Homo sapiens
uaggauuaauaaaga

SEQ ID NO: 1708128 - RNA, 17 nt, Homo sapiens
uaggcauguagcuacag

SEQ ID NO: 1708129 - RNA, 18 nt, Homo sapiens
uaggccccuuugaggcuc

SEQ ID NO: 1708130 - RNA, 14 nt, Homo sapiens
uaggccuaccugau

SEQ ID NO: 1708131 - RNA, 14 nt, Homo sapiens
uagggaagcucagg

SEQ ID NO: 1708132 - RNA, 22 nt, Homo sapiens
uagggacucagggccaugccug

SEQ ID NO: 1708133 - RNA, 11 nt, Homo sapiens
uagguggcaag

SEQ ID NO: 1708134 - RNA, 15 nt, Homo sapiens
uagguggcugagcau

SEQ ID NO: 1708135 - RNA, 19 nt, Homo sapiens
uagguucaggaagaccaca

SEQ ID NO: 1708136 - RNA, 22 nt, Homo sapiens
uagucaacaugccauaucucau

SEQ ID NO: 1708137 - RNA, 21 nt, Homo sapiens
uagucacauggccuaugcaca

SEQ ID NO: 1708138 - RNA, 23 nt, Homo sapiens
uagucaccccaaguagucugcuc

SEQ ID NO: 1708139 - RNA, 13 nt, Homo sapiens
uaguccaaaaagc

SEQ ID NO: 1708140 - RNA, 22 nt, Homo sapiens
uaguccaaauaacaaguaccaa

SEQ ID NO: 1708141 - RNA, 19 nt, Homo sapiens
uaguccggacccaccucac

SEQ ID NO: 1708142 - RNA, 16 nt, Homo sapiens
uagucuguacuucauc

SEQ ID NO: 1708143 - RNA, 17 nt, Homo sapiens
uagugaccccugccuac

SEQ ID NO: 1708144 - RNA, 14 nt, Homo sapiens
uagugacuaugaac

SEQ ID NO: 1708145 - RNA, 13 nt, Homo sapiens
uagugcacaaaau

SEQ ID NO: 1708146 - RNA, 19 nt, Homo sapiens
uagugcacaaaaugaauga

SEQ ID NO: 1708147 - RNA, 16 nt, Homo sapiens
uagugcagaaucucau

SEQ ID NO: 1708148 - RNA, 18 nt, Homo sapiens
uaguguccaaauucucac

SEQ ID NO: 1708149 - RNA, 16 nt, Homo sapiens
uaguguuggggauccu

SEQ ID NO: 1708150 - RNA, 13 nt, Homo sapiens
uaguucuaccuca

SEQ ID NO: 1708151 - RNA, 21 nt, Homo sapiens
uaguugaucuacaaaggccau

SEQ ID NO: 1708152 - RNA, 19 nt, Homo sapiens
uaguuugagaaaugcauag

SEQ ID NO: 1708153 - RNA, 23 nt, Homo sapiens
uaguuuuaaacucauuuuugcca

SEQ ID NO: 1708154 - RNA, 15 nt, Homo sapiens
uauaaaaagcuucca

SEQ ID NO: 1708155 - RNA, 15 nt, Homo sapiens
uauaaaauuaaucac

SEQ ID NO: 1708156 - RNA, 17 nt, Homo sapiens
uauaaacuguaugcuca

SEQ ID NO: 1708157 - RNA, 22 nt, Homo sapiens
uauaaagaagaacuugcaugga

SEQ ID NO: 1708158 - RNA, 16 nt, Homo sapiens
uauaaagcaacuguua

SEQ ID NO: 1708159 - RNA, 22 nt, Homo sapiens
uauaaccacaaagcacaguuug

SEQ ID NO: 1708160 - RNA, 22 nt, Homo sapiens
uauaacuaagacauaugcauuu

SEQ ID NO: 1708161 - RNA, 22 nt, Homo sapiens
uauaagaaaugcauaugucacu

SEQ ID NO: 1708162 - RNA, 17 nt, Homo sapiens
uauaauucacucaagca

SEQ ID NO: 1708163 - RNA, 15 nt, Homo sapiens
uauaauuucuguuca

SEQ ID NO: 1708164 - RNA, 15 nt, Homo sapiens
uauacaccauauacu

SEQ ID NO: 1708165 - RNA, 12 nt, Homo sapiens
uauacagaggaa

SEQ ID NO: 1708166 - RNA, 23 nt, Homo sapiens
uauacagauagaguuccauauau

SEQ ID NO: 1708167 - RNA, 16 nt, Homo sapiens
uauacaggcauaaaau

SEQ ID NO: 1708168 - RNA, 17 nt, Homo sapiens
uauacauguguguauau

SEQ ID NO: 1708169 - RNA, 12 nt, Homo sapiens
uauacauuugau

SEQ ID NO: 1708170 - RNA, 17 nt, Homo sapiens
uauaccaucuccagcua

SEQ ID NO: 1708171 - RNA, 20 nt, Homo sapiens
uauacugguucacauccuac

SEQ ID NO: 1708172 - RNA, 15 nt, Homo sapiens
uauacuuuaguauga

SEQ ID NO: 1708173 - RNA, 13 nt, Homo sapiens
uauagaaacacca

SEQ ID NO: 1708174 - RNA, 14 nt, Homo sapiens
uauagaaguagcaa

SEQ ID NO: 1708175 - RNA, 16 nt, Homo sapiens
uauagaaguuugucca

SEQ ID NO: 1708176 - RNA, 21 nt, Homo sapiens
uauagagggcuuaugauucag

SEQ ID NO: 1708177 - RNA, 20 nt, Homo sapiens
uauagccuauggcagaaaaa

SEQ ID NO: 1708178 - RNA, 15 nt, Homo sapiens
uauagcguucccaac

SEQ ID NO: 1708179 - RNA, 23 nt, Homo sapiens
uauagcguucccaacaacaucca

SEQ ID NO: 1708180 - RNA, 22 nt, Homo sapiens
uauaggaucauuuguuggaaug

SEQ ID NO: 1708181 - RNA, 19 nt, Homo sapiens
uauaguaacacacuuccag

SEQ ID NO: 1708182 - RNA, 14 nt, Homo sapiens
uauaguacaugaua

SEQ ID NO: 1708183 - RNA, 17 nt, Homo sapiens
uauauacccacauguac

SEQ ID NO: 1708184 - RNA, 14 nt, Homo sapiens
uauaucaucuauca

SEQ ID NO: 1708185 - RNA, 17 nt, Homo sapiens
uauaucuguggucuuca

SEQ ID NO: 1708186 - RNA, 14 nt, Homo sapiens
uauauguacaugag

SEQ ID NO: 1708187 - RNA, 12 nt, Homo sapiens
uauauguaccgu

SEQ ID NO: 1708188 - RNA, 22 nt, Homo sapiens
uauauuugaaaaaaacuucauu

SEQ ID NO: 1708189 - RNA, 24 nt, Homo sapiens
uaucaaagagaaguuacauauuag

SEQ ID NO: 1708190 - RNA, 15 nt, Homo sapiens
uaucauacuguucaa

SEQ ID NO: 1708191 - RNA, 13 nt, Homo sapiens
uaucauacuucca

SEQ ID NO: 1708192 - RNA, 21 nt, Homo sapiens
uaucaucacauugagcugaua

SEQ ID NO: 1708193 - RNA, 16 nt, Homo sapiens
uaucauuggaacaacu

SEQ ID NO: 1708194 - RNA, 22 nt, Homo sapiens
uauccaacaagccagaaucagc

SEQ ID NO: 1708195 - RNA, 20 nt, Homo sapiens
uauccacuacuccgugaagg

SEQ ID NO: 1708196 - RNA, 19 nt, Homo sapiens
uauccagaggguugugauu

SEQ ID NO: 1708197 - RNA, 22 nt, Homo sapiens
uaucccacauccaacuccagca

SEQ ID NO: 1708198 - RNA, 18 nt, Homo sapiens
uaucccauugaaacaaaa

SEQ ID NO: 1708199 - RNA, 17 nt, Homo sapiens
uaucccgagucugggac

SEQ ID NO: 1708200 - RNA, 19 nt, Homo sapiens
uauccuuggcaccaaagau

SEQ ID NO: 1708201 - RNA, 23 nt, Homo sapiens
uaucuaauauguaacaagccacc

SEQ ID NO: 1708202 - RNA, 17 nt, Homo sapiens
uaucuaguacuucccag

SEQ ID NO: 1708203 - RNA, 20 nt, Homo sapiens
uaucuauagcuaaguacaca

SEQ ID NO: 1708204 - RNA, 22 nt, Homo sapiens
uaucuauaguagacacacuauc

SEQ ID NO: 1708205 - RNA, 21 nt, Homo sapiens
uaucugaguugccaagacaaa

SEQ ID NO: 1708206 - RNA, 23 nt, Homo sapiens
uaucuggcccucgacacucacca

SEQ ID NO: 1708207 - RNA, 15 nt, Homo sapiens
uaucugugucaaaag

SEQ ID NO: 1708208 - RNA, 22 nt, Homo sapiens
uaucuugcgaauccaagcuccc

SEQ ID NO: 1708209 - RNA, 14 nt, Homo sapiens
uaucuuucaaagag

SEQ ID NO: 1708210 - RNA, 17 nt, Homo sapiens
uaucuuugugugacaug

SEQ ID NO: 1708211 - RNA, 16 nt, Homo sapiens
uaugaacaacuccaaa

SEQ ID NO: 1708212 - RNA, 16 nt, Homo sapiens
uaugacaucacuugua

SEQ ID NO: 1708213 - RNA, 17 nt, Homo sapiens
uaugagcagaaggaaac

SEQ ID NO: 1708214 - RNA, 22 nt, Homo sapiens
uaugagccgugaacugugcaua

SEQ ID NO: 1708215 - RNA, 22 nt, Homo sapiens
uaugaugaugaaaauuuuacca

SEQ ID NO: 1708216 - RNA, 18 nt, Homo sapiens
uaugauucagauuguuau

SEQ ID NO: 1708217 - RNA, 17 nt, Homo sapiens
uaugauuguuucucaaa

SEQ ID NO: 1708218 - RNA, 21 nt, Homo sapiens
uaugcaaaucaaacauauucu

SEQ ID NO: 1708219 - RNA, 21 nt, Homo sapiens
uaugcaguaaauuaucuuggg

SEQ ID NO: 1708220 - RNA, 12 nt, Homo sapiens
uaugcagugaua

SEQ ID NO: 1708221 - RNA, 15 nt, Homo sapiens
uaugcauuugcauuu

SEQ ID NO: 1708222 - RNA, 20 nt, Homo sapiens
uaugcauuugcauuugcucu

SEQ ID NO: 1708223 - RNA, 21 nt, Homo sapiens
uaugccuuuuuccuagccugu

SEQ ID NO: 1708224 - RNA, 21 nt, Homo sapiens
uaugcucucgcaccuuuccaa

SEQ ID NO: 1708225 - RNA, 20 nt, Homo sapiens
uauggacaguaaguccagua

SEQ ID NO: 1708226 - RNA, 16 nt, Homo sapiens
uauggagaauugcuga

SEQ ID NO: 1708227 - RNA, 15 nt, Homo sapiens
uaugggggcacugag

SEQ ID NO: 1708228 - RNA, 16 nt, Homo sapiens
uauguaaaguauguaa

SEQ ID NO: 1708229 - RNA, 15 nt, Homo sapiens
uauguacaaguguug

SEQ ID NO: 1708230 - RNA, 13 nt, Homo sapiens
uauguagcacaua

SEQ ID NO: 1708231 - RNA, 23 nt, Homo sapiens
uauguaguaauugacaugugcca

SEQ ID NO: 1708232 - RNA, 17 nt, Homo sapiens
uauguaugaguaucugu

SEQ ID NO: 1708233 - RNA, 16 nt, Homo sapiens
uaugucagcaguauug

SEQ ID NO: 1708234 - RNA, 20 nt, Homo sapiens
uaugucuuggacacuguaca

SEQ ID NO: 1708235 - RNA, 13 nt, Homo sapiens
uaugugacaccaa

SEQ ID NO: 1708236 - RNA, 20 nt, Homo sapiens
aaagaaauccauaucuuaaa

SEQ ID NO: 1708237 - RNA, 13 nt, Homo sapiens
aaagaaccagaga

SEQ ID NO: 1708238 - RNA, 13 nt, Homo sapiens
aaagaauuugcac

SEQ ID NO: 1708239 - RNA, 14 nt, Homo sapiens
aaagacaccauuua

SEQ ID NO: 1708240 - RNA, 12 nt, Homo sapiens
aaagacacugcc

SEQ ID NO: 1708241 - RNA, 19 nt, Homo sapiens
aaagacauucuuccaaaaa

SEQ ID NO: 1708242 - RNA, 22 nt, Homo sapiens
aaagaugcaaggaccaggacuc

SEQ ID NO: 1708243 - RNA, 20 nt, Homo sapiens
aaagaugcagccgccuuccu

SEQ ID NO: 1708244 - RNA, 21 nt, Homo sapiens
aaagauggcugugccucugcc

SEQ ID NO: 1708245 - RNA, 21 nt, Homo sapiens
aaagauuauagaaguagcaaa

SEQ ID NO: 1708246 - RNA, 20 nt, Homo sapiens
aaagauugauuaaugaacua

SEQ ID NO: 1708247 - RNA, 15 nt, Homo sapiens
aaagauuuucagaaa

SEQ ID NO: 1708248 - RNA, 15 nt, Homo sapiens
aaagcaccuuagcug

SEQ ID NO: 1708249 - RNA, 22 nt, Homo sapiens
aaagcacuguagcccuggaccu

SEQ ID NO: 1708250 - RNA, 17 nt, Homo sapiens
aaagcaguaaauuugcu

SEQ ID NO: 1708251 - RNA, 21 nt, Homo sapiens
aaagcauauuggugcuagaaa

SEQ ID NO: 1708252 - RNA, 19 nt, Homo sapiens
aaagccagggucucucccu

SEQ ID NO: 1708253 - RNA, 16 nt, Homo sapiens
aaagccugcaauuuca

SEQ ID NO: 1708254 - RNA, 13 nt, Homo sapiens
aaagccuugugua

SEQ ID NO: 1708255 - RNA, 16 nt, Homo sapiens
aaagccuuguguauau

SEQ ID NO: 1708256 - RNA, 17 nt, Homo sapiens
aaagcugaggacagggu

SEQ ID NO: 1708257 - RNA, 13 nt, Homo sapiens
aaagcugcugaca

SEQ ID NO: 1708258 - RNA, 18 nt, Homo sapiens
aaagcuguuaaacuguua

SEQ ID NO: 1708259 - RNA, 21 nt, Homo sapiens
aaagcuuuuuacucaaagagu

SEQ ID NO: 1708260 - RNA, 15 nt, Homo sapiens
aaagcuuuuuccucc

SEQ ID NO: 1708261 - RNA, 20 nt, Homo sapiens
aaagcuuuuuccuccuggaa

SEQ ID NO: 1708262 - RNA, 14 nt, Homo sapiens
aaaggaagucagua

SEQ ID NO: 1708263 - RNA, 22 nt, Homo sapiens
aaaggacaucagcaaacaggau

SEQ ID NO: 1708264 - RNA, 12 nt, Homo sapiens
aaaggacuguaa

SEQ ID NO: 1708265 - RNA, 22 nt, Homo sapiens
aaaggcccccuacgccaaucaa

SEQ ID NO: 1708266 - RNA, 15 nt, Homo sapiens
aaaggcugguggcaa

SEQ ID NO: 1708267 - RNA, 21 nt, Homo sapiens
aaagggaucaucaugcagcuc

SEQ ID NO: 1708268 - RNA, 16 nt, Homo sapiens
aaagggccauguuuca

SEQ ID NO: 1708269 - RNA, 15 nt, Homo sapiens
aaagggcuugggaga

SEQ ID NO: 1708270 - RNA, 13 nt, Homo sapiens
aaaggggcacugg

SEQ ID NO: 1708271 - RNA, 23 nt, Homo sapiens
aaagggggugggauggggguacu

SEQ ID NO: 1708272 - RNA, 20 nt, Homo sapiens
aaagguauuuugaauaccau

SEQ ID NO: 1708273 - RNA, 16 nt, Homo sapiens
aaagguugagauguaa

SEQ ID NO: 1708274 - RNA, 22 nt, Homo sapiens
aaagguuuuaaccgcacaugca

SEQ ID NO: 1708275 - RNA, 17 nt, Homo sapiens
aaaguaaauucauguaa

SEQ ID NO: 1708276 - RNA, 19 nt, Homo sapiens
aaaguacaucucuacuaaa

SEQ ID NO: 1708277 - RNA, 23 nt, Homo sapiens
aaaguagcagugugaaguacaau

SEQ ID NO: 1708278 - RNA, 13 nt, Homo sapiens
aaagucaaaaaua

SEQ ID NO: 1708279 - RNA, 22 nt, Homo sapiens
aaagucaccacuccauucccaa

SEQ ID NO: 1708280 - RNA, 23 nt, Homo sapiens
aaagugaaccacaagacucccuc

SEQ ID NO: 1708281 - RNA, 23 nt, Homo sapiens
aaaguuaugguacuauguuagcc

SEQ ID NO: 1708282 - RNA, 15 nt, Homo sapiens
aaaguuauugugaua

SEQ ID NO: 1708283 - RNA, 23 nt, Homo sapiens
aaaguucccuacuuccugugacu

SEQ ID NO: 1708284 - RNA, 17 nt, Homo sapiens
aaaguuucucuuuucaa

SEQ ID NO: 1708285 - RNA, 14 nt, Homo sapiens
aaauaaaacuuaaa

SEQ ID NO: 1708286 - RNA, 12 nt, Homo sapiens
aaauaauaugca

SEQ ID NO: 1708287 - RNA, 17 nt, Homo sapiens
aaauaauucaugauuca

SEQ ID NO: 1708288 - RNA, 20 nt, Homo sapiens
aaauaccuauaugaauauga

SEQ ID NO: 1708289 - RNA, 20 nt, Homo sapiens
aaauacuguguggaacuuuu

SEQ ID NO: 1708290 - RNA, 20 nt, Homo sapiens
aaauagaguaaauacaggua

SEQ ID NO: 1708291 - RNA, 15 nt, Homo sapiens
aaauagcugccuuuu

SEQ ID NO: 1708292 - RNA, 14 nt, Homo sapiens
aaauagucuucuca

SEQ ID NO: 1708293 - RNA, 15 nt, Homo sapiens
aaauaguuguccaua

SEQ ID NO: 1708294 - RNA, 16 nt, Homo sapiens
aaauauacuggggcuu

SEQ ID NO: 1708295 - RNA, 15 nt, Homo sapiens
aaauauauaagcuca

SEQ ID NO: 1708296 - RNA, 18 nt, Homo sapiens
aaauaucauacuguucaa

SEQ ID NO: 1708297 - RNA, 17 nt, Homo sapiens
aaauauugcuucaauaa

SEQ ID NO: 1708298 - RNA, 20 nt, Homo sapiens
aaauauugucauaggauuaa

SEQ ID NO: 1708299 - RNA, 17 nt, Homo sapiens
aaauauuugacuugcau

SEQ ID NO: 1708300 - RNA, 14 nt, Homo sapiens
aaauauuuuugcca

SEQ ID NO: 1708301 - RNA, 21 nt, Homo sapiens
aaaucauaguuuaaacugcau

SEQ ID NO: 1708302 - RNA, 21 nt, Homo sapiens
aaaucauggcaacauaauuca

SEQ ID NO: 1708303 - RNA, 19 nt, Homo sapiens
aaaucauuaauacucuucu

SEQ ID NO: 1708304 - RNA, 16 nt, Homo sapiens
aaaucauuuauuuaca

SEQ ID NO: 1708305 - RNA, 13 nt, Homo sapiens
aaauccaguucua

SEQ ID NO: 1708306 - RNA, 22 nt, Homo sapiens
aaauccccuuaugacuugcuac

SEQ ID NO: 1708307 - RNA, 13 nt, Homo sapiens
aaauccuuccaaa

SEQ ID NO: 1708308 - RNA, 17 nt, Homo sapiens
aaauccuuccaaaaauu

SEQ ID NO: 1708309 - RNA, 15 nt, Homo sapiens
aaaucguuuauuuca

SEQ ID NO: 1708310 - RNA, 16 nt, Homo sapiens
aaaucuaaaucuucag

SEQ ID NO: 1708311 - RNA, 22 nt, Homo sapiens
aaaucuauucuguguugcauua

SEQ ID NO: 1708312 - RNA, 22 nt, Homo sapiens
aaaucucaaugaagccagcuca

SEQ ID NO: 1708313 - RNA, 13 nt, Homo sapiens
aaaucucuaauau

SEQ ID NO: 1708314 - RNA, 23 nt, Homo sapiens
aaaucuggcuccuuuacaaaaga

SEQ ID NO: 1708315 - RNA, 16 nt, Homo sapiens
aaaucuuauaguucua

SEQ ID NO: 1708316 - RNA, 19 nt, Homo sapiens
aaaucuuuuaaaaauucaa

SEQ ID NO: 1708317 - RNA, 19 nt, Homo sapiens
aaaugaaacaaauaaucac

SEQ ID NO: 1708318 - RNA, 21 nt, Homo sapiens
aaaugaaggcagaaaaauguc

SEQ ID NO: 1708319 - RNA, 16 nt, Homo sapiens
aaaugcaaaguucugu

SEQ ID NO: 1708320 - RNA, 21 nt, Homo sapiens
aaaugcacgucacaggcucag

SEQ ID NO: 1708321 - RNA, 18 nt, Homo sapiens
aaauggugcuuaaguucc

SEQ ID NO: 1708322 - RNA, 19 nt, Homo sapiens
aaauguccauuuauaucau

SEQ ID NO: 1708323 - RNA, 19 nt, Homo sapiens
aaaugucuuuguaagucag

SEQ ID NO: 1708324 - RNA, 16 nt, Homo sapiens
aaaugugaagugaaug

SEQ ID NO: 1708325 - RNA, 19 nt, Homo sapiens
aaaugugguuacacacuuu

SEQ ID NO: 1708326 - RNA, 19 nt, Homo sapiens
aaauguucuaaguuucuaa

SEQ ID NO: 1708327 - RNA, 23 nt, Homo sapiens
aaauuaaacgguaacauccaaaa

SEQ ID NO: 1708328 - RNA, 12 nt, Homo sapiens
aaauuacuaauu

SEQ ID NO: 1708329 - RNA, 20 nt, Homo sapiens
aaauuagaaaguagccacgu

SEQ ID NO: 1708330 - RNA, 19 nt, Homo sapiens
aaauuagcugggcauggug

SEQ ID NO: 1708331 - RNA, 14 nt, Homo sapiens
aaauuauaguuuca

SEQ ID NO: 1708332 - RNA, 17 nt, Homo sapiens
aaauuaugaccauggua

SEQ ID NO: 1708333 - RNA, 14 nt, Homo sapiens
aaauuaugugacau

SEQ ID NO: 1708334 - RNA, 19 nt, Homo sapiens
aaauuauugcuguauguaa

SEQ ID NO: 1708335 - RNA, 14 nt, Homo sapiens
aaauuauuugucau

SEQ ID NO: 1708336 - RNA, 16 nt, Homo sapiens
aaauucacaaacuuuu

SEQ ID NO: 1708337 - RNA, 17 nt, Homo sapiens
aaauucagaugcuguua

SEQ ID NO: 1708338 - RNA, 19 nt, Homo sapiens
aaauuccacacuaccacau

SEQ ID NO: 1708339 - RNA, 20 nt, Homo sapiens
aaauuccacacuaccacauu

SEQ ID NO: 1708340 - RNA, 14 nt, Homo sapiens
aaauuccagaagaa

SEQ ID NO: 1708341 - RNA, 22 nt, Homo sapiens
aaauucccaacuucucuugcuu

SEQ ID NO: 1708342 - RNA, 19 nt, Homo sapiens
aaauucuaaagagcacuua

SEQ ID NO: 1708343 - RNA, 19 nt, Homo sapiens
aaauucuagagccagcugu

SEQ ID NO: 1708344 - RNA, 9 nt, Homo sapiens
aaauucugu

SEQ ID NO: 1708345 - RNA, 15 nt, Homo sapiens
aauuugagauucuac

SEQ ID NO: 1708346 - RNA, 17 nt, Homo sapiens
aauuuuauaacagaauu

SEQ ID NO: 1708347 - RNA, 21 nt, Homo sapiens
aauuuucuagauuuucuacuu

SEQ ID NO: 1708348 - RNA, 21 nt, Homo sapiens
aauuuucuucauacuuaaaaa

SEQ ID NO: 1708349 - RNA, 19 nt, Homo sapiens
aauuuuguuuguugaugug

SEQ ID NO: 1708350 - RNA, 14 nt, Homo sapiens
aauuuuuccaugaa

SEQ ID NO: 1708351 - RNA, 16 nt, Homo sapiens
aauuuuugaaaacugg

SEQ ID NO: 1708352 - RNA, 19 nt, Homo sapiens
aauuuuugcuaugcuguaa

SEQ ID NO: 1708353 - RNA, 21 nt, Homo sapiens
aauuuuuucccagacuacuau

SEQ ID NO: 1708354 - RNA, 15 nt, Homo sapiens
acaaaaugauuuuga

SEQ ID NO: 1708355 - RNA, 23 nt, Homo sapiens
acaaaccacaacugacacaggaa

SEQ ID NO: 1708356 - RNA, 14 nt, Homo sapiens
acaaagaaauauua

SEQ ID NO: 1708357 - RNA, 16 nt, Homo sapiens
acaaagcacaguuuga

SEQ ID NO: 1708358 - RNA, 17 nt, Homo sapiens
acaaagcacaguuugaa

SEQ ID NO: 1708359 - RNA, 18 nt, Homo sapiens
acaaagcccuuccauguc

SEQ ID NO: 1708360 - RNA, 19 nt, Homo sapiens
acaaagcuguuaaacuguu

SEQ ID NO: 1708361 - RNA, 22 nt, Homo sapiens
acaaaggaguaguagcugaauu

SEQ ID NO: 1708362 - RNA, 14 nt, Homo sapiens
acaaaggcugagaa

SEQ ID NO: 1708363 - RNA, 23 nt, Homo sapiens
acaaaguuacugauucacugcau

SEQ ID NO: 1708364 - RNA, 14 nt, Homo sapiens
acaaauaauuuuag

SEQ ID NO: 1708365 - RNA, 19 nt, Homo sapiens
acaaaugaauaaaugcaua

SEQ ID NO: 1708366 - RNA, 16 nt, Homo sapiens
acaaaugaugccaugg

SEQ ID NO: 1708367 - RNA, 16 nt, Homo sapiens
acaaauuuuaacuucu

SEQ ID NO: 1708368 - RNA, 17 nt, Homo sapiens
acaaauuuuaacuucuu

SEQ ID NO: 1708369 - RNA, 15 nt, Homo sapiens
acaaccucauccagg

SEQ ID NO: 1708370 - RNA, 22 nt, Homo sapiens
acaaccugcaucuuuagugcuu

SEQ ID NO: 1708371 - RNA, 16 nt, Homo sapiens
acaacuccuacaugau

SEQ ID NO: 1708372 - RNA, 16 nt, Homo sapiens
acaacuuaguguaaua

SEQ ID NO: 1708373 - RNA, 16 nt, Homo sapiens
acaacuucaauaucca

SEQ ID NO: 1708374 - RNA, 18 nt, Homo sapiens
acaagaccccgucucaaa

SEQ ID NO: 1708375 - RNA, 20 nt, Homo sapiens
acaagccacaagucuuccag

SEQ ID NO: 1708376 - RNA, 21 nt, Homo sapiens
acaagcccacagcacagcucc

SEQ ID NO: 1708377 - RNA, 19 nt, Homo sapiens
acaaggcuuuaucucaggg

SEQ ID NO: 1708378 - RNA, 13 nt, Homo sapiens
acaaggugacaaa

SEQ ID NO: 1708379 - RNA, 17 nt, Homo sapiens
acaaguuccaugggaua

SEQ ID NO: 1708380 - RNA, 18 nt, Homo sapiens
acaauaaaaauuccaaau

SEQ ID NO: 1708381 - RNA, 15 nt, Homo sapiens
acaauaacacugucu

SEQ ID NO: 1708382 - RNA, 18 nt, Homo sapiens
acaaucaugaaauaugca

SEQ ID NO: 1708383 - RNA, 13 nt, Homo sapiens
acaaugaagugac

SEQ ID NO: 1708384 - RNA, 16 nt, Homo sapiens
acaaugaagugacacu

SEQ ID NO: 1708385 - RNA, 19 nt, Homo sapiens
acaaugcagcaaggcccug

SEQ ID NO: 1708386 - RNA, 21 nt, Homo sapiens
acaaugccuuugaugaacugu

SEQ ID NO: 1708387 - RNA, 11 nt, Homo sapiens
acaaugcugau

SEQ ID NO: 1708388 - RNA, 13 nt, Homo sapiens
acaaugugcugga

SEQ ID NO: 1708389 - RNA, 21 nt, Homo sapiens
acaauugucgaaaagagucuu

SEQ ID NO: 1708390 - RNA, 19 nt, Homo sapiens
acacaaaguguauacaugu

SEQ ID NO: 1708391 - RNA, 18 nt, Homo sapiens
acacaaggugcaaaucaa

SEQ ID NO: 1708392 - RNA, 13 nt, Homo sapiens
acacacaugcaca

SEQ ID NO: 1708393 - RNA, 13 nt, Homo sapiens
acacacgcuuucu

SEQ ID NO: 1708394 - RNA, 15 nt, Homo sapiens
acacacuuccagugu

SEQ ID NO: 1708395 - RNA, 17 nt, Homo sapiens
acacaggcuucaucaag

SEQ ID NO: 1708396 - RNA, 11 nt, Homo sapiens
acacaggguga

SEQ ID NO: 1708397 - RNA, 16 nt, Homo sapiens
acacaguucaauucuc

SEQ ID NO: 1708398 - RNA, 22 nt, Homo sapiens
acacauagauuaauggcacuga

SEQ ID NO: 1708399 - RNA, 22 nt, Homo sapiens
acacauccgccuuuuguauaca

SEQ ID NO: 1708400 - RNA, 18 nt, Homo sapiens
acaccaaauuuuucuauc

SEQ ID NO: 1708401 - RNA, 22 nt, Homo sapiens
acaccaucaggccgcauccuga

SEQ ID NO: 1708402 - RNA, 19 nt, Homo sapiens
acaccggcuuaacacuauc

SEQ ID NO: 1708403 - RNA, 20 nt, Homo sapiens
acaccucaccagaauugugc

SEQ ID NO: 1708404 - RNA, 15 nt, Homo sapiens
acaccuguaguccca

SEQ ID NO: 1708405 - RNA, 22 nt, Homo sapiens
acacgccuaaggucacagcuag

SEQ ID NO: 1708406 - RNA, 15 nt, Homo sapiens
acacgcgcgcgcaca

SEQ ID NO: 1708407 - RNA, 16 nt, Homo sapiens
acacgcugguggugcu

SEQ ID NO: 1708408 - RNA, 14 nt, Homo sapiens
acacggaggcaucc

SEQ ID NO: 1708409 - RNA, 16 nt, Homo sapiens
acacggaucugacaga

SEQ ID NO: 1708410 - RNA, 18 nt, Homo sapiens
acacguacaaaauccagc

SEQ ID NO: 1708411 - RNA, 15 nt, Homo sapiens
acacguguccuguag

SEQ ID NO: 1708412 - RNA, 22 nt, Homo sapiens
acacguguggcgggcaguggga

SEQ ID NO: 1708413 - RNA, 15 nt, Homo sapiens
acacuaacucaccag

SEQ ID NO: 1708414 - RNA, 22 nt, Homo sapiens
acacuaagcgaauguguacaaa

SEQ ID NO: 1708415 - RNA, 16 nt, Homo sapiens
acacuaccacauuaaa

SEQ ID NO: 1708416 - RNA, 22 nt, Homo sapiens
acacuaucauggacuacaccag

SEQ ID NO: 1708417 - RNA, 15 nt, Homo sapiens
acacuccagugccag

SEQ ID NO: 1708418 - RNA, 23 nt, Homo sapiens
acacuccagugccagcaaugaca

SEQ ID NO: 1708419 - RNA, 21 nt, Homo sapiens
acacugaggagagauucccgc

SEQ ID NO: 1708420 - RNA, 12 nt, Homo sapiens
acacugcacugu

SEQ ID NO: 1708421 - RNA, 13 nt, Homo sapiens
acacugcacuguu

SEQ ID NO: 1708422 - RNA, 10 nt, Homo sapiens
acacuggguu

SEQ ID NO: 1708423 - RNA, 23 nt, Homo sapiens
acacuggugugaccugagggcag

SEQ ID NO: 1708424 - RNA, 13 nt, Homo sapiens
acacugugcuaua

SEQ ID NO: 1708425 - RNA, 14 nt, Homo sapiens
acacugugcuauaa

SEQ ID NO: 1708426 - RNA, 22 nt, Homo sapiens
acacuuaucugucucuucuaca

SEQ ID NO: 1708427 - RNA, 15 nt, Homo sapiens
acacuugaaccuaau

SEQ ID NO: 1708428 - RNA, 22 nt, Homo sapiens
acacuuucagaaaaacaaaugu

SEQ ID NO: 1708429 - RNA, 22 nt, Homo sapiens
acacuuugggaggcugaggcag

SEQ ID NO: 1708430 - RNA, 23 nt, Homo sapiens
acagaagcuucugcccaccuacu

SEQ ID NO: 1708431 - RNA, 16 nt, Homo sapiens
acagacauacauuucu

SEQ ID NO: 1708432 - RNA, 13 nt, Homo sapiens
acagaccacagag

SEQ ID NO: 1708433 - RNA, 18 nt, Homo sapiens
acagaccacaucuuuauc

SEQ ID NO: 1708434 - RNA, 21 nt, Homo sapiens
acagacuggcuccaacacugc

SEQ ID NO: 1708435 - RNA, 19 nt, Homo sapiens
acagacuucaucauugugc

SEQ ID NO: 1708436 - RNA, 16 nt, Homo sapiens
acagagauugaacucc

SEQ ID NO: 1708437 - RNA, 18 nt, Homo sapiens
acagagauugaacuccaa

SEQ ID NO: 1708438 - RNA, 20 nt, Homo sapiens
acagagcaagacccaucuca

SEQ ID NO: 1708439 - RNA, 22 nt, Homo sapiens
acagaggaauuuauaccucaaa

SEQ ID NO: 1708440 - RNA, 17 nt, Homo sapiens
acagagugcauugugag

SEQ ID NO: 1708441 - RNA, 15 nt, Homo sapiens
acagauuuuaauugu

SEQ ID NO: 1708442 - RNA, 23 nt, Homo sapiens
acagcaaccucuucaugagcuug

SEQ ID NO: 1708443 - RNA, 23 nt, Homo sapiens
acagcaauuccuggacucggggg

SEQ ID NO: 1708444 - RNA, 16 nt, Homo sapiens
acagcacuggggaguc

SEQ ID NO: 1708445 - RNA, 15 nt, Homo sapiens
acagcagucagggac

SEQ ID NO: 1708446 - RNA, 16 nt, Homo sapiens
acagcaugugccuuaa

SEQ ID NO: 1708447 - RNA, 21 nt, Homo sapiens
acagccucccacccccaucuc

SEQ ID NO: 1708448 - RNA, 16 nt, Homo sapiens
acagcgacauagccca

SEQ ID NO: 1708449 - RNA, 17 nt, Homo sapiens
acagcugaaagauugau

SEQ ID NO: 1708450 - RNA, 22 nt, Homo sapiens
acagcugagugcccuguccuca

SEQ ID NO: 1708451 - RNA, 17 nt, Homo sapiens
acagcuggagcucucaa

SEQ ID NO: 1708452 - RNA, 22 nt, Homo sapiens
acagcuuucuugcucccuucag

SEQ ID NO: 1708453 - RNA, 18 nt, Homo sapiens
acaggaagucccuugcca

SEQ ID NO: 1708454 - RNA, 18 nt, Homo sapiens
augucacagggccaacuu

SEQ ID NO: 1708455 - RNA, 15 nt, Homo sapiens
augucaggucagcca

SEQ ID NO: 1708456 - RNA, 12 nt, Homo sapiens
auguccaaagag

SEQ ID NO: 1708457 - RNA, 15 nt, Homo sapiens
augucccaacuugua

SEQ ID NO: 1708458 - RNA, 13 nt, Homo sapiens
auguccuggacac

SEQ ID NO: 1708459 - RNA, 17 nt, Homo sapiens
augucuauaaucccagc

SEQ ID NO: 1708460 - RNA, 16 nt, Homo sapiens
augucucuaaagcacu

SEQ ID NO: 1708461 - RNA, 20 nt, Homo sapiens
augucucuuuaaugucacag

SEQ ID NO: 1708462 - RNA, 23 nt, Homo sapiens
augucuguuuaagaaaaguauuu

SEQ ID NO: 1708463 - RNA, 20 nt, Homo sapiens
augugaaaaaugugucugua

SEQ ID NO: 1708464 - RNA, 22 nt, Homo sapiens
augugaaggggagagacagggg

SEQ ID NO: 1708465 - RNA, 20 nt, Homo sapiens
augugagagauucugugauc

SEQ ID NO: 1708466 - RNA, 15 nt, Homo sapiens
augugauguucuaag

SEQ ID NO: 1708467 - RNA, 14 nt, Homo sapiens
augugcacaugcac

SEQ ID NO: 1708468 - RNA, 19 nt, Homo sapiens
augugcagguuuugaaaau

SEQ ID NO: 1708469 - RNA, 19 nt, Homo sapiens
augugccauuuaugugagu

SEQ ID NO: 1708470 - RNA, 17 nt, Homo sapiens
augugcugucaaaacaa

SEQ ID NO: 1708471 - RNA, 18 nt, Homo sapiens
auguggccgaggacuuug

SEQ ID NO: 1708472 - RNA, 18 nt, Homo sapiens
augugggagggagcagac

SEQ ID NO: 1708473 - RNA, 12 nt, Homo sapiens
auguggucucag

SEQ ID NO: 1708474 - RNA, 19 nt, Homo sapiens
auguguauguacguuugua

SEQ ID NO: 1708475 - RNA, 16 nt, Homo sapiens
auguguaugugccauu

SEQ ID NO: 1708476 - RNA, 15 nt, Homo sapiens
augugugaggagcug

SEQ ID NO: 1708477 - RNA, 15 nt, Homo sapiens
auguguggacugugg

SEQ ID NO: 1708478 - RNA, 20 nt, Homo sapiens
augugugguggccucagcug

SEQ ID NO: 1708479 - RNA, 17 nt, Homo sapiens
auguguuuuaauuccaa

SEQ ID NO: 1708480 - RNA, 18 nt, Homo sapiens
auguguuuuagaugguuu

SEQ ID NO: 1708481 - RNA, 18 nt, Homo sapiens
auguguuuuaucacuuca

SEQ ID NO: 1708482 - RNA, 12 nt, Homo sapiens
auguuacagauu

SEQ ID NO: 1708483 - RNA, 15 nt, Homo sapiens
auguucuauuguggg

SEQ ID NO: 1708484 - RNA, 20 nt, Homo sapiens
auguucugggacacaguuca

SEQ ID NO: 1708485 - RNA, 13 nt, Homo sapiens
auguuggucaaaa

SEQ ID NO: 1708486 - RNA, 23 nt, Homo sapiens
auguugguguuccacguguuuua

SEQ ID NO: 1708487 - RNA, 21 nt, Homo sapiens
auguugugauguauucuagcu

SEQ ID NO: 1708488 - RNA, 23 nt, Homo sapiens
auguuguuaugcuauuaaaguga

SEQ ID NO: 1708489 - RNA, 12 nt, Homo sapiens
auguuuacuucu

SEQ ID NO: 1708490 - RNA, 20 nt, Homo sapiens
auguuucacauaaaaccuca

SEQ ID NO: 1708491 - RNA, 22 nt, Homo sapiens
auguuucauguuuugugacuau

SEQ ID NO: 1708492 - RNA, 16 nt, Homo sapiens
auguuugcacuuguga

SEQ ID NO: 1708493 - RNA, 17 nt, Homo sapiens
auguuuuuaugauaucc

SEQ ID NO: 1708494 - RNA, 21 nt, Homo sapiens
auguuuuuuaaacuaguuuau

SEQ ID NO: 1708495 - RNA, 15 nt, Homo sapiens
auuaaaaaaauggaa

SEQ ID NO: 1708496 - RNA, 15 nt, Homo sapiens
auuaaaaaccugaug

SEQ ID NO: 1708497 - RNA, 20 nt, Homo sapiens
auuaacaacaauaacacugu

SEQ ID NO: 1708498 - RNA, 16 nt, Homo sapiens
auuaaccaccaaucca

SEQ ID NO: 1708499 - RNA, 19 nt, Homo sapiens
auuaagacgguuaaauacu

SEQ ID NO: 1708500 - RNA, 13 nt, Homo sapiens
auuaaguuaucuu

SEQ ID NO: 1708501 - RNA, 20 nt, Homo sapiens
auuaauuaagucaccuguau

SEQ ID NO: 1708502 - RNA, 19 nt, Homo sapiens
auuacaaggcuuuaucuca

SEQ ID NO: 1708503 - RNA, 22 nt, Homo sapiens
auuacaaggcuuuaucucaggg

SEQ ID NO: 1708504 - RNA, 23 nt, Homo sapiens
auuacaggugugaaccaccacac

SEQ ID NO: 1708505 - RNA, 14 nt, Homo sapiens
auuacucaguuuau

SEQ ID NO: 1708506 - RNA, 19 nt, Homo sapiens
auuagaaaauuuuauggac

SEQ ID NO: 1708507 - RNA, 14 nt, Homo sapiens
auuagaaaguuaac

SEQ ID NO: 1708508 - RNA, 16 nt, Homo sapiens
auuagaguauuuucca

SEQ ID NO: 1708509 - RNA, 14 nt, Homo sapiens
auuagcacagauuu

SEQ ID NO: 1708510 - RNA, 12 nt, Homo sapiens
auuagcugugau

SEQ ID NO: 1708511 - RNA, 13 nt, Homo sapiens
auuaggugcaauu

SEQ ID NO: 1708512 - RNA, 17 nt, Homo sapiens
auuauaaacuguaugcu

SEQ ID NO: 1708513 - RNA, 14 nt, Homo sapiens
auuaucaagcuuuu

SEQ ID NO: 1708514 - RNA, 15 nt, Homo sapiens
auuaucugugucaaa

SEQ ID NO: 1708515 - RNA, 22 nt, Homo sapiens
auuaucugugucaaaagccaga

SEQ ID NO: 1708516 - RNA, 20 nt, Homo sapiens
auuaugaguaguguggaauu

SEQ ID NO: 1708517 - RNA, 18 nt, Homo sapiens
auuaugaugaaaaccuac

SEQ ID NO: 1708518 - RNA, 19 nt, Homo sapiens
auuaugaugaaaaccuaca

SEQ ID NO: 1708519 - RNA, 11 nt, Homo sapiens
auuauggcauu

SEQ ID NO: 1708520 - RNA, 19 nt, Homo sapiens
auuaugugacauuuuacau

SEQ ID NO: 1708521 - RNA, 22 nt, Homo sapiens
auuauucuuguaguuuaccucu

SEQ ID NO: 1708522 - RNA, 19 nt, Homo sapiens
auuauugaaauuguacaua

SEQ ID NO: 1708523 - RNA, 20 nt, Homo sapiens
auuauuugucauucauucaa

SEQ ID NO: 1708524 - RNA, 16 nt, Homo sapiens
auuauuuucugucaga

SEQ ID NO: 1708525 - RNA, 16 nt, Homo sapiens
auucaaaaauuaucua

SEQ ID NO: 1708526 - RNA, 20 nt, Homo sapiens
auucaaaagguuauauacca

SEQ ID NO: 1708527 - RNA, 16 nt, Homo sapiens
auucaaaucacaugga

SEQ ID NO: 1708528 - RNA, 15 nt, Homo sapiens
auucaauauugacau

SEQ ID NO: 1708529 - RNA, 23 nt, Homo sapiens
auucacgcuguuuguuucauaua

SEQ ID NO: 1708530 - RNA, 16 nt, Homo sapiens
auucacuugcauuucu

SEQ ID NO: 1708531 - RNA, 16 nt, Homo sapiens
auucagguauguugcc

SEQ ID NO: 1708532 - RNA, 23 nt, Homo sapiens
auucagguauguugccuuuaugg

SEQ ID NO: 1708533 - RNA, 22 nt, Homo sapiens
auucaugccagggacugacaaa

SEQ ID NO: 1708534 - RNA, 14 nt, Homo sapiens
auucauuguucaaa

SEQ ID NO: 1708535 - RNA, 16 nt, Homo sapiens
auuccaccuucccaug

SEQ ID NO: 1708536 - RNA, 19 nt, Homo sapiens
auucccaagccaaaaaccu

SEQ ID NO: 1708537 - RNA, 20 nt, Homo sapiens
auucccaagguuacuggaua

SEQ ID NO: 1708538 - RNA, 20 nt, Homo sapiens
auuccuauuggaaacagaga

SEQ ID NO: 1708539 - RNA, 19 nt, Homo sapiens
auuccugccaccacugggc

SEQ ID NO: 1708540 - RNA, 14 nt, Homo sapiens
auuccuuacuguaa

SEQ ID NO: 1708541 - RNA, 23 nt, Homo sapiens
auuccuuugucuucaaacuguga

SEQ ID NO: 1708542 - RNA, 13 nt, Homo sapiens
auucgcuguuacc

SEQ ID NO: 1708543 - RNA, 12 nt, Homo sapiens
auucuacuauac

SEQ ID NO: 1708544 - RNA, 16 nt, Homo sapiens
auucuagagccagcug

SEQ ID NO: 1708545 - RNA, 16 nt, Homo sapiens
auucuaucaagcccag

SEQ ID NO: 1708546 - RNA, 17 nt, Homo sapiens
auucuauuuauauguac

SEQ ID NO: 1708547 - RNA, 21 nt, Homo sapiens
auucuauuuauauguacauga

SEQ ID NO: 1708548 - RNA, 16 nt, Homo sapiens
auucucaaaauuccua

SEQ ID NO: 1708549 - RNA, 16 nt, Homo sapiens
auucucauuugucaca

SEQ ID NO: 1708550 - RNA, 21 nt, Homo sapiens
auucucuggcuguaaggcucu

SEQ ID NO: 1708551 - RNA, 18 nt, Homo sapiens
auucugagacauguguca

SEQ ID NO: 1708552 - RNA, 14 nt, Homo sapiens
auucugaugagcaa

SEQ ID NO: 1708553 - RNA, 17 nt, Homo sapiens
auucugcauugcuagau

SEQ ID NO: 1708554 - RNA, 17 nt, Homo sapiens
auucuggaaaagcaaaa

SEQ ID NO: 1708555 - RNA, 14 nt, Homo sapiens
auucuguggaacaa

SEQ ID NO: 1708556 - RNA, 18 nt, Homo sapiens
auucuucaaccucauuga

SEQ ID NO: 1708557 - RNA, 23 nt, Homo sapiens
auucuucaaccucauugacaaga

SEQ ID NO: 1708558 - RNA, 13 nt, Homo sapiens
auucuucugcuuc

SEQ ID NO: 1708559 - RNA, 12 nt, Homo sapiens
auucuucuguac

SEQ ID NO: 1708560 - RNA, 19 nt, Homo sapiens
auucuuguuuuaagugccu

SEQ ID NO: 1708561 - RNA, 19 nt, Homo sapiens
auucuuucagcuaucagua

SEQ ID NO: 1708562 - RNA, 22 nt, Homo sapiens
auugaaaaugugaauugcauga

SEQ ID NO: 1708563 - RNA, 20 nt, Homo sapiens
auugaaacuacuacaaugau

SEQ ID NO: 1708564 - RNA, 19 nt, Homo sapiens
cagaacagcuucagguuau

SEQ ID NO: 1708565 - RNA, 17 nt, Homo sapiens
cagaaccccuacaugaa

SEQ ID NO: 1708566 - RNA, 18 nt, Homo sapiens
cagaacuucccugauuga

SEQ ID NO: 1708567 - RNA, 21 nt, Homo sapiens
cagaacuugaaugugucaggu

SEQ ID NO: 1708568 - RNA, 15 nt, Homo sapiens
cagaaguaauuugaa

SEQ ID NO: 1708569 - RNA, 19 nt, Homo sapiens
cagaauauugcuuugguca

SEQ ID NO: 1708570 - RNA, 22 nt, Homo sapiens
cagaaugcugcaggacuugaga

SEQ ID NO: 1708571 - RNA, 12 nt, Homo sapiens
cagaauguaucu

SEQ ID NO: 1708572 - RNA, 12 nt, Homo sapiens
cagaauugugca

SEQ ID NO: 1708573 - RNA, 18 nt, Homo sapiens
cagacacaggcccggcuc

SEQ ID NO: 1708574 - RNA, 18 nt, Homo sapiens
cagacagaagucuccuca

SEQ ID NO: 1708575 - RNA, 19 nt, Homo sapiens
cagacagaagucuccucaa

SEQ ID NO: 1708576 - RNA, 17 nt, Homo sapiens
cagacauaaagccaugu

SEQ ID NO: 1708577 - RNA, 18 nt, Homo sapiens
cagacauacgaaacacaa

SEQ ID NO: 1708578 - RNA, 21 nt, Homo sapiens
cagacaucggccuccaugacc

SEQ ID NO: 1708579 - RNA, 14 nt, Homo sapiens
cagaccaccaucca

SEQ ID NO: 1708580 - RNA, 14 nt, Homo sapiens
cagacuacacagga

SEQ ID NO: 1708581 - RNA, 15 nt, Homo sapiens
cagacuacacaggau

SEQ ID NO: 1708582 - RNA, 20 nt, Homo sapiens
cagacuucucccgugagcca

SEQ ID NO: 1708583 - RNA, 14 nt, Homo sapiens
cagagaaaguacuu

SEQ ID NO: 1708584 - RNA, 20 nt, Homo sapiens
cagagaccugaagugugcac

SEQ ID NO: 1708585 - RNA, 15 nt, Homo sapiens
cagagagcaacucug

SEQ ID NO: 1708586 - RNA, 21 nt, Homo sapiens
cagagagcagcuuuaaacuca

SEQ ID NO: 1708587 - RNA, 23 nt, Homo sapiens
cagagagccauuuugugaaugga

SEQ ID NO: 1708588 - RNA, 19 nt, Homo sapiens
cagagagcggucucaggcu

SEQ ID NO: 1708589 - RNA, 17 nt, Homo sapiens
cagagaggcucugagaa

SEQ ID NO: 1708590 - RNA, 22 nt, Homo sapiens
cagagaugugcacccaugggcu

SEQ ID NO: 1708591 - RNA, 19 nt, Homo sapiens
cagagauucccaagccaaa

SEQ ID NO: 1708592 - RNA, 19 nt, Homo sapiens
cagagcaagacccaucuca

SEQ ID NO: 1708593 - RNA, 17 nt, Homo sapiens
cagagcccugugucugu

SEQ ID NO: 1708594 - RNA, 22 nt, Homo sapiens
cagagcccugugucuguauaca

SEQ ID NO: 1708595 - RNA, 21 nt, Homo sapiens
cagagcuggaccaguggugcc

SEQ ID NO: 1708596 - RNA, 19 nt, Homo sapiens
cagaggaacuguccagaga

SEQ ID NO: 1708597 - RNA, 14 nt, Homo sapiens
cagaggaaguggaa

SEQ ID NO: 1708598 - RNA, 21 nt, Homo sapiens
cagaggcgcccuggguggugg

SEQ ID NO: 1708599 - RNA, 22 nt, Homo sapiens
cagagggcggggagaaucucag

SEQ ID NO: 1708600 - RNA, 13 nt, Homo sapiens
cagagucaucuga

SEQ ID NO: 1708601 - RNA, 16 nt, Homo sapiens
cagagugagagacauc

SEQ ID NO: 1708602 - RNA, 11 nt, Homo sapiens
cagauaacaua

SEQ ID NO: 1708603 - RNA, 15 nt, Homo sapiens
cagauacaucacugc

SEQ ID NO: 1708604 - RNA, 19 nt, Homo sapiens
cagaucaacagcaaccucu

SEQ ID NO: 1708605 - RNA, 13 nt, Homo sapiens
cagaugcaguuug

SEQ ID NO: 1708606 - RNA, 15 nt, Homo sapiens
cagaugcuccaagau

SEQ ID NO: 1708607 - RNA, 20 nt, Homo sapiens
cagauggaaugcuguguuaa

SEQ ID NO: 1708608 - RNA, 17 nt, Homo sapiens
cagauggcacuuugaag

SEQ ID NO: 1708609 - RNA, 19 nt, Homo sapiens
cagauggggcacugaccca

SEQ ID NO: 1708610 - RNA, 19 nt, Homo sapiens
cagaugugaaaacaucuca

SEQ ID NO: 1708611 - RNA, 16 nt, Homo sapiens
cagauuauuuaaaugg

SEQ ID NO: 1708612 - RNA, 16 nt, Homo sapiens
cagauucagucuugcc

SEQ ID NO: 1708613 - RNA, 19 nt, Homo sapiens
cagauuuuaauugucaugg

SEQ ID NO: 1708614 - RNA, 15 nt, Homo sapiens
cagauuuuugcaaua

SEQ ID NO: 1708615 - RNA, 16 nt, Homo sapiens
cagcaaccugacucag

SEQ ID NO: 1708616 - RNA, 20 nt, Homo sapiens
cagcaaugacaucucagggg

SEQ ID NO: 1708617 - RNA, 20 nt, Homo sapiens
cagcaauuuaaauguuauga

SEQ ID NO: 1708618 - RNA, 19 nt, Homo sapiens
cagcacucugaaacugaga

SEQ ID NO: 1708619 - RNA, 12 nt, Homo sapiens
cagcacuuguau

SEQ ID NO: 1708620 - RNA, 16 nt, Homo sapiens
cagcacuuguguuguc

SEQ ID NO: 1708621 - RNA, 18 nt, Homo sapiens
cagcacuuguguugucug

SEQ ID NO: 1708622 - RNA, 22 nt, Homo sapiens
cagcagcuucaccagagcauuu

SEQ ID NO: 1708623 - RNA, 14 nt, Homo sapiens
cagcaucugugaug

SEQ ID NO: 1708624 - RNA, 13 nt, Homo sapiens
cagcaugccugaa

SEQ ID NO: 1708625 - RNA, 16 nt, Homo sapiens
cagcaugccugaacua

SEQ ID NO: 1708626 - RNA, 13 nt, Homo sapiens
cagcauuugauaa

SEQ ID NO: 1708627 - RNA, 19 nt, Homo sapiens
cagccacacccaggcacuu

SEQ ID NO: 1708628 - RNA, 12 nt, Homo sapiens
cagccaccagcg

SEQ ID NO: 1708629 - RNA, 22 nt, Homo sapiens
cagccacuucggccaggucaca

SEQ ID NO: 1708630 - RNA, 21 nt, Homo sapiens
cagcccagagacuuuguagau

SEQ ID NO: 1708631 - RNA, 21 nt, Homo sapiens
cagcccauggcccugugcuaa

SEQ ID NO: 1708632 - RNA, 15 nt, Homo sapiens
cagccccacugccag

SEQ ID NO: 1708633 - RNA, 20 nt, Homo sapiens
cagccccuagaaacccaagc

SEQ ID NO: 1708634 - RNA, 15 nt, Homo sapiens
cagccccucccccau

SEQ ID NO: 1708635 - RNA, 14 nt, Homo sapiens
cagccccugccucg

SEQ ID NO: 1708636 - RNA, 18 nt, Homo sapiens
cagcccuagagccugccu

SEQ ID NO: 1708637 - RNA, 14 nt, Homo sapiens
cagcccugcugcag

SEQ ID NO: 1708638 - RNA, 18 nt, Homo sapiens
cagccuagacauccaggu

SEQ ID NO: 1708639 - RNA, 15 nt, Homo sapiens
cagccucaguccucc

SEQ ID NO: 1708640 - RNA, 19 nt, Homo sapiens
cagccucccgaauagcugg

SEQ ID NO: 1708641 - RNA, 20 nt, Homo sapiens
cagccucccgaguagcuggg

SEQ ID NO: 1708642 - RNA, 17 nt, Homo sapiens
cagccucuugacucuga

SEQ ID NO: 1708643 - RNA, 19 nt, Homo sapiens
cagccugcuucccaccucc

SEQ ID NO: 1708644 - RNA, 19 nt, Homo sapiens
cagccugggcaacagagca

SEQ ID NO: 1708645 - RNA, 23 nt, Homo sapiens
cagccuugaugccauaugccuug

SEQ ID NO: 1708646 - RNA, 23 nt, Homo sapiens
cagccuuuggccuuggcuuuucu

SEQ ID NO: 1708647 - RNA, 18 nt, Homo sapiens
cagcgaaugaaugcugua

SEQ ID NO: 1708648 - RNA, 19 nt, Homo sapiens
cagcgaccuuccucaucca

SEQ ID NO: 1708649 - RNA, 21 nt, Homo sapiens
cagcgagggcaccuugugauc

SEQ ID NO: 1708650 - RNA, 15 nt, Homo sapiens
cagcgcuucuaugca

SEQ ID NO: 1708651 - RNA, 16 nt, Homo sapiens
cagcgucccagucucu

SEQ ID NO: 1708652 - RNA, 13 nt, Homo sapiens
cagcuacucagga

SEQ ID NO: 1708653 - RNA, 23 nt, Homo sapiens
cagcuauuuucaacauaacugaa

SEQ ID NO: 1708654 - RNA, 17 nt, Homo sapiens
cagcucuguccugggag

SEQ ID NO: 1708655 - RNA, 17 nt, Homo sapiens
cagcugaaaguucuugc

SEQ ID NO: 1708656 - RNA, 19 nt, Homo sapiens
cagcugcgguccacccagg

SEQ ID NO: 1708657 - RNA, 19 nt, Homo sapiens
cagcuggaagggucaacau

SEQ ID NO: 1708658 - RNA, 18 nt, Homo sapiens
cagcugggcucugcaauu

SEQ ID NO: 1708659 - RNA, 20 nt, Homo sapiens
cagcuucaccagagcauuuc

SEQ ID NO: 1708660 - RNA, 15 nt, Homo sapiens
cagcuuccugaagca

SEQ ID NO: 1708661 - RNA, 20 nt, Homo sapiens
cagcuuggggccaccaaagc

SEQ ID NO: 1708662 - RNA, 19 nt, Homo sapiens
cagcuuguaaauagcucag

SEQ ID NO: 1708663 - RNA, 22 nt, Homo sapiens
cagcuuguaaauagcucaggug

SEQ ID NO: 1708664 - RNA, 17 nt, Homo sapiens
cagcuuucaagugccuu

SEQ ID NO: 1708665 - RNA, 20 nt, Homo sapiens
caggaaaccaacacccaaag

SEQ ID NO: 1708666 - RNA, 23 nt, Homo sapiens
caggaaggaaaugacaccaaaua

SEQ ID NO: 1708667 - RNA, 16 nt, Homo sapiens
caggaauguguggccu

SEQ ID NO: 1708668 - RNA, 19 nt, Homo sapiens
caggacagucagcucucuc

SEQ ID NO: 1708669 - RNA, 19 nt, Homo sapiens
caggaccucccuuccgacc

SEQ ID NO: 1708670 - RNA, 13 nt, Homo sapiens
caggacggggcac

SEQ ID NO: 1708671 - RNA, 19 nt, Homo sapiens
caggacucugacgucucuu

SEQ ID NO: 1708672 - RNA, 22 nt, Homo sapiens
caggacucugccuccucuucaa

SEQ ID NO: 1708673 - RNA, 13 nt, Homo sapiens
ccaccagccacuu

SEQ ID NO: 1708674 - RNA, 16 nt, Homo sapiens
ccaccauccuauugca

SEQ ID NO: 1708675 - RNA, 13 nt, Homo sapiens
ccacccuaguccc

SEQ ID NO: 1708676 - RNA, 21 nt, Homo sapiens
ccaccuacuuuucuuuccuca

SEQ ID NO: 1708677 - RNA, 13 nt, Homo sapiens
ccaccuagacugu

SEQ ID NO: 1708678 - RNA, 16 nt, Homo sapiens
ccaccugacucuugca

SEQ ID NO: 1708679 - RNA, 24 nt, Homo sapiens
ccaccugccugcaucugugaaaag

SEQ ID NO: 1708680 - RNA, 20 nt, Homo sapiens
ccacgaccuuugaagagcuu

SEQ ID NO: 1708681 - RNA, 15 nt, Homo sapiens
ccacggccaggccag

SEQ ID NO: 1708682 - RNA, 22 nt, Homo sapiens
ccacguccagcuggaaggguca

SEQ ID NO: 1708683 - RNA, 16 nt, Homo sapiens
ccacuagcauuuucuc

SEQ ID NO: 1708684 - RNA, 17 nt, Homo sapiens
ccacuauccuucgugaa

SEQ ID NO: 1708685 - RNA, 14 nt, Homo sapiens
ccacugaagcccau

SEQ ID NO: 1708686 - RNA, 17 nt, Homo sapiens
ccacugaugcuguucuc

SEQ ID NO: 1708687 - RNA, 20 nt, Homo sapiens
ccacugggccauuguggugu

SEQ ID NO: 1708688 - RNA, 15 nt, Homo sapiens
ccacuugaacaaaau

SEQ ID NO: 1708689 - RNA, 13 nt, Homo sapiens
ccagaaaugucua

SEQ ID NO: 1708690 - RNA, 21 nt, Homo sapiens
ccagaagaacaguaggugaca

SEQ ID NO: 1708691 - RNA, 10 nt, Homo sapiens
ccagacagac

SEQ ID NO: 1708692 - RNA, 21 nt, Homo sapiens
ccagacauacgaaacacaaac

SEQ ID NO: 1708693 - RNA, 13 nt, Homo sapiens
ccagacccggcug

SEQ ID NO: 1708694 - RNA, 15 nt, Homo sapiens
ccagagaaaagaguc

SEQ ID NO: 1708695 - RNA, 15 nt, Homo sapiens
ccagagaguccugug

SEQ ID NO: 1708696 - RNA, 21 nt, Homo sapiens
ccagagcauuuccaacaccac

SEQ ID NO: 1708697 - RNA, 20 nt, Homo sapiens
ccagagcugggaggcauggc

SEQ ID NO: 1708698 - RNA, 16 nt, Homo sapiens
ccagaggaacugucca

SEQ ID NO: 1708699 - RNA, 17 nt, Homo sapiens
ccagaggaauccuggca

SEQ ID NO: 1708700 - RNA, 23 nt, Homo sapiens
ccagaguccuuuccaaggcuucu

SEQ ID NO: 1708701 - RNA, 15 nt, Homo sapiens
ccagaucacugccac

SEQ ID NO: 1708702 - RNA, 19 nt, Homo sapiens
ccagaugugaaaacaucuc

SEQ ID NO: 1708703 - RNA, 23 nt, Homo sapiens
ccagcaaagaggacucgcuugua

SEQ ID NO: 1708704 - RNA, 16 nt, Homo sapiens
ccagcaagcucuucac

SEQ ID NO: 1708705 - RNA, 17 nt, Homo sapiens
ccagcaaugacaucuca

SEQ ID NO: 1708706 - RNA, 22 nt, Homo sapiens
ccagcaaugacaucucaggggc

SEQ ID NO: 1708707 - RNA, 16 nt, Homo sapiens
ccagcaccaacaccac

SEQ ID NO: 1708708 - RNA, 18 nt, Homo sapiens
ccagcagaugccacauaa

SEQ ID NO: 1708709 - RNA, 17 nt, Homo sapiens
ccagcaguucuguuaua

SEQ ID NO: 1708710 - RNA, 14 nt, Homo sapiens
ccagccacacuuga

SEQ ID NO: 1708711 - RNA, 16 nt, Homo sapiens
ccagccccacugccag

SEQ ID NO: 1708712 - RNA, 17 nt, Homo sapiens
ccagccccacugccagc

SEQ ID NO: 1708713 - RNA, 19 nt, Homo sapiens
ccagccccugccucgagga

SEQ ID NO: 1708714 - RNA, 23 nt, Homo sapiens
ccagcccuguucugggugcagcu

SEQ ID NO: 1708715 - RNA, 12 nt, Homo sapiens
ccagcuaugaau

SEQ ID NO: 1708716 - RNA, 13 nt, Homo sapiens
ccagcugcagcug

SEQ ID NO: 1708717 - RNA, 14 nt, Homo sapiens
ccagcuucaggcag

SEQ ID NO: 1708718 - RNA, 22 nt, Homo sapiens
ccagcuugcgaauaacaguccc

SEQ ID NO: 1708719 - RNA, 19 nt, Homo sapiens
ccaggaaaggauuuuauaa

SEQ ID NO: 1708720 - RNA, 17 nt, Homo sapiens
ccaggacugaccucuuc

SEQ ID NO: 1708721 - RNA, 12 nt, Homo sapiens
ccaggacugagc

SEQ ID NO: 1708722 - RNA, 20 nt, Homo sapiens
ccaggagaacaucuuugaca

SEQ ID NO: 1708723 - RNA, 13 nt, Homo sapiens
ccaggagcucuuc

SEQ ID NO: 1708724 - RNA, 22 nt, Homo sapiens
ccaggaggagaaagcagccauu

SEQ ID NO: 1708725 - RNA, 18 nt, Homo sapiens
ccaggcaccaucucccuu

SEQ ID NO: 1708726 - RNA, 16 nt, Homo sapiens
ccaggcacugcugcac

SEQ ID NO: 1708727 - RNA, 18 nt, Homo sapiens
ccaggcaggucuugaacu

SEQ ID NO: 1708728 - RNA, 17 nt, Homo sapiens
ccaggcaugguggcuca

SEQ ID NO: 1708729 - RNA, 18 nt, Homo sapiens
ccaggccgggguggagca

SEQ ID NO: 1708730 - RNA, 15 nt, Homo sapiens
ccaggccugccuguu

SEQ ID NO: 1708731 - RNA, 19 nt, Homo sapiens
ccaggcuaguccggaccca

SEQ ID NO: 1708732 - RNA, 23 nt, Homo sapiens
ccaggcuggagugcaguggugca

SEQ ID NO: 1708733 - RNA, 18 nt, Homo sapiens
ccaggcuggcgugcagug

SEQ ID NO: 1708734 - RNA, 17 nt, Homo sapiens
ccagggcagugcuagug

SEQ ID NO: 1708735 - RNA, 22 nt, Homo sapiens
ccaggggaaccugccaugccag

SEQ ID NO: 1708736 - RNA, 18 nt, Homo sapiens
ccagguagaaacuuuuau

SEQ ID NO: 1708737 - RNA, 20 nt, Homo sapiens
ccagguuuuuggucugaccc

SEQ ID NO: 1708738 - RNA, 22 nt, Homo sapiens
ccaguauuuuuauuucuuuaau

SEQ ID NO: 1708739 - RNA, 21 nt, Homo sapiens
ccagucacaugaccugaucac

SEQ ID NO: 1708740 - RNA, 19 nt, Homo sapiens
ccagucucaaaaauacaaa

SEQ ID NO: 1708741 - RNA, 20 nt, Homo sapiens
ccagugaccccugaccucac

SEQ ID NO: 1708742 - RNA, 15 nt, Homo sapiens
ccagugcuccaggca

SEQ ID NO: 1708743 - RNA, 14 nt, Homo sapiens
ccaguggaugccac

SEQ ID NO: 1708744 - RNA, 13 nt, Homo sapiens
ccagugucauccg

SEQ ID NO: 1708745 - RNA, 23 nt, Homo sapiens
ccaguguccccuccacugucaca

SEQ ID NO: 1708746 - RNA, 16 nt, Homo sapiens
ccaguguggaaccacu

SEQ ID NO: 1708747 - RNA, 19 nt, Homo sapiens
ccaguguucuaugaacaac

SEQ ID NO: 1708748 - RNA, 13 nt, Homo sapiens
ccaguguuuacaa

SEQ ID NO: 1708749 - RNA, 20 nt, Homo sapiens
ccaguguuuacaaggugaca

SEQ ID NO: 1708750 - RNA, 18 nt, Homo sapiens
ccauagccaccccagaaa

SEQ ID NO: 1708751 - RNA, 16 nt, Homo sapiens
ccauaucugugaaaug

SEQ ID NO: 1708752 - RNA, 22 nt, Homo sapiens
ccauauugugcuucacaguaga

SEQ ID NO: 1708753 - RNA, 18 nt, Homo sapiens
ccaucaggccuaaucuca

SEQ ID NO: 1708754 - RNA, 23 nt, Homo sapiens
ccaucaugggcuggacauuggac

SEQ ID NO: 1708755 - RNA, 12 nt, Homo sapiens
ccauccagguuc

SEQ ID NO: 1708756 - RNA, 18 nt, Homo sapiens
ccauccccuggacuggga

SEQ ID NO: 1708757 - RNA, 19 nt, Homo sapiens
ccauccccuggacugggag

SEQ ID NO: 1708758 - RNA, 20 nt, Homo sapiens
ccaucuggaccugguacaaa

SEQ ID NO: 1708759 - RNA, 16 nt, Homo sapiens
ccaugaagccuuuuga

SEQ ID NO: 1708760 - RNA, 19 nt, Homo sapiens
ccaugaagcgaaacacaga

SEQ ID NO: 1708761 - RNA, 19 nt, Homo sapiens
ccaugcuucucaucugcaa

SEQ ID NO: 1708762 - RNA, 22 nt, Homo sapiens
ccauggacacuccagugccagc

SEQ ID NO: 1708763 - RNA, 13 nt, Homo sapiens
ccauguccaaaga

SEQ ID NO: 1708764 - RNA, 16 nt, Homo sapiens
ccauuauuuucuguca

SEQ ID NO: 1708765 - RNA, 11 nt, Homo sapiens
ccauucucuga

SEQ ID NO: 1708766 - RNA, 11 nt, Homo sapiens
ccauugcauca

SEQ ID NO: 1708767 - RNA, 12 nt, Homo sapiens
ccauuugauacc

SEQ ID NO: 1708768 - RNA, 14 nt, Homo sapiens
ccauuuugugaaug

SEQ ID NO: 1708769 - RNA, 14 nt, Homo sapiens
cccaacgcacagga

SEQ ID NO: 1708770 - RNA, 16 nt, Homo sapiens
cccaacgcacaggaaa

SEQ ID NO: 1708771 - RNA, 22 nt, Homo sapiens
cccaagagauuguuguuugcca

SEQ ID NO: 1708772 - RNA, 23 nt, Homo sapiens
cccaagaggucaaggcugcagug

SEQ ID NO: 1708773 - RNA, 16 nt, Homo sapiens
cccaaggaagagccaa

SEQ ID NO: 1708774 - RNA, 17 nt, Homo sapiens
cccaaggaagagccaau

SEQ ID NO: 1708775 - RNA, 15 nt, Homo sapiens
cccaaucagcacuga

SEQ ID NO: 1708776 - RNA, 20 nt, Homo sapiens
cccaaugcacauccauuccc

SEQ ID NO: 1708777 - RNA, 15 nt, Homo sapiens
cccacaccucugcca

SEQ ID NO: 1708778 - RNA, 14 nt, Homo sapiens
cccacagacugguu

SEQ ID NO: 1708779 - RNA, 23 nt, Homo sapiens
cccacaugugacacauaugcacc

SEQ ID NO: 1708780 - RNA, 16 nt, Homo sapiens
cccaccgguccagcug

SEQ ID NO: 1708781 - RNA, 18 nt, Homo sapiens
cccacgugucuuccacuu

SEQ ID NO: 1708782 - RNA, 14 nt, Homo sapiens
cccagaauagcuuu

SEQ ID NO: 1708783 - RNA, 22 nt, Homo sapiens
gagcuguccccguguugcauga

SEQ ID NO: 1708784 - RNA, 21 nt, Homo sapiens
gaggacaaaacuucuugucag

SEQ ID NO: 1708785 - RNA, 18 nt, Homo sapiens
gaggacacuaaccacgcu

SEQ ID NO: 1708786 - RNA, 22 nt, Homo sapiens
gaggacauucuggaaaagcaaa

SEQ ID NO: 1708787 - RNA, 17 nt, Homo sapiens
gaggacuuuucuuugug

SEQ ID NO: 1708788 - RNA, 19 nt, Homo sapiens
gaggcaagugugggccacu

SEQ ID NO: 1708789 - RNA, 17 nt, Homo sapiens
gaggcagaauaagaaaa

SEQ ID NO: 1708790 - RNA, 20 nt, Homo sapiens
gaggcagagguugcagugag

SEQ ID NO: 1708791 - RNA, 13 nt, Homo sapiens
gaggcagugacag

SEQ ID NO: 1708792 - RNA, 18 nt, Homo sapiens
gaggcccuccugugcugg

SEQ ID NO: 1708793 - RNA, 20 nt, Homo sapiens
gaggcggagguugcaaugag

SEQ ID NO: 1708794 - RNA, 16 nt, Homo sapiens
gaggcugccccucuca

SEQ ID NO: 1708795 - RNA, 20 nt, Homo sapiens
gaggcugccccucucaccaa

SEQ ID NO: 1708796 - RNA, 13 nt, Homo sapiens
gagggcagcugcu

SEQ ID NO: 1708797 - RNA, 22 nt, Homo sapiens
gagggcccuccgaccacuucca

SEQ ID NO: 1708798 - RNA, 15 nt, Homo sapiens
gagguguacagguac

SEQ ID NO: 1708799 - RNA, 23 nt, Homo sapiens
gagguuucacccuuaacccaagg

SEQ ID NO: 1708800 - RNA, 23 nt, Homo sapiens
gaguaagcccucaggagccucug

SEQ ID NO: 1708801 - RNA, 17 nt, Homo sapiens
gaguagaauugcauuga

SEQ ID NO: 1708802 - RNA, 12 nt, Homo sapiens
gaguauaugcac

SEQ ID NO: 1708803 - RNA, 21 nt, Homo sapiens
gaguauauuuccgcacuucag

SEQ ID NO: 1708804 - RNA, 14 nt, Homo sapiens
gaguauccuaccca

SEQ ID NO: 1708805 - RNA, 15 nt, Homo sapiens
gaguaugucugaugg

SEQ ID NO: 1708806 - RNA, 22 nt, Homo sapiens
gagucagaucuuucuccuugaa

SEQ ID NO: 1708807 - RNA, 14 nt, Homo sapiens
gaguccucacuccc

SEQ ID NO: 1708808 - RNA, 15 nt, Homo sapiens
gaguccucacuccca

SEQ ID NO: 1708809 - RNA, 17 nt, Homo sapiens
gagucucuucuccacug

SEQ ID NO: 1708810 - RNA, 15 nt, Homo sapiens
gagucugcaugugca

SEQ ID NO: 1708811 - RNA, 19 nt, Homo sapiens
gagucuuugguucuaagga

SEQ ID NO: 1708812 - RNA, 16 nt, Homo sapiens
gagugacuaguacaaa

SEQ ID NO: 1708813 - RNA, 21 nt, Homo sapiens
gagugccguaacaacuguggu

SEQ ID NO: 1708814 - RNA, 16 nt, Homo sapiens
gagugcucaccgccuc

SEQ ID NO: 1708815 - RNA, 18 nt, Homo sapiens
gagugugacagggccagu

SEQ ID NO: 1708816 - RNA, 12 nt, Homo sapiens
gaguucauccca

SEQ ID NO: 1708817 - RNA, 19 nt, Homo sapiens
gaguucgagaccagccuga

SEQ ID NO: 1708818 - RNA, 19 nt, Homo sapiens
gaguucgaggcugcaguca

SEQ ID NO: 1708819 - RNA, 13 nt, Homo sapiens
gaguugugaucau

SEQ ID NO: 1708820 - RNA, 17 nt, Homo sapiens
gaguugugaucauccca

SEQ ID NO: 1708821 - RNA, 16 nt, Homo sapiens
gaguuugccuguacuc

SEQ ID NO: 1708822 - RNA, 20 nt, Homo sapiens
gauaaauauuugacuugcau

SEQ ID NO: 1708823 - RNA, 20 nt, Homo sapiens
gauaacucaggaagccucug

SEQ ID NO: 1708824 - RNA, 13 nt, Homo sapiens
gauaauagauucu

SEQ ID NO: 1708825 - RNA, 16 nt, Homo sapiens
gauaauagauucucuu

SEQ ID NO: 1708826 - RNA, 13 nt, Homo sapiens
gauacaaccuccc

SEQ ID NO: 1708827 - RNA, 18 nt, Homo sapiens
gauacaggaaaagcugcu

SEQ ID NO: 1708828 - RNA, 19 nt, Homo sapiens
gauacaggaaaagcugcug

SEQ ID NO: 1708829 - RNA, 22 nt, Homo sapiens
gauaccugcacuguccugacca

SEQ ID NO: 1708830 - RNA, 15 nt, Homo sapiens
gauacuucacuacuu

SEQ ID NO: 1708831 - RNA, 20 nt, Homo sapiens
gauagaugcacuuaugcagu

SEQ ID NO: 1708832 - RNA, 14 nt, Homo sapiens
gauaggaaugugaa

SEQ ID NO: 1708833 - RNA, 18 nt, Homo sapiens
gauaggaccuugggccaa

SEQ ID NO: 1708834 - RNA, 22 nt, Homo sapiens
gauagugggcaccccacugcaa

SEQ ID NO: 1708835 - RNA, 17 nt, Homo sapiens
gauauauaccacuuucc

SEQ ID NO: 1708836 - RNA, 23 nt, Homo sapiens
gauauauguuaagcagauauuca

SEQ ID NO: 1708837 - RNA, 18 nt, Homo sapiens
gauauuaacaacaauaac

SEQ ID NO: 1708838 - RNA, 18 nt, Homo sapiens
gauauuacuacuuaccau

SEQ ID NO: 1708839 - RNA, 12 nt, Homo sapiens
gauauuacuuua

SEQ ID NO: 1708840 - RNA, 13 nt, Homo sapiens
gauauuacuuuau

SEQ ID NO: 1708841 - RNA, 16 nt, Homo sapiens
gauauucagaaguaua

SEQ ID NO: 1708842 - RNA, 14 nt, Homo sapiens
gauauugucauauc

SEQ ID NO: 1708843 - RNA, 23 nt, Homo sapiens
gauauuuuaccucuuauugcaaa

SEQ ID NO: 1708844 - RNA, 15 nt, Homo sapiens
gaucaaauauuucaa

SEQ ID NO: 1708845 - RNA, 17 nt, Homo sapiens
gaucaaggaguacaaug

SEQ ID NO: 1708846 - RNA, 17 nt, Homo sapiens
gaucacgccacugcacu

SEQ ID NO: 1708847 - RNA, 19 nt, Homo sapiens
gaucauagguauuucaaaa

SEQ ID NO: 1708848 - RNA, 18 nt, Homo sapiens
gaucauccacugugccau

SEQ ID NO: 1708849 - RNA, 22 nt, Homo sapiens
gauccccguuccugacaucaca

SEQ ID NO: 1708850 - RNA, 12 nt, Homo sapiens
gaucccugacau

SEQ ID NO: 1708851 - RNA, 16 nt, Homo sapiens
gauccucccaccucag

SEQ ID NO: 1708852 - RNA, 22 nt, Homo sapiens
gaucguuuuuucccagggcaag

SEQ ID NO: 1708853 - RNA, 15 nt, Homo sapiens
gaucucacauuucac

SEQ ID NO: 1708854 - RNA, 20 nt, Homo sapiens
gaucucagcagugaaguaua

SEQ ID NO: 1708855 - RNA, 11 nt, Homo sapiens
gaucugugaua

SEQ ID NO: 1708856 - RNA, 17 nt, Homo sapiens
gaucuguuuuucaccac

SEQ ID NO: 1708857 - RNA, 13 nt, Homo sapiens
gaugacaaccucc

SEQ ID NO: 1708858 - RNA, 21 nt, Homo sapiens
gaugaggugguggaguggagu

SEQ ID NO: 1708859 - RNA, 15 nt, Homo sapiens
gaugauauucucacc

SEQ ID NO: 1708860 - RNA, 16 nt, Homo sapiens
gaugauguuauucaca

SEQ ID NO: 1708861 - RNA, 17 nt, Homo sapiens
gaugcacuuauucaaua

SEQ ID NO: 1708862 - RNA, 16 nt, Homo sapiens
gaugcagucuccucuu

SEQ ID NO: 1708863 - RNA, 12 nt, Homo sapiens
gaugcugcuaug

SEQ ID NO: 1708864 - RNA, 22 nt, Homo sapiens
gauggccacugugaauaacugu

SEQ ID NO: 1708865 - RNA, 16 nt, Homo sapiens
gauggccagagaugcu

SEQ ID NO: 1708866 - RNA, 17 nt, Homo sapiens
gauggcucgugggaugu

SEQ ID NO: 1708867 - RNA, 18 nt, Homo sapiens
gauggggcaagggcacaa

SEQ ID NO: 1708868 - RNA, 22 nt, Homo sapiens
gauguaaugucccuuucagaga

SEQ ID NO: 1708869 - RNA, 11 nt, Homo sapiens
gauguacaauu

SEQ ID NO: 1708870 - RNA, 17 nt, Homo sapiens
gauguaugaaggcuuuu

SEQ ID NO: 1708871 - RNA, 16 nt, Homo sapiens
gauguguccucaggga

SEQ ID NO: 1708872 - RNA, 16 nt, Homo sapiens
gauuacaggcaccugc

SEQ ID NO: 1708873 - RNA, 22 nt, Homo sapiens
gauuagugccuucugcccuccc

SEQ ID NO: 1708874 - RNA, 13 nt, Homo sapiens
gauuauagauucu

SEQ ID NO: 1708875 - RNA, 14 nt, Homo sapiens
gauucaaaucuaug

SEQ ID NO: 1708876 - RNA, 19 nt, Homo sapiens
gauucaacugcaucuccaa

SEQ ID NO: 1708877 - RNA, 14 nt, Homo sapiens
gauucaccaaaaua

SEQ ID NO: 1708878 - RNA, 22 nt, Homo sapiens
gauucagaaauuggaacagaau

SEQ ID NO: 1708879 - RNA, 15 nt, Homo sapiens
gauucagucuugccu

SEQ ID NO: 1708880 - RNA, 18 nt, Homo sapiens
gauucaucaucccuuaau

SEQ ID NO: 1708881 - RNA, 22 nt, Homo sapiens
gauucaugauuuauaaaugcca

SEQ ID NO: 1708882 - RNA, 14 nt, Homo sapiens
gauucaugccaauu

SEQ ID NO: 1708883 - RNA, 23 nt, Homo sapiens
gauucucuuguauaagauccuag

SEQ ID NO: 1708884 - RNA, 19 nt, Homo sapiens
gauucugcaguaaaucuuu

SEQ ID NO: 1708885 - RNA, 12 nt, Homo sapiens
gauugaacucca

SEQ ID NO: 1708886 - RNA, 22 nt, Homo sapiens
gauugcagguggaacucaguca

SEQ ID NO: 1708887 - RNA, 20 nt, Homo sapiens
gauugcugaaaaaguagauu

SEQ ID NO: 1708888 - RNA, 19 nt, Homo sapiens
gauugcuuucuucuuaacc

SEQ ID NO: 1708889 - RNA, 20 nt, Homo sapiens
gauuguccagugcaaccaca

SEQ ID NO: 1708890 - RNA, 18 nt, Homo sapiens
gauuguuuccucuuccaa

SEQ ID NO: 1708891 - RNA, 15 nt, Homo sapiens
gauuuaauacaguuu

SEQ ID NO: 1708892 - RNA, 22 nt, Homo sapiens
gauuuaauuuccaggguugcuu

SEQ ID NO: 1708893 - RNA, 22 nt, Homo sapiens
gcugcccuccuuguccacccac

SEQ ID NO: 1708894 - RNA, 17 nt, Homo sapiens
gcugcugaaaaccaucu

SEQ ID NO: 1708895 - RNA, 15 nt, Homo sapiens
gcuggacgugcgcga

SEQ ID NO: 1708896 - RNA, 13 nt, Homo sapiens
gcuggcaaccacu

SEQ ID NO: 1708897 - RNA, 18 nt, Homo sapiens
gcuggcaaccacuaagaa

SEQ ID NO: 1708898 - RNA, 16 nt, Homo sapiens
gcuggccucuaccaca

SEQ ID NO: 1708899 - RNA, 17 nt, Homo sapiens
gcugggccauguccaaa

SEQ ID NO: 1708900 - RNA, 18 nt, Homo sapiens
gcugggccauguccaaag

SEQ ID NO: 1708901 - RNA, 14 nt, Homo sapiens
gcugguggcaauaa

SEQ ID NO: 1708902 - RNA, 15 nt, Homo sapiens
gcugguggugcugca

SEQ ID NO: 1708903 - RNA, 21 nt, Homo sapiens
gcuguacccagagaguccugu

SEQ ID NO: 1708904 - RNA, 13 nt, Homo sapiens
gcuguagauccca

SEQ ID NO: 1708905 - RNA, 22 nt, Homo sapiens
gcuguaggugguaugugacacc

SEQ ID NO: 1708906 - RNA, 17 nt, Homo sapiens
gcuguccugaucuguga

SEQ ID NO: 1708907 - RNA, 16 nt, Homo sapiens
gcugucgacuucauga

SEQ ID NO: 1708908 - RNA, 14 nt, Homo sapiens
gcugucuucuggac

SEQ ID NO: 1708909 - RNA, 11 nt, Homo sapiens
gcugugcucuc

SEQ ID NO: 1708910 - RNA, 23 nt, Homo sapiens
gcugugggaaguccucccuggug

SEQ ID NO: 1708911 - RNA, 14 nt, Homo sapiens
gcuguugcuugaau

SEQ ID NO: 1708912 - RNA, 16 nt, Homo sapiens
gcuguugcuugaauag

SEQ ID NO: 1708913 - RNA, 15 nt, Homo sapiens
gcuguuuguagugaa

SEQ ID NO: 1708914 - RNA, 15 nt, Homo sapiens
gcuguuuucuucuau

SEQ ID NO: 1708915 - RNA, 18 nt, Homo sapiens
gcuuaaaacaacacucac

SEQ ID NO: 1708916 - RNA, 20 nt, Homo sapiens
gcuuaacacuaucauggacu

SEQ ID NO: 1708917 - RNA, 21 nt, Homo sapiens
gcuucaaauaaaguccugaca

SEQ ID NO: 1708918 - RNA, 23 nt, Homo sapiens
gcuucaaauaaaguccugacacu

SEQ ID NO: 1708919 - RNA, 15 nt, Homo sapiens
gcuucaaggcuucca

SEQ ID NO: 1708920 - RNA, 21 nt, Homo sapiens
gcuucacaguagagccagcuu

SEQ ID NO: 1708921 - RNA, 21 nt, Homo sapiens
gcuucaccagagcauuuccaa

SEQ ID NO: 1708922 - RNA, 17 nt, Homo sapiens
gcuucaguacuugugaa

SEQ ID NO: 1708923 - RNA, 18 nt, Homo sapiens
gcuucaguggcagcugcu

SEQ ID NO: 1708924 - RNA, 24 nt, Homo sapiens
gcuucaugugcugccugcaagcuu

SEQ ID NO: 1708925 - RNA, 11 nt, Homo sapiens
gcuuccaugau

SEQ ID NO: 1708926 - RNA, 20 nt, Homo sapiens
gcuucccaugucuuucucca

SEQ ID NO: 1708927 - RNA, 13 nt, Homo sapiens
gcuucucaucccc

SEQ ID NO: 1708928 - RNA, 19 nt, Homo sapiens
gcuucucuugagucacacu

SEQ ID NO: 1708929 - RNA, 23 nt, Homo sapiens
gcuucuggaauuuguucaaguuu

SEQ ID NO: 1708930 - RNA, 12 nt, Homo sapiens
gcuugaaccugg

SEQ ID NO: 1708931 - RNA, 19 nt, Homo sapiens
gcuugcugguagcacuugc

SEQ ID NO: 1708932 - RNA, 19 nt, Homo sapiens
gcuuggcccuuuccuucca

SEQ ID NO: 1708933 - RNA, 15 nt, Homo sapiens
gcuugugugcaaaag

SEQ ID NO: 1708934 - RNA, 20 nt, Homo sapiens
gcuugugugcaaaagcagug

SEQ ID NO: 1708935 - RNA, 11 nt, Homo sapiens
gcuuguguuaa

SEQ ID NO: 1708936 - RNA, 17 nt, Homo sapiens
gcuuuaaacucagggac

SEQ ID NO: 1708937 - RNA, 22 nt, Homo sapiens
gcuuuaaacucagggacagagc

SEQ ID NO: 1708938 - RNA, 15 nt, Homo sapiens
gcuuuacugcaugaa

SEQ ID NO: 1708939 - RNA, 17 nt, Homo sapiens
gcuuuauauauggacau

SEQ ID NO: 1708940 - RNA, 22 nt, Homo sapiens
gcuuuaugauuuucauaacuua

SEQ ID NO: 1708941 - RNA, 16 nt, Homo sapiens
gcuuucugcuuacuga

SEQ ID NO: 1708942 - RNA, 16 nt, Homo sapiens
gcuuuggauuugacau

SEQ ID NO: 1708943 - RNA, 14 nt, Homo sapiens
gcuuugguuuauau

SEQ ID NO: 1708944 - RNA, 23 nt, Homo sapiens
gcuuuguauucaaaaauuaucua

SEQ ID NO: 1708945 - RNA, 17 nt, Homo sapiens
gcuuugugucaucacaa

SEQ ID NO: 1708946 - RNA, 12 nt, Homo sapiens
gcuuuucagggu

SEQ ID NO: 1708947 - RNA, 21 nt, Homo sapiens
gcuuuuccuauuuguuuucau

SEQ ID NO: 1708948 - RNA, 13 nt, Homo sapiens
ggaaaacacugcc

SEQ ID NO: 1708949 - RNA, 14 nt, Homo sapiens
ggaaaacgugcuuu

SEQ ID NO: 1708950 - RNA, 14 nt, Homo sapiens
ggaaacacacuguu

SEQ ID NO: 1708951 - RNA, 16 nt, Homo sapiens
ggaaaccgccuaguuu

SEQ ID NO: 1708952 - RNA, 19 nt, Homo sapiens
ggaaagccucacugauaua

SEQ ID NO: 1708953 - RNA, 20 nt, Homo sapiens
ggaaaggaggcaugccucug

SEQ ID NO: 1708954 - RNA, 17 nt, Homo sapiens
ggaaauccccuuaugac

SEQ ID NO: 1708955 - RNA, 21 nt, Homo sapiens
ggaacaaaaaaaccacaaagg

SEQ ID NO: 1708956 - RNA, 18 nt, Homo sapiens
ggaacagaagacagcugc

SEQ ID NO: 1708957 - RNA, 18 nt, Homo sapiens
ggaacagaaggaugaaug

SEQ ID NO: 1708958 - RNA, 23 nt, Homo sapiens
ggaacagcacuggggagucuuug

SEQ ID NO: 1708959 - RNA, 20 nt, Homo sapiens
ggaacauauagaaugcagag

SEQ ID NO: 1708960 - RNA, 13 nt, Homo sapiens
ggaacucucucca

SEQ ID NO: 1708961 - RNA, 21 nt, Homo sapiens
ggaagaggaacagcacugggg

SEQ ID NO: 1708962 - RNA, 18 nt, Homo sapiens
ggaagcggcccuaaggga

SEQ ID NO: 1708963 - RNA, 14 nt, Homo sapiens
ggaagcuccacugu

SEQ ID NO: 1708964 - RNA, 16 nt, Homo sapiens
ggaagcuccacuguca

SEQ ID NO: 1708965 - RNA, 16 nt, Homo sapiens
ggaagcugucccucac

SEQ ID NO: 1708966 - RNA, 22 nt, Homo sapiens
ggaaggaaaugacaccaaauau

SEQ ID NO: 1708967 - RNA, 11 nt, Homo sapiens
ggaagggucaa

SEQ ID NO: 1708968 - RNA, 14 nt, Homo sapiens
ggaagguucucugu

SEQ ID NO: 1708969 - RNA, 19 nt, Homo sapiens
ggaaguaaccauuugcacu

SEQ ID NO: 1708970 - RNA, 22 nt, Homo sapiens
ggaaguccuugcccacuuccca

SEQ ID NO: 1708971 - RNA, 13 nt, Homo sapiens
ggaauaaaauccu

SEQ ID NO: 1708972 - RNA, 16 nt, Homo sapiens
ggaaucuucugaauuu

SEQ ID NO: 1708973 - RNA, 15 nt, Homo sapiens
ggaauugauuugcau

SEQ ID NO: 1708974 - RNA, 20 nt, Homo sapiens
ggacaaaugaugccauggca

SEQ ID NO: 1708975 - RNA, 15 nt, Homo sapiens
ggacaccacacccag

SEQ ID NO: 1708976 - RNA, 15 nt, Homo sapiens
ggacagaccacagag

SEQ ID NO: 1708977 - RNA, 15 nt, Homo sapiens
ggacagggaggugac

SEQ ID NO: 1708978 - RNA, 16 nt, Homo sapiens
ggacagucagcucucu

SEQ ID NO: 1708979 - RNA, 18 nt, Homo sapiens
ggacauugcggacagcca

SEQ ID NO: 1708980 - RNA, 14 nt, Homo sapiens
ggaccacaguaaca

SEQ ID NO: 1708981 - RNA, 20 nt, Homo sapiens
ggaccaugugucacuugugc

SEQ ID NO: 1708982 - RNA, 21 nt, Homo sapiens
ggaccugccccccacucugca

SEQ ID NO: 1708983 - RNA, 22 nt, Homo sapiens
ggaccugccccccacucugcac

SEQ ID NO: 1708984 - RNA, 23 nt, Homo sapiens
ggaccuggggcacaguccaggaa

SEQ ID NO: 1708985 - RNA, 19 nt, Homo sapiens
ggaccuguauuuaagcaaa

SEQ ID NO: 1708986 - RNA, 19 nt, Homo sapiens
ggacuacaccaggguccug

SEQ ID NO: 1708987 - RNA, 12 nt, Homo sapiens
ggacucaaugca

SEQ ID NO: 1708988 - RNA, 19 nt, Homo sapiens
ggacucuuacugcuaacuu

SEQ ID NO: 1708989 - RNA, 20 nt, Homo sapiens
ggacuggaaggggaagggac

SEQ ID NO: 1708990 - RNA, 10 nt, Homo sapiens
ggacugggag

SEQ ID NO: 1708991 - RNA, 18 nt, Homo sapiens
ggacuggugugcucucuu

SEQ ID NO: 1708992 - RNA, 18 nt, Homo sapiens
ggacuuccagugcucaga

SEQ ID NO: 1708993 - RNA, 22 nt, Homo sapiens
ggacuugauccuucuccaggaa

SEQ ID NO: 1708994 - RNA, 14 nt, Homo sapiens
ggagaacuagagaa

SEQ ID NO: 1708995 - RNA, 17 nt, Homo sapiens
ggagaaggcagugauua

SEQ ID NO: 1708996 - RNA, 24 nt, Homo sapiens
ggagaauuauauagguugugcaaa

SEQ ID NO: 1708997 - RNA, 19 nt, Homo sapiens
ggagacaaaagcaguuucu

SEQ ID NO: 1708998 - RNA, 19 nt, Homo sapiens
ggagacacuggccccucaa

SEQ ID NO: 1708999 - RNA, 20 nt, Homo sapiens
ggagacccaccccaccugca

SEQ ID NO: 1709000 - RNA, 12 nt, Homo sapiens
ggagacuuguau

SEQ ID NO: 1709001 - RNA, 17 nt, Homo sapiens
ggagauaaucuagaaca

SEQ ID NO: 1709002 - RNA, 15 nt, Homo sapiens
ggagcaguccaugca

SEQ ID NO: 1709003 - RNA, 13 nt, Homo sapiens
gucuuuaacucau

SEQ ID NO: 1709004 - RNA, 12 nt, Homo sapiens
gucuuuuacccg

SEQ ID NO: 1709005 - RNA, 15 nt, Homo sapiens
gucuuuuagaagaua

SEQ ID NO: 1709006 - RNA, 13 nt, Homo sapiens
gucuuuugaauau

SEQ ID NO: 1709007 - RNA, 14 nt, Homo sapiens
gugaaaaacuuaag

SEQ ID NO: 1709008 - RNA, 13 nt, Homo sapiens
gugaaacuggcac

SEQ ID NO: 1709009 - RNA, 21 nt, Homo sapiens
gugaaaggaagcuccacuguc

SEQ ID NO: 1709010 - RNA, 23 nt, Homo sapiens
gugaaccaccacacccagcccac

SEQ ID NO: 1709011 - RNA, 16 nt, Homo sapiens
gugaaccacuucauuc

SEQ ID NO: 1709012 - RNA, 17 nt, Homo sapiens
gugaaccuuaguaccua

SEQ ID NO: 1709013 - RNA, 12 nt, Homo sapiens
gugaacuuguag

SEQ ID NO: 1709014 - RNA, 15 nt, Homo sapiens
gugaagaaugcaugu

SEQ ID NO: 1709015 - RNA, 13 nt, Homo sapiens
gugaaugugggca

SEQ ID NO: 1709016 - RNA, 13 nt, Homo sapiens
gugacacagcagc

SEQ ID NO: 1709017 - RNA, 20 nt, Homo sapiens
gugacagaccacaucuuuau

SEQ ID NO: 1709018 - RNA, 21 nt, Homo sapiens
gugacccuucccaaucagcac

SEQ ID NO: 1709019 - RNA, 21 nt, Homo sapiens
gugaccucugccugaagucac

SEQ ID NO: 1709020 - RNA, 14 nt, Homo sapiens
gugaccuggccaga

SEQ ID NO: 1709021 - RNA, 22 nt, Homo sapiens
gugaccuggccagagccaagaa

SEQ ID NO: 1709022 - RNA, 20 nt, Homo sapiens
gugacucgagucacacucaa

SEQ ID NO: 1709023 - RNA, 17 nt, Homo sapiens
gugagaaauuucuguga

SEQ ID NO: 1709024 - RNA, 14 nt, Homo sapiens
gugaggagcacagc

SEQ ID NO: 1709025 - RNA, 12 nt, Homo sapiens
gugauacauuug

SEQ ID NO: 1709026 - RNA, 13 nt, Homo sapiens
gugauccucccac

SEQ ID NO: 1709027 - RNA, 18 nt, Homo sapiens
gugauccucccaccucag

SEQ ID NO: 1709028 - RNA, 12 nt, Homo sapiens
gugauguucuaa

SEQ ID NO: 1709029 - RNA, 13 nt, Homo sapiens
gugauuucucucc

SEQ ID NO: 1709030 - RNA, 13 nt, Homo sapiens
gugcacguugcuu

SEQ ID NO: 1709031 - RNA, 18 nt, Homo sapiens
gugcacugcuuugggauu

SEQ ID NO: 1709032 - RNA, 19 nt, Homo sapiens
gugcagccccuuccuggug

SEQ ID NO: 1709033 - RNA, 21 nt, Homo sapiens
gugcagccccuuccuggugac

SEQ ID NO: 1709034 - RNA, 19 nt, Homo sapiens
gugcaguggcgugaucucg

SEQ ID NO: 1709035 - RNA, 13 nt, Homo sapiens
gugcaugaugcug

SEQ ID NO: 1709036 - RNA, 17 nt, Homo sapiens
gugccagcaaugacauc

SEQ ID NO: 1709037 - RNA, 21 nt, Homo sapiens
gugccauuuuaagaguuacuu

SEQ ID NO: 1709038 - RNA, 18 nt, Homo sapiens
gugcccacccugggagac

SEQ ID NO: 1709039 - RNA, 18 nt, Homo sapiens
gugccguaacaacugugg

SEQ ID NO: 1709040 - RNA, 18 nt, Homo sapiens
gugccuggccuggcacac

SEQ ID NO: 1709041 - RNA, 23 nt, Homo sapiens
gugccugggggaguuuuccucua

SEQ ID NO: 1709042 - RNA, 18 nt, Homo sapiens
gugcgaauggacuuugga

SEQ ID NO: 1709043 - RNA, 23 nt, Homo sapiens
gugcgugcucccgaugcugcuau

SEQ ID NO: 1709044 - RNA, 12 nt, Homo sapiens
gugcucagagac

SEQ ID NO: 1709045 - RNA, 13 nt, Homo sapiens
gugcucauuuaag

SEQ ID NO: 1709046 - RNA, 22 nt, Homo sapiens
gugcucuacaccuuagugcagc

SEQ ID NO: 1709047 - RNA, 17 nt, Homo sapiens
gugcucugaucauccac

SEQ ID NO: 1709048 - RNA, 12 nt, Homo sapiens
gugcucuuugcu

SEQ ID NO: 1709049 - RNA, 12 nt, Homo sapiens
gugcugcaccug

SEQ ID NO: 1709050 - RNA, 14 nt, Homo sapiens
gugcugccauuuga

SEQ ID NO: 1709051 - RNA, 18 nt, Homo sapiens
gugcugggauuacaggug

SEQ ID NO: 1709052 - RNA, 16 nt, Homo sapiens
gugcugggcauuuuua

SEQ ID NO: 1709053 - RNA, 13 nt, Homo sapiens
gugcugugacucg

SEQ ID NO: 1709054 - RNA, 22 nt, Homo sapiens
guggaaagaaagaccaucuccc

SEQ ID NO: 1709055 - RNA, 18 nt, Homo sapiens
guggacuuagaaagcagg

SEQ ID NO: 1709056 - RNA, 14 nt, Homo sapiens
guggauuguuuaua

SEQ ID NO: 1709057 - RNA, 16 nt, Homo sapiens
guggcacacaccagua

SEQ ID NO: 1709058 - RNA, 20 nt, Homo sapiens
guggcacuugccugggucac

SEQ ID NO: 1709059 - RNA, 16 nt, Homo sapiens
guggcagacaucggcc

SEQ ID NO: 1709060 - RNA, 14 nt, Homo sapiens
guggcccaagacaa

SEQ ID NO: 1709061 - RNA, 19 nt, Homo sapiens
guggcccagggaagccaaa

SEQ ID NO: 1709062 - RNA, 12 nt, Homo sapiens
guggccucagaa

SEQ ID NO: 1709063 - RNA, 18 nt, Homo sapiens
guggcuucccgcucagcc

SEQ ID NO: 1709064 - RNA, 15 nt, Homo sapiens
gugggagaaggcagu

SEQ ID NO: 1709065 - RNA, 20 nt, Homo sapiens
gugggaggggcgcccaccuc

SEQ ID NO: 1709066 - RNA, 17 nt, Homo sapiens
gugggcuccuggcagaa

SEQ ID NO: 1709067 - RNA, 19 nt, Homo sapiens
gugggucuguguggcagga

SEQ ID NO: 1709068 - RNA, 14 nt, Homo sapiens
gugguaugugacac

SEQ ID NO: 1709069 - RNA, 22 nt, Homo sapiens
guggugcucuuugcugcacuau

SEQ ID NO: 1709070 - RNA, 23 nt, Homo sapiens
gugguggcauacgccuguagucc

SEQ ID NO: 1709071 - RNA, 21 nt, Homo sapiens
guguaauguagcguguuuaca

SEQ ID NO: 1709072 - RNA, 15 nt, Homo sapiens
guguagcuuugcucu

SEQ ID NO: 1709073 - RNA, 12 nt, Homo sapiens
gugucacaaaga

SEQ ID NO: 1709074 - RNA, 15 nt, Homo sapiens
gugucacuugugcuu

SEQ ID NO: 1709075 - RNA, 14 nt, Homo sapiens
guguccucagggag

SEQ ID NO: 1709076 - RNA, 23 nt, Homo sapiens
gugucucagggugcagaggucag

SEQ ID NO: 1709077 - RNA, 22 nt, Homo sapiens
gugucugcuuuaaagggccugc

SEQ ID NO: 1709078 - RNA, 20 nt, Homo sapiens
gugucuuccacuuugcauau

SEQ ID NO: 1709079 - RNA, 22 nt, Homo sapiens
guguggacuguggcacuugccu

SEQ ID NO: 1709080 - RNA, 13 nt, Homo sapiens
guguggcucagug

SEQ ID NO: 1709081 - RNA, 13 nt, Homo sapiens
gugugugugcaug

SEQ ID NO: 1709082 - RNA, 21 nt, Homo sapiens
guguucgcuuggcuccaugcu

SEQ ID NO: 1709083 - RNA, 14 nt, Homo sapiens
guguugaccacaga

SEQ ID NO: 1709084 - RNA, 20 nt, Homo sapiens
guguugggaaaaaggccucu

SEQ ID NO: 1709085 - RNA, 19 nt, Homo sapiens
guguuucagcuaagggaag

SEQ ID NO: 1709086 - RNA, 15 nt, Homo sapiens
guguuugguuuacau

SEQ ID NO: 1709087 - RNA, 18 nt, Homo sapiens
guuaaaaucuauucugug

SEQ ID NO: 1709088 - RNA, 17 nt, Homo sapiens
guuaaagguucacaggg

SEQ ID NO: 1709089 - RNA, 14 nt, Homo sapiens
guuaaauauuguca

SEQ ID NO: 1709090 - RNA, 12 nt, Homo sapiens
guuaacaucuca

SEQ ID NO: 1709091 - RNA, 17 nt, Homo sapiens
guuacaggaagucccuu

SEQ ID NO: 1709092 - RNA, 16 nt, Homo sapiens
guuacauaacaagaaa

SEQ ID NO: 1709093 - RNA, 11 nt, Homo sapiens
guuaccauauu

SEQ ID NO: 1709094 - RNA, 12 nt, Homo sapiens
guuaccauucac

SEQ ID NO: 1709095 - RNA, 19 nt, Homo sapiens
guuacuguggccaguauuu

SEQ ID NO: 1709096 - RNA, 21 nt, Homo sapiens
guuagagagggaccauguguc

SEQ ID NO: 1709097 - RNA, 22 nt, Homo sapiens
guuagcuggguuuacaugugau

SEQ ID NO: 1709098 - RNA, 18 nt, Homo sapiens
guuaggaaauaaaaccuu

SEQ ID NO: 1709099 - RNA, 13 nt, Homo sapiens
guuaggcauuaau

SEQ ID NO: 1709100 - RNA, 18 nt, Homo sapiens
guuauauuuaaugcauua

SEQ ID NO: 1709101 - RNA, 22 nt, Homo sapiens
guuaugaacccuuccugagcuu

SEQ ID NO: 1709102 - RNA, 15 nt, Homo sapiens
guuaugacuauguaa

SEQ ID NO: 1709103 - RNA, 14 nt, Homo sapiens
guuauguacuguac

SEQ ID NO: 1709104 - RNA, 15 nt, Homo sapiens
guuauguucagucac

SEQ ID NO: 1709105 - RNA, 19 nt, Homo sapiens
guuauuacagggcauucaa

SEQ ID NO: 1709106 - RNA, 22 nt, Homo sapiens
guuauuugaaaauuugauuuug

SEQ ID NO: 1709107 - RNA, 13 nt, Homo sapiens
guuauuugcacac

SEQ ID NO: 1709108 - RNA, 13 nt, Homo sapiens
guucaaagcacag

SEQ ID NO: 1709109 - RNA, 18 nt, Homo sapiens
guucaaugcuagaacaac

SEQ ID NO: 1709110 - RNA, 17 nt, Homo sapiens
guucacgcaacuugaaa

SEQ ID NO: 1709111 - RNA, 16 nt, Homo sapiens
guucacucccaaccug

SEQ ID NO: 1709112 - RNA, 16 nt, Homo sapiens
guucauuauguaugaa

SEQ ID NO: 1709113 - RNA, 16 nt, Homo sapiens
guucauugcacuuuga

SEQ ID NO: 1709114 - RNA, 13 nt, Homo sapiens
uacuguucuugcu

SEQ ID NO: 1709115 - RNA, 16 nt, Homo sapiens
uacuuaccauuugcua

SEQ ID NO: 1709116 - RNA, 14 nt, Homo sapiens
uacuuacuccccac

SEQ ID NO: 1709117 - RNA, 15 nt, Homo sapiens
uacuuaugccauaga

SEQ ID NO: 1709118 - RNA, 12 nt, Homo sapiens
uacuucacuacu

SEQ ID NO: 1709119 - RNA, 18 nt, Homo sapiens
uacuucaucauuuugaca

SEQ ID NO: 1709120 - RNA, 12 nt, Homo sapiens
uacuucucacca

SEQ ID NO: 1709121 - RNA, 20 nt, Homo sapiens
uacuucucuuguuagguaau

SEQ ID NO: 1709122 - RNA, 20 nt, Homo sapiens
uacuugugaaacacagcugu

SEQ ID NO: 1709123 - RNA, 17 nt, Homo sapiens
uacuuguggacacagcu

SEQ ID NO: 1709124 - RNA, 12 nt, Homo sapiens
uacuuuaccucc

SEQ ID NO: 1709125 - RNA, 15 nt, Homo sapiens
uacuuuaucacuuuu

SEQ ID NO: 1709126 - RNA, 14 nt, Homo sapiens
uacuuucacacuaa

SEQ ID NO: 1709127 - RNA, 13 nt, Homo sapiens
uagaaacaugaca

SEQ ID NO: 1709128 - RNA, 12 nt, Homo sapiens
uagaaacccaag

SEQ ID NO: 1709129 - RNA, 16 nt, Homo sapiens
uagaaagcaggggcua

SEQ ID NO: 1709130 - RNA, 17 nt, Homo sapiens
uagaaagggccuugaca

SEQ ID NO: 1709131 - RNA, 17 nt, Homo sapiens
uagaaauguaaacugcc

SEQ ID NO: 1709132 - RNA, 17 nt, Homo sapiens
uagaacaacgccuguca

SEQ ID NO: 1709133 - RNA, 17 nt, Homo sapiens
uagaaccucaccuguua

SEQ ID NO: 1709134 - RNA, 18 nt, Homo sapiens
uagaacucuccaucuuau

SEQ ID NO: 1709135 - RNA, 12 nt, Homo sapiens
uagaacugagaa

SEQ ID NO: 1709136 - RNA, 17 nt, Homo sapiens
uagaacuuauaugaauu

SEQ ID NO: 1709137 - RNA, 12 nt, Homo sapiens
uagaacuugcag

SEQ ID NO: 1709138 - RNA, 23 nt, Homo sapiens
uagaagccugcagaauccagcua

SEQ ID NO: 1709139 - RNA, 14 nt, Homo sapiens
uagaagucauaugu

SEQ ID NO: 1709140 - RNA, 15 nt, Homo sapiens
uagaauacuuuuuaa

SEQ ID NO: 1709141 - RNA, 17 nt, Homo sapiens
uagaauaggcuguguau

SEQ ID NO: 1709142 - RNA, 23 nt, Homo sapiens
uagacacccauuuucacauuccc

SEQ ID NO: 1709143 - RNA, 12 nt, Homo sapiens
uagacugccugg

SEQ ID NO: 1709144 - RNA, 20 nt, Homo sapiens
uagagauagcuacaguguaa

SEQ ID NO: 1709145 - RNA, 16 nt, Homo sapiens
uagagugucucagggu

SEQ ID NO: 1709146 - RNA, 23 nt, Homo sapiens
uagauaaaagaaccgagcaauuu

SEQ ID NO: 1709147 - RNA, 12 nt, Homo sapiens
uagauaacgcuu

SEQ ID NO: 1709148 - RNA, 17 nt, Homo sapiens
uagauauaacacuaugu

SEQ ID NO: 1709149 - RNA, 22 nt, Homo sapiens
uagaugacaaccuccauucuau

SEQ ID NO: 1709150 - RNA, 17 nt, Homo sapiens
uagaugcugacuguacu

SEQ ID NO: 1709151 - RNA, 18 nt, Homo sapiens
uagauggguuauuucaac

SEQ ID NO: 1709152 - RNA, 19 nt, Homo sapiens
uagauguauaaaucuuucu

SEQ ID NO: 1709153 - RNA, 21 nt, Homo sapiens
uagauguugccauguguuuua

SEQ ID NO: 1709154 - RNA, 21 nt, Homo sapiens
uagauucucugugucuaagau

SEQ ID NO: 1709155 - RNA, 20 nt, Homo sapiens
uagcaaauggcagaaccaaa

SEQ ID NO: 1709156 - RNA, 20 nt, Homo sapiens
uagcaagcugccgaaccaaa

SEQ ID NO: 1709157 - RNA, 18 nt, Homo sapiens
uagcacaauuugcacuaa

SEQ ID NO: 1709158 - RNA, 14 nt, Homo sapiens
uagcacuauuuaca

SEQ ID NO: 1709159 - RNA, 18 nt, Homo sapiens
uagcacuuugaaauaccu

SEQ ID NO: 1709160 - RNA, 19 nt, Homo sapiens
uagcacuuugaaauaccuc

SEQ ID NO: 1709161 - RNA, 20 nt, Homo sapiens
uagcauagcuuauuauugaa

SEQ ID NO: 1709162 - RNA, 16 nt, Homo sapiens
uagcauugagugcuuu

SEQ ID NO: 1709163 - RNA, 19 nt, Homo sapiens
uagccacugaucauuuuua

SEQ ID NO: 1709164 - RNA, 16 nt, Homo sapiens
uagcccuggaccugcc

SEQ ID NO: 1709165 - RNA, 17 nt, Homo sapiens
uagccgcccaugcacug

SEQ ID NO: 1709166 - RNA, 21 nt, Homo sapiens
uagccucauaguuauuaucca

SEQ ID NO: 1709167 - RNA, 17 nt, Homo sapiens
uagccuuagaagucaca

SEQ ID NO: 1709168 - RNA, 16 nt, Homo sapiens
uagcgccaguguaauc

SEQ ID NO: 1709169 - RNA, 22 nt, Homo sapiens
uagcguucccaacaacauccau

SEQ ID NO: 1709170 - RNA, 19 nt, Homo sapiens
uagcuauggaaucaauuca

SEQ ID NO: 1709171 - RNA, 15 nt, Homo sapiens
uagcuccacuggaga

SEQ ID NO: 1709172 - RNA, 18 nt, Homo sapiens
uagcuggccauucaggua

SEQ ID NO: 1709173 - RNA, 16 nt, Homo sapiens
uagcugggacuacagg

SEQ ID NO: 1709174 - RNA, 18 nt, Homo sapiens
uagcugggacuacaggug

SEQ ID NO: 1709175 - RNA, 15 nt, Homo sapiens
uagcugucugcucag

SEQ ID NO: 1709176 - RNA, 13 nt, Homo sapiens
uagcuuaccugac

SEQ ID NO: 1709177 - RNA, 19 nt, Homo sapiens
uagcuugcaccuugucaca

SEQ ID NO: 1709178 - RNA, 20 nt, Homo sapiens
uagcuuguauaguguaaaau

SEQ ID NO: 1709179 - RNA, 23 nt, Homo sapiens
uagcuuuaaaaccugugugccau

SEQ ID NO: 1709180 - RNA, 13 nt, Homo sapiens
uagcuuuacaaau

SEQ ID NO: 1709181 - RNA, 15 nt, Homo sapiens
uagcuuuauucuuca

SEQ ID NO: 1709182 - RNA, 18 nt, Homo sapiens
uaggaaaaaaauaguaaa

SEQ ID NO: 1709183 - RNA, 21 nt, Homo sapiens
uaggaaaaguuauugugauaa

SEQ ID NO: 1709184 - RNA, 18 nt, Homo sapiens
uaggaaccuaugaaacua

SEQ ID NO: 1709185 - RNA, 22 nt, Homo sapiens
uaggaaggucucauucuuccaa

SEQ ID NO: 1709186 - RNA, 16 nt, Homo sapiens
uaggacauugugucag

SEQ ID NO: 1709187 - RNA, 23 nt, Homo sapiens
uaggagccugcuggucacagccu

SEQ ID NO: 1709188 - RNA, 22 nt, Homo sapiens
uaggagcuuccagcucuaauaa

SEQ ID NO: 1709189 - RNA, 16 nt, Homo sapiens
uaggcauuaacacaaa

SEQ ID NO: 1709190 - RNA, 14 nt, Homo sapiens
uagggagaaaccaa

SEQ ID NO: 1709191 - RNA, 20 nt, Homo sapiens
uagguaggggcccacuucac

SEQ ID NO: 1709192 - RNA, 20 nt, Homo sapiens
uaguauugguguauguauga

SEQ ID NO: 1709193 - RNA, 18 nt, Homo sapiens
uagucaaauuauguauug

SEQ ID NO: 1709194 - RNA, 12 nt, Homo sapiens
uagucacauggc

SEQ ID NO: 1709195 - RNA, 19 nt, Homo sapiens
uagucacauggccuaugca

SEQ ID NO: 1709196 - RNA, 22 nt, Homo sapiens
uagucacauggccuaugcacau

SEQ ID NO: 1709197 - RNA, 12 nt, Homo sapiens
uaguccaaaaag

SEQ ID NO: 1709198 - RNA, 19 nt, Homo sapiens
uagucccagcuacuccgga

SEQ ID NO: 1709199 - RNA, 19 nt, Homo sapiens
uagugaagaaugcauguau

SEQ ID NO: 1709200 - RNA, 18 nt, Homo sapiens
uagugccugaaauuucac

SEQ ID NO: 1709201 - RNA, 16 nt, Homo sapiens
uagugcuuucuuguca

SEQ ID NO: 1709202 - RNA, 17 nt, Homo sapiens
uagugcuuucuugucag

SEQ ID NO: 1709203 - RNA, 20 nt, Homo sapiens
uagugggcaccccacugcaa

SEQ ID NO: 1709204 - RNA, 21 nt, Homo sapiens
uagugggcaccccacugcaau

SEQ ID NO: 1709205 - RNA, 23 nt, Homo sapiens
uagugggccagggcugcccugag

SEQ ID NO: 1709206 - RNA, 23 nt, Homo sapiens
uaguuaacauaguaaguucagca

SEQ ID NO: 1709207 - RNA, 13 nt, Homo sapiens
uaguuaauggauu

SEQ ID NO: 1709208 - RNA, 17 nt, Homo sapiens
uaguuaauuauuucaac

SEQ ID NO: 1709209 - RNA, 20 nt, Homo sapiens
uaguucacccccugagaucc

SEQ ID NO: 1709210 - RNA, 20 nt, Homo sapiens
uaguugcguggacucugcac

SEQ ID NO: 1709211 - RNA, 22 nt, Homo sapiens
uaguugcguggacucugcacau

SEQ ID NO: 1709212 - RNA, 15 nt, Homo sapiens
uaguugucuuuccug

SEQ ID NO: 1709213 - RNA, 23 nt, Homo sapiens
uaguuuugauccuaaaucugccu

SEQ ID NO: 1709214 - RNA, 16 nt, Homo sapiens
uauaaagaagaacuug

SEQ ID NO: 1709215 - RNA, 18 nt, Homo sapiens
uauaaaugagcaaauauc

SEQ ID NO: 1709216 - RNA, 20 nt, Homo sapiens
uauaaaugggaaaucagugu

SEQ ID NO: 1709217 - RNA, 18 nt, Homo sapiens
uauaaauguauauacaca

SEQ ID NO: 1709218 - RNA, 20 nt, Homo sapiens
uauaaauuuuauaacagaau

SEQ ID NO: 1709219 - RNA, 21 nt, Homo sapiens
uauaaauuuuauaacagaauu

SEQ ID NO: 1709220 - RNA, 19 nt, Homo sapiens
uauaaccauaugauacuau

SEQ ID NO: 1709221 - RNA, 15 nt, Homo sapiens
uauaagcugccauau

SEQ ID NO: 1709222 - RNA, 15 nt, Homo sapiens
uauaagucacaaaga

SEQ ID NO: 1709223 - RNA, 17 nt, Homo sapiens
uauaaucccagcacuuu

SEQ ID NO: 1709224 - RNA, 12 nt, Homo sapiens
ucaaagaaagaa

SEQ ID NO: 1709225 - RNA, 18 nt, Homo sapiens
ucaaagauccagugcagu

SEQ ID NO: 1709226 - RNA, 15 nt, Homo sapiens
ucaaagguucuaggu

SEQ ID NO: 1709227 - RNA, 17 nt, Homo sapiens
ucaaaguucuaaugaca

SEQ ID NO: 1709228 - RNA, 20 nt, Homo sapiens
ucaaaguuuugaaaagcuau

SEQ ID NO: 1709229 - RNA, 21 nt, Homo sapiens
ucaaauaaaucuaaaucuuca

SEQ ID NO: 1709230 - RNA, 14 nt, Homo sapiens
ucaaauccuuccaa

SEQ ID NO: 1709231 - RNA, 12 nt, Homo sapiens
ucaaaugggcug

SEQ ID NO: 1709232 - RNA, 19 nt, Homo sapiens
ucaaauuaagugugcauga

SEQ ID NO: 1709233 - RNA, 23 nt, Homo sapiens
ucaaauugucuuuugucaugugg

SEQ ID NO: 1709234 - RNA, 19 nt, Homo sapiens
ucaacaaagcacaguguua

SEQ ID NO: 1709235 - RNA, 13 nt, Homo sapiens
ucaacacuguuac

SEQ ID NO: 1709236 - RNA, 19 nt, Homo sapiens
ucaacaucuuuuacauucu

SEQ ID NO: 1709237 - RNA, 19 nt, Homo sapiens
ucaaccucuucuggcucaa

SEQ ID NO: 1709238 - RNA, 21 nt, Homo sapiens
ucaacuuucuguuggauucca

SEQ ID NO: 1709239 - RNA, 14 nt, Homo sapiens
ucaagaaaauggau

SEQ ID NO: 1709240 - RNA, 13 nt, Homo sapiens
ucaagacaaugca

SEQ ID NO: 1709241 - RNA, 21 nt, Homo sapiens
ucaagauuuucauacuuuuac

SEQ ID NO: 1709242 - RNA, 18 nt, Homo sapiens
ucaagcugagauugagca

SEQ ID NO: 1709243 - RNA, 22 nt, Homo sapiens
ucaagcuuuuaaaaacuagagc

SEQ ID NO: 1709244 - RNA, 15 nt, Homo sapiens
ucaaggaguacaaug

SEQ ID NO: 1709245 - RNA, 21 nt, Homo sapiens
ucaaggcccauaucugugaaa

SEQ ID NO: 1709246 - RNA, 15 nt, Homo sapiens
ucaaggcugcaguga

SEQ ID NO: 1709247 - RNA, 21 nt, Homo sapiens
ucaagggaacuugagcgugaa

SEQ ID NO: 1709248 - RNA, 17 nt, Homo sapiens
ucaagggcuuacuauuu

SEQ ID NO: 1709249 - RNA, 19 nt, Homo sapiens
ucaagguuuuagguucuaa

SEQ ID NO: 1709250 - RNA, 11 nt, Homo sapiens
ucaaguaauaa

SEQ ID NO: 1709251 - RNA, 16 nt, Homo sapiens
ucaagucaaucauuuc

SEQ ID NO: 1709252 - RNA, 19 nt, Homo sapiens
ucaagugggaucugucaca

SEQ ID NO: 1709253 - RNA, 18 nt, Homo sapiens
ucaaguuugaacucugua

SEQ ID NO: 1709254 - RNA, 21 nt, Homo sapiens
ucaaucauaauaccugcugug

SEQ ID NO: 1709255 - RNA, 21 nt, Homo sapiens
ucaaucccuagggcuggcaga

SEQ ID NO: 1709256 - RNA, 16 nt, Homo sapiens
ucaauggaaagcugcu

SEQ ID NO: 1709257 - RNA, 17 nt, Homo sapiens
ucaauuuggacuggugu

SEQ ID NO: 1709258 - RNA, 14 nt, Homo sapiens
ucacaaaaauuuga

SEQ ID NO: 1709259 - RNA, 16 nt, Homo sapiens
ucacaaaccaugcaaa

SEQ ID NO: 1709260 - RNA, 23 nt, Homo sapiens
ucacaaagaauuuaaaauaacac

SEQ ID NO: 1709261 - RNA, 21 nt, Homo sapiens
ucacaauaggccaggggaguu

SEQ ID NO: 1709262 - RNA, 11 nt, Homo sapiens
ucacaccagcc

SEQ ID NO: 1709263 - RNA, 17 nt, Homo sapiens
ucacagaguagaaacuc

SEQ ID NO: 1709264 - RNA, 14 nt, Homo sapiens
ucacagcagccucc

SEQ ID NO: 1709265 - RNA, 16 nt, Homo sapiens
ucacagcuccucccac

SEQ ID NO: 1709266 - RNA, 21 nt, Homo sapiens
ucacaggcagguccaggguuu

SEQ ID NO: 1709267 - RNA, 14 nt, Homo sapiens
ucacagggcugaaa

SEQ ID NO: 1709268 - RNA, 18 nt, Homo sapiens
ucacaguacagcaugugc

SEQ ID NO: 1709269 - RNA, 17 nt, Homo sapiens
ucacauagagugaucuu

SEQ ID NO: 1709270 - RNA, 16 nt, Homo sapiens
ucacaucugcaucuua

SEQ ID NO: 1709271 - RNA, 15 nt, Homo sapiens
ucacaugaugcauac

SEQ ID NO: 1709272 - RNA, 22 nt, Homo sapiens
ucacauuucaccccaggcucaa

SEQ ID NO: 1709273 - RNA, 15 nt, Homo sapiens
ucaccacuccauucc

SEQ ID NO: 1709274 - RNA, 18 nt, Homo sapiens
ucaccagagcauuuccaa

SEQ ID NO: 1709275 - RNA, 19 nt, Homo sapiens
ucaccagccccacugccag

SEQ ID NO: 1709276 - RNA, 22 nt, Homo sapiens
ucaccauugcugucaaguuccu

SEQ ID NO: 1709277 - RNA, 21 nt, Homo sapiens
ucacccucuccagcaagagaa

SEQ ID NO: 1709278 - RNA, 19 nt, Homo sapiens
ucacccucuuccugugauc

SEQ ID NO: 1709279 - RNA, 16 nt, Homo sapiens
ucacccuguauguuag

SEQ ID NO: 1709280 - RNA, 17 nt, Homo sapiens
ucacccuuggacaagac

SEQ ID NO: 1709281 - RNA, 20 nt, Homo sapiens
ucaccuaagucucugugaau

SEQ ID NO: 1709282 - RNA, 21 nt, Homo sapiens
ucaccucuacccaaacccuag

SEQ ID NO: 1709283 - RNA, 16 nt, Homo sapiens
ucaccuguuacugaaa

SEQ ID NO: 1709284 - RNA, 14 nt, Homo sapiens
ucacggccaagugu

SEQ ID NO: 1709285 - RNA, 23 nt, Homo sapiens
ucacgggucacuugaaauucuuu

SEQ ID NO: 1709286 - RNA, 23 nt, Homo sapiens
ucacuaaagcaguagaaauaaua

SEQ ID NO: 1709287 - RNA, 14 nt, Homo sapiens
ucacuaauacuaau

SEQ ID NO: 1709288 - RNA, 13 nt, Homo sapiens
ucacucaagcacu

SEQ ID NO: 1709289 - RNA, 16 nt, Homo sapiens
ucacucaagcacugau

SEQ ID NO: 1709290 - RNA, 17 nt, Homo sapiens
ucacuccaaugucugcu

SEQ ID NO: 1709291 - RNA, 19 nt, Homo sapiens
ucacuccacaacccaagaa

SEQ ID NO: 1709292 - RNA, 11 nt, Homo sapiens
ucacucuguca

SEQ ID NO: 1709293 - RNA, 16 nt, Homo sapiens
ucacugaaguucuccu

SEQ ID NO: 1709294 - RNA, 14 nt, Homo sapiens
ucacugcaaccucc

SEQ ID NO: 1709295 - RNA, 13 nt, Homo sapiens
ucacugggccaau

SEQ ID NO: 1709296 - RNA, 15 nt, Homo sapiens
ucacuucauagcuca

SEQ ID NO: 1709297 - RNA, 13 nt, Homo sapiens
ucacuuccuacaa

SEQ ID NO: 1709298 - RNA, 13 nt, Homo sapiens
ucacuucucuuaa

SEQ ID NO: 1709299 - RNA, 19 nt, Homo sapiens
ucacuuuuuacagugcuau

SEQ ID NO: 1709300 - RNA, 16 nt, Homo sapiens
ucagaaacgaaaucua

SEQ ID NO: 1709301 - RNA, 19 nt, Homo sapiens
ucagaaccucuuccccaga

SEQ ID NO: 1709302 - RNA, 15 nt, Homo sapiens
ucagaauaaggcagg

SEQ ID NO: 1709303 - RNA, 21 nt, Homo sapiens
ucagaauaaggcaggcauuga

SEQ ID NO: 1709304 - RNA, 15 nt, Homo sapiens
ucagacagaacuuga

SEQ ID NO: 1709305 - RNA, 16 nt, Homo sapiens
ucagacauaaagccau

SEQ ID NO: 1709306 - RNA, 16 nt, Homo sapiens
ucagagaccugaagug

SEQ ID NO: 1709307 - RNA, 14 nt, Homo sapiens
ucagagcacagcag

SEQ ID NO: 1709308 - RNA, 23 nt, Homo sapiens
ucagaggaccuguauuuaagcaa

SEQ ID NO: 1709309 - RNA, 16 nt, Homo sapiens
ucagaugaacucuuag

SEQ ID NO: 1709310 - RNA, 20 nt, Homo sapiens
ucagaugcuccaagauucua

SEQ ID NO: 1709311 - RNA, 23 nt, Homo sapiens
ucagaugcuguuaguaccuacau

SEQ ID NO: 1709312 - RNA, 20 nt, Homo sapiens
ucagauuauuuaaaugggaa

SEQ ID NO: 1709313 - RNA, 16 nt, Homo sapiens
ucagcaucugugaugg

SEQ ID NO: 1709314 - RNA, 16 nt, Homo sapiens
ucagcauuuggaccaa

SEQ ID NO: 1709315 - RNA, 14 nt, Homo sapiens
ucagccacauucua

SEQ ID NO: 1709316 - RNA, 23 nt, Homo sapiens
ucagccuacuuucacacuaagaa

SEQ ID NO: 1709317 - RNA, 20 nt, Homo sapiens
ucagccucuuaaagcugccu

SEQ ID NO: 1709318 - RNA, 21 nt, Homo sapiens
ucagcuaagggaagacauuuc

SEQ ID NO: 1709319 - RNA, 15 nt, Homo sapiens
ucagcugaaugccuc

SEQ ID NO: 1709320 - RNA, 19 nt, Homo sapiens
ucagcuuucagggccaugg

SEQ ID NO: 1709321 - RNA, 18 nt, Homo sapiens
ucaggaaggggugugcug

SEQ ID NO: 1709322 - RNA, 13 nt, Homo sapiens
ucaggcagcucaa

SEQ ID NO: 1709323 - RNA, 19 nt, Homo sapiens
ucaggcccuggugcgaaug

SEQ ID NO: 1709324 - RNA, 16 nt, Homo sapiens
ucaggccgcauccuga

SEQ ID NO: 1709325 - RNA, 14 nt, Homo sapiens
ucagggacagagcc

SEQ ID NO: 1709326 - RNA, 16 nt, Homo sapiens
ucagggccaugccugc

SEQ ID NO: 1709327 - RNA, 22 nt, Homo sapiens
ucaggggugauaacucaggaag

SEQ ID NO: 1709328 - RNA, 16 nt, Homo sapiens
ucagguauguugccuu

SEQ ID NO: 1709329 - RNA, 16 nt, Homo sapiens
ucagguggggcagcuu

SEQ ID NO: 1709330 - RNA, 16 nt, Homo sapiens
ucaguccccauggcac

SEQ ID NO: 1709331 - RNA, 20 nt, Homo sapiens
ucaguccugcuccagaauuu

SEQ ID NO: 1709332 - RNA, 23 nt, Homo sapiens
ucaguccugggagacccauguaa

SEQ ID NO: 1709333 - RNA, 14 nt, Homo sapiens
ucagugaaagccag

SEQ ID NO: 1709334 - RNA, 22 nt, Homo sapiens
uuaugaagcaagccccacuuau

SEQ ID NO: 1709335 - RNA, 22 nt, Homo sapiens
uuaugaccaugguauauuccua

SEQ ID NO: 1709336 - RNA, 15 nt, Homo sapiens
uuaugccuucacuuu

SEQ ID NO: 1709337 - RNA, 21 nt, Homo sapiens
uuaugccuucacuuuacaaau

SEQ ID NO: 1709338 - RNA, 23 nt, Homo sapiens
uuaugugaguguguguuugugcu

SEQ ID NO: 1709339 - RNA, 14 nt, Homo sapiens
uuauguuagcauug

SEQ ID NO: 1709340 - RNA, 13 nt, Homo sapiens
uuauguucaguca

SEQ ID NO: 1709341 - RNA, 19 nt, Homo sapiens
uuauuauuuuggggucucu

SEQ ID NO: 1709342 - RNA, 17 nt, Homo sapiens
uuauucauuagcuguga

SEQ ID NO: 1709343 - RNA, 21 nt, Homo sapiens
uuauuuaaaaugcauaauuca

SEQ ID NO: 1709344 - RNA, 17 nt, Homo sapiens
uuauuuuguauuguggu

SEQ ID NO: 1709345 - RNA, 18 nt, Homo sapiens
uuauuuuuaaaaagaaau

SEQ ID NO: 1709346 - RNA, 14 nt, Homo sapiens
uucaaaauccaaaa

SEQ ID NO: 1709347 - RNA, 17 nt, Homo sapiens
uucaaacugcaugauuc

SEQ ID NO: 1709348 - RNA, 13 nt, Homo sapiens
uucaaacugugaa

SEQ ID NO: 1709349 - RNA, 22 nt, Homo sapiens
uucaaacugugaagcauuuaca

SEQ ID NO: 1709350 - RNA, 22 nt, Homo sapiens
uucaaaucacauggaacuuuag

SEQ ID NO: 1709351 - RNA, 12 nt, Homo sapiens
uucaaaugaaac

SEQ ID NO: 1709352 - RNA, 22 nt, Homo sapiens
uucaaaugugcugucaaaacaa

SEQ ID NO: 1709353 - RNA, 18 nt, Homo sapiens
uucaacaguuuuugcuaa

SEQ ID NO: 1709354 - RNA, 16 nt, Homo sapiens
uucaacuugcauccaa

SEQ ID NO: 1709355 - RNA, 12 nt, Homo sapiens
uucaagauccuc

SEQ ID NO: 1709356 - RNA, 15 nt, Homo sapiens
uucaagccugugcaa

SEQ ID NO: 1709357 - RNA, 14 nt, Homo sapiens
uucacacccugcaa

SEQ ID NO: 1709358 - RNA, 19 nt, Homo sapiens
uucacauaguuuauuucaa

SEQ ID NO: 1709359 - RNA, 19 nt, Homo sapiens
uucacauucagaaguaauu

SEQ ID NO: 1709360 - RNA, 21 nt, Homo sapiens
uucaccaaaauagucuucuca

SEQ ID NO: 1709361 - RNA, 17 nt, Homo sapiens
uucaccacaugugcaca

SEQ ID NO: 1709362 - RNA, 11 nt, Homo sapiens
uucaccagagc

SEQ ID NO: 1709363 - RNA, 18 nt, Homo sapiens
uucaccagagcauuucca

SEQ ID NO: 1709364 - RNA, 15 nt, Homo sapiens
uucaccagauuugcu

SEQ ID NO: 1709365 - RNA, 17 nt, Homo sapiens
uucacccaucuuaucaa

SEQ ID NO: 1709366 - RNA, 22 nt, Homo sapiens
uucaccuaagucucugugaauu

SEQ ID NO: 1709367 - RNA, 13 nt, Homo sapiens
uucacgccauucu

SEQ ID NO: 1709368 - RNA, 15 nt, Homo sapiens
uucacgccauucucc

SEQ ID NO: 1709369 - RNA, 19 nt, Homo sapiens
uucacgcuguuuguuucau

SEQ ID NO: 1709370 - RNA, 17 nt, Homo sapiens
uucacucaagcacugau

SEQ ID NO: 1709371 - RNA, 13 nt, Homo sapiens
uucacucugucau

SEQ ID NO: 1709372 - RNA, 14 nt, Homo sapiens
uucacuguugaaaa

SEQ ID NO: 1709373 - RNA, 18 nt, Homo sapiens
uucacuugaugauacaau

SEQ ID NO: 1709374 - RNA, 15 nt, Homo sapiens
uucagacaagcugca

SEQ ID NO: 1709375 - RNA, 23 nt, Homo sapiens
uucagagagcagcuuuaaacuca

SEQ ID NO: 1709376 - RNA, 12 nt, Homo sapiens
uucagagauuua

SEQ ID NO: 1709377 - RNA, 16 nt, Homo sapiens
uucagauacaaacugc

SEQ ID NO: 1709378 - RNA, 12 nt, Homo sapiens
uucagauauuau

SEQ ID NO: 1709379 - RNA, 20 nt, Homo sapiens
uucagaugcuguuaguaccu

SEQ ID NO: 1709380 - RNA, 18 nt, Homo sapiens
uucagcaacugucuuauu

SEQ ID NO: 1709381 - RNA, 13 nt, Homo sapiens
uucagcucuacag

SEQ ID NO: 1709382 - RNA, 23 nt, Homo sapiens
uucagguauaaggcaggguggug

SEQ ID NO: 1709383 - RNA, 14 nt, Homo sapiens
uucaguacuuguga

SEQ ID NO: 1709384 - RNA, 14 nt, Homo sapiens
uucaguggcagcug

SEQ ID NO: 1709385 - RNA, 21 nt, Homo sapiens
uucaguucagauaauuggcaa

SEQ ID NO: 1709386 - RNA, 13 nt, Homo sapiens
uucaguuccaaga

SEQ ID NO: 1709387 - RNA, 15 nt, Homo sapiens
uucauacacuaacca

SEQ ID NO: 1709388 - RNA, 12 nt, Homo sapiens
uucauaccuaag

SEQ ID NO: 1709389 - RNA, 19 nt, Homo sapiens
uucaucuacccugcugacc

SEQ ID NO: 1709390 - RNA, 16 nt, Homo sapiens
uucaugcucugcaaaa

SEQ ID NO: 1709391 - RNA, 19 nt, Homo sapiens
uucauggugaaaauguacu

SEQ ID NO: 1709392 - RNA, 14 nt, Homo sapiens
uucauguggcugua

SEQ ID NO: 1709393 - RNA, 15 nt, Homo sapiens
uucauguuugcuuca

SEQ ID NO: 1709394 - RNA, 23 nt, Homo sapiens
uucauuacuugauuaagauuuua

SEQ ID NO: 1709395 - RNA, 16 nt, Homo sapiens
uucauuagacacuuaa

SEQ ID NO: 1709396 - RNA, 18 nt, Homo sapiens
uucauucaguacaagaga

SEQ ID NO: 1709397 - RNA, 13 nt, Homo sapiens
uucauucugcauu

SEQ ID NO: 1709398 - RNA, 13 nt, Homo sapiens
uucauugaugacc

SEQ ID NO: 1709399 - RNA, 16 nt, Homo sapiens
uucauugcacuuugau

SEQ ID NO: 1709400 - RNA, 21 nt, Homo sapiens
uuccaaaauaauuuuaagaaa

SEQ ID NO: 1709401 - RNA, 23 nt, Homo sapiens
uuccaacaccacagacacacaca

SEQ ID NO: 1709402 - RNA, 18 nt, Homo sapiens
uuccaaguuuccaaacaa

SEQ ID NO: 1709403 - RNA, 21 nt, Homo sapiens
uuccacaguugccaccaccuc

SEQ ID NO: 1709404 - RNA, 22 nt, Homo sapiens
uuccagaagaagagaagcugcu

SEQ ID NO: 1709405 - RNA, 13 nt, Homo sapiens
uuccagacugcuu

SEQ ID NO: 1709406 - RNA, 17 nt, Homo sapiens
uuccagcguacuauaau

SEQ ID NO: 1709407 - RNA, 17 nt, Homo sapiens
uuccagcugcugucuuc

SEQ ID NO: 1709408 - RNA, 19 nt, Homo sapiens
uuccaggggucguuugcuu

SEQ ID NO: 1709409 - RNA, 14 nt, Homo sapiens
uuccagguguuacu

SEQ ID NO: 1709410 - RNA, 15 nt, Homo sapiens
uuccaugaugguuau

SEQ ID NO: 1709411 - RNA, 20 nt, Homo sapiens
uuccaugggauacaaccucc

SEQ ID NO: 1709412 - RNA, 20 nt, Homo sapiens
uucccaaauaaacucuaaac

SEQ ID NO: 1709413 - RNA, 20 nt, Homo sapiens
uucccaacuagacauuacca

SEQ ID NO: 1709414 - RNA, 21 nt, Homo sapiens
uuccccagcgucccagucucu

SEQ ID NO: 1709415 - RNA, 16 nt, Homo sapiens
uuccccaucuucuaaa

SEQ ID NO: 1709416 - RNA, 15 nt, Homo sapiens
uuccccuugccuaaa

SEQ ID NO: 1709417 - RNA, 16 nt, Homo sapiens
uucccucugcucagcc

SEQ ID NO: 1709418 - RNA, 19 nt, Homo sapiens
uucccuuaaacaaaagugu

SEQ ID NO: 1709419 - RNA, 15 nt, Homo sapiens
uucccuuuccccagc

SEQ ID NO: 1709420 - RNA, 19 nt, Homo sapiens
uuccucaugaaucucucaa

SEQ ID NO: 1709421 - RNA, 19 nt, Homo sapiens
uuccugacaucacagcagc

SEQ ID NO: 1709422 - RNA, 18 nt, Homo sapiens
uuccuguauguuguccaa

SEQ ID NO: 1709423 - RNA, 21 nt, Homo sapiens
uuccuugaauguggcuugaga

SEQ ID NO: 1709424 - RNA, 16 nt, Homo sapiens
uuccuugggaugaucu

SEQ ID NO: 1709425 - RNA, 15 nt, Homo sapiens
uucgaagccuugccu

SEQ ID NO: 1709426 - RNA, 19 nt, Homo sapiens
uucgagaccagccugacca

SEQ ID NO: 1709427 - RNA, 23 nt, Homo sapiens
uucgauacaccgggccuggagaa

SEQ ID NO: 1709428 - RNA, 23 nt, Homo sapiens
uucgcaccuaccaucagggacag

SEQ ID NO: 1709429 - RNA, 13 nt, Homo sapiens
uucguaguuuuca

SEQ ID NO: 1709430 - RNA, 21 nt, Homo sapiens
uucuaaaaucuuauaguucua

SEQ ID NO: 1709431 - RNA, 15 nt, Homo sapiens
uucuaaagagcacuu

SEQ ID NO: 1709432 - RNA, 14 nt, Homo sapiens
uucuaaaguucuaa

SEQ ID NO: 1709433 - RNA, 13 nt, Homo sapiens
uucuaagauucug

SEQ ID NO: 1709434 - RNA, 16 nt, Homo sapiens
uucuaaguuucuaaga

SEQ ID NO: 1709435 - RNA, 16 nt, Homo sapiens
uucuaguggucuuugu

SEQ ID NO: 1709436 - RNA, 14 nt, Homo sapiens
uucuauaguucuag

SEQ ID NO: 1709437 - RNA, 21 nt, Homo sapiens
uucuauaugaauuuaaauaua

SEQ ID NO: 1709438 - RNA, 15 nt, Homo sapiens
uucuauugacuucaa

SEQ ID NO: 1709439 - RNA, 17 nt, Homo sapiens
uucucagccacaaaaua

SEQ ID NO: 1709440 - RNA, 19 nt, Homo sapiens
uucucagcuauuuccagag

SEQ ID NO: 1709441 - RNA, 21 nt, Homo sapiens
uucucccgugagccaggcaaa

SEQ ID NO: 1709442 - RNA, 20 nt, Homo sapiens
uucuccugccugugcuguga

SEQ ID NO: 1709443 - RNA, 19 nt, Homo sapiens
uucuccuguuuauucccau

SEQ ID NO: 1709444 - RNA, 12 nt, Homo sapiens
aaacacagagaa

SEQ ID NO: 1709445 - RNA, 21 nt, Homo sapiens
aaacaccacuaauuguguaca

SEQ ID NO: 1709446 - RNA, 12 nt, Homo sapiens
aaacacugccau

SEQ ID NO: 1709447 - RNA, 13 nt, Homo sapiens
aaacacuguggaa

SEQ ID NO: 1709448 - RNA, 14 nt, Homo sapiens
aaacacuuacagaa

SEQ ID NO: 1709449 - RNA, 22 nt, Homo sapiens
aaacacuuugccuccuguguac

SEQ ID NO: 1709450 - RNA, 16 nt, Homo sapiens
aaacagauuucauacc

SEQ ID NO: 1709451 - RNA, 21 nt, Homo sapiens
aaacagcaggacuuguuuaca

SEQ ID NO: 1709452 - RNA, 13 nt, Homo sapiens
aaacauacguucu

SEQ ID NO: 1709453 - RNA, 23 nt, Homo sapiens
aaacauguauuuauguaaugaag

SEQ ID NO: 1709454 - RNA, 19 nt, Homo sapiens
aaaccaagcaucaggggga

SEQ ID NO: 1709455 - RNA, 21 nt, Homo sapiens
aaaccacuagaacucuccauc

SEQ ID NO: 1709456 - RNA, 14 nt, Homo sapiens
aaaccacuuuccuu

SEQ ID NO: 1709457 - RNA, 14 nt, Homo sapiens
aaaccauccaguga

SEQ ID NO: 1709458 - RNA, 13 nt, Homo sapiens
aaacccaauccaa

SEQ ID NO: 1709459 - RNA, 20 nt, Homo sapiens
aaaccccaucuuuacuaaaa

SEQ ID NO: 1709460 - RNA, 13 nt, Homo sapiens
aaacccucuguca

SEQ ID NO: 1709461 - RNA, 15 nt, Homo sapiens
aaaccuggaugucac

SEQ ID NO: 1709462 - RNA, 17 nt, Homo sapiens
aaaccugugugccauuu

SEQ ID NO: 1709463 - RNA, 21 nt, Homo sapiens
aaaccuugcuaauuuucucaa

SEQ ID NO: 1709464 - RNA, 16 nt, Homo sapiens
aaacggauuccaaaga

SEQ ID NO: 1709465 - RNA, 16 nt, Homo sapiens
aaacuaaaagacauuu

SEQ ID NO: 1709466 - RNA, 16 nt, Homo sapiens
aaacuaaaucucuaau

SEQ ID NO: 1709467 - RNA, 17 nt, Homo sapiens
aaacuaaaucucuaaua

SEQ ID NO: 1709468 - RNA, 22 nt, Homo sapiens
aaacucagccugggacaguuua

SEQ ID NO: 1709469 - RNA, 19 nt, Homo sapiens
aaacucauuacuuuuccau

SEQ ID NO: 1709470 - RNA, 15 nt, Homo sapiens
aaacugaauuuguac

SEQ ID NO: 1709471 - RNA, 20 nt, Homo sapiens
aaacugcauuuccuuucuac

SEQ ID NO: 1709472 - RNA, 17 nt, Homo sapiens
aaacugcuuacuuaugc

SEQ ID NO: 1709473 - RNA, 23 nt, Homo sapiens
aaacugcuuuuuuuuuuccagca

SEQ ID NO: 1709474 - RNA, 18 nt, Homo sapiens
aaacuggacagucacugc

SEQ ID NO: 1709475 - RNA, 21 nt, Homo sapiens
aaacuggcugcuuuguucaau

SEQ ID NO: 1709476 - RNA, 15 nt, Homo sapiens
aaacugugaagcauu

SEQ ID NO: 1709477 - RNA, 21 nt, Homo sapiens
aaacuuaccuaagugacauuu

SEQ ID NO: 1709478 - RNA, 21 nt, Homo sapiens
aaacuugugaaugcuucucac

SEQ ID NO: 1709479 - RNA, 13 nt, Homo sapiens
aaacuuguuuaca

SEQ ID NO: 1709480 - RNA, 23 nt, Homo sapiens
aaacuuuaggguaaaaauugcca

SEQ ID NO: 1709481 - RNA, 13 nt, Homo sapiens
aaagaagaacuug

SEQ ID NO: 1709482 - RNA, 17 nt, Homo sapiens
aaagacauucuuccaaa

SEQ ID NO: 1709483 - RNA, 21 nt, Homo sapiens
aaagacauucuuccaaaaaga

SEQ ID NO: 1709484 - RNA, 18 nt, Homo sapiens
aaagacgauuugucaguu

SEQ ID NO: 1709485 - RNA, 18 nt, Homo sapiens
aaagagcuuugugauaua

SEQ ID NO: 1709486 - RNA, 20 nt, Homo sapiens
aaagaggcugccccucucac

SEQ ID NO: 1709487 - RNA, 22 nt, Homo sapiens
aaagaggcugccccucucacca

SEQ ID NO: 1709488 - RNA, 18 nt, Homo sapiens
aaagaguauauguucccu

SEQ ID NO: 1709489 - RNA, 22 nt, Homo sapiens
aaagauccaagaaggccuucau

SEQ ID NO: 1709490 - RNA, 19 nt, Homo sapiens
aaagauuagcaaggucauu

SEQ ID NO: 1709491 - RNA, 23 nt, Homo sapiens
aaagauuggacaccccugcuaua

SEQ ID NO: 1709492 - RNA, 23 nt, Homo sapiens
aaagcacgugucucagacugcau

SEQ ID NO: 1709493 - RNA, 20 nt, Homo sapiens
aaagcaguaaauuugcuagc

SEQ ID NO: 1709494 - RNA, 20 nt, Homo sapiens
aaagcauggacuaaccccaa

SEQ ID NO: 1709495 - RNA, 13 nt, Homo sapiens
aaagcccuuccau

SEQ ID NO: 1709496 - RNA, 13 nt, Homo sapiens
aaagccuccucau

SEQ ID NO: 1709497 - RNA, 18 nt, Homo sapiens
aaagcuugaagcugugga

SEQ ID NO: 1709498 - RNA, 19 nt, Homo sapiens
aaaggaagcuccacuguca

SEQ ID NO: 1709499 - RNA, 12 nt, Homo sapiens
cagcacauauuu

SEQ ID NO: 1709500 - RNA, 20 nt, Homo sapiens
cagcacugaaaauaccauca

SEQ ID NO: 1709501 - RNA, 14 nt, Homo sapiens
cagcacuugucuca

SEQ ID NO: 1709502 - RNA, 20 nt, Homo sapiens
cagcagcauuuuuauuucag

SEQ ID NO: 1709503 - RNA, 20 nt, Homo sapiens
cagcagccgccuuaagcuga

SEQ ID NO: 1709504 - RNA, 18 nt, Homo sapiens
cagcaggcauggauccag

SEQ ID NO: 1709505 - RNA, 15 nt, Homo sapiens
cagcaggugcucaau

SEQ ID NO: 1709506 - RNA, 18 nt, Homo sapiens
cagccaaacccugucuga

SEQ ID NO: 1709507 - RNA, 18 nt, Homo sapiens
cagccaaccucauugcag

SEQ ID NO: 1709508 - RNA, 15 nt, Homo sapiens
cagccaacuuuugca

SEQ ID NO: 1709509 - RNA, 15 nt, Homo sapiens
cagccacccugagaa

SEQ ID NO: 1709510 - RNA, 15 nt, Homo sapiens
cagccacuuuaguga

SEQ ID NO: 1709511 - RNA, 21 nt, Homo sapiens
cagccaggcagguccacagag

SEQ ID NO: 1709512 - RNA, 14 nt, Homo sapiens
cagccaggcugcca

SEQ ID NO: 1709513 - RNA, 17 nt, Homo sapiens
cagcccagagacuuugu

SEQ ID NO: 1709514 - RNA, 16 nt, Homo sapiens
cagccccagugcccac

SEQ ID NO: 1709515 - RNA, 19 nt, Homo sapiens
cagcccugaggugaaaggg

SEQ ID NO: 1709516 - RNA, 18 nt, Homo sapiens
cagccgccuuaagcugau

SEQ ID NO: 1709517 - RNA, 24 nt, Homo sapiens
cagccgggauuuugagaucaucag

SEQ ID NO: 1709518 - RNA, 14 nt, Homo sapiens
cagccuccaacaca

SEQ ID NO: 1709519 - RNA, 20 nt, Homo sapiens
cagccucccgaauagcuggg

SEQ ID NO: 1709520 - RNA, 22 nt, Homo sapiens
cagccucugaccccuccucacu

SEQ ID NO: 1709521 - RNA, 14 nt, Homo sapiens
cagccuggagaccc

SEQ ID NO: 1709522 - RNA, 22 nt, Homo sapiens
cagccuggggggucguggcaga

SEQ ID NO: 1709523 - RNA, 16 nt, Homo sapiens
cagcgagcccuggugg

SEQ ID NO: 1709524 - RNA, 20 nt, Homo sapiens
cagcgcagcuggacucugca

SEQ ID NO: 1709525 - RNA, 21 nt, Homo sapiens
cagcgcagcuggacucugcau

SEQ ID NO: 1709526 - RNA, 15 nt, Homo sapiens
cagcgucccagucuc

SEQ ID NO: 1709527 - RNA, 18 nt, Homo sapiens
cagcgucccuagcaguga

SEQ ID NO: 1709528 - RNA, 12 nt, Homo sapiens
cagcuacucaga

SEQ ID NO: 1709529 - RNA, 17 nt, Homo sapiens
cagcucagcgccagccu

SEQ ID NO: 1709530 - RNA, 18 nt, Homo sapiens
cagcucaggaacuagacu

SEQ ID NO: 1709531 - RNA, 16 nt, Homo sapiens
cagcucccugccaaac

SEQ ID NO: 1709532 - RNA, 23 nt, Homo sapiens
cagcuccuccccacuagcauuuu

SEQ ID NO: 1709533 - RNA, 14 nt, Homo sapiens
cagcucuccaauac

SEQ ID NO: 1709534 - RNA, 19 nt, Homo sapiens
cagcucucuccuuucaggg

SEQ ID NO: 1709535 - RNA, 18 nt, Homo sapiens
cagcucuguguugccaug

SEQ ID NO: 1709536 - RNA, 18 nt, Homo sapiens
cagcugaaaguucuugcu

SEQ ID NO: 1709537 - RNA, 19 nt, Homo sapiens
cagcugccaucgaccugga

SEQ ID NO: 1709538 - RNA, 20 nt, Homo sapiens
cagcuggacagaggggacuc

SEQ ID NO: 1709539 - RNA, 16 nt, Homo sapiens
cagcugucuguggcuu

SEQ ID NO: 1709540 - RNA, 23 nt, Homo sapiens
cagcugugugggucauaccgugu

SEQ ID NO: 1709541 - RNA, 21 nt, Homo sapiens
cagcuucaccagagcauuucc

SEQ ID NO: 1709542 - RNA, 16 nt, Homo sapiens
cagcuuggcccuuucc

SEQ ID NO: 1709543 - RNA, 13 nt, Homo sapiens
cagcuuguaugca

SEQ ID NO: 1709544 - RNA, 19 nt, Homo sapiens
cagcuuugcuaccaaagca

SEQ ID NO: 1709545 - RNA, 14 nt, Homo sapiens
caggaaaccacuua

SEQ ID NO: 1709546 - RNA, 20 nt, Homo sapiens
caggaaaguuuacccaugaa

SEQ ID NO: 1709547 - RNA, 15 nt, Homo sapiens
caggaaguacuucca

SEQ ID NO: 1709548 - RNA, 21 nt, Homo sapiens
caggacacggggcaguggcaa

SEQ ID NO: 1709549 - RNA, 18 nt, Homo sapiens
caggacagucagcucucu

SEQ ID NO: 1709550 - RNA, 20 nt, Homo sapiens
caggacuugagaagaccuca

SEQ ID NO: 1709551 - RNA, 16 nt, Homo sapiens
caggacuuguuuacaa

SEQ ID NO: 1709552 - RNA, 16 nt, Homo sapiens
caggauauugacaaga

SEQ ID NO: 1709553 - RNA, 17 nt, Homo sapiens
caggaugagguggugga

SEQ ID NO: 1709554 - RNA, 19 nt, Homo sapiens
caggcacagguccccagau

SEQ ID NO: 1709555 - RNA, 17 nt, Homo sapiens
caggcacccaccaucau

SEQ ID NO: 1709556 - RNA, 18 nt, Homo sapiens
caggcagcgauggucuca

SEQ ID NO: 1709557 - RNA, 16 nt, Homo sapiens
caggcagcgccaagug

SEQ ID NO: 1709558 - RNA, 18 nt, Homo sapiens
caggcccggcuccaggcu

SEQ ID NO: 1709559 - RNA, 18 nt, Homo sapiens
caggcccuggugcgaaug

SEQ ID NO: 1709560 - RNA, 17 nt, Homo sapiens
caggccgcagcuccauu

SEQ ID NO: 1709561 - RNA, 20 nt, Homo sapiens
caggcgauccaccugucuca

SEQ ID NO: 1709562 - RNA, 16 nt, Homo sapiens
caggcucaacugagga

SEQ ID NO: 1709563 - RNA, 22 nt, Homo sapiens
caggcucaacugaggauguggc

SEQ ID NO: 1709564 - RNA, 20 nt, Homo sapiens
caggcugggccauguccaaa

SEQ ID NO: 1709565 - RNA, 14 nt, Homo sapiens
caggcugugcagcg

SEQ ID NO: 1709566 - RNA, 18 nt, Homo sapiens
caggcuguucugcacuga

SEQ ID NO: 1709567 - RNA, 13 nt, Homo sapiens
caggcuugugcaa

SEQ ID NO: 1709568 - RNA, 23 nt, Homo sapiens
cagggaauccugaccugagccag

SEQ ID NO: 1709569 - RNA, 13 nt, Homo sapiens
cagggaucuugca

SEQ ID NO: 1709570 - RNA, 14 nt, Homo sapiens
cagggaucuugcaa

SEQ ID NO: 1709571 - RNA, 22 nt, Homo sapiens
cagggcaaaugacaugcacuga

SEQ ID NO: 1709572 - RNA, 14 nt, Homo sapiens
cagggcaaucaaug

SEQ ID NO: 1709573 - RNA, 13 nt, Homo sapiens
cagggccaacuug

SEQ ID NO: 1709574 - RNA, 20 nt, Homo sapiens
caggggcgugaggucccagg

SEQ ID NO: 1709575 - RNA, 14 nt, Homo sapiens
cagggggacuagcc

SEQ ID NO: 1709576 - RNA, 12 nt, Homo sapiens
cagggucucacu

SEQ ID NO: 1709577 - RNA, 20 nt, Homo sapiens
cagggugacccugaagugag

SEQ ID NO: 1709578 - RNA, 22 nt, Homo sapiens
cagggugaucgcacaaccugca

SEQ ID NO: 1709579 - RNA, 17 nt, Homo sapiens
cagggugguguaccugc

SEQ ID NO: 1709580 - RNA, 21 nt, Homo sapiens
caggguuuugccauguuggcc

SEQ ID NO: 1709581 - RNA, 18 nt, Homo sapiens
caggguuuuuaccuguca

SEQ ID NO: 1709582 - RNA, 14 nt, Homo sapiens
caggucacacgacc

SEQ ID NO: 1709583 - RNA, 14 nt, Homo sapiens
caggugcugccauc

SEQ ID NO: 1709584 - RNA, 15 nt, Homo sapiens
caggugcugccaucc

SEQ ID NO: 1709585 - RNA, 20 nt, Homo sapiens
cagguggacacacaaggugc

SEQ ID NO: 1709586 - RNA, 16 nt, Homo sapiens
caggugugaaccacca

SEQ ID NO: 1709587 - RNA, 19 nt, Homo sapiens
caggugugaaccaccacac

SEQ ID NO: 1709588 - RNA, 14 nt, Homo sapiens
caggugugagucac

SEQ ID NO: 1709589 - RNA, 16 nt, Homo sapiens
cagguuaaugcugaaa

SEQ ID NO: 1709590 - RNA, 19 nt, Homo sapiens
cagguuuugaaaauguaca

SEQ ID NO: 1709591 - RNA, 15 nt, Homo sapiens
caguaaccaugcccg

SEQ ID NO: 1709592 - RNA, 19 nt, Homo sapiens
caguaacccaaaccucaag

SEQ ID NO: 1709593 - RNA, 17 nt, Homo sapiens
caguaagaaaaagaaga

SEQ ID NO: 1709594 - RNA, 19 nt, Homo sapiens
caguaaucccagcuacuca

SEQ ID NO: 1709595 - RNA, 19 nt, Homo sapiens
caguacaugggaaaggagg

SEQ ID NO: 1709596 - RNA, 16 nt, Homo sapiens
caguacccucucagcu

SEQ ID NO: 1709597 - RNA, 12 nt, Homo sapiens
caguagacagaa

SEQ ID NO: 1709598 - RNA, 19 nt, Homo sapiens
caguagagcaaaucuauga

SEQ ID NO: 1709599 - RNA, 21 nt, Homo sapiens
caguauaggccaucaauauca

SEQ ID NO: 1709600 - RNA, 17 nt, Homo sapiens
caguaucccacauccaa

SEQ ID NO: 1709601 - RNA, 18 nt, Homo sapiens
caguaucccacauccaac

SEQ ID NO: 1709602 - RNA, 21 nt, Homo sapiens
caguauuucauugccugugua

SEQ ID NO: 1709603 - RNA, 19 nt, Homo sapiens
cagucgaugcguucacucc

SEQ ID NO: 1709604 - RNA, 21 nt, Homo sapiens
cagucguacugauucuaaugg

SEQ ID NO: 1709605 - RNA, 16 nt, Homo sapiens
cagugacaaggcccug

SEQ ID NO: 1709606 - RNA, 17 nt, Homo sapiens
cagugacaaggcccuga

SEQ ID NO: 1709607 - RNA, 18 nt, Homo sapiens
cagugaccccugaccuca

SEQ ID NO: 1709608 - RNA, 16 nt, Homo sapiens
aggguggcccuugcag

SEQ ID NO: 1709609 - RNA, 15 nt, Homo sapiens
aggguuuugacacuu

SEQ ID NO: 1709610 - RNA, 18 nt, Homo sapiens
agguaagggggugcagca

SEQ ID NO: 1709611 - RNA, 17 nt, Homo sapiens
agguaggaucaucccac

SEQ ID NO: 1709612 - RNA, 21 nt, Homo sapiens
agguauaccuguugagacuga

SEQ ID NO: 1709613 - RNA, 12 nt, Homo sapiens
agguccacagag

SEQ ID NO: 1709614 - RNA, 22 nt, Homo sapiens
aggucccgaaaggggcacuggu

SEQ ID NO: 1709615 - RNA, 15 nt, Homo sapiens
aggucccucagacau

SEQ ID NO: 1709616 - RNA, 11 nt, Homo sapiens
aggucuaucaa

SEQ ID NO: 1709617 - RNA, 17 nt, Homo sapiens
aggucugcagcuccagg

SEQ ID NO: 1709618 - RNA, 15 nt, Homo sapiens
aggugacauuugcuc

SEQ ID NO: 1709619 - RNA, 16 nt, Homo sapiens
aggugacccugaugaa

SEQ ID NO: 1709620 - RNA, 24 nt, Homo sapiens
aggugaccuggccagagccaagaa

SEQ ID NO: 1709621 - RNA, 17 nt, Homo sapiens
aggugauccaccugccu

SEQ ID NO: 1709622 - RNA, 19 nt, Homo sapiens
aggugcuauuguuacucuu

SEQ ID NO: 1709623 - RNA, 16 nt, Homo sapiens
agguggccccaguuca

SEQ ID NO: 1709624 - RNA, 14 nt, Homo sapiens
agguggggcagcuu

SEQ ID NO: 1709625 - RNA, 18 nt, Homo sapiens
agguuaucgaaauaacaa

SEQ ID NO: 1709626 - RNA, 14 nt, Homo sapiens
agguucacaggggu

SEQ ID NO: 1709627 - RNA, 17 nt, Homo sapiens
agguucaggaagaccac

SEQ ID NO: 1709628 - RNA, 13 nt, Homo sapiens
agguucaguauua

SEQ ID NO: 1709629 - RNA, 16 nt, Homo sapiens
agguucaguauuaugu

SEQ ID NO: 1709630 - RNA, 16 nt, Homo sapiens
agguucuaaaguucua

SEQ ID NO: 1709631 - RNA, 19 nt, Homo sapiens
agguucuaaaguucuaaga

SEQ ID NO: 1709632 - RNA, 12 nt, Homo sapiens
agguucuugaua

SEQ ID NO: 1709633 - RNA, 18 nt, Homo sapiens
agguugucugaagucacu

SEQ ID NO: 1709634 - RNA, 21 nt, Homo sapiens
agguugucugaagucacugca

SEQ ID NO: 1709635 - RNA, 21 nt, Homo sapiens
agguuuuaaccgcacaugcac

SEQ ID NO: 1709636 - RNA, 23 nt, Homo sapiens
agguuuuaaccgcacaugcacac

SEQ ID NO: 1709637 - RNA, 12 nt, Homo sapiens
aguaacucccau

SEQ ID NO: 1709638 - RNA, 19 nt, Homo sapiens
aguaacuuggcuuucauua

SEQ ID NO: 1709639 - RNA, 14 nt, Homo sapiens
aguaaugaucucaa

SEQ ID NO: 1709640 - RNA, 18 nt, Homo sapiens
aguacaaacacaggauuu

SEQ ID NO: 1709641 - RNA, 14 nt, Homo sapiens
aguacaaugcccag

SEQ ID NO: 1709642 - RNA, 18 nt, Homo sapiens
aguacaucucuacuaaaa

SEQ ID NO: 1709643 - RNA, 19 nt, Homo sapiens
aguacaugauaaaugauag

SEQ ID NO: 1709644 - RNA, 15 nt, Homo sapiens
aguacccaucuagua

SEQ ID NO: 1709645 - RNA, 15 nt, Homo sapiens
aguacccuuucaaac

SEQ ID NO: 1709646 - RNA, 20 nt, Homo sapiens
aguacuccaagacagagaca

SEQ ID NO: 1709647 - RNA, 16 nt, Homo sapiens
aguagcaucaccaucu

SEQ ID NO: 1709648 - RNA, 23 nt, Homo sapiens
aguagcguuuuuuaaauguauac

SEQ ID NO: 1709649 - RNA, 14 nt, Homo sapiens
aguagcugggacua

SEQ ID NO: 1709650 - RNA, 16 nt, Homo sapiens
aguagguuuacauuca

SEQ ID NO: 1709651 - RNA, 16 nt, Homo sapiens
aguaguaugaugauac

SEQ ID NO: 1709652 - RNA, 15 nt, Homo sapiens
aguagucuugaugac

SEQ ID NO: 1709653 - RNA, 15 nt, Homo sapiens
aguagugcugugauu

SEQ ID NO: 1709654 - RNA, 23 nt, Homo sapiens
aguaguuuuuacagcuguguuau

SEQ ID NO: 1709655 - RNA, 21 nt, Homo sapiens
aguauauuuccgcacuucaga

SEQ ID NO: 1709656 - RNA, 23 nt, Homo sapiens
aguaucaguguuuuaaauucuga

SEQ ID NO: 1709657 - RNA, 13 nt, Homo sapiens
aguaucuuugcac

SEQ ID NO: 1709658 - RNA, 14 nt, Homo sapiens
aguaugagggaaaa

SEQ ID NO: 1709659 - RNA, 20 nt, Homo sapiens
aguauggcuccuccauaucu

SEQ ID NO: 1709660 - RNA, 13 nt, Homo sapiens
aguauuaaaacau

SEQ ID NO: 1709661 - RNA, 23 nt, Homo sapiens
aguauugaaauguuugcauaaag

SEQ ID NO: 1709662 - RNA, 18 nt, Homo sapiens
aguauuucaugcugggaa

SEQ ID NO: 1709663 - RNA, 19 nt, Homo sapiens
aguauuuuagaaacuccaa

SEQ ID NO: 1709664 - RNA, 18 nt, Homo sapiens
agucacaaagaguucugg

SEQ ID NO: 1709665 - RNA, 16 nt, Homo sapiens
agucacaugaccugau

SEQ ID NO: 1709666 - RNA, 19 nt, Homo sapiens
agucacauggccuaugcac

SEQ ID NO: 1709667 - RNA, 22 nt, Homo sapiens
agucacauggccuaugcacaua

SEQ ID NO: 1709668 - RNA, 18 nt, Homo sapiens
agucaccuauguggucca

SEQ ID NO: 1709669 - RNA, 21 nt, Homo sapiens
agcuuucuccccgcuaaggaa

SEQ ID NO: 1709670 - RNA, 21 nt, Homo sapiens
agcuuuguguuugguuuacau

SEQ ID NO: 1709671 - RNA, 19 nt, Homo sapiens
aggaaaaguuauugugaua

SEQ ID NO: 1709672 - RNA, 16 nt, Homo sapiens
aggaaaaugauacgca

SEQ ID NO: 1709673 - RNA, 15 nt, Homo sapiens
aggaacagcacuggg

SEQ ID NO: 1709674 - RNA, 15 nt, Homo sapiens
aggaacuccuuggcc

SEQ ID NO: 1709675 - RNA, 18 nt, Homo sapiens
aggaagcaccccaugcca

SEQ ID NO: 1709676 - RNA, 17 nt, Homo sapiens
aggaagcuccacuguca

SEQ ID NO: 1709677 - RNA, 15 nt, Homo sapiens
aggaagguggugcuu

SEQ ID NO: 1709678 - RNA, 20 nt, Homo sapiens
aggaaguuuucuguagucau

SEQ ID NO: 1709679 - RNA, 18 nt, Homo sapiens
aggaauaagaauggagca

SEQ ID NO: 1709680 - RNA, 21 nt, Homo sapiens
aggaauccuggcagcccagag

SEQ ID NO: 1709681 - RNA, 17 nt, Homo sapiens
aggaaugugaaagcacg

SEQ ID NO: 1709682 - RNA, 16 nt, Homo sapiens
aggaauuugcauuuag

SEQ ID NO: 1709683 - RNA, 17 nt, Homo sapiens
aggaauuugcauuuagu

SEQ ID NO: 1709684 - RNA, 18 nt, Homo sapiens
aggacaaccauuccagac

SEQ ID NO: 1709685 - RNA, 19 nt, Homo sapiens
aggacagcugaaccccugg

SEQ ID NO: 1709686 - RNA, 14 nt, Homo sapiens
aggaccaagccaca

SEQ ID NO: 1709687 - RNA, 18 nt, Homo sapiens
aggaccacucagccccua

SEQ ID NO: 1709688 - RNA, 19 nt, Homo sapiens
aggacccaggaggugugau

SEQ ID NO: 1709689 - RNA, 23 nt, Homo sapiens
aggacggugcaacccaaggacug

SEQ ID NO: 1709690 - RNA, 21 nt, Homo sapiens
aggacuacaaccaauuuacac

SEQ ID NO: 1709691 - RNA, 21 nt, Homo sapiens
aggacuguugaugaaagggac

SEQ ID NO: 1709692 - RNA, 17 nt, Homo sapiens
aggagaacaaauauuca

SEQ ID NO: 1709693 - RNA, 23 nt, Homo sapiens
aggagacaaguuccaugggauac

SEQ ID NO: 1709694 - RNA, 22 nt, Homo sapiens
aggagaccuacccuccacaggc

SEQ ID NO: 1709695 - RNA, 15 nt, Homo sapiens
aggagacuagauugc

SEQ ID NO: 1709696 - RNA, 16 nt, Homo sapiens
aggagauuucaugccu

SEQ ID NO: 1709697 - RNA, 21 nt, Homo sapiens
aggagccuuuuuaaaacacau

SEQ ID NO: 1709698 - RNA, 13 nt, Homo sapiens
aggagcuacccuu

SEQ ID NO: 1709699 - RNA, 18 nt, Homo sapiens
aggagcuuccagcucuaa

SEQ ID NO: 1709700 - RNA, 13 nt, Homo sapiens
aggagcuucccac

SEQ ID NO: 1709701 - RNA, 20 nt, Homo sapiens
aggaggacauuuggugggcu

SEQ ID NO: 1709702 - RNA, 16 nt, Homo sapiens
aggaggcacugcugau

SEQ ID NO: 1709703 - RNA, 16 nt, Homo sapiens
aggaggguugugcuac

SEQ ID NO: 1709704 - RNA, 17 nt, Homo sapiens
aggaguacaaugcccag

SEQ ID NO: 1709705 - RNA, 20 nt, Homo sapiens
aggagugggaaaacacugcc

SEQ ID NO: 1709706 - RNA, 22 nt, Homo sapiens
aggagugggaaaacacugccau

SEQ ID NO: 1709707 - RNA, 18 nt, Homo sapiens
aggauacuuuacaugguu

SEQ ID NO: 1709708 - RNA, 14 nt, Homo sapiens
aggaucuguacaau

SEQ ID NO: 1709709 - RNA, 17 nt, Homo sapiens
aggaugaguuacuugaa

SEQ ID NO: 1709710 - RNA, 18 nt, Homo sapiens
aggaugcuguguugucaa

SEQ ID NO: 1709711 - RNA, 22 nt, Homo sapiens
aggauuaauaaagauggcacuu

SEQ ID NO: 1709712 - RNA, 14 nt, Homo sapiens
aggauugcuacugu

SEQ ID NO: 1709713 - RNA, 14 nt, Homo sapiens
aggcaaaauugcaa

SEQ ID NO: 1709714 - RNA, 13 nt, Homo sapiens
aggcaauuucacc

SEQ ID NO: 1709715 - RNA, 21 nt, Homo sapiens
aggcaauuucaccaccaaaug

SEQ ID NO: 1709716 - RNA, 16 nt, Homo sapiens
aggcacuguaguucua

SEQ ID NO: 1709717 - RNA, 22 nt, Homo sapiens
aggcacuguaguucuaagacuc

SEQ ID NO: 1709718 - RNA, 14 nt, Homo sapiens
aggcagagaaucau

SEQ ID NO: 1709719 - RNA, 21 nt, Homo sapiens
aggcagaguuugccuuccuuu

SEQ ID NO: 1709720 - RNA, 23 nt, Homo sapiens
aggcagaucugugccccaugccu

SEQ ID NO: 1709721 - RNA, 22 nt, Homo sapiens
aggcagauggggcacugaccca

SEQ ID NO: 1709722 - RNA, 21 nt, Homo sapiens
aggcagcccugccaugucaca

SEQ ID NO: 1709723 - RNA, 14 nt, Homo sapiens
aggcaggguggugu

SEQ ID NO: 1709724 - RNA, 14 nt, Homo sapiens
aggcaguaaccaug

SEQ ID NO: 1709725 - RNA, 18 nt, Homo sapiens
aggcagugauuagcacuu

SEQ ID NO: 1709726 - RNA, 19 nt, Homo sapiens
aggcaucugauuugcauau

SEQ ID NO: 1709727 - RNA, 17 nt, Homo sapiens
aggcaugaagagcaaaa

SEQ ID NO: 1709728 - RNA, 14 nt, Homo sapiens
agccacacuugaac

SEQ ID NO: 1709729 - RNA, 14 nt, Homo sapiens
agccacuucggcca

SEQ ID NO: 1709730 - RNA, 22 nt, Homo sapiens
agccagcauccccaacugcgac

SEQ ID NO: 1709731 - RNA, 18 nt, Homo sapiens
agccagccugaccuuccu

SEQ ID NO: 1709732 - RNA, 15 nt, Homo sapiens
agccagcucaaauca

SEQ ID NO: 1709733 - RNA, 23 nt, Homo sapiens
agccagcuuggggccaccaaagc

SEQ ID NO: 1709734 - RNA, 18 nt, Homo sapiens
agccaggaaguacuucca

SEQ ID NO: 1709735 - RNA, 18 nt, Homo sapiens
agccaggccccaagccca

SEQ ID NO: 1709736 - RNA, 19 nt, Homo sapiens
agccagggggacuagcccc

SEQ ID NO: 1709737 - RNA, 14 nt, Homo sapiens
agccagggucucac

SEQ ID NO: 1709738 - RNA, 21 nt, Homo sapiens
agccauauaaguuugaaggaa

SEQ ID NO: 1709739 - RNA, 16 nt, Homo sapiens
agccaucacaugaucu

SEQ ID NO: 1709740 - RNA, 16 nt, Homo sapiens
agccauuggcacugug

SEQ ID NO: 1709741 - RNA, 18 nt, Homo sapiens
agcccagaauagcuuuga

SEQ ID NO: 1709742 - RNA, 14 nt, Homo sapiens
agccccacugccag

SEQ ID NO: 1709743 - RNA, 18 nt, Homo sapiens
agccccagagcagggugu

SEQ ID NO: 1709744 - RNA, 17 nt, Homo sapiens
agccccuagaaacccaa

SEQ ID NO: 1709745 - RNA, 21 nt, Homo sapiens
agccccucccccaucucccac

SEQ ID NO: 1709746 - RNA, 17 nt, Homo sapiens
agcccugccaugucaca

SEQ ID NO: 1709747 - RNA, 16 nt, Homo sapiens
agcccuggaccugccu

SEQ ID NO: 1709748 - RNA, 19 nt, Homo sapiens
agcccugugucuguauaca

SEQ ID NO: 1709749 - RNA, 21 nt, Homo sapiens
agcccuuuuguugagccaggc

SEQ ID NO: 1709750 - RNA, 13 nt, Homo sapiens
agccgcugugagc

SEQ ID NO: 1709751 - RNA, 16 nt, Homo sapiens
agccgcuucugacugc

SEQ ID NO: 1709752 - RNA, 22 nt, Homo sapiens
agccuacuuucacacuaagaaa

SEQ ID NO: 1709753 - RNA, 18 nt, Homo sapiens
agccuaggaccacucagc

SEQ ID NO: 1709754 - RNA, 16 nt, Homo sapiens
agccuaggugacagag

SEQ ID NO: 1709755 - RNA, 16 nt, Homo sapiens
agccuauuuaccugca

SEQ ID NO: 1709756 - RNA, 17 nt, Homo sapiens
agccucaucauuuccca

SEQ ID NO: 1709757 - RNA, 15 nt, Homo sapiens
agccuccacugccuc

SEQ ID NO: 1709758 - RNA, 23 nt, Homo sapiens
agccuccuauccaccacugcuua

SEQ ID NO: 1709759 - RNA, 21 nt, Homo sapiens
agccucugaccccuccucacu

SEQ ID NO: 1709760 - RNA, 16 nt, Homo sapiens
agccucuggcuagagg

SEQ ID NO: 1709761 - RNA, 11 nt, Homo sapiens
agccucugggg

SEQ ID NO: 1709762 - RNA, 19 nt, Homo sapiens
agccucuucugccaagaga

SEQ ID NO: 1709763 - RNA, 19 nt, Homo sapiens
agccugaauuuuguugcug

SEQ ID NO: 1709764 - RNA, 17 nt, Homo sapiens
agccugaggcagccacu

SEQ ID NO: 1709765 - RNA, 12 nt, Homo sapiens
agccugcacagu

SEQ ID NO: 1709766 - RNA, 15 nt, Homo sapiens
agccugcagaaucca

SEQ ID NO: 1709767 - RNA, 23 nt, Homo sapiens
agccugcaguuauuaacacuaac

SEQ ID NO: 1709768 - RNA, 20 nt, Homo sapiens
agccugcucccucacccagg

SEQ ID NO: 1709769 - RNA, 14 nt, Homo sapiens
agccuggcaacaca

SEQ ID NO: 1709770 - RNA, 22 nt, Homo sapiens
agccugggacaguuuaucauga

SEQ ID NO: 1709771 - RNA, 18 nt, Homo sapiens
agccugggcagcauagca

SEQ ID NO: 1709772 - RNA, 23 nt, Homo sapiens
agccugucccauggacacuccag

SEQ ID NO: 1709773 - RNA, 19 nt, Homo sapiens
agccuucgggcgucugugu

SEQ ID NO: 1709774 - RNA, 21 nt, Homo sapiens
agccuuuuuaaaacacauguu

SEQ ID NO: 1709775 - RNA, 19 nt, Homo sapiens
agcgaauguguacaaagug

SEQ ID NO: 1709776 - RNA, 22 nt, Homo sapiens
agcgaccgcccccuccucuagc

SEQ ID NO: 1709777 - RNA, 21 nt, Homo sapiens
agcgcaacggcuccuuugcca

SEQ ID NO: 1709778 - RNA, 22 nt, Homo sapiens
agcgcagguuuaguuuacucaa

SEQ ID NO: 1709779 - RNA, 14 nt, Homo sapiens
agcgccugugcaca

SEQ ID NO: 1709780 - RNA, 21 nt, Homo sapiens
agcgcucagaacaguaucuuu

SEQ ID NO: 1709781 - RNA, 20 nt, Homo sapiens
agcgcucugccucaccgcuu

SEQ ID NO: 1709782 - RNA, 19 nt, Homo sapiens
agcgcugagugggagaagg

SEQ ID NO: 1709783 - RNA, 15 nt, Homo sapiens
agcggugggcacugu

SEQ ID NO: 1709784 - RNA, 21 nt, Homo sapiens
aaaugcuagguuaauuccaau

SEQ ID NO: 1709785 - RNA, 17 nt, Homo sapiens
aaaugcucucucaaauu

SEQ ID NO: 1709786 - RNA, 16 nt, Homo sapiens
aaauggaaaguaacuc

SEQ ID NO: 1709787 - RNA, 16 nt, Homo sapiens
aaauggguuggugcuu

SEQ ID NO: 1709788 - RNA, 20 nt, Homo sapiens
aaauguaauacuccuaagac

SEQ ID NO: 1709789 - RNA, 22 nt, Homo sapiens
aaauguacaacugcaccuguca

SEQ ID NO: 1709790 - RNA, 14 nt, Homo sapiens
aaauguaguugaug

SEQ ID NO: 1709791 - RNA, 15 nt, Homo sapiens
aaauguauacuauag

SEQ ID NO: 1709792 - RNA, 13 nt, Homo sapiens
aaauguauauaca

SEQ ID NO: 1709793 - RNA, 16 nt, Homo sapiens
aaauguccguguaaaa

SEQ ID NO: 1709794 - RNA, 14 nt, Homo sapiens
aaaugugauacauu

SEQ ID NO: 1709795 - RNA, 22 nt, Homo sapiens
aaauguggaggcuaucaacaaa

SEQ ID NO: 1709796 - RNA, 17 nt, Homo sapiens
aaauuaacaguccuaac

SEQ ID NO: 1709797 - RNA, 12 nt, Homo sapiens
aaauuaagaagg

SEQ ID NO: 1709798 - RNA, 15 nt, Homo sapiens
aaauuaagugugcau

SEQ ID NO: 1709799 - RNA, 20 nt, Homo sapiens
aaauuagaaagcaacuuauc

SEQ ID NO: 1709800 - RNA, 15 nt, Homo sapiens
aaauucaagccuuag

SEQ ID NO: 1709801 - RNA, 13 nt, Homo sapiens
aaauugucccauu

SEQ ID NO: 1709802 - RNA, 23 nt, Homo sapiens
aaauuuaauguuuuuuaaacuag

SEQ ID NO: 1709803 - RNA, 15 nt, Homo sapiens
aaauuuaucuuucaa

SEQ ID NO: 1709804 - RNA, 23 nt, Homo sapiens
aaauuucaccauugcugucaagu

SEQ ID NO: 1709805 - RNA, 20 nt, Homo sapiens
aaauuucucaucacagggau

SEQ ID NO: 1709806 - RNA, 13 nt, Homo sapiens
aaauuuguaaguu

SEQ ID NO: 1709807 - RNA, 20 nt, Homo sapiens
aaauuuuaccagcagaagga

SEQ ID NO: 1709808 - RNA, 23 nt, Homo sapiens
aacaaaaaucuguguaacuguaa

SEQ ID NO: 1709809 - RNA, 20 nt, Homo sapiens
aacaaacauuguguugacau

SEQ ID NO: 1709810 - RNA, 12 nt, Homo sapiens
aacaaagucuuu

SEQ ID NO: 1709811 - RNA, 12 nt, Homo sapiens
aacaaauaugca

SEQ ID NO: 1709812 - RNA, 19 nt, Homo sapiens
aacaacaauaacacugucu

SEQ ID NO: 1709813 - RNA, 20 nt, Homo sapiens
aacaacacuggugugaccug

SEQ ID NO: 1709814 - RNA, 15 nt, Homo sapiens
aacaaccaagcgcau

SEQ ID NO: 1709815 - RNA, 22 nt, Homo sapiens
aacaaccuggucacaggacucu

SEQ ID NO: 1709816 - RNA, 17 nt, Homo sapiens
aacaacuguggucaauc

SEQ ID NO: 1709817 - RNA, 16 nt, Homo sapiens
aacaacuuacacuuau

SEQ ID NO: 1709818 - RNA, 14 nt, Homo sapiens
aacaagaauuggaa

SEQ ID NO: 1709819 - RNA, 12 nt, Homo sapiens
aacaagaucugc

SEQ ID NO: 1709820 - RNA, 22 nt, Homo sapiens
aacaaggggcuguuacauaaca

SEQ ID NO: 1709821 - RNA, 15 nt, Homo sapiens
aacaagugaaauaac

SEQ ID NO: 1709822 - RNA, 18 nt, Homo sapiens
aacaaguuuuucugucaa

SEQ ID NO: 1709823 - RNA, 15 nt, Homo sapiens
aacaauaucauauca

SEQ ID NO: 1709824 - RNA, 13 nt, Homo sapiens
aacaaugacuuaa

SEQ ID NO: 1709825 - RNA, 14 nt, Homo sapiens
aacaauucaaguga

SEQ ID NO: 1709826 - RNA, 21 nt, Homo sapiens
aacaauuguccauggucucaa

SEQ ID NO: 1709827 - RNA, 15 nt, Homo sapiens
aacacaaaguguaua

SEQ ID NO: 1709828 - RNA, 14 nt, Homo sapiens
aacacacaugcaca

SEQ ID NO: 1709829 - RNA, 17 nt, Homo sapiens
aacacaggcgcugagua

SEQ ID NO: 1709830 - RNA, 15 nt, Homo sapiens
aacaccaguaccuga

SEQ ID NO: 1709831 - RNA, 16 nt, Homo sapiens
aacaccaguaccugaa

SEQ ID NO: 1709832 - RNA, 22 nt, Homo sapiens
aacacccuguagguucuugaua

SEQ ID NO: 1709833 - RNA, 18 nt, Homo sapiens
aacaccgcuucugccuuu

SEQ ID NO: 1709834 - RNA, 22 nt, Homo sapiens
aacacuuugggaggcugaggca

SEQ ID NO: 1709835 - RNA, 18 nt, Homo sapiens
aacagaaaccuauccuca

SEQ ID NO: 1709836 - RNA, 18 nt, Homo sapiens
aacagaaagcauccuaaa

SEQ ID NO: 1709837 - RNA, 13 nt, Homo sapiens
aacagacaacaga

SEQ ID NO: 1709838 - RNA, 16 nt, Homo sapiens
aacagaucuugaaauc

SEQ ID NO: 1709839 - RNA, 13 nt, Homo sapiens
aacagaugaauaa

SEQ ID NO: 1709840 - RNA, 19 nt, Homo sapiens
ugcacaguggccccaucau

SEQ ID NO: 1709841 - RNA, 21 nt, Homo sapiens
ugcacauccauucccaagaaa

SEQ ID NO: 1709842 - RNA, 17 nt, Homo sapiens
ugcacaugcacgugugu

SEQ ID NO: 1709843 - RNA, 23 nt, Homo sapiens
ugcacaugucuuguacaugugua

SEQ ID NO: 1709844 - RNA, 14 nt, Homo sapiens
ugcaccagagcaac

SEQ ID NO: 1709845 - RNA, 18 nt, Homo sapiens
ugcaccaggcacugcugc

SEQ ID NO: 1709846 - RNA, 19 nt, Homo sapiens
ugcaccaggcacugcugca

SEQ ID NO: 1709847 - RNA, 21 nt, Homo sapiens
ugcaccuugugucuguacacg

SEQ ID NO: 1709848 - RNA, 22 nt, Homo sapiens
ugcaccuugugucuguacacgu

SEQ ID NO: 1709849 - RNA, 14 nt, Homo sapiens
ugcacuaaagccag

SEQ ID NO: 1709850 - RNA, 15 nt, Homo sapiens
ugcacuguccugacc

SEQ ID NO: 1709851 - RNA, 17 nt, Homo sapiens
ugcacuguccugaccau

SEQ ID NO: 1709852 - RNA, 20 nt, Homo sapiens
ugcacuuuuuuauaagagcu

SEQ ID NO: 1709853 - RNA, 13 nt, Homo sapiens
ugcagaacugcca

SEQ ID NO: 1709854 - RNA, 13 nt, Homo sapiens
ugcagagagccau

SEQ ID NO: 1709855 - RNA, 17 nt, Homo sapiens
ugcagagcccauagcca

SEQ ID NO: 1709856 - RNA, 20 nt, Homo sapiens
ugcagaggauaaggaggcac

SEQ ID NO: 1709857 - RNA, 19 nt, Homo sapiens
ugcagaggucagacuaaga

SEQ ID NO: 1709858 - RNA, 16 nt, Homo sapiens
ugcagaguaggcagcu

SEQ ID NO: 1709859 - RNA, 11 nt, Homo sapiens
ugcagcaauau

SEQ ID NO: 1709860 - RNA, 23 nt, Homo sapiens
ugcagcacggacaauaaaccucc

SEQ ID NO: 1709861 - RNA, 22 nt, Homo sapiens
ugcaggcccuuugaagccucag

SEQ ID NO: 1709862 - RNA, 14 nt, Homo sapiens
ugcagggacugcca

SEQ ID NO: 1709863 - RNA, 21 nt, Homo sapiens
ugcagggggugugucugcuca

SEQ ID NO: 1709864 - RNA, 16 nt, Homo sapiens
ugcaggugacauuugc

SEQ ID NO: 1709865 - RNA, 21 nt, Homo sapiens
ugcaguucaccugcacuuaag

SEQ ID NO: 1709866 - RNA, 21 nt, Homo sapiens
ugcaguuguaggcauguagcu

SEQ ID NO: 1709867 - RNA, 21 nt, Homo sapiens
ugcauaaauaugcagugauau

SEQ ID NO: 1709868 - RNA, 19 nt, Homo sapiens
ugcauccccuuggcuguga

SEQ ID NO: 1709869 - RNA, 17 nt, Homo sapiens
ugcaucucaaaauuauu

SEQ ID NO: 1709870 - RNA, 21 nt, Homo sapiens
ugcaucuggguuuguuuacag

SEQ ID NO: 1709871 - RNA, 17 nt, Homo sapiens
ugcauggaggcccuccu

SEQ ID NO: 1709872 - RNA, 14 nt, Homo sapiens
ugcauggcuccaga

SEQ ID NO: 1709873 - RNA, 15 nt, Homo sapiens
ugcauguguguauaa

SEQ ID NO: 1709874 - RNA, 15 nt, Homo sapiens
ugcauucuauugccu

SEQ ID NO: 1709875 - RNA, 18 nt, Homo sapiens
ugcauugcuaaaauauua

SEQ ID NO: 1709876 - RNA, 16 nt, Homo sapiens
ugccaagaaaguauuu

SEQ ID NO: 1709877 - RNA, 21 nt, Homo sapiens
ugccacaccagucacaugacc

SEQ ID NO: 1709878 - RNA, 17 nt, Homo sapiens
ugccacuuuacccaccu

SEQ ID NO: 1709879 - RNA, 18 nt, Homo sapiens
ugccagcaaugacaucuc

SEQ ID NO: 1709880 - RNA, 19 nt, Homo sapiens
ugccagccccacacagcua

SEQ ID NO: 1709881 - RNA, 16 nt, Homo sapiens
ugccagugccucucac

SEQ ID NO: 1709882 - RNA, 21 nt, Homo sapiens
ugccauaaugacucagaauau

SEQ ID NO: 1709883 - RNA, 14 nt, Homo sapiens
ugccauaugccuug

SEQ ID NO: 1709884 - RNA, 18 nt, Homo sapiens
ugccauauucuguuggcc

SEQ ID NO: 1709885 - RNA, 13 nt, Homo sapiens
ugccauuugauac

SEQ ID NO: 1709886 - RNA, 13 nt, Homo sapiens
ugcccaacugccu

SEQ ID NO: 1709887 - RNA, 21 nt, Homo sapiens
ugcccaacugccugccuuagg

SEQ ID NO: 1709888 - RNA, 19 nt, Homo sapiens
ugcccacccugggagacag

SEQ ID NO: 1709889 - RNA, 19 nt, Homo sapiens
ugcccacgcuggagugcag

SEQ ID NO: 1709890 - RNA, 13 nt, Homo sapiens
ugcccagaucaac

SEQ ID NO: 1709891 - RNA, 15 nt, Homo sapiens
ugcccagaucaacag

SEQ ID NO: 1709892 - RNA, 19 nt, Homo sapiens
uggauaagugcuaccuuaa

SEQ ID NO: 1709893 - RNA, 18 nt, Homo sapiens
uggauauuauucuuguag

SEQ ID NO: 1709894 - RNA, 20 nt, Homo sapiens
uggaugaaucucccacucca

SEQ ID NO: 1709895 - RNA, 23 nt, Homo sapiens
uggaugugguuuaauuguuuguc

SEQ ID NO: 1709896 - RNA, 14 nt, Homo sapiens
uggauuauuuagau

SEQ ID NO: 1709897 - RNA, 17 nt, Homo sapiens
uggauucauucucauaa

SEQ ID NO: 1709898 - RNA, 18 nt, Homo sapiens
uggauugggggggccaaa

SEQ ID NO: 1709899 - RNA, 15 nt, Homo sapiens
uggcaccacugcacu

SEQ ID NO: 1709900 - RNA, 18 nt, Homo sapiens
uggcacuguggagcucag

SEQ ID NO: 1709901 - RNA, 10 nt, Homo sapiens
uggcacuuug

SEQ ID NO: 1709902 - RNA, 23 nt, Homo sapiens
uggcagacaucggccuccaugac

SEQ ID NO: 1709903 - RNA, 16 nt, Homo sapiens
uggcagccauggccau

SEQ ID NO: 1709904 - RNA, 17 nt, Homo sapiens
uggcagccgugccuuca

SEQ ID NO: 1709905 - RNA, 13 nt, Homo sapiens
uggccaaagccaa

SEQ ID NO: 1709906 - RNA, 23 nt, Homo sapiens
uggccacucagcuuccuacccac

SEQ ID NO: 1709907 - RNA, 15 nt, Homo sapiens
uggccagcacucuga

SEQ ID NO: 1709908 - RNA, 19 nt, Homo sapiens
uggcccagggaagccaaaa

SEQ ID NO: 1709909 - RNA, 19 nt, Homo sapiens
uggccccaguccaugcuuc

SEQ ID NO: 1709910 - RNA, 16 nt, Homo sapiens
uggccccucaaccucc

SEQ ID NO: 1709911 - RNA, 17 nt, Homo sapiens
uggccccugcccggcug

SEQ ID NO: 1709912 - RNA, 16 nt, Homo sapiens
uggcccucgacacuca

SEQ ID NO: 1709913 - RNA, 13 nt, Homo sapiens
uggcccugugcua

SEQ ID NO: 1709914 - RNA, 23 nt, Homo sapiens
uggccgaggacuuugauugcaca

SEQ ID NO: 1709915 - RNA, 15 nt, Homo sapiens
uggccucaagugauu

SEQ ID NO: 1709916 - RNA, 14 nt, Homo sapiens
uggccucucuagca

SEQ ID NO: 1709917 - RNA, 21 nt, Homo sapiens
uggccucugugccuucuuuug

SEQ ID NO: 1709918 - RNA, 17 nt, Homo sapiens
uggccuugaaaccaccu

SEQ ID NO: 1709919 - RNA, 22 nt, Homo sapiens
uggcuaacuauauuugcuuuuu

SEQ ID NO: 1709920 - RNA, 14 nt, Homo sapiens
uggcuaacuggcga

SEQ ID NO: 1709921 - RNA, 20 nt, Homo sapiens
uggcucacgccuguaauccc

SEQ ID NO: 1709922 - RNA, 23 nt, Homo sapiens
uggcucagcucggggagccuuag

SEQ ID NO: 1709923 - RNA, 14 nt, Homo sapiens
uggcucuucugccc

SEQ ID NO: 1709924 - RNA, 19 nt, Homo sapiens
uggcugggggccucagugc

SEQ ID NO: 1709925 - RNA, 15 nt, Homo sapiens
uggcugugaaauuca

SEQ ID NO: 1709926 - RNA, 22 nt, Homo sapiens
uggcuguggagagggucaagga

SEQ ID NO: 1709927 - RNA, 23 nt, Homo sapiens
uggcuuaccugaccucuugcugu

SEQ ID NO: 1709928 - RNA, 14 nt, Homo sapiens
uggcuugacucagg

SEQ ID NO: 1709929 - RNA, 16 nt, Homo sapiens
ugggacaaaggacauu

SEQ ID NO: 1709930 - RNA, 12 nt, Homo sapiens
ugggacacaguu

SEQ ID NO: 1709931 - RNA, 14 nt, Homo sapiens
ugggacccuugaga

SEQ ID NO: 1709932 - RNA, 17 nt, Homo sapiens
ugggagggaaaagggaa

SEQ ID NO: 1709933 - RNA, 12 nt, Homo sapiens
ugggaguacuga

SEQ ID NO: 1709934 - RNA, 20 nt, Homo sapiens
ugggaucugucacaccagcc

SEQ ID NO: 1709935 - RNA, 19 nt, Homo sapiens
ugggauguccuacuaucac

SEQ ID NO: 1709936 - RNA, 19 nt, Homo sapiens
ugggauuacaggugugaac

SEQ ID NO: 1709937 - RNA, 16 nt, Homo sapiens
ugggauuuaauuucca

SEQ ID NO: 1709938 - RNA, 15 nt, Homo sapiens
ugggcaacagagcaa

SEQ ID NO: 1709939 - RNA, 21 nt, Homo sapiens
ugggcaacagagcaagacucc

SEQ ID NO: 1709940 - RNA, 13 nt, Homo sapiens
ugggcacuggccc

SEQ ID NO: 1709941 - RNA, 16 nt, Homo sapiens
ugggcacuucaucuga

SEQ ID NO: 1709942 - RNA, 12 nt, Homo sapiens
ugggcaugugau

SEQ ID NO: 1709943 - RNA, 15 nt, Homo sapiens
ugggcauugacaaau

SEQ ID NO: 1709944 - RNA, 13 nt, Homo sapiens
ugggccaccagcc

SEQ ID NO: 1709945 - RNA, 16 nt, Homo sapiens
ugggccaccagccacu

SEQ ID NO: 1709946 - RNA, 14 nt, Homo sapiens
ugggcccagaucug

SEQ ID NO: 1709947 - RNA, 23 nt, Homo sapiens
uaaccccuuccagaucacugcca

SEQ ID NO: 1709948 - RNA, 16 nt, Homo sapiens
uaaccgcacaugcaca

SEQ ID NO: 1709949 - RNA, 21 nt, Homo sapiens
uaaccuucuggcuuccuucuc

SEQ ID NO: 1709950 - RNA, 15 nt, Homo sapiens
uaacuaacagcaucc

SEQ ID NO: 1709951 - RNA, 15 nt, Homo sapiens
uaacuauugcauuua

SEQ ID NO: 1709952 - RNA, 20 nt, Homo sapiens
uaacucaccagccccacugc

SEQ ID NO: 1709953 - RNA, 14 nt, Homo sapiens
uaacuucacauuaa

SEQ ID NO: 1709954 - RNA, 17 nt, Homo sapiens
uaacuuuuguaagacaa

SEQ ID NO: 1709955 - RNA, 18 nt, Homo sapiens
uaagaaaaaaacuugucu

SEQ ID NO: 1709956 - RNA, 16 nt, Homo sapiens
uaagaaaacaaucaca

SEQ ID NO: 1709957 - RNA, 13 nt, Homo sapiens
uaagaaacauaac

SEQ ID NO: 1709958 - RNA, 17 nt, Homo sapiens
uaagaaauaugugagau

SEQ ID NO: 1709959 - RNA, 23 nt, Homo sapiens
uaagaauggagcaguacauggga

SEQ ID NO: 1709960 - RNA, 19 nt, Homo sapiens
uaagaauucaaacuggggc

SEQ ID NO: 1709961 - RNA, 21 nt, Homo sapiens
uaagacgguuaaauacugugu

SEQ ID NO: 1709962 - RNA, 22 nt, Homo sapiens
uaagacgguuaaauacugugug

SEQ ID NO: 1709963 - RNA, 14 nt, Homo sapiens
uaagacucauuccc

SEQ ID NO: 1709964 - RNA, 22 nt, Homo sapiens
uaagagaaacuuuauacauuag

SEQ ID NO: 1709965 - RNA, 19 nt, Homo sapiens
uaagagugccguaacaacu

SEQ ID NO: 1709966 - RNA, 21 nt, Homo sapiens
uaagauaucccuaaggaauuu

SEQ ID NO: 1709967 - RNA, 20 nt, Homo sapiens
uaagauauucagaaguauau

SEQ ID NO: 1709968 - RNA, 19 nt, Homo sapiens
uaagauccacaaaugaagg

SEQ ID NO: 1709969 - RNA, 19 nt, Homo sapiens
uaagaucuuagauucucug

SEQ ID NO: 1709970 - RNA, 23 nt, Homo sapiens
uaagauuauagauucuaaagauu

SEQ ID NO: 1709971 - RNA, 18 nt, Homo sapiens
uaagauuuuacaaaagag

SEQ ID NO: 1709972 - RNA, 16 nt, Homo sapiens
uaagcagauauucaau

SEQ ID NO: 1709973 - RNA, 15 nt, Homo sapiens
uaagccuaaaugccu

SEQ ID NO: 1709974 - RNA, 22 nt, Homo sapiens
gugaccucagugagauauuugg

SEQ ID NO: 1709975 - RNA, 21 nt, Homo sapiens
gugacuucuccaggucucacg

SEQ ID NO: 1709976 - RNA, 14 nt, Homo sapiens
gugagaaauuucug

SEQ ID NO: 1709977 - RNA, 14 nt, Homo sapiens
gugagaugagggau

SEQ ID NO: 1709978 - RNA, 15 nt, Homo sapiens
gugagcacuaaggug

SEQ ID NO: 1709979 - RNA, 16 nt, Homo sapiens
gugaggaagaacuaca

SEQ ID NO: 1709980 - RNA, 15 nt, Homo sapiens
gugauaaugcagacu

SEQ ID NO: 1709981 - RNA, 12 nt, Homo sapiens
gugauacauuua

SEQ ID NO: 1709982 - RNA, 16 nt, Homo sapiens
gugauauucuaagacu

SEQ ID NO: 1709983 - RNA, 13 nt, Homo sapiens
gugaucaucccau

SEQ ID NO: 1709984 - RNA, 18 nt, Homo sapiens
gugauccacccaccucag

SEQ ID NO: 1709985 - RNA, 20 nt, Homo sapiens
gugaucucccaagcuaucua

SEQ ID NO: 1709986 - RNA, 21 nt, Homo sapiens
gugaugaugaaaugaggucag

SEQ ID NO: 1709987 - RNA, 13 nt, Homo sapiens
gugauggggcaag

SEQ ID NO: 1709988 - RNA, 18 nt, Homo sapiens
gugauguuuuagugcuuu

SEQ ID NO: 1709989 - RNA, 23 nt, Homo sapiens
gugauuuuucugcacuaauauaa

SEQ ID NO: 1709990 - RNA, 21 nt, Homo sapiens
gugcaaacgccuagauugcuu

SEQ ID NO: 1709991 - RNA, 19 nt, Homo sapiens
gugcaaaguucccuacuuc

SEQ ID NO: 1709992 - RNA, 20 nt, Homo sapiens
gugcacccaugggcucugac

SEQ ID NO: 1709993 - RNA, 18 nt, Homo sapiens
gugcacguacacacacau

SEQ ID NO: 1709994 - RNA, 19 nt, Homo sapiens
gugcaguggugugaucuca

SEQ ID NO: 1709995 - RNA, 21 nt, Homo sapiens
gugcauaugaaauccuugacu

SEQ ID NO: 1709996 - RNA, 21 nt, Homo sapiens
gugccagcaaugacaucucag

SEQ ID NO: 1709997 - RNA, 17 nt, Homo sapiens
guuuaaaacaguauuua

SEQ ID NO: 1709998 - RNA, 17 nt, Homo sapiens
guuuacagcaauuccug

SEQ ID NO: 1709999 - RNA, 23 nt, Homo sapiens
guuuacauuguaaauaguauuug

SEQ ID NO: 1710000 - RNA, 17 nt, Homo sapiens
guuuagauuucaagaaa

SEQ ID NO: 1710001 - RNA, 18 nt, Homo sapiens
guuuauuucaacuauuua

SEQ ID NO: 1710002 - RNA, 17 nt, Homo sapiens
guuucacacuagucaca

SEQ ID NO: 1710003 - RNA, 20 nt, Homo sapiens
guuucauguuuugugacuau

SEQ ID NO: 1710004 - RNA, 14 nt, Homo sapiens
guuucuuccuguua

SEQ ID NO: 1710005 - RNA, 15 nt, Homo sapiens
guuucuugugggcua

SEQ ID NO: 1710006 - RNA, 21 nt, Homo sapiens
guuugaucauuucuugugaug

SEQ ID NO: 1710007 - RNA, 15 nt, Homo sapiens
guuugcuguuugcaa

SEQ ID NO: 1710008 - RNA, 16 nt, Homo sapiens
guuugguuuacauuua

SEQ ID NO: 1710009 - RNA, 18 nt, Homo sapiens
guuugucuguuuguuuca

SEQ ID NO: 1710010 - RNA, 14 nt, Homo sapiens
guuuguggccucag

SEQ ID NO: 1710011 - RNA, 20 nt, Homo sapiens
guuuguggccucagaauuga

SEQ ID NO: 1710012 - RNA, 16 nt, Homo sapiens
guuuguuucauauaua

SEQ ID NO: 1710013 - RNA, 17 nt, Homo sapiens
guuuguuucauauauac

SEQ ID NO: 1710014 - RNA, 23 nt, Homo sapiens
guuuuaauccuuaacacauucaa

SEQ ID NO: 1710015 - RNA, 14 nt, Homo sapiens
guuuuaauuccaau

SEQ ID NO: 1710016 - RNA, 23 nt, Homo sapiens
guuuuagacgaggccacagcugc

SEQ ID NO: 1710017 - RNA, 20 nt, Homo sapiens
guuuuagagacuauggagcc

SEQ ID NO: 1710018 - RNA, 15 nt, Homo sapiens
guuuuaucacuucau

SEQ ID NO: 1710019 - RNA, 15 nt, Homo sapiens
guuuucuagaauuua

SEQ ID NO: 1710020 - RNA, 20 nt, Homo sapiens
guuuugaaggcaaaauugca

SEQ ID NO: 1710021 - RNA, 23 nt, Homo sapiens
guuuugaguagauauuacuuuau

SEQ ID NO: 1710022 - RNA, 14 nt, Homo sapiens
guuuuuaaacuaau

SEQ ID NO: 1710023 - RNA, 17 nt, Homo sapiens
guuuuucugaagacagu

SEQ ID NO: 1710024 - RNA, 22 nt, Homo sapiens
uaaaaaacauaaauuucuuuaa

SEQ ID NO: 1710025 - RNA, 20 nt, Homo sapiens
uaaaaagccugcaauuucau

SEQ ID NO: 1710026 - RNA, 14 nt, Homo sapiens
uaaaaagcuuccau

SEQ ID NO: 1710027 - RNA, 20 nt, Homo sapiens
uaaaaagugacacagcagcu

SEQ ID NO: 1710028 - RNA, 14 nt, Homo sapiens
uaaaaauacaagca

SEQ ID NO: 1710029 - RNA, 18 nt, Homo sapiens
uaaaaauggccauuugcu

SEQ ID NO: 1710030 - RNA, 16 nt, Homo sapiens
uaaaaauguccugccu

SEQ ID NO: 1710031 - RNA, 20 nt, Homo sapiens
uaaaaauuccaaauggacua

SEQ ID NO: 1710032 - RNA, 18 nt, Homo sapiens
uaaaaccugucaaugaua

SEQ ID NO: 1710033 - RNA, 18 nt, Homo sapiens
uaaaaccugugugccauu

SEQ ID NO: 1710034 - RNA, 12 nt, Homo sapiens
uaaaaccuuuca

SEQ ID NO: 1710035 - RNA, 20 nt, Homo sapiens
uaaaacuagugacagcuugu

SEQ ID NO: 1710036 - RNA, 14 nt, Homo sapiens
uaaaagagccuagu

SEQ ID NO: 1710037 - RNA, 22 nt, Homo sapiens
uaaaagauuuuuuuuaaucuag

SEQ ID NO: 1710038 - RNA, 19 nt, Homo sapiens
uaaaaggcaaauguguaca

SEQ ID NO: 1710039 - RNA, 21 nt, Homo sapiens
uaaaagugaaugaaagauuaa

SEQ ID NO: 1710040 - RNA, 19 nt, Homo sapiens
uaaaauaauuuucauucau

SEQ ID NO: 1710041 - RNA, 22 nt, Homo sapiens
uaaaauauuuuguaaugcugca

SEQ ID NO: 1710042 - RNA, 15 nt, Homo sapiens
uaaaauccauccaau

SEQ ID NO: 1710043 - RNA, 19 nt, Homo sapiens
uaaaauccuaagacacaaa

SEQ ID NO: 1710044 - RNA, 20 nt, Homo sapiens
uaaaaugugaggaagaacua

SEQ ID NO: 1710045 - RNA, 22 nt, Homo sapiens
uaaaaugugauguucuaaggcu

SEQ ID NO: 1710046 - RNA, 22 nt, Homo sapiens
uaaaauguguuuuaucacuuca

SEQ ID NO: 1710047 - RNA, 20 nt, Homo sapiens
uaaaauuccucuuacuguaa

SEQ ID NO: 1710048 - RNA, 17 nt, Homo sapiens
uaaaauucucauuacuc

SEQ ID NO: 1710049 - RNA, 15 nt, Homo sapiens
uaaaauuucuaagag

SEQ ID NO: 1710050 - RNA, 15 nt, Homo sapiens
uaaacaaauucauau

SEQ ID NO: 1710051 - RNA, 23 nt, Homo sapiens
uaaacaaugaugcccugcuccag

SEQ ID NO: 1710052 - RNA, 20 nt, Homo sapiens
uaaacgacaagaauaauuca

SEQ ID NO: 1710053 - RNA, 14 nt, Homo sapiens
uaaacuacucuuug

SEQ ID NO: 1710054 - RNA, 17 nt, Homo sapiens
uaaacuaucuuggugaa

SEQ ID NO: 1710055 - RNA, 22 nt, Homo sapiens
uaaacucaagacaaugcaccua

SEQ ID NO: 1710056 - RNA, 17 nt, Homo sapiens
uaaacuguaugcucaca

SEQ ID NO: 1710057 - RNA, 21 nt, Homo sapiens
uaaacuguuagcacuguugau

SEQ ID NO: 1710058 - RNA, 17 nt, Homo sapiens
uaaacuuguuuacaaag

SEQ ID NO: 1710059 - RNA, 15 nt, Homo sapiens
uaaagaagaacuugc

SEQ ID NO: 1710060 - RNA, 21 nt, Homo sapiens
uaaagacagggaagagcagaa

SEQ ID NO: 1710061 - RNA, 18 nt, Homo sapiens
uaaagagcacuuacugua

SEQ ID NO: 1710062 - RNA, 18 nt, Homo sapiens
uaaagagcuuugugauau

SEQ ID NO: 1710063 - RNA, 16 nt, Homo sapiens
uaaagauauuguucaa

SEQ ID NO: 1710064 - RNA, 18 nt, Homo sapiens
uaaagaugaacucugaac

SEQ ID NO: 1710065 - RNA, 17 nt, Homo sapiens
uaaagcauaaguauaca

SEQ ID NO: 1710066 - RNA, 21 nt, Homo sapiens
uaaagccaacacccugucuaa

SEQ ID NO: 1710067 - RNA, 15 nt, Homo sapiens
uaaagccauguuucc

SEQ ID NO: 1710068 - RNA, 15 nt, Homo sapiens
uaaaguacaucucua

SEQ ID NO: 1710069 - RNA, 13 nt, Homo sapiens
uaaagucugaauc

SEQ ID NO: 1710070 - RNA, 14 nt, Homo sapiens
uaaagugauuucau

SEQ ID NO: 1710071 - RNA, 22 nt, Homo sapiens
uaaagugcuaagguucuaaggc

SEQ ID NO: 1710072 - RNA, 14 nt, Homo sapiens
uaaaguuggaauuu

SEQ ID NO: 1710073 - RNA, 20 nt, Homo sapiens
uaaauaaaacuuaaaucuca

SEQ ID NO: 1710074 - RNA, 19 nt, Homo sapiens
uaaauaaaccucaaaaugu

SEQ ID NO: 1710075 - RNA, 15 nt, Homo sapiens
uaaauaaaucauuaa

SEQ ID NO: 1710076 - RNA, 13 nt, Homo sapiens
uaaauacagguag

SEQ ID NO: 1710077 - RNA, 17 nt, Homo sapiens
uaaauacuguguggaac

SEQ ID NO: 1710078 - RNA, 15 nt, Homo sapiens
uaaauagaguuugcu

SEQ ID NO: 1710079 - RNA, 12 nt, Homo sapiens
uaaauagcucag

SEQ ID NO: 1710080 - RNA, 22 nt, Homo sapiens
uaaauaguauuugagaguucua

SEQ ID NO: 1710081 - RNA, 14 nt, Homo sapiens
uaaauagugcagaa

SEQ ID NO: 1710082 - RNA, 20 nt, Homo sapiens
uaaauaucauccugccuuca

SEQ ID NO: 1710083 - RNA, 16 nt, Homo sapiens
uaaauaugcagugaua

SEQ ID NO: 1710084 - RNA, 14 nt, Homo sapiens
uaaauauugucaua

SEQ ID NO: 1710085 - RNA, 12 nt, Homo sapiens
uaaaucaagucc

SEQ ID NO: 1710086 - RNA, 16 nt, Homo sapiens
uaaaucaaguccuuua

SEQ ID NO: 1710087 - RNA, 13 nt, Homo sapiens
uaaauccugccau

SEQ ID NO: 1710088 - RNA, 21 nt, Homo sapiens
uaaaucuguucugggcucuuu

SEQ ID NO: 1710089 - RNA, 22 nt, Homo sapiens
uaaaugggaaaucaguguuuua

SEQ ID NO: 1710090 - RNA, 17 nt, Homo sapiens
uaaauguaucauagaaa

SEQ ID NO: 1710091 - RNA, 12 nt, Homo sapiens
uaaaugugauau

SEQ ID NO: 1710092 - RNA, 16 nt, Homo sapiens
uaaauguuaugacuau

SEQ ID NO: 1710093 - RNA, 13 nt, Homo sapiens
uaaauguuugaca

SEQ ID NO: 1710094 - RNA, 13 nt, Homo sapiens
uaaauuagcuuuu

SEQ ID NO: 1710095 - RNA, 16 nt, Homo sapiens
uaaauuaugguauuaa

SEQ ID NO: 1710096 - RNA, 11 nt, Homo sapiens
uaaauucauuu

SEQ ID NO: 1710097 - RNA, 15 nt, Homo sapiens
uaaauugauguugcu

SEQ ID NO: 1710098 - RNA, 20 nt, Homo sapiens
uaaauuuguaaguuucaggu

SEQ ID NO: 1710099 - RNA, 21 nt, Homo sapiens
uaaauuuuauaacagaauuaa

SEQ ID NO: 1710100 - RNA, 17 nt, Homo sapiens
uaacaaacaucacucug

SEQ ID NO: 1710101 - RNA, 18 nt, Homo sapiens
uaacaacaauaacacugu

SEQ ID NO: 1710102 - RNA, 13 nt, Homo sapiens
uaacaacuguggu

SEQ ID NO: 1710103 - RNA, 15 nt, Homo sapiens
uaacacggugcucau

SEQ ID NO: 1710104 - RNA, 10 nt, Homo sapiens
uaacagaauu

SEQ ID NO: 1710105 - RNA, 16 nt, Homo sapiens
uaacaggcagauacag

SEQ ID NO: 1710106 - RNA, 22 nt, Homo sapiens
uaacaugcuuaugacaaugacu

SEQ ID NO: 1710107 - RNA, 23 nt, Homo sapiens
cuuguccgcugggugguacccuc

SEQ ID NO: 1710108 - RNA, 16 nt, Homo sapiens
cuugucugucuaguua

SEQ ID NO: 1710109 - RNA, 19 nt, Homo sapiens
cuugugaaacacagcuguu

SEQ ID NO: 1710110 - RNA, 15 nt, Homo sapiens
cuugugauguuuuga

SEQ ID NO: 1710111 - RNA, 12 nt, Homo sapiens
cuugugugcaaa

SEQ ID NO: 1710112 - RNA, 15 nt, Homo sapiens
cuuguuaucagcuuu

SEQ ID NO: 1710113 - RNA, 14 nt, Homo sapiens
cuuguuucuccugc

SEQ ID NO: 1710114 - RNA, 18 nt, Homo sapiens
cuuguuuuacccuauaca

SEQ ID NO: 1710115 - RNA, 22 nt, Homo sapiens
cuuguuuuacccuauacaucca

SEQ ID NO: 1710116 - RNA, 13 nt, Homo sapiens
cuuuaaaacaaaa

SEQ ID NO: 1710117 - RNA, 13 nt, Homo sapiens
cuuuaaacucagg

SEQ ID NO: 1710118 - RNA, 19 nt, Homo sapiens
cuuuaagggcaugccuugu

SEQ ID NO: 1710119 - RNA, 13 nt, Homo sapiens
cuuuacuucccag

SEQ ID NO: 1710120 - RNA, 18 nt, Homo sapiens
cuuuagugcuuucuuguc

SEQ ID NO: 1710121 - RNA, 19 nt, Homo sapiens
cuuuauauuuauccacuac

SEQ ID NO: 1710122 - RNA, 11 nt, Homo sapiens
cuuuaucucag

SEQ ID NO: 1710123 - RNA, 15 nt, Homo sapiens
cuuucaggaccuuuu

SEQ ID NO: 1710124 - RNA, 13 nt, Homo sapiens
cuuucagggccaa

SEQ ID NO: 1710125 - RNA, 13 nt, Homo sapiens
cuuucccaaauaa

SEQ ID NO: 1710126 - RNA, 13 nt, Homo sapiens
cuuuccuccugag

SEQ ID NO: 1710127 - RNA, 20 nt, Homo sapiens
cuuuccugguuuucaucagg

SEQ ID NO: 1710128 - RNA, 14 nt, Homo sapiens
cuuuccuuguggca

SEQ ID NO: 1710129 - RNA, 13 nt, Homo sapiens
cuuucuaugcugu

SEQ ID NO: 1710130 - RNA, 15 nt, Homo sapiens
cuuucucagccacaa

SEQ ID NO: 1710131 - RNA, 16 nt, Homo sapiens
cuuucuccaggaccaa

SEQ ID NO: 1710132 - RNA, 12 nt, Homo sapiens
cuuucucugcaa

SEQ ID NO: 1710133 - RNA, 14 nt, Homo sapiens
cuuucugugcccua

SEQ ID NO: 1710134 - RNA, 22 nt, Homo sapiens
cuuucuuacauuagcaguuugc

SEQ ID NO: 1710135 - RNA, 12 nt, Homo sapiens
cuuucuugcucc

SEQ ID NO: 1710136 - RNA, 15 nt, Homo sapiens
cuuugaaauaccuca

SEQ ID NO: 1710137 - RNA, 14 nt, Homo sapiens
cuuugaauuuacug

SEQ ID NO: 1710138 - RNA, 13 nt, Homo sapiens
cuuugacugaugc

SEQ ID NO: 1710139 - RNA, 17 nt, Homo sapiens
cuuugagggacugccuc

SEQ ID NO: 1710140 - RNA, 23 nt, Homo sapiens
cuuugagggacugccucugccac

SEQ ID NO: 1710141 - RNA, 22 nt, Homo sapiens
cuuugaucccugacaucuggaa

SEQ ID NO: 1710142 - RNA, 18 nt, Homo sapiens
cuuugcugcacuauuugc

SEQ ID NO: 1710143 - RNA, 23 nt, Homo sapiens
cuuuggggcauagaucagaagac

SEQ ID NO: 1710144 - RNA, 23 nt, Homo sapiens
cuuugucccggggcuccacugaa

SEQ ID NO: 1710145 - RNA, 12 nt, Homo sapiens
cuuugucugucg

SEQ ID NO: 1710146 - RNA, 15 nt, Homo sapiens
cuuugugauaauuua

SEQ ID NO: 1710147 - RNA, 19 nt, Homo sapiens
cuuuguguagaaagccaaa

SEQ ID NO: 1710148 - RNA, 20 nt, Homo sapiens
cuuuguguagaaagccaaau

SEQ ID NO: 1710149 - RNA, 16 nt, Homo sapiens
cuuuuaaccaucugau

SEQ ID NO: 1710150 - RNA, 18 nt, Homo sapiens
cuuuuacaacugccucga

SEQ ID NO: 1710151 - RNA, 21 nt, Homo sapiens
cuuuuaugauauauauaugcu

SEQ ID NO: 1710152 - RNA, 20 nt, Homo sapiens
cuuuuauucauuagcuguga

SEQ ID NO: 1710153 - RNA, 15 nt, Homo sapiens
cuuuuauuuuacaca

SEQ ID NO: 1710154 - RNA, 19 nt, Homo sapiens
cuuuucaaaauauuacuca

SEQ ID NO: 1710155 - RNA, 18 nt, Homo sapiens
cuuuucauaaccuagccu

SEQ ID NO: 1710156 - RNA, 17 nt, Homo sapiens
cuuuucaucuaauguga

SEQ ID NO: 1710157 - RNA, 14 nt, Homo sapiens
cuuuucccauuuca

SEQ ID NO: 1710158 - RNA, 16 nt, Homo sapiens
cuuuucuggccaaaag

SEQ ID NO: 1710159 - RNA, 20 nt, Homo sapiens
cuuuucuggggaaagacacu

SEQ ID NO: 1710160 - RNA, 14 nt, Homo sapiens
cuuuucuuggcaaa

SEQ ID NO: 1710161 - RNA, 21 nt, Homo sapiens
cuuuuuacauaacugccuuga

SEQ ID NO: 1710162 - RNA, 16 nt, Homo sapiens
cuuuuuacucaaagag

SEQ ID NO: 1710163 - RNA, 16 nt, Homo sapiens
cuuuuuauuagagcuc

SEQ ID NO: 1710164 - RNA, 18 nt, Homo sapiens
cuuuuuccuccuggaaca

SEQ ID NO: 1710165 - RNA, 18 nt, Homo sapiens
gaaaaaaacuucauucuc

SEQ ID NO: 1710166 - RNA, 15 nt, Homo sapiens
gaaaaaaaucaucua

SEQ ID NO: 1710167 - RNA, 22 nt, Homo sapiens
gaaaaaggccaguggaaauuca

SEQ ID NO: 1710168 - RNA, 19 nt, Homo sapiens
gaaaaauguuugucucagu

SEQ ID NO: 1710169 - RNA, 19 nt, Homo sapiens
gaaaacuguuaccuaaagu

SEQ ID NO: 1710170 - RNA, 15 nt, Homo sapiens
gaaaagcugcugaca

SEQ ID NO: 1710171 - RNA, 20 nt, Homo sapiens
gaaaagcugcugacaguguu

SEQ ID NO: 1710172 - RNA, 21 nt, Homo sapiens
gaaaagguagcuuaccugaca

SEQ ID NO: 1710173 - RNA, 16 nt, Homo sapiens
gaaaagugaaccacaa

SEQ ID NO: 1710174 - RNA, 14 nt, Homo sapiens
gaaaauaaacugac

SEQ ID NO: 1710175 - RNA, 17 nt, Homo sapiens
gaaaaugaaaaacaacc

SEQ ID NO: 1710176 - RNA, 17 nt, Homo sapiens
gaaaauguguucucgga

SEQ ID NO: 1710177 - RNA, 21 nt, Homo sapiens
gaaaauucuguagguucugug

SEQ ID NO: 1710178 - RNA, 19 nt, Homo sapiens
gaaaauuggauucccuuaa

SEQ ID NO: 1710179 - RNA, 18 nt, Homo sapiens
gaaaauuuuaaaaauaca

SEQ ID NO: 1710180 - RNA, 15 nt, Homo sapiens
gaaacaauggcuaag

SEQ ID NO: 1710181 - RNA, 22 nt, Homo sapiens
gaaacaauggcuaagauaccaa

SEQ ID NO: 1710182 - RNA, 18 nt, Homo sapiens
gaaacacagcaacaauga

SEQ ID NO: 1710183 - RNA, 14 nt, Homo sapiens
gaaacaugacacug

SEQ ID NO: 1710184 - RNA, 17 nt, Homo sapiens
gaaacauuaugccuuaa

SEQ ID NO: 1710185 - RNA, 13 nt, Homo sapiens
gaaacccaagcuc

SEQ ID NO: 1710186 - RNA, 21 nt, Homo sapiens
gaaaccccuucuuuacuuccc

SEQ ID NO: 1710187 - RNA, 19 nt, Homo sapiens
gaaaccucuacauauuuau

SEQ ID NO: 1710188 - RNA, 16 nt, Homo sapiens
gaaacucaaaaauauu

SEQ ID NO: 1710189 - RNA, 21 nt, Homo sapiens
gaaacucaguaugcugccccu

SEQ ID NO: 1710190 - RNA, 14 nt, Homo sapiens
gaaacuuagaucau

SEQ ID NO: 1710191 - RNA, 23 nt, Homo sapiens
gaaagaaguccuuucucuuuauu

SEQ ID NO: 1710192 - RNA, 20 nt, Homo sapiens
gaaaggaagcuccacuguca

SEQ ID NO: 1710193 - RNA, 14 nt, Homo sapiens
gaaaggagacuaga

SEQ ID NO: 1710194 - RNA, 13 nt, Homo sapiens
gaaaggccaauaa

SEQ ID NO: 1710195 - RNA, 19 nt, Homo sapiens
gaaaggccugcacacaagc

SEQ ID NO: 1710196 - RNA, 13 nt, Homo sapiens
gaaagggagcuau

SEQ ID NO: 1710197 - RNA, 17 nt, Homo sapiens
gaaagggguugggguga

SEQ ID NO: 1710198 - RNA, 19 nt, Homo sapiens
gaaagguacuauauuugcu

SEQ ID NO: 1710199 - RNA, 23 nt, Homo sapiens
gaaagugugugauuucucuccca

SEQ ID NO: 1710200 - RNA, 11 nt, Homo sapiens
gaaauaccuca

SEQ ID NO: 1710201 - RNA, 21 nt, Homo sapiens
gaaauaucuuaaaacgcaaaa

SEQ ID NO: 1710202 - RNA, 21 nt, Homo sapiens
gaaaugaaacaaauaaucaca

SEQ ID NO: 1710203 - RNA, 21 nt, Homo sapiens
gaaauggugcucaccaugcuu

SEQ ID NO: 1710204 - RNA, 22 nt, Homo sapiens
gaaauguucguuuucuccugcc

SEQ ID NO: 1710205 - RNA, 16 nt, Homo sapiens
gaaauuaagaaggcaa

SEQ ID NO: 1710206 - RNA, 16 nt, Homo sapiens
gaaauuccaaagucuc

SEQ ID NO: 1710207 - RNA, 19 nt, Homo sapiens
gaaauuccagcguacuaua

SEQ ID NO: 1710208 - RNA, 19 nt, Homo sapiens
gaaauugcauuuccugaca

SEQ ID NO: 1710209 - RNA, 15 nt, Homo sapiens
gaaauuguacauauu

SEQ ID NO: 1710210 - RNA, 23 nt, Homo sapiens
gaaauuuucaauuugagauucua

SEQ ID NO: 1710211 - RNA, 22 nt, Homo sapiens
cuguugcaaacucagugcaaac

SEQ ID NO: 1710212 - RNA, 14 nt, Homo sapiens
cuguugcuugaaua

SEQ ID NO: 1710213 - RNA, 22 nt, Homo sapiens
cuguuguaacuaggcucagaga

SEQ ID NO: 1710214 - RNA, 15 nt, Homo sapiens
cuguuguacuaugga

SEQ ID NO: 1710215 - RNA, 13 nt, Homo sapiens
cuguuuaacauuu

SEQ ID NO: 1710216 - RNA, 21 nt, Homo sapiens
cuguuuuguaagugcugcuau

SEQ ID NO: 1710217 - RNA, 23 nt, Homo sapiens
cuuaaaaaagcccuuugcuaaaa

SEQ ID NO: 1710218 - RNA, 20 nt, Homo sapiens
cuuaaagaaacagcuuucaa

SEQ ID NO: 1710219 - RNA, 15 nt, Homo sapiens
cuuaacacauucaau

SEQ ID NO: 1710220 - RNA, 21 nt, Homo sapiens
cuuacaggguaacugugcuga

SEQ ID NO: 1710221 - RNA, 18 nt, Homo sapiens
cuuaccagaagcuuccau

SEQ ID NO: 1710222 - RNA, 15 nt, Homo sapiens
cuuacccaauuuccc

SEQ ID NO: 1710223 - RNA, 15 nt, Homo sapiens
cuuacuucuuagcac

SEQ ID NO: 1710224 - RNA, 14 nt, Homo sapiens
cuuacuuugaguua

SEQ ID NO: 1710225 - RNA, 22 nt, Homo sapiens
cuuagaaaugaaggcagaaaaa

SEQ ID NO: 1710226 - RNA, 14 nt, Homo sapiens
cuuagaaauuguaa

SEQ ID NO: 1710227 - RNA, 21 nt, Homo sapiens
cuuagacauaacaaaacacuc

SEQ ID NO: 1710228 - RNA, 16 nt, Homo sapiens
cuuagcugucugcuca

SEQ ID NO: 1710229 - RNA, 23 nt, Homo sapiens
cuuaggccuuccucucuccagau

SEQ ID NO: 1710230 - RNA, 16 nt, Homo sapiens
cuuauaaaaaucuuaa

SEQ ID NO: 1710231 - RNA, 23 nt, Homo sapiens
cuuauauugaagacaauuugaua

SEQ ID NO: 1710232 - RNA, 15 nt, Homo sapiens
cuuauccugcauugu

SEQ ID NO: 1710233 - RNA, 17 nt, Homo sapiens
cuuauuuuugacagugu

SEQ ID NO: 1710234 - RNA, 23 nt, Homo sapiens
cuucaaaagcuuuuuacucaaag

SEQ ID NO: 1710235 - RNA, 20 nt, Homo sapiens
cuucaaacugugaagcauuu

SEQ ID NO: 1710236 - RNA, 21 nt, Homo sapiens
cuucaacugaccagccuccau

SEQ ID NO: 1710237 - RNA, 18 nt, Homo sapiens
cuucaagccugugcaaug

SEQ ID NO: 1710238 - RNA, 13 nt, Homo sapiens
cuucacaacuagg

SEQ ID NO: 1710239 - RNA, 21 nt, Homo sapiens
cuucaccccaguggccacuca

SEQ ID NO: 1710240 - RNA, 20 nt, Homo sapiens
cuucacuacuuuaauaaaga

SEQ ID NO: 1710241 - RNA, 19 nt, Homo sapiens
cuucacugaaagacaccau

SEQ ID NO: 1710242 - RNA, 16 nt, Homo sapiens
cuucacuguauaaaua

SEQ ID NO: 1710243 - RNA, 14 nt, Homo sapiens
cuucagauagaaaa

SEQ ID NO: 1710244 - RNA, 23 nt, Homo sapiens
cuucaggggcacuucauugagag

SEQ ID NO: 1710245 - RNA, 22 nt, Homo sapiens
cuucagguuaucgaaauaacaa

SEQ ID NO: 1710246 - RNA, 14 nt, Homo sapiens
cuucauggaacuca

SEQ ID NO: 1710247 - RNA, 21 nt, Homo sapiens
cuucauggaacucagcugucu

SEQ ID NO: 1710248 - RNA, 16 nt, Homo sapiens
cuucauguaacuauag

SEQ ID NO: 1710249 - RNA, 17 nt, Homo sapiens
cuucauucacauucaga

SEQ ID NO: 1710250 - RNA, 22 nt, Homo sapiens
cuucauuccuuccacuaacuca

SEQ ID NO: 1710251 - RNA, 22 nt, Homo sapiens
cuuccacaacagaaguauuucu

SEQ ID NO: 1710252 - RNA, 12 nt, Homo sapiens
cuuccacuuugc

SEQ ID NO: 1710253 - RNA, 17 nt, Homo sapiens
cuuccagaucacugcca

SEQ ID NO: 1710254 - RNA, 18 nt, Homo sapiens
cuuccaggggaaccugcc

SEQ ID NO: 1710255 - RNA, 14 nt, Homo sapiens
cuuccagugcucag

SEQ ID NO: 1710256 - RNA, 13 nt, Homo sapiens
cuuccaucuggcu

SEQ ID NO: 1710257 - RNA, 12 nt, Homo sapiens
cuuccauuugcu

SEQ ID NO: 1710258 - RNA, 21 nt, Homo sapiens
cuucccaaucagcacugaaaa

SEQ ID NO: 1710259 - RNA, 14 nt, Homo sapiens
cuucccagugaauu

SEQ ID NO: 1710260 - RNA, 20 nt, Homo sapiens
cuucccggcgucccuaccuc

SEQ ID NO: 1710261 - RNA, 13 nt, Homo sapiens
cuucccuaccuca

SEQ ID NO: 1710262 - RNA, 17 nt, Homo sapiens
cuuccgauggaugaauc

SEQ ID NO: 1710263 - RNA, 13 nt, Homo sapiens
cuuccuccagcug

SEQ ID NO: 1710264 - RNA, 18 nt, Homo sapiens
cuuccucucucaggggug

SEQ ID NO: 1710265 - RNA, 18 nt, Homo sapiens
cuuccugaggaugggcaa

SEQ ID NO: 1710266 - RNA, 18 nt, Homo sapiens
cuuccuggaguacaaaca

SEQ ID NO: 1710267 - RNA, 19 nt, Homo sapiens
cuuccuggaguacaaacac

SEQ ID NO: 1710268 - RNA, 17 nt, Homo sapiens
cuuccugucaacacuuc

SEQ ID NO: 1710269 - RNA, 15 nt, Homo sapiens
cuuccugucugagua

SEQ ID NO: 1710270 - RNA, 19 nt, Homo sapiens
cuucgaggcuuuacagugu

SEQ ID NO: 1710271 - RNA, 16 nt, Homo sapiens
cuucuacaauuguggu

SEQ ID NO: 1710272 - RNA, 11 nt, Homo sapiens
cuucucaggaa

SEQ ID NO: 1710273 - RNA, 14 nt, Homo sapiens
cuucuccaccaaag

SEQ ID NO: 1710274 - RNA, 15 nt, Homo sapiens
cuucuccaccaaaga

SEQ ID NO: 1710275 - RNA, 17 nt, Homo sapiens
cuucuccaccaaagaca

SEQ ID NO: 1710276 - RNA, 22 nt, Homo sapiens
cuucucuauaucaugcuuuaaa

SEQ ID NO: 1710277 - RNA, 22 nt, Homo sapiens
cuucugaugucucuaaagcacu

SEQ ID NO: 1710278 - RNA, 17 nt, Homo sapiens
cuucuguccuacucugu

SEQ ID NO: 1710279 - RNA, 14 nt, Homo sapiens
cuucuuaaucugaa

SEQ ID NO: 1710280 - RNA, 16 nt, Homo sapiens
cuucuuacuggugcua

SEQ ID NO: 1710281 - RNA, 22 nt, Homo sapiens
cuucuuauggaauugauuugca

SEQ ID NO: 1710282 - RNA, 19 nt, Homo sapiens
cuucuuugauaauguuaaa

SEQ ID NO: 1710283 - RNA, 16 nt, Homo sapiens
cuucuuuuaugagcag

SEQ ID NO: 1710284 - RNA, 20 nt, Homo sapiens
cuugaaauuaagaaggcaaa

SEQ ID NO: 1710285 - RNA, 16 nt, Homo sapiens
cuugaaauuauaucug

SEQ ID NO: 1710286 - RNA, 13 nt, Homo sapiens
cuugaacaaaagg

SEQ ID NO: 1710287 - RNA, 17 nt, Homo sapiens
cuugaacaaaaucuguu

SEQ ID NO: 1710288 - RNA, 13 nt, Homo sapiens
cuugaacccaaga

SEQ ID NO: 1710289 - RNA, 17 nt, Homo sapiens
cuugaaugugcaccuga

SEQ ID NO: 1710290 - RNA, 18 nt, Homo sapiens
cuugacccccuugagggu

SEQ ID NO: 1710291 - RNA, 15 nt, Homo sapiens
cuugagcaaauuacc

SEQ ID NO: 1710292 - RNA, 22 nt, Homo sapiens
cuugagcgugaaucuguaucuu

SEQ ID NO: 1710293 - RNA, 20 nt, Homo sapiens
cuugaguguaauguuuguua

SEQ ID NO: 1710294 - RNA, 13 nt, Homo sapiens
cuugaugauacaa

SEQ ID NO: 1710295 - RNA, 20 nt, Homo sapiens
cuugauuuagcacuauuuac

SEQ ID NO: 1710296 - RNA, 18 nt, Homo sapiens
cuugcaggugacauuugc

SEQ ID NO: 1710297 - RNA, 22 nt, Homo sapiens
cuugcauuacuuugaauuuaau

SEQ ID NO: 1710298 - RNA, 13 nt, Homo sapiens
cuugcauucauuu

SEQ ID NO: 1710299 - RNA, 21 nt, Homo sapiens
cuugccuaaauuuaaugcugc

SEQ ID NO: 1710300 - RNA, 18 nt, Homo sapiens
cuugcucauaugcaugua

SEQ ID NO: 1710301 - RNA, 23 nt, Homo sapiens
cuugcuggacggggacuggggau

SEQ ID NO: 1710302 - RNA, 16 nt, Homo sapiens
cuugcuugcaauaggu

SEQ ID NO: 1710303 - RNA, 16 nt, Homo sapiens
cuuggaucagaugaac

SEQ ID NO: 1710304 - RNA, 18 nt, Homo sapiens
cuuggaucagaugaacuc

SEQ ID NO: 1710305 - RNA, 14 nt, Homo sapiens
cuuggaugugguuu

SEQ ID NO: 1710306 - RNA, 22 nt, Homo sapiens
cuuggcaaaagccuuguguaua

SEQ ID NO: 1710307 - RNA, 13 nt, Homo sapiens
cuuggcaccaaag

SEQ ID NO: 1710308 - RNA, 11 nt, Homo sapiens
cuuggccuagc

SEQ ID NO: 1710309 - RNA, 13 nt, Homo sapiens
cuuggcugugagg

SEQ ID NO: 1710310 - RNA, 17 nt, Homo sapiens
cuuggcuucugugauga

SEQ ID NO: 1710311 - RNA, 22 nt, Homo sapiens
cuuggcuucugugaugagcuga

SEQ ID NO: 1710312 - RNA, 16 nt, Homo sapiens
cuugggagauucaugc

SEQ ID NO: 1710313 - RNA, 20 nt, Homo sapiens
cuuggggagauggaguucuu

SEQ ID NO: 1710314 - RNA, 20 nt, Homo sapiens
cuugggggaacgaugugucu

SEQ ID NO: 1710315 - RNA, 21 nt, Homo sapiens
cuugguuuuuauaccauucag

SEQ ID NO: 1710316 - RNA, 16 nt, Homo sapiens
cuuguauauacgcauc

SEQ ID NO: 1710317 - RNA, 21 nt, Homo sapiens
cuugucagacauaaagccaug

SEQ ID NO: 1710318 - RNA, 17 nt, Homo sapiens
cuugucaugugacaggu

SEQ ID NO: 1710319 - RNA, 15 nt, Homo sapiens
cuuguccaugugguu

SEQ ID NO: 1710320 - RNA, 21 nt, Homo sapiens
cuggauaacuuagguggcaag

SEQ ID NO: 1710321 - RNA, 18 nt, Homo sapiens
cuggaucacgacgcugca

SEQ ID NO: 1710322 - RNA, 18 nt, Homo sapiens
cuggauggagcccaggcg

SEQ ID NO: 1710323 - RNA, 17 nt, Homo sapiens
cuggauggcccauagac

SEQ ID NO: 1710324 - RNA, 19 nt, Homo sapiens
cuggcaagucuuccaugac

SEQ ID NO: 1710325 - RNA, 20 nt, Homo sapiens
cuggcaagucuuccaugacc

SEQ ID NO: 1710326 - RNA, 21 nt, Homo sapiens
cuggcaagucuuccaugaccc

SEQ ID NO: 1710327 - RNA, 19 nt, Homo sapiens
cuggcccugcccugaggaa

SEQ ID NO: 1710328 - RNA, 13 nt, Homo sapiens
cuggccgccuagg

SEQ ID NO: 1710329 - RNA, 20 nt, Homo sapiens
cuggccgcguuuagaccaag

SEQ ID NO: 1710330 - RNA, 20 nt, Homo sapiens
cuggcgugcaguggugcgau

SEQ ID NO: 1710331 - RNA, 23 nt, Homo sapiens
cuggcugcaaaggguaucaggug

SEQ ID NO: 1710332 - RNA, 22 nt, Homo sapiens
cuggcugcuuuguucaaugcua

SEQ ID NO: 1710333 - RNA, 20 nt, Homo sapiens
cuggcuuauuuuaaugugau

SEQ ID NO: 1710334 - RNA, 18 nt, Homo sapiens
cuggcuucuacacugggu

SEQ ID NO: 1710335 - RNA, 21 nt, Homo sapiens
cugggaaaaucuauuccugcc

SEQ ID NO: 1710336 - RNA, 16 nt, Homo sapiens
cugggagcagcucugu

SEQ ID NO: 1710337 - RNA, 22 nt, Homo sapiens
cugggagcagcucugugacucc

SEQ ID NO: 1710338 - RNA, 19 nt, Homo sapiens
cugggaggcagagguugca

SEQ ID NO: 1710339 - RNA, 18 nt, Homo sapiens
cugggauuacaagcguga

SEQ ID NO: 1710340 - RNA, 22 nt, Homo sapiens
cugggauuacaauugugagcca

SEQ ID NO: 1710341 - RNA, 18 nt, Homo sapiens
cugggccaccagccacuu

SEQ ID NO: 1710342 - RNA, 13 nt, Homo sapiens
cugggccaugucc

SEQ ID NO: 1710343 - RNA, 15 nt, Homo sapiens
cugggccauguccaa

SEQ ID NO: 1710344 - RNA, 16 nt, Homo sapiens
cugggccauguccaaa

SEQ ID NO: 1710345 - RNA, 13 nt, Homo sapiens
cugggcuagggga

SEQ ID NO: 1710346 - RNA, 22 nt, Homo sapiens
cugggcugcuacccagaaauca

SEQ ID NO: 1710347 - RNA, 20 nt, Homo sapiens
cuggggaaagacacugccug

SEQ ID NO: 1710348 - RNA, 11 nt, Homo sapiens
cugggggaguu

SEQ ID NO: 1710349 - RNA, 20 nt, Homo sapiens
cuggggguggggagguguca

SEQ ID NO: 1710350 - RNA, 18 nt, Homo sapiens
cuggggugcugccugaau

SEQ ID NO: 1710351 - RNA, 13 nt, Homo sapiens
cugguagcacuug

SEQ ID NO: 1710352 - RNA, 23 nt, Homo sapiens
cuggucaggcccuggugcgaaug

SEQ ID NO: 1710353 - RNA, 14 nt, Homo sapiens
cuggucugaaaaug

SEQ ID NO: 1710354 - RNA, 23 nt, Homo sapiens
cuggugggccuuucuguguccua

SEQ ID NO: 1710355 - RNA, 17 nt, Homo sapiens
cuguaaaaacacugaaa

SEQ ID NO: 1710356 - RNA, 16 nt, Homo sapiens
cuguaaacuuccaagc

SEQ ID NO: 1710357 - RNA, 14 nt, Homo sapiens
cuguaaauaccauu

SEQ ID NO: 1710358 - RNA, 17 nt, Homo sapiens
cuguaacauauucugua

SEQ ID NO: 1710359 - RNA, 15 nt, Homo sapiens
cuguaagccaaagaa

SEQ ID NO: 1710360 - RNA, 14 nt, Homo sapiens
cuguaauaauaccu

SEQ ID NO: 1710361 - RNA, 16 nt, Homo sapiens
cuguaauaauaccuca

SEQ ID NO: 1710362 - RNA, 17 nt, Homo sapiens
cuguaauaauaccucaa

SEQ ID NO: 1710363 - RNA, 21 nt, Homo sapiens
cuguaaucccaacacuuuggg

SEQ ID NO: 1710364 - RNA, 18 nt, Homo sapiens
cuguacacugacuugaga

SEQ ID NO: 1710365 - RNA, 19 nt, Homo sapiens
cuguacacugacuugagac

SEQ ID NO: 1710366 - RNA, 13 nt, Homo sapiens
cuguaccauuuau

SEQ ID NO: 1710367 - RNA, 17 nt, Homo sapiens
cuguacucuuaucuggg

SEQ ID NO: 1710368 - RNA, 13 nt, Homo sapiens
cuguagaugaugu

SEQ ID NO: 1710369 - RNA, 18 nt, Homo sapiens
cuguagauucuguggaac

SEQ ID NO: 1710370 - RNA, 16 nt, Homo sapiens
cuguaggggcaaaaau

SEQ ID NO: 1710371 - RNA, 23 nt, Homo sapiens
cuguaggugguaugugacaccaa

SEQ ID NO: 1710372 - RNA, 15 nt, Homo sapiens
cuguagguucuugau

SEQ ID NO: 1710373 - RNA, 13 nt, Homo sapiens
cuguagucauuua

SEQ ID NO: 1710374 - RNA, 17 nt, Homo sapiens
cuguaguucuaagacuc

SEQ ID NO: 1710375 - RNA, 22 nt, Homo sapiens
cuguauguaaacuguuacugaa

SEQ ID NO: 1710376 - RNA, 23 nt, Homo sapiens
cuguauuuguaucucugaagcau

SEQ ID NO: 1710377 - RNA, 18 nt, Homo sapiens
cugucaaaacacugugga

SEQ ID NO: 1710378 - RNA, 23 nt, Homo sapiens
cugucaagcaccugcaugugcug

SEQ ID NO: 1710379 - RNA, 14 nt, Homo sapiens
cugucacaccagcc

SEQ ID NO: 1710380 - RNA, 19 nt, Homo sapiens
cugucagaaugcuauugaa

SEQ ID NO: 1710381 - RNA, 19 nt, Homo sapiens
cugucauccucaugcugcu

SEQ ID NO: 1710382 - RNA, 20 nt, Homo sapiens
cugucauccucaugcugcuc

SEQ ID NO: 1710383 - RNA, 24 nt, Homo sapiens
cugucaugaaaucagcaagagagg

SEQ ID NO: 1710384 - RNA, 22 nt, Homo sapiens
cugucauucgcucccacauucu

SEQ ID NO: 1710385 - RNA, 23 nt, Homo sapiens
cugucauucgcucccacauucug

SEQ ID NO: 1710386 - RNA, 23 nt, Homo sapiens
cuguccacugggccauuguggug

SEQ ID NO: 1710387 - RNA, 18 nt, Homo sapiens
cuguccugaucugugaua

SEQ ID NO: 1710388 - RNA, 14 nt, Homo sapiens
cugucgcccagucu

SEQ ID NO: 1710389 - RNA, 23 nt, Homo sapiens
cugucuaaaaaccagacaaggaa

SEQ ID NO: 1710390 - RNA, 21 nt, Homo sapiens
cugucucagacuuuuguacau

SEQ ID NO: 1710391 - RNA, 19 nt, Homo sapiens
cugucugagacucacagga

SEQ ID NO: 1710392 - RNA, 23 nt, Homo sapiens
cugucugaguaagcccucaggag

SEQ ID NO: 1710393 - RNA, 13 nt, Homo sapiens
cugugaaacuggc

SEQ ID NO: 1710394 - RNA, 15 nt, Homo sapiens
cugugaccucaggca

SEQ ID NO: 1710395 - RNA, 15 nt, Homo sapiens
cugugauccacccaa

SEQ ID NO: 1710396 - RNA, 21 nt, Homo sapiens
cugugcacacacacacacaug

SEQ ID NO: 1710397 - RNA, 14 nt, Homo sapiens
cugugcugggggaa

SEQ ID NO: 1710398 - RNA, 14 nt, Homo sapiens
cuguggaacauaaa

SEQ ID NO: 1710399 - RNA, 16 nt, Homo sapiens
cuguggaacauaaaaa

SEQ ID NO: 1710400 - RNA, 22 nt, Homo sapiens
cuguggaacccagcaguucugu

SEQ ID NO: 1710401 - RNA, 17 nt, Homo sapiens
cuguggaccacugcaug

SEQ ID NO: 1710402 - RNA, 19 nt, Homo sapiens
cuguggauggcaucaaaca

SEQ ID NO: 1710403 - RNA, 15 nt, Homo sapiens
cuguggcacuugccu

SEQ ID NO: 1710404 - RNA, 16 nt, Homo sapiens
cuguggcaucuuugcc

SEQ ID NO: 1710405 - RNA, 16 nt, Homo sapiens
cugugggggugagggu

SEQ ID NO: 1710406 - RNA, 22 nt, Homo sapiens
cuguggguccgauaauaucuuu

SEQ ID NO: 1710407 - RNA, 21 nt, Homo sapiens
cuguggucuucaaauugucuu

SEQ ID NO: 1710408 - RNA, 20 nt, Homo sapiens
cuguguauauaguuuuuacc

SEQ ID NO: 1710409 - RNA, 22 nt, Homo sapiens
cuguguauuuacaugaauguau

SEQ ID NO: 1710410 - RNA, 18 nt, Homo sapiens
cuguguccuacuccuugc

SEQ ID NO: 1710411 - RNA, 15 nt, Homo sapiens
cugugucuaagauuc

SEQ ID NO: 1710412 - RNA, 19 nt, Homo sapiens
cugugugaugaacuuucuc

SEQ ID NO: 1710413 - RNA, 13 nt, Homo sapiens
cugugugaugaug

SEQ ID NO: 1710414 - RNA, 22 nt, Homo sapiens
cugugugugaaaggaagcucca

SEQ ID NO: 1710415 - RNA, 15 nt, Homo sapiens
cugugugugugaaug

SEQ ID NO: 1710416 - RNA, 13 nt, Homo sapiens
cuguguuaggggu

SEQ ID NO: 1710417 - RNA, 21 nt, Homo sapiens
cuguguuauucuuugcgugua

SEQ ID NO: 1710418 - RNA, 20 nt, Homo sapiens
cuguguuuuuccuccauaaa

SEQ ID NO: 1710419 - RNA, 15 nt, Homo sapiens
cuguuaaaugaacuu

SEQ ID NO: 1710420 - RNA, 13 nt, Homo sapiens
cuguuaccauuca

SEQ ID NO: 1710421 - RNA, 19 nt, Homo sapiens
cuguuacugaaauugguau

SEQ ID NO: 1710422 - RNA, 16 nt, Homo sapiens
cuguuauguacuguac

SEQ ID NO: 1710423 - RNA, 14 nt, Homo sapiens
cuguucacuuugua

SEQ ID NO: 1710424 - RNA, 18 nt, Homo sapiens
cuguucugggugcagcug

SEQ ID NO: 1710425 - RNA, 17 nt, Homo sapiens
cuguucuugcugcuaga

SEQ ID NO: 1710426 - RNA, 18 nt, Homo sapiens
cuguucuugcugcuagaa

SEQ ID NO: 1710427 - RNA, 21 nt, Homo sapiens
cuguugaugaaagggacagau

SEQ ID NO: 1710428 - RNA, 23 nt, Homo sapiens
cacuagcauuuucucuaccuuca

SEQ ID NO: 1710429 - RNA, 17 nt, Homo sapiens
cacuagucacauucuug

SEQ ID NO: 1710430 - RNA, 16 nt, Homo sapiens
cacucaagcacugaua

SEQ ID NO: 1710431 - RNA, 22 nt, Homo sapiens
cacucaguuuaugcugugcuaa

SEQ ID NO: 1710432 - RNA, 21 nt, Homo sapiens
cacuccaggauauugacaaga

SEQ ID NO: 1710433 - RNA, 13 nt, Homo sapiens
cacuccauuccca

SEQ ID NO: 1710434 - RNA, 21 nt, Homo sapiens
cacugaaacugguugaagggu

SEQ ID NO: 1710435 - RNA, 21 nt, Homo sapiens
cacugaccuuggagagacaca

SEQ ID NO: 1710436 - RNA, 18 nt, Homo sapiens
cacugcaauccugucuuu

SEQ ID NO: 1710437 - RNA, 16 nt, Homo sapiens
cacugcacuguuuuca

SEQ ID NO: 1710438 - RNA, 14 nt, Homo sapiens
cacugccacacucu

SEQ ID NO: 1710439 - RNA, 9 nt, Homo sapiens
cacugccuc

SEQ ID NO: 1710440 - RNA, 15 nt, Homo sapiens
cacugccuguauacu

SEQ ID NO: 1710441 - RNA, 23 nt, Homo sapiens
cacugggaugagccgcugugagc

SEQ ID NO: 1710442 - RNA, 22 nt, Homo sapiens
cacugguggccgugguggggcc

SEQ ID NO: 1710443 - RNA, 14 nt, Homo sapiens
cacuguaguucuaa

SEQ ID NO: 1710444 - RNA, 17 nt, Homo sapiens
cacuguaguucuaagac

SEQ ID NO: 1710445 - RNA, 19 nt, Homo sapiens
cacugugccaugugccagg

SEQ ID NO: 1710446 - RNA, 15 nt, Homo sapiens
cacuguggagcucag

SEQ ID NO: 1710447 - RNA, 19 nt, Homo sapiens
cacuguguacaccucugga

SEQ ID NO: 1710448 - RNA, 14 nt, Homo sapiens
cacuguuucuugcu

SEQ ID NO: 1710449 - RNA, 18 nt, Homo sapiens
cacuuagcuaucagaaga

SEQ ID NO: 1710450 - RNA, 18 nt, Homo sapiens
cacuucaaugcacauggu

SEQ ID NO: 1710451 - RNA, 18 nt, Homo sapiens
cacuucauucacauucag

SEQ ID NO: 1710452 - RNA, 18 nt, Homo sapiens
cacuucauucugcagggu

SEQ ID NO: 1710453 - RNA, 17 nt, Homo sapiens
cacuucucacaucuuau

SEQ ID NO: 1710454 - RNA, 15 nt, Homo sapiens
cacuugaugauacaa

SEQ ID NO: 1710455 - RNA, 20 nt, Homo sapiens
cacuuugaaggggccucacc

SEQ ID NO: 1710456 - RNA, 12 nt, Homo sapiens
cacuuugccucc

SEQ ID NO: 1710457 - RNA, 16 nt, Homo sapiens
cacuuugccuccugug

SEQ ID NO: 1710458 - RNA, 18 nt, Homo sapiens
cacuuugucuaacucaga

SEQ ID NO: 1710459 - RNA, 22 nt, Homo sapiens
cagaaaacgggaagcgcucaga

SEQ ID NO: 1710460 - RNA, 14 nt, Homo sapiens
cagaaacacugccu

SEQ ID NO: 1710461 - RNA, 21 nt, Homo sapiens
cagaaacuagaaaugugaaug

SEQ ID NO: 1710462 - RNA, 17 nt, Homo sapiens
cagaaagcauccuaaau

SEQ ID NO: 1710463 - RNA, 19 nt, Homo sapiens
cagaaauccugcaaugaaa

SEQ ID NO: 1710464 - RNA, 21 nt, Homo sapiens
cagaaauggggaauucucuaa

SEQ ID NO: 1710465 - RNA, 23 nt, Homo sapiens
cagaaauggugcucaccaugcuu

SEQ ID NO: 1710466 - RNA, 21 nt, Homo sapiens
cagaaaugucuaaaugcugaa

SEQ ID NO: 1710467 - RNA, 22 nt, Homo sapiens
cagaacagggucauguuugcag

SEQ ID NO: 1710468 - RNA, 12 nt, Homo sapiens
cagaaccaaagc

SEQ ID NO: 1710469 - RNA, 16 nt, Homo sapiens
cagaaccaaagcucaa

SEQ ID NO: 1710470 - RNA, 23 nt, Homo sapiens
cagaacccagggcucugccccag

SEQ ID NO: 1710471 - RNA, 12 nt, Homo sapiens
cagaacugccau

SEQ ID NO: 1710472 - RNA, 13 nt, Homo sapiens
cagaacugccauu

SEQ ID NO: 1710473 - RNA, 17 nt, Homo sapiens
cagaagaaaauucuccu

SEQ ID NO: 1710474 - RNA, 14 nt, Homo sapiens
cagaagacaaaaag

SEQ ID NO: 1710475 - RNA, 13 nt, Homo sapiens
cagaaggacucag

SEQ ID NO: 1710476 - RNA, 22 nt, Homo sapiens
cagaaggugccacuuuacccac

SEQ ID NO: 1710477 - RNA, 15 nt, Homo sapiens
cagaagguugcucua

SEQ ID NO: 1710478 - RNA, 14 nt, Homo sapiens
cagaaguuccucaa

SEQ ID NO: 1710479 - RNA, 23 nt, Homo sapiens
cagaaucucauagguugccaaua

SEQ ID NO: 1710480 - RNA, 18 nt, Homo sapiens
cagaaugcugcaggacuu

SEQ ID NO: 1710481 - RNA, 17 nt, Homo sapiens
cagaauguaucugugaa

SEQ ID NO: 1710482 - RNA, 12 nt, Homo sapiens
cagaauuaugaa

SEQ ID NO: 1710483 - RNA, 19 nt, Homo sapiens
cagaauuaugaagagguau

SEQ ID NO: 1710484 - RNA, 14 nt, Homo sapiens
cagaauugugcaaa

SEQ ID NO: 1710485 - RNA, 16 nt, Homo sapiens
cagaauuuuaaagagc

SEQ ID NO: 1710486 - RNA, 12 nt, Homo sapiens
cagacaacagaa

SEQ ID NO: 1710487 - RNA, 15 nt, Homo sapiens
cagacaagugacugu

SEQ ID NO: 1710488 - RNA, 15 nt, Homo sapiens
cagacaaugauccag

SEQ ID NO: 1710489 - RNA, 22 nt, Homo sapiens
cagacacacacacgcacgcaca

SEQ ID NO: 1710490 - RNA, 11 nt, Homo sapiens
cagacaccagu

SEQ ID NO: 1710491 - RNA, 12 nt, Homo sapiens
cagacagagauu

SEQ ID NO: 1710492 - RNA, 20 nt, Homo sapiens
cagacaucggccuccaugac

SEQ ID NO: 1710493 - RNA, 20 nt, Homo sapiens
cagaccgugaccaucuuugu

SEQ ID NO: 1710494 - RNA, 18 nt, Homo sapiens
cugaccuggagaugcugc

SEQ ID NO: 1710495 - RNA, 20 nt, Homo sapiens
cugacuagaagggccagucc

SEQ ID NO: 1710496 - RNA, 20 nt, Homo sapiens
cugacugaagugaacuauga

SEQ ID NO: 1710497 - RNA, 16 nt, Homo sapiens
cugacuguacuccucc

SEQ ID NO: 1710498 - RNA, 18 nt, Homo sapiens
cugacuuguuugucuucc

SEQ ID NO: 1710499 - RNA, 20 nt, Homo sapiens
cugacuuguuugucuuccau

SEQ ID NO: 1710500 - RNA, 16 nt, Homo sapiens
cugagaacuccugacu

SEQ ID NO: 1710501 - RNA, 15 nt, Homo sapiens
cugagaauguggaau

SEQ ID NO: 1710502 - RNA, 16 nt, Homo sapiens
cugagaauguggaaua

SEQ ID NO: 1710503 - RNA, 19 nt, Homo sapiens
cugagagacauggcuuuca

SEQ ID NO: 1710504 - RNA, 13 nt, Homo sapiens
cugagagaugaca

SEQ ID NO: 1710505 - RNA, 17 nt, Homo sapiens
cugagcaacucuugauu

SEQ ID NO: 1710506 - RNA, 19 nt, Homo sapiens
cugagccccagggugccca

SEQ ID NO: 1710507 - RNA, 19 nt, Homo sapiens
cugagccuggcccauagaa

SEQ ID NO: 1710508 - RNA, 20 nt, Homo sapiens
cugagcgggaggcagaguuu

SEQ ID NO: 1710509 - RNA, 17 nt, Homo sapiens
cugaggacaaaguggag

SEQ ID NO: 1710510 - RNA, 16 nt, Homo sapiens
cugagggaaagugcau

SEQ ID NO: 1710511 - RNA, 22 nt, Homo sapiens
cugaggguccccaccugggacc

SEQ ID NO: 1710512 - RNA, 23 nt, Homo sapiens
cugaggguugggguggggaagca

SEQ ID NO: 1710513 - RNA, 18 nt, Homo sapiens
cugagucaaugcgcaaaa

SEQ ID NO: 1710514 - RNA, 21 nt, Homo sapiens
cugagugccagcccuggcaga

SEQ ID NO: 1710515 - RNA, 19 nt, Homo sapiens
cugagugggagaaggcagu

SEQ ID NO: 1710516 - RNA, 18 nt, Homo sapiens
cugaguucuggucaaaga

SEQ ID NO: 1710517 - RNA, 18 nt, Homo sapiens
cugaguugccaagacaaa

SEQ ID NO: 1710518 - RNA, 21 nt, Homo sapiens
cugaguuugcuguuugcaauu

SEQ ID NO: 1710519 - RNA, 19 nt, Homo sapiens
cugauaugggacugagccu

SEQ ID NO: 1710520 - RNA, 16 nt, Homo sapiens
cugaucacuagccugu

SEQ ID NO: 1710521 - RNA, 16 nt, Homo sapiens
cugauccuaacugaag

SEQ ID NO: 1710522 - RNA, 17 nt, Homo sapiens
cugaugaaacucacaaa

SEQ ID NO: 1710523 - RNA, 19 nt, Homo sapiens
cugauucccaagcucugcu

SEQ ID NO: 1710524 - RNA, 22 nt, Homo sapiens
cugauuguggaucuuuucauuc

SEQ ID NO: 1710525 - RNA, 18 nt, Homo sapiens
cugauuuguauucuguga

SEQ ID NO: 1710526 - RNA, 16 nt, Homo sapiens
cugauuuuuagcuuua

SEQ ID NO: 1710527 - RNA, 16 nt, Homo sapiens
cugcaaaacacuaaag

SEQ ID NO: 1710528 - RNA, 19 nt, Homo sapiens
cugcaacaggcuugugcaa

SEQ ID NO: 1710529 - RNA, 21 nt, Homo sapiens
cugcaaucugagccagugcuu

SEQ ID NO: 1710530 - RNA, 18 nt, Homo sapiens
cugcaaugggcacuggga

SEQ ID NO: 1710531 - RNA, 17 nt, Homo sapiens
cugcacagagucaggau

SEQ ID NO: 1710532 - RNA, 13 nt, Homo sapiens
cugcacagugaag

SEQ ID NO: 1710533 - RNA, 17 nt, Homo sapiens
cugcacaugucuuguac

SEQ ID NO: 1710534 - RNA, 18 nt, Homo sapiens
cugcacaugucuuguaca

SEQ ID NO: 1710535 - RNA, 19 nt, Homo sapiens
cugcacaugucuuguacau

SEQ ID NO: 1710536 - RNA, 17 nt, Homo sapiens
cugcacuguccugacca

SEQ ID NO: 1710537 - RNA, 23 nt, Homo sapiens
cugcacuguccugaccaucgcac

SEQ ID NO: 1710538 - RNA, 14 nt, Homo sapiens
cugcacuugcagac

SEQ ID NO: 1710539 - RNA, 17 nt, Homo sapiens
cugcagaaguacuccua

SEQ ID NO: 1710540 - RNA, 16 nt, Homo sapiens
cugcagaauccagcua

SEQ ID NO: 1710541 - RNA, 16 nt, Homo sapiens
cugcagcuuccuguca

SEQ ID NO: 1710542 - RNA, 14 nt, Homo sapiens
cugcaggaaucaaa

SEQ ID NO: 1710543 - RNA, 20 nt, Homo sapiens
cugcauguaccauuugcaug

SEQ ID NO: 1710544 - RNA, 13 nt, Homo sapiens
cugcauugcuaga

SEQ ID NO: 1710545 - RNA, 18 nt, Homo sapiens
cugcauuugugucaucuu

SEQ ID NO: 1710546 - RNA, 22 nt, Homo sapiens
cugccaagagagggccaugcaa

SEQ ID NO: 1710547 - RNA, 17 nt, Homo sapiens
cugccacaccagucaca

SEQ ID NO: 1710548 - RNA, 22 nt, Homo sapiens
cugccaccacugggcaaacaga

SEQ ID NO: 1710549 - RNA, 19 nt, Homo sapiens
cugccagaagauccccuca

SEQ ID NO: 1710550 - RNA, 14 nt, Homo sapiens
cugccagcaaagag

SEQ ID NO: 1710551 - RNA, 19 nt, Homo sapiens
cugccagccccacacagcu

SEQ ID NO: 1710552 - RNA, 15 nt, Homo sapiens
cugccaguguggaac

SEQ ID NO: 1710553 - RNA, 19 nt, Homo sapiens
cugccauauucuguuggcc

SEQ ID NO: 1710554 - RNA, 13 nt, Homo sapiens
cugccauguacua

SEQ ID NO: 1710555 - RNA, 19 nt, Homo sapiens
cugccauuauuuucuguca

SEQ ID NO: 1710556 - RNA, 22 nt, Homo sapiens
cugccauuggagccaaugugug

SEQ ID NO: 1710557 - RNA, 19 nt, Homo sapiens
cugcccaaggaugcuguca

SEQ ID NO: 1710558 - RNA, 12 nt, Homo sapiens
cugcccccggcc

SEQ ID NO: 1710559 - RNA, 15 nt, Homo sapiens
cugccccucucacca

SEQ ID NO: 1710560 - RNA, 17 nt, Homo sapiens
cugccccucucaccaaa

SEQ ID NO: 1710561 - RNA, 18 nt, Homo sapiens
cugcccgggagggcuucc

SEQ ID NO: 1710562 - RNA, 19 nt, Homo sapiens
cugccuagcugccuagcaa

SEQ ID NO: 1710563 - RNA, 22 nt, Homo sapiens
cugccuccuucccucggggcca

SEQ ID NO: 1710564 - RNA, 15 nt, Homo sapiens
cugccucugacacac

SEQ ID NO: 1710565 - RNA, 15 nt, Homo sapiens
cugccugaagucaca

SEQ ID NO: 1710566 - RNA, 14 nt, Homo sapiens
cugccuucucagga

SEQ ID NO: 1710567 - RNA, 17 nt, Homo sapiens
cugccuuuucaucuaau

SEQ ID NO: 1710568 - RNA, 12 nt, Homo sapiens
cugcgucuuccg

SEQ ID NO: 1710569 - RNA, 17 nt, Homo sapiens
cugcgugguugaugauc

SEQ ID NO: 1710570 - RNA, 17 nt, Homo sapiens
cugcuauaucuauccau

SEQ ID NO: 1710571 - RNA, 18 nt, Homo sapiens
cugcucacaguaacccaa

SEQ ID NO: 1710572 - RNA, 22 nt, Homo sapiens
cugcucaggcugcagcuggaca

SEQ ID NO: 1710573 - RNA, 13 nt, Homo sapiens
cugcuccacccuu

SEQ ID NO: 1710574 - RNA, 16 nt, Homo sapiens
cugcuccacguucucu

SEQ ID NO: 1710575 - RNA, 22 nt, Homo sapiens
cugcuccucuaggccucacuca

SEQ ID NO: 1710576 - RNA, 14 nt, Homo sapiens
cugcucuuccucag

SEQ ID NO: 1710577 - RNA, 14 nt, Homo sapiens
cugcucuuguucua

SEQ ID NO: 1710578 - RNA, 20 nt, Homo sapiens
cugcugaaaaccaucuggcc

SEQ ID NO: 1710579 - RNA, 14 nt, Homo sapiens
cugcugggaccuug

SEQ ID NO: 1710580 - RNA, 16 nt, Homo sapiens
cugcuguuacuguuaa

SEQ ID NO: 1710581 - RNA, 20 nt, Homo sapiens
cugcuuccaauuuucuggaa

SEQ ID NO: 1710582 - RNA, 18 nt, Homo sapiens
cugcuuccgguagggagg

SEQ ID NO: 1710583 - RNA, 22 nt, Homo sapiens
cugcuucuguguguggugagca

SEQ ID NO: 1710584 - RNA, 13 nt, Homo sapiens
cugcuuguguuaa

SEQ ID NO: 1710585 - RNA, 15 nt, Homo sapiens
cuggaaaaauuccag

SEQ ID NO: 1710586 - RNA, 16 nt, Homo sapiens
cuggaaaaauuccaga

SEQ ID NO: 1710587 - RNA, 16 nt, Homo sapiens
cuggaaaacccaaagu

SEQ ID NO: 1710588 - RNA, 12 nt, Homo sapiens
aucccagcacuu

SEQ ID NO: 1710589 - RNA, 17 nt, Homo sapiens
aucccaucuaagcugca

SEQ ID NO: 1710590 - RNA, 22 nt, Homo sapiens
auccccaaguggugaaugacac

SEQ ID NO: 1710591 - RNA, 17 nt, Homo sapiens
auccccugcuacccuag

SEQ ID NO: 1710592 - RNA, 16 nt, Homo sapiens
auccccuggacuggga

SEQ ID NO: 1710593 - RNA, 20 nt, Homo sapiens
auccguacauucaauguuua

SEQ ID NO: 1710594 - RNA, 16 nt, Homo sapiens
auccuaaauaauguua

SEQ ID NO: 1710595 - RNA, 20 nt, Homo sapiens
auccuaccccuuugcacuug

SEQ ID NO: 1710596 - RNA, 22 nt, Homo sapiens
auccuggguacugaaagccuua

SEQ ID NO: 1710597 - RNA, 16 nt, Homo sapiens
auccuuaacacauuca

SEQ ID NO: 1710598 - RNA, 20 nt, Homo sapiens
auccuuaacacauucaauag

SEQ ID NO: 1710599 - RNA, 19 nt, Homo sapiens
auccuucgugaacaucccc

SEQ ID NO: 1710600 - RNA, 21 nt, Homo sapiens
auccuuguuuugaaaaccuaa

SEQ ID NO: 1710601 - RNA, 22 nt, Homo sapiens
auccuuguuuugaaaaccuaaa

SEQ ID NO: 1710602 - RNA, 23 nt, Homo sapiens
aucgcucguguguucuauccaaa

SEQ ID NO: 1710603 - RNA, 14 nt, Homo sapiens
aucuaaggauguca

SEQ ID NO: 1710604 - RNA, 18 nt, Homo sapiens
aucuaaggaugucacagg

SEQ ID NO: 1710605 - RNA, 16 nt, Homo sapiens
aucuaauauauaugaa

SEQ ID NO: 1710606 - RNA, 13 nt, Homo sapiens
aucuacccugcug

SEQ ID NO: 1710607 - RNA, 12 nt, Homo sapiens
aucuaguuuaca

SEQ ID NO: 1710608 - RNA, 17 nt, Homo sapiens
aucuaguuuacagaaaa

SEQ ID NO: 1710609 - RNA, 19 nt, Homo sapiens
aucuauaaagaagaacuug

SEQ ID NO: 1710610 - RNA, 18 nt, Homo sapiens
aucuauagcuaaguacac

SEQ ID NO: 1710611 - RNA, 14 nt, Homo sapiens
aucuauaguagaca

SEQ ID NO: 1710612 - RNA, 15 nt, Homo sapiens
aucuaucaacuauaa

SEQ ID NO: 1710613 - RNA, 21 nt, Homo sapiens
aucuauuuugaugcagcauuu

SEQ ID NO: 1710614 - RNA, 21 nt, Homo sapiens
aucucagagguagggcugcca

SEQ ID NO: 1710615 - RNA, 19 nt, Homo sapiens
aucucauaccucugaccaa

SEQ ID NO: 1710616 - RNA, 14 nt, Homo sapiens
aucucccacuccag

SEQ ID NO: 1710617 - RNA, 21 nt, Homo sapiens
aucuccugacagaaggugcca

SEQ ID NO: 1710618 - RNA, 20 nt, Homo sapiens
aucucggcucacugcaagcu

SEQ ID NO: 1710619 - RNA, 16 nt, Homo sapiens
aucucuaauauggcaa

SEQ ID NO: 1710620 - RNA, 22 nt, Homo sapiens
aucucucccuccccugccauuu

SEQ ID NO: 1710621 - RNA, 15 nt, Homo sapiens
aucucugaaagcaca

SEQ ID NO: 1710622 - RNA, 20 nt, Homo sapiens
aucucugaagcauguuucau

SEQ ID NO: 1710623 - RNA, 16 nt, Homo sapiens
aucucugguuuugcuu

SEQ ID NO: 1710624 - RNA, 22 nt, Homo sapiens
aucucuuaaauuggguucauga

SEQ ID NO: 1710625 - RNA, 13 nt, Homo sapiens
aucugacaagacu

SEQ ID NO: 1710626 - RNA, 21 nt, Homo sapiens
aucugacagacaaugauccag

SEQ ID NO: 1710627 - RNA, 19 nt, Homo sapiens
aucugaguugccaagacaa

SEQ ID NO: 1710628 - RNA, 14 nt, Homo sapiens
aucugcagcuaacu

SEQ ID NO: 1710629 - RNA, 22 nt, Homo sapiens
aucuggaaaccucuacauauuu

SEQ ID NO: 1710630 - RNA, 20 nt, Homo sapiens
aucuggaagaagaugggcug

SEQ ID NO: 1710631 - RNA, 22 nt, Homo sapiens
aucuggaaguaaccauuugcac

SEQ ID NO: 1710632 - RNA, 18 nt, Homo sapiens
aucuggaccugguacaaa

SEQ ID NO: 1710633 - RNA, 17 nt, Homo sapiens
aucugugccccaugccu

SEQ ID NO: 1710634 - RNA, 20 nt, Homo sapiens
aucuguuuugaaggcaaaau

SEQ ID NO: 1710635 - RNA, 13 nt, Homo sapiens
aucuuacuugagc

SEQ ID NO: 1710636 - RNA, 15 nt, Homo sapiens
aucuuauaguucuag

SEQ ID NO: 1710637 - RNA, 19 nt, Homo sapiens
aucuuccccaagagggacu

SEQ ID NO: 1710638 - RNA, 20 nt, Homo sapiens
aucuucuaaacccaauccaa

SEQ ID NO: 1710639 - RNA, 22 nt, Homo sapiens
aucuucuaaacccaauccaaau

SEQ ID NO: 1710640 - RNA, 18 nt, Homo sapiens
aucuuggagggaccaagg

SEQ ID NO: 1710641 - RNA, 13 nt, Homo sapiens
aucuugugugauu

SEQ ID NO: 1710642 - RNA, 20 nt, Homo sapiens
aucuuuacaaaacuacauga

SEQ ID NO: 1710643 - RNA, 22 nt, Homo sapiens
aucuuuacucccaagacuucau

SEQ ID NO: 1710644 - RNA, 21 nt, Homo sapiens
aucuuuagugcuuucuuguca

SEQ ID NO: 1710645 - RNA, 19 nt, Homo sapiens
aucuuucauccuugacuaa

SEQ ID NO: 1710646 - RNA, 15 nt, Homo sapiens
aucuuuucauucuca

SEQ ID NO: 1710647 - RNA, 16 nt, Homo sapiens
augaaaaacaaccaag

SEQ ID NO: 1710648 - RNA, 23 nt, Homo sapiens
augaaaagucguuuuccaaacug

SEQ ID NO: 1710649 - RNA, 14 nt, Homo sapiens
augaaaaugaauau

SEQ ID NO: 1710650 - RNA, 16 nt, Homo sapiens
augaaaucagcaagag

SEQ ID NO: 1710651 - RNA, 18 nt, Homo sapiens
augaagagcaacugggac

SEQ ID NO: 1710652 - RNA, 16 nt, Homo sapiens
augaauaaaguguaag

SEQ ID NO: 1710653 - RNA, 12 nt, Homo sapiens
augaaugaaacu

SEQ ID NO: 1710654 - RNA, 17 nt, Homo sapiens
augaaugacauugaacu

SEQ ID NO: 1710655 - RNA, 21 nt, Homo sapiens
augacaaggagcacaagaagu

SEQ ID NO: 1710656 - RNA, 12 nt, Homo sapiens
augacaaugaag

SEQ ID NO: 1710657 - RNA, 18 nt, Homo sapiens
augacaccaaauaugucc

SEQ ID NO: 1710658 - RNA, 11 nt, Homo sapiens
augacacugac

SEQ ID NO: 1710659 - RNA, 13 nt, Homo sapiens
augacacugaccu

SEQ ID NO: 1710660 - RNA, 13 nt, Homo sapiens
augacaucacuug

SEQ ID NO: 1710661 - RNA, 20 nt, Homo sapiens
augacaucacuuguacaaaa

SEQ ID NO: 1710662 - RNA, 14 nt, Homo sapiens
augacaucucaggg

SEQ ID NO: 1710663 - RNA, 18 nt, Homo sapiens
augacaucucaggggcca

SEQ ID NO: 1710664 - RNA, 12 nt, Homo sapiens
augacauguuau

SEQ ID NO: 1710665 - RNA, 14 nt, Homo sapiens
augacccacugucc

SEQ ID NO: 1710666 - RNA, 23 nt, Homo sapiens
augacccccaaccaaguggcucc

SEQ ID NO: 1710667 - RNA, 13 nt, Homo sapiens
augacucacauga

SEQ ID NO: 1710668 - RNA, 13 nt, Homo sapiens
augacuuguagca

SEQ ID NO: 1710669 - RNA, 21 nt, Homo sapiens
augagaaggcagccaccagcg

SEQ ID NO: 1710670 - RNA, 19 nt, Homo sapiens
augagccgugaacugugca

SEQ ID NO: 1710671 - RNA, 21 nt, Homo sapiens
augagccucagcauccuggca

SEQ ID NO: 1710672 - RNA, 22 nt, Homo sapiens
augagcugaucugcggaucuca

SEQ ID NO: 1710673 - RNA, 22 nt, Homo sapiens
augaggaaggaacagcaauggu

SEQ ID NO: 1710674 - RNA, 15 nt, Homo sapiens
augaggcaaugucag

SEQ ID NO: 1710675 - RNA, 16 nt, Homo sapiens
augagggaaaaugagu

SEQ ID NO: 1710676 - RNA, 14 nt, Homo sapiens
augaguuacuugaa

SEQ ID NO: 1710677 - RNA, 14 nt, Homo sapiens
augaucacggcuca

SEQ ID NO: 1710678 - RNA, 20 nt, Homo sapiens
augaucacggcucacugcag

SEQ ID NO: 1710679 - RNA, 17 nt, Homo sapiens
augaucuggauccacca

SEQ ID NO: 1710680 - RNA, 12 nt, Homo sapiens
augaugaucugg

SEQ ID NO: 1710681 - RNA, 19 nt, Homo sapiens
augauggcaccacugcacu

SEQ ID NO: 1710682 - RNA, 14 nt, Homo sapiens
augauguaaucucu

SEQ ID NO: 1710683 - RNA, 16 nt, Homo sapiens
augcaaaguagcaauu

SEQ ID NO: 1710684 - RNA, 18 nt, Homo sapiens
augcaaaguagcaauuuc

SEQ ID NO: 1710685 - RNA, 22 nt, Homo sapiens
augcaaggaaggaaagaaagaa

SEQ ID NO: 1710686 - RNA, 20 nt, Homo sapiens
augcacacacacacaucuca

SEQ ID NO: 1710687 - RNA, 20 nt, Homo sapiens
augcacauauggacucugca

SEQ ID NO: 1710688 - RNA, 16 nt, Homo sapiens
augcacuuauucaaua

SEQ ID NO: 1710689 - RNA, 15 nt, Homo sapiens
augcagcccaugccc

SEQ ID NO: 1710690 - RNA, 21 nt, Homo sapiens
augcauaaauaugcagugaua

SEQ ID NO: 1710691 - RNA, 15 nt, Homo sapiens
augcauuucauaaac

SEQ ID NO: 1710692 - RNA, 16 nt, Homo sapiens
augccaauacuaguca

SEQ ID NO: 1710693 - RNA, 15 nt, Homo sapiens
augccacccuagcca

SEQ ID NO: 1710694 - RNA, 16 nt, Homo sapiens
augccaggaaccuguc

SEQ ID NO: 1710695 - RNA, 13 nt, Homo sapiens
augccauaugccu

SEQ ID NO: 1710696 - RNA, 19 nt, Homo sapiens
augccucagccuacuuuca

SEQ ID NO: 1710697 - RNA, 14 nt, Homo sapiens
augccuugaugauu

SEQ ID NO: 1710698 - RNA, 16 nt, Homo sapiens
auuccucucaguccuu

SEQ ID NO: 1710699 - RNA, 20 nt, Homo sapiens
auuccugccaccacugggca

SEQ ID NO: 1710700 - RNA, 16 nt, Homo sapiens
auuccuucucugaaca

SEQ ID NO: 1710701 - RNA, 14 nt, Homo sapiens
auuccuucuggccu

SEQ ID NO: 1710702 - RNA, 18 nt, Homo sapiens
auucuaauggggacacag

SEQ ID NO: 1710703 - RNA, 15 nt, Homo sapiens
auucuagagccagcu

SEQ ID NO: 1710704 - RNA, 19 nt, Homo sapiens
auucuauuuauauguacau

SEQ ID NO: 1710705 - RNA, 19 nt, Homo sapiens
auucucauuugucacacac

SEQ ID NO: 1710706 - RNA, 15 nt, Homo sapiens
auucuccugccucag

SEQ ID NO: 1710707 - RNA, 18 nt, Homo sapiens
auucugaagcaacauuuu

SEQ ID NO: 1710708 - RNA, 15 nt, Homo sapiens
auucugcauugcuag

SEQ ID NO: 1710709 - RNA, 18 nt, Homo sapiens
auucugccacuccugaca

SEQ ID NO: 1710710 - RNA, 21 nt, Homo sapiens
auucugccgcccccuccugaa

SEQ ID NO: 1710711 - RNA, 22 nt, Homo sapiens
auucuggaaaagcaaaacugua

SEQ ID NO: 1710712 - RNA, 20 nt, Homo sapiens
auucuuacacugccuguaua

SEQ ID NO: 1710713 - RNA, 18 nt, Homo sapiens
auucuuacccuguacaua

SEQ ID NO: 1710714 - RNA, 20 nt, Homo sapiens
auucuucagauacaaacugc

SEQ ID NO: 1710715 - RNA, 20 nt, Homo sapiens
auucuuguaguuuaccucuu

SEQ ID NO: 1710716 - RNA, 16 nt, Homo sapiens
auucuuucagcuauca

SEQ ID NO: 1710717 - RNA, 16 nt, Homo sapiens
auucuuucccagugag

SEQ ID NO: 1710718 - RNA, 20 nt, Homo sapiens
auucuuuuuuaauaaacuac

SEQ ID NO: 1710719 - RNA, 14 nt, Homo sapiens
auugaaagaaccag

SEQ ID NO: 1710720 - RNA, 13 nt, Homo sapiens
auugaaaugucac

SEQ ID NO: 1710721 - RNA, 13 nt, Homo sapiens
auugaaugugauu

SEQ ID NO: 1710722 - RNA, 14 nt, Homo sapiens
auugacaacacagc

SEQ ID NO: 1710723 - RNA, 21 nt, Homo sapiens
auugagcagaagaucaaggag

SEQ ID NO: 1710724 - RNA, 20 nt, Homo sapiens
auugaguucgaggacuacaa

SEQ ID NO: 1710725 - RNA, 14 nt, Homo sapiens
auugaugacccucu

SEQ ID NO: 1710726 - RNA, 16 nt, Homo sapiens
auugcaagaguuuaau

SEQ ID NO: 1710727 - RNA, 20 nt, Homo sapiens
auugccaccaggagaaccac

SEQ ID NO: 1710728 - RNA, 22 nt, Homo sapiens
auugcuaugaaugauacccuga

SEQ ID NO: 1710729 - RNA, 19 nt, Homo sapiens
auugcuauuuauuuuuaca

SEQ ID NO: 1710730 - RNA, 13 nt, Homo sapiens
auugcuuugguca

SEQ ID NO: 1710731 - RNA, 16 nt, Homo sapiens
auugggaguccaggca

SEQ ID NO: 1710732 - RNA, 15 nt, Homo sapiens
auugggggacguggg

SEQ ID NO: 1710733 - RNA, 18 nt, Homo sapiens
auugggggggccaaaagg

SEQ ID NO: 1710734 - RNA, 20 nt, Homo sapiens
auuguacauauuuguggaau

SEQ ID NO: 1710735 - RNA, 21 nt, Homo sapiens
auuguacauauuuguggaaua

SEQ ID NO: 1710736 - RNA, 16 nt, Homo sapiens
auuguaggugcaagau

SEQ ID NO: 1710737 - RNA, 14 nt, Homo sapiens
auuguauuuaguua

SEQ ID NO: 1710738 - RNA, 15 nt, Homo sapiens
auuguccagugcaac

SEQ ID NO: 1710739 - RNA, 23 nt, Homo sapiens
auuguccagugcaaccacacacc

SEQ ID NO: 1710740 - RNA, 17 nt, Homo sapiens
auuguuaauucuuccua

SEQ ID NO: 1710741 - RNA, 13 nt, Homo sapiens
auuguuagcacua

SEQ ID NO: 1710742 - RNA, 18 nt, Homo sapiens
auuguugacaacugugac

SEQ ID NO: 1710743 - RNA, 16 nt, Homo sapiens
auuuaaacucaagaca

SEQ ID NO: 1710744 - RNA, 19 nt, Homo sapiens
auuuaaagcuuacucuguc

SEQ ID NO: 1710745 - RNA, 22 nt, Homo sapiens
auuuaaauguuaugacuaugua

SEQ ID NO: 1710746 - RNA, 16 nt, Homo sapiens
auuuaauuauuuccua

SEQ ID NO: 1710747 - RNA, 20 nt, Homo sapiens
auuuacagaaacgcauccag

SEQ ID NO: 1710748 - RNA, 14 nt, Homo sapiens
auuuacaugugauu

SEQ ID NO: 1710749 - RNA, 19 nt, Homo sapiens
auuuacaugugauugugau

SEQ ID NO: 1710750 - RNA, 22 nt, Homo sapiens
auuuacuauauauauaugccuu

SEQ ID NO: 1710751 - RNA, 21 nt, Homo sapiens
auuuacugaaguuauuuauua

SEQ ID NO: 1710752 - RNA, 17 nt, Homo sapiens
auuuagacucaucuuac

SEQ ID NO: 1710753 - RNA, 17 nt, Homo sapiens
auuuagauauaacacua

SEQ ID NO: 1710754 - RNA, 21 nt, Homo sapiens
auuuagcuaaacggauuccaa

SEQ ID NO: 1710755 - RNA, 16 nt, Homo sapiens
auuuaugaugcacuua

SEQ ID NO: 1710756 - RNA, 14 nt, Homo sapiens
auuucaauuccugu

SEQ ID NO: 1710757 - RNA, 16 nt, Homo sapiens
auuucaccaccaaaug

SEQ ID NO: 1710758 - RNA, 23 nt, Homo sapiens
auuucacuugaugauacaaugaa

SEQ ID NO: 1710759 - RNA, 18 nt, Homo sapiens
auuucauuccauugccua

SEQ ID NO: 1710760 - RNA, 22 nt, Homo sapiens
auuuccaguguucuaugaacaa

SEQ ID NO: 1710761 - RNA, 15 nt, Homo sapiens
auuuccaucauguca

SEQ ID NO: 1710762 - RNA, 17 nt, Homo sapiens
auuucccaucuggaccu

SEQ ID NO: 1710763 - RNA, 19 nt, Homo sapiens
auuucccauuugugccaga

SEQ ID NO: 1710764 - RNA, 20 nt, Homo sapiens
auuucuagccugcacuuuga

SEQ ID NO: 1710765 - RNA, 17 nt, Homo sapiens
auuucuccguugaguca

SEQ ID NO: 1710766 - RNA, 14 nt, Homo sapiens
auuucugcuuucuu

SEQ ID NO: 1710767 - RNA, 19 nt, Homo sapiens
auuucugguucugaugcca

SEQ ID NO: 1710768 - RNA, 23 nt, Homo sapiens
auuucuguggauggcaucaaaca

SEQ ID NO: 1710769 - RNA, 18 nt, Homo sapiens
auuucuguucacuuugua

SEQ ID NO: 1710770 - RNA, 22 nt, Homo sapiens
auuugaauagccuguuccuuua

SEQ ID NO: 1710771 - RNA, 13 nt, Homo sapiens
auuugacuauucu

SEQ ID NO: 1710772 - RNA, 19 nt, Homo sapiens
auuugcacacugcacuguu

SEQ ID NO: 1710773 - RNA, 14 nt, Homo sapiens
auuugcaguauuca

SEQ ID NO: 1710774 - RNA, 13 nt, Homo sapiens
auuugcauauuca

SEQ ID NO: 1710775 - RNA, 16 nt, Homo sapiens
auuugcauuaaauuca

SEQ ID NO: 1710776 - RNA, 22 nt, Homo sapiens
auuugcuaaucaaagccagggu

SEQ ID NO: 1710777 - RNA, 19 nt, Homo sapiens
auuuggacuggugugcucu

SEQ ID NO: 1710778 - RNA, 22 nt, Homo sapiens
auuuggacuggugugcucucuu

SEQ ID NO: 1710779 - RNA, 15 nt, Homo sapiens
auuuggauugcuaau

SEQ ID NO: 1710780 - RNA, 18 nt, Homo sapiens
auuugguaccauggugua

SEQ ID NO: 1710781 - RNA, 19 nt, Homo sapiens
auuugugugaaaaugugac

SEQ ID NO: 1710782 - RNA, 19 nt, Homo sapiens
auuuguuaaaauuaucaau

SEQ ID NO: 1710783 - RNA, 14 nt, Homo sapiens
auuuuacuuaacuc

SEQ ID NO: 1710784 - RNA, 17 nt, Homo sapiens
auuuuauaccagcuuau

SEQ ID NO: 1710785 - RNA, 14 nt, Homo sapiens
auuuuauacugaca

SEQ ID NO: 1710786 - RNA, 17 nt, Homo sapiens
auuuucaauuaauauua

SEQ ID NO: 1710787 - RNA, 17 nt, Homo sapiens
auuuucugaaaguuacc

SEQ ID NO: 1710788 - RNA, 23 nt, Homo sapiens
auuuucugucagaugagaacaaa

SEQ ID NO: 1710789 - RNA, 12 nt, Homo sapiens
auuuugacuuaa

SEQ ID NO: 1710790 - RNA, 15 nt, Homo sapiens
auuuuggggucucuu

SEQ ID NO: 1710791 - RNA, 12 nt, Homo sapiens
auuuuuacuuca

SEQ ID NO: 1710792 - RNA, 17 nt, Homo sapiens
auuuuuagacucaucaa

SEQ ID NO: 1710793 - RNA, 14 nt, Homo sapiens
auuuuuccacuuaa

SEQ ID NO: 1710794 - RNA, 15 nt, Homo sapiens
auuuuuccaguaacu

SEQ ID NO: 1710795 - RNA, 19 nt, Homo sapiens
auuuuuccaguaacuuuuc

SEQ ID NO: 1710796 - RNA, 15 nt, Homo sapiens
auuuuugaaaacugg

SEQ ID NO: 1710797 - RNA, 12 nt, Homo sapiens
auuuuugcaaug

SEQ ID NO: 1710798 - RNA, 17 nt, Homo sapiens
auuuuuuaaggaaacaa

SEQ ID NO: 1710799 - RNA, 15 nt, Homo sapiens
auuuuuuaauaaaga

SEQ ID NO: 1710800 - RNA, 21 nt, Homo sapiens
auuuuuuagugcauccaguua

SEQ ID NO: 1710801 - RNA, 18 nt, Homo sapiens
auuuuuugggcagcaauu

SEQ ID NO: 1710802 - RNA, 18 nt, Homo sapiens
auuuuuuugagacagagu

SEQ ID NO: 1710803 - RNA, 20 nt, Homo sapiens
caaaaaaaaccuucagugaa

SEQ ID NO: 1710804 - RNA, 14 nt, Homo sapiens
caaaaaaaccacaa

SEQ ID NO: 1710805 - RNA, 20 nt, Homo sapiens
caaaaaucuguguaacugua

SEQ ID NO: 1710806 - RNA, 15 nt, Homo sapiens
caaaacacuguggaa

SEQ ID NO: 1710807 - RNA, 23 nt, Homo sapiens
caaaaccuugcuaauuuucucaa

SEQ ID NO: 1710808 - RNA, 15 nt, Homo sapiens
caaggcuuuaucuca

SEQ ID NO: 1710809 - RNA, 21 nt, Homo sapiens
caagggaacuugagcgugaau

SEQ ID NO: 1710810 - RNA, 13 nt, Homo sapiens
caagggcaccugg

SEQ ID NO: 1710811 - RNA, 23 nt, Homo sapiens
caaggguucuuggugaugcuggc

SEQ ID NO: 1710812 - RNA, 18 nt, Homo sapiens
caagguggugugaucuua

SEQ ID NO: 1710813 - RNA, 22 nt, Homo sapiens
caagguggugugaucuuaauau

SEQ ID NO: 1710814 - RNA, 17 nt, Homo sapiens
caagguuuuagguucua

SEQ ID NO: 1710815 - RNA, 21 nt, Homo sapiens
caaguacaccagccaccucca

SEQ ID NO: 1710816 - RNA, 21 nt, Homo sapiens
caaguauguuuguacaguaug

SEQ ID NO: 1710817 - RNA, 17 nt, Homo sapiens
caagucaacaugcauau

SEQ ID NO: 1710818 - RNA, 23 nt, Homo sapiens
caagucccauugaaaaugaaugc

SEQ ID NO: 1710819 - RNA, 21 nt, Homo sapiens
caaguccugugaauuucuuca

SEQ ID NO: 1710820 - RNA, 16 nt, Homo sapiens
caagucuuccaugacc

SEQ ID NO: 1710821 - RNA, 21 nt, Homo sapiens
caagugaucugcccaccucag

SEQ ID NO: 1710822 - RNA, 16 nt, Homo sapiens
caagugggaucuguca

SEQ ID NO: 1710823 - RNA, 21 nt, Homo sapiens
caaguuaagagaaacuuuaua

SEQ ID NO: 1710824 - RNA, 15 nt, Homo sapiens
caaguucuaagauuc

SEQ ID NO: 1710825 - RNA, 22 nt, Homo sapiens
caaguuggaaauauucaugcuu

SEQ ID NO: 1710826 - RNA, 17 nt, Homo sapiens
caaguuuuguggggcuu

SEQ ID NO: 1710827 - RNA, 16 nt, Homo sapiens
caaguuuuucugucaa

SEQ ID NO: 1710828 - RNA, 16 nt, Homo sapiens
caauaaaucuuuggaa

SEQ ID NO: 1710829 - RNA, 13 nt, Homo sapiens
caauaacaaacug

SEQ ID NO: 1710830 - RNA, 16 nt, Homo sapiens
caauaacacugucucc

SEQ ID NO: 1710831 - RNA, 15 nt, Homo sapiens
caauaacuucugacc

SEQ ID NO: 1710832 - RNA, 21 nt, Homo sapiens
caauaauaaauauuuuugcca

SEQ ID NO: 1710833 - RNA, 21 nt, Homo sapiens
caauacuagucaccccaagua

SEQ ID NO: 1710834 - RNA, 19 nt, Homo sapiens
caauagcauaucacagaga

SEQ ID NO: 1710835 - RNA, 15 nt, Homo sapiens
caauaucauaucauc

SEQ ID NO: 1710836 - RNA, 13 nt, Homo sapiens
caauauugccaug

SEQ ID NO: 1710837 - RNA, 19 nt, Homo sapiens
caauauugccaugguuuua

SEQ ID NO: 1710838 - RNA, 18 nt, Homo sapiens
caaucaagccauguauaa

SEQ ID NO: 1710839 - RNA, 12 nt, Homo sapiens
caaucacacuca

SEQ ID NO: 1710840 - RNA, 13 nt, Homo sapiens
caaucagcacuga

SEQ ID NO: 1710841 - RNA, 15 nt, Homo sapiens
caaucagcacugaaa

SEQ ID NO: 1710842 - RNA, 17 nt, Homo sapiens
caaucagccacauucua

SEQ ID NO: 1710843 - RNA, 22 nt, Homo sapiens
caaucaugaaauaugcaucuca

SEQ ID NO: 1710844 - RNA, 14 nt, Homo sapiens
caauccaacaucca

SEQ ID NO: 1710845 - RNA, 18 nt, Homo sapiens
caaucuauguuugcacuu

SEQ ID NO: 1710846 - RNA, 15 nt, Homo sapiens
caaugaaccacaaaa

SEQ ID NO: 1710847 - RNA, 22 nt, Homo sapiens
caaugacaucucaggggccaga

SEQ ID NO: 1710848 - RNA, 19 nt, Homo sapiens
caaugacuuaaccauauaa

SEQ ID NO: 1710849 - RNA, 16 nt, Homo sapiens
caauggagacugucuc

SEQ ID NO: 1710850 - RNA, 16 nt, Homo sapiens
caaugggcucuuccaa

SEQ ID NO: 1710851 - RNA, 22 nt, Homo sapiens
caaugugaaaaaugugucugua

SEQ ID NO: 1710852 - RNA, 19 nt, Homo sapiens
caauuacuggcucacuggc

SEQ ID NO: 1710853 - RNA, 14 nt, Homo sapiens
caauuccgcauuua

SEQ ID NO: 1710854 - RNA, 16 nt, Homo sapiens
caauuggcacuaaaga

SEQ ID NO: 1710855 - RNA, 17 nt, Homo sapiens
caauugucgaaaagagu

SEQ ID NO: 1710856 - RNA, 13 nt, Homo sapiens
caauugugcugcc

SEQ ID NO: 1710857 - RNA, 20 nt, Homo sapiens
caauugugcugccauuugau

SEQ ID NO: 1710858 - RNA, 19 nt, Homo sapiens
caauuuaacuagacacaga

SEQ ID NO: 1710859 - RNA, 19 nt, Homo sapiens
caauuucacuuagucugua

SEQ ID NO: 1710860 - RNA, 23 nt, Homo sapiens
caauuucuugcucuaucucucaa

SEQ ID NO: 1710861 - RNA, 13 nt, Homo sapiens
caauuugccuuuu

SEQ ID NO: 1710862 - RNA, 19 nt, Homo sapiens
caauuuguuaguuccugua

SEQ ID NO: 1710863 - RNA, 18 nt, Homo sapiens
caauuuuugucucagaag

SEQ ID NO: 1710864 - RNA, 19 nt, Homo sapiens
cacaaaaagugucucugcc

SEQ ID NO: 1710865 - RNA, 19 nt, Homo sapiens
cacaaaugaagggauauaa

SEQ ID NO: 1710866 - RNA, 19 nt, Homo sapiens
cacaacugacacaggaaac

SEQ ID NO: 1710867 - RNA, 20 nt, Homo sapiens
cacaagcagagugcacagcu

SEQ ID NO: 1710868 - RNA, 16 nt, Homo sapiens
cacaagcccacagcac

SEQ ID NO: 1710869 - RNA, 14 nt, Homo sapiens
cacaaguccuguga

SEQ ID NO: 1710870 - RNA, 15 nt, Homo sapiens
cacaaguccugugaa

SEQ ID NO: 1710871 - RNA, 16 nt, Homo sapiens
cacaaguggaccuuag

SEQ ID NO: 1710872 - RNA, 14 nt, Homo sapiens
cacaaugcugaaua

SEQ ID NO: 1710873 - RNA, 12 nt, Homo sapiens
cacacacacaaa

SEQ ID NO: 1710874 - RNA, 13 nt, Homo sapiens
cacacacacaaac

SEQ ID NO: 1710875 - RNA, 14 nt, Homo sapiens
cacacacacaugca

SEQ ID NO: 1710876 - RNA, 15 nt, Homo sapiens
cacacacacaugcac

SEQ ID NO: 1710877 - RNA, 15 nt, Homo sapiens
cacacacaugcuagg

SEQ ID NO: 1710878 - RNA, 13 nt, Homo sapiens
cacacacccagcu

SEQ ID NO: 1710879 - RNA, 19 nt, Homo sapiens
cacaccacaaccaccuuca

SEQ ID NO: 1710880 - RNA, 17 nt, Homo sapiens
cacaccuuuuauugaca

SEQ ID NO: 1710881 - RNA, 16 nt, Homo sapiens
cacacgcgugcacaca

SEQ ID NO: 1710882 - RNA, 14 nt, Homo sapiens
cacacugcuagcaa

SEQ ID NO: 1710883 - RNA, 13 nt, Homo sapiens
cacagaaacacug

SEQ ID NO: 1710884 - RNA, 15 nt, Homo sapiens
cacagaaacacugcc

SEQ ID NO: 1710885 - RNA, 21 nt, Homo sapiens
cacagaacuauguacuuuaaa

SEQ ID NO: 1710886 - RNA, 14 nt, Homo sapiens
cacagaaggaauaa

SEQ ID NO: 1710887 - RNA, 16 nt, Homo sapiens
cacagacugcgauuug

SEQ ID NO: 1710888 - RNA, 17 nt, Homo sapiens
cacagcaacaaugacuu

SEQ ID NO: 1710889 - RNA, 14 nt, Homo sapiens
cacagcuacagcuu

SEQ ID NO: 1710890 - RNA, 16 nt, Homo sapiens
cacagcuacagcuuuc

SEQ ID NO: 1710891 - RNA, 17 nt, Homo sapiens
cacagcuacagcuuucu

SEQ ID NO: 1710892 - RNA, 16 nt, Homo sapiens
cacagcugaacuauuu

SEQ ID NO: 1710893 - RNA, 12 nt, Homo sapiens
cacagcugccau

SEQ ID NO: 1710894 - RNA, 21 nt, Homo sapiens
cacagcugccaucgaccugga

SEQ ID NO: 1710895 - RNA, 13 nt, Homo sapiens
cacaggaugcugg

SEQ ID NO: 1710896 - RNA, 13 nt, Homo sapiens
cacagggugguuu

SEQ ID NO: 1710897 - RNA, 16 nt, Homo sapiens
cacagguucaugccac

SEQ ID NO: 1710898 - RNA, 12 nt, Homo sapiens
cacaguggcacc

SEQ ID NO: 1710899 - RNA, 13 nt, Homo sapiens
cacagugggaacu

SEQ ID NO: 1710900 - RNA, 18 nt, Homo sapiens
cacaguuagguagcuuua

SEQ ID NO: 1710901 - RNA, 18 nt, Homo sapiens
cacaguuggcuggaugaa

SEQ ID NO: 1710902 - RNA, 21 nt, Homo sapiens
cacauagauuaauggcacuga

SEQ ID NO: 1710903 - RNA, 18 nt, Homo sapiens
cacauauggacucugcac

SEQ ID NO: 1710904 - RNA, 13 nt, Homo sapiens
cacauccauuccc

SEQ ID NO: 1710905 - RNA, 14 nt, Homo sapiens
cacaucuugcucug

SEQ ID NO: 1710906 - RNA, 11 nt, Homo sapiens
cacaugcacac

SEQ ID NO: 1710907 - RNA, 14 nt, Homo sapiens
cacaugcacgugug

SEQ ID NO: 1710908 - RNA, 14 nt, Homo sapiens
cacauggaacuuua

SEQ ID NO: 1710909 - RNA, 15 nt, Homo sapiens
cacauggccuaugca

SEQ ID NO: 1710910 - RNA, 16 nt, Homo sapiens
cacauggccuaugcac

SEQ ID NO: 1710911 - RNA, 20 nt, Homo sapiens
cacaugucuuguacaugugu

SEQ ID NO: 1710912 - RNA, 17 nt, Homo sapiens
cacaugugacacauaug

SEQ ID NO: 1710913 - RNA, 19 nt, Homo sapiens
cacaugugacacauaugca

SEQ ID NO: 1710914 - RNA, 19 nt, Homo sapiens
cacauucaauagcauauca

SEQ ID NO: 1710915 - RNA, 17 nt, Homo sapiens
cacauucccaucuguca

SEQ ID NO: 1710916 - RNA, 23 nt, Homo sapiens
cacauuggauucaucagcauuug

SEQ ID NO: 1710917 - RNA, 14 nt, Homo sapiens
caccaaagcugccc

SEQ ID NO: 1710918 - RNA, 22 nt, Homo sapiens
caccaacauugcuugugccaca

SEQ ID NO: 1710919 - RNA, 17 nt, Homo sapiens
cagacaaaguaauuccu

SEQ ID NO: 1710920 - RNA, 15 nt, Homo sapiens
cagacaaaugugguu

SEQ ID NO: 1710921 - RNA, 16 nt, Homo sapiens
cagacaacagaaguca

SEQ ID NO: 1710922 - RNA, 19 nt, Homo sapiens
cagacacacacacacacaa

SEQ ID NO: 1710923 - RNA, 22 nt, Homo sapiens
cagacaggaggaaucaugucag

SEQ ID NO: 1710924 - RNA, 15 nt, Homo sapiens
cagacauaaagccau

SEQ ID NO: 1710925 - RNA, 19 nt, Homo sapiens
cagacauacauuuaugcac

SEQ ID NO: 1710926 - RNA, 22 nt, Homo sapiens
cagacauacauuuaugcacauu

SEQ ID NO: 1710927 - RNA, 19 nt, Homo sapiens
cagacaucggccuccauga

SEQ ID NO: 1710928 - RNA, 22 nt, Homo sapiens
cagaccaguuucagagaaauac

SEQ ID NO: 1710929 - RNA, 19 nt, Homo sapiens
cagacccugccacucucac

SEQ ID NO: 1710930 - RNA, 20 nt, Homo sapiens
cagacucuacagaggccaug

SEQ ID NO: 1710931 - RNA, 21 nt, Homo sapiens
cagacucuacagaggccaugg

SEQ ID NO: 1710932 - RNA, 15 nt, Homo sapiens
cagacuggcuccaac

SEQ ID NO: 1710933 - RNA, 22 nt, Homo sapiens
cagacuuggcucagcucgggga

SEQ ID NO: 1710934 - RNA, 16 nt, Homo sapiens
cagagaaagaaguccu

SEQ ID NO: 1710935 - RNA, 22 nt, Homo sapiens
cagagaagcggauuuccaggga

SEQ ID NO: 1710936 - RNA, 20 nt, Homo sapiens
cagagaaucauacuuagcaa

SEQ ID NO: 1710937 - RNA, 15 nt, Homo sapiens
cagagaccguccuca

SEQ ID NO: 1710938 - RNA, 22 nt, Homo sapiens
cagagagaggggagaagccugg

SEQ ID NO: 1710939 - RNA, 21 nt, Homo sapiens
cagagagggcaccaucacaau

SEQ ID NO: 1710940 - RNA, 20 nt, Homo sapiens
cagagaguccugugcugaau

SEQ ID NO: 1710941 - RNA, 20 nt, Homo sapiens
cagagaucguguauugagau

SEQ ID NO: 1710942 - RNA, 21 nt, Homo sapiens
cagagaugucaucagagcucc

SEQ ID NO: 1710943 - RNA, 15 nt, Homo sapiens
cagagcaaccucuca

SEQ ID NO: 1710944 - RNA, 16 nt, Homo sapiens
cagagcaagacccauc

SEQ ID NO: 1710945 - RNA, 21 nt, Homo sapiens
cagagcaccuuugcacaggau

SEQ ID NO: 1710946 - RNA, 18 nt, Homo sapiens
cagagcaggaagcauuca

SEQ ID NO: 1710947 - RNA, 20 nt, Homo sapiens
cagagccucccaaggagaac

SEQ ID NO: 1710948 - RNA, 15 nt, Homo sapiens
cagagcuggaccagu

SEQ ID NO: 1710949 - RNA, 21 nt, Homo sapiens
cagagcuguggaggauugcua

SEQ ID NO: 1710950 - RNA, 20 nt, Homo sapiens
cagaggaauuuauaccucaa

SEQ ID NO: 1710951 - RNA, 21 nt, Homo sapiens
cagaggcagcucgugugccug

SEQ ID NO: 1710952 - RNA, 15 nt, Homo sapiens
cagaggccauggcag

SEQ ID NO: 1710953 - RNA, 17 nt, Homo sapiens
cagaggggcucagguca

SEQ ID NO: 1710954 - RNA, 14 nt, Homo sapiens
cagaggguugugau

SEQ ID NO: 1710955 - RNA, 15 nt, Homo sapiens
cagaguagaaacuca

SEQ ID NO: 1710956 - RNA, 15 nt, Homo sapiens
cagaguccuuuccaa

SEQ ID NO: 1710957 - RNA, 12 nt, Homo sapiens
cagagucucacu

SEQ ID NO: 1710958 - RNA, 18 nt, Homo sapiens
cagaguuugccuuccuuu

SEQ ID NO: 1710959 - RNA, 20 nt, Homo sapiens
cagauaagacauaucucuaa

SEQ ID NO: 1710960 - RNA, 13 nt, Homo sapiens
cagauacauuucc

SEQ ID NO: 1710961 - RNA, 15 nt, Homo sapiens
cagauaucugaaugg

SEQ ID NO: 1710962 - RNA, 11 nt, Homo sapiens
cagauccugca

SEQ ID NO: 1710963 - RNA, 16 nt, Homo sapiens
cagaucugugccccau

SEQ ID NO: 1710964 - RNA, 21 nt, Homo sapiens
cagaucuuucuccuugaauau

SEQ ID NO: 1710965 - RNA, 14 nt, Homo sapiens
cagaugagaacaaa

SEQ ID NO: 1710966 - RNA, 14 nt, Homo sapiens
cagaugcaccagcc

SEQ ID NO: 1710967 - RNA, 17 nt, Homo sapiens
cagaugcuccaagauuc

SEQ ID NO: 1710968 - RNA, 21 nt, Homo sapiens
cagaugcuguuaguaccuaca

SEQ ID NO: 1710969 - RNA, 21 nt, Homo sapiens
cagauggacagacagccaccc

SEQ ID NO: 1710970 - RNA, 14 nt, Homo sapiens
cagauggcacuuug

SEQ ID NO: 1710971 - RNA, 16 nt, Homo sapiens
cagauggcacuuugaa

SEQ ID NO: 1710972 - RNA, 16 nt, Homo sapiens
cagaugugaaaacauc

SEQ ID NO: 1710973 - RNA, 21 nt, Homo sapiens
cagaugugaaaacaucucaau

SEQ ID NO: 1710974 - RNA, 19 nt, Homo sapiens
cagauugcaacaggcuggg

SEQ ID NO: 1710975 - RNA, 20 nt, Homo sapiens
cagcaaagaggacucgcuug

SEQ ID NO: 1710976 - RNA, 13 nt, Homo sapiens
cagcaacaaugac

SEQ ID NO: 1710977 - RNA, 18 nt, Homo sapiens
cagcaaccucuucaugag

SEQ ID NO: 1710978 - RNA, 20 nt, Homo sapiens
cagcaagcccuacagagcug

SEQ ID NO: 1710979 - RNA, 18 nt, Homo sapiens
cagcaagugagagcuggg

SEQ ID NO: 1710980 - RNA, 17 nt, Homo sapiens
cagcaaugacaucucag

SEQ ID NO: 1710981 - RNA, 18 nt, Homo sapiens
cagcaaugacaucucagg

SEQ ID NO: 1710982 - RNA, 16 nt, Homo sapiens
cagcacggacaauaaa

SEQ ID NO: 1710983 - RNA, 21 nt, Homo sapiens
cagcacggacaauaaaccucc

SEQ ID NO: 1710984 - RNA, 22 nt, Homo sapiens
cagcagccuccaacacaaggcu

SEQ ID NO: 1710985 - RNA, 15 nt, Homo sapiens
cagcaucaccugccu

SEQ ID NO: 1710986 - RNA, 15 nt, Homo sapiens
cagcaucacucccca

SEQ ID NO: 1710987 - RNA, 19 nt, Homo sapiens
cagcaucacuccccaagga

SEQ ID NO: 1710988 - RNA, 23 nt, Homo sapiens
cagcaugaggacagaccacagag

SEQ ID NO: 1710989 - RNA, 15 nt, Homo sapiens
cagcaugauguguug

SEQ ID NO: 1710990 - RNA, 21 nt, Homo sapiens
cagccaaccucauugcagcua

SEQ ID NO: 1710991 - RNA, 13 nt, Homo sapiens
cagccacauucua

SEQ ID NO: 1710992 - RNA, 18 nt, Homo sapiens
cagccacgggggacugac

SEQ ID NO: 1710993 - RNA, 13 nt, Homo sapiens
cagccagauccuc

SEQ ID NO: 1710994 - RNA, 17 nt, Homo sapiens
cagccaucacaugaucu

SEQ ID NO: 1710995 - RNA, 19 nt, Homo sapiens
cagcccaacgggaagcaac

SEQ ID NO: 1710996 - RNA, 21 nt, Homo sapiens
cagcccagccccuccaaaggu

SEQ ID NO: 1710997 - RNA, 13 nt, Homo sapiens
cagcccagggugg

SEQ ID NO: 1710998 - RNA, 20 nt, Homo sapiens
cagcccauggcccugugcua

SEQ ID NO: 1710999 - RNA, 19 nt, Homo sapiens
cagccccagagcagggugu

SEQ ID NO: 1711000 - RNA, 14 nt, Homo sapiens
cagccccuagccca

SEQ ID NO: 1711001 - RNA, 21 nt, Homo sapiens
cagccccucacauuccuaggg

SEQ ID NO: 1711002 - RNA, 21 nt, Homo sapiens
cagcccuagagccugccugga

SEQ ID NO: 1711003 - RNA, 16 nt, Homo sapiens
cagcccugccauguca

SEQ ID NO: 1711004 - RNA, 13 nt, Homo sapiens
cagcccugcugca

SEQ ID NO: 1711005 - RNA, 16 nt, Homo sapiens
cagccuaugagcaucc

SEQ ID NO: 1711006 - RNA, 19 nt, Homo sapiens
cagccucccgaguagcugg

SEQ ID NO: 1711007 - RNA, 12 nt, Homo sapiens
cagccugaaccc

SEQ ID NO: 1711008 - RNA, 21 nt, Homo sapiens
cagccugaccaacauggugaa

SEQ ID NO: 1711009 - RNA, 18 nt, Homo sapiens
cagccugggcaacagagc

SEQ ID NO: 1711010 - RNA, 17 nt, Homo sapiens
cagcgaaugaaugcugu

SEQ ID NO: 1711011 - RNA, 19 nt, Homo sapiens
cagcuaagggaagacauuu

SEQ ID NO: 1711012 - RNA, 22 nt, Homo sapiens
cagcuacgaauauagaggguuu

SEQ ID NO: 1711013 - RNA, 14 nt, Homo sapiens
cagcuacucaggag

SEQ ID NO: 1711014 - RNA, 16 nt, Homo sapiens
cagcucagaacccagg

SEQ ID NO: 1711015 - RNA, 16 nt, Homo sapiens
cagcuccgacugccgc

SEQ ID NO: 1711016 - RNA, 14 nt, Homo sapiens
cagcuccuguaaca

SEQ ID NO: 1711017 - RNA, 21 nt, Homo sapiens
cagcuccuguaacauacuggc

SEQ ID NO: 1711018 - RNA, 15 nt, Homo sapiens
cagcuccuucugucc

SEQ ID NO: 1711019 - RNA, 22 nt, Homo sapiens
cagcugaaagauugauuaauga

SEQ ID NO: 1711020 - RNA, 15 nt, Homo sapiens
cagcugaguuaugau

SEQ ID NO: 1711021 - RNA, 21 nt, Homo sapiens
cagcugcugggucaggccacc

SEQ ID NO: 1711022 - RNA, 13 nt, Homo sapiens
cagcuguacugag

SEQ ID NO: 1711023 - RNA, 19 nt, Homo sapiens
cagcuguacugaggaugau

SEQ ID NO: 1711024 - RNA, 14 nt, Homo sapiens
cagcuuaugagcuc

SEQ ID NO: 1711025 - RNA, 21 nt, Homo sapiens
caggaaaagguagcuuaccug

SEQ ID NO: 1711026 - RNA, 14 nt, Homo sapiens
caggaaaccaacac

SEQ ID NO: 1711027 - RNA, 20 nt, Homo sapiens
caggaaagcuggugucugau

SEQ ID NO: 1711028 - RNA, 20 nt, Homo sapiens
gccacuccagaccccuggcu

SEQ ID NO: 1711029 - RNA, 15 nt, Homo sapiens
gccacuucggccagg

SEQ ID NO: 1711030 - RNA, 16 nt, Homo sapiens
gccacuuuacccaccu

SEQ ID NO: 1711031 - RNA, 19 nt, Homo sapiens
gccagaccuuaagcucuau

SEQ ID NO: 1711032 - RNA, 17 nt, Homo sapiens
gccagagaugcuggacu

SEQ ID NO: 1711033 - RNA, 21 nt, Homo sapiens
gccagagccaagaaacacuuu

SEQ ID NO: 1711034 - RNA, 19 nt, Homo sapiens
gccagaguggccuggccag

SEQ ID NO: 1711035 - RNA, 21 nt, Homo sapiens
gccagcaaugacaucucaggg

SEQ ID NO: 1711036 - RNA, 14 nt, Homo sapiens
gccagcaccacuuc

SEQ ID NO: 1711037 - RNA, 14 nt, Homo sapiens
gccagccccacaca

SEQ ID NO: 1711038 - RNA, 21 nt, Homo sapiens
gccaggacaugcagcccagaa

SEQ ID NO: 1711039 - RNA, 20 nt, Homo sapiens
gccaggauccucuccuuuga

SEQ ID NO: 1711040 - RNA, 16 nt, Homo sapiens
gccaggcaaaggaaau

SEQ ID NO: 1711041 - RNA, 20 nt, Homo sapiens
gccaggcaggugccuggaca

SEQ ID NO: 1711042 - RNA, 19 nt, Homo sapiens
gccagggaauccugaccug

SEQ ID NO: 1711043 - RNA, 18 nt, Homo sapiens
gccagggcaaugaugaau

SEQ ID NO: 1711044 - RNA, 18 nt, Homo sapiens
gccagggcagugcuagug

SEQ ID NO: 1711045 - RNA, 16 nt, Homo sapiens
gccagggcugcccuga

SEQ ID NO: 1711046 - RNA, 19 nt, Homo sapiens
gccagggucugugugaaug

SEQ ID NO: 1711047 - RNA, 18 nt, Homo sapiens
gccagugccucucacccc

SEQ ID NO: 1711048 - RNA, 14 nt, Homo sapiens
gccaucaacuacua

SEQ ID NO: 1711049 - RNA, 18 nt, Homo sapiens
gccauccuaaaagccacc

SEQ ID NO: 1711050 - RNA, 15 nt, Homo sapiens
gccaucgaccuggag

SEQ ID NO: 1711051 - RNA, 15 nt, Homo sapiens
gccaucucuuccuca

SEQ ID NO: 1711052 - RNA, 23 nt, Homo sapiens
gccauggaagguucucugugcuc

SEQ ID NO: 1711053 - RNA, 14 nt, Homo sapiens
gccauguccaaaga

SEQ ID NO: 1711054 - RNA, 15 nt, Homo sapiens
gccauguuuccucuu

SEQ ID NO: 1711055 - RNA, 23 nt, Homo sapiens
gccauugaucauaaacugacuau

SEQ ID NO: 1711056 - RNA, 22 nt, Homo sapiens
gccauuuuggguuuugggucuu

SEQ ID NO: 1711057 - RNA, 22 nt, Homo sapiens
gcccaaagagcacaaacauuuu

SEQ ID NO: 1711058 - RNA, 17 nt, Homo sapiens
gcccaacuccaccagau

SEQ ID NO: 1711059 - RNA, 14 nt, Homo sapiens
gcccaagaauagau

SEQ ID NO: 1711060 - RNA, 18 nt, Homo sapiens
gcccaauauaaaaggcaa

SEQ ID NO: 1711061 - RNA, 22 nt, Homo sapiens
gcccacagcugagaauguggaa

SEQ ID NO: 1711062 - RNA, 20 nt, Homo sapiens
gcccacgcuggagugcagug

SEQ ID NO: 1711063 - RNA, 21 nt, Homo sapiens
gcccacugcugcaguagggga

SEQ ID NO: 1711064 - RNA, 22 nt, Homo sapiens
gcccacuucaccguacuaacca

SEQ ID NO: 1711065 - RNA, 20 nt, Homo sapiens
gcccagaagaaaauucuccu

SEQ ID NO: 1711066 - RNA, 22 nt, Homo sapiens
gcccagccccuagaaacccaag

SEQ ID NO: 1711067 - RNA, 22 nt, Homo sapiens
gcccaggagagagaaagccagg

SEQ ID NO: 1711068 - RNA, 21 nt, Homo sapiens
gcccaggaucguuuuuuccca

SEQ ID NO: 1711069 - RNA, 20 nt, Homo sapiens
gcccagggaagccaaaagau

SEQ ID NO: 1711070 - RNA, 16 nt, Homo sapiens
gcccauagaaacauga

SEQ ID NO: 1711071 - RNA, 22 nt, Homo sapiens
gccccacacagcuacagcuuuc

SEQ ID NO: 1711072 - RNA, 23 nt, Homo sapiens
gccccagagcuguuuauggccuc

SEQ ID NO: 1711073 - RNA, 23 nt, Homo sapiens
gccccagcucgcgggacccgacc

SEQ ID NO: 1711074 - RNA, 21 nt, Homo sapiens
gcccccacguggggaggugga

SEQ ID NO: 1711075 - RNA, 16 nt, Homo sapiens
gcccccuccucuagcu

SEQ ID NO: 1711076 - RNA, 17 nt, Homo sapiens
gccccuagaaacccaag

SEQ ID NO: 1711077 - RNA, 15 nt, Homo sapiens
gccccuagcuuuaua

SEQ ID NO: 1711078 - RNA, 21 nt, Homo sapiens
gccccuauagaaacaccagua

SEQ ID NO: 1711079 - RNA, 14 nt, Homo sapiens
gccccucaaccucc

SEQ ID NO: 1711080 - RNA, 19 nt, Homo sapiens
gccccucugaccugcacug

SEQ ID NO: 1711081 - RNA, 14 nt, Homo sapiens
gccccugucauccu

SEQ ID NO: 1711082 - RNA, 21 nt, Homo sapiens
gcccgcacacccucacucugc

SEQ ID NO: 1711083 - RNA, 14 nt, Homo sapiens
gcccgcacagcagc

SEQ ID NO: 1711084 - RNA, 22 nt, Homo sapiens
gcccguacccagcccugcugca

SEQ ID NO: 1711085 - RNA, 13 nt, Homo sapiens
gcccguucuugaa

SEQ ID NO: 1711086 - RNA, 21 nt, Homo sapiens
gcccuaaccccuuccagauca

SEQ ID NO: 1711087 - RNA, 20 nt, Homo sapiens
gcccucauuacugggccuua

SEQ ID NO: 1711088 - RNA, 19 nt, Homo sapiens
gcccucccccagcaguuga

SEQ ID NO: 1711089 - RNA, 17 nt, Homo sapiens
gcccuccuggugcccac

SEQ ID NO: 1711090 - RNA, 16 nt, Homo sapiens
gcccuccuuucugugc

SEQ ID NO: 1711091 - RNA, 20 nt, Homo sapiens
gcccucgacacucaccauga

SEQ ID NO: 1711092 - RNA, 16 nt, Homo sapiens
gcccugaguccaagag

SEQ ID NO: 1711093 - RNA, 15 nt, Homo sapiens
gcccugcagccagcu

SEQ ID NO: 1711094 - RNA, 15 nt, Homo sapiens
gcccuggugcgaaug

SEQ ID NO: 1711095 - RNA, 15 nt, Homo sapiens
gcccuggugcugcca

SEQ ID NO: 1711096 - RNA, 15 nt, Homo sapiens
gcccuuuccuuccag

SEQ ID NO: 1711097 - RNA, 15 nt, Homo sapiens
gccgccuuaagcuga

SEQ ID NO: 1711098 - RNA, 18 nt, Homo sapiens
gccggaggucaugaugau

SEQ ID NO: 1711099 - RNA, 17 nt, Homo sapiens
gccggcaggccuggacu

SEQ ID NO: 1711100 - RNA, 18 nt, Homo sapiens
gccgggugugguggcaca

SEQ ID NO: 1711101 - RNA, 14 nt, Homo sapiens
gccuaaaugccuua

SEQ ID NO: 1711102 - RNA, 19 nt, Homo sapiens
gccuaugcacauauggacu

SEQ ID NO: 1711103 - RNA, 16 nt, Homo sapiens
gccuauuuaccugcag

SEQ ID NO: 1711104 - RNA, 12 nt, Homo sapiens
gccucaccucua

SEQ ID NO: 1711105 - RNA, 19 nt, Homo sapiens
gccucccacccccaucucu

SEQ ID NO: 1711106 - RNA, 20 nt, Homo sapiens
gccuccuauccaccacugcu

SEQ ID NO: 1711107 - RNA, 23 nt, Homo sapiens
gccuccuguguacugugucauaa

SEQ ID NO: 1711108 - RNA, 14 nt, Homo sapiens
gccucugugccuuc

SEQ ID NO: 1711109 - RNA, 20 nt, Homo sapiens
gccugaagauauuacuacuu

SEQ ID NO: 1711110 - RNA, 20 nt, Homo sapiens
gccugagcaacucuugauua

SEQ ID NO: 1711111 - RNA, 21 nt, Homo sapiens
gccugcacagugaagugcugg

SEQ ID NO: 1711112 - RNA, 16 nt, Homo sapiens
gccugcacuaauuuga

SEQ ID NO: 1711113 - RNA, 18 nt, Homo sapiens
gccugccccccucaucuc

SEQ ID NO: 1711114 - RNA, 20 nt, Homo sapiens
gccugcccccuugggugacc

SEQ ID NO: 1711115 - RNA, 14 nt, Homo sapiens
gccugcgucuuccg

SEQ ID NO: 1711116 - RNA, 15 nt, Homo sapiens
gccugcuuugcuuua

SEQ ID NO: 1711117 - RNA, 19 nt, Homo sapiens
gccuggacacuguaccgac

SEQ ID NO: 1711118 - RNA, 14 nt, Homo sapiens
gccugguggcagcu

SEQ ID NO: 1711119 - RNA, 22 nt, Homo sapiens
gccuguaaucccaacacuuugg

SEQ ID NO: 1711120 - RNA, 14 nt, Homo sapiens
gccugugcacacac

SEQ ID NO: 1711121 - RNA, 12 nt, Homo sapiens
gccuguggaaug

SEQ ID NO: 1711122 - RNA, 11 nt, Homo sapiens
gccuguggcau

SEQ ID NO: 1711123 - RNA, 15 nt, Homo sapiens
gccuuagugggccag

SEQ ID NO: 1711124 - RNA, 16 nt, Homo sapiens
gccuuagugggccagg

SEQ ID NO: 1711125 - RNA, 17 nt, Homo sapiens
gccuucagcaugccuga

SEQ ID NO: 1711126 - RNA, 23 nt, Homo sapiens
gccuucauggaacucagcugucu

SEQ ID NO: 1711127 - RNA, 23 nt, Homo sapiens
gccuuccuuucuccaggaccaau

SEQ ID NO: 1711128 - RNA, 15 nt, Homo sapiens
gccuucugcccuccc

SEQ ID NO: 1711129 - RNA, 18 nt, Homo sapiens
gccuucuuauugcuuuua

SEQ ID NO: 1711130 - RNA, 22 nt, Homo sapiens
gccuugacaucaguuccuuugu

SEQ ID NO: 1711131 - RNA, 19 nt, Homo sapiens
gccuugaugccauaugccu

SEQ ID NO: 1711132 - RNA, 17 nt, Homo sapiens
gccuugcagaacugcca

SEQ ID NO: 1711133 - RNA, 21 nt, Homo sapiens
gccuuguguauauuuguauau

SEQ ID NO: 1711134 - RNA, 21 nt, Homo sapiens
gccuuuaguuuuaacaguuca

SEQ ID NO: 1711135 - RNA, 15 nt, Homo sapiens
gccuuuuaacauuuu

SEQ ID NO: 1711136 - RNA, 16 nt, Homo sapiens
gcgcaugaaccuggac

SEQ ID NO: 1711137 - RNA, 14 nt, Homo sapiens
ggugcaaaucaaug

SEQ ID NO: 1711138 - RNA, 17 nt, Homo sapiens
ggugcaugaugcugccc

SEQ ID NO: 1711139 - RNA, 19 nt, Homo sapiens
gguggaaggcagacagcag

SEQ ID NO: 1711140 - RNA, 12 nt, Homo sapiens
gguggcaauaaa

SEQ ID NO: 1711141 - RNA, 20 nt, Homo sapiens
gguggcugagcaucggagug

SEQ ID NO: 1711142 - RNA, 17 nt, Homo sapiens
gguggugggaaccauga

SEQ ID NO: 1711143 - RNA, 23 nt, Homo sapiens
gguguaccugcuggcacuaucca

SEQ ID NO: 1711144 - RNA, 11 nt, Homo sapiens
ggugucauauu

SEQ ID NO: 1711145 - RNA, 20 nt, Homo sapiens
gguuaaacccacagccaaac

SEQ ID NO: 1711146 - RNA, 15 nt, Homo sapiens
gguucagcugaagcu

SEQ ID NO: 1711147 - RNA, 14 nt, Homo sapiens
gguuccaacuguau

SEQ ID NO: 1711148 - RNA, 22 nt, Homo sapiens
gguucccaagaguauccuaccc

SEQ ID NO: 1711149 - RNA, 17 nt, Homo sapiens
gguucugcuacucccca

SEQ ID NO: 1711150 - RNA, 22 nt, Homo sapiens
gguucugcuacuccccagaccu

SEQ ID NO: 1711151 - RNA, 16 nt, Homo sapiens
gguucuuugcugcauu

SEQ ID NO: 1711152 - RNA, 16 nt, Homo sapiens
gguugguagcagggag

SEQ ID NO: 1711153 - RNA, 22 nt, Homo sapiens
gguuucucucuacagugccaac

SEQ ID NO: 1711154 - RNA, 16 nt, Homo sapiens
gguuuuaacaauuucc

SEQ ID NO: 1711155 - RNA, 18 nt, Homo sapiens
guaaaagaugaaguuuua

SEQ ID NO: 1711156 - RNA, 14 nt, Homo sapiens
guaaacgacacucu

SEQ ID NO: 1711157 - RNA, 12 nt, Homo sapiens
guaaacuuccaa

SEQ ID NO: 1711158 - RNA, 19 nt, Homo sapiens
guaaagaaauuuacuauau

SEQ ID NO: 1711159 - RNA, 13 nt, Homo sapiens
guaaagugccuua

SEQ ID NO: 1711160 - RNA, 16 nt, Homo sapiens
guaaauaguauuugag

SEQ ID NO: 1711161 - RNA, 23 nt, Homo sapiens
guaaauccuuuuggaacauauag

SEQ ID NO: 1711162 - RNA, 14 nt, Homo sapiens
guaacaacuguggu

SEQ ID NO: 1711163 - RNA, 16 nt, Homo sapiens
guaacacaugaacauu

SEQ ID NO: 1711164 - RNA, 17 nt, Homo sapiens
guaacagacuggcucca

SEQ ID NO: 1711165 - RNA, 21 nt, Homo sapiens
guaacauauucuguaugaacu

SEQ ID NO: 1711166 - RNA, 14 nt, Homo sapiens
guaagcaguuucca

SEQ ID NO: 1711167 - RNA, 12 nt, Homo sapiens
guaagugcugcu

SEQ ID NO: 1711168 - RNA, 15 nt, Homo sapiens
guaauaacugugaag

SEQ ID NO: 1711169 - RNA, 15 nt, Homo sapiens
guaauaauaccucaa

SEQ ID NO: 1711170 - RNA, 22 nt, Homo sapiens
guaauauagugacuaugaacuu

SEQ ID NO: 1711171 - RNA, 16 nt, Homo sapiens
guaaucaagggucauu

SEQ ID NO: 1711172 - RNA, 23 nt, Homo sapiens
guaaucccccaggagaacaucuu

SEQ ID NO: 1711173 - RNA, 17 nt, Homo sapiens
guaaugcugcacagaaa

SEQ ID NO: 1711174 - RNA, 21 nt, Homo sapiens
guaauuaaaaugauaguugau

SEQ ID NO: 1711175 - RNA, 18 nt, Homo sapiens
guaauuaaaggaacagag

SEQ ID NO: 1711176 - RNA, 17 nt, Homo sapiens
guaauuagcauggcccc

SEQ ID NO: 1711177 - RNA, 15 nt, Homo sapiens
guacaggaacugcau

SEQ ID NO: 1711178 - RNA, 16 nt, Homo sapiens
guacaggaaugaaccu

SEQ ID NO: 1711179 - RNA, 20 nt, Homo sapiens
guacaguauguuuuacaugu

SEQ ID NO: 1711180 - RNA, 21 nt, Homo sapiens
guacaguauguuuuacaugua

SEQ ID NO: 1711181 - RNA, 18 nt, Homo sapiens
guacauauguaaacauaa

SEQ ID NO: 1711182 - RNA, 21 nt, Homo sapiens
guacuauucugagcauacuca

SEQ ID NO: 1711183 - RNA, 18 nt, Homo sapiens
guacugaaagccuuaggg

SEQ ID NO: 1711184 - RNA, 14 nt, Homo sapiens
guacuuuugagugu

SEQ ID NO: 1711185 - RNA, 22 nt, Homo sapiens
guagaacagauaaucagugugu

SEQ ID NO: 1711186 - RNA, 20 nt, Homo sapiens
guagccaaagguucacucuc

SEQ ID NO: 1711187 - RNA, 16 nt, Homo sapiens
guagcccuggaccugc

SEQ ID NO: 1711188 - RNA, 19 nt, Homo sapiens
guagcugggacuacaggca

SEQ ID NO: 1711189 - RNA, 14 nt, Homo sapiens
guagcuugcucccu

SEQ ID NO: 1711190 - RNA, 13 nt, Homo sapiens
guaggacauacca

SEQ ID NO: 1711191 - RNA, 15 nt, Homo sapiens
guaggagcugccuug

SEQ ID NO: 1711192 - RNA, 14 nt, Homo sapiens
guaggggcaaaaau

SEQ ID NO: 1711193 - RNA, 17 nt, Homo sapiens
guaggggcccacuucac

SEQ ID NO: 1711194 - RNA, 14 nt, Homo sapiens
guagguucuugaua

SEQ ID NO: 1711195 - RNA, 15 nt, Homo sapiens
guagugaaauuauac

SEQ ID NO: 1711196 - RNA, 11 nt, Homo sapiens
guauacaguau

SEQ ID NO: 1711197 - RNA, 17 nt, Homo sapiens
guauauacacauauacc

SEQ ID NO: 1711198 - RNA, 20 nt, Homo sapiens
guauccaauaggcauuugau

SEQ ID NO: 1711199 - RNA, 18 nt, Homo sapiens
guaucccaugagccucag

SEQ ID NO: 1711200 - RNA, 18 nt, Homo sapiens
guaucccgagucugggac

SEQ ID NO: 1711201 - RNA, 13 nt, Homo sapiens
guauccugcagcg

SEQ ID NO: 1711202 - RNA, 18 nt, Homo sapiens
guaucuuccauauuugga

SEQ ID NO: 1711203 - RNA, 13 nt, Homo sapiens
guauggcucugca

SEQ ID NO: 1711204 - RNA, 15 nt, Homo sapiens
guauguauauauaca

SEQ ID NO: 1711205 - RNA, 16 nt, Homo sapiens
guauguauauauacac

SEQ ID NO: 1711206 - RNA, 15 nt, Homo sapiens
guauucuucaaccuc

SEQ ID NO: 1711207 - RNA, 18 nt, Homo sapiens
guauuuauuuauguacuu

SEQ ID NO: 1711208 - RNA, 17 nt, Homo sapiens
guauuuuuauccaugac

SEQ ID NO: 1711209 - RNA, 15 nt, Homo sapiens
gucaaaacacugugg

SEQ ID NO: 1711210 - RNA, 16 nt, Homo sapiens
gucaaaaggacauuua

SEQ ID NO: 1711211 - RNA, 16 nt, Homo sapiens
gucaacaaaccaagca

SEQ ID NO: 1711212 - RNA, 20 nt, Homo sapiens
gucaacaugcauauuacauu

SEQ ID NO: 1711213 - RNA, 13 nt, Homo sapiens
gucaagcaccugc

SEQ ID NO: 1711214 - RNA, 18 nt, Homo sapiens
gucacacacuuuggcuau

SEQ ID NO: 1711215 - RNA, 11 nt, Homo sapiens
gucacacuggu

SEQ ID NO: 1711216 - RNA, 13 nt, Homo sapiens
gucacagggccaa

SEQ ID NO: 1711217 - RNA, 10 nt, Homo sapiens
gucacagggu

SEQ ID NO: 1711218 - RNA, 18 nt, Homo sapiens
gucacauuguaacugaac

SEQ ID NO: 1711219 - RNA, 19 nt, Homo sapiens
gucaccggccgauggagac

SEQ ID NO: 1711220 - RNA, 17 nt, Homo sapiens
gucacugccacuuugca

SEQ ID NO: 1711221 - RNA, 12 nt, Homo sapiens
gucagcucucuc

SEQ ID NO: 1711222 - RNA, 21 nt, Homo sapiens
gucagcucucuccuuucaggg

SEQ ID NO: 1711223 - RNA, 16 nt, Homo sapiens
gucagucaugauggca

SEQ ID NO: 1711224 - RNA, 17 nt, Homo sapiens
gucauccucaugcugcu

SEQ ID NO: 1711225 - RNA, 22 nt, Homo sapiens
gucaucgggaggagcagccuga

SEQ ID NO: 1711226 - RNA, 16 nt, Homo sapiens
gucaugaccuccaggg

SEQ ID NO: 1711227 - RNA, 13 nt, Homo sapiens
gucauguuugcag

SEQ ID NO: 1711228 - RNA, 13 nt, Homo sapiens
gucauucauucaa

SEQ ID NO: 1711229 - RNA, 14 nt, Homo sapiens
gucauuucauucca

SEQ ID NO: 1711230 - RNA, 13 nt, Homo sapiens
guccacaggucua

SEQ ID NO: 1711231 - RNA, 21 nt, Homo sapiens
guccagagcggaggcugugug

SEQ ID NO: 1711232 - RNA, 23 nt, Homo sapiens
guccagccgccauugccaccagg

SEQ ID NO: 1711233 - RNA, 16 nt, Homo sapiens
guccaggaacaagcua

SEQ ID NO: 1711234 - RNA, 19 nt, Homo sapiens
guccauuuauccacaggaa

SEQ ID NO: 1711235 - RNA, 21 nt, Homo sapiens
gucccaaguuggaaauauuca

SEQ ID NO: 1711236 - RNA, 14 nt, Homo sapiens
gucccaccugcaca

SEQ ID NO: 1711237 - RNA, 20 nt, Homo sapiens
gucccacgugucuuccacuu

SEQ ID NO: 1711238 - RNA, 19 nt, Homo sapiens
gucccauggacacuccagu

SEQ ID NO: 1711239 - RNA, 17 nt, Homo sapiens
guccccacgaacuggcc

SEQ ID NO: 1711240 - RNA, 15 nt, Homo sapiens
guccccuccacuguc

SEQ ID NO: 1711241 - RNA, 20 nt, Homo sapiens
gucccuugaugcacagagaa

SEQ ID NO: 1711242 - RNA, 16 nt, Homo sapiens
guccgguguucuaaga

SEQ ID NO: 1711243 - RNA, 14 nt, Homo sapiens
guccuaaaagcaaa

SEQ ID NO: 1711244 - RNA, 19 nt, Homo sapiens
guccucacugcucccugaa

SEQ ID NO: 1711245 - RNA, 18 nt, Homo sapiens
guccucccucugauuuuu

SEQ ID NO: 1711246 - RNA, 15 nt, Homo sapiens
guccugacacuauuc

SEQ ID NO: 1711247 - RNA, 16 nt, Homo sapiens
guccugacacuauuca

SEQ ID NO: 1711248 - RNA, 14 nt, Homo sapiens
uaaauaacaggcau

SEQ ID NO: 1711249 - RNA, 18 nt, Homo sapiens
uaaauaagauucuaacgg

SEQ ID NO: 1711250 - RNA, 17 nt, Homo sapiens
uaaauaugcagugauau

SEQ ID NO: 1711251 - RNA, 23 nt, Homo sapiens
uaaaucauucuacuuuugcacuu

SEQ ID NO: 1711252 - RNA, 21 nt, Homo sapiens
uaaauccauccauccaaaggc

SEQ ID NO: 1711253 - RNA, 16 nt, Homo sapiens
uaaauccaugcaccua

SEQ ID NO: 1711254 - RNA, 23 nt, Homo sapiens
uaaaugaaauuguaaaaccuguc

SEQ ID NO: 1711255 - RNA, 11 nt, Homo sapiens
uaaaugaacuu

SEQ ID NO: 1711256 - RNA, 17 nt, Homo sapiens
uaaaugauagguauuau

SEQ ID NO: 1711257 - RNA, 14 nt, Homo sapiens
uaaauguauacuau

SEQ ID NO: 1711258 - RNA, 16 nt, Homo sapiens
uaaauguaucauagaa

SEQ ID NO: 1711259 - RNA, 14 nt, Homo sapiens
uaaaugugaacuua

SEQ ID NO: 1711260 - RNA, 16 nt, Homo sapiens
uaaauuauggcauuuu

SEQ ID NO: 1711261 - RNA, 22 nt, Homo sapiens
uaaauuccacacuaccacauua

SEQ ID NO: 1711262 - RNA, 20 nt, Homo sapiens
uaaauucccaacuucucuug

SEQ ID NO: 1711263 - RNA, 19 nt, Homo sapiens
uaaauugcuccuugacauu

SEQ ID NO: 1711264 - RNA, 17 nt, Homo sapiens
uaaauuuugaguucuac

SEQ ID NO: 1711265 - RNA, 15 nt, Homo sapiens
uaacaaaacacucgg

SEQ ID NO: 1711266 - RNA, 13 nt, Homo sapiens
uaacaaacaucac

SEQ ID NO: 1711267 - RNA, 22 nt, Homo sapiens
uaacaaacaucacucugcugcu

SEQ ID NO: 1711268 - RNA, 18 nt, Homo sapiens
uaacaaauaugcuaauuu

SEQ ID NO: 1711269 - RNA, 16 nt, Homo sapiens
uaacaaguaccaaagu

SEQ ID NO: 1711270 - RNA, 11 nt, Homo sapiens
uaacaaugaag

SEQ ID NO: 1711271 - RNA, 14 nt, Homo sapiens
uaacaauguuaagg

SEQ ID NO: 1711272 - RNA, 12 nt, Homo sapiens
uaacacauucaa

SEQ ID NO: 1711273 - RNA, 21 nt, Homo sapiens
uaacacauuuuuuaacuaaua

SEQ ID NO: 1711274 - RNA, 15 nt, Homo sapiens
uaacagaccacugua

SEQ ID NO: 1711275 - RNA, 23 nt, Homo sapiens
uaacagaccacuguauguuuacu

SEQ ID NO: 1711276 - RNA, 19 nt, Homo sapiens
uaacauggacugcuucauc

SEQ ID NO: 1711277 - RNA, 24 nt, Homo sapiens
uaaccaaggaaauauauuuuacca

SEQ ID NO: 1711278 - RNA, 19 nt, Homo sapiens
uaaccacaaagcacaguuu

SEQ ID NO: 1711279 - RNA, 18 nt, Homo sapiens
uaaccaucugauaucuau

SEQ ID NO: 1711280 - RNA, 20 nt, Homo sapiens
uaaccccaacgcacaggaaa

SEQ ID NO: 1711281 - RNA, 17 nt, Homo sapiens
uaaccgcacaugcacac

SEQ ID NO: 1711282 - RNA, 16 nt, Homo sapiens
uaaccucuucaccuua

SEQ ID NO: 1711283 - RNA, 19 nt, Homo sapiens
uaacgacuucuccaucucc

SEQ ID NO: 1711284 - RNA, 22 nt, Homo sapiens
uaacuaggcucagagaugugca

SEQ ID NO: 1711285 - RNA, 20 nt, Homo sapiens
uaacuaguggcucucaguua

SEQ ID NO: 1711286 - RNA, 15 nt, Homo sapiens
uaacucagaauuauu

SEQ ID NO: 1711287 - RNA, 14 nt, Homo sapiens
uaacuguacauuuc

SEQ ID NO: 1711288 - RNA, 22 nt, Homo sapiens
uaacuguagauaaagugguuug

SEQ ID NO: 1711289 - RNA, 12 nt, Homo sapiens
uaacugugcuga

SEQ ID NO: 1711290 - RNA, 14 nt, Homo sapiens
uaacuuauauugaa

SEQ ID NO: 1711291 - RNA, 13 nt, Homo sapiens
uaacuuauuuucc

SEQ ID NO: 1711292 - RNA, 20 nt, Homo sapiens
uaacuucaaggcccauaucu

SEQ ID NO: 1711293 - RNA, 18 nt, Homo sapiens
uaagaaaaagaagaacua

SEQ ID NO: 1711294 - RNA, 16 nt, Homo sapiens
uaagaaacccucuguc

SEQ ID NO: 1711295 - RNA, 20 nt, Homo sapiens
uaagaagcaaauaaauauca

SEQ ID NO: 1711296 - RNA, 15 nt, Homo sapiens
uaagacacaaaugca

SEQ ID NO: 1711297 - RNA, 15 nt, Homo sapiens
uaagacacucaaaua

SEQ ID NO: 1711298 - RNA, 16 nt, Homo sapiens
uaagacauaucucuaa

SEQ ID NO: 1711299 - RNA, 17 nt, Homo sapiens
uaagaggaucuccuguc

SEQ ID NO: 1711300 - RNA, 22 nt, Homo sapiens
uaagaggaucuccuguccauca

SEQ ID NO: 1711301 - RNA, 17 nt, Homo sapiens
uaagaguaaaauuccuc

SEQ ID NO: 1711302 - RNA, 22 nt, Homo sapiens
uaagagugccguaacaacugug

SEQ ID NO: 1711303 - RNA, 19 nt, Homo sapiens
uaagauauucagaaguaua

SEQ ID NO: 1711304 - RNA, 21 nt, Homo sapiens
uaagaugugauauucuaagac

SEQ ID NO: 1711305 - RNA, 17 nt, Homo sapiens
uaagauuuugcaccugu

SEQ ID NO: 1711306 - RNA, 16 nt, Homo sapiens
uaagcagaaauccugc

SEQ ID NO: 1711307 - RNA, 23 nt, Homo sapiens
uaagcagaaauccugcaaugaaa

SEQ ID NO: 1711308 - RNA, 20 nt, Homo sapiens
uaagcauuaccacucaggca

SEQ ID NO: 1711309 - RNA, 16 nt, Homo sapiens
uaagcuaggaaugaaa

SEQ ID NO: 1711310 - RNA, 13 nt, Homo sapiens
uaaggaacaacgu

SEQ ID NO: 1711311 - RNA, 16 nt, Homo sapiens
uaaggaggcacugcug

SEQ ID NO: 1711312 - RNA, 20 nt, Homo sapiens
uaaggguuaguuuacaauca

SEQ ID NO: 1711313 - RNA, 18 nt, Homo sapiens
uaagguccgguguucuaa

SEQ ID NO: 1711314 - RNA, 15 nt, Homo sapiens
uaaguacacaauaag

SEQ ID NO: 1711315 - RNA, 12 nt, Homo sapiens
uaaguacuguaa

SEQ ID NO: 1711316 - RNA, 13 nt, Homo sapiens
uaaguacuguaau

SEQ ID NO: 1711317 - RNA, 23 nt, Homo sapiens
uaaguauauuuaauucacuuaac

SEQ ID NO: 1711318 - RNA, 15 nt, Homo sapiens
uaagucucugugaau

SEQ ID NO: 1711319 - RNA, 15 nt, Homo sapiens
uaagugguuugauca

SEQ ID NO: 1711320 - RNA, 21 nt, Homo sapiens
uaaguuugaaggaaacaguua

SEQ ID NO: 1711321 - RNA, 18 nt, Homo sapiens
uaauaaaaaucauggcaa

SEQ ID NO: 1711322 - RNA, 15 nt, Homo sapiens
uaauaaaccuccuuc

SEQ ID NO: 1711323 - RNA, 15 nt, Homo sapiens
uaauaaacuacucuu

SEQ ID NO: 1711324 - RNA, 12 nt, Homo sapiens
uaauaauaccuc

SEQ ID NO: 1711325 - RNA, 15 nt, Homo sapiens
uaauagcauucauaa

SEQ ID NO: 1711326 - RNA, 19 nt, Homo sapiens
uaauagcuuuuauuguaua

SEQ ID NO: 1711327 - RNA, 20 nt, Homo sapiens
uaauagggagaaaccaagag

SEQ ID NO: 1711328 - RNA, 22 nt, Homo sapiens
uaauauaccagcuuguaugcaa

SEQ ID NO: 1711329 - RNA, 19 nt, Homo sapiens
uaauauauuguacacuaca

SEQ ID NO: 1711330 - RNA, 20 nt, Homo sapiens
uaauauauuguacacuacag

SEQ ID NO: 1711331 - RNA, 18 nt, Homo sapiens
uaaucaucuauaaagaag

SEQ ID NO: 1711332 - RNA, 15 nt, Homo sapiens
uaauccaguguuacu

SEQ ID NO: 1711333 - RNA, 13 nt, Homo sapiens
uaaucccaacacu

SEQ ID NO: 1711334 - RNA, 13 nt, Homo sapiens
uaaucccagcacu

SEQ ID NO: 1711335 - RNA, 20 nt, Homo sapiens
uaauccuucuggcagauuca

SEQ ID NO: 1711336 - RNA, 22 nt, Homo sapiens
uaaucucuguuauguacuguac

SEQ ID NO: 1711337 - RNA, 20 nt, Homo sapiens
uaaucugucaaaacacugug

SEQ ID NO: 1711338 - RNA, 14 nt, Homo sapiens
uaaugcuucauuca

SEQ ID NO: 1711339 - RNA, 13 nt, Homo sapiens
uaauggcacugau

SEQ ID NO: 1711340 - RNA, 13 nt, Homo sapiens
uaaugggacacua

SEQ ID NO: 1711341 - RNA, 17 nt, Homo sapiens
uaauguaauaauagaaa

SEQ ID NO: 1711342 - RNA, 20 nt, Homo sapiens
uaauguuguaauucaugcca

SEQ ID NO: 1711343 - RNA, 21 nt, Homo sapiens
uaauuaaaaaguuaaucuuca

SEQ ID NO: 1711344 - RNA, 15 nt, Homo sapiens
uaauuaugcaauuag

SEQ ID NO: 1711345 - RNA, 19 nt, Homo sapiens
uaauucacucaagcacuga

SEQ ID NO: 1711346 - RNA, 21 nt, Homo sapiens
uaauucacucaagcacugaua

SEQ ID NO: 1711347 - RNA, 14 nt, Homo sapiens
uaauucaugauuca

SEQ ID NO: 1711348 - RNA, 17 nt, Homo sapiens
uaauucuuacacugccu

SEQ ID NO: 1711349 - RNA, 16 nt, Homo sapiens
uaauugacaacacagc

SEQ ID NO: 1711350 - RNA, 14 nt, Homo sapiens
uaauuuaaagcuua

SEQ ID NO: 1711351 - RNA, 13 nt, Homo sapiens
uaauuuccagggu

SEQ ID NO: 1711352 - RNA, 18 nt, Homo sapiens
uacaaaacuacaugagaa

SEQ ID NO: 1711353 - RNA, 20 nt, Homo sapiens
uacaaaauccagcuaugaau

SEQ ID NO: 1711354 - RNA, 16 nt, Homo sapiens
uacaaagcgugcacaa

SEQ ID NO: 1711355 - RNA, 18 nt, Homo sapiens
uacaacuugcauauguca

SEQ ID NO: 1711356 - RNA, 15 nt, Homo sapiens
uacaagaaguuuauu

SEQ ID NO: 1711357 - RNA, 20 nt, Homo sapiens
uacaaggcuuuaucucaggg

SEQ ID NO: 1711358 - RNA, 20 nt, Homo sapiens
augcaugucaaacaugagau

SEQ ID NO: 1711359 - RNA, 19 nt, Homo sapiens
augcauuuuuaauaugaca

SEQ ID NO: 1711360 - RNA, 21 nt, Homo sapiens
augccaauaaaguuugcccau

SEQ ID NO: 1711361 - RNA, 21 nt, Homo sapiens
augccagcuacuuccuccucc

SEQ ID NO: 1711362 - RNA, 22 nt, Homo sapiens
augccagcucagucccaucaga

SEQ ID NO: 1711363 - RNA, 14 nt, Homo sapiens
augccauaugccuu

SEQ ID NO: 1711364 - RNA, 13 nt, Homo sapiens
augccauucuucc

SEQ ID NO: 1711365 - RNA, 14 nt, Homo sapiens
augcccaacugccu

SEQ ID NO: 1711366 - RNA, 15 nt, Homo sapiens
augccuagaguuuac

SEQ ID NO: 1711367 - RNA, 14 nt, Homo sapiens
augccugcaaucug

SEQ ID NO: 1711368 - RNA, 17 nt, Homo sapiens
augccugguggcagcug

SEQ ID NO: 1711369 - RNA, 16 nt, Homo sapiens
augccuuaaaauggaa

SEQ ID NO: 1711370 - RNA, 19 nt, Homo sapiens
augccuucacuuuacaaau

SEQ ID NO: 1711371 - RNA, 18 nt, Homo sapiens
augccuuggggaggacaa

SEQ ID NO: 1711372 - RNA, 18 nt, Homo sapiens
augcguaaacgacacucu

SEQ ID NO: 1711373 - RNA, 17 nt, Homo sapiens
augcuaauuuggggaaa

SEQ ID NO: 1711374 - RNA, 23 nt, Homo sapiens
augcuagaacaacgccugucaca

SEQ ID NO: 1711375 - RNA, 14 nt, Homo sapiens
augcuauugaaaau

SEQ ID NO: 1711376 - RNA, 19 nt, Homo sapiens
augcuauugaaaaugugaa

SEQ ID NO: 1711377 - RNA, 23 nt, Homo sapiens
augcucccuccccugcccugguc

SEQ ID NO: 1711378 - RNA, 17 nt, Homo sapiens
augcugagaagaucuga

SEQ ID NO: 1711379 - RNA, 11 nt, Homo sapiens
augcugcuaug

SEQ ID NO: 1711380 - RNA, 21 nt, Homo sapiens
augcugcuauggaaggugcua

SEQ ID NO: 1711381 - RNA, 18 nt, Homo sapiens
augcugcucaauuccuuc

SEQ ID NO: 1711382 - RNA, 20 nt, Homo sapiens
augcuggcagccauggccau

SEQ ID NO: 1711383 - RNA, 23 nt, Homo sapiens
augcuggcauuugcaccuaccuc

SEQ ID NO: 1711384 - RNA, 14 nt, Homo sapiens
augcuguaacuuaa

SEQ ID NO: 1711385 - RNA, 22 nt, Homo sapiens
augcuguauauccuuucuaaca

SEQ ID NO: 1711386 - RNA, 18 nt, Homo sapiens
augcuguuuguagugaaa

SEQ ID NO: 1711387 - RNA, 14 nt, Homo sapiens
augcuuacaaaguc

SEQ ID NO: 1711388 - RNA, 14 nt, Homo sapiens
augcuuaugacaau

SEQ ID NO: 1711389 - RNA, 24 nt, Homo sapiens
augcuuaugacaaugacugugcua

SEQ ID NO: 1711390 - RNA, 18 nt, Homo sapiens
augcuucaguacuuguga

SEQ ID NO: 1711391 - RNA, 13 nt, Homo sapiens
auggaaaaaccau

SEQ ID NO: 1711392 - RNA, 23 nt, Homo sapiens
auggaacgcuaaugaaacacagc

SEQ ID NO: 1711393 - RNA, 14 nt, Homo sapiens
auggaauuacaugu

SEQ ID NO: 1711394 - RNA, 15 nt, Homo sapiens
auggaauuacaugua

SEQ ID NO: 1711395 - RNA, 16 nt, Homo sapiens
auggaauugauuugca

SEQ ID NO: 1711396 - RNA, 21 nt, Homo sapiens
auggacacuccagugccagca

SEQ ID NO: 1711397 - RNA, 23 nt, Homo sapiens
auggaccagugguuuccagucau

SEQ ID NO: 1711398 - RNA, 22 nt, Homo sapiens
auggacuaaccccaacgcacag

SEQ ID NO: 1711399 - RNA, 12 nt, Homo sapiens
auggacucugca

SEQ ID NO: 1711400 - RNA, 16 nt, Homo sapiens
auggacugcuucaucu

SEQ ID NO: 1711401 - RNA, 21 nt, Homo sapiens
auggagacaagggcaucaucu

SEQ ID NO: 1711402 - RNA, 15 nt, Homo sapiens
auggagaggaacaca

SEQ ID NO: 1711403 - RNA, 14 nt, Homo sapiens
auggaggucauaca

SEQ ID NO: 1711404 - RNA, 18 nt, Homo sapiens
auggaguucuugugccau

SEQ ID NO: 1711405 - RNA, 22 nt, Homo sapiens
auggaugaaucucccacuccag

SEQ ID NO: 1711406 - RNA, 14 nt, Homo sapiens
auggauucuauuua

SEQ ID NO: 1711407 - RNA, 22 nt, Homo sapiens
auggcaccacugcacuccagcc

SEQ ID NO: 1711408 - RNA, 21 nt, Homo sapiens
auggccagagaugcuggacuu

SEQ ID NO: 1711409 - RNA, 13 nt, Homo sapiens
auggccagccaac

SEQ ID NO: 1711410 - RNA, 17 nt, Homo sapiens
auggcugugccucugcc

SEQ ID NO: 1711411 - RNA, 14 nt, Homo sapiens
augggcacuugaga

SEQ ID NO: 1711412 - RNA, 18 nt, Homo sapiens
augggcuucacuguauaa

SEQ ID NO: 1711413 - RNA, 19 nt, Homo sapiens
auggggguacucaauggag

SEQ ID NO: 1711414 - RNA, 16 nt, Homo sapiens
augguaaauccuuuug

SEQ ID NO: 1711415 - RNA, 17 nt, Homo sapiens
augguaccaagcauuua

SEQ ID NO: 1711416 - RNA, 21 nt, Homo sapiens
augguacuaguguuuuuuaga

SEQ ID NO: 1711417 - RNA, 15 nt, Homo sapiens
auggucacacacuga

SEQ ID NO: 1711418 - RNA, 16 nt, Homo sapiens
auggucuaacacuggc

SEQ ID NO: 1711419 - RNA, 20 nt, Homo sapiens
augguggcucacgccuguaa

SEQ ID NO: 1711420 - RNA, 13 nt, Homo sapiens
auguaaacugcca

SEQ ID NO: 1711421 - RNA, 12 nt, Homo sapiens
auguaaauacca

SEQ ID NO: 1711422 - RNA, 19 nt, Homo sapiens
auguacaucuggccuugaa

SEQ ID NO: 1711423 - RNA, 15 nt, Homo sapiens
auguagauuuguaca

SEQ ID NO: 1711424 - RNA, 19 nt, Homo sapiens
auguagcauuaugcaauua

SEQ ID NO: 1711425 - RNA, 16 nt, Homo sapiens
auguaguugauguauc

SEQ ID NO: 1711426 - RNA, 18 nt, Homo sapiens
auguauauauacacggua

SEQ ID NO: 1711427 - RNA, 22 nt, Homo sapiens
augucacagggccaacuugagg

SEQ ID NO: 1711428 - RNA, 20 nt, Homo sapiens
augucauagguaagaaacac

SEQ ID NO: 1711429 - RNA, 11 nt, Homo sapiens
auguccaaaga

SEQ ID NO: 1711430 - RNA, 15 nt, Homo sapiens
augucccugggccag

SEQ ID NO: 1711431 - RNA, 15 nt, Homo sapiens
auguccuacuaucac

SEQ ID NO: 1711432 - RNA, 15 nt, Homo sapiens
auguccucagcauuu

SEQ ID NO: 1711433 - RNA, 16 nt, Homo sapiens
auguccucagcauuuc

SEQ ID NO: 1711434 - RNA, 18 nt, Homo sapiens
augucuagccacugauca

SEQ ID NO: 1711435 - RNA, 14 nt, Homo sapiens
augucuagcuuuca

SEQ ID NO: 1711436 - RNA, 19 nt, Homo sapiens
augucucuuuaaugucaca

SEQ ID NO: 1711437 - RNA, 17 nt, Homo sapiens
augucuuggacacugua

SEQ ID NO: 1711438 - RNA, 22 nt, Homo sapiens
augucuuuuacccggcacauuc

SEQ ID NO: 1711439 - RNA, 16 nt, Homo sapiens
augugaaaacaucuca

SEQ ID NO: 1711440 - RNA, 14 nt, Homo sapiens
augugaaggggaga

SEQ ID NO: 1711441 - RNA, 16 nt, Homo sapiens
augugauuuuucugca

SEQ ID NO: 1711442 - RNA, 12 nt, Homo sapiens
augugcacugau

SEQ ID NO: 1711443 - RNA, 13 nt, Homo sapiens
augugcugucacg

SEQ ID NO: 1711444 - RNA, 19 nt, Homo sapiens
auguggaaggcagcagagc

SEQ ID NO: 1711445 - RNA, 14 nt, Homo sapiens
augugggucuucca

SEQ ID NO: 1711446 - RNA, 14 nt, Homo sapiens
auguggguggcaaa

SEQ ID NO: 1711447 - RNA, 18 nt, Homo sapiens
auguguagccugugcaug

SEQ ID NO: 1711448 - RNA, 17 nt, Homo sapiens
auguguaugugccauuu

SEQ ID NO: 1711449 - RNA, 17 nt, Homo sapiens
auguguccaaucggaga

SEQ ID NO: 1711450 - RNA, 15 nt, Homo sapiens
auguguccucaggga

SEQ ID NO: 1711451 - RNA, 19 nt, Homo sapiens
augugugaaaaagaugcca

SEQ ID NO: 1711452 - RNA, 20 nt, Homo sapiens
auguguucucggagugugua

SEQ ID NO: 1711453 - RNA, 16 nt, Homo sapiens
auguguugaaaaccaa

SEQ ID NO: 1711454 - RNA, 19 nt, Homo sapiens
auguguuuuucuccagugc

SEQ ID NO: 1711455 - RNA, 18 nt, Homo sapiens
auguuaaggaaacucuua

SEQ ID NO: 1711456 - RNA, 20 nt, Homo sapiens
auguuauguaccauaugauc

SEQ ID NO: 1711457 - RNA, 12 nt, Homo sapiens
auguucagucac

SEQ ID NO: 1711458 - RNA, 19 nt, Homo sapiens
auguuccucugucaaugaa

SEQ ID NO: 1711459 - RNA, 16 nt, Homo sapiens
auguucuaaguuucua

SEQ ID NO: 1711460 - RNA, 17 nt, Homo sapiens
auguucucugaggacac

SEQ ID NO: 1711461 - RNA, 18 nt, Homo sapiens
auguugccauguguuuua

SEQ ID NO: 1711462 - RNA, 15 nt, Homo sapiens
auguugccuuuaugg

SEQ ID NO: 1711463 - RNA, 15 nt, Homo sapiens
auguugguguuccac

SEQ ID NO: 1711464 - RNA, 17 nt, Homo sapiens
auguuuauuuacuaauu

SEQ ID NO: 1711465 - RNA, 14 nt, Homo sapiens
auguuugacacaau

SEQ ID NO: 1711466 - RNA, 19 nt, Homo sapiens
auguuugacacaauuggaa

SEQ ID NO: 1711467 - RNA, 17 nt, Homo sapiens
auguuuguggccucaga

SEQ ID NO: 1711468 - RNA, 15 nt, Homo sapiens
acugugaagcauuua

SEQ ID NO: 1711469 - RNA, 21 nt, Homo sapiens
acugugaccuagagacuucac

SEQ ID NO: 1711470 - RNA, 12 nt, Homo sapiens
acugugacugua

SEQ ID NO: 1711471 - RNA, 23 nt, Homo sapiens
acugugccuuguuucaacaguuu

SEQ ID NO: 1711472 - RNA, 19 nt, Homo sapiens
acugugccuuugcaaauca

SEQ ID NO: 1711473 - RNA, 11 nt, Homo sapiens
acugugcugaa

SEQ ID NO: 1711474 - RNA, 18 nt, Homo sapiens
acuguggagcucagugug

SEQ ID NO: 1711475 - RNA, 22 nt, Homo sapiens
acuguuaagaagcagccaucac

SEQ ID NO: 1711476 - RNA, 16 nt, Homo sapiens
acuguucagcuguccu

SEQ ID NO: 1711477 - RNA, 13 nt, Homo sapiens
acuguucuaaagc

SEQ ID NO: 1711478 - RNA, 23 nt, Homo sapiens
acuguugagaggguuacuuacau

SEQ ID NO: 1711479 - RNA, 15 nt, Homo sapiens
acuguugauguaucu

SEQ ID NO: 1711480 - RNA, 13 nt, Homo sapiens
acuguuuuaucug

SEQ ID NO: 1711481 - RNA, 16 nt, Homo sapiens
acuuaaaaauauccau

SEQ ID NO: 1711482 - RNA, 19 nt, Homo sapiens
acuuaacaugggcucuuca

SEQ ID NO: 1711483 - RNA, 15 nt, Homo sapiens
acuuaagcacaagca

SEQ ID NO: 1711484 - RNA, 18 nt, Homo sapiens
acuuaaguacccuuucaa

SEQ ID NO: 1711485 - RNA, 21 nt, Homo sapiens
acuuaauguuugguaacuuuu

SEQ ID NO: 1711486 - RNA, 14 nt, Homo sapiens
acuuacuuuacuca

SEQ ID NO: 1711487 - RNA, 17 nt, Homo sapiens
acuuagcaugucccuac

SEQ ID NO: 1711488 - RNA, 21 nt, Homo sapiens
acuuagguggcaagcugugac

SEQ ID NO: 1711489 - RNA, 18 nt, Homo sapiens
acuuagucuguacuucau

SEQ ID NO: 1711490 - RNA, 12 nt, Homo sapiens
acuuagugacaa

SEQ ID NO: 1711491 - RNA, 18 nt, Homo sapiens
acuuauaccugcuaucag

SEQ ID NO: 1711492 - RNA, 18 nt, Homo sapiens
acuuauaguacaugauaa

SEQ ID NO: 1711493 - RNA, 18 nt, Homo sapiens
acuuauauugaagacaau

SEQ ID NO: 1711494 - RNA, 23 nt, Homo sapiens
acuuauauugaagacaauuugau

SEQ ID NO: 1711495 - RNA, 14 nt, Homo sapiens
acuuaucacaugga

SEQ ID NO: 1711496 - RNA, 13 nt, Homo sapiens
acuuaugccauag

SEQ ID NO: 1711497 - RNA, 15 nt, Homo sapiens
acuuauuaacuaaga

SEQ ID NO: 1711498 - RNA, 12 nt, Homo sapiens
acuuauuacaau

SEQ ID NO: 1711499 - RNA, 18 nt, Homo sapiens
acuucaaugcacauggug

SEQ ID NO: 1711500 - RNA, 13 nt, Homo sapiens
acuucacuuauua

SEQ ID NO: 1711501 - RNA, 12 nt, Homo sapiens
acuucauucucg

SEQ ID NO: 1711502 - RNA, 22 nt, Homo sapiens
acuuccacauuauacauuugau

SEQ ID NO: 1711503 - RNA, 17 nt, Homo sapiens
acuuccuuuaaagauga

SEQ ID NO: 1711504 - RNA, 14 nt, Homo sapiens
acuucgaaaccugg

SEQ ID NO: 1711505 - RNA, 20 nt, Homo sapiens
acuucucccgugagccaggc

SEQ ID NO: 1711506 - RNA, 16 nt, Homo sapiens
acuucugcuggcauca

SEQ ID NO: 1711507 - RNA, 23 nt, Homo sapiens
acuucuuaaaaguugugauucca

SEQ ID NO: 1711508 - RNA, 21 nt, Homo sapiens
acuugaaauucuuucagcuau

SEQ ID NO: 1711509 - RNA, 17 nt, Homo sapiens
acuugaaauuugccuug

SEQ ID NO: 1711510 - RNA, 14 nt, Homo sapiens
acuugaacaaaagg

SEQ ID NO: 1711511 - RNA, 14 nt, Homo sapiens
acuugaaugugcac

SEQ ID NO: 1711512 - RNA, 18 nt, Homo sapiens
acuugaccuaaacuucua

SEQ ID NO: 1711513 - RNA, 15 nt, Homo sapiens
acuugaugauacaau

SEQ ID NO: 1711514 - RNA, 23 nt, Homo sapiens
acuugccuaaaauauauuccuga

SEQ ID NO: 1711515 - RNA, 17 nt, Homo sapiens
acuugcugauccaugag

SEQ ID NO: 1711516 - RNA, 16 nt, Homo sapiens
acuugcuuuaugccuu

SEQ ID NO: 1711517 - RNA, 22 nt, Homo sapiens
acuugggugacggcagucgaug

SEQ ID NO: 1711518 - RNA, 23 nt, Homo sapiens
acuuguaagaaaaugagacaaaa

SEQ ID NO: 1711519 - RNA, 21 nt, Homo sapiens
acuugucacugacacaaagga

SEQ ID NO: 1711520 - RNA, 16 nt, Homo sapiens
acuuguggacacagcu

SEQ ID NO: 1711521 - RNA, 16 nt, Homo sapiens
acuuguuccagcucuu

SEQ ID NO: 1711522 - RNA, 19 nt, Homo sapiens
acuuguuuucacuuuauca

SEQ ID NO: 1711523 - RNA, 16 nt, Homo sapiens
acuuuaaaagacugaa

SEQ ID NO: 1711524 - RNA, 21 nt, Homo sapiens
acuuuagaagugcauuucuga

SEQ ID NO: 1711525 - RNA, 18 nt, Homo sapiens
acuuuaucuaauaccucu

SEQ ID NO: 1711526 - RNA, 16 nt, Homo sapiens
acuuucaaaauuaaau

SEQ ID NO: 1711527 - RNA, 16 nt, Homo sapiens
acuuucacacuaagaa

SEQ ID NO: 1711528 - RNA, 12 nt, Homo sapiens
acuuuccacuuc

SEQ ID NO: 1711529 - RNA, 23 nt, Homo sapiens
acuuucccagaaaaaaaaaaacu

SEQ ID NO: 1711530 - RNA, 16 nt, Homo sapiens
acuuuccuguugucua

SEQ ID NO: 1711531 - RNA, 16 nt, Homo sapiens
acuuugaaucugcaac

SEQ ID NO: 1711532 - RNA, 15 nt, Homo sapiens
acuuugcacagcucu

SEQ ID NO: 1711533 - RNA, 12 nt, Homo sapiens
acuuugcugauu

SEQ ID NO: 1711534 - RNA, 15 nt, Homo sapiens
acuuuucgacauauu

SEQ ID NO: 1711535 - RNA, 21 nt, Homo sapiens
acuuuucuuuccucagaucau

SEQ ID NO: 1711536 - RNA, 23 nt, Homo sapiens
acuuuucuuuuuuucaaaugaau

SEQ ID NO: 1711537 - RNA, 16 nt, Homo sapiens
acuuuuguguaaugaa

SEQ ID NO: 1711538 - RNA, 22 nt, Homo sapiens
acuuuuguguaucguaaccagc

SEQ ID NO: 1711539 - RNA, 22 nt, Homo sapiens
acuuuuuucuaguacacuuuua

SEQ ID NO: 1711540 - RNA, 22 nt, Homo sapiens
augaggacuugugucucugugc

SEQ ID NO: 1711541 - RNA, 20 nt, Homo sapiens
augaggagaaaggggcccca

SEQ ID NO: 1711542 - RNA, 19 nt, Homo sapiens
augaggauuauugauagua

SEQ ID NO: 1711543 - RNA, 15 nt, Homo sapiens
augaggucuguuuaa

SEQ ID NO: 1711544 - RNA, 14 nt, Homo sapiens
augaguauggauug

SEQ ID NO: 1711545 - RNA, 14 nt, Homo sapiens
augaguccuugaaa

SEQ ID NO: 1711546 - RNA, 22 nt, Homo sapiens
augaguuacuugaaauuugccu

SEQ ID NO: 1711547 - RNA, 14 nt, Homo sapiens
augauaaugaaacu

SEQ ID NO: 1711548 - RNA, 13 nt, Homo sapiens
augauacaaugaa

SEQ ID NO: 1711549 - RNA, 18 nt, Homo sapiens
augauccccaagugguga

SEQ ID NO: 1711550 - RNA, 19 nt, Homo sapiens
augauccccaaguggugaa

SEQ ID NO: 1711551 - RNA, 21 nt, Homo sapiens
augaucuguuuuucaccacuu

SEQ ID NO: 1711552 - RNA, 22 nt, Homo sapiens
augaucuguuuuucaccacuuc

SEQ ID NO: 1711553 - RNA, 19 nt, Homo sapiens
augaugagaguuucuguua

SEQ ID NO: 1711554 - RNA, 20 nt, Homo sapiens
augaugcccugcuccaggga

SEQ ID NO: 1711555 - RNA, 14 nt, Homo sapiens
augauggaugccaa

SEQ ID NO: 1711556 - RNA, 15 nt, Homo sapiens
augaugugaaacacu

SEQ ID NO: 1711557 - RNA, 20 nt, Homo sapiens
augauuaaauaagauucuaa

SEQ ID NO: 1711558 - RNA, 19 nt, Homo sapiens
augauuucaugcuaucucu

SEQ ID NO: 1711559 - RNA, 15 nt, Homo sapiens
augcaaaguagcaau

SEQ ID NO: 1711560 - RNA, 21 nt, Homo sapiens
augcacauauggacucugcac

SEQ ID NO: 1711561 - RNA, 18 nt, Homo sapiens
augcaccuagcugugcaa

SEQ ID NO: 1711562 - RNA, 18 nt, Homo sapiens
augcacugacccuuccag

SEQ ID NO: 1711563 - RNA, 23 nt, Homo sapiens
augcaggcccuuugaagccucag

SEQ ID NO: 1711564 - RNA, 12 nt, Homo sapiens
augcaugaacaa

SEQ ID NO: 1711565 - RNA, 13 nt, Homo sapiens
augcaugaacaag

SEQ ID NO: 1711566 - RNA, 11 nt, Homo sapiens
caacaaaccau

SEQ ID NO: 1711567 - RNA, 19 nt, Homo sapiens
caacaacuuacacuuauuu

SEQ ID NO: 1711568 - RNA, 17 nt, Homo sapiens
caacacuguacacauaa

SEQ ID NO: 1711569 - RNA, 19 nt, Homo sapiens
caacacuguuacuuucgua

SEQ ID NO: 1711570 - RNA, 21 nt, Homo sapiens
caacaggcuguucugcacuga

SEQ ID NO: 1711571 - RNA, 14 nt, Homo sapiens
caacauccaaaaua

SEQ ID NO: 1711572 - RNA, 12 nt, Homo sapiens
caacaugcugcc

SEQ ID NO: 1711573 - RNA, 22 nt, Homo sapiens
caacauggugaaaaccccaucu

SEQ ID NO: 1711574 - RNA, 18 nt, Homo sapiens
caaccaagucaugugcau

SEQ ID NO: 1711575 - RNA, 15 nt, Homo sapiens
caaccaauuuacacu

SEQ ID NO: 1711576 - RNA, 19 nt, Homo sapiens
caaccacaaaccuaguacg

SEQ ID NO: 1711577 - RNA, 18 nt, Homo sapiens
caaccagagaagcugcua

SEQ ID NO: 1711578 - RNA, 17 nt, Homo sapiens
caaccucauugcagcua

SEQ ID NO: 1711579 - RNA, 17 nt, Homo sapiens
caaccugacucaggcca

SEQ ID NO: 1711580 - RNA, 23 nt, Homo sapiens
caaccuguuuuggucacaucacu

SEQ ID NO: 1711581 - RNA, 14 nt, Homo sapiens
caacuauuuuucca

SEQ ID NO: 1711582 - RNA, 17 nt, Homo sapiens
caacugaacugaacuaa

SEQ ID NO: 1711583 - RNA, 10 nt, Homo sapiens
caacugacca

SEQ ID NO: 1711584 - RNA, 17 nt, Homo sapiens
caacugauacuucacua

SEQ ID NO: 1711585 - RNA, 21 nt, Homo sapiens
caacugccggggguucagggu

SEQ ID NO: 1711586 - RNA, 15 nt, Homo sapiens
caacuguccuacuca

SEQ ID NO: 1711587 - RNA, 21 nt, Homo sapiens
caacuugaaauuauaucugug

SEQ ID NO: 1711588 - RNA, 22 nt, Homo sapiens
caacuugaaauuauaucugugg

SEQ ID NO: 1711589 - RNA, 11 nt, Homo sapiens
caacuugagau

SEQ ID NO: 1711590 - RNA, 15 nt, Homo sapiens
caagaaacacuuuca

SEQ ID NO: 1711591 - RNA, 16 nt, Homo sapiens
caagaaacgucuucua

SEQ ID NO: 1711592 - RNA, 21 nt, Homo sapiens
caagaaccuggaaaaauucca

SEQ ID NO: 1711593 - RNA, 15 nt, Homo sapiens
caagaacugaaacca

SEQ ID NO: 1711594 - RNA, 19 nt, Homo sapiens
caagaagugguccaucucc

SEQ ID NO: 1711595 - RNA, 13 nt, Homo sapiens
caagaaugaaaca

SEQ ID NO: 1711596 - RNA, 22 nt, Homo sapiens
caagacaauucuucuucuucca

SEQ ID NO: 1711597 - RNA, 16 nt, Homo sapiens
caagaggcuccugucc

SEQ ID NO: 1711598 - RNA, 19 nt, Homo sapiens
caagaucugaaauaaauga

SEQ ID NO: 1711599 - RNA, 21 nt, Homo sapiens
caagcaucagggggaagaagc

SEQ ID NO: 1711600 - RNA, 13 nt, Homo sapiens
caagcaugcuugu

SEQ ID NO: 1711601 - RNA, 20 nt, Homo sapiens
caagcauugcuucagaauga

SEQ ID NO: 1711602 - RNA, 22 nt, Homo sapiens
caagcauuuagugcacaguggc

SEQ ID NO: 1711603 - RNA, 21 nt, Homo sapiens
caagccacagcagguccucca

SEQ ID NO: 1711604 - RNA, 16 nt, Homo sapiens
caagccagcccggccg

SEQ ID NO: 1711605 - RNA, 16 nt, Homo sapiens
caagcccaggugccag

SEQ ID NO: 1711606 - RNA, 23 nt, Homo sapiens
caagccccgcccccucugcccca

SEQ ID NO: 1711607 - RNA, 16 nt, Homo sapiens
caagcuccucgugaua

SEQ ID NO: 1711608 - RNA, 15 nt, Homo sapiens
caagcucuucacuga

SEQ ID NO: 1711609 - RNA, 21 nt, Homo sapiens
caagcuggucccacucagucc

SEQ ID NO: 1711610 - RNA, 23 nt, Homo sapiens
caaggaaauauauuuuaccauac

SEQ ID NO: 1711611 - RNA, 17 nt, Homo sapiens
caaggagcacaagccac

SEQ ID NO: 1711612 - RNA, 18 nt, Homo sapiens
caaggagcacaagccaca

SEQ ID NO: 1711613 - RNA, 17 nt, Homo sapiens
caaggaguacuccaaga

SEQ ID NO: 1711614 - RNA, 15 nt, Homo sapiens
caaggcacucuagau

SEQ ID NO: 1711615 - RNA, 15 nt, Homo sapiens
caaggccagugcuaa

SEQ ID NO: 1711616 - RNA, 21 nt, Homo sapiens
caaggguucuuggugaugcug

SEQ ID NO: 1711617 - RNA, 14 nt, Homo sapiens
caaggucuuugguu

SEQ ID NO: 1711618 - RNA, 17 nt, Homo sapiens
caagguggucaguaaau

SEQ ID NO: 1711619 - RNA, 21 nt, Homo sapiens
caagguggucaguaaauaaca

SEQ ID NO: 1711620 - RNA, 19 nt, Homo sapiens
caaguagcugggauuacag

SEQ ID NO: 1711621 - RNA, 20 nt, Homo sapiens
caaguauagccuauggcaga

SEQ ID NO: 1711622 - RNA, 19 nt, Homo sapiens
caaguauguugagaguugc

SEQ ID NO: 1711623 - RNA, 18 nt, Homo sapiens
caagucaugugcauuucc

SEQ ID NO: 1711624 - RNA, 21 nt, Homo sapiens
caagugagagagaugggagcu

SEQ ID NO: 1711625 - RNA, 18 nt, Homo sapiens
caagugggaucugucaca

SEQ ID NO: 1711626 - RNA, 11 nt, Homo sapiens
caaguuugcac

SEQ ID NO: 1711627 - RNA, 12 nt, Homo sapiens
caauaaaccucc

SEQ ID NO: 1711628 - RNA, 13 nt, Homo sapiens
caauaaaccuccg

SEQ ID NO: 1711629 - RNA, 19 nt, Homo sapiens
caauaaauaccagacacgu

SEQ ID NO: 1711630 - RNA, 14 nt, Homo sapiens
caauaacacuaaaa

SEQ ID NO: 1711631 - RNA, 14 nt, Homo sapiens
caauaacuucugac

SEQ ID NO: 1711632 - RNA, 19 nt, Homo sapiens
caauaauauuguuguauaa

SEQ ID NO: 1711633 - RNA, 14 nt, Homo sapiens
caauacgacacuga

SEQ ID NO: 1711634 - RNA, 15 nt, Homo sapiens
caauagcauaucaca

SEQ ID NO: 1711635 - RNA, 18 nt, Homo sapiens
caauauccaaaccaaaua

SEQ ID NO: 1711636 - RNA, 22 nt, Homo sapiens
caaugaaaaaaaguacauguau

SEQ ID NO: 1711637 - RNA, 19 nt, Homo sapiens
caaugaagugacacuuuga

SEQ ID NO: 1711638 - RNA, 20 nt, Homo sapiens
caaugaagugacacuuugac

SEQ ID NO: 1711639 - RNA, 13 nt, Homo sapiens
caaugacaucuca

SEQ ID NO: 1711640 - RNA, 15 nt, Homo sapiens
caaugacaucucagg

SEQ ID NO: 1711641 - RNA, 17 nt, Homo sapiens
caaugacaucucagggg

SEQ ID NO: 1711642 - RNA, 17 nt, Homo sapiens
caaugauacagucccua

SEQ ID NO: 1711643 - RNA, 18 nt, Homo sapiens
caaugcacauccauuccc

SEQ ID NO: 1711644 - RNA, 14 nt, Homo sapiens
caaugcauugcuaa

SEQ ID NO: 1711645 - RNA, 15 nt, Homo sapiens
caaugccaaucuuca

SEQ ID NO: 1711646 - RNA, 16 nt, Homo sapiens
caaugggcacugggau

SEQ ID NO: 1711647 - RNA, 23 nt, Homo sapiens
caauggugucaguauccaggcuu

SEQ ID NO: 1711648 - RNA, 19 nt, Homo sapiens
caaugucaggaacagaagg

SEQ ID NO: 1711649 - RNA, 18 nt, Homo sapiens
caaugugaaaaauguguc

SEQ ID NO: 1711650 - RNA, 21 nt, Homo sapiens
caaugugauucuaaugucuuc

SEQ ID NO: 1711651 - RNA, 18 nt, Homo sapiens
caauguguggcucagugc

SEQ ID NO: 1711652 - RNA, 22 nt, Homo sapiens
caauguuuguaauaauugcuca

SEQ ID NO: 1711653 - RNA, 17 nt, Homo sapiens
caauguuuuccacccau

SEQ ID NO: 1711654 - RNA, 19 nt, Homo sapiens
cgagcauaguccaaaaagc

SEQ ID NO: 1711655 - RNA, 22 nt, Homo sapiens
cgaggacuacaaccaauuuaca

SEQ ID NO: 1711656 - RNA, 14 nt, Homo sapiens
cgagggcagcugcu

SEQ ID NO: 1711657 - RNA, 14 nt, Homo sapiens
cgauauacagauga

SEQ ID NO: 1711658 - RNA, 15 nt, Homo sapiens
cgauguggaccucua

SEQ ID NO: 1711659 - RNA, 18 nt, Homo sapiens
cgauuauuuccaguguuc

SEQ ID NO: 1711660 - RNA, 19 nt, Homo sapiens
cgauugaaagaaccagaga

SEQ ID NO: 1711661 - RNA, 17 nt, Homo sapiens
cgcacacccucacucug

SEQ ID NO: 1711662 - RNA, 17 nt, Homo sapiens
cgcacuggggcuggcaa

SEQ ID NO: 1711663 - RNA, 15 nt, Homo sapiens
cgcaggcaucugauu

SEQ ID NO: 1711664 - RNA, 16 nt, Homo sapiens
cgcaucaggccuggca

SEQ ID NO: 1711665 - RNA, 20 nt, Homo sapiens
cgccagagggcuugugaaca

SEQ ID NO: 1711666 - RNA, 11 nt, Homo sapiens
cgcgcacacac

SEQ ID NO: 1711667 - RNA, 18 nt, Homo sapiens
cgcuacccacuucuaaau

SEQ ID NO: 1711668 - RNA, 10 nt, Homo sapiens
cgcuaugugc

SEQ ID NO: 1711669 - RNA, 12 nt, Homo sapiens
cgcuaugugcac

SEQ ID NO: 1711670 - RNA, 15 nt, Homo sapiens
cgcucgccacagucc

SEQ ID NO: 1711671 - RNA, 16 nt, Homo sapiens
cgcugacuucauggaa

SEQ ID NO: 1711672 - RNA, 22 nt, Homo sapiens
cgcugagcgucacggccaagug

SEQ ID NO: 1711673 - RNA, 16 nt, Homo sapiens
cgcuggaccuugaacu

SEQ ID NO: 1711674 - RNA, 14 nt, Homo sapiens
cgcugggugguacc

SEQ ID NO: 1711675 - RNA, 13 nt, Homo sapiens
cgcugucaaaagu

SEQ ID NO: 1711676 - RNA, 19 nt, Homo sapiens
cgcuucugccuuuucacug

SEQ ID NO: 1711677 - RNA, 15 nt, Homo sapiens
cgcuuuguugcccag

SEQ ID NO: 1711678 - RNA, 23 nt, Homo sapiens
cggaagcugucgacuucaugaca

SEQ ID NO: 1711679 - RNA, 18 nt, Homo sapiens
cggaaggucccucagaca

SEQ ID NO: 1711680 - RNA, 20 nt, Homo sapiens
cggauccagcaauuccugag

SEQ ID NO: 1711681 - RNA, 18 nt, Homo sapiens
cggcaucaaggugcugaa

SEQ ID NO: 1711682 - RNA, 21 nt, Homo sapiens
cggccccugcugguucagggu

SEQ ID NO: 1711683 - RNA, 21 nt, Homo sapiens
cggccuccucuccuacuuugg

SEQ ID NO: 1711684 - RNA, 15 nt, Homo sapiens
cgggagggcggcaca

SEQ ID NO: 1711685 - RNA, 22 nt, Homo sapiens
cgggccacgggaagaaccaagc

SEQ ID NO: 1711686 - RNA, 13 nt, Homo sapiens
cggggaagccgag

SEQ ID NO: 1711687 - RNA, 15 nt, Homo sapiens
cggguuacuuucaca

SEQ ID NO: 1711688 - RNA, 15 nt, Homo sapiens
cggugcaugaugcug

SEQ ID NO: 1711689 - RNA, 22 nt, Homo sapiens
cgguuuuuuauuuucuuuacaa

SEQ ID NO: 1711690 - RNA, 18 nt, Homo sapiens
cguaaacgacacucucug

SEQ ID NO: 1711691 - RNA, 15 nt, Homo sapiens
cguaacaacuguggu

SEQ ID NO: 1711692 - RNA, 20 nt, Homo sapiens
cguaauuaaaggaacagagu

SEQ ID NO: 1711693 - RNA, 21 nt, Homo sapiens
cgucagucuuuuucuguugua

SEQ ID NO: 1711694 - RNA, 20 nt, Homo sapiens
cguccagcuggaagggucaa

SEQ ID NO: 1711695 - RNA, 13 nt, Homo sapiens
cgucccuaccucc

SEQ ID NO: 1711696 - RNA, 23 nt, Homo sapiens
cgucgaggggcucucagcucagc

SEQ ID NO: 1711697 - RNA, 13 nt, Homo sapiens
cgucuaugcugcu

SEQ ID NO: 1711698 - RNA, 17 nt, Homo sapiens
cgugagcgccugugcac

SEQ ID NO: 1711699 - RNA, 16 nt, Homo sapiens
cgugcauuagcacaga

SEQ ID NO: 1711700 - RNA, 17 nt, Homo sapiens
cgugcucccgaugcugc

SEQ ID NO: 1711701 - RNA, 14 nt, Homo sapiens
cguggacucugcac

SEQ ID NO: 1711702 - RNA, 17 nt, Homo sapiens
cguggacucugcacaug

SEQ ID NO: 1711703 - RNA, 22 nt, Homo sapiens
cguggacucugcacaugucuug

SEQ ID NO: 1711704 - RNA, 12 nt, Homo sapiens
cguggacuuggc

SEQ ID NO: 1711705 - RNA, 20 nt, Homo sapiens
cguggggaacugcguggugc

SEQ ID NO: 1711706 - RNA, 21 nt, Homo sapiens
cguguguguugucugaacaug

SEQ ID NO: 1711707 - RNA, 20 nt, Homo sapiens
cguugaagaggaagggcaaa

SEQ ID NO: 1711708 - RNA, 23 nt, Homo sapiens
cuaaaaaaaaaauccagccucau

SEQ ID NO: 1711709 - RNA, 19 nt, Homo sapiens
cuaaaaauaaaccaaagga

SEQ ID NO: 1711710 - RNA, 14 nt, Homo sapiens
cuaaaacuggcaaa

SEQ ID NO: 1711711 - RNA, 12 nt, Homo sapiens
cuaaaagauuau

SEQ ID NO: 1711712 - RNA, 17 nt, Homo sapiens
cuaaaaggaaaucucac

SEQ ID NO: 1711713 - RNA, 20 nt, Homo sapiens
cuaaaaucccuggaucacga

SEQ ID NO: 1711714 - RNA, 16 nt, Homo sapiens
cuaaacucagaggcag

SEQ ID NO: 1711715 - RNA, 10 nt, Homo sapiens
cuaaacugua

SEQ ID NO: 1711716 - RNA, 22 nt, Homo sapiens
cuaaagauaauauuacuguuua

SEQ ID NO: 1711717 - RNA, 20 nt, Homo sapiens
cuaaagguccacaggucuag

SEQ ID NO: 1711718 - RNA, 22 nt, Homo sapiens
cuaaaguuaaauaggauauuaa

SEQ ID NO: 1711719 - RNA, 12 nt, Homo sapiens
cuaaaguucuaa

SEQ ID NO: 1711720 - RNA, 14 nt, Homo sapiens
cuaaaguucuaaga

SEQ ID NO: 1711721 - RNA, 13 nt, Homo sapiens
cuaaaucagagac

SEQ ID NO: 1711722 - RNA, 18 nt, Homo sapiens
cuaaaucagagacaaaau

SEQ ID NO: 1711723 - RNA, 14 nt, Homo sapiens
cuaacacgcacagc

SEQ ID NO: 1711724 - RNA, 14 nt, Homo sapiens
cuaacacggugcuc

SEQ ID NO: 1711725 - RNA, 14 nt, Homo sapiens
cuaaccccuuccag

SEQ ID NO: 1711726 - RNA, 16 nt, Homo sapiens
cuaaccuugaaugcug

SEQ ID NO: 1711727 - RNA, 18 nt, Homo sapiens
cuaacuguacauuucaca

SEQ ID NO: 1711728 - RNA, 15 nt, Homo sapiens
cuaagaaauauucca

SEQ ID NO: 1711729 - RNA, 23 nt, Homo sapiens
cuaagacugugacaacugucuaa

SEQ ID NO: 1711730 - RNA, 13 nt, Homo sapiens
cuaagauuaccuu

SEQ ID NO: 1711731 - RNA, 16 nt, Homo sapiens
cuaagauucuaaaggu

SEQ ID NO: 1711732 - RNA, 14 nt, Homo sapiens
cuaaggugugcucu

SEQ ID NO: 1711733 - RNA, 15 nt, Homo sapiens
cuaaguacacaauaa

SEQ ID NO: 1711734 - RNA, 20 nt, Homo sapiens
cuaaguauauuuaauucacu

SEQ ID NO: 1711735 - RNA, 17 nt, Homo sapiens
cuaaguguuuucaaaua

SEQ ID NO: 1711736 - RNA, 19 nt, Homo sapiens
cuaaguuucuaagauucua

SEQ ID NO: 1711737 - RNA, 16 nt, Homo sapiens
cuaauaaaacuuugac

SEQ ID NO: 1711738 - RNA, 17 nt, Homo sapiens
cuaauaaacauccuuca

SEQ ID NO: 1711739 - RNA, 14 nt, Homo sapiens
cuaauaauagcauu

SEQ ID NO: 1711740 - RNA, 16 nt, Homo sapiens
cuaauaauagcauuca

SEQ ID NO: 1711741 - RNA, 16 nt, Homo sapiens
cuaauacaacauguag

SEQ ID NO: 1711742 - RNA, 17 nt, Homo sapiens
cuaauauguaacaagcc

SEQ ID NO: 1711743 - RNA, 16 nt, Homo sapiens
cuaaucgaaugaacaa

SEQ ID NO: 1711744 - RNA, 14 nt, Homo sapiens
cuaauggcacuuau

SEQ ID NO: 1711745 - RNA, 16 nt, Homo sapiens
cuaauggggacacaga

SEQ ID NO: 1711746 - RNA, 15 nt, Homo sapiens
cuaauguaauaacug

SEQ ID NO: 1711747 - RNA, 22 nt, Homo sapiens
cuaauuaaaaaguuaaucuuca

SEQ ID NO: 1711748 - RNA, 23 nt, Homo sapiens
cuaauuaaaaaguuaaucuucau

SEQ ID NO: 1711749 - RNA, 18 nt, Homo sapiens
cuaauuggccucuuuaag

SEQ ID NO: 1711750 - RNA, 14 nt, Homo sapiens
cuaauuguguacau

SEQ ID NO: 1711751 - RNA, 18 nt, Homo sapiens
cuaauuugauguuuacag

SEQ ID NO: 1711752 - RNA, 21 nt, Homo sapiens
cuaauuugcauuaaauucaca

SEQ ID NO: 1711753 - RNA, 16 nt, Homo sapiens
cuaauuuuaguauuca

SEQ ID NO: 1711754 - RNA, 18 nt, Homo sapiens
cucauugacaagaacuga

SEQ ID NO: 1711755 - RNA, 23 nt, Homo sapiens
cucauugacaagaacugaaacca

SEQ ID NO: 1711756 - RNA, 13 nt, Homo sapiens
cucauuugucaca

SEQ ID NO: 1711757 - RNA, 17 nt, Homo sapiens
cucauuuuaguugccua

SEQ ID NO: 1711758 - RNA, 12 nt, Homo sapiens
cuccaagacaga

SEQ ID NO: 1711759 - RNA, 13 nt, Homo sapiens
cuccaagcuccau

SEQ ID NO: 1711760 - RNA, 17 nt, Homo sapiens
cuccaaugaaagacacu

SEQ ID NO: 1711761 - RNA, 17 nt, Homo sapiens
cuccaaugucugcugag

SEQ ID NO: 1711762 - RNA, 21 nt, Homo sapiens
acggcgugccuggacacugua

SEQ ID NO: 1711763 - RNA, 19 nt, Homo sapiens
acgggaauucagacaagcu

SEQ ID NO: 1711764 - RNA, 18 nt, Homo sapiens
acgggcaugggcacuccc

SEQ ID NO: 1711765 - RNA, 20 nt, Homo sapiens
acgguagugccugaaauuuc

SEQ ID NO: 1711766 - RNA, 23 nt, Homo sapiens
acguacaaaauccagcuaugaau

SEQ ID NO: 1711767 - RNA, 16 nt, Homo sapiens
acguaugguggcucau

SEQ ID NO: 1711768 - RNA, 16 nt, Homo sapiens
acgugccggcccuccu

SEQ ID NO: 1711769 - RNA, 19 nt, Homo sapiens
acguggaaccucugucuca

SEQ ID NO: 1711770 - RNA, 18 nt, Homo sapiens
acgugucuuccacuuugc

SEQ ID NO: 1711771 - RNA, 17 nt, Homo sapiens
acguucauuugugugcu

SEQ ID NO: 1711772 - RNA, 22 nt, Homo sapiens
acguugccuaauaaacauccuu

SEQ ID NO: 1711773 - RNA, 15 nt, Homo sapiens
acguuuucuuucaca

SEQ ID NO: 1711774 - RNA, 22 nt, Homo sapiens
acuaaaauuuuaggcacucuua

SEQ ID NO: 1711775 - RNA, 16 nt, Homo sapiens
acuaaacauaugauuu

SEQ ID NO: 1711776 - RNA, 11 nt, Homo sapiens
acuaaagccag

SEQ ID NO: 1711777 - RNA, 18 nt, Homo sapiens
acuaaaggugcacugcuu

SEQ ID NO: 1711778 - RNA, 17 nt, Homo sapiens
acuaaaguauaucuuua

SEQ ID NO: 1711779 - RNA, 14 nt, Homo sapiens
acuaaauuugauac

SEQ ID NO: 1711780 - RNA, 21 nt, Homo sapiens
acuaaccccaacgcacaggaa

SEQ ID NO: 1711781 - RNA, 21 nt, Homo sapiens
acuaacuccugagaaauguua

SEQ ID NO: 1711782 - RNA, 17 nt, Homo sapiens
acuaaucgaaugaacaa

SEQ ID NO: 1711783 - RNA, 14 nt, Homo sapiens
acuaauuaggcaag

SEQ ID NO: 1711784 - RNA, 21 nt, Homo sapiens
acuaauuuuaguauucauucu

SEQ ID NO: 1711785 - RNA, 14 nt, Homo sapiens
acuacagcucuuaa

SEQ ID NO: 1711786 - RNA, 13 nt, Homo sapiens
acuaccuguguau

SEQ ID NO: 1711787 - RNA, 15 nt, Homo sapiens
acuagaacucuccau

SEQ ID NO: 1711788 - RNA, 13 nt, Homo sapiens
acuaggacacucc

SEQ ID NO: 1711789 - RNA, 14 nt, Homo sapiens
acuaggcucagaga

SEQ ID NO: 1711790 - RNA, 19 nt, Homo sapiens
acuaguacuguguacugua

SEQ ID NO: 1711791 - RNA, 12 nt, Homo sapiens
acuaguuuauuu

SEQ ID NO: 1711792 - RNA, 16 nt, Homo sapiens
acuaguuuucaaucau

SEQ ID NO: 1711793 - RNA, 22 nt, Homo sapiens
acuauagccuaggugacagagu

SEQ ID NO: 1711794 - RNA, 19 nt, Homo sapiens
acuaugaaguaagcaacaa

SEQ ID NO: 1711795 - RNA, 19 nt, Homo sapiens
acuauggagccuggcacag

SEQ ID NO: 1711796 - RNA, 15 nt, Homo sapiens
acuauguugcccagg

SEQ ID NO: 1711797 - RNA, 14 nt, Homo sapiens
acuauugcauuuau

SEQ ID NO: 1711798 - RNA, 17 nt, Homo sapiens
acucaaggaauuugcau

SEQ ID NO: 1711799 - RNA, 16 nt, Homo sapiens
acucaauggaguaugu

SEQ ID NO: 1711800 - RNA, 16 nt, Homo sapiens
acucacaagugcucau

SEQ ID NO: 1711801 - RNA, 20 nt, Homo sapiens
acucacuccacaacccaaga

SEQ ID NO: 1711802 - RNA, 20 nt, Homo sapiens
acucagaggaggacauuugg

SEQ ID NO: 1711803 - RNA, 13 nt, Homo sapiens
acucaggccagug

SEQ ID NO: 1711804 - RNA, 18 nt, Homo sapiens
acucagggacagagccau

SEQ ID NO: 1711805 - RNA, 20 nt, Homo sapiens
acucagggcuccucccagcu

SEQ ID NO: 1711806 - RNA, 20 nt, Homo sapiens
acuccaaugucugcugagga

SEQ ID NO: 1711807 - RNA, 21 nt, Homo sapiens
acuccagauuuuuuacagcug

SEQ ID NO: 1711808 - RNA, 19 nt, Homo sapiens
acuccagcgcugaguggga

SEQ ID NO: 1711809 - RNA, 13 nt, Homo sapiens
acuccaugcugcc

SEQ ID NO: 1711810 - RNA, 14 nt, Homo sapiens
acucccaugaagcc

SEQ ID NO: 1711811 - RNA, 17 nt, Homo sapiens
acucccugcagaugcca

SEQ ID NO: 1711812 - RNA, 17 nt, Homo sapiens
acucccuugguggcaag

SEQ ID NO: 1711813 - RNA, 14 nt, Homo sapiens
acuccucuuuacac

SEQ ID NO: 1711814 - RNA, 23 nt, Homo sapiens
acuccugacgucugaagcuugac

SEQ ID NO: 1711815 - RNA, 18 nt, Homo sapiens
acuccugacuccuaccug

SEQ ID NO: 1711816 - RNA, 14 nt, Homo sapiens
acuccugacuguaa

SEQ ID NO: 1711817 - RNA, 16 nt, Homo sapiens
acuccuuggccuagcc

SEQ ID NO: 1711818 - RNA, 21 nt, Homo sapiens
acucgcuuguaaauaccagga

SEQ ID NO: 1711819 - RNA, 21 nt, Homo sapiens
acucuagaugaaguuuuacau

SEQ ID NO: 1711820 - RNA, 12 nt, Homo sapiens
acucugcacaug

SEQ ID NO: 1711821 - RNA, 15 nt, Homo sapiens
acucugcacaugucu

SEQ ID NO: 1711822 - RNA, 18 nt, Homo sapiens
acucugcacaugucuugu

SEQ ID NO: 1711823 - RNA, 22 nt, Homo sapiens
acucugcugcuuagacauaaca

SEQ ID NO: 1711824 - RNA, 20 nt, Homo sapiens
acucuggggugcugccugaa

SEQ ID NO: 1711825 - RNA, 17 nt, Homo sapiens
acucuguuauuuagacu

SEQ ID NO: 1711826 - RNA, 15 nt, Homo sapiens
acucuuaucugggug

SEQ ID NO: 1711827 - RNA, 21 nt, Homo sapiens
acucuuaucugggugccuuaa

SEQ ID NO: 1711828 - RNA, 12 nt, Homo sapiens
acucuugcaggg

SEQ ID NO: 1711829 - RNA, 18 nt, Homo sapiens
acucuuguggucaucaug

SEQ ID NO: 1711830 - RNA, 14 nt, Homo sapiens
acugaaacauuuaa

SEQ ID NO: 1711831 - RNA, 16 nt, Homo sapiens
acugaaggugauucac

SEQ ID NO: 1711832 - RNA, 19 nt, Homo sapiens
acugaauguuuauuccuug

SEQ ID NO: 1711833 - RNA, 20 nt, Homo sapiens
acugaauuuuuugucuguua

SEQ ID NO: 1711834 - RNA, 17 nt, Homo sapiens
acugacaaccucaucca

SEQ ID NO: 1711835 - RNA, 14 nt, Homo sapiens
acugacacaggaaa

SEQ ID NO: 1711836 - RNA, 18 nt, Homo sapiens
acugacagcaugugcccu

SEQ ID NO: 1711837 - RNA, 11 nt, Homo sapiens
acugaccagcc

SEQ ID NO: 1711838 - RNA, 15 nt, Homo sapiens
acugaccagccucca

SEQ ID NO: 1711839 - RNA, 17 nt, Homo sapiens
acugaccauauugugcu

SEQ ID NO: 1711840 - RNA, 12 nt, Homo sapiens
acugacuacugg

SEQ ID NO: 1711841 - RNA, 12 nt, Homo sapiens
acugacuuucau

SEQ ID NO: 1711842 - RNA, 22 nt, Homo sapiens
acugagccccgcagaccucccc

SEQ ID NO: 1711843 - RNA, 20 nt, Homo sapiens
acugaguguuauuugcacac

SEQ ID NO: 1711844 - RNA, 15 nt, Homo sapiens
acugauaucuggccu

SEQ ID NO: 1711845 - RNA, 17 nt, Homo sapiens
acugauaucuggccuaa

SEQ ID NO: 1711846 - RNA, 15 nt, Homo sapiens
acugauuaugucuuu

SEQ ID NO: 1711847 - RNA, 19 nt, Homo sapiens
acugcaaagcucggugcuc

SEQ ID NO: 1711848 - RNA, 16 nt, Homo sapiens
acugcaugaaugaaac

SEQ ID NO: 1711849 - RNA, 19 nt, Homo sapiens
acugcccgcacacccucac

SEQ ID NO: 1711850 - RNA, 14 nt, Homo sapiens
acugccgcugagaa

SEQ ID NO: 1711851 - RNA, 13 nt, Homo sapiens
acugccucugcca

SEQ ID NO: 1711852 - RNA, 22 nt, Homo sapiens
acugccucugccacacucugac

SEQ ID NO: 1711853 - RNA, 14 nt, Homo sapiens
acugcgacugugac

SEQ ID NO: 1711854 - RNA, 19 nt, Homo sapiens
acugcgccgaccccgccac

SEQ ID NO: 1711855 - RNA, 19 nt, Homo sapiens
acugcucccugaagccagc

SEQ ID NO: 1711856 - RNA, 18 nt, Homo sapiens
acugcucuguguuuacag

SEQ ID NO: 1711857 - RNA, 18 nt, Homo sapiens
acuggaaguucauaccua

SEQ ID NO: 1711858 - RNA, 16 nt, Homo sapiens
acuggauucauucuca

SEQ ID NO: 1711859 - RNA, 17 nt, Homo sapiens
acuggauucauucucau

SEQ ID NO: 1711860 - RNA, 14 nt, Homo sapiens
acuggcugcaaagg

SEQ ID NO: 1711861 - RNA, 20 nt, Homo sapiens
acuggggagucuuuguggau

SEQ ID NO: 1711862 - RNA, 23 nt, Homo sapiens
acuggggccuccagaacucacug

SEQ ID NO: 1711863 - RNA, 17 nt, Homo sapiens
acuggguaaaugcaaag

SEQ ID NO: 1711864 - RNA, 16 nt, Homo sapiens
acuggugugcucucuu

SEQ ID NO: 1711865 - RNA, 15 nt, Homo sapiens
acuguaauaauaccu

SEQ ID NO: 1711866 - RNA, 17 nt, Homo sapiens
acuguaauaauaccuca

SEQ ID NO: 1711867 - RNA, 13 nt, Homo sapiens
acuguacuccucc

SEQ ID NO: 1711868 - RNA, 15 nt, Homo sapiens
acuguaucaagucau

SEQ ID NO: 1711869 - RNA, 16 nt, Homo sapiens
acuguccuacccaccc

SEQ ID NO: 1711870 - RNA, 12 nt, Homo sapiens
acugucucaaga

SEQ ID NO: 1711871 - RNA, 14 nt, Homo sapiens
acugucucacuuaa

SEQ ID NO: 1711872 - RNA, 13 nt, Homo sapiens
acccccagcucaa

SEQ ID NO: 1711873 - RNA, 16 nt, Homo sapiens
acccccaggucugcag

SEQ ID NO: 1711874 - RNA, 21 nt, Homo sapiens
accccggcaggcccugcagug

SEQ ID NO: 1711875 - RNA, 16 nt, Homo sapiens
accccuaggaacucag

SEQ ID NO: 1711876 - RNA, 14 nt, Homo sapiens
accccuccaggaau

SEQ ID NO: 1711877 - RNA, 23 nt, Homo sapiens
accccucccucuguccaccagcc

SEQ ID NO: 1711878 - RNA, 13 nt, Homo sapiens
accccuccucacu

SEQ ID NO: 1711879 - RNA, 13 nt, Homo sapiens
accccucugggaa

SEQ ID NO: 1711880 - RNA, 18 nt, Homo sapiens
accccuguccucacugcu

SEQ ID NO: 1711881 - RNA, 18 nt, Homo sapiens
accccuuagccucccuga

SEQ ID NO: 1711882 - RNA, 21 nt, Homo sapiens
acccgaccggugcaugaugcu

SEQ ID NO: 1711883 - RNA, 18 nt, Homo sapiens
acccgacugaaacuggaa

SEQ ID NO: 1711884 - RNA, 16 nt, Homo sapiens
acccuacacccagacc

SEQ ID NO: 1711885 - RNA, 20 nt, Homo sapiens
acccuagccaaugucuccuc

SEQ ID NO: 1711886 - RNA, 20 nt, Homo sapiens
acccuaguucuaccucaggc

SEQ ID NO: 1711887 - RNA, 18 nt, Homo sapiens
acccuauacaacuggaca

SEQ ID NO: 1711888 - RNA, 22 nt, Homo sapiens
acccuccuuucaccacaugugc

SEQ ID NO: 1711889 - RNA, 19 nt, Homo sapiens
acccucugccaccagagac

SEQ ID NO: 1711890 - RNA, 17 nt, Homo sapiens
acccucuuccugugauc

SEQ ID NO: 1711891 - RNA, 11 nt, Homo sapiens
acccugagaac

SEQ ID NO: 1711892 - RNA, 16 nt, Homo sapiens
acccugcgauuuugcc

SEQ ID NO: 1711893 - RNA, 15 nt, Homo sapiens
acccugcugaccucc

SEQ ID NO: 1711894 - RNA, 16 nt, Homo sapiens
acccugcugaccuccc

SEQ ID NO: 1711895 - RNA, 15 nt, Homo sapiens
acccuggaaauggac

SEQ ID NO: 1711896 - RNA, 18 nt, Homo sapiens
acccuguaccucauccca

SEQ ID NO: 1711897 - RNA, 18 nt, Homo sapiens
acccuguagcgccagugu

SEQ ID NO: 1711898 - RNA, 19 nt, Homo sapiens
acccuguagcgccagugua

SEQ ID NO: 1711899 - RNA, 19 nt, Homo sapiens
acccuguagguucuugaua

SEQ ID NO: 1711900 - RNA, 14 nt, Homo sapiens
acccuguuuuacaa

SEQ ID NO: 1711901 - RNA, 22 nt, Homo sapiens
acccuucccaaucagcacugaa

SEQ ID NO: 1711902 - RNA, 22 nt, Homo sapiens
acccuucccugcacuaaagcca

SEQ ID NO: 1711903 - RNA, 18 nt, Homo sapiens
acccuuccuucuguaaau

SEQ ID NO: 1711904 - RNA, 17 nt, Homo sapiens
acccuucuuuugaagga

SEQ ID NO: 1711905 - RNA, 16 nt, Homo sapiens
acccuuggacaagaca

SEQ ID NO: 1711906 - RNA, 19 nt, Homo sapiens
acccuuggagccaauggag

SEQ ID NO: 1711907 - RNA, 16 nt, Homo sapiens
accgagucucuucucc

SEQ ID NO: 1711908 - RNA, 13 nt, Homo sapiens
accgccacugggc

SEQ ID NO: 1711909 - RNA, 23 nt, Homo sapiens
accgcuucugccuuuucacugug

SEQ ID NO: 1711910 - RNA, 18 nt, Homo sapiens
accggcuggcagggcugg

SEQ ID NO: 1711911 - RNA, 21 nt, Homo sapiens
accggggccagcaccacuucc

SEQ ID NO: 1711912 - RNA, 15 nt, Homo sapiens
accguaaauguccau

SEQ ID NO: 1711913 - RNA, 22 nt, Homo sapiens
accguccucaccccuguccuca

SEQ ID NO: 1711914 - RNA, 23 nt, Homo sapiens
accuaaaaggaaaucucacccca

SEQ ID NO: 1711915 - RNA, 20 nt, Homo sapiens
accuaaacgguucaguuucu

SEQ ID NO: 1711916 - RNA, 17 nt, Homo sapiens
accuaaguacuguaaua

SEQ ID NO: 1711917 - RNA, 18 nt, Homo sapiens
accuaagucucugugaau

SEQ ID NO: 1711918 - RNA, 12 nt, Homo sapiens
accuaccaaaau

SEQ ID NO: 1711919 - RNA, 17 nt, Homo sapiens
accuaccaaaauggaau

SEQ ID NO: 1711920 - RNA, 13 nt, Homo sapiens
accuaccaucagg

SEQ ID NO: 1711921 - RNA, 20 nt, Homo sapiens
accuacuuuucuuuccucag

SEQ ID NO: 1711922 - RNA, 23 nt, Homo sapiens
accuaguacgacuucauuccuuc

SEQ ID NO: 1711923 - RNA, 23 nt, Homo sapiens
accuauaauguguguauguguau

SEQ ID NO: 1711924 - RNA, 13 nt, Homo sapiens
accucacagugac

SEQ ID NO: 1711925 - RNA, 12 nt, Homo sapiens
accucacuguga

SEQ ID NO: 1711926 - RNA, 20 nt, Homo sapiens
accucaguucccucuugcuc

SEQ ID NO: 1711927 - RNA, 16 nt, Homo sapiens
accucauccaggcuac

SEQ ID NO: 1711928 - RNA, 15 nt, Homo sapiens
accucaucccaugag

SEQ ID NO: 1711929 - RNA, 23 nt, Homo sapiens
accuccccagccccuagcccagg

SEQ ID NO: 1711930 - RNA, 16 nt, Homo sapiens
accuccgccaaugcac

SEQ ID NO: 1711931 - RNA, 11 nt, Homo sapiens
accuccucaug

SEQ ID NO: 1711932 - RNA, 18 nt, Homo sapiens
accuccuuggguagugag

SEQ ID NO: 1711933 - RNA, 22 nt, Homo sapiens
accucgggaaacuuagaucauc

SEQ ID NO: 1711934 - RNA, 13 nt, Homo sapiens
accucgugaucca

SEQ ID NO: 1711935 - RNA, 14 nt, Homo sapiens
accucuacuuucca

SEQ ID NO: 1711936 - RNA, 19 nt, Homo sapiens
accucucuccuuugcugag

SEQ ID NO: 1711937 - RNA, 17 nt, Homo sapiens
accucugccugaaguca

SEQ ID NO: 1711938 - RNA, 16 nt, Homo sapiens
accucugugaccucag

SEQ ID NO: 1711939 - RNA, 14 nt, Homo sapiens
accucuuauugcaa

SEQ ID NO: 1711940 - RNA, 22 nt, Homo sapiens
accucuuccuccucgcugccag

SEQ ID NO: 1711941 - RNA, 14 nt, Homo sapiens
accugaaauuccaa

SEQ ID NO: 1711942 - RNA, 22 nt, Homo sapiens
accugaaauuccaaagucucua

SEQ ID NO: 1711943 - RNA, 17 nt, Homo sapiens
accugaagacugaggac

SEQ ID NO: 1711944 - RNA, 18 nt, Homo sapiens
accugaucacuagccugu

SEQ ID NO: 1711945 - RNA, 18 nt, Homo sapiens
accugcacuuaaggcacu

SEQ ID NO: 1711946 - RNA, 19 nt, Homo sapiens
accugcagggacuccaugc

SEQ ID NO: 1711947 - RNA, 17 nt, Homo sapiens
accugcaugugcuguca

SEQ ID NO: 1711948 - RNA, 19 nt, Homo sapiens
accugcccaaggaugcugu

SEQ ID NO: 1711949 - RNA, 22 nt, Homo sapiens
accugcccaaggaugcugucaa

SEQ ID NO: 1711950 - RNA, 18 nt, Homo sapiens
accugccugcgucuuccg

SEQ ID NO: 1711951 - RNA, 19 nt, Homo sapiens
accugcucuccucuugcca

SEQ ID NO: 1711952 - RNA, 23 nt, Homo sapiens
accugcucuuguucuacugagaa

SEQ ID NO: 1711953 - RNA, 20 nt, Homo sapiens
accugggcccaggaccugcc

SEQ ID NO: 1711954 - RNA, 21 nt, Homo sapiens
accuggggcacaguccaggaa

SEQ ID NO: 1711955 - RNA, 20 nt, Homo sapiens
accuguacacugacuugaga

SEQ ID NO: 1711956 - RNA, 16 nt, Homo sapiens
accuguagucccagcu

SEQ ID NO: 1711957 - RNA, 16 nt, Homo sapiens
accugucacauugcau

SEQ ID NO: 1711958 - RNA, 15 nt, Homo sapiens
accugucuccacugu

SEQ ID NO: 1711959 - RNA, 17 nt, Homo sapiens
accugucuccacugugc

SEQ ID NO: 1711960 - RNA, 19 nt, Homo sapiens
accuguugguuagauucaa

SEQ ID NO: 1711961 - RNA, 22 nt, Homo sapiens
accuguuuucgcaccuaccauc

SEQ ID NO: 1711962 - RNA, 18 nt, Homo sapiens
accuucaagaaccaggca

SEQ ID NO: 1711963 - RNA, 19 nt, Homo sapiens
accuuccagcuccuguaac

SEQ ID NO: 1711964 - RNA, 18 nt, Homo sapiens
accuuccccagcguccca

SEQ ID NO: 1711965 - RNA, 12 nt, Homo sapiens
accuucuuucac

SEQ ID NO: 1711966 - RNA, 19 nt, Homo sapiens
accuuggaucagaugaacu

SEQ ID NO: 1711967 - RNA, 17 nt, Homo sapiens
accuugugucuguacac

SEQ ID NO: 1711968 - RNA, 23 nt, Homo sapiens
accuuguguguuccaaguuucca

SEQ ID NO: 1711969 - RNA, 16 nt, Homo sapiens
accuuuuauguagcac

SEQ ID NO: 1711970 - RNA, 22 nt, Homo sapiens
accuuuuggugaaagcugagaa

SEQ ID NO: 1711971 - RNA, 23 nt, Homo sapiens
acgaaacacaaaccacaacugac

SEQ ID NO: 1711972 - RNA, 22 nt, Homo sapiens
acgaauauagaggguuuugcuc

SEQ ID NO: 1711973 - RNA, 15 nt, Homo sapiens
acgacuaaguugaau

SEQ ID NO: 1711974 - RNA, 20 nt, Homo sapiens
acgagcauaguccaaaaagc

SEQ ID NO: 1711975 - RNA, 17 nt, Homo sapiens
acgaggccacagcugcc

SEQ ID NO: 1711976 - RNA, 13 nt, Homo sapiens
acgauuugucagu

SEQ ID NO: 1711977 - RNA, 15 nt, Homo sapiens
acgcagaucacuaaa

SEQ ID NO: 1711978 - RNA, 21 nt, Homo sapiens
acgccacugcacuauagccua

SEQ ID NO: 1711979 - RNA, 20 nt, Homo sapiens
acgcuagggcggggcacaga

SEQ ID NO: 1711980 - RNA, 18 nt, Homo sapiens
acggagucuugcucuguc

SEQ ID NO: 1711981 - RNA, 23 nt, Homo sapiens
acaguuuauuuuuauacuuucag

SEQ ID NO: 1711982 - RNA, 15 nt, Homo sapiens
acaguuugaugucau

SEQ ID NO: 1711983 - RNA, 12 nt, Homo sapiens
acauaaagccau

SEQ ID NO: 1711984 - RNA, 21 nt, Homo sapiens
acauaacucuguaaaaacacu

SEQ ID NO: 1711985 - RNA, 19 nt, Homo sapiens
acauaagggguuugccauu

SEQ ID NO: 1711986 - RNA, 17 nt, Homo sapiens
acauaccuggcccaacc

SEQ ID NO: 1711987 - RNA, 14 nt, Homo sapiens
acauacuuucaucc

SEQ ID NO: 1711988 - RNA, 19 nt, Homo sapiens
acauagauuaauggcacug

SEQ ID NO: 1711989 - RNA, 16 nt, Homo sapiens
acauaguuuauuucaa

SEQ ID NO: 1711990 - RNA, 13 nt, Homo sapiens
acauaucugucau

SEQ ID NO: 1711991 - RNA, 15 nt, Homo sapiens
acauccaacuccagc

SEQ ID NO: 1711992 - RNA, 20 nt, Homo sapiens
acauccccuuuguguagaaa

SEQ ID NO: 1711993 - RNA, 18 nt, Homo sapiens
acaucggccuccaugacc

SEQ ID NO: 1711994 - RNA, 12 nt, Homo sapiens
acaucucagaaa

SEQ ID NO: 1711995 - RNA, 18 nt, Homo sapiens
acaucugagagaugacag

SEQ ID NO: 1711996 - RNA, 22 nt, Homo sapiens
acaucuggccuugaaaccaccu

SEQ ID NO: 1711997 - RNA, 13 nt, Homo sapiens
acaucuuuuacau

SEQ ID NO: 1711998 - RNA, 22 nt, Homo sapiens
acaucuuuuuaaagcuuaucca

SEQ ID NO: 1711999 - RNA, 18 nt, Homo sapiens
acaugaaucccacccaca

SEQ ID NO: 1712000 - RNA, 14 nt, Homo sapiens
acaugacacugacc

SEQ ID NO: 1712001 - RNA, 19 nt, Homo sapiens
acaugagaacaaacagauc

SEQ ID NO: 1712002 - RNA, 21 nt, Homo sapiens
acaugcacacacacacaucuc

SEQ ID NO: 1712003 - RNA, 13 nt, Homo sapiens
acaugcacugacc

SEQ ID NO: 1712004 - RNA, 23 nt, Homo sapiens
acaugcagcccagaauagcuuug

SEQ ID NO: 1712005 - RNA, 16 nt, Homo sapiens
acaugcuuaugacaau

SEQ ID NO: 1712006 - RNA, 22 nt, Homo sapiens
acaugcuuaugacaaugacugu

SEQ ID NO: 1712007 - RNA, 17 nt, Homo sapiens
acauggacugcuucauc

SEQ ID NO: 1712008 - RNA, 19 nt, Homo sapiens
acauggccuaugcacauau

SEQ ID NO: 1712009 - RNA, 21 nt, Homo sapiens
acauggccuaugcacauaugg

SEQ ID NO: 1712010 - RNA, 18 nt, Homo sapiens
acaugugacacauaugca

SEQ ID NO: 1712011 - RNA, 14 nt, Homo sapiens
acaugugauuguga

SEQ ID NO: 1712012 - RNA, 15 nt, Homo sapiens
acaugugauugugau

SEQ ID NO: 1712013 - RNA, 16 nt, Homo sapiens
acaugugauugugauu

SEQ ID NO: 1712014 - RNA, 20 nt, Homo sapiens
acauguguagccugugcaug

SEQ ID NO: 1712015 - RNA, 16 nt, Homo sapiens
acauguguguauauau

SEQ ID NO: 1712016 - RNA, 22 nt, Homo sapiens
acauguucauggguuuaccacu

SEQ ID NO: 1712017 - RNA, 15 nt, Homo sapiens
acauuauacauuuga

SEQ ID NO: 1712018 - RNA, 19 nt, Homo sapiens
acauuauuucuaguccaaa

SEQ ID NO: 1712019 - RNA, 18 nt, Homo sapiens
acauucaauagcauauca

SEQ ID NO: 1712020 - RNA, 24 nt, Homo sapiens
acauuccuuagucucaagggcuag

SEQ ID NO: 1712021 - RNA, 20 nt, Homo sapiens
acauucugcaagcacaucug

SEQ ID NO: 1712022 - RNA, 13 nt, Homo sapiens
acauucuuccaaa

SEQ ID NO: 1712023 - RNA, 21 nt, Homo sapiens
acauucuuguuuuaagugccu

SEQ ID NO: 1712024 - RNA, 20 nt, Homo sapiens
acauugcauucuauugccuu

SEQ ID NO: 1712025 - RNA, 12 nt, Homo sapiens
acauugugccuu

SEQ ID NO: 1712026 - RNA, 23 nt, Homo sapiens
acauugugucagauuaccaguua

SEQ ID NO: 1712027 - RNA, 17 nt, Homo sapiens
acauuuaaaauugcuau

SEQ ID NO: 1712028 - RNA, 19 nt, Homo sapiens
acauuucuguaaauaccau

SEQ ID NO: 1712029 - RNA, 21 nt, Homo sapiens
acauuuuuuaugggcauugac

SEQ ID NO: 1712030 - RNA, 14 nt, Homo sapiens
accaaacacccaca

SEQ ID NO: 1712031 - RNA, 16 nt, Homo sapiens
accaaagaaauuauaa

SEQ ID NO: 1712032 - RNA, 13 nt, Homo sapiens
accaaagcugccc

SEQ ID NO: 1712033 - RNA, 16 nt, Homo sapiens
accaaagcugcccacu

SEQ ID NO: 1712034 - RNA, 18 nt, Homo sapiens
accaaagcugcccacugu

SEQ ID NO: 1712035 - RNA, 18 nt, Homo sapiens
accaacugggcccaagac

SEQ ID NO: 1712036 - RNA, 17 nt, Homo sapiens
accaagaacauaagaau

SEQ ID NO: 1712037 - RNA, 17 nt, Homo sapiens
accaagcuauuccuuuc

SEQ ID NO: 1712038 - RNA, 21 nt, Homo sapiens
accaaggcgggagcaucucuu

SEQ ID NO: 1712039 - RNA, 23 nt, Homo sapiens
accaaggggugggccacagccau

SEQ ID NO: 1712040 - RNA, 13 nt, Homo sapiens
accaauagcuuua

SEQ ID NO: 1712041 - RNA, 15 nt, Homo sapiens
accaauugugcugcc

SEQ ID NO: 1712042 - RNA, 17 nt, Homo sapiens
accaauugugcugccau

SEQ ID NO: 1712043 - RNA, 15 nt, Homo sapiens
accacaacugacaca

SEQ ID NO: 1712044 - RNA, 21 nt, Homo sapiens
accacaagggcucucuuaggc

SEQ ID NO: 1712045 - RNA, 22 nt, Homo sapiens
accacaagggcucucuuaggca

SEQ ID NO: 1712046 - RNA, 11 nt, Homo sapiens
accacacaaag

SEQ ID NO: 1712047 - RNA, 13 nt, Homo sapiens
accacacaccuca

SEQ ID NO: 1712048 - RNA, 14 nt, Homo sapiens
accacaccaucagg

SEQ ID NO: 1712049 - RNA, 23 nt, Homo sapiens
ugacucccaaguuuccauagcaa

SEQ ID NO: 1712050 - RNA, 19 nt, Homo sapiens
ugacucccagaucagucag

SEQ ID NO: 1712051 - RNA, 24 nt, Homo sapiens
ugacuguaacauauucuguaugaa

SEQ ID NO: 1712052 - RNA, 12 nt, Homo sapiens
ugacuguaucug

SEQ ID NO: 1712053 - RNA, 15 nt, Homo sapiens
ugacugucucacuua

SEQ ID NO: 1712054 - RNA, 21 nt, Homo sapiens
ugacugugcuacugucuuugg

SEQ ID NO: 1712055 - RNA, 23 nt, Homo sapiens
ugacuguucuugcgggggauaaa

SEQ ID NO: 1712056 - RNA, 18 nt, Homo sapiens
ugacuuaguugcguuaca

SEQ ID NO: 1712057 - RNA, 12 nt, Homo sapiens
ugagaacaaagc

SEQ ID NO: 1712058 - RNA, 18 nt, Homo sapiens
ugagaaccccucugggaa

SEQ ID NO: 1712059 - RNA, 13 nt, Homo sapiens
ugagaagaucuga

SEQ ID NO: 1712060 - RNA, 18 nt, Homo sapiens
ugagaagccuucagcucc

SEQ ID NO: 1712061 - RNA, 19 nt, Homo sapiens
ugagaaggcagccaccagc

SEQ ID NO: 1712062 - RNA, 15 nt, Homo sapiens
ugagaauguggaaua

SEQ ID NO: 1712063 - RNA, 20 nt, Homo sapiens
ugagaauguggaauaccuaa

SEQ ID NO: 1712064 - RNA, 22 nt, Homo sapiens
ugagaguaucaggucucccacg

SEQ ID NO: 1712065 - RNA, 22 nt, Homo sapiens
ugagagucuagauucucuggcu

SEQ ID NO: 1712066 - RNA, 18 nt, Homo sapiens
ugagauauuugguaccau

SEQ ID NO: 1712067 - RNA, 23 nt, Homo sapiens
ugagaucuaaggaugucacaggg

SEQ ID NO: 1712068 - RNA, 13 nt, Homo sapiens
ugagaugcuggag

SEQ ID NO: 1712069 - RNA, 20 nt, Homo sapiens
ugagauuuccuccuggccuu

SEQ ID NO: 1712070 - RNA, 14 nt, Homo sapiens
ugagcaaaggugau

SEQ ID NO: 1712071 - RNA, 17 nt, Homo sapiens
ugagcaaccgcuucccu

SEQ ID NO: 1712072 - RNA, 16 nt, Homo sapiens
ugagcaacucuugauu

SEQ ID NO: 1712073 - RNA, 18 nt, Homo sapiens
ugagcagaaguggagcug

SEQ ID NO: 1712074 - RNA, 19 nt, Homo sapiens
ugagcagugagcagaaagc

SEQ ID NO: 1712075 - RNA, 13 nt, Homo sapiens
ugagccacugcac

SEQ ID NO: 1712076 - RNA, 17 nt, Homo sapiens
ugagccgugaacugugc

SEQ ID NO: 1712077 - RNA, 14 nt, Homo sapiens
ugagcgcauggcaa

SEQ ID NO: 1712078 - RNA, 21 nt, Homo sapiens
ugagcuauugcuguucucuug

SEQ ID NO: 1712079 - RNA, 21 nt, Homo sapiens
ugagcuggccucucuagcaca

SEQ ID NO: 1712080 - RNA, 16 nt, Homo sapiens
ugaggaagucacuuua

SEQ ID NO: 1712081 - RNA, 23 nt, Homo sapiens
ugaggacuuaaaauauuccugca

SEQ ID NO: 1712082 - RNA, 16 nt, Homo sapiens
ugaggaggaugucccu

SEQ ID NO: 1712083 - RNA, 17 nt, Homo sapiens
ugaggaugauguuauuc

SEQ ID NO: 1712084 - RNA, 20 nt, Homo sapiens
ugaggaugauguuauucaca

SEQ ID NO: 1712085 - RNA, 20 nt, Homo sapiens
ugaggcccugcccaaugaga

SEQ ID NO: 1712086 - RNA, 23 nt, Homo sapiens
ugaggcugggcgucuaugcugcu

SEQ ID NO: 1712087 - RNA, 16 nt, Homo sapiens
ugagggaaaaugagua

SEQ ID NO: 1712088 - RNA, 15 nt, Homo sapiens
ugagggaaagugcau

SEQ ID NO: 1712089 - RNA, 13 nt, Homo sapiens
ugagggacugccu

SEQ ID NO: 1712090 - RNA, 22 nt, Homo sapiens
ugaggggguaauaaaccuccuu

SEQ ID NO: 1712091 - RNA, 12 nt, Homo sapiens
ugaggggucccc

SEQ ID NO: 1712092 - RNA, 12 nt, Homo sapiens
ugaggucaggga

SEQ ID NO: 1712093 - RNA, 16 nt, Homo sapiens
ugaggugccuguccca

SEQ ID NO: 1712094 - RNA, 21 nt, Homo sapiens
ugagguugaccagcucugggg

SEQ ID NO: 1712095 - RNA, 21 nt, Homo sapiens
ugaguaaauauugaggcuuug

SEQ ID NO: 1712096 - RNA, 18 nt, Homo sapiens
ugaguagggacucagggc

SEQ ID NO: 1712097 - RNA, 16 nt, Homo sapiens
ugaguaguguggaauu

SEQ ID NO: 1712098 - RNA, 14 nt, Homo sapiens
ugagucgaggacag

SEQ ID NO: 1712099 - RNA, 17 nt, Homo sapiens
ugagucugcaugugcac

SEQ ID NO: 1712100 - RNA, 21 nt, Homo sapiens
ugaguugccaagacaaaucaa

SEQ ID NO: 1712101 - RNA, 19 nt, Homo sapiens
ugaguugcccaucuuguuu

SEQ ID NO: 1712102 - RNA, 15 nt, Homo sapiens
ugauaaagcacagcu

SEQ ID NO: 1712103 - RNA, 21 nt, Homo sapiens
ugauaaagcuuaacacuugac

SEQ ID NO: 1712104 - RNA, 15 nt, Homo sapiens
ugauaauagauucuc

SEQ ID NO: 1712105 - RNA, 19 nt, Homo sapiens
ugauacaagaaagcaaugc

SEQ ID NO: 1712106 - RNA, 23 nt, Homo sapiens
ugauacucuuucuaaugcugaua

SEQ ID NO: 1712107 - RNA, 20 nt, Homo sapiens
ugauagauuucuacacugag

SEQ ID NO: 1712108 - RNA, 22 nt, Homo sapiens
ugauaguucacccccugagauc

SEQ ID NO: 1712109 - RNA, 14 nt, Homo sapiens
ugauauauugcugu

SEQ ID NO: 1712110 - RNA, 17 nt, Homo sapiens
ugauaucuggccuaaaa

SEQ ID NO: 1712111 - RNA, 15 nt, Homo sapiens
ugauauggguuuaua

SEQ ID NO: 1712112 - RNA, 17 nt, Homo sapiens
ugaucaaauauuucaac

SEQ ID NO: 1712113 - RNA, 18 nt, Homo sapiens
ugaucacggcucacugca

SEQ ID NO: 1712114 - RNA, 15 nt, Homo sapiens
ugaucacuagccugu

SEQ ID NO: 1712115 - RNA, 18 nt, Homo sapiens
ugaucagcaucugugaug

SEQ ID NO: 1712116 - RNA, 20 nt, Homo sapiens
ugaucauuauaucauuggaa

SEQ ID NO: 1712117 - RNA, 21 nt, Homo sapiens
ugauccaugaguuugcccugg

SEQ ID NO: 1712118 - RNA, 17 nt, Homo sapiens
ugauccccaagugguga

SEQ ID NO: 1712119 - RNA, 22 nt, Homo sapiens
ugauccccaaguggugaaugac

SEQ ID NO: 1712120 - RNA, 16 nt, Homo sapiens
ugaugcugagauucuu

SEQ ID NO: 1712121 - RNA, 21 nt, Homo sapiens
ugauggcaccacugcacucca

SEQ ID NO: 1712122 - RNA, 16 nt, Homo sapiens
ugaugucuccacuuuc

SEQ ID NO: 1712123 - RNA, 12 nt, Homo sapiens
ugauuagcuuug

SEQ ID NO: 1712124 - RNA, 13 nt, Homo sapiens
ugauucaaauggg

SEQ ID NO: 1712125 - RNA, 18 nt, Homo sapiens
ugauucuaauggggacac

SEQ ID NO: 1712126 - RNA, 14 nt, Homo sapiens
ugauugcagcuuua

SEQ ID NO: 1712127 - RNA, 16 nt, Homo sapiens
ugauuuggugaccaac

SEQ ID NO: 1712128 - RNA, 13 nt, Homo sapiens
ugauuuuacuuaa

SEQ ID NO: 1712129 - RNA, 14 nt, Homo sapiens
ugcaaaacacuaaa

SEQ ID NO: 1712130 - RNA, 17 nt, Homo sapiens
ugcaaaacacuaaagau

SEQ ID NO: 1712131 - RNA, 19 nt, Homo sapiens
ugcaaaucaaacauauucu

SEQ ID NO: 1712132 - RNA, 17 nt, Homo sapiens
ucuucuuacuggugcua

SEQ ID NO: 1712133 - RNA, 19 nt, Homo sapiens
ucuucuuuuuuugugaugu

SEQ ID NO: 1712134 - RNA, 17 nt, Homo sapiens
ucuugaaaucugaaugc

SEQ ID NO: 1712135 - RNA, 17 nt, Homo sapiens
ucuugaauagacuucca

SEQ ID NO: 1712136 - RNA, 14 nt, Homo sapiens
ucuugacuagugca

SEQ ID NO: 1712137 - RNA, 15 nt, Homo sapiens
ucuugaggccaggag

SEQ ID NO: 1712138 - RNA, 23 nt, Homo sapiens
ucuugaguauaagaaaugcauau

SEQ ID NO: 1712139 - RNA, 16 nt, Homo sapiens
ucuugcuuauucacug

SEQ ID NO: 1712140 - RNA, 17 nt, Homo sapiens
ucuuggaaguacaugaa

SEQ ID NO: 1712141 - RNA, 16 nt, Homo sapiens
ucuuggcaaaagccuu

SEQ ID NO: 1712142 - RNA, 14 nt, Homo sapiens
ucuuggcguggcag

SEQ ID NO: 1712143 - RNA, 20 nt, Homo sapiens
ucuuguauaagauccuagau

SEQ ID NO: 1712144 - RNA, 15 nt, Homo sapiens
ucuuguucuacugag

SEQ ID NO: 1712145 - RNA, 15 nt, Homo sapiens
ucuuuaagcagagaa

SEQ ID NO: 1712146 - RNA, 12 nt, Homo sapiens
ucuuucacuuca

SEQ ID NO: 1712147 - RNA, 18 nt, Homo sapiens
ucuuucuaaugugugaau

SEQ ID NO: 1712148 - RNA, 21 nt, Homo sapiens
ucuuugcacuccaaucauuca

SEQ ID NO: 1712149 - RNA, 22 nt, Homo sapiens
ucuuugcucauggcaacaguua

SEQ ID NO: 1712150 - RNA, 15 nt, Homo sapiens
ucuuugugugacaug

SEQ ID NO: 1712151 - RNA, 18 nt, Homo sapiens
ucuuuuuaaaauggugcu

SEQ ID NO: 1712152 - RNA, 22 nt, Homo sapiens
ugaaaaaagguuguguagcugu

SEQ ID NO: 1712153 - RNA, 23 nt, Homo sapiens
ugaaaaaagguuguguagcugug

SEQ ID NO: 1712154 - RNA, 19 nt, Homo sapiens
ugaaaaacagaaagcaucc

SEQ ID NO: 1712155 - RNA, 23 nt, Homo sapiens
ugaaaaaguagauugaguauaaa

SEQ ID NO: 1712156 - RNA, 18 nt, Homo sapiens
ugaaaacauagcaucuca

SEQ ID NO: 1712157 - RNA, 19 nt, Homo sapiens
ugaaaaccuacauauucca

SEQ ID NO: 1712158 - RNA, 15 nt, Homo sapiens
ugaaaagucacuuac

SEQ ID NO: 1712159 - RNA, 12 nt, Homo sapiens
ugaaaauguacu

SEQ ID NO: 1712160 - RNA, 14 nt, Homo sapiens
ugaaaauguacuga

SEQ ID NO: 1712161 - RNA, 12 nt, Homo sapiens
ugaaaaugugac

SEQ ID NO: 1712162 - RNA, 13 nt, Homo sapiens
ugaaaauguguuc

SEQ ID NO: 1712163 - RNA, 17 nt, Homo sapiens
ugaaacaaauaaucaca

SEQ ID NO: 1712164 - RNA, 13 nt, Homo sapiens
ugaaacacagcug

SEQ ID NO: 1712165 - RNA, 14 nt, Homo sapiens
ugaaaccugugaag

SEQ ID NO: 1712166 - RNA, 11 nt, Homo sapiens
ugaaacuaaga

SEQ ID NO: 1712167 - RNA, 20 nt, Homo sapiens
ugaaacuauuuuaccugaac

SEQ ID NO: 1712168 - RNA, 17 nt, Homo sapiens
ugaaagcucuguugcaa

SEQ ID NO: 1712169 - RNA, 21 nt, Homo sapiens
ugaaagggaucaucaugcagc

SEQ ID NO: 1712170 - RNA, 23 nt, Homo sapiens
ugaaagguacuauauuugcuaga

SEQ ID NO: 1712171 - RNA, 13 nt, Homo sapiens
ugaaagugguuug

SEQ ID NO: 1712172 - RNA, 19 nt, Homo sapiens
ugaaauaauguacaucugg

SEQ ID NO: 1712173 - RNA, 12 nt, Homo sapiens
ugaaaugaccuc

SEQ ID NO: 1712174 - RNA, 16 nt, Homo sapiens
ugaaaugcaucagguc

SEQ ID NO: 1712175 - RNA, 15 nt, Homo sapiens
ugaaaugcuggcauu

SEQ ID NO: 1712176 - RNA, 18 nt, Homo sapiens
ugaaauguuagucauugu

SEQ ID NO: 1712177 - RNA, 17 nt, Homo sapiens
ugaaauguuugcauaaa

SEQ ID NO: 1712178 - RNA, 17 nt, Homo sapiens
ugaaauuaagaaggcaa

SEQ ID NO: 1712179 - RNA, 16 nt, Homo sapiens
ugaaauuauacagaua

SEQ ID NO: 1712180 - RNA, 19 nt, Homo sapiens
ugaaauuauuugucauuca

SEQ ID NO: 1712181 - RNA, 14 nt, Homo sapiens
ugaacaagguuuca

SEQ ID NO: 1712182 - RNA, 21 nt, Homo sapiens
ugaacagaccggagaggacag

SEQ ID NO: 1712183 - RNA, 22 nt, Homo sapiens
ugaacauccccucccaucauua

SEQ ID NO: 1712184 - RNA, 18 nt, Homo sapiens
ugaacaugugaaguuaua

SEQ ID NO: 1712185 - RNA, 16 nt, Homo sapiens
ugaaccgcacagcuca

SEQ ID NO: 1712186 - RNA, 22 nt, Homo sapiens
ugaacggcaucaaggugcugaa

SEQ ID NO: 1712187 - RNA, 19 nt, Homo sapiens
ugaacuacauaacuuccua

SEQ ID NO: 1712188 - RNA, 15 nt, Homo sapiens
ugaacucuguaaaac

SEQ ID NO: 1712189 - RNA, 21 nt, Homo sapiens
ugaacugcuucuccaaggaca

SEQ ID NO: 1712190 - RNA, 20 nt, Homo sapiens
ugaagaagguggaccuuuua

SEQ ID NO: 1712191 - RNA, 20 nt, Homo sapiens
ugaagagaaccgagcaaaga

SEQ ID NO: 1712192 - RNA, 14 nt, Homo sapiens
ugaagagcuucauu

SEQ ID NO: 1712193 - RNA, 22 nt, Homo sapiens
ugaagaggaagggcaaaaccac

SEQ ID NO: 1712194 - RNA, 18 nt, Homo sapiens
ugaagagggagaagggau

SEQ ID NO: 1712195 - RNA, 17 nt, Homo sapiens
ugaagaguaguuuacua

SEQ ID NO: 1712196 - RNA, 21 nt, Homo sapiens
ugaagcagguggagggcauca

SEQ ID NO: 1712197 - RNA, 14 nt, Homo sapiens
ugaagucacacagu

SEQ ID NO: 1712198 - RNA, 15 nt, Homo sapiens
ugaagugacacuuug

SEQ ID NO: 1712199 - RNA, 19 nt, Homo sapiens
ugaagugcuuaguguacuu

SEQ ID NO: 1712200 - RNA, 22 nt, Homo sapiens
ugaagugugcacguugcuucag

SEQ ID NO: 1712201 - RNA, 22 nt, Homo sapiens
ugaauaaacugaaaauggaccu

SEQ ID NO: 1712202 - RNA, 18 nt, Homo sapiens
ugaauccucuucuuuaua

SEQ ID NO: 1712203 - RNA, 15 nt, Homo sapiens
ugaauccuuugccug

SEQ ID NO: 1712204 - RNA, 17 nt, Homo sapiens
ugaaucucccacuccag

SEQ ID NO: 1712205 - RNA, 14 nt, Homo sapiens
ugaaugcaaaguag

SEQ ID NO: 1712206 - RNA, 21 nt, Homo sapiens
ugaauguauguaauguguggu

SEQ ID NO: 1712207 - RNA, 13 nt, Homo sapiens
ugaauguggacuc

SEQ ID NO: 1712208 - RNA, 21 nt, Homo sapiens
ugaauguuuuauggaauugaa

SEQ ID NO: 1712209 - RNA, 15 nt, Homo sapiens
ugaauuaaucaucua

SEQ ID NO: 1712210 - RNA, 15 nt, Homo sapiens
ugaauugaaauguuc

SEQ ID NO: 1712211 - RNA, 14 nt, Homo sapiens
ugaauugcaugacu

SEQ ID NO: 1712212 - RNA, 17 nt, Homo sapiens
ugacaaccucauccagg

SEQ ID NO: 1712213 - RNA, 17 nt, Homo sapiens
ugacaaccuccauucua

SEQ ID NO: 1712214 - RNA, 22 nt, Homo sapiens
ugacaacugugacuguacccaa

SEQ ID NO: 1712215 - RNA, 13 nt, Homo sapiens
ugacacauaugca

SEQ ID NO: 1712216 - RNA, 15 nt, Homo sapiens
ugacacauaugcacc

SEQ ID NO: 1712217 - RNA, 20 nt, Homo sapiens
ucucacuauguugcccaggc

SEQ ID NO: 1712218 - RNA, 16 nt, Homo sapiens
ucucacuguugcccag

SEQ ID NO: 1712219 - RNA, 19 nt, Homo sapiens
ucucagacugcauguacca

SEQ ID NO: 1712220 - RNA, 18 nt, Homo sapiens
ucucagcuaccuaagaaa

SEQ ID NO: 1712221 - RNA, 13 nt, Homo sapiens
ucucagcugacca

SEQ ID NO: 1712222 - RNA, 14 nt, Homo sapiens
ucucagcuuugaga

SEQ ID NO: 1712223 - RNA, 22 nt, Homo sapiens
ucucaggggugauaacucagga

SEQ ID NO: 1712224 - RNA, 14 nt, Homo sapiens
ucucagggugcaga

SEQ ID NO: 1712225 - RNA, 19 nt, Homo sapiens
ucucaguggcuucaucugu

SEQ ID NO: 1712226 - RNA, 21 nt, Homo sapiens
ucucauaccuuccccacaucu

SEQ ID NO: 1712227 - RNA, 13 nt, Homo sapiens
ucuccaauacuca

SEQ ID NO: 1712228 - RNA, 19 nt, Homo sapiens
ucuccacuucuuguucccc

SEQ ID NO: 1712229 - RNA, 15 nt, Homo sapiens
ucuccagccaaccuc

SEQ ID NO: 1712230 - RNA, 21 nt, Homo sapiens
ucuccagccaaccucauugca

SEQ ID NO: 1712231 - RNA, 19 nt, Homo sapiens
ucucccacccuguaccuca

SEQ ID NO: 1712232 - RNA, 14 nt, Homo sapiens
ucucccacuccagc

SEQ ID NO: 1712233 - RNA, 19 nt, Homo sapiens
ucuccccaguguaugucuu

SEQ ID NO: 1712234 - RNA, 22 nt, Homo sapiens
ucuccccgcuaaggaagauauc

SEQ ID NO: 1712235 - RNA, 20 nt, Homo sapiens
ucucccgaauucgcuguuac

SEQ ID NO: 1712236 - RNA, 15 nt, Homo sapiens
ucucccgugagccag

SEQ ID NO: 1712237 - RNA, 16 nt, Homo sapiens
ucuccguaauuagcau

SEQ ID NO: 1712238 - RNA, 11 nt, Homo sapiens
ucuccuacuuu

SEQ ID NO: 1712239 - RNA, 18 nt, Homo sapiens
ucuccuguaagccaaaga

SEQ ID NO: 1712240 - RNA, 17 nt, Homo sapiens
ucucgaaugcugagaag

SEQ ID NO: 1712241 - RNA, 12 nt, Homo sapiens
ucucgcuuuguu

SEQ ID NO: 1712242 - RNA, 18 nt, Homo sapiens
ucucgcuuuguugcccag

SEQ ID NO: 1712243 - RNA, 15 nt, Homo sapiens
ucucgggcacaggcc

SEQ ID NO: 1712244 - RNA, 17 nt, Homo sapiens
ucucuagugucuuuugc

SEQ ID NO: 1712245 - RNA, 18 nt, Homo sapiens
ucucucagacuuacuuua

SEQ ID NO: 1712246 - RNA, 14 nt, Homo sapiens
ucucuccagccuga

SEQ ID NO: 1712247 - RNA, 20 nt, Homo sapiens
ucucuccugauagucuuuca

SEQ ID NO: 1712248 - RNA, 22 nt, Homo sapiens
ucucuccuuuucuuuuguuacu

SEQ ID NO: 1712249 - RNA, 14 nt, Homo sapiens
ucucucuucccuca

SEQ ID NO: 1712250 - RNA, 20 nt, Homo sapiens
ucucuggcuguaaggcucua

SEQ ID NO: 1712251 - RNA, 19 nt, Homo sapiens
ucucugugcccuccagcaa

SEQ ID NO: 1712252 - RNA, 14 nt, Homo sapiens
ucucuuuaaaucaa

SEQ ID NO: 1712253 - RNA, 23 nt, Homo sapiens
ucugaagcccucccagguguuaa

SEQ ID NO: 1712254 - RNA, 20 nt, Homo sapiens
ucugaagucacaucacagga

SEQ ID NO: 1712255 - RNA, 17 nt, Homo sapiens
ucugaagucacugcaca

SEQ ID NO: 1712256 - RNA, 13 nt, Homo sapiens
ucugacacacagc

SEQ ID NO: 1712257 - RNA, 23 nt, Homo sapiens
ucugacagaaagcagauaccuca

SEQ ID NO: 1712258 - RNA, 14 nt, Homo sapiens
ucugacgucucuuu

SEQ ID NO: 1712259 - RNA, 19 nt, Homo sapiens
ucugagaagaggagcccuc

SEQ ID NO: 1712260 - RNA, 17 nt, Homo sapiens
ucugagggaaagugcau

SEQ ID NO: 1712261 - RNA, 17 nt, Homo sapiens
ucugauaggaaugugaa

SEQ ID NO: 1712262 - RNA, 22 nt, Homo sapiens
ucugaucugcaguuuuugccug

SEQ ID NO: 1712263 - RNA, 18 nt, Homo sapiens
ucugaugccaauacuagu

SEQ ID NO: 1712264 - RNA, 14 nt, Homo sapiens
ucugauuugcauau

SEQ ID NO: 1712265 - RNA, 20 nt, Homo sapiens
ucugcaaugggcacugggau

SEQ ID NO: 1712266 - RNA, 15 nt, Homo sapiens
ucugcacaugucuug

SEQ ID NO: 1712267 - RNA, 13 nt, Homo sapiens
ucugcacugaaaa

SEQ ID NO: 1712268 - RNA, 16 nt, Homo sapiens
ucugcagcuaacuuau

SEQ ID NO: 1712269 - RNA, 23 nt, Homo sapiens
ucugcagcuccagguacauauca

SEQ ID NO: 1712270 - RNA, 19 nt, Homo sapiens
ucugcaucccagcaccugc

SEQ ID NO: 1712271 - RNA, 15 nt, Homo sapiens
ucugccacacucuga

SEQ ID NO: 1712272 - RNA, 16 nt, Homo sapiens
ucugccagaagauccc

SEQ ID NO: 1712273 - RNA, 13 nt, Homo sapiens
ucugcccaccuac

SEQ ID NO: 1712274 - RNA, 15 nt, Homo sapiens
ucugccuuuucacug

SEQ ID NO: 1712275 - RNA, 22 nt, Homo sapiens
ucugcuccccugugaacccacu

SEQ ID NO: 1712276 - RNA, 23 nt, Homo sapiens
ucugcuggggauggccacuguga

SEQ ID NO: 1712277 - RNA, 13 nt, Homo sapiens
ucuggaaucugga

SEQ ID NO: 1712278 - RNA, 17 nt, Homo sapiens
ucuggaccugguacaaa

SEQ ID NO: 1712279 - RNA, 19 nt, Homo sapiens
ucuggcaggaaucuaucca

SEQ ID NO: 1712280 - RNA, 19 nt, Homo sapiens
ucuggcugccccaaccugc

SEQ ID NO: 1712281 - RNA, 21 nt, Homo sapiens
ucugggaaaaucuauuccugc

SEQ ID NO: 1712282 - RNA, 17 nt, Homo sapiens
ucuggugcuuucuguca

SEQ ID NO: 1712283 - RNA, 14 nt, Homo sapiens
ucugguucugaugc

SEQ ID NO: 1712284 - RNA, 20 nt, Homo sapiens
ucugguuuuaacaauuuccu

SEQ ID NO: 1712285 - RNA, 14 nt, Homo sapiens
ucuguaaacucaaa

SEQ ID NO: 1712286 - RNA, 16 nt, Homo sapiens
ucuguaaguaacuuca

SEQ ID NO: 1712287 - RNA, 10 nt, Homo sapiens
ucuguacaau

SEQ ID NO: 1712288 - RNA, 13 nt, Homo sapiens
ucuguacaaugac

SEQ ID NO: 1712289 - RNA, 21 nt, Homo sapiens
ucuguauugggguacaggaau

SEQ ID NO: 1712290 - RNA, 23 nt, Homo sapiens
ucugucaccaacugaaguggcua

SEQ ID NO: 1712291 - RNA, 19 nt, Homo sapiens
ucugucauuuguugugaug

SEQ ID NO: 1712292 - RNA, 16 nt, Homo sapiens
ucuguccauuuaucca

SEQ ID NO: 1712293 - RNA, 19 nt, Homo sapiens
ucugugacuccuggucuga

SEQ ID NO: 1712294 - RNA, 14 nt, Homo sapiens
ucugugccccaugc

SEQ ID NO: 1712295 - RNA, 16 nt, Homo sapiens
ucugugccccaugccu

SEQ ID NO: 1712296 - RNA, 22 nt, Homo sapiens
ucuguggaguuugacauuguau

SEQ ID NO: 1712297 - RNA, 12 nt, Homo sapiens
ucuguguggcag

SEQ ID NO: 1712298 - RNA, 13 nt, Homo sapiens
ucuguguuuacag

SEQ ID NO: 1712299 - RNA, 18 nt, Homo sapiens
ucuguuaaaugaacuuga

SEQ ID NO: 1712300 - RNA, 15 nt, Homo sapiens
ucuguuaaucaugua

SEQ ID NO: 1712301 - RNA, 20 nt, Homo sapiens
ucuguuauauccccugcuac

SEQ ID NO: 1712302 - RNA, 14 nt, Homo sapiens
ucuguuauguacua

SEQ ID NO: 1712303 - RNA, 22 nt, Homo sapiens
ucuguuauuaacaaacaucacu

SEQ ID NO: 1712304 - RNA, 20 nt, Homo sapiens
aaaggaagcuccacugucac

SEQ ID NO: 1712305 - RNA, 21 nt, Homo sapiens
aaaggaagcuccacugucacc

SEQ ID NO: 1712306 - RNA, 16 nt, Homo sapiens
aaaggaagucaguaca

SEQ ID NO: 1712307 - RNA, 19 nt, Homo sapiens
aaaggacagaguaugaaca

SEQ ID NO: 1712308 - RNA, 16 nt, Homo sapiens
aaaggacaucagcaaa

SEQ ID NO: 1712309 - RNA, 13 nt, Homo sapiens
aaaggaggggaua

SEQ ID NO: 1712310 - RNA, 21 nt, Homo sapiens
aaaggcuagguacacagcucu

SEQ ID NO: 1712311 - RNA, 14 nt, Homo sapiens
aaagggaaugggaa

SEQ ID NO: 1712312 - RNA, 18 nt, Homo sapiens
aaagggcccagagagggu

SEQ ID NO: 1712313 - RNA, 17 nt, Homo sapiens
aaagggccuugacauca

SEQ ID NO: 1712314 - RNA, 13 nt, Homo sapiens
aaagguacuauau

SEQ ID NO: 1712315 - RNA, 13 nt, Homo sapiens
aaagguucacagg

SEQ ID NO: 1712316 - RNA, 13 nt, Homo sapiens
aaagguucuucau

SEQ ID NO: 1712317 - RNA, 18 nt, Homo sapiens
aaagguucuucaucccuu

SEQ ID NO: 1712318 - RNA, 13 nt, Homo sapiens
aaagguuguguag

SEQ ID NO: 1712319 - RNA, 19 nt, Homo sapiens
aaagguuuuggaucuugaa

SEQ ID NO: 1712320 - RNA, 15 nt, Homo sapiens
aaaguaaugaucuca

SEQ ID NO: 1712321 - RNA, 14 nt, Homo sapiens
aaaguagcaauuuc

SEQ ID NO: 1712322 - RNA, 21 nt, Homo sapiens
aaagucaccacuccauuccca

SEQ ID NO: 1712323 - RNA, 15 nt, Homo sapiens
aaaguccacaguuua

SEQ ID NO: 1712324 - RNA, 18 nt, Homo sapiens
aaagucuacauacuuuca

SEQ ID NO: 1712325 - RNA, 14 nt, Homo sapiens
aaagugacacagca

SEQ ID NO: 1712326 - RNA, 11 nt, Homo sapiens
aaagugcauau

SEQ ID NO: 1712327 - RNA, 15 nt, Homo sapiens
aaaguggcaaucuca

SEQ ID NO: 1712328 - RNA, 17 nt, Homo sapiens
aaaguguaaguucacaa

SEQ ID NO: 1712329 - RNA, 15 nt, Homo sapiens
aaaguuaaaagcaaa

SEQ ID NO: 1712330 - RNA, 14 nt, Homo sapiens
aaaguuauugugau

SEQ ID NO: 1712331 - RNA, 17 nt, Homo sapiens
aaaguucuguguuuaau

SEQ ID NO: 1712332 - RNA, 19 nt, Homo sapiens
aaauaaaaauauuguguug

SEQ ID NO: 1712333 - RNA, 20 nt, Homo sapiens
aaauaacuucaguccugcuc

SEQ ID NO: 1712334 - RNA, 20 nt, Homo sapiens
aaauaauuuuauuaugcaac

SEQ ID NO: 1712335 - RNA, 17 nt, Homo sapiens
aaauacacuugugauua

SEQ ID NO: 1712336 - RNA, 16 nt, Homo sapiens
aaauacauacggucag

SEQ ID NO: 1712337 - RNA, 20 nt, Homo sapiens
aaauacgguaaggauacuuu

SEQ ID NO: 1712338 - RNA, 23 nt, Homo sapiens
aaauagagcuuuuaaaaaugucc

SEQ ID NO: 1712339 - RNA, 22 nt, Homo sapiens
aaauauagauuagaaaaauucc

SEQ ID NO: 1712340 - RNA, 22 nt, Homo sapiens
aaauauauacccccccaugcag

SEQ ID NO: 1712341 - RNA, 19 nt, Homo sapiens
aaauauauauagugcuaua

SEQ ID NO: 1712342 - RNA, 18 nt, Homo sapiens
aaauauauuuuggaaaac

SEQ ID NO: 1712343 - RNA, 22 nt, Homo sapiens
aaauaugagaugcguuguuaca

SEQ ID NO: 1712344 - RNA, 13 nt, Homo sapiens
aaauauuccugca

SEQ ID NO: 1712345 - RNA, 18 nt, Homo sapiens
aaauauugcuucaauaau

SEQ ID NO: 1712346 - RNA, 15 nt, Homo sapiens
aaauauuuuugccau

SEQ ID NO: 1712347 - RNA, 15 nt, Homo sapiens
aaaucaacagaagca

SEQ ID NO: 1712348 - RNA, 18 nt, Homo sapiens
aaaucagaccuggcugcu

SEQ ID NO: 1712349 - RNA, 21 nt, Homo sapiens
aaauccaaaaagaaaugaugu

SEQ ID NO: 1712350 - RNA, 13 nt, Homo sapiens
aaauccacccaua

SEQ ID NO: 1712351 - RNA, 19 nt, Homo sapiens
aaaucgaaugcugcauuuu

SEQ ID NO: 1712352 - RNA, 17 nt, Homo sapiens
aaaucuauucuguguug

SEQ ID NO: 1712353 - RNA, 19 nt, Homo sapiens
aaaucuauucuguguugca

SEQ ID NO: 1712354 - RNA, 22 nt, Homo sapiens
aaaucuuaaaagcccuaaguga

SEQ ID NO: 1712355 - RNA, 17 nt, Homo sapiens
aaaugacaugcacugac

SEQ ID NO: 1712356 - RNA, 20 nt, Homo sapiens
aaaugacucuggggagguga

SEQ ID NO: 1712357 - RNA, 16 nt, Homo sapiens
aaaugcccauuugccu

SEQ ID NO: 1712358 - RNA, 10 nt, Homo sapiens
agaauuugca

SEQ ID NO: 1712359 - RNA, 15 nt, Homo sapiens
agaauuugucagaaa

SEQ ID NO: 1712360 - RNA, 17 nt, Homo sapiens
agacaaaguaauuccuc

SEQ ID NO: 1712361 - RNA, 18 nt, Homo sapiens
agacaagauauuguacau

SEQ ID NO: 1712362 - RNA, 16 nt, Homo sapiens
agacaagcugcauuuc

SEQ ID NO: 1712363 - RNA, 21 nt, Homo sapiens
agacaagugacuguaucugug

SEQ ID NO: 1712364 - RNA, 24 nt, Homo sapiens
agacaagugacuguaucuguguag

SEQ ID NO: 1712365 - RNA, 20 nt, Homo sapiens
agacacaacuauuuuuccaa

SEQ ID NO: 1712366 - RNA, 16 nt, Homo sapiens
agacaccaaaguucua

SEQ ID NO: 1712367 - RNA, 22 nt, Homo sapiens
agacacggagcccagcccuccc

SEQ ID NO: 1712368 - RNA, 20 nt, Homo sapiens
agacacgggcaagcaugccu

SEQ ID NO: 1712369 - RNA, 21 nt, Homo sapiens
agacagaaccccuacaugaaa

SEQ ID NO: 1712370 - RNA, 14 nt, Homo sapiens
agacagaacuugaa

SEQ ID NO: 1712371 - RNA, 22 nt, Homo sapiens
agacagaguuuucacucuuauu

SEQ ID NO: 1712372 - RNA, 19 nt, Homo sapiens
agacagccacccugagaac

SEQ ID NO: 1712373 - RNA, 15 nt, Homo sapiens
agacaguucaagaaa

SEQ ID NO: 1712374 - RNA, 13 nt, Homo sapiens
agacauaaagcca

SEQ ID NO: 1712375 - RNA, 20 nt, Homo sapiens
agacauacauuuaugcacau

SEQ ID NO: 1712376 - RNA, 20 nt, Homo sapiens
agacaucggccuccaugacc

SEQ ID NO: 1712377 - RNA, 21 nt, Homo sapiens
agacaucggccuccaugaccu

SEQ ID NO: 1712378 - RNA, 17 nt, Homo sapiens
agacaugauuuccuuga

SEQ ID NO: 1712379 - RNA, 16 nt, Homo sapiens
agacauguaucacugu

SEQ ID NO: 1712380 - RNA, 23 nt, Homo sapiens
agacaugucuagccacugaucau

SEQ ID NO: 1712381 - RNA, 12 nt, Homo sapiens
agaccaaaauaa

SEQ ID NO: 1712382 - RNA, 22 nt, Homo sapiens
agaccaaggaacaaaaaaacca

SEQ ID NO: 1712383 - RNA, 22 nt, Homo sapiens
agaccaaggcgggagcaucucu

SEQ ID NO: 1712384 - RNA, 13 nt, Homo sapiens
agacccacagacu

SEQ ID NO: 1712385 - RNA, 13 nt, Homo sapiens
agacccaucucaa

SEQ ID NO: 1712386 - RNA, 13 nt, Homo sapiens
agaccuacccucc

SEQ ID NO: 1712387 - RNA, 21 nt, Homo sapiens
agaccucuccuuccuacccuc

SEQ ID NO: 1712388 - RNA, 14 nt, Homo sapiens
agaccugacguccc

SEQ ID NO: 1712389 - RNA, 20 nt, Homo sapiens
agaccugguucccgccuccc

SEQ ID NO: 1712390 - RNA, 19 nt, Homo sapiens
agaccuuccauaaugcuac

SEQ ID NO: 1712391 - RNA, 17 nt, Homo sapiens
agacgaaauagugacau

SEQ ID NO: 1712392 - RNA, 17 nt, Homo sapiens
agacucaaauguucuaa

SEQ ID NO: 1712393 - RNA, 15 nt, Homo sapiens
agacucccaugaagc

SEQ ID NO: 1712394 - RNA, 19 nt, Homo sapiens
agacucccaugaagccuuu

SEQ ID NO: 1712395 - RNA, 14 nt, Homo sapiens
agacucugucucaa

SEQ ID NO: 1712396 - RNA, 22 nt, Homo sapiens
agacugaaaauauauaagcuca

SEQ ID NO: 1712397 - RNA, 22 nt, Homo sapiens
agacugcauguaccauuugcau

SEQ ID NO: 1712398 - RNA, 17 nt, Homo sapiens
agacuggaagcacagcu

SEQ ID NO: 1712399 - RNA, 20 nt, Homo sapiens
agacugggucucgcuuuguu

SEQ ID NO: 1712400 - RNA, 19 nt, Homo sapiens
agacugucccugaaaccua

SEQ ID NO: 1712401 - RNA, 19 nt, Homo sapiens
agacugucucaagagggca

SEQ ID NO: 1712402 - RNA, 16 nt, Homo sapiens
agacuuacucuaagau

SEQ ID NO: 1712403 - RNA, 15 nt, Homo sapiens
agacuucguaauuaa

SEQ ID NO: 1712404 - RNA, 20 nt, Homo sapiens
agacuucucccgugagccag

SEQ ID NO: 1712405 - RNA, 19 nt, Homo sapiens
agacuuggggaaauugcuu

SEQ ID NO: 1712406 - RNA, 18 nt, Homo sapiens
agacuuucuuaucacuua

SEQ ID NO: 1712407 - RNA, 13 nt, Homo sapiens
agagaaagccagg

SEQ ID NO: 1712408 - RNA, 23 nt, Homo sapiens
agagaaaggccugcacacaagcc

SEQ ID NO: 1712409 - RNA, 18 nt, Homo sapiens
agagaagaccucugugag

SEQ ID NO: 1712410 - RNA, 12 nt, Homo sapiens
agagaagcugcu

SEQ ID NO: 1712411 - RNA, 15 nt, Homo sapiens
agagaauuggcucaa

SEQ ID NO: 1712412 - RNA, 22 nt, Homo sapiens
agagaccugagucugcaugugc

SEQ ID NO: 1712413 - RNA, 16 nt, Homo sapiens
agagacugucccugaa

SEQ ID NO: 1712414 - RNA, 14 nt, Homo sapiens
agagagagaacuuu

SEQ ID NO: 1712415 - RNA, 20 nt, Homo sapiens
agagagccauuuugugaaug

SEQ ID NO: 1712416 - RNA, 15 nt, Homo sapiens
agagaggcucugaga

SEQ ID NO: 1712417 - RNA, 18 nt, Homo sapiens
agagagggaccauguguc

SEQ ID NO: 1712418 - RNA, 17 nt, Homo sapiens
agagaggguggugaccu

SEQ ID NO: 1712419 - RNA, 17 nt, Homo sapiens
agagauaaacuacauag

SEQ ID NO: 1712420 - RNA, 15 nt, Homo sapiens
agagauauaucugaa

SEQ ID NO: 1712421 - RNA, 15 nt, Homo sapiens
agagaugacagggaa

SEQ ID NO: 1712422 - RNA, 12 nt, Homo sapiens
agagauucugug

SEQ ID NO: 1712423 - RNA, 19 nt, Homo sapiens
agagcaagacccaucucaa

SEQ ID NO: 1712424 - RNA, 22 nt, Homo sapiens
agagcauuuccaacaccacaga

SEQ ID NO: 1712425 - RNA, 21 nt, Homo sapiens
agagccaauguuuuccaccca

SEQ ID NO: 1712426 - RNA, 13 nt, Homo sapiens
agagccagggucu

SEQ ID NO: 1712427 - RNA, 20 nt, Homo sapiens
agagcccggcgccccugcca

SEQ ID NO: 1712428 - RNA, 21 nt, Homo sapiens
agagccuucugaugucucuaa

SEQ ID NO: 1712429 - RNA, 22 nt, Homo sapiens
agagcgaucucggcucacugca

SEQ ID NO: 1712430 - RNA, 16 nt, Homo sapiens
agagcggucucaggcu

SEQ ID NO: 1712431 - RNA, 20 nt, Homo sapiens
agagcuuuuaaaaauguccu

SEQ ID NO: 1712432 - RNA, 19 nt, Homo sapiens
agaggaaagagucuucaac

SEQ ID NO: 1712433 - RNA, 13 nt, Homo sapiens
agaggaacagcac

SEQ ID NO: 1712434 - RNA, 14 nt, Homo sapiens
agaggaacugucca

SEQ ID NO: 1712435 - RNA, 15 nt, Homo sapiens
agaggagccagacag

SEQ ID NO: 1712436 - RNA, 23 nt, Homo sapiens
agaggagccagacagacccugaa

SEQ ID NO: 1712437 - RNA, 17 nt, Homo sapiens
agaggcugccccucuca

SEQ ID NO: 1712438 - RNA, 17 nt, Homo sapiens
agagggaccauguguca

SEQ ID NO: 1712439 - RNA, 24 nt, Homo sapiens
agagggaccaugugucacuugugc

SEQ ID NO: 1712440 - RNA, 16 nt, Homo sapiens
agagggagagcagaga

SEQ ID NO: 1712441 - RNA, 22 nt, Homo sapiens
agagguagguaggaucauccca

SEQ ID NO: 1712442 - RNA, 14 nt, Homo sapiens
agagguugcaguga

SEQ ID NO: 1712443 - RNA, 17 nt, Homo sapiens
agaguagaacagauaau

SEQ ID NO: 1712444 - RNA, 15 nt, Homo sapiens
agaguauccuaccca

SEQ ID NO: 1712445 - RNA, 20 nt, Homo sapiens
agagugagagacaucaucaa

SEQ ID NO: 1712446 - RNA, 19 nt, Homo sapiens
agagugauugcagcuuuau

SEQ ID NO: 1712447 - RNA, 23 nt, Homo sapiens
agagugccguaacaacugugguc

SEQ ID NO: 1712448 - RNA, 17 nt, Homo sapiens
agagugucucugauaaa

SEQ ID NO: 1712449 - RNA, 22 nt, Homo sapiens
agauaaguuugcaguuggcuaa

SEQ ID NO: 1712450 - RNA, 12 nt, Homo sapiens
agauaaucagug

SEQ ID NO: 1712451 - RNA, 22 nt, Homo sapiens
agauaauuggcaacugggugaa

SEQ ID NO: 1712452 - RNA, 15 nt, Homo sapiens
agauacaaaugucua

SEQ ID NO: 1712453 - RNA, 16 nt, Homo sapiens
agauagcuacagugua

SEQ ID NO: 1712454 - RNA, 23 nt, Homo sapiens
agauaguuguguuuuuauuguua

SEQ ID NO: 1712455 - RNA, 12 nt, Homo sapiens
agauauuacuuu

SEQ ID NO: 1712456 - RNA, 13 nt, Homo sapiens
agauauuacuuua

SEQ ID NO: 1712457 - RNA, 18 nt, Homo sapiens
agauauucagaaguauau

SEQ ID NO: 1712458 - RNA, 15 nt, Homo sapiens
agauauuugguacca

SEQ ID NO: 1712459 - RNA, 17 nt, Homo sapiens
agauauuugguaccaug

SEQ ID NO: 1712460 - RNA, 17 nt, Homo sapiens
agaucacgucacugcac

SEQ ID NO: 1712461 - RNA, 15 nt, Homo sapiens
agaucacugccacac

SEQ ID NO: 1712462 - RNA, 15 nt, Homo sapiens
agaucaucagucacc

SEQ ID NO: 1712463 - RNA, 17 nt, Homo sapiens
agaucuaaggaugucac

SEQ ID NO: 1712464 - RNA, 18 nt, Homo sapiens
agaucuaaggaugucaca

SEQ ID NO: 1712465 - RNA, 22 nt, Homo sapiens
agaucucucgaaugcugagaag

SEQ ID NO: 1712466 - RNA, 20 nt, Homo sapiens
agaugaacaugguguucaac

SEQ ID NO: 1712467 - RNA, 18 nt, Homo sapiens
agaugacggaugccuaga

SEQ ID NO: 1712468 - RNA, 19 nt, Homo sapiens
agaugauggaugccaauau

SEQ ID NO: 1712469 - RNA, 18 nt, Homo sapiens
agaugcacuuaugcagua

SEQ ID NO: 1712470 - RNA, 18 nt, Homo sapiens
agaugcuaaaaucccugg

SEQ ID NO: 1712471 - RNA, 20 nt, Homo sapiens
agaugcugacuguacuccuc

SEQ ID NO: 1712472 - RNA, 22 nt, Homo sapiens
agaugcuguaggugguauguga

SEQ ID NO: 1712473 - RNA, 15 nt, Homo sapiens
agauggaaugcugug

SEQ ID NO: 1712474 - RNA, 21 nt, Homo sapiens
agauggaguucuugugccaua

SEQ ID NO: 1712475 - RNA, 14 nt, Homo sapiens
agauggggcacuga

SEQ ID NO: 1712476 - RNA, 12 nt, Homo sapiens
agauguacuugu

SEQ ID NO: 1712477 - RNA, 16 nt, Homo sapiens
agaugugucuauggcu

SEQ ID NO: 1712478 - RNA, 21 nt, Homo sapiens
agauguugauuuuuacugugu

SEQ ID NO: 1712479 - RNA, 22 nt, Homo sapiens
agauuauagaaguagcaaaaag

SEQ ID NO: 1712480 - RNA, 13 nt, Homo sapiens
agauucuaaugau

SEQ ID NO: 1712481 - RNA, 15 nt, Homo sapiens
agauucugugaucuu

SEQ ID NO: 1712482 - RNA, 14 nt, Homo sapiens
agauucuucugugu

SEQ ID NO: 1712483 - RNA, 21 nt, Homo sapiens
agauugauuaaugaacuauug

SEQ ID NO: 1712484 - RNA, 19 nt, Homo sapiens
agauuugcuugaaccuggg

SEQ ID NO: 1712485 - RNA, 18 nt, Homo sapiens
agauuuuuaauacguuaa

SEQ ID NO: 1712486 - RNA, 13 nt, Homo sapiens
agcaaacaaguug

SEQ ID NO: 1712487 - RNA, 18 nt, Homo sapiens
agcaaauggcagaaccaa

SEQ ID NO: 1712488 - RNA, 12 nt, Homo sapiens
agcaacaaugac

SEQ ID NO: 1712489 - RNA, 16 nt, Homo sapiens
agcaacucuugauuau

SEQ ID NO: 1712490 - RNA, 18 nt, Homo sapiens
agcaacuguuaugaaaua

SEQ ID NO: 1712491 - RNA, 20 nt, Homo sapiens
agcaacuucuucuccauccc

SEQ ID NO: 1712492 - RNA, 22 nt, Homo sapiens
agcaagaucccauggguugugu

SEQ ID NO: 1712493 - RNA, 14 nt, Homo sapiens
agcaagcuauucaa

SEQ ID NO: 1712494 - RNA, 18 nt, Homo sapiens
agcaauaccagcaauuca

SEQ ID NO: 1712495 - RNA, 19 nt, Homo sapiens
agcaaugacaucucagggg

SEQ ID NO: 1712496 - RNA, 20 nt, Homo sapiens
agcaaugcaagcagccuagc

SEQ ID NO: 1712497 - RNA, 20 nt, Homo sapiens
agcaauuccuggacucgggg

SEQ ID NO: 1712498 - RNA, 14 nt, Homo sapiens
agcacaauuugcac

SEQ ID NO: 1712499 - RNA, 18 nt, Homo sapiens
agcacaauuugcacuaaa

SEQ ID NO: 1712500 - RNA, 21 nt, Homo sapiens
agcacaauuugcacuaaauca

SEQ ID NO: 1712501 - RNA, 20 nt, Homo sapiens
agcacagauaaaaaguggaa

SEQ ID NO: 1712502 - RNA, 13 nt, Homo sapiens
agcacccauucca

SEQ ID NO: 1712503 - RNA, 14 nt, Homo sapiens
agcacccauuccaa

SEQ ID NO: 1712504 - RNA, 22 nt, Homo sapiens
agcacggacucuuacugcuaac

SEQ ID NO: 1712505 - RNA, 19 nt, Homo sapiens
agcacuaaggugugcucug

SEQ ID NO: 1712506 - RNA, 17 nt, Homo sapiens
agcacuggggagucuuu

SEQ ID NO: 1712507 - RNA, 20 nt, Homo sapiens
agcagaagagaaaauguugu

SEQ ID NO: 1712508 - RNA, 14 nt, Homo sapiens
agcagacucuggag

SEQ ID NO: 1712509 - RNA, 18 nt, Homo sapiens
agcagagugcacagcugu

SEQ ID NO: 1712510 - RNA, 22 nt, Homo sapiens
agcagcagaggcggucuucaac

SEQ ID NO: 1712511 - RNA, 18 nt, Homo sapiens
agcagcggggcagugugg

SEQ ID NO: 1712512 - RNA, 15 nt, Homo sapiens
agcaggaguggugca

SEQ ID NO: 1712513 - RNA, 19 nt, Homo sapiens
agcaggcagcgccaagugc

SEQ ID NO: 1712514 - RNA, 11 nt, Homo sapiens
agcaguucugu

SEQ ID NO: 1712515 - RNA, 15 nt, Homo sapiens
agcaucagggggaag

SEQ ID NO: 1712516 - RNA, 15 nt, Homo sapiens
agcaucucaggagau

SEQ ID NO: 1712517 - RNA, 21 nt, Homo sapiens
agcaucuguagugacccacug

SEQ ID NO: 1712518 - RNA, 23 nt, Homo sapiens
agcauuccuucuuugauaauguu

SEQ ID NO: 1712519 - RNA, 20 nt, Homo sapiens
agcauuuaagagugaaguca

SEQ ID NO: 1712520 - RNA, 11 nt, Homo sapiens
agccaaccuca

SEQ ID NO: 1712521 - RNA, 17 nt, Homo sapiens
agccaagaaacacuuuc

SEQ ID NO: 1712522 - RNA, 23 nt, Homo sapiens
agccaagcuuguuaucagcuuuc

SEQ ID NO: 1712523 - RNA, 22 nt, Homo sapiens
agccaauguuuuccacccauaa

SEQ ID NO: 1712524 - RNA, 17 nt, Homo sapiens
agccaauucacaaguua

SEQ ID NO: 1712525 - RNA, 19 nt, Homo sapiens
agcuaaccaguuaccacac

SEQ ID NO: 1712526 - RNA, 21 nt, Homo sapiens
agcuaagggugggugcucaga

SEQ ID NO: 1712527 - RNA, 23 nt, Homo sapiens
agcuaaggucacauugugccuuu

SEQ ID NO: 1712528 - RNA, 15 nt, Homo sapiens
agcuaauguaauaac

SEQ ID NO: 1712529 - RNA, 22 nt, Homo sapiens
agcuaauguaauaacugugaag

SEQ ID NO: 1712530 - RNA, 16 nt, Homo sapiens
agcuagaaaacauuuu

SEQ ID NO: 1712531 - RNA, 22 nt, Homo sapiens
agcuaggccuggccagaugcac

SEQ ID NO: 1712532 - RNA, 16 nt, Homo sapiens
agcuaguuugagccag

SEQ ID NO: 1712533 - RNA, 14 nt, Homo sapiens
agcuaugaauauag

SEQ ID NO: 1712534 - RNA, 17 nt, Homo sapiens
agcuaugggagccccag

SEQ ID NO: 1712535 - RNA, 10 nt, Homo sapiens
agcucaccag

SEQ ID NO: 1712536 - RNA, 17 nt, Homo sapiens
agcucacuacccuauuc

SEQ ID NO: 1712537 - RNA, 23 nt, Homo sapiens
agcucagauuauuuaaaugggaa

SEQ ID NO: 1712538 - RNA, 12 nt, Homo sapiens
agcucagguguc

SEQ ID NO: 1712539 - RNA, 13 nt, Homo sapiens
agcuccacuguca

SEQ ID NO: 1712540 - RNA, 17 nt, Homo sapiens
agcuccgccucccgggu

SEQ ID NO: 1712541 - RNA, 23 nt, Homo sapiens
agcuccuucuguccuacucugug

SEQ ID NO: 1712542 - RNA, 13 nt, Homo sapiens
agcucgugugccu

SEQ ID NO: 1712543 - RNA, 15 nt, Homo sapiens
agcucuguuuuacaa

SEQ ID NO: 1712544 - RNA, 19 nt, Homo sapiens
agcucuguuuuacaauaaa

SEQ ID NO: 1712545 - RNA, 22 nt, Homo sapiens
agcugaaagauugauuaaugaa

SEQ ID NO: 1712546 - RNA, 20 nt, Homo sapiens
agcugaauuugauucuccag

SEQ ID NO: 1712547 - RNA, 21 nt, Homo sapiens
agcugaccuggagaugcugcc

SEQ ID NO: 1712548 - RNA, 13 nt, Homo sapiens
agcugauccugcg

SEQ ID NO: 1712549 - RNA, 23 nt, Homo sapiens
agcugaucugcggaucucagcuu

SEQ ID NO: 1712550 - RNA, 22 nt, Homo sapiens
agcugccaccucuccauccugc

SEQ ID NO: 1712551 - RNA, 19 nt, Homo sapiens
agcugcccuccuuguccac

SEQ ID NO: 1712552 - RNA, 16 nt, Homo sapiens
agcugccucacuuccu

SEQ ID NO: 1712553 - RNA, 16 nt, Homo sapiens
agcugccuuggcucag

SEQ ID NO: 1712554 - RNA, 22 nt, Homo sapiens
agcugccuuggcucagacaugu

SEQ ID NO: 1712555 - RNA, 20 nt, Homo sapiens
agcugcucagcaaccuuuca

SEQ ID NO: 1712556 - RNA, 16 nt, Homo sapiens
agcuggccucucuagc

SEQ ID NO: 1712557 - RNA, 17 nt, Homo sapiens
agcugggacuacagggg

SEQ ID NO: 1712558 - RNA, 22 nt, Homo sapiens
agcuggggaccugguacccucc

SEQ ID NO: 1712559 - RNA, 18 nt, Homo sapiens
agcugguaaacuauuugu

SEQ ID NO: 1712560 - RNA, 14 nt, Homo sapiens
agcugucacuuuug

SEQ ID NO: 1712561 - RNA, 19 nt, Homo sapiens
agcugucgacuucaugaca

SEQ ID NO: 1712562 - RNA, 18 nt, Homo sapiens
agcuguggaggauugcua

SEQ ID NO: 1712563 - RNA, 17 nt, Homo sapiens
agcuguuuauggccuca

SEQ ID NO: 1712564 - RNA, 18 nt, Homo sapiens
agcuguuuauggccucag

SEQ ID NO: 1712565 - RNA, 14 nt, Homo sapiens
agcuuaaacacauu

SEQ ID NO: 1712566 - RNA, 13 nt, Homo sapiens
agcuuaccugaca

SEQ ID NO: 1712567 - RNA, 18 nt, Homo sapiens
agcuuaccugacacaaga

SEQ ID NO: 1712568 - RNA, 18 nt, Homo sapiens
agcuuauauauuacuugu

SEQ ID NO: 1712569 - RNA, 20 nt, Homo sapiens
agcuucaccagagcauuucc

SEQ ID NO: 1712570 - RNA, 21 nt, Homo sapiens
agcuucagaaguuuggcaaua

SEQ ID NO: 1712571 - RNA, 21 nt, Homo sapiens
agcuuccugucaacacuucuc

SEQ ID NO: 1712572 - RNA, 22 nt, Homo sapiens
agcuugacucccaaguuuccau

SEQ ID NO: 1712573 - RNA, 15 nt, Homo sapiens
agcuuguaggagcug

SEQ ID NO: 1712574 - RNA, 19 nt, Homo sapiens
agcuuguuaucagcuuuca

SEQ ID NO: 1712575 - RNA, 16 nt, Homo sapiens
agcuuuaaacucaggg

SEQ ID NO: 1712576 - RNA, 18 nt, Homo sapiens
agcuuuacaaauauguca

SEQ ID NO: 1712577 - RNA, 20 nt, Homo sapiens
agcuuuauuaccaguggcgu

SEQ ID NO: 1712578 - RNA, 21 nt, Homo sapiens
aaaaagcuuuaugauuuucau

SEQ ID NO: 1712579 - RNA, 21 nt, Homo sapiens
aaaaagggauccguacauuca

SEQ ID NO: 1712580 - RNA, 22 nt, Homo sapiens
aaaaagggauccguacauucaa

SEQ ID NO: 1712581 - RNA, 12 nt, Homo sapiens
aaaaaguguuua

SEQ ID NO: 1712582 - RNA, 17 nt, Homo sapiens
aaaaaguuaaucuucau

SEQ ID NO: 1712583 - RNA, 17 nt, Homo sapiens
aaaaauaaaccaaagga

SEQ ID NO: 1712584 - RNA, 18 nt, Homo sapiens
aaaaauaaaucuguucug

SEQ ID NO: 1712585 - RNA, 12 nt, Homo sapiens
aaaaauacaugu

SEQ ID NO: 1712586 - RNA, 22 nt, Homo sapiens
aaaaaucuugugcuagaauacu

SEQ ID NO: 1712587 - RNA, 22 nt, Homo sapiens
aaaaauggaacuguacacuugu

SEQ ID NO: 1712588 - RNA, 14 nt, Homo sapiens
aaaaauuuacuuga

SEQ ID NO: 1712589 - RNA, 18 nt, Homo sapiens
aaaaauuugaacacuggc

SEQ ID NO: 1712590 - RNA, 20 nt, Homo sapiens
aaaacaacuucaauauccaa

SEQ ID NO: 1712591 - RNA, 14 nt, Homo sapiens
aaaacacauugccu

SEQ ID NO: 1712592 - RNA, 22 nt, Homo sapiens
aaaacaccacuaauuguguaca

SEQ ID NO: 1712593 - RNA, 14 nt, Homo sapiens
aaaacaccaugaaa

SEQ ID NO: 1712594 - RNA, 19 nt, Homo sapiens
aaaacaccgcuucugccuu

SEQ ID NO: 1712595 - RNA, 17 nt, Homo sapiens
aaaacaccuagcuuuau

SEQ ID NO: 1712596 - RNA, 13 nt, Homo sapiens
aaaacacugugga

SEQ ID NO: 1712597 - RNA, 13 nt, Homo sapiens
aaaacacuuccau

SEQ ID NO: 1712598 - RNA, 18 nt, Homo sapiens
aaaacaugauuguuuaca

SEQ ID NO: 1712599 - RNA, 22 nt, Homo sapiens
aaaaccaaaagaacaagaauuu

SEQ ID NO: 1712600 - RNA, 16 nt, Homo sapiens
aaaaccaauagcuuua

SEQ ID NO: 1712601 - RNA, 14 nt, Homo sapiens
aaaaccuacauauu

SEQ ID NO: 1712602 - RNA, 22 nt, Homo sapiens
aaaaccugaagacugaggacaa

SEQ ID NO: 1712603 - RNA, 14 nt, Homo sapiens
aaaacuacaaauca

SEQ ID NO: 1712604 - RNA, 17 nt, Homo sapiens
aaaacuccccuuccuca

SEQ ID NO: 1712605 - RNA, 17 nt, Homo sapiens
aaaacugauuuuuagcu

SEQ ID NO: 1712606 - RNA, 21 nt, Homo sapiens
aaaacugcuuacuuaugccau

SEQ ID NO: 1712607 - RNA, 15 nt, Homo sapiens
aaaacuggacaguca

SEQ ID NO: 1712608 - RNA, 18 nt, Homo sapiens
aaaacuggcuacugcucu

SEQ ID NO: 1712609 - RNA, 15 nt, Homo sapiens
aaaacugugccuugu

SEQ ID NO: 1712610 - RNA, 15 nt, Homo sapiens
aaaagaaaagaaaau

SEQ ID NO: 1712611 - RNA, 18 nt, Homo sapiens
aaaagaaccgagcaauuu

SEQ ID NO: 1712612 - RNA, 14 nt, Homo sapiens
aaaagauuauagaa

SEQ ID NO: 1712613 - RNA, 15 nt, Homo sapiens
aaaagcuagacagau

SEQ ID NO: 1712614 - RNA, 23 nt, Homo sapiens
aaaagcugaucauaagugaauuu

SEQ ID NO: 1712615 - RNA, 20 nt, Homo sapiens
aaaagcuucuuaauuaauuu

SEQ ID NO: 1712616 - RNA, 14 nt, Homo sapiens
aaaagucacuuacu

SEQ ID NO: 1712617 - RNA, 16 nt, Homo sapiens
aaaauaaaaacuauuc

SEQ ID NO: 1712618 - RNA, 17 nt, Homo sapiens
aaaauacaugcaucuca

SEQ ID NO: 1712619 - RNA, 15 nt, Homo sapiens
aaaauauauacuaaa

SEQ ID NO: 1712620 - RNA, 19 nt, Homo sapiens
aaaauauuauguguuucca

SEQ ID NO: 1712621 - RNA, 12 nt, Homo sapiens
aaaaucugucca

SEQ ID NO: 1712622 - RNA, 12 nt, Homo sapiens
aaaaugccuuug

SEQ ID NO: 1712623 - RNA, 18 nt, Homo sapiens
aaaaugguaauuguugcu

SEQ ID NO: 1712624 - RNA, 17 nt, Homo sapiens
aaaaugugucuguaaga

SEQ ID NO: 1712625 - RNA, 17 nt, Homo sapiens
aaaauguugaaccaaac

SEQ ID NO: 1712626 - RNA, 19 nt, Homo sapiens
aaaauguugagaaucccaa

SEQ ID NO: 1712627 - RNA, 18 nt, Homo sapiens
aaaauuauuauaagcauu

SEQ ID NO: 1712628 - RNA, 12 nt, Homo sapiens
aaaauuuugcuu

SEQ ID NO: 1712629 - RNA, 16 nt, Homo sapiens
aaacaaaugugauaca

SEQ ID NO: 1712630 - RNA, 20 nt, Homo sapiens
aaacaacuucaauauccaaa

SEQ ID NO: 1712631 - RNA, 19 nt, Homo sapiens
aaacaaguuuuucugucaa

SEQ ID NO: 1712632 - RNA, 18 nt, Homo sapiens
cagugagaaaaagcuccu

SEQ ID NO: 1712633 - RNA, 17 nt, Homo sapiens
cagugagauauuuggua

SEQ ID NO: 1712634 - RNA, 16 nt, Homo sapiens
cagugagaugagggau

SEQ ID NO: 1712635 - RNA, 17 nt, Homo sapiens
cagugcaaccacacacc

SEQ ID NO: 1712636 - RNA, 17 nt, Homo sapiens
cagugccagcaaugaca

SEQ ID NO: 1712637 - RNA, 13 nt, Homo sapiens
cagugcccuaggc

SEQ ID NO: 1712638 - RNA, 22 nt, Homo sapiens
caguggaugccacagcccagcu

SEQ ID NO: 1712639 - RNA, 19 nt, Homo sapiens
caguggcuucaucugucaa

SEQ ID NO: 1712640 - RNA, 15 nt, Homo sapiens
cagugguaugaucac

SEQ ID NO: 1712641 - RNA, 23 nt, Homo sapiens
caguguaaucccccaggagaaca

SEQ ID NO: 1712642 - RNA, 18 nt, Homo sapiens
caguguccccuccacugu

SEQ ID NO: 1712643 - RNA, 21 nt, Homo sapiens
caguguccccuccacugucac

SEQ ID NO: 1712644 - RNA, 12 nt, Homo sapiens
cagugugacaag

SEQ ID NO: 1712645 - RNA, 19 nt, Homo sapiens
caguguuacuguguuuauc

SEQ ID NO: 1712646 - RNA, 12 nt, Homo sapiens
caguguuuacaa

SEQ ID NO: 1712647 - RNA, 19 nt, Homo sapiens
caguuaacuauugcauuua

SEQ ID NO: 1712648 - RNA, 19 nt, Homo sapiens
caguuaugcagaauccaaa

SEQ ID NO: 1712649 - RNA, 19 nt, Homo sapiens
caguucacacccugcaagg

SEQ ID NO: 1712650 - RNA, 17 nt, Homo sapiens
caguucaccugcacuua

SEQ ID NO: 1712651 - RNA, 12 nt, Homo sapiens
caguucagauaa

SEQ ID NO: 1712652 - RNA, 21 nt, Homo sapiens
caguuccuguagaacugagaa

SEQ ID NO: 1712653 - RNA, 18 nt, Homo sapiens
caguuugauaccugcacu

SEQ ID NO: 1712654 - RNA, 19 nt, Homo sapiens
caguuugauaccugcacug

SEQ ID NO: 1712655 - RNA, 11 nt, Homo sapiens
cauaaagccau

SEQ ID NO: 1712656 - RNA, 20 nt, Homo sapiens
cauaaccaaacacaaugaug

SEQ ID NO: 1712657 - RNA, 21 nt, Homo sapiens
cauaacuaaauuugauacuua

SEQ ID NO: 1712658 - RNA, 22 nt, Homo sapiens
cauaacuaaauuugauacuuau

SEQ ID NO: 1712659 - RNA, 20 nt, Homo sapiens
cauaacucauugucugugga

SEQ ID NO: 1712660 - RNA, 17 nt, Homo sapiens
cauaacugaaggcauau

SEQ ID NO: 1712661 - RNA, 22 nt, Homo sapiens
cauaagguuucguuucuguaua

SEQ ID NO: 1712662 - RNA, 21 nt, Homo sapiens
cauaauaaaaaauuaugacaa

SEQ ID NO: 1712663 - RNA, 19 nt, Homo sapiens
cauaauuccuacagcacua

SEQ ID NO: 1712664 - RNA, 14 nt, Homo sapiens
cauacaugcauaca

SEQ ID NO: 1712665 - RNA, 17 nt, Homo sapiens
cauacauuuaugcacau

SEQ ID NO: 1712666 - RNA, 18 nt, Homo sapiens
cauacauuuaugcacauu

SEQ ID NO: 1712667 - RNA, 15 nt, Homo sapiens
cauacccuguuacca

SEQ ID NO: 1712668 - RNA, 17 nt, Homo sapiens
cauaccguguaccucag

SEQ ID NO: 1712669 - RNA, 17 nt, Homo sapiens
cauaccucugaccaaca

SEQ ID NO: 1712670 - RNA, 16 nt, Homo sapiens
cauacguucuuuucaa

SEQ ID NO: 1712671 - RNA, 21 nt, Homo sapiens
cauacuacauugaguagacac

SEQ ID NO: 1712672 - RNA, 13 nt, Homo sapiens
cauacuuaucucu

SEQ ID NO: 1712673 - RNA, 21 nt, Homo sapiens
cauacuuaucucucugugcug

SEQ ID NO: 1712674 - RNA, 17 nt, Homo sapiens
cauagaaacaugacacu

SEQ ID NO: 1712675 - RNA, 17 nt, Homo sapiens
cauagagugaucuuucc

SEQ ID NO: 1712676 - RNA, 17 nt, Homo sapiens
cauagauuaauggcacu

SEQ ID NO: 1712677 - RNA, 19 nt, Homo sapiens
cauagcaagacacaucccu

SEQ ID NO: 1712678 - RNA, 17 nt, Homo sapiens
cauaggaugguaccaag

SEQ ID NO: 1712679 - RNA, 19 nt, Homo sapiens
cauaguaaguucagcacuu

SEQ ID NO: 1712680 - RNA, 15 nt, Homo sapiens
cauaguuuauuucaa

SEQ ID NO: 1712681 - RNA, 14 nt, Homo sapiens
cauauaaguuugaa

SEQ ID NO: 1712682 - RNA, 19 nt, Homo sapiens
cauauaggugauguuugcu

SEQ ID NO: 1712683 - RNA, 16 nt, Homo sapiens
cauauauacaggcaua

SEQ ID NO: 1712684 - RNA, 17 nt, Homo sapiens
cauaucagcacauauuu

SEQ ID NO: 1712685 - RNA, 15 nt, Homo sapiens
cauauccaccaccuc

SEQ ID NO: 1712686 - RNA, 21 nt, Homo sapiens
cauaucgcugacuucauggaa

SEQ ID NO: 1712687 - RNA, 17 nt, Homo sapiens
cauaucggcucacaaag

SEQ ID NO: 1712688 - RNA, 12 nt, Homo sapiens
cauaugccuugg

SEQ ID NO: 1712689 - RNA, 23 nt, Homo sapiens
cauaugccuuggggaggacaaaa

SEQ ID NO: 1712690 - RNA, 16 nt, Homo sapiens
cauauucuguuggcca

SEQ ID NO: 1712691 - RNA, 23 nt, Homo sapiens
cauauuuucacagguguggugua

SEQ ID NO: 1712692 - RNA, 21 nt, Homo sapiens
caucaacaaagaaauauuauu

SEQ ID NO: 1712693 - RNA, 16 nt, Homo sapiens
caucacaggacacggg

SEQ ID NO: 1712694 - RNA, 19 nt, Homo sapiens
caucacccucuuccuguga

SEQ ID NO: 1712695 - RNA, 21 nt, Homo sapiens
caucacccucuuccugugauc

SEQ ID NO: 1712696 - RNA, 18 nt, Homo sapiens
caucaggccgcauccuga

SEQ ID NO: 1712697 - RNA, 18 nt, Homo sapiens
caucaggccuaaucucau

SEQ ID NO: 1712698 - RNA, 18 nt, Homo sapiens
caucagggacaggaugac

SEQ ID NO: 1712699 - RNA, 15 nt, Homo sapiens
caucauuagaacaaa

SEQ ID NO: 1712700 - RNA, 18 nt, Homo sapiens
caucauuuugacagcauc

SEQ ID NO: 1712701 - RNA, 13 nt, Homo sapiens
cauccagaggcaa

SEQ ID NO: 1712702 - RNA, 16 nt, Homo sapiens
cauccagguucagcuu

SEQ ID NO: 1712703 - RNA, 13 nt, Homo sapiens
caucccaucuaag

SEQ ID NO: 1712704 - RNA, 19 nt, Homo sapiens
cuggaaaccucuacauauu

SEQ ID NO: 1712705 - RNA, 12 nt, Homo sapiens
cuggaaauggac

SEQ ID NO: 1712706 - RNA, 23 nt, Homo sapiens
cuggaagaaaaaaaccacacaaa

SEQ ID NO: 1712707 - RNA, 18 nt, Homo sapiens
cuggaagggguccagccu

SEQ ID NO: 1712708 - RNA, 19 nt, Homo sapiens
cuggaaguucauaccuaag

SEQ ID NO: 1712709 - RNA, 19 nt, Homo sapiens
cuggaauaagaagcaaaua

SEQ ID NO: 1712710 - RNA, 21 nt, Homo sapiens
cuggaccugcccugggccaca

SEQ ID NO: 1712711 - RNA, 16 nt, Homo sapiens
cuggaccugguacaaa

SEQ ID NO: 1712712 - RNA, 21 nt, Homo sapiens
cuggacgugcgcgaugccugg

SEQ ID NO: 1712713 - RNA, 15 nt, Homo sapiens
cuggacuugccuaaa

SEQ ID NO: 1712714 - RNA, 20 nt, Homo sapiens
cuggagaacuagagaaggac

SEQ ID NO: 1712715 - RNA, 17 nt, Homo sapiens
cuggagacccaccccac

SEQ ID NO: 1712716 - RNA, 17 nt, Homo sapiens
cuggagccuccacugcc

SEQ ID NO: 1712717 - RNA, 13 nt, Homo sapiens
cuggagugcagug

SEQ ID NO: 1712718 - RNA, 20 nt, Homo sapiens
cuggaguggaguggcgugau

SEQ ID NO: 1712719 - RNA, 20 nt, Homo sapiens
ugggcuccuggggcaauggg

SEQ ID NO: 1712720 - RNA, 23 nt, Homo sapiens
ugggcuucaguaaguccccggcg

SEQ ID NO: 1712721 - RNA, 16 nt, Homo sapiens
ugggcuugaaacauua

SEQ ID NO: 1712722 - RNA, 15 nt, Homo sapiens
uggggaaaaaacugu

SEQ ID NO: 1712723 - RNA, 20 nt, Homo sapiens
uggggacccaggcuccgccc

SEQ ID NO: 1712724 - RNA, 16 nt, Homo sapiens
uggggagaaaguacuu

SEQ ID NO: 1712725 - RNA, 17 nt, Homo sapiens
uggggagcccgucucag

SEQ ID NO: 1712726 - RNA, 13 nt, Homo sapiens
uggggaggacaaa

SEQ ID NO: 1712727 - RNA, 19 nt, Homo sapiens
uggggaguaggacauacca

SEQ ID NO: 1712728 - RNA, 24 nt, Homo sapiens
uggggcaggcugggccauguccaa

SEQ ID NO: 1712729 - RNA, 18 nt, Homo sapiens
uggggccuccagaacuca

SEQ ID NO: 1712730 - RNA, 19 nt, Homo sapiens
uggggcuccucacauagcu

SEQ ID NO: 1712731 - RNA, 14 nt, Homo sapiens
ugggggacacccgg

SEQ ID NO: 1712732 - RNA, 18 nt, Homo sapiens
ugggggacgugggcauuu

SEQ ID NO: 1712733 - RNA, 22 nt, Homo sapiens
ugggucaaagugcggcugccau

SEQ ID NO: 1712734 - RNA, 22 nt, Homo sapiens
uggguccuaauuaccagucuuu

SEQ ID NO: 1712735 - RNA, 20 nt, Homo sapiens
ugggucucauuuagaacuug

SEQ ID NO: 1712736 - RNA, 19 nt, Homo sapiens
ugggucugcuggcuucuac

SEQ ID NO: 1712737 - RNA, 14 nt, Homo sapiens
ugggugcucagaau

SEQ ID NO: 1712738 - RNA, 20 nt, Homo sapiens
ugggugucaagagggucuga

SEQ ID NO: 1712739 - RNA, 14 nt, Homo sapiens
ugguacagcacugu

SEQ ID NO: 1712740 - RNA, 15 nt, Homo sapiens
ugguaccaagcauuu

SEQ ID NO: 1712741 - RNA, 23 nt, Homo sapiens
ugguacuuagaguuucuguuuga

SEQ ID NO: 1712742 - RNA, 12 nt, Homo sapiens
ugguagcacuug

SEQ ID NO: 1712743 - RNA, 15 nt, Homo sapiens
ugguaggcauuuccu

SEQ ID NO: 1712744 - RNA, 13 nt, Homo sapiens
ugguaugugacac

SEQ ID NO: 1712745 - RNA, 18 nt, Homo sapiens
uggucacagccuccucug

SEQ ID NO: 1712746 - RNA, 22 nt, Homo sapiens
uggucccugccuuaggccuacc

SEQ ID NO: 1712747 - RNA, 13 nt, Homo sapiens
uggucugacccac

SEQ ID NO: 1712748 - RNA, 22 nt, Homo sapiens
uggucuuuguaagaguguagaa

SEQ ID NO: 1712749 - RNA, 22 nt, Homo sapiens
uggucuuuguaucuuccauauu

SEQ ID NO: 1712750 - RNA, 16 nt, Homo sapiens
uggugaaagcugagaa

SEQ ID NO: 1712751 - RNA, 21 nt, Homo sapiens
uggugaagaguaguuuacuag

SEQ ID NO: 1712752 - RNA, 15 nt, Homo sapiens
uggugcccacucccg

SEQ ID NO: 1712753 - RNA, 13 nt, Homo sapiens
uggugcuaauuaa

SEQ ID NO: 1712754 - RNA, 16 nt, Homo sapiens
ugguggccaccgccag

SEQ ID NO: 1712755 - RNA, 16 nt, Homo sapiens
ugguggguucagggga

SEQ ID NO: 1712756 - RNA, 13 nt, Homo sapiens
uggugguucucag

SEQ ID NO: 1712757 - RNA, 14 nt, Homo sapiens
uggugucaguaucc

SEQ ID NO: 1712758 - RNA, 13 nt, Homo sapiens
uggugugaccuga

SEQ ID NO: 1712759 - RNA, 13 nt, Homo sapiens
uggugugccucag

SEQ ID NO: 1712760 - RNA, 14 nt, Homo sapiens
uggugugcucucuu

SEQ ID NO: 1712761 - RNA, 17 nt, Homo sapiens
ugguguggccagcacuc

SEQ ID NO: 1712762 - RNA, 14 nt, Homo sapiens
ugguuaacaucuca

SEQ ID NO: 1712763 - RNA, 20 nt, Homo sapiens
ugguuauuucucaacaaagc

SEQ ID NO: 1712764 - RNA, 22 nt, Homo sapiens
ugguucaauuucagaaguaaug

SEQ ID NO: 1712765 - RNA, 22 nt, Homo sapiens
ugguucugaaauaaacuucacu

SEQ ID NO: 1712766 - RNA, 21 nt, Homo sapiens
ugguuuacauuuaaagcauug

SEQ ID NO: 1712767 - RNA, 22 nt, Homo sapiens
uguaaaaaaaaaugccuuugag

SEQ ID NO: 1712768 - RNA, 22 nt, Homo sapiens
uguaaaaugugaagugaaugaa

SEQ ID NO: 1712769 - RNA, 16 nt, Homo sapiens
uguaaagaaauuuacu

SEQ ID NO: 1712770 - RNA, 21 nt, Homo sapiens
uguaacugacugccuugcuaa

SEQ ID NO: 1712771 - RNA, 16 nt, Homo sapiens
uguaagacucauuccc

SEQ ID NO: 1712772 - RNA, 13 nt, Homo sapiens
uguaagugcugcu

SEQ ID NO: 1712773 - RNA, 16 nt, Homo sapiens
uguaagugcugcuaua

SEQ ID NO: 1712774 - RNA, 21 nt, Homo sapiens
uguaaugaaaaugaauaucua

SEQ ID NO: 1712775 - RNA, 13 nt, Homo sapiens
uguacaacugcac

SEQ ID NO: 1712776 - RNA, 23 nt, Homo sapiens
ugcugagugaaugaacaaaugaa

SEQ ID NO: 1712777 - RNA, 20 nt, Homo sapiens
ugcugcaucuuauagcacuu

SEQ ID NO: 1712778 - RNA, 14 nt, Homo sapiens
ugcugccauuugau

SEQ ID NO: 1712779 - RNA, 12 nt, Homo sapiens
ugcugccugaau

SEQ ID NO: 1712780 - RNA, 20 nt, Homo sapiens
ugcugccuggccacugcucc

SEQ ID NO: 1712781 - RNA, 20 nt, Homo sapiens
ugcuggacgccgagaaggcc

SEQ ID NO: 1712782 - RNA, 13 nt, Homo sapiens
ugcuggacucugg

SEQ ID NO: 1712783 - RNA, 14 nt, Homo sapiens
ugcuggcugccuua

SEQ ID NO: 1712784 - RNA, 15 nt, Homo sapiens
ugcuguccugaucug

SEQ ID NO: 1712785 - RNA, 17 nt, Homo sapiens
ugcuguuggucaugugg

SEQ ID NO: 1712786 - RNA, 15 nt, Homo sapiens
ugcuuaagugccuau

SEQ ID NO: 1712787 - RNA, 18 nt, Homo sapiens
ugcuuaguguacuuggag

SEQ ID NO: 1712788 - RNA, 22 nt, Homo sapiens
ugcuucacaguagagccagcuu

SEQ ID NO: 1712789 - RNA, 19 nt, Homo sapiens
ugcuucauuguacuaccug

SEQ ID NO: 1712790 - RNA, 14 nt, Homo sapiens
ugcuucccaccucc

SEQ ID NO: 1712791 - RNA, 12 nt, Homo sapiens
ugcuucucucac

SEQ ID NO: 1712792 - RNA, 19 nt, Homo sapiens
ugcuugaucauuauaucau

SEQ ID NO: 1712793 - RNA, 17 nt, Homo sapiens
ugcuuuaaaaaaauaca

SEQ ID NO: 1712794 - RNA, 17 nt, Homo sapiens
ugcuuuguaugcacuuu

SEQ ID NO: 1712795 - RNA, 17 nt, Homo sapiens
ugcuuuuuuaaauauua

SEQ ID NO: 1712796 - RNA, 17 nt, Homo sapiens
uggaaaaaccauuugaa

SEQ ID NO: 1712797 - RNA, 13 nt, Homo sapiens
uggaaaagcaaaa

SEQ ID NO: 1712798 - RNA, 19 nt, Homo sapiens
uggaacaacugauacuuca

SEQ ID NO: 1712799 - RNA, 16 nt, Homo sapiens
uggaacagaagacagc

SEQ ID NO: 1712800 - RNA, 23 nt, Homo sapiens
uggaagaggaacagcacugggga

SEQ ID NO: 1712801 - RNA, 13 nt, Homo sapiens
uggaagauuggaa

SEQ ID NO: 1712802 - RNA, 14 nt, Homo sapiens
uggaagcacagcuu

SEQ ID NO: 1712803 - RNA, 15 nt, Homo sapiens
uggaagggguccagc

SEQ ID NO: 1712804 - RNA, 22 nt, Homo sapiens
uggaaguaaccauuugcacugg

SEQ ID NO: 1712805 - RNA, 20 nt, Homo sapiens
uggaauaaagucacagaauu

SEQ ID NO: 1712806 - RNA, 16 nt, Homo sapiens
uggaauguacucuguu

SEQ ID NO: 1712807 - RNA, 15 nt, Homo sapiens
uggaauuuguucaag

SEQ ID NO: 1712808 - RNA, 17 nt, Homo sapiens
uggacaaaugaugccau

SEQ ID NO: 1712809 - RNA, 15 nt, Homo sapiens
uggacagacagccac

SEQ ID NO: 1712810 - RNA, 17 nt, Homo sapiens
uggacaguucacacccu

SEQ ID NO: 1712811 - RNA, 20 nt, Homo sapiens
uggacaguucacacccugca

SEQ ID NO: 1712812 - RNA, 21 nt, Homo sapiens
uggacauccuguauaagcacu

SEQ ID NO: 1712813 - RNA, 12 nt, Homo sapiens
uggaccacugca

SEQ ID NO: 1712814 - RNA, 22 nt, Homo sapiens
uggaccacuguuucuugcuugu

SEQ ID NO: 1712815 - RNA, 17 nt, Homo sapiens
uggaccaguggugccuu

SEQ ID NO: 1712816 - RNA, 17 nt, Homo sapiens
uggacucugcacauguc

SEQ ID NO: 1712817 - RNA, 19 nt, Homo sapiens
uggacuguggcacuugccu

SEQ ID NO: 1712818 - RNA, 17 nt, Homo sapiens
uggacuuuccuguuguc

SEQ ID NO: 1712819 - RNA, 22 nt, Homo sapiens
uggagagcacaccuaucuuagu

SEQ ID NO: 1712820 - RNA, 23 nt, Homo sapiens
uggagagucagaucuuucuccuu

SEQ ID NO: 1712821 - RNA, 23 nt, Homo sapiens
uggagauucaguuuucauuuggu

SEQ ID NO: 1712822 - RNA, 19 nt, Homo sapiens
uggaggaacaacucuccag

SEQ ID NO: 1712823 - RNA, 21 nt, Homo sapiens
uggaggcacugaagugcuuag

SEQ ID NO: 1712824 - RNA, 17 nt, Homo sapiens
uggaggccugugccuug

SEQ ID NO: 1712825 - RNA, 16 nt, Homo sapiens
uggagggaaugcucag

SEQ ID NO: 1712826 - RNA, 15 nt, Homo sapiens
uggagggauaagcca

SEQ ID NO: 1712827 - RNA, 20 nt, Homo sapiens
uggagggguguggcuccuuc

SEQ ID NO: 1712828 - RNA, 18 nt, Homo sapiens
uggaguagauauuaauua

SEQ ID NO: 1712829 - RNA, 22 nt, Homo sapiens
uggaguccccucaccuccucua

SEQ ID NO: 1712830 - RNA, 15 nt, Homo sapiens
uggaguucuuacuug

SEQ ID NO: 1712831 - RNA, 19 nt, Homo sapiens
ugaacacuggcuaaagaua

SEQ ID NO: 1712832 - RNA, 19 nt, Homo sapiens
ugaacacuuauaagugaag

SEQ ID NO: 1712833 - RNA, 11 nt, Homo sapiens
ugaacagaauu

SEQ ID NO: 1712834 - RNA, 16 nt, Homo sapiens
ugaacauccccuccca

SEQ ID NO: 1712835 - RNA, 13 nt, Homo sapiens
ugaaccacaucuu

SEQ ID NO: 1712836 - RNA, 18 nt, Homo sapiens
ugaaccgcacagcucagg

SEQ ID NO: 1712837 - RNA, 21 nt, Homo sapiens
ugaacuaaugauaaaguaaug

SEQ ID NO: 1712838 - RNA, 20 nt, Homo sapiens
ugaacuacuaaaguuuuaca

SEQ ID NO: 1712839 - RNA, 18 nt, Homo sapiens
ugaacuagggaagcucag

SEQ ID NO: 1712840 - RNA, 21 nt, Homo sapiens
ugaacuauuucuacacagugg

SEQ ID NO: 1712841 - RNA, 12 nt, Homo sapiens
ugaacucuuaga

SEQ ID NO: 1712842 - RNA, 15 nt, Homo sapiens
ugaacugaacuaauc

SEQ ID NO: 1712843 - RNA, 13 nt, Homo sapiens
ugaacugugcaua

SEQ ID NO: 1712844 - RNA, 20 nt, Homo sapiens
ugaacuuguagcuguaaaac

SEQ ID NO: 1712845 - RNA, 21 nt, Homo sapiens
ugaagaagguggaccuuuuaa

SEQ ID NO: 1712846 - RNA, 15 nt, Homo sapiens
ugaagagcaacuggg

SEQ ID NO: 1712847 - RNA, 19 nt, Homo sapiens
ugaagagcuugcuuugauu

SEQ ID NO: 1712848 - RNA, 17 nt, Homo sapiens
ugaagauauuacuacuu

SEQ ID NO: 1712849 - RNA, 23 nt, Homo sapiens
ugaagaugcagcucacuacccua

SEQ ID NO: 1712850 - RNA, 19 nt, Homo sapiens
ugaagauuuaugaugcacu

SEQ ID NO: 1712851 - RNA, 16 nt, Homo sapiens
ugaagcgaaacacaga

SEQ ID NO: 1712852 - RNA, 16 nt, Homo sapiens
ugaaggaacauuccuu

SEQ ID NO: 1712853 - RNA, 18 nt, Homo sapiens
ugaaggugauucaccaaa

SEQ ID NO: 1712854 - RNA, 19 nt, Homo sapiens
ugaaggugauucaccaaaa

SEQ ID NO: 1712855 - RNA, 13 nt, Homo sapiens
ugaaguaagcaac

SEQ ID NO: 1712856 - RNA, 16 nt, Homo sapiens
ugaagucacacaguga

SEQ ID NO: 1712857 - RNA, 14 nt, Homo sapiens
ugaagucuaugaug

SEQ ID NO: 1712858 - RNA, 11 nt, Homo sapiens
ugaagucuugu

SEQ ID NO: 1712859 - RNA, 18 nt, Homo sapiens
ugaagugcccuucccuug

SEQ ID NO: 1712860 - RNA, 15 nt, Homo sapiens
ugaagugcgugaaug

SEQ ID NO: 1712861 - RNA, 18 nt, Homo sapiens
ugaaguugcaaugcuuca

SEQ ID NO: 1712862 - RNA, 17 nt, Homo sapiens
ugaaguuuacauuguaa

SEQ ID NO: 1712863 - RNA, 15 nt, Homo sapiens
ugaaguuuacauuuu

SEQ ID NO: 1712864 - RNA, 21 nt, Homo sapiens
ugaauaaaguguaaguucaca

SEQ ID NO: 1712865 - RNA, 13 nt, Homo sapiens
ugaauauucccaa

SEQ ID NO: 1712866 - RNA, 16 nt, Homo sapiens
ugaaugaacaaaugaa

SEQ ID NO: 1712867 - RNA, 16 nt, Homo sapiens
ugaaugagagguuccu

SEQ ID NO: 1712868 - RNA, 20 nt, Homo sapiens
ugaaugccuccuguggggaa

SEQ ID NO: 1712869 - RNA, 20 nt, Homo sapiens
ugaaugugcugaucauuuga

SEQ ID NO: 1712870 - RNA, 14 nt, Homo sapiens
ugaaugugucaggu

SEQ ID NO: 1712871 - RNA, 15 nt, Homo sapiens
ugaauucauaucgcc

SEQ ID NO: 1712872 - RNA, 14 nt, Homo sapiens
ugaauuuuguugcu

SEQ ID NO: 1712873 - RNA, 12 nt, Homo sapiens
ugacaacuguga

SEQ ID NO: 1712874 - RNA, 17 nt, Homo sapiens
ugacaacugugacugua

SEQ ID NO: 1712875 - RNA, 16 nt, Homo sapiens
ugacaagggcugaccu

SEQ ID NO: 1712876 - RNA, 22 nt, Homo sapiens
ugacaaugaagugacacuuuga

SEQ ID NO: 1712877 - RNA, 21 nt, Homo sapiens
ugacaaugacugugcuacugu

SEQ ID NO: 1712878 - RNA, 12 nt, Homo sapiens
ugacacacagcu

SEQ ID NO: 1712879 - RNA, 13 nt, Homo sapiens
ugacacacagcuc

SEQ ID NO: 1712880 - RNA, 14 nt, Homo sapiens
ugacacauaugcac

SEQ ID NO: 1712881 - RNA, 23 nt, Homo sapiens
ugacacgccuaaggucacagcua

SEQ ID NO: 1712882 - RNA, 21 nt, Homo sapiens
ugacacucuucccuccuccca

SEQ ID NO: 1712883 - RNA, 10 nt, Homo sapiens
ugacacugaa

SEQ ID NO: 1712884 - RNA, 18 nt, Homo sapiens
ugacacuuugacauuucc

SEQ ID NO: 1712885 - RNA, 17 nt, Homo sapiens
ugacagaaggugccacu

SEQ ID NO: 1712886 - RNA, 14 nt, Homo sapiens
ugacaggcaaugcu

SEQ ID NO: 1712887 - RNA, 19 nt, Homo sapiens
ugacaggccugaagauauu

SEQ ID NO: 1712888 - RNA, 23 nt, Homo sapiens
ugacaucacagcagccuccaaca

SEQ ID NO: 1712889 - RNA, 14 nt, Homo sapiens
ugacaucucagggg

SEQ ID NO: 1712890 - RNA, 19 nt, Homo sapiens
ugacaucucaggggccaga

SEQ ID NO: 1712891 - RNA, 18 nt, Homo sapiens
ugacaucucaguucacug

SEQ ID NO: 1712892 - RNA, 13 nt, Homo sapiens
ugacaugcacuga

SEQ ID NO: 1712893 - RNA, 16 nt, Homo sapiens
ugaggcaggcagauca

SEQ ID NO: 1712894 - RNA, 18 nt, Homo sapiens
ugagggucuuugcaagaa

SEQ ID NO: 1712895 - RNA, 15 nt, Homo sapiens
ugaggguuaaugaaa

SEQ ID NO: 1712896 - RNA, 14 nt, Homo sapiens
ugaguagauauuac

SEQ ID NO: 1712897 - RNA, 15 nt, Homo sapiens
ugaguagauauuacu

SEQ ID NO: 1712898 - RNA, 23 nt, Homo sapiens
ugagucaaugcgcaaaaugcagc

SEQ ID NO: 1712899 - RNA, 22 nt, Homo sapiens
ugaguccaagaggguccuuuag

SEQ ID NO: 1712900 - RNA, 15 nt, Homo sapiens
ugagucugcaugugc

SEQ ID NO: 1712901 - RNA, 22 nt, Homo sapiens
ugagugcuggauauuuuacuac

SEQ ID NO: 1712902 - RNA, 22 nt, Homo sapiens
ugagugggagaaggcagugauu

SEQ ID NO: 1712903 - RNA, 16 nt, Homo sapiens
ugaguguuauuugcac

SEQ ID NO: 1712904 - RNA, 20 nt, Homo sapiens
ugaguuaugauguaaucucu

SEQ ID NO: 1712905 - RNA, 16 nt, Homo sapiens
ugaguucgaggacuac

SEQ ID NO: 1712906 - RNA, 15 nt, Homo sapiens
ugaguugccaagaca

SEQ ID NO: 1712907 - RNA, 18 nt, Homo sapiens
ugauaaaugauagacaau

SEQ ID NO: 1712908 - RNA, 16 nt, Homo sapiens
ugauaauagauucucu

SEQ ID NO: 1712909 - RNA, 14 nt, Homo sapiens
ugauacccugaauu

SEQ ID NO: 1712910 - RNA, 19 nt, Homo sapiens
ugauacgcaacauaauuaa

SEQ ID NO: 1712911 - RNA, 20 nt, Homo sapiens
ugauaguuaauuauuucaac

SEQ ID NO: 1712912 - RNA, 13 nt, Homo sapiens
ugauauaaauucu

SEQ ID NO: 1712913 - RNA, 14 nt, Homo sapiens
ugauauauuuucca

SEQ ID NO: 1712914 - RNA, 20 nt, Homo sapiens
ugauaucuauaguagacaca

SEQ ID NO: 1712915 - RNA, 19 nt, Homo sapiens
ugaucacggcucacugcag

SEQ ID NO: 1712916 - RNA, 14 nt, Homo sapiens
ugaucagaccuugg

SEQ ID NO: 1712917 - RNA, 16 nt, Homo sapiens
ugaucagcaucuguga

SEQ ID NO: 1712918 - RNA, 17 nt, Homo sapiens
ugauccacccaccucag

SEQ ID NO: 1712919 - RNA, 16 nt, Homo sapiens
ugauccccaaguggug

SEQ ID NO: 1712920 - RNA, 21 nt, Homo sapiens
ugaucccccauagguggcuga

SEQ ID NO: 1712921 - RNA, 20 nt, Homo sapiens
ugaucucccaagcuaucuaa

SEQ ID NO: 1712922 - RNA, 21 nt, Homo sapiens
ugaugcagcauuugauaauga

SEQ ID NO: 1712923 - RNA, 13 nt, Homo sapiens
ugaugccaagaaa

SEQ ID NO: 1712924 - RNA, 14 nt, Homo sapiens
ugaugccauaugcc

SEQ ID NO: 1712925 - RNA, 23 nt, Homo sapiens
ugaugcucccuccccugcccugg

SEQ ID NO: 1712926 - RNA, 15 nt, Homo sapiens
ugaugugaaacauua

SEQ ID NO: 1712927 - RNA, 11 nt, Homo sapiens
ugauguugcug

SEQ ID NO: 1712928 - RNA, 13 nt, Homo sapiens
ugauguuuuagug

SEQ ID NO: 1712929 - RNA, 17 nt, Homo sapiens
ugauuacaaggcuuuau

SEQ ID NO: 1712930 - RNA, 15 nt, Homo sapiens
ugauuauuaaagucc

SEQ ID NO: 1712931 - RNA, 12 nt, Homo sapiens
ugauuugcaaua

SEQ ID NO: 1712932 - RNA, 14 nt, Homo sapiens
ugauuuuacuuaac

SEQ ID NO: 1712933 - RNA, 14 nt, Homo sapiens
ugauuuugugauau

SEQ ID NO: 1712934 - RNA, 23 nt, Homo sapiens
ugcaaaauauuugacuauucugu

SEQ ID NO: 1712935 - RNA, 17 nt, Homo sapiens
ugcaaacucagugcaaa

SEQ ID NO: 1712936 - RNA, 20 nt, Homo sapiens
ugcaaaguucccuacuuccu

SEQ ID NO: 1712937 - RNA, 19 nt, Homo sapiens
ugcaacaggcuugugcaac

SEQ ID NO: 1712938 - RNA, 16 nt, Homo sapiens
ugcaacccuuaccccu

SEQ ID NO: 1712939 - RNA, 22 nt, Homo sapiens
ugcaacugggucugacaugaac

SEQ ID NO: 1712940 - RNA, 15 nt, Homo sapiens
ugcaagcacaucugc

SEQ ID NO: 1712941 - RNA, 18 nt, Homo sapiens
ugcaagcgacgacagaug

SEQ ID NO: 1712942 - RNA, 18 nt, Homo sapiens
ugcaaggcccacaggagg

SEQ ID NO: 1712943 - RNA, 18 nt, Homo sapiens
ugcaauaggugugcguca

SEQ ID NO: 1712944 - RNA, 18 nt, Homo sapiens
ugcaaugggcacugggau

SEQ ID NO: 1712945 - RNA, 17 nt, Homo sapiens
ugcaauucaucccagag

SEQ ID NO: 1712946 - RNA, 19 nt, Homo sapiens
ugcaauuuucuaagcaauu

SEQ ID NO: 1712947 - RNA, 20 nt, Homo sapiens
ugcacacacacacacaugca

SEQ ID NO: 1712948 - RNA, 21 nt, Homo sapiens
ugcacacacacacacaugcac

SEQ ID NO: 1712949 - RNA, 20 nt, Homo sapiens
ugcacacguuugugagcucc

SEQ ID NO: 1712950 - RNA, 22 nt, Homo sapiens
ugcacagagucaggaucucaca

SEQ ID NO: 1712951 - RNA, 16 nt, Homo sapiens
ugcacaguagagcaaa

SEQ ID NO: 1712952 - RNA, 16 nt, Homo sapiens
aaacucuccuagucaa

SEQ ID NO: 1712953 - RNA, 20 nt, Homo sapiens
aaacucuugaccucagguga

SEQ ID NO: 1712954 - RNA, 18 nt, Homo sapiens
aaacugacuaaacuuaca

SEQ ID NO: 1712955 - RNA, 20 nt, Homo sapiens
aaacugauuuuuagcuuuac

SEQ ID NO: 1712956 - RNA, 19 nt, Homo sapiens
aaacuggacagucacugcc

SEQ ID NO: 1712957 - RNA, 22 nt, Homo sapiens
aaacuggcugcuuuguucaaug

SEQ ID NO: 1712958 - RNA, 20 nt, Homo sapiens
aaacuguuagcacuguugau

SEQ ID NO: 1712959 - RNA, 13 nt, Homo sapiens
aaacuuaacuuua

SEQ ID NO: 1712960 - RNA, 15 nt, Homo sapiens
aaacuuaauguucuu

SEQ ID NO: 1712961 - RNA, 19 nt, Homo sapiens
aaacuuagaucaucaguca

SEQ ID NO: 1712962 - RNA, 19 nt, Homo sapiens
aaacuuagugacaaaauag

SEQ ID NO: 1712963 - RNA, 23 nt, Homo sapiens
aaacuugaaguagguagcaacgu

SEQ ID NO: 1712964 - RNA, 23 nt, Homo sapiens
aaacuuguuauugugaaugauuc

SEQ ID NO: 1712965 - RNA, 17 nt, Homo sapiens
aaacuuuggcuuauaaa

SEQ ID NO: 1712966 - RNA, 17 nt, Homo sapiens
aaacuuuucugcugaua

SEQ ID NO: 1712967 - RNA, 12 nt, Homo sapiens
aaagaaauccau

SEQ ID NO: 1712968 - RNA, 19 nt, Homo sapiens
aaagaauuugauacuccuc

SEQ ID NO: 1712969 - RNA, 21 nt, Homo sapiens
aaagaauuuuccugagacaaa

SEQ ID NO: 1712970 - RNA, 13 nt, Homo sapiens
aaagacaccauuu

SEQ ID NO: 1712971 - RNA, 18 nt, Homo sapiens
aaagacaccuacugagug

SEQ ID NO: 1712972 - RNA, 12 nt, Homo sapiens
aaagacauguug

SEQ ID NO: 1712973 - RNA, 15 nt, Homo sapiens
aaagaggcugccccu

SEQ ID NO: 1712974 - RNA, 18 nt, Homo sapiens
aaagauaaaaauaucauc

SEQ ID NO: 1712975 - RNA, 16 nt, Homo sapiens
aaagauggaguuucua

SEQ ID NO: 1712976 - RNA, 18 nt, Homo sapiens
aaagauucuauaguucua

SEQ ID NO: 1712977 - RNA, 20 nt, Homo sapiens
aaagauucuucuguguuuau

SEQ ID NO: 1712978 - RNA, 13 nt, Homo sapiens
aaagcacuguagc

SEQ ID NO: 1712979 - RNA, 15 nt, Homo sapiens
aaagcagauaccuca

SEQ ID NO: 1712980 - RNA, 20 nt, Homo sapiens
aaagcagccauuggcacugu

SEQ ID NO: 1712981 - RNA, 21 nt, Homo sapiens
aaagcaguaaauuugcuagca

SEQ ID NO: 1712982 - RNA, 13 nt, Homo sapiens
aaagcaguagcau

SEQ ID NO: 1712983 - RNA, 17 nt, Homo sapiens
aaagccuccucaucccg

SEQ ID NO: 1712984 - RNA, 14 nt, Homo sapiens
aaagcucuguugca

SEQ ID NO: 1712985 - RNA, 18 nt, Homo sapiens
aaagcucuguugcaauua

SEQ ID NO: 1712986 - RNA, 20 nt, Homo sapiens
aaagcugagaacuccugacu

SEQ ID NO: 1712987 - RNA, 17 nt, Homo sapiens
aaagcugcugacagugu

SEQ ID NO: 1712988 - RNA, 21 nt, Homo sapiens
aaagcuggugucugauuuugg

SEQ ID NO: 1712989 - RNA, 12 nt, Homo sapiens
aaagcuuuauga

SEQ ID NO: 1712990 - RNA, 22 nt, Homo sapiens
aaaggagacaaguuccauggga

SEQ ID NO: 1712991 - RNA, 13 nt, Homo sapiens
aaaggccugcaca

SEQ ID NO: 1712992 - RNA, 21 nt, Homo sapiens
aaaggccugcacacaagccca

SEQ ID NO: 1712993 - RNA, 19 nt, Homo sapiens
aaagggaaguaguccuugg

SEQ ID NO: 1712994 - RNA, 23 nt, Homo sapiens
aaagggccuugacaucaguuccu

SEQ ID NO: 1712995 - RNA, 16 nt, Homo sapiens
aaagguucacucucaa

SEQ ID NO: 1712996 - RNA, 14 nt, Homo sapiens
aaagguucuagguu

SEQ ID NO: 1712997 - RNA, 13 nt, Homo sapiens
aaaguacauguau

SEQ ID NO: 1712998 - RNA, 13 nt, Homo sapiens
aaaguagauugag

SEQ ID NO: 1712999 - RNA, 17 nt, Homo sapiens
aaaguagggaccucaga

SEQ ID NO: 1713000 - RNA, 21 nt, Homo sapiens
aaaguauaaccauaugauacu

SEQ ID NO: 1713001 - RNA, 21 nt, Homo sapiens
aaaguauuuugaaguuuacau

SEQ ID NO: 1713002 - RNA, 12 nt, Homo sapiens
aaaguccugaca

SEQ ID NO: 1713003 - RNA, 14 nt, Homo sapiens
aaagugacauuugu

SEQ ID NO: 1713004 - RNA, 22 nt, Homo sapiens
aaagugcugggauuacaggcgu

SEQ ID NO: 1713005 - RNA, 14 nt, Homo sapiens
aaagugggcuugau

SEQ ID NO: 1713006 - RNA, 17 nt, Homo sapiens
aaaguguaauaauauga

SEQ ID NO: 1713007 - RNA, 17 nt, Homo sapiens
aaaguguugaccacaga

SEQ ID NO: 1713008 - RNA, 20 nt, Homo sapiens
aaaguuacugauucacugca

SEQ ID NO: 1713009 - RNA, 21 nt, Homo sapiens
aaaguuacugauucacugcau

SEQ ID NO: 1713010 - RNA, 12 nt, Homo sapiens
aaaguucccuga

SEQ ID NO: 1713011 - RNA, 18 nt, Homo sapiens
aaaguucuugguggugga

SEQ ID NO: 1713012 - RNA, 14 nt, Homo sapiens
aaaguuuacaacau

SEQ ID NO: 1713013 - RNA, 13 nt, Homo sapiens
aaauaaacuucac

SEQ ID NO: 1713014 - RNA, 15 nt, Homo sapiens
aaauaacaggcauuu

SEQ ID NO: 1713015 - RNA, 14 nt, Homo sapiens
aaauaaguggguca

SEQ ID NO: 1713016 - RNA, 14 nt, Homo sapiens
aaauacacaacaca

SEQ ID NO: 1713017 - RNA, 22 nt, Homo sapiens
aaauacauaucgcugacuucau

SEQ ID NO: 1713018 - RNA, 13 nt, Homo sapiens
aaauacauguuca

SEQ ID NO: 1713019 - RNA, 12 nt, Homo sapiens
aaauaccauuga

SEQ ID NO: 1713020 - RNA, 17 nt, Homo sapiens
aaauacuguguggaacu

SEQ ID NO: 1713021 - RNA, 12 nt, Homo sapiens
aaauaugcagug

SEQ ID NO: 1713022 - RNA, 13 nt, Homo sapiens
aaauaugcaguga

SEQ ID NO: 1713023 - RNA, 20 nt, Homo sapiens
aaauauggaacuucuaauau

SEQ ID NO: 1713024 - RNA, 19 nt, Homo sapiens
aaauauuagaagccugcag

SEQ ID NO: 1713025 - RNA, 15 nt, Homo sapiens
aaauauuauuugcua

SEQ ID NO: 1713026 - RNA, 12 nt, Homo sapiens
aaauauugucau

SEQ ID NO: 1713027 - RNA, 13 nt, Homo sapiens
aaauauuucccau

SEQ ID NO: 1713028 - RNA, 23 nt, Homo sapiens
aaauauuucccauuugugccaga

SEQ ID NO: 1713029 - RNA, 16 nt, Homo sapiens
aaauauuuggucucua

SEQ ID NO: 1713030 - RNA, 20 nt, Homo sapiens
aaauauuuuguaaugcugca

SEQ ID NO: 1713031 - RNA, 15 nt, Homo sapiens
aaaucauaguuuaaa

SEQ ID NO: 1713032 - RNA, 13 nt, Homo sapiens
aaauccaaaaaga

SEQ ID NO: 1713033 - RNA, 22 nt, Homo sapiens
aaauccaaaaagaaaugauguu

SEQ ID NO: 1713034 - RNA, 23 nt, Homo sapiens
aaauccgcauugauggccucaau

SEQ ID NO: 1713035 - RNA, 21 nt, Homo sapiens
aaauccuaagacacaaaugca

SEQ ID NO: 1713036 - RNA, 14 nt, Homo sapiens
aaaucucacucuag

SEQ ID NO: 1713037 - RNA, 16 nt, Homo sapiens
aaaucuucagcaugau

SEQ ID NO: 1713038 - RNA, 17 nt, Homo sapiens
aaaucuuggaaguacau

SEQ ID NO: 1713039 - RNA, 21 nt, Homo sapiens
aaaugaaugaggucugggcua

SEQ ID NO: 1713040 - RNA, 14 nt, Homo sapiens
aaaugacaugcacu

SEQ ID NO: 1713041 - RNA, 12 nt, Homo sapiens
aaaugagacaaa

SEQ ID NO: 1713042 - RNA, 15 nt, Homo sapiens
aaaugauagacaauu

SEQ ID NO: 1713043 - RNA, 19 nt, Homo sapiens
aaaugauauauaccacuuu

SEQ ID NO: 1713044 - RNA, 19 nt, Homo sapiens
aaaugcuagguuaauucca

SEQ ID NO: 1713045 - RNA, 20 nt, Homo sapiens
aaaugggaguacugaugaaa

SEQ ID NO: 1713046 - RNA, 18 nt, Homo sapiens
aaaugguaggcauuuccu

SEQ ID NO: 1713047 - RNA, 11 nt, Homo sapiens
aaauguacaau

SEQ ID NO: 1713048 - RNA, 23 nt, Homo sapiens
aaauguaccuucuuucacucugu

SEQ ID NO: 1713049 - RNA, 14 nt, Homo sapiens
aaauguauacuaua

SEQ ID NO: 1713050 - RNA, 19 nt, Homo sapiens
aaauguauauacacauaua

SEQ ID NO: 1713051 - RNA, 13 nt, Homo sapiens
aaaugucuaucaa

SEQ ID NO: 1713052 - RNA, 21 nt, Homo sapiens
aaaugucucuuuaaugucaca

SEQ ID NO: 1713053 - RNA, 18 nt, Homo sapiens
aaauguuaugacuaugua

SEQ ID NO: 1713054 - RNA, 19 nt, Homo sapiens
aaauguucagaagguugcu

SEQ ID NO: 1713055 - RNA, 18 nt, Homo sapiens
aaauguugagaaucccaa

SEQ ID NO: 1713056 - RNA, 12 nt, Homo sapiens
aaauguuugaua

SEQ ID NO: 1713057 - RNA, 22 nt, Homo sapiens
aaauuaaagccuuuaguaucag

SEQ ID NO: 1713058 - RNA, 13 nt, Homo sapiens
aaauuaugugaca

SEQ ID NO: 1713059 - RNA, 15 nt, Homo sapiens
aaauucagaugcugu

SEQ ID NO: 1713060 - RNA, 22 nt, Homo sapiens
aaauucaggugaaaauguucau

SEQ ID NO: 1713061 - RNA, 23 nt, Homo sapiens
aaauuccagaagaagagaagcug

SEQ ID NO: 1713062 - RNA, 13 nt, Homo sapiens
ggaagaguguuuc

SEQ ID NO: 1713063 - RNA, 19 nt, Homo sapiens
ggaagcucugaagucacau

SEQ ID NO: 1713064 - RNA, 21 nt, Homo sapiens
ggaaggaacagcaaugguguc

SEQ ID NO: 1713065 - RNA, 18 nt, Homo sapiens
ggaaguaaccauuugcac

SEQ ID NO: 1713066 - RNA, 22 nt, Homo sapiens
ggaauaaaauccuaagacacaa

SEQ ID NO: 1713067 - RNA, 20 nt, Homo sapiens
ggaauaaccuuccauacauu

SEQ ID NO: 1713068 - RNA, 20 nt, Homo sapiens
ggaauccaagccuccacagc

SEQ ID NO: 1713069 - RNA, 19 nt, Homo sapiens
ggaaugugggucugcaccu

SEQ ID NO: 1713070 - RNA, 21 nt, Homo sapiens
ggaauugcagcuguacugagg

SEQ ID NO: 1713071 - RNA, 17 nt, Homo sapiens
ggacaaaugaugccaug

SEQ ID NO: 1713072 - RNA, 11 nt, Homo sapiens
ggacacuguac

SEQ ID NO: 1713073 - RNA, 12 nt, Homo sapiens
ggacagagccau

SEQ ID NO: 1713074 - RNA, 23 nt, Homo sapiens
ggacagaggggacucugggcuau

SEQ ID NO: 1713075 - RNA, 15 nt, Homo sapiens
ggacaggcauguucu

SEQ ID NO: 1713076 - RNA, 19 nt, Homo sapiens
ggacagggcugucucugaa

SEQ ID NO: 1713077 - RNA, 16 nt, Homo sapiens
ggacaguaucccacau

SEQ ID NO: 1713078 - RNA, 18 nt, Homo sapiens
ggacaguggauuguuuau

SEQ ID NO: 1713079 - RNA, 19 nt, Homo sapiens
ggacaguuuaucaugaagc

SEQ ID NO: 1713080 - RNA, 18 nt, Homo sapiens
ggaccaaggggugggcca

SEQ ID NO: 1713081 - RNA, 15 nt, Homo sapiens
ggaccccagcuguga

SEQ ID NO: 1713082 - RNA, 18 nt, Homo sapiens
ggacgugcgcgaugccug

SEQ ID NO: 1713083 - RNA, 22 nt, Homo sapiens
ggacuaaccccaacgcacagga

SEQ ID NO: 1713084 - RNA, 23 nt, Homo sapiens
ggacuaaccccaacgcacaggaa

SEQ ID NO: 1713085 - RNA, 23 nt, Homo sapiens
ggacucaaugcacugacauuguu

SEQ ID NO: 1713086 - RNA, 20 nt, Homo sapiens
ggacugacagcaugugcccu

SEQ ID NO: 1713087 - RNA, 22 nt, Homo sapiens
ggacugagccuggcccauagaa

SEQ ID NO: 1713088 - RNA, 20 nt, Homo sapiens
ggacuguugaugaaagggac

SEQ ID NO: 1713089 - RNA, 15 nt, Homo sapiens
ggacuuccauuugcu

SEQ ID NO: 1713090 - RNA, 23 nt, Homo sapiens
ggacuugauagcaaacacugggg

SEQ ID NO: 1713091 - RNA, 22 nt, Homo sapiens
ggagaacgcggggaccccagaa

SEQ ID NO: 1713092 - RNA, 17 nt, Homo sapiens
ggagacacugugcuaua

SEQ ID NO: 1713093 - RNA, 16 nt, Homo sapiens
ggagacugucucaaga

SEQ ID NO: 1713094 - RNA, 13 nt, Homo sapiens
ggagagcccuuca

SEQ ID NO: 1713095 - RNA, 12 nt, Homo sapiens
ggagaugcugcc

SEQ ID NO: 1713096 - RNA, 19 nt, Homo sapiens
ggagcauguuuuguauaca

SEQ ID NO: 1713097 - RNA, 20 nt, Homo sapiens
ggagcauguuuuguauacaa

SEQ ID NO: 1713098 - RNA, 23 nt, Homo sapiens
ggagccagggaauccugaccuga

SEQ ID NO: 1713099 - RNA, 14 nt, Homo sapiens
ggagcccucaucuu

SEQ ID NO: 1713100 - RNA, 21 nt, Homo sapiens
ggagcugccuuggcucagaca

SEQ ID NO: 1713101 - RNA, 20 nt, Homo sapiens
ggagcuucccacuccaggac

SEQ ID NO: 1713102 - RNA, 21 nt, Homo sapiens
ggaggacccuggaaauggacu

SEQ ID NO: 1713103 - RNA, 12 nt, Homo sapiens
ggaggauguucu

SEQ ID NO: 1713104 - RNA, 20 nt, Homo sapiens
ggaggauguucugggacaca

SEQ ID NO: 1713105 - RNA, 18 nt, Homo sapiens
ggaggcaccaaacaccca

SEQ ID NO: 1713106 - RNA, 12 nt, Homo sapiens
ggaggcaccugg

SEQ ID NO: 1713107 - RNA, 23 nt, Homo sapiens
ggaggcugaagcaggagauuugc

SEQ ID NO: 1713108 - RNA, 17 nt, Homo sapiens
ggaggcugcgugccagu

SEQ ID NO: 1713109 - RNA, 16 nt, Homo sapiens
ggaggcugugugccug

SEQ ID NO: 1713110 - RNA, 21 nt, Homo sapiens
ggagggcccuccgaccacuuc

SEQ ID NO: 1713111 - RNA, 18 nt, Homo sapiens
ggagggguauuuuugccc

SEQ ID NO: 1713112 - RNA, 14 nt, Homo sapiens
ggaggucgacccca

SEQ ID NO: 1713113 - RNA, 22 nt, Homo sapiens
ggaguauauuuccgcacuucag

SEQ ID NO: 1713114 - RNA, 19 nt, Homo sapiens
ggagucagaaacuguuucu

SEQ ID NO: 1713115 - RNA, 22 nt, Homo sapiens
ggagucuugcucugucacccag

SEQ ID NO: 1713116 - RNA, 22 nt, Homo sapiens
ggaguguugggcaugugaucac

SEQ ID NO: 1713117 - RNA, 16 nt, Homo sapiens
ggaguucuuacuugac

SEQ ID NO: 1713118 - RNA, 15 nt, Homo sapiens
ggauaaggaggcacu

SEQ ID NO: 1713119 - RNA, 20 nt, Homo sapiens
ggauaaggaggcacugcuga

SEQ ID NO: 1713120 - RNA, 14 nt, Homo sapiens
ggauagaagccaac

SEQ ID NO: 1713121 - RNA, 19 nt, Homo sapiens
ggauagaucaaagucaaaa

SEQ ID NO: 1713122 - RNA, 23 nt, Homo sapiens
ggauagugggcaccccacugcaa

SEQ ID NO: 1713123 - RNA, 20 nt, Homo sapiens
ggauaucaauuaauuugaaa

SEQ ID NO: 1713124 - RNA, 19 nt, Homo sapiens
ggauaucauacuuccaucu

SEQ ID NO: 1713125 - RNA, 20 nt, Homo sapiens
ggauaucauacuuccaucug

SEQ ID NO: 1713126 - RNA, 20 nt, Homo sapiens
ggauauuaacaacaauaaca

SEQ ID NO: 1713127 - RNA, 19 nt, Homo sapiens
ggaucaguuaacuauugca

SEQ ID NO: 1713128 - RNA, 22 nt, Homo sapiens
ggaucaguuaacuauugcauuu

SEQ ID NO: 1713129 - RNA, 17 nt, Homo sapiens
ggauccagaacugcacu

SEQ ID NO: 1713130 - RNA, 21 nt, Homo sapiens
ggaucgugggccgcacugggg

SEQ ID NO: 1713131 - RNA, 14 nt, Homo sapiens
ggaucuccugucca

SEQ ID NO: 1713132 - RNA, 15 nt, Homo sapiens
ggaucuugaaugugg

SEQ ID NO: 1713133 - RNA, 19 nt, Homo sapiens
ggaugccacagcccagcuu

SEQ ID NO: 1713134 - RNA, 15 nt, Homo sapiens
ggaugccuguggaag

SEQ ID NO: 1713135 - RNA, 17 nt, Homo sapiens
ggaugucccugggccag

SEQ ID NO: 1713136 - RNA, 16 nt, Homo sapiens
ggauguucugggacac

SEQ ID NO: 1713137 - RNA, 15 nt, Homo sapiens
ggauuaaauuuaauu

SEQ ID NO: 1713138 - RNA, 16 nt, Homo sapiens
ggauugcuaugaauga

SEQ ID NO: 1713139 - RNA, 20 nt, Homo sapiens
ggauuuaauuuccaggguug

SEQ ID NO: 1713140 - RNA, 20 nt, Homo sapiens
ggauuugaugcuguuugaca

SEQ ID NO: 1713141 - RNA, 13 nt, Homo sapiens
ggcacacaccagu

SEQ ID NO: 1713142 - RNA, 15 nt, Homo sapiens
ggcacaguccaggaa

SEQ ID NO: 1713143 - RNA, 17 nt, Homo sapiens
ggcacauuccccuugcc

SEQ ID NO: 1713144 - RNA, 14 nt, Homo sapiens
ggcaccuucaccug

SEQ ID NO: 1713145 - RNA, 14 nt, Homo sapiens
ggcacgguggcuca

SEQ ID NO: 1713146 - RNA, 11 nt, Homo sapiens
ggcacugggau

SEQ ID NO: 1713147 - RNA, 10 nt, Homo sapiens
ggcacugggc

SEQ ID NO: 1713148 - RNA, 15 nt, Homo sapiens
ggcacuucauugaga

SEQ ID NO: 1713149 - RNA, 15 nt, Homo sapiens
ggcagaaccaaagcu

SEQ ID NO: 1713150 - RNA, 21 nt, Homo sapiens
ggcagacaucggccuccauga

SEQ ID NO: 1713151 - RNA, 17 nt, Homo sapiens
ggcagauggggcacuga

SEQ ID NO: 1713152 - RNA, 23 nt, Homo sapiens
ggcagauggggcacugacccagg

SEQ ID NO: 1713153 - RNA, 12 nt, Homo sapiens
ggcagcaauuua

SEQ ID NO: 1713154 - RNA, 22 nt, Homo sapiens
ggcagcggguggcauccaggcu

SEQ ID NO: 1713155 - RNA, 14 nt, Homo sapiens
ggcagggcccagug

SEQ ID NO: 1713156 - RNA, 17 nt, Homo sapiens
ggcagggcccagugaca

SEQ ID NO: 1713157 - RNA, 17 nt, Homo sapiens
ggcauauccaccaccuc

SEQ ID NO: 1713158 - RNA, 13 nt, Homo sapiens
ggcaucaaacagg

SEQ ID NO: 1713159 - RNA, 13 nt, Homo sapiens
ggcaucacugggu

SEQ ID NO: 1713160 - RNA, 22 nt, Homo sapiens
ggcaucuuugccuugggcugcu

SEQ ID NO: 1713161 - RNA, 16 nt, Homo sapiens
ggcaugccccggccac

SEQ ID NO: 1713162 - RNA, 20 nt, Homo sapiens
ggcauuugcaccuaccucac

SEQ ID NO: 1713163 - RNA, 12 nt, Homo sapiens
ggccaaguguac

SEQ ID NO: 1713164 - RNA, 21 nt, Homo sapiens
ggccaccccuaggaacucagu

SEQ ID NO: 1713165 - RNA, 22 nt, Homo sapiens
ggccaccugccugcgucuuccg

SEQ ID NO: 1713166 - RNA, 22 nt, Homo sapiens
ggccacugcucccuaagccagc

SEQ ID NO: 1713167 - RNA, 20 nt, Homo sapiens
ggccaggaguuugagaccag

SEQ ID NO: 1713168 - RNA, 19 nt, Homo sapiens
ggccaggcaugguggcuca

SEQ ID NO: 1713169 - RNA, 17 nt, Homo sapiens
ggccaggcuggucucaa

SEQ ID NO: 1713170 - RNA, 20 nt, Homo sapiens
ggccagggucugugugaaug

SEQ ID NO: 1713171 - RNA, 16 nt, Homo sapiens
guccugaucugugaua

SEQ ID NO: 1713172 - RNA, 17 nt, Homo sapiens
gucuacauacuuucauc

SEQ ID NO: 1713173 - RNA, 22 nt, Homo sapiens
gucuagacuauuaggugcaauu

SEQ ID NO: 1713174 - RNA, 23 nt, Homo sapiens
gucucacgggcaugggcacuccc

SEQ ID NO: 1713175 - RNA, 17 nt, Homo sapiens
gucucacuauguugccc

SEQ ID NO: 1713176 - RNA, 19 nt, Homo sapiens
gucuccucuuuaaaacaaa

SEQ ID NO: 1713177 - RNA, 17 nt, Homo sapiens
gucucgcuuuguugccc

SEQ ID NO: 1713178 - RNA, 21 nt, Homo sapiens
gucugcuggcuucuacacugg

SEQ ID NO: 1713179 - RNA, 22 nt, Homo sapiens
gucuggugggaggacggugcaa

SEQ ID NO: 1713180 - RNA, 22 nt, Homo sapiens
gucugugcauuucugguugcac

SEQ ID NO: 1713181 - RNA, 18 nt, Homo sapiens
gucuucauaaaguacuug

SEQ ID NO: 1713182 - RNA, 13 nt, Homo sapiens
gucuucuaaacuu

SEQ ID NO: 1713183 - RNA, 15 nt, Homo sapiens
gucuugugaaggcag

SEQ ID NO: 1713184 - RNA, 16 nt, Homo sapiens
gucuuuguucugugau

SEQ ID NO: 1713185 - RNA, 15 nt, Homo sapiens
gugaaaguacauuug

SEQ ID NO: 1713186 - RNA, 14 nt, Homo sapiens
gugaaaugcuggca

SEQ ID NO: 1713187 - RNA, 19 nt, Homo sapiens
gugaaaugcuggcauuugc

SEQ ID NO: 1713188 - RNA, 21 nt, Homo sapiens
gugaacauccccucccaucau

SEQ ID NO: 1713189 - RNA, 13 nt, Homo sapiens
gugaacugugcau

SEQ ID NO: 1713190 - RNA, 12 nt, Homo sapiens
gugaagcauuua

SEQ ID NO: 1713191 - RNA, 22 nt, Homo sapiens
gugacuuccucgccucucccac

SEQ ID NO: 1713192 - RNA, 20 nt, Homo sapiens
gugagauauuugguaccaug

SEQ ID NO: 1713193 - RNA, 15 nt, Homo sapiens
gugagccaagauugc

SEQ ID NO: 1713194 - RNA, 12 nt, Homo sapiens
gugagggguccc

SEQ ID NO: 1713195 - RNA, 13 nt, Homo sapiens
gugauccacccac

SEQ ID NO: 1713196 - RNA, 20 nt, Homo sapiens
gugaucgcacaaccugcauc

SEQ ID NO: 1713197 - RNA, 14 nt, Homo sapiens
gugauguuugcucu

SEQ ID NO: 1713198 - RNA, 14 nt, Homo sapiens
gugauuggaccagg

SEQ ID NO: 1713199 - RNA, 18 nt, Homo sapiens
gugcacacacacacacau

SEQ ID NO: 1713200 - RNA, 23 nt, Homo sapiens
gugcagcgcagcuggacucugca

SEQ ID NO: 1713201 - RNA, 20 nt, Homo sapiens
gugcagugagccgagaucac

SEQ ID NO: 1713202 - RNA, 15 nt, Homo sapiens
gugcauggaggcccu

SEQ ID NO: 1713203 - RNA, 15 nt, Homo sapiens
gugccagcaaugaca

SEQ ID NO: 1713204 - RNA, 19 nt, Homo sapiens
gugccccaugccuguccag

SEQ ID NO: 1713205 - RNA, 10 nt, Homo sapiens
gugcccucca

SEQ ID NO: 1713206 - RNA, 19 nt, Homo sapiens
gugccuacagggcugggcc

SEQ ID NO: 1713207 - RNA, 15 nt, Homo sapiens
gugccuaugggaaug

SEQ ID NO: 1713208 - RNA, 12 nt, Homo sapiens
gugccuucugcc

SEQ ID NO: 1713209 - RNA, 15 nt, Homo sapiens
gugcggcugccauug

SEQ ID NO: 1713210 - RNA, 17 nt, Homo sapiens
gugcucagagaccugaa

SEQ ID NO: 1713211 - RNA, 20 nt, Homo sapiens
gugcuccuccuuggugccug

SEQ ID NO: 1713212 - RNA, 12 nt, Homo sapiens
gugcucuaucca

SEQ ID NO: 1713213 - RNA, 16 nt, Homo sapiens
gugcucuuaagccuaa

SEQ ID NO: 1713214 - RNA, 19 nt, Homo sapiens
gugcugggauuacaggugu

SEQ ID NO: 1713215 - RNA, 16 nt, Homo sapiens
gugcugggggaaugag

SEQ ID NO: 1713216 - RNA, 18 nt, Homo sapiens
guggaacucagucauuag

SEQ ID NO: 1713217 - RNA, 17 nt, Homo sapiens
guggaccacugcaugag

SEQ ID NO: 1713218 - RNA, 21 nt, Homo sapiens
guggaccacugcaugagcuuu

SEQ ID NO: 1713219 - RNA, 13 nt, Homo sapiens
guggagcucagug

SEQ ID NO: 1713220 - RNA, 22 nt, Homo sapiens
guggcaagcugugacuucucca

SEQ ID NO: 1713221 - RNA, 16 nt, Homo sapiens
guggcaccuucaccug

SEQ ID NO: 1713222 - RNA, 20 nt, Homo sapiens
guggcagacaucggccucca

SEQ ID NO: 1713223 - RNA, 21 nt, Homo sapiens
guggcagauaaucagccucuu

SEQ ID NO: 1713224 - RNA, 13 nt, Homo sapiens
guggccaguauuu

SEQ ID NO: 1713225 - RNA, 18 nt, Homo sapiens
guggccgaggacuuugau

SEQ ID NO: 1713226 - RNA, 22 nt, Homo sapiens
guggcguuguugcauguuugaa

SEQ ID NO: 1713227 - RNA, 19 nt, Homo sapiens
guggcuuguaucaacacug

SEQ ID NO: 1713228 - RNA, 13 nt, Homo sapiens
gugggaacucuga

SEQ ID NO: 1713229 - RNA, 20 nt, Homo sapiens
gugggaucugucacaccagc

SEQ ID NO: 1713230 - RNA, 23 nt, Homo sapiens
gugggccagggcugcccugagaa

SEQ ID NO: 1713231 - RNA, 21 nt, Homo sapiens
gugggguaaccaaauguuggc

SEQ ID NO: 1713232 - RNA, 12 nt, Homo sapiens
guggguaaucca

SEQ ID NO: 1713233 - RNA, 14 nt, Homo sapiens
gugguacagcacug

SEQ ID NO: 1713234 - RNA, 15 nt, Homo sapiens
guggucaucauggcc

SEQ ID NO: 1713235 - RNA, 20 nt, Homo sapiens
gugguuuauugaaugugauu

SEQ ID NO: 1713236 - RNA, 18 nt, Homo sapiens
guguaaaauacguuugaa

SEQ ID NO: 1713237 - RNA, 20 nt, Homo sapiens
guguaaucccccaggagaac

SEQ ID NO: 1713238 - RNA, 23 nt, Homo sapiens
guguaccucaguucccucuugcu

SEQ ID NO: 1713239 - RNA, 19 nt, Homo sapiens
guguagaggguguuugcag

SEQ ID NO: 1713240 - RNA, 12 nt, Homo sapiens
guguauacaugu

SEQ ID NO: 1713241 - RNA, 12 nt, Homo sapiens
gugucaggugac

SEQ ID NO: 1713242 - RNA, 15 nt, Homo sapiens
gugucaugccaguga

SEQ ID NO: 1713243 - RNA, 15 nt, Homo sapiens
gugucauuucauucc

SEQ ID NO: 1713244 - RNA, 16 nt, Homo sapiens
guguccccuccacugu

SEQ ID NO: 1713245 - RNA, 20 nt, Homo sapiens
gugucuguacacguguccug

SEQ ID NO: 1713246 - RNA, 18 nt, Homo sapiens
gugucuuucacagcuccu

SEQ ID NO: 1713247 - RNA, 21 nt, Homo sapiens
gugugcaacagacaagugacu

SEQ ID NO: 1713248 - RNA, 16 nt, Homo sapiens
gugugcauguguguau

SEQ ID NO: 1713249 - RNA, 17 nt, Homo sapiens
gugugcauguguguaua

SEQ ID NO: 1713250 - RNA, 14 nt, Homo sapiens
gugugccauuuuaa

SEQ ID NO: 1713251 - RNA, 15 nt, Homo sapiens
guguuauuugcacac

SEQ ID NO: 1713252 - RNA, 17 nt, Homo sapiens
guguuauuugcacacug

SEQ ID NO: 1713253 - RNA, 20 nt, Homo sapiens
guuaaaacuguacauuuaaa

SEQ ID NO: 1713254 - RNA, 22 nt, Homo sapiens
guuaaacuguuagcacuguuga

SEQ ID NO: 1713255 - RNA, 18 nt, Homo sapiens
guuaaagguucacagggg

SEQ ID NO: 1713256 - RNA, 20 nt, Homo sapiens
guuaaauagaguauaugcac

SEQ ID NO: 1713257 - RNA, 18 nt, Homo sapiens
guuaaggguuaguuuaca

SEQ ID NO: 1713258 - RNA, 23 nt, Homo sapiens
guuaccauauuuauccauuugua

SEQ ID NO: 1713259 - RNA, 24 nt, Homo sapiens
guuacuggcuucucuugagucaca

SEQ ID NO: 1713260 - RNA, 15 nt, Homo sapiens
guuagcagagcugga

SEQ ID NO: 1713261 - RNA, 15 nt, Homo sapiens
guuaggauagcauuu

SEQ ID NO: 1713262 - RNA, 21 nt, Homo sapiens
guuaucaguaagaaaaagaag

SEQ ID NO: 1713263 - RNA, 18 nt, Homo sapiens
guuaucuaauauguaaca

SEQ ID NO: 1713264 - RNA, 19 nt, Homo sapiens
guuaucuguguagcaagcu

SEQ ID NO: 1713265 - RNA, 14 nt, Homo sapiens
guuaugacuaugua

SEQ ID NO: 1713266 - RNA, 16 nt, Homo sapiens
guuauggucaauccca

SEQ ID NO: 1713267 - RNA, 19 nt, Homo sapiens
guuauuuugcuauuugccu

SEQ ID NO: 1713268 - RNA, 23 nt, Homo sapiens
guucaauucucauuugucacaca

SEQ ID NO: 1713269 - RNA, 11 nt, Homo sapiens
guucacuccca

SEQ ID NO: 1713270 - RNA, 20 nt, Homo sapiens
guucaggagucccaaggaaa

SEQ ID NO: 1713271 - RNA, 13 nt, Homo sapiens
guucaggguccuu

SEQ ID NO: 1713272 - RNA, 17 nt, Homo sapiens
guucauccaggcccaac

SEQ ID NO: 1713273 - RNA, 18 nt, Homo sapiens
guucaugaugcagucucc

SEQ ID NO: 1713274 - RNA, 16 nt, Homo sapiens
guucccucuugcucag

SEQ ID NO: 1713275 - RNA, 19 nt, Homo sapiens
guucccuguucuuccucca

SEQ ID NO: 1713276 - RNA, 18 nt, Homo sapiens
guuccgcacuuuccacuu

SEQ ID NO: 1713277 - RNA, 15 nt, Homo sapiens
guucgagaccagccu

SEQ ID NO: 1713278 - RNA, 20 nt, Homo sapiens
guucgcauggucacacacug

SEQ ID NO: 1713279 - RNA, 17 nt, Homo sapiens
guucuaauggcacuuau

SEQ ID NO: 1713280 - RNA, 16 nt, Homo sapiens
guucuacccguuccaa

SEQ ID NO: 1713281 - RNA, 19 nt, Homo sapiens
uuugauacaagaaagcaau

SEQ ID NO: 1713282 - RNA, 12 nt, Homo sapiens
uuugauacuuau

SEQ ID NO: 1713283 - RNA, 14 nt, Homo sapiens
uuugauguuuacag

SEQ ID NO: 1713284 - RNA, 21 nt, Homo sapiens
uuugauuaacaaauaugcuaa

SEQ ID NO: 1713285 - RNA, 14 nt, Homo sapiens
uuugauugauuuga

SEQ ID NO: 1713286 - RNA, 15 nt, Homo sapiens
uuugauuuacauaua

SEQ ID NO: 1713287 - RNA, 16 nt, Homo sapiens
uuugauuuugauuuua

SEQ ID NO: 1713288 - RNA, 18 nt, Homo sapiens
uuugcacacugcacuguu

SEQ ID NO: 1713289 - RNA, 13 nt, Homo sapiens
uuugcacaggaug

SEQ ID NO: 1713290 - RNA, 15 nt, Homo sapiens
uuugcaguucaccug

SEQ ID NO: 1713291 - RNA, 15 nt, Homo sapiens
uuugcauguuuugua

SEQ ID NO: 1713292 - RNA, 19 nt, Homo sapiens
uuugcauuaaauucacaaa

SEQ ID NO: 1713293 - RNA, 10 nt, Homo sapiens
uuugccauuu

SEQ ID NO: 1713294 - RNA, 11 nt, Homo sapiens
uuugccuuccu

SEQ ID NO: 1713295 - RNA, 13 nt, Homo sapiens
uuugcucauggca

SEQ ID NO: 1713296 - RNA, 16 nt, Homo sapiens
uuugguuaaacccaug

SEQ ID NO: 1713297 - RNA, 17 nt, Homo sapiens
uuuguaaacgacaagaa

SEQ ID NO: 1713298 - RNA, 14 nt, Homo sapiens
uuuguaagugcugc

SEQ ID NO: 1713299 - RNA, 18 nt, Homo sapiens
uuuguaagugcugcuaua

SEQ ID NO: 1713300 - RNA, 13 nt, Homo sapiens
uuuguaaugcugc

SEQ ID NO: 1713301 - RNA, 22 nt, Homo sapiens
uuuguauacaaauauauuguua

SEQ ID NO: 1713302 - RNA, 14 nt, Homo sapiens
uuuguccuccuggg

SEQ ID NO: 1713303 - RNA, 15 nt, Homo sapiens
uuugucuuauauaua

SEQ ID NO: 1713304 - RNA, 15 nt, Homo sapiens
uuugugucacaaaga

SEQ ID NO: 1713305 - RNA, 22 nt, Homo sapiens
uuuguuacagccaagugccaaa

SEQ ID NO: 1713306 - RNA, 13 nt, Homo sapiens
uuuguuacuguuc

SEQ ID NO: 1713307 - RNA, 23 nt, Homo sapiens
uuuguuguaaaaagaaaaaccac

SEQ ID NO: 1713308 - RNA, 21 nt, Homo sapiens
uuuguuucagguucaguauua

SEQ ID NO: 1713309 - RNA, 21 nt, Homo sapiens
uuuuaaaaguuucaaugugau

SEQ ID NO: 1713310 - RNA, 22 nt, Homo sapiens
uuuuaaaaguuucaaugugauu

SEQ ID NO: 1713311 - RNA, 17 nt, Homo sapiens
uuuuaaacaaaugugau

SEQ ID NO: 1713312 - RNA, 18 nt, Homo sapiens
uuuuaaauguauacuaua

SEQ ID NO: 1713313 - RNA, 20 nt, Homo sapiens
uuuuaaauguauacuauagu

SEQ ID NO: 1713314 - RNA, 14 nt, Homo sapiens
uuuuaauaugacaa

SEQ ID NO: 1713315 - RNA, 11 nt, Homo sapiens
uuuuaccauac

SEQ ID NO: 1713316 - RNA, 13 nt, Homo sapiens
uuuuagacagagu

SEQ ID NO: 1713317 - RNA, 20 nt, Homo sapiens
uuuuauaaaauuaagcaaug

SEQ ID NO: 1713318 - RNA, 23 nt, Homo sapiens
uuuuauguguggcccaagacaau

SEQ ID NO: 1713319 - RNA, 18 nt, Homo sapiens
uuuuauuaauuuauaugu

SEQ ID NO: 1713320 - RNA, 19 nt, Homo sapiens
uuuucaaaauccaaaaaga

SEQ ID NO: 1713321 - RNA, 18 nt, Homo sapiens
uuuucaaagauguguugc

SEQ ID NO: 1713322 - RNA, 21 nt, Homo sapiens
uuuucaaucauaauaccugcu

SEQ ID NO: 1713323 - RNA, 17 nt, Homo sapiens
uuuucacagucacugau

SEQ ID NO: 1713324 - RNA, 14 nt, Homo sapiens
uuuucuaagcaauu

SEQ ID NO: 1713325 - RNA, 13 nt, Homo sapiens
uuuucugaagaca

SEQ ID NO: 1713326 - RNA, 14 nt, Homo sapiens
uuuucugccaggga

SEQ ID NO: 1713327 - RNA, 13 nt, Homo sapiens
uuuucuucaucug

SEQ ID NO: 1713328 - RNA, 14 nt, Homo sapiens
uuuucuuccuugua

SEQ ID NO: 1713329 - RNA, 15 nt, Homo sapiens
uuuucuugauuugag

SEQ ID NO: 1713330 - RNA, 15 nt, Homo sapiens
uuuugaaaaccuaaa

SEQ ID NO: 1713331 - RNA, 12 nt, Homo sapiens
uuuugaaggcaa

SEQ ID NO: 1713332 - RNA, 13 nt, Homo sapiens
uuuuguaagugcu

SEQ ID NO: 1713333 - RNA, 21 nt, Homo sapiens
uuuugucugcuuaguaucuca

SEQ ID NO: 1713334 - RNA, 22 nt, Homo sapiens
uuuugugucaaaaggacauuua

SEQ ID NO: 1713335 - RNA, 22 nt, Homo sapiens
uuuuguuaacugauuugcaaua

SEQ ID NO: 1713336 - RNA, 14 nt, Homo sapiens
uuuuguugagccag

SEQ ID NO: 1713337 - RNA, 21 nt, Homo sapiens
uuuuuaauggcaauaggacau

SEQ ID NO: 1713338 - RNA, 17 nt, Homo sapiens
uuuuuaauuuaguguga

SEQ ID NO: 1713339 - RNA, 20 nt, Homo sapiens
uuuuuagcugguggcaauaa

SEQ ID NO: 1713340 - RNA, 15 nt, Homo sapiens
uuuuucauucauccc

SEQ ID NO: 1713341 - RNA, 19 nt, Homo sapiens
uuuuuccuagccuguuucu

SEQ ID NO: 1713342 - RNA, 22 nt, Homo sapiens
uuuuucuuugagacugggucuc

SEQ ID NO: 1713343 - RNA, 16 nt, Homo sapiens
ugacacauaugcaccu

SEQ ID NO: 1713344 - RNA, 19 nt, Homo sapiens
ugacacgccuaaggucaca

SEQ ID NO: 1713345 - RNA, 23 nt, Homo sapiens
ugacagaaagcagauaccucacc

SEQ ID NO: 1713346 - RNA, 13 nt, Homo sapiens
ugacagacaauga

SEQ ID NO: 1713347 - RNA, 16 nt, Homo sapiens
ugacagaccacaucuu

SEQ ID NO: 1713348 - RNA, 16 nt, Homo sapiens
ugacagggaaaacugc

SEQ ID NO: 1713349 - RNA, 16 nt, Homo sapiens
ugacagucuugugcuu

SEQ ID NO: 1713350 - RNA, 22 nt, Homo sapiens
ugacauaacagugcagggcaaa

SEQ ID NO: 1713351 - RNA, 16 nt, Homo sapiens
ugacauaauauauucu

SEQ ID NO: 1713352 - RNA, 13 nt, Homo sapiens
ugacauuccaggg

SEQ ID NO: 1713353 - RNA, 15 nt, Homo sapiens
ugacauuguauguau

SEQ ID NO: 1713354 - RNA, 14 nt, Homo sapiens
ugacauuguuggcc

SEQ ID NO: 1713355 - RNA, 20 nt, Homo sapiens
ugaccaauugugcugccauu

SEQ ID NO: 1713356 - RNA, 21 nt, Homo sapiens
ugacccacccuagaucuuccc

SEQ ID NO: 1713357 - RNA, 21 nt, Homo sapiens
ugaccccuucccuguccuugc

SEQ ID NO: 1713358 - RNA, 20 nt, Homo sapiens
ugacccucugacccuagcuc

SEQ ID NO: 1713359 - RNA, 15 nt, Homo sapiens
ugaccucacagugac

SEQ ID NO: 1713360 - RNA, 20 nt, Homo sapiens
ugaccucagugagauauuug

SEQ ID NO: 1713361 - RNA, 14 nt, Homo sapiens
ugaccucccaguga

SEQ ID NO: 1713362 - RNA, 13 nt, Homo sapiens
ugaccucuugcug

SEQ ID NO: 1713363 - RNA, 20 nt, Homo sapiens
ugaccuggccagagccaaga

SEQ ID NO: 1713364 - RNA, 14 nt, Homo sapiens
ugaccuugagcaaa

SEQ ID NO: 1713365 - RNA, 18 nt, Homo sapiens
ugaccuuggagagacaca

SEQ ID NO: 1713366 - RNA, 22 nt, Homo sapiens
ugacgucacuggaccacugggc

SEQ ID NO: 1713367 - RNA, 17 nt, Homo sapiens
ugacuaacuagacacca

SEQ ID NO: 1713368 - RNA, 13 nt, Homo sapiens
ugacuaguacaaa

SEQ ID NO: 1713369 - RNA, 15 nt, Homo sapiens
uuugaaauaccucau

SEQ ID NO: 1713370 - RNA, 22 nt, Homo sapiens
uuugaagcuacuguguguguga

SEQ ID NO: 1713371 - RNA, 20 nt, Homo sapiens
uuugaaggcaaaauugcaaa

SEQ ID NO: 1713372 - RNA, 23 nt, Homo sapiens
uuugaagguuuuaagugguuuga

SEQ ID NO: 1713373 - RNA, 13 nt, Homo sapiens
uuugaagucuugu

SEQ ID NO: 1713374 - RNA, 20 nt, Homo sapiens
uuugacuugcaugaagagaa

SEQ ID NO: 1713375 - RNA, 20 nt, Homo sapiens
uuugagaaaugcauagcauu

SEQ ID NO: 1713376 - RNA, 17 nt, Homo sapiens
uuugauaccugcacugu

SEQ ID NO: 1713377 - RNA, 18 nt, Homo sapiens
uuugauaugaaguguuag

SEQ ID NO: 1713378 - RNA, 22 nt, Homo sapiens
uuugaugccaagaaaguauuug

SEQ ID NO: 1713379 - RNA, 14 nt, Homo sapiens
uuugauucuccagc

SEQ ID NO: 1713380 - RNA, 18 nt, Homo sapiens
uuugcaauaccaaguaua

SEQ ID NO: 1713381 - RNA, 23 nt, Homo sapiens
uuugcauuugcucuuucaucucu

SEQ ID NO: 1713382 - RNA, 17 nt, Homo sapiens
uuugccagugccucuca

SEQ ID NO: 1713383 - RNA, 14 nt, Homo sapiens
uuugccauguugcc

SEQ ID NO: 1713384 - RNA, 23 nt, Homo sapiens
uuugccuuccuuucuccaggacc

SEQ ID NO: 1713385 - RNA, 22 nt, Homo sapiens
uuugcucuuagcugucugcuca

SEQ ID NO: 1713386 - RNA, 17 nt, Homo sapiens
uuuggacuguaacugac

SEQ ID NO: 1713387 - RNA, 19 nt, Homo sapiens
uuuggagacacaacuauuu

SEQ ID NO: 1713388 - RNA, 19 nt, Homo sapiens
uuuggaguccccucaccuc

SEQ ID NO: 1713389 - RNA, 14 nt, Homo sapiens
uuugggaaccaagc

SEQ ID NO: 1713390 - RNA, 17 nt, Homo sapiens
uuuggguuuugggucuu

SEQ ID NO: 1713391 - RNA, 19 nt, Homo sapiens
uuuggugggcuuuggagcu

SEQ ID NO: 1713392 - RNA, 10 nt, Homo sapiens
uuugguucua

SEQ ID NO: 1713393 - RNA, 20 nt, Homo sapiens
uuuguaaugcugcacagaaa

SEQ ID NO: 1713394 - RNA, 22 nt, Homo sapiens
uuugucccggggcuccacugaa

SEQ ID NO: 1713395 - RNA, 13 nt, Homo sapiens
uuugucuugaaug

SEQ ID NO: 1713396 - RNA, 13 nt, Homo sapiens
uuuguggccucag

SEQ ID NO: 1713397 - RNA, 19 nt, Homo sapiens
uuuguguaucguaaccagc

SEQ ID NO: 1713398 - RNA, 18 nt, Homo sapiens
uuugugucaaaaggacau

SEQ ID NO: 1713399 - RNA, 16 nt, Homo sapiens
uuuguuucauauauac

SEQ ID NO: 1713400 - RNA, 21 nt, Homo sapiens
uuuuaaagcauauuggugcua

SEQ ID NO: 1713401 - RNA, 16 nt, Homo sapiens
uuuuaaaguguuucag

SEQ ID NO: 1713402 - RNA, 15 nt, Homo sapiens
uuuuaagugccuuua

SEQ ID NO: 1713403 - RNA, 12 nt, Homo sapiens
uuuuaauggugu

SEQ ID NO: 1713404 - RNA, 14 nt, Homo sapiens
uuuuacacauuaga

SEQ ID NO: 1713405 - RNA, 17 nt, Homo sapiens
uuuuacagugcuauuua

SEQ ID NO: 1713406 - RNA, 20 nt, Homo sapiens
uuuuacccuauacauccaca

SEQ ID NO: 1713407 - RNA, 20 nt, Homo sapiens
uuuuacugugaaacuggcac

SEQ ID NO: 1713408 - RNA, 20 nt, Homo sapiens
uuuuagaaaccccucuguag

SEQ ID NO: 1713409 - RNA, 14 nt, Homo sapiens
uuuuauacuuucag

SEQ ID NO: 1713410 - RNA, 11 nt, Homo sapiens
uuuuaugcugg

SEQ ID NO: 1713411 - RNA, 23 nt, Homo sapiens
uuuuauuuuuagacagagucuca

SEQ ID NO: 1713412 - RNA, 14 nt, Homo sapiens
uuuucaacauaacu

SEQ ID NO: 1713413 - RNA, 15 nt, Homo sapiens
uuuucaagacuuccu

SEQ ID NO: 1713414 - RNA, 21 nt, Homo sapiens
uuuucacugcuggcugccuua

SEQ ID NO: 1713415 - RNA, 12 nt, Homo sapiens
uuuuccacccau

SEQ ID NO: 1713416 - RNA, 13 nt, Homo sapiens
uuuuccacuuaga

SEQ ID NO: 1713417 - RNA, 14 nt, Homo sapiens
uuuucccauuucaa

SEQ ID NO: 1713418 - RNA, 22 nt, Homo sapiens
uuuucugcuaaaaaguccuuga

SEQ ID NO: 1713419 - RNA, 21 nt, Homo sapiens
uuuucuggccaaaagcaguaa

SEQ ID NO: 1713420 - RNA, 21 nt, Homo sapiens
uuuugagaguaaugcauacag

SEQ ID NO: 1713421 - RNA, 17 nt, Homo sapiens
uuuugccauaaugacuc

SEQ ID NO: 1713422 - RNA, 13 nt, Homo sapiens
uuuuggcuugacu

SEQ ID NO: 1713423 - RNA, 22 nt, Homo sapiens
uuuugucugcuuaguaucucau

SEQ ID NO: 1713424 - RNA, 20 nt, Homo sapiens
uuuuuaauagcuauggaauc

SEQ ID NO: 1713425 - RNA, 22 nt, Homo sapiens
uuuuuacuaaacucagaggcag

SEQ ID NO: 1713426 - RNA, 16 nt, Homo sapiens
uuuuuagugcauccag

SEQ ID NO: 1713427 - RNA, 13 nt, Homo sapiens
uuuuucuccagcu

SEQ ID NO: 1713428 - RNA, 18 nt, Homo sapiens
uuuuugggggaaggucag

SEQ ID NO: 1713429 - RNA, 14 nt, Homo sapiens
uuuuuguaacugga

SEQ ID NO: 1713430 - RNA, 19 nt, Homo sapiens
uuuuuguuaucagucaaua

SEQ ID NO: 1713431 - RNA, 20 nt, Homo sapiens
uuuuuucaaaauccaaaaag

SEQ ID NO: 1713432 - RNA, 13 nt, Homo sapiens
uuuuuucccccac

SEQ ID NO: 1713433 - RNA, 14 nt, Homo sapiens
aaauuugauuuuga

SEQ ID NO: 1713434 - RNA, 15 nt, Homo sapiens
aaauuuuaaucaaaa

SEQ ID NO: 1713435 - RNA, 23 nt, Homo sapiens
aaauuuugucuuuaacucauaaa

SEQ ID NO: 1713436 - RNA, 16 nt, Homo sapiens
aaauuuuuacugagaa

SEQ ID NO: 1713437 - RNA, 14 nt, Homo sapiens
aacaaaaaaaccac

SEQ ID NO: 1713438 - RNA, 12 nt, Homo sapiens
aacaaaacuaua

SEQ ID NO: 1713439 - RNA, 19 nt, Homo sapiens
aacaaaagcgacccauuca

SEQ ID NO: 1713440 - RNA, 12 nt, Homo sapiens
aacaaaauuaca

SEQ ID NO: 1713441 - RNA, 21 nt, Homo sapiens
aacaaacauuguguugacauu

SEQ ID NO: 1713442 - RNA, 14 nt, Homo sapiens
aacaaagaaugggc

SEQ ID NO: 1713443 - RNA, 13 nt, Homo sapiens
aacaaaguccaca

SEQ ID NO: 1713444 - RNA, 23 nt, Homo sapiens
aacaaauucauauucugucugga

SEQ ID NO: 1713445 - RNA, 13 nt, Homo sapiens
aacaacaacuauc

SEQ ID NO: 1713446 - RNA, 20 nt, Homo sapiens
aacaacauccauguccuaug

SEQ ID NO: 1713447 - RNA, 19 nt, Homo sapiens
aacaaccuggucacaggac

SEQ ID NO: 1713448 - RNA, 21 nt, Homo sapiens
aacaacuauccugacuucuaa

SEQ ID NO: 1713449 - RNA, 14 nt, Homo sapiens
aacaacuccaaaac

SEQ ID NO: 1713450 - RNA, 19 nt, Homo sapiens
aacaacuguggucaauccg

SEQ ID NO: 1713451 - RNA, 15 nt, Homo sapiens
aacaacuuacacuua

SEQ ID NO: 1713452 - RNA, 18 nt, Homo sapiens
aacaagcaaguucugaga

SEQ ID NO: 1713453 - RNA, 22 nt, Homo sapiens
aacaagguggugugaucuuaau

SEQ ID NO: 1713454 - RNA, 12 nt, Homo sapiens
aacacacaugca

SEQ ID NO: 1713455 - RNA, 19 nt, Homo sapiens
aacacacuuaucugucucu

SEQ ID NO: 1713456 - RNA, 22 nt, Homo sapiens
aacacacuuggaugcaggguuu

SEQ ID NO: 1713457 - RNA, 19 nt, Homo sapiens
aacacagcaacaaugacuu

SEQ ID NO: 1713458 - RNA, 20 nt, Homo sapiens
aacacagcaacaaugacuua

SEQ ID NO: 1713459 - RNA, 17 nt, Homo sapiens
aacacaugaacauugaa

SEQ ID NO: 1713460 - RNA, 15 nt, Homo sapiens
aacaccuagcuuuau

SEQ ID NO: 1713461 - RNA, 21 nt, Homo sapiens
aacaccuagcuuuauucuuca

SEQ ID NO: 1713462 - RNA, 17 nt, Homo sapiens
aacacuacauuacuuua

SEQ ID NO: 1713463 - RNA, 18 nt, Homo sapiens
aacacuagagucugucau

SEQ ID NO: 1713464 - RNA, 20 nt, Homo sapiens
aacacuaucauggacuacac

SEQ ID NO: 1713465 - RNA, 23 nt, Homo sapiens
aacacuguccaucuugcaucauu

SEQ ID NO: 1713466 - RNA, 18 nt, Homo sapiens
aacacuguggaacuaaua

SEQ ID NO: 1713467 - RNA, 17 nt, Homo sapiens
aacagaaagcauccuaa

SEQ ID NO: 1713468 - RNA, 18 nt, Homo sapiens
aacagaagacagcugcug

SEQ ID NO: 1713469 - RNA, 23 nt, Homo sapiens
aacagacuggcuccaacacugca

SEQ ID NO: 1713470 - RNA, 21 nt, Homo sapiens
aacagagcaagacccaucuca

SEQ ID NO: 1713471 - RNA, 13 nt, Homo sapiens
aacagaggccaug

SEQ ID NO: 1713472 - RNA, 17 nt, Homo sapiens
aacagcaauggugucag

SEQ ID NO: 1713473 - RNA, 15 nt, Homo sapiens
aacagcugucucuaa

SEQ ID NO: 1713474 - RNA, 20 nt, Homo sapiens
aacaggcuguucugcacuga

SEQ ID NO: 1713475 - RNA, 16 nt, Homo sapiens
aacauaauucacuuuc

SEQ ID NO: 1713476 - RNA, 21 nt, Homo sapiens
aacauccaaaagcaaccacaa

SEQ ID NO: 1713477 - RNA, 19 nt, Homo sapiens
aacauccuucaagaacucu

SEQ ID NO: 1713478 - RNA, 14 nt, Homo sapiens
aacaugagaugugu

SEQ ID NO: 1713479 - RNA, 19 nt, Homo sapiens
aacaugauuguuuacagcu

SEQ ID NO: 1713480 - RNA, 16 nt, Homo sapiens
aacaugccauaucuca

SEQ ID NO: 1713481 - RNA, 23 nt, Homo sapiens
aacaugugagagguuugacuaga

SEQ ID NO: 1713482 - RNA, 13 nt, Homo sapiens
aacauuaugccuu

SEQ ID NO: 1713483 - RNA, 17 nt, Homo sapiens
aacauuccaaugcauug

SEQ ID NO: 1713484 - RNA, 21 nt, Homo sapiens
aacauucuuuuaacuucuuuc

SEQ ID NO: 1713485 - RNA, 16 nt, Homo sapiens
aacauugacgauuccu

SEQ ID NO: 1713486 - RNA, 10 nt, Homo sapiens
aacauuugcc

SEQ ID NO: 1713487 - RNA, 17 nt, Homo sapiens
aacauuugccuugcaga

SEQ ID NO: 1713488 - RNA, 21 nt, Homo sapiens
aacauuuggauuggugaaugg

SEQ ID NO: 1713489 - RNA, 18 nt, Homo sapiens
aaccaaaagaauuugcac

SEQ ID NO: 1713490 - RNA, 15 nt, Homo sapiens
aaccaauagcuuuaa

SEQ ID NO: 1713491 - RNA, 20 nt, Homo sapiens
aaccacaaaggccaaacugc

SEQ ID NO: 1713492 - RNA, 15 nt, Homo sapiens
aaccaccuucaccug

SEQ ID NO: 1713493 - RNA, 17 nt, Homo sapiens
aaccacuccacuggccu

SEQ ID NO: 1713494 - RNA, 14 nt, Homo sapiens
aaccaggcagcccu

SEQ ID NO: 1713495 - RNA, 12 nt, Homo sapiens
aaccagugccaa

SEQ ID NO: 1713496 - RNA, 14 nt, Homo sapiens
aaccaguuuaucca

SEQ ID NO: 1713497 - RNA, 18 nt, Homo sapiens
aaccauaugauacuauca

SEQ ID NO: 1713498 - RNA, 11 nt, Homo sapiens
aacccaaagug

SEQ ID NO: 1713499 - RNA, 15 nt, Homo sapiens
aacccacagccaaac

SEQ ID NO: 1713500 - RNA, 19 nt, Homo sapiens
aacccaccccgcuuucgua

SEQ ID NO: 1713501 - RNA, 17 nt, Homo sapiens
aacccauucccucucca

SEQ ID NO: 1713502 - RNA, 20 nt, Homo sapiens
aaccccauguccucagcauu

SEQ ID NO: 1713503 - RNA, 23 nt, Homo sapiens
aaccccuuccagaucacugccac

SEQ ID NO: 1713504 - RNA, 12 nt, Homo sapiens
aaccgacaggcc

SEQ ID NO: 1713505 - RNA, 21 nt, Homo sapiens
aaccgguggauccucaaacaa

SEQ ID NO: 1713506 - RNA, 11 nt, Homo sapiens
aaccuacauau

SEQ ID NO: 1713507 - RNA, 14 nt, Homo sapiens
aaccuacauauucc

SEQ ID NO: 1713508 - RNA, 15 nt, Homo sapiens
aaccuacauauucca

SEQ ID NO: 1713509 - RNA, 23 nt, Homo sapiens
aaccuauuuaaaacagugaauua

SEQ ID NO: 1713510 - RNA, 20 nt, Homo sapiens
aaccucaaguaaacuccccu

SEQ ID NO: 1713511 - RNA, 14 nt, Homo sapiens
aaccucauugacaa

SEQ ID NO: 1713512 - RNA, 14 nt, Homo sapiens
aaccuccauucuau

SEQ ID NO: 1713513 - RNA, 13 nt, Homo sapiens
aaccucuacauau

SEQ ID NO: 1713514 - RNA, 16 nt, Homo sapiens
aaccucuucaugagcu

SEQ ID NO: 1713515 - RNA, 17 nt, Homo sapiens
aaccucuucuggcucaa

SEQ ID NO: 1713516 - RNA, 19 nt, Homo sapiens
aaccuuccuuccugcuuga

SEQ ID NO: 1713517 - RNA, 11 nt, Homo sapiens
aaccuuucaaa

SEQ ID NO: 1713518 - RNA, 12 nt, Homo sapiens
aacgaugugucu

SEQ ID NO: 1713519 - RNA, 12 nt, Homo sapiens
aacgcuugugaa

SEQ ID NO: 1713520 - RNA, 22 nt, Homo sapiens
aacguagcuucuaccaugaaca

SEQ ID NO: 1713521 - RNA, 16 nt, Homo sapiens
aacuaagacauaugca

SEQ ID NO: 1713522 - RNA, 24 nt, Homo sapiens
aacuaaugauaaaguaaugaucuc

SEQ ID NO: 1713523 - RNA, 15 nt, Homo sapiens
aacuacuacaaugau

SEQ ID NO: 1713524 - RNA, 16 nt, Homo sapiens
aacuagagcacagaag

SEQ ID NO: 1713525 - RNA, 20 nt, Homo sapiens
aacuauaaauauguacaauu

SEQ ID NO: 1713526 - RNA, 18 nt, Homo sapiens
aacuauaagcccacuguu

SEQ ID NO: 1713527 - RNA, 17 nt, Homo sapiens
aacuauauucauuucca

SEQ ID NO: 1713528 - RNA, 13 nt, Homo sapiens
aacuauccugacu

SEQ ID NO: 1713529 - RNA, 22 nt, Homo sapiens
aacuaugagcuugcucauuaau

SEQ ID NO: 1713530 - RNA, 16 nt, Homo sapiens
aacuauguacuuuaaa

SEQ ID NO: 1713531 - RNA, 17 nt, Homo sapiens
aacuauuacaccaaaua

SEQ ID NO: 1713532 - RNA, 20 nt, Homo sapiens
aacuauugcauuuauaugua

SEQ ID NO: 1713533 - RNA, 20 nt, Homo sapiens
aacuauuucuacacaguggg

SEQ ID NO: 1713534 - RNA, 21 nt, Homo sapiens
aacucaccagccccacugcca

SEQ ID NO: 1713535 - RNA, 19 nt, Homo sapiens
aacucagggacagagccau

SEQ ID NO: 1713536 - RNA, 19 nt, Homo sapiens
aacucaguccuguacucug

SEQ ID NO: 1713537 - RNA, 18 nt, Homo sapiens
aacucauuacuuuuccau

SEQ ID NO: 1713538 - RNA, 18 nt, Homo sapiens
aacuccaccuucccacuu

SEQ ID NO: 1713539 - RNA, 20 nt, Homo sapiens
aacuccagcaacuucuucuc

SEQ ID NO: 1713540 - RNA, 14 nt, Homo sapiens
aacuccuacaugau

SEQ ID NO: 1713541 - RNA, 13 nt, Homo sapiens
aacuccugagaaa

SEQ ID NO: 1713542 - RNA, 18 nt, Homo sapiens
aacucugagaucuaagga

SEQ ID NO: 1713543 - RNA, 15 nt, Homo sapiens
agugaagucuaugau

SEQ ID NO: 1713544 - RNA, 13 nt, Homo sapiens
agugaaucuguau

SEQ ID NO: 1713545 - RNA, 23 nt, Homo sapiens
agugacaaaauagacaauuugca

SEQ ID NO: 1713546 - RNA, 14 nt, Homo sapiens
agugacacuuugac

SEQ ID NO: 1713547 - RNA, 15 nt, Homo sapiens
agugacccacccuag

SEQ ID NO: 1713548 - RNA, 16 nt, Homo sapiens
agugaccccugaccuc

SEQ ID NO: 1713549 - RNA, 22 nt, Homo sapiens
agugaccccugccuacuuccuu

SEQ ID NO: 1713550 - RNA, 16 nt, Homo sapiens
agugacuaguacaaau

SEQ ID NO: 1713551 - RNA, 22 nt, Homo sapiens
agugacuaugaacuucucucag

SEQ ID NO: 1713552 - RNA, 16 nt, Homo sapiens
agugacuccaagaaca

SEQ ID NO: 1713553 - RNA, 21 nt, Homo sapiens
agugagauauuugguaccaug

SEQ ID NO: 1713554 - RNA, 22 nt, Homo sapiens
agugagauauuugguaccaugg

SEQ ID NO: 1713555 - RNA, 22 nt, Homo sapiens
agugagccugaauuuuguugcu

SEQ ID NO: 1713556 - RNA, 17 nt, Homo sapiens
agugauuucauucugcc

SEQ ID NO: 1713557 - RNA, 12 nt, Homo sapiens
agugcacagcug

SEQ ID NO: 1713558 - RNA, 20 nt, Homo sapiens
agugcaguggugugaucuca

SEQ ID NO: 1713559 - RNA, 14 nt, Homo sapiens
agugccaacuccuc

SEQ ID NO: 1713560 - RNA, 17 nt, Homo sapiens
agugccaaggaccuccu

SEQ ID NO: 1713561 - RNA, 16 nt, Homo sapiens
agugccacucauuccu

SEQ ID NO: 1713562 - RNA, 21 nt, Homo sapiens
agugccagcaaugacaucuca

SEQ ID NO: 1713563 - RNA, 19 nt, Homo sapiens
agugccagcccuggcagac

SEQ ID NO: 1713564 - RNA, 13 nt, Homo sapiens
agugcccuaggcc

SEQ ID NO: 1713565 - RNA, 16 nt, Homo sapiens
agugccguaacaacug

SEQ ID NO: 1713566 - RNA, 23 nt, Homo sapiens
agugcgugcucccgaugcugcua

SEQ ID NO: 1713567 - RNA, 19 nt, Homo sapiens
agugcuggcucacaguaca

SEQ ID NO: 1713568 - RNA, 15 nt, Homo sapiens
agugcuguccaugcu

SEQ ID NO: 1713569 - RNA, 20 nt, Homo sapiens
agugcuguccaugcuucuca

SEQ ID NO: 1713570 - RNA, 21 nt, Homo sapiens
agugcuguccaugcuucucau

SEQ ID NO: 1713571 - RNA, 14 nt, Homo sapiens
aguggagacagacu

SEQ ID NO: 1713572 - RNA, 22 nt, Homo sapiens
aguggagugagagcaauuguaa

SEQ ID NO: 1713573 - RNA, 16 nt, Homo sapiens
aguggauugcauuucu

SEQ ID NO: 1713574 - RNA, 23 nt, Homo sapiens
aguggccccaucauagccugcag

SEQ ID NO: 1713575 - RNA, 15 nt, Homo sapiens
aguggcgugaucucg

SEQ ID NO: 1713576 - RNA, 22 nt, Homo sapiens
aguggcguuguugcauguuuga

SEQ ID NO: 1713577 - RNA, 15 nt, Homo sapiens
agugggaacucugac

SEQ ID NO: 1713578 - RNA, 17 nt, Homo sapiens
agugggaacucugacaa

SEQ ID NO: 1713579 - RNA, 11 nt, Homo sapiens
agugggccagg

SEQ ID NO: 1713580 - RNA, 19 nt, Homo sapiens
aguggguaauccaggcaca

SEQ ID NO: 1713581 - RNA, 17 nt, Homo sapiens
aguggucuuuguaagag

SEQ ID NO: 1713582 - RNA, 21 nt, Homo sapiens
aguggugcgaucuggguucac

SEQ ID NO: 1713583 - RNA, 20 nt, Homo sapiens
agugguuguuuugucaugaa

SEQ ID NO: 1713584 - RNA, 16 nt, Homo sapiens
aguguagaagcauucc

SEQ ID NO: 1713585 - RNA, 21 nt, Homo sapiens
aguguauuuuauguguggccc

SEQ ID NO: 1713586 - RNA, 23 nt, Homo sapiens
agugucaggcgccgcacuuccuu

SEQ ID NO: 1713587 - RNA, 18 nt, Homo sapiens
agugucucagggugcaga

SEQ ID NO: 1713588 - RNA, 16 nt, Homo sapiens
agugucugucauuuca

SEQ ID NO: 1713589 - RNA, 17 nt, Homo sapiens
agugucuuagcauauuu

SEQ ID NO: 1713590 - RNA, 13 nt, Homo sapiens
agugugacagggc

SEQ ID NO: 1713591 - RNA, 12 nt, Homo sapiens
aguguggcccag

SEQ ID NO: 1713592 - RNA, 21 nt, Homo sapiens
agugugugauuucucucccac

SEQ ID NO: 1713593 - RNA, 18 nt, Homo sapiens
agugugugugugcaugug

SEQ ID NO: 1713594 - RNA, 14 nt, Homo sapiens
aguguuauuugcac

SEQ ID NO: 1713595 - RNA, 20 nt, Homo sapiens
aguguuauuugcacacugca

SEQ ID NO: 1713596 - RNA, 19 nt, Homo sapiens
aguguucuaugaacaacuc

SEQ ID NO: 1713597 - RNA, 12 nt, Homo sapiens
aguguugcccag

SEQ ID NO: 1713598 - RNA, 18 nt, Homo sapiens
aguguuucuuccacaaca

SEQ ID NO: 1713599 - RNA, 15 nt, Homo sapiens
aguguuuuuuauuca

SEQ ID NO: 1713600 - RNA, 12 nt, Homo sapiens
aguuaacuauug

SEQ ID NO: 1713601 - RNA, 18 nt, Homo sapiens
aguuaagaagcuguugua

SEQ ID NO: 1713602 - RNA, 12 nt, Homo sapiens
aguuacauauua

SEQ ID NO: 1713603 - RNA, 16 nt, Homo sapiens
aguuagguagcuuuag

SEQ ID NO: 1713604 - RNA, 18 nt, Homo sapiens
aguuaugauguaaucucu

SEQ ID NO: 1713605 - RNA, 16 nt, Homo sapiens
aguuauuaaucuggac

SEQ ID NO: 1713606 - RNA, 17 nt, Homo sapiens
aguucacacccugcaag

SEQ ID NO: 1713607 - RNA, 16 nt, Homo sapiens
aguucaccugcacuua

SEQ ID NO: 1713608 - RNA, 16 nt, Homo sapiens
aguucagagucuucag

SEQ ID NO: 1713609 - RNA, 20 nt, Homo sapiens
aguuccaagagucuaaagau

SEQ ID NO: 1713610 - RNA, 17 nt, Homo sapiens
aguuccagcagaugcca

SEQ ID NO: 1713611 - RNA, 18 nt, Homo sapiens
aguuccaugggauacaac

SEQ ID NO: 1713612 - RNA, 18 nt, Homo sapiens
aguucgaggcugcaguca

SEQ ID NO: 1713613 - RNA, 16 nt, Homo sapiens
aguucuaagauucuaa

SEQ ID NO: 1713614 - RNA, 22 nt, Homo sapiens
aguucuguuauauccccugcua

SEQ ID NO: 1713615 - RNA, 17 nt, Homo sapiens
aguucuuggucccucca

SEQ ID NO: 1713616 - RNA, 17 nt, Homo sapiens
aguugaaauucuauucu

SEQ ID NO: 1713617 - RNA, 19 nt, Homo sapiens
aguugaauaaaagugcaca

SEQ ID NO: 1713618 - RNA, 18 nt, Homo sapiens
aguugccaagacaaauca

SEQ ID NO: 1713619 - RNA, 17 nt, Homo sapiens
aguugccuaagcauugc

SEQ ID NO: 1713620 - RNA, 20 nt, Homo sapiens
aguugcguggacucugcaca

SEQ ID NO: 1713621 - RNA, 21 nt, Homo sapiens
aguugcguggacucugcacau

SEQ ID NO: 1713622 - RNA, 14 nt, Homo sapiens
aguugucaguauua

SEQ ID NO: 1713623 - RNA, 23 nt, Homo sapiens
aguugucaguauuauucuacuau

SEQ ID NO: 1713624 - RNA, 21 nt, Homo sapiens
aguuuaauuuuugaaaacugg

SEQ ID NO: 1713625 - RNA, 16 nt, Homo sapiens
aguuuacaaucagcca

SEQ ID NO: 1713626 - RNA, 17 nt, Homo sapiens
aguuuacccaugaagau

SEQ ID NO: 1713627 - RNA, 16 nt, Homo sapiens
aguuuaucaugaagcc

SEQ ID NO: 1713628 - RNA, 22 nt, Homo sapiens
aguuuaugcugugcuaaauauc

SEQ ID NO: 1713629 - RNA, 18 nt, Homo sapiens
aguuuauguuguacaaug

SEQ ID NO: 1713630 - RNA, 20 nt, Homo sapiens
aguuuauuuuuauacuuuca

SEQ ID NO: 1713631 - RNA, 21 nt, Homo sapiens
aguuucagagaaauacuuuca

SEQ ID NO: 1713632 - RNA, 22 nt, Homo sapiens
aguuucagagaaauacuuucag

SEQ ID NO: 1713633 - RNA, 14 nt, Homo sapiens
aguuucaggugaca

SEQ ID NO: 1713634 - RNA, 16 nt, Homo sapiens
aguuucuaagauucua

SEQ ID NO: 1713635 - RNA, 17 nt, Homo sapiens
aguuucuaagauucuaa

SEQ ID NO: 1713636 - RNA, 18 nt, Homo sapiens
aguuugcaguuaugcaga

SEQ ID NO: 1713637 - RNA, 13 nt, Homo sapiens
aguuugccuguac

SEQ ID NO: 1713638 - RNA, 22 nt, Homo sapiens
aguuugccuuuguaccauauaa

SEQ ID NO: 1713639 - RNA, 21 nt, Homo sapiens
aguuugcuuauguaaucucac

SEQ ID NO: 1713640 - RNA, 17 nt, Homo sapiens
aguuugcuuuguaugca

SEQ ID NO: 1713641 - RNA, 19 nt, Homo sapiens
aguuugcuuuguaugcacu

SEQ ID NO: 1713642 - RNA, 18 nt, Homo sapiens
aguuuuauuuuuguagag

SEQ ID NO: 1713643 - RNA, 21 nt, Homo sapiens
aguuuuccucuauacaucucu

SEQ ID NO: 1713644 - RNA, 20 nt, Homo sapiens
aguuuucuggagugagcacu

SEQ ID NO: 1713645 - RNA, 15 nt, Homo sapiens
aguuuucuguaguca

SEQ ID NO: 1713646 - RNA, 14 nt, Homo sapiens
aguuuuucugucaa

SEQ ID NO: 1713647 - RNA, 13 nt, Homo sapiens
auaaaacauuaug

SEQ ID NO: 1713648 - RNA, 20 nt, Homo sapiens
auaaaacuuuucugcugaua

SEQ ID NO: 1713649 - RNA, 16 nt, Homo sapiens
auaaaagauucaccug

SEQ ID NO: 1713650 - RNA, 23 nt, Homo sapiens
auaaaauccuaagacacaaaugc

SEQ ID NO: 1713651 - RNA, 20 nt, Homo sapiens
auaaacaaauaacaaugugc

SEQ ID NO: 1713652 - RNA, 14 nt, Homo sapiens
auuuuuucccccac

SEQ ID NO: 1713653 - RNA, 12 nt, Homo sapiens
caaaaacuuugg

SEQ ID NO: 1713654 - RNA, 16 nt, Homo sapiens
caaaaagaaaugaugu

SEQ ID NO: 1713655 - RNA, 22 nt, Homo sapiens
caaaaagggauccguacauuca

SEQ ID NO: 1713656 - RNA, 21 nt, Homo sapiens
caaaacaaguuuuucugucaa

SEQ ID NO: 1713657 - RNA, 12 nt, Homo sapiens
caaaacauaucu

SEQ ID NO: 1713658 - RNA, 13 nt, Homo sapiens
caaaacauaucuu

SEQ ID NO: 1713659 - RNA, 17 nt, Homo sapiens
caaaacauuuuacuuua

SEQ ID NO: 1713660 - RNA, 14 nt, Homo sapiens
caaaacuacaaauc

SEQ ID NO: 1713661 - RNA, 16 nt, Homo sapiens
caaaacuucuugucag

SEQ ID NO: 1713662 - RNA, 22 nt, Homo sapiens
caaaagaggagcacuuccaaaa

SEQ ID NO: 1713663 - RNA, 14 nt, Homo sapiens
caaaagaugccauu

SEQ ID NO: 1713664 - RNA, 14 nt, Homo sapiens
caaaagaugucuga

SEQ ID NO: 1713665 - RNA, 20 nt, Homo sapiens
caaaagcuuauucaucuguu

SEQ ID NO: 1713666 - RNA, 15 nt, Homo sapiens
caaaagcuuuuuacu

SEQ ID NO: 1713667 - RNA, 15 nt, Homo sapiens
caaaaggaaaaagcu

SEQ ID NO: 1713668 - RNA, 22 nt, Homo sapiens
caaaagucaccacuccauuccc

SEQ ID NO: 1713669 - RNA, 23 nt, Homo sapiens
caaaagucaccacuccauuccca

SEQ ID NO: 1713670 - RNA, 14 nt, Homo sapiens
caaaaguucccuga

SEQ ID NO: 1713671 - RNA, 18 nt, Homo sapiens
caaaauagacaauuugca

SEQ ID NO: 1713672 - RNA, 13 nt, Homo sapiens
caaaaugcuuuuu

SEQ ID NO: 1713673 - RNA, 12 nt, Homo sapiens
caaaauguguaa

SEQ ID NO: 1713674 - RNA, 20 nt, Homo sapiens
caaaauucuaaaaauuugca

SEQ ID NO: 1713675 - RNA, 17 nt, Homo sapiens
caaacagaacaggguca

SEQ ID NO: 1713676 - RNA, 18 nt, Homo sapiens
caaacagggcaaaguguu

SEQ ID NO: 1713677 - RNA, 22 nt, Homo sapiens
caaaccaagucggaacagcaga

SEQ ID NO: 1713678 - RNA, 13 nt, Homo sapiens
caaacccauuccc

SEQ ID NO: 1713679 - RNA, 16 nt, Homo sapiens
caaaccccgaccaccu

SEQ ID NO: 1713680 - RNA, 14 nt, Homo sapiens
caaaccuaccaaaa

SEQ ID NO: 1713681 - RNA, 13 nt, Homo sapiens
caaaccucaagua

SEQ ID NO: 1713682 - RNA, 22 nt, Homo sapiens
caaaccuucugccuuugauguu

SEQ ID NO: 1713683 - RNA, 14 nt, Homo sapiens
caaacuugcuuuau

SEQ ID NO: 1713684 - RNA, 18 nt, Homo sapiens
caaagaaaugcugaugga

SEQ ID NO: 1713685 - RNA, 14 nt, Homo sapiens
caaagaaugggcuu

SEQ ID NO: 1713686 - RNA, 20 nt, Homo sapiens
caaagaaugggcuugaaaca

SEQ ID NO: 1713687 - RNA, 13 nt, Homo sapiens
caaagaggcugcc

SEQ ID NO: 1713688 - RNA, 19 nt, Homo sapiens
caaagaguauauguucccu

SEQ ID NO: 1713689 - RNA, 23 nt, Homo sapiens
caaagaucaaaauaaaaagugac

SEQ ID NO: 1713690 - RNA, 15 nt, Homo sapiens
caaagcccacugcca

SEQ ID NO: 1713691 - RNA, 20 nt, Homo sapiens
caaagcuguuaaacuguuag

SEQ ID NO: 1713692 - RNA, 18 nt, Homo sapiens
caaaggacagaguaugaa

SEQ ID NO: 1713693 - RNA, 20 nt, Homo sapiens
caaaggacagaguaugaaca

SEQ ID NO: 1713694 - RNA, 16 nt, Homo sapiens
caaagucaaaaauagc

SEQ ID NO: 1713695 - RNA, 18 nt, Homo sapiens
caaaguccuuuuuuucca

SEQ ID NO: 1713696 - RNA, 14 nt, Homo sapiens
caaagugaaggaca

SEQ ID NO: 1713697 - RNA, 18 nt, Homo sapiens
caaagugcggcugccauu

SEQ ID NO: 1713698 - RNA, 19 nt, Homo sapiens
caaagugcugagauuacag

SEQ ID NO: 1713699 - RNA, 22 nt, Homo sapiens
caaaguuaaaagcaaacacuua

SEQ ID NO: 1713700 - RNA, 13 nt, Homo sapiens
caaauaaaaucua

SEQ ID NO: 1713701 - RNA, 17 nt, Homo sapiens
caaaucaaacauauucu

SEQ ID NO: 1713702 - RNA, 18 nt, Homo sapiens
caaaucaaacauauucua

SEQ ID NO: 1713703 - RNA, 20 nt, Homo sapiens
caaaucagaccuggcugcuu

SEQ ID NO: 1713704 - RNA, 17 nt, Homo sapiens
caaauccucuaauugca

SEQ ID NO: 1713705 - RNA, 22 nt, Homo sapiens
caaaucguccagcgaccuuccu

SEQ ID NO: 1713706 - RNA, 16 nt, Homo sapiens
caaaucuugaaauuaa

SEQ ID NO: 1713707 - RNA, 18 nt, Homo sapiens
caaaugacaugcacugac

SEQ ID NO: 1713708 - RNA, 13 nt, Homo sapiens
caaaugaugccau

SEQ ID NO: 1713709 - RNA, 20 nt, Homo sapiens
caaaugguaggcauuuccua

SEQ ID NO: 1713710 - RNA, 15 nt, Homo sapiens
caaauuaagaaucua

SEQ ID NO: 1713711 - RNA, 18 nt, Homo sapiens
caaauucauauucugucu

SEQ ID NO: 1713712 - RNA, 21 nt, Homo sapiens
caaauuugauugauuugaaga

SEQ ID NO: 1713713 - RNA, 18 nt, Homo sapiens
caacaacauccauguccu

SEQ ID NO: 1713714 - RNA, 19 nt, Homo sapiens
caacaacauccauguccua

SEQ ID NO: 1713715 - RNA, 12 nt, Homo sapiens
caacaaccaagc

SEQ ID NO: 1713716 - RNA, 17 nt, Homo sapiens
caacacccaaagcaugg

SEQ ID NO: 1713717 - RNA, 14 nt, Homo sapiens
caacagacaaguga

SEQ ID NO: 1713718 - RNA, 22 nt, Homo sapiens
caacaggcuguucugcacugaa

SEQ ID NO: 1713719 - RNA, 16 nt, Homo sapiens
caacaggcuugugcaa

SEQ ID NO: 1713720 - RNA, 17 nt, Homo sapiens
caacagugagucuguca

SEQ ID NO: 1713721 - RNA, 18 nt, Homo sapiens
caacagugagucugucag

SEQ ID NO: 1713722 - RNA, 15 nt, Homo sapiens
caacauaacugaagg

SEQ ID NO: 1713723 - RNA, 22 nt, Homo sapiens
caacauaauuaaauuuugaguu

SEQ ID NO: 1713724 - RNA, 13 nt, Homo sapiens
caacauccugcca

SEQ ID NO: 1713725 - RNA, 20 nt, Homo sapiens
caacauccugccagccccac

SEQ ID NO: 1713726 - RNA, 21 nt, Homo sapiens
caacauggcaaaaccccaucu

SEQ ID NO: 1713727 - RNA, 18 nt, Homo sapiens
caacauugcuugugccac

SEQ ID NO: 1713728 - RNA, 17 nt, Homo sapiens
caaccaagcgcauccaa

SEQ ID NO: 1713729 - RNA, 15 nt, Homo sapiens
caaccacacaccuca

SEQ ID NO: 1713730 - RNA, 13 nt, Homo sapiens
caaccacaugcag

SEQ ID NO: 1713731 - RNA, 19 nt, Homo sapiens
caaccagagaagcugcuac

SEQ ID NO: 1713732 - RNA, 15 nt, Homo sapiens
caaccagugccaagg

SEQ ID NO: 1713733 - RNA, 22 nt, Homo sapiens
caaccaguuuauccaccaagaa

SEQ ID NO: 1713734 - RNA, 12 nt, Homo sapiens
caaccucaucca

SEQ ID NO: 1713735 - RNA, 16 nt, Homo sapiens
caaccucauccaggcu

SEQ ID NO: 1713736 - RNA, 19 nt, Homo sapiens
caaccucauugacaagaac

SEQ ID NO: 1713737 - RNA, 20 nt, Homo sapiens
caaccugcucuccucuugcc

SEQ ID NO: 1713738 - RNA, 22 nt, Homo sapiens
caaccugcugaagggcagaggu

SEQ ID NO: 1713739 - RNA, 21 nt, Homo sapiens
caacuacuauucaaaaccuca

SEQ ID NO: 1713740 - RNA, 12 nt, Homo sapiens
caacuagccauc

SEQ ID NO: 1713741 - RNA, 20 nt, Homo sapiens
caacucugagaucuaaggau

SEQ ID NO: 1713742 - RNA, 13 nt, Homo sapiens
caacugaccagcc

SEQ ID NO: 1713743 - RNA, 19 nt, Homo sapiens
caacugaggauguggcuua

SEQ ID NO: 1713744 - RNA, 21 nt, Homo sapiens
caacugcaucuccaaacauua

SEQ ID NO: 1713745 - RNA, 21 nt, Homo sapiens
caacugcccccgccacaaccc

SEQ ID NO: 1713746 - RNA, 18 nt, Homo sapiens
caacugucuaacuuuaga

SEQ ID NO: 1713747 - RNA, 16 nt, Homo sapiens
caacuguggucaaucc

SEQ ID NO: 1713748 - RNA, 11 nt, Homo sapiens
caacuguguug

SEQ ID NO: 1713749 - RNA, 19 nt, Homo sapiens
caacuugaaauuauaucug

SEQ ID NO: 1713750 - RNA, 21 nt, Homo sapiens
caacuuucuguuggauuccau

SEQ ID NO: 1713751 - RNA, 15 nt, Homo sapiens
caacuuuguuuucca

SEQ ID NO: 1713752 - RNA, 23 nt, Homo sapiens
caagaaaacaacuucaauaucca

SEQ ID NO: 1713753 - RNA, 12 nt, Homo sapiens
caagaaaaucag

SEQ ID NO: 1713754 - RNA, 17 nt, Homo sapiens
caagaaaguauuuggua

SEQ ID NO: 1713755 - RNA, 22 nt, Homo sapiens
caagaaccaggcagcccugcca

SEQ ID NO: 1713756 - RNA, 20 nt, Homo sapiens
caagaacuuucucugccauc

SEQ ID NO: 1713757 - RNA, 20 nt, Homo sapiens
caagaaguagcagugucugu

SEQ ID NO: 1713758 - RNA, 18 nt, Homo sapiens
caagaaguuuauucucau

SEQ ID NO: 1713759 - RNA, 23 nt, Homo sapiens
caagaauagaugcugacuguacu

SEQ ID NO: 1713760 - RNA, 15 nt, Homo sapiens
caagacaaauucaaa

SEQ ID NO: 1713761 - RNA, 13 nt, Homo sapiens
caagacucuagag

SEQ ID NO: 1713762 - RNA, 20 nt, Homo sapiens
caggacuuccauuugcuuug

SEQ ID NO: 1713763 - RNA, 19 nt, Homo sapiens
caggacuuguuuacaaaga

SEQ ID NO: 1713764 - RNA, 14 nt, Homo sapiens
caggagacaguuca

SEQ ID NO: 1713765 - RNA, 19 nt, Homo sapiens
caggagauuugcuugaacc

SEQ ID NO: 1713766 - RNA, 11 nt, Homo sapiens
caggagcucuu

SEQ ID NO: 1713767 - RNA, 15 nt, Homo sapiens
caggaggcaagcaag

SEQ ID NO: 1713768 - RNA, 20 nt, Homo sapiens
caggaggcccccaucuauga

SEQ ID NO: 1713769 - RNA, 16 nt, Homo sapiens
caggagggcccuaccu

SEQ ID NO: 1713770 - RNA, 17 nt, Homo sapiens
caggauauccuuaucag

SEQ ID NO: 1713771 - RNA, 15 nt, Homo sapiens
caggaucuguacaau

SEQ ID NO: 1713772 - RNA, 12 nt, Homo sapiens
caggauggucau

SEQ ID NO: 1713773 - RNA, 12 nt, Homo sapiens
caggauucauug

SEQ ID NO: 1713774 - RNA, 16 nt, Homo sapiens
caggauuucuaaucaa

SEQ ID NO: 1713775 - RNA, 21 nt, Homo sapiens
caggcaacuucaguccuggga

SEQ ID NO: 1713776 - RNA, 13 nt, Homo sapiens
caggcaagcaccu

SEQ ID NO: 1713777 - RNA, 16 nt, Homo sapiens
caggcaagcaccuccu

SEQ ID NO: 1713778 - RNA, 14 nt, Homo sapiens
caggcaauuucacc

SEQ ID NO: 1713779 - RNA, 12 nt, Homo sapiens
caggcaccugcc

SEQ ID NO: 1713780 - RNA, 13 nt, Homo sapiens
caggcaccugcca

SEQ ID NO: 1713781 - RNA, 16 nt, Homo sapiens
caggcacuaagacuaa

SEQ ID NO: 1713782 - RNA, 12 nt, Homo sapiens
caggcacugggc

SEQ ID NO: 1713783 - RNA, 12 nt, Homo sapiens
caggcagacuac

SEQ ID NO: 1713784 - RNA, 19 nt, Homo sapiens
caggcagacuacacaggau

SEQ ID NO: 1713785 - RNA, 16 nt, Homo sapiens
caggcagaucugugcc

SEQ ID NO: 1713786 - RNA, 15 nt, Homo sapiens
caggcagggucuguu

SEQ ID NO: 1713787 - RNA, 16 nt, Homo sapiens
caggcagguccagggu

SEQ ID NO: 1713788 - RNA, 18 nt, Homo sapiens
caggcauuugacugaaga

SEQ ID NO: 1713789 - RNA, 16 nt, Homo sapiens
caggccagcaagcucu

SEQ ID NO: 1713790 - RNA, 17 nt, Homo sapiens
caggccauacuuuacaa

SEQ ID NO: 1713791 - RNA, 14 nt, Homo sapiens
caggccccugccac

SEQ ID NO: 1713792 - RNA, 15 nt, Homo sapiens
caggcccugcagugu

SEQ ID NO: 1713793 - RNA, 18 nt, Homo sapiens
caggcccuuccucuccac

SEQ ID NO: 1713794 - RNA, 21 nt, Homo sapiens
caggcccuuccucuccacugc

SEQ ID NO: 1713795 - RNA, 17 nt, Homo sapiens
caggccgggguggagca

SEQ ID NO: 1713796 - RNA, 18 nt, Homo sapiens
caggccgggguggagcau

SEQ ID NO: 1713797 - RNA, 22 nt, Homo sapiens
caggccuggacuuccagugcuc

SEQ ID NO: 1713798 - RNA, 18 nt, Homo sapiens
caggccuuaccgcucugu

SEQ ID NO: 1713799 - RNA, 19 nt, Homo sapiens
caggccuugggcuccugau

SEQ ID NO: 1713800 - RNA, 20 nt, Homo sapiens
caggcgugagccaccgcgcc

SEQ ID NO: 1713801 - RNA, 22 nt, Homo sapiens
caggcucucugguguucagggu

SEQ ID NO: 1713802 - RNA, 15 nt, Homo sapiens
caggcuggacaugcu

SEQ ID NO: 1713803 - RNA, 14 nt, Homo sapiens
caggcugggccaug

SEQ ID NO: 1713804 - RNA, 20 nt, Homo sapiens
caggcugggcuucaguggca

SEQ ID NO: 1713805 - RNA, 19 nt, Homo sapiens
caggcuguucugcacugaa

SEQ ID NO: 1713806 - RNA, 13 nt, Homo sapiens
caggcuucaucaa

SEQ ID NO: 1713807 - RNA, 15 nt, Homo sapiens
caggcuugugcaaca

SEQ ID NO: 1713808 - RNA, 13 nt, Homo sapiens
cagggaaaacugc

SEQ ID NO: 1713809 - RNA, 16 nt, Homo sapiens
cagggaaaacugcaaa

SEQ ID NO: 1713810 - RNA, 19 nt, Homo sapiens
cagggaagcugucccucac

SEQ ID NO: 1713811 - RNA, 20 nt, Homo sapiens
cagggacuccaugcugccag

SEQ ID NO: 1713812 - RNA, 22 nt, Homo sapiens
cagggauuuagacuuacuauua

SEQ ID NO: 1713813 - RNA, 13 nt, Homo sapiens
cagggcaaaauau

SEQ ID NO: 1713814 - RNA, 22 nt, Homo sapiens
cagggcagccccacaacuuuaa

SEQ ID NO: 1713815 - RNA, 20 nt, Homo sapiens
cagggcagccucccccggcu

SEQ ID NO: 1713816 - RNA, 17 nt, Homo sapiens
cagggcagugcuaguga

SEQ ID NO: 1713817 - RNA, 17 nt, Homo sapiens
cagggcaugccccggcc

SEQ ID NO: 1713818 - RNA, 17 nt, Homo sapiens
cagggccaggacugagc

SEQ ID NO: 1713819 - RNA, 14 nt, Homo sapiens
cagggcccagugac

SEQ ID NO: 1713820 - RNA, 18 nt, Homo sapiens
cagggccuggggccugag

SEQ ID NO: 1713821 - RNA, 18 nt, Homo sapiens
caggggaggugauagcau

SEQ ID NO: 1713822 - RNA, 20 nt, Homo sapiens
cagggggugugucugcucag

SEQ ID NO: 1713823 - RNA, 18 nt, Homo sapiens
cagggucauguuugcagg

SEQ ID NO: 1713824 - RNA, 19 nt, Homo sapiens
cagggucucacucugucgc

SEQ ID NO: 1713825 - RNA, 12 nt, Homo sapiens
cagggugagcuc

SEQ ID NO: 1713826 - RNA, 14 nt, Homo sapiens
caggguugguagca

SEQ ID NO: 1713827 - RNA, 13 nt, Homo sapiens
caggguuuuuacc

SEQ ID NO: 1713828 - RNA, 19 nt, Homo sapiens
cagguaagggggugcagca

SEQ ID NO: 1713829 - RNA, 15 nt, Homo sapiens
caggucugcagcucc

SEQ ID NO: 1713830 - RNA, 15 nt, Homo sapiens
caggugaaaauccau

SEQ ID NO: 1713831 - RNA, 20 nt, Homo sapiens
caggugaaaauccaucucau

SEQ ID NO: 1713832 - RNA, 17 nt, Homo sapiens
caggugaacugggagca

SEQ ID NO: 1713833 - RNA, 21 nt, Homo sapiens
caggugauccacccaccucag

SEQ ID NO: 1713834 - RNA, 19 nt, Homo sapiens
caggugugugccaccacac

SEQ ID NO: 1713835 - RNA, 21 nt, Homo sapiens
cagguguuaacauuccaagac

SEQ ID NO: 1713836 - RNA, 17 nt, Homo sapiens
cagguguucugggcucc

SEQ ID NO: 1713837 - RNA, 15 nt, Homo sapiens
cagguuaaugcugaa

SEQ ID NO: 1713838 - RNA, 15 nt, Homo sapiens
cagguuuuuggucug

SEQ ID NO: 1713839 - RNA, 13 nt, Homo sapiens
caguaaacauaaa

SEQ ID NO: 1713840 - RNA, 19 nt, Homo sapiens
caguaaauaacaggcauuu

SEQ ID NO: 1713841 - RNA, 19 nt, Homo sapiens
caguaaauguacaacugca

SEQ ID NO: 1713842 - RNA, 23 nt, Homo sapiens
caguaaauguacaacugcaccug

SEQ ID NO: 1713843 - RNA, 23 nt, Homo sapiens
caguaaauuugcuagcaguaaaa

SEQ ID NO: 1713844 - RNA, 13 nt, Homo sapiens
caguacaugggaa

SEQ ID NO: 1713845 - RNA, 19 nt, Homo sapiens
caguagaaauaauaugcau

SEQ ID NO: 1713846 - RNA, 15 nt, Homo sapiens
caguagagccagcuu

SEQ ID NO: 1713847 - RNA, 16 nt, Homo sapiens
caguaucccacaucca

SEQ ID NO: 1713848 - RNA, 17 nt, Homo sapiens
caguauucuugucaaaa

SEQ ID NO: 1713849 - RNA, 19 nt, Homo sapiens
cagucaaaauguuugauau

SEQ ID NO: 1713850 - RNA, 22 nt, Homo sapiens
cagucacaugaccugaucacua

SEQ ID NO: 1713851 - RNA, 20 nt, Homo sapiens
cagucagcucucuccuuuca

SEQ ID NO: 1713852 - RNA, 16 nt, Homo sapiens
caguccauagcagaga

SEQ ID NO: 1713853 - RNA, 19 nt, Homo sapiens
caguccaugcuucuagccu

SEQ ID NO: 1713854 - RNA, 15 nt, Homo sapiens
cagucccaucagaga

SEQ ID NO: 1713855 - RNA, 23 nt, Homo sapiens
cagucccuaaagaaaaaaaauca

SEQ ID NO: 1713856 - RNA, 20 nt, Homo sapiens
cagucccuauguauuugcag

SEQ ID NO: 1713857 - RNA, 21 nt, Homo sapiens
cagucgaugcguucacuccaa

SEQ ID NO: 1713858 - RNA, 22 nt, Homo sapiens
cagucucuucgaggcuuuacag

SEQ ID NO: 1713859 - RNA, 21 nt, Homo sapiens
cagugaauuaaauuuucacua

SEQ ID NO: 1713860 - RNA, 15 nt, Homo sapiens
cagugaccccugacc

SEQ ID NO: 1713861 - RNA, 18 nt, Homo sapiens
cagugacuggugccagug

SEQ ID NO: 1713862 - RNA, 18 nt, Homo sapiens
cagugagauauuugguac

SEQ ID NO: 1713863 - RNA, 20 nt, Homo sapiens
cagugagccaagauugcgcc

SEQ ID NO: 1713864 - RNA, 22 nt, Homo sapiens
cagugccuggacaaaugaugcc

SEQ ID NO: 1713865 - RNA, 23 nt, Homo sapiens
cagugcuaaaauucagaugcugu

SEQ ID NO: 1713866 - RNA, 18 nt, Homo sapiens
cagugggaguaccaaaga

SEQ ID NO: 1713867 - RNA, 18 nt, Homo sapiens
caguguuuuaaauucuga

SEQ ID NO: 1713868 - RNA, 19 nt, Homo sapiens
caguuaaucagcaaccuga

SEQ ID NO: 1713869 - RNA, 17 nt, Homo sapiens
caguuaccacacaucua

SEQ ID NO: 1713870 - RNA, 18 nt, Homo sapiens
caguucauugcacuuuga

SEQ ID NO: 1713871 - RNA, 21 nt, Homo sapiens
caguugaaugacaacagaagc

SEQ ID NO: 1713872 - RNA, 11 nt, Homo sapiens
cauguuugcag

SEQ ID NO: 1713873 - RNA, 22 nt, Homo sapiens
cauuaaaaaaauuagaaaguag

SEQ ID NO: 1713874 - RNA, 21 nt, Homo sapiens
cauuaaaccugucuccacugu

SEQ ID NO: 1713875 - RNA, 13 nt, Homo sapiens
cauuaacacaaag

SEQ ID NO: 1713876 - RNA, 14 nt, Homo sapiens
cauuaauacaaaga

SEQ ID NO: 1713877 - RNA, 13 nt, Homo sapiens
cauuaauguuucu

SEQ ID NO: 1713878 - RNA, 14 nt, Homo sapiens
cauuauacauuuga

SEQ ID NO: 1713879 - RNA, 22 nt, Homo sapiens
cauuauaucauuggaacaacug

SEQ ID NO: 1713880 - RNA, 20 nt, Homo sapiens
cauuaucaguugacagugua

SEQ ID NO: 1713881 - RNA, 21 nt, Homo sapiens
cauuaugaguaguguggaauu

SEQ ID NO: 1713882 - RNA, 12 nt, Homo sapiens
cauuauguauga

SEQ ID NO: 1713883 - RNA, 21 nt, Homo sapiens
cauuaugugugcaugugugua

SEQ ID NO: 1713884 - RNA, 15 nt, Homo sapiens
cauuauuuucuguca

SEQ ID NO: 1713885 - RNA, 17 nt, Homo sapiens
cauucaauagcauauca

SEQ ID NO: 1713886 - RNA, 16 nt, Homo sapiens
cauucaauauugacau

SEQ ID NO: 1713887 - RNA, 18 nt, Homo sapiens
cauucaauguuuaugcaa

SEQ ID NO: 1713888 - RNA, 13 nt, Homo sapiens
cauucacauucag

SEQ ID NO: 1713889 - RNA, 17 nt, Homo sapiens
cauucagagagcagcuu

SEQ ID NO: 1713890 - RNA, 21 nt, Homo sapiens
cauucagggcuauuuuuuccc

SEQ ID NO: 1713891 - RNA, 16 nt, Homo sapiens
cauucaucucauucca

SEQ ID NO: 1713892 - RNA, 18 nt, Homo sapiens
cauuccagacugcuucca

SEQ ID NO: 1713893 - RNA, 13 nt, Homo sapiens
cauucuagguagg

SEQ ID NO: 1713894 - RNA, 15 nt, Homo sapiens
cauucuauuuuagaa

SEQ ID NO: 1713895 - RNA, 15 nt, Homo sapiens
cauucuccugccuca

SEQ ID NO: 1713896 - RNA, 19 nt, Homo sapiens
cauucucgugagucauuua

SEQ ID NO: 1713897 - RNA, 17 nt, Homo sapiens
cauucugccugcccagg

SEQ ID NO: 1713898 - RNA, 21 nt, Homo sapiens
cauugaaacuacuacaaugau

SEQ ID NO: 1713899 - RNA, 16 nt, Homo sapiens
cauugaacacaaacug

SEQ ID NO: 1713900 - RNA, 17 nt, Homo sapiens
cauugacccauagcaca

SEQ ID NO: 1713901 - RNA, 23 nt, Homo sapiens
cauugaccgcgacuaauuucaaa

SEQ ID NO: 1713902 - RNA, 19 nt, Homo sapiens
cauugaucaaauauuucaa

SEQ ID NO: 1713903 - RNA, 17 nt, Homo sapiens
cauugauggccucaaug

SEQ ID NO: 1713904 - RNA, 14 nt, Homo sapiens
cauugcaauuugca

SEQ ID NO: 1713905 - RNA, 15 nt, Homo sapiens
cauugcaauuugcag

SEQ ID NO: 1713906 - RNA, 14 nt, Homo sapiens
cauugcacuuugau

SEQ ID NO: 1713907 - RNA, 17 nt, Homo sapiens
cauugcgugauucaaug

SEQ ID NO: 1713908 - RNA, 15 nt, Homo sapiens
cauugcuuucgugua

SEQ ID NO: 1713909 - RNA, 15 nt, Homo sapiens
cauuggacuuccucc

SEQ ID NO: 1713910 - RNA, 20 nt, Homo sapiens
cauuggauucaucagcauuu

SEQ ID NO: 1713911 - RNA, 20 nt, Homo sapiens
cauugggguuccgcacuuuc

SEQ ID NO: 1713912 - RNA, 23 nt, Homo sapiens
cauugucgcuauugauuuuuacu

SEQ ID NO: 1713913 - RNA, 20 nt, Homo sapiens
cauuuaaaaaaaucacaaaa

SEQ ID NO: 1713914 - RNA, 16 nt, Homo sapiens
cauuuaaaauucaauu

SEQ ID NO: 1713915 - RNA, 22 nt, Homo sapiens
cauuuagaggacauucuggaaa

SEQ ID NO: 1713916 - RNA, 17 nt, Homo sapiens
cauuuauuuuaagcacu

SEQ ID NO: 1713917 - RNA, 13 nt, Homo sapiens
cauuucauuccau

SEQ ID NO: 1713918 - RNA, 18 nt, Homo sapiens
cauuuccaacaccacaga

SEQ ID NO: 1713919 - RNA, 15 nt, Homo sapiens
cauuuccaagcacuu

SEQ ID NO: 1713920 - RNA, 16 nt, Homo sapiens
cauuucuguaaauacc

SEQ ID NO: 1713921 - RNA, 13 nt, Homo sapiens
cauuucuugugau

SEQ ID NO: 1713922 - RNA, 22 nt, Homo sapiens
cauuugauaaugauaaaacacc

SEQ ID NO: 1713923 - RNA, 15 nt, Homo sapiens
cauuugcauuugcuc

SEQ ID NO: 1713924 - RNA, 14 nt, Homo sapiens
cauuugcucuuuca

SEQ ID NO: 1713925 - RNA, 12 nt, Homo sapiens
cauuugugucaa

SEQ ID NO: 1713926 - RNA, 16 nt, Homo sapiens
cauuugugugcucaug

SEQ ID NO: 1713927 - RNA, 13 nt, Homo sapiens
cauuuuaaaaaca

SEQ ID NO: 1713928 - RNA, 15 nt, Homo sapiens
cauuuucuuucaugg

SEQ ID NO: 1713929 - RNA, 19 nt, Homo sapiens
cauuuuggcgcuauuacaa

SEQ ID NO: 1713930 - RNA, 21 nt, Homo sapiens
cauuuuuaguagagacagggu

SEQ ID NO: 1713931 - RNA, 15 nt, Homo sapiens
ccaaaagcaguaaau

SEQ ID NO: 1713932 - RNA, 18 nt, Homo sapiens
ccaaaauaaaaccagcuc

SEQ ID NO: 1713933 - RNA, 20 nt, Homo sapiens
ccaaagaaaugaacauucca

SEQ ID NO: 1713934 - RNA, 22 nt, Homo sapiens
ccaaagcauggacuaaccccaa

SEQ ID NO: 1713935 - RNA, 14 nt, Homo sapiens
ccaaaggacauuau

SEQ ID NO: 1713936 - RNA, 18 nt, Homo sapiens
ccaaagucucuaauucua

SEQ ID NO: 1713937 - RNA, 20 nt, Homo sapiens
ccaaagugaccuacccagag

SEQ ID NO: 1713938 - RNA, 14 nt, Homo sapiens
ccaaaguuauccag

SEQ ID NO: 1713939 - RNA, 12 nt, Homo sapiens
ccaaaguucuaa

SEQ ID NO: 1713940 - RNA, 15 nt, Homo sapiens
ccaaauaugagaugc

SEQ ID NO: 1713941 - RNA, 23 nt, Homo sapiens
ccaaauuagggcaauuggaacaa

SEQ ID NO: 1713942 - RNA, 14 nt, Homo sapiens
ccaaauugcagcuu

SEQ ID NO: 1713943 - RNA, 15 nt, Homo sapiens
ccaaauuuggcuaaa

SEQ ID NO: 1713944 - RNA, 16 nt, Homo sapiens
ccaaauuuggcuaaaa

SEQ ID NO: 1713945 - RNA, 12 nt, Homo sapiens
ccaacacccaaa

SEQ ID NO: 1713946 - RNA, 13 nt, Homo sapiens
ccaacacccaaag

SEQ ID NO: 1713947 - RNA, 15 nt, Homo sapiens
ccaacacccugucua

SEQ ID NO: 1713948 - RNA, 16 nt, Homo sapiens
ccaacagcgacauagc

SEQ ID NO: 1713949 - RNA, 19 nt, Homo sapiens
ccaacccuaucuccugaca

SEQ ID NO: 1713950 - RNA, 13 nt, Homo sapiens
ccaacgcacagga

SEQ ID NO: 1713951 - RNA, 16 nt, Homo sapiens
ccaacgcacaggaaaa

SEQ ID NO: 1713952 - RNA, 18 nt, Homo sapiens
ccaacugaacugaacuaa

SEQ ID NO: 1713953 - RNA, 22 nt, Homo sapiens
ccaacuugagggcccagagcag

SEQ ID NO: 1713954 - RNA, 20 nt, Homo sapiens
ccaacuugguucugcuucaa

SEQ ID NO: 1713955 - RNA, 22 nt, Homo sapiens
ccaacuugguucugcuucaaua

SEQ ID NO: 1713956 - RNA, 16 nt, Homo sapiens
ccaacuuuguuuucca

SEQ ID NO: 1713957 - RNA, 19 nt, Homo sapiens
ccaagaauccacauuucua

SEQ ID NO: 1713958 - RNA, 22 nt, Homo sapiens
ccaagccuucgggcgucugugu

SEQ ID NO: 1713959 - RNA, 22 nt, Homo sapiens
ccaagcucccugccccaaauaa

SEQ ID NO: 1713960 - RNA, 20 nt, Homo sapiens
ccaaggaacaaaaaaaccac

SEQ ID NO: 1713961 - RNA, 20 nt, Homo sapiens
ccaagguuuaaagagucuag

SEQ ID NO: 1713962 - RNA, 22 nt, Homo sapiens
ccaaguagucugcucacaguaa

SEQ ID NO: 1713963 - RNA, 15 nt, Homo sapiens
ccaagucaugugcau

SEQ ID NO: 1713964 - RNA, 11 nt, Homo sapiens
ccaagugugaa

SEQ ID NO: 1713965 - RNA, 20 nt, Homo sapiens
ccaauacuagucaccccaag

SEQ ID NO: 1713966 - RNA, 18 nt, Homo sapiens
ccaaucggagacaaaagc

SEQ ID NO: 1713967 - RNA, 17 nt, Homo sapiens
ccaaucuccaucuguca

SEQ ID NO: 1713968 - RNA, 18 nt, Homo sapiens
ccaaugagacucuagggu

SEQ ID NO: 1713969 - RNA, 18 nt, Homo sapiens
ccaauugugcugccauuu

SEQ ID NO: 1713970 - RNA, 23 nt, Homo sapiens
ccaauuuucuggaauacaugaaa

SEQ ID NO: 1713971 - RNA, 15 nt, Homo sapiens
ccacacccacuuugu

SEQ ID NO: 1713972 - RNA, 18 nt, Homo sapiens
ccacacccacuuugucca

SEQ ID NO: 1713973 - RNA, 14 nt, Homo sapiens
ccacacucuccauc

SEQ ID NO: 1713974 - RNA, 15 nt, Homo sapiens
ccacacucuccauca

SEQ ID NO: 1713975 - RNA, 21 nt, Homo sapiens
ccacagagagggagagcagag

SEQ ID NO: 1713976 - RNA, 14 nt, Homo sapiens
ccacagcugccauc

SEQ ID NO: 1713977 - RNA, 14 nt, Homo sapiens
ccacaggcacaggu

SEQ ID NO: 1713978 - RNA, 22 nt, Homo sapiens
ccacauaccuggcccaaccaga

SEQ ID NO: 1713979 - RNA, 23 nt, Homo sapiens
ccacauaccuggcccaaccagac

SEQ ID NO: 1713980 - RNA, 17 nt, Homo sapiens
ccacauguacagacaua

SEQ ID NO: 1713981 - RNA, 20 nt, Homo sapiens
ccacaugugacacauaugca

SEQ ID NO: 1713982 - RNA, 18 nt, Homo sapiens
gacaugauuuccuugaau

SEQ ID NO: 1713983 - RNA, 15 nt, Homo sapiens
gacaugcacugaccc

SEQ ID NO: 1713984 - RNA, 18 nt, Homo sapiens
gacaugucuagccacuga

SEQ ID NO: 1713985 - RNA, 13 nt, Homo sapiens
gacauuaugugug

SEQ ID NO: 1713986 - RNA, 18 nt, Homo sapiens
gacauugcggacagccac

SEQ ID NO: 1713987 - RNA, 16 nt, Homo sapiens
gacauuguuggccaaa

SEQ ID NO: 1713988 - RNA, 15 nt, Homo sapiens
gaccaacugggccca

SEQ ID NO: 1713989 - RNA, 20 nt, Homo sapiens
gaccaauugugcugccauuu

SEQ ID NO: 1713990 - RNA, 15 nt, Homo sapiens
gaccaccacuucgaa

SEQ ID NO: 1713991 - RNA, 20 nt, Homo sapiens
gaccacuguuucuugcuugu

SEQ ID NO: 1713992 - RNA, 14 nt, Homo sapiens
gaccagccugggca

SEQ ID NO: 1713993 - RNA, 22 nt, Homo sapiens
gaccaucaguucuuuugucuua

SEQ ID NO: 1713994 - RNA, 20 nt, Homo sapiens
gaccccaaauuaagaaucua

SEQ ID NO: 1713995 - RNA, 13 nt, Homo sapiens
gacccucugggaa

SEQ ID NO: 1713996 - RNA, 16 nt, Homo sapiens
gacccuggaaauggac

SEQ ID NO: 1713997 - RNA, 18 nt, Homo sapiens
gaccgcccccuccucuag

SEQ ID NO: 1713998 - RNA, 21 nt, Homo sapiens
gaccgcguuggaaggugcaga

SEQ ID NO: 1713999 - RNA, 18 nt, Homo sapiens
gaccuauuagaguauuuu

SEQ ID NO: 1714000 - RNA, 13 nt, Homo sapiens
gaccucacaguga

SEQ ID NO: 1714001 - RNA, 16 nt, Homo sapiens
gaccucaccuagaaau

SEQ ID NO: 1714002 - RNA, 20 nt, Homo sapiens
gaccucucauaaauuuacuu

SEQ ID NO: 1714003 - RNA, 10 nt, Homo sapiens
gaccucuugu

SEQ ID NO: 1714004 - RNA, 21 nt, Homo sapiens
gaccuguuuaugagaugcugg

SEQ ID NO: 1714005 - RNA, 17 nt, Homo sapiens
gaccuuaggccuuccuc

SEQ ID NO: 1714006 - RNA, 20 nt, Homo sapiens
gaccuuggagagacacagcg

SEQ ID NO: 1714007 - RNA, 20 nt, Homo sapiens
gacgcccucagucuagggau

SEQ ID NO: 1714008 - RNA, 15 nt, Homo sapiens
gacggggacugggga

SEQ ID NO: 1714009 - RNA, 23 nt, Homo sapiens
gacgguuaaauacuguguggaac

SEQ ID NO: 1714010 - RNA, 15 nt, Homo sapiens
gacgucaccaagaaa

SEQ ID NO: 1714011 - RNA, 18 nt, Homo sapiens
gacgugcgcgaugccugg

SEQ ID NO: 1714012 - RNA, 13 nt, Homo sapiens
gacguugcagggu

SEQ ID NO: 1714013 - RNA, 23 nt, Homo sapiens
gacuaaccccaacgcacaggaaa

SEQ ID NO: 1714014 - RNA, 18 nt, Homo sapiens
gacuaagccuaccugcuc

SEQ ID NO: 1714015 - RNA, 15 nt, Homo sapiens
gacuaauuaggcaag

SEQ ID NO: 1714016 - RNA, 17 nt, Homo sapiens
gacuacaggcacccacc

SEQ ID NO: 1714017 - RNA, 20 nt, Homo sapiens
gacuacauuugugaacaaaa

SEQ ID NO: 1714018 - RNA, 21 nt, Homo sapiens
gacuagccaggaaguacuucc

SEQ ID NO: 1714019 - RNA, 15 nt, Homo sapiens
gacuauguaaacuac

SEQ ID NO: 1714020 - RNA, 16 nt, Homo sapiens
gacucaaauguucuaa

SEQ ID NO: 1714021 - RNA, 19 nt, Homo sapiens
gacucaaauguucuaaguu

SEQ ID NO: 1714022 - RNA, 21 nt, Homo sapiens
gacucagggccaugccugccc

SEQ ID NO: 1714023 - RNA, 12 nt, Homo sapiens
gacuccaugcug

SEQ ID NO: 1714024 - RNA, 14 nt, Homo sapiens
gacucccacaacaa

SEQ ID NO: 1714025 - RNA, 17 nt, Homo sapiens
gacucuacagaggccau

SEQ ID NO: 1714026 - RNA, 10 nt, Homo sapiens
gacucugcac

SEQ ID NO: 1714027 - RNA, 18 nt, Homo sapiens
gacucugcacaugucuug

SEQ ID NO: 1714028 - RNA, 18 nt, Homo sapiens
gacucugggcuauggaca

SEQ ID NO: 1714029 - RNA, 14 nt, Homo sapiens
gacugaaacuggaa

SEQ ID NO: 1714030 - RNA, 14 nt, Homo sapiens
gacugacaaccuca

SEQ ID NO: 1714031 - RNA, 20 nt, Homo sapiens
gacugauacugcagugacug

SEQ ID NO: 1714032 - RNA, 18 nt, Homo sapiens
gacuggcuccaacacugc

SEQ ID NO: 1714033 - RNA, 14 nt, Homo sapiens
gacuguacuccucc

SEQ ID NO: 1714034 - RNA, 15 nt, Homo sapiens
gacuuaaaaccaaau

SEQ ID NO: 1714035 - RNA, 22 nt, Homo sapiens
gacuuaaaauauuccugcauuu

SEQ ID NO: 1714036 - RNA, 12 nt, Homo sapiens
gacuucacuuau

SEQ ID NO: 1714037 - RNA, 19 nt, Homo sapiens
gacuuccucgccucuccca

SEQ ID NO: 1714038 - RNA, 17 nt, Homo sapiens
gacuuugauagauuucu

SEQ ID NO: 1714039 - RNA, 16 nt, Homo sapiens
gacuuugauugcacau

SEQ ID NO: 1714040 - RNA, 22 nt, Homo sapiens
gagaaaauaaagaccuugcuua

SEQ ID NO: 1714041 - RNA, 16 nt, Homo sapiens
gagaaaauguuguaua

SEQ ID NO: 1714042 - RNA, 18 nt, Homo sapiens
gagaacaaagcuguuaaa

SEQ ID NO: 1714043 - RNA, 23 nt, Homo sapiens
gagaaccccucugggaaaaucua

SEQ ID NO: 1714044 - RNA, 16 nt, Homo sapiens
gagaagaccucuguga

SEQ ID NO: 1714045 - RNA, 20 nt, Homo sapiens
gagaagcauauagaggcaag

SEQ ID NO: 1714046 - RNA, 21 nt, Homo sapiens
gagaaucccaaauuugauuga

SEQ ID NO: 1714047 - RNA, 20 nt, Homo sapiens
gagaaucucagcgugggcca

SEQ ID NO: 1714048 - RNA, 21 nt, Homo sapiens
gagacacaacuauuuuuccaa

SEQ ID NO: 1714049 - RNA, 12 nt, Homo sapiens
gagacaggguuu

SEQ ID NO: 1714050 - RNA, 12 nt, Homo sapiens
gagacagugacu

SEQ ID NO: 1714051 - RNA, 19 nt, Homo sapiens
gagacagugacuggugcca

SEQ ID NO: 1714052 - RNA, 22 nt, Homo sapiens
gagacagugacuggugccagug

SEQ ID NO: 1714053 - RNA, 23 nt, Homo sapiens
gagacccccacaccucaguuccc

SEQ ID NO: 1714054 - RNA, 14 nt, Homo sapiens
gagacucacaggaa

SEQ ID NO: 1714055 - RNA, 16 nt, Homo sapiens
gagacucuagggucca

SEQ ID NO: 1714056 - RNA, 13 nt, Homo sapiens
gagacucugucuc

SEQ ID NO: 1714057 - RNA, 16 nt, Homo sapiens
gagagauucugugauc

SEQ ID NO: 1714058 - RNA, 22 nt, Homo sapiens
gagagcagcuuuaaacucaggg

SEQ ID NO: 1714059 - RNA, 22 nt, Homo sapiens
gagagcccggcgccccugccac

SEQ ID NO: 1714060 - RNA, 17 nt, Homo sapiens
gagaggacaguggauug

SEQ ID NO: 1714061 - RNA, 14 nt, Homo sapiens
gagauaaacuacau

SEQ ID NO: 1714062 - RNA, 22 nt, Homo sapiens
gagaucacgucacugcacucca

SEQ ID NO: 1714063 - RNA, 21 nt, Homo sapiens
gagaucuaaggaugucacagg

SEQ ID NO: 1714064 - RNA, 17 nt, Homo sapiens
gagaugcggccaagaua

SEQ ID NO: 1714065 - RNA, 20 nt, Homo sapiens
gagaugcuggagaagagagg

SEQ ID NO: 1714066 - RNA, 15 nt, Homo sapiens
gagauguaugaaggc

SEQ ID NO: 1714067 - RNA, 14 nt, Homo sapiens
gagauugaacucca

SEQ ID NO: 1714068 - RNA, 17 nt, Homo sapiens
gagauuguuguuugcca

SEQ ID NO: 1714069 - RNA, 18 nt, Homo sapiens
gagauuguuguuugccau

SEQ ID NO: 1714070 - RNA, 22 nt, Homo sapiens
gagauuuuauaugcacauuucu

SEQ ID NO: 1714071 - RNA, 12 nt, Homo sapiens
gagcaaccucuc

SEQ ID NO: 1714072 - RNA, 19 nt, Homo sapiens
gagcaccuuugcacaggau

SEQ ID NO: 1714073 - RNA, 17 nt, Homo sapiens
gagcagaaagcugugaa

SEQ ID NO: 1714074 - RNA, 13 nt, Homo sapiens
gagcagccugaac

SEQ ID NO: 1714075 - RNA, 16 nt, Homo sapiens
gagcaggaagcauuca

SEQ ID NO: 1714076 - RNA, 17 nt, Homo sapiens
gagcauaguccaaaaag

SEQ ID NO: 1714077 - RNA, 19 nt, Homo sapiens
gagcaucucuugaggccag

SEQ ID NO: 1714078 - RNA, 17 nt, Homo sapiens
gagccaccccuaaagag

SEQ ID NO: 1714079 - RNA, 18 nt, Homo sapiens
gagccagccacacuugaa

SEQ ID NO: 1714080 - RNA, 17 nt, Homo sapiens
gagccaguuagacuagu

SEQ ID NO: 1714081 - RNA, 16 nt, Homo sapiens
gagcccauagccagcu

SEQ ID NO: 1714082 - RNA, 16 nt, Homo sapiens
gagccccagcuacccu

SEQ ID NO: 1714083 - RNA, 18 nt, Homo sapiens
gagccccuacagcauugu

SEQ ID NO: 1714084 - RNA, 12 nt, Homo sapiens
gagccgcuguga

SEQ ID NO: 1714085 - RNA, 20 nt, Homo sapiens
gagccgugaacugugcauag

SEQ ID NO: 1714086 - RNA, 17 nt, Homo sapiens
gagccuccacugccucu

SEQ ID NO: 1714087 - RNA, 12 nt, Homo sapiens
gagccugcaguu

SEQ ID NO: 1714088 - RNA, 17 nt, Homo sapiens
gagcuagaaacucagga

SEQ ID NO: 1714089 - RNA, 13 nt, Homo sapiens
gagcucagugugu

SEQ ID NO: 1714090 - RNA, 17 nt, Homo sapiens
gagcuggggggcgugga

SEQ ID NO: 1714091 - RNA, 18 nt, Homo sapiens
gagcugucccaccugcac

SEQ ID NO: 1714092 - RNA, 19 nt, Homo sapiens
gccucuuuucucugugcuu

SEQ ID NO: 1714093 - RNA, 15 nt, Homo sapiens
gccugaagucacaca

SEQ ID NO: 1714094 - RNA, 22 nt, Homo sapiens
gccugacuuggggagauggagu

SEQ ID NO: 1714095 - RNA, 13 nt, Homo sapiens
gccugcaagcuuc

SEQ ID NO: 1714096 - RNA, 22 nt, Homo sapiens
gccugccccccucaucucauuc

SEQ ID NO: 1714097 - RNA, 13 nt, Homo sapiens
gccugccuuaggg

SEQ ID NO: 1714098 - RNA, 22 nt, Homo sapiens
gccuggacacuguaccgacuuu

SEQ ID NO: 1714099 - RNA, 20 nt, Homo sapiens
gccuggccaggagcucuuca

SEQ ID NO: 1714100 - RNA, 23 nt, Homo sapiens
gccuggcccauagaaacaugaca

SEQ ID NO: 1714101 - RNA, 14 nt, Homo sapiens
gccugggcaacaga

SEQ ID NO: 1714102 - RNA, 22 nt, Homo sapiens
gccuggucaggcccuggugcga

SEQ ID NO: 1714103 - RNA, 22 nt, Homo sapiens
gccuguaaucccagcacuuugg

SEQ ID NO: 1714104 - RNA, 15 nt, Homo sapiens
gccuguauacuuuag

SEQ ID NO: 1714105 - RNA, 12 nt, Homo sapiens
gccugugcaaug

SEQ ID NO: 1714106 - RNA, 20 nt, Homo sapiens
gccugugcauguaugucuug

SEQ ID NO: 1714107 - RNA, 14 nt, Homo sapiens
gccugugcugugac

SEQ ID NO: 1714108 - RNA, 18 nt, Homo sapiens
gccugugcugugacucga

SEQ ID NO: 1714109 - RNA, 21 nt, Homo sapiens
gccugugguuaacaucucaga

SEQ ID NO: 1714110 - RNA, 19 nt, Homo sapiens
gccuuaaguaauguuaauu

SEQ ID NO: 1714111 - RNA, 21 nt, Homo sapiens
gccuuaaguggcagaauauaa

SEQ ID NO: 1714112 - RNA, 12 nt, Homo sapiens
gccuuaauacuu

SEQ ID NO: 1714113 - RNA, 16 nt, Homo sapiens
gccuuaaugcuucaua

SEQ ID NO: 1714114 - RNA, 19 nt, Homo sapiens
gccuucacgugucuguucc

SEQ ID NO: 1714115 - RNA, 15 nt, Homo sapiens
gccuucacuuuacaa

SEQ ID NO: 1714116 - RNA, 16 nt, Homo sapiens
gccuucccaugaaucu

SEQ ID NO: 1714117 - RNA, 19 nt, Homo sapiens
gccuuccuuucuccaggac

SEQ ID NO: 1714118 - RNA, 22 nt, Homo sapiens
gccuucugacggcccugcaaug

SEQ ID NO: 1714119 - RNA, 21 nt, Homo sapiens
gccuugcuagcugaccuggag

SEQ ID NO: 1714120 - RNA, 14 nt, Homo sapiens
gccuugggcugcuc

SEQ ID NO: 1714121 - RNA, 16 nt, Homo sapiens
gccuugugcuguuaau

SEQ ID NO: 1714122 - RNA, 21 nt, Homo sapiens
gcgaaaguucuugguggugga

SEQ ID NO: 1714123 - RNA, 14 nt, Homo sapiens
gcgacauagcccau

SEQ ID NO: 1714124 - RNA, 17 nt, Homo sapiens
gcgacccauucagagac

SEQ ID NO: 1714125 - RNA, 22 nt, Homo sapiens
gcgauccaccugucucagccuc

SEQ ID NO: 1714126 - RNA, 15 nt, Homo sapiens
gcgcaaaaugcagcu

SEQ ID NO: 1714127 - RNA, 14 nt, Homo sapiens
gcgcaucaggccug

SEQ ID NO: 1714128 - RNA, 14 nt, Homo sapiens
gcgcgcgcacacac

SEQ ID NO: 1714129 - RNA, 19 nt, Homo sapiens
gcggaccccagcugugagc

SEQ ID NO: 1714130 - RNA, 17 nt, Homo sapiens
gcggcggaaagccugua

SEQ ID NO: 1714131 - RNA, 17 nt, Homo sapiens
gcguaaacgacacucuc

SEQ ID NO: 1714132 - RNA, 14 nt, Homo sapiens
gcguacagaucucu

SEQ ID NO: 1714133 - RNA, 16 nt, Homo sapiens
gcgucacggccaagug

SEQ ID NO: 1714134 - RNA, 13 nt, Homo sapiens
gcgugauucaaug

SEQ ID NO: 1714135 - RNA, 12 nt, Homo sapiens
gcgugcacacac

SEQ ID NO: 1714136 - RNA, 23 nt, Homo sapiens
gcguggugcucuuugcugcacua

SEQ ID NO: 1714137 - RNA, 19 nt, Homo sapiens
gcguguguagaguuaagaa

SEQ ID NO: 1714138 - RNA, 19 nt, Homo sapiens
gcguuguugcauguuugaa

SEQ ID NO: 1714139 - RNA, 22 nt, Homo sapiens
gcguuuuuuaaauguauacuau

SEQ ID NO: 1714140 - RNA, 17 nt, Homo sapiens
gcuaagggugggugcuc

SEQ ID NO: 1714141 - RNA, 19 nt, Homo sapiens
gcuaaucuucuuaugcaau

SEQ ID NO: 1714142 - RNA, 14 nt, Homo sapiens
gcuaauguaauaac

SEQ ID NO: 1714143 - RNA, 17 nt, Homo sapiens
gcuacccaugacuuuau

SEQ ID NO: 1714144 - RNA, 16 nt, Homo sapiens
gcuacccuagaugaau

SEQ ID NO: 1714145 - RNA, 18 nt, Homo sapiens
gcuacccuuuuccuuugu

SEQ ID NO: 1714146 - RNA, 18 nt, Homo sapiens
gcuacucaggaggcugaa

SEQ ID NO: 1714147 - RNA, 18 nt, Homo sapiens
gcuagcaguaaaagauga

SEQ ID NO: 1714148 - RNA, 17 nt, Homo sapiens
gcuaggaaugaaauccu

SEQ ID NO: 1714149 - RNA, 19 nt, Homo sapiens
gcuagggcggggcacagau

SEQ ID NO: 1714150 - RNA, 11 nt, Homo sapiens
gcuaguauuug

SEQ ID NO: 1714151 - RNA, 21 nt, Homo sapiens
gcuaguccggacccaccucac

SEQ ID NO: 1714152 - RNA, 18 nt, Homo sapiens
gcuaguucguagcuuucc

SEQ ID NO: 1714153 - RNA, 11 nt, Homo sapiens
gcuauuugccu

SEQ ID NO: 1714154 - RNA, 20 nt, Homo sapiens
gcucaaaguacuacagcaaa

SEQ ID NO: 1714155 - RNA, 22 nt, Homo sapiens
gcucaaaguacuacagcaaagc

SEQ ID NO: 1714156 - RNA, 16 nt, Homo sapiens
gcucacaaagagauaa

SEQ ID NO: 1714157 - RNA, 18 nt, Homo sapiens
gcucacauaucugucauu

SEQ ID NO: 1714158 - RNA, 15 nt, Homo sapiens
gcucagaaaggaaau

SEQ ID NO: 1714159 - RNA, 13 nt, Homo sapiens
gcucagaacccag

SEQ ID NO: 1714160 - RNA, 23 nt, Homo sapiens
gcucagauuauuuaaaugggaau

SEQ ID NO: 1714161 - RNA, 16 nt, Homo sapiens
gcucagcaaccuuuca

SEQ ID NO: 1714162 - RNA, 14 nt, Homo sapiens
gcucagcgccagcc

SEQ ID NO: 1714163 - RNA, 21 nt, Homo sapiens
gcucaggaaggggugugcuga

SEQ ID NO: 1714164 - RNA, 20 nt, Homo sapiens
gcucaggugucccugcacuu

SEQ ID NO: 1714165 - RNA, 22 nt, Homo sapiens
gcucauuuuuucuucuccuaaa

SEQ ID NO: 1714166 - RNA, 11 nt, Homo sapiens
gcuccacugaa

SEQ ID NO: 1714167 - RNA, 13 nt, Homo sapiens
gcuccacugucac

SEQ ID NO: 1714168 - RNA, 12 nt, Homo sapiens
gcuccagcaaca

SEQ ID NO: 1714169 - RNA, 19 nt, Homo sapiens
gcuccagggaauccaagcc

SEQ ID NO: 1714170 - RNA, 22 nt, Homo sapiens
gcucccacauucugaugagcaa

SEQ ID NO: 1714171 - RNA, 23 nt, Homo sapiens
gcucccacauucugaugagcaac

SEQ ID NO: 1714172 - RNA, 15 nt, Homo sapiens
gcucccucacccagg

SEQ ID NO: 1714173 - RNA, 21 nt, Homo sapiens
gcucccucacccaggcacugg

SEQ ID NO: 1714174 - RNA, 22 nt, Homo sapiens
gcucccucuauuuauguuugca

SEQ ID NO: 1714175 - RNA, 20 nt, Homo sapiens
gcuccgacugccgcugagaa

SEQ ID NO: 1714176 - RNA, 15 nt, Homo sapiens
gcuccgccucugucc

SEQ ID NO: 1714177 - RNA, 18 nt, Homo sapiens
gcuccuccccacuagcau

SEQ ID NO: 1714178 - RNA, 21 nt, Homo sapiens
gcuccucuaggccucacucaa

SEQ ID NO: 1714179 - RNA, 17 nt, Homo sapiens
gcuccuuggcuuaccug

SEQ ID NO: 1714180 - RNA, 16 nt, Homo sapiens
gcuccuuuacaaaaga

SEQ ID NO: 1714181 - RNA, 16 nt, Homo sapiens
gcucucauggggucca

SEQ ID NO: 1714182 - RNA, 20 nt, Homo sapiens
gcucugagaaaccucgggaa

SEQ ID NO: 1714183 - RNA, 23 nt, Homo sapiens
gcucugcaccccucugcccucau

SEQ ID NO: 1714184 - RNA, 22 nt, Homo sapiens
gcucuguauauauauauacuua

SEQ ID NO: 1714185 - RNA, 10 nt, Homo sapiens
gcucuuccaa

SEQ ID NO: 1714186 - RNA, 17 nt, Homo sapiens
gcugaacaauaggcugu

SEQ ID NO: 1714187 - RNA, 20 nt, Homo sapiens
gcugacuaaauuuggggaca

SEQ ID NO: 1714188 - RNA, 18 nt, Homo sapiens
gcugacuguacuccuccc

SEQ ID NO: 1714189 - RNA, 22 nt, Homo sapiens
gcugagaaggguugauccugca

SEQ ID NO: 1714190 - RNA, 14 nt, Homo sapiens
gcugaguauggagc

SEQ ID NO: 1714191 - RNA, 14 nt, Homo sapiens
gcugagugggagaa

SEQ ID NO: 1714192 - RNA, 20 nt, Homo sapiens
gcugauuuccccucuucccu

SEQ ID NO: 1714193 - RNA, 16 nt, Homo sapiens
gcugcagcuugggaga

SEQ ID NO: 1714194 - RNA, 14 nt, Homo sapiens
gcugcaggaaucaa

SEQ ID NO: 1714195 - RNA, 16 nt, Homo sapiens
gcugcaggaaucaaaa

SEQ ID NO: 1714196 - RNA, 14 nt, Homo sapiens
gcugcaucggaggc

SEQ ID NO: 1714197 - RNA, 18 nt, Homo sapiens
gcugcauuugugucaucu

SEQ ID NO: 1714198 - RNA, 21 nt, Homo sapiens
gcugccaccucuccauccugc

SEQ ID NO: 1714199 - RNA, 19 nt, Homo sapiens
gcugccagaugauuguuca

SEQ ID NO: 1714200 - RNA, 20 nt, Homo sapiens
gcugccagaugauuguucaa

SEQ ID NO: 1714201 - RNA, 18 nt, Homo sapiens
guagaaauaauaugcauu

SEQ ID NO: 1714202 - RNA, 13 nt, Homo sapiens
guagagccagcuu

SEQ ID NO: 1714203 - RNA, 22 nt, Homo sapiens
guagagggaguugucaagucuc

SEQ ID NO: 1714204 - RNA, 15 nt, Homo sapiens
guagauauuaauuaa

SEQ ID NO: 1714205 - RNA, 18 nt, Homo sapiens
guagauuuuaaaagauaa

SEQ ID NO: 1714206 - RNA, 20 nt, Homo sapiens
guagcguguuuacaugugua

SEQ ID NO: 1714207 - RNA, 16 nt, Homo sapiens
guagcugccacuugaa

SEQ ID NO: 1714208 - RNA, 22 nt, Homo sapiens
guagcugugucauguauauacc

SEQ ID NO: 1714209 - RNA, 17 nt, Homo sapiens
guagcuuaccugacaca

SEQ ID NO: 1714210 - RNA, 21 nt, Homo sapiens
guaggagcugccuuggcucag

SEQ ID NO: 1714211 - RNA, 17 nt, Homo sapiens
guagugaaauuauacag

SEQ ID NO: 1714212 - RNA, 14 nt, Homo sapiens
guauaagcacugaa

SEQ ID NO: 1714213 - RNA, 14 nt, Homo sapiens
guauacuauaguac

SEQ ID NO: 1714214 - RNA, 20 nt, Homo sapiens
guauauucugguuacugugg

SEQ ID NO: 1714215 - RNA, 14 nt, Homo sapiens
guauauuuaauuca

SEQ ID NO: 1714216 - RNA, 15 nt, Homo sapiens
guaucaacacuguua

SEQ ID NO: 1714217 - RNA, 15 nt, Homo sapiens
guaucaccauacauu

SEQ ID NO: 1714218 - RNA, 11 nt, Homo sapiens
guaucacuggu

SEQ ID NO: 1714219 - RNA, 16 nt, Homo sapiens
guaucaggugcugcca

SEQ ID NO: 1714220 - RNA, 18 nt, Homo sapiens
guaucccacauccaacuc

SEQ ID NO: 1714221 - RNA, 22 nt, Homo sapiens
guaucugaguugccaagacaaa

SEQ ID NO: 1714222 - RNA, 21 nt, Homo sapiens
guaucuuucauccuugacuaa

SEQ ID NO: 1714223 - RNA, 17 nt, Homo sapiens
guaugaucacggcucac

SEQ ID NO: 1714224 - RNA, 14 nt, Homo sapiens
guaugcaauggauu

SEQ ID NO: 1714225 - RNA, 16 nt, Homo sapiens
guaugcagaauguuuu

SEQ ID NO: 1714226 - RNA, 17 nt, Homo sapiens
guaugugacaccaaagc

SEQ ID NO: 1714227 - RNA, 19 nt, Homo sapiens
guaugugacaccaaagcca

SEQ ID NO: 1714228 - RNA, 13 nt, Homo sapiens
guaugugccauuu

SEQ ID NO: 1714229 - RNA, 18 nt, Homo sapiens
guauuauauaaacuuaac

SEQ ID NO: 1714230 - RNA, 16 nt, Homo sapiens
guauucucuuccucau

SEQ ID NO: 1714231 - RNA, 15 nt, Homo sapiens
guauuggaaauggau

SEQ ID NO: 1714232 - RNA, 22 nt, Homo sapiens
guauuuguucauguuuggugca

SEQ ID NO: 1714233 - RNA, 18 nt, Homo sapiens
guauuuugaaguuuacau

SEQ ID NO: 1714234 - RNA, 16 nt, Homo sapiens
gucaaaacacugugga

SEQ ID NO: 1714235 - RNA, 14 nt, Homo sapiens
gucaacaugcauau

SEQ ID NO: 1714236 - RNA, 20 nt, Homo sapiens
gucaaucccaaaagucacca

SEQ ID NO: 1714237 - RNA, 11 nt, Homo sapiens
gucacaaagaa

SEQ ID NO: 1714238 - RNA, 18 nt, Homo sapiens
gucacauagagugaucuu

SEQ ID NO: 1714239 - RNA, 17 nt, Homo sapiens
gucacauggccuaugca

SEQ ID NO: 1714240 - RNA, 18 nt, Homo sapiens
gucacauggccuaugcac

SEQ ID NO: 1714241 - RNA, 23 nt, Homo sapiens
gucacauggccuaugcacauaug

SEQ ID NO: 1714242 - RNA, 12 nt, Homo sapiens
gucaccaagaaa

SEQ ID NO: 1714243 - RNA, 15 nt, Homo sapiens
gucacucauugcuga

SEQ ID NO: 1714244 - RNA, 17 nt, Homo sapiens
gucacugacacaaagga

SEQ ID NO: 1714245 - RNA, 16 nt, Homo sapiens
gucacugccacuuugc

SEQ ID NO: 1714246 - RNA, 23 nt, Homo sapiens
gucagaagaguugugcacgcaga

SEQ ID NO: 1714247 - RNA, 12 nt, Homo sapiens
gucagacauaaa

SEQ ID NO: 1714248 - RNA, 13 nt, Homo sapiens
gucagacauaaag

SEQ ID NO: 1714249 - RNA, 17 nt, Homo sapiens
gucagacauaaagccau

SEQ ID NO: 1714250 - RNA, 14 nt, Homo sapiens
gucaggaacagaag

SEQ ID NO: 1714251 - RNA, 20 nt, Homo sapiens
gucauaaugguuuuuaacac

SEQ ID NO: 1714252 - RNA, 10 nt, Homo sapiens
gucauagaaa

SEQ ID NO: 1714253 - RNA, 17 nt, Homo sapiens
gucaucaucacauucag

SEQ ID NO: 1714254 - RNA, 23 nt, Homo sapiens
gucaucgggaggagcagccugaa

SEQ ID NO: 1714255 - RNA, 14 nt, Homo sapiens
gucaucugccaacu

SEQ ID NO: 1714256 - RNA, 20 nt, Homo sapiens
gucaucugccaacuguccua

SEQ ID NO: 1714257 - RNA, 18 nt, Homo sapiens
gucaugaccuccagggag

SEQ ID NO: 1714258 - RNA, 23 nt, Homo sapiens
gucaugauggcaccacugcacuc

SEQ ID NO: 1714259 - RNA, 15 nt, Homo sapiens
gucaugguuacaaac

SEQ ID NO: 1714260 - RNA, 21 nt, Homo sapiens
gucauguuugcaggggugacg

SEQ ID NO: 1714261 - RNA, 21 nt, Homo sapiens
gucauuucauuccauugccua

SEQ ID NO: 1714262 - RNA, 18 nt, Homo sapiens
guccacccaccuaugugc

SEQ ID NO: 1714263 - RNA, 12 nt, Homo sapiens
guccagugcaac

SEQ ID NO: 1714264 - RNA, 13 nt, Homo sapiens
gucccacugugca

SEQ ID NO: 1714265 - RNA, 12 nt, Homo sapiens
gucccagucucu

SEQ ID NO: 1714266 - RNA, 17 nt, Homo sapiens
gucccauggacacucca

SEQ ID NO: 1714267 - RNA, 14 nt, Homo sapiens
guccccaccuggga

SEQ ID NO: 1714268 - RNA, 16 nt, Homo sapiens
guccccuccacuguca

SEQ ID NO: 1714269 - RNA, 17 nt, Homo sapiens
guccccuccacugucac

SEQ ID NO: 1714270 - RNA, 11 nt, Homo sapiens
gucccuaccuc

SEQ ID NO: 1714271 - RNA, 14 nt, Homo sapiens
gucccucuuccauc

SEQ ID NO: 1714272 - RNA, 14 nt, Homo sapiens
guccggacccaccu

SEQ ID NO: 1714273 - RNA, 14 nt, Homo sapiens
guccuccccucaca

SEQ ID NO: 1714274 - RNA, 17 nt, Homo sapiens
guccuccgguugcauac

SEQ ID NO: 1714275 - RNA, 21 nt, Homo sapiens
guccugacacuauucauuuga

SEQ ID NO: 1714276 - RNA, 16 nt, Homo sapiens
guccugaccaucgcac

SEQ ID NO: 1714277 - RNA, 17 nt, Homo sapiens
guccugccucagccucc

SEQ ID NO: 1714278 - RNA, 17 nt, Homo sapiens
guccuggggaccauuca

SEQ ID NO: 1714279 - RNA, 23 nt, Homo sapiens
guccuuucccuucaguacccucu

SEQ ID NO: 1714280 - RNA, 18 nt, Homo sapiens
guccuuucuaaguauuuu

SEQ ID NO: 1714281 - RNA, 20 nt, Homo sapiens
gucggaacccaagcuuagaa

SEQ ID NO: 1714282 - RNA, 18 nt, Homo sapiens
gucuaaaaacaccaaaaa

SEQ ID NO: 1714283 - RNA, 15 nt, Homo sapiens
gucuaauuuauucaa

SEQ ID NO: 1714284 - RNA, 14 nt, Homo sapiens
gucuagccacugau

SEQ ID NO: 1714285 - RNA, 17 nt, Homo sapiens
gucuagccacugaucau

SEQ ID NO: 1714286 - RNA, 12 nt, Homo sapiens
gucuaugcugcu

SEQ ID NO: 1714287 - RNA, 15 nt, Homo sapiens
gucuauggcacuaau

SEQ ID NO: 1714288 - RNA, 18 nt, Homo sapiens
gucuaugggacucaaugc

SEQ ID NO: 1714289 - RNA, 19 nt, Homo sapiens
gucucaagagggcacuggu

SEQ ID NO: 1714290 - RNA, 21 nt, Homo sapiens
gucuccaagggcaucacuggg

SEQ ID NO: 1714291 - RNA, 22 nt, Homo sapiens
gucuccaagggcaucacugggu

SEQ ID NO: 1714292 - RNA, 13 nt, Homo sapiens
gucuccacugugc

SEQ ID NO: 1714293 - RNA, 18 nt, Homo sapiens
gucucccuucuguuucuu

SEQ ID NO: 1714294 - RNA, 23 nt, Homo sapiens
gucuccucaauuuuugucucaga

SEQ ID NO: 1714295 - RNA, 13 nt, Homo sapiens
gucucgcuuuguu

SEQ ID NO: 1714296 - RNA, 13 nt, Homo sapiens
gucucucccucag

SEQ ID NO: 1714297 - RNA, 21 nt, Homo sapiens
gucucuuuaaugucacaggca

SEQ ID NO: 1714298 - RNA, 12 nt, Homo sapiens
gucugacaggca

SEQ ID NO: 1714299 - RNA, 21 nt, Homo sapiens
gucugaguaagcccucaggag

SEQ ID NO: 1714300 - RNA, 17 nt, Homo sapiens
gucugcuuaguaucuca

SEQ ID NO: 1714301 - RNA, 19 nt, Homo sapiens
gucugugugaaugugggca

SEQ ID NO: 1714302 - RNA, 20 nt, Homo sapiens
gucugugugaugaacuuucu

SEQ ID NO: 1714303 - RNA, 18 nt, Homo sapiens
gucuucauuucauuguau

SEQ ID NO: 1714304 - RNA, 15 nt, Homo sapiens
gucuuccacuucaau

SEQ ID NO: 1714305 - RNA, 14 nt, Homo sapiens
gucuuccacuuugc

SEQ ID NO: 1714306 - RNA, 14 nt, Homo sapiens
gucuucccuaccuc

SEQ ID NO: 1714307 - RNA, 19 nt, Homo sapiens
gucuucuaauuucaaaaau

SEQ ID NO: 1714308 - RNA, 16 nt, Homo sapiens
gucuucucugucucag

SEQ ID NO: 1714309 - RNA, 16 nt, Homo sapiens
gucuucuuaaucugaa

SEQ ID NO: 1714310 - RNA, 12 nt, Homo sapiens
gucuugaacucc

SEQ ID NO: 1714311 - RNA, 15 nt, Homo sapiens
gucuuggacacugua

SEQ ID NO: 1714312 - RNA, 18 nt, Homo sapiens
guucauuugugugcucau

SEQ ID NO: 1714313 - RNA, 16 nt, Homo sapiens
guucccuguucuuccu

SEQ ID NO: 1714314 - RNA, 22 nt, Homo sapiens
guucccuuggccucagaauuca

SEQ ID NO: 1714315 - RNA, 17 nt, Homo sapiens
guuccucucugguggcu

SEQ ID NO: 1714316 - RNA, 17 nt, Homo sapiens
guuccugacaucacagc

SEQ ID NO: 1714317 - RNA, 19 nt, Homo sapiens
guucguggggaacugcgug

SEQ ID NO: 1714318 - RNA, 14 nt, Homo sapiens
guucuaaugacaua

SEQ ID NO: 1714319 - RNA, 22 nt, Homo sapiens
guucuacugagaaaagccucuc

SEQ ID NO: 1714320 - RNA, 15 nt, Homo sapiens
guucuauccaaacau

SEQ ID NO: 1714321 - RNA, 22 nt, Homo sapiens
guucugaugccaauacuaguca

SEQ ID NO: 1714322 - RNA, 22 nt, Homo sapiens
guucugcaagcaucaguucuac

SEQ ID NO: 1714323 - RNA, 21 nt, Homo sapiens
guucugcugggaccuuggaga

SEQ ID NO: 1714324 - RNA, 13 nt, Homo sapiens
guucuuacuugac

SEQ ID NO: 1714325 - RNA, 19 nt, Homo sapiens
guucuucuguucugcagac

SEQ ID NO: 1714326 - RNA, 22 nt, Homo sapiens
guucuuggugaugcuggcagcc

SEQ ID NO: 1714327 - RNA, 13 nt, Homo sapiens
guugcacugauau

SEQ ID NO: 1714328 - RNA, 17 nt, Homo sapiens
guugccuaagcauugcc

SEQ ID NO: 1714329 - RNA, 20 nt, Homo sapiens
guugcguggacucugcacau

SEQ ID NO: 1714330 - RNA, 16 nt, Homo sapiens
guugcuggacugucau

SEQ ID NO: 1714331 - RNA, 16 nt, Homo sapiens
guugcuuuuacuucuc

SEQ ID NO: 1714332 - RNA, 16 nt, Homo sapiens
guuggaaccacggaga

SEQ ID NO: 1714333 - RNA, 17 nt, Homo sapiens
guuggcaaggagccagg

SEQ ID NO: 1714334 - RNA, 22 nt, Homo sapiens
guuggccagugugacaaggauu

SEQ ID NO: 1714335 - RNA, 14 nt, Homo sapiens
guuggggugacagu

SEQ ID NO: 1714336 - RNA, 21 nt, Homo sapiens
guugguuguuuuuuccuuugc

SEQ ID NO: 1714337 - RNA, 21 nt, Homo sapiens
guugucugaagucacugcaca

SEQ ID NO: 1714338 - RNA, 17 nt, Homo sapiens
guugugugucaugccag

SEQ ID NO: 1714339 - RNA, 14 nt, Homo sapiens
guuuaaacagucaa

SEQ ID NO: 1714340 - RNA, 14 nt, Homo sapiens
guuuaacauuugcc

SEQ ID NO: 1714341 - RNA, 16 nt, Homo sapiens
guuuaagggugauagu

SEQ ID NO: 1714342 - RNA, 15 nt, Homo sapiens
guuuacagugaugcc

SEQ ID NO: 1714343 - RNA, 14 nt, Homo sapiens
guuuaccacuaacu

SEQ ID NO: 1714344 - RNA, 24 nt, Homo sapiens
guuuaccuagaagaagcuauguca

SEQ ID NO: 1714345 - RNA, 12 nt, Homo sapiens
guuuagaccaag

SEQ ID NO: 1714346 - RNA, 17 nt, Homo sapiens
guuuaggaauccuuugg

SEQ ID NO: 1714347 - RNA, 16 nt, Homo sapiens
guuuaugcugugcuaa

SEQ ID NO: 1714348 - RNA, 19 nt, Homo sapiens
guuuauggccacauuuaau

SEQ ID NO: 1714349 - RNA, 18 nt, Homo sapiens
guuuauuauaaacuguau

SEQ ID NO: 1714350 - RNA, 19 nt, Homo sapiens
guuucacuguguuagccag

SEQ ID NO: 1714351 - RNA, 13 nt, Homo sapiens
guuuccaucugcu

SEQ ID NO: 1714352 - RNA, 23 nt, Homo sapiens
guuuccgaaggguuuugcuacau

SEQ ID NO: 1714353 - RNA, 12 nt, Homo sapiens
guuucugagaaa

SEQ ID NO: 1714354 - RNA, 14 nt, Homo sapiens
guuucugucuguaa

SEQ ID NO: 1714355 - RNA, 16 nt, Homo sapiens
guuucuuagcuuuuua

SEQ ID NO: 1714356 - RNA, 12 nt, Homo sapiens
guuucuuucuag

SEQ ID NO: 1714357 - RNA, 23 nt, Homo sapiens
guuucuuucuaguggucuuugua

SEQ ID NO: 1714358 - RNA, 15 nt, Homo sapiens
guuugaacucuguaa

SEQ ID NO: 1714359 - RNA, 17 nt, Homo sapiens
guuugagaaaugcauag

SEQ ID NO: 1714360 - RNA, 18 nt, Homo sapiens
guuugauaccugcacugu

SEQ ID NO: 1714361 - RNA, 16 nt, Homo sapiens
guuugcaauuuuucca

SEQ ID NO: 1714362 - RNA, 15 nt, Homo sapiens
guuuguauuuggcca

SEQ ID NO: 1714363 - RNA, 21 nt, Homo sapiens
guuuguuucaagaaccuggaa

SEQ ID NO: 1714364 - RNA, 17 nt, Homo sapiens
guuuuaacaguucacuu

SEQ ID NO: 1714365 - RNA, 22 nt, Homo sapiens
guuuuaagaggcagggucucac

SEQ ID NO: 1714366 - RNA, 22 nt, Homo sapiens
guuuuaauccuuaacacauuca

SEQ ID NO: 1714367 - RNA, 18 nt, Homo sapiens
guuuuacaaugucauaua

SEQ ID NO: 1714368 - RNA, 20 nt, Homo sapiens
guuuuacauuguugagcuau

SEQ ID NO: 1714369 - RNA, 21 nt, Homo sapiens
guuuuagcggucaauuugccu

SEQ ID NO: 1714370 - RNA, 18 nt, Homo sapiens
guuuuauggagaccucuc

SEQ ID NO: 1714371 - RNA, 21 nt, Homo sapiens
guuuucaaauaacgauuuuau

SEQ ID NO: 1714372 - RNA, 17 nt, Homo sapiens
guuuucauggugaaaau

SEQ ID NO: 1714373 - RNA, 19 nt, Homo sapiens
guuuuccagucucuuguac

SEQ ID NO: 1714374 - RNA, 13 nt, Homo sapiens
guuuucugacuaa

SEQ ID NO: 1714375 - RNA, 17 nt, Homo sapiens
guuuuggaagcucugaa

SEQ ID NO: 1714376 - RNA, 23 nt, Homo sapiens
guuuuguagagauggggucucac

SEQ ID NO: 1714377 - RNA, 18 nt, Homo sapiens
guuuuuaaaaguuucaau

SEQ ID NO: 1714378 - RNA, 20 nt, Homo sapiens
guuuuuauauuaauguacuu

SEQ ID NO: 1714379 - RNA, 13 nt, Homo sapiens
guuuuuccuccau

SEQ ID NO: 1714380 - RNA, 12 nt, Homo sapiens
guuuuuuuccaa

SEQ ID NO: 1714381 - RNA, 23 nt, Homo sapiens
guuuuuuuuuuccacuuagaaau

SEQ ID NO: 1714382 - RNA, 23 nt, Homo sapiens
uaaaaaggaccagagaauucuua

SEQ ID NO: 1714383 - RNA, 13 nt, Homo sapiens
uaaaaagugacac

SEQ ID NO: 1714384 - RNA, 19 nt, Homo sapiens
uaaaaagugacacagcagc

SEQ ID NO: 1714385 - RNA, 22 nt, Homo sapiens
uaaaaauauauauagugcuaua

SEQ ID NO: 1714386 - RNA, 19 nt, Homo sapiens
uaaaaauggccauuugcuu

SEQ ID NO: 1714387 - RNA, 12 nt, Homo sapiens
uaaaaauucuug

SEQ ID NO: 1714388 - RNA, 16 nt, Homo sapiens
uaaaaauugacaauga

SEQ ID NO: 1714389 - RNA, 11 nt, Homo sapiens
uaaaacaaaca

SEQ ID NO: 1714390 - RNA, 23 nt, Homo sapiens
uaaaacauuauagauuuucaugu

SEQ ID NO: 1714391 - RNA, 17 nt, Homo sapiens
uaaaacuacacaucccu

SEQ ID NO: 1714392 - RNA, 19 nt, Homo sapiens
uaaaacuacauggucaaca

SEQ ID NO: 1714393 - RNA, 18 nt, Homo sapiens
uaaaacuuaaaucucacu

SEQ ID NO: 1714394 - RNA, 13 nt, Homo sapiens
uaaaacuuaacuu

SEQ ID NO: 1714395 - RNA, 13 nt, Homo sapiens
uaaaacuucuuaa

SEQ ID NO: 1714396 - RNA, 19 nt, Homo sapiens
uaaaacuuuucugcugaua

SEQ ID NO: 1714397 - RNA, 23 nt, Homo sapiens
uaaaagaaccgagcaauuuucug

SEQ ID NO: 1714398 - RNA, 24 nt, Homo sapiens
uaaaagcggaaaguuagugcuugu

SEQ ID NO: 1714399 - RNA, 18 nt, Homo sapiens
uaaaagguugcauacuga

SEQ ID NO: 1714400 - RNA, 19 nt, Homo sapiens
uaaaagugaucuacaugag

SEQ ID NO: 1714401 - RNA, 18 nt, Homo sapiens
uaaaaguuucaaugugau

SEQ ID NO: 1714402 - RNA, 12 nt, Homo sapiens
uaaaauagagua

SEQ ID NO: 1714403 - RNA, 19 nt, Homo sapiens
uaaaauagaguguaguuua

SEQ ID NO: 1714404 - RNA, 18 nt, Homo sapiens
uaaaauauuuaucugauu

SEQ ID NO: 1714405 - RNA, 16 nt, Homo sapiens
uaaaauccuaagacac

SEQ ID NO: 1714406 - RNA, 23 nt, Homo sapiens
uaaaauccuaagacacaaaugca

SEQ ID NO: 1714407 - RNA, 12 nt, Homo sapiens
uaaaaucucaaa

SEQ ID NO: 1714408 - RNA, 12 nt, Homo sapiens
uaaaaugcauaa

SEQ ID NO: 1714409 - RNA, 18 nt, Homo sapiens
uaaaaugugaagugaaug

SEQ ID NO: 1714410 - RNA, 23 nt, Homo sapiens
uaaaaugugaggaagaacuacag

SEQ ID NO: 1714411 - RNA, 14 nt, Homo sapiens
uaaaauucucauua

SEQ ID NO: 1714412 - RNA, 19 nt, Homo sapiens
uaaaauucucauuacucuu

SEQ ID NO: 1714413 - RNA, 16 nt, Homo sapiens
uaaacaaacauugugu

SEQ ID NO: 1714414 - RNA, 17 nt, Homo sapiens
uaaacaaauaacaaugu

SEQ ID NO: 1714415 - RNA, 14 nt, Homo sapiens
uaaacagaugaaua

SEQ ID NO: 1714416 - RNA, 18 nt, Homo sapiens
uaaacagauggcacuuug

SEQ ID NO: 1714417 - RNA, 19 nt, Homo sapiens
uaaacagauggcacuuuga

SEQ ID NO: 1714418 - RNA, 20 nt, Homo sapiens
uaaacagugagccugaauuu

SEQ ID NO: 1714419 - RNA, 21 nt, Homo sapiens
uaaacauccuucaagaacucu

SEQ ID NO: 1714420 - RNA, 20 nt, Homo sapiens
uaaaccugucuccacugugc

SEQ ID NO: 1714421 - RNA, 20 nt, Homo sapiens
uauaauucacucaagcacug

SEQ ID NO: 1714422 - RNA, 11 nt, Homo sapiens
uauacaucucu

SEQ ID NO: 1714423 - RNA, 16 nt, Homo sapiens
uauacauguguguaua

SEQ ID NO: 1714424 - RNA, 19 nt, Homo sapiens
uauaccagcuuguaugcaa

SEQ ID NO: 1714425 - RNA, 17 nt, Homo sapiens
uauacuugaacaaaagg

SEQ ID NO: 1714426 - RNA, 21 nt, Homo sapiens
uauagcacuuugaaauaccuc

SEQ ID NO: 1714427 - RNA, 20 nt, Homo sapiens
uauaggugauguuugcucuu

SEQ ID NO: 1714428 - RNA, 23 nt, Homo sapiens
uauaguuucaagccaacugugga

SEQ ID NO: 1714429 - RNA, 14 nt, Homo sapiens
uauauaaacuuaac

SEQ ID NO: 1714430 - RNA, 21 nt, Homo sapiens
uauauacccccccaugcaguc

SEQ ID NO: 1714431 - RNA, 17 nt, Homo sapiens
uauauagguugugcaaa

SEQ ID NO: 1714432 - RNA, 22 nt, Homo sapiens
uauauauacauacacuuguaua

SEQ ID NO: 1714433 - RNA, 15 nt, Homo sapiens
uauauauauaugccu

SEQ ID NO: 1714434 - RNA, 16 nt, Homo sapiens
uauauaucaguuugau

SEQ ID NO: 1714435 - RNA, 14 nt, Homo sapiens
uauauccugugacu

SEQ ID NO: 1714436 - RNA, 13 nt, Homo sapiens
uauauguaccgua

SEQ ID NO: 1714437 - RNA, 12 nt, Homo sapiens
uauauuauuugg

SEQ ID NO: 1714438 - RNA, 20 nt, Homo sapiens
uauauugaagacaauuugau

SEQ ID NO: 1714439 - RNA, 23 nt, Homo sapiens
uauauuucauuuuaaaauuugag

SEQ ID NO: 1714440 - RNA, 15 nt, Homo sapiens
uauauuuuaccauac

SEQ ID NO: 1714441 - RNA, 14 nt, Homo sapiens
uaucaagcuuuuaa

SEQ ID NO: 1714442 - RNA, 16 nt, Homo sapiens
uaucacauuuuagucc

SEQ ID NO: 1714443 - RNA, 20 nt, Homo sapiens
uaucacuuuuugaacuaaga

SEQ ID NO: 1714444 - RNA, 23 nt, Homo sapiens
uaucagcuuuuuaaaguggguua

SEQ ID NO: 1714445 - RNA, 19 nt, Homo sapiens
uaucaguguuuuaaauucu

SEQ ID NO: 1714446 - RNA, 13 nt, Homo sapiens
uaucaguuuccag

SEQ ID NO: 1714447 - RNA, 21 nt, Homo sapiens
uauccaugcaccaaacuaaua

SEQ ID NO: 1714448 - RNA, 15 nt, Homo sapiens
uauccugugacuguc

SEQ ID NO: 1714449 - RNA, 12 nt, Homo sapiens
uaucuccugaca

SEQ ID NO: 1714450 - RNA, 23 nt, Homo sapiens
uaucuccugacagaaggugccac

SEQ ID NO: 1714451 - RNA, 10 nt, Homo sapiens
uaucucucaa

SEQ ID NO: 1714452 - RNA, 21 nt, Homo sapiens
uaucucugaagcauguuucau

SEQ ID NO: 1714453 - RNA, 20 nt, Homo sapiens
uaucuggaggccuuccagcu

SEQ ID NO: 1714454 - RNA, 11 nt, Homo sapiens
uaucugugaaa

SEQ ID NO: 1714455 - RNA, 21 nt, Homo sapiens
uaucuguguagacuauuugcu

SEQ ID NO: 1714456 - RNA, 13 nt, Homo sapiens
uaucuguucuguu

SEQ ID NO: 1714457 - RNA, 17 nt, Homo sapiens
uaucuucucaaguucua

SEQ ID NO: 1714458 - RNA, 15 nt, Homo sapiens
uaucuugauaaacua

SEQ ID NO: 1714459 - RNA, 13 nt, Homo sapiens
uaugaaaugaccu

SEQ ID NO: 1714460 - RNA, 22 nt, Homo sapiens
uaugaaguugcaaugcuucaca

SEQ ID NO: 1714461 - RNA, 16 nt, Homo sapiens
uaugaauuugauuuau

SEQ ID NO: 1714462 - RNA, 17 nt, Homo sapiens
uaugacagaaaaguaau

SEQ ID NO: 1714463 - RNA, 18 nt, Homo sapiens
uaugacagaaaaguaaug

SEQ ID NO: 1714464 - RNA, 23 nt, Homo sapiens
uaugagacguuuuuggaagagua

SEQ ID NO: 1714465 - RNA, 23 nt, Homo sapiens
uaugaguaucuguauguauauau

SEQ ID NO: 1714466 - RNA, 17 nt, Homo sapiens
uaugaugaaaaccuaca

SEQ ID NO: 1714467 - RNA, 12 nt, Homo sapiens
uaugaugcacuu

SEQ ID NO: 1714468 - RNA, 13 nt, Homo sapiens
uaugaugcacuua

SEQ ID NO: 1714469 - RNA, 14 nt, Homo sapiens
uaugcaaaauggaa

SEQ ID NO: 1714470 - RNA, 19 nt, Homo sapiens
uaugcaaccaguuuaucca

SEQ ID NO: 1714471 - RNA, 20 nt, Homo sapiens
uaugcaauuagccucauagu

SEQ ID NO: 1714472 - RNA, 14 nt, Homo sapiens
uaugcacauaugga

SEQ ID NO: 1714473 - RNA, 14 nt, Homo sapiens
uaugcacauucacg

SEQ ID NO: 1714474 - RNA, 13 nt, Homo sapiens
uaugcacauuucu

SEQ ID NO: 1714475 - RNA, 16 nt, Homo sapiens
uaugccaagagugcac

SEQ ID NO: 1714476 - RNA, 14 nt, Homo sapiens
uaugcuaacuguag

SEQ ID NO: 1714477 - RNA, 18 nt, Homo sapiens
uaugcucagggucaauuu

SEQ ID NO: 1714478 - RNA, 22 nt, Homo sapiens
uaugcucagggucaauuucuuu

SEQ ID NO: 1714479 - RNA, 16 nt, Homo sapiens
uauggaacucucucca

SEQ ID NO: 1714480 - RNA, 19 nt, Homo sapiens
uauggaauugauuugcauu

SEQ ID NO: 1714481 - RNA, 16 nt, Homo sapiens
uauggugaacccacaa

SEQ ID NO: 1714482 - RNA, 14 nt, Homo sapiens
uauguaaucucacc

SEQ ID NO: 1714483 - RNA, 15 nt, Homo sapiens
uauguaccauaugau

SEQ ID NO: 1714484 - RNA, 16 nt, Homo sapiens
uaugucaguuugcagu

SEQ ID NO: 1714485 - RNA, 20 nt, Homo sapiens
uauguccgcagaauggacuu

SEQ ID NO: 1714486 - RNA, 21 nt, Homo sapiens
uaugugaucaauuuugacuua

SEQ ID NO: 1714487 - RNA, 15 nt, Homo sapiens
uauguguaugugcca

SEQ ID NO: 1714488 - RNA, 21 nt, Homo sapiens
uaugugugcauguguguauaa

SEQ ID NO: 1714489 - RNA, 17 nt, Homo sapiens
uauguuaaaauucucau

SEQ ID NO: 1714490 - RNA, 23 nt, Homo sapiens
uauuaaagugcuaagguucuaag

SEQ ID NO: 1714491 - RNA, 19 nt, Homo sapiens
uauuaaauauauacugacu

SEQ ID NO: 1714492 - RNA, 15 nt, Homo sapiens
uauuaacuugcuaca

SEQ ID NO: 1714493 - RNA, 17 nt, Homo sapiens
uauuaacuuuaauucuc

SEQ ID NO: 1714494 - RNA, 20 nt, Homo sapiens
uauuaauuguuuugcacuuu

SEQ ID NO: 1714495 - RNA, 12 nt, Homo sapiens
uauuaccagcaa

SEQ ID NO: 1714496 - RNA, 22 nt, Homo sapiens
uauuacuuauuuuugacagugu

SEQ ID NO: 1714497 - RNA, 22 nt, Homo sapiens
uauuauaaacuguaugcucaca

SEQ ID NO: 1714498 - RNA, 21 nt, Homo sapiens
uauucagauauaaaacaguuu

SEQ ID NO: 1714499 - RNA, 13 nt, Homo sapiens
uauuccugcauuu

SEQ ID NO: 1714500 - RNA, 15 nt, Homo sapiens
uauuccugccaccac

SEQ ID NO: 1714501 - RNA, 15 nt, Homo sapiens
uauucuaaaaccauu

SEQ ID NO: 1714502 - RNA, 18 nt, Homo sapiens
uauucucuuccucaucca

SEQ ID NO: 1714503 - RNA, 13 nt, Homo sapiens
uauucuucuagag

SEQ ID NO: 1714504 - RNA, 14 nt, Homo sapiens
uauugauaugugaa

SEQ ID NO: 1714505 - RNA, 13 nt, Homo sapiens
uauuggugcuaga

SEQ ID NO: 1714506 - RNA, 16 nt, Homo sapiens
uauugugccaauaugu

SEQ ID NO: 1714507 - RNA, 22 nt, Homo sapiens
uauuuaaagccuccucaucccg

SEQ ID NO: 1714508 - RNA, 14 nt, Homo sapiens
uauuuaagcaaaua

SEQ ID NO: 1714509 - RNA, 16 nt, Homo sapiens
uauuuaagcaaauacu

SEQ ID NO: 1714510 - RNA, 20 nt, Homo sapiens
uauuuaggagugugugacau

SEQ ID NO: 1714511 - RNA, 18 nt, Homo sapiens
uauuuauaagagugccgu

SEQ ID NO: 1714512 - RNA, 18 nt, Homo sapiens
uauuuauguuugcacuug

SEQ ID NO: 1714513 - RNA, 16 nt, Homo sapiens
uauuucaaaacacauc

SEQ ID NO: 1714514 - RNA, 16 nt, Homo sapiens
uauuuccaucauguca

SEQ ID NO: 1714515 - RNA, 18 nt, Homo sapiens
uauuugguaccauggugu

SEQ ID NO: 1714516 - RNA, 11 nt, Homo sapiens
uauuugucauu

SEQ ID NO: 1714517 - RNA, 15 nt, Homo sapiens
uauuuuacacagaaa

SEQ ID NO: 1714518 - RNA, 18 nt, Homo sapiens
uauuuuagaaacuccaau

SEQ ID NO: 1714519 - RNA, 14 nt, Homo sapiens
uauuuugaaguuua

SEQ ID NO: 1714520 - RNA, 21 nt, Homo sapiens
uauuuuguaaugcugcacaga

SEQ ID NO: 1714521 - RNA, 19 nt, Homo sapiens
uauuuuuacaagaaguuua

SEQ ID NO: 1714522 - RNA, 23 nt, Homo sapiens
uauuuuucaaagauguguugcua

SEQ ID NO: 1714523 - RNA, 14 nt, Homo sapiens
ucaaaaaguguuua

SEQ ID NO: 1714524 - RNA, 12 nt, Homo sapiens
ucaaaacacugu

SEQ ID NO: 1714525 - RNA, 17 nt, Homo sapiens
ucaaaagccagauguga

SEQ ID NO: 1714526 - RNA, 22 nt, Homo sapiens
ucaaaauaaaaagugacacagc

SEQ ID NO: 1714527 - RNA, 15 nt, Homo sapiens
ucaaaauccaaaaag

SEQ ID NO: 1714528 - RNA, 15 nt, Homo sapiens
ucaaaauccuuccaa

SEQ ID NO: 1714529 - RNA, 22 nt, Homo sapiens
ucaaaaugaaggcuuaguucaa

SEQ ID NO: 1714530 - RNA, 15 nt, Homo sapiens
ucaaacccauucccu

SEQ ID NO: 1714531 - RNA, 18 nt, Homo sapiens
uucuccuuuuacuucacu

SEQ ID NO: 1714532 - RNA, 22 nt, Homo sapiens
uucucuccaacucccucuggga

SEQ ID NO: 1714533 - RNA, 21 nt, Homo sapiens
uucucuuagaacauuguauua

SEQ ID NO: 1714534 - RNA, 17 nt, Homo sapiens
uucucuugagcuggccu

SEQ ID NO: 1714535 - RNA, 22 nt, Homo sapiens
uucucuuuguggggcuuggcgu

SEQ ID NO: 1714536 - RNA, 17 nt, Homo sapiens
uucugacggcccugcaa

SEQ ID NO: 1714537 - RNA, 15 nt, Homo sapiens
uucugagaaggugag

SEQ ID NO: 1714538 - RNA, 23 nt, Homo sapiens
uucugaggcccugcccaaugaga

SEQ ID NO: 1714539 - RNA, 20 nt, Homo sapiens
uucugcaaaauagacauauu

SEQ ID NO: 1714540 - RNA, 12 nt, Homo sapiens
uucugcacugaa

SEQ ID NO: 1714541 - RNA, 23 nt, Homo sapiens
uucugcuacuccccagaccucag

SEQ ID NO: 1714542 - RNA, 13 nt, Homo sapiens
uucugggacacag

SEQ ID NO: 1714543 - RNA, 20 nt, Homo sapiens
uucuggggaaagacacugcc

SEQ ID NO: 1714544 - RNA, 14 nt, Homo sapiens
uucuguaaauacca

SEQ ID NO: 1714545 - RNA, 22 nt, Homo sapiens
uucuguaaauaccauugacaca

SEQ ID NO: 1714546 - RNA, 19 nt, Homo sapiens
uucugucagaaugcuauug

SEQ ID NO: 1714547 - RNA, 21 nt, Homo sapiens
uucugucagaaugcuauugaa

SEQ ID NO: 1714548 - RNA, 22 nt, Homo sapiens
uucuuaaaaguugugauuccag

SEQ ID NO: 1714549 - RNA, 14 nt, Homo sapiens
uucuuaacaaccga

SEQ ID NO: 1714550 - RNA, 18 nt, Homo sapiens
uucuuacccaauuuccca

SEQ ID NO: 1714551 - RNA, 18 nt, Homo sapiens
uucuuagcccucuagaaa

SEQ ID NO: 1714552 - RNA, 14 nt, Homo sapiens
uucuucauacuuaa

SEQ ID NO: 1714553 - RNA, 19 nt, Homo sapiens
uucuugcaagcaugcuugu

SEQ ID NO: 1714554 - RNA, 22 nt, Homo sapiens
uucuugucagacauaaagccau

SEQ ID NO: 1714555 - RNA, 23 nt, Homo sapiens
uucuugucagacauaaagccaug

SEQ ID NO: 1714556 - RNA, 17 nt, Homo sapiens
uucuugugauguuuuga

SEQ ID NO: 1714557 - RNA, 21 nt, Homo sapiens
uucuuuccaauagcaaauuca

SEQ ID NO: 1714558 - RNA, 20 nt, Homo sapiens
uucuuugacaccacaccauc

SEQ ID NO: 1714559 - RNA, 22 nt, Homo sapiens
uucuuuuccugucccucuucca

SEQ ID NO: 1714560 - RNA, 16 nt, Homo sapiens
uucuuuuggcuuccau

SEQ ID NO: 1714561 - RNA, 16 nt, Homo sapiens
uugaaaacucacagaa

SEQ ID NO: 1714562 - RNA, 14 nt, Homo sapiens
uugaaaauguucag

SEQ ID NO: 1714563 - RNA, 14 nt, Homo sapiens
uugaaauaguugau

SEQ ID NO: 1714564 - RNA, 19 nt, Homo sapiens
uugaaaugaaauuuaaaca

SEQ ID NO: 1714565 - RNA, 21 nt, Homo sapiens
uugaaauguaggcaucaugca

SEQ ID NO: 1714566 - RNA, 20 nt, Homo sapiens
uugaaauuaagaaggcaaaa

SEQ ID NO: 1714567 - RNA, 15 nt, Homo sapiens
uugaacaagguuuca

SEQ ID NO: 1714568 - RNA, 12 nt, Homo sapiens
uugaacugguuc

SEQ ID NO: 1714569 - RNA, 18 nt, Homo sapiens
uugaacugguucaugaaa

SEQ ID NO: 1714570 - RNA, 22 nt, Homo sapiens
uugaaggguguugcacccuuuu

SEQ ID NO: 1714571 - RNA, 14 nt, Homo sapiens
uugaaguaugguug

SEQ ID NO: 1714572 - RNA, 18 nt, Homo sapiens
uugaauaaaagugcacac

SEQ ID NO: 1714573 - RNA, 15 nt, Homo sapiens
uugaaugaugagccu

SEQ ID NO: 1714574 - RNA, 17 nt, Homo sapiens
uugacacuuguugucca

SEQ ID NO: 1714575 - RNA, 15 nt, Homo sapiens
uugagacugauucag

SEQ ID NO: 1714576 - RNA, 21 nt, Homo sapiens
uugaggacaaccauuccagac

SEQ ID NO: 1714577 - RNA, 16 nt, Homo sapiens
uugauaccugcacugu

SEQ ID NO: 1714578 - RNA, 20 nt, Homo sapiens
uugauaguuaauuauuucaa

SEQ ID NO: 1714579 - RNA, 17 nt, Homo sapiens
uugaugacccucugacc

SEQ ID NO: 1714580 - RNA, 12 nt, Homo sapiens
uugaugccauau

SEQ ID NO: 1714581 - RNA, 21 nt, Homo sapiens
uugauggcuccgaacacccuc

SEQ ID NO: 1714582 - RNA, 13 nt, Homo sapiens
uugauguaucuga

SEQ ID NO: 1714583 - RNA, 17 nt, Homo sapiens
uugaugugaaacauuau

SEQ ID NO: 1714584 - RNA, 14 nt, Homo sapiens
uugauuaaaacauu

SEQ ID NO: 1714585 - RNA, 14 nt, Homo sapiens
uugauuaaugaacu

SEQ ID NO: 1714586 - RNA, 16 nt, Homo sapiens
uugcaaaucuugaaau

SEQ ID NO: 1714587 - RNA, 15 nt, Homo sapiens
uugcagcugauguug

SEQ ID NO: 1714588 - RNA, 13 nt, Homo sapiens
uugcagggcagcc

SEQ ID NO: 1714589 - RNA, 14 nt, Homo sapiens
uugcaggugacauu

SEQ ID NO: 1714590 - RNA, 22 nt, Homo sapiens
uugcaggugacauuugcucuga

SEQ ID NO: 1714591 - RNA, 20 nt, Homo sapiens
uugcccaggcuggucucaaa

SEQ ID NO: 1714592 - RNA, 22 nt, Homo sapiens
uugccuaaaauauauuccugag

SEQ ID NO: 1714593 - RNA, 14 nt, Homo sapiens
uugccuggugaaug

SEQ ID NO: 1714594 - RNA, 17 nt, Homo sapiens
uugccuuccuuucucca

SEQ ID NO: 1714595 - RNA, 20 nt, Homo sapiens
uugcgccguuguacuccagc

SEQ ID NO: 1714596 - RNA, 13 nt, Homo sapiens
uugcuagcaguaa

SEQ ID NO: 1714597 - RNA, 23 nt, Homo sapiens
uugcucagugggggcagagccac

SEQ ID NO: 1714598 - RNA, 14 nt, Homo sapiens
uugcuccuugacau

SEQ ID NO: 1714599 - RNA, 21 nt, Homo sapiens
uugcucgggucccuucaccuc

SEQ ID NO: 1714600 - RNA, 16 nt, Homo sapiens
uugcugauccaugaga

SEQ ID NO: 1714601 - RNA, 14 nt, Homo sapiens
uugcuggacuguca

SEQ ID NO: 1714602 - RNA, 19 nt, Homo sapiens
uugcuggagccugagucag

SEQ ID NO: 1714603 - RNA, 18 nt, Homo sapiens
uugcugguagcacuugcu

SEQ ID NO: 1714604 - RNA, 16 nt, Homo sapiens
uugcuguugcuugaau

SEQ ID NO: 1714605 - RNA, 15 nt, Homo sapiens
uugcuuauucacuga

SEQ ID NO: 1714606 - RNA, 20 nt, Homo sapiens
uugcuucucauccccagucc

SEQ ID NO: 1714607 - RNA, 22 nt, Homo sapiens
uugcuuuagcacaggacaacuu

SEQ ID NO: 1714608 - RNA, 10 nt, Homo sapiens
uugcuuuaug

SEQ ID NO: 1714609 - RNA, 19 nt, Homo sapiens
uugcuuugauuuacagcaa

SEQ ID NO: 1714610 - RNA, 23 nt, Homo sapiens
uugcuuuguuggcaaggagccag

SEQ ID NO: 1714611 - RNA, 14 nt, Homo sapiens
uuggaagagaauca

SEQ ID NO: 1714612 - RNA, 21 nt, Homo sapiens
uuggaagaggaacagcacugg

SEQ ID NO: 1714613 - RNA, 15 nt, Homo sapiens
uuggaaguacaugaa

SEQ ID NO: 1714614 - RNA, 18 nt, Homo sapiens
uuggaaguacaugaauac

SEQ ID NO: 1714615 - RNA, 15 nt, Homo sapiens
uuggagagacacagc

SEQ ID NO: 1714616 - RNA, 20 nt, Homo sapiens
uuggagcugucccaccugca

SEQ ID NO: 1714617 - RNA, 12 nt, Homo sapiens
uuggagggauaa

SEQ ID NO: 1714618 - RNA, 20 nt, Homo sapiens
uuggagggguauuuuugccc

SEQ ID NO: 1714619 - RNA, 23 nt, Homo sapiens
uuggagggguauuuuugcccuga

SEQ ID NO: 1714620 - RNA, 17 nt, Homo sapiens
uuggagggugucccaaa

SEQ ID NO: 1714621 - RNA, 18 nt, Homo sapiens
uuggagugcgggugggcu

SEQ ID NO: 1714622 - RNA, 12 nt, Homo sapiens
uuggauuugaca

SEQ ID NO: 1714623 - RNA, 20 nt, Homo sapiens
uuggcaaaagccuuguguau

SEQ ID NO: 1714624 - RNA, 18 nt, Homo sapiens
uuggcauggauuucuguc

SEQ ID NO: 1714625 - RNA, 22 nt, Homo sapiens
uuggccucagaauucacaaaau

SEQ ID NO: 1714626 - RNA, 14 nt, Homo sapiens
uuggcucaauccuc

SEQ ID NO: 1714627 - RNA, 17 nt, Homo sapiens
uuggcucacagggcuga

SEQ ID NO: 1714628 - RNA, 22 nt, Homo sapiens
uuggcuccaugcuccucacugc

SEQ ID NO: 1714629 - RNA, 15 nt, Homo sapiens
uuggcuucugugaug

SEQ ID NO: 1714630 - RNA, 24 nt, Homo sapiens
uuggcuucugugaugagcugaucu

SEQ ID NO: 1714631 - RNA, 20 nt, Homo sapiens
uugggacauugcaauuugca

SEQ ID NO: 1714632 - RNA, 16 nt, Homo sapiens
uugggcugcuccucau

SEQ ID NO: 1714633 - RNA, 20 nt, Homo sapiens
uuggggaugagaaagguuga

SEQ ID NO: 1714634 - RNA, 15 nt, Homo sapiens
uuggggccaccaaag

SEQ ID NO: 1714635 - RNA, 16 nt, Homo sapiens
uuggggccaccaaagc

SEQ ID NO: 1714636 - RNA, 18 nt, Homo sapiens
uugggggggccaaaagga

SEQ ID NO: 1714637 - RNA, 23 nt, Homo sapiens
uuggguuaagcauuaccacucag

SEQ ID NO: 1714638 - RNA, 12 nt, Homo sapiens
uugguaccaugg

SEQ ID NO: 1714639 - RNA, 13 nt, Homo sapiens
uuggucacagggu

SEQ ID NO: 1714640 - RNA, 16 nt, Homo sapiens
uugguccuggggacca

SEQ ID NO: 1714641 - RNA, 19 nt, Homo sapiens
uuguaaaaagaaaaaccac

SEQ ID NO: 1714642 - RNA, 21 nt, Homo sapiens
uuguaacgacuucuccaucuc

SEQ ID NO: 1714643 - RNA, 16 nt, Homo sapiens
uuguaagaguguagaa

SEQ ID NO: 1714644 - RNA, 19 nt, Homo sapiens
uuguaauuuugcaaaacau

SEQ ID NO: 1714645 - RNA, 19 nt, Homo sapiens
uuguacccccagguggaag

SEQ ID NO: 1714646 - RNA, 19 nt, Homo sapiens
uuguagagauggggucuca

SEQ ID NO: 1714647 - RNA, 21 nt, Homo sapiens
uuguagagccagggucucacu

SEQ ID NO: 1714648 - RNA, 14 nt, Homo sapiens
uuguauauuacaca

SEQ ID NO: 1714649 - RNA, 23 nt, Homo sapiens
uuguauauuacacauuuguacag

SEQ ID NO: 1714650 - RNA, 19 nt, Homo sapiens
uuguaucaacacuguuacu

SEQ ID NO: 1714651 - RNA, 21 nt, Homo sapiens
uuguauggagccucuucugcc

SEQ ID NO: 1714652 - RNA, 17 nt, Homo sapiens
uugucaacaaaccaagc

SEQ ID NO: 1714653 - RNA, 11 nt, Homo sapiens
uugucaugaau

SEQ ID NO: 1714654 - RNA, 22 nt, Homo sapiens
uuguccguguucauacauuuga

SEQ ID NO: 1714655 - RNA, 19 nt, Homo sapiens
uugucuuuucaaaauauua

SEQ ID NO: 1714656 - RNA, 15 nt, Homo sapiens
uugugagccaccacg

SEQ ID NO: 1714657 - RNA, 15 nt, Homo sapiens
uugugaugucuuuuc

SEQ ID NO: 1714658 - RNA, 16 nt, Homo sapiens
uugugcugccauuuga

SEQ ID NO: 1714659 - RNA, 21 nt, Homo sapiens
uugugcuggauggagcccagg

SEQ ID NO: 1714660 - RNA, 20 nt, Homo sapiens
uugugguuuauugaauguga

SEQ ID NO: 1714661 - RNA, 16 nt, Homo sapiens
uugugucagauuacca

SEQ ID NO: 1714662 - RNA, 18 nt, Homo sapiens
uugugugaccaacugugu

SEQ ID NO: 1714663 - RNA, 15 nt, Homo sapiens
uuguuaauucuuccu

SEQ ID NO: 1714664 - RNA, 22 nt, Homo sapiens
uuguuacuguucuugcugcuag

SEQ ID NO: 1714665 - RNA, 18 nt, Homo sapiens
uuguuaucagauauguga

SEQ ID NO: 1714666 - RNA, 15 nt, Homo sapiens
uuguuaucagucaau

SEQ ID NO: 1714667 - RNA, 16 nt, Homo sapiens
uuguucaguaugcaaa

SEQ ID NO: 1714668 - RNA, 14 nt, Homo sapiens
uuguucuacugaga

SEQ ID NO: 1714669 - RNA, 17 nt, Homo sapiens
uuguuggccaaagccaa

SEQ ID NO: 1714670 - RNA, 20 nt, Homo sapiens
uuguuuagauaugacauuua

SEQ ID NO: 1714671 - RNA, 22 nt, Homo sapiens
uuguuuauacuccaguguacau

SEQ ID NO: 1714672 - RNA, 19 nt, Homo sapiens
uuguuucaaccaagucaug

SEQ ID NO: 1714673 - RNA, 15 nt, Homo sapiens
uuguuucuuuucaca

SEQ ID NO: 1714674 - RNA, 14 nt, Homo sapiens
uuguuugucuucca

SEQ ID NO: 1714675 - RNA, 19 nt, Homo sapiens
uuguuuuacccuauacauc

SEQ ID NO: 1714676 - RNA, 13 nt, Homo sapiens
uuuaaaacacaug

SEQ ID NO: 1714677 - RNA, 14 nt, Homo sapiens
uuuaaaagauaaaa

SEQ ID NO: 1714678 - RNA, 17 nt, Homo sapiens
uuuaaaaguuucaaugu

SEQ ID NO: 1714679 - RNA, 14 nt, Homo sapiens
uuuaaacucaggga

SEQ ID NO: 1714680 - RNA, 22 nt, Homo sapiens
uuuaaacucagggacagagcca

SEQ ID NO: 1714681 - RNA, 14 nt, Homo sapiens
uuuaaaguggcaau

SEQ ID NO: 1714682 - RNA, 17 nt, Homo sapiens
uuuaaccgcacaugcac

SEQ ID NO: 1714683 - RNA, 16 nt, Homo sapiens
uuuaacuagacacaga

SEQ ID NO: 1714684 - RNA, 13 nt, Homo sapiens
uuuaagaaaucaa

SEQ ID NO: 1714685 - RNA, 17 nt, Homo sapiens
uuuaagaguuacuuaau

SEQ ID NO: 1714686 - RNA, 15 nt, Homo sapiens
uuuaaguacuacaca

SEQ ID NO: 1714687 - RNA, 19 nt, Homo sapiens
uuuaauagcuauggaauca

SEQ ID NO: 1714688 - RNA, 13 nt, Homo sapiens
uuuaauagucauu

SEQ ID NO: 1714689 - RNA, 19 nt, Homo sapiens
uuuaaucauuuugccucuu

SEQ ID NO: 1714690 - RNA, 13 nt, Homo sapiens
uuuaauggcagca

SEQ ID NO: 1714691 - RNA, 12 nt, Homo sapiens
uuuacaaaguau

SEQ ID NO: 1714692 - RNA, 22 nt, Homo sapiens
uuuacagauaucugaauggaag

SEQ ID NO: 1714693 - RNA, 21 nt, Homo sapiens
uuuacagcuaucgaacuucac

SEQ ID NO: 1714694 - RNA, 13 nt, Homo sapiens
uuuacagcugccu

SEQ ID NO: 1714695 - RNA, 18 nt, Homo sapiens
uuuacagugcuauuuacu

SEQ ID NO: 1714696 - RNA, 23 nt, Homo sapiens
uuuacauguguagccuauguugu

SEQ ID NO: 1714697 - RNA, 17 nt, Homo sapiens
uuuacauuauuaagaaa

SEQ ID NO: 1714698 - RNA, 11 nt, Homo sapiens
uuuacauucau

SEQ ID NO: 1714699 - RNA, 15 nt, Homo sapiens
uuuacauucaucuca

SEQ ID NO: 1714700 - RNA, 10 nt, Homo sapiens
uuuacauuua

SEQ ID NO: 1714701 - RNA, 19 nt, Homo sapiens
uuuaccaguuaauuacuca

SEQ ID NO: 1714702 - RNA, 23 nt, Homo sapiens
uuuacccauuaaauuaagacuug

SEQ ID NO: 1714703 - RNA, 20 nt, Homo sapiens
uuuacccuauacauccacag

SEQ ID NO: 1714704 - RNA, 17 nt, Homo sapiens
uuuaccuuauguuuaau

SEQ ID NO: 1714705 - RNA, 13 nt, Homo sapiens
uuuaggagugugu

SEQ ID NO: 1714706 - RNA, 21 nt, Homo sapiens
uuuaggugaauuaauuaaaca

SEQ ID NO: 1714707 - RNA, 13 nt, Homo sapiens
uuuauaagucauu

SEQ ID NO: 1714708 - RNA, 13 nt, Homo sapiens
uuuauaauaaaca

SEQ ID NO: 1714709 - RNA, 14 nt, Homo sapiens
uuuauagagugucu

SEQ ID NO: 1714710 - RNA, 19 nt, Homo sapiens
uuuauagagugucucaggg

SEQ ID NO: 1714711 - RNA, 17 nt, Homo sapiens
uuuauauguacaugaga

SEQ ID NO: 1714712 - RNA, 23 nt, Homo sapiens
uuuauauguguugaaaaccaaaa

SEQ ID NO: 1714713 - RNA, 15 nt, Homo sapiens
uuuaucaaagcauag

SEQ ID NO: 1714714 - RNA, 19 nt, Homo sapiens
uuuaucacuucauucacau

SEQ ID NO: 1714715 - RNA, 23 nt, Homo sapiens
uuuaucacuucauucacauucag

SEQ ID NO: 1714716 - RNA, 13 nt, Homo sapiens
uuuaugaaaugac

SEQ ID NO: 1714717 - RNA, 11 nt, Homo sapiens
uuuaugcacau

SEQ ID NO: 1714718 - RNA, 22 nt, Homo sapiens
uuuauuaguuaauauaucccag

SEQ ID NO: 1714719 - RNA, 21 nt, Homo sapiens
uuuauucauuagcugugauuu

SEQ ID NO: 1714720 - RNA, 13 nt, Homo sapiens
uuuauuucuguca

SEQ ID NO: 1714721 - RNA, 15 nt, Homo sapiens
uuucaaaugugcugu

SEQ ID NO: 1714722 - RNA, 18 nt, Homo sapiens
uuucaaauuaagugugca

SEQ ID NO: 1714723 - RNA, 12 nt, Homo sapiens
uuucaacuauuu

SEQ ID NO: 1714724 - RNA, 15 nt, Homo sapiens
uuucacagucacuga

SEQ ID NO: 1714725 - RNA, 11 nt, Homo sapiens
uuucaccacau

SEQ ID NO: 1714726 - RNA, 15 nt, Homo sapiens
uuucagaaaauauua

SEQ ID NO: 1714727 - RNA, 20 nt, Homo sapiens
uuucagagaaauacuuucag

SEQ ID NO: 1714728 - RNA, 18 nt, Homo sapiens
uuucauaaccuagccuua

SEQ ID NO: 1714729 - RNA, 19 nt, Homo sapiens
uuucauagagauuugucua

SEQ ID NO: 1714730 - RNA, 22 nt, Homo sapiens
uuucauguggcuguagauccca

SEQ ID NO: 1714731 - RNA, 22 nt, Homo sapiens
uuucauugccuguguauggaaa

SEQ ID NO: 1714732 - RNA, 19 nt, Homo sapiens
uuuccagacuuccuugaga

SEQ ID NO: 1714733 - RNA, 17 nt, Homo sapiens
uuuccagcagaagacaa

SEQ ID NO: 1714734 - RNA, 15 nt, Homo sapiens
uuuccaggcuagucc

SEQ ID NO: 1714735 - RNA, 12 nt, Homo sapiens
uuuccaggguug

SEQ ID NO: 1714736 - RNA, 17 nt, Homo sapiens
uuuccaggguugcuuga

SEQ ID NO: 1714737 - RNA, 15 nt, Homo sapiens
uuuccaucugcuggg

SEQ ID NO: 1714738 - RNA, 19 nt, Homo sapiens
uuucccagagucaucugau

SEQ ID NO: 1714739 - RNA, 13 nt, Homo sapiens
uuuccccuaucau

SEQ ID NO: 1714740 - RNA, 15 nt, Homo sapiens
uuuccuuucugccac

SEQ ID NO: 1714741 - RNA, 22 nt, Homo sapiens
uuucgcaccuaccaucagggac

SEQ ID NO: 1714742 - RNA, 21 nt, Homo sapiens
uuucuaaccuugaaugcugcc

SEQ ID NO: 1714743 - RNA, 12 nt, Homo sapiens
uuucuacccagc

SEQ ID NO: 1714744 - RNA, 22 nt, Homo sapiens
uuucuagaaguuucccuuccuc

SEQ ID NO: 1714745 - RNA, 13 nt, Homo sapiens
uuucucauuaaau

SEQ ID NO: 1714746 - RNA, 13 nt, Homo sapiens
uuucuccagugcu

SEQ ID NO: 1714747 - RNA, 17 nt, Homo sapiens
uuucuccuuuuacuuca

SEQ ID NO: 1714748 - RNA, 19 nt, Homo sapiens
uuucucuguaaacuuccaa

SEQ ID NO: 1714749 - RNA, 22 nt, Homo sapiens
uuucugcuaaaaaguccuugau

SEQ ID NO: 1714750 - RNA, 11 nt, Homo sapiens
aagaauggaga

SEQ ID NO: 1714751 - RNA, 22 nt, Homo sapiens
aagaauuuuuuuuaacauucca

SEQ ID NO: 1714752 - RNA, 14 nt, Homo sapiens
aagacacagacugc

SEQ ID NO: 1714753 - RNA, 19 nt, Homo sapiens
aagacagggaagagcagaa

SEQ ID NO: 1714754 - RNA, 14 nt, Homo sapiens
aagacauaucucua

SEQ ID NO: 1714755 - RNA, 15 nt, Homo sapiens
aagacauucuuccaa

SEQ ID NO: 1714756 - RNA, 17 nt, Homo sapiens
aagaccagccuggccaa

SEQ ID NO: 1714757 - RNA, 14 nt, Homo sapiens
aagacuacaaaaau

SEQ ID NO: 1714758 - RNA, 16 nt, Homo sapiens
aagacucuauucucaa

SEQ ID NO: 1714759 - RNA, 19 nt, Homo sapiens
aagacuguugccacuuaac

SEQ ID NO: 1714760 - RNA, 16 nt, Homo sapiens
aagagaaccgagcaaa

SEQ ID NO: 1714761 - RNA, 15 nt, Homo sapiens
aagagauaaacuaca

SEQ ID NO: 1714762 - RNA, 20 nt, Homo sapiens
aagagccauauaaguuugaa

SEQ ID NO: 1714763 - RNA, 23 nt, Homo sapiens
aagaggguccuuuaguaccugaa

SEQ ID NO: 1714764 - RNA, 16 nt, Homo sapiens
aagagggucugaggaa

SEQ ID NO: 1714765 - RNA, 13 nt, Homo sapiens
aagaguccaagaa

SEQ ID NO: 1714766 - RNA, 13 nt, Homo sapiens
aagagucuuccaa

SEQ ID NO: 1714767 - RNA, 18 nt, Homo sapiens
aagagugacuaguacaaa

SEQ ID NO: 1714768 - RNA, 19 nt, Homo sapiens
aagagugccguaacaacug

SEQ ID NO: 1714769 - RNA, 16 nt, Homo sapiens
aagaguguuucuucca

SEQ ID NO: 1714770 - RNA, 15 nt, Homo sapiens
aagauaauuuacuua

SEQ ID NO: 1714771 - RNA, 14 nt, Homo sapiens
aagauaguaacaau

SEQ ID NO: 1714772 - RNA, 22 nt, Homo sapiens
aagaucaaggaguacaaugccc

SEQ ID NO: 1714773 - RNA, 21 nt, Homo sapiens
aagaucagugaagacagcaau

SEQ ID NO: 1714774 - RNA, 21 nt, Homo sapiens
aagaucuguaaguaacuucac

SEQ ID NO: 1714775 - RNA, 15 nt, Homo sapiens
aagaucuguuuugaa

SEQ ID NO: 1714776 - RNA, 20 nt, Homo sapiens
aagaugauucuggcugaaaa

SEQ ID NO: 1714777 - RNA, 14 nt, Homo sapiens
aagauguacuugug

SEQ ID NO: 1714778 - RNA, 16 nt, Homo sapiens
aagauuagaagcugaa

SEQ ID NO: 1714779 - RNA, 13 nt, Homo sapiens
aagauugauacuu

SEQ ID NO: 1714780 - RNA, 22 nt, Homo sapiens
aagauuuagaaaaaaguuuaca

SEQ ID NO: 1714781 - RNA, 21 nt, Homo sapiens
aagcaaaaaaugaaugucuaa

SEQ ID NO: 1714782 - RNA, 20 nt, Homo sapiens
aagcacaagcagagugcaca

SEQ ID NO: 1714783 - RNA, 15 nt, Homo sapiens
aagcacaguuugaac

SEQ ID NO: 1714784 - RNA, 13 nt, Homo sapiens
aagcacaucugca

SEQ ID NO: 1714785 - RNA, 22 nt, Homo sapiens
aagcacgugucucagacugcau

SEQ ID NO: 1714786 - RNA, 22 nt, Homo sapiens
aagcagcaucuucugguuuaaa

SEQ ID NO: 1714787 - RNA, 17 nt, Homo sapiens
aagcagccaucacauga

SEQ ID NO: 1714788 - RNA, 21 nt, Homo sapiens
aagcagccauuggcacugugg

SEQ ID NO: 1714789 - RNA, 22 nt, Homo sapiens
aagcagcgaccgcccccuccuc

SEQ ID NO: 1714790 - RNA, 23 nt, Homo sapiens
aagcaucucagccuaccaugaga

SEQ ID NO: 1714791 - RNA, 24 nt, Homo sapiens
aagcaucucagccuaccaugagaa

SEQ ID NO: 1714792 - RNA, 17 nt, Homo sapiens
aagcaugccucuucccu

SEQ ID NO: 1714793 - RNA, 17 nt, Homo sapiens
aagccacaagucuucca

SEQ ID NO: 1714794 - RNA, 18 nt, Homo sapiens
aagccacaagucuuccag

SEQ ID NO: 1714795 - RNA, 13 nt, Homo sapiens
aagccacuugaaa

SEQ ID NO: 1714796 - RNA, 16 nt, Homo sapiens
aagccagcugcagcug

SEQ ID NO: 1714797 - RNA, 21 nt, Homo sapiens
aagccagcugcagcugggcug

SEQ ID NO: 1714798 - RNA, 21 nt, Homo sapiens
aagccauguauaaaugugaua

SEQ ID NO: 1714799 - RNA, 17 nt, Homo sapiens
aagcccaagugaaauca

SEQ ID NO: 1714800 - RNA, 12 nt, Homo sapiens
aagcccacagca

SEQ ID NO: 1714801 - RNA, 14 nt, Homo sapiens
aagcccuaagugac

SEQ ID NO: 1714802 - RNA, 21 nt, Homo sapiens
aagcccugaaccccaagcgcu

SEQ ID NO: 1714803 - RNA, 23 nt, Homo sapiens
aagcccugauguguccucaggga

SEQ ID NO: 1714804 - RNA, 12 nt, Homo sapiens
aagccuccucau

SEQ ID NO: 1714805 - RNA, 12 nt, Homo sapiens
aagccucugggu

SEQ ID NO: 1714806 - RNA, 15 nt, Homo sapiens
aagccugugcaaugc

SEQ ID NO: 1714807 - RNA, 23 nt, Homo sapiens
aagccuuaaguggcagaauauaa

SEQ ID NO: 1714808 - RNA, 13 nt, Homo sapiens
aagccuugccuaa

SEQ ID NO: 1714809 - RNA, 17 nt, Homo sapiens
aagcgauucuccugccu

SEQ ID NO: 1714810 - RNA, 17 nt, Homo sapiens
aagcggauuuccaggga

SEQ ID NO: 1714811 - RNA, 14 nt, Homo sapiens
aagcuaaauuccac

SEQ ID NO: 1714812 - RNA, 14 nt, Homo sapiens
aagcuccacuguca

SEQ ID NO: 1714813 - RNA, 15 nt, Homo sapiens
aagcuccacugucac

SEQ ID NO: 1714814 - RNA, 15 nt, Homo sapiens
aagcuccucgugaua

SEQ ID NO: 1714815 - RNA, 14 nt, Homo sapiens
aagcucuagaaucu

SEQ ID NO: 1714816 - RNA, 21 nt, Homo sapiens
aagcucuagaaucugcaauuc

SEQ ID NO: 1714817 - RNA, 12 nt, Homo sapiens
aagcucuaguuc

SEQ ID NO: 1714818 - RNA, 21 nt, Homo sapiens
aagcucuucacugaaacuggu

SEQ ID NO: 1714819 - RNA, 16 nt, Homo sapiens
aagcugagauugagca

SEQ ID NO: 1714820 - RNA, 15 nt, Homo sapiens
aagcugauuaccuga

SEQ ID NO: 1714821 - RNA, 16 nt, Homo sapiens
aagcugcccacuguuu

SEQ ID NO: 1714822 - RNA, 16 nt, Homo sapiens
aagcuggcuuuuccca

SEQ ID NO: 1714823 - RNA, 17 nt, Homo sapiens
aagcuguuguacauuua

SEQ ID NO: 1714824 - RNA, 20 nt, Homo sapiens
aagcuuguuaucagcuuuca

SEQ ID NO: 1714825 - RNA, 22 nt, Homo sapiens
aagcuuuuggagggugauauaa

SEQ ID NO: 1714826 - RNA, 21 nt, Homo sapiens
aagcuuuuuccuccuggaaca

SEQ ID NO: 1714827 - RNA, 14 nt, Homo sapiens
aaggaaaaugacuc

SEQ ID NO: 1714828 - RNA, 14 nt, Homo sapiens
aaggaaacuccuga

SEQ ID NO: 1714829 - RNA, 15 nt, Homo sapiens
aaggaaaucucaccc

SEQ ID NO: 1714830 - RNA, 23 nt, Homo sapiens
aaggaacagagugagagacauca

SEQ ID NO: 1714831 - RNA, 12 nt, Homo sapiens
aaggaagcucca

SEQ ID NO: 1714832 - RNA, 16 nt, Homo sapiens
aaggaagcuccacugu

SEQ ID NO: 1714833 - RNA, 19 nt, Homo sapiens
aaggaagcuccacugucac

SEQ ID NO: 1714834 - RNA, 19 nt, Homo sapiens
aaggacagaguaugaacac

SEQ ID NO: 1714835 - RNA, 22 nt, Homo sapiens
aaggacagugucaaagugauaa

SEQ ID NO: 1714836 - RNA, 21 nt, Homo sapiens
aaggacauuuaaaauucaauu

SEQ ID NO: 1714837 - RNA, 15 nt, Homo sapiens
aaggagcagcauuga

SEQ ID NO: 1714838 - RNA, 14 nt, Homo sapiens
aaggauacuuuaca

SEQ ID NO: 1714839 - RNA, 19 nt, Homo sapiens
aaggaugucacagggccaa

SEQ ID NO: 1714840 - RNA, 12 nt, Homo sapiens
aaggaugugauu

SEQ ID NO: 1714841 - RNA, 14 nt, Homo sapiens
aaggcagauggggc

SEQ ID NO: 1714842 - RNA, 19 nt, Homo sapiens
aaggcagauggggcacuga

SEQ ID NO: 1714843 - RNA, 16 nt, Homo sapiens
aaggcagccaccagcg

SEQ ID NO: 1714844 - RNA, 17 nt, Homo sapiens
aaggcuuuaucucaggg

SEQ ID NO: 1714845 - RNA, 15 nt, Homo sapiens
aagggcaugccuugu

SEQ ID NO: 1714846 - RNA, 12 nt, Homo sapiens
aagggcucucuu

SEQ ID NO: 1714847 - RNA, 12 nt, Homo sapiens
aaggggcacugg

SEQ ID NO: 1714848 - RNA, 18 nt, Homo sapiens
aagggggggcuacauuau

SEQ ID NO: 1714849 - RNA, 21 nt, Homo sapiens
aagggguuggauugcaauauc

SEQ ID NO: 1714850 - RNA, 19 nt, Homo sapiens
aagggugggugcucagaau

SEQ ID NO: 1714851 - RNA, 18 nt, Homo sapiens
aagguacuauauuugcua

SEQ ID NO: 1714852 - RNA, 19 nt, Homo sapiens
aagguccacaggucuagac

SEQ ID NO: 1714853 - RNA, 22 nt, Homo sapiens
aaggugaccuggccagagccaa

SEQ ID NO: 1714854 - RNA, 12 nt, Homo sapiens
aaggugccacuu

SEQ ID NO: 1714855 - RNA, 24 nt, Homo sapiens
aaggugugcucugaucauccacug

SEQ ID NO: 1714856 - RNA, 16 nt, Homo sapiens
aagguuccaacuguau

SEQ ID NO: 1714857 - RNA, 21 nt, Homo sapiens
aagguuggcccccacgugggg

SEQ ID NO: 1714858 - RNA, 22 nt, Homo sapiens
aagguuguguagcugugucaug

SEQ ID NO: 1714859 - RNA, 16 nt, Homo sapiens
aaguaaccauuugcac

SEQ ID NO: 1714860 - RNA, 17 nt, Homo sapiens
aacagauggcacuuuga

SEQ ID NO: 1714861 - RNA, 14 nt, Homo sapiens
aacagcucucaccu

SEQ ID NO: 1714862 - RNA, 16 nt, Homo sapiens
aacaggaaaccacuua

SEQ ID NO: 1714863 - RNA, 21 nt, Homo sapiens
aacaggcuguucugcacugaa

SEQ ID NO: 1714864 - RNA, 13 nt, Homo sapiens
aacagggcauuuu

SEQ ID NO: 1714865 - RNA, 12 nt, Homo sapiens
aacaguauuuca

SEQ ID NO: 1714866 - RNA, 20 nt, Homo sapiens
aacaguucauguuugcuuca

SEQ ID NO: 1714867 - RNA, 19 nt, Homo sapiens
aacauaaaaaaacuuccau

SEQ ID NO: 1714868 - RNA, 20 nt, Homo sapiens
aacauacuggccuggacugu

SEQ ID NO: 1714869 - RNA, 13 nt, Homo sapiens
aacauaucuugag

SEQ ID NO: 1714870 - RNA, 23 nt, Homo sapiens
aacauccauguccuaugugugac

SEQ ID NO: 1714871 - RNA, 15 nt, Homo sapiens
aacaugacacugacc

SEQ ID NO: 1714872 - RNA, 11 nt, Homo sapiens
aacaugcugcc

SEQ ID NO: 1714873 - RNA, 21 nt, Homo sapiens
aacauguuagaagcaaugaau

SEQ ID NO: 1714874 - RNA, 13 nt, Homo sapiens
aacauuccaagac

SEQ ID NO: 1714875 - RNA, 17 nt, Homo sapiens
aacauuccuuagucuca

SEQ ID NO: 1714876 - RNA, 18 nt, Homo sapiens
aacauuccuuagucucaa

SEQ ID NO: 1714877 - RNA, 22 nt, Homo sapiens
aacauugaaguuaaaacccaga

SEQ ID NO: 1714878 - RNA, 15 nt, Homo sapiens
aacauuguguugaca

SEQ ID NO: 1714879 - RNA, 20 nt, Homo sapiens
aacauuguguugacauuaag

SEQ ID NO: 1714880 - RNA, 15 nt, Homo sapiens
aaccaagaucuauaa

SEQ ID NO: 1714881 - RNA, 17 nt, Homo sapiens
aaccaauuuacacugcc

SEQ ID NO: 1714882 - RNA, 11 nt, Homo sapiens
aaccacaaagg

SEQ ID NO: 1714883 - RNA, 15 nt, Homo sapiens
aaccacaacugacac

SEQ ID NO: 1714884 - RNA, 12 nt, Homo sapiens
aaccaccaaucc

SEQ ID NO: 1714885 - RNA, 21 nt, Homo sapiens
aaccagacaaggaaauacccu

SEQ ID NO: 1714886 - RNA, 16 nt, Homo sapiens
aaccagagaagcugcu

SEQ ID NO: 1714887 - RNA, 13 nt, Homo sapiens
aaccagagaggcu

SEQ ID NO: 1714888 - RNA, 16 nt, Homo sapiens
aaccauccacuuacau

SEQ ID NO: 1714889 - RNA, 16 nt, Homo sapiens
aaccauccagugacaa

SEQ ID NO: 1714890 - RNA, 17 nt, Homo sapiens
aaccauccagugacaaa

SEQ ID NO: 1714891 - RNA, 18 nt, Homo sapiens
aacccaaggacugaggga

SEQ ID NO: 1714892 - RNA, 14 nt, Homo sapiens
aacccaaggagcac

SEQ ID NO: 1714893 - RNA, 20 nt, Homo sapiens
aacccacgauuuucuccagc

SEQ ID NO: 1714894 - RNA, 21 nt, Homo sapiens
aacccacuugucacugacaca

SEQ ID NO: 1714895 - RNA, 22 nt, Homo sapiens
aacccagggcucugccccaguc

SEQ ID NO: 1714896 - RNA, 18 nt, Homo sapiens
aaccccaacgcacaggaa

SEQ ID NO: 1714897 - RNA, 21 nt, Homo sapiens
aaccccauguccucagcauuu

SEQ ID NO: 1714898 - RNA, 15 nt, Homo sapiens
aaccccucugggaaa

SEQ ID NO: 1714899 - RNA, 14 nt, Homo sapiens
aaccccuucuuuac

SEQ ID NO: 1714900 - RNA, 17 nt, Homo sapiens
aacccuaucuccugaca

SEQ ID NO: 1714901 - RNA, 19 nt, Homo sapiens
aacccuaucuccugacaga

SEQ ID NO: 1714902 - RNA, 22 nt, Homo sapiens
aaccuagccuuagaagucacac

SEQ ID NO: 1714903 - RNA, 18 nt, Homo sapiens
aaccuaguacgacuucau

SEQ ID NO: 1714904 - RNA, 14 nt, Homo sapiens
aaccuaguacugcc

SEQ ID NO: 1714905 - RNA, 17 nt, Homo sapiens
aaccuaugaaacuauug

SEQ ID NO: 1714906 - RNA, 22 nt, Homo sapiens
aaccucauccaggcuaccaucc

SEQ ID NO: 1714907 - RNA, 12 nt, Homo sapiens
aaccucauucuc

SEQ ID NO: 1714908 - RNA, 16 nt, Homo sapiens
aaccucuacauauuua

SEQ ID NO: 1714909 - RNA, 17 nt, Homo sapiens
aaccugaagacugagga

SEQ ID NO: 1714910 - RNA, 18 nt, Homo sapiens
aaccugccaugccaggaa

SEQ ID NO: 1714911 - RNA, 14 nt, Homo sapiens
aaccugcugaaggg

SEQ ID NO: 1714912 - RNA, 23 nt, Homo sapiens
aaccuguccuaaggaaccuuccu

SEQ ID NO: 1714913 - RNA, 16 nt, Homo sapiens
aaccuugaaugcugcc

SEQ ID NO: 1714914 - RNA, 17 nt, Homo sapiens
aaccuugaaugcugcca

SEQ ID NO: 1714915 - RNA, 21 nt, Homo sapiens
aacgagcauaguccaaaaagc

SEQ ID NO: 1714916 - RNA, 21 nt, Homo sapiens
aacuaagaaaauucuauguua

SEQ ID NO: 1714917 - RNA, 18 nt, Homo sapiens
aacuaauaaaacuuugac

SEQ ID NO: 1714918 - RNA, 23 nt, Homo sapiens
aacuaauccuucuggcagauuca

SEQ ID NO: 1714919 - RNA, 12 nt, Homo sapiens
aacuacuaaagu

SEQ ID NO: 1714920 - RNA, 17 nt, Homo sapiens
aacuaugagcuugcuca

SEQ ID NO: 1714921 - RNA, 22 nt, Homo sapiens
aacuauucgaaugaaaagacaa

SEQ ID NO: 1714922 - RNA, 19 nt, Homo sapiens
aacuauugauaugugaaua

SEQ ID NO: 1714923 - RNA, 17 nt, Homo sapiens
aacuauuuauugaauga

SEQ ID NO: 1714924 - RNA, 19 nt, Homo sapiens
aacucaaaaauauuugcug

SEQ ID NO: 1714925 - RNA, 13 nt, Homo sapiens
aacucaagacaau

SEQ ID NO: 1714926 - RNA, 22 nt, Homo sapiens
aacucacaagugcucaucuguu

SEQ ID NO: 1714927 - RNA, 17 nt, Homo sapiens
aacucagaucugucuga

SEQ ID NO: 1714928 - RNA, 12 nt, Homo sapiens
aacucagggaca

SEQ ID NO: 1714929 - RNA, 14 nt, Homo sapiens
aacucccucuggga

SEQ ID NO: 1714930 - RNA, 11 nt, Homo sapiens
aacuccugacu

SEQ ID NO: 1714931 - RNA, 12 nt, Homo sapiens
aacucucuccac

SEQ ID NO: 1714932 - RNA, 14 nt, Homo sapiens
aacucuugaccuca

SEQ ID NO: 1714933 - RNA, 16 nt, Homo sapiens
aacucuugaccucagg

SEQ ID NO: 1714934 - RNA, 14 nt, Homo sapiens
aacugacacaggaa

SEQ ID NO: 1714935 - RNA, 20 nt, Homo sapiens
aacugaguguuauuugcaca

SEQ ID NO: 1714936 - RNA, 19 nt, Homo sapiens
aacugcaauaacuucugac

SEQ ID NO: 1714937 - RNA, 17 nt, Homo sapiens
aacugcguggugcucuu

SEQ ID NO: 1714938 - RNA, 18 nt, Homo sapiens
aacuggaauuaaaaggau

SEQ ID NO: 1714939 - RNA, 21 nt, Homo sapiens
aacuguaacguuuucuuucac

SEQ ID NO: 1714940 - RNA, 16 nt, Homo sapiens
aacuguauauauuccc

SEQ ID NO: 1714941 - RNA, 12 nt, Homo sapiens
aacugugacugu

SEQ ID NO: 1714942 - RNA, 13 nt, Homo sapiens
aacugugccuugu

SEQ ID NO: 1714943 - RNA, 12 nt, Homo sapiens
aacugugcugaa

SEQ ID NO: 1714944 - RNA, 20 nt, Homo sapiens
aacugugcugaaugcuuuag

SEQ ID NO: 1714945 - RNA, 18 nt, Homo sapiens
aacuguguuguauuaaca

SEQ ID NO: 1714946 - RNA, 23 nt, Homo sapiens
aacuguuuuguaagugcugcuau

SEQ ID NO: 1714947 - RNA, 16 nt, Homo sapiens
aacuuaaacauauucu

SEQ ID NO: 1714948 - RNA, 16 nt, Homo sapiens
aacuuacuauucauua

SEQ ID NO: 1714949 - RNA, 23 nt, Homo sapiens
aacuuaggcccuagcggcagaaa

SEQ ID NO: 1714950 - RNA, 14 nt, Homo sapiens
aacuuagugacaaa

SEQ ID NO: 1714951 - RNA, 12 nt, Homo sapiens
aacuucauucuc

SEQ ID NO: 1714952 - RNA, 23 nt, Homo sapiens
aacuuccacauuauacauuugau

SEQ ID NO: 1714953 - RNA, 19 nt, Homo sapiens
aacuucucuugcuuucuau

SEQ ID NO: 1714954 - RNA, 19 nt, Homo sapiens
aacuucuugucagacauaa

SEQ ID NO: 1714955 - RNA, 14 nt, Homo sapiens
aacuugacccccuu

SEQ ID NO: 1714956 - RNA, 16 nt, Homo sapiens
aacuugagggcccaga

SEQ ID NO: 1714957 - RNA, 20 nt, Homo sapiens
aacuuuggaguccccucacc

SEQ ID NO: 1714958 - RNA, 17 nt, Homo sapiens
aacuuuucgacauauuu

SEQ ID NO: 1714959 - RNA, 19 nt, Homo sapiens
aacuuuuuuaaauaaacuu

SEQ ID NO: 1714960 - RNA, 12 nt, Homo sapiens
aagaaaaaccac

SEQ ID NO: 1714961 - RNA, 13 nt, Homo sapiens
aagaaaaaccacu

SEQ ID NO: 1714962 - RNA, 14 nt, Homo sapiens
aagaaaacaacuuc

SEQ ID NO: 1714963 - RNA, 22 nt, Homo sapiens
aagaaaaucaaagcugaggaca

SEQ ID NO: 1714964 - RNA, 22 nt, Homo sapiens
aagaaagcaaugccaaucuuca

SEQ ID NO: 1714965 - RNA, 22 nt, Homo sapiens
aagaaccagagaggcucugaga

SEQ ID NO: 1714966 - RNA, 16 nt, Homo sapiens
aagaagccacccuccu

SEQ ID NO: 1714967 - RNA, 23 nt, Homo sapiens
aagaagccacccuccuugcagga

SEQ ID NO: 1714968 - RNA, 16 nt, Homo sapiens
aagaagcuuuaauauu

SEQ ID NO: 1714969 - RNA, 12 nt, Homo sapiens
aagaauaauuca

SEQ ID NO: 1714970 - RNA, 11 nt, Homo sapiens
acucaauggag

SEQ ID NO: 1714971 - RNA, 17 nt, Homo sapiens
acucaauggaguauguc

SEQ ID NO: 1714972 - RNA, 17 nt, Homo sapiens
acucaauggccuaaaac

SEQ ID NO: 1714973 - RNA, 21 nt, Homo sapiens
acucaccagccccacugccag

SEQ ID NO: 1714974 - RNA, 15 nt, Homo sapiens
acucacucaguuuau

SEQ ID NO: 1714975 - RNA, 16 nt, Homo sapiens
acucagaagacacuga

SEQ ID NO: 1714976 - RNA, 17 nt, Homo sapiens
acucagagaaacaaugg

SEQ ID NO: 1714977 - RNA, 18 nt, Homo sapiens
acucagaggcagugacag

SEQ ID NO: 1714978 - RNA, 14 nt, Homo sapiens
acucaggcauuuga

SEQ ID NO: 1714979 - RNA, 13 nt, Homo sapiens
acucagugcaaac

SEQ ID NO: 1714980 - RNA, 13 nt, Homo sapiens
acucauaacucau

SEQ ID NO: 1714981 - RNA, 20 nt, Homo sapiens
acuccagauuuuuuacagcu

SEQ ID NO: 1714982 - RNA, 15 nt, Homo sapiens
acuccagccugggca

SEQ ID NO: 1714983 - RNA, 14 nt, Homo sapiens
acucccucugggaa

SEQ ID NO: 1714984 - RNA, 18 nt, Homo sapiens
acuccuaagacuuaugua

SEQ ID NO: 1714985 - RNA, 22 nt, Homo sapiens
acuccuugcaggugacauuugc

SEQ ID NO: 1714986 - RNA, 17 nt, Homo sapiens
acucgagucacacucaa

SEQ ID NO: 1714987 - RNA, 21 nt, Homo sapiens
acucgcuucccccauagccac

SEQ ID NO: 1714988 - RNA, 14 nt, Homo sapiens
acucggauuccagc

SEQ ID NO: 1714989 - RNA, 13 nt, Homo sapiens
acucgugugcaac

SEQ ID NO: 1714990 - RNA, 13 nt, Homo sapiens
acucuacccuaua

SEQ ID NO: 1714991 - RNA, 15 nt, Homo sapiens
acucuaggguccagu

SEQ ID NO: 1714992 - RNA, 19 nt, Homo sapiens
acucucuucccuuucccca

SEQ ID NO: 1714993 - RNA, 17 nt, Homo sapiens
acucugagaucuaagga

SEQ ID NO: 1714994 - RNA, 14 nt, Homo sapiens
acucugcacauguc

SEQ ID NO: 1714995 - RNA, 20 nt, Homo sapiens
acucugcacaugucuuguac

SEQ ID NO: 1714996 - RNA, 18 nt, Homo sapiens
acucuguaaaaacacuga

SEQ ID NO: 1714997 - RNA, 12 nt, Homo sapiens
acucugugucag

SEQ ID NO: 1714998 - RNA, 20 nt, Homo sapiens
acucuuagcuaaaucccucc

SEQ ID NO: 1714999 - RNA, 18 nt, Homo sapiens
acucuucgaagccuugcc

SEQ ID NO: 1715000 - RNA, 19 nt, Homo sapiens
acucuugaauagacuucca

SEQ ID NO: 1715001 - RNA, 23 nt, Homo sapiens
acucuuguggucaucauggccag

SEQ ID NO: 1715002 - RNA, 14 nt, Homo sapiens
acugaaacuucccu

SEQ ID NO: 1715003 - RNA, 15 nt, Homo sapiens
acugaaagacaccau

SEQ ID NO: 1715004 - RNA, 15 nt, Homo sapiens
acugaacucacuuuc

SEQ ID NO: 1715005 - RNA, 21 nt, Homo sapiens
acugaagccugcguuggucca

SEQ ID NO: 1715006 - RNA, 16 nt, Homo sapiens
acugacaaccucaucc

SEQ ID NO: 1715007 - RNA, 20 nt, Homo sapiens
acugaccauauugugcuuca

SEQ ID NO: 1715008 - RNA, 12 nt, Homo sapiens
acugacuugagg

SEQ ID NO: 1715009 - RNA, 17 nt, Homo sapiens
acugagggacucugaag

SEQ ID NO: 1715010 - RNA, 13 nt, Homo sapiens
acugauacugcag

SEQ ID NO: 1715011 - RNA, 15 nt, Homo sapiens
acugaugcuguucuc

SEQ ID NO: 1715012 - RNA, 14 nt, Homo sapiens
acugauguacaauu

SEQ ID NO: 1715013 - RNA, 17 nt, Homo sapiens
acugauuuuuagcuuua

SEQ ID NO: 1715014 - RNA, 20 nt, Homo sapiens
acugcacuauagccuaggug

SEQ ID NO: 1715015 - RNA, 21 nt, Homo sapiens
acugcacuauagccuagguga

SEQ ID NO: 1715016 - RNA, 15 nt, Homo sapiens
acugcagcuuuacau

SEQ ID NO: 1715017 - RNA, 20 nt, Homo sapiens
acugcagggacugccagucc

SEQ ID NO: 1715018 - RNA, 16 nt, Homo sapiens
acugccacacucucca

SEQ ID NO: 1715019 - RNA, 19 nt, Homo sapiens
acugccucgaaacacagaa

SEQ ID NO: 1715020 - RNA, 13 nt, Homo sapiens
acugccucuggaa

SEQ ID NO: 1715021 - RNA, 16 nt, Homo sapiens
acugcuuaagugccua

SEQ ID NO: 1715022 - RNA, 15 nt, Homo sapiens
acugcuuuuggucug

SEQ ID NO: 1715023 - RNA, 14 nt, Homo sapiens
acuggaacggugaa

SEQ ID NO: 1715024 - RNA, 17 nt, Homo sapiens
acuggaacggugaaggu

SEQ ID NO: 1715025 - RNA, 13 nt, Homo sapiens
acuggaccuggug

SEQ ID NO: 1715026 - RNA, 14 nt, Homo sapiens
acuggcccaagugg

SEQ ID NO: 1715027 - RNA, 18 nt, Homo sapiens
acuggcuccaacacugca

SEQ ID NO: 1715028 - RNA, 17 nt, Homo sapiens
acuggcuucucuugagu

SEQ ID NO: 1715029 - RNA, 22 nt, Homo sapiens
acugggaugagccgcugugagc

SEQ ID NO: 1715030 - RNA, 19 nt, Homo sapiens
acugggcaaugauggcaau

SEQ ID NO: 1715031 - RNA, 20 nt, Homo sapiens
acugggccuuagugggccag

SEQ ID NO: 1715032 - RNA, 18 nt, Homo sapiens
acuggggagucuuugugg

SEQ ID NO: 1715033 - RNA, 13 nt, Homo sapiens
acuggugugcucu

SEQ ID NO: 1715034 - RNA, 12 nt, Homo sapiens
acuguacauuua

SEQ ID NO: 1715035 - RNA, 17 nt, Homo sapiens
acuguacugacuugagg

SEQ ID NO: 1715036 - RNA, 12 nt, Homo sapiens
acuguagaugau

SEQ ID NO: 1715037 - RNA, 22 nt, Homo sapiens
acuguauguuuacuucucacca

SEQ ID NO: 1715038 - RNA, 22 nt, Homo sapiens
acuguccagagagcaacucuga

SEQ ID NO: 1715039 - RNA, 24 nt, Homo sapiens
acuguccagagagcaacucugaga

SEQ ID NO: 1715040 - RNA, 14 nt, Homo sapiens
acuguccuacccac

SEQ ID NO: 1715041 - RNA, 13 nt, Homo sapiens
acugugaaacugg

SEQ ID NO: 1715042 - RNA, 12 nt, Homo sapiens
acugugcuacug

SEQ ID NO: 1715043 - RNA, 13 nt, Homo sapiens
acugugcuacugu

SEQ ID NO: 1715044 - RNA, 17 nt, Homo sapiens
acuguggcacuugccug

SEQ ID NO: 1715045 - RNA, 18 nt, Homo sapiens
acuguguuuaucuugaua

SEQ ID NO: 1715046 - RNA, 21 nt, Homo sapiens
acuguuuuauaaacugcugua

SEQ ID NO: 1715047 - RNA, 19 nt, Homo sapiens
acuguuuuggguagcugcc

SEQ ID NO: 1715048 - RNA, 23 nt, Homo sapiens
acuuagaucaucagucaccgaag

SEQ ID NO: 1715049 - RNA, 13 nt, Homo sapiens
acuuagcaaaaag

SEQ ID NO: 1715050 - RNA, 20 nt, Homo sapiens
acuuaugggcccagccagcc

SEQ ID NO: 1715051 - RNA, 17 nt, Homo sapiens
acuucauucacauucag

SEQ ID NO: 1715052 - RNA, 18 nt, Homo sapiens
acuucauucacauucaga

SEQ ID NO: 1715053 - RNA, 13 nt, Homo sapiens
acuuccauuugcu

SEQ ID NO: 1715054 - RNA, 18 nt, Homo sapiens
acuuccuacguauccugc

SEQ ID NO: 1715055 - RNA, 16 nt, Homo sapiens
acuucgggcuguguaa

SEQ ID NO: 1715056 - RNA, 21 nt, Homo sapiens
acuucucccgugagccaggca

SEQ ID NO: 1715057 - RNA, 19 nt, Homo sapiens
acuucucucagacuuacuu

SEQ ID NO: 1715058 - RNA, 14 nt, Homo sapiens
acuucuguuuccau

SEQ ID NO: 1715059 - RNA, 13 nt, Homo sapiens
acuucuuccuuuc

SEQ ID NO: 1715060 - RNA, 11 nt, Homo sapiens
acuucuugucu

SEQ ID NO: 1715061 - RNA, 16 nt, Homo sapiens
acuugaaauucuuuca

SEQ ID NO: 1715062 - RNA, 14 nt, Homo sapiens
acuugaaccuaaua

SEQ ID NO: 1715063 - RNA, 18 nt, Homo sapiens
acuugaugauacaaugaa

SEQ ID NO: 1715064 - RNA, 18 nt, Homo sapiens
acuugucacugacacaaa

SEQ ID NO: 1715065 - RNA, 19 nt, Homo sapiens
acuugucacugacacaaag

SEQ ID NO: 1715066 - RNA, 17 nt, Homo sapiens
acuuguuugucuuccau

SEQ ID NO: 1715067 - RNA, 11 nt, Homo sapiens
acuuuagucuc

SEQ ID NO: 1715068 - RNA, 18 nt, Homo sapiens
acuuucaguaaacauaaa

SEQ ID NO: 1715069 - RNA, 15 nt, Homo sapiens
acuuuccaggcuagu

SEQ ID NO: 1715070 - RNA, 19 nt, Homo sapiens
acuuucucuucauacuuuu

SEQ ID NO: 1715071 - RNA, 21 nt, Homo sapiens
acuuucuguuggauuccaugc

SEQ ID NO: 1715072 - RNA, 18 nt, Homo sapiens
acuuucuuaucacuuaua

SEQ ID NO: 1715073 - RNA, 18 nt, Homo sapiens
acuuugaacaagguuuca

SEQ ID NO: 1715074 - RNA, 12 nt, Homo sapiens
acuuugaacuaa

SEQ ID NO: 1715075 - RNA, 20 nt, Homo sapiens
acuuugacgagucaccuucc

SEQ ID NO: 1715076 - RNA, 18 nt, Homo sapiens
acuuugaguuagugccau

SEQ ID NO: 1715077 - RNA, 22 nt, Homo sapiens
acuuuggaauguacucuguuca

SEQ ID NO: 1715078 - RNA, 14 nt, Homo sapiens
acuuuguguucacc

SEQ ID NO: 1715079 - RNA, 18 nt, Homo sapiens
acuuuuuacagugcuauu

SEQ ID NO: 1715080 - RNA, 17 nt, Homo sapiens
agaaaaauaaaucuguu

SEQ ID NO: 1715081 - RNA, 13 nt, Homo sapiens
agaaaaccagcuu

SEQ ID NO: 1715082 - RNA, 15 nt, Homo sapiens
agaaaagccucucca

SEQ ID NO: 1715083 - RNA, 14 nt, Homo sapiens
agaaacacugccuu

SEQ ID NO: 1715084 - RNA, 20 nt, Homo sapiens
agaaacagauaccauacuca

SEQ ID NO: 1715085 - RNA, 12 nt, Homo sapiens
agaaacaugaca

SEQ ID NO: 1715086 - RNA, 18 nt, Homo sapiens
agaaacaugacacugacc

SEQ ID NO: 1715087 - RNA, 20 nt, Homo sapiens
agaaacaugacacugaccuu

SEQ ID NO: 1715088 - RNA, 14 nt, Homo sapiens
agaaacgucuucua

SEQ ID NO: 1715089 - RNA, 19 nt, Homo sapiens
agaaacucaaaaauauuug

SEQ ID NO: 1715090 - RNA, 17 nt, Homo sapiens
agaaacuugcugaucca

SEQ ID NO: 1715091 - RNA, 17 nt, Homo sapiens
agaaagaaguccuuucu

SEQ ID NO: 1715092 - RNA, 21 nt, Homo sapiens
agaaagcauccuaaauauauc

SEQ ID NO: 1715093 - RNA, 15 nt, Homo sapiens
agaaaggucagccuu

SEQ ID NO: 1715094 - RNA, 16 nt, Homo sapiens
agaaaguuaaccccau

SEQ ID NO: 1715095 - RNA, 14 nt, Homo sapiens
agaaauaauaugca

SEQ ID NO: 1715096 - RNA, 20 nt, Homo sapiens
agaaauaauaugcauuguca

SEQ ID NO: 1715097 - RNA, 17 nt, Homo sapiens
agaaauccugcaaugaa

SEQ ID NO: 1715098 - RNA, 15 nt, Homo sapiens
agaaauuauaaacaa

SEQ ID NO: 1715099 - RNA, 15 nt, Homo sapiens
agaaauugcaauaac

SEQ ID NO: 1715100 - RNA, 22 nt, Homo sapiens
agaaauugcauuuccugacaga

SEQ ID NO: 1715101 - RNA, 21 nt, Homo sapiens
agaaauuucugugaaaccugu

SEQ ID NO: 1715102 - RNA, 14 nt, Homo sapiens
agaacacuaacuca

SEQ ID NO: 1715103 - RNA, 13 nt, Homo sapiens
agaacagggucau

SEQ ID NO: 1715104 - RNA, 22 nt, Homo sapiens
agaacaucauuagaacaaagga

SEQ ID NO: 1715105 - RNA, 20 nt, Homo sapiens
agaaccaaaaguuuuccuga

SEQ ID NO: 1715106 - RNA, 23 nt, Homo sapiens
agaaccaggcagcccugccaugu

SEQ ID NO: 1715107 - RNA, 23 nt, Homo sapiens
agaaccauccauaguaguaugau

SEQ ID NO: 1715108 - RNA, 19 nt, Homo sapiens
agaacccagggcucugccc

SEQ ID NO: 1715109 - RNA, 18 nt, Homo sapiens
agaacccuuggagccaau

SEQ ID NO: 1715110 - RNA, 14 nt, Homo sapiens
agaaccgagcaaag

SEQ ID NO: 1715111 - RNA, 18 nt, Homo sapiens
agaaccgagcaaagauca

SEQ ID NO: 1715112 - RNA, 13 nt, Homo sapiens
agaaccucuuccc

SEQ ID NO: 1715113 - RNA, 13 nt, Homo sapiens
agaaccuggaaaa

SEQ ID NO: 1715114 - RNA, 17 nt, Homo sapiens
agaacuauaugugaauc

SEQ ID NO: 1715115 - RNA, 14 nt, Homo sapiens
agaacuugaaugug

SEQ ID NO: 1715116 - RNA, 14 nt, Homo sapiens
agaacuugaccccc

SEQ ID NO: 1715117 - RNA, 21 nt, Homo sapiens
agaagaccguuuaccuagaag

SEQ ID NO: 1715118 - RNA, 22 nt, Homo sapiens
agaagcuugcugguagcacuug

SEQ ID NO: 1715119 - RNA, 22 nt, Homo sapiens
agaaggcagugauuagcacuug

SEQ ID NO: 1715120 - RNA, 16 nt, Homo sapiens
agaagggauaacccua

SEQ ID NO: 1715121 - RNA, 17 nt, Homo sapiens
agaagggauaacccuac

SEQ ID NO: 1715122 - RNA, 21 nt, Homo sapiens
agaaggugccacuuuacccac

SEQ ID NO: 1715123 - RNA, 14 nt, Homo sapiens
agaaguacuccuau

SEQ ID NO: 1715124 - RNA, 19 nt, Homo sapiens
agaagucauauguugucuu

SEQ ID NO: 1715125 - RNA, 15 nt, Homo sapiens
agaauaaauucccaa

SEQ ID NO: 1715126 - RNA, 15 nt, Homo sapiens
agaauaggcugugua

SEQ ID NO: 1715127 - RNA, 23 nt, Homo sapiens
agaauauugucccuuugagcaga

SEQ ID NO: 1715128 - RNA, 21 nt, Homo sapiens
agaauccagcuacgaauauag

SEQ ID NO: 1715129 - RNA, 22 nt, Homo sapiens
agaaugcugcaggacuugagaa

SEQ ID NO: 1715130 - RNA, 20 nt, Homo sapiens
agaauggagaggaacacagg

SEQ ID NO: 1715131 - RNA, 14 nt, Homo sapiens
agaauggagcagua

SEQ ID NO: 1715132 - RNA, 17 nt, Homo sapiens
agugcuuaguguacuug

SEQ ID NO: 1715133 - RNA, 23 nt, Homo sapiens
aguggcaaccuugucucuaugcc

SEQ ID NO: 1715134 - RNA, 13 nt, Homo sapiens
aguggccacucag

SEQ ID NO: 1715135 - RNA, 14 nt, Homo sapiens
aguggccuggccag

SEQ ID NO: 1715136 - RNA, 17 nt, Homo sapiens
aguggcuucaucuguca

SEQ ID NO: 1715137 - RNA, 14 nt, Homo sapiens
agugggacccauag

SEQ ID NO: 1715138 - RNA, 12 nt, Homo sapiens
aguggugcaauc

SEQ ID NO: 1715139 - RNA, 15 nt, Homo sapiens
agugguuugaucauu

SEQ ID NO: 1715140 - RNA, 14 nt, Homo sapiens
agugguuugugcua

SEQ ID NO: 1715141 - RNA, 15 nt, Homo sapiens
aguguaaguucacaa

SEQ ID NO: 1715142 - RNA, 19 nt, Homo sapiens
aguguccccuccacuguca

SEQ ID NO: 1715143 - RNA, 20 nt, Homo sapiens
aguguccccuccacugucac

SEQ ID NO: 1715144 - RNA, 16 nt, Homo sapiens
agugugaacaaaagau

SEQ ID NO: 1715145 - RNA, 21 nt, Homo sapiens
agugugaacaaaagaugcucu

SEQ ID NO: 1715146 - RNA, 20 nt, Homo sapiens
agugugcaugauuguauaug

SEQ ID NO: 1715147 - RNA, 12 nt, Homo sapiens
aguguggaacca

SEQ ID NO: 1715148 - RNA, 22 nt, Homo sapiens
aguguggcccagggaagccaaa

SEQ ID NO: 1715149 - RNA, 23 nt, Homo sapiens
aguguggcccagggaagccaaaa

SEQ ID NO: 1715150 - RNA, 15 nt, Homo sapiens
agugugugacauucc

SEQ ID NO: 1715151 - RNA, 23 nt, Homo sapiens
aguguuauuugcacacugcacug

SEQ ID NO: 1715152 - RNA, 19 nt, Homo sapiens
aguguuccccaucuggguc

SEQ ID NO: 1715153 - RNA, 16 nt, Homo sapiens
aguguugagaugggga

SEQ ID NO: 1715154 - RNA, 23 nt, Homo sapiens
aguguugcccaggcuggucucaa

SEQ ID NO: 1715155 - RNA, 22 nt, Homo sapiens
aguguuuacaaggugacaaaug

SEQ ID NO: 1715156 - RNA, 20 nt, Homo sapiens
aguguuuuuuagauacagag

SEQ ID NO: 1715157 - RNA, 20 nt, Homo sapiens
aguuaaccccauguccucag

SEQ ID NO: 1715158 - RNA, 12 nt, Homo sapiens
aguuaaggguua

SEQ ID NO: 1715159 - RNA, 15 nt, Homo sapiens
aguuagguagcuuua

SEQ ID NO: 1715160 - RNA, 13 nt, Homo sapiens
aguuagugccaua

SEQ ID NO: 1715161 - RNA, 16 nt, Homo sapiens
aguuauguucagucac

SEQ ID NO: 1715162 - RNA, 20 nt, Homo sapiens
aguucaaucucccgcugcug

SEQ ID NO: 1715163 - RNA, 17 nt, Homo sapiens
aguucaccugcacuuaa

SEQ ID NO: 1715164 - RNA, 22 nt, Homo sapiens
aguucacuuuuuacagugcuau

SEQ ID NO: 1715165 - RNA, 19 nt, Homo sapiens
aguucauacccuguuacca

SEQ ID NO: 1715166 - RNA, 13 nt, Homo sapiens
aguucauaccuaa

SEQ ID NO: 1715167 - RNA, 21 nt, Homo sapiens
aguucauaccuaaguacugua

SEQ ID NO: 1715168 - RNA, 13 nt, Homo sapiens
aguucuaggcacu

SEQ ID NO: 1715169 - RNA, 16 nt, Homo sapiens
aguucuuagcccucua

SEQ ID NO: 1715170 - RNA, 15 nt, Homo sapiens
aguucuugugccaua

SEQ ID NO: 1715171 - RNA, 19 nt, Homo sapiens
aguugcguggacucugcac

SEQ ID NO: 1715172 - RNA, 18 nt, Homo sapiens
aguuggaauucaccaaga

SEQ ID NO: 1715173 - RNA, 17 nt, Homo sapiens
aguugucuuuccuggca

SEQ ID NO: 1715174 - RNA, 14 nt, Homo sapiens
aguuuacccaugaa

SEQ ID NO: 1715175 - RNA, 20 nt, Homo sapiens
aguuuauaaaugugaacuua

SEQ ID NO: 1715176 - RNA, 13 nt, Homo sapiens
aguuuaucuuuca

SEQ ID NO: 1715177 - RNA, 22 nt, Homo sapiens
aguuucaaugugauucuaaugu

SEQ ID NO: 1715178 - RNA, 12 nt, Homo sapiens
aguuucccugaa

SEQ ID NO: 1715179 - RNA, 14 nt, Homo sapiens
aguuucccuuccuc

SEQ ID NO: 1715180 - RNA, 15 nt, Homo sapiens
aguuucuuagcuuuu

SEQ ID NO: 1715181 - RNA, 23 nt, Homo sapiens
aguuugaacucuguaaaaccuca

SEQ ID NO: 1715182 - RNA, 18 nt, Homo sapiens
aguuugaccucacaguga

SEQ ID NO: 1715183 - RNA, 13 nt, Homo sapiens
aguuugagaccag

SEQ ID NO: 1715184 - RNA, 17 nt, Homo sapiens
aguuugauaccugcacu

SEQ ID NO: 1715185 - RNA, 19 nt, Homo sapiens
aguuugguccuggggacca

SEQ ID NO: 1715186 - RNA, 17 nt, Homo sapiens
aguuuguagguaaaaug

SEQ ID NO: 1715187 - RNA, 18 nt, Homo sapiens
aguuuguuuuuaaacuaa

SEQ ID NO: 1715188 - RNA, 20 nt, Homo sapiens
aguuuuaaacaaaugugaua

SEQ ID NO: 1715189 - RNA, 16 nt, Homo sapiens
aguuuuggacuggaua

SEQ ID NO: 1715190 - RNA, 10 nt, Homo sapiens
aguuuuuacu

SEQ ID NO: 1715191 - RNA, 15 nt, Homo sapiens
auaaaaacauuucuu

SEQ ID NO: 1715192 - RNA, 14 nt, Homo sapiens
auaaaaacugcuua

SEQ ID NO: 1715193 - RNA, 20 nt, Homo sapiens
auaaaaagugacacagcagc

SEQ ID NO: 1715194 - RNA, 18 nt, Homo sapiens
auaaaaauugacaaugau

SEQ ID NO: 1715195 - RNA, 12 nt, Homo sapiens
accugcaggcug

SEQ ID NO: 1715196 - RNA, 17 nt, Homo sapiens
accugcccaaggaugcu

SEQ ID NO: 1715197 - RNA, 22 nt, Homo sapiens
accugccccccacucugcacag

SEQ ID NO: 1715198 - RNA, 20 nt, Homo sapiens
accugccugcaucugugaaa

SEQ ID NO: 1715199 - RNA, 14 nt, Homo sapiens
accugcgcucucag

SEQ ID NO: 1715200 - RNA, 19 nt, Homo sapiens
accuggaggacagcuggac

SEQ ID NO: 1715201 - RNA, 22 nt, Homo sapiens
accuggaugaucacuaauacua

SEQ ID NO: 1715202 - RNA, 20 nt, Homo sapiens
accuggccagagccaagaaa

SEQ ID NO: 1715203 - RNA, 17 nt, Homo sapiens
accuggggcacagucca

SEQ ID NO: 1715204 - RNA, 23 nt, Homo sapiens
accugguacaaaugcacgucaca

SEQ ID NO: 1715205 - RNA, 19 nt, Homo sapiens
accugguacccuccuggcu

SEQ ID NO: 1715206 - RNA, 16 nt, Homo sapiens
accuguaaagugccuu

SEQ ID NO: 1715207 - RNA, 18 nt, Homo sapiens
accuguaaagugccuuac

SEQ ID NO: 1715208 - RNA, 20 nt, Homo sapiens
accuguugagacugauucag

SEQ ID NO: 1715209 - RNA, 16 nt, Homo sapiens
accuucccaugcccug

SEQ ID NO: 1715210 - RNA, 22 nt, Homo sapiens
accuugacuugauuagugccuu

SEQ ID NO: 1715211 - RNA, 15 nt, Homo sapiens
accuugugucuguac

SEQ ID NO: 1715212 - RNA, 17 nt, Homo sapiens
accuuuggagcaaagcu

SEQ ID NO: 1715213 - RNA, 22 nt, Homo sapiens
accuuuugaggagccccagcua

SEQ ID NO: 1715214 - RNA, 14 nt, Homo sapiens
acgaaaacagucaa

SEQ ID NO: 1715215 - RNA, 15 nt, Homo sapiens
acgaaacacaaacca

SEQ ID NO: 1715216 - RNA, 14 nt, Homo sapiens
acgccgagaaggcc

SEQ ID NO: 1715217 - RNA, 19 nt, Homo sapiens
acgccgcucuucacugugg

SEQ ID NO: 1715218 - RNA, 18 nt, Homo sapiens
acgcgcguacagaucucu

SEQ ID NO: 1715219 - RNA, 21 nt, Homo sapiens
acgcuuugucacacaaaaagu

SEQ ID NO: 1715220 - RNA, 20 nt, Homo sapiens
acggagucuugcucugucac

SEQ ID NO: 1715221 - RNA, 18 nt, Homo sapiens
acggcaacugaagcggcu

SEQ ID NO: 1715222 - RNA, 17 nt, Homo sapiens
acggcuaagaggcugcu

SEQ ID NO: 1715223 - RNA, 14 nt, Homo sapiens
acgguuaacuguaa

SEQ ID NO: 1715224 - RNA, 14 nt, Homo sapiens
acgucaccaagaaa

SEQ ID NO: 1715225 - RNA, 13 nt, Homo sapiens
acgugggcauuuu

SEQ ID NO: 1715226 - RNA, 19 nt, Homo sapiens
acgugucuuccacuuugca

SEQ ID NO: 1715227 - RNA, 22 nt, Homo sapiens
acgugucuuccacuuugcauau

SEQ ID NO: 1715228 - RNA, 20 nt, Homo sapiens
acgugugugcacguacacac

SEQ ID NO: 1715229 - RNA, 13 nt, Homo sapiens
acuaaaugaacau

SEQ ID NO: 1715230 - RNA, 17 nt, Homo sapiens
acuaaauuugauacuua

SEQ ID NO: 1715231 - RNA, 20 nt, Homo sapiens
acuaaccccaacgcacagga

SEQ ID NO: 1715232 - RNA, 18 nt, Homo sapiens
acuaaccuggguucccuu

SEQ ID NO: 1715233 - RNA, 19 nt, Homo sapiens
acuaagcauagcaaacaga

SEQ ID NO: 1715234 - RNA, 17 nt, Homo sapiens
acuaaggugugcucuga

SEQ ID NO: 1715235 - RNA, 13 nt, Homo sapiens
acuacacugagga

SEQ ID NO: 1715236 - RNA, 17 nt, Homo sapiens
acuacaugcaaggcacu

SEQ ID NO: 1715237 - RNA, 20 nt, Homo sapiens
acuacaugcaaggcacugua

SEQ ID NO: 1715238 - RNA, 17 nt, Homo sapiens
acuacauugaguagaca

SEQ ID NO: 1715239 - RNA, 20 nt, Homo sapiens
acuaccuaacauuauuuauu

SEQ ID NO: 1715240 - RNA, 15 nt, Homo sapiens
acuacgcuugcucau

SEQ ID NO: 1715241 - RNA, 22 nt, Homo sapiens
acuacuccgugaaggcuucucu

SEQ ID NO: 1715242 - RNA, 18 nt, Homo sapiens
acuacugagaauagcaug

SEQ ID NO: 1715243 - RNA, 16 nt, Homo sapiens
acuagaagggccaguc

SEQ ID NO: 1715244 - RNA, 22 nt, Homo sapiens
acuagccaggaaguacuuccac

SEQ ID NO: 1715245 - RNA, 15 nt, Homo sapiens
acuagggaagcucag

SEQ ID NO: 1715246 - RNA, 19 nt, Homo sapiens
acuagucacauucuuguuu

SEQ ID NO: 1715247 - RNA, 18 nt, Homo sapiens
acuaguggcucucaguua

SEQ ID NO: 1715248 - RNA, 16 nt, Homo sapiens
acuauaaauauguaca

SEQ ID NO: 1715249 - RNA, 21 nt, Homo sapiens
acuauaaugaaaacauccuug

SEQ ID NO: 1715250 - RNA, 16 nt, Homo sapiens
acuauugaaaucaagc

SEQ ID NO: 1715251 - RNA, 21 nt, Homo sapiens
acuauuuaaagccuccucauc

SEQ ID NO: 1715252 - RNA, 18 nt, Homo sapiens
acuauuuagauauaacac

SEQ ID NO: 1715253 - RNA, 22 nt, Homo sapiens
acuauuuagauauaacacuaug

SEQ ID NO: 1715254 - RNA, 22 nt, Homo sapiens
acuauuucugggucuuuugcua

SEQ ID NO: 1715255 - RNA, 15 nt, Homo sapiens
acuauuuugugcucc

SEQ ID NO: 1715256 - RNA, 14 nt, Homo sapiens
acuauuuuuccaaa

SEQ ID NO: 1715257 - RNA, 18 nt, Homo sapiens
aucacugaacaaacuaaa

SEQ ID NO: 1715258 - RNA, 19 nt, Homo sapiens
aucacugaacuacuaaagu

SEQ ID NO: 1715259 - RNA, 19 nt, Homo sapiens
aucacugcauuauucucuu

SEQ ID NO: 1715260 - RNA, 15 nt, Homo sapiens
aucacuucauucaca

SEQ ID NO: 1715261 - RNA, 13 nt, Homo sapiens
aucagaugaacuc

SEQ ID NO: 1715262 - RNA, 18 nt, Homo sapiens
aucagcuucagaauggca

SEQ ID NO: 1715263 - RNA, 17 nt, Homo sapiens
aucagggggaagaagca

SEQ ID NO: 1715264 - RNA, 15 nt, Homo sapiens
aucagucaacaacuu

SEQ ID NO: 1715265 - RNA, 16 nt, Homo sapiens
aucaguguaccauuug

SEQ ID NO: 1715266 - RNA, 18 nt, Homo sapiens
aucaguguuuuaaauucu

SEQ ID NO: 1715267 - RNA, 19 nt, Homo sapiens
aucaguucuuuugucuuag

SEQ ID NO: 1715268 - RNA, 14 nt, Homo sapiens
aucauaaaaucaaa

SEQ ID NO: 1715269 - RNA, 12 nt, Homo sapiens
aucauacuucca

SEQ ID NO: 1715270 - RNA, 21 nt, Homo sapiens
aucaucaacaagauuuccuug

SEQ ID NO: 1715271 - RNA, 22 nt, Homo sapiens
aucaucuauaaagaagaacuug

SEQ ID NO: 1715272 - RNA, 16 nt, Homo sapiens
aucauggcaacauaau

SEQ ID NO: 1715273 - RNA, 20 nt, Homo sapiens
aucauuggaacaacugauac

SEQ ID NO: 1715274 - RNA, 17 nt, Homo sapiens
auccaaucucaaggaau

SEQ ID NO: 1715275 - RNA, 18 nt, Homo sapiens
auccaccaagaacauaag

SEQ ID NO: 1715276 - RNA, 15 nt, Homo sapiens
auccaccaccucccu

SEQ ID NO: 1715277 - RNA, 15 nt, Homo sapiens
auccaccacugcuua

SEQ ID NO: 1715278 - RNA, 15 nt, Homo sapiens
auccacccaccucag

SEQ ID NO: 1715279 - RNA, 16 nt, Homo sapiens
auccacccaccucagc

SEQ ID NO: 1715280 - RNA, 23 nt, Homo sapiens
auccaccgccacugggccuguca

SEQ ID NO: 1715281 - RNA, 12 nt, Homo sapiens
auccaccugccu

SEQ ID NO: 1715282 - RNA, 21 nt, Homo sapiens
auccacugggcacaacugcaa

SEQ ID NO: 1715283 - RNA, 13 nt, Homo sapiens
auccacugugcca

SEQ ID NO: 1715284 - RNA, 16 nt, Homo sapiens
auccacuuacauauau

SEQ ID NO: 1715285 - RNA, 21 nt, Homo sapiens
auccagaggacccaacugaac

SEQ ID NO: 1715286 - RNA, 20 nt, Homo sapiens
auccagcaauuccugagcca

SEQ ID NO: 1715287 - RNA, 16 nt, Homo sapiens
auccaggcuuuguaca

SEQ ID NO: 1715288 - RNA, 18 nt, Homo sapiens
auccauugaacuaaaaua

SEQ ID NO: 1715289 - RNA, 19 nt, Homo sapiens
aucccaaccagugccaagg

SEQ ID NO: 1715290 - RNA, 15 nt, Homo sapiens
aucccacauccaacu

SEQ ID NO: 1715291 - RNA, 15 nt, Homo sapiens
aucccagcuacucag

SEQ ID NO: 1715292 - RNA, 11 nt, Homo sapiens
aucccaggaca

SEQ ID NO: 1715293 - RNA, 22 nt, Homo sapiens
auccccaacugcgacugugacc

SEQ ID NO: 1715294 - RNA, 15 nt, Homo sapiens
auccccucccaucau

SEQ ID NO: 1715295 - RNA, 15 nt, Homo sapiens
auccccugcuacccu

SEQ ID NO: 1715296 - RNA, 19 nt, Homo sapiens
auccccuggacugggaggu

SEQ ID NO: 1715297 - RNA, 17 nt, Homo sapiens
auccccuuggcugugag

SEQ ID NO: 1715298 - RNA, 14 nt, Homo sapiens
aucccuacaaaaaa

SEQ ID NO: 1715299 - RNA, 22 nt, Homo sapiens
aucccugacaucuggaaucugg

SEQ ID NO: 1715300 - RNA, 16 nt, Homo sapiens
aucccugccuggucac

SEQ ID NO: 1715301 - RNA, 16 nt, Homo sapiens
aucccugccuguuaag

SEQ ID NO: 1715302 - RNA, 12 nt, Homo sapiens
aucccuuuccag

SEQ ID NO: 1715303 - RNA, 13 nt, Homo sapiens
auccgaaguauga

SEQ ID NO: 1715304 - RNA, 13 nt, Homo sapiens
auccuaagacaca

SEQ ID NO: 1715305 - RNA, 11 nt, Homo sapiens
auccuauuuau

SEQ ID NO: 1715306 - RNA, 21 nt, Homo sapiens
auccucucccauggagacaag

SEQ ID NO: 1715307 - RNA, 17 nt, Homo sapiens
auccucugguucuucau

SEQ ID NO: 1715308 - RNA, 21 nt, Homo sapiens
auccugccagccccacacagc

SEQ ID NO: 1715309 - RNA, 22 nt, Homo sapiens
auccugccagccccacacagcu

SEQ ID NO: 1715310 - RNA, 21 nt, Homo sapiens
auccuggguacugaaagccuu

SEQ ID NO: 1715311 - RNA, 18 nt, Homo sapiens
auccugucuuuaaggaaa

SEQ ID NO: 1715312 - RNA, 19 nt, Homo sapiens
auccuuaacacauucaaua

SEQ ID NO: 1715313 - RNA, 14 nt, Homo sapiens
auccuuccaaaaau

SEQ ID NO: 1715314 - RNA, 15 nt, Homo sapiens
auccuuccaaagaau

SEQ ID NO: 1715315 - RNA, 14 nt, Homo sapiens
auccuugacuuuga

SEQ ID NO: 1715316 - RNA, 16 nt, Homo sapiens
aucgaaucuacuaauu

SEQ ID NO: 1715317 - RNA, 12 nt, Homo sapiens
aucgaccuggag

SEQ ID NO: 1715318 - RNA, 13 nt, Homo sapiens
aucgcaaaucaaa

SEQ ID NO: 1715319 - RNA, 19 nt, Homo sapiens
aucgcacaaccugcaucuu

SEQ ID NO: 1715320 - RNA, 16 nt, Homo sapiens
aucggcucacaaagag

SEQ ID NO: 1715321 - RNA, 22 nt, Homo sapiens
aucguccagcgaccuuccucau

SEQ ID NO: 1715322 - RNA, 18 nt, Homo sapiens
aucgugggccgcacuggg

SEQ ID NO: 1715323 - RNA, 17 nt, Homo sapiens
auacccugaauuuggcc

SEQ ID NO: 1715324 - RNA, 18 nt, Homo sapiens
auacccugcccuugacau

SEQ ID NO: 1715325 - RNA, 16 nt, Homo sapiens
auaccuaaguacugua

SEQ ID NO: 1715326 - RNA, 17 nt, Homo sapiens
auaccuaaguacuguaa

SEQ ID NO: 1715327 - RNA, 14 nt, Homo sapiens
auaccucugaccaa

SEQ ID NO: 1715328 - RNA, 14 nt, Homo sapiens
auaccugcacuguc

SEQ ID NO: 1715329 - RNA, 15 nt, Homo sapiens
auaccuuccccacau

SEQ ID NO: 1715330 - RNA, 19 nt, Homo sapiens
auaccuucuuaaguuuuca

SEQ ID NO: 1715331 - RNA, 15 nt, Homo sapiens
auacuauccaguuac

SEQ ID NO: 1715332 - RNA, 16 nt, Homo sapiens
auacuauccaguuacu

SEQ ID NO: 1715333 - RNA, 19 nt, Homo sapiens
auacuggccuggacuguuu

SEQ ID NO: 1715334 - RNA, 23 nt, Homo sapiens
auacuuccaucuggcugccuuug

SEQ ID NO: 1715335 - RNA, 13 nt, Homo sapiens
auacuuuacaugg

SEQ ID NO: 1715336 - RNA, 13 nt, Homo sapiens
auacuuuuuacaa

SEQ ID NO: 1715337 - RNA, 18 nt, Homo sapiens
auacuuuuuuucacaguu

SEQ ID NO: 1715338 - RNA, 14 nt, Homo sapiens
auagaaaacugaaa

SEQ ID NO: 1715339 - RNA, 21 nt, Homo sapiens
auagaaacaccaguaccugaa

SEQ ID NO: 1715340 - RNA, 18 nt, Homo sapiens
auagaaacaugacacuga

SEQ ID NO: 1715341 - RNA, 14 nt, Homo sapiens
auagaagcaaauua

SEQ ID NO: 1715342 - RNA, 17 nt, Homo sapiens
auagaaguagcaaaaag

SEQ ID NO: 1715343 - RNA, 18 nt, Homo sapiens
auagaauaaaauauaauu

SEQ ID NO: 1715344 - RNA, 22 nt, Homo sapiens
auagaaugagcacccauuccaa

SEQ ID NO: 1715345 - RNA, 13 nt, Homo sapiens
auagacaguuugu

SEQ ID NO: 1715346 - RNA, 21 nt, Homo sapiens
auagaggcaagaaagagauac

SEQ ID NO: 1715347 - RNA, 18 nt, Homo sapiens
auagaguaaauacaggua

SEQ ID NO: 1715348 - RNA, 20 nt, Homo sapiens
auagagucaucaauguauuu

SEQ ID NO: 1715349 - RNA, 18 nt, Homo sapiens
auagagucucacuguguc

SEQ ID NO: 1715350 - RNA, 17 nt, Homo sapiens
auagagugucucagggu

SEQ ID NO: 1715351 - RNA, 15 nt, Homo sapiens
auagauauuuucaca

SEQ ID NO: 1715352 - RNA, 15 nt, Homo sapiens
auagaugucuuuuau

SEQ ID NO: 1715353 - RNA, 17 nt, Homo sapiens
auagauuaauggcacug

SEQ ID NO: 1715354 - RNA, 18 nt, Homo sapiens
auagauuaauggcacuga

SEQ ID NO: 1715355 - RNA, 20 nt, Homo sapiens
auagauuucuacacugaggu

SEQ ID NO: 1715356 - RNA, 22 nt, Homo sapiens
auagauuuucauguucuugcag

SEQ ID NO: 1715357 - RNA, 17 nt, Homo sapiens
auagcacacacauacac

SEQ ID NO: 1715358 - RNA, 20 nt, Homo sapiens
auagcagagggguaagagag

SEQ ID NO: 1715359 - RNA, 12 nt, Homo sapiens
auagcaugguuu

SEQ ID NO: 1715360 - RNA, 21 nt, Homo sapiens
auagccuaauacaacauguag

SEQ ID NO: 1715361 - RNA, 12 nt, Homo sapiens
auaggcugugua

SEQ ID NO: 1715362 - RNA, 21 nt, Homo sapiens
auaguaccaguaggggcuuau

SEQ ID NO: 1715363 - RNA, 15 nt, Homo sapiens
auaguagacacacua

SEQ ID NO: 1715364 - RNA, 15 nt, Homo sapiens
auagucacauggccu

SEQ ID NO: 1715365 - RNA, 23 nt, Homo sapiens
auagucacauggccuaugcacau

SEQ ID NO: 1715366 - RNA, 17 nt, Homo sapiens
auagugacuaugaacuu

SEQ ID NO: 1715367 - RNA, 16 nt, Homo sapiens
auaguggaaaaacaca

SEQ ID NO: 1715368 - RNA, 12 nt, Homo sapiens
auaguguccaaa

SEQ ID NO: 1715369 - RNA, 17 nt, Homo sapiens
auaguuaauuauuucaa

SEQ ID NO: 1715370 - RNA, 14 nt, Homo sapiens
auaguuuaccugaa

SEQ ID NO: 1715371 - RNA, 17 nt, Homo sapiens
auaguuuguuauauccu

SEQ ID NO: 1715372 - RNA, 14 nt, Homo sapiens
auauaaaaggcaaa

SEQ ID NO: 1715373 - RNA, 18 nt, Homo sapiens
auauaaguuugaaggaaa

SEQ ID NO: 1715374 - RNA, 21 nt, Homo sapiens
auauaauucacucaagcacug

SEQ ID NO: 1715375 - RNA, 12 nt, Homo sapiens
auauaccaucuc

SEQ ID NO: 1715376 - RNA, 22 nt, Homo sapiens
auauagagggcuuaugauucag

SEQ ID NO: 1715377 - RNA, 17 nt, Homo sapiens
auaucaaaaaguauuaa

SEQ ID NO: 1715378 - RNA, 14 nt, Homo sapiens
auaucaaucaagcc

SEQ ID NO: 1715379 - RNA, 22 nt, Homo sapiens
auaucaauuaauuugaaaacau

SEQ ID NO: 1715380 - RNA, 15 nt, Homo sapiens
auaucauacuuccau

SEQ ID NO: 1715381 - RNA, 21 nt, Homo sapiens
auaucauccugccuucaugga

SEQ ID NO: 1715382 - RNA, 22 nt, Homo sapiens
auaucaugcuuuaaaguguaau

SEQ ID NO: 1715383 - RNA, 16 nt, Homo sapiens
auauccaaaccaaaua

SEQ ID NO: 1715384 - RNA, 14 nt, Homo sapiens
auauccugugacug

SEQ ID NO: 1715385 - RNA, 13 nt, Homo sapiens
auaucgaucucuu

SEQ ID NO: 1715386 - RNA, 14 nt, Homo sapiens
uccaaaguuaucca

SEQ ID NO: 1715387 - RNA, 19 nt, Homo sapiens
uccaaauaacaaguaccaa

SEQ ID NO: 1715388 - RNA, 15 nt, Homo sapiens
uccaaauguccucca

SEQ ID NO: 1715389 - RNA, 16 nt, Homo sapiens
uccaacacugcaacau

SEQ ID NO: 1715390 - RNA, 15 nt, Homo sapiens
uccaacuccaggaua

SEQ ID NO: 1715391 - RNA, 17 nt, Homo sapiens
uccaacucccucuggga

SEQ ID NO: 1715392 - RNA, 20 nt, Homo sapiens
uccaagacucuagaguccaa

SEQ ID NO: 1715393 - RNA, 15 nt, Homo sapiens
uccaagucucagugg

SEQ ID NO: 1715394 - RNA, 12 nt, Homo sapiens
uccaauacucag

SEQ ID NO: 1715395 - RNA, 15 nt, Homo sapiens
uccaauaggcauuug

SEQ ID NO: 1715396 - RNA, 15 nt, Homo sapiens
uccaaucggagacaa

SEQ ID NO: 1715397 - RNA, 19 nt, Homo sapiens
uccaaucggagacaaaagc

SEQ ID NO: 1715398 - RNA, 21 nt, Homo sapiens
uccaaugucugcugaggaguu

SEQ ID NO: 1715399 - RNA, 17 nt, Homo sapiens
uccacaaaaucugucca

SEQ ID NO: 1715400 - RNA, 14 nt, Homo sapiens
uccacaacagaagu

SEQ ID NO: 1715401 - RNA, 17 nt, Homo sapiens
uccacaccuuuuauuga

SEQ ID NO: 1715402 - RNA, 14 nt, Homo sapiens
uccacauuauacau

SEQ ID NO: 1715403 - RNA, 19 nt, Homo sapiens
uccacauuauacauuugau

SEQ ID NO: 1715404 - RNA, 19 nt, Homo sapiens
uccaccccauccaauuuau

SEQ ID NO: 1715405 - RNA, 13 nt, Homo sapiens
uccacccuuggcc

SEQ ID NO: 1715406 - RNA, 22 nt, Homo sapiens
uccaccuaccacucacaugaca

SEQ ID NO: 1715407 - RNA, 15 nt, Homo sapiens
uccaccuagacugua

SEQ ID NO: 1715408 - RNA, 12 nt, Homo sapiens
uccaccuguggg

SEQ ID NO: 1715409 - RNA, 17 nt, Homo sapiens
uccacgucaacagaauu

SEQ ID NO: 1715410 - RNA, 17 nt, Homo sapiens
uccacucuacccuccca

SEQ ID NO: 1715411 - RNA, 11 nt, Homo sapiens
uccacugccuc

SEQ ID NO: 1715412 - RNA, 15 nt, Homo sapiens
uccacugugccaugu

SEQ ID NO: 1715413 - RNA, 19 nt, Homo sapiens
uccacuucuuguuccccac

SEQ ID NO: 1715414 - RNA, 23 nt, Homo sapiens
uccacuucuuguuccccacugac

SEQ ID NO: 1715415 - RNA, 14 nt, Homo sapiens
uccagaacacggcu

SEQ ID NO: 1715416 - RNA, 13 nt, Homo sapiens
uccagacaccagu

SEQ ID NO: 1715417 - RNA, 15 nt, Homo sapiens
uccagacauacgaaa

SEQ ID NO: 1715418 - RNA, 14 nt, Homo sapiens
uccagagaaaagag

SEQ ID NO: 1715419 - RNA, 16 nt, Homo sapiens
uccagaggguugugau

SEQ ID NO: 1715420 - RNA, 15 nt, Homo sapiens
uccagaucacugcca

SEQ ID NO: 1715421 - RNA, 16 nt, Homo sapiens
uccagaucacugccac

SEQ ID NO: 1715422 - RNA, 17 nt, Homo sapiens
uccagaucacugccaca

SEQ ID NO: 1715423 - RNA, 17 nt, Homo sapiens
uccagcagaugccacau

SEQ ID NO: 1715424 - RNA, 22 nt, Homo sapiens
uccagccaaccucauugcagcu

SEQ ID NO: 1715425 - RNA, 23 nt, Homo sapiens
uccagcuggaagggucaacaucu

SEQ ID NO: 1715426 - RNA, 17 nt, Homo sapiens
uccaggacuguugauga

SEQ ID NO: 1715427 - RNA, 13 nt, Homo sapiens
uccaggcacagcu

SEQ ID NO: 1715428 - RNA, 18 nt, Homo sapiens
uccaggcccaacugugag

SEQ ID NO: 1715429 - RNA, 17 nt, Homo sapiens
uccagguguuacuguaa

SEQ ID NO: 1715430 - RNA, 17 nt, Homo sapiens
uccaguauucuugucaa

SEQ ID NO: 1715431 - RNA, 13 nt, Homo sapiens
uccaguguuuaca

SEQ ID NO: 1715432 - RNA, 14 nt, Homo sapiens
uccaguuaaccaag

SEQ ID NO: 1715433 - RNA, 17 nt, Homo sapiens
uccauaaugcuacuguc

SEQ ID NO: 1715434 - RNA, 12 nt, Homo sapiens
uccauaccagcu

SEQ ID NO: 1715435 - RNA, 14 nt, Homo sapiens
uccaugcuaagcaa

SEQ ID NO: 1715436 - RNA, 18 nt, Homo sapiens
uccaugcuccucacugcc

SEQ ID NO: 1715437 - RNA, 22 nt, Homo sapiens
uccaugucgccucugcauucag

SEQ ID NO: 1715438 - RNA, 13 nt, Homo sapiens
uccauucucugag

SEQ ID NO: 1715439 - RNA, 15 nt, Homo sapiens
uccauucucugaguc

SEQ ID NO: 1715440 - RNA, 16 nt, Homo sapiens
uccauugccuagcucu

SEQ ID NO: 1715441 - RNA, 21 nt, Homo sapiens
ucccaaaagucaccacuccau

SEQ ID NO: 1715442 - RNA, 19 nt, Homo sapiens
ucccaaagugcugagauua

SEQ ID NO: 1715443 - RNA, 23 nt, Homo sapiens
ucccaaaucaauaagaagguaga

SEQ ID NO: 1715444 - RNA, 16 nt, Homo sapiens
ucccaacaacauccau

SEQ ID NO: 1715445 - RNA, 14 nt, Homo sapiens
ucccaacugagugu

SEQ ID NO: 1715446 - RNA, 17 nt, Homo sapiens
ucccacccccaucucuc

SEQ ID NO: 1715447 - RNA, 14 nt, Homo sapiens
ucccaccucagccu

SEQ ID NO: 1715448 - RNA, 20 nt, Homo sapiens
ucccaccucugugaccucag

SEQ ID NO: 1715449 - RNA, 14 nt, Homo sapiens
ucccaccugcacac

SEQ ID NO: 1715450 - RNA, 18 nt, Homo sapiens
ucccaccugccaccaggc

SEQ ID NO: 1715451 - RNA, 16 nt, Homo sapiens
ucccacgugucuucca

SEQ ID NO: 1715452 - RNA, 17 nt, Homo sapiens
ucccagauggcuggaag

SEQ ID NO: 1715453 - RNA, 22 nt, Homo sapiens
ucccaggagcagcggggcagug

SEQ ID NO: 1715454 - RNA, 17 nt, Homo sapiens
ucccaggauuaggccau

SEQ ID NO: 1715455 - RNA, 22 nt, Homo sapiens
ucccagguguuaacauuccaag

SEQ ID NO: 1715456 - RNA, 15 nt, Homo sapiens
ucccagucucuggca

SEQ ID NO: 1715457 - RNA, 15 nt, Homo sapiens
ucccaucuuuacucc

SEQ ID NO: 1715458 - RNA, 22 nt, Homo sapiens
ucccauggguuguguguuuauu

SEQ ID NO: 1715459 - RNA, 14 nt, Homo sapiens
ucccauguauuuau

SEQ ID NO: 1715460 - RNA, 15 nt, Homo sapiens
ucccauucuugcaug

SEQ ID NO: 1715461 - RNA, 18 nt, Homo sapiens
ucccauugcaucaccucu

SEQ ID NO: 1715462 - RNA, 18 nt, Homo sapiens
ucccauugguguugucau

SEQ ID NO: 1715463 - RNA, 17 nt, Homo sapiens
uccccacgaacuggccu

SEQ ID NO: 1715464 - RNA, 21 nt, Homo sapiens
uccccagcccaggguggacuu

SEQ ID NO: 1715465 - RNA, 13 nt, Homo sapiens
uccccagggggca

SEQ ID NO: 1715466 - RNA, 19 nt, Homo sapiens
uccccaucuggguccuugc

SEQ ID NO: 1715467 - RNA, 14 nt, Homo sapiens
ucccccaaaguuca

SEQ ID NO: 1715468 - RNA, 18 nt, Homo sapiens
ucccccaccgguccagcu

SEQ ID NO: 1715469 - RNA, 14 nt, Homo sapiens
ucccccauagccac

SEQ ID NO: 1715470 - RNA, 12 nt, Homo sapiens
ucccccauaggu

SEQ ID NO: 1715471 - RNA, 18 nt, Homo sapiens
ucccccuauccuuggcac

SEQ ID NO: 1715472 - RNA, 17 nt, Homo sapiens
ucccccugcuugucuuc

SEQ ID NO: 1715473 - RNA, 18 nt, Homo sapiens
uccccgaaggugcuggag

SEQ ID NO: 1715474 - RNA, 23 nt, Homo sapiens
uccccgauugaaagaaccagaga

SEQ ID NO: 1715475 - RNA, 14 nt, Homo sapiens
uccccucaccuccu

SEQ ID NO: 1715476 - RNA, 13 nt, Homo sapiens
uccccuccacugu

SEQ ID NO: 1715477 - RNA, 22 nt, Homo sapiens
uccccuccacugucacauugua

SEQ ID NO: 1715478 - RNA, 20 nt, Homo sapiens
uccccugcuacccuagauga

SEQ ID NO: 1715479 - RNA, 15 nt, Homo sapiens
uccccuggacuggga

SEQ ID NO: 1715480 - RNA, 22 nt, Homo sapiens
uccccuggggucucugcugcau

SEQ ID NO: 1715481 - RNA, 23 nt, Homo sapiens
uccccuggggucucugcugcauu

SEQ ID NO: 1715482 - RNA, 19 nt, Homo sapiens
uccccuugccuaaauacaa

SEQ ID NO: 1715483 - RNA, 15 nt, Homo sapiens
uccccuuggcuguga

SEQ ID NO: 1715484 - RNA, 16 nt, Homo sapiens
ucccgaagaauggaga

SEQ ID NO: 1715485 - RNA, 19 nt, Homo sapiens
ucccggcgucccuaccucc

SEQ ID NO: 1715486 - RNA, 17 nt, Homo sapiens
ucccgugagccaggcaa

SEQ ID NO: 1715487 - RNA, 17 nt, Homo sapiens
ucccuaaaauacauuua

SEQ ID NO: 1715488 - RNA, 12 nt, Homo sapiens
ucccuaccuccu

SEQ ID NO: 1715489 - RNA, 16 nt, Homo sapiens
ucccucacccaggcac

SEQ ID NO: 1715490 - RNA, 16 nt, Homo sapiens
ucccuccccugccauu

SEQ ID NO: 1715491 - RNA, 14 nt, Homo sapiens
ucccucuucacucc

SEQ ID NO: 1715492 - RNA, 22 nt, Homo sapiens
ucccucuuuggcuccccuguac

SEQ ID NO: 1715493 - RNA, 17 nt, Homo sapiens
ucccugaaaccuaguac

SEQ ID NO: 1715494 - RNA, 16 nt, Homo sapiens
ucccugcagaugccac

SEQ ID NO: 1715495 - RNA, 23 nt, Homo sapiens
ucccugcagaugccacccuagcc

SEQ ID NO: 1715496 - RNA, 22 nt, Homo sapiens
uaugugagauuuuuuauugcua

SEQ ID NO: 1715497 - RNA, 16 nt, Homo sapiens
uaugugcacugauaug

SEQ ID NO: 1715498 - RNA, 12 nt, Homo sapiens
uauguguaaaau

SEQ ID NO: 1715499 - RNA, 19 nt, Homo sapiens
uauuaacaugcuuaugaca

SEQ ID NO: 1715500 - RNA, 22 nt, Homo sapiens
uauuaaguucucaaugugaaaa

SEQ ID NO: 1715501 - RNA, 19 nt, Homo sapiens
uauuaaucuggacauucga

SEQ ID NO: 1715502 - RNA, 14 nt, Homo sapiens
uauuauguguuucc

SEQ ID NO: 1715503 - RNA, 14 nt, Homo sapiens
uauucaaccaugga

SEQ ID NO: 1715504 - RNA, 13 nt, Homo sapiens
uauucaauggaaa

SEQ ID NO: 1715505 - RNA, 19 nt, Homo sapiens
uauucaauggaaagcugcu

SEQ ID NO: 1715506 - RNA, 20 nt, Homo sapiens
uauucaauggaaagcugcuu

SEQ ID NO: 1715507 - RNA, 14 nt, Homo sapiens
uauucaggagagua

SEQ ID NO: 1715508 - RNA, 14 nt, Homo sapiens
uauucauuggucua

SEQ ID NO: 1715509 - RNA, 18 nt, Homo sapiens
uauucccaagcccaugag

SEQ ID NO: 1715510 - RNA, 17 nt, Homo sapiens
uauucucuuaaaagaca

SEQ ID NO: 1715511 - RNA, 23 nt, Homo sapiens
uauucuuaagggaacuuccacau

SEQ ID NO: 1715512 - RNA, 12 nt, Homo sapiens
uauucuugucaa

SEQ ID NO: 1715513 - RNA, 15 nt, Homo sapiens
uauucuugugcuuuu

SEQ ID NO: 1715514 - RNA, 13 nt, Homo sapiens
uauugaagacaau

SEQ ID NO: 1715515 - RNA, 18 nt, Homo sapiens
uauugcauuuauauguac

SEQ ID NO: 1715516 - RNA, 14 nt, Homo sapiens
uauugcgcugcuac

SEQ ID NO: 1715517 - RNA, 15 nt, Homo sapiens
uauuguaaacaugug

SEQ ID NO: 1715518 - RNA, 12 nt, Homo sapiens
uauuguacauaa

SEQ ID NO: 1715519 - RNA, 15 nt, Homo sapiens
uauugugguauugaa

SEQ ID NO: 1715520 - RNA, 18 nt, Homo sapiens
uauuguugacaacuguga

SEQ ID NO: 1715521 - RNA, 16 nt, Homo sapiens
uauuuaaaaugcauaa

SEQ ID NO: 1715522 - RNA, 21 nt, Homo sapiens
uauuuaaauaaaaucauauug

SEQ ID NO: 1715523 - RNA, 13 nt, Homo sapiens
uauuuaacuuuaa

SEQ ID NO: 1715524 - RNA, 22 nt, Homo sapiens
uauuuaauauaguaacacacuu

SEQ ID NO: 1715525 - RNA, 18 nt, Homo sapiens
uauuuacauacaggccau

SEQ ID NO: 1715526 - RNA, 18 nt, Homo sapiens
uauuuagauauaacacua

SEQ ID NO: 1715527 - RNA, 15 nt, Homo sapiens
uauuuagugaacuac

SEQ ID NO: 1715528 - RNA, 21 nt, Homo sapiens
uauuuauaauuccuauauccu

SEQ ID NO: 1715529 - RNA, 15 nt, Homo sapiens
uauuuauauguacug

SEQ ID NO: 1715530 - RNA, 15 nt, Homo sapiens
uauuuaugaaguuua

SEQ ID NO: 1715531 - RNA, 13 nt, Homo sapiens
gcuuauauucaac

SEQ ID NO: 1715532 - RNA, 20 nt, Homo sapiens
gcuuauucaucuguuuuucu

SEQ ID NO: 1715533 - RNA, 13 nt, Homo sapiens
gcuuccaucccaa

SEQ ID NO: 1715534 - RNA, 15 nt, Homo sapiens
gcuuccaugauucua

SEQ ID NO: 1715535 - RNA, 21 nt, Homo sapiens
gcuuccauuuuccuacaggca

SEQ ID NO: 1715536 - RNA, 21 nt, Homo sapiens
gcuucccagcaccaacaugua

SEQ ID NO: 1715537 - RNA, 23 nt, Homo sapiens
gcuucccggcgucccuaccuccu

SEQ ID NO: 1715538 - RNA, 13 nt, Homo sapiens
gcuucuacacugg

SEQ ID NO: 1715539 - RNA, 14 nt, Homo sapiens
gcuucucaucccca

SEQ ID NO: 1715540 - RNA, 20 nt, Homo sapiens
gcuucuccaauucugcccaa

SEQ ID NO: 1715541 - RNA, 21 nt, Homo sapiens
gcuucuggggguagaucucaa

SEQ ID NO: 1715542 - RNA, 22 nt, Homo sapiens
gcuuguuuuccagucucuugua

SEQ ID NO: 1715543 - RNA, 20 nt, Homo sapiens
gcuuuauuccagaaugcugu

SEQ ID NO: 1715544 - RNA, 21 nt, Homo sapiens
gcuuucaagugccuuucugca

SEQ ID NO: 1715545 - RNA, 18 nt, Homo sapiens
gcuuucagaaaacgggaa

SEQ ID NO: 1715546 - RNA, 14 nt, Homo sapiens
gcuuucagggccau

SEQ ID NO: 1715547 - RNA, 20 nt, Homo sapiens
gcuuucguaguuuucauuua

SEQ ID NO: 1715548 - RNA, 18 nt, Homo sapiens
gcuuucuucuuaaccuau

SEQ ID NO: 1715549 - RNA, 14 nt, Homo sapiens
gcuuuguugcccag

SEQ ID NO: 1715550 - RNA, 20 nt, Homo sapiens
gcuuuuucacagucacugau

SEQ ID NO: 1715551 - RNA, 23 nt, Homo sapiens
gcuuuuucacagucacugaugua

SEQ ID NO: 1715552 - RNA, 16 nt, Homo sapiens
ggaaaaaaaaagggaa

SEQ ID NO: 1715553 - RNA, 15 nt, Homo sapiens
ggaaaaaaaugaaug

SEQ ID NO: 1715554 - RNA, 19 nt, Homo sapiens
ggaaaaaccaauagcuuua

SEQ ID NO: 1715555 - RNA, 21 nt, Homo sapiens
ggaaaagagcgcaucaggccu

SEQ ID NO: 1715556 - RNA, 13 nt, Homo sapiens
ggaaaagcaaaac

SEQ ID NO: 1715557 - RNA, 12 nt, Homo sapiens
ggaaaaugacuc

SEQ ID NO: 1715558 - RNA, 12 nt, Homo sapiens
ggaaaaugagua

SEQ ID NO: 1715559 - RNA, 23 nt, Homo sapiens
ggaaacaauauaaccacaaagca

SEQ ID NO: 1715560 - RNA, 16 nt, Homo sapiens
ggaaagaugaucagcu

SEQ ID NO: 1715561 - RNA, 18 nt, Homo sapiens
ggaaauccccuuaugacu

SEQ ID NO: 1715562 - RNA, 13 nt, Homo sapiens
ggaacagaauguu

SEQ ID NO: 1715563 - RNA, 16 nt, Homo sapiens
ggaacagcagauaaca

SEQ ID NO: 1715564 - RNA, 23 nt, Homo sapiens
ggaaccuugcuguccugaucugu

SEQ ID NO: 1715565 - RNA, 14 nt, Homo sapiens
ggaacucucuccac

SEQ ID NO: 1715566 - RNA, 22 nt, Homo sapiens
ggaacugaagagggcccaaguc

SEQ ID NO: 1715567 - RNA, 20 nt, Homo sapiens
ggaacugcguggugcucuuu

SEQ ID NO: 1715568 - RNA, 21 nt, Homo sapiens
ggaagaacuacagcucuuaaa

SEQ ID NO: 1715569 - RNA, 11 nt, Homo sapiens
ggaagauaucu

SEQ ID NO: 1715570 - RNA, 21 nt, Homo sapiens
ggaagcaacaggaaucaagag

SEQ ID NO: 1715571 - RNA, 14 nt, Homo sapiens
ggaagccucugggu

SEQ ID NO: 1715572 - RNA, 15 nt, Homo sapiens
ggaagcuaauuugca

SEQ ID NO: 1715573 - RNA, 17 nt, Homo sapiens
ggaagcuccacugucac

SEQ ID NO: 1715574 - RNA, 21 nt, Homo sapiens
ggaagcuccgcuuucuaccca

SEQ ID NO: 1715575 - RNA, 20 nt, Homo sapiens
ggaagcuuguuuuccagucu

SEQ ID NO: 1715576 - RNA, 23 nt, Homo sapiens
ggaaggcagcagagggucuccaa

SEQ ID NO: 1715577 - RNA, 16 nt, Homo sapiens
ggaaguccuugcccac

SEQ ID NO: 1715578 - RNA, 23 nt, Homo sapiens
ggaagugaagagggagaagggau

SEQ ID NO: 1715579 - RNA, 15 nt, Homo sapiens
ggaaguucaacuucc

SEQ ID NO: 1715580 - RNA, 17 nt, Homo sapiens
ggaauaaaaacauuucu

SEQ ID NO: 1715581 - RNA, 22 nt, Homo sapiens
ggaauaaauugcuccuugacau

SEQ ID NO: 1715582 - RNA, 14 nt, Homo sapiens
ggaauaaccuucca

SEQ ID NO: 1715583 - RNA, 16 nt, Homo sapiens
ggaauaagaagcaaau

SEQ ID NO: 1715584 - RNA, 12 nt, Homo sapiens
ggaauaauguaa

SEQ ID NO: 1715585 - RNA, 22 nt, Homo sapiens
ggaaucaauucaauuuggacug

SEQ ID NO: 1715586 - RNA, 13 nt, Homo sapiens
ggaaucagucagc

SEQ ID NO: 1715587 - RNA, 22 nt, Homo sapiens
ggaauccuggcagcccagagac

SEQ ID NO: 1715588 - RNA, 20 nt, Homo sapiens
ggaauccuuuggugccaacu

SEQ ID NO: 1715589 - RNA, 15 nt, Homo sapiens
ggacaaaugaugcca

SEQ ID NO: 1715590 - RNA, 17 nt, Homo sapiens
ggacaagacaaaccaag

SEQ ID NO: 1715591 - RNA, 18 nt, Homo sapiens
ggacaagagguacagggu

SEQ ID NO: 1715592 - RNA, 18 nt, Homo sapiens
ggacaauuaucuguguca

SEQ ID NO: 1715593 - RNA, 14 nt, Homo sapiens
ggacacuccagugc

SEQ ID NO: 1715594 - RNA, 21 nt, Homo sapiens
ggacacugugcccagcccgga

SEQ ID NO: 1715595 - RNA, 15 nt, Homo sapiens
ggacaggaugaccug

SEQ ID NO: 1715596 - RNA, 23 nt, Homo sapiens
ggacaguaucccacauccaacuc

SEQ ID NO: 1715597 - RNA, 20 nt, Homo sapiens
ggacaguuuaucaugaagcc

SEQ ID NO: 1715598 - RNA, 20 nt, Homo sapiens
ggaccacucagccccuagga

SEQ ID NO: 1715599 - RNA, 23 nt, Homo sapiens
ggaccacuguuucuugcuuguac

SEQ ID NO: 1715600 - RNA, 17 nt, Homo sapiens
ggaccaggccauucugc

SEQ ID NO: 1715601 - RNA, 17 nt, Homo sapiens
ggaccaguggugccuug

SEQ ID NO: 1715602 - RNA, 13 nt, Homo sapiens
ggaccauguguca

SEQ ID NO: 1715603 - RNA, 17 nt, Homo sapiens
ggacccuggaaauggac

SEQ ID NO: 1715604 - RNA, 12 nt, Homo sapiens
ggaccucaggug

SEQ ID NO: 1715605 - RNA, 14 nt, Homo sapiens
ggaccugguacaaa

SEQ ID NO: 1715606 - RNA, 13 nt, Homo sapiens
ggacuacaaccaa

SEQ ID NO: 1715607 - RNA, 13 nt, Homo sapiens
ggacuacaggcac

SEQ ID NO: 1715608 - RNA, 17 nt, Homo sapiens
ggacuacaggcacccac

SEQ ID NO: 1715609 - RNA, 22 nt, Homo sapiens
ggacucaaugcacugacauugu

SEQ ID NO: 1715610 - RNA, 23 nt, Homo sapiens
ggacucagguugucugaagucac

SEQ ID NO: 1715611 - RNA, 16 nt, Homo sapiens
ggacucugcaucccag

SEQ ID NO: 1715612 - RNA, 14 nt, Homo sapiens
ggacugauacugca

SEQ ID NO: 1715613 - RNA, 23 nt, Homo sapiens
ggacugccucugccacacucuga

SEQ ID NO: 1715614 - RNA, 19 nt, Homo sapiens
ggacuguggcacuugccug

SEQ ID NO: 1715615 - RNA, 20 nt, Homo sapiens
ggacuuccagugcucagagg

SEQ ID NO: 1715616 - RNA, 13 nt, Homo sapiens
ggagaacuagaga

SEQ ID NO: 1715617 - RNA, 15 nt, Homo sapiens
ggagacaaguuccau

SEQ ID NO: 1715618 - RNA, 23 nt, Homo sapiens
ggagacacaacuauuuuuccaaa

SEQ ID NO: 1715619 - RNA, 22 nt, Homo sapiens
ggagacccauguaaauaccaga

SEQ ID NO: 1715620 - RNA, 21 nt, Homo sapiens
ggagacccucgcccaacucca

SEQ ID NO: 1715621 - RNA, 18 nt, Homo sapiens
ggagacguggaaccucug

SEQ ID NO: 1715622 - RNA, 16 nt, Homo sapiens
ggagacuugccagagc

SEQ ID NO: 1715623 - RNA, 17 nt, Homo sapiens
ggagagagaaagccagg

SEQ ID NO: 1715624 - RNA, 23 nt, Homo sapiens
ggagagagauuguguucuuccuc

SEQ ID NO: 1715625 - RNA, 23 nt, Homo sapiens
ggagagcccggcgccccugccac

SEQ ID NO: 1715626 - RNA, 23 nt, Homo sapiens
ggagcucuucaggccucccucuc

SEQ ID NO: 1715627 - RNA, 18 nt, Homo sapiens
uacauccagucacuuugc

SEQ ID NO: 1715628 - RNA, 19 nt, Homo sapiens
uacaugcaaggcacuguac

SEQ ID NO: 1715629 - RNA, 14 nt, Homo sapiens
uacaugucuuccau

SEQ ID NO: 1715630 - RNA, 14 nt, Homo sapiens
uacauguguguaua

SEQ ID NO: 1715631 - RNA, 15 nt, Homo sapiens
uacauugugcugcac

SEQ ID NO: 1715632 - RNA, 14 nt, Homo sapiens
uacauuucucauac

SEQ ID NO: 1715633 - RNA, 21 nt, Homo sapiens
uacauuuuuugggcagcaauu

SEQ ID NO: 1715634 - RNA, 16 nt, Homo sapiens
uaccacuaacuccuga

SEQ ID NO: 1715635 - RNA, 14 nt, Homo sapiens
uaccacuuguauua

SEQ ID NO: 1715636 - RNA, 13 nt, Homo sapiens
uaccaucagggac

SEQ ID NO: 1715637 - RNA, 17 nt, Homo sapiens
uaccauuuuucauucac

SEQ ID NO: 1715638 - RNA, 15 nt, Homo sapiens
uacccagagaguccu

SEQ ID NO: 1715639 - RNA, 19 nt, Homo sapiens
uacccaggaccaagccaca

SEQ ID NO: 1715640 - RNA, 13 nt, Homo sapiens
uacccagugccua

SEQ ID NO: 1715641 - RNA, 15 nt, Homo sapiens
uaccucaauguuuga

SEQ ID NO: 1715642 - RNA, 16 nt, Homo sapiens
uaccucuuauugcaaa

SEQ ID NO: 1715643 - RNA, 17 nt, Homo sapiens
uaccugaaagcacugua

SEQ ID NO: 1715644 - RNA, 18 nt, Homo sapiens
uaccugaaggacagcuga

SEQ ID NO: 1715645 - RNA, 16 nt, Homo sapiens
uaccuuaucacugcau

SEQ ID NO: 1715646 - RNA, 20 nt, Homo sapiens
uaccuucaagaaccaggcag

SEQ ID NO: 1715647 - RNA, 16 nt, Homo sapiens
uaccuucuuguugaua

SEQ ID NO: 1715648 - RNA, 23 nt, Homo sapiens
uacgaaacacaaaccacaacuga

SEQ ID NO: 1715649 - RNA, 14 nt, Homo sapiens
uacgugucugaauc

SEQ ID NO: 1715650 - RNA, 19 nt, Homo sapiens
uacguuugaaauaguugau

SEQ ID NO: 1715651 - RNA, 21 nt, Homo sapiens
uacuaauuuucuagauuuucu

SEQ ID NO: 1715652 - RNA, 18 nt, Homo sapiens
uacucauugaaaugucac

SEQ ID NO: 1715653 - RNA, 20 nt, Homo sapiens
uacucuaucagagaaaaaca

SEQ ID NO: 1715654 - RNA, 16 nt, Homo sapiens
uacucuggggugcugc

SEQ ID NO: 1715655 - RNA, 17 nt, Homo sapiens
uacucuggggugcugcc

SEQ ID NO: 1715656 - RNA, 21 nt, Homo sapiens
uacucuguccauuuauccaca

SEQ ID NO: 1715657 - RNA, 13 nt, Homo sapiens
uacugacuugagg

SEQ ID NO: 1715658 - RNA, 16 nt, Homo sapiens
uacugagaauagcaug

SEQ ID NO: 1715659 - RNA, 13 nt, Homo sapiens
uacugaucuuacu

SEQ ID NO: 1715660 - RNA, 13 nt, Homo sapiens
uacugaugaaaua

SEQ ID NO: 1715661 - RNA, 15 nt, Homo sapiens
uacugauucacugca

SEQ ID NO: 1715662 - RNA, 17 nt, Homo sapiens
uacugauuuuugugauu

SEQ ID NO: 1715663 - RNA, 23 nt, Homo sapiens
uacugcacagagucaggaucuca

SEQ ID NO: 1715664 - RNA, 23 nt, Homo sapiens
uacugggugucauuucauuccau

SEQ ID NO: 1715665 - RNA, 16 nt, Homo sapiens
uacuguucuugcugcu

SEQ ID NO: 1715666 - RNA, 14 nt, Homo sapiens
uacuucacuucaaa

SEQ ID NO: 1715667 - RNA, 17 nt, Homo sapiens
uacuucaggggcacuuc

SEQ ID NO: 1715668 - RNA, 20 nt, Homo sapiens
uacuugacuugaaugugcac

SEQ ID NO: 1715669 - RNA, 18 nt, Homo sapiens
uacuuguuuucacuuuau

SEQ ID NO: 1715670 - RNA, 15 nt, Homo sapiens
uacuuuaccuccuau

SEQ ID NO: 1715671 - RNA, 22 nt, Homo sapiens
uacuuugguuucugucuguaag

SEQ ID NO: 1715672 - RNA, 14 nt, Homo sapiens
uacuuuuauuugca

SEQ ID NO: 1715673 - RNA, 17 nt, Homo sapiens
uacuuuucuuuccucag

SEQ ID NO: 1715674 - RNA, 22 nt, Homo sapiens
uacuuuuucugguguguuaaca

SEQ ID NO: 1715675 - RNA, 17 nt, Homo sapiens
uagaaacaugacacuga

SEQ ID NO: 1715676 - RNA, 17 nt, Homo sapiens
uagaaacgaguuggugu

SEQ ID NO: 1715677 - RNA, 20 nt, Homo sapiens
uagaaacucaggauggucau

SEQ ID NO: 1715678 - RNA, 16 nt, Homo sapiens
uagaaacuccaaugaa

SEQ ID NO: 1715679 - RNA, 18 nt, Homo sapiens
uagaaagcaacuuaucag

SEQ ID NO: 1715680 - RNA, 14 nt, Homo sapiens
uagaaagggucccu

SEQ ID NO: 1715681 - RNA, 16 nt, Homo sapiens
uagaaauaauaugcau

SEQ ID NO: 1715682 - RNA, 13 nt, Homo sapiens
uagaaauggauuu

SEQ ID NO: 1715683 - RNA, 18 nt, Homo sapiens
uagaaauuggcuggaugu

SEQ ID NO: 1715684 - RNA, 18 nt, Homo sapiens
uagaacaacgccugucac

SEQ ID NO: 1715685 - RNA, 17 nt, Homo sapiens
uagaacagauaaucagu

SEQ ID NO: 1715686 - RNA, 17 nt, Homo sapiens
uagaacguaaccacgga

SEQ ID NO: 1715687 - RNA, 18 nt, Homo sapiens
uagaagaagcuaugucaa

SEQ ID NO: 1715688 - RNA, 21 nt, Homo sapiens
uagaagcuguaguagcccuuu

SEQ ID NO: 1715689 - RNA, 12 nt, Homo sapiens
uagaagucacac

SEQ ID NO: 1715690 - RNA, 16 nt, Homo sapiens
uagaagucacacagua

SEQ ID NO: 1715691 - RNA, 23 nt, Homo sapiens
uagaauaaauucccaacuucucu

SEQ ID NO: 1715692 - RNA, 16 nt, Homo sapiens
uagaaucuauuuucua

SEQ ID NO: 1715693 - RNA, 23 nt, Homo sapiens
uagaaugggaagggucauagaaa

SEQ ID NO: 1715694 - RNA, 18 nt, Homo sapiens
uagaauuaucaagcuuuu

SEQ ID NO: 1715695 - RNA, 12 nt, Homo sapiens
uagaauucugaa

SEQ ID NO: 1715696 - RNA, 14 nt, Homo sapiens
uagacacagauaau

SEQ ID NO: 1715697 - RNA, 16 nt, Homo sapiens
uagacagagucucacu

SEQ ID NO: 1715698 - RNA, 21 nt, Homo sapiens
uagacauggagguucuaaggc

SEQ ID NO: 1715699 - RNA, 13 nt, Homo sapiens
uagacuacauuua

SEQ ID NO: 1715700 - RNA, 23 nt, Homo sapiens
uagacugacuuguuugucuucca

SEQ ID NO: 1715701 - RNA, 23 nt, Homo sapiens
uagacugccgugcauuagcacag

SEQ ID NO: 1715702 - RNA, 19 nt, Homo sapiens
uagacuuucuuaucacuua

SEQ ID NO: 1715703 - RNA, 19 nt, Homo sapiens
uagagaugugucuauggcu

SEQ ID NO: 1715704 - RNA, 12 nt, Homo sapiens
uagagauuacaa

SEQ ID NO: 1715705 - RNA, 15 nt, Homo sapiens
uagaguuccauauau

SEQ ID NO: 1715706 - RNA, 12 nt, Homo sapiens
uagaucuagaaa

SEQ ID NO: 1715707 - RNA, 23 nt, Homo sapiens
uagaugcacuuaugcaguaaauu

SEQ ID NO: 1715708 - RNA, 23 nt, Homo sapiens
uagauugcuuucuucuuaaccua

SEQ ID NO: 1715709 - RNA, 17 nt, Homo sapiens
uagauuucuacacugag

SEQ ID NO: 1715710 - RNA, 13 nt, Homo sapiens
uagcaaacacugg

SEQ ID NO: 1715711 - RNA, 22 nt, Homo sapiens
uagcaagcuggccucuaccaca

SEQ ID NO: 1715712 - RNA, 16 nt, Homo sapiens
uagcaaggucauuucu

SEQ ID NO: 1715713 - RNA, 18 nt, Homo sapiens
uagcagggaaacagcuaa

SEQ ID NO: 1715714 - RNA, 17 nt, Homo sapiens
uagcagggaguacccag

SEQ ID NO: 1715715 - RNA, 19 nt, Homo sapiens
uagcagggaguacccagug

SEQ ID NO: 1715716 - RNA, 13 nt, Homo sapiens
uagcaucucagga

SEQ ID NO: 1715717 - RNA, 17 nt, Homo sapiens
uagccagcacuuguaua

SEQ ID NO: 1715718 - RNA, 23 nt, Homo sapiens
uagccaggguggucuugaucucc

SEQ ID NO: 1715719 - RNA, 15 nt, Homo sapiens
uagccauugaucaua

SEQ ID NO: 1715720 - RNA, 23 nt, Homo sapiens
uagcccaucccugccuggucaca

SEQ ID NO: 1715721 - RNA, 16 nt, Homo sapiens
uagccuaauacaacau

SEQ ID NO: 1715722 - RNA, 17 nt, Homo sapiens
uagccucgcucuuggca

SEQ ID NO: 1715723 - RNA, 19 nt, Homo sapiens
uagcuaaacggauuccaaa

SEQ ID NO: 1715724 - RNA, 14 nt, Homo sapiens
uagcuauggaauca

SEQ ID NO: 1715725 - RNA, 15 nt, Homo sapiens
uagcuauggaaucaa

SEQ ID NO: 1715726 - RNA, 13 nt, Homo sapiens
uagcuaugugacc

SEQ ID NO: 1715727 - RNA, 15 nt, Homo sapiens
uagcugggacuacag

SEQ ID NO: 1715728 - RNA, 18 nt, Homo sapiens
uagcugggacuacagggg

SEQ ID NO: 1715729 - RNA, 19 nt, Homo sapiens
uagcuuccugccccagaca

SEQ ID NO: 1715730 - RNA, 12 nt, Homo sapiens
uagcuugcuccc

SEQ ID NO: 1715731 - RNA, 22 nt, Homo sapiens
uagcuuuagggcaauauugcca

SEQ ID NO: 1715732 - RNA, 15 nt, Homo sapiens
uaggaaccuaugaaa

SEQ ID NO: 1715733 - RNA, 21 nt, Homo sapiens
uaggaacucaguccuguacuc

SEQ ID NO: 1715734 - RNA, 23 nt, Homo sapiens
uaggaauaagcucuaguucuuaa

SEQ ID NO: 1715735 - RNA, 14 nt, Homo sapiens
uaggagacuugcca

SEQ ID NO: 1715736 - RNA, 21 nt, Homo sapiens
uaggagcuaaggcucuaugag

SEQ ID NO: 1715737 - RNA, 19 nt, Homo sapiens
gggaagcggcccuaaggga

SEQ ID NO: 1715738 - RNA, 14 nt, Homo sapiens
gggaagcucagggg

SEQ ID NO: 1715739 - RNA, 23 nt, Homo sapiens
gggaagcuggcuuucuggcugcu

SEQ ID NO: 1715740 - RNA, 22 nt, Homo sapiens
gggaauccaagccuccacagcg

SEQ ID NO: 1715741 - RNA, 14 nt, Homo sapiens
gggacagagccaug

SEQ ID NO: 1715742 - RNA, 14 nt, Homo sapiens
gggacuccaugcug

SEQ ID NO: 1715743 - RNA, 20 nt, Homo sapiens
gggagacacuggccccucaa

SEQ ID NO: 1715744 - RNA, 22 nt, Homo sapiens
gggagauucaugcgaugugucc

SEQ ID NO: 1715745 - RNA, 22 nt, Homo sapiens
gggaggacaaaacuucuuguca

SEQ ID NO: 1715746 - RNA, 23 nt, Homo sapiens
gggaggcaagugugggggguccu

SEQ ID NO: 1715747 - RNA, 20 nt, Homo sapiens
gggaggcagagguugcagug

SEQ ID NO: 1715748 - RNA, 16 nt, Homo sapiens
gggaguccaggcacag

SEQ ID NO: 1715749 - RNA, 14 nt, Homo sapiens
gggauaagccagcu

SEQ ID NO: 1715750 - RNA, 19 nt, Homo sapiens
gggaucugucacaccagcc

SEQ ID NO: 1715751 - RNA, 23 nt, Homo sapiens
gggaucuuccuugggaugaucuu

SEQ ID NO: 1715752 - RNA, 19 nt, Homo sapiens
gggaugagccgcugugagc

SEQ ID NO: 1715753 - RNA, 17 nt, Homo sapiens
uaagccuaaaugccuua

SEQ ID NO: 1715754 - RNA, 14 nt, Homo sapiens
uaagcugauuaccu

SEQ ID NO: 1715755 - RNA, 14 nt, Homo sapiens
uaaggaagauaucu

SEQ ID NO: 1715756 - RNA, 14 nt, Homo sapiens
uaaggaggcacugc

SEQ ID NO: 1715757 - RNA, 18 nt, Homo sapiens
uaaggaugucacagggcc

SEQ ID NO: 1715758 - RNA, 16 nt, Homo sapiens
uaaggcuuuaguguau

SEQ ID NO: 1715759 - RNA, 13 nt, Homo sapiens
uaaggucacagcu

SEQ ID NO: 1715760 - RNA, 20 nt, Homo sapiens
uaaggucacauugugccuuu

SEQ ID NO: 1715761 - RNA, 17 nt, Homo sapiens
uaaguaacuucacauua

SEQ ID NO: 1715762 - RNA, 19 nt, Homo sapiens
uaaguacacaauaagcaaa

SEQ ID NO: 1715763 - RNA, 23 nt, Homo sapiens
uaaguacuguaauaauaccucaa

SEQ ID NO: 1715764 - RNA, 16 nt, Homo sapiens
uaagucaccuguauaa

SEQ ID NO: 1715765 - RNA, 14 nt, Homo sapiens
uaagucucugugaa

SEQ ID NO: 1715766 - RNA, 12 nt, Homo sapiens
uaagugugcaug

SEQ ID NO: 1715767 - RNA, 17 nt, Homo sapiens
uaaguucagcacuuguc

SEQ ID NO: 1715768 - RNA, 22 nt, Homo sapiens
uaaguugucuaaacaaugcuga

SEQ ID NO: 1715769 - RNA, 14 nt, Homo sapiens
uaaguuuaucuuuc

SEQ ID NO: 1715770 - RNA, 21 nt, Homo sapiens
uaauaaaacagcugucucuaa

SEQ ID NO: 1715771 - RNA, 19 nt, Homo sapiens
uaauaaaacuaaacuuuca

SEQ ID NO: 1715772 - RNA, 13 nt, Homo sapiens
uaauaaacauccu

SEQ ID NO: 1715773 - RNA, 14 nt, Homo sapiens
uaauaauaaucuag

SEQ ID NO: 1715774 - RNA, 16 nt, Homo sapiens
uaauacguuaauacgc

SEQ ID NO: 1715775 - RNA, 13 nt, Homo sapiens
uaauagcauucau

SEQ ID NO: 1715776 - RNA, 22 nt, Homo sapiens
uaauauaaaaagcuuccaugau

SEQ ID NO: 1715777 - RNA, 16 nt, Homo sapiens
uaauauggacauuuau

SEQ ID NO: 1715778 - RNA, 18 nt, Homo sapiens
uaauauuguuugugaugg

SEQ ID NO: 1715779 - RNA, 16 nt, Homo sapiens
uaaucacaaauuucac

SEQ ID NO: 1715780 - RNA, 22 nt, Homo sapiens
uaaucagguccucagagaauuu

SEQ ID NO: 1715781 - RNA, 19 nt, Homo sapiens
uaaucccagcuacucagga

SEQ ID NO: 1715782 - RNA, 21 nt, Homo sapiens
uaaucugucaaaacacugugg

SEQ ID NO: 1715783 - RNA, 15 nt, Homo sapiens
uaaucuucauggcca

SEQ ID NO: 1715784 - RNA, 22 nt, Homo sapiens
uaaugaaauaauguacaucugg

SEQ ID NO: 1715785 - RNA, 14 nt, Homo sapiens
uaaugaacauguga

SEQ ID NO: 1715786 - RNA, 19 nt, Homo sapiens
uaaugacaaugaagugaca

SEQ ID NO: 1715787 - RNA, 15 nt, Homo sapiens
uaaugauaaaguaau

SEQ ID NO: 1715788 - RNA, 20 nt, Homo sapiens
uaauggaagagaaaucucau

SEQ ID NO: 1715789 - RNA, 17 nt, Homo sapiens
uaauggcaauaggacau

SEQ ID NO: 1715790 - RNA, 18 nt, Homo sapiens
uaaugguuuuuaacaccu

SEQ ID NO: 1715791 - RNA, 14 nt, Homo sapiens
uaauguacaucugg

SEQ ID NO: 1715792 - RNA, 22 nt, Homo sapiens
uaaugucuucauaaaguacuug

SEQ ID NO: 1715793 - RNA, 20 nt, Homo sapiens
uaauguuuuguaauuuugca

SEQ ID NO: 1715794 - RNA, 15 nt, Homo sapiens
uaauuaaaaugauag

SEQ ID NO: 1715795 - RNA, 23 nt, Homo sapiens
uaauuaaauuuugaguucuacau

SEQ ID NO: 1715796 - RNA, 13 nt, Homo sapiens
uaauuacaccaua

SEQ ID NO: 1715797 - RNA, 18 nt, Homo sapiens
uaauuaggguacauuuau

SEQ ID NO: 1715798 - RNA, 14 nt, Homo sapiens
uaauuccaauauga

SEQ ID NO: 1715799 - RNA, 17 nt, Homo sapiens
uaauuccuacagcacua

SEQ ID NO: 1715800 - RNA, 14 nt, Homo sapiens
uaauucuggagaua

SEQ ID NO: 1715801 - RNA, 19 nt, Homo sapiens
uaauuguuuaaaaugccuc

SEQ ID NO: 1715802 - RNA, 19 nt, Homo sapiens
uaauuuucuagauuuucua

SEQ ID NO: 1715803 - RNA, 15 nt, Homo sapiens
uacaaaauccagcua

SEQ ID NO: 1715804 - RNA, 14 nt, Homo sapiens
uacaaaguauuugc

SEQ ID NO: 1715805 - RNA, 12 nt, Homo sapiens
uacaacauguag

SEQ ID NO: 1715806 - RNA, 20 nt, Homo sapiens
uacaagauugaaaaucuugu

SEQ ID NO: 1715807 - RNA, 13 nt, Homo sapiens
uacaaguguauau

SEQ ID NO: 1715808 - RNA, 19 nt, Homo sapiens
uacaaucagccacauucua

SEQ ID NO: 1715809 - RNA, 19 nt, Homo sapiens
uacaaugaaguuaagguua

SEQ ID NO: 1715810 - RNA, 18 nt, Homo sapiens
uacaauuggcacuaaaga

SEQ ID NO: 1715811 - RNA, 12 nt, Homo sapiens
uacaauugugag

SEQ ID NO: 1715812 - RNA, 13 nt, Homo sapiens
uacaauugugagc

SEQ ID NO: 1715813 - RNA, 19 nt, Homo sapiens
uacaauugugggcauaaac

SEQ ID NO: 1715814 - RNA, 12 nt, Homo sapiens
uacaauuucacu

SEQ ID NO: 1715815 - RNA, 20 nt, Homo sapiens
uacaauuucacuuagucugu

SEQ ID NO: 1715816 - RNA, 15 nt, Homo sapiens
uacacauauaccuau

SEQ ID NO: 1715817 - RNA, 14 nt, Homo sapiens
uacaccaaugccca

SEQ ID NO: 1715818 - RNA, 17 nt, Homo sapiens
uacaccuuagugcagcg

SEQ ID NO: 1715819 - RNA, 11 nt, Homo sapiens
uacacuggguu

SEQ ID NO: 1715820 - RNA, 22 nt, Homo sapiens
uacacuuguauaaauguauaua

SEQ ID NO: 1715821 - RNA, 13 nt, Homo sapiens
uacacuugugauu

SEQ ID NO: 1715822 - RNA, 19 nt, Homo sapiens
uacagauagaguuccauau

SEQ ID NO: 1715823 - RNA, 23 nt, Homo sapiens
uacagcaugugccuuaaugcuuc

SEQ ID NO: 1715824 - RNA, 20 nt, Homo sapiens
uacagcuaucgaacuucaca

SEQ ID NO: 1715825 - RNA, 14 nt, Homo sapiens
uacagcucuggcca

SEQ ID NO: 1715826 - RNA, 21 nt, Homo sapiens
uacaggaagcaccccaugcca

SEQ ID NO: 1715827 - RNA, 14 nt, Homo sapiens
uacaggcgugagcc

SEQ ID NO: 1715828 - RNA, 13 nt, Homo sapiens
uacaggugugaac

SEQ ID NO: 1715829 - RNA, 16 nt, Homo sapiens
uacaggugugagucac

SEQ ID NO: 1715830 - RNA, 19 nt, Homo sapiens
uacaguauguuuuacaugu

SEQ ID NO: 1715831 - RNA, 19 nt, Homo sapiens
uacagugccaacuccucac

SEQ ID NO: 1715832 - RNA, 21 nt, Homo sapiens
uacaguuauuaaucuggacau

SEQ ID NO: 1715833 - RNA, 14 nt, Homo sapiens
uacauaacugccuu

SEQ ID NO: 1715834 - RNA, 13 nt, Homo sapiens
uacauaaguaauu

SEQ ID NO: 1715835 - RNA, 22 nt, Homo sapiens
uacauauguagacuauauacau

SEQ ID NO: 1715836 - RNA, 21 nt, Homo sapiens
gccugucccauggacacucca

SEQ ID NO: 1715837 - RNA, 16 nt, Homo sapiens
gccugucugagacuca

SEQ ID NO: 1715838 - RNA, 14 nt, Homo sapiens
gccugugaugcugg

SEQ ID NO: 1715839 - RNA, 13 nt, Homo sapiens
gccugugcaugua

SEQ ID NO: 1715840 - RNA, 20 nt, Homo sapiens
gccugugguuaacaucucag

SEQ ID NO: 1715841 - RNA, 22 nt, Homo sapiens
gccuuagaaauguaaacugcca

SEQ ID NO: 1715842 - RNA, 23 nt, Homo sapiens
gccuuagaaauguaaacugccau

SEQ ID NO: 1715843 - RNA, 21 nt, Homo sapiens
gccuuagccgcccaugcacug

SEQ ID NO: 1715844 - RNA, 18 nt, Homo sapiens
gccuuagucucaguuugu

SEQ ID NO: 1715845 - RNA, 12 nt, Homo sapiens
gccuuagugggc

SEQ ID NO: 1715846 - RNA, 13 nt, Homo sapiens
gccuucucaggaa

SEQ ID NO: 1715847 - RNA, 16 nt, Homo sapiens
gccuugaaaccaccuu

SEQ ID NO: 1715848 - RNA, 20 nt, Homo sapiens
gccuugagucaucuauucaa

SEQ ID NO: 1715849 - RNA, 23 nt, Homo sapiens
gccuugccuaaauuuaaugcugc

SEQ ID NO: 1715850 - RNA, 18 nt, Homo sapiens
gccuuggggaggacaaaa

SEQ ID NO: 1715851 - RNA, 15 nt, Homo sapiens
gccuuugacauuuaa

SEQ ID NO: 1715852 - RNA, 13 nt, Homo sapiens
gccuuugcuuaag

SEQ ID NO: 1715853 - RNA, 18 nt, Homo sapiens
gccuuuuucauuuuccaa

SEQ ID NO: 1715854 - RNA, 13 nt, Homo sapiens
gcgaauaacaguc

SEQ ID NO: 1715855 - RNA, 22 nt, Homo sapiens
gcgcacacacacacacacacau

SEQ ID NO: 1715856 - RNA, 23 nt, Homo sapiens
gcgccccugccaccucccugacc

SEQ ID NO: 1715857 - RNA, 16 nt, Homo sapiens
gcgcccuggguggugg

SEQ ID NO: 1715858 - RNA, 11 nt, Homo sapiens
gcgcgcugagc

SEQ ID NO: 1715859 - RNA, 20 nt, Homo sapiens
gcgcugaguauggagcagcc

SEQ ID NO: 1715860 - RNA, 19 nt, Homo sapiens
gcggaaggucccucagaca

SEQ ID NO: 1715861 - RNA, 19 nt, Homo sapiens
gcggagucuguccugugac

SEQ ID NO: 1715862 - RNA, 17 nt, Homo sapiens
gcggcuggaaucaguca

SEQ ID NO: 1715863 - RNA, 16 nt, Homo sapiens
gcggggaccccagaaa

SEQ ID NO: 1715864 - RNA, 14 nt, Homo sapiens
gcgucuaugcugcu

SEQ ID NO: 1715865 - RNA, 19 nt, Homo sapiens
gcgugaaucuguaucuugc

SEQ ID NO: 1715866 - RNA, 21 nt, Homo sapiens
gcgugcucccgaugcugcuau

SEQ ID NO: 1715867 - RNA, 16 nt, Homo sapiens
gcguggacucugcaca

SEQ ID NO: 1715868 - RNA, 20 nt, Homo sapiens
gcguggacucugcacauguc

SEQ ID NO: 1715869 - RNA, 23 nt, Homo sapiens
gcguggcggagcugcugcugcuc

SEQ ID NO: 1715870 - RNA, 23 nt, Homo sapiens
gcguuacacccuuucuugacaaa

SEQ ID NO: 1715871 - RNA, 21 nt, Homo sapiens
gcguuauaguaacucccauca

SEQ ID NO: 1715872 - RNA, 22 nt, Homo sapiens
gcguucacuccaaugucugcug

SEQ ID NO: 1715873 - RNA, 21 nt, Homo sapiens
gcguuguuacaggaagucccu

SEQ ID NO: 1715874 - RNA, 21 nt, Homo sapiens
gcuaaagagcuuugugauaua

SEQ ID NO: 1715875 - RNA, 18 nt, Homo sapiens
gcuaaaggaagugaaucu

SEQ ID NO: 1715876 - RNA, 20 nt, Homo sapiens
gcuaacccccuucuacugag

SEQ ID NO: 1715877 - RNA, 20 nt, Homo sapiens
gcuaacuauauuugcuuuuu

SEQ ID NO: 1715878 - RNA, 15 nt, Homo sapiens
gcuaagggugggugc

SEQ ID NO: 1715879 - RNA, 21 nt, Homo sapiens
gcuaaucaaagccagggucuc

SEQ ID NO: 1715880 - RNA, 21 nt, Homo sapiens
gcuaauugcuggcuggcugcc

SEQ ID NO: 1715881 - RNA, 22 nt, Homo sapiens
gcuacuccccagaccucaggga

SEQ ID NO: 1715882 - RNA, 15 nt, Homo sapiens
gcuagggaaagggau

SEQ ID NO: 1715883 - RNA, 11 nt, Homo sapiens
gcuaugugcac

SEQ ID NO: 1715884 - RNA, 13 nt, Homo sapiens
gcucaauuccuuc

SEQ ID NO: 1715885 - RNA, 19 nt, Homo sapiens
gcucacaaaccaugcaaau

SEQ ID NO: 1715886 - RNA, 12 nt, Homo sapiens
gcucacaaagag

SEQ ID NO: 1715887 - RNA, 13 nt, Homo sapiens
gcucacaguacag

SEQ ID NO: 1715888 - RNA, 13 nt, Homo sapiens
gcucagaacagua

SEQ ID NO: 1715889 - RNA, 15 nt, Homo sapiens
gcucagaacaguauc

SEQ ID NO: 1715890 - RNA, 21 nt, Homo sapiens
gcucagaacaguaucuuugca

SEQ ID NO: 1715891 - RNA, 15 nt, Homo sapiens
gcucagaauaaggca

SEQ ID NO: 1715892 - RNA, 16 nt, Homo sapiens
gcucagugccuggaca

SEQ ID NO: 1715893 - RNA, 20 nt, Homo sapiens
gcucaugucuauaaucccag

SEQ ID NO: 1715894 - RNA, 17 nt, Homo sapiens
gcucauuuuuucuuaca

SEQ ID NO: 1715895 - RNA, 14 nt, Homo sapiens
gcuccaggccugca

SEQ ID NO: 1715896 - RNA, 12 nt, Homo sapiens
gcucccaugacc

SEQ ID NO: 1715897 - RNA, 17 nt, Homo sapiens
gcucccuaggagaccaa

SEQ ID NO: 1715898 - RNA, 23 nt, Homo sapiens
gcucccucacccaggcacugggc

SEQ ID NO: 1715899 - RNA, 16 nt, Homo sapiens
gcuccgcugcuccuug

SEQ ID NO: 1715900 - RNA, 17 nt, Homo sapiens
gcuccuaguuugaccuc

SEQ ID NO: 1715901 - RNA, 21 nt, Homo sapiens
gcuccuccccacuagcauuuu

SEQ ID NO: 1715902 - RNA, 21 nt, Homo sapiens
gcucuccccaaacuugcuuua

SEQ ID NO: 1715903 - RNA, 19 nt, Homo sapiens
gcucugagaaaccucggga

SEQ ID NO: 1715904 - RNA, 22 nt, Homo sapiens
gcucugcaaugggcacugggau

SEQ ID NO: 1715905 - RNA, 21 nt, Homo sapiens
gcucugcaauuccccucugcu

SEQ ID NO: 1715906 - RNA, 18 nt, Homo sapiens
gcucugcuucuccaagga

SEQ ID NO: 1715907 - RNA, 15 nt, Homo sapiens
gcucuucacuguggu

SEQ ID NO: 1715908 - RNA, 17 nt, Homo sapiens
gcucuuguucuacugag

SEQ ID NO: 1715909 - RNA, 16 nt, Homo sapiens
gcucuuugcugcacua

SEQ ID NO: 1715910 - RNA, 15 nt, Homo sapiens
gcugaaaaaacaccu

SEQ ID NO: 1715911 - RNA, 19 nt, Homo sapiens
gcugaaaaaucauccaaga

SEQ ID NO: 1715912 - RNA, 15 nt, Homo sapiens
gcugaaaguucuugc

SEQ ID NO: 1715913 - RNA, 18 nt, Homo sapiens
gcugagugaaugaacaaa

SEQ ID NO: 1715914 - RNA, 20 nt, Homo sapiens
gcugagugggagaaggcagu

SEQ ID NO: 1715915 - RNA, 13 nt, Homo sapiens
gcugcaccugguc

SEQ ID NO: 1715916 - RNA, 21 nt, Homo sapiens
gcugcacucaagcuuggguga

SEQ ID NO: 1715917 - RNA, 14 nt, Homo sapiens
gcugccacaaccag

SEQ ID NO: 1715918 - RNA, 13 nt, Homo sapiens
gcugcccacuguu

SEQ ID NO: 1715919 - RNA, 20 nt, Homo sapiens
gcugccccaaccugcugaag

SEQ ID NO: 1715920 - RNA, 21 nt, Homo sapiens
gcugccugcaaugcagggcau

SEQ ID NO: 1715921 - RNA, 15 nt, Homo sapiens
gcugcugccuggcca

SEQ ID NO: 1715922 - RNA, 23 nt, Homo sapiens
gcugcugcuuagcuugcaccuug

SEQ ID NO: 1715923 - RNA, 21 nt, Homo sapiens
gcugcuggggccucagacgag

SEQ ID NO: 1715924 - RNA, 17 nt, Homo sapiens
gcugcugggucaggcca

SEQ ID NO: 1715925 - RNA, 17 nt, Homo sapiens
gcugcuuagacauaaca

SEQ ID NO: 1715926 - RNA, 21 nt, Homo sapiens
gcugcuucuguguguggugag

SEQ ID NO: 1715927 - RNA, 14 nt, Homo sapiens
gcugcuuuguucaa

SEQ ID NO: 1715928 - RNA, 17 nt, Homo sapiens
gcugcuuuguucaaugc

SEQ ID NO: 1715929 - RNA, 15 nt, Homo sapiens
gcuggaaggggucca

SEQ ID NO: 1715930 - RNA, 15 nt, Homo sapiens
gcuggacaugcugac

SEQ ID NO: 1715931 - RNA, 21 nt, Homo sapiens
gcuggaccaguggugccuugg

SEQ ID NO: 1715932 - RNA, 15 nt, Homo sapiens
gcuggagugcaguga

SEQ ID NO: 1715933 - RNA, 18 nt, Homo sapiens
gcuggagugcaguggugu

SEQ ID NO: 1715934 - RNA, 20 nt, Homo sapiens
gcuggagugcagugguguga

SEQ ID NO: 1715935 - RNA, 16 nt, Homo sapiens
gcuggcaagucuucca

SEQ ID NO: 1715936 - RNA, 15 nt, Homo sapiens
gcuggcacuauccag

SEQ ID NO: 1715937 - RNA, 17 nt, Homo sapiens
gcuggcagaaagggaac

SEQ ID NO: 1715938 - RNA, 22 nt, Homo sapiens
gcuggcagaaagggaacagaaa

SEQ ID NO: 1715939 - RNA, 15 nt, Homo sapiens
gcuggcccagccaaa

SEQ ID NO: 1715940 - RNA, 14 nt, Homo sapiens
gcuggcgugcagug

SEQ ID NO: 1715941 - RNA, 20 nt, Homo sapiens
gcuggcgugcaguggugcga

SEQ ID NO: 1715942 - RNA, 17 nt, Homo sapiens
gcuggcucacaguacag

SEQ ID NO: 1715943 - RNA, 22 nt, Homo sapiens
gcugggaagacgccugagcuca

SEQ ID NO: 1715944 - RNA, 16 nt, Homo sapiens
gcugggacuacaggug

SEQ ID NO: 1715945 - RNA, 17 nt, Homo sapiens
gauuuaauuuccagggu

SEQ ID NO: 1715946 - RNA, 22 nt, Homo sapiens
gauuuaugaugcacuuauucaa

SEQ ID NO: 1715947 - RNA, 15 nt, Homo sapiens
gauuucagcagggau

SEQ ID NO: 1715948 - RNA, 23 nt, Homo sapiens
gauuucaugccuggugcuuccaa

SEQ ID NO: 1715949 - RNA, 17 nt, Homo sapiens
gauuuccuccuggccuu

SEQ ID NO: 1715950 - RNA, 23 nt, Homo sapiens
cugaacaaacuaaaggugcacug

SEQ ID NO: 1715951 - RNA, 17 nt, Homo sapiens
cugaaccgcacagcuca

SEQ ID NO: 1715952 - RNA, 20 nt, Homo sapiens
cugaagauugcgguuuacag

SEQ ID NO: 1715953 - RNA, 11 nt, Homo sapiens
cugaagcccau

SEQ ID NO: 1715954 - RNA, 16 nt, Homo sapiens
cugaagcccauuucuc

SEQ ID NO: 1715955 - RNA, 20 nt, Homo sapiens
cugaaguacuaacacaagga

SEQ ID NO: 1715956 - RNA, 13 nt, Homo sapiens
cugaagucacaca

SEQ ID NO: 1715957 - RNA, 14 nt, Homo sapiens
cugaagucacauca

SEQ ID NO: 1715958 - RNA, 21 nt, Homo sapiens
cugaagucaccucuugguuac

SEQ ID NO: 1715959 - RNA, 13 nt, Homo sapiens
cugaagugcuuag

SEQ ID NO: 1715960 - RNA, 14 nt, Homo sapiens
cugaaguggcuaaa

SEQ ID NO: 1715961 - RNA, 20 nt, Homo sapiens
cugaauucuuuuucauuuga

SEQ ID NO: 1715962 - RNA, 19 nt, Homo sapiens
cugaauuuggccugcacua

SEQ ID NO: 1715963 - RNA, 12 nt, Homo sapiens
cugacacaggaa

SEQ ID NO: 1715964 - RNA, 13 nt, Homo sapiens
cugacacaggaaa

SEQ ID NO: 1715965 - RNA, 21 nt, Homo sapiens
cugacagaaggugccacuuua

SEQ ID NO: 1715966 - RNA, 13 nt, Homo sapiens
cugacccuagcuc

SEQ ID NO: 1715967 - RNA, 15 nt, Homo sapiens
cugaccucacuguga

SEQ ID NO: 1715968 - RNA, 16 nt, Homo sapiens
cugaccucccagugac

SEQ ID NO: 1715969 - RNA, 17 nt, Homo sapiens
ccugaauuuuguugcug

SEQ ID NO: 1715970 - RNA, 18 nt, Homo sapiens
ccugacaucacagcagcc

SEQ ID NO: 1715971 - RNA, 16 nt, Homo sapiens
ccugaccugagccaga

SEQ ID NO: 1715972 - RNA, 20 nt, Homo sapiens
ccugagaaccccucugggaa

SEQ ID NO: 1715973 - RNA, 12 nt, Homo sapiens
ccugagaucccc

SEQ ID NO: 1715974 - RNA, 22 nt, Homo sapiens
ccugagcaggaaaguuuaccca

SEQ ID NO: 1715975 - RNA, 21 nt, Homo sapiens
ccugaggugaaagggagcuau

SEQ ID NO: 1715976 - RNA, 23 nt, Homo sapiens
ccugaguuggccaggcauggugg

SEQ ID NO: 1715977 - RNA, 20 nt, Homo sapiens
ccugauggaaguaaagccuc

SEQ ID NO: 1715978 - RNA, 11 nt, Homo sapiens
ccugcacacaa

SEQ ID NO: 1715979 - RNA, 23 nt, Homo sapiens
ccugcacuggggagcccgucuca

SEQ ID NO: 1715980 - RNA, 18 nt, Homo sapiens
ccugcagaaguacuccua

SEQ ID NO: 1715981 - RNA, 12 nt, Homo sapiens
ccugcagcacgg

SEQ ID NO: 1715982 - RNA, 19 nt, Homo sapiens
ccugcagggacuccaugcu

SEQ ID NO: 1715983 - RNA, 16 nt, Homo sapiens
ccugcaugugcuguca

SEQ ID NO: 1715984 - RNA, 16 nt, Homo sapiens
ccugcccugcugccgc

SEQ ID NO: 1715985 - RNA, 10 nt, Homo sapiens
ccugccugua

SEQ ID NO: 1715986 - RNA, 22 nt, Homo sapiens
ccugccuuuuaacguagauaua

SEQ ID NO: 1715987 - RNA, 23 nt, Homo sapiens
ccugcgcucucagcugaccauca

SEQ ID NO: 1715988 - RNA, 13 nt, Homo sapiens
ccugcgucuuccg

SEQ ID NO: 1715989 - RNA, 21 nt, Homo sapiens
ccugcucuucuaccauuugaa

SEQ ID NO: 1715990 - RNA, 14 nt, Homo sapiens
ccuggacacuguac

SEQ ID NO: 1715991 - RNA, 20 nt, Homo sapiens
ccuggacugggagguagaua

SEQ ID NO: 1715992 - RNA, 15 nt, Homo sapiens
ccuggaggcacugaa

SEQ ID NO: 1715993 - RNA, 15 nt, Homo sapiens
ccuggcacacaucag

SEQ ID NO: 1715994 - RNA, 18 nt, Homo sapiens
ccuggcacuaacguugag

SEQ ID NO: 1715995 - RNA, 23 nt, Homo sapiens
ccuggcauuauguccacugugua

SEQ ID NO: 1715996 - RNA, 22 nt, Homo sapiens
ccuggcauucuuguacagugua

SEQ ID NO: 1715997 - RNA, 18 nt, Homo sapiens
ccuggccaacauggcaaa

SEQ ID NO: 1715998 - RNA, 18 nt, Homo sapiens
ccuggcccaaccagacuu

SEQ ID NO: 1715999 - RNA, 21 nt, Homo sapiens
ccuggccgcguuuagaccaag

SEQ ID NO: 1716000 - RNA, 16 nt, Homo sapiens
ccuggcucugcaaugg

SEQ ID NO: 1716001 - RNA, 16 nt, Homo sapiens
ccugggcccuuccuau

SEQ ID NO: 1716002 - RNA, 18 nt, Homo sapiens
ccugggcugaccccggug

SEQ ID NO: 1716003 - RNA, 21 nt, Homo sapiens
ccugggguagccuccuaucca

SEQ ID NO: 1716004 - RNA, 14 nt, Homo sapiens
ccugguccuggaca

SEQ ID NO: 1716005 - RNA, 13 nt, Homo sapiens
ccuggugcugaga

SEQ ID NO: 1716006 - RNA, 22 nt, Homo sapiens
ccuggugucugcccugcuggga

SEQ ID NO: 1716007 - RNA, 20 nt, Homo sapiens
ccuguaaucccaacacuuug

SEQ ID NO: 1716008 - RNA, 15 nt, Homo sapiens
ccuguagucccagcu

SEQ ID NO: 1716009 - RNA, 14 nt, Homo sapiens
ccuguauacuuuag

SEQ ID NO: 1716010 - RNA, 19 nt, Homo sapiens
ccugucauccuuggucuuu

SEQ ID NO: 1716011 - RNA, 23 nt, Homo sapiens
ccuguccaucagccaggacaguc

SEQ ID NO: 1716012 - RNA, 16 nt, Homo sapiens
ccugucuccacugugc

SEQ ID NO: 1716013 - RNA, 16 nt, Homo sapiens
ccugucuugcugucau

SEQ ID NO: 1716014 - RNA, 18 nt, Homo sapiens
ccugugaaccaacacaga

SEQ ID NO: 1716015 - RNA, 16 nt, Homo sapiens
ccugugacugucucac

SEQ ID NO: 1716016 - RNA, 15 nt, Homo sapiens
ccugugcuaauccca

SEQ ID NO: 1716017 - RNA, 22 nt, Homo sapiens
ccugugcugaauguggacucaa

SEQ ID NO: 1716018 - RNA, 17 nt, Homo sapiens
ccugugugccauuuuaa

SEQ ID NO: 1716019 - RNA, 18 nt, Homo sapiens
ccuguuggcucacagggc

SEQ ID NO: 1716020 - RNA, 17 nt, Homo sapiens
ccuuaacccaaggagca

SEQ ID NO: 1716021 - RNA, 12 nt, Homo sapiens
ccuuacccaaac

SEQ ID NO: 1716022 - RNA, 14 nt, Homo sapiens
ccuuaccgcucugu

SEQ ID NO: 1716023 - RNA, 15 nt, Homo sapiens
ccuuagcuggcauua

SEQ ID NO: 1716024 - RNA, 15 nt, Homo sapiens
ccuuagucucaaggg

SEQ ID NO: 1716025 - RNA, 14 nt, Homo sapiens
ccuuauccugcauu

SEQ ID NO: 1716026 - RNA, 16 nt, Homo sapiens
ccuucagacacccuca

SEQ ID NO: 1716027 - RNA, 16 nt, Homo sapiens
ccuucagcuccaggga

SEQ ID NO: 1716028 - RNA, 21 nt, Homo sapiens
ccuuccaaauaauaaagucua

SEQ ID NO: 1716029 - RNA, 20 nt, Homo sapiens
ccuuccagaucacugccaca

SEQ ID NO: 1716030 - RNA, 17 nt, Homo sapiens
ccuuccagcuccuguaa

SEQ ID NO: 1716031 - RNA, 19 nt, Homo sapiens
ccuucccaaucagcacuga

SEQ ID NO: 1716032 - RNA, 23 nt, Homo sapiens
ccuuccccagcgucccagucucu

SEQ ID NO: 1716033 - RNA, 13 nt, Homo sapiens
ccuucccuuccac

SEQ ID NO: 1716034 - RNA, 19 nt, Homo sapiens
ccuuccgacccucugggaa

SEQ ID NO: 1716035 - RNA, 18 nt, Homo sapiens
ccuucggcagcuacucag

SEQ ID NO: 1716036 - RNA, 23 nt, Homo sapiens
ccuucucugaacacaggcagcuu

SEQ ID NO: 1716037 - RNA, 17 nt, Homo sapiens
ccuucucugugcaguag

SEQ ID NO: 1716038 - RNA, 14 nt, Homo sapiens
ccuucuguggcuca

SEQ ID NO: 1716039 - RNA, 11 nt, Homo sapiens
ccuucuuucac

SEQ ID NO: 1716040 - RNA, 13 nt, Homo sapiens
ccuugaugcacag

SEQ ID NO: 1716041 - RNA, 14 nt, Homo sapiens
ccuugcuagcugac

SEQ ID NO: 1716042 - RNA, 21 nt, Homo sapiens
ccuugcuggacggggacuggg

SEQ ID NO: 1716043 - RNA, 13 nt, Homo sapiens
ccuuggcugugag

SEQ ID NO: 1716044 - RNA, 16 nt, Homo sapiens
ccuuggcuucugugau

SEQ ID NO: 1716045 - RNA, 15 nt, Homo sapiens
ccuugggaugaucuu

SEQ ID NO: 1716046 - RNA, 16 nt, Homo sapiens
ccuugggcugcuccuc

SEQ ID NO: 1716047 - RNA, 14 nt, Homo sapiens
ccuugugucuguac

SEQ ID NO: 1716048 - RNA, 17 nt, Homo sapiens
ccuuuaguaccugaaaa

SEQ ID NO: 1716049 - RNA, 16 nt, Homo sapiens
ccuuucaccacaugug

SEQ ID NO: 1716050 - RNA, 20 nt, Homo sapiens
ccuuucaccacaugugcaca

SEQ ID NO: 1716051 - RNA, 17 nt, Homo sapiens
cucagucccaucagaga

SEQ ID NO: 1716052 - RNA, 22 nt, Homo sapiens
cucagugagauauuugguacca

SEQ ID NO: 1716053 - RNA, 23 nt, Homo sapiens
cucagugagauauuugguaccau

SEQ ID NO: 1716054 - RNA, 19 nt, Homo sapiens
cucaguuugugugucuuaa

SEQ ID NO: 1716055 - RNA, 13 nt, Homo sapiens
cucauaagcaaua

SEQ ID NO: 1716056 - RNA, 21 nt, Homo sapiens
cucauauuuaaagacagggaa

SEQ ID NO: 1716057 - RNA, 14 nt, Homo sapiens
cucaucuuacugua

SEQ ID NO: 1716058 - RNA, 15 nt, Homo sapiens
cucaucuuacuguac

SEQ ID NO: 1716059 - RNA, 20 nt, Homo sapiens
cucaugccuguaaucccagc

SEQ ID NO: 1716060 - RNA, 14 nt, Homo sapiens
cucaugcugcucaa

SEQ ID NO: 1716061 - RNA, 15 nt, Homo sapiens
cucauguuuaugaaa

SEQ ID NO: 1716062 - RNA, 13 nt, Homo sapiens
cucauugaaaugu

SEQ ID NO: 1716063 - RNA, 15 nt, Homo sapiens
cucauugaaauguca

SEQ ID NO: 1716064 - RNA, 13 nt, Homo sapiens
cucauugcagcua

SEQ ID NO: 1716065 - RNA, 14 nt, Homo sapiens
cuccaaacauuacu

SEQ ID NO: 1716066 - RNA, 20 nt, Homo sapiens
cuccaaaggucugaugucuc

SEQ ID NO: 1716067 - RNA, 20 nt, Homo sapiens
cuccaagguagaauuugcaa

SEQ ID NO: 1716068 - RNA, 19 nt, Homo sapiens
cuccaaugucugcugagga

SEQ ID NO: 1716069 - RNA, 21 nt, Homo sapiens
cuccaccuaccacucacauga

SEQ ID NO: 1716070 - RNA, 19 nt, Homo sapiens
cuccacuggccuccuggca

SEQ ID NO: 1716071 - RNA, 20 nt, Homo sapiens
cuccacugugccuuugcaaa

SEQ ID NO: 1716072 - RNA, 21 nt, Homo sapiens
cuccagaauuuggaaauccua

SEQ ID NO: 1716073 - RNA, 23 nt, Homo sapiens
ccaguuucagagaaauacuuuca

SEQ ID NO: 1716074 - RNA, 20 nt, Homo sapiens
ccauacuucuguuuccaucu

SEQ ID NO: 1716075 - RNA, 21 nt, Homo sapiens
ccauaguaguaugaugauaca

SEQ ID NO: 1716076 - RNA, 21 nt, Homo sapiens
ccauauauaacagauacauuu

SEQ ID NO: 1716077 - RNA, 23 nt, Homo sapiens
ccaucccucgugguccccaacag

SEQ ID NO: 1716078 - RNA, 13 nt, Homo sapiens
ccauccugccauc

SEQ ID NO: 1716079 - RNA, 15 nt, Homo sapiens
ccaucuaagcugcag

SEQ ID NO: 1716080 - RNA, 16 nt, Homo sapiens
ccaucucugauuuuca

SEQ ID NO: 1716081 - RNA, 22 nt, Homo sapiens
ccaucuucuaaacccaauccaa

SEQ ID NO: 1716082 - RNA, 19 nt, Homo sapiens
ccaucuugcaucauugaaa

SEQ ID NO: 1716083 - RNA, 15 nt, Homo sapiens
ccaugaagacaggau

SEQ ID NO: 1716084 - RNA, 21 nt, Homo sapiens
ccaugaagcgaaacacagaga

SEQ ID NO: 1716085 - RNA, 22 nt, Homo sapiens
ccaugaagcgaaacacagagaa

SEQ ID NO: 1716086 - RNA, 16 nt, Homo sapiens
ccaugagaaucuuaau

SEQ ID NO: 1716087 - RNA, 19 nt, Homo sapiens
ccaugaggaaggaacagca

SEQ ID NO: 1716088 - RNA, 20 nt, Homo sapiens
ccaugaggcaaugucaggaa

SEQ ID NO: 1716089 - RNA, 13 nt, Homo sapiens
ccaugcaauucau

SEQ ID NO: 1716090 - RNA, 17 nt, Homo sapiens
ccaugcagggggcuccu

SEQ ID NO: 1716091 - RNA, 13 nt, Homo sapiens
ccauguaucuuuu

SEQ ID NO: 1716092 - RNA, 23 nt, Homo sapiens
ccauguaucuuuugaacuggcaa

SEQ ID NO: 1716093 - RNA, 10 nt, Homo sapiens
ccauguccaa

SEQ ID NO: 1716094 - RNA, 14 nt, Homo sapiens
ccauguccaaagag

SEQ ID NO: 1716095 - RNA, 21 nt, Homo sapiens
ccauguccaaagaggcugccc

SEQ ID NO: 1716096 - RNA, 19 nt, Homo sapiens
ccaugucgccucugcauuc

SEQ ID NO: 1716097 - RNA, 17 nt, Homo sapiens
ccauguuguaaugcugc

SEQ ID NO: 1716098 - RNA, 13 nt, Homo sapiens
ccauucacaauaa

SEQ ID NO: 1716099 - RNA, 21 nt, Homo sapiens
ccauucauacccacacaccca

SEQ ID NO: 1716100 - RNA, 19 nt, Homo sapiens
ccauucugccgcccccucc

SEQ ID NO: 1716101 - RNA, 15 nt, Homo sapiens
ccauugguccaagau

SEQ ID NO: 1716102 - RNA, 17 nt, Homo sapiens
ccauuuauccacaggaa

SEQ ID NO: 1716103 - RNA, 13 nt, Homo sapiens
ccauuuccugaga

SEQ ID NO: 1716104 - RNA, 23 nt, Homo sapiens
ccauuuucuuauugcgcugcuac

SEQ ID NO: 1716105 - RNA, 14 nt, Homo sapiens
cccaaaacaaagua

SEQ ID NO: 1716106 - RNA, 19 nt, Homo sapiens
cccaaaagucaccacucca

SEQ ID NO: 1716107 - RNA, 16 nt, Homo sapiens
cccaaggaugcuguca

SEQ ID NO: 1716108 - RNA, 18 nt, Homo sapiens
cccaaggcucaugguccu

SEQ ID NO: 1716109 - RNA, 18 nt, Homo sapiens
cccaagugaaaucaaagg

SEQ ID NO: 1716110 - RNA, 22 nt, Homo sapiens
cccaaguggugaaugacacgcc

SEQ ID NO: 1716111 - RNA, 19 nt, Homo sapiens
cccaaucuccaucugucaa

SEQ ID NO: 1716112 - RNA, 16 nt, Homo sapiens
cccacaacgacuuuau

SEQ ID NO: 1716113 - RNA, 13 nt, Homo sapiens
cccacaacuuuaa

SEQ ID NO: 1716114 - RNA, 22 nt, Homo sapiens
cccacacccuggaggauuucau

SEQ ID NO: 1716115 - RNA, 19 nt, Homo sapiens
cccacaugugacacauaug

SEQ ID NO: 1716116 - RNA, 14 nt, Homo sapiens
cccacauucugaug

SEQ ID NO: 1716117 - RNA, 15 nt, Homo sapiens
cccaccgguccagcu

SEQ ID NO: 1716118 - RNA, 11 nt, Homo sapiens
cccaccugcca

SEQ ID NO: 1716119 - RNA, 17 nt, Homo sapiens
cccacugaaccuucuga

SEQ ID NO: 1716120 - RNA, 20 nt, Homo sapiens
cccacugaagcccauuucuc

SEQ ID NO: 1716121 - RNA, 13 nt, Homo sapiens
cccacugccagca

SEQ ID NO: 1716122 - RNA, 16 nt, Homo sapiens
cccacugcucugguua

SEQ ID NO: 1716123 - RNA, 19 nt, Homo sapiens
cccacuguuucucuugagc

SEQ ID NO: 1716124 - RNA, 15 nt, Homo sapiens
cccacuucugccaua

SEQ ID NO: 1716125 - RNA, 19 nt, Homo sapiens
cccagacuacuauuuucuu

SEQ ID NO: 1716126 - RNA, 20 nt, Homo sapiens
cccagagaggguggugaccu

SEQ ID NO: 1716127 - RNA, 18 nt, Homo sapiens
cccagagcaaaauaauuu

SEQ ID NO: 1716128 - RNA, 20 nt, Homo sapiens
cccagagcaggaagcauuca

SEQ ID NO: 1716129 - RNA, 18 nt, Homo sapiens
cccagagguaacagaaca

SEQ ID NO: 1716130 - RNA, 19 nt, Homo sapiens
cccagagguaacagaacag

SEQ ID NO: 1716131 - RNA, 15 nt, Homo sapiens
cccagaucugguccc

SEQ ID NO: 1716132 - RNA, 12 nt, Homo sapiens
cccagauugcaa

SEQ ID NO: 1716133 - RNA, 13 nt, Homo sapiens
cccagcaucacuc

SEQ ID NO: 1716134 - RNA, 20 nt, Homo sapiens
cccagccaaacccugucuga

SEQ ID NO: 1716135 - RNA, 15 nt, Homo sapiens
cccagcccagggugg

SEQ ID NO: 1716136 - RNA, 19 nt, Homo sapiens
cccagccccuccaaagguc

SEQ ID NO: 1716137 - RNA, 15 nt, Homo sapiens
cccagcccugcugca

SEQ ID NO: 1716138 - RNA, 22 nt, Homo sapiens
cccagccggccaauggaaaccu

SEQ ID NO: 1716139 - RNA, 20 nt, Homo sapiens
cccagcucaggggcagcuca

SEQ ID NO: 1716140 - RNA, 16 nt, Homo sapiens
cccaggaaguggccaa

SEQ ID NO: 1716141 - RNA, 21 nt, Homo sapiens
cccaggagagagaaagccagg

SEQ ID NO: 1716142 - RNA, 21 nt, Homo sapiens
cccaggagcagcggggcagug

SEQ ID NO: 1716143 - RNA, 23 nt, Homo sapiens
cccaggaggucgaccccaaagcc

SEQ ID NO: 1716144 - RNA, 14 nt, Homo sapiens
cccaggcacugggc

SEQ ID NO: 1716145 - RNA, 19 nt, Homo sapiens
cccaggcuggcgugcagug

SEQ ID NO: 1716146 - RNA, 17 nt, Homo sapiens
cccaggcugugcagcgc

SEQ ID NO: 1716147 - RNA, 14 nt, Homo sapiens
cccaguccaugcuu

SEQ ID NO: 1716148 - RNA, 23 nt, Homo sapiens
cccaguccucucccaaguccaca

SEQ ID NO: 1716149 - RNA, 20 nt, Homo sapiens
auguggaccucuacuuucca

SEQ ID NO: 1716150 - RNA, 22 nt, Homo sapiens
auguggcaaggaaaaacagguc

SEQ ID NO: 1716151 - RNA, 13 nt, Homo sapiens
auguggucucagg

SEQ ID NO: 1716152 - RNA, 15 nt, Homo sapiens
augugucacuugugc

SEQ ID NO: 1716153 - RNA, 22 nt, Homo sapiens
augugucaggugacccugauga

SEQ ID NO: 1716154 - RNA, 20 nt, Homo sapiens
auguguccaaucggagacaa

SEQ ID NO: 1716155 - RNA, 21 nt, Homo sapiens
auguguggcucagugccugga

SEQ ID NO: 1716156 - RNA, 22 nt, Homo sapiens
auguguggcucagugccuggac

SEQ ID NO: 1716157 - RNA, 15 nt, Homo sapiens
auguguugcuauccu

SEQ ID NO: 1716158 - RNA, 14 nt, Homo sapiens
auguguugugauag

SEQ ID NO: 1716159 - RNA, 20 nt, Homo sapiens
auguguuuuucuccagugcu

SEQ ID NO: 1716160 - RNA, 21 nt, Homo sapiens
auguuaucuucucaaguucua

SEQ ID NO: 1716161 - RNA, 15 nt, Homo sapiens
auguuaugacuaugu

SEQ ID NO: 1716162 - RNA, 19 nt, Homo sapiens
auguucagaauguacggaa

SEQ ID NO: 1716163 - RNA, 15 nt, Homo sapiens
auguucuaaggcucu

SEQ ID NO: 1716164 - RNA, 14 nt, Homo sapiens
auguucugggacac

SEQ ID NO: 1716165 - RNA, 23 nt, Homo sapiens
auguugauuuuuacuguguuuua

SEQ ID NO: 1716166 - RNA, 14 nt, Homo sapiens
auguugcccaggca

SEQ ID NO: 1716167 - RNA, 16 nt, Homo sapiens
auguuguaaugcugca

SEQ ID NO: 1716168 - RNA, 14 nt, Homo sapiens
auguuuaaagauca

SEQ ID NO: 1716169 - RNA, 18 nt, Homo sapiens
auguuugcacuugugcuu

SEQ ID NO: 1716170 - RNA, 23 nt, Homo sapiens
auguuuguaauaauugcucauaa

SEQ ID NO: 1716171 - RNA, 23 nt, Homo sapiens
auguuugucuuuuaaugcuucau

SEQ ID NO: 1716172 - RNA, 18 nt, Homo sapiens
auuaaaagugacauuugu

SEQ ID NO: 1716173 - RNA, 19 nt, Homo sapiens
auuaaacgguaacauccaa

SEQ ID NO: 1716174 - RNA, 21 nt, Homo sapiens
auuaaauaccuauaugaauau

SEQ ID NO: 1716175 - RNA, 17 nt, Homo sapiens
auuaaauucacaaacuu

SEQ ID NO: 1716176 - RNA, 13 nt, Homo sapiens
auuaacaaacauc

SEQ ID NO: 1716177 - RNA, 15 nt, Homo sapiens
auuaacuacauuuau

SEQ ID NO: 1716178 - RNA, 18 nt, Homo sapiens
auuaaguucucaauguga

SEQ ID NO: 1716179 - RNA, 17 nt, Homo sapiens
auuaauaguuugucuau

SEQ ID NO: 1716180 - RNA, 17 nt, Homo sapiens
auuaaucaucuauaaag

SEQ ID NO: 1716181 - RNA, 19 nt, Homo sapiens
auuaauuccaacuguacuu

SEQ ID NO: 1716182 - RNA, 20 nt, Homo sapiens
auuaauucuauaaggccaua

SEQ ID NO: 1716183 - RNA, 15 nt, Homo sapiens
auuacaggcaccugc

SEQ ID NO: 1716184 - RNA, 18 nt, Homo sapiens
auuacauggggucuagaa

SEQ ID NO: 1716185 - RNA, 14 nt, Homo sapiens
auuacuauaugcaa

SEQ ID NO: 1716186 - RNA, 14 nt, Homo sapiens
auuacuucugcuac

SEQ ID NO: 1716187 - RNA, 19 nt, Homo sapiens
auuagaaaaaaauuacuaa

SEQ ID NO: 1716188 - RNA, 13 nt, Homo sapiens
auuagacuccucc

SEQ ID NO: 1716189 - RNA, 19 nt, Homo sapiens
auuagcaauugacugucac

SEQ ID NO: 1716190 - RNA, 13 nt, Homo sapiens
auuagcuuugugu

SEQ ID NO: 1716191 - RNA, 18 nt, Homo sapiens
auuaggauuuugauguga

SEQ ID NO: 1716192 - RNA, 13 nt, Homo sapiens
auuauacauuuga

SEQ ID NO: 1716193 - RNA, 19 nt, Homo sapiens
auuauagauuuucauguuc

SEQ ID NO: 1716194 - RNA, 21 nt, Homo sapiens
auuaucccccaaaaugcauuu

SEQ ID NO: 1716195 - RNA, 11 nt, Homo sapiens
auuaugacaau

SEQ ID NO: 1716196 - RNA, 22 nt, Homo sapiens
auuaugaugaaaaccuacauau

SEQ ID NO: 1716197 - RNA, 15 nt, Homo sapiens
auuauuuaauaacau

SEQ ID NO: 1716198 - RNA, 22 nt, Homo sapiens
auuauuuccaguguucuaugaa

SEQ ID NO: 1716199 - RNA, 23 nt, Homo sapiens
auuauuugggagggaaaagggaa

SEQ ID NO: 1716200 - RNA, 16 nt, Homo sapiens
auuauuuucacuguag

SEQ ID NO: 1716201 - RNA, 19 nt, Homo sapiens
auucaaaaauuaucuauag

SEQ ID NO: 1716202 - RNA, 19 nt, Homo sapiens
auucaaaagaugccauuca

SEQ ID NO: 1716203 - RNA, 17 nt, Homo sapiens
auucaaaugggugauau

SEQ ID NO: 1716204 - RNA, 20 nt, Homo sapiens
auucaauagcauaucacaga

SEQ ID NO: 1716205 - RNA, 19 nt, Homo sapiens
auucacagccccuggccca

SEQ ID NO: 1716206 - RNA, 20 nt, Homo sapiens
auucacauaguuuauuucaa

SEQ ID NO: 1716207 - RNA, 13 nt, Homo sapiens
auucacauucaga

SEQ ID NO: 1716208 - RNA, 22 nt, Homo sapiens
auucaccaaaauagucuucuca

SEQ ID NO: 1716209 - RNA, 16 nt, Homo sapiens
auucagguauaaggca

SEQ ID NO: 1716210 - RNA, 20 nt, Homo sapiens
auucauacccacacacccag

SEQ ID NO: 1716211 - RNA, 16 nt, Homo sapiens
auucauuagcugugau

SEQ ID NO: 1716212 - RNA, 21 nt, Homo sapiens
ucacauuguuugcugcuauug

SEQ ID NO: 1716213 - RNA, 19 nt, Homo sapiens
ucacauuucaccccaggcu

SEQ ID NO: 1716214 - RNA, 22 nt, Homo sapiens
ucaccaaaauagucuucucaaa

SEQ ID NO: 1716215 - RNA, 16 nt, Homo sapiens
ucaccacaugugcaca

SEQ ID NO: 1716216 - RNA, 17 nt, Homo sapiens
ucaccacaugugcacau

SEQ ID NO: 1716217 - RNA, 17 nt, Homo sapiens
ucaccagaauugugcaa

SEQ ID NO: 1716218 - RNA, 18 nt, Homo sapiens
ucaccagaauugugcaaa

SEQ ID NO: 1716219 - RNA, 15 nt, Homo sapiens
ucaccagagcauuuc

SEQ ID NO: 1716220 - RNA, 15 nt, Homo sapiens
ucaccagauuugcua

SEQ ID NO: 1716221 - RNA, 12 nt, Homo sapiens
ucaccagugucc

SEQ ID NO: 1716222 - RNA, 13 nt, Homo sapiens
ucacccaaaacaa

SEQ ID NO: 1716223 - RNA, 19 nt, Homo sapiens
ucacccaggcuggagugca

SEQ ID NO: 1716224 - RNA, 22 nt, Homo sapiens
ucaccccaggcucaacugagga

SEQ ID NO: 1716225 - RNA, 14 nt, Homo sapiens
ucacccccugagau

SEQ ID NO: 1716226 - RNA, 22 nt, Homo sapiens
ucaccccuguccucacugcucc

SEQ ID NO: 1716227 - RNA, 16 nt, Homo sapiens
ucacccuuaacccaag

SEQ ID NO: 1716228 - RNA, 18 nt, Homo sapiens
ucaccuggaugugcagcc

SEQ ID NO: 1716229 - RNA, 16 nt, Homo sapiens
ucacggcucacugcag

SEQ ID NO: 1716230 - RNA, 16 nt, Homo sapiens
ucacgggucacuugaa

SEQ ID NO: 1716231 - RNA, 17 nt, Homo sapiens
ucacuaauacuaauuca

SEQ ID NO: 1716232 - RNA, 15 nt, Homo sapiens
ucacuauccaugcac

SEQ ID NO: 1716233 - RNA, 20 nt, Homo sapiens
ucacuauccaugcaccaaac

SEQ ID NO: 1716234 - RNA, 19 nt, Homo sapiens
ucacucaagcacugauauc

SEQ ID NO: 1716235 - RNA, 17 nt, Homo sapiens
ucacucaccaucuggaa

SEQ ID NO: 1716236 - RNA, 14 nt, Homo sapiens
ucacucccagucca

SEQ ID NO: 1716237 - RNA, 12 nt, Homo sapiens
ucacuccccaag

SEQ ID NO: 1716238 - RNA, 18 nt, Homo sapiens
ucacugaacaaacuaaag

SEQ ID NO: 1716239 - RNA, 18 nt, Homo sapiens
ucacugggucugcuggcu

SEQ ID NO: 1716240 - RNA, 15 nt, Homo sapiens
ucacuuaauccuuug

SEQ ID NO: 1716241 - RNA, 19 nt, Homo sapiens
ucacuucauucacauucag

SEQ ID NO: 1716242 - RNA, 15 nt, Homo sapiens
ucacuugaguguaau

SEQ ID NO: 1716243 - RNA, 12 nt, Homo sapiens
ucagaaaacggg

SEQ ID NO: 1716244 - RNA, 12 nt, Homo sapiens
ucagaaaccaaa

SEQ ID NO: 1716245 - RNA, 13 nt, Homo sapiens
ucagaaaccugca

SEQ ID NO: 1716246 - RNA, 19 nt, Homo sapiens
ucagaacaguaucuuugca

SEQ ID NO: 1716247 - RNA, 15 nt, Homo sapiens
ucagaaccauccaua

SEQ ID NO: 1716248 - RNA, 13 nt, Homo sapiens
ucagaauagccac

SEQ ID NO: 1716249 - RNA, 19 nt, Homo sapiens
ucagaauauucauauugga

SEQ ID NO: 1716250 - RNA, 21 nt, Homo sapiens
ucccuggcucccaugaccaua

SEQ ID NO: 1716251 - RNA, 19 nt, Homo sapiens
ucccuuccugggucuacca

SEQ ID NO: 1716252 - RNA, 13 nt, Homo sapiens
ucccuugaaauuu

SEQ ID NO: 1716253 - RNA, 22 nt, Homo sapiens
ucccuugcuuuucccucuuuuc

SEQ ID NO: 1716254 - RNA, 22 nt, Homo sapiens
ucccuuggaauaaaaacauuuc

SEQ ID NO: 1716255 - RNA, 18 nt, Homo sapiens
ucccuuuccccagcauca

SEQ ID NO: 1716256 - RNA, 17 nt, Homo sapiens
ucccuuuuuauauccca

SEQ ID NO: 1716257 - RNA, 17 nt, Homo sapiens
uccgcacuucagaauuc

SEQ ID NO: 1716258 - RNA, 16 nt, Homo sapiens
uccgcacuuuccacuu

SEQ ID NO: 1716259 - RNA, 17 nt, Homo sapiens
uccggaggcugaggcag

SEQ ID NO: 1716260 - RNA, 22 nt, Homo sapiens
uccgggagcggcuguugggcug

SEQ ID NO: 1716261 - RNA, 13 nt, Homo sapiens
uccguacauucaa

SEQ ID NO: 1716262 - RNA, 21 nt, Homo sapiens
uccuaagcuucaaaucagaag

SEQ ID NO: 1716263 - RNA, 16 nt, Homo sapiens
uccuacagggccacaa

SEQ ID NO: 1716264 - RNA, 15 nt, Homo sapiens
uccuacguauccugc

SEQ ID NO: 1716265 - RNA, 18 nt, Homo sapiens
uccuacuaucacugaaca

SEQ ID NO: 1716266 - RNA, 18 nt, Homo sapiens
uccuacucugugucaggu

SEQ ID NO: 1716267 - RNA, 14 nt, Homo sapiens
uccuaguuugaccu

SEQ ID NO: 1716268 - RNA, 20 nt, Homo sapiens
uccuauaaucugucaaaaca

SEQ ID NO: 1716269 - RNA, 23 nt, Homo sapiens
uccuaucacugauaguguccaaa

SEQ ID NO: 1716270 - RNA, 22 nt, Homo sapiens
uccuauuuauaagagugccgua

SEQ ID NO: 1716271 - RNA, 21 nt, Homo sapiens
uccucacacacccugagguca

SEQ ID NO: 1716272 - RNA, 13 nt, Homo sapiens
uccucaugcugcu

SEQ ID NO: 1716273 - RNA, 22 nt, Homo sapiens
uccuccauaaauuauggcauuu

SEQ ID NO: 1716274 - RNA, 13 nt, Homo sapiens
uccuccaucccaa

SEQ ID NO: 1716275 - RNA, 23 nt, Homo sapiens
uccuccauccuauccacugggca

SEQ ID NO: 1716276 - RNA, 15 nt, Homo sapiens
uccuccccacuagca

SEQ ID NO: 1716277 - RNA, 14 nt, Homo sapiens
uccuccgguugcau

SEQ ID NO: 1716278 - RNA, 20 nt, Homo sapiens
uccuccugggucagggagaa

SEQ ID NO: 1716279 - RNA, 13 nt, Homo sapiens
uccuccuuucucc

SEQ ID NO: 1716280 - RNA, 19 nt, Homo sapiens
uccucuguccaggcacugc

SEQ ID NO: 1716281 - RNA, 15 nt, Homo sapiens
uccucuugaaccaca

SEQ ID NO: 1716282 - RNA, 16 nt, Homo sapiens
uccugaccugagccag

SEQ ID NO: 1716283 - RNA, 16 nt, Homo sapiens
uccugagccaaggagg

SEQ ID NO: 1716284 - RNA, 17 nt, Homo sapiens
uccugaggaugggcaac

SEQ ID NO: 1716285 - RNA, 13 nt, Homo sapiens
uccugccaccacu

SEQ ID NO: 1716286 - RNA, 18 nt, Homo sapiens
uccugccuguagcaguga

SEQ ID NO: 1716287 - RNA, 20 nt, Homo sapiens
uccuggaacagaagacagcu

SEQ ID NO: 1716288 - RNA, 13 nt, Homo sapiens
uccuggcacuaac

SEQ ID NO: 1716289 - RNA, 21 nt, Homo sapiens
uccuggcagcccagagacuuu

SEQ ID NO: 1716290 - RNA, 15 nt, Homo sapiens
uccuggcgacaucuu

SEQ ID NO: 1716291 - RNA, 17 nt, Homo sapiens
uccugggcuaagugauc

SEQ ID NO: 1716292 - RNA, 21 nt, Homo sapiens
aagcugucccucacuguugaa

SEQ ID NO: 1716293 - RNA, 15 nt, Homo sapiens
aagcugugacuucuc

SEQ ID NO: 1716294 - RNA, 18 nt, Homo sapiens
aagcuuaacacuugaccu

SEQ ID NO: 1716295 - RNA, 17 nt, Homo sapiens
aagcuugaagcugugga

SEQ ID NO: 1716296 - RNA, 18 nt, Homo sapiens
aagcuugaagcuguggag

SEQ ID NO: 1716297 - RNA, 21 nt, Homo sapiens
aagcuuuauuaccaguggcgu

SEQ ID NO: 1716298 - RNA, 19 nt, Homo sapiens
aagcuuuuuacucaaagag

SEQ ID NO: 1716299 - RNA, 18 nt, Homo sapiens
aaggaaauacccuucuuu

SEQ ID NO: 1716300 - RNA, 19 nt, Homo sapiens
aaggaacaaaaaaaccaca

SEQ ID NO: 1716301 - RNA, 21 nt, Homo sapiens
aaggaacauuccuuagucuca

SEQ ID NO: 1716302 - RNA, 18 nt, Homo sapiens
aaggaagcuccacuguca

SEQ ID NO: 1716303 - RNA, 19 nt, Homo sapiens
aaggaaucuuuaagcagag

SEQ ID NO: 1716304 - RNA, 17 nt, Homo sapiens
aaggagcacaagccaca

SEQ ID NO: 1716305 - RNA, 12 nt, Homo sapiens
aaggagccaggg

SEQ ID NO: 1716306 - RNA, 14 nt, Homo sapiens
aaggagccagggaa

SEQ ID NO: 1716307 - RNA, 16 nt, Homo sapiens
aaggaguacaaugccc

SEQ ID NO: 1716308 - RNA, 21 nt, Homo sapiens
aaggccugacuucugcuggca

SEQ ID NO: 1716309 - RNA, 22 nt, Homo sapiens
aagggaacuugagcgugaaucu

SEQ ID NO: 1716310 - RNA, 22 nt, Homo sapiens
aagggagagaacaaaagcuaua

SEQ ID NO: 1716311 - RNA, 18 nt, Homo sapiens
aagggauccguacauuca

SEQ ID NO: 1716312 - RNA, 14 nt, Homo sapiens
aagggcaucaucua

SEQ ID NO: 1716313 - RNA, 19 nt, Homo sapiens
aaggggcuuuuguccuccu

SEQ ID NO: 1716314 - RNA, 17 nt, Homo sapiens
aagggguuggggugaca

SEQ ID NO: 1716315 - RNA, 16 nt, Homo sapiens
aagggugggugcucag

SEQ ID NO: 1716316 - RNA, 18 nt, Homo sapiens
aaggucacauugugccuu

SEQ ID NO: 1716317 - RNA, 13 nt, Homo sapiens
aaggucaccagca

SEQ ID NO: 1716318 - RNA, 21 nt, Homo sapiens
aaggucugagccacagcagca

SEQ ID NO: 1716319 - RNA, 13 nt, Homo sapiens
aaggugcacugcu

SEQ ID NO: 1716320 - RNA, 14 nt, Homo sapiens
aaggugccacuuua

SEQ ID NO: 1716321 - RNA, 14 nt, Homo sapiens
aaggugcuacuuga

SEQ ID NO: 1716322 - RNA, 22 nt, Homo sapiens
aagguugcugaggcucugaccc

SEQ ID NO: 1716323 - RNA, 17 nt, Homo sapiens
aagguuuuuacugugag

SEQ ID NO: 1716324 - RNA, 14 nt, Homo sapiens
aaguaaugaucuca

SEQ ID NO: 1716325 - RNA, 15 nt, Homo sapiens
aaguaaugaucucaa

SEQ ID NO: 1716326 - RNA, 22 nt, Homo sapiens
aaguaauguaaaauccauccaa

SEQ ID NO: 1716327 - RNA, 15 nt, Homo sapiens
aaguaauuugaauag

SEQ ID NO: 1716328 - RNA, 19 nt, Homo sapiens
aaguacaucucuacuaaaa

SEQ ID NO: 1716329 - RNA, 15 nt, Homo sapiens
aaguacuacagcaaa

SEQ ID NO: 1716330 - RNA, 20 nt, Homo sapiens
aaguagaagucauauguugu

SEQ ID NO: 1716331 - RNA, 16 nt, Homo sapiens
aaguagaauccuaaau

SEQ ID NO: 1716332 - RNA, 18 nt, Homo sapiens
aaguagauuuuaaaagau

SEQ ID NO: 1716333 - RNA, 20 nt, Homo sapiens
aaguagcaaaaaguauugaa

SEQ ID NO: 1716334 - RNA, 21 nt, Homo sapiens
aaguagcagugugaaguacaa

SEQ ID NO: 1716335 - RNA, 20 nt, Homo sapiens
aaguagcaucccaucccaac

SEQ ID NO: 1716336 - RNA, 22 nt, Homo sapiens
aaguauaaucagcacuuugcca

SEQ ID NO: 1716337 - RNA, 12 nt, Homo sapiens
aaguauuugaaa

SEQ ID NO: 1716338 - RNA, 19 nt, Homo sapiens
aagucaccacuccauuccc

SEQ ID NO: 1716339 - RNA, 21 nt, Homo sapiens
aagucaccacuccauucccaa

SEQ ID NO: 1716340 - RNA, 13 nt, Homo sapiens
aaguccuuuaugu

SEQ ID NO: 1716341 - RNA, 18 nt, Homo sapiens
aagucucugugaauugaa

SEQ ID NO: 1716342 - RNA, 15 nt, Homo sapiens
aagucuuccaugacc

SEQ ID NO: 1716343 - RNA, 16 nt, Homo sapiens
aagucuuccaugaccc

SEQ ID NO: 1716344 - RNA, 14 nt, Homo sapiens
aagugaacuaugaa

SEQ ID NO: 1716345 - RNA, 15 nt, Homo sapiens
aagugauacuaucca

SEQ ID NO: 1716346 - RNA, 17 nt, Homo sapiens
aagugauacuauccagu

SEQ ID NO: 1716347 - RNA, 19 nt, Homo sapiens
aagugaucugcccaccuca

SEQ ID NO: 1716348 - RNA, 20 nt, Homo sapiens
aagugaucugcccaccucag

SEQ ID NO: 1716349 - RNA, 17 nt, Homo sapiens
aagugcaguucuuagcc

SEQ ID NO: 1716350 - RNA, 17 nt, Homo sapiens
aagugccaaaugcucuc

SEQ ID NO: 1716351 - RNA, 21 nt, Homo sapiens
aagugccaaaugcucucucaa

SEQ ID NO: 1716352 - RNA, 18 nt, Homo sapiens
aagugcuauuucuugcau

SEQ ID NO: 1716353 - RNA, 12 nt, Homo sapiens
aagugcugcuau

SEQ ID NO: 1716354 - RNA, 17 nt, Homo sapiens
aagugggaucugucaca

SEQ ID NO: 1716355 - RNA, 22 nt, Homo sapiens
aagugggaucugucacaccagc

SEQ ID NO: 1716356 - RNA, 23 nt, Homo sapiens
aagugggaucugucacaccagcc

SEQ ID NO: 1716357 - RNA, 19 nt, Homo sapiens
aagugguaggaaagccuca

SEQ ID NO: 1716358 - RNA, 15 nt, Homo sapiens
aaguggugaaugaca

SEQ ID NO: 1716359 - RNA, 16 nt, Homo sapiens
aaguggugaaugacac

SEQ ID NO: 1716360 - RNA, 13 nt, Homo sapiens
aagugugcaugau

SEQ ID NO: 1716361 - RNA, 16 nt, Homo sapiens
aaguguuuuuuauuga

SEQ ID NO: 1716362 - RNA, 20 nt, Homo sapiens
aaguuaaccccauguccuca

SEQ ID NO: 1716363 - RNA, 12 nt, Homo sapiens
aaguuccaagag

SEQ ID NO: 1716364 - RNA, 15 nt, Homo sapiens
aaguucucaauguga

SEQ ID NO: 1716365 - RNA, 22 nt, Homo sapiens
aaguucuguguuuaauuucuuc

SEQ ID NO: 1716366 - RNA, 22 nt, Homo sapiens
aaguugcauuccuuugucuuca

SEQ ID NO: 1716367 - RNA, 13 nt, Homo sapiens
aaguuucacccaa

SEQ ID NO: 1716368 - RNA, 14 nt, Homo sapiens
aaguuucccuuccu

SEQ ID NO: 1716369 - RNA, 23 nt, Homo sapiens
aaguuuucagaaccucuucccca

SEQ ID NO: 1716370 - RNA, 18 nt, Homo sapiens
aauaaaacuuaaaucuca

SEQ ID NO: 1716371 - RNA, 13 nt, Homo sapiens
aauaaaauaauuc

SEQ ID NO: 1716372 - RNA, 19 nt, Homo sapiens
aauaaaauuucuaagagag

SEQ ID NO: 1716373 - RNA, 16 nt, Homo sapiens
aauaaacgcauuauca

SEQ ID NO: 1716374 - RNA, 17 nt, Homo sapiens
aauaaagaauuaacaga

SEQ ID NO: 1716375 - RNA, 20 nt, Homo sapiens
aauaaagaauuaacagagau

SEQ ID NO: 1716376 - RNA, 14 nt, Homo sapiens
aauaaaguccugac

SEQ ID NO: 1716377 - RNA, 14 nt, Homo sapiens
aauaaauugcuccu

SEQ ID NO: 1716378 - RNA, 15 nt, Homo sapiens
aauaacaggcauuug

SEQ ID NO: 1716379 - RNA, 13 nt, Homo sapiens
aauaacugugaag

SEQ ID NO: 1716380 - RNA, 13 nt, Homo sapiens
aauaauaccucaa

SEQ ID NO: 1716381 - RNA, 14 nt, Homo sapiens
aauaauauuagcuu

SEQ ID NO: 1716382 - RNA, 18 nt, Homo sapiens
aauaauauuguuguauaa

SEQ ID NO: 1716383 - RNA, 14 nt, Homo sapiens
aauaauguacaucu

SEQ ID NO: 1716384 - RNA, 20 nt, Homo sapiens
aauaauuagguuaacauugu

SEQ ID NO: 1716385 - RNA, 14 nt, Homo sapiens
aauaauucauauuc

SEQ ID NO: 1716386 - RNA, 14 nt, Homo sapiens
aauacaacauguag

SEQ ID NO: 1716387 - RNA, 23 nt, Homo sapiens
aauacccugcccuugacaucugg

SEQ ID NO: 1716388 - RNA, 13 nt, Homo sapiens
aauacuacugcac

SEQ ID NO: 1716389 - RNA, 14 nt, Homo sapiens
aauacuccuaagac

SEQ ID NO: 1716390 - RNA, 13 nt, Homo sapiens
aauacuuacuucu

SEQ ID NO: 1716391 - RNA, 17 nt, Homo sapiens
aauacuuuuuaaaaggu

SEQ ID NO: 1716392 - RNA, 18 nt, Homo sapiens
aauacuuuuuacaauuaa

SEQ ID NO: 1716393 - RNA, 22 nt, Homo sapiens
aauagauacaaaugucuaucaa

SEQ ID NO: 1716394 - RNA, 19 nt, Homo sapiens
aauagcaacguagcuucua

SEQ ID NO: 1716395 - RNA, 19 nt, Homo sapiens
aauagcauaucacagagag

SEQ ID NO: 1716396 - RNA, 15 nt, Homo sapiens
aauagccacauuugg

SEQ ID NO: 1716397 - RNA, 21 nt, Homo sapiens
aauagccuaauacaacaugua

SEQ ID NO: 1716398 - RNA, 15 nt, Homo sapiens
aauagcuauggaauc

SEQ ID NO: 1716399 - RNA, 12 nt, Homo sapiens
aauagucauucc

SEQ ID NO: 1716400 - RNA, 18 nt, Homo sapiens
aauagucauuccaaauau

SEQ ID NO: 1716401 - RNA, 14 nt, Homo sapiens
aauagucuucucaa

SEQ ID NO: 1716402 - RNA, 19 nt, Homo sapiens
accacaacugacacaggaa

SEQ ID NO: 1716403 - RNA, 20 nt, Homo sapiens
accacaacugacacaggaaa

SEQ ID NO: 1716404 - RNA, 15 nt, Homo sapiens
accacacggaucuga

SEQ ID NO: 1716405 - RNA, 20 nt, Homo sapiens
accacagagcugucacuuuu

SEQ ID NO: 1716406 - RNA, 13 nt, Homo sapiens
accacagcugcag

SEQ ID NO: 1716407 - RNA, 17 nt, Homo sapiens
accaccauccaccgcug

SEQ ID NO: 1716408 - RNA, 17 nt, Homo sapiens
accaccuucaccuggau

SEQ ID NO: 1716409 - RNA, 21 nt, Homo sapiens
accacuaagaauucaaacugg

SEQ ID NO: 1716410 - RNA, 18 nt, Homo sapiens
accacuagaacucuccau

SEQ ID NO: 1716411 - RNA, 15 nt, Homo sapiens
accacuccauuccca

SEQ ID NO: 1716412 - RNA, 13 nt, Homo sapiens
accacugggcaaa

SEQ ID NO: 1716413 - RNA, 21 nt, Homo sapiens
accagagaccguccucacccc

SEQ ID NO: 1716414 - RNA, 14 nt, Homo sapiens
accagagcauuucc

SEQ ID NO: 1716415 - RNA, 12 nt, Homo sapiens
accagauuugcu

SEQ ID NO: 1716416 - RNA, 13 nt, Homo sapiens
accagcaagaaua

SEQ ID NO: 1716417 - RNA, 14 nt, Homo sapiens
accagccauacuua

SEQ ID NO: 1716418 - RNA, 20 nt, Homo sapiens
accaggacucccuccucacc

SEQ ID NO: 1716419 - RNA, 13 nt, Homo sapiens
accagugccaagg

SEQ ID NO: 1716420 - RNA, 23 nt, Homo sapiens
accaguguccccuccacugucac

SEQ ID NO: 1716421 - RNA, 14 nt, Homo sapiens
accaguuaccacac

SEQ ID NO: 1716422 - RNA, 16 nt, Homo sapiens
accaguuucagagaaa

SEQ ID NO: 1716423 - RNA, 16 nt, Homo sapiens
accauaacaacuucau

SEQ ID NO: 1716424 - RNA, 13 nt, Homo sapiens
accauacauuuaa

SEQ ID NO: 1716425 - RNA, 20 nt, Homo sapiens
accauauaccaucuccagcu

SEQ ID NO: 1716426 - RNA, 18 nt, Homo sapiens
accauccugccauccuug

SEQ ID NO: 1716427 - RNA, 21 nt, Homo sapiens
accauccugccauccuugacu

SEQ ID NO: 1716428 - RNA, 18 nt, Homo sapiens
accaucuccccaggcuau

SEQ ID NO: 1716429 - RNA, 15 nt, Homo sapiens
accauuuaucuaccc

SEQ ID NO: 1716430 - RNA, 12 nt, Homo sapiens
accauuugcacu

SEQ ID NO: 1716431 - RNA, 16 nt, Homo sapiens
accauuuuuuaaggaa

SEQ ID NO: 1716432 - RNA, 21 nt, Homo sapiens
acccacaugugacacauaugc

SEQ ID NO: 1716433 - RNA, 22 nt, Homo sapiens
acccacuaauacuacugcacag

SEQ ID NO: 1716434 - RNA, 21 nt, Homo sapiens
acccacuucuaaauagcaauu

SEQ ID NO: 1716435 - RNA, 17 nt, Homo sapiens
acccagaccccaggcug

SEQ ID NO: 1716436 - RNA, 13 nt, Homo sapiens
accccaccugcag

SEQ ID NO: 1716437 - RNA, 12 nt, Homo sapiens
accccacugcaa

SEQ ID NO: 1716438 - RNA, 23 nt, Homo sapiens
accccagagauucccaagccaaa

SEQ ID NO: 1716439 - RNA, 22 nt, Homo sapiens
accccgaccaccugcccaaccu

SEQ ID NO: 1716440 - RNA, 14 nt, Homo sapiens
accccgggcucucu

SEQ ID NO: 1716441 - RNA, 13 nt, Homo sapiens
accccuacaugaa

SEQ ID NO: 1716442 - RNA, 17 nt, Homo sapiens
accccugcuauauacua

SEQ ID NO: 1716443 - RNA, 22 nt, Homo sapiens
acccggaucauucacugugaua

SEQ ID NO: 1716444 - RNA, 19 nt, Homo sapiens
acccuacacccagacccca

SEQ ID NO: 1716445 - RNA, 13 nt, Homo sapiens
acccuagucccuu

SEQ ID NO: 1716446 - RNA, 20 nt, Homo sapiens
acccuauuuagaaauggauu

SEQ ID NO: 1716447 - RNA, 17 nt, Homo sapiens
acccucauuucucaucu

SEQ ID NO: 1716448 - RNA, 16 nt, Homo sapiens
acccucuuccugugau

SEQ ID NO: 1716449 - RNA, 23 nt, Homo sapiens
acccugagaaccccucugggaaa

SEQ ID NO: 1716450 - RNA, 21 nt, Homo sapiens
acccugcgcaugaaccuggac

SEQ ID NO: 1716451 - RNA, 22 nt, Homo sapiens
acccugcugaccucccagugac

SEQ ID NO: 1716452 - RNA, 17 nt, Homo sapiens
acccugggagacagacc

SEQ ID NO: 1716453 - RNA, 20 nt, Homo sapiens
acccuguaccucaucccaug

SEQ ID NO: 1716454 - RNA, 10 nt, Homo sapiens
acccuuccag

SEQ ID NO: 1716455 - RNA, 21 nt, Homo sapiens
acccuucuuuuaugagcagaa

SEQ ID NO: 1716456 - RNA, 18 nt, Homo sapiens
acccuugguggcuuaugg

SEQ ID NO: 1716457 - RNA, 14 nt, Homo sapiens
accgacuagccagg

SEQ ID NO: 1716458 - RNA, 22 nt, Homo sapiens
accgacuagccaggaaguacuu

SEQ ID NO: 1716459 - RNA, 21 nt, Homo sapiens
accgagucucuucuccacugg

SEQ ID NO: 1716460 - RNA, 14 nt, Homo sapiens
accgcgacguugca

SEQ ID NO: 1716461 - RNA, 21 nt, Homo sapiens
accgcuuguggggacccaggc

SEQ ID NO: 1716462 - RNA, 14 nt, Homo sapiens
accggcgcgcucuu

SEQ ID NO: 1716463 - RNA, 14 nt, Homo sapiens
accgugaccaucuu

SEQ ID NO: 1716464 - RNA, 18 nt, Homo sapiens
accguguaccucaguucc

SEQ ID NO: 1716465 - RNA, 14 nt, Homo sapiens
accguuguuugcaa

SEQ ID NO: 1716466 - RNA, 23 nt, Homo sapiens
accuaagucucugugaauugaaa

SEQ ID NO: 1716467 - RNA, 19 nt, Homo sapiens
accuaauucgaugaaggcu

SEQ ID NO: 1716468 - RNA, 12 nt, Homo sapiens
accuacauauuc

SEQ ID NO: 1716469 - RNA, 14 nt, Homo sapiens
accuacauauucca

SEQ ID NO: 1716470 - RNA, 18 nt, Homo sapiens
accuagaacacuaacuca

SEQ ID NO: 1716471 - RNA, 14 nt, Homo sapiens
accuagaagaagcu

SEQ ID NO: 1716472 - RNA, 17 nt, Homo sapiens
accuagcaauuccauca

SEQ ID NO: 1716473 - RNA, 11 nt, Homo sapiens
accuagcuuua

SEQ ID NO: 1716474 - RNA, 23 nt, Homo sapiens
accuaguacugccccccaugagg

SEQ ID NO: 1716475 - RNA, 15 nt, Homo sapiens
accuauccucacugc

SEQ ID NO: 1716476 - RNA, 13 nt, Homo sapiens
accuaugugccaa

SEQ ID NO: 1716477 - RNA, 19 nt, Homo sapiens
accucagccucccaaagug

SEQ ID NO: 1716478 - RNA, 16 nt, Homo sapiens
accucaggcacuagcc

SEQ ID NO: 1716479 - RNA, 16 nt, Homo sapiens
accucaggcagcucaa

SEQ ID NO: 1716480 - RNA, 17 nt, Homo sapiens
accucauuuuaguugcc

SEQ ID NO: 1716481 - RNA, 19 nt, Homo sapiens
accuccagucccccuaucc

SEQ ID NO: 1716482 - RNA, 12 nt, Homo sapiens
accucccaguga

SEQ ID NO: 1716483 - RNA, 20 nt, Homo sapiens
accuccccagccccuagccc

SEQ ID NO: 1716484 - RNA, 20 nt, Homo sapiens
accuccuccucuggacaaag

SEQ ID NO: 1716485 - RNA, 13 nt, Homo sapiens
accuccuguggaa

SEQ ID NO: 1716486 - RNA, 16 nt, Homo sapiens
accucuccauccugcu

SEQ ID NO: 1716487 - RNA, 22 nt, Homo sapiens
accucugccugaagucacacag

SEQ ID NO: 1716488 - RNA, 14 nt, Homo sapiens
accugaagugugca

SEQ ID NO: 1716489 - RNA, 16 nt, Homo sapiens
accugacucaggccag

SEQ ID NO: 1716490 - RNA, 20 nt, Homo sapiens
accugauggaaguaaagccu

SEQ ID NO: 1716491 - RNA, 18 nt, Homo sapiens
accugcaugugcugucac

SEQ ID NO: 1716492 - RNA, 21 nt, Homo sapiens
accugcccaaggaugcuguca

SEQ ID NO: 1716493 - RNA, 16 nt, Homo sapiens
accuggagaugcugcc

SEQ ID NO: 1716494 - RNA, 11 nt, Homo sapiens
accugucaaug

SEQ ID NO: 1716495 - RNA, 17 nt, Homo sapiens
accugugaagcugaaaa

SEQ ID NO: 1716496 - RNA, 19 nt, Homo sapiens
accuguuacugaaaguggu

SEQ ID NO: 1716497 - RNA, 22 nt, Homo sapiens
accuguugguuagauucaaggc

SEQ ID NO: 1716498 - RNA, 19 nt, Homo sapiens
accuguuuucgcaccuacc

SEQ ID NO: 1716499 - RNA, 17 nt, Homo sapiens
accuuaagauuuugcac

SEQ ID NO: 1716500 - RNA, 18 nt, Homo sapiens
accuuaagauuuugcacc

SEQ ID NO: 1716501 - RNA, 13 nt, Homo sapiens
accuuauccugca

SEQ ID NO: 1716502 - RNA, 14 nt, Homo sapiens
accuucagugaaag

SEQ ID NO: 1716503 - RNA, 12 nt, Homo sapiens
accuuccucauc

SEQ ID NO: 1716504 - RNA, 15 nt, Homo sapiens
accuugaaugcugcc

SEQ ID NO: 1716505 - RNA, 14 nt, Homo sapiens
accuugcuguccug

SEQ ID NO: 1716506 - RNA, 15 nt, Homo sapiens
accuuuggagcaaag

SEQ ID NO: 1716507 - RNA, 14 nt, Homo sapiens
accuuuuacucuuc

SEQ ID NO: 1716508 - RNA, 17 nt, Homo sapiens
accuuuuuuaagauuuu

SEQ ID NO: 1716509 - RNA, 18 nt, Homo sapiens
acgaaacacaaaccacaa

SEQ ID NO: 1716510 - RNA, 23 nt, Homo sapiens
acgacaggcgagagaggagccag

SEQ ID NO: 1716511 - RNA, 22 nt, Homo sapiens
acgaccggggccagcaccacuu

SEQ ID NO: 1716512 - RNA, 16 nt, Homo sapiens
agauccuggguacuga

SEQ ID NO: 1716513 - RNA, 21 nt, Homo sapiens
agaucuaaggaugucacaggg

SEQ ID NO: 1716514 - RNA, 13 nt, Homo sapiens
agaucuuccccaa

SEQ ID NO: 1716515 - RNA, 14 nt, Homo sapiens
agaugacaaccucc

SEQ ID NO: 1716516 - RNA, 15 nt, Homo sapiens
agaugacagggaaaa

SEQ ID NO: 1716517 - RNA, 19 nt, Homo sapiens
agaugacagggaaaacugc

SEQ ID NO: 1716518 - RNA, 15 nt, Homo sapiens
agaugauuguucaaa

SEQ ID NO: 1716519 - RNA, 20 nt, Homo sapiens
agaugcguuguuacaggaag

SEQ ID NO: 1716520 - RNA, 19 nt, Homo sapiens
agauggaaugcuguguuaa

SEQ ID NO: 1716521 - RNA, 12 nt, Homo sapiens
agauggaguucu

SEQ ID NO: 1716522 - RNA, 16 nt, Homo sapiens
agauggggcacugacc

SEQ ID NO: 1716523 - RNA, 18 nt, Homo sapiens
agauguauaaaucuuucu

SEQ ID NO: 1716524 - RNA, 18 nt, Homo sapiens
agaugucuagguacuuca

SEQ ID NO: 1716525 - RNA, 16 nt, Homo sapiens
agaugugaaaacaucu

SEQ ID NO: 1716526 - RNA, 19 nt, Homo sapiens
agaugugaaaacaucucaa

SEQ ID NO: 1716527 - RNA, 13 nt, Homo sapiens
agauuaauggcac

SEQ ID NO: 1716528 - RNA, 16 nt, Homo sapiens
agauuaauggcacuga

SEQ ID NO: 1716529 - RNA, 22 nt, Homo sapiens
agauuaugaugaaaaccuacau

SEQ ID NO: 1716530 - RNA, 22 nt, Homo sapiens
agauucaaggccccgagcuguu

SEQ ID NO: 1716531 - RNA, 22 nt, Homo sapiens
agauucagguauguugccuuua

SEQ ID NO: 1716532 - RNA, 15 nt, Homo sapiens
agauucccaagccaa

SEQ ID NO: 1716533 - RNA, 14 nt, Homo sapiens
agauucuagaugau

SEQ ID NO: 1716534 - RNA, 17 nt, Homo sapiens
agauucuagaugauuaa

SEQ ID NO: 1716535 - RNA, 16 nt, Homo sapiens
agauucuauaguucua

SEQ ID NO: 1716536 - RNA, 21 nt, Homo sapiens
agauucucuuguauaagaucc

SEQ ID NO: 1716537 - RNA, 13 nt, Homo sapiens
agauucuguggaa

SEQ ID NO: 1716538 - RNA, 21 nt, Homo sapiens
agauucuucaggcuuccugca

SEQ ID NO: 1716539 - RNA, 14 nt, Homo sapiens
agauugacuuugaa

SEQ ID NO: 1716540 - RNA, 17 nt, Homo sapiens
agauugauuaaugaacu

SEQ ID NO: 1716541 - RNA, 18 nt, Homo sapiens
agauugauuaaugaacua

SEQ ID NO: 1716542 - RNA, 21 nt, Homo sapiens
agauugcugaaaaaguagauu

SEQ ID NO: 1716543 - RNA, 17 nt, Homo sapiens
agauuguccagugcaac

SEQ ID NO: 1716544 - RNA, 21 nt, Homo sapiens
agauuguccagugcaaccaca

SEQ ID NO: 1716545 - RNA, 12 nt, Homo sapiens
agauugugcucc

SEQ ID NO: 1716546 - RNA, 14 nt, Homo sapiens
agauuuaagcacaa

SEQ ID NO: 1716547 - RNA, 19 nt, Homo sapiens
agauuuggaauaggaauaa

SEQ ID NO: 1716548 - RNA, 15 nt, Homo sapiens
agauuuuacaaaaga

SEQ ID NO: 1716549 - RNA, 20 nt, Homo sapiens
agcaaaacaauaaacuagca

SEQ ID NO: 1716550 - RNA, 19 nt, Homo sapiens
agcaaaauugauguguuua

SEQ ID NO: 1716551 - RNA, 13 nt, Homo sapiens
agcaaacacuggg

SEQ ID NO: 1716552 - RNA, 18 nt, Homo sapiens
agcaaacacuuacagaau

SEQ ID NO: 1716553 - RNA, 22 nt, Homo sapiens
agcaaagaggacucgcuuguaa

SEQ ID NO: 1716554 - RNA, 15 nt, Homo sapiens
agcaaagcaaaacaa

SEQ ID NO: 1716555 - RNA, 21 nt, Homo sapiens
agcaaagcugaugacaacuuc

SEQ ID NO: 1716556 - RNA, 20 nt, Homo sapiens
agcaaauggcagaaccaaag

SEQ ID NO: 1716557 - RNA, 15 nt, Homo sapiens
agcaaauguggcucc

SEQ ID NO: 1716558 - RNA, 16 nt, Homo sapiens
agcaaauguggcuccu

SEQ ID NO: 1716559 - RNA, 15 nt, Homo sapiens
agcaacacagaggaa

SEQ ID NO: 1716560 - RNA, 14 nt, Homo sapiens
agcaaccacacgga

SEQ ID NO: 1716561 - RNA, 17 nt, Homo sapiens
agcaacuguuaugaaau

SEQ ID NO: 1716562 - RNA, 14 nt, Homo sapiens
agcaagacacaucc

SEQ ID NO: 1716563 - RNA, 23 nt, Homo sapiens
agcaauauuuauggaugcaacac

SEQ ID NO: 1716564 - RNA, 13 nt, Homo sapiens
agcacaagccaca

SEQ ID NO: 1716565 - RNA, 14 nt, Homo sapiens
agcacaccuaucuu

SEQ ID NO: 1716566 - RNA, 13 nt, Homo sapiens
agcacagaauuug

SEQ ID NO: 1716567 - RNA, 21 nt, Homo sapiens
agcacaucuuugaccacguca

SEQ ID NO: 1716568 - RNA, 21 nt, Homo sapiens
agcaccuccgccagauccugc

SEQ ID NO: 1716569 - RNA, 20 nt, Homo sapiens
agcaccuuuccuucaagcca

SEQ ID NO: 1716570 - RNA, 15 nt, Homo sapiens
agcacggacucuuac

SEQ ID NO: 1716571 - RNA, 13 nt, Homo sapiens
agcacgugucuca

SEQ ID NO: 1716572 - RNA, 22 nt, Homo sapiens
agcacuacugggugucauuuca

SEQ ID NO: 1716573 - RNA, 12 nt, Homo sapiens
agcacucugaaa

SEQ ID NO: 1716574 - RNA, 20 nt, Homo sapiens
agcacuuugaaauaccucau

SEQ ID NO: 1716575 - RNA, 15 nt, Homo sapiens
agcacuuugccaugc

SEQ ID NO: 1716576 - RNA, 23 nt, Homo sapiens
agcagaccaccccgccugcccuc

SEQ ID NO: 1716577 - RNA, 21 nt, Homo sapiens
agcagacucuggaggccugug

SEQ ID NO: 1716578 - RNA, 17 nt, Homo sapiens
agcagagugcacagcug

SEQ ID NO: 1716579 - RNA, 19 nt, Homo sapiens
agcagccauuggcacugug

SEQ ID NO: 1716580 - RNA, 18 nt, Homo sapiens
agcagccuaacacggugc

SEQ ID NO: 1716581 - RNA, 17 nt, Homo sapiens
agcagccuggagaccca

SEQ ID NO: 1716582 - RNA, 14 nt, Homo sapiens
agcagcuuuaaaca

SEQ ID NO: 1716583 - RNA, 14 nt, Homo sapiens
agcaggaguggugc

SEQ ID NO: 1716584 - RNA, 14 nt, Homo sapiens
agcaggcaauuuca

SEQ ID NO: 1716585 - RNA, 21 nt, Homo sapiens
agcaggcagcgccaagugcgu

SEQ ID NO: 1716586 - RNA, 23 nt, Homo sapiens
agcaggcagcgccaagugcgugc

SEQ ID NO: 1716587 - RNA, 11 nt, Homo sapiens
agcaggcaugg

SEQ ID NO: 1716588 - RNA, 23 nt, Homo sapiens
agcagggaguacccagugccuac

SEQ ID NO: 1716589 - RNA, 24 nt, Homo sapiens
agcagggugaucgcacaaccugca

SEQ ID NO: 1716590 - RNA, 16 nt, Homo sapiens
agcaguaaauuugcua

SEQ ID NO: 1716591 - RNA, 22 nt, Homo sapiens
agcaguuuaugagacagcugag

SEQ ID NO: 1716592 - RNA, 14 nt, Homo sapiens
agcauaaguauaca

SEQ ID NO: 1716593 - RNA, 21 nt, Homo sapiens
agcaucuaaguuauaagacuc

SEQ ID NO: 1716594 - RNA, 15 nt, Homo sapiens
agcaugaugagaguu

SEQ ID NO: 1716595 - RNA, 13 nt, Homo sapiens
agcaugcuacagu

SEQ ID NO: 1716596 - RNA, 22 nt, Homo sapiens
agcauuuacagaaacgcaucca

SEQ ID NO: 1716597 - RNA, 16 nt, Homo sapiens
agcauuuagugcacag

SEQ ID NO: 1716598 - RNA, 22 nt, Homo sapiens
agcauuuccaacaccacagaca

SEQ ID NO: 1716599 - RNA, 19 nt, Homo sapiens
agcauuucuuuucuggcca

SEQ ID NO: 1716600 - RNA, 14 nt, Homo sapiens
agccaaacccauga

SEQ ID NO: 1716601 - RNA, 23 nt, Homo sapiens
agccaaauaaaaucuauacauac

SEQ ID NO: 1716602 - RNA, 17 nt, Homo sapiens
agccaacacccugucua

SEQ ID NO: 1716603 - RNA, 14 nt, Homo sapiens
agccaacuuuugca

SEQ ID NO: 1716604 - RNA, 22 nt, Homo sapiens
agccaagcuuguuaucagcuuu

SEQ ID NO: 1716605 - RNA, 15 nt, Homo sapiens
agccaauguuuucca

SEQ ID NO: 1716606 - RNA, 17 nt, Homo sapiens
agccacaagucuuccag

SEQ ID NO: 1716607 - RNA, 13 nt, Homo sapiens
agccacacuugaa

SEQ ID NO: 1716608 - RNA, 19 nt, Homo sapiens
agccacagcagguccucca

SEQ ID NO: 1716609 - RNA, 19 nt, Homo sapiens
agccacgggggacugacgc

SEQ ID NO: 1716610 - RNA, 18 nt, Homo sapiens
agccagccacacuugaac

SEQ ID NO: 1716611 - RNA, 13 nt, Homo sapiens
agccagcccggcc

SEQ ID NO: 1716612 - RNA, 22 nt, Homo sapiens
agccaggguggucuugaucucc

SEQ ID NO: 1716613 - RNA, 10 nt, Homo sapiens
agccauaaau

SEQ ID NO: 1716614 - RNA, 22 nt, Homo sapiens
agccauacuuaucucucugugc

SEQ ID NO: 1716615 - RNA, 15 nt, Homo sapiens
agccauuggcacugu

SEQ ID NO: 1716616 - RNA, 23 nt, Homo sapiens
agcccacauuggauucaucagca

SEQ ID NO: 1716617 - RNA, 16 nt, Homo sapiens
agcccaccuuggcuca

SEQ ID NO: 1716618 - RNA, 16 nt, Homo sapiens
agcccacuguuaauau

SEQ ID NO: 1716619 - RNA, 13 nt, Homo sapiens
agccccacugcca

SEQ ID NO: 1716620 - RNA, 22 nt, Homo sapiens
agccccauucugccugcccagg

SEQ ID NO: 1716621 - RNA, 18 nt, Homo sapiens
agccccuagaaacccaag

SEQ ID NO: 1716622 - RNA, 18 nt, Homo sapiens
aguguugggcaugugauc

SEQ ID NO: 1716623 - RNA, 14 nt, Homo sapiens
aguguuucuuccac

SEQ ID NO: 1716624 - RNA, 22 nt, Homo sapiens
aguguuuuagagagagaacuuu

SEQ ID NO: 1716625 - RNA, 21 nt, Homo sapiens
aguuaaauagaguauaugcac

SEQ ID NO: 1716626 - RNA, 12 nt, Homo sapiens
aguuaagacaug

SEQ ID NO: 1716627 - RNA, 19 nt, Homo sapiens
aguuaaggauuguuuuaaa

SEQ ID NO: 1716628 - RNA, 17 nt, Homo sapiens
aguuacugccgguuuga

SEQ ID NO: 1716629 - RNA, 12 nt, Homo sapiens
aguuacuugaaa

SEQ ID NO: 1716630 - RNA, 21 nt, Homo sapiens
aguuaugauguaaucucucug

SEQ ID NO: 1716631 - RNA, 18 nt, Homo sapiens
aguuauucauauucuguu

SEQ ID NO: 1716632 - RNA, 19 nt, Homo sapiens
aguucaauaaaugucuguu

SEQ ID NO: 1716633 - RNA, 22 nt, Homo sapiens
aguucauaccuaaguacuguaa

SEQ ID NO: 1716634 - RNA, 15 nt, Homo sapiens
aguuccaagagucua

SEQ ID NO: 1716635 - RNA, 14 nt, Homo sapiens
aguucccucuugcu

SEQ ID NO: 1716636 - RNA, 13 nt, Homo sapiens
aguucccuuggcc

SEQ ID NO: 1716637 - RNA, 17 nt, Homo sapiens
aguucccuuggccucag

SEQ ID NO: 1716638 - RNA, 16 nt, Homo sapiens
aguucuaagauucuga

SEQ ID NO: 1716639 - RNA, 20 nt, Homo sapiens
aguugaucuacaaaggccau

SEQ ID NO: 1716640 - RNA, 18 nt, Homo sapiens
aguugcguggacucugca

SEQ ID NO: 1716641 - RNA, 15 nt, Homo sapiens
aguugucaguauuau

SEQ ID NO: 1716642 - RNA, 23 nt, Homo sapiens
aguuuaauuuuugaaaacuggcu

SEQ ID NO: 1716643 - RNA, 21 nt, Homo sapiens
aguuuaugcugugcuaaauau

SEQ ID NO: 1716644 - RNA, 21 nt, Homo sapiens
aguuuauuuuuauacuuucag

SEQ ID NO: 1716645 - RNA, 21 nt, Homo sapiens
aguuucauguacaagaugaag

SEQ ID NO: 1716646 - RNA, 15 nt, Homo sapiens
aguuuccauauguua

SEQ ID NO: 1716647 - RNA, 17 nt, Homo sapiens
aguuuccauauguuaua

SEQ ID NO: 1716648 - RNA, 20 nt, Homo sapiens
aguuugacauuguauguauc

SEQ ID NO: 1716649 - RNA, 16 nt, Homo sapiens
aguuugauaccugcac

SEQ ID NO: 1716650 - RNA, 18 nt, Homo sapiens
aguuugauaccugcacug

SEQ ID NO: 1716651 - RNA, 21 nt, Homo sapiens
aguuugauaccugcacugucc

SEQ ID NO: 1716652 - RNA, 19 nt, Homo sapiens
aguuugcccugguuucacu

SEQ ID NO: 1716653 - RNA, 15 nt, Homo sapiens
aguuuuaaauaagcu

SEQ ID NO: 1716654 - RNA, 15 nt, Homo sapiens
auaaaaagugacaca

SEQ ID NO: 1716655 - RNA, 16 nt, Homo sapiens
auaaaaauauguacaa

SEQ ID NO: 1716656 - RNA, 22 nt, Homo sapiens
auaaaaaucauggcaacauaau

SEQ ID NO: 1716657 - RNA, 21 nt, Homo sapiens
auaaaagaaccgagcaauuuu

SEQ ID NO: 1716658 - RNA, 17 nt, Homo sapiens
auaaaauaguuguccau

SEQ ID NO: 1716659 - RNA, 19 nt, Homo sapiens
auaaaauccuaagacacaa

SEQ ID NO: 1716660 - RNA, 22 nt, Homo sapiens
auaaacagacuguuaauuauag

SEQ ID NO: 1716661 - RNA, 22 nt, Homo sapiens
auaaacauccuucaagaacucu

SEQ ID NO: 1716662 - RNA, 19 nt, Homo sapiens
auaaaccuccgccaaugca

SEQ ID NO: 1716663 - RNA, 20 nt, Homo sapiens
auaaagaauuaacagagauu

SEQ ID NO: 1716664 - RNA, 14 nt, Homo sapiens
auaaauaugcagug

SEQ ID NO: 1716665 - RNA, 18 nt, Homo sapiens
auaaauauuuuugccaua

SEQ ID NO: 1716666 - RNA, 14 nt, Homo sapiens
auaacaaaacacuc

SEQ ID NO: 1716667 - RNA, 13 nt, Homo sapiens
auaacagaauuaa

SEQ ID NO: 1716668 - RNA, 16 nt, Homo sapiens
auaacccacuugucac

SEQ ID NO: 1716669 - RNA, 17 nt, Homo sapiens
auaacucauugucugug

SEQ ID NO: 1716670 - RNA, 13 nt, Homo sapiens
auaagccagcugc

SEQ ID NO: 1716671 - RNA, 19 nt, Homo sapiens
auaagcucaugagaugaca

SEQ ID NO: 1716672 - RNA, 22 nt, Homo sapiens
auaagcucuccccaaacuugcu

SEQ ID NO: 1716673 - RNA, 18 nt, Homo sapiens
auaaggaaagcaaugacu

SEQ ID NO: 1716674 - RNA, 23 nt, Homo sapiens
auaagugggucaaguacaccagc

SEQ ID NO: 1716675 - RNA, 14 nt, Homo sapiens
auaauaaacauaau

SEQ ID NO: 1716676 - RNA, 19 nt, Homo sapiens
auaauaacucggauuccag

SEQ ID NO: 1716677 - RNA, 12 nt, Homo sapiens
auaauaccucaa

SEQ ID NO: 1716678 - RNA, 13 nt, Homo sapiens
auaauacucuguu

SEQ ID NO: 1716679 - RNA, 13 nt, Homo sapiens
auaaucagugugu

SEQ ID NO: 1716680 - RNA, 16 nt, Homo sapiens
auaaucagugugucua

SEQ ID NO: 1716681 - RNA, 18 nt, Homo sapiens
auaaucuaggcaugaaga

SEQ ID NO: 1716682 - RNA, 20 nt, Homo sapiens
auaaucuuuggguaacuuca

SEQ ID NO: 1716683 - RNA, 21 nt, Homo sapiens
auaaucuuuggguaacuucaa

SEQ ID NO: 1716684 - RNA, 15 nt, Homo sapiens
auaaugcuacugucu

SEQ ID NO: 1716685 - RNA, 13 nt, Homo sapiens
auaauguguguau

SEQ ID NO: 1716686 - RNA, 17 nt, Homo sapiens
auaauguuaaccaagga

SEQ ID NO: 1716687 - RNA, 13 nt, Homo sapiens
auaauucacucaa

SEQ ID NO: 1716688 - RNA, 20 nt, Homo sapiens
auaauucacucaagcacuga

SEQ ID NO: 1716689 - RNA, 18 nt, Homo sapiens
auaauuccuacagcacua

SEQ ID NO: 1716690 - RNA, 23 nt, Homo sapiens
auaauuccuauauccugugacug

SEQ ID NO: 1716691 - RNA, 15 nt, Homo sapiens
auaauuggaguagau

SEQ ID NO: 1716692 - RNA, 21 nt, Homo sapiens
auaauuguugaaauuuugcaa

SEQ ID NO: 1716693 - RNA, 13 nt, Homo sapiens
auaauuugaucuu

SEQ ID NO: 1716694 - RNA, 20 nt, Homo sapiens
auaauuuucauucauucacu

SEQ ID NO: 1716695 - RNA, 12 nt, Homo sapiens
auacaaaccuac

SEQ ID NO: 1716696 - RNA, 14 nt, Homo sapiens
auacaaaccuacca

SEQ ID NO: 1716697 - RNA, 17 nt, Homo sapiens
auacaaaccuaccaaaa

SEQ ID NO: 1716698 - RNA, 13 nt, Homo sapiens
auacaacauguag

SEQ ID NO: 1716699 - RNA, 19 nt, Homo sapiens
auacaaccucccucuuguu

SEQ ID NO: 1716700 - RNA, 11 nt, Homo sapiens
auacaguauuu

SEQ ID NO: 1716701 - RNA, 19 nt, Homo sapiens
auacauaacuaaauuugau

SEQ ID NO: 1716702 - RNA, 21 nt, Homo sapiens
auacauaacuaaauuugauac

SEQ ID NO: 1716703 - RNA, 19 nt, Homo sapiens
auacauauguagacuauau

SEQ ID NO: 1716704 - RNA, 15 nt, Homo sapiens
auacauccuggguaa

SEQ ID NO: 1716705 - RNA, 18 nt, Homo sapiens
auacaugcauacaaagag

SEQ ID NO: 1716706 - RNA, 14 nt, Homo sapiens
auaccaacuguaca

SEQ ID NO: 1716707 - RNA, 18 nt, Homo sapiens
auaccagcuuaugagcuc

SEQ ID NO: 1716708 - RNA, 19 nt, Homo sapiens
auaccauuuuuuaaggaaa

SEQ ID NO: 1716709 - RNA, 13 nt, Homo sapiens
auaccugcacugu

SEQ ID NO: 1716710 - RNA, 14 nt, Homo sapiens
auaccugcucuugu

SEQ ID NO: 1716711 - RNA, 16 nt, Homo sapiens
auaccuuuuuguguca

SEQ ID NO: 1716712 - RNA, 19 nt, Homo sapiens
auacgaaacacaaaccaca

SEQ ID NO: 1716713 - RNA, 18 nt, Homo sapiens
auacgguuuucauugaca

SEQ ID NO: 1716714 - RNA, 20 nt, Homo sapiens
auacguuugaaauaguugau

SEQ ID NO: 1716715 - RNA, 21 nt, Homo sapiens
auacuacauugaguagacaca

SEQ ID NO: 1716716 - RNA, 23 nt, Homo sapiens
auacuagucaccccaaguagucu

SEQ ID NO: 1716717 - RNA, 18 nt, Homo sapiens
auacucauuucuaaaaga

SEQ ID NO: 1716718 - RNA, 13 nt, Homo sapiens
auacugacuccua

SEQ ID NO: 1716719 - RNA, 18 nt, Homo sapiens
auacugcagugacugccg

SEQ ID NO: 1716720 - RNA, 15 nt, Homo sapiens
auacuggggcuuccu

SEQ ID NO: 1716721 - RNA, 18 nt, Homo sapiens
auacuguucaaugguucu

SEQ ID NO: 1716722 - RNA, 20 nt, Homo sapiens
auacuguucaaugguucuga

SEQ ID NO: 1716723 - RNA, 14 nt, Homo sapiens
auacuuucagucaa

SEQ ID NO: 1716724 - RNA, 19 nt, Homo sapiens
auagaaaauuaaacacaaa

SEQ ID NO: 1716725 - RNA, 14 nt, Homo sapiens
auagaaacaccagu

SEQ ID NO: 1716726 - RNA, 23 nt, Homo sapiens
auagagcuuuuaaaaauguccug

SEQ ID NO: 1716727 - RNA, 16 nt, Homo sapiens
auagagugucucaggg

SEQ ID NO: 1716728 - RNA, 14 nt, Homo sapiens
auagaugcacuuau

SEQ ID NO: 1716729 - RNA, 20 nt, Homo sapiens
auagaugucuagguacuuca

SEQ ID NO: 1716730 - RNA, 13 nt, Homo sapiens
auagcaagacaca

SEQ ID NO: 1716731 - RNA, 18 nt, Homo sapiens
auagcauugcuuucgugu

SEQ ID NO: 1716732 - RNA, 21 nt, Homo sapiens
ccacgcuagggcggggcacag

SEQ ID NO: 1716733 - RNA, 17 nt, Homo sapiens
ccacuaacuccugagaa

SEQ ID NO: 1716734 - RNA, 14 nt, Homo sapiens
ccacuaagaauuca

SEQ ID NO: 1716735 - RNA, 22 nt, Homo sapiens
ccacuaauuguguacauaugua

SEQ ID NO: 1716736 - RNA, 21 nt, Homo sapiens
ccacucaggcauuugacugaa

SEQ ID NO: 1716737 - RNA, 14 nt, Homo sapiens
ccacuguguauaga

SEQ ID NO: 1716738 - RNA, 21 nt, Homo sapiens
ccacuguuucucuugagcugg

SEQ ID NO: 1716739 - RNA, 19 nt, Homo sapiens
ccacuuagaaauugcauuu

SEQ ID NO: 1716740 - RNA, 19 nt, Homo sapiens
ccacuuugcacauuuugau

SEQ ID NO: 1716741 - RNA, 18 nt, Homo sapiens
ccagaagaagagaagcug

SEQ ID NO: 1716742 - RNA, 17 nt, Homo sapiens
ccagaagcuuccauagu

SEQ ID NO: 1716743 - RNA, 17 nt, Homo sapiens
ccagaaggcgugcuggc

SEQ ID NO: 1716744 - RNA, 12 nt, Homo sapiens
ccagaaugcugc

SEQ ID NO: 1716745 - RNA, 20 nt, Homo sapiens
ccagacauacgaaacacaaa

SEQ ID NO: 1716746 - RNA, 19 nt, Homo sapiens
ccagagaggguggugaccu

SEQ ID NO: 1716747 - RNA, 19 nt, Homo sapiens
ccagagaguccugugcuga

SEQ ID NO: 1716748 - RNA, 14 nt, Homo sapiens
ccagagcaaaauaa

SEQ ID NO: 1716749 - RNA, 15 nt, Homo sapiens
ccagaggcaguaacc

SEQ ID NO: 1716750 - RNA, 19 nt, Homo sapiens
ccagaggcuauuauuuuca

SEQ ID NO: 1716751 - RNA, 17 nt, Homo sapiens
ccagaggguugugauuu

SEQ ID NO: 1716752 - RNA, 20 nt, Homo sapiens
ccagaguggccuggccagga

SEQ ID NO: 1716753 - RNA, 14 nt, Homo sapiens
ccagaucacugcca

SEQ ID NO: 1716754 - RNA, 20 nt, Homo sapiens
ccagaugugaaaacaucuca

SEQ ID NO: 1716755 - RNA, 12 nt, Homo sapiens
ccagauugcaac

SEQ ID NO: 1716756 - RNA, 19 nt, Homo sapiens
ccagcaauuccugagccaa

SEQ ID NO: 1716757 - RNA, 12 nt, Homo sapiens
ccagcaccacuu

SEQ ID NO: 1716758 - RNA, 18 nt, Homo sapiens
ccagcacucugaaacuga

SEQ ID NO: 1716759 - RNA, 16 nt, Homo sapiens
ccagcacuuugggagg

SEQ ID NO: 1716760 - RNA, 22 nt, Homo sapiens
ccagccaaccucauugcagcua

SEQ ID NO: 1716761 - RNA, 22 nt, Homo sapiens
ccagccaccccgggcucucugc

SEQ ID NO: 1716762 - RNA, 15 nt, Homo sapiens
ccagccccacugcca

SEQ ID NO: 1716763 - RNA, 21 nt, Homo sapiens
ccagccuaugagcauccugag

SEQ ID NO: 1716764 - RNA, 12 nt, Homo sapiens
ccagccugacca

SEQ ID NO: 1716765 - RNA, 19 nt, Homo sapiens
ccagccuggccaacauggc

SEQ ID NO: 1716766 - RNA, 20 nt, Homo sapiens
ccagccugggcaacagagca

SEQ ID NO: 1716767 - RNA, 19 nt, Homo sapiens
ccagcuaacaggucuagaa

SEQ ID NO: 1716768 - RNA, 15 nt, Homo sapiens
ccagcucagucccau

SEQ ID NO: 1716769 - RNA, 15 nt, Homo sapiens
ccagcugccuuggac

SEQ ID NO: 1716770 - RNA, 16 nt, Homo sapiens
ccagcugcugucuucu

SEQ ID NO: 1716771 - RNA, 13 nt, Homo sapiens
ccaggagacaguu

SEQ ID NO: 1716772 - RNA, 18 nt, Homo sapiens
ccaggaguuugagaccag

SEQ ID NO: 1716773 - RNA, 15 nt, Homo sapiens
ccaggauagugggca

SEQ ID NO: 1716774 - RNA, 17 nt, Homo sapiens
ccaggcaggugccugga

SEQ ID NO: 1716775 - RNA, 15 nt, Homo sapiens
ccaggccucaccaaa

SEQ ID NO: 1716776 - RNA, 21 nt, Homo sapiens
ccaggccucaccaaagcccac

SEQ ID NO: 1716777 - RNA, 16 nt, Homo sapiens
ccaggcuggucucaaa

SEQ ID NO: 1716778 - RNA, 16 nt, Homo sapiens
ccagggcugcccugag

SEQ ID NO: 1716779 - RNA, 12 nt, Homo sapiens
ccaguccaugcu

SEQ ID NO: 1716780 - RNA, 20 nt, Homo sapiens
ccagugcuguccaugcuucu

SEQ ID NO: 1716781 - RNA, 17 nt, Homo sapiens
ccagugcuuuaauggca

SEQ ID NO: 1716782 - RNA, 14 nt, Homo sapiens
ccaguuaugaauca

SEQ ID NO: 1716783 - RNA, 22 nt, Homo sapiens
ccaguuccuguagaacugagaa

SEQ ID NO: 1716784 - RNA, 15 nt, Homo sapiens
ccaguugguuuaaug

SEQ ID NO: 1716785 - RNA, 19 nt, Homo sapiens
ccaguuuucccucugggag

SEQ ID NO: 1716786 - RNA, 19 nt, Homo sapiens
ccauaauccuuucugccga

SEQ ID NO: 1716787 - RNA, 22 nt, Homo sapiens
ccauagaaacaugacacugacc

SEQ ID NO: 1716788 - RNA, 15 nt, Homo sapiens
ccauagucacauggc

SEQ ID NO: 1716789 - RNA, 16 nt, Homo sapiens
ccauagucacauggcc

SEQ ID NO: 1716790 - RNA, 18 nt, Homo sapiens
ccauauauaacagauaca

SEQ ID NO: 1716791 - RNA, 22 nt, Homo sapiens
ccauaucuuaaagaaacagcuu

SEQ ID NO: 1716792 - RNA, 12 nt, Homo sapiens
ccaucacaugau

SEQ ID NO: 1716793 - RNA, 14 nt, Homo sapiens
ccauccaccgcugc

SEQ ID NO: 1716794 - RNA, 21 nt, Homo sapiens
ccauccuugacuuugaacuaa

SEQ ID NO: 1716795 - RNA, 22 nt, Homo sapiens
ccaucucgggcacaggcccacc

SEQ ID NO: 1716796 - RNA, 22 nt, Homo sapiens
ccaucucuacuaaaaauacaaa

SEQ ID NO: 1716797 - RNA, 18 nt, Homo sapiens
ccaugaccugcgcucuca

SEQ ID NO: 1716798 - RNA, 21 nt, Homo sapiens
ccaugagacccuggugccugg

SEQ ID NO: 1716799 - RNA, 12 nt, Homo sapiens
ccaugcugccag

SEQ ID NO: 1716800 - RNA, 14 nt, Homo sapiens
ccauggacacucca

SEQ ID NO: 1716801 - RNA, 22 nt, Homo sapiens
ccauggagacaagggcaucauc

SEQ ID NO: 1716802 - RNA, 13 nt, Homo sapiens
ccaugggauacaa

SEQ ID NO: 1716803 - RNA, 18 nt, Homo sapiens
ccauggggacgcccucag

SEQ ID NO: 1716804 - RNA, 19 nt, Homo sapiens
ccauguuguaaugcugcac

SEQ ID NO: 1716805 - RNA, 15 nt, Homo sapiens
ccauuaaaacugcuu

SEQ ID NO: 1716806 - RNA, 22 nt, Homo sapiens
ccauucauacccacacacccag

SEQ ID NO: 1716807 - RNA, 17 nt, Homo sapiens
ccauuccagacugcuuc

SEQ ID NO: 1716808 - RNA, 21 nt, Homo sapiens
cccaaacuugcuuuaugccuu

SEQ ID NO: 1716809 - RNA, 20 nt, Homo sapiens
cccaaauuaagaaucuagga

SEQ ID NO: 1716810 - RNA, 16 nt, Homo sapiens
cccaacaaaccaucca

SEQ ID NO: 1716811 - RNA, 15 nt, Homo sapiens
cccaacccuaucucc

SEQ ID NO: 1716812 - RNA, 15 nt, Homo sapiens
cccaacgcacaggaa

SEQ ID NO: 1716813 - RNA, 19 nt, Homo sapiens
cccaacuagacauuaccaa

SEQ ID NO: 1716814 - RNA, 23 nt, Homo sapiens
cccaacugaguguuauuugcaca

SEQ ID NO: 1716815 - RNA, 17 nt, Homo sapiens
cccaacuugagauguau

SEQ ID NO: 1716816 - RNA, 18 nt, Homo sapiens
cccaagccagcccggccg

SEQ ID NO: 1716817 - RNA, 22 nt, Homo sapiens
cccaaugcacauccauucccaa

SEQ ID NO: 1716818 - RNA, 18 nt, Homo sapiens
cccacacagcuacagcuu

SEQ ID NO: 1716819 - RNA, 23 nt, Homo sapiens
cccacagcugagaauguggaaua

SEQ ID NO: 1716820 - RNA, 17 nt, Homo sapiens
cccacauccaacuccag

SEQ ID NO: 1716821 - RNA, 15 nt, Homo sapiens
cccaccaucaugucu

SEQ ID NO: 1716822 - RNA, 17 nt, Homo sapiens
cccacccacaugugaca

SEQ ID NO: 1716823 - RNA, 21 nt, Homo sapiens
cccacccccuucucugcucca

SEQ ID NO: 1716824 - RNA, 21 nt, Homo sapiens
cccacccuccuuucaccacau

SEQ ID NO: 1716825 - RNA, 16 nt, Homo sapiens
cccacccugcugccuu

SEQ ID NO: 1716826 - RNA, 13 nt, Homo sapiens
cccaccuccagcc

SEQ ID NO: 1716827 - RNA, 19 nt, Homo sapiens
cccacgcuggagugcagug

SEQ ID NO: 1716828 - RNA, 22 nt, Homo sapiens
cccacugaguuugcuguuugca

SEQ ID NO: 1716829 - RNA, 13 nt, Homo sapiens
cccacugcuucua

SEQ ID NO: 1716830 - RNA, 12 nt, Homo sapiens
cccagagcagga

SEQ ID NO: 1716831 - RNA, 23 nt, Homo sapiens
cccagagguaacagaacagcuuc

SEQ ID NO: 1716832 - RNA, 20 nt, Homo sapiens
cccagcccacuucugccaua

SEQ ID NO: 1716833 - RNA, 12 nt, Homo sapiens
cccagccuauga

SEQ ID NO: 1716834 - RNA, 13 nt, Homo sapiens
cccagccucuggc

SEQ ID NO: 1716835 - RNA, 14 nt, Homo sapiens
cccaggcaaauagg

SEQ ID NO: 1716836 - RNA, 19 nt, Homo sapiens
cccaggccgggguggagca

SEQ ID NO: 1716837 - RNA, 16 nt, Homo sapiens
cccaggcugugcagcg

SEQ ID NO: 1716838 - RNA, 17 nt, Homo sapiens
cccagggaagccaaaag

SEQ ID NO: 1716839 - RNA, 12 nt, Homo sapiens
cccagggggaga

SEQ ID NO: 1716840 - RNA, 13 nt, Homo sapiens
cccaguccaugcu

SEQ ID NO: 1716841 - RNA, 23 nt, Homo sapiens
cccauagaaacaugacacugacc

SEQ ID NO: 1716842 - RNA, 14 nt, Homo sapiens
cuaauuuauucaaa

SEQ ID NO: 1716843 - RNA, 20 nt, Homo sapiens
cuaauuuuaguauucauucu

SEQ ID NO: 1716844 - RNA, 15 nt, Homo sapiens
cuacaaaaaugaagc

SEQ ID NO: 1716845 - RNA, 23 nt, Homo sapiens
cuacaaacucccacuugucaugu

SEQ ID NO: 1716846 - RNA, 22 nt, Homo sapiens
cuacaauuaauaguuugucuau

SEQ ID NO: 1716847 - RNA, 22 nt, Homo sapiens
cuacacuggguucugcuacucc

SEQ ID NO: 1716848 - RNA, 14 nt, Homo sapiens
cuacagauagaaaa

SEQ ID NO: 1716849 - RNA, 19 nt, Homo sapiens
cuacagggccacaacugcc

SEQ ID NO: 1716850 - RNA, 14 nt, Homo sapiens
cuaccaucagggac

SEQ ID NO: 1716851 - RNA, 15 nt, Homo sapiens
cuaccaucagggaca

SEQ ID NO: 1716852 - RNA, 18 nt, Homo sapiens
cuaccauuugaauuugug

SEQ ID NO: 1716853 - RNA, 14 nt, Homo sapiens
cuacccugcugacc

SEQ ID NO: 1716854 - RNA, 18 nt, Homo sapiens
cuacccugcugaccuccc

SEQ ID NO: 1716855 - RNA, 17 nt, Homo sapiens
cuacccuuuucugggga

SEQ ID NO: 1716856 - RNA, 17 nt, Homo sapiens
cuacgaauauagagggu

SEQ ID NO: 1716857 - RNA, 14 nt, Homo sapiens
cuacgaaucuuccg

SEQ ID NO: 1716858 - RNA, 14 nt, Homo sapiens
cuacguauccugca

SEQ ID NO: 1716859 - RNA, 20 nt, Homo sapiens
cuacuaaguucacauuagaa

SEQ ID NO: 1716860 - RNA, 12 nt, Homo sapiens
cuacuccugacu

SEQ ID NO: 1716861 - RNA, 12 nt, Homo sapiens
cuacucuuugau

SEQ ID NO: 1716862 - RNA, 19 nt, Homo sapiens
cuacugggugucauuucau

SEQ ID NO: 1716863 - RNA, 12 nt, Homo sapiens
cuacuguucuaa

SEQ ID NO: 1716864 - RNA, 14 nt, Homo sapiens
cuagaacucuccau

SEQ ID NO: 1716865 - RNA, 19 nt, Homo sapiens
cuagaacucuccaucuuau

SEQ ID NO: 1716866 - RNA, 18 nt, Homo sapiens
cuagaagaagcuauguca

SEQ ID NO: 1716867 - RNA, 10 nt, Homo sapiens
cuagaaggca

SEQ ID NO: 1716868 - RNA, 18 nt, Homo sapiens
cuagacauggagguucua

SEQ ID NO: 1716869 - RNA, 15 nt, Homo sapiens
cuagagauuacaauu

SEQ ID NO: 1716870 - RNA, 14 nt, Homo sapiens
cuagaguccucacu

SEQ ID NO: 1716871 - RNA, 16 nt, Homo sapiens
cuagauuuucuacuuu

SEQ ID NO: 1716872 - RNA, 18 nt, Homo sapiens
cuagauuuucuacuuuau

SEQ ID NO: 1716873 - RNA, 15 nt, Homo sapiens
cuagcaauuccauca

SEQ ID NO: 1716874 - RNA, 13 nt, Homo sapiens
cuagccugcacuu

SEQ ID NO: 1716875 - RNA, 16 nt, Homo sapiens
cuagcuaauguaauaa

SEQ ID NO: 1716876 - RNA, 13 nt, Homo sapiens
cuaggagaccaag

SEQ ID NO: 1716877 - RNA, 18 nt, Homo sapiens
cuaggccucaauuguucc

SEQ ID NO: 1716878 - RNA, 20 nt, Homo sapiens
cuaggcucagagaugugcac

SEQ ID NO: 1716879 - RNA, 15 nt, Homo sapiens
cuagguagaaaaagg

SEQ ID NO: 1716880 - RNA, 22 nt, Homo sapiens
cuaguaaguaauuaugcacuaa

SEQ ID NO: 1716881 - RNA, 21 nt, Homo sapiens
cuaguauuucaugcugggaau

SEQ ID NO: 1716882 - RNA, 13 nt, Homo sapiens
cuaguguucuguc

SEQ ID NO: 1716883 - RNA, 17 nt, Homo sapiens
cuaguucccucugcuca

SEQ ID NO: 1716884 - RNA, 16 nt, Homo sapiens
cuauaagcccacuguu

SEQ ID NO: 1716885 - RNA, 12 nt, Homo sapiens
cuauacaucucu

SEQ ID NO: 1716886 - RNA, 16 nt, Homo sapiens
cuauacuugaacaaaa

SEQ ID NO: 1716887 - RNA, 23 nt, Homo sapiens
cuauagccuaggugacagaguga

SEQ ID NO: 1716888 - RNA, 18 nt, Homo sapiens
cuauagcugcuauagcaa

SEQ ID NO: 1716889 - RNA, 13 nt, Homo sapiens
cuauaguucuaga

SEQ ID NO: 1716890 - RNA, 17 nt, Homo sapiens
cuauauacaugugugua

SEQ ID NO: 1716891 - RNA, 17 nt, Homo sapiens
cuauauacuauaugauu

SEQ ID NO: 1716892 - RNA, 18 nt, Homo sapiens
cuauauacuauaugauuc

SEQ ID NO: 1716893 - RNA, 16 nt, Homo sapiens
cuauauagaaugcugc

SEQ ID NO: 1716894 - RNA, 14 nt, Homo sapiens
cuauauauguguau

SEQ ID NO: 1716895 - RNA, 22 nt, Homo sapiens
cuauauccugugacugucucac

SEQ ID NO: 1716896 - RNA, 12 nt, Homo sapiens
cuauauuugcua

SEQ ID NO: 1716897 - RNA, 13 nt, Homo sapiens
cuaucaacaaaga

SEQ ID NO: 1716898 - RNA, 18 nt, Homo sapiens
cuaugaaaauuauaucuc

SEQ ID NO: 1716899 - RNA, 19 nt, Homo sapiens
cuaugaaugauacccugaa

SEQ ID NO: 1716900 - RNA, 22 nt, Homo sapiens
cuaugcaacagcucucaccuac

SEQ ID NO: 1716901 - RNA, 14 nt, Homo sapiens
cuaugcacauaugg

SEQ ID NO: 1716902 - RNA, 11 nt, Homo sapiens
cuaugggacuc

SEQ ID NO: 1716903 - RNA, 17 nt, Homo sapiens
cuauguugugguccauc

SEQ ID NO: 1716904 - RNA, 14 nt, Homo sapiens
cuauguuuauuuac

SEQ ID NO: 1716905 - RNA, 20 nt, Homo sapiens
cuauuaaagugauuucauuc

SEQ ID NO: 1716906 - RNA, 16 nt, Homo sapiens
cuauuacaccaaauaa

SEQ ID NO: 1716907 - RNA, 23 nt, Homo sapiens
cuauuguugaugggcacuugaga

SEQ ID NO: 1716908 - RNA, 23 nt, Homo sapiens
cuauuuaccugcaggcugagcca

SEQ ID NO: 1716909 - RNA, 20 nt, Homo sapiens
cuauuucauuuuuugcauca

SEQ ID NO: 1716910 - RNA, 11 nt, Homo sapiens
cuauuuccauu

SEQ ID NO: 1716911 - RNA, 17 nt, Homo sapiens
cuauuucuacacagugg

SEQ ID NO: 1716912 - RNA, 12 nt, Homo sapiens
cuauuugccaug

SEQ ID NO: 1716913 - RNA, 15 nt, Homo sapiens
cuauuugccaugggc

SEQ ID NO: 1716914 - RNA, 23 nt, Homo sapiens
cucaaauuauuuaaaaugcauaa

SEQ ID NO: 1716915 - RNA, 20 nt, Homo sapiens
cucaacaaagcacaguguua

SEQ ID NO: 1716916 - RNA, 14 nt, Homo sapiens
cucaacaugcugcc

SEQ ID NO: 1716917 - RNA, 22 nt, Homo sapiens
cucaaccuccugggcuaaguga

SEQ ID NO: 1716918 - RNA, 22 nt, Homo sapiens
cucaaccuccuguggaacccag

SEQ ID NO: 1716919 - RNA, 16 nt, Homo sapiens
cucaagacaaugcacc

SEQ ID NO: 1716920 - RNA, 12 nt, Homo sapiens
cucaaguucuaa

SEQ ID NO: 1716921 - RNA, 11 nt, Homo sapiens
cucaauggagu

SEQ ID NO: 1716922 - RNA, 21 nt, Homo sapiens
cucaauguuugaggagcaugu

SEQ ID NO: 1716923 - RNA, 19 nt, Homo sapiens
cucacagagugcauuguga

SEQ ID NO: 1716924 - RNA, 20 nt, Homo sapiens
cucacagagugcauugugag

SEQ ID NO: 1716925 - RNA, 14 nt, Homo sapiens
cucacaguguugcc

SEQ ID NO: 1716926 - RNA, 17 nt, Homo sapiens
cucacauuuauucugcu

SEQ ID NO: 1716927 - RNA, 13 nt, Homo sapiens
cucacauuucacc

SEQ ID NO: 1716928 - RNA, 23 nt, Homo sapiens
cucaccucuacccaaacccuagg

SEQ ID NO: 1716929 - RNA, 17 nt, Homo sapiens
cucaccuguuacugaaa

SEQ ID NO: 1716930 - RNA, 19 nt, Homo sapiens
cucacgcccuaagcgcaca

SEQ ID NO: 1716931 - RNA, 15 nt, Homo sapiens
cucacucaccaucug

SEQ ID NO: 1716932 - RNA, 23 nt, Homo sapiens
cucacuggggccuacagcuuuga

SEQ ID NO: 1716933 - RNA, 23 nt, Homo sapiens
cucagaacaguaucuuugcacuc

SEQ ID NO: 1716934 - RNA, 21 nt, Homo sapiens
cucagaagugaaaaucuugga

SEQ ID NO: 1716935 - RNA, 23 nt, Homo sapiens
cucagagaauuucuaccauuuca

SEQ ID NO: 1716936 - RNA, 18 nt, Homo sapiens
cucagccucccaaagugc

SEQ ID NO: 1716937 - RNA, 18 nt, Homo sapiens
cucagcuuugagaagccu

SEQ ID NO: 1716938 - RNA, 16 nt, Homo sapiens
cucagggagcagggaa

SEQ ID NO: 1716939 - RNA, 14 nt, Homo sapiens
cucagggcagccuc

SEQ ID NO: 1716940 - RNA, 23 nt, Homo sapiens
cucagggcagccucccccggcuc

SEQ ID NO: 1716941 - RNA, 18 nt, Homo sapiens
cucagucaugcauaaaua

SEQ ID NO: 1716942 - RNA, 13 nt, Homo sapiens
cucaguccuguac

SEQ ID NO: 1716943 - RNA, 19 nt, Homo sapiens
cucaguccuguacucuggg

SEQ ID NO: 1716944 - RNA, 12 nt, Homo sapiens
cucagugccugg

SEQ ID NO: 1716945 - RNA, 18 nt, Homo sapiens
cucaguuugugugucuua

SEQ ID NO: 1716946 - RNA, 16 nt, Homo sapiens
cucauaaaguagauua

SEQ ID NO: 1716947 - RNA, 17 nt, Homo sapiens
cucauaggaugguacca

SEQ ID NO: 1716948 - RNA, 15 nt, Homo sapiens
cucaucccaugagac

SEQ ID NO: 1716949 - RNA, 16 nt, Homo sapiens
cucaugcuucacuuag

SEQ ID NO: 1716950 - RNA, 15 nt, Homo sapiens
cucauguggccaagc

SEQ ID NO: 1716951 - RNA, 13 nt, Homo sapiens
cucauuccaccuu

SEQ ID NO: 1716952 - RNA, 21 nt, Homo sapiens
cucauuuagaacuugcagcug

SEQ ID NO: 1716953 - RNA, 21 nt, Homo sapiens
cuuaugcaaucuauguuugca

SEQ ID NO: 1716954 - RNA, 23 nt, Homo sapiens
cuuauggaauugauuugcauuga

SEQ ID NO: 1716955 - RNA, 22 nt, Homo sapiens
cuuaugggucccccucagcaag

SEQ ID NO: 1716956 - RNA, 18 nt, Homo sapiens
cuuauguagauauuuggc

SEQ ID NO: 1716957 - RNA, 21 nt, Homo sapiens
cuuauuacaauuuguucaucc

SEQ ID NO: 1716958 - RNA, 14 nt, Homo sapiens
cuucaaaucagaag

SEQ ID NO: 1716959 - RNA, 17 nt, Homo sapiens
cuucaaccucauugaca

SEQ ID NO: 1716960 - RNA, 17 nt, Homo sapiens
cuucaccuaagucucug

SEQ ID NO: 1716961 - RNA, 12 nt, Homo sapiens
cuucacuacuuu

SEQ ID NO: 1716962 - RNA, 16 nt, Homo sapiens
cuucacucugggcaca

SEQ ID NO: 1716963 - RNA, 11 nt, Homo sapiens
cuucacugaag

SEQ ID NO: 1716964 - RNA, 22 nt, Homo sapiens
cuucaguauuuuuaaauuguaa

SEQ ID NO: 1716965 - RNA, 22 nt, Homo sapiens
cuucagucuugaauuucuaaaa

SEQ ID NO: 1716966 - RNA, 23 nt, Homo sapiens
cuucauauguuggguaagaaaca

SEQ ID NO: 1716967 - RNA, 18 nt, Homo sapiens
cuucauggaacucagcug

SEQ ID NO: 1716968 - RNA, 14 nt, Homo sapiens
cuucaugugcugcc

SEQ ID NO: 1716969 - RNA, 16 nt, Homo sapiens
cuucauucacauucag

SEQ ID NO: 1716970 - RNA, 18 nt, Homo sapiens
cuuccagaucacugccac

SEQ ID NO: 1716971 - RNA, 20 nt, Homo sapiens
cuuccagugcccuaggccug

SEQ ID NO: 1716972 - RNA, 15 nt, Homo sapiens
cuuccagugcucaga

SEQ ID NO: 1716973 - RNA, 20 nt, Homo sapiens
cuuccauaaugcuacugucu

SEQ ID NO: 1716974 - RNA, 12 nt, Homo sapiens
cuuccauuccau

SEQ ID NO: 1716975 - RNA, 11 nt, Homo sapiens
cuuccauuugc

SEQ ID NO: 1716976 - RNA, 20 nt, Homo sapiens
cuucccaaucagcacugaaa

SEQ ID NO: 1716977 - RNA, 19 nt, Homo sapiens
cuucccacucaccccggca

SEQ ID NO: 1716978 - RNA, 21 nt, Homo sapiens
cuucccaugucuuucuccaaa

SEQ ID NO: 1716979 - RNA, 18 nt, Homo sapiens
cuucccccuuccaaauaa

SEQ ID NO: 1716980 - RNA, 22 nt, Homo sapiens
cuucccgccagagggcuuguga

SEQ ID NO: 1716981 - RNA, 19 nt, Homo sapiens
cuucccucggggccauacu

SEQ ID NO: 1716982 - RNA, 22 nt, Homo sapiens
cuuccucacagucccacugugc

SEQ ID NO: 1716983 - RNA, 18 nt, Homo sapiens
cuuccuccucgcugccag

SEQ ID NO: 1716984 - RNA, 15 nt, Homo sapiens
cuuccucuccacugc

SEQ ID NO: 1716985 - RNA, 20 nt, Homo sapiens
cuuccugaguggccagggaa

SEQ ID NO: 1716986 - RNA, 13 nt, Homo sapiens
cuuccugccccuc

SEQ ID NO: 1716987 - RNA, 17 nt, Homo sapiens
cuuccugggcaaagaag

SEQ ID NO: 1716988 - RNA, 14 nt, Homo sapiens
cuuccugugaucca

SEQ ID NO: 1716989 - RNA, 16 nt, Homo sapiens
cuuccuguuaauguau

SEQ ID NO: 1716990 - RNA, 20 nt, Homo sapiens
cuuccuugggaugaucuuga

SEQ ID NO: 1716991 - RNA, 22 nt, Homo sapiens
cuuccuuucuccaggaccaaua

SEQ ID NO: 1716992 - RNA, 13 nt, Homo sapiens
cuucggauaugau

SEQ ID NO: 1716993 - RNA, 16 nt, Homo sapiens
cuucguuagaccgcuc

SEQ ID NO: 1716994 - RNA, 19 nt, Homo sapiens
cuucuaaacccaauccaaa

SEQ ID NO: 1716995 - RNA, 18 nt, Homo sapiens
cuucuacgggauggccag

SEQ ID NO: 1716996 - RNA, 18 nt, Homo sapiens
cuucuauuccauggcuaa

SEQ ID NO: 1716997 - RNA, 21 nt, Homo sapiens
cuucucaaaacuggacaguca

SEQ ID NO: 1716998 - RNA, 20 nt, Homo sapiens
cuucucauccccagucccaa

SEQ ID NO: 1716999 - RNA, 13 nt, Homo sapiens
cuucucugcucca

SEQ ID NO: 1717000 - RNA, 16 nt, Homo sapiens
cuucucuugagucaca

SEQ ID NO: 1717001 - RNA, 19 nt, Homo sapiens
cuucugacuuuuagaaaca

SEQ ID NO: 1717002 - RNA, 14 nt, Homo sapiens
cuucugcaacaucu

SEQ ID NO: 1717003 - RNA, 16 nt, Homo sapiens
cuucuguucugcagac

SEQ ID NO: 1717004 - RNA, 17 nt, Homo sapiens
cuucuguuuccaucugc

SEQ ID NO: 1717005 - RNA, 15 nt, Homo sapiens
cuucuuacuggugcu

SEQ ID NO: 1717006 - RNA, 21 nt, Homo sapiens
cuucuuagcacuguugagagg

SEQ ID NO: 1717007 - RNA, 18 nt, Homo sapiens
cuucuuccugggucuuca

SEQ ID NO: 1717008 - RNA, 13 nt, Homo sapiens
cuucuugggggua

SEQ ID NO: 1717009 - RNA, 11 nt, Homo sapiens
cuucuugucag

SEQ ID NO: 1717010 - RNA, 17 nt, Homo sapiens
cuucuuuauacuguaau

SEQ ID NO: 1717011 - RNA, 22 nt, Homo sapiens
cuucuuugacaccacaccauca

SEQ ID NO: 1717012 - RNA, 17 nt, Homo sapiens
cuucuuuuggcuuccau

SEQ ID NO: 1717013 - RNA, 14 nt, Homo sapiens
cuugaaacauuaua

SEQ ID NO: 1717014 - RNA, 17 nt, Homo sapiens
cuugaaccacaguucua

SEQ ID NO: 1717015 - RNA, 14 nt, Homo sapiens
cuugaaugcugcca

SEQ ID NO: 1717016 - RNA, 16 nt, Homo sapiens
cuugaauguggcuuga

SEQ ID NO: 1717017 - RNA, 13 nt, Homo sapiens
cuugaaugugguc

SEQ ID NO: 1717018 - RNA, 14 nt, Homo sapiens
cuugacagggcaca

SEQ ID NO: 1717019 - RNA, 20 nt, Homo sapiens
cuugaccuaagggacuccca

SEQ ID NO: 1717020 - RNA, 19 nt, Homo sapiens
cuugaccucaggugaucca

SEQ ID NO: 1717021 - RNA, 20 nt, Homo sapiens
cuugagggugcuuguucccu

SEQ ID NO: 1717022 - RNA, 14 nt, Homo sapiens
cuugaguucccaga

SEQ ID NO: 1717023 - RNA, 19 nt, Homo sapiens
cuugauaggaauucaucuu

SEQ ID NO: 1717024 - RNA, 20 nt, Homo sapiens
cuugaucauuauaucauugg

SEQ ID NO: 1717025 - RNA, 16 nt, Homo sapiens
cuugaugccauaugcc

SEQ ID NO: 1717026 - RNA, 17 nt, Homo sapiens
cuugauucugcaguaaa

SEQ ID NO: 1717027 - RNA, 17 nt, Homo sapiens
cuugcagcuaguuuucu

SEQ ID NO: 1717028 - RNA, 20 nt, Homo sapiens
cuugccuaaauacaagggcu

SEQ ID NO: 1717029 - RNA, 21 nt, Homo sapiens
cuugcuaaaagauuauagaag

SEQ ID NO: 1717030 - RNA, 18 nt, Homo sapiens
cuugcuagcuaugugacc

SEQ ID NO: 1717031 - RNA, 12 nt, Homo sapiens
cuugcucagugg

SEQ ID NO: 1717032 - RNA, 20 nt, Homo sapiens
cuuggagggauaagccagcu

SEQ ID NO: 1717033 - RNA, 19 nt, Homo sapiens
cuuggagggcccacuugua

SEQ ID NO: 1717034 - RNA, 13 nt, Homo sapiens
cuuggaugugguu

SEQ ID NO: 1717035 - RNA, 14 nt, Homo sapiens
cuuggcaaaagccu

SEQ ID NO: 1717036 - RNA, 19 nt, Homo sapiens
cuuggcaaauuccuaguca

SEQ ID NO: 1717037 - RNA, 13 nt, Homo sapiens
cuuguaaauuaca

SEQ ID NO: 1717038 - RNA, 20 nt, Homo sapiens
cuuguacccccagguggaag

SEQ ID NO: 1717039 - RNA, 13 nt, Homo sapiens
cuuguagcuguaa

SEQ ID NO: 1717040 - RNA, 16 nt, Homo sapiens
cuuguaucaacacugu

SEQ ID NO: 1717041 - RNA, 23 nt, Homo sapiens
cuugucagacauaaagccauguu

SEQ ID NO: 1717042 - RNA, 11 nt, Homo sapiens
cuugugccaua

SEQ ID NO: 1717043 - RNA, 23 nt, Homo sapiens
cuuguuaucagcuuucagggcca

SEQ ID NO: 1717044 - RNA, 16 nt, Homo sapiens
cuuguuccccacugac

SEQ ID NO: 1717045 - RNA, 15 nt, Homo sapiens
cuuguucuacugaga

SEQ ID NO: 1717046 - RNA, 16 nt, Homo sapiens
cuuguucuacugagaa

SEQ ID NO: 1717047 - RNA, 23 nt, Homo sapiens
cuuguuucacacuagucacauuc

SEQ ID NO: 1717048 - RNA, 16 nt, Homo sapiens
cuuuaaacaaauucau

SEQ ID NO: 1717049 - RNA, 21 nt, Homo sapiens
cuuuaaccccaaauuuggcua

SEQ ID NO: 1717050 - RNA, 20 nt, Homo sapiens
cuuuaagagagaaaucugaa

SEQ ID NO: 1717051 - RNA, 16 nt, Homo sapiens
cuuuacaauuucacuu

SEQ ID NO: 1717052 - RNA, 19 nt, Homo sapiens
cuuuaguaucaguguuuua

SEQ ID NO: 1717053 - RNA, 19 nt, Homo sapiens
cuuuagucucccacuaaaa

SEQ ID NO: 1717054 - RNA, 23 nt, Homo sapiens
cuuuagugaccccugccuacuuc

SEQ ID NO: 1717055 - RNA, 13 nt, Homo sapiens
cuuuauacauuag

SEQ ID NO: 1717056 - RNA, 15 nt, Homo sapiens
cuuuauagugcacaa

SEQ ID NO: 1717057 - RNA, 18 nt, Homo sapiens
cuuuauauggaugauuca

SEQ ID NO: 1717058 - RNA, 12 nt, Homo sapiens
cuuuaucacaac

SEQ ID NO: 1717059 - RNA, 14 nt, Homo sapiens
cuuuaucuaaagaa

SEQ ID NO: 1717060 - RNA, 13 nt, Homo sapiens
cuuuaucucaggg

SEQ ID NO: 1717061 - RNA, 22 nt, Homo sapiens
cuuuaugguccuaaaagcaaaa

SEQ ID NO: 1717062 - RNA, 13 nt, Homo sapiens
cuuuauguggaaa

SEQ ID NO: 1717063 - RNA, 19 nt, Homo sapiens
gaggaaggaacagcaaugg

SEQ ID NO: 1717064 - RNA, 18 nt, Homo sapiens
gaggacuuugauugcaca

SEQ ID NO: 1717065 - RNA, 14 nt, Homo sapiens
gaggagcccucauc

SEQ ID NO: 1717066 - RNA, 13 nt, Homo sapiens
gaggccacagcug

SEQ ID NO: 1717067 - RNA, 18 nt, Homo sapiens
gaggcccugcccaaugag

SEQ ID NO: 1717068 - RNA, 12 nt, Homo sapiens
gaggcuuugugu

SEQ ID NO: 1717069 - RNA, 14 nt, Homo sapiens
gagggaaaaugagu

SEQ ID NO: 1717070 - RNA, 14 nt, Homo sapiens
gagggaaagugcau

SEQ ID NO: 1717071 - RNA, 17 nt, Homo sapiens
gagggacuuugcugauu

SEQ ID NO: 1717072 - RNA, 16 nt, Homo sapiens
gagggaggagaaugag

SEQ ID NO: 1717073 - RNA, 14 nt, Homo sapiens
gagggagugacaga

SEQ ID NO: 1717074 - RNA, 23 nt, Homo sapiens
gagggauaagccagcugcagcug

SEQ ID NO: 1717075 - RNA, 19 nt, Homo sapiens
gagggguaagagaggaugu

SEQ ID NO: 1717076 - RNA, 23 nt, Homo sapiens
gaggucagggagugcuggcucac

SEQ ID NO: 1717077 - RNA, 19 nt, Homo sapiens
gaggugagagaagaccucu

SEQ ID NO: 1717078 - RNA, 15 nt, Homo sapiens
gaguacuccaagaca

SEQ ID NO: 1717079 - RNA, 14 nt, Homo sapiens
gaguauaauauuca

SEQ ID NO: 1717080 - RNA, 13 nt, Homo sapiens
gaguaugucugau

SEQ ID NO: 1717081 - RNA, 17 nt, Homo sapiens
gagucacaguugacaaa

SEQ ID NO: 1717082 - RNA, 16 nt, Homo sapiens
gagucugcacgggacc

SEQ ID NO: 1717083 - RNA, 13 nt, Homo sapiens
gagugagcugguu

SEQ ID NO: 1717084 - RNA, 13 nt, Homo sapiens
gagugaucuuucc

SEQ ID NO: 1717085 - RNA, 13 nt, Homo sapiens
gagugcacagcug

SEQ ID NO: 1717086 - RNA, 19 nt, Homo sapiens
gagugcaguggugugaucu

SEQ ID NO: 1717087 - RNA, 19 nt, Homo sapiens
gagugcauugugaggguua

SEQ ID NO: 1717088 - RNA, 13 nt, Homo sapiens
gagugcccugucc

SEQ ID NO: 1717089 - RNA, 16 nt, Homo sapiens
gaguguuauuugcaca

SEQ ID NO: 1717090 - RNA, 21 nt, Homo sapiens
gaguguuauuugcacacugca

SEQ ID NO: 1717091 - RNA, 21 nt, Homo sapiens
gaguguugggcaugugaucac

SEQ ID NO: 1717092 - RNA, 20 nt, Homo sapiens
gaguucauacccuguuacca

SEQ ID NO: 1717093 - RNA, 22 nt, Homo sapiens
gaguucuugugccauagucaca

SEQ ID NO: 1717094 - RNA, 20 nt, Homo sapiens
gaguugccaagacaaaucaa

SEQ ID NO: 1717095 - RNA, 14 nt, Homo sapiens
gauaauaauggguu

SEQ ID NO: 1717096 - RNA, 12 nt, Homo sapiens
gauacaaacugc

SEQ ID NO: 1717097 - RNA, 20 nt, Homo sapiens
gauacaaugaacacuuauaa

SEQ ID NO: 1717098 - RNA, 21 nt, Homo sapiens
gauacaucacugcuugaugaa

SEQ ID NO: 1717099 - RNA, 16 nt, Homo sapiens
gauacccugcccucca

SEQ ID NO: 1717100 - RNA, 15 nt, Homo sapiens
gauaccugcacuguc

SEQ ID NO: 1717101 - RNA, 19 nt, Homo sapiens
gauacugaguaaauccaug

SEQ ID NO: 1717102 - RNA, 14 nt, Homo sapiens
gauagcauugcuuu

SEQ ID NO: 1717103 - RNA, 15 nt, Homo sapiens
gauaguuuaccugaa

SEQ ID NO: 1717104 - RNA, 20 nt, Homo sapiens
gauauaacacuauguuuauu

SEQ ID NO: 1717105 - RNA, 13 nt, Homo sapiens
gauauggaguucu

SEQ ID NO: 1717106 - RNA, 17 nt, Homo sapiens
gaucacuaaaguauauc

SEQ ID NO: 1717107 - RNA, 12 nt, Homo sapiens
gaucacugccac

SEQ ID NO: 1717108 - RNA, 15 nt, Homo sapiens
gaucagcaucuguga

SEQ ID NO: 1717109 - RNA, 17 nt, Homo sapiens
gaucagcaucugugaug

SEQ ID NO: 1717110 - RNA, 21 nt, Homo sapiens
gaucauuuguuggaaugaauu

SEQ ID NO: 1717111 - RNA, 23 nt, Homo sapiens
gauccaagaaggccuucauggcc

SEQ ID NO: 1717112 - RNA, 16 nt, Homo sapiens
gauccacccaccucag

SEQ ID NO: 1717113 - RNA, 21 nt, Homo sapiens
gauccaccugucucagccucc

SEQ ID NO: 1717114 - RNA, 15 nt, Homo sapiens
gauccagaacugcac

SEQ ID NO: 1717115 - RNA, 15 nt, Homo sapiens
gauccccaaguggug

SEQ ID NO: 1717116 - RNA, 16 nt, Homo sapiens
gauccccaagugugaa

SEQ ID NO: 1717117 - RNA, 19 nt, Homo sapiens
gauccuaagcaucuaaguu

SEQ ID NO: 1717118 - RNA, 21 nt, Homo sapiens
gaucgugggccgcacuggggc

SEQ ID NO: 1717119 - RNA, 20 nt, Homo sapiens
gaucucaauuugcaguauuc

SEQ ID NO: 1717120 - RNA, 14 nt, Homo sapiens
gaucuccuguccau

SEQ ID NO: 1717121 - RNA, 13 nt, Homo sapiens
gaucugugauagu

SEQ ID NO: 1717122 - RNA, 18 nt, Homo sapiens
gaucuguuuugaaggcaa

SEQ ID NO: 1717123 - RNA, 19 nt, Homo sapiens
gaucuguuuugaaggcaaa

SEQ ID NO: 1717124 - RNA, 22 nt, Homo sapiens
gaucuguuuuucaccacuucac

SEQ ID NO: 1717125 - RNA, 12 nt, Homo sapiens
gaugaaaaccua

SEQ ID NO: 1717126 - RNA, 17 nt, Homo sapiens
gaugaggcuggccaagc

SEQ ID NO: 1717127 - RNA, 16 nt, Homo sapiens
gaugauggaugccaau

SEQ ID NO: 1717128 - RNA, 13 nt, Homo sapiens
gaugauuguucaa

SEQ ID NO: 1717129 - RNA, 18 nt, Homo sapiens
gaugauuuaauauggauu

SEQ ID NO: 1717130 - RNA, 16 nt, Homo sapiens
gaugccauaugccuug

SEQ ID NO: 1717131 - RNA, 11 nt, Homo sapiens
gaugcugcuau

SEQ ID NO: 1717132 - RNA, 20 nt, Homo sapiens
gaugcuggcagccauggcca

SEQ ID NO: 1717133 - RNA, 17 nt, Homo sapiens
gauggagacaccaaccg

SEQ ID NO: 1717134 - RNA, 22 nt, Homo sapiens
gauggaugaaucucccacucca

SEQ ID NO: 1717135 - RNA, 16 nt, Homo sapiens
gauggcaccacugcac

SEQ ID NO: 1717136 - RNA, 18 nt, Homo sapiens
gauggcaccacugcacuc

SEQ ID NO: 1717137 - RNA, 14 nt, Homo sapiens
gauggccacuguga

SEQ ID NO: 1717138 - RNA, 18 nt, Homo sapiens
gauggcccauagaccuga

SEQ ID NO: 1717139 - RNA, 22 nt, Homo sapiens
gauggcucagagggggacugcu

SEQ ID NO: 1717140 - RNA, 21 nt, Homo sapiens
gauguaaucucucugcagcug

SEQ ID NO: 1717141 - RNA, 13 nt, Homo sapiens
gauguacaauuaa

SEQ ID NO: 1717142 - RNA, 16 nt, Homo sapiens
gauguaugaaggcuuu

SEQ ID NO: 1717143 - RNA, 12 nt, Homo sapiens
gauguccuacua

SEQ ID NO: 1717144 - RNA, 23 nt, Homo sapiens
gauguguccaaucggagacaaaa

SEQ ID NO: 1717145 - RNA, 15 nt, Homo sapiens
gauguucugggacac

SEQ ID NO: 1717146 - RNA, 18 nt, Homo sapiens
gauguugcuggacuguca

SEQ ID NO: 1717147 - RNA, 22 nt, Homo sapiens
gauguuuuaaguuuaucuuuca

SEQ ID NO: 1717148 - RNA, 23 nt, Homo sapiens
gauuaaauaaaacuuaaaucuca

SEQ ID NO: 1717149 - RNA, 22 nt, Homo sapiens
gauuaagauauucagaaguaua

SEQ ID NO: 1717150 - RNA, 17 nt, Homo sapiens
gauuaagauuuuacaaa

SEQ ID NO: 1717151 - RNA, 18 nt, Homo sapiens
gauuaaggugaugugauu

SEQ ID NO: 1717152 - RNA, 18 nt, Homo sapiens
gauuacaggugugaacca

SEQ ID NO: 1717153 - RNA, 18 nt, Homo sapiens
gauuagcaaggucauuuc

SEQ ID NO: 1717154 - RNA, 15 nt, Homo sapiens
gauuauuuccagugu

SEQ ID NO: 1717155 - RNA, 22 nt, Homo sapiens
gauucagccggagggaagggac

SEQ ID NO: 1717156 - RNA, 21 nt, Homo sapiens
gauucauucucauaauuccua

SEQ ID NO: 1717157 - RNA, 12 nt, Homo sapiens
gauuccagagag

SEQ ID NO: 1717158 - RNA, 20 nt, Homo sapiens
gauuccagcccacauuggau

SEQ ID NO: 1717159 - RNA, 22 nt, Homo sapiens
gauuccuuuuuucaaaauccaa

SEQ ID NO: 1717160 - RNA, 20 nt, Homo sapiens
gauucuccagccaaccucau

SEQ ID NO: 1717161 - RNA, 23 nt, Homo sapiens
gauugcagcuuuauguucauuug

SEQ ID NO: 1717162 - RNA, 16 nt, Homo sapiens
gauuguauauggaaca

SEQ ID NO: 1717163 - RNA, 21 nt, Homo sapiens
gauuuagaaaaaaguuuacaa

SEQ ID NO: 1717164 - RNA, 23 nt, Homo sapiens
gauuuccuugaauguggcuugag

SEQ ID NO: 1717165 - RNA, 19 nt, Homo sapiens
gauuuccuugugcaaaaua

SEQ ID NO: 1717166 - RNA, 11 nt, Homo sapiens
gauuugcaaua

SEQ ID NO: 1717167 - RNA, 22 nt, Homo sapiens
gauuugcuuccauuuuccuaca

SEQ ID NO: 1717168 - RNA, 16 nt, Homo sapiens
gauuugggaaccaagc

SEQ ID NO: 1717169 - RNA, 13 nt, Homo sapiens
gauuuggugacca

SEQ ID NO: 1717170 - RNA, 19 nt, Homo sapiens
gauuuuaaguaacauaacu

SEQ ID NO: 1717171 - RNA, 19 nt, Homo sapiens
gauuuucaaaagcauuaau

SEQ ID NO: 1717172 - RNA, 23 nt, Homo sapiens
gauuuuucuaaccuugaaugcug

SEQ ID NO: 1717173 - RNA, 17 nt, Homo sapiens
uagaguuucuguuugau

SEQ ID NO: 1717174 - RNA, 22 nt, Homo sapiens
uagauauaacacuauguuuauu

SEQ ID NO: 1717175 - RNA, 16 nt, Homo sapiens
uagaucaucagucacc

SEQ ID NO: 1717176 - RNA, 13 nt, Homo sapiens
uagaucuuucuag

SEQ ID NO: 1717177 - RNA, 14 nt, Homo sapiens
uagaugauguauuu

SEQ ID NO: 1717178 - RNA, 18 nt, Homo sapiens
uagaugcacuuaugcagu

SEQ ID NO: 1717179 - RNA, 17 nt, Homo sapiens
uagauugcuaguuuauu

SEQ ID NO: 1717180 - RNA, 19 nt, Homo sapiens
uagauugcuuucuucuuaa

SEQ ID NO: 1717181 - RNA, 17 nt, Homo sapiens
uagauuuguacaggagu

SEQ ID NO: 1717182 - RNA, 16 nt, Homo sapiens
uagcaaacacuggggg

SEQ ID NO: 1717183 - RNA, 19 nt, Homo sapiens
uagcaaauggcagaaccaa

SEQ ID NO: 1717184 - RNA, 21 nt, Homo sapiens
uagcaaauggcagaaccaaag

SEQ ID NO: 1717185 - RNA, 15 nt, Homo sapiens
uagcaauauggauug

SEQ ID NO: 1717186 - RNA, 17 nt, Homo sapiens
uagcacuauuuacauac

SEQ ID NO: 1717187 - RNA, 20 nt, Homo sapiens
uagcacuuugaaauaccuca

SEQ ID NO: 1717188 - RNA, 22 nt, Homo sapiens
uagcaggcuaugaaguugcaau

SEQ ID NO: 1717189 - RNA, 15 nt, Homo sapiens
uagcauuaugcaauu

SEQ ID NO: 1717190 - RNA, 16 nt, Homo sapiens
uagcauuaugcaauua

SEQ ID NO: 1717191 - RNA, 13 nt, Homo sapiens
uagccaccccaga

SEQ ID NO: 1717192 - RNA, 17 nt, Homo sapiens
uagccaggaaguacuuc

SEQ ID NO: 1717193 - RNA, 19 nt, Homo sapiens
uagccaggaaguacuucca

SEQ ID NO: 1717194 - RNA, 20 nt, Homo sapiens
uagccuaauacaacauguag

SEQ ID NO: 1717195 - RNA, 18 nt, Homo sapiens
uagccuauuuaccugcag

SEQ ID NO: 1717196 - RNA, 18 nt, Homo sapiens
uagccugcauaucauuca

SEQ ID NO: 1717197 - RNA, 18 nt, Homo sapiens
uagccuuagaagucacac

SEQ ID NO: 1717198 - RNA, 15 nt, Homo sapiens
uagcgccucuuuuau

SEQ ID NO: 1717199 - RNA, 13 nt, Homo sapiens
uagcggucaauuu

SEQ ID NO: 1717200 - RNA, 19 nt, Homo sapiens
uagcugaguuuaacaugug

SEQ ID NO: 1717201 - RNA, 17 nt, Homo sapiens
uagcugggacuacaggu

SEQ ID NO: 1717202 - RNA, 18 nt, Homo sapiens
uagcuuauuauugaagga

SEQ ID NO: 1717203 - RNA, 13 nt, Homo sapiens
uagcuugcaccuu

SEQ ID NO: 1717204 - RNA, 16 nt, Homo sapiens
uagcuuuagggcaaua

SEQ ID NO: 1717205 - RNA, 14 nt, Homo sapiens
uagcuuuuauucau

SEQ ID NO: 1717206 - RNA, 14 nt, Homo sapiens
uaggaaauuccuuc

SEQ ID NO: 1717207 - RNA, 17 nt, Homo sapiens
uaggaaauuccuucaua

SEQ ID NO: 1717208 - RNA, 21 nt, Homo sapiens
uaggcacuguaguucuaagac

SEQ ID NO: 1717209 - RNA, 12 nt, Homo sapiens
uaggcagaucac

SEQ ID NO: 1717210 - RNA, 21 nt, Homo sapiens
uaggcauguagcuacaggaca

SEQ ID NO: 1717211 - RNA, 14 nt, Homo sapiens
uaggcuagcuauuu

SEQ ID NO: 1717212 - RNA, 22 nt, Homo sapiens
uaggcuccugccaguguggaac

SEQ ID NO: 1717213 - RNA, 20 nt, Homo sapiens
uaggugacagagugagacuc

SEQ ID NO: 1717214 - RNA, 16 nt, Homo sapiens
uagguggcaagcugug

SEQ ID NO: 1717215 - RNA, 21 nt, Homo sapiens
uagguucuaaaguucuaagau

SEQ ID NO: 1717216 - RNA, 14 nt, Homo sapiens
uagguuuacauuca

SEQ ID NO: 1717217 - RNA, 20 nt, Homo sapiens
uaguaacucccaucaccucu

SEQ ID NO: 1717218 - RNA, 14 nt, Homo sapiens
uaguagacacacua

SEQ ID NO: 1717219 - RNA, 19 nt, Homo sapiens
uaguauuuuuauccaugac

SEQ ID NO: 1717220 - RNA, 23 nt, Homo sapiens
uagucacauggccuaugcacaua

SEQ ID NO: 1717221 - RNA, 14 nt, Homo sapiens
uagucauuuacuaa

SEQ ID NO: 1717222 - RNA, 16 nt, Homo sapiens
uagugacuaugaacuu

SEQ ID NO: 1717223 - RNA, 14 nt, Homo sapiens
uaguguacuuggag

SEQ ID NO: 1717224 - RNA, 16 nt, Homo sapiens
uaguuaauuauuucaa

SEQ ID NO: 1717225 - RNA, 19 nt, Homo sapiens
uaguugcguggacucugca

SEQ ID NO: 1717226 - RNA, 13 nt, Homo sapiens
uaguuuauuucaa

SEQ ID NO: 1717227 - RNA, 14 nt, Homo sapiens
uaguuuauuucaac

SEQ ID NO: 1717228 - RNA, 19 nt, Homo sapiens
uaguuugaccucacaguga

SEQ ID NO: 1717229 - RNA, 21 nt, Homo sapiens
uaguuuucuccuuuuacuuca

SEQ ID NO: 1717230 - RNA, 14 nt, Homo sapiens
uauaaaaaguggag

SEQ ID NO: 1717231 - RNA, 20 nt, Homo sapiens
uauaaauguauauacacaua

SEQ ID NO: 1717232 - RNA, 14 nt, Homo sapiens
uauaacagaauuaa

SEQ ID NO: 1717233 - RNA, 21 nt, Homo sapiens
uauaacagaauuaaaguagau

SEQ ID NO: 1717234 - RNA, 18 nt, Homo sapiens
uauaagcauguauauucu

SEQ ID NO: 1717235 - RNA, 22 nt, Homo sapiens
uauaagcccacuguuaauauuc

SEQ ID NO: 1717236 - RNA, 14 nt, Homo sapiens
uauaauauaccaau

SEQ ID NO: 1717237 - RNA, 21 nt, Homo sapiens
uauacacuauuugugagcaaa

SEQ ID NO: 1717238 - RNA, 15 nt, Homo sapiens
uauacaggcauaaaa

SEQ ID NO: 1717239 - RNA, 13 nt, Homo sapiens
uauaccaaaaggg

SEQ ID NO: 1717240 - RNA, 22 nt, Homo sapiens
uauacccccccaugcagucuaa

SEQ ID NO: 1717241 - RNA, 20 nt, Homo sapiens
uauaccuaccugugugguac

SEQ ID NO: 1717242 - RNA, 18 nt, Homo sapiens
uauacuguggcuaugcaa

SEQ ID NO: 1717243 - RNA, 11 nt, Homo sapiens
uauacuuucag

SEQ ID NO: 1717244 - RNA, 13 nt, Homo sapiens
uauagcacuuuga

SEQ ID NO: 1717245 - RNA, 23 nt, Homo sapiens
uauagcacuuugaaauaccucau

SEQ ID NO: 1717246 - RNA, 21 nt, Homo sapiens
uauagcgauugaaagggcaau

SEQ ID NO: 1717247 - RNA, 15 nt, Homo sapiens
uauaggaacaauucu

SEQ ID NO: 1717248 - RNA, 20 nt, Homo sapiens
uauaguagacacacuaucau

SEQ ID NO: 1717249 - RNA, 21 nt, Homo sapiens
uauagugacccacccuagauc

SEQ ID NO: 1717250 - RNA, 14 nt, Homo sapiens
uauaguucuaggca

SEQ ID NO: 1717251 - RNA, 20 nt, Homo sapiens
uauaguugucaguauuauuc

SEQ ID NO: 1717252 - RNA, 16 nt, Homo sapiens
uauaguuucugaggcu

SEQ ID NO: 1717253 - RNA, 23 nt, Homo sapiens
uauaguuuguuuuuaaacuaaua

SEQ ID NO: 1717254 - RNA, 13 nt, Homo sapiens
uauauaccaagcu

SEQ ID NO: 1717255 - RNA, 15 nt, Homo sapiens
uauauauacauaugu

SEQ ID NO: 1717256 - RNA, 13 nt, Homo sapiens
uauauauauauca

SEQ ID NO: 1717257 - RNA, 22 nt, Homo sapiens
uauauaugcuuggcuaacuaua

SEQ ID NO: 1717258 - RNA, 16 nt, Homo sapiens
uauauauguguauaua

SEQ ID NO: 1717259 - RNA, 13 nt, Homo sapiens
uauauauuacuug

SEQ ID NO: 1717260 - RNA, 20 nt, Homo sapiens
uauauauuucuuuguuauca

SEQ ID NO: 1717261 - RNA, 13 nt, Homo sapiens
uauaucaguuuga

SEQ ID NO: 1717262 - RNA, 14 nt, Homo sapiens
uauaucgaucucuu

SEQ ID NO: 1717263 - RNA, 14 nt, Homo sapiens
uauaucuaugucua

SEQ ID NO: 1717264 - RNA, 20 nt, Homo sapiens
uauauguguauauauacaua

SEQ ID NO: 1717265 - RNA, 21 nt, Homo sapiens
uauauguguauauauacauac

SEQ ID NO: 1717266 - RNA, 15 nt, Homo sapiens
uaucaaaaaguauua

SEQ ID NO: 1717267 - RNA, 16 nt, Homo sapiens
uaucaaaaaguauuaa

SEQ ID NO: 1717268 - RNA, 13 nt, Homo sapiens
uaucacgcagauc

SEQ ID NO: 1717269 - RNA, 18 nt, Homo sapiens
uaucacgggucacuugaa

SEQ ID NO: 1717270 - RNA, 20 nt, Homo sapiens
uaucacgggucacuugaaau

SEQ ID NO: 1717271 - RNA, 20 nt, Homo sapiens
uaucacuucauucacauuca

SEQ ID NO: 1717272 - RNA, 21 nt, Homo sapiens
uaucacuucauucacauucag

SEQ ID NO: 1717273 - RNA, 20 nt, Homo sapiens
uaucauccugccuucaugga

SEQ ID NO: 1717274 - RNA, 14 nt, Homo sapiens
uaucauucacccaa

SEQ ID NO: 1717275 - RNA, 20 nt, Homo sapiens
uaucauuggaacaacugaua

SEQ ID NO: 1717276 - RNA, 15 nt, Homo sapiens
uauccaaaccaaaua

SEQ ID NO: 1717277 - RNA, 19 nt, Homo sapiens
uauccaauaggcauuugau

SEQ ID NO: 1717278 - RNA, 13 nt, Homo sapiens
uauccaccaccuc

SEQ ID NO: 1717279 - RNA, 21 nt, Homo sapiens
uauccagauggaggcaccaaa

SEQ ID NO: 1717280 - RNA, 16 nt, Homo sapiens
uauccauugaacuaaa

SEQ ID NO: 1717281 - RNA, 15 nt, Homo sapiens
uauccuuucuaacaa

SEQ ID NO: 1717282 - RNA, 21 nt, Homo sapiens
uaucgaaauaacaauguuaag

SEQ ID NO: 1717283 - RNA, 14 nt, Homo sapiens
uccuacccuuccag

SEQ ID NO: 1717284 - RNA, 16 nt, Homo sapiens
uccuacguauccugca

SEQ ID NO: 1717285 - RNA, 18 nt, Homo sapiens
uccuauaacuugaugcau

SEQ ID NO: 1717286 - RNA, 18 nt, Homo sapiens
uccuaucaccuauuucca

SEQ ID NO: 1717287 - RNA, 16 nt, Homo sapiens
uccuauccacugggca

SEQ ID NO: 1717288 - RNA, 19 nt, Homo sapiens
uccucaagggccaggacuu

SEQ ID NO: 1717289 - RNA, 13 nt, Homo sapiens
uccucauguacau

SEQ ID NO: 1717290 - RNA, 20 nt, Homo sapiens
uccuccagaagccucuggcu

SEQ ID NO: 1717291 - RNA, 15 nt, Homo sapiens
uccucccaccucagc

SEQ ID NO: 1717292 - RNA, 14 nt, Homo sapiens
uccucccucugauu

SEQ ID NO: 1717293 - RNA, 13 nt, Homo sapiens
uccucgcugccag

SEQ ID NO: 1717294 - RNA, 17 nt, Homo sapiens
uccucguuccuuucucc

SEQ ID NO: 1717295 - RNA, 13 nt, Homo sapiens
uccucuccacugc

SEQ ID NO: 1717296 - RNA, 18 nt, Homo sapiens
uccucuccacugccuucg

SEQ ID NO: 1717297 - RNA, 16 nt, Homo sapiens
uccucucccaagucca

SEQ ID NO: 1717298 - RNA, 14 nt, Homo sapiens
uccucuccuacuuu

SEQ ID NO: 1717299 - RNA, 23 nt, Homo sapiens
uccucugccucccauucugacca

SEQ ID NO: 1717300 - RNA, 18 nt, Homo sapiens
uccugaaccgcacagcuc

SEQ ID NO: 1717301 - RNA, 13 nt, Homo sapiens
uccugacaucaca

SEQ ID NO: 1717302 - RNA, 13 nt, Homo sapiens
uccugacuguaac

SEQ ID NO: 1717303 - RNA, 18 nt, Homo sapiens
uccugagaggaagccuga

SEQ ID NO: 1717304 - RNA, 19 nt, Homo sapiens
uccugaguuggccaggcau

SEQ ID NO: 1717305 - RNA, 13 nt, Homo sapiens
uccugaucuguga

SEQ ID NO: 1717306 - RNA, 15 nt, Homo sapiens
uccugaucugugaua

SEQ ID NO: 1717307 - RNA, 19 nt, Homo sapiens
uccugccugugcugugacu

SEQ ID NO: 1717308 - RNA, 18 nt, Homo sapiens
uccuggaguacaaacaca

SEQ ID NO: 1717309 - RNA, 14 nt, Homo sapiens
uccugggucuacca

SEQ ID NO: 1717310 - RNA, 15 nt, Homo sapiens
uccugguccuggaca

SEQ ID NO: 1717311 - RNA, 19 nt, Homo sapiens
uccuguacucuggggugcu

SEQ ID NO: 1717312 - RNA, 20 nt, Homo sapiens
uccuguauaagcacugaaaa

SEQ ID NO: 1717313 - RNA, 16 nt, Homo sapiens
uccugucccucuucca

SEQ ID NO: 1717314 - RNA, 13 nt, Homo sapiens
uccugugauccac

SEQ ID NO: 1717315 - RNA, 17 nt, Homo sapiens
uccuguuuuucugggug

SEQ ID NO: 1717316 - RNA, 17 nt, Homo sapiens
uccuuaacacauucaau

SEQ ID NO: 1717317 - RNA, 20 nt, Homo sapiens
uccuuacgcuuugucacaca

SEQ ID NO: 1717318 - RNA, 18 nt, Homo sapiens
uccuuauuguuaaaaaca

SEQ ID NO: 1717319 - RNA, 15 nt, Homo sapiens
uccuucaagaacucu

SEQ ID NO: 1717320 - RNA, 19 nt, Homo sapiens
uccuuccuauaacuugaug

SEQ ID NO: 1717321 - RNA, 23 nt, Homo sapiens
uccuuccugcuugaguucccaga

SEQ ID NO: 1717322 - RNA, 21 nt, Homo sapiens
uccuucucugaacacaggcag

SEQ ID NO: 1717323 - RNA, 21 nt, Homo sapiens
uccuucuuugauaauguuaaa

SEQ ID NO: 1717324 - RNA, 13 nt, Homo sapiens
uccuugacuuuga

SEQ ID NO: 1717325 - RNA, 19 nt, Homo sapiens
uccuugauacuaaaaguuc

SEQ ID NO: 1717326 - RNA, 20 nt, Homo sapiens
uccuugcaggugacauuugc

SEQ ID NO: 1717327 - RNA, 10 nt, Homo sapiens
uccuuggcau

SEQ ID NO: 1717328 - RNA, 23 nt, Homo sapiens
uccuugugcaaaauauuugacua

SEQ ID NO: 1717329 - RNA, 18 nt, Homo sapiens
uccuuuaguaccugaaaa

SEQ ID NO: 1717330 - RNA, 14 nt, Homo sapiens
uccuuucaccacau

SEQ ID NO: 1717331 - RNA, 22 nt, Homo sapiens
uccuuuccccagcccagggugg

SEQ ID NO: 1717332 - RNA, 23 nt, Homo sapiens
ucgaaaauucauuucacauuaau

SEQ ID NO: 1717333 - RNA, 16 nt, Homo sapiens
ucgagaccagccugac

SEQ ID NO: 1717334 - RNA, 20 nt, Homo sapiens
ucgaggacugauacugcagu

SEQ ID NO: 1717335 - RNA, 15 nt, Homo sapiens
ucgaggggcucucag

SEQ ID NO: 1717336 - RNA, 18 nt, Homo sapiens
ucgaugcguucacuccaa

SEQ ID NO: 1717337 - RNA, 20 nt, Homo sapiens
ucgcaccuaccaucagggac

SEQ ID NO: 1717338 - RNA, 17 nt, Homo sapiens
ucgcccaggagacaucc

SEQ ID NO: 1717339 - RNA, 18 nt, Homo sapiens
ucgcccaggagacauccg

SEQ ID NO: 1717340 - RNA, 21 nt, Homo sapiens
ucgcuauugauuuuuacuuca

SEQ ID NO: 1717341 - RNA, 19 nt, Homo sapiens
ucgcuuguaaauaccagga

SEQ ID NO: 1717342 - RNA, 13 nt, Homo sapiens
ucggaacagcaga

SEQ ID NO: 1717343 - RNA, 15 nt, Homo sapiens
ucggccuccaugacc

SEQ ID NO: 1717344 - RNA, 14 nt, Homo sapiens
ucggggacccugcg

SEQ ID NO: 1717345 - RNA, 18 nt, Homo sapiens
ucgggucccuucaccucc

SEQ ID NO: 1717346 - RNA, 15 nt, Homo sapiens
ucgugagucauuuaa

SEQ ID NO: 1717347 - RNA, 18 nt, Homo sapiens
ucgugggccgcacugggg

SEQ ID NO: 1717348 - RNA, 21 nt, Homo sapiens
ucuaaacuuccccaucuucua

SEQ ID NO: 1717349 - RNA, 18 nt, Homo sapiens
ucuaaagauggaguuucu

SEQ ID NO: 1717350 - RNA, 15 nt, Homo sapiens
ucuaaccuugaaugc

SEQ ID NO: 1717351 - RNA, 21 nt, Homo sapiens
ucuaaccuugaaugcugccag

SEQ ID NO: 1717352 - RNA, 13 nt, Homo sapiens
ucuaacgcuuuaa

SEQ ID NO: 1717353 - RNA, 16 nt, Homo sapiens
ucuaacucagaauuau

SEQ ID NO: 1717354 - RNA, 21 nt, Homo sapiens
ucuaagacucaaauguucuaa

SEQ ID NO: 1717355 - RNA, 17 nt, Homo sapiens
ucuaagauaguaacaau

SEQ ID NO: 1717356 - RNA, 14 nt, Homo sapiens
ucuaagauucuaau

SEQ ID NO: 1717357 - RNA, 14 nt, Homo sapiens
ucuaagauucugau

SEQ ID NO: 1717358 - RNA, 22 nt, Homo sapiens
ucuaagcugcagcuuccuguca

SEQ ID NO: 1717359 - RNA, 14 nt, Homo sapiens
ucuaaucgaaagaa

SEQ ID NO: 1717360 - RNA, 22 nt, Homo sapiens
ucuaaucuuuuaauguauuugu

SEQ ID NO: 1717361 - RNA, 16 nt, Homo sapiens
ucuaauuaugcaauua

SEQ ID NO: 1717362 - RNA, 14 nt, Homo sapiens
ucuacaaaggccau

SEQ ID NO: 1717363 - RNA, 17 nt, Homo sapiens
ucuacacugagguuuga

SEQ ID NO: 1717364 - RNA, 20 nt, Homo sapiens
ucuacagugccaacuccuca

SEQ ID NO: 1717365 - RNA, 15 nt, Homo sapiens
ucuacccuauacaac

SEQ ID NO: 1717366 - RNA, 19 nt, Homo sapiens
ucuacccugcugaccuccc

SEQ ID NO: 1717367 - RNA, 21 nt, Homo sapiens
ucuacuuuccaggcuaguccg

SEQ ID NO: 1717368 - RNA, 15 nt, Homo sapiens
ucuagaaacagaucu

SEQ ID NO: 1717369 - RNA, 13 nt, Homo sapiens
ucuagaacuugac

SEQ ID NO: 1717370 - RNA, 20 nt, Homo sapiens
ucuagaauuauaagucacaa

SEQ ID NO: 1717371 - RNA, 20 nt, Homo sapiens
ucuagacauggagguucuaa

SEQ ID NO: 1717372 - RNA, 18 nt, Homo sapiens
ucuagaguucagaguccu

SEQ ID NO: 1717373 - RNA, 18 nt, Homo sapiens
ucuagauuuucuacuuua

SEQ ID NO: 1717374 - RNA, 23 nt, Homo sapiens
ucuaggccucacucaacaaccaa

SEQ ID NO: 1717375 - RNA, 15 nt, Homo sapiens
ucuaguacacuuuua

SEQ ID NO: 1717376 - RNA, 19 nt, Homo sapiens
ucuaguugccaaaucuggc

SEQ ID NO: 1717377 - RNA, 20 nt, Homo sapiens
ucuauacaaaaugauuuuga

SEQ ID NO: 1717378 - RNA, 15 nt, Homo sapiens
ucuaucaacuuuaau

SEQ ID NO: 1717379 - RNA, 12 nt, Homo sapiens
ucuaucucucaa

SEQ ID NO: 1717380 - RNA, 14 nt, Homo sapiens
ucuaucucucaaaa

SEQ ID NO: 1717381 - RNA, 21 nt, Homo sapiens
ucuaugccagcucagucccau

SEQ ID NO: 1717382 - RNA, 23 nt, Homo sapiens
ucuaugggacucaaugcacugac

SEQ ID NO: 1717383 - RNA, 16 nt, Homo sapiens
ucuauucaagcacuua

SEQ ID NO: 1717384 - RNA, 23 nt, Homo sapiens
ucucaagggcuagcaucccugag

SEQ ID NO: 1717385 - RNA, 21 nt, Homo sapiens
ucucaauaugcuuacaaaguc

SEQ ID NO: 1717386 - RNA, 16 nt, Homo sapiens
ucucacagcacaugcu

SEQ ID NO: 1717387 - RNA, 23 nt, Homo sapiens
ucucacgggcaugggcacucccu

SEQ ID NO: 1717388 - RNA, 18 nt, Homo sapiens
ucucacuguugcccaggc

SEQ ID NO: 1717389 - RNA, 20 nt, Homo sapiens
ucucagaccugcgcacucca

SEQ ID NO: 1717390 - RNA, 13 nt, Homo sapiens
ucucagaugcagu

SEQ ID NO: 1717391 - RNA, 16 nt, Homo sapiens
ucucagccuaccauga

SEQ ID NO: 1717392 - RNA, 21 nt, Homo sapiens
ucucagccuaccaugagaaua

SEQ ID NO: 1717393 - RNA, 15 nt, Homo sapiens
uggacauaacauuuu

SEQ ID NO: 1717394 - RNA, 15 nt, Homo sapiens
uggaccugccuccug

SEQ ID NO: 1717395 - RNA, 17 nt, Homo sapiens
uggacuuccagugcuca

SEQ ID NO: 1717396 - RNA, 21 nt, Homo sapiens
uggacuuccagugcucagagg

SEQ ID NO: 1717397 - RNA, 14 nt, Homo sapiens
uggacuugccuaaa

SEQ ID NO: 1717398 - RNA, 22 nt, Homo sapiens
uggagacaagggcaucaucuau

SEQ ID NO: 1717399 - RNA, 14 nt, Homo sapiens
uggagacacaacua

SEQ ID NO: 1717400 - RNA, 22 nt, Homo sapiens
uggagacagacugauguguaua

SEQ ID NO: 1717401 - RNA, 19 nt, Homo sapiens
uggagacguggaaccucug

SEQ ID NO: 1717402 - RNA, 15 nt, Homo sapiens
uggagagcacaccua

SEQ ID NO: 1717403 - RNA, 14 nt, Homo sapiens
uggagaggaacaca

SEQ ID NO: 1717404 - RNA, 19 nt, Homo sapiens
uggagagucagaucuuucu

SEQ ID NO: 1717405 - RNA, 20 nt, Homo sapiens
uggagagucagaucuuucuc

SEQ ID NO: 1717406 - RNA, 21 nt, Homo sapiens
uggagagugagcuacagagcc

SEQ ID NO: 1717407 - RNA, 21 nt, Homo sapiens
uggagauucaguuuucauuug

SEQ ID NO: 1717408 - RNA, 22 nt, Homo sapiens
uggagccaauguguggcucagu

SEQ ID NO: 1717409 - RNA, 21 nt, Homo sapiens
uggagcccuaaccccuuccag

SEQ ID NO: 1717410 - RNA, 18 nt, Homo sapiens
uggagccuggcacaggac

SEQ ID NO: 1717411 - RNA, 15 nt, Homo sapiens
uggagggcaucaggc

SEQ ID NO: 1717412 - RNA, 16 nt, Homo sapiens
uggaguauuggggucu

SEQ ID NO: 1717413 - RNA, 17 nt, Homo sapiens
uggagugcccacccugg

SEQ ID NO: 1717414 - RNA, 15 nt, Homo sapiens
uggaguugugaucau

SEQ ID NO: 1717415 - RNA, 13 nt, Homo sapiens
uggaugauucaga

SEQ ID NO: 1717416 - RNA, 15 nt, Homo sapiens
uggauucaucagcau

SEQ ID NO: 1717417 - RNA, 15 nt, Homo sapiens
uggcaaggagccagg

SEQ ID NO: 1717418 - RNA, 20 nt, Homo sapiens
uggcaagucuuccaugaccc

SEQ ID NO: 1717419 - RNA, 20 nt, Homo sapiens
uggcaauauuccuuagucaa

SEQ ID NO: 1717420 - RNA, 14 nt, Homo sapiens
uggcacacaccagu

SEQ ID NO: 1717421 - RNA, 14 nt, Homo sapiens
uggcacuauccaga

SEQ ID NO: 1717422 - RNA, 15 nt, Homo sapiens
uggcacuauccagau

SEQ ID NO: 1717423 - RNA, 12 nt, Homo sapiens
uggcacuugccu

SEQ ID NO: 1717424 - RNA, 12 nt, Homo sapiens
uggcagagccag

SEQ ID NO: 1717425 - RNA, 15 nt, Homo sapiens
uggcagccauggcca

SEQ ID NO: 1717426 - RNA, 13 nt, Homo sapiens
uggccacugcucc

SEQ ID NO: 1717427 - RNA, 23 nt, Homo sapiens
uggccaggcuggucuaaaacucc

SEQ ID NO: 1717428 - RNA, 18 nt, Homo sapiens
uggccaggcuggucucaa

SEQ ID NO: 1717429 - RNA, 23 nt, Homo sapiens
uggccaguuggaaccacggagau

SEQ ID NO: 1717430 - RNA, 22 nt, Homo sapiens
uggcccaagugguuugugcuaa

SEQ ID NO: 1717431 - RNA, 23 nt, Homo sapiens
uggcccaagugguuugugcuaac

SEQ ID NO: 1717432 - RNA, 13 nt, Homo sapiens
uggcccacccacu

SEQ ID NO: 1717433 - RNA, 13 nt, Homo sapiens
uggcccagccaaa

SEQ ID NO: 1717434 - RNA, 20 nt, Homo sapiens
uggcccauagaaacaugaca

SEQ ID NO: 1717435 - RNA, 14 nt, Homo sapiens
uggccuaugcacau

SEQ ID NO: 1717436 - RNA, 16 nt, Homo sapiens
uggccucuggcucuca

SEQ ID NO: 1717437 - RNA, 14 nt, Homo sapiens
uggccugcacuggu

SEQ ID NO: 1717438 - RNA, 12 nt, Homo sapiens
uggccuggcaca

SEQ ID NO: 1717439 - RNA, 12 nt, Homo sapiens
uggcucacaggg

SEQ ID NO: 1717440 - RNA, 19 nt, Homo sapiens
uggcucacagggcugaaag

SEQ ID NO: 1717441 - RNA, 18 nt, Homo sapiens
uggcucagagggggacug

SEQ ID NO: 1717442 - RNA, 17 nt, Homo sapiens
uggcucaugucuauaau

SEQ ID NO: 1717443 - RNA, 15 nt, Homo sapiens
uggcucccaugacca

SEQ ID NO: 1717444 - RNA, 13 nt, Homo sapiens
uggcucucauggg

SEQ ID NO: 1717445 - RNA, 22 nt, Homo sapiens
uggcucuggagacagccccaga

SEQ ID NO: 1717446 - RNA, 18 nt, Homo sapiens
uggcugaguccauuagcu

SEQ ID NO: 1717447 - RNA, 12 nt, Homo sapiens
uggcuggcugcc

SEQ ID NO: 1717448 - RNA, 11 nt, Homo sapiens
uggcugugagg

SEQ ID NO: 1717449 - RNA, 14 nt, Homo sapiens
uggcuucugugaug

SEQ ID NO: 1717450 - RNA, 21 nt, Homo sapiens
uggcuuuugcggccaguauua

SEQ ID NO: 1717451 - RNA, 21 nt, Homo sapiens
ugggaaaaucuauuccugcca

SEQ ID NO: 1717452 - RNA, 12 nt, Homo sapiens
ugggaagugaag

SEQ ID NO: 1717453 - RNA, 20 nt, Homo sapiens
ugggacacaaaacuccgccc

SEQ ID NO: 1717454 - RNA, 14 nt, Homo sapiens
ugggacuacaggca

SEQ ID NO: 1717455 - RNA, 14 nt, Homo sapiens
ugggagaaggcagu

SEQ ID NO: 1717456 - RNA, 18 nt, Homo sapiens
ugggagcaggaacaauga

SEQ ID NO: 1717457 - RNA, 14 nt, Homo sapiens
ugggagcaggagau

SEQ ID NO: 1717458 - RNA, 23 nt, Homo sapiens
ugggaggagacaucccaggaaaa

SEQ ID NO: 1717459 - RNA, 17 nt, Homo sapiens
ugggaggcuguggagcc

SEQ ID NO: 1717460 - RNA, 16 nt, Homo sapiens
ugggaggucuugcuag

SEQ ID NO: 1717461 - RNA, 14 nt, Homo sapiens
ugggauacaaccuc

SEQ ID NO: 1717462 - RNA, 17 nt, Homo sapiens
ugggaucugucacacca

SEQ ID NO: 1717463 - RNA, 23 nt, Homo sapiens
ugggcacucccuugguggcaaga

SEQ ID NO: 1717464 - RNA, 13 nt, Homo sapiens
ugggcacugggau

SEQ ID NO: 1717465 - RNA, 18 nt, Homo sapiens
ugggcagggugacccuga

SEQ ID NO: 1717466 - RNA, 15 nt, Homo sapiens
ugggccauguccaaa

SEQ ID NO: 1717467 - RNA, 18 nt, Homo sapiens
ugggccauguccaaagag

SEQ ID NO: 1717468 - RNA, 14 nt, Homo sapiens
ugggcuauggacac

SEQ ID NO: 1717469 - RNA, 15 nt, Homo sapiens
ugggcucugaggcug

SEQ ID NO: 1717470 - RNA, 13 nt, Homo sapiens
ugggcucuuccaa

SEQ ID NO: 1717471 - RNA, 15 nt, Homo sapiens
uggggacacagauca

SEQ ID NO: 1717472 - RNA, 14 nt, Homo sapiens
uggggacauuugcc

SEQ ID NO: 1717473 - RNA, 12 nt, Homo sapiens
uggggaggacaa

SEQ ID NO: 1717474 - RNA, 22 nt, Homo sapiens
uggggaggacaaaacuucuugu

SEQ ID NO: 1717475 - RNA, 15 nt, Homo sapiens
uggggaucagacaga

SEQ ID NO: 1717476 - RNA, 20 nt, Homo sapiens
uggggcagcuugaggguugg

SEQ ID NO: 1717477 - RNA, 17 nt, Homo sapiens
uggggcaggcugcuuca

SEQ ID NO: 1717478 - RNA, 19 nt, Homo sapiens
uggggcaggcugggccaug

SEQ ID NO: 1717479 - RNA, 12 nt, Homo sapiens
uggggccaccaa

SEQ ID NO: 1717480 - RNA, 15 nt, Homo sapiens
uggggccucagacga

SEQ ID NO: 1717481 - RNA, 11 nt, Homo sapiens
uggggccugug

SEQ ID NO: 1717482 - RNA, 12 nt, Homo sapiens
uggggcucucuc

SEQ ID NO: 1717483 - RNA, 19 nt, Homo sapiens
ugggggacgugggcauuuu

SEQ ID NO: 1717484 - RNA, 22 nt, Homo sapiens
ugggggcaccuuaagauuuugc

SEQ ID NO: 1717485 - RNA, 15 nt, Homo sapiens
uggggucuuuuuaug

SEQ ID NO: 1717486 - RNA, 21 nt, Homo sapiens
uggggucuuuuuaugcauuug

SEQ ID NO: 1717487 - RNA, 19 nt, Homo sapiens
uggguacugaaagccuuag

SEQ ID NO: 1717488 - RNA, 20 nt, Homo sapiens
uggguccuaauuaccagucu

SEQ ID NO: 1717489 - RNA, 19 nt, Homo sapiens
ugggucuaccacucagaga

SEQ ID NO: 1717490 - RNA, 14 nt, Homo sapiens
ugguaaaugaucac

SEQ ID NO: 1717491 - RNA, 23 nt, Homo sapiens
ugguaacuuuuuuuuaaagcuca

SEQ ID NO: 1717492 - RNA, 14 nt, Homo sapiens
ugguaucacugaac

SEQ ID NO: 1717493 - RNA, 21 nt, Homo sapiens
ugguaucacugaacuacuaaa

SEQ ID NO: 1717494 - RNA, 12 nt, Homo sapiens
ugguaugaucac

SEQ ID NO: 1717495 - RNA, 19 nt, Homo sapiens
ugguaugugacaccaaagc

SEQ ID NO: 1717496 - RNA, 19 nt, Homo sapiens
uggucaauccgaaguauga

SEQ ID NO: 1717497 - RNA, 20 nt, Homo sapiens
uggucaauccgaaguaugag

SEQ ID NO: 1717498 - RNA, 11 nt, Homo sapiens
uggucacaggg

SEQ ID NO: 1717499 - RNA, 14 nt, Homo sapiens
uggucaucauggcc

SEQ ID NO: 1717500 - RNA, 23 nt, Homo sapiens
uggucuaaaaauaaaccaaagga

SEQ ID NO: 1717501 - RNA, 17 nt, Homo sapiens
uggucuugaucuccuga

SEQ ID NO: 1717502 - RNA, 21 nt, Homo sapiens
uggugacgcacggcauuagcu

SEQ ID NO: 1717503 - RNA, 17 nt, Homo sapiens
uggugcgcccugucucu

SEQ ID NO: 1717504 - RNA, 16 nt, Homo sapiens
uuaucuagagaauaca

SEQ ID NO: 1717505 - RNA, 14 nt, Homo sapiens
uuaugacuugcuac

SEQ ID NO: 1717506 - RNA, 16 nt, Homo sapiens
uuaugagcagaaggaa

SEQ ID NO: 1717507 - RNA, 21 nt, Homo sapiens
uuaugaugaaaaccuacauau

SEQ ID NO: 1717508 - RNA, 17 nt, Homo sapiens
uuaugccuucacuuuac

SEQ ID NO: 1717509 - RNA, 19 nt, Homo sapiens
uuauggcauuuuucuggga

SEQ ID NO: 1717510 - RNA, 13 nt, Homo sapiens
uuauguaaucuca

SEQ ID NO: 1717511 - RNA, 14 nt, Homo sapiens
uuauguaaugcaaa

SEQ ID NO: 1717512 - RNA, 13 nt, Homo sapiens
uuauguacuguac

SEQ ID NO: 1717513 - RNA, 23 nt, Homo sapiens
uuauguacuguacuaauucuuac

SEQ ID NO: 1717514 - RNA, 21 nt, Homo sapiens
uuaugucuauuuaagccucau

SEQ ID NO: 1717515 - RNA, 19 nt, Homo sapiens
uuaugugugaggagcugcu

SEQ ID NO: 1717516 - RNA, 13 nt, Homo sapiens
uuauuaacuaaga

SEQ ID NO: 1717517 - RNA, 14 nt, Homo sapiens
uuauuaaugccauu

SEQ ID NO: 1717518 - RNA, 19 nt, Homo sapiens
uuauuacauggggucuaga

SEQ ID NO: 1717519 - RNA, 17 nt, Homo sapiens
uuauuccuugaucauuu

SEQ ID NO: 1717520 - RNA, 14 nt, Homo sapiens
uuauucuacuauac

SEQ ID NO: 1717521 - RNA, 14 nt, Homo sapiens
uuauucugugcgcu

SEQ ID NO: 1717522 - RNA, 15 nt, Homo sapiens
uuauugaaugugauu

SEQ ID NO: 1717523 - RNA, 15 nt, Homo sapiens
uuauuuaauaacauu

SEQ ID NO: 1717524 - RNA, 16 nt, Homo sapiens
uuauuuacaugugauu

SEQ ID NO: 1717525 - RNA, 16 nt, Homo sapiens
uuauuuagcuggccau

SEQ ID NO: 1717526 - RNA, 16 nt, Homo sapiens
uuauuuugaaaauaau

SEQ ID NO: 1717527 - RNA, 22 nt, Homo sapiens
uuauuuuucauauugugccaau

SEQ ID NO: 1717528 - RNA, 18 nt, Homo sapiens
uucaaaagguuauauacc

SEQ ID NO: 1717529 - RNA, 13 nt, Homo sapiens
uucaaaaguucca

SEQ ID NO: 1717530 - RNA, 16 nt, Homo sapiens
uucaaaauccaaaaag

SEQ ID NO: 1717531 - RNA, 16 nt, Homo sapiens
uucaaacaauaucaua

SEQ ID NO: 1717532 - RNA, 13 nt, Homo sapiens
uucaaaguuaaaa

SEQ ID NO: 1717533 - RNA, 21 nt, Homo sapiens
uucaaauuaagugugcaugau

SEQ ID NO: 1717534 - RNA, 19 nt, Homo sapiens
uucaaauuuuuacugagaa

SEQ ID NO: 1717535 - RNA, 19 nt, Homo sapiens
uucaacaguuuuugcuaau

SEQ ID NO: 1717536 - RNA, 15 nt, Homo sapiens
uucaagaaagcuuca

SEQ ID NO: 1717537 - RNA, 16 nt, Homo sapiens
uucaagccuuagauaa

SEQ ID NO: 1717538 - RNA, 21 nt, Homo sapiens
uucaauagcauaucacagaga

SEQ ID NO: 1717539 - RNA, 14 nt, Homo sapiens
uucaauauugacau

SEQ ID NO: 1717540 - RNA, 17 nt, Homo sapiens
uucaaugaaccacaaaa

SEQ ID NO: 1717541 - RNA, 15 nt, Homo sapiens
uucaauucucaaaag

SEQ ID NO: 1717542 - RNA, 19 nt, Homo sapiens
uucacaccgcugcacucaa

SEQ ID NO: 1717543 - RNA, 19 nt, Homo sapiens
uucacauucccaucuguca

SEQ ID NO: 1717544 - RNA, 11 nt, Homo sapiens
uucaccaaaau

SEQ ID NO: 1717545 - RNA, 19 nt, Homo sapiens
uucacccaaaacaaaguaa

SEQ ID NO: 1717546 - RNA, 18 nt, Homo sapiens
uucaccuaccgaguucaa

SEQ ID NO: 1717547 - RNA, 12 nt, Homo sapiens
uucacuacauua

SEQ ID NO: 1717548 - RNA, 14 nt, Homo sapiens
uucacuacuuuaau

SEQ ID NO: 1717549 - RNA, 21 nt, Homo sapiens
uucacuagaaaagcugaucau

SEQ ID NO: 1717550 - RNA, 18 nt, Homo sapiens
uucacugaaggugauuca

SEQ ID NO: 1717551 - RNA, 13 nt, Homo sapiens
uucacuuuacaaa

SEQ ID NO: 1717552 - RNA, 18 nt, Homo sapiens
uucagaaccauccauagu

SEQ ID NO: 1717553 - RNA, 24 nt, Homo sapiens
uucagaaguaauuugaauagccug

SEQ ID NO: 1717554 - RNA, 23 nt, Homo sapiens
uucagaauguacggaaagaugau

SEQ ID NO: 1717555 - RNA, 19 nt, Homo sapiens
uucagaggagcaacccuau

SEQ ID NO: 1717556 - RNA, 19 nt, Homo sapiens
uucagauauuauugcuuua

SEQ ID NO: 1717557 - RNA, 20 nt, Homo sapiens
uucagcuccagcucaccagc

SEQ ID NO: 1717558 - RNA, 14 nt, Homo sapiens
uucaggcaggccaa

SEQ ID NO: 1717559 - RNA, 23 nt, Homo sapiens
uucaggccauucuccugccucag

SEQ ID NO: 1717560 - RNA, 15 nt, Homo sapiens
uucaguacuugugaa

SEQ ID NO: 1717561 - RNA, 23 nt, Homo sapiens
uucaguacuugugaaacacagcu

SEQ ID NO: 1717562 - RNA, 13 nt, Homo sapiens
uucaguaugcaaa

SEQ ID NO: 1717563 - RNA, 16 nt, Homo sapiens
uucauacccuguuacc

SEQ ID NO: 1717564 - RNA, 11 nt, Homo sapiens
uucaucucuug

SEQ ID NO: 1717565 - RNA, 16 nt, Homo sapiens
uucaugacaagcauuu

SEQ ID NO: 1717566 - RNA, 15 nt, Homo sapiens
uucaugaccauccug

SEQ ID NO: 1717567 - RNA, 17 nt, Homo sapiens
uucaugagcuugaacaa

SEQ ID NO: 1717568 - RNA, 18 nt, Homo sapiens
uucaugagcuugaacaag

SEQ ID NO: 1717569 - RNA, 12 nt, Homo sapiens
uucaugccagcu

SEQ ID NO: 1717570 - RNA, 13 nt, Homo sapiens
uucauggccccag

SEQ ID NO: 1717571 - RNA, 19 nt, Homo sapiens
uucauguaauagcaaugca

SEQ ID NO: 1717572 - RNA, 14 nt, Homo sapiens
uucauucacauuca

SEQ ID NO: 1717573 - RNA, 21 nt, Homo sapiens
uucauucccaagguuacugga

SEQ ID NO: 1717574 - RNA, 22 nt, Homo sapiens
uucauucugcauugcuagauaa

SEQ ID NO: 1717575 - RNA, 17 nt, Homo sapiens
uucauuuugagaucaag

SEQ ID NO: 1717576 - RNA, 21 nt, Homo sapiens
uuccaacaccacagacacaca

SEQ ID NO: 1717577 - RNA, 17 nt, Homo sapiens
uuccacuaacucauagu

SEQ ID NO: 1717578 - RNA, 18 nt, Homo sapiens
uuccacucccuuugccag

SEQ ID NO: 1717579 - RNA, 17 nt, Homo sapiens
uuccagcagaugccaca

SEQ ID NO: 1717580 - RNA, 16 nt, Homo sapiens
uuccagcguacuauaa

SEQ ID NO: 1717581 - RNA, 16 nt, Homo sapiens
uuccagcuccuguaac

SEQ ID NO: 1717582 - RNA, 11 nt, Homo sapiens
uuccagcugcu

SEQ ID NO: 1717583 - RNA, 12 nt, Homo sapiens
uuccagcugcug

SEQ ID NO: 1717584 - RNA, 16 nt, Homo sapiens
uuccaucucugacuua

SEQ ID NO: 1717585 - RNA, 22 nt, Homo sapiens
uuccauguaucuuuugaacugg

SEQ ID NO: 1717586 - RNA, 21 nt, Homo sapiens
uucccaggccagcaagcucuu

SEQ ID NO: 1717587 - RNA, 15 nt, Homo sapiens
uucccagucuucuga

SEQ ID NO: 1717588 - RNA, 19 nt, Homo sapiens
uucccaucgcugucacagg

SEQ ID NO: 1717589 - RNA, 14 nt, Homo sapiens
uucccauucuugca

SEQ ID NO: 1717590 - RNA, 16 nt, Homo sapiens
uucccauuugugccag

SEQ ID NO: 1717591 - RNA, 17 nt, Homo sapiens
uucccauuugugccaga

SEQ ID NO: 1717592 - RNA, 12 nt, Homo sapiens
uuccccacugac

SEQ ID NO: 1717593 - RNA, 17 nt, Homo sapiens
uuccccauaacucaaug

SEQ ID NO: 1717594 - RNA, 19 nt, Homo sapiens
uuccccucaacaugcugcc

SEQ ID NO: 1717595 - RNA, 19 nt, Homo sapiens
uucccuacuuccugugacu

SEQ ID NO: 1717596 - RNA, 17 nt, Homo sapiens
uucccucuuuucuuacu

SEQ ID NO: 1717597 - RNA, 19 nt, Homo sapiens
uucccugaaaccguuaaaa

SEQ ID NO: 1717598 - RNA, 18 nt, Homo sapiens
uucccugauugaccugcu

SEQ ID NO: 1717599 - RNA, 19 nt, Homo sapiens
uucccuggagagaaagugu

SEQ ID NO: 1717600 - RNA, 14 nt, Homo sapiens
uucccuuccacugc

SEQ ID NO: 1717601 - RNA, 14 nt, Homo sapiens
uucccuucuugcau

SEQ ID NO: 1717602 - RNA, 19 nt, Homo sapiens
uuccuauuuguuuucaugg

SEQ ID NO: 1717603 - RNA, 20 nt, Homo sapiens
uuccuauuuuagauggaaua

SEQ ID NO: 1717604 - RNA, 13 nt, Homo sapiens
uuccucagaucau

SEQ ID NO: 1717605 - RNA, 15 nt, Homo sapiens
uuccucucucagggg

SEQ ID NO: 1717606 - RNA, 12 nt, Homo sapiens
uuccucugucaa

SEQ ID NO: 1717607 - RNA, 16 nt, Homo sapiens
uuccugagaccacaga

SEQ ID NO: 1717608 - RNA, 18 nt, Homo sapiens
uuccugccccagacagac

SEQ ID NO: 1717609 - RNA, 11 nt, Homo sapiens
uuccugugauc

SEQ ID NO: 1717610 - RNA, 13 nt, Homo sapiens
uuccugugaucca

SEQ ID NO: 1717611 - RNA, 19 nt, Homo sapiens
uuccuguucccuuggaaua

SEQ ID NO: 1717612 - RNA, 20 nt, Homo sapiens
uuccuguugucuacaccaau

SEQ ID NO: 1717613 - RNA, 24 nt, Homo sapiens
uuccuuuauagagugucucagggu

SEQ ID NO: 1717614 - RNA, 19 nt, Homo sapiens
uuccuuuccccagcccagg

SEQ ID NO: 1717615 - RNA, 22 nt, Homo sapiens
aaagugugugauuucucuccca

SEQ ID NO: 1717616 - RNA, 15 nt, Homo sapiens
aaaguuccuuccuaa

SEQ ID NO: 1717617 - RNA, 12 nt, Homo sapiens
aaaguucuugcu

SEQ ID NO: 1717618 - RNA, 17 nt, Homo sapiens
aaaguuuacccaugaag

SEQ ID NO: 1717619 - RNA, 22 nt, Homo sapiens
aaauaaaaagugacacagcagc

SEQ ID NO: 1717620 - RNA, 18 nt, Homo sapiens
aaauaaagaaauugcaau

SEQ ID NO: 1717621 - RNA, 12 nt, Homo sapiens
aaauaaagacaa

SEQ ID NO: 1717622 - RNA, 15 nt, Homo sapiens
aaauaacaaguacca

SEQ ID NO: 1717623 - RNA, 15 nt, Homo sapiens
aaauaagaaugauuu

SEQ ID NO: 1717624 - RNA, 18 nt, Homo sapiens
aaauaagcucuccccaaa

SEQ ID NO: 1717625 - RNA, 19 nt, Homo sapiens
aaauaauauggcuaugcuu

SEQ ID NO: 1717626 - RNA, 16 nt, Homo sapiens
aaauaccaacuguaca

SEQ ID NO: 1717627 - RNA, 16 nt, Homo sapiens
aaauaccaaguauuua

SEQ ID NO: 1717628 - RNA, 11 nt, Homo sapiens
aaauaccucau

SEQ ID NO: 1717629 - RNA, 14 nt, Homo sapiens
aaauagacauauua

SEQ ID NO: 1717630 - RNA, 22 nt, Homo sapiens
aaauagagcuuuuaaaaauguc

SEQ ID NO: 1717631 - RNA, 20 nt, Homo sapiens
aaauauauacccccccaugc

SEQ ID NO: 1717632 - RNA, 15 nt, Homo sapiens
aaauauauacuaaac

SEQ ID NO: 1717633 - RNA, 15 nt, Homo sapiens
aaauauauauaaaga

SEQ ID NO: 1717634 - RNA, 13 nt, Homo sapiens
aaauauauauaca

SEQ ID NO: 1717635 - RNA, 15 nt, Homo sapiens
aaauauauuguuaau

SEQ ID NO: 1717636 - RNA, 19 nt, Homo sapiens
aaauauauuguuaaucucu

SEQ ID NO: 1717637 - RNA, 22 nt, Homo sapiens
aaauauguccgcagaauggacu

SEQ ID NO: 1717638 - RNA, 18 nt, Homo sapiens
aaauauuacucaguuuau

SEQ ID NO: 1717639 - RNA, 18 nt, Homo sapiens
aaauauugaggcuuugug

SEQ ID NO: 1717640 - RNA, 23 nt, Homo sapiens
aaauauuguugacaacugugacu

SEQ ID NO: 1717641 - RNA, 21 nt, Homo sapiens
aaaucaacagaagcauuugua

SEQ ID NO: 1717642 - RNA, 13 nt, Homo sapiens
aaaucaaguccuu

SEQ ID NO: 1717643 - RNA, 14 nt, Homo sapiens
aaaucagagacaaa

SEQ ID NO: 1717644 - RNA, 13 nt, Homo sapiens
aaaucaguauuug

SEQ ID NO: 1717645 - RNA, 23 nt, Homo sapiens
aaaucauaguuuaaacugcauua

SEQ ID NO: 1717646 - RNA, 20 nt, Homo sapiens
aaaucauccaagacaguuau

SEQ ID NO: 1717647 - RNA, 15 nt, Homo sapiens
aaauccauaucuuaa

SEQ ID NO: 1717648 - RNA, 17 nt, Homo sapiens
aaauccuaagacacaaa

SEQ ID NO: 1717649 - RNA, 21 nt, Homo sapiens
aaaucgugacaacacuugugu

SEQ ID NO: 1717650 - RNA, 19 nt, Homo sapiens
aaaucugacaagacugaaa

SEQ ID NO: 1717651 - RNA, 18 nt, Homo sapiens
aaaucuguguaacuguaa

SEQ ID NO: 1717652 - RNA, 14 nt, Homo sapiens
aaaugaacauuuca

SEQ ID NO: 1717653 - RNA, 16 nt, Homo sapiens
aaaugaagggauauaa

SEQ ID NO: 1717654 - RNA, 13 nt, Homo sapiens
aaaugacuacuua

SEQ ID NO: 1717655 - RNA, 15 nt, Homo sapiens
aaauggcagaaccaa

SEQ ID NO: 1717656 - RNA, 15 nt, Homo sapiens
aaauguacaacugca

SEQ ID NO: 1717657 - RNA, 12 nt, Homo sapiens
aaauguagcaau

SEQ ID NO: 1717658 - RNA, 21 nt, Homo sapiens
aaauguaggcaucaugcaugu

SEQ ID NO: 1717659 - RNA, 17 nt, Homo sapiens
aaauguauacuauagua

SEQ ID NO: 1717660 - RNA, 14 nt, Homo sapiens
aaauguauauacac

SEQ ID NO: 1717661 - RNA, 20 nt, Homo sapiens
aaaugugaauugcaugacuu

SEQ ID NO: 1717662 - RNA, 22 nt, Homo sapiens
aaauguguaauuuuguuuauau

SEQ ID NO: 1717663 - RNA, 14 nt, Homo sapiens
aaauguuaugacua

SEQ ID NO: 1717664 - RNA, 15 nt, Homo sapiens
aaauuaagaaggcaa

SEQ ID NO: 1717665 - RNA, 18 nt, Homo sapiens
aaauuaagacuugugcau

SEQ ID NO: 1717666 - RNA, 14 nt, Homo sapiens
aaauuauaucucag

SEQ ID NO: 1717667 - RNA, 16 nt, Homo sapiens
aaauuauaucucagua

SEQ ID NO: 1717668 - RNA, 16 nt, Homo sapiens
aaauuaugugacauuu

SEQ ID NO: 1717669 - RNA, 15 nt, Homo sapiens
aaauuauucugcccu

SEQ ID NO: 1717670 - RNA, 18 nt, Homo sapiens
aaauucaauuaggauuaa

SEQ ID NO: 1717671 - RNA, 15 nt, Homo sapiens
aaauugcuccuugac

SEQ ID NO: 1717672 - RNA, 24 nt, Homo sapiens
aaauugucuuuugucauguggcua

SEQ ID NO: 1717673 - RNA, 24 nt, Homo sapiens
aaauuuaagugcguguguagaguu

SEQ ID NO: 1717674 - RNA, 15 nt, Homo sapiens
aaauuuaucaaagca

SEQ ID NO: 1717675 - RNA, 18 nt, Homo sapiens
aaauuugauugauuugaa

SEQ ID NO: 1717676 - RNA, 13 nt, Homo sapiens
aaccagugccaag

SEQ ID NO: 1717677 - RNA, 13 nt, Homo sapiens
aacccaagcuccu

SEQ ID NO: 1717678 - RNA, 22 nt, Homo sapiens
aacccaguuuucccucugggag

SEQ ID NO: 1717679 - RNA, 19 nt, Homo sapiens
aaccccaucgccaacuaag

SEQ ID NO: 1717680 - RNA, 12 nt, Homo sapiens
aaccccuuccag

SEQ ID NO: 1717681 - RNA, 21 nt, Homo sapiens
aaccccuuccagaucacugcc

SEQ ID NO: 1717682 - RNA, 22 nt, Homo sapiens
aaccccuuccagaucacugcca

SEQ ID NO: 1717683 - RNA, 18 nt, Homo sapiens
aacccggggcuggugggc

SEQ ID NO: 1717684 - RNA, 18 nt, Homo sapiens
aaccuccuguggaaccca

SEQ ID NO: 1717685 - RNA, 22 nt, Homo sapiens
aaccuccuguggaacccagcag

SEQ ID NO: 1717686 - RNA, 20 nt, Homo sapiens
aaccucuucaugagcuugaa

SEQ ID NO: 1717687 - RNA, 23 nt, Homo sapiens
aaccuggaccccuucggcagcua

SEQ ID NO: 1717688 - RNA, 18 nt, Homo sapiens
aaccuggaguauaauauu

SEQ ID NO: 1717689 - RNA, 23 nt, Homo sapiens
aaccuggccgcguuuagaccaag

SEQ ID NO: 1717690 - RNA, 22 nt, Homo sapiens
aaccugucuccacugugccuuu

SEQ ID NO: 1717691 - RNA, 14 nt, Homo sapiens
aaccugugugccau

SEQ ID NO: 1717692 - RNA, 18 nt, Homo sapiens
aaccuugaaugcugccag

SEQ ID NO: 1717693 - RNA, 21 nt, Homo sapiens
aaccuugcuguccugaucugu

SEQ ID NO: 1717694 - RNA, 23 nt, Homo sapiens
aaccuugcuguccugaucuguga

SEQ ID NO: 1717695 - RNA, 18 nt, Homo sapiens
aaccuugucucuaugcca

SEQ ID NO: 1717696 - RNA, 20 nt, Homo sapiens
aacgagcauaguccaaaaag

SEQ ID NO: 1717697 - RNA, 15 nt, Homo sapiens
aacuaaacagauaaa

SEQ ID NO: 1717698 - RNA, 17 nt, Homo sapiens
aacuaagacauaugcau

SEQ ID NO: 1717699 - RNA, 12 nt, Homo sapiens
aacuacuauuca

SEQ ID NO: 1717700 - RNA, 20 nt, Homo sapiens
aacuagagcacagaaggaau

SEQ ID NO: 1717701 - RNA, 21 nt, Homo sapiens
aacuaggcucagagaugugca

SEQ ID NO: 1717702 - RNA, 23 nt, Homo sapiens
aacuaggcucagagaugugcacc

SEQ ID NO: 1717703 - RNA, 19 nt, Homo sapiens
aacuauacuugaacaaaag

SEQ ID NO: 1717704 - RNA, 19 nt, Homo sapiens
aacuauuucuacacagugg

SEQ ID NO: 1717705 - RNA, 20 nt, Homo sapiens
aacucaacugggcucugucc

SEQ ID NO: 1717706 - RNA, 18 nt, Homo sapiens
aacucacaagugcucauc

SEQ ID NO: 1717707 - RNA, 18 nt, Homo sapiens
aacucagaucugucugau

SEQ ID NO: 1717708 - RNA, 20 nt, Homo sapiens
aacucagggacagagccaug

SEQ ID NO: 1717709 - RNA, 15 nt, Homo sapiens
aacucaguccuguac

SEQ ID NO: 1717710 - RNA, 21 nt, Homo sapiens
aacucauggaccacaguaaca

SEQ ID NO: 1717711 - RNA, 16 nt, Homo sapiens
aacucccucugggaag

SEQ ID NO: 1717712 - RNA, 16 nt, Homo sapiens
aacuccuuggccuagc

SEQ ID NO: 1717713 - RNA, 14 nt, Homo sapiens
aacucugacaaggg

SEQ ID NO: 1717714 - RNA, 22 nt, Homo sapiens
aacucugacaagggcugaccug

SEQ ID NO: 1717715 - RNA, 21 nt, Homo sapiens
aacucugagaucuaaggaugu

SEQ ID NO: 1717716 - RNA, 19 nt, Homo sapiens
aacucugguaaaugaucac

SEQ ID NO: 1717717 - RNA, 16 nt, Homo sapiens
aacugaaaauggaccu

SEQ ID NO: 1717718 - RNA, 20 nt, Homo sapiens
aacugaccagccuccaugcu

SEQ ID NO: 1717719 - RNA, 13 nt, Homo sapiens
aacugacugccuu

SEQ ID NO: 1717720 - RNA, 17 nt, Homo sapiens
aacugcaccugucauca

SEQ ID NO: 1717721 - RNA, 21 nt, Homo sapiens
aacugccauuauuuucuguca

SEQ ID NO: 1717722 - RNA, 11 nt, Homo sapiens
aacuggcugca

SEQ ID NO: 1717723 - RNA, 14 nt, Homo sapiens
aacugggaccugag

SEQ ID NO: 1717724 - RNA, 15 nt, Homo sapiens
aacugguucaugaaa

SEQ ID NO: 1717725 - RNA, 17 nt, Homo sapiens
aacugugaagcauuuac

SEQ ID NO: 1717726 - RNA, 17 nt, Homo sapiens
aacugugcugaaugcuu

SEQ ID NO: 1717727 - RNA, 14 nt, Homo sapiens
aacuguguuuacuc

SEQ ID NO: 1717728 - RNA, 13 nt, Homo sapiens
aacuguuaccuaa

SEQ ID NO: 1717729 - RNA, 13 nt, Homo sapiens
aacuguuaugaaa

SEQ ID NO: 1717730 - RNA, 18 nt, Homo sapiens
aacuguucagcuguccuc

SEQ ID NO: 1717731 - RNA, 13 nt, Homo sapiens
aacuuacuauuca

SEQ ID NO: 1717732 - RNA, 19 nt, Homo sapiens
aacuucagaugggaggaaa

SEQ ID NO: 1717733 - RNA, 17 nt, Homo sapiens
aacuucagcaccaugga

SEQ ID NO: 1717734 - RNA, 16 nt, Homo sapiens
aacuucccagugaauu

SEQ ID NO: 1717735 - RNA, 15 nt, Homo sapiens
aacuucccugauuga

SEQ ID NO: 1717736 - RNA, 12 nt, Homo sapiens
aacuucuuguca

SEQ ID NO: 1717737 - RNA, 18 nt, Homo sapiens
aacuugaaugugucaggu

SEQ ID NO: 1717738 - RNA, 16 nt, Homo sapiens
aagggaucuuccuugg

SEQ ID NO: 1717739 - RNA, 15 nt, Homo sapiens
aagggcaucacuggg

SEQ ID NO: 1717740 - RNA, 16 nt, Homo sapiens
aagggcaucacugggu

SEQ ID NO: 1717741 - RNA, 17 nt, Homo sapiens
aagggcaucacuggguc

SEQ ID NO: 1717742 - RNA, 13 nt, Homo sapiens
aaggggcaaauuu

SEQ ID NO: 1717743 - RNA, 19 nt, Homo sapiens
aagggguuggggugacagu

SEQ ID NO: 1717744 - RNA, 21 nt, Homo sapiens
aagguagcuuaccugacacaa

SEQ ID NO: 1717745 - RNA, 19 nt, Homo sapiens
aagguauuuugaauaccau

SEQ ID NO: 1717746 - RNA, 21 nt, Homo sapiens
aaggucauaagggagcaugau

SEQ ID NO: 1717747 - RNA, 16 nt, Homo sapiens
aaggugaaagugcagu

SEQ ID NO: 1717748 - RNA, 14 nt, Homo sapiens
aagguuacuggaua

SEQ ID NO: 1717749 - RNA, 17 nt, Homo sapiens
aagguuccaacuguaua

SEQ ID NO: 1717750 - RNA, 13 nt, Homo sapiens
aaguaaugauuaa

SEQ ID NO: 1717751 - RNA, 17 nt, Homo sapiens
aaguaauguuaauucuu

SEQ ID NO: 1717752 - RNA, 20 nt, Homo sapiens
aaguaauuccucucacuaaa

SEQ ID NO: 1717753 - RNA, 12 nt, Homo sapiens
aaguacauguau

SEQ ID NO: 1717754 - RNA, 13 nt, Homo sapiens
aaguacccuuuug

SEQ ID NO: 1717755 - RNA, 22 nt, Homo sapiens
aaguacuguaauaauaccucaa

SEQ ID NO: 1717756 - RNA, 22 nt, Homo sapiens
aaguagauuagaaaacuagauu

SEQ ID NO: 1717757 - RNA, 18 nt, Homo sapiens
aaguagguuuacauucau

SEQ ID NO: 1717758 - RNA, 13 nt, Homo sapiens
aaguaugagggaa

SEQ ID NO: 1717759 - RNA, 16 nt, Homo sapiens
aaguaugagggaaaau

SEQ ID NO: 1717760 - RNA, 18 nt, Homo sapiens
aaguauguaaacaggaga

SEQ ID NO: 1717761 - RNA, 20 nt, Homo sapiens
aaguauuuugaaguuuacau

SEQ ID NO: 1717762 - RNA, 15 nt, Homo sapiens
aagucaccuguauaa

SEQ ID NO: 1717763 - RNA, 23 nt, Homo sapiens
aagucacugcacagugcaucuca

SEQ ID NO: 1717764 - RNA, 20 nt, Homo sapiens
aagucaugaagcccaaguga

SEQ ID NO: 1717765 - RNA, 23 nt, Homo sapiens
aaguccugacacuauucauuuga

SEQ ID NO: 1717766 - RNA, 20 nt, Homo sapiens
aagucuccagucaccuacaa

SEQ ID NO: 1717767 - RNA, 15 nt, Homo sapiens
aagucugcuacccuc

SEQ ID NO: 1717768 - RNA, 21 nt, Homo sapiens
aagugaagagggagaagggau

SEQ ID NO: 1717769 - RNA, 13 nt, Homo sapiens
aagugacacagca

SEQ ID NO: 1717770 - RNA, 15 nt, Homo sapiens
aagugacacuuugac

SEQ ID NO: 1717771 - RNA, 20 nt, Homo sapiens
aagugauccucccaccucag

SEQ ID NO: 1717772 - RNA, 23 nt, Homo sapiens
aagugcauaugaaauccuugacu

SEQ ID NO: 1717773 - RNA, 14 nt, Homo sapiens
aagugcgugaaugu

SEQ ID NO: 1717774 - RNA, 18 nt, Homo sapiens
aagugcgugaauguaugu

SEQ ID NO: 1717775 - RNA, 23 nt, Homo sapiens
aagugcgugccgugugaguguga

SEQ ID NO: 1717776 - RNA, 18 nt, Homo sapiens
aagugcuggcaaccacua

SEQ ID NO: 1717777 - RNA, 21 nt, Homo sapiens
aagugcugggauuacaggugu

SEQ ID NO: 1717778 - RNA, 17 nt, Homo sapiens
aagugucucugccuuga

SEQ ID NO: 1717779 - RNA, 22 nt, Homo sapiens
aaguguuuuuuauugaaugcuu

SEQ ID NO: 1717780 - RNA, 12 nt, Homo sapiens
aaguuacuuuau

SEQ ID NO: 1717781 - RNA, 22 nt, Homo sapiens
aaguuauacuguggcuaugcaa

SEQ ID NO: 1717782 - RNA, 22 nt, Homo sapiens
aaguuccaguguucucucuuau

SEQ ID NO: 1717783 - RNA, 12 nt, Homo sapiens
aaguugacuuau

SEQ ID NO: 1717784 - RNA, 23 nt, Homo sapiens
agccccuccaaaggucugauguc

SEQ ID NO: 1717785 - RNA, 20 nt, Homo sapiens
agccccucccccaucuccca

SEQ ID NO: 1717786 - RNA, 17 nt, Homo sapiens
agccccuggggccuaga

SEQ ID NO: 1717787 - RNA, 15 nt, Homo sapiens
agccccugguccuga

SEQ ID NO: 1717788 - RNA, 19 nt, Homo sapiens
agcccucccccagcaguug

SEQ ID NO: 1717789 - RNA, 12 nt, Homo sapiens
agcccugaaccc

SEQ ID NO: 1717790 - RNA, 15 nt, Homo sapiens
agcccugaggugaaa

SEQ ID NO: 1717791 - RNA, 19 nt, Homo sapiens
agcccugccaugucacaau

SEQ ID NO: 1717792 - RNA, 17 nt, Homo sapiens
agcccugugucuguaua

SEQ ID NO: 1717793 - RNA, 16 nt, Homo sapiens
agcccuuagcagggaa

SEQ ID NO: 1717794 - RNA, 21 nt, Homo sapiens
agccgagaucacgccacugca

SEQ ID NO: 1717795 - RNA, 19 nt, Homo sapiens
agccgggugugguggcaca

SEQ ID NO: 1717796 - RNA, 20 nt, Homo sapiens
agccuaaaagugggcuugau

SEQ ID NO: 1717797 - RNA, 21 nt, Homo sapiens
agccuacuuucacacuaagaa

SEQ ID NO: 1717798 - RNA, 18 nt, Homo sapiens
agccuagccugcauauca

SEQ ID NO: 1717799 - RNA, 18 nt, Homo sapiens
agccuaggugacagagug

SEQ ID NO: 1717800 - RNA, 14 nt, Homo sapiens
agccuauuuaccug

SEQ ID NO: 1717801 - RNA, 12 nt, Homo sapiens
agccuccacugc

SEQ ID NO: 1717802 - RNA, 16 nt, Homo sapiens
agccugaccaacaugg

SEQ ID NO: 1717803 - RNA, 14 nt, Homo sapiens
agccugcugcaugg

SEQ ID NO: 1717804 - RNA, 14 nt, Homo sapiens
agccugcuucccac

SEQ ID NO: 1717805 - RNA, 14 nt, Homo sapiens
agccuggcacagga

SEQ ID NO: 1717806 - RNA, 12 nt, Homo sapiens
agccuggcucuu

SEQ ID NO: 1717807 - RNA, 22 nt, Homo sapiens
agccugugcauguaugucuugg

SEQ ID NO: 1717808 - RNA, 23 nt, Homo sapiens
agccuguggcaucuuugccuugg

SEQ ID NO: 1717809 - RNA, 17 nt, Homo sapiens
agccuucugaugucucu

SEQ ID NO: 1717810 - RNA, 21 nt, Homo sapiens
agccuucuuccaucccaggac

SEQ ID NO: 1717811 - RNA, 19 nt, Homo sapiens
agccuugaugccauaugcc

SEQ ID NO: 1717812 - RNA, 14 nt, Homo sapiens
agccuuugccuccc

SEQ ID NO: 1717813 - RNA, 19 nt, Homo sapiens
agcgcagguuuaguuuacu

SEQ ID NO: 1717814 - RNA, 17 nt, Homo sapiens
agcgcucagaacaguau

SEQ ID NO: 1717815 - RNA, 18 nt, Homo sapiens
agcgucacggccaagugu

SEQ ID NO: 1717816 - RNA, 19 nt, Homo sapiens
agcguguuuacauguguag

SEQ ID NO: 1717817 - RNA, 20 nt, Homo sapiens
agcguuuuuuaaauguauac

SEQ ID NO: 1717818 - RNA, 18 nt, Homo sapiens
agcuaaacggauuccaaa

SEQ ID NO: 1717819 - RNA, 17 nt, Homo sapiens
agcuaaccuuauccugc

SEQ ID NO: 1717820 - RNA, 18 nt, Homo sapiens
agcuaaccuuauccugca

SEQ ID NO: 1717821 - RNA, 16 nt, Homo sapiens
agcuaacuuauuuucc

SEQ ID NO: 1717822 - RNA, 13 nt, Homo sapiens
agcuaaguacaca

SEQ ID NO: 1717823 - RNA, 17 nt, Homo sapiens
agcuaaguacacaauaa

SEQ ID NO: 1717824 - RNA, 16 nt, Homo sapiens
agcuaauaaugagcua

SEQ ID NO: 1717825 - RNA, 12 nt, Homo sapiens
agcuaauuugca

SEQ ID NO: 1717826 - RNA, 15 nt, Homo sapiens
agcuacaggacauuu

SEQ ID NO: 1717827 - RNA, 16 nt, Homo sapiens
agcuacccacuauccu

SEQ ID NO: 1717828 - RNA, 23 nt, Homo sapiens
agcuacugugugugugaaugaac

SEQ ID NO: 1717829 - RNA, 15 nt, Homo sapiens
agcuauggaaucaau

SEQ ID NO: 1717830 - RNA, 16 nt, Homo sapiens
agcuauuagccaggau

SEQ ID NO: 1717831 - RNA, 19 nt, Homo sapiens
agcucagaaacgaaaucua

SEQ ID NO: 1717832 - RNA, 16 nt, Homo sapiens
agcucagcgccagccu

SEQ ID NO: 1717833 - RNA, 17 nt, Homo sapiens
agcucaggggcagcuca

SEQ ID NO: 1717834 - RNA, 21 nt, Homo sapiens
agcuccucccacaaugcugaa

SEQ ID NO: 1717835 - RNA, 21 nt, Homo sapiens
agcucucuugccgaggagcca

SEQ ID NO: 1717836 - RNA, 22 nt, Homo sapiens
agcucuggccacaacagggcau

SEQ ID NO: 1717837 - RNA, 17 nt, Homo sapiens
agcucuucaggccuccc

SEQ ID NO: 1717838 - RNA, 18 nt, Homo sapiens
agcugaaaguucuugcuc

SEQ ID NO: 1717839 - RNA, 14 nt, Homo sapiens
agcugaacaauagg

SEQ ID NO: 1717840 - RNA, 15 nt, Homo sapiens
agcugaagcuggugc

SEQ ID NO: 1717841 - RNA, 14 nt, Homo sapiens
agcugacaucucag

SEQ ID NO: 1717842 - RNA, 15 nt, Homo sapiens
agcugaccaucaucc

SEQ ID NO: 1717843 - RNA, 18 nt, Homo sapiens
agcugagaauguggaaua

SEQ ID NO: 1717844 - RNA, 15 nt, Homo sapiens
agcugagagacuuuu

SEQ ID NO: 1717845 - RNA, 16 nt, Homo sapiens
agcugauauaaauucu

SEQ ID NO: 1717846 - RNA, 16 nt, Homo sapiens
agcugcuggcuugcag

SEQ ID NO: 1717847 - RNA, 23 nt, Homo sapiens
agcugcugucuucuggacaggcu

SEQ ID NO: 1717848 - RNA, 22 nt, Homo sapiens
agcuggaagggucaacaucuuu

SEQ ID NO: 1717849 - RNA, 13 nt, Homo sapiens
agcuggccugaga

SEQ ID NO: 1717850 - RNA, 18 nt, Homo sapiens
agcugggacuacaggcac

SEQ ID NO: 1717851 - RNA, 17 nt, Homo sapiens
agcugggacuacaggug

SEQ ID NO: 1717852 - RNA, 17 nt, Homo sapiens
agcugggcucugcaauu

SEQ ID NO: 1717853 - RNA, 14 nt, Homo sapiens
agcugguaaacuau

SEQ ID NO: 1717854 - RNA, 21 nt, Homo sapiens
agcugguggcaauaaauauua

SEQ ID NO: 1717855 - RNA, 19 nt, Homo sapiens
agcuguaaaacgcugucaa

SEQ ID NO: 1717856 - RNA, 14 nt, Homo sapiens
agcuguacugagga

SEQ ID NO: 1717857 - RNA, 18 nt, Homo sapiens
agcugucaggcugauuau

SEQ ID NO: 1717858 - RNA, 19 nt, Homo sapiens
agcugucccucacuguuga

SEQ ID NO: 1717859 - RNA, 12 nt, Homo sapiens
agcugucugcuc

SEQ ID NO: 1717860 - RNA, 15 nt, Homo sapiens
agcugugacuucucc

SEQ ID NO: 1717861 - RNA, 11 nt, Homo sapiens
agcugugauuu

SEQ ID NO: 1717862 - RNA, 17 nt, Homo sapiens
agcuucaccagagcauu

SEQ ID NO: 1717863 - RNA, 23 nt, Homo sapiens
agcuucuaauaaauuauacaaau

SEQ ID NO: 1717864 - RNA, 17 nt, Homo sapiens
agcuuuaaacucaggga

SEQ ID NO: 1717865 - RNA, 12 nt, Homo sapiens
agcuuucuugcu

SEQ ID NO: 1717866 - RNA, 18 nt, Homo sapiens
agcuuuuaaaaauguccu

SEQ ID NO: 1717867 - RNA, 19 nt, Homo sapiens
aggaaacaagugaaagcau

SEQ ID NO: 1717868 - RNA, 14 nt, Homo sapiens
aggaaacaauauaa

SEQ ID NO: 1717869 - RNA, 21 nt, Homo sapiens
aggaaaccaacacccaaagca

SEQ ID NO: 1717870 - RNA, 17 nt, Homo sapiens
aggaaagcacacaguca

SEQ ID NO: 1717871 - RNA, 19 nt, Homo sapiens
aggaaaguuuacccaugaa

SEQ ID NO: 1717872 - RNA, 16 nt, Homo sapiens
aggaacagcaauggug

SEQ ID NO: 1717873 - RNA, 20 nt, Homo sapiens
aggaacauuccuuagucuca

SEQ ID NO: 1717874 - RNA, 22 nt, Homo sapiens
aggaacugggccaacucaccug

SEQ ID NO: 1717875 - RNA, 14 nt, Homo sapiens
aggaagauauacau

SEQ ID NO: 1717876 - RNA, 14 nt, Homo sapiens
aggaagcauucaga

SEQ ID NO: 1717877 - RNA, 23 nt, Homo sapiens
aggaagccugagguugaccagcu

SEQ ID NO: 1717878 - RNA, 16 nt, Homo sapiens
aggaaggaaaugacac

SEQ ID NO: 1717879 - RNA, 14 nt, Homo sapiens
aggaaguacuucca

SEQ ID NO: 1717880 - RNA, 13 nt, Homo sapiens
aggaaucauguca

SEQ ID NO: 1717881 - RNA, 20 nt, Homo sapiens
aggaauuggccgcugucacu

SEQ ID NO: 1717882 - RNA, 18 nt, Homo sapiens
aggacagggaggugaccc

SEQ ID NO: 1717883 - RNA, 13 nt, Homo sapiens
aggacugauacug

SEQ ID NO: 1717884 - RNA, 21 nt, Homo sapiens
aggacuuccauuugcuuuguc

SEQ ID NO: 1717885 - RNA, 17 nt, Homo sapiens
aggagaaaggggcccca

SEQ ID NO: 1717886 - RNA, 20 nt, Homo sapiens
aggagagaaagugggugaga

SEQ ID NO: 1717887 - RNA, 14 nt, Homo sapiens
aggagcacuuccaa

SEQ ID NO: 1717888 - RNA, 18 nt, Homo sapiens
aggagcagauuuuugcaa

SEQ ID NO: 1717889 - RNA, 20 nt, Homo sapiens
aggaggcaagcaagcucucu

SEQ ID NO: 1717890 - RNA, 21 nt, Homo sapiens
aggaggccuccaucucaugua

SEQ ID NO: 1717891 - RNA, 19 nt, Homo sapiens
aggagggccgaggugggcu

SEQ ID NO: 1717892 - RNA, 11 nt, Homo sapiens
aggaguacaau

SEQ ID NO: 1717893 - RNA, 20 nt, Homo sapiens
aggaguacaaugcccagauc

SEQ ID NO: 1717894 - RNA, 19 nt, Homo sapiens
agaagaauuuuucugucuu

SEQ ID NO: 1717895 - RNA, 16 nt, Homo sapiens
agaagaggacauugga

SEQ ID NO: 1717896 - RNA, 18 nt, Homo sapiens
agaagauagaugcacuua

SEQ ID NO: 1717897 - RNA, 22 nt, Homo sapiens
agaagauccaagaggcccugca

SEQ ID NO: 1717898 - RNA, 13 nt, Homo sapiens
agaagaugaucag

SEQ ID NO: 1717899 - RNA, 15 nt, Homo sapiens
agaagcugagacaca

SEQ ID NO: 1717900 - RNA, 20 nt, Homo sapiens
agaagcuguuguacauuuau

SEQ ID NO: 1717901 - RNA, 14 nt, Homo sapiens
agaaggcaaaaaug

SEQ ID NO: 1717902 - RNA, 18 nt, Homo sapiens
agaaggcagccaccagcg

SEQ ID NO: 1717903 - RNA, 19 nt, Homo sapiens
agaaggggaagcacucgug

SEQ ID NO: 1717904 - RNA, 19 nt, Homo sapiens
agaaggucauaagggagca

SEQ ID NO: 1717905 - RNA, 13 nt, Homo sapiens
agaaggugccacu

SEQ ID NO: 1717906 - RNA, 14 nt, Homo sapiens
agaagguugcucua

SEQ ID NO: 1717907 - RNA, 14 nt, Homo sapiens
agaauaaauuccca

SEQ ID NO: 1717908 - RNA, 14 nt, Homo sapiens
agaauagcuuugaa

SEQ ID NO: 1717909 - RNA, 15 nt, Homo sapiens
agaauauaggucucu

SEQ ID NO: 1717910 - RNA, 15 nt, Homo sapiens
agaaucccugccugu

SEQ ID NO: 1717911 - RNA, 18 nt, Homo sapiens
agaaucucuugaaccugg

SEQ ID NO: 1717912 - RNA, 14 nt, Homo sapiens
agaaucugcagcua

SEQ ID NO: 1717913 - RNA, 17 nt, Homo sapiens
agaaucugcagcuaacu

SEQ ID NO: 1717914 - RNA, 18 nt, Homo sapiens
agaauggagaggaacaca

SEQ ID NO: 1717915 - RNA, 17 nt, Homo sapiens
agaauguaucugugaag

SEQ ID NO: 1717916 - RNA, 18 nt, Homo sapiens
agaauuaagauacaaauu

SEQ ID NO: 1717917 - RNA, 16 nt, Homo sapiens
agaauuauaagucaca

SEQ ID NO: 1717918 - RNA, 18 nt, Homo sapiens
agaauuauaagucacaaa

SEQ ID NO: 1717919 - RNA, 13 nt, Homo sapiens
agaauuauucucu

SEQ ID NO: 1717920 - RNA, 20 nt, Homo sapiens
agaauuuaaaauaacacuug

SEQ ID NO: 1717921 - RNA, 11 nt, Homo sapiens
agaauuugcac

SEQ ID NO: 1717922 - RNA, 16 nt, Homo sapiens
agacaaaauauuuccc

SEQ ID NO: 1717923 - RNA, 16 nt, Homo sapiens
agacaaguauggcucc

SEQ ID NO: 1717924 - RNA, 21 nt, Homo sapiens
agacaaguauggcuccuccau

SEQ ID NO: 1717925 - RNA, 17 nt, Homo sapiens
agacaagugacuguauc

SEQ ID NO: 1717926 - RNA, 23 nt, Homo sapiens
agacacagcgucccuagcaguga

SEQ ID NO: 1717927 - RNA, 17 nt, Homo sapiens
agacacaggcccggcuc

SEQ ID NO: 1717928 - RNA, 15 nt, Homo sapiens
agacacugugcuaua

SEQ ID NO: 1717929 - RNA, 15 nt, Homo sapiens
agacagaauguaucu

SEQ ID NO: 1717930 - RNA, 20 nt, Homo sapiens
agacagauccccguuccuga

SEQ ID NO: 1717931 - RNA, 23 nt, Homo sapiens
agacagcaggcagcgccaagugc

SEQ ID NO: 1717932 - RNA, 17 nt, Homo sapiens
agacagcugcuggguca

SEQ ID NO: 1717933 - RNA, 20 nt, Homo sapiens
agacaggaugguuacucuug

SEQ ID NO: 1717934 - RNA, 19 nt, Homo sapiens
agacaggguuucacugugu

SEQ ID NO: 1717935 - RNA, 18 nt, Homo sapiens
agacaggguuuugccaug

SEQ ID NO: 1717936 - RNA, 14 nt, Homo sapiens
agacauaacaaaac

SEQ ID NO: 1717937 - RNA, 16 nt, Homo sapiens
agacauacauuucuca

SEQ ID NO: 1717938 - RNA, 19 nt, Homo sapiens
agacauacgaaacacaaac

SEQ ID NO: 1717939 - RNA, 17 nt, Homo sapiens
agacauaggccaugaaa

SEQ ID NO: 1717940 - RNA, 14 nt, Homo sapiens
agacauccauguuu

SEQ ID NO: 1717941 - RNA, 21 nt, Homo sapiens
agacaugauuuccuugaaugu

SEQ ID NO: 1717942 - RNA, 14 nt, Homo sapiens
agacauucuuccaa

SEQ ID NO: 1717943 - RNA, 16 nt, Homo sapiens
agaccaucaguucuuu

SEQ ID NO: 1717944 - RNA, 15 nt, Homo sapiens
agacuacacaggaug

SEQ ID NO: 1717945 - RNA, 13 nt, Homo sapiens
agacuauggagcc

SEQ ID NO: 1717946 - RNA, 19 nt, Homo sapiens
agacuauuaggugcaauuu

SEQ ID NO: 1717947 - RNA, 17 nt, Homo sapiens
agacucaucuuacugua

SEQ ID NO: 1717948 - RNA, 20 nt, Homo sapiens
agacucuacagaggccaugg

SEQ ID NO: 1717949 - RNA, 22 nt, Homo sapiens
agacugacuuguuugucuucca

SEQ ID NO: 1717950 - RNA, 16 nt, Homo sapiens
agagaaaguacuucuc

SEQ ID NO: 1717951 - RNA, 17 nt, Homo sapiens
agagaaauuucucauca

SEQ ID NO: 1717952 - RNA, 19 nt, Homo sapiens
agagaaugcacagauauac

SEQ ID NO: 1717953 - RNA, 17 nt, Homo sapiens
agagacagaauguaucu

SEQ ID NO: 1717954 - RNA, 14 nt, Homo sapiens
agagaccugagucu

SEQ ID NO: 1717955 - RNA, 22 nt, Homo sapiens
agagagaacuuuucgacauauu

SEQ ID NO: 1717956 - RNA, 17 nt, Homo sapiens
agagagauauaucugaa

SEQ ID NO: 1717957 - RNA, 21 nt, Homo sapiens
agagagauuguguucuuccuc

SEQ ID NO: 1717958 - RNA, 19 nt, Homo sapiens
agagagcaacucugagauc

SEQ ID NO: 1717959 - RNA, 14 nt, Homo sapiens
agagaggaugugca

SEQ ID NO: 1717960 - RNA, 16 nt, Homo sapiens
agagagguuuuucuga

SEQ ID NO: 1717961 - RNA, 16 nt, Homo sapiens
agagauaaacuacaua

SEQ ID NO: 1717962 - RNA, 20 nt, Homo sapiens
agagauggggucucacagug

SEQ ID NO: 1717963 - RNA, 14 nt, Homo sapiens
agagcaaccucuca

SEQ ID NO: 1717964 - RNA, 21 nt, Homo sapiens
agagcaacucugagaucuaag

SEQ ID NO: 1717965 - RNA, 18 nt, Homo sapiens
agagcaagacccaucuca

SEQ ID NO: 1717966 - RNA, 15 nt, Homo sapiens
agagcagaugcagag

SEQ ID NO: 1717967 - RNA, 20 nt, Homo sapiens
agagcaggaagcauucagag

SEQ ID NO: 1717968 - RNA, 15 nt, Homo sapiens
agcagcucugugacu

SEQ ID NO: 1717969 - RNA, 21 nt, Homo sapiens
agcagcuuuaaacaaauucau

SEQ ID NO: 1717970 - RNA, 15 nt, Homo sapiens
agcaggaaaccugug

SEQ ID NO: 1717971 - RNA, 19 nt, Homo sapiens
agcaggacuuugaggcaag

SEQ ID NO: 1717972 - RNA, 18 nt, Homo sapiens
agcaggagauuugcuuga

SEQ ID NO: 1717973 - RNA, 18 nt, Homo sapiens
agcagggaguacccagug

SEQ ID NO: 1717974 - RNA, 21 nt, Homo sapiens
agcagugggcuccuggcagaa

SEQ ID NO: 1717975 - RNA, 14 nt, Homo sapiens
agcaguugugucag

SEQ ID NO: 1717976 - RNA, 21 nt, Homo sapiens
agcaguuuaugagacagcuga

SEQ ID NO: 1717977 - RNA, 22 nt, Homo sapiens
agcauauaggugauguuugcuc

SEQ ID NO: 1717978 - RNA, 23 nt, Homo sapiens
agcaucacuccccaaggaagagc

SEQ ID NO: 1717979 - RNA, 15 nt, Homo sapiens
agcaucccccaaagu

SEQ ID NO: 1717980 - RNA, 12 nt, Homo sapiens
agcaucucagga

SEQ ID NO: 1717981 - RNA, 17 nt, Homo sapiens
agcaugaggacagacca

SEQ ID NO: 1717982 - RNA, 22 nt, Homo sapiens
agcaugauaggauuuggggcag

SEQ ID NO: 1717983 - RNA, 17 nt, Homo sapiens
agcauggccccagucca

SEQ ID NO: 1717984 - RNA, 12 nt, Homo sapiens
agcauguuucau

SEQ ID NO: 1717985 - RNA, 17 nt, Homo sapiens
agcauguuuuguauaca

SEQ ID NO: 1717986 - RNA, 14 nt, Homo sapiens
agcauugcuuucgu

SEQ ID NO: 1717987 - RNA, 18 nt, Homo sapiens
agcauuuccaacaccaca

SEQ ID NO: 1717988 - RNA, 16 nt, Homo sapiens
agccaaauaaaaucua

SEQ ID NO: 1717989 - RNA, 20 nt, Homo sapiens
agccaacacccugucuaaaa

SEQ ID NO: 1717990 - RNA, 12 nt, Homo sapiens
agccaaccucau

SEQ ID NO: 1717991 - RNA, 23 nt, Homo sapiens
agccaacuuuugcauguuuugua

SEQ ID NO: 1717992 - RNA, 15 nt, Homo sapiens
agccaauguguggcu

SEQ ID NO: 1717993 - RNA, 14 nt, Homo sapiens
agccagcacuugua

SEQ ID NO: 1717994 - RNA, 12 nt, Homo sapiens
agccagccugac

SEQ ID NO: 1717995 - RNA, 15 nt, Homo sapiens
agccagcugcagcug

SEQ ID NO: 1717996 - RNA, 21 nt, Homo sapiens
agccaggguggucuugaucuc

SEQ ID NO: 1717997 - RNA, 19 nt, Homo sapiens
agccauauuugauaguaua

SEQ ID NO: 1717998 - RNA, 15 nt, Homo sapiens
agccauuuugugaau

SEQ ID NO: 1717999 - RNA, 18 nt, Homo sapiens
agcccacccugcugccuu

SEQ ID NO: 1718000 - RNA, 23 nt, Homo sapiens
agcccacccugcugccuucugac

SEQ ID NO: 1718001 - RNA, 20 nt, Homo sapiens
agcccacuguuaauauucua

SEQ ID NO: 1718002 - RNA, 16 nt, Homo sapiens
agcccauagccagcug

SEQ ID NO: 1718003 - RNA, 13 nt, Homo sapiens
aaaaaaacuucau

SEQ ID NO: 1718004 - RNA, 18 nt, Homo sapiens
aaaaaccaauagcuuuaa

SEQ ID NO: 1718005 - RNA, 20 nt, Homo sapiens
aaaaagucuacauacuuuca

SEQ ID NO: 1718006 - RNA, 15 nt, Homo sapiens
aaaaauagacacucc

SEQ ID NO: 1718007 - RNA, 16 nt, Homo sapiens
aaaaauagcaaugccu

SEQ ID NO: 1718008 - RNA, 22 nt, Homo sapiens
aaaaauauaaaguacaucucua

SEQ ID NO: 1718009 - RNA, 20 nt, Homo sapiens
aaaaauauauauagugcuau

SEQ ID NO: 1718010 - RNA, 14 nt, Homo sapiens
aaaaauauguacaa

SEQ ID NO: 1718011 - RNA, 16 nt, Homo sapiens
aaaaauauuugcugag

SEQ ID NO: 1718012 - RNA, 20 nt, Homo sapiens
aaaaauauuugcugagugaa

SEQ ID NO: 1718013 - RNA, 19 nt, Homo sapiens
aaaaauuauacuaacuuau

SEQ ID NO: 1718014 - RNA, 15 nt, Homo sapiens
aaaaauuuuuccuga

SEQ ID NO: 1718015 - RNA, 17 nt, Homo sapiens
aaaaauuuuuuuccuga

SEQ ID NO: 1718016 - RNA, 16 nt, Homo sapiens
aaaacaaaacaaaaca

SEQ ID NO: 1718017 - RNA, 22 nt, Homo sapiens
aaaacaacagcucgauccaaau

SEQ ID NO: 1718018 - RNA, 15 nt, Homo sapiens
aaaacacaucuuucc

SEQ ID NO: 1718019 - RNA, 23 nt, Homo sapiens
aaaacacauggggaaaaaaauca

SEQ ID NO: 1718020 - RNA, 11 nt, Homo sapiens
aaaacacugcc

SEQ ID NO: 1718021 - RNA, 12 nt, Homo sapiens
aaaacacugugg

SEQ ID NO: 1718022 - RNA, 15 nt, Homo sapiens
aaaacaggucuucau

SEQ ID NO: 1718023 - RNA, 11 nt, Homo sapiens
aaaacauaucu

SEQ ID NO: 1718024 - RNA, 13 nt, Homo sapiens
aaaacauuuuacu

SEQ ID NO: 1718025 - RNA, 23 nt, Homo sapiens
aaaacauuuuacuuuaaaaggag

SEQ ID NO: 1718026 - RNA, 20 nt, Homo sapiens
aaaaccccaucuuuacuaaa

SEQ ID NO: 1718027 - RNA, 18 nt, Homo sapiens
aaaaccuuucaaauuuca

SEQ ID NO: 1718028 - RNA, 20 nt, Homo sapiens
aaaacugauuuuuagcuuua

SEQ ID NO: 1718029 - RNA, 15 nt, Homo sapiens
aaaacuucuugucag

SEQ ID NO: 1718030 - RNA, 22 nt, Homo sapiens
aaaagaagaccguuuaccuaga

SEQ ID NO: 1718031 - RNA, 15 nt, Homo sapiens
aaaagacauguugua

SEQ ID NO: 1718032 - RNA, 16 nt, Homo sapiens
aaaagacauucuucca

SEQ ID NO: 1718033 - RNA, 18 nt, Homo sapiens
aaaagauuuucagaaaau

SEQ ID NO: 1718034 - RNA, 14 nt, Homo sapiens
aaaagccacauaga

SEQ ID NO: 1718035 - RNA, 16 nt, Homo sapiens
aaaagcccuuugcuaa

SEQ ID NO: 1718036 - RNA, 14 nt, Homo sapiens
aaaagccuugugua

SEQ ID NO: 1718037 - RNA, 22 nt, Homo sapiens
aaaagcuauuagccaggaucau

SEQ ID NO: 1718038 - RNA, 18 nt, Homo sapiens
aaaagggaaguugugccu

SEQ ID NO: 1718039 - RNA, 19 nt, Homo sapiens
aaaagggcugacauuuucu

SEQ ID NO: 1718040 - RNA, 22 nt, Homo sapiens
aaaagguagcuuaccugacaca

SEQ ID NO: 1718041 - RNA, 24 nt, Homo sapiens
aaaagguauuuugaauaccauuaa

SEQ ID NO: 1718042 - RNA, 20 nt, Homo sapiens
aaaagguuaaauauugucau

SEQ ID NO: 1718043 - RNA, 13 nt, Homo sapiens
aaaaguacauauu

SEQ ID NO: 1718044 - RNA, 19 nt, Homo sapiens
aaaaguccuugauuuagca

SEQ ID NO: 1718045 - RNA, 13 nt, Homo sapiens
aaaaguggggcag

SEQ ID NO: 1718046 - RNA, 15 nt, Homo sapiens
aaaaguuaugguacu

SEQ ID NO: 1718047 - RNA, 12 nt, Homo sapiens
aaaauaauucua

SEQ ID NO: 1718048 - RNA, 17 nt, Homo sapiens
aaaauacauaucgcuga

SEQ ID NO: 1718049 - RNA, 10 nt, Homo sapiens
aaaauaugcc

SEQ ID NO: 1718050 - RNA, 13 nt, Homo sapiens
aaaauauugcuuc

SEQ ID NO: 1718051 - RNA, 14 nt, Homo sapiens
aaaaucgaaugcug

SEQ ID NO: 1718052 - RNA, 16 nt, Homo sapiens
aaaaucuguguaacug

SEQ ID NO: 1718053 - RNA, 16 nt, Homo sapiens
aaaaucuuggaaguac

SEQ ID NO: 1718054 - RNA, 19 nt, Homo sapiens
aaaaugaaaaacaaccaag

SEQ ID NO: 1718055 - RNA, 14 nt, Homo sapiens
aaaaugaauaucua

SEQ ID NO: 1718056 - RNA, 15 nt, Homo sapiens
aaaaugccuuugaga

SEQ ID NO: 1718057 - RNA, 16 nt, Homo sapiens
aaaauggccauuugcu

SEQ ID NO: 1718058 - RNA, 16 nt, Homo sapiens
aaaauguccugccuuu

SEQ ID NO: 1718059 - RNA, 23 nt, Homo sapiens
aaaaugucuaagauaguaacaau

SEQ ID NO: 1718060 - RNA, 18 nt, Homo sapiens
aaaauguguccuaucuau

SEQ ID NO: 1718061 - RNA, 16 nt, Homo sapiens
aaaaugugucuguaag

SEQ ID NO: 1718062 - RNA, 16 nt, Homo sapiens
aaaauguuuucuucau

SEQ ID NO: 1718063 - RNA, 23 nt, Homo sapiens
aaaauguuuucuucaucugugac

SEQ ID NO: 1718064 - RNA, 17 nt, Homo sapiens
aaaauuaucaauaucua

SEQ ID NO: 1718065 - RNA, 19 nt, Homo sapiens
aaaauucauuucacauuaa

SEQ ID NO: 1718066 - RNA, 18 nt, Homo sapiens
aaaauuccucuuacugua

SEQ ID NO: 1718067 - RNA, 18 nt, Homo sapiens
aaaauucucauuacucuu

SEQ ID NO: 1718068 - RNA, 17 nt, Homo sapiens
aaaauugcuauguuacu

SEQ ID NO: 1718069 - RNA, 16 nt, Homo sapiens
aaaauuugagacuauu

SEQ ID NO: 1718070 - RNA, 22 nt, Homo sapiens
aaaauuuuuuuuguaacuggag

SEQ ID NO: 1718071 - RNA, 20 nt, Homo sapiens
aaacaacagcucgauccaaa

SEQ ID NO: 1718072 - RNA, 15 nt, Homo sapiens
aaacacaaaccacaa

SEQ ID NO: 1718073 - RNA, 20 nt, Homo sapiens
aaacacauguuuuuauacaa

SEQ ID NO: 1718074 - RNA, 17 nt, Homo sapiens
aaacaccaaaaagggau

SEQ ID NO: 1718075 - RNA, 22 nt, Homo sapiens
aaacacccacauaccuggccca

SEQ ID NO: 1718076 - RNA, 17 nt, Homo sapiens
aaacacgaaacuuguua

SEQ ID NO: 1718077 - RNA, 19 nt, Homo sapiens
aaacacugggggcaccuua

SEQ ID NO: 1718078 - RNA, 20 nt, Homo sapiens
aaacagaaagcauccuaaau

SEQ ID NO: 1718079 - RNA, 16 nt, Homo sapiens
aaacagaugaugagaa

SEQ ID NO: 1718080 - RNA, 13 nt, Homo sapiens
aaacagggcaaag

SEQ ID NO: 1718081 - RNA, 17 nt, Homo sapiens
aaacauagcaucucagg

SEQ ID NO: 1718082 - RNA, 17 nt, Homo sapiens
aaacaugauuguuuaca

SEQ ID NO: 1718083 - RNA, 19 nt, Homo sapiens
aaacauuaaaugucuuaua

SEQ ID NO: 1718084 - RNA, 18 nt, Homo sapiens
aaacauucugauuuggaa

SEQ ID NO: 1718085 - RNA, 23 nt, Homo sapiens
aaacauugauuauaagcauguau

SEQ ID NO: 1718086 - RNA, 19 nt, Homo sapiens
aaaccaagccguggcuucc

SEQ ID NO: 1718087 - RNA, 15 nt, Homo sapiens
aaacccacaaaaaug

SEQ ID NO: 1718088 - RNA, 21 nt, Homo sapiens
aaaccccccagagcucuuuac

SEQ ID NO: 1718089 - RNA, 18 nt, Homo sapiens
aaaccccuucuuuacuuc

SEQ ID NO: 1718090 - RNA, 15 nt, Homo sapiens
aaaccuaacuugcgc

SEQ ID NO: 1718091 - RNA, 18 nt, Homo sapiens
aaaccucaaguaaacucc

SEQ ID NO: 1718092 - RNA, 17 nt, Homo sapiens
aaaccucuacauauuua

SEQ ID NO: 1718093 - RNA, 13 nt, Homo sapiens
aaaccuucaguga

SEQ ID NO: 1718094 - RNA, 13 nt, Homo sapiens
aaacucaagacaa

SEQ ID NO: 1718095 - RNA, 18 nt, Homo sapiens
aaacucaagacaaugcac

SEQ ID NO: 1718096 - RNA, 19 nt, Homo sapiens
aaacucacaagugcucauc

SEQ ID NO: 1718097 - RNA, 20 nt, Homo sapiens
aaacucacagaacuauguac

SEQ ID NO: 1718098 - RNA, 17 nt, Homo sapiens
aaacugaaaaucuaaua

SEQ ID NO: 1718099 - RNA, 19 nt, Homo sapiens
aaacugauuuuuagcuuua

SEQ ID NO: 1718100 - RNA, 18 nt, Homo sapiens
aaacugucuuuaaaagag

SEQ ID NO: 1718101 - RNA, 15 nt, Homo sapiens
aaacuguuacugaaa

SEQ ID NO: 1718102 - RNA, 14 nt, Homo sapiens
uugggcaacagagc

SEQ ID NO: 1718103 - RNA, 16 nt, Homo sapiens
uugggcuggugucacc

SEQ ID NO: 1718104 - RNA, 22 nt, Homo sapiens
uuggggaggacaaaacuucuug

SEQ ID NO: 1718105 - RNA, 13 nt, Homo sapiens
uugggucuuugaa

SEQ ID NO: 1718106 - RNA, 22 nt, Homo sapiens
uugguguauguaugaguaucug

SEQ ID NO: 1718107 - RNA, 17 nt, Homo sapiens
uuguaaagaaauuuacu

SEQ ID NO: 1718108 - RNA, 20 nt, Homo sapiens
uuguaacgaagacacagacu

SEQ ID NO: 1718109 - RNA, 15 nt, Homo sapiens
uuguaauuccuuacu

SEQ ID NO: 1718110 - RNA, 22 nt, Homo sapiens
uuguacaggaacugcauugacu

SEQ ID NO: 1718111 - RNA, 19 nt, Homo sapiens
uuguacauauuuguggaau

SEQ ID NO: 1718112 - RNA, 20 nt, Homo sapiens
uuguacuccagccugggcaa

SEQ ID NO: 1718113 - RNA, 21 nt, Homo sapiens
uuguagagauggggucucaca

SEQ ID NO: 1718114 - RNA, 15 nt, Homo sapiens
uuguaugagguuuga

SEQ ID NO: 1718115 - RNA, 15 nt, Homo sapiens
uuguauguaucuauu

SEQ ID NO: 1718116 - RNA, 19 nt, Homo sapiens
uuguauuuuauuguuucuu

SEQ ID NO: 1718117 - RNA, 19 nt, Homo sapiens
uugucagaaaccugcaggg

SEQ ID NO: 1718118 - RNA, 17 nt, Homo sapiens
uugucagcaauuuaacu

SEQ ID NO: 1718119 - RNA, 18 nt, Homo sapiens
uugucuaaacaaugcuga

SEQ ID NO: 1718120 - RNA, 19 nt, Homo sapiens
uugucuccuacuccugacu

SEQ ID NO: 1718121 - RNA, 20 nt, Homo sapiens
uugucuguuuguuucaagaa

SEQ ID NO: 1718122 - RNA, 22 nt, Homo sapiens
uugucuuuaaauagauacaaau

SEQ ID NO: 1718123 - RNA, 20 nt, Homo sapiens
uugugaugucuuuucuuggc

SEQ ID NO: 1718124 - RNA, 21 nt, Homo sapiens
uugugcuccuucggauaugau

SEQ ID NO: 1718125 - RNA, 21 nt, Homo sapiens
uuguguaauauauuguacacu

SEQ ID NO: 1718126 - RNA, 21 nt, Homo sapiens
uuguguaaugaaaaugaauau

SEQ ID NO: 1718127 - RNA, 17 nt, Homo sapiens
uuguguagaaagccaaa

SEQ ID NO: 1718128 - RNA, 15 nt, Homo sapiens
uugugucuguacacg

SEQ ID NO: 1718129 - RNA, 16 nt, Homo sapiens
uugugugaaaauguga

SEQ ID NO: 1718130 - RNA, 22 nt, Homo sapiens
uugugugcucauguaugugcga

SEQ ID NO: 1718131 - RNA, 20 nt, Homo sapiens
uuguguguuccaaguuucca

SEQ ID NO: 1718132 - RNA, 13 nt, Homo sapiens
uuguuagcacuag

SEQ ID NO: 1718133 - RNA, 12 nt, Homo sapiens
uuguuaugcuau

SEQ ID NO: 1718134 - RNA, 13 nt, Homo sapiens
uuguuaugcuauu

SEQ ID NO: 1718135 - RNA, 13 nt, Homo sapiens
uuguuauuuugga

SEQ ID NO: 1718136 - RNA, 19 nt, Homo sapiens
uuguucauccuauuguuga

SEQ ID NO: 1718137 - RNA, 21 nt, Homo sapiens
uuguuucaaaugaaacuuuaa

SEQ ID NO: 1718138 - RNA, 20 nt, Homo sapiens
uuuaaaaaaaaaaguuacag

SEQ ID NO: 1718139 - RNA, 16 nt, Homo sapiens
uuuaaaaaaaagcaua

SEQ ID NO: 1718140 - RNA, 15 nt, Homo sapiens
uuuaaaagcaucuca

SEQ ID NO: 1718141 - RNA, 13 nt, Homo sapiens
uuuaaaaugcaua

SEQ ID NO: 1718142 - RNA, 15 nt, Homo sapiens
uuuaaaauucaauua

SEQ ID NO: 1718143 - RNA, 22 nt, Homo sapiens
uuuaaacucaagacaaugcacc

SEQ ID NO: 1718144 - RNA, 15 nt, Homo sapiens
uuuaaacucagggac

SEQ ID NO: 1718145 - RNA, 12 nt, Homo sapiens
uuuaaacugcau

SEQ ID NO: 1718146 - RNA, 16 nt, Homo sapiens
uuuaaagacucaaggu

SEQ ID NO: 1718147 - RNA, 19 nt, Homo sapiens
uuuaaagaugaacucugaa

SEQ ID NO: 1718148 - RNA, 14 nt, Homo sapiens
uuuaaagccuccuc

SEQ ID NO: 1718149 - RNA, 18 nt, Homo sapiens
uuuaaaguggcaaucuca

SEQ ID NO: 1718150 - RNA, 18 nt, Homo sapiens
uuuaaauggcuacuuugg

SEQ ID NO: 1718151 - RNA, 19 nt, Homo sapiens
uuuaagaaaaguauuuuga

SEQ ID NO: 1718152 - RNA, 14 nt, Homo sapiens
uuuaagcuaccaau

SEQ ID NO: 1718153 - RNA, 14 nt, Homo sapiens
uuuaagguaacaaa

SEQ ID NO: 1718154 - RNA, 18 nt, Homo sapiens
uuuaagugcguguguaga

SEQ ID NO: 1718155 - RNA, 12 nt, Homo sapiens
uuuaauccuuaa

SEQ ID NO: 1718156 - RNA, 21 nt, Homo sapiens
uuuaauccuuaacacauucaa

SEQ ID NO: 1718157 - RNA, 16 nt, Homo sapiens
uuuaaugauaaguaaa

SEQ ID NO: 1718158 - RNA, 15 nt, Homo sapiens
uuuaauggcauguca

SEQ ID NO: 1718159 - RNA, 15 nt, Homo sapiens
uuuaauuuagugauc

SEQ ID NO: 1718160 - RNA, 17 nt, Homo sapiens
uuuaauuuguuaucuca

SEQ ID NO: 1718161 - RNA, 21 nt, Homo sapiens
uuuacaagaaguuuauucuca

SEQ ID NO: 1718162 - RNA, 17 nt, Homo sapiens
uuuacaaguguauauca

SEQ ID NO: 1718163 - RNA, 23 nt, Homo sapiens
uuuacaauaaaacuuugcugcca

SEQ ID NO: 1718164 - RNA, 17 nt, Homo sapiens
uuuacagcaaguagaua

SEQ ID NO: 1718165 - RNA, 13 nt, Homo sapiens
uuuacaugugauu

SEQ ID NO: 1718166 - RNA, 10 nt, Homo sapiens
uuuacauuca

SEQ ID NO: 1718167 - RNA, 14 nt, Homo sapiens
uuuacauucugcaa

SEQ ID NO: 1718168 - RNA, 13 nt, Homo sapiens
uuuacuaccuuau

SEQ ID NO: 1718169 - RNA, 18 nt, Homo sapiens
uuuagaacuugcagcuga

SEQ ID NO: 1718170 - RNA, 20 nt, Homo sapiens
uuuagcaauuuauacaauau

SEQ ID NO: 1718171 - RNA, 16 nt, Homo sapiens
uuuauaaaauuuugcu

SEQ ID NO: 1718172 - RNA, 22 nt, Homo sapiens
uuuauaccagcuuaugagcuca

SEQ ID NO: 1718173 - RNA, 19 nt, Homo sapiens
uuuauacuccaguguacau

SEQ ID NO: 1718174 - RNA, 13 nt, Homo sapiens
uuuauggccucag

SEQ ID NO: 1718175 - RNA, 21 nt, Homo sapiens
uuuaugguccuaaaagcaaaa

SEQ ID NO: 1718176 - RNA, 18 nt, Homo sapiens
uuuauuauaugauuauca

SEQ ID NO: 1718177 - RNA, 19 nt, Homo sapiens
uuuauucauuagcugugau

SEQ ID NO: 1718178 - RNA, 19 nt, Homo sapiens
uuucaaagauguguugcua

SEQ ID NO: 1718179 - RNA, 13 nt, Homo sapiens
uuucaaagcuaaa

SEQ ID NO: 1718180 - RNA, 20 nt, Homo sapiens
uuucaaauuuuuacugagaa

SEQ ID NO: 1718181 - RNA, 13 nt, Homo sapiens
uuucaacuugcau

SEQ ID NO: 1718182 - RNA, 17 nt, Homo sapiens
uuucaccacaugugcac

SEQ ID NO: 1718183 - RNA, 14 nt, Homo sapiens
uuucauucauccca

SEQ ID NO: 1718184 - RNA, 23 nt, Homo sapiens
uuccuuuaaagaugaacucugaa

SEQ ID NO: 1718185 - RNA, 20 nt, Homo sapiens
uucgcgugcccucgcugcuu

SEQ ID NO: 1718186 - RNA, 17 nt, Homo sapiens
uucuaaagcucugacau

SEQ ID NO: 1718187 - RNA, 17 nt, Homo sapiens
uucuaaaguucuaagau

SEQ ID NO: 1718188 - RNA, 22 nt, Homo sapiens
uucuaaggaccugaaauuccaa

SEQ ID NO: 1718189 - RNA, 17 nt, Homo sapiens
uucuaaggcucugagag

SEQ ID NO: 1718190 - RNA, 21 nt, Homo sapiens
uucuaaggcucugagagucua

SEQ ID NO: 1718191 - RNA, 23 nt, Homo sapiens
uucuaagguccgguguucuaaga

SEQ ID NO: 1718192 - RNA, 18 nt, Homo sapiens
uucuaaugcugauaugau

SEQ ID NO: 1718193 - RNA, 21 nt, Homo sapiens
uucuaauggcacuuaucauua

SEQ ID NO: 1718194 - RNA, 19 nt, Homo sapiens
uucuaauuucaaaaauaua

SEQ ID NO: 1718195 - RNA, 17 nt, Homo sapiens
uucuaauuuuuaagcaa

SEQ ID NO: 1718196 - RNA, 22 nt, Homo sapiens
uucuacaauuucaauuucuccc

SEQ ID NO: 1718197 - RNA, 15 nt, Homo sapiens
uucuaccauuugaau

SEQ ID NO: 1718198 - RNA, 17 nt, Homo sapiens
uucuagguaggggccca

SEQ ID NO: 1718199 - RNA, 22 nt, Homo sapiens
uucuauaacagauauggcagcu

SEQ ID NO: 1718200 - RNA, 23 nt, Homo sapiens
uucuaugcuguuuguagugaaau

SEQ ID NO: 1718201 - RNA, 22 nt, Homo sapiens
uucuaugguuaugaaagaauau

SEQ ID NO: 1718202 - RNA, 24 nt, Homo sapiens
uucuauguacuaguacuguguacu

SEQ ID NO: 1718203 - RNA, 14 nt, Homo sapiens
uucucaaaauuccu

SEQ ID NO: 1718204 - RNA, 15 nt, Homo sapiens
uucucaaguucuaag

SEQ ID NO: 1718205 - RNA, 16 nt, Homo sapiens
uucucaccauuugagu

SEQ ID NO: 1718206 - RNA, 20 nt, Homo sapiens
uucucacuccuaccugguaa

SEQ ID NO: 1718207 - RNA, 22 nt, Homo sapiens
uucucagaccugcgcacuccau

SEQ ID NO: 1718208 - RNA, 23 nt, Homo sapiens
uucucauaauuccuacagcacua

SEQ ID NO: 1718209 - RNA, 21 nt, Homo sapiens
uucuccaccuagacuguaaac

SEQ ID NO: 1718210 - RNA, 11 nt, Homo sapiens
uucuccacugg

SEQ ID NO: 1718211 - RNA, 19 nt, Homo sapiens
uucuccaucccucuaauga

SEQ ID NO: 1718212 - RNA, 21 nt, Homo sapiens
uucuccaucccucuaaugaga

SEQ ID NO: 1718213 - RNA, 17 nt, Homo sapiens
uucucccgugagccagg

SEQ ID NO: 1718214 - RNA, 22 nt, Homo sapiens
uucuccuguuggcucacagggc

SEQ ID NO: 1718215 - RNA, 14 nt, Homo sapiens
uucucugaaggaca

SEQ ID NO: 1718216 - RNA, 21 nt, Homo sapiens
uucucugugucuaagauucua

SEQ ID NO: 1718217 - RNA, 19 nt, Homo sapiens
uucugaaugugcugaucau

SEQ ID NO: 1718218 - RNA, 18 nt, Homo sapiens
uucugagggaaagugcau

SEQ ID NO: 1718219 - RNA, 22 nt, Homo sapiens
uucugcaacaucuuaagaucca

SEQ ID NO: 1718220 - RNA, 14 nt, Homo sapiens
uucugcacugaaaa

SEQ ID NO: 1718221 - RNA, 17 nt, Homo sapiens
uucugcauauguugaau

SEQ ID NO: 1718222 - RNA, 18 nt, Homo sapiens
uucugccucuuaagccug

SEQ ID NO: 1718223 - RNA, 17 nt, Homo sapiens
uucugccuucucaggaa

SEQ ID NO: 1718224 - RNA, 13 nt, Homo sapiens
uucugcucacaua

SEQ ID NO: 1718225 - RNA, 17 nt, Homo sapiens
uucuguaugaacuuuau

SEQ ID NO: 1718226 - RNA, 13 nt, Homo sapiens
uucugucuuccua

SEQ ID NO: 1718227 - RNA, 21 nt, Homo sapiens
uucuguggaccacugcaugag

SEQ ID NO: 1718228 - RNA, 14 nt, Homo sapiens
uucuguuuggugug

SEQ ID NO: 1718229 - RNA, 15 nt, Homo sapiens
uucuuaaagugcagu

SEQ ID NO: 1718230 - RNA, 21 nt, Homo sapiens
uucuuaaggaagaagaguauu

SEQ ID NO: 1718231 - RNA, 23 nt, Homo sapiens
uucuuacuugacuugaaugugca

SEQ ID NO: 1718232 - RNA, 18 nt, Homo sapiens
uucuuccucucucagggg

SEQ ID NO: 1718233 - RNA, 18 nt, Homo sapiens
uucuugacaaaaccuaac

SEQ ID NO: 1718234 - RNA, 17 nt, Homo sapiens
uucuugcagucaucaga

SEQ ID NO: 1718235 - RNA, 15 nt, Homo sapiens
uucuuggugguggau

SEQ ID NO: 1718236 - RNA, 18 nt, Homo sapiens
uucuuggugguggaugac

SEQ ID NO: 1718237 - RNA, 10 nt, Homo sapiens
uucuugucag

SEQ ID NO: 1718238 - RNA, 15 nt, Homo sapiens
uucuuuacaauuuca

SEQ ID NO: 1718239 - RNA, 16 nt, Homo sapiens
uucuuuccaauagcaa

SEQ ID NO: 1718240 - RNA, 16 nt, Homo sapiens
uucuuugauucuccuu

SEQ ID NO: 1718241 - RNA, 14 nt, Homo sapiens
uucuuugucuuauc

SEQ ID NO: 1718242 - RNA, 13 nt, Homo sapiens
uucuuuugcucuu

SEQ ID NO: 1718243 - RNA, 19 nt, Homo sapiens
uucuuuuguaagugcuaca

SEQ ID NO: 1718244 - RNA, 18 nt, Homo sapiens
uucuuuuguuacuguucu

SEQ ID NO: 1718245 - RNA, 18 nt, Homo sapiens
uucuuuuucguuggugua

SEQ ID NO: 1718246 - RNA, 14 nt, Homo sapiens
uugaaaagcuauua

SEQ ID NO: 1718247 - RNA, 12 nt, Homo sapiens
uugaaaauguuc

SEQ ID NO: 1718248 - RNA, 14 nt, Homo sapiens
uugaaacugaaugu

SEQ ID NO: 1718249 - RNA, 13 nt, Homo sapiens
uugaaagaaccag

SEQ ID NO: 1718250 - RNA, 14 nt, Homo sapiens
uugaaagaaccaga

SEQ ID NO: 1718251 - RNA, 21 nt, Homo sapiens
uugaaaucaaugcaagaguga

SEQ ID NO: 1718252 - RNA, 15 nt, Homo sapiens
uugaaaucugaaugc

SEQ ID NO: 1718253 - RNA, 15 nt, Homo sapiens
uugaacucuguaaaa

SEQ ID NO: 1718254 - RNA, 12 nt, Homo sapiens
uugaagccucag

SEQ ID NO: 1718255 - RNA, 15 nt, Homo sapiens
uugaagucuuguaua

SEQ ID NO: 1718256 - RNA, 11 nt, Homo sapiens
uugaaugauga

SEQ ID NO: 1718257 - RNA, 17 nt, Homo sapiens
uugaaugcugccagugu

SEQ ID NO: 1718258 - RNA, 17 nt, Homo sapiens
uugaauguggucucagg

SEQ ID NO: 1718259 - RNA, 14 nt, Homo sapiens
uugaaugugucagg

SEQ ID NO: 1718260 - RNA, 11 nt, Homo sapiens
uugacaaugac

SEQ ID NO: 1718261 - RNA, 13 nt, Homo sapiens
uugacacucugca

SEQ ID NO: 1718262 - RNA, 16 nt, Homo sapiens
uugaccucucauaaau

SEQ ID NO: 1718263 - RNA, 22 nt, Homo sapiens
uugacuagaugauggaugccaa

SEQ ID NO: 1718264 - RNA, 15 nt, Homo sapiens
uugacuagugcaauu

SEQ ID NO: 1718265 - RNA, 23 nt, Homo sapiens
uugacugucacuguuccuuguca

SEQ ID NO: 1718266 - RNA, 22 nt, Homo sapiens
uugagaagccuucagcuccagg

SEQ ID NO: 1718267 - RNA, 14 nt, Homo sapiens
uugagaaucccaaa

SEQ ID NO: 1718268 - RNA, 18 nt, Homo sapiens
uugagaguugcuggugua

SEQ ID NO: 1718269 - RNA, 18 nt, Homo sapiens
uugagauguaugaaggcu

SEQ ID NO: 1718270 - RNA, 22 nt, Homo sapiens
uugaggagcauguuuuguauac

SEQ ID NO: 1718271 - RNA, 17 nt, Homo sapiens
uugaggauuuugaucca

SEQ ID NO: 1718272 - RNA, 20 nt, Homo sapiens
uugaguagauauuacuuuau

SEQ ID NO: 1718273 - RNA, 17 nt, Homo sapiens
uugauagauuucuacac

SEQ ID NO: 1718274 - RNA, 19 nt, Homo sapiens
uugauagcaaacacugggg

SEQ ID NO: 1718275 - RNA, 17 nt, Homo sapiens
uugaucaaauauuucaa

SEQ ID NO: 1718276 - RNA, 16 nt, Homo sapiens
uugaugaaaagauuua

SEQ ID NO: 1718277 - RNA, 11 nt, Homo sapiens
uugaugccaua

SEQ ID NO: 1718278 - RNA, 18 nt, Homo sapiens
uugauguuuguggccuca

SEQ ID NO: 1718279 - RNA, 15 nt, Homo sapiens
uugauuuacauauau

SEQ ID NO: 1718280 - RNA, 15 nt, Homo sapiens
uugcaaaucaguguu

SEQ ID NO: 1718281 - RNA, 15 nt, Homo sapiens
uugcaagaaucauua

SEQ ID NO: 1718282 - RNA, 23 nt, Homo sapiens
uugcaauuaggauuuugauguga

SEQ ID NO: 1718283 - RNA, 19 nt, Homo sapiens
uugcaauuuuuccaugaag

SEQ ID NO: 1718284 - RNA, 23 nt, Homo sapiens
uugcacagcucuccggucucucu

SEQ ID NO: 1718285 - RNA, 11 nt, Homo sapiens
uugcacaggau

SEQ ID NO: 1718286 - RNA, 21 nt, Homo sapiens
uugcaccaggcacugcugcac

SEQ ID NO: 1718287 - RNA, 14 nt, Homo sapiens
uugcagaacugcca

SEQ ID NO: 1718288 - RNA, 21 nt, Homo sapiens
uugcaugacuuguagcauauu

SEQ ID NO: 1718289 - RNA, 18 nt, Homo sapiens
uugcauggcuccagaaau

SEQ ID NO: 1718290 - RNA, 23 nt, Homo sapiens
uugccaacaccacagaaaugggg

SEQ ID NO: 1718291 - RNA, 16 nt, Homo sapiens
uugccaugugugcuga

SEQ ID NO: 1718292 - RNA, 17 nt, Homo sapiens
uugccaugugugcugaa

SEQ ID NO: 1718293 - RNA, 21 nt, Homo sapiens
uuaucugugucaaaagccaga

SEQ ID NO: 1718294 - RNA, 13 nt, Homo sapiens
uuaucuugggaua

SEQ ID NO: 1718295 - RNA, 23 nt, Homo sapiens
uuaugaaauaaagaaauugcaau

SEQ ID NO: 1718296 - RNA, 14 nt, Homo sapiens
uuaugaaaugaccu

SEQ ID NO: 1718297 - RNA, 22 nt, Homo sapiens
uuaugaaaugaccucuguccuc

SEQ ID NO: 1718298 - RNA, 22 nt, Homo sapiens
uuaugaggcaaccugauuguaa

SEQ ID NO: 1718299 - RNA, 15 nt, Homo sapiens
uuaugaugaaaaccu

SEQ ID NO: 1718300 - RNA, 21 nt, Homo sapiens
uuaugcagaauccaaaguaaa

SEQ ID NO: 1718301 - RNA, 19 nt, Homo sapiens
uuaugggaagacaaaacaa

SEQ ID NO: 1718302 - RNA, 18 nt, Homo sapiens
uuauguaguaauugacau

SEQ ID NO: 1718303 - RNA, 23 nt, Homo sapiens
uuauguauuugaaaacucacaga

SEQ ID NO: 1718304 - RNA, 17 nt, Homo sapiens
uuauuacauggggucua

SEQ ID NO: 1718305 - RNA, 21 nt, Homo sapiens
uuauuagguacguaacuauuu

SEQ ID NO: 1718306 - RNA, 12 nt, Homo sapiens
uuauuauauucc

SEQ ID NO: 1718307 - RNA, 13 nt, Homo sapiens
uuauuauuucuau

SEQ ID NO: 1718308 - RNA, 15 nt, Homo sapiens
uuauuccuugaucau

SEQ ID NO: 1718309 - RNA, 15 nt, Homo sapiens
uuauugcgcugcuac

SEQ ID NO: 1718310 - RNA, 17 nt, Homo sapiens
uuauuuaaaugggaaua

SEQ ID NO: 1718311 - RNA, 20 nt, Homo sapiens
uuauuuacaugugauuguga

SEQ ID NO: 1718312 - RNA, 21 nt, Homo sapiens
uuauuucugguaacucacuca

SEQ ID NO: 1718313 - RNA, 17 nt, Homo sapiens
uuauuugcacacugcac

SEQ ID NO: 1718314 - RNA, 21 nt, Homo sapiens
uuauuugcuaaucaaagccag

SEQ ID NO: 1718315 - RNA, 19 nt, Homo sapiens
uucaaaagaugccauucau

SEQ ID NO: 1718316 - RNA, 21 nt, Homo sapiens
uucaaacaauaucauaucauc

SEQ ID NO: 1718317 - RNA, 19 nt, Homo sapiens
uucaaacugcaugauucau

SEQ ID NO: 1718318 - RNA, 18 nt, Homo sapiens
uucaaaguuaaaagcaaa

SEQ ID NO: 1718319 - RNA, 12 nt, Homo sapiens
uucaaaugaauu

SEQ ID NO: 1718320 - RNA, 12 nt, Homo sapiens
uucaaaugggcu

SEQ ID NO: 1718321 - RNA, 17 nt, Homo sapiens
uucaauagcauaucaca

SEQ ID NO: 1718322 - RNA, 19 nt, Homo sapiens
uucaauagcauaucacaga

SEQ ID NO: 1718323 - RNA, 16 nt, Homo sapiens
uucaaucauaauaccu

SEQ ID NO: 1718324 - RNA, 16 nt, Homo sapiens
uguuuuuaaacuaaua

SEQ ID NO: 1718325 - RNA, 20 nt, Homo sapiens
uguuuuuagcugguggcaau

SEQ ID NO: 1718326 - RNA, 22 nt, Homo sapiens
uuaaaaaaucucaaauuuggau

SEQ ID NO: 1718327 - RNA, 20 nt, Homo sapiens
uuaaaaacuagagcacagaa

SEQ ID NO: 1718328 - RNA, 16 nt, Homo sapiens
uuaaaaauagacacuc

SEQ ID NO: 1718329 - RNA, 21 nt, Homo sapiens
uuaaaaaugggaguacugaug

SEQ ID NO: 1718330 - RNA, 19 nt, Homo sapiens
uuaaaacaaaacaaaacaa

SEQ ID NO: 1718331 - RNA, 19 nt, Homo sapiens
uuaaaagugacauuugucu

SEQ ID NO: 1718332 - RNA, 12 nt, Homo sapiens
uuaaaaugauug

SEQ ID NO: 1718333 - RNA, 23 nt, Homo sapiens
uuaaacaaacauuguguugacau

SEQ ID NO: 1718334 - RNA, 14 nt, Homo sapiens
uuaaacaccuccuc

SEQ ID NO: 1718335 - RNA, 14 nt, Homo sapiens
uuaaacccacagcc

SEQ ID NO: 1718336 - RNA, 18 nt, Homo sapiens
uuaaacccacagccaaac

SEQ ID NO: 1718337 - RNA, 22 nt, Homo sapiens
uuaaacgguaacauccaaaagc

SEQ ID NO: 1718338 - RNA, 19 nt, Homo sapiens
uuaaacucaagacaaugca

SEQ ID NO: 1718339 - RNA, 20 nt, Homo sapiens
uuaaagaaagucgaauuaau

SEQ ID NO: 1718340 - RNA, 17 nt, Homo sapiens
uuaaagacucaaggugg

SEQ ID NO: 1718341 - RNA, 13 nt, Homo sapiens
uuaaagagucuag

SEQ ID NO: 1718342 - RNA, 16 nt, Homo sapiens
uuaaagaucaugacau

SEQ ID NO: 1718343 - RNA, 19 nt, Homo sapiens
uuaaagcuuauccauaaaa

SEQ ID NO: 1718344 - RNA, 20 nt, Homo sapiens
uuaaaggaacagagugagag

SEQ ID NO: 1718345 - RNA, 15 nt, Homo sapiens
uuaaagguucacagg

SEQ ID NO: 1718346 - RNA, 19 nt, Homo sapiens
uuaaaguaaugagcaugau

SEQ ID NO: 1718347 - RNA, 20 nt, Homo sapiens
uuaaagugcaguucuuagcc

SEQ ID NO: 1718348 - RNA, 17 nt, Homo sapiens
uuaaaguggcaaucuca

SEQ ID NO: 1718349 - RNA, 16 nt, Homo sapiens
uuaaaucaaaagggag

SEQ ID NO: 1718350 - RNA, 13 nt, Homo sapiens
uuaaaucaagucc

SEQ ID NO: 1718351 - RNA, 11 nt, Homo sapiens
uuaaauucuga

SEQ ID NO: 1718352 - RNA, 16 nt, Homo sapiens
uuaaauuguaaaugaa

SEQ ID NO: 1718353 - RNA, 18 nt, Homo sapiens
uuaacaaccgacacuccu

SEQ ID NO: 1718354 - RNA, 14 nt, Homo sapiens
uuaacauuugccuu

SEQ ID NO: 1718355 - RNA, 15 nt, Homo sapiens
ugggaggucuugcua

SEQ ID NO: 1718356 - RNA, 20 nt, Homo sapiens
ugggauuaugccaaggccgu

SEQ ID NO: 1718357 - RNA, 18 nt, Homo sapiens
ugggcaacagagcaagac

SEQ ID NO: 1718358 - RNA, 18 nt, Homo sapiens
ugggcaacagagcaagau

SEQ ID NO: 1718359 - RNA, 22 nt, Homo sapiens
ugggcaacccccaggucugcag

SEQ ID NO: 1718360 - RNA, 22 nt, Homo sapiens
ugggcacucccuugguggcaag

SEQ ID NO: 1718361 - RNA, 20 nt, Homo sapiens
ugggcauugacaaaucugug

SEQ ID NO: 1718362 - RNA, 19 nt, Homo sapiens
ugggcauuuuucuuacuuu

SEQ ID NO: 1718363 - RNA, 14 nt, Homo sapiens
ugggccauguccaa

SEQ ID NO: 1718364 - RNA, 16 nt, Homo sapiens
ugggccgcacuggggc

SEQ ID NO: 1718365 - RNA, 20 nt, Homo sapiens
ugggccucugcuucucucac

SEQ ID NO: 1718366 - RNA, 19 nt, Homo sapiens
ugggcuggugucaccugaa

SEQ ID NO: 1718367 - RNA, 15 nt, Homo sapiens
ugggcuucaguaagu

SEQ ID NO: 1718368 - RNA, 14 nt, Homo sapiens
ugggcuugauucug

SEQ ID NO: 1718369 - RNA, 15 nt, Homo sapiens
ugggcuuuggagcug

SEQ ID NO: 1718370 - RNA, 23 nt, Homo sapiens
uggggaacugcguggugcucuuu

SEQ ID NO: 1718371 - RNA, 19 nt, Homo sapiens
uggggaagaguggucuuga

SEQ ID NO: 1718372 - RNA, 16 nt, Homo sapiens
uggggaaggguuugaa

SEQ ID NO: 1718373 - RNA, 22 nt, Homo sapiens
uggggccaccaaagcugcccac

SEQ ID NO: 1718374 - RNA, 16 nt, Homo sapiens
uggggccuguggaaug

SEQ ID NO: 1718375 - RNA, 16 nt, Homo sapiens
ugggggcugugauauu

SEQ ID NO: 1718376 - RNA, 18 nt, Homo sapiens
ugggguacccacugcucu

SEQ ID NO: 1718377 - RNA, 21 nt, Homo sapiens
ugggguacccacugcucuggu

SEQ ID NO: 1718378 - RNA, 22 nt, Homo sapiens
ugggguugaaaauucaaaaagu

SEQ ID NO: 1718379 - RNA, 21 nt, Homo sapiens
uggguacugaaagccuuaggg

SEQ ID NO: 1718380 - RNA, 23 nt, Homo sapiens
uggguacugaaagccuuagggaa

SEQ ID NO: 1718381 - RNA, 18 nt, Homo sapiens
uggguacuuguggacaca

SEQ ID NO: 1718382 - RNA, 23 nt, Homo sapiens
ugggucucauuuagaacuugcag

SEQ ID NO: 1718383 - RNA, 23 nt, Homo sapiens
uggguguagccagguauggcucu

SEQ ID NO: 1718384 - RNA, 13 nt, Homo sapiens
uggguuauuucaa

SEQ ID NO: 1718385 - RNA, 22 nt, Homo sapiens
uggguuccaauccuggcucugu

SEQ ID NO: 1718386 - RNA, 13 nt, Homo sapiens
uggguucugcuac

SEQ ID NO: 1718387 - RNA, 17 nt, Homo sapiens
uggguuguguguuuauu

SEQ ID NO: 1718388 - RNA, 20 nt, Homo sapiens
uggguuuugggucuuugaac

SEQ ID NO: 1718389 - RNA, 23 nt, Homo sapiens
ugguaacacaaauuuucaccugc

SEQ ID NO: 1718390 - RNA, 22 nt, Homo sapiens
ugguaagagacagaauguaucu

SEQ ID NO: 1718391 - RNA, 15 nt, Homo sapiens
ugguaccauggugua

SEQ ID NO: 1718392 - RNA, 15 nt, Homo sapiens
uggucacacacugau

SEQ ID NO: 1718393 - RNA, 12 nt, Homo sapiens
uggucacagggu

SEQ ID NO: 1718394 - RNA, 23 nt, Homo sapiens
uggucacaugaugugcauagaga

SEQ ID NO: 1718395 - RNA, 23 nt, Homo sapiens
uggucaguaaauaacaggcauuu

SEQ ID NO: 1718396 - RNA, 19 nt, Homo sapiens
ugguccuggggaccauuca

SEQ ID NO: 1718397 - RNA, 19 nt, Homo sapiens
uggugaaaaccccaucucu

SEQ ID NO: 1718398 - RNA, 20 nt, Homo sapiens
uggugaaaaccccaucucua

SEQ ID NO: 1718399 - RNA, 14 nt, Homo sapiens
uggugaaugacacg

SEQ ID NO: 1718400 - RNA, 14 nt, Homo sapiens
uggugacaguccaa

SEQ ID NO: 1718401 - RNA, 19 nt, Homo sapiens
uggugagaaauuucuguga

SEQ ID NO: 1718402 - RNA, 14 nt, Homo sapiens
uggugcucuuugcu

SEQ ID NO: 1718403 - RNA, 22 nt, Homo sapiens
uggugcucuuugcugcacuauu

SEQ ID NO: 1718404 - RNA, 23 nt, Homo sapiens
ugguggaguggagugagagcaau

SEQ ID NO: 1718405 - RNA, 17 nt, Homo sapiens
ugguggcacacaccagu

SEQ ID NO: 1718406 - RNA, 15 nt, Homo sapiens
ugguguaauuuauaa

SEQ ID NO: 1718407 - RNA, 21 nt, Homo sapiens
ugguguggccagcacucugaa

SEQ ID NO: 1718408 - RNA, 20 nt, Homo sapiens
ugguuaucuaauauguaaca

SEQ ID NO: 1718409 - RNA, 19 nt, Homo sapiens
ugguucacauccuaccccu

SEQ ID NO: 1718410 - RNA, 20 nt, Homo sapiens
ugguuuauugaaugugauuu

SEQ ID NO: 1718411 - RNA, 19 nt, Homo sapiens
uguaaaaagaaaaaccacu

SEQ ID NO: 1718412 - RNA, 12 nt, Homo sapiens
uguaaacugcca

SEQ ID NO: 1718413 - RNA, 13 nt, Homo sapiens
uguaaacugccau

SEQ ID NO: 1718414 - RNA, 11 nt, Homo sapiens
uguaaacugga

SEQ ID NO: 1718415 - RNA, 13 nt, Homo sapiens
uguaaagugccuu

SEQ ID NO: 1718416 - RNA, 20 nt, Homo sapiens
uguaaauaccagacugcagg

SEQ ID NO: 1718417 - RNA, 22 nt, Homo sapiens
uguaaaucauucuacuuuugca

SEQ ID NO: 1718418 - RNA, 23 nt, Homo sapiens
uguaacacagcugagagacuuuu

SEQ ID NO: 1718419 - RNA, 20 nt, Homo sapiens
uguaaccuguugcuguguuu

SEQ ID NO: 1718420 - RNA, 23 nt, Homo sapiens
uguaacguuuucuuucacacaca

SEQ ID NO: 1718421 - RNA, 19 nt, Homo sapiens
uguaacuuauguagauauu

SEQ ID NO: 1718422 - RNA, 22 nt, Homo sapiens
uguaagcaggagagaaauuucu

SEQ ID NO: 1718423 - RNA, 15 nt, Homo sapiens
uguaaggcucuagau

SEQ ID NO: 1718424 - RNA, 17 nt, Homo sapiens
uguaauaauucuaugca

SEQ ID NO: 1718425 - RNA, 14 nt, Homo sapiens
uguaaugcugcaca

SEQ ID NO: 1718426 - RNA, 12 nt, Homo sapiens
uguacaaugaca

SEQ ID NO: 1718427 - RNA, 13 nt, Homo sapiens
uguacacuacagc

SEQ ID NO: 1718428 - RNA, 16 nt, Homo sapiens
uguacauaguguaaug

SEQ ID NO: 1718429 - RNA, 23 nt, Homo sapiens
uguacaucuauuuuggauuguau

SEQ ID NO: 1718430 - RNA, 19 nt, Homo sapiens
uguaccaaaaaauauugcu

SEQ ID NO: 1718431 - RNA, 14 nt, Homo sapiens
uguaccauuugccu

SEQ ID NO: 1718432 - RNA, 18 nt, Homo sapiens
uguacgucugacaggcaa

SEQ ID NO: 1718433 - RNA, 16 nt, Homo sapiens
uguacuaguacugugu

SEQ ID NO: 1718434 - RNA, 15 nt, Homo sapiens
uguagaaugauuuca

SEQ ID NO: 1718435 - RNA, 15 nt, Homo sapiens
uguagacuauuugcu

SEQ ID NO: 1718436 - RNA, 16 nt, Homo sapiens
uguagagcuucuggca

SEQ ID NO: 1718437 - RNA, 16 nt, Homo sapiens
uguagcaauggcacug

SEQ ID NO: 1718438 - RNA, 14 nt, Homo sapiens
uguagccugugcau

SEQ ID NO: 1718439 - RNA, 15 nt, Homo sapiens
uguagcguguuuaca

SEQ ID NO: 1718440 - RNA, 15 nt, Homo sapiens
uguagcuuugcucuu

SEQ ID NO: 1718441 - RNA, 23 nt, Homo sapiens
uguagcuuugcucuuugguagaa

SEQ ID NO: 1718442 - RNA, 14 nt, Homo sapiens
uguaguaauugaca

SEQ ID NO: 1718443 - RNA, 15 nt, Homo sapiens
uguauaaacuaucag

SEQ ID NO: 1718444 - RNA, 14 nt, Homo sapiens
uguauacacauaua

SEQ ID NO: 1718445 - RNA, 16 nt, Homo sapiens
uguauagacaguuugu

SEQ ID NO: 1718446 - RNA, 17 nt, Homo sapiens
uguauauaaaugaacaa

SEQ ID NO: 1718447 - RNA, 17 nt, Homo sapiens
uguauauacacauauac

SEQ ID NO: 1718448 - RNA, 17 nt, Homo sapiens
uguaucaagucauggca

SEQ ID NO: 1718449 - RNA, 23 nt, Homo sapiens
uguauccccccccuguauaguua

SEQ ID NO: 1718450 - RNA, 16 nt, Homo sapiens
uguaucccuucucaca

SEQ ID NO: 1718451 - RNA, 18 nt, Homo sapiens
uguaugaaagauuguggg

SEQ ID NO: 1718452 - RNA, 12 nt, Homo sapiens
uguaugcacuuu

SEQ ID NO: 1718453 - RNA, 17 nt, Homo sapiens
uguauucucuuccucau

SEQ ID NO: 1718454 - RNA, 16 nt, Homo sapiens
uguauucuucaaccuc

SEQ ID NO: 1718455 - RNA, 13 nt, Homo sapiens
ugucaaagugaua

SEQ ID NO: 1718456 - RNA, 12 nt, Homo sapiens
ugucaaugauac

SEQ ID NO: 1718457 - RNA, 15 nt, Homo sapiens
ugucacacaaaaagu

SEQ ID NO: 1718458 - RNA, 18 nt, Homo sapiens
ugucacuguuccuuguca

SEQ ID NO: 1718459 - RNA, 23 nt, Homo sapiens
ugucacuucgcgugcccucgcug

SEQ ID NO: 1718460 - RNA, 22 nt, Homo sapiens
ugucagaaaccugcagggacuc

SEQ ID NO: 1718461 - RNA, 15 nt, Homo sapiens
ugucagaaugcuauu

SEQ ID NO: 1718462 - RNA, 12 nt, Homo sapiens
ugucagacauaa

SEQ ID NO: 1718463 - RNA, 20 nt, Homo sapiens
ugucaucagccaccauccua

SEQ ID NO: 1718464 - RNA, 23 nt, Homo sapiens
ugucaucccauauaacuaagaca

SEQ ID NO: 1718465 - RNA, 18 nt, Homo sapiens
ugucauccucaugcugcu

SEQ ID NO: 1718466 - RNA, 21 nt, Homo sapiens
ugucauccucaugcugcucaa

SEQ ID NO: 1718467 - RNA, 16 nt, Homo sapiens
ugucauccuuggucuu

SEQ ID NO: 1718468 - RNA, 15 nt, Homo sapiens
ugucauucgcuccca

SEQ ID NO: 1718469 - RNA, 18 nt, Homo sapiens
ugucauuguaaacaaacu

SEQ ID NO: 1718470 - RNA, 16 nt, Homo sapiens
ugucauuucauuccau

SEQ ID NO: 1718471 - RNA, 19 nt, Homo sapiens
ugucauuucauuccauugc

SEQ ID NO: 1718472 - RNA, 11 nt, Homo sapiens
uguccaaagag

SEQ ID NO: 1718473 - RNA, 16 nt, Homo sapiens
uguccauuuauaucau

SEQ ID NO: 1718474 - RNA, 18 nt, Homo sapiens
uguccccguguugcauga

SEQ ID NO: 1718475 - RNA, 19 nt, Homo sapiens
uguccccuccacugucaca

SEQ ID NO: 1718476 - RNA, 15 nt, Homo sapiens
ugucccucccaccuc

SEQ ID NO: 1718477 - RNA, 17 nt, Homo sapiens
ugucccucuuccauccc

SEQ ID NO: 1718478 - RNA, 15 nt, Homo sapiens
uguccugaucuguga

SEQ ID NO: 1718479 - RNA, 23 nt, Homo sapiens
ugucuaaaaaccagacaaggaaa

SEQ ID NO: 1718480 - RNA, 17 nt, Homo sapiens
ugucuaaacaaugcuga

SEQ ID NO: 1718481 - RNA, 15 nt, Homo sapiens
ugucuaagauucuag

SEQ ID NO: 1718482 - RNA, 17 nt, Homo sapiens
ugucuccacugugccuu

SEQ ID NO: 1718483 - RNA, 18 nt, Homo sapiens
ugucuccuuucucuuaug

SEQ ID NO: 1718484 - RNA, 16 nt, Homo sapiens
ugucugacaaccucuu

SEQ ID NO: 1718485 - RNA, 15 nt, Homo sapiens
ugucuggugguggca

SEQ ID NO: 1718486 - RNA, 18 nt, Homo sapiens
ugucuguuaaaugaacuu

SEQ ID NO: 1718487 - RNA, 22 nt, Homo sapiens
ugucuucagccucuccaggcac

SEQ ID NO: 1718488 - RNA, 19 nt, Homo sapiens
ugucuuccacuuugcauau

SEQ ID NO: 1718489 - RNA, 21 nt, Homo sapiens
ugucuuucugagcacacuuua

SEQ ID NO: 1718490 - RNA, 15 nt, Homo sapiens
ugugaaacacagcug

SEQ ID NO: 1718491 - RNA, 17 nt, Homo sapiens
ugugaaacuggcacuga

SEQ ID NO: 1718492 - RNA, 16 nt, Homo sapiens
ugugaaggggagagac

SEQ ID NO: 1718493 - RNA, 22 nt, Homo sapiens
ugugacaauaauauuguuguau

SEQ ID NO: 1718494 - RNA, 18 nt, Homo sapiens
ugcucauacuacauugag

SEQ ID NO: 1718495 - RNA, 14 nt, Homo sapiens
ugcucauaugcaug

SEQ ID NO: 1718496 - RNA, 21 nt, Homo sapiens
ugcucauuuuuucuucuccua

SEQ ID NO: 1718497 - RNA, 17 nt, Homo sapiens
ugcucccugaagccagc

SEQ ID NO: 1718498 - RNA, 16 nt, Homo sapiens
ugcuccuccuacccuu

SEQ ID NO: 1718499 - RNA, 20 nt, Homo sapiens
ugcucugaacuggaugauac

SEQ ID NO: 1718500 - RNA, 19 nt, Homo sapiens
ugcucugguuugagcaauu

SEQ ID NO: 1718501 - RNA, 15 nt, Homo sapiens
ugcucuuagcugucu

SEQ ID NO: 1718502 - RNA, 18 nt, Homo sapiens
ugcucuuucaucucugcu

SEQ ID NO: 1718503 - RNA, 17 nt, Homo sapiens
ugcugaaaaccaucugg

SEQ ID NO: 1718504 - RNA, 17 nt, Homo sapiens
ugcugaauguggacuca

SEQ ID NO: 1718505 - RNA, 14 nt, Homo sapiens
ugcugacaugguuu

SEQ ID NO: 1718506 - RNA, 10 nt, Homo sapiens
ugcugcuaug

SEQ ID NO: 1718507 - RNA, 23 nt, Homo sapiens
ugcugcugcgcccuuaccuuccc

SEQ ID NO: 1718508 - RNA, 21 nt, Homo sapiens
ugcuggacgccgagaaggccu

SEQ ID NO: 1718509 - RNA, 15 nt, Homo sapiens
ugcuggcacuaucca

SEQ ID NO: 1718510 - RNA, 23 nt, Homo sapiens
ugcuggcagccauggccauggca

SEQ ID NO: 1718511 - RNA, 15 nt, Homo sapiens
ugcuggcauuugcac

SEQ ID NO: 1718512 - RNA, 22 nt, Homo sapiens
ugcuggcauuugcaccuaccuc

SEQ ID NO: 1718513 - RNA, 23 nt, Homo sapiens
ugcugggaagacgccugagcuca

SEQ ID NO: 1718514 - RNA, 20 nt, Homo sapiens
ugcugggcacuucaucugau

SEQ ID NO: 1718515 - RNA, 16 nt, Homo sapiens
ugcuggggccucagac

SEQ ID NO: 1718516 - RNA, 14 nt, Homo sapiens
ugcugugaacaauu

SEQ ID NO: 1718517 - RNA, 21 nt, Homo sapiens
ugcuguuucacaauaccucau

SEQ ID NO: 1718518 - RNA, 13 nt, Homo sapiens
ugcuuacaaaguc

SEQ ID NO: 1718519 - RNA, 16 nt, Homo sapiens
ugcuuaugacaucacu

SEQ ID NO: 1718520 - RNA, 22 nt, Homo sapiens
ugcuucaaauaaaguccugaca

SEQ ID NO: 1718521 - RNA, 13 nt, Homo sapiens
ugcuucaucugcu

SEQ ID NO: 1718522 - RNA, 18 nt, Homo sapiens
ugcuucugaaugugcuga

SEQ ID NO: 1718523 - RNA, 14 nt, Homo sapiens
ugcuugaacccaag

SEQ ID NO: 1718524 - RNA, 19 nt, Homo sapiens
ugcuugugccacacccucc

SEQ ID NO: 1718525 - RNA, 12 nt, Homo sapiens
ugcuuguucccu

SEQ ID NO: 1718526 - RNA, 18 nt, Homo sapiens
ugcuuuugaggaacauua

SEQ ID NO: 1718527 - RNA, 19 nt, Homo sapiens
uggaaaaauguuugucuca

SEQ ID NO: 1718528 - RNA, 22 nt, Homo sapiens
uggaaaagcaaaacuguagggg

SEQ ID NO: 1718529 - RNA, 17 nt, Homo sapiens
uggaaaaucagcugcuc

SEQ ID NO: 1718530 - RNA, 12 nt, Homo sapiens
uggaaacuaaga

SEQ ID NO: 1718531 - RNA, 17 nt, Homo sapiens
uggaaagaaucuaauag

SEQ ID NO: 1718532 - RNA, 18 nt, Homo sapiens
uggaacagaagacagcug

SEQ ID NO: 1718533 - RNA, 23 nt, Homo sapiens
uggaacgcuaaugaaacacagcu

SEQ ID NO: 1718534 - RNA, 14 nt, Homo sapiens
uggaacuguacacu

SEQ ID NO: 1718535 - RNA, 13 nt, Homo sapiens
uggaagcaacagg

SEQ ID NO: 1718536 - RNA, 13 nt, Homo sapiens
uggaaggggucca

SEQ ID NO: 1718537 - RNA, 12 nt, Homo sapiens
uggaagggucaa

SEQ ID NO: 1718538 - RNA, 14 nt, Homo sapiens
uggaaguacaugaa

SEQ ID NO: 1718539 - RNA, 16 nt, Homo sapiens
uggaauaccuaaggau

SEQ ID NO: 1718540 - RNA, 14 nt, Homo sapiens
uggaauaggaauaa

SEQ ID NO: 1718541 - RNA, 13 nt, Homo sapiens
uggaauugcucaa

SEQ ID NO: 1718542 - RNA, 13 nt, Homo sapiens
uggaauuucuugu

SEQ ID NO: 1718543 - RNA, 12 nt, Homo sapiens
uggacacagcuc

SEQ ID NO: 1718544 - RNA, 19 nt, Homo sapiens
uggacaccccugcuauaua

SEQ ID NO: 1718545 - RNA, 22 nt, Homo sapiens
uggacagucacugccacuuugc

SEQ ID NO: 1718546 - RNA, 15 nt, Homo sapiens
uggaccacugcauga

SEQ ID NO: 1718547 - RNA, 15 nt, Homo sapiens
uggaccugguacaaa

SEQ ID NO: 1718548 - RNA, 14 nt, Homo sapiens
uggacucuaaagac

SEQ ID NO: 1718549 - RNA, 22 nt, Homo sapiens
uggacucucauguggccaagca

SEQ ID NO: 1718550 - RNA, 14 nt, Homo sapiens
uggacucugcacau

SEQ ID NO: 1718551 - RNA, 19 nt, Homo sapiens
uggacuggugugcucucuu

SEQ ID NO: 1718552 - RNA, 16 nt, Homo sapiens
uggacuguaacugacu

SEQ ID NO: 1718553 - RNA, 22 nt, Homo sapiens
uggacuuccagugcucagaggg

SEQ ID NO: 1718554 - RNA, 21 nt, Homo sapiens
uggacuugauagcaaacacug

SEQ ID NO: 1718555 - RNA, 18 nt, Homo sapiens
uggagaagcuagaaggca

SEQ ID NO: 1718556 - RNA, 22 nt, Homo sapiens
uggagacacaacuauuuuucca

SEQ ID NO: 1718557 - RNA, 23 nt, Homo sapiens
uggagacaccaaccgacaggccc

SEQ ID NO: 1718558 - RNA, 23 nt, Homo sapiens
uggagacccugcaaacagaacag

SEQ ID NO: 1718559 - RNA, 15 nt, Homo sapiens
uggagaccucuccuu

SEQ ID NO: 1718560 - RNA, 17 nt, Homo sapiens
uggagacugacaaccuc

SEQ ID NO: 1718561 - RNA, 15 nt, Homo sapiens
uggagagaagggcau

SEQ ID NO: 1718562 - RNA, 24 nt, Homo sapiens
uggaguuucauguacaagaugaag

SEQ ID NO: 1718563 - RNA, 18 nt, Homo sapiens
uggaguuugacauuguau

SEQ ID NO: 1718564 - RNA, 16 nt, Homo sapiens
uggauaucauacuucc

SEQ ID NO: 1718565 - RNA, 16 nt, Homo sapiens
uggaucagaugaacuc

SEQ ID NO: 1718566 - RNA, 18 nt, Homo sapiens
uggauucaucagcauuug

SEQ ID NO: 1718567 - RNA, 16 nt, Homo sapiens
uggauugggggggcca

SEQ ID NO: 1718568 - RNA, 17 nt, Homo sapiens
uggcaaacauuuuucca

SEQ ID NO: 1718569 - RNA, 12 nt, Homo sapiens
uggcaagagccc

SEQ ID NO: 1718570 - RNA, 16 nt, Homo sapiens
uggcaagucacaugcg

SEQ ID NO: 1718571 - RNA, 20 nt, Homo sapiens
uggcacacaccaguaauccc

SEQ ID NO: 1718572 - RNA, 19 nt, Homo sapiens
uggcaccaaagaugcagcc

SEQ ID NO: 1718573 - RNA, 21 nt, Homo sapiens
uggcacuaaagaauacauuua

SEQ ID NO: 1718574 - RNA, 14 nt, Homo sapiens
uggcacuaauauaa

SEQ ID NO: 1718575 - RNA, 11 nt, Homo sapiens
uggcacuuuga

SEQ ID NO: 1718576 - RNA, 12 nt, Homo sapiens
uggcacuuugaa

SEQ ID NO: 1718577 - RNA, 15 nt, Homo sapiens
uggcagaaccaaagc

SEQ ID NO: 1718578 - RNA, 19 nt, Homo sapiens
uggcagaaccaaagcucaa

SEQ ID NO: 1718579 - RNA, 21 nt, Homo sapiens
uggcagcggguggcauccagg

SEQ ID NO: 1718580 - RNA, 19 nt, Homo sapiens
uggcauacgccuguagucc

SEQ ID NO: 1718581 - RNA, 14 nt, Homo sapiens
uggccaaaagcuag

SEQ ID NO: 1718582 - RNA, 21 nt, Homo sapiens
uggcccaagugguuugugcua

SEQ ID NO: 1718583 - RNA, 17 nt, Homo sapiens
uggcccagggaagccaa

SEQ ID NO: 1718584 - RNA, 22 nt, Homo sapiens
uggcccauagaaacaugacacu

SEQ ID NO: 1718585 - RNA, 23 nt, Homo sapiens
uggccccucaaccuccuguggaa

SEQ ID NO: 1718586 - RNA, 18 nt, Homo sapiens
uggcccggaugcugcuuc

SEQ ID NO: 1718587 - RNA, 22 nt, Homo sapiens
uggcccuuuccuuccagauccu

SEQ ID NO: 1718588 - RNA, 13 nt, Homo sapiens
uggccuaugcaca

SEQ ID NO: 1718589 - RNA, 16 nt, Homo sapiens
uggccuaugcacauau

SEQ ID NO: 1718590 - RNA, 18 nt, Homo sapiens
uggccuaugcacauaugg

SEQ ID NO: 1718591 - RNA, 20 nt, Homo sapiens
uggccucagcugaaugccuc

SEQ ID NO: 1718592 - RNA, 20 nt, Homo sapiens
uggccuggacaguaucccac

SEQ ID NO: 1718593 - RNA, 18 nt, Homo sapiens
uggcguggcagccucuug

SEQ ID NO: 1718594 - RNA, 21 nt, Homo sapiens
uggcuaaagagcuuugugaua

SEQ ID NO: 1718595 - RNA, 22 nt, Homo sapiens
uggcuccccuuuuucuuccuca

SEQ ID NO: 1718596 - RNA, 16 nt, Homo sapiens
uggcugcuuuguucaa

SEQ ID NO: 1718597 - RNA, 17 nt, Homo sapiens
uggcugcuuuguucaau

SEQ ID NO: 1718598 - RNA, 17 nt, Homo sapiens
uggcuggaaggggucca

SEQ ID NO: 1718599 - RNA, 16 nt, Homo sapiens
uggcuucuacacuggg

SEQ ID NO: 1718600 - RNA, 20 nt, Homo sapiens
uggcuuuugcggccaguauu

SEQ ID NO: 1718601 - RNA, 18 nt, Homo sapiens
ugggaaaucaguguuuua

SEQ ID NO: 1718602 - RNA, 15 nt, Homo sapiens
ugggacauugcaauu

SEQ ID NO: 1718603 - RNA, 15 nt, Homo sapiens
ugggacuauucauug

SEQ ID NO: 1718604 - RNA, 21 nt, Homo sapiens
ugcaagccugucugagacuca

SEQ ID NO: 1718605 - RNA, 23 nt, Homo sapiens
ugcaauaccaaguauagccuaug

SEQ ID NO: 1718606 - RNA, 20 nt, Homo sapiens
ugcaauguaucccuucucac

SEQ ID NO: 1718607 - RNA, 15 nt, Homo sapiens
ugcacaaagcccuuc

SEQ ID NO: 1718608 - RNA, 22 nt, Homo sapiens
ugcacacaagcccacagcacag

SEQ ID NO: 1718609 - RNA, 20 nt, Homo sapiens
ugcacacacacacaucucau

SEQ ID NO: 1718610 - RNA, 13 nt, Homo sapiens
ugcacacaccaga

SEQ ID NO: 1718611 - RNA, 22 nt, Homo sapiens
ugcacagugaagugcuggcaac

SEQ ID NO: 1718612 - RNA, 19 nt, Homo sapiens
ugcaccagagcaaccucuc

SEQ ID NO: 1718613 - RNA, 24 nt, Homo sapiens
ugcaccuagcugugcaagaccuag

SEQ ID NO: 1718614 - RNA, 16 nt, Homo sapiens
ugcacguugcuucagg

SEQ ID NO: 1718615 - RNA, 13 nt, Homo sapiens
ugcacuccaauca

SEQ ID NO: 1718616 - RNA, 22 nt, Homo sapiens
ugcacuggggagcccgucucag

SEQ ID NO: 1718617 - RNA, 22 nt, Homo sapiens
ugcacuguccugaccaucgcac

SEQ ID NO: 1718618 - RNA, 15 nt, Homo sapiens
ugcacuuguggcaac

SEQ ID NO: 1718619 - RNA, 20 nt, Homo sapiens
ugcacuuguggcaacagaua

SEQ ID NO: 1718620 - RNA, 23 nt, Homo sapiens
ugcacuuguggcaacagauaagu

SEQ ID NO: 1718621 - RNA, 14 nt, Homo sapiens
ugcagaacugccau

SEQ ID NO: 1718622 - RNA, 15 nt, Homo sapiens
ugcagaacugccauu

SEQ ID NO: 1718623 - RNA, 16 nt, Homo sapiens
ugcagaaguacuccua

SEQ ID NO: 1718624 - RNA, 17 nt, Homo sapiens
ugcagaauccaaaguaa

SEQ ID NO: 1718625 - RNA, 19 nt, Homo sapiens
ugcagaggauaaggaggca

SEQ ID NO: 1718626 - RNA, 20 nt, Homo sapiens
ugcagaugccacccuagcca

SEQ ID NO: 1718627 - RNA, 21 nt, Homo sapiens
ugcagaugccacccuagccaa

SEQ ID NO: 1718628 - RNA, 22 nt, Homo sapiens
ugcagcauggucccugccuuag

SEQ ID NO: 1718629 - RNA, 18 nt, Homo sapiens
ugcagccacaucacggca

SEQ ID NO: 1718630 - RNA, 15 nt, Homo sapiens
ugcagcccaugccca

SEQ ID NO: 1718631 - RNA, 20 nt, Homo sapiens
ugcagccuccuccaccucac

SEQ ID NO: 1718632 - RNA, 17 nt, Homo sapiens
ugcagccuuugccuccc

SEQ ID NO: 1718633 - RNA, 18 nt, Homo sapiens
ugcagcuagaggcaucuu

SEQ ID NO: 1718634 - RNA, 17 nt, Homo sapiens
ugcagcuguacugagga

SEQ ID NO: 1718635 - RNA, 18 nt, Homo sapiens
ugcagcuguacugaggau

SEQ ID NO: 1718636 - RNA, 15 nt, Homo sapiens
ugcagcuuccuguca

SEQ ID NO: 1718637 - RNA, 16 nt, Homo sapiens
ugcagcuuuauguuca

SEQ ID NO: 1718638 - RNA, 16 nt, Homo sapiens
ugcaggacuugagaag

SEQ ID NO: 1718639 - RNA, 20 nt, Homo sapiens
ugcaggacuugagaagaccu

SEQ ID NO: 1718640 - RNA, 22 nt, Homo sapiens
ugcaggacuugagaagaccuca

SEQ ID NO: 1718641 - RNA, 23 nt, Homo sapiens
ugcaggcuccauggaacuuuuaa

SEQ ID NO: 1718642 - RNA, 17 nt, Homo sapiens
ugcagggacuccaugcu

SEQ ID NO: 1718643 - RNA, 22 nt, Homo sapiens
ugcaggggguggacaaacugga

SEQ ID NO: 1718644 - RNA, 17 nt, Homo sapiens
ugcaggugacauuugcu

SEQ ID NO: 1718645 - RNA, 20 nt, Homo sapiens
ugcagucaucagaaauucca

SEQ ID NO: 1718646 - RNA, 17 nt, Homo sapiens
ugcaguggcgugaucuc

SEQ ID NO: 1718647 - RNA, 18 nt, Homo sapiens
ugcaguggcgugaucucg

SEQ ID NO: 1718648 - RNA, 17 nt, Homo sapiens
ugcaguggugugaucuc

SEQ ID NO: 1718649 - RNA, 19 nt, Homo sapiens
ugcauaaauaugcagugau

SEQ ID NO: 1718650 - RNA, 16 nt, Homo sapiens
ugcauacuacucucaa

SEQ ID NO: 1718651 - RNA, 17 nt, Homo sapiens
ugcauagugcugggaug

SEQ ID NO: 1718652 - RNA, 15 nt, Homo sapiens
ugcauguggcuuuuu

SEQ ID NO: 1718653 - RNA, 16 nt, Homo sapiens
ugcauucuauugccuu

SEQ ID NO: 1718654 - RNA, 16 nt, Homo sapiens
ugcauugugaggguua

SEQ ID NO: 1718655 - RNA, 14 nt, Homo sapiens
ugccaacuccucac

SEQ ID NO: 1718656 - RNA, 18 nt, Homo sapiens
ugccaagaaaguauuugg

SEQ ID NO: 1718657 - RNA, 23 nt, Homo sapiens
ugccacaccagucacaugaccug

SEQ ID NO: 1718658 - RNA, 14 nt, Homo sapiens
ugccacugccucuu

SEQ ID NO: 1718659 - RNA, 18 nt, Homo sapiens
ugccagaugauuguucaa

SEQ ID NO: 1718660 - RNA, 19 nt, Homo sapiens
ugccagcaaugacaucuca

SEQ ID NO: 1718661 - RNA, 18 nt, Homo sapiens
ugccagggacugacaaaa

SEQ ID NO: 1718662 - RNA, 15 nt, Homo sapiens
ugccagugucauccg

SEQ ID NO: 1718663 - RNA, 12 nt, Homo sapiens
ugccauaugccu

SEQ ID NO: 1718664 - RNA, 17 nt, Homo sapiens
ugccaucaacuacuauu

SEQ ID NO: 1718665 - RNA, 16 nt, Homo sapiens
ugccaucgaccuggag

SEQ ID NO: 1718666 - RNA, 20 nt, Homo sapiens
ugccaugccaggaaccuguc

SEQ ID NO: 1718667 - RNA, 18 nt, Homo sapiens
ugccauuauuuucuguca

SEQ ID NO: 1718668 - RNA, 18 nt, Homo sapiens
ugcccaaugagacucuag

SEQ ID NO: 1718669 - RNA, 20 nt, Homo sapiens
ugcccacgcuggagugcagu

SEQ ID NO: 1718670 - RNA, 20 nt, Homo sapiens
ugccccaaacaaauaugcaa

SEQ ID NO: 1718671 - RNA, 18 nt, Homo sapiens
ugccccagaaaaauaacu

SEQ ID NO: 1718672 - RNA, 17 nt, Homo sapiens
ugccccaugccugucca

SEQ ID NO: 1718673 - RNA, 19 nt, Homo sapiens
ugccccccagccucuggca

SEQ ID NO: 1718674 - RNA, 17 nt, Homo sapiens
ugccccuggggcuucca

SEQ ID NO: 1718675 - RNA, 15 nt, Homo sapiens
ugcccgcacagcagc

SEQ ID NO: 1718676 - RNA, 13 nt, Homo sapiens
ugcccucauggcc

SEQ ID NO: 1718677 - RNA, 19 nt, Homo sapiens
ugccgccuccuugugcaca

SEQ ID NO: 1718678 - RNA, 17 nt, Homo sapiens
ugccggggguucagggu

SEQ ID NO: 1718679 - RNA, 21 nt, Homo sapiens
ugccguaacaacuguggucaa

SEQ ID NO: 1718680 - RNA, 17 nt, Homo sapiens
ugccgucagcuccgacu

SEQ ID NO: 1718681 - RNA, 19 nt, Homo sapiens
ugccgugcauuagcacaga

SEQ ID NO: 1718682 - RNA, 20 nt, Homo sapiens
ugccgugugagugugacagg

SEQ ID NO: 1718683 - RNA, 22 nt, Homo sapiens
ugccuaaaauauauuccugaga

SEQ ID NO: 1718684 - RNA, 22 nt, Homo sapiens
ugccuagcaagcuggccucuac

SEQ ID NO: 1718685 - RNA, 16 nt, Homo sapiens
ugccucacuuccuaca

SEQ ID NO: 1718686 - RNA, 21 nt, Homo sapiens
ugccuccucguuccuuucucc

SEQ ID NO: 1718687 - RNA, 18 nt, Homo sapiens
ugccucgaacuggcugca

SEQ ID NO: 1718688 - RNA, 14 nt, Homo sapiens
ugccuggacacugu

SEQ ID NO: 1718689 - RNA, 16 nt, Homo sapiens
ugccuggccuggcaca

SEQ ID NO: 1718690 - RNA, 16 nt, Homo sapiens
ugccuggugugccuca

SEQ ID NO: 1718691 - RNA, 11 nt, Homo sapiens
ugccuguguau

SEQ ID NO: 1718692 - RNA, 20 nt, Homo sapiens
ugccuguucccauucuugca

SEQ ID NO: 1718693 - RNA, 16 nt, Homo sapiens
ugccuuaggccuaccu

SEQ ID NO: 1718694 - RNA, 15 nt, Homo sapiens
ugccuucucaggaaa

SEQ ID NO: 1718695 - RNA, 16 nt, Homo sapiens
ugccuucuuauugcuu

SEQ ID NO: 1718696 - RNA, 20 nt, Homo sapiens
ugccuucuuauugcuuuuau

SEQ ID NO: 1718697 - RNA, 21 nt, Homo sapiens
ugccuucuuauugcuuuuaug

SEQ ID NO: 1718698 - RNA, 18 nt, Homo sapiens
ugccuugcuaaaagauua

SEQ ID NO: 1718699 - RNA, 16 nt, Homo sapiens
ugccuuuguaccauau

SEQ ID NO: 1718700 - RNA, 20 nt, Homo sapiens
ugccuuuucaucuaauguga

SEQ ID NO: 1718701 - RNA, 23 nt, Homo sapiens
ugcggccaguauuagacuggaag

SEQ ID NO: 1718702 - RNA, 11 nt, Homo sapiens
ugcgucuuccg

SEQ ID NO: 1718703 - RNA, 14 nt, Homo sapiens
ugcguggacucugc

SEQ ID NO: 1718704 - RNA, 14 nt, Homo sapiens
ugcguucacuccaa

SEQ ID NO: 1718705 - RNA, 22 nt, Homo sapiens
ugcuaaauggucgcccaggaga

SEQ ID NO: 1718706 - RNA, 24 nt, Homo sapiens
ugcuaauuaaaaaguuaaucuuca

SEQ ID NO: 1718707 - RNA, 19 nt, Homo sapiens
ugcuaccccuacaucaucu

SEQ ID NO: 1718708 - RNA, 13 nt, Homo sapiens
ugcuaguauuuga

SEQ ID NO: 1718709 - RNA, 23 nt, Homo sapiens
ugcuauuuauuuuccuaaagaga

SEQ ID NO: 1718710 - RNA, 15 nt, Homo sapiens
ugcucagccaagcuu

SEQ ID NO: 1718711 - RNA, 22 nt, Homo sapiens
ugcucagugggggcagagccac

SEQ ID NO: 1718712 - RNA, 24 nt, Homo sapiens
ucaguuguuuguuuuugcuuguua

SEQ ID NO: 1718713 - RNA, 13 nt, Homo sapiens
ucauaaauuuacu

SEQ ID NO: 1718714 - RNA, 14 nt, Homo sapiens
ucauacaugcauac

SEQ ID NO: 1718715 - RNA, 11 nt, Homo sapiens
ucauaccuuau

SEQ ID NO: 1718716 - RNA, 15 nt, Homo sapiens
ucauauacugccaug

SEQ ID NO: 1718717 - RNA, 20 nt, Homo sapiens
ucauaucaucacauugagcu

SEQ ID NO: 1718718 - RNA, 23 nt, Homo sapiens
ucauauugguauucacuaaucug

SEQ ID NO: 1718719 - RNA, 21 nt, Homo sapiens
ucaucaacaaagaaauauuau

SEQ ID NO: 1718720 - RNA, 23 nt, Homo sapiens
ucaucagagcuccucuguccugc

SEQ ID NO: 1718721 - RNA, 19 nt, Homo sapiens
ucaucagcauuuggaccaa

SEQ ID NO: 1718722 - RNA, 23 nt, Homo sapiens
ucaucagcuaucguuaguguauu

SEQ ID NO: 1718723 - RNA, 20 nt, Homo sapiens
ucaucaggaaggaaaugaca

SEQ ID NO: 1718724 - RNA, 14 nt, Homo sapiens
ucauccaacuuaug

SEQ ID NO: 1718725 - RNA, 13 nt, Homo sapiens
ucauccaccccau

SEQ ID NO: 1718726 - RNA, 15 nt, Homo sapiens
ucauccugacucugc

SEQ ID NO: 1718727 - RNA, 20 nt, Homo sapiens
ucaucuauaaagaagaacuu

SEQ ID NO: 1718728 - RNA, 10 nt, Homo sapiens
ucaugaaauu

SEQ ID NO: 1718729 - RNA, 15 nt, Homo sapiens
ucaugagcuugaaca

SEQ ID NO: 1718730 - RNA, 20 nt, Homo sapiens
ucaugagcuugaacaaggac

SEQ ID NO: 1718731 - RNA, 12 nt, Homo sapiens
ucauggaacuca

SEQ ID NO: 1718732 - RNA, 18 nt, Homo sapiens
ucaugguggguucagggg

SEQ ID NO: 1718733 - RNA, 22 nt, Homo sapiens
ucauguauauguguucauuaaa

SEQ ID NO: 1718734 - RNA, 13 nt, Homo sapiens
ucauuagcuguga

SEQ ID NO: 1718735 - RNA, 14 nt, Homo sapiens
ucauuagcugugau

SEQ ID NO: 1718736 - RNA, 17 nt, Homo sapiens
ucauuccaccuucccau

SEQ ID NO: 1718737 - RNA, 12 nt, Homo sapiens
ucauucuaucaa

SEQ ID NO: 1718738 - RNA, 15 nt, Homo sapiens
ucauugcacuuugau

SEQ ID NO: 1718739 - RNA, 15 nt, Homo sapiens
ucauuguuucugcau

SEQ ID NO: 1718740 - RNA, 15 nt, Homo sapiens
ucauuuauugagcac

SEQ ID NO: 1718741 - RNA, 14 nt, Homo sapiens
ucauuucauuccau

SEQ ID NO: 1718742 - RNA, 15 nt, Homo sapiens
ucauuucuugugaug

SEQ ID NO: 1718743 - RNA, 12 nt, Homo sapiens
uccaaagaggcu

SEQ ID NO: 1718744 - RNA, 23 nt, Homo sapiens
uccaaagaguagaauugcauuga

SEQ ID NO: 1718745 - RNA, 17 nt, Homo sapiens
uccaacaccacagacac

SEQ ID NO: 1718746 - RNA, 18 nt, Homo sapiens
uccaacucccucugggaa

SEQ ID NO: 1718747 - RNA, 17 nt, Homo sapiens
uccaauauuggagcaua

SEQ ID NO: 1718748 - RNA, 14 nt, Homo sapiens
uccaaucggagaca

SEQ ID NO: 1718749 - RNA, 18 nt, Homo sapiens
uccaaugaaagacacugu

SEQ ID NO: 1718750 - RNA, 20 nt, Homo sapiens
uccaauguuagagacuuuuu

SEQ ID NO: 1718751 - RNA, 22 nt, Homo sapiens
uccacacccacuuuguccauuu

SEQ ID NO: 1718752 - RNA, 15 nt, Homo sapiens
uccaccacugcuuaa

SEQ ID NO: 1718753 - RNA, 16 nt, Homo sapiens
uccaccagcccauggc

SEQ ID NO: 1718754 - RNA, 22 nt, Homo sapiens
uccacccauaauccuuucugcc

SEQ ID NO: 1718755 - RNA, 21 nt, Homo sapiens
uccacccuuggccugucucau

SEQ ID NO: 1718756 - RNA, 16 nt, Homo sapiens
uccaccuagacuguaa

SEQ ID NO: 1718757 - RNA, 13 nt, Homo sapiens
uccaccugucuca

SEQ ID NO: 1718758 - RNA, 14 nt, Homo sapiens
uccacgauccugcc

SEQ ID NO: 1718759 - RNA, 21 nt, Homo sapiens
uccacuccagauuuuuuacag

SEQ ID NO: 1718760 - RNA, 15 nt, Homo sapiens
uccacugucaagaaa

SEQ ID NO: 1718761 - RNA, 14 nt, Homo sapiens
uccacugugccaug

SEQ ID NO: 1718762 - RNA, 11 nt, Homo sapiens
uccacuuagaa

SEQ ID NO: 1718763 - RNA, 13 nt, Homo sapiens
uccacuucuuccu

SEQ ID NO: 1718764 - RNA, 21 nt, Homo sapiens
uccagaagaagagaagcugcu

SEQ ID NO: 1718765 - RNA, 18 nt, Homo sapiens
uccagaggguugugauuu

SEQ ID NO: 1718766 - RNA, 20 nt, Homo sapiens
uccagccaaccucauugcag

SEQ ID NO: 1718767 - RNA, 15 nt, Homo sapiens
uccagcucaccagcc

SEQ ID NO: 1718768 - RNA, 14 nt, Homo sapiens
uccagcuccuguaa

SEQ ID NO: 1718769 - RNA, 14 nt, Homo sapiens
uccagcucuaauaa

SEQ ID NO: 1718770 - RNA, 14 nt, Homo sapiens
uccagcuucaggca

SEQ ID NO: 1718771 - RNA, 14 nt, Homo sapiens
uccaggcaccaucu

SEQ ID NO: 1718772 - RNA, 19 nt, Homo sapiens
uccaguauucuugucaaaa

SEQ ID NO: 1718773 - RNA, 20 nt, Homo sapiens
uccagugccagcaaugacau

SEQ ID NO: 1718774 - RNA, 15 nt, Homo sapiens
uccagugccuggauc

SEQ ID NO: 1718775 - RNA, 19 nt, Homo sapiens
uccagugguucugcuucaa

SEQ ID NO: 1718776 - RNA, 15 nt, Homo sapiens
uccaguucaugagaa

SEQ ID NO: 1718777 - RNA, 19 nt, Homo sapiens
uccauaaugcuacugucuc

SEQ ID NO: 1718778 - RNA, 19 nt, Homo sapiens
uccauaguaguaugaugau

SEQ ID NO: 1718779 - RNA, 16 nt, Homo sapiens
uccauccaaucuauua

SEQ ID NO: 1718780 - RNA, 23 nt, Homo sapiens
uccaucuggcugccuuugcuuaa

SEQ ID NO: 1718781 - RNA, 20 nt, Homo sapiens
uccaucuuuacaaaacuaca

SEQ ID NO: 1718782 - RNA, 16 nt, Homo sapiens
uccaugcugccuccag

SEQ ID NO: 1718783 - RNA, 20 nt, Homo sapiens
uccaugggauacaaccuccc

SEQ ID NO: 1718784 - RNA, 20 nt, Homo sapiens
ucccaaaagauugcugaaaa

SEQ ID NO: 1718785 - RNA, 17 nt, Homo sapiens
ucccaaaagucaccacu

SEQ ID NO: 1718786 - RNA, 20 nt, Homo sapiens
ucccaaagugcugagauuac

SEQ ID NO: 1718787 - RNA, 22 nt, Homo sapiens
ucccaacaacauccauguccua

SEQ ID NO: 1718788 - RNA, 22 nt, Homo sapiens
ucccaacugaguguuauuugca

SEQ ID NO: 1718789 - RNA, 20 nt, Homo sapiens
ucccaaguagcugggauuac

SEQ ID NO: 1718790 - RNA, 16 nt, Homo sapiens
ucccacccacauguga

SEQ ID NO: 1718791 - RNA, 20 nt, Homo sapiens
ucccacccacaugugacaca

SEQ ID NO: 1718792 - RNA, 11 nt, Homo sapiens
ucccacuccag

SEQ ID NO: 1718793 - RNA, 23 nt, Homo sapiens
ucccagaaauuagaaaccuuaau

SEQ ID NO: 1718794 - RNA, 16 nt, Homo sapiens
ucccagagucaucuga

SEQ ID NO: 1718795 - RNA, 13 nt, Homo sapiens
ucccagcacuuug

SEQ ID NO: 1718796 - RNA, 15 nt, Homo sapiens
ucccaggaacugggc

SEQ ID NO: 1718797 - RNA, 16 nt, Homo sapiens
ucccauggacacucca

SEQ ID NO: 1718798 - RNA, 16 nt, Homo sapiens
uccccacuagcauuuu

SEQ ID NO: 1718799 - RNA, 23 nt, Homo sapiens
uccccagcccuggcucugcaaug

SEQ ID NO: 1718800 - RNA, 24 nt, Homo sapiens
uccccagucccaaugcacauccau

SEQ ID NO: 1718801 - RNA, 16 nt, Homo sapiens
uccccauaacucaaug

SEQ ID NO: 1718802 - RNA, 19 nt, Homo sapiens
aauccuucuggcagauuca

SEQ ID NO: 1718803 - RNA, 21 nt, Homo sapiens
aaucguccagcgaccuuccuc

SEQ ID NO: 1718804 - RNA, 16 nt, Homo sapiens
aaucguuuauuucaca

SEQ ID NO: 1718805 - RNA, 15 nt, Homo sapiens
aaucuaacaucgugg

SEQ ID NO: 1718806 - RNA, 21 nt, Homo sapiens
aaucuaacaucguggcugugg

SEQ ID NO: 1718807 - RNA, 15 nt, Homo sapiens
aaucuacuaauucca

SEQ ID NO: 1718808 - RNA, 16 nt, Homo sapiens
aaucuacuaauuccac

SEQ ID NO: 1718809 - RNA, 17 nt, Homo sapiens
aaucuaggaagcucaga

SEQ ID NO: 1718810 - RNA, 20 nt, Homo sapiens
aaucuaucuaguacuuccca

SEQ ID NO: 1718811 - RNA, 15 nt, Homo sapiens
aaucuauguuugcac

SEQ ID NO: 1718812 - RNA, 16 nt, Homo sapiens
aaucucccacuccagc

SEQ ID NO: 1718813 - RNA, 20 nt, Homo sapiens
aaucugagccagugcuuuaa

SEQ ID NO: 1718814 - RNA, 23 nt, Homo sapiens
aaucugagccagugcuuuaaugg

SEQ ID NO: 1718815 - RNA, 22 nt, Homo sapiens
aaucuggcuccuuuacaaaaga

SEQ ID NO: 1718816 - RNA, 21 nt, Homo sapiens
aaucuuccgauggaugaaucu

SEQ ID NO: 1718817 - RNA, 19 nt, Homo sapiens
aaucuucuccuaugcauuu

SEQ ID NO: 1718818 - RNA, 23 nt, Homo sapiens
aaucuuuaagcagagaagggcau

SEQ ID NO: 1718819 - RNA, 19 nt, Homo sapiens
aaucuuuuaaaaauucaaa

SEQ ID NO: 1718820 - RNA, 17 nt, Homo sapiens
aaugaaaaacaaccaag

SEQ ID NO: 1718821 - RNA, 20 nt, Homo sapiens
aaugaacuaauaauagcauu

SEQ ID NO: 1718822 - RNA, 22 nt, Homo sapiens
aaugaagcuaauaauucuucac

SEQ ID NO: 1718823 - RNA, 22 nt, Homo sapiens
aaugaauuuucuucauacuuaa

SEQ ID NO: 1718824 - RNA, 15 nt, Homo sapiens
aaugacaucucaggg

SEQ ID NO: 1718825 - RNA, 15 nt, Homo sapiens
aaugacaugcacuga

SEQ ID NO: 1718826 - RNA, 18 nt, Homo sapiens
aaugacaugcacugaccc

SEQ ID NO: 1718827 - RNA, 21 nt, Homo sapiens
aaugacccaaaucucuuccac

SEQ ID NO: 1718828 - RNA, 23 nt, Homo sapiens
aaugagaagccaagcucuucaag

SEQ ID NO: 1718829 - RNA, 20 nt, Homo sapiens
aaugagacauaggccaugaa

SEQ ID NO: 1718830 - RNA, 21 nt, Homo sapiens
aaugagacauaggccaugaaa

SEQ ID NO: 1718831 - RNA, 14 nt, Homo sapiens
aaugagacugacca

SEQ ID NO: 1718832 - RNA, 20 nt, Homo sapiens
aaugaguuaugaguuauuca

SEQ ID NO: 1718833 - RNA, 14 nt, Homo sapiens
aaugauaaaacacc

SEQ ID NO: 1718834 - RNA, 21 nt, Homo sapiens
aaugauaaaguaaugaucuca

SEQ ID NO: 1718835 - RNA, 16 nt, Homo sapiens
aaugauagacaauuga

SEQ ID NO: 1718836 - RNA, 13 nt, Homo sapiens
aaugaucacucca

SEQ ID NO: 1718837 - RNA, 18 nt, Homo sapiens
aaugaucugccucuaaaa

SEQ ID NO: 1718838 - RNA, 23 nt, Homo sapiens
aaugauuaacaguuaugugguca

SEQ ID NO: 1718839 - RNA, 19 nt, Homo sapiens
aaugauuauuuucauuaca

SEQ ID NO: 1718840 - RNA, 15 nt, Homo sapiens
aaugauucauguuau

SEQ ID NO: 1718841 - RNA, 17 nt, Homo sapiens
aaugauucauguuauau

SEQ ID NO: 1718842 - RNA, 15 nt, Homo sapiens
aaugauuuuacuuaa

SEQ ID NO: 1718843 - RNA, 22 nt, Homo sapiens
aaugcacugacauuguuggcca

SEQ ID NO: 1718844 - RNA, 21 nt, Homo sapiens
aaugcauuauaggaucauuug

SEQ ID NO: 1718845 - RNA, 14 nt, Homo sapiens
aaugcauugcuaaa

SEQ ID NO: 1718846 - RNA, 23 nt, Homo sapiens
ucaaaacuggacagucacugcca

SEQ ID NO: 1718847 - RNA, 16 nt, Homo sapiens
ucaaaauccaaaaaga

SEQ ID NO: 1718848 - RNA, 21 nt, Homo sapiens
ucaaaauccuuccaaagaauu

SEQ ID NO: 1718849 - RNA, 21 nt, Homo sapiens
ucaaacauauucuaaugccug

SEQ ID NO: 1718850 - RNA, 19 nt, Homo sapiens
ucaaacucuugaccucagg

SEQ ID NO: 1718851 - RNA, 21 nt, Homo sapiens
ucaaagcacagaauuugucag

SEQ ID NO: 1718852 - RNA, 21 nt, Homo sapiens
ucaaagcuaaauuccacacua

SEQ ID NO: 1718853 - RNA, 22 nt, Homo sapiens
ucaaaguuuugaaaagcuauua

SEQ ID NO: 1718854 - RNA, 13 nt, Homo sapiens
ucaaaugugcugu

SEQ ID NO: 1718855 - RNA, 23 nt, Homo sapiens
ucaaauuuugaugccaagaaagu

SEQ ID NO: 1718856 - RNA, 14 nt, Homo sapiens
ucaacaaaccaagc

SEQ ID NO: 1718857 - RNA, 20 nt, Homo sapiens
ucaacagaaacuaaaugaac

SEQ ID NO: 1718858 - RNA, 21 nt, Homo sapiens
ucaacauccugccagccccac

SEQ ID NO: 1718859 - RNA, 16 nt, Homo sapiens
ucaagaacucugggcu

SEQ ID NO: 1718860 - RNA, 22 nt, Homo sapiens
ucaagcacuuacagcucuggcc

SEQ ID NO: 1718861 - RNA, 14 nt, Homo sapiens
ucaaggcacucuag

SEQ ID NO: 1718862 - RNA, 18 nt, Homo sapiens
ucaaggcugcagugagcc

SEQ ID NO: 1718863 - RNA, 19 nt, Homo sapiens
ucaaggcuuccacugcaaa

SEQ ID NO: 1718864 - RNA, 21 nt, Homo sapiens
ucaaggucagcaugaggacag

SEQ ID NO: 1718865 - RNA, 18 nt, Homo sapiens
ucaaucauaauaccugcu

SEQ ID NO: 1718866 - RNA, 19 nt, Homo sapiens
ucaaucaucugugugaaaa

SEQ ID NO: 1718867 - RNA, 15 nt, Homo sapiens
ucaauccucuaagcu

SEQ ID NO: 1718868 - RNA, 19 nt, Homo sapiens
ucaaugaaccacaaaaaag

SEQ ID NO: 1718869 - RNA, 20 nt, Homo sapiens
ucaaugcaagagugauugca

SEQ ID NO: 1718870 - RNA, 23 nt, Homo sapiens
ucaaugcaagagugauugcagcu

SEQ ID NO: 1718871 - RNA, 18 nt, Homo sapiens
ucaauggaguaugucuga

SEQ ID NO: 1718872 - RNA, 15 nt, Homo sapiens
ucaauuccugugauu

SEQ ID NO: 1718873 - RNA, 15 nt, Homo sapiens
ucaauuuugacuuaa

SEQ ID NO: 1718874 - RNA, 15 nt, Homo sapiens
ucacaaaaauuugaa

SEQ ID NO: 1718875 - RNA, 19 nt, Homo sapiens
ucacagaacuauguacuuu

SEQ ID NO: 1718876 - RNA, 16 nt, Homo sapiens
ucacagcuaguuugag

SEQ ID NO: 1718877 - RNA, 19 nt, Homo sapiens
ucacaggacucugccuccu

SEQ ID NO: 1718878 - RNA, 23 nt, Homo sapiens
ucacaggugggaucggcacucag

SEQ ID NO: 1718879 - RNA, 19 nt, Homo sapiens
ucacagugacccuucccaa

SEQ ID NO: 1718880 - RNA, 16 nt, Homo sapiens
ucacaguguugcccag

SEQ ID NO: 1718881 - RNA, 19 nt, Homo sapiens
ucacauaguuuauuucaac

SEQ ID NO: 1718882 - RNA, 22 nt, Homo sapiens
ucacauccuaccccuuugcacu

SEQ ID NO: 1718883 - RNA, 22 nt, Homo sapiens
ucacauggccuaugcacauaug

SEQ ID NO: 1718884 - RNA, 18 nt, Homo sapiens
ucacauugagcugauaua

SEQ ID NO: 1718885 - RNA, 16 nt, Homo sapiens
ucacauugcauucuau

SEQ ID NO: 1718886 - RNA, 19 nt, Homo sapiens
ucacauuguuugcugcuau

SEQ ID NO: 1718887 - RNA, 18 nt, Homo sapiens
ucacauuuauucugcuca

SEQ ID NO: 1718888 - RNA, 19 nt, Homo sapiens
ucacauuuauucugcucac

SEQ ID NO: 1718889 - RNA, 17 nt, Homo sapiens
ucaccaaaauagucuuc

SEQ ID NO: 1718890 - RNA, 19 nt, Homo sapiens
ucaccaagaaaacaugcaa

SEQ ID NO: 1718891 - RNA, 12 nt, Homo sapiens
ucaccaagccca

SEQ ID NO: 1718892 - RNA, 19 nt, Homo sapiens
ucaccaguguccccuccac

SEQ ID NO: 1718893 - RNA, 21 nt, Homo sapiens
ucaccaugaagcgaaacacag

SEQ ID NO: 1718894 - RNA, 17 nt, Homo sapiens
ucacccaggcacugggc

SEQ ID NO: 1718895 - RNA, 19 nt, Homo sapiens
ucacccaggcuggaguaca

SEQ ID NO: 1718896 - RNA, 17 nt, Homo sapiens
ucaccccaguggccacu

SEQ ID NO: 1718897 - RNA, 16 nt, Homo sapiens
ucaccccguuacagcu

SEQ ID NO: 1718898 - RNA, 17 nt, Homo sapiens
ucacccgacccgugcac

SEQ ID NO: 1718899 - RNA, 12 nt, Homo sapiens
ucacccugcuac

SEQ ID NO: 1718900 - RNA, 19 nt, Homo sapiens
ucaccuaagucucugugaa

SEQ ID NO: 1718901 - RNA, 16 nt, Homo sapiens
ucaccucuaacacgca

SEQ ID NO: 1718902 - RNA, 21 nt, Homo sapiens
ucaccuugaaagcaguagcau

SEQ ID NO: 1718903 - RNA, 19 nt, Homo sapiens
ucacgcaacuugaaauuau

SEQ ID NO: 1718904 - RNA, 14 nt, Homo sapiens
ucacgccacugcac

SEQ ID NO: 1718905 - RNA, 19 nt, Homo sapiens
ucacuaaaguauaucuuua

SEQ ID NO: 1718906 - RNA, 21 nt, Homo sapiens
ucacuagaaaagcugaucaua

SEQ ID NO: 1718907 - RNA, 14 nt, Homo sapiens
ucacucaccaucug

SEQ ID NO: 1718908 - RNA, 14 nt, Homo sapiens
ucacucauugcuga

SEQ ID NO: 1718909 - RNA, 17 nt, Homo sapiens
ucacucuuauugcccac

SEQ ID NO: 1718910 - RNA, 18 nt, Homo sapiens
ucacugaaagacaccauu

SEQ ID NO: 1718911 - RNA, 13 nt, Homo sapiens
ucacugcacucca

SEQ ID NO: 1718912 - RNA, 15 nt, Homo sapiens
ucacugcagccucaa

SEQ ID NO: 1718913 - RNA, 15 nt, Homo sapiens
ucacugccacuuugc

SEQ ID NO: 1718914 - RNA, 18 nt, Homo sapiens
ucacugcuugaugaagca

SEQ ID NO: 1718915 - RNA, 17 nt, Homo sapiens
ucacuggaccacugggc

SEQ ID NO: 1718916 - RNA, 13 nt, Homo sapiens
ucacuguggucau

SEQ ID NO: 1718917 - RNA, 15 nt, Homo sapiens
ucacuguggucaucc

SEQ ID NO: 1718918 - RNA, 23 nt, Homo sapiens
ucacuuaaagcccgccugacaga

SEQ ID NO: 1718919 - RNA, 19 nt, Homo sapiens
ucacuucauagcucaccag

SEQ ID NO: 1718920 - RNA, 14 nt, Homo sapiens
ucacuucauucaca

SEQ ID NO: 1718921 - RNA, 20 nt, Homo sapiens
ucacuuuacaaauucaagcc

SEQ ID NO: 1718922 - RNA, 18 nt, Homo sapiens
ucagaaaugcugucauaa

SEQ ID NO: 1718923 - RNA, 22 nt, Homo sapiens
ucagaagacacugaugggcaac

SEQ ID NO: 1718924 - RNA, 19 nt, Homo sapiens
ucagaaguuucucagcucc

SEQ ID NO: 1718925 - RNA, 20 nt, Homo sapiens
ucagaauaaauuauugcugu

SEQ ID NO: 1718926 - RNA, 15 nt, Homo sapiens
ucagaauagccacau

SEQ ID NO: 1718927 - RNA, 15 nt, Homo sapiens
ucagacaagcugcau

SEQ ID NO: 1718928 - RNA, 18 nt, Homo sapiens
ucagacauaaagccaugu

SEQ ID NO: 1718929 - RNA, 16 nt, Homo sapiens
ucagaccuggcugcuu

SEQ ID NO: 1718930 - RNA, 18 nt, Homo sapiens
ucagagaaauacuuucag

SEQ ID NO: 1718931 - RNA, 20 nt, Homo sapiens
ucagagccccuacagcauug

SEQ ID NO: 1718932 - RNA, 23 nt, Homo sapiens
ucagauuaccaguuauaggaaca

SEQ ID NO: 1718933 - RNA, 20 nt, Homo sapiens
ucagauuguuaucuaucaac

SEQ ID NO: 1718934 - RNA, 13 nt, Homo sapiens
ucagcaaaccauu

SEQ ID NO: 1718935 - RNA, 20 nt, Homo sapiens
ucagcaagcccuacagagcu

SEQ ID NO: 1718936 - RNA, 14 nt, Homo sapiens
cuucaccaguguuu

SEQ ID NO: 1718937 - RNA, 18 nt, Homo sapiens
cuucacgaacagcguuuu

SEQ ID NO: 1718938 - RNA, 20 nt, Homo sapiens
cuucacuuauccuguucucu

SEQ ID NO: 1718939 - RNA, 20 nt, Homo sapiens
cuuuauuauuuacuuugcau

SEQ ID NO: 1718940 - RNA, 21 nt, Homo sapiens
gaauaugggguugguguucuc

SEQ ID NO: 1718941 - RNA, 20 nt, Homo sapiens
gagcaagguggacaucuuca

SEQ ID NO: 1718942 - RNA, 13 nt, Homo sapiens
gcaauuaacugau

SEQ ID NO: 1718943 - RNA, 18 nt, Homo sapiens
gcagaguugcucuucacc

SEQ ID NO: 1718944 - RNA, 21 nt, Homo sapiens
gcauugcacagagugaacuua

SEQ ID NO: 1718945 - RNA, 18 nt, Homo sapiens
gucacaccucacugucau

SEQ ID NO: 1718946 - RNA, 17 nt, Homo sapiens
guccagcgcucaggaau

SEQ ID NO: 1718947 - RNA, 19 nt, Homo sapiens
guggccccaaauuugcuau

SEQ ID NO: 1718948 - RNA, 23 nt, Homo sapiens
guuucacucuuuccagauaagca

SEQ ID NO: 1718949 - RNA, 20 nt, Homo sapiens
uaaccaguuuuuucaccucc

SEQ ID NO: 1718950 - RNA, 15 nt, Homo sapiens
uaaggaguaacuugc

SEQ ID NO: 1718951 - RNA, 22 nt, Homo sapiens
uaauuuaugaauuuuacuugca

SEQ ID NO: 1718952 - RNA, 19 nt, Homo sapiens
uauauaccaaugacuucca

SEQ ID NO: 1718953 - RNA, 17 nt, Homo sapiens
uaugaauuuuacuugca

SEQ ID NO: 1718954 - RNA, 19 nt, Homo sapiens
ucaagaacaggacauagca

SEQ ID NO: 1718955 - RNA, 16 nt, Homo sapiens
ucacaccucacuguca

SEQ ID NO: 1718956 - RNA, 17 nt, Homo sapiens
ucaucaggcagcccaaa

SEQ ID NO: 1718957 - RNA, 13 nt, Homo sapiens
uccagauaagcag

SEQ ID NO: 1718958 - RNA, 20 nt, Homo sapiens
ugaauagugugguucaguga

SEQ ID NO: 1718959 - RNA, 21 nt, Homo sapiens
ugaauagugugguucagugag

SEQ ID NO: 1718960 - RNA, 23 nt, Homo sapiens
ugaauaugggguugguguucuca

SEQ ID NO: 1718961 - RNA, 16 nt, Homo sapiens
ugacuacucaguccag

SEQ ID NO: 1718962 - RNA, 15 nt, Homo sapiens
ugauauguaaaacag

SEQ ID NO: 1718963 - RNA, 13 nt, Homo sapiens
ugaugucauguca

SEQ ID NO: 1718964 - RNA, 14 nt, Homo sapiens
ugcucuucuuuaga

SEQ ID NO: 1718965 - RNA, 15 nt, Homo sapiens
ugguguucucaucua

SEQ ID NO: 1718966 - RNA, 15 nt, Homo sapiens
ugucaugucagcucc

SEQ ID NO: 1718967 - RNA, 17 nt, Homo sapiens
uuaauggacgaagcaac

SEQ ID NO: 1718968 - RNA, 19 nt, Homo sapiens
uucauagcaauuaacugau

SEQ ID NO: 1718969 - RNA, 21 nt, Homo sapiens
uuccuuuuuauuuguuugcaa

SEQ ID NO: 1718970 - RNA, 13 nt, Homo sapiens
uugcucuucacca

SEQ ID NO: 1718971 - RNA, 13 nt, Homo sapiens
uugguguucucau

SEQ ID NO: 1718972 - RNA, 23 nt, Homo sapiens
uuguaagucuuuauuauuuacuu

SEQ ID NO: 1718973 - RNA, 13 nt, Homo sapiens
uuuacuugcaccu

SEQ ID NO: 1718974 - RNA, 22 nt, Homo sapiens
uuuagauggcuguaaaucuauu

SEQ ID NO: 1718975 - RNA, 16 nt, Homo sapiens
uuuauuuguuugcaau

SEQ ID NO: 1718976 - RNA, 16 nt, Homo sapiens
aaaaguuuauuggacu

SEQ ID NO: 1718977 - RNA, 21 nt, Homo sapiens
aaaugaugucaugucagcucc

SEQ ID NO: 1718978 - RNA, 20 nt, Homo sapiens
aagucaucauaauucagcuc

SEQ ID NO: 1718979 - RNA, 21 nt, Homo sapiens
aagucuuuauuauuuacuuug

SEQ ID NO: 1718980 - RNA, 23 nt, Homo sapiens
aagucuuuauuauuuacuuugca

SEQ ID NO: 1718981 - RNA, 18 nt, Homo sapiens
aauaaaaugcagagacau

SEQ ID NO: 1718982 - RNA, 19 nt, Homo sapiens
aauuguuuccaaagugcau

SEQ ID NO: 1718983 - RNA, 23 nt, Homo sapiens
acaaauaugucaagaacaggaca

SEQ ID NO: 1718984 - RNA, 21 nt, Homo sapiens
acaaccacggucacaccucac

SEQ ID NO: 1718985 - RNA, 17 nt, Homo sapiens
acaccucacugucaucu

SEQ ID NO: 1718986 - RNA, 17 nt, Homo sapiens
accacggucacaccuca

SEQ ID NO: 1718987 - RNA, 24 nt, Homo sapiens
accaguaggaggaggaugagccac

SEQ ID NO: 1718988 - RNA, 19 nt, Homo sapiens
accucacugucaucugcca

SEQ ID NO: 1718989 - RNA, 21 nt, Homo sapiens
acuuaauggacgaagcaacaa

SEQ ID NO: 1718990 - RNA, 16 nt, Homo sapiens
acuuauccuguucucu

SEQ ID NO: 1718991 - RNA, 15 nt, Homo sapiens
acuugcaaguuuuca

SEQ ID NO: 1718992 - RNA, 19 nt, Homo sapiens
agaagaaaggcauugcaca

SEQ ID NO: 1718993 - RNA, 13 nt, Homo sapiens
agagcuuacuuuu

SEQ ID NO: 1718994 - RNA, 14 nt, Homo sapiens
agagugugacucau

SEQ ID NO: 1718995 - RNA, 20 nt, Homo sapiens
agcuccgccccuugaacaug

SEQ ID NO: 1718996 - RNA, 18 nt, Homo sapiens
agcugacaaagcagauaa

SEQ ID NO: 1718997 - RNA, 12 nt, Homo sapiens
agcuuacuuuua

SEQ ID NO: 1718998 - RNA, 15 nt, Homo sapiens
aggacauagcacgaa

SEQ ID NO: 1718999 - RNA, 15 nt, Homo sapiens
aggaguaacuugcaa

SEQ ID NO: 1719000 - RNA, 19 nt, Homo sapiens
aguaggaggaggaugagcc

SEQ ID NO: 1719001 - RNA, 17 nt, Homo sapiens
auaaaaucuacuccaaa

SEQ ID NO: 1719002 - RNA, 23 nt, Homo sapiens
auaauucagcucuugagagcauu

SEQ ID NO: 1719003 - RNA, 22 nt, Homo sapiens
auaguucauagcaauuaacuga

SEQ ID NO: 1719004 - RNA, 20 nt, Homo sapiens
auaugggguugguguucuca

SEQ ID NO: 1719005 - RNA, 21 nt, Homo sapiens
auaugggguugguguucucau

SEQ ID NO: 1719006 - RNA, 22 nt, Homo sapiens
aucaggcagcccaaaaguuuau

SEQ ID NO: 1719007 - RNA, 13 nt, Homo sapiens
aucugccacuggu

SEQ ID NO: 1719008 - RNA, 20 nt, Homo sapiens
augacugaauagugugguuc

SEQ ID NO: 1719009 - RNA, 16 nt, Homo sapiens
auggacgaagcaacaa

SEQ ID NO: 1719010 - RNA, 16 nt, Homo sapiens
augucaugucagcucc

SEQ ID NO: 1719011 - RNA, 22 nt, Homo sapiens
auuguuuccaaagugcauguca

SEQ ID NO: 1719012 - RNA, 17 nt, Homo sapiens
auuucaagucuuccuga

SEQ ID NO: 1719013 - RNA, 12 nt, Homo sapiens
auuuuacuugca

SEQ ID NO: 1719014 - RNA, 13 nt, Homo sapiens
auuuuacuugcac

SEQ ID NO: 1719015 - RNA, 17 nt, Homo sapiens
caaaaacuuucaugccu

SEQ ID NO: 1719016 - RNA, 21 nt, Homo sapiens
caaagugcaugucacaugcca

SEQ ID NO: 1719017 - RNA, 22 nt, Homo sapiens
caagucuuccugauacaugacu

SEQ ID NO: 1719018 - RNA, 19 nt, Homo sapiens
caaguuuucaguacaaauc

SEQ ID NO: 1719019 - RNA, 19 nt, Homo sapiens
caccuuauaguucauagca

SEQ ID NO: 1719020 - RNA, 15 nt, Homo sapiens
cacgaaucuguuacc

SEQ ID NO: 1719021 - RNA, 14 nt, Homo sapiens
cacucuuuccagau

SEQ ID NO: 1719022 - RNA, 18 nt, Homo sapiens
cacuuauccuguucucug

SEQ ID NO: 1719023 - RNA, 23 nt, Homo sapiens
cagaacuucaucugccacugguu

SEQ ID NO: 1719024 - RNA, 17 nt, Homo sapiens
cagguuuguguuuucuu

SEQ ID NO: 1719025 - RNA, 16 nt, Homo sapiens
cagugagcugcacuga

SEQ ID NO: 1719026 - RNA, 17 nt, Homo sapiens
caguguuuuucuucaug

SEQ ID NO: 1719027 - RNA, 16 nt, Homo sapiens
caucaggcagcccaaa

SEQ ID NO: 1719028 - RNA, 17 nt, Homo sapiens
caucauaauucagcucu

SEQ ID NO: 1719029 - RNA, 14 nt, Homo sapiens
aaaacuauguucag

SEQ ID NO: 1719030 - RNA, 13 nt, Homo sapiens
aaaauuguuucca

SEQ ID NO: 1719031 - RNA, 13 nt, Homo sapiens
aaauaugucaaga

SEQ ID NO: 1719032 - RNA, 20 nt, Homo sapiens
aaaucugugcuacacuggau

SEQ ID NO: 1719033 - RNA, 15 nt, Homo sapiens
aacaggacauagcac

SEQ ID NO: 1719034 - RNA, 14 nt, Homo sapiens
aacuucaucugcca

SEQ ID NO: 1719035 - RNA, 19 nt, Homo sapiens
aacuuuauguugcaggaaa

SEQ ID NO: 1719036 - RNA, 21 nt, Homo sapiens
aauaugggguugguguucuca

SEQ ID NO: 1719037 - RNA, 22 nt, Homo sapiens
aauuucaagucuuccugauaca

SEQ ID NO: 1719038 - RNA, 20 nt, Homo sapiens
aauuuuacuugcaccuuaua

SEQ ID NO: 1719039 - RNA, 14 nt, Homo sapiens
acaaaacugaccuu

SEQ ID NO: 1719040 - RNA, 21 nt, Homo sapiens
acaaaucugugcuacacugga

SEQ ID NO: 1719041 - RNA, 22 nt, Homo sapiens
acaagucaucauaauucagcuc

SEQ ID NO: 1719042 - RNA, 21 nt, Homo sapiens
acauagcacgaaucuguuacc

SEQ ID NO: 1719043 - RNA, 22 nt, Homo sapiens
accuuauaguucauagcaauua

SEQ ID NO: 1719044 - RNA, 16 nt, Homo sapiens
acucuuuaagaccuca

SEQ ID NO: 1719045 - RNA, 14 nt, Homo sapiens
acugucaucugcca

SEQ ID NO: 1719046 - RNA, 13 nt, Homo sapiens
acuucaucugcca

SEQ ID NO: 1719047 - RNA, 13 nt, Homo sapiens
acuuuauguugca

SEQ ID NO: 1719048 - RNA, 15 nt, Homo sapiens
agaaaggcauugcac

SEQ ID NO: 1719049 - RNA, 16 nt, Homo sapiens
agaaaggcauugcaca

SEQ ID NO: 1719050 - RNA, 14 nt, Homo sapiens
aggaguaacuugca

SEQ ID NO: 1719051 - RNA, 12 nt, Homo sapiens
auaagcagaguu

SEQ ID NO: 1719052 - RNA, 20 nt, Homo sapiens
auaauuuucuaauuucaagu

SEQ ID NO: 1719053 - RNA, 18 nt, Homo sapiens
auaccaaugacuuccaua

SEQ ID NO: 1719054 - RNA, 15 nt, Homo sapiens
auauaccaaugacuu

SEQ ID NO: 1719055 - RNA, 12 nt, Homo sapiens
auccuguucucu

SEQ ID NO: 1719056 - RNA, 20 nt, Homo sapiens
augagccacagaaauugcau

SEQ ID NO: 1719057 - RNA, 22 nt, Homo sapiens
auggcuguaaaucuauuggcca

SEQ ID NO: 1719058 - RNA, 18 nt, Homo sapiens
augucaagaacaggacau

SEQ ID NO: 1719059 - RNA, 13 nt, Homo sapiens
augugcaaaguga

SEQ ID NO: 1719060 - RNA, 18 nt, Homo sapiens
caaaaugaugucauguca

SEQ ID NO: 1719061 - RNA, 14 nt, Homo sapiens
caaagugcauguca

SEQ ID NO: 1719062 - RNA, 22 nt, Homo sapiens
caaagugcaugucacaugccac

SEQ ID NO: 1719063 - RNA, 19 nt, Homo sapiens
caagguggacaucuucacg

SEQ ID NO: 1719064 - RNA, 14 nt, Homo sapiens
caccuccaugucau

SEQ ID NO: 1719065 - RNA, 20 nt, Homo sapiens
cagaagaaaggcauugcaca

SEQ ID NO: 1719066 - RNA, 16 nt, Homo sapiens
caguuuuuucaccucc

SEQ ID NO: 1719067 - RNA, 22 nt, Homo sapiens
caugccacaaccacggucacac

SEQ ID NO: 1719068 - RNA, 17 nt, Homo sapiens
ccaucugggcuucacag

SEQ ID NO: 1719069 - RNA, 17 nt, Homo sapiens
cgggaacaaaaugaugu

SEQ ID NO: 1719070 - RNA, 22 nt, Homo sapiens
cuacaagucaucauaauucagc

SEQ ID NO: 1719071 - RNA, 23 nt, Homo sapiens
cucaguccagcgcucaggaauau

SEQ ID NO: 1719072 - RNA, 19 nt, Homo sapiens
cugugcuacacuggauaaa

SEQ ID NO: 1719073 - RNA, 15 nt, Homo sapiens
cuuauccuguucucu

SEQ ID NO: 1719074 - RNA, 17 nt, Homo sapiens
cuugaguuaaccuugcu

SEQ ID NO: 1719075 - RNA, 17 nt, Homo sapiens
gaauuuuacuugcaccu

SEQ ID NO: 1719076 - RNA, 16 nt, Homo sapiens
gaugagccacagaaau

SEQ ID NO: 1719077 - RNA, 22 nt, Homo sapiens
gaugagccacagaaauugcaua

SEQ ID NO: 1719078 - RNA, 18 nt, Homo sapiens
gcaaaaacuuucaugccu

SEQ ID NO: 1719079 - RNA, 19 nt, Homo sapiens
gcauaauuuucuaauuuca

SEQ ID NO: 1719080 - RNA, 16 nt, Homo sapiens
gcauugcacagaguga

SEQ ID NO: 1719081 - RNA, 11 nt, Homo sapiens
ggcauugcaca

SEQ ID NO: 1719082 - RNA, 18 nt, Homo sapiens
ggccaucugggcuucaca

SEQ ID NO: 1719083 - RNA, 14 nt, Homo sapiens
gucaugucagcucc

SEQ ID NO: 1719084 - RNA, 17 nt, Homo sapiens
gugacuauuuguucuau

SEQ ID NO: 1719085 - RNA, 17 nt, Homo sapiens
gugcaugucacaugcca

SEQ ID NO: 1719086 - RNA, 18 nt, Homo sapiens
guggccccaaauuugcua

SEQ ID NO: 1719087 - RNA, 13 nt, Homo sapiens
guugguguucuca

SEQ ID NO: 1719088 - RNA, 12 nt, Homo sapiens
uaaaacagauuu

SEQ ID NO: 1719089 - RNA, 12 nt, Homo sapiens
uaaaaucuacuc

SEQ ID NO: 1719090 - RNA, 14 nt, Homo sapiens
caugucacaugcca

SEQ ID NO: 1719091 - RNA, 12 nt, Homo sapiens
caugucagcucc

SEQ ID NO: 1719092 - RNA, 21 nt, Homo sapiens
cauuguuuguuuuauauacca

SEQ ID NO: 1719093 - RNA, 12 nt, Homo sapiens
ccaaagugcaug

SEQ ID NO: 1719094 - RNA, 18 nt, Homo sapiens
ccgggaacaaaaugaugu

SEQ ID NO: 1719095 - RNA, 18 nt, Homo sapiens
ccuguucucugaagaugu

SEQ ID NO: 1719096 - RNA, 11 nt, Homo sapiens
cuaaggaguaa

SEQ ID NO: 1719097 - RNA, 18 nt, Homo sapiens
cuaaggaguaacuugcaa

SEQ ID NO: 1719098 - RNA, 22 nt, Homo sapiens
cuucaccaguguuuuucuucau

SEQ ID NO: 1719099 - RNA, 21 nt, Homo sapiens
cuuuccagauaagcagaguug

SEQ ID NO: 1719100 - RNA, 20 nt, Homo sapiens
gaacuucaucugccacuggu

SEQ ID NO: 1719101 - RNA, 18 nt, Homo sapiens
gaagaaaggcauugcaca

SEQ ID NO: 1719102 - RNA, 18 nt, Homo sapiens
gaagcaacaaauauguca

SEQ ID NO: 1719103 - RNA, 15 nt, Homo sapiens
gaauuuuacuugcac

SEQ ID NO: 1719104 - RNA, 13 nt, Homo sapiens
gagcauucugcuc

SEQ ID NO: 1719105 - RNA, 20 nt, Homo sapiens
gagccacagaaauugcauaa

SEQ ID NO: 1719106 - RNA, 15 nt, Homo sapiens
gaguaacuugcaagu

SEQ ID NO: 1719107 - RNA, 22 nt, Homo sapiens
gcauuuuguuuguuucuucacu

SEQ ID NO: 1719108 - RNA, 16 nt, Homo sapiens
gggguugguguucuca

SEQ ID NO: 1719109 - RNA, 16 nt, Homo sapiens
guaaaucuauuggcca

SEQ ID NO: 1719110 - RNA, 17 nt, Homo sapiens
gucacaccucacuguca

SEQ ID NO: 1719111 - RNA, 13 nt, Homo sapiens
gugcuacacugga

SEQ ID NO: 1719112 - RNA, 20 nt, Homo sapiens
uaaauguauugagguauuau

SEQ ID NO: 1719113 - RNA, 21 nt, Homo sapiens
uaaggaguaacuugcaaguuu

SEQ ID NO: 1719114 - RNA, 21 nt, Homo sapiens
uacaagucaucauaauucagc

SEQ ID NO: 1719115 - RNA, 18 nt, Homo sapiens
uauaguucauagcaauua

SEQ ID NO: 1719116 - RNA, 12 nt, Homo sapiens
uauccuguucuc

SEQ ID NO: 1719117 - RNA, 13 nt, Homo sapiens
uauccuguucucu

SEQ ID NO: 1719118 - RNA, 16 nt, Homo sapiens
uaugaauuuuacuugc

SEQ ID NO: 1719119 - RNA, 16 nt, Homo sapiens
uauuauuuacuuugca

SEQ ID NO: 1719120 - RNA, 13 nt, Homo sapiens
ucaagaacaggac

SEQ ID NO: 1719121 - RNA, 23 nt, Homo sapiens
ucaagucuuccugauacaugacu

SEQ ID NO: 1719122 - RNA, 14 nt, Homo sapiens
ucacaccucacugu

SEQ ID NO: 1719123 - RNA, 15 nt, Homo sapiens
ucauagcaauuaacu

SEQ ID NO: 1719124 - RNA, 11 nt, Homo sapiens
uccuguucucu

SEQ ID NO: 1719125 - RNA, 16 nt, Homo sapiens
ugaccuugacuacuca

SEQ ID NO: 1719126 - RNA, 14 nt, Homo sapiens
ugcaaaaacuuuca

SEQ ID NO: 1719127 - RNA, 23 nt, Homo sapiens
ugcauuuuguuucacucuuucca

SEQ ID NO: 1719128 - RNA, 19 nt, Homo sapiens
uggacaucuucacgaacag

SEQ ID NO: 1719129 - RNA, 19 nt, Homo sapiens
uguugcaggaaacccuuuu

SEQ ID NO: 1719130 - RNA, 12 nt, Homo sapiens
uucaagucuucc

SEQ ID NO: 1719131 - RNA, 19 nt, Homo sapiens
uucacuuauccuguucucu

SEQ ID NO: 1719132 - RNA, 12 nt, Homo sapiens
uucccaugcauu

SEQ ID NO: 1719133 - RNA, 16 nt, Homo sapiens
uuccugauacaugacu

SEQ ID NO: 1719134 - RNA, 18 nt, Homo sapiens
uugcuauucccaugcauu

SEQ ID NO: 1719135 - RNA, 15 nt, Homo sapiens
caaugacuuccauau

SEQ ID NO: 1719136 - RNA, 22 nt, Homo sapiens
cacaccucacugucaucugcca

SEQ ID NO: 1719137 - RNA, 15 nt, Homo sapiens
cacagaaauugcaua

SEQ ID NO: 1719138 - RNA, 13 nt, Homo sapiens
cacagagugaacu

SEQ ID NO: 1719139 - RNA, 14 nt, Homo sapiens
caccucacugucau

SEQ ID NO: 1719140 - RNA, 14 nt, Homo sapiens
cagaaauugcauaa

SEQ ID NO: 1719141 - RNA, 12 nt, Homo sapiens
caggacauagca

SEQ ID NO: 1719142 - RNA, 16 nt, Homo sapiens
cauuuuguuucacucu

SEQ ID NO: 1719143 - RNA, 16 nt, Homo sapiens
ccaaagugcaugucac

SEQ ID NO: 1719144 - RNA, 22 nt, Homo sapiens
ccaaagugcaugucacaugcca

SEQ ID NO: 1719145 - RNA, 16 nt, Homo sapiens
ccugauacaugacuga

SEQ ID NO: 1719146 - RNA, 14 nt, Homo sapiens
ccuuauaguucaua

SEQ ID NO: 1719147 - RNA, 14 nt, Homo sapiens
cggucacaccucac

SEQ ID NO: 1719148 - RNA, 18 nt, Homo sapiens
cguggccccaaauuugcu

SEQ ID NO: 1719149 - RNA, 17 nt, Homo sapiens
cuuaaaauaaaaugcag

SEQ ID NO: 1719150 - RNA, 20 nt, Homo sapiens
cuuaauggacgaagcaacaa

SEQ ID NO: 1719151 - RNA, 21 nt, Homo sapiens
cuuaauggacgaagcaacaaa

SEQ ID NO: 1719152 - RNA, 17 nt, Homo sapiens
cuucacgaacagcguuu

SEQ ID NO: 1719153 - RNA, 22 nt, Homo sapiens
cuuccugauacaugacugaaua

SEQ ID NO: 1719154 - RNA, 14 nt, Homo sapiens
cuuucaugccuuuu

SEQ ID NO: 1719155 - RNA, 20 nt, Homo sapiens
cuuuccagauaagcagaguu

SEQ ID NO: 1719156 - RNA, 15 nt, Homo sapiens
gaaaggcauugcaca

SEQ ID NO: 1719157 - RNA, 15 nt, Homo sapiens
gaacuucaucugcca

SEQ ID NO: 1719158 - RNA, 22 nt, Homo sapiens
gaauaugggguugguguucuca

SEQ ID NO: 1719159 - RNA, 16 nt, Homo sapiens
gagagcauucugcucu

SEQ ID NO: 1719160 - RNA, 19 nt, Homo sapiens
gagccacagaaauugcaua

SEQ ID NO: 1719161 - RNA, 20 nt, Homo sapiens
gaguaacuugcaaguuuuca

SEQ ID NO: 1719162 - RNA, 23 nt, Homo sapiens
gauguuuugugaccagguuugug

SEQ ID NO: 1719163 - RNA, 19 nt, Homo sapiens
gcaaaaacuuucaugccuu

SEQ ID NO: 1719164 - RNA, 13 nt, Homo sapiens
gcugcacugaccu

SEQ ID NO: 1719165 - RNA, 14 nt, Homo sapiens
ggaguaacuugcaa

SEQ ID NO: 1719166 - RNA, 14 nt, Homo sapiens
gguugguguucuca

SEQ ID NO: 1719167 - RNA, 22 nt, Homo sapiens
gucuuuauuauuuacuuugcau

SEQ ID NO: 1719168 - RNA, 18 nt, Homo sapiens
guugaacaaaacugaccu

SEQ ID NO: 1719169 - RNA, 19 nt, Homo sapiens
uaaccaguuuuuucaccuc

SEQ ID NO: 1719170 - RNA, 22 nt, Homo sapiens
uaaccaguuuuuucaccuccau

SEQ ID NO: 1719171 - RNA, 16 nt, Homo sapiens
uaaggaguaacuugca

SEQ ID NO: 1719172 - RNA, 19 nt, Homo sapiens
uaauggacgaagcaacaaa

SEQ ID NO: 1719173 - RNA, 17 nt, Homo sapiens
uacacuggauaaaaauc

SEQ ID NO: 1719174 - RNA, 14 nt, Homo sapiens
ucaagaacaggaca

SEQ ID NO: 1719175 - RNA, 20 nt, Homo sapiens
ucaagaacaggacauagcac

SEQ ID NO: 1719176 - RNA, 18 nt, Homo sapiens
ucacuuauccuguucucu

SEQ ID NO: 1719177 - RNA, 15 nt, Homo sapiens
ucagaacuucaucug

SEQ ID NO: 1719178 - RNA, 18 nt, Homo sapiens
ucagaacuucaucugcca

SEQ ID NO: 1719179 - RNA, 20 nt, Homo sapiens
ucagaagaaaggcauugcac

SEQ ID NO: 1719180 - RNA, 18 nt, Homo sapiens
ucuuccugauacaugacu

SEQ ID NO: 1719181 - RNA, 20 nt, Homo sapiens
ugaauuuuacuugcaccuua

SEQ ID NO: 1719182 - RNA, 15 nt, Homo sapiens
ugacucaucaggcag

SEQ ID NO: 1719183 - RNA, 14 nt, Homo sapiens
ugagagcauucugc

SEQ ID NO: 1719184 - RNA, 12 nt, Homo sapiens
ugauacaugacu

SEQ ID NO: 1719185 - RNA, 14 nt, Homo sapiens
uggacaucuucacg

SEQ ID NO: 1719186 - RNA, 16 nt, Homo sapiens
ugucaagaacaggaca

SEQ ID NO: 1719187 - RNA, 21 nt, Homo sapiens
ugucaagaacaggacauagca

SEQ ID NO: 1719188 - RNA, 12 nt, Homo sapiens
ugucaucugcca

SEQ ID NO: 1719189 - RNA, 21 nt, Homo sapiens
uguucagaacuucaucugcca

SEQ ID NO: 1719190 - RNA, 23 nt, Homo sapiens
uguuuccaaagugcaugucacau

SEQ ID NO: 1719191 - RNA, 14 nt, Homo sapiens
uuauccuguucucu

SEQ ID NO: 1719192 - RNA, 15 nt, Homo sapiens
uucaccuccauguca

SEQ ID NO: 1719193 - RNA, 11 nt, Homo sapiens
uuuauguugca

SEQ ID NO: 1719194 - RNA, 23 nt, Homo sapiens
uuucuaaggaguaacuugcaagu

SEQ ID NO: 1719195 - RNA, 22 nt, Homo sapiens
uuuucaagagagugugacucau

SEQ ID NO: 1719196 - RNA, 22 nt, Homo sapiens
uuuuccgggaacaaaaugaugu

SEQ ID NO: 1719197 - RNA, 22 nt, Homo sapiens
uuuuucuaaggaguaacuugca

SEQ ID NO: 1719198 - RNA, 21 nt, Homo sapiens
aaaacuauguucagaacuuca

SEQ ID NO: 1719199 - RNA, 21 nt, Homo sapiens
aaaaugaugucaugucagcuc

SEQ ID NO: 1719200 - RNA, 21 nt, Homo sapiens
aaacuauguucagaacuucau

SEQ ID NO: 1719201 - RNA, 20 nt, Homo sapiens
aaagugcaugucacaugcca

SEQ ID NO: 1719202 - RNA, 20 nt, Homo sapiens
aaaugaugucaugucagcuc

SEQ ID NO: 1719203 - RNA, 16 nt, Homo sapiens
aacuugcaaguuuuca

SEQ ID NO: 1719204 - RNA, 20 nt, Homo sapiens
aagaacaggacauagcacga

SEQ ID NO: 1719205 - RNA, 15 nt, Homo sapiens
aaggaguaacuugca

SEQ ID NO: 1719206 - RNA, 23 nt, Homo sapiens
aaggaguaacuugcaaguuuuca

SEQ ID NO: 1719207 - RNA, 21 nt, Homo sapiens
aaucugugcuacacuggauaa

SEQ ID NO: 1719208 - RNA, 12 nt, Homo sapiens
aaugacuuccau

SEQ ID NO: 1719209 - RNA, 20 nt, Homo sapiens
aaugaugucaugucagcucc

SEQ ID NO: 1719210 - RNA, 16 nt, Homo sapiens
aauuucaagucuuccu

SEQ ID NO: 1719211 - RNA, 23 nt, Homo sapiens
acaaaacugaccuugacuacuca

SEQ ID NO: 1719212 - RNA, 19 nt, Homo sapiens
accaguuuuuucaccucca

SEQ ID NO: 1719213 - RNA, 15 nt, Homo sapiens
accuccaugucaucc

SEQ ID NO: 1719214 - RNA, 22 nt, Homo sapiens
acucuuuaagaccucaaaccau

SEQ ID NO: 1719215 - RNA, 18 nt, Homo sapiens
agaaaggcauugcacaga

SEQ ID NO: 1719216 - RNA, 17 nt, Homo sapiens
agaacaggacauagcac

SEQ ID NO: 1719217 - RNA, 19 nt, Homo sapiens
agcaagguggacaucuuca

SEQ ID NO: 1719218 - RNA, 13 nt, Homo sapiens
agcugacaaagca

SEQ ID NO: 1719219 - RNA, 13 nt, Homo sapiens
aggcauugcacag

SEQ ID NO: 1719220 - RNA, 14 nt, Homo sapiens
aggcauugcacaga

SEQ ID NO: 1719221 - RNA, 17 nt, Homo sapiens
agugagcugcacugacc

SEQ ID NO: 1719222 - RNA, 21 nt, Homo sapiens
agugcaaaaacuuucaugccu

SEQ ID NO: 1719223 - RNA, 13 nt, Homo sapiens
auaauucagcucu

SEQ ID NO: 1719224 - RNA, 18 nt, Homo sapiens
auauaccaaugacuucca

SEQ ID NO: 1719225 - RNA, 14 nt, Homo sapiens
auaugggguuggug

SEQ ID NO: 1719226 - RNA, 16 nt, Homo sapiens
aucauaauucagcucu

SEQ ID NO: 1719227 - RNA, 19 nt, Homo sapiens
augggguugguguucucau

SEQ ID NO: 1719228 - RNA, 15 nt, Homo sapiens
auuuaugaauuuuac

SEQ ID NO: 1719229 - RNA, 17 nt, Homo sapiens
auuuaugaauuuuacuu

SEQ ID NO: 1719230 - RNA, 18 nt, Homo sapiens
auuuuacuugcaccuuau

SEQ ID NO: 1719231 - RNA, 21 nt, Homo sapiens
auuuucaagagagugugacuc

SEQ ID NO: 1719232 - RNA, 18 nt, Homo sapiens
caaaaacuuucaugccuu

SEQ ID NO: 1719233 - RNA, 16 nt, Homo sapiens
caagguggacaucuuc

SEQ ID NO: 1719234 - RNA, 16 nt, Homo sapiens
caauaccuacaaguca

SEQ ID NO: 1719235 - RNA, 20 nt, Homo sapiens
caccucacugucaucugcca

SEQ ID NO: 1719236 - RNA, 17 nt, Homo sapiens
cacuuauccuguucucu

SEQ ID NO: 1719237 - RNA, 22 nt, Homo sapiens
cagcccaaaaguuuauuggacu

SEQ ID NO: 1719238 - RNA, 21 nt, Homo sapiens
caguguuuuucuucaugugca

SEQ ID NO: 1719239 - RNA, 18 nt, Homo sapiens
caguuuuuucaccuccau

SEQ ID NO: 1719240 - RNA, 22 nt, Homo sapiens
caguuuuuucaccuccauguca

SEQ ID NO: 1719241 - RNA, 13 nt, Homo sapiens
ccaaugacuucca

SEQ ID NO: 1719242 - RNA, 16 nt, Homo sapiens
ccaguaggaggaggau

SEQ ID NO: 1719243 - RNA, 22 nt, Homo sapiens
ccuacaagucaucauaauucag

SEQ ID NO: 1719244 - RNA, 18 nt, Homo sapiens
cuaaucaauaccuacaag

SEQ ID NO: 1719245 - RNA, 23 nt, Homo sapiens
cuaauuuaugaauuuuacuugca

SEQ ID NO: 1719246 - RNA, 14 nt, Homo sapiens
cugauacaugacug

SEQ ID NO: 1719247 - RNA, 17 nt, Homo sapiens
cugugcuacacuggaua

SEQ ID NO: 1719248 - RNA, 23 nt, Homo sapiens
aaaaucuacuccaaauuauuuuc

SEQ ID NO: 1719249 - RNA, 20 nt, Homo sapiens
aaagagaaaaacaacuuuau

SEQ ID NO: 1719250 - RNA, 19 nt, Homo sapiens
aaagcagauaaaaucuacu

SEQ ID NO: 1719251 - RNA, 21 nt, Homo sapiens
aaaucugugcuacacuggaua

SEQ ID NO: 1719252 - RNA, 16 nt, Homo sapiens
aaauuugcuauuccca

SEQ ID NO: 1719253 - RNA, 22 nt, Homo sapiens
aaauuugcuauucccaugcauu

SEQ ID NO: 1719254 - RNA, 19 nt, Homo sapiens
aacugauuuguagugauuc

SEQ ID NO: 1719255 - RNA, 21 nt, Homo sapiens
aacugauuuguagugauucau

SEQ ID NO: 1719256 - RNA, 21 nt, Homo sapiens
aagucaucauaauucagcucu

SEQ ID NO: 1719257 - RNA, 13 nt, Homo sapiens
aagugcaugucac

SEQ ID NO: 1719258 - RNA, 20 nt, Homo sapiens
aauuauuuucaagagagugu

SEQ ID NO: 1719259 - RNA, 20 nt, Homo sapiens
aauucagcucuugagagcau

SEQ ID NO: 1719260 - RNA, 17 nt, Homo sapiens
aauuguuuccaaagugc

SEQ ID NO: 1719261 - RNA, 17 nt, Homo sapiens
acaacuuuauguugcag

SEQ ID NO: 1719262 - RNA, 22 nt, Homo sapiens
acaacuuuauguugcaggaaac

SEQ ID NO: 1719263 - RNA, 16 nt, Homo sapiens
acauucaaaaaccccu

SEQ ID NO: 1719264 - RNA, 18 nt, Homo sapiens
accacggucacaccucac

SEQ ID NO: 1719265 - RNA, 21 nt, Homo sapiens
accguggccccaaauuugcua

SEQ ID NO: 1719266 - RNA, 16 nt, Homo sapiens
acgaaucuguuaccag

SEQ ID NO: 1719267 - RNA, 21 nt, Homo sapiens
acggucacaccucacugucau

SEQ ID NO: 1719268 - RNA, 15 nt, Homo sapiens
acucuuuccagauaa

SEQ ID NO: 1719269 - RNA, 18 nt, Homo sapiens
agagagugugacucauca

SEQ ID NO: 1719270 - RNA, 18 nt, Homo sapiens
agagugugacucaucagg

SEQ ID NO: 1719271 - RNA, 12 nt, Homo sapiens
agcagaguugcu

SEQ ID NO: 1719272 - RNA, 17 nt, Homo sapiens
agcagaguugcucuuca

SEQ ID NO: 1719273 - RNA, 20 nt, Homo sapiens
agcagaguugcucuucacca

SEQ ID NO: 1719274 - RNA, 15 nt, Homo sapiens
agcugcacugaccuc

SEQ ID NO: 1719275 - RNA, 22 nt, Homo sapiens
agucuuuauuauuuacuuugca

SEQ ID NO: 1719276 - RNA, 18 nt, Homo sapiens
agugcaugucacaugcca

SEQ ID NO: 1719277 - RNA, 19 nt, Homo sapiens
agugugacucaucaggcag

SEQ ID NO: 1719278 - RNA, 17 nt, Homo sapiens
auagugugguucaguga

SEQ ID NO: 1719279 - RNA, 19 nt, Homo sapiens
auccuguucucugaagaug

SEQ ID NO: 1719280 - RNA, 13 nt, Homo sapiens
aucugccaggacg

SEQ ID NO: 1719281 - RNA, 18 nt, Homo sapiens
aucugugcuacacuggau

SEQ ID NO: 1719282 - RNA, 11 nt, Homo sapiens
augagccacag

SEQ ID NO: 1719283 - RNA, 22 nt, Homo sapiens
augucaagaacaggacauagca

SEQ ID NO: 1719284 - RNA, 22 nt, Homo sapiens
auguucagaacuucaucugcca

SEQ ID NO: 1719285 - RNA, 15 nt, Homo sapiens
auuuguagugauuca

SEQ ID NO: 1719286 - RNA, 13 nt, Homo sapiens
auuuguuugcaau

SEQ ID NO: 1719287 - RNA, 14 nt, Homo sapiens
auuuucuaauuuca

SEQ ID NO: 1719288 - RNA, 15 nt, Homo sapiens
caagagagugugacu

SEQ ID NO: 1719289 - RNA, 11 nt, Homo sapiens
uaaaaugcaga

SEQ ID NO: 1719290 - RNA, 23 nt, Homo sapiens
uaaguagaaaaauuguuuccaaa

SEQ ID NO: 1719291 - RNA, 15 nt, Homo sapiens
uaauucagcucuuga

SEQ ID NO: 1719292 - RNA, 20 nt, Homo sapiens
uacaaaucugugcuacacug

SEQ ID NO: 1719293 - RNA, 18 nt, Homo sapiens
uagaaaaauuguuuccaa

SEQ ID NO: 1719294 - RNA, 21 nt, Homo sapiens
uaguucauagcaauuaacuga

SEQ ID NO: 1719295 - RNA, 18 nt, Homo sapiens
uaugaauuuuacuugcac

SEQ ID NO: 1719296 - RNA, 22 nt, Homo sapiens
uaugaauuuuacuugcaccuua

SEQ ID NO: 1719297 - RNA, 15 nt, Homo sapiens
uauucccaugcauuu

SEQ ID NO: 1719298 - RNA, 22 nt, Homo sapiens
ucaagucuuccugauacaugac

SEQ ID NO: 1719299 - RNA, 17 nt, Homo sapiens
ucacaccucacugucau

SEQ ID NO: 1719300 - RNA, 19 nt, Homo sapiens
ucacaccucacugucaucu

SEQ ID NO: 1719301 - RNA, 14 nt, Homo sapiens
ucaccuccauguca

SEQ ID NO: 1719302 - RNA, 13 nt, Homo sapiens
ucacugucaucug

SEQ ID NO: 1719303 - RNA, 16 nt, Homo sapiens
ucacugucaucugcca

SEQ ID NO: 1719304 - RNA, 19 nt, Homo sapiens
ucagaagaaaggcauugca

SEQ ID NO: 1719305 - RNA, 19 nt, Homo sapiens
ucagcucuugagagcauuc

SEQ ID NO: 1719306 - RNA, 17 nt, Homo sapiens
ucagugagcugcacuga

SEQ ID NO: 1719307 - RNA, 12 nt, Homo sapiens
uccaugucaucc

SEQ ID NO: 1719308 - RNA, 20 nt, Homo sapiens
uccuuuuuauuuguuugcaa

SEQ ID NO: 1719309 - RNA, 21 nt, Homo sapiens
ucuuucuuuucuauuagugaa

SEQ ID NO: 1719310 - RNA, 16 nt, Homo sapiens
ugaauuuuacuugcac

SEQ ID NO: 1719311 - RNA, 18 nt, Homo sapiens
ugcaaguuuucaguacaa

SEQ ID NO: 1719312 - RNA, 15 nt, Homo sapiens
uggacaucuucacga

SEQ ID NO: 1719313 - RNA, 20 nt, Homo sapiens
ugguagagcugacaaagcag

SEQ ID NO: 1719314 - RNA, 21 nt, Homo sapiens
uguaagucuuuauuauuuacu

SEQ ID NO: 1719315 - RNA, 16 nt, Homo sapiens
uucaagucuuccugau

SEQ ID NO: 1719316 - RNA, 20 nt, Homo sapiens
uucagugagcugcacugacc

SEQ ID NO: 1719317 - RNA, 21 nt, Homo sapiens
uuccagauaagcagaguugcu

SEQ ID NO: 1719318 - RNA, 21 nt, Homo sapiens
uugcaauauuuucagaagaaa

SEQ ID NO: 1719319 - RNA, 15 nt, Homo sapiens
uuguagagcuuacuu

SEQ ID NO: 1719320 - RNA, 12 nt, Homo sapiens
uuguuucacucu

SEQ ID NO: 1719321 - RNA, 21 nt, Homo sapiens
uuucagaagaaaggcauugca

SEQ ID NO: 1719322 - RNA, 18 nt, Homo sapiens
uuuucaccuccaugucau

SEQ ID NO: 1719323 - RNA, 17 nt, Homo sapiens
aaaaauucucaguucuc

SEQ ID NO: 1719324 - RNA, 13 nt, Homo sapiens
aaaacacagguuu

SEQ ID NO: 1719325 - RNA, 16 nt, Homo sapiens
aaaacugaagcaucaa

SEQ ID NO: 1719326 - RNA, 15 nt, Homo sapiens
aaaauaaaaccacca

SEQ ID NO: 1719327 - RNA, 19 nt, Homo sapiens
aaaauuuuccuuuuagucu

SEQ ID NO: 1719328 - RNA, 21 nt, Homo sapiens
aaacuuccacaagagugaauu

SEQ ID NO: 1719329 - RNA, 20 nt, Homo sapiens
aaagcaguggcuccauuggu

SEQ ID NO: 1719330 - RNA, 18 nt, Homo sapiens
aaagucaagccacauggu

SEQ ID NO: 1719331 - RNA, 21 nt, Homo sapiens
aaaguguuaggauuacaggca

SEQ ID NO: 1719332 - RNA, 18 nt, Homo sapiens
aaaguucccacuccuuca

SEQ ID NO: 1719333 - RNA, 21 nt, Homo sapiens
aaauaauaaaauaaucauaca

SEQ ID NO: 1719334 - RNA, 23 nt, Homo sapiens
aaauuagaggacacuauugagag

SEQ ID NO: 1719335 - RNA, 23 nt, Homo sapiens
aaauuuuccuuuuagucuagccu

SEQ ID NO: 1719336 - RNA, 22 nt, Homo sapiens
aacaugcuugaauaacugagcu

SEQ ID NO: 1719337 - RNA, 23 nt, Homo sapiens
aacauuuguuccgugucuggcca

SEQ ID NO: 1719338 - RNA, 16 nt, Homo sapiens
aaccuaguucaaugug

SEQ ID NO: 1719339 - RNA, 19 nt, Homo sapiens
aaccuccaccuccggguuc

SEQ ID NO: 1719340 - RNA, 12 nt, Homo sapiens
aacuguucucuu

SEQ ID NO: 1719341 - RNA, 22 nt, Homo sapiens
aacuuagaggaaaagggcacag

SEQ ID NO: 1719342 - RNA, 17 nt, Homo sapiens
aagacuuaucaacauuu

SEQ ID NO: 1719343 - RNA, 14 nt, Homo sapiens
aagauguacuugug

SEQ ID NO: 1719344 - RNA, 12 nt, Homo sapiens
aagccacauggu

SEQ ID NO: 1719345 - RNA, 22 nt, Homo sapiens
aagccacauggugacuuuugaa

SEQ ID NO: 1719346 - RNA, 23 nt, Homo sapiens
aagcuuuuguaaaauaaaaccac

SEQ ID NO: 1719347 - RNA, 15 nt, Homo sapiens
aaggaaccaaagcga

SEQ ID NO: 1719348 - RNA, 22 nt, Homo sapiens
aaguguuaggauuacaggcaug

SEQ ID NO: 1719349 - RNA, 19 nt, Homo sapiens
aauaaaggaaccauaauca

SEQ ID NO: 1719350 - RNA, 12 nt, Homo sapiens
aauaagugccag

SEQ ID NO: 1719351 - RNA, 20 nt, Homo sapiens
aauacacaauccuccaagaa

SEQ ID NO: 1719352 - RNA, 21 nt, Homo sapiens
aaucccaucuauucucugccu

SEQ ID NO: 1719353 - RNA, 16 nt, Homo sapiens
aaucuucuaauuccaa

SEQ ID NO: 1719354 - RNA, 22 nt, Homo sapiens
aaugaggcugcuuuccaaagcc

SEQ ID NO: 1719355 - RNA, 20 nt, Homo sapiens
aauguaaaguaagacaucuc

SEQ ID NO: 1719356 - RNA, 20 nt, Homo sapiens
aauguacguuacagcuuuca

SEQ ID NO: 1719357 - RNA, 19 nt, Homo sapiens
aauucuggacaacccaagu

SEQ ID NO: 1719358 - RNA, 22 nt, Homo sapiens
acaauccuccaagaauuugacu

SEQ ID NO: 1719359 - RNA, 14 nt, Homo sapiens
acacagacccgcug

SEQ ID NO: 1719360 - RNA, 15 nt, Homo sapiens
acacccagugccagg

SEQ ID NO: 1719361 - RNA, 16 nt, Homo sapiens
acaccggguuccagca

SEQ ID NO: 1719362 - RNA, 23 nt, Homo sapiens
acagacacucccacuuggcauca

SEQ ID NO: 1719363 - RNA, 13 nt, Homo sapiens
acaucuacuacag

SEQ ID NO: 1719364 - RNA, 16 nt, Homo sapiens
acauggugacuuuuga

SEQ ID NO: 1719365 - RNA, 12 nt, Homo sapiens
acauuuguucca

SEQ ID NO: 1719366 - RNA, 18 nt, Homo sapiens
accaaaugcuuuuccuca

SEQ ID NO: 1719367 - RNA, 19 nt, Homo sapiens
accaaaugcuuuuccucaa

SEQ ID NO: 1719368 - RNA, 21 nt, Homo sapiens
accaaauuagcaggugcaccu

SEQ ID NO: 1719369 - RNA, 15 nt, Homo sapiens
accacacagccaagg

SEQ ID NO: 1719370 - RNA, 21 nt, Homo sapiens
acccauuucuacuuuuugcac

SEQ ID NO: 1719371 - RNA, 20 nt, Homo sapiens
acccccccuccugcugccua

SEQ ID NO: 1719372 - RNA, 15 nt, Homo sapiens
accccucauccaaag

SEQ ID NO: 1719373 - RNA, 16 nt, Homo sapiens
acccugagccugugug

SEQ ID NO: 1719374 - RNA, 15 nt, Homo sapiens
accuccacauaccug

SEQ ID NO: 1719375 - RNA, 15 nt, Homo sapiens
accucgggugaucca

SEQ ID NO: 1719376 - RNA, 14 nt, Homo sapiens
accugugugccagg

SEQ ID NO: 1719377 - RNA, 15 nt, Homo sapiens
acgcagaucacuaaa

SEQ ID NO: 1719378 - RNA, 21 nt, Homo sapiens
acgucccccaaaacgugcaug

SEQ ID NO: 1719379 - RNA, 22 nt, Homo sapiens
acgucccccaaaacgugcaugg

SEQ ID NO: 1719380 - RNA, 12 nt, Homo sapiens
acuaaaguauau

SEQ ID NO: 1719381 - RNA, 12 nt, Homo sapiens
acuaaccuggua

SEQ ID NO: 1719382 - RNA, 14 nt, Homo sapiens
acuaacuguuuaca

SEQ ID NO: 1719383 - RNA, 21 nt, Homo sapiens
acuauauguugaccauuccaa

SEQ ID NO: 1719384 - RNA, 16 nt, Homo sapiens
acucaggcccaaagcc

SEQ ID NO: 1719385 - RNA, 14 nt, Homo sapiens
acucaggggucauu

SEQ ID NO: 1719386 - RNA, 18 nt, Homo sapiens
acucagucuuuaaucuga

SEQ ID NO: 1719387 - RNA, 16 nt, Homo sapiens
acucccagcagguaug

SEQ ID NO: 1719388 - RNA, 14 nt, Homo sapiens
acuccuccuagcca

SEQ ID NO: 1719389 - RNA, 14 nt, Homo sapiens
acucuccaccacac

SEQ ID NO: 1719390 - RNA, 21 nt, Homo sapiens
acucuggagguuuguuuagaa

SEQ ID NO: 1719391 - RNA, 13 nt, Homo sapiens
acugcuguagaca

SEQ ID NO: 1719392 - RNA, 20 nt, Homo sapiens
acugcuguagacauuugcua

SEQ ID NO: 1719393 - RNA, 19 nt, Homo sapiens
acuggccccugagaucucu

SEQ ID NO: 1719394 - RNA, 20 nt, Homo sapiens
acuguucaguuuagcauuaa

SEQ ID NO: 1719395 - RNA, 17 nt, Homo sapiens
acuuaaaagaacaugua

SEQ ID NO: 1719396 - RNA, 14 nt, Homo sapiens
acuuaaacuuccac

SEQ ID NO: 1719397 - RNA, 16 nt, Homo sapiens
acuucccauuuacucu

SEQ ID NO: 1719398 - RNA, 20 nt, Homo sapiens
acuucccuacccuaccccca

SEQ ID NO: 1719399 - RNA, 22 nt, Homo sapiens
acuuguguauauuuuaaugaau

SEQ ID NO: 1719400 - RNA, 21 nt, Homo sapiens
agaaacaccacccauuucuac

SEQ ID NO: 1719401 - RNA, 21 nt, Homo sapiens
agaacgagaccugugugccag

SEQ ID NO: 1719402 - RNA, 14 nt, Homo sapiens
agaauaaacuggca

SEQ ID NO: 1719403 - RNA, 21 nt, Homo sapiens
agaaucagagcuggauucaau

SEQ ID NO: 1719404 - RNA, 22 nt, Homo sapiens
agacaucucaggauuucaccag

SEQ ID NO: 1719405 - RNA, 23 nt, Homo sapiens
agacaugucuagccacugaucau

SEQ ID NO: 1719406 - RNA, 17 nt, Homo sapiens
agagcugaacuauuaga

SEQ ID NO: 1719407 - RNA, 21 nt, Homo sapiens
agagcugugcaucagcuagaa

SEQ ID NO: 1719408 - RNA, 13 nt, Homo sapiens
agaguagugcuug

SEQ ID NO: 1719409 - RNA, 23 nt, Homo sapiens
agagucuucuccaauguccaaaa

SEQ ID NO: 1719410 - RNA, 16 nt, Homo sapiens
cacugugaugcuuuau

SEQ ID NO: 1719411 - RNA, 17 nt, Homo sapiens
cacuguucaguuuagca

SEQ ID NO: 1719412 - RNA, 15 nt, Homo sapiens
cacuugcaugaauua

SEQ ID NO: 1719413 - RNA, 21 nt, Homo sapiens
cagaaugaggcugcuuuccaa

SEQ ID NO: 1719414 - RNA, 14 nt, Homo sapiens
cagacccgcuggac

SEQ ID NO: 1719415 - RNA, 17 nt, Homo sapiens
cagacuggagugcagug

SEQ ID NO: 1719416 - RNA, 13 nt, Homo sapiens
cagaggacaguau

SEQ ID NO: 1719417 - RNA, 14 nt, Homo sapiens
cagcacugugaugc

SEQ ID NO: 1719418 - RNA, 18 nt, Homo sapiens
cagcuggaguucaugucg

SEQ ID NO: 1719419 - RNA, 14 nt, Homo sapiens
cagcugguggagca

SEQ ID NO: 1719420 - RNA, 18 nt, Homo sapiens
caggaaauggcuguggag

SEQ ID NO: 1719421 - RNA, 18 nt, Homo sapiens
caggaggcggcagugcaa

SEQ ID NO: 1719422 - RNA, 19 nt, Homo sapiens
caggccgagaugugcaaca

SEQ ID NO: 1719423 - RNA, 18 nt, Homo sapiens
caggcuggucuugaacuc

SEQ ID NO: 1719424 - RNA, 18 nt, Homo sapiens
cagggauucuuccugcuu

SEQ ID NO: 1719425 - RNA, 18 nt, Homo sapiens
cagggucucacucuguca

SEQ ID NO: 1719426 - RNA, 20 nt, Homo sapiens
caggguuuugccauguugcc

SEQ ID NO: 1719427 - RNA, 21 nt, Homo sapiens
caggugugacccacugcgcac

SEQ ID NO: 1719428 - RNA, 17 nt, Homo sapiens
caguaaccuagugaauu

SEQ ID NO: 1719429 - RNA, 22 nt, Homo sapiens
cagugacugaggggccuggcuc

SEQ ID NO: 1719430 - RNA, 23 nt, Homo sapiens
cauaaauuuaugguucucaggcc

SEQ ID NO: 1719431 - RNA, 21 nt, Homo sapiens
cauaccuggcccugugccuug

SEQ ID NO: 1719432 - RNA, 14 nt, Homo sapiens
cauagcagcagugc

SEQ ID NO: 1719433 - RNA, 16 nt, Homo sapiens
cauagcagcagugcau

SEQ ID NO: 1719434 - RNA, 20 nt, Homo sapiens
cauaucuaaagcuuuggaca

SEQ ID NO: 1719435 - RNA, 23 nt, Homo sapiens
cauauuuuuaguagagacagggu

SEQ ID NO: 1719436 - RNA, 17 nt, Homo sapiens
cauccauagcaccucca

SEQ ID NO: 1719437 - RNA, 18 nt, Homo sapiens
caucuacuacagcacugu

SEQ ID NO: 1719438 - RNA, 14 nt, Homo sapiens
caucuguaccucug

SEQ ID NO: 1719439 - RNA, 17 nt, Homo sapiens
cauggauaugugccagg

SEQ ID NO: 1719440 - RNA, 21 nt, Homo sapiens
cauuuacucuugagacuacuu

SEQ ID NO: 1719441 - RNA, 17 nt, Homo sapiens
ccaacagagcugggcua

SEQ ID NO: 1719442 - RNA, 14 nt, Homo sapiens
ccaagugauaauuu

SEQ ID NO: 1719443 - RNA, 19 nt, Homo sapiens
ccaauguccaaaaggcuag

SEQ ID NO: 1719444 - RNA, 17 nt, Homo sapiens
ccaauuauuacaguccu

SEQ ID NO: 1719445 - RNA, 20 nt, Homo sapiens
ccaauuauuacaguccuuca

SEQ ID NO: 1719446 - RNA, 16 nt, Homo sapiens
ccacaagagugaauuu

SEQ ID NO: 1719447 - RNA, 14 nt, Homo sapiens
ccacauaccuggcc

SEQ ID NO: 1719448 - RNA, 13 nt, Homo sapiens
ccacauggugacu

SEQ ID NO: 1719449 - RNA, 18 nt, Homo sapiens
ccaccucugcaggggaga

SEQ ID NO: 1719450 - RNA, 18 nt, Homo sapiens
ccacucaggggucauuca

SEQ ID NO: 1719451 - RNA, 19 nt, Homo sapiens
ccacucaggggucauucau

SEQ ID NO: 1719452 - RNA, 18 nt, Homo sapiens
ccacuccuccuagccacc

SEQ ID NO: 1719453 - RNA, 18 nt, Homo sapiens
ccagaaguuacagaugag

SEQ ID NO: 1719454 - RNA, 20 nt, Homo sapiens
ccagaggaagggacaccaag

SEQ ID NO: 1719455 - RNA, 21 nt, Homo sapiens
ccaggaggcggcagugcaaca

SEQ ID NO: 1719456 - RNA, 19 nt, Homo sapiens
ccaggcugcagugcaaugg

SEQ ID NO: 1719457 - RNA, 11 nt, Homo sapiens
ccagugccagg

SEQ ID NO: 1719458 - RNA, 18 nt, Homo sapiens
ccauagcagcagugcaug

SEQ ID NO: 1719459 - RNA, 23 nt, Homo sapiens
ccauuccaaaguucuuaucucua

SEQ ID NO: 1719460 - RNA, 18 nt, Homo sapiens
cccaggcugcagugcaau

SEQ ID NO: 1719461 - RNA, 14 nt, Homo sapiens
cccaucuauucucu

SEQ ID NO: 1719462 - RNA, 17 nt, Homo sapiens
cccugaguuccuagcca

SEQ ID NO: 1719463 - RNA, 18 nt, Homo sapiens
cccugaguuccuagccac

SEQ ID NO: 1719464 - RNA, 16 nt, Homo sapiens
cccugccugguccuca

SEQ ID NO: 1719465 - RNA, 19 nt, Homo sapiens
ccggccuccugucccucau

SEQ ID NO: 1719466 - RNA, 20 nt, Homo sapiens
ccgggucaucuguaccucug

SEQ ID NO: 1719467 - RNA, 23 nt, Homo sapiens
ccucacaauuaggcuucauugca

SEQ ID NO: 1719468 - RNA, 19 nt, Homo sapiens
ccuccaccuccggguucaa

SEQ ID NO: 1719469 - RNA, 21 nt, Homo sapiens
ccuccaccugcucugugccca

SEQ ID NO: 1719470 - RNA, 21 nt, Homo sapiens
ccucccaaaguguuaggauua

SEQ ID NO: 1719471 - RNA, 15 nt, Homo sapiens
ccuccugucccucau

SEQ ID NO: 1719472 - RNA, 18 nt, Homo sapiens
ccuccugucccucaucca

SEQ ID NO: 1719473 - RNA, 13 nt, Homo sapiens
ccucuauaaacuu

SEQ ID NO: 1719474 - RNA, 19 nt, Homo sapiens
ccucugauuucaguucacu

SEQ ID NO: 1719475 - RNA, 15 nt, Homo sapiens
ccugcucugugccca

SEQ ID NO: 1719476 - RNA, 15 nt, Homo sapiens
ccuggucagcccaaa

SEQ ID NO: 1719477 - RNA, 17 nt, Homo sapiens
ccugguccucacacuca

SEQ ID NO: 1719478 - RNA, 22 nt, Homo sapiens
ccugguccucacacucacccaa

SEQ ID NO: 1719479 - RNA, 14 nt, Homo sapiens
ccuucagauuugcc

SEQ ID NO: 1719480 - RNA, 18 nt, Homo sapiens
ccuucuuacucuccucuu

SEQ ID NO: 1719481 - RNA, 13 nt, Homo sapiens
ccuugugaaggaa

SEQ ID NO: 1719482 - RNA, 13 nt, Homo sapiens
cgcagcgcaggac

SEQ ID NO: 1719483 - RNA, 15 nt, Homo sapiens
cgccaacgagcagug

SEQ ID NO: 1719484 - RNA, 19 nt, Homo sapiens
cggccucccuaguagcugg

SEQ ID NO: 1719485 - RNA, 13 nt, Homo sapiens
cgugcuaccugca

SEQ ID NO: 1719486 - RNA, 19 nt, Homo sapiens
cuaaguaaagcacaguccc

SEQ ID NO: 1719487 - RNA, 15 nt, Homo sapiens
cuaauuccacacccu

SEQ ID NO: 1719488 - RNA, 13 nt, Homo sapiens
cuaccucuuggcu

SEQ ID NO: 1719489 - RNA, 18 nt, Homo sapiens
cuacucacuucuccuuua

SEQ ID NO: 1719490 - RNA, 15 nt, Homo sapiens
cuacuuuuugcaccu

SEQ ID NO: 1719491 - RNA, 15 nt, Homo sapiens
cuagcauuucuucca

SEQ ID NO: 1719492 - RNA, 11 nt, Homo sapiens
cuaugguucuc

SEQ ID NO: 1719493 - RNA, 13 nt, Homo sapiens
cucaaaacuguau

SEQ ID NO: 1719494 - RNA, 17 nt, Homo sapiens
cucacugcaaccuccac

SEQ ID NO: 1719495 - RNA, 15 nt, Homo sapiens
cucagaucauuauca

SEQ ID NO: 1719496 - RNA, 19 nt, Homo sapiens
cucaggccugcgagaagac

SEQ ID NO: 1719497 - RNA, 23 nt, Homo sapiens
cucaucaggccauugucccugaa

SEQ ID NO: 1719498 - RNA, 18 nt, Homo sapiens
cuccaccaagccugguca

SEQ ID NO: 1719499 - RNA, 20 nt, Homo sapiens
cuccaccugcucugugccca

SEQ ID NO: 1719500 - RNA, 19 nt, Homo sapiens
cucccaaagugcugggauu

SEQ ID NO: 1719501 - RNA, 20 nt, Homo sapiens
cucccaaaguguuaggauua

SEQ ID NO: 1719502 - RNA, 16 nt, Homo sapiens
cucccaccuccuggug

SEQ ID NO: 1719503 - RNA, 13 nt, Homo sapiens
cuccuccuagcca

SEQ ID NO: 1719504 - RNA, 19 nt, Homo sapiens
cuccucugauuucaguuca

SEQ ID NO: 1719505 - RNA, 13 nt, Homo sapiens
cuccugcagggau

SEQ ID NO: 1719506 - RNA, 23 nt, Homo sapiens
cuccuuuaccccucauccaaagu

SEQ ID NO: 1719507 - RNA, 21 nt, Homo sapiens
cucgcaagggaaguccuugca

SEQ ID NO: 1719508 - RNA, 11 nt, Homo sapiens
cucuccaagcc

SEQ ID NO: 1719509 - RNA, 11 nt, Homo sapiens
cucucucauga

SEQ ID NO: 1719510 - RNA, 16 nt, Homo sapiens
cucucuccucuuugau

SEQ ID NO: 1719511 - RNA, 17 nt, Homo sapiens
cucugccucccaaagug

SEQ ID NO: 1719512 - RNA, 18 nt, Homo sapiens
cucuugauuaagaucuca

SEQ ID NO: 1719513 - RNA, 19 nt, Homo sapiens
cucuuuuaggaggcacaac

SEQ ID NO: 1719514 - RNA, 13 nt, Homo sapiens
cugaaggaaccaa

SEQ ID NO: 1719515 - RNA, 17 nt, Homo sapiens
cugccacucaggcccaa

SEQ ID NO: 1719516 - RNA, 19 nt, Homo sapiens
cugccacucaggcccaaag

SEQ ID NO: 1719517 - RNA, 15 nt, Homo sapiens
cugccagacccccug

SEQ ID NO: 1719518 - RNA, 14 nt, Homo sapiens
cugccucugccucc

SEQ ID NO: 1719519 - RNA, 21 nt, Homo sapiens
cugcucugugcccacccucca

SEQ ID NO: 1719520 - RNA, 21 nt, Homo sapiens
cuggagacuaaccccaccaca

SEQ ID NO: 1719521 - RNA, 21 nt, Homo sapiens
cuggcaguaaccuagugaauu

SEQ ID NO: 1719522 - RNA, 12 nt, Homo sapiens
cuggcccugugc

SEQ ID NO: 1719523 - RNA, 16 nt, Homo sapiens
cugggagccuacccac

SEQ ID NO: 1719524 - RNA, 18 nt, Homo sapiens
cuggucuugaacuccuaa

SEQ ID NO: 1719525 - RNA, 22 nt, Homo sapiens
cuguauauaaaucuucaaagcu

SEQ ID NO: 1719526 - RNA, 17 nt, Homo sapiens
cugugcccacccuccac

SEQ ID NO: 1719527 - RNA, 20 nt, Homo sapiens
gcaggacauuuggcugugau

SEQ ID NO: 1719528 - RNA, 18 nt, Homo sapiens
gcagguccccagacucca

SEQ ID NO: 1719529 - RNA, 11 nt, Homo sapiens
gcagugcaaca

SEQ ID NO: 1719530 - RNA, 17 nt, Homo sapiens
gcagugcaacaacccca

SEQ ID NO: 1719531 - RNA, 22 nt, Homo sapiens
gcaguggcacgaucucggcuca

SEQ ID NO: 1719532 - RNA, 13 nt, Homo sapiens
gcaucacccagcu

SEQ ID NO: 1719533 - RNA, 17 nt, Homo sapiens
gcaucucccaguucaua

SEQ ID NO: 1719534 - RNA, 14 nt, Homo sapiens
gccacagugcaauu

SEQ ID NO: 1719535 - RNA, 19 nt, Homo sapiens
gccacucaggcccaaagcc

SEQ ID NO: 1719536 - RNA, 20 nt, Homo sapiens
gccacucaggcccaaagccu

SEQ ID NO: 1719537 - RNA, 19 nt, Homo sapiens
gcccagaauaaacuggcag

SEQ ID NO: 1719538 - RNA, 18 nt, Homo sapiens
gcccccauuuccucgggu

SEQ ID NO: 1719539 - RNA, 22 nt, Homo sapiens
gcccucuacagccugacuuucu

SEQ ID NO: 1719540 - RNA, 22 nt, Homo sapiens
gcccuugacaaagucaagccac

SEQ ID NO: 1719541 - RNA, 16 nt, Homo sapiens
gccucccuaguagcug

SEQ ID NO: 1719542 - RNA, 16 nt, Homo sapiens
gccuccugucccucau

SEQ ID NO: 1719543 - RNA, 21 nt, Homo sapiens
gccuccuuuccccucccucag

SEQ ID NO: 1719544 - RNA, 15 nt, Homo sapiens
gccuuauuggcagcu

SEQ ID NO: 1719545 - RNA, 13 nt, Homo sapiens
gccuuuacuauau

SEQ ID NO: 1719546 - RNA, 19 nt, Homo sapiens
gcguggagaaguggugcuc

SEQ ID NO: 1719547 - RNA, 14 nt, Homo sapiens
gcuauuuucauuua

SEQ ID NO: 1719548 - RNA, 11 nt, Homo sapiens
gcucacugcaa

SEQ ID NO: 1719549 - RNA, 21 nt, Homo sapiens
gcucaugcacaucagcuggug

SEQ ID NO: 1719550 - RNA, 20 nt, Homo sapiens
gcuccauugguguugacaua

SEQ ID NO: 1719551 - RNA, 19 nt, Homo sapiens
gcucuacccugaguucaua

SEQ ID NO: 1719552 - RNA, 14 nt, Homo sapiens
gcucuuucacagcu

SEQ ID NO: 1719553 - RNA, 13 nt, Homo sapiens
gcugacccccaua

SEQ ID NO: 1719554 - RNA, 18 nt, Homo sapiens
gcugcuuuccaaagccaa

SEQ ID NO: 1719555 - RNA, 19 nt, Homo sapiens
gcugcuuuccaaagccaau

SEQ ID NO: 1719556 - RNA, 23 nt, Homo sapiens
gcugcuuuccaaagccaauguga

SEQ ID NO: 1719557 - RNA, 24 nt, Homo sapiens
ggaaaagaaaucuaugauuccagg

SEQ ID NO: 1719558 - RNA, 23 nt, Homo sapiens
ggaaccccaggaggccugcagcc

SEQ ID NO: 1719559 - RNA, 19 nt, Homo sapiens
ggaagagcuguguggccug

SEQ ID NO: 1719560 - RNA, 23 nt, Homo sapiens
ggaauauagucaguaauuuaucu

SEQ ID NO: 1719561 - RNA, 16 nt, Homo sapiens
ggaauuauucccauga

SEQ ID NO: 1719562 - RNA, 15 nt, Homo sapiens
ggagagagugcuauu

SEQ ID NO: 1719563 - RNA, 16 nt, Homo sapiens
ggaggcggcagugcaa

SEQ ID NO: 1719564 - RNA, 15 nt, Homo sapiens
ggaugucucucauga

SEQ ID NO: 1719565 - RNA, 17 nt, Homo sapiens
ggauuugcucagugucu

SEQ ID NO: 1719566 - RNA, 16 nt, Homo sapiens
ggcagcucagcuguuu

SEQ ID NO: 1719567 - RNA, 19 nt, Homo sapiens
ggcagguccccagacucca

SEQ ID NO: 1719568 - RNA, 13 nt, Homo sapiens
ggcaucagugucu

SEQ ID NO: 1719569 - RNA, 19 nt, Homo sapiens
ggcccagaguuuacauucu

SEQ ID NO: 1719570 - RNA, 15 nt, Homo sapiens
ggccgagaugugcaa

SEQ ID NO: 1719571 - RNA, 17 nt, Homo sapiens
ggccuccugucccucau

SEQ ID NO: 1719572 - RNA, 20 nt, Homo sapiens
ggcugaggccucucauucca

SEQ ID NO: 1719573 - RNA, 13 nt, Homo sapiens
ggcugcuuuccaa

SEQ ID NO: 1719574 - RNA, 20 nt, Homo sapiens
gggaaccggcagcaucccag

SEQ ID NO: 1719575 - RNA, 13 nt, Homo sapiens
gggauuacaggcg

SEQ ID NO: 1719576 - RNA, 16 nt, Homo sapiens
gggauuggcugugagg

SEQ ID NO: 1719577 - RNA, 14 nt, Homo sapiens
gggcucucucauga

SEQ ID NO: 1719578 - RNA, 12 nt, Homo sapiens
ggggcgugcaug

SEQ ID NO: 1719579 - RNA, 13 nt, Homo sapiens
ggggcucucucau

SEQ ID NO: 1719580 - RNA, 21 nt, Homo sapiens
ggguguggucuccacugggga

SEQ ID NO: 1719581 - RNA, 21 nt, Homo sapiens
gguacagacacucccacuugg

SEQ ID NO: 1719582 - RNA, 22 nt, Homo sapiens
uauuucccugaaggaaccaaag

SEQ ID NO: 1719583 - RNA, 19 nt, Homo sapiens
uauuuuaagagaaaacugc

SEQ ID NO: 1719584 - RNA, 14 nt, Homo sapiens
uauuuuucucauga

SEQ ID NO: 1719585 - RNA, 22 nt, Homo sapiens
ucaaagggagagagugcuauug

SEQ ID NO: 1719586 - RNA, 14 nt, Homo sapiens
ucaagccacauggu

SEQ ID NO: 1719587 - RNA, 14 nt, Homo sapiens
ucaagccauucugc

SEQ ID NO: 1719588 - RNA, 15 nt, Homo sapiens
ucaagcgauucuugu

SEQ ID NO: 1719589 - RNA, 17 nt, Homo sapiens
ucaauuccuguccuuca

SEQ ID NO: 1719590 - RNA, 15 nt, Homo sapiens
ucacccagcucacgu

SEQ ID NO: 1719591 - RNA, 20 nt, Homo sapiens
ucacccaggcugcagugcaa

SEQ ID NO: 1719592 - RNA, 14 nt, Homo sapiens
ucagcuuggggaca

SEQ ID NO: 1719593 - RNA, 15 nt, Homo sapiens
ucaggcccaaagccu

SEQ ID NO: 1719594 - RNA, 11 nt, Homo sapiens
ucaguaugugg

SEQ ID NO: 1719595 - RNA, 12 nt, Homo sapiens
ucaguaugugga

SEQ ID NO: 1719596 - RNA, 18 nt, Homo sapiens
ucagucuuuaaucugaga

SEQ ID NO: 1719597 - RNA, 15 nt, Homo sapiens
ucauaaucacaaccc

SEQ ID NO: 1719598 - RNA, 12 nt, Homo sapiens
ucauacacauga

SEQ ID NO: 1719599 - RNA, 20 nt, Homo sapiens
ucaucaugaagcguggagac

SEQ ID NO: 1719600 - RNA, 20 nt, Homo sapiens
ucauuauuuaaccuaguuca

SEQ ID NO: 1719601 - RNA, 11 nt, Homo sapiens
uccaaagccaa

SEQ ID NO: 1719602 - RNA, 18 nt, Homo sapiens
uccaauuauuacaguccu

SEQ ID NO: 1719603 - RNA, 17 nt, Homo sapiens
uccacacccucacugcu

SEQ ID NO: 1719604 - RNA, 19 nt, Homo sapiens
uccaccuccggguucaagc

SEQ ID NO: 1719605 - RNA, 17 nt, Homo sapiens
uccacucuccucuucca

SEQ ID NO: 1719606 - RNA, 16 nt, Homo sapiens
uccaggcuggggccau

SEQ ID NO: 1719607 - RNA, 22 nt, Homo sapiens
ucccauuuacucuugagacuac

SEQ ID NO: 1719608 - RNA, 23 nt, Homo sapiens
ucccccuccaccugcucugugcc

SEQ ID NO: 1719609 - RNA, 13 nt, Homo sapiens
uccccuacuacac

SEQ ID NO: 1719610 - RNA, 13 nt, Homo sapiens
uccccucaaccca

SEQ ID NO: 1719611 - RNA, 19 nt, Homo sapiens
ucccucaggccgaaggagg

SEQ ID NO: 1719612 - RNA, 18 nt, Homo sapiens
ucccugaagagaagggca

SEQ ID NO: 1719613 - RNA, 22 nt, Homo sapiens
uccgaacuacuguuauaauuau

SEQ ID NO: 1719614 - RNA, 20 nt, Homo sapiens
uccuaaccucgggugaucca

SEQ ID NO: 1719615 - RNA, 18 nt, Homo sapiens
uccuagccacccaccaca

SEQ ID NO: 1719616 - RNA, 22 nt, Homo sapiens
uccucaaagggagagagugcua

SEQ ID NO: 1719617 - RNA, 14 nt, Homo sapiens
uccucggguaccaa

SEQ ID NO: 1719618 - RNA, 15 nt, Homo sapiens
uccugccucuuugag

SEQ ID NO: 1719619 - RNA, 13 nt, Homo sapiens
uccugcugccuaa

SEQ ID NO: 1719620 - RNA, 13 nt, Homo sapiens
uccugucccucau

SEQ ID NO: 1719621 - RNA, 12 nt, Homo sapiens
uccuguccuuca

SEQ ID NO: 1719622 - RNA, 15 nt, Homo sapiens
uccuuaacuucaggg

SEQ ID NO: 1719623 - RNA, 17 nt, Homo sapiens
uccuuuaaauucuuucc

SEQ ID NO: 1719624 - RNA, 19 nt, Homo sapiens
uccuuuaccccucauccaa

SEQ ID NO: 1719625 - RNA, 21 nt, Homo sapiens
uccuuuccccucccucaggcc

SEQ ID NO: 1719626 - RNA, 17 nt, Homo sapiens
ucgauauccugaucucg

SEQ ID NO: 1719627 - RNA, 17 nt, Homo sapiens
ucuacugcugcugacau

SEQ ID NO: 1719628 - RNA, 18 nt, Homo sapiens
ucucaggccugacucuca

SEQ ID NO: 1719629 - RNA, 13 nt, Homo sapiens
ucucauuccagag

SEQ ID NO: 1719630 - RNA, 20 nt, Homo sapiens
ucuccaagcccaguucagcu

SEQ ID NO: 1719631 - RNA, 23 nt, Homo sapiens
ucuccacaggcaggcucauuuca

SEQ ID NO: 1719632 - RNA, 18 nt, Homo sapiens
ucuccucuucuagcauuu

SEQ ID NO: 1719633 - RNA, 16 nt, Homo sapiens
ucucucgcaagggaag

SEQ ID NO: 1719634 - RNA, 12 nt, Homo sapiens
ucugaaguacuu

SEQ ID NO: 1719635 - RNA, 10 nt, Homo sapiens
ucugccaggc

SEQ ID NO: 1719636 - RNA, 20 nt, Homo sapiens
accaucucuuuaccuccuaa

SEQ ID NO: 1719637 - RNA, 14 nt, Homo sapiens
accauuccaaaguu

SEQ ID NO: 1719638 - RNA, 19 nt, Homo sapiens
acccaggcugcagugcaau

SEQ ID NO: 1719639 - RNA, 13 nt, Homo sapiens
acccagugccagg

SEQ ID NO: 1719640 - RNA, 16 nt, Homo sapiens
acccccaggaccccug

SEQ ID NO: 1719641 - RNA, 18 nt, Homo sapiens
acccgguguaugccaagu

SEQ ID NO: 1719642 - RNA, 23 nt, Homo sapiens
accuccuaauuccacacccucac

SEQ ID NO: 1719643 - RNA, 17 nt, Homo sapiens
accuccuggugguacca

SEQ ID NO: 1719644 - RNA, 17 nt, Homo sapiens
accucuuggcugccuug

SEQ ID NO: 1719645 - RNA, 13 nt, Homo sapiens
accuuggccuccc

SEQ ID NO: 1719646 - RNA, 20 nt, Homo sapiens
accuuggccucccaaagugu

SEQ ID NO: 1719647 - RNA, 15 nt, Homo sapiens
accuuuccugaggaa

SEQ ID NO: 1719648 - RNA, 18 nt, Homo sapiens
acguaaugaaacuuggau

SEQ ID NO: 1719649 - RNA, 19 nt, Homo sapiens
acgugcauggauaugugcc

SEQ ID NO: 1719650 - RNA, 22 nt, Homo sapiens
acuacagcgccaacgagcagug

SEQ ID NO: 1719651 - RNA, 16 nt, Homo sapiens
acuacauaucuaaagc

SEQ ID NO: 1719652 - RNA, 16 nt, Homo sapiens
acucaggggucauuca

SEQ ID NO: 1719653 - RNA, 12 nt, Homo sapiens
acuccuucagga

SEQ ID NO: 1719654 - RNA, 15 nt, Homo sapiens
acucucuugauuaag

SEQ ID NO: 1719655 - RNA, 17 nt, Homo sapiens
acugaaccacucuccca

SEQ ID NO: 1719656 - RNA, 16 nt, Homo sapiens
acugcugggcuuggca

SEQ ID NO: 1719657 - RNA, 18 nt, Homo sapiens
acuggcaguaaccuagug

SEQ ID NO: 1719658 - RNA, 13 nt, Homo sapiens
acuuccacaagag

SEQ ID NO: 1719659 - RNA, 14 nt, Homo sapiens
acuucccauuuacu

SEQ ID NO: 1719660 - RNA, 18 nt, Homo sapiens
acuucuccuuuaaauucu

SEQ ID NO: 1719661 - RNA, 21 nt, Homo sapiens
acuuguaaauaaaggaaccau

SEQ ID NO: 1719662 - RNA, 19 nt, Homo sapiens
acuuguuuucacuuuauca

SEQ ID NO: 1719663 - RNA, 21 nt, Homo sapiens
acuuuaucaaagagaaguuac

SEQ ID NO: 1719664 - RNA, 22 nt, Homo sapiens
agaaagacuuaucaacauuugu

SEQ ID NO: 1719665 - RNA, 21 nt, Homo sapiens
agaaaggacccucaagacaaa

SEQ ID NO: 1719666 - RNA, 15 nt, Homo sapiens
agaaggcuaugggga

SEQ ID NO: 1719667 - RNA, 14 nt, Homo sapiens
agaaugaggcugcu

SEQ ID NO: 1719668 - RNA, 15 nt, Homo sapiens
agacagggucucacu

SEQ ID NO: 1719669 - RNA, 18 nt, Homo sapiens
agacauuugcuaugagcu

SEQ ID NO: 1719670 - RNA, 16 nt, Homo sapiens
agaccugugugccagg

SEQ ID NO: 1719671 - RNA, 19 nt, Homo sapiens
agacuucucugugaacuuc

SEQ ID NO: 1719672 - RNA, 20 nt, Homo sapiens
agagaauaaacuagaucuag

SEQ ID NO: 1719673 - RNA, 11 nt, Homo sapiens
agagacagggu

SEQ ID NO: 1719674 - RNA, 23 nt, Homo sapiens
agagcugccugugccuuuugcca

SEQ ID NO: 1719675 - RNA, 22 nt, Homo sapiens
agagggggcgauauagagaaua

SEQ ID NO: 1719676 - RNA, 14 nt, Homo sapiens
agagugagguggaa

SEQ ID NO: 1719677 - RNA, 21 nt, Homo sapiens
agagugggguagguugggaga

SEQ ID NO: 1719678 - RNA, 17 nt, Homo sapiens
agauaaaagauguacuu

SEQ ID NO: 1719679 - RNA, 17 nt, Homo sapiens
agaugaggcacuggaag

SEQ ID NO: 1719680 - RNA, 12 nt, Homo sapiens
agaugugcaaca

SEQ ID NO: 1719681 - RNA, 14 nt, Homo sapiens
agaugugcaacacu

SEQ ID NO: 1719682 - RNA, 17 nt, Homo sapiens
agauguggaaaagccaa

SEQ ID NO: 1719683 - RNA, 20 nt, Homo sapiens
agauuuugcccuugacaaag

SEQ ID NO: 1719684 - RNA, 21 nt, Homo sapiens
agcaccaucucuuuaccuccu

SEQ ID NO: 1719685 - RNA, 16 nt, Homo sapiens
agccacuagcuugauu

SEQ ID NO: 1719686 - RNA, 22 nt, Homo sapiens
agccauucugccucagccuccc

SEQ ID NO: 1719687 - RNA, 21 nt, Homo sapiens
agcccagcucaugcacaucag

SEQ ID NO: 1719688 - RNA, 23 nt, Homo sapiens
agcccgggucaucuguaccucug

SEQ ID NO: 1719689 - RNA, 18 nt, Homo sapiens
agcccugaguuccuagcc

SEQ ID NO: 1719690 - RNA, 17 nt, Homo sapiens
agccuuggcucuacccu

SEQ ID NO: 1719691 - RNA, 22 nt, Homo sapiens
agcuccuccuuuacuuucucuc

SEQ ID NO: 1719692 - RNA, 22 nt, Homo sapiens
agcuuuuguaaaauaaaaccac

SEQ ID NO: 1719693 - RNA, 19 nt, Homo sapiens
aggaggcggcagugcaaca

SEQ ID NO: 1719694 - RNA, 14 nt, Homo sapiens
aggagucagggaga

SEQ ID NO: 1719695 - RNA, 21 nt, Homo sapiens
aggagucccugccaucauguu

SEQ ID NO: 1719696 - RNA, 18 nt, Homo sapiens
aggcacaacaguucucuu

SEQ ID NO: 1719697 - RNA, 18 nt, Homo sapiens
aggcaggcucauuucacu

SEQ ID NO: 1719698 - RNA, 17 nt, Homo sapiens
aggccagcaccaucucu

SEQ ID NO: 1719699 - RNA, 24 nt, Homo sapiens
aggccgagaugugcaacacucagg

SEQ ID NO: 1719700 - RNA, 16 nt, Homo sapiens
aggcggcagugcaaca

SEQ ID NO: 1719701 - RNA, 21 nt, Homo sapiens
aggcucccuccccauggggca

SEQ ID NO: 1719702 - RNA, 19 nt, Homo sapiens
aggcugaaaggaauauagu

SEQ ID NO: 1719703 - RNA, 16 nt, Homo sapiens
agggagagagugcuau

SEQ ID NO: 1719704 - RNA, 18 nt, Homo sapiens
agggauuuggggcucaga

SEQ ID NO: 1719705 - RNA, 21 nt, Homo sapiens
aggguugggcgugcuaccugc

SEQ ID NO: 1719706 - RNA, 17 nt, Homo sapiens
aguacuuaaacuuccac

SEQ ID NO: 1719707 - RNA, 15 nt, Homo sapiens
aguauguggaagugu

SEQ ID NO: 1719708 - RNA, 18 nt, Homo sapiens
agucaguaauuuaucuua

SEQ ID NO: 1719709 - RNA, 17 nt, Homo sapiens
agucccugccaucaugu

SEQ ID NO: 1719710 - RNA, 15 nt, Homo sapiens
agucuucuccaaugu

SEQ ID NO: 1719711 - RNA, 13 nt, Homo sapiens
agugagaagccag

SEQ ID NO: 1719712 - RNA, 20 nt, Homo sapiens
agugcaauggcgcgaucuca

SEQ ID NO: 1719713 - RNA, 20 nt, Homo sapiens
agugcaguggcacgaucucg

SEQ ID NO: 1719714 - RNA, 18 nt, Homo sapiens
agugcuaaacaaguaaga

SEQ ID NO: 1719715 - RNA, 15 nt, Homo sapiens
agugcuuuccaauuc

SEQ ID NO: 1719716 - RNA, 15 nt, Homo sapiens
aguggugcuccaagg

SEQ ID NO: 1719717 - RNA, 14 nt, Homo sapiens
aguuaaaaggcuga

SEQ ID NO: 1719718 - RNA, 15 nt, Homo sapiens
auaaaaccaccaaag

SEQ ID NO: 1719719 - RNA, 18 nt, Homo sapiens
auaaacaugcuugcauua

SEQ ID NO: 1719720 - RNA, 16 nt, Homo sapiens
auaaagagacugagcc

SEQ ID NO: 1719721 - RNA, 12 nt, Homo sapiens
auagaaugaacu

SEQ ID NO: 1719722 - RNA, 13 nt, Homo sapiens
auagaaugaacuu

SEQ ID NO: 1719723 - RNA, 15 nt, Homo sapiens
auagcaccuccacau

SEQ ID NO: 1719724 - RNA, 18 nt, Homo sapiens
auauaaacaugcuugcau

SEQ ID NO: 1719725 - RNA, 20 nt, Homo sapiens
auauagagaauaaggcacaa

SEQ ID NO: 1719726 - RNA, 23 nt, Homo sapiens
auaucuguccccugcuacuagau

SEQ ID NO: 1719727 - RNA, 19 nt, Homo sapiens
auaugauacucucagauuu

SEQ ID NO: 1719728 - RNA, 21 nt, Homo sapiens
auauuacuuguuuucacuuua

SEQ ID NO: 1719729 - RNA, 23 nt, Homo sapiens
auauuacuuguuuucacuuuauc

SEQ ID NO: 1719730 - RNA, 13 nt, Homo sapiens
aucauacaguucc

SEQ ID NO: 1719731 - RNA, 23 nt, Homo sapiens
auccagcccugaguuccuagcca

SEQ ID NO: 1719732 - RNA, 18 nt, Homo sapiens
auccuccaagaauuugac

SEQ ID NO: 1719733 - RNA, 20 nt, Homo sapiens
aucucaggauuucaccagaa

SEQ ID NO: 1719734 - RNA, 15 nt, Homo sapiens
aucucuuuaccuccu

SEQ ID NO: 1719735 - RNA, 13 nt, Homo sapiens
aucuggacuuccu

SEQ ID NO: 1719736 - RNA, 16 nt, Homo sapiens
aucuguccccugcuac

SEQ ID NO: 1719737 - RNA, 12 nt, Homo sapiens
aucuuacucuac

SEQ ID NO: 1719738 - RNA, 15 nt, Homo sapiens
augaaaugcuuccaa

SEQ ID NO: 1719739 - RNA, 22 nt, Homo sapiens
augagcuggggaugucucucau

SEQ ID NO: 1719740 - RNA, 23 nt, Homo sapiens
augagcuggggaugucucucaug

SEQ ID NO: 1719741 - RNA, 23 nt, Homo sapiens
augaggcugcuuuccaaagccaa

SEQ ID NO: 1719742 - RNA, 23 nt, Homo sapiens
augaugggggaaaaaaaguaauc

SEQ ID NO: 1719743 - RNA, 14 nt, Homo sapiens
augcucugugcaga

SEQ ID NO: 1719744 - RNA, 18 nt, Homo sapiens
augcugacauccaggugg

SEQ ID NO: 1719745 - RNA, 17 nt, Homo sapiens
augcugcucauccaaag

SEQ ID NO: 1719746 - RNA, 15 nt, Homo sapiens
augcuugcauuauau

SEQ ID NO: 1719747 - RNA, 17 nt, Homo sapiens
auggcuguggagugugg

SEQ ID NO: 1719748 - RNA, 22 nt, Homo sapiens
augggacccgguguaugccaag

SEQ ID NO: 1719749 - RNA, 16 nt, Homo sapiens
auggugacuuuugaaa

SEQ ID NO: 1719750 - RNA, 15 nt, Homo sapiens
auguaaguacuucca

SEQ ID NO: 1719751 - RNA, 16 nt, Homo sapiens
auguaaguacuuccac

SEQ ID NO: 1719752 - RNA, 21 nt, Homo sapiens
ucuccucugauuucaguucac

SEQ ID NO: 1719753 - RNA, 14 nt, Homo sapiens
ucuccucuuugaug

SEQ ID NO: 1719754 - RNA, 17 nt, Homo sapiens
ucuccucuuugauguca

SEQ ID NO: 1719755 - RNA, 13 nt, Homo sapiens
ucucucaugacca

SEQ ID NO: 1719756 - RNA, 15 nt, Homo sapiens
ucucuuuaccuccua

SEQ ID NO: 1719757 - RNA, 21 nt, Homo sapiens
ucugaaguacuuaaacuucca

SEQ ID NO: 1719758 - RNA, 12 nt, Homo sapiens
ucuucauuaccu

SEQ ID NO: 1719759 - RNA, 20 nt, Homo sapiens
ucuucauuaccucagugaga

SEQ ID NO: 1719760 - RNA, 21 nt, Homo sapiens
ucuuuccacuccuccuagcca

SEQ ID NO: 1719761 - RNA, 17 nt, Homo sapiens
ugaaaggaauauaguca

SEQ ID NO: 1719762 - RNA, 19 nt, Homo sapiens
ugaacuauuagagcugccu

SEQ ID NO: 1719763 - RNA, 15 nt, Homo sapiens
ugaauuucugaaaga

SEQ ID NO: 1719764 - RNA, 16 nt, Homo sapiens
ugacauacauccaaca

SEQ ID NO: 1719765 - RNA, 16 nt, Homo sapiens
ugacucucagcagcua

SEQ ID NO: 1719766 - RNA, 19 nt, Homo sapiens
ugagaggccacagugcaau

SEQ ID NO: 1719767 - RNA, 18 nt, Homo sapiens
ugagagugagguggaauu

SEQ ID NO: 1719768 - RNA, 13 nt, Homo sapiens
ugaggccucucau

SEQ ID NO: 1719769 - RNA, 15 nt, Homo sapiens
ugaggggcucucuca

SEQ ID NO: 1719770 - RNA, 20 nt, Homo sapiens
ugagggugacuauggagcug

SEQ ID NO: 1719771 - RNA, 17 nt, Homo sapiens
ugauuucaguucacugu

SEQ ID NO: 1719772 - RNA, 19 nt, Homo sapiens
ugcacuuuaugaaaacuga

SEQ ID NO: 1719773 - RNA, 22 nt, Homo sapiens
ugcaggaaauggcuguggagug

SEQ ID NO: 1719774 - RNA, 21 nt, Homo sapiens
ugcaggacauuuggcugugau

SEQ ID NO: 1719775 - RNA, 22 nt, Homo sapiens
ugcaggacauuuggcugugaug

SEQ ID NO: 1719776 - RNA, 16 nt, Homo sapiens
ugcauaauuauauacu

SEQ ID NO: 1719777 - RNA, 16 nt, Homo sapiens
ugcccaggcaaagugc

SEQ ID NO: 1719778 - RNA, 14 nt, Homo sapiens
ugccucagccuccc

SEQ ID NO: 1719779 - RNA, 14 nt, Homo sapiens
ugccucccaaagug

SEQ ID NO: 1719780 - RNA, 16 nt, Homo sapiens
ugccuuggugugcugu

SEQ ID NO: 1719781 - RNA, 19 nt, Homo sapiens
ugcguuuccugugcaugga

SEQ ID NO: 1719782 - RNA, 19 nt, Homo sapiens
ugcuauuguagagccagag

SEQ ID NO: 1719783 - RNA, 21 nt, Homo sapiens
ugcuauuguagagccagaggu

SEQ ID NO: 1719784 - RNA, 12 nt, Homo sapiens
ugcucagugucu

SEQ ID NO: 1719785 - RNA, 14 nt, Homo sapiens
ugcucugugcagac

SEQ ID NO: 1719786 - RNA, 15 nt, Homo sapiens
ugcugggcuuggcag

SEQ ID NO: 1719787 - RNA, 19 nt, Homo sapiens
uggagauagccccacagga

SEQ ID NO: 1719788 - RNA, 23 nt, Homo sapiens
uggagcugcguuuccugugcaug

SEQ ID NO: 1719789 - RNA, 14 nt, Homo sapiens
uggauaugugccag

SEQ ID NO: 1719790 - RNA, 13 nt, Homo sapiens
uggccccugagau

SEQ ID NO: 1719791 - RNA, 21 nt, Homo sapiens
uggcuccaggccagggggcca

SEQ ID NO: 1719792 - RNA, 12 nt, Homo sapiens
uggcugccuugu

SEQ ID NO: 1719793 - RNA, 21 nt, Homo sapiens
uggcugggaauaagugccagg

SEQ ID NO: 1719794 - RNA, 12 nt, Homo sapiens
uggcuugaaccu

SEQ ID NO: 1719795 - RNA, 13 nt, Homo sapiens
ugggauuacaggu

SEQ ID NO: 1719796 - RNA, 22 nt, Homo sapiens
ugggccacucaggggucauuca

SEQ ID NO: 1719797 - RNA, 21 nt, Homo sapiens
uggucagcccaaaccaccaga

SEQ ID NO: 1719798 - RNA, 15 nt, Homo sapiens
uggugcugaccucca

SEQ ID NO: 1719799 - RNA, 19 nt, Homo sapiens
uguaaaaucccaucugcua

SEQ ID NO: 1719800 - RNA, 14 nt, Homo sapiens
uguaaguacuucca

SEQ ID NO: 1719801 - RNA, 15 nt, Homo sapiens
uguaaguacuuccac

SEQ ID NO: 1719802 - RNA, 19 nt, Homo sapiens
uguaccaaaaaauauugcu

SEQ ID NO: 1719803 - RNA, 15 nt, Homo sapiens
uguagccagaauucu

SEQ ID NO: 1719804 - RNA, 16 nt, Homo sapiens
ugucccagaaugccuc

SEQ ID NO: 1719805 - RNA, 15 nt, Homo sapiens
ugucccucauccaua

SEQ ID NO: 1719806 - RNA, 22 nt, Homo sapiens
ugucccucauccauagcaccuc

SEQ ID NO: 1719807 - RNA, 23 nt, Homo sapiens
ugucguuucccucccaacagagc

SEQ ID NO: 1719808 - RNA, 12 nt, Homo sapiens
ugucucucauga

SEQ ID NO: 1719809 - RNA, 15 nt, Homo sapiens
uguuauaauuauucc

SEQ ID NO: 1719810 - RNA, 23 nt, Homo sapiens
uguucuucauuaccucagugaga

SEQ ID NO: 1719811 - RNA, 13 nt, Homo sapiens
uguuggacaccca

SEQ ID NO: 1719812 - RNA, 19 nt, Homo sapiens
uuaaauggagaaaggaccc

SEQ ID NO: 1719813 - RNA, 18 nt, Homo sapiens
uuaauguacguuacagcu

SEQ ID NO: 1719814 - RNA, 20 nt, Homo sapiens
uuaccuucuaccucuuggcu

SEQ ID NO: 1719815 - RNA, 17 nt, Homo sapiens
uuagagucuucuccaau

SEQ ID NO: 1719816 - RNA, 16 nt, Homo sapiens
uuaggccauauauauu

SEQ ID NO: 1719817 - RNA, 23 nt, Homo sapiens
uuauagaaugaacuugcauaauu

SEQ ID NO: 1719818 - RNA, 23 nt, Homo sapiens
uuauauuuguaaauuuaugugau

SEQ ID NO: 1719819 - RNA, 14 nt, Homo sapiens
uuaucagccugugc

SEQ ID NO: 1719820 - RNA, 22 nt, Homo sapiens
uuaugcaacuaacuguuuacau

SEQ ID NO: 1719821 - RNA, 14 nt, Homo sapiens
uuauuccuucuuac

SEQ ID NO: 1719822 - RNA, 19 nt, Homo sapiens
uucaagccauucugccuca

SEQ ID NO: 1719823 - RNA, 21 nt, Homo sapiens
uucuauggguuggacaaccuc

SEQ ID NO: 1719824 - RNA, 16 nt, Homo sapiens
uucuccucugauuuca

SEQ ID NO: 1719825 - RNA, 21 nt, Homo sapiens
uugaccucuauaaacuucaga

SEQ ID NO: 1719826 - RNA, 20 nt, Homo sapiens
uugcacugaucuuacucuac

SEQ ID NO: 1719827 - RNA, 19 nt, Homo sapiens
uugcuagugaaacugccca

SEQ ID NO: 1719828 - RNA, 20 nt, Homo sapiens
uuggacacccagugccaggg

SEQ ID NO: 1719829 - RNA, 14 nt, Homo sapiens
uuggggacaggggc

SEQ ID NO: 1719830 - RNA, 22 nt, Homo sapiens
uuguaaaauaaaaccaccaaag

SEQ ID NO: 1719831 - RNA, 16 nt, Homo sapiens
uugugucagaaacaug

SEQ ID NO: 1719832 - RNA, 19 nt, Homo sapiens
uuguuccgugucuggccag

SEQ ID NO: 1719833 - RNA, 23 nt, Homo sapiens
uuuaaagaaaaauaugauacucu

SEQ ID NO: 1719834 - RNA, 15 nt, Homo sapiens
uuuaaccuaguucaa

SEQ ID NO: 1719835 - RNA, 20 nt, Homo sapiens
uuuaccccucauccaaaguu

SEQ ID NO: 1719836 - RNA, 20 nt, Homo sapiens
uuuauuuuguuuauugcacu

SEQ ID NO: 1719837 - RNA, 12 nt, Homo sapiens
uuucaguucacu

SEQ ID NO: 1719838 - RNA, 17 nt, Homo sapiens
uuucaguucacuguuca

SEQ ID NO: 1719839 - RNA, 11 nt, Homo sapiens
uuuggggcuca

SEQ ID NO: 1719840 - RNA, 18 nt, Homo sapiens
uuuggggggcgugcaugu

SEQ ID NO: 1719841 - RNA, 14 nt, Homo sapiens
uuuucucaugauga

SEQ ID NO: 1719842 - RNA, 16 nt, Homo sapiens
gcugcuuuccaaagcc

SEQ ID NO: 1719843 - RNA, 14 nt, Homo sapiens
gcuggggaugucuc

SEQ ID NO: 1719844 - RNA, 19 nt, Homo sapiens
gcuguagacauuugcuaug

SEQ ID NO: 1719845 - RNA, 15 nt, Homo sapiens
gcuucauacacauga

SEQ ID NO: 1719846 - RNA, 16 nt, Homo sapiens
ggaaauggcuguggag

SEQ ID NO: 1719847 - RNA, 14 nt, Homo sapiens
ggaagagcugugug

SEQ ID NO: 1719848 - RNA, 16 nt, Homo sapiens
ggacaaccucauuuua

SEQ ID NO: 1719849 - RNA, 19 nt, Homo sapiens
ggacauaguaaaugauuca

SEQ ID NO: 1719850 - RNA, 18 nt, Homo sapiens
ggacccugagccugugug

SEQ ID NO: 1719851 - RNA, 15 nt, Homo sapiens
ggaggacgggacccu

SEQ ID NO: 1719852 - RNA, 22 nt, Homo sapiens
ggaugggacagaauguggcgug

SEQ ID NO: 1719853 - RNA, 19 nt, Homo sapiens
ggcaagcaagccugggagc

SEQ ID NO: 1719854 - RNA, 21 nt, Homo sapiens
ggcagggcugaggccucucau

SEQ ID NO: 1719855 - RNA, 22 nt, Homo sapiens
ggcaguuuggcaaacucuccac

SEQ ID NO: 1719856 - RNA, 16 nt, Homo sapiens
ggccagcaccaucucu

SEQ ID NO: 1719857 - RNA, 13 nt, Homo sapiens
ggcugacuacuca

SEQ ID NO: 1719858 - RNA, 11 nt, Homo sapiens
ggcugccuugu

SEQ ID NO: 1719859 - RNA, 13 nt, Homo sapiens
ggcuggacuugga

SEQ ID NO: 1719860 - RNA, 19 nt, Homo sapiens
ggcuguggaguguggcagu

SEQ ID NO: 1719861 - RNA, 16 nt, Homo sapiens
ggcuuuucuuucuacc

SEQ ID NO: 1719862 - RNA, 15 nt, Homo sapiens
gggacaggugccagg

SEQ ID NO: 1719863 - RNA, 22 nt, Homo sapiens
gggccacucaggggucauucau

SEQ ID NO: 1719864 - RNA, 19 nt, Homo sapiens
gggcucucucaugauagaa

SEQ ID NO: 1719865 - RNA, 17 nt, Homo sapiens
gggcugaggccucucau

SEQ ID NO: 1719866 - RNA, 16 nt, Homo sapiens
ggggaugcucugugca

SEQ ID NO: 1719867 - RNA, 12 nt, Homo sapiens
ggggcacccgcc

SEQ ID NO: 1719868 - RNA, 23 nt, Homo sapiens
gggugcugcuguaccacacagcc

SEQ ID NO: 1719869 - RNA, 13 nt, Homo sapiens
gggugguguccuu

SEQ ID NO: 1719870 - RNA, 17 nt, Homo sapiens
ggguuggacaaccucau

SEQ ID NO: 1719871 - RNA, 22 nt, Homo sapiens
gguggcaucagugucuuuccac

SEQ ID NO: 1719872 - RNA, 12 nt, Homo sapiens
ggugugcuguau

SEQ ID NO: 1719873 - RNA, 13 nt, Homo sapiens
guacagacacucc

SEQ ID NO: 1719874 - RNA, 16 nt, Homo sapiens
guagacauuugcuaug

SEQ ID NO: 1719875 - RNA, 16 nt, Homo sapiens
gucaucuguaccucug

SEQ ID NO: 1719876 - RNA, 19 nt, Homo sapiens
guccccagacuccaccaag

SEQ ID NO: 1719877 - RNA, 22 nt, Homo sapiens
gucccugaggcagguccccaga

SEQ ID NO: 1719878 - RNA, 21 nt, Homo sapiens
guccucauuauaaaaugggaa

SEQ ID NO: 1719879 - RNA, 17 nt, Homo sapiens
gucuagccacugaucau

SEQ ID NO: 1719880 - RNA, 13 nt, Homo sapiens
gucucagugcuuu

SEQ ID NO: 1719881 - RNA, 22 nt, Homo sapiens
gugaggaugucugggccacuca

SEQ ID NO: 1719882 - RNA, 19 nt, Homo sapiens
guguucuucauuaccucag

SEQ ID NO: 1719883 - RNA, 21 nt, Homo sapiens
guuaaacucgcucacugcuaa

SEQ ID NO: 1719884 - RNA, 16 nt, Homo sapiens
guuauccccuccuuua

SEQ ID NO: 1719885 - RNA, 15 nt, Homo sapiens
uaaaagucuaugauc

SEQ ID NO: 1719886 - RNA, 18 nt, Homo sapiens
uaaaauaaucauacaguu

SEQ ID NO: 1719887 - RNA, 20 nt, Homo sapiens
uaaaaugggaagacugagcu

SEQ ID NO: 1719888 - RNA, 20 nt, Homo sapiens
uaaagaaaaauaugauacuc

SEQ ID NO: 1719889 - RNA, 15 nt, Homo sapiens
uaaauuuaugugaug

SEQ ID NO: 1719890 - RNA, 14 nt, Homo sapiens
uaaccccaccacac

SEQ ID NO: 1719891 - RNA, 15 nt, Homo sapiens
uaaccucaaaacugu

SEQ ID NO: 1719892 - RNA, 14 nt, Homo sapiens
uaagcucgagugaa

SEQ ID NO: 1719893 - RNA, 15 nt, Homo sapiens
uaauaaaauaaucau

SEQ ID NO: 1719894 - RNA, 18 nt, Homo sapiens
uaauacuagauugaucua

SEQ ID NO: 1719895 - RNA, 23 nt, Homo sapiens
uaaugaaacuuggauuugcucag

SEQ ID NO: 1719896 - RNA, 17 nt, Homo sapiens
uaauguacguuacagcu

SEQ ID NO: 1719897 - RNA, 21 nt, Homo sapiens
uacagacacucccacuuggca

SEQ ID NO: 1719898 - RNA, 12 nt, Homo sapiens
uaccacacagcc

SEQ ID NO: 1719899 - RNA, 19 nt, Homo sapiens
uaccucuuggcugccuugu

SEQ ID NO: 1719900 - RNA, 13 nt, Homo sapiens
uacuagauugauc

SEQ ID NO: 1719901 - RNA, 19 nt, Homo sapiens
uacuccuuaauacuagauu

SEQ ID NO: 1719902 - RNA, 17 nt, Homo sapiens
uacugaaccacucuccc

SEQ ID NO: 1719903 - RNA, 20 nt, Homo sapiens
uaggagaaacuuagaggaaa

SEQ ID NO: 1719904 - RNA, 17 nt, Homo sapiens
uaggccagcaccaucuc

SEQ ID NO: 1719905 - RNA, 23 nt, Homo sapiens
uaguuaagagaauaaacuagauc

SEQ ID NO: 1719906 - RNA, 24 nt, Homo sapiens
uaucuacuuuagagucuucuccaa

SEQ ID NO: 1719907 - RNA, 17 nt, Homo sapiens
uaugguucucucgcaag

SEQ ID NO: 1719908 - RNA, 22 nt, Homo sapiens
uauguggaagugugggucugug

SEQ ID NO: 1719909 - RNA, 18 nt, Homo sapiens
uauuuaccuucuaccucu

SEQ ID NO: 1719910 - RNA, 13 nt, Homo sapiens
uauuuauaaacua

SEQ ID NO: 1719911 - RNA, 21 nt, Homo sapiens
ucaagccauucugccucagcc

SEQ ID NO: 1719912 - RNA, 11 nt, Homo sapiens
ucaagcugcac

SEQ ID NO: 1719913 - RNA, 17 nt, Homo sapiens
ucaaggcugacuacuca

SEQ ID NO: 1719914 - RNA, 20 nt, Homo sapiens
ucaaggcugacuacucacuu

SEQ ID NO: 1719915 - RNA, 20 nt, Homo sapiens
ucaaugugcuuuuaauguac

SEQ ID NO: 1719916 - RNA, 16 nt, Homo sapiens
ucacaauuaggcuuca

SEQ ID NO: 1719917 - RNA, 21 nt, Homo sapiens
ucaccaggaggcggcagugca

SEQ ID NO: 1719918 - RNA, 21 nt, Homo sapiens
ucacccaggcugcagugcaau

SEQ ID NO: 1719919 - RNA, 12 nt, Homo sapiens
ucacucuuggag

SEQ ID NO: 1719920 - RNA, 21 nt, Homo sapiens
ucagagcccagcucaugcaca

SEQ ID NO: 1719921 - RNA, 19 nt, Homo sapiens
ucagaguccucauuauaaa

SEQ ID NO: 1719922 - RNA, 14 nt, Homo sapiens
ucagaucauuauca

SEQ ID NO: 1719923 - RNA, 14 nt, Homo sapiens
ucagcagugaugcu

SEQ ID NO: 1719924 - RNA, 14 nt, Homo sapiens
ucagcucacugcaa

SEQ ID NO: 1719925 - RNA, 20 nt, Homo sapiens
ucagugucuuuccacuccuc

SEQ ID NO: 1719926 - RNA, 15 nt, Homo sapiens
ucaguucacuguuca

SEQ ID NO: 1719927 - RNA, 21 nt, Homo sapiens
ucaguucacuguucaguuuag

SEQ ID NO: 1719928 - RNA, 15 nt, Homo sapiens
ucaguuccuuugauc

SEQ ID NO: 1719929 - RNA, 17 nt, Homo sapiens
ucaguuccuuugaucuc

SEQ ID NO: 1719930 - RNA, 13 nt, Homo sapiens
ucaucaguuccuu

SEQ ID NO: 1719931 - RNA, 15 nt, Homo sapiens
ucaucuguaccucug

SEQ ID NO: 1719932 - RNA, 22 nt, Homo sapiens
ucaugaagcguggagacagcuu

SEQ ID NO: 1719933 - RNA, 19 nt, Homo sapiens
ucauguuuacagaggacag

SEQ ID NO: 1719934 - RNA, 14 nt, Homo sapiens
ucauuauaaaaugg

SEQ ID NO: 1719935 - RNA, 21 nt, Homo sapiens
uccaaaguugccacagaugau

SEQ ID NO: 1719936 - RNA, 13 nt, Homo sapiens
uccaagaauuuga

SEQ ID NO: 1719937 - RNA, 15 nt, Homo sapiens
uccaagcccaguuca

SEQ ID NO: 1719938 - RNA, 17 nt, Homo sapiens
uccacaagagugaauuu

SEQ ID NO: 1719939 - RNA, 20 nt, Homo sapiens
uccagguggcaucagugucu

SEQ ID NO: 1719940 - RNA, 20 nt, Homo sapiens
uccauccauggggcugauug

SEQ ID NO: 1719941 - RNA, 17 nt, Homo sapiens
uccauugguguugacau

SEQ ID NO: 1719942 - RNA, 13 nt, Homo sapiens
uccccucccucag

SEQ ID NO: 1719943 - RNA, 20 nt, Homo sapiens
ucccuaguagcugggauuac

SEQ ID NO: 1719944 - RNA, 11 nt, Homo sapiens
ucccucaggcc

SEQ ID NO: 1719945 - RNA, 14 nt, Homo sapiens
ucccucauccauag

SEQ ID NO: 1719946 - RNA, 20 nt, Homo sapiens
ucccugaagagaagggcagg

SEQ ID NO: 1719947 - RNA, 19 nt, Homo sapiens
uccuagccaccgccuccua

SEQ ID NO: 1719948 - RNA, 14 nt, Homo sapiens
uccucaaagggaga

SEQ ID NO: 1719949 - RNA, 17 nt, Homo sapiens
uccucacacucacccaa

SEQ ID NO: 1719950 - RNA, 23 nt, Homo sapiens
uccuccaagaauuugacuuggaa

SEQ ID NO: 1719951 - RNA, 16 nt, Homo sapiens
uccucggguaccaaua

SEQ ID NO: 1719952 - RNA, 16 nt, Homo sapiens
uccugucccucaucca

SEQ ID NO: 1719953 - RNA, 14 nt, Homo sapiens
ucgggcagcugcag

SEQ ID NO: 1719954 - RNA, 19 nt, Homo sapiens
ucuagccuuguguuauaga

SEQ ID NO: 1719955 - RNA, 16 nt, Homo sapiens
ucucagugcuuuccaa

SEQ ID NO: 1719956 - RNA, 17 nt, Homo sapiens
ucucaugaccaaaugcu

SEQ ID NO: 1719957 - RNA, 17 nt, Homo sapiens
ucucaugauagaaggcu

SEQ ID NO: 1719958 - RNA, 11 nt, Homo sapiens
ucuccacuggg

SEQ ID NO: 1719959 - RNA, 13 nt, Homo sapiens
ggaagggacacca

SEQ ID NO: 1719960 - RNA, 23 nt, Homo sapiens
ggacaggugccagguguguggug

SEQ ID NO: 1719961 - RNA, 18 nt, Homo sapiens
ggacauuuggcugugaug

SEQ ID NO: 1719962 - RNA, 20 nt, Homo sapiens
ggaccaaagcagcugcagcc

SEQ ID NO: 1719963 - RNA, 21 nt, Homo sapiens
ggaccccugaguaaaaaagcu

SEQ ID NO: 1719964 - RNA, 18 nt, Homo sapiens
ggacuguucccugaggug

SEQ ID NO: 1719965 - RNA, 19 nt, Homo sapiens
ggagaaaggacccucaaga

SEQ ID NO: 1719966 - RNA, 22 nt, Homo sapiens
ggagcugcguuuccugugcaug

SEQ ID NO: 1719967 - RNA, 12 nt, Homo sapiens
ggaugucucuca

SEQ ID NO: 1719968 - RNA, 13 nt, Homo sapiens
ggcagugcaacaa

SEQ ID NO: 1719969 - RNA, 18 nt, Homo sapiens
ggccacagugcaauuuua

SEQ ID NO: 1719970 - RNA, 11 nt, Homo sapiens
ggccagcacca

SEQ ID NO: 1719971 - RNA, 12 nt, Homo sapiens
ggcccaaagccu

SEQ ID NO: 1719972 - RNA, 22 nt, Homo sapiens
uccuuagccuuugucccagaau

SEQ ID NO: 1719973 - RNA, 19 nt, Homo sapiens
uccuucacauuuacuagcu

SEQ ID NO: 1719974 - RNA, 21 nt, Homo sapiens
uccuucuaccacuggggugcu

SEQ ID NO: 1719975 - RNA, 17 nt, Homo sapiens
uccuuuccccucccuca

SEQ ID NO: 1719976 - RNA, 18 nt, Homo sapiens
uccuuuccccucccucag

SEQ ID NO: 1719977 - RNA, 15 nt, Homo sapiens
ucggcucacugcaac

SEQ ID NO: 1719978 - RNA, 19 nt, Homo sapiens
ucgugcggaggauccugua

SEQ ID NO: 1719979 - RNA, 19 nt, Homo sapiens
ucuauggguuggacaaccu

SEQ ID NO: 1719980 - RNA, 16 nt, Homo sapiens
ucuccaauguccaaaa

SEQ ID NO: 1719981 - RNA, 11 nt, Homo sapiens
ucugauuucag

SEQ ID NO: 1719982 - RNA, 14 nt, Homo sapiens
ucugccucccaaag

SEQ ID NO: 1719983 - RNA, 14 nt, Homo sapiens
ucuggaaaagcagc

SEQ ID NO: 1719984 - RNA, 13 nt, Homo sapiens
ucuggcugcagag

SEQ ID NO: 1719985 - RNA, 15 nt, Homo sapiens
ucuuaacagucucca

SEQ ID NO: 1719986 - RNA, 14 nt, Homo sapiens
ucuucauuaccuca

SEQ ID NO: 1719987 - RNA, 22 nt, Homo sapiens
ucuuggagccugcagagcugcg

SEQ ID NO: 1719988 - RNA, 14 nt, Homo sapiens
ucuugguuccagcc

SEQ ID NO: 1719989 - RNA, 17 nt, Homo sapiens
ucuuguagccagaauuc

SEQ ID NO: 1719990 - RNA, 23 nt, Homo sapiens
ucuuuuaggaggcacaacaguuc

SEQ ID NO: 1719991 - RNA, 16 nt, Homo sapiens
ucuuuugucccagaaa

SEQ ID NO: 1719992 - RNA, 14 nt, Homo sapiens
ugaauaacugagcu

SEQ ID NO: 1719993 - RNA, 21 nt, Homo sapiens
ugaccucuauaaacuucagag

SEQ ID NO: 1719994 - RNA, 22 nt, Homo sapiens
ugacuacucacuucuccuuuaa

SEQ ID NO: 1719995 - RNA, 18 nt, Homo sapiens
ugagaagccagcuuuccu

SEQ ID NO: 1719996 - RNA, 17 nt, Homo sapiens
ugagcuggggaugucuc

SEQ ID NO: 1719997 - RNA, 14 nt, Homo sapiens
ugaggccucucauu

SEQ ID NO: 1719998 - RNA, 20 nt, Homo sapiens
ugagguggaagagggcugca

SEQ ID NO: 1719999 - RNA, 19 nt, Homo sapiens
ugauauguaaguacuucca

SEQ ID NO: 1720000 - RNA, 19 nt, Homo sapiens
ugcagauuuugcccuugac

SEQ ID NO: 1720001 - RNA, 21 nt, Homo sapiens
ugccacagaugauacuuccaa

SEQ ID NO: 1720002 - RNA, 19 nt, Homo sapiens
ugccagacuggagugcagu

SEQ ID NO: 1720003 - RNA, 16 nt, Homo sapiens
ugcgggcgaggucuga

SEQ ID NO: 1720004 - RNA, 16 nt, Homo sapiens
ugcguuuccugugcau

SEQ ID NO: 1720005 - RNA, 18 nt, Homo sapiens
ugcuguagacauuugcua

SEQ ID NO: 1720006 - RNA, 20 nt, Homo sapiens
ugcuguagacauuugcuaug

SEQ ID NO: 1720007 - RNA, 21 nt, Homo sapiens
ugcuguagacauuugcuauga

SEQ ID NO: 1720008 - RNA, 15 nt, Homo sapiens
ugcuguauccaucca

SEQ ID NO: 1720009 - RNA, 23 nt, Homo sapiens
ugcuuagcuugagggugacuaug

SEQ ID NO: 1720010 - RNA, 17 nt, Homo sapiens
ugcuuuccaaagccaau

SEQ ID NO: 1720011 - RNA, 12 nt, Homo sapiens
uggaaaagccaa

SEQ ID NO: 1720012 - RNA, 15 nt, Homo sapiens
uggaaaagccaagag

SEQ ID NO: 1720013 - RNA, 15 nt, Homo sapiens
uggaagugcuugaua

SEQ ID NO: 1720014 - RNA, 21 nt, Homo sapiens
uggacaacccaagucucuggg

SEQ ID NO: 1720015 - RNA, 20 nt, Homo sapiens
uggagaacgagaccugugug

SEQ ID NO: 1720016 - RNA, 12 nt, Homo sapiens
uggaucugugag

SEQ ID NO: 1720017 - RNA, 19 nt, Homo sapiens
uggcaucagugucuuucca

SEQ ID NO: 1720018 - RNA, 22 nt, Homo sapiens
uggccuguucuucuauggguug

SEQ ID NO: 1720019 - RNA, 17 nt, Homo sapiens
uggcugacuggcaguaa

SEQ ID NO: 1720020 - RNA, 16 nt, Homo sapiens
uggcuuuucuuucuac

SEQ ID NO: 1720021 - RNA, 21 nt, Homo sapiens
ugggagauguggaaaagccaa

SEQ ID NO: 1720022 - RNA, 16 nt, Homo sapiens
uggggaugucucucau

SEQ ID NO: 1720023 - RNA, 15 nt, Homo sapiens
uggggcugauuguau

SEQ ID NO: 1720024 - RNA, 14 nt, Homo sapiens
ugguccucacacuc

SEQ ID NO: 1720025 - RNA, 14 nt, Homo sapiens
uggucuccacuggg

SEQ ID NO: 1720026 - RNA, 18 nt, Homo sapiens
uggugcagccuacacuau

SEQ ID NO: 1720027 - RNA, 16 nt, Homo sapiens
uguaaaauaaaaccac

SEQ ID NO: 1720028 - RNA, 20 nt, Homo sapiens
uguauuuaccuucuaccucu

SEQ ID NO: 1720029 - RNA, 15 nt, Homo sapiens
ugucccagaaaagca

SEQ ID NO: 1720030 - RNA, 18 nt, Homo sapiens
ugucccagaaugccuccu

SEQ ID NO: 1720031 - RNA, 21 nt, Homo sapiens
ugucuuuccacuccuccuagc

SEQ ID NO: 1720032 - RNA, 16 nt, Homo sapiens
ugugauggcaaagaag

SEQ ID NO: 1720033 - RNA, 14 nt, Homo sapiens
ugugauguguccug

SEQ ID NO: 1720034 - RNA, 13 nt, Homo sapiens
ugugcaacacuca

SEQ ID NO: 1720035 - RNA, 18 nt, Homo sapiens
ugugcagacacaugugcc

SEQ ID NO: 1720036 - RNA, 23 nt, Homo sapiens
uguggaaaagccaagaggcugca

SEQ ID NO: 1720037 - RNA, 13 nt, Homo sapiens
ugugggacccgcc

SEQ ID NO: 1720038 - RNA, 21 nt, Homo sapiens
uguggggagggauuuggggcu

SEQ ID NO: 1720039 - RNA, 16 nt, Homo sapiens
uguuaggauuacaggc

SEQ ID NO: 1720040 - RNA, 19 nt, Homo sapiens
uguuuacagaggacaguau

SEQ ID NO: 1720041 - RNA, 16 nt, Homo sapiens
uuaaccucaaaacugu

SEQ ID NO: 1720042 - RNA, 16 nt, Homo sapiens
uuaaucaucaguuccu

SEQ ID NO: 1720043 - RNA, 14 nt, Homo sapiens
uuacaggugugacc

SEQ ID NO: 1720044 - RNA, 19 nt, Homo sapiens
uuacucuugagacuacuuc

SEQ ID NO: 1720045 - RNA, 20 nt, Homo sapiens
uuagagcugccugugccuuu

SEQ ID NO: 1720046 - RNA, 16 nt, Homo sapiens
uuagaggacacuauug

SEQ ID NO: 1720047 - RNA, 17 nt, Homo sapiens
uuagaggacacuauuga

SEQ ID NO: 1720048 - RNA, 16 nt, Homo sapiens
uuaguagagacagggu

SEQ ID NO: 1720049 - RNA, 19 nt, Homo sapiens
uuaguuccccuacuacacu

SEQ ID NO: 1720050 - RNA, 22 nt, Homo sapiens
uucacuguucaguuuagcauua

SEQ ID NO: 1720051 - RNA, 13 nt, Homo sapiens
uucagaguccuca

SEQ ID NO: 1720052 - RNA, 17 nt, Homo sapiens
uuccacaagagugaauu

SEQ ID NO: 1720053 - RNA, 14 nt, Homo sapiens
uuccagcaccacac

SEQ ID NO: 1720054 - RNA, 21 nt, Homo sapiens
uuccagguggcaucagugucu

SEQ ID NO: 1720055 - RNA, 22 nt, Homo sapiens
uuccccaccaaccccuccaaug

SEQ ID NO: 1720056 - RNA, 21 nt, Homo sapiens
uuccggccuccugucccucau

SEQ ID NO: 1720057 - RNA, 22 nt, Homo sapiens
uucuaauuugcauugugucaga

SEQ ID NO: 1720058 - RNA, 15 nt, Homo sapiens
uucuccaauguccaa

SEQ ID NO: 1720059 - RNA, 19 nt, Homo sapiens
uucuccuuuaaauucuuuc

SEQ ID NO: 1720060 - RNA, 17 nt, Homo sapiens
uucucucuccucuuuga

SEQ ID NO: 1720061 - RNA, 16 nt, Homo sapiens
uucuucauuaccucag

SEQ ID NO: 1720062 - RNA, 23 nt, Homo sapiens
uugaaccuucaaagcuuuuguaa

SEQ ID NO: 1720063 - RNA, 20 nt, Homo sapiens
uugauauguaaguacuucca

SEQ ID NO: 1720064 - RNA, 18 nt, Homo sapiens
uugauuuucuuucuccuc

SEQ ID NO: 1720065 - RNA, 21 nt, Homo sapiens
uugcauaauuauauacuccuu

SEQ ID NO: 1720066 - RNA, 18 nt, Homo sapiens
uugccacagaugauacuu

SEQ ID NO: 1720067 - RNA, 14 nt, Homo sapiens
uugccagacuggag

SEQ ID NO: 1720068 - RNA, 20 nt, Homo sapiens
uugccagacuggagugcagu

SEQ ID NO: 1720069 - RNA, 21 nt, Homo sapiens
uuggacaaguccuugaccucu

SEQ ID NO: 1720070 - RNA, 15 nt, Homo sapiens
uuggagcuguuccau

SEQ ID NO: 1720071 - RNA, 22 nt, Homo sapiens
uuggauucugagagcugugcau

SEQ ID NO: 1720072 - RNA, 20 nt, Homo sapiens
uuggcaaacucuccaccaca

SEQ ID NO: 1720073 - RNA, 16 nt, Homo sapiens
uuggcagcucuacucu

SEQ ID NO: 1720074 - RNA, 15 nt, Homo sapiens
uuggcucuacccuga

SEQ ID NO: 1720075 - RNA, 20 nt, Homo sapiens
uugucaaggcugacuacuca

SEQ ID NO: 1720076 - RNA, 16 nt, Homo sapiens
uugugauguguccuga

SEQ ID NO: 1720077 - RNA, 14 nt, Homo sapiens
uuuaaaauugugau

SEQ ID NO: 1720078 - RNA, 19 nt, Homo sapiens
guaaaugauucauauaucc

SEQ ID NO: 1720079 - RNA, 15 nt, Homo sapiens
guaaugaaacuugga

SEQ ID NO: 1720080 - RNA, 12 nt, Homo sapiens
guacagacacuc

SEQ ID NO: 1720081 - RNA, 14 nt, Homo sapiens
guacguuacagcuu

SEQ ID NO: 1720082 - RNA, 18 nt, Homo sapiens
guacuugugaccauugua

SEQ ID NO: 1720083 - RNA, 21 nt, Homo sapiens
guauauaaaucuucaaagcuu

SEQ ID NO: 1720084 - RNA, 15 nt, Homo sapiens
guaugggacaggugc

SEQ ID NO: 1720085 - RNA, 15 nt, Homo sapiens
gucaguauguggaag

SEQ ID NO: 1720086 - RNA, 23 nt, Homo sapiens
gucccagaaugccuccugcaggg

SEQ ID NO: 1720087 - RNA, 13 nt, Homo sapiens
guccccagacucc

SEQ ID NO: 1720088 - RNA, 22 nt, Homo sapiens
guccuucacauuuacuagcugu

SEQ ID NO: 1720089 - RNA, 18 nt, Homo sapiens
gucucagugcuuuccaau

SEQ ID NO: 1720090 - RNA, 17 nt, Homo sapiens
gucugggccacucaggg

SEQ ID NO: 1720091 - RNA, 19 nt, Homo sapiens
gucuguguguuuaugugug

SEQ ID NO: 1720092 - RNA, 14 nt, Homo sapiens
gugaggggcucucu

SEQ ID NO: 1720093 - RNA, 18 nt, Homo sapiens
gugccuuggugugcugua

SEQ ID NO: 1720094 - RNA, 21 nt, Homo sapiens
guggcaucagugucuuuccac

SEQ ID NO: 1720095 - RNA, 16 nt, Homo sapiens
gugugggaguguguaa

SEQ ID NO: 1720096 - RNA, 20 nt, Homo sapiens
gugugguggggacaacagca

SEQ ID NO: 1720097 - RNA, 19 nt, Homo sapiens
gugugugggaguguguaau

SEQ ID NO: 1720098 - RNA, 22 nt, Homo sapiens
gugugugguggggacaacagca

SEQ ID NO: 1720099 - RNA, 18 nt, Homo sapiens
guguuaggauuacaggca

SEQ ID NO: 1720100 - RNA, 23 nt, Homo sapiens
guguucuucauuaccucagugag

SEQ ID NO: 1720101 - RNA, 11 nt, Homo sapiens
guuacauauua

SEQ ID NO: 1720102 - RNA, 23 nt, Homo sapiens
guuacuugcugcccugugcuccu

SEQ ID NO: 1720103 - RNA, 13 nt, Homo sapiens
guuaggauuacag

SEQ ID NO: 1720104 - RNA, 17 nt, Homo sapiens
guucaaaaaacuuguaa

SEQ ID NO: 1720105 - RNA, 15 nt, Homo sapiens
guuccagcaccacac

SEQ ID NO: 1720106 - RNA, 15 nt, Homo sapiens
guucccacuccuuca

SEQ ID NO: 1720107 - RNA, 11 nt, Homo sapiens
guucucaggcc

SEQ ID NO: 1720108 - RNA, 20 nt, Homo sapiens
guuggacacccagugccagg

SEQ ID NO: 1720109 - RNA, 21 nt, Homo sapiens
guuggacacccagugccaggg

SEQ ID NO: 1720110 - RNA, 14 nt, Homo sapiens
uaaacaugcuugca

SEQ ID NO: 1720111 - RNA, 12 nt, Homo sapiens
uaaacuccuuaa

SEQ ID NO: 1720112 - RNA, 14 nt, Homo sapiens
uaaaguaagacauc

SEQ ID NO: 1720113 - RNA, 15 nt, Homo sapiens
uaaauaaaacaugca

SEQ ID NO: 1720114 - RNA, 15 nt, Homo sapiens
uaaccuagugaauuu

SEQ ID NO: 1720115 - RNA, 20 nt, Homo sapiens
uaagcugagcuccuuagccu

SEQ ID NO: 1720116 - RNA, 16 nt, Homo sapiens
uaaugaucaaaacaug

SEQ ID NO: 1720117 - RNA, 14 nt, Homo sapiens
uacacuuugcuagu

SEQ ID NO: 1720118 - RNA, 18 nt, Homo sapiens
uacuuguuuucacuuuau

SEQ ID NO: 1720119 - RNA, 22 nt, Homo sapiens
uagacaugucuagccacugauc

SEQ ID NO: 1720120 - RNA, 15 nt, Homo sapiens
uagaguauaccuccu

SEQ ID NO: 1720121 - RNA, 18 nt, Homo sapiens
uagcaccuccacauaccu

SEQ ID NO: 1720122 - RNA, 19 nt, Homo sapiens
uagccacugaucauuuuua

SEQ ID NO: 1720123 - RNA, 15 nt, Homo sapiens
uagccuuugucccag

SEQ ID NO: 1720124 - RNA, 13 nt, Homo sapiens
uagcuugauuuuc

SEQ ID NO: 1720125 - RNA, 21 nt, Homo sapiens
uaggaacugcugggcuuggca

SEQ ID NO: 1720126 - RNA, 15 nt, Homo sapiens
uaggauuacaggcau

SEQ ID NO: 1720127 - RNA, 13 nt, Homo sapiens
uauaaacuccuua

SEQ ID NO: 1720128 - RNA, 14 nt, Homo sapiens
uauaauuauuccuu

SEQ ID NO: 1720129 - RNA, 11 nt, Homo sapiens
uauauaaacuc

SEQ ID NO: 1720130 - RNA, 24 nt, Homo sapiens
uaucaaagagaaguuacauauuag

SEQ ID NO: 1720131 - RNA, 19 nt, Homo sapiens
uaucagccugugccacgau

SEQ ID NO: 1720132 - RNA, 23 nt, Homo sapiens
uaugagcuggggaugucucucau

SEQ ID NO: 1720133 - RNA, 20 nt, Homo sapiens
uauggguuggacaaccucau

SEQ ID NO: 1720134 - RNA, 14 nt, Homo sapiens
uaugguucucaggc

SEQ ID NO: 1720135 - RNA, 13 nt, Homo sapiens
uauuagcuuauau

SEQ ID NO: 1720136 - RNA, 12 nt, Homo sapiens
uauucccaugag

SEQ ID NO: 1720137 - RNA, 14 nt, Homo sapiens
uauuggcagcucua

SEQ ID NO: 1720138 - RNA, 12 nt, Homo sapiens
uauuuaaccuag

SEQ ID NO: 1720139 - RNA, 22 nt, Homo sapiens
uauuuaaccuaguucaaugugc

SEQ ID NO: 1720140 - RNA, 15 nt, Homo sapiens
cccaaaacgugcaug

SEQ ID NO: 1720141 - RNA, 14 nt, Homo sapiens
cccacuuggcauca

SEQ ID NO: 1720142 - RNA, 20 nt, Homo sapiens
cccagaaugaggcugcuuuc

SEQ ID NO: 1720143 - RNA, 19 nt, Homo sapiens
cccaggcugcagugcaaug

SEQ ID NO: 1720144 - RNA, 19 nt, Homo sapiens
ccccauagcagcagugcau

SEQ ID NO: 1720145 - RNA, 13 nt, Homo sapiens
cccucccaacaga

SEQ ID NO: 1720146 - RNA, 16 nt, Homo sapiens
cccuccugcugccuaa

SEQ ID NO: 1720147 - RNA, 19 nt, Homo sapiens
cccugaaggaaccaaagcg

SEQ ID NO: 1720148 - RNA, 15 nt, Homo sapiens
cccuggcuccaggcc

SEQ ID NO: 1720149 - RNA, 23 nt, Homo sapiens
ccggcugaguguacuaguaguua

SEQ ID NO: 1720150 - RNA, 11 nt, Homo sapiens
ccuagccaccc

SEQ ID NO: 1720151 - RNA, 17 nt, Homo sapiens
ccuaguucaaugugcuu

SEQ ID NO: 1720152 - RNA, 23 nt, Homo sapiens
ccucacugcuguagacauuugcu

SEQ ID NO: 1720153 - RNA, 16 nt, Homo sapiens
ccucagugagaagcca

SEQ ID NO: 1720154 - RNA, 14 nt, Homo sapiens
ccucauccaaaguu

SEQ ID NO: 1720155 - RNA, 13 nt, Homo sapiens
ccucccaaagugc

SEQ ID NO: 1720156 - RNA, 13 nt, Homo sapiens
ccucccaaagugu

SEQ ID NO: 1720157 - RNA, 17 nt, Homo sapiens
ccucuuggcugccuugu

SEQ ID NO: 1720158 - RNA, 17 nt, Homo sapiens
ccucuuugaguauauua

SEQ ID NO: 1720159 - RNA, 13 nt, Homo sapiens
ccugagaugauuu

SEQ ID NO: 1720160 - RNA, 23 nt, Homo sapiens
ccugaggcagguccccagacucc

SEQ ID NO: 1720161 - RNA, 21 nt, Homo sapiens
ccuggucagcccaaaccacca

SEQ ID NO: 1720162 - RNA, 15 nt, Homo sapiens
ccugugccuuuugcc

SEQ ID NO: 1720163 - RNA, 12 nt, Homo sapiens
ccuucuaccucu

SEQ ID NO: 1720164 - RNA, 21 nt, Homo sapiens
ccuugguccugccucuuugag

SEQ ID NO: 1720165 - RNA, 22 nt, Homo sapiens
ccuuuacuuucucucuccucuu

SEQ ID NO: 1720166 - RNA, 18 nt, Homo sapiens
cgaguacagaguggcccu

SEQ ID NO: 1720167 - RNA, 12 nt, Homo sapiens
cgaucucagcuc

SEQ ID NO: 1720168 - RNA, 20 nt, Homo sapiens
cgccuugaaaacaagccucc

SEQ ID NO: 1720169 - RNA, 21 nt, Homo sapiens
cgggcgaggucugauggagcu

SEQ ID NO: 1720170 - RNA, 17 nt, Homo sapiens
cuaaagcuuuggacaag

SEQ ID NO: 1720171 - RNA, 17 nt, Homo sapiens
cuaaaguauaucuuuaa

SEQ ID NO: 1720172 - RNA, 16 nt, Homo sapiens
cuaaccccaccacacc

SEQ ID NO: 1720173 - RNA, 19 nt, Homo sapiens
cuaaccucgggugauccac

SEQ ID NO: 1720174 - RNA, 17 nt, Homo sapiens
cuaauuccacacccuca

SEQ ID NO: 1720175 - RNA, 21 nt, Homo sapiens
cuacagcgccaacgagcagug

SEQ ID NO: 1720176 - RNA, 18 nt, Homo sapiens
cuacuacagcacugugau

SEQ ID NO: 1720177 - RNA, 14 nt, Homo sapiens
cuacuacagcgcca

SEQ ID NO: 1720178 - RNA, 12 nt, Homo sapiens
cuacucacuucu

SEQ ID NO: 1720179 - RNA, 20 nt, Homo sapiens
cuacugggagccuacccacc

SEQ ID NO: 1720180 - RNA, 22 nt, Homo sapiens
cuaggacauaguaaaugauuca

SEQ ID NO: 1720181 - RNA, 19 nt, Homo sapiens
cuaguagcugggauuacag

SEQ ID NO: 1720182 - RNA, 19 nt, Homo sapiens
cuaugaucuggacuuccua

SEQ ID NO: 1720183 - RNA, 22 nt, Homo sapiens
cucacugcuaagaauauuugaa

SEQ ID NO: 1720184 - RNA, 16 nt, Homo sapiens
cucaggggucauucau

SEQ ID NO: 1720185 - RNA, 17 nt, Homo sapiens
cuccagcgguccaaagu

SEQ ID NO: 1720186 - RNA, 12 nt, Homo sapiens
cucccaaagugc

SEQ ID NO: 1720187 - RNA, 17 nt, Homo sapiens
cuccccauggggcagca

SEQ ID NO: 1720188 - RNA, 19 nt, Homo sapiens
cucccuaguagcugggauu

SEQ ID NO: 1720189 - RNA, 14 nt, Homo sapiens
cucccucuacuggg

SEQ ID NO: 1720190 - RNA, 20 nt, Homo sapiens
cuccuagccacccaccacac

SEQ ID NO: 1720191 - RNA, 14 nt, Homo sapiens
cuccuccuagccac

SEQ ID NO: 1720192 - RNA, 17 nt, Homo sapiens
cuccugcugccuaauaa

SEQ ID NO: 1720193 - RNA, 18 nt, Homo sapiens
cucgauauccugaucucg

SEQ ID NO: 1720194 - RNA, 13 nt, Homo sapiens
cucucucaugaua

SEQ ID NO: 1720195 - RNA, 19 nt, Homo sapiens
cucuugauuaagaucucag

SEQ ID NO: 1720196 - RNA, 12 nt, Homo sapiens
cucuuguagcca

SEQ ID NO: 1720197 - RNA, 12 nt, Homo sapiens
cucuuuaccucc

SEQ ID NO: 1720198 - RNA, 13 nt, Homo sapiens
cucuuuaccuccu

SEQ ID NO: 1720199 - RNA, 17 nt, Homo sapiens
cugaagcaucaauaaaa

SEQ ID NO: 1720200 - RNA, 16 nt, Homo sapiens
cugacuuucucuccag

SEQ ID NO: 1720201 - RNA, 19 nt, Homo sapiens
cugagcagguguucuucau

SEQ ID NO: 1720202 - RNA, 23 nt, Homo sapiens
cugagcagguguucuucauuacc

SEQ ID NO: 1720203 - RNA, 18 nt, Homo sapiens
cugagcccccacauucuc

SEQ ID NO: 1720204 - RNA, 13 nt, Homo sapiens
cugaucuuacucu

SEQ ID NO: 1720205 - RNA, 23 nt, Homo sapiens
cugccacucaggcccaaagccuc

SEQ ID NO: 1720206 - RNA, 14 nt, Homo sapiens
cugccucagccucc

SEQ ID NO: 1720207 - RNA, 17 nt, Homo sapiens
cugcuuuccaaagccaa

SEQ ID NO: 1720208 - RNA, 20 nt, Homo sapiens
cuggagugcaguggcacgau

SEQ ID NO: 1720209 - RNA, 20 nt, Homo sapiens
cuggaucugugaggggcucu

SEQ ID NO: 1720210 - RNA, 18 nt, Homo sapiens
cuggccccugagaucucu

SEQ ID NO: 1720211 - RNA, 19 nt, Homo sapiens
cuggcuuuucuuucuacca

SEQ ID NO: 1720212 - RNA, 19 nt, Homo sapiens
cugucccucauccauagca

SEQ ID NO: 1720213 - RNA, 17 nt, Homo sapiens
cugugugcucuccaagc

SEQ ID NO: 1720214 - RNA, 21 nt, Homo sapiens
cuguucaguuuagcauuaaaa

SEQ ID NO: 1720215 - RNA, 20 nt, Homo sapiens
cuuaguuuuuucaucuguaa

SEQ ID NO: 1720216 - RNA, 19 nt, Homo sapiens
cuuaucaacauuuguucca

SEQ ID NO: 1720217 - RNA, 14 nt, Homo sapiens
cuucauacacauga

SEQ ID NO: 1720218 - RNA, 22 nt, Homo sapiens
cuucauacagggaugguguuca

SEQ ID NO: 1720219 - RNA, 17 nt, Homo sapiens
cuucauuaccucaguga

SEQ ID NO: 1720220 - RNA, 12 nt, Homo sapiens
cuucuggugacc

SEQ ID NO: 1720221 - RNA, 19 nt, Homo sapiens
cuugcaugaauuacuguau

SEQ ID NO: 1720222 - RNA, 16 nt, Homo sapiens
cuugugaccauuguaa

SEQ ID NO: 1720223 - RNA, 16 nt, Homo sapiens
cuuuccucaucaggcc

SEQ ID NO: 1720224 - RNA, 15 nt, Homo sapiens
cuuucuaccaaauga

SEQ ID NO: 1720225 - RNA, 22 nt, Homo sapiens
cuuucucuuuuaggaggcacaa

SEQ ID NO: 1720226 - RNA, 11 nt, Homo sapiens
cuuugaucucg

SEQ ID NO: 1720227 - RNA, 19 nt, Homo sapiens
cuuuuaauguacguuacag

SEQ ID NO: 1720228 - RNA, 19 nt, Homo sapiens
gaaaagagaugaugaaaau

SEQ ID NO: 1720229 - RNA, 18 nt, Homo sapiens
gaaaccacacagacuugg

SEQ ID NO: 1720230 - RNA, 22 nt, Homo sapiens
gaaagaucauuauuuaaccuag

SEQ ID NO: 1720231 - RNA, 13 nt, Homo sapiens
gaacuuuuuccaa

SEQ ID NO: 1720232 - RNA, 16 nt, Homo sapiens
gaagagggcugcaaau

SEQ ID NO: 1720233 - RNA, 19 nt, Homo sapiens
gaaggaggagucagggaga

SEQ ID NO: 1720234 - RNA, 17 nt, Homo sapiens
gaauaaacuggcagcuc

SEQ ID NO: 1720235 - RNA, 21 nt, Homo sapiens
gacaaagucaagccacauggu

SEQ ID NO: 1720236 - RNA, 15 nt, Homo sapiens
gacaaccucauuuua

SEQ ID NO: 1720237 - RNA, 14 nt, Homo sapiens
gacacaugugccgg

SEQ ID NO: 1720238 - RNA, 20 nt, Homo sapiens
gaccaaaugcuuuuccucaa

SEQ ID NO: 1720239 - RNA, 19 nt, Homo sapiens
gaccuaccugcagugggaa

SEQ ID NO: 1720240 - RNA, 14 nt, Homo sapiens
gacucucagcagcu

SEQ ID NO: 1720241 - RNA, 17 nt, Homo sapiens
gagauguggaaaagcca

SEQ ID NO: 1720242 - RNA, 23 nt, Homo sapiens
gagcaguagcagcagcaucucug

SEQ ID NO: 1720243 - RNA, 22 nt, Homo sapiens
gagccuuaguuuuuucaucugu

SEQ ID NO: 1720244 - RNA, 17 nt, Homo sapiens
gagcuccuuagccuuug

SEQ ID NO: 1720245 - RNA, 13 nt, Homo sapiens
gaggauccuguau

SEQ ID NO: 1720246 - RNA, 20 nt, Homo sapiens
gagucuucuccaauguccaa

SEQ ID NO: 1720247 - RNA, 12 nt, Homo sapiens
gagugaauuuga

SEQ ID NO: 1720248 - RNA, 13 nt, Homo sapiens
gauaugugccagg

SEQ ID NO: 1720249 - RNA, 15 nt, Homo sapiens
gaugaggcacuggaa

SEQ ID NO: 1720250 - RNA, 21 nt, Homo sapiens
gaugcuuuaugcaacuaacug

SEQ ID NO: 1720251 - RNA, 22 nt, Homo sapiens
gaugcuuuaugcaacuaacugu

SEQ ID NO: 1720252 - RNA, 16 nt, Homo sapiens
gauucuuccugcuuag

SEQ ID NO: 1720253 - RNA, 14 nt, Homo sapiens
gcaagucacuggcc

SEQ ID NO: 1720254 - RNA, 22 nt, Homo sapiens
gcaauggcgcgaucucagcuca

SEQ ID NO: 1720255 - RNA, 19 nt, Homo sapiens
gcacaacaguucucuucua

SEQ ID NO: 1720256 - RNA, 21 nt, Homo sapiens
gcacgaucucggcucacugca

SEQ ID NO: 1720257 - RNA, 22 nt, Homo sapiens
cuagccaccgccuccuacagcc

SEQ ID NO: 1720258 - RNA, 20 nt, Homo sapiens
cuagccuuguguuauagaau

SEQ ID NO: 1720259 - RNA, 22 nt, Homo sapiens
cuaguagcugggauuacaggcg

SEQ ID NO: 1720260 - RNA, 16 nt, Homo sapiens
cuagugaaacugccca

SEQ ID NO: 1720261 - RNA, 12 nt, Homo sapiens
cucacucuguca

SEQ ID NO: 1720262 - RNA, 23 nt, Homo sapiens
cucagaucauuaucagccugugc

SEQ ID NO: 1720263 - RNA, 12 nt, Homo sapiens
cucauccaaagu

SEQ ID NO: 1720264 - RNA, 15 nt, Homo sapiens
cucauuccagaggaa

SEQ ID NO: 1720265 - RNA, 14 nt, Homo sapiens
cucauuuuaacuca

SEQ ID NO: 1720266 - RNA, 15 nt, Homo sapiens
cuccaauguccaaaa

SEQ ID NO: 1720267 - RNA, 12 nt, Homo sapiens
cuccacauaccu

SEQ ID NO: 1720268 - RNA, 18 nt, Homo sapiens
cuccauugguguugacau

SEQ ID NO: 1720269 - RNA, 22 nt, Homo sapiens
cuccucugauuucaguucacug

SEQ ID NO: 1720270 - RNA, 18 nt, Homo sapiens
cuccugucccucauccau

SEQ ID NO: 1720271 - RNA, 17 nt, Homo sapiens
cuccuucuaccacuggg

SEQ ID NO: 1720272 - RNA, 12 nt, Homo sapiens
cucgagugaauu

SEQ ID NO: 1720273 - RNA, 21 nt, Homo sapiens
auugcuucaauaauauuagcu

SEQ ID NO: 1720274 - RNA, 18 nt, Homo sapiens
auugguguugacauacau

SEQ ID NO: 1720275 - RNA, 18 nt, Homo sapiens
auuguaacaauagcacaa

SEQ ID NO: 1720276 - RNA, 17 nt, Homo sapiens
auuuaccuucuaccucu

SEQ ID NO: 1720277 - RNA, 15 nt, Homo sapiens
auuuaugguucucag

SEQ ID NO: 1720278 - RNA, 21 nt, Homo sapiens
auuuaugguucucaggccuga

SEQ ID NO: 1720279 - RNA, 13 nt, Homo sapiens
auuuaugugaugg

SEQ ID NO: 1720280 - RNA, 22 nt, Homo sapiens
auuucccugaaggaaccaaagc

SEQ ID NO: 1720281 - RNA, 20 nt, Homo sapiens
auuuuauaugaugggggaaa

SEQ ID NO: 1720282 - RNA, 18 nt, Homo sapiens
auuuuauuuuucucauga

SEQ ID NO: 1720283 - RNA, 19 nt, Homo sapiens
auuuucuuucuccucugau

SEQ ID NO: 1720284 - RNA, 11 nt, Homo sapiens
caaaacacagg

SEQ ID NO: 1720285 - RNA, 17 nt, Homo sapiens
caaacucuccaccacac

SEQ ID NO: 1720286 - RNA, 14 nt, Homo sapiens
caaagccaauguga

SEQ ID NO: 1720287 - RNA, 20 nt, Homo sapiens
caaaguucuuaucucuagcu

SEQ ID NO: 1720288 - RNA, 17 nt, Homo sapiens
caagagagggaugcaug

SEQ ID NO: 1720289 - RNA, 17 nt, Homo sapiens
caagagccugagaguga

SEQ ID NO: 1720290 - RNA, 21 nt, Homo sapiens
caaguccuugaccucuauaaa

SEQ ID NO: 1720291 - RNA, 17 nt, Homo sapiens
aaaacgugcauggauau

SEQ ID NO: 1720292 - RNA, 23 nt, Homo sapiens
aaaaggcugaaaggaauauaguc

SEQ ID NO: 1720293 - RNA, 13 nt, Homo sapiens
aaaauauugcuuc

SEQ ID NO: 1720294 - RNA, 12 nt, Homo sapiens
aaacgugcaugg

SEQ ID NO: 1720295 - RNA, 18 nt, Homo sapiens
aaacuccuuaacuucagg

SEQ ID NO: 1720296 - RNA, 13 nt, Homo sapiens
aaacuguauauaa

SEQ ID NO: 1720297 - RNA, 19 nt, Homo sapiens
aaagcagcccccauuuccu

SEQ ID NO: 1720298 - RNA, 15 nt, Homo sapiens
aaaucuucuaauucc

SEQ ID NO: 1720299 - RNA, 17 nt, Homo sapiens
aaaucuucuaauuccaa

SEQ ID NO: 1720300 - RNA, 12 nt, Homo sapiens
aaaugcuuccaa

SEQ ID NO: 1720301 - RNA, 16 nt, Homo sapiens
aaaugcuuuuccucaa

SEQ ID NO: 1720302 - RNA, 14 nt, Homo sapiens
aaauggcuguggag

SEQ ID NO: 1720303 - RNA, 13 nt, Homo sapiens
aaauuuaugugau

SEQ ID NO: 1720304 - RNA, 13 nt, Homo sapiens
aacaauagcacaa

SEQ ID NO: 1720305 - RNA, 15 nt, Homo sapiens
aacagagcugggcua

SEQ ID NO: 1720306 - RNA, 17 nt, Homo sapiens
aacaugcuugcauuaua

SEQ ID NO: 1720307 - RNA, 13 nt, Homo sapiens
aaccccaggaggc

SEQ ID NO: 1720308 - RNA, 14 nt, Homo sapiens
aaccucaaaacugu

SEQ ID NO: 1720309 - RNA, 17 nt, Homo sapiens
aacuacagaaguggaag

SEQ ID NO: 1720310 - RNA, 15 nt, Homo sapiens
aagaaagacuuauca

SEQ ID NO: 1720311 - RNA, 20 nt, Homo sapiens
aagaauugucuuucugucuc

SEQ ID NO: 1720312 - RNA, 13 nt, Homo sapiens
aagagacugagcc

SEQ ID NO: 1720313 - RNA, 14 nt, Homo sapiens
aagaucucaguggu

SEQ ID NO: 1720314 - RNA, 14 nt, Homo sapiens
aagccauucugccu

SEQ ID NO: 1720315 - RNA, 23 nt, Homo sapiens
aaggaccauaaauuuaaauggag

SEQ ID NO: 1720316 - RNA, 14 nt, Homo sapiens
aaggagagcauagg

SEQ ID NO: 1720317 - RNA, 18 nt, Homo sapiens
aaguacuuaaacuuccac

SEQ ID NO: 1720318 - RNA, 15 nt, Homo sapiens
aaguccuugcucccg

SEQ ID NO: 1720319 - RNA, 14 nt, Homo sapiens
aaguggugcuccaa

SEQ ID NO: 1720320 - RNA, 13 nt, Homo sapiens
aaguucuuaucuc

SEQ ID NO: 1720321 - RNA, 13 nt, Homo sapiens
aauaaggcacaaa

SEQ ID NO: 1720322 - RNA, 23 nt, Homo sapiens
aauauuaucacgcagaucacuaa

SEQ ID NO: 1720323 - RNA, 21 nt, Homo sapiens
aauccuugugggaaaagaaau

SEQ ID NO: 1720324 - RNA, 18 nt, Homo sapiens
aaucuucuaauuccaaga

SEQ ID NO: 1720325 - RNA, 23 nt, Homo sapiens
aaugaggcugcuuuccaaagcca

SEQ ID NO: 1720326 - RNA, 21 nt, Homo sapiens
aauguacguuacagcuuucac

SEQ ID NO: 1720327 - RNA, 15 nt, Homo sapiens
aauguaugcuucaua

SEQ ID NO: 1720328 - RNA, 17 nt, Homo sapiens
aauuuacacacuugcau

SEQ ID NO: 1720329 - RNA, 20 nt, Homo sapiens
aauuuaucuuaaccucaaaa

SEQ ID NO: 1720330 - RNA, 20 nt, Homo sapiens
aauuuuguuuaaaacucaga

SEQ ID NO: 1720331 - RNA, 18 nt, Homo sapiens
acaaagucaagccacaug

SEQ ID NO: 1720332 - RNA, 15 nt, Homo sapiens
acaaguccuugaccu

SEQ ID NO: 1720333 - RNA, 16 nt, Homo sapiens
acacaauccuccaaga

SEQ ID NO: 1720334 - RNA, 18 nt, Homo sapiens
acacccagugccaggggc

SEQ ID NO: 1720335 - RNA, 19 nt, Homo sapiens
acacguaaugaaacuugga

SEQ ID NO: 1720336 - RNA, 20 nt, Homo sapiens
acacguaaugaaacuuggau

SEQ ID NO: 1720337 - RNA, 20 nt, Homo sapiens
acacucccacuuggcaucau

SEQ ID NO: 1720338 - RNA, 15 nt, Homo sapiens
acagacacucccacu

SEQ ID NO: 1720339 - RNA, 20 nt, Homo sapiens
acagacacucccacuuggca

SEQ ID NO: 1720340 - RNA, 21 nt, Homo sapiens
acagaguggacuguucccuga

SEQ ID NO: 1720341 - RNA, 16 nt, Homo sapiens
acagaugauacuucca

SEQ ID NO: 1720342 - RNA, 15 nt, Homo sapiens
acauacauccaacau

SEQ ID NO: 1720343 - RNA, 22 nt, Homo sapiens
acauaccuggcccugugccuug

SEQ ID NO: 1720344 - RNA, 18 nt, Homo sapiens
acauaguaaaugauucau

SEQ ID NO: 1720345 - RNA, 22 nt, Homo sapiens
acauccaggugggaggugucag

SEQ ID NO: 1720346 - RNA, 14 nt, Homo sapiens
acauuuguuccaug

SEQ ID NO: 1720347 - RNA, 22 nt, Homo sapiens
acauuuguuccgugucuggcca

SEQ ID NO: 1720348 - RNA, 23 nt, Homo sapiens
accaagccuuggcucuacccuga

SEQ ID NO: 1720349 - RNA, 14 nt, Homo sapiens
accacacacagcua

SEQ ID NO: 1720350 - RNA, 12 nt, Homo sapiens
accaccaaaguc

SEQ ID NO: 1720351 - RNA, 20 nt, Homo sapiens
accaggaggcggcagugcaa

SEQ ID NO: 1720352 - RNA, 22 nt, Homo sapiens
accaggaggcggcagugcaaca

SEQ ID NO: 1720353 - RNA, 18 nt, Homo sapiens
accauaaauuuaaaugga

SEQ ID NO: 1720354 - RNA, 18 nt, Homo sapiens
ccuugacaaagucaagcc

SEQ ID NO: 1720355 - RNA, 23 nt, Homo sapiens
ccuuggugugcuguauccaucca

SEQ ID NO: 1720356 - RNA, 14 nt, Homo sapiens
ccuuuaccccucau

SEQ ID NO: 1720357 - RNA, 17 nt, Homo sapiens
ccuuuccccucccucag

SEQ ID NO: 1720358 - RNA, 19 nt, Homo sapiens
cgauugcaggagucccugc

SEQ ID NO: 1720359 - RNA, 18 nt, Homo sapiens
cggccuccugucccucau

SEQ ID NO: 1720360 - RNA, 19 nt, Homo sapiens
cggcgggaggucugccagg

SEQ ID NO: 1720361 - RNA, 15 nt, Homo sapiens
cgggaugucaugucc

SEQ ID NO: 1720362 - RNA, 19 nt, Homo sapiens
cuagaaucagagcuggauu

SEQ ID NO: 1720363 - RNA, 19 nt, Homo sapiens
cuauauguugaccauucca

SEQ ID NO: 1720364 - RNA, 23 nt, Homo sapiens
cuauuagagcugccugugccuuu

SEQ ID NO: 1720365 - RNA, 15 nt, Homo sapiens
cucaagacaaaugac

SEQ ID NO: 1720366 - RNA, 11 nt, Homo sapiens
cucagugcuuu

SEQ ID NO: 1720367 - RNA, 14 nt, Homo sapiens
cucaucaggccauu

SEQ ID NO: 1720368 - RNA, 13 nt, Homo sapiens
cucauccaaaguu

SEQ ID NO: 1720369 - RNA, 22 nt, Homo sapiens
cuccacaggcaggcucauuuca

SEQ ID NO: 1720370 - RNA, 21 nt, Homo sapiens
cuccaggccagggggccaguc

SEQ ID NO: 1720371 - RNA, 20 nt, Homo sapiens
cuccaggccgagaugugcaa

SEQ ID NO: 1720372 - RNA, 22 nt, Homo sapiens
cuccauugguguugacauacau

SEQ ID NO: 1720373 - RNA, 23 nt, Homo sapiens
cuccccauggggcagcaucagga

SEQ ID NO: 1720374 - RNA, 22 nt, Homo sapiens
cuccucguuccucuccuggaug

SEQ ID NO: 1720375 - RNA, 11 nt, Homo sapiens
cuccucugauu

SEQ ID NO: 1720376 - RNA, 23 nt, Homo sapiens
cuccucuucuagcauuucuucca

SEQ ID NO: 1720377 - RNA, 18 nt, Homo sapiens
cucuccucuuugauguca

SEQ ID NO: 1720378 - RNA, 20 nt, Homo sapiens
cucucuugauuaagaucuca

SEQ ID NO: 1720379 - RNA, 18 nt, Homo sapiens
cucugugcccacccucca

SEQ ID NO: 1720380 - RNA, 18 nt, Homo sapiens
cugaaaggaauauaguca

SEQ ID NO: 1720381 - RNA, 20 nt, Homo sapiens
cugaaguacuuaaacuucca

SEQ ID NO: 1720382 - RNA, 14 nt, Homo sapiens
cugccacucaggcc

SEQ ID NO: 1720383 - RNA, 13 nt, Homo sapiens
cugccccuuccac

SEQ ID NO: 1720384 - RNA, 14 nt, Homo sapiens
cugcccugugcucc

SEQ ID NO: 1720385 - RNA, 17 nt, Homo sapiens
cugccucagccucccaa

SEQ ID NO: 1720386 - RNA, 23 nt, Homo sapiens
cugccuccuuuccccucccucag

SEQ ID NO: 1720387 - RNA, 21 nt, Homo sapiens
cugccugguccucacacucac

SEQ ID NO: 1720388 - RNA, 18 nt, Homo sapiens
cugcuacuagauugugag

SEQ ID NO: 1720389 - RNA, 14 nt, Homo sapiens
cugcucauccaaag

SEQ ID NO: 1720390 - RNA, 19 nt, Homo sapiens
cuggagugcaguggcacga

SEQ ID NO: 1720391 - RNA, 17 nt, Homo sapiens
cuggcccugugccuugg

SEQ ID NO: 1720392 - RNA, 21 nt, Homo sapiens
cuggggaugucucucaugacc

SEQ ID NO: 1720393 - RNA, 21 nt, Homo sapiens
cuguagacauuugcuaugagc

SEQ ID NO: 1720394 - RNA, 15 nt, Homo sapiens
cugugugcucuccaa

SEQ ID NO: 1720395 - RNA, 12 nt, Homo sapiens
cuuaaacuucca

SEQ ID NO: 1720396 - RNA, 19 nt, Homo sapiens
cuuaaccucaaaacuguau

SEQ ID NO: 1720397 - RNA, 15 nt, Homo sapiens
cuuaggccagcacca

SEQ ID NO: 1720398 - RNA, 23 nt, Homo sapiens
cuuaucaacauuuguuccaugag

SEQ ID NO: 1720399 - RNA, 18 nt, Homo sapiens
cuucaagauuccauuucu

SEQ ID NO: 1720400 - RNA, 14 nt, Homo sapiens
cuucauuaccucag

SEQ ID NO: 1720401 - RNA, 23 nt, Homo sapiens
cuucuaccucuuggcugccuugu

SEQ ID NO: 1720402 - RNA, 14 nt, Homo sapiens
cuucuuacucuccu

SEQ ID NO: 1720403 - RNA, 20 nt, Homo sapiens
cuugauuaagaucucagugg

SEQ ID NO: 1720404 - RNA, 22 nt, Homo sapiens
cuuuggguuggagcuguuccau

SEQ ID NO: 1720405 - RNA, 20 nt, Homo sapiens
cuuuugaaaagaggugugca

SEQ ID NO: 1720406 - RNA, 20 nt, Homo sapiens
cuuuuguaaaauaaaaccac

SEQ ID NO: 1720407 - RNA, 14 nt, Homo sapiens
cuuuugucccagaa

SEQ ID NO: 1720408 - RNA, 19 nt, Homo sapiens
gaaaaauaugauacucuca

SEQ ID NO: 1720409 - RNA, 15 nt, Homo sapiens
gaacgagaccugugu

SEQ ID NO: 1720410 - RNA, 13 nt, Homo sapiens
gaagagaagggca

SEQ ID NO: 1720411 - RNA, 22 nt, Homo sapiens
gaagagcuguguggccuggcaa

SEQ ID NO: 1720412 - RNA, 13 nt, Homo sapiens
gaagcaucaauaa

SEQ ID NO: 1720413 - RNA, 15 nt, Homo sapiens
gaaggaaccaaagcg

SEQ ID NO: 1720414 - RNA, 14 nt, Homo sapiens
gaaggcuaugggga

SEQ ID NO: 1720415 - RNA, 19 nt, Homo sapiens
gaaguacuuaaacuuccac

SEQ ID NO: 1720416 - RNA, 12 nt, Homo sapiens
gaauauuugaau

SEQ ID NO: 1720417 - RNA, 23 nt, Homo sapiens
gaauguaugcuucauacagggau

SEQ ID NO: 1720418 - RNA, 16 nt, Homo sapiens
gacaaccucauuuuaa

SEQ ID NO: 1720419 - RNA, 15 nt, Homo sapiens
gacacuacauaucua

SEQ ID NO: 1720420 - RNA, 18 nt, Homo sapiens
gacagcugcugugcauua

SEQ ID NO: 1720421 - RNA, 12 nt, Homo sapiens
gacauggcuccc

SEQ ID NO: 1720422 - RNA, 18 nt, Homo sapiens
gacaugucuagccacuga

SEQ ID NO: 1720423 - RNA, 17 nt, Homo sapiens
gaccauuguaacaauag

SEQ ID NO: 1720424 - RNA, 21 nt, Homo sapiens
gacgggacccugagccugugu

SEQ ID NO: 1720425 - RNA, 17 nt, Homo sapiens
gacuaaccccaccacac

SEQ ID NO: 1720426 - RNA, 12 nt, Homo sapiens
gacuauggagcu

SEQ ID NO: 1720427 - RNA, 23 nt, Homo sapiens
gacuggcaguaaccuagugaauu

SEQ ID NO: 1720428 - RNA, 13 nt, Homo sapiens
gagaaugucagua

SEQ ID NO: 1720429 - RNA, 14 nt, Homo sapiens
gagagagugcuauu

SEQ ID NO: 1720430 - RNA, 18 nt, Homo sapiens
gagauguggaaaagccaa

SEQ ID NO: 1720431 - RNA, 19 nt, Homo sapiens
gagauguggaaaagccaag

SEQ ID NO: 1720432 - RNA, 16 nt, Homo sapiens
gagcccccacauucuc

SEQ ID NO: 1720433 - RNA, 14 nt, Homo sapiens
gagcugugggagag

SEQ ID NO: 1720434 - RNA, 21 nt, Homo sapiens
gagcuuggaagcuucugguga

SEQ ID NO: 1720435 - RNA, 12 nt, Homo sapiens
gaggaagggaca

SEQ ID NO: 1720436 - RNA, 16 nt, Homo sapiens
gaggccucucauucca

SEQ ID NO: 1720437 - RNA, 19 nt, Homo sapiens
gaggcugcuuuccaaagcc

SEQ ID NO: 1720438 - RNA, 20 nt, Homo sapiens
gagugggguagguugggaga

SEQ ID NO: 1720439 - RNA, 20 nt, Homo sapiens
gaguguacuaguaguuaaga

SEQ ID NO: 1720440 - RNA, 14 nt, Homo sapiens
gauagaaggcuaug

SEQ ID NO: 1720441 - RNA, 15 nt, Homo sapiens
gauagccccacagga

SEQ ID NO: 1720442 - RNA, 14 nt, Homo sapiens
gauaugugccaggc

SEQ ID NO: 1720443 - RNA, 17 nt, Homo sapiens
gaucacuaaaguauauc

SEQ ID NO: 1720444 - RNA, 14 nt, Homo sapiens
gaugcugacaucca

SEQ ID NO: 1720445 - RNA, 24 nt, Homo sapiens
gauggagcugcguuuccugugcau

SEQ ID NO: 1720446 - RNA, 11 nt, Homo sapiens
gaugugcaaca

SEQ ID NO: 1720447 - RNA, 22 nt, Homo sapiens
gauucauauauccgaacuacug

SEQ ID NO: 1720448 - RNA, 12 nt, Homo sapiens
gauuggcuguga

SEQ ID NO: 1720449 - RNA, 19 nt, Homo sapiens
gauuucaguucacuguuca

SEQ ID NO: 1720450 - RNA, 19 nt, Homo sapiens
gcaaccccaucauccucag

SEQ ID NO: 1720451 - RNA, 23 nt, Homo sapiens
gcaauguagaggggaaaagagau

SEQ ID NO: 1720452 - RNA, 22 nt, Homo sapiens
gcacugaucuuacucuacugcu

SEQ ID NO: 1720453 - RNA, 18 nt, Homo sapiens
gcauggauaugugccagg

SEQ ID NO: 1720454 - RNA, 16 nt, Homo sapiens
gccaggccacuggccc

SEQ ID NO: 1720455 - RNA, 21 nt, Homo sapiens
gcccagcucaugcacaucagc

SEQ ID NO: 1720456 - RNA, 17 nt, Homo sapiens
gcccggcugaguguacu

SEQ ID NO: 1720457 - RNA, 20 nt, Homo sapiens
gcccugaguuccuagccacc

SEQ ID NO: 1720458 - RNA, 16 nt, Homo sapiens
gccgagaugugcaaca

SEQ ID NO: 1720459 - RNA, 13 nt, Homo sapiens
gccucgacacaga

SEQ ID NO: 1720460 - RNA, 20 nt, Homo sapiens
gccucugccucccaaagugc

SEQ ID NO: 1720461 - RNA, 12 nt, Homo sapiens
gccugccccuga

SEQ ID NO: 1720462 - RNA, 12 nt, Homo sapiens
gccugugccuuu

SEQ ID NO: 1720463 - RNA, 15 nt, Homo sapiens
gcguuuccugugcau

SEQ ID NO: 1720464 - RNA, 19 nt, Homo sapiens
gcuaagaauauuugaaugu

SEQ ID NO: 1720465 - RNA, 19 nt, Homo sapiens
gcucugugcccacccucca

SEQ ID NO: 1720466 - RNA, 22 nt, Homo sapiens
gcugaggccucucauuccagag

SEQ ID NO: 1720467 - RNA, 13 nt, Homo sapiens
gcugaguguacua

SEQ ID NO: 1720468 - RNA, 14 nt, Homo sapiens
gcugcagagcagug

SEQ ID NO: 1720469 - RNA, 12 nt, Homo sapiens
gcugccuaauaa

SEQ ID NO: 1720470 - RNA, 16 nt, Homo sapiens
uuuaucuuaaccucaa

SEQ ID NO: 1720471 - RNA, 23 nt, Homo sapiens
uuucccugaaggaaccaaagcga

SEQ ID NO: 1720472 - RNA, 23 nt, Homo sapiens
uuucucuccagcgguccaaaguu

SEQ ID NO: 1720473 - RNA, 15 nt, Homo sapiens
uuugaauguaugcuu

SEQ ID NO: 1720474 - RNA, 18 nt, Homo sapiens
uuuguaaaauaaaaccac

SEQ ID NO: 1720475 - RNA, 16 nt, Homo sapiens
uuuucauuuagugcua

SEQ ID NO: 1720476 - RNA, 19 nt, Homo sapiens
uccggccuccugucccuca

SEQ ID NO: 1720477 - RNA, 20 nt, Homo sapiens
uccggccuccugucccucau

SEQ ID NO: 1720478 - RNA, 14 nt, Homo sapiens
uccuagccacccac

SEQ ID NO: 1720479 - RNA, 19 nt, Homo sapiens
uccuagccacccaccacac

SEQ ID NO: 1720480 - RNA, 17 nt, Homo sapiens
uccucagaucauuauca

SEQ ID NO: 1720481 - RNA, 22 nt, Homo sapiens
uccugaggaagagggacuguuc

SEQ ID NO: 1720482 - RNA, 14 nt, Homo sapiens
uccuggaugggaca

SEQ ID NO: 1720483 - RNA, 12 nt, Homo sapiens
uccugugcaugg

SEQ ID NO: 1720484 - RNA, 16 nt, Homo sapiens
uccugugccagaggaa

SEQ ID NO: 1720485 - RNA, 23 nt, Homo sapiens
uccuguuggacacccagugccag

SEQ ID NO: 1720486 - RNA, 14 nt, Homo sapiens
aaaacuguauauaa

SEQ ID NO: 1720487 - RNA, 19 nt, Homo sapiens
aaaauaaaaccaccaaagu

SEQ ID NO: 1720488 - RNA, 15 nt, Homo sapiens
aaacugaagcaucaa

SEQ ID NO: 1720489 - RNA, 12 nt, Homo sapiens
aaagagacugag

SEQ ID NO: 1720490 - RNA, 16 nt, Homo sapiens
aaagaucauuauuuaa

SEQ ID NO: 1720491 - RNA, 17 nt, Homo sapiens
aaauaaaaccaccaaag

SEQ ID NO: 1720492 - RNA, 18 nt, Homo sapiens
aaauaaaaccaccaaagu

SEQ ID NO: 1720493 - RNA, 17 nt, Homo sapiens
aaauauugcuucaauaa

SEQ ID NO: 1720494 - RNA, 18 nt, Homo sapiens
aaauauugcuucaauaau

SEQ ID NO: 1720495 - RNA, 15 nt, Homo sapiens
aaaugcuuuuccuca

SEQ ID NO: 1720496 - RNA, 15 nt, Homo sapiens
aaauuagaggacacu

SEQ ID NO: 1720497 - RNA, 16 nt, Homo sapiens
aaauucucaguucucu

SEQ ID NO: 1720498 - RNA, 14 nt, Homo sapiens
aaauuuaaauggag

SEQ ID NO: 1720499 - RNA, 14 nt, Homo sapiens
aacagugcgccagg

SEQ ID NO: 1720500 - RNA, 16 nt, Homo sapiens
aacaugcuugcauuau

SEQ ID NO: 1720501 - RNA, 12 nt, Homo sapiens
aaccuagugaau

SEQ ID NO: 1720502 - RNA, 13 nt, Homo sapiens
aaccuaguucaau

SEQ ID NO: 1720503 - RNA, 20 nt, Homo sapiens
aaccucugccucccggguuc

SEQ ID NO: 1720504 - RNA, 16 nt, Homo sapiens
aaccuucaaagcuuuu

SEQ ID NO: 1720505 - RNA, 23 nt, Homo sapiens
aacgugcauggauaugugccagg

SEQ ID NO: 1720506 - RNA, 18 nt, Homo sapiens
aacucucgagacuucucu

SEQ ID NO: 1720507 - RNA, 21 nt, Homo sapiens
aacuuccacaagagugaauuu

SEQ ID NO: 1720508 - RNA, 14 nt, Homo sapiens
aagauuccauuucu

SEQ ID NO: 1720509 - RNA, 23 nt, Homo sapiens
aagauuccuaauaaucauuggau

SEQ ID NO: 1720510 - RNA, 18 nt, Homo sapiens
aagcaccccagucacuag

SEQ ID NO: 1720511 - RNA, 15 nt, Homo sapiens
aagccauucugccuc

SEQ ID NO: 1720512 - RNA, 14 nt, Homo sapiens
aaggaaccaaagcg

SEQ ID NO: 1720513 - RNA, 19 nt, Homo sapiens
aagggacaccaagccuugg

SEQ ID NO: 1720514 - RNA, 12 nt, Homo sapiens
aaguacuuccac

SEQ ID NO: 1720515 - RNA, 19 nt, Homo sapiens
aaguauaucuuuaauucug

SEQ ID NO: 1720516 - RNA, 20 nt, Homo sapiens
aagucacuggccaguggcug

SEQ ID NO: 1720517 - RNA, 22 nt, Homo sapiens
aagucaucuguuuaauuuacac

SEQ ID NO: 1720518 - RNA, 14 nt, Homo sapiens
aauaauauuagcuu

SEQ ID NO: 1720519 - RNA, 15 nt, Homo sapiens
aauaauauuagcuua

SEQ ID NO: 1720520 - RNA, 19 nt, Homo sapiens
aauauugauguuaacaaga

SEQ ID NO: 1720521 - RNA, 14 nt, Homo sapiens
aaucauacaguucc

SEQ ID NO: 1720522 - RNA, 22 nt, Homo sapiens
aaucaucaguuccuuugaucuc

SEQ ID NO: 1720523 - RNA, 19 nt, Homo sapiens
aaucccaucuauucucugc

SEQ ID NO: 1720524 - RNA, 16 nt, Homo sapiens
aaucuaugauuccagg

SEQ ID NO: 1720525 - RNA, 23 nt, Homo sapiens
aaucugagaggccacagugcaau

SEQ ID NO: 1720526 - RNA, 17 nt, Homo sapiens
aaugacccccaucccau

SEQ ID NO: 1720527 - RNA, 20 nt, Homo sapiens
aauggcgcgaucucagcuca

SEQ ID NO: 1720528 - RNA, 17 nt, Homo sapiens
aaugucaguauguggaa

SEQ ID NO: 1720529 - RNA, 21 nt, Homo sapiens
aauuggguggggggcuucaua

SEQ ID NO: 1720530 - RNA, 17 nt, Homo sapiens
acaaaaauucucaguuc

SEQ ID NO: 1720531 - RNA, 16 nt, Homo sapiens
acaagagugaauuuga

SEQ ID NO: 1720532 - RNA, 19 nt, Homo sapiens
acaagagugaauuugaccu

SEQ ID NO: 1720533 - RNA, 14 nt, Homo sapiens
acacccagugccag

SEQ ID NO: 1720534 - RNA, 22 nt, Homo sapiens
acaccggguuccagcaccacac

SEQ ID NO: 1720535 - RNA, 13 nt, Homo sapiens
acacugauccagc

SEQ ID NO: 1720536 - RNA, 21 nt, Homo sapiens
acacugauccagcccugaguu

SEQ ID NO: 1720537 - RNA, 18 nt, Homo sapiens
acagcggcuggacuugga

SEQ ID NO: 1720538 - RNA, 20 nt, Homo sapiens
acagggucucacucugucac

SEQ ID NO: 1720539 - RNA, 23 nt, Homo sapiens
acaugcuugaauaacugagcuua

SEQ ID NO: 1720540 - RNA, 16 nt, Homo sapiens
acaugcuugcauuaua

SEQ ID NO: 1720541 - RNA, 15 nt, Homo sapiens
acucuccucuuccag

SEQ ID NO: 1720542 - RNA, 22 nt, Homo sapiens
acugauccagcccugaguuccu

SEQ ID NO: 1720543 - RNA, 16 nt, Homo sapiens
acugaucuuacucuac

SEQ ID NO: 1720544 - RNA, 17 nt, Homo sapiens
acugcugggcuuggcag

SEQ ID NO: 1720545 - RNA, 21 nt, Homo sapiens
acuggcaguaaccuagugaau

SEQ ID NO: 1720546 - RNA, 20 nt, Homo sapiens
acuguauauaaaucuucaaa

SEQ ID NO: 1720547 - RNA, 13 nt, Homo sapiens
acuguucccugag

SEQ ID NO: 1720548 - RNA, 19 nt, Homo sapiens
acuuccacaagagugaauu

SEQ ID NO: 1720549 - RNA, 15 nt, Homo sapiens
acuuggcaucauuca

SEQ ID NO: 1720550 - RNA, 16 nt, Homo sapiens
acuuuaugaaaacuga

SEQ ID NO: 1720551 - RNA, 18 nt, Homo sapiens
acuuuaugaaaacugaag

SEQ ID NO: 1720552 - RNA, 14 nt, Homo sapiens
acuuuuuccaaucu

SEQ ID NO: 1720553 - RNA, 20 nt, Homo sapiens
agaaaaauaagcucgaguga

SEQ ID NO: 1720554 - RNA, 19 nt, Homo sapiens
agaaaagcaguggcuccau

SEQ ID NO: 1720555 - RNA, 23 nt, Homo sapiens
agacacucccacuuggcaucauu

SEQ ID NO: 1720556 - RNA, 9 nt, Homo sapiens
agacagggu

SEQ ID NO: 1720557 - RNA, 20 nt, Homo sapiens
agacagggucucacucuguc

SEQ ID NO: 1720558 - RNA, 14 nt, Homo sapiens
agaccucaccucca

SEQ ID NO: 1720559 - RNA, 17 nt, Homo sapiens
agaccugugugccaggg

SEQ ID NO: 1720560 - RNA, 14 nt, Homo sapiens
agacuggagugcag

SEQ ID NO: 1720561 - RNA, 12 nt, Homo sapiens
agagacugagcc

SEQ ID NO: 1720562 - RNA, 14 nt, Homo sapiens
agagagugcuauug

SEQ ID NO: 1720563 - RNA, 18 nt, Homo sapiens
agagcccagcucaugcac

SEQ ID NO: 1720564 - RNA, 20 nt, Homo sapiens
agagcgagagaauaugucac

SEQ ID NO: 1720565 - RNA, 14 nt, Homo sapiens
agaggacaguauuu

SEQ ID NO: 1720566 - RNA, 21 nt, Homo sapiens
agaguggacuguucccugagg

SEQ ID NO: 1720567 - RNA, 15 nt, Homo sapiens
agauagccccacagg

SEQ ID NO: 1720568 - RNA, 16 nt, Homo sapiens
agauagccccacagga

SEQ ID NO: 1720569 - RNA, 16 nt, Homo sapiens
agaugaggcacuggaa

SEQ ID NO: 1720570 - RNA, 12 nt, Homo sapiens
agauguacuugu

SEQ ID NO: 1720571 - RNA, 13 nt, Homo sapiens
agauuugccuuau

SEQ ID NO: 1720572 - RNA, 13 nt, Homo sapiens
agcagcagugcau

SEQ ID NO: 1720573 - RNA, 22 nt, Homo sapiens
agccagaauucuggacaaccca

SEQ ID NO: 1720574 - RNA, 19 nt, Homo sapiens
agccuacacuauucuagca

SEQ ID NO: 1720575 - RNA, 16 nt, Homo sapiens
agcucagacaucuacu

SEQ ID NO: 1720576 - RNA, 13 nt, Homo sapiens
agcucuacucugg

SEQ ID NO: 1720577 - RNA, 17 nt, Homo sapiens
agcugggauuacaggcg

SEQ ID NO: 1720578 - RNA, 18 nt, Homo sapiens
agcuuauauauuacuugu

SEQ ID NO: 1720579 - RNA, 13 nt, Homo sapiens
aggaaauggcugu

SEQ ID NO: 1720580 - RNA, 13 nt, Homo sapiens
aggaaccaaagcg

SEQ ID NO: 1720581 - RNA, 21 nt, Homo sapiens
aggaagaugcugacauccagg

SEQ ID NO: 1720582 - RNA, 14 nt, Homo sapiens
aggaccccugagua

SEQ ID NO: 1720583 - RNA, 13 nt, Homo sapiens
aggaggccugcag

SEQ ID NO: 1720584 - RNA, 18 nt, Homo sapiens
aggcaaagugcaccucaa

SEQ ID NO: 1720585 - RNA, 15 nt, Homo sapiens
aggccagcaccaucu

SEQ ID NO: 1720586 - RNA, 15 nt, Homo sapiens
aggccauugucccug

SEQ ID NO: 1720587 - RNA, 12 nt, Homo sapiens
aggcccaaagcc

SEQ ID NO: 1720588 - RNA, 16 nt, Homo sapiens
aggcugucgccugcac

SEQ ID NO: 1720589 - RNA, 22 nt, Homo sapiens
aggcuucauugcacugaucuua

SEQ ID NO: 1720590 - RNA, 23 nt, Homo sapiens
agggcagggcugaggccucucau

SEQ ID NO: 1720591 - RNA, 14 nt, Homo sapiens
aggggucauucaug

SEQ ID NO: 1720592 - RNA, 14 nt, Homo sapiens
agggugacuaugga

SEQ ID NO: 1720593 - RNA, 22 nt, Homo sapiens
aggguugggcgugcuaccugca

SEQ ID NO: 1720594 - RNA, 16 nt, Homo sapiens
agguaucuacuuuaga

SEQ ID NO: 1720595 - RNA, 14 nt, Homo sapiens
aggugccaggugug

SEQ ID NO: 1720596 - RNA, 21 nt, Homo sapiens
agguguucuucauuaccucag

SEQ ID NO: 1720597 - RNA, 13 nt, Homo sapiens
agucauccucaga

SEQ ID NO: 1720598 - RNA, 21 nt, Homo sapiens
agucaucuguuuaauuuacac

SEQ ID NO: 1720599 - RNA, 13 nt, Homo sapiens
agugcuugauaug

SEQ ID NO: 1720600 - RNA, 15 nt, Homo sapiens
agugggguagguugg

SEQ ID NO: 1720601 - RNA, 12 nt, Homo sapiens
aguuacauauua

SEQ ID NO: 1720602 - RNA, 16 nt, Homo sapiens
aguucaugucgcaaca

SEQ ID NO: 1720603 - RNA, 15 nt, Homo sapiens
aguuccuuugaucuc

SEQ ID NO: 1720604 - RNA, 20 nt, Homo sapiens
aguucuuaucucuagcucag

SEQ ID NO: 1720605 - RNA, 19 nt, Homo sapiens
aguuuggcaaacucuccac

SEQ ID NO: 1720606 - RNA, 17 nt, Homo sapiens
auaaaaccaccaaaguc

SEQ ID NO: 1720607 - RNA, 19 nt, Homo sapiens
auaaaauaaucauacaguu

SEQ ID NO: 1720608 - RNA, 23 nt, Homo sapiens
auaagcagucauccucagaucau

SEQ ID NO: 1720609 - RNA, 18 nt, Homo sapiens
auaaucacaacccuucag

SEQ ID NO: 1720610 - RNA, 14 nt, Homo sapiens
auaauuauauacuc

SEQ ID NO: 1720611 - RNA, 18 nt, Homo sapiens
auagcaccuccacauacc

SEQ ID NO: 1720612 - RNA, 17 nt, Homo sapiens
auagucaguaauuuauc

SEQ ID NO: 1720613 - RNA, 14 nt, Homo sapiens
auauccugaucucg

SEQ ID NO: 1720614 - RNA, 18 nt, Homo sapiens
auauguaaguacuuccac

SEQ ID NO: 1720615 - RNA, 18 nt, Homo sapiens
aucaacauuuguuccaug

SEQ ID NO: 1720616 - RNA, 13 nt, Homo sapiens
aucacccagcuca

SEQ ID NO: 1720617 - RNA, 17 nt, Homo sapiens
aucacgcagaucacuaa

SEQ ID NO: 1720618 - RNA, 14 nt, Homo sapiens
aucucuuuaccucc

SEQ ID NO: 1720619 - RNA, 17 nt, Homo sapiens
aucugagaggccacagu

SEQ ID NO: 1720620 - RNA, 21 nt, Homo sapiens
augaggcugcuuuccaaagcc

SEQ ID NO: 1720621 - RNA, 13 nt, Homo sapiens
augauacuuccaa

SEQ ID NO: 1720622 - RNA, 16 nt, Homo sapiens
augaucaaaacaugcu

SEQ ID NO: 1720623 - RNA, 22 nt, Homo sapiens
augaugagguuuucuuaacuua

SEQ ID NO: 1720624 - RNA, 18 nt, Homo sapiens
augcugcucauccaaagu

SEQ ID NO: 1720625 - RNA, 13 nt, Homo sapiens
auguaaaguaaga

SEQ ID NO: 1720626 - RNA, 17 nt, Homo sapiens
augucaaacgccuugaa

SEQ ID NO: 1720627 - RNA, 16 nt, Homo sapiens
auguggaaaagccaag

SEQ ID NO: 1720628 - RNA, 15 nt, Homo sapiens
auguugaccauucca

SEQ ID NO: 1720629 - RNA, 23 nt, Homo sapiens
auuacaggugugacccacugcgc

SEQ ID NO: 1720630 - RNA, 16 nt, Homo sapiens
auuaucacgcagauca

SEQ ID NO: 1720631 - RNA, 17 nt, Homo sapiens
auuaucacgcagaucac

SEQ ID NO: 1720632 - RNA, 12 nt, Homo sapiens
auuauucccaug

SEQ ID NO: 1720633 - RNA, 13 nt, Homo sapiens
auuauucccauga

SEQ ID NO: 1720634 - RNA, 20 nt, Homo sapiens
auucacagcaagucacuggc

SEQ ID NO: 1720635 - RNA, 15 nt, Homo sapiens
auuccuucuuacucu

SEQ ID NO: 1720636 - RNA, 14 nt, Homo sapiens
auucucaguucucu

SEQ ID NO: 1720637 - RNA, 23 nt, Homo sapiens
auucuugugccucggccucccua

SEQ ID NO: 1720638 - RNA, 15 nt, Homo sapiens
agagugaauuugacc

SEQ ID NO: 1720639 - RNA, 17 nt, Homo sapiens
agauauuaggggggaaa

SEQ ID NO: 1720640 - RNA, 18 nt, Homo sapiens
agauccaauaggaucucg

SEQ ID NO: 1720641 - RNA, 21 nt, Homo sapiens
agaugaguaauuucuuuggca

SEQ ID NO: 1720642 - RNA, 18 nt, Homo sapiens
agaugcugacauccaggu

SEQ ID NO: 1720643 - RNA, 11 nt, Homo sapiens
agauuccauuu

SEQ ID NO: 1720644 - RNA, 16 nt, Homo sapiens
agcaagucacuggcca

SEQ ID NO: 1720645 - RNA, 11 nt, Homo sapiens
agcacaguccc

SEQ ID NO: 1720646 - RNA, 22 nt, Homo sapiens
agcagaccuaccugcaguggga

SEQ ID NO: 1720647 - RNA, 23 nt, Homo sapiens
agcagguaugggacaggugccag

SEQ ID NO: 1720648 - RNA, 22 nt, Homo sapiens
agcaucucccaguucauaauca

SEQ ID NO: 1720649 - RNA, 14 nt, Homo sapiens
agcauggccuccag

SEQ ID NO: 1720650 - RNA, 13 nt, Homo sapiens
agccaaugugaac

SEQ ID NO: 1720651 - RNA, 12 nt, Homo sapiens
agccacuagcuu

SEQ ID NO: 1720652 - RNA, 17 nt, Homo sapiens
agccagaggucuggccc

SEQ ID NO: 1720653 - RNA, 14 nt, Homo sapiens
agcccaaaccacca

SEQ ID NO: 1720654 - RNA, 12 nt, Homo sapiens
agcccagaauaa

SEQ ID NO: 1720655 - RNA, 18 nt, Homo sapiens
agccggcgggaggucugc

SEQ ID NO: 1720656 - RNA, 17 nt, Homo sapiens
agcgagagaauauguca

SEQ ID NO: 1720657 - RNA, 18 nt, Homo sapiens
agcucacugcaaccucca

SEQ ID NO: 1720658 - RNA, 18 nt, Homo sapiens
agcucaugcacaucagcu

SEQ ID NO: 1720659 - RNA, 19 nt, Homo sapiens
agcuggggaugucucucau

SEQ ID NO: 1720660 - RNA, 21 nt, Homo sapiens
agcuugagggugacuauggag

SEQ ID NO: 1720661 - RNA, 19 nt, Homo sapiens
agcuuuccucaucaggcca

SEQ ID NO: 1720662 - RNA, 16 nt, Homo sapiens
aggacccuuucuccac

SEQ ID NO: 1720663 - RNA, 15 nt, Homo sapiens
agggaaguccuugca

SEQ ID NO: 1720664 - RNA, 18 nt, Homo sapiens
agggagcaccuggugagu

SEQ ID NO: 1720665 - RNA, 18 nt, Homo sapiens
agggaugcauggagauag

SEQ ID NO: 1720666 - RNA, 15 nt, Homo sapiens
aggggcucucucaug

SEQ ID NO: 1720667 - RNA, 13 nt, Homo sapiens
aggggucauucau

SEQ ID NO: 1720668 - RNA, 14 nt, Homo sapiens
agggucgugcuccg

SEQ ID NO: 1720669 - RNA, 22 nt, Homo sapiens
agguaugggacaggugccaggu

SEQ ID NO: 1720670 - RNA, 13 nt, Homo sapiens
aggucugccaggc

SEQ ID NO: 1720671 - RNA, 16 nt, Homo sapiens
agguggggacucugga

SEQ ID NO: 1720672 - RNA, 23 nt, Homo sapiens
agguguucuucauuaccucagug

SEQ ID NO: 1720673 - RNA, 21 nt, Homo sapiens
agguuuguuuagaagaagugu

SEQ ID NO: 1720674 - RNA, 14 nt, Homo sapiens
aguagagacagggu

SEQ ID NO: 1720675 - RNA, 13 nt, Homo sapiens
agucuagccuugu

SEQ ID NO: 1720676 - RNA, 22 nt, Homo sapiens
agucuagccuuguguuauagaa

SEQ ID NO: 1720677 - RNA, 16 nt, Homo sapiens
agugagguggaauuau

SEQ ID NO: 1720678 - RNA, 13 nt, Homo sapiens
aguuccuagccac

SEQ ID NO: 1720679 - RNA, 16 nt, Homo sapiens
aguuccuuugaucucg

SEQ ID NO: 1720680 - RNA, 13 nt, Homo sapiens
aguuuagcauuaa

SEQ ID NO: 1720681 - RNA, 19 nt, Homo sapiens
aguuuggaaugaagaaauu

SEQ ID NO: 1720682 - RNA, 13 nt, Homo sapiens
auaaaagaauugu

SEQ ID NO: 1720683 - RNA, 18 nt, Homo sapiens
auaaaagauguacuugug

SEQ ID NO: 1720684 - RNA, 17 nt, Homo sapiens
auaagcucgagugaauu

SEQ ID NO: 1720685 - RNA, 20 nt, Homo sapiens
auacacaugagauaauaugc

SEQ ID NO: 1720686 - RNA, 20 nt, Homo sapiens
auaccuggcccugugccuug

SEQ ID NO: 1720687 - RNA, 20 nt, Homo sapiens
auagcaccuccacauaccug

SEQ ID NO: 1720688 - RNA, 15 nt, Homo sapiens
auagcagcagugcau

SEQ ID NO: 1720689 - RNA, 14 nt, Homo sapiens
auauaaaucuucaa

SEQ ID NO: 1720690 - RNA, 12 nt, Homo sapiens
auauaacaugua

SEQ ID NO: 1720691 - RNA, 14 nt, Homo sapiens
auaugauacucuca

SEQ ID NO: 1720692 - RNA, 17 nt, Homo sapiens
auauguaaguacuucca

SEQ ID NO: 1720693 - RNA, 22 nt, Homo sapiens
auauuaucacgcagaucacuaa

SEQ ID NO: 1720694 - RNA, 14 nt, Homo sapiens
auauuucuagacau

SEQ ID NO: 1720695 - RNA, 15 nt, Homo sapiens
aucauuaucagccug

SEQ ID NO: 1720696 - RNA, 22 nt, Homo sapiens
aucccaucuauucucugccuuu

SEQ ID NO: 1720697 - RNA, 14 nt, Homo sapiens
aucuaugauuccag

SEQ ID NO: 1720698 - RNA, 17 nt, Homo sapiens
aucucagcucacugcaa

SEQ ID NO: 1720699 - RNA, 17 nt, Homo sapiens
aucucggcucacugcaa

SEQ ID NO: 1720700 - RNA, 13 nt, Homo sapiens
aucuguaccucug

SEQ ID NO: 1720701 - RNA, 21 nt, Homo sapiens
aucuguccccugcuacuagau

SEQ ID NO: 1720702 - RNA, 23 nt, Homo sapiens
aucugugaggggcucucucauga

SEQ ID NO: 1720703 - RNA, 19 nt, Homo sapiens
aucuuaaccucaaaacugu

SEQ ID NO: 1720704 - RNA, 15 nt, Homo sapiens
aucuucaaagcuuuu

SEQ ID NO: 1720705 - RNA, 14 nt, Homo sapiens
augauuccaggugg

SEQ ID NO: 1720706 - RNA, 22 nt, Homo sapiens
augcagauuuugcccuugacaa

SEQ ID NO: 1720707 - RNA, 16 nt, Homo sapiens
auggagauagccccac

SEQ ID NO: 1720708 - RNA, 16 nt, Homo sapiens
augggaagacugagcu

SEQ ID NO: 1720709 - RNA, 17 nt, Homo sapiens
augggacaggugccagg

SEQ ID NO: 1720710 - RNA, 19 nt, Homo sapiens
auggugaggagauccuguu

SEQ ID NO: 1720711 - RNA, 23 nt, Homo sapiens
auguacguuacagcuuucacaga

SEQ ID NO: 1720712 - RNA, 13 nt, Homo sapiens
augucucucauga

SEQ ID NO: 1720713 - RNA, 21 nt, Homo sapiens
augugggggucuguguguuua

SEQ ID NO: 1720714 - RNA, 16 nt, Homo sapiens
auguugaccauuccaa

SEQ ID NO: 1720715 - RNA, 20 nt, Homo sapiens
auguugaccauuccaaaguu

SEQ ID NO: 1720716 - RNA, 14 nt, Homo sapiens
auuacaguccuuca

SEQ ID NO: 1720717 - RNA, 14 nt, Homo sapiens
auuauauacuccuu

SEQ ID NO: 1720718 - RNA, 13 nt, Homo sapiens
auucacagcaagu

SEQ ID NO: 1720719 - RNA, 18 nt, Homo sapiens
auucacagcaagucacug

SEQ ID NO: 1720720 - RNA, 23 nt, Homo sapiens
auuccacacccucacugcuguag

SEQ ID NO: 1720721 - RNA, 23 nt, Homo sapiens
auuccuguccuucacauuuacua

SEQ ID NO: 1720722 - RNA, 22 nt, Homo sapiens
auucucaguucucuucacucaa

SEQ ID NO: 1720723 - RNA, 15 nt, Homo sapiens
auucuuugaccuguu

SEQ ID NO: 1720724 - RNA, 16 nt, Homo sapiens
auugcaggagucccug

SEQ ID NO: 1720725 - RNA, 18 nt, Homo sapiens
auugcuucaauaauauua

SEQ ID NO: 1720726 - RNA, 12 nt, Homo sapiens
auugucccugaa

SEQ ID NO: 1720727 - RNA, 22 nt, Homo sapiens
auugugcccgggcccaugggga

SEQ ID NO: 1720728 - RNA, 14 nt, Homo sapiens
auuucaguucacug

SEQ ID NO: 1720729 - RNA, 13 nt, Homo sapiens
auuugcuaugagc

SEQ ID NO: 1720730 - RNA, 22 nt, Homo sapiens
auuuugcccuugacaaagucaa

SEQ ID NO: 1720731 - RNA, 17 nt, Homo sapiens
caaaacuguauauaaau

SEQ ID NO: 1720732 - RNA, 14 nt, Homo sapiens
caaagcagcugcag

SEQ ID NO: 1720733 - RNA, 18 nt, Homo sapiens
caaagcuuuuuucauuua

SEQ ID NO: 1720734 - RNA, 21 nt, Homo sapiens
caaagucaagccacaugguga

SEQ ID NO: 1720735 - RNA, 22 nt, Homo sapiens
caaaguguuaggauuacaggca

SEQ ID NO: 1720736 - RNA, 15 nt, Homo sapiens
caacagcacgugcag

SEQ ID NO: 1720737 - RNA, 18 nt, Homo sapiens
caacauuuguuccaugag

SEQ ID NO: 1720738 - RNA, 13 nt, Homo sapiens
caagaggggaaaa

SEQ ID NO: 1720739 - RNA, 22 nt, Homo sapiens
caagccacauggugacuuuuga

SEQ ID NO: 1720740 - RNA, 15 nt, Homo sapiens
caagccuccacuucc

SEQ ID NO: 1720741 - RNA, 16 nt, Homo sapiens
caauuccuguccuuca

SEQ ID NO: 1720742 - RNA, 14 nt, Homo sapiens
caauucgaacuuuu

SEQ ID NO: 1720743 - RNA, 23 nt, Homo sapiens
cacaacccuucagauuugccuua

SEQ ID NO: 1720744 - RNA, 19 nt, Homo sapiens
cacagacacuacauaucua

SEQ ID NO: 1720745 - RNA, 17 nt, Homo sapiens
cacagaugauacuucca

SEQ ID NO: 1720746 - RNA, 19 nt, Homo sapiens
caccaucucuuuaccuccu

SEQ ID NO: 1720747 - RNA, 14 nt, Homo sapiens
cacccuccacucuc

SEQ ID NO: 1720748 - RNA, 22 nt, Homo sapiens
caccucaaaucuucuaauucca

SEQ ID NO: 1720749 - RNA, 22 nt, Homo sapiens
caccuggcuuuucuuucuacca

SEQ ID NO: 1720750 - RNA, 12 nt, Homo sapiens
cacuagcuugau

SEQ ID NO: 1720751 - RNA, 18 nt, Homo sapiens
cacucacccaacaauccc

SEQ ID NO: 1720752 - RNA, 18 nt, Homo sapiens
cacucaggcccaaagccu

SEQ ID NO: 1720753 - RNA, 14 nt, Homo sapiens
cacuccuccuagcc

SEQ ID NO: 1720754 - RNA, 17 nt, Homo sapiens
cacuggccccugagauc

SEQ ID NO: 1720755 - RNA, 21 nt, Homo sapiens
guccuucacauuuacuagcug

SEQ ID NO: 1720756 - RNA, 14 nt, Homo sapiens
gucuccacugggga

SEQ ID NO: 1720757 - RNA, 20 nt, Homo sapiens
gucucgauauccugaucucg

SEQ ID NO: 1720758 - RNA, 14 nt, Homo sapiens
gugacccacugcgc

SEQ ID NO: 1720759 - RNA, 22 nt, Homo sapiens
gugaccuuccaagagccugaga

SEQ ID NO: 1720760 - RNA, 21 nt, Homo sapiens
gugauguguccugauaagcug

SEQ ID NO: 1720761 - RNA, 21 nt, Homo sapiens
gugcugggauuacagguguga

SEQ ID NO: 1720762 - RNA, 13 nt, Homo sapiens
guggaaaagccaa

SEQ ID NO: 1720763 - RNA, 22 nt, Homo sapiens
guggcuggaucugugaggggcu

SEQ ID NO: 1720764 - RNA, 20 nt, Homo sapiens
guguccuucuccucuuguag

SEQ ID NO: 1720765 - RNA, 22 nt, Homo sapiens
gugugcaagagagggaugcaug

SEQ ID NO: 1720766 - RNA, 13 nt, Homo sapiens
guguguguguaug

SEQ ID NO: 1720767 - RNA, 14 nt, Homo sapiens
guguucuucauuac

SEQ ID NO: 1720768 - RNA, 17 nt, Homo sapiens
guuauaauuauuccuuc

SEQ ID NO: 1720769 - RNA, 23 nt, Homo sapiens
uaaaaaagcugugugcucuccaa

SEQ ID NO: 1720770 - RNA, 12 nt, Homo sapiens
uaaaacagggau

SEQ ID NO: 1720771 - RNA, 15 nt, Homo sapiens
uaaaaccaccaaagu

SEQ ID NO: 1720772 - RNA, 22 nt, Homo sapiens
uaaacuggcuggcccagaguuu

SEQ ID NO: 1720773 - RNA, 21 nt, Homo sapiens
uaaauuuaugguucucaggcc

SEQ ID NO: 1720774 - RNA, 22 nt, Homo sapiens
uaacucagucuuuaaucugaga

SEQ ID NO: 1720775 - RNA, 23 nt, Homo sapiens
uaaucuaaguaaagcacaguccc

SEQ ID NO: 1720776 - RNA, 16 nt, Homo sapiens
uaaucugagaggccac

SEQ ID NO: 1720777 - RNA, 21 nt, Homo sapiens
uaauguacguuacagcuuuca

SEQ ID NO: 1720778 - RNA, 23 nt, Homo sapiens
uaauuccacacccucacugcugu

SEQ ID NO: 1720779 - RNA, 19 nt, Homo sapiens
uaauuugcauugugucaga

SEQ ID NO: 1720780 - RNA, 23 nt, Homo sapiens
uacacaauccuccaagaauuuga

SEQ ID NO: 1720781 - RNA, 13 nt, Homo sapiens
uaccaaaugaggg

SEQ ID NO: 1720782 - RNA, 15 nt, Homo sapiens
uaccagcaucuccca

SEQ ID NO: 1720783 - RNA, 16 nt, Homo sapiens
uacccccccuccugcu

SEQ ID NO: 1720784 - RNA, 23 nt, Homo sapiens
uaccuccuaauuccacacccuca

SEQ ID NO: 1720785 - RNA, 14 nt, Homo sapiens
uaccuucuaccucu

SEQ ID NO: 1720786 - RNA, 15 nt, Homo sapiens
uaccuucuaccucuu

SEQ ID NO: 1720787 - RNA, 21 nt, Homo sapiens
uaccuucuaccucuuggcugc

SEQ ID NO: 1720788 - RNA, 18 nt, Homo sapiens
uacguuacagcuuucaca

SEQ ID NO: 1720789 - RNA, 19 nt, Homo sapiens
uacucuugagacuacuuca

SEQ ID NO: 1720790 - RNA, 14 nt, Homo sapiens
uacuuaaacuucca

SEQ ID NO: 1720791 - RNA, 15 nt, Homo sapiens
uacuuaaacuuccac

SEQ ID NO: 1720792 - RNA, 17 nt, Homo sapiens
uacuuguuuucacuuua

SEQ ID NO: 1720793 - RNA, 14 nt, Homo sapiens
uagagcugccugug

SEQ ID NO: 1720794 - RNA, 14 nt, Homo sapiens
uagcagcagugcau

SEQ ID NO: 1720795 - RNA, 16 nt, Homo sapiens
uagcagcagugcaugg

SEQ ID NO: 1720796 - RNA, 14 nt, Homo sapiens
uagcauuucuucca

SEQ ID NO: 1720797 - RNA, 20 nt, Homo sapiens
uaggccagcaccaucucuuu

SEQ ID NO: 1720798 - RNA, 19 nt, Homo sapiens
uaggugcccagaaugaggc

SEQ ID NO: 1720799 - RNA, 15 nt, Homo sapiens
uaguagagacagggu

SEQ ID NO: 1720800 - RNA, 16 nt, Homo sapiens
uagucaguaauuuauc

SEQ ID NO: 1720801 - RNA, 13 nt, Homo sapiens
uauaaaucuucaa

SEQ ID NO: 1720802 - RNA, 14 nt, Homo sapiens
uauacaaaaauucu

SEQ ID NO: 1720803 - RNA, 23 nt, Homo sapiens
uauaccuccuauauguccauuua

SEQ ID NO: 1720804 - RNA, 13 nt, Homo sapiens
uauauauuacuug

SEQ ID NO: 1720805 - RNA, 13 nt, Homo sapiens
uaucacgcagauc

SEQ ID NO: 1720806 - RNA, 13 nt, Homo sapiens
uauccauccaugg

SEQ ID NO: 1720807 - RNA, 12 nt, Homo sapiens
uaucuacuuuag

SEQ ID NO: 1720808 - RNA, 20 nt, Homo sapiens
uaucuuaaccucaaaacugu

SEQ ID NO: 1720809 - RNA, 12 nt, Homo sapiens
uaugaaaacuga

SEQ ID NO: 1720810 - RNA, 14 nt, Homo sapiens
uaugaaaacugaag

SEQ ID NO: 1720811 - RNA, 22 nt, Homo sapiens
uaugagcuggggaugucucuca

SEQ ID NO: 1720812 - RNA, 16 nt, Homo sapiens
uaugcugcucauccaa

SEQ ID NO: 1720813 - RNA, 18 nt, Homo sapiens
uauggguuggacaaccuc

SEQ ID NO: 1720814 - RNA, 22 nt, Homo sapiens
uaugguaggaacugcugggcuu

SEQ ID NO: 1720815 - RNA, 15 nt, Homo sapiens
uaugguucucaggcc

SEQ ID NO: 1720816 - RNA, 16 nt, Homo sapiens
uauguaaguacuucca

SEQ ID NO: 1720817 - RNA, 16 nt, Homo sapiens
uaugugggggucugug

SEQ ID NO: 1720818 - RNA, 17 nt, Homo sapiens
uaugugggggucugugu

SEQ ID NO: 1720819 - RNA, 18 nt, Homo sapiens
uauuagagcugccugugc

SEQ ID NO: 1720820 - RNA, 21 nt, Homo sapiens
uauuagagcugccugugccuu

SEQ ID NO: 1720821 - RNA, 15 nt, Homo sapiens
uauuaggccauauau

SEQ ID NO: 1720822 - RNA, 18 nt, Homo sapiens
uauuuaaccuaguucaau

SEQ ID NO: 1720823 - RNA, 16 nt, Homo sapiens
ucaaaagguagauccu

SEQ ID NO: 1720824 - RNA, 20 nt, Homo sapiens
ucaaagggagagagugcuau

SEQ ID NO: 1720825 - RNA, 19 nt, Homo sapiens
ucaaaucuucuaauuccaa

SEQ ID NO: 1720826 - RNA, 23 nt, Homo sapiens
ucaacaagagacuggaaggacca

SEQ ID NO: 1720827 - RNA, 23 nt, Homo sapiens
ucaauuaguuccccuacuacacu

SEQ ID NO: 1720828 - RNA, 15 nt, Homo sapiens
ucacauuuacuagcu

SEQ ID NO: 1720829 - RNA, 16 nt, Homo sapiens
ucacauuuacuagcug

SEQ ID NO: 1720830 - RNA, 23 nt, Homo sapiens
ucaccaggaggcggcagugcaac

SEQ ID NO: 1720831 - RNA, 16 nt, Homo sapiens
ucacugcuguagacau

SEQ ID NO: 1720832 - RNA, 22 nt, Homo sapiens
ucacuguucaguuuagcauuaa

SEQ ID NO: 1720833 - RNA, 20 nt, Homo sapiens
ucagagcuggauucaauucc

SEQ ID NO: 1720834 - RNA, 16 nt, Homo sapiens
ucaggauuucaccaga

SEQ ID NO: 1720835 - RNA, 15 nt, Homo sapiens
ucaguucucuucacu

SEQ ID NO: 1720836 - RNA, 12 nt, Homo sapiens
ucaucaggccau

SEQ ID NO: 1720837 - RNA, 15 nt, Homo sapiens
ucauuggcucuugaa

SEQ ID NO: 1720838 - RNA, 16 nt, Homo sapiens
uccaaagccaauguga

SEQ ID NO: 1720839 - RNA, 22 nt, Homo sapiens
uccaaaguuauccccuccuuua

SEQ ID NO: 1720840 - RNA, 21 nt, Homo sapiens
uccaaaguucuuaucucuagc

SEQ ID NO: 1720841 - RNA, 14 nt, Homo sapiens
uccaauguccaaaa

SEQ ID NO: 1720842 - RNA, 21 nt, Homo sapiens
uccaauuauuacaguccuuca

SEQ ID NO: 1720843 - RNA, 19 nt, Homo sapiens
uccacaccccaucuugcuc

SEQ ID NO: 1720844 - RNA, 19 nt, Homo sapiens
uccaggccgagaugugcaa

SEQ ID NO: 1720845 - RNA, 20 nt, Homo sapiens
uccaggccgagaugugcaac

SEQ ID NO: 1720846 - RNA, 22 nt, Homo sapiens
uccaggccgagaugugcaacac

SEQ ID NO: 1720847 - RNA, 20 nt, Homo sapiens
ucccaaagugcugggauuac

SEQ ID NO: 1720848 - RNA, 20 nt, Homo sapiens
ucccaaaguguuaggauuac

SEQ ID NO: 1720849 - RNA, 23 nt, Homo sapiens
ucccaaguagcugggaguacagg

SEQ ID NO: 1720850 - RNA, 16 nt, Homo sapiens
ucccacuccuucagga

SEQ ID NO: 1720851 - RNA, 13 nt, Homo sapiens
ucccacuuggcau

SEQ ID NO: 1720852 - RNA, 14 nt, Homo sapiens
ucccucuacuggga

SEQ ID NO: 1720853 - RNA, 23 nt, Homo sapiens
ucccucuacugggagccuaccca

SEQ ID NO: 1720854 - RNA, 21 nt, Homo sapiens
uccguagaugagaagcugccu

SEQ ID NO: 1720855 - RNA, 22 nt, Homo sapiens
uccuagccacccaccacacuga

SEQ ID NO: 1720856 - RNA, 18 nt, Homo sapiens
uccucacucccaguuccc

SEQ ID NO: 1720857 - RNA, 15 nt, Homo sapiens
uccucugauuucagu

SEQ ID NO: 1720858 - RNA, 19 nt, Homo sapiens
uccugucccucauccauag

SEQ ID NO: 1720859 - RNA, 15 nt, Homo sapiens
uccuuaauacuagau

SEQ ID NO: 1720860 - RNA, 13 nt, Homo sapiens
uccuuugaucucg

SEQ ID NO: 1720861 - RNA, 15 nt, Homo sapiens
ucgaacuuuuuccaa

SEQ ID NO: 1720862 - RNA, 23 nt, Homo sapiens
ucuaaagcuuuggacaaguccuu

SEQ ID NO: 1720863 - RNA, 20 nt, Homo sapiens
ucuaccucuuggcugccuug

SEQ ID NO: 1720864 - RNA, 15 nt, Homo sapiens
ucuauaaacuucaga

SEQ ID NO: 1720865 - RNA, 19 nt, Homo sapiens
ucuaugaucuggacuuccu

SEQ ID NO: 1720866 - RNA, 21 nt, Homo sapiens
ucuccacaggcaggcucauuu

SEQ ID NO: 1720867 - RNA, 19 nt, Homo sapiens
ucucuuuuaggaggcacaa

SEQ ID NO: 1720868 - RNA, 20 nt, Homo sapiens
ucugccucccggguucaagc

SEQ ID NO: 1720869 - RNA, 20 nt, Homo sapiens
ucuuaaccucaaaacuguau

SEQ ID NO: 1720870 - RNA, 22 nt, Homo sapiens
ucuuacucuacugcugcugaca

SEQ ID NO: 1720871 - RNA, 15 nt, Homo sapiens
auaugcagauuuugc

SEQ ID NO: 1720872 - RNA, 12 nt, Homo sapiens
auauuacuuguu

SEQ ID NO: 1720873 - RNA, 22 nt, Homo sapiens
auauuuuuaguagagacagggu

SEQ ID NO: 1720874 - RNA, 17 nt, Homo sapiens
aucaacauuuguuccau

SEQ ID NO: 1720875 - RNA, 22 nt, Homo sapiens
aucagagcuggauucaauuccu

SEQ ID NO: 1720876 - RNA, 19 nt, Homo sapiens
aucaguuccuuugaucucg

SEQ ID NO: 1720877 - RNA, 19 nt, Homo sapiens
aucauuuuuaaauauaggu

SEQ ID NO: 1720878 - RNA, 22 nt, Homo sapiens
auccauagcaccuccacauacc

SEQ ID NO: 1720879 - RNA, 19 nt, Homo sapiens
auccauggggcugauugua

SEQ ID NO: 1720880 - RNA, 16 nt, Homo sapiens
aucuaugauuccaggu

SEQ ID NO: 1720881 - RNA, 15 nt, Homo sapiens
aucucaggauuucac

SEQ ID NO: 1720882 - RNA, 15 nt, Homo sapiens
aucuucuaauuccaa

SEQ ID NO: 1720883 - RNA, 18 nt, Homo sapiens
augauaguaggccuucaa

SEQ ID NO: 1720884 - RNA, 13 nt, Homo sapiens
augcugacaucca

SEQ ID NO: 1720885 - RNA, 18 nt, Homo sapiens
auggaccacacuuugaga

SEQ ID NO: 1720886 - RNA, 23 nt, Homo sapiens
auggagcugcguuuccugugcau

SEQ ID NO: 1720887 - RNA, 23 nt, Homo sapiens
auggucucgauauccugaucucg

SEQ ID NO: 1720888 - RNA, 15 nt, Homo sapiens
auguaccagcaucuc

SEQ ID NO: 1720889 - RNA, 18 nt, Homo sapiens
auguacguuacagcuuuc

SEQ ID NO: 1720890 - RNA, 18 nt, Homo sapiens
augucuagccacugauca

SEQ ID NO: 1720891 - RNA, 12 nt, Homo sapiens
auuaagaucuca

SEQ ID NO: 1720892 - RNA, 16 nt, Homo sapiens
auuaguuccccuacua

SEQ ID NO: 1720893 - RNA, 19 nt, Homo sapiens
auuaguuccccuacuacac

SEQ ID NO: 1720894 - RNA, 21 nt, Homo sapiens
auuauuacaguccuucaagau

SEQ ID NO: 1720895 - RNA, 21 nt, Homo sapiens
auuccuguccuucacauuuac

SEQ ID NO: 1720896 - RNA, 14 nt, Homo sapiens
auucuaauuugcau

SEQ ID NO: 1720897 - RNA, 18 nt, Homo sapiens
auucucaguucucuucac

SEQ ID NO: 1720898 - RNA, 20 nt, Homo sapiens
auucucugccuuuacuauau

SEQ ID NO: 1720899 - RNA, 15 nt, Homo sapiens
auucuuuccuaccuu

SEQ ID NO: 1720900 - RNA, 16 nt, Homo sapiens
auugauguuaacaaga

SEQ ID NO: 1720901 - RNA, 19 nt, Homo sapiens
auugcacugaucuuacucu

SEQ ID NO: 1720902 - RNA, 13 nt, Homo sapiens
auugcacuuuaug

SEQ ID NO: 1720903 - RNA, 21 nt, Homo sapiens
auugcacuuuaugaaaacuga

SEQ ID NO: 1720904 - RNA, 18 nt, Homo sapiens
auuuaccuucuaccucuu

SEQ ID NO: 1720905 - RNA, 12 nt, Homo sapiens
auuuacuagcug

SEQ ID NO: 1720906 - RNA, 23 nt, Homo sapiens
auuuaugcugcucauccaaaguu

SEQ ID NO: 1720907 - RNA, 12 nt, Homo sapiens
auuucaguucac

SEQ ID NO: 1720908 - RNA, 16 nt, Homo sapiens
auuucaguucacuguu

SEQ ID NO: 1720909 - RNA, 14 nt, Homo sapiens
auuuggcugugaug

SEQ ID NO: 1720910 - RNA, 20 nt, Homo sapiens
auuuguaaauuuaugugaug

SEQ ID NO: 1720911 - RNA, 23 nt, Homo sapiens
auuuucuuucuccucugauuuca

SEQ ID NO: 1720912 - RNA, 15 nt, Homo sapiens
auuuugcccuugaca

SEQ ID NO: 1720913 - RNA, 19 nt, Homo sapiens
caaagugcugggauuacag

SEQ ID NO: 1720914 - RNA, 16 nt, Homo sapiens
caaaugcuuuuccuca

SEQ ID NO: 1720915 - RNA, 14 nt, Homo sapiens
caacaaguugccuc

SEQ ID NO: 1720916 - RNA, 19 nt, Homo sapiens
caaccccccauuucuuccc

SEQ ID NO: 1720917 - RNA, 14 nt, Homo sapiens
caaccucugccucc

SEQ ID NO: 1720918 - RNA, 15 nt, Homo sapiens
caacgagcagugccg

SEQ ID NO: 1720919 - RNA, 13 nt, Homo sapiens
caagacaaaugac

SEQ ID NO: 1720920 - RNA, 23 nt, Homo sapiens
caagagagggaugcauggagaua

SEQ ID NO: 1720921 - RNA, 17 nt, Homo sapiens
caagccauucugccuca

SEQ ID NO: 1720922 - RNA, 21 nt, Homo sapiens
caaggcugucgccugcaccuu

SEQ ID NO: 1720923 - RNA, 20 nt, Homo sapiens
caaggggaugcucugugcag

SEQ ID NO: 1720924 - RNA, 22 nt, Homo sapiens
caaguagcugggaguacaggcg

SEQ ID NO: 1720925 - RNA, 14 nt, Homo sapiens
cacaagagugaauu

SEQ ID NO: 1720926 - RNA, 15 nt, Homo sapiens
cacaagagugaauuu

SEQ ID NO: 1720927 - RNA, 15 nt, Homo sapiens
cacaauccuccaaga

SEQ ID NO: 1720928 - RNA, 23 nt, Homo sapiens
cacacagacccgcuggaccaaag

SEQ ID NO: 1720929 - RNA, 20 nt, Homo sapiens
cugugccuuggugugcugua

SEQ ID NO: 1720930 - RNA, 21 nt, Homo sapiens
cugugccuuggugugcuguau

SEQ ID NO: 1720931 - RNA, 12 nt, Homo sapiens
cugugugccagg

SEQ ID NO: 1720932 - RNA, 16 nt, Homo sapiens
cuguucuuuuguccca

SEQ ID NO: 1720933 - RNA, 17 nt, Homo sapiens
cuuaaccucaaaacugu

SEQ ID NO: 1720934 - RNA, 15 nt, Homo sapiens
cuuacucuacugcug

SEQ ID NO: 1720935 - RNA, 14 nt, Homo sapiens
cuucaagauuccau

SEQ ID NO: 1720936 - RNA, 18 nt, Homo sapiens
cuucacauuuacuagcug

SEQ ID NO: 1720937 - RNA, 16 nt, Homo sapiens
cuucagauuugccuua

SEQ ID NO: 1720938 - RNA, 13 nt, Homo sapiens
cuucauuaccuca

SEQ ID NO: 1720939 - RNA, 19 nt, Homo sapiens
cuuccaauuauuacagucc

SEQ ID NO: 1720940 - RNA, 18 nt, Homo sapiens
cuuccacaagagugaauu

SEQ ID NO: 1720941 - RNA, 22 nt, Homo sapiens
cuugauauguaaguacuuccac

SEQ ID NO: 1720942 - RNA, 19 nt, Homo sapiens
cuugauuuucuuucuccuc

SEQ ID NO: 1720943 - RNA, 15 nt, Homo sapiens
cuuggagccugcaga

SEQ ID NO: 1720944 - RNA, 18 nt, Homo sapiens
cuuggauuugcucagugu

SEQ ID NO: 1720945 - RNA, 19 nt, Homo sapiens
cuuggcagcccgggucauc

SEQ ID NO: 1720946 - RNA, 13 nt, Homo sapiens
cuuggccucccaa

SEQ ID NO: 1720947 - RNA, 19 nt, Homo sapiens
cuuguagccagaauucugg

SEQ ID NO: 1720948 - RNA, 19 nt, Homo sapiens
cuuuaccccucauccaaag

SEQ ID NO: 1720949 - RNA, 13 nt, Homo sapiens
cuuuacuuucucu

SEQ ID NO: 1720950 - RNA, 12 nt, Homo sapiens
cuuuaucaaaga

SEQ ID NO: 1720951 - RNA, 22 nt, Homo sapiens
cuuuaugaaaacugaagcauca

SEQ ID NO: 1720952 - RNA, 17 nt, Homo sapiens
cuuuaugcaacuaacug

SEQ ID NO: 1720953 - RNA, 14 nt, Homo sapiens
cuuuccaaagccaa

SEQ ID NO: 1720954 - RNA, 14 nt, Homo sapiens
cuuucugucucucu

SEQ ID NO: 1720955 - RNA, 20 nt, Homo sapiens
cuuugaucucgcuguaagau

SEQ ID NO: 1720956 - RNA, 13 nt, Homo sapiens
cuuugucccagaa

SEQ ID NO: 1720957 - RNA, 13 nt, Homo sapiens
cuuuugucccaga

SEQ ID NO: 1720958 - RNA, 19 nt, Homo sapiens
gaaaagcaguggcuccauu

SEQ ID NO: 1720959 - RNA, 14 nt, Homo sapiens
gaaaauauuuaaag

SEQ ID NO: 1720960 - RNA, 15 nt, Homo sapiens
gaaggaauuauuccc

SEQ ID NO: 1720961 - RNA, 17 nt, Homo sapiens
gaagugugggucugugu

SEQ ID NO: 1720962 - RNA, 22 nt, Homo sapiens
gaagugugucacccuuaggcca

SEQ ID NO: 1720963 - RNA, 16 nt, Homo sapiens
gaaugaacuugcauaa

SEQ ID NO: 1720964 - RNA, 18 nt, Homo sapiens
gaaugaggcugcuuucca

SEQ ID NO: 1720965 - RNA, 19 nt, Homo sapiens
gacacaugugccgggccau

SEQ ID NO: 1720966 - RNA, 15 nt, Homo sapiens
gacacccagugccag

SEQ ID NO: 1720967 - RNA, 14 nt, Homo sapiens
gacacuacauaucu

SEQ ID NO: 1720968 - RNA, 23 nt, Homo sapiens
gacagcuuccucgaugggacccg

SEQ ID NO: 1720969 - RNA, 13 nt, Homo sapiens
gacaggugccagg

SEQ ID NO: 1720970 - RNA, 20 nt, Homo sapiens
gacaguuacccccaaccuga

SEQ ID NO: 1720971 - RNA, 16 nt, Homo sapiens
gaccccuggucucagu

SEQ ID NO: 1720972 - RNA, 10 nt, Homo sapiens
gacucuggaa

SEQ ID NO: 1720973 - RNA, 15 nt, Homo sapiens
gacuggagugcagug

SEQ ID NO: 1720974 - RNA, 12 nt, Homo sapiens
gacuuaucaaca

SEQ ID NO: 1720975 - RNA, 14 nt, Homo sapiens
gagaagacccagcu

SEQ ID NO: 1720976 - RNA, 14 nt, Homo sapiens
gagaugugcaacac

SEQ ID NO: 1720977 - RNA, 14 nt, Homo sapiens
gagauguggaaaag

SEQ ID NO: 1720978 - RNA, 22 nt, Homo sapiens
gagauguggaaaagccaagagg

SEQ ID NO: 1720979 - RNA, 19 nt, Homo sapiens
gagccacugcgcccggcug

SEQ ID NO: 1720980 - RNA, 22 nt, Homo sapiens
gagcuggggaugucucucauga

SEQ ID NO: 1720981 - RNA, 19 nt, Homo sapiens
gagcuguguggccuggcaa

SEQ ID NO: 1720982 - RNA, 20 nt, Homo sapiens
gaggucugauggagcugcgu

SEQ ID NO: 1720983 - RNA, 12 nt, Homo sapiens
gaguauaccucc

SEQ ID NO: 1720984 - RNA, 14 nt, Homo sapiens
gaguuuacauucua

SEQ ID NO: 1720985 - RNA, 15 nt, Homo sapiens
gauauccugaucucg

SEQ ID NO: 1720986 - RNA, 18 nt, Homo sapiens
gaucauuaucagccugug

SEQ ID NO: 1720987 - RNA, 19 nt, Homo sapiens
gauccuguauugugcccgg

SEQ ID NO: 1720988 - RNA, 18 nt, Homo sapiens
gauccuguuggacaccca

SEQ ID NO: 1720989 - RNA, 20 nt, Homo sapiens
gauuccagguggcaucagug

SEQ ID NO: 1720990 - RNA, 20 nt, Homo sapiens
gcaauggcgcgaucucagcu

SEQ ID NO: 1720991 - RNA, 22 nt, Homo sapiens
gcagauuuugcccuugacaaag

SEQ ID NO: 1720992 - RNA, 13 nt, Homo sapiens
gcagcucuacucu

SEQ ID NO: 1720993 - RNA, 18 nt, Homo sapiens
gcaggaaauggcugugga

SEQ ID NO: 1720994 - RNA, 14 nt, Homo sapiens
gcagggauucuucc

SEQ ID NO: 1720995 - RNA, 12 nt, Homo sapiens
gcagugcaacaa

SEQ ID NO: 1720996 - RNA, 21 nt, Homo sapiens
gccaaggggaugcucugugca

SEQ ID NO: 1720997 - RNA, 15 nt, Homo sapiens
gccagggggccaguc

SEQ ID NO: 1720998 - RNA, 21 nt, Homo sapiens
gccaguggcuggaucugugag

SEQ ID NO: 1720999 - RNA, 14 nt, Homo sapiens
gccauauauauuuc

SEQ ID NO: 1721000 - RNA, 21 nt, Homo sapiens
gcccaggcaaagugcaccuca

SEQ ID NO: 1721001 - RNA, 17 nt, Homo sapiens
gcccaggcuggucuuga

SEQ ID NO: 1721002 - RNA, 19 nt, Homo sapiens
gcccugaguuccuagccac

SEQ ID NO: 1721003 - RNA, 14 nt, Homo sapiens
gccgcucccuggug

SEQ ID NO: 1721004 - RNA, 16 nt, Homo sapiens
gccucccaaguagcug

SEQ ID NO: 1721005 - RNA, 20 nt, Homo sapiens
gccucgacacagaguggacu

SEQ ID NO: 1721006 - RNA, 16 nt, Homo sapiens
gccugggggauguacc

SEQ ID NO: 1721007 - RNA, 17 nt, Homo sapiens
gcgggaggucugccagg

SEQ ID NO: 1721008 - RNA, 20 nt, Homo sapiens
gcuauggggauagaugugug

SEQ ID NO: 1721009 - RNA, 15 nt, Homo sapiens
gcuauuguagagcca

SEQ ID NO: 1721010 - RNA, 16 nt, Homo sapiens
gcucagacaucuacua

SEQ ID NO: 1721011 - RNA, 12 nt, Homo sapiens
gcucauuucacu

SEQ ID NO: 1721012 - RNA, 21 nt, Homo sapiens
gcuccagugacugaggggccu

SEQ ID NO: 1721013 - RNA, 23 nt, Homo sapiens
gcugagcagguguucuucauuac

SEQ ID NO: 1721014 - RNA, 18 nt, Homo sapiens
gcugaggccucucauucc

SEQ ID NO: 1721015 - RNA, 19 nt, Homo sapiens
gcuggaguucaugucgcaa

SEQ ID NO: 1721016 - RNA, 19 nt, Homo sapiens
gcugggaauaagugccagg

SEQ ID NO: 1721017 - RNA, 14 nt, Homo sapiens
gcuucauacaggga

SEQ ID NO: 1721018 - RNA, 13 nt, Homo sapiens
gcuucauugcacu

SEQ ID NO: 1721019 - RNA, 15 nt, Homo sapiens
ggacaccaagccuug

SEQ ID NO: 1721020 - RNA, 15 nt, Homo sapiens
ggaccccuccaggaa

SEQ ID NO: 1721021 - RNA, 19 nt, Homo sapiens
ggagaacgagaccugugug

SEQ ID NO: 1721022 - RNA, 23 nt, Homo sapiens
ggagauccgcaucuggggacccc

SEQ ID NO: 1721023 - RNA, 13 nt, Homo sapiens
ggagcaccuggug

SEQ ID NO: 1721024 - RNA, 22 nt, Homo sapiens
ggagggcgcuaugucguggcug

SEQ ID NO: 1721025 - RNA, 23 nt, Homo sapiens
ggagugaggaugucugggccacu

SEQ ID NO: 1721026 - RNA, 16 nt, Homo sapiens
ggauguaccagcaucu

SEQ ID NO: 1721027 - RNA, 19 nt, Homo sapiens
ggcacccccuggcuugaac

SEQ ID NO: 1721028 - RNA, 17 nt, Homo sapiens
ggcgcgaucucagcuca

SEQ ID NO: 1721029 - RNA, 14 nt, Homo sapiens
gggaagaugagcau

SEQ ID NO: 1721030 - RNA, 16 nt, Homo sapiens
gggagaaugucaguau

SEQ ID NO: 1721031 - RNA, 16 nt, Homo sapiens
gggagagagugcuauu

SEQ ID NO: 1721032 - RNA, 13 nt, Homo sapiens
gggaguacaggcg

SEQ ID NO: 1721033 - RNA, 14 nt, Homo sapiens
gggaguguguaauu

SEQ ID NO: 1721034 - RNA, 22 nt, Homo sapiens
gggcuucauacacaugagauaa

SEQ ID NO: 1721035 - RNA, 10 nt, Homo sapiens
ggguucaagc

SEQ ID NO: 1721036 - RNA, 11 nt, Homo sapiens
gguucucaggc

SEQ ID NO: 1721037 - RNA, 15 nt, Homo sapiens
gguuuuuucaauuua

SEQ ID NO: 1721038 - RNA, 12 nt, Homo sapiens
guaaaugauuca

SEQ ID NO: 1721039 - RNA, 15 nt, Homo sapiens
guaaccuagugaauu

SEQ ID NO: 1721040 - RNA, 18 nt, Homo sapiens
guaaccuagugaauuucu

SEQ ID NO: 1721041 - RNA, 14 nt, Homo sapiens
guaaguacuuccac

SEQ ID NO: 1721042 - RNA, 18 nt, Homo sapiens
guaauuuaaaauugugau

SEQ ID NO: 1721043 - RNA, 20 nt, Homo sapiens
guagagacaggguuuugcca

SEQ ID NO: 1721044 - RNA, 14 nt, Homo sapiens
guaggaacugcugg

SEQ ID NO: 1721045 - RNA, 20 nt, Homo sapiens
guccccagacuccaccaagc

SEQ ID NO: 1721046 - RNA, 15 nt, Homo sapiens
ucuucauuaccucag

SEQ ID NO: 1721047 - RNA, 20 nt, Homo sapiens
ucuucuagcauuucuuccaa

SEQ ID NO: 1721048 - RNA, 20 nt, Homo sapiens
ucuugguuccagccugccac

SEQ ID NO: 1721049 - RNA, 14 nt, Homo sapiens
ucuuguagccagaa

SEQ ID NO: 1721050 - RNA, 14 nt, Homo sapiens
ucuuuugucccaga

SEQ ID NO: 1721051 - RNA, 13 nt, Homo sapiens
ugaaaugcuucca

SEQ ID NO: 1721052 - RNA, 15 nt, Homo sapiens
ugaacuucccuaccc

SEQ ID NO: 1721053 - RNA, 15 nt, Homo sapiens
ugaccuuccaagagc

SEQ ID NO: 1721054 - RNA, 17 nt, Homo sapiens
ugaccuuccaagagccu

SEQ ID NO: 1721055 - RNA, 17 nt, Homo sapiens
ugagagcugugcaucag

SEQ ID NO: 1721056 - RNA, 15 nt, Homo sapiens
ugagcagguguucuu

SEQ ID NO: 1721057 - RNA, 23 nt, Homo sapiens
ugagcagguguucuucauuaccu

SEQ ID NO: 1721058 - RNA, 18 nt, Homo sapiens
ugagcuggggaugucucu

SEQ ID NO: 1721059 - RNA, 23 nt, Homo sapiens
ugaggaucggagggcgcuauguc

SEQ ID NO: 1721060 - RNA, 16 nt, Homo sapiens
ugaggcugcuuuccaa

SEQ ID NO: 1721061 - RNA, 22 nt, Homo sapiens
ugaggcugcuuuccaaagccaa

SEQ ID NO: 1721062 - RNA, 14 nt, Homo sapiens
ugaguuccuagcca

SEQ ID NO: 1721063 - RNA, 15 nt, Homo sapiens
ugaguuccuagccac

SEQ ID NO: 1721064 - RNA, 17 nt, Homo sapiens
ugauaagcugagcuccu

SEQ ID NO: 1721065 - RNA, 16 nt, Homo sapiens
ugauauguaaguacuu

SEQ ID NO: 1721066 - RNA, 18 nt, Homo sapiens
ugaugcuuuaugcaacua

SEQ ID NO: 1721067 - RNA, 19 nt, Homo sapiens
ugauuucaguucacuguuc

SEQ ID NO: 1721068 - RNA, 13 nt, Homo sapiens
ugcaaccucugcc

SEQ ID NO: 1721069 - RNA, 17 nt, Homo sapiens
ugcaaccucugccuccc

SEQ ID NO: 1721070 - RNA, 18 nt, Homo sapiens
ugcagccaggccacuggc

SEQ ID NO: 1721071 - RNA, 21 nt, Homo sapiens
ugcaggagucccugccaucau

SEQ ID NO: 1721072 - RNA, 18 nt, Homo sapiens
ugcauaauuauauacucc

SEQ ID NO: 1721073 - RNA, 20 nt, Homo sapiens
ugcauggauaugugccaggc

SEQ ID NO: 1721074 - RNA, 20 nt, Homo sapiens
ugccacagaugauacuucca

SEQ ID NO: 1721075 - RNA, 14 nt, Homo sapiens
ugccucggccuccc

SEQ ID NO: 1721076 - RNA, 18 nt, Homo sapiens
ugccugugccuuuugcca

SEQ ID NO: 1721077 - RNA, 22 nt, Homo sapiens
ugcgcacagccccagcuaauuu

SEQ ID NO: 1721078 - RNA, 15 nt, Homo sapiens
ugcgugugggacccg

SEQ ID NO: 1721079 - RNA, 18 nt, Homo sapiens
ugcuguauccauccaugg

SEQ ID NO: 1721080 - RNA, 23 nt, Homo sapiens
ugcuugauauguaaguacuucca

SEQ ID NO: 1721081 - RNA, 19 nt, Homo sapiens
ugcuuuaugcaacuaacug

SEQ ID NO: 1721082 - RNA, 18 nt, Homo sapiens
uggaagagggcugcaaau

SEQ ID NO: 1721083 - RNA, 20 nt, Homo sapiens
uggagacuaaccccaccaca

SEQ ID NO: 1721084 - RNA, 24 nt, Homo sapiens
uggagcugagcagguguucuucau

SEQ ID NO: 1721085 - RNA, 23 nt, Homo sapiens
uggaggguugaccccuggucuca

SEQ ID NO: 1721086 - RNA, 21 nt, Homo sapiens
uggagguuuguuuagaagaag

SEQ ID NO: 1721087 - RNA, 13 nt, Homo sapiens
uggcaaccuuccu

SEQ ID NO: 1721088 - RNA, 20 nt, Homo sapiens
uggcaucagugucuuuccac

SEQ ID NO: 1721089 - RNA, 21 nt, Homo sapiens
uggccagcccuggaggguuga

SEQ ID NO: 1721090 - RNA, 14 nt, Homo sapiens
uggcccuaugcuuc

SEQ ID NO: 1721091 - RNA, 20 nt, Homo sapiens
uggcguggagaaguggugcu

SEQ ID NO: 1721092 - RNA, 17 nt, Homo sapiens
ugggacaggugccaggu

SEQ ID NO: 1721093 - RNA, 15 nt, Homo sapiens
ugggacucucuugau

SEQ ID NO: 1721094 - RNA, 17 nt, Homo sapiens
ugggagaaugucaguau

SEQ ID NO: 1721095 - RNA, 15 nt, Homo sapiens
ugggagauguggaaa

SEQ ID NO: 1721096 - RNA, 16 nt, Homo sapiens
ugggauuggcugugag

SEQ ID NO: 1721097 - RNA, 14 nt, Homo sapiens
ugggcgugcuaccu

SEQ ID NO: 1721098 - RNA, 16 nt, Homo sapiens
uggggacucuggaaaa

SEQ ID NO: 1721099 - RNA, 13 nt, Homo sapiens
uggugugcuguau

SEQ ID NO: 1721100 - RNA, 21 nt, Homo sapiens
uguaaaauaaaaccaccaaag

SEQ ID NO: 1721101 - RNA, 22 nt, Homo sapiens
uguaaaauaaaaccaccaaagu

SEQ ID NO: 1721102 - RNA, 16 nt, Homo sapiens
uguaaauuuaugugau

SEQ ID NO: 1721103 - RNA, 22 nt, Homo sapiens
uguacguuacagcuuucacaga

SEQ ID NO: 1721104 - RNA, 10 nt, Homo sapiens
uguacuugug

SEQ ID NO: 1721105 - RNA, 19 nt, Homo sapiens
uguauccauccauggggcu

SEQ ID NO: 1721106 - RNA, 21 nt, Homo sapiens
ugucccagaaugccuccugca

SEQ ID NO: 1721107 - RNA, 23 nt, Homo sapiens
ugugaaggaauuauucccaugag

SEQ ID NO: 1721108 - RNA, 18 nt, Homo sapiens
ugugcucuccaagcccag

SEQ ID NO: 1721109 - RNA, 15 nt, Homo sapiens
uguggaguguggcag

SEQ ID NO: 1721110 - RNA, 12 nt, Homo sapiens
ugugugccaggg

SEQ ID NO: 1721111 - RNA, 21 nt, Homo sapiens
uguuauagaaugaacuugcau

SEQ ID NO: 1721112 - RNA, 22 nt, Homo sapiens
uguuaucccugccugguccuca

SEQ ID NO: 1721113 - RNA, 15 nt, Homo sapiens
uguugaccauuccaa

SEQ ID NO: 1721114 - RNA, 19 nt, Homo sapiens
uuaaauucuuuccuaccuu

SEQ ID NO: 1721115 - RNA, 21 nt, Homo sapiens
uuaacuuaaaagaacauguau

SEQ ID NO: 1721116 - RNA, 18 nt, Homo sapiens
uuaaucugagaggccaca

SEQ ID NO: 1721117 - RNA, 18 nt, Homo sapiens
uuacuauauguugaccau

SEQ ID NO: 1721118 - RNA, 18 nt, Homo sapiens
uuacucuugagacuacuu

SEQ ID NO: 1721119 - RNA, 16 nt, Homo sapiens
uuagagcugccugugc

SEQ ID NO: 1721120 - RNA, 20 nt, Homo sapiens
uuagauauuaggggggaaag

SEQ ID NO: 1721121 - RNA, 16 nt, Homo sapiens
uuaguuccccuacuac

SEQ ID NO: 1721122 - RNA, 20 nt, Homo sapiens
uuaguuccccuacuacacuu

SEQ ID NO: 1721123 - RNA, 19 nt, Homo sapiens
uuaucacgcagaucacuaa

SEQ ID NO: 1721124 - RNA, 20 nt, Homo sapiens
uuaucuuaaccucaaaacug

SEQ ID NO: 1721125 - RNA, 12 nt, Homo sapiens
uuaugaaaacug

SEQ ID NO: 1721126 - RNA, 16 nt, Homo sapiens
uucaaugugcuuuuaa

SEQ ID NO: 1721127 - RNA, 14 nt, Homo sapiens
uucagauuugccuu

SEQ ID NO: 1721128 - RNA, 15 nt, Homo sapiens
uucagauuugccuua

SEQ ID NO: 1721129 - RNA, 16 nt, Homo sapiens
uucaguuuagcauuaa

SEQ ID NO: 1721130 - RNA, 20 nt, Homo sapiens
uucauauauccgaacuacug

SEQ ID NO: 1721131 - RNA, 13 nt, Homo sapiens
uuccaaagccaau

SEQ ID NO: 1721132 - RNA, 17 nt, Homo sapiens
uuccaaagccaauguga

SEQ ID NO: 1721133 - RNA, 21 nt, Homo sapiens
uuccacacccucacugcugua

SEQ ID NO: 1721134 - RNA, 17 nt, Homo sapiens
uuccacuuguguauauu

SEQ ID NO: 1721135 - RNA, 22 nt, Homo sapiens
uuccauuucuuaacagucucca

SEQ ID NO: 1721136 - RNA, 13 nt, Homo sapiens
uuccuuugaucuc

SEQ ID NO: 1721137 - RNA, 20 nt, Homo sapiens
uucuaccucuuggcugccuu

SEQ ID NO: 1721138 - RNA, 12 nt, Homo sapiens
uucuuacucucc

SEQ ID NO: 1721139 - RNA, 12 nt, Homo sapiens
uucuucuauggg

SEQ ID NO: 1721140 - RNA, 12 nt, Homo sapiens
uugaaccuucaa

SEQ ID NO: 1721141 - RNA, 14 nt, Homo sapiens
uuggacaaccucau

SEQ ID NO: 1721142 - RNA, 16 nt, Homo sapiens
uuggccucccaaagug

SEQ ID NO: 1721143 - RNA, 17 nt, Homo sapiens
uuguaacaauagcacaa

SEQ ID NO: 1721144 - RNA, 12 nt, Homo sapiens
uuguagccagaa

SEQ ID NO: 1721145 - RNA, 20 nt, Homo sapiens
uuguauuuaccuucuaccuc

SEQ ID NO: 1721146 - RNA, 18 nt, Homo sapiens
uuuaaaggcccuaucugu

SEQ ID NO: 1721147 - RNA, 23 nt, Homo sapiens
uuuaagggggaaaacuguucucu

SEQ ID NO: 1721148 - RNA, 22 nt, Homo sapiens
uuuaugaaaacugaagcaucaa

SEQ ID NO: 1721149 - RNA, 24 nt, Homo sapiens
uuuaugaaaacugaagcaucaaua

SEQ ID NO: 1721150 - RNA, 11 nt, Homo sapiens
uuuaugguucu

SEQ ID NO: 1721151 - RNA, 16 nt, Homo sapiens
uuuauuuuucucauga

SEQ ID NO: 1721152 - RNA, 16 nt, Homo sapiens
uuucaguucacuguuc

SEQ ID NO: 1721153 - RNA, 13 nt, Homo sapiens
uuucugucucucu

SEQ ID NO: 1721154 - RNA, 22 nt, Homo sapiens
uuuggcaaacucuccaccacac

SEQ ID NO: 1721155 - RNA, 20 nt, Homo sapiens
acaugucuagccacugauca

SEQ ID NO: 1721156 - RNA, 15 nt, Homo sapiens
accacacugauccag

SEQ ID NO: 1721157 - RNA, 17 nt, Homo sapiens
accaggaggcggcagug

SEQ ID NO: 1721158 - RNA, 17 nt, Homo sapiens
accaucucuuuaccucc

SEQ ID NO: 1721159 - RNA, 22 nt, Homo sapiens
acccccauagcagcagugcaug

SEQ ID NO: 1721160 - RNA, 17 nt, Homo sapiens
acccucaagacaaauga

SEQ ID NO: 1721161 - RNA, 13 nt, Homo sapiens
acccugaguucau

SEQ ID NO: 1721162 - RNA, 22 nt, Homo sapiens
acccuuaggccagcaccaucuc

SEQ ID NO: 1721163 - RNA, 17 nt, Homo sapiens
acccuucagauuugccu

SEQ ID NO: 1721164 - RNA, 13 nt, Homo sapiens
acccuuucuccac

SEQ ID NO: 1721165 - RNA, 15 nt, Homo sapiens
accgaggaccggcug

SEQ ID NO: 1721166 - RNA, 20 nt, Homo sapiens
accuccaucccccucugucu

SEQ ID NO: 1721167 - RNA, 16 nt, Homo sapiens
accugcucugugccca

SEQ ID NO: 1721168 - RNA, 22 nt, Homo sapiens
accugcucugugcccacccucc

SEQ ID NO: 1721169 - RNA, 19 nt, Homo sapiens
accuggcccugugccuugg

SEQ ID NO: 1721170 - RNA, 17 nt, Homo sapiens
acggcugccccuuccac

SEQ ID NO: 1721171 - RNA, 21 nt, Homo sapiens
acuauggagcugagcaggugu

SEQ ID NO: 1721172 - RNA, 17 nt, Homo sapiens
acucaggggucauucau

SEQ ID NO: 1721173 - RNA, 15 nt, Homo sapiens
acuccuccuagccac

SEQ ID NO: 1721174 - RNA, 15 nt, Homo sapiens
acucuacugcugcug

SEQ ID NO: 1721175 - RNA, 20 nt, Homo sapiens
acucucagcagcuaugguag

SEQ ID NO: 1721176 - RNA, 15 nt, Homo sapiens
caaugcuguuauccc

SEQ ID NO: 1721177 - RNA, 14 nt, Homo sapiens
caauuuaugcugcu

SEQ ID NO: 1721178 - RNA, 19 nt, Homo sapiens
cacacuucccauuuacucu

SEQ ID NO: 1721179 - RNA, 18 nt, Homo sapiens
cacagaugauacuuccaa

SEQ ID NO: 1721180 - RNA, 21 nt, Homo sapiens
cacagcaagucacuggccagu

SEQ ID NO: 1721181 - RNA, 23 nt, Homo sapiens
cacauaccuggcccugugccuug

SEQ ID NO: 1721182 - RNA, 18 nt, Homo sapiens
caccaucucuuuaccucc

SEQ ID NO: 1721183 - RNA, 20 nt, Homo sapiens
cacccaggcugcagugcaau

SEQ ID NO: 1721184 - RNA, 23 nt, Homo sapiens
cacggaagggcucuuucacagcu

SEQ ID NO: 1721185 - RNA, 13 nt, Homo sapiens
cacguguggaccc

SEQ ID NO: 1721186 - RNA, 11 nt, Homo sapiens
cacugcuguag

SEQ ID NO: 1721187 - RNA, 18 nt, Homo sapiens
cacuucccauuuacucuu

SEQ ID NO: 1721188 - RNA, 22 nt, Homo sapiens
cagaauaaacuggcagcucagc

SEQ ID NO: 1721189 - RNA, 18 nt, Homo sapiens
cagaccucaccuccaucc

SEQ ID NO: 1721190 - RNA, 15 nt, Homo sapiens
cagaugauacuucca

SEQ ID NO: 1721191 - RNA, 16 nt, Homo sapiens
cagaugauacuuccaa

SEQ ID NO: 1721192 - RNA, 14 nt, Homo sapiens
cagcacgugcagcc

SEQ ID NO: 1721193 - RNA, 20 nt, Homo sapiens
caggaagagcuguguggccu

SEQ ID NO: 1721194 - RNA, 20 nt, Homo sapiens
caggaggguugggcgugcua

SEQ ID NO: 1721195 - RNA, 24 nt, Homo sapiens
caggcaggcucauuucacuaagcu

SEQ ID NO: 1721196 - RNA, 13 nt, Homo sapiens
caggcccaaagcc

SEQ ID NO: 1721197 - RNA, 16 nt, Homo sapiens
caggccucucuucaca

SEQ ID NO: 1721198 - RNA, 20 nt, Homo sapiens
cagggauucuuccugcuuag

SEQ ID NO: 1721199 - RNA, 17 nt, Homo sapiens
cagggugccuguccagg

SEQ ID NO: 1721200 - RNA, 22 nt, Homo sapiens
caggguuugcuguuugcgugaa

SEQ ID NO: 1721201 - RNA, 14 nt, Homo sapiens
cagguuugggaccc

SEQ ID NO: 1721202 - RNA, 18 nt, Homo sapiens
caguggcuggaucuguga

SEQ ID NO: 1721203 - RNA, 21 nt, Homo sapiens
cauaucuguccccugcuacua

SEQ ID NO: 1721204 - RNA, 17 nt, Homo sapiens
caucagugucuuuccac

SEQ ID NO: 1721205 - RNA, 10 nt, Homo sapiens
cauccaaagu

SEQ ID NO: 1721206 - RNA, 22 nt, Homo sapiens
cauccaggugggaggugucaga

SEQ ID NO: 1721207 - RNA, 22 nt, Homo sapiens
caugcuugcauuauauuuguaa

SEQ ID NO: 1721208 - RNA, 17 nt, Homo sapiens
cauggcucccccuccac

SEQ ID NO: 1721209 - RNA, 16 nt, Homo sapiens
cauggggcugauugua

SEQ ID NO: 1721210 - RNA, 17 nt, Homo sapiens
caugugccgggccauug

SEQ ID NO: 1721211 - RNA, 21 nt, Homo sapiens
cauuauuuaaccuaguucaau

SEQ ID NO: 1721212 - RNA, 22 nt, Homo sapiens
cauucacagcaagucacuggcc

SEQ ID NO: 1721213 - RNA, 20 nt, Homo sapiens
cauuccaaaguucuuaucuc

SEQ ID NO: 1721214 - RNA, 12 nt, Homo sapiens
cauugguguuga

SEQ ID NO: 1721215 - RNA, 19 nt, Homo sapiens
cauugguguugacauacau

SEQ ID NO: 1721216 - RNA, 22 nt, Homo sapiens
cauuucuacuuuuugcaccuua

SEQ ID NO: 1721217 - RNA, 19 nt, Homo sapiens
cauuucuuaacagucucca

SEQ ID NO: 1721218 - RNA, 19 nt, Homo sapiens
ccaaaguucccacuccuuc

SEQ ID NO: 1721219 - RNA, 21 nt, Homo sapiens
ccaacauuaaaagccaccccc

SEQ ID NO: 1721220 - RNA, 18 nt, Homo sapiens
ccaaccugaccagugucu

SEQ ID NO: 1721221 - RNA, 21 nt, Homo sapiens
ccaaguagcugggaguacagg

SEQ ID NO: 1721222 - RNA, 19 nt, Homo sapiens
ccaaucccaucuauucucu

SEQ ID NO: 1721223 - RNA, 13 nt, Homo sapiens
ccacacacagcua

SEQ ID NO: 1721224 - RNA, 18 nt, Homo sapiens
ccacagaugauacuucca

SEQ ID NO: 1721225 - RNA, 20 nt, Homo sapiens
ccacaggcaggcucauuuca

SEQ ID NO: 1721226 - RNA, 21 nt, Homo sapiens
ccaccuuggccucccaaagug

SEQ ID NO: 1721227 - RNA, 17 nt, Homo sapiens
ccagaaaagcaguggcu

SEQ ID NO: 1721228 - RNA, 12 nt, Homo sapiens
ccagcaccacac

SEQ ID NO: 1721229 - RNA, 19 nt, Homo sapiens
ccaggaggcggcagugcaa

SEQ ID NO: 1721230 - RNA, 20 nt, Homo sapiens
ccaggaggcggcagugcaac

SEQ ID NO: 1721231 - RNA, 20 nt, Homo sapiens
ccaggccgagaugugcaaca

SEQ ID NO: 1721232 - RNA, 21 nt, Homo sapiens
ccaggccgagaugugcaacac

SEQ ID NO: 1721233 - RNA, 17 nt, Homo sapiens
ccaggcugcagugcaau

SEQ ID NO: 1721234 - RNA, 18 nt, Homo sapiens
ccaggcugcagugcaaug

SEQ ID NO: 1721235 - RNA, 21 nt, Homo sapiens
ccaguggcuggaucugugagg

SEQ ID NO: 1721236 - RNA, 14 nt, Homo sapiens
ccauagcaccucca

SEQ ID NO: 1721237 - RNA, 21 nt, Homo sapiens
ccauggggcugauuguauuua

SEQ ID NO: 1721238 - RNA, 16 nt, Homo sapiens
ccauuccaaaguucuu

SEQ ID NO: 1721239 - RNA, 17 nt, Homo sapiens
cccacacuucccauuua

SEQ ID NO: 1721240 - RNA, 17 nt, Homo sapiens
cccaccaaccccuccaa

SEQ ID NO: 1721241 - RNA, 18 nt, Homo sapiens
cccagacuccaccaagcc

SEQ ID NO: 1721242 - RNA, 22 nt, Homo sapiens
cccagcucaugcacaucagcug

SEQ ID NO: 1721243 - RNA, 19 nt, Homo sapiens
cccauagcagcagugcaug

SEQ ID NO: 1721244 - RNA, 20 nt, Homo sapiens
cccccauagcagcagugcau

SEQ ID NO: 1721245 - RNA, 18 nt, Homo sapiens
ccccucugucugcccuca

SEQ ID NO: 1721246 - RNA, 16 nt, Homo sapiens
cccgccuggaggagau

SEQ ID NO: 1721247 - RNA, 16 nt, Homo sapiens
cccugaguuccuagcc

SEQ ID NO: 1721248 - RNA, 11 nt, Homo sapiens
cccugccauca

SEQ ID NO: 1721249 - RNA, 20 nt, Homo sapiens
cccuugacaaagucaagcca

SEQ ID NO: 1721250 - RNA, 13 nt, Homo sapiens
ccuauaaauauua

SEQ ID NO: 1721251 - RNA, 12 nt, Homo sapiens
ccucaccuccau

SEQ ID NO: 1721252 - RNA, 13 nt, Homo sapiens
ccucccucaggcc

SEQ ID NO: 1721253 - RNA, 12 nt, Homo sapiens
ccucucauucca

SEQ ID NO: 1721254 - RNA, 18 nt, Homo sapiens
ccucugccucccaaagug

SEQ ID NO: 1721255 - RNA, 20 nt, Homo sapiens
ccucugccucccggguucaa

SEQ ID NO: 1721256 - RNA, 14 nt, Homo sapiens
ccugaaggaaccaa

SEQ ID NO: 1721257 - RNA, 18 nt, Homo sapiens
ccugagaucucugcagga

SEQ ID NO: 1721258 - RNA, 20 nt, Homo sapiens
ccugagaugauuuggucaga

SEQ ID NO: 1721259 - RNA, 23 nt, Homo sapiens
ccuggagacuaaccccaccacac

SEQ ID NO: 1721260 - RNA, 20 nt, Homo sapiens
ccuugacaaagucaagccac

SEQ ID NO: 1721261 - RNA, 22 nt, Homo sapiens
ccuugcaagcuaauucuuugac

SEQ ID NO: 1721262 - RNA, 15 nt, Homo sapiens
ccuuggugugcugua

SEQ ID NO: 1721263 - RNA, 12 nt, Homo sapiens
ccuuugaucucg

SEQ ID NO: 1721264 - RNA, 14 nt, Homo sapiens
ccuuugucccagaa

SEQ ID NO: 1721265 - RNA, 13 nt, Homo sapiens
ccuuuugccaucc

SEQ ID NO: 1721266 - RNA, 18 nt, Homo sapiens
cgagaccugugugccagg

SEQ ID NO: 1721267 - RNA, 23 nt, Homo sapiens
cgguggccugggauuggcuguga

SEQ ID NO: 1721268 - RNA, 12 nt, Homo sapiens
cgugcccugcuc

SEQ ID NO: 1721269 - RNA, 15 nt, Homo sapiens
cuacagcacugugau

SEQ ID NO: 1721270 - RNA, 19 nt, Homo sapiens
cuaccuugguccugccucu

SEQ ID NO: 1721271 - RNA, 19 nt, Homo sapiens
cuacugggagccuacccac

SEQ ID NO: 1721272 - RNA, 17 nt, Homo sapiens
cuacuuuagagucuucu

SEQ ID NO: 1721273 - RNA, 18 nt, Homo sapiens
cuacuuuuugcaccuuau

SEQ ID NO: 1721274 - RNA, 20 nt, Homo sapiens
cacauuuacuagcugugcaa

SEQ ID NO: 1721275 - RNA, 22 nt, Homo sapiens
cacgaucucggcucacugcaac

SEQ ID NO: 1721276 - RNA, 20 nt, Homo sapiens
cacggaagggcucuuucaca

SEQ ID NO: 1721277 - RNA, 15 nt, Homo sapiens
cacucccaguucccu

SEQ ID NO: 1721278 - RNA, 13 nt, Homo sapiens
cacuccuucagga

SEQ ID NO: 1721279 - RNA, 13 nt, Homo sapiens
cagagcccagcuc

SEQ ID NO: 1721280 - RNA, 20 nt, Homo sapiens
cagagcgagagaauauguca

SEQ ID NO: 1721281 - RNA, 13 nt, Homo sapiens
cagagcugggcua

SEQ ID NO: 1721282 - RNA, 16 nt, Homo sapiens
cagaguggacuguucc

SEQ ID NO: 1721283 - RNA, 23 nt, Homo sapiens
cagauuuuaagggggaaaacugu

SEQ ID NO: 1721284 - RNA, 21 nt, Homo sapiens
cagcaccaucucuuuaccucc

SEQ ID NO: 1721285 - RNA, 23 nt, Homo sapiens
cagcacguguggccuguucuucu

SEQ ID NO: 1721286 - RNA, 18 nt, Homo sapiens
cagcccgggucaucugua

SEQ ID NO: 1721287 - RNA, 20 nt, Homo sapiens
cagcccugaguuccuagcca

SEQ ID NO: 1721288 - RNA, 19 nt, Homo sapiens
cagccucccaaguagcugg

SEQ ID NO: 1721289 - RNA, 14 nt, Homo sapiens
cagcucacugcaac

SEQ ID NO: 1721290 - RNA, 15 nt, Homo sapiens
cagcugcugugcauu

SEQ ID NO: 1721291 - RNA, 19 nt, Homo sapiens
caggacauuuggcugugau

SEQ ID NO: 1721292 - RNA, 13 nt, Homo sapiens
caggagucccugc

SEQ ID NO: 1721293 - RNA, 18 nt, Homo sapiens
caggagucccugccauca

SEQ ID NO: 1721294 - RNA, 18 nt, Homo sapiens
caggccauugucccugaa

SEQ ID NO: 1721295 - RNA, 14 nt, Homo sapiens
caggcccaaagccu

SEQ ID NO: 1721296 - RNA, 16 nt, Homo sapiens
caggcugcagugcaau

SEQ ID NO: 1721297 - RNA, 19 nt, Homo sapiens
caggcugcagugcaauggc

SEQ ID NO: 1721298 - RNA, 21 nt, Homo sapiens
caggguuuugccauguugccc

SEQ ID NO: 1721299 - RNA, 22 nt, Homo sapiens
caggugggaggugucagagccc

SEQ ID NO: 1721300 - RNA, 21 nt, Homo sapiens
cagguguucuucauuaccuca

SEQ ID NO: 1721301 - RNA, 20 nt, Homo sapiens
caguuacccccaaccugacc

SEQ ID NO: 1721302 - RNA, 17 nt, Homo sapiens
caguuccuuugaucucg

SEQ ID NO: 1721303 - RNA, 19 nt, Homo sapiens
cauccaacauuaaaagcca

SEQ ID NO: 1721304 - RNA, 12 nt, Homo sapiens
caucuacuacag

SEQ ID NO: 1721305 - RNA, 21 nt, Homo sapiens
caucuauucucugccuuuacu

SEQ ID NO: 1721306 - RNA, 23 nt, Homo sapiens
caucucuuuaccuccuaauucca

SEQ ID NO: 1721307 - RNA, 17 nt, Homo sapiens
caugaguuggcugggaa

SEQ ID NO: 1721308 - RNA, 23 nt, Homo sapiens
cauuaaaauaauaaaauaaucau

SEQ ID NO: 1721309 - RNA, 20 nt, Homo sapiens
cauuaucagccugugccacg

SEQ ID NO: 1721310 - RNA, 21 nt, Homo sapiens
cauuggaccuuuccugaggaa

SEQ ID NO: 1721311 - RNA, 12 nt, Homo sapiens
cauugucccuga

SEQ ID NO: 1721312 - RNA, 17 nt, Homo sapiens
ccacacacagcuaauuu

SEQ ID NO: 1721313 - RNA, 19 nt, Homo sapiens
ccacucaggcccaaagccu

SEQ ID NO: 1721314 - RNA, 17 nt, Homo sapiens
ccacucucccaccuccu

SEQ ID NO: 1721315 - RNA, 18 nt, Homo sapiens
ccagaaugccuccugcag

SEQ ID NO: 1721316 - RNA, 11 nt, Homo sapiens
ccagacuccac

SEQ ID NO: 1721317 - RNA, 17 nt, Homo sapiens
ccagacuggagugcagu

SEQ ID NO: 1721318 - RNA, 18 nt, Homo sapiens
ccagaggucuggcccuau

SEQ ID NO: 1721319 - RNA, 19 nt, Homo sapiens
ccagcaucucccaguucau

SEQ ID NO: 1721320 - RNA, 14 nt, Homo sapiens
ccagcuuuccucau

SEQ ID NO: 1721321 - RNA, 17 nt, Homo sapiens
ccagcuuuccucaucag

SEQ ID NO: 1721322 - RNA, 16 nt, Homo sapiens
ccaggaggcggcagug

SEQ ID NO: 1721323 - RNA, 18 nt, Homo sapiens
ccaggccgagaugugcaa

SEQ ID NO: 1721324 - RNA, 17 nt, Homo sapiens
ccauagcagcagugcau

SEQ ID NO: 1721325 - RNA, 13 nt, Homo sapiens
ccaucuauucucu

SEQ ID NO: 1721326 - RNA, 13 nt, Homo sapiens
ccaucucuuuacc

SEQ ID NO: 1721327 - RNA, 13 nt, Homo sapiens
ccauggggcagca

SEQ ID NO: 1721328 - RNA, 22 nt, Homo sapiens
ccauuccaaaguucuuaucucu

SEQ ID NO: 1721329 - RNA, 15 nt, Homo sapiens
ccauugguguugaca

SEQ ID NO: 1721330 - RNA, 22 nt, Homo sapiens
ccauuuacucuugagacuacuu

SEQ ID NO: 1721331 - RNA, 20 nt, Homo sapiens
ccauuucuuaacagucucca

SEQ ID NO: 1721332 - RNA, 23 nt, Homo sapiens
ucugggagaaaugagauaaaaga

SEQ ID NO: 1721333 - RNA, 17 nt, Homo sapiens
ucuguccccugcuacua

SEQ ID NO: 1721334 - RNA, 21 nt, Homo sapiens
ucugugaggggcucucucaug

SEQ ID NO: 1721335 - RNA, 19 nt, Homo sapiens
ucuguguguguguaugugg

SEQ ID NO: 1721336 - RNA, 23 nt, Homo sapiens
ucuguguguguguaugugggggu

SEQ ID NO: 1721337 - RNA, 18 nt, Homo sapiens
ucuuacucuacugcugcu

SEQ ID NO: 1721338 - RNA, 22 nt, Homo sapiens
ucuucuauggguuggacaaccu

SEQ ID NO: 1721339 - RNA, 21 nt, Homo sapiens
ucuugcucuaaugaucaaaac

SEQ ID NO: 1721340 - RNA, 12 nt, Homo sapiens
ucuuuaccuccu

SEQ ID NO: 1721341 - RNA, 11 nt, Homo sapiens
ugaaccuucaa

SEQ ID NO: 1721342 - RNA, 21 nt, Homo sapiens
ugaccagugucuacauugcca

SEQ ID NO: 1721343 - RNA, 21 nt, Homo sapiens
ugagcuggaguucagcaguga

SEQ ID NO: 1721344 - RNA, 20 nt, Homo sapiens
ugagcuggggaugucucuca

SEQ ID NO: 1721345 - RNA, 22 nt, Homo sapiens
ugagcuggggaugucucucaug

SEQ ID NO: 1721346 - RNA, 16 nt, Homo sapiens
ugaggggcucucucau

SEQ ID NO: 1721347 - RNA, 18 nt, Homo sapiens
ugaggggcucucucauga

SEQ ID NO: 1721348 - RNA, 19 nt, Homo sapiens
ugagggugacuauggagcu

SEQ ID NO: 1721349 - RNA, 17 nt, Homo sapiens
ugaggugggagaugugg

SEQ ID NO: 1721350 - RNA, 20 nt, Homo sapiens
ugauacuuccaagugauaau

SEQ ID NO: 1721351 - RNA, 15 nt, Homo sapiens
ugauuguauuuaccu

SEQ ID NO: 1721352 - RNA, 15 nt, Homo sapiens
ugauuucaguucacu

SEQ ID NO: 1721353 - RNA, 20 nt, Homo sapiens
ugauuucaguucacuguuca

SEQ ID NO: 1721354 - RNA, 20 nt, Homo sapiens
ugcaaccccaucauccucag

SEQ ID NO: 1721355 - RNA, 15 nt, Homo sapiens
ugcacacguguggac

SEQ ID NO: 1721356 - RNA, 20 nt, Homo sapiens
ugcaggacauuuggcuguga

SEQ ID NO: 1721357 - RNA, 17 nt, Homo sapiens
ugcauggauaugugcca

SEQ ID NO: 1721358 - RNA, 16 nt, Homo sapiens
ugccacagaugauacu

SEQ ID NO: 1721359 - RNA, 18 nt, Homo sapiens
ugccaccaugccuaauuu

SEQ ID NO: 1721360 - RNA, 22 nt, Homo sapiens
ugccaggcccucuccugccaca

SEQ ID NO: 1721361 - RNA, 19 nt, Homo sapiens
ugcccaggcaaagugcacc

SEQ ID NO: 1721362 - RNA, 13 nt, Homo sapiens
ugcccugugcucc

SEQ ID NO: 1721363 - RNA, 15 nt, Homo sapiens
ugccucccaaagugc

SEQ ID NO: 1721364 - RNA, 14 nt, Homo sapiens
ugccucugccuccc

SEQ ID NO: 1721365 - RNA, 14 nt, Homo sapiens
ugccugguccucac

SEQ ID NO: 1721366 - RNA, 15 nt, Homo sapiens
ugccuuuacuauaug

SEQ ID NO: 1721367 - RNA, 14 nt, Homo sapiens
ugcucugugcccac

SEQ ID NO: 1721368 - RNA, 10 nt, Homo sapiens
ugcugccuaa

SEQ ID NO: 1721369 - RNA, 18 nt, Homo sapiens
ugcugccuaauaaagaga

SEQ ID NO: 1721370 - RNA, 15 nt, Homo sapiens
ugcugcuguaccaca

SEQ ID NO: 1721371 - RNA, 16 nt, Homo sapiens
ugcuguuaucccugcc

SEQ ID NO: 1721372 - RNA, 22 nt, Homo sapiens
ugcuguuaucccugccuggucc

SEQ ID NO: 1721373 - RNA, 13 nt, Homo sapiens
uggaaaagccaag

SEQ ID NO: 1721374 - RNA, 18 nt, Homo sapiens
uggaagugugggucugug

SEQ ID NO: 1721375 - RNA, 16 nt, Homo sapiens
uggagacuaaccccac

SEQ ID NO: 1721376 - RNA, 21 nt, Homo sapiens
uggagcugcguuuccugugca

SEQ ID NO: 1721377 - RNA, 15 nt, Homo sapiens
uggcuggaucuguga

SEQ ID NO: 1721378 - RNA, 15 nt, Homo sapiens
ugggagccuacccac

SEQ ID NO: 1721379 - RNA, 18 nt, Homo sapiens
ugggcaggguacagacac

SEQ ID NO: 1721380 - RNA, 18 nt, Homo sapiens
uggggaugucucucauga

SEQ ID NO: 1721381 - RNA, 14 nt, Homo sapiens
ugggucaguuguau

SEQ ID NO: 1721382 - RNA, 17 nt, Homo sapiens
uggguuggacaaccuca

SEQ ID NO: 1721383 - RNA, 15 nt, Homo sapiens
uggucuccacugggg

SEQ ID NO: 1721384 - RNA, 16 nt, Homo sapiens
uggucuccacugggga

SEQ ID NO: 1721385 - RNA, 16 nt, Homo sapiens
ugguguugacauacau

SEQ ID NO: 1721386 - RNA, 18 nt, Homo sapiens
uguaauuuaaaauuguga

SEQ ID NO: 1721387 - RNA, 17 nt, Homo sapiens
uguacuaguaguuaaga

SEQ ID NO: 1721388 - RNA, 14 nt, Homo sapiens
uguauccauccaug

SEQ ID NO: 1721389 - RNA, 19 nt, Homo sapiens
uguaugcuucauacaggga

SEQ ID NO: 1721390 - RNA, 15 nt, Homo sapiens
ugucucucaugacca

SEQ ID NO: 1721391 - RNA, 18 nt, Homo sapiens
ugugccuuggugugcugu

SEQ ID NO: 1721392 - RNA, 14 nt, Homo sapiens
uguggaaaagccaa

SEQ ID NO: 1721393 - RNA, 17 nt, Homo sapiens
uguggcaguuuggcaaa

SEQ ID NO: 1721394 - RNA, 18 nt, Homo sapiens
uguuccauuggguccucu

SEQ ID NO: 1721395 - RNA, 13 nt, Homo sapiens
uuaagggggaaaa

SEQ ID NO: 1721396 - RNA, 22 nt, Homo sapiens
aaaagaauugucuuucugucuc

SEQ ID NO: 1721397 - RNA, 23 nt, Homo sapiens
aaacgugcauggauaugugccag

SEQ ID NO: 1721398 - RNA, 21 nt, Homo sapiens
aaacuuggauuugcucagugu

SEQ ID NO: 1721399 - RNA, 16 nt, Homo sapiens
aaaguaagacaucuca

SEQ ID NO: 1721400 - RNA, 17 nt, Homo sapiens
aacaugaaaugcuucca

SEQ ID NO: 1721401 - RNA, 20 nt, Homo sapiens
aacccuucagauuugccuua

SEQ ID NO: 1721402 - RNA, 14 nt, Homo sapiens
aaccucugccuccc

SEQ ID NO: 1721403 - RNA, 13 nt, Homo sapiens
aaccugaccagug

SEQ ID NO: 1721404 - RNA, 22 nt, Homo sapiens
aacucucgagacuucucuguga

SEQ ID NO: 1721405 - RNA, 18 nt, Homo sapiens
aacugcccaggcaaagug

SEQ ID NO: 1721406 - RNA, 19 nt, Homo sapiens
aacuuccacaagagugaau

SEQ ID NO: 1721407 - RNA, 18 nt, Homo sapiens
aacuuuuuccaaucuuag

SEQ ID NO: 1721408 - RNA, 12 nt, Homo sapiens
aagagugaauuu

SEQ ID NO: 1721409 - RNA, 22 nt, Homo sapiens
aagaugcugacauccagguggg

SEQ ID NO: 1721410 - RNA, 16 nt, Homo sapiens
aagccagcuuuccuca

SEQ ID NO: 1721411 - RNA, 14 nt, Homo sapiens
aagcucgagugaau

SEQ ID NO: 1721412 - RNA, 15 nt, Homo sapiens
aagcucgagugaauu

SEQ ID NO: 1721413 - RNA, 14 nt, Homo sapiens
aagcuuuggacaag

SEQ ID NO: 1721414 - RNA, 18 nt, Homo sapiens
aagggacaccaagccuug

SEQ ID NO: 1721415 - RNA, 15 nt, Homo sapiens
aagucacuggccagu

SEQ ID NO: 1721416 - RNA, 21 nt, Homo sapiens
aagucaucuguuuaauuuaca

SEQ ID NO: 1721417 - RNA, 23 nt, Homo sapiens
aagugcugggauuacagguguga

SEQ ID NO: 1721418 - RNA, 13 nt, Homo sapiens
aauaaaaccacca

SEQ ID NO: 1721419 - RNA, 14 nt, Homo sapiens
aauaaggcacaaaa

SEQ ID NO: 1721420 - RNA, 20 nt, Homo sapiens
aauaauagggaaaauaccua

SEQ ID NO: 1721421 - RNA, 17 nt, Homo sapiens
aauaugauacucucaga

SEQ ID NO: 1721422 - RNA, 14 nt, Homo sapiens
aaugaugggucagu

SEQ ID NO: 1721423 - RNA, 13 nt, Homo sapiens
aaugcuuccaagc

SEQ ID NO: 1721424 - RNA, 18 nt, Homo sapiens
aaugucuuugagccuuag

SEQ ID NO: 1721425 - RNA, 18 nt, Homo sapiens
aauuugcauugugucaga

SEQ ID NO: 1721426 - RNA, 19 nt, Homo sapiens
acaaaaauucucaguucuc

SEQ ID NO: 1721427 - RNA, 17 nt, Homo sapiens
acaaagucaagccacau

SEQ ID NO: 1721428 - RNA, 19 nt, Homo sapiens
acaaccucauuuuaacuca

SEQ ID NO: 1721429 - RNA, 12 nt, Homo sapiens
acaauccuccaa

SEQ ID NO: 1721430 - RNA, 21 nt, Homo sapiens
acacccucccucuacugggag

SEQ ID NO: 1721431 - RNA, 17 nt, Homo sapiens
acacucccacuuggcau

SEQ ID NO: 1721432 - RNA, 15 nt, Homo sapiens
acaggcgucugccac

SEQ ID NO: 1721433 - RNA, 21 nt, Homo sapiens
acaggcgucugccaccaugcc

SEQ ID NO: 1721434 - RNA, 12 nt, Homo sapiens
acaggugccagg

SEQ ID NO: 1721435 - RNA, 23 nt, Homo sapiens
acauaccuggcccugugccuugg

SEQ ID NO: 1721436 - RNA, 19 nt, Homo sapiens
acaucuacuacagcacugu

SEQ ID NO: 1721437 - RNA, 12 nt, Homo sapiens
acaugcaggcug

SEQ ID NO: 1721438 - RNA, 15 nt, Homo sapiens
acauucuaauuugca

SEQ ID NO: 1721439 - RNA, 20 nt, Homo sapiens
accacacagccaaggggaug

SEQ ID NO: 1721440 - RNA, 23 nt, Homo sapiens
accaggaggcggcagugcaacaa

SEQ ID NO: 1721441 - RNA, 16 nt, Homo sapiens
acccagcuaugguucu

SEQ ID NO: 1721442 - RNA, 20 nt, Homo sapiens
acccaggcugcagugcaaug

SEQ ID NO: 1721443 - RNA, 14 nt, Homo sapiens
acccuuaggccagc

SEQ ID NO: 1721444 - RNA, 22 nt, Homo sapiens
accuaguucaaugugcuuuuaa

SEQ ID NO: 1721445 - RNA, 18 nt, Homo sapiens
accuggcccugugccuug

SEQ ID NO: 1721446 - RNA, 14 nt, Homo sapiens
accuucuaccucuu

SEQ ID NO: 1721447 - RNA, 19 nt, Homo sapiens
accuuggccucccaaagug

SEQ ID NO: 1721448 - RNA, 19 nt, Homo sapiens
acgagaccugugugccagg

SEQ ID NO: 1721449 - RNA, 11 nt, Homo sapiens
acgcagaucac

SEQ ID NO: 1721450 - RNA, 22 nt, Homo sapiens
acgggacccugagccugugugu

SEQ ID NO: 1721451 - RNA, 22 nt, Homo sapiens
acgugcauggauaugugccagg

SEQ ID NO: 1721452 - RNA, 17 nt, Homo sapiens
acuaaaguauaucuuua

SEQ ID NO: 1721453 - RNA, 13 nt, Homo sapiens
acuagauugaucu

SEQ ID NO: 1721454 - RNA, 16 nt, Homo sapiens
acuauucuagcaggag

SEQ ID NO: 1721455 - RNA, 17 nt, Homo sapiens
acucaggcccaaagccu

SEQ ID NO: 1721456 - RNA, 15 nt, Homo sapiens
acucccacuuggcau

SEQ ID NO: 1721457 - RNA, 16 nt, Homo sapiens
acuccuuaauacuaga

SEQ ID NO: 1721458 - RNA, 12 nt, Homo sapiens
acucuacugcug

SEQ ID NO: 1721459 - RNA, 21 nt, Homo sapiens
acucugcccucagggugccug

SEQ ID NO: 1721460 - RNA, 11 nt, Homo sapiens
acugauccagc

SEQ ID NO: 1721461 - RNA, 16 nt, Homo sapiens
acugcaaccucugccu

SEQ ID NO: 1721462 - RNA, 19 nt, Homo sapiens
acuguauauaaacuccuua

SEQ ID NO: 1721463 - RNA, 21 nt, Homo sapiens
acuguucaguuuagcauuaaa

SEQ ID NO: 1721464 - RNA, 14 nt, Homo sapiens
acuuaucaacauuu

SEQ ID NO: 1721465 - RNA, 13 nt, Homo sapiens
acuuccaagugau

SEQ ID NO: 1721466 - RNA, 18 nt, Homo sapiens
acuuccacaagagugaau

SEQ ID NO: 1721467 - RNA, 13 nt, Homo sapiens
acuucccauuuac

SEQ ID NO: 1721468 - RNA, 19 nt, Homo sapiens
acuugcugcccugugcucc

SEQ ID NO: 1721469 - RNA, 17 nt, Homo sapiens
acuuggagguagcuuug

SEQ ID NO: 1721470 - RNA, 16 nt, Homo sapiens
agaaaagcaguggcuc

SEQ ID NO: 1721471 - RNA, 13 nt, Homo sapiens
agaagccagcuuu

SEQ ID NO: 1721472 - RNA, 13 nt, Homo sapiens
agaagcccagaau

SEQ ID NO: 1721473 - RNA, 19 nt, Homo sapiens
agaauucuggacaacccaa

SEQ ID NO: 1721474 - RNA, 13 nt, Homo sapiens
agacaucucagga

SEQ ID NO: 1721475 - RNA, 19 nt, Homo sapiens
agacauuugcuaugagcug

SEQ ID NO: 1721476 - RNA, 21 nt, Homo sapiens
agaggaaggaaaaggaggaaa

SEQ ID NO: 1721477 - RNA, 15 nt, Homo sapiens
agaugauacuuccaa

SEQ ID NO: 1721478 - RNA, 14 nt, Homo sapiens
agaugauuugguca

SEQ ID NO: 1721479 - RNA, 16 nt, Homo sapiens
agaugugcaacacuca

SEQ ID NO: 1721480 - RNA, 17 nt, Homo sapiens
agauuuuaagggggaaa

SEQ ID NO: 1721481 - RNA, 19 nt, Homo sapiens
agcaagucacuggccagug

SEQ ID NO: 1721482 - RNA, 19 nt, Homo sapiens
agcacagucccuaggacau

SEQ ID NO: 1721483 - RNA, 17 nt, Homo sapiens
agcacguguggccuguu

SEQ ID NO: 1721484 - RNA, 15 nt, Homo sapiens
agcagcccccauuuc

SEQ ID NO: 1721485 - RNA, 18 nt, Homo sapiens
agcagugccgcguggccu

SEQ ID NO: 1721486 - RNA, 16 nt, Homo sapiens
agcaguggcuccauug

SEQ ID NO: 1721487 - RNA, 20 nt, Homo sapiens
agcauaggaaaccacacaga

SEQ ID NO: 1721488 - RNA, 17 nt, Homo sapiens
agcaucucccaguucau

SEQ ID NO: 1721489 - RNA, 18 nt, Homo sapiens
agccucgacacagagugg

SEQ ID NO: 1721490 - RNA, 20 nt, Homo sapiens
agccuuaguuuuuucaucug

SEQ ID NO: 1721491 - RNA, 18 nt, Homo sapiens
agccuuggcucuacccug

SEQ ID NO: 1721492 - RNA, 13 nt, Homo sapiens
agcgguccaaagu

SEQ ID NO: 1721493 - RNA, 18 nt, Homo sapiens
agcgugagcugugggaga

SEQ ID NO: 1721494 - RNA, 17 nt, Homo sapiens
agcuggaguucaugucg

SEQ ID NO: 1721495 - RNA, 15 nt, Homo sapiens
agcuggauucaauuc

SEQ ID NO: 1721496 - RNA, 16 nt, Homo sapiens
agcuggcggccugcag

SEQ ID NO: 1721497 - RNA, 14 nt, Homo sapiens
agcugggauuacag

SEQ ID NO: 1721498 - RNA, 15 nt, Homo sapiens
agcuuugagguggaa

SEQ ID NO: 1721499 - RNA, 19 nt, Homo sapiens
aggaaccaaagcgaauuuu

SEQ ID NO: 1721500 - RNA, 14 nt, Homo sapiens
aggaauauagucag

SEQ ID NO: 1721501 - RNA, 15 nt, Homo sapiens
aggagucccugccau

SEQ ID NO: 1721502 - RNA, 14 nt, Homo sapiens
aggauuacaggcau

SEQ ID NO: 1721503 - RNA, 13 nt, Homo sapiens
aggcacaacaguu

SEQ ID NO: 1721504 - RNA, 18 nt, Homo sapiens
aggcaugagccacugcgc

SEQ ID NO: 1721505 - RNA, 17 nt, Homo sapiens
aggccacagugcaauuu

SEQ ID NO: 1721506 - RNA, 16 nt, Homo sapiens
aggccgagaugugcaa

SEQ ID NO: 1721507 - RNA, 16 nt, Homo sapiens
aggcugacuacucacu

SEQ ID NO: 1721508 - RNA, 16 nt, Homo sapiens
aggcugcagugcaaug

SEQ ID NO: 1721509 - RNA, 20 nt, Homo sapiens
aggcugcuuuccaaagccaa

SEQ ID NO: 1721510 - RNA, 21 nt, Homo sapiens
aggcugcuuuccaaagccaau

SEQ ID NO: 1721511 - RNA, 20 nt, Homo sapiens
agggacaccaagccuuggcu

SEQ ID NO: 1721512 - RNA, 19 nt, Homo sapiens
agggcucuuucacagcugg

SEQ ID NO: 1721513 - RNA, 21 nt, Homo sapiens
aggggaaaagagaugaugaaa

SEQ ID NO: 1721514 - RNA, 14 nt, Homo sapiens
aggggcucucucau

SEQ ID NO: 1721515 - RNA, 20 nt, Homo sapiens
aggguuuugccauguugccc

SEQ ID NO: 1721516 - RNA, 13 nt, Homo sapiens
agguccccagacu

SEQ ID NO: 1721517 - RNA, 20 nt, Homo sapiens
agguguucuucauuaccuca

SEQ ID NO: 1721518 - RNA, 13 nt, Homo sapiens
aguaaccuaguga

SEQ ID NO: 1721519 - RNA, 16 nt, Homo sapiens
aguagagacaggguuu

SEQ ID NO: 1721520 - RNA, 16 nt, Homo sapiens
agucauccucagauca

SEQ ID NO: 1721521 - RNA, 17 nt, Homo sapiens
aguccuucaagauucca

SEQ ID NO: 1721522 - RNA, 20 nt, Homo sapiens
agucuagccuuguguuauag

SEQ ID NO: 1721523 - RNA, 15 nt, Homo sapiens
agugagccacuagcu

SEQ ID NO: 1721524 - RNA, 21 nt, Homo sapiens
agugcaauggcgcgaucucag

SEQ ID NO: 1721525 - RNA, 15 nt, Homo sapiens
agugcuauuguagag

SEQ ID NO: 1721526 - RNA, 16 nt, Homo sapiens
agugguuaagauuccu

SEQ ID NO: 1721527 - RNA, 18 nt, Homo sapiens
aguucaugucgcaacagu

SEQ ID NO: 1721528 - RNA, 16 nt, Homo sapiens
aguuccccuacuacac

SEQ ID NO: 1721529 - RNA, 20 nt, Homo sapiens
auaagcagucauccucagau

SEQ ID NO: 1721530 - RNA, 13 nt, Homo sapiens
auacuagauugau

SEQ ID NO: 1721531 - RNA, 16 nt, Homo sapiens
auacuagauugaucua

SEQ ID NO: 1721532 - RNA, 17 nt, Homo sapiens
auagcagcagugcaugg

SEQ ID NO: 1721533 - RNA, 22 nt, Homo sapiens
auaggaaaccacacagacuugg

SEQ ID NO: 1721534 - RNA, 15 nt, Homo sapiens
auauauuucccugaa

SEQ ID NO: 1721535 - RNA, 15 nt, Homo sapiens
uuacuauauguugac

SEQ ID NO: 1721536 - RNA, 21 nt, Homo sapiens
uuacuguauauaaacuccuua

SEQ ID NO: 1721537 - RNA, 16 nt, Homo sapiens
uuauauauuacuuguu

SEQ ID NO: 1721538 - RNA, 13 nt, Homo sapiens
uuaugaaaacuga

SEQ ID NO: 1721539 - RNA, 19 nt, Homo sapiens
uuauuuuguuuauugcacu

SEQ ID NO: 1721540 - RNA, 21 nt, Homo sapiens
uucauauauccgaacuacugu

SEQ ID NO: 1721541 - RNA, 12 nt, Homo sapiens
uucauuaccuca

SEQ ID NO: 1721542 - RNA, 17 nt, Homo sapiens
uuccacuccuccuagcc

SEQ ID NO: 1721543 - RNA, 17 nt, Homo sapiens
uucccauuuacucuuga

SEQ ID NO: 1721544 - RNA, 20 nt, Homo sapiens
uucccugaaggaaccaaagc

SEQ ID NO: 1721545 - RNA, 22 nt, Homo sapiens
uucccugaaggaaccaaagcga

SEQ ID NO: 1721546 - RNA, 20 nt, Homo sapiens
uuccuuuuagucuagccuug

SEQ ID NO: 1721547 - RNA, 13 nt, Homo sapiens
uucuaccaaauga

SEQ ID NO: 1721548 - RNA, 17 nt, Homo sapiens
uucuuaacagucuccaa

SEQ ID NO: 1721549 - RNA, 20 nt, Homo sapiens
uucuuucuccucugauuuca

SEQ ID NO: 1721550 - RNA, 19 nt, Homo sapiens
uugacaaagucaagccaca

SEQ ID NO: 1721551 - RNA, 21 nt, Homo sapiens
uugccacagaugauacuucca

SEQ ID NO: 1721552 - RNA, 13 nt, Homo sapiens
uugccauguugcc

SEQ ID NO: 1721553 - RNA, 23 nt, Homo sapiens
uugcccaggcuggucuugaacuc

SEQ ID NO: 1721554 - RNA, 20 nt, Homo sapiens
uugccuuauuggcagcucua

SEQ ID NO: 1721555 - RNA, 15 nt, Homo sapiens
uuggagccugcagag

SEQ ID NO: 1721556 - RNA, 19 nt, Homo sapiens
uuggauuugcucagugucu

SEQ ID NO: 1721557 - RNA, 23 nt, Homo sapiens
uuggcagcucuacucuggagguu

SEQ ID NO: 1721558 - RNA, 14 nt, Homo sapiens
uuggccucccaaag

SEQ ID NO: 1721559 - RNA, 16 nt, Homo sapiens
uuguauuuaccuucua

SEQ ID NO: 1721560 - RNA, 15 nt, Homo sapiens
uuguuuauugcacuu

SEQ ID NO: 1721561 - RNA, 16 nt, Homo sapiens
uuguuugagacagggu

SEQ ID NO: 1721562 - RNA, 16 nt, Homo sapiens
uuuacuuucucucucc

SEQ ID NO: 1721563 - RNA, 14 nt, Homo sapiens
uuuaucuuaaccuc

SEQ ID NO: 1721564 - RNA, 15 nt, Homo sapiens
uuuaucuuaaccuca

SEQ ID NO: 1721565 - RNA, 12 nt, Homo sapiens
uuuaugguucuc

SEQ ID NO: 1721566 - RNA, 14 nt, Homo sapiens
uuuccugugcaugg

SEQ ID NO: 1721567 - RNA, 23 nt, Homo sapiens
uuucuuccaauuauuacaguccu

SEQ ID NO: 1721568 - RNA, 21 nt, Homo sapiens
uuuggcaaacucuccaccaca

SEQ ID NO: 1721569 - RNA, 20 nt, Homo sapiens
uuuggggcucagaguggggu

SEQ ID NO: 1721570 - RNA, 22 nt, Homo sapiens
uuugucaaggcugacuacucac

SEQ ID NO: 1721571 - RNA, 13 nt, Homo sapiens
uuuguuccaugag

SEQ ID NO: 1721572 - RNA, 22 nt, Homo sapiens
uuuugcccuugacaaagucaag

SEQ ID NO: 1721573 - RNA, 12 nt, Homo sapiens
cucuacccugag

SEQ ID NO: 1721574 - RNA, 20 nt, Homo sapiens
cucuacucuggagguuuguu

SEQ ID NO: 1721575 - RNA, 17 nt, Homo sapiens
cucuccucuuugauguc

SEQ ID NO: 1721576 - RNA, 23 nt, Homo sapiens
cucucgcaagggaaguccuugca

SEQ ID NO: 1721577 - RNA, 21 nt, Homo sapiens
cucuucuagcauuucuuccaa

SEQ ID NO: 1721578 - RNA, 17 nt, Homo sapiens
cucuugagacuacuuca

SEQ ID NO: 1721579 - RNA, 14 nt, Homo sapiens
cugaaggaaccaaa

SEQ ID NO: 1721580 - RNA, 14 nt, Homo sapiens
cugaaguacuuaaa

SEQ ID NO: 1721581 - RNA, 21 nt, Homo sapiens
cugaaguacuuaaacuuccac

SEQ ID NO: 1721582 - RNA, 15 nt, Homo sapiens
cugacuuucucucca

SEQ ID NO: 1721583 - RNA, 21 nt, Homo sapiens
cugcaccuucgccagggagca

SEQ ID NO: 1721584 - RNA, 16 nt, Homo sapiens
cugcagccaggccacu

SEQ ID NO: 1721585 - RNA, 19 nt, Homo sapiens
cugcagccaggccacuggc

SEQ ID NO: 1721586 - RNA, 20 nt, Homo sapiens
cugcagugcaauggcgcgau

SEQ ID NO: 1721587 - RNA, 23 nt, Homo sapiens
cugccaucauguuuacagaggac

SEQ ID NO: 1721588 - RNA, 17 nt, Homo sapiens
cugcccaggcaaagugc

SEQ ID NO: 1721589 - RNA, 17 nt, Homo sapiens
cugccucugccucccaa

SEQ ID NO: 1721590 - RNA, 20 nt, Homo sapiens
cugccugguccucacacuca

SEQ ID NO: 1721591 - RNA, 15 nt, Homo sapiens
cugcucauccaaagu

SEQ ID NO: 1721592 - RNA, 18 nt, Homo sapiens
cugcuuuccaaagccaau

SEQ ID NO: 1721593 - RNA, 17 nt, Homo sapiens
cuggagacuaaccccac

SEQ ID NO: 1721594 - RNA, 22 nt, Homo sapiens
cuggcaguaaccuagugaauuu

SEQ ID NO: 1721595 - RNA, 17 nt, Homo sapiens
cugggauuggcugugag

SEQ ID NO: 1721596 - RNA, 19 nt, Homo sapiens
cuggggaugucucucauga

SEQ ID NO: 1721597 - RNA, 13 nt, Homo sapiens
cuggucucagugc

SEQ ID NO: 1721598 - RNA, 16 nt, Homo sapiens
cuguaccacacagcca

SEQ ID NO: 1721599 - RNA, 21 nt, Homo sapiens
cugugaggggcucucucauga

SEQ ID NO: 1721600 - RNA, 14 nt, Homo sapiens
cugugccuuuugcc

SEQ ID NO: 1721601 - RNA, 20 nt, Homo sapiens
cuguuggacacccagugcca

SEQ ID NO: 1721602 - RNA, 22 nt, Homo sapiens
cuguuggacacccagugccagg

SEQ ID NO: 1721603 - RNA, 18 nt, Homo sapiens
cuuaaaagaacauguaua

SEQ ID NO: 1721604 - RNA, 15 nt, Homo sapiens
cuuaaugucuuugag

SEQ ID NO: 1721605 - RNA, 14 nt, Homo sapiens
cuucagauuugccu

SEQ ID NO: 1721606 - RNA, 23 nt, Homo sapiens
cuuccaauuauuacaguccuuca

SEQ ID NO: 1721607 - RNA, 16 nt, Homo sapiens
cuucuaauuccaagau

SEQ ID NO: 1721608 - RNA, 21 nt, Homo sapiens
cuucuccucuuguagccagaa

SEQ ID NO: 1721609 - RNA, 21 nt, Homo sapiens
cuugauauguaaguacuucca

SEQ ID NO: 1721610 - RNA, 20 nt, Homo sapiens
cuugauuuucuuucuccucu

SEQ ID NO: 1721611 - RNA, 20 nt, Homo sapiens
cuugcauaauuauauacucc

SEQ ID NO: 1721612 - RNA, 22 nt, Homo sapiens
cuugcauaauuauauacuccuu

SEQ ID NO: 1721613 - RNA, 18 nt, Homo sapiens
cuuggccucccaaagugu

SEQ ID NO: 1721614 - RNA, 20 nt, Homo sapiens
cuugugccucggccucccua

SEQ ID NO: 1721615 - RNA, 17 nt, Homo sapiens
cuuuaugaaaacugaag

SEQ ID NO: 1721616 - RNA, 19 nt, Homo sapiens
cuuuccaaagccaauguga

SEQ ID NO: 1721617 - RNA, 16 nt, Homo sapiens
cuuuccccucccucag

SEQ ID NO: 1721618 - RNA, 23 nt, Homo sapiens
cuuugagguggaagagggcugca

SEQ ID NO: 1721619 - RNA, 23 nt, Homo sapiens
cuuuuaaagaaaaauaugauacu

SEQ ID NO: 1721620 - RNA, 21 nt, Homo sapiens
gaaaagaaaucuaugauucca

SEQ ID NO: 1721621 - RNA, 21 nt, Homo sapiens
gaaacugcccaggcaaagugc

SEQ ID NO: 1721622 - RNA, 14 nt, Homo sapiens
gaacugagcuugga

SEQ ID NO: 1721623 - RNA, 17 nt, Homo sapiens
gaagccagcuuuccuca

SEQ ID NO: 1721624 - RNA, 22 nt, Homo sapiens
gaagcccagaauaaacuggcag

SEQ ID NO: 1721625 - RNA, 14 nt, Homo sapiens
gaaggaauuauucc

SEQ ID NO: 1721626 - RNA, 19 nt, Homo sapiens
gaauucuggacaacccaag

SEQ ID NO: 1721627 - RNA, 21 nt, Homo sapiens
gacaaaugacccccaucccau

SEQ ID NO: 1721628 - RNA, 16 nt, Homo sapiens
gacagggucucacucu

SEQ ID NO: 1721629 - RNA, 14 nt, Homo sapiens
gaccugugugccag

SEQ ID NO: 1721630 - RNA, 14 nt, Homo sapiens
gaccuguugggagu

SEQ ID NO: 1721631 - RNA, 20 nt, Homo sapiens
gacuccaccaagccugguca

SEQ ID NO: 1721632 - RNA, 20 nt, Homo sapiens
gagaagccagcuuuccucau

SEQ ID NO: 1721633 - RNA, 21 nt, Homo sapiens
gagaagccagcuuuccucauc

SEQ ID NO: 1721634 - RNA, 19 nt, Homo sapiens
gagaggccacagugcaauu

SEQ ID NO: 1721635 - RNA, 17 nt, Homo sapiens
gaggcggcagugcaaca

SEQ ID NO: 1721636 - RNA, 21 nt, Homo sapiens
gaggcugcuuuccaaagccaa

SEQ ID NO: 1721637 - RNA, 22 nt, Homo sapiens
gagucuucuccaauguccaaaa

SEQ ID NO: 1721638 - RNA, 17 nt, Homo sapiens
gagugaauuugaccuag

SEQ ID NO: 1721639 - RNA, 23 nt, Homo sapiens
gaucauuaucagccugugccacg

SEQ ID NO: 1721640 - RNA, 15 nt, Homo sapiens
gauccuguuggacac

SEQ ID NO: 1721641 - RNA, 20 nt, Homo sapiens
gauguaccagcaucucccag

SEQ ID NO: 1721642 - RNA, 16 nt, Homo sapiens
gauguggaaaagccaa

SEQ ID NO: 1721643 - RNA, 13 nt, Homo sapiens
gauguguggacac

SEQ ID NO: 1721644 - RNA, 20 nt, Homo sapiens
gauguuaacaagaggggaaa

SEQ ID NO: 1721645 - RNA, 14 nt, Homo sapiens
gauuucaguucacu

SEQ ID NO: 1721646 - RNA, 20 nt, Homo sapiens
gcaaacucuccaccacacgu

SEQ ID NO: 1721647 - RNA, 22 nt, Homo sapiens
gcacguguggccuguucuucua

SEQ ID NO: 1721648 - RNA, 19 nt, Homo sapiens
gcagguguucuucauuacc

SEQ ID NO: 1721649 - RNA, 22 nt, Homo sapiens
gcagugcaugggcgcuggucua

SEQ ID NO: 1721650 - RNA, 11 nt, Homo sapiens
gcaucauucac

SEQ ID NO: 1721651 - RNA, 19 nt, Homo sapiens
gccacucaggggucauuca

SEQ ID NO: 1721652 - RNA, 19 nt, Homo sapiens
gccagacuggagugcagug

SEQ ID NO: 1721653 - RNA, 16 nt, Homo sapiens
gcccaaaccaccagaa

SEQ ID NO: 1721654 - RNA, 21 nt, Homo sapiens
gcccagaauaaacuggcagcu

SEQ ID NO: 1721655 - RNA, 18 nt, Homo sapiens
gcccagcaaucugcauuu

SEQ ID NO: 1721656 - RNA, 18 nt, Homo sapiens
gcccagcucaugcacauc

SEQ ID NO: 1721657 - RNA, 16 nt, Homo sapiens
gcccggaaccccagga

SEQ ID NO: 1721658 - RNA, 13 nt, Homo sapiens
gccuguccaggaa

SEQ ID NO: 1721659 - RNA, 22 nt, Homo sapiens
gccuuggagaacgagaccugug

SEQ ID NO: 1721660 - RNA, 16 nt, Homo sapiens
gccuuguguuauagaa

SEQ ID NO: 1721661 - RNA, 23 nt, Homo sapiens
gcgaauuuuaaaagaugcaaugu

SEQ ID NO: 1721662 - RNA, 21 nt, Homo sapiens
gcggcgccuccuucuaccacu

SEQ ID NO: 1721663 - RNA, 18 nt, Homo sapiens
gcuaugguucucucgcaa

SEQ ID NO: 1721664 - RNA, 18 nt, Homo sapiens
gcucagacaucuacuaca

SEQ ID NO: 1721665 - RNA, 20 nt, Homo sapiens
gcuccugcggaggaggugug

SEQ ID NO: 1721666 - RNA, 13 nt, Homo sapiens
gcucgagugaauu

SEQ ID NO: 1721667 - RNA, 13 nt, Homo sapiens
gcugggauuacag

SEQ ID NO: 1721668 - RNA, 17 nt, Homo sapiens
gcuguauccauccaugg

SEQ ID NO: 1721669 - RNA, 16 nt, Homo sapiens
gcugugugcucuccaa

SEQ ID NO: 1721670 - RNA, 14 nt, Homo sapiens
gcuuagcuugaggg

SEQ ID NO: 1721671 - RNA, 20 nt, Homo sapiens
gcuucauugcacugaucuua

SEQ ID NO: 1721672 - RNA, 20 nt, Homo sapiens
gcuugauuuucuuucuccuc

SEQ ID NO: 1721673 - RNA, 15 nt, Homo sapiens
ggcccugugccuugg

SEQ ID NO: 1721674 - RNA, 14 nt, Homo sapiens
ggccugacucucag

SEQ ID NO: 1721675 - RNA, 14 nt, Homo sapiens
gggcucaagcugca

SEQ ID NO: 1721676 - RNA, 16 nt, Homo sapiens
gggcucagaguggggu

SEQ ID NO: 1721677 - RNA, 19 nt, Homo sapiens
gggcugauuguauuuaccu

SEQ ID NO: 1721678 - RNA, 19 nt, Homo sapiens
gggcuucauacacaugaga

SEQ ID NO: 1721679 - RNA, 15 nt, Homo sapiens
ggggaugucucucau

SEQ ID NO: 1721680 - RNA, 10 nt, Homo sapiens
gggucugugu

SEQ ID NO: 1721681 - RNA, 14 nt, Homo sapiens
gguagguugggaga

SEQ ID NO: 1721682 - RNA, 16 nt, Homo sapiens
ggucuugguuccagcc

SEQ ID NO: 1721683 - RNA, 15 nt, Homo sapiens
ggugggagaugugga

SEQ ID NO: 1721684 - RNA, 13 nt, Homo sapiens
ggugugcaagaga

SEQ ID NO: 1721685 - RNA, 17 nt, Homo sapiens
gguugaccccuggucuc

SEQ ID NO: 1721686 - RNA, 13 nt, Homo sapiens
guaaaacagggau

SEQ ID NO: 1721687 - RNA, 15 nt, Homo sapiens
guaaagcacaguccc

SEQ ID NO: 1721688 - RNA, 20 nt, Homo sapiens
guaauuuaucuuaaccucaa

SEQ ID NO: 1721689 - RNA, 23 nt, Homo sapiens
guacaagcuggcggccugcagcg

SEQ ID NO: 1721690 - RNA, 18 nt, Homo sapiens
gucaaggcugacuacuca

SEQ ID NO: 1721691 - RNA, 13 nt, Homo sapiens
guccucacacuca

SEQ ID NO: 1721692 - RNA, 16 nt, Homo sapiens
guccuucacauuuacu

SEQ ID NO: 1721693 - RNA, 14 nt, Homo sapiens
gucuagccacugau

SEQ ID NO: 1721694 - RNA, 16 nt, Homo sapiens
gucugggccacucagg

SEQ ID NO: 1721695 - RNA, 21 nt, Homo sapiens
gucuuuccacuccuccuagcc

SEQ ID NO: 1721696 - RNA, 13 nt, Homo sapiens
gucuuucugucuc

SEQ ID NO: 1721697 - RNA, 17 nt, Homo sapiens
gugaggggcucucucau

SEQ ID NO: 1721698 - RNA, 19 nt, Homo sapiens
gugaugcuuuaugcaacua

SEQ ID NO: 1721699 - RNA, 19 nt, Homo sapiens
gugcaauggcgcgaucuca

SEQ ID NO: 1721700 - RNA, 16 nt, Homo sapiens
gugccaggauggaaug

SEQ ID NO: 1721701 - RNA, 22 nt, Homo sapiens
gugccaggugugugguggggac

SEQ ID NO: 1721702 - RNA, 13 nt, Homo sapiens
gugucacccuuag

SEQ ID NO: 1721703 - RNA, 22 nt, Homo sapiens
gugucagagcccagcucaugca

SEQ ID NO: 1721704 - RNA, 19 nt, Homo sapiens
gugucgggaugucaugucc

SEQ ID NO: 1721705 - RNA, 13 nt, Homo sapiens
gugucuggcugca

SEQ ID NO: 1721706 - RNA, 12 nt, Homo sapiens
guguuggugcug

SEQ ID NO: 1721707 - RNA, 14 nt, Homo sapiens
guuccuagccaccg

SEQ ID NO: 1721708 - RNA, 15 nt, Homo sapiens
guuccuuugaucucg

SEQ ID NO: 1721709 - RNA, 16 nt, Homo sapiens
guucuucauuaccuca

SEQ ID NO: 1721710 - RNA, 15 nt, Homo sapiens
guuuacaguguuccg

SEQ ID NO: 1721711 - RNA, 16 nt, Homo sapiens
uaaaaugggaagacug

SEQ ID NO: 1721712 - RNA, 22 nt, Homo sapiens
uaaaauuagaggacacuauuga

SEQ ID NO: 1721713 - RNA, 14 nt, Homo sapiens
uaaaauugugaugu

SEQ ID NO: 1721714 - RNA, 17 nt, Homo sapiens
uaaagaaaaauaugaua

SEQ ID NO: 1721715 - RNA, 16 nt, Homo sapiens
uaaauuuaugugaugg

SEQ ID NO: 1721716 - RNA, 14 nt, Homo sapiens
uaagaucucagugg

SEQ ID NO: 1721717 - RNA, 17 nt, Homo sapiens
uaagcucgagugaauuu

SEQ ID NO: 1721718 - RNA, 22 nt, Homo sapiens
uaaggcccagcaaucugcauuu

SEQ ID NO: 1721719 - RNA, 17 nt, Homo sapiens
uaauacuagauugaucu

SEQ ID NO: 1721720 - RNA, 22 nt, Homo sapiens
uaauacuagauugaucuaaggg

SEQ ID NO: 1721721 - RNA, 21 nt, Homo sapiens
uaaucugagaggccacagugc

SEQ ID NO: 1721722 - RNA, 15 nt, Homo sapiens
uaaucuuuaaacugg

SEQ ID NO: 1721723 - RNA, 15 nt, Homo sapiens
uaauuauauacuccu

SEQ ID NO: 1721724 - RNA, 14 nt, Homo sapiens
uacagaggacagua

SEQ ID NO: 1721725 - RNA, 17 nt, Homo sapiens
uacaggcgucugccacc

SEQ ID NO: 1721726 - RNA, 14 nt, Homo sapiens
uaccucuuggcugc

SEQ ID NO: 1721727 - RNA, 19 nt, Homo sapiens
uaccuggcccugugccuug

SEQ ID NO: 1721728 - RNA, 20 nt, Homo sapiens
uaccuggcccugugccuugg

SEQ ID NO: 1721729 - RNA, 22 nt, Homo sapiens
uacuauauguugaccauuccaa

SEQ ID NO: 1721730 - RNA, 17 nt, Homo sapiens
uacuccuuaauacuaga

SEQ ID NO: 1721731 - RNA, 20 nt, Homo sapiens
uaggauuacuaggugcccag

SEQ ID NO: 1721732 - RNA, 20 nt, Homo sapiens
uaguagcugggauuacaggc

SEQ ID NO: 1721733 - RNA, 19 nt, Homo sapiens
uaguuccccuacuacacuu

SEQ ID NO: 1721734 - RNA, 13 nt, Homo sapiens
uauagaaugaacu

SEQ ID NO: 1721735 - RNA, 19 nt, Homo sapiens
uauagagaauaaggcacaa

SEQ ID NO: 1721736 - RNA, 15 nt, Homo sapiens
uauauaaaucuucaa

SEQ ID NO: 1721737 - RNA, 12 nt, Homo sapiens
uauccugaucuc

SEQ ID NO: 1721738 - RNA, 15 nt, Homo sapiens
uaugaugggggaaaa

SEQ ID NO: 1721739 - RNA, 18 nt, Homo sapiens
uaugauuccagguggcau

SEQ ID NO: 1721740 - RNA, 23 nt, Homo sapiens
uauguggaagugugggucugugu

SEQ ID NO: 1721741 - RNA, 18 nt, Homo sapiens
uauuacaguccuucaaga

SEQ ID NO: 1721742 - RNA, 16 nt, Homo sapiens
uauuagcuuauauauu

SEQ ID NO: 1721743 - RNA, 13 nt, Homo sapiens
uauugcacuuuau

SEQ ID NO: 1721744 - RNA, 17 nt, Homo sapiens
uauuuaaccuaguucaa

SEQ ID NO: 1721745 - RNA, 18 nt, Homo sapiens
uauuuuguuuauugcacu

SEQ ID NO: 1721746 - RNA, 17 nt, Homo sapiens
ucaaaucuucuaauucc

SEQ ID NO: 1721747 - RNA, 15 nt, Homo sapiens
ucaagauuccauuuc

SEQ ID NO: 1721748 - RNA, 16 nt, Homo sapiens
ucaagauuccauuucu

SEQ ID NO: 1721749 - RNA, 17 nt, Homo sapiens
ucaauaauauuagcuua

SEQ ID NO: 1721750 - RNA, 15 nt, Homo sapiens
ucaaugugcuuuuaa

SEQ ID NO: 1721751 - RNA, 19 nt, Homo sapiens
ucaauuccuguccuucaca

SEQ ID NO: 1721752 - RNA, 20 nt, Homo sapiens
ucacagcaagucacuggcca

SEQ ID NO: 1721753 - RNA, 22 nt, Homo sapiens
ucaccaggaggcggcagugcaa

SEQ ID NO: 1721754 - RNA, 19 nt, Homo sapiens
ucacuaaaguauaucuuua

SEQ ID NO: 1721755 - RNA, 19 nt, Homo sapiens
ucacuaggaugcagaugga

SEQ ID NO: 1721756 - RNA, 16 nt, Homo sapiens
ucacugcaaccuccac

SEQ ID NO: 1721757 - RNA, 15 nt, Homo sapiens
ucagagcccagcuca

SEQ ID NO: 1721758 - RNA, 12 nt, Homo sapiens
ucagauuugccu

SEQ ID NO: 1721759 - RNA, 19 nt, Homo sapiens
ucagcacguguggccuguu

SEQ ID NO: 1721760 - RNA, 15 nt, Homo sapiens
ucagcucacugcaac

SEQ ID NO: 1721761 - RNA, 18 nt, Homo sapiens
ucaggccauugucccuga

SEQ ID NO: 1721762 - RNA, 19 nt, Homo sapiens
ucauauauccgaacuacug

SEQ ID NO: 1721763 - RNA, 16 nt, Homo sapiens
ucaucaguuccuuuga

SEQ ID NO: 1721764 - RNA, 11 nt, Homo sapiens
ucauuaccuca

SEQ ID NO: 1721765 - RNA, 16 nt, Homo sapiens
ucauugcacugaucuu

SEQ ID NO: 1721766 - RNA, 21 nt, Homo sapiens
uccaaaguucccacuccuuca

SEQ ID NO: 1721767 - RNA, 17 nt, Homo sapiens
uccaacauuaaaagcca

SEQ ID NO: 1721768 - RNA, 19 nt, Homo sapiens
uccaauuauuacaguccuu

SEQ ID NO: 1721769 - RNA, 22 nt, Homo sapiens
uccacaggcaggcucauuucac

SEQ ID NO: 1721770 - RNA, 21 nt, Homo sapiens
uccagcccugaguuccuagcc

SEQ ID NO: 1721771 - RNA, 17 nt, Homo sapiens
uccaggaagagcugugu

SEQ ID NO: 1721772 - RNA, 14 nt, Homo sapiens
uccauuucuuaaca

SEQ ID NO: 1721773 - RNA, 11 nt, Homo sapiens
ucccaaagugu

SEQ ID NO: 1721774 - RNA, 18 nt, Homo sapiens
ucccauuuacucuugaga

SEQ ID NO: 1721775 - RNA, 15 nt, Homo sapiens
ucccccuccaccugc

SEQ ID NO: 1721776 - RNA, 15 nt, Homo sapiens
ucccucuacugggag

SEQ ID NO: 1721777 - RNA, 14 nt, Homo sapiens
ucccugguggagcu

SEQ ID NO: 1721778 - RNA, 14 nt, Homo sapiens
auguaccagcaucu

SEQ ID NO: 1721779 - RNA, 16 nt, Homo sapiens
auguacguuacagcuu

SEQ ID NO: 1721780 - RNA, 14 nt, Homo sapiens
augugcaacacuca

SEQ ID NO: 1721781 - RNA, 15 nt, Homo sapiens
auguggaaaagccaa

SEQ ID NO: 1721782 - RNA, 16 nt, Homo sapiens
auguguguguguugug

SEQ ID NO: 1721783 - RNA, 23 nt, Homo sapiens
auuacaggcaugagccacugcgc

SEQ ID NO: 1721784 - RNA, 20 nt, Homo sapiens
auuccaaaguucuuaucucu

SEQ ID NO: 1721785 - RNA, 15 nt, Homo sapiens
auuccacacccucac

SEQ ID NO: 1721786 - RNA, 14 nt, Homo sapiens
auuccuguccuuca

SEQ ID NO: 1721787 - RNA, 21 nt, Homo sapiens
auucucuaggagaaacuuaga

SEQ ID NO: 1721788 - RNA, 14 nt, Homo sapiens
auucucugccuuua

SEQ ID NO: 1721789 - RNA, 17 nt, Homo sapiens
auucucugccuuuacua

SEQ ID NO: 1721790 - RNA, 13 nt, Homo sapiens
auucuuccugcuu

SEQ ID NO: 1721791 - RNA, 15 nt, Homo sapiens
auugcacugaucuua

SEQ ID NO: 1721792 - RNA, 21 nt, Homo sapiens
auuguauuuaccuucuaccuc

SEQ ID NO: 1721793 - RNA, 10 nt, Homo sapiens
auugugaugu

SEQ ID NO: 1721794 - RNA, 16 nt, Homo sapiens
auuuaaccuaguucaa

SEQ ID NO: 1721795 - RNA, 15 nt, Homo sapiens
auuucaguucacugu

SEQ ID NO: 1721796 - RNA, 18 nt, Homo sapiens
auuuguuugagacagggu

SEQ ID NO: 1721797 - RNA, 15 nt, Homo sapiens
caaaacgugcaugga

SEQ ID NO: 1721798 - RNA, 19 nt, Homo sapiens
caaaguguuaggauuacag

SEQ ID NO: 1721799 - RNA, 18 nt, Homo sapiens
caaccucauuuuaacuca

SEQ ID NO: 1721800 - RNA, 15 nt, Homo sapiens
caagagccugagagu

SEQ ID NO: 1721801 - RNA, 20 nt, Homo sapiens
caagcuuuggguuggagcug

SEQ ID NO: 1721802 - RNA, 22 nt, Homo sapiens
caauuaggcuucauugcacuga

SEQ ID NO: 1721803 - RNA, 21 nt, Homo sapiens
caauuaguuccccuacuacac

SEQ ID NO: 1721804 - RNA, 19 nt, Homo sapiens
caauuauuacaguccuuca

SEQ ID NO: 1721805 - RNA, 12 nt, Homo sapiens
cacaauccucca

SEQ ID NO: 1721806 - RNA, 15 nt, Homo sapiens
cacacuucccauuua

SEQ ID NO: 1721807 - RNA, 22 nt, Homo sapiens
cacaggccucucuucacacacu

SEQ ID NO: 1721808 - RNA, 16 nt, Homo sapiens
caccacacugauccag

SEQ ID NO: 1721809 - RNA, 18 nt, Homo sapiens
caccaggaggcggcagug

SEQ ID NO: 1721810 - RNA, 19 nt, Homo sapiens
caccaggaggcggcagugc

SEQ ID NO: 1721811 - RNA, 22 nt, Homo sapiens
caccaggaggcggcagugcaac

SEQ ID NO: 1721812 - RNA, 15 nt, Homo sapiens
cacccaggcugcagu

SEQ ID NO: 1721813 - RNA, 14 nt, Homo sapiens
cacccagugccagg

SEQ ID NO: 1721814 - RNA, 14 nt, Homo sapiens
caccccagaccuca

SEQ ID NO: 1721815 - RNA, 13 nt, Homo sapiens
caccuuggccucc

SEQ ID NO: 1721816 - RNA, 20 nt, Homo sapiens
cacuaagcuccuccuuuacu

SEQ ID NO: 1721817 - RNA, 20 nt, Homo sapiens
cacucucccaccuccuggug

SEQ ID NO: 1721818 - RNA, 20 nt, Homo sapiens
cacuggccccugagaucucu

SEQ ID NO: 1721819 - RNA, 18 nt, Homo sapiens
cagagcccagcucaugca

SEQ ID NO: 1721820 - RNA, 17 nt, Homo sapiens
cagaguuuacauucuaa

SEQ ID NO: 1721821 - RNA, 18 nt, Homo sapiens
cagcacugugaugcuuua

SEQ ID NO: 1721822 - RNA, 19 nt, Homo sapiens
cagcgccaacgagcagugc

SEQ ID NO: 1721823 - RNA, 23 nt, Homo sapiens
cagcuggaguucaugucgcaaca

SEQ ID NO: 1721824 - RNA, 20 nt, Homo sapiens
cagcuuuccucaucaggcca

SEQ ID NO: 1721825 - RNA, 19 nt, Homo sapiens
caggaaauggcuguggagu

SEQ ID NO: 1721826 - RNA, 19 nt, Homo sapiens
caggagguggucugggacu

SEQ ID NO: 1721827 - RNA, 23 nt, Homo sapiens
caggccagggggccagucccuga

SEQ ID NO: 1721828 - RNA, 20 nt, Homo sapiens
caggccauugucccugaaga

SEQ ID NO: 1721829 - RNA, 13 nt, Homo sapiens
caggcgucugcca

SEQ ID NO: 1721830 - RNA, 14 nt, Homo sapiens
caggcgucugccac

SEQ ID NO: 1721831 - RNA, 20 nt, Homo sapiens
caggcgucugccaccaugcc

SEQ ID NO: 1721832 - RNA, 17 nt, Homo sapiens
caggcugcagugcaaug

SEQ ID NO: 1721833 - RNA, 20 nt, Homo sapiens
caggcugcagugcaauggcg

SEQ ID NO: 1721834 - RNA, 19 nt, Homo sapiens
cagggcugaggccucucau

SEQ ID NO: 1721835 - RNA, 18 nt, Homo sapiens
cagggggccagucccuga

SEQ ID NO: 1721836 - RNA, 22 nt, Homo sapiens
cagguaugggacaggugccagg

SEQ ID NO: 1721837 - RNA, 16 nt, Homo sapiens
cagguccccagacucc

SEQ ID NO: 1721838 - RNA, 17 nt, Homo sapiens
cagugagaagccagcuu

SEQ ID NO: 1721839 - RNA, 19 nt, Homo sapiens
caguggcuggaucugugag

SEQ ID NO: 1721840 - RNA, 15 nt, Homo sapiens
cagugucuggcugca

SEQ ID NO: 1721841 - RNA, 13 nt, Homo sapiens
caguuuagcauua

SEQ ID NO: 1721842 - RNA, 15 nt, Homo sapiens
cauacacaugagaua

SEQ ID NO: 1721843 - RNA, 20 nt, Homo sapiens
cauacagggaugguguucaa

SEQ ID NO: 1721844 - RNA, 22 nt, Homo sapiens
cauaccuggcccugugccuugg

SEQ ID NO: 1721845 - RNA, 19 nt, Homo sapiens
cauagcagcagugcauggg

SEQ ID NO: 1721846 - RNA, 19 nt, Homo sapiens
caucuauucucugccuuua

SEQ ID NO: 1721847 - RNA, 16 nt, Homo sapiens
caucucuuuaccuccu

SEQ ID NO: 1721848 - RNA, 15 nt, Homo sapiens
caugaaaugcuucca

SEQ ID NO: 1721849 - RNA, 23 nt, Homo sapiens
caugaccaaaugcuuuuccucaa

SEQ ID NO: 1721850 - RNA, 17 nt, Homo sapiens
caugagauaauaugcag

SEQ ID NO: 1721851 - RNA, 21 nt, Homo sapiens
cauuccaaaguucuuaucucu

SEQ ID NO: 1721852 - RNA, 20 nt, Homo sapiens
cauugcacugaucuuacucu

SEQ ID NO: 1721853 - RNA, 14 nt, Homo sapiens
cauuuguuccauga

SEQ ID NO: 1721854 - RNA, 14 nt, Homo sapiens
ccaaaacgugcaug

SEQ ID NO: 1721855 - RNA, 15 nt, Homo sapiens
ccaaagcagcugcag

SEQ ID NO: 1721856 - RNA, 14 nt, Homo sapiens
ccaagcccaguuca

SEQ ID NO: 1721857 - RNA, 23 nt, Homo sapiens
ccaaguagcugggaguacaggcg

SEQ ID NO: 1721858 - RNA, 16 nt, Homo sapiens
ccacacccucacugcu

SEQ ID NO: 1721859 - RNA, 22 nt, Homo sapiens
ccacugcgcacagccccagcua

SEQ ID NO: 1721860 - RNA, 17 nt, Homo sapiens
ccacuuggcaucauuca

SEQ ID NO: 1721861 - RNA, 17 nt, Homo sapiens
ccagaauaaacuggcag

SEQ ID NO: 1721862 - RNA, 17 nt, Homo sapiens
ccagaguuuacauucua

SEQ ID NO: 1721863 - RNA, 16 nt, Homo sapiens
ccagcaaucugcauuu

SEQ ID NO: 1721864 - RNA, 16 nt, Homo sapiens
ccagcgguccaaaguu

SEQ ID NO: 1721865 - RNA, 24 nt, Homo sapiens
ccagcuggaguucaugucgcaaca

SEQ ID NO: 1721866 - RNA, 16 nt, Homo sapiens
ccaggaccccugagua

SEQ ID NO: 1721867 - RNA, 13 nt, Homo sapiens
ccaggcaaagugc

SEQ ID NO: 1721868 - RNA, 15 nt, Homo sapiens
ccaggcugcagugca

SEQ ID NO: 1721869 - RNA, 20 nt, Homo sapiens
ccaggcugcagugcaauggc

SEQ ID NO: 1721870 - RNA, 14 nt, Homo sapiens
ccaggggcugccuc

SEQ ID NO: 1721871 - RNA, 16 nt, Homo sapiens
ccagucccugaggcag

SEQ ID NO: 1721872 - RNA, 16 nt, Homo sapiens
ccaucucuuuaccucc

SEQ ID NO: 1721873 - RNA, 19 nt, Homo sapiens
cccacuuggcaucauucac

SEQ ID NO: 1721874 - RNA, 18 nt, Homo sapiens
cccagaaugccuccugca

SEQ ID NO: 1721875 - RNA, 20 nt, Homo sapiens
cccaggcugcagugcaaugg

SEQ ID NO: 1721876 - RNA, 20 nt, Homo sapiens
ccccagaaccccuggcucca

SEQ ID NO: 1721877 - RNA, 19 nt, Homo sapiens
cccccauagcagcagugca

SEQ ID NO: 1721878 - RNA, 15 nt, Homo sapiens
cccgcuggaccaaag

SEQ ID NO: 1721879 - RNA, 20 nt, Homo sapiens
cccggcugaguguacuagua

SEQ ID NO: 1721880 - RNA, 16 nt, Homo sapiens
cccgguguaugccaag

SEQ ID NO: 1721881 - RNA, 14 nt, Homo sapiens
cccuccaggaagau

SEQ ID NO: 1721882 - RNA, 14 nt, Homo sapiens
cccugagaucucug

SEQ ID NO: 1721883 - RNA, 19 nt, Homo sapiens
ccuaaccucgggugaucca

SEQ ID NO: 1721884 - RNA, 17 nt, Homo sapiens
ccuaauuccacacccuc

SEQ ID NO: 1721885 - RNA, 14 nt, Homo sapiens
ccuaucuguuuaca

SEQ ID NO: 1721886 - RNA, 20 nt, Homo sapiens
ccucaaaucuucuaauucca

SEQ ID NO: 1721887 - RNA, 22 nt, Homo sapiens
ccucacugcuguagacauuugc

SEQ ID NO: 1721888 - RNA, 14 nt, Homo sapiens
ccucauccauagca

SEQ ID NO: 1721889 - RNA, 17 nt, Homo sapiens
ccucauuggcucuugaa

SEQ ID NO: 1721890 - RNA, 11 nt, Homo sapiens
ccuccccaugg

SEQ ID NO: 1721891 - RNA, 21 nt, Homo sapiens
ccugaggugggagauguggaa

SEQ ID NO: 1721892 - RNA, 21 nt, Homo sapiens
ccuucacauuuacuagcugug

SEQ ID NO: 1721893 - RNA, 15 nt, Homo sapiens
ccuuccacaccccau

SEQ ID NO: 1721894 - RNA, 23 nt, Homo sapiens
agcccgggucaucuguaccucug

SEQ ID NO: 1721895 - RNA, 23 nt, Homo sapiens
agccuggcaccuuuaugucaaca

SEQ ID NO: 1721896 - RNA, 17 nt, Homo sapiens
agccuuggcucuacccu

SEQ ID NO: 1721897 - RNA, 18 nt, Homo sapiens
agccuuggcucuacccug

SEQ ID NO: 1721898 - RNA, 14 nt, Homo sapiens
agcugcugugaaca

SEQ ID NO: 1721899 - RNA, 22 nt, Homo sapiens
agcugcugugaacauuugugua

SEQ ID NO: 1721900 - RNA, 20 nt, Homo sapiens
aggaacucaauaaagugcuu

SEQ ID NO: 1721901 - RNA, 21 nt, Homo sapiens
aggagggauguuccaguggau

SEQ ID NO: 1721902 - RNA, 17 nt, Homo sapiens
aggaucagauucuugcu

SEQ ID NO: 1721903 - RNA, 12 nt, Homo sapiens
aggcaugaacac

SEQ ID NO: 1721904 - RNA, 14 nt, Homo sapiens
aggcaugaacacac

SEQ ID NO: 1721905 - RNA, 19 nt, Homo sapiens
aggcaugaacacacaugga

SEQ ID NO: 1721906 - RNA, 17 nt, Homo sapiens
aggccagcaccaucucu

SEQ ID NO: 1721907 - RNA, 20 nt, Homo sapiens
agggacaccaagccuuggcu

SEQ ID NO: 1721908 - RNA, 18 nt, Homo sapiens
agggauguuccaguggau

SEQ ID NO: 1721909 - RNA, 13 nt, Homo sapiens
agggccaugucag

SEQ ID NO: 1721910 - RNA, 15 nt, Homo sapiens
agguaugcaaauauc

SEQ ID NO: 1721911 - RNA, 16 nt, Homo sapiens
aguaacaaaaguauag

SEQ ID NO: 1721912 - RNA, 19 nt, Homo sapiens
aguacagagccaugacuca

SEQ ID NO: 1721913 - RNA, 23 nt, Homo sapiens
aguauaggauaaauuacauuaaa

SEQ ID NO: 1721914 - RNA, 22 nt, Homo sapiens
aguaucaguugcaggugccaau

SEQ ID NO: 1721915 - RNA, 15 nt, Homo sapiens
aguauguggaagugu

SEQ ID NO: 1721916 - RNA, 17 nt, Homo sapiens
agucccugccaucaugu

SEQ ID NO: 1721917 - RNA, 22 nt, Homo sapiens
agucugaaauggggcuacuguu

SEQ ID NO: 1721918 - RNA, 15 nt, Homo sapiens
agugagagaguggcu

SEQ ID NO: 1721919 - RNA, 23 nt, Homo sapiens
agugcacacggaugcacagagau

SEQ ID NO: 1721920 - RNA, 15 nt, Homo sapiens
aguggaagaagggaa

SEQ ID NO: 1721921 - RNA, 15 nt, Homo sapiens
aguuauaaucugaug

SEQ ID NO: 1721922 - RNA, 14 nt, Homo sapiens
auaaauuacauuaa

SEQ ID NO: 1721923 - RNA, 23 nt, Homo sapiens
auaagcagucauccucagaucau

SEQ ID NO: 1721924 - RNA, 17 nt, Homo sapiens
auaagugcuacuuugcc

SEQ ID NO: 1721925 - RNA, 17 nt, Homo sapiens
auacacucaagugccau

SEQ ID NO: 1721926 - RNA, 20 nt, Homo sapiens
auaccaagggccauucagua

SEQ ID NO: 1721927 - RNA, 15 nt, Homo sapiens
auagcaccuccacau

SEQ ID NO: 1721928 - RNA, 18 nt, Homo sapiens
auauagcuaggugacaua

SEQ ID NO: 1721929 - RNA, 23 nt, Homo sapiens
auauccuaggagguaaugaccau

SEQ ID NO: 1721930 - RNA, 14 nt, Homo sapiens
auaugcaaagucua

SEQ ID NO: 1721931 - RNA, 20 nt, Homo sapiens
auauucccuuguauggauau

SEQ ID NO: 1721932 - RNA, 17 nt, Homo sapiens
aucaacauuuguuccau

SEQ ID NO: 1721933 - RNA, 21 nt, Homo sapiens
aucaugcauagagugugaugu

SEQ ID NO: 1721934 - RNA, 15 nt, Homo sapiens
aucauuaucagccug

SEQ ID NO: 1721935 - RNA, 19 nt, Homo sapiens
aucauuggauccuacucaa

SEQ ID NO: 1721936 - RNA, 20 nt, Homo sapiens
aucauuggauccuacucaac

SEQ ID NO: 1721937 - RNA, 13 nt, Homo sapiens
aucuauccuuuaa

SEQ ID NO: 1721938 - RNA, 22 nt, Homo sapiens
aucucaagcaaguuuaaucaau

SEQ ID NO: 1721939 - RNA, 17 nt, Homo sapiens
aucuccagacucuacca

SEQ ID NO: 1721940 - RNA, 13 nt, Homo sapiens
aucuguaccucug

SEQ ID NO: 1721941 - RNA, 23 nt, Homo sapiens
augagcuggggaugucucucaug

SEQ ID NO: 1721942 - RNA, 23 nt, Homo sapiens
augagggccaccaggaagcacag

SEQ ID NO: 1721943 - RNA, 13 nt, Homo sapiens
augaucaucucac

SEQ ID NO: 1721944 - RNA, 15 nt, Homo sapiens
augcacacacacaga

SEQ ID NO: 1721945 - RNA, 23 nt, Homo sapiens
augcacacacacagagauaugca

SEQ ID NO: 1721946 - RNA, 15 nt, Homo sapiens
augcacacacacgga

SEQ ID NO: 1721947 - RNA, 18 nt, Homo sapiens
augcacacacagaugcac

SEQ ID NO: 1721948 - RNA, 19 nt, Homo sapiens
augcacacacagaugcaca

SEQ ID NO: 1721949 - RNA, 16 nt, Homo sapiens
augcacacacauggau

SEQ ID NO: 1721950 - RNA, 18 nt, Homo sapiens
augcccagcucagugcca

SEQ ID NO: 1721951 - RNA, 15 nt, Homo sapiens
auggaaucauauagu

SEQ ID NO: 1721952 - RNA, 12 nt, Homo sapiens
auggaugcacac

SEQ ID NO: 1721953 - RNA, 15 nt, Homo sapiens
auggaugcacgcaca

SEQ ID NO: 1721954 - RNA, 16 nt, Homo sapiens
auggcgcaggaacuca

SEQ ID NO: 1721955 - RNA, 16 nt, Homo sapiens
augggagucugaaaug

SEQ ID NO: 1721956 - RNA, 19 nt, Homo sapiens
augggagucugaaaugggg

SEQ ID NO: 1721957 - RNA, 20 nt, Homo sapiens
auguacacacacagaugcac

SEQ ID NO: 1721958 - RNA, 14 nt, Homo sapiens
auguaccagcaucu

SEQ ID NO: 1721959 - RNA, 15 nt, Homo sapiens
auguaccagcaucuc

SEQ ID NO: 1721960 - RNA, 13 nt, Homo sapiens
augucucucauga

SEQ ID NO: 1721961 - RNA, 16 nt, Homo sapiens
auguggagaacauuca

SEQ ID NO: 1721962 - RNA, 14 nt, Homo sapiens
auguuuugcucaau

SEQ ID NO: 1721963 - RNA, 16 nt, Homo sapiens
auuaaaauaucccaag

SEQ ID NO: 1721964 - RNA, 23 nt, Homo sapiens
auuaacugacgaagaagcaacua

SEQ ID NO: 1721965 - RNA, 17 nt, Homo sapiens
auuaauaaacaaucucc

SEQ ID NO: 1721966 - RNA, 15 nt, Homo sapiens
auuaauuaaaccaga

SEQ ID NO: 1721967 - RNA, 17 nt, Homo sapiens
auuaauuaaaccagacu

SEQ ID NO: 1721968 - RNA, 15 nt, Homo sapiens
auuacaaaagcaauu

SEQ ID NO: 1721969 - RNA, 13 nt, Homo sapiens
auuacugauauca

SEQ ID NO: 1721970 - RNA, 12 nt, Homo sapiens
auuauucccaug

SEQ ID NO: 1721971 - RNA, 18 nt, Homo sapiens
auuauuuugugguccuuu

SEQ ID NO: 1721972 - RNA, 15 nt, Homo sapiens
auuccacacccucac

SEQ ID NO: 1721973 - RNA, 22 nt, Homo sapiens
auucccugauuuaauaugcaaa

SEQ ID NO: 1721974 - RNA, 16 nt, Homo sapiens
auuccgaaacauacaa

SEQ ID NO: 1721975 - RNA, 14 nt, Homo sapiens
auucuuuucacugu

SEQ ID NO: 1721976 - RNA, 10 nt, Homo sapiens
auugugaugu

SEQ ID NO: 1721977 - RNA, 16 nt, Homo sapiens
auuuacuuaagacuua

SEQ ID NO: 1721978 - RNA, 15 nt, Homo sapiens
auuuauaauuacaau

SEQ ID NO: 1721979 - RNA, 15 nt, Homo sapiens
auuuaugguucucag

SEQ ID NO: 1721980 - RNA, 13 nt, Homo sapiens
auuuaugugaugg

SEQ ID NO: 1721981 - RNA, 14 nt, Homo sapiens
auuuccauuuacuu

SEQ ID NO: 1721982 - RNA, 21 nt, Homo sapiens
auuugaggagauaacauuuca

SEQ ID NO: 1721983 - RNA, 23 nt, Homo sapiens
auuuguucauuaaacgucauuca

SEQ ID NO: 1721984 - RNA, 18 nt, Homo sapiens
auuuuauuuuucucauga

SEQ ID NO: 1721985 - RNA, 18 nt, Homo sapiens
auuuucgacguuugacua

SEQ ID NO: 1721986 - RNA, 17 nt, Homo sapiens
auuuuuauaaagauaua

SEQ ID NO: 1721987 - RNA, 14 nt, Homo sapiens
auuuuuguacauua

SEQ ID NO: 1721988 - RNA, 15 nt, Homo sapiens
caaaagagauuuacu

SEQ ID NO: 1721989 - RNA, 17 nt, Homo sapiens
caaaaggaacuaugaaa

SEQ ID NO: 1721990 - RNA, 18 nt, Homo sapiens
caaagagagguccagagu

SEQ ID NO: 1721991 - RNA, 21 nt, Homo sapiens
caaagcuucacuucauuuuaa

SEQ ID NO: 1721992 - RNA, 18 nt, Homo sapiens
caacugucaguucauccu

SEQ ID NO: 1721993 - RNA, 18 nt, Homo sapiens
caagacaaaaaaaaugaa

SEQ ID NO: 1721994 - RNA, 18 nt, Homo sapiens
caaggaucagauucuugc

SEQ ID NO: 1721995 - RNA, 23 nt, Homo sapiens
caagguggaaauggcccauuuaa

SEQ ID NO: 1721996 - RNA, 15 nt, Homo sapiens
caaguggcaguuuua

SEQ ID NO: 1721997 - RNA, 17 nt, Homo sapiens
caauuuauaauuacaau

SEQ ID NO: 1721998 - RNA, 16 nt, Homo sapiens
caauuuuaaacauauc

SEQ ID NO: 1721999 - RNA, 13 nt, Homo sapiens
cacacacaccaau

SEQ ID NO: 1722000 - RNA, 13 nt, Homo sapiens
cacacacaccgau

SEQ ID NO: 1722001 - RNA, 15 nt, Homo sapiens
cacacacaccgaugu

SEQ ID NO: 1722002 - RNA, 12 nt, Homo sapiens
cacacacaugga

SEQ ID NO: 1722003 - RNA, 19 nt, Homo sapiens
cacacacgccaaugcacac

SEQ ID NO: 1722004 - RNA, 22 nt, Homo sapiens
cacacacggaugcacacacaga

SEQ ID NO: 1722005 - RNA, 21 nt, Homo sapiens
cacacagaugcacacacagau

SEQ ID NO: 1722006 - RNA, 18 nt, Homo sapiens
cacacagauggucacaca

SEQ ID NO: 1722007 - RNA, 17 nt, Homo sapiens
cacacauggaugagcac

SEQ ID NO: 1722008 - RNA, 17 nt, Homo sapiens
cacacauggaugcacac

SEQ ID NO: 1722009 - RNA, 15 nt, Homo sapiens
cacacggaugcacag

SEQ ID NO: 1722010 - RNA, 16 nt, Homo sapiens
cacacggaugcacaga

SEQ ID NO: 1722011 - RNA, 20 nt, Homo sapiens
cacacggaugcacagagaua

SEQ ID NO: 1722012 - RNA, 23 nt, Homo sapiens
cacacggaugcacagagauaugc

SEQ ID NO: 1722013 - RNA, 15 nt, Homo sapiens
cacagagauaugcac

SEQ ID NO: 1722014 - RNA, 24 nt, Homo sapiens
cacauagagauaugcacacacaga

SEQ ID NO: 1722015 - RNA, 21 nt, Homo sapiens
caccgauguacacacacagau

SEQ ID NO: 1722016 - RNA, 22 nt, Homo sapiens
cacgcacauagagauaugcaca

SEQ ID NO: 1722017 - RNA, 16 nt, Homo sapiens
cacggaugcacacaca

SEQ ID NO: 1722018 - RNA, 14 nt, Homo sapiens
cacggaugcacaga

SEQ ID NO: 1722019 - RNA, 12 nt, Homo sapiens
cacucaaucuag

SEQ ID NO: 1722020 - RNA, 20 nt, Homo sapiens
cacugagauccagagaggcu

SEQ ID NO: 1722021 - RNA, 21 nt, Homo sapiens
cacuucuggauauagcuaggu

SEQ ID NO: 1722022 - RNA, 16 nt, Homo sapiens
augucuuuuuacccuu

SEQ ID NO: 1722023 - RNA, 19 nt, Homo sapiens
augucuuuuuacccuuuaa

SEQ ID NO: 1722024 - RNA, 17 nt, Homo sapiens
augugcgcacacacaga

SEQ ID NO: 1722025 - RNA, 16 nt, Homo sapiens
auguguguguguugug

SEQ ID NO: 1722026 - RNA, 22 nt, Homo sapiens
auuaaaaaaagacauaauucac

SEQ ID NO: 1722027 - RNA, 16 nt, Homo sapiens
auuaaaacucauuuag

SEQ ID NO: 1722028 - RNA, 12 nt, Homo sapiens
auuaaaauaucc

SEQ ID NO: 1722029 - RNA, 20 nt, Homo sapiens
auuaagagagugaacauauc

SEQ ID NO: 1722030 - RNA, 18 nt, Homo sapiens
auuaagagguaagacuua

SEQ ID NO: 1722031 - RNA, 23 nt, Homo sapiens
auuaucaccuuccccucacacuc

SEQ ID NO: 1722032 - RNA, 18 nt, Homo sapiens
auuauggaaacagaugaa

SEQ ID NO: 1722033 - RNA, 13 nt, Homo sapiens
auuauucccauga

SEQ ID NO: 1722034 - RNA, 15 nt, Homo sapiens
auuccagcaagacca

SEQ ID NO: 1722035 - RNA, 13 nt, Homo sapiens
auucccccagugc

SEQ ID NO: 1722036 - RNA, 15 nt, Homo sapiens
auuccuugguucugu

SEQ ID NO: 1722037 - RNA, 18 nt, Homo sapiens
auucucugaaaguuucuu

SEQ ID NO: 1722038 - RNA, 15 nt, Homo sapiens
auucuuugaccuguu

SEQ ID NO: 1722039 - RNA, 16 nt, Homo sapiens
auugacccacaaaguu

SEQ ID NO: 1722040 - RNA, 20 nt, Homo sapiens
auugguuugagaacuucucu

SEQ ID NO: 1722041 - RNA, 12 nt, Homo sapiens
auugucccugaa

SEQ ID NO: 1722042 - RNA, 16 nt, Homo sapiens
auuguuuuaagccaau

SEQ ID NO: 1722043 - RNA, 14 nt, Homo sapiens
auuuauugauuuca

SEQ ID NO: 1722044 - RNA, 16 nt, Homo sapiens
auuucaagucuucuau

SEQ ID NO: 1722045 - RNA, 23 nt, Homo sapiens
auuucaauacacucaagugccau

SEQ ID NO: 1722046 - RNA, 20 nt, Homo sapiens
auuuguaaauuuaugugaug

SEQ ID NO: 1722047 - RNA, 19 nt, Homo sapiens
auuuuuguacauuauguua

SEQ ID NO: 1722048 - RNA, 14 nt, Homo sapiens
auuuuuuucccaag

SEQ ID NO: 1722049 - RNA, 22 nt, Homo sapiens
caaaaaaaaugaagacacucaa

SEQ ID NO: 1722050 - RNA, 21 nt, Homo sapiens
caaaaaguuguuuuauccauu

SEQ ID NO: 1722051 - RNA, 17 nt, Homo sapiens
caaaaggacaaccacag

SEQ ID NO: 1722052 - RNA, 19 nt, Homo sapiens
caaacacaccgaugcacac

SEQ ID NO: 1722053 - RNA, 21 nt, Homo sapiens
caaacucucccccaaauguau

SEQ ID NO: 1722054 - RNA, 15 nt, Homo sapiens
caaagcucaauagga

SEQ ID NO: 1722055 - RNA, 16 nt, Homo sapiens
caaaugcuuuuccuca

SEQ ID NO: 1722056 - RNA, 19 nt, Homo sapiens
caacagagcaagacuccau

SEQ ID NO: 1722057 - RNA, 21 nt, Homo sapiens
caacaguucuuguuagaauca

SEQ ID NO: 1722058 - RNA, 18 nt, Homo sapiens
caacauuuuuguacauua

SEQ ID NO: 1722059 - RNA, 18 nt, Homo sapiens
caaccucauuuuaacuca

SEQ ID NO: 1722060 - RNA, 16 nt, Homo sapiens
caaccuguuaccacuu

SEQ ID NO: 1722061 - RNA, 14 nt, Homo sapiens
caacugucaguuca

SEQ ID NO: 1722062 - RNA, 19 nt, Homo sapiens
caagaaguaacaaaaguau

SEQ ID NO: 1722063 - RNA, 12 nt, Homo sapiens
caagacuccauc

SEQ ID NO: 1722064 - RNA, 18 nt, Homo sapiens
caagggaauauugccaau

SEQ ID NO: 1722065 - RNA, 21 nt, Homo sapiens
caagggccauucaguacauca

SEQ ID NO: 1722066 - RNA, 14 nt, Homo sapiens
caagugccauucau

SEQ ID NO: 1722067 - RNA, 19 nt, Homo sapiens
caagugccauucauccuuu

SEQ ID NO: 1722068 - RNA, 15 nt, Homo sapiens
caauacacucaagug

SEQ ID NO: 1722069 - RNA, 23 nt, Homo sapiens
caauaggagggauguuccagugg

SEQ ID NO: 1722070 - RNA, 18 nt, Homo sapiens
caauaggugcugagugua

SEQ ID NO: 1722071 - RNA, 14 nt, Homo sapiens
caaugaucaucuca

SEQ ID NO: 1722072 - RNA, 14 nt, Homo sapiens
cacacacacagaga

SEQ ID NO: 1722073 - RNA, 23 nt, Homo sapiens
cacacacagaugcacacacagau

SEQ ID NO: 1722074 - RNA, 13 nt, Homo sapiens
cacacacauggau

SEQ ID NO: 1722075 - RNA, 17 nt, Homo sapiens
cacacaccgauguacac

SEQ ID NO: 1722076 - RNA, 17 nt, Homo sapiens
cacacaccgaugugcgc

SEQ ID NO: 1722077 - RNA, 22 nt, Homo sapiens
cacacaccgaugugcgcacaca

SEQ ID NO: 1722078 - RNA, 15 nt, Homo sapiens
cacacacggaugcac

SEQ ID NO: 1722079 - RNA, 23 nt, Homo sapiens
cacacacggaugcacacacagau

SEQ ID NO: 1722080 - RNA, 15 nt, Homo sapiens
cacacagagauaugc

SEQ ID NO: 1722081 - RNA, 21 nt, Homo sapiens
cacacagauauacacauggau

SEQ ID NO: 1722082 - RNA, 13 nt, Homo sapiens
cacacagauaugc

SEQ ID NO: 1722083 - RNA, 15 nt, Homo sapiens
cacacaucagugcac

SEQ ID NO: 1722084 - RNA, 11 nt, Homo sapiens
cacacauggau

SEQ ID NO: 1722085 - RNA, 15 nt, Homo sapiens
cacacauggaugcac

SEQ ID NO: 1722086 - RNA, 18 nt, Homo sapiens
cacaccaaugcgcacaca

SEQ ID NO: 1722087 - RNA, 15 nt, Homo sapiens
cacaccgaugcacac

SEQ ID NO: 1722088 - RNA, 23 nt, Homo sapiens
cacaccgauguacacacacagau

SEQ ID NO: 1722089 - RNA, 15 nt, Homo sapiens
cacacggaugcacac

SEQ ID NO: 1722090 - RNA, 16 nt, Homo sapiens
cacagagauaugcaca

SEQ ID NO: 1722091 - RNA, 17 nt, Homo sapiens
cacagagauaugcacac

SEQ ID NO: 1722092 - RNA, 13 nt, Homo sapiens
cacagauaugcac

SEQ ID NO: 1722093 - RNA, 15 nt, Homo sapiens
cacagauaugcacac

SEQ ID NO: 1722094 - RNA, 18 nt, Homo sapiens
cacagaugcacacacaga

SEQ ID NO: 1722095 - RNA, 22 nt, Homo sapiens
cacagguuuaguugacuaauga

SEQ ID NO: 1722096 - RNA, 23 nt, Homo sapiens
cacauaccuggcccugugccuug

SEQ ID NO: 1722097 - RNA, 16 nt, Homo sapiens
cacauagagauaugca

SEQ ID NO: 1722098 - RNA, 17 nt, Homo sapiens
cacauagagauaugcac

SEQ ID NO: 1722099 - RNA, 18 nt, Homo sapiens
caccaucucuuuaccucc

SEQ ID NO: 1722100 - RNA, 13 nt, Homo sapiens
caccgaugcacac

SEQ ID NO: 1722101 - RNA, 15 nt, Homo sapiens
cacggaugcacacac

SEQ ID NO: 1722102 - RNA, 17 nt, Homo sapiens
cacuacauuugcuccau

SEQ ID NO: 1722103 - RNA, 19 nt, Homo sapiens
cagagauacgcaaacacac

SEQ ID NO: 1722104 - RNA, 13 nt, Homo sapiens
cagaggacaguau

SEQ ID NO: 1722105 - RNA, 17 nt, Homo sapiens
cagauauacacauggau

SEQ ID NO: 1722106 - RNA, 19 nt, Homo sapiens
cagauauacacauggaugc

SEQ ID NO: 1722107 - RNA, 12 nt, Homo sapiens
cagauaugcaca

SEQ ID NO: 1722108 - RNA, 13 nt, Homo sapiens
cagauaugcacac

SEQ ID NO: 1722109 - RNA, 11 nt, Homo sapiens
cagaugcacac

SEQ ID NO: 1722110 - RNA, 13 nt, Homo sapiens
cagaugcacacac

SEQ ID NO: 1722111 - RNA, 16 nt, Homo sapiens
cagauggucacacaga

SEQ ID NO: 1722112 - RNA, 17 nt, Homo sapiens
cagauggucacacagag

SEQ ID NO: 1722113 - RNA, 15 nt, Homo sapiens
cagauuaauagauuu

SEQ ID NO: 1722114 - RNA, 23 nt, Homo sapiens
cagcacguguggccuguucuucu

SEQ ID NO: 1722115 - RNA, 19 nt, Homo sapiens
cagccugggcaacagagca

SEQ ID NO: 1722116 - RNA, 13 nt, Homo sapiens
cagcucagugcca

SEQ ID NO: 1722117 - RNA, 16 nt, Homo sapiens
caggauggcgcaggaa

SEQ ID NO: 1722118 - RNA, 14 nt, Homo sapiens
caggccagcuccac

SEQ ID NO: 1722119 - RNA, 19 nt, Homo sapiens
cagggcugaggccucucau

SEQ ID NO: 1722120 - RNA, 16 nt, Homo sapiens
caguacaggacauaua

SEQ ID NO: 1722121 - RNA, 18 nt, Homo sapiens
caguggcuggaucuguga

SEQ ID NO: 1722122 - RNA, 19 nt, Homo sapiens
caguggcuggaucugugag

SEQ ID NO: 1722123 - RNA, 13 nt, Homo sapiens
caguguugccaga

SEQ ID NO: 1722124 - RNA, 16 nt, Homo sapiens
cauaaaauaaacugaa

SEQ ID NO: 1722125 - RNA, 17 nt, Homo sapiens
cauaagccaaaacugag

SEQ ID NO: 1722126 - RNA, 11 nt, Homo sapiens
cauaaguccuc

SEQ ID NO: 1722127 - RNA, 13 nt, Homo sapiens
cauacaggugccu

SEQ ID NO: 1722128 - RNA, 22 nt, Homo sapiens
cauagagauaugcacacacaga

SEQ ID NO: 1722129 - RNA, 20 nt, Homo sapiens
cauaucucuuaucuuacgaa

SEQ ID NO: 1722130 - RNA, 23 nt, Homo sapiens
caucagugcacacggaugcacag

SEQ ID NO: 1722131 - RNA, 21 nt, Homo sapiens
cauccacuggguguaaacaca

SEQ ID NO: 1722132 - RNA, 21 nt, Homo sapiens
caucuccagacucuaccacuu

SEQ ID NO: 1722133 - RNA, 16 nt, Homo sapiens
caucucuuuaccuccu

SEQ ID NO: 1722134 - RNA, 14 nt, Homo sapiens
caucuguaccucug

SEQ ID NO: 1722135 - RNA, 17 nt, Homo sapiens
caugaacacacauggau

SEQ ID NO: 1722136 - RNA, 16 nt, Homo sapiens
caugagagcccagaaa

SEQ ID NO: 1722137 - RNA, 20 nt, Homo sapiens
caugccaaugcacgcacaca

SEQ ID NO: 1722138 - RNA, 13 nt, Homo sapiens
cauggaaggcaag

SEQ ID NO: 1722139 - RNA, 18 nt, Homo sapiens
cauggaugagcacacaca

SEQ ID NO: 1722140 - RNA, 13 nt, Homo sapiens
cauggaugcacac

SEQ ID NO: 1722141 - RNA, 22 nt, Homo sapiens
cauggaugcacgcacaugccaa

SEQ ID NO: 1722142 - RNA, 14 nt, Homo sapiens
caugucagacacag

SEQ ID NO: 1722143 - RNA, 17 nt, Homo sapiens
cauguugaaaacuccau

SEQ ID NO: 1722144 - RNA, 20 nt, Homo sapiens
cauuaucagccugugccacg

SEQ ID NO: 1722145 - RNA, 18 nt, Homo sapiens
cauucuuuccuaaauaua

SEQ ID NO: 1722146 - RNA, 14 nt, Homo sapiens
cauuuacuuguuga

SEQ ID NO: 1722147 - RNA, 14 nt, Homo sapiens
cauuuguuccauga

SEQ ID NO: 1722148 - RNA, 22 nt, Homo sapiens
ccaaaaagauuuauuaauuaaa

SEQ ID NO: 1722149 - RNA, 18 nt, Homo sapiens
ccaaaaucauaaugccau

SEQ ID NO: 1722150 - RNA, 19 nt, Homo sapiens
ccaaugacuaacuuuuuga

SEQ ID NO: 1722151 - RNA, 21 nt, Homo sapiens
gccaguggcuggaucugugag

SEQ ID NO: 1722152 - RNA, 12 nt, Homo sapiens
gccauucauccu

SEQ ID NO: 1722153 - RNA, 16 nt, Homo sapiens
gccauuggaaagcaaa

SEQ ID NO: 1722154 - RNA, 16 nt, Homo sapiens
gcccaccugcacguga

SEQ ID NO: 1722155 - RNA, 21 nt, Homo sapiens
gccccugauuuuaucauucug

SEQ ID NO: 1722156 - RNA, 11 nt, Homo sapiens
gcccugucauu

SEQ ID NO: 1722157 - RNA, 21 nt, Homo sapiens
gccuccuuuccccucccucag

SEQ ID NO: 1722158 - RNA, 16 nt, Homo sapiens
gccugggggauguacc

SEQ ID NO: 1722159 - RNA, 15 nt, Homo sapiens
gccuuauuggcagcu

SEQ ID NO: 1722160 - RNA, 20 nt, Homo sapiens
gcgcacacacagauaugcac

SEQ ID NO: 1722161 - RNA, 22 nt, Homo sapiens
gcuaaauguaccugagacauau

SEQ ID NO: 1722162 - RNA, 17 nt, Homo sapiens
gcuacuguuucaguccu

SEQ ID NO: 1722163 - RNA, 21 nt, Homo sapiens
gcuauaauuccgaaacauaca

SEQ ID NO: 1722164 - RNA, 21 nt, Homo sapiens
gcuauuuucuuauccuuugua

SEQ ID NO: 1722165 - RNA, 20 nt, Homo sapiens
gcuccauugguguugacaua

SEQ ID NO: 1722166 - RNA, 19 nt, Homo sapiens
gcugggaauaagugccagg

SEQ ID NO: 1722167 - RNA, 14 nt, Homo sapiens
gcuuagcuugaggg

SEQ ID NO: 1722168 - RNA, 19 nt, Homo sapiens
gcuucuauuuccuuuccac

SEQ ID NO: 1722169 - RNA, 16 nt, Homo sapiens
gcuucuuucacuuugc

SEQ ID NO: 1722170 - RNA, 23 nt, Homo sapiens
ggaaggcaagauugugucccauu

SEQ ID NO: 1722171 - RNA, 16 nt, Homo sapiens
ggacaaccucauuuua

SEQ ID NO: 1722172 - RNA, 20 nt, Homo sapiens
ggacaauggacuugcaaagc

SEQ ID NO: 1722173 - RNA, 12 nt, Homo sapiens
ggaugcacacac

SEQ ID NO: 1722174 - RNA, 13 nt, Homo sapiens
ggcacuauuuauu

SEQ ID NO: 1722175 - RNA, 18 nt, Homo sapiens
ggccacagugcaauuuua

SEQ ID NO: 1722176 - RNA, 17 nt, Homo sapiens
ggccuccugucccucau

SEQ ID NO: 1722177 - RNA, 21 nt, Homo sapiens
ggcuuguaccacuuuugcaaa

SEQ ID NO: 1722178 - RNA, 17 nt, Homo sapiens
gggcugaggccucucau

SEQ ID NO: 1722179 - RNA, 17 nt, Homo sapiens
gggcuucuccugaaauc

SEQ ID NO: 1722180 - RNA, 15 nt, Homo sapiens
ggggaugucucucau

SEQ ID NO: 1722181 - RNA, 14 nt, Homo sapiens
gguagguugggaga

SEQ ID NO: 1722182 - RNA, 15 nt, Homo sapiens
gguugaaacauaucu

SEQ ID NO: 1722183 - RNA, 19 nt, Homo sapiens
guaauuaaauacuauuaau

SEQ ID NO: 1722184 - RNA, 13 nt, Homo sapiens
guacagacacucc

SEQ ID NO: 1722185 - RNA, 16 nt, Homo sapiens
guagacauuugcuaug

SEQ ID NO: 1722186 - RNA, 18 nt, Homo sapiens
guagcauuuuaaacaaaa

SEQ ID NO: 1722187 - RNA, 14 nt, Homo sapiens
guaggaacugcugg

SEQ ID NO: 1722188 - RNA, 14 nt, Homo sapiens
guaggaucugucaa

SEQ ID NO: 1722189 - RNA, 14 nt, Homo sapiens
guauaaauaaccaa

SEQ ID NO: 1722190 - RNA, 18 nt, Homo sapiens
guauagaauaggcacuuu

SEQ ID NO: 1722191 - RNA, 23 nt, Homo sapiens
guauuuccaaauuacugauauca

SEQ ID NO: 1722192 - RNA, 21 nt, Homo sapiens
guauuuuuuacauuuuacaca

SEQ ID NO: 1722193 - RNA, 19 nt, Homo sapiens
gucaacauuuuugauucua

SEQ ID NO: 1722194 - RNA, 15 nt, Homo sapiens
gucaguauguggaag

SEQ ID NO: 1722195 - RNA, 17 nt, Homo sapiens
gucagucugcuuagaaa

SEQ ID NO: 1722196 - RNA, 16 nt, Homo sapiens
gucaucuguaccucug

SEQ ID NO: 1722197 - RNA, 19 nt, Homo sapiens
guccacuuuuaaaacuaua

SEQ ID NO: 1722198 - RNA, 21 nt, Homo sapiens
gucucuacuaaaaaugcaaaa

SEQ ID NO: 1722199 - RNA, 21 nt, Homo sapiens
gucugaaauggggcuacuguu

SEQ ID NO: 1722200 - RNA, 22 nt, Homo sapiens
gugaggaugucugggccacuca

SEQ ID NO: 1722201 - RNA, 17 nt, Homo sapiens
gugaggggcucucucau

SEQ ID NO: 1722202 - RNA, 19 nt, Homo sapiens
gugauuguugaaguacaaa

SEQ ID NO: 1722203 - RNA, 14 nt, Homo sapiens
guguucuucauuac

SEQ ID NO: 1722204 - RNA, 18 nt, Homo sapiens
guguugccagagccuuaa

SEQ ID NO: 1722205 - RNA, 11 nt, Homo sapiens
guucucaggcc

SEQ ID NO: 1722206 - RNA, 14 nt, Homo sapiens
guugauuucaauac

SEQ ID NO: 1722207 - RNA, 18 nt, Homo sapiens
guuucaaaagagauuuac

SEQ ID NO: 1722208 - RNA, 15 nt, Homo sapiens
guuucaauaacagcu

SEQ ID NO: 1722209 - RNA, 13 nt, Homo sapiens
guuucccucugua

SEQ ID NO: 1722210 - RNA, 12 nt, Homo sapiens
guuugaacauuu

SEQ ID NO: 1722211 - RNA, 21 nt, Homo sapiens
guuuucaauuuuaaacauauc

SEQ ID NO: 1722212 - RNA, 15 nt, Homo sapiens
uaaaaaaagacauaa

SEQ ID NO: 1722213 - RNA, 22 nt, Homo sapiens
uaaaaaaagacauaauucacac

SEQ ID NO: 1722214 - RNA, 22 nt, Homo sapiens
uaaaacucacugaaucuaacca

SEQ ID NO: 1722215 - RNA, 15 nt, Homo sapiens
uaaaauaagucugau

SEQ ID NO: 1722216 - RNA, 17 nt, Homo sapiens
uaaacaaucucccaagu

SEQ ID NO: 1722217 - RNA, 14 nt, Homo sapiens
uaacaaaaggacaa

SEQ ID NO: 1722218 - RNA, 23 nt, Homo sapiens
uaacaauaaagcauuuugcaaac

SEQ ID NO: 1722219 - RNA, 20 nt, Homo sapiens
uaacacugagauccagagag

SEQ ID NO: 1722220 - RNA, 21 nt, Homo sapiens
uaacauuuuuauaaagauaua

SEQ ID NO: 1722221 - RNA, 20 nt, Homo sapiens
uaaccaauuucuuucuaaaa

SEQ ID NO: 1722222 - RNA, 14 nt, Homo sapiens
uaagaauagugaaa

SEQ ID NO: 1722223 - RNA, 16 nt, Homo sapiens
uaagacuuaguacuau

SEQ ID NO: 1722224 - RNA, 17 nt, Homo sapiens
uaagagagugaacauau

SEQ ID NO: 1722225 - RNA, 23 nt, Homo sapiens
uaaguccucuagugaauguaggc

SEQ ID NO: 1722226 - RNA, 21 nt, Homo sapiens
uaagugcuacuuugccauuaa

SEQ ID NO: 1722227 - RNA, 20 nt, Homo sapiens
uaauccugguggucuugccu

SEQ ID NO: 1722228 - RNA, 21 nt, Homo sapiens
uaaucugagaggccacagugc

SEQ ID NO: 1722229 - RNA, 14 nt, Homo sapiens
uaaugaccaugaaa

SEQ ID NO: 1722230 - RNA, 16 nt, Homo sapiens
uaauuaguaagugagu

SEQ ID NO: 1722231 - RNA, 20 nt, Homo sapiens
uacaauauguauuuaugucu

SEQ ID NO: 1722232 - RNA, 19 nt, Homo sapiens
uaccuggcccugugccuug

SEQ ID NO: 1722233 - RNA, 20 nt, Homo sapiens
uaccuggcccugugccuugg

SEQ ID NO: 1722234 - RNA, 23 nt, Homo sapiens
uacgcaaacacaccgaugcacac

SEQ ID NO: 1722235 - RNA, 17 nt, Homo sapiens
uagaaaacuaaucuaaa

SEQ ID NO: 1722236 - RNA, 23 nt, Homo sapiens
uagaggcaugaacacacauggau

SEQ ID NO: 1722237 - RNA, 17 nt, Homo sapiens
uagaugaacucuucuca

SEQ ID NO: 1722238 - RNA, 13 nt, Homo sapiens
uagauugcucaaa

SEQ ID NO: 1722239 - RNA, 19 nt, Homo sapiens
uagcuggcugcagaacucc

SEQ ID NO: 1722240 - RNA, 14 nt, Homo sapiens
uaggaaaaccauga

SEQ ID NO: 1722241 - RNA, 21 nt, Homo sapiens
uaggaacugcugggcuuggca

SEQ ID NO: 1722242 - RNA, 13 nt, Homo sapiens
uaggcacuuuaaa

SEQ ID NO: 1722243 - RNA, 15 nt, Homo sapiens
uaguuauaaucugau

SEQ ID NO: 1722244 - RNA, 17 nt, Homo sapiens
uaguugacuaaugaggc

SEQ ID NO: 1722245 - RNA, 14 nt, Homo sapiens
uauaauuaacauaa

SEQ ID NO: 1722246 - RNA, 19 nt, Homo sapiens
uauaauuccgaaacauaca

SEQ ID NO: 1722247 - RNA, 12 nt, Homo sapiens
uauacacaugga

SEQ ID NO: 1722248 - RNA, 13 nt, Homo sapiens
uauacacauggau

SEQ ID NO: 1722249 - RNA, 15 nt, Homo sapiens
uauacacauggaugc

SEQ ID NO: 1722250 - RNA, 20 nt, Homo sapiens
uauagcuaggugacauauac

SEQ ID NO: 1722251 - RNA, 16 nt, Homo sapiens
uauaguuauaaucuga

SEQ ID NO: 1722252 - RNA, 16 nt, Homo sapiens
uaucauuuuguggaua

SEQ ID NO: 1722253 - RNA, 22 nt, Homo sapiens
uauccuuuucuauuaagauaua

SEQ ID NO: 1722254 - RNA, 12 nt, Homo sapiens
uaugaauucauu

SEQ ID NO: 1722255 - RNA, 13 nt, Homo sapiens
uaugagaaacugg

SEQ ID NO: 1722256 - RNA, 11 nt, Homo sapiens
uaugcacacac

SEQ ID NO: 1722257 - RNA, 19 nt, Homo sapiens
uaugcacacacauggauga

SEQ ID NO: 1722258 - RNA, 15 nt, Homo sapiens
uaugcuauauucaaa

SEQ ID NO: 1722259 - RNA, 19 nt, Homo sapiens
uaugcugguagcuagugau

SEQ ID NO: 1722260 - RNA, 23 nt, Homo sapiens
uauggauauaccacaauucauuu

SEQ ID NO: 1722261 - RNA, 15 nt, Homo sapiens
uaugggagcugucaa

SEQ ID NO: 1722262 - RNA, 19 nt, Homo sapiens
uaugugaauggaaucauau

SEQ ID NO: 1722263 - RNA, 18 nt, Homo sapiens
uauguuauuggaauuuuc

SEQ ID NO: 1722264 - RNA, 13 nt, Homo sapiens
uauucaaaauuca

SEQ ID NO: 1722265 - RNA, 23 nt, Homo sapiens
uauuuacaaauguuuugcucaau

SEQ ID NO: 1722266 - RNA, 22 nt, Homo sapiens
uauuuccaaauuacugauauca

SEQ ID NO: 1722267 - RNA, 22 nt, Homo sapiens
ucaagcauguauuuuugucaau

SEQ ID NO: 1722268 - RNA, 11 nt, Homo sapiens
ucaagugccau

SEQ ID NO: 1722269 - RNA, 17 nt, Homo sapiens
ucaauaaauuucugcuu

SEQ ID NO: 1722270 - RNA, 20 nt, Homo sapiens
ucaauacacucaagugccau

SEQ ID NO: 1722271 - RNA, 22 nt, Homo sapiens
ucaauacacucaagugccauuc

SEQ ID NO: 1722272 - RNA, 23 nt, Homo sapiens
ucaauauuugaucuaaguugcau

SEQ ID NO: 1722273 - RNA, 23 nt, Homo sapiens
ucaaucuugccgucacuauucau

SEQ ID NO: 1722274 - RNA, 16 nt, Homo sapiens
ucaaugaagauuaaca

SEQ ID NO: 1722275 - RNA, 12 nt, Homo sapiens
ucacacagagau

SEQ ID NO: 1722276 - RNA, 19 nt, Homo sapiens
ucacaggcuauucuacuuu

SEQ ID NO: 1722277 - RNA, 21 nt, Homo sapiens
ucacguuugaaucuaccauuc

SEQ ID NO: 1722278 - RNA, 16 nt, Homo sapiens
ucacuaaguaugaucu

SEQ ID NO: 1722279 - RNA, 17 nt, Homo sapiens
ucacuucagacaauuca

SEQ ID NO: 1722280 - RNA, 17 nt, Homo sapiens
aaaacugucauuuagcu

SEQ ID NO: 1722281 - RNA, 14 nt, Homo sapiens
aaacaaugcaguac

SEQ ID NO: 1722282 - RNA, 17 nt, Homo sapiens
aaacacaccgaugcaca

SEQ ID NO: 1722283 - RNA, 11 nt, Homo sapiens
aaacagaagau

SEQ ID NO: 1722284 - RNA, 18 nt, Homo sapiens
aaacuauuuaugaauauu

SEQ ID NO: 1722285 - RNA, 20 nt, Homo sapiens
aaacucacugaaucuaacca

SEQ ID NO: 1722286 - RNA, 20 nt, Homo sapiens
aaacucauuuaggacuguau

SEQ ID NO: 1722287 - RNA, 14 nt, Homo sapiens
aaacugaacauauu

SEQ ID NO: 1722288 - RNA, 16 nt, Homo sapiens
aaacugucauuuagcu

SEQ ID NO: 1722289 - RNA, 14 nt, Homo sapiens
aaagaaaaguuuau

SEQ ID NO: 1722290 - RNA, 12 nt, Homo sapiens
aaagaacauacc

SEQ ID NO: 1722291 - RNA, 20 nt, Homo sapiens
aaagcaguggcuccauuggu

SEQ ID NO: 1722292 - RNA, 17 nt, Homo sapiens
aaagcuuuauugagaua

SEQ ID NO: 1722293 - RNA, 20 nt, Homo sapiens
aaagucuaguuaccuacuuu

SEQ ID NO: 1722294 - RNA, 15 nt, Homo sapiens
augcuugcauuauau

SEQ ID NO: 1722295 - RNA, 19 nt, Homo sapiens
auggaauuagaaauauauc

SEQ ID NO: 1722296 - RNA, 20 nt, Homo sapiens
auggaauuagaaauauaucu

SEQ ID NO: 1722297 - RNA, 17 nt, Homo sapiens
auggacuucuggaugcc

SEQ ID NO: 1722298 - RNA, 17 nt, Homo sapiens
auggaggacuccaggca

SEQ ID NO: 1722299 - RNA, 19 nt, Homo sapiens
auggaugcacgcacaugcc

SEQ ID NO: 1722300 - RNA, 16 nt, Homo sapiens
auguacacacacagau

SEQ ID NO: 1722301 - RNA, 21 nt, Homo sapiens
auguacacacacagaugcaca

SEQ ID NO: 1722302 - RNA, 18 nt, Homo sapiens
augucuccaucuugaugc

SEQ ID NO: 1722303 - RNA, 20 nt, Homo sapiens
augugauuguugaaguacaa

SEQ ID NO: 1722304 - RNA, 23 nt, Homo sapiens
augugcgcacacacagauaugca

SEQ ID NO: 1722305 - RNA, 17 nt, Homo sapiens
auguggagaacauucaa

SEQ ID NO: 1722306 - RNA, 23 nt, Homo sapiens
auguguaucagauguuucacuga

SEQ ID NO: 1722307 - RNA, 16 nt, Homo sapiens
auuaaaaaaagacaua

SEQ ID NO: 1722308 - RNA, 13 nt, Homo sapiens
auucacagcaagu

SEQ ID NO: 1722309 - RNA, 18 nt, Homo sapiens
auucacagcaagucacug

SEQ ID NO: 1722310 - RNA, 20 nt, Homo sapiens
auucacagcaagucacuggc

SEQ ID NO: 1722311 - RNA, 23 nt, Homo sapiens
auuccacacccucacugcuguag

SEQ ID NO: 1722312 - RNA, 14 nt, Homo sapiens
auuccgaaacauac

SEQ ID NO: 1722313 - RNA, 18 nt, Homo sapiens
auugauuucaagucuucu

SEQ ID NO: 1722314 - RNA, 16 nt, Homo sapiens
auugcaggagucccug

SEQ ID NO: 1722315 - RNA, 17 nt, Homo sapiens
auugcaugaaagacaga

SEQ ID NO: 1722316 - RNA, 18 nt, Homo sapiens
auuggaauuuucuuucau

SEQ ID NO: 1722317 - RNA, 22 nt, Homo sapiens
auuggaauuuucuuucauacau

SEQ ID NO: 1722318 - RNA, 18 nt, Homo sapiens
auugguguugacauacau

SEQ ID NO: 1722319 - RNA, 13 nt, Homo sapiens
auuuacaaauguu

SEQ ID NO: 1722320 - RNA, 12 nt, Homo sapiens
auuuacacaggu

SEQ ID NO: 1722321 - RNA, 18 nt, Homo sapiens
auuuacuuguugaugaca

SEQ ID NO: 1722322 - RNA, 21 nt, Homo sapiens
auuuaugguucucaggccuga

SEQ ID NO: 1722323 - RNA, 13 nt, Homo sapiens
auuuauuuaugua

SEQ ID NO: 1722324 - RNA, 16 nt, Homo sapiens
auuuauuuauguagga

SEQ ID NO: 1722325 - RNA, 22 nt, Homo sapiens
auuucaaguggcaguuuuauca

SEQ ID NO: 1722326 - RNA, 20 nt, Homo sapiens
auuucuuucccuaaagaaca

SEQ ID NO: 1722327 - RNA, 13 nt, Homo sapiens
auuugcuaugagc

SEQ ID NO: 1722328 - RNA, 18 nt, Homo sapiens
auuuuaacaaaaggacaa

SEQ ID NO: 1722329 - RNA, 22 nt, Homo sapiens
auuuucgacguuugacuagcca

SEQ ID NO: 1722330 - RNA, 23 nt, Homo sapiens
auuuucgacguuugacuagccau

SEQ ID NO: 1722331 - RNA, 19 nt, Homo sapiens
auuuucuuucauacauuau

SEQ ID NO: 1722332 - RNA, 20 nt, Homo sapiens
auuuugcugcacacaaucua

SEQ ID NO: 1722333 - RNA, 20 nt, Homo sapiens
caaaaagauuuauuaauuaa

SEQ ID NO: 1722334 - RNA, 14 nt, Homo sapiens
caaagagaggucca

SEQ ID NO: 1722335 - RNA, 13 nt, Homo sapiens
caaaugacaguuu

SEQ ID NO: 1722336 - RNA, 17 nt, Homo sapiens
caaauguuuugcucaau

SEQ ID NO: 1722337 - RNA, 17 nt, Homo sapiens
caaauuuuaacaaaagg

SEQ ID NO: 1722338 - RNA, 18 nt, Homo sapiens
caacagugagagacucca

SEQ ID NO: 1722339 - RNA, 18 nt, Homo sapiens
caacauuuguuccaugag

SEQ ID NO: 1722340 - RNA, 17 nt, Homo sapiens
caacuuauaauuacaau

SEQ ID NO: 1722341 - RNA, 19 nt, Homo sapiens
caagaacuccugaaaucau

SEQ ID NO: 1722342 - RNA, 21 nt, Homo sapiens
caagauugugucccauucccc

SEQ ID NO: 1722343 - RNA, 11 nt, Homo sapiens
caagcauguau

SEQ ID NO: 1722344 - RNA, 12 nt, Homo sapiens
caagugccauuc

SEQ ID NO: 1722345 - RNA, 17 nt, Homo sapiens
caagugccauucauccu

SEQ ID NO: 1722346 - RNA, 14 nt, Homo sapiens
caauaaagugcuuu

SEQ ID NO: 1722347 - RNA, 14 nt, Homo sapiens
caauauuugaucua

SEQ ID NO: 1722348 - RNA, 15 nt, Homo sapiens
caauauuugaucuaa

SEQ ID NO: 1722349 - RNA, 15 nt, Homo sapiens
caaugaucaucucac

SEQ ID NO: 1722350 - RNA, 17 nt, Homo sapiens
caaugcacacacacaga

SEQ ID NO: 1722351 - RNA, 21 nt, Homo sapiens
caaugcaguacaggacauaua

SEQ ID NO: 1722352 - RNA, 14 nt, Homo sapiens
caaugcgcacacac

SEQ ID NO: 1722353 - RNA, 22 nt, Homo sapiens
caauuaagagagugaacauauc

SEQ ID NO: 1722354 - RNA, 13 nt, Homo sapiens
cacaaagcucaau

SEQ ID NO: 1722355 - RNA, 15 nt, Homo sapiens
cacacacacaccaau

SEQ ID NO: 1722356 - RNA, 14 nt, Homo sapiens
cacacacagagaua

SEQ ID NO: 1722357 - RNA, 13 nt, Homo sapiens
cacacacagaugg

SEQ ID NO: 1722358 - RNA, 17 nt, Homo sapiens
cacacagagauaugcac

SEQ ID NO: 1722359 - RNA, 15 nt, Homo sapiens
cacaccaaugcgcac

SEQ ID NO: 1722360 - RNA, 21 nt, Homo sapiens
cacacggaugcacacacagau

SEQ ID NO: 1722361 - RNA, 18 nt, Homo sapiens
cacagagauaugcacaca

SEQ ID NO: 1722362 - RNA, 19 nt, Homo sapiens
cacagauauacacauggau

SEQ ID NO: 1722363 - RNA, 23 nt, Homo sapiens
cacagauauacacauggaugcac

SEQ ID NO: 1722364 - RNA, 13 nt, Homo sapiens
cacagaugcacac

SEQ ID NO: 1722365 - RNA, 14 nt, Homo sapiens
cacagaugcacaca

SEQ ID NO: 1722366 - RNA, 18 nt, Homo sapiens
cacagauggucacacaga

SEQ ID NO: 1722367 - RNA, 20 nt, Homo sapiens
cacagauggucacacagaga

SEQ ID NO: 1722368 - RNA, 14 nt, Homo sapiens
cacaggcuauucua

SEQ ID NO: 1722369 - RNA, 21 nt, Homo sapiens
cacaguguugccagagccuua

SEQ ID NO: 1722370 - RNA, 16 nt, Homo sapiens
cacauggaugcacaca

SEQ ID NO: 1722371 - RNA, 21 nt, Homo sapiens
caccagcaugguaguggcaaa

SEQ ID NO: 1722372 - RNA, 19 nt, Homo sapiens
caccaucucuuuaccuccu

SEQ ID NO: 1722373 - RNA, 20 nt, Homo sapiens
caccgaugcacacgcacaua

SEQ ID NO: 1722374 - RNA, 15 nt, Homo sapiens
cacgccaaugcacac

SEQ ID NO: 1722375 - RNA, 15 nt, Homo sapiens
cacggaugcacagag

SEQ ID NO: 1722376 - RNA, 19 nt, Homo sapiens
cacuauucaucaaugaaga

SEQ ID NO: 1722377 - RNA, 11 nt, Homo sapiens
cacugcuguag

SEQ ID NO: 1722378 - RNA, 20 nt, Homo sapiens
cacuggguguaaacacaucu

SEQ ID NO: 1722379 - RNA, 20 nt, Homo sapiens
cacuguacacauaagccaaa

SEQ ID NO: 1722380 - RNA, 21 nt, Homo sapiens
cagaaaccuuccugcugagcc

SEQ ID NO: 1722381 - RNA, 22 nt, Homo sapiens
cagaagaaaauagaauugacau

SEQ ID NO: 1722382 - RNA, 15 nt, Homo sapiens
cagagauaugcacac

SEQ ID NO: 1722383 - RNA, 15 nt, Homo sapiens
cagagccaugacuca

SEQ ID NO: 1722384 - RNA, 16 nt, Homo sapiens
cagauauacacaugga

SEQ ID NO: 1722385 - RNA, 23 nt, Homo sapiens
cagcagcaacaacugucaguuca

SEQ ID NO: 1722386 - RNA, 17 nt, Homo sapiens
cagcaugguaguggcaa

SEQ ID NO: 1722387 - RNA, 20 nt, Homo sapiens
caggccauugucccugaaga

SEQ ID NO: 1722388 - RNA, 20 nt, Homo sapiens
cagggauucuuccugcuuag

SEQ ID NO: 1722389 - RNA, 20 nt, Homo sapiens
cagggccuuugucugucuca

SEQ ID NO: 1722390 - RNA, 21 nt, Homo sapiens
cagguguucuucauuaccuca

SEQ ID NO: 1722391 - RNA, 20 nt, Homo sapiens
caguagaggcaugaacacac

SEQ ID NO: 1722392 - RNA, 19 nt, Homo sapiens
cagugcacacggaugcaca

SEQ ID NO: 1722393 - RNA, 20 nt, Homo sapiens
cagugcacacggaugcacag

SEQ ID NO: 1722394 - RNA, 23 nt, Homo sapiens
cauaaauuuaugguucucaggcc

SEQ ID NO: 1722395 - RNA, 18 nt, Homo sapiens
cauacauuauauuccucu

SEQ ID NO: 1722396 - RNA, 17 nt, Homo sapiens
cauagagauaugcacac

SEQ ID NO: 1722397 - RNA, 22 nt, Homo sapiens
cauauccaaguuugaauuccua

SEQ ID NO: 1722398 - RNA, 19 nt, Homo sapiens
cauccaacauuaaaagcca

SEQ ID NO: 1722399 - RNA, 17 nt, Homo sapiens
cauccauagcaccucca

SEQ ID NO: 1722400 - RNA, 21 nt, Homo sapiens
cauccuggcuaacacggugaa

SEQ ID NO: 1722401 - RNA, 16 nt, Homo sapiens
caucucaagcaaguuu

SEQ ID NO: 1722402 - RNA, 18 nt, Homo sapiens
caucucacgcugaucauu

SEQ ID NO: 1722403 - RNA, 23 nt, Homo sapiens
caugaccaaaugcuuuuccucaa

SEQ ID NO: 1722404 - RNA, 22 nt, Homo sapiens
caugacucaauaaauacauguu

SEQ ID NO: 1722405 - RNA, 21 nt, Homo sapiens
caugccaaugcacgcacacau

SEQ ID NO: 1722406 - RNA, 16 nt, Homo sapiens
cauggaugcacacaca

SEQ ID NO: 1722407 - RNA, 18 nt, Homo sapiens
cauggccccuugcauuuc

SEQ ID NO: 1722408 - RNA, 12 nt, Homo sapiens
cauuacaaaaga

SEQ ID NO: 1722409 - RNA, 18 nt, Homo sapiens
cauuggauccuacucaac

SEQ ID NO: 1722410 - RNA, 16 nt, Homo sapiens
cauuuaaaccaguauc

SEQ ID NO: 1722411 - RNA, 20 nt, Homo sapiens
cauuuuguggauauaguuau

SEQ ID NO: 1722412 - RNA, 18 nt, Homo sapiens
ccaaauuacugauaucag

SEQ ID NO: 1722413 - RNA, 13 nt, Homo sapiens
ccaaugcacacac

SEQ ID NO: 1722414 - RNA, 17 nt, Homo sapiens
ccaaugcacacacacag

SEQ ID NO: 1722415 - RNA, 22 nt, Homo sapiens
ccacuagacguuguaaugcaca

SEQ ID NO: 1722416 - RNA, 18 nt, Homo sapiens
ccacucaggggucauuca

SEQ ID NO: 1722417 - RNA, 18 nt, Homo sapiens
ccagagaggcuggaugac

SEQ ID NO: 1722418 - RNA, 19 nt, Homo sapiens
ccagcaucucccaguucau

SEQ ID NO: 1722419 - RNA, 18 nt, Homo sapiens
ccaggaagcacaggucca

SEQ ID NO: 1722420 - RNA, 16 nt, Homo sapiens
ccaggauggcgcagga

SEQ ID NO: 1722421 - RNA, 13 nt, Homo sapiens
ccaucucuuuacc

SEQ ID NO: 1722422 - RNA, 23 nt, Homo sapiens
cccaaguauugauuuaacuucau

SEQ ID NO: 1722423 - RNA, 15 nt, Homo sapiens
uuuaauuuuaucauc

SEQ ID NO: 1722424 - RNA, 18 nt, Homo sapiens
uuuacacacuguacacau

SEQ ID NO: 1722425 - RNA, 16 nt, Homo sapiens
uuuacugauuccagca

SEQ ID NO: 1722426 - RNA, 17 nt, Homo sapiens
uuuauaaagauauacca

SEQ ID NO: 1722427 - RNA, 14 nt, Homo sapiens
uuuauaauuacaau

SEQ ID NO: 1722428 - RNA, 18 nt, Homo sapiens
uuuauccauuugauuuga

SEQ ID NO: 1722429 - RNA, 13 nt, Homo sapiens
uuuauuuacaaau

SEQ ID NO: 1722430 - RNA, 19 nt, Homo sapiens
uuuccuauuggacaaugga

SEQ ID NO: 1722431 - RNA, 13 nt, Homo sapiens
uuucuaauaauca

SEQ ID NO: 1722432 - RNA, 21 nt, Homo sapiens
uuucuucauuucucuugcuca

SEQ ID NO: 1722433 - RNA, 17 nt, Homo sapiens
uuugacuagccaucuca

SEQ ID NO: 1722434 - RNA, 17 nt, Homo sapiens
uuugagauucauauguc

SEQ ID NO: 1722435 - RNA, 21 nt, Homo sapiens
uuugcuccauccuccugggau

SEQ ID NO: 1722436 - RNA, 20 nt, Homo sapiens
uuuggggcucagaguggggu

SEQ ID NO: 1722437 - RNA, 14 nt, Homo sapiens
uuuuaaacauaucc

SEQ ID NO: 1722438 - RNA, 23 nt, Homo sapiens
uuuucacaccuuguggagaacau

SEQ ID NO: 1722439 - RNA, 14 nt, Homo sapiens
uuuuuaaccuccua

SEQ ID NO: 1722440 - RNA, 10 nt, Homo sapiens
gggucugugu

SEQ ID NO: 1722441 - RNA, 17 nt, Homo sapiens
ggguuggacaaccucau

SEQ ID NO: 1722442 - RNA, 21 nt, Homo sapiens
gguacagacacucccacuugg

SEQ ID NO: 1722443 - RNA, 16 nt, Homo sapiens
gguaguggcaaagaga

SEQ ID NO: 1722444 - RNA, 13 nt, Homo sapiens
ggucaauauuuga

SEQ ID NO: 1722445 - RNA, 16 nt, Homo sapiens
ggugauuccgcaguga

SEQ ID NO: 1722446 - RNA, 12 nt, Homo sapiens
ggugugcuguau

SEQ ID NO: 1722447 - RNA, 15 nt, Homo sapiens
guaaugaccaugaaa

SEQ ID NO: 1722448 - RNA, 15 nt, Homo sapiens
guaauuaaauacuau

SEQ ID NO: 1722449 - RNA, 14 nt, Homo sapiens
guaauuauacuuau

SEQ ID NO: 1722450 - RNA, 18 nt, Homo sapiens
guaauuuaaaauugugau

SEQ ID NO: 1722451 - RNA, 19 nt, Homo sapiens
guacaaaaggaacuaugaa

SEQ ID NO: 1722452 - RNA, 13 nt, Homo sapiens
guacacacacaga

SEQ ID NO: 1722453 - RNA, 12 nt, Homo sapiens
guacagacacuc

SEQ ID NO: 1722454 - RNA, 14 nt, Homo sapiens
guacagaguggaau

SEQ ID NO: 1722455 - RNA, 21 nt, Homo sapiens
guauagaaaaucuucauggaa

SEQ ID NO: 1722456 - RNA, 19 nt, Homo sapiens
guaucaguugcaggugcca

SEQ ID NO: 1722457 - RNA, 13 nt, Homo sapiens
gucaagcauguau

SEQ ID NO: 1722458 - RNA, 23 nt, Homo sapiens
gucaguucauccugcaugggaaa

SEQ ID NO: 1722459 - RNA, 23 nt, Homo sapiens
gucccagaaugccuccugcaggg

SEQ ID NO: 1722460 - RNA, 14 nt, Homo sapiens
guccucuagugaau

SEQ ID NO: 1722461 - RNA, 19 nt, Homo sapiens
gucuguguguuuaugugug

SEQ ID NO: 1722462 - RNA, 14 nt, Homo sapiens
gucuucuuuaccuc

SEQ ID NO: 1722463 - RNA, 14 nt, Homo sapiens
gugaggggcucucu

SEQ ID NO: 1722464 - RNA, 16 nt, Homo sapiens
gugccaggauggaaug

SEQ ID NO: 1722465 - RNA, 15 nt, Homo sapiens
gugcgcacacacaga

SEQ ID NO: 1722466 - RNA, 19 nt, Homo sapiens
gugugugggaguguguaau

SEQ ID NO: 1722467 - RNA, 13 nt, Homo sapiens
guguguguguaug

SEQ ID NO: 1722468 - RNA, 22 nt, Homo sapiens
guucagaacucguuaaagcaaa

SEQ ID NO: 1722469 - RNA, 18 nt, Homo sapiens
guuucgacguuugacuag

SEQ ID NO: 1722470 - RNA, 16 nt, Homo sapiens
guuugacuagccaucu

SEQ ID NO: 1722471 - RNA, 18 nt, Homo sapiens
guuuuaguuuugggauau

SEQ ID NO: 1722472 - RNA, 22 nt, Homo sapiens
uaaaagucuaguuaccuacuuu

SEQ ID NO: 1722473 - RNA, 20 nt, Homo sapiens
uaaacauauccaaguuugaa

SEQ ID NO: 1722474 - RNA, 14 nt, Homo sapiens
uaaacaugcuugca

SEQ ID NO: 1722475 - RNA, 14 nt, Homo sapiens
uaaacugaacauau

SEQ ID NO: 1722476 - RNA, 20 nt, Homo sapiens
uaaacugugguccaucucca

SEQ ID NO: 1722477 - RNA, 13 nt, Homo sapiens
uaaagaacauacc

SEQ ID NO: 1722478 - RNA, 22 nt, Homo sapiens
uaaagcaaagcgcuaaguaaaa

SEQ ID NO: 1722479 - RNA, 13 nt, Homo sapiens
uaaagcauuuugc

SEQ ID NO: 1722480 - RNA, 18 nt, Homo sapiens
uaaaugaaaaucuauccu

SEQ ID NO: 1722481 - RNA, 15 nt, Homo sapiens
uaaauuuaugugaug

SEQ ID NO: 1722482 - RNA, 22 nt, Homo sapiens
uaagaauagugaaaaauaacaa

SEQ ID NO: 1722483 - RNA, 21 nt, Homo sapiens
uaagagagugaacauauccau

SEQ ID NO: 1722484 - RNA, 20 nt, Homo sapiens
uaagcugagcuccuuagccu

SEQ ID NO: 1722485 - RNA, 19 nt, Homo sapiens
uaauauuacucuaugauga

SEQ ID NO: 1722486 - RNA, 21 nt, Homo sapiens
uaaucuaaacuguagcuguau

SEQ ID NO: 1722487 - RNA, 16 nt, Homo sapiens
uaaugaggcauuacaa

SEQ ID NO: 1722488 - RNA, 21 nt, Homo sapiens
uacaaaagcaauuuucauuua

SEQ ID NO: 1722489 - RNA, 20 nt, Homo sapiens
uacaaccuaaaaaauuccua

SEQ ID NO: 1722490 - RNA, 20 nt, Homo sapiens
uacacauggaugcacgcaca

SEQ ID NO: 1722491 - RNA, 16 nt, Homo sapiens
uacacucaagugccau

SEQ ID NO: 1722492 - RNA, 21 nt, Homo sapiens
uacagacacucccacuuggca

SEQ ID NO: 1722493 - RNA, 14 nt, Homo sapiens
uaccucuuggcugc

SEQ ID NO: 1722494 - RNA, 19 nt, Homo sapiens
uaccucuuggcugccuugu

SEQ ID NO: 1722495 - RNA, 14 nt, Homo sapiens
uaccuucuaccucu

SEQ ID NO: 1722496 - RNA, 21 nt, Homo sapiens
uaccuucuaccucuuggcugc

SEQ ID NO: 1722497 - RNA, 17 nt, Homo sapiens
uagaauugacauugaaa

SEQ ID NO: 1722498 - RNA, 14 nt, Homo sapiens
uagagauaugcaca

SEQ ID NO: 1722499 - RNA, 15 nt, Homo sapiens
uagcacaugauuuuc

SEQ ID NO: 1722500 - RNA, 15 nt, Homo sapiens
uagcuaggugacaua

SEQ ID NO: 1722501 - RNA, 18 nt, Homo sapiens
uagcuaggugacauauac

SEQ ID NO: 1722502 - RNA, 16 nt, Homo sapiens
uagcuagugauuuaca

SEQ ID NO: 1722503 - RNA, 21 nt, Homo sapiens
uaggaucugucaaagaaaacu

SEQ ID NO: 1722504 - RNA, 14 nt, Homo sapiens
uaguuauaaucuga

SEQ ID NO: 1722505 - RNA, 14 nt, Homo sapiens
uaguuuugggauau

SEQ ID NO: 1722506 - RNA, 16 nt, Homo sapiens
uauaaagauauaccaa

SEQ ID NO: 1722507 - RNA, 22 nt, Homo sapiens
uauaauuacaaugcacaauuua

SEQ ID NO: 1722508 - RNA, 19 nt, Homo sapiens
uauauuuauuuauguagga

SEQ ID NO: 1722509 - RNA, 19 nt, Homo sapiens
uaucagccugugccacgau

SEQ ID NO: 1722510 - RNA, 13 nt, Homo sapiens
uauccauccaugg

SEQ ID NO: 1722511 - RNA, 17 nt, Homo sapiens
uauccguaguuuugaua

SEQ ID NO: 1722512 - RNA, 23 nt, Homo sapiens
uauccuuuguacuguagcuaaau

SEQ ID NO: 1722513 - RNA, 23 nt, Homo sapiens
uaugagcuggggaugucucucau

SEQ ID NO: 1722514 - RNA, 23 nt, Homo sapiens
uaugcacacacacggaugcacac

SEQ ID NO: 1722515 - RNA, 17 nt, Homo sapiens
uaugcacacacauauau

SEQ ID NO: 1722516 - RNA, 17 nt, Homo sapiens
uaugcacacacauggau

SEQ ID NO: 1722517 - RNA, 18 nt, Homo sapiens
uauggguuggacaaccuc

SEQ ID NO: 1722518 - RNA, 20 nt, Homo sapiens
uauggguuggacaaccucau

SEQ ID NO: 1722519 - RNA, 14 nt, Homo sapiens
uaugguucucaggc

SEQ ID NO: 1722520 - RNA, 15 nt, Homo sapiens
uaugguucucaggcc

SEQ ID NO: 1722521 - RNA, 18 nt, Homo sapiens
uaugugaauggaaucaua

SEQ ID NO: 1722522 - RNA, 22 nt, Homo sapiens
uauguggaagugugggucugug

SEQ ID NO: 1722523 - RNA, 12 nt, Homo sapiens
uauucccaugag

SEQ ID NO: 1722524 - RNA, 17 nt, Homo sapiens
uauugauucaccuccua

SEQ ID NO: 1722525 - RNA, 13 nt, Homo sapiens
uauugauuucaag

SEQ ID NO: 1722526 - RNA, 13 nt, Homo sapiens
cugaaaugucagu

SEQ ID NO: 1722527 - RNA, 14 nt, Homo sapiens
cugagauccagaga

SEQ ID NO: 1722528 - RNA, 14 nt, Homo sapiens
cugaggacauggag

SEQ ID NO: 1722529 - RNA, 18 nt, Homo sapiens
cugauguuuaaaagucca

SEQ ID NO: 1722530 - RNA, 20 nt, Homo sapiens
cugauuuuaucauucugcuu

SEQ ID NO: 1722531 - RNA, 16 nt, Homo sapiens
cugcacacaaucuagc

SEQ ID NO: 1722532 - RNA, 19 nt, Homo sapiens
cugcuucccagcuucacaa

SEQ ID NO: 1722533 - RNA, 18 nt, Homo sapiens
cuggcugggaguggaaga

SEQ ID NO: 1722534 - RNA, 14 nt, Homo sapiens
cuguauuagcagca

SEQ ID NO: 1722535 - RNA, 19 nt, Homo sapiens
cugucccucauccauagca

SEQ ID NO: 1722536 - RNA, 18 nt, Homo sapiens
cuuaaaagaacauguaua

SEQ ID NO: 1722537 - RNA, 15 nt, Homo sapiens
cuuagaaauaacaga

SEQ ID NO: 1722538 - RNA, 14 nt, Homo sapiens
cuuauaauuacaau

SEQ ID NO: 1722539 - RNA, 19 nt, Homo sapiens
cuuaucaacauuuguucca

SEQ ID NO: 1722540 - RNA, 23 nt, Homo sapiens
cuuaucaacauuuguuccaugag

SEQ ID NO: 1722541 - RNA, 21 nt, Homo sapiens
cuuauguuucaauaacagcug

SEQ ID NO: 1722542 - RNA, 16 nt, Homo sapiens
cuucagauuugccuua

SEQ ID NO: 1722543 - RNA, 17 nt, Homo sapiens
cuucauuaccucaguga

SEQ ID NO: 1722544 - RNA, 12 nt, Homo sapiens
cuugcucaaguu

SEQ ID NO: 1722545 - RNA, 17 nt, Homo sapiens
cuugcucaaguucacca

SEQ ID NO: 1722546 - RNA, 15 nt, Homo sapiens
cuugcugugacccaa

SEQ ID NO: 1722547 - RNA, 13 nt, Homo sapiens
cuugguucuguca

SEQ ID NO: 1722548 - RNA, 16 nt, Homo sapiens
cuuuccucaucaggcc

SEQ ID NO: 1722549 - RNA, 17 nt, Homo sapiens
cuuuggucaauauuuga

SEQ ID NO: 1722550 - RNA, 18 nt, Homo sapiens
cuuuguaguagaauuuac

SEQ ID NO: 1722551 - RNA, 20 nt, Homo sapiens
gaaaaguuuauaaaagugaa

SEQ ID NO: 1722552 - RNA, 20 nt, Homo sapiens
gaaaauagaauugacauuga

SEQ ID NO: 1722553 - RNA, 17 nt, Homo sapiens
gaaaaucuauccuuuaa

SEQ ID NO: 1722554 - RNA, 19 nt, Homo sapiens
gaaauguggagaacauuca

SEQ ID NO: 1722555 - RNA, 22 nt, Homo sapiens
gaaauuagguugaaacauaucu

SEQ ID NO: 1722556 - RNA, 20 nt, Homo sapiens
gaacacacauggaugcacac

SEQ ID NO: 1722557 - RNA, 16 nt, Homo sapiens
gaacugaucauguuua

SEQ ID NO: 1722558 - RNA, 22 nt, Homo sapiens
gaacugaucauguuuaugagaa

SEQ ID NO: 1722559 - RNA, 22 nt, Homo sapiens
gaagaaaagaaaaaagucuuug

SEQ ID NO: 1722560 - RNA, 15 nt, Homo sapiens
gaagcaacuaaguua

SEQ ID NO: 1722561 - RNA, 17 nt, Homo sapiens
gaagccagcuuuccuca

SEQ ID NO: 1722562 - RNA, 19 nt, Homo sapiens
gaaggaggagucagggaga

SEQ ID NO: 1722563 - RNA, 23 nt, Homo sapiens
gaaguacaaaaggaacuaugaaa

SEQ ID NO: 1722564 - RNA, 17 nt, Homo sapiens
gaagugugggucugugu

SEQ ID NO: 1722565 - RNA, 15 nt, Homo sapiens
gacaaccucauuuua

SEQ ID NO: 1722566 - RNA, 12 nt, Homo sapiens
gacuauggagcu

SEQ ID NO: 1722567 - RNA, 14 nt, Homo sapiens
gacugcaacauaca

SEQ ID NO: 1722568 - RNA, 19 nt, Homo sapiens
gacugcaacauacaggugc

SEQ ID NO: 1722569 - RNA, 12 nt, Homo sapiens
gacuugcucaag

SEQ ID NO: 1722570 - RNA, 14 nt, Homo sapiens
gagaacaugcauac

SEQ ID NO: 1722571 - RNA, 14 nt, Homo sapiens
gagagagugcuauu

SEQ ID NO: 1722572 - RNA, 21 nt, Homo sapiens
gagagcccagaaaacugucau

SEQ ID NO: 1722573 - RNA, 16 nt, Homo sapiens
gagagcugcauguguc

SEQ ID NO: 1722574 - RNA, 13 nt, Homo sapiens
gagauaugcacac

SEQ ID NO: 1722575 - RNA, 15 nt, Homo sapiens
gagauaugcacacac

SEQ ID NO: 1722576 - RNA, 17 nt, Homo sapiens
gagccucacagcaguga

SEQ ID NO: 1722577 - RNA, 12 nt, Homo sapiens
gaggaagggaca

SEQ ID NO: 1722578 - RNA, 20 nt, Homo sapiens
gaggcaggagacuggcguga

SEQ ID NO: 1722579 - RNA, 18 nt, Homo sapiens
gaggcuggaugacuugcu

SEQ ID NO: 1722580 - RNA, 16 nt, Homo sapiens
gagguuaaaaagaaaa

SEQ ID NO: 1722581 - RNA, 19 nt, Homo sapiens
gauacgcaaacacaccgau

SEQ ID NO: 1722582 - RNA, 14 nt, Homo sapiens
gauagaaggcuaug

SEQ ID NO: 1722583 - RNA, 11 nt, Homo sapiens
gauaugcacac

SEQ ID NO: 1722584 - RNA, 19 nt, Homo sapiens
gauaugcacacacacggau

SEQ ID NO: 1722585 - RNA, 19 nt, Homo sapiens
gauaugcacacacauggau

SEQ ID NO: 1722586 - RNA, 16 nt, Homo sapiens
gauauggaagcaccca

SEQ ID NO: 1722587 - RNA, 23 nt, Homo sapiens
gaucauuaucagccugugccacg

SEQ ID NO: 1722588 - RNA, 12 nt, Homo sapiens
gauguacacaca

SEQ ID NO: 1722589 - RNA, 20 nt, Homo sapiens
gauguaccagcaucucccag

SEQ ID NO: 1722590 - RNA, 15 nt, Homo sapiens
gauguauguguaaua

SEQ ID NO: 1722591 - RNA, 16 nt, Homo sapiens
gaugugcgcacacaca

SEQ ID NO: 1722592 - RNA, 17 nt, Homo sapiens
gauugcgagaauuuuca

SEQ ID NO: 1722593 - RNA, 21 nt, Homo sapiens
gauuuauuaauuaaaccagac

SEQ ID NO: 1722594 - RNA, 22 nt, Homo sapiens
gauuugaauuguuuuaagccaa

SEQ ID NO: 1722595 - RNA, 18 nt, Homo sapiens
gauuuucgacguuugacu

SEQ ID NO: 1722596 - RNA, 20 nt, Homo sapiens
gauuuucgacguuugacuag

SEQ ID NO: 1722597 - RNA, 21 nt, Homo sapiens
gcaaagcuucacuucauuuua

SEQ ID NO: 1722598 - RNA, 17 nt, Homo sapiens
gcaacauacaggugccu

SEQ ID NO: 1722599 - RNA, 14 nt, Homo sapiens
gcaagaccaaauca

SEQ ID NO: 1722600 - RNA, 14 nt, Homo sapiens
gcacacacaccgau

SEQ ID NO: 1722601 - RNA, 22 nt, Homo sapiens
gcacacacagauauacacaugg

SEQ ID NO: 1722602 - RNA, 18 nt, Homo sapiens
gcacacacagauaugcac

SEQ ID NO: 1722603 - RNA, 20 nt, Homo sapiens
gcacacacagauaugcacac

SEQ ID NO: 1722604 - RNA, 12 nt, Homo sapiens
gcacacacaugg

SEQ ID NO: 1722605 - RNA, 19 nt, Homo sapiens
gcacacggaugcacagaga

SEQ ID NO: 1722606 - RNA, 16 nt, Homo sapiens
gcacauagagauaugc

SEQ ID NO: 1722607 - RNA, 20 nt, Homo sapiens
gcacauagagauaugcacac

SEQ ID NO: 1722608 - RNA, 22 nt, Homo sapiens
gcacauagagauaugcacacac

SEQ ID NO: 1722609 - RNA, 19 nt, Homo sapiens
agaagcaucaccaugcaug

SEQ ID NO: 1722610 - RNA, 18 nt, Homo sapiens
agaauuuucaaauaagga

SEQ ID NO: 1722611 - RNA, 15 nt, Homo sapiens
agacagagacagaga

SEQ ID NO: 1722612 - RNA, 16 nt, Homo sapiens
agacagagacagagag

SEQ ID NO: 1722613 - RNA, 19 nt, Homo sapiens
agacauuugcuaugagcug

SEQ ID NO: 1722614 - RNA, 15 nt, Homo sapiens
agacucuaccacuua

SEQ ID NO: 1722615 - RNA, 14 nt, Homo sapiens
agagagugcuauug

SEQ ID NO: 1722616 - RNA, 19 nt, Homo sapiens
agagauaugcacacacaga

SEQ ID NO: 1722617 - RNA, 18 nt, Homo sapiens
agaguauaaauaaccaau

SEQ ID NO: 1722618 - RNA, 17 nt, Homo sapiens
agaguaucaguugcagg

SEQ ID NO: 1722619 - RNA, 23 nt, Homo sapiens
agaguaucaguugcaggugccaa

SEQ ID NO: 1722620 - RNA, 16 nt, Homo sapiens
agauauacacauggau

SEQ ID NO: 1722621 - RNA, 12 nt, Homo sapiens
agauaugcacac

SEQ ID NO: 1722622 - RNA, 19 nt, Homo sapiens
agauaugcacacacaugga

SEQ ID NO: 1722623 - RNA, 15 nt, Homo sapiens
agauaugcacacacc

SEQ ID NO: 1722624 - RNA, 17 nt, Homo sapiens
agaugaacucuucucaa

SEQ ID NO: 1722625 - RNA, 17 nt, Homo sapiens
agauguacgacuugcau

SEQ ID NO: 1722626 - RNA, 20 nt, Homo sapiens
agauguuucacugacaguuu

SEQ ID NO: 1722627 - RNA, 17 nt, Homo sapiens
agauugugucccauucc

SEQ ID NO: 1722628 - RNA, 19 nt, Homo sapiens
agcaagucacuggccagug

SEQ ID NO: 1722629 - RNA, 21 nt, Homo sapiens
agcaccaucucuuuaccuccu

SEQ ID NO: 1722630 - RNA, 20 nt, Homo sapiens
agcauaggaaaccacacaga

SEQ ID NO: 1722631 - RNA, 22 nt, Homo sapiens
agcaucucccaguucauaauca

SEQ ID NO: 1722632 - RNA, 15 nt, Homo sapiens
agccaucucaagcaa

SEQ ID NO: 1722633 - RNA, 23 nt, Homo sapiens
agcuaauccacaaccuguuacca

SEQ ID NO: 1722634 - RNA, 19 nt, Homo sapiens
agcuauggcccaucuguau

SEQ ID NO: 1722635 - RNA, 16 nt, Homo sapiens
agcucagugccacaaa

SEQ ID NO: 1722636 - RNA, 19 nt, Homo sapiens
agcugcugugaacauuugu

SEQ ID NO: 1722637 - RNA, 19 nt, Homo sapiens
agcuggggaugucucucau

SEQ ID NO: 1722638 - RNA, 19 nt, Homo sapiens
agcuuuccucaucaggcca

SEQ ID NO: 1722639 - RNA, 14 nt, Homo sapiens
aggaaaaccaugac

SEQ ID NO: 1722640 - RNA, 11 nt, Homo sapiens
aggauggcgca

SEQ ID NO: 1722641 - RNA, 17 nt, Homo sapiens
aggccacagugcaauuu

SEQ ID NO: 1722642 - RNA, 14 nt, Homo sapiens
agggagacagagac

SEQ ID NO: 1722643 - RNA, 23 nt, Homo sapiens
agggauguuccaguggaugaggg

SEQ ID NO: 1722644 - RNA, 23 nt, Homo sapiens
agggcagggcugaggccucucau

SEQ ID NO: 1722645 - RNA, 14 nt, Homo sapiens
aggggcucucucau

SEQ ID NO: 1722646 - RNA, 15 nt, Homo sapiens
aggggcucucucaug

SEQ ID NO: 1722647 - RNA, 13 nt, Homo sapiens
aggggucauucau

SEQ ID NO: 1722648 - RNA, 20 nt, Homo sapiens
agguguucuucauuaccuca

SEQ ID NO: 1722649 - RNA, 21 nt, Homo sapiens
agguguucuucauuaccucag

SEQ ID NO: 1722650 - RNA, 15 nt, Homo sapiens
agguugaaacauauc

SEQ ID NO: 1722651 - RNA, 22 nt, Homo sapiens
agucuucuauuaaggacauuua

SEQ ID NO: 1722652 - RNA, 13 nt, Homo sapiens
agugagaagccag

SEQ ID NO: 1722653 - RNA, 19 nt, Homo sapiens
agugcguguaauuaaauac

SEQ ID NO: 1722654 - RNA, 16 nt, Homo sapiens
aguguacagaguggaa

SEQ ID NO: 1722655 - RNA, 16 nt, Homo sapiens
aguugagauucucuac

SEQ ID NO: 1722656 - RNA, 20 nt, Homo sapiens
aguugguguucauaauuuca

SEQ ID NO: 1722657 - RNA, 18 nt, Homo sapiens
aguuugggcuuguaccac

SEQ ID NO: 1722658 - RNA, 19 nt, Homo sapiens
auaaaagauuuuccuauuc

SEQ ID NO: 1722659 - RNA, 14 nt, Homo sapiens
auaaagauauacca

SEQ ID NO: 1722660 - RNA, 20 nt, Homo sapiens
auaagcagucauccucagau

SEQ ID NO: 1722661 - RNA, 13 nt, Homo sapiens
auaaguuuucaca

SEQ ID NO: 1722662 - RNA, 18 nt, Homo sapiens
auaaucacaacccuucag

SEQ ID NO: 1722663 - RNA, 21 nt, Homo sapiens
auacacauggaugcacgcaca

SEQ ID NO: 1722664 - RNA, 20 nt, Homo sapiens
auagcaccuccacauaccug

SEQ ID NO: 1722665 - RNA, 18 nt, Homo sapiens
auauaaacaugcuugcau

SEQ ID NO: 1722666 - RNA, 22 nt, Homo sapiens
auaugcacacacagaugcacac

SEQ ID NO: 1722667 - RNA, 17 nt, Homo sapiens
auaugcacacacaugga

SEQ ID NO: 1722668 - RNA, 19 nt, Homo sapiens
auaugcacacacauggaug

SEQ ID NO: 1722669 - RNA, 13 nt, Homo sapiens
auauuugaucuaa

SEQ ID NO: 1722670 - RNA, 22 nt, Homo sapiens
aucaagguggaaauggcccauu

SEQ ID NO: 1722671 - RNA, 22 nt, Homo sapiens
aucauaaacuauauucugugac

SEQ ID NO: 1722672 - RNA, 22 nt, Homo sapiens
auccauagcaccuccacauacc

SEQ ID NO: 1722673 - RNA, 19 nt, Homo sapiens
auccauggggcugauugua

SEQ ID NO: 1722674 - RNA, 13 nt, Homo sapiens
auccuacucaaca

SEQ ID NO: 1722675 - RNA, 22 nt, Homo sapiens
aucucugauucccugauuuaau

SEQ ID NO: 1722676 - RNA, 20 nt, Homo sapiens
aucugaacagagagauauaa

SEQ ID NO: 1722677 - RNA, 22 nt, Homo sapiens
aucugucaaagaaaacuuccaa

SEQ ID NO: 1722678 - RNA, 17 nt, Homo sapiens
aucuuuucucugcuuau

SEQ ID NO: 1722679 - RNA, 19 nt, Homo sapiens
augaacacacauggaugca

SEQ ID NO: 1722680 - RNA, 20 nt, Homo sapiens
augaacuagugucuaaauac

SEQ ID NO: 1722681 - RNA, 15 nt, Homo sapiens
augaacucuucucaa

SEQ ID NO: 1722682 - RNA, 23 nt, Homo sapiens
augacucaauaaauacauguuaa

SEQ ID NO: 1722683 - RNA, 22 nt, Homo sapiens
augagcuggggaugucucucau

SEQ ID NO: 1722684 - RNA, 18 nt, Homo sapiens
augauugauuauaucauu

SEQ ID NO: 1722685 - RNA, 22 nt, Homo sapiens
augcacacacacggaugcacac

SEQ ID NO: 1722686 - RNA, 13 nt, Homo sapiens
augcacacacaga

SEQ ID NO: 1722687 - RNA, 17 nt, Homo sapiens
augcacacacauggaug

SEQ ID NO: 1722688 - RNA, 17 nt, Homo sapiens
augcacagagauaugca

SEQ ID NO: 1722689 - RNA, 19 nt, Homo sapiens
augcacagagauaugcaca

SEQ ID NO: 1722690 - RNA, 21 nt, Homo sapiens
augcacgcacaugccaaugca

SEQ ID NO: 1722691 - RNA, 19 nt, Homo sapiens
augcccagcucagugccac

SEQ ID NO: 1722692 - RNA, 21 nt, Homo sapiens
auggaaacagaugaaaagccu

SEQ ID NO: 1722693 - RNA, 17 nt, Homo sapiens
auggaauucacaaagua

SEQ ID NO: 1722694 - RNA, 17 nt, Homo sapiens
auggagaacuugcucaa

SEQ ID NO: 1722695 - RNA, 14 nt, Homo sapiens
auggaggacuccag

SEQ ID NO: 1722696 - RNA, 14 nt, Homo sapiens
auggaugagcacac

SEQ ID NO: 1722697 - RNA, 17 nt, Homo sapiens
auggaugagcacacaca

SEQ ID NO: 1722698 - RNA, 13 nt, Homo sapiens
augguagcauuuu

SEQ ID NO: 1722699 - RNA, 13 nt, Homo sapiens
auguacacacaca

SEQ ID NO: 1722700 - RNA, 22 nt, Homo sapiens
auguacacacacagaugcacac

SEQ ID NO: 1722701 - RNA, 24 nt, Homo sapiens
augucaacauuuuugauucuagcu

SEQ ID NO: 1722702 - RNA, 23 nt, Homo sapiens
augucaguucugauauggaagca

SEQ ID NO: 1722703 - RNA, 21 nt, Homo sapiens
augugggggucuguguguuua

SEQ ID NO: 1722704 - RNA, 14 nt, Homo sapiens
auguuccaguggau

SEQ ID NO: 1722705 - RNA, 14 nt, Homo sapiens
auuaaaauauccca

SEQ ID NO: 1722706 - RNA, 15 nt, Homo sapiens
auuaaggacauuuag

SEQ ID NO: 1722707 - RNA, 21 nt, Homo sapiens
auuaauaaacaaucucccaag

SEQ ID NO: 1722708 - RNA, 23 nt, Homo sapiens
auuacugauaucagaguuauuua

SEQ ID NO: 1722709 - RNA, 14 nt, Homo sapiens
auuagcagcaaaac

SEQ ID NO: 1722710 - RNA, 23 nt, Homo sapiens
auuaugcgcuguggccacuccaa

SEQ ID NO: 1722711 - RNA, 16 nt, Homo sapiens
auucaacccauuuacu

SEQ ID NO: 1722712 - RNA, 13 nt, Homo sapiens
auucuuccugcuu

SEQ ID NO: 1722713 - RNA, 19 nt, Homo sapiens
auugacccacaaaguuuca

SEQ ID NO: 1722714 - RNA, 22 nt, Homo sapiens
auugagauauaauuaacauaaa

SEQ ID NO: 1722715 - RNA, 21 nt, Homo sapiens
auuguauuuaccuucuaccuc

SEQ ID NO: 1722716 - RNA, 18 nt, Homo sapiens
auuuaaaaauuguuuauu

SEQ ID NO: 1722717 - RNA, 15 nt, Homo sapiens
auuuaacccuucaca

SEQ ID NO: 1722718 - RNA, 17 nt, Homo sapiens
auuuaccuucuaccucu

SEQ ID NO: 1722719 - RNA, 18 nt, Homo sapiens
auuuaccuucuaccucuu

SEQ ID NO: 1722720 - RNA, 15 nt, Homo sapiens
auuuaucuacaugca

SEQ ID NO: 1722721 - RNA, 21 nt, Homo sapiens
auuuaucuacaugcauuucaa

SEQ ID NO: 1722722 - RNA, 22 nt, Homo sapiens
auuuccauuuacuuaagacuua

SEQ ID NO: 1722723 - RNA, 19 nt, Homo sapiens
auuucugcuugugccuuua

SEQ ID NO: 1722724 - RNA, 22 nt, Homo sapiens
auuugaggagauaacauuucaa

SEQ ID NO: 1722725 - RNA, 14 nt, Homo sapiens
auuuuaaacauauc

SEQ ID NO: 1722726 - RNA, 17 nt, Homo sapiens
auuuuaaacauauccaa

SEQ ID NO: 1722727 - RNA, 18 nt, Homo sapiens
auuuuaaacauauccaag

SEQ ID NO: 1722728 - RNA, 22 nt, Homo sapiens
auuuuuauaaagauauaccaag

SEQ ID NO: 1722729 - RNA, 15 nt, Homo sapiens
auuuuuguacauuau

SEQ ID NO: 1722730 - RNA, 20 nt, Homo sapiens
caaacucucccccaaaugua

SEQ ID NO: 1722731 - RNA, 20 nt, Homo sapiens
caaagaaaacuuccaaaaag

SEQ ID NO: 1722732 - RNA, 20 nt, Homo sapiens
caaauaauauuacucuauga

SEQ ID NO: 1722733 - RNA, 21 nt, Homo sapiens
caacagagcaagacuccaucu

SEQ ID NO: 1722734 - RNA, 20 nt, Homo sapiens
caacagugagagacuccaua

SEQ ID NO: 1722735 - RNA, 18 nt, Homo sapiens
ucccauucccccagugcg

SEQ ID NO: 1722736 - RNA, 18 nt, Homo sapiens
ucccugaagagaagggca

SEQ ID NO: 1722737 - RNA, 20 nt, Homo sapiens
uccggccuccugucccucau

SEQ ID NO: 1722738 - RNA, 15 nt, Homo sapiens
uccuaaaacaacaga

SEQ ID NO: 1722739 - RNA, 14 nt, Homo sapiens
uccucaaagggaga

SEQ ID NO: 1722740 - RNA, 23 nt, Homo sapiens
uccugaaaucauauagaaaggcu

SEQ ID NO: 1722741 - RNA, 16 nt, Homo sapiens
uccugucccucaucca

SEQ ID NO: 1722742 - RNA, 19 nt, Homo sapiens
uccugucccucauccauag

SEQ ID NO: 1722743 - RNA, 22 nt, Homo sapiens
uccuuagccuuugucccagaau

SEQ ID NO: 1722744 - RNA, 16 nt, Homo sapiens
uccuucuuaacucucu

SEQ ID NO: 1722745 - RNA, 22 nt, Homo sapiens
uccuucuuaacucucuguuaca

SEQ ID NO: 1722746 - RNA, 21 nt, Homo sapiens
uccuugucguaggaaaaccau

SEQ ID NO: 1722747 - RNA, 21 nt, Homo sapiens
uccuuuaagaaaaacaucugg

SEQ ID NO: 1722748 - RNA, 18 nt, Homo sapiens
uccuuuccccucccucag

SEQ ID NO: 1722749 - RNA, 14 nt, Homo sapiens
ucgacguuugacua

SEQ ID NO: 1722750 - RNA, 20 nt, Homo sapiens
ucuaccucuuggcugccuug

SEQ ID NO: 1722751 - RNA, 11 nt, Homo sapiens
ucuauccuuua

SEQ ID NO: 1722752 - RNA, 15 nt, Homo sapiens
ucuaugcuauauuca

SEQ ID NO: 1722753 - RNA, 13 nt, Homo sapiens
ucucauuccagag

SEQ ID NO: 1722754 - RNA, 13 nt, Homo sapiens
ucucucaugacca

SEQ ID NO: 1722755 - RNA, 16 nt, Homo sapiens
ucucucgcaagggaag

SEQ ID NO: 1722756 - RNA, 18 nt, Homo sapiens
ucuggcuucuuucacuuu

SEQ ID NO: 1722757 - RNA, 19 nt, Homo sapiens
ucuguaugugacaacauuu

SEQ ID NO: 1722758 - RNA, 16 nt, Homo sapiens
ucuuaacucucuguua

SEQ ID NO: 1722759 - RNA, 14 nt, Homo sapiens
ucuuauccuuugua

SEQ ID NO: 1722760 - RNA, 12 nt, Homo sapiens
ucuucauuaccu

SEQ ID NO: 1722761 - RNA, 12 nt, Homo sapiens
ucuuuaccuccu

SEQ ID NO: 1722762 - RNA, 16 nt, Homo sapiens
ucuuuugucccagaaa

SEQ ID NO: 1722763 - RNA, 19 nt, Homo sapiens
ugaaaacccucugaacuca

SEQ ID NO: 1722764 - RNA, 22 nt, Homo sapiens
ugaacauauuuaaaguguacua

SEQ ID NO: 1722765 - RNA, 13 nt, Homo sapiens
ugaagggggcuaa

SEQ ID NO: 1722766 - RNA, 21 nt, Homo sapiens
ugaauagaaacagauggaauu

SEQ ID NO: 1722767 - RNA, 22 nt, Homo sapiens
ugaauauuaaaaaaagacauaa

SEQ ID NO: 1722768 - RNA, 21 nt, Homo sapiens
ugacuaaugaggcauuacaaa

SEQ ID NO: 1722769 - RNA, 16 nt, Homo sapiens
ugacuagccaucucaa

SEQ ID NO: 1722770 - RNA, 20 nt, Homo sapiens
ugacuagccaucucaagcaa

SEQ ID NO: 1722771 - RNA, 11 nt, Homo sapiens
ugagcacacac

SEQ ID NO: 1722772 - RNA, 15 nt, Homo sapiens
ugagcagguguucuu

SEQ ID NO: 1722773 - RNA, 21 nt, Homo sapiens
ugagccucacagcagugagac

SEQ ID NO: 1722774 - RNA, 19 nt, Homo sapiens
ugagggugacuauggagcu

SEQ ID NO: 1722775 - RNA, 15 nt, Homo sapiens
ugauuuacacagguu

SEQ ID NO: 1722776 - RNA, 15 nt, Homo sapiens
ugcacacacagaugc

SEQ ID NO: 1722777 - RNA, 15 nt, Homo sapiens
ugcacacacauauau

SEQ ID NO: 1722778 - RNA, 15 nt, Homo sapiens
ugcacagagauaugc

SEQ ID NO: 1722779 - RNA, 18 nt, Homo sapiens
ugcacagagauaugcaca

SEQ ID NO: 1722780 - RNA, 19 nt, Homo sapiens
ugcacagagauaugcacac

SEQ ID NO: 1722781 - RNA, 13 nt, Homo sapiens
ugcacgcacacau

SEQ ID NO: 1722782 - RNA, 18 nt, Homo sapiens
ugcaguacaggacauaua

SEQ ID NO: 1722783 - RNA, 16 nt, Homo sapiens
ugccaaugcacgcaca

SEQ ID NO: 1722784 - RNA, 13 nt, Homo sapiens
ugccauucauccu

SEQ ID NO: 1722785 - RNA, 19 nt, Homo sapiens
ugcccagcucagugccaca

SEQ ID NO: 1722786 - RNA, 18 nt, Homo sapiens
ugccugugccuuuugcca

SEQ ID NO: 1722787 - RNA, 13 nt, Homo sapiens
ugcuagaagaaaa

SEQ ID NO: 1722788 - RNA, 18 nt, Homo sapiens
ugcuauggagcaaaucca

SEQ ID NO: 1722789 - RNA, 13 nt, Homo sapiens
ugcucaagugcag

SEQ ID NO: 1722790 - RNA, 18 nt, Homo sapiens
ugcucguaugaauucauu

SEQ ID NO: 1722791 - RNA, 23 nt, Homo sapiens
ugcuuagcuugagggugacuaug

SEQ ID NO: 1722792 - RNA, 21 nt, Homo sapiens
uggagaacauucaaucuugcc

SEQ ID NO: 1722793 - RNA, 23 nt, Homo sapiens
uggagaacuugcucaagugcagg

SEQ ID NO: 1722794 - RNA, 13 nt, Homo sapiens
uggaggacuccag

SEQ ID NO: 1722795 - RNA, 21 nt, Homo sapiens
uggagguuuguuuagaagaag

SEQ ID NO: 1722796 - RNA, 12 nt, Homo sapiens
uggaucugugag

SEQ ID NO: 1722797 - RNA, 15 nt, Homo sapiens
uggaugagcacacac

SEQ ID NO: 1722798 - RNA, 19 nt, Homo sapiens
uggaugagggccaccagga

SEQ ID NO: 1722799 - RNA, 13 nt, Homo sapiens
uggcaaagcagaa

SEQ ID NO: 1722800 - RNA, 22 nt, Homo sapiens
ugggaaaaauguuggaauggga

SEQ ID NO: 1722801 - RNA, 14 nt, Homo sapiens
ugggacaacacuuu

SEQ ID NO: 1722802 - RNA, 18 nt, Homo sapiens
ugggcaacagagcaagac

SEQ ID NO: 1722803 - RNA, 23 nt, Homo sapiens
ugggcaacagagcaagacuccau

SEQ ID NO: 1722804 - RNA, 22 nt, Homo sapiens
uggggaaauguggagaacauuc

SEQ ID NO: 1722805 - RNA, 13 nt, Homo sapiens
ugguaguggcaaa

SEQ ID NO: 1722806 - RNA, 14 nt, Homo sapiens
ugguaguggcaaag

SEQ ID NO: 1722807 - RNA, 13 nt, Homo sapiens
uggugugcuguau

SEQ ID NO: 1722808 - RNA, 16 nt, Homo sapiens
ugguguugacauacau

SEQ ID NO: 1722809 - RNA, 18 nt, Homo sapiens
uguaauuuaaaauuguga

SEQ ID NO: 1722810 - RNA, 17 nt, Homo sapiens
uguacacacacagaugc

SEQ ID NO: 1722811 - RNA, 15 nt, Homo sapiens
uguagcuaaauguac

SEQ ID NO: 1722812 - RNA, 14 nt, Homo sapiens
uguauccauccaug

SEQ ID NO: 1722813 - RNA, 20 nt, Homo sapiens
uguauuuaccuucuaccucu

SEQ ID NO: 1722814 - RNA, 21 nt, Homo sapiens
ugucaaagaaaacuuccaaaa

SEQ ID NO: 1722815 - RNA, 22 nt, Homo sapiens
ugucaaagaaaacuuccaaaaa

SEQ ID NO: 1722816 - RNA, 15 nt, Homo sapiens
ugucucucaugacca

SEQ ID NO: 1722817 - RNA, 22 nt, Homo sapiens
uguguaucagauguuucacuga

SEQ ID NO: 1722818 - RNA, 22 nt, Homo sapiens
uguguccgcccccgauggagga

SEQ ID NO: 1722819 - RNA, 23 nt, Homo sapiens
uguucuucauuaccucagugaga

SEQ ID NO: 1722820 - RNA, 19 nt, Homo sapiens
uguuuacagaggacaguau

SEQ ID NO: 1722821 - RNA, 12 nt, Homo sapiens
uuaaaagcauuu

SEQ ID NO: 1722822 - RNA, 17 nt, Homo sapiens
uuaaaauuugacuccuc

SEQ ID NO: 1722823 - RNA, 19 nt, Homo sapiens
uuaacacugagauccagag

SEQ ID NO: 1722824 - RNA, 16 nt, Homo sapiens
uuaacucucuguuaca

SEQ ID NO: 1722825 - RNA, 18 nt, Homo sapiens
uuaaucugagaggccaca

SEQ ID NO: 1722826 - RNA, 22 nt, Homo sapiens
uuacgaaaaaaugguagcauuu

SEQ ID NO: 1722827 - RNA, 14 nt, Homo sapiens
uuagaaauauaucu

SEQ ID NO: 1722828 - RNA, 20 nt, Homo sapiens
uuagagcugccugugccuuu

SEQ ID NO: 1722829 - RNA, 15 nt, Homo sapiens
uuagguugaaacaua

SEQ ID NO: 1722830 - RNA, 12 nt, Homo sapiens
uucaagucuucu

SEQ ID NO: 1722831 - RNA, 21 nt, Homo sapiens
uuccaguaugaaaagcuaucu

SEQ ID NO: 1722832 - RNA, 13 nt, Homo sapiens
uucccucuguaua

SEQ ID NO: 1722833 - RNA, 16 nt, Homo sapiens
uucccuuguauggaua

SEQ ID NO: 1722834 - RNA, 21 nt, Homo sapiens
uucccuuguauggauauacca

SEQ ID NO: 1722835 - RNA, 12 nt, Homo sapiens
uucucuugaaua

SEQ ID NO: 1722836 - RNA, 16 nt, Homo sapiens
uucuucauuaccucag

SEQ ID NO: 1722837 - RNA, 12 nt, Homo sapiens
uucuucuauggg

SEQ ID NO: 1722838 - RNA, 13 nt, Homo sapiens
uucuuuucacugu

SEQ ID NO: 1722839 - RNA, 12 nt, Homo sapiens
uugaaguacaaa

SEQ ID NO: 1722840 - RNA, 17 nt, Homo sapiens
uugacuaaugaggcauu

SEQ ID NO: 1722841 - RNA, 16 nt, Homo sapiens
uugacuagccaucuca

SEQ ID NO: 1722842 - RNA, 17 nt, Homo sapiens
uugacuagccaucucaa

SEQ ID NO: 1722843 - RNA, 21 nt, Homo sapiens
uugaugcucguaugaauucau

SEQ ID NO: 1722844 - RNA, 20 nt, Homo sapiens
uugcaugaaagacagaacau

SEQ ID NO: 1722845 - RNA, 13 nt, Homo sapiens
uugccagagccuu

SEQ ID NO: 1722846 - RNA, 15 nt, Homo sapiens
uugccagagccuuaa

SEQ ID NO: 1722847 - RNA, 14 nt, Homo sapiens
uugcucaagugcag

SEQ ID NO: 1722848 - RNA, 12 nt, Homo sapiens
uuguauccuuuu

SEQ ID NO: 1722849 - RNA, 20 nt, Homo sapiens
uuguauuuaccuucuaccuc

SEQ ID NO: 1722850 - RNA, 17 nt, Homo sapiens
uuuaauuuacugauucc

SEQ ID NO: 1722851 - RNA, 14 nt, Homo sapiens
uuuauaaagauaua

SEQ ID NO: 1722852 - RNA, 22 nt, Homo sapiens
uuuauuuauguaggaucuguca

SEQ ID NO: 1722853 - RNA, 21 nt, Homo sapiens
uuucaacuuuguuccuaaaua

SEQ ID NO: 1722854 - RNA, 20 nt, Homo sapiens
uuucacaccuuguggagaac

SEQ ID NO: 1722855 - RNA, 20 nt, Homo sapiens
uuuccaaauuacugauauca

SEQ ID NO: 1722856 - RNA, 20 nt, Homo sapiens
uuuccugagagcagcacagg

SEQ ID NO: 1722857 - RNA, 21 nt, Homo sapiens
uuucuaauaaucauaaacuau

SEQ ID NO: 1722858 - RNA, 16 nt, Homo sapiens
uuucuauuaagauaua

SEQ ID NO: 1722859 - RNA, 15 nt, Homo sapiens
uuucucuuacuauau

SEQ ID NO: 1722860 - RNA, 20 nt, Homo sapiens
uuugaauucuauguuggcau

SEQ ID NO: 1722861 - RNA, 18 nt, Homo sapiens
uuugacuagccaucucaa

SEQ ID NO: 1722862 - RNA, 21 nt, Homo sapiens
uuugacuagccaucucaagca

SEQ ID NO: 1722863 - RNA, 16 nt, Homo sapiens
ucaggaugagauauca

SEQ ID NO: 1722864 - RNA, 18 nt, Homo sapiens
ucagucuuuaaucugaga

SEQ ID NO: 1722865 - RNA, 15 nt, Homo sapiens
ucauaaucacaaccc

SEQ ID NO: 1722866 - RNA, 18 nt, Homo sapiens
ucaucaacagugagagac

SEQ ID NO: 1722867 - RNA, 21 nt, Homo sapiens
ucaugucuuuuuacccuuuaa

SEQ ID NO: 1722868 - RNA, 13 nt, Homo sapiens
ucauucaguacuu

SEQ ID NO: 1722869 - RNA, 19 nt, Homo sapiens
ucauuuuguggauauaguu

SEQ ID NO: 1722870 - RNA, 16 nt, Homo sapiens
uccaaauuuucaauaa

SEQ ID NO: 1722871 - RNA, 17 nt, Homo sapiens
uccaacauuaaaagcca

SEQ ID NO: 1722872 - RNA, 22 nt, Homo sapiens
uccacaguaacacgcugaaggg

SEQ ID NO: 1722873 - RNA, 17 nt, Homo sapiens
uccacaguguugccaga

SEQ ID NO: 1722874 - RNA, 17 nt, Homo sapiens
uccauugguguugacau

SEQ ID NO: 1722875 - RNA, 19 nt, Homo sapiens
uccccacccaaacuuuauu

SEQ ID NO: 1722876 - RNA, 13 nt, Homo sapiens
uccccucaaccca

SEQ ID NO: 1722877 - RNA, 13 nt, Homo sapiens
uccccucccucag

SEQ ID NO: 1722878 - RNA, 11 nt, Homo sapiens
ucccucaggcc

SEQ ID NO: 1722879 - RNA, 19 nt, Homo sapiens
ucccucaggccgaaggagg

SEQ ID NO: 1722880 - RNA, 14 nt, Homo sapiens
ucccucauccauag

SEQ ID NO: 1722881 - RNA, 13 nt, Homo sapiens
uccgaaacauaca

SEQ ID NO: 1722882 - RNA, 16 nt, Homo sapiens
uccuaaugugcugugu

SEQ ID NO: 1722883 - RNA, 23 nt, Homo sapiens
uccuaaugugcugugugacauug

SEQ ID NO: 1722884 - RNA, 17 nt, Homo sapiens
uccucagaucauuauca

SEQ ID NO: 1722885 - RNA, 13 nt, Homo sapiens
uccuccccagaaa

SEQ ID NO: 1722886 - RNA, 18 nt, Homo sapiens
uccugagagcugcaugug

SEQ ID NO: 1722887 - RNA, 22 nt, Homo sapiens
uccuuggugauuccgcagugag

SEQ ID NO: 1722888 - RNA, 21 nt, Homo sapiens
uccuuuccccucccucaggcc

SEQ ID NO: 1722889 - RNA, 18 nt, Homo sapiens
uccuuuucuauuaagaua

SEQ ID NO: 1722890 - RNA, 23 nt, Homo sapiens
ucuaaccauagcugaccuuugua

SEQ ID NO: 1722891 - RNA, 18 nt, Homo sapiens
ucuagcuaccuguauuau

SEQ ID NO: 1722892 - RNA, 19 nt, Homo sapiens
ucuauggguuggacaaccu

SEQ ID NO: 1722893 - RNA, 13 nt, Homo sapiens
ucucaucucugua

SEQ ID NO: 1722894 - RNA, 17 nt, Homo sapiens
ucucaugaccaaaugcu

SEQ ID NO: 1722895 - RNA, 17 nt, Homo sapiens
ucucaugauagaaggcu

SEQ ID NO: 1722896 - RNA, 22 nt, Homo sapiens
ucugcacaguguucccauggcc

SEQ ID NO: 1722897 - RNA, 20 nt, Homo sapiens
ucuggauaucaagguggaaa

SEQ ID NO: 1722898 - RNA, 17 nt, Homo sapiens
ucugggaaaaagugcac

SEQ ID NO: 1722899 - RNA, 23 nt, Homo sapiens
ucugucucaucucuguauuccca

SEQ ID NO: 1722900 - RNA, 18 nt, Homo sapiens
ucugugacaugcuaauua

SEQ ID NO: 1722901 - RNA, 15 nt, Homo sapiens
ucuuaaaaacaacga

SEQ ID NO: 1722902 - RNA, 19 nt, Homo sapiens
ucuuacuauauuuauugau

SEQ ID NO: 1722903 - RNA, 23 nt, Homo sapiens
ucuugaauauguauuaaaauauc

SEQ ID NO: 1722904 - RNA, 16 nt, Homo sapiens
ucuuucauacauuaua

SEQ ID NO: 1722905 - RNA, 20 nt, Homo sapiens
ucuuucccuaaagaacauac

SEQ ID NO: 1722906 - RNA, 20 nt, Homo sapiens
ucuuucccuccuuggugauu

SEQ ID NO: 1722907 - RNA, 14 nt, Homo sapiens
ucuuuugucccaga

SEQ ID NO: 1722908 - RNA, 13 nt, Homo sapiens
ugaaaaaaguaua

SEQ ID NO: 1722909 - RNA, 17 nt, Homo sapiens
ugaacacacauggaugc

SEQ ID NO: 1722910 - RNA, 21 nt, Homo sapiens
ugaagacuauugguuugagaa

SEQ ID NO: 1722911 - RNA, 17 nt, Homo sapiens
ugaagauuaacacugag

SEQ ID NO: 1722912 - RNA, 14 nt, Homo sapiens
ugaaguacaaaagg

SEQ ID NO: 1722913 - RNA, 14 nt, Homo sapiens
ugaauagaaacaga

SEQ ID NO: 1722914 - RNA, 16 nt, Homo sapiens
ugacauacauccaaca

SEQ ID NO: 1722915 - RNA, 18 nt, Homo sapiens
ugacauugaaaucuagga

SEQ ID NO: 1722916 - RNA, 16 nt, Homo sapiens
ugacgaagaagcaacu

SEQ ID NO: 1722917 - RNA, 23 nt, Homo sapiens
ugacuagccaucucaagcaaguu

SEQ ID NO: 1722918 - RNA, 16 nt, Homo sapiens
ugacucucagcagcua

SEQ ID NO: 1722919 - RNA, 18 nt, Homo sapiens
ugagaagccagcuuuccu

SEQ ID NO: 1722920 - RNA, 13 nt, Homo sapiens
ugagagacuccau

SEQ ID NO: 1722921 - RNA, 12 nt, Homo sapiens
ugagauccagag

SEQ ID NO: 1722922 - RNA, 23 nt, Homo sapiens
ugagcagguguucuucauuaccu

SEQ ID NO: 1722923 - RNA, 18 nt, Homo sapiens
ugagcuggggaugucucu

SEQ ID NO: 1722924 - RNA, 20 nt, Homo sapiens
ugagcuggggaugucucuca

SEQ ID NO: 1722925 - RNA, 15 nt, Homo sapiens
ugaggcauuacaaau

SEQ ID NO: 1722926 - RNA, 13 nt, Homo sapiens
ugaggccucucau

SEQ ID NO: 1722927 - RNA, 16 nt, Homo sapiens
ugaggcggguggauca

SEQ ID NO: 1722928 - RNA, 16 nt, Homo sapiens
ugaggggcucucucau

SEQ ID NO: 1722929 - RNA, 17 nt, Homo sapiens
ugauaagcugagcuccu

SEQ ID NO: 1722930 - RNA, 18 nt, Homo sapiens
ugaucuaugcuauauuca

SEQ ID NO: 1722931 - RNA, 20 nt, Homo sapiens
ugaugacuccuccccagaaa

SEQ ID NO: 1722932 - RNA, 15 nt, Homo sapiens
ugcaacauacaggug

SEQ ID NO: 1722933 - RNA, 15 nt, Homo sapiens
ugcaaggcaaauguu

SEQ ID NO: 1722934 - RNA, 19 nt, Homo sapiens
ugcaaggcaaauguuuauu

SEQ ID NO: 1722935 - RNA, 22 nt, Homo sapiens
ugcacacacacagagauaugca

SEQ ID NO: 1722936 - RNA, 21 nt, Homo sapiens
ugcacacacacggaugcacac

SEQ ID NO: 1722937 - RNA, 13 nt, Homo sapiens
ugcacacacagau

SEQ ID NO: 1722938 - RNA, 14 nt, Homo sapiens
ugcacacacagaug

SEQ ID NO: 1722939 - RNA, 14 nt, Homo sapiens
ugcacacacauaua

SEQ ID NO: 1722940 - RNA, 23 nt, Homo sapiens
ugcacacgcacauagagauaugc

SEQ ID NO: 1722941 - RNA, 21 nt, Homo sapiens
ugcacacggaugcacagagau

SEQ ID NO: 1722942 - RNA, 21 nt, Homo sapiens
ugcacagagauaugcacacac

SEQ ID NO: 1722943 - RNA, 17 nt, Homo sapiens
ugccagggccaugucag

SEQ ID NO: 1722944 - RNA, 15 nt, Homo sapiens
ugccgucacuauuca

SEQ ID NO: 1722945 - RNA, 11 nt, Homo sapiens
ugcgcacacac

SEQ ID NO: 1722946 - RNA, 15 nt, Homo sapiens
ugcgcacacacagau

SEQ ID NO: 1722947 - RNA, 20 nt, Homo sapiens
ugcuauuuucuuauccuuug

SEQ ID NO: 1722948 - RNA, 15 nt, Homo sapiens
ugcuguauccaucca

SEQ ID NO: 1722949 - RNA, 14 nt, Homo sapiens
uggaaacagaugaa

SEQ ID NO: 1722950 - RNA, 18 nt, Homo sapiens
uggaagugugggucugug

SEQ ID NO: 1722951 - RNA, 24 nt, Homo sapiens
uggagcugagcagguguucuucau

SEQ ID NO: 1722952 - RNA, 11 nt, Homo sapiens
uggaugcacac

SEQ ID NO: 1722953 - RNA, 13 nt, Homo sapiens
uggaugcacacac

SEQ ID NO: 1722954 - RNA, 19 nt, Homo sapiens
uggcaaagagagguccaga

SEQ ID NO: 1722955 - RNA, 14 nt, Homo sapiens
uggcccuaugcuuc

SEQ ID NO: 1722956 - RNA, 15 nt, Homo sapiens
uggcgcaggaacuca

SEQ ID NO: 1722957 - RNA, 15 nt, Homo sapiens
uggcuggaucuguga

SEQ ID NO: 1722958 - RNA, 21 nt, Homo sapiens
uggcugggaauaagugccagg

SEQ ID NO: 1722959 - RNA, 18 nt, Homo sapiens
ugggacauauuuuccuga

SEQ ID NO: 1722960 - RNA, 17 nt, Homo sapiens
ugggagaaugucaguau

SEQ ID NO: 1722961 - RNA, 21 nt, Homo sapiens
ugggauauuacaaauaaagcu

SEQ ID NO: 1722962 - RNA, 15 nt, Homo sapiens
uggggagggagacag

SEQ ID NO: 1722963 - RNA, 18 nt, Homo sapiens
uggggaugucucucauga

SEQ ID NO: 1722964 - RNA, 17 nt, Homo sapiens
uggguuggacaaccuca

SEQ ID NO: 1722965 - RNA, 16 nt, Homo sapiens
uguaaauuuaugugau

SEQ ID NO: 1722966 - RNA, 15 nt, Homo sapiens
uguacacacacagau

SEQ ID NO: 1722967 - RNA, 21 nt, Homo sapiens
uguacacacacagaugcacac

SEQ ID NO: 1722968 - RNA, 14 nt, Homo sapiens
ugucaguucauccu

SEQ ID NO: 1722969 - RNA, 21 nt, Homo sapiens
ugucccagaaugccuccugca

SEQ ID NO: 1722970 - RNA, 22 nt, Homo sapiens
ugucccucauccauagcaccuc

SEQ ID NO: 1722971 - RNA, 23 nt, Homo sapiens
ugugaaggaauuauucccaugag

SEQ ID NO: 1722972 - RNA, 15 nt, Homo sapiens
ugugcuagacuguaa

SEQ ID NO: 1722973 - RNA, 13 nt, Homo sapiens
uguuuugcucaau

SEQ ID NO: 1722974 - RNA, 13 nt, Homo sapiens
uuaaaagcuuuau

SEQ ID NO: 1722975 - RNA, 18 nt, Homo sapiens
uuaaaaguccacuuuuaa

SEQ ID NO: 1722976 - RNA, 12 nt, Homo sapiens
uuaacaaaagga

SEQ ID NO: 1722977 - RNA, 21 nt, Homo sapiens
uuaacauaaaauaaacugaac

SEQ ID NO: 1722978 - RNA, 21 nt, Homo sapiens
uuaacuuaaaagaacauguau

SEQ ID NO: 1722979 - RNA, 14 nt, Homo sapiens
aaaaaaugaagaca

SEQ ID NO: 1722980 - RNA, 17 nt, Homo sapiens
aaaacucucaagcagac

SEQ ID NO: 1722981 - RNA, 16 nt, Homo sapiens
aaaagacauaauucac

SEQ ID NO: 1722982 - RNA, 21 nt, Homo sapiens
aaaaguuuauaaaagugaaua

SEQ ID NO: 1722983 - RNA, 15 nt, Homo sapiens
aaacaacagauguac

SEQ ID NO: 1722984 - RNA, 12 nt, Homo sapiens
aaacucacugaa

SEQ ID NO: 1722985 - RNA, 23 nt, Homo sapiens
aaacucucaagcagacgugagug

SEQ ID NO: 1722986 - RNA, 16 nt, Homo sapiens
aaacucuuccacuaga

SEQ ID NO: 1722987 - RNA, 12 nt, Homo sapiens
uuaaucaaugau

SEQ ID NO: 1722988 - RNA, 20 nt, Homo sapiens
uuaaugauugauuauaucau

SEQ ID NO: 1722989 - RNA, 14 nt, Homo sapiens
uuacaaaagacaga

SEQ ID NO: 1722990 - RNA, 19 nt, Homo sapiens
uuacaacuuauaauuacaa

SEQ ID NO: 1722991 - RNA, 23 nt, Homo sapiens
uuacaacuuauaauuacaaugca

SEQ ID NO: 1722992 - RNA, 23 nt, Homo sapiens
uuacacagguuuaguugacuaau

SEQ ID NO: 1722993 - RNA, 16 nt, Homo sapiens
uuagagcugccugugc

SEQ ID NO: 1722994 - RNA, 18 nt, Homo sapiens
uuagguugaaacauaucu

SEQ ID NO: 1722995 - RNA, 16 nt, Homo sapiens
uuaguccccacccaaa

SEQ ID NO: 1722996 - RNA, 17 nt, Homo sapiens
uuauaaagauauaccaa

SEQ ID NO: 1722997 - RNA, 12 nt, Homo sapiens
uuauaauuacaa

SEQ ID NO: 1722998 - RNA, 23 nt, Homo sapiens
uuauauuuguaaauuuaugugau

SEQ ID NO: 1722999 - RNA, 14 nt, Homo sapiens
uuaucagccugugc

SEQ ID NO: 1723000 - RNA, 23 nt, Homo sapiens
uuauuccaagggaauauugccaa

SEQ ID NO: 1723001 - RNA, 13 nt, Homo sapiens
aaaaagacauaau

SEQ ID NO: 1723002 - RNA, 14 nt, Homo sapiens
aaaacaaugcagua

SEQ ID NO: 1723003 - RNA, 16 nt, Homo sapiens
auguauuuuugucaau

SEQ ID NO: 1723004 - RNA, 22 nt, Homo sapiens
acuggcaaagcagaaugugaua

SEQ ID NO: 1723005 - RNA, 23 nt, Homo sapiens
acuggcaaagcagaaugugauau

SEQ ID NO: 1723006 - RNA, 18 nt, Homo sapiens
acuggguguaaacacauc

SEQ ID NO: 1723007 - RNA, 17 nt, Homo sapiens
acuguacacauaagcca

SEQ ID NO: 1723008 - RNA, 21 nt, Homo sapiens
ccaauuucuuucuaaaacaca

SEQ ID NO: 1723009 - RNA, 22 nt, Homo sapiens
ccacaaaguuucagaaauucuc

SEQ ID NO: 1723010 - RNA, 16 nt, Homo sapiens
ccacacccucacugcu

SEQ ID NO: 1723011 - RNA, 16 nt, Homo sapiens
ccacuuuuaaaacuau

SEQ ID NO: 1723012 - RNA, 23 nt, Homo sapiens
ccagagccuuaauaaacguccac

SEQ ID NO: 1723013 - RNA, 23 nt, Homo sapiens
ccagcuccacaguguugccagag

SEQ ID NO: 1723014 - RNA, 17 nt, Homo sapiens
ccagguaugcaaauauc

SEQ ID NO: 1723015 - RNA, 18 nt, Homo sapiens
cccagaaugccuccugca

SEQ ID NO: 1723016 - RNA, 19 nt, Homo sapiens
cccugauuuaauaugcaaa

SEQ ID NO: 1723017 - RNA, 11 nt, Homo sapiens
cccugccauca

SEQ ID NO: 1723018 - RNA, 22 nt, Homo sapiens
ccgaaacauacaagacaaaaaa

SEQ ID NO: 1723019 - RNA, 20 nt, Homo sapiens
ccgaugugcgcacacacaga

SEQ ID NO: 1723020 - RNA, 20 nt, Homo sapiens
ccgggucaucuguaccucug

SEQ ID NO: 1723021 - RNA, 21 nt, Homo sapiens
ccgucacuauucaucaaugaa

SEQ ID NO: 1723022 - RNA, 18 nt, Homo sapiens
ccuccugucccucaucca

SEQ ID NO: 1723023 - RNA, 21 nt, Homo sapiens
ccucucacuaaguaugaucua

SEQ ID NO: 1723024 - RNA, 12 nt, Homo sapiens
ccucucauucca

SEQ ID NO: 1723025 - RNA, 20 nt, Homo sapiens
ccugcuuuuuaugggagcug

SEQ ID NO: 1723026 - RNA, 19 nt, Homo sapiens
ccuggcuaacacggugaaa

SEQ ID NO: 1723027 - RNA, 22 nt, Homo sapiens
ccuugcaagcuaauucuuugac

SEQ ID NO: 1723028 - RNA, 15 nt, Homo sapiens
ccuuggugugcugua

SEQ ID NO: 1723029 - RNA, 13 nt, Homo sapiens
ccuugugaaggaa

SEQ ID NO: 1723030 - RNA, 13 nt, Homo sapiens
ccuuuugccaucc

SEQ ID NO: 1723031 - RNA, 17 nt, Homo sapiens
cgaaaucaagaaacuca

SEQ ID NO: 1723032 - RNA, 16 nt, Homo sapiens
cgacguuugacuagcc

SEQ ID NO: 1723033 - RNA, 15 nt, Homo sapiens
cgauguacacacaca

SEQ ID NO: 1723034 - RNA, 17 nt, Homo sapiens
cgauguacacacacaga

SEQ ID NO: 1723035 - RNA, 21 nt, Homo sapiens
cgcaaacacaccgaugcacac

SEQ ID NO: 1723036 - RNA, 15 nt, Homo sapiens
cgcacacacaccgau

SEQ ID NO: 1723037 - RNA, 13 nt, Homo sapiens
cgcacacacagau

SEQ ID NO: 1723038 - RNA, 19 nt, Homo sapiens
cgcacacacagauaugcac

SEQ ID NO: 1723039 - RNA, 13 nt, Homo sapiens
cgggcugcacaga

SEQ ID NO: 1723040 - RNA, 15 nt, Homo sapiens
cguuugacuagccau

SEQ ID NO: 1723041 - RNA, 19 nt, Homo sapiens
cguuugacuagccaucuca

SEQ ID NO: 1723042 - RNA, 15 nt, Homo sapiens
cuaaagaacauaccu

SEQ ID NO: 1723043 - RNA, 17 nt, Homo sapiens
cuaaggaaauauuucaa

SEQ ID NO: 1723044 - RNA, 19 nt, Homo sapiens
cuaaugugcugugugacau

SEQ ID NO: 1723045 - RNA, 15 nt, Homo sapiens
cuaauuccacacccu

SEQ ID NO: 1723046 - RNA, 15 nt, Homo sapiens
cuacaugcauuucaa

SEQ ID NO: 1723047 - RNA, 16 nt, Homo sapiens
cuacauuugcuccauc

SEQ ID NO: 1723048 - RNA, 13 nt, Homo sapiens
cuaccucuuggcu

SEQ ID NO: 1723049 - RNA, 16 nt, Homo sapiens
cuagccaucucaagca

SEQ ID NO: 1723050 - RNA, 18 nt, Homo sapiens
cuaggugacauauacaua

SEQ ID NO: 1723051 - RNA, 18 nt, Homo sapiens
cuauauuuauugauuuca

SEQ ID NO: 1723052 - RNA, 14 nt, Homo sapiens
cuauucaucaauga

SEQ ID NO: 1723053 - RNA, 15 nt, Homo sapiens
cuauuuauuuacaaa

SEQ ID NO: 1723054 - RNA, 12 nt, Homo sapiens
cuccacauaccu

SEQ ID NO: 1723055 - RNA, 21 nt, Homo sapiens
cucgcaagggaaguccuugca

SEQ ID NO: 1723056 - RNA, 15 nt, Homo sapiens
cucuaaaacucucaa

SEQ ID NO: 1723057 - RNA, 13 nt, Homo sapiens
cucucucaugaua

SEQ ID NO: 1723058 - RNA, 17 nt, Homo sapiens
cugaaguccauuuuccc

SEQ ID NO: 1723059 - RNA, 15 nt, Homo sapiens
cugacgaagaagcaa

SEQ ID NO: 1723060 - RNA, 19 nt, Homo sapiens
cugagcagguguucuucau

SEQ ID NO: 1723061 - RNA, 15 nt, Homo sapiens
cugauaucagaguua

SEQ ID NO: 1723062 - RNA, 13 nt, Homo sapiens
cugaugacuccuc

SEQ ID NO: 1723063 - RNA, 18 nt, Homo sapiens
cugauuuaauaugcaaag

SEQ ID NO: 1723064 - RNA, 20 nt, Homo sapiens
cuggaucugugaggggcucu

SEQ ID NO: 1723065 - RNA, 12 nt, Homo sapiens
cuggcccugugc

SEQ ID NO: 1723066 - RNA, 21 nt, Homo sapiens
cuggggaugucucucaugacc

SEQ ID NO: 1723067 - RNA, 21 nt, Homo sapiens
cuguagacauuugcuaugagc

SEQ ID NO: 1723068 - RNA, 14 nt, Homo sapiens
cugugaacauuugu

SEQ ID NO: 1723069 - RNA, 20 nt, Homo sapiens
cugugccuuggugugcugua

SEQ ID NO: 1723070 - RNA, 21 nt, Homo sapiens
cugugccuuggugugcuguau

SEQ ID NO: 1723071 - RNA, 20 nt, Homo sapiens
cuucacaggcuauucuacuu

SEQ ID NO: 1723072 - RNA, 17 nt, Homo sapiens
cuucauggaauucacaa

SEQ ID NO: 1723073 - RNA, 13 nt, Homo sapiens
cuucauuaccuca

SEQ ID NO: 1723074 - RNA, 14 nt, Homo sapiens
cuucauuaccucag

SEQ ID NO: 1723075 - RNA, 18 nt, Homo sapiens
cuucauuucucuugcuca

SEQ ID NO: 1723076 - RNA, 20 nt, Homo sapiens
cuucauuuuucuaauaauca

SEQ ID NO: 1723077 - RNA, 23 nt, Homo sapiens
cuucuaccucuuggcugccuugu

SEQ ID NO: 1723078 - RNA, 22 nt, Homo sapiens
cuucuauugacccacaaaguuu

SEQ ID NO: 1723079 - RNA, 16 nt, Homo sapiens
cuucuguaugugacaa

SEQ ID NO: 1723080 - RNA, 20 nt, Homo sapiens
cuucuuaacucucuguuaca

SEQ ID NO: 1723081 - RNA, 20 nt, Homo sapiens
cuuggugauuccgcagugag

SEQ ID NO: 1723082 - RNA, 13 nt, Homo sapiens
cuuguauggauau

SEQ ID NO: 1723083 - RNA, 18 nt, Homo sapiens
cuuguugaugacauuugg

SEQ ID NO: 1723084 - RNA, 20 nt, Homo sapiens
cuuuccacccacucuucaca

SEQ ID NO: 1723085 - RNA, 16 nt, Homo sapiens
cuuuccccucccucag

SEQ ID NO: 1723086 - RNA, 19 nt, Homo sapiens
cuuucccuaaagaacauac

SEQ ID NO: 1723087 - RNA, 20 nt, Homo sapiens
cuuucccucucuggaccuca

SEQ ID NO: 1723088 - RNA, 14 nt, Homo sapiens
gaaaacuaaucuaa

SEQ ID NO: 1723089 - RNA, 21 nt, Homo sapiens
gaaaacuccauaacaguuuua

SEQ ID NO: 1723090 - RNA, 15 nt, Homo sapiens
gaaaacugucauuua

SEQ ID NO: 1723091 - RNA, 19 nt, Homo sapiens
gaaaagcaguggcuccauu

SEQ ID NO: 1723092 - RNA, 18 nt, Homo sapiens
gaaaccacacagacuugg

SEQ ID NO: 1723093 - RNA, 13 nt, Homo sapiens
gaagccuuuugca

SEQ ID NO: 1723094 - RNA, 15 nt, Homo sapiens
gaagccuuuugcaaa

SEQ ID NO: 1723095 - RNA, 14 nt, Homo sapiens
gaaggcuaugggga

SEQ ID NO: 1723096 - RNA, 13 nt, Homo sapiens
gaauauugccaau

SEQ ID NO: 1723097 - RNA, 18 nt, Homo sapiens
gaauauugccaaugcuac

SEQ ID NO: 1723098 - RNA, 15 nt, Homo sapiens
gaauucuauguuggc

SEQ ID NO: 1723099 - RNA, 16 nt, Homo sapiens
gacaaccucauuuuaa

SEQ ID NO: 1723100 - RNA, 16 nt, Homo sapiens
gacacagauuggccag

SEQ ID NO: 1723101 - RNA, 13 nt, Homo sapiens
gacacucaaucua

SEQ ID NO: 1723102 - RNA, 20 nt, Homo sapiens
gaccaaaugcuuuuccucaa

SEQ ID NO: 1723103 - RNA, 14 nt, Homo sapiens
gaccuguugggagu

SEQ ID NO: 1723104 - RNA, 16 nt, Homo sapiens
gacguuugacuagcca

SEQ ID NO: 1723105 - RNA, 17 nt, Homo sapiens
gacguuugacuagccau

SEQ ID NO: 1723106 - RNA, 23 nt, Homo sapiens
gacguuugacuagccaucucaag

SEQ ID NO: 1723107 - RNA, 19 nt, Homo sapiens
gacuaauagagacacagag

SEQ ID NO: 1723108 - RNA, 19 nt, Homo sapiens
gacuagccaucucaagcaa

SEQ ID NO: 1723109 - RNA, 14 nt, Homo sapiens
gacucucagcagcu

SEQ ID NO: 1723110 - RNA, 22 nt, Homo sapiens
gacuugcaaagcuucacuucau

SEQ ID NO: 1723111 - RNA, 13 nt, Homo sapiens
gagaaugucagua

SEQ ID NO: 1723112 - RNA, 13 nt, Homo sapiens
gagcaagacucca

SEQ ID NO: 1723113 - RNA, 22 nt, Homo sapiens
gagcuggggaugucucucauga

SEQ ID NO: 1723114 - RNA, 13 nt, Homo sapiens
gagguaagaauag

SEQ ID NO: 1723115 - RNA, 11 nt, Homo sapiens
gauauauuugu

SEQ ID NO: 1723116 - RNA, 15 nt, Homo sapiens
gaugacuugcucaag

SEQ ID NO: 1723117 - RNA, 21 nt, Homo sapiens
gaugcacacacagauauacac

SEQ ID NO: 1723118 - RNA, 13 nt, Homo sapiens
gauguacacacac

SEQ ID NO: 1723119 - RNA, 17 nt, Homo sapiens
gauguacacacacagau

SEQ ID NO: 1723120 - RNA, 20 nt, Homo sapiens
gauguaugcacacacauaua

SEQ ID NO: 1723121 - RNA, 13 nt, Homo sapiens
gauuccgcaguga

SEQ ID NO: 1723122 - RNA, 14 nt, Homo sapiens
gauugugucccauu

SEQ ID NO: 1723123 - RNA, 14 nt, Homo sapiens
gauuuacacagguu

SEQ ID NO: 1723124 - RNA, 20 nt, Homo sapiens
gcaaacacaccgaugcacac

SEQ ID NO: 1723125 - RNA, 16 nt, Homo sapiens
gcacacacacaccaau

SEQ ID NO: 1723126 - RNA, 21 nt, Homo sapiens
gcacacacacagagauaugca

SEQ ID NO: 1723127 - RNA, 17 nt, Homo sapiens
gcacacacaccgaugua

SEQ ID NO: 1723128 - RNA, 12 nt, Homo sapiens
gcacacacagau

SEQ ID NO: 1723129 - RNA, 15 nt, Homo sapiens
gcacacacagaugca

SEQ ID NO: 1723130 - RNA, 14 nt, Homo sapiens
gcacacacauauau

SEQ ID NO: 1723131 - RNA, 17 nt, Homo sapiens
gcaggagacuggcguga

SEQ ID NO: 1723132 - RNA, 19 nt, Homo sapiens
gcagguguucuucauuacc

SEQ ID NO: 1723133 - RNA, 11 nt, Homo sapiens
gcaucauucac

SEQ ID NO: 1723134 - RNA, 15 nt, Homo sapiens
gcacaugccaaugca

SEQ ID NO: 1723135 - RNA, 19 nt, Homo sapiens
gcaccccagcaauuaugaa

SEQ ID NO: 1723136 - RNA, 22 nt, Homo sapiens
gcagacgugagugugacuuuuu

SEQ ID NO: 1723137 - RNA, 15 nt, Homo sapiens
gcagcaaaacaaacg

SEQ ID NO: 1723138 - RNA, 15 nt, Homo sapiens
gcagcaacaacuguc

SEQ ID NO: 1723139 - RNA, 16 nt, Homo sapiens
gcaugaacacacaugg

SEQ ID NO: 1723140 - RNA, 19 nt, Homo sapiens
gcaugggaaaaauguugga

SEQ ID NO: 1723141 - RNA, 16 nt, Homo sapiens
gccagggccaugucag

SEQ ID NO: 1723142 - RNA, 14 nt, Homo sapiens
gccaucucaagcaa

SEQ ID NO: 1723143 - RNA, 18 nt, Homo sapiens
gccaucucaagcaaguuu

SEQ ID NO: 1723144 - RNA, 20 nt, Homo sapiens
gcccagaaaacugucauuua

SEQ ID NO: 1723145 - RNA, 16 nt, Homo sapiens
gccgggcugcacagac

SEQ ID NO: 1723146 - RNA, 16 nt, Homo sapiens
gccuccugucccucau

SEQ ID NO: 1723147 - RNA, 23 nt, Homo sapiens
gcuaauccacaaccuguuaccac

SEQ ID NO: 1723148 - RNA, 13 nt, Homo sapiens
gcucaccaagaag

SEQ ID NO: 1723149 - RNA, 20 nt, Homo sapiens
gcucguaugaauucauucuu

SEQ ID NO: 1723150 - RNA, 19 nt, Homo sapiens
gcucuacccugaguucaua

SEQ ID NO: 1723151 - RNA, 23 nt, Homo sapiens
gcugagcagguguucuucauuac

SEQ ID NO: 1723152 - RNA, 13 nt, Homo sapiens
gcuggcuuucaga

SEQ ID NO: 1723153 - RNA, 14 nt, Homo sapiens
gcuggggaugucuc

SEQ ID NO: 1723154 - RNA, 15 nt, Homo sapiens
gcuguggccacucca

SEQ ID NO: 1723155 - RNA, 21 nt, Homo sapiens
gcuucucucugcaaccuugaa

SEQ ID NO: 1723156 - RNA, 13 nt, Homo sapiens
ggaaauggcccau

SEQ ID NO: 1723157 - RNA, 17 nt, Homo sapiens
ggaauuagaaauauauc

SEQ ID NO: 1723158 - RNA, 23 nt, Homo sapiens
ggagugaggaugucugggccacu

SEQ ID NO: 1723159 - RNA, 16 nt, Homo sapiens
ggaugcacacacagau

SEQ ID NO: 1723160 - RNA, 14 nt, Homo sapiens
ggaugcacagagau

SEQ ID NO: 1723161 - RNA, 15 nt, Homo sapiens
ggaugucucucauga

SEQ ID NO: 1723162 - RNA, 12 nt, Homo sapiens
ggcaaagcagaa

SEQ ID NO: 1723163 - RNA, 20 nt, Homo sapiens
ggcaacagagcaagacucca

SEQ ID NO: 1723164 - RNA, 19 nt, Homo sapiens
ggcacuauuuauuuacaaa

SEQ ID NO: 1723165 - RNA, 21 nt, Homo sapiens
ggcagggcugaggccucucau

SEQ ID NO: 1723166 - RNA, 19 nt, Homo sapiens
ggcaugaacacacauggau

SEQ ID NO: 1723167 - RNA, 11 nt, Homo sapiens
ggccagcacca

SEQ ID NO: 1723168 - RNA, 16 nt, Homo sapiens
ggccagcaccaucucu

SEQ ID NO: 1723169 - RNA, 15 nt, Homo sapiens
ggcccugugccuugg

SEQ ID NO: 1723170 - RNA, 23 nt, Homo sapiens
ggcuggucccacacuuaucagca

SEQ ID NO: 1723171 - RNA, 14 nt, Homo sapiens
gggaauauugccaa

SEQ ID NO: 1723172 - RNA, 22 nt, Homo sapiens
gggaauauugccaaugcuacag

SEQ ID NO: 1723173 - RNA, 16 nt, Homo sapiens
gggagaaugucaguau

SEQ ID NO: 1723174 - RNA, 16 nt, Homo sapiens
gggagagagugcuauu

SEQ ID NO: 1723175 - RNA, 14 nt, Homo sapiens
gggaguguguaauu

SEQ ID NO: 1723176 - RNA, 22 nt, Homo sapiens
gggccacucaggggucauucau

SEQ ID NO: 1723177 - RNA, 16 nt, Homo sapiens
gggcucagaguggggu

SEQ ID NO: 1723178 - RNA, 14 nt, Homo sapiens
gggagucugaaaug

SEQ ID NO: 1723179 - RNA, 14 nt, Homo sapiens
gggcucucucauga

SEQ ID NO: 1723180 - RNA, 19 nt, Homo sapiens
gggcucucucaugauagaa

SEQ ID NO: 1723181 - RNA, 22 nt, Homo sapiens
gggcuugguguuuguaagaaaa

SEQ ID NO: 1723182 - RNA, 13 nt, Homo sapiens
ggggcucucucau

SEQ ID NO: 1723183 - RNA, 14 nt, Homo sapiens
ggguuacuauuucu

SEQ ID NO: 1723184 - RNA, 14 nt, Homo sapiens
gguggucuauuaaa

SEQ ID NO: 1723185 - RNA, 14 nt, Homo sapiens
gguuacuauuucuu

SEQ ID NO: 1723186 - RNA, 21 nt, Homo sapiens
gguuuucuuuuaagaaucaau

SEQ ID NO: 1723187 - RNA, 18 nt, Homo sapiens
guaaaaauauuaacugac

SEQ ID NO: 1723188 - RNA, 23 nt, Homo sapiens
guaaaagucuaguuaccuacuuu

SEQ ID NO: 1723189 - RNA, 16 nt, Homo sapiens
guaacaaaaguauagu

SEQ ID NO: 1723190 - RNA, 16 nt, Homo sapiens
guaaucccagcacuuu

SEQ ID NO: 1723191 - RNA, 21 nt, Homo sapiens
guacauuaaagauuucugcuc

SEQ ID NO: 1723192 - RNA, 15 nt, Homo sapiens
guaccacuuuugcaa

SEQ ID NO: 1723193 - RNA, 15 nt, Homo sapiens
guagauguaugcaca

SEQ ID NO: 1723194 - RNA, 16 nt, Homo sapiens
guagauguaugcacac

SEQ ID NO: 1723195 - RNA, 21 nt, Homo sapiens
guagcuguauuagcagcaaaa

SEQ ID NO: 1723196 - RNA, 17 nt, Homo sapiens
guaguuguucugaaaug

SEQ ID NO: 1723197 - RNA, 18 nt, Homo sapiens
guaugcacacacauauau

SEQ ID NO: 1723198 - RNA, 21 nt, Homo sapiens
gucaaagaaaacuuccaaaaa

SEQ ID NO: 1723199 - RNA, 19 nt, Homo sapiens
gucacuauucaucaaugaa

SEQ ID NO: 1723200 - RNA, 22 nt, Homo sapiens
guccaucuccagacucuaccac

SEQ ID NO: 1723201 - RNA, 17 nt, Homo sapiens
guccucuagugaaugua

SEQ ID NO: 1723202 - RNA, 16 nt, Homo sapiens
gucugggccacucagg

SEQ ID NO: 1723203 - RNA, 21 nt, Homo sapiens
gugauguguccugauaagcug

SEQ ID NO: 1723204 - RNA, 17 nt, Homo sapiens
gugcugaguguacagag

SEQ ID NO: 1723205 - RNA, 22 nt, Homo sapiens
guggcuggaucugugaggggcu

SEQ ID NO: 1723206 - RNA, 23 nt, Homo sapiens
gugguggcaggcaccuguagucc

SEQ ID NO: 1723207 - RNA, 19 nt, Homo sapiens
guguucuucauuaccucag

SEQ ID NO: 1723208 - RNA, 19 nt, Homo sapiens
guguuuucaauuuuaaaca

SEQ ID NO: 1723209 - RNA, 17 nt, Homo sapiens
guuauuauuucuucauu

SEQ ID NO: 1723210 - RNA, 16 nt, Homo sapiens
guucaucaacagugag

SEQ ID NO: 1723211 - RNA, 16 nt, Homo sapiens
guucuucauuaccuca

SEQ ID NO: 1723212 - RNA, 19 nt, Homo sapiens
guuuaaaaguccacuuuua

SEQ ID NO: 1723213 - RNA, 21 nt, Homo sapiens
guuuaaucaaugaucaucuca

SEQ ID NO: 1723214 - RNA, 18 nt, Homo sapiens
guuuagcccugaacauuu

SEQ ID NO: 1723215 - RNA, 20 nt, Homo sapiens
guuuauuugaggagauaaca

SEQ ID NO: 1723216 - RNA, 14 nt, Homo sapiens
guuugacuagccau

SEQ ID NO: 1723217 - RNA, 13 nt, Homo sapiens
uaaacuauauucu

SEQ ID NO: 1723218 - RNA, 12 nt, Homo sapiens
uaaacucuucca

SEQ ID NO: 1723219 - RNA, 14 nt, Homo sapiens
uaaagaaguuugaa

SEQ ID NO: 1723220 - RNA, 15 nt, Homo sapiens
uaaagauuucugcuc

SEQ ID NO: 1723221 - RNA, 16 nt, Homo sapiens
uaaagcaguugagauu

SEQ ID NO: 1723222 - RNA, 17 nt, Homo sapiens
uaaagcauuuugcaaac

SEQ ID NO: 1723223 - RNA, 13 nt, Homo sapiens
uaaauaaccaauu

SEQ ID NO: 1723224 - RNA, 18 nt, Homo sapiens
uaaauaaccaauuccuca

SEQ ID NO: 1723225 - RNA, 13 nt, Homo sapiens
uaaauuucugcuu

SEQ ID NO: 1723226 - RNA, 13 nt, Homo sapiens
uaacaaaaguaua

SEQ ID NO: 1723227 - RNA, 15 nt, Homo sapiens
uaacaaaaguauagu

SEQ ID NO: 1723228 - RNA, 17 nt, Homo sapiens
uaacacugagauccaga

SEQ ID NO: 1723229 - RNA, 19 nt, Homo sapiens
uaacuaaggaaauauuuca

SEQ ID NO: 1723230 - RNA, 22 nt, Homo sapiens
uaacucagucuuuaaucugaga

SEQ ID NO: 1723231 - RNA, 20 nt, Homo sapiens
uaacuucauuuuucuaauaa

SEQ ID NO: 1723232 - RNA, 16 nt, Homo sapiens
uaauauuacucuauga

SEQ ID NO: 1723233 - RNA, 14 nt, Homo sapiens
uaaucauaggcaga

SEQ ID NO: 1723234 - RNA, 20 nt, Homo sapiens
uaaugccccugauuuuauca

SEQ ID NO: 1723235 - RNA, 17 nt, Homo sapiens
uaauuccgaaacauaca

SEQ ID NO: 1723236 - RNA, 13 nt, Homo sapiens
uacaaaagcaauu

SEQ ID NO: 1723237 - RNA, 15 nt, Homo sapiens
uacacacacagaugc

SEQ ID NO: 1723238 - RNA, 18 nt, Homo sapiens
uacacacacagaugcaca

SEQ ID NO: 1723239 - RNA, 21 nt, Homo sapiens
uacacagguuuaguugacuaa

SEQ ID NO: 1723240 - RNA, 13 nt, Homo sapiens
uacaggacauaua

SEQ ID NO: 1723241 - RNA, 14 nt, Homo sapiens
uacaggacauauau

SEQ ID NO: 1723242 - RNA, 14 nt, Homo sapiens
uacauuacaaaaga

SEQ ID NO: 1723243 - RNA, 22 nt, Homo sapiens
uaccaagggccauucaguacau

SEQ ID NO: 1723244 - RNA, 14 nt, Homo sapiens
uaccugagacauau

SEQ ID NO: 1723245 - RNA, 15 nt, Homo sapiens
uacuuugccauuaag

SEQ ID NO: 1723246 - RNA, 22 nt, Homo sapiens
uagaaguucuaguguuuucaau

SEQ ID NO: 1723247 - RNA, 22 nt, Homo sapiens
uagaggcaugaacacacaugga

SEQ ID NO: 1723248 - RNA, 16 nt, Homo sapiens
uagauguaugcacaca

SEQ ID NO: 1723249 - RNA, 23 nt, Homo sapiens
uagauguaugcacacacauauau

SEQ ID NO: 1723250 - RNA, 12 nt, Homo sapiens
uagccaucucaa

SEQ ID NO: 1723251 - RNA, 17 nt, Homo sapiens
uagccaucucaagcaag

SEQ ID NO: 1723252 - RNA, 18 nt, Homo sapiens
uagccaucucaagcaagu

SEQ ID NO: 1723253 - RNA, 18 nt, Homo sapiens
uaggauaaauuacauuaa

SEQ ID NO: 1723254 - RNA, 17 nt, Homo sapiens
uaggccagcaccaucuc

SEQ ID NO: 1723255 - RNA, 13 nt, Homo sapiens
uaggugacauaua

SEQ ID NO: 1723256 - RNA, 15 nt, Homo sapiens
uaguagaauuuacaa

SEQ ID NO: 1723257 - RNA, 12 nt, Homo sapiens
uagugauuuaca

SEQ ID NO: 1723258 - RNA, 14 nt, Homo sapiens
uaguugacuaauga

SEQ ID NO: 1723259 - RNA, 18 nt, Homo sapiens
uauaauuacaaugcacaa

SEQ ID NO: 1723260 - RNA, 11 nt, Homo sapiens
uauacauacuu

SEQ ID NO: 1723261 - RNA, 23 nt, Homo sapiens
uauauuuuuuaaaauaagucuga

SEQ ID NO: 1723262 - RNA, 14 nt, Homo sapiens
uaucaagguggaaa

SEQ ID NO: 1723263 - RNA, 14 nt, Homo sapiens
uauccuuuaaacuc

SEQ ID NO: 1723264 - RNA, 13 nt, Homo sapiens
uaucuacaugcau

SEQ ID NO: 1723265 - RNA, 22 nt, Homo sapiens
uaugagcuggggaugucucuca

SEQ ID NO: 1723266 - RNA, 20 nt, Homo sapiens
uaugaucuaugcuauauuca

SEQ ID NO: 1723267 - RNA, 22 nt, Homo sapiens
uaugaucuaugcuauauucaaa

SEQ ID NO: 1723268 - RNA, 16 nt, Homo sapiens
uaugcacacacagaug

SEQ ID NO: 1723269 - RNA, 16 nt, Homo sapiens
uaugcacacacauaua

SEQ ID NO: 1723270 - RNA, 22 nt, Homo sapiens
uaugguaggaacugcugggcuu

SEQ ID NO: 1723271 - RNA, 17 nt, Homo sapiens
uaugguucucucgcaag

SEQ ID NO: 1723272 - RNA, 23 nt, Homo sapiens
uauguggaagugugggucugugu

SEQ ID NO: 1723273 - RNA, 16 nt, Homo sapiens
uaugugggggucugug

SEQ ID NO: 1723274 - RNA, 17 nt, Homo sapiens
uaugugggggucugugu

SEQ ID NO: 1723275 - RNA, 16 nt, Homo sapiens
uauuaaaauaucccaa

SEQ ID NO: 1723276 - RNA, 12 nt, Homo sapiens
uauuaagauaua

SEQ ID NO: 1723277 - RNA, 18 nt, Homo sapiens
uauuagagcugccugugc

SEQ ID NO: 1723278 - RNA, 14 nt, Homo sapiens
uauuagcagcaaaa

SEQ ID NO: 1723279 - RNA, 14 nt, Homo sapiens
uauucaucaaugaa

SEQ ID NO: 1723280 - RNA, 19 nt, Homo sapiens
uauuugauaaguuuucaca

SEQ ID NO: 1723281 - RNA, 22 nt, Homo sapiens
uauuuugcugcacacaaucuag

SEQ ID NO: 1723282 - RNA, 20 nt, Homo sapiens
ucaaagggagagagugcuau

SEQ ID NO: 1723283 - RNA, 14 nt, Homo sapiens
ucaagagcaaagua

SEQ ID NO: 1723284 - RNA, 20 nt, Homo sapiens
ucaagagcaaaguagaucau

SEQ ID NO: 1723285 - RNA, 15 nt, Homo sapiens
ucaauagauugcuca

SEQ ID NO: 1723286 - RNA, 20 nt, Homo sapiens
ucaaugaagauuaacacuga

SEQ ID NO: 1723287 - RNA, 19 nt, Homo sapiens
ucacagcagugagacuggg

SEQ ID NO: 1723288 - RNA, 22 nt, Homo sapiens
ucaccagcaugguaguggcaaa

SEQ ID NO: 1723289 - RNA, 21 nt, Homo sapiens
ucaccuagcuugucccaagcu

SEQ ID NO: 1723290 - RNA, 16 nt, Homo sapiens
ucacugcuguagacau

SEQ ID NO: 1723291 - RNA, 20 nt, Homo sapiens
ucagaacucguuaaagcaaa

SEQ ID NO: 1723292 - RNA, 14 nt, Homo sapiens
ucagaucauuauca

SEQ ID NO: 1723293 - RNA, 19 nt, Homo sapiens
ucagcacguguggccuguu

SEQ ID NO: 1723294 - RNA, 18 nt, Homo sapiens
ucaggagaucgagaccau

SEQ ID NO: 1723295 - RNA, 12 nt, Homo sapiens
ucauaaacuaua

SEQ ID NO: 1723296 - RNA, 24 nt, Homo sapiens
ucauccuuuaagaaaaacaucugg

SEQ ID NO: 1723297 - RNA, 17 nt, Homo sapiens
ucaucucuguauuccca

SEQ ID NO: 1723298 - RNA, 15 nt, Homo sapiens
ucaucuguaccucug

SEQ ID NO: 1723299 - RNA, 11 nt, Homo sapiens
ucauuaccuca

SEQ ID NO: 1723300 - RNA, 14 nt, Homo sapiens
ucauucaguacuua

SEQ ID NO: 1723301 - RNA, 19 nt, Homo sapiens
ucauucgugguugauuuca

SEQ ID NO: 1723302 - RNA, 19 nt, Homo sapiens
uccagagaggcuggaugac

SEQ ID NO: 1723303 - RNA, 20 nt, Homo sapiens
uccauccauggggcugauug

SEQ ID NO: 1723304 - RNA, 15 nt, Homo sapiens
ucccagcuacucggg

SEQ ID NO: 1723305 - RNA, 21 nt, Homo sapiens
ucccauggccccuugcauuuc

SEQ ID NO: 1723306 - RNA, 17 nt, Homo sapiens
cacuuuaaaacacucuu

SEQ ID NO: 1723307 - RNA, 19 nt, Homo sapiens
cacuuugggaggcugaggc

SEQ ID NO: 1723308 - RNA, 17 nt, Homo sapiens
cagaaugugauauccua

SEQ ID NO: 1723309 - RNA, 19 nt, Homo sapiens
cagacuaggguucaugucu

SEQ ID NO: 1723310 - RNA, 13 nt, Homo sapiens
cagagacagagag

SEQ ID NO: 1723311 - RNA, 18 nt, Homo sapiens
cagagauacgcaaacaca

SEQ ID NO: 1723312 - RNA, 14 nt, Homo sapiens
cagagauaugcaca

SEQ ID NO: 1723313 - RNA, 16 nt, Homo sapiens
cagagcaagacuccau

SEQ ID NO: 1723314 - RNA, 13 nt, Homo sapiens
cagagccaugacu

SEQ ID NO: 1723315 - RNA, 20 nt, Homo sapiens
cagauaugcacacacaugga

SEQ ID NO: 1723316 - RNA, 15 nt, Homo sapiens
cagaugcacacacag

SEQ ID NO: 1723317 - RNA, 20 nt, Homo sapiens
cagauggucacacagagaua

SEQ ID NO: 1723318 - RNA, 18 nt, Homo sapiens
cagauucuugcugugacc

SEQ ID NO: 1723319 - RNA, 18 nt, Homo sapiens
cagcuaaagaaguuugaa

SEQ ID NO: 1723320 - RNA, 14 nt, Homo sapiens
cagcucagugccac

SEQ ID NO: 1723321 - RNA, 15 nt, Homo sapiens
cagcuccacaguguu

SEQ ID NO: 1723322 - RNA, 20 nt, Homo sapiens
cagcuuuccucaucaggcca

SEQ ID NO: 1723323 - RNA, 14 nt, Homo sapiens
caggaacucaauaa

SEQ ID NO: 1723324 - RNA, 12 nt, Homo sapiens
caggaagcacag

SEQ ID NO: 1723325 - RNA, 18 nt, Homo sapiens
caggaagcacagguccaa

SEQ ID NO: 1723326 - RNA, 18 nt, Homo sapiens
caggagucccugccauca

SEQ ID NO: 1723327 - RNA, 18 nt, Homo sapiens
caggccauugucccugaa

SEQ ID NO: 1723328 - RNA, 18 nt, Homo sapiens
cagggauucuuccugcuu

SEQ ID NO: 1723329 - RNA, 21 nt, Homo sapiens
caguacagagccaugacucaa

SEQ ID NO: 1723330 - RNA, 20 nt, Homo sapiens
caguaugaaaagcuaucuua

SEQ ID NO: 1723331 - RNA, 16 nt, Homo sapiens
cagugagagacuccau

SEQ ID NO: 1723332 - RNA, 16 nt, Homo sapiens
cauaauucacacauua

SEQ ID NO: 1723333 - RNA, 16 nt, Homo sapiens
cauagagauaugcaca

SEQ ID NO: 1723334 - RNA, 13 nt, Homo sapiens
cauagagugugau

SEQ ID NO: 1723335 - RNA, 16 nt, Homo sapiens
cauagagugugaugua

SEQ ID NO: 1723336 - RNA, 21 nt, Homo sapiens
caucagugcacacggaugcac

SEQ ID NO: 1723337 - RNA, 13 nt, Homo sapiens
caucucaagcaag

SEQ ID NO: 1723338 - RNA, 23 nt, Homo sapiens
caucucuuuaccuccuaauucca

SEQ ID NO: 1723339 - RNA, 20 nt, Homo sapiens
caucuggauaucaaggugga

SEQ ID NO: 1723340 - RNA, 15 nt, Homo sapiens
caucuguaugcuggu

SEQ ID NO: 1723341 - RNA, 16 nt, Homo sapiens
caugaacacacaugga

SEQ ID NO: 1723342 - RNA, 16 nt, Homo sapiens
caugcauuucaauaaa

SEQ ID NO: 1723343 - RNA, 22 nt, Homo sapiens
caugcuugcauuauauuuguaa

SEQ ID NO: 1723344 - RNA, 21 nt, Homo sapiens
cauggagagagacucaaagag

SEQ ID NO: 1723345 - RNA, 14 nt, Homo sapiens
cauggaugagcaca

SEQ ID NO: 1723346 - RNA, 16 nt, Homo sapiens
cauggggcugauugua

SEQ ID NO: 1723347 - RNA, 21 nt, Homo sapiens
cauuggaccuuuccugaggaa

SEQ ID NO: 1723348 - RNA, 12 nt, Homo sapiens
cauugguguuga

SEQ ID NO: 1723349 - RNA, 12 nt, Homo sapiens
cauugucccuga

SEQ ID NO: 1723350 - RNA, 15 nt, Homo sapiens
cauuuaaaccaguau

SEQ ID NO: 1723351 - RNA, 23 nt, Homo sapiens
cauuuaaugauugauuauaucau

SEQ ID NO: 1723352 - RNA, 21 nt, Homo sapiens
cauuucucuugcucaccaaga

SEQ ID NO: 1723353 - RNA, 16 nt, Homo sapiens
ccaagaaguaacaaaa

SEQ ID NO: 1723354 - RNA, 15 nt, Homo sapiens
ccaagauucaaagag

SEQ ID NO: 1723355 - RNA, 18 nt, Homo sapiens
ccaaugcacacacacaga

SEQ ID NO: 1723356 - RNA, 21 nt, Homo sapiens
ccaaugcacgcacacaucagu

SEQ ID NO: 1723357 - RNA, 20 nt, Homo sapiens
ccaaugcgcacacacaccga

SEQ ID NO: 1723358 - RNA, 14 nt, Homo sapiens
ccacaaaguuucag

SEQ ID NO: 1723359 - RNA, 20 nt, Homo sapiens
ccacacgacugcaacauaca

SEQ ID NO: 1723360 - RNA, 16 nt, Homo sapiens
ccacucuucacaggcu

SEQ ID NO: 1723361 - RNA, 18 nt, Homo sapiens
ccagaaugccuccugcag

SEQ ID NO: 1723362 - RNA, 21 nt, Homo sapiens
ccagagguaagaauagaauuu

SEQ ID NO: 1723363 - RNA, 23 nt, Homo sapiens
ccagauguguaucagauguuuca

SEQ ID NO: 1723364 - RNA, 20 nt, Homo sapiens
ccagccugggcaacagagca

SEQ ID NO: 1723365 - RNA, 17 nt, Homo sapiens
ccaggauggcgcaggaa

SEQ ID NO: 1723366 - RNA, 18 nt, Homo sapiens
ccaugaaagacuucucua

SEQ ID NO: 1723367 - RNA, 17 nt, Homo sapiens
ccauucauccuuuaaga

SEQ ID NO: 1723368 - RNA, 15 nt, Homo sapiens
ccauugguguugaca

SEQ ID NO: 1723369 - RNA, 13 nt, Homo sapiens
ccauuugauuuga

SEQ ID NO: 1723370 - RNA, 19 nt, Homo sapiens
cccacuuggcaucauucac

SEQ ID NO: 1723371 - RNA, 22 nt, Homo sapiens
cccagagguaagaauagaauuu

SEQ ID NO: 1723372 - RNA, 17 nt, Homo sapiens
cccagcucagugccaca

SEQ ID NO: 1723373 - RNA, 16 nt, Homo sapiens
cccuaaagaacauacc

SEQ ID NO: 1723374 - RNA, 15 nt, Homo sapiens
cccugccagccugaa

SEQ ID NO: 1723375 - RNA, 17 nt, Homo sapiens
ccgauguacacacacag

SEQ ID NO: 1723376 - RNA, 18 nt, Homo sapiens
ccgauguacacacacaga

SEQ ID NO: 1723377 - RNA, 19 nt, Homo sapiens
ccgaugugcgcacacacag

SEQ ID NO: 1723378 - RNA, 14 nt, Homo sapiens
ccuacaaaugacag

SEQ ID NO: 1723379 - RNA, 22 nt, Homo sapiens
ccucacugcuguagacauuugc

SEQ ID NO: 1723380 - RNA, 16 nt, Homo sapiens
ccucagugagaagcca

SEQ ID NO: 1723381 - RNA, 13 nt, Homo sapiens
ccucccucaggcc

SEQ ID NO: 1723382 - RNA, 17 nt, Homo sapiens
ccucuuggcugccuugu

SEQ ID NO: 1723383 - RNA, 14 nt, Homo sapiens
ccugagacauauua

SEQ ID NO: 1723384 - RNA, 23 nt, Homo sapiens
ccuuccccucacacuccuaaaau

SEQ ID NO: 1723385 - RNA, 12 nt, Homo sapiens
ccuucuaccucu

SEQ ID NO: 1723386 - RNA, 23 nt, Homo sapiens
ccuuggugugcuguauccaucca

SEQ ID NO: 1723387 - RNA, 20 nt, Homo sapiens
ccuugucguaggaaaaccau

SEQ ID NO: 1723388 - RNA, 12 nt, Homo sapiens
ccuuuugcaaau

SEQ ID NO: 1723389 - RNA, 18 nt, Homo sapiens
cgacguuugacuagccau

SEQ ID NO: 1723390 - RNA, 19 nt, Homo sapiens
cgacguuugacuagccauc

SEQ ID NO: 1723391 - RNA, 22 nt, Homo sapiens
cgacguuugacuagccaucuca

SEQ ID NO: 1723392 - RNA, 15 nt, Homo sapiens
cgaugcacacgcaca

SEQ ID NO: 1723393 - RNA, 19 nt, Homo sapiens
cgaugugcgcacacacaga

SEQ ID NO: 1723394 - RNA, 15 nt, Homo sapiens
cgcaaacacaccgau

SEQ ID NO: 1723395 - RNA, 17 nt, Homo sapiens
cggaugcacacacagau

SEQ ID NO: 1723396 - RNA, 18 nt, Homo sapiens
cggccuccugucccucau

SEQ ID NO: 1723397 - RNA, 14 nt, Homo sapiens
cguuugacuagcca

SEQ ID NO: 1723398 - RNA, 21 nt, Homo sapiens
cuaaaaaauuccuaggugcua

SEQ ID NO: 1723399 - RNA, 15 nt, Homo sapiens
cuaaaaaugcaaaaa

SEQ ID NO: 1723400 - RNA, 17 nt, Homo sapiens
cuaaaauuauggaaaca

SEQ ID NO: 1723401 - RNA, 15 nt, Homo sapiens
cuaaguaugaucuau

SEQ ID NO: 1723402 - RNA, 16 nt, Homo sapiens
cuaaucuaaacuguag

SEQ ID NO: 1723403 - RNA, 17 nt, Homo sapiens
cuaaugaggcauuacaa

SEQ ID NO: 1723404 - RNA, 20 nt, Homo sapiens
cuacacuuuuuuggucuguu

SEQ ID NO: 1723405 - RNA, 19 nt, Homo sapiens
cuacccaucuuaaaaacaa

SEQ ID NO: 1723406 - RNA, 14 nt, Homo sapiens
cuagaacaaacuaa

SEQ ID NO: 1723407 - RNA, 14 nt, Homo sapiens
cuagccaucucaag

SEQ ID NO: 1723408 - RNA, 17 nt, Homo sapiens
cuaggaaaauuauucua

SEQ ID NO: 1723409 - RNA, 18 nt, Homo sapiens
cuauuaguccccacccaa

SEQ ID NO: 1723410 - RNA, 15 nt, Homo sapiens
cuauucuacuuuaaa

SEQ ID NO: 1723411 - RNA, 22 nt, Homo sapiens
cuauuggacaauggacuugcaa

SEQ ID NO: 1723412 - RNA, 13 nt, Homo sapiens
cucaaacaaaagu

SEQ ID NO: 1723413 - RNA, 12 nt, Homo sapiens
cucaagugccau

SEQ ID NO: 1723414 - RNA, 14 nt, Homo sapiens
cucaaucuagaaca

SEQ ID NO: 1723415 - RNA, 15 nt, Homo sapiens
cucagaucauuauca

SEQ ID NO: 1723416 - RNA, 16 nt, Homo sapiens
cucaggggucauucau

SEQ ID NO: 1723417 - RNA, 13 nt, Homo sapiens
cucagugccacaa

SEQ ID NO: 1723418 - RNA, 15 nt, Homo sapiens
cucauuccagaggaa

SEQ ID NO: 1723419 - RNA, 13 nt, Homo sapiens
cuccacaguguug

SEQ ID NO: 1723420 - RNA, 18 nt, Homo sapiens
cuccauugguguugacau

SEQ ID NO: 1723421 - RNA, 14 nt, Homo sapiens
cucuacaaccuaaa

SEQ ID NO: 1723422 - RNA, 17 nt, Homo sapiens
cucuacccaucuuaaaa

SEQ ID NO: 1723423 - RNA, 12 nt, Homo sapiens
cucuacccugag

SEQ ID NO: 1723424 - RNA, 20 nt, Homo sapiens
cucucacuaaguaugaucua

SEQ ID NO: 1723425 - RNA, 22 nt, Homo sapiens
cugaaaucuacaggccucaggg

SEQ ID NO: 1723426 - RNA, 13 nt, Homo sapiens
cugaauagaaaca

SEQ ID NO: 1723427 - RNA, 16 nt, Homo sapiens
cugaaucaguuauuau

SEQ ID NO: 1723428 - RNA, 21 nt, Homo sapiens
cugcaugggaaaaauguugga

SEQ ID NO: 1723429 - RNA, 23 nt, Homo sapiens
cugccuccuuuccccucccucag

SEQ ID NO: 1723430 - RNA, 16 nt, Homo sapiens
cuggcuucuuucacuu

SEQ ID NO: 1723431 - RNA, 21 nt, Homo sapiens
cugggugccgggcugcacaga

SEQ ID NO: 1723432 - RNA, 15 nt, Homo sapiens
cuguauuagcagcaa

SEQ ID NO: 1723433 - RNA, 20 nt, Homo sapiens
cugucaaagaaaacuuccaa

SEQ ID NO: 1723434 - RNA, 22 nt, Homo sapiens
uuauuuacaaauguuuugcuca

SEQ ID NO: 1723435 - RNA, 14 nt, Homo sapiens
uucagauuugccuu

SEQ ID NO: 1723436 - RNA, 15 nt, Homo sapiens
uucagauuugccuua

SEQ ID NO: 1723437 - RNA, 12 nt, Homo sapiens
uucauuaccuca

SEQ ID NO: 1723438 - RNA, 17 nt, Homo sapiens
uucauuuuucuaauaau

SEQ ID NO: 1723439 - RNA, 14 nt, Homo sapiens
uuccaguggaugag

SEQ ID NO: 1723440 - RNA, 14 nt, Homo sapiens
uuccgaaacauaca

SEQ ID NO: 1723441 - RNA, 21 nt, Homo sapiens
uucuaauaaucauaaacuaua

SEQ ID NO: 1723442 - RNA, 15 nt, Homo sapiens
uucuauuaagauaua

SEQ ID NO: 1723443 - RNA, 18 nt, Homo sapiens
uucugcacaguguuccca

SEQ ID NO: 1723444 - RNA, 23 nt, Homo sapiens
uucuguugugauauaaaucacag

SEQ ID NO: 1723445 - RNA, 18 nt, Homo sapiens
uucuuauccuuuguacug

SEQ ID NO: 1723446 - RNA, 13 nt, Homo sapiens
uugaaacauaucu

SEQ ID NO: 1723447 - RNA, 13 nt, Homo sapiens
uugcaggugccaa

SEQ ID NO: 1723448 - RNA, 20 nt, Homo sapiens
uugccuuauuggcagcucua

SEQ ID NO: 1723449 - RNA, 16 nt, Homo sapiens
uugcgagaauuuucaa

SEQ ID NO: 1723450 - RNA, 14 nt, Homo sapiens
uuggacaaccucau

SEQ ID NO: 1723451 - RNA, 16 nt, Homo sapiens
uuggcagcucuacucu

SEQ ID NO: 1723452 - RNA, 16 nt, Homo sapiens
uugugauguguccuga

SEQ ID NO: 1723453 - RNA, 17 nt, Homo sapiens
uuuaagguaaaacucac

SEQ ID NO: 1723454 - RNA, 22 nt, Homo sapiens
uuuaggacuguauuuccaaauu

SEQ ID NO: 1723455 - RNA, 11 nt, Homo sapiens
uuuaugguucu

SEQ ID NO: 1723456 - RNA, 12 nt, Homo sapiens
uuuaugguucuc

SEQ ID NO: 1723457 - RNA, 16 nt, Homo sapiens
uuuauuuuucucauga

SEQ ID NO: 1723458 - RNA, 19 nt, Homo sapiens
uuucaacuuuguuccuaaa

SEQ ID NO: 1723459 - RNA, 23 nt, Homo sapiens
uuucaauacacucaagugccauu

SEQ ID NO: 1723460 - RNA, 16 nt, Homo sapiens
uuucaauuuuaaacau

SEQ ID NO: 1723461 - RNA, 13 nt, Homo sapiens
uuucauacauuau

SEQ ID NO: 1723462 - RNA, 22 nt, Homo sapiens
uuucauacauuauauuccucua

SEQ ID NO: 1723463 - RNA, 16 nt, Homo sapiens
uuucgacguuugacua

SEQ ID NO: 1723464 - RNA, 22 nt, Homo sapiens
uuucucuugcucaccaagaagu

SEQ ID NO: 1723465 - RNA, 14 nt, Homo sapiens
uuugacuagccauc

SEQ ID NO: 1723466 - RNA, 22 nt, Homo sapiens
uuugacuagccaucucaagcaa

SEQ ID NO: 1723467 - RNA, 23 nt, Homo sapiens
uuugauuuucgacguuugacuag

SEQ ID NO: 1723468 - RNA, 11 nt, Homo sapiens
uuuggggcuca

SEQ ID NO: 1723469 - RNA, 13 nt, Homo sapiens
uuuguuccaugag

SEQ ID NO: 1723470 - RNA, 23 nt, Homo sapiens
uuuugcaaauaguagaguaucag

SEQ ID NO: 1723471 - RNA, 17 nt, Homo sapiens
uaauaaaugaaugucac

SEQ ID NO: 1723472 - RNA, 15 nt, Homo sapiens
uaauaaugacucuaa

SEQ ID NO: 1723473 - RNA, 18 nt, Homo sapiens
uaaucaaugaucaucuca

SEQ ID NO: 1723474 - RNA, 19 nt, Homo sapiens
uaaucaaugaucaucucac

SEQ ID NO: 1723475 - RNA, 16 nt, Homo sapiens
uaaucugagaggccac

SEQ ID NO: 1723476 - RNA, 17 nt, Homo sapiens
uaaugugcugugugaca

SEQ ID NO: 1723477 - RNA, 23 nt, Homo sapiens
uaauuccacacccucacugcugu

SEQ ID NO: 1723478 - RNA, 10 nt, Homo sapiens
uacaaaagga

SEQ ID NO: 1723479 - RNA, 12 nt, Homo sapiens
uacaaaugacag

SEQ ID NO: 1723480 - RNA, 19 nt, Homo sapiens
uacaaccuaaaaaauuccu

SEQ ID NO: 1723481 - RNA, 14 nt, Homo sapiens
uacacacacagaug

SEQ ID NO: 1723482 - RNA, 19 nt, Homo sapiens
uacacacacagaugcacac

SEQ ID NO: 1723483 - RNA, 14 nt, Homo sapiens
uacagaggacagua

SEQ ID NO: 1723484 - RNA, 16 nt, Homo sapiens
uacauuauauuccucu

SEQ ID NO: 1723485 - RNA, 14 nt, Homo sapiens
uaccacaauucauu

SEQ ID NO: 1723486 - RNA, 22 nt, Homo sapiens
uaccacaauucauuuacccauu

SEQ ID NO: 1723487 - RNA, 17 nt, Homo sapiens
uaccacuuuugcaaaua

SEQ ID NO: 1723488 - RNA, 15 nt, Homo sapiens
uaccagcaucuccca

SEQ ID NO: 1723489 - RNA, 23 nt, Homo sapiens
uaccuccuaauuccacacccuca

SEQ ID NO: 1723490 - RNA, 15 nt, Homo sapiens
uaccuucuaccucuu

SEQ ID NO: 1723491 - RNA, 22 nt, Homo sapiens
uacuauauuuauugauuucaag

SEQ ID NO: 1723492 - RNA, 18 nt, Homo sapiens
uagaauuuacaacuuaua

SEQ ID NO: 1723493 - RNA, 15 nt, Homo sapiens
uagagacacagagau

SEQ ID NO: 1723494 - RNA, 13 nt, Homo sapiens
uagagauaugcac

SEQ ID NO: 1723495 - RNA, 15 nt, Homo sapiens
uagagauaugcacac

SEQ ID NO: 1723496 - RNA, 17 nt, Homo sapiens
uagagauaugcacacac

SEQ ID NO: 1723497 - RNA, 14 nt, Homo sapiens
uagagcugccugug

SEQ ID NO: 1723498 - RNA, 14 nt, Homo sapiens
uagaugaacucuuc

SEQ ID NO: 1723499 - RNA, 22 nt, Homo sapiens
uagauguaugcacacacauaua

SEQ ID NO: 1723500 - RNA, 14 nt, Homo sapiens
uagauuuuugcucu

SEQ ID NO: 1723501 - RNA, 18 nt, Homo sapiens
uagcaccuccacauaccu

SEQ ID NO: 1723502 - RNA, 15 nt, Homo sapiens
uagccaucucaagca

SEQ ID NO: 1723503 - RNA, 15 nt, Homo sapiens
uagccuuugucccag

SEQ ID NO: 1723504 - RNA, 20 nt, Homo sapiens
uaggccagcaccaucucuuu

SEQ ID NO: 1723505 - RNA, 17 nt, Homo sapiens
uagguugaaacauaucu

SEQ ID NO: 1723506 - RNA, 14 nt, Homo sapiens
uauaccacaauuca

SEQ ID NO: 1723507 - RNA, 17 nt, Homo sapiens
uauauuuauugauuuca

SEQ ID NO: 1723508 - RNA, 18 nt, Homo sapiens
uaucagauguuucacuga

SEQ ID NO: 1723509 - RNA, 13 nt, Homo sapiens
uaucauucugcuu

SEQ ID NO: 1723510 - RNA, 23 nt, Homo sapiens
uauccuuuucuauuaagauauau

SEQ ID NO: 1723511 - RNA, 13 nt, Homo sapiens
uaucguaucauug

SEQ ID NO: 1723512 - RNA, 15 nt, Homo sapiens
uaugaaaagcuaucu

SEQ ID NO: 1723513 - RNA, 18 nt, Homo sapiens
uaugaaaagcuaucuuaa

SEQ ID NO: 1723514 - RNA, 13 nt, Homo sapiens
uaugaauucauuc

SEQ ID NO: 1723515 - RNA, 18 nt, Homo sapiens
uaugcacacacagaugca

SEQ ID NO: 1723516 - RNA, 22 nt, Homo sapiens
uauguauuaaaauaucccaagc

SEQ ID NO: 1723517 - RNA, 13 nt, Homo sapiens
uauuaaauaugaa

SEQ ID NO: 1723518 - RNA, 16 nt, Homo sapiens
uauuaauuaaaccaga

SEQ ID NO: 1723519 - RNA, 21 nt, Homo sapiens
uauuagagcugccugugccuu

SEQ ID NO: 1723520 - RNA, 14 nt, Homo sapiens
uauuccaagggaau

SEQ ID NO: 1723521 - RNA, 14 nt, Homo sapiens
uauuggcagcucua

SEQ ID NO: 1723522 - RNA, 19 nt, Homo sapiens
uauugguuugagaacuucu

SEQ ID NO: 1723523 - RNA, 16 nt, Homo sapiens
uauuuugagauucaua

SEQ ID NO: 1723524 - RNA, 14 nt, Homo sapiens
uauuuuucucauga

SEQ ID NO: 1723525 - RNA, 16 nt, Homo sapiens
uauuuuuuucccaagg

SEQ ID NO: 1723526 - RNA, 19 nt, Homo sapiens
ucaaagaaaacuuccaaaa

SEQ ID NO: 1723527 - RNA, 20 nt, Homo sapiens
ucaacagugagagacuccau

SEQ ID NO: 1723528 - RNA, 22 nt, Homo sapiens
ucaagcagacgugagugugacu

SEQ ID NO: 1723529 - RNA, 15 nt, Homo sapiens
ucaaguucaccagca

SEQ ID NO: 1723530 - RNA, 16 nt, Homo sapiens
ucaaugaucaucucac

SEQ ID NO: 1723531 - RNA, 17 nt, Homo sapiens
ucaauuuuaaacauauc

SEQ ID NO: 1723532 - RNA, 20 nt, Homo sapiens
ucacagcaagucacuggcca

SEQ ID NO: 1723533 - RNA, 12 nt, Homo sapiens
ucacuuugcaua

SEQ ID NO: 1723534 - RNA, 15 nt, Homo sapiens
ucagaaguacauuaa

SEQ ID NO: 1723535 - RNA, 18 nt, Homo sapiens
ucagauucuugcugugac

SEQ ID NO: 1723536 - RNA, 12 nt, Homo sapiens
ucagauuugccu

SEQ ID NO: 1723537 - RNA, 18 nt, Homo sapiens
ucaggccauugucccuga

SEQ ID NO: 1723538 - RNA, 11 nt, Homo sapiens
ucaguaugugg

SEQ ID NO: 1723539 - RNA, 21 nt, Homo sapiens
ucagugcacacggaugcacag

SEQ ID NO: 1723540 - RNA, 13 nt, Homo sapiens
ucauaaacuauau

SEQ ID NO: 1723541 - RNA, 16 nt, Homo sapiens
ucauaaacuauauucu

SEQ ID NO: 1723542 - RNA, 19 nt, Homo sapiens
ucauguuuacagaggacag

SEQ ID NO: 1723543 - RNA, 15 nt, Homo sapiens
ucauuaucaccuucc

SEQ ID NO: 1723544 - RNA, 22 nt, Homo sapiens
ucauucuuuuaaauguugaaua

SEQ ID NO: 1723545 - RNA, 16 nt, Homo sapiens
ucauugaaacuacacu

SEQ ID NO: 1723546 - RNA, 17 nt, Homo sapiens
uccacacccucacugcu

SEQ ID NO: 1723547 - RNA, 14 nt, Homo sapiens
uccacagaguauaa

SEQ ID NO: 1723548 - RNA, 15 nt, Homo sapiens
uccacccacucuuca

SEQ ID NO: 1723549 - RNA, 17 nt, Homo sapiens
ucccuaaagaacauacc

SEQ ID NO: 1723550 - RNA, 20 nt, Homo sapiens
ucccugaagagaagggcagg

SEQ ID NO: 1723551 - RNA, 19 nt, Homo sapiens
uccggccuccugucccuca

SEQ ID NO: 1723552 - RNA, 18 nt, Homo sapiens
uccuacucaacaaaagga

SEQ ID NO: 1723553 - RNA, 15 nt, Homo sapiens
uccuaggugcuauuu

SEQ ID NO: 1723554 - RNA, 22 nt, Homo sapiens
uccucaaagggagagagugcua

SEQ ID NO: 1723555 - RNA, 13 nt, Homo sapiens
uccugucccucau

SEQ ID NO: 1723556 - RNA, 23 nt, Homo sapiens
uccuuuaagaaaaacaucuggau

SEQ ID NO: 1723557 - RNA, 17 nt, Homo sapiens
uccuuuccccucccuca

SEQ ID NO: 1723558 - RNA, 13 nt, Homo sapiens
uccuuuucuauua

SEQ ID NO: 1723559 - RNA, 18 nt, Homo sapiens
ucgacguuugacuagcca

SEQ ID NO: 1723560 - RNA, 15 nt, Homo sapiens
ucguuaaagcaaagc

SEQ ID NO: 1723561 - RNA, 14 nt, Homo sapiens
ucuaaaacucucaa

SEQ ID NO: 1723562 - RNA, 13 nt, Homo sapiens
ucucaagcaaguu

SEQ ID NO: 1723563 - RNA, 12 nt, Homo sapiens
ucucuguuacac

SEQ ID NO: 1723564 - RNA, 15 nt, Homo sapiens
ucucuuuaccuccua

SEQ ID NO: 1723565 - RNA, 19 nt, Homo sapiens
ucugcaaccuugaagacua

SEQ ID NO: 1723566 - RNA, 19 nt, Homo sapiens
ucugggaaaaagugcacgu

SEQ ID NO: 1723567 - RNA, 21 nt, Homo sapiens
ucugucaaagaaaacuuccaa

SEQ ID NO: 1723568 - RNA, 20 nt, Homo sapiens
ucuucacuucagacaauuca

SEQ ID NO: 1723569 - RNA, 12 nt, Homo sapiens
ucuucauggaau

SEQ ID NO: 1723570 - RNA, 14 nt, Homo sapiens
ucuucauuaccuca

SEQ ID NO: 1723571 - RNA, 15 nt, Homo sapiens
ucuucauuaccucag

SEQ ID NO: 1723572 - RNA, 22 nt, Homo sapiens
ucuucuauggguuggacaaccu

SEQ ID NO: 1723573 - RNA, 21 nt, Homo sapiens
ucuuucccuaaagaacauacc

SEQ ID NO: 1723574 - RNA, 16 nt, Homo sapiens
ugaaaaccagaacaaa

SEQ ID NO: 1723575 - RNA, 14 nt, Homo sapiens
ugaacacacaugga

SEQ ID NO: 1723576 - RNA, 15 nt, Homo sapiens
ugaacacacauggau

SEQ ID NO: 1723577 - RNA, 21 nt, Homo sapiens
ugaacacacauggaugcacac

SEQ ID NO: 1723578 - RNA, 12 nt, Homo sapiens
ugaacauuucau

SEQ ID NO: 1723579 - RNA, 15 nt, Homo sapiens
ugacuaacuuuuuga

SEQ ID NO: 1723580 - RNA, 12 nt, Homo sapiens
ugacuagccauc

SEQ ID NO: 1723581 - RNA, 19 nt, Homo sapiens
ugacuagccaucucaagca

SEQ ID NO: 1723582 - RNA, 19 nt, Homo sapiens
ugagaggccacagugcaau

SEQ ID NO: 1723583 - RNA, 17 nt, Homo sapiens
ugagcuggggaugucuc

SEQ ID NO: 1723584 - RNA, 13 nt, Homo sapiens
ugaggacauggag

SEQ ID NO: 1723585 - RNA, 22 nt, Homo sapiens
ugaggacauggagagagacuca

SEQ ID NO: 1723586 - RNA, 20 nt, Homo sapiens
ugaggagauaacauuucaac

SEQ ID NO: 1723587 - RNA, 14 nt, Homo sapiens
ugaggccucucauu

SEQ ID NO: 1723588 - RNA, 15 nt, Homo sapiens
ugaggggcucucuca

SEQ ID NO: 1723589 - RNA, 18 nt, Homo sapiens
ugaggggcucucucauga

SEQ ID NO: 1723590 - RNA, 15 nt, Homo sapiens
ugaucuaugcuauau

SEQ ID NO: 1723591 - RNA, 22 nt, Homo sapiens
ugauugcuuccacccacacgac

SEQ ID NO: 1723592 - RNA, 16 nt, Homo sapiens
ugauuucaagucuucu

SEQ ID NO: 1723593 - RNA, 18 nt, Homo sapiens
ugcaaccuugaagacuau

SEQ ID NO: 1723594 - RNA, 14 nt, Homo sapiens
ugcacacacacaga

SEQ ID NO: 1723595 - RNA, 17 nt, Homo sapiens
ugcacacacacagagau

SEQ ID NO: 1723596 - RNA, 21 nt, Homo sapiens
ugcacacacacagagauaugc

SEQ ID NO: 1723597 - RNA, 23 nt, Homo sapiens
ugcacacacacagagauaugcac

SEQ ID NO: 1723598 - RNA, 12 nt, Homo sapiens
ugcacacacaga

SEQ ID NO: 1723599 - RNA, 16 nt, Homo sapiens
ugcacacacagaugca

SEQ ID NO: 1723600 - RNA, 19 nt, Homo sapiens
ugcacacacagaugcacac

SEQ ID NO: 1723601 - RNA, 12 nt, Homo sapiens
ugcacacgcaca

SEQ ID NO: 1723602 - RNA, 17 nt, Homo sapiens
ugcacacggaugcacag

SEQ ID NO: 1723603 - RNA, 17 nt, Homo sapiens
ugcacagagauaugcac

SEQ ID NO: 1723604 - RNA, 20 nt, Homo sapiens
ugcacgcacaugccaaugca

SEQ ID NO: 1723605 - RNA, 21 nt, Homo sapiens
ugcaggagucccugccaucau

SEQ ID NO: 1723606 - RNA, 19 nt, Homo sapiens
ugcaguacaggacauauau

SEQ ID NO: 1723607 - RNA, 15 nt, Homo sapiens
ugcaugaaagacaga

SEQ ID NO: 1723608 - RNA, 22 nt, Homo sapiens
ugcauuuccuucuuaacucucu

SEQ ID NO: 1723609 - RNA, 23 nt, Homo sapiens
ugccaaacaugagagcccagaaa

SEQ ID NO: 1723610 - RNA, 18 nt, Homo sapiens
ugccagggccaugucaga

SEQ ID NO: 1723611 - RNA, 16 nt, Homo sapiens
ugccuuggugugcugu

SEQ ID NO: 1723612 - RNA, 16 nt, Homo sapiens
ugcgcacacacagaua

SEQ ID NO: 1723613 - RNA, 19 nt, Homo sapiens
ugcgcacacacagauaugc

SEQ ID NO: 1723614 - RNA, 21 nt, Homo sapiens
ugcgcacacacagauaugcac

SEQ ID NO: 1723615 - RNA, 19 nt, Homo sapiens
ugcuauuguagagccagag

SEQ ID NO: 1723616 - RNA, 21 nt, Homo sapiens
ugcuauuguagagccagaggu

SEQ ID NO: 1723617 - RNA, 18 nt, Homo sapiens
ugcuguagacauuugcua

SEQ ID NO: 1723618 - RNA, 21 nt, Homo sapiens
ugcuguagacauuugcuauga

SEQ ID NO: 1723619 - RNA, 18 nt, Homo sapiens
ugcuguauccauccaugg

SEQ ID NO: 1723620 - RNA, 18 nt, Homo sapiens
uggaauuagaaauauauc

SEQ ID NO: 1723621 - RNA, 14 nt, Homo sapiens
uggagaacauucaa

SEQ ID NO: 1723622 - RNA, 14 nt, Homo sapiens
uggaugcacgcaca

SEQ ID NO: 1723623 - RNA, 22 nt, Homo sapiens
uggccuguucuucuauggguug

SEQ ID NO: 1723624 - RNA, 17 nt, Homo sapiens
ugggauuggcugugaac

SEQ ID NO: 1723625 - RNA, 18 nt, Homo sapiens
ugggcaggguacagacac

SEQ ID NO: 1723626 - RNA, 22 nt, Homo sapiens
ugggccacucaggggucauuca

SEQ ID NO: 1723627 - RNA, 14 nt, Homo sapiens
ugggucaguuguau

SEQ ID NO: 1723628 - RNA, 20 nt, Homo sapiens
ugggugccgggcugcacaga

SEQ ID NO: 1723629 - RNA, 20 nt, Homo sapiens
uggucacacagagauacgca

SEQ ID NO: 1723630 - RNA, 18 nt, Homo sapiens
uggugauuccgcagugag

SEQ ID NO: 1723631 - RNA, 15 nt, Homo sapiens
uguaaugcacacuua

SEQ ID NO: 1723632 - RNA, 23 nt, Homo sapiens
uguacacacacagaugcacacac

SEQ ID NO: 1723633 - RNA, 20 nt, Homo sapiens
uguaccacuuuugcaaauaa

SEQ ID NO: 1723634 - RNA, 23 nt, Homo sapiens
uguauauguagauguaugcacac

SEQ ID NO: 1723635 - RNA, 19 nt, Homo sapiens
uguauccauccauggggcu

SEQ ID NO: 1723636 - RNA, 14 nt, Homo sapiens
ugucacaaugcucc

SEQ ID NO: 1723637 - RNA, 15 nt, Homo sapiens
ugucccucauccaua

SEQ ID NO: 1723638 - RNA, 16 nt, Homo sapiens
uguccuggcaccaaau

SEQ ID NO: 1723639 - RNA, 12 nt, Homo sapiens
ugucucucauga

SEQ ID NO: 1723640 - RNA, 19 nt, Homo sapiens
ugucugggaaaaagugcac

SEQ ID NO: 1723641 - RNA, 16 nt, Homo sapiens
ugugauggcaaagaag

SEQ ID NO: 1723642 - RNA, 18 nt, Homo sapiens
ugugccuuggugugcugu

SEQ ID NO: 1723643 - RNA, 13 nt, Homo sapiens
ugugcgcacacac

SEQ ID NO: 1723644 - RNA, 16 nt, Homo sapiens
ugugcuagacuguaag

SEQ ID NO: 1723645 - RNA, 21 nt, Homo sapiens
uguggggagggauuuggggcu

SEQ ID NO: 1723646 - RNA, 22 nt, Homo sapiens
uguguaauaaauauguuucaca

SEQ ID NO: 1723647 - RNA, 15 nt, Homo sapiens
uguuccuaaauauau

SEQ ID NO: 1723648 - RNA, 16 nt, Homo sapiens
uuaaaaguccacuuuu

SEQ ID NO: 1723649 - RNA, 14 nt, Homo sapiens
uuaacccuucacaa

SEQ ID NO: 1723650 - RNA, 19 nt, Homo sapiens
uuaagagagugaacauauc

SEQ ID NO: 1723651 - RNA, 20 nt, Homo sapiens
uuaaucaaugaucaucucac

SEQ ID NO: 1723652 - RNA, 23 nt, Homo sapiens
uuacacgucauugaaacuacacu

SEQ ID NO: 1723653 - RNA, 20 nt, Homo sapiens
uuaccuucuaccucuuggcu

SEQ ID NO: 1723654 - RNA, 19 nt, Homo sapiens
uuaggcuucuauuuccuuu

SEQ ID NO: 1723655 - RNA, 16 nt, Homo sapiens
uuaugugaauggaauc

SEQ ID NO: 1723656 - RNA, 23 nt, Homo sapiens
uuauuugaggagauaacauuuca

SEQ ID NO: 1723657 - RNA, 15 nt, Homo sapiens
uuauuuuuuucccaa

SEQ ID NO: 1723658 - RNA, 12 nt, Homo sapiens
uucaaaauucaa

SEQ ID NO: 1723659 - RNA, 15 nt, Homo sapiens
uuccaaauuacugau

SEQ ID NO: 1723660 - RNA, 21 nt, Homo sapiens
uuccacacccucacugcugua

SEQ ID NO: 1723661 - RNA, 21 nt, Homo sapiens
uuccaggagccuggcaccuuu

SEQ ID NO: 1723662 - RNA, 20 nt, Homo sapiens
uucccugauuuaauaugcaa

SEQ ID NO: 1723663 - RNA, 16 nt, Homo sapiens
uucgacguuugacuag

SEQ ID NO: 1723664 - RNA, 20 nt, Homo sapiens
uucgacguuugacuagccau

SEQ ID NO: 1723665 - RNA, 23 nt, Homo sapiens
uucgacguuugacuagccaucuc

SEQ ID NO: 1723666 - RNA, 20 nt, Homo sapiens
uucuaccucuuggcugccuu

SEQ ID NO: 1723667 - RNA, 14 nt, Homo sapiens
uucuagcuaccugu

SEQ ID NO: 1723668 - RNA, 21 nt, Homo sapiens
uucuauggguuggacaaccuc

SEQ ID NO: 1723669 - RNA, 19 nt, Homo sapiens
uucuuucccuaaagaacau

SEQ ID NO: 1723670 - RNA, 15 nt, Homo sapiens
uugaaguacaaaagg

SEQ ID NO: 1723671 - RNA, 22 nt, Homo sapiens
uugaaucuaccauucauagcca

SEQ ID NO: 1723672 - RNA, 22 nt, Homo sapiens
uugauuauaucauuuuguggau

SEQ ID NO: 1723673 - RNA, 14 nt, Homo sapiens
uugcucaaguucac

SEQ ID NO: 1723674 - RNA, 23 nt, Homo sapiens
uuggcagcucuacucuggagguu

SEQ ID NO: 1723675 - RNA, 14 nt, Homo sapiens
uugucaauuaccag

SEQ ID NO: 1723676 - RNA, 22 nt, Homo sapiens
uugucacuugggugccaaacau

SEQ ID NO: 1723677 - RNA, 14 nt, Homo sapiens
uuguuuuaagccaa

SEQ ID NO: 1723678 - RNA, 20 nt, Homo sapiens
uuuaaucaaugaucaucuca

SEQ ID NO: 1723679 - RNA, 21 nt, Homo sapiens
uuuaguugacuaaugaggcau

SEQ ID NO: 1723680 - RNA, 20 nt, Homo sapiens
uuuaucugaacagagagaua

SEQ ID NO: 1723681 - RNA, 12 nt, Homo sapiens
uuuauugagaua

SEQ ID NO: 1723682 - RNA, 16 nt, Homo sapiens
uuuauugauucaccuc

SEQ ID NO: 1723683 - RNA, 14 nt, Homo sapiens
uuucaaaagagauu

SEQ ID NO: 1723684 - RNA, 22 nt, Homo sapiens
uuucaauacacucaagugccau

SEQ ID NO: 1723685 - RNA, 20 nt, Homo sapiens
uuucgacguuugacuagcca

SEQ ID NO: 1723686 - RNA, 15 nt, Homo sapiens
uuucuuugauuuucg

SEQ ID NO: 1723687 - RNA, 18 nt, Homo sapiens
uuuugcugcacacaaucu

SEQ ID NO: 1723688 - RNA, 23 nt, Homo sapiens
uuuuguagaugaacucuucucaa

SEQ ID NO: 1723689 - RNA, 16 nt, Homo sapiens
aaaacccucugaacuc

SEQ ID NO: 1723690 - RNA, 13 nt, Homo sapiens
aaaacuccauaac

SEQ ID NO: 1723691 - RNA, 13 nt, Homo sapiens
aaaagagauuuac

SEQ ID NO: 1723692 - RNA, 16 nt, Homo sapiens
aaaaugaagacacuca

SEQ ID NO: 1723693 - RNA, 20 nt, Homo sapiens
aaaauguuggaaugggaguc

SEQ ID NO: 1723694 - RNA, 20 nt, Homo sapiens
aaaauuaacugcuaacuucu

SEQ ID NO: 1723695 - RNA, 14 nt, Homo sapiens
aaacaaucucccaa

SEQ ID NO: 1723696 - RNA, 11 nt, Homo sapiens
aaaccaugacg

SEQ ID NO: 1723697 - RNA, 12 nt, Homo sapiens
aaacucuuccac

SEQ ID NO: 1723698 - RNA, 18 nt, Homo sapiens
aaagcagaaugugauauc

SEQ ID NO: 1723699 - RNA, 13 nt, Homo sapiens
aaagcauuuugca

SEQ ID NO: 1723700 - RNA, 15 nt, Homo sapiens
aaagcauuuugcaaa

SEQ ID NO: 1723701 - RNA, 13 nt, Homo sapiens
aaagcuaucuuaa

SEQ ID NO: 1723702 - RNA, 14 nt, Homo sapiens
aaaggacaaccaca

SEQ ID NO: 1723703 - RNA, 11 nt, Homo sapiens
aaagguccuuu

SEQ ID NO: 1723704 - RNA, 18 nt, Homo sapiens
aaauaaacugaacauauu

SEQ ID NO: 1723705 - RNA, 21 nt, Homo sapiens
aaauagcucuguggguuuuaa

SEQ ID NO: 1723706 - RNA, 21 nt, Homo sapiens
aaauauagaaaacuaaucuaa

SEQ ID NO: 1723707 - RNA, 18 nt, Homo sapiens
aaaucccauauauucuuc

SEQ ID NO: 1723708 - RNA, 20 nt, Homo sapiens
aaauguaccugagacauauu

SEQ ID NO: 1723709 - RNA, 21 nt, Homo sapiens
aaaugugauuguugaaguaca

SEQ ID NO: 1723710 - RNA, 16 nt, Homo sapiens
aaauguuuugcucaau

SEQ ID NO: 1723711 - RNA, 13 nt, Homo sapiens
aaauuacauuaaa

SEQ ID NO: 1723712 - RNA, 17 nt, Homo sapiens
aacacaccgaugcacac

SEQ ID NO: 1723713 - RNA, 19 nt, Homo sapiens
aacauucuuuccuaaauau

SEQ ID NO: 1723714 - RNA, 15 nt, Homo sapiens
aacucaaacaaaagu

SEQ ID NO: 1723715 - RNA, 15 nt, Homo sapiens
aacucucaagcagac

SEQ ID NO: 1723716 - RNA, 17 nt, Homo sapiens
aacugucaguucauccu

SEQ ID NO: 1723717 - RNA, 20 nt, Homo sapiens
aacuuccaaaaagauuuauu

SEQ ID NO: 1723718 - RNA, 17 nt, Homo sapiens
aacuugcucaagugcag

SEQ ID NO: 1723719 - RNA, 15 nt, Homo sapiens
aagaagcaacuaagu

SEQ ID NO: 1723720 - RNA, 17 nt, Homo sapiens
aagagagugaacauauc

SEQ ID NO: 1723721 - RNA, 23 nt, Homo sapiens
aagauuuauuaauuaaaccagac

SEQ ID NO: 1723722 - RNA, 20 nt, Homo sapiens
aagccuuuugcaaauaguag

SEQ ID NO: 1723723 - RNA, 14 nt, Homo sapiens
aaggacuuuaucug

SEQ ID NO: 1723724 - RNA, 21 nt, Homo sapiens
aaggcaagagaaacauucuuu

SEQ ID NO: 1723725 - RNA, 19 nt, Homo sapiens
aagggacaccaagccuugg

SEQ ID NO: 1723726 - RNA, 13 nt, Homo sapiens
aaguaugaucuau

SEQ ID NO: 1723727 - RNA, 19 nt, Homo sapiens
aagucuaguuaccuacuuu

SEQ ID NO: 1723728 - RNA, 23 nt, Homo sapiens
aaguggcagacagaagcuucucu

SEQ ID NO: 1723729 - RNA, 14 nt, Homo sapiens
aaguuguuuuaucc

SEQ ID NO: 1723730 - RNA, 17 nt, Homo sapiens
aauaaagcauuuugcaa

SEQ ID NO: 1723731 - RNA, 15 nt, Homo sapiens
aauagauugcucaaa

SEQ ID NO: 1723732 - RNA, 18 nt, Homo sapiens
aauauuacucuaugauga

SEQ ID NO: 1723733 - RNA, 12 nt, Homo sapiens
aauauugccaau

SEQ ID NO: 1723734 - RNA, 22 nt, Homo sapiens
aauauugccaaugcuacaguaa

SEQ ID NO: 1723735 - RNA, 11 nt, Homo sapiens
aaucaugucag

SEQ ID NO: 1723736 - RNA, 12 nt, Homo sapiens
aaucaugucagu

SEQ ID NO: 1723737 - RNA, 11 nt, Homo sapiens
aaucuacaggc

SEQ ID NO: 1723738 - RNA, 20 nt, Homo sapiens
aaugaccaugaaagacuucu

SEQ ID NO: 1723739 - RNA, 14 nt, Homo sapiens
aaugaucaucucac

SEQ ID NO: 1723740 - RNA, 18 nt, Homo sapiens
aaugauugauuauaucau

SEQ ID NO: 1723741 - RNA, 16 nt, Homo sapiens
aaugcacacacacaga

SEQ ID NO: 1723742 - RNA, 19 nt, Homo sapiens
aaugcacacacacagagau

SEQ ID NO: 1723743 - RNA, 19 nt, Homo sapiens
aaugcacgcacacaucagu

SEQ ID NO: 1723744 - RNA, 21 nt, Homo sapiens
aaugcaguacaggacauauau

SEQ ID NO: 1723745 - RNA, 17 nt, Homo sapiens
aaugucaguauguggaa

SEQ ID NO: 1723746 - RNA, 15 nt, Homo sapiens
aauuacugauaucag

SEQ ID NO: 1723747 - RNA, 22 nt, Homo sapiens
aauuuacaacuuauaauuacaa

SEQ ID NO: 1723748 - RNA, 16 nt, Homo sapiens
aauuuuaauuuuauca

SEQ ID NO: 1723749 - RNA, 19 nt, Homo sapiens
aauuuucuuucauacauua

SEQ ID NO: 1723750 - RNA, 16 nt, Homo sapiens
acaaaugacaguuuca

SEQ ID NO: 1723751 - RNA, 18 nt, Homo sapiens
acaaaugugggaguucau

SEQ ID NO: 1723752 - RNA, 20 nt, Homo sapiens
acaauuuauaauuacaauau

SEQ ID NO: 1723753 - RNA, 14 nt, Homo sapiens
acacaaacaaggcc

SEQ ID NO: 1723754 - RNA, 15 nt, Homo sapiens
acacacaccaaugcg

SEQ ID NO: 1723755 - RNA, 15 nt, Homo sapiens
acacacagauaugca

SEQ ID NO: 1723756 - RNA, 17 nt, Homo sapiens
acacacagauaugcaca

SEQ ID NO: 1723757 - RNA, 15 nt, Homo sapiens
acacacgccaaugca

SEQ ID NO: 1723758 - RNA, 15 nt, Homo sapiens
acacacggaugcaca

SEQ ID NO: 1723759 - RNA, 21 nt, Homo sapiens
acacacggaugcacacacaga

SEQ ID NO: 1723760 - RNA, 15 nt, Homo sapiens
acacagagauaugca

SEQ ID NO: 1723761 - RNA, 18 nt, Homo sapiens
acacagagauaugcacac

SEQ ID NO: 1723762 - RNA, 21 nt, Homo sapiens
acacagauggucacacagaga

SEQ ID NO: 1723763 - RNA, 21 nt, Homo sapiens
acacauauauuauuugcagug

SEQ ID NO: 1723764 - RNA, 14 nt, Homo sapiens
acacauggaugcac

SEQ ID NO: 1723765 - RNA, 16 nt, Homo sapiens
acacauggaugcacgc

SEQ ID NO: 1723766 - RNA, 19 nt, Homo sapiens
acacauuaauaaacaaucu

SEQ ID NO: 1723767 - RNA, 14 nt, Homo sapiens
acaccgaugcacac

SEQ ID NO: 1723768 - RNA, 16 nt, Homo sapiens
acaccgauguacacac

SEQ ID NO: 1723769 - RNA, 14 nt, Homo sapiens
acacggaugcacag

SEQ ID NO: 1723770 - RNA, 15 nt, Homo sapiens
acacucaagugccau

SEQ ID NO: 1723771 - RNA, 20 nt, Homo sapiens
acacucccacuuggcaucau

SEQ ID NO: 1723772 - RNA, 14 nt, Homo sapiens
acacugagauccag

SEQ ID NO: 1723773 - RNA, 20 nt, Homo sapiens
acacuuaucagcagcaacaa

SEQ ID NO: 1723774 - RNA, 13 nt, Homo sapiens
acagaaacagaga

SEQ ID NO: 1723775 - RNA, 22 nt, Homo sapiens
acagacuauuccccaccugcuu

SEQ ID NO: 1723776 - RNA, 13 nt, Homo sapiens
acagagacagaga

SEQ ID NO: 1723777 - RNA, 14 nt, Homo sapiens
acagagauaugcac

SEQ ID NO: 1723778 - RNA, 17 nt, Homo sapiens
acagagcaagacuccau

SEQ ID NO: 1723779 - RNA, 14 nt, Homo sapiens
acagauaugcacac

SEQ ID NO: 1723780 - RNA, 12 nt, Homo sapiens
acagaugcacac

SEQ ID NO: 1723781 - RNA, 16 nt, Homo sapiens
acagauggucacacag

SEQ ID NO: 1723782 - RNA, 21 nt, Homo sapiens
acaguguugccagagccuuaa

SEQ ID NO: 1723783 - RNA, 16 nt, Homo sapiens
acaguucuuguuagaa

SEQ ID NO: 1723784 - RNA, 21 nt, Homo sapiens
acaugccagggccaugucaga

SEQ ID NO: 1723785 - RNA, 16 nt, Homo sapiens
acaugcuugcauuaua

SEQ ID NO: 1723786 - RNA, 14 nt, Homo sapiens
acauggaugcacac

SEQ ID NO: 1723787 - RNA, 17 nt, Homo sapiens
accagacucuguugcaa

SEQ ID NO: 1723788 - RNA, 20 nt, Homo sapiens
accauccuggcuaacacggu

SEQ ID NO: 1723789 - RNA, 14 nt, Homo sapiens
acccacucuucaca

SEQ ID NO: 1723790 - RNA, 16 nt, Homo sapiens
acccagcuaugguucu

SEQ ID NO: 1723791 - RNA, 17 nt, Homo sapiens
acccuucagauuugccu

SEQ ID NO: 1723792 - RNA, 19 nt, Homo sapiens
accucaguuucccucugua

SEQ ID NO: 1723793 - RNA, 20 nt, Homo sapiens
accucaguuucccucuguau

SEQ ID NO: 1723794 - RNA, 15 nt, Homo sapiens
accuccacauaccug

SEQ ID NO: 1723795 - RNA, 17 nt, Homo sapiens
accucuuggcugccuug

SEQ ID NO: 1723796 - RNA, 19 nt, Homo sapiens
accuggcccugugccuugg

SEQ ID NO: 1723797 - RNA, 11 nt, Homo sapiens
acgccaaugca

SEQ ID NO: 1723798 - RNA, 16 nt, Homo sapiens
acguuguaaugcacac

SEQ ID NO: 1723799 - RNA, 17 nt, Homo sapiens
acguuugacuagccauc

SEQ ID NO: 1723800 - RNA, 21 nt, Homo sapiens
acguuugacuagccaucucaa

SEQ ID NO: 1723801 - RNA, 14 nt, Homo sapiens
acuagccaucucaa

SEQ ID NO: 1723802 - RNA, 23 nt, Homo sapiens
acuaucugugcguagaaguucua

SEQ ID NO: 1723803 - RNA, 16 nt, Homo sapiens
acucaagugccauuca

SEQ ID NO: 1723804 - RNA, 21 nt, Homo sapiens
acucacugaaucuaaccauag

SEQ ID NO: 1723805 - RNA, 16 nt, Homo sapiens
acucaggggucauuca

SEQ ID NO: 1723806 - RNA, 14 nt, Homo sapiens
acuccuuugcagaa

SEQ ID NO: 1723807 - RNA, 15 nt, Homo sapiens
acucguuaaagcaaa

SEQ ID NO: 1723808 - RNA, 17 nt, Homo sapiens
acucugaggacauggag

SEQ ID NO: 1723809 - RNA, 12 nt, Homo sapiens
acugaacauauu

SEQ ID NO: 1723810 - RNA, 14 nt, Homo sapiens
acugcaacauacag

SEQ ID NO: 1723811 - RNA, 13 nt, Homo sapiens
acugcuguagaca

SEQ ID NO: 1723812 - RNA, 18 nt, Homo sapiens
gcauguauuuuugucaau

SEQ ID NO: 1723813 - RNA, 12 nt, Homo sapiens
gcauuuugcaaa

SEQ ID NO: 1723814 - RNA, 13 nt, Homo sapiens
gcauuuugcaaac

SEQ ID NO: 1723815 - RNA, 19 nt, Homo sapiens
gccaauauuuuaagguaaa

SEQ ID NO: 1723816 - RNA, 13 nt, Homo sapiens
gccagagccuuaa

SEQ ID NO: 1723817 - RNA, 21 nt, Homo sapiens
acuguauuuuauaucacuuau

SEQ ID NO: 1723818 - RNA, 17 nt, Homo sapiens
acuuaaaagaacaugua

SEQ ID NO: 1723819 - RNA, 22 nt, Homo sapiens
acuuaaugaaaacaaugcagua

SEQ ID NO: 1723820 - RNA, 16 nt, Homo sapiens
acuuacauguguguau

SEQ ID NO: 1723821 - RNA, 22 nt, Homo sapiens
acuucuggaugcccauccacug

SEQ ID NO: 1723822 - RNA, 16 nt, Homo sapiens
acuugcauaccugcuu

SEQ ID NO: 1723823 - RNA, 15 nt, Homo sapiens
acuuggcaucauuca

SEQ ID NO: 1723824 - RNA, 21 nt, Homo sapiens
agaaaaacaucuggauaucaa

SEQ ID NO: 1723825 - RNA, 20 nt, Homo sapiens
agaaacagaagauuacaaaa

SEQ ID NO: 1723826 - RNA, 20 nt, Homo sapiens
agaacucguuaaagcaaagc

SEQ ID NO: 1723827 - RNA, 16 nt, Homo sapiens
agaacuucucuuccca

SEQ ID NO: 1723828 - RNA, 23 nt, Homo sapiens
agaacuucucuucccauaccacc

SEQ ID NO: 1723829 - RNA, 13 nt, Homo sapiens
agaagccagcuuu

SEQ ID NO: 1723830 - RNA, 15 nt, Homo sapiens
agaaggcuaugggga

SEQ ID NO: 1723831 - RNA, 19 nt, Homo sapiens
agaagggaagccuuuugca

SEQ ID NO: 1723832 - RNA, 10 nt, Homo sapiens
agacagagac

SEQ ID NO: 1723833 - RNA, 18 nt, Homo sapiens
agacauuugcuaugagcu

SEQ ID NO: 1723834 - RNA, 15 nt, Homo sapiens
agagaggcuggauga

SEQ ID NO: 1723835 - RNA, 14 nt, Homo sapiens
agaggacaguauuu

SEQ ID NO: 1723836 - RNA, 16 nt, Homo sapiens
agagggauauagugaa

SEQ ID NO: 1723837 - RNA, 23 nt, Homo sapiens
agaguccuggcccuugaugccca

SEQ ID NO: 1723838 - RNA, 13 nt, Homo sapiens
agauaacauuuca

SEQ ID NO: 1723839 - RNA, 15 nt, Homo sapiens
agauauacacaugga

SEQ ID NO: 1723840 - RNA, 14 nt, Homo sapiens
agauaugcacacac

SEQ ID NO: 1723841 - RNA, 20 nt, Homo sapiens
agauaugcacacacacggau

SEQ ID NO: 1723842 - RNA, 20 nt, Homo sapiens
agauaugcacacacauggau

SEQ ID NO: 1723843 - RNA, 12 nt, Homo sapiens
agaugcacacac

SEQ ID NO: 1723844 - RNA, 13 nt, Homo sapiens
agauuaacacuga

SEQ ID NO: 1723845 - RNA, 16 nt, Homo sapiens
agcaguggcuccauug

SEQ ID NO: 1723846 - RNA, 16 nt, Homo sapiens
agcaugguaguggcaa

SEQ ID NO: 1723847 - RNA, 18 nt, Homo sapiens
agccaaaacugagcauaa

SEQ ID NO: 1723848 - RNA, 16 nt, Homo sapiens
agccaucucaagcaag

SEQ ID NO: 1723849 - RNA, 17 nt, Homo sapiens
agccaucucaagcaagu

SEQ ID NO: 1723850 - RNA, 17 nt, Homo sapiens
agcccugaacauuucau

SEQ ID NO: 1723851 - RNA, 13 nt, Homo sapiens
agcucagugccac

SEQ ID NO: 1723852 - RNA, 13 nt, Homo sapiens
agcuccacagugu

SEQ ID NO: 1723853 - RNA, 13 nt, Homo sapiens
agcucuacucugg

SEQ ID NO: 1723854 - RNA, 13 nt, Homo sapiens
agcuucucucugc

SEQ ID NO: 1723855 - RNA, 21 nt, Homo sapiens
agcuugagggugacuauggag

SEQ ID NO: 1723856 - RNA, 18 nt, Homo sapiens
aggaacuaugaaaaccag

SEQ ID NO: 1723857 - RNA, 11 nt, Homo sapiens
aggacaaccac

SEQ ID NO: 1723858 - RNA, 22 nt, Homo sapiens
aggacaaccacagagggauaua

SEQ ID NO: 1723859 - RNA, 14 nt, Homo sapiens
aggagucagggaga

SEQ ID NO: 1723860 - RNA, 20 nt, Homo sapiens
aggaucagauucuugcugug

SEQ ID NO: 1723861 - RNA, 20 nt, Homo sapiens
aggcagacuaggguucaugu

SEQ ID NO: 1723862 - RNA, 20 nt, Homo sapiens
aggccaggcgcgguggcuca

SEQ ID NO: 1723863 - RNA, 12 nt, Homo sapiens
aggccugucagc

SEQ ID NO: 1723864 - RNA, 20 nt, Homo sapiens
aggcuggaugacuugcucaa

SEQ ID NO: 1723865 - RNA, 17 nt, Homo sapiens
agggaagccuuuugcaa

SEQ ID NO: 1723866 - RNA, 16 nt, Homo sapiens
agggagagagugcuau

SEQ ID NO: 1723867 - RNA, 18 nt, Homo sapiens
agggauuuggggcucaga

SEQ ID NO: 1723868 - RNA, 15 nt, Homo sapiens
agggccaugucagac

SEQ ID NO: 1723869 - RNA, 14 nt, Homo sapiens
aggggucauucaug

SEQ ID NO: 1723870 - RNA, 14 nt, Homo sapiens
agggugacuaugga

SEQ ID NO: 1723871 - RNA, 21 nt, Homo sapiens
agguuuguuuagaagaagugu

SEQ ID NO: 1723872 - RNA, 15 nt, Homo sapiens
aguaugaaaagcuau

SEQ ID NO: 1723873 - RNA, 13 nt, Homo sapiens
agucauccucaga

SEQ ID NO: 1723874 - RNA, 22 nt, Homo sapiens
aguccacuuuuaaaacuauauu

SEQ ID NO: 1723875 - RNA, 13 nt, Homo sapiens
agucugauuuaau

SEQ ID NO: 1723876 - RNA, 23 nt, Homo sapiens
agucugauuuaauugggcacuau

SEQ ID NO: 1723877 - RNA, 14 nt, Homo sapiens
agucugcuuagaaa

SEQ ID NO: 1723878 - RNA, 12 nt, Homo sapiens
agugaacauauc

SEQ ID NO: 1723879 - RNA, 21 nt, Homo sapiens
agugaacauauccaucauccc

SEQ ID NO: 1723880 - RNA, 19 nt, Homo sapiens
agugcacacggaugcacag

SEQ ID NO: 1723881 - RNA, 20 nt, Homo sapiens
agugcacacggaugcacaga

SEQ ID NO: 1723882 - RNA, 20 nt, Homo sapiens
agugggacauauuuuccuga

SEQ ID NO: 1723883 - RNA, 15 nt, Homo sapiens
agugggguagguugg

SEQ ID NO: 1723884 - RNA, 22 nt, Homo sapiens
aguuucgacguuugacuagcca

SEQ ID NO: 1723885 - RNA, 14 nt, Homo sapiens
auaaaagauuuucc

SEQ ID NO: 1723886 - RNA, 18 nt, Homo sapiens
auaaacaugcuugcauua

SEQ ID NO: 1723887 - RNA, 20 nt, Homo sapiens
auaaacuauauucugugaca

SEQ ID NO: 1723888 - RNA, 15 nt, Homo sapiens
auaaagcauuuugca

SEQ ID NO: 1723889 - RNA, 15 nt, Homo sapiens
auaaaugaaaaucua

SEQ ID NO: 1723890 - RNA, 13 nt, Homo sapiens
auaaauuucugcu

SEQ ID NO: 1723891 - RNA, 11 nt, Homo sapiens
auaauucacac

SEQ ID NO: 1723892 - RNA, 24 nt, Homo sapiens
auaccacccaaaaucauaaugcca

SEQ ID NO: 1723893 - RNA, 20 nt, Homo sapiens
auaccuggcccugugccuug

SEQ ID NO: 1723894 - RNA, 22 nt, Homo sapiens
auacgcaaacacaccgaugcac

SEQ ID NO: 1723895 - RNA, 14 nt, Homo sapiens
auacuuauguuuca

SEQ ID NO: 1723896 - RNA, 15 nt, Homo sapiens
auagagugugaugua

SEQ ID NO: 1723897 - RNA, 18 nt, Homo sapiens
auagcuaggugacauaua

SEQ ID NO: 1723898 - RNA, 22 nt, Homo sapiens
auaggaaaccacacagacuugg

SEQ ID NO: 1723899 - RNA, 15 nt, Homo sapiens
auauacacauggaug

SEQ ID NO: 1723900 - RNA, 20 nt, Homo sapiens
auauacauacuuacaugugu

SEQ ID NO: 1723901 - RNA, 17 nt, Homo sapiens
auaugcacacacacgga

SEQ ID NO: 1723902 - RNA, 22 nt, Homo sapiens
auaugcacacacacggaugcac

SEQ ID NO: 1723903 - RNA, 16 nt, Homo sapiens
auaugcacacacagau

SEQ ID NO: 1723904 - RNA, 14 nt, Homo sapiens
auauguagauguau

SEQ ID NO: 1723905 - RNA, 18 nt, Homo sapiens
auauuaaaaaaagacaua

SEQ ID NO: 1723906 - RNA, 15 nt, Homo sapiens
auauuagucuuugaa

SEQ ID NO: 1723907 - RNA, 20 nt, Homo sapiens
auauuccucuaaaacucuca

SEQ ID NO: 1723908 - RNA, 18 nt, Homo sapiens
aucaacauuuguuccaug

SEQ ID NO: 1723909 - RNA, 17 nt, Homo sapiens
aucaaugaucaucucac

SEQ ID NO: 1723910 - RNA, 13 nt, Homo sapiens
aucagauguuuca

SEQ ID NO: 1723911 - RNA, 20 nt, Homo sapiens
aucagauucuugcugugacc

SEQ ID NO: 1723912 - RNA, 22 nt, Homo sapiens
aucagugcacacggaugcacag

SEQ ID NO: 1723913 - RNA, 23 nt, Homo sapiens
aucaugaacuagugucuaaauac

SEQ ID NO: 1723914 - RNA, 22 nt, Homo sapiens
auccuuuaagaaaaacaucugg

SEQ ID NO: 1723915 - RNA, 17 nt, Homo sapiens
aucuaagaauagugaaa

SEQ ID NO: 1723916 - RNA, 16 nt, Homo sapiens
aucucaagcaaguuuc

SEQ ID NO: 1723917 - RNA, 21 nt, Homo sapiens
aucugucaaagaaaacuucca

SEQ ID NO: 1723918 - RNA, 23 nt, Homo sapiens
aucugugaggggcucucucauga

SEQ ID NO: 1723919 - RNA, 17 nt, Homo sapiens
augaacacacauggaug

SEQ ID NO: 1723920 - RNA, 22 nt, Homo sapiens
augaacacacauggaugcacac

SEQ ID NO: 1723921 - RNA, 11 nt, Homo sapiens
augaagacacu

SEQ ID NO: 1723922 - RNA, 16 nt, Homo sapiens
augacuugcucaaguu

SEQ ID NO: 1723923 - RNA, 20 nt, Homo sapiens
augagcacacacacaccaau

SEQ ID NO: 1723924 - RNA, 23 nt, Homo sapiens
augagcacacacacaccaaugcg

SEQ ID NO: 1723925 - RNA, 16 nt, Homo sapiens
augauaauuuaucuac

SEQ ID NO: 1723926 - RNA, 22 nt, Homo sapiens
augaugagguuuucuuaacuua

SEQ ID NO: 1723927 - RNA, 21 nt, Homo sapiens
augcacaauuuauaauuacaa

SEQ ID NO: 1723928 - RNA, 21 nt, Homo sapiens
augcacacacacggaugcaca

SEQ ID NO: 1723929 - RNA, 15 nt, Homo sapiens
augcacacacagaug

SEQ ID NO: 1723930 - RNA, 15 nt, Homo sapiens
augcacacacauaua

SEQ ID NO: 1723931 - RNA, 16 nt, Homo sapiens
augcacacacauauau

SEQ ID NO: 1723932 - RNA, 23 nt, Homo sapiens
augcacgcacacaucagugcaca

SEQ ID NO: 1723933 - RNA, 19 nt, Homo sapiens
augcaguacaggacauaua

SEQ ID NO: 1723934 - RNA, 13 nt, Homo sapiens
augcauacuacaa

SEQ ID NO: 1723935 - RNA, 16 nt, Homo sapiens
augcuccuccugauga

SEQ ID NO: 1723936 - RNA, 23 nt, Homo sapiens
auggaaauuaaaacucauuuagg

SEQ ID NO: 1723937 - RNA, 15 nt, Homo sapiens
auggaugcacacaca

SEQ ID NO: 1723938 - RNA, 17 nt, Homo sapiens
auggcccaucuguaugc

SEQ ID NO: 1723939 - RNA, 13 nt, Homo sapiens
augguaguggcaa

SEQ ID NO: 1723940 - RNA, 15 nt, Homo sapiens
auguacacacacaga

SEQ ID NO: 1723941 - RNA, 18 nt, Homo sapiens
auguaggaucugucaaag

SEQ ID NO: 1723942 - RNA, 11 nt, Homo sapiens
ccaaugcacac

SEQ ID NO: 1723943 - RNA, 23 nt, Homo sapiens
aaauauaaaugaaaaucuauccu

SEQ ID NO: 1723944 - RNA, 12 nt, Homo sapiens
aaaugacaguuu

SEQ ID NO: 1723945 - RNA, 15 nt, Homo sapiens
aaaugcuuuuccuca

SEQ ID NO: 1723946 - RNA, 19 nt, Homo sapiens
aaauguggagaacauucaa

SEQ ID NO: 1723947 - RNA, 13 nt, Homo sapiens
aaauuacugauau

SEQ ID NO: 1723948 - RNA, 13 nt, Homo sapiens
aaauuuaugugau

SEQ ID NO: 1723949 - RNA, 17 nt, Homo sapiens
aacaauaaagcauuuug

SEQ ID NO: 1723950 - RNA, 14 nt, Homo sapiens
aacacgcugaaggg

SEQ ID NO: 1723951 - RNA, 22 nt, Homo sapiens
aacagaagauuacaaaagcaau

SEQ ID NO: 1723952 - RNA, 16 nt, Homo sapiens
aacagagagagacaga

SEQ ID NO: 1723953 - RNA, 16 nt, Homo sapiens
aacauacaggugccuu

SEQ ID NO: 1723954 - RNA, 19 nt, Homo sapiens
aacauuuuugauucuagcu

SEQ ID NO: 1723955 - RNA, 18 nt, Homo sapiens
aacguccacagaguauaa

SEQ ID NO: 1723956 - RNA, 16 nt, Homo sapiens
aacugaucauguuuau

SEQ ID NO: 1723957 - RNA, 20 nt, Homo sapiens
aagaaacaaagaaggacaga

SEQ ID NO: 1723958 - RNA, 15 nt, Homo sapiens
aagaaagacuuauca

SEQ ID NO: 1723959 - RNA, 14 nt, Homo sapiens
aagcaaggaaguaa

SEQ ID NO: 1723960 - RNA, 14 nt, Homo sapiens
aagccaauauuuua

SEQ ID NO: 1723961 - RNA, 16 nt, Homo sapiens
aagccagcuuuccuca

SEQ ID NO: 1723962 - RNA, 14 nt, Homo sapiens
aagccuuuugcaaa

SEQ ID NO: 1723963 - RNA, 14 nt, Homo sapiens
aaggagagcauagg

SEQ ID NO: 1723964 - RNA, 15 nt, Homo sapiens
aaggcaaauguuuau

SEQ ID NO: 1723965 - RNA, 14 nt, Homo sapiens
aaggucuacauuac

SEQ ID NO: 1723966 - RNA, 23 nt, Homo sapiens
aaguaugaucuaugcuauauuca

SEQ ID NO: 1723967 - RNA, 20 nt, Homo sapiens
aagucacuggccaguggcug

SEQ ID NO: 1723968 - RNA, 20 nt, Homo sapiens
aaguucaccagcaugguagu

SEQ ID NO: 1723969 - RNA, 17 nt, Homo sapiens
aauagagacacagagau

SEQ ID NO: 1723970 - RNA, 17 nt, Homo sapiens
aaucaaugaucaucuca

SEQ ID NO: 1723971 - RNA, 15 nt, Homo sapiens
aaucccagcacuuug

SEQ ID NO: 1723972 - RNA, 15 nt, Homo sapiens
aaugaaaacaaugca

SEQ ID NO: 1723973 - RNA, 14 nt, Homo sapiens
aaugaugggucagu

SEQ ID NO: 1723974 - RNA, 20 nt, Homo sapiens
aaugauugauuauaucauuu

SEQ ID NO: 1723975 - RNA, 14 nt, Homo sapiens
aaugugcuguguga

SEQ ID NO: 1723976 - RNA, 13 nt, Homo sapiens
aauuaaaccagac

SEQ ID NO: 1723977 - RNA, 16 nt, Homo sapiens
aauuaaauacuauuaa

SEQ ID NO: 1723978 - RNA, 19 nt, Homo sapiens
aauuacaauauguauuuau

SEQ ID NO: 1723979 - RNA, 22 nt, Homo sapiens
aauucuauguuggcauuaacaa

SEQ ID NO: 1723980 - RNA, 22 nt, Homo sapiens
aauucucugaaaguuucuuccu

SEQ ID NO: 1723981 - RNA, 15 nt, Homo sapiens
aauuuauaauuacaa

SEQ ID NO: 1723982 - RNA, 18 nt, Homo sapiens
aauuugacuccucuucaa

SEQ ID NO: 1723983 - RNA, 21 nt, Homo sapiens
acaaauaaagcugcugugaac

SEQ ID NO: 1723984 - RNA, 22 nt, Homo sapiens
acaaauguuuugcucaauagau

SEQ ID NO: 1723985 - RNA, 13 nt, Homo sapiens
acaacagauguac

SEQ ID NO: 1723986 - RNA, 19 nt, Homo sapiens
acaaccucauuuuaacuca

SEQ ID NO: 1723987 - RNA, 21 nt, Homo sapiens
acaacgaaagaaggcauggac

SEQ ID NO: 1723988 - RNA, 14 nt, Homo sapiens
acaacuuauaauua

SEQ ID NO: 1723989 - RNA, 21 nt, Homo sapiens
acaaugcuccuccugaugacu

SEQ ID NO: 1723990 - RNA, 23 nt, Homo sapiens
acaauuaagagagugaacauauc

SEQ ID NO: 1723991 - RNA, 14 nt, Homo sapiens
acaauuuauaauua

SEQ ID NO: 1723992 - RNA, 17 nt, Homo sapiens
acacacagagauaugca

SEQ ID NO: 1723993 - RNA, 18 nt, Homo sapiens
acacacagagauaugcac

SEQ ID NO: 1723994 - RNA, 16 nt, Homo sapiens
acacacagauaugcac

SEQ ID NO: 1723995 - RNA, 18 nt, Homo sapiens
acacacauggaugcacac

SEQ ID NO: 1723996 - RNA, 17 nt, Homo sapiens
acacacgccaaugcaca

SEQ ID NO: 1723997 - RNA, 14 nt, Homo sapiens
acacagaugcacac

SEQ ID NO: 1723998 - RNA, 19 nt, Homo sapiens
acacagauggucacacaga

SEQ ID NO: 1723999 - RNA, 21 nt, Homo sapiens
acacaggccagcuccacagug

SEQ ID NO: 1724000 - RNA, 21 nt, Homo sapiens
acaccgauguacacacacaga

SEQ ID NO: 1724001 - RNA, 23 nt, Homo sapiens
acaccgaugugcgcacacacaga

SEQ ID NO: 1724002 - RNA, 20 nt, Homo sapiens
acaccuuguggagaacaugc

SEQ ID NO: 1724003 - RNA, 17 nt, Homo sapiens
acacggaugcacagaga

SEQ ID NO: 1724004 - RNA, 20 nt, Homo sapiens
acagacacucccacuuggca

SEQ ID NO: 1724005 - RNA, 23 nt, Homo sapiens
acagacacucccacuuggcauca

SEQ ID NO: 1724006 - RNA, 15 nt, Homo sapiens
acagagauaugcaca

SEQ ID NO: 1724007 - RNA, 20 nt, Homo sapiens
acagagcaagacuccaucuc

SEQ ID NO: 1724008 - RNA, 13 nt, Homo sapiens
acagauaugcaca

SEQ ID NO: 1724009 - RNA, 21 nt, Homo sapiens
acaggccucagggugggagau

SEQ ID NO: 1724010 - RNA, 12 nt, Homo sapiens
acaggugccuug

SEQ ID NO: 1724011 - RNA, 17 nt, Homo sapiens
acagugagagacuccau

SEQ ID NO: 1724012 - RNA, 17 nt, Homo sapiens
acauagagauaugcaca

SEQ ID NO: 1724013 - RNA, 18 nt, Homo sapiens
acauagagauaugcacac

SEQ ID NO: 1724014 - RNA, 20 nt, Homo sapiens
acauagagauaugcacacac

SEQ ID NO: 1724015 - RNA, 14 nt, Homo sapiens
acaucagugcacac

SEQ ID NO: 1724016 - RNA, 15 nt, Homo sapiens
acaugccagggccau

SEQ ID NO: 1724017 - RNA, 16 nt, Homo sapiens
acauggaugagcacac

SEQ ID NO: 1724018 - RNA, 17 nt, Homo sapiens
acauugggacaacacuu

SEQ ID NO: 1724019 - RNA, 19 nt, Homo sapiens
acauuuagccuucaaugga

SEQ ID NO: 1724020 - RNA, 19 nt, Homo sapiens
acauuugcuccauccuccu

SEQ ID NO: 1724021 - RNA, 23 nt, Homo sapiens
accaagccuuggcucuacccuga

SEQ ID NO: 1724022 - RNA, 13 nt, Homo sapiens
accaauuccucau

SEQ ID NO: 1724023 - RNA, 19 nt, Homo sapiens
accagcaugguaguggcaa

SEQ ID NO: 1724024 - RNA, 20 nt, Homo sapiens
accaucucuuuaccuccuaa

SEQ ID NO: 1724025 - RNA, 21 nt, Homo sapiens
acccauuuacuuguugaugac

SEQ ID NO: 1724026 - RNA, 23 nt, Homo sapiens
accuccuaauuccacacccucac

SEQ ID NO: 1724027 - RNA, 18 nt, Homo sapiens
accuggcccugugccuug

SEQ ID NO: 1724028 - RNA, 15 nt, Homo sapiens
accuuuccugaggaa

SEQ ID NO: 1724029 - RNA, 17 nt, Homo sapiens
acgacugcaacauacag

SEQ ID NO: 1724030 - RNA, 22 nt, Homo sapiens
acgcaaacacaccgaugcacac

SEQ ID NO: 1724031 - RNA, 13 nt, Homo sapiens
acgcacacaucag

SEQ ID NO: 1724032 - RNA, 19 nt, Homo sapiens
acgcacauagagauaugca

SEQ ID NO: 1724033 - RNA, 16 nt, Homo sapiens
acgccaaugcacacac

SEQ ID NO: 1724034 - RNA, 21 nt, Homo sapiens
acgccaaugcacacacacaga

SEQ ID NO: 1724035 - RNA, 14 nt, Homo sapiens
acggcaagguuuaa

SEQ ID NO: 1724036 - RNA, 17 nt, Homo sapiens
acuaaugaggcauuaca

SEQ ID NO: 1724037 - RNA, 13 nt, Homo sapiens
acuagccaucuca

SEQ ID NO: 1724038 - RNA, 15 nt, Homo sapiens
acuagccaucucaag

SEQ ID NO: 1724039 - RNA, 18 nt, Homo sapiens
acuagccaucucaagcaa

SEQ ID NO: 1724040 - RNA, 20 nt, Homo sapiens
acuauauuuauugauuucaa

SEQ ID NO: 1724041 - RNA, 21 nt, Homo sapiens
acuauggagcugagcaggugu

SEQ ID NO: 1724042 - RNA, 20 nt, Homo sapiens
acucaagugccauucauccu

SEQ ID NO: 1724043 - RNA, 20 nt, Homo sapiens
acucacugaaucuaaccaua

SEQ ID NO: 1724044 - RNA, 14 nt, Homo sapiens
acucaggggucauu

SEQ ID NO: 1724045 - RNA, 12 nt, Homo sapiens
acucaucuuucc

SEQ ID NO: 1724046 - RNA, 22 nt, Homo sapiens
acuccauaguuugggcuuguac

SEQ ID NO: 1724047 - RNA, 14 nt, Homo sapiens
acucucuguuacac

SEQ ID NO: 1724048 - RNA, 15 nt, Homo sapiens
acugauaucagaguu

SEQ ID NO: 1724049 - RNA, 20 nt, Homo sapiens
acugcuguagacauuugcua

SEQ ID NO: 1724050 - RNA, 23 nt, Homo sapiens
acuuaaugaaaacaaugcaguac

SEQ ID NO: 1724051 - RNA, 15 nt, Homo sapiens
acuuauaauuacaau

SEQ ID NO: 1724052 - RNA, 17 nt, Homo sapiens
acuuauuuuuuucccaa

SEQ ID NO: 1724053 - RNA, 22 nt, Homo sapiens
acuucauuuuucuaauaaucau

SEQ ID NO: 1724054 - RNA, 19 nt, Homo sapiens
acuucuggaugcccaucca

SEQ ID NO: 1724055 - RNA, 16 nt, Homo sapiens
agaaaagcaguggcuc

SEQ ID NO: 1724056 - RNA, 19 nt, Homo sapiens
agaaaagcaguggcuccau

SEQ ID NO: 1724057 - RNA, 19 nt, Homo sapiens
agaaacagaagauuacaaa

SEQ ID NO: 1724058 - RNA, 22 nt, Homo sapiens
agaaagacuuaucaacauuugu

SEQ ID NO: 1724059 - RNA, 15 nt, Homo sapiens
agaagcaacuaaguu

SEQ ID NO: 1724060 - RNA, 17 nt, Homo sapiens
agaagcaucaccaugca

SEQ ID NO: 1724061 - RNA, 19 nt, Homo sapiens
agacacaugccagggccau

SEQ ID NO: 1724062 - RNA, 23 nt, Homo sapiens
agacacucccacuuggcaucauu

SEQ ID NO: 1724063 - RNA, 14 nt, Homo sapiens
agagagguccagag

SEQ ID NO: 1724064 - RNA, 14 nt, Homo sapiens
agauaacauuucaa

SEQ ID NO: 1724065 - RNA, 17 nt, Homo sapiens
agauacgcaaacacacc

SEQ ID NO: 1724066 - RNA, 17 nt, Homo sapiens
agauaugcacacacaga

SEQ ID NO: 1724067 - RNA, 15 nt, Homo sapiens
agaugcacacacacc

SEQ ID NO: 1724068 - RNA, 19 nt, Homo sapiens
agauggaauuagaaauaua

SEQ ID NO: 1724069 - RNA, 20 nt, Homo sapiens
agcaaagcgcuaaguaaaaa

SEQ ID NO: 1724070 - RNA, 16 nt, Homo sapiens
agcaagucacuggcca

SEQ ID NO: 1724071 - RNA, 17 nt, Homo sapiens
agcacguguggccuguu

SEQ ID NO: 1724072 - RNA, 17 nt, Homo sapiens
agcaucucccaguucau

SEQ ID NO: 1724073 - RNA, 17 nt, Homo sapiens
agccagaggucuggccc

SEQ ID NO: 1724074 - RNA, 11 nt, Homo sapiens
agccaucucaa

SEQ ID NO: 1724075 - RNA, 12 nt, Homo sapiens
agccaucucaag

SEQ ID NO: 1724076 - RNA, 14 nt, Homo sapiens
agccaucucaagca

SEQ ID NO: 1724077 - RNA, 18 nt, Homo sapiens
agccaucucaagcaaguu

SEQ ID NO: 1724078 - RNA, 15 nt, Homo sapiens
agcccugaacauuuc

SEQ ID NO: 1724079 - RNA, 20 nt, Homo sapiens
agccgagaucgcgccacugu

SEQ ID NO: 1724080 - RNA, 16 nt, Homo sapiens
agcuaggugacauaua

SEQ ID NO: 1724081 - RNA, 22 nt, Homo sapiens
agcucagugccacaaagcucaa

SEQ ID NO: 1724082 - RNA, 17 nt, Homo sapiens
aggaaaaaaauucuguu

SEQ ID NO: 1724083 - RNA, 15 nt, Homo sapiens
aggacuuuaucugaa

SEQ ID NO: 1724084 - RNA, 18 nt, Homo sapiens
aggagauaacauuucaac

SEQ ID NO: 1724085 - RNA, 18 nt, Homo sapiens
aggagggauguuccagug

SEQ ID NO: 1724086 - RNA, 15 nt, Homo sapiens
aggagucccugccau

SEQ ID NO: 1724087 - RNA, 21 nt, Homo sapiens
aggagucccugccaucauguu

SEQ ID NO: 1724088 - RNA, 18 nt, Homo sapiens
aggcagcagacacaugcc

SEQ ID NO: 1724089 - RNA, 15 nt, Homo sapiens
aggccagcaccaucu

SEQ ID NO: 1724090 - RNA, 15 nt, Homo sapiens
aggccauugucccug

SEQ ID NO: 1724091 - RNA, 16 nt, Homo sapiens
aggcuggcuuucagag

SEQ ID NO: 1724092 - RNA, 14 nt, Homo sapiens
agggaagccuuuug

SEQ ID NO: 1724093 - RNA, 15 nt, Homo sapiens
agggaaguccuugca

SEQ ID NO: 1724094 - RNA, 16 nt, Homo sapiens
agggacucaucuuucc

SEQ ID NO: 1724095 - RNA, 13 nt, Homo sapiens
agggagacagaga

SEQ ID NO: 1724096 - RNA, 22 nt, Homo sapiens
agggggcuaagcuauggcccau

SEQ ID NO: 1724097 - RNA, 19 nt, Homo sapiens
aggucuacauuacaaaaga

SEQ ID NO: 1724098 - RNA, 23 nt, Homo sapiens
agguguucuucauuaccucagug

SEQ ID NO: 1724099 - RNA, 14 nt, Homo sapiens
aguagaauuuacaa

SEQ ID NO: 1724100 - RNA, 16 nt, Homo sapiens
aguagaucaugcauag

SEQ ID NO: 1724101 - RNA, 18 nt, Homo sapiens
aguauaguuuugacagag

SEQ ID NO: 1724102 - RNA, 16 nt, Homo sapiens
agucauccucagauca

SEQ ID NO: 1724103 - RNA, 13 nt, Homo sapiens
agucccugaagga

SEQ ID NO: 1724104 - RNA, 13 nt, Homo sapiens
agucuuugauuau

SEQ ID NO: 1724105 - RNA, 17 nt, Homo sapiens
agugccacaaagcucaa

SEQ ID NO: 1724106 - RNA, 15 nt, Homo sapiens
agugcuauuguagag

SEQ ID NO: 1724107 - RNA, 14 nt, Homo sapiens
aguggcaaagagag

SEQ ID NO: 1724108 - RNA, 18 nt, Homo sapiens
aguucgaaagccucucac

SEQ ID NO: 1724109 - RNA, 21 nt, Homo sapiens
aguugauugcgagaauuuuca

SEQ ID NO: 1724110 - RNA, 16 nt, Homo sapiens
aguugguguucauaau

SEQ ID NO: 1724111 - RNA, 17 nt, Homo sapiens
aguuucgacguuugacu

SEQ ID NO: 1724112 - RNA, 23 nt, Homo sapiens
aguuucgacguuugacuagccau

SEQ ID NO: 1724113 - RNA, 15 nt, Homo sapiens
auaaacaaucuccca

SEQ ID NO: 1724114 - RNA, 16 nt, Homo sapiens
auaaagcauuuugcaa

SEQ ID NO: 1724115 - RNA, 12 nt, Homo sapiens
auaaagugcuuu

SEQ ID NO: 1724116 - RNA, 12 nt, Homo sapiens
auaaauaaccaa

SEQ ID NO: 1724117 - RNA, 17 nt, Homo sapiens
auaauuacaaugcacaa

SEQ ID NO: 1724118 - RNA, 15 nt, Homo sapiens
auacacauggaugca

SEQ ID NO: 1724119 - RNA, 14 nt, Homo sapiens
auacauuauauucc

SEQ ID NO: 1724120 - RNA, 13 nt, Homo sapiens
auagagauaugca

SEQ ID NO: 1724121 - RNA, 18 nt, Homo sapiens
auagcaccuccacauacc

SEQ ID NO: 1724122 - RNA, 20 nt, Homo sapiens
auaugcacacacagaugcac

SEQ ID NO: 1724123 - RNA, 16 nt, Homo sapiens
auaugcacacaccgau

SEQ ID NO: 1724124 - RNA, 18 nt, Homo sapiens
auauuacucuaugaugau

SEQ ID NO: 1724125 - RNA, 12 nt, Homo sapiens
auauuucugcac

SEQ ID NO: 1724126 - RNA, 15 nt, Homo sapiens
aucagugcacacgga

SEQ ID NO: 1724127 - RNA, 19 nt, Homo sapiens
aucaguugcaggugccaau

SEQ ID NO: 1724128 - RNA, 13 nt, Homo sapiens
aucauaaugccau

SEQ ID NO: 1724129 - RNA, 16 nt, Homo sapiens
aucauuuuguggauau

SEQ ID NO: 1724130 - RNA, 14 nt, Homo sapiens
auccuacucaacaa

SEQ ID NO: 1724131 - RNA, 13 nt, Homo sapiens
aucucaagcaagu

SEQ ID NO: 1724132 - RNA, 17 nt, Homo sapiens
aucucaagcaaguuuaa

SEQ ID NO: 1724133 - RNA, 14 nt, Homo sapiens
aucucuuuaccucc

SEQ ID NO: 1724134 - RNA, 15 nt, Homo sapiens
aucucuuuaccuccu

SEQ ID NO: 1724135 - RNA, 17 nt, Homo sapiens
aucugagaggccacagu

SEQ ID NO: 1724136 - RNA, 18 nt, Homo sapiens
augaacucuucucaacuc

SEQ ID NO: 1724137 - RNA, 14 nt, Homo sapiens
augaagacacucaa

SEQ ID NO: 1724138 - RNA, 16 nt, Homo sapiens
augagcacacacacac

SEQ ID NO: 1724139 - RNA, 19 nt, Homo sapiens
augaucuaugcuauauuca

SEQ ID NO: 1724140 - RNA, 14 nt, Homo sapiens
augcaaauaucgcu

SEQ ID NO: 1724141 - RNA, 16 nt, Homo sapiens
augcacacacagaugc

SEQ ID NO: 1724142 - RNA, 17 nt, Homo sapiens
augcacacacagaugca

SEQ ID NO: 1724143 - RNA, 20 nt, Homo sapiens
augcacacacagaugcacac

SEQ ID NO: 1724144 - RNA, 22 nt, Homo sapiens
augcacacacauggaugagcac

SEQ ID NO: 1724145 - RNA, 16 nt, Homo sapiens
augcacagagauaugc

SEQ ID NO: 1724146 - RNA, 18 nt, Homo sapiens
augcacagagauaugcac

SEQ ID NO: 1724147 - RNA, 20 nt, Homo sapiens
augcacagagauaugcacac

SEQ ID NO: 1724148 - RNA, 18 nt, Homo sapiens
uauuuaccuucuaccucu

SEQ ID NO: 1724149 - RNA, 21 nt, Homo sapiens
uauuucugcacaguguuccca

SEQ ID NO: 1724150 - RNA, 12 nt, Homo sapiens
uauuuugagauu

SEQ ID NO: 1724151 - RNA, 17 nt, Homo sapiens
ucaaagaaaacuuccaa

SEQ ID NO: 1724152 - RNA, 22 nt, Homo sapiens
ucaaagggagagagugcuauug

SEQ ID NO: 1724153 - RNA, 19 nt, Homo sapiens
ucaacagugagagacucca

SEQ ID NO: 1724154 - RNA, 14 nt, Homo sapiens
ucaauauuugaucu

SEQ ID NO: 1724155 - RNA, 13 nt, Homo sapiens
ucaaucaugucag

SEQ ID NO: 1724156 - RNA, 15 nt, Homo sapiens
ucaaugaucaucuca

SEQ ID NO: 1724157 - RNA, 18 nt, Homo sapiens
ucaauuuuaaacauaucc

SEQ ID NO: 1724158 - RNA, 23 nt, Homo sapiens
ucacaccuuguggagaacaugca

SEQ ID NO: 1724159 - RNA, 12 nt, Homo sapiens
ucaguaugugga

SEQ ID NO: 1724160 - RNA, 19 nt, Homo sapiens
ucaguugcaggugccaaug

SEQ ID NO: 1724161 - RNA, 12 nt, Homo sapiens
ucauacauuaua

SEQ ID NO: 1724162 - RNA, 12 nt, Homo sapiens
ucaucaggccau

SEQ ID NO: 1724163 - RNA, 15 nt, Homo sapiens
ucauuuguucauuaa

SEQ ID NO: 1724164 - RNA, 16 nt, Homo sapiens
uccagagaggcuggau

SEQ ID NO: 1724165 - RNA, 16 nt, Homo sapiens
uccagcaagaccaaau

SEQ ID NO: 1724166 - RNA, 20 nt, Homo sapiens
uccagccugggcaacagagc

SEQ ID NO: 1724167 - RNA, 21 nt, Homo sapiens
uccauuuacuuaagacuuaau

SEQ ID NO: 1724168 - RNA, 13 nt, Homo sapiens
ucccacuuggcau

SEQ ID NO: 1724169 - RNA, 21 nt, Homo sapiens
uccuaaaauuauggaaacaga

SEQ ID NO: 1724170 - RNA, 22 nt, Homo sapiens
uccugaggaagagggacuguuc

SEQ ID NO: 1724171 - RNA, 16 nt, Homo sapiens
uccugaugaaggcaga

SEQ ID NO: 1724172 - RNA, 16 nt, Homo sapiens
uccugaugacuccucc

SEQ ID NO: 1724173 - RNA, 22 nt, Homo sapiens
uccuugucguaggaaaaccaug

SEQ ID NO: 1724174 - RNA, 20 nt, Homo sapiens
ucgacguuugacuagccauc

SEQ ID NO: 1724175 - RNA, 16 nt, Homo sapiens
ucggggacacaggcca

SEQ ID NO: 1724176 - RNA, 12 nt, Homo sapiens
ucuacaaccuaa

SEQ ID NO: 1724177 - RNA, 13 nt, Homo sapiens
ucuacauuacaaa

SEQ ID NO: 1724178 - RNA, 19 nt, Homo sapiens
ucuaccauucauagccaga

SEQ ID NO: 1724179 - RNA, 23 nt, Homo sapiens
ucuaguugauugcgagaauuuuc

SEQ ID NO: 1724180 - RNA, 22 nt, Homo sapiens
ucuauugacccacaaaguuuca

SEQ ID NO: 1724181 - RNA, 18 nt, Homo sapiens
ucucaggccugacucuca

SEQ ID NO: 1724182 - RNA, 17 nt, Homo sapiens
ucucaucucuguauucc

SEQ ID NO: 1724183 - RNA, 18 nt, Homo sapiens
ucucuugcucaccaagaa

SEQ ID NO: 1724184 - RNA, 13 nt, Homo sapiens
ucugcacaguguu

SEQ ID NO: 1724185 - RNA, 19 nt, Homo sapiens
ucugcuuagaaauaacaga

SEQ ID NO: 1724186 - RNA, 20 nt, Homo sapiens
ucuggaauuuaagcuauucu

SEQ ID NO: 1724187 - RNA, 21 nt, Homo sapiens
ucugugaggggcucucucaug

SEQ ID NO: 1724188 - RNA, 19 nt, Homo sapiens
ucuguguguguguaugugg

SEQ ID NO: 1724189 - RNA, 23 nt, Homo sapiens
ucuguguguguguaugugggggu

SEQ ID NO: 1724190 - RNA, 22 nt, Homo sapiens
ucuuaaaaacaacgaaagaagg

SEQ ID NO: 1724191 - RNA, 20 nt, Homo sapiens
ucuucauuaccucagugaga

SEQ ID NO: 1724192 - RNA, 22 nt, Homo sapiens
ucuugccgucacuauucaucaa

SEQ ID NO: 1724193 - RNA, 15 nt, Homo sapiens
ucuuucauacauuau

SEQ ID NO: 1724194 - RNA, 21 nt, Homo sapiens
ucuuucuuuucuauuagugaa

SEQ ID NO: 1724195 - RNA, 12 nt, Homo sapiens
ugaaacauaucu

SEQ ID NO: 1724196 - RNA, 15 nt, Homo sapiens
ugaaacauaucucuu

SEQ ID NO: 1724197 - RNA, 23 nt, Homo sapiens
ugaacacacauggaugcacacac

SEQ ID NO: 1724198 - RNA, 18 nt, Homo sapiens
ugaacauauccaucaucc

SEQ ID NO: 1724199 - RNA, 19 nt, Homo sapiens
ugaacuauuagagcugccu

SEQ ID NO: 1724200 - RNA, 14 nt, Homo sapiens
ugaagaaacaaaga

SEQ ID NO: 1724201 - RNA, 23 nt, Homo sapiens
ugacaacauuuuuguacauuaug

SEQ ID NO: 1724202 - RNA, 14 nt, Homo sapiens
ugacauugggacaa

SEQ ID NO: 1724203 - RNA, 18 nt, Homo sapiens
ugaccuuuguaguagaau

SEQ ID NO: 1724204 - RNA, 20 nt, Homo sapiens
ugacuaaugaggcauuacaa

SEQ ID NO: 1724205 - RNA, 15 nt, Homo sapiens
ugacuagccaucuca

SEQ ID NO: 1724206 - RNA, 20 nt, Homo sapiens
ugagaacuucucuucccaua

SEQ ID NO: 1724207 - RNA, 22 nt, Homo sapiens
ugagacauauuagucuuugaaa

SEQ ID NO: 1724208 - RNA, 22 nt, Homo sapiens
ugagcuggggaugucucucaug

SEQ ID NO: 1724209 - RNA, 20 nt, Homo sapiens
ugagggugacuauggagcug

SEQ ID NO: 1724210 - RNA, 22 nt, Homo sapiens
ugauaaaagauuuuccuauucc

SEQ ID NO: 1724211 - RNA, 12 nt, Homo sapiens
ugaucaucucac

SEQ ID NO: 1724212 - RNA, 14 nt, Homo sapiens
ugaugcccagcuca

SEQ ID NO: 1724213 - RNA, 21 nt, Homo sapiens
ugaugcccagcucagugccac

SEQ ID NO: 1724214 - RNA, 15 nt, Homo sapiens
ugauuguauuuaccu

SEQ ID NO: 1724215 - RNA, 16 nt, Homo sapiens
ugcacagagauaugca

SEQ ID NO: 1724216 - RNA, 12 nt, Homo sapiens
ugcaugggaaaa

SEQ ID NO: 1724217 - RNA, 18 nt, Homo sapiens
ugcccagcucagugccac

SEQ ID NO: 1724218 - RNA, 16 nt, Homo sapiens
ugccgggcugcacaga

SEQ ID NO: 1724219 - RNA, 20 nt, Homo sapiens
ugcgcacacacagauaugca

SEQ ID NO: 1724220 - RNA, 23 nt, Homo sapiens
ugcgcacacacagauaugcacac

SEQ ID NO: 1724221 - RNA, 17 nt, Homo sapiens
ugcuacuuugccauuaa

SEQ ID NO: 1724222 - RNA, 21 nt, Homo sapiens
ugcuauaauuccgaaacauac

SEQ ID NO: 1724223 - RNA, 14 nt, Homo sapiens
ugcucaccaagaag

SEQ ID NO: 1724224 - RNA, 19 nt, Homo sapiens
ugcuccaaauuuucaauaa

SEQ ID NO: 1724225 - RNA, 15 nt, Homo sapiens
ugcugggcuuggcag

SEQ ID NO: 1724226 - RNA, 20 nt, Homo sapiens
ugcuguagacauuugcuaug

SEQ ID NO: 1724227 - RNA, 18 nt, Homo sapiens
uggagaacaugcauacua

SEQ ID NO: 1724228 - RNA, 18 nt, Homo sapiens
uggcaaagagagguccag

SEQ ID NO: 1724229 - RNA, 12 nt, Homo sapiens
uggcugccuugu

SEQ ID NO: 1724230 - RNA, 23 nt, Homo sapiens
ugggcuuguaccacuuuugcaaa

SEQ ID NO: 1724231 - RNA, 16 nt, Homo sapiens
uggggaugucucucau

SEQ ID NO: 1724232 - RNA, 15 nt, Homo sapiens
uggggcugauuguau

SEQ ID NO: 1724233 - RNA, 21 nt, Homo sapiens
uggucacacagagauacgcaa

SEQ ID NO: 1724234 - RNA, 11 nt, Homo sapiens
uguaugugaca

SEQ ID NO: 1724235 - RNA, 13 nt, Homo sapiens
uguauuuccaaau

SEQ ID NO: 1724236 - RNA, 15 nt, Homo sapiens
ugucccagaaaagca

SEQ ID NO: 1724237 - RNA, 16 nt, Homo sapiens
ugucccagaaugccuc

SEQ ID NO: 1724238 - RNA, 18 nt, Homo sapiens
ugucccagaaugccuccu

SEQ ID NO: 1724239 - RNA, 16 nt, Homo sapiens
ugucguaggaaaacca

SEQ ID NO: 1724240 - RNA, 20 nt, Homo sapiens
ugucguaggaaaaccaugac

SEQ ID NO: 1724241 - RNA, 16 nt, Homo sapiens
ugugauauccuaggag

SEQ ID NO: 1724242 - RNA, 14 nt, Homo sapiens
ugugauguguccug

SEQ ID NO: 1724243 - RNA, 14 nt, Homo sapiens
uguguauauguaga

SEQ ID NO: 1724244 - RNA, 15 nt, Homo sapiens
uguuggcauuaacaa

SEQ ID NO: 1724245 - RNA, 20 nt, Homo sapiens
uguuuugauauggguaguau

SEQ ID NO: 1724246 - RNA, 18 nt, Homo sapiens
uuaaaaacaacgaaagaa

SEQ ID NO: 1724247 - RNA, 11 nt, Homo sapiens
uuaaaacuauu

SEQ ID NO: 1724248 - RNA, 11 nt, Homo sapiens
uuaaacgucau

SEQ ID NO: 1724249 - RNA, 21 nt, Homo sapiens
uuaaacugugguccaucucca

SEQ ID NO: 1724250 - RNA, 17 nt, Homo sapiens
uuaaauauuucugcaca

SEQ ID NO: 1724251 - RNA, 21 nt, Homo sapiens
uuaacaaaaggacaaccacag

SEQ ID NO: 1724252 - RNA, 15 nt, Homo sapiens
uuaacucucuguuac

SEQ ID NO: 1724253 - RNA, 20 nt, Homo sapiens
uuaagagagugaacauaucc

SEQ ID NO: 1724254 - RNA, 19 nt, Homo sapiens
uuaaucaaugaucaucuca

SEQ ID NO: 1724255 - RNA, 21 nt, Homo sapiens
uuacuauauuuauugauuuca

SEQ ID NO: 1724256 - RNA, 12 nt, Homo sapiens
uuacucuaugau

SEQ ID NO: 1724257 - RNA, 16 nt, Homo sapiens
uuacucuaugaugauu

SEQ ID NO: 1724258 - RNA, 20 nt, Homo sapiens
uuauuaagagguaagacuua

SEQ ID NO: 1724259 - RNA, 16 nt, Homo sapiens
uuauuaauuaaaccag

SEQ ID NO: 1724260 - RNA, 17 nt, Homo sapiens
uuauuaauuaaaccaga

SEQ ID NO: 1724261 - RNA, 21 nt, Homo sapiens
uucagaacucguuaaagcaaa

SEQ ID NO: 1724262 - RNA, 18 nt, Homo sapiens
uucauuuuaagagcaaaa

SEQ ID NO: 1724263 - RNA, 11 nt, Homo sapiens
uuccaaaaaga

SEQ ID NO: 1724264 - RNA, 18 nt, Homo sapiens
uuccacccacucuucaca

SEQ ID NO: 1724265 - RNA, 19 nt, Homo sapiens
uucccuaaagaacauaccu

SEQ ID NO: 1724266 - RNA, 21 nt, Homo sapiens
uuccggccuccugucccucau

SEQ ID NO: 1724267 - RNA, 12 nt, Homo sapiens
uuccuaaauaua

SEQ ID NO: 1724268 - RNA, 19 nt, Homo sapiens
uucgacguuugacuagcca

SEQ ID NO: 1724269 - RNA, 19 nt, Homo sapiens
uucuagcuaccuguauuau

SEQ ID NO: 1724270 - RNA, 18 nt, Homo sapiens
uucuauuaaggacauuua

SEQ ID NO: 1724271 - RNA, 15 nt, Homo sapiens
uuggcucuacccuga

SEQ ID NO: 1724272 - RNA, 16 nt, Homo sapiens
uuguauuuaccuucua

SEQ ID NO: 1724273 - RNA, 12 nt, Homo sapiens
uugucugucuca

SEQ ID NO: 1724274 - RNA, 12 nt, Homo sapiens
uugugccuuuag

SEQ ID NO: 1724275 - RNA, 19 nt, Homo sapiens
uuguuuuuuuccugaugaa

SEQ ID NO: 1724276 - RNA, 14 nt, Homo sapiens
uuuaaaauugugau

SEQ ID NO: 1724277 - RNA, 23 nt, Homo sapiens
uuuaacaaaaggacaaccacaga

SEQ ID NO: 1724278 - RNA, 14 nt, Homo sapiens
cccacaaaguuuca

SEQ ID NO: 1724279 - RNA, 14 nt, Homo sapiens
cccacuuggcauca

SEQ ID NO: 1724280 - RNA, 20 nt, Homo sapiens
cccauaccacccaaaaucau

SEQ ID NO: 1724281 - RNA, 21 nt, Homo sapiens
cccucaaagugucacaaugcu

SEQ ID NO: 1724282 - RNA, 11 nt, Homo sapiens
ccgaugcacac

SEQ ID NO: 1724283 - RNA, 23 nt, Homo sapiens
ccucacugcuguagacauuugcu

SEQ ID NO: 1724284 - RNA, 22 nt, Homo sapiens
ccuucaauggaaauuaaaacuc

SEQ ID NO: 1724285 - RNA, 14 nt, Homo sapiens
ccuucagauuugcc

SEQ ID NO: 1724286 - RNA, 14 nt, Homo sapiens
ccuuugucccagaa

SEQ ID NO: 1724287 - RNA, 17 nt, Homo sapiens
cgacguuugacuagcca

SEQ ID NO: 1724288 - RNA, 21 nt, Homo sapiens
cgacguuugacuagccaucuc

SEQ ID NO: 1724289 - RNA, 19 nt, Homo sapiens
cgaugcacacgcacauaga

SEQ ID NO: 1724290 - RNA, 19 nt, Homo sapiens
cgauugcaggagucccugc

SEQ ID NO: 1724291 - RNA, 13 nt, Homo sapiens
cgccaaugcacac

SEQ ID NO: 1724292 - RNA, 16 nt, Homo sapiens
cggaugcacacacaga

SEQ ID NO: 1724293 - RNA, 14 nt, Homo sapiens
cggaugcacagaga

SEQ ID NO: 1724294 - RNA, 21 nt, Homo sapiens
cggcugcgucuccuccgcaca

SEQ ID NO: 1724295 - RNA, 13 nt, Homo sapiens
cguaggaaaacca

SEQ ID NO: 1724296 - RNA, 16 nt, Homo sapiens
cguuugacuagccauc

SEQ ID NO: 1724297 - RNA, 20 nt, Homo sapiens
cguuugacuagccaucucaa

SEQ ID NO: 1724298 - RNA, 22 nt, Homo sapiens
cuaaguuaaauauuucugcaca

SEQ ID NO: 1724299 - RNA, 14 nt, Homo sapiens
cuaauccacaaccu

SEQ ID NO: 1724300 - RNA, 22 nt, Homo sapiens
cuaaucuaaacuguagcuguau

SEQ ID NO: 1724301 - RNA, 17 nt, Homo sapiens
cuaauuccacacccuca

SEQ ID NO: 1724302 - RNA, 16 nt, Homo sapiens
cuacaugcauuucaau

SEQ ID NO: 1724303 - RNA, 17 nt, Homo sapiens
cuacuaaaaaugcaaaa

SEQ ID NO: 1724304 - RNA, 20 nt, Homo sapiens
cuagacguuguaaugcacac

SEQ ID NO: 1724305 - RNA, 18 nt, Homo sapiens
cuagccaucucaagcaag

SEQ ID NO: 1724306 - RNA, 15 nt, Homo sapiens
cuaggguucaugucu

SEQ ID NO: 1724307 - RNA, 14 nt, Homo sapiens
cuaggugacauaua

SEQ ID NO: 1724308 - RNA, 15 nt, Homo sapiens
cuaggugacauauac

SEQ ID NO: 1724309 - RNA, 20 nt, Homo sapiens
cuauaauuccgaaacauaca

SEQ ID NO: 1724310 - RNA, 17 nt, Homo sapiens
cuauauucaaaauucaa

SEQ ID NO: 1724311 - RNA, 21 nt, Homo sapiens
cuauauuuauuuauguaggau

SEQ ID NO: 1724312 - RNA, 19 nt, Homo sapiens
cuauuccuugguucuguca

SEQ ID NO: 1724313 - RNA, 15 nt, Homo sapiens
cucaagugccauuca

SEQ ID NO: 1724314 - RNA, 17 nt, Homo sapiens
cucaauaaagugcuuug

SEQ ID NO: 1724315 - RNA, 14 nt, Homo sapiens
cucaucaggccauu

SEQ ID NO: 1724316 - RNA, 23 nt, Homo sapiens
cucaucaggccauugucccugaa

SEQ ID NO: 1724317 - RNA, 17 nt, Homo sapiens
cucauguucuuaacuuu

SEQ ID NO: 1724318 - RNA, 12 nt, Homo sapiens
cuccuaaaacaa

SEQ ID NO: 1724319 - RNA, 13 nt, Homo sapiens
cuccugcagggau

SEQ ID NO: 1724320 - RNA, 20 nt, Homo sapiens
cucuacucuggagguuuguu

SEQ ID NO: 1724321 - RNA, 14 nt, Homo sapiens
cucuagugaaugua

SEQ ID NO: 1724322 - RNA, 23 nt, Homo sapiens
cucucgcaagggaaguccuugca

SEQ ID NO: 1724323 - RNA, 18 nt, Homo sapiens
cucuugaauauguauuaa

SEQ ID NO: 1724324 - RNA, 13 nt, Homo sapiens
cucuuuaccuccu

SEQ ID NO: 1724325 - RNA, 17 nt, Homo sapiens
caagaacuccugaaauc

SEQ ID NO: 1724326 - RNA, 16 nt, Homo sapiens
caagaaguaacaaaag

SEQ ID NO: 1724327 - RNA, 20 nt, Homo sapiens
caagauugugucccauuccc

SEQ ID NO: 1724328 - RNA, 18 nt, Homo sapiens
caaggaaaaaaauucugu

SEQ ID NO: 1724329 - RNA, 16 nt, Homo sapiens
caagugccauucaucc

SEQ ID NO: 1724330 - RNA, 18 nt, Homo sapiens
caauaaagcauuuugcaa

SEQ ID NO: 1724331 - RNA, 20 nt, Homo sapiens
caaugcacaauuuauaauua

SEQ ID NO: 1724332 - RNA, 15 nt, Homo sapiens
caaugcacacacaca

SEQ ID NO: 1724333 - RNA, 16 nt, Homo sapiens
caaugcacgcacacau

SEQ ID NO: 1724334 - RNA, 22 nt, Homo sapiens
caaugcaguacaggacauauau

SEQ ID NO: 1724335 - RNA, 17 nt, Homo sapiens
caauuuuaaacauaucc

SEQ ID NO: 1724336 - RNA, 23 nt, Homo sapiens
cacaacccuucagauuugccuua

SEQ ID NO: 1724337 - RNA, 16 nt, Homo sapiens
cacaauucauuuaccc

SEQ ID NO: 1724338 - RNA, 15 nt, Homo sapiens
cacacacacagagau

SEQ ID NO: 1724339 - RNA, 13 nt, Homo sapiens
cacacacagaugc

SEQ ID NO: 1724340 - RNA, 13 nt, Homo sapiens
cacacacauauau

SEQ ID NO: 1724341 - RNA, 21 nt, Homo sapiens
cacacacauauauuauuugca

SEQ ID NO: 1724342 - RNA, 20 nt, Homo sapiens
cacacagauauacacaugga

SEQ ID NO: 1724343 - RNA, 15 nt, Homo sapiens
cacacagauaugcac

SEQ ID NO: 1724344 - RNA, 15 nt, Homo sapiens
cacacagaugcacac

SEQ ID NO: 1724345 - RNA, 20 nt, Homo sapiens
cacacagaugcacacacaga

SEQ ID NO: 1724346 - RNA, 22 nt, Homo sapiens
cacacagauggucacacagaga

SEQ ID NO: 1724347 - RNA, 16 nt, Homo sapiens
cacaccgauguacaca

SEQ ID NO: 1724348 - RNA, 15 nt, Homo sapiens
cacaccgaugugcgc

SEQ ID NO: 1724349 - RNA, 17 nt, Homo sapiens
cacacgccaaugcacac

SEQ ID NO: 1724350 - RNA, 19 nt, Homo sapiens
cacacggaugcacagagau

SEQ ID NO: 1724351 - RNA, 14 nt, Homo sapiens
cacagauaugcaca

SEQ ID NO: 1724352 - RNA, 16 nt, Homo sapiens
cacagauaugcacaca

SEQ ID NO: 1724353 - RNA, 19 nt, Homo sapiens
cacagaugcacacacagau

SEQ ID NO: 1724354 - RNA, 21 nt, Homo sapiens
cacagcaagucacuggccagu

SEQ ID NO: 1724355 - RNA, 18 nt, Homo sapiens
cacaguaaagaaauucuu

SEQ ID NO: 1724356 - RNA, 23 nt, Homo sapiens
cacauaagccaaaacugagcaua

SEQ ID NO: 1724357 - RNA, 15 nt, Homo sapiens
cacauagagauaugc

SEQ ID NO: 1724358 - RNA, 14 nt, Homo sapiens
cacaucagugcaca

SEQ ID NO: 1724359 - RNA, 18 nt, Homo sapiens
caccugcacgugaucugc

SEQ ID NO: 1724360 - RNA, 18 nt, Homo sapiens
cacgacugcaacauacag

SEQ ID NO: 1724361 - RNA, 14 nt, Homo sapiens
cacgccaaugcaca

SEQ ID NO: 1724362 - RNA, 16 nt, Homo sapiens
cacggaugcacagaga

SEQ ID NO: 1724363 - RNA, 13 nt, Homo sapiens
cacucaagugcca

SEQ ID NO: 1724364 - RNA, 23 nt, Homo sapiens
cagauaugcacacacauggauga

SEQ ID NO: 1724365 - RNA, 16 nt, Homo sapiens
cagaugcacacacaga

SEQ ID NO: 1724366 - RNA, 23 nt, Homo sapiens
cagaugcacacacagaugcacac

SEQ ID NO: 1724367 - RNA, 19 nt, Homo sapiens
cagauguacgacuugcaua

SEQ ID NO: 1724368 - RNA, 21 nt, Homo sapiens
cagauguuucacugacaguuu

SEQ ID NO: 1724369 - RNA, 21 nt, Homo sapiens
cagcaccaucucuuuaccucc

SEQ ID NO: 1724370 - RNA, 15 nt, Homo sapiens
cagcagcaacaacug

SEQ ID NO: 1724371 - RNA, 18 nt, Homo sapiens
cagcccgggucaucugua

SEQ ID NO: 1724372 - RNA, 15 nt, Homo sapiens
cagcucagugccaca

SEQ ID NO: 1724373 - RNA, 19 nt, Homo sapiens
cagcuccacaguguugcca

SEQ ID NO: 1724374 - RNA, 11 nt, Homo sapiens
caggacauaua

SEQ ID NO: 1724375 - RNA, 13 nt, Homo sapiens
caggagucccugc

SEQ ID NO: 1724376 - RNA, 15 nt, Homo sapiens
cagguaugcaaauau

SEQ ID NO: 1724377 - RNA, 15 nt, Homo sapiens
cagucugcuuagaaa

SEQ ID NO: 1724378 - RNA, 17 nt, Homo sapiens
cagugagaagccagcuu

SEQ ID NO: 1724379 - RNA, 19 nt, Homo sapiens
caguucauccugcauggga

SEQ ID NO: 1724380 - RNA, 15 nt, Homo sapiens
caguugcaggugcca

SEQ ID NO: 1724381 - RNA, 22 nt, Homo sapiens
caguuuuuaacaauaaauucuu

SEQ ID NO: 1724382 - RNA, 20 nt, Homo sapiens
cauaacaguuuuaugcugau

SEQ ID NO: 1724383 - RNA, 21 nt, Homo sapiens
cauaccuggcccugugccuug

SEQ ID NO: 1724384 - RNA, 22 nt, Homo sapiens
cauaccuggcccugugccuugg

SEQ ID NO: 1724385 - RNA, 15 nt, Homo sapiens
cauagagauaugcac

SEQ ID NO: 1724386 - RNA, 20 nt, Homo sapiens
cauagagauaugcacacaca

SEQ ID NO: 1724387 - RNA, 19 nt, Homo sapiens
caugaacacacauggaugc

SEQ ID NO: 1724388 - RNA, 22 nt, Homo sapiens
caugaacacacauggaugcaca

SEQ ID NO: 1724389 - RNA, 23 nt, Homo sapiens
caugaacacacauggaugcacac

SEQ ID NO: 1724390 - RNA, 17 nt, Homo sapiens
caugaguuggcugggaa

SEQ ID NO: 1724391 - RNA, 20 nt, Homo sapiens
caugcauagagugugaugua

SEQ ID NO: 1724392 - RNA, 12 nt, Homo sapiens
cauggaugcaca

SEQ ID NO: 1724393 - RNA, 18 nt, Homo sapiens
cauguucuuaacuuuaaa

SEQ ID NO: 1724394 - RNA, 22 nt, Homo sapiens
cauucacagcaagucacuggcc

SEQ ID NO: 1724395 - RNA, 14 nt, Homo sapiens
cauucauagccaga

SEQ ID NO: 1724396 - RNA, 16 nt, Homo sapiens
cauugggacaacacuu

SEQ ID NO: 1724397 - RNA, 19 nt, Homo sapiens
cauugguguugacauacau

SEQ ID NO: 1724398 - RNA, 21 nt, Homo sapiens
ccaacauuaaaagccaccccc

SEQ ID NO: 1724399 - RNA, 21 nt, Homo sapiens
ccaauacguagauuuuugcuc

SEQ ID NO: 1724400 - RNA, 23 nt, Homo sapiens
ccaaucggcuuucauuuugcauu

SEQ ID NO: 1724401 - RNA, 11 nt, Homo sapiens
ccaauuccuca

SEQ ID NO: 1724402 - RNA, 12 nt, Homo sapiens
ccaauuccucau

SEQ ID NO: 1724403 - RNA, 14 nt, Homo sapiens
ccacauaccuggcc

SEQ ID NO: 1724404 - RNA, 13 nt, Homo sapiens
ccacccaaaauca

SEQ ID NO: 1724405 - RNA, 19 nt, Homo sapiens
ccacucaggggucauucau

SEQ ID NO: 1724406 - RNA, 17 nt, Homo sapiens
ccacuuggcaucauuca

SEQ ID NO: 1724407 - RNA, 17 nt, Homo sapiens
ccagaaaagcaguggcu

SEQ ID NO: 1724408 - RNA, 23 nt, Homo sapiens
ccagaacaaauuuuaacaaaagg

SEQ ID NO: 1724409 - RNA, 20 nt, Homo sapiens
ccagaggaagggacaccaag

SEQ ID NO: 1724410 - RNA, 18 nt, Homo sapiens
ccagaggucuggcccuau

SEQ ID NO: 1724411 - RNA, 18 nt, Homo sapiens
ccagcaugguaguggcaa

SEQ ID NO: 1724412 - RNA, 14 nt, Homo sapiens
ccagcuuuccucau

SEQ ID NO: 1724413 - RNA, 17 nt, Homo sapiens
ccagcuuuccucaucag

SEQ ID NO: 1724414 - RNA, 20 nt, Homo sapiens
ccaggauggcgcaggaacuc

SEQ ID NO: 1724415 - RNA, 21 nt, Homo sapiens
ccaguggcuggaucugugagg

SEQ ID NO: 1724416 - RNA, 14 nt, Homo sapiens
ccauagcaccucca

SEQ ID NO: 1724417 - RNA, 16 nt, Homo sapiens
ccaucucuuuaccucc

SEQ ID NO: 1724418 - RNA, 12 nt, Homo sapiens
ccaucuguaugc

SEQ ID NO: 1724419 - RNA, 21 nt, Homo sapiens
ccauggggcugauuguauuua

SEQ ID NO: 1724420 - RNA, 21 nt, Homo sapiens
ccauuggagucccugaaggac

SEQ ID NO: 1724421 - RNA, 16 nt, Homo sapiens
cccagcucagugccac

SEQ ID NO: 1724422 - RNA, 18 nt, Homo sapiens
cccugauuuuaucauucu

SEQ ID NO: 1724423 - RNA, 20 nt, Homo sapiens
cccugucauucgugguugau

SEQ ID NO: 1724424 - RNA, 12 nt, Homo sapiens
ccgaaacauaca

SEQ ID NO: 1724425 - RNA, 19 nt, Homo sapiens
ccggccuccugucccucau

SEQ ID NO: 1724426 - RNA, 14 nt, Homo sapiens
ccuaaaaaauuccu

SEQ ID NO: 1724427 - RNA, 17 nt, Homo sapiens
ccuaauuccacacccuc

SEQ ID NO: 1724428 - RNA, 14 nt, Homo sapiens
ccucauccauagca

SEQ ID NO: 1724429 - RNA, 15 nt, Homo sapiens
ccuccugucccucau

SEQ ID NO: 1724430 - RNA, 19 nt, Homo sapiens
ccugauuuaauaugcaaag

SEQ ID NO: 1724431 - RNA, 18 nt, Homo sapiens
ccuggccuguggagagaa

SEQ ID NO: 1724432 - RNA, 15 nt, Homo sapiens
ccugugccuuuugcc

SEQ ID NO: 1724433 - RNA, 19 nt, Homo sapiens
ccuucauugcuggagacag

SEQ ID NO: 1724434 - RNA, 20 nt, Homo sapiens
ccuuggugauuccgcaguga

SEQ ID NO: 1724435 - RNA, 21 nt, Homo sapiens
ccuuggugauuccgcagugag

SEQ ID NO: 1724436 - RNA, 22 nt, Homo sapiens
ccuugucguaggaaaaccauga

SEQ ID NO: 1724437 - RNA, 17 nt, Homo sapiens
ccuuuccccucccucag

SEQ ID NO: 1724438 - RNA, 19 nt, Homo sapiens
cgcacauagagauaugcac

SEQ ID NO: 1724439 - RNA, 12 nt, Homo sapiens
cgcaggaacuca

SEQ ID NO: 1724440 - RNA, 18 nt, Homo sapiens
cguuaaagcaaagcgcua

SEQ ID NO: 1724441 - RNA, 22 nt, Homo sapiens
cguuugacuagccaucucaagc

SEQ ID NO: 1724442 - RNA, 22 nt, Homo sapiens
cuaaccauagcugaccuuugua

SEQ ID NO: 1724443 - RNA, 22 nt, Homo sapiens
cuaaguaaaaauauuaacugac

SEQ ID NO: 1724444 - RNA, 19 nt, Homo sapiens
cuaauagagacacagagau

SEQ ID NO: 1724445 - RNA, 14 nt, Homo sapiens
cuaauuauuauuaa

SEQ ID NO: 1724446 - RNA, 19 nt, Homo sapiens
cuacucgggaggcugaggc

SEQ ID NO: 1724447 - RNA, 13 nt, Homo sapiens
cuagccaucucaa

SEQ ID NO: 1724448 - RNA, 17 nt, Homo sapiens
cuaggagguaaugacca

SEQ ID NO: 1724449 - RNA, 11 nt, Homo sapiens
cuaugguucuc

SEQ ID NO: 1724450 - RNA, 23 nt, Homo sapiens
cuauuagagcugccugugccuuu

SEQ ID NO: 1724451 - RNA, 16 nt, Homo sapiens
cuauuuaugaauauua

SEQ ID NO: 1724452 - RNA, 13 nt, Homo sapiens
aagacacucaauc

SEQ ID NO: 1724453 - RNA, 13 nt, Homo sapiens
aagacauaauuca

SEQ ID NO: 1724454 - RNA, 15 nt, Homo sapiens
aagacauaauucaca

SEQ ID NO: 1724455 - RNA, 17 nt, Homo sapiens
aagauuacaaaagcaau

SEQ ID NO: 1724456 - RNA, 19 nt, Homo sapiens
aagauugugucccauuccc

SEQ ID NO: 1724457 - RNA, 22 nt, Homo sapiens
aagcaaaaaguuguuuuaucca

SEQ ID NO: 1724458 - RNA, 16 nt, Homo sapiens
aagcaauuuucauuua

SEQ ID NO: 1724459 - RNA, 13 nt, Homo sapiens
aagcauuuugcaa

SEQ ID NO: 1724460 - RNA, 22 nt, Homo sapiens
aagcccaccugcacgugaucug

SEQ ID NO: 1724461 - RNA, 13 nt, Homo sapiens
aagccuuuugcaa

SEQ ID NO: 1724462 - RNA, 20 nt, Homo sapiens
aaggaguaaccaauuucuuu

SEQ ID NO: 1724463 - RNA, 13 nt, Homo sapiens
aaggcugguccca

SEQ ID NO: 1724464 - RNA, 18 nt, Homo sapiens
aagggacaccaagccuug

SEQ ID NO: 1724465 - RNA, 17 nt, Homo sapiens
aagguuuuuuuuaucuu

SEQ ID NO: 1724466 - RNA, 15 nt, Homo sapiens
aaguaaacucaaaca

SEQ ID NO: 1724467 - RNA, 18 nt, Homo sapiens
aaguauaggauaaauuac

SEQ ID NO: 1724468 - RNA, 18 nt, Homo sapiens
aagucuaguuaccuacuu

SEQ ID NO: 1724469 - RNA, 16 nt, Homo sapiens
aagugccauucauccu

SEQ ID NO: 1724470 - RNA, 20 nt, Homo sapiens
aagugcguguaauuaaauac

SEQ ID NO: 1724471 - RNA, 12 nt, Homo sapiens
aagugcuacuuu

SEQ ID NO: 1724472 - RNA, 17 nt, Homo sapiens
aaguuuauaaaagugaa

SEQ ID NO: 1724473 - RNA, 12 nt, Homo sapiens
aauaagugccag

SEQ ID NO: 1724474 - RNA, 22 nt, Homo sapiens
aauaaucauaaacuauauucug

SEQ ID NO: 1724475 - RNA, 18 nt, Homo sapiens
aauacacucaagugccau

SEQ ID NO: 1724476 - RNA, 19 nt, Homo sapiens
aauacacucaagugccauu

SEQ ID NO: 1724477 - RNA, 21 nt, Homo sapiens
aauagaauuucuuucccuaaa

SEQ ID NO: 1724478 - RNA, 18 nt, Homo sapiens
aauagauuuaacccuuca

SEQ ID NO: 1724479 - RNA, 21 nt, Homo sapiens
aauaucguaucauuguaauca

SEQ ID NO: 1724480 - RNA, 16 nt, Homo sapiens
aauauguauuuauguc

SEQ ID NO: 1724481 - RNA, 18 nt, Homo sapiens
aaucaaugaucaucucac

SEQ ID NO: 1724482 - RNA, 22 nt, Homo sapiens
aaucucccaaguauugauuuaa

SEQ ID NO: 1724483 - RNA, 18 nt, Homo sapiens
aaugagacuuuaaaagca

SEQ ID NO: 1724484 - RNA, 22 nt, Homo sapiens
aaugauugauuauaucauuuug

SEQ ID NO: 1724485 - RNA, 15 nt, Homo sapiens
aaugcacacacacag

SEQ ID NO: 1724486 - RNA, 17 nt, Homo sapiens
aauuaaaacucauuuag

SEQ ID NO: 1724487 - RNA, 20 nt, Homo sapiens
aauuaacugcuaacuucuau

SEQ ID NO: 1724488 - RNA, 21 nt, Homo sapiens
aauuccucagggggaacagcu

SEQ ID NO: 1724489 - RNA, 15 nt, Homo sapiens
aauuuuaaacauauc

SEQ ID NO: 1724490 - RNA, 16 nt, Homo sapiens
aauuuuaaacauaucc

SEQ ID NO: 1724491 - RNA, 18 nt, Homo sapiens
acaaccuguuaccacuuc

SEQ ID NO: 1724492 - RNA, 23 nt, Homo sapiens
acaaugcaguacaggacauauau

SEQ ID NO: 1724493 - RNA, 20 nt, Homo sapiens
acaaugcuccuccugaugac

SEQ ID NO: 1724494 - RNA, 23 nt, Homo sapiens
acaauggacuugcaaagcuucac

SEQ ID NO: 1724495 - RNA, 22 nt, Homo sapiens
acaauuaagagagugaacauau

SEQ ID NO: 1724496 - RNA, 17 nt, Homo sapiens
acacacacgccaaugca

SEQ ID NO: 1724497 - RNA, 19 nt, Homo sapiens
acacacagagauaugcaca

SEQ ID NO: 1724498 - RNA, 18 nt, Homo sapiens
acacacagauaugcacac

SEQ ID NO: 1724499 - RNA, 13 nt, Homo sapiens
acacacagaugca

SEQ ID NO: 1724500 - RNA, 16 nt, Homo sapiens
acacacagaugcacac

SEQ ID NO: 1724501 - RNA, 12 nt, Homo sapiens
acacacauggau

SEQ ID NO: 1724502 - RNA, 23 nt, Homo sapiens
acacaccgauguacacacacaga

SEQ ID NO: 1724503 - RNA, 20 nt, Homo sapiens
acacacggaugcacacacag

SEQ ID NO: 1724504 - RNA, 16 nt, Homo sapiens
acacagauaugcacac

SEQ ID NO: 1724505 - RNA, 19 nt, Homo sapiens
acacagaugcacacacaga

SEQ ID NO: 1724506 - RNA, 22 nt, Homo sapiens
acacagauggucacacagagau

SEQ ID NO: 1724507 - RNA, 22 nt, Homo sapiens
acacauaagccaaaacugagca

SEQ ID NO: 1724508 - RNA, 19 nt, Homo sapiens
acacaucagugcacacgga

SEQ ID NO: 1724509 - RNA, 15 nt, Homo sapiens
acaccaaugcgcaca

SEQ ID NO: 1724510 - RNA, 16 nt, Homo sapiens
acaccgaugugcgcac

SEQ ID NO: 1724511 - RNA, 16 nt, Homo sapiens
acacgccaaugcacac

SEQ ID NO: 1724512 - RNA, 15 nt, Homo sapiens
acacggaugcacaga

SEQ ID NO: 1724513 - RNA, 16 nt, Homo sapiens
acacucaagugccauu

SEQ ID NO: 1724514 - RNA, 16 nt, Homo sapiens
acacuccuaaaauugc

SEQ ID NO: 1724515 - RNA, 24 nt, Homo sapiens
acacuuaucagcagcaacaacugu

SEQ ID NO: 1724516 - RNA, 14 nt, Homo sapiens
acagaagauuacaa

SEQ ID NO: 1724517 - RNA, 16 nt, Homo sapiens
acagagccaugacuca

SEQ ID NO: 1724518 - RNA, 19 nt, Homo sapiens
acagaguugguguucauaa

SEQ ID NO: 1724519 - RNA, 19 nt, Homo sapiens
acagaugcacacacaccga

SEQ ID NO: 1724520 - RNA, 16 nt, Homo sapiens
acagaugcacacacag

SEQ ID NO: 1724521 - RNA, 22 nt, Homo sapiens
acagauggaauuagaaauauau

SEQ ID NO: 1724522 - RNA, 23 nt, Homo sapiens
acagauuggccagaaaccuuccu

SEQ ID NO: 1724523 - RNA, 22 nt, Homo sapiens
acauaccuggcccugugccuug

SEQ ID NO: 1724524 - RNA, 23 nt, Homo sapiens
acauaccuggcccugugccuugg

SEQ ID NO: 1724525 - RNA, 17 nt, Homo sapiens
acauacuuacaugugug

SEQ ID NO: 1724526 - RNA, 16 nt, Homo sapiens
acauagagauaugcac

SEQ ID NO: 1724527 - RNA, 22 nt, Homo sapiens
acauagagauaugcacacacag

SEQ ID NO: 1724528 - RNA, 13 nt, Homo sapiens
acaugcauuucaa

SEQ ID NO: 1724529 - RNA, 13 nt, Homo sapiens
acauguguguaua

SEQ ID NO: 1724530 - RNA, 17 nt, Homo sapiens
acauuaaaauagcacau

SEQ ID NO: 1724531 - RNA, 19 nt, Homo sapiens
accccagcaauuaugaaaa

SEQ ID NO: 1724532 - RNA, 13 nt, Homo sapiens
acccugaguucau

SEQ ID NO: 1724533 - RNA, 22 nt, Homo sapiens
acccuuaggccagcaccaucuc

SEQ ID NO: 1724534 - RNA, 12 nt, Homo sapiens
accgaugcacac

SEQ ID NO: 1724535 - RNA, 14 nt, Homo sapiens
accugagacauauu

SEQ ID NO: 1724536 - RNA, 15 nt, Homo sapiens
accuugaagacuauu

SEQ ID NO: 1724537 - RNA, 14 nt, Homo sapiens
acgaagaagcaacu

SEQ ID NO: 1724538 - RNA, 14 nt, Homo sapiens
acgccaaugcacac

SEQ ID NO: 1724539 - RNA, 12 nt, Homo sapiens
acggaugcacag

SEQ ID NO: 1724540 - RNA, 12 nt, Homo sapiens
acgucauucagu

SEQ ID NO: 1724541 - RNA, 14 nt, Homo sapiens
acuaaaaaugcaaa

SEQ ID NO: 1724542 - RNA, 20 nt, Homo sapiens
acuagccaucucaagcaagu

SEQ ID NO: 1724543 - RNA, 16 nt, Homo sapiens
acuauuuaugaauauu

SEQ ID NO: 1724544 - RNA, 19 nt, Homo sapiens
acuauuucuugugguuaua

SEQ ID NO: 1724545 - RNA, 22 nt, Homo sapiens
acucaauaaauacauguuaaau

SEQ ID NO: 1724546 - RNA, 17 nt, Homo sapiens
acucaggggucauucau

SEQ ID NO: 1724547 - RNA, 18 nt, Homo sapiens
acucagucuuuaaucuga

SEQ ID NO: 1724548 - RNA, 19 nt, Homo sapiens
acuccaagauucaaagaga

SEQ ID NO: 1724549 - RNA, 20 nt, Homo sapiens
acucucagcagcuaugguag

SEQ ID NO: 1724550 - RNA, 21 nt, Homo sapiens
acucuggagguuuguuuagaa

SEQ ID NO: 1724551 - RNA, 16 nt, Homo sapiens
acucuuuaagaccuca

SEQ ID NO: 1724552 - RNA, 16 nt, Homo sapiens
acugaaucuaaccaua

SEQ ID NO: 1724553 - RNA, 17 nt, Homo sapiens
acugugguccaucucca

SEQ ID NO: 1724554 - RNA, 17 nt, Homo sapiens
acuuacauguguguaua

SEQ ID NO: 1724555 - RNA, 22 nt, Homo sapiens
acuuaguacuaucugugcguag

SEQ ID NO: 1724556 - RNA, 22 nt, Homo sapiens
acuuauaauuacaaugcacaau

SEQ ID NO: 1724557 - RNA, 14 nt, Homo sapiens
acuuaucaacauuu

SEQ ID NO: 1724558 - RNA, 13 nt, Homo sapiens
acuuugccauuaa

SEQ ID NO: 1724559 - RNA, 15 nt, Homo sapiens
acuuuuaaaacuaua

SEQ ID NO: 1724560 - RNA, 20 nt, Homo sapiens
acuuuuugaaaaaaguauag

SEQ ID NO: 1724561 - RNA, 19 nt, Homo sapiens
agaaaacaagugggacaua

SEQ ID NO: 1724562 - RNA, 12 nt, Homo sapiens
agaaaacuaauc

SEQ ID NO: 1724563 - RNA, 13 nt, Homo sapiens
agaaaacuaaucu

SEQ ID NO: 1724564 - RNA, 14 nt, Homo sapiens
agaaaacugucauu

SEQ ID NO: 1724565 - RNA, 18 nt, Homo sapiens
agaaacagaagauuacaa

SEQ ID NO: 1724566 - RNA, 19 nt, Homo sapiens
agaaacauucuuuccuaaa

SEQ ID NO: 1724567 - RNA, 20 nt, Homo sapiens
agaagggaagccuuuugcaa

SEQ ID NO: 1724568 - RNA, 15 nt, Homo sapiens
agaaucaugggaugu

SEQ ID NO: 1724569 - RNA, 20 nt, Homo sapiens
agacaggcgcuggacagagg

SEQ ID NO: 1724570 - RNA, 21 nt, Homo sapiens
agagacuaauagagacacaga

SEQ ID NO: 1724571 - RNA, 17 nt, Homo sapiens
agagcugaacuauuaga

SEQ ID NO: 1724572 - RNA, 23 nt, Homo sapiens
agagcugccugugccuuuugcca

SEQ ID NO: 1724573 - RNA, 22 nt, Homo sapiens
agaggguguugaguucacugug

SEQ ID NO: 1724574 - RNA, 14 nt, Homo sapiens
agagugaacauauc

SEQ ID NO: 1724575 - RNA, 21 nt, Homo sapiens
agagugggguagguugggaga

SEQ ID NO: 1724576 - RNA, 14 nt, Homo sapiens
agaugaacucuucu

SEQ ID NO: 1724577 - RNA, 20 nt, Homo sapiens
agauguuugcuuuuguuaaa

SEQ ID NO: 1724578 - RNA, 13 nt, Homo sapiens
agauuugccuuau

SEQ ID NO: 1724579 - RNA, 19 nt, Homo sapiens
agcaacaacugucaguuca

SEQ ID NO: 1724580 - RNA, 14 nt, Homo sapiens
aaaaaguauaggau

SEQ ID NO: 1724581 - RNA, 18 nt, Homo sapiens
aaaaaugaagacacucaa

SEQ ID NO: 1724582 - RNA, 17 nt, Homo sapiens
aaaaguuguuuuaucca

SEQ ID NO: 1724583 - RNA, 14 nt, Homo sapiens
aaaauagcacauga

SEQ ID NO: 1724584 - RNA, 18 nt, Homo sapiens
aaacaagugggacauauu

SEQ ID NO: 1724585 - RNA, 13 nt, Homo sapiens
aaacaaucuccca

SEQ ID NO: 1724586 - RNA, 22 nt, Homo sapiens
aaacagaagauuacaaaagcaa

SEQ ID NO: 1724587 - RNA, 15 nt, Homo sapiens
aaacguccacagagu

SEQ ID NO: 1724588 - RNA, 16 nt, Homo sapiens
aaacugucacaaguug

SEQ ID NO: 1724589 - RNA, 19 nt, Homo sapiens
aaagaaggcauggacuucu

SEQ ID NO: 1724590 - RNA, 15 nt, Homo sapiens
aaagcuucacuucau

SEQ ID NO: 1724591 - RNA, 15 nt, Homo sapiens
aaaggaacuaugaaa

SEQ ID NO: 1724592 - RNA, 20 nt, Homo sapiens
aaauauguuucacacaaaca

SEQ ID NO: 1724593 - RNA, 20 nt, Homo sapiens
aaauauuaacugacgaagaa

SEQ ID NO: 1724594 - RNA, 16 nt, Homo sapiens
aaaugcuuuuccucaa

SEQ ID NO: 1724595 - RNA, 16 nt, Homo sapiens
aaaugugggaguucau

SEQ ID NO: 1724596 - RNA, 20 nt, Homo sapiens
aaauuagguugaaacauauc

SEQ ID NO: 1724597 - RNA, 13 nt, Homo sapiens
aacacacauggau

SEQ ID NO: 1724598 - RNA, 18 nt, Homo sapiens
aacacacauggaugcaca

SEQ ID NO: 1724599 - RNA, 19 nt, Homo sapiens
aacacacauggaugcacac

SEQ ID NO: 1724600 - RNA, 19 nt, Homo sapiens
aacacggugaaacccgucu

SEQ ID NO: 1724601 - RNA, 16 nt, Homo sapiens
aacaugcuugcauuau

SEQ ID NO: 1724602 - RNA, 17 nt, Homo sapiens
aacaugcuugcauuaua

SEQ ID NO: 1724603 - RNA, 16 nt, Homo sapiens
aacauggagaacuugc

SEQ ID NO: 1724604 - RNA, 16 nt, Homo sapiens
aacucguuaaagcaaa

SEQ ID NO: 1724605 - RNA, 23 nt, Homo sapiens
aacucuguuuugcuaugcuauaa

SEQ ID NO: 1724606 - RNA, 13 nt, Homo sapiens
aacugaacauauu

SEQ ID NO: 1724607 - RNA, 23 nt, Homo sapiens
aacuucauuuuucuaauaaucau

SEQ ID NO: 1724608 - RNA, 23 nt, Homo sapiens
aagaagggaagccuuuugcaaau

SEQ ID NO: 1724609 - RNA, 14 nt, Homo sapiens
cugugaacugauca

SEQ ID NO: 1724610 - RNA, 21 nt, Homo sapiens
cugugaggggcucucucauga

SEQ ID NO: 1724611 - RNA, 14 nt, Homo sapiens
cugugccuuuugcc

SEQ ID NO: 1724612 - RNA, 16 nt, Homo sapiens
cuguucuuuuguccca

SEQ ID NO: 1724613 - RNA, 17 nt, Homo sapiens
cuguuuugcuaugcuau

SEQ ID NO: 1724614 - RNA, 17 nt, Homo sapiens
cuuaaugagacuuuaaa

SEQ ID NO: 1724615 - RNA, 18 nt, Homo sapiens
cuuaucagcagcaacaac

SEQ ID NO: 1724616 - RNA, 21 nt, Homo sapiens
cuucuauuaaggacauuuagc

SEQ ID NO: 1724617 - RNA, 18 nt, Homo sapiens
cuucuuaacucucuguua

SEQ ID NO: 1724618 - RNA, 20 nt, Homo sapiens
cuugaagacuauugguuuga

SEQ ID NO: 1724619 - RNA, 14 nt, Homo sapiens
cuuucauacauuau

SEQ ID NO: 1724620 - RNA, 19 nt, Homo sapiens
cuuucuaaaacacauuuaa

SEQ ID NO: 1724621 - RNA, 22 nt, Homo sapiens
cuuuuaaauguugaauauuccc

SEQ ID NO: 1724622 - RNA, 21 nt, Homo sapiens
cuuuuugaauucuauguuggc

SEQ ID NO: 1724623 - RNA, 14 nt, Homo sapiens
gaaaaaaguauagg

SEQ ID NO: 1724624 - RNA, 21 nt, Homo sapiens
gaaaacuaaucuaaacuguag

SEQ ID NO: 1724625 - RNA, 18 nt, Homo sapiens
gaaaauacaaaagguaaa

SEQ ID NO: 1724626 - RNA, 23 nt, Homo sapiens
gaaaaucuucauggaauucacaa

SEQ ID NO: 1724627 - RNA, 15 nt, Homo sapiens
gaaauuaaaacucau

SEQ ID NO: 1724628 - RNA, 14 nt, Homo sapiens
gaaggaauuauucc

SEQ ID NO: 1724629 - RNA, 23 nt, Homo sapiens
gaauaggcacuuuaaaacacucu

SEQ ID NO: 1724630 - RNA, 20 nt, Homo sapiens
gaauuccuaaaauuauggaa

SEQ ID NO: 1724631 - RNA, 12 nt, Homo sapiens
gacacaugccag

SEQ ID NO: 1724632 - RNA, 18 nt, Homo sapiens
gacacaugccagggccau

SEQ ID NO: 1724633 - RNA, 20 nt, Homo sapiens
gacgagaugacgguguuauu

SEQ ID NO: 1724634 - RNA, 20 nt, Homo sapiens
gacggaaaggaaaaacugau

SEQ ID NO: 1724635 - RNA, 19 nt, Homo sapiens
gacgugagugugacuuuuu

SEQ ID NO: 1724636 - RNA, 21 nt, Homo sapiens
gacguuugacuagccaucuca

SEQ ID NO: 1724637 - RNA, 15 nt, Homo sapiens
gacuagccaucucaa

SEQ ID NO: 1724638 - RNA, 22 nt, Homo sapiens
gacucaauaaauacauguuaaa

SEQ ID NO: 1724639 - RNA, 15 nt, Homo sapiens
gacucuaaagaaaca

SEQ ID NO: 1724640 - RNA, 16 nt, Homo sapiens
gagaacaugcauacua

SEQ ID NO: 1724641 - RNA, 23 nt, Homo sapiens
gagaaccuaauaagugcuacuuu

SEQ ID NO: 1724642 - RNA, 16 nt, Homo sapiens
gagaacuucucuuccc

SEQ ID NO: 1724643 - RNA, 20 nt, Homo sapiens
gagaagccagcuuuccucau

SEQ ID NO: 1724644 - RNA, 21 nt, Homo sapiens
gagaagccagcuuuccucauc

SEQ ID NO: 1724645 - RNA, 23 nt, Homo sapiens
gagagcaaaaaggggaaauaugu

SEQ ID NO: 1724646 - RNA, 16 nt, Homo sapiens
gagauacgcaaacaca

SEQ ID NO: 1724647 - RNA, 11 nt, Homo sapiens
gagauaugcac

SEQ ID NO: 1724648 - RNA, 20 nt, Homo sapiens
gagcccaagaaaguaauuag

SEQ ID NO: 1724649 - RNA, 17 nt, Homo sapiens
gagcuccuuagccuuug

SEQ ID NO: 1724650 - RNA, 16 nt, Homo sapiens
gaggacagauuaauag

SEQ ID NO: 1724651 - RNA, 19 nt, Homo sapiens
gagucugaaauggggcuac

SEQ ID NO: 1724652 - RNA, 21 nt, Homo sapiens
gaguugguguucauaauuuca

SEQ ID NO: 1724653 - RNA, 16 nt, Homo sapiens
gauauaauuaacauaa

SEQ ID NO: 1724654 - RNA, 18 nt, Homo sapiens
gaucauuaucagccugug

SEQ ID NO: 1724655 - RNA, 12 nt, Homo sapiens
gaugagggccac

SEQ ID NO: 1724656 - RNA, 12 nt, Homo sapiens
gaugcacacaca

SEQ ID NO: 1724657 - RNA, 14 nt, Homo sapiens
gauggaggacucca

SEQ ID NO: 1724658 - RNA, 14 nt, Homo sapiens
gauguacacacaca

SEQ ID NO: 1724659 - RNA, 23 nt, Homo sapiens
gauguacacacacagaugcacac

SEQ ID NO: 1724660 - RNA, 13 nt, Homo sapiens
gauguguggacac

SEQ ID NO: 1724661 - RNA, 16 nt, Homo sapiens
gauuacaaaagcaauu

SEQ ID NO: 1724662 - RNA, 16 nt, Homo sapiens
gauucuuccugcuuag

SEQ ID NO: 1724663 - RNA, 14 nt, Homo sapiens
gcaagucacuggcc

SEQ ID NO: 1724664 - RNA, 15 nt, Homo sapiens
gcacacacacagaga

SEQ ID NO: 1724665 - RNA, 20 nt, Homo sapiens
gcacacacacggaugcacac

SEQ ID NO: 1724666 - RNA, 13 nt, Homo sapiens
gcacacacagaua

SEQ ID NO: 1724667 - RNA, 18 nt, Homo sapiens
gcacacacagaugcacac

SEQ ID NO: 1724668 - RNA, 20 nt, Homo sapiens
gcacacacagaugcacacac

SEQ ID NO: 1724669 - RNA, 24 nt, Homo sapiens
gcacacacagaugcacacacagau

SEQ ID NO: 1724670 - RNA, 12 nt, Homo sapiens
gcacacaccgau

SEQ ID NO: 1724671 - RNA, 16 nt, Homo sapiens
gcacacaccgaugugc

SEQ ID NO: 1724672 - RNA, 16 nt, Homo sapiens
gcacacggaugcacag

SEQ ID NO: 1724673 - RNA, 15 nt, Homo sapiens
gcacagagauaugca

SEQ ID NO: 1724674 - RNA, 16 nt, Homo sapiens
gcacagagauaugcac

SEQ ID NO: 1724675 - RNA, 17 nt, Homo sapiens
gcacauagagauaugca

SEQ ID NO: 1724676 - RNA, 18 nt, Homo sapiens
gcacauagagauaugcac

SEQ ID NO: 1724677 - RNA, 20 nt, Homo sapiens
gcacgcacaugccaaugcac

SEQ ID NO: 1724678 - RNA, 13 nt, Homo sapiens
gcagcucuacucu

SEQ ID NO: 1724679 - RNA, 17 nt, Homo sapiens
gcaucucccaguucaua

SEQ ID NO: 1724680 - RNA, 20 nt, Homo sapiens
gccaaugcacacacacagag

SEQ ID NO: 1724681 - RNA, 14 nt, Homo sapiens
gccacagugcaauu

SEQ ID NO: 1724682 - RNA, 19 nt, Homo sapiens
gccacucaggggucauuca

SEQ ID NO: 1724683 - RNA, 18 nt, Homo sapiens
gcccagaaaacugucauu

SEQ ID NO: 1724684 - RNA, 12 nt, Homo sapiens
gccugugccuuu

SEQ ID NO: 1724685 - RNA, 12 nt, Homo sapiens
gccuuuugcaaa

SEQ ID NO: 1724686 - RNA, 13 nt, Homo sapiens
gccuuuugcaaau

SEQ ID NO: 1724687 - RNA, 14 nt, Homo sapiens
gcgcacacacagau

SEQ ID NO: 1724688 - RNA, 20 nt, Homo sapiens
gcuauggggauagaugugug

SEQ ID NO: 1724689 - RNA, 12 nt, Homo sapiens
gcucagugccac

SEQ ID NO: 1724690 - RNA, 15 nt, Homo sapiens
gcucagugccacaaa

SEQ ID NO: 1724691 - RNA, 21 nt, Homo sapiens
gcucagugccacaaagcucaa

SEQ ID NO: 1724692 - RNA, 17 nt, Homo sapiens
gcuccacaguguugcca

SEQ ID NO: 1724693 - RNA, 22 nt, Homo sapiens
gcugcgucuccuccgcacaccu

SEQ ID NO: 1724694 - RNA, 19 nt, Homo sapiens
gcuguagacauuugcuaug

SEQ ID NO: 1724695 - RNA, 17 nt, Homo sapiens
gcuguauccauccaugg

SEQ ID NO: 1724696 - RNA, 22 nt, Homo sapiens
gcuuguaccacuuuugcaaaua

SEQ ID NO: 1724697 - RNA, 16 nt, Homo sapiens
ggaaauuaaaacucau

SEQ ID NO: 1724698 - RNA, 12 nt, Homo sapiens
ggacacaggcca

SEQ ID NO: 1724699 - RNA, 12 nt, Homo sapiens
ggaugucucuca

SEQ ID NO: 1724700 - RNA, 19 nt, Homo sapiens
ggcaacagagcaagacucc

SEQ ID NO: 1724701 - RNA, 14 nt, Homo sapiens
ggccugacucucag

SEQ ID NO: 1724702 - RNA, 20 nt, Homo sapiens
ggcggguggaucacgagguc

SEQ ID NO: 1724703 - RNA, 11 nt, Homo sapiens
ggcugccuugu

SEQ ID NO: 1724704 - RNA, 19 nt, Homo sapiens
gggcugauuguauuuaccu

SEQ ID NO: 1724705 - RNA, 21 nt, Homo sapiens
ggguaguauuuuuuacauuuu

SEQ ID NO: 1724706 - RNA, 11 nt, Homo sapiens
gguagcauuuu

SEQ ID NO: 1724707 - RNA, 18 nt, Homo sapiens
ggucuacauuacaaaaga

SEQ ID NO: 1724708 - RNA, 11 nt, Homo sapiens
gguucucaggc

SEQ ID NO: 1724709 - RNA, 20 nt, Homo sapiens
guacacacacagaugcacac

SEQ ID NO: 1724710 - RNA, 15 nt, Homo sapiens
guacaggacauauau

SEQ ID NO: 1724711 - RNA, 22 nt, Homo sapiens
guauauguagauguaugcacac

SEQ ID NO: 1724712 - RNA, 17 nt, Homo sapiens
guauuaaaauaucccaa

SEQ ID NO: 1724713 - RNA, 15 nt, Homo sapiens
gucagagaaccuaau

SEQ ID NO: 1724714 - RNA, 22 nt, Homo sapiens
gucagcuaaagaaguuugaaca

SEQ ID NO: 1724715 - RNA, 14 nt, Homo sapiens
gucuaaauaccuau

SEQ ID NO: 1724716 - RNA, 17 nt, Homo sapiens
gucugggccacucaggg

SEQ ID NO: 1724717 - RNA, 22 nt, Homo sapiens
gugaauguaggcuggcuuucag

SEQ ID NO: 1724718 - RNA, 18 nt, Homo sapiens
gugccuuggugugcugua

SEQ ID NO: 1724719 - RNA, 13 nt, Homo sapiens
gugucacccuuag

SEQ ID NO: 1724720 - RNA, 16 nt, Homo sapiens
gugugggaguguguaa

SEQ ID NO: 1724721 - RNA, 23 nt, Homo sapiens
guguucuucauuaccucagugag

SEQ ID NO: 1724722 - RNA, 12 nt, Homo sapiens
guuaaagcaaag

SEQ ID NO: 1724723 - RNA, 16 nt, Homo sapiens
guugaaguacaaaagg

SEQ ID NO: 1724724 - RNA, 15 nt, Homo sapiens
guuucccucuguaua

SEQ ID NO: 1724725 - RNA, 18 nt, Homo sapiens
guuugacuagccaucuca

SEQ ID NO: 1724726 - RNA, 19 nt, Homo sapiens
guuugacuagccaucucaa

SEQ ID NO: 1724727 - RNA, 20 nt, Homo sapiens
guuuugauaaaagauuuucc

SEQ ID NO: 1724728 - RNA, 22 nt, Homo sapiens
uaaaacucucaagcagacguga

SEQ ID NO: 1724729 - RNA, 14 nt, Homo sapiens
uaaaauugugaugu

SEQ ID NO: 1724730 - RNA, 17 nt, Homo sapiens
uaaacucaaacaaaagu

SEQ ID NO: 1724731 - RNA, 15 nt, Homo sapiens
uaaacugaacauauu

SEQ ID NO: 1724732 - RNA, 16 nt, Homo sapiens
uaaagcauuuugcaaa

SEQ ID NO: 1724733 - RNA, 17 nt, Homo sapiens
uaaauucuuuucacugu

SEQ ID NO: 1724734 - RNA, 21 nt, Homo sapiens
uaaauuuaugguucucaggcc

SEQ ID NO: 1724735 - RNA, 16 nt, Homo sapiens
uaaauuuaugugaugg

SEQ ID NO: 1724736 - RNA, 17 nt, Homo sapiens
uaaguguauuuugaaau

SEQ ID NO: 1724737 - RNA, 23 nt, Homo sapiens
cucagaucauuaucagccugugc

SEQ ID NO: 1724738 - RNA, 14 nt, Homo sapiens
cucauuuuaacuca

SEQ ID NO: 1724739 - RNA, 19 nt, Homo sapiens
cuccaggcagcagacacau

SEQ ID NO: 1724740 - RNA, 22 nt, Homo sapiens
cuccauugguguugacauacau

SEQ ID NO: 1724741 - RNA, 11 nt, Homo sapiens
cuccugaaauc

SEQ ID NO: 1724742 - RNA, 18 nt, Homo sapiens
cuccugucccucauccau

SEQ ID NO: 1724743 - RNA, 11 nt, Homo sapiens
cucucucauga

SEQ ID NO: 1724744 - RNA, 15 nt, Homo sapiens
cucuucaagcuugaa

SEQ ID NO: 1724745 - RNA, 21 nt, Homo sapiens
cucuucccauaccacccaaaa

SEQ ID NO: 1724746 - RNA, 12 nt, Homo sapiens
cucuuuaccucc

SEQ ID NO: 1724747 - RNA, 23 nt, Homo sapiens
cugagcagguguucuucauuacc

SEQ ID NO: 1724748 - RNA, 18 nt, Homo sapiens
cugaugauaauuuaucua

SEQ ID NO: 1724749 - RNA, 21 nt, Homo sapiens
cugaugauaauuuaucuacau

SEQ ID NO: 1724750 - RNA, 15 nt, Homo sapiens
cugcagaacuccuuu

SEQ ID NO: 1724751 - RNA, 23 nt, Homo sapiens
cugccaucauguuuacagaggac

SEQ ID NO: 1724752 - RNA, 17 nt, Homo sapiens
cuggcccugugccuugg

SEQ ID NO: 1724753 - RNA, 19 nt, Homo sapiens
cuggggaugucucucauga

SEQ ID NO: 1724754 - RNA, 22 nt, Homo sapiens
cuggggugggcccugucauucg

SEQ ID NO: 1724755 - RNA, 16 nt, Homo sapiens
cugugugacauuggga

SEQ ID NO: 1724756 - RNA, 15 nt, Homo sapiens
cuuaggccagcacca

SEQ ID NO: 1724757 - RNA, 19 nt, Homo sapiens
cuuauaauuacaaugcaca

SEQ ID NO: 1724758 - RNA, 21 nt, Homo sapiens
cuucacaggcuauucuacuuu

SEQ ID NO: 1724759 - RNA, 14 nt, Homo sapiens
cuucagauuugccu

SEQ ID NO: 1724760 - RNA, 23 nt, Homo sapiens
cuuccuuuuuucucuuacuauau

SEQ ID NO: 1724761 - RNA, 19 nt, Homo sapiens
cuucuauuaaggacauuua

SEQ ID NO: 1724762 - RNA, 14 nt, Homo sapiens
cuucuccugaaauc

SEQ ID NO: 1724763 - RNA, 20 nt, Homo sapiens
cuugccgucacuauucauca

SEQ ID NO: 1724764 - RNA, 23 nt, Homo sapiens
cuugcucaccaagaaguaacaaa

SEQ ID NO: 1724765 - RNA, 19 nt, Homo sapiens
cuuggcagcccgggucauc

SEQ ID NO: 1724766 - RNA, 20 nt, Homo sapiens
cuuguggagaacaugcauac

SEQ ID NO: 1724767 - RNA, 17 nt, Homo sapiens
cuugugguuauaacuua

SEQ ID NO: 1724768 - RNA, 15 nt, Homo sapiens
cuuguugaugacauu

SEQ ID NO: 1724769 - RNA, 19 nt, Homo sapiens
cuuucccuccuuggugauu

SEQ ID NO: 1724770 - RNA, 18 nt, Homo sapiens
cuuucuaaaacacauuua

SEQ ID NO: 1724771 - RNA, 21 nt, Homo sapiens
cuuuggucaauauuugaucua

SEQ ID NO: 1724772 - RNA, 13 nt, Homo sapiens
cuuugucccagaa

SEQ ID NO: 1724773 - RNA, 19 nt, Homo sapiens
cuuuugcuauggagcaaau

SEQ ID NO: 1724774 - RNA, 13 nt, Homo sapiens
cuuuugucccaga

SEQ ID NO: 1724775 - RNA, 14 nt, Homo sapiens
cuuuugucccagaa

SEQ ID NO: 1724776 - RNA, 17 nt, Homo sapiens
gaaaaauaacaauuuua

SEQ ID NO: 1724777 - RNA, 12 nt, Homo sapiens
gaaaacaaugca

SEQ ID NO: 1724778 - RNA, 15 nt, Homo sapiens
gaaacauucuuuccu

SEQ ID NO: 1724779 - RNA, 18 nt, Homo sapiens
gaaacauucuuuccuaaa

SEQ ID NO: 1724780 - RNA, 16 nt, Homo sapiens
gaaagaaggcauggac

SEQ ID NO: 1724781 - RNA, 21 nt, Homo sapiens
gaaauuagguugaaacauauc

SEQ ID NO: 1724782 - RNA, 17 nt, Homo sapiens
gaacaaacuaagccagg

SEQ ID NO: 1724783 - RNA, 12 nt, Homo sapiens
gaagaagggaag

SEQ ID NO: 1724784 - RNA, 13 nt, Homo sapiens
gaagagaagggca

SEQ ID NO: 1724785 - RNA, 16 nt, Homo sapiens
gaagcaucaccaugca

SEQ ID NO: 1724786 - RNA, 15 nt, Homo sapiens
gaaggaauuauuccc

SEQ ID NO: 1724787 - RNA, 20 nt, Homo sapiens
gaaggcaagagaaacauucu

SEQ ID NO: 1724788 - RNA, 22 nt, Homo sapiens
gaagugugucacccuuaggcca

SEQ ID NO: 1724789 - RNA, 15 nt, Homo sapiens
gaauccaacuuuuaa

SEQ ID NO: 1724790 - RNA, 14 nt, Homo sapiens
gaauugacauugaa

SEQ ID NO: 1724791 - RNA, 23 nt, Homo sapiens
gacacaggccagcuccacagugu

SEQ ID NO: 1724792 - RNA, 19 nt, Homo sapiens
gacacaugccagggccaug

SEQ ID NO: 1724793 - RNA, 16 nt, Homo sapiens
gacauuuagccuucaa

SEQ ID NO: 1724794 - RNA, 22 nt, Homo sapiens
gacguuugacuagccaucucaa

SEQ ID NO: 1724795 - RNA, 14 nt, Homo sapiens
gacuagccaucuca

SEQ ID NO: 1724796 - RNA, 16 nt, Homo sapiens
gacuagccaucucaag

SEQ ID NO: 1724797 - RNA, 12 nt, Homo sapiens
gacuuaucaaca

SEQ ID NO: 1724798 - RNA, 20 nt, Homo sapiens
gacuuuuugaaaaaaguaua

SEQ ID NO: 1724799 - RNA, 19 nt, Homo sapiens
gagaacuucucuucccaua

SEQ ID NO: 1724800 - RNA, 19 nt, Homo sapiens
gagacuuuaaaagcauuuu

SEQ ID NO: 1724801 - RNA, 20 nt, Homo sapiens
gagagcccagaaaacuguca

SEQ ID NO: 1724802 - RNA, 19 nt, Homo sapiens
gagaggccacagugcaauu

SEQ ID NO: 1724803 - RNA, 20 nt, Homo sapiens
gagcaaauccaggaaggcaa

SEQ ID NO: 1724804 - RNA, 16 nt, Homo sapiens
gaggccucucauucca

SEQ ID NO: 1724805 - RNA, 20 nt, Homo sapiens
gagugggguagguugggaga

SEQ ID NO: 1724806 - RNA, 22 nt, Homo sapiens
gaguuuagcccugaacauuuca

SEQ ID NO: 1724807 - RNA, 21 nt, Homo sapiens
gauauagcuaggugacauaua

SEQ ID NO: 1724808 - RNA, 13 nt, Homo sapiens
gauaugcacacac

SEQ ID NO: 1724809 - RNA, 14 nt, Homo sapiens
gauaugcacacaca

SEQ ID NO: 1724810 - RNA, 14 nt, Homo sapiens
gaugagcacacaca

SEQ ID NO: 1724811 - RNA, 18 nt, Homo sapiens
gaugagcacacacacacc

SEQ ID NO: 1724812 - RNA, 19 nt, Homo sapiens
gaugcacacacagaugcac

SEQ ID NO: 1724813 - RNA, 18 nt, Homo sapiens
gaugcacagagauaugca

SEQ ID NO: 1724814 - RNA, 19 nt, Homo sapiens
gaugcacagagauaugcac

SEQ ID NO: 1724815 - RNA, 19 nt, Homo sapiens
gauucuagcuaccuguauu

SEQ ID NO: 1724816 - RNA, 14 nt, Homo sapiens
gauuuaauaugcaa

SEQ ID NO: 1724817 - RNA, 15 nt, Homo sapiens
gauuuaauaugcaaa

SEQ ID NO: 1724818 - RNA, 20 nt, Homo sapiens
gcaaagagagguccagaguc

SEQ ID NO: 1724819 - RNA, 19 nt, Homo sapiens
gcaagaccaaaucauugua

SEQ ID NO: 1724820 - RNA, 15 nt, Homo sapiens
gcaaguuuaaucaau

SEQ ID NO: 1724821 - RNA, 22 nt, Homo sapiens
gcacacacacagagauaugcac

SEQ ID NO: 1724822 - RNA, 19 nt, Homo sapiens
gcacacacaccgaugcuga

SEQ ID NO: 1724823 - RNA, 17 nt, Homo sapiens
gcacacacagauaugca

SEQ ID NO: 1724824 - RNA, 22 nt, Homo sapiens
gcacacacagauaugcacacac

SEQ ID NO: 1724825 - RNA, 22 nt, Homo sapiens
gcacacuuauuuuuuucccaag

SEQ ID NO: 1724826 - RNA, 22 nt, Homo sapiens
gcacguguggccuguucuucua

SEQ ID NO: 1724827 - RNA, 17 nt, Homo sapiens
gcacuauuuauuuacaa

SEQ ID NO: 1724828 - RNA, 15 nt, Homo sapiens
gcagacacaugccag

SEQ ID NO: 1724829 - RNA, 16 nt, Homo sapiens
gcagcaacaacuguca

SEQ ID NO: 1724830 - RNA, 14 nt, Homo sapiens
gcagggauucuucc

SEQ ID NO: 1724831 - RNA, 21 nt, Homo sapiens
gcagggccuuugucugucuca

SEQ ID NO: 1724832 - RNA, 13 nt, Homo sapiens
gcaggugccaaug

SEQ ID NO: 1724833 - RNA, 23 nt, Homo sapiens
gcagugcaguauagaauaggcac

SEQ ID NO: 1724834 - RNA, 23 nt, Homo sapiens
gcauagagugugauguaugugua

SEQ ID NO: 1724835 - RNA, 12 nt, Homo sapiens
gccaaugcacac

SEQ ID NO: 1724836 - RNA, 20 nt, Homo sapiens
gccaccaggaagcacagguc

SEQ ID NO: 1724837 - RNA, 14 nt, Homo sapiens
gccaggauggcgca

SEQ ID NO: 1724838 - RNA, 19 nt, Homo sapiens
gccagguaugcaaauaucg

SEQ ID NO: 1724839 - RNA, 16 nt, Homo sapiens
gcuaaauguaccugag

SEQ ID NO: 1724840 - RNA, 16 nt, Homo sapiens
gcuaggugacauauac

SEQ ID NO: 1724841 - RNA, 20 nt, Homo sapiens
gcuagugauuuacacagguu

SEQ ID NO: 1724842 - RNA, 18 nt, Homo sapiens
gcuaugguucucucgcaa

SEQ ID NO: 1724843 - RNA, 15 nt, Homo sapiens
gcuauuguagagcca

SEQ ID NO: 1724844 - RNA, 18 nt, Homo sapiens
gcugaggccucucauucc

SEQ ID NO: 1724845 - RNA, 22 nt, Homo sapiens
gcugaggccucucauuccagag

SEQ ID NO: 1724846 - RNA, 20 nt, Homo sapiens
gcuuucauuuugcauuuugu

SEQ ID NO: 1724847 - RNA, 17 nt, Homo sapiens
ggaagccuuuugcaaau

SEQ ID NO: 1724848 - RNA, 13 nt, Homo sapiens
ggaagggacacca

SEQ ID NO: 1724849 - RNA, 16 nt, Homo sapiens
ggaauuauucccauga

SEQ ID NO: 1724850 - RNA, 15 nt, Homo sapiens
ggacaccaagccuug

SEQ ID NO: 1724851 - RNA, 23 nt, Homo sapiens
ggacuugcaaagcuucacuucau

SEQ ID NO: 1724852 - RNA, 21 nt, Homo sapiens
ggagaacuugcucaagugcag

SEQ ID NO: 1724853 - RNA, 15 nt, Homo sapiens
ggagagagugcuauu

SEQ ID NO: 1724854 - RNA, 20 nt, Homo sapiens
ggaggcggaccuuguaguga

SEQ ID NO: 1724855 - RNA, 17 nt, Homo sapiens
ggauagguggggaaauc

SEQ ID NO: 1724856 - RNA, 20 nt, Homo sapiens
ggaugcacagagauaugcac

SEQ ID NO: 1724857 - RNA, 13 nt, Homo sapiens
ggauggcgcagga

SEQ ID NO: 1724858 - RNA, 16 nt, Homo sapiens
ggauguaccagcaucu

SEQ ID NO: 1724859 - RNA, 22 nt, Homo sapiens
ggcagggccuuugucugucuca

SEQ ID NO: 1724860 - RNA, 16 nt, Homo sapiens
ggcuauucuacuuuaa

SEQ ID NO: 1724861 - RNA, 20 nt, Homo sapiens
ggcugaggccucucauucca

SEQ ID NO: 1724862 - RNA, 11 nt, Homo sapiens
ggcugcacaga

SEQ ID NO: 1724863 - RNA, 19 nt, Homo sapiens
ggcuucacauuuaaaccag

SEQ ID NO: 1724864 - RNA, 12 nt, Homo sapiens
uuuguacauuau

SEQ ID NO: 1724865 - RNA, 16 nt, Homo sapiens
uuuguuuuuuuccuga

SEQ ID NO: 1724866 - RNA, 14 nt, Homo sapiens
uuuucucaugauga

SEQ ID NO: 1724867 - RNA, 13 nt, Homo sapiens
uuuugagauucau

SEQ ID NO: 1724868 - RNA, 16 nt, Homo sapiens
uuuuuauuuugcugca

SEQ ID NO: 1724869 - RNA, 19 nt, Homo sapiens
uuuuugaaaaaaguauagg

SEQ ID NO: 1724870 - RNA, 11 nt, Homo sapiens
uuuuugcucuu

SEQ ID NO: 1724871 - RNA, 20 nt, Homo sapiens
aaagacuucucuacccaucu

SEQ ID NO: 1724872 - RNA, 14 nt, Homo sapiens
aaagccucucacua

SEQ ID NO: 1724873 - RNA, 16 nt, Homo sapiens
aaaggaaaaacugaug

SEQ ID NO: 1724874 - RNA, 22 nt, Homo sapiens
aaaggaacuaugaaaaccagaa

SEQ ID NO: 1724875 - RNA, 18 nt, Homo sapiens
aaaguguacuauuugaua

SEQ ID NO: 1724876 - RNA, 14 nt, Homo sapiens
aaauguaccugaga

SEQ ID NO: 1724877 - RNA, 22 nt, Homo sapiens
aaauguuggaaugggagucuga

SEQ ID NO: 1724878 - RNA, 20 nt, Homo sapiens
aacaacugucaguucauccu

SEQ ID NO: 1724879 - RNA, 21 nt, Homo sapiens
aacaauaaagcauuuugcaaa

SEQ ID NO: 1724880 - RNA, 23 nt, Homo sapiens
aacaaugcaguacaggacauaua

SEQ ID NO: 1724881 - RNA, 18 nt, Homo sapiens
aacaauuuuaaauuugaa

SEQ ID NO: 1724882 - RNA, 16 nt, Homo sapiens
aacacaccgaugcaca

SEQ ID NO: 1724883 - RNA, 17 nt, Homo sapiens
aacaucuggauaucaag

SEQ ID NO: 1724884 - RNA, 20 nt, Homo sapiens
aacccuucagauuugccuua

SEQ ID NO: 1724885 - RNA, 15 nt, Homo sapiens
aacucguuaaagcaa

SEQ ID NO: 1724886 - RNA, 13 nt, Homo sapiens
aagaaaaguuuau

SEQ ID NO: 1724887 - RNA, 20 nt, Homo sapiens
aagaagggaagccuuuugca

SEQ ID NO: 1724888 - RNA, 21 nt, Homo sapiens
aagaagggaagccuuuugcaa

SEQ ID NO: 1724889 - RNA, 17 nt, Homo sapiens
aagacuuaucaacauuu

SEQ ID NO: 1724890 - RNA, 18 nt, Homo sapiens
aagacuucucuacccauc

SEQ ID NO: 1724891 - RNA, 18 nt, Homo sapiens
aagagaaacauucuuucc

SEQ ID NO: 1724892 - RNA, 22 nt, Homo sapiens
aagagacuaauagagacacaga

SEQ ID NO: 1724893 - RNA, 11 nt, Homo sapiens
aagauuaacac

SEQ ID NO: 1724894 - RNA, 12 nt, Homo sapiens
aagauuucugcu

SEQ ID NO: 1724895 - RNA, 19 nt, Homo sapiens
aagcaguugagauucucua

SEQ ID NO: 1724896 - RNA, 19 nt, Homo sapiens
aagcauuuuuuaaccuccu

SEQ ID NO: 1724897 - RNA, 20 nt, Homo sapiens
aaggaaaaacugauguuuaa

SEQ ID NO: 1724898 - RNA, 15 nt, Homo sapiens
aaggaaauauuucaa

SEQ ID NO: 1724899 - RNA, 18 nt, Homo sapiens
aagggaagccuuuugcaa

SEQ ID NO: 1724900 - RNA, 24 nt, Homo sapiens
aagguaaagcaguugagauucucu

SEQ ID NO: 1724901 - RNA, 12 nt, Homo sapiens
aaguacaaaagg

SEQ ID NO: 1724902 - RNA, 20 nt, Homo sapiens
aaguacaaaaggaacuauga

SEQ ID NO: 1724903 - RNA, 15 nt, Homo sapiens
aagucacuggccagu

SEQ ID NO: 1724904 - RNA, 13 nt, Homo sapiens
aagugaauaaccu

SEQ ID NO: 1724905 - RNA, 16 nt, Homo sapiens
aauaaagcauuuugca

SEQ ID NO: 1724906 - RNA, 17 nt, Homo sapiens
aauagauuuaacccuuc

SEQ ID NO: 1724907 - RNA, 23 nt, Homo sapiens
aauaugucugggaaaaagugcac

SEQ ID NO: 1724908 - RNA, 14 nt, Homo sapiens
aaucaaagaaguaa

SEQ ID NO: 1724909 - RNA, 15 nt, Homo sapiens
aaucauaaacuauau

SEQ ID NO: 1724910 - RNA, 23 nt, Homo sapiens
aauccaacuuuuaauuaccagag

SEQ ID NO: 1724911 - RNA, 23 nt, Homo sapiens
aaucugagaggccacagugcaau

SEQ ID NO: 1724912 - RNA, 15 nt, Homo sapiens
aaugaagacacucaa

SEQ ID NO: 1724913 - RNA, 15 nt, Homo sapiens
aaugcacacuuauuu

SEQ ID NO: 1724914 - RNA, 18 nt, Homo sapiens
aaugcacgcacacaucag

SEQ ID NO: 1724915 - RNA, 18 nt, Homo sapiens
aaugccuuauuucaaaac

SEQ ID NO: 1724916 - RNA, 14 nt, Homo sapiens
aauggaaucauaua

SEQ ID NO: 1724917 - RNA, 17 nt, Homo sapiens
aauguggagaacauuca

SEQ ID NO: 1724918 - RNA, 14 nt, Homo sapiens
aauuacugauauca

SEQ ID NO: 1724919 - RNA, 21 nt, Homo sapiens
aauuuaucuacaugcauuuca

SEQ ID NO: 1724920 - RNA, 18 nt, Homo sapiens
aauuucuuucuaaaacac

SEQ ID NO: 1724921 - RNA, 12 nt, Homo sapiens
acaaaagcaauu

SEQ ID NO: 1724922 - RNA, 15 nt, Homo sapiens
acaauggacuugcaa

SEQ ID NO: 1724923 - RNA, 22 nt, Homo sapiens
acaauucauuuacccauuuacu

SEQ ID NO: 1724924 - RNA, 13 nt, Homo sapiens
acacacacaccaa

SEQ ID NO: 1724925 - RNA, 15 nt, Homo sapiens
acacacacagaugca

SEQ ID NO: 1724926 - RNA, 16 nt, Homo sapiens
acacacagagauaugc

SEQ ID NO: 1724927 - RNA, 20 nt, Homo sapiens
acacaccgaugcugacucca

SEQ ID NO: 1724928 - RNA, 22 nt, Homo sapiens
acacaccgauguacacacacag

SEQ ID NO: 1724929 - RNA, 16 nt, Homo sapiens
acacagagauaugcac

SEQ ID NO: 1724930 - RNA, 14 nt, Homo sapiens
acacagauaugcac

SEQ ID NO: 1724931 - RNA, 16 nt, Homo sapiens
acacauggaugcacac

SEQ ID NO: 1724932 - RNA, 24 nt, Homo sapiens
acacauuaauaaacaaucucccaa

SEQ ID NO: 1724933 - RNA, 17 nt, Homo sapiens
acaccgaugugcgcaca

SEQ ID NO: 1724934 - RNA, 14 nt, Homo sapiens
acacggaugcacac

SEQ ID NO: 1724935 - RNA, 15 nt, Homo sapiens
acacucaaucuagaa

SEQ ID NO: 1724936 - RNA, 17 nt, Homo sapiens
acacucccacuuggcau

SEQ ID NO: 1724937 - RNA, 15 nt, Homo sapiens
acagacacucccacu

SEQ ID NO: 1724938 - RNA, 13 nt, Homo sapiens
acagagacagaaa

SEQ ID NO: 1724939 - RNA, 16 nt, Homo sapiens
acagagauaugcacac

SEQ ID NO: 1724940 - RNA, 19 nt, Homo sapiens
acagagauaugcacacacc

SEQ ID NO: 1724941 - RNA, 15 nt, Homo sapiens
acagagccaugacuc

SEQ ID NO: 1724942 - RNA, 18 nt, Homo sapiens
acagauauacacauggau

SEQ ID NO: 1724943 - RNA, 12 nt, Homo sapiens
acagauaugcac

SEQ ID NO: 1724944 - RNA, 22 nt, Homo sapiens
acagauaugcacacacauggau

SEQ ID NO: 1724945 - RNA, 17 nt, Homo sapiens
acagaugcacacacaga

SEQ ID NO: 1724946 - RNA, 20 nt, Homo sapiens
acagauggaauuagaaauau

SEQ ID NO: 1724947 - RNA, 17 nt, Homo sapiens
acagauggucacacaga

SEQ ID NO: 1724948 - RNA, 22 nt, Homo sapiens
acauaaaauaaacugaacauau

SEQ ID NO: 1724949 - RNA, 15 nt, Homo sapiens
acauacauccaacau

SEQ ID NO: 1724950 - RNA, 13 nt, Homo sapiens
acauauacauacu

SEQ ID NO: 1724951 - RNA, 12 nt, Homo sapiens
acaucuggauau

SEQ ID NO: 1724952 - RNA, 22 nt, Homo sapiens
acauggagagagacucaaagag

SEQ ID NO: 1724953 - RNA, 16 nt, Homo sapiens
acauggaugcacacac

SEQ ID NO: 1724954 - RNA, 16 nt, Homo sapiens
acauucaaaaaccccu

SEQ ID NO: 1724955 - RNA, 14 nt, Homo sapiens
acauuuaaaccagu

SEQ ID NO: 1724956 - RNA, 12 nt, Homo sapiens
acauuuguucca

SEQ ID NO: 1724957 - RNA, 14 nt, Homo sapiens
acauuuguuccaug

SEQ ID NO: 1724958 - RNA, 18 nt, Homo sapiens
accaaaugcuuuuccuca

SEQ ID NO: 1724959 - RNA, 19 nt, Homo sapiens
accaaaugcuuuuccucaa

SEQ ID NO: 1724960 - RNA, 15 nt, Homo sapiens
accacccaaaaucau

SEQ ID NO: 1724961 - RNA, 17 nt, Homo sapiens
accacccaaaaucauaa

SEQ ID NO: 1724962 - RNA, 15 nt, Homo sapiens
accacuuacggacag

SEQ ID NO: 1724963 - RNA, 14 nt, Homo sapiens
accaggaagcacag

SEQ ID NO: 1724964 - RNA, 17 nt, Homo sapiens
accaucucuuuaccucc

SEQ ID NO: 1724965 - RNA, 12 nt, Homo sapiens
acccacucuuca

SEQ ID NO: 1724966 - RNA, 22 nt, Homo sapiens
acccauuuacuuuggucaauau

SEQ ID NO: 1724967 - RNA, 14 nt, Homo sapiens
acccuuaggccagc

SEQ ID NO: 1724968 - RNA, 21 nt, Homo sapiens
accuaauaagugcuacuuugc

SEQ ID NO: 1724969 - RNA, 17 nt, Homo sapiens
accuacuuuuucuuuga

SEQ ID NO: 1724970 - RNA, 18 nt, Homo sapiens
accuuccccucacacucc

SEQ ID NO: 1724971 - RNA, 14 nt, Homo sapiens
accuucuaccucuu

SEQ ID NO: 1724972 - RNA, 17 nt, Homo sapiens
acgcacaugccaaugca

SEQ ID NO: 1724973 - RNA, 23 nt, Homo sapiens
acgccaaugcacacacacagaga

SEQ ID NO: 1724974 - RNA, 17 nt, Homo sapiens
acguagauuuuugcucu

SEQ ID NO: 1724975 - RNA, 20 nt, Homo sapiens
acguuugacuagccaucuca

SEQ ID NO: 1724976 - RNA, 18 nt, Homo sapiens
acuaaggaaauauuucaa

SEQ ID NO: 1724977 - RNA, 15 nt, Homo sapiens
acuaauagagacaca

SEQ ID NO: 1724978 - RNA, 17 nt, Homo sapiens
acuaauagagacacaga

SEQ ID NO: 1724979 - RNA, 23 nt, Homo sapiens
acuaaucuaaacuguagcuguau

SEQ ID NO: 1724980 - RNA, 21 nt, Homo sapiens
acuagacguuguaaugcacac

SEQ ID NO: 1724981 - RNA, 18 nt, Homo sapiens
acuauuuaugaauauuaa

SEQ ID NO: 1724982 - RNA, 13 nt, Homo sapiens
acucaagugccau

SEQ ID NO: 1724983 - RNA, 17 nt, Homo sapiens
acucaagugccauucau

SEQ ID NO: 1724984 - RNA, 15 nt, Homo sapiens
acucccacuuggcau

SEQ ID NO: 1724985 - RNA, 22 nt, Homo sapiens
acucuuuaagaccucaaaccau

SEQ ID NO: 1724986 - RNA, 13 nt, Homo sapiens
acugacaguuuuu

SEQ ID NO: 1724987 - RNA, 18 nt, Homo sapiens
acugacgaagaagcaacu

SEQ ID NO: 1724988 - RNA, 16 nt, Homo sapiens
acugcugggcuuggca

SEQ ID NO: 1724989 - RNA, 17 nt, Homo sapiens
acugcugggcuuggcag

SEQ ID NO: 1724990 - RNA, 12 nt, Homo sapiens
acuucuggauau

SEQ ID NO: 1724991 - RNA, 16 nt, Homo sapiens
acuucuggaugcccau

SEQ ID NO: 1724992 - RNA, 19 nt, Homo sapiens
acuuguugaugacauuugg

SEQ ID NO: 1724993 - RNA, 16 nt, Homo sapiens
acuuuaaaagcauuuu

SEQ ID NO: 1724994 - RNA, 12 nt, Homo sapiens
acuuuaucugaa

SEQ ID NO: 1724995 - RNA, 17 nt, Homo sapiens
agaaaaacaucuggaua

SEQ ID NO: 1724996 - RNA, 23 nt, Homo sapiens
agaaauaacagaagaaaauagaa

SEQ ID NO: 1724997 - RNA, 21 nt, Homo sapiens
agaacaaauuuuaacaaaagg

SEQ ID NO: 1724998 - RNA, 12 nt, Homo sapiens
agaacauucaau

SEQ ID NO: 1724999 - RNA, 21 nt, Homo sapiens
augcuguuaguaccuacauca

SEQ ID NO: 1725000 - RNA, 14 nt, Homo sapiens
augcuucaugugcu

SEQ ID NO: 1725001 - RNA, 15 nt, Homo sapiens
augcuucaugugcug

SEQ ID NO: 1725002 - RNA, 14 nt, Homo sapiens
auggaaagaaggaa

SEQ ID NO: 1725003 - RNA, 13 nt, Homo sapiens
auggaagaaagaa

SEQ ID NO: 1725004 - RNA, 20 nt, Homo sapiens
augucauagguaagaaacac

SEQ ID NO: 1725005 - RNA, 19 nt, Homo sapiens
auuaauguuucuucuccaa

SEQ ID NO: 1725006 - RNA, 11 nt, Homo sapiens
auuaccaaaac

SEQ ID NO: 1725007 - RNA, 19 nt, Homo sapiens
auuaucaaugggauaugau

SEQ ID NO: 1725008 - RNA, 11 nt, Homo sapiens
auucuguguuc

SEQ ID NO: 1725009 - RNA, 15 nt, Homo sapiens
auugucuauuccuga

SEQ ID NO: 1725010 - RNA, 22 nt, Homo sapiens
auugucuauuccugaguuauaa

SEQ ID NO: 1725011 - RNA, 10 nt, Homo sapiens
auuguggcau

SEQ ID NO: 1725012 - RNA, 15 nt, Homo sapiens
auuuaggaguauuau

SEQ ID NO: 1725013 - RNA, 14 nt, Homo sapiens
auuuagugacaaaa

SEQ ID NO: 1725014 - RNA, 12 nt, Homo sapiens
auuucaagacua

SEQ ID NO: 1725015 - RNA, 13 nt, Homo sapiens
auuucuguuaacc

SEQ ID NO: 1725016 - RNA, 15 nt, Homo sapiens
auuugugcugacgau

SEQ ID NO: 1725017 - RNA, 15 nt, Homo sapiens
auuuucacagcacua

SEQ ID NO: 1725018 - RNA, 19 nt, Homo sapiens
auuuucccuacuugcagcg

SEQ ID NO: 1725019 - RNA, 18 nt, Homo sapiens
caaaauaaucuauauuaa

SEQ ID NO: 1725020 - RNA, 14 nt, Homo sapiens
caaaauguacuuaa

SEQ ID NO: 1725021 - RNA, 17 nt, Homo sapiens
caaacggugcaacagaa

SEQ ID NO: 1725022 - RNA, 14 nt, Homo sapiens
caaauauacaucag

SEQ ID NO: 1725023 - RNA, 11 nt, Homo sapiens
caaauguccua

SEQ ID NO: 1725024 - RNA, 15 nt, Homo sapiens
caagagagcacauga

SEQ ID NO: 1725025 - RNA, 16 nt, Homo sapiens
caagagggauaaaaca

SEQ ID NO: 1725026 - RNA, 18 nt, Homo sapiens
caagcuuaaagcuugauu

SEQ ID NO: 1725027 - RNA, 15 nt, Homo sapiens
caaggccagugcuaa

SEQ ID NO: 1725028 - RNA, 22 nt, Homo sapiens
caaggccuuacugucugcacuu

SEQ ID NO: 1725029 - RNA, 21 nt, Homo sapiens
caaugauacccaacaguuuau

SEQ ID NO: 1725030 - RNA, 17 nt, Homo sapiens
caauuuuugacauuaau

SEQ ID NO: 1725031 - RNA, 19 nt, Homo sapiens
cuguguugucagcacugua

SEQ ID NO: 1725032 - RNA, 20 nt, Homo sapiens
cuguuuuucagauacacugu

SEQ ID NO: 1725033 - RNA, 22 nt, Homo sapiens
cuuaaagcacugauaggacuua

SEQ ID NO: 1725034 - RNA, 14 nt, Homo sapiens
cuuacuaaaugcag

SEQ ID NO: 1725035 - RNA, 19 nt, Homo sapiens
cuuacugucugcacuugaa

SEQ ID NO: 1725036 - RNA, 22 nt, Homo sapiens
cuuagugguuaagcauuccuuu

SEQ ID NO: 1725037 - RNA, 15 nt, Homo sapiens
cuuccucucugugau

SEQ ID NO: 1725038 - RNA, 17 nt, Homo sapiens
cuucuccaauucugaaa

SEQ ID NO: 1725039 - RNA, 15 nt, Homo sapiens
cuucuccugccuaau

SEQ ID NO: 1725040 - RNA, 14 nt, Homo sapiens
cuucugcaacaucu

SEQ ID NO: 1725041 - RNA, 17 nt, Homo sapiens
cuucugcaacaucuuaa

SEQ ID NO: 1725042 - RNA, 14 nt, Homo sapiens
cuucuugucauucu

SEQ ID NO: 1725043 - RNA, 13 nt, Homo sapiens
cuucuuguucccc

SEQ ID NO: 1725044 - RNA, 17 nt, Homo sapiens
cuugcaguuaaggguua

SEQ ID NO: 1725045 - RNA, 18 nt, Homo sapiens
cuugcaguuaaggguuag

SEQ ID NO: 1725046 - RNA, 16 nt, Homo sapiens
cuugggaucugcaaga

SEQ ID NO: 1725047 - RNA, 15 nt, Homo sapiens
cuuuaacugaacucu

SEQ ID NO: 1725048 - RNA, 17 nt, Homo sapiens
cuuuaauuugaaucuua

SEQ ID NO: 1725049 - RNA, 11 nt, Homo sapiens
cuuuguugccc

SEQ ID NO: 1725050 - RNA, 13 nt, Homo sapiens
cuuuugucuuuga

SEQ ID NO: 1725051 - RNA, 15 nt, Homo sapiens
cuuuuucuagacuug

SEQ ID NO: 1725052 - RNA, 14 nt, Homo sapiens
gaaaaaugcuguuu

SEQ ID NO: 1725053 - RNA, 18 nt, Homo sapiens
gaaacacagcaacaauga

SEQ ID NO: 1725054 - RNA, 15 nt, Homo sapiens
gaaagguaauggacu

SEQ ID NO: 1725055 - RNA, 14 nt, Homo sapiens
gaaaggucauuaaa

SEQ ID NO: 1725056 - RNA, 23 nt, Homo sapiens
gaaauuuucaauuugagauucua

SEQ ID NO: 1725057 - RNA, 19 nt, Homo sapiens
gaagcauugaaaacaaaga

SEQ ID NO: 1725058 - RNA, 21 nt, Homo sapiens
gaaggguuuugcuacauucua

SEQ ID NO: 1725059 - RNA, 19 nt, Homo sapiens
gaauuuucucuaacuucaa

SEQ ID NO: 1725060 - RNA, 17 nt, Homo sapiens
gacaccuggugcuuuua

SEQ ID NO: 1725061 - RNA, 11 nt, Homo sapiens
gacaucugccu

SEQ ID NO: 1725062 - RNA, 18 nt, Homo sapiens
gacuuaaaauagucucau

SEQ ID NO: 1725063 - RNA, 18 nt, Homo sapiens
gagaaaggagccaccagc

SEQ ID NO: 1725064 - RNA, 19 nt, Homo sapiens
gagcuugacaccuggugcu

SEQ ID NO: 1725065 - RNA, 15 nt, Homo sapiens
gaggccaaacacacu

SEQ ID NO: 1725066 - RNA, 19 nt, Homo sapiens
gaggcucaucuaacucugu

SEQ ID NO: 1725067 - RNA, 19 nt, Homo sapiens
gagucggauuaccaaaaca

SEQ ID NO: 1725068 - RNA, 20 nt, Homo sapiens
gagugauagcuacuguagaa

SEQ ID NO: 1725069 - RNA, 19 nt, Homo sapiens
gaguuacuuagaaugccau

SEQ ID NO: 1725070 - RNA, 17 nt, Homo sapiens
gaguugucaagucucug

SEQ ID NO: 1725071 - RNA, 21 nt, Homo sapiens
gauaucauuuaggaguauuau

SEQ ID NO: 1725072 - RNA, 21 nt, Homo sapiens
gaucagaugcugaauugagaa

SEQ ID NO: 1725073 - RNA, 15 nt, Homo sapiens
gaucuguacuuugug

SEQ ID NO: 1725074 - RNA, 20 nt, Homo sapiens
gaucuuuguuuaaaugccaa

SEQ ID NO: 1725075 - RNA, 20 nt, Homo sapiens
gauguguauacguaggaauu

SEQ ID NO: 1725076 - RNA, 13 nt, Homo sapiens
gauuaaugaucau

SEQ ID NO: 1725077 - RNA, 16 nt, Homo sapiens
gcaagcauuuuuccau

SEQ ID NO: 1725078 - RNA, 14 nt, Homo sapiens
gcacacacccagag

SEQ ID NO: 1725079 - RNA, 19 nt, Homo sapiens
gcagcuaaaggaagugaau

SEQ ID NO: 1725080 - RNA, 17 nt, Homo sapiens
gccacccggcacuggcg

SEQ ID NO: 1725081 - RNA, 18 nt, Homo sapiens
gcccauaucugugaaaug

SEQ ID NO: 1725082 - RNA, 19 nt, Homo sapiens
gccucccacccccaucucu

SEQ ID NO: 1725083 - RNA, 18 nt, Homo sapiens
gccuccugacucacugac

SEQ ID NO: 1725084 - RNA, 20 nt, Homo sapiens
gccucuuaccggaaauacuu

SEQ ID NO: 1725085 - RNA, 16 nt, Homo sapiens
gccuugaaaccaccuu

SEQ ID NO: 1725086 - RNA, 15 nt, Homo sapiens
gcgaaagcaguggcu

SEQ ID NO: 1725087 - RNA, 21 nt, Homo sapiens
gcuaaagagcuuugugauaua

SEQ ID NO: 1725088 - RNA, 18 nt, Homo sapiens
gcuaaaggaagugaaucu

SEQ ID NO: 1725089 - RNA, 12 nt, Homo sapiens
gcuaaucugccu

SEQ ID NO: 1725090 - RNA, 21 nt, Homo sapiens
gcuaaucugccugguuuuauu

SEQ ID NO: 1725091 - RNA, 20 nt, Homo sapiens
gcucuacuggaauuuucaua

SEQ ID NO: 1725092 - RNA, 16 nt, Homo sapiens
gcucuagaaaguauag

SEQ ID NO: 1725093 - RNA, 17 nt, Homo sapiens
gcugaaaagagcuuugu

SEQ ID NO: 1725094 - RNA, 12 nt, Homo sapiens
gcugcuuuccag

SEQ ID NO: 1725095 - RNA, 19 nt, Homo sapiens
gcuguguugucagcacugu

SEQ ID NO: 1725096 - RNA, 23 nt, Homo sapiens
gcuuaguucuucuccugccuaau

SEQ ID NO: 1725097 - RNA, 12 nt, Homo sapiens
gcuucuugucau

SEQ ID NO: 1725098 - RNA, 14 nt, Homo sapiens
gcuuuguugcccag

SEQ ID NO: 1725099 - RNA, 18 nt, Homo sapiens
ggaaaaaaggaggauaga

SEQ ID NO: 1725100 - RNA, 11 nt, Homo sapiens
ggaagggucaa

SEQ ID NO: 1725101 - RNA, 16 nt, Homo sapiens
ggacacguaaccuggc

SEQ ID NO: 1725102 - RNA, 19 nt, Homo sapiens
ggacauuuaaaauucaauu

SEQ ID NO: 1725103 - RNA, 13 nt, Homo sapiens
ggagaaaugccag

SEQ ID NO: 1725104 - RNA, 20 nt, Homo sapiens
ggagaugaauagaagaaaga

SEQ ID NO: 1725105 - RNA, 19 nt, Homo sapiens
ggauauaaaaauaauguca

SEQ ID NO: 1725106 - RNA, 18 nt, Homo sapiens
ggauggugguaucaggga

SEQ ID NO: 1725107 - RNA, 21 nt, Homo sapiens
ggauuaccaaaacacugccug

SEQ ID NO: 1725108 - RNA, 18 nt, Homo sapiens
ggcaauuuuugacauuaa

SEQ ID NO: 1725109 - RNA, 15 nt, Homo sapiens
ggcagugagugccau

SEQ ID NO: 1725110 - RNA, 22 nt, Homo sapiens
ggcagugagugccaugcuuuuu

SEQ ID NO: 1725111 - RNA, 15 nt, Homo sapiens
ggcauuucacaaaaa

SEQ ID NO: 1725112 - RNA, 20 nt, Homo sapiens
ggcauuugcaccuaccucac

SEQ ID NO: 1725113 - RNA, 15 nt, Homo sapiens
ggccugcacuggugu

SEQ ID NO: 1725114 - RNA, 18 nt, Homo sapiens
ggcggaacucucagggga

SEQ ID NO: 1725115 - RNA, 15 nt, Homo sapiens
ggcucuuauagagcc

SEQ ID NO: 1725116 - RNA, 19 nt, Homo sapiens
ggcuggaguggaguggcgu

SEQ ID NO: 1725117 - RNA, 15 nt, Homo sapiens
aaaaauaugcauuuu

SEQ ID NO: 1725118 - RNA, 14 nt, Homo sapiens
aaaacaccaugaaa

SEQ ID NO: 1725119 - RNA, 18 nt, Homo sapiens
aaaaugccuacacaguaa

SEQ ID NO: 1725120 - RNA, 17 nt, Homo sapiens
aaacagcugacccagug

SEQ ID NO: 1725121 - RNA, 20 nt, Homo sapiens
aaacauuauaaaaauugaca

SEQ ID NO: 1725122 - RNA, 17 nt, Homo sapiens
aaacauuugucaguaau

SEQ ID NO: 1725123 - RNA, 21 nt, Homo sapiens
aaaguauagauggccaaagga

SEQ ID NO: 1725124 - RNA, 18 nt, Homo sapiens
aaauauaauuuacauuaa

SEQ ID NO: 1725125 - RNA, 15 nt, Homo sapiens
aaaucaguuguguaa

SEQ ID NO: 1725126 - RNA, 21 nt, Homo sapiens
aaaugcagaaguuacuaagua

SEQ ID NO: 1725127 - RNA, 17 nt, Homo sapiens
aaaugguaagaguuucu

SEQ ID NO: 1725128 - RNA, 14 nt, Homo sapiens
aaauuaguuugaca

SEQ ID NO: 1725129 - RNA, 18 nt, Homo sapiens
aaauuaguuugacacugc

SEQ ID NO: 1725130 - RNA, 18 nt, Homo sapiens
aaauucaauuaggauuaa

SEQ ID NO: 1725131 - RNA, 16 nt, Homo sapiens
aacaacuuacacuuau

SEQ ID NO: 1725132 - RNA, 16 nt, Homo sapiens
aacacugccugcucuu

SEQ ID NO: 1725133 - RNA, 16 nt, Homo sapiens
aacacuuacuaccugg

SEQ ID NO: 1725134 - RNA, 19 nt, Homo sapiens
aacacuuacuaccuggugu

SEQ ID NO: 1725135 - RNA, 12 nt, Homo sapiens
aacagcaaaauu

SEQ ID NO: 1725136 - RNA, 15 nt, Homo sapiens
aacagcugacccagu

SEQ ID NO: 1725137 - RNA, 16 nt, Homo sapiens
aacagcugacccagug

SEQ ID NO: 1725138 - RNA, 15 nt, Homo sapiens
aacaucagaaacuga

SEQ ID NO: 1725139 - RNA, 19 nt, Homo sapiens
aacaucugaucuguauaaa

SEQ ID NO: 1725140 - RNA, 14 nt, Homo sapiens
aaccagaucauguu

SEQ ID NO: 1725141 - RNA, 14 nt, Homo sapiens
aacccuugcuugca

SEQ ID NO: 1725142 - RNA, 17 nt, Homo sapiens
aaccucuuaucacuaag

SEQ ID NO: 1725143 - RNA, 20 nt, Homo sapiens
aacuaguaaagcaaagugag

SEQ ID NO: 1725144 - RNA, 16 nt, Homo sapiens
aacugaauucuggaca

SEQ ID NO: 1725145 - RNA, 17 nt, Homo sapiens
aacugcuuuauuuuccc

SEQ ID NO: 1725146 - RNA, 14 nt, Homo sapiens
aacuuugcaaaaag

SEQ ID NO: 1725147 - RNA, 18 nt, Homo sapiens
aacuuuugguuuucagau

SEQ ID NO: 1725148 - RNA, 20 nt, Homo sapiens
aagaacuccaggucuaaaca

SEQ ID NO: 1725149 - RNA, 16 nt, Homo sapiens
aagaaggagaugaaua

SEQ ID NO: 1725150 - RNA, 13 nt, Homo sapiens
aagacaucugccu

SEQ ID NO: 1725151 - RNA, 17 nt, Homo sapiens
aagagggcucacaagac

SEQ ID NO: 1725152 - RNA, 19 nt, Homo sapiens
aagagucggauuaccaaaa

SEQ ID NO: 1725153 - RNA, 23 nt, Homo sapiens
aagauggugggguuguucaccuc

SEQ ID NO: 1725154 - RNA, 19 nt, Homo sapiens
aagauuuaugaugcacuua

SEQ ID NO: 1725155 - RNA, 16 nt, Homo sapiens
aagcaguucgacaaau

SEQ ID NO: 1725156 - RNA, 21 nt, Homo sapiens
aagcgagucacgaaugauuaa

SEQ ID NO: 1725157 - RNA, 16 nt, Homo sapiens
aagcucagcucugcuu

SEQ ID NO: 1725158 - RNA, 16 nt, Homo sapiens
aagcuuuaucuuugug

SEQ ID NO: 1725159 - RNA, 15 nt, Homo sapiens
aaggaaauagacuuu

SEQ ID NO: 1725160 - RNA, 16 nt, Homo sapiens
aaggaaauagacuuug

SEQ ID NO: 1725161 - RNA, 15 nt, Homo sapiens
aaggaaaucucaccc

SEQ ID NO: 1725162 - RNA, 15 nt, Homo sapiens
aagggagaaaugcca

SEQ ID NO: 1725163 - RNA, 18 nt, Homo sapiens
aaggguggaaaaaugccc

SEQ ID NO: 1725164 - RNA, 21 nt, Homo sapiens
aaggucauuaaaccagaucau

SEQ ID NO: 1725165 - RNA, 14 nt, Homo sapiens
aaguuauuguacaa

SEQ ID NO: 1725166 - RNA, 14 nt, Homo sapiens
aauaaacuuucuca

SEQ ID NO: 1725167 - RNA, 15 nt, Homo sapiens
aauaagaauaaacuu

SEQ ID NO: 1725168 - RNA, 13 nt, Homo sapiens
aauaauguucacg

SEQ ID NO: 1725169 - RNA, 20 nt, Homo sapiens
aauagaggugaugcugcuaa

SEQ ID NO: 1725170 - RNA, 16 nt, Homo sapiens
aaucagccacauucua

SEQ ID NO: 1725171 - RNA, 17 nt, Homo sapiens
aaucaugcucauguaua

SEQ ID NO: 1725172 - RNA, 14 nt, Homo sapiens
aaucccaccugcca

SEQ ID NO: 1725173 - RNA, 18 nt, Homo sapiens
aaucucaccccaucccac

SEQ ID NO: 1725174 - RNA, 13 nt, Homo sapiens
aaugaccaaggac

SEQ ID NO: 1725175 - RNA, 18 nt, Homo sapiens
aaugauuaaugcauuuau

SEQ ID NO: 1725176 - RNA, 15 nt, Homo sapiens
aaugcagcaucuuug

SEQ ID NO: 1725177 - RNA, 14 nt, Homo sapiens
aaugucauagguaa

SEQ ID NO: 1725178 - RNA, 16 nt, Homo sapiens
aauuaaacuaguuuaa

SEQ ID NO: 1725179 - RNA, 17 nt, Homo sapiens
aauuaguuugacacugc

SEQ ID NO: 1725180 - RNA, 21 nt, Homo sapiens
aauugucuauuccugaguuau

SEQ ID NO: 1725181 - RNA, 15 nt, Homo sapiens
aauuugagauucuac

SEQ ID NO: 1725182 - RNA, 21 nt, Homo sapiens
aauuugggcuguuuuucagau

SEQ ID NO: 1725183 - RNA, 17 nt, Homo sapiens
aauuuucuagauauuau

SEQ ID NO: 1725184 - RNA, 17 nt, Homo sapiens
acaaaaagaagaguuug

SEQ ID NO: 1725185 - RNA, 21 nt, Homo sapiens
acaaaacuuccucaaugcauu

SEQ ID NO: 1725186 - RNA, 23 nt, Homo sapiens
acaaagcauucuaaaugaacuca

SEQ ID NO: 1725187 - RNA, 20 nt, Homo sapiens
acaaugaccaaggacugcua

SEQ ID NO: 1725188 - RNA, 16 nt, Homo sapiens
acacaaaaaaggcagu

SEQ ID NO: 1725189 - RNA, 16 nt, Homo sapiens
acacagcaacaaugac

SEQ ID NO: 1725190 - RNA, 17 nt, Homo sapiens
acacagcaacaaugacu

SEQ ID NO: 1725191 - RNA, 16 nt, Homo sapiens
acacaguaagugugaa

SEQ ID NO: 1725192 - RNA, 23 nt, Homo sapiens
acaccggguaagagcucugaguc

SEQ ID NO: 1725193 - RNA, 22 nt, Homo sapiens
acagacaauaauuuaacaagcu

SEQ ID NO: 1725194 - RNA, 16 nt, Homo sapiens
acagacugauguguau

SEQ ID NO: 1725195 - RNA, 13 nt, Homo sapiens
acagcaacaauga

SEQ ID NO: 1725196 - RNA, 15 nt, Homo sapiens
acagcugacccagug

SEQ ID NO: 1725197 - RNA, 16 nt, Homo sapiens
acaucagaaacugaau

SEQ ID NO: 1725198 - RNA, 22 nt, Homo sapiens
acaucagauuagagagucucaa

SEQ ID NO: 1725199 - RNA, 22 nt, Homo sapiens
acaucuggccuugaaaccaccu

SEQ ID NO: 1725200 - RNA, 19 nt, Homo sapiens
acaucuuuuacauucugca

SEQ ID NO: 1725201 - RNA, 18 nt, Homo sapiens
acauuauucuucacuuaa

SEQ ID NO: 1725202 - RNA, 23 nt, Homo sapiens
acauuuaccaagagagcacauga

SEQ ID NO: 1725203 - RNA, 22 nt, Homo sapiens
accaacugaaguggcuaaagag

SEQ ID NO: 1725204 - RNA, 23 nt, Homo sapiens
accaauuuauccuugaccaauaa

SEQ ID NO: 1725205 - RNA, 16 nt, Homo sapiens
accaccaacauucugu

SEQ ID NO: 1725206 - RNA, 15 nt, Homo sapiens
accauauaccaucuc

SEQ ID NO: 1725207 - RNA, 21 nt, Homo sapiens
accaucuccagcuauuuacac

SEQ ID NO: 1725208 - RNA, 20 nt, Homo sapiens
acccaggacuuccauuugcu

SEQ ID NO: 1725209 - RNA, 19 nt, Homo sapiens
acccaguguuggucugugu

SEQ ID NO: 1725210 - RNA, 19 nt, Homo sapiens
accggcccuuucuuuguga

SEQ ID NO: 1725211 - RNA, 23 nt, Homo sapiens
accucugauuacaauucugaugu

SEQ ID NO: 1725212 - RNA, 12 nt, Homo sapiens
accucuguacag

SEQ ID NO: 1725213 - RNA, 21 nt, Homo sapiens
accuguaccuccaaaagugac

SEQ ID NO: 1725214 - RNA, 22 nt, Homo sapiens
accuuuccuuaggaagacauuu

SEQ ID NO: 1725215 - RNA, 17 nt, Homo sapiens
acgcacccccacugcug

SEQ ID NO: 1725216 - RNA, 17 nt, Homo sapiens
acguguucgguacugag

SEQ ID NO: 1725217 - RNA, 17 nt, Homo sapiens
acuaaaugcagaaauaa

SEQ ID NO: 1725218 - RNA, 22 nt, Homo sapiens
acucuguccuuacauacucaau

SEQ ID NO: 1725219 - RNA, 22 nt, Homo sapiens
acugaauucuggacagauuuaa

SEQ ID NO: 1725220 - RNA, 13 nt, Homo sapiens
acuggagugaaug

SEQ ID NO: 1725221 - RNA, 17 nt, Homo sapiens
acuggcgagcagccacu

SEQ ID NO: 1725222 - RNA, 14 nt, Homo sapiens
acuuccauuugcuu

SEQ ID NO: 1725223 - RNA, 18 nt, Homo sapiens
acuugaaguuuugguucu

SEQ ID NO: 1725224 - RNA, 18 nt, Homo sapiens
acuuuaaagauaagucua

SEQ ID NO: 1725225 - RNA, 17 nt, Homo sapiens
acuuuguacauguuaca

SEQ ID NO: 1725226 - RNA, 13 nt, Homo sapiens
cuguaccuccaaa

SEQ ID NO: 1725227 - RNA, 19 nt, Homo sapiens
cuguauuuuacaagucaaa

SEQ ID NO: 1725228 - RNA, 20 nt, Homo sapiens
cuguauuuuauauaggcauu

SEQ ID NO: 1725229 - RNA, 14 nt, Homo sapiens
cugucugacaaccu

SEQ ID NO: 1725230 - RNA, 12 nt, Homo sapiens
cuguggaugcuu

SEQ ID NO: 1725231 - RNA, 13 nt, Homo sapiens
cuuaaagcacuga

SEQ ID NO: 1725232 - RNA, 14 nt, Homo sapiens
cuuaaagcacugau

SEQ ID NO: 1725233 - RNA, 13 nt, Homo sapiens
cuuaaagcuugau

SEQ ID NO: 1725234 - RNA, 13 nt, Homo sapiens
cuuagaaugccau

SEQ ID NO: 1725235 - RNA, 18 nt, Homo sapiens
cuucaaauuggucugaaa

SEQ ID NO: 1725236 - RNA, 22 nt, Homo sapiens
cuucaaggcccauaucugugaa

SEQ ID NO: 1725237 - RNA, 15 nt, Homo sapiens
cuucacucaugcaaa

SEQ ID NO: 1725238 - RNA, 20 nt, Homo sapiens
cuucagacuuaaagcacuga

SEQ ID NO: 1725239 - RNA, 12 nt, Homo sapiens
cuucagugcaga

SEQ ID NO: 1725240 - RNA, 12 nt, Homo sapiens
cuuccauuugcu

SEQ ID NO: 1725241 - RNA, 16 nt, Homo sapiens
cuuccucucugugaug

SEQ ID NO: 1725242 - RNA, 16 nt, Homo sapiens
cuuguuccccacugac

SEQ ID NO: 1725243 - RNA, 15 nt, Homo sapiens
cuuuaaaagucauua

SEQ ID NO: 1725244 - RNA, 11 nt, Homo sapiens
cuuugcacuug

SEQ ID NO: 1725245 - RNA, 15 nt, Homo sapiens
cuuugcugcugugaa

SEQ ID NO: 1725246 - RNA, 17 nt, Homo sapiens
cuuugucccggggcucc

SEQ ID NO: 1725247 - RNA, 18 nt, Homo sapiens
cuuugugaaaacuacuga

SEQ ID NO: 1725248 - RNA, 16 nt, Homo sapiens
cuuuuugaaagaacau

SEQ ID NO: 1725249 - RNA, 18 nt, Homo sapiens
gaaaaaacagaucagggc

SEQ ID NO: 1725250 - RNA, 16 nt, Homo sapiens
gaaacagucacuauca

SEQ ID NO: 1725251 - RNA, 15 nt, Homo sapiens
gaaacugaauucugg

SEQ ID NO: 1725252 - RNA, 17 nt, Homo sapiens
gaaagguaauggacuca

SEQ ID NO: 1725253 - RNA, 12 nt, Homo sapiens
gaaaugaucauu

SEQ ID NO: 1725254 - RNA, 13 nt, Homo sapiens
gaacaguacucca

SEQ ID NO: 1725255 - RNA, 15 nt, Homo sapiens
gaagaacaguacucc

SEQ ID NO: 1725256 - RNA, 17 nt, Homo sapiens
gaaguagcaaugacaau

SEQ ID NO: 1725257 - RNA, 22 nt, Homo sapiens
gaagucagugcuaaagcuggag

SEQ ID NO: 1725258 - RNA, 17 nt, Homo sapiens
gaaguuuuuuacuuugg

SEQ ID NO: 1725259 - RNA, 20 nt, Homo sapiens
gaaugggcuugaaacauuau

SEQ ID NO: 1725260 - RNA, 20 nt, Homo sapiens
gaauuuucucuaacuucaag

SEQ ID NO: 1725261 - RNA, 12 nt, Homo sapiens
gacaaugaccaa

SEQ ID NO: 1725262 - RNA, 11 nt, Homo sapiens
gacacacugug

SEQ ID NO: 1725263 - RNA, 22 nt, Homo sapiens
gacaggcuagcuagcuguguua

SEQ ID NO: 1725264 - RNA, 23 nt, Homo sapiens
gaccuuuauccagcuagugccaa

SEQ ID NO: 1725265 - RNA, 13 nt, Homo sapiens
gacucaguauuau

SEQ ID NO: 1725266 - RNA, 15 nt, Homo sapiens
gacuuaaagcacuga

SEQ ID NO: 1725267 - RNA, 18 nt, Homo sapiens
gacuuugauuuccuuaau

SEQ ID NO: 1725268 - RNA, 21 nt, Homo sapiens
gagaagcacuaagacugcuuc

SEQ ID NO: 1725269 - RNA, 13 nt, Homo sapiens
gagaccaagaaca

SEQ ID NO: 1725270 - RNA, 15 nt, Homo sapiens
gagaguuugaaaaau

SEQ ID NO: 1725271 - RNA, 16 nt, Homo sapiens
gagaguuugaaaaaug

SEQ ID NO: 1725272 - RNA, 15 nt, Homo sapiens
gagauuggauuugcu

SEQ ID NO: 1725273 - RNA, 15 nt, Homo sapiens
gaggaauuggccgcu

SEQ ID NO: 1725274 - RNA, 23 nt, Homo sapiens
gaguaaugauguaacagugcaag

SEQ ID NO: 1725275 - RNA, 13 nt, Homo sapiens
gagugccaugcuu

SEQ ID NO: 1725276 - RNA, 19 nt, Homo sapiens
gauaaguucuuuuacaaau

SEQ ID NO: 1725277 - RNA, 18 nt, Homo sapiens
gauaauaaucaugaucac

SEQ ID NO: 1725278 - RNA, 18 nt, Homo sapiens
gauauaaaaauaauguca

SEQ ID NO: 1725279 - RNA, 21 nt, Homo sapiens
gaugaucuggauccaccaaga

SEQ ID NO: 1725280 - RNA, 16 nt, Homo sapiens
gauuagagagucucaa

SEQ ID NO: 1725281 - RNA, 12 nt, Homo sapiens
gauucugaccau

SEQ ID NO: 1725282 - RNA, 17 nt, Homo sapiens
gcaaaaagauuuacuuu

SEQ ID NO: 1725283 - RNA, 14 nt, Homo sapiens
gcaaacugcuuuau

SEQ ID NO: 1725284 - RNA, 13 nt, Homo sapiens
gcaacaaugacuu

SEQ ID NO: 1725285 - RNA, 18 nt, Homo sapiens
gcaacagguuuguucuca

SEQ ID NO: 1725286 - RNA, 21 nt, Homo sapiens
gcaacagguuuguucucagga

SEQ ID NO: 1725287 - RNA, 22 nt, Homo sapiens
gcacaucugcauuuucacccca

SEQ ID NO: 1725288 - RNA, 17 nt, Homo sapiens
gcagcacaccccacagc

SEQ ID NO: 1725289 - RNA, 21 nt, Homo sapiens
gcagcucuucuggcuguguug

SEQ ID NO: 1725290 - RNA, 20 nt, Homo sapiens
gcagcuuuugggaagucuca

SEQ ID NO: 1725291 - RNA, 18 nt, Homo sapiens
gcagugagugccaugcuu

SEQ ID NO: 1725292 - RNA, 19 nt, Homo sapiens
gcauccuguguaaauggaa

SEQ ID NO: 1725293 - RNA, 15 nt, Homo sapiens
gccaaacacacugua

SEQ ID NO: 1725294 - RNA, 17 nt, Homo sapiens
gccauauaugcuguauu

SEQ ID NO: 1725295 - RNA, 14 nt, Homo sapiens
gcccuacacugccu

SEQ ID NO: 1725296 - RNA, 12 nt, Homo sapiens
gcccugaugacc

SEQ ID NO: 1725297 - RNA, 16 nt, Homo sapiens
gcggagcuugcaguga

SEQ ID NO: 1725298 - RNA, 20 nt, Homo sapiens
gcggcaaaauuaauggacac

SEQ ID NO: 1725299 - RNA, 18 nt, Homo sapiens
gcuaaagcuggagcaguu

SEQ ID NO: 1725300 - RNA, 15 nt, Homo sapiens
gcucagaaaggaaau

SEQ ID NO: 1725301 - RNA, 21 nt, Homo sapiens
gcugcaacagguuuguucuca

SEQ ID NO: 1725302 - RNA, 15 nt, Homo sapiens
gcuggcccugaugac

SEQ ID NO: 1725303 - RNA, 15 nt, Homo sapiens
gcuuaaagcuugauu

SEQ ID NO: 1725304 - RNA, 19 nt, Homo sapiens
gcuuuaaaaugucugugua

SEQ ID NO: 1725305 - RNA, 13 nt, Homo sapiens
ggaagagggcuca

SEQ ID NO: 1725306 - RNA, 16 nt, Homo sapiens
ggaagcugucccucac

SEQ ID NO: 1725307 - RNA, 19 nt, Homo sapiens
ggaauuuauccuugaccaa

SEQ ID NO: 1725308 - RNA, 17 nt, Homo sapiens
ggacauuuaaaauucaa

SEQ ID NO: 1725309 - RNA, 15 nt, Homo sapiens
ggacuuccauuugcu

SEQ ID NO: 1725310 - RNA, 21 nt, Homo sapiens
ggaucagcucuuccuguguuu

SEQ ID NO: 1725311 - RNA, 18 nt, Homo sapiens
ggauuaccaaaacacugc

SEQ ID NO: 1725312 - RNA, 15 nt, Homo sapiens
ggcacuaacacuggg

SEQ ID NO: 1725313 - RNA, 19 nt, Homo sapiens
ggcacuggcgagcagccac

SEQ ID NO: 1725314 - RNA, 17 nt, Homo sapiens
ggcacuuuuauuuucau

SEQ ID NO: 1725315 - RNA, 14 nt, Homo sapiens
ggcccuuucuuugu

SEQ ID NO: 1725316 - RNA, 18 nt, Homo sapiens
ggcuagcuagcuguguua

SEQ ID NO: 1725317 - RNA, 19 nt, Homo sapiens
ggcuguguugucagcacug

SEQ ID NO: 1725318 - RNA, 17 nt, Homo sapiens
gggagguauucaguuga

SEQ ID NO: 1725319 - RNA, 23 nt, Homo sapiens
gggcagcuuuugggaagucucag

SEQ ID NO: 1725320 - RNA, 18 nt, Homo sapiens
ggggagguauucaguuga

SEQ ID NO: 1725321 - RNA, 16 nt, Homo sapiens
gggucuuugaacccuu

SEQ ID NO: 1725322 - RNA, 20 nt, Homo sapiens
ggguucauuugugaugacau

SEQ ID NO: 1725323 - RNA, 14 nt, Homo sapiens
ggguuuugcuacau

SEQ ID NO: 1725324 - RNA, 20 nt, Homo sapiens
ggucucacaguguugcccag

SEQ ID NO: 1725325 - RNA, 23 nt, Homo sapiens
guaaaaccccgucucuacuaaaa

SEQ ID NO: 1725326 - RNA, 22 nt, Homo sapiens
guaaauaugguucuugccaaaa

SEQ ID NO: 1725327 - RNA, 20 nt, Homo sapiens
guaaauuaguuugacacugc

SEQ ID NO: 1725328 - RNA, 18 nt, Homo sapiens
guaagugugaauugcugc

SEQ ID NO: 1725329 - RNA, 15 nt, Homo sapiens
guaaucccagcacuu

SEQ ID NO: 1725330 - RNA, 14 nt, Homo sapiens
guaaucuaaguaua

SEQ ID NO: 1725331 - RNA, 17 nt, Homo sapiens
guaauuuaaugcugcua

SEQ ID NO: 1725332 - RNA, 18 nt, Homo sapiens
guagaaagacaucugccu

SEQ ID NO: 1725333 - RNA, 22 nt, Homo sapiens
guagagggaguugucaagucuc

SEQ ID NO: 1725334 - RNA, 17 nt, Homo sapiens
guaggggcccacuucac

SEQ ID NO: 1725335 - RNA, 23 nt, Homo sapiens
guauaguagaaagacaucugccu

SEQ ID NO: 1725336 - RNA, 20 nt, Homo sapiens
guauuaaguauuacugagua

SEQ ID NO: 1725337 - RNA, 16 nt, Homo sapiens
gucaaaaggacauuua

SEQ ID NO: 1725338 - RNA, 14 nt, Homo sapiens
gucagcacuguaac

SEQ ID NO: 1725339 - RNA, 17 nt, Homo sapiens
gucucacaguguugccc

SEQ ID NO: 1725340 - RNA, 13 nt, Homo sapiens
gucugaacaaaac

SEQ ID NO: 1725341 - RNA, 14 nt, Homo sapiens
gugaaaugcuggca

SEQ ID NO: 1725342 - RNA, 23 nt, Homo sapiens
uuuuuggaaaccuggaacacaaa

SEQ ID NO: 1725343 - RNA, 20 nt, Homo sapiens
uguuuuacccuauacaucca

SEQ ID NO: 1725344 - RNA, 17 nt, Homo sapiens
uuaaaauauucuacaga

SEQ ID NO: 1725345 - RNA, 13 nt, Homo sapiens
uuaaaauguaguu

SEQ ID NO: 1725346 - RNA, 21 nt, Homo sapiens
uuaaacaaaauuucacaguuc

SEQ ID NO: 1725347 - RNA, 19 nt, Homo sapiens
uuaaagcauauuggugcua

SEQ ID NO: 1725348 - RNA, 15 nt, Homo sapiens
uuaaaguauguccuu

SEQ ID NO: 1725349 - RNA, 23 nt, Homo sapiens
uuaaauaaaguuuggacuuaucu

SEQ ID NO: 1725350 - RNA, 15 nt, Homo sapiens
uuaacaucacuacaa

SEQ ID NO: 1725351 - RNA, 20 nt, Homo sapiens
uuacaaucagccacauucua

SEQ ID NO: 1725352 - RNA, 15 nt, Homo sapiens
uuagauucugaccau

SEQ ID NO: 1725353 - RNA, 24 nt, Homo sapiens
uuaggagcagguagggcuuguacu

SEQ ID NO: 1725354 - RNA, 15 nt, Homo sapiens
uuauaaauacauaaa

SEQ ID NO: 1725355 - RNA, 17 nt, Homo sapiens
uuauccuugaccaauuu

SEQ ID NO: 1725356 - RNA, 18 nt, Homo sapiens
uuaucuugaguugcagcu

SEQ ID NO: 1725357 - RNA, 18 nt, Homo sapiens
uuaugaaaggucauuaaa

SEQ ID NO: 1725358 - RNA, 22 nt, Homo sapiens
uucaauaaaggaaauaugcacu

SEQ ID NO: 1725359 - RNA, 12 nt, Homo sapiens
uucacagcacua

SEQ ID NO: 1725360 - RNA, 21 nt, Homo sapiens
uucaggacgguugucacuuau

SEQ ID NO: 1725361 - RNA, 11 nt, Homo sapiens
uucaucucuug

SEQ ID NO: 1725362 - RNA, 18 nt, Homo sapiens
uucaugugcugccugcaa

SEQ ID NO: 1725363 - RNA, 15 nt, Homo sapiens
uucuaaaugaacuca

SEQ ID NO: 1725364 - RNA, 17 nt, Homo sapiens
uucuggggugggaauca

SEQ ID NO: 1725365 - RNA, 20 nt, Homo sapiens
uucuuuuuugggucuucauu

SEQ ID NO: 1725366 - RNA, 21 nt, Homo sapiens
uugaaaaacuuuuagguuguu

SEQ ID NO: 1725367 - RNA, 18 nt, Homo sapiens
uugaaagagaagcacuaa

SEQ ID NO: 1725368 - RNA, 15 nt, Homo sapiens
uugaauuaccauaga

SEQ ID NO: 1725369 - RNA, 14 nt, Homo sapiens
agaaaaauaugcau

SEQ ID NO: 1725370 - RNA, 16 nt, Homo sapiens
agaaaaucaguugugu

SEQ ID NO: 1725371 - RNA, 13 nt, Homo sapiens
agaacaaaugauc

SEQ ID NO: 1725372 - RNA, 18 nt, Homo sapiens
agaacaguacuccacaaa

SEQ ID NO: 1725373 - RNA, 22 nt, Homo sapiens
agaacagugcacaagauuauuu

SEQ ID NO: 1725374 - RNA, 14 nt, Homo sapiens
agaacuugaccccc

SEQ ID NO: 1725375 - RNA, 18 nt, Homo sapiens
agaaguuuuuuacuuugg

SEQ ID NO: 1725376 - RNA, 16 nt, Homo sapiens
agacaugguaaacuuu

SEQ ID NO: 1725377 - RNA, 20 nt, Homo sapiens
agacauuugguuuucaucau

SEQ ID NO: 1725378 - RNA, 16 nt, Homo sapiens
agacuuaaagcacuga

SEQ ID NO: 1725379 - RNA, 17 nt, Homo sapiens
agacuugggaucugcaa

SEQ ID NO: 1725380 - RNA, 22 nt, Homo sapiens
agagcucugagucuuagugguu

SEQ ID NO: 1725381 - RNA, 19 nt, Homo sapiens
agaguccuguaccacucac

SEQ ID NO: 1725382 - RNA, 15 nt, Homo sapiens
agagucggauuacca

SEQ ID NO: 1725383 - RNA, 15 nt, Homo sapiens
agauacacugugaua

SEQ ID NO: 1725384 - RNA, 19 nt, Homo sapiens
agcaaaauuguggcauuuu

SEQ ID NO: 1725385 - RNA, 12 nt, Homo sapiens
agcaacaaugac

SEQ ID NO: 1725386 - RNA, 17 nt, Homo sapiens
agcacaccccacagcca

SEQ ID NO: 1725387 - RNA, 13 nt, Homo sapiens
agcagacaugcca

SEQ ID NO: 1725388 - RNA, 19 nt, Homo sapiens
agcagaggcuuugcugcug

SEQ ID NO: 1725389 - RNA, 13 nt, Homo sapiens
agcagcacccagu

SEQ ID NO: 1725390 - RNA, 14 nt, Homo sapiens
agcagcacccagug

SEQ ID NO: 1725391 - RNA, 22 nt, Homo sapiens
agcagcucuucuggcuguguug

SEQ ID NO: 1725392 - RNA, 13 nt, Homo sapiens
agcauaacagcca

SEQ ID NO: 1725393 - RNA, 22 nt, Homo sapiens
agcauuccuuucucuucagugc

SEQ ID NO: 1725394 - RNA, 23 nt, Homo sapiens
agccaacuuuugcauguuuugua

SEQ ID NO: 1725395 - RNA, 13 nt, Homo sapiens
agccugcacuggg

SEQ ID NO: 1725396 - RNA, 14 nt, Homo sapiens
agccuuugccuccc

SEQ ID NO: 1725397 - RNA, 18 nt, Homo sapiens
agcuugacaccuggugcu

SEQ ID NO: 1725398 - RNA, 13 nt, Homo sapiens
aggaaagaaggag

SEQ ID NO: 1725399 - RNA, 23 nt, Homo sapiens
aggacucaguauuauuucaagac

SEQ ID NO: 1725400 - RNA, 16 nt, Homo sapiens
aggacuuccauuugcu

SEQ ID NO: 1725401 - RNA, 16 nt, Homo sapiens
aggccaaacggugcaa

SEQ ID NO: 1725402 - RNA, 19 nt, Homo sapiens
aggcgauccaccugucuca

SEQ ID NO: 1725403 - RNA, 17 nt, Homo sapiens
aggcucagacaacagac

SEQ ID NO: 1725404 - RNA, 19 nt, Homo sapiens
aggcucaucuaacucuguc

SEQ ID NO: 1725405 - RNA, 15 nt, Homo sapiens
agggaagagggcuca

SEQ ID NO: 1725406 - RNA, 18 nt, Homo sapiens
agggaagcugucccucac

SEQ ID NO: 1725407 - RNA, 15 nt, Homo sapiens
aggguuuugacacuu

SEQ ID NO: 1725408 - RNA, 20 nt, Homo sapiens
aguaagugugaauugcugca

SEQ ID NO: 1725409 - RNA, 12 nt, Homo sapiens
aguaauuuaaca

SEQ ID NO: 1725410 - RNA, 18 nt, Homo sapiens
aguaccuacaucagucaa

SEQ ID NO: 1725411 - RNA, 15 nt, Homo sapiens
aguagcaaugacaau

SEQ ID NO: 1725412 - RNA, 18 nt, Homo sapiens
aguagggauaaagucauc

SEQ ID NO: 1725413 - RNA, 16 nt, Homo sapiens
aguaguaaucugucag

SEQ ID NO: 1725414 - RNA, 14 nt, Homo sapiens
aguauguaaaacau

SEQ ID NO: 1725415 - RNA, 20 nt, Homo sapiens
aguauguccuucagcugacu

SEQ ID NO: 1725416 - RNA, 15 nt, Homo sapiens
aguauuacugaguau

SEQ ID NO: 1725417 - RNA, 13 nt, Homo sapiens
agucccagccaca

SEQ ID NO: 1725418 - RNA, 16 nt, Homo sapiens
agucucauucaaauac

SEQ ID NO: 1725419 - RNA, 17 nt, Homo sapiens
agugaccaccaacauuc

SEQ ID NO: 1725420 - RNA, 19 nt, Homo sapiens
agugaccaccaacauucug

SEQ ID NO: 1725421 - RNA, 20 nt, Homo sapiens
agugacugcagcuugccaaa

SEQ ID NO: 1725422 - RNA, 20 nt, Homo sapiens
aguggauaaauauacaaauc

SEQ ID NO: 1725423 - RNA, 12 nt, Homo sapiens
aguguugcccag

SEQ ID NO: 1725424 - RNA, 21 nt, Homo sapiens
aguuuauauuuuuucucaaaa

SEQ ID NO: 1725425 - RNA, 14 nt, Homo sapiens
auaaucaugaucac

SEQ ID NO: 1725426 - RNA, 19 nt, Homo sapiens
auaaucaugcucauguaua

SEQ ID NO: 1725427 - RNA, 15 nt, Homo sapiens
auaccuuuuuguguc

SEQ ID NO: 1725428 - RNA, 16 nt, Homo sapiens
auaccuuuuuguguca

SEQ ID NO: 1725429 - RNA, 13 nt, Homo sapiens
auagcuacuguag

SEQ ID NO: 1725430 - RNA, 17 nt, Homo sapiens
auaggacauugugucag

SEQ ID NO: 1725431 - RNA, 16 nt, Homo sapiens
auaggcaaaagacaug

SEQ ID NO: 1725432 - RNA, 14 nt, Homo sapiens
auaggcauuucaca

SEQ ID NO: 1725433 - RNA, 20 nt, Homo sapiens
auauaaaaauaaugucauag

SEQ ID NO: 1725434 - RNA, 18 nt, Homo sapiens
auauacugguucacaucc

SEQ ID NO: 1725435 - RNA, 22 nt, Homo sapiens
auauaggcauuucacaaaaaca

SEQ ID NO: 1725436 - RNA, 14 nt, Homo sapiens
auaucgaucucuua

SEQ ID NO: 1725437 - RNA, 20 nt, Homo sapiens
auaucuuugcugcuuuccag

SEQ ID NO: 1725438 - RNA, 20 nt, Homo sapiens
auauugaaaguugcuuuuau

SEQ ID NO: 1725439 - RNA, 15 nt, Homo sapiens
aucagucaacaacuu

SEQ ID NO: 1725440 - RNA, 13 nt, Homo sapiens
aucccaccugcca

SEQ ID NO: 1725441 - RNA, 12 nt, Homo sapiens
aucccagcacuu

SEQ ID NO: 1725442 - RNA, 20 nt, Homo sapiens
auccuaccccuuugcacuug

SEQ ID NO: 1725443 - RNA, 22 nt, Homo sapiens
aucucucccuccccugccauuu

SEQ ID NO: 1725444 - RNA, 23 nt, Homo sapiens
aucucuuguauaugaugaucugg

SEQ ID NO: 1725445 - RNA, 23 nt, Homo sapiens
aucugcuuccauuaaaagcauaa

SEQ ID NO: 1725446 - RNA, 21 nt, Homo sapiens
aucuguguaaaaucugacaua

SEQ ID NO: 1725447 - RNA, 18 nt, Homo sapiens
augaauaccuuuguucaa

SEQ ID NO: 1725448 - RNA, 19 nt, Homo sapiens
augaccaaggacugcuaca

SEQ ID NO: 1725449 - RNA, 20 nt, Homo sapiens
augauaauaaucaugaucac

SEQ ID NO: 1725450 - RNA, 20 nt, Homo sapiens
augauauuuccccuaacuau

SEQ ID NO: 1725451 - RNA, 18 nt, Homo sapiens
auggagggaaugcucaga

SEQ ID NO: 1725452 - RNA, 18 nt, Homo sapiens
auggaucagcucuuccug

SEQ ID NO: 1725453 - RNA, 13 nt, Homo sapiens
auggccagccaac

SEQ ID NO: 1725454 - RNA, 20 nt, Homo sapiens
auguaaaacauucuuuugca

SEQ ID NO: 1725455 - RNA, 13 nt, Homo sapiens
auuaaccugguca

SEQ ID NO: 1725456 - RNA, 15 nt, Homo sapiens
auuaaguauuacuga

SEQ ID NO: 1725457 - RNA, 20 nt, Homo sapiens
auuaauaccacuacccguga

SEQ ID NO: 1725458 - RNA, 14 nt, Homo sapiens
auuacaauugugag

SEQ ID NO: 1725459 - RNA, 18 nt, Homo sapiens
auuacauggggucuagaa

SEQ ID NO: 1725460 - RNA, 14 nt, Homo sapiens
auuaccaaaacacu

SEQ ID NO: 1725461 - RNA, 16 nt, Homo sapiens
auuaccaaaacacugc

SEQ ID NO: 1725462 - RNA, 19 nt, Homo sapiens
auuaccaaaacacugccug

SEQ ID NO: 1725463 - RNA, 15 nt, Homo sapiens
auuagagagucucaa

SEQ ID NO: 1725464 - RNA, 15 nt, Homo sapiens
auuagguguacugua

SEQ ID NO: 1725465 - RNA, 13 nt, Homo sapiens
auuaguuugacac

SEQ ID NO: 1725466 - RNA, 23 nt, Homo sapiens
auuauauaaagguggugggcaaa

SEQ ID NO: 1725467 - RNA, 16 nt, Homo sapiens
auucuaaaugaacuca

SEQ ID NO: 1725468 - RNA, 14 nt, Homo sapiens
auugaagcuuugug

SEQ ID NO: 1725469 - RNA, 19 nt, Homo sapiens
auugcuuguuuguggucac

SEQ ID NO: 1725470 - RNA, 15 nt, Homo sapiens
auuuaaaauucaauu

SEQ ID NO: 1725471 - RNA, 12 nt, Homo sapiens
auuucaucucuu

SEQ ID NO: 1725472 - RNA, 16 nt, Homo sapiens
auuuuacaagucaaaa

SEQ ID NO: 1725473 - RNA, 21 nt, Homo sapiens
auuuuaugcuggacucuggac

SEQ ID NO: 1725474 - RNA, 12 nt, Homo sapiens
auuuucuagaua

SEQ ID NO: 1725475 - RNA, 19 nt, Homo sapiens
caaaauauaauuuacauua

SEQ ID NO: 1725476 - RNA, 15 nt, Homo sapiens
caaaauauauauuaa

SEQ ID NO: 1725477 - RNA, 13 nt, Homo sapiens
caaacacacugua

SEQ ID NO: 1725478 - RNA, 18 nt, Homo sapiens
caaagaaugggcuugaaa

SEQ ID NO: 1725479 - RNA, 20 nt, Homo sapiens
caaauauugguuaguauuua

SEQ ID NO: 1725480 - RNA, 14 nt, Homo sapiens
caaaugaaauaaua

SEQ ID NO: 1725481 - RNA, 17 nt, Homo sapiens
caaauuaaaaaaucaaa

SEQ ID NO: 1725482 - RNA, 15 nt, Homo sapiens
caagcauuuuuccau

SEQ ID NO: 1725483 - RNA, 13 nt, Homo sapiens
caagcgagucacg

SEQ ID NO: 1725484 - RNA, 19 nt, Homo sapiens
caaggcccauaucugugaa

SEQ ID NO: 1725485 - RNA, 20 nt, Homo sapiens
ugagguaauucuagccuuuu

SEQ ID NO: 1725486 - RNA, 17 nt, Homo sapiens
ugagugccaugcuuuuu

SEQ ID NO: 1725487 - RNA, 20 nt, Homo sapiens
ugaguuacuuagaaugccau

SEQ ID NO: 1725488 - RNA, 19 nt, Homo sapiens
ugauaauaaucaugaucac

SEQ ID NO: 1725489 - RNA, 12 nt, Homo sapiens
ugauauuucccc

SEQ ID NO: 1725490 - RNA, 14 nt, Homo sapiens
ugaucuguacuuug

SEQ ID NO: 1725491 - RNA, 13 nt, Homo sapiens
ugauuaaucauaa

SEQ ID NO: 1725492 - RNA, 21 nt, Homo sapiens
ugauuaccagucugauuauac

SEQ ID NO: 1725493 - RNA, 16 nt, Homo sapiens
ugcaaacugcuuuauu

SEQ ID NO: 1725494 - RNA, 19 nt, Homo sapiens
ugcaacagguuuguucuca

SEQ ID NO: 1725495 - RNA, 19 nt, Homo sapiens
ugcaagcacagcauaccug

SEQ ID NO: 1725496 - RNA, 21 nt, Homo sapiens
ugcagaaguuacuaaguauua

SEQ ID NO: 1725497 - RNA, 16 nt, Homo sapiens
ugcaguguuaguauuc

SEQ ID NO: 1725498 - RNA, 16 nt, Homo sapiens
ugcauugugaggguua

SEQ ID NO: 1725499 - RNA, 13 nt, Homo sapiens
ugccaugcuuuuu

SEQ ID NO: 1725500 - RNA, 21 nt, Homo sapiens
ugccugcucuucagacuuaaa

SEQ ID NO: 1725501 - RNA, 20 nt, Homo sapiens
ugcuaaagggagaaaugcca

SEQ ID NO: 1725502 - RNA, 21 nt, Homo sapiens
ugcuacaccucugauuacaau

SEQ ID NO: 1725503 - RNA, 16 nt, Homo sapiens
ugcuauuaagaaggca

SEQ ID NO: 1725504 - RNA, 11 nt, Homo sapiens
ugcucauguau

SEQ ID NO: 1725505 - RNA, 17 nt, Homo sapiens
ugcucauguauauuuag

SEQ ID NO: 1725506 - RNA, 14 nt, Homo sapiens
ugcucuucagacuu

SEQ ID NO: 1725507 - RNA, 20 nt, Homo sapiens
ugcugaaauaaaaugauuaa

SEQ ID NO: 1725508 - RNA, 23 nt, Homo sapiens
ugcugcacagaaauuuucaauuu

SEQ ID NO: 1725509 - RNA, 22 nt, Homo sapiens
ugcuggcauuugcaccuaccuc

SEQ ID NO: 1725510 - RNA, 15 nt, Homo sapiens
ugcuggcccugauga

SEQ ID NO: 1725511 - RNA, 22 nt, Homo sapiens
ugcuucacucaugcaaacugcu

SEQ ID NO: 1725512 - RNA, 21 nt, Homo sapiens
ugcuuuaauucagcuuuagaa

SEQ ID NO: 1725513 - RNA, 16 nt, Homo sapiens
uggagggaaugcucag

SEQ ID NO: 1725514 - RNA, 18 nt, Homo sapiens
uggaugcuuucacccuca

SEQ ID NO: 1725515 - RNA, 15 nt, Homo sapiens
uggcacuaacacugg

SEQ ID NO: 1725516 - RNA, 16 nt, Homo sapiens
uggccugacaauauga

SEQ ID NO: 1725517 - RNA, 15 nt, Homo sapiens
uggcgagcagccacu

SEQ ID NO: 1725518 - RNA, 16 nt, Homo sapiens
ugggaaucaagucaua

SEQ ID NO: 1725519 - RNA, 19 nt, Homo sapiens
uggggaguaggacauacca

SEQ ID NO: 1725520 - RNA, 20 nt, Homo sapiens
ugguuugaacaucaaaggga

SEQ ID NO: 1725521 - RNA, 21 nt, Homo sapiens
uguaaauuaguuugacacugc

SEQ ID NO: 1725522 - RNA, 23 nt, Homo sapiens
ugucaccaacugaaguggcuaaa

SEQ ID NO: 1725523 - RNA, 14 nt, Homo sapiens
ugucagcacuguaa

SEQ ID NO: 1725524 - RNA, 16 nt, Homo sapiens
ugucccucacuguuga

SEQ ID NO: 1725525 - RNA, 14 nt, Homo sapiens
ugucuagugccaca

SEQ ID NO: 1725526 - RNA, 23 nt, Homo sapiens
ugugaaagaugcacaacacuccu

SEQ ID NO: 1725527 - RNA, 13 nt, Homo sapiens
ugugcgcacacac

SEQ ID NO: 1725528 - RNA, 23 nt, Homo sapiens
ugugcuuuaauucagcuuuagaa

SEQ ID NO: 1725529 - RNA, 17 nt, Homo sapiens
uguggguccaacacuua

SEQ ID NO: 1725530 - RNA, 22 nt, Homo sapiens
uguguucugucaccaacugaag

SEQ ID NO: 1725531 - RNA, 13 nt, Homo sapiens
uguuaauuuagag

SEQ ID NO: 1725532 - RNA, 16 nt, Homo sapiens
uguuagaaguagcaau

SEQ ID NO: 1725533 - RNA, 15 nt, Homo sapiens
uuaaaauagucucau

SEQ ID NO: 1725534 - RNA, 18 nt, Homo sapiens
uuaaccucuuaucacuaa

SEQ ID NO: 1725535 - RNA, 19 nt, Homo sapiens
uuaacuguauuucaguauu

SEQ ID NO: 1725536 - RNA, 19 nt, Homo sapiens
uuaagauccacaaaugaag

SEQ ID NO: 1725537 - RNA, 19 nt, Homo sapiens
uuaagccuugacacacugu

SEQ ID NO: 1725538 - RNA, 14 nt, Homo sapiens
uuaauaaucuuggc

SEQ ID NO: 1725539 - RNA, 20 nt, Homo sapiens
uuaauauaauuggcacagaa

SEQ ID NO: 1725540 - RNA, 13 nt, Homo sapiens
uuacaauugugag

SEQ ID NO: 1725541 - RNA, 13 nt, Homo sapiens
uuaccaaaacacu

SEQ ID NO: 1725542 - RNA, 14 nt, Homo sapiens
uuacuaaaugcaga

SEQ ID NO: 1725543 - RNA, 17 nt, Homo sapiens
uuagaaauuaauaccac

SEQ ID NO: 1725544 - RNA, 20 nt, Homo sapiens
uuagaaggacucaguauuau

SEQ ID NO: 1725545 - RNA, 15 nt, Homo sapiens
uuagagagucucaag

SEQ ID NO: 1725546 - RNA, 19 nt, Homo sapiens
uuagauucugaccaugacu

SEQ ID NO: 1725547 - RNA, 22 nt, Homo sapiens
uuagauugggucguuacuaaaa

SEQ ID NO: 1725548 - RNA, 18 nt, Homo sapiens
uuaguauuuaacuacauc

SEQ ID NO: 1725549 - RNA, 20 nt, Homo sapiens
uuaguuuacaaucagccaca

SEQ ID NO: 1725550 - RNA, 23 nt, Homo sapiens
uuauauaaagguggugggcaaaa

SEQ ID NO: 1725551 - RNA, 20 nt, Homo sapiens
uuaucaaugaaaauuucacu

SEQ ID NO: 1725552 - RNA, 16 nt, Homo sapiens
uuaucacuaagaaaga

SEQ ID NO: 1725553 - RNA, 17 nt, Homo sapiens
uuaugaaaggucauuaa

SEQ ID NO: 1725554 - RNA, 11 nt, Homo sapiens
uuaugagauuu

SEQ ID NO: 1725555 - RNA, 20 nt, Homo sapiens
uucacuggggcaugagauuu

SEQ ID NO: 1725556 - RNA, 19 nt, Homo sapiens
uucagauacacugugauaa

SEQ ID NO: 1725557 - RNA, 20 nt, Homo sapiens
uucagaugcuguuaguaccu

SEQ ID NO: 1725558 - RNA, 21 nt, Homo sapiens
uucagugucgggaauuuuccc

SEQ ID NO: 1725559 - RNA, 16 nt, Homo sapiens
uucaguucccaggugg

SEQ ID NO: 1725560 - RNA, 20 nt, Homo sapiens
uucauacacguaaaugcaga

SEQ ID NO: 1725561 - RNA, 12 nt, Homo sapiens
uuccccacugac

SEQ ID NO: 1725562 - RNA, 15 nt, Homo sapiens
uuccuguucuauuaa

SEQ ID NO: 1725563 - RNA, 22 nt, Homo sapiens
uucgguacugagcagccacuac

SEQ ID NO: 1725564 - RNA, 16 nt, Homo sapiens
uucucagucuccuuaa

SEQ ID NO: 1725565 - RNA, 23 nt, Homo sapiens
uucugcaacaucuuaagauccac

SEQ ID NO: 1725566 - RNA, 13 nt, Homo sapiens
uugaaaacaaaga

SEQ ID NO: 1725567 - RNA, 17 nt, Homo sapiens
uugacacuuguugucca

SEQ ID NO: 1725568 - RNA, 21 nt, Homo sapiens
uugcaaauauugguuaguauu

SEQ ID NO: 1725569 - RNA, 12 nt, Homo sapiens
uugcuacauucu

SEQ ID NO: 1725570 - RNA, 23 nt, Homo sapiens
uugcuuccugauuaccagucuga

SEQ ID NO: 1725571 - RNA, 22 nt, Homo sapiens
uuggaaaccuggaacacaaaac

SEQ ID NO: 1725572 - RNA, 15 nt, Homo sapiens
uuggagucccagaau

SEQ ID NO: 1725573 - RNA, 16 nt, Homo sapiens
uugguguaaaucuuuu

SEQ ID NO: 1725574 - RNA, 22 nt, Homo sapiens
uuguaaaaucuauuuaugaaag

SEQ ID NO: 1725575 - RNA, 14 nt, Homo sapiens
uuguaaaugucuga

SEQ ID NO: 1725576 - RNA, 13 nt, Homo sapiens
uugucagcacugu

SEQ ID NO: 1725577 - RNA, 19 nt, Homo sapiens
uuguuuuacccuauacauc

SEQ ID NO: 1725578 - RNA, 21 nt, Homo sapiens
uuguuuuaugcucagggucaa

SEQ ID NO: 1725579 - RNA, 19 nt, Homo sapiens
uuuaagguuuuuacuguga

SEQ ID NO: 1725580 - RNA, 21 nt, Homo sapiens
uuuaccaagagagcacaugau

SEQ ID NO: 1725581 - RNA, 20 nt, Homo sapiens
uuuacccuauacauccacag

SEQ ID NO: 1725582 - RNA, 21 nt, Homo sapiens
uuuagaaggacucaguauuau

SEQ ID NO: 1725583 - RNA, 16 nt, Homo sapiens
uuuaguuacguauaau

SEQ ID NO: 1725584 - RNA, 18 nt, Homo sapiens
uuucaauuugagauucua

SEQ ID NO: 1725585 - RNA, 14 nt, Homo sapiens
uuucacagcacuac

SEQ ID NO: 1725586 - RNA, 19 nt, Homo sapiens
uuucauguauguauauaau

SEQ ID NO: 1725587 - RNA, 22 nt, Homo sapiens
uuuccuguucuauuaauacaua

SEQ ID NO: 1725588 - RNA, 14 nt, Homo sapiens
uuucucuucagugc

SEQ ID NO: 1725589 - RNA, 22 nt, Homo sapiens
uuucugcugauuaucacacauc

SEQ ID NO: 1725590 - RNA, 19 nt, Homo sapiens
uuugaacccuugcuugcaa

SEQ ID NO: 1725591 - RNA, 14 nt, Homo sapiens
uuugaggucuacau

SEQ ID NO: 1725592 - RNA, 17 nt, Homo sapiens
uuuggguuuugggucuu

SEQ ID NO: 1725593 - RNA, 20 nt, Homo sapiens
uuuguaaugcugcacagaaa

SEQ ID NO: 1725594 - RNA, 18 nt, Homo sapiens
uuugugucaaaaggacau

SEQ ID NO: 1725595 - RNA, 20 nt, Homo sapiens
uuuuaaaguaaacuugugua

SEQ ID NO: 1725596 - RNA, 23 nt, Homo sapiens
uuuuacaauaaaacuuugcugcc

SEQ ID NO: 1725597 - RNA, 15 nt, Homo sapiens
uuuugcuacauucua

SEQ ID NO: 1725598 - RNA, 16 nt, Homo sapiens
uuuugggaagucucag

SEQ ID NO: 1725599 - RNA, 22 nt, Homo sapiens
acucucaggggagaccaagaac

SEQ ID NO: 1725600 - RNA, 21 nt, Homo sapiens
acucuguccuuacauacucaa

SEQ ID NO: 1725601 - RNA, 14 nt, Homo sapiens
acugaaguggcuaa

SEQ ID NO: 1725602 - RNA, 14 nt, Homo sapiens
acugcaagcauuuu

SEQ ID NO: 1725603 - RNA, 22 nt, Homo sapiens
acugcuacaccucugauuacaa

SEQ ID NO: 1725604 - RNA, 17 nt, Homo sapiens
acugcuucucuuugugc

SEQ ID NO: 1725605 - RNA, 16 nt, Homo sapiens
acugguucacauccua

SEQ ID NO: 1725606 - RNA, 14 nt, Homo sapiens
acuguagaaaggaa

SEQ ID NO: 1725607 - RNA, 15 nt, Homo sapiens
acuuaaagcacugau

SEQ ID NO: 1725608 - RNA, 19 nt, Homo sapiens
acuuuaaagauaagucuac

SEQ ID NO: 1725609 - RNA, 16 nt, Homo sapiens
acuuugaaacuauuaa

SEQ ID NO: 1725610 - RNA, 19 nt, Homo sapiens
agaaaggaaauagacuuug

SEQ ID NO: 1725611 - RNA, 18 nt, Homo sapiens
agaaauaagaauaaacuu

SEQ ID NO: 1725612 - RNA, 12 nt, Homo sapiens
agaaaugaucau

SEQ ID NO: 1725613 - RNA, 11 nt, Homo sapiens
agaaaugccag

SEQ ID NO: 1725614 - RNA, 22 nt, Homo sapiens
agaacaaaugaucuguuuucau

SEQ ID NO: 1725615 - RNA, 20 nt, Homo sapiens
agaagcacccaggacuucca

SEQ ID NO: 1725616 - RNA, 19 nt, Homo sapiens
agaaguuacuaaguauuaa

SEQ ID NO: 1725617 - RNA, 16 nt, Homo sapiens
agaauaaacuuucuca

SEQ ID NO: 1725618 - RNA, 12 nt, Homo sapiens
agacaucugccu

SEQ ID NO: 1725619 - RNA, 15 nt, Homo sapiens
agacaugguaaacuu

SEQ ID NO: 1725620 - RNA, 21 nt, Homo sapiens
agacuugggaucugcaagaag

SEQ ID NO: 1725621 - RNA, 20 nt, Homo sapiens
agagauggggucucacagug

SEQ ID NO: 1725622 - RNA, 14 nt, Homo sapiens
agagccugugugaa

SEQ ID NO: 1725623 - RNA, 21 nt, Homo sapiens
agaggcucaucuaacucuguc

SEQ ID NO: 1725624 - RNA, 22 nt, Homo sapiens
agagucggauuaccaaaacacu

SEQ ID NO: 1725625 - RNA, 18 nt, Homo sapiens
agauaugcuuaaugauag

SEQ ID NO: 1725626 - RNA, 17 nt, Homo sapiens
agauuuaugaugcacuu

SEQ ID NO: 1725627 - RNA, 15 nt, Homo sapiens
agcaaauaggcaaaa

SEQ ID NO: 1725628 - RNA, 19 nt, Homo sapiens
agcaaauaggcaaaagaca

SEQ ID NO: 1725629 - RNA, 10 nt, Homo sapiens
agcacuguaa

SEQ ID NO: 1725630 - RNA, 21 nt, Homo sapiens
agcagcucuucuggcuguguu

SEQ ID NO: 1725631 - RNA, 16 nt, Homo sapiens
agccauugagugcagc

SEQ ID NO: 1725632 - RNA, 20 nt, Homo sapiens
ugcuacaguuauuaaucugg

SEQ ID NO: 1725633 - RNA, 13 nt, Homo sapiens
ugcuggacucugg

SEQ ID NO: 1725634 - RNA, 12 nt, Homo sapiens
uggaagggucaa

SEQ ID NO: 1725635 - RNA, 14 nt, Homo sapiens
uggaucagcucuuc

SEQ ID NO: 1725636 - RNA, 19 nt, Homo sapiens
uggauggugguaucaggga

SEQ ID NO: 1725637 - RNA, 14 nt, Homo sapiens
uggccugcacuggu

SEQ ID NO: 1725638 - RNA, 18 nt, Homo sapiens
uggccuugaaaccaccuu

SEQ ID NO: 1725639 - RNA, 13 nt, Homo sapiens
ugggaagucucag

SEQ ID NO: 1725640 - RNA, 17 nt, Homo sapiens
ugggaagucucagcagc

SEQ ID NO: 1725641 - RNA, 13 nt, Homo sapiens
ugggcucagcauu

SEQ ID NO: 1725642 - RNA, 14 nt, Homo sapiens
uggguccaacacuu

SEQ ID NO: 1725643 - RNA, 23 nt, Homo sapiens
uggguucauuugugaugacauaa

SEQ ID NO: 1725644 - RNA, 12 nt, Homo sapiens
ugguuaaaucau

SEQ ID NO: 1725645 - RNA, 19 nt, Homo sapiens
uguaaaaucuauuuaugaa

SEQ ID NO: 1725646 - RNA, 18 nt, Homo sapiens
uguaauuaccacauugcc

SEQ ID NO: 1725647 - RNA, 20 nt, Homo sapiens
uguaauuuaaugcugcuaca

SEQ ID NO: 1725648 - RNA, 20 nt, Homo sapiens
uguagagauggggucucaca

SEQ ID NO: 1725649 - RNA, 19 nt, Homo sapiens
uguauuuuauauaggcauu

SEQ ID NO: 1725650 - RNA, 20 nt, Homo sapiens
ugucccggggcuccacugaa

SEQ ID NO: 1725651 - RNA, 17 nt, Homo sapiens
uguccuccaucaggggu

SEQ ID NO: 1725652 - RNA, 16 nt, Homo sapiens
ugucgggaauuuuccc

SEQ ID NO: 1725653 - RNA, 16 nt, Homo sapiens
ugucugacaaccucuu

SEQ ID NO: 1725654 - RNA, 23 nt, Homo sapiens
ugucuguuaaguuacauuuacca

SEQ ID NO: 1725655 - RNA, 13 nt, Homo sapiens
ugugaauugcugc

SEQ ID NO: 1725656 - RNA, 16 nt, Homo sapiens
ugugagccaccacguc

SEQ ID NO: 1725657 - RNA, 12 nt, Homo sapiens
uguguaaucuaa

SEQ ID NO: 1725658 - RNA, 17 nt, Homo sapiens
ugugucuagugccacac

SEQ ID NO: 1725659 - RNA, 14 nt, Homo sapiens
uguguucugucacc

SEQ ID NO: 1725660 - RNA, 14 nt, Homo sapiens
uguguugucagcac

SEQ ID NO: 1725661 - RNA, 12 nt, Homo sapiens
uguuaaguuaca

SEQ ID NO: 1725662 - RNA, 17 nt, Homo sapiens
uguuaaguuacauuuac

SEQ ID NO: 1725663 - RNA, 22 nt, Homo sapiens
uguuacauuauuccaaugauac

SEQ ID NO: 1725664 - RNA, 16 nt, Homo sapiens
uguuuucucuaagaua

SEQ ID NO: 1725665 - RNA, 23 nt, Homo sapiens
uguuuuucagauacacugugaua

SEQ ID NO: 1725666 - RNA, 15 nt, Homo sapiens
uuaaaagucauuauu

SEQ ID NO: 1725667 - RNA, 13 nt, Homo sapiens
uuaaaauucaauu

SEQ ID NO: 1725668 - RNA, 15 nt, Homo sapiens
uuaaaauucaauuag

SEQ ID NO: 1725669 - RNA, 20 nt, Homo sapiens
uuaaaucaugcaaccuuucc

SEQ ID NO: 1725670 - RNA, 16 nt, Homo sapiens
uuaacuaaaugcucau

SEQ ID NO: 1725671 - RNA, 23 nt, Homo sapiens
uuaacuuccaaggugguuuuacu

SEQ ID NO: 1725672 - RNA, 18 nt, Homo sapiens
uuaagcuucuuaacugcc

SEQ ID NO: 1725673 - RNA, 17 nt, Homo sapiens
uuaaguugaaaaguaaa

SEQ ID NO: 1725674 - RNA, 22 nt, Homo sapiens
uuaauucaccccacacuagaaa

SEQ ID NO: 1725675 - RNA, 17 nt, Homo sapiens
uuaauucagcuuuagaa

SEQ ID NO: 1725676 - RNA, 19 nt, Homo sapiens
uuacaaucagccacauucu

SEQ ID NO: 1725677 - RNA, 14 nt, Homo sapiens
uuacuaaguauuaa

SEQ ID NO: 1725678 - RNA, 15 nt, Homo sapiens
uuagguguacuguac

SEQ ID NO: 1725679 - RNA, 16 nt, Homo sapiens
uucaaucauaauaccu

SEQ ID NO: 1725680 - RNA, 19 nt, Homo sapiens
uucacuagaguucuuugaa

SEQ ID NO: 1725681 - RNA, 20 nt, Homo sapiens
uucagacuuaaagcacugau

SEQ ID NO: 1725682 - RNA, 21 nt, Homo sapiens
uucagcugacuccaguauaau

SEQ ID NO: 1725683 - RNA, 14 nt, Homo sapiens
uucauacacguaaa

SEQ ID NO: 1725684 - RNA, 21 nt, Homo sapiens
uucauacacguaaaugcagaa

SEQ ID NO: 1725685 - RNA, 15 nt, Homo sapiens
uuccagacuuugaaa

SEQ ID NO: 1725686 - RNA, 20 nt, Homo sapiens
uuccuaacuucaucauugau

SEQ ID NO: 1725687 - RNA, 12 nt, Homo sapiens
uucuagccuuuu

SEQ ID NO: 1725688 - RNA, 14 nt, Homo sapiens
uucuagccuuuuaa

SEQ ID NO: 1725689 - RNA, 20 nt, Homo sapiens
uucugagugaguuuuacucu

SEQ ID NO: 1725690 - RNA, 10 nt, Homo sapiens
uucugucacc

SEQ ID NO: 1725691 - RNA, 19 nt, Homo sapiens
uucuucacuuaaacucagc

SEQ ID NO: 1725692 - RNA, 19 nt, Homo sapiens
uugaaagaacauggucugu

SEQ ID NO: 1725693 - RNA, 21 nt, Homo sapiens
uugaaaucuuggaguuucaag

SEQ ID NO: 1725694 - RNA, 22 nt, Homo sapiens
uugaagauuuaugaugcacuua

SEQ ID NO: 1725695 - RNA, 19 nt, Homo sapiens
uugaccaauaaccuaauug

SEQ ID NO: 1725696 - RNA, 20 nt, Homo sapiens
uugcccaggcuggucucaaa

SEQ ID NO: 1725697 - RNA, 14 nt, Homo sapiens
uugcugcuuuccag

SEQ ID NO: 1725698 - RNA, 18 nt, Homo sapiens
uuggaaaccuggaacaca

SEQ ID NO: 1725699 - RNA, 13 nt, Homo sapiens
uuggugcuagaaa

SEQ ID NO: 1725700 - RNA, 20 nt, Homo sapiens
uugguuuucaucaugauuaa

SEQ ID NO: 1725701 - RNA, 22 nt, Homo sapiens
uuguagagauggggucucacag

SEQ ID NO: 1725702 - RNA, 18 nt, Homo sapiens
uuguauuuagugacaaaa

SEQ ID NO: 1725703 - RNA, 15 nt, Homo sapiens
uugucagcacuguaa

SEQ ID NO: 1725704 - RNA, 15 nt, Homo sapiens
uugugagccaccacg

SEQ ID NO: 1725705 - RNA, 19 nt, Homo sapiens
uuuaaaagaaaaaugcugu

SEQ ID NO: 1725706 - RNA, 21 nt, Homo sapiens
uuuaacaagcucagcucugcu

SEQ ID NO: 1725707 - RNA, 23 nt, Homo sapiens
uuuaauggcaauaggacauugug

SEQ ID NO: 1725708 - RNA, 19 nt, Homo sapiens
uuuaauuaaaaacuuuaaa

SEQ ID NO: 1725709 - RNA, 15 nt, Homo sapiens
uuuaucgaaguauau

SEQ ID NO: 1725710 - RNA, 19 nt, Homo sapiens
uuucagauacacugugaua

SEQ ID NO: 1725711 - RNA, 22 nt, Homo sapiens
uuucauacacguaaaugcagaa

SEQ ID NO: 1725712 - RNA, 15 nt, Homo sapiens
uuucuuagauucuga

SEQ ID NO: 1725713 - RNA, 14 nt, Homo sapiens
uuugaaacuauuaa

SEQ ID NO: 1725714 - RNA, 18 nt, Homo sapiens
uuugacauuaauuaugaa

SEQ ID NO: 1725715 - RNA, 18 nt, Homo sapiens
uuugauaguuaacauuuc

SEQ ID NO: 1725716 - RNA, 14 nt, Homo sapiens
uuugcuacauucua

SEQ ID NO: 1725717 - RNA, 15 nt, Homo sapiens
uuugcugcuuuccag

SEQ ID NO: 1725718 - RNA, 19 nt, Homo sapiens
uuuggagcauuaacuaaau

SEQ ID NO: 1725719 - RNA, 22 nt, Homo sapiens
uuuggaugugugcuuuaauuca

SEQ ID NO: 1725720 - RNA, 13 nt, Homo sapiens
uuuguaaugcugc

SEQ ID NO: 1725721 - RNA, 16 nt, Homo sapiens
uuuguaaugcugcaca

SEQ ID NO: 1725722 - RNA, 21 nt, Homo sapiens
uuugucccccgggcccaccac

SEQ ID NO: 1725723 - RNA, 22 nt, Homo sapiens
uuugucccggggcuccacugaa

SEQ ID NO: 1725724 - RNA, 12 nt, Homo sapiens
uuuguugcccag

SEQ ID NO: 1725725 - RNA, 11 nt, Homo sapiens
uuuuaugcugg

SEQ ID NO: 1725726 - RNA, 21 nt, Homo sapiens
uuuucaaucauaauaccugcu

SEQ ID NO: 1725727 - RNA, 19 nt, Homo sapiens
uuuucagauacacugugau

SEQ ID NO: 1725728 - RNA, 14 nt, Homo sapiens
uuuucucaauugua

SEQ ID NO: 1725729 - RNA, 17 nt, Homo sapiens
uuuugggaagucucagc

SEQ ID NO: 1725730 - RNA, 14 nt, Homo sapiens
aaaacacugccugc

SEQ ID NO: 1725731 - RNA, 16 nt, Homo sapiens
aaaaggaugugaaaau

SEQ ID NO: 1725732 - RNA, 17 nt, Homo sapiens
aaaaguccccauccuua

SEQ ID NO: 1725733 - RNA, 12 nt, Homo sapiens
aaaauaaucuau

SEQ ID NO: 1725734 - RNA, 14 nt, Homo sapiens
aaaauauauauuaa

SEQ ID NO: 1725735 - RNA, 16 nt, Homo sapiens
aaaaugccuacacagu

SEQ ID NO: 1725736 - RNA, 22 nt, Homo sapiens
aaaaugcuuauuggacacguaa

SEQ ID NO: 1725737 - RNA, 15 nt, Homo sapiens
aaaauuaauggacac

SEQ ID NO: 1725738 - RNA, 14 nt, Homo sapiens
aaaauucagaugcu

SEQ ID NO: 1725739 - RNA, 14 nt, Homo sapiens
aaaauugacaauga

SEQ ID NO: 1725740 - RNA, 22 nt, Homo sapiens
aaaauuuaaacaugaagcacac

SEQ ID NO: 1725741 - RNA, 18 nt, Homo sapiens
aaacagcugacccaguga

SEQ ID NO: 1725742 - RNA, 18 nt, Homo sapiens
aaacuccugggcucaggc

SEQ ID NO: 1725743 - RNA, 20 nt, Homo sapiens
aaagaaggagaugaauagaa

SEQ ID NO: 1725744 - RNA, 16 nt, Homo sapiens
aaagacauucuuccca

SEQ ID NO: 1725745 - RNA, 18 nt, Homo sapiens
aaagagcuuugugauaua

SEQ ID NO: 1725746 - RNA, 12 nt, Homo sapiens
aaagagugaaug

SEQ ID NO: 1725747 - RNA, 21 nt, Homo sapiens
aaagcauauuggugcuagaaa

SEQ ID NO: 1725748 - RNA, 17 nt, Homo sapiens
aaagggagaaaugccag

SEQ ID NO: 1725749 - RNA, 14 nt, Homo sapiens
aaagguaauggacu

SEQ ID NO: 1725750 - RNA, 14 nt, Homo sapiens
aaauauaauuuaca

SEQ ID NO: 1725751 - RNA, 17 nt, Homo sapiens
aaaugcagaaauaagaa

SEQ ID NO: 1725752 - RNA, 22 nt, Homo sapiens
aaauguggaggcuaucaacaaa

SEQ ID NO: 1725753 - RNA, 21 nt, Homo sapiens
aaauguuauuaaaauauccag

SEQ ID NO: 1725754 - RNA, 22 nt, Homo sapiens
aaauuacguucuuacaagcuua

SEQ ID NO: 1725755 - RNA, 14 nt, Homo sapiens
aacaaagaaugggc

SEQ ID NO: 1725756 - RNA, 19 nt, Homo sapiens
aacacagcaacaaugacuu

SEQ ID NO: 1725757 - RNA, 14 nt, Homo sapiens
aacagacaauaauu

SEQ ID NO: 1725758 - RNA, 19 nt, Homo sapiens
aacaucuuaagauccacaa

SEQ ID NO: 1725759 - RNA, 17 nt, Homo sapiens
aacaucuuuuacauucu

SEQ ID NO: 1725760 - RNA, 23 nt, Homo sapiens
aacaugaagcacacacacaaaaa

SEQ ID NO: 1725761 - RNA, 12 nt, Homo sapiens
aacccugucuga

SEQ ID NO: 1725762 - RNA, 22 nt, Homo sapiens
aacuaauuguauuuagugacaa

SEQ ID NO: 1725763 - RNA, 22 nt, Homo sapiens
aacucuuuaaguugaaaaguaa

SEQ ID NO: 1725764 - RNA, 16 nt, Homo sapiens
aacugaaaauggaccu

SEQ ID NO: 1725765 - RNA, 16 nt, Homo sapiens
aacugacucuguuauu

SEQ ID NO: 1725766 - RNA, 17 nt, Homo sapiens
aagagcucugagucuua

SEQ ID NO: 1725767 - RNA, 12 nt, Homo sapiens
aagagcuuugua

SEQ ID NO: 1725768 - RNA, 23 nt, Homo sapiens
aagagcuuugugauauacugguu

SEQ ID NO: 1725769 - RNA, 24 nt, Homo sapiens
aagaguucuauggagacuuugcug

SEQ ID NO: 1725770 - RNA, 15 nt, Homo sapiens
aagauuuaugaugca

SEQ ID NO: 1725771 - RNA, 20 nt, Homo sapiens
aagcaguucgacaaauauac

SEQ ID NO: 1725772 - RNA, 20 nt, Homo sapiens
aagcauuccuuucucuucag

SEQ ID NO: 1725773 - RNA, 18 nt, Homo sapiens
aaggaaaaaaggaggaua

SEQ ID NO: 1725774 - RNA, 17 nt, Homo sapiens
aagguuuuuacugugag

SEQ ID NO: 1725775 - RNA, 17 nt, Homo sapiens
aaguacauuaaaacacu

SEQ ID NO: 1725776 - RNA, 18 nt, Homo sapiens
aaguauuacugaguauua

SEQ ID NO: 1725777 - RNA, 15 nt, Homo sapiens
aauaaaguuuggacu

SEQ ID NO: 1725778 - RNA, 16 nt, Homo sapiens
aauaaucaugaucaca

SEQ ID NO: 1725779 - RNA, 14 nt, Homo sapiens
aauaaucuuggcaa

SEQ ID NO: 1725780 - RNA, 16 nt, Homo sapiens
aauaauguacaucugg

SEQ ID NO: 1725781 - RNA, 18 nt, Homo sapiens
aauaggauuaaugaucau

SEQ ID NO: 1725782 - RNA, 21 nt, Homo sapiens
aauauccagugagcucuuuag

SEQ ID NO: 1725783 - RNA, 19 nt, Homo sapiens
aauauuuuguaaugcugca

SEQ ID NO: 1725784 - RNA, 18 nt, Homo sapiens
aaucaaggccagugcuaa

SEQ ID NO: 1725785 - RNA, 15 nt, Homo sapiens
aaucaaggugacuaa

SEQ ID NO: 1725786 - RNA, 18 nt, Homo sapiens
aaucaaggugacuaagaa

SEQ ID NO: 1725787 - RNA, 15 nt, Homo sapiens
aaucagccacauucu

SEQ ID NO: 1725788 - RNA, 11 nt, Homo sapiens
aauccaugcuu

SEQ ID NO: 1725789 - RNA, 18 nt, Homo sapiens
aaucuaaaaauugaacua

SEQ ID NO: 1725790 - RNA, 21 nt, Homo sapiens
aaucuuuuuugauaugauaau

SEQ ID NO: 1725791 - RNA, 16 nt, Homo sapiens
aaugaaccuucugcaa

SEQ ID NO: 1725792 - RNA, 18 nt, Homo sapiens
aaugaccaaggacugcua

SEQ ID NO: 1725793 - RNA, 22 nt, Homo sapiens
aaugauagucuuacuaaaugca

SEQ ID NO: 1725794 - RNA, 16 nt, Homo sapiens
aaugcagaaguuacua

SEQ ID NO: 1725795 - RNA, 10 nt, Homo sapiens
aaugcaguuu

SEQ ID NO: 1725796 - RNA, 22 nt, Homo sapiens
aaugcugaaauaaaaugauuaa

SEQ ID NO: 1725797 - RNA, 16 nt, Homo sapiens
aaugcuggcauuugca

SEQ ID NO: 1725798 - RNA, 20 nt, Homo sapiens
aauguaaggagccuuuccag

SEQ ID NO: 1725799 - RNA, 13 nt, Homo sapiens
aauguaguuuuaa

SEQ ID NO: 1725800 - RNA, 19 nt, Homo sapiens
aaugucauugccauacagc

SEQ ID NO: 1725801 - RNA, 15 nt, Homo sapiens
aauuaaaaacuuuaa

SEQ ID NO: 1725802 - RNA, 17 nt, Homo sapiens
aauuaauaccacuaccc

SEQ ID NO: 1725803 - RNA, 22 nt, Homo sapiens
aauuacguucuuacaagcuuaa

SEQ ID NO: 1725804 - RNA, 20 nt, Homo sapiens
aauuagguguacuguacuga

SEQ ID NO: 1725805 - RNA, 15 nt, Homo sapiens
aauucagaugcuguu

SEQ ID NO: 1725806 - RNA, 23 nt, Homo sapiens
aauuguaacgacuucuccaucuc

SEQ ID NO: 1725807 - RNA, 14 nt, Homo sapiens
aauuuaaugcugcu

SEQ ID NO: 1725808 - RNA, 20 nt, Homo sapiens
aauuuccaaaauaaucuaua

SEQ ID NO: 1725809 - RNA, 16 nt, Homo sapiens
aauuuucaauuugaga

SEQ ID NO: 1725810 - RNA, 22 nt, Homo sapiens
aauuuucauacacguaaaugca

SEQ ID NO: 1725811 - RNA, 20 nt, Homo sapiens
acaaacaugggugguaacaa

SEQ ID NO: 1725812 - RNA, 22 nt, Homo sapiens
acaaacaugggugguaacaaga

SEQ ID NO: 1725813 - RNA, 18 nt, Homo sapiens
acaaguauucuaccuaaa

SEQ ID NO: 1725814 - RNA, 18 nt, Homo sapiens
acaauaauuuaacaagcu

SEQ ID NO: 1725815 - RNA, 11 nt, Homo sapiens
acacacaaaaa

SEQ ID NO: 1725816 - RNA, 15 nt, Homo sapiens
acacuggagugaaug

SEQ ID NO: 1725817 - RNA, 17 nt, Homo sapiens
acagagugcauugugag

SEQ ID NO: 1725818 - RNA, 12 nt, Homo sapiens
acagaugcacaa

SEQ ID NO: 1725819 - RNA, 21 nt, Homo sapiens
acagccucccacccccaucuc

SEQ ID NO: 1725820 - RNA, 23 nt, Homo sapiens
acagccucccacccccaucucuc

SEQ ID NO: 1725821 - RNA, 22 nt, Homo sapiens
acauccuaccccuuugcacuug

SEQ ID NO: 1725822 - RNA, 15 nt, Homo sapiens
acaucugcauuuuca

SEQ ID NO: 1725823 - RNA, 20 nt, Homo sapiens
acaugguaaacuuuugguuu

SEQ ID NO: 1725824 - RNA, 20 nt, Homo sapiens
acauuauaaaaauugacaau

SEQ ID NO: 1725825 - RNA, 20 nt, Homo sapiens
acauucugcaagcacaucug

SEQ ID NO: 1725826 - RNA, 23 nt, Homo sapiens
acauugugucagauuaccaguua

SEQ ID NO: 1725827 - RNA, 16 nt, Homo sapiens
acauuuaaaauucaau

SEQ ID NO: 1725828 - RNA, 15 nt, Homo sapiens
acauuugguuuucau

SEQ ID NO: 1725829 - RNA, 13 nt, Homo sapiens
accaaaacacugc

SEQ ID NO: 1725830 - RNA, 23 nt, Homo sapiens
accaccaacauucuguguucaca

SEQ ID NO: 1725831 - RNA, 13 nt, Homo sapiens
accagcaccacuc

SEQ ID NO: 1725832 - RNA, 23 nt, Homo sapiens
accaucuguauguuaggugacau

SEQ ID NO: 1725833 - RNA, 15 nt, Homo sapiens
acccaguguuggucu

SEQ ID NO: 1725834 - RNA, 18 nt, Homo sapiens
accggguaagagcucuga

SEQ ID NO: 1725835 - RNA, 17 nt, Homo sapiens
accuggucaauagugau

SEQ ID NO: 1725836 - RNA, 15 nt, Homo sapiens
accuggugcuuuuaa

SEQ ID NO: 1725837 - RNA, 18 nt, Homo sapiens
acguuaguucuacauuau

SEQ ID NO: 1725838 - RNA, 17 nt, Homo sapiens
acuaaauaaacaucuga

SEQ ID NO: 1725839 - RNA, 12 nt, Homo sapiens
acuaaguauuaa

SEQ ID NO: 1725840 - RNA, 22 nt, Homo sapiens
acuauccuuccucucugugaug

SEQ ID NO: 1725841 - RNA, 21 nt, Homo sapiens
acuauguuaaugaguauguaa

SEQ ID NO: 1725842 - RNA, 21 nt, Homo sapiens
acucucaggggagaccaagaa

SEQ ID NO: 1725843 - RNA, 14 nt, Homo sapiens
acugacucuguuau

SEQ ID NO: 1725844 - RNA, 13 nt, Homo sapiens
acuggcuuugugu

SEQ ID NO: 1725845 - RNA, 23 nt, Homo sapiens
acuguauuuuauauaggcauuuc

SEQ ID NO: 1725846 - RNA, 22 nt, Homo sapiens
acuucauggucccaaaauguca

SEQ ID NO: 1725847 - RNA, 15 nt, Homo sapiens
acuuguuuuaugcuc

SEQ ID NO: 1725848 - RNA, 20 nt, Homo sapiens
acuuucccguuuuauuccag

SEQ ID NO: 1725849 - RNA, 14 nt, Homo sapiens
acuuugcaaaaaga

SEQ ID NO: 1725850 - RNA, 20 nt, Homo sapiens
agaaaaaugcuguuuauuca

SEQ ID NO: 1725851 - RNA, 10 nt, Homo sapiens
agaaagaagc

SEQ ID NO: 1725852 - RNA, 21 nt, Homo sapiens
agaaauagaggugaugcugcu

SEQ ID NO: 1725853 - RNA, 17 nt, Homo sapiens
agaaguauuuuaauuca

SEQ ID NO: 1725854 - RNA, 23 nt, Homo sapiens
agaauaaaugguuucucauuaaa

SEQ ID NO: 1725855 - RNA, 17 nt, Homo sapiens
agacaaagcauucuaaa

SEQ ID NO: 1725856 - RNA, 18 nt, Homo sapiens
agacuuaaagcacugaua

SEQ ID NO: 1725857 - RNA, 12 nt, Homo sapiens
agagagucucaa

SEQ ID NO: 1725858 - RNA, 17 nt, Homo sapiens
agagggagaguuugaaa

SEQ ID NO: 1725859 - RNA, 18 nt, Homo sapiens
agauaagucuacauuaaa

SEQ ID NO: 1725860 - RNA, 22 nt, Homo sapiens
agauaaguuugcaguuggcuaa

SEQ ID NO: 1725861 - RNA, 14 nt, Homo sapiens
agaugcacaacacu

SEQ ID NO: 1725862 - RNA, 21 nt, Homo sapiens
agauggggucucacaguguug

SEQ ID NO: 1725863 - RNA, 22 nt, Homo sapiens
agauguaagaaauguucuugca

SEQ ID NO: 1725864 - RNA, 23 nt, Homo sapiens
agauuuaagccuugacacacugu

SEQ ID NO: 1725865 - RNA, 23 nt, Homo sapiens
agcacccaguguuggucuguguc

SEQ ID NO: 1725866 - RNA, 22 nt, Homo sapiens
agcaguggcucauccuaccugu

SEQ ID NO: 1725867 - RNA, 19 nt, Homo sapiens
agcauaauuuuaguuuugu

SEQ ID NO: 1725868 - RNA, 13 nt, Homo sapiens
agcaugcuacagu

SEQ ID NO: 1725869 - RNA, 21 nt, Homo sapiens
agccuuguggugugugcgcac

SEQ ID NO: 1725870 - RNA, 11 nt, Homo sapiens
agccuuuccag

SEQ ID NO: 1725871 - RNA, 13 nt, Homo sapiens
agcuugcagugag

SEQ ID NO: 1725872 - RNA, 20 nt, Homo sapiens
agcuugccaaaucuuugugu

SEQ ID NO: 1725873 - RNA, 21 nt, Homo sapiens
aggaaauagacuuuguaugaa

SEQ ID NO: 1725874 - RNA, 18 nt, Homo sapiens
aggacgcacccccacugc

SEQ ID NO: 1725875 - RNA, 19 nt, Homo sapiens
aggacuuaaaauagucuca

SEQ ID NO: 1725876 - RNA, 18 nt, Homo sapiens
aggagaugaauagaagaa

SEQ ID NO: 1725877 - RNA, 22 nt, Homo sapiens
aggagccaccagcaccacucag

SEQ ID NO: 1725878 - RNA, 14 nt, Homo sapiens
aggagccuuuccag

SEQ ID NO: 1725879 - RNA, 22 nt, Homo sapiens
aggauuaauaaagauggcacuu

SEQ ID NO: 1725880 - RNA, 22 nt, Homo sapiens
aggcgauccaccugucucagcc

SEQ ID NO: 1725881 - RNA, 18 nt, Homo sapiens
aggcuagcuagcuguguu

SEQ ID NO: 1725882 - RNA, 20 nt, Homo sapiens
agguggugggcaaaaacaau

SEQ ID NO: 1725883 - RNA, 13 nt, Homo sapiens
agguguacuguac

SEQ ID NO: 1725884 - RNA, 21 nt, Homo sapiens
agucuguguuuaaagugaauu

SEQ ID NO: 1725885 - RNA, 13 nt, Homo sapiens
agugaaucuguau

SEQ ID NO: 1725886 - RNA, 17 nt, Homo sapiens
agugauagcuacuguag

SEQ ID NO: 1725887 - RNA, 17 nt, Homo sapiens
agugauggggaauuuau

SEQ ID NO: 1725888 - RNA, 12 nt, Homo sapiens
aguuaaggguua

SEQ ID NO: 1725889 - RNA, 16 nt, Homo sapiens
aguuauuaaucuggac

SEQ ID NO: 1725890 - RNA, 19 nt, Homo sapiens
aguucuacauuauucuuca

SEQ ID NO: 1725891 - RNA, 17 nt, Homo sapiens
aguuuguuuuaacuucc

SEQ ID NO: 1725892 - RNA, 17 nt, Homo sapiens
aguuuuuuuuuuuccag

SEQ ID NO: 1725893 - RNA, 18 nt, Homo sapiens
auaaaaauugacaaugau

SEQ ID NO: 1725894 - RNA, 23 nt, Homo sapiens
auaaaauugcaguuucauguaug

SEQ ID NO: 1725895 - RNA, 15 nt, Homo sapiens
auaaacuuucucaaa

SEQ ID NO: 1725896 - RNA, 23 nt, Homo sapiens
auaaacuuucucaaauuauuaaa

SEQ ID NO: 1725897 - RNA, 15 nt, Homo sapiens
auaagucuacauuaa

SEQ ID NO: 1725898 - RNA, 22 nt, Homo sapiens
auaaucuuggcaauuuuugaca

SEQ ID NO: 1725899 - RNA, 13 nt, Homo sapiens
auaauucagucug

SEQ ID NO: 1725900 - RNA, 14 nt, Homo sapiens
auagaaaugaucau

SEQ ID NO: 1725901 - RNA, 19 nt, Homo sapiens
auauaccuuuuugugucaa

SEQ ID NO: 1725902 - RNA, 19 nt, Homo sapiens
auauaggcauuucacaaaa

SEQ ID NO: 1725903 - RNA, 22 nt, Homo sapiens
auauauuaauaaucuuggcaau

SEQ ID NO: 1725904 - RNA, 12 nt, Homo sapiens
auauauuucaca

SEQ ID NO: 1725905 - RNA, 13 nt, Homo sapiens
auaucgaucucuu

SEQ ID NO: 1725906 - RNA, 12 nt, Homo sapiens
aucaacaaagaa

SEQ ID NO: 1725907 - RNA, 19 nt, Homo sapiens
aucacaucuaaagcuuuau

SEQ ID NO: 1725908 - RNA, 13 nt, Homo sapiens
aucacuacaagcu

SEQ ID NO: 1725909 - RNA, 13 nt, Homo sapiens
aucagaaacugaa

SEQ ID NO: 1725910 - RNA, 23 nt, Homo sapiens
aucagucaacaacuuacacuuau

SEQ ID NO: 1725911 - RNA, 13 nt, Homo sapiens
aucauagggauaa

SEQ ID NO: 1725912 - RNA, 23 nt, Homo sapiens
aucaugauuaagaugauuccuag

SEQ ID NO: 1725913 - RNA, 20 nt, Homo sapiens
auccacaaaugaagggauau

SEQ ID NO: 1725914 - RNA, 21 nt, Homo sapiens
auccuaccccuuugcacuugu

SEQ ID NO: 1725915 - RNA, 20 nt, Homo sapiens
aucucgcuaaagagugaaug

SEQ ID NO: 1725916 - RNA, 16 nt, Homo sapiens
aucucuuauuuuacaa

SEQ ID NO: 1725917 - RNA, 17 nt, Homo sapiens
aucucuuauuuuacaau

SEQ ID NO: 1725918 - RNA, 20 nt, Homo sapiens
aucuggacauucgaggaauu

SEQ ID NO: 1725919 - RNA, 13 nt, Homo sapiens
aucuguacuuugu

SEQ ID NO: 1725920 - RNA, 15 nt, Homo sapiens
aucuguacuuugugu

SEQ ID NO: 1725921 - RNA, 17 nt, Homo sapiens
aucuugaguugcagcuc

SEQ ID NO: 1725922 - RNA, 23 nt, Homo sapiens
aucuuuguguaaucuaaguauau

SEQ ID NO: 1725923 - RNA, 18 nt, Homo sapiens
aucuuuguuuaaaugcca

SEQ ID NO: 1725924 - RNA, 15 nt, Homo sapiens
augaaaggucauuaa

SEQ ID NO: 1725925 - RNA, 15 nt, Homo sapiens
augacuuaaccauau

SEQ ID NO: 1725926 - RNA, 16 nt, Homo sapiens
augagaacaguaugaa

SEQ ID NO: 1725927 - RNA, 16 nt, Homo sapiens
augcacuuauucaaua

SEQ ID NO: 1725928 - RNA, 17 nt, Homo sapiens
augcagcaucuuugugg

SEQ ID NO: 1725929 - RNA, 15 nt, Homo sapiens
augcugcacagaaau

SEQ ID NO: 1725930 - RNA, 23 nt, Homo sapiens
augcuggcauuugcaccuaccuc

SEQ ID NO: 1725931 - RNA, 18 nt, Homo sapiens
augguaggucaaguaaua

SEQ ID NO: 1725932 - RNA, 18 nt, Homo sapiens
auggugggguuguucacc

SEQ ID NO: 1725933 - RNA, 16 nt, Homo sapiens
auguaaggagccuuuc

SEQ ID NO: 1725934 - RNA, 19 nt, Homo sapiens
auguacaucuggccuugaa

SEQ ID NO: 1725935 - RNA, 19 nt, Homo sapiens
augucagacccgaacuggc

SEQ ID NO: 1725936 - RNA, 15 nt, Homo sapiens
auguuuucucuaaga

SEQ ID NO: 1725937 - RNA, 12 nt, Homo sapiens
auuaaaauaucc

SEQ ID NO: 1725938 - RNA, 21 nt, Homo sapiens
auuaaguauuacugaguauua

SEQ ID NO: 1725939 - RNA, 20 nt, Homo sapiens
auuagcucuacuggaauuuu

SEQ ID NO: 1725940 - RNA, 16 nt, Homo sapiens
auuagguguacuguac

SEQ ID NO: 1725941 - RNA, 15 nt, Homo sapiens
auuccaggagauugg

SEQ ID NO: 1725942 - RNA, 18 nt, Homo sapiens
auucugaaauacuuuuga

SEQ ID NO: 1725943 - RNA, 15 nt, Homo sapiens
auucuucauugcuug

SEQ ID NO: 1725944 - RNA, 17 nt, Homo sapiens
auugcaguuucauguau

SEQ ID NO: 1725945 - RNA, 13 nt, Homo sapiens
auuguaacgacuu

SEQ ID NO: 1725946 - RNA, 15 nt, Homo sapiens
auugugagccaccac

SEQ ID NO: 1725947 - RNA, 19 nt, Homo sapiens
auuuaaacaugaagcacac

SEQ ID NO: 1725948 - RNA, 16 nt, Homo sapiens
auuuaacuuugcaaaa

SEQ ID NO: 1725949 - RNA, 21 nt, Homo sapiens
auuuaagccuugacacacugu

SEQ ID NO: 1725950 - RNA, 12 nt, Homo sapiens
auuuacauuaau

SEQ ID NO: 1725951 - RNA, 22 nt, Homo sapiens
auuuaugaugcacuuauucaau

SEQ ID NO: 1725952 - RNA, 12 nt, Homo sapiens
auuucacaaaaa

SEQ ID NO: 1725953 - RNA, 19 nt, Homo sapiens
auuucuucagacucaaaac

SEQ ID NO: 1725954 - RNA, 19 nt, Homo sapiens
auuuguaaaugucugacuu

SEQ ID NO: 1725955 - RNA, 21 nt, Homo sapiens
auuuucaauuuggagcauuaa

SEQ ID NO: 1725956 - RNA, 19 nt, Homo sapiens
auuuuuuuguuuucaaaaa

SEQ ID NO: 1725957 - RNA, 13 nt, Homo sapiens
caaaaacagcaaa

SEQ ID NO: 1725958 - RNA, 19 nt, Homo sapiens
caaaauuguggcauuuugu

SEQ ID NO: 1725959 - RNA, 21 nt, Homo sapiens
caaacaugggugguaacaaga

SEQ ID NO: 1725960 - RNA, 14 nt, Homo sapiens
caaagaaugggcuu

SEQ ID NO: 1725961 - RNA, 20 nt, Homo sapiens
caaagaaugggcuugaaaca

SEQ ID NO: 1725962 - RNA, 17 nt, Homo sapiens
caacagguuuguucuca

SEQ ID NO: 1725963 - RNA, 18 nt, Homo sapiens
caacagguuuguucucag

SEQ ID NO: 1725964 - RNA, 22 nt, Homo sapiens
caacauucuguguucacaugug

SEQ ID NO: 1725965 - RNA, 22 nt, Homo sapiens
caagcccaguuguugcagugau

SEQ ID NO: 1725966 - RNA, 15 nt, Homo sapiens
caagcuaaucugccu

SEQ ID NO: 1725967 - RNA, 22 nt, Homo sapiens
caaggcccauaucugugaaaug

SEQ ID NO: 1725968 - RNA, 16 nt, Homo sapiens
caaguaugaaguauaa

SEQ ID NO: 1725969 - RNA, 17 nt, Homo sapiens
caauauaaaaacauuca

SEQ ID NO: 1725970 - RNA, 17 nt, Homo sapiens
caaucagccacauucua

SEQ ID NO: 1725971 - RNA, 16 nt, Homo sapiens
caauucugaugugaaa

SEQ ID NO: 1725972 - RNA, 15 nt, Homo sapiens
caauuguaacgacuu

SEQ ID NO: 1725973 - RNA, 22 nt, Homo sapiens
caauuugagauucuacaguaag

SEQ ID NO: 1725974 - RNA, 19 nt, Homo sapiens
cacaaaugaagggauauaa

SEQ ID NO: 1725975 - RNA, 20 nt, Homo sapiens
cacacccuggaggauuucau

SEQ ID NO: 1725976 - RNA, 16 nt, Homo sapiens
cacacuggagugaaug

SEQ ID NO: 1725977 - RNA, 16 nt, Homo sapiens
cacagaaauuuucaau

SEQ ID NO: 1725978 - RNA, 15 nt, Homo sapiens
cacagauuugcuaau

SEQ ID NO: 1725979 - RNA, 23 nt, Homo sapiens
cacaucaugagcugagugacugc

SEQ ID NO: 1725980 - RNA, 19 nt, Homo sapiens
caccaacugaaguggcuaa

SEQ ID NO: 1725981 - RNA, 22 nt, Homo sapiens
caccucugauuacaauucugau

SEQ ID NO: 1725982 - RNA, 17 nt, Homo sapiens
cacugacuccucacugg

SEQ ID NO: 1725983 - RNA, 21 nt, Homo sapiens
cacugccugcucuucagacuu

SEQ ID NO: 1725984 - RNA, 14 nt, Homo sapiens
cagaaaaugaauga

SEQ ID NO: 1725985 - RNA, 23 nt, Homo sapiens
cagaacaaaugaucuguuuucau

SEQ ID NO: 1725986 - RNA, 15 nt, Homo sapiens
cagauaaguuugcag

SEQ ID NO: 1725987 - RNA, 12 nt, Homo sapiens
cagaucauguuc

SEQ ID NO: 1725988 - RNA, 19 nt, Homo sapiens
cagauuaugaguuacuguu

SEQ ID NO: 1725989 - RNA, 18 nt, Homo sapiens
cagccaaacccugucuga

SEQ ID NO: 1725990 - RNA, 21 nt, Homo sapiens
cagccacauguccuccaucag

SEQ ID NO: 1725991 - RNA, 21 nt, Homo sapiens
cagcuggaagggucaacaucu

SEQ ID NO: 1725992 - RNA, 17 nt, Homo sapiens
caggaccccugcauuua

SEQ ID NO: 1725993 - RNA, 20 nt, Homo sapiens
caggacuuccauuugcuuug

SEQ ID NO: 1725994 - RNA, 13 nt, Homo sapiens
caggcuggucuca

SEQ ID NO: 1725995 - RNA, 21 nt, Homo sapiens
caguaagccauugagugcagc

SEQ ID NO: 1725996 - RNA, 19 nt, Homo sapiens
cagugcuauucugagugaa

SEQ ID NO: 1725997 - RNA, 19 nt, Homo sapiens
caguucccuccuucuuaca

SEQ ID NO: 1725998 - RNA, 20 nt, Homo sapiens
caguuguguaaauaaaauca

SEQ ID NO: 1725999 - RNA, 14 nt, Homo sapiens
cauaacuaggauua

SEQ ID NO: 1726000 - RNA, 21 nt, Homo sapiens
cauauauuuaacuuugcaaaa

SEQ ID NO: 1726001 - RNA, 15 nt, Homo sapiens
caucagucaacaacu

SEQ ID NO: 1726002 - RNA, 22 nt, Homo sapiens
cauccacaggguuuugacacuu

SEQ ID NO: 1726003 - RNA, 15 nt, Homo sapiens
cauccucucacugca

SEQ ID NO: 1726004 - RNA, 14 nt, Homo sapiens
caucucuuguauau

SEQ ID NO: 1726005 - RNA, 13 nt, Homo sapiens
caucugaucugua

SEQ ID NO: 1726006 - RNA, 18 nt, Homo sapiens
caucuuuuacauucugca

SEQ ID NO: 1726007 - RNA, 12 nt, Homo sapiens
caugaagcacac

SEQ ID NO: 1726008 - RNA, 14 nt, Homo sapiens
caugaagcacacac

SEQ ID NO: 1726009 - RNA, 23 nt, Homo sapiens
caugcaaacugcuuuauuuuccc

SEQ ID NO: 1726010 - RNA, 21 nt, Homo sapiens
cauuaaacucuaaagauuagg

SEQ ID NO: 1726011 - RNA, 23 nt, Homo sapiens
cauuaauauaauuggcacagaaa

SEQ ID NO: 1726012 - RNA, 14 nt, Homo sapiens
cauucaaauacugu

SEQ ID NO: 1726013 - RNA, 18 nt, Homo sapiens
cauucugcaagcacaucu

SEQ ID NO: 1726014 - RNA, 15 nt, Homo sapiens
cauugugaggguuaa

SEQ ID NO: 1726015 - RNA, 13 nt, Homo sapiens
cauuucacaaaaa

SEQ ID NO: 1726016 - RNA, 15 nt, Homo sapiens
cauuucacaaaaaca

SEQ ID NO: 1726017 - RNA, 14 nt, Homo sapiens
cauuuucaauuugg

SEQ ID NO: 1726018 - RNA, 14 nt, Homo sapiens
ccaaaauauauauu

SEQ ID NO: 1726019 - RNA, 19 nt, Homo sapiens
ccaacauucuguguucaca

SEQ ID NO: 1726020 - RNA, 20 nt, Homo sapiens
ccaacauucuguguucacau

SEQ ID NO: 1726021 - RNA, 22 nt, Homo sapiens
ccagcaccuauugaauuaccau

SEQ ID NO: 1726022 - RNA, 19 nt, Homo sapiens
ccagccuuauguguuacau

SEQ ID NO: 1726023 - RNA, 15 nt, Homo sapiens
ccagcuagugccaaa

SEQ ID NO: 1726024 - RNA, 15 nt, Homo sapiens
ccagcuauuuacaca

SEQ ID NO: 1726025 - RNA, 20 nt, Homo sapiens
ccaguuuacauuuaggcauu

SEQ ID NO: 1726026 - RNA, 16 nt, Homo sapiens
ccaugacucauaagcu

SEQ ID NO: 1726027 - RNA, 15 nt, Homo sapiens
ccaugugugcuaaua

SEQ ID NO: 1726028 - RNA, 11 nt, Homo sapiens
ccauugugaug

SEQ ID NO: 1726029 - RNA, 14 nt, Homo sapiens
cccaccugccacca

SEQ ID NO: 1726030 - RNA, 20 nt, Homo sapiens
cccagccaaacccugucuga

SEQ ID NO: 1726031 - RNA, 22 nt, Homo sapiens
cccagccacauguccuccauca

SEQ ID NO: 1726032 - RNA, 16 nt, Homo sapiens
cccuccccagauauca

SEQ ID NO: 1726033 - RNA, 18 nt, Homo sapiens
ccuaaaaggaaaucucac

SEQ ID NO: 1726034 - RNA, 20 nt, Homo sapiens
ccucacagagugcauuguga

SEQ ID NO: 1726035 - RNA, 15 nt, Homo sapiens
ccugggcucagcauu

SEQ ID NO: 1726036 - RNA, 22 nt, Homo sapiens
ccuuuaaaugguaagaguuucu

SEQ ID NO: 1726037 - RNA, 16 nt, Homo sapiens
cgaaugauuaaucaua

SEQ ID NO: 1726038 - RNA, 16 nt, Homo sapiens
cgcuaaagagugaaug

SEQ ID NO: 1726039 - RNA, 15 nt, Homo sapiens
cgcuuuguugcccag

SEQ ID NO: 1726040 - RNA, 17 nt, Homo sapiens
cggugcaacagaagggu

SEQ ID NO: 1726041 - RNA, 13 nt, Homo sapiens
cuaaaugaacuca

SEQ ID NO: 1726042 - RNA, 12 nt, Homo sapiens
cuaaaugcagaa

SEQ ID NO: 1726043 - RNA, 13 nt, Homo sapiens
cuaacuucaucau

SEQ ID NO: 1726044 - RNA, 18 nt, Homo sapiens
cuaagcaaauaggcaaaa

SEQ ID NO: 1726045 - RNA, 15 nt, Homo sapiens
cuacauucuaaugca

SEQ ID NO: 1726046 - RNA, 15 nt, Homo sapiens
cuaccccugaugaga

SEQ ID NO: 1726047 - RNA, 13 nt, Homo sapiens
cuaucaacaaaga

SEQ ID NO: 1726048 - RNA, 20 nt, Homo sapiens
cucaaaaauuuuagcagugu

SEQ ID NO: 1726049 - RNA, 21 nt, Homo sapiens
cucagcauucgagaucuugag

SEQ ID NO: 1726050 - RNA, 20 nt, Homo sapiens
cucagccugcacugggagca

SEQ ID NO: 1726051 - RNA, 22 nt, Homo sapiens
cucagcggcaaaauuaauggac

SEQ ID NO: 1726052 - RNA, 23 nt, Homo sapiens
cucagcggcaaaauuaauggaca

SEQ ID NO: 1726053 - RNA, 18 nt, Homo sapiens
cucauaagcuucuuguca

SEQ ID NO: 1726054 - RNA, 13 nt, Homo sapiens
cuccugggcucag

SEQ ID NO: 1726055 - RNA, 21 nt, Homo sapiens
cuccuucuuuugucuuugauu

SEQ ID NO: 1726056 - RNA, 15 nt, Homo sapiens
cucugauuacaauuc

SEQ ID NO: 1726057 - RNA, 16 nt, Homo sapiens
cucuggaccauauacc

SEQ ID NO: 1726058 - RNA, 19 nt, Homo sapiens
cucuuaaaucauuugguua

SEQ ID NO: 1726059 - RNA, 13 nt, Homo sapiens
cucuuccuguguu

SEQ ID NO: 1726060 - RNA, 16 nt, Homo sapiens
cucuucuggcuguguu

SEQ ID NO: 1726061 - RNA, 21 nt, Homo sapiens
cucuuguauaugaugaucugg

SEQ ID NO: 1726062 - RNA, 14 nt, Homo sapiens
cugaaguggcuaaa

SEQ ID NO: 1726063 - RNA, 23 nt, Homo sapiens
cugagugacugcagcuugccaaa

SEQ ID NO: 1726064 - RNA, 14 nt, Homo sapiens
cugauaggacuuaa

SEQ ID NO: 1726065 - RNA, 21 nt, Homo sapiens
cugauggcacuaacacugggu

SEQ ID NO: 1726066 - RNA, 16 nt, Homo sapiens
cugauuacaauucuga

SEQ ID NO: 1726067 - RNA, 20 nt, Homo sapiens
cugcaacagguuuguucuca

SEQ ID NO: 1726068 - RNA, 16 nt, Homo sapiens
cugcaagcacaucugc

SEQ ID NO: 1726069 - RNA, 16 nt, Homo sapiens
cugccugcucuucaga

SEQ ID NO: 1726070 - RNA, 21 nt, Homo sapiens
cuggagugauagcuacuguag

SEQ ID NO: 1726071 - RNA, 14 nt, Homo sapiens
cuggcccagccaaa

SEQ ID NO: 1726072 - RNA, 22 nt, Homo sapiens
cugggauuacaauugugagcca

SEQ ID NO: 1726073 - RNA, 17 nt, Homo sapiens
cugguuagguagaggga

SEQ ID NO: 1726074 - RNA, 23 nt, Homo sapiens
cuguaaauguuauuaaaauaucc

SEQ ID NO: 1726075 - RNA, 18 nt, Homo sapiens
cuguauguuaggugacau

SEQ ID NO: 1726076 - RNA, 21 nt, Homo sapiens
cuguauuuuauauaggcauuu

SEQ ID NO: 1726077 - RNA, 22 nt, Homo sapiens
cugugaaaugcuggcauuugca

SEQ ID NO: 1726078 - RNA, 20 nt, Homo sapiens
cuguguugucagcacuguaa

SEQ ID NO: 1726079 - RNA, 23 nt, Homo sapiens
cuguuaaccucuuaucacuaaga

SEQ ID NO: 1726080 - RNA, 20 nt, Homo sapiens
cuguugcccuacacugccuu

SEQ ID NO: 1726081 - RNA, 16 nt, Homo sapiens
cuguuuccuaacuuca

SEQ ID NO: 1726082 - RNA, 16 nt, Homo sapiens
cuguuucuuagauucu

SEQ ID NO: 1726083 - RNA, 18 nt, Homo sapiens
cuguuucuuagauucuga

SEQ ID NO: 1726084 - RNA, 22 nt, Homo sapiens
cuguuuuucagauacacuguga

SEQ ID NO: 1726085 - RNA, 15 nt, Homo sapiens
cuuacuaaaugcaga

SEQ ID NO: 1726086 - RNA, 21 nt, Homo sapiens
cuuaguucuucuccugccuaa

SEQ ID NO: 1726087 - RNA, 20 nt, Homo sapiens
cuucacuagaguucuuugaa

SEQ ID NO: 1726088 - RNA, 23 nt, Homo sapiens
cuuccaaggugguuuuacuucug

SEQ ID NO: 1726089 - RNA, 11 nt, Homo sapiens
cuuccauuugc

SEQ ID NO: 1726090 - RNA, 15 nt, Homo sapiens
cuucuccaucuccug

SEQ ID NO: 1726091 - RNA, 14 nt, Homo sapiens
cuugaaacauuaua

SEQ ID NO: 1726092 - RNA, 22 nt, Homo sapiens
cuuggcuuacugcagccuuugc

SEQ ID NO: 1726093 - RNA, 23 nt, Homo sapiens
cuuguuccccacugacagccucc

SEQ ID NO: 1726094 - RNA, 17 nt, Homo sapiens
cuuuagaaauuaauacc

SEQ ID NO: 1726095 - RNA, 13 nt, Homo sapiens
cuuuagcaugcua

SEQ ID NO: 1726096 - RNA, 15 nt, Homo sapiens
cuuucucuucagugc

SEQ ID NO: 1726097 - RNA, 18 nt, Homo sapiens
cuuucuuuagcaugcuac

SEQ ID NO: 1726098 - RNA, 14 nt, Homo sapiens
cuuugcugcuguga

SEQ ID NO: 1726099 - RNA, 16 nt, Homo sapiens
cuuuguuuaaaugcca

SEQ ID NO: 1726100 - RNA, 17 nt, Homo sapiens
cuuuguuuaaaugccaa

SEQ ID NO: 1726101 - RNA, 13 nt, Homo sapiens
cuuuuucuuugag

SEQ ID NO: 1726102 - RNA, 11 nt, Homo sapiens
gaaacuauuaa

SEQ ID NO: 1726103 - RNA, 15 nt, Homo sapiens
gaaagcaguggcuca

SEQ ID NO: 1726104 - RNA, 16 nt, Homo sapiens
gaaaguugcuuuuauu

SEQ ID NO: 1726105 - RNA, 14 nt, Homo sapiens
gaaauagacuuugu

SEQ ID NO: 1726106 - RNA, 16 nt, Homo sapiens
gaaauaugcacugcuc

SEQ ID NO: 1726107 - RNA, 21 nt, Homo sapiens
gaacuccaggucuaaacagcu

SEQ ID NO: 1726108 - RNA, 23 nt, Homo sapiens
gaaggagaugaauagaagaaaga

SEQ ID NO: 1726109 - RNA, 15 nt, Homo sapiens
gaaugauuaaucaua

SEQ ID NO: 1726110 - RNA, 21 nt, Homo sapiens
gaaugggcuugaaacauuaua

SEQ ID NO: 1726111 - RNA, 23 nt, Homo sapiens
gaauguacauacugaaaaauaca

SEQ ID NO: 1726112 - RNA, 18 nt, Homo sapiens
gacauguuggaaauguag

SEQ ID NO: 1726113 - RNA, 21 nt, Homo sapiens
gaccaauuuauccuugaccaa

SEQ ID NO: 1726114 - RNA, 18 nt, Homo sapiens
gacguuuacuagacuuug

SEQ ID NO: 1726115 - RNA, 23 nt, Homo sapiens
gacucacugacuccucacuggcu

SEQ ID NO: 1726116 - RNA, 19 nt, Homo sapiens
gacuuccauuugcuuuguc

SEQ ID NO: 1726117 - RNA, 20 nt, Homo sapiens
gacuuguuuuaugcucaggg

SEQ ID NO: 1726118 - RNA, 16 nt, Homo sapiens
gacuuugaaacuauua

SEQ ID NO: 1726119 - RNA, 13 nt, Homo sapiens
gagacugggucuc

SEQ ID NO: 1726120 - RNA, 16 nt, Homo sapiens
gaggauuucaucucuu

SEQ ID NO: 1726121 - RNA, 13 nt, Homo sapiens
gauaauuggugca

SEQ ID NO: 1726122 - RNA, 17 nt, Homo sapiens
gaugcacuuauucaaua

SEQ ID NO: 1726123 - RNA, 18 nt, Homo sapiens
gauuaccagucugauuau

SEQ ID NO: 1726124 - RNA, 13 nt, Homo sapiens
gauuccaugccau

SEQ ID NO: 1726125 - RNA, 16 nt, Homo sapiens
gauuuaugaugcacuu

SEQ ID NO: 1726126 - RNA, 22 nt, Homo sapiens
gauuuaugaugcacuuauucaa

SEQ ID NO: 1726127 - RNA, 15 nt, Homo sapiens
gcaagcacaucugca

SEQ ID NO: 1726128 - RNA, 17 nt, Homo sapiens
gcaaugacaaugaccaa

SEQ ID NO: 1726129 - RNA, 17 nt, Homo sapiens
gcacagaaauuuucaau

SEQ ID NO: 1726130 - RNA, 13 nt, Homo sapiens
gcaccuaccucac

SEQ ID NO: 1726131 - RNA, 18 nt, Homo sapiens
gcacugauaggacuuaaa

SEQ ID NO: 1726132 - RNA, 18 nt, Homo sapiens
gcacuuaauaguacauca

SEQ ID NO: 1726133 - RNA, 21 nt, Homo sapiens
gcagaggcuuugcugcuguga

SEQ ID NO: 1726134 - RNA, 23 nt, Homo sapiens
gcagaggcuuugcugcugugaau

SEQ ID NO: 1726135 - RNA, 16 nt, Homo sapiens
gcagcagugugcuguu

SEQ ID NO: 1726136 - RNA, 16 nt, Homo sapiens
gcagguagggcuugua

SEQ ID NO: 1726137 - RNA, 19 nt, Homo sapiens
gcaguccugccucagccuc

SEQ ID NO: 1726138 - RNA, 21 nt, Homo sapiens
gcauuccuuucucuucagugc

SEQ ID NO: 1726139 - RNA, 17 nt, Homo sapiens
gccaagcuaaucugccu

SEQ ID NO: 1726140 - RNA, 20 nt, Homo sapiens
gccacauguccuccaucagg

SEQ ID NO: 1726141 - RNA, 16 nt, Homo sapiens
gccacccggcacuggc

SEQ ID NO: 1726142 - RNA, 19 nt, Homo sapiens
gccacuaccccugaugaga

SEQ ID NO: 1726143 - RNA, 20 nt, Homo sapiens
gccauugagugcagcagugu

SEQ ID NO: 1726144 - RNA, 22 nt, Homo sapiens
gccauuuuggguuuugggucuu

SEQ ID NO: 1726145 - RNA, 17 nt, Homo sapiens
gcccaccacaucauccu

SEQ ID NO: 1726146 - RNA, 15 nt, Homo sapiens
gcccauggaucagcu

SEQ ID NO: 1726147 - RNA, 13 nt, Homo sapiens
gccugcaagcuuc

SEQ ID NO: 1726148 - RNA, 20 nt, Homo sapiens
gccugcucuucagacuuaaa

SEQ ID NO: 1726149 - RNA, 16 nt, Homo sapiens
gccuuguggugugugc

SEQ ID NO: 1726150 - RNA, 17 nt, Homo sapiens
gcuacaguuauuaaucu

SEQ ID NO: 1726151 - RNA, 13 nt, Homo sapiens
gcuagugccaaau

SEQ ID NO: 1726152 - RNA, 16 nt, Homo sapiens
gcucaucuaacucugu

SEQ ID NO: 1726153 - RNA, 13 nt, Homo sapiens
gcuccacugaaca

SEQ ID NO: 1726154 - RNA, 22 nt, Homo sapiens
gcucuucagacuuaaagcacug

SEQ ID NO: 1726155 - RNA, 20 nt, Homo sapiens
gcucuuuagaaggacucagu

SEQ ID NO: 1726156 - RNA, 12 nt, Homo sapiens
gcugcaacaggu

SEQ ID NO: 1726157 - RNA, 23 nt, Homo sapiens
gcugcuaaagggagaaaugccag

SEQ ID NO: 1726158 - RNA, 15 nt, Homo sapiens
gcuggcccagccaaa

SEQ ID NO: 1726159 - RNA, 14 nt, Homo sapiens
gcuguggaugcuuc

SEQ ID NO: 1726160 - RNA, 23 nt, Homo sapiens
gcuuaaugauagucuuacuaaau

SEQ ID NO: 1726161 - RNA, 11 nt, Homo sapiens
gcuugccaaau

SEQ ID NO: 1726162 - RNA, 15 nt, Homo sapiens
gcuuuaaaagucauu

SEQ ID NO: 1726163 - RNA, 17 nt, Homo sapiens
ggaagucucagcagcuc

SEQ ID NO: 1726164 - RNA, 23 nt, Homo sapiens
ggaauacaagacaaaacuuccuc

SEQ ID NO: 1726165 - RNA, 13 nt, Homo sapiens
ggaauacugucuc

SEQ ID NO: 1726166 - RNA, 16 nt, Homo sapiens
ggagguauucaguuga

SEQ ID NO: 1726167 - RNA, 16 nt, Homo sapiens
ggaguaggacauacca

SEQ ID NO: 1726168 - RNA, 18 nt, Homo sapiens
ggcaaacuuuucuuucuu

SEQ ID NO: 1726169 - RNA, 15 nt, Homo sapiens
ggcauuuugugaggc

SEQ ID NO: 1726170 - RNA, 17 nt, Homo sapiens
ggcgagcagccacuggc

SEQ ID NO: 1726171 - RNA, 21 nt, Homo sapiens
ggcucaucuaacucuguccuu

SEQ ID NO: 1726172 - RNA, 15 nt, Homo sapiens
ggcuuuaaaagucau

SEQ ID NO: 1726173 - RNA, 13 nt, Homo sapiens
gggucaacaucuu

SEQ ID NO: 1726174 - RNA, 19 nt, Homo sapiens
gggucucgcuuuguugccc

SEQ ID NO: 1726175 - RNA, 17 nt, Homo sapiens
gguaauucuagccuuuu

SEQ ID NO: 1726176 - RNA, 16 nt, Homo sapiens
gguacugagcagccac

SEQ ID NO: 1726177 - RNA, 19 nt, Homo sapiens
ggucuaaacagcugaccca

SEQ ID NO: 1726178 - RNA, 20 nt, Homo sapiens
ggucucgcuuuguugcccag

SEQ ID NO: 1726179 - RNA, 16 nt, Homo sapiens
gguguacuguacugaa

SEQ ID NO: 1726180 - RNA, 19 nt, Homo sapiens
gguuccuuuugcaugccuc

SEQ ID NO: 1726181 - RNA, 23 nt, Homo sapiens
gguuuccgaaggguuuugcuaca

SEQ ID NO: 1726182 - RNA, 21 nt, Homo sapiens
guaaauuaguuugacacugcu

SEQ ID NO: 1726183 - RNA, 14 nt, Homo sapiens
guaaggagccuuuc

SEQ ID NO: 1726184 - RNA, 15 nt, Homo sapiens
guaaucuaaguauau

SEQ ID NO: 1726185 - RNA, 17 nt, Homo sapiens
guaaugcugcacagaaa

SEQ ID NO: 1726186 - RNA, 18 nt, Homo sapiens
guaauucuagccuuuuaa

SEQ ID NO: 1726187 - RNA, 16 nt, Homo sapiens
guacaggaaugaaccu

SEQ ID NO: 1726188 - RNA, 19 nt, Homo sapiens
guacaggaaugaaccuucu

SEQ ID NO: 1726189 - RNA, 22 nt, Homo sapiens
guagcugugucauguauauacc

SEQ ID NO: 1726190 - RNA, 17 nt, Homo sapiens
guaguuuaaaacaucag

SEQ ID NO: 1726191 - RNA, 20 nt, Homo sapiens
guauuuaacuacaucugccu

SEQ ID NO: 1726192 - RNA, 22 nt, Homo sapiens
gucaaaauugguagugucuguu

SEQ ID NO: 1726193 - RNA, 18 nt, Homo sapiens
gucuauagaaaugaucau

SEQ ID NO: 1726194 - RNA, 13 nt, Homo sapiens
gucucgcuuuguu

SEQ ID NO: 1726195 - RNA, 17 nt, Homo sapiens
gucucgcuuuguugccc

SEQ ID NO: 1726196 - RNA, 20 nt, Homo sapiens
gucuguguuuaaagugaauu

SEQ ID NO: 1726197 - RNA, 18 nt, Homo sapiens
gucuuacuaaaugcagaa

SEQ ID NO: 1726198 - RNA, 20 nt, Homo sapiens
gugaaaugcuggcauuugca

SEQ ID NO: 1726199 - RNA, 22 nt, Homo sapiens
gugaaucccaccugccaccagc

SEQ ID NO: 1726200 - RNA, 19 nt, Homo sapiens
gugauauacugguucacau

SEQ ID NO: 1726201 - RNA, 14 nt, Homo sapiens
gugggguuguucac

SEQ ID NO: 1726202 - RNA, 18 nt, Homo sapiens
guggucuuacaauggaca

SEQ ID NO: 1726203 - RNA, 12 nt, Homo sapiens
guguccaucagu

SEQ ID NO: 1726204 - RNA, 16 nt, Homo sapiens
guuaacauuucuuugu

SEQ ID NO: 1726205 - RNA, 17 nt, Homo sapiens
guuacuuagaaugccau

SEQ ID NO: 1726206 - RNA, 22 nt, Homo sapiens
guuauaauacgcugcugaucua

SEQ ID NO: 1726207 - RNA, 20 nt, Homo sapiens
guucaccucuguacagacca

SEQ ID NO: 1726208 - RNA, 13 nt, Homo sapiens
guuccccacugac

SEQ ID NO: 1726209 - RNA, 20 nt, Homo sapiens
guuccccacugacagccucc

SEQ ID NO: 1726210 - RNA, 17 nt, Homo sapiens
guugcaggagcuggcug

SEQ ID NO: 1726211 - RNA, 20 nt, Homo sapiens
guuugcaguuggcuaagaga

SEQ ID NO: 1726212 - RNA, 22 nt, Homo sapiens
guuuuacuucugauagccggug

SEQ ID NO: 1726213 - RNA, 15 nt, Homo sapiens
guuuugcuacauucu

SEQ ID NO: 1726214 - RNA, 13 nt, Homo sapiens
guuuuuacuguga

SEQ ID NO: 1726215 - RNA, 19 nt, Homo sapiens
uaaaaaugccuacacagua

SEQ ID NO: 1726216 - RNA, 19 nt, Homo sapiens
uaaaauucagaugcuguua

SEQ ID NO: 1726217 - RNA, 17 nt, Homo sapiens
uaaaauugcaguuucau

SEQ ID NO: 1726218 - RNA, 18 nt, Homo sapiens
uaaagagcuuugugauau

SEQ ID NO: 1726219 - RNA, 19 nt, Homo sapiens
uaaagcauauuggugcuag

SEQ ID NO: 1726220 - RNA, 16 nt, Homo sapiens
uaaagcuugauuugau

SEQ ID NO: 1726221 - RNA, 16 nt, Homo sapiens
uaaauaaaaucaugua

SEQ ID NO: 1726222 - RNA, 21 nt, Homo sapiens
uaaauaaacaucugaucugua

SEQ ID NO: 1726223 - RNA, 19 nt, Homo sapiens
uaacauuucuuugugaaag

SEQ ID NO: 1726224 - RNA, 23 nt, Homo sapiens
uaacauuucuuugugaaagguaa

SEQ ID NO: 1726225 - RNA, 19 nt, Homo sapiens
uaacgacuucuccaucucc

SEQ ID NO: 1726226 - RNA, 16 nt, Homo sapiens
uaacuaaaugcucaua

SEQ ID NO: 1726227 - RNA, 15 nt, Homo sapiens
uaacuacaucugccu

SEQ ID NO: 1726228 - RNA, 14 nt, Homo sapiens
uaacucuguccuua

SEQ ID NO: 1726229 - RNA, 20 nt, Homo sapiens
uaacuucaaggcccauaucu

SEQ ID NO: 1726230 - RNA, 22 nt, Homo sapiens
uaacuuugcaaaaagauuuacu

SEQ ID NO: 1726231 - RNA, 13 nt, Homo sapiens
uaagauccacaaa

SEQ ID NO: 1726232 - RNA, 14 nt, Homo sapiens
uaagauccacaaau

SEQ ID NO: 1726233 - RNA, 20 nt, Homo sapiens
uaaggguuaguuuacaauca

SEQ ID NO: 1726234 - RNA, 20 nt, Homo sapiens
uaaguuugaaacuaacucau

SEQ ID NO: 1726235 - RNA, 22 nt, Homo sapiens
uaauaccacuacccgugaauua

SEQ ID NO: 1726236 - RNA, 14 nt, Homo sapiens
uaaucaugcucaug

SEQ ID NO: 1726237 - RNA, 18 nt, Homo sapiens
uaaucuccucugcucauu

SEQ ID NO: 1726238 - RNA, 17 nt, Homo sapiens
uaaugaguauguaaaac

SEQ ID NO: 1726239 - RNA, 14 nt, Homo sapiens
uaaugauagucuua

SEQ ID NO: 1726240 - RNA, 13 nt, Homo sapiens
uaauuuacauuaa

SEQ ID NO: 1726241 - RNA, 14 nt, Homo sapiens
uacaaauaucuaua

SEQ ID NO: 1726242 - RNA, 20 nt, Homo sapiens
uacaagcuuaaagcuugauu

SEQ ID NO: 1726243 - RNA, 19 nt, Homo sapiens
uacaaucagccacauucua

SEQ ID NO: 1726244 - RNA, 20 nt, Homo sapiens
uacaaucagccacauucuag

SEQ ID NO: 1726245 - RNA, 15 nt, Homo sapiens
uacacguaaaugcag

SEQ ID NO: 1726246 - RNA, 17 nt, Homo sapiens
uacacguaaaugcagaa

SEQ ID NO: 1726247 - RNA, 22 nt, Homo sapiens
uacagcuucacuagaguucuuu

SEQ ID NO: 1726248 - RNA, 23 nt, Homo sapiens
uacaucagauuagagagucucaa

SEQ ID NO: 1726249 - RNA, 11 nt, Homo sapiens
uacaucuggcc

SEQ ID NO: 1726250 - RNA, 14 nt, Homo sapiens
uacccuauacaucc

SEQ ID NO: 1726251 - RNA, 16 nt, Homo sapiens
uacccuauacauccac

SEQ ID NO: 1726252 - RNA, 15 nt, Homo sapiens
uaccuacaucaguca

SEQ ID NO: 1726253 - RNA, 19 nt, Homo sapiens
uaccucacagagugcauug

SEQ ID NO: 1726254 - RNA, 18 nt, Homo sapiens
uacuaaauaaacaucuga

SEQ ID NO: 1726255 - RNA, 21 nt, Homo sapiens
uagaacguuuccgcugcagua

SEQ ID NO: 1726256 - RNA, 18 nt, Homo sapiens
uagacuuuguaugaacuc

SEQ ID NO: 1726257 - RNA, 17 nt, Homo sapiens
uagagccugugugaaag

SEQ ID NO: 1726258 - RNA, 15 nt, Homo sapiens
uagcagacaugccac

SEQ ID NO: 1726259 - RNA, 12 nt, Homo sapiens
uagcuacuguag

SEQ ID NO: 1726260 - RNA, 14 nt, Homo sapiens
uagcuacuguagaa

SEQ ID NO: 1726261 - RNA, 14 nt, Homo sapiens
uagcuuaguucuuc

SEQ ID NO: 1726262 - RNA, 22 nt, Homo sapiens
uaggauaagauuccaguauugu

SEQ ID NO: 1726263 - RNA, 17 nt, Homo sapiens
uaggcauuucacaaaaa

SEQ ID NO: 1726264 - RNA, 20 nt, Homo sapiens
uagguaggggcccacuucac

SEQ ID NO: 1726265 - RNA, 14 nt, Homo sapiens
uagguguacuguac

SEQ ID NO: 1726266 - RNA, 12 nt, Homo sapiens
uaguaaagcaaa

SEQ ID NO: 1726267 - RNA, 20 nt, Homo sapiens
uaguagaaagacaucugccu

SEQ ID NO: 1726268 - RNA, 15 nt, Homo sapiens
uaguguauaugcuaa

SEQ ID NO: 1726269 - RNA, 14 nt, Homo sapiens
uaguucuacauuau

SEQ ID NO: 1726270 - RNA, 14 nt, Homo sapiens
uaguuugacacugc

SEQ ID NO: 1726271 - RNA, 15 nt, Homo sapiens
uauaagguaauguag

SEQ ID NO: 1726272 - RNA, 20 nt, Homo sapiens
uauacugguucacauccuac

SEQ ID NO: 1726273 - RNA, 15 nt, Homo sapiens
uauaggaacaauucu

SEQ ID NO: 1726274 - RNA, 19 nt, Homo sapiens
uauaggcauuucacaaaaa

SEQ ID NO: 1726275 - RNA, 21 nt, Homo sapiens
uauaggcauuucacaaaaaca

SEQ ID NO: 1726276 - RNA, 14 nt, Homo sapiens
uauaucgaucucuu

SEQ ID NO: 1726277 - RNA, 22 nt, Homo sapiens
uaucugugaaaugcuggcauuu

SEQ ID NO: 1726278 - RNA, 12 nt, Homo sapiens
uaugaugcacuu

SEQ ID NO: 1726279 - RNA, 13 nt, Homo sapiens
uaugaugcacuua

SEQ ID NO: 1726280 - RNA, 18 nt, Homo sapiens
uaugugagaaaucagaau

SEQ ID NO: 1726281 - RNA, 19 nt, Homo sapiens
uauugaaaguugcuuuuau

SEQ ID NO: 1726282 - RNA, 17 nt, Homo sapiens
uauuuuguaaugcugca

SEQ ID NO: 1726283 - RNA, 14 nt, Homo sapiens
ucaaauacuguauu

SEQ ID NO: 1726284 - RNA, 19 nt, Homo sapiens
ucaacaucuuuuacauucu

SEQ ID NO: 1726285 - RNA, 21 nt, Homo sapiens
ucaaucauaauaccugcugug

SEQ ID NO: 1726286 - RNA, 22 nt, Homo sapiens
ucacaaggggaagaaacaugcu

SEQ ID NO: 1726287 - RNA, 18 nt, Homo sapiens
ucacagagugcauuguga

SEQ ID NO: 1726288 - RNA, 14 nt, Homo sapiens
ucacgaaugauuaa

SEQ ID NO: 1726289 - RNA, 23 nt, Homo sapiens
ucagaugcuguuaguaccuacau

SEQ ID NO: 1726290 - RNA, 23 nt, Homo sapiens
ucagauuaccaguuauaggaaca

SEQ ID NO: 1726291 - RNA, 11 nt, Homo sapiens
ucagcacugua

SEQ ID NO: 1726292 - RNA, 18 nt, Homo sapiens
ucagcuuuagaaauuaau

SEQ ID NO: 1726293 - RNA, 23 nt, Homo sapiens
ucagggaaacuaauuguauuuag

SEQ ID NO: 1726294 - RNA, 19 nt, Homo sapiens
ucaguauuuuccagccuua

SEQ ID NO: 1726295 - RNA, 14 nt, Homo sapiens
ucagucaacaacuu

SEQ ID NO: 1726296 - RNA, 13 nt, Homo sapiens
ucagugcccagca

SEQ ID NO: 1726297 - RNA, 22 nt, Homo sapiens
ucaguucccuccuucuuacaga

SEQ ID NO: 1726298 - RNA, 15 nt, Homo sapiens
ucauuuuuaggcaug

SEQ ID NO: 1726299 - RNA, 22 nt, Homo sapiens
uccaaaugauaguguauaugcu

SEQ ID NO: 1726300 - RNA, 16 nt, Homo sapiens
uccaagauauccaaau

SEQ ID NO: 1726301 - RNA, 23 nt, Homo sapiens
uccacuucuuguuccccacugac

SEQ ID NO: 1726302 - RNA, 13 nt, Homo sapiens
uccagacuuugaa

SEQ ID NO: 1726303 - RNA, 21 nt, Homo sapiens
uccagaguuguuguuugccaa

SEQ ID NO: 1726304 - RNA, 19 nt, Homo sapiens
uccaggucuaaacagcuga

SEQ ID NO: 1726305 - RNA, 23 nt, Homo sapiens
uccaguuauaagcguauuuagac

SEQ ID NO: 1726306 - RNA, 18 nt, Homo sapiens
ucccacccccaucucucc

SEQ ID NO: 1726307 - RNA, 18 nt, Homo sapiens
ucccggggcuccacugaa

SEQ ID NO: 1726308 - RNA, 16 nt, Homo sapiens
ucccuccccugccauu

SEQ ID NO: 1726309 - RNA, 13 nt, Homo sapiens
uccuccagucuug

SEQ ID NO: 1726310 - RNA, 12 nt, Homo sapiens
uccuguguuugu

SEQ ID NO: 1726311 - RNA, 18 nt, Homo sapiens
uccuuccucucugugaug

SEQ ID NO: 1726312 - RNA, 20 nt, Homo sapiens
uccuugaccaauaaccuaau

SEQ ID NO: 1726313 - RNA, 20 nt, Homo sapiens
ucggauuaccaaaacacugc

SEQ ID NO: 1726314 - RNA, 18 nt, Homo sapiens
ucuaaaaggaugugaaaa

SEQ ID NO: 1726315 - RNA, 15 nt, Homo sapiens
ucuaccuaaaucuuc

SEQ ID NO: 1726316 - RNA, 22 nt, Homo sapiens
ucuagguaggggcccacuucac

SEQ ID NO: 1726317 - RNA, 22 nt, Homo sapiens
ucuauagaaaugaucauugcau

SEQ ID NO: 1726318 - RNA, 12 nt, Homo sapiens
ucucgcuuuguu

SEQ ID NO: 1726319 - RNA, 13 nt, Homo sapiens
ucugaugugaaaa

SEQ ID NO: 1726320 - RNA, 22 nt, Homo sapiens
ucuggcuguguugucagcacug

SEQ ID NO: 1726321 - RNA, 14 nt, Homo sapiens
ucuguaauguaggc

SEQ ID NO: 1726322 - RNA, 18 nt, Homo sapiens
ucugucaccaacugaagu

SEQ ID NO: 1726323 - RNA, 23 nt, Homo sapiens
ucugucaccaacugaaguggcua

SEQ ID NO: 1726324 - RNA, 23 nt, Homo sapiens
ucuuagucuauagaaaugaucau

SEQ ID NO: 1726325 - RNA, 14 nt, Homo sapiens
ucuucagacuuaaa

SEQ ID NO: 1726326 - RNA, 19 nt, Homo sapiens
ucuuuagaaggacucagua

SEQ ID NO: 1726327 - RNA, 17 nt, Homo sapiens
ucuuuagcaugcuacag

SEQ ID NO: 1726328 - RNA, 23 nt, Homo sapiens
ugaaaaaagguuguguagcugug

SEQ ID NO: 1726329 - RNA, 16 nt, Homo sapiens
ugaaaggcccauggau

SEQ ID NO: 1726330 - RNA, 15 nt, Homo sapiens
ugaaaugcuggcauu

SEQ ID NO: 1726331 - RNA, 16 nt, Homo sapiens
ugaaaugcuggcauuu

SEQ ID NO: 1726332 - RNA, 19 nt, Homo sapiens
ugaaaugcuggcauuugca

SEQ ID NO: 1726333 - RNA, 22 nt, Homo sapiens
ugaacuaccuauaguagucugu

SEQ ID NO: 1726334 - RNA, 19 nt, Homo sapiens
ugaagauuuaugaugcacu

SEQ ID NO: 1726335 - RNA, 22 nt, Homo sapiens
ugaaguuuugguucuucagugc

SEQ ID NO: 1726336 - RNA, 22 nt, Homo sapiens
ugaauaaacugaaaauggaccu

SEQ ID NO: 1726337 - RNA, 18 nt, Homo sapiens
ugaauguaauagucuugc

SEQ ID NO: 1726338 - RNA, 12 nt, Homo sapiens
ugacaaccucuu

SEQ ID NO: 1726339 - RNA, 19 nt, Homo sapiens
ugacagcagaggcuuugcu

SEQ ID NO: 1726340 - RNA, 12 nt, Homo sapiens
ugacagccuccc

SEQ ID NO: 1726341 - RNA, 17 nt, Homo sapiens
ugacuaagaaaaucagu

SEQ ID NO: 1726342 - RNA, 15 nt, Homo sapiens
ugaggguuaaugaaa

SEQ ID NO: 1726343 - RNA, 19 nt, Homo sapiens
ugaguauggcuaucuauac

SEQ ID NO: 1726344 - RNA, 17 nt, Homo sapiens
ugagucuuagugguuaa

SEQ ID NO: 1726345 - RNA, 12 nt, Homo sapiens
ugaguuacuuag

SEQ ID NO: 1726346 - RNA, 19 nt, Homo sapiens
ugauacccaacaguuuauu

SEQ ID NO: 1726347 - RNA, 22 nt, Homo sapiens
ugauaggacuuaaaauagucuc

SEQ ID NO: 1726348 - RNA, 22 nt, Homo sapiens
ugauagucuuacuaaaugcaga

SEQ ID NO: 1726349 - RNA, 21 nt, Homo sapiens
ugaucacaucuaaagcuuuau

SEQ ID NO: 1726350 - RNA, 22 nt, Homo sapiens
ugaucacaucuaaagcuuuauc

SEQ ID NO: 1726351 - RNA, 23 nt, Homo sapiens
ugauucaguucccuccuucuuac

SEQ ID NO: 1726352 - RNA, 15 nt, Homo sapiens
ugcaaacugcuuuau

SEQ ID NO: 1726353 - RNA, 20 nt, Homo sapiens
ugcaacagaaggguagguua

SEQ ID NO: 1726354 - RNA, 23 nt, Homo sapiens
ugcaagaaggccaauugccuaaa

SEQ ID NO: 1726355 - RNA, 15 nt, Homo sapiens
ugcaagcacaucugc

SEQ ID NO: 1726356 - RNA, 19 nt, Homo sapiens
ugcaagcacaucugcauuu

SEQ ID NO: 1726357 - RNA, 15 nt, Homo sapiens
ugcacuuauucaaua

SEQ ID NO: 1726358 - RNA, 17 nt, Homo sapiens
ugcagccuuugccuccc

SEQ ID NO: 1726359 - RNA, 15 nt, Homo sapiens
ugcaguuucauguau

SEQ ID NO: 1726360 - RNA, 20 nt, Homo sapiens
ugcccaggcuggaguggagu

SEQ ID NO: 1726361 - RNA, 17 nt, Homo sapiens
ugcccaggcuggucuca

SEQ ID NO: 1726362 - RNA, 16 nt, Homo sapiens
ugcccuacacugccuu

SEQ ID NO: 1726363 - RNA, 13 nt, Homo sapiens
ugccugguuuuau

SEQ ID NO: 1726364 - RNA, 18 nt, Homo sapiens
ugcuacauucuaaugcau

SEQ ID NO: 1726365 - RNA, 13 nt, Homo sapiens
ugcuggcauuugc

SEQ ID NO: 1726366 - RNA, 15 nt, Homo sapiens
ugcuggcauuugcac

SEQ ID NO: 1726367 - RNA, 18 nt, Homo sapiens
ugcuuaaugauagucuua

SEQ ID NO: 1726368 - RNA, 15 nt, Homo sapiens
ugcuuccauuaaaag

SEQ ID NO: 1726369 - RNA, 12 nt, Homo sapiens
ugcuuguucccu

SEQ ID NO: 1726370 - RNA, 18 nt, Homo sapiens
ugcuuuaauucagcuuua

SEQ ID NO: 1726371 - RNA, 22 nt, Homo sapiens
ugcuuuauuuucccuacuugca

SEQ ID NO: 1726372 - RNA, 16 nt, Homo sapiens
ugcuuuccagacuuug

SEQ ID NO: 1726373 - RNA, 19 nt, Homo sapiens
uggaauuuucauacacgua

SEQ ID NO: 1726374 - RNA, 17 nt, Homo sapiens
uggacucacaaggggaa

SEQ ID NO: 1726375 - RNA, 16 nt, Homo sapiens
uggagcaaauguccua

SEQ ID NO: 1726376 - RNA, 20 nt, Homo sapiens
ugggguuguucaccucugua

SEQ ID NO: 1726377 - RNA, 20 nt, Homo sapiens
uggguuuugggucuuugaac

SEQ ID NO: 1726378 - RNA, 20 nt, Homo sapiens
ugguaguuuaaaacaucaga

SEQ ID NO: 1726379 - RNA, 15 nt, Homo sapiens
uggugggcaaaaaca

SEQ ID NO: 1726380 - RNA, 15 nt, Homo sapiens
uggugguaucaggga

SEQ ID NO: 1726381 - RNA, 12 nt, Homo sapiens
ugguuaaaguau

SEQ ID NO: 1726382 - RNA, 14 nt, Homo sapiens
ugguuacagcauaa

SEQ ID NO: 1726383 - RNA, 15 nt, Homo sapiens
ugguuuuacuucuga

SEQ ID NO: 1726384 - RNA, 20 nt, Homo sapiens
ugguuuucagauaugcuuaa

SEQ ID NO: 1726385 - RNA, 15 nt, Homo sapiens
uguagcugugucaug

SEQ ID NO: 1726386 - RNA, 12 nt, Homo sapiens
uguauuuaguga

SEQ ID NO: 1726387 - RNA, 18 nt, Homo sapiens
uguauuuuacaagucaaa

SEQ ID NO: 1726388 - RNA, 17 nt, Homo sapiens
ugucagauuaccaguua

SEQ ID NO: 1726389 - RNA, 14 nt, Homo sapiens
ugucucagccuccc

SEQ ID NO: 1726390 - RNA, 14 nt, Homo sapiens
ugucugacaaccuc

SEQ ID NO: 1726391 - RNA, 21 nt, Homo sapiens
ugugaaaaagaugguguuugg

SEQ ID NO: 1726392 - RNA, 17 nt, Homo sapiens
ugugaauugcugcaaca

SEQ ID NO: 1726393 - RNA, 20 nt, Homo sapiens
uguggaggcuaucaacaaag

SEQ ID NO: 1726394 - RNA, 17 nt, Homo sapiens
uguggucuuacaaugga

SEQ ID NO: 1726395 - RNA, 17 nt, Homo sapiens
uguguaaucuaaguaua

SEQ ID NO: 1726396 - RNA, 13 nt, Homo sapiens
ugugucauguaua

SEQ ID NO: 1726397 - RNA, 13 nt, Homo sapiens
uguguucugucac

SEQ ID NO: 1726398 - RNA, 18 nt, Homo sapiens
uguguucugucaccaacu

SEQ ID NO: 1726399 - RNA, 14 nt, Homo sapiens
uguuccccacugac

SEQ ID NO: 1726400 - RNA, 19 nt, Homo sapiens
uguuggaaauguaguauag

SEQ ID NO: 1726401 - RNA, 13 nt, Homo sapiens
uguuggucugugu

SEQ ID NO: 1726402 - RNA, 16 nt, Homo sapiens
uguugucagcacugua

SEQ ID NO: 1726403 - RNA, 14 nt, Homo sapiens
uuaaguagggauaa

SEQ ID NO: 1726404 - RNA, 21 nt, Homo sapiens
uuaaguauuacugaguauuaa

SEQ ID NO: 1726405 - RNA, 22 nt, Homo sapiens
uuaaguuugaaacuaacucaua

SEQ ID NO: 1726406 - RNA, 21 nt, Homo sapiens
uuaauacauaguguauuuugc

SEQ ID NO: 1726407 - RNA, 14 nt, Homo sapiens
uuaaugcugcuaca

SEQ ID NO: 1726408 - RNA, 14 nt, Homo sapiens
uuacuagacuuuga

SEQ ID NO: 1726409 - RNA, 14 nt, Homo sapiens
uuagagagucucaa

SEQ ID NO: 1726410 - RNA, 17 nt, Homo sapiens
uuagcaugcuacaguua

SEQ ID NO: 1726411 - RNA, 21 nt, Homo sapiens
uuauauaggcauuucacaaaa

SEQ ID NO: 1726412 - RNA, 17 nt, Homo sapiens
uuauuacauggggucua

SEQ ID NO: 1726413 - RNA, 19 nt, Homo sapiens
uuauuacauggggucuaga

SEQ ID NO: 1726414 - RNA, 12 nt, Homo sapiens
uuauuagcucua

SEQ ID NO: 1726415 - RNA, 19 nt, Homo sapiens
uucagacuuaaagcacuga

SEQ ID NO: 1726416 - RNA, 16 nt, Homo sapiens
uucauuuuuaggcaug

SEQ ID NO: 1726417 - RNA, 14 nt, Homo sapiens
uuccagacuuugaa

SEQ ID NO: 1726418 - RNA, 22 nt, Homo sapiens
uuccagacuuugaaacuauuaa

SEQ ID NO: 1726419 - RNA, 15 nt, Homo sapiens
uucuaaagcuaguaa

SEQ ID NO: 1726420 - RNA, 22 nt, Homo sapiens
uucuacauuauucuucacuuaa

SEQ ID NO: 1726421 - RNA, 17 nt, Homo sapiens
uucuagguaggggccca

SEQ ID NO: 1726422 - RNA, 16 nt, Homo sapiens
uucugauagccgguga

SEQ ID NO: 1726423 - RNA, 22 nt, Homo sapiens
uucugcaacaucuuaagaucca

SEQ ID NO: 1726424 - RNA, 17 nt, Homo sapiens
uugaaauuaaagcugcc

SEQ ID NO: 1726425 - RNA, 11 nt, Homo sapiens
uugacaaugau

SEQ ID NO: 1726426 - RNA, 13 nt, Homo sapiens
uugaggccaaaca

SEQ ID NO: 1726427 - RNA, 22 nt, Homo sapiens
uugcaaauauugguuaguauuu

SEQ ID NO: 1726428 - RNA, 14 nt, Homo sapiens
uugcuguuuacucc

SEQ ID NO: 1726429 - RNA, 20 nt, Homo sapiens
uugcuuccugauuaccaguc

SEQ ID NO: 1726430 - RNA, 14 nt, Homo sapiens
uugggaagucucag

SEQ ID NO: 1726431 - RNA, 13 nt, Homo sapiens
uugggucuuugaa

SEQ ID NO: 1726432 - RNA, 22 nt, Homo sapiens
uuguaaucaaggugacuaagaa

SEQ ID NO: 1726433 - RNA, 17 nt, Homo sapiens
uuguaaugcugcacaga

SEQ ID NO: 1726434 - RNA, 14 nt, Homo sapiens
uugucagcacugua

SEQ ID NO: 1726435 - RNA, 21 nt, Homo sapiens
uugugaaagguaauggacuca

SEQ ID NO: 1726436 - RNA, 16 nt, Homo sapiens
uuguuccccacugaca

SEQ ID NO: 1726437 - RNA, 22 nt, Homo sapiens
uuuaaaaauguuucuggucuga

SEQ ID NO: 1726438 - RNA, 13 nt, Homo sapiens
uuuaaaagucauu

SEQ ID NO: 1726439 - RNA, 19 nt, Homo sapiens
uuuaaagauaagucuacau

SEQ ID NO: 1726440 - RNA, 20 nt, Homo sapiens
uuuaagccuugacacacugu

SEQ ID NO: 1726441 - RNA, 16 nt, Homo sapiens
uuuaaugcugcuacaa

SEQ ID NO: 1726442 - RNA, 23 nt, Homo sapiens
uuuacaauaaaacuuugcugcca

SEQ ID NO: 1726443 - RNA, 17 nt, Homo sapiens
uuuagagcguuugguua

SEQ ID NO: 1726444 - RNA, 16 nt, Homo sapiens
uuuauagaacguuucc

SEQ ID NO: 1726445 - RNA, 16 nt, Homo sapiens
uuuaucacuacaagcu

SEQ ID NO: 1726446 - RNA, 13 nt, Homo sapiens
uuucauagauuug

SEQ ID NO: 1726447 - RNA, 15 nt, Homo sapiens
uuugcauguuuugua

SEQ ID NO: 1726448 - RNA, 17 nt, Homo sapiens
uuugggaagucucagca

SEQ ID NO: 1726449 - RNA, 20 nt, Homo sapiens
uuugguuuucagauaugcuu

SEQ ID NO: 1726450 - RNA, 22 nt, Homo sapiens
aaaaaugcccauuuuugcuaau

SEQ ID NO: 1726451 - RNA, 14 nt, Homo sapiens
aaaacaauacuaaa

SEQ ID NO: 1726452 - RNA, 15 nt, Homo sapiens
aaaagaagaguuugu

SEQ ID NO: 1726453 - RNA, 19 nt, Homo sapiens
aaaauauaauuuacauuaa

SEQ ID NO: 1726454 - RNA, 21 nt, Homo sapiens
aaaauugcaguuucauguaug

SEQ ID NO: 1726455 - RNA, 21 nt, Homo sapiens
aaacacagcaacaaugacuua

SEQ ID NO: 1726456 - RNA, 12 nt, Homo sapiens
aaacacugccug

SEQ ID NO: 1726457 - RNA, 21 nt, Homo sapiens
aaacuaauuguauuuagugac

SEQ ID NO: 1726458 - RNA, 18 nt, Homo sapiens
aaacugcuuuauuuuccc

SEQ ID NO: 1726459 - RNA, 11 nt, Homo sapiens
aaagagugaau

SEQ ID NO: 1726460 - RNA, 13 nt, Homo sapiens
aaagguuguguag

SEQ ID NO: 1726461 - RNA, 14 nt, Homo sapiens
aaauaaacaucuga

SEQ ID NO: 1726462 - RNA, 20 nt, Homo sapiens
aaauaagaauaaacuuucuc

SEQ ID NO: 1726463 - RNA, 17 nt, Homo sapiens
aaauaaucuauauuaaa

SEQ ID NO: 1726464 - RNA, 15 nt, Homo sapiens
aaauaauuauuuucc

SEQ ID NO: 1726465 - RNA, 15 nt, Homo sapiens
aaauagucucauuca

SEQ ID NO: 1726466 - RNA, 20 nt, Homo sapiens
aaauauuuuguaaugcugca

SEQ ID NO: 1726467 - RNA, 16 nt, Homo sapiens
aaaugaagggauauaa

SEQ ID NO: 1726468 - RNA, 15 nt, Homo sapiens
aaauucagaugcugu

SEQ ID NO: 1726469 - RNA, 17 nt, Homo sapiens
aaauucagaugcuguua

SEQ ID NO: 1726470 - RNA, 19 nt, Homo sapiens
aacaaaucaucucgcuaaa

SEQ ID NO: 1726471 - RNA, 15 nt, Homo sapiens
aacaacuuacacuua

SEQ ID NO: 1726472 - RNA, 13 nt, Homo sapiens
aacaaugacuuaa

SEQ ID NO: 1726473 - RNA, 20 nt, Homo sapiens
aacacagcaacaaugacuua

SEQ ID NO: 1726474 - RNA, 19 nt, Homo sapiens
aacacugccugcucuucag

SEQ ID NO: 1726475 - RNA, 15 nt, Homo sapiens
aacacuuacuaccug

SEQ ID NO: 1726476 - RNA, 16 nt, Homo sapiens
aacagguuuguucuca

SEQ ID NO: 1726477 - RNA, 14 nt, Homo sapiens
aacauucuguguuc

SEQ ID NO: 1726478 - RNA, 16 nt, Homo sapiens
aacauucuguguucac

SEQ ID NO: 1726479 - RNA, 14 nt, Homo sapiens
aacuacaucugccu

SEQ ID NO: 1726480 - RNA, 23 nt, Homo sapiens
aacugaauucuggacagauuuaa

SEQ ID NO: 1726481 - RNA, 14 nt, Homo sapiens
aacuugacccccuu

SEQ ID NO: 1726482 - RNA, 18 nt, Homo sapiens
aacuuuuagguuguuacc

SEQ ID NO: 1726483 - RNA, 21 nt, Homo sapiens
aagaaacacagcaacaaugac

SEQ ID NO: 1726484 - RNA, 19 nt, Homo sapiens
aagaaggccaauugccuaa

SEQ ID NO: 1726485 - RNA, 15 nt, Homo sapiens
aagauggcaacugua

SEQ ID NO: 1726486 - RNA, 18 nt, Homo sapiens
aagauggcaacuguauua

SEQ ID NO: 1726487 - RNA, 14 nt, Homo sapiens
aagcauuuuuccau

SEQ ID NO: 1726488 - RNA, 17 nt, Homo sapiens
aagccuugacacacugu

SEQ ID NO: 1726489 - RNA, 11 nt, Homo sapiens
aagcuuuguga

SEQ ID NO: 1726490 - RNA, 18 nt, Homo sapiens
aaggaaauagacuuugua

SEQ ID NO: 1726491 - RNA, 22 nt, Homo sapiens
aaggaaauagacuuuguaugaa

SEQ ID NO: 1726492 - RNA, 21 nt, Homo sapiens
aaggacauuuaaaauucaauu

SEQ ID NO: 1726493 - RNA, 13 nt, Homo sapiens
aaggagaugaaua

SEQ ID NO: 1726494 - RNA, 16 nt, Homo sapiens
aaggauggaagaaaga

SEQ ID NO: 1726495 - RNA, 18 nt, Homo sapiens
aaggcccauaucugugaa

SEQ ID NO: 1726496 - RNA, 20 nt, Homo sapiens
aaggguagguuagaugcuau

SEQ ID NO: 1726497 - RNA, 13 nt, Homo sapiens
aagguccucuucu

SEQ ID NO: 1726498 - RNA, 13 nt, Homo sapiens
aaggugacuaaga

SEQ ID NO: 1726499 - RNA, 22 nt, Homo sapiens
aagguuguguagcugugucaug

SEQ ID NO: 1726500 - RNA, 17 nt, Homo sapiens
aagucucagcagcucuu

SEQ ID NO: 1726501 - RNA, 21 nt, Homo sapiens
aaguuacauuuaccaagagag

SEQ ID NO: 1726502 - RNA, 18 nt, Homo sapiens
aaguuuugguucuucagu

SEQ ID NO: 1726503 - RNA, 23 nt, Homo sapiens
aaguuuugguucuucagugcaga

SEQ ID NO: 1726504 - RNA, 14 nt, Homo sapiens
aauaaaaucaugua

SEQ ID NO: 1726505 - RNA, 18 nt, Homo sapiens
aauaaacugaaaauggac

SEQ ID NO: 1726506 - RNA, 16 nt, Homo sapiens
aauagacuuuguauga

SEQ ID NO: 1726507 - RNA, 16 nt, Homo sapiens
aauagcccauuucugu

SEQ ID NO: 1726508 - RNA, 23 nt, Homo sapiens
aauagucucauucaaauacugua

SEQ ID NO: 1726509 - RNA, 16 nt, Homo sapiens
aauauaaaaacauuca

SEQ ID NO: 1726510 - RNA, 20 nt, Homo sapiens
aauauacuuuuuuuguuaua

SEQ ID NO: 1726511 - RNA, 21 nt, Homo sapiens
aauauuuuguaaugcugcaca

SEQ ID NO: 1726512 - RNA, 15 nt, Homo sapiens
aaucuuuaacugaac

SEQ ID NO: 1726513 - RNA, 18 nt, Homo sapiens
aaucuuuaacugaacucu

SEQ ID NO: 1726514 - RNA, 22 nt, Homo sapiens
aaugaaccuucugcaacaucuu

SEQ ID NO: 1726515 - RNA, 22 nt, Homo sapiens
aaugaucacaucuaaagcuuua

SEQ ID NO: 1726516 - RNA, 15 nt, Homo sapiens
aaugaucauugcaug

SEQ ID NO: 1726517 - RNA, 15 nt, Homo sapiens
augcuggcauuugca

SEQ ID NO: 1726518 - RNA, 15 nt, Homo sapiens
auggaucagcucuuc

SEQ ID NO: 1726519 - RNA, 17 nt, Homo sapiens
auggcacuaacacuggg

SEQ ID NO: 1726520 - RNA, 18 nt, Homo sapiens
auguaaauuaguuugaca

SEQ ID NO: 1726521 - RNA, 22 nt, Homo sapiens
auguaaauuaguuugacacugc

SEQ ID NO: 1726522 - RNA, 14 nt, Homo sapiens
auuaaguauuacug

SEQ ID NO: 1726523 - RNA, 20 nt, Homo sapiens
auuaauaaagauggcacuuu

SEQ ID NO: 1726524 - RNA, 21 nt, Homo sapiens
auuaccaaaauauauauuaau

SEQ ID NO: 1726525 - RNA, 14 nt, Homo sapiens
auuagagagucuca

SEQ ID NO: 1726526 - RNA, 16 nt, Homo sapiens
auuaguuugacacugc

SEQ ID NO: 1726527 - RNA, 23 nt, Homo sapiens
auucacuggggcaugagauuuug

SEQ ID NO: 1726528 - RNA, 21 nt, Homo sapiens
auucuguguucacaugugugg

SEQ ID NO: 1726529 - RNA, 13 nt, Homo sapiens
auugaagcuuugu

SEQ ID NO: 1726530 - RNA, 20 nt, Homo sapiens
auugcuuguuuguggucaca

SEQ ID NO: 1726531 - RNA, 23 nt, Homo sapiens
auuggacacguaaccuggcucua

SEQ ID NO: 1726532 - RNA, 16 nt, Homo sapiens
auuuaagccuugacac

SEQ ID NO: 1726533 - RNA, 21 nt, Homo sapiens
auuuaccaaaauuugugcaca

SEQ ID NO: 1726534 - RNA, 22 nt, Homo sapiens
auuuacugcucuagaaaguaua

SEQ ID NO: 1726535 - RNA, 20 nt, Homo sapiens
auuuaguaaaugcugaaaua

SEQ ID NO: 1726536 - RNA, 15 nt, Homo sapiens
auuuaugaugcacuu

SEQ ID NO: 1726537 - RNA, 16 nt, Homo sapiens
auuuaugaugcacuua

SEQ ID NO: 1726538 - RNA, 22 nt, Homo sapiens
auuucugaaagaauaggauuaa

SEQ ID NO: 1726539 - RNA, 16 nt, Homo sapiens
auuuggcuugcuguuu

SEQ ID NO: 1726540 - RNA, 15 nt, Homo sapiens
auuuuugacauuaau

SEQ ID NO: 1726541 - RNA, 20 nt, Homo sapiens
caaaaaaacauuugucagua

SEQ ID NO: 1726542 - RNA, 14 nt, Homo sapiens
caaaaacaauguaa

SEQ ID NO: 1726543 - RNA, 12 nt, Homo sapiens
caaaaacagcaa

SEQ ID NO: 1726544 - RNA, 22 nt, Homo sapiens
caaaaagaagaguuugugacua

SEQ ID NO: 1726545 - RNA, 17 nt, Homo sapiens
caaaugaucuguuuuca

SEQ ID NO: 1726546 - RNA, 20 nt, Homo sapiens
caacaaagaaugggcuugaa

SEQ ID NO: 1726547 - RNA, 19 nt, Homo sapiens
caacaacuuacacuuauuu

SEQ ID NO: 1726548 - RNA, 14 nt, Homo sapiens
caacaaugacuuaa

SEQ ID NO: 1726549 - RNA, 22 nt, Homo sapiens
caacaaugacuuaaccauauaa

SEQ ID NO: 1726550 - RNA, 15 nt, Homo sapiens
caacauucuguguuc

SEQ ID NO: 1726551 - RNA, 18 nt, Homo sapiens
caacauucuguguucaca

SEQ ID NO: 1726552 - RNA, 21 nt, Homo sapiens
caagaaggccaauugccuaaa

SEQ ID NO: 1726553 - RNA, 23 nt, Homo sapiens
caauaugaauuagguguacugua

SEQ ID NO: 1726554 - RNA, 17 nt, Homo sapiens
caaucauaauaccugcu

SEQ ID NO: 1726555 - RNA, 21 nt, Homo sapiens
caaugaccaaggacugcuaca

SEQ ID NO: 1726556 - RNA, 15 nt, Homo sapiens
cacaaaaaaggcagu

SEQ ID NO: 1726557 - RNA, 14 nt, Homo sapiens
cacagagugcauug

SEQ ID NO: 1726558 - RNA, 16 nt, Homo sapiens
caccucuguacagacc

SEQ ID NO: 1726559 - RNA, 20 nt, Homo sapiens
cacuacaagcuuuuaacuuu

SEQ ID NO: 1726560 - RNA, 22 nt, Homo sapiens
cacuacccgugaauuauauggc

SEQ ID NO: 1726561 - RNA, 15 nt, Homo sapiens
cacuagaaaugcagc

SEQ ID NO: 1726562 - RNA, 21 nt, Homo sapiens
cacuucuuguuccccacugac

SEQ ID NO: 1726563 - RNA, 20 nt, Homo sapiens
cagaaacugaauucuggaca

SEQ ID NO: 1726564 - RNA, 17 nt, Homo sapiens
cagacuuaaagcacuga

SEQ ID NO: 1726565 - RNA, 19 nt, Homo sapiens
cagcaaaauuguggcauuu

SEQ ID NO: 1726566 - RNA, 19 nt, Homo sapiens
cagcacaccccacagccaa

SEQ ID NO: 1726567 - RNA, 20 nt, Homo sapiens
caggcgauccaccugucuca

SEQ ID NO: 1726568 - RNA, 18 nt, Homo sapiens
cagggcggaacucucagg

SEQ ID NO: 1726569 - RNA, 22 nt, Homo sapiens
cagguucaugccaccauggcca

SEQ ID NO: 1726570 - RNA, 16 nt, Homo sapiens
cagguuuguucucagg

SEQ ID NO: 1726571 - RNA, 18 nt, Homo sapiens
caguaccgacuaagcaaa

SEQ ID NO: 1726572 - RNA, 15 nt, Homo sapiens
caguauuguauauga

SEQ ID NO: 1726573 - RNA, 18 nt, Homo sapiens
caguauuuuccagccuua

SEQ ID NO: 1726574 - RNA, 14 nt, Homo sapiens
cagugagcucuuua

SEQ ID NO: 1726575 - RNA, 23 nt, Homo sapiens
caguuauuaaucuggacauucga

SEQ ID NO: 1726576 - RNA, 19 nt, Homo sapiens
caguuuuauaaaaagugga

SEQ ID NO: 1726577 - RNA, 14 nt, Homo sapiens
cauaaaaacagugc

SEQ ID NO: 1726578 - RNA, 23 nt, Homo sapiens
cauaaauaaaagaaaaauaugca

SEQ ID NO: 1726579 - RNA, 23 nt, Homo sapiens
cauaagcuucuugucauucuuca

SEQ ID NO: 1726580 - RNA, 18 nt, Homo sapiens
cauacacguaaaugcaga

SEQ ID NO: 1726581 - RNA, 17 nt, Homo sapiens
cauacucaaugcauaua

SEQ ID NO: 1726582 - RNA, 21 nt, Homo sapiens
caucagugaccaccaacauuc

SEQ ID NO: 1726583 - RNA, 18 nt, Homo sapiens
cauccuaccccuuugcac

SEQ ID NO: 1726584 - RNA, 13 nt, Homo sapiens
caucuccagcuau

SEQ ID NO: 1726585 - RNA, 21 nt, Homo sapiens
caucucgcuaaagagugaaug

SEQ ID NO: 1726586 - RNA, 23 nt, Homo sapiens
caucucucccuccccugccauuu

SEQ ID NO: 1726587 - RNA, 21 nt, Homo sapiens
cauggaucagcucuuccugug

SEQ ID NO: 1726588 - RNA, 20 nt, Homo sapiens
caugucagacccgaacuggc

SEQ ID NO: 1726589 - RNA, 15 nt, Homo sapiens
caugugcugccugca

SEQ ID NO: 1726590 - RNA, 15 nt, Homo sapiens
caugugugcuaauau

SEQ ID NO: 1726591 - RNA, 20 nt, Homo sapiens
cauuuaccaagagagcacau

SEQ ID NO: 1726592 - RNA, 16 nt, Homo sapiens
cauuuaggaguauuau

SEQ ID NO: 1726593 - RNA, 19 nt, Homo sapiens
cauuuauuucucuggcaaa

SEQ ID NO: 1726594 - RNA, 14 nt, Homo sapiens
cauuugcuuugucc

SEQ ID NO: 1726595 - RNA, 16 nt, Homo sapiens
cauuuucacagcacua

SEQ ID NO: 1726596 - RNA, 14 nt, Homo sapiens
cauuuucaccccac

SEQ ID NO: 1726597 - RNA, 13 nt, Homo sapiens
ccaaaauaaucua

SEQ ID NO: 1726598 - RNA, 14 nt, Homo sapiens
ccaauucugaaaua

SEQ ID NO: 1726599 - RNA, 19 nt, Homo sapiens
ccaauuuauccuugaccaa

SEQ ID NO: 1726600 - RNA, 22 nt, Homo sapiens
ccacguccagcuggaaggguca

SEQ ID NO: 1726601 - RNA, 17 nt, Homo sapiens
ccagcuagugccaaaua

SEQ ID NO: 1726602 - RNA, 14 nt, Homo sapiens
ccagugagcucuuu

SEQ ID NO: 1726603 - RNA, 23 nt, Homo sapiens
ccauauaccaucuccagcuauuu

SEQ ID NO: 1726604 - RNA, 14 nt, Homo sapiens
cccaauccaugcuu

SEQ ID NO: 1726605 - RNA, 17 nt, Homo sapiens
cccauaucugugaaaug

SEQ ID NO: 1726606 - RNA, 11 nt, Homo sapiens
ccccacugaca

SEQ ID NO: 1726607 - RNA, 17 nt, Homo sapiens
cccggggcuccacugaa

SEQ ID NO: 1726608 - RNA, 20 nt, Homo sapiens
cccugggcagugagugccau

SEQ ID NO: 1726609 - RNA, 21 nt, Homo sapiens
ccuaccucacagagugcauug

SEQ ID NO: 1726610 - RNA, 23 nt, Homo sapiens
ccucacagagugcauugugaggg

SEQ ID NO: 1726611 - RNA, 19 nt, Homo sapiens
ccucauuuucacagcacua

SEQ ID NO: 1726612 - RNA, 15 nt, Homo sapiens
ccuccccagauauca

SEQ ID NO: 1726613 - RNA, 17 nt, Homo sapiens
ccuccccagauaucauu

SEQ ID NO: 1726614 - RNA, 23 nt, Homo sapiens
ccuccugugccucccuuuucucc

SEQ ID NO: 1726615 - RNA, 15 nt, Homo sapiens
cgagcagccacuggc

SEQ ID NO: 1726616 - RNA, 15 nt, Homo sapiens
cggggcuccacugaa

SEQ ID NO: 1726617 - RNA, 12 nt, Homo sapiens
cguaaaugcaga

SEQ ID NO: 1726618 - RNA, 17 nt, Homo sapiens
cguuaguucuacauuau

SEQ ID NO: 1726619 - RNA, 17 nt, Homo sapiens
cuaaaaggaaaucucac

SEQ ID NO: 1726620 - RNA, 13 nt, Homo sapiens
cuaaagcuuuauc

SEQ ID NO: 1726621 - RNA, 21 nt, Homo sapiens
cuaauuguauuuagugacaaa

SEQ ID NO: 1726622 - RNA, 12 nt, Homo sapiens
cuacaucugccu

SEQ ID NO: 1726623 - RNA, 17 nt, Homo sapiens
cuaccugguguaugaaa

SEQ ID NO: 1726624 - RNA, 14 nt, Homo sapiens
cuaguuuucaauca

SEQ ID NO: 1726625 - RNA, 15 nt, Homo sapiens
cuauucugagugaaa

SEQ ID NO: 1726626 - RNA, 18 nt, Homo sapiens
cuccugccuaauuuugaa

SEQ ID NO: 1726627 - RNA, 12 nt, Homo sapiens
cucuaacuucaa

SEQ ID NO: 1726628 - RNA, 22 nt, Homo sapiens
cucuaagauaucuuugcugcuu

SEQ ID NO: 1726629 - RNA, 16 nt, Homo sapiens
cucugauuacaauucu

SEQ ID NO: 1726630 - RNA, 18 nt, Homo sapiens
cucuuguauaugaugauc

SEQ ID NO: 1726631 - RNA, 16 nt, Homo sapiens
cacaaaaacagcaaaa

SEQ ID NO: 1726632 - RNA, 17 nt, Homo sapiens
cacacaaaaaaggcagu

SEQ ID NO: 1726633 - RNA, 23 nt, Homo sapiens
cacagagugcauugugaggguua

SEQ ID NO: 1726634 - RNA, 20 nt, Homo sapiens
cacagaugcacaacacuccu

SEQ ID NO: 1726635 - RNA, 17 nt, Homo sapiens
cacagcaacaaugacuu

SEQ ID NO: 1726636 - RNA, 13 nt, Homo sapiens
cacaucugcauuu

SEQ ID NO: 1726637 - RNA, 21 nt, Homo sapiens
cacccuggaggauuucaucuc

SEQ ID NO: 1726638 - RNA, 22 nt, Homo sapiens
cacccugggcagugagugccau

SEQ ID NO: 1726639 - RNA, 12 nt, Homo sapiens
cacuaacacugg

SEQ ID NO: 1726640 - RNA, 17 nt, Homo sapiens
cacuagaaaugcagcau

SEQ ID NO: 1726641 - RNA, 15 nt, Homo sapiens
cacuggagugaauga

SEQ ID NO: 1726642 - RNA, 15 nt, Homo sapiens
cacuuaaacucagcu

SEQ ID NO: 1726643 - RNA, 23 nt, Homo sapiens
cacuuaugaagucagugcuaaag

SEQ ID NO: 1726644 - RNA, 22 nt, Homo sapiens
cagaaggguagguuagaugcua

SEQ ID NO: 1726645 - RNA, 19 nt, Homo sapiens
cagaaguuacuaaguauua

SEQ ID NO: 1726646 - RNA, 23 nt, Homo sapiens
cagauaucauuuaggaguauuau

SEQ ID NO: 1726647 - RNA, 21 nt, Homo sapiens
cagaugcuguuaguaccuaca

SEQ ID NO: 1726648 - RNA, 13 nt, Homo sapiens
cagcaacaaugac

SEQ ID NO: 1726649 - RNA, 15 nt, Homo sapiens
cagcagcacccagug

SEQ ID NO: 1726650 - RNA, 13 nt, Homo sapiens
cagccacauucua

SEQ ID NO: 1726651 - RNA, 20 nt, Homo sapiens
cagcucuucuggcuguguug

SEQ ID NO: 1726652 - RNA, 15 nt, Homo sapiens
cagcugacccaguga

SEQ ID NO: 1726653 - RNA, 13 nt, Homo sapiens
cagcuugccaaau

SEQ ID NO: 1726654 - RNA, 19 nt, Homo sapiens
cagggaagcugucccucac

SEQ ID NO: 1726655 - RNA, 14 nt, Homo sapiens
caguaagugugaau

SEQ ID NO: 1726656 - RNA, 12 nt, Homo sapiens
cagugagcucuu

SEQ ID NO: 1726657 - RNA, 23 nt, Homo sapiens
cagugcuaaaauucagaugcugu

SEQ ID NO: 1726658 - RNA, 11 nt, Homo sapiens
caguguugccc

SEQ ID NO: 1726659 - RNA, 16 nt, Homo sapiens
caguuauuaaucugga

SEQ ID NO: 1726660 - RNA, 18 nt, Homo sapiens
caguuuuuuuuuuuccag

SEQ ID NO: 1726661 - RNA, 22 nt, Homo sapiens
cauaacuaggauuauaaugcug

SEQ ID NO: 1726662 - RNA, 17 nt, Homo sapiens
cauacacguaaaugcag

SEQ ID NO: 1726663 - RNA, 15 nt, Homo sapiens
cauagauugcaaaua

SEQ ID NO: 1726664 - RNA, 15 nt, Homo sapiens
cauauauuuaacuuu

SEQ ID NO: 1726665 - RNA, 16 nt, Homo sapiens
caucagucaacaacuu

SEQ ID NO: 1726666 - RNA, 15 nt, Homo sapiens
caucauccucacgug

SEQ ID NO: 1726667 - RNA, 20 nt, Homo sapiens
cauccuaccccuuugcacuu

SEQ ID NO: 1726668 - RNA, 15 nt, Homo sapiens
caucuccagcuauuu

SEQ ID NO: 1726669 - RNA, 18 nt, Homo sapiens
caugaaaauaaacuugaa

SEQ ID NO: 1726670 - RNA, 21 nt, Homo sapiens
caugaagcacacacacaaaaa

SEQ ID NO: 1726671 - RNA, 15 nt, Homo sapiens
caugcuacaguuauu

SEQ ID NO: 1726672 - RNA, 23 nt, Homo sapiens
caugguaaacuuuugguuuucag

SEQ ID NO: 1726673 - RNA, 18 nt, Homo sapiens
cauggucccaaaauguca

SEQ ID NO: 1726674 - RNA, 18 nt, Homo sapiens
cauguauguauauaauca

SEQ ID NO: 1726675 - RNA, 16 nt, Homo sapiens
cauuauucuucacuua

SEQ ID NO: 1726676 - RNA, 16 nt, Homo sapiens
cauucuguguucacau

SEQ ID NO: 1726677 - RNA, 13 nt, Homo sapiens
cauuugcaccuac

SEQ ID NO: 1726678 - RNA, 15 nt, Homo sapiens
cauuugcaccuaccu

SEQ ID NO: 1726679 - RNA, 16 nt, Homo sapiens
cauuugcaccuaccuc

SEQ ID NO: 1726680 - RNA, 14 nt, Homo sapiens
ccaaaacacugccu

SEQ ID NO: 1726681 - RNA, 20 nt, Homo sapiens
ccacccggcacuggcgagca

SEQ ID NO: 1726682 - RNA, 13 nt, Homo sapiens
ccaccugucucag

SEQ ID NO: 1726683 - RNA, 16 nt, Homo sapiens
ccacuaccccugauga

SEQ ID NO: 1726684 - RNA, 15 nt, Homo sapiens
ccacugcuguuuuca

SEQ ID NO: 1726685 - RNA, 19 nt, Homo sapiens
ccagaauugcugacagcag

SEQ ID NO: 1726686 - RNA, 13 nt, Homo sapiens
ccaguauaaucuc

SEQ ID NO: 1726687 - RNA, 23 nt, Homo sapiens
ccaguuaucuugaguugcagcuc

SEQ ID NO: 1726688 - RNA, 16 nt, Homo sapiens
cccagaauugcugaca

SEQ ID NO: 1726689 - RNA, 22 nt, Homo sapiens
cccagagugcugggauuacaau

SEQ ID NO: 1726690 - RNA, 12 nt, Homo sapiens
cccagcagcacc

SEQ ID NO: 1726691 - RNA, 22 nt, Homo sapiens
cccaguguuggucuguguccau

SEQ ID NO: 1726692 - RNA, 24 nt, Homo sapiens
cccaguguuggucuguguccauca

SEQ ID NO: 1726693 - RNA, 15 nt, Homo sapiens
cccauaucugugaaa

SEQ ID NO: 1726694 - RNA, 15 nt, Homo sapiens
cccaugguaguuuaa

SEQ ID NO: 1726695 - RNA, 15 nt, Homo sapiens
ccccaauccaugcuu

SEQ ID NO: 1726696 - RNA, 12 nt, Homo sapiens
cccccuugaggg

SEQ ID NO: 1726697 - RNA, 12 nt, Homo sapiens
cccuacacugcc

SEQ ID NO: 1726698 - RNA, 15 nt, Homo sapiens
cccucacuguugaau

SEQ ID NO: 1726699 - RNA, 16 nt, Homo sapiens
ccggggcuccacugaa

SEQ ID NO: 1726700 - RNA, 15 nt, Homo sapiens
ccuauacauccacag

SEQ ID NO: 1726701 - RNA, 22 nt, Homo sapiens
ccugcuuuccuaucuagcauuu

SEQ ID NO: 1726702 - RNA, 20 nt, Homo sapiens
ccuuucccagguaauuuaaa

SEQ ID NO: 1726703 - RNA, 22 nt, Homo sapiens
cguuuccgcugcaguaagccau

SEQ ID NO: 1726704 - RNA, 18 nt, Homo sapiens
cuaaagggagaaaugcca

SEQ ID NO: 1726705 - RNA, 21 nt, Homo sapiens
cuaaauaaacaucugaucugu

SEQ ID NO: 1726706 - RNA, 16 nt, Homo sapiens
cuaaaugaacucaaua

SEQ ID NO: 1726707 - RNA, 16 nt, Homo sapiens
cuaacguuuaauugcc

SEQ ID NO: 1726708 - RNA, 17 nt, Homo sapiens
cuaacuucaaggcccau

SEQ ID NO: 1726709 - RNA, 14 nt, Homo sapiens
cuaagaaaaucagu

SEQ ID NO: 1726710 - RNA, 14 nt, Homo sapiens
cuacaccucugauu

SEQ ID NO: 1726711 - RNA, 12 nt, Homo sapiens
cuacaguuauua

SEQ ID NO: 1726712 - RNA, 18 nt, Homo sapiens
cuagaaaaggcagcuaaa

SEQ ID NO: 1726713 - RNA, 17 nt, Homo sapiens
cuagaaaugcagcaucu

SEQ ID NO: 1726714 - RNA, 15 nt, Homo sapiens
cuagguaggggccca

SEQ ID NO: 1726715 - RNA, 17 nt, Homo sapiens
cuagguaggggcccacu

SEQ ID NO: 1726716 - RNA, 20 nt, Homo sapiens
cuauguuaaugaguauguaa

SEQ ID NO: 1726717 - RNA, 19 nt, Homo sapiens
cucacagagugcauuguga

SEQ ID NO: 1726718 - RNA, 16 nt, Homo sapiens
cucacuuuaauuugaa

SEQ ID NO: 1726719 - RNA, 15 nt, Homo sapiens
cucauagauugcaaa

SEQ ID NO: 1726720 - RNA, 19 nt, Homo sapiens
cucauucaaauacuguauu

SEQ ID NO: 1726721 - RNA, 18 nt, Homo sapiens
cucauuuucacagcacua

SEQ ID NO: 1726722 - RNA, 17 nt, Homo sapiens
cucuggaccauauacca

SEQ ID NO: 1726723 - RNA, 20 nt, Homo sapiens
cucuucagacuuaaagcacu

SEQ ID NO: 1726724 - RNA, 22 nt, Homo sapiens
cucuucagacuuaaagcacuga

SEQ ID NO: 1726725 - RNA, 11 nt, Homo sapiens
cugacccagug

SEQ ID NO: 1726726 - RNA, 19 nt, Homo sapiens
cugagaacagugcacaaga

SEQ ID NO: 1726727 - RNA, 19 nt, Homo sapiens
cugauggcacuaacacugg

SEQ ID NO: 1726728 - RNA, 20 nt, Homo sapiens
cugauggcacuaacacuggg

SEQ ID NO: 1726729 - RNA, 16 nt, Homo sapiens
cugcaagcacagcaua

SEQ ID NO: 1726730 - RNA, 12 nt, Homo sapiens
cugcaagcauuu

SEQ ID NO: 1726731 - RNA, 20 nt, Homo sapiens
cugcacagaaauuuucaauu

SEQ ID NO: 1726732 - RNA, 22 nt, Homo sapiens
cugcuaaagggagaaaugccag

SEQ ID NO: 1726733 - RNA, 20 nt, Homo sapiens
cuggaauuuucauacacgua

SEQ ID NO: 1726734 - RNA, 18 nt, Homo sapiens
cuggacagauuuaagccu

SEQ ID NO: 1726735 - RNA, 16 nt, Homo sapiens
cuggacauucgaggaa

SEQ ID NO: 1726736 - RNA, 20 nt, Homo sapiens
cuggaguggaguggcgugau

SEQ ID NO: 1726737 - RNA, 16 nt, Homo sapiens
cuggcuguguugucag

SEQ ID NO: 1726738 - RNA, 21 nt, Homo sapiens
cuggcuguguugucagcacug

SEQ ID NO: 1726739 - RNA, 22 nt, Homo sapiens
cuggcuguguugucagcacugu

SEQ ID NO: 1726740 - RNA, 23 nt, Homo sapiens
cugggucucgcuuuguugcccag

SEQ ID NO: 1726741 - RNA, 15 nt, Homo sapiens
cuggucucaaacucc

SEQ ID NO: 1726742 - RNA, 23 nt, Homo sapiens
cuguagaaaggaaauagacuuug

SEQ ID NO: 1726743 - RNA, 17 nt, Homo sapiens
cuguccuuacauacuca

SEQ ID NO: 1726744 - RNA, 17 nt, Homo sapiens
caaguauucuaccuaaa

SEQ ID NO: 1726745 - RNA, 19 nt, Homo sapiens
caaugacuuaaccauauaa

SEQ ID NO: 1726746 - RNA, 14 nt, Homo sapiens
caauggagagauuc

SEQ ID NO: 1726747 - RNA, 17 nt, Homo sapiens
caauguaaggagccuuu

SEQ ID NO: 1726748 - RNA, 14 nt, Homo sapiens
cacacacacaaaaa

SEQ ID NO: 1726749 - RNA, 18 nt, Homo sapiens
cacacuagaaaugcagca

SEQ ID NO: 1726750 - RNA, 15 nt, Homo sapiens
cacagcaacaaugac

SEQ ID NO: 1726751 - RNA, 16 nt, Homo sapiens
cacagguucaugccac

SEQ ID NO: 1726752 - RNA, 15 nt, Homo sapiens
cacaguaagugugaa

SEQ ID NO: 1726753 - RNA, 16 nt, Homo sapiens
cacaucuaaagcuuua

SEQ ID NO: 1726754 - RNA, 18 nt, Homo sapiens
cacaucuaaagcuuuauc

SEQ ID NO: 1726755 - RNA, 20 nt, Homo sapiens
cacauguccuccaucagggg

SEQ ID NO: 1726756 - RNA, 17 nt, Homo sapiens
caccaacauucuguguu

SEQ ID NO: 1726757 - RNA, 17 nt, Homo sapiens
caccauguaaggucaca

SEQ ID NO: 1726758 - RNA, 16 nt, Homo sapiens
cacccuggaggauuuc

SEQ ID NO: 1726759 - RNA, 21 nt, Homo sapiens
cacccuuccccuccuucuccc

SEQ ID NO: 1726760 - RNA, 14 nt, Homo sapiens
caccuauugaauua

SEQ ID NO: 1726761 - RNA, 11 nt, Homo sapiens
cacuacaagcu

SEQ ID NO: 1726762 - RNA, 15 nt, Homo sapiens
cacuaccccugauga

SEQ ID NO: 1726763 - RNA, 20 nt, Homo sapiens
cacuauccuuccucucugug

SEQ ID NO: 1726764 - RNA, 23 nt, Homo sapiens
cacuauccuuccucucugugaug

SEQ ID NO: 1726765 - RNA, 17 nt, Homo sapiens
cacugccugcucuucag

SEQ ID NO: 1726766 - RNA, 15 nt, Homo sapiens
cacugggagcacagc

SEQ ID NO: 1726767 - RNA, 15 nt, Homo sapiens
cagacuuaaagcacu

SEQ ID NO: 1726768 - RNA, 13 nt, Homo sapiens
cagauacacugug

SEQ ID NO: 1726769 - RNA, 17 nt, Homo sapiens
cagauacacugugauaa

SEQ ID NO: 1726770 - RNA, 13 nt, Homo sapiens
cagcagaggcuuu

SEQ ID NO: 1726771 - RNA, 15 nt, Homo sapiens
cagccaacuuuugca

SEQ ID NO: 1726772 - RNA, 14 nt, Homo sapiens
cagcuacugcaaau

SEQ ID NO: 1726773 - RNA, 19 nt, Homo sapiens
cagcucuguaguuucuuga

SEQ ID NO: 1726774 - RNA, 17 nt, Homo sapiens
cagcucuuccuguguuu

SEQ ID NO: 1726775 - RNA, 19 nt, Homo sapiens
cagcuggaagggucaacau

SEQ ID NO: 1726776 - RNA, 22 nt, Homo sapiens
caguaauuuaacaucacuacaa

SEQ ID NO: 1726777 - RNA, 19 nt, Homo sapiens
caguccugccucagccucc

SEQ ID NO: 1726778 - RNA, 19 nt, Homo sapiens
caguuuacauuuaggcauu

SEQ ID NO: 1726779 - RNA, 19 nt, Homo sapiens
cauaaaauugcaguuucau

SEQ ID NO: 1726780 - RNA, 16 nt, Homo sapiens
cauauaccaucuccag

SEQ ID NO: 1726781 - RNA, 22 nt, Homo sapiens
cauauaugaaaacaauacuaaa

SEQ ID NO: 1726782 - RNA, 20 nt, Homo sapiens
cauccuuauuagcucuacug

SEQ ID NO: 1726783 - RNA, 20 nt, Homo sapiens
caucucgcuaaagagugaau

SEQ ID NO: 1726784 - RNA, 13 nt, Homo sapiens
caucuuuacuaug

SEQ ID NO: 1726785 - RNA, 19 nt, Homo sapiens
caugaagcacacacacaaa

SEQ ID NO: 1726786 - RNA, 22 nt, Homo sapiens
caugccuguaaucccagcacuu

SEQ ID NO: 1726787 - RNA, 16 nt, Homo sapiens
caugcuacaguuauua

SEQ ID NO: 1726788 - RNA, 18 nt, Homo sapiens
cauguccuccaucagggg

SEQ ID NO: 1726789 - RNA, 18 nt, Homo sapiens
cauuccuuucucuucagu

SEQ ID NO: 1726790 - RNA, 13 nt, Homo sapiens
cauucuagguagg

SEQ ID NO: 1726791 - RNA, 12 nt, Homo sapiens
cauucuuuugca

SEQ ID NO: 1726792 - RNA, 16 nt, Homo sapiens
cauuuaaaauucaauu

SEQ ID NO: 1726793 - RNA, 18 nt, Homo sapiens
cauuucacaaaaacagca

SEQ ID NO: 1726794 - RNA, 16 nt, Homo sapiens
ccaaaauguacuuaaa

SEQ ID NO: 1726795 - RNA, 13 nt, Homo sapiens
ccaaaaugucauu

SEQ ID NO: 1726796 - RNA, 13 nt, Homo sapiens
ccaacuuuugcau

SEQ ID NO: 1726797 - RNA, 20 nt, Homo sapiens
ccaaguagaggcgaaagcag

SEQ ID NO: 1726798 - RNA, 22 nt, Homo sapiens
ccacacccuggaggauuucauc

SEQ ID NO: 1726799 - RNA, 18 nt, Homo sapiens
ccacaccggguaagagcu

SEQ ID NO: 1726800 - RNA, 15 nt, Homo sapiens
ccagagggagaguuu

SEQ ID NO: 1726801 - RNA, 18 nt, Homo sapiens
ccagagggagaguuugaa

SEQ ID NO: 1726802 - RNA, 15 nt, Homo sapiens
ccagaucauguuccu

SEQ ID NO: 1726803 - RNA, 16 nt, Homo sapiens
ccagcagcacccagug

SEQ ID NO: 1726804 - RNA, 16 nt, Homo sapiens
ccaggcuggucucaaa

SEQ ID NO: 1726805 - RNA, 16 nt, Homo sapiens
ccauaucugugaaaug

SEQ ID NO: 1726806 - RNA, 17 nt, Homo sapiens
ccaucugugugcaacua

SEQ ID NO: 1726807 - RNA, 11 nt, Homo sapiens
ccaugccaucu

SEQ ID NO: 1726808 - RNA, 20 nt, Homo sapiens
ccaugcuucacucaugcaaa

SEQ ID NO: 1726809 - RNA, 22 nt, Homo sapiens
cccacacccuggaggauuucau

SEQ ID NO: 1726810 - RNA, 16 nt, Homo sapiens
cccacagccaaguaga

SEQ ID NO: 1726811 - RNA, 16 nt, Homo sapiens
cccagguggcagacuc

SEQ ID NO: 1726812 - RNA, 14 nt, Homo sapiens
cccauaucugugaa

SEQ ID NO: 1726813 - RNA, 23 nt, Homo sapiens
cccauaucugugaaaugcuggca

SEQ ID NO: 1726814 - RNA, 22 nt, Homo sapiens
cccaucccacacccuggaggau

SEQ ID NO: 1726815 - RNA, 15 nt, Homo sapiens
cccuccccugccauu

SEQ ID NO: 1726816 - RNA, 22 nt, Homo sapiens
cccuccuagcagacaugccaca

SEQ ID NO: 1726817 - RNA, 18 nt, Homo sapiens
ccgaaggguuuugcuaca

SEQ ID NO: 1726818 - RNA, 15 nt, Homo sapiens
ccuccuagcagacau

SEQ ID NO: 1726819 - RNA, 15 nt, Homo sapiens
ccuggaacacaaaac

SEQ ID NO: 1726820 - RNA, 18 nt, Homo sapiens
ccuguaaucccagcacuu

SEQ ID NO: 1726821 - RNA, 20 nt, Homo sapiens
ccuguaauuaaacuaguuua

SEQ ID NO: 1726822 - RNA, 14 nt, Homo sapiens
ccuugacacacugu

SEQ ID NO: 1726823 - RNA, 15 nt, Homo sapiens
ccuuuuaaguuugaa

SEQ ID NO: 1726824 - RNA, 19 nt, Homo sapiens
ccuuuuuauucagcuagaa

SEQ ID NO: 1726825 - RNA, 23 nt, Homo sapiens
cgcacccccacugcuguuuucac

SEQ ID NO: 1726826 - RNA, 16 nt, Homo sapiens
cgcugcaguaagccau

SEQ ID NO: 1726827 - RNA, 16 nt, Homo sapiens
cguauaaugcuuucug

SEQ ID NO: 1726828 - RNA, 20 nt, Homo sapiens
cguccagcuggaagggucaa

SEQ ID NO: 1726829 - RNA, 21 nt, Homo sapiens
cguuacuaaaaguacauuaaa

SEQ ID NO: 1726830 - RNA, 15 nt, Homo sapiens
cguuuacuagacuuu

SEQ ID NO: 1726831 - RNA, 13 nt, Homo sapiens
cguuuuauuccag

SEQ ID NO: 1726832 - RNA, 19 nt, Homo sapiens
cuaaagggagaaaugccag

SEQ ID NO: 1726833 - RNA, 16 nt, Homo sapiens
cuaaauaaacaucuga

SEQ ID NO: 1726834 - RNA, 16 nt, Homo sapiens
cuagcuagcuguguua

SEQ ID NO: 1726835 - RNA, 14 nt, Homo sapiens
cuaucuagcauuua

SEQ ID NO: 1726836 - RNA, 14 nt, Homo sapiens
cucacagagugcau

SEQ ID NO: 1726837 - RNA, 20 nt, Homo sapiens
cucacagagugcauugugag

SEQ ID NO: 1726838 - RNA, 21 nt, Homo sapiens
cucacagagugcauugugagg

SEQ ID NO: 1726839 - RNA, 14 nt, Homo sapiens
cucacaguguugcc

SEQ ID NO: 1726840 - RNA, 17 nt, Homo sapiens
cucacuguugaauuuuc

SEQ ID NO: 1726841 - RNA, 15 nt, Homo sapiens
cucagcuacugcaaa

SEQ ID NO: 1726842 - RNA, 21 nt, Homo sapiens
cucaggaggguaagaacucca

SEQ ID NO: 1726843 - RNA, 16 nt, Homo sapiens
cucgagcaguccugcc

SEQ ID NO: 1726844 - RNA, 17 nt, Homo sapiens
cucgcuuuguugcccag

SEQ ID NO: 1726845 - RNA, 14 nt, Homo sapiens
cucuuaaaucauuu

SEQ ID NO: 1726846 - RNA, 22 nt, Homo sapiens
cucuuauagagccugugugaaa

SEQ ID NO: 1726847 - RNA, 17 nt, Homo sapiens
cucuuguauaugaugau

SEQ ID NO: 1726848 - RNA, 18 nt, Homo sapiens
cugaaagaauaggauuaa

SEQ ID NO: 1726849 - RNA, 19 nt, Homo sapiens
cugaaaguccugcuuuccu

SEQ ID NO: 1726850 - RNA, 20 nt, Homo sapiens
cugaacucugaccacuuaaa

SEQ ID NO: 1726851 - RNA, 17 nt, Homo sapiens
cugagaacagugcacaa

SEQ ID NO: 1726852 - RNA, 15 nt, Homo sapiens
cugagcagccacuac

SEQ ID NO: 1726853 - RNA, 13 nt, Homo sapiens
cugaguuuagugg

SEQ ID NO: 1726854 - RNA, 22 nt, Homo sapiens
cugccucauuuucacagcacua

SEQ ID NO: 1726855 - RNA, 23 nt, Homo sapiens
cuggagugauagcuacuguagaa

SEQ ID NO: 1726856 - RNA, 22 nt, Homo sapiens
cuggcauaucucuguucaguua

SEQ ID NO: 1726857 - RNA, 19 nt, Homo sapiens
cuggcauuugcaccuaccu

SEQ ID NO: 1726858 - RNA, 17 nt, Homo sapiens
cuggggaagagguuuua

SEQ ID NO: 1726859 - RNA, 17 nt, Homo sapiens
aaauuaaccuggucaau

SEQ ID NO: 1726860 - RNA, 13 nt, Homo sapiens
aacaauacuaaau

SEQ ID NO: 1726861 - RNA, 16 nt, Homo sapiens
aacagcaaaauugugg

SEQ ID NO: 1726862 - RNA, 22 nt, Homo sapiens
aacagugcuauucugagugaaa

SEQ ID NO: 1726863 - RNA, 18 nt, Homo sapiens
aacaucuuuuacauucug

SEQ ID NO: 1726864 - RNA, 22 nt, Homo sapiens
aacaugaagcacacacacaaaa

SEQ ID NO: 1726865 - RNA, 22 nt, Homo sapiens
aacauucuguguucacaugugu

SEQ ID NO: 1726866 - RNA, 15 nt, Homo sapiens
aacauuucuuuguga

SEQ ID NO: 1726867 - RNA, 14 nt, Homo sapiens
aacuauaacagugu

SEQ ID NO: 1726868 - RNA, 23 nt, Homo sapiens
aacucuguccuuacauacucaau

SEQ ID NO: 1726869 - RNA, 23 nt, Homo sapiens
aacuguauuucaguauuuuccag

SEQ ID NO: 1726870 - RNA, 17 nt, Homo sapiens
aacuuuuuaaguuauug

SEQ ID NO: 1726871 - RNA, 15 nt, Homo sapiens
aagacauguuggaaa

SEQ ID NO: 1726872 - RNA, 15 nt, Homo sapiens
aagaguuugugacua

SEQ ID NO: 1726873 - RNA, 16 nt, Homo sapiens
aagauggcaacuguau

SEQ ID NO: 1726874 - RNA, 21 nt, Homo sapiens
aagaugguguuuggcucuuau

SEQ ID NO: 1726875 - RNA, 13 nt, Homo sapiens
aagcacaucugca

SEQ ID NO: 1726876 - RNA, 17 nt, Homo sapiens
aagcauucuaaaugaac

SEQ ID NO: 1726877 - RNA, 14 nt, Homo sapiens
aagcuaaucugccu

SEQ ID NO: 1726878 - RNA, 23 nt, Homo sapiens
aagcuggagcaguugcuuuuuga

SEQ ID NO: 1726879 - RNA, 21 nt, Homo sapiens
aagcugucccucacuguugaa

SEQ ID NO: 1726880 - RNA, 21 nt, Homo sapiens
aagcuucuugucauucuucau

SEQ ID NO: 1726881 - RNA, 17 nt, Homo sapiens
aagcuuuaucuuugugu

SEQ ID NO: 1726882 - RNA, 21 nt, Homo sapiens
aaggcuuggaugcguguguaa

SEQ ID NO: 1726883 - RNA, 19 nt, Homo sapiens
aagucucagcagcucuucu

SEQ ID NO: 1726884 - RNA, 16 nt, Homo sapiens
aauaaaaucauguauc

SEQ ID NO: 1726885 - RNA, 20 nt, Homo sapiens
aauaaaugguuucucauuaa

SEQ ID NO: 1726886 - RNA, 15 nt, Homo sapiens
aauaaucuauauuaa

SEQ ID NO: 1726887 - RNA, 14 nt, Homo sapiens
aauaauguacaucu

SEQ ID NO: 1726888 - RNA, 23 nt, Homo sapiens
aauacauaguguauuuugcacaa

SEQ ID NO: 1726889 - RNA, 15 nt, Homo sapiens
aauagagccuugugg

SEQ ID NO: 1726890 - RNA, 23 nt, Homo sapiens
aauagucuugcagaaaaugaaug

SEQ ID NO: 1726891 - RNA, 18 nt, Homo sapiens
aauauaauuggcacagaa

SEQ ID NO: 1726892 - RNA, 17 nt, Homo sapiens
aaucagggaaacuaauu

SEQ ID NO: 1726893 - RNA, 12 nt, Homo sapiens
aaucaugaucac

SEQ ID NO: 1726894 - RNA, 16 nt, Homo sapiens
aaucaugcucauguau

SEQ ID NO: 1726895 - RNA, 22 nt, Homo sapiens
aaucaugcucauguauauuuag

SEQ ID NO: 1726896 - RNA, 13 nt, Homo sapiens
aaucccagcacuu

SEQ ID NO: 1726897 - RNA, 16 nt, Homo sapiens
aaucuuggaguuucaa

SEQ ID NO: 1726898 - RNA, 16 nt, Homo sapiens
aaugacuuaaccauau

SEQ ID NO: 1726899 - RNA, 12 nt, Homo sapiens
aaugcugcuaca

SEQ ID NO: 1726900 - RNA, 17 nt, Homo sapiens
aaugcuggcccugauga

SEQ ID NO: 1726901 - RNA, 20 nt, Homo sapiens
aaugguaggucaaguaauaa

SEQ ID NO: 1726902 - RNA, 17 nt, Homo sapiens
aauuagguguacuguac

SEQ ID NO: 1726903 - RNA, 18 nt, Homo sapiens
aauuaugaaacauuuuag

SEQ ID NO: 1726904 - RNA, 17 nt, Homo sapiens
aauuggccgcugucacu

SEQ ID NO: 1726905 - RNA, 18 nt, Homo sapiens
aauugucuauuccugagu

SEQ ID NO: 1726906 - RNA, 14 nt, Homo sapiens
aauuuaacaagcuc

SEQ ID NO: 1726907 - RNA, 17 nt, Homo sapiens
aauuuaacaucacuaca

SEQ ID NO: 1726908 - RNA, 21 nt, Homo sapiens
aauuuaacaucacuacaaaaa

SEQ ID NO: 1726909 - RNA, 20 nt, Homo sapiens
aauuucugagaacagugcac

SEQ ID NO: 1726910 - RNA, 18 nt, Homo sapiens
aauuugagauucuacagu

SEQ ID NO: 1726911 - RNA, 17 nt, Homo sapiens
acaagcuuuuaacuuuu

SEQ ID NO: 1726912 - RNA, 17 nt, Homo sapiens
acacugcuuuuuugaua

SEQ ID NO: 1726913 - RNA, 21 nt, Homo sapiens
acagcaaaauuguggcauuuu

SEQ ID NO: 1726914 - RNA, 10 nt, Homo sapiens
acagugcaag

SEQ ID NO: 1726915 - RNA, 14 nt, Homo sapiens
acaguguugcccag

SEQ ID NO: 1726916 - RNA, 22 nt, Homo sapiens
acaguguuuuuggaaaccugga

SEQ ID NO: 1726917 - RNA, 11 nt, Homo sapiens
acauacucaau

SEQ ID NO: 1726918 - RNA, 17 nt, Homo sapiens
acaucuuuuacauucug

SEQ ID NO: 1726919 - RNA, 13 nt, Homo sapiens
acaugguaaacuu

SEQ ID NO: 1726920 - RNA, 14 nt, Homo sapiens
acauguuacaggcu

SEQ ID NO: 1726921 - RNA, 19 nt, Homo sapiens
acauuaaacaaugaucaca

SEQ ID NO: 1726922 - RNA, 19 nt, Homo sapiens
acauuauucuucacuuaaa

SEQ ID NO: 1726923 - RNA, 23 nt, Homo sapiens
acauucugcaagcacaucugcau

SEQ ID NO: 1726924 - RNA, 17 nt, Homo sapiens
acauucuugguuguuaa

SEQ ID NO: 1726925 - RNA, 15 nt, Homo sapiens
accaacauucugugu

SEQ ID NO: 1726926 - RNA, 17 nt, Homo sapiens
accacagguucaugcca

SEQ ID NO: 1726927 - RNA, 16 nt, Homo sapiens
accacgaguuugguuu

SEQ ID NO: 1726928 - RNA, 17 nt, Homo sapiens
accagccugcagcacac

SEQ ID NO: 1726929 - RNA, 20 nt, Homo sapiens
accauauaccaucuccagcu

SEQ ID NO: 1726930 - RNA, 20 nt, Homo sapiens
accauuaauauaauuggcac

SEQ ID NO: 1726931 - RNA, 13 nt, Homo sapiens
accccuuugcacu

SEQ ID NO: 1726932 - RNA, 12 nt, Homo sapiens
acccgaacuggc

SEQ ID NO: 1726933 - RNA, 17 nt, Homo sapiens
acguuuacuagacuuug

SEQ ID NO: 1726934 - RNA, 24 nt, Homo sapiens
acuaaaugcucauacacaguuaaa

SEQ ID NO: 1726935 - RNA, 14 nt, Homo sapiens
acuaccccugauga

SEQ ID NO: 1726936 - RNA, 14 nt, Homo sapiens
acuaguaaagcaaa

SEQ ID NO: 1726937 - RNA, 16 nt, Homo sapiens
acuaguuuucaaucau

SEQ ID NO: 1726938 - RNA, 21 nt, Homo sapiens
acucacugacuccucacuggc

SEQ ID NO: 1726939 - RNA, 12 nt, Homo sapiens
acucaguauuau

SEQ ID NO: 1726940 - RNA, 17 nt, Homo sapiens
agccuugacacacugug

SEQ ID NO: 1726941 - RNA, 12 nt, Homo sapiens
agcggcaaaauu

SEQ ID NO: 1726942 - RNA, 20 nt, Homo sapiens
agcggcaaaauuaauggaca

SEQ ID NO: 1726943 - RNA, 13 nt, Homo sapiens
agcuaaucugccu

SEQ ID NO: 1726944 - RNA, 16 nt, Homo sapiens
agcuagcuguguuaga

SEQ ID NO: 1726945 - RNA, 18 nt, Homo sapiens
agcugaaaagagcuuugu

SEQ ID NO: 1726946 - RNA, 22 nt, Homo sapiens
agcugagugacugcagcuugcc

SEQ ID NO: 1726947 - RNA, 19 nt, Homo sapiens
agcugucccucacuguuga

SEQ ID NO: 1726948 - RNA, 23 nt, Homo sapiens
agcuuugugaaaacuacugaugu

SEQ ID NO: 1726949 - RNA, 19 nt, Homo sapiens
agcuuuugggaagucucag

SEQ ID NO: 1726950 - RNA, 12 nt, Homo sapiens
aggaagacauuu

SEQ ID NO: 1726951 - RNA, 21 nt, Homo sapiens
aggaagacauuugguuuucau

SEQ ID NO: 1726952 - RNA, 21 nt, Homo sapiens
aggacuuccauuugcuuuguc

SEQ ID NO: 1726953 - RNA, 20 nt, Homo sapiens
aggauggaagaaagaagcau

SEQ ID NO: 1726954 - RNA, 21 nt, Homo sapiens
aggccaaacggugcaacagaa

SEQ ID NO: 1726955 - RNA, 20 nt, Homo sapiens
aggcccauggaucagcucuu

SEQ ID NO: 1726956 - RNA, 20 nt, Homo sapiens
aggccuuacugucugcacuu

SEQ ID NO: 1726957 - RNA, 15 nt, Homo sapiens
aggcgauccaccugu

SEQ ID NO: 1726958 - RNA, 13 nt, Homo sapiens
agggaaugcucag

SEQ ID NO: 1726959 - RNA, 16 nt, Homo sapiens
agggauaauuggugca

SEQ ID NO: 1726960 - RNA, 17 nt, Homo sapiens
agguaauucuagccuuu

SEQ ID NO: 1726961 - RNA, 14 nt, Homo sapiens
aggucauuaaacca

SEQ ID NO: 1726962 - RNA, 18 nt, Homo sapiens
aguaaaaaauauaugugg

SEQ ID NO: 1726963 - RNA, 13 nt, Homo sapiens
aguaagugugaau

SEQ ID NO: 1726964 - RNA, 16 nt, Homo sapiens
aguacauuaaaacacu

SEQ ID NO: 1726965 - RNA, 17 nt, Homo sapiens
aguacuugaaacaguca

SEQ ID NO: 1726966 - RNA, 15 nt, Homo sapiens
aguauuaaguaguaa

SEQ ID NO: 1726967 - RNA, 21 nt, Homo sapiens
aguauuuaacuacaucugccu

SEQ ID NO: 1726968 - RNA, 20 nt, Homo sapiens
agucacuaucauagggauaa

SEQ ID NO: 1726969 - RNA, 19 nt, Homo sapiens
agucuauagaaaugaucau

SEQ ID NO: 1726970 - RNA, 14 nt, Homo sapiens
agugaaucuguauu

SEQ ID NO: 1726971 - RNA, 22 nt, Homo sapiens
agugacauaauuguccaguuau

SEQ ID NO: 1726972 - RNA, 16 nt, Homo sapiens
agugagugccaugcuu

SEQ ID NO: 1726973 - RNA, 16 nt, Homo sapiens
agugauagcuacugua

SEQ ID NO: 1726974 - RNA, 14 nt, Homo sapiens
aguggagacagacu

SEQ ID NO: 1726975 - RNA, 15 nt, Homo sapiens
aguggauaaauauac

SEQ ID NO: 1726976 - RNA, 16 nt, Homo sapiens
agugguuaagcauucc

SEQ ID NO: 1726977 - RNA, 23 nt, Homo sapiens
agugugcuguugcccuacacugc

SEQ ID NO: 1726978 - RNA, 22 nt, Homo sapiens
aguguugcccaggcuggucuca

SEQ ID NO: 1726979 - RNA, 23 nt, Homo sapiens
aguguugcccaggcuggucucaa

SEQ ID NO: 1726980 - RNA, 15 nt, Homo sapiens
aguuccaucccagga

SEQ ID NO: 1726981 - RNA, 16 nt, Homo sapiens
aguugcuuuuauugca

SEQ ID NO: 1726982 - RNA, 17 nt, Homo sapiens
aguuucuugaggccaaa

SEQ ID NO: 1726983 - RNA, 23 nt, Homo sapiens
aguuucuugaggccaaacacacu

SEQ ID NO: 1726984 - RNA, 22 nt, Homo sapiens
auaaaaaucuuuuuugauauga

SEQ ID NO: 1726985 - RNA, 23 nt, Homo sapiens
auaaagucauccucucacugcaa

SEQ ID NO: 1726986 - RNA, 16 nt, Homo sapiens
auaaguuugcaguugg

SEQ ID NO: 1726987 - RNA, 18 nt, Homo sapiens
auaauaaucaugaucaca

SEQ ID NO: 1726988 - RNA, 16 nt, Homo sapiens
auaauuuuaugcugga

SEQ ID NO: 1726989 - RNA, 18 nt, Homo sapiens
auacacguaaaugcagaa

SEQ ID NO: 1726990 - RNA, 18 nt, Homo sapiens
auagaggugaugcugcua

SEQ ID NO: 1726991 - RNA, 22 nt, Homo sapiens
auaggacuuaaaauagucucau

SEQ ID NO: 1726992 - RNA, 17 nt, Homo sapiens
auaggauuaaugaucau

SEQ ID NO: 1726993 - RNA, 21 nt, Homo sapiens
auagucuuacuaaaugcagaa

SEQ ID NO: 1726994 - RNA, 21 nt, Homo sapiens
auaguguauaugcuaacugga

SEQ ID NO: 1726995 - RNA, 21 nt, Homo sapiens
auauaaagguggugggcaaaa

SEQ ID NO: 1726996 - RNA, 12 nt, Homo sapiens
auauaccaucuc

SEQ ID NO: 1726997 - RNA, 20 nt, Homo sapiens
auaugaugaucuggauccac

SEQ ID NO: 1726998 - RNA, 17 nt, Homo sapiens
auauuaauaaucuuggc

SEQ ID NO: 1726999 - RNA, 13 nt, Homo sapiens
auauuuaacuuug

SEQ ID NO: 1727000 - RNA, 21 nt, Homo sapiens
auauuucacacuggagugaau

SEQ ID NO: 1727001 - RNA, 21 nt, Homo sapiens
aucacuaagaaagaaaggaaa

SEQ ID NO: 1727002 - RNA, 14 nt, Homo sapiens
aucacuacaagcuu

SEQ ID NO: 1727003 - RNA, 15 nt, Homo sapiens
aucagccacauucua

SEQ ID NO: 1727004 - RNA, 17 nt, Homo sapiens
aucagcucuuccugugu

SEQ ID NO: 1727005 - RNA, 21 nt, Homo sapiens
aucaugaucacaacugagauc

SEQ ID NO: 1727006 - RNA, 13 nt, Homo sapiens
auccuaccuguua

SEQ ID NO: 1727007 - RNA, 13 nt, Homo sapiens
aucuaacucuguc

SEQ ID NO: 1727008 - RNA, 12 nt, Homo sapiens
aucugaguuuag

SEQ ID NO: 1727009 - RNA, 21 nt, Homo sapiens
aucuguauguuaggugacauu

SEQ ID NO: 1727010 - RNA, 15 nt, Homo sapiens
aucuuaucaacuuac

SEQ ID NO: 1727011 - RNA, 19 nt, Homo sapiens
aucuuuguuuaaaugccaa

SEQ ID NO: 1727012 - RNA, 23 nt, Homo sapiens
augaauuuuguaucugcuuccau

SEQ ID NO: 1727013 - RNA, 23 nt, Homo sapiens
augacauaagucagcaaacugcg

SEQ ID NO: 1727014 - RNA, 17 nt, Homo sapiens
augaccaaggacugcua

SEQ ID NO: 1727015 - RNA, 16 nt, Homo sapiens
augaguuacuguuuaa

SEQ ID NO: 1727016 - RNA, 19 nt, Homo sapiens
augauaauaaucaugauca

SEQ ID NO: 1727017 - RNA, 12 nt, Homo sapiens
augaugaucugg

SEQ ID NO: 1727018 - RNA, 16 nt, Homo sapiens
augcaaacugcuuuau

SEQ ID NO: 1727019 - RNA, 16 nt, Homo sapiens
augcagaaguuacuaa

SEQ ID NO: 1727020 - RNA, 13 nt, Homo sapiens
augcucagaaagg

SEQ ID NO: 1727021 - RNA, 14 nt, Homo sapiens
augcucagggucaa

SEQ ID NO: 1727022 - RNA, 23 nt, Homo sapiens
ggacaagaguugagcagccuuuc

SEQ ID NO: 1727023 - RNA, 19 nt, Homo sapiens
ggagucccagaauugcuga

SEQ ID NO: 1727024 - RNA, 14 nt, Homo sapiens
ggauuaaugaucau

SEQ ID NO: 1727025 - RNA, 16 nt, Homo sapiens
ggcaguaggaaaaaug

SEQ ID NO: 1727026 - RNA, 17 nt, Homo sapiens
ggcccacuucaccguac

SEQ ID NO: 1727027 - RNA, 16 nt, Homo sapiens
ggcccauaucugugaa

SEQ ID NO: 1727028 - RNA, 12 nt, Homo sapiens
ggcgugaucuug

SEQ ID NO: 1727029 - RNA, 12 nt, Homo sapiens
gggaagucucag

SEQ ID NO: 1727030 - RNA, 14 nt, Homo sapiens
gggagaaaugccag

SEQ ID NO: 1727031 - RNA, 22 nt, Homo sapiens
gggagaccaagaacagguugaa

SEQ ID NO: 1727032 - RNA, 20 nt, Homo sapiens
gggucucacaguguugccca

SEQ ID NO: 1727033 - RNA, 20 nt, Homo sapiens
gggucucgcuuuguugccca

SEQ ID NO: 1727034 - RNA, 17 nt, Homo sapiens
gguacugagcagccacu

SEQ ID NO: 1727035 - RNA, 22 nt, Homo sapiens
gguaguuuguuuuaacuuccaa

SEQ ID NO: 1727036 - RNA, 23 nt, Homo sapiens
gguuacagcauaacuaggauuau

SEQ ID NO: 1727037 - RNA, 13 nt, Homo sapiens
gguucuucagugc

SEQ ID NO: 1727038 - RNA, 15 nt, Homo sapiens
guaaaaucugacaua

SEQ ID NO: 1727039 - RNA, 18 nt, Homo sapiens
guaaauaaaaucauguau

SEQ ID NO: 1727040 - RNA, 17 nt, Homo sapiens
guaaggagccuuuccag

SEQ ID NO: 1727041 - RNA, 12 nt, Homo sapiens
guacaucuggcc

SEQ ID NO: 1727042 - RNA, 13 nt, Homo sapiens
guacauguuacag

SEQ ID NO: 1727043 - RNA, 22 nt, Homo sapiens
guaguuucuugaggccaaacac

SEQ ID NO: 1727044 - RNA, 24 nt, Homo sapiens
guaugaaauuggaccugaacuguu

SEQ ID NO: 1727045 - RNA, 15 nt, Homo sapiens
gucaacaacuuacac

SEQ ID NO: 1727046 - RNA, 13 nt, Homo sapiens
gucagcacuguaa

SEQ ID NO: 1727047 - RNA, 13 nt, Homo sapiens
gucaucagauuau

SEQ ID NO: 1727048 - RNA, 13 nt, Homo sapiens
guccaucagugac

SEQ ID NO: 1727049 - RNA, 16 nt, Homo sapiens
guccuuacauacucaa

SEQ ID NO: 1727050 - RNA, 15 nt, Homo sapiens
gucggauuaccaaaa

SEQ ID NO: 1727051 - RNA, 18 nt, Homo sapiens
guuaaggguuaguuuaca

SEQ ID NO: 1727052 - RNA, 14 nt, Homo sapiens
guucuuuuacaaau

SEQ ID NO: 1727053 - RNA, 18 nt, Homo sapiens
guuggccugcacuggugu

SEQ ID NO: 1727054 - RNA, 15 nt, Homo sapiens
guuuacuagacuuug

SEQ ID NO: 1727055 - RNA, 14 nt, Homo sapiens
uaaaauagucucau

SEQ ID NO: 1727056 - RNA, 22 nt, Homo sapiens
uaaaauauccagugagcucuuu

SEQ ID NO: 1727057 - RNA, 19 nt, Homo sapiens
uaaacucagcuacugcaaa

SEQ ID NO: 1727058 - RNA, 16 nt, Homo sapiens
uaaacugaaaauggac

SEQ ID NO: 1727059 - RNA, 23 nt, Homo sapiens
uaaacuuguguauugagucuuaa

SEQ ID NO: 1727060 - RNA, 21 nt, Homo sapiens
uaaacuuucucaaauuauuaa

SEQ ID NO: 1727061 - RNA, 15 nt, Homo sapiens
uaaagauggcacuuu

SEQ ID NO: 1727062 - RNA, 21 nt, Homo sapiens
uaaagcuuuaucuuuguguaa

SEQ ID NO: 1727063 - RNA, 14 nt, Homo sapiens
uaaaguauguccuu

SEQ ID NO: 1727064 - RNA, 20 nt, Homo sapiens
uaaaguuuggacuuaucuau

SEQ ID NO: 1727065 - RNA, 17 nt, Homo sapiens
uaacuaaaugcucauac

SEQ ID NO: 1727066 - RNA, 23 nt, Homo sapiens
uaacuguauuucaguauuuucca

SEQ ID NO: 1727067 - RNA, 19 nt, Homo sapiens
uaagauccacaaaugaagg

SEQ ID NO: 1727068 - RNA, 18 nt, Homo sapiens
uaagccuugacacacugu

SEQ ID NO: 1727069 - RNA, 20 nt, Homo sapiens
uaagcuucuugucauucuuc

SEQ ID NO: 1727070 - RNA, 13 nt, Homo sapiens
uaaggagccuuuc

SEQ ID NO: 1727071 - RNA, 15 nt, Homo sapiens
uaagguaauguaggg

SEQ ID NO: 1727072 - RNA, 17 nt, Homo sapiens
uaaguaguaaucuguca

SEQ ID NO: 1727073 - RNA, 14 nt, Homo sapiens
uaagucuacauuaa

SEQ ID NO: 1727074 - RNA, 22 nt, Homo sapiens
uaaguucuuuuacaaauaucua

SEQ ID NO: 1727075 - RNA, 10 nt, Homo sapiens
uaaugaucau

SEQ ID NO: 1727076 - RNA, 17 nt, Homo sapiens
uaauggcaauaggacau

SEQ ID NO: 1727077 - RNA, 14 nt, Homo sapiens
uaauguacaucugg

SEQ ID NO: 1727078 - RNA, 13 nt, Homo sapiens
uaauugaucagau

SEQ ID NO: 1727079 - RNA, 13 nt, Homo sapiens
uacaaaaagaaga

SEQ ID NO: 1727080 - RNA, 21 nt, Homo sapiens
uacaacaaggcuagaguuugu

SEQ ID NO: 1727081 - RNA, 11 nt, Homo sapiens
uacaauuguga

SEQ ID NO: 1727082 - RNA, 23 nt, Homo sapiens
uacagauggagcaaauguccuaa

SEQ ID NO: 1727083 - RNA, 21 nt, Homo sapiens
uacaguuauuaaucuggacau

SEQ ID NO: 1727084 - RNA, 22 nt, Homo sapiens
uacauucugcaagcacaucugc

SEQ ID NO: 1727085 - RNA, 23 nt, Homo sapiens
uacauucuugguuguuaauuuag

SEQ ID NO: 1727086 - RNA, 21 nt, Homo sapiens
uacauuugaaaauauuugcac

SEQ ID NO: 1727087 - RNA, 14 nt, Homo sapiens
uaccaaaacacugc

SEQ ID NO: 1727088 - RNA, 15 nt, Homo sapiens
uacugcaaauuuugu

SEQ ID NO: 1727089 - RNA, 16 nt, Homo sapiens
uacuucauuucuagag

SEQ ID NO: 1727090 - RNA, 22 nt, Homo sapiens
uagaaaaaggauggaagaaaga

SEQ ID NO: 1727091 - RNA, 21 nt, Homo sapiens
uagaaaaggcagcuaaaggaa

SEQ ID NO: 1727092 - RNA, 23 nt, Homo sapiens
uagaaggacucaguauuauuuca

SEQ ID NO: 1727093 - RNA, 12 nt, Homo sapiens
uagaaugccaua

SEQ ID NO: 1727094 - RNA, 22 nt, Homo sapiens
uagagauggggucucacagugu

SEQ ID NO: 1727095 - RNA, 16 nt, Homo sapiens
uaggacauugugucag

SEQ ID NO: 1727096 - RNA, 15 nt, Homo sapiens
uaggauuaauaaaga

SEQ ID NO: 1727097 - RNA, 18 nt, Homo sapiens
uagguguacuguacugaa

SEQ ID NO: 1727098 - RNA, 20 nt, Homo sapiens
uagucuuacuaaaugcagaa

SEQ ID NO: 1727099 - RNA, 14 nt, Homo sapiens
uagugauuaccaaa

SEQ ID NO: 1727100 - RNA, 18 nt, Homo sapiens
uaguguauuuugcacaaa

SEQ ID NO: 1727101 - RNA, 17 nt, Homo sapiens
uaguuuaaaacaucaga

SEQ ID NO: 1727102 - RNA, 20 nt, Homo sapiens
uauaaagguggugggcaaaa

SEQ ID NO: 1727103 - RNA, 17 nt, Homo sapiens
uauaccaucuccagcua

SEQ ID NO: 1727104 - RNA, 16 nt, Homo sapiens
uauccuugaccaauaa

SEQ ID NO: 1727105 - RNA, 14 nt, Homo sapiens
uaucuagcauuuau

SEQ ID NO: 1727106 - RNA, 16 nt, Homo sapiens
uaucugcuuccauuaa

SEQ ID NO: 1727107 - RNA, 22 nt, Homo sapiens
uaugcucagggucaauuucuuu

SEQ ID NO: 1727108 - RNA, 15 nt, Homo sapiens
uauguguuacauuau

SEQ ID NO: 1727109 - RNA, 22 nt, Homo sapiens
uauucaugcugaggugauucag

SEQ ID NO: 1727110 - RNA, 13 nt, Homo sapiens
uauuggugcuaga

SEQ ID NO: 1727111 - RNA, 21 nt, Homo sapiens
uauuuuguaaugcugcacaga

SEQ ID NO: 1727112 - RNA, 18 nt, Homo sapiens
ucaaagggaguuuugcca

SEQ ID NO: 1727113 - RNA, 21 nt, Homo sapiens
ucaacuuacucauaaagggac

SEQ ID NO: 1727114 - RNA, 21 nt, Homo sapiens
ucaaggcccauaucugugaaa

SEQ ID NO: 1727115 - RNA, 18 nt, Homo sapiens
ucaaucauaauaccugcu

SEQ ID NO: 1727116 - RNA, 15 nt, Homo sapiens
ucacagagugcauug

SEQ ID NO: 1727117 - RNA, 16 nt, Homo sapiens
ucacagagugcauugu

SEQ ID NO: 1727118 - RNA, 17 nt, Homo sapiens
ucacaucuaaagcuuua

SEQ ID NO: 1727119 - RNA, 20 nt, Homo sapiens
ucaccaacugaaguggcuaa

SEQ ID NO: 1727120 - RNA, 19 nt, Homo sapiens
ucacuagaguucuuugaac

SEQ ID NO: 1727121 - RNA, 21 nt, Homo sapiens
ucacucaugcaaacugcuuua

SEQ ID NO: 1727122 - RNA, 17 nt, Homo sapiens
ucagacuuaaagcacug

SEQ ID NO: 1727123 - RNA, 18 nt, Homo sapiens
ucagacuuaaagcacuga

SEQ ID NO: 1727124 - RNA, 15 nt, Homo sapiens
ucagauacacuguga

SEQ ID NO: 1727125 - RNA, 17 nt, Homo sapiens
ucagcucuuccuguguu

SEQ ID NO: 1727126 - RNA, 20 nt, Homo sapiens
ucaggacgguugucacuuau

SEQ ID NO: 1727127 - RNA, 17 nt, Homo sapiens
ucaguauuauuucaaga

SEQ ID NO: 1727128 - RNA, 19 nt, Homo sapiens
ucaguuuuuuuuuuuccag

SEQ ID NO: 1727129 - RNA, 15 nt, Homo sapiens
ucauguaagauggca

SEQ ID NO: 1727130 - RNA, 13 nt, Homo sapiens
ucauucaaauacu

SEQ ID NO: 1727131 - RNA, 14 nt, Homo sapiens
ucauugaagcuuug

SEQ ID NO: 1727132 - RNA, 16 nt, Homo sapiens
ucauuuaggaguauua

SEQ ID NO: 1727133 - RNA, 21 nt, Homo sapiens
ucauuuuuuuccccauuguga

SEQ ID NO: 1727134 - RNA, 13 nt, Homo sapiens
uccaccugucuca

SEQ ID NO: 1727135 - RNA, 23 nt, Homo sapiens
uccaguuuuauaaaaaguggaga

SEQ ID NO: 1727136 - RNA, 17 nt, Homo sapiens
ucccacccccaucucuc

SEQ ID NO: 1727137 - RNA, 16 nt, Homo sapiens
uugcaaaaagauuuac

SEQ ID NO: 1727138 - RNA, 16 nt, Homo sapiens
uugccauacagcuuca

SEQ ID NO: 1727139 - RNA, 14 nt, Homo sapiens
uugcuacauucuaa

SEQ ID NO: 1727140 - RNA, 21 nt, Homo sapiens
uuggagucccagaauugcuga

SEQ ID NO: 1727141 - RNA, 21 nt, Homo sapiens
uuguaacgacuucuccaucuc

SEQ ID NO: 1727142 - RNA, 22 nt, Homo sapiens
uuguaacgacuucuccaucucc

SEQ ID NO: 1727143 - RNA, 19 nt, Homo sapiens
uuguagagauggggucuca

SEQ ID NO: 1727144 - RNA, 21 nt, Homo sapiens
uuguagagauggggucucaca

SEQ ID NO: 1727145 - RNA, 19 nt, Homo sapiens
uugugaauaguaagcauaa

SEQ ID NO: 1727146 - RNA, 18 nt, Homo sapiens
uuguggugugugcgcaca

SEQ ID NO: 1727147 - RNA, 16 nt, Homo sapiens
uugugucagauuacca

SEQ ID NO: 1727148 - RNA, 17 nt, Homo sapiens
uuguuuguggucacaga

SEQ ID NO: 1727149 - RNA, 15 nt, Homo sapiens
uuuaaaauucaauua

SEQ ID NO: 1727150 - RNA, 22 nt, Homo sapiens
uuuaaagcauauuggugcuaga

SEQ ID NO: 1727151 - RNA, 15 nt, Homo sapiens
uuuaagccuugacac

SEQ ID NO: 1727152 - RNA, 15 nt, Homo sapiens
uuuaagugacauaau

SEQ ID NO: 1727153 - RNA, 22 nt, Homo sapiens
uuuaauucaccccacacuagaa

SEQ ID NO: 1727154 - RNA, 14 nt, Homo sapiens
uuuacauucugcaa

SEQ ID NO: 1727155 - RNA, 14 nt, Homo sapiens
uuuaggaguauuau

SEQ ID NO: 1727156 - RNA, 21 nt, Homo sapiens
uuuaucacuacaagcuuuuaa

SEQ ID NO: 1727157 - RNA, 13 nt, Homo sapiens
uuuauccuugacc

SEQ ID NO: 1727158 - RNA, 22 nt, Homo sapiens
uuuccagacuuugaaacuauua

SEQ ID NO: 1727159 - RNA, 13 nt, Homo sapiens
uuucucauuaaau

SEQ ID NO: 1727160 - RNA, 18 nt, Homo sapiens
uuucuuuagcaugcuaca

SEQ ID NO: 1727161 - RNA, 18 nt, Homo sapiens
uuugaucuuuguuuaaau

SEQ ID NO: 1727162 - RNA, 20 nt, Homo sapiens
uuugcauugaugaauuuugu

SEQ ID NO: 1727163 - RNA, 18 nt, Homo sapiens
uuuggcuugcuguuuacu

SEQ ID NO: 1727164 - RNA, 15 nt, Homo sapiens
uuugggaagucucag

SEQ ID NO: 1727165 - RNA, 19 nt, Homo sapiens
uuugguuuucaucaugauu

SEQ ID NO: 1727166 - RNA, 14 nt, Homo sapiens
uuuguaaugcugca

SEQ ID NO: 1727167 - RNA, 15 nt, Homo sapiens
uuuguaaugcugcac

SEQ ID NO: 1727168 - RNA, 22 nt, Homo sapiens
uuuuaaguuugaaacuaacuca

SEQ ID NO: 1727169 - RNA, 20 nt, Homo sapiens
uuuuacccuauacauccaca

SEQ ID NO: 1727170 - RNA, 15 nt, Homo sapiens
uuuuacuuugguuua

SEQ ID NO: 1727171 - RNA, 19 nt, Homo sapiens
uuuucaauuugagauucua

SEQ ID NO: 1727172 - RNA, 13 nt, Homo sapiens
uuuucaccccacc

SEQ ID NO: 1727173 - RNA, 22 nt, Homo sapiens
uuuugugucaaaaggacauuua

SEQ ID NO: 1727174 - RNA, 22 nt, Homo sapiens
uuuuucuuugagacugggucuc

SEQ ID NO: 1727175 - RNA, 12 nt, Homo sapiens
uuuuugugucaa

SEQ ID NO: 1727176 - RNA, 17 nt, Homo sapiens
cugaaagaauaggauua

SEQ ID NO: 1727177 - RNA, 18 nt, Homo sapiens
cugaaauaaaaugauuaa

SEQ ID NO: 1727178 - RNA, 22 nt, Homo sapiens
cugacaauaugaauuaggugua

SEQ ID NO: 1727179 - RNA, 22 nt, Homo sapiens
cugagaucaaaaaaauauauga

SEQ ID NO: 1727180 - RNA, 18 nt, Homo sapiens
cugaguauuaaguaguaa

SEQ ID NO: 1727181 - RNA, 17 nt, Homo sapiens
cugagugacugcagcuu

SEQ ID NO: 1727182 - RNA, 11 nt, Homo sapiens
cugcacuggga

SEQ ID NO: 1727183 - RNA, 17 nt, Homo sapiens
cugcuuuccagacuuug

SEQ ID NO: 1727184 - RNA, 21 nt, Homo sapiens
cuggaaaugguuuaccuaaaa

SEQ ID NO: 1727185 - RNA, 14 nt, Homo sapiens
cuggaacacaaaac

SEQ ID NO: 1727186 - RNA, 22 nt, Homo sapiens
cuggaauuuucauacacguaaa

SEQ ID NO: 1727187 - RNA, 12 nt, Homo sapiens
cuggagugaaug

SEQ ID NO: 1727188 - RNA, 21 nt, Homo sapiens
cugggucucgcuuuguugccc

SEQ ID NO: 1727189 - RNA, 23 nt, Homo sapiens
cuggucucaaacuccugggcuca

SEQ ID NO: 1727190 - RNA, 13 nt, Homo sapiens
cugguuagguaga

SEQ ID NO: 1727191 - RNA, 17 nt, Homo sapiens
cuguaaucccagcacuu

SEQ ID NO: 1727192 - RNA, 20 nt, Homo sapiens
cuguauuuuacaagucaaaa

SEQ ID NO: 1727193 - RNA, 14 nt, Homo sapiens
cugucucagccucc

SEQ ID NO: 1727194 - RNA, 21 nt, Homo sapiens
cugugaaaugcuggcauuugc

SEQ ID NO: 1727195 - RNA, 13 nt, Homo sapiens
cuguggaugcuuc

SEQ ID NO: 1727196 - RNA, 17 nt, Homo sapiens
cuguguccaucagugac

SEQ ID NO: 1727197 - RNA, 18 nt, Homo sapiens
cuguguugucagcacugu

SEQ ID NO: 1727198 - RNA, 22 nt, Homo sapiens
cuuaaacucagcuacugcaaau

SEQ ID NO: 1727199 - RNA, 16 nt, Homo sapiens
cuuaaugauagucuua

SEQ ID NO: 1727200 - RNA, 23 nt, Homo sapiens
cuuaaugguaggucaaguaauaa

SEQ ID NO: 1727201 - RNA, 13 nt, Homo sapiens
cuuacaauggaca

SEQ ID NO: 1727202 - RNA, 17 nt, Homo sapiens
cuuauguguuacauuau

SEQ ID NO: 1727203 - RNA, 16 nt, Homo sapiens
cuuauucagaaugaga

SEQ ID NO: 1727204 - RNA, 18 nt, Homo sapiens
cuucagacuuaaagcacu

SEQ ID NO: 1727205 - RNA, 14 nt, Homo sapiens
cuucaugugcugcc

SEQ ID NO: 1727206 - RNA, 23 nt, Homo sapiens
cuucgcagaaaagagucggauua

SEQ ID NO: 1727207 - RNA, 21 nt, Homo sapiens
cuucuuuugucuuugauuaaa

SEQ ID NO: 1727208 - RNA, 16 nt, Homo sapiens
cuugaccaauaaccua

SEQ ID NO: 1727209 - RNA, 18 nt, Homo sapiens
cuugacccccuugagggu

SEQ ID NO: 1727210 - RNA, 20 nt, Homo sapiens
cuugagggugcuuguucccu

SEQ ID NO: 1727211 - RNA, 16 nt, Homo sapiens
cuugcuugcaauaggu

SEQ ID NO: 1727212 - RNA, 18 nt, Homo sapiens
cuuguuuuacccuauaca

SEQ ID NO: 1727213 - RNA, 22 nt, Homo sapiens
cuuguuuuacccuauacaucca

SEQ ID NO: 1727214 - RNA, 16 nt, Homo sapiens
cuuguuuuaugcucag

SEQ ID NO: 1727215 - RNA, 22 nt, Homo sapiens
cuuuagaaggacucaguauuau

SEQ ID NO: 1727216 - RNA, 15 nt, Homo sapiens
cuuuaucuuugugua

SEQ ID NO: 1727217 - RNA, 17 nt, Homo sapiens
cuuugagacugggucuc

SEQ ID NO: 1727218 - RNA, 23 nt, Homo sapiens
cuuugucccggggcuccacugaa

SEQ ID NO: 1727219 - RNA, 16 nt, Homo sapiens
cuuuuaaaauauucua

SEQ ID NO: 1727220 - RNA, 13 nt, Homo sapiens
cuuuuacauucug

SEQ ID NO: 1727221 - RNA, 12 nt, Homo sapiens
cuuuuauuacau

SEQ ID NO: 1727222 - RNA, 20 nt, Homo sapiens
gaaaaagaguuaagcaguuc

SEQ ID NO: 1727223 - RNA, 14 nt, Homo sapiens
gaaaacaauacuaa

SEQ ID NO: 1727224 - RNA, 15 nt, Homo sapiens
gaaaagagcuuugua

SEQ ID NO: 1727225 - RNA, 17 nt, Homo sapiens
gaaaggcccauggauca

SEQ ID NO: 1727226 - RNA, 20 nt, Homo sapiens
gaaaggucauuaaaccagau

SEQ ID NO: 1727227 - RNA, 18 nt, Homo sapiens
gaaaguauagauggccaa

SEQ ID NO: 1727228 - RNA, 12 nt, Homo sapiens
gaaauacuuuug

SEQ ID NO: 1727229 - RNA, 13 nt, Homo sapiens
gaaauagacuuug

SEQ ID NO: 1727230 - RNA, 17 nt, Homo sapiens
gaagauuuaugaugcac

SEQ ID NO: 1727231 - RNA, 18 nt, Homo sapiens
gaagcacacacacaaaaa

SEQ ID NO: 1727232 - RNA, 21 nt, Homo sapiens
gaauggagggaaugcucagaa

SEQ ID NO: 1727233 - RNA, 17 nt, Homo sapiens
gaauuagguguacugua

SEQ ID NO: 1727234 - RNA, 19 nt, Homo sapiens
gaauuggcauaauuugucu

SEQ ID NO: 1727235 - RNA, 18 nt, Homo sapiens
gaauuggccgcugucacu

SEQ ID NO: 1727236 - RNA, 23 nt, Homo sapiens
gaccuuuuuuuuuuuaauggcaa

SEQ ID NO: 1727237 - RNA, 14 nt, Homo sapiens
gacugauguguaua

SEQ ID NO: 1727238 - RNA, 16 nt, Homo sapiens
gacuuaaagcacugau

SEQ ID NO: 1727239 - RNA, 12 nt, Homo sapiens
gagaaaugccag

SEQ ID NO: 1727240 - RNA, 15 nt, Homo sapiens
gagcagguagggcuu

SEQ ID NO: 1727241 - RNA, 17 nt, Homo sapiens
gagcaguccugccucag

SEQ ID NO: 1727242 - RNA, 20 nt, Homo sapiens
gagccaccacguccagcugg

SEQ ID NO: 1727243 - RNA, 24 nt, Homo sapiens
gagccuuguggugugugcgcacac

SEQ ID NO: 1727244 - RNA, 19 nt, Homo sapiens
gaggcuuugcugcugugaa

SEQ ID NO: 1727245 - RNA, 9 nt, Homo sapiens
gagugaaug

SEQ ID NO: 1727246 - RNA, 19 nt, Homo sapiens
gagugcauugugaggguua

SEQ ID NO: 1727247 - RNA, 21 nt, Homo sapiens
gagugcugacccaacagccuc

SEQ ID NO: 1727248 - RNA, 17 nt, Homo sapiens
gaguugagcagccuuuc

SEQ ID NO: 1727249 - RNA, 16 nt, Homo sapiens
gaguugcagcucugua

SEQ ID NO: 1727250 - RNA, 18 nt, Homo sapiens
gaguuuuaaaaaugcaaa

SEQ ID NO: 1727251 - RNA, 11 nt, Homo sapiens
gauacacugug

SEQ ID NO: 1727252 - RNA, 14 nt, Homo sapiens
gauagcuacuguag

SEQ ID NO: 1727253 - RNA, 15 nt, Homo sapiens
gauaucuuugcugcu

SEQ ID NO: 1727254 - RNA, 17 nt, Homo sapiens
gauaucuuugcugcuuu

SEQ ID NO: 1727255 - RNA, 21 nt, Homo sapiens
gauccaccugucucagccucc

SEQ ID NO: 1727256 - RNA, 17 nt, Homo sapiens
gauggcaacuguauuaa

SEQ ID NO: 1727257 - RNA, 14 nt, Homo sapiens
gauuaaugaucaua

SEQ ID NO: 1727258 - RNA, 23 nt, Homo sapiens
gauuauuuuaucacuacaagcuu

SEQ ID NO: 1727259 - RNA, 18 nt, Homo sapiens
gcaaaaagauuuacuuug

SEQ ID NO: 1727260 - RNA, 21 nt, Homo sapiens
gcaacagauaaguuugcaguu

SEQ ID NO: 1727261 - RNA, 22 nt, Homo sapiens
gcacacucaaguccugcaguca

SEQ ID NO: 1727262 - RNA, 22 nt, Homo sapiens
gcacccaggacuuccauuugcu

SEQ ID NO: 1727263 - RNA, 12 nt, Homo sapiens
gcaccuaccuca

SEQ ID NO: 1727264 - RNA, 15 nt, Homo sapiens
gcacuaacacugggu

SEQ ID NO: 1727265 - RNA, 22 nt, Homo sapiens
gcagaggcuuugcugcugugaa

SEQ ID NO: 1727266 - RNA, 21 nt, Homo sapiens
gcagccacuaccccugaugag

SEQ ID NO: 1727267 - RNA, 20 nt, Homo sapiens
gcagcuaaaggaagugaauc

SEQ ID NO: 1727268 - RNA, 15 nt, Homo sapiens
aaugauuaaugcauu

SEQ ID NO: 1727269 - RNA, 18 nt, Homo sapiens
aaugcccauuuuugcuaa

SEQ ID NO: 1727270 - RNA, 17 nt, Homo sapiens
aaugcuggcauuugcac

SEQ ID NO: 1727271 - RNA, 12 nt, Homo sapiens
aauuaauggaca

SEQ ID NO: 1727272 - RNA, 17 nt, Homo sapiens
aauuauuaaaaaugccu

SEQ ID NO: 1727273 - RNA, 13 nt, Homo sapiens
aauugacaaugau

SEQ ID NO: 1727274 - RNA, 17 nt, Homo sapiens
aauugacaaugauuuau

SEQ ID NO: 1727275 - RNA, 15 nt, Homo sapiens
acaagacacauuugu

SEQ ID NO: 1727276 - RNA, 13 nt, Homo sapiens
acaagcucagcuc

SEQ ID NO: 1727277 - RNA, 22 nt, Homo sapiens
acaaugaccaaggacugcuaca

SEQ ID NO: 1727278 - RNA, 22 nt, Homo sapiens
acacugugauaaguucuuuuac

SEQ ID NO: 1727279 - RNA, 18 nt, Homo sapiens
acacuuguuguccaguug

SEQ ID NO: 1727280 - RNA, 20 nt, Homo sapiens
acagaaguauuuuaauucac

SEQ ID NO: 1727281 - RNA, 23 nt, Homo sapiens
acagacaauaauuuaacaagcuc

SEQ ID NO: 1727282 - RNA, 13 nt, Homo sapiens
acagagugcauug

SEQ ID NO: 1727283 - RNA, 19 nt, Homo sapiens
acagaugcacaacacuccu

SEQ ID NO: 1727284 - RNA, 18 nt, Homo sapiens
acagcugaaaagagcuuu

SEQ ID NO: 1727285 - RNA, 20 nt, Homo sapiens
acagcugaaaagagcuuugu

SEQ ID NO: 1727286 - RNA, 20 nt, Homo sapiens
acagcuucacuagaguucuu

SEQ ID NO: 1727287 - RNA, 16 nt, Homo sapiens
acagguuuguucucag

SEQ ID NO: 1727288 - RNA, 17 nt, Homo sapiens
acauaguguauuuugca

SEQ ID NO: 1727289 - RNA, 10 nt, Homo sapiens
acaucugccu

SEQ ID NO: 1727290 - RNA, 13 nt, Homo sapiens
acaucuuuuacau

SEQ ID NO: 1727291 - RNA, 16 nt, Homo sapiens
acauucuguguucaca

SEQ ID NO: 1727292 - RNA, 17 nt, Homo sapiens
acauucuguguucacau

SEQ ID NO: 1727293 - RNA, 17 nt, Homo sapiens
acauuuaguaaaugcug

SEQ ID NO: 1727294 - RNA, 14 nt, Homo sapiens
accaaaacacugcc

SEQ ID NO: 1727295 - RNA, 20 nt, Homo sapiens
accaauaaccuaauugucua

SEQ ID NO: 1727296 - RNA, 15 nt, Homo sapiens
accaauuuauccuug

SEQ ID NO: 1727297 - RNA, 16 nt, Homo sapiens
accauauaccaucucc

SEQ ID NO: 1727298 - RNA, 22 nt, Homo sapiens
accccaguaccgacuaagcaaa

SEQ ID NO: 1727299 - RNA, 23 nt, Homo sapiens
accuaaaaggaaaucucacccca

SEQ ID NO: 1727300 - RNA, 19 nt, Homo sapiens
accuaauugucuauuccug

SEQ ID NO: 1727301 - RNA, 15 nt, Homo sapiens
accucugauuacaau

SEQ ID NO: 1727302 - RNA, 16 nt, Homo sapiens
accuggaacacaaaac

SEQ ID NO: 1727303 - RNA, 21 nt, Homo sapiens
accugguguaugaaauuggac

SEQ ID NO: 1727304 - RNA, 16 nt, Homo sapiens
acuaaaaguacauuaa

SEQ ID NO: 1727305 - RNA, 12 nt, Homo sapiens
acuaacacuggg

SEQ ID NO: 1727306 - RNA, 19 nt, Homo sapiens
acuaagcaaauaggcaaaa

SEQ ID NO: 1727307 - RNA, 13 nt, Homo sapiens
acuacaucugccu

SEQ ID NO: 1727308 - RNA, 19 nt, Homo sapiens
acuaccugguguaugaaau

SEQ ID NO: 1727309 - RNA, 19 nt, Homo sapiens
acuccaggucuaaacagcu

SEQ ID NO: 1727310 - RNA, 15 nt, Homo sapiens
acuccgucucaaaaa

SEQ ID NO: 1727311 - RNA, 18 nt, Homo sapiens
acucuggaccauauacca

SEQ ID NO: 1727312 - RNA, 13 nt, Homo sapiens
acugacucuguua

SEQ ID NO: 1727313 - RNA, 19 nt, Homo sapiens
acuguauuuuacaagucaa

SEQ ID NO: 1727314 - RNA, 17 nt, Homo sapiens
acuuaaaauagucucau

SEQ ID NO: 1727315 - RNA, 14 nt, Homo sapiens
acuuaaagcacuga

SEQ ID NO: 1727316 - RNA, 14 nt, Homo sapiens
acuuagaaugccau

SEQ ID NO: 1727317 - RNA, 13 nt, Homo sapiens
acuuccauuugcu

SEQ ID NO: 1727318 - RNA, 20 nt, Homo sapiens
acuugggaucugcaagaagg

SEQ ID NO: 1727319 - RNA, 18 nt, Homo sapiens
acuuucucaaauuauuaa

SEQ ID NO: 1727320 - RNA, 22 nt, Homo sapiens
agaaaagagucggauuaccaaa

SEQ ID NO: 1727321 - RNA, 20 nt, Homo sapiens
agaaaaggcagcuaaaggaa

SEQ ID NO: 1727322 - RNA, 19 nt, Homo sapiens
agaaauaagaauaaacuuu

SEQ ID NO: 1727323 - RNA, 12 nt, Homo sapiens
agaaguuacuaa

SEQ ID NO: 1727324 - RNA, 15 nt, Homo sapiens
agaaguuacuaagua

SEQ ID NO: 1727325 - RNA, 17 nt, Homo sapiens
agacccgaacuggccug

SEQ ID NO: 1727326 - RNA, 20 nt, Homo sapiens
agacugggucucgcuuuguu

SEQ ID NO: 1727327 - RNA, 21 nt, Homo sapiens
agacugggucucgcuuuguug

SEQ ID NO: 1727328 - RNA, 14 nt, Homo sapiens
agacuuugcuguua

SEQ ID NO: 1727329 - RNA, 19 nt, Homo sapiens
agaggcgaaagcaguggcu

SEQ ID NO: 1727330 - RNA, 16 nt, Homo sapiens
agagucggauuaccaa

SEQ ID NO: 1727331 - RNA, 10 nt, Homo sapiens
agagugaaug

SEQ ID NO: 1727332 - RNA, 19 nt, Homo sapiens
agaguuguuguuugccaag

SEQ ID NO: 1727333 - RNA, 17 nt, Homo sapiens
agauauccaaaugauag

SEQ ID NO: 1727334 - RNA, 16 nt, Homo sapiens
agaugcuucucuugcu

SEQ ID NO: 1727335 - RNA, 18 nt, Homo sapiens
agcacugauaggacuuaa

SEQ ID NO: 1727336 - RNA, 14 nt, Homo sapiens
agccaacuuuugca

SEQ ID NO: 1727337 - RNA, 12 nt, Homo sapiens
agccguguucag

SEQ ID NO: 1727338 - RNA, 17 nt, Homo sapiens
agccuuucugcugauua

SEQ ID NO: 1727339 - RNA, 14 nt, Homo sapiens
agcucuacuggaau

SEQ ID NO: 1727340 - RNA, 16 nt, Homo sapiens
agcucuuccuguguuu

SEQ ID NO: 1727341 - RNA, 13 nt, Homo sapiens
agcugacccagug

SEQ ID NO: 1727342 - RNA, 22 nt, Homo sapiens
agcuggaagggucaacaucuuu

SEQ ID NO: 1727343 - RNA, 23 nt, Homo sapiens
agcuggaagggucaacaucuuuu

SEQ ID NO: 1727344 - RNA, 20 nt, Homo sapiens
aggaauuggccgcugucacu

SEQ ID NO: 1727345 - RNA, 20 nt, Homo sapiens
aggacuuaaaauagucucau

SEQ ID NO: 1727346 - RNA, 14 nt, Homo sapiens
aggagccaccagca

SEQ ID NO: 1727347 - RNA, 15 nt, Homo sapiens
aggauuaaugaucau

SEQ ID NO: 1727348 - RNA, 18 nt, Homo sapiens
aggccacccggcacuggc

SEQ ID NO: 1727349 - RNA, 12 nt, Homo sapiens
aggccagugcua

SEQ ID NO: 1727350 - RNA, 16 nt, Homo sapiens
aggcuaucaacaaaga

SEQ ID NO: 1727351 - RNA, 21 nt, Homo sapiens
agggaagcugucccucacugu

SEQ ID NO: 1727352 - RNA, 22 nt, Homo sapiens
agggaagcugucccucacuguu

SEQ ID NO: 1727353 - RNA, 16 nt, Homo sapiens
agggcucacaagacac

SEQ ID NO: 1727354 - RNA, 13 nt, Homo sapiens
aggggaauggagg

SEQ ID NO: 1727355 - RNA, 13 nt, Homo sapiens
agguaauggacuc

SEQ ID NO: 1727356 - RNA, 19 nt, Homo sapiens
agguaggggcccacuucac

SEQ ID NO: 1727357 - RNA, 15 nt, Homo sapiens
agguuuuuacuguga

SEQ ID NO: 1727358 - RNA, 22 nt, Homo sapiens
aguaaauaugguucuugccaaa

SEQ ID NO: 1727359 - RNA, 21 nt, Homo sapiens
aguaaucugucaguuauuaaa

SEQ ID NO: 1727360 - RNA, 14 nt, Homo sapiens
aguaugaaguauaa

SEQ ID NO: 1727361 - RNA, 16 nt, Homo sapiens
agucucagcagcucuu

SEQ ID NO: 1727362 - RNA, 17 nt, Homo sapiens
agucucagcagcucuuc

SEQ ID NO: 1727363 - RNA, 21 nt, Homo sapiens
agucuugugggggcagcuuuu

SEQ ID NO: 1727364 - RNA, 18 nt, Homo sapiens
agugacugcaagcauuuu

SEQ ID NO: 1727365 - RNA, 18 nt, Homo sapiens
agugauagcuacuguaga

SEQ ID NO: 1727366 - RNA, 17 nt, Homo sapiens
agugcugggauuacaau

SEQ ID NO: 1727367 - RNA, 21 nt, Homo sapiens
aguuauaggaacaauucucuu

SEQ ID NO: 1727368 - RNA, 14 nt, Homo sapiens
aguucgacaaauau

SEQ ID NO: 1727369 - RNA, 18 nt, Homo sapiens
aguucuuugaaccacagc

SEQ ID NO: 1727370 - RNA, 17 nt, Homo sapiens
aguucuuuuacaaauau

SEQ ID NO: 1727371 - RNA, 23 nt, Homo sapiens
aguuuaaggguggaaaaaugccc

SEQ ID NO: 1727372 - RNA, 16 nt, Homo sapiens
aguuuacaaucagcca

SEQ ID NO: 1727373 - RNA, 18 nt, Homo sapiens
auaaacaucugaucugua

SEQ ID NO: 1727374 - RNA, 22 nt, Homo sapiens
auaaagucauccucucacugca

SEQ ID NO: 1727375 - RNA, 19 nt, Homo sapiens
auaaauagaaagaguucua

SEQ ID NO: 1727376 - RNA, 12 nt, Homo sapiens
auaauaaucaug

SEQ ID NO: 1727377 - RNA, 22 nt, Homo sapiens
auaaugcugccucauuuucaca

SEQ ID NO: 1727378 - RNA, 19 nt, Homo sapiens
auaauuugucuuaguugau

SEQ ID NO: 1727379 - RNA, 22 nt, Homo sapiens
auacauccacaggguuuugaca

SEQ ID NO: 1727380 - RNA, 18 nt, Homo sapiens
auaggcauuucacaaaaa

SEQ ID NO: 1727381 - RNA, 22 nt, Homo sapiens
ggcuguuuuucagauacacugu

SEQ ID NO: 1727382 - RNA, 20 nt, Homo sapiens
gggaguaggacauaccagcu

SEQ ID NO: 1727383 - RNA, 19 nt, Homo sapiens
gggucucacaguguugccc

SEQ ID NO: 1727384 - RNA, 21 nt, Homo sapiens
gggucucgcuuuguugcccag

SEQ ID NO: 1727385 - RNA, 21 nt, Homo sapiens
ggguuaguuuacaaucagcca

SEQ ID NO: 1727386 - RNA, 20 nt, Homo sapiens
ggugaaccuuaguaccuaaa

SEQ ID NO: 1727387 - RNA, 20 nt, Homo sapiens
guaaucuuuaacugaacucu

SEQ ID NO: 1727388 - RNA, 15 nt, Homo sapiens
guaauuuaaugcugc

SEQ ID NO: 1727389 - RNA, 22 nt, Homo sapiens
guaccacucacgagagcugaug

SEQ ID NO: 1727390 - RNA, 19 nt, Homo sapiens
guacuccacaaacaugggu

SEQ ID NO: 1727391 - RNA, 13 nt, Homo sapiens
guaggacauacca

SEQ ID NO: 1727392 - RNA, 21 nt, Homo sapiens
gucaacaucuuuuacauucug

SEQ ID NO: 1727393 - RNA, 15 nt, Homo sapiens
gucauuaaaccagau

SEQ ID NO: 1727394 - RNA, 20 nt, Homo sapiens
gucccggggcuccacugaac

SEQ ID NO: 1727395 - RNA, 17 nt, Homo sapiens
guccugccucagccucc

SEQ ID NO: 1727396 - RNA, 20 nt, Homo sapiens
gucucauucaaauacuguau

SEQ ID NO: 1727397 - RNA, 18 nt, Homo sapiens
gucugaacaaaaccaaag

SEQ ID NO: 1727398 - RNA, 15 nt, Homo sapiens
gucuuacaauggaca

SEQ ID NO: 1727399 - RNA, 20 nt, Homo sapiens
gucuucagaggcucaucuaa

SEQ ID NO: 1727400 - RNA, 14 nt, Homo sapiens
gucuuugaacccuu

SEQ ID NO: 1727401 - RNA, 19 nt, Homo sapiens
gugaaaugcuggcauuugc

SEQ ID NO: 1727402 - RNA, 13 nt, Homo sapiens
gugcagaacaaau

SEQ ID NO: 1727403 - RNA, 16 nt, Homo sapiens
guguugucagcacugu

SEQ ID NO: 1727404 - RNA, 14 nt, Homo sapiens
guuaagcauuccuu

SEQ ID NO: 1727405 - RNA, 23 nt, Homo sapiens
guuacaaauuuuuuaauuuccaa

SEQ ID NO: 1727406 - RNA, 15 nt, Homo sapiens
guuaccaaguaugaa

SEQ ID NO: 1727407 - RNA, 14 nt, Homo sapiens
guuccccacugaca

SEQ ID NO: 1727408 - RNA, 21 nt, Homo sapiens
auaguagaaagacaucugccu

SEQ ID NO: 1727409 - RNA, 22 nt, Homo sapiens
auaguguauaugcuaacuggau

SEQ ID NO: 1727410 - RNA, 15 nt, Homo sapiens
auaguguauuuugca

SEQ ID NO: 1727411 - RNA, 18 nt, Homo sapiens
auauaggcauuucacaaa

SEQ ID NO: 1727412 - RNA, 14 nt, Homo sapiens
aucaagagggauaa

SEQ ID NO: 1727413 - RNA, 14 nt, Homo sapiens
auccuuucccuuac

SEQ ID NO: 1727414 - RNA, 13 nt, Homo sapiens
aucuagcauuuau

SEQ ID NO: 1727415 - RNA, 16 nt, Homo sapiens
aucucaccccauccca

SEQ ID NO: 1727416 - RNA, 18 nt, Homo sapiens
aucugcauuuucacccca

SEQ ID NO: 1727417 - RNA, 22 nt, Homo sapiens
aucugcuuccauuaaaagcaua

SEQ ID NO: 1727418 - RNA, 14 nt, Homo sapiens
aucuuaagauccac

SEQ ID NO: 1727419 - RNA, 16 nt, Homo sapiens
aucuuaagauccacaa

SEQ ID NO: 1727420 - RNA, 20 nt, Homo sapiens
aucuuuguuuaaaugccaaa

SEQ ID NO: 1727421 - RNA, 22 nt, Homo sapiens
augaaauuggaccugaacuguu

SEQ ID NO: 1727422 - RNA, 21 nt, Homo sapiens
augaguuacuuagaaugccau

SEQ ID NO: 1727423 - RNA, 17 nt, Homo sapiens
augaucuggauccacca

SEQ ID NO: 1727424 - RNA, 13 nt, Homo sapiens
augaugcacuuau

SEQ ID NO: 1727425 - RNA, 19 nt, Homo sapiens
augcguguguaauagagcc

SEQ ID NO: 1727426 - RNA, 15 nt, Homo sapiens
guugucagcacugua

SEQ ID NO: 1727427 - RNA, 15 nt, Homo sapiens
guuuaaaugccaaaa

SEQ ID NO: 1727428 - RNA, 16 nt, Homo sapiens
guuucuaaaacagaca

SEQ ID NO: 1727429 - RNA, 16 nt, Homo sapiens
guuuugcuacauucua

SEQ ID NO: 1727430 - RNA, 14 nt, Homo sapiens
uaaaaguacauuaa

SEQ ID NO: 1727431 - RNA, 22 nt, Homo sapiens
uaaaauauuuuguaaugcugca

SEQ ID NO: 1727432 - RNA, 21 nt, Homo sapiens
uaaacuuuugguuuucagaua

SEQ ID NO: 1727433 - RNA, 20 nt, Homo sapiens
uaaagcacugauaggacuua

SEQ ID NO: 1727434 - RNA, 15 nt, Homo sapiens
uaaagcauauuggug

SEQ ID NO: 1727435 - RNA, 18 nt, Homo sapiens
uaaagcauauuggugcua

SEQ ID NO: 1727436 - RNA, 12 nt, Homo sapiens
uaaagcuuuauc

SEQ ID NO: 1727437 - RNA, 17 nt, Homo sapiens
uaaagggagaaaugcca

SEQ ID NO: 1727438 - RNA, 18 nt, Homo sapiens
uaaagggagaaaugccag

SEQ ID NO: 1727439 - RNA, 11 nt, Homo sapiens
uaaagugaauu

SEQ ID NO: 1727440 - RNA, 11 nt, Homo sapiens
uaaaucaugca

SEQ ID NO: 1727441 - RNA, 12 nt, Homo sapiens
uaaaugaacuca

SEQ ID NO: 1727442 - RNA, 12 nt, Homo sapiens
uaaaugcucaua

SEQ ID NO: 1727443 - RNA, 20 nt, Homo sapiens
uaaauuaguuugacacugcu

SEQ ID NO: 1727444 - RNA, 13 nt, Homo sapiens
uaacucauagauu

SEQ ID NO: 1727445 - RNA, 20 nt, Homo sapiens
uaacucuguccuuacauacu

SEQ ID NO: 1727446 - RNA, 21 nt, Homo sapiens
uaagaaagaaaggaaagaagg

SEQ ID NO: 1727447 - RNA, 21 nt, Homo sapiens
uaagccuugacacacuguguu

SEQ ID NO: 1727448 - RNA, 16 nt, Homo sapiens
uaaggagccuuuccag

SEQ ID NO: 1727449 - RNA, 22 nt, Homo sapiens
uaaggcaggagaauggcgugaa

SEQ ID NO: 1727450 - RNA, 23 nt, Homo sapiens
uaagugccaacaauuuucuagau

SEQ ID NO: 1727451 - RNA, 13 nt, Homo sapiens
uaaucaugcucau

SEQ ID NO: 1727452 - RNA, 19 nt, Homo sapiens
uaaucuuuaacugaacucu

SEQ ID NO: 1727453 - RNA, 22 nt, Homo sapiens
uaaugaaauaauguacaucugg

SEQ ID NO: 1727454 - RNA, 22 nt, Homo sapiens
uaaugucauagguaagaaacac

SEQ ID NO: 1727455 - RNA, 14 nt, Homo sapiens
uaauuuaacaagcu

SEQ ID NO: 1727456 - RNA, 21 nt, Homo sapiens
uacaauaaaacuuugcugcca

SEQ ID NO: 1727457 - RNA, 12 nt, Homo sapiens
uacaauugugag

SEQ ID NO: 1727458 - RNA, 17 nt, Homo sapiens
uacaccucugauuacaa

SEQ ID NO: 1727459 - RNA, 12 nt, Homo sapiens
uacacugugaua

SEQ ID NO: 1727460 - RNA, 20 nt, Homo sapiens
uacacugugauaaguucuuu

SEQ ID NO: 1727461 - RNA, 20 nt, Homo sapiens
uacacuuauuuuacuaguuu

SEQ ID NO: 1727462 - RNA, 14 nt, Homo sapiens
uacauuuaggcauu

SEQ ID NO: 1727463 - RNA, 23 nt, Homo sapiens
uaccucacagagugcauugugag

SEQ ID NO: 1727464 - RNA, 20 nt, Homo sapiens
uaccugcuguggaugcuuca

SEQ ID NO: 1727465 - RNA, 12 nt, Homo sapiens
uacuagacuuug

SEQ ID NO: 1727466 - RNA, 14 nt, Homo sapiens
uacucauaaaggga

SEQ ID NO: 1727467 - RNA, 15 nt, Homo sapiens
uacuuagaaugccau

SEQ ID NO: 1727468 - RNA, 22 nt, Homo sapiens
uacuugaaacagucacuaucau

SEQ ID NO: 1727469 - RNA, 21 nt, Homo sapiens
uagaagaaagaaaauggaaag

SEQ ID NO: 1727470 - RNA, 22 nt, Homo sapiens
uagacuuuguaugaacucuuua

SEQ ID NO: 1727471 - RNA, 22 nt, Homo sapiens
uaguauuuaacuacaucugccu

SEQ ID NO: 1727472 - RNA, 17 nt, Homo sapiens
uagugauuaccaaaaua

SEQ ID NO: 1727473 - RNA, 16 nt, Homo sapiens
uaguugccgccaaaca

SEQ ID NO: 1727474 - RNA, 18 nt, Homo sapiens
uaguuucuugaggccaaa

SEQ ID NO: 1727475 - RNA, 23 nt, Homo sapiens
uaucacuaagaaagaaaggaaag

SEQ ID NO: 1727476 - RNA, 20 nt, Homo sapiens
uauccuuccucucugugaug

SEQ ID NO: 1727477 - RNA, 13 nt, Homo sapiens
uaucgaucucuua

SEQ ID NO: 1727478 - RNA, 11 nt, Homo sapiens
uaucugugaaa

SEQ ID NO: 1727479 - RNA, 22 nt, Homo sapiens
uaugcuggacucuggaccauau

SEQ ID NO: 1727480 - RNA, 22 nt, Homo sapiens
uauggccugacaauaugaauua

SEQ ID NO: 1727481 - RNA, 16 nt, Homo sapiens
ucacaguguugcccag

SEQ ID NO: 1727482 - RNA, 22 nt, Homo sapiens
ucacauccuaccccuuugcacu

SEQ ID NO: 1727483 - RNA, 17 nt, Homo sapiens
ucacuacaaaaagaaga

SEQ ID NO: 1727484 - RNA, 13 nt, Homo sapiens
ucagauaugcuua

SEQ ID NO: 1727485 - RNA, 12 nt, Homo sapiens
ucagcacuguaa

SEQ ID NO: 1727486 - RNA, 19 nt, Homo sapiens
ucaggaccccugcauuuac

SEQ ID NO: 1727487 - RNA, 15 nt, Homo sapiens
ucagggcggaacucu

SEQ ID NO: 1727488 - RNA, 14 nt, Homo sapiens
ucaguauuuuccag

SEQ ID NO: 1727489 - RNA, 16 nt, Homo sapiens
ucagugaccaccaaca

SEQ ID NO: 1727490 - RNA, 15 nt, Homo sapiens
ucaucauugauuguu

SEQ ID NO: 1727491 - RNA, 15 nt, Homo sapiens
ucaugcucauguaua

SEQ ID NO: 1727492 - RNA, 14 nt, Homo sapiens
ucauguauauaccu

SEQ ID NO: 1727493 - RNA, 16 nt, Homo sapiens
ucauucaaauacugua

SEQ ID NO: 1727494 - RNA, 17 nt, Homo sapiens
ucauuuucacagcacua

SEQ ID NO: 1727495 - RNA, 22 nt, Homo sapiens
uccaaugauacccaacaguuua

SEQ ID NO: 1727496 - RNA, 23 nt, Homo sapiens
uccagcuggaagggucaacaucu

SEQ ID NO: 1727497 - RNA, 21 nt, Homo sapiens
uccaguuauaagcguauuuag

SEQ ID NO: 1727498 - RNA, 15 nt, Homo sapiens
uccauuugcuuuguc

SEQ ID NO: 1727499 - RNA, 18 nt, Homo sapiens
ucccucacuguugaauuu

SEQ ID NO: 1727500 - RNA, 23 nt, Homo sapiens
ucccuuuuuauaucccauuuuua

SEQ ID NO: 1727501 - RNA, 15 nt, Homo sapiens
uccugacucacugac

SEQ ID NO: 1727502 - RNA, 20 nt, Homo sapiens
uccuucuuacagaaguauuu

SEQ ID NO: 1727503 - RNA, 16 nt, Homo sapiens
ucgcuuuguugcccag

SEQ ID NO: 1727504 - RNA, 19 nt, Homo sapiens
ucuccacuucuuguucccc

SEQ ID NO: 1727505 - RNA, 21 nt, Homo sapiens
ucugcugauuaucacacauca

SEQ ID NO: 1727506 - RNA, 21 nt, Homo sapiens
ucuguauugggguacaggaau

SEQ ID NO: 1727507 - RNA, 13 nt, Homo sapiens
ucugucaccaacu

SEQ ID NO: 1727508 - RNA, 13 nt, Homo sapiens
ucuguccuuacau

SEQ ID NO: 1727509 - RNA, 20 nt, Homo sapiens
ucuguuuuucuucugaaaua

SEQ ID NO: 1727510 - RNA, 22 nt, Homo sapiens
ucuucagacuuaaagcacugau

SEQ ID NO: 1727511 - RNA, 20 nt, Homo sapiens
ucuuggauuuuuaaaccaca

SEQ ID NO: 1727512 - RNA, 23 nt, Homo sapiens
ucuuugugcaguguuaguauuca

SEQ ID NO: 1727513 - RNA, 17 nt, Homo sapiens
gugaaccuuaguaccua

SEQ ID NO: 1727514 - RNA, 17 nt, Homo sapiens
gugaacgucacauuggc

SEQ ID NO: 1727515 - RNA, 22 nt, Homo sapiens
gugaguuuuacucuuaaaucau

SEQ ID NO: 1727516 - RNA, 23 nt, Homo sapiens
gugauauacugguucacauccua

SEQ ID NO: 1727517 - RNA, 18 nt, Homo sapiens
guggucacagaugcacaa

SEQ ID NO: 1727518 - RNA, 20 nt, Homo sapiens
guuaggggaauggagggaau

SEQ ID NO: 1727519 - RNA, 16 nt, Homo sapiens
guuauuguacaaguau

SEQ ID NO: 1727520 - RNA, 17 nt, Homo sapiens
guucauugaagcuuugu

SEQ ID NO: 1727521 - RNA, 13 nt, Homo sapiens
guuuaaaugccaa

SEQ ID NO: 1727522 - RNA, 23 nt, Homo sapiens
guuuccgaaggguuuugcuacau

SEQ ID NO: 1727523 - RNA, 21 nt, Homo sapiens
guuugccaagcuaaucugccu

SEQ ID NO: 1727524 - RNA, 23 nt, Homo sapiens
guuuuguagagauggggucucac

SEQ ID NO: 1727525 - RNA, 20 nt, Homo sapiens
uaaaaaugccuacacaguaa

SEQ ID NO: 1727526 - RNA, 16 nt, Homo sapiens
uaaaaauugacaauga

SEQ ID NO: 1727527 - RNA, 17 nt, Homo sapiens
uaaaagaaaaaugcugu

SEQ ID NO: 1727528 - RNA, 13 nt, Homo sapiens
uaaaauagucuca

SEQ ID NO: 1727529 - RNA, 17 nt, Homo sapiens
uaaaauucagaugcugu

SEQ ID NO: 1727530 - RNA, 13 nt, Homo sapiens
uaaacuaguuuaa

SEQ ID NO: 1727531 - RNA, 17 nt, Homo sapiens
uaaagacaaagcauucu

SEQ ID NO: 1727532 - RNA, 18 nt, Homo sapiens
uaaagcaaagugagucau

SEQ ID NO: 1727533 - RNA, 22 nt, Homo sapiens
uaaaguauguccuucagcugac

SEQ ID NO: 1727534 - RNA, 15 nt, Homo sapiens
uaagaaggcacuuaa

SEQ ID NO: 1727535 - RNA, 22 nt, Homo sapiens
uaagacugcuucuaggcuuuau

SEQ ID NO: 1727536 - RNA, 20 nt, Homo sapiens
uaagauggcaacuguauuaa

SEQ ID NO: 1727537 - RNA, 16 nt, Homo sapiens
uaaguauuaaguauua

SEQ ID NO: 1727538 - RNA, 19 nt, Homo sapiens
uaagugaauuuaugagauu

SEQ ID NO: 1727539 - RNA, 19 nt, Homo sapiens
uaaucaaggccagugcuaa

SEQ ID NO: 1727540 - RNA, 13 nt, Homo sapiens
uaaucaugaucac

SEQ ID NO: 1727541 - RNA, 14 nt, Homo sapiens
uaaucccagcacuu

SEQ ID NO: 1727542 - RNA, 17 nt, Homo sapiens
uaaugcauuuaucaaua

SEQ ID NO: 1727543 - RNA, 12 nt, Homo sapiens
uacaagucaaaa

SEQ ID NO: 1727544 - RNA, 13 nt, Homo sapiens
uacaauugugagc

SEQ ID NO: 1727545 - RNA, 16 nt, Homo sapiens
uacacguaaaugcaga

SEQ ID NO: 1727546 - RNA, 14 nt, Homo sapiens
uacauuauucuuca

SEQ ID NO: 1727547 - RNA, 20 nt, Homo sapiens
uacauucugcaagcacaucu

SEQ ID NO: 1727548 - RNA, 14 nt, Homo sapiens
uaccaugugugcua

SEQ ID NO: 1727549 - RNA, 16 nt, Homo sapiens
uaccccuuugcacuug

SEQ ID NO: 1727550 - RNA, 12 nt, Homo sapiens
uacuaaaugcag

SEQ ID NO: 1727551 - RNA, 13 nt, Homo sapiens
uacuaaaugcaga

SEQ ID NO: 1727552 - RNA, 14 nt, Homo sapiens
uacuaguuuucaau

SEQ ID NO: 1727553 - RNA, 16 nt, Homo sapiens
uacuaguuuucaauca

SEQ ID NO: 1727554 - RNA, 21 nt, Homo sapiens
uacugaagaacaguacuccac

SEQ ID NO: 1727555 - RNA, 19 nt, Homo sapiens
uacugaguauuaaguagua

SEQ ID NO: 1727556 - RNA, 21 nt, Homo sapiens
uacuugaaacagucacuauca

SEQ ID NO: 1727557 - RNA, 19 nt, Homo sapiens
uagaaggacucaguauuau

SEQ ID NO: 1727558 - RNA, 23 nt, Homo sapiens
uagaggaaaaaacagaucagggc

SEQ ID NO: 1727559 - RNA, 17 nt, Homo sapiens
uagcagacaugccacac

SEQ ID NO: 1727560 - RNA, 15 nt, Homo sapiens
uagcuagcuguguua

SEQ ID NO: 1727561 - RNA, 23 nt, Homo sapiens
uagcugugucauguauauaccuu

SEQ ID NO: 1727562 - RNA, 19 nt, Homo sapiens
uaguucuacauuauucuuc

SEQ ID NO: 1727563 - RNA, 14 nt, Homo sapiens
uauaaaaaguggag

SEQ ID NO: 1727564 - RNA, 19 nt, Homo sapiens
uauaccaugugugcuaaua

SEQ ID NO: 1727565 - RNA, 23 nt, Homo sapiens
uauaccugccuuuuaaguuugaa

SEQ ID NO: 1727566 - RNA, 14 nt, Homo sapiens
uauauaggcauuuc

SEQ ID NO: 1727567 - RNA, 19 nt, Homo sapiens
uaucacuaagaaagaaagg

SEQ ID NO: 1727568 - RNA, 17 nt, Homo sapiens
uauccuugaccaauuua

SEQ ID NO: 1727569 - RNA, 15 nt, Homo sapiens
uaugaauuaggugua

SEQ ID NO: 1727570 - RNA, 18 nt, Homo sapiens
uaugcucagggucaauuu

SEQ ID NO: 1727571 - RNA, 19 nt, Homo sapiens
uaugguucuugccaaaacu

SEQ ID NO: 1727572 - RNA, 19 nt, Homo sapiens
uauuaaucuggacauucga

SEQ ID NO: 1727573 - RNA, 18 nt, Homo sapiens
uauucuucacuuaaacuc

SEQ ID NO: 1727574 - RNA, 20 nt, Homo sapiens
ucaacaucuuuuacauucug

SEQ ID NO: 1727575 - RNA, 12 nt, Homo sapiens
ucaauagcuguc

SEQ ID NO: 1727576 - RNA, 23 nt, Homo sapiens
ucacaaaaacagcaaaauugugg

SEQ ID NO: 1727577 - RNA, 15 nt, Homo sapiens
ucacacuggagugaa

SEQ ID NO: 1727578 - RNA, 18 nt, Homo sapiens
ucacuggggcaugagauu

SEQ ID NO: 1727579 - RNA, 17 nt, Homo sapiens
ucacuuaaacucagcua

SEQ ID NO: 1727580 - RNA, 18 nt, Homo sapiens
ucagaaacugaauucugg

SEQ ID NO: 1727581 - RNA, 17 nt, Homo sapiens
ucagauacacugugaua

SEQ ID NO: 1727582 - RNA, 18 nt, Homo sapiens
ucagauuagagagucuca

SEQ ID NO: 1727583 - RNA, 17 nt, Homo sapiens
ucagcacuguaacuucg

SEQ ID NO: 1727584 - RNA, 14 nt, Homo sapiens
ucagccacauucua

SEQ ID NO: 1727585 - RNA, 21 nt, Homo sapiens
ucagccccagucccagccaca

SEQ ID NO: 1727586 - RNA, 23 nt, Homo sapiens
ucaggcgauccaccugucucagc

SEQ ID NO: 1727587 - RNA, 20 nt, Homo sapiens
ucagucaacaacuuacacuu

SEQ ID NO: 1727588 - RNA, 21 nt, Homo sapiens
ucagucaacaacuuacacuua

SEQ ID NO: 1727589 - RNA, 22 nt, Homo sapiens
ucagucugcuuuuggauuuuca

SEQ ID NO: 1727590 - RNA, 15 nt, Homo sapiens
ucaucuaacucuguc

SEQ ID NO: 1727591 - RNA, 18 nt, Homo sapiens
ucaugcaaacugcuuuau

SEQ ID NO: 1727592 - RNA, 23 nt, Homo sapiens
ucaugccaccauggccagccaac

SEQ ID NO: 1727593 - RNA, 23 nt, Homo sapiens
ucaugccuguaaucccagcacuu

SEQ ID NO: 1727594 - RNA, 19 nt, Homo sapiens
ucaugugcugccugcaagc

SEQ ID NO: 1727595 - RNA, 19 nt, Homo sapiens
uccacuucuuguuccccac

SEQ ID NO: 1727596 - RNA, 22 nt, Homo sapiens
uccaguuuuauaaaaaguggag

SEQ ID NO: 1727597 - RNA, 17 nt, Homo sapiens
ucccuuuuuauauccca

SEQ ID NO: 1727598 - RNA, 19 nt, Homo sapiens
uccuaacuucaucauugau

SEQ ID NO: 1727599 - RNA, 17 nt, Homo sapiens
uccucaaugcauugacu

SEQ ID NO: 1727600 - RNA, 15 nt, Homo sapiens
ucgcuaaagagugaa

SEQ ID NO: 1727601 - RNA, 15 nt, Homo sapiens
ucuaaaaauugaacu

SEQ ID NO: 1727602 - RNA, 21 nt, Homo sapiens
ucuaauuugggcuguuuuuca

SEQ ID NO: 1727603 - RNA, 22 nt, Homo sapiens
ucuagacuugggaucugcaaga

SEQ ID NO: 1727604 - RNA, 11 nt, Homo sapiens
ucuagccuuuu

SEQ ID NO: 1727605 - RNA, 16 nt, Homo sapiens
ucuagugccacacucc

SEQ ID NO: 1727606 - RNA, 17 nt, Homo sapiens
ucuagugccacacucca

SEQ ID NO: 1727607 - RNA, 16 nt, Homo sapiens
ucucacugcaagcaca

SEQ ID NO: 1727608 - RNA, 20 nt, Homo sapiens
ucucaggaggguaagaacuc

SEQ ID NO: 1727609 - RNA, 19 nt, Homo sapiens
ucucccuccccugccauuu

SEQ ID NO: 1727610 - RNA, 23 nt, Homo sapiens
ucucccuguuggucgguggguug

SEQ ID NO: 1727611 - RNA, 15 nt, Homo sapiens
ucucuucagugccca

SEQ ID NO: 1727612 - RNA, 18 nt, Homo sapiens
ucugagaacagugcacaa

SEQ ID NO: 1727613 - RNA, 21 nt, Homo sapiens
ucugcaagcacaucugcauuu

SEQ ID NO: 1727614 - RNA, 21 nt, Homo sapiens
ucuggaccauauaccaucucc

SEQ ID NO: 1727615 - RNA, 17 nt, Homo sapiens
ucuguuaaguuacauuu

SEQ ID NO: 1727616 - RNA, 21 nt, Homo sapiens
ucuucagacuuaaagcacuga

SEQ ID NO: 1727617 - RNA, 17 nt, Homo sapiens
ucuuguuccccacugac

SEQ ID NO: 1727618 - RNA, 22 nt, Homo sapiens
ucuuuagaaggacucaguauua

SEQ ID NO: 1727619 - RNA, 19 nt, Homo sapiens
ucuuuuccugaccaaucuu

SEQ ID NO: 1727620 - RNA, 19 nt, Homo sapiens
ugaaagagaagcacuaaga

SEQ ID NO: 1727621 - RNA, 18 nt, Homo sapiens
ugaaaucuuggaguuuca

SEQ ID NO: 1727622 - RNA, 16 nt, Homo sapiens
ugaaccuucugcaaca

SEQ ID NO: 1727623 - RNA, 16 nt, Homo sapiens
ugaauaguaagcauaa

SEQ ID NO: 1727624 - RNA, 19 nt, Homo sapiens
ugaccaaggacugcuacac

SEQ ID NO: 1727625 - RNA, 13 nt, Homo sapiens
ugagcagccuuuc

SEQ ID NO: 1727626 - RNA, 15 nt, Homo sapiens
ugagcuugacaccug

SEQ ID NO: 1727627 - RNA, 16 nt, Homo sapiens
aaaaaggaggauagaa

SEQ ID NO: 1727628 - RNA, 13 nt, Homo sapiens
aaaaauugaacua

SEQ ID NO: 1727629 - RNA, 11 nt, Homo sapiens
aaaacaucaga

SEQ ID NO: 1727630 - RNA, 17 nt, Homo sapiens
aaaacaucagaaacuga

SEQ ID NO: 1727631 - RNA, 23 nt, Homo sapiens
aaaagacauguuggaaauguagu

SEQ ID NO: 1727632 - RNA, 13 nt, Homo sapiens
aaaaguacauuaa

SEQ ID NO: 1727633 - RNA, 14 nt, Homo sapiens
aaaauagucucauu

SEQ ID NO: 1727634 - RNA, 14 nt, Homo sapiens
aaaaucaaaucaug

SEQ ID NO: 1727635 - RNA, 23 nt, Homo sapiens
aaaaucuuuuuugauaugauaau

SEQ ID NO: 1727636 - RNA, 14 nt, Homo sapiens
aaaaugccuacaca

SEQ ID NO: 1727637 - RNA, 15 nt, Homo sapiens
aaaauugacaaugau

SEQ ID NO: 1727638 - RNA, 14 nt, Homo sapiens
aaaauuguggcauu

SEQ ID NO: 1727639 - RNA, 19 nt, Homo sapiens
aaacacacuguauuuuaca

SEQ ID NO: 1727640 - RNA, 17 nt, Homo sapiens
aaagccaccuuguuaca

SEQ ID NO: 1727641 - RNA, 13 nt, Homo sapiens
aaagucuaccggc

SEQ ID NO: 1727642 - RNA, 21 nt, Homo sapiens
aaaguugcuuuuauugcacca

SEQ ID NO: 1727643 - RNA, 21 nt, Homo sapiens
aaauaagaauaaacuuucuca

SEQ ID NO: 1727644 - RNA, 13 nt, Homo sapiens
aaaugaaugaaua

SEQ ID NO: 1727645 - RNA, 13 nt, Homo sapiens
aaaugcuguuuau

SEQ ID NO: 1727646 - RNA, 16 nt, Homo sapiens
ucuuuuacauucugca

SEQ ID NO: 1727647 - RNA, 14 nt, Homo sapiens
ugaaacauuuuagc

SEQ ID NO: 1727648 - RNA, 22 nt, Homo sapiens
ugaaagaacauggucuguggug

SEQ ID NO: 1727649 - RNA, 17 nt, Homo sapiens
ugaaaguugcuuuuauu

SEQ ID NO: 1727650 - RNA, 18 nt, Homo sapiens
ugaaaugcuggcauuugc

SEQ ID NO: 1727651 - RNA, 22 nt, Homo sapiens
ugaaucccaccugccaccagcc

SEQ ID NO: 1727652 - RNA, 21 nt, Homo sapiens
ugaccaccaacauucuguguu

SEQ ID NO: 1727653 - RNA, 22 nt, Homo sapiens
ugaccaccaacauucuguguuc

SEQ ID NO: 1727654 - RNA, 15 nt, Homo sapiens
ugacuuaaccauaua

SEQ ID NO: 1727655 - RNA, 21 nt, Homo sapiens
ugaucuuuguuuaaaugccaa

SEQ ID NO: 1727656 - RNA, 22 nt, Homo sapiens
ugauuaccaaaauauauauuaa

SEQ ID NO: 1727657 - RNA, 21 nt, Homo sapiens
ugcaaauauugguuaguauuu

SEQ ID NO: 1727658 - RNA, 22 nt, Homo sapiens
ugcaacagguuuguucucagga

SEQ ID NO: 1727659 - RNA, 18 nt, Homo sapiens
ugcaauaggugugcguca

SEQ ID NO: 1727660 - RNA, 16 nt, Homo sapiens
ugcaguuucauguaug

SEQ ID NO: 1727661 - RNA, 23 nt, Homo sapiens
ugcauuuaccaaaauuugugcac

SEQ ID NO: 1727662 - RNA, 21 nt, Homo sapiens
ugccucauuuucacagcacua

SEQ ID NO: 1727663 - RNA, 20 nt, Homo sapiens
gcagcucuucuggcuguguu

SEQ ID NO: 1727664 - RNA, 20 nt, Homo sapiens
gcaguuucauguauguauau

SEQ ID NO: 1727665 - RNA, 18 nt, Homo sapiens
gcauucuaaaugaacuca

SEQ ID NO: 1727666 - RNA, 13 nt, Homo sapiens
gccaaggcuugga

SEQ ID NO: 1727667 - RNA, 22 nt, Homo sapiens
gcccacuucaccguacuaacca

SEQ ID NO: 1727668 - RNA, 20 nt, Homo sapiens
gcccaggcuggaguggagug

SEQ ID NO: 1727669 - RNA, 14 nt, Homo sapiens
gcccauaucuguga

SEQ ID NO: 1727670 - RNA, 20 nt, Homo sapiens
gccucauuuucacagcacua

SEQ ID NO: 1727671 - RNA, 22 nt, Homo sapiens
gcgauccaccugucucagccuc

SEQ ID NO: 1727672 - RNA, 16 nt, Homo sapiens
gcuaaaggaagugaau

SEQ ID NO: 1727673 - RNA, 23 nt, Homo sapiens
gcuacaguuauuaaucuggacau

SEQ ID NO: 1727674 - RNA, 21 nt, Homo sapiens
gcuauuaagaaggcacuuaau

SEQ ID NO: 1727675 - RNA, 11 nt, Homo sapiens
gcuccacugaa

SEQ ID NO: 1727676 - RNA, 15 nt, Homo sapiens
gcucgagcaguccug

SEQ ID NO: 1727677 - RNA, 18 nt, Homo sapiens
gcugagugacugcagcuu

SEQ ID NO: 1727678 - RNA, 14 nt, Homo sapiens
gcuggcccugauga

SEQ ID NO: 1727679 - RNA, 21 nt, Homo sapiens
gcuucacuagaguucuuugaa

SEQ ID NO: 1727680 - RNA, 24 nt, Homo sapiens
gcuucaugugcugccugcaagcuu

SEQ ID NO: 1727681 - RNA, 16 nt, Homo sapiens
gcuuguuguuugcgca

SEQ ID NO: 1727682 - RNA, 17 nt, Homo sapiens
gcuuuccagacuuugaa

SEQ ID NO: 1727683 - RNA, 23 nt, Homo sapiens
gcuuugugaaaacuacugauguu

SEQ ID NO: 1727684 - RNA, 14 nt, Homo sapiens
ggaacacaaaacca

SEQ ID NO: 1727685 - RNA, 20 nt, Homo sapiens
ucccagcaccuauugaauua

SEQ ID NO: 1727686 - RNA, 17 nt, Homo sapiens
ucccagguaauuuaaau

SEQ ID NO: 1727687 - RNA, 17 nt, Homo sapiens
uccuaccccuuugcacu

SEQ ID NO: 1727688 - RNA, 18 nt, Homo sapiens
uccuagauuuagcacaau

SEQ ID NO: 1727689 - RNA, 19 nt, Homo sapiens
uccuagcagacaugccaca

SEQ ID NO: 1727690 - RNA, 15 nt, Homo sapiens
uccuguaccacucac

SEQ ID NO: 1727691 - RNA, 13 nt, Homo sapiens
uccuguguaaaug

SEQ ID NO: 1727692 - RNA, 16 nt, Homo sapiens
ucggauuaccaaaaca

SEQ ID NO: 1727693 - RNA, 19 nt, Homo sapiens
ucgguacugagcagccacu

SEQ ID NO: 1727694 - RNA, 21 nt, Homo sapiens
ucuaaacagcugacccaguga

SEQ ID NO: 1727695 - RNA, 20 nt, Homo sapiens
ucuaaagcuaguaaacuucc

SEQ ID NO: 1727696 - RNA, 15 nt, Homo sapiens
ucuaaugcauguauu

SEQ ID NO: 1727697 - RNA, 13 nt, Homo sapiens
ucuagaacuugac

SEQ ID NO: 1727698 - RNA, 13 nt, Homo sapiens
ucuauaccugccu

SEQ ID NO: 1727699 - RNA, 17 nt, Homo sapiens
ucuauagaaaugaucau

SEQ ID NO: 1727700 - RNA, 18 nt, Homo sapiens
ucucacaguguugcccag

SEQ ID NO: 1727701 - RNA, 18 nt, Homo sapiens
ucucgcuuuguugcccag

SEQ ID NO: 1727702 - RNA, 16 nt, Homo sapiens
ucugaccaugacucau

SEQ ID NO: 1727703 - RNA, 20 nt, Homo sapiens
ucuggccuugaaaccaccuu

SEQ ID NO: 1727704 - RNA, 23 nt, Homo sapiens
ucuggcuguguugucagcacugu

SEQ ID NO: 1727705 - RNA, 20 nt, Homo sapiens
ucuguauugggguacaggaa

SEQ ID NO: 1727706 - RNA, 18 nt, Homo sapiens
ucuguguccaucagugac

SEQ ID NO: 1727707 - RNA, 22 nt, Homo sapiens
ucuuaagauccacaaaugaagg

SEQ ID NO: 1727708 - RNA, 23 nt, Homo sapiens
ucuucagacuuaaagcacugaua

SEQ ID NO: 1727709 - RNA, 19 nt, Homo sapiens
ucuucagaggcucaucuaa

SEQ ID NO: 1727710 - RNA, 19 nt, Homo sapiens
ucuuccaauuuccuuuaaa

SEQ ID NO: 1727711 - RNA, 21 nt, Homo sapiens
ucuucuccugccuaauuuuga

SEQ ID NO: 1727712 - RNA, 14 nt, Homo sapiens
ucuugagaaugauu

SEQ ID NO: 1727713 - RNA, 20 nt, Homo sapiens
ucuuugaacccuugcuugca

SEQ ID NO: 1727714 - RNA, 22 nt, Homo sapiens
ugaaaaaagguuguguagcugu

SEQ ID NO: 1727715 - RNA, 22 nt, Homo sapiens
ugaaaauaaguguaauuaccac

SEQ ID NO: 1727716 - RNA, 21 nt, Homo sapiens
ugaaacuauuaagcuucuuaa

SEQ ID NO: 1727717 - RNA, 16 nt, Homo sapiens
ugaaaguugcuuuuau

SEQ ID NO: 1727718 - RNA, 19 nt, Homo sapiens
ugaaauaauguacaucugg

SEQ ID NO: 1727719 - RNA, 22 nt, Homo sapiens
ugaagcuuugugaaaacuacug

SEQ ID NO: 1727720 - RNA, 18 nt, Homo sapiens
ugaaucccaccugccacc

SEQ ID NO: 1727721 - RNA, 15 nt, Homo sapiens
ugacaauaugaauua

SEQ ID NO: 1727722 - RNA, 13 nt, Homo sapiens
ugacaaugaccaa

SEQ ID NO: 1727723 - RNA, 16 nt, Homo sapiens
ugacaccuggugcuuu

SEQ ID NO: 1727724 - RNA, 22 nt, Homo sapiens
ugagguaauucuagccuuuuaa

SEQ ID NO: 1727725 - RNA, 16 nt, Homo sapiens
ugaguauuaaguagua

SEQ ID NO: 1727726 - RNA, 20 nt, Homo sapiens
ugaucuuuguuuaaaugcca

SEQ ID NO: 1727727 - RNA, 15 nt, Homo sapiens
ugcacuuguggcaac

SEQ ID NO: 1727728 - RNA, 20 nt, Homo sapiens
ugcacuuguggcaacagaua

SEQ ID NO: 1727729 - RNA, 23 nt, Homo sapiens
ugcacuuguggcaacagauaagu

SEQ ID NO: 1727730 - RNA, 16 nt, Homo sapiens
ugcagaaauaagaaua

SEQ ID NO: 1727731 - RNA, 20 nt, Homo sapiens
ugccaccauggccagccaac

SEQ ID NO: 1727732 - RNA, 21 nt, Homo sapiens
ugccuaauuuugaacuaguaa

SEQ ID NO: 1727733 - RNA, 19 nt, Homo sapiens
ugccugguuuuauuuauau

SEQ ID NO: 1727734 - RNA, 13 nt, Homo sapiens
ugcucauguauau

SEQ ID NO: 1727735 - RNA, 18 nt, Homo sapiens
ugcucauguauauuuagu

SEQ ID NO: 1727736 - RNA, 15 nt, Homo sapiens
ugcucuucagacuua

SEQ ID NO: 1727737 - RNA, 14 nt, Homo sapiens
ugcuggcauuugca

SEQ ID NO: 1727738 - RNA, 19 nt, Homo sapiens
ugcuuuaaaaugucugugu

SEQ ID NO: 1727739 - RNA, 18 nt, Homo sapiens
ugcuuuccagacuuugaa

SEQ ID NO: 1727740 - RNA, 11 nt, Homo sapiens
uggaaagaagg

SEQ ID NO: 1727741 - RNA, 22 nt, Homo sapiens
uggagacagacugauguguaua

SEQ ID NO: 1727742 - RNA, 19 nt, Homo sapiens
uggagggaaugcucagaaa

SEQ ID NO: 1727743 - RNA, 12 nt, Homo sapiens
uggagugauagc

SEQ ID NO: 1727744 - RNA, 22 nt, Homo sapiens
uggaucagcucuuccuguguuu

SEQ ID NO: 1727745 - RNA, 13 nt, Homo sapiens
uggcccagccaaa

SEQ ID NO: 1727746 - RNA, 17 nt, Homo sapiens
uggccuugaaaccaccu

SEQ ID NO: 1727747 - RNA, 21 nt, Homo sapiens
uggcuaaagagcuuugugaua

SEQ ID NO: 1727748 - RNA, 11 nt, Homo sapiens
uggcuguguug

SEQ ID NO: 1727749 - RNA, 17 nt, Homo sapiens
ugggcagugagugccau

SEQ ID NO: 1727750 - RNA, 16 nt, Homo sapiens
ugggcuugaaacauua

SEQ ID NO: 1727751 - RNA, 18 nt, Homo sapiens
uggggaagagguuuuauu

SEQ ID NO: 1727752 - RNA, 20 nt, Homo sapiens
uggggaauuuauccuugacc

SEQ ID NO: 1727753 - RNA, 17 nt, Homo sapiens
uggucacagaugcacaa

SEQ ID NO: 1727754 - RNA, 24 nt, Homo sapiens
uggucauuucuccccaugguaguu

SEQ ID NO: 1727755 - RNA, 19 nt, Homo sapiens
ugguucacauccuaccccu

SEQ ID NO: 1727756 - RNA, 19 nt, Homo sapiens
uguaaaaucugacauaaaa

SEQ ID NO: 1727757 - RNA, 19 nt, Homo sapiens
uguaaauaaaaucauguau

SEQ ID NO: 1727758 - RNA, 14 nt, Homo sapiens
uguaacagugcaag

SEQ ID NO: 1727759 - RNA, 15 nt, Homo sapiens
uguaaggagccuuuc

SEQ ID NO: 1727760 - RNA, 22 nt, Homo sapiens
uguaaucaaggccagugcuaaa

SEQ ID NO: 1727761 - RNA, 14 nt, Homo sapiens
uguaaugcugcaca

SEQ ID NO: 1727762 - RNA, 14 nt, Homo sapiens
uguacaaguauucu

SEQ ID NO: 1727763 - RNA, 20 nt, Homo sapiens
uguacaaguauucuaccuaa

SEQ ID NO: 1727764 - RNA, 13 nt, Homo sapiens
uguaguuucuuga

SEQ ID NO: 1727765 - RNA, 12 nt, Homo sapiens
ugucagcacugu

SEQ ID NO: 1727766 - RNA, 22 nt, Homo sapiens
ugugaaagaugcacaacacucc

SEQ ID NO: 1727767 - RNA, 19 nt, Homo sapiens
uguggucacagaugcacaa

SEQ ID NO: 1727768 - RNA, 18 nt, Homo sapiens
ugugugcgcacacaccca

SEQ ID NO: 1727769 - RNA, 21 nt, Homo sapiens
uguugcccaggcuggucucaa

SEQ ID NO: 1727770 - RNA, 11 nt, Homo sapiens
uguuggucugu

SEQ ID NO: 1727771 - RNA, 15 nt, Homo sapiens
uguuuaaagugaauu

SEQ ID NO: 1727772 - RNA, 16 nt, Homo sapiens
uguuuaucgaaguaua

SEQ ID NO: 1727773 - RNA, 21 nt, Homo sapiens
uuuuaaagcauauuggugcua

SEQ ID NO: 1727774 - RNA, 11 nt, Homo sapiens
uuuuaacuucc

SEQ ID NO: 1727775 - RNA, 13 nt, Homo sapiens
uuuucaucaugau

SEQ ID NO: 1727776 - RNA, 23 nt, Homo sapiens
uuuugaaagaacauggucugugg

SEQ ID NO: 1727777 - RNA, 21 nt, Homo sapiens
uuuuuaauggcaauaggacau

SEQ ID NO: 1727778 - RNA, 17 nt, Homo sapiens
aaaaauacucacauggc

SEQ ID NO: 1727779 - RNA, 16 nt, Homo sapiens
aaaacagcugcgacaa

SEQ ID NO: 1727780 - RNA, 12 nt, Homo sapiens
aaaauaaagcug

SEQ ID NO: 1727781 - RNA, 22 nt, Homo sapiens
aaaaucacaaggcaacugugag

SEQ ID NO: 1727782 - RNA, 18 nt, Homo sapiens
aaaaugcaacaacaugua

SEQ ID NO: 1727783 - RNA, 20 nt, Homo sapiens
aaacaauuguaaauuucuuu

SEQ ID NO: 1727784 - RNA, 22 nt, Homo sapiens
aaacacuauauggcagugucuu

SEQ ID NO: 1727785 - RNA, 14 nt, Homo sapiens
aaacucucuagggc

SEQ ID NO: 1727786 - RNA, 21 nt, Homo sapiens
aaagaaggcacagguguaaau

SEQ ID NO: 1727787 - RNA, 17 nt, Homo sapiens
aaagaugucccacaggg

SEQ ID NO: 1727788 - RNA, 11 nt, Homo sapiens
aaaguccaggc

SEQ ID NO: 1727789 - RNA, 19 nt, Homo sapiens
aaaguggcaggacacugca

SEQ ID NO: 1727790 - RNA, 22 nt, Homo sapiens
aaauacacagugcugaccagac

SEQ ID NO: 1727791 - RNA, 23 nt, Homo sapiens
aaauacacagugcugaccagaca

SEQ ID NO: 1727792 - RNA, 15 nt, Homo sapiens
aaauauaaacuugug

SEQ ID NO: 1727793 - RNA, 16 nt, Homo sapiens
aaauauaaacuugugu

SEQ ID NO: 1727794 - RNA, 18 nt, Homo sapiens
aaaugcaaacacugugua

SEQ ID NO: 1727795 - RNA, 13 nt, Homo sapiens
aaaugcaagguga

SEQ ID NO: 1727796 - RNA, 17 nt, Homo sapiens
aaaugggaaaaccagac

SEQ ID NO: 1727797 - RNA, 12 nt, Homo sapiens
aaauuaaacccu

SEQ ID NO: 1727798 - RNA, 15 nt, Homo sapiens
aaauuaaacccugcc

SEQ ID NO: 1727799 - RNA, 21 nt, Homo sapiens
aacaccacuuugucucugaga

SEQ ID NO: 1727800 - RNA, 18 nt, Homo sapiens
aacagacguuaccaauua

SEQ ID NO: 1727801 - RNA, 16 nt, Homo sapiens
aacauaaauuuaucau

SEQ ID NO: 1727802 - RNA, 16 nt, Homo sapiens
aaccaugggcucaggg

SEQ ID NO: 1727803 - RNA, 11 nt, Homo sapiens
aacccaaauaa

SEQ ID NO: 1727804 - RNA, 21 nt, Homo sapiens
aacucugccugagacuuucag

SEQ ID NO: 1727805 - RNA, 17 nt, Homo sapiens
aagacaccguucauuca

SEQ ID NO: 1727806 - RNA, 22 nt, Homo sapiens
aagacucuccacugaccugguu

SEQ ID NO: 1727807 - RNA, 20 nt, Homo sapiens
aagauaauuuguugggccau

SEQ ID NO: 1727808 - RNA, 14 nt, Homo sapiens
aagauggcacuguc

SEQ ID NO: 1727809 - RNA, 24 nt, Homo sapiens
aagauggcacuguccagggcccau

SEQ ID NO: 1727810 - RNA, 13 nt, Homo sapiens
aagcaaucacugg

SEQ ID NO: 1727811 - RNA, 16 nt, Homo sapiens
aagcaucacuugggau

SEQ ID NO: 1727812 - RNA, 20 nt, Homo sapiens
aagccacagcuggugguauc

SEQ ID NO: 1727813 - RNA, 15 nt, Homo sapiens
aaggaagccacagcu

SEQ ID NO: 1727814 - RNA, 16 nt, Homo sapiens
aaggaaggaugccuua

SEQ ID NO: 1727815 - RNA, 14 nt, Homo sapiens
aaggcacaggugua

SEQ ID NO: 1727816 - RNA, 22 nt, Homo sapiens
aaggcauaugcuggcccauaaa

SEQ ID NO: 1727817 - RNA, 13 nt, Homo sapiens
aaguagcugcuac

SEQ ID NO: 1727818 - RNA, 14 nt, Homo sapiens
aaguagcugcuacc

SEQ ID NO: 1727819 - RNA, 13 nt, Homo sapiens
aagucacuuuuau

SEQ ID NO: 1727820 - RNA, 14 nt, Homo sapiens
aauauauccaugau

SEQ ID NO: 1727821 - RNA, 19 nt, Homo sapiens
aauaugggcucaagucacu

SEQ ID NO: 1727822 - RNA, 17 nt, Homo sapiens
aauccgaaaucagcagg

SEQ ID NO: 1727823 - RNA, 15 nt, Homo sapiens
aauggggugcaugaa

SEQ ID NO: 1727824 - RNA, 14 nt, Homo sapiens
aauuaaacccugcc

SEQ ID NO: 1727825 - RNA, 17 nt, Homo sapiens
aauugugcgacuucaca

SEQ ID NO: 1727826 - RNA, 20 nt, Homo sapiens
aauuucuaccuuuacuacau

SEQ ID NO: 1727827 - RNA, 12 nt, Homo sapiens
acaaaaugcaag

SEQ ID NO: 1727828 - RNA, 12 nt, Homo sapiens
acaaacaugugg

SEQ ID NO: 1727829 - RNA, 17 nt, Homo sapiens
acaaaccuuuagcugug

SEQ ID NO: 1727830 - RNA, 18 nt, Homo sapiens
acaaaugggaaaaccaga

SEQ ID NO: 1727831 - RNA, 17 nt, Homo sapiens
acaacauguauaauauu

SEQ ID NO: 1727832 - RNA, 22 nt, Homo sapiens
acaagacccaaguagcugcuac

SEQ ID NO: 1727833 - RNA, 16 nt, Homo sapiens
acacaagagcuggagc

SEQ ID NO: 1727834 - RNA, 14 nt, Homo sapiens
acacccaagaagaa

SEQ ID NO: 1727835 - RNA, 21 nt, Homo sapiens
acagaacacugucuugaagac

SEQ ID NO: 1727836 - RNA, 12 nt, Homo sapiens
acagacagcagc

SEQ ID NO: 1727837 - RNA, 12 nt, Homo sapiens
acagacugugag

SEQ ID NO: 1727838 - RNA, 13 nt, Homo sapiens
acagacugugagu

SEQ ID NO: 1727839 - RNA, 18 nt, Homo sapiens
acagcaguuucaccaucu

SEQ ID NO: 1727840 - RNA, 12 nt, Homo sapiens
acagguguaaau

SEQ ID NO: 1727841 - RNA, 21 nt, Homo sapiens
acauaaauuuaucaucucgac

SEQ ID NO: 1727842 - RNA, 15 nt, Homo sapiens
acauccauguuccga

SEQ ID NO: 1727843 - RNA, 17 nt, Homo sapiens
acaugcagcucugauga

SEQ ID NO: 1727844 - RNA, 15 nt, Homo sapiens
acauugucaccauuu

SEQ ID NO: 1727845 - RNA, 16 nt, Homo sapiens
accaaaaccagagggc

SEQ ID NO: 1727846 - RNA, 23 nt, Homo sapiens
accacuuuucaguucaguggcau

SEQ ID NO: 1727847 - RNA, 14 nt, Homo sapiens
accagcugccaaaa

SEQ ID NO: 1727848 - RNA, 22 nt, Homo sapiens
accaggcugccaggcaccaucu

SEQ ID NO: 1727849 - RNA, 20 nt, Homo sapiens
accaucugccaaugccauga

SEQ ID NO: 1727850 - RNA, 19 nt, Homo sapiens
accaugggcucagggccag

SEQ ID NO: 1727851 - RNA, 20 nt, Homo sapiens
acccaaauaaauguguaaau

SEQ ID NO: 1727852 - RNA, 13 nt, Homo sapiens
accugaagacacc

SEQ ID NO: 1727853 - RNA, 17 nt, Homo sapiens
accugcuguggaugucc

SEQ ID NO: 1727854 - RNA, 23 nt, Homo sapiens
accuguuguccugaacugugagu

SEQ ID NO: 1727855 - RNA, 18 nt, Homo sapiens
accuugggucugugucac

SEQ ID NO: 1727856 - RNA, 18 nt, Homo sapiens
acuacaauuuaaagcaaa

SEQ ID NO: 1727857 - RNA, 22 nt, Homo sapiens
acuaguguguguguguauauau

SEQ ID NO: 1727858 - RNA, 16 nt, Homo sapiens
acucucaggcauggau

SEQ ID NO: 1727859 - RNA, 20 nt, Homo sapiens
acugaccugguuguccaggu

SEQ ID NO: 1727860 - RNA, 19 nt, Homo sapiens
acugcccuccagggccagg

SEQ ID NO: 1727861 - RNA, 21 nt, Homo sapiens
acugucuugaagacaauggcu

SEQ ID NO: 1727862 - RNA, 22 nt, Homo sapiens
acugucuugaagacaauggcuu

SEQ ID NO: 1727863 - RNA, 13 nt, Homo sapiens
acuguuuucccaa

SEQ ID NO: 1727864 - RNA, 17 nt, Homo sapiens
acuucacaaaaugcaag

SEQ ID NO: 1727865 - RNA, 17 nt, Homo sapiens
acuugacagaacacugu

SEQ ID NO: 1727866 - RNA, 20 nt, Homo sapiens
agaaagucauagauuucuga

SEQ ID NO: 1727867 - RNA, 20 nt, Homo sapiens
agaacagcuucauguuccca

SEQ ID NO: 1727868 - RNA, 22 nt, Homo sapiens
agaacagcuucauguucccaaa

SEQ ID NO: 1727869 - RNA, 12 nt, Homo sapiens
agaacuuugcau

SEQ ID NO: 1727870 - RNA, 23 nt, Homo sapiens
agaacuuugcauagcagcugcua

SEQ ID NO: 1727871 - RNA, 16 nt, Homo sapiens
agaagauggcacuguc

SEQ ID NO: 1727872 - RNA, 15 nt, Homo sapiens
agaaugaagacuguu

SEQ ID NO: 1727873 - RNA, 14 nt, Homo sapiens
agacagauugcuga

SEQ ID NO: 1727874 - RNA, 18 nt, Homo sapiens
agacccaaguagcugcua

SEQ ID NO: 1727875 - RNA, 14 nt, Homo sapiens
agagcuuccacugu

SEQ ID NO: 1727876 - RNA, 15 nt, Homo sapiens
agagcuuucaaguac

SEQ ID NO: 1727877 - RNA, 23 nt, Homo sapiens
agaggcaugggggcccaaagggg

SEQ ID NO: 1727878 - RNA, 17 nt, Homo sapiens
agaguccuuuuagcaca

SEQ ID NO: 1727879 - RNA, 20 nt, Homo sapiens
agagugagacuccgucucaa

SEQ ID NO: 1727880 - RNA, 17 nt, Homo sapiens
agaguuguucucagggg

SEQ ID NO: 1727881 - RNA, 14 nt, Homo sapiens
agauaauacauucc

SEQ ID NO: 1727882 - RNA, 19 nt, Homo sapiens
agauccucuucucaaagcu

SEQ ID NO: 1727883 - RNA, 14 nt, Homo sapiens
agauggagaggcau

SEQ ID NO: 1727884 - RNA, 17 nt, Homo sapiens
agauuccgcaccaauaa

SEQ ID NO: 1727885 - RNA, 20 nt, Homo sapiens
agauugcgccacugcacucc

SEQ ID NO: 1727886 - RNA, 14 nt, Homo sapiens
agcaaucacugggc

SEQ ID NO: 1727887 - RNA, 20 nt, Homo sapiens
agcaauuagauuaguauuuu

SEQ ID NO: 1727888 - RNA, 23 nt, Homo sapiens
agcacccauaucugugugcccua

SEQ ID NO: 1727889 - RNA, 12 nt, Homo sapiens
agcacucugaaa

SEQ ID NO: 1727890 - RNA, 23 nt, Homo sapiens
agcagaaaggaaaagauuccugu

SEQ ID NO: 1727891 - RNA, 20 nt, Homo sapiens
agcagaagacucuccacuga

SEQ ID NO: 1727892 - RNA, 18 nt, Homo sapiens
agcauuaugauguggguc

SEQ ID NO: 1727893 - RNA, 22 nt, Homo sapiens
agcccacggggcaaagcugcug

SEQ ID NO: 1727894 - RNA, 16 nt, Homo sapiens
agccccgcccgccugg

SEQ ID NO: 1727895 - RNA, 19 nt, Homo sapiens
agccuaacaugauuauuug

SEQ ID NO: 1727896 - RNA, 15 nt, Homo sapiens
agcuagaugcuuuag

SEQ ID NO: 1727897 - RNA, 15 nt, Homo sapiens
agcugccaccaucac

SEQ ID NO: 1727898 - RNA, 20 nt, Homo sapiens
agcugcugggccaguggcac

SEQ ID NO: 1727899 - RNA, 21 nt, Homo sapiens
uaaaaacauaaaauauacaaa

SEQ ID NO: 1727900 - RNA, 15 nt, Homo sapiens
uaaaauauacaaaca

SEQ ID NO: 1727901 - RNA, 15 nt, Homo sapiens
uaaagcuacaacaaa

SEQ ID NO: 1727902 - RNA, 19 nt, Homo sapiens
uaaagcuguucucauuccu

SEQ ID NO: 1727903 - RNA, 17 nt, Homo sapiens
uaaaugcaaacacugug

SEQ ID NO: 1727904 - RNA, 18 nt, Homo sapiens
uaaaugcaaacacugugu

SEQ ID NO: 1727905 - RNA, 16 nt, Homo sapiens
uaaauuuaucaucucg

SEQ ID NO: 1727906 - RNA, 22 nt, Homo sapiens
uaacauaaauuuaucaucucga

SEQ ID NO: 1727907 - RNA, 18 nt, Homo sapiens
uaaccaugggcucagggc

SEQ ID NO: 1727908 - RNA, 19 nt, Homo sapiens
uaagccacguuaaguccaa

SEQ ID NO: 1727909 - RNA, 22 nt, Homo sapiens
uaaggccagcuagagcuuccac

SEQ ID NO: 1727910 - RNA, 18 nt, Homo sapiens
uaauagauguuacucaaa

SEQ ID NO: 1727911 - RNA, 14 nt, Homo sapiens
uaauauaagccaua

SEQ ID NO: 1727912 - RNA, 16 nt, Homo sapiens
uaauauauccaugauc

SEQ ID NO: 1727913 - RNA, 12 nt, Homo sapiens
uacaaacaugug

SEQ ID NO: 1727914 - RNA, 17 nt, Homo sapiens
uaccaaccugaagacac

SEQ ID NO: 1727915 - RNA, 22 nt, Homo sapiens
uacuaguguguguguguauaua

SEQ ID NO: 1727916 - RNA, 17 nt, Homo sapiens
uacuccaggagacccac

SEQ ID NO: 1727917 - RNA, 12 nt, Homo sapiens
uacucucaggca

SEQ ID NO: 1727918 - RNA, 12 nt, Homo sapiens
uagaagcucagg

SEQ ID NO: 1727919 - RNA, 17 nt, Homo sapiens
uagauuaguauuuucca

SEQ ID NO: 1727920 - RNA, 14 nt, Homo sapiens
uagcacaucacuga

SEQ ID NO: 1727921 - RNA, 22 nt, Homo sapiens
uagcagaaaggaaaagauuccu

SEQ ID NO: 1727922 - RNA, 16 nt, Homo sapiens
uagccgaaaugaucuu

SEQ ID NO: 1727923 - RNA, 18 nt, Homo sapiens
uaguacauggagcucagg

SEQ ID NO: 1727924 - RNA, 22 nt, Homo sapiens
uaguaccaugucguaguuacuc

SEQ ID NO: 1727925 - RNA, 19 nt, Homo sapiens
uaugaaaaaucaaugucaa

SEQ ID NO: 1727926 - RNA, 19 nt, Homo sapiens
uauggcagugucuuuccac

SEQ ID NO: 1727927 - RNA, 13 nt, Homo sapiens
uauucugccaugg

SEQ ID NO: 1727928 - RNA, 14 nt, Homo sapiens
uauuuuccaugaaa

SEQ ID NO: 1727929 - RNA, 21 nt, Homo sapiens
ucaacaaguaacuuuguagaa

SEQ ID NO: 1727930 - RNA, 21 nt, Homo sapiens
ucaacauucccccaacauuac

SEQ ID NO: 1727931 - RNA, 20 nt, Homo sapiens
ucaaguaccaaaauguuaau

SEQ ID NO: 1727932 - RNA, 22 nt, Homo sapiens
ucacaccauuuuguuuagacaa

SEQ ID NO: 1727933 - RNA, 16 nt, Homo sapiens
ucacacccaccugcug

SEQ ID NO: 1727934 - RNA, 21 nt, Homo sapiens
ucacugagaagauggcacugu

SEQ ID NO: 1727935 - RNA, 18 nt, Homo sapiens
ucagauuccgcaccaaua

SEQ ID NO: 1727936 - RNA, 12 nt, Homo sapiens
ucagguauuugu

SEQ ID NO: 1727937 - RNA, 18 nt, Homo sapiens
ucagugcacuguauauag

SEQ ID NO: 1727938 - RNA, 17 nt, Homo sapiens
uccacccacaacaucua

SEQ ID NO: 1727939 - RNA, 23 nt, Homo sapiens
uccccagcccuccccaccugcuc

SEQ ID NO: 1727940 - RNA, 13 nt, Homo sapiens
uccgggaucaaag

SEQ ID NO: 1727941 - RNA, 15 nt, Homo sapiens
uccucugcuugccau

SEQ ID NO: 1727942 - RNA, 19 nt, Homo sapiens
uccuuccucaguccuggaa

SEQ ID NO: 1727943 - RNA, 15 nt, Homo sapiens
ucguaguuacucuca

SEQ ID NO: 1727944 - RNA, 14 nt, Homo sapiens
ucuaaacccaaaua

SEQ ID NO: 1727945 - RNA, 23 nt, Homo sapiens
ucuaugaccucgcccuccacaaa

SEQ ID NO: 1727946 - RNA, 16 nt, Homo sapiens
ucucaggcauggauga

SEQ ID NO: 1727947 - RNA, 14 nt, Homo sapiens
ucucccacacaaga

SEQ ID NO: 1727948 - RNA, 18 nt, Homo sapiens
ucucugagaacagacguu

SEQ ID NO: 1727949 - RNA, 14 nt, Homo sapiens
ucucuuaauuuuuc

SEQ ID NO: 1727950 - RNA, 13 nt, Homo sapiens
ucucuuucuuauu

SEQ ID NO: 1727951 - RNA, 16 nt, Homo sapiens
ucuggggcuuugccau

SEQ ID NO: 1727952 - RNA, 15 nt, Homo sapiens
ucuucuaccagaccc

SEQ ID NO: 1727953 - RNA, 15 nt, Homo sapiens
ucuugaaggugcugc

SEQ ID NO: 1727954 - RNA, 21 nt, Homo sapiens
ucuugggguuuucaguaugaa

SEQ ID NO: 1727955 - RNA, 15 nt, Homo sapiens
ugaaaaaaaugcauu

SEQ ID NO: 1727956 - RNA, 24 nt, Homo sapiens
ugaaacuuuagagauuaacgacaa

SEQ ID NO: 1727957 - RNA, 23 nt, Homo sapiens
ugaacaccacuuugucucugaga

SEQ ID NO: 1727958 - RNA, 15 nt, Homo sapiens
ugacaaugcugccau

SEQ ID NO: 1727959 - RNA, 18 nt, Homo sapiens
ugacauauauauguauau

SEQ ID NO: 1727960 - RNA, 21 nt, Homo sapiens
ugaccaaaaccagagggcagu

SEQ ID NO: 1727961 - RNA, 15 nt, Homo sapiens
ugagacuccgucuca

SEQ ID NO: 1727962 - RNA, 20 nt, Homo sapiens
ugaggcaugagaaucacuug

SEQ ID NO: 1727963 - RNA, 21 nt, Homo sapiens
ugaguugguguugacaugugc

SEQ ID NO: 1727964 - RNA, 14 nt, Homo sapiens
ugauauaugccuau

SEQ ID NO: 1727965 - RNA, 18 nt, Homo sapiens
ugauccuucaacucugug

SEQ ID NO: 1727966 - RNA, 15 nt, Homo sapiens
ugcaggaaugcugac

SEQ ID NO: 1727967 - RNA, 14 nt, Homo sapiens
ugcagugggccauc

SEQ ID NO: 1727968 - RNA, 13 nt, Homo sapiens
ugcauauauacau

SEQ ID NO: 1727969 - RNA, 18 nt, Homo sapiens
ugccagauccucuucuca

SEQ ID NO: 1727970 - RNA, 20 nt, Homo sapiens
ugccaugggggcaacagcca

SEQ ID NO: 1727971 - RNA, 13 nt, Homo sapiens
ugcccuccagggc

SEQ ID NO: 1727972 - RNA, 20 nt, Homo sapiens
ugcccucuccugggcagcug

SEQ ID NO: 1727973 - RNA, 15 nt, Homo sapiens
ugccucaacagcagg

SEQ ID NO: 1727974 - RNA, 21 nt, Homo sapiens
ugcgccacugcacuccagucu

SEQ ID NO: 1727975 - RNA, 13 nt, Homo sapiens
ugcuaaaugcaaa

SEQ ID NO: 1727976 - RNA, 14 nt, Homo sapiens
ugcucccacagaac

SEQ ID NO: 1727977 - RNA, 21 nt, Homo sapiens
ugcucggcuguaaacagcucu

SEQ ID NO: 1727978 - RNA, 10 nt, Homo sapiens
ugcuugccau

SEQ ID NO: 1727979 - RNA, 19 nt, Homo sapiens
ugcuuuaguacauggagcu

SEQ ID NO: 1727980 - RNA, 18 nt, Homo sapiens
uggaaauuaaacccugcc

SEQ ID NO: 1727981 - RNA, 16 nt, Homo sapiens
uggaacaagcacagau

SEQ ID NO: 1727982 - RNA, 18 nt, Homo sapiens
uggacaggggcgugggau

SEQ ID NO: 1727983 - RNA, 19 nt, Homo sapiens
uggacaggggcgugggauu

SEQ ID NO: 1727984 - RNA, 22 nt, Homo sapiens
uggacaggggcgugggauugaa

SEQ ID NO: 1727985 - RNA, 15 nt, Homo sapiens
uggagucaguagcca

SEQ ID NO: 1727986 - RNA, 16 nt, Homo sapiens
uggcaagcugcaaaag

SEQ ID NO: 1727987 - RNA, 15 nt, Homo sapiens
uggcgcaucauaugc

SEQ ID NO: 1727988 - RNA, 13 nt, Homo sapiens
ugggacagacagc

SEQ ID NO: 1727989 - RNA, 16 nt, Homo sapiens
ugggacagacagcagc

SEQ ID NO: 1727990 - RNA, 22 nt, Homo sapiens
uggggacaccagccaucaugug

SEQ ID NO: 1727991 - RNA, 14 nt, Homo sapiens
ugggggcccaaagg

SEQ ID NO: 1727992 - RNA, 13 nt, Homo sapiens
ugguaaguaacug

SEQ ID NO: 1727993 - RNA, 15 nt, Homo sapiens
ugguggagaaccaca

SEQ ID NO: 1727994 - RNA, 16 nt, Homo sapiens
uguaauaaacucucua

SEQ ID NO: 1727995 - RNA, 12 nt, Homo sapiens
ugucagugcucg

SEQ ID NO: 1727996 - RNA, 23 nt, Homo sapiens
uguccugaacugugaguccugau

SEQ ID NO: 1727997 - RNA, 17 nt, Homo sapiens
ugucguaguuacucuca

SEQ ID NO: 1727998 - RNA, 13 nt, Homo sapiens
ugucucugagaac

SEQ ID NO: 1727999 - RNA, 11 nt, Homo sapiens
ugucucugagg

SEQ ID NO: 1728000 - RNA, 19 nt, Homo sapiens
ugugaaauaccaaccugaa

SEQ ID NO: 1728001 - RNA, 14 nt, Homo sapiens
ugugauauaugcau

SEQ ID NO: 1728002 - RNA, 17 nt, Homo sapiens
ugugcccuagggcucag

SEQ ID NO: 1728003 - RNA, 21 nt, Homo sapiens
ugugcgacuucacaaaaugca

SEQ ID NO: 1728004 - RNA, 19 nt, Homo sapiens
ugugguggugggugccugu

SEQ ID NO: 1728005 - RNA, 22 nt, Homo sapiens
ugugguuaaugccauggacaga

SEQ ID NO: 1728006 - RNA, 17 nt, Homo sapiens
uguguuucuggggacac

SEQ ID NO: 1728007 - RNA, 21 nt, Homo sapiens
uguguuucuggggacaccagc

SEQ ID NO: 1728008 - RNA, 14 nt, Homo sapiens
uguugacaugugcu

SEQ ID NO: 1728009 - RNA, 17 nt, Homo sapiens
uguuguccugaacugug

SEQ ID NO: 1728010 - RNA, 16 nt, Homo sapiens
uguuucugaaugacau

SEQ ID NO: 1728011 - RNA, 15 nt, Homo sapiens
uuaaaauguauuuac

SEQ ID NO: 1728012 - RNA, 21 nt, Homo sapiens
uuaaaugguguuuuauuacaa

SEQ ID NO: 1728013 - RNA, 14 nt, Homo sapiens
uuacagacugugag

SEQ ID NO: 1728014 - RNA, 15 nt, Homo sapiens
uuagccagugaugcu

SEQ ID NO: 1728015 - RNA, 14 nt, Homo sapiens
uuagguugcuucag

SEQ ID NO: 1728016 - RNA, 18 nt, Homo sapiens
uucaggcaacgcacaaaa

SEQ ID NO: 1728017 - RNA, 22 nt, Homo sapiens
uucagggaugcucauuccauga

SEQ ID NO: 1728018 - RNA, 14 nt, Homo sapiens
uuccacuuccugcc

SEQ ID NO: 1728019 - RNA, 16 nt, Homo sapiens
uuccaugaaaaugcaa

SEQ ID NO: 1728020 - RNA, 20 nt, Homo sapiens
uucccuccacccacuugccu

SEQ ID NO: 1728021 - RNA, 12 nt, Homo sapiens
uucccugccaca

SEQ ID NO: 1728022 - RNA, 21 nt, Homo sapiens
uuccgcaccaauaaagccuuc

SEQ ID NO: 1728023 - RNA, 16 nt, Homo sapiens
uucgauggcauccugc

SEQ ID NO: 1728024 - RNA, 17 nt, Homo sapiens
uucuggggcuuugccau

SEQ ID NO: 1728025 - RNA, 12 nt, Homo sapiens
acacaaggucau

SEQ ID NO: 1728026 - RNA, 16 nt, Homo sapiens
acaccagguagaacac

SEQ ID NO: 1728027 - RNA, 14 nt, Homo sapiens
acacccaccugcug

SEQ ID NO: 1728028 - RNA, 14 nt, Homo sapiens
acaccguucauuca

SEQ ID NO: 1728029 - RNA, 13 nt, Homo sapiens
acaccuaagagaa

SEQ ID NO: 1728030 - RNA, 17 nt, Homo sapiens
acacuaauacaccaggu

SEQ ID NO: 1728031 - RNA, 15 nt, Homo sapiens
acacugucuugaaga

SEQ ID NO: 1728032 - RNA, 17 nt, Homo sapiens
acagcucuguguuucug

SEQ ID NO: 1728033 - RNA, 12 nt, Homo sapiens
acagcugcgaca

SEQ ID NO: 1728034 - RNA, 19 nt, Homo sapiens
acagcuucauguucccaaa

SEQ ID NO: 1728035 - RNA, 22 nt, Homo sapiens
acaggcaaauccgaaaucagca

SEQ ID NO: 1728036 - RNA, 14 nt, Homo sapiens
accaauaaagccuu

SEQ ID NO: 1728037 - RNA, 12 nt, Homo sapiens
accaucugccaa

SEQ ID NO: 1728038 - RNA, 19 nt, Homo sapiens
acccaccugcugcuguaug

SEQ ID NO: 1728039 - RNA, 15 nt, Homo sapiens
acccauaucugugug

SEQ ID NO: 1728040 - RNA, 21 nt, Homo sapiens
accccaucccuggcugaccug

SEQ ID NO: 1728041 - RNA, 14 nt, Homo sapiens
acccucauacacag

SEQ ID NO: 1728042 - RNA, 19 nt, Homo sapiens
accuaagcaaucacugggc

SEQ ID NO: 1728043 - RNA, 14 nt, Homo sapiens
accucccugcaaua

SEQ ID NO: 1728044 - RNA, 16 nt, Homo sapiens
accucccugcaauaaa

SEQ ID NO: 1728045 - RNA, 22 nt, Homo sapiens
accuguucuuccuaccaaauau

SEQ ID NO: 1728046 - RNA, 17 nt, Homo sapiens
acgaaucguacuucuuu

SEQ ID NO: 1728047 - RNA, 22 nt, Homo sapiens
acgacaagauuuucuacuuuuu

SEQ ID NO: 1728048 - RNA, 18 nt, Homo sapiens
acgauucuucacuucuug

SEQ ID NO: 1728049 - RNA, 16 nt, Homo sapiens
acuccauuacuaaaga

SEQ ID NO: 1728050 - RNA, 17 nt, Homo sapiens
acucucaggcauggaug

SEQ ID NO: 1728051 - RNA, 16 nt, Homo sapiens
acucugaaacugagaa

SEQ ID NO: 1728052 - RNA, 19 nt, Homo sapiens
acugaaggcauaugcuggc

SEQ ID NO: 1728053 - RNA, 15 nt, Homo sapiens
acugcccuccagggc

SEQ ID NO: 1728054 - RNA, 15 nt, Homo sapiens
acugcucaggccuca

SEQ ID NO: 1728055 - RNA, 15 nt, Homo sapiens
acuggaugaggucau

SEQ ID NO: 1728056 - RNA, 18 nt, Homo sapiens
acuguauauagaagucua

SEQ ID NO: 1728057 - RNA, 15 nt, Homo sapiens
acuguggaacugcca

SEQ ID NO: 1728058 - RNA, 17 nt, Homo sapiens
gcaugagaaucacuuga

SEQ ID NO: 1728059 - RNA, 18 nt, Homo sapiens
gcaugagaaucacuugaa

SEQ ID NO: 1728060 - RNA, 14 nt, Homo sapiens
gcaugugugugaug

SEQ ID NO: 1728061 - RNA, 15 nt, Homo sapiens
gccaaugccaugacu

SEQ ID NO: 1728062 - RNA, 19 nt, Homo sapiens
gccaggauucaggccucug

SEQ ID NO: 1728063 - RNA, 13 nt, Homo sapiens
gcccgugcccuac

SEQ ID NO: 1728064 - RNA, 19 nt, Homo sapiens
gcccucagauuccgcacca

SEQ ID NO: 1728065 - RNA, 23 nt, Homo sapiens
gcccugugcccccugaaacagcu

SEQ ID NO: 1728066 - RNA, 13 nt, Homo sapiens
gccgggacaugca

SEQ ID NO: 1728067 - RNA, 23 nt, Homo sapiens
gccuccccuccucugcuugccau

SEQ ID NO: 1728068 - RNA, 13 nt, Homo sapiens
gccuucaaacucc

SEQ ID NO: 1728069 - RNA, 22 nt, Homo sapiens
gccuuggagucgucuggcaucu

SEQ ID NO: 1728070 - RNA, 17 nt, Homo sapiens
gcucaguucugccuuau

SEQ ID NO: 1728071 - RNA, 15 nt, Homo sapiens
gcucauuccaugacu

SEQ ID NO: 1728072 - RNA, 22 nt, Homo sapiens
gcuccacuuucagugaaagcau

SEQ ID NO: 1728073 - RNA, 17 nt, Homo sapiens
gcucugcuggucacugg

SEQ ID NO: 1728074 - RNA, 19 nt, Homo sapiens
gcugccaugcccaccaucg

SEQ ID NO: 1728075 - RNA, 16 nt, Homo sapiens
gcugggccaguggcac

SEQ ID NO: 1728076 - RNA, 23 nt, Homo sapiens
gcuugauugcguggaauugugcu

SEQ ID NO: 1728077 - RNA, 23 nt, Homo sapiens
gcuuggcugugcccucagauucc

SEQ ID NO: 1728078 - RNA, 17 nt, Homo sapiens
ggaaacuggaugagguc

SEQ ID NO: 1728079 - RNA, 18 nt, Homo sapiens
ggacacuaauacaccagg

SEQ ID NO: 1728080 - RNA, 23 nt, Homo sapiens
ggacaggggcgugggauugaauu

SEQ ID NO: 1728081 - RNA, 20 nt, Homo sapiens
ggacuaauccaauaccucuu

SEQ ID NO: 1728082 - RNA, 20 nt, Homo sapiens
ggagacagacacacacuggc

SEQ ID NO: 1728083 - RNA, 20 nt, Homo sapiens
ggagguggagguugcaguga

SEQ ID NO: 1728084 - RNA, 14 nt, Homo sapiens
ggagguugcaguga

SEQ ID NO: 1728085 - RNA, 16 nt, Homo sapiens
ggagucaugugccucu

SEQ ID NO: 1728086 - RNA, 20 nt, Homo sapiens
ggauaccccaaaguccaggc

SEQ ID NO: 1728087 - RNA, 20 nt, Homo sapiens
ggauugaauuaaaacagcug

SEQ ID NO: 1728088 - RNA, 15 nt, Homo sapiens
ggcaagcugcaaaag

SEQ ID NO: 1728089 - RNA, 15 nt, Homo sapiens
ggcaccaucugccaa

SEQ ID NO: 1728090 - RNA, 19 nt, Homo sapiens
ggcacuguccagggcccau

SEQ ID NO: 1728091 - RNA, 21 nt, Homo sapiens
ggcagaaagauggagaggcau

SEQ ID NO: 1728092 - RNA, 17 nt, Homo sapiens
ggcaggggcaguggccu

SEQ ID NO: 1728093 - RNA, 18 nt, Homo sapiens
ggcaucucccacacaaga

SEQ ID NO: 1728094 - RNA, 14 nt, Homo sapiens
ggccaguggcacuc

SEQ ID NO: 1728095 - RNA, 17 nt, Homo sapiens
ggccccugggccugcca

SEQ ID NO: 1728096 - RNA, 14 nt, Homo sapiens
ggcccguccggcgg

SEQ ID NO: 1728097 - RNA, 15 nt, Homo sapiens
ggcgcaucauaugca

SEQ ID NO: 1728098 - RNA, 14 nt, Homo sapiens
ggcgugggauugaa

SEQ ID NO: 1728099 - RNA, 13 nt, Homo sapiens
ggcucagggccag

SEQ ID NO: 1728100 - RNA, 14 nt, Homo sapiens
ggcucagggccagg

SEQ ID NO: 1728101 - RNA, 17 nt, Homo sapiens
ggcuccagacaggagga

SEQ ID NO: 1728102 - RNA, 14 nt, Homo sapiens
ccucauacacagaa

SEQ ID NO: 1728103 - RNA, 22 nt, Homo sapiens
ccuccaggaugaguuacuugaa

SEQ ID NO: 1728104 - RNA, 16 nt, Homo sapiens
ccucgcccuccacaaa

SEQ ID NO: 1728105 - RNA, 16 nt, Homo sapiens
ccugcagugggccauc

SEQ ID NO: 1728106 - RNA, 14 nt, Homo sapiens
ccugcucccacaga

SEQ ID NO: 1728107 - RNA, 19 nt, Homo sapiens
ccuguucuuccuaccaaau

SEQ ID NO: 1728108 - RNA, 19 nt, Homo sapiens
ccuuaauucacucccacac

SEQ ID NO: 1728109 - RNA, 20 nt, Homo sapiens
ccuucuggggcuuugccauu

SEQ ID NO: 1728110 - RNA, 22 nt, Homo sapiens
ccuucuggugccagauccucuu

SEQ ID NO: 1728111 - RNA, 16 nt, Homo sapiens
ccuugaguguguuacc

SEQ ID NO: 1728112 - RNA, 22 nt, Homo sapiens
ccuuuccaagcuccucgugaua

SEQ ID NO: 1728113 - RNA, 17 nt, Homo sapiens
ccuuuuauuucuuaaac

SEQ ID NO: 1728114 - RNA, 20 nt, Homo sapiens
ccuuuucuuguaaacauugc

SEQ ID NO: 1728115 - RNA, 14 nt, Homo sapiens
cgacuguuuuccca

SEQ ID NO: 1728116 - RNA, 17 nt, Homo sapiens
cgcaccaauaaagccuu

SEQ ID NO: 1728117 - RNA, 18 nt, Homo sapiens
cgcaccaauaaagccuuc

SEQ ID NO: 1728118 - RNA, 16 nt, Homo sapiens
cgugaaagcagaugag

SEQ ID NO: 1728119 - RNA, 15 nt, Homo sapiens
cgugcccuaccacac

SEQ ID NO: 1728120 - RNA, 17 nt, Homo sapiens
cguguacuacaauuuaa

SEQ ID NO: 1728121 - RNA, 17 nt, Homo sapiens
cuaagcaaucacugggc

SEQ ID NO: 1728122 - RNA, 20 nt, Homo sapiens
cuaagcugccgguucuuaaa

SEQ ID NO: 1728123 - RNA, 20 nt, Homo sapiens
cuaccuucuuuggccccuug

SEQ ID NO: 1728124 - RNA, 16 nt, Homo sapiens
cuagcaggaauauuuc

SEQ ID NO: 1728125 - RNA, 14 nt, Homo sapiens
cuauauuaggcaug

SEQ ID NO: 1728126 - RNA, 14 nt, Homo sapiens
cucaaaugcuaaau

SEQ ID NO: 1728127 - RNA, 19 nt, Homo sapiens
cucaggcauggaugaauaa

SEQ ID NO: 1728128 - RNA, 17 nt, Homo sapiens
cucagguucccugccac

SEQ ID NO: 1728129 - RNA, 21 nt, Homo sapiens
cuccaggaugaguuacuugaa

SEQ ID NO: 1728130 - RNA, 12 nt, Homo sapiens
cucccacagaac

SEQ ID NO: 1728131 - RNA, 22 nt, Homo sapiens
cucccacauugucaccauuuca

SEQ ID NO: 1728132 - RNA, 14 nt, Homo sapiens
cucuccuugccugg

SEQ ID NO: 1728133 - RNA, 16 nt, Homo sapiens
cucucuaaacccaaau

SEQ ID NO: 1728134 - RNA, 18 nt, Homo sapiens
cucugaggagcccacggg

SEQ ID NO: 1728135 - RNA, 13 nt, Homo sapiens
cucugcuugccau

SEQ ID NO: 1728136 - RNA, 22 nt, Homo sapiens
cucuguguuucuggggacacca

SEQ ID NO: 1728137 - RNA, 20 nt, Homo sapiens
cucuuucuuauuuuguaaua

SEQ ID NO: 1728138 - RNA, 19 nt, Homo sapiens
cugaaggcugaaagacagg

SEQ ID NO: 1728139 - RNA, 13 nt, Homo sapiens
cugagaaacuucc

SEQ ID NO: 1728140 - RNA, 18 nt, Homo sapiens
cugagaaacuuccuuuga

SEQ ID NO: 1728141 - RNA, 21 nt, Homo sapiens
cugagaagauggcacugucca

SEQ ID NO: 1728142 - RNA, 14 nt, Homo sapiens
cauugggauauucu

SEQ ID NO: 1728143 - RNA, 23 nt, Homo sapiens
ccaacauuacuccauuacuaaag

SEQ ID NO: 1728144 - RNA, 21 nt, Homo sapiens
ccaagcuguuccacuucucua

SEQ ID NO: 1728145 - RNA, 13 nt, Homo sapiens
ccaaguagcugcu

SEQ ID NO: 1728146 - RNA, 13 nt, Homo sapiens
ccaauaaagccuu

SEQ ID NO: 1728147 - RNA, 22 nt, Homo sapiens
ccaauuccacuuccugccccaa

SEQ ID NO: 1728148 - RNA, 23 nt, Homo sapiens
ccacagaacacagcaauuccuca

SEQ ID NO: 1728149 - RNA, 21 nt, Homo sapiens
ccacugcccuccagggccagg

SEQ ID NO: 1728150 - RNA, 22 nt, Homo sapiens
ccagcaguucagagcugcccuc

SEQ ID NO: 1728151 - RNA, 20 nt, Homo sapiens
ccagccaucaugugccugga

SEQ ID NO: 1728152 - RNA, 23 nt, Homo sapiens
ccagccaucaugugccuggaaau

SEQ ID NO: 1728153 - RNA, 18 nt, Homo sapiens
ccagguccucacagcagu

SEQ ID NO: 1728154 - RNA, 20 nt, Homo sapiens
ccaucagcaaauauuauucu

SEQ ID NO: 1728155 - RNA, 21 nt, Homo sapiens
ccauggacagaagaaggcagc

SEQ ID NO: 1728156 - RNA, 15 nt, Homo sapiens
cccagccagcaguuc

SEQ ID NO: 1728157 - RNA, 17 nt, Homo sapiens
cccagccagcaguucag

SEQ ID NO: 1728158 - RNA, 23 nt, Homo sapiens
ccccaacaucucccucccacauu

SEQ ID NO: 1728159 - RNA, 16 nt, Homo sapiens
uaaauucacauccuca

SEQ ID NO: 1728160 - RNA, 18 nt, Homo sapiens
uaaauucagaaagucaua

SEQ ID NO: 1728161 - RNA, 23 nt, Homo sapiens
uaacauaaauuuaucaucucgac

SEQ ID NO: 1728162 - RNA, 24 nt, Homo sapiens
uaagcagaagacucuccacugacc

SEQ ID NO: 1728163 - RNA, 15 nt, Homo sapiens
uaauaaacucucuag

SEQ ID NO: 1728164 - RNA, 16 nt, Homo sapiens
uaauccaauaccucuu

SEQ ID NO: 1728165 - RNA, 21 nt, Homo sapiens
uaauuugauaguauugugcau

SEQ ID NO: 1728166 - RNA, 21 nt, Homo sapiens
uacaaaauaaagcuguucuca

SEQ ID NO: 1728167 - RNA, 16 nt, Homo sapiens
uacacuuugaaguauu

SEQ ID NO: 1728168 - RNA, 17 nt, Homo sapiens
uacauggagcucagguu

SEQ ID NO: 1728169 - RNA, 12 nt, Homo sapiens
uaccaugcugaa

SEQ ID NO: 1728170 - RNA, 23 nt, Homo sapiens
uaccaugucguaguuacucucag

SEQ ID NO: 1728171 - RNA, 16 nt, Homo sapiens
uacuagcaggaauauu

SEQ ID NO: 1728172 - RNA, 23 nt, Homo sapiens
uacuaguguguguguguauauau

SEQ ID NO: 1728173 - RNA, 17 nt, Homo sapiens
uagaauuuggcccagag

SEQ ID NO: 1728174 - RNA, 20 nt, Homo sapiens
uagcaaccuucugcauucau

SEQ ID NO: 1728175 - RNA, 13 nt, Homo sapiens
uagcagcugcuac

SEQ ID NO: 1728176 - RNA, 23 nt, Homo sapiens
gaauuaaguuagggaauggcaca

SEQ ID NO: 1728177 - RNA, 16 nt, Homo sapiens
gacagcgccaccucuu

SEQ ID NO: 1728178 - RNA, 18 nt, Homo sapiens
gacccaaguagcugcuac

SEQ ID NO: 1728179 - RNA, 17 nt, Homo sapiens
gaccugguuguccaggu

SEQ ID NO: 1728180 - RNA, 22 nt, Homo sapiens
gaccuucuaggaagcuccaguu

SEQ ID NO: 1728181 - RNA, 16 nt, Homo sapiens
gacgacuguuuuccca

SEQ ID NO: 1728182 - RNA, 18 nt, Homo sapiens
gacucuagaagcucaggu

SEQ ID NO: 1728183 - RNA, 16 nt, Homo sapiens
gacucuuuuccaaaca

SEQ ID NO: 1728184 - RNA, 17 nt, Homo sapiens
gacuucacaaaaugcaa

SEQ ID NO: 1728185 - RNA, 18 nt, Homo sapiens
gacuugacagaacacugu

SEQ ID NO: 1728186 - RNA, 20 nt, Homo sapiens
gacuugacagaacacugucu

SEQ ID NO: 1728187 - RNA, 21 nt, Homo sapiens
gagaagauggcacuguccagg

SEQ ID NO: 1728188 - RNA, 16 nt, Homo sapiens
gagagagugcugagaa

SEQ ID NO: 1728189 - RNA, 16 nt, Homo sapiens
gagcaccgccugugaa

SEQ ID NO: 1728190 - RNA, 16 nt, Homo sapiens
gagcugggauguuucu

SEQ ID NO: 1728191 - RNA, 23 nt, Homo sapiens
gaggauaccccaaaguccaggcu

SEQ ID NO: 1728192 - RNA, 15 nt, Homo sapiens
gaguacaaacacagg

SEQ ID NO: 1728193 - RNA, 12 nt, Homo sapiens
gagugcugagaa

SEQ ID NO: 1728194 - RNA, 20 nt, Homo sapiens
caggcaacgcacaaaacaga

SEQ ID NO: 1728195 - RNA, 19 nt, Homo sapiens
caggggcgugggauugaau

SEQ ID NO: 1728196 - RNA, 17 nt, Homo sapiens
cagugcucggcuguaaa

SEQ ID NO: 1728197 - RNA, 23 nt, Homo sapiens
cagugcucggcuguaaacagcuc

SEQ ID NO: 1728198 - RNA, 18 nt, Homo sapiens
caguggcauucacaucuc

SEQ ID NO: 1728199 - RNA, 23 nt, Homo sapiens
caguggcccauaaguguaaaaua

SEQ ID NO: 1728200 - RNA, 16 nt, Homo sapiens
caguuccuuucaaugg

SEQ ID NO: 1728201 - RNA, 17 nt, Homo sapiens
cauagcagcugcuacua

SEQ ID NO: 1728202 - RNA, 18 nt, Homo sapiens
cauagcagcugcuacuag

SEQ ID NO: 1728203 - RNA, 24 nt, Homo sapiens
cauccuuggaaauuggaagagcac

SEQ ID NO: 1728204 - RNA, 18 nt, Homo sapiens
caugcacccucauacaca

SEQ ID NO: 1728205 - RNA, 20 nt, Homo sapiens
cauguagcuggcaagcugca

SEQ ID NO: 1728206 - RNA, 19 nt, Homo sapiens
cauucaggcaacgcacaaa

SEQ ID NO: 1728207 - RNA, 20 nt, Homo sapiens
cauucucuugaaggugcugc

SEQ ID NO: 1728208 - RNA, 18 nt, Homo sapiens
ccaaauaaauguguaaau

SEQ ID NO: 1728209 - RNA, 19 nt, Homo sapiens
ccaaauauaaacuugugua

SEQ ID NO: 1728210 - RNA, 14 nt, Homo sapiens
ccaaauuacgugua

SEQ ID NO: 1728211 - RNA, 20 nt, Homo sapiens
ccaaauuacguguacuacaa

SEQ ID NO: 1728212 - RNA, 16 nt, Homo sapiens
ccaaccugaagacacc

SEQ ID NO: 1728213 - RNA, 14 nt, Homo sapiens
ccaaugccaugacu

SEQ ID NO: 1728214 - RNA, 10 nt, Homo sapiens
ccacauaaca

SEQ ID NO: 1728215 - RNA, 19 nt, Homo sapiens
ccacuuucuucuaccagac

SEQ ID NO: 1728216 - RNA, 16 nt, Homo sapiens
ccagaaggauauuuac

SEQ ID NO: 1728217 - RNA, 13 nt, Homo sapiens
ccagcacucugaa

SEQ ID NO: 1728218 - RNA, 18 nt, Homo sapiens
ccagcacucugaaacuga

SEQ ID NO: 1728219 - RNA, 19 nt, Homo sapiens
ccagcccuccccaccugcu

SEQ ID NO: 1728220 - RNA, 21 nt, Homo sapiens
ccaucccuggcugaccugcug

SEQ ID NO: 1728221 - RNA, 22 nt, Homo sapiens
ccaugaaacuuuagagauuaac

SEQ ID NO: 1728222 - RNA, 20 nt, Homo sapiens
ccaugacugcucaggccuca

SEQ ID NO: 1728223 - RNA, 17 nt, Homo sapiens
ccaugggagaguccagg

SEQ ID NO: 1728224 - RNA, 18 nt, Homo sapiens
ccauuuuucuagacuguc

SEQ ID NO: 1728225 - RNA, 13 nt, Homo sapiens
cccacagguauga

SEQ ID NO: 1728226 - RNA, 16 nt, Homo sapiens
cccaccugcugcugua

SEQ ID NO: 1728227 - RNA, 15 nt, Homo sapiens
cccaggguacacucu

SEQ ID NO: 1728228 - RNA, 20 nt, Homo sapiens
ccccagauggccgggacaug

SEQ ID NO: 1728229 - RNA, 13 nt, Homo sapiens
cccuacugagaaa

SEQ ID NO: 1728230 - RNA, 13 nt, Homo sapiens
cccugcucccaca

SEQ ID NO: 1728231 - RNA, 18 nt, Homo sapiens
ccgaggggcucaguucug

SEQ ID NO: 1728232 - RNA, 13 nt, Homo sapiens
ccggugaagugca

SEQ ID NO: 1728233 - RNA, 17 nt, Homo sapiens
ccgguucuuaaauccau

SEQ ID NO: 1728234 - RNA, 18 nt, Homo sapiens
ccguacgacucuuuucca

SEQ ID NO: 1728235 - RNA, 23 nt, Homo sapiens
ccuaaccaugggcucagggccag

SEQ ID NO: 1728236 - RNA, 12 nt, Homo sapiens
ccuaccaaauau

SEQ ID NO: 1728237 - RNA, 12 nt, Homo sapiens
ccucagauuccg

SEQ ID NO: 1728238 - RNA, 22 nt, Homo sapiens
ccuccccaccugcucaccaauu

SEQ ID NO: 1728239 - RNA, 15 nt, Homo sapiens
ccucgcccuccacaa

SEQ ID NO: 1728240 - RNA, 17 nt, Homo sapiens
ccucgguacucccauaa

SEQ ID NO: 1728241 - RNA, 21 nt, Homo sapiens
ccugauuuguuccuucugggg

SEQ ID NO: 1728242 - RNA, 15 nt, Homo sapiens
ccugcuggacagggg

SEQ ID NO: 1728243 - RNA, 23 nt, Homo sapiens
ccuggagucaguagccagaguug

SEQ ID NO: 1728244 - RNA, 16 nt, Homo sapiens
ccugggcagcugccuc

SEQ ID NO: 1728245 - RNA, 20 nt, Homo sapiens
ccuuaucuaaaucaccagag

SEQ ID NO: 1728246 - RNA, 17 nt, Homo sapiens
ccuuccccagacuucuc

SEQ ID NO: 1728247 - RNA, 22 nt, Homo sapiens
ccuucucagaccugcgcacucc

SEQ ID NO: 1728248 - RNA, 21 nt, Homo sapiens
cgccaccucuugucagugcuc

SEQ ID NO: 1728249 - RNA, 16 nt, Homo sapiens
cgccuggccccugggc

SEQ ID NO: 1728250 - RNA, 13 nt, Homo sapiens
cgugauaaugcag

SEQ ID NO: 1728251 - RNA, 20 nt, Homo sapiens
cgugauaaugcagacuuccu

SEQ ID NO: 1728252 - RNA, 13 nt, Homo sapiens
cuaacuagcuugg

SEQ ID NO: 1728253 - RNA, 21 nt, Homo sapiens
cuaacuuuuuugcuauccagc

SEQ ID NO: 1728254 - RNA, 14 nt, Homo sapiens
cuaggucugaccaa

SEQ ID NO: 1728255 - RNA, 16 nt, Homo sapiens
cuauauggcagugucu

SEQ ID NO: 1728256 - RNA, 21 nt, Homo sapiens
cuauuuucaacauaacugaag

SEQ ID NO: 1728257 - RNA, 22 nt, Homo sapiens
cuauuuuuauuuguuugugcau

SEQ ID NO: 1728258 - RNA, 23 nt, Homo sapiens
cuauuuuuauuuguuugugcauu

SEQ ID NO: 1728259 - RNA, 18 nt, Homo sapiens
cucagguucccugccaca

SEQ ID NO: 1728260 - RNA, 13 nt, Homo sapiens
cucauacacagaa

SEQ ID NO: 1728261 - RNA, 22 nt, Homo sapiens
cuccaggaugaguuacuugaaa

SEQ ID NO: 1728262 - RNA, 13 nt, Homo sapiens
cucuacucuggaa

SEQ ID NO: 1728263 - RNA, 15 nt, Homo sapiens
cucuagagaacaugc

SEQ ID NO: 1728264 - RNA, 21 nt, Homo sapiens
cucucaggcauggaugaauaa

SEQ ID NO: 1728265 - RNA, 22 nt, Homo sapiens
cucuucagaauauggacaaaga

SEQ ID NO: 1728266 - RNA, 17 nt, Homo sapiens
cucuucucaaagcuggg

SEQ ID NO: 1728267 - RNA, 17 nt, Homo sapiens
cugaaaauuaacacugc

SEQ ID NO: 1728268 - RNA, 16 nt, Homo sapiens
cugaaacagcugccac

SEQ ID NO: 1728269 - RNA, 15 nt, Homo sapiens
cugaacucuaagcag

SEQ ID NO: 1728270 - RNA, 15 nt, Homo sapiens
cugagaaauguucag

SEQ ID NO: 1728271 - RNA, 18 nt, Homo sapiens
cugagacuuucagugcac

SEQ ID NO: 1728272 - RNA, 17 nt, Homo sapiens
cugauccuucaacucug

SEQ ID NO: 1728273 - RNA, 18 nt, Homo sapiens
cugccaugcccaccaucg

SEQ ID NO: 1728274 - RNA, 19 nt, Homo sapiens
cugccccacuucucuacuc

SEQ ID NO: 1728275 - RNA, 23 nt, Homo sapiens
cugccccacuucucuacucugga

SEQ ID NO: 1728276 - RNA, 13 nt, Homo sapiens
cugcuugccaucc

SEQ ID NO: 1728277 - RNA, 20 nt, Homo sapiens
cugggaucaagaaggggaca

SEQ ID NO: 1728278 - RNA, 20 nt, Homo sapiens
cugggauccgggaucaaagu

SEQ ID NO: 1728279 - RNA, 22 nt, Homo sapiens
cugggccaguggcacucugugu

SEQ ID NO: 1728280 - RNA, 15 nt, Homo sapiens
cuggggacaccagcc

SEQ ID NO: 1728281 - RNA, 15 nt, Homo sapiens
cuggggcuuugccau

SEQ ID NO: 1728282 - RNA, 17 nt, Homo sapiens
cuguauuucaagaccuc

SEQ ID NO: 1728283 - RNA, 15 nt, Homo sapiens
cuguggaugucccua

SEQ ID NO: 1728284 - RNA, 19 nt, Homo sapiens
cuuaaagcacagucugaug

SEQ ID NO: 1728285 - RNA, 16 nt, Homo sapiens
cuucagccaaacacaa

SEQ ID NO: 1728286 - RNA, 22 nt, Homo sapiens
cuucuguucucaaaugcuaaau

SEQ ID NO: 1728287 - RNA, 20 nt, Homo sapiens
cuugaagguuugaugccaaa

SEQ ID NO: 1728288 - RNA, 14 nt, Homo sapiens
cuugaguguguuac

SEQ ID NO: 1728289 - RNA, 14 nt, Homo sapiens
cuugccaucccucc

SEQ ID NO: 1728290 - RNA, 11 nt, Homo sapiens
cuuggcacugu

SEQ ID NO: 1728291 - RNA, 17 nt, Homo sapiens
cuuggccgacucaggga

SEQ ID NO: 1728292 - RNA, 10 nt, Homo sapiens
cuuggcugug

SEQ ID NO: 1728293 - RNA, 18 nt, Homo sapiens
gaaagacagagcugggau

SEQ ID NO: 1728294 - RNA, 15 nt, Homo sapiens
gaacacaaggucauu

SEQ ID NO: 1728295 - RNA, 14 nt, Homo sapiens
gaaccucaaacugg

SEQ ID NO: 1728296 - RNA, 19 nt, Homo sapiens
gaagacuauauuguacaca

SEQ ID NO: 1728297 - RNA, 14 nt, Homo sapiens
gaaggugcugccac

SEQ ID NO: 1728298 - RNA, 18 nt, Homo sapiens
gaauuaaaacagcugcga

SEQ ID NO: 1728299 - RNA, 13 nt, Homo sapiens
gaauuucccacau

SEQ ID NO: 1728300 - RNA, 14 nt, Homo sapiens
gacaaugcugccau

SEQ ID NO: 1728301 - RNA, 19 nt, Homo sapiens
gacaaugcugccaugccca

SEQ ID NO: 1728302 - RNA, 23 nt, Homo sapiens
gacaccagccaucaugugccugg

SEQ ID NO: 1728303 - RNA, 14 nt, Homo sapiens
gacagagcugggau

SEQ ID NO: 1728304 - RNA, 20 nt, Homo sapiens
gacaggggcgugggauugaa

SEQ ID NO: 1728305 - RNA, 21 nt, Homo sapiens
gacaugcagcucugaugagag

SEQ ID NO: 1728306 - RNA, 14 nt, Homo sapiens
gacccaaguagcug

SEQ ID NO: 1728307 - RNA, 20 nt, Homo sapiens
gacuccgucucaaaaacaaa

SEQ ID NO: 1728308 - RNA, 14 nt, Homo sapiens
gacucgggccuuag

SEQ ID NO: 1728309 - RNA, 19 nt, Homo sapiens
gagaaggacaccuccuucc

SEQ ID NO: 1728310 - RNA, 17 nt, Homo sapiens
gagaaucacuugaacuc

SEQ ID NO: 1728311 - RNA, 24 nt, Homo sapiens
gagagugcugagaaggacaccucc

SEQ ID NO: 1728312 - RNA, 21 nt, Homo sapiens
gagauugcgccacugcacucc

SEQ ID NO: 1728313 - RNA, 14 nt, Homo sapiens
gagcuuccacuguc

SEQ ID NO: 1728314 - RNA, 23 nt, Homo sapiens
gagggguugaugccagacaucac

SEQ ID NO: 1728315 - RNA, 17 nt, Homo sapiens
gaggguggggugcccca

SEQ ID NO: 1728316 - RNA, 20 nt, Homo sapiens
gagguggagguugcagugag

SEQ ID NO: 1728317 - RNA, 14 nt, Homo sapiens
gaucuaauuuacau

SEQ ID NO: 1728318 - RNA, 21 nt, Homo sapiens
gaugaggucauagcagugcuu

SEQ ID NO: 1728319 - RNA, 17 nt, Homo sapiens
ugucccuauucugccau

SEQ ID NO: 1728320 - RNA, 18 nt, Homo sapiens
uguccuucaccuuuccca

SEQ ID NO: 1728321 - RNA, 13 nt, Homo sapiens
ugugcccucagau

SEQ ID NO: 1728322 - RNA, 17 nt, Homo sapiens
ugugcgacuucacaaaa

SEQ ID NO: 1728323 - RNA, 22 nt, Homo sapiens
ugugcugaguugguguugacau

SEQ ID NO: 1728324 - RNA, 18 nt, Homo sapiens
uguggaggagcucaggac

SEQ ID NO: 1728325 - RNA, 17 nt, Homo sapiens
uguggaugucccuauuc

SEQ ID NO: 1728326 - RNA, 18 nt, Homo sapiens
ugugggaaaauggcagaa

SEQ ID NO: 1728327 - RNA, 15 nt, Homo sapiens
uguuucuggggacac

SEQ ID NO: 1728328 - RNA, 16 nt, Homo sapiens
uguuucuuucauauga

SEQ ID NO: 1728329 - RNA, 17 nt, Homo sapiens
uguuucuuucauaugaa

SEQ ID NO: 1728330 - RNA, 16 nt, Homo sapiens
uuaaaacagcugcgac

SEQ ID NO: 1728331 - RNA, 17 nt, Homo sapiens
uuaaacaaauguaugau

SEQ ID NO: 1728332 - RNA, 21 nt, Homo sapiens
uuaaacccugccccacuucuc

SEQ ID NO: 1728333 - RNA, 18 nt, Homo sapiens
uuacucucaggcauggau

SEQ ID NO: 1728334 - RNA, 19 nt, Homo sapiens
uuauaauaaaauugguguu

SEQ ID NO: 1728335 - RNA, 18 nt, Homo sapiens
uuauagccgaaaugaucu

SEQ ID NO: 1728336 - RNA, 20 nt, Homo sapiens
uuaucaucucgaccacuuuu

SEQ ID NO: 1728337 - RNA, 13 nt, Homo sapiens
uucaacucuguga

SEQ ID NO: 1728338 - RNA, 21 nt, Homo sapiens
uucauucaggcaacgcacaaa

SEQ ID NO: 1728339 - RNA, 18 nt, Homo sapiens
uuccacuucucuagagaa

SEQ ID NO: 1728340 - RNA, 14 nt, Homo sapiens
uuccccuccugacc

SEQ ID NO: 1728341 - RNA, 20 nt, Homo sapiens
uuccuucuggggcuuugcca

SEQ ID NO: 1728342 - RNA, 16 nt, Homo sapiens
uucuaggaagcuccag

SEQ ID NO: 1728343 - RNA, 22 nt, Homo sapiens
uucucaaaugcuaaaugcaaac

SEQ ID NO: 1728344 - RNA, 22 nt, Homo sapiens
uucucacuuuccuuuucuuguc

SEQ ID NO: 1728345 - RNA, 23 nt, Homo sapiens
uucucucugugguggagaaccac

SEQ ID NO: 1728346 - RNA, 18 nt, Homo sapiens
uugaaauuugccuugagu

SEQ ID NO: 1728347 - RNA, 16 nt, Homo sapiens
uugaauauaaacacua

SEQ ID NO: 1728348 - RNA, 17 nt, Homo sapiens
uugaauuaaaacagcug

SEQ ID NO: 1728349 - RNA, 17 nt, Homo sapiens
uugcauagcagcugcua

SEQ ID NO: 1728350 - RNA, 19 nt, Homo sapiens
uugcauagcagcugcuacu

SEQ ID NO: 1728351 - RNA, 16 nt, Homo sapiens
uugggauauucugaaa

SEQ ID NO: 1728352 - RNA, 13 nt, Homo sapiens
uuggggcuuuuac

SEQ ID NO: 1728353 - RNA, 23 nt, Homo sapiens
uuguaaucauguuaccauuacaa

SEQ ID NO: 1728354 - RNA, 16 nt, Homo sapiens
uuguagcagaaaggaa

SEQ ID NO: 1728355 - RNA, 14 nt, Homo sapiens
uuuaacugcauaau

SEQ ID NO: 1728356 - RNA, 12 nt, Homo sapiens
uuuaucaucucg

SEQ ID NO: 1728357 - RNA, 19 nt, Homo sapiens
uuucagugaaagcaucacu

SEQ ID NO: 1728358 - RNA, 17 nt, Homo sapiens
uuucauguaaauuuugu

SEQ ID NO: 1728359 - RNA, 20 nt, Homo sapiens
uuuccucacacccaccugcu

SEQ ID NO: 1728360 - RNA, 18 nt, Homo sapiens
uuuccuuuucuugucucu

SEQ ID NO: 1728361 - RNA, 13 nt, Homo sapiens
uuucuagacuguc

SEQ ID NO: 1728362 - RNA, 16 nt, Homo sapiens
uuucugucacaucagc

SEQ ID NO: 1728363 - RNA, 16 nt, Homo sapiens
uuucuuacacaagagc

SEQ ID NO: 1728364 - RNA, 18 nt, Homo sapiens
uuucuuuuuuauacucaa

SEQ ID NO: 1728365 - RNA, 17 nt, Homo sapiens
uuuucaacaaguaacuu

SEQ ID NO: 1728366 - RNA, 14 nt, Homo sapiens
uuuucaacauaacu

SEQ ID NO: 1728367 - RNA, 22 nt, Homo sapiens
uuuucuuguaaacauugccuga

SEQ ID NO: 1728368 - RNA, 19 nt, Homo sapiens
uuuuguaauaaacucucua

SEQ ID NO: 1728369 - RNA, 14 nt, Homo sapiens
ugccuggagucagu

SEQ ID NO: 1728370 - RNA, 23 nt, Homo sapiens
ugccuuaucuaaaucaccagaga

SEQ ID NO: 1728371 - RNA, 22 nt, Homo sapiens
ugccuuaucucuucucacuuuc

SEQ ID NO: 1728372 - RNA, 15 nt, Homo sapiens
ugcuacuagcucuuu

SEQ ID NO: 1728373 - RNA, 20 nt, Homo sapiens
ugcucggcuguaaacagcuc

SEQ ID NO: 1728374 - RNA, 20 nt, Homo sapiens
ugcugacaaugcugccaugc

SEQ ID NO: 1728375 - RNA, 18 nt, Homo sapiens
ugcugaccagacagccuc

SEQ ID NO: 1728376 - RNA, 23 nt, Homo sapiens
ugcugccaccccuuggcacugug

SEQ ID NO: 1728377 - RNA, 21 nt, Homo sapiens
ugcuggagucaugugccucug

SEQ ID NO: 1728378 - RNA, 19 nt, Homo sapiens
ugcuggcccauaaacaccc

SEQ ID NO: 1728379 - RNA, 23 nt, Homo sapiens
ugcugggauggcuauauuaggca

SEQ ID NO: 1728380 - RNA, 16 nt, Homo sapiens
ugcugggccaguggca

SEQ ID NO: 1728381 - RNA, 14 nt, Homo sapiens
ugcuugaauugcaa

SEQ ID NO: 1728382 - RNA, 14 nt, Homo sapiens
uggaacaagcacag

SEQ ID NO: 1728383 - RNA, 18 nt, Homo sapiens
uggagcccagggugcugg

SEQ ID NO: 1728384 - RNA, 15 nt, Homo sapiens
uggagcuaaggccag

SEQ ID NO: 1728385 - RNA, 21 nt, Homo sapiens
uggagcuaaggccagcuagag

SEQ ID NO: 1728386 - RNA, 15 nt, Homo sapiens
uggcaaccuguucuu

SEQ ID NO: 1728387 - RNA, 23 nt, Homo sapiens
uggcccagagagguuaacuaaua

SEQ ID NO: 1728388 - RNA, 16 nt, Homo sapiens
uggcgcaucauaugca

SEQ ID NO: 1728389 - RNA, 14 nt, Homo sapiens
uggcugaccugcug

SEQ ID NO: 1728390 - RNA, 14 nt, Homo sapiens
uggcuuacuccagg

SEQ ID NO: 1728391 - RNA, 18 nt, Homo sapiens
ugggaaaauggcagaaag

SEQ ID NO: 1728392 - RNA, 12 nt, Homo sapiens
ugggcagcugcc

SEQ ID NO: 1728393 - RNA, 18 nt, Homo sapiens
ugggcauuuucccagaug

SEQ ID NO: 1728394 - RNA, 17 nt, Homo sapiens
uggugggugccuguaau

SEQ ID NO: 1728395 - RNA, 17 nt, Homo sapiens
ugguggugggugccugu

SEQ ID NO: 1728396 - RNA, 13 nt, Homo sapiens
uguaaacagcucu

SEQ ID NO: 1728397 - RNA, 13 nt, Homo sapiens
uguaauaaacucu

SEQ ID NO: 1728398 - RNA, 16 nt, Homo sapiens
uguaauagugacauau

SEQ ID NO: 1728399 - RNA, 17 nt, Homo sapiens
uguaaucccagcuacau

SEQ ID NO: 1728400 - RNA, 16 nt, Homo sapiens
uguaggugaaaggcau

SEQ ID NO: 1728401 - RNA, 23 nt, Homo sapiens
ugugccaaacuaccguucccaaa

SEQ ID NO: 1728402 - RNA, 17 nt, Homo sapiens
ugugccaaagugcauag

SEQ ID NO: 1728403 - RNA, 23 nt, Homo sapiens
ugugcccccugaaacagcugcca

SEQ ID NO: 1728404 - RNA, 19 nt, Homo sapiens
ugugccugcugggcacugg

SEQ ID NO: 1728405 - RNA, 13 nt, Homo sapiens
ugugguuuacuag

SEQ ID NO: 1728406 - RNA, 12 nt, Homo sapiens
ugugugugauau

SEQ ID NO: 1728407 - RNA, 23 nt, Homo sapiens
uguuccuucuggggcuuugccau

SEQ ID NO: 1728408 - RNA, 18 nt, Homo sapiens
uguucucaaaugcuaaau

SEQ ID NO: 1728409 - RNA, 19 nt, Homo sapiens
uguucuuucuuacacaaga

SEQ ID NO: 1728410 - RNA, 13 nt, Homo sapiens
uguugacaugugc

SEQ ID NO: 1728411 - RNA, 18 nt, Homo sapiens
uguuucuggggacaccag

SEQ ID NO: 1728412 - RNA, 14 nt, Homo sapiens
uuaaaacagcugcg

SEQ ID NO: 1728413 - RNA, 20 nt, Homo sapiens
uuaaacccugccccacuucu

SEQ ID NO: 1728414 - RNA, 20 nt, Homo sapiens
uuaacugcauaauagccuaa

SEQ ID NO: 1728415 - RNA, 16 nt, Homo sapiens
uuaauucacucccaca

SEQ ID NO: 1728416 - RNA, 18 nt, Homo sapiens
uuaauuugauaguauugu

SEQ ID NO: 1728417 - RNA, 11 nt, Homo sapiens
uuacacaagag

SEQ ID NO: 1728418 - RNA, 14 nt, Homo sapiens
uuagauuaguauuu

SEQ ID NO: 1728419 - RNA, 17 nt, Homo sapiens
uuaucuguguugucucu

SEQ ID NO: 1728420 - RNA, 23 nt, Homo sapiens
uucagaauguacggaaagaugau

SEQ ID NO: 1728421 - RNA, 12 nt, Homo sapiens
uucagagcugcc

SEQ ID NO: 1728422 - RNA, 16 nt, Homo sapiens
uuccucaguccuggaa

SEQ ID NO: 1728423 - RNA, 16 nt, Homo sapiens
uucucaggggugcugg

SEQ ID NO: 1728424 - RNA, 15 nt, Homo sapiens
uucucuacucuggaa

SEQ ID NO: 1728425 - RNA, 20 nt, Homo sapiens
uucucuuuuccuuugguccu

SEQ ID NO: 1728426 - RNA, 21 nt, Homo sapiens
uucuuaaaauguuaacuggca

SEQ ID NO: 1728427 - RNA, 13 nt, Homo sapiens
uucuuacaaacau

SEQ ID NO: 1728428 - RNA, 13 nt, Homo sapiens
uucuucuaccaga

SEQ ID NO: 1728429 - RNA, 15 nt, Homo sapiens
uugaauuaaaacagc

SEQ ID NO: 1728430 - RNA, 20 nt, Homo sapiens
uugauugcguggaauugugc

SEQ ID NO: 1728431 - RNA, 19 nt, Homo sapiens
uugcgccacugcacuccag

SEQ ID NO: 1728432 - RNA, 21 nt, Homo sapiens
uuggcgggggcuuggcugugc

SEQ ID NO: 1728433 - RNA, 21 nt, Homo sapiens
uugggagcaccgccugugaaa

SEQ ID NO: 1728434 - RNA, 21 nt, Homo sapiens
uugggauauucugaaacuuga

SEQ ID NO: 1728435 - RNA, 13 nt, Homo sapiens
uugucuacacucu

SEQ ID NO: 1728436 - RNA, 23 nt, Homo sapiens
uugucucucuaaacccaaauaaa

SEQ ID NO: 1728437 - RNA, 16 nt, Homo sapiens
uuuaauuugauaguau

SEQ ID NO: 1728438 - RNA, 12 nt, Homo sapiens
uuuacaccaguu

SEQ ID NO: 1728439 - RNA, 14 nt, Homo sapiens
uuuacuagugugug

SEQ ID NO: 1728440 - RNA, 12 nt, Homo sapiens
uuuagcugugaa

SEQ ID NO: 1728441 - RNA, 22 nt, Homo sapiens
uuuccaugcacccucauacaca

SEQ ID NO: 1728442 - RNA, 18 nt, Homo sapiens
uuuccugcuggacagggg

SEQ ID NO: 1728443 - RNA, 16 nt, Homo sapiens
uuucuaccuuuacuac

SEQ ID NO: 1728444 - RNA, 22 nt, Homo sapiens
uuucugucacaucagcuccacu

SEQ ID NO: 1728445 - RNA, 17 nt, Homo sapiens
uuucuuuuuuauacuca

SEQ ID NO: 1728446 - RNA, 18 nt, Homo sapiens
uuugaaguggccagauga

SEQ ID NO: 1728447 - RNA, 16 nt, Homo sapiens
uuuguaauaaacucuc

SEQ ID NO: 1728448 - RNA, 20 nt, Homo sapiens
uuuguaauaaacucucuagg

SEQ ID NO: 1728449 - RNA, 22 nt, Homo sapiens
uuugugcagagauaaagaccuu

SEQ ID NO: 1728450 - RNA, 15 nt, Homo sapiens
uuugugugugugaua

SEQ ID NO: 1728451 - RNA, 18 nt, Homo sapiens
uuuguuucuuucauauga

SEQ ID NO: 1728452 - RNA, 12 nt, Homo sapiens
uuuuacaccagu

SEQ ID NO: 1728453 - RNA, 17 nt, Homo sapiens
aaaauaaagcuguucuc

SEQ ID NO: 1728454 - RNA, 18 nt, Homo sapiens
aaacagcugccaccauca

SEQ ID NO: 1728455 - RNA, 23 nt, Homo sapiens
aaacaugugguuaaugccaugga

SEQ ID NO: 1728456 - RNA, 13 nt, Homo sapiens
aaacuuguguaug

SEQ ID NO: 1728457 - RNA, 22 nt, Homo sapiens
aaagaccuuuuccaugcacccu

SEQ ID NO: 1728458 - RNA, 17 nt, Homo sapiens
aaagcagaugagcugug

SEQ ID NO: 1728459 - RNA, 16 nt, Homo sapiens
aaauaaauguguaaau

SEQ ID NO: 1728460 - RNA, 17 nt, Homo sapiens
aaauauacaaacaugug

SEQ ID NO: 1728461 - RNA, 16 nt, Homo sapiens
aaaugcaaacacugug

SEQ ID NO: 1728462 - RNA, 19 nt, Homo sapiens
aaauguuauagcugcauuu

SEQ ID NO: 1728463 - RNA, 20 nt, Homo sapiens
aaauucagaaagucauagau

SEQ ID NO: 1728464 - RNA, 22 nt, Homo sapiens
aacaccacuuugucucugagaa

SEQ ID NO: 1728465 - RNA, 23 nt, Homo sapiens
aacaccacuuugucucugagaac

SEQ ID NO: 1728466 - RNA, 22 nt, Homo sapiens
aacacccuguagguucuugaua

SEQ ID NO: 1728467 - RNA, 22 nt, Homo sapiens
aacagauaaucccuguauuuca

SEQ ID NO: 1728468 - RNA, 19 nt, Homo sapiens
aacaugugguuaaugccau

SEQ ID NO: 1728469 - RNA, 21 nt, Homo sapiens
aacaugugguuaaugccaugg

SEQ ID NO: 1728470 - RNA, 13 nt, Homo sapiens
aacauugccugau

SEQ ID NO: 1728471 - RNA, 12 nt, Homo sapiens
aaccaguccugc

SEQ ID NO: 1728472 - RNA, 17 nt, Homo sapiens
aaccaugggcucagggc

SEQ ID NO: 1728473 - RNA, 16 nt, Homo sapiens
aaccucaaacugggua

SEQ ID NO: 1728474 - RNA, 12 nt, Homo sapiens
aacgcacaaaac

SEQ ID NO: 1728475 - RNA, 19 nt, Homo sapiens
aacucaauauuuuccauga

SEQ ID NO: 1728476 - RNA, 12 nt, Homo sapiens
aacucucuaggg

SEQ ID NO: 1728477 - RNA, 13 nt, Homo sapiens
aagacaauggcuu

SEQ ID NO: 1728478 - RNA, 16 nt, Homo sapiens
aagacagagcugggau

SEQ ID NO: 1728479 - RNA, 17 nt, Homo sapiens
aagacuauauuguacac

SEQ ID NO: 1728480 - RNA, 23 nt, Homo sapiens
aagacuguuaaaugaaaccagaa

SEQ ID NO: 1728481 - RNA, 21 nt, Homo sapiens
aagagugagacuccgucucaa

SEQ ID NO: 1728482 - RNA, 19 nt, Homo sapiens
aagauggcacuguccaggg

SEQ ID NO: 1728483 - RNA, 14 nt, Homo sapiens
aagccggccggcug

SEQ ID NO: 1728484 - RNA, 18 nt, Homo sapiens
aagcuguucucauuccug

SEQ ID NO: 1728485 - RNA, 22 nt, Homo sapiens
aaggacaccuccuuccucaguc

SEQ ID NO: 1728486 - RNA, 14 nt, Homo sapiens
aaggcaacugugag

SEQ ID NO: 1728487 - RNA, 20 nt, Homo sapiens
aaggggacagcgccaccucu

SEQ ID NO: 1728488 - RNA, 14 nt, Homo sapiens
aagguuugaugcca

SEQ ID NO: 1728489 - RNA, 19 nt, Homo sapiens
aaguaacugugguuuacua

SEQ ID NO: 1728490 - RNA, 16 nt, Homo sapiens
aauaaaaguuuacaga

SEQ ID NO: 1728491 - RNA, 16 nt, Homo sapiens
aauaaacucucuaggg

SEQ ID NO: 1728492 - RNA, 22 nt, Homo sapiens
aauaauuacccacaaaugccac

SEQ ID NO: 1728493 - RNA, 15 nt, Homo sapiens
aauauaguagcagga

SEQ ID NO: 1728494 - RNA, 19 nt, Homo sapiens
aaugcugacaaugcugcca

SEQ ID NO: 1728495 - RNA, 22 nt, Homo sapiens
aaugcugacaaugcugccaugc

SEQ ID NO: 1728496 - RNA, 22 nt, Homo sapiens
aaugcugccaugcccaccaucg

SEQ ID NO: 1728497 - RNA, 13 nt, Homo sapiens
aaugcuucaauca

SEQ ID NO: 1728498 - RNA, 16 nt, Homo sapiens
aauggcugugccccac

SEQ ID NO: 1728499 - RNA, 14 nt, Homo sapiens
aaugguuugaauau

SEQ ID NO: 1728500 - RNA, 14 nt, Homo sapiens
aauuuaucaucucg

SEQ ID NO: 1728501 - RNA, 19 nt, Homo sapiens
acaaaauaaagcuguucuc

SEQ ID NO: 1728502 - RNA, 14 nt, Homo sapiens
acaaacaugugguu

SEQ ID NO: 1728503 - RNA, 17 nt, Homo sapiens
acaaugcugccaugccc

SEQ ID NO: 1728504 - RNA, 22 nt, Homo sapiens
augauucagaaauuuucauuca

SEQ ID NO: 1728505 - RNA, 16 nt, Homo sapiens
augcaacaacauguau

SEQ ID NO: 1728506 - RNA, 13 nt, Homo sapiens
augcagacuuccu

SEQ ID NO: 1728507 - RNA, 13 nt, Homo sapiens
augcagcucugau

SEQ ID NO: 1728508 - RNA, 15 nt, Homo sapiens
augcucauuccauga

SEQ ID NO: 1728509 - RNA, 17 nt, Homo sapiens
auggagcucagguuucu

SEQ ID NO: 1728510 - RNA, 17 nt, Homo sapiens
augugccucuguccuua

SEQ ID NO: 1728511 - RNA, 24 nt, Homo sapiens
augugguuaaugccauggacagaa

SEQ ID NO: 1728512 - RNA, 17 nt, Homo sapiens
auuagaggauguggcag

SEQ ID NO: 1728513 - RNA, 20 nt, Homo sapiens
auucacucccacacccaaga

SEQ ID NO: 1728514 - RNA, 16 nt, Homo sapiens
auucagaaagucauag

SEQ ID NO: 1728515 - RNA, 19 nt, Homo sapiens
auucagguauuuguaauag

SEQ ID NO: 1728516 - RNA, 19 nt, Homo sapiens
auucaucucucuuuaauau

SEQ ID NO: 1728517 - RNA, 14 nt, Homo sapiens
auuccuuacuguaa

SEQ ID NO: 1728518 - RNA, 18 nt, Homo sapiens
auucucuugaaggugcug

SEQ ID NO: 1728519 - RNA, 20 nt, Homo sapiens
auucuuacaaacaugugguu

SEQ ID NO: 1728520 - RNA, 18 nt, Homo sapiens
auugaauuaaaacagcug

SEQ ID NO: 1728521 - RNA, 13 nt, Homo sapiens
auuucaagaccuc

SEQ ID NO: 1728522 - RNA, 21 nt, Homo sapiens
auuuguaauuccuuacuguaa

SEQ ID NO: 1728523 - RNA, 23 nt, Homo sapiens
auuuuccucacacccaccugcug

SEQ ID NO: 1728524 - RNA, 20 nt, Homo sapiens
auuuuguaauaaacucucua

SEQ ID NO: 1728525 - RNA, 14 nt, Homo sapiens
auuuuguaugaaaa

SEQ ID NO: 1728526 - RNA, 19 nt, Homo sapiens
caaaauaaagcuguucuca

SEQ ID NO: 1728527 - RNA, 18 nt, Homo sapiens
caaagggcccacagugac

SEQ ID NO: 1728528 - RNA, 15 nt, Homo sapiens
caaaguccaggcuaa

SEQ ID NO: 1728529 - RNA, 14 nt, Homo sapiens
caaccugaagacac

SEQ ID NO: 1728530 - RNA, 21 nt, Homo sapiens
caagacccaaguagcugcuac

SEQ ID NO: 1728531 - RNA, 18 nt, Homo sapiens
caagaccucugugcacuu

SEQ ID NO: 1728532 - RNA, 16 nt, Homo sapiens
caagcuccucgugaua

SEQ ID NO: 1728533 - RNA, 22 nt, Homo sapiens
caaggacuaauccaauaccucu

SEQ ID NO: 1728534 - RNA, 17 nt, Homo sapiens
caaggugaacaccacuu

SEQ ID NO: 1728535 - RNA, 15 nt, Homo sapiens
caauaaaauggguuu

SEQ ID NO: 1728536 - RNA, 18 nt, Homo sapiens
caaugccaugacugcuca

SEQ ID NO: 1728537 - RNA, 14 nt, Homo sapiens
caaugcugccaugc

SEQ ID NO: 1728538 - RNA, 23 nt, Homo sapiens
caauuauggagugucaccagcug

SEQ ID NO: 1728539 - RNA, 17 nt, Homo sapiens
cacaaaaugcaagguga

SEQ ID NO: 1728540 - RNA, 14 nt, Homo sapiens
augacugcucaggc

SEQ ID NO: 1728541 - RNA, 22 nt, Homo sapiens
augagcuguggacuagcaauau

SEQ ID NO: 1728542 - RNA, 18 nt, Homo sapiens
augaugugggucaaggaa

SEQ ID NO: 1728543 - RNA, 15 nt, Homo sapiens
augcaacaacaugua

SEQ ID NO: 1728544 - RNA, 17 nt, Homo sapiens
augcaacaacauguaua

SEQ ID NO: 1728545 - RNA, 13 nt, Homo sapiens
augcccaccaucg

SEQ ID NO: 1728546 - RNA, 18 nt, Homo sapiens
augcugacaaugcugcca

SEQ ID NO: 1728547 - RNA, 23 nt, Homo sapiens
auggcagaaagauggagaggcau

SEQ ID NO: 1728548 - RNA, 16 nt, Homo sapiens
augggagaguccaggc

SEQ ID NO: 1728549 - RNA, 18 nt, Homo sapiens
augggcucaagucacuuu

SEQ ID NO: 1728550 - RNA, 14 nt, Homo sapiens
augggggcccaaag

SEQ ID NO: 1728551 - RNA, 21 nt, Homo sapiens
augguuugcaaggaagccaca

SEQ ID NO: 1728552 - RNA, 17 nt, Homo sapiens
augucccuauucugcca

SEQ ID NO: 1728553 - RNA, 23 nt, Homo sapiens
augucguaguuacucucaggcau

SEQ ID NO: 1728554 - RNA, 13 nt, Homo sapiens
augugccuggaaa

SEQ ID NO: 1728555 - RNA, 18 nt, Homo sapiens
auguuuacagacugugag

SEQ ID NO: 1728556 - RNA, 17 nt, Homo sapiens
auuacacuuugaaguau

SEQ ID NO: 1728557 - RNA, 18 nt, Homo sapiens
auuauggagugucaccag

SEQ ID NO: 1728558 - RNA, 11 nt, Homo sapiens
auucacaucuc

SEQ ID NO: 1728559 - RNA, 15 nt, Homo sapiens
auucacaucucaugu

SEQ ID NO: 1728560 - RNA, 17 nt, Homo sapiens
auucaggcaacgcacaa

SEQ ID NO: 1728561 - RNA, 16 nt, Homo sapiens
auucaggccucugagg

SEQ ID NO: 1728562 - RNA, 14 nt, Homo sapiens
auuccuguccuuca

SEQ ID NO: 1728563 - RNA, 18 nt, Homo sapiens
auucuaacuuuuuugcua

SEQ ID NO: 1728564 - RNA, 12 nt, Homo sapiens
auucugccaugg

SEQ ID NO: 1728565 - RNA, 19 nt, Homo sapiens
auugaauuaaaacagcugc

SEQ ID NO: 1728566 - RNA, 21 nt, Homo sapiens
auuguucuuauccucaauuca

SEQ ID NO: 1728567 - RNA, 24 nt, Homo sapiens
auuuauuaguuaggugugccaaac

SEQ ID NO: 1728568 - RNA, 14 nt, Homo sapiens
auuucccccaggga

SEQ ID NO: 1728569 - RNA, 15 nt, Homo sapiens
auuucccccagggaa

SEQ ID NO: 1728570 - RNA, 15 nt, Homo sapiens
auuugauaguauugu

SEQ ID NO: 1728571 - RNA, 18 nt, Homo sapiens
auuugugugugugauaua

SEQ ID NO: 1728572 - RNA, 20 nt, Homo sapiens
auuuguuaaugguuugaaua

SEQ ID NO: 1728573 - RNA, 14 nt, Homo sapiens
auuuuaauuugaua

SEQ ID NO: 1728574 - RNA, 17 nt, Homo sapiens
auuuuccucacacccac

SEQ ID NO: 1728575 - RNA, 18 nt, Homo sapiens
caaaaauacucacauggc

SEQ ID NO: 1728576 - RNA, 14 nt, Homo sapiens
caaaaauaguauuc

SEQ ID NO: 1728577 - RNA, 15 nt, Homo sapiens
caaaaggccugugau

SEQ ID NO: 1728578 - RNA, 13 nt, Homo sapiens
caaacacugugua

SEQ ID NO: 1728579 - RNA, 21 nt, Homo sapiens
caaagcagacauuuuccucac

SEQ ID NO: 1728580 - RNA, 17 nt, Homo sapiens
caaauauuauucuuaau

SEQ ID NO: 1728581 - RNA, 18 nt, Homo sapiens
caaaugggaaaaccagac

SEQ ID NO: 1728582 - RNA, 12 nt, Homo sapiens
caacauaacuga

SEQ ID NO: 1728583 - RNA, 15 nt, Homo sapiens
caacauaacugaagg

SEQ ID NO: 1728584 - RNA, 20 nt, Homo sapiens
caacauaacugaaggcauau

SEQ ID NO: 1728585 - RNA, 17 nt, Homo sapiens
caacauucccccaacau

SEQ ID NO: 1728586 - RNA, 21 nt, Homo sapiens
caaccuguucuuccuaccaaa

SEQ ID NO: 1728587 - RNA, 16 nt, Homo sapiens
caaggaugacacugcc

SEQ ID NO: 1728588 - RNA, 15 nt, Homo sapiens
caaggcaacugugag

SEQ ID NO: 1728589 - RNA, 15 nt, Homo sapiens
caaggucauuugcua

SEQ ID NO: 1728590 - RNA, 19 nt, Homo sapiens
caaguacauggcuagcuuu

SEQ ID NO: 1728591 - RNA, 14 nt, Homo sapiens
caaguagcugcuac

SEQ ID NO: 1728592 - RNA, 22 nt, Homo sapiens
caaugguuugcaaggaagccac

SEQ ID NO: 1728593 - RNA, 20 nt, Homo sapiens
caauucuaacuuuuuugcua

SEQ ID NO: 1728594 - RNA, 23 nt, Homo sapiens
caauuuucuuuuuuauacucaau

SEQ ID NO: 1728595 - RNA, 12 nt, Homo sapiens
cacaaaaugcaa

SEQ ID NO: 1728596 - RNA, 14 nt, Homo sapiens
cacaggauuuguaa

SEQ ID NO: 1728597 - RNA, 18 nt, Homo sapiens
cacagggaccacauccac

SEQ ID NO: 1728598 - RNA, 20 nt, Homo sapiens
cacagggaugaccuggaguc

SEQ ID NO: 1728599 - RNA, 17 nt, Homo sapiens
caccagccaucaugugc

SEQ ID NO: 1728600 - RNA, 15 nt, Homo sapiens
caccaucugccaaug

SEQ ID NO: 1728601 - RNA, 16 nt, Homo sapiens
caccccccugugccug

SEQ ID NO: 1728602 - RNA, 21 nt, Homo sapiens
caccguacgacucuuuuccaa

SEQ ID NO: 1728603 - RNA, 14 nt, Homo sapiens
caccucccugcaau

SEQ ID NO: 1728604 - RNA, 17 nt, Homo sapiens
caccucccugcaauaaa

SEQ ID NO: 1728605 - RNA, 19 nt, Homo sapiens
cacuccucgguacucccau

SEQ ID NO: 1728606 - RNA, 16 nt, Homo sapiens
cacugcccuccagggc

SEQ ID NO: 1728607 - RNA, 19 nt, Homo sapiens
cacugucagucccacugca

SEQ ID NO: 1728608 - RNA, 17 nt, Homo sapiens
cacuguggaacugccac

SEQ ID NO: 1728609 - RNA, 22 nt, Homo sapiens
cagaacacugucuugaagacaa

SEQ ID NO: 1728610 - RNA, 19 nt, Homo sapiens
cagaagacucuccacugac

SEQ ID NO: 1728611 - RNA, 21 nt, Homo sapiens
cagaagacucuccacugaccu

SEQ ID NO: 1728612 - RNA, 17 nt, Homo sapiens
cagaauauggacaaaga

SEQ ID NO: 1728613 - RNA, 15 nt, Homo sapiens
cagacacacacuggc

SEQ ID NO: 1728614 - RNA, 16 nt, Homo sapiens
cagagauaaagaccuu

SEQ ID NO: 1728615 - RNA, 18 nt, Homo sapiens
cagaguuguucucagggg

SEQ ID NO: 1728616 - RNA, 15 nt, Homo sapiens
cagauccucuucuca

SEQ ID NO: 1728617 - RNA, 17 nt, Homo sapiens
cagauccucuucucaaa

SEQ ID NO: 1728618 - RNA, 19 nt, Homo sapiens
cagauguuuacagacugug

SEQ ID NO: 1728619 - RNA, 17 nt, Homo sapiens
cagcacucugaaacuga

SEQ ID NO: 1728620 - RNA, 21 nt, Homo sapiens
cagccccacugcccuccaggg

SEQ ID NO: 1728621 - RNA, 19 nt, Homo sapiens
cagcccuccccaccugcuc

SEQ ID NO: 1728622 - RNA, 14 nt, Homo sapiens
cagcgccaccucuu

SEQ ID NO: 1728623 - RNA, 24 nt, Homo sapiens
cagcgccaccucuugucagugcuc

SEQ ID NO: 1728624 - RNA, 16 nt, Homo sapiens
cagcuucauguuccca

SEQ ID NO: 1728625 - RNA, 13 nt, Homo sapiens
caggaugaguuac

SEQ ID NO: 1728626 - RNA, 14 nt, Homo sapiens
caggcaacgcacaa

SEQ ID NO: 1728627 - RNA, 18 nt, Homo sapiens
caggcaacgcacaaaaca

SEQ ID NO: 1728628 - RNA, 18 nt, Homo sapiens
caggcaccaucugccaau

SEQ ID NO: 1728629 - RNA, 18 nt, Homo sapiens
caggggcgugggauugaa

SEQ ID NO: 1728630 - RNA, 21 nt, Homo sapiens
cagguagaacacaaggucauu

SEQ ID NO: 1728631 - RNA, 22 nt, Homo sapiens
caggugagcaauuagauuagua

SEQ ID NO: 1728632 - RNA, 17 nt, Homo sapiens
cagugccaugggggcaa

SEQ ID NO: 1728633 - RNA, 21 nt, Homo sapiens
cagugcccagcugggggucaa

SEQ ID NO: 1728634 - RNA, 13 nt, Homo sapiens
caguggcacucug

SEQ ID NO: 1728635 - RNA, 19 nt, Homo sapiens
caguggcauucacaucuca

SEQ ID NO: 1728636 - RNA, 18 nt, Homo sapiens
caguucugccuuaucuaa

SEQ ID NO: 1728637 - RNA, 22 nt, Homo sapiens
cauaaaucuuguaaucauguua

SEQ ID NO: 1728638 - RNA, 23 nt, Homo sapiens
cauaacauaaauuuaucaucucg

SEQ ID NO: 1728639 - RNA, 15 nt, Homo sapiens
cauagcagcugcuac

SEQ ID NO: 1728640 - RNA, 15 nt, Homo sapiens
cauagcagugcuuga

SEQ ID NO: 1728641 - RNA, 13 nt, Homo sapiens
cauauauauguau

SEQ ID NO: 1728642 - RNA, 18 nt, Homo sapiens
cauaugaaaaaaaugcau

SEQ ID NO: 1728643 - RNA, 16 nt, Homo sapiens
caucaugugccuggaa

SEQ ID NO: 1728644 - RNA, 22 nt, Homo sapiens
cauggaugaauaaauguuauag

SEQ ID NO: 1728645 - RNA, 21 nt, Homo sapiens
caugucguaguuacucucagg

SEQ ID NO: 1728646 - RNA, 22 nt, Homo sapiens
cauguucagggaugcucauucc

SEQ ID NO: 1728647 - RNA, 18 nt, Homo sapiens
cauucccuuuuccauaua

SEQ ID NO: 1728648 - RNA, 14 nt, Homo sapiens
cauuccuguucuuu

SEQ ID NO: 1728649 - RNA, 20 nt, Homo sapiens
gagugucaccagcugccaaa

SEQ ID NO: 1728650 - RNA, 16 nt, Homo sapiens
gauaaagcaguauuug

SEQ ID NO: 1728651 - RNA, 20 nt, Homo sapiens
gaugcucauuccaugacucu

SEQ ID NO: 1728652 - RNA, 19 nt, Homo sapiens
gauguuuacagacugugag

SEQ ID NO: 1728653 - RNA, 16 nt, Homo sapiens
gcaaaagucauuacac

SEQ ID NO: 1728654 - RNA, 18 nt, Homo sapiens
gcaccaauaaagccuuca

SEQ ID NO: 1728655 - RNA, 14 nt, Homo sapiens
gcacuguccagggc

SEQ ID NO: 1728656 - RNA, 21 nt, Homo sapiens
gcagaacagcuucauguuccc

SEQ ID NO: 1728657 - RNA, 22 nt, Homo sapiens
gcagaacagcuucauguuccca

SEQ ID NO: 1728658 - RNA, 17 nt, Homo sapiens
gcaugaagguuucugaa

SEQ ID NO: 1728659 - RNA, 17 nt, Homo sapiens
gcaugggggcccaaagg

SEQ ID NO: 1728660 - RNA, 14 nt, Homo sapiens
gcauucacaucuca

SEQ ID NO: 1728661 - RNA, 15 nt, Homo sapiens
gcauucacaucucau

SEQ ID NO: 1728662 - RNA, 21 nt, Homo sapiens
gccacguauguuuuuguguau

SEQ ID NO: 1728663 - RNA, 18 nt, Homo sapiens
gccaggcaccaucugcca

SEQ ID NO: 1728664 - RNA, 13 nt, Homo sapiens
gccaggccucuac

SEQ ID NO: 1728665 - RNA, 18 nt, Homo sapiens
gccaucaugugccuggaa

SEQ ID NO: 1728666 - RNA, 20 nt, Homo sapiens
gcccauuuuucuagacuguc

SEQ ID NO: 1728667 - RNA, 22 nt, Homo sapiens
gccccacuucucuacucuggaa

SEQ ID NO: 1728668 - RNA, 19 nt, Homo sapiens
gcccgugcccuaccacaca

SEQ ID NO: 1728669 - RNA, 12 nt, Homo sapiens
gcccuccagggc

SEQ ID NO: 1728670 - RNA, 16 nt, Homo sapiens
gcccuccagggccagg

SEQ ID NO: 1728671 - RNA, 19 nt, Homo sapiens
gcccucuccugggcagcug

SEQ ID NO: 1728672 - RNA, 13 nt, Homo sapiens
gccgacucaggga

SEQ ID NO: 1728673 - RNA, 14 nt, Homo sapiens
gccuccagguugcc

SEQ ID NO: 1728674 - RNA, 22 nt, Homo sapiens
gccuccccuccucugcuugcca

SEQ ID NO: 1728675 - RNA, 16 nt, Homo sapiens
gccugaggcaugagaa

SEQ ID NO: 1728676 - RNA, 11 nt, Homo sapiens
gcgggggcuug

SEQ ID NO: 1728677 - RNA, 22 nt, Homo sapiens
gcgugggauugaauuaaaacag

SEQ ID NO: 1728678 - RNA, 12 nt, Homo sapiens
gcuaaaugcaaa

SEQ ID NO: 1728679 - RNA, 16 nt, Homo sapiens
gcuaauaaaagucaga

SEQ ID NO: 1728680 - RNA, 14 nt, Homo sapiens
gcuaggaagcaaga

SEQ ID NO: 1728681 - RNA, 22 nt, Homo sapiens
gcuaggucugaccaaaaccaga

SEQ ID NO: 1728682 - RNA, 21 nt, Homo sapiens
gcucaaggaaggaugccuuau

SEQ ID NO: 1728683 - RNA, 13 nt, Homo sapiens
gcucagggccagg

SEQ ID NO: 1728684 - RNA, 14 nt, Homo sapiens
gcugagaaggacac

SEQ ID NO: 1728685 - RNA, 14 nt, Homo sapiens
gcugcuacuagcuc

SEQ ID NO: 1728686 - RNA, 21 nt, Homo sapiens
gcuggacaggggcgugggauu

SEQ ID NO: 1728687 - RNA, 21 nt, Homo sapiens
gcuggagcaaaagucauuaca

SEQ ID NO: 1728688 - RNA, 17 nt, Homo sapiens
gcuggagucaugugccu

SEQ ID NO: 1728689 - RNA, 23 nt, Homo sapiens
gcuuggaaacuggaugaggucau

SEQ ID NO: 1728690 - RNA, 13 nt, Homo sapiens
gcuuggcugugcc

SEQ ID NO: 1728691 - RNA, 18 nt, Homo sapiens
gcuuggcugugcccucag

SEQ ID NO: 1728692 - RNA, 21 nt, Homo sapiens
gcuuuguuucuuucauaugaa

SEQ ID NO: 1728693 - RNA, 20 nt, Homo sapiens
ggaaacuggaugaggucaua

SEQ ID NO: 1728694 - RNA, 19 nt, Homo sapiens
ggacgacuguuuucccaac

SEQ ID NO: 1728695 - RNA, 18 nt, Homo sapiens
ggaugaauaaauguuaua

SEQ ID NO: 1728696 - RNA, 12 nt, Homo sapiens
ggcaacugugag

SEQ ID NO: 1728697 - RNA, 22 nt, Homo sapiens
ggcacagcaguuucaccaucuu

SEQ ID NO: 1728698 - RNA, 16 nt, Homo sapiens
ggcagagaaguggagu

SEQ ID NO: 1728699 - RNA, 17 nt, Homo sapiens
ggccagaugcacauccc

SEQ ID NO: 1728700 - RNA, 15 nt, Homo sapiens
ggccugugauccagg

SEQ ID NO: 1728701 - RNA, 19 nt, Homo sapiens
ggcugaccugcuguggaug

SEQ ID NO: 1728702 - RNA, 22 nt, Homo sapiens
gggacagcgccaccucuuguca

SEQ ID NO: 1728703 - RNA, 12 nt, Homo sapiens
gggacaugcagc

SEQ ID NO: 1728704 - RNA, 14 nt, Homo sapiens
gggagaguccaggc

SEQ ID NO: 1728705 - RNA, 20 nt, Homo sapiens
gggagguggagguugcagug

SEQ ID NO: 1728706 - RNA, 20 nt, Homo sapiens
gggauugaauuaaaacagcu

SEQ ID NO: 1728707 - RNA, 21 nt, Homo sapiens
gggauugaauuaaaacagcug

SEQ ID NO: 1728708 - RNA, 23 nt, Homo sapiens
gggcagaguggagcccagggugc

SEQ ID NO: 1728709 - RNA, 14 nt, Homo sapiens
ggggcaguggccug

SEQ ID NO: 1728710 - RNA, 20 nt, Homo sapiens
gggggcuuggcugugcccuc

SEQ ID NO: 1728711 - RNA, 23 nt, Homo sapiens
gguaaaucuaguaccaugucgua

SEQ ID NO: 1728712 - RNA, 11 nt, Homo sapiens
ggucauuugcu

SEQ ID NO: 1728713 - RNA, 13 nt, Homo sapiens
gguugcagugagc

SEQ ID NO: 1728714 - RNA, 21 nt, Homo sapiens
gguuuccugcuggacaggggc

SEQ ID NO: 1728715 - RNA, 15 nt, Homo sapiens
guaaaauaacaucag

SEQ ID NO: 1728716 - RNA, 21 nt, Homo sapiens
guaaacauugccugauuuguu

SEQ ID NO: 1728717 - RNA, 15 nt, Homo sapiens
guaauaaacucucua

SEQ ID NO: 1728718 - RNA, 22 nt, Homo sapiens
guaaugauguaggggccaagca

SEQ ID NO: 1728719 - RNA, 11 nt, Homo sapiens
guagcugcuac

SEQ ID NO: 1728720 - RNA, 15 nt, Homo sapiens
guaugaauagcugug

SEQ ID NO: 1728721 - RNA, 13 nt, Homo sapiens
guauugugcauag

SEQ ID NO: 1728722 - RNA, 22 nt, Homo sapiens
gucacuuguagguuucucugcc

SEQ ID NO: 1728723 - RNA, 21 nt, Homo sapiens
gucauuuggugccaguauuuu

SEQ ID NO: 1728724 - RNA, 15 nt, Homo sapiens
gucccuauucugcca

SEQ ID NO: 1728725 - RNA, 15 nt, Homo sapiens
guccuuuuagcacau

SEQ ID NO: 1728726 - RNA, 18 nt, Homo sapiens
gucucucuaaacccaaau

SEQ ID NO: 1728727 - RNA, 16 nt, Homo sapiens
gucuggcaucucccac

SEQ ID NO: 1728728 - RNA, 19 nt, Homo sapiens
gugaguccgggaaucucuu

SEQ ID NO: 1728729 - RNA, 15 nt, Homo sapiens
gugaguccugauccu

SEQ ID NO: 1728730 - RNA, 15 nt, Homo sapiens
gugccccagcuagga

SEQ ID NO: 1728731 - RNA, 22 nt, Homo sapiens
gugccuguaaucccagcuacau

SEQ ID NO: 1728732 - RNA, 19 nt, Homo sapiens
gugcucggcuguaaacagc

SEQ ID NO: 1728733 - RNA, 15 nt, Homo sapiens
guggaacaagcacag

SEQ ID NO: 1728734 - RNA, 15 nt, Homo sapiens
guggaauugugcuga

SEQ ID NO: 1728735 - RNA, 17 nt, Homo sapiens
guggagguugcagugag

SEQ ID NO: 1728736 - RNA, 18 nt, Homo sapiens
guggcauucacaucucau

SEQ ID NO: 1728737 - RNA, 17 nt, Homo sapiens
guggccagcacucugaa

SEQ ID NO: 1728738 - RNA, 12 nt, Homo sapiens
gugggugccugu

SEQ ID NO: 1728739 - RNA, 13 nt, Homo sapiens
gugugugugauau

SEQ ID NO: 1728740 - RNA, 13 nt, Homo sapiens
guucaguggcauu

SEQ ID NO: 1728741 - RNA, 17 nt, Homo sapiens
guucucauuccuguucu

SEQ ID NO: 1728742 - RNA, 15 nt, Homo sapiens
guucuuccuaccaaa

SEQ ID NO: 1728743 - RNA, 21 nt, Homo sapiens
guucuuucuuacacaagagcu

SEQ ID NO: 1728744 - RNA, 22 nt, Homo sapiens
guuggcgggggcuuggcugugc

SEQ ID NO: 1728745 - RNA, 18 nt, Homo sapiens
guuucucugccuccaggu

SEQ ID NO: 1728746 - RNA, 19 nt, Homo sapiens
guuuuguggaggagcucag

SEQ ID NO: 1728747 - RNA, 19 nt, Homo sapiens
uaaaacacaccuaagagaa

SEQ ID NO: 1728748 - RNA, 17 nt, Homo sapiens
uaaaauaaaaguuuaca

SEQ ID NO: 1728749 - RNA, 18 nt, Homo sapiens
uaaacaaauguaugauua

SEQ ID NO: 1728750 - RNA, 23 nt, Homo sapiens
uaaacaaauguaugauuacauca

SEQ ID NO: 1728751 - RNA, 19 nt, Homo sapiens
uaaacauugccugauuugu

SEQ ID NO: 1728752 - RNA, 14 nt, Homo sapiens
uaaacucucuaggg

SEQ ID NO: 1728753 - RNA, 15 nt, Homo sapiens
uaaacuuguguauga

SEQ ID NO: 1728754 - RNA, 12 nt, Homo sapiens
uaaagccuucaa

SEQ ID NO: 1728755 - RNA, 16 nt, Homo sapiens
uaaauguguaaaugug

SEQ ID NO: 1728756 - RNA, 12 nt, Homo sapiens
uaaauguuauag

SEQ ID NO: 1728757 - RNA, 22 nt, Homo sapiens
uaaauguuauagcugcauuugu

SEQ ID NO: 1728758 - RNA, 21 nt, Homo sapiens
aaaaccgcaaggguagacugg

SEQ ID NO: 1728759 - RNA, 15 nt, Homo sapiens
aaaaugcaacaacau

SEQ ID NO: 1728760 - RNA, 14 nt, Homo sapiens
aaacaaaacaaaac

SEQ ID NO: 1728761 - RNA, 23 nt, Homo sapiens
aaacccaaauaaauguguaaaug

SEQ ID NO: 1728762 - RNA, 21 nt, Homo sapiens
aaagcagacauuuuccucaca

SEQ ID NO: 1728763 - RNA, 20 nt, Homo sapiens
aaagcagaugagcuguggac

SEQ ID NO: 1728764 - RNA, 13 nt, Homo sapiens
aaagcaguauuug

SEQ ID NO: 1728765 - RNA, 17 nt, Homo sapiens
aaagccuucaaacuccc

SEQ ID NO: 1728766 - RNA, 13 nt, Homo sapiens
aaagcuguucuca

SEQ ID NO: 1728767 - RNA, 21 nt, Homo sapiens
aaagcuguucucauuccuguu

SEQ ID NO: 1728768 - RNA, 16 nt, Homo sapiens
aaaguaaugcuucaau

SEQ ID NO: 1728769 - RNA, 22 nt, Homo sapiens
aaauaaagcuguucucauuccu

SEQ ID NO: 1728770 - RNA, 14 nt, Homo sapiens
aaauauacaaacau

SEQ ID NO: 1728771 - RNA, 18 nt, Homo sapiens
aaauauacaaacaugugg

SEQ ID NO: 1728772 - RNA, 15 nt, Homo sapiens
aaaugcaaacacugu

SEQ ID NO: 1728773 - RNA, 18 nt, Homo sapiens
aaaugggaaaaccagacu

SEQ ID NO: 1728774 - RNA, 21 nt, Homo sapiens
aaauguuauagcugcauuugu

SEQ ID NO: 1728775 - RNA, 21 nt, Homo sapiens
aacauguggcaaccuguucuu

SEQ ID NO: 1728776 - RNA, 13 nt, Homo sapiens
aaccaugggcuca

SEQ ID NO: 1728777 - RNA, 19 nt, Homo sapiens
aacccugccccacuucucu

SEQ ID NO: 1728778 - RNA, 13 nt, Homo sapiens
aacccugggcucc

SEQ ID NO: 1728779 - RNA, 20 nt, Homo sapiens
aacucaauauuuuccaugaa

SEQ ID NO: 1728780 - RNA, 12 nt, Homo sapiens
aacucugugagg

SEQ ID NO: 1728781 - RNA, 19 nt, Homo sapiens
aacugcaggaaugcugaca

SEQ ID NO: 1728782 - RNA, 17 nt, Homo sapiens
aagauggcacuguccag

SEQ ID NO: 1728783 - RNA, 19 nt, Homo sapiens
aagcacagauguucuucaa

SEQ ID NO: 1728784 - RNA, 21 nt, Homo sapiens
aagcucagguucccugccaca

SEQ ID NO: 1728785 - RNA, 13 nt, Homo sapiens
aagcuccucguga

SEQ ID NO: 1728786 - RNA, 18 nt, Homo sapiens
aaggauauuuacuacuuu

SEQ ID NO: 1728787 - RNA, 20 nt, Homo sapiens
aaggauauuuacuacuuuug

SEQ ID NO: 1728788 - RNA, 15 nt, Homo sapiens
aaggaugacacugcc

SEQ ID NO: 1728789 - RNA, 13 nt, Homo sapiens
aaggcacaggugu

SEQ ID NO: 1728790 - RNA, 13 nt, Homo sapiens
aaggccugugauc

SEQ ID NO: 1728791 - RNA, 19 nt, Homo sapiens
aaggccugugauccaggaa

SEQ ID NO: 1728792 - RNA, 19 nt, Homo sapiens
aagguggaacaagcacaga

SEQ ID NO: 1728793 - RNA, 14 nt, Homo sapiens
aaguaaugcuucaa

SEQ ID NO: 1728794 - RNA, 22 nt, Homo sapiens
aaguuagggaauggcacagccc

SEQ ID NO: 1728795 - RNA, 19 nt, Homo sapiens
aaguugacaggcagugcca

SEQ ID NO: 1728796 - RNA, 16 nt, Homo sapiens
aauaaagcuguucuca

SEQ ID NO: 1728797 - RNA, 21 nt, Homo sapiens
aauaaagcuguucucauuccu

SEQ ID NO: 1728798 - RNA, 19 nt, Homo sapiens
aauauucuauuuugcagau

SEQ ID NO: 1728799 - RNA, 15 nt, Homo sapiens
aauauuuuccaugaa

SEQ ID NO: 1728800 - RNA, 23 nt, Homo sapiens
aauauuuuccaugaaaaugcaac

SEQ ID NO: 1728801 - RNA, 19 nt, Homo sapiens
aauauuuuguuuugugcag

SEQ ID NO: 1728802 - RNA, 20 nt, Homo sapiens
aaucacaaggcaacugugag

SEQ ID NO: 1728803 - RNA, 15 nt, Homo sapiens
aauccaauaccucuu

SEQ ID NO: 1728804 - RNA, 13 nt, Homo sapiens
aaugaagacuguu

SEQ ID NO: 1728805 - RNA, 16 nt, Homo sapiens
aaugcaacaacaugua

SEQ ID NO: 1728806 - RNA, 22 nt, Homo sapiens
aaugcaaggugaacaccacuuu

SEQ ID NO: 1728807 - RNA, 12 nt, Homo sapiens
aaugccaugacu

SEQ ID NO: 1728808 - RNA, 13 nt, Homo sapiens
aaugcugccaugc

SEQ ID NO: 1728809 - RNA, 15 nt, Homo sapiens
aauguuauagcugca

SEQ ID NO: 1728810 - RNA, 13 nt, Homo sapiens
aauuaaaacagcu

SEQ ID NO: 1728811 - RNA, 15 nt, Homo sapiens
aauuaaaacagcugc

SEQ ID NO: 1728812 - RNA, 12 nt, Homo sapiens
aauuaacacugc

SEQ ID NO: 1728813 - RNA, 18 nt, Homo sapiens
aauucuuacaaacaugug

SEQ ID NO: 1728814 - RNA, 19 nt, Homo sapiens
aauucuuacaaacaugugg

SEQ ID NO: 1728815 - RNA, 20 nt, Homo sapiens
acaagacccaaguagcugcu

SEQ ID NO: 1728816 - RNA, 14 nt, Homo sapiens
acacaaauucuaaa

SEQ ID NO: 1728817 - RNA, 16 nt, Homo sapiens
acaccacuuugucucu

SEQ ID NO: 1728818 - RNA, 22 nt, Homo sapiens
acaccuaagagaaaaagaucga

SEQ ID NO: 1728819 - RNA, 16 nt, Homo sapiens
acagacacacacuggc

SEQ ID NO: 1728820 - RNA, 17 nt, Homo sapiens
acagacacacacuggcu

SEQ ID NO: 1728821 - RNA, 22 nt, Homo sapiens
acagacugugaguacagcagaa

SEQ ID NO: 1728822 - RNA, 18 nt, Homo sapiens
acagcuucauguucccaa

SEQ ID NO: 1728823 - RNA, 18 nt, Homo sapiens
acaggauuuguaauuccu

SEQ ID NO: 1728824 - RNA, 12 nt, Homo sapiens
acaggugugagc

SEQ ID NO: 1728825 - RNA, 16 nt, Homo sapiens
acaucucccucccaca

SEQ ID NO: 1728826 - RNA, 15 nt, Homo sapiens
acauucccccaacau

SEQ ID NO: 1728827 - RNA, 17 nt, Homo sapiens
accaauaaagccuucaa

SEQ ID NO: 1728828 - RNA, 15 nt, Homo sapiens
accacauaacauaaa

SEQ ID NO: 1728829 - RNA, 22 nt, Homo sapiens
accagguagaacacaaggucau

SEQ ID NO: 1728830 - RNA, 17 nt, Homo sapiens
accaucggguguaggug

SEQ ID NO: 1728831 - RNA, 9 nt, Homo sapiens
accaugcug

SEQ ID NO: 1728832 - RNA, 16 nt, Homo sapiens
accaugggcucagggc

SEQ ID NO: 1728833 - RNA, 17 nt, Homo sapiens
accaugucguaguuacu

SEQ ID NO: 1728834 - RNA, 21 nt, Homo sapiens
accaugucguaguuacucuca

SEQ ID NO: 1728835 - RNA, 17 nt, Homo sapiens
acccacuugccugucac

SEQ ID NO: 1728836 - RNA, 23 nt, Homo sapiens
accccagauggccgggacaugca

SEQ ID NO: 1728837 - RNA, 19 nt, Homo sapiens
acccuguagguucuugaua

SEQ ID NO: 1728838 - RNA, 23 nt, Homo sapiens
accguucauucaggcaacgcaca

SEQ ID NO: 1728839 - RNA, 13 nt, Homo sapiens
accugcucaccaa

SEQ ID NO: 1728840 - RNA, 21 nt, Homo sapiens
accuucuaggaagcuccaguu

SEQ ID NO: 1728841 - RNA, 17 nt, Homo sapiens
acguuaaguccaaggag

SEQ ID NO: 1728842 - RNA, 14 nt, Homo sapiens
acucaaucauuucu

SEQ ID NO: 1728843 - RNA, 11 nt, Homo sapiens
acucucuaggg

SEQ ID NO: 1728844 - RNA, 14 nt, Homo sapiens
acugcacuccaguc

SEQ ID NO: 1728845 - RNA, 12 nt, Homo sapiens
acuguccagggc

SEQ ID NO: 1728846 - RNA, 14 nt, Homo sapiens
acugugaguccuga

SEQ ID NO: 1728847 - RNA, 13 nt, Homo sapiens
acuuccuuugaga

SEQ ID NO: 1728848 - RNA, 15 nt, Homo sapiens
acuuucuucuaccag

SEQ ID NO: 1728849 - RNA, 17 nt, Homo sapiens
acuuuugcaugaaaaua

SEQ ID NO: 1728850 - RNA, 16 nt, Homo sapiens
agaaaaucuuuuacua

SEQ ID NO: 1728851 - RNA, 17 nt, Homo sapiens
agaaauaaauucacauc

SEQ ID NO: 1728852 - RNA, 23 nt, Homo sapiens
agaaauuuucauucagguauuug

SEQ ID NO: 1728853 - RNA, 16 nt, Homo sapiens
agaacacaaggucauu

SEQ ID NO: 1728854 - RNA, 14 nt, Homo sapiens
agaacagcuucaug

SEQ ID NO: 1728855 - RNA, 20 nt, Homo sapiens
agaacuuugcauagcagcug

SEQ ID NO: 1728856 - RNA, 19 nt, Homo sapiens
agaagacuauauuguacac

SEQ ID NO: 1728857 - RNA, 16 nt, Homo sapiens
agaaggacaccuccuu

SEQ ID NO: 1728858 - RNA, 23 nt, Homo sapiens
agaaggggacagcgccaccucuu

SEQ ID NO: 1728859 - RNA, 22 nt, Homo sapiens
agaaguugacaggcagugccau

SEQ ID NO: 1728860 - RNA, 16 nt, Homo sapiens
agaauccccuccaucu

SEQ ID NO: 1728861 - RNA, 18 nt, Homo sapiens
agagaaguggagugacua

SEQ ID NO: 1728862 - RNA, 22 nt, Homo sapiens
agaggagacagacacacacugg

SEQ ID NO: 1728863 - RNA, 19 nt, Homo sapiens
agagugagacuccgucuca

SEQ ID NO: 1728864 - RNA, 21 nt, Homo sapiens
agaguggagcccagggugcug

SEQ ID NO: 1728865 - RNA, 14 nt, Homo sapiens
agauccucuucuca

SEQ ID NO: 1728866 - RNA, 23 nt, Homo sapiens
agauggccgggacaugcagcucu

SEQ ID NO: 1728867 - RNA, 17 nt, Homo sapiens
agcaagaucgcugugcu

SEQ ID NO: 1728868 - RNA, 14 nt, Homo sapiens
agcagguggcagaa

SEQ ID NO: 1728869 - RNA, 13 nt, Homo sapiens
agcaguucagagc

SEQ ID NO: 1728870 - RNA, 22 nt, Homo sapiens
agcaguucagagcugcccucuc

SEQ ID NO: 1728871 - RNA, 17 nt, Homo sapiens
agcauuucccccaggga

SEQ ID NO: 1728872 - RNA, 14 nt, Homo sapiens
agccagcaguucag

SEQ ID NO: 1728873 - RNA, 21 nt, Homo sapiens
agccagcaguucagagcugcc

SEQ ID NO: 1728874 - RNA, 19 nt, Homo sapiens
agccaucaugugccuggaa

SEQ ID NO: 1728875 - RNA, 16 nt, Homo sapiens
agcccccuacugagaa

SEQ ID NO: 1728876 - RNA, 18 nt, Homo sapiens
agcccuccccaccugcuc

SEQ ID NO: 1728877 - RNA, 20 nt, Homo sapiens
agcccuccccaccugcucac

SEQ ID NO: 1728878 - RNA, 15 nt, Homo sapiens
agcgugaaagcagau

SEQ ID NO: 1728879 - RNA, 22 nt, Homo sapiens
agcuauuuucaacauaacugaa

SEQ ID NO: 1728880 - RNA, 20 nt, Homo sapiens
agcugagauugcgccacugc

SEQ ID NO: 1728881 - RNA, 11 nt, Homo sapiens
agcugccaaaa

SEQ ID NO: 1728882 - RNA, 23 nt, Homo sapiens
agcugcccucuccugggcagcug

SEQ ID NO: 1728883 - RNA, 15 nt, Homo sapiens
agcugcugggccagu

SEQ ID NO: 1728884 - RNA, 17 nt, Homo sapiens
cuugggagcaccgccug

SEQ ID NO: 1728885 - RNA, 16 nt, Homo sapiens
cuuguaaacauugccu

SEQ ID NO: 1728886 - RNA, 23 nt, Homo sapiens
cuuguaaacauugccugauuugu

SEQ ID NO: 1728887 - RNA, 21 nt, Homo sapiens
cuugucagugcucggcuguaa

SEQ ID NO: 1728888 - RNA, 13 nt, Homo sapiens
cuugucucugagg

SEQ ID NO: 1728889 - RNA, 14 nt, Homo sapiens
cuuguguuuuuaac

SEQ ID NO: 1728890 - RNA, 21 nt, Homo sapiens
cuuuaguacauggagcucagg

SEQ ID NO: 1728891 - RNA, 17 nt, Homo sapiens
cuuucuuacacaagagc

SEQ ID NO: 1728892 - RNA, 21 nt, Homo sapiens
cuuugcauagcagcugcuacu

SEQ ID NO: 1728893 - RNA, 15 nt, Homo sapiens
cuuugucucugagaa

SEQ ID NO: 1728894 - RNA, 20 nt, Homo sapiens
cuuuuagcacaucacugaga

SEQ ID NO: 1728895 - RNA, 15 nt, Homo sapiens
gaaaaucugaacucu

SEQ ID NO: 1728896 - RNA, 14 nt, Homo sapiens
gaaaauuaacacug

SEQ ID NO: 1728897 - RNA, 22 nt, Homo sapiens
gaaacuuccuuugagaauugug

SEQ ID NO: 1728898 - RNA, 23 nt, Homo sapiens
gaaauacacagugcugaccagac

SEQ ID NO: 1728899 - RNA, 15 nt, Homo sapiens
gaaaucagcaggacg

SEQ ID NO: 1728900 - RNA, 23 nt, Homo sapiens
gaagacaauggcuuacuccagga

SEQ ID NO: 1728901 - RNA, 17 nt, Homo sapiens
gaagacuauauuguaca

SEQ ID NO: 1728902 - RNA, 23 nt, Homo sapiens
gaagcacuccucgguacucccau

SEQ ID NO: 1728903 - RNA, 19 nt, Homo sapiens
gaagccggccggcugggau

SEQ ID NO: 1728904 - RNA, 18 nt, Homo sapiens
gaaggaugccuuaucucu

SEQ ID NO: 1728905 - RNA, 11 nt, Homo sapiens
gaauagcugug

SEQ ID NO: 1728906 - RNA, 15 nt, Homo sapiens
gaaucacuugaacuc

SEQ ID NO: 1728907 - RNA, 14 nt, Homo sapiens
gaauuuggcccaga

SEQ ID NO: 1728908 - RNA, 15 nt, Homo sapiens
gacaggcagugccau

SEQ ID NO: 1728909 - RNA, 16 nt, Homo sapiens
gacaugcagcucugau

SEQ ID NO: 1728910 - RNA, 21 nt, Homo sapiens
gaccacuuuucaguucagugg

SEQ ID NO: 1728911 - RNA, 15 nt, Homo sapiens
gaccuacuaaaaaua

SEQ ID NO: 1728912 - RNA, 13 nt, Homo sapiens
gaccuucuaggaa

SEQ ID NO: 1728913 - RNA, 13 nt, Homo sapiens
gagacuccgucuc

SEQ ID NO: 1728914 - RNA, 20 nt, Homo sapiens
gagauugcgccacugcacuc

SEQ ID NO: 1728915 - RNA, 16 nt, Homo sapiens
gagccacguauguuuu

SEQ ID NO: 1728916 - RNA, 16 nt, Homo sapiens
gagccugaggcaugag

SEQ ID NO: 1728917 - RNA, 13 nt, Homo sapiens
gaggaaccucaaa

SEQ ID NO: 1728918 - RNA, 19 nt, Homo sapiens
gagguggagguugcaguga

SEQ ID NO: 1728919 - RNA, 18 nt, Homo sapiens
gagugagacuccgucuca

SEQ ID NO: 1728920 - RNA, 13 nt, Homo sapiens
gauaccccaaagu

SEQ ID NO: 1728921 - RNA, 16 nt, Homo sapiens
gaugagagagugcuga

SEQ ID NO: 1728922 - RNA, 18 nt, Homo sapiens
gaugaguuuaucauguca

SEQ ID NO: 1728923 - RNA, 12 nt, Homo sapiens
gauuauuugaac

SEQ ID NO: 1728924 - RNA, 17 nt, Homo sapiens
gauugaauuaaaacagc

SEQ ID NO: 1728925 - RNA, 15 nt, Homo sapiens
gcaaacacuguguau

SEQ ID NO: 1728926 - RNA, 15 nt, Homo sapiens
gcaccaauaaagccu

SEQ ID NO: 1728927 - RNA, 21 nt, Homo sapiens
gcacuguccagggcccaugua

SEQ ID NO: 1728928 - RNA, 14 nt, Homo sapiens
gcaggacacugcag

SEQ ID NO: 1728929 - RNA, 17 nt, Homo sapiens
gcagucuaguccugggg

SEQ ID NO: 1728930 - RNA, 15 nt, Homo sapiens
gcagugagcugagau

SEQ ID NO: 1728931 - RNA, 15 nt, Homo sapiens
gcauauauacauaua

SEQ ID NO: 1728932 - RNA, 18 nt, Homo sapiens
gccaaggaugacacugcc

SEQ ID NO: 1728933 - RNA, 21 nt, Homo sapiens
gccacagcuggugguaucuga

SEQ ID NO: 1728934 - RNA, 14 nt, Homo sapiens
gccaucaugugccu

SEQ ID NO: 1728935 - RNA, 15 nt, Homo sapiens
gccaugacugcucag

SEQ ID NO: 1728936 - RNA, 18 nt, Homo sapiens
gccaugggggcaacagcc

SEQ ID NO: 1728937 - RNA, 20 nt, Homo sapiens
gccccacugcccuccagggc

SEQ ID NO: 1728938 - RNA, 23 nt, Homo sapiens
gcccucacugucagucccacugc

SEQ ID NO: 1728939 - RNA, 14 nt, Homo sapiens
gcccucagauuccg

SEQ ID NO: 1728940 - RNA, 15 nt, Homo sapiens
gcccuccagggccag

SEQ ID NO: 1728941 - RNA, 15 nt, Homo sapiens
gcccuccccaccugc

SEQ ID NO: 1728942 - RNA, 20 nt, Homo sapiens
gccuggaaauuaaacccugc

SEQ ID NO: 1728943 - RNA, 18 nt, Homo sapiens
gcuacaaaauaaagcugu

SEQ ID NO: 1728944 - RNA, 21 nt, Homo sapiens
gcucaagucacuuuuauuuga

SEQ ID NO: 1728945 - RNA, 14 nt, Homo sapiens
gcucaguucugccu

SEQ ID NO: 1728946 - RNA, 20 nt, Homo sapiens
gcucauuccaugacucugcc

SEQ ID NO: 1728947 - RNA, 22 nt, Homo sapiens
gcucugcacagggaugaccugg

SEQ ID NO: 1728948 - RNA, 12 nt, Homo sapiens
gcuggacagggg

SEQ ID NO: 1728949 - RNA, 21 nt, Homo sapiens
gcugggauguuucugucacau

SEQ ID NO: 1728950 - RNA, 19 nt, Homo sapiens
gcugggauuacagguguga

SEQ ID NO: 1728951 - RNA, 14 nt, Homo sapiens
gcuguucucauucc

SEQ ID NO: 1728952 - RNA, 20 nt, Homo sapiens
gcuucauguucccaaaauca

SEQ ID NO: 1728953 - RNA, 14 nt, Homo sapiens
gcuuguguuuuuaa

SEQ ID NO: 1728954 - RNA, 12 nt, Homo sapiens
gcuuuaguacau

SEQ ID NO: 1728955 - RNA, 19 nt, Homo sapiens
ggaaacuggaugaggucau

SEQ ID NO: 1728956 - RNA, 16 nt, Homo sapiens
ggaaagaugaucagcu

SEQ ID NO: 1728957 - RNA, 17 nt, Homo sapiens
ggaaggacauccauguu

SEQ ID NO: 1728958 - RNA, 16 nt, Homo sapiens
ggacagcgccaccucu

SEQ ID NO: 1728959 - RNA, 21 nt, Homo sapiens
ggacagcgccaccucuuguca

SEQ ID NO: 1728960 - RNA, 17 nt, Homo sapiens
ggagaaugaagacuguu

SEQ ID NO: 1728961 - RNA, 15 nt, Homo sapiens
ggagccugaggcaug

SEQ ID NO: 1728962 - RNA, 19 nt, Homo sapiens
ggagguggagguugcagug

SEQ ID NO: 1728963 - RNA, 13 nt, Homo sapiens
ggaugaggucaua

SEQ ID NO: 1728964 - RNA, 19 nt, Homo sapiens
ggaugcucauuccaugacu

SEQ ID NO: 1728965 - RNA, 16 nt, Homo sapiens
ggcaacgcacaaaaca

SEQ ID NO: 1728966 - RNA, 14 nt, Homo sapiens
ggcaccaucugcca

SEQ ID NO: 1728967 - RNA, 14 nt, Homo sapiens
ggcacuguccaggg

SEQ ID NO: 1728968 - RNA, 15 nt, Homo sapiens
ggcacuguccagggc

SEQ ID NO: 1728969 - RNA, 17 nt, Homo sapiens
ggccugugauccaggaa

SEQ ID NO: 1728970 - RNA, 14 nt, Homo sapiens
ggccuuagaacuuu

SEQ ID NO: 1728971 - RNA, 16 nt, Homo sapiens
ggcugccaggcaccau

SEQ ID NO: 1728972 - RNA, 13 nt, Homo sapiens
gggaaaaccagac

SEQ ID NO: 1728973 - RNA, 17 nt, Homo sapiens
gggauguuucugucaca

SEQ ID NO: 1728974 - RNA, 22 nt, Homo sapiens
gggauugaauuaaaacagcugc

SEQ ID NO: 1728975 - RNA, 11 nt, Homo sapiens
gggcacugggc

SEQ ID NO: 1728976 - RNA, 16 nt, Homo sapiens
ggggcgugggauugaa

SEQ ID NO: 1728977 - RNA, 17 nt, Homo sapiens
ggggcuuuuacaccagu

SEQ ID NO: 1728978 - RNA, 22 nt, Homo sapiens
gguaaagcccucagaucccagg

SEQ ID NO: 1728979 - RNA, 12 nt, Homo sapiens
ggugaaaggcau

SEQ ID NO: 1728980 - RNA, 19 nt, Homo sapiens
ggugcaugaagguuucuga

SEQ ID NO: 1728981 - RNA, 13 nt, Homo sapiens
gguguugacaugu

SEQ ID NO: 1728982 - RNA, 15 nt, Homo sapiens
guaaacagcucugug

SEQ ID NO: 1728983 - RNA, 16 nt, Homo sapiens
guaauaaacucucuag

SEQ ID NO: 1728984 - RNA, 20 nt, Homo sapiens
guaaucccagcuacauggga

SEQ ID NO: 1728985 - RNA, 23 nt, Homo sapiens
guagccagaguuguucucagggg

SEQ ID NO: 1728986 - RNA, 19 nt, Homo sapiens
gucuggccuuuucuuguaa

SEQ ID NO: 1728987 - RNA, 19 nt, Homo sapiens
gugacauauauauguauau

SEQ ID NO: 1728988 - RNA, 17 nt, Homo sapiens
gugagacuccgucucaa

SEQ ID NO: 1728989 - RNA, 15 nt, Homo sapiens
gugauauaugccuau

SEQ ID NO: 1728990 - RNA, 18 nt, Homo sapiens
gugcauagagccacguau

SEQ ID NO: 1728991 - RNA, 19 nt, Homo sapiens
gugccaugggggcaacagc

SEQ ID NO: 1728992 - RNA, 17 nt, Homo sapiens
gugcccccugaaacagc

SEQ ID NO: 1728993 - RNA, 16 nt, Homo sapiens
gugcucuucuguucuc

SEQ ID NO: 1728994 - RNA, 22 nt, Homo sapiens
guggaugucccuauucugccau

SEQ ID NO: 1728995 - RNA, 22 nt, Homo sapiens
guggcagaauggggugcaugaa

SEQ ID NO: 1728996 - RNA, 19 nt, Homo sapiens
guggcaggggcaguggccu

SEQ ID NO: 1728997 - RNA, 22 nt, Homo sapiens
guggcauucacaucucauguaa

SEQ ID NO: 1728998 - RNA, 14 nt, Homo sapiens
guguguguguauau

SEQ ID NO: 1728999 - RNA, 17 nt, Homo sapiens
guguugacaugugcuuu

SEQ ID NO: 1729000 - RNA, 16 nt, Homo sapiens
guguuucuggggacac

SEQ ID NO: 1729001 - RNA, 14 nt, Homo sapiens
guuaaugguuugaa

SEQ ID NO: 1729002 - RNA, 13 nt, Homo sapiens
guuacucucaggc

SEQ ID NO: 1729003 - RNA, 17 nt, Homo sapiens
guuauagcugcauuugu

SEQ ID NO: 1729004 - RNA, 15 nt, Homo sapiens
guuccaguugcuuga

SEQ ID NO: 1729005 - RNA, 15 nt, Homo sapiens
guuccgagaagaaca

SEQ ID NO: 1729006 - RNA, 18 nt, Homo sapiens
guucuuccuaccaaauau

SEQ ID NO: 1729007 - RNA, 14 nt, Homo sapiens
guuguauugcauau

SEQ ID NO: 1729008 - RNA, 23 nt, Homo sapiens
guugucucucuaaacccaaauaa

SEQ ID NO: 1729009 - RNA, 21 nt, Homo sapiens
guuuauuuuuuuaaaacacaa

SEQ ID NO: 1729010 - RNA, 14 nt, Homo sapiens
guuucuggggacac

SEQ ID NO: 1729011 - RNA, 16 nt, Homo sapiens
uucuuacaaacaugug

SEQ ID NO: 1729012 - RNA, 20 nt, Homo sapiens
uucuuauuuuguaauaaacu

SEQ ID NO: 1729013 - RNA, 17 nt, Homo sapiens
uucuuguaaacauugcc

SEQ ID NO: 1729014 - RNA, 13 nt, Homo sapiens
uucuugucucuga

SEQ ID NO: 1729015 - RNA, 19 nt, Homo sapiens
uugaacuuauuuacacaua

SEQ ID NO: 1729016 - RNA, 22 nt, Homo sapiens
uugaauuaaaacagcugcgaca

SEQ ID NO: 1729017 - RNA, 15 nt, Homo sapiens
uugacagaacacugu

SEQ ID NO: 1729018 - RNA, 16 nt, Homo sapiens
uugacagaacacuguc

SEQ ID NO: 1729019 - RNA, 17 nt, Homo sapiens
uugacuugacagaacac

SEQ ID NO: 1729020 - RNA, 22 nt, Homo sapiens
uugcacgugcucuucuguucuc

SEQ ID NO: 1729021 - RNA, 21 nt, Homo sapiens
uugccucaacagcaggaggca

SEQ ID NO: 1729022 - RNA, 10 nt, Homo sapiens
uuggcacugu

SEQ ID NO: 1729023 - RNA, 20 nt, Homo sapiens
uuguaguuuuggcuaguccu

SEQ ID NO: 1729024 - RNA, 15 nt, Homo sapiens
uuguauugcauauau

SEQ ID NO: 1729025 - RNA, 16 nt, Homo sapiens
uuguccuucagccaaa

SEQ ID NO: 1729026 - RNA, 13 nt, Homo sapiens
uuguucucagggg

SEQ ID NO: 1729027 - RNA, 14 nt, Homo sapiens
uuuaagaacuguau

SEQ ID NO: 1729028 - RNA, 14 nt, Homo sapiens
uuuacagacuguga

SEQ ID NO: 1729029 - RNA, 17 nt, Homo sapiens
uuucuggggacaccagc

SEQ ID NO: 1729030 - RNA, 19 nt, Homo sapiens
uuucuuguaaacauugccu

SEQ ID NO: 1729031 - RNA, 13 nt, Homo sapiens
uuugaaaugucau

SEQ ID NO: 1729032 - RNA, 12 nt, Homo sapiens
uuuuaacugcau

SEQ ID NO: 1729033 - RNA, 22 nt, Homo sapiens
uuuuauaaauucagaaagucau

SEQ ID NO: 1729034 - RNA, 12 nt, Homo sapiens
uuuucaguauga

SEQ ID NO: 1729035 - RNA, 18 nt, Homo sapiens
uuuuccaaacacaggcaa

SEQ ID NO: 1729036 - RNA, 15 nt, Homo sapiens
uuuucuagacugucu

SEQ ID NO: 1729037 - RNA, 20 nt, Homo sapiens
aacauaaauuuaucaucucg

SEQ ID NO: 1729038 - RNA, 20 nt, Homo sapiens
aacauguuuuguauguuaaa

SEQ ID NO: 1729039 - RNA, 15 nt, Homo sapiens
aaccaugggcucagg

SEQ ID NO: 1729040 - RNA, 18 nt, Homo sapiens
aacccugccccacuucuc

SEQ ID NO: 1729041 - RNA, 18 nt, Homo sapiens
aacuagcuuggaaacugg

SEQ ID NO: 1729042 - RNA, 11 nt, Homo sapiens
aacucaauauu

SEQ ID NO: 1729043 - RNA, 16 nt, Homo sapiens
aacuggaugaggucau

SEQ ID NO: 1729044 - RNA, 22 nt, Homo sapiens
aacuuugcauagcagcugcuac

SEQ ID NO: 1729045 - RNA, 19 nt, Homo sapiens
aagagugagacuccgucuc

SEQ ID NO: 1729046 - RNA, 20 nt, Homo sapiens
aagagugagacuccgucuca

SEQ ID NO: 1729047 - RNA, 21 nt, Homo sapiens
aagaugcuuuguuucuuucau

SEQ ID NO: 1729048 - RNA, 18 nt, Homo sapiens
aagcauuucccccaggga

SEQ ID NO: 1729049 - RNA, 22 nt, Homo sapiens
aagccacguuaaguccaaggag

SEQ ID NO: 1729050 - RNA, 18 nt, Homo sapiens
aagcccccuacugagaaa

SEQ ID NO: 1729051 - RNA, 15 nt, Homo sapiens
aagcuccucgugaua

SEQ ID NO: 1729052 - RNA, 17 nt, Homo sapiens
aagcugccgguucuuaa

SEQ ID NO: 1729053 - RNA, 17 nt, Homo sapiens
aagcuguuccacuucuc

SEQ ID NO: 1729054 - RNA, 12 nt, Homo sapiens
aaggacaccucc

SEQ ID NO: 1729055 - RNA, 14 nt, Homo sapiens
aaggauauuuacua

SEQ ID NO: 1729056 - RNA, 16 nt, Homo sapiens
aaggccugugauccag

SEQ ID NO: 1729057 - RNA, 16 nt, Homo sapiens
aaguagcugcuaccuu

SEQ ID NO: 1729058 - RNA, 21 nt, Homo sapiens
aaguuuuguggaggagcucag

SEQ ID NO: 1729059 - RNA, 14 nt, Homo sapiens
aauauaaacacuau

SEQ ID NO: 1729060 - RNA, 19 nt, Homo sapiens
aauauggacaaagaaggca

SEQ ID NO: 1729061 - RNA, 17 nt, Homo sapiens
aauaugggcucaaguca

SEQ ID NO: 1729062 - RNA, 16 nt, Homo sapiens
aaucaccagagaccaa

SEQ ID NO: 1729063 - RNA, 14 nt, Homo sapiens
aaucguagguguug

SEQ ID NO: 1729064 - RNA, 15 nt, Homo sapiens
aaugcuaaaugcaaa

SEQ ID NO: 1729065 - RNA, 15 nt, Homo sapiens
aaugggaaaaccaga

SEQ ID NO: 1729066 - RNA, 17 nt, Homo sapiens
aauggggugcaugaagg

SEQ ID NO: 1729067 - RNA, 21 nt, Homo sapiens
aauguuauagcugcauuuguc

SEQ ID NO: 1729068 - RNA, 13 nt, Homo sapiens
aauucacucccac

SEQ ID NO: 1729069 - RNA, 17 nt, Homo sapiens
aauucaucucucuuuaa

SEQ ID NO: 1729070 - RNA, 14 nt, Homo sapiens
acaaaaaaaccaca

SEQ ID NO: 1729071 - RNA, 13 nt, Homo sapiens
acaaauacuacag

SEQ ID NO: 1729072 - RNA, 13 nt, Homo sapiens
acaaauguaugau

SEQ ID NO: 1729073 - RNA, 17 nt, Homo sapiens
acaauggcuuacuccag

SEQ ID NO: 1729074 - RNA, 21 nt, Homo sapiens
acacacuggcuccuggaccua

SEQ ID NO: 1729075 - RNA, 17 nt, Homo sapiens
acacauuuggcaguuua

SEQ ID NO: 1729076 - RNA, 23 nt, Homo sapiens
acacccaagaagaaaugcuuucc

SEQ ID NO: 1729077 - RNA, 15 nt, Homo sapiens
acacuaauacaccag

SEQ ID NO: 1729078 - RNA, 14 nt, Homo sapiens
acagaacacugucu

SEQ ID NO: 1729079 - RNA, 13 nt, Homo sapiens
acagacacacacu

SEQ ID NO: 1729080 - RNA, 14 nt, Homo sapiens
acaucaacauuccc

SEQ ID NO: 1729081 - RNA, 15 nt, Homo sapiens
acauggagcucaggu

SEQ ID NO: 1729082 - RNA, 10 nt, Homo sapiens
acaugugcuu

SEQ ID NO: 1729083 - RNA, 15 nt, Homo sapiens
accaauaaagccuuc

SEQ ID NO: 1729084 - RNA, 13 nt, Homo sapiens
accacagcugcag

SEQ ID NO: 1729085 - RNA, 19 nt, Homo sapiens
accacuuugucucugagaa

SEQ ID NO: 1729086 - RNA, 22 nt, Homo sapiens
accaucugccaaugccaugacu

SEQ ID NO: 1729087 - RNA, 16 nt, Homo sapiens
acccaaguagcugcua

SEQ ID NO: 1729088 - RNA, 20 nt, Homo sapiens
accccuuggcacuguggaac

SEQ ID NO: 1729089 - RNA, 15 nt, Homo sapiens
accucccugcaauaa

SEQ ID NO: 1729090 - RNA, 15 nt, Homo sapiens
accucuugucagugc

SEQ ID NO: 1729091 - RNA, 21 nt, Homo sapiens
accuguucuuccuaccaaaua

SEQ ID NO: 1729092 - RNA, 17 nt, Homo sapiens
acgacuguuuucccaac

SEQ ID NO: 1729093 - RNA, 18 nt, Homo sapiens
acgugcucuucuguucuc

SEQ ID NO: 1729094 - RNA, 16 nt, Homo sapiens
acguuuauagccgaaa

SEQ ID NO: 1729095 - RNA, 21 nt, Homo sapiens
acucuggaaguccccgggagc

SEQ ID NO: 1729096 - RNA, 22 nt, Homo sapiens
acucuuuuccaaacacaggcaa

SEQ ID NO: 1729097 - RNA, 17 nt, Homo sapiens
acugcauaauagccuaa

SEQ ID NO: 1729098 - RNA, 18 nt, Homo sapiens
acugcccuccagggccag

SEQ ID NO: 1729099 - RNA, 14 nt, Homo sapiens
acugucagcccuca

SEQ ID NO: 1729100 - RNA, 16 nt, Homo sapiens
acugucuugaagacaa

SEQ ID NO: 1729101 - RNA, 15 nt, Homo sapiens
acugugaguccugau

SEQ ID NO: 1729102 - RNA, 13 nt, Homo sapiens
acuucucuagaga

SEQ ID NO: 1729103 - RNA, 15 nt, Homo sapiens
acuucucuuucuuau

SEQ ID NO: 1729104 - RNA, 17 nt, Homo sapiens
acuugaaauuugccuug

SEQ ID NO: 1729105 - RNA, 17 nt, Homo sapiens
acuuugucucugagaac

SEQ ID NO: 1729106 - RNA, 14 nt, Homo sapiens
agaaggacaccucc

SEQ ID NO: 1729107 - RNA, 16 nt, Homo sapiens
agaccucugugcacuu

SEQ ID NO: 1729108 - RNA, 23 nt, Homo sapiens
agagcugggauguuucugucaca

SEQ ID NO: 1729109 - RNA, 17 nt, Homo sapiens
agagggcagucuagucc

SEQ ID NO: 1729110 - RNA, 15 nt, Homo sapiens
agauaauacauuccg

SEQ ID NO: 1729111 - RNA, 19 nt, Homo sapiens
agauggccgggacaugcag

SEQ ID NO: 1729112 - RNA, 16 nt, Homo sapiens
agauuccgcaccaaua

SEQ ID NO: 1729113 - RNA, 14 nt, Homo sapiens
agcagaagacucuc

SEQ ID NO: 1729114 - RNA, 20 nt, Homo sapiens
agccagaggaggccggugaa

SEQ ID NO: 1729115 - RNA, 14 nt, Homo sapiens
agccccacugcccu

SEQ ID NO: 1729116 - RNA, 14 nt, Homo sapiens
agccggccggcugg

SEQ ID NO: 1729117 - RNA, 23 nt, Homo sapiens
agcugagauugcgccacugcacu

SEQ ID NO: 1729118 - RNA, 21 nt, Homo sapiens
agcugauccuucaacucugug

SEQ ID NO: 1729119 - RNA, 20 nt, Homo sapiens
agcuggagcccgugcccuac

SEQ ID NO: 1729120 - RNA, 23 nt, Homo sapiens
agcuggagcccgugcccuaccac

SEQ ID NO: 1729121 - RNA, 23 nt, Homo sapiens
aggaaugcugacaaugcugccau

SEQ ID NO: 1729122 - RNA, 17 nt, Homo sapiens
aggacuaauccaauacc

SEQ ID NO: 1729123 - RNA, 16 nt, Homo sapiens
aggaugacacugccag

SEQ ID NO: 1729124 - RNA, 19 nt, Homo sapiens
aggauucaggccucugagg

SEQ ID NO: 1729125 - RNA, 21 nt, Homo sapiens
aggcaacugugaguccgggaa

SEQ ID NO: 1729126 - RNA, 16 nt, Homo sapiens
aggcaugagaaucacu

SEQ ID NO: 1729127 - RNA, 22 nt, Homo sapiens
aggcauguucagggaugcucau

SEQ ID NO: 1729128 - RNA, 15 nt, Homo sapiens
aggccagaugcacau

SEQ ID NO: 1729129 - RNA, 23 nt, Homo sapiens
aggcucuccaaauuuugcuuuag

SEQ ID NO: 1729130 - RNA, 21 nt, Homo sapiens
aggggcgugggauugaauuaa

SEQ ID NO: 1729131 - RNA, 23 nt, Homo sapiens
aggggcuguugaauuucccacau

SEQ ID NO: 1729132 - RNA, 23 nt, Homo sapiens
agguccucacagcagucacaggc

SEQ ID NO: 1729133 - RNA, 15 nt, Homo sapiens
aggucugcuccugaa

SEQ ID NO: 1729134 - RNA, 17 nt, Homo sapiens
aguccaggccuggguca

SEQ ID NO: 1729135 - RNA, 22 nt, Homo sapiens
agucccuucugagcgagcacac

SEQ ID NO: 1729136 - RNA, 20 nt, Homo sapiens
agugaaagcaucacuuggga

SEQ ID NO: 1729137 - RNA, 18 nt, Homo sapiens
agugagacuccgucucaa

SEQ ID NO: 1729138 - RNA, 16 nt, Homo sapiens
agugcacuguauauag

SEQ ID NO: 1729139 - RNA, 15 nt, Homo sapiens
agugcugaccagaca

SEQ ID NO: 1729140 - RNA, 14 nt, Homo sapiens
aguggcacucugug

SEQ ID NO: 1729141 - RNA, 19 nt, Homo sapiens
aguggcauucacaucucau

SEQ ID NO: 1729142 - RNA, 23 nt, Homo sapiens
aguucaguggcauucacaucuca

SEQ ID NO: 1729143 - RNA, 13 nt, Homo sapiens
aguucugccuuau

SEQ ID NO: 1729144 - RNA, 22 nt, Homo sapiens
aguugacuugacagaacacugu

SEQ ID NO: 1729145 - RNA, 18 nt, Homo sapiens
auaaaagucagagcucag

SEQ ID NO: 1729146 - RNA, 22 nt, Homo sapiens
ccccacuucucuacucuggaag

SEQ ID NO: 1729147 - RNA, 18 nt, Homo sapiens
cccgcaguugugccaaag

SEQ ID NO: 1729148 - RNA, 16 nt, Homo sapiens
cccuauucugccaugg

SEQ ID NO: 1729149 - RNA, 18 nt, Homo sapiens
cccuggaaggacauccau

SEQ ID NO: 1729150 - RNA, 14 nt, Homo sapiens
cccuugcuggaguc

SEQ ID NO: 1729151 - RNA, 12 nt, Homo sapiens
cccuuggcacug

SEQ ID NO: 1729152 - RNA, 19 nt, Homo sapiens
ccgcaccaauaaagccuuc

SEQ ID NO: 1729153 - RNA, 12 nt, Homo sapiens
ccgucucaaaaa

SEQ ID NO: 1729154 - RNA, 14 nt, Homo sapiens
ccuccccaccugcu

SEQ ID NO: 1729155 - RNA, 18 nt, Homo sapiens
ccuccucugcuugccauc

SEQ ID NO: 1729156 - RNA, 20 nt, Homo sapiens
ccucuccugggcagcugccu

SEQ ID NO: 1729157 - RNA, 17 nt, Homo sapiens
ccugaaccaguccugcu

SEQ ID NO: 1729158 - RNA, 21 nt, Homo sapiens
ccugcugggcacugggcacua

SEQ ID NO: 1729159 - RNA, 17 nt, Homo sapiens
ccuggccccugggccug

SEQ ID NO: 1729160 - RNA, 21 nt, Homo sapiens
ccuguaaucccagcuacaugg

SEQ ID NO: 1729161 - RNA, 17 nt, Homo sapiens
ccuguagguucuugaua

SEQ ID NO: 1729162 - RNA, 14 nt, Homo sapiens
ccuguucuuucuua

SEQ ID NO: 1729163 - RNA, 21 nt, Homo sapiens
ccuguucuuucuuacacaaga

SEQ ID NO: 1729164 - RNA, 23 nt, Homo sapiens
ccuuagaacuuugcauagcagcu

SEQ ID NO: 1729165 - RNA, 18 nt, Homo sapiens
ccuuccucaguccuggaa

SEQ ID NO: 1729166 - RNA, 17 nt, Homo sapiens
ccuucuggggcuuugcc

SEQ ID NO: 1729167 - RNA, 18 nt, Homo sapiens
ccuucuggggcuuugcca

SEQ ID NO: 1729168 - RNA, 21 nt, Homo sapiens
ccuuuucuuguaaacauugcc

SEQ ID NO: 1729169 - RNA, 17 nt, Homo sapiens
cgaggggcucaguucug

SEQ ID NO: 1729170 - RNA, 20 nt, Homo sapiens
cgccagacagauugcugaua

SEQ ID NO: 1729171 - RNA, 23 nt, Homo sapiens
cgcuacaaaauaaagcuguucuc

SEQ ID NO: 1729172 - RNA, 23 nt, Homo sapiens
cgggggcuuggcugugcccucag

SEQ ID NO: 1729173 - RNA, 15 nt, Homo sapiens
cguaguuacucucag

SEQ ID NO: 1729174 - RNA, 20 nt, Homo sapiens
cguggaauugugcugaguug

SEQ ID NO: 1729175 - RNA, 18 nt, Homo sapiens
cgugggauugaauuaaaa

SEQ ID NO: 1729176 - RNA, 14 nt, Homo sapiens
cuaaacccaaauaa

SEQ ID NO: 1729177 - RNA, 12 nt, Homo sapiens
cuaaagacagaa

SEQ ID NO: 1729178 - RNA, 16 nt, Homo sapiens
cuaaagguuguauugc

SEQ ID NO: 1729179 - RNA, 19 nt, Homo sapiens
cuaaagguuguauugcaua

SEQ ID NO: 1729180 - RNA, 14 nt, Homo sapiens
cuaauauauccaug

SEQ ID NO: 1729181 - RNA, 14 nt, Homo sapiens
cuagagaacaugcc

SEQ ID NO: 1729182 - RNA, 15 nt, Homo sapiens
cuagagaacaugccc

SEQ ID NO: 1729183 - RNA, 13 nt, Homo sapiens
cuaggucugacca

SEQ ID NO: 1729184 - RNA, 15 nt, Homo sapiens
cuaggucugaccaaa

SEQ ID NO: 1729185 - RNA, 23 nt, Homo sapiens
cuaguaccaugucguaguuacuc

SEQ ID NO: 1729186 - RNA, 11 nt, Homo sapiens
cuauccagcua

SEQ ID NO: 1729187 - RNA, 22 nt, Homo sapiens
cucaggacacuaauacaccagg

SEQ ID NO: 1729188 - RNA, 13 nt, Homo sapiens
cucaggggugcug

SEQ ID NO: 1729189 - RNA, 20 nt, Homo sapiens
cuccacaaaugggaaaacca

SEQ ID NO: 1729190 - RNA, 13 nt, Homo sapiens
cuccacugaccug

SEQ ID NO: 1729191 - RNA, 15 nt, Homo sapiens
cuccacugaccuggu

SEQ ID NO: 1729192 - RNA, 17 nt, Homo sapiens
cuccaggaugaguuacu

SEQ ID NO: 1729193 - RNA, 19 nt, Homo sapiens
cuccagucuggucggcaag

SEQ ID NO: 1729194 - RNA, 15 nt, Homo sapiens
cucccacauugucac

SEQ ID NO: 1729195 - RNA, 14 nt, Homo sapiens
cuccccaccugcuc

SEQ ID NO: 1729196 - RNA, 16 nt, Homo sapiens
cucccuccaccucccu

SEQ ID NO: 1729197 - RNA, 15 nt, Homo sapiens
cucuagaagcucagg

SEQ ID NO: 1729198 - RNA, 17 nt, Homo sapiens
cucucuaaacccaaaua

SEQ ID NO: 1729199 - RNA, 22 nt, Homo sapiens
cucugcacagggaugaccugga

SEQ ID NO: 1729200 - RNA, 14 nt, Homo sapiens
cugaaugacaucaa

SEQ ID NO: 1729201 - RNA, 17 nt, Homo sapiens
cugagaaauguucagaa

SEQ ID NO: 1729202 - RNA, 16 nt, Homo sapiens
cugagaaggacaccuc

SEQ ID NO: 1729203 - RNA, 15 nt, Homo sapiens
cugaggcucuccaaa

SEQ ID NO: 1729204 - RNA, 18 nt, Homo sapiens
cugaugagagagugcuga

SEQ ID NO: 1729205 - RNA, 21 nt, Homo sapiens
cugaugagagagugcugagaa

SEQ ID NO: 1729206 - RNA, 16 nt, Homo sapiens
cugaugcuuuggugug

SEQ ID NO: 1729207 - RNA, 20 nt, Homo sapiens
cugcagaguaggcagcugcc

SEQ ID NO: 1729208 - RNA, 23 nt, Homo sapiens
cugcagugggccauccagagcau

SEQ ID NO: 1729209 - RNA, 16 nt, Homo sapiens
cugccaaggaugacac

SEQ ID NO: 1729210 - RNA, 15 nt, Homo sapiens
cugccagucacgagc

SEQ ID NO: 1729211 - RNA, 12 nt, Homo sapiens
cugcuugccauc

SEQ ID NO: 1729212 - RNA, 18 nt, Homo sapiens
cuggcgcaucauaugcag

SEQ ID NO: 1729213 - RNA, 15 nt, Homo sapiens
cuggcugaccugcug

SEQ ID NO: 1729214 - RNA, 21 nt, Homo sapiens
cugggaucaagaaggggacag

SEQ ID NO: 1729215 - RNA, 18 nt, Homo sapiens
cuggggacaccagccauc

SEQ ID NO: 1729216 - RNA, 15 nt, Homo sapiens
cuguagguucuugau

SEQ ID NO: 1729217 - RNA, 20 nt, Homo sapiens
cugugccugcugggcacugg

SEQ ID NO: 1729218 - RNA, 22 nt, Homo sapiens
cugugccugcugggcacugggc

SEQ ID NO: 1729219 - RNA, 14 nt, Homo sapiens
cuguggaacugcca

SEQ ID NO: 1729220 - RNA, 13 nt, Homo sapiens
cugugguggagaa

SEQ ID NO: 1729221 - RNA, 20 nt, Homo sapiens
cugugugggaaaauggcaga

SEQ ID NO: 1729222 - RNA, 18 nt, Homo sapiens
cuguguuucuggggacac

SEQ ID NO: 1729223 - RNA, 19 nt, Homo sapiens
cuguuccacuucucuagag

SEQ ID NO: 1729224 - RNA, 20 nt, Homo sapiens
cuguucuuucuuacacaaga

SEQ ID NO: 1729225 - RNA, 16 nt, Homo sapiens
cuuaauucacucccac

SEQ ID NO: 1729226 - RNA, 14 nt, Homo sapiens
cuuacaaacaugug

SEQ ID NO: 1729227 - RNA, 18 nt, Homo sapiens
cuuacaaacaugugguua

SEQ ID NO: 1729228 - RNA, 14 nt, Homo sapiens
cuuacuguaacgga

SEQ ID NO: 1729229 - RNA, 23 nt, Homo sapiens
cuucaccuuucccacuuucuucu

SEQ ID NO: 1729230 - RNA, 18 nt, Homo sapiens
cuuccuggaguacaaaca

SEQ ID NO: 1729231 - RNA, 16 nt, Homo sapiens
cuucgauggcauccug

SEQ ID NO: 1729232 - RNA, 17 nt, Homo sapiens
cuucuggggcuuugcca

SEQ ID NO: 1729233 - RNA, 17 nt, Homo sapiens
cuugaaggugcugccac

SEQ ID NO: 1729234 - RNA, 17 nt, Homo sapiens
cuugacagaacacuguc

SEQ ID NO: 1729235 - RNA, 12 nt, Homo sapiens
cuuuagcuguga

SEQ ID NO: 1729236 - RNA, 18 nt, Homo sapiens
cuuucuuauuuuguaaua

SEQ ID NO: 1729237 - RNA, 19 nt, Homo sapiens
cuuuuauuugaaaugucau

SEQ ID NO: 1729238 - RNA, 13 nt, Homo sapiens
cuuuuccaaacac

SEQ ID NO: 1729239 - RNA, 22 nt, Homo sapiens
cuuuuccaugcacccucauaca

SEQ ID NO: 1729240 - RNA, 14 nt, Homo sapiens
cuuuuuuauacuca

SEQ ID NO: 1729241 - RNA, 18 nt, Homo sapiens
cuuuuuuauacucaauca

SEQ ID NO: 1729242 - RNA, 15 nt, Homo sapiens
gaaaagauuccuguc

SEQ ID NO: 1729243 - RNA, 15 nt, Homo sapiens
gaaaauuaacacugc

SEQ ID NO: 1729244 - RNA, 14 nt, Homo sapiens
gaaacagcugccac

SEQ ID NO: 1729245 - RNA, 19 nt, Homo sapiens
gaaacuggaugaggucaua

SEQ ID NO: 1729246 - RNA, 15 nt, Homo sapiens
gaaagaugucccaca

SEQ ID NO: 1729247 - RNA, 18 nt, Homo sapiens
gaaccugcccugcuccca

SEQ ID NO: 1729248 - RNA, 21 nt, Homo sapiens
gaaccugcccugcucccacag

SEQ ID NO: 1729249 - RNA, 23 nt, Homo sapiens
gaacuuugcauagcagcugcuac

SEQ ID NO: 1729250 - RNA, 22 nt, Homo sapiens
gaagaacagauaaucccuguau

SEQ ID NO: 1729251 - RNA, 24 nt, Homo sapiens
gaagaggccuagccugagccaaag

SEQ ID NO: 1729252 - RNA, 17 nt, Homo sapiens
gaagauggcacugucca

SEQ ID NO: 1729253 - RNA, 22 nt, Homo sapiens
gaauauauuugugugugugaua

SEQ ID NO: 1729254 - RNA, 13 nt, Homo sapiens
gaauuaaaacagc

SEQ ID NO: 1729255 - RNA, 15 nt, Homo sapiens
gaauuaaaacagcug

SEQ ID NO: 1729256 - RNA, 15 nt, Homo sapiens
gaugaguuacuugaa

SEQ ID NO: 1729257 - RNA, 22 nt, Homo sapiens
gauggagaggcaugggggccca

SEQ ID NO: 1729258 - RNA, 18 nt, Homo sapiens
gauggcacuguccagggc

SEQ ID NO: 1729259 - RNA, 21 nt, Homo sapiens
gauggcacuguccagggccca

SEQ ID NO: 1729260 - RNA, 17 nt, Homo sapiens
gauggccgggacaugca

SEQ ID NO: 1729261 - RNA, 17 nt, Homo sapiens
gauuguucaucaugaca

SEQ ID NO: 1729262 - RNA, 12 nt, Homo sapiens
gcaaaagucauu

SEQ ID NO: 1729263 - RNA, 22 nt, Homo sapiens
gcaauucuaacuuuuuugcuau

SEQ ID NO: 1729264 - RNA, 16 nt, Homo sapiens
gcaccaauaaagccuu

SEQ ID NO: 1729265 - RNA, 17 nt, Homo sapiens
gcacuguggaacugcca

SEQ ID NO: 1729266 - RNA, 22 nt, Homo sapiens
gcagaaaggaaaagauuccugu

SEQ ID NO: 1729267 - RNA, 20 nt, Homo sapiens
gcaggacgacuguuuuccca

SEQ ID NO: 1729268 - RNA, 16 nt, Homo sapiens
gcauagcagcugcuac

SEQ ID NO: 1729269 - RNA, 21 nt, Homo sapiens
gcaucucccacacaagaccca

SEQ ID NO: 1729270 - RNA, 13 nt, Homo sapiens
gcauggaugaaua

SEQ ID NO: 1729271 - RNA, 15 nt, Homo sapiens
gccaagcagugccca

SEQ ID NO: 1729272 - RNA, 14 nt, Homo sapiens
gccaaggaugacac

SEQ ID NO: 1729273 - RNA, 13 nt, Homo sapiens
gccacugcacucc

SEQ ID NO: 1729274 - RNA, 19 nt, Homo sapiens
gccagguccucacagcagu

SEQ ID NO: 1729275 - RNA, 11 nt, Homo sapiens
gccaguauuuu

SEQ ID NO: 1729276 - RNA, 19 nt, Homo sapiens
gccaucaugugccuggaaa

SEQ ID NO: 1729277 - RNA, 13 nt, Homo sapiens
gcccagggugcug

SEQ ID NO: 1729278 - RNA, 19 nt, Homo sapiens
gccuaacaugauuauuuga

SEQ ID NO: 1729279 - RNA, 21 nt, Homo sapiens
gccugccaaggaugacacugc

SEQ ID NO: 1729280 - RNA, 13 nt, Homo sapiens
gcgagcacaccuu

SEQ ID NO: 1729281 - RNA, 14 nt, Homo sapiens
gcuacuagcucuuu

SEQ ID NO: 1729282 - RNA, 14 nt, Homo sapiens
gcucccacagaaca

SEQ ID NO: 1729283 - RNA, 23 nt, Homo sapiens
gcucuguguuucuggggacacca

SEQ ID NO: 1729284 - RNA, 20 nt, Homo sapiens
gcugagauugcgccacugca

SEQ ID NO: 1729285 - RNA, 18 nt, Homo sapiens
gcugaguugguguugaca

SEQ ID NO: 1729286 - RNA, 15 nt, Homo sapiens
gcuguuccacuucuc

SEQ ID NO: 1729287 - RNA, 18 nt, Homo sapiens
gcuguucucauuccuguu

SEQ ID NO: 1729288 - RNA, 14 nt, Homo sapiens
gcuuccacugucag

SEQ ID NO: 1729289 - RNA, 11 nt, Homo sapiens
gcuugccaucc

SEQ ID NO: 1729290 - RNA, 16 nt, Homo sapiens
gcuuggcugugcccuc

SEQ ID NO: 1729291 - RNA, 21 nt, Homo sapiens
gcuuuagguugcuucagcuga

SEQ ID NO: 1729292 - RNA, 21 nt, Homo sapiens
ggaaguuuuguggaggagcuc

SEQ ID NO: 1729293 - RNA, 23 nt, Homo sapiens
ggaauauauuugugugugugaua

SEQ ID NO: 1729294 - RNA, 13 nt, Homo sapiens
ggaauucaucucu

SEQ ID NO: 1729295 - RNA, 14 nt, Homo sapiens
ggacagacagcagc

SEQ ID NO: 1729296 - RNA, 19 nt, Homo sapiens
ggagaaugaagacuguuaa

SEQ ID NO: 1729297 - RNA, 13 nt, Homo sapiens
ggagaguccaggc

SEQ ID NO: 1729298 - RNA, 23 nt, Homo sapiens
ggagccucuccuugccuggugac

SEQ ID NO: 1729299 - RNA, 22 nt, Homo sapiens
ggagguugcagugagcugagau

SEQ ID NO: 1729300 - RNA, 23 nt, Homo sapiens
ggaguaguugcuacucuucagaa

SEQ ID NO: 1729301 - RNA, 13 nt, Homo sapiens
ggauauuuacuac

SEQ ID NO: 1729302 - RNA, 18 nt, Homo sapiens
ggaucaagaaggggacag

SEQ ID NO: 1729303 - RNA, 22 nt, Homo sapiens
ggaucaagaaggggacagcgcc

SEQ ID NO: 1729304 - RNA, 23 nt, Homo sapiens
ggaugaggaaccucaaacugggu

SEQ ID NO: 1729305 - RNA, 20 nt, Homo sapiens
ggcauccugcagugggccau

SEQ ID NO: 1729306 - RNA, 16 nt, Homo sapiens
ggcauucacaucucau

SEQ ID NO: 1729307 - RNA, 12 nt, Homo sapiens
ggccaguggcac

SEQ ID NO: 1729308 - RNA, 19 nt, Homo sapiens
gggaccuaagccacguuaa

SEQ ID NO: 1729309 - RNA, 16 nt, Homo sapiens
gggagccucuccuugc

SEQ ID NO: 1729310 - RNA, 19 nt, Homo sapiens
gggagccucuccuugccug

SEQ ID NO: 1729311 - RNA, 16 nt, Homo sapiens
gggccaggauucaggc

SEQ ID NO: 1729312 - RNA, 14 nt, Homo sapiens
gggcuuugccauua

SEQ ID NO: 1729313 - RNA, 15 nt, Homo sapiens
gguggaacaagcaca

SEQ ID NO: 1729314 - RNA, 17 nt, Homo sapiens
gguggagguugcaguga

SEQ ID NO: 1729315 - RNA, 20 nt, Homo sapiens
guacaaacacaggauuugua

SEQ ID NO: 1729316 - RNA, 14 nt, Homo sapiens
guagcugcuaccuu

SEQ ID NO: 1729317 - RNA, 13 nt, Homo sapiens
guaguuacucuca

SEQ ID NO: 1729318 - RNA, 17 nt, Homo sapiens
gucaccagcugccaaaa

SEQ ID NO: 1729319 - RNA, 14 nt, Homo sapiens
gucccuauucugcc

SEQ ID NO: 1729320 - RNA, 16 nt, Homo sapiens
gucccuauucugccau

SEQ ID NO: 1729321 - RNA, 20 nt, Homo sapiens
gucucucuaaacccaaauaa

SEQ ID NO: 1729322 - RNA, 15 nt, Homo sapiens
gucuggcaucuccca

SEQ ID NO: 1729323 - RNA, 18 nt, Homo sapiens
gugaauggcugugcccca

SEQ ID NO: 1729324 - RNA, 18 nt, Homo sapiens
gugagaccuuggcgcuac

SEQ ID NO: 1729325 - RNA, 13 nt, Homo sapiens
gugauauaugcau

SEQ ID NO: 1729326 - RNA, 15 nt, Homo sapiens
gugauauaugcaugu

SEQ ID NO: 1729327 - RNA, 19 nt, Homo sapiens
gugccagauccucuucuca

SEQ ID NO: 1729328 - RNA, 17 nt, Homo sapiens
guggcauucacaucuca

SEQ ID NO: 1729329 - RNA, 18 nt, Homo sapiens
gugguggagaaccacagc

SEQ ID NO: 1729330 - RNA, 11 nt, Homo sapiens
guuaaugccau

SEQ ID NO: 1729331 - RNA, 18 nt, Homo sapiens
guucuuucuuacacaaga

SEQ ID NO: 1729332 - RNA, 14 nt, Homo sapiens
guugaugccagaca

SEQ ID NO: 1729333 - RNA, 13 nt, Homo sapiens
guuggaacauccu

SEQ ID NO: 1729334 - RNA, 19 nt, Homo sapiens
guuggaugcggaacccaaa

SEQ ID NO: 1729335 - RNA, 22 nt, Homo sapiens
guuuauccacccacaacaucua

SEQ ID NO: 1729336 - RNA, 11 nt, Homo sapiens
uaaaacagcug

SEQ ID NO: 1729337 - RNA, 14 nt, Homo sapiens
uaaaacagcugcga

SEQ ID NO: 1729338 - RNA, 14 nt, Homo sapiens
uaaacaaauguaug

SEQ ID NO: 1729339 - RNA, 12 nt, Homo sapiens
uaaacauugccu

SEQ ID NO: 1729340 - RNA, 22 nt, Homo sapiens
uaaacccaaauaaauguguaaa

SEQ ID NO: 1729341 - RNA, 15 nt, Homo sapiens
uaaauuuaucaucuc

SEQ ID NO: 1729342 - RNA, 19 nt, Homo sapiens
uaagcccccuacugagaaa

SEQ ID NO: 1729343 - RNA, 19 nt, Homo sapiens
uaauauggggaugcagcau

SEQ ID NO: 1729344 - RNA, 23 nt, Homo sapiens
uacagcagaaaaucuuuuacuag

SEQ ID NO: 1729345 - RNA, 10 nt, Homo sapiens
uaccaaauau

SEQ ID NO: 1729346 - RNA, 17 nt, Homo sapiens
uacgacucuuuuccaaa

SEQ ID NO: 1729347 - RNA, 13 nt, Homo sapiens
uacucucaggcau

SEQ ID NO: 1729348 - RNA, 23 nt, Homo sapiens
uacucucaggcauggaugaauaa

SEQ ID NO: 1729349 - RNA, 16 nt, Homo sapiens
uagagcuuccacuguc

SEQ ID NO: 1729350 - RNA, 15 nt, Homo sapiens
uagcagucaaaucua

SEQ ID NO: 1729351 - RNA, 11 nt, Homo sapiens
uagcugcauuu

SEQ ID NO: 1729352 - RNA, 13 nt, Homo sapiens
uagcugcauuugu

SEQ ID NO: 1729353 - RNA, 14 nt, Homo sapiens
uagcugcuaccuuc

SEQ ID NO: 1729354 - RNA, 15 nt, Homo sapiens
uaggcuccagacagg

SEQ ID NO: 1729355 - RNA, 14 nt, Homo sapiens
uauacaaacaugug

SEQ ID NO: 1729356 - RNA, 20 nt, Homo sapiens
uauaggaaacauaauuuuga

SEQ ID NO: 1729357 - RNA, 15 nt, Homo sapiens
uauucagcacuaaaa

SEQ ID NO: 1729358 - RNA, 21 nt, Homo sapiens
uauuccacuggcgcaucauau

SEQ ID NO: 1729359 - RNA, 17 nt, Homo sapiens
uauucucuuaauuuuuc

SEQ ID NO: 1729360 - RNA, 13 nt, Homo sapiens
uauugugcauaga

SEQ ID NO: 1729361 - RNA, 15 nt, Homo sapiens
uauuuguuugugcau

SEQ ID NO: 1729362 - RNA, 20 nt, Homo sapiens
ucaaaaauacucacauggcu

SEQ ID NO: 1729363 - RNA, 19 nt, Homo sapiens
ucaaaaguaaugcuucaau

SEQ ID NO: 1729364 - RNA, 19 nt, Homo sapiens
ucaacuguuuuugucuaca

SEQ ID NO: 1729365 - RNA, 12 nt, Homo sapiens
ucaccuaagcaa

SEQ ID NO: 1729366 - RNA, 16 nt, Homo sapiens
ucacuugaacucggga

SEQ ID NO: 1729367 - RNA, 14 nt, Homo sapiens
ucagaaagugcagc

SEQ ID NO: 1729368 - RNA, 15 nt, Homo sapiens
ucaggcaacgcacaa

SEQ ID NO: 1729369 - RNA, 23 nt, Homo sapiens
ucagggaugcucauuccaugacu

SEQ ID NO: 1729370 - RNA, 13 nt, Homo sapiens
ucaguccuggaag

SEQ ID NO: 1729371 - RNA, 17 nt, Homo sapiens
ucagugaaaaauaauua

SEQ ID NO: 1729372 - RNA, 20 nt, Homo sapiens
ucaguggcauucacaucuca

SEQ ID NO: 1729373 - RNA, 20 nt, Homo sapiens
ucauaugaaaaaaaugcauu

SEQ ID NO: 1729374 - RNA, 19 nt, Homo sapiens
ucaugugccucuguccuua

SEQ ID NO: 1729375 - RNA, 14 nt, Homo sapiens
uccacuucucuaga

SEQ ID NO: 1729376 - RNA, 12 nt, Homo sapiens
uccagggccagg

SEQ ID NO: 1729377 - RNA, 22 nt, Homo sapiens
uccagguugccucaacagcagg

SEQ ID NO: 1729378 - RNA, 21 nt, Homo sapiens
ucccaacacggguaaaucuag

SEQ ID NO: 1729379 - RNA, 13 nt, Homo sapiens
ucccacacaagac

SEQ ID NO: 1729380 - RNA, 22 nt, Homo sapiens
uccccagacuucucuuucuuau

SEQ ID NO: 1729381 - RNA, 17 nt, Homo sapiens
ucccuggaggacucuag

SEQ ID NO: 1729382 - RNA, 24 nt, Homo sapiens
ucccuggcugaccugcuguggaug

SEQ ID NO: 1729383 - RNA, 17 nt, Homo sapiens
agcuguucucauuccug

SEQ ID NO: 1729384 - RNA, 14 nt, Homo sapiens
agcuuggaaacugg

SEQ ID NO: 1729385 - RNA, 22 nt, Homo sapiens
agcuuggaaacuggaugagguc

SEQ ID NO: 1729386 - RNA, 17 nt, Homo sapiens
aggaauuaaguuaggga

SEQ ID NO: 1729387 - RNA, 21 nt, Homo sapiens
aggaggagugggacagacagc

SEQ ID NO: 1729388 - RNA, 13 nt, Homo sapiens
aggaugacacugc

SEQ ID NO: 1729389 - RNA, 22 nt, Homo sapiens
aggaugccuuaucucuucucac

SEQ ID NO: 1729390 - RNA, 20 nt, Homo sapiens
aggcaugagaaucacuugaa

SEQ ID NO: 1729391 - RNA, 20 nt, Homo sapiens
aggccucuacuaggucugcu

SEQ ID NO: 1729392 - RNA, 22 nt, Homo sapiens
agggccagguccucacagcagu

SEQ ID NO: 1729393 - RNA, 14 nt, Homo sapiens
aggggcaguggccu

SEQ ID NO: 1729394 - RNA, 15 nt, Homo sapiens
aggggccaagcagug

SEQ ID NO: 1729395 - RNA, 17 nt, Homo sapiens
aggucauagcagugcuu

SEQ ID NO: 1729396 - RNA, 12 nt, Homo sapiens
agguucuugaua

SEQ ID NO: 1729397 - RNA, 19 nt, Homo sapiens
agguugccucaacagcagg

SEQ ID NO: 1729398 - RNA, 18 nt, Homo sapiens
aguacaaacacaggauuu

SEQ ID NO: 1729399 - RNA, 22 nt, Homo sapiens
agucgucuggcaucucccacac

SEQ ID NO: 1729400 - RNA, 16 nt, Homo sapiens
agugccaugggggcaa

SEQ ID NO: 1729401 - RNA, 17 nt, Homo sapiens
agugccaugggggcaac

SEQ ID NO: 1729402 - RNA, 19 nt, Homo sapiens
agugcugagaaggacaccu

SEQ ID NO: 1729403 - RNA, 15 nt, Homo sapiens
aguggcacucugugu

SEQ ID NO: 1729404 - RNA, 17 nt, Homo sapiens
aguuaggugugccaaac

SEQ ID NO: 1729405 - RNA, 14 nt, Homo sapiens
aguucagagcugcc

SEQ ID NO: 1729406 - RNA, 16 nt, Homo sapiens
aguuccuuucaauggu

SEQ ID NO: 1729407 - RNA, 20 nt, Homo sapiens
aguucuggugaauguucaau

SEQ ID NO: 1729408 - RNA, 20 nt, Homo sapiens
aguuguucucaggggugcug

SEQ ID NO: 1729409 - RNA, 21 nt, Homo sapiens
aguuguucucaggggugcugg

SEQ ID NO: 1729410 - RNA, 14 nt, Homo sapiens
aguuuaucauguca

SEQ ID NO: 1729411 - RNA, 16 nt, Homo sapiens
aguuuaucaugucagu

SEQ ID NO: 1729412 - RNA, 13 nt, Homo sapiens
aguuucaccaucu

SEQ ID NO: 1729413 - RNA, 19 nt, Homo sapiens
auaaagcuguucucauucc

SEQ ID NO: 1729414 - RNA, 18 nt, Homo sapiens
auaaauguguaaaugugg

SEQ ID NO: 1729415 - RNA, 18 nt, Homo sapiens
auaaauuuaucaucucga

SEQ ID NO: 1729416 - RNA, 22 nt, Homo sapiens
auacaaaccuuuagcugugaau

SEQ ID NO: 1729417 - RNA, 13 nt, Homo sapiens
auauaagccauag

SEQ ID NO: 1729418 - RNA, 18 nt, Homo sapiens
auauguauauacauauca

SEQ ID NO: 1729419 - RNA, 12 nt, Homo sapiens
auauuuacuacu

SEQ ID NO: 1729420 - RNA, 15 nt, Homo sapiens
aucaaugucaaguac

SEQ ID NO: 1729421 - RNA, 20 nt, Homo sapiens
aucaucucgaccacuuuuca

SEQ ID NO: 1729422 - RNA, 19 nt, Homo sapiens
aucauguuaccauuacaaa

SEQ ID NO: 1729423 - RNA, 18 nt, Homo sapiens
aucccuggcugaccugcu

SEQ ID NO: 1729424 - RNA, 15 nt, Homo sapiens
auccgggaucaaagu

SEQ ID NO: 1729425 - RNA, 14 nt, Homo sapiens
aucucccacacaag

SEQ ID NO: 1729426 - RNA, 16 nt, Homo sapiens
aucuguuuuucaugua

SEQ ID NO: 1729427 - RNA, 20 nt, Homo sapiens
augaauaaauguuauagcug

SEQ ID NO: 1729428 - RNA, 16 nt, Homo sapiens
augacaucaacauucc

SEQ ID NO: 1729429 - RNA, 22 nt, Homo sapiens
augaggucauagcagugcuuga

SEQ ID NO: 1729430 - RNA, 17 nt, Homo sapiens
augaguuuaucauguca

SEQ ID NO: 1729431 - RNA, 17 nt, Homo sapiens
augcucauuccaugacu

SEQ ID NO: 1729432 - RNA, 15 nt, Homo sapiens
augcuuuagguugcu

SEQ ID NO: 1729433 - RNA, 23 nt, Homo sapiens
auggaugaauaaauguuauagcu

SEQ ID NO: 1729434 - RNA, 17 nt, Homo sapiens
auggcacuguccagggc

SEQ ID NO: 1729435 - RNA, 17 nt, Homo sapiens
augggagaguccaggcc

SEQ ID NO: 1729436 - RNA, 16 nt, Homo sapiens
augggcucagggccag

SEQ ID NO: 1729437 - RNA, 17 nt, Homo sapiens
augggcucagggccagg

SEQ ID NO: 1729438 - RNA, 23 nt, Homo sapiens
augucaaguaccaaaauguuaau

SEQ ID NO: 1729439 - RNA, 14 nt, Homo sapiens
augucccacaggga

SEQ ID NO: 1729440 - RNA, 19 nt, Homo sapiens
augugggucaaggaauuaa

SEQ ID NO: 1729441 - RNA, 18 nt, Homo sapiens
auguucagggaugcucau

SEQ ID NO: 1729442 - RNA, 22 nt, Homo sapiens
auguuucugucacaucagcucc

SEQ ID NO: 1729443 - RNA, 17 nt, Homo sapiens
auguuuuagccagugau

SEQ ID NO: 1729444 - RNA, 20 nt, Homo sapiens
auuaauauggggaugcagca

SEQ ID NO: 1729445 - RNA, 13 nt, Homo sapiens
auucacaucucau

SEQ ID NO: 1729446 - RNA, 21 nt, Homo sapiens
auucucuugaaggugcugcca

SEQ ID NO: 1729447 - RNA, 22 nt, Homo sapiens
auugaauuaaaacagcugcgac

SEQ ID NO: 1729448 - RNA, 14 nt, Homo sapiens
auuggaagagcaca

SEQ ID NO: 1729449 - RNA, 16 nt, Homo sapiens
auuguucaucaugaca

SEQ ID NO: 1729450 - RNA, 14 nt, Homo sapiens
auuuaucaucucga

SEQ ID NO: 1729451 - RNA, 14 nt, Homo sapiens
auuugaaaugucau

SEQ ID NO: 1729452 - RNA, 17 nt, Homo sapiens
auuuuguaauaaacucu

SEQ ID NO: 1729453 - RNA, 21 nt, Homo sapiens
auuuuguaauaaacucucuag

SEQ ID NO: 1729454 - RNA, 24 nt, Homo sapiens
auuuuguaugaaaaaucaauguca

SEQ ID NO: 1729455 - RNA, 16 nt, Homo sapiens
auuuuuuuaaaacaca

SEQ ID NO: 1729456 - RNA, 18 nt, Homo sapiens
caaacacaggauuuguaa

SEQ ID NO: 1729457 - RNA, 23 nt, Homo sapiens
caaccuguucuuccuaccaaaua

SEQ ID NO: 1729458 - RNA, 14 nt, Homo sapiens
caagaaggggacag

SEQ ID NO: 1729459 - RNA, 19 nt, Homo sapiens
caagacccaaguagcugcu

SEQ ID NO: 1729460 - RNA, 16 nt, Homo sapiens
caagaccucugugcac

SEQ ID NO: 1729461 - RNA, 20 nt, Homo sapiens
caagagugagacuccgucuc

SEQ ID NO: 1729462 - RNA, 18 nt, Homo sapiens
caauaugggcucaaguca

SEQ ID NO: 1729463 - RNA, 19 nt, Homo sapiens
caauucuuacaaacaugug

SEQ ID NO: 1729464 - RNA, 14 nt, Homo sapiens
caauuucuaccuuu

SEQ ID NO: 1729465 - RNA, 22 nt, Homo sapiens
cacaagacccaaguagcugcua

SEQ ID NO: 1729466 - RNA, 20 nt, Homo sapiens
cacagaacacagcaauuccu

SEQ ID NO: 1729467 - RNA, 13 nt, Homo sapiens
cacagguguaaau

SEQ ID NO: 1729468 - RNA, 23 nt, Homo sapiens
cacaucccuggaaggacauccau

SEQ ID NO: 1729469 - RNA, 14 nt, Homo sapiens
caccagccaucaug

SEQ ID NO: 1729470 - RNA, 20 nt, Homo sapiens
cacccuguagguucuugaua

SEQ ID NO: 1729471 - RNA, 15 nt, Homo sapiens
caccucccugcaaua

SEQ ID NO: 1729472 - RNA, 14 nt, Homo sapiens
caccuuucccacuu

SEQ ID NO: 1729473 - RNA, 17 nt, Homo sapiens
cacggggcaaagcugcu

SEQ ID NO: 1729474 - RNA, 14 nt, Homo sapiens
cacucugaaacuga

SEQ ID NO: 1729475 - RNA, 17 nt, Homo sapiens
cacuguccagggcccau

SEQ ID NO: 1729476 - RNA, 18 nt, Homo sapiens
cacuucucuacucuggaa

SEQ ID NO: 1729477 - RNA, 13 nt, Homo sapiens
cagaacacugucu

SEQ ID NO: 1729478 - RNA, 23 nt, Homo sapiens
cagacauuuuccucacacccacc

SEQ ID NO: 1729479 - RNA, 23 nt, Homo sapiens
cagaggaggccggugaagugcau

SEQ ID NO: 1729480 - RNA, 17 nt, Homo sapiens
cagauggccgggacaug

SEQ ID NO: 1729481 - RNA, 19 nt, Homo sapiens
cagcacucugaaacugaga

SEQ ID NO: 1729482 - RNA, 16 nt, Homo sapiens
cagcagaaaaucuuuu

SEQ ID NO: 1729483 - RNA, 22 nt, Homo sapiens
cagcaggacgacuguuuuccca

SEQ ID NO: 1729484 - RNA, 13 nt, Homo sapiens
cagcgccaccucu

SEQ ID NO: 1729485 - RNA, 22 nt, Homo sapiens
cagcuaagcccccuacugagaa

SEQ ID NO: 1729486 - RNA, 13 nt, Homo sapiens
cagcucugaugag

SEQ ID NO: 1729487 - RNA, 20 nt, Homo sapiens
caggacacugcagaacagcu

SEQ ID NO: 1729488 - RNA, 13 nt, Homo sapiens
caggccucugagg

SEQ ID NO: 1729489 - RNA, 16 nt, Homo sapiens
cagggccagguccuca

SEQ ID NO: 1729490 - RNA, 23 nt, Homo sapiens
cagggcuacacagacccugccca

SEQ ID NO: 1729491 - RNA, 20 nt, Homo sapiens
cagguucccugccacacuau

SEQ ID NO: 1729492 - RNA, 23 nt, Homo sapiens
cagugauauaugccuauaauaua

SEQ ID NO: 1729493 - RNA, 16 nt, Homo sapiens
cagugcacuguauaua

SEQ ID NO: 1729494 - RNA, 16 nt, Homo sapiens
caguggcacucugugu

SEQ ID NO: 1729495 - RNA, 21 nt, Homo sapiens
caguucaguggcauucacauc

SEQ ID NO: 1729496 - RNA, 19 nt, Homo sapiens
caguucugccuuaucuaaa

SEQ ID NO: 1729497 - RNA, 15 nt, Homo sapiens
cauacacagaaacca

SEQ ID NO: 1729498 - RNA, 16 nt, Homo sapiens
cauauauauguauaua

SEQ ID NO: 1729499 - RNA, 23 nt, Homo sapiens
cauauuuuaggacagguaaaaua

SEQ ID NO: 1729500 - RNA, 21 nt, Homo sapiens
caucagguuccaguugcuuga

SEQ ID NO: 1729501 - RNA, 24 nt, Homo sapiens
cauccauguuccgagaagaacaga

SEQ ID NO: 1729502 - RNA, 15 nt, Homo sapiens
caucccuggaaggac

SEQ ID NO: 1729503 - RNA, 14 nt, Homo sapiens
caucucgaccacuu

SEQ ID NO: 1729504 - RNA, 18 nt, Homo sapiens
caucugccaaugccauga

SEQ ID NO: 1729505 - RNA, 16 nt, Homo sapiens
caugacugcucaggcc

SEQ ID NO: 1729506 - RNA, 14 nt, Homo sapiens
cauguucccaaaau

SEQ ID NO: 1729507 - RNA, 18 nt, Homo sapiens
cauguuuuguauguuaaa

SEQ ID NO: 1729508 - RNA, 19 nt, Homo sapiens
ggcugccaggcaccaucug

SEQ ID NO: 1729509 - RNA, 13 nt, Homo sapiens
gggacaccagcca

SEQ ID NO: 1729510 - RNA, 23 nt, Homo sapiens
gggcccagaggagaggagacaga

SEQ ID NO: 1729511 - RNA, 23 nt, Homo sapiens
gggccugccaaggaugacacugc

SEQ ID NO: 1729512 - RNA, 19 nt, Homo sapiens
gggcucagcagccagagga

SEQ ID NO: 1729513 - RNA, 22 nt, Homo sapiens
gggcuuggcugugcccucagau

SEQ ID NO: 1729514 - RNA, 16 nt, Homo sapiens
gggcuuuuacaccagu

SEQ ID NO: 1729515 - RNA, 14 nt, Homo sapiens
gggugccccacuaa

SEQ ID NO: 1729516 - RNA, 11 nt, Homo sapiens
gggugccugua

SEQ ID NO: 1729517 - RNA, 20 nt, Homo sapiens
ggucuuggccgacucaggga

SEQ ID NO: 1729518 - RNA, 17 nt, Homo sapiens
ggugcaugaagguuucu

SEQ ID NO: 1729519 - RNA, 14 nt, Homo sapiens
guagguucuugaua

SEQ ID NO: 1729520 - RNA, 15 nt, Homo sapiens
guauauagaagucua

SEQ ID NO: 1729521 - RNA, 17 nt, Homo sapiens
gucacuuuuauuugaaa

SEQ ID NO: 1729522 - RNA, 16 nt, Homo sapiens
gucagucccacugcac

SEQ ID NO: 1729523 - RNA, 17 nt, Homo sapiens
gucccagccagcaguuc

SEQ ID NO: 1729524 - RNA, 19 nt, Homo sapiens
guccucacagcagucacag

SEQ ID NO: 1729525 - RNA, 19 nt, Homo sapiens
gucuggcaucucccacaca

SEQ ID NO: 1729526 - RNA, 20 nt, Homo sapiens
gugaaagcaucacuugggau

SEQ ID NO: 1729527 - RNA, 15 nt, Homo sapiens
gugauaaugcagacu

SEQ ID NO: 1729528 - RNA, 11 nt, Homo sapiens
gugcauuuuau

SEQ ID NO: 1729529 - RNA, 22 nt, Homo sapiens
gugccuggaaauuaaacccugc

SEQ ID NO: 1729530 - RNA, 15 nt, Homo sapiens
gugcucggcuguaaa

SEQ ID NO: 1729531 - RNA, 22 nt, Homo sapiens
gugcucggcuguaaacagcucu

SEQ ID NO: 1729532 - RNA, 19 nt, Homo sapiens
gugcuggagcaaaagucau

SEQ ID NO: 1729533 - RNA, 13 nt, Homo sapiens
guggcacucugug

SEQ ID NO: 1729534 - RNA, 11 nt, Homo sapiens
gugugccaaac

SEQ ID NO: 1729535 - RNA, 15 nt, Homo sapiens
guguuucuggggaca

SEQ ID NO: 1729536 - RNA, 16 nt, Homo sapiens
guuaggugugccaaac

SEQ ID NO: 1729537 - RNA, 15 nt, Homo sapiens
guuauagcugcauuu

SEQ ID NO: 1729538 - RNA, 16 nt, Homo sapiens
guugaauuucccacau

SEQ ID NO: 1729539 - RNA, 23 nt, Homo sapiens
guugaauuucccacauacccucc

SEQ ID NO: 1729540 - RNA, 19 nt, Homo sapiens
guugugccaaagugcauag

SEQ ID NO: 1729541 - RNA, 14 nt, Homo sapiens
guuuacagacugug

SEQ ID NO: 1729542 - RNA, 18 nt, Homo sapiens
guuucuggggacaccagc

SEQ ID NO: 1729543 - RNA, 21 nt, Homo sapiens
guuucuggggacaccagccau

SEQ ID NO: 1729544 - RNA, 16 nt, Homo sapiens
uaaaacagcugcgaca

SEQ ID NO: 1729545 - RNA, 17 nt, Homo sapiens
uaacucaauauuuucca

SEQ ID NO: 1729546 - RNA, 19 nt, Homo sapiens
uaaguuagggaauggcaca

SEQ ID NO: 1729547 - RNA, 16 nt, Homo sapiens
uaauagugacauauau

SEQ ID NO: 1729548 - RNA, 21 nt, Homo sapiens
uaaucauguuaccauuacaaa

SEQ ID NO: 1729549 - RNA, 13 nt, Homo sapiens
uacagacugugag

SEQ ID NO: 1729550 - RNA, 15 nt, Homo sapiens
uacauggagcucagg

SEQ ID NO: 1729551 - RNA, 15 nt, Homo sapiens
uaccaaaauguuaau

SEQ ID NO: 1729552 - RNA, 22 nt, Homo sapiens
uaccaugucguaguuacucuca

SEQ ID NO: 1729553 - RNA, 12 nt, Homo sapiens
uacuaaagacag

SEQ ID NO: 1729554 - RNA, 20 nt, Homo sapiens
uacucucaggcauggaugaa

SEQ ID NO: 1729555 - RNA, 14 nt, Homo sapiens
uagaaaugagccag

SEQ ID NO: 1729556 - RNA, 21 nt, Homo sapiens
uagaaguugacaggcagugcc

SEQ ID NO: 1729557 - RNA, 22 nt, Homo sapiens
uagaugcuuuagguugcuucag

SEQ ID NO: 1729558 - RNA, 15 nt, Homo sapiens
uagcuuggaaacugg

SEQ ID NO: 1729559 - RNA, 12 nt, Homo sapiens
uagggcucagag

SEQ ID NO: 1729560 - RNA, 18 nt, Homo sapiens
uaguguguguguguauau

SEQ ID NO: 1729561 - RNA, 20 nt, Homo sapiens
uauacaaaccuuuagcugug

SEQ ID NO: 1729562 - RNA, 14 nt, Homo sapiens
uauauauguauaua

SEQ ID NO: 1729563 - RNA, 20 nt, Homo sapiens
uauauuugugugugugauau

SEQ ID NO: 1729564 - RNA, 16 nt, Homo sapiens
uaugaauagcugugua

SEQ ID NO: 1729565 - RNA, 23 nt, Homo sapiens
uaugaccucgcccuccacaaaug

SEQ ID NO: 1729566 - RNA, 15 nt, Homo sapiens
uauuaguuaggugug

SEQ ID NO: 1729567 - RNA, 21 nt, Homo sapiens
uauuugaacuuauuuacacau

SEQ ID NO: 1729568 - RNA, 20 nt, Homo sapiens
uauuuguaauagugacauau

SEQ ID NO: 1729569 - RNA, 13 nt, Homo sapiens
ucaaaaauacuca

SEQ ID NO: 1729570 - RNA, 16 nt, Homo sapiens
ucaaaaauacucacau

SEQ ID NO: 1729571 - RNA, 13 nt, Homo sapiens
ucaacgugcauuu

SEQ ID NO: 1729572 - RNA, 18 nt, Homo sapiens
ucacaaggcaacugugag

SEQ ID NO: 1729573 - RNA, 23 nt, Homo sapiens
ucacauccucagaaagugcagca

SEQ ID NO: 1729574 - RNA, 22 nt, Homo sapiens
ucacuuguagguuucucugccu

SEQ ID NO: 1729575 - RNA, 21 nt, Homo sapiens
ucagaugauucagaaauuuuc

SEQ ID NO: 1729576 - RNA, 16 nt, Homo sapiens
ucagcaggacgacugu

SEQ ID NO: 1729577 - RNA, 21 nt, Homo sapiens
ucagggaugcucauuccauga

SEQ ID NO: 1729578 - RNA, 13 nt, Homo sapiens
ucaggggugcugg

SEQ ID NO: 1729579 - RNA, 19 nt, Homo sapiens
ucaguggcauucacaucuc

SEQ ID NO: 1729580 - RNA, 20 nt, Homo sapiens
ucauucagguauuuguaaua

SEQ ID NO: 1729581 - RNA, 13 nt, Homo sapiens
ucauuccaugacu

SEQ ID NO: 1729582 - RNA, 20 nt, Homo sapiens
uccaggaugaguuacuugaa

SEQ ID NO: 1729583 - RNA, 19 nt, Homo sapiens
uccaggucuagaaggccag

SEQ ID NO: 1729584 - RNA, 16 nt, Homo sapiens
ucccuauucugccaug

SEQ ID NO: 1729585 - RNA, 21 nt, Homo sapiens
ucccuccaccucccugcaaua

SEQ ID NO: 1729586 - RNA, 13 nt, Homo sapiens
uccuaacccuggg

SEQ ID NO: 1729587 - RNA, 14 nt, Homo sapiens
uccucugcuugcca

SEQ ID NO: 1729588 - RNA, 16 nt, Homo sapiens
uccucuucucaaagcu

SEQ ID NO: 1729589 - RNA, 19 nt, Homo sapiens
uccugaaccaguccugcug

SEQ ID NO: 1729590 - RNA, 18 nt, Homo sapiens
uccuggaguacaaacaca

SEQ ID NO: 1729591 - RNA, 17 nt, Homo sapiens
uccugggcagcugccuc

SEQ ID NO: 1729592 - RNA, 22 nt, Homo sapiens
uccuucuggggcuuugccauua

SEQ ID NO: 1729593 - RNA, 19 nt, Homo sapiens
ucgaccacuuuucaguuca

SEQ ID NO: 1729594 - RNA, 16 nt, Homo sapiens
ucuaaaucaccagaga

SEQ ID NO: 1729595 - RNA, 15 nt, Homo sapiens
ucuagagaacaugcc

SEQ ID NO: 1729596 - RNA, 20 nt, Homo sapiens
ucucagaccugcgcacucca

SEQ ID NO: 1729597 - RNA, 11 nt, Homo sapiens
ucucucugugg

SEQ ID NO: 1729598 - RNA, 12 nt, Homo sapiens
ucugcuugccau

SEQ ID NO: 1729599 - RNA, 15 nt, Homo sapiens
ucuggggacaccagc

SEQ ID NO: 1729600 - RNA, 19 nt, Homo sapiens
ucuggugccagauccucuu

SEQ ID NO: 1729601 - RNA, 15 nt, Homo sapiens
ucuuaaaauguuaac

SEQ ID NO: 1729602 - RNA, 13 nt, Homo sapiens
ucuuacacaagag

SEQ ID NO: 1729603 - RNA, 21 nt, Homo sapiens
ucuucagaauauggacaaaga

SEQ ID NO: 1729604 - RNA, 20 nt, Homo sapiens
ucuuccuaccaaauauaaac

SEQ ID NO: 1729605 - RNA, 16 nt, Homo sapiens
ucuuguaaacauugcc

SEQ ID NO: 1729606 - RNA, 14 nt, Homo sapiens
ucuugucucugagg

SEQ ID NO: 1729607 - RNA, 22 nt, Homo sapiens
ucuuucuuacacaagagcugga

SEQ ID NO: 1729608 - RNA, 17 nt, Homo sapiens
ugaaaaaaaaaagacaa

SEQ ID NO: 1729609 - RNA, 16 nt, Homo sapiens
ugaaaauuaacacugc

SEQ ID NO: 1729610 - RNA, 13 nt, Homo sapiens
ugaaacagcugcc

SEQ ID NO: 1729611 - RNA, 23 nt, Homo sapiens
ugaaauaccaaccugaagacacc

SEQ ID NO: 1729612 - RNA, 15 nt, Homo sapiens
ugaacaccacuuugu

SEQ ID NO: 1729613 - RNA, 17 nt, Homo sapiens
ugaaguggccagaugag

SEQ ID NO: 1729614 - RNA, 17 nt, Homo sapiens
ugaauauaaacacuaua

SEQ ID NO: 1729615 - RNA, 22 nt, Homo sapiens
ugaauuaaaacagcugcgacaa

SEQ ID NO: 1729616 - RNA, 17 nt, Homo sapiens
ugacaaugcugccaugc

SEQ ID NO: 1729617 - RNA, 14 nt, Homo sapiens
ugacagaacacugu

SEQ ID NO: 1729618 - RNA, 15 nt, Homo sapiens
ugacagaacacuguc

SEQ ID NO: 1729619 - RNA, 12 nt, Homo sapiens
ugacaugugcuu

SEQ ID NO: 1729620 - RNA, 16 nt, Homo sapiens
ugacucgggccuuaga

SEQ ID NO: 1729621 - RNA, 17 nt, Homo sapiens
ugagaaacuuccuuuga

SEQ ID NO: 1729622 - RNA, 22 nt, Homo sapiens
ugagaacagacguuaccaauua

SEQ ID NO: 1729623 - RNA, 16 nt, Homo sapiens
ugagauaauacauucc

SEQ ID NO: 1729624 - RNA, 13 nt, Homo sapiens
ugaguaaaaucua

SEQ ID NO: 1729625 - RNA, 12 nt, Homo sapiens
ugaguuacuuga

SEQ ID NO: 1729626 - RNA, 16 nt, Homo sapiens
ugauaaugcagacuuc

SEQ ID NO: 1729627 - RNA, 22 nt, Homo sapiens
ugcaaggugaacaccacuuugu

SEQ ID NO: 1729628 - RNA, 15 nt, Homo sapiens
ugcaauaaaaugggu

SEQ ID NO: 1729629 - RNA, 19 nt, Homo sapiens
ugccaaggaugacacugcc

SEQ ID NO: 1729630 - RNA, 16 nt, Homo sapiens
ugccaaugccaugacu

SEQ ID NO: 1729631 - RNA, 14 nt, Homo sapiens
ugccagacaucacc

SEQ ID NO: 1729632 - RNA, 20 nt, Homo sapiens
ugccaggcaccaucugccaa

SEQ ID NO: 1729633 - RNA, 15 nt, Homo sapiens
ugcccucagauuccg

SEQ ID NO: 1729634 - RNA, 16 nt, Homo sapiens
ugccucaacagcagga

SEQ ID NO: 1729635 - RNA, 23 nt, Homo sapiens
ugccugauuuguuccuucugggg

SEQ ID NO: 1729636 - RNA, 17 nt, Homo sapiens
cugagcgagcacaccuu

SEQ ID NO: 1729637 - RNA, 18 nt, Homo sapiens
cugaggauaccccaaagu

SEQ ID NO: 1729638 - RNA, 20 nt, Homo sapiens
cugccaaugccaugacugcu

SEQ ID NO: 1729639 - RNA, 16 nt, Homo sapiens
cugccaggcaccaucu

SEQ ID NO: 1729640 - RNA, 17 nt, Homo sapiens
cugcccugcucccacag

SEQ ID NO: 1729641 - RNA, 14 nt, Homo sapiens
cugcucccacagaa

SEQ ID NO: 1729642 - RNA, 15 nt, Homo sapiens
cugcuggacaggggc

SEQ ID NO: 1729643 - RNA, 11 nt, Homo sapiens
cugcuugccau

SEQ ID NO: 1729644 - RNA, 17 nt, Homo sapiens
cuggagcaaaagucauu

SEQ ID NO: 1729645 - RNA, 15 nt, Homo sapiens
cuggcaagcugcaaa

SEQ ID NO: 1729646 - RNA, 22 nt, Homo sapiens
cuggucccagccagcaguucag

SEQ ID NO: 1729647 - RNA, 17 nt, Homo sapiens
cuguaugaauagcugug

SEQ ID NO: 1729648 - RNA, 14 nt, Homo sapiens
cugugcccucagau

SEQ ID NO: 1729649 - RNA, 13 nt, Homo sapiens
cuguguugucucu

SEQ ID NO: 1729650 - RNA, 19 nt, Homo sapiens
cuguucuuccuaccaaaua

SEQ ID NO: 1729651 - RNA, 18 nt, Homo sapiens
cuguugaauuucccacau

SEQ ID NO: 1729652 - RNA, 19 nt, Homo sapiens
cuguuuuugucuacacucu

SEQ ID NO: 1729653 - RNA, 14 nt, Homo sapiens
cuuaaaauguuaac

SEQ ID NO: 1729654 - RNA, 20 nt, Homo sapiens
cuucagaauauggacaaaga

SEQ ID NO: 1729655 - RNA, 14 nt, Homo sapiens
cuuccuaccaaaua

SEQ ID NO: 1729656 - RNA, 15 nt, Homo sapiens
cuuccuaccaaauau

SEQ ID NO: 1729657 - RNA, 19 nt, Homo sapiens
cuuccuggaguacaaacac

SEQ ID NO: 1729658 - RNA, 19 nt, Homo sapiens
cuugccaucccucccucca

SEQ ID NO: 1729659 - RNA, 19 nt, Homo sapiens
cuugccuggugaccuacua

SEQ ID NO: 1729660 - RNA, 21 nt, Homo sapiens
cuuggaaauuggaagagcaca

SEQ ID NO: 1729661 - RNA, 15 nt, Homo sapiens
cuuggcugugcccuc

SEQ ID NO: 1729662 - RNA, 15 nt, Homo sapiens
cuuucuuauuuugua

SEQ ID NO: 1729663 - RNA, 19 nt, Homo sapiens
cuuucuuauuuuguaauaa

SEQ ID NO: 1729664 - RNA, 16 nt, Homo sapiens
cuuuggaaauacacag

SEQ ID NO: 1729665 - RNA, 14 nt, Homo sapiens
cuuuuacaccaguu

SEQ ID NO: 1729666 - RNA, 16 nt, Homo sapiens
cuuuucuugucucuga

SEQ ID NO: 1729667 - RNA, 23 nt, Homo sapiens
gaaaccagaaggauauuuacuac

SEQ ID NO: 1729668 - RNA, 18 nt, Homo sapiens
gaaacuggaugaggucau

SEQ ID NO: 1729669 - RNA, 18 nt, Homo sapiens
gaaagcaucacuugggau

SEQ ID NO: 1729670 - RNA, 14 nt, Homo sapiens
gaacacaaggucau

SEQ ID NO: 1729671 - RNA, 21 nt, Homo sapiens
gaacagcuucauguucccaaa

SEQ ID NO: 1729672 - RNA, 18 nt, Homo sapiens
gaaccucaaacuggguau

SEQ ID NO: 1729673 - RNA, 14 nt, Homo sapiens
gaacuuauuuacac

SEQ ID NO: 1729674 - RNA, 21 nt, Homo sapiens
gaacuuugcauagcagcugcu

SEQ ID NO: 1729675 - RNA, 22 nt, Homo sapiens
gaagcucagguucccugccaca

SEQ ID NO: 1729676 - RNA, 21 nt, Homo sapiens
gaaguugacaggcagugccau

SEQ ID NO: 1729677 - RNA, 17 nt, Homo sapiens
gaauauaaacacuauau

SEQ ID NO: 1729678 - RNA, 19 nt, Homo sapiens
gaaugcugacaaugcugcc

SEQ ID NO: 1729679 - RNA, 19 nt, Homo sapiens
gaauggggugcaugaaggu

SEQ ID NO: 1729680 - RNA, 16 nt, Homo sapiens
gaauuaaaacagcugc

SEQ ID NO: 1729681 - RNA, 20 nt, Homo sapiens
gaauuaaaacagcugcgaca

SEQ ID NO: 1729682 - RNA, 23 nt, Homo sapiens
gacaaugcugccaugcccaccau

SEQ ID NO: 1729683 - RNA, 20 nt, Homo sapiens
gacaauggcuuacuccagga

SEQ ID NO: 1729684 - RNA, 12 nt, Homo sapiens
gacacacacugg

SEQ ID NO: 1729685 - RNA, 14 nt, Homo sapiens
gacacacacuggcu

SEQ ID NO: 1729686 - RNA, 13 nt, Homo sapiens
gacagaacacugu

SEQ ID NO: 1729687 - RNA, 19 nt, Homo sapiens
gacuaauccaauaccucuu

SEQ ID NO: 1729688 - RNA, 16 nt, Homo sapiens
gacucagggaccuaag

SEQ ID NO: 1729689 - RNA, 15 nt, Homo sapiens
gacucuccacugacc

SEQ ID NO: 1729690 - RNA, 16 nt, Homo sapiens
gacucugccuaaccau

SEQ ID NO: 1729691 - RNA, 12 nt, Homo sapiens
gacugcucaggc

SEQ ID NO: 1729692 - RNA, 16 nt, Homo sapiens
gacugguaaguaacug

SEQ ID NO: 1729693 - RNA, 13 nt, Homo sapiens
gacuguuuuccca

SEQ ID NO: 1729694 - RNA, 13 nt, Homo sapiens
gagaaacuuccuu

SEQ ID NO: 1729695 - RNA, 22 nt, Homo sapiens
gagauugcgccacugcacucca

SEQ ID NO: 1729696 - RNA, 21 nt, Homo sapiens
gagcccgcucugcacagggau

SEQ ID NO: 1729697 - RNA, 15 nt, Homo sapiens
gagccucuccuugcc

SEQ ID NO: 1729698 - RNA, 23 nt, Homo sapiens
gaggcagcgugaaagcagaugag

SEQ ID NO: 1729699 - RNA, 19 nt, Homo sapiens
gagugagacuccgucucaa

SEQ ID NO: 1729700 - RNA, 15 nt, Homo sapiens
gaguuguucucaggg

SEQ ID NO: 1729701 - RNA, 20 nt, Homo sapiens
gauaccccaaaguccaggcu

SEQ ID NO: 1729702 - RNA, 14 nt, Homo sapiens
gauggagaggcaug

SEQ ID NO: 1729703 - RNA, 21 nt, Homo sapiens
gaugucccuauucugccaugg

SEQ ID NO: 1729704 - RNA, 15 nt, Homo sapiens
gauguuucugucaca

SEQ ID NO: 1729705 - RNA, 23 nt, Homo sapiens
gauucaggccucugaggagccca

SEQ ID NO: 1729706 - RNA, 23 nt, Homo sapiens
gauuccgcaccaauaaagccuuc

SEQ ID NO: 1729707 - RNA, 18 nt, Homo sapiens
gauugaauuaaaacagcu

SEQ ID NO: 1729708 - RNA, 19 nt, Homo sapiens
gauugaauuaaaacagcug

SEQ ID NO: 1729709 - RNA, 19 nt, Homo sapiens
gcaaauccgaaaucagcag

SEQ ID NO: 1729710 - RNA, 19 nt, Homo sapiens
gcaauuagauuaguauuuu

SEQ ID NO: 1729711 - RNA, 18 nt, Homo sapiens
gcacagcaguuucaccau

SEQ ID NO: 1729712 - RNA, 16 nt, Homo sapiens
gcacagucugaugaca

SEQ ID NO: 1729713 - RNA, 12 nt, Homo sapiens
gcaccaucugcc

SEQ ID NO: 1729714 - RNA, 18 nt, Homo sapiens
gcacuguccagggcccau

SEQ ID NO: 1729715 - RNA, 18 nt, Homo sapiens
gcagcugcuacuagcucu

SEQ ID NO: 1729716 - RNA, 18 nt, Homo sapiens
gcaggacacugcagaaca

SEQ ID NO: 1729717 - RNA, 14 nt, Homo sapiens
gcauccugcagugg

SEQ ID NO: 1729718 - RNA, 17 nt, Homo sapiens
gcaucucccacacaaga

SEQ ID NO: 1729719 - RNA, 13 nt, Homo sapiens
cacaagagcugga

SEQ ID NO: 1729720 - RNA, 16 nt, Homo sapiens
cacacaucuguggaga

SEQ ID NO: 1729721 - RNA, 21 nt, Homo sapiens
cacaggauuuguaauuccuua

SEQ ID NO: 1729722 - RNA, 16 nt, Homo sapiens
caccaauaaagccuuc

SEQ ID NO: 1729723 - RNA, 15 nt, Homo sapiens
caccacuuugucucu

SEQ ID NO: 1729724 - RNA, 20 nt, Homo sapiens
caccacuuugucucugagaa

SEQ ID NO: 1729725 - RNA, 13 nt, Homo sapiens
caccaucugccaa

SEQ ID NO: 1729726 - RNA, 21 nt, Homo sapiens
caccauuuuguuuagacaauu

SEQ ID NO: 1729727 - RNA, 13 nt, Homo sapiens
cacccaccugcug

SEQ ID NO: 1729728 - RNA, 13 nt, Homo sapiens
caccccaacaucu

SEQ ID NO: 1729729 - RNA, 22 nt, Homo sapiens
caccccaucccuggcugaccug

SEQ ID NO: 1729730 - RNA, 16 nt, Homo sapiens
caccucccugcaauaa

SEQ ID NO: 1729731 - RNA, 19 nt, Homo sapiens
cacugagaagauggcacug

SEQ ID NO: 1729732 - RNA, 17 nt, Homo sapiens
cacugccagucacgagc

SEQ ID NO: 1729733 - RNA, 17 nt, Homo sapiens
cacuucucuacucugga

SEQ ID NO: 1729734 - RNA, 22 nt, Homo sapiens
cagaaaaaaauaaaaacauaaa

SEQ ID NO: 1729735 - RNA, 21 nt, Homo sapiens
cagaacacagcaauuccucag

SEQ ID NO: 1729736 - RNA, 21 nt, Homo sapiens
cagaaggauauuuacuacuuu

SEQ ID NO: 1729737 - RNA, 15 nt, Homo sapiens
cagaauguacggaaa

SEQ ID NO: 1729738 - RNA, 15 nt, Homo sapiens
cagacagauugcuga

SEQ ID NO: 1729739 - RNA, 17 nt, Homo sapiens
cagacagcagcuggacu

SEQ ID NO: 1729740 - RNA, 11 nt, Homo sapiens
cagagcucagg

SEQ ID NO: 1729741 - RNA, 23 nt, Homo sapiens
cagaguggagcccagggugcugg

SEQ ID NO: 1729742 - RNA, 18 nt, Homo sapiens
cagauuccgcaccaauaa

SEQ ID NO: 1729743 - RNA, 23 nt, Homo sapiens
cagcaaggccagaugcacauccc

SEQ ID NO: 1729744 - RNA, 19 nt, Homo sapiens
cagccaucaugugccugga

SEQ ID NO: 1729745 - RNA, 15 nt, Homo sapiens
cagccccacugcccu

SEQ ID NO: 1729746 - RNA, 22 nt, Homo sapiens
cagccccacugcccuccagggc

SEQ ID NO: 1729747 - RNA, 16 nt, Homo sapiens
cagccccgcccgccug

SEQ ID NO: 1729748 - RNA, 23 nt, Homo sapiens
cagcuauuuucaacauaacugaa

SEQ ID NO: 1729749 - RNA, 19 nt, Homo sapiens
caggaugaguuacuugaaa

SEQ ID NO: 1729750 - RNA, 15 nt, Homo sapiens
caggcaacgcacaaa

SEQ ID NO: 1729751 - RNA, 12 nt, Homo sapiens
cagggaugcuca

SEQ ID NO: 1729752 - RNA, 20 nt, Homo sapiens
cagguagaacacaaggucau

SEQ ID NO: 1729753 - RNA, 14 nt, Homo sapiens
caggugagcaauua

SEQ ID NO: 1729754 - RNA, 23 nt, Homo sapiens
cagucaccuaagcaaucacuggg

SEQ ID NO: 1729755 - RNA, 20 nt, Homo sapiens
cagugagcugagauugcgcc

SEQ ID NO: 1729756 - RNA, 20 nt, Homo sapiens
caguggcauucacaucucau

SEQ ID NO: 1729757 - RNA, 23 nt, Homo sapiens
caguggcauucacaucucaugua

SEQ ID NO: 1729758 - RNA, 18 nt, Homo sapiens
caguggccuggaugcaca

SEQ ID NO: 1729759 - RNA, 17 nt, Homo sapiens
cagugucuuuccaccuu

SEQ ID NO: 1729760 - RNA, 14 nt, Homo sapiens
caguuucaccaucu

SEQ ID NO: 1729761 - RNA, 19 nt, Homo sapiens
cauaaauuuaucaucucga

SEQ ID NO: 1729762 - RNA, 17 nt, Homo sapiens
cauaacugaaggcauau

SEQ ID NO: 1729763 - RNA, 16 nt, Homo sapiens
cauaugcagugauaua

SEQ ID NO: 1729764 - RNA, 20 nt, Homo sapiens
caucccuggcugaccugcug

SEQ ID NO: 1729765 - RNA, 16 nt, Homo sapiens
caucucccucccacau

SEQ ID NO: 1729766 - RNA, 14 nt, Homo sapiens
caucucucuuuaau

SEQ ID NO: 1729767 - RNA, 14 nt, Homo sapiens
caugcccaccaucg

SEQ ID NO: 1729768 - RNA, 14 nt, Homo sapiens
caugggcucagggc

SEQ ID NO: 1729769 - RNA, 16 nt, Homo sapiens
caugggggcccaaagg

SEQ ID NO: 1729770 - RNA, 22 nt, Homo sapiens
cauguuuuguauguuaaauuca

SEQ ID NO: 1729771 - RNA, 14 nt, Homo sapiens
cauucacaucucau

SEQ ID NO: 1729772 - RNA, 12 nt, Homo sapiens
cauuccaugacu

SEQ ID NO: 1729773 - RNA, 23 nt, Homo sapiens
cauucucuugaaggugcugccac

SEQ ID NO: 1729774 - RNA, 15 nt, Homo sapiens
cauuuuauaaauuca

SEQ ID NO: 1729775 - RNA, 17 nt, Homo sapiens
ccaaaaucguagguguu

SEQ ID NO: 1729776 - RNA, 16 nt, Homo sapiens
ccaaauaaauguguaa

SEQ ID NO: 1729777 - RNA, 21 nt, Homo sapiens
ccaaggaugacacugccaguc

SEQ ID NO: 1729778 - RNA, 13 nt, Homo sapiens
ccacaaaugccac

SEQ ID NO: 1729779 - RNA, 16 nt, Homo sapiens
ccaccucccugcaaua

SEQ ID NO: 1729780 - RNA, 21 nt, Homo sapiens
ccacugaccugguuguccagg

SEQ ID NO: 1729781 - RNA, 22 nt, Homo sapiens
ccacuuccugccccaacugcag

SEQ ID NO: 1729782 - RNA, 23 nt, Homo sapiens
ccagacuucucuuucuuauuuug

SEQ ID NO: 1729783 - RNA, 20 nt, Homo sapiens
ccagauguuuacagacugug

SEQ ID NO: 1729784 - RNA, 14 nt, Homo sapiens
ccagccagcaguuc

SEQ ID NO: 1729785 - RNA, 19 nt, Homo sapiens
ccaggaugaguuacuugaa

SEQ ID NO: 1729786 - RNA, 22 nt, Homo sapiens
ccagucacgagcccgcucugca

SEQ ID NO: 1729787 - RNA, 10 nt, Homo sapiens
ccaucccucc

SEQ ID NO: 1729788 - RNA, 18 nt, Homo sapiens
ccaucugccaaugccaug

SEQ ID NO: 1729789 - RNA, 15 nt, Homo sapiens
ccaugaaaaugcaac

SEQ ID NO: 1729790 - RNA, 23 nt, Homo sapiens
ccaugaaaaugcaacaacaugua

SEQ ID NO: 1729791 - RNA, 18 nt, Homo sapiens
ccaugggggcaacagcca

SEQ ID NO: 1729792 - RNA, 16 nt, Homo sapiens
cccaaguagcugcuac

SEQ ID NO: 1729793 - RNA, 20 nt, Homo sapiens
cccaaguagcugcuaccuuc

SEQ ID NO: 1729794 - RNA, 19 nt, Homo sapiens
cccacuucucuacucugga

SEQ ID NO: 1729795 - RNA, 15 nt, Homo sapiens
cccacuugccuguca

SEQ ID NO: 1729796 - RNA, 17 nt, Homo sapiens
cccacuuucuucuacca

SEQ ID NO: 1729797 - RNA, 23 nt, Homo sapiens
cccagccccuguggagggggugc

SEQ ID NO: 1729798 - RNA, 20 nt, Homo sapiens
cccagcccuccccaccugcu

SEQ ID NO: 1729799 - RNA, 16 nt, Homo sapiens
cccaggauuugacucg

SEQ ID NO: 1729800 - RNA, 12 nt, Homo sapiens
cccuauucugcc

SEQ ID NO: 1729801 - RNA, 14 nt, Homo sapiens
cccuauucugccau

SEQ ID NO: 1729802 - RNA, 13 nt, Homo sapiens
cccucagauuccg

SEQ ID NO: 1729803 - RNA, 16 nt, Homo sapiens
cccugccccacuucuc

SEQ ID NO: 1729804 - RNA, 12 nt, Homo sapiens
ccgagaagaaca

SEQ ID NO: 1729805 - RNA, 17 nt, Homo sapiens
ccucacacccaccugcu

SEQ ID NO: 1729806 - RNA, 11 nt, Homo sapiens
acuuguagguu

SEQ ID NO: 1729807 - RNA, 18 nt, Homo sapiens
acuuuucaguucaguggc

SEQ ID NO: 1729808 - RNA, 12 nt, Homo sapiens
agaaacuuccuu

SEQ ID NO: 1729809 - RNA, 17 nt, Homo sapiens
agaaacuuccuuugaga

SEQ ID NO: 1729810 - RNA, 21 nt, Homo sapiens
agaaaugcuuuccaaaaccgc

SEQ ID NO: 1729811 - RNA, 22 nt, Homo sapiens
agaacuuugcauagcagcugcu

SEQ ID NO: 1729812 - RNA, 21 nt, Homo sapiens
agaagacucuccacugaccug

SEQ ID NO: 1729813 - RNA, 21 nt, Homo sapiens
agaagauggcacuguccaggg

SEQ ID NO: 1729814 - RNA, 13 nt, Homo sapiens
agaagcucagguu

SEQ ID NO: 1729815 - RNA, 16 nt, Homo sapiens
agaaggcacaggugua

SEQ ID NO: 1729816 - RNA, 12 nt, Homo sapiens
agaaggggacag

SEQ ID NO: 1729817 - RNA, 22 nt, Homo sapiens
agaaggggacagcgccaccucu

SEQ ID NO: 1729818 - RNA, 18 nt, Homo sapiens
agaaguugacaggcagug

SEQ ID NO: 1729819 - RNA, 21 nt, Homo sapiens
agacaauggcuuacuccagga

SEQ ID NO: 1729820 - RNA, 15 nt, Homo sapiens
agaccuuggcgcuac

SEQ ID NO: 1729821 - RNA, 16 nt, Homo sapiens
agagccagggcugaug

SEQ ID NO: 1729822 - RNA, 17 nt, Homo sapiens
agaguccaggccugggu

SEQ ID NO: 1729823 - RNA, 22 nt, Homo sapiens
agaguuguucucaggggugcug

SEQ ID NO: 1729824 - RNA, 13 nt, Homo sapiens
agauaaagaccuu

SEQ ID NO: 1729825 - RNA, 19 nt, Homo sapiens
agaugcccaggauuugacu

SEQ ID NO: 1729826 - RNA, 15 nt, Homo sapiens
agauggccgggacau

SEQ ID NO: 1729827 - RNA, 20 nt, Homo sapiens
agaugucccacagggaccac

SEQ ID NO: 1729828 - RNA, 23 nt, Homo sapiens
agauuaguauuuuccacgucacu

SEQ ID NO: 1729829 - RNA, 17 nt, Homo sapiens
agauugcgccacugcac

SEQ ID NO: 1729830 - RNA, 24 nt, Homo sapiens
agauugcgccacugcacuccaguc

SEQ ID NO: 1729831 - RNA, 17 nt, Homo sapiens
agcaaaagucauuacac

SEQ ID NO: 1729832 - RNA, 12 nt, Homo sapiens
agcagcugcuac

SEQ ID NO: 1729833 - RNA, 21 nt, Homo sapiens
agcaggacgacuguuuuccca

SEQ ID NO: 1729834 - RNA, 21 nt, Homo sapiens
agcaucacuugggauuaauau

SEQ ID NO: 1729835 - RNA, 22 nt, Homo sapiens
agccagcaguucagagcugccc

SEQ ID NO: 1729836 - RNA, 14 nt, Homo sapiens
agcccagggugcug

SEQ ID NO: 1729837 - RNA, 15 nt, Homo sapiens
agcccagggugcugg

SEQ ID NO: 1729838 - RNA, 19 nt, Homo sapiens
agcccgugcccuaccacac

SEQ ID NO: 1729839 - RNA, 17 nt, Homo sapiens
agcccuccccaccugcu

SEQ ID NO: 1729840 - RNA, 21 nt, Homo sapiens
agcccuccccaccugcucacc

SEQ ID NO: 1729841 - RNA, 21 nt, Homo sapiens
agccucuccuugccuggugac

SEQ ID NO: 1729842 - RNA, 16 nt, Homo sapiens
agccugagccaaagag

SEQ ID NO: 1729843 - RNA, 18 nt, Homo sapiens
agcuccacuuucagugaa

SEQ ID NO: 1729844 - RNA, 21 nt, Homo sapiens
agcugagauugcgccacugca

SEQ ID NO: 1729845 - RNA, 19 nt, Homo sapiens
agcugcauuugucuggccu

SEQ ID NO: 1729846 - RNA, 17 nt, Homo sapiens
agcugcuacuagcucuu

SEQ ID NO: 1729847 - RNA, 16 nt, Homo sapiens
agcuggugguaucuga

SEQ ID NO: 1729848 - RNA, 20 nt, Homo sapiens
agcuggugguaucugaguug

SEQ ID NO: 1729849 - RNA, 17 nt, Homo sapiens
agcuguuccacuucucu

SEQ ID NO: 1729850 - RNA, 17 nt, Homo sapiens
aggaaaagauuccuguc

SEQ ID NO: 1729851 - RNA, 14 nt, Homo sapiens
aggaagcuccaguu

SEQ ID NO: 1729852 - RNA, 16 nt, Homo sapiens
aggaaggaugccuuau

SEQ ID NO: 1729853 - RNA, 18 nt, Homo sapiens
aggagacccacagguaug

SEQ ID NO: 1729854 - RNA, 17 nt, Homo sapiens
aggaugaguuacuugaa

SEQ ID NO: 1729855 - RNA, 14 nt, Homo sapiens
aggcaacugugagu

SEQ ID NO: 1729856 - RNA, 16 nt, Homo sapiens
aggcaccaucugccaa

SEQ ID NO: 1729857 - RNA, 21 nt, Homo sapiens
aggccauugggauauucugaa

SEQ ID NO: 1729858 - RNA, 15 nt, Homo sapiens
aggcugaaagacagg

SEQ ID NO: 1729859 - RNA, 19 nt, Homo sapiens
aggcugccaggcaccaucu

SEQ ID NO: 1729860 - RNA, 23 nt, Homo sapiens
aggcugccaggcaccaucugcca

SEQ ID NO: 1729861 - RNA, 16 nt, Homo sapiens
agggccagguccucac

SEQ ID NO: 1729862 - RNA, 23 nt, Homo sapiens
agggcuacacagacccugcccac

SEQ ID NO: 1729863 - RNA, 13 nt, Homo sapiens
aggucugcuccug

SEQ ID NO: 1729864 - RNA, 18 nt, Homo sapiens
agguggaacaagcacaga

SEQ ID NO: 1729865 - RNA, 13 nt, Homo sapiens
aggugugccaaac

SEQ ID NO: 1729866 - RNA, 12 nt, Homo sapiens
aguagcugcuac

SEQ ID NO: 1729867 - RNA, 17 nt, Homo sapiens
aguagcugcuaccuucu

SEQ ID NO: 1729868 - RNA, 15 nt, Homo sapiens
aguaggcuccagaca

SEQ ID NO: 1729869 - RNA, 12 nt, Homo sapiens
aguauugugcau

SEQ ID NO: 1729870 - RNA, 17 nt, Homo sapiens
aguauuuggggucauau

SEQ ID NO: 1729871 - RNA, 12 nt, Homo sapiens
aguccauuuuaa

SEQ ID NO: 1729872 - RNA, 13 nt, Homo sapiens
agucuaaaacaca

SEQ ID NO: 1729873 - RNA, 15 nt, Homo sapiens
agucugaguaaaauc

SEQ ID NO: 1729874 - RNA, 14 nt, Homo sapiens
agucugaugacaca

SEQ ID NO: 1729875 - RNA, 20 nt, Homo sapiens
aguggagcccagggugcugg

SEQ ID NO: 1729876 - RNA, 12 nt, Homo sapiens
aguuacuugaaa

SEQ ID NO: 1729877 - RNA, 11 nt, Homo sapiens
aguuaggugug

SEQ ID NO: 1729878 - RNA, 14 nt, Homo sapiens
auaaauguguaaau

SEQ ID NO: 1729879 - RNA, 19 nt, Homo sapiens
auaaauguuauagcugcau

SEQ ID NO: 1729880 - RNA, 20 nt, Homo sapiens
auaaauguuauagcugcauu

SEQ ID NO: 1729881 - RNA, 20 nt, Homo sapiens
auagagcuuucaaguacaug

SEQ ID NO: 1729882 - RNA, 15 nt, Homo sapiens
auauaaacacuauau

SEQ ID NO: 1729883 - RNA, 15 nt, Homo sapiens
auauacaaacaugug

SEQ ID NO: 1729884 - RNA, 14 nt, Homo sapiens
auauguauauacau

SEQ ID NO: 1729885 - RNA, 18 nt, Homo sapiens
auauuuuguuuugugcag

SEQ ID NO: 1729886 - RNA, 22 nt, Homo sapiens
aucaacauucccccaacauuac

SEQ ID NO: 1729887 - RNA, 22 nt, Homo sapiens
aucaccguacgacucuuuucca

SEQ ID NO: 1729888 - RNA, 14 nt, Homo sapiens
auccaauaccucuu

SEQ ID NO: 1729889 - RNA, 15 nt, Homo sapiens
aucccuggaaggaca

SEQ ID NO: 1729890 - RNA, 24 nt, Homo sapiens
auccuuggaaauuggaagagcaca

SEQ ID NO: 1729891 - RNA, 20 nt, Homo sapiens
aucugaguugacuugacaga

SEQ ID NO: 1729892 - RNA, 17 nt, Homo sapiens
aucugccaaugccauga

SEQ ID NO: 1729893 - RNA, 16 nt, Homo sapiens
augaaaccagaaggau

SEQ ID NO: 1729894 - RNA, 12 nt, Homo sapiens
augagaaucacu

SEQ ID NO: 1729895 - RNA, 13 nt, Homo sapiens
augaucuuuucaa

SEQ ID NO: 1729896 - RNA, 17 nt, Homo sapiens
augauguaggggccaag

SEQ ID NO: 1729897 - RNA, 23 nt, Homo sapiens
aaaaugaagguggaacaagcaca

SEQ ID NO: 1729898 - RNA, 14 nt, Homo sapiens
aaacagcucugugu

SEQ ID NO: 1729899 - RNA, 22 nt, Homo sapiens
aaacauguggcaaccuguucuu

SEQ ID NO: 1729900 - RNA, 20 nt, Homo sapiens
aaacaugugguuaaugccau

SEQ ID NO: 1729901 - RNA, 14 nt, Homo sapiens
aaacauugccugau

SEQ ID NO: 1729902 - RNA, 12 nt, Homo sapiens
aaacccaaauaa

SEQ ID NO: 1729903 - RNA, 17 nt, Homo sapiens
aaaccuuuagcugugaa

SEQ ID NO: 1729904 - RNA, 23 nt, Homo sapiens
aaagaauuuuuuaagaacuguau

SEQ ID NO: 1729905 - RNA, 22 nt, Homo sapiens
aaagcuacaacaaauacuacag

SEQ ID NO: 1729906 - RNA, 15 nt, Homo sapiens
aaagcugcugggcca

SEQ ID NO: 1729907 - RNA, 17 nt, Homo sapiens
aaauaaagcuguucuca

SEQ ID NO: 1729908 - RNA, 19 nt, Homo sapiens
aaaucacaaggcaacugug

SEQ ID NO: 1729909 - RNA, 20 nt, Homo sapiens
aaaucuaggugauuguucau

SEQ ID NO: 1729910 - RNA, 17 nt, Homo sapiens
aaaugcaacaacaugua

SEQ ID NO: 1729911 - RNA, 23 nt, Homo sapiens
aaaugcaaggugaacaccacuuu

SEQ ID NO: 1729912 - RNA, 22 nt, Homo sapiens
aacaagcauuucccccagggaa

SEQ ID NO: 1729913 - RNA, 13 nt, Homo sapiens
aacagauaauccc

SEQ ID NO: 1729914 - RNA, 22 nt, Homo sapiens
auaccaaccugaagacaccguu

SEQ ID NO: 1729915 - RNA, 21 nt, Homo sapiens
auacccuccuuccaccaaguu

SEQ ID NO: 1729916 - RNA, 20 nt, Homo sapiens
auaguauucaggugagcaau

SEQ ID NO: 1729917 - RNA, 14 nt, Homo sapiens
auaguauugugcau

SEQ ID NO: 1729918 - RNA, 21 nt, Homo sapiens
auagugagaccuuggcgcuac

SEQ ID NO: 1729919 - RNA, 21 nt, Homo sapiens
auauauauguauauacauauc

SEQ ID NO: 1729920 - RNA, 14 nt, Homo sapiens
auaugcagugauau

SEQ ID NO: 1729921 - RNA, 15 nt, Homo sapiens
auaugcagugauaua

SEQ ID NO: 1729922 - RNA, 15 nt, Homo sapiens
auccaauaccucuug

SEQ ID NO: 1729923 - RNA, 19 nt, Homo sapiens
aucccuggcugaccugcug

SEQ ID NO: 1729924 - RNA, 23 nt, Homo sapiens
auccucaauucaauguggugaug

SEQ ID NO: 1729925 - RNA, 16 nt, Homo sapiens
aucucccacacaagac

SEQ ID NO: 1729926 - RNA, 23 nt, Homo sapiens
aucugugugcccuagggcucaga

SEQ ID NO: 1729927 - RNA, 20 nt, Homo sapiens
augaaaaaaaugcauuuuau

SEQ ID NO: 1729928 - RNA, 20 nt, Homo sapiens
augaaccugcccugcuccca

SEQ ID NO: 1729929 - RNA, 21 nt, Homo sapiens
augaagguggaacaagcacag

SEQ ID NO: 1729930 - RNA, 21 nt, Homo sapiens
augaagguuucugaaaauuaa

SEQ ID NO: 1729931 - RNA, 12 nt, Homo sapiens
augacugcucag

SEQ ID NO: 1729932 - RNA, 13 nt, Homo sapiens
agcugggggucaa

SEQ ID NO: 1729933 - RNA, 15 nt, Homo sapiens
aggaaaagauuccug

SEQ ID NO: 1729934 - RNA, 16 nt, Homo sapiens
aggaaaaucugaacuc

SEQ ID NO: 1729935 - RNA, 19 nt, Homo sapiens
aggaaccucaaacugggua

SEQ ID NO: 1729936 - RNA, 20 nt, Homo sapiens
aggacgacuguuuucccaac

SEQ ID NO: 1729937 - RNA, 22 nt, Homo sapiens
aggagacagacacacacuggcu

SEQ ID NO: 1729938 - RNA, 15 nt, Homo sapiens
aggagacccacaggu

SEQ ID NO: 1729939 - RNA, 14 nt, Homo sapiens
aggaggagugggac

SEQ ID NO: 1729940 - RNA, 21 nt, Homo sapiens
aggauaccccaaaguccaggc

SEQ ID NO: 1729941 - RNA, 21 nt, Homo sapiens
aggcaaauccgaaaucagcag

SEQ ID NO: 1729942 - RNA, 20 nt, Homo sapiens
agggaauggcacagcccaaa

SEQ ID NO: 1729943 - RNA, 15 nt, Homo sapiens
agggaugaccuggag

SEQ ID NO: 1729944 - RNA, 13 nt, Homo sapiens
aggggcaguggcc

SEQ ID NO: 1729945 - RNA, 18 nt, Homo sapiens
aggggccucaucuucccc

SEQ ID NO: 1729946 - RNA, 22 nt, Homo sapiens
aggugaggguggggugccccag

SEQ ID NO: 1729947 - RNA, 12 nt, Homo sapiens
aggugcugccac

SEQ ID NO: 1729948 - RNA, 16 nt, Homo sapiens
aggugugccaaacuac

SEQ ID NO: 1729949 - RNA, 15 nt, Homo sapiens
agguucacaccauuu

SEQ ID NO: 1729950 - RNA, 16 nt, Homo sapiens
aguacauggagcucag

SEQ ID NO: 1729951 - RNA, 20 nt, Homo sapiens
agucacgagcccgcucugca

SEQ ID NO: 1729952 - RNA, 14 nt, Homo sapiens
aguccauauuucaa

SEQ ID NO: 1729953 - RNA, 23 nt, Homo sapiens
agucccacugcaccccccugugc

SEQ ID NO: 1729954 - RNA, 11 nt, Homo sapiens
aguccuggaag

SEQ ID NO: 1729955 - RNA, 20 nt, Homo sapiens
agucgucuggcaucucccac

SEQ ID NO: 1729956 - RNA, 22 nt, Homo sapiens
agugacauauauauguauauac

SEQ ID NO: 1729957 - RNA, 22 nt, Homo sapiens
agugcugagaaggacaccuccu

SEQ ID NO: 1729958 - RNA, 21 nt, Homo sapiens
agugcuugauugcguggaauu

SEQ ID NO: 1729959 - RNA, 16 nt, Homo sapiens
aguggcauucacaucu

SEQ ID NO: 1729960 - RNA, 18 nt, Homo sapiens
aguggcauucacaucuca

SEQ ID NO: 1729961 - RNA, 20 nt, Homo sapiens
agugucaccagcugccaaaa

SEQ ID NO: 1729962 - RNA, 14 nt, Homo sapiens
aguuacucucaggc

SEQ ID NO: 1729963 - RNA, 17 nt, Homo sapiens
aguuacucucaggcaug

SEQ ID NO: 1729964 - RNA, 10 nt, Homo sapiens
aguucagugg

SEQ ID NO: 1729965 - RNA, 15 nt, Homo sapiens
aguugacuugacaga

SEQ ID NO: 1729966 - RNA, 18 nt, Homo sapiens
aguuuaauagauguuacu

SEQ ID NO: 1729967 - RNA, 13 nt, Homo sapiens
auaaaaacauaaa

SEQ ID NO: 1729968 - RNA, 21 nt, Homo sapiens
auaaaauauacaaacaugugg

SEQ ID NO: 1729969 - RNA, 14 nt, Homo sapiens
auaaacucucuagg

SEQ ID NO: 1729970 - RNA, 17 nt, Homo sapiens
auaaauguguaaaugug

SEQ ID NO: 1729971 - RNA, 23 nt, Homo sapiens
auaacauaaauuuaucaucucga

SEQ ID NO: 1729972 - RNA, 14 nt, Homo sapiens
auaauauaagccau

SEQ ID NO: 1729973 - RNA, 15 nt, Homo sapiens
auacacagugcugac

SEQ ID NO: 1729974 - RNA, 15 nt, Homo sapiens
auagagccacguaug

SEQ ID NO: 1729975 - RNA, 14 nt, Homo sapiens
auagcagcugcuac

SEQ ID NO: 1729976 - RNA, 22 nt, Homo sapiens
auagcagcugcuacuagcucuu

SEQ ID NO: 1729977 - RNA, 12 nt, Homo sapiens
auagcugcauuu

SEQ ID NO: 1729978 - RNA, 15 nt, Homo sapiens
auaguauugugcaua

SEQ ID NO: 1729979 - RNA, 22 nt, Homo sapiens
auaguauugugcauagagccac

SEQ ID NO: 1729980 - RNA, 16 nt, Homo sapiens
auauggcagugucuuu

SEQ ID NO: 1729981 - RNA, 16 nt, Homo sapiens
auaugggcucaaguca

SEQ ID NO: 1729982 - RNA, 20 nt, Homo sapiens
aucaccagagaccaaacaag

SEQ ID NO: 1729983 - RNA, 19 nt, Homo sapiens
aucacugagaagauggcac

SEQ ID NO: 1729984 - RNA, 13 nt, Homo sapiens
aucaugugccugg

SEQ ID NO: 1729985 - RNA, 13 nt, Homo sapiens
auccaauaccucu

SEQ ID NO: 1729986 - RNA, 17 nt, Homo sapiens
auccaggaaagaugucc

SEQ ID NO: 1729987 - RNA, 17 nt, Homo sapiens
auccaugaucacacagc

SEQ ID NO: 1729988 - RNA, 18 nt, Homo sapiens
auccuucaacucugugag

SEQ ID NO: 1729989 - RNA, 19 nt, Homo sapiens
aucugccaaugccaugacu

SEQ ID NO: 1729990 - RNA, 15 nt, Homo sapiens
aucuguguugucucu

SEQ ID NO: 1729991 - RNA, 23 nt, Homo sapiens
augaaccugcccugcucccacag

SEQ ID NO: 1729992 - RNA, 18 nt, Homo sapiens
augaagguggaacaagca

SEQ ID NO: 1729993 - RNA, 15 nt, Homo sapiens
augacaucaacauuc

SEQ ID NO: 1729994 - RNA, 14 nt, Homo sapiens
augaguuacuugaa

SEQ ID NO: 1729995 - RNA, 22 nt, Homo sapiens
augaguuacuugaaauuugccu

SEQ ID NO: 1729996 - RNA, 19 nt, Homo sapiens
augauucagaaauuuucau

SEQ ID NO: 1729997 - RNA, 18 nt, Homo sapiens
augcaacaacauguauaa

SEQ ID NO: 1729998 - RNA, 22 nt, Homo sapiens
auggcacagcccaaagaaggaa

SEQ ID NO: 1729999 - RNA, 13 nt, Homo sapiens
auggcauccugca

SEQ ID NO: 1730000 - RNA, 22 nt, Homo sapiens
auguaggggccaagcagugccc

SEQ ID NO: 1730001 - RNA, 19 nt, Homo sapiens
auguucagaauguacggaa

SEQ ID NO: 1730002 - RNA, 17 nt, Homo sapiens
auguuccgagaagaaca

SEQ ID NO: 1730003 - RNA, 19 nt, Homo sapiens
auuacuccauuacuaaaga

SEQ ID NO: 1730004 - RNA, 14 nt, Homo sapiens
auuccgcaccaaua

SEQ ID NO: 1730005 - RNA, 16 nt, Homo sapiens
auugcgccacugcacu

SEQ ID NO: 1730006 - RNA, 23 nt, Homo sapiens
auuugugugugugauauaugcau

SEQ ID NO: 1730007 - RNA, 14 nt, Homo sapiens
auuuguuugugcau

SEQ ID NO: 1730008 - RNA, 19 nt, Homo sapiens
auuuucaacauaacugaag

SEQ ID NO: 1730009 - RNA, 17 nt, Homo sapiens
caaaacagaaaaugaag

SEQ ID NO: 1730010 - RNA, 16 nt, Homo sapiens
caaaccuuuagcugug

SEQ ID NO: 1730011 - RNA, 22 nt, Homo sapiens
caaagaaggcacagguguaaau

SEQ ID NO: 1730012 - RNA, 11 nt, Homo sapiens
caaaguuggcg

SEQ ID NO: 1730013 - RNA, 17 nt, Homo sapiens
caaauaaauguguaaau

SEQ ID NO: 1730014 - RNA, 16 nt, Homo sapiens
caaaugcuaaaugcaa

SEQ ID NO: 1730015 - RNA, 12 nt, Homo sapiens
caacaacaugua

SEQ ID NO: 1730016 - RNA, 21 nt, Homo sapiens
caacauuacuccauuacuaaa

SEQ ID NO: 1730017 - RNA, 23 nt, Homo sapiens
caacauuacuccauuacuaaaga

SEQ ID NO: 1730018 - RNA, 18 nt, Homo sapiens
caagagugagacuccguc

SEQ ID NO: 1730019 - RNA, 16 nt, Homo sapiens
caagauuuucuacuuu

SEQ ID NO: 1730020 - RNA, 17 nt, Homo sapiens
caaggccagaugcacau

SEQ ID NO: 1730021 - RNA, 15 nt, Homo sapiens
caaguagcugcuacc

SEQ ID NO: 1730022 - RNA, 20 nt, Homo sapiens
caaguauuuuaucuguguug

SEQ ID NO: 1730023 - RNA, 13 nt, Homo sapiens
caauaaagccuuc

SEQ ID NO: 1730024 - RNA, 15 nt, Homo sapiens
caauaaagccuucaa

SEQ ID NO: 1730025 - RNA, 19 nt, Homo sapiens
caauaaagccuucaaacuc

SEQ ID NO: 1730026 - RNA, 12 nt, Homo sapiens
caaugcugccau

SEQ ID NO: 1730027 - RNA, 17 nt, Homo sapiens
caaugcugccaugccca

SEQ ID NO: 1730028 - RNA, 16 nt, Homo sapiens
caauggcuuacuccag

SEQ ID NO: 1730029 - RNA, 12 nt, Homo sapiens
cacaaaacagaa

SEQ ID NO: 1730030 - RNA, 14 nt, Homo sapiens
cacacccaccugcu

SEQ ID NO: 1730031 - RNA, 22 nt, Homo sapiens
cacaccuuauauuuacguauga

SEQ ID NO: 1730032 - RNA, 17 nt, Homo sapiens
cacagugcugaccagac

SEQ ID NO: 1730033 - RNA, 15 nt, Homo sapiens
caccagagaccaaac

SEQ ID NO: 1730034 - RNA, 15 nt, Homo sapiens
caccagcugccaaaa

SEQ ID NO: 1730035 - RNA, 16 nt, Homo sapiens
caccaguuccuuucaa

SEQ ID NO: 1730036 - RNA, 15 nt, Homo sapiens
caccaugaaacuuua

SEQ ID NO: 1730037 - RNA, 14 nt, Homo sapiens
cacccacaacaucu

SEQ ID NO: 1730038 - RNA, 19 nt, Homo sapiens
caccuaagcaaucacuggg

SEQ ID NO: 1730039 - RNA, 22 nt, Homo sapiens
caccuccuuccucaguccugga

SEQ ID NO: 1730040 - RNA, 18 nt, Homo sapiens
caccucuugucagugcuc

SEQ ID NO: 1730041 - RNA, 19 nt, Homo sapiens
cacugcccuccagggccag

SEQ ID NO: 1730042 - RNA, 13 nt, Homo sapiens
cacuguccagggc

SEQ ID NO: 1730043 - RNA, 21 nt, Homo sapiens
cacuucucuagagaacaugcc

SEQ ID NO: 1730044 - RNA, 14 nt, Homo sapiens
cagaaagugcagca

SEQ ID NO: 1730045 - RNA, 16 nt, Homo sapiens
cagaacacugucuuga

SEQ ID NO: 1730046 - RNA, 17 nt, Homo sapiens
cagaggaggccggugaa

SEQ ID NO: 1730047 - RNA, 14 nt, Homo sapiens
cagagggcagucua

SEQ ID NO: 1730048 - RNA, 20 nt, Homo sapiens
cagcacucugaaacugagaa

SEQ ID NO: 1730049 - RNA, 20 nt, Homo sapiens
cagccagaggaggccgguga

SEQ ID NO: 1730050 - RNA, 15 nt, Homo sapiens
cagccaucaugugcc

SEQ ID NO: 1730051 - RNA, 18 nt, Homo sapiens
cagcccuccccaccugcu

SEQ ID NO: 1730052 - RNA, 21 nt, Homo sapiens
cagcuaagcccccuacugaga

SEQ ID NO: 1730053 - RNA, 19 nt, Homo sapiens
cagcuauuuucaacauaac

SEQ ID NO: 1730054 - RNA, 20 nt, Homo sapiens
cagcucuguguuucugggga

SEQ ID NO: 1730055 - RNA, 23 nt, Homo sapiens
cagcugccaaaaucguagguguu

SEQ ID NO: 1730056 - RNA, 22 nt, Homo sapiens
caggaaagaugucccacaggga

SEQ ID NO: 1730057 - RNA, 18 nt, Homo sapiens
caggaugaguuacuugaa

SEQ ID NO: 1730058 - RNA, 13 nt, Homo sapiens
uccugggcagcug

SEQ ID NO: 1730059 - RNA, 16 nt, Homo sapiens
uccugggcagcugccu

SEQ ID NO: 1730060 - RNA, 15 nt, Homo sapiens
uccuuggaaauugga

SEQ ID NO: 1730061 - RNA, 17 nt, Homo sapiens
uccuuugguccuucaaa

SEQ ID NO: 1730062 - RNA, 16 nt, Homo sapiens
ucgucuggcaucuccc

SEQ ID NO: 1730063 - RNA, 16 nt, Homo sapiens
ucuaccuuuacuacau

SEQ ID NO: 1730064 - RNA, 22 nt, Homo sapiens
ucuagacugucucuguggaaua

SEQ ID NO: 1730065 - RNA, 14 nt, Homo sapiens
ucucaggggugcug

SEQ ID NO: 1730066 - RNA, 12 nt, Homo sapiens
ucucauuccugu

SEQ ID NO: 1730067 - RNA, 18 nt, Homo sapiens
ucugaaaauuaacacugc

SEQ ID NO: 1730068 - RNA, 19 nt, Homo sapiens
ucugaaaauuaacacugcu

SEQ ID NO: 1730069 - RNA, 15 nt, Homo sapiens
ucugaaugacaucaa

SEQ ID NO: 1730070 - RNA, 17 nt, Homo sapiens
ucuggugccagauccuc

SEQ ID NO: 1730071 - RNA, 14 nt, Homo sapiens
ucuuccuaccaaau

SEQ ID NO: 1730072 - RNA, 18 nt, Homo sapiens
ucuuggccgacucaggga

SEQ ID NO: 1730073 - RNA, 16 nt, Homo sapiens
ugaaaaaaaugcauuu

SEQ ID NO: 1730074 - RNA, 14 nt, Homo sapiens
ugaaagcagaugag

SEQ ID NO: 1730075 - RNA, 15 nt, Homo sapiens
ugaaccaguccugcu

SEQ ID NO: 1730076 - RNA, 22 nt, Homo sapiens
ugaauaaauguuauagcugcau

SEQ ID NO: 1730077 - RNA, 12 nt, Homo sapiens
ugaauguucaau

SEQ ID NO: 1730078 - RNA, 16 nt, Homo sapiens
ugaauuucccacauac

SEQ ID NO: 1730079 - RNA, 14 nt, Homo sapiens
ugacaugugcuuug

SEQ ID NO: 1730080 - RNA, 19 nt, Homo sapiens
ugacuugacagaacacugu

SEQ ID NO: 1730081 - RNA, 17 nt, Homo sapiens
ugagaagauggcacugu

SEQ ID NO: 1730082 - RNA, 20 nt, Homo sapiens
ugagaaggacaccuccuucc

SEQ ID NO: 1730083 - RNA, 18 nt, Homo sapiens
ugagaaucacuugaacuc

SEQ ID NO: 1730084 - RNA, 19 nt, Homo sapiens
ugaggguggggugccccag

SEQ ID NO: 1730085 - RNA, 15 nt, Homo sapiens
ugauaaagcaguauu

SEQ ID NO: 1730086 - RNA, 23 nt, Homo sapiens
ugauaauaaauuagguaagauaa

SEQ ID NO: 1730087 - RNA, 14 nt, Homo sapiens
ugauauaugcaugu

SEQ ID NO: 1730088 - RNA, 21 nt, Homo sapiens
ugcacuguauauagaagucua

SEQ ID NO: 1730089 - RNA, 16 nt, Homo sapiens
ugcagaguaggcagcu

SEQ ID NO: 1730090 - RNA, 19 nt, Homo sapiens
ugcauagagccacguaugu

SEQ ID NO: 1730091 - RNA, 14 nt, Homo sapiens
ugccagauccucuu

SEQ ID NO: 1730092 - RNA, 19 nt, Homo sapiens
ugccaggcaccaucugcca

SEQ ID NO: 1730093 - RNA, 12 nt, Homo sapiens
ugccccaacugc

SEQ ID NO: 1730094 - RNA, 14 nt, Homo sapiens
ugcccucagauucc

SEQ ID NO: 1730095 - RNA, 14 nt, Homo sapiens
ugccucuguccuua

SEQ ID NO: 1730096 - RNA, 19 nt, Homo sapiens
ugccuggaaauuaaacccu

SEQ ID NO: 1730097 - RNA, 19 nt, Homo sapiens
ugccuggagucaguagcca

SEQ ID NO: 1730098 - RNA, 21 nt, Homo sapiens
ugcgacuucacaaaaugcaag

SEQ ID NO: 1730099 - RNA, 23 nt, Homo sapiens
ugcucaccaagcuguuccacuuc

SEQ ID NO: 1730100 - RNA, 13 nt, Homo sapiens
ugcucccacagaa

SEQ ID NO: 1730101 - RNA, 15 nt, Homo sapiens
ugcugagaaggacac

SEQ ID NO: 1730102 - RNA, 17 nt, Homo sapiens
ugcuggagucaugugcc

SEQ ID NO: 1730103 - RNA, 19 nt, Homo sapiens
ugcuggagucaugugccuc

SEQ ID NO: 1730104 - RNA, 19 nt, Homo sapiens
ugcuugaauugcaaggcua

SEQ ID NO: 1730105 - RNA, 17 nt, Homo sapiens
uggaacaagcacagaug

SEQ ID NO: 1730106 - RNA, 16 nt, Homo sapiens
uggaagagcacaagag

SEQ ID NO: 1730107 - RNA, 13 nt, Homo sapiens
uggaauugugcug

SEQ ID NO: 1730108 - RNA, 21 nt, Homo sapiens
uggaugucccuauucugccau

SEQ ID NO: 1730109 - RNA, 14 nt, Homo sapiens
uggcaggacacugc

SEQ ID NO: 1730110 - RNA, 17 nt, Homo sapiens
uggcauucacaucucau

SEQ ID NO: 1730111 - RNA, 15 nt, Homo sapiens
uggccagcacucuga

SEQ ID NO: 1730112 - RNA, 15 nt, Homo sapiens
uggccgacucaggga

SEQ ID NO: 1730113 - RNA, 13 nt, Homo sapiens
ugggccaguggca

SEQ ID NO: 1730114 - RNA, 17 nt, Homo sapiens
ugguguggccagcacuc

SEQ ID NO: 1730115 - RNA, 20 nt, Homo sapiens
ugguguggccagcacucuga

SEQ ID NO: 1730116 - RNA, 17 nt, Homo sapiens
ugguguugacaugugcu

SEQ ID NO: 1730117 - RNA, 13 nt, Homo sapiens
ugguuguccaggu

SEQ ID NO: 1730118 - RNA, 15 nt, Homo sapiens
uguaauaaacucucu

SEQ ID NO: 1730119 - RNA, 19 nt, Homo sapiens
uguaauaaacucucuaggg

SEQ ID NO: 1730120 - RNA, 14 nt, Homo sapiens
ugugcccucagauu

SEQ ID NO: 1730121 - RNA, 12 nt, Homo sapiens
ugugccuggaaa

SEQ ID NO: 1730122 - RNA, 22 nt, Homo sapiens
uguggagaugcccaggauuuga

SEQ ID NO: 1730123 - RNA, 19 nt, Homo sapiens
ugugguuaaugccauggac

SEQ ID NO: 1730124 - RNA, 22 nt, Homo sapiens
uguguguuagcagucaaaucua

SEQ ID NO: 1730125 - RNA, 22 nt, Homo sapiens
uguucucaaaugcuaaaugcaa

SEQ ID NO: 1730126 - RNA, 12 nt, Homo sapiens
uguucucagggg

SEQ ID NO: 1730127 - RNA, 15 nt, Homo sapiens
uguuuacagacugug

SEQ ID NO: 1730128 - RNA, 22 nt, Homo sapiens
uguuucuggggacaccagccau

SEQ ID NO: 1730129 - RNA, 12 nt, Homo sapiens
uuaaaacagcug

SEQ ID NO: 1730130 - RNA, 17 nt, Homo sapiens
uuaaaacagcugcgaca

SEQ ID NO: 1730131 - RNA, 12 nt, Homo sapiens
uuacuaaagaca

SEQ ID NO: 1730132 - RNA, 21 nt, Homo sapiens
uuacucucaggcauggaugaa

SEQ ID NO: 1730133 - RNA, 18 nt, Homo sapiens
uuaggugugccaaacuac

SEQ ID NO: 1730134 - RNA, 17 nt, Homo sapiens
uuaucuaaaucaccaga

SEQ ID NO: 1730135 - RNA, 21 nt, Homo sapiens
uucaaaaauacucacauggcu

SEQ ID NO: 1730136 - RNA, 14 nt, Homo sapiens
uucaucaugacaac

SEQ ID NO: 1730137 - RNA, 13 nt, Homo sapiens
uuccgcaccaaua

SEQ ID NO: 1730138 - RNA, 18 nt, Homo sapiens
uuccucacacccaccugc

SEQ ID NO: 1730139 - RNA, 19 nt, Homo sapiens
uuccuggaguacaaacaca

SEQ ID NO: 1730140 - RNA, 17 nt, Homo sapiens
uucgauggcauccugca

SEQ ID NO: 1730141 - RNA, 17 nt, Homo sapiens
uucuaggaagcuccagu

SEQ ID NO: 1730142 - RNA, 22 nt, Homo sapiens
uucucagaccugcgcacuccau

SEQ ID NO: 1730143 - RNA, 21 nt, Homo sapiens
uucuuaaacaaauguaugauu

SEQ ID NO: 1730144 - RNA, 17 nt, Homo sapiens
uucuuccuaccaaauau

SEQ ID NO: 1730145 - RNA, 13 nt, Homo sapiens
uugaaggugcugc

SEQ ID NO: 1730146 - RNA, 17 nt, Homo sapiens
uugaaggugcugccacc

SEQ ID NO: 1730147 - RNA, 20 nt, Homo sapiens
uugaauuaaaacagcugcga

SEQ ID NO: 1730148 - RNA, 16 nt, Homo sapiens
uugauaguauugugca

SEQ ID NO: 1730149 - RNA, 16 nt, Homo sapiens
uugaugccaaagcaga

SEQ ID NO: 1730150 - RNA, 18 nt, Homo sapiens
uugcauagcagcugcuac

SEQ ID NO: 1730151 - RNA, 22 nt, Homo sapiens
uugccaucccucccuccaccuc

SEQ ID NO: 1730152 - RNA, 22 nt, Homo sapiens
uuggcugugcccucagauuccg

SEQ ID NO: 1730153 - RNA, 14 nt, Homo sapiens
uuguaauaaacucu

SEQ ID NO: 1730154 - RNA, 15 nt, Homo sapiens
uuguaauuccuuacu

SEQ ID NO: 1730155 - RNA, 19 nt, Homo sapiens
uuguagaaaugagccagaa

SEQ ID NO: 1730156 - RNA, 22 nt, Homo sapiens
uugucucucuaaacccaaauaa

SEQ ID NO: 1730157 - RNA, 20 nt, Homo sapiens
uuguucuuuggaaauacaca

SEQ ID NO: 1730158 - RNA, 12 nt, Homo sapiens
uuuaaaacacaa

SEQ ID NO: 1730159 - RNA, 23 nt, Homo sapiens
uuuauuaguuaggugugccaaac

SEQ ID NO: 1730160 - RNA, 22 nt, Homo sapiens
uuuauuuuuuuaaaacacaaau

SEQ ID NO: 1730161 - RNA, 16 nt, Homo sapiens
uuucaacaaguaacuu

SEQ ID NO: 1730162 - RNA, 18 nt, Homo sapiens
uuuccuuugguccuucaa

SEQ ID NO: 1730163 - RNA, 15 nt, Homo sapiens
uuucuucuaccagac

SEQ ID NO: 1730164 - RNA, 21 nt, Homo sapiens
uuucuuguaaacauugccuga

SEQ ID NO: 1730165 - RNA, 14 nt, Homo sapiens
uuugauaaagcagu

SEQ ID NO: 1730166 - RNA, 17 nt, Homo sapiens
uuuuagcacaucacuga

SEQ ID NO: 1730167 - RNA, 14 nt, Homo sapiens
uuuucaagaugcuu

SEQ ID NO: 1730168 - RNA, 17 nt, Homo sapiens
uuuuuaacugcauaaua

SEQ ID NO: 1730169 - RNA, 12 nt, Homo sapiens
cauucacaucuc

SEQ ID NO: 1730170 - RNA, 17 nt, Homo sapiens
cauucccuccacccacu

SEQ ID NO: 1730171 - RNA, 21 nt, Homo sapiens
cauugccugauuuguuccuuc

SEQ ID NO: 1730172 - RNA, 23 nt, Homo sapiens
cauuuuccucacacccaccugcu

SEQ ID NO: 1730173 - RNA, 13 nt, Homo sapiens
ccaaaauguuaau

SEQ ID NO: 1730174 - RNA, 13 nt, Homo sapiens
ccaaacacaggca

SEQ ID NO: 1730175 - RNA, 21 nt, Homo sapiens
ccaacugcaggaaugcugaca

SEQ ID NO: 1730176 - RNA, 22 nt, Homo sapiens
ccaacugcaggaaugcugacaa

SEQ ID NO: 1730177 - RNA, 18 nt, Homo sapiens
ccaaggaugacacugcca

SEQ ID NO: 1730178 - RNA, 22 nt, Homo sapiens
ccaauaaagccuucaaacuccc

SEQ ID NO: 1730179 - RNA, 21 nt, Homo sapiens
ccacaaaugggaaaaccagac

SEQ ID NO: 1730180 - RNA, 17 nt, Homo sapiens
ccaccucccugcaauaa

SEQ ID NO: 1730181 - RNA, 15 nt, Homo sapiens
ccaccugcucaccaa

SEQ ID NO: 1730182 - RNA, 15 nt, Homo sapiens
ccaccuguuguccug

SEQ ID NO: 1730183 - RNA, 22 nt, Homo sapiens
ccaccuguuguccugaacugug

SEQ ID NO: 1730184 - RNA, 19 nt, Homo sapiens
ccaccuugggucuguguca

SEQ ID NO: 1730185 - RNA, 14 nt, Homo sapiens
ccacguuaagucca

SEQ ID NO: 1730186 - RNA, 16 nt, Homo sapiens
ccacuuugucucugag

SEQ ID NO: 1730187 - RNA, 18 nt, Homo sapiens
ccagacuucucuuucuua

SEQ ID NO: 1730188 - RNA, 19 nt, Homo sapiens
ccagagaccaaacaaggac

SEQ ID NO: 1730189 - RNA, 20 nt, Homo sapiens
ccagauggccgggacaugca

SEQ ID NO: 1730190 - RNA, 11 nt, Homo sapiens
ccagcacucug

SEQ ID NO: 1730191 - RNA, 15 nt, Homo sapiens
ccagccagcaguuca

SEQ ID NO: 1730192 - RNA, 16 nt, Homo sapiens
ccagccagcaguucag

SEQ ID NO: 1730193 - RNA, 11 nt, Homo sapiens
ccaucugccaa

SEQ ID NO: 1730194 - RNA, 17 nt, Homo sapiens
ccaugaaaaugcaacaa

SEQ ID NO: 1730195 - RNA, 23 nt, Homo sapiens
ccaugcacccucauacacagaaa

SEQ ID NO: 1730196 - RNA, 19 nt, Homo sapiens
ccaugggcucagggccagg

SEQ ID NO: 1730197 - RNA, 20 nt, Homo sapiens
ccaugucguaguuacucuca

SEQ ID NO: 1730198 - RNA, 17 nt, Homo sapiens
cccacacaagacccaag

SEQ ID NO: 1730199 - RNA, 20 nt, Homo sapiens
cccacuucucuacucuggaa

SEQ ID NO: 1730200 - RNA, 21 nt, Homo sapiens
cccagauggccgggacaugca

SEQ ID NO: 1730201 - RNA, 18 nt, Homo sapiens
cccagccccgcccgccug

SEQ ID NO: 1730202 - RNA, 21 nt, Homo sapiens
cccaucccuggcugaccugcu

SEQ ID NO: 1730203 - RNA, 16 nt, Homo sapiens
ccccacuucucuacuc

SEQ ID NO: 1730204 - RNA, 20 nt, Homo sapiens
ccccugugccugcugggcac

SEQ ID NO: 1730205 - RNA, 12 nt, Homo sapiens
cccgcucugcac

SEQ ID NO: 1730206 - RNA, 17 nt, Homo sapiens
cccuauucugccauggg

SEQ ID NO: 1730207 - RNA, 20 nt, Homo sapiens
cccuccucugcuugccaucc

SEQ ID NO: 1730208 - RNA, 19 nt, Homo sapiens
ccgggagccucuccuugcc

SEQ ID NO: 1730209 - RNA, 13 nt, Homo sapiens
ccuauucugccau

SEQ ID NO: 1730210 - RNA, 13 nt, Homo sapiens
ccucaacagcagg

SEQ ID NO: 1730211 - RNA, 21 nt, Homo sapiens
ccucagauuccgcaccaauaa

SEQ ID NO: 1730212 - RNA, 20 nt, Homo sapiens
ccuccaccucccugcaauaa

SEQ ID NO: 1730213 - RNA, 14 nt, Homo sapiens
ccucugcuugccau

SEQ ID NO: 1730214 - RNA, 15 nt, Homo sapiens
ccucugcuugccauc

SEQ ID NO: 1730215 - RNA, 13 nt, Homo sapiens
ccugaaccagucc

SEQ ID NO: 1730216 - RNA, 16 nt, Homo sapiens
ccugauuuguuccuuc

SEQ ID NO: 1730217 - RNA, 23 nt, Homo sapiens
ccugccccacuucucuacucugg

SEQ ID NO: 1730218 - RNA, 20 nt, Homo sapiens
ccuggaaauuaaacccugcc

SEQ ID NO: 1730219 - RNA, 19 nt, Homo sapiens
ccuggaagccggccggcug

SEQ ID NO: 1730220 - RNA, 15 nt, Homo sapiens
ccuggcugaccugcu

SEQ ID NO: 1730221 - RNA, 19 nt, Homo sapiens
ccuggugaccuacuaaaaa

SEQ ID NO: 1730222 - RNA, 23 nt, Homo sapiens
ccuguaaucccagcuacauggga

SEQ ID NO: 1730223 - RNA, 23 nt, Homo sapiens
ccuguagcaaccuucugcauuca

SEQ ID NO: 1730224 - RNA, 14 nt, Homo sapiens
ccugugaaauacca

SEQ ID NO: 1730225 - RNA, 21 nt, Homo sapiens
ccuguucuuccuaccaaauau

SEQ ID NO: 1730226 - RNA, 14 nt, Homo sapiens
cgcaucauaugcag

SEQ ID NO: 1730227 - RNA, 13 nt, Homo sapiens
cgcccuccacaaa

SEQ ID NO: 1730228 - RNA, 22 nt, Homo sapiens
cgcugggauccgggaucaaagu

SEQ ID NO: 1730229 - RNA, 18 nt, Homo sapiens
cguaguuacucucaggca

SEQ ID NO: 1730230 - RNA, 18 nt, Homo sapiens
cgucucaaaaacaaaaca

SEQ ID NO: 1730231 - RNA, 17 nt, Homo sapiens
cuaaaaaauggugggag

SEQ ID NO: 1730232 - RNA, 22 nt, Homo sapiens
cuaauaaaagucagagcucagg

SEQ ID NO: 1730233 - RNA, 21 nt, Homo sapiens
cuacaacaaauacuacaggcc

SEQ ID NO: 1730234 - RNA, 19 nt, Homo sapiens
cuacuagcucuuugagaua

SEQ ID NO: 1730235 - RNA, 14 nt, Homo sapiens
cuacuugggagcac

SEQ ID NO: 1730236 - RNA, 13 nt, Homo sapiens
cuagaagcucagg

SEQ ID NO: 1730237 - RNA, 16 nt, Homo sapiens
cuagcucuuugagaua

SEQ ID NO: 1730238 - RNA, 17 nt, Homo sapiens
cuauauuguacacaccu

SEQ ID NO: 1730239 - RNA, 13 nt, Homo sapiens
cuauucugccaug

SEQ ID NO: 1730240 - RNA, 16 nt, Homo sapiens
cuauucugccauggga

SEQ ID NO: 1730241 - RNA, 12 nt, Homo sapiens
cucaacagcagg

SEQ ID NO: 1730242 - RNA, 16 nt, Homo sapiens
cucacacccaccugcu

SEQ ID NO: 1730243 - RNA, 15 nt, Homo sapiens
cucaguucugccuua

SEQ ID NO: 1730244 - RNA, 14 nt, Homo sapiens
cucauacacagaaa

SEQ ID NO: 1730245 - RNA, 20 nt, Homo sapiens
cuccaggaugaguuacuuga

SEQ ID NO: 1730246 - RNA, 15 nt, Homo sapiens
cuccauuacuaaaga

SEQ ID NO: 1730247 - RNA, 13 nt, Homo sapiens
cucccacacaaga

SEQ ID NO: 1730248 - RNA, 22 nt, Homo sapiens
cucccuccaccucccugcaaua

SEQ ID NO: 1730249 - RNA, 15 nt, Homo sapiens
cuccucugcuugcca

SEQ ID NO: 1730250 - RNA, 24 nt, Homo sapiens
cucuaugaccucgcccuccacaaa

SEQ ID NO: 1730251 - RNA, 21 nt, Homo sapiens
cucuccuugccuggugaccua

SEQ ID NO: 1730252 - RNA, 14 nt, Homo sapiens
cucugagaacagac

SEQ ID NO: 1730253 - RNA, 22 nt, Homo sapiens
cucugagaacagacguuaccaa

SEQ ID NO: 1730254 - RNA, 20 nt, Homo sapiens
cucugaugagagagugcuga

SEQ ID NO: 1730255 - RNA, 19 nt, Homo sapiens
cucugccugagacuuucag

SEQ ID NO: 1730256 - RNA, 13 nt, Homo sapiens
cucuucucaaagc

SEQ ID NO: 1730257 - RNA, 16 nt, Homo sapiens
cugaacucuaagcaga

SEQ ID NO: 1730258 - RNA, 16 nt, Homo sapiens
cugacaaugcugccau

SEQ ID NO: 1730259 - RNA, 15 nt, Homo sapiens
cugaccaaaaccaga

SEQ ID NO: 1730260 - RNA, 15 nt, Homo sapiens
cugagaaacuuccuu

SEQ ID NO: 1730261 - RNA, 15 nt, Homo sapiens
cugagaaggacaccu

SEQ ID NO: 1730262 - RNA, 22 nt, Homo sapiens
cugagauugcgccacugcacuc

SEQ ID NO: 1730263 - RNA, 18 nt, Homo sapiens
cugagcgagcacaccuuc

SEQ ID NO: 1730264 - RNA, 17 nt, Homo sapiens
cugaugacacauuuggc

SEQ ID NO: 1730265 - RNA, 19 nt, Homo sapiens
cugcaaaaggccugugauc

SEQ ID NO: 1730266 - RNA, 12 nt, Homo sapiens
cugcacagggau

SEQ ID NO: 1730267 - RNA, 23 nt, Homo sapiens
cugccaccccuuggcacugugga

SEQ ID NO: 1730268 - RNA, 13 nt, Homo sapiens
cugccaggcacca

SEQ ID NO: 1730269 - RNA, 15 nt, Homo sapiens
cugccuaaccauggg

SEQ ID NO: 1730270 - RNA, 14 nt, Homo sapiens
cugcuggacagggg

SEQ ID NO: 1730271 - RNA, 18 nt, Homo sapiens
cuggagucaguagccaga

SEQ ID NO: 1730272 - RNA, 20 nt, Homo sapiens
cuggagucccuucugagcga

SEQ ID NO: 1730273 - RNA, 22 nt, Homo sapiens
cuggcaucucccacacaagacc

SEQ ID NO: 1730274 - RNA, 18 nt, Homo sapiens
cugggccaguggcacucu

SEQ ID NO: 1730275 - RNA, 13 nt, Homo sapiens
cuggggacaccag

SEQ ID NO: 1730276 - RNA, 14 nt, Homo sapiens
cuggggacaccagc

SEQ ID NO: 1730277 - RNA, 16 nt, Homo sapiens
cuggggcuuugccauu

SEQ ID NO: 1730278 - RNA, 16 nt, Homo sapiens
cuggugaccuacuaaa

SEQ ID NO: 1730279 - RNA, 23 nt, Homo sapiens
cugucacaucagcuccacuuuca

SEQ ID NO: 1730280 - RNA, 18 nt, Homo sapiens
cugugcccucagauuccg

SEQ ID NO: 1730281 - RNA, 20 nt, Homo sapiens
cugugcuaggucugaccaaa

SEQ ID NO: 1730282 - RNA, 19 nt, Homo sapiens
cuguucucaaaugcuaaau

SEQ ID NO: 1730283 - RNA, 12 nt, Homo sapiens
cuguuguccuga

SEQ ID NO: 1730284 - RNA, 14 nt, Homo sapiens
cuuaaauccauccu

SEQ ID NO: 1730285 - RNA, 18 nt, Homo sapiens
cuuagguuguagcagaaa

SEQ ID NO: 1730286 - RNA, 24 nt, Homo sapiens
cuuauuuuguaauaaacucucuag

SEQ ID NO: 1730287 - RNA, 13 nt, Homo sapiens
cuuccuaccaaau

SEQ ID NO: 1730288 - RNA, 20 nt, Homo sapiens
cuuccuuaauucacucccac

SEQ ID NO: 1730289 - RNA, 21 nt, Homo sapiens
cuucgauggcauccugcagug

SEQ ID NO: 1730290 - RNA, 19 nt, Homo sapiens
cuucucaaagcugggauua

SEQ ID NO: 1730291 - RNA, 17 nt, Homo sapiens
cuucugagcgagcacac

SEQ ID NO: 1730292 - RNA, 19 nt, Homo sapiens
cuucuggggcuuugccauu

SEQ ID NO: 1730293 - RNA, 16 nt, Homo sapiens
cuucuuccuuaauuca

SEQ ID NO: 1730294 - RNA, 18 nt, Homo sapiens
cuugaagacaauggcuua

SEQ ID NO: 1730295 - RNA, 11 nt, Homo sapiens
uagcugcuacc

SEQ ID NO: 1730296 - RNA, 14 nt, Homo sapiens
uaggugugccaaac

SEQ ID NO: 1730297 - RNA, 19 nt, Homo sapiens
uagguuucucugccuccag

SEQ ID NO: 1730298 - RNA, 13 nt, Homo sapiens
uauagcugcauuu

SEQ ID NO: 1730299 - RNA, 17 nt, Homo sapiens
uaucauuuugcacgugc

SEQ ID NO: 1730300 - RNA, 23 nt, Homo sapiens
uauccaugaucacacagcuaaua

SEQ ID NO: 1730301 - RNA, 14 nt, Homo sapiens
uaucugaguugacu

SEQ ID NO: 1730302 - RNA, 21 nt, Homo sapiens
uauuaguuaggugugccaaac

SEQ ID NO: 1730303 - RNA, 20 nt, Homo sapiens
uauuugugugugugauauau

SEQ ID NO: 1730304 - RNA, 17 nt, Homo sapiens
uauuuuguaauaaacuc

SEQ ID NO: 1730305 - RNA, 15 nt, Homo sapiens
ucaaagcugggauua

SEQ ID NO: 1730306 - RNA, 13 nt, Homo sapiens
ucacaaguucaau

SEQ ID NO: 1730307 - RNA, 20 nt, Homo sapiens
ucaccaauuccacuuccugc

SEQ ID NO: 1730308 - RNA, 13 nt, Homo sapiens
ucagaaagucaua

SEQ ID NO: 1730309 - RNA, 11 nt, Homo sapiens
ucagagcugcc

SEQ ID NO: 1730310 - RNA, 21 nt, Homo sapiens
ucaggacacuaauacaccagg

SEQ ID NO: 1730311 - RNA, 14 nt, Homo sapiens
ucaggccucugagg

SEQ ID NO: 1730312 - RNA, 12 nt, Homo sapiens
ucaugugccugg

SEQ ID NO: 1730313 - RNA, 19 nt, Homo sapiens
ucauucucuugaaggugcu

SEQ ID NO: 1730314 - RNA, 17 nt, Homo sapiens
uccaccucccugcaaua

SEQ ID NO: 1730315 - RNA, 16 nt, Homo sapiens
uccagggcaaggccau

SEQ ID NO: 1730316 - RNA, 16 nt, Homo sapiens
uccaugaucacacagc

SEQ ID NO: 1730317 - RNA, 17 nt, Homo sapiens
ucccagccagcaguuca

SEQ ID NO: 1730318 - RNA, 15 nt, Homo sapiens
ucccuauucugccau

SEQ ID NO: 1730319 - RNA, 22 nt, Homo sapiens
uccuaacccugggcucccugga

SEQ ID NO: 1730320 - RNA, 22 nt, Homo sapiens
uccucaauucaauguggugaug

SEQ ID NO: 1730321 - RNA, 13 nt, Homo sapiens
uccucacagcagu

SEQ ID NO: 1730322 - RNA, 16 nt, Homo sapiens
uccucgguacucccau

SEQ ID NO: 1730323 - RNA, 13 nt, Homo sapiens
uccucugcuugcc

SEQ ID NO: 1730324 - RNA, 17 nt, Homo sapiens
uccuguucuuucuuaca

SEQ ID NO: 1730325 - RNA, 23 nt, Homo sapiens
uccuuuccaagcuccucgugaua

SEQ ID NO: 1730326 - RNA, 18 nt, Homo sapiens
ucgaauuuuucagaugau

SEQ ID NO: 1730327 - RNA, 23 nt, Homo sapiens
ucuaaaucaccagagaccaaaca

SEQ ID NO: 1730328 - RNA, 13 nt, Homo sapiens
ucuagaaggccag

SEQ ID NO: 1730329 - RNA, 15 nt, Homo sapiens
ucucaggggugcugg

SEQ ID NO: 1730330 - RNA, 14 nt, Homo sapiens
ucuccugggcagcu

SEQ ID NO: 1730331 - RNA, 15 nt, Homo sapiens
ucuccugggcagcug

SEQ ID NO: 1730332 - RNA, 14 nt, Homo sapiens
ucucugagaacaga

SEQ ID NO: 1730333 - RNA, 16 nt, Homo sapiens
ucugccaaugccauga

SEQ ID NO: 1730334 - RNA, 21 nt, Homo sapiens
ucugccuaaccaugggcucag

SEQ ID NO: 1730335 - RNA, 21 nt, Homo sapiens
ucuggcaucucccacacaaga

SEQ ID NO: 1730336 - RNA, 12 nt, Homo sapiens
ucuuacacaaga

SEQ ID NO: 1730337 - RNA, 17 nt, Homo sapiens
ucuucucaaagcuggga

SEQ ID NO: 1730338 - RNA, 13 nt, Homo sapiens
ucuucucacuuuc

SEQ ID NO: 1730339 - RNA, 18 nt, Homo sapiens
ucuugaaggugcugccac

SEQ ID NO: 1730340 - RNA, 18 nt, Homo sapiens
ucuuguaaacauugccug

SEQ ID NO: 1730341 - RNA, 14 nt, Homo sapiens
ucuuucuuacacaa

SEQ ID NO: 1730342 - RNA, 19 nt, Homo sapiens
ucuuucuuacacaagagcu

SEQ ID NO: 1730343 - RNA, 20 nt, Homo sapiens
ucuuugagauaauacauucc

SEQ ID NO: 1730344 - RNA, 21 nt, Homo sapiens
ucuuugagauaauacauuccg

SEQ ID NO: 1730345 - RNA, 14 nt, Homo sapiens
ugaaacagcugcca

SEQ ID NO: 1730346 - RNA, 22 nt, Homo sapiens
ugaaaccagaaggauauuuacu

SEQ ID NO: 1730347 - RNA, 10 nt, Homo sapiens
ugaaagcaga

SEQ ID NO: 1730348 - RNA, 19 nt, Homo sapiens
ugaacaccacuuugucucu

SEQ ID NO: 1730349 - RNA, 15 nt, Homo sapiens
ugaaggugcugccac

SEQ ID NO: 1730350 - RNA, 19 nt, Homo sapiens
ugaagguggaacaagcaca

SEQ ID NO: 1730351 - RNA, 15 nt, Homo sapiens
ugaauuaaaacagcu

SEQ ID NO: 1730352 - RNA, 16 nt, Homo sapiens
ugaauuaaaacagcug

SEQ ID NO: 1730353 - RNA, 16 nt, Homo sapiens
ugacaaugcugccaug

SEQ ID NO: 1730354 - RNA, 16 nt, Homo sapiens
ugacacugccagucac

SEQ ID NO: 1730355 - RNA, 16 nt, Homo sapiens
ugacaggcagugccau

SEQ ID NO: 1730356 - RNA, 20 nt, Homo sapiens
ugaccucgcccuccacaaau

SEQ ID NO: 1730357 - RNA, 15 nt, Homo sapiens
ugacucgggccuuag

SEQ ID NO: 1730358 - RNA, 19 nt, Homo sapiens
ugagaccuuggcgcuacaa

SEQ ID NO: 1730359 - RNA, 17 nt, Homo sapiens
ugagauaauacauuccg

SEQ ID NO: 1730360 - RNA, 18 nt, Homo sapiens
ugauaaagcaguauuugg

SEQ ID NO: 1730361 - RNA, 14 nt, Homo sapiens
ugaucuaauuuaca

SEQ ID NO: 1730362 - RNA, 13 nt, Homo sapiens
ugcaacaacaugu

SEQ ID NO: 1730363 - RNA, 14 nt, Homo sapiens
ugcaacaacaugua

SEQ ID NO: 1730364 - RNA, 19 nt, Homo sapiens
ugcaaggcuaagaaguacu

SEQ ID NO: 1730365 - RNA, 20 nt, Homo sapiens
ugcaccccccugugccugcu

SEQ ID NO: 1730366 - RNA, 15 nt, Homo sapiens
ugcauagcagcugcu

SEQ ID NO: 1730367 - RNA, 17 nt, Homo sapiens
ugcauagcagcugcuac

SEQ ID NO: 1730368 - RNA, 15 nt, Homo sapiens
ugcaugugugugaug

SEQ ID NO: 1730369 - RNA, 13 nt, Homo sapiens
ugccacacuauuu

SEQ ID NO: 1730370 - RNA, 15 nt, Homo sapiens
ugccaggcaccaucu

SEQ ID NO: 1730371 - RNA, 17 nt, Homo sapiens
ugccaugcccaccaucg

SEQ ID NO: 1730372 - RNA, 21 nt, Homo sapiens
ugccccaccuguuguccugaa

SEQ ID NO: 1730373 - RNA, 19 nt, Homo sapiens
ugccugaugggaguaggcu

SEQ ID NO: 1730374 - RNA, 22 nt, Homo sapiens
ugcuaacuagcuuggaaacugg

SEQ ID NO: 1730375 - RNA, 15 nt, Homo sapiens
ugcuaggucugacca

SEQ ID NO: 1730376 - RNA, 13 nt, Homo sapiens
ugcuggacagggg

SEQ ID NO: 1730377 - RNA, 20 nt, Homo sapiens
ugcuguaugaauagcugugu

SEQ ID NO: 1730378 - RNA, 12 nt, Homo sapiens
ugcuugccaucc

SEQ ID NO: 1730379 - RNA, 13 nt, Homo sapiens
uggaacaagcaca

SEQ ID NO: 1730380 - RNA, 13 nt, Homo sapiens
uggaacugccacc

SEQ ID NO: 1730381 - RNA, 21 nt, Homo sapiens
uggaagccggccggcugggau

SEQ ID NO: 1730382 - RNA, 22 nt, Homo sapiens
uggacugguaaguaacuguggu

SEQ ID NO: 1730383 - RNA, 23 nt, Homo sapiens
uggagcccgugcccuaccacaca

SEQ ID NO: 1730384 - RNA, 14 nt, Homo sapiens
uggagguugcagug

SEQ ID NO: 1730385 - RNA, 23 nt, Homo sapiens
uggagugucaccagcugccaaaa

SEQ ID NO: 1730386 - RNA, 23 nt, Homo sapiens
uggaugucccuauucugccaugg

SEQ ID NO: 1730387 - RNA, 20 nt, Homo sapiens
uggcaagcugcaaaaggccu

SEQ ID NO: 1730388 - RNA, 11 nt, Homo sapiens
uggcacugugg

SEQ ID NO: 1730389 - RNA, 22 nt, Homo sapiens
uggcaucucccacacaagaccc

SEQ ID NO: 1730390 - RNA, 16 nt, Homo sapiens
uggcauucacaucuca

SEQ ID NO: 1730391 - RNA, 15 nt, Homo sapiens
uggccccugggccug

SEQ ID NO: 1730392 - RNA, 19 nt, Homo sapiens
uggccuggaugcacagugc

SEQ ID NO: 1730393 - RNA, 14 nt, Homo sapiens
ugggaaaaccagac

SEQ ID NO: 1730394 - RNA, 15 nt, Homo sapiens
ugggaaaaccagacu

SEQ ID NO: 1730395 - RNA, 15 nt, Homo sapiens
ugggagcaccgccug

SEQ ID NO: 1730396 - RNA, 19 nt, Homo sapiens
ugggagggguugaugccag

SEQ ID NO: 1730397 - RNA, 20 nt, Homo sapiens
ugggaucaagaaggggacag

SEQ ID NO: 1730398 - RNA, 20 nt, Homo sapiens
ugggauugaauuaaaacagc

SEQ ID NO: 1730399 - RNA, 18 nt, Homo sapiens
uggggcuuuuacaccagu

SEQ ID NO: 1730400 - RNA, 21 nt, Homo sapiens
ugguguggccagcacucugaa

SEQ ID NO: 1730401 - RNA, 21 nt, Homo sapiens
uguagguuucucugccuccag

SEQ ID NO: 1730402 - RNA, 16 nt, Homo sapiens
uguaugaauagcugug

SEQ ID NO: 1730403 - RNA, 20 nt, Homo sapiens
uguaugauuacaucaaggcu

SEQ ID NO: 1730404 - RNA, 16 nt, Homo sapiens
uguauuucaagaccuc

SEQ ID NO: 1730405 - RNA, 18 nt, Homo sapiens
ugucaccagcugccaaaa

SEQ ID NO: 1730406 - RNA, 19 nt, Homo sapiens
auuacugaaauauaccuuu

SEQ ID NO: 1730407 - RNA, 20 nt, Homo sapiens
auuaugcauuauaucaaauc

SEQ ID NO: 1730408 - RNA, 23 nt, Homo sapiens
auuauuccucucaccccacuccu

SEQ ID NO: 1730409 - RNA, 21 nt, Homo sapiens
auugacaaccgagaagguuua

SEQ ID NO: 1730410 - RNA, 15 nt, Homo sapiens
auugccaagucagau

SEQ ID NO: 1730411 - RNA, 21 nt, Homo sapiens
auugucaggggaacagagaag

SEQ ID NO: 1730412 - RNA, 17 nt, Homo sapiens
auugugcaguacuuugu

SEQ ID NO: 1730413 - RNA, 15 nt, Homo sapiens
auuucaccaccaaau

SEQ ID NO: 1730414 - RNA, 18 nt, Homo sapiens
caaaaaaaauuuuagcuc

SEQ ID NO: 1730415 - RNA, 20 nt, Homo sapiens
caaaaaaaauuuuagcucuu

SEQ ID NO: 1730416 - RNA, 12 nt, Homo sapiens
caaagcacuuaa

SEQ ID NO: 1730417 - RNA, 21 nt, Homo sapiens
caacaaugugaggggucccua

SEQ ID NO: 1730418 - RNA, 14 nt, Homo sapiens
caacauccacuguu

SEQ ID NO: 1730419 - RNA, 15 nt, Homo sapiens
caacaugcacugaug

SEQ ID NO: 1730420 - RNA, 15 nt, Homo sapiens
caaccaauuuacacu

SEQ ID NO: 1730421 - RNA, 18 nt, Homo sapiens
caaccaauuuacacugcc

SEQ ID NO: 1730422 - RNA, 17 nt, Homo sapiens
caacucuaacucugaga

SEQ ID NO: 1730423 - RNA, 15 nt, Homo sapiens
caaucuauguuugca

SEQ ID NO: 1730424 - RNA, 23 nt, Homo sapiens
caaucugccuguaucucucacua

SEQ ID NO: 1730425 - RNA, 17 nt, Homo sapiens
caaugcuucuagaguuu

SEQ ID NO: 1730426 - RNA, 17 nt, Homo sapiens
cacaugaaaccuacaca

SEQ ID NO: 1730427 - RNA, 15 nt, Homo sapiens
caccaaccugcauuu

SEQ ID NO: 1730428 - RNA, 23 nt, Homo sapiens
caccaggaauccccaacaugcac

SEQ ID NO: 1730429 - RNA, 13 nt, Homo sapiens
cacuguuagcaca

SEQ ID NO: 1730430 - RNA, 17 nt, Homo sapiens
cacuuuaaacaccccca

SEQ ID NO: 1730431 - RNA, 20 nt, Homo sapiens
cagaagaccccugacucauc

SEQ ID NO: 1730432 - RNA, 14 nt, Homo sapiens
cagaauaauucuua

SEQ ID NO: 1730433 - RNA, 15 nt, Homo sapiens
cagacucugucucaa

SEQ ID NO: 1730434 - RNA, 22 nt, Homo sapiens
cagagaugguguguucugcaau

SEQ ID NO: 1730435 - RNA, 16 nt, Homo sapiens
cagaguugaaguuuac

SEQ ID NO: 1730436 - RNA, 15 nt, Homo sapiens
cagcccacccugcug

SEQ ID NO: 1730437 - RNA, 19 nt, Homo sapiens
cagccuucuugauguauuu

SEQ ID NO: 1730438 - RNA, 14 nt, Homo sapiens
cagcuucuccagga

SEQ ID NO: 1730439 - RNA, 23 nt, Homo sapiens
caggaugacgugcuccguagcuc

SEQ ID NO: 1730440 - RNA, 22 nt, Homo sapiens
caggcaauuucaccaccaaaug

SEQ ID NO: 1730441 - RNA, 21 nt, Homo sapiens
caggcgugauggcaggugccu

SEQ ID NO: 1730442 - RNA, 19 nt, Homo sapiens
cagggccauggcucagggu

SEQ ID NO: 1730443 - RNA, 23 nt, Homo sapiens
cagguaccaucuuguauacacau

SEQ ID NO: 1730444 - RNA, 23 nt, Homo sapiens
caguaaauguacaacugcaccug

SEQ ID NO: 1730445 - RNA, 17 nt, Homo sapiens
caguauucuugcacuga

SEQ ID NO: 1730446 - RNA, 19 nt, Homo sapiens
cagucuucccagcaauuau

SEQ ID NO: 1730447 - RNA, 22 nt, Homo sapiens
caguggaugccacagcccagcu

SEQ ID NO: 1730448 - RNA, 17 nt, Homo sapiens
cauaaaugaaucaucaa

SEQ ID NO: 1730449 - RNA, 18 nt, Homo sapiens
cauacauuuaugcacauu

SEQ ID NO: 1730450 - RNA, 16 nt, Homo sapiens
cauauagaaugcagag

SEQ ID NO: 1730451 - RNA, 20 nt, Homo sapiens
cauauauacaggcauaaaau

SEQ ID NO: 1730452 - RNA, 15 nt, Homo sapiens
cauauauacccacau

SEQ ID NO: 1730453 - RNA, 13 nt, Homo sapiens
cauauauggaaga

SEQ ID NO: 1730454 - RNA, 13 nt, Homo sapiens
caucacagggugg

SEQ ID NO: 1730455 - RNA, 18 nt, Homo sapiens
caucauuuugacagcauc

SEQ ID NO: 1730456 - RNA, 15 nt, Homo sapiens
caugagacucagugc

SEQ ID NO: 1730457 - RNA, 19 nt, Homo sapiens
caugagacucagugcagau

SEQ ID NO: 1730458 - RNA, 18 nt, Homo sapiens
caugggcaccaaccugca

SEQ ID NO: 1730459 - RNA, 17 nt, Homo sapiens
cauguacagacauacau

SEQ ID NO: 1730460 - RNA, 22 nt, Homo sapiens
cauguauggaaucccacuguau

SEQ ID NO: 1730461 - RNA, 15 nt, Homo sapiens
cauguccuaauucuu

SEQ ID NO: 1730462 - RNA, 16 nt, Homo sapiens
cauuuuaccacuuuaa

SEQ ID NO: 1730463 - RNA, 15 nt, Homo sapiens
cauuuucuuucaugg

SEQ ID NO: 1730464 - RNA, 15 nt, Homo sapiens
ccaacaugcacugau

SEQ ID NO: 1730465 - RNA, 16 nt, Homo sapiens
ccaaguuuccauagca

SEQ ID NO: 1730466 - RNA, 12 nt, Homo sapiens
ccacacccaaag

SEQ ID NO: 1730467 - RNA, 23 nt, Homo sapiens
ccacauuuagauccugguuucau

SEQ ID NO: 1730468 - RNA, 18 nt, Homo sapiens
ccagccuggccaacaugg

SEQ ID NO: 1730469 - RNA, 17 nt, Homo sapiens
ccagugacgcugcugac

SEQ ID NO: 1730470 - RNA, 20 nt, Homo sapiens
ccauuauuccucucacccca

SEQ ID NO: 1730471 - RNA, 15 nt, Homo sapiens
ccauucagagacugu

SEQ ID NO: 1730472 - RNA, 21 nt, Homo sapiens
cccaaaccggcaggugcgauu

SEQ ID NO: 1730473 - RNA, 19 nt, Homo sapiens
cccaacacuuccagcauuu

SEQ ID NO: 1730474 - RNA, 19 nt, Homo sapiens
cccacauguccagcaccuu

SEQ ID NO: 1730475 - RNA, 16 nt, Homo sapiens
cccagcccaccugcuc

SEQ ID NO: 1730476 - RNA, 19 nt, Homo sapiens
cccagggcaccauccagcu

SEQ ID NO: 1730477 - RNA, 18 nt, Homo sapiens
cccagugcaugguggcca

SEQ ID NO: 1730478 - RNA, 16 nt, Homo sapiens
ccccaacaugcacuga

SEQ ID NO: 1730479 - RNA, 17 nt, Homo sapiens
ccccucagagacugaaa

SEQ ID NO: 1730480 - RNA, 15 nt, Homo sapiens
cccgcaucaagguca

SEQ ID NO: 1730481 - RNA, 23 nt, Homo sapiens
cccggugggacccccguggggca

SEQ ID NO: 1730482 - RNA, 16 nt, Homo sapiens
cccugaauggucucag

SEQ ID NO: 1730483 - RNA, 15 nt, Homo sapiens
cccugacucaucauu

SEQ ID NO: 1730484 - RNA, 21 nt, Homo sapiens
cccugggcuacagaaaccaca

SEQ ID NO: 1730485 - RNA, 17 nt, Homo sapiens
cccuuauaauuggugca

SEQ ID NO: 1730486 - RNA, 12 nt, Homo sapiens
ccgcacaugcac

SEQ ID NO: 1730487 - RNA, 22 nt, Homo sapiens
ccuaguacugccccccaugagg

SEQ ID NO: 1730488 - RNA, 20 nt, Homo sapiens
ccuagucuagcauucugcaa

SEQ ID NO: 1730489 - RNA, 15 nt, Homo sapiens
acucuaggguccagu

SEQ ID NO: 1730490 - RNA, 18 nt, Homo sapiens
acucuaggguccagugga

SEQ ID NO: 1730491 - RNA, 21 nt, Homo sapiens
acugaaauuacggguaccuga

SEQ ID NO: 1730492 - RNA, 14 nt, Homo sapiens
acugcaaaguguau

SEQ ID NO: 1730493 - RNA, 20 nt, Homo sapiens
acuggggagucuuuguggau

SEQ ID NO: 1730494 - RNA, 14 nt, Homo sapiens
acuuccaucccugc

SEQ ID NO: 1730495 - RNA, 18 nt, Homo sapiens
acuuccuuuaggaucuca

SEQ ID NO: 1730496 - RNA, 20 nt, Homo sapiens
acuuccuuuaggaucucagg

SEQ ID NO: 1730497 - RNA, 16 nt, Homo sapiens
acuucugcuggcauca

SEQ ID NO: 1730498 - RNA, 14 nt, Homo sapiens
agaaaagugcauau

SEQ ID NO: 1730499 - RNA, 21 nt, Homo sapiens
agaaaagugcauauuuaucca

SEQ ID NO: 1730500 - RNA, 18 nt, Homo sapiens
agaagggaauccuccucc

SEQ ID NO: 1730501 - RNA, 20 nt, Homo sapiens
agacauacauuuaugcacau

SEQ ID NO: 1730502 - RNA, 19 nt, Homo sapiens
agacugucccugaaaccua

SEQ ID NO: 1730503 - RNA, 20 nt, Homo sapiens
agagccagacucugucucaa

SEQ ID NO: 1730504 - RNA, 21 nt, Homo sapiens
agaggcugccccucucaccaa

SEQ ID NO: 1730505 - RNA, 16 nt, Homo sapiens
agagggagagcagaga

SEQ ID NO: 1730506 - RNA, 17 nt, Homo sapiens
agaugggagccuuuacc

SEQ ID NO: 1730507 - RNA, 17 nt, Homo sapiens
agaugguguguucugca

SEQ ID NO: 1730508 - RNA, 20 nt, Homo sapiens
agaugguguguucugcaaua

SEQ ID NO: 1730509 - RNA, 17 nt, Homo sapiens
agauguuacaaguuuau

SEQ ID NO: 1730510 - RNA, 17 nt, Homo sapiens
agcaugaggacagacca

SEQ ID NO: 1730511 - RNA, 23 nt, Homo sapiens
agccaaggaggugaggagcagag

SEQ ID NO: 1730512 - RNA, 22 nt, Homo sapiens
agccagggggaugccacuccuc

SEQ ID NO: 1730513 - RNA, 22 nt, Homo sapiens
agcccacccugcugcuggugca

SEQ ID NO: 1730514 - RNA, 22 nt, Homo sapiens
agcccagcuuggcccuuuccuu

SEQ ID NO: 1730515 - RNA, 15 nt, Homo sapiens
agccuggacugcuac

SEQ ID NO: 1730516 - RNA, 22 nt, Homo sapiens
agcggcccuaagggagugucua

SEQ ID NO: 1730517 - RNA, 12 nt, Homo sapiens
agcuacuuggca

SEQ ID NO: 1730518 - RNA, 20 nt, Homo sapiens
agcucucuccuaauauucca

SEQ ID NO: 1730519 - RNA, 14 nt, Homo sapiens
agcugagccugcag

SEQ ID NO: 1730520 - RNA, 16 nt, Homo sapiens
agcuugagaccauuuc

SEQ ID NO: 1730521 - RNA, 17 nt, Homo sapiens
aggaaaaggcugguaca

SEQ ID NO: 1730522 - RNA, 16 nt, Homo sapiens
aggaacagcaauggug

SEQ ID NO: 1730523 - RNA, 13 nt, Homo sapiens
aggaaccuguguu

SEQ ID NO: 1730524 - RNA, 13 nt, Homo sapiens
aggaaccuuccuu

SEQ ID NO: 1730525 - RNA, 21 nt, Homo sapiens
aggaaggaacagcaauggugu

SEQ ID NO: 1730526 - RNA, 16 nt, Homo sapiens
aggaaguagaagucau

SEQ ID NO: 1730527 - RNA, 17 nt, Homo sapiens
aggaauccccaacaugc

SEQ ID NO: 1730528 - RNA, 14 nt, Homo sapiens
aggacuacaaccaa

SEQ ID NO: 1730529 - RNA, 21 nt, Homo sapiens
aggaucaacaacauccacugu

SEQ ID NO: 1730530 - RNA, 13 nt, Homo sapiens
aggcaauuucacc

SEQ ID NO: 1730531 - RNA, 16 nt, Homo sapiens
aggcagguccacagag

SEQ ID NO: 1730532 - RNA, 21 nt, Homo sapiens
aggcugggccauguccaaaga

SEQ ID NO: 1730533 - RNA, 13 nt, Homo sapiens
agggcugacauuu

SEQ ID NO: 1730534 - RNA, 19 nt, Homo sapiens
aggucauacaugcauacaa

SEQ ID NO: 1730535 - RNA, 16 nt, Homo sapiens
aggugauuccagugaa

SEQ ID NO: 1730536 - RNA, 23 nt, Homo sapiens
agguuuuaaccgcacaugcacac

SEQ ID NO: 1730537 - RNA, 15 nt, Homo sapiens
aguauccaggcuuug

SEQ ID NO: 1730538 - RNA, 16 nt, Homo sapiens
agugugggggguccuu

SEQ ID NO: 1730539 - RNA, 10 nt, Homo sapiens
aguuuuuacu

SEQ ID NO: 1730540 - RNA, 21 nt, Homo sapiens
aguuuuuuauuaugcauuaua

SEQ ID NO: 1730541 - RNA, 19 nt, Homo sapiens
auaaagacaccugguugcu

SEQ ID NO: 1730542 - RNA, 22 nt, Homo sapiens
auaacaauucccccauccuuca

SEQ ID NO: 1730543 - RNA, 14 nt, Homo sapiens
auaacuacuuccau

SEQ ID NO: 1730544 - RNA, 17 nt, Homo sapiens
auaauucuuaacagugg

SEQ ID NO: 1730545 - RNA, 21 nt, Homo sapiens
auacacgguauuuauagagag

SEQ ID NO: 1730546 - RNA, 21 nt, Homo sapiens
auacagauagaguuccauaua

SEQ ID NO: 1730547 - RNA, 18 nt, Homo sapiens
auacauuuaugcacauuc

SEQ ID NO: 1730548 - RNA, 15 nt, Homo sapiens
auaccauuuccucag

SEQ ID NO: 1730549 - RNA, 18 nt, Homo sapiens
auacuuugccacugcugu

SEQ ID NO: 1730550 - RNA, 18 nt, Homo sapiens
auagaguaaauacaggua

SEQ ID NO: 1730551 - RNA, 18 nt, Homo sapiens
auagcagaugguuuccac

SEQ ID NO: 1730552 - RNA, 19 nt, Homo sapiens
auauacuuugccacugcug

SEQ ID NO: 1730553 - RNA, 14 nt, Homo sapiens
auauauuguucaaa

SEQ ID NO: 1730554 - RNA, 22 nt, Homo sapiens
aucaaauugugcaguacuuugu

SEQ ID NO: 1730555 - RNA, 18 nt, Homo sapiens
aucaacaacauccacugu

SEQ ID NO: 1730556 - RNA, 14 nt, Homo sapiens
auccaggcuuugua

SEQ ID NO: 1730557 - RNA, 20 nt, Homo sapiens
auccuagucuagcauucugc

SEQ ID NO: 1730558 - RNA, 15 nt, Homo sapiens
auccuccaguaccuu

SEQ ID NO: 1730559 - RNA, 18 nt, Homo sapiens
auccugcagauacuuuga

SEQ ID NO: 1730560 - RNA, 22 nt, Homo sapiens
auccuggguacugaaagccuua

SEQ ID NO: 1730561 - RNA, 13 nt, Homo sapiens
aucgaacuucaca

SEQ ID NO: 1730562 - RNA, 15 nt, Homo sapiens
aucguaccuauugca

SEQ ID NO: 1730563 - RNA, 19 nt, Homo sapiens
aucuaaaagaaaccuucca

SEQ ID NO: 1730564 - RNA, 22 nt, Homo sapiens
aucugcacuauguuuccauuug

SEQ ID NO: 1730565 - RNA, 17 nt, Homo sapiens
aucugccuguaucucuc

SEQ ID NO: 1730566 - RNA, 18 nt, Homo sapiens
aucugccuguaucucuca

SEQ ID NO: 1730567 - RNA, 21 nt, Homo sapiens
aucuucugggagcaggaacaa

SEQ ID NO: 1730568 - RNA, 14 nt, Homo sapiens
augaaaucuuccca

SEQ ID NO: 1730569 - RNA, 20 nt, Homo sapiens
augaaaucuucccaguauua

SEQ ID NO: 1730570 - RNA, 15 nt, Homo sapiens
augaaucaucaaagc

SEQ ID NO: 1730571 - RNA, 23 nt, Homo sapiens
augacauuuuuuuuaacuacuau

SEQ ID NO: 1730572 - RNA, 13 nt, Homo sapiens
augacuccuacuu

SEQ ID NO: 1730573 - RNA, 18 nt, Homo sapiens
augaggacagaccacaga

SEQ ID NO: 1730574 - RNA, 16 nt, Homo sapiens
cagagaaagaaguccu

SEQ ID NO: 1730575 - RNA, 16 nt, Homo sapiens
cagagacugucccuga

SEQ ID NO: 1730576 - RNA, 19 nt, Homo sapiens
cagagcaggcaauuucacc

SEQ ID NO: 1730577 - RNA, 17 nt, Homo sapiens
cagauagaguuccauau

SEQ ID NO: 1730578 - RNA, 18 nt, Homo sapiens
cagaucaccugaggucag

SEQ ID NO: 1730579 - RNA, 19 nt, Homo sapiens
cagauccuuuuauucucca

SEQ ID NO: 1730580 - RNA, 21 nt, Homo sapiens
cagauccuuuuauucuccaga

SEQ ID NO: 1730581 - RNA, 21 nt, Homo sapiens
cagccaggcagguccacagag

SEQ ID NO: 1730582 - RNA, 21 nt, Homo sapiens
cagccuggccaacauggugaa

SEQ ID NO: 1730583 - RNA, 23 nt, Homo sapiens
caggaaaaaaaaaaaucuaucca

SEQ ID NO: 1730584 - RNA, 16 nt, Homo sapiens
caggaaauacuuugua

SEQ ID NO: 1730585 - RNA, 21 nt, Homo sapiens
caggaauaauguuuugggaaa

SEQ ID NO: 1730586 - RNA, 14 nt, Homo sapiens
caggcaauuucacc

SEQ ID NO: 1730587 - RNA, 14 nt, Homo sapiens
caggcugggccaug

SEQ ID NO: 1730588 - RNA, 20 nt, Homo sapiens
caggcugggccauguccaaa

SEQ ID NO: 1730589 - RNA, 21 nt, Homo sapiens
cagggagacgguuuccaggga

SEQ ID NO: 1730590 - RNA, 20 nt, Homo sapiens
cagguaccaucuuguauaca

SEQ ID NO: 1730591 - RNA, 21 nt, Homo sapiens
cagguaccaucuuguauacac

SEQ ID NO: 1730592 - RNA, 11 nt, Homo sapiens
caggugcagag

SEQ ID NO: 1730593 - RNA, 21 nt, Homo sapiens
cagucguacugauucuaaugg

SEQ ID NO: 1730594 - RNA, 16 nt, Homo sapiens
cagugacgcugcugac

SEQ ID NO: 1730595 - RNA, 22 nt, Homo sapiens
cagugagcugagaucguaccua

SEQ ID NO: 1730596 - RNA, 17 nt, Homo sapiens
cauacauuuaugcacau

SEQ ID NO: 1730597 - RNA, 21 nt, Homo sapiens
cauacauuuaugcacauucac

SEQ ID NO: 1730598 - RNA, 15 nt, Homo sapiens
cauagaaucugugac

SEQ ID NO: 1730599 - RNA, 18 nt, Homo sapiens
cauagcagaugguuucca

SEQ ID NO: 1730600 - RNA, 16 nt, Homo sapiens
cauauauacaggcaua

SEQ ID NO: 1730601 - RNA, 21 nt, Homo sapiens
cauauauacccacauguacag

SEQ ID NO: 1730602 - RNA, 19 nt, Homo sapiens
cauauauauauauaacaua

SEQ ID NO: 1730603 - RNA, 16 nt, Homo sapiens
cauauauauuaauacu

SEQ ID NO: 1730604 - RNA, 21 nt, Homo sapiens
cauauauauuaauacugguau

SEQ ID NO: 1730605 - RNA, 20 nt, Homo sapiens
cauauguauauauauauaug

SEQ ID NO: 1730606 - RNA, 21 nt, Homo sapiens
cauccuagucuagcauucugc

SEQ ID NO: 1730607 - RNA, 18 nt, Homo sapiens
caugagacucagugcaga

SEQ ID NO: 1730608 - RNA, 16 nt, Homo sapiens
cauggaggucauacau

SEQ ID NO: 1730609 - RNA, 21 nt, Homo sapiens
caugggcaccaaccugcauuu

SEQ ID NO: 1730610 - RNA, 21 nt, Homo sapiens
cauguaauguuaauguuauau

SEQ ID NO: 1730611 - RNA, 20 nt, Homo sapiens
cauguacagacauacauuua

SEQ ID NO: 1730612 - RNA, 17 nt, Homo sapiens
cauguccuaauucuucu

SEQ ID NO: 1730613 - RNA, 22 nt, Homo sapiens
caugucuuaccagugacgcugc

SEQ ID NO: 1730614 - RNA, 12 nt, Homo sapiens
cauuauguauga

SEQ ID NO: 1730615 - RNA, 12 nt, Homo sapiens
cauuuaugcaca

SEQ ID NO: 1730616 - RNA, 17 nt, Homo sapiens
cauuuugacagcaucuu

SEQ ID NO: 1730617 - RNA, 19 nt, Homo sapiens
ccaaggaaacgcuaccucu

SEQ ID NO: 1730618 - RNA, 18 nt, Homo sapiens
ccaaugagacucuagggu

SEQ ID NO: 1730619 - RNA, 21 nt, Homo sapiens
ccaaugcuucuguugaucuca

SEQ ID NO: 1730620 - RNA, 18 nt, Homo sapiens
ccacacccacuuugucca

SEQ ID NO: 1730621 - RNA, 15 nt, Homo sapiens
ccacacuaacgugug

SEQ ID NO: 1730622 - RNA, 21 nt, Homo sapiens
ccacagagagggagagcagag

SEQ ID NO: 1730623 - RNA, 13 nt, Homo sapiens
ccacugcuguauu

SEQ ID NO: 1730624 - RNA, 15 nt, Homo sapiens
ccagacucugucuca

SEQ ID NO: 1730625 - RNA, 18 nt, Homo sapiens
ccaggccugggugaucug

SEQ ID NO: 1730626 - RNA, 16 nt, Homo sapiens
ccaggcgugauggcag

SEQ ID NO: 1730627 - RNA, 14 nt, Homo sapiens
ccaggcuuuguaca

SEQ ID NO: 1730628 - RNA, 22 nt, Homo sapiens
ccaggggaaccugccaugccag

SEQ ID NO: 1730629 - RNA, 21 nt, Homo sapiens
ccagggugauuuuaugaucag

SEQ ID NO: 1730630 - RNA, 15 nt, Homo sapiens
ccaucccugcuuauu

SEQ ID NO: 1730631 - RNA, 18 nt, Homo sapiens
ccauccuucccuuuggag

SEQ ID NO: 1730632 - RNA, 16 nt, Homo sapiens
ccauggcucagggugg

SEQ ID NO: 1730633 - RNA, 10 nt, Homo sapiens
ccauguccaa

SEQ ID NO: 1730634 - RNA, 13 nt, Homo sapiens
ccauguccaaaga

SEQ ID NO: 1730635 - RNA, 18 nt, Homo sapiens
ccauuaauuaaaagugug

SEQ ID NO: 1730636 - RNA, 18 nt, Homo sapiens
ccauuucaaacuggagag

SEQ ID NO: 1730637 - RNA, 17 nt, Homo sapiens
cccacuguaugauuuau

SEQ ID NO: 1730638 - RNA, 18 nt, Homo sapiens
cccagcgacgaacuuucc

SEQ ID NO: 1730639 - RNA, 22 nt, Homo sapiens
ccccaacaaugugagggguccc

SEQ ID NO: 1730640 - RNA, 15 nt, Homo sapiens
cccugcccaaugaga

SEQ ID NO: 1730641 - RNA, 16 nt, Homo sapiens
cccugcugcuggugca

SEQ ID NO: 1730642 - RNA, 18 nt, Homo sapiens
cccuggguguccccgcug

SEQ ID NO: 1730643 - RNA, 14 nt, Homo sapiens
ccgaccacuuccag

SEQ ID NO: 1730644 - RNA, 19 nt, Homo sapiens
ccguagcucugcugcugau

SEQ ID NO: 1730645 - RNA, 21 nt, Homo sapiens
ccuagcuacuuggcaggcuaa

SEQ ID NO: 1730646 - RNA, 14 nt, Homo sapiens
ccuaggauguucug

SEQ ID NO: 1730647 - RNA, 16 nt, Homo sapiens
ccuccgaccacuucca

SEQ ID NO: 1730648 - RNA, 21 nt, Homo sapiens
ccuccucucaguguuuuggac

SEQ ID NO: 1730649 - RNA, 18 nt, Homo sapiens
ccucggccccucccacac

SEQ ID NO: 1730650 - RNA, 18 nt, Homo sapiens
ccugaaccucauucuggu

SEQ ID NO: 1730651 - RNA, 23 nt, Homo sapiens
ccuguaucucucacuauuaucua

SEQ ID NO: 1730652 - RNA, 16 nt, Homo sapiens
ccugugugcgugcgca

SEQ ID NO: 1730653 - RNA, 23 nt, Homo sapiens
ccuucagauccuuuuauucucca

SEQ ID NO: 1730654 - RNA, 16 nt, Homo sapiens
ccuuucaaagcacuua

SEQ ID NO: 1730655 - RNA, 16 nt, Homo sapiens
ccuuucauaccuugaa

SEQ ID NO: 1730656 - RNA, 13 nt, Homo sapiens
ccuuuuaugcaaa

SEQ ID NO: 1730657 - RNA, 24 nt, Homo sapiens
cgacauggcuccggccucugccuu

SEQ ID NO: 1730658 - RNA, 21 nt, Homo sapiens
cgauguuauuagauguuacaa

SEQ ID NO: 1730659 - RNA, 14 nt, Homo sapiens
cgccaucaugucuu

SEQ ID NO: 1730660 - RNA, 22 nt, Homo sapiens
cgcuaccucccuccccgucuca

SEQ ID NO: 1730661 - RNA, 21 nt, Homo sapiens
cggaaacuaguguacauuucu

SEQ ID NO: 1730662 - RNA, 22 nt, Homo sapiens
cggacuuccuuuaggaucucag

SEQ ID NO: 1730663 - RNA, 15 nt, Homo sapiens
cggccccucccacac

SEQ ID NO: 1730664 - RNA, 19 nt, Homo sapiens
cggccccucccacacccaa

SEQ ID NO: 1730665 - RNA, 22 nt, Homo sapiens
cgguuuacagcuaucgaacuuc

SEQ ID NO: 1730666 - RNA, 22 nt, Homo sapiens
cuaaagguuuuaaccgcacaug

SEQ ID NO: 1730667 - RNA, 15 nt, Homo sapiens
cuaauauacuuguaa

SEQ ID NO: 1730668 - RNA, 19 nt, Homo sapiens
cuaauucuucuguccugag

SEQ ID NO: 1730669 - RNA, 14 nt, Homo sapiens
cuacacacugucau

SEQ ID NO: 1730670 - RNA, 15 nt, Homo sapiens
cuaccguuguuugca

SEQ ID NO: 1730671 - RNA, 15 nt, Homo sapiens
cuacuuccaucccug

SEQ ID NO: 1730672 - RNA, 20 nt, Homo sapiens
cuagcauucugcaacauuua

SEQ ID NO: 1730673 - RNA, 23 nt, Homo sapiens
uaugaguaucuguauguauauau

SEQ ID NO: 1730674 - RNA, 14 nt, Homo sapiens
uaugcacauucacg

SEQ ID NO: 1730675 - RNA, 16 nt, Homo sapiens
uaugcaguauucuugc

SEQ ID NO: 1730676 - RNA, 17 nt, Homo sapiens
uaugcaguauucuugca

SEQ ID NO: 1730677 - RNA, 12 nt, Homo sapiens
uaugcuacugaa

SEQ ID NO: 1730678 - RNA, 20 nt, Homo sapiens
uaugguauauauacauauau

SEQ ID NO: 1730679 - RNA, 17 nt, Homo sapiens
uauguaugaguaucugu

SEQ ID NO: 1730680 - RNA, 19 nt, Homo sapiens
uauuuguuuuaugcuacug

SEQ ID NO: 1730681 - RNA, 14 nt, Homo sapiens
ucaaaauauuucuc

SEQ ID NO: 1730682 - RNA, 15 nt, Homo sapiens
ucaaauuuccuuuca

SEQ ID NO: 1730683 - RNA, 21 nt, Homo sapiens
ucaccaaggaaacgcuaccuc

SEQ ID NO: 1730684 - RNA, 19 nt, Homo sapiens
ucagaagaccccugacuca

SEQ ID NO: 1730685 - RNA, 18 nt, Homo sapiens
ucagauccuuuuauucuc

SEQ ID NO: 1730686 - RNA, 20 nt, Homo sapiens
ucagaugguacggacuuccu

SEQ ID NO: 1730687 - RNA, 14 nt, Homo sapiens
ucauacaugcauac

SEQ ID NO: 1730688 - RNA, 20 nt, Homo sapiens
ucauacaugcauacaaagag

SEQ ID NO: 1730689 - RNA, 21 nt, Homo sapiens
ucaucaaagcucacaccaaau

SEQ ID NO: 1730690 - RNA, 21 nt, Homo sapiens
ucauccuagucuagcauucug

SEQ ID NO: 1730691 - RNA, 16 nt, Homo sapiens
ucaugacuccuacuuu

SEQ ID NO: 1730692 - RNA, 18 nt, Homo sapiens
ucaugccuguaaucccag

SEQ ID NO: 1730693 - RNA, 19 nt, Homo sapiens
ucaugccuguaaucccagc

SEQ ID NO: 1730694 - RNA, 22 nt, Homo sapiens
uccaaagaggcugccccucuca

SEQ ID NO: 1730695 - RNA, 12 nt, Homo sapiens
uccaacacucca

SEQ ID NO: 1730696 - RNA, 23 nt, Homo sapiens
uccaaugcuucuguugaucucag

SEQ ID NO: 1730697 - RNA, 11 nt, Homo sapiens
uccaaugucaa

SEQ ID NO: 1730698 - RNA, 18 nt, Homo sapiens
uccaaugucaaugugaac

SEQ ID NO: 1730699 - RNA, 16 nt, Homo sapiens
uccagcauuuagcugg

SEQ ID NO: 1730700 - RNA, 13 nt, Homo sapiens
uccaucucucauc

SEQ ID NO: 1730701 - RNA, 20 nt, Homo sapiens
uccaugauuuuaaauuguga

SEQ ID NO: 1730702 - RNA, 16 nt, Homo sapiens
uccauuauuccucuca

SEQ ID NO: 1730703 - RNA, 16 nt, Homo sapiens
uccauuugcaaauaua

SEQ ID NO: 1730704 - RNA, 22 nt, Homo sapiens
ucccaagcugauuuuauucaau

SEQ ID NO: 1730705 - RNA, 17 nt, Homo sapiens
ucccagauggcuggaag

SEQ ID NO: 1730706 - RNA, 15 nt, Homo sapiens
uccccaacaugcacu

SEQ ID NO: 1730707 - RNA, 22 nt, Homo sapiens
ucccucugucccucuccuugcc

SEQ ID NO: 1730708 - RNA, 16 nt, Homo sapiens
ucccuuuggagaugcu

SEQ ID NO: 1730709 - RNA, 18 nt, Homo sapiens
ucccuuuggagaugcuga

SEQ ID NO: 1730710 - RNA, 19 nt, Homo sapiens
uccugaaggaaauucuuau

SEQ ID NO: 1730711 - RNA, 16 nt, Homo sapiens
uccugagccaaggagg

SEQ ID NO: 1730712 - RNA, 18 nt, Homo sapiens
uccugcagauacuuugaa

SEQ ID NO: 1730713 - RNA, 16 nt, Homo sapiens
uccuggguacugaaag

SEQ ID NO: 1730714 - RNA, 23 nt, Homo sapiens
uccuuccugcuugaguucccaga

SEQ ID NO: 1730715 - RNA, 15 nt, Homo sapiens
ucguguacugcaaag

SEQ ID NO: 1730716 - RNA, 19 nt, Homo sapiens
ucuaauggggacacagauc

SEQ ID NO: 1730717 - RNA, 22 nt, Homo sapiens
ucuauguuugcacuugugcuuu

SEQ ID NO: 1730718 - RNA, 14 nt, Homo sapiens
ucucaugacuccua

SEQ ID NO: 1730719 - RNA, 18 nt, Homo sapiens
ucuccagaauaauucuua

SEQ ID NO: 1730720 - RNA, 21 nt, Homo sapiens
ucugcaguucucaugacuccu

SEQ ID NO: 1730721 - RNA, 12 nt, Homo sapiens
ucugcugcugag

SEQ ID NO: 1730722 - RNA, 13 nt, Homo sapiens
ucugcugcugaua

SEQ ID NO: 1730723 - RNA, 21 nt, Homo sapiens
ucuggggggacccagugcaga

SEQ ID NO: 1730724 - RNA, 22 nt, Homo sapiens
ucuggggggacccagugcagaa

SEQ ID NO: 1730725 - RNA, 13 nt, Homo sapiens
ucuguucacuuuc

SEQ ID NO: 1730726 - RNA, 14 nt, Homo sapiens
ucuguugaucucag

SEQ ID NO: 1730727 - RNA, 15 nt, Homo sapiens
ucuguugaucucagu

SEQ ID NO: 1730728 - RNA, 16 nt, Homo sapiens
ucuguugaucucagua

SEQ ID NO: 1730729 - RNA, 17 nt, Homo sapiens
ucuuaugcaaucuaugu

SEQ ID NO: 1730730 - RNA, 14 nt, Homo sapiens
ucuucccaguauua

SEQ ID NO: 1730731 - RNA, 21 nt, Homo sapiens
ucuucuuggggcccagugcau

SEQ ID NO: 1730732 - RNA, 14 nt, Homo sapiens
ucuuguauacacau

SEQ ID NO: 1730733 - RNA, 17 nt, Homo sapiens
ucuuguauacacauaua

SEQ ID NO: 1730734 - RNA, 18 nt, Homo sapiens
ucuuguauacacauauau

SEQ ID NO: 1730735 - RNA, 20 nt, Homo sapiens
ucuuguauacacauauauac

SEQ ID NO: 1730736 - RNA, 18 nt, Homo sapiens
ugaaaccuacacacuguc

SEQ ID NO: 1730737 - RNA, 19 nt, Homo sapiens
ugacaccccugacuuuuau

SEQ ID NO: 1730738 - RNA, 17 nt, Homo sapiens
ugacagccuucuugaug

SEQ ID NO: 1730739 - RNA, 20 nt, Homo sapiens
ugaccucugacaacugugaa

SEQ ID NO: 1730740 - RNA, 20 nt, Homo sapiens
ugagacucagugcagaugga

SEQ ID NO: 1730741 - RNA, 20 nt, Homo sapiens
ugaggucaggaguucaagac

SEQ ID NO: 1730742 - RNA, 21 nt, Homo sapiens
ugaggucaggaguucaagacc

SEQ ID NO: 1730743 - RNA, 19 nt, Homo sapiens
ugaguuuuuacaagaugua

SEQ ID NO: 1730744 - RNA, 18 nt, Homo sapiens
ugauguguccucagggag

SEQ ID NO: 1730745 - RNA, 10 nt, Homo sapiens
ugauuuacag

SEQ ID NO: 1730746 - RNA, 15 nt, Homo sapiens
ugauuuagugaucaa

SEQ ID NO: 1730747 - RNA, 12 nt, Homo sapiens
ugcacagccacu

SEQ ID NO: 1730748 - RNA, 21 nt, Homo sapiens
ugcacauccgcgugugccugu

SEQ ID NO: 1730749 - RNA, 15 nt, Homo sapiens
ugcagauacuuugaa

SEQ ID NO: 1730750 - RNA, 17 nt, Homo sapiens
ugcagcggugguuguca

SEQ ID NO: 1730751 - RNA, 22 nt, Homo sapiens
ugcagguuccgauguuauuaga

SEQ ID NO: 1730752 - RNA, 18 nt, Homo sapiens
ugcauaauaacuacuucc

SEQ ID NO: 1730753 - RNA, 20 nt, Homo sapiens
ugccaugccaggaaccuguc

SEQ ID NO: 1730754 - RNA, 17 nt, Homo sapiens
ugccccccaugaggaag

SEQ ID NO: 1730755 - RNA, 14 nt, Homo sapiens
ugccccucucacca

SEQ ID NO: 1730756 - RNA, 15 nt, Homo sapiens
ugccuucugcugaaa

SEQ ID NO: 1730757 - RNA, 19 nt, Homo sapiens
ugcuccguagcucugcugc

SEQ ID NO: 1730758 - RNA, 20 nt, Homo sapiens
ugcugauacugggucugcga

SEQ ID NO: 1730759 - RNA, 12 nt, Homo sapiens
ugcuggugcaca

SEQ ID NO: 1730760 - RNA, 14 nt, Homo sapiens
ugcuguaugcugau

SEQ ID NO: 1730761 - RNA, 14 nt, Homo sapiens
ugcuguguguccca

SEQ ID NO: 1730762 - RNA, 17 nt, Homo sapiens
ugcuucuguugaucuca

SEQ ID NO: 1730763 - RNA, 13 nt, Homo sapiens
uggaaggggucca

SEQ ID NO: 1730764 - RNA, 22 nt, Homo sapiens
uggacuccaucucucauccucc

SEQ ID NO: 1730765 - RNA, 22 nt, Homo sapiens
uggcccuuuccuuccagauccu

SEQ ID NO: 1730766 - RNA, 17 nt, Homo sapiens
uggcuggaaggggucca

SEQ ID NO: 1730767 - RNA, 22 nt, Homo sapiens
ugggaaaauaaauacauucgaa

SEQ ID NO: 1730768 - RNA, 18 nt, Homo sapiens
ugggccauguccaaagag

SEQ ID NO: 1730769 - RNA, 15 nt, Homo sapiens
uggggacacagauca

SEQ ID NO: 1730770 - RNA, 24 nt, Homo sapiens
uggggcaggcugggccauguccaa

SEQ ID NO: 1730771 - RNA, 19 nt, Homo sapiens
uggggggacccagugcaga

SEQ ID NO: 1730772 - RNA, 19 nt, Homo sapiens
uggucugccuucugcugaa

SEQ ID NO: 1730773 - RNA, 21 nt, Homo sapiens
uggugcuggaaccagcucucu

SEQ ID NO: 1730774 - RNA, 16 nt, Homo sapiens
ugguucccugcugcgc

SEQ ID NO: 1730775 - RNA, 11 nt, Homo sapiens
uguacagguac

SEQ ID NO: 1730776 - RNA, 16 nt, Homo sapiens
uguagcccauccuucc

SEQ ID NO: 1730777 - RNA, 16 nt, Homo sapiens
uguauacacauauaua

SEQ ID NO: 1730778 - RNA, 15 nt, Homo sapiens
uguauauacauauau

SEQ ID NO: 1730779 - RNA, 19 nt, Homo sapiens
uguaugcaguauucuugca

SEQ ID NO: 1730780 - RNA, 20 nt, Homo sapiens
ugucaaugugaacguccaca

SEQ ID NO: 1730781 - RNA, 16 nt, Homo sapiens
ugucaggggaacagag

SEQ ID NO: 1730782 - RNA, 11 nt, Homo sapiens
uguccaaagag

SEQ ID NO: 1730783 - RNA, 15 nt, Homo sapiens
uguccauuugcaaau

SEQ ID NO: 1730784 - RNA, 16 nt, Homo sapiens
ugucccugaaaccuag

SEQ ID NO: 1730785 - RNA, 18 nt, Homo sapiens
ugucuuuguuguagugaa

SEQ ID NO: 1730786 - RNA, 17 nt, Homo sapiens
uguggauggucauugca

SEQ ID NO: 1730787 - RNA, 21 nt, Homo sapiens
uguggcucccuuggugcccuc

SEQ ID NO: 1730788 - RNA, 19 nt, Homo sapiens
ugugucccaggcagggaga

SEQ ID NO: 1730789 - RNA, 13 nt, Homo sapiens
ugugugugcacau

SEQ ID NO: 1730790 - RNA, 15 nt, Homo sapiens
ugugugugugcacau

SEQ ID NO: 1730791 - RNA, 13 nt, Homo sapiens
ugugugugugcgu

SEQ ID NO: 1730792 - RNA, 20 nt, Homo sapiens
uguguuuuuaacaugucaau

SEQ ID NO: 1730793 - RNA, 16 nt, Homo sapiens
uguuauauauuuacuc

SEQ ID NO: 1730794 - RNA, 22 nt, Homo sapiens
uguucccacaccccaacacuuc

SEQ ID NO: 1730795 - RNA, 17 nt, Homo sapiens
uguugccaccauaccuc

SEQ ID NO: 1730796 - RNA, 13 nt, Homo sapiens
uguuguagacuua

SEQ ID NO: 1730797 - RNA, 13 nt, Homo sapiens
uguuguaugggga

SEQ ID NO: 1730798 - RNA, 16 nt, Homo sapiens
uuaaagaucaugacau

SEQ ID NO: 1730799 - RNA, 14 nt, Homo sapiens
uuaauuaaaagugu

SEQ ID NO: 1730800 - RNA, 18 nt, Homo sapiens
uuaauuaauggaaucuuc

SEQ ID NO: 1730801 - RNA, 18 nt, Homo sapiens
uuacaaguuuauauauau

SEQ ID NO: 1730802 - RNA, 13 nt, Homo sapiens
uuacacacugucu

SEQ ID NO: 1730803 - RNA, 17 nt, Homo sapiens
uuacauugccaagucag

SEQ ID NO: 1730804 - RNA, 19 nt, Homo sapiens
uuaccacuuuaaacacccc

SEQ ID NO: 1730805 - RNA, 16 nt, Homo sapiens
uuacgcaaugcuucua

SEQ ID NO: 1730806 - RNA, 20 nt, Homo sapiens
uuagcauauuuuaaugcagu

SEQ ID NO: 1730807 - RNA, 11 nt, Homo sapiens
uuagugcuugu

SEQ ID NO: 1730808 - RNA, 18 nt, Homo sapiens
uuauaacucaacauuugu

SEQ ID NO: 1730809 - RNA, 18 nt, Homo sapiens
uuauaauuggugcauagc

SEQ ID NO: 1730810 - RNA, 21 nt, Homo sapiens
uuauguaugaaaaguaacuga

SEQ ID NO: 1730811 - RNA, 22 nt, Homo sapiens
uuauuccggaaacuaguguaca

SEQ ID NO: 1730812 - RNA, 13 nt, Homo sapiens
uuauuuuugcaca

SEQ ID NO: 1730813 - RNA, 18 nt, Homo sapiens
uucaauaugguuacguug

SEQ ID NO: 1730814 - RNA, 15 nt, Homo sapiens
uucauccuagucuag

SEQ ID NO: 1730815 - RNA, 13 nt, Homo sapiens
uuccaacacucca

SEQ ID NO: 1730816 - RNA, 19 nt, Homo sapiens
uuccaaugcuucuguugau

SEQ ID NO: 1730817 - RNA, 15 nt, Homo sapiens
uucccagcgcugcug

SEQ ID NO: 1730818 - RNA, 15 nt, Homo sapiens
uuccuuucauaccuu

SEQ ID NO: 1730819 - RNA, 14 nt, Homo sapiens
uucguguacugcaa

SEQ ID NO: 1730820 - RNA, 23 nt, Homo sapiens
uucucaugacuccuacuuuucau

SEQ ID NO: 1730821 - RNA, 16 nt, Homo sapiens
uucuuacacacugucu

SEQ ID NO: 1730822 - RNA, 15 nt, Homo sapiens
uucuucuguccugag

SEQ ID NO: 1730823 - RNA, 19 nt, Homo sapiens
uugccugcagggccauggc

SEQ ID NO: 1730824 - RNA, 16 nt, Homo sapiens
uuggggcccagugcau

SEQ ID NO: 1730825 - RNA, 22 nt, Homo sapiens
uugguguauguaugaguaucug

SEQ ID NO: 1730826 - RNA, 23 nt, Homo sapiens
uuguuugugauauuucguguacu

SEQ ID NO: 1730827 - RNA, 18 nt, Homo sapiens
uuguuuuaugcuacugaa

SEQ ID NO: 1730828 - RNA, 17 nt, Homo sapiens
uuuaaccgcacaugcac

SEQ ID NO: 1730829 - RNA, 14 nt, Homo sapiens
uuucaugcagaguu

SEQ ID NO: 1730830 - RNA, 12 nt, Homo sapiens
uuuccuuccaga

SEQ ID NO: 1730831 - RNA, 18 nt, Homo sapiens
uuucuagaguagcuccca

SEQ ID NO: 1730832 - RNA, 17 nt, Homo sapiens
uuucuguuuacugucaa

SEQ ID NO: 1730833 - RNA, 12 nt, Homo sapiens
uuugaugccauu

SEQ ID NO: 1730834 - RNA, 23 nt, Homo sapiens
uuugggaaaauaaauacauucga

SEQ ID NO: 1730835 - RNA, 16 nt, Homo sapiens
uuugugccccacacua

SEQ ID NO: 1730836 - RNA, 20 nt, Homo sapiens
uuuuaagaaaguaauuuaau

SEQ ID NO: 1730837 - RNA, 18 nt, Homo sapiens
uuuuuauuaugcauuaua

SEQ ID NO: 1730838 - RNA, 13 nt, Homo sapiens
uuuuuauuuuugc

SEQ ID NO: 1730839 - RNA, 18 nt, Homo sapiens
aauucuucuguccugaga

SEQ ID NO: 1730840 - RNA, 22 nt, Homo sapiens
aauucuucuguccugagaagca

SEQ ID NO: 1730841 - RNA, 14 nt, Homo sapiens
aauuuacacugcca

SEQ ID NO: 1730842 - RNA, 18 nt, Homo sapiens
aauuuccuuucauaccuu

SEQ ID NO: 1730843 - RNA, 17 nt, Homo sapiens
aauuuuagcucuuccca

SEQ ID NO: 1730844 - RNA, 12 nt, Homo sapiens
aauuuugcugga

SEQ ID NO: 1730845 - RNA, 15 nt, Homo sapiens
acaaaaauuagccag

SEQ ID NO: 1730846 - RNA, 16 nt, Homo sapiens
acaaagagguguacag

SEQ ID NO: 1730847 - RNA, 19 nt, Homo sapiens
acaaagagguguacaggua

SEQ ID NO: 1730848 - RNA, 22 nt, Homo sapiens
acaacuuuugagaguauagcau

SEQ ID NO: 1730849 - RNA, 15 nt, Homo sapiens
acaccccaacacuuc

SEQ ID NO: 1730850 - RNA, 20 nt, Homo sapiens
acagacauacauuuaugcac

SEQ ID NO: 1730851 - RNA, 13 nt, Homo sapiens
acagaccacagag

SEQ ID NO: 1730852 - RNA, 19 nt, Homo sapiens
acagcuaucgaacuucaca

SEQ ID NO: 1730853 - RNA, 22 nt, Homo sapiens
acaugaagcuguugugugaggu

SEQ ID NO: 1730854 - RNA, 16 nt, Homo sapiens
acaugucaaucugucc

SEQ ID NO: 1730855 - RNA, 17 nt, Homo sapiens
acauugauaaaagcauu

SEQ ID NO: 1730856 - RNA, 11 nt, Homo sapiens
accagcucucu

SEQ ID NO: 1730857 - RNA, 21 nt, Homo sapiens
accaggcagugugccaguuua

SEQ ID NO: 1730858 - RNA, 9 nt, Homo sapiens
acccagugc

SEQ ID NO: 1730859 - RNA, 19 nt, Homo sapiens
acccaugcaagcagaggac

SEQ ID NO: 1730860 - RNA, 14 nt, Homo sapiens
acccugggggcaca

SEQ ID NO: 1730861 - RNA, 19 nt, Homo sapiens
accuauugcacuccauccu

SEQ ID NO: 1730862 - RNA, 19 nt, Homo sapiens
accuccaggcuuucccacu

SEQ ID NO: 1730863 - RNA, 13 nt, Homo sapiens
accugccaugcca

SEQ ID NO: 1730864 - RNA, 21 nt, Homo sapiens
accugucaucauggaggucau

SEQ ID NO: 1730865 - RNA, 14 nt, Homo sapiens
acuacuauauugau

SEQ ID NO: 1730866 - RNA, 16 nt, Homo sapiens
acuagugacagcuugu

SEQ ID NO: 1730867 - RNA, 14 nt, Homo sapiens
acucagugcagaug

SEQ ID NO: 1730868 - RNA, 16 nt, Homo sapiens
acugaaauauaccuuu

SEQ ID NO: 1730869 - RNA, 16 nt, Homo sapiens
acugcaaaguguaugc

SEQ ID NO: 1730870 - RNA, 20 nt, Homo sapiens
acugcccuuucaaagcacuu

SEQ ID NO: 1730871 - RNA, 18 nt, Homo sapiens
acuuagucuguacuucau

SEQ ID NO: 1730872 - RNA, 16 nt, Homo sapiens
acuuugaagugcagcu

SEQ ID NO: 1730873 - RNA, 17 nt, Homo sapiens
acuuugccacugcugua

SEQ ID NO: 1730874 - RNA, 14 nt, Homo sapiens
acuuuuauuaaaga

SEQ ID NO: 1730875 - RNA, 12 nt, Homo sapiens
acuuuucauccu

SEQ ID NO: 1730876 - RNA, 18 nt, Homo sapiens
agaaaccacagucuuccc

SEQ ID NO: 1730877 - RNA, 17 nt, Homo sapiens
agaaagaaguccuuucu

SEQ ID NO: 1730878 - RNA, 22 nt, Homo sapiens
agaagcccugauguguccucag

SEQ ID NO: 1730879 - RNA, 15 nt, Homo sapiens
agacucagugcagau

SEQ ID NO: 1730880 - RNA, 14 nt, Homo sapiens
agagaccuauguaa

SEQ ID NO: 1730881 - RNA, 12 nt, Homo sapiens
agagcugucacu

SEQ ID NO: 1730882 - RNA, 16 nt, Homo sapiens
agaggaacagcacugg

SEQ ID NO: 1730883 - RNA, 23 nt, Homo sapiens
agaggugucacccaaaccggcag

SEQ ID NO: 1730884 - RNA, 15 nt, Homo sapiens
agagucaugggagag

SEQ ID NO: 1730885 - RNA, 11 nt, Homo sapiens
agaucaugaca

SEQ ID NO: 1730886 - RNA, 19 nt, Homo sapiens
agaucaugacauaugacuu

SEQ ID NO: 1730887 - RNA, 20 nt, Homo sapiens
agaucguaccuauugcacuc

SEQ ID NO: 1730888 - RNA, 22 nt, Homo sapiens
agcaauuauuacaauucuugaa

SEQ ID NO: 1730889 - RNA, 13 nt, Homo sapiens
agcagagcaggca

SEQ ID NO: 1730890 - RNA, 20 nt, Homo sapiens
agcagaggaccagggccuuu

SEQ ID NO: 1730891 - RNA, 14 nt, Homo sapiens
agcaggcaauuuca

SEQ ID NO: 1730892 - RNA, 18 nt, Homo sapiens
agcauucugcaacauuua

SEQ ID NO: 1730893 - RNA, 18 nt, Homo sapiens
agcccugauguguccuca

SEQ ID NO: 1730894 - RNA, 13 nt, Homo sapiens
agccugcagggaa

SEQ ID NO: 1730895 - RNA, 15 nt, Homo sapiens
agcguggggacuucu

SEQ ID NO: 1730896 - RNA, 14 nt, Homo sapiens
caauuuacacugcc

SEQ ID NO: 1730897 - RNA, 22 nt, Homo sapiens
caauuucaccaccaaaugccaa

SEQ ID NO: 1730898 - RNA, 19 nt, Homo sapiens
caauuucacuuagucugua

SEQ ID NO: 1730899 - RNA, 15 nt, Homo sapiens
cacacccugacuuca

SEQ ID NO: 1730900 - RNA, 20 nt, Homo sapiens
cacagucuucccagcaauua

SEQ ID NO: 1730901 - RNA, 22 nt, Homo sapiens
caccaaggaaacgcuaccucuc

SEQ ID NO: 1730902 - RNA, 18 nt, Homo sapiens
caccacgggacaucacag

SEQ ID NO: 1730903 - RNA, 15 nt, Homo sapiens
cacccacuuugucca

SEQ ID NO: 1730904 - RNA, 14 nt, Homo sapiens
caccccaacacuuc

SEQ ID NO: 1730905 - RNA, 12 nt, Homo sapiens
caccgcaguuuu

SEQ ID NO: 1730906 - RNA, 23 nt, Homo sapiens
caccgccuccccaccuccaggcu

SEQ ID NO: 1730907 - RNA, 18 nt, Homo sapiens
caccugucaucauggagg

SEQ ID NO: 1730908 - RNA, 13 nt, Homo sapiens
caccuugugccug

SEQ ID NO: 1730909 - RNA, 23 nt, Homo sapiens
cacugcuguauuuuuauuuuugc

SEQ ID NO: 1730910 - RNA, 17 nt, Homo sapiens
cacuguaugauuuauaa

SEQ ID NO: 1730911 - RNA, 15 nt, Homo sapiens
cacuuccagcauuua

SEQ ID NO: 1730912 - RNA, 15 nt, Homo sapiens
cacuuuguccauuug

SEQ ID NO: 1730913 - RNA, 18 nt, Homo sapiens
cagaccacagagcuguca

SEQ ID NO: 1730914 - RNA, 13 nt, Homo sapiens
cagacucugucuc

SEQ ID NO: 1730915 - RNA, 15 nt, Homo sapiens
cagagucaugggaga

SEQ ID NO: 1730916 - RNA, 23 nt, Homo sapiens
cagcaugaggacagaccacagag

SEQ ID NO: 1730917 - RNA, 18 nt, Homo sapiens
cagccacuccccggcaug

SEQ ID NO: 1730918 - RNA, 18 nt, Homo sapiens
cagcuuuaaaaucuguuc

SEQ ID NO: 1730919 - RNA, 17 nt, Homo sapiens
caggcugggccaugucc

SEQ ID NO: 1730920 - RNA, 23 nt, Homo sapiens
caggcugggccauguccaaagag

SEQ ID NO: 1730921 - RNA, 19 nt, Homo sapiens
caggcuucugcaguucuca

SEQ ID NO: 1730922 - RNA, 12 nt, Homo sapiens
cagggugggccu

SEQ ID NO: 1730923 - RNA, 12 nt, Homo sapiens
caggugccugua

SEQ ID NO: 1730924 - RNA, 15 nt, Homo sapiens
caggugccuguaauc

SEQ ID NO: 1730925 - RNA, 19 nt, Homo sapiens
caguaaauguacaacugca

SEQ ID NO: 1730926 - RNA, 17 nt, Homo sapiens
cagugccucaccuucca

SEQ ID NO: 1730927 - RNA, 18 nt, Homo sapiens
cauacaaagagguguaca

SEQ ID NO: 1730928 - RNA, 18 nt, Homo sapiens
cauacaugcauacaaaga

SEQ ID NO: 1730929 - RNA, 19 nt, Homo sapiens
cauauauacccacauguac

SEQ ID NO: 1730930 - RNA, 16 nt, Homo sapiens
cauaugacuugaucuu

SEQ ID NO: 1730931 - RNA, 21 nt, Homo sapiens
caucaaagcucacaccaaauu

SEQ ID NO: 1730932 - RNA, 12 nt, Homo sapiens
caucaaggucag

SEQ ID NO: 1730933 - RNA, 22 nt, Homo sapiens
caucauggaggucauacaugca

SEQ ID NO: 1730934 - RNA, 14 nt, Homo sapiens
cauccgcgugugcc

SEQ ID NO: 1730935 - RNA, 16 nt, Homo sapiens
cauccgcgugugccug

SEQ ID NO: 1730936 - RNA, 13 nt, Homo sapiens
caugacauaugac

SEQ ID NO: 1730937 - RNA, 20 nt, Homo sapiens
caugagacucagugcagaug

SEQ ID NO: 1730938 - RNA, 20 nt, Homo sapiens
cucaccuuccaacacuccau

SEQ ID NO: 1730939 - RNA, 15 nt, Homo sapiens
cucaugccuguaauc

SEQ ID NO: 1730940 - RNA, 19 nt, Homo sapiens
cucaugccuguaaucccag

SEQ ID NO: 1730941 - RNA, 22 nt, Homo sapiens
cuccauccugcagauacuuuga

SEQ ID NO: 1730942 - RNA, 17 nt, Homo sapiens
cuccauuauuccucuca

SEQ ID NO: 1730943 - RNA, 18 nt, Homo sapiens
cuccucaguaaauguaca

SEQ ID NO: 1730944 - RNA, 16 nt, Homo sapiens
cucuacaaaaauacaa

SEQ ID NO: 1730945 - RNA, 22 nt, Homo sapiens
cucugacaacugugaagccacc

SEQ ID NO: 1730946 - RNA, 16 nt, Homo sapiens
cucuggccuugcccca

SEQ ID NO: 1730947 - RNA, 19 nt, Homo sapiens
cucuucuuggggcccagug

SEQ ID NO: 1730948 - RNA, 12 nt, Homo sapiens
cucuugaugcca

SEQ ID NO: 1730949 - RNA, 17 nt, Homo sapiens
cugaaagccuuagggaa

SEQ ID NO: 1730950 - RNA, 19 nt, Homo sapiens
cugaagaugggagccuuua

SEQ ID NO: 1730951 - RNA, 15 nt, Homo sapiens
cugacuucagggaag

SEQ ID NO: 1730952 - RNA, 18 nt, Homo sapiens
cugauacugggucugcga

SEQ ID NO: 1730953 - RNA, 13 nt, Homo sapiens
cugcccaaugaga

SEQ ID NO: 1730954 - RNA, 18 nt, Homo sapiens
cugcccuuucaaagcacu

SEQ ID NO: 1730955 - RNA, 15 nt, Homo sapiens
cugccgcuaccuccc

SEQ ID NO: 1730956 - RNA, 18 nt, Homo sapiens
cugcugaaagacucgaga

SEQ ID NO: 1730957 - RNA, 18 nt, Homo sapiens
cugcugagacgccacgga

SEQ ID NO: 1730958 - RNA, 15 nt, Homo sapiens
cugggccauguccaa

SEQ ID NO: 1730959 - RNA, 20 nt, Homo sapiens
cugggcuaauauacuuguaa

SEQ ID NO: 1730960 - RNA, 17 nt, Homo sapiens
cuggggggacccagugc

SEQ ID NO: 1730961 - RNA, 21 nt, Homo sapiens
cuggggggacccagugcagaa

SEQ ID NO: 1730962 - RNA, 11 nt, Homo sapiens
cuggugcacag

SEQ ID NO: 1730963 - RNA, 17 nt, Homo sapiens
cugguucccugcugcgc

SEQ ID NO: 1730964 - RNA, 22 nt, Homo sapiens
cuguacuguuacugggcccuga

SEQ ID NO: 1730965 - RNA, 18 nt, Homo sapiens
cugucaaaauauuucuca

SEQ ID NO: 1730966 - RNA, 19 nt, Homo sapiens
cugucccuugcuguaugcu

SEQ ID NO: 1730967 - RNA, 23 nt, Homo sapiens
cuguuggucugccuucugcugaa

SEQ ID NO: 1730968 - RNA, 15 nt, Homo sapiens
cuuaucaacuaauga

SEQ ID NO: 1730969 - RNA, 16 nt, Homo sapiens
cuuaugcaaucuaugu

SEQ ID NO: 1730970 - RNA, 18 nt, Homo sapiens
cuucaaagcaagcuggua

SEQ ID NO: 1730971 - RNA, 23 nt, Homo sapiens
cuucaucauucccucucaucuca

SEQ ID NO: 1730972 - RNA, 23 nt, Homo sapiens
cuuccagcauuuagcuggccaca

SEQ ID NO: 1730973 - RNA, 18 nt, Homo sapiens
cuuccaggggaaccugcc

SEQ ID NO: 1730974 - RNA, 17 nt, Homo sapiens
cuuccuuuaggaucuca

SEQ ID NO: 1730975 - RNA, 18 nt, Homo sapiens
cuuccuuuaggaucucag

SEQ ID NO: 1730976 - RNA, 19 nt, Homo sapiens
cuucuguugaucucaguau

SEQ ID NO: 1730977 - RNA, 23 nt, Homo sapiens
cuugaaaagcuaguguaccuccu

SEQ ID NO: 1730978 - RNA, 16 nt, Homo sapiens
cuugaaguauguguuu

SEQ ID NO: 1730979 - RNA, 15 nt, Homo sapiens
cuugaccuguuucuc

SEQ ID NO: 1730980 - RNA, 15 nt, Homo sapiens
auuucguguacugca

SEQ ID NO: 1730981 - RNA, 14 nt, Homo sapiens
auuucucaucugca

SEQ ID NO: 1730982 - RNA, 23 nt, Homo sapiens
auuuggcuagcaaucugccugua

SEQ ID NO: 1730983 - RNA, 17 nt, Homo sapiens
auuuguaaagcuauuua

SEQ ID NO: 1730984 - RNA, 18 nt, Homo sapiens
auuuguuuuaugcuacug

SEQ ID NO: 1730985 - RNA, 16 nt, Homo sapiens
auuuuucuaucaaaua

SEQ ID NO: 1730986 - RNA, 12 nt, Homo sapiens
auuuuugcacaa

SEQ ID NO: 1730987 - RNA, 13 nt, Homo sapiens
caaagaggcugcc

SEQ ID NO: 1730988 - RNA, 22 nt, Homo sapiens
caaauaaaacuagugacagcuu

SEQ ID NO: 1730989 - RNA, 18 nt, Homo sapiens
caaaucuaccacuguaug

SEQ ID NO: 1730990 - RNA, 19 nt, Homo sapiens
caaaucuaccacuguauga

SEQ ID NO: 1730991 - RNA, 21 nt, Homo sapiens
caaauuuccuuucauaccuug

SEQ ID NO: 1730992 - RNA, 16 nt, Homo sapiens
caacaugcacugaugu

SEQ ID NO: 1730993 - RNA, 17 nt, Homo sapiens
caagcugguauuuucau

SEQ ID NO: 1730994 - RNA, 16 nt, Homo sapiens
caaggugccuguuaua

SEQ ID NO: 1730995 - RNA, 13 nt, Homo sapiens
caaguuuccauag

SEQ ID NO: 1730996 - RNA, 20 nt, Homo sapiens
caaucugccuguaucucuca

SEQ ID NO: 1730997 - RNA, 20 nt, Homo sapiens
caaucuguccguucacaugu

SEQ ID NO: 1730998 - RNA, 21 nt, Homo sapiens
caaugcuucuguugaucucag

SEQ ID NO: 1730999 - RNA, 23 nt, Homo sapiens
caauggugucaguauccaggcuu

SEQ ID NO: 1731000 - RNA, 16 nt, Homo sapiens
cacaccccaacacuuc

SEQ ID NO: 1731001 - RNA, 19 nt, Homo sapiens
cacaccccaacacuuccag

SEQ ID NO: 1731002 - RNA, 22 nt, Homo sapiens
cacacgcuuucuuaugcaaucu

SEQ ID NO: 1731003 - RNA, 15 nt, Homo sapiens
cacacugucuguaua

SEQ ID NO: 1731004 - RNA, 19 nt, Homo sapiens
cacaugaaaccuacacacu

SEQ ID NO: 1731005 - RNA, 22 nt, Homo sapiens
caccaggaauccccaacaugca

SEQ ID NO: 1731006 - RNA, 16 nt, Homo sapiens
caccccugacuuuuau

SEQ ID NO: 1731007 - RNA, 20 nt, Homo sapiens
cacccugcugcuggugcaca

SEQ ID NO: 1731008 - RNA, 23 nt, Homo sapiens
caccuccaggcuuucccacuucc

SEQ ID NO: 1731009 - RNA, 17 nt, Homo sapiens
cacuauguauauacaua

SEQ ID NO: 1731010 - RNA, 20 nt, Homo sapiens
cacugucaugcuucaucauu

SEQ ID NO: 1731011 - RNA, 12 nt, Homo sapiens
cacuuccagggg

SEQ ID NO: 1731012 - RNA, 19 nt, Homo sapiens
cagaagaccccugacucau

SEQ ID NO: 1731013 - RNA, 19 nt, Homo sapiens
cagacauacauuuaugcac

SEQ ID NO: 1731014 - RNA, 22 nt, Homo sapiens
cagacauacauuuaugcacauu

SEQ ID NO: 1731015 - RNA, 14 nt, Homo sapiens
cagagaccuaugua

SEQ ID NO: 1731016 - RNA, 22 nt, Homo sapiens
cagauacuuugaagugcagcuc

SEQ ID NO: 1731017 - RNA, 21 nt, Homo sapiens
cagcaauggugucaguaucca

SEQ ID NO: 1731018 - RNA, 22 nt, Homo sapiens
cagcaugaggacagaccacaga

SEQ ID NO: 1731019 - RNA, 12 nt, Homo sapiens
cagcuuaucucu

SEQ ID NO: 1731020 - RNA, 16 nt, Homo sapiens
cagcuuggcccuuucc

SEQ ID NO: 1731021 - RNA, 17 nt, Homo sapiens
caggaaauacuuuguaa

SEQ ID NO: 1731022 - RNA, 18 nt, Homo sapiens
caggaauccccaacaugc

SEQ ID NO: 1731023 - RNA, 19 nt, Homo sapiens
caggaauccccaacaugca

SEQ ID NO: 1731024 - RNA, 18 nt, Homo sapiens
caggcugggccaugucca

SEQ ID NO: 1731025 - RNA, 19 nt, Homo sapiens
caggcugggccauguccaa

SEQ ID NO: 1731026 - RNA, 22 nt, Homo sapiens
caggcugggccauguccaaaga

SEQ ID NO: 1731027 - RNA, 13 nt, Homo sapiens
caggcuuuguaca

SEQ ID NO: 1731028 - RNA, 14 nt, Homo sapiens
caguaaauguacaa

SEQ ID NO: 1731029 - RNA, 20 nt, Homo sapiens
caguauccaggcuuuguaca

SEQ ID NO: 1731030 - RNA, 14 nt, Homo sapiens
cauaaaugaaucau

SEQ ID NO: 1731031 - RNA, 14 nt, Homo sapiens
cauacaugcauaca

SEQ ID NO: 1731032 - RNA, 15 nt, Homo sapiens
cauacauuuaugcac

SEQ ID NO: 1731033 - RNA, 13 nt, Homo sapiens
cauaccuccuucc

SEQ ID NO: 1731034 - RNA, 19 nt, Homo sapiens
caucauggaggucauacau

SEQ ID NO: 1731035 - RNA, 23 nt, Homo sapiens
caucauggaggucauacaugcau

SEQ ID NO: 1731036 - RNA, 17 nt, Homo sapiens
caugagacucagugcag

SEQ ID NO: 1731037 - RNA, 18 nt, Homo sapiens
ccaacacuuccagcauuu

SEQ ID NO: 1731038 - RNA, 22 nt, Homo sapiens
ccaacugcaggaaaacccuuaa

SEQ ID NO: 1731039 - RNA, 15 nt, Homo sapiens
ccacacccacuuugu

SEQ ID NO: 1731040 - RNA, 17 nt, Homo sapiens
ccacauguacagacaua

SEQ ID NO: 1731041 - RNA, 20 nt, Homo sapiens
ccacauguacagacauacau

SEQ ID NO: 1731042 - RNA, 22 nt, Homo sapiens
ccagaauaauucuuaacagugg

SEQ ID NO: 1731043 - RNA, 19 nt, Homo sapiens
ccagaggugucacccaaac

SEQ ID NO: 1731044 - RNA, 15 nt, Homo sapiens
ccagugcuccaggca

SEQ ID NO: 1731045 - RNA, 19 nt, Homo sapiens
ccauccuucagugaacuaa

SEQ ID NO: 1731046 - RNA, 21 nt, Homo sapiens
ccauguccaaagaggcugccc

SEQ ID NO: 1731047 - RNA, 12 nt, Homo sapiens
cccagggggaga

SEQ ID NO: 1731048 - RNA, 13 nt, Homo sapiens
ccccaacacuucc

SEQ ID NO: 1731049 - RNA, 17 nt, Homo sapiens
ccccaacaugcacugau

SEQ ID NO: 1731050 - RNA, 13 nt, Homo sapiens
ccccucucaccaa

SEQ ID NO: 1731051 - RNA, 12 nt, Homo sapiens
ccgaauccacag

SEQ ID NO: 1731052 - RNA, 14 nt, Homo sapiens
ccgcacaugcacac

SEQ ID NO: 1731053 - RNA, 23 nt, Homo sapiens
ccgcagaagcccugauguguccu

SEQ ID NO: 1731054 - RNA, 16 nt, Homo sapiens
ccuagucuagcauucu

SEQ ID NO: 1731055 - RNA, 14 nt, Homo sapiens
ccuauuucaugcag

SEQ ID NO: 1731056 - RNA, 21 nt, Homo sapiens
ccuauuucaugcagaguugaa

SEQ ID NO: 1731057 - RNA, 18 nt, Homo sapiens
ccucagggagcagggaag

SEQ ID NO: 1731058 - RNA, 23 nt, Homo sapiens
ccucaguaaauguacaacugcac

SEQ ID NO: 1731059 - RNA, 12 nt, Homo sapiens
ccucucaccaaa

SEQ ID NO: 1731060 - RNA, 16 nt, Homo sapiens
ccucucaccccacucc

SEQ ID NO: 1731061 - RNA, 19 nt, Homo sapiens
ccugaagaugggagccuuu

SEQ ID NO: 1731062 - RNA, 21 nt, Homo sapiens
ccugggugaucugcugcugag

SEQ ID NO: 1731063 - RNA, 17 nt, Homo sapiens
ccuucagugaacuaagu

SEQ ID NO: 1731064 - RNA, 17 nt, Homo sapiens
ccuuccaaugcuucugu

SEQ ID NO: 1731065 - RNA, 12 nt, Homo sapiens
ccuucugcugaa

SEQ ID NO: 1731066 - RNA, 23 nt, Homo sapiens
ccuugcaagguuaagcaaggugg

SEQ ID NO: 1731067 - RNA, 16 nt, Homo sapiens
ccuuggcugacaugaa

SEQ ID NO: 1731068 - RNA, 14 nt, Homo sapiens
ccuuuaggaucuca

SEQ ID NO: 1731069 - RNA, 23 nt, Homo sapiens
ccuuuaggaucucaggcuucugc

SEQ ID NO: 1731070 - RNA, 13 nt, Homo sapiens
ccuuuccuuccag

SEQ ID NO: 1731071 - RNA, 22 nt, Homo sapiens
cgcaaugcuucuagaguuuuau

SEQ ID NO: 1731072 - RNA, 13 nt, Homo sapiens
cgcaucuugccuc

SEQ ID NO: 1731073 - RNA, 13 nt, Homo sapiens
cggguaccugaag

SEQ ID NO: 1731074 - RNA, 13 nt, Homo sapiens
cuaagauuaccuu

SEQ ID NO: 1731075 - RNA, 18 nt, Homo sapiens
cuaauauuccacguuugu

SEQ ID NO: 1731076 - RNA, 19 nt, Homo sapiens
cuaauggggacacagauca

SEQ ID NO: 1731077 - RNA, 18 nt, Homo sapiens
cuacaaccaauuuacacu

SEQ ID NO: 1731078 - RNA, 12 nt, Homo sapiens
cuaccacuguau

SEQ ID NO: 1731079 - RNA, 13 nt, Homo sapiens
cuacuauauugau

SEQ ID NO: 1731080 - RNA, 12 nt, Homo sapiens
ugcgaugcagcg

SEQ ID NO: 1731081 - RNA, 17 nt, Homo sapiens
ugcucuaggaagacauu

SEQ ID NO: 1731082 - RNA, 16 nt, Homo sapiens
ugcuggaauuccuaac

SEQ ID NO: 1731083 - RNA, 13 nt, Homo sapiens
ugcuggugcacag

SEQ ID NO: 1731084 - RNA, 21 nt, Homo sapiens
ugcuguaugcugaucaucgcc

SEQ ID NO: 1731085 - RNA, 12 nt, Homo sapiens
uggaaacuaaga

SEQ ID NO: 1731086 - RNA, 18 nt, Homo sapiens
uggaacauauagaaugca

SEQ ID NO: 1731087 - RNA, 19 nt, Homo sapiens
uggagagaagcaagccagc

SEQ ID NO: 1731088 - RNA, 16 nt, Homo sapiens
uggagagacagcuaca

SEQ ID NO: 1731089 - RNA, 17 nt, Homo sapiens
uggcagucccuuauaau

SEQ ID NO: 1731090 - RNA, 17 nt, Homo sapiens
uggccagaggugucacc

SEQ ID NO: 1731091 - RNA, 22 nt, Homo sapiens
ugggcagggucuguuuggacug

SEQ ID NO: 1731092 - RNA, 21 nt, Homo sapiens
ugggcccacccggugggaccc

SEQ ID NO: 1731093 - RNA, 18 nt, Homo sapiens
ugggcuacagaaaccaca

SEQ ID NO: 1731094 - RNA, 13 nt, Homo sapiens
uggggcccagugc

SEQ ID NO: 1731095 - RNA, 15 nt, Homo sapiens
uggggcccagugcau

SEQ ID NO: 1731096 - RNA, 21 nt, Homo sapiens
uggguacugaaagccuuaggg

SEQ ID NO: 1731097 - RNA, 10 nt, Homo sapiens
ugggugcugc

SEQ ID NO: 1731098 - RNA, 14 nt, Homo sapiens
uggugcuggaacca

SEQ ID NO: 1731099 - RNA, 15 nt, Homo sapiens
ugguguauguaugag

SEQ ID NO: 1731100 - RNA, 18 nt, Homo sapiens
ugguucguucuguacugu

SEQ ID NO: 1731101 - RNA, 15 nt, Homo sapiens
uguaagugggcccac

SEQ ID NO: 1731102 - RNA, 19 nt, Homo sapiens
uguaauauuucuucaaaua

SEQ ID NO: 1731103 - RNA, 13 nt, Homo sapiens
uguacaacugcac

SEQ ID NO: 1731104 - RNA, 17 nt, Homo sapiens
uguagacuuaacacuuc

SEQ ID NO: 1731105 - RNA, 14 nt, Homo sapiens
uguauacacauaua

SEQ ID NO: 1731106 - RNA, 23 nt, Homo sapiens
uguauauuuguuuuaugcuacug

SEQ ID NO: 1731107 - RNA, 23 nt, Homo sapiens
uguaugaguaucuguauguauau

SEQ ID NO: 1731108 - RNA, 22 nt, Homo sapiens
uguauggaaucccacuguauga

SEQ ID NO: 1731109 - RNA, 21 nt, Homo sapiens
uguauuuuuauuuuugcacaa

SEQ ID NO: 1731110 - RNA, 13 nt, Homo sapiens
ugucaaugugaac

SEQ ID NO: 1731111 - RNA, 17 nt, Homo sapiens
uguccaaagaggcugcc

SEQ ID NO: 1731112 - RNA, 13 nt, Homo sapiens
uguccagcaccuu

SEQ ID NO: 1731113 - RNA, 20 nt, Homo sapiens
uguccagcaccuugugccug

SEQ ID NO: 1731114 - RNA, 18 nt, Homo sapiens
ugucucaaaacaaacaaa

SEQ ID NO: 1731115 - RNA, 14 nt, Homo sapiens
ugucuuaccaguga

SEQ ID NO: 1731116 - RNA, 19 nt, Homo sapiens
ugugagguucgcuuaucaa

SEQ ID NO: 1731117 - RNA, 18 nt, Homo sapiens
ugugauauuucguguacu

SEQ ID NO: 1731118 - RNA, 21 nt, Homo sapiens
ugugccccacacuaacgugug

SEQ ID NO: 1731119 - RNA, 23 nt, Homo sapiens
ugugccugggguguuaguggcac

SEQ ID NO: 1731120 - RNA, 13 nt, Homo sapiens
ugugggggguccu

SEQ ID NO: 1731121 - RNA, 21 nt, Homo sapiens
ugugucccgaauccacagucg

SEQ ID NO: 1731122 - RNA, 17 nt, Homo sapiens
ugugucuuacauugcca

SEQ ID NO: 1731123 - RNA, 14 nt, Homo sapiens
ugugugugugcaca

SEQ ID NO: 1731124 - RNA, 16 nt, Homo sapiens
ugugugugugugcaca

SEQ ID NO: 1731125 - RNA, 13 nt, Homo sapiens
uguuugugauauu

SEQ ID NO: 1731126 - RNA, 16 nt, Homo sapiens
uguuuguuucauauau

SEQ ID NO: 1731127 - RNA, 16 nt, Homo sapiens
uguuuuugacagccuu

SEQ ID NO: 1731128 - RNA, 11 nt, Homo sapiens
uuaacaugucg

SEQ ID NO: 1731129 - RNA, 18 nt, Homo sapiens
uuaaccgcacaugcacac

SEQ ID NO: 1731130 - RNA, 17 nt, Homo sapiens
uuaauguuauaucauau

SEQ ID NO: 1731131 - RNA, 21 nt, Homo sapiens
uuacaagauguauuuguugua

SEQ ID NO: 1731132 - RNA, 22 nt, Homo sapiens
uuacugcccuuucaaagcacuu

SEQ ID NO: 1731133 - RNA, 13 nt, Homo sapiens
uuaggaucucagg

SEQ ID NO: 1731134 - RNA, 21 nt, Homo sapiens
uuauaaauaaacuguugcucg

SEQ ID NO: 1731135 - RNA, 23 nt, Homo sapiens
uuauacagauagaguuccauaua

SEQ ID NO: 1731136 - RNA, 20 nt, Homo sapiens
uuauucuccagaauaauucu

SEQ ID NO: 1731137 - RNA, 22 nt, Homo sapiens
uucagauccuuuuauucuccag

SEQ ID NO: 1731138 - RNA, 14 nt, Homo sapiens
uucauuauguauga

SEQ ID NO: 1731139 - RNA, 19 nt, Homo sapiens
uuccaacacuccauuauuc

SEQ ID NO: 1731140 - RNA, 22 nt, Homo sapiens
uuccccgagugacucuggauuu

SEQ ID NO: 1731141 - RNA, 23 nt, Homo sapiens
uucugaggcccugcccaaugaga

SEQ ID NO: 1731142 - RNA, 23 nt, Homo sapiens
uucuguccugagaagcauguaau

SEQ ID NO: 1731143 - RNA, 16 nt, Homo sapiens
uucuucuguccugaga

SEQ ID NO: 1731144 - RNA, 15 nt, Homo sapiens
uucuuuacaauuuca

SEQ ID NO: 1731145 - RNA, 12 nt, Homo sapiens
uucuuucuagag

SEQ ID NO: 1731146 - RNA, 17 nt, Homo sapiens
uugaccgggagacagag

SEQ ID NO: 1731147 - RNA, 18 nt, Homo sapiens
uuguaggagaaacuccca

SEQ ID NO: 1731148 - RNA, 21 nt, Homo sapiens
uuguaggagaaacucccaugu

SEQ ID NO: 1731149 - RNA, 16 nt, Homo sapiens
uuuaaaaucuguucac

SEQ ID NO: 1731150 - RNA, 14 nt, Homo sapiens
uuuaggaucucagg

SEQ ID NO: 1731151 - RNA, 17 nt, Homo sapiens
uuuauccaaaaugugua

SEQ ID NO: 1731152 - RNA, 14 nt, Homo sapiens
uuucaaagcacuua

SEQ ID NO: 1731153 - RNA, 12 nt, Homo sapiens
uuucuuccugca

SEQ ID NO: 1731154 - RNA, 16 nt, Homo sapiens
uuugaagugcagcuca

SEQ ID NO: 1731155 - RNA, 21 nt, Homo sapiens
uuugcacaacuuuugagagua

SEQ ID NO: 1731156 - RNA, 22 nt, Homo sapiens
uuugggaaaauaaauacauucg

SEQ ID NO: 1731157 - RNA, 14 nt, Homo sapiens
uuuuaacaugucaa

SEQ ID NO: 1731158 - RNA, 18 nt, Homo sapiens
uuuuccuauuuauuugag

SEQ ID NO: 1731159 - RNA, 14 nt, Homo sapiens
uuuucuaucaaaua

SEQ ID NO: 1731160 - RNA, 20 nt, Homo sapiens
uuuuguauuguuuucugaca

SEQ ID NO: 1731161 - RNA, 21 nt, Homo sapiens
aaaaaauuuuagcucuuccca

SEQ ID NO: 1731162 - RNA, 15 nt, Homo sapiens
aaaagaaaccuucca

SEQ ID NO: 1731163 - RNA, 19 nt, Homo sapiens
aaagaaaccuuccaaugcu

SEQ ID NO: 1731164 - RNA, 20 nt, Homo sapiens
aaagaggcugccccucucac

SEQ ID NO: 1731165 - RNA, 13 nt, Homo sapiens
aaagccuuaggga

SEQ ID NO: 1731166 - RNA, 19 nt, Homo sapiens
aaagcuaguguaccuccuc

SEQ ID NO: 1731167 - RNA, 16 nt, Homo sapiens
aaagcugagccugcag

SEQ ID NO: 1731168 - RNA, 23 nt, Homo sapiens
aaagcuuggagggaagccgugaa

SEQ ID NO: 1731169 - RNA, 15 nt, Homo sapiens
aaaucuaccacugua

SEQ ID NO: 1731170 - RNA, 18 nt, Homo sapiens
aaaucuucccaguauuau

SEQ ID NO: 1731171 - RNA, 15 nt, Homo sapiens
aaauguacaacugca

SEQ ID NO: 1731172 - RNA, 17 nt, Homo sapiens
aacaacauccacuguua

SEQ ID NO: 1731173 - RNA, 22 nt, Homo sapiens
cgguuuuuuauuuucuuuacaa

SEQ ID NO: 1731174 - RNA, 19 nt, Homo sapiens
cguacugauucuaaugggg

SEQ ID NO: 1731175 - RNA, 19 nt, Homo sapiens
cgucucuacaaaaauacaa

SEQ ID NO: 1731176 - RNA, 22 nt, Homo sapiens
cuaacgcaggagaaucacuuga

SEQ ID NO: 1731177 - RNA, 22 nt, Homo sapiens
cuaaugauuuagugaucaaauu

SEQ ID NO: 1731178 - RNA, 16 nt, Homo sapiens
cuaauggggacacaga

SEQ ID NO: 1731179 - RNA, 22 nt, Homo sapiens
cuaguguacauuucuauaaaua

SEQ ID NO: 1731180 - RNA, 16 nt, Homo sapiens
cuauguuuccauuugu

SEQ ID NO: 1731181 - RNA, 16 nt, Homo sapiens
cucagggagcagggaa

SEQ ID NO: 1731182 - RNA, 17 nt, Homo sapiens
cucagggagcagggaag

SEQ ID NO: 1731183 - RNA, 10 nt, Homo sapiens
cucaugccug

SEQ ID NO: 1731184 - RNA, 23 nt, Homo sapiens
cucauucugguucccugcugcgc

SEQ ID NO: 1731185 - RNA, 12 nt, Homo sapiens
cuccaggcuuuc

SEQ ID NO: 1731186 - RNA, 19 nt, Homo sapiens
cuccaguaccuugcuucuu

SEQ ID NO: 1731187 - RNA, 21 nt, Homo sapiens
cuccgaccacuuccaggggaa

SEQ ID NO: 1731188 - RNA, 21 nt, Homo sapiens
cuccguagcucugcugcugau

SEQ ID NO: 1731189 - RNA, 18 nt, Homo sapiens
cucguuuacacugcacau

SEQ ID NO: 1731190 - RNA, 16 nt, Homo sapiens
cucucaguguuuugga

SEQ ID NO: 1731191 - RNA, 20 nt, Homo sapiens
cucugucccucuccuugccc

SEQ ID NO: 1731192 - RNA, 14 nt, Homo sapiens
cucuuguucccaca

SEQ ID NO: 1731193 - RNA, 19 nt, Homo sapiens
cugaaagacucgagaacca

SEQ ID NO: 1731194 - RNA, 16 nt, Homo sapiens
cugaaagccuuaggga

SEQ ID NO: 1731195 - RNA, 12 nt, Homo sapiens
cugaacugaaag

SEQ ID NO: 1731196 - RNA, 14 nt, Homo sapiens
cugacaacugugaa

SEQ ID NO: 1731197 - RNA, 18 nt, Homo sapiens
cugacaacugugaagcca

SEQ ID NO: 1731198 - RNA, 15 nt, Homo sapiens
cugacuggugcugca

SEQ ID NO: 1731199 - RNA, 18 nt, Homo sapiens
cugauguguccucaggga

SEQ ID NO: 1731200 - RNA, 22 nt, Homo sapiens
cugcagggccauggcucagggu

SEQ ID NO: 1731201 - RNA, 15 nt, Homo sapiens
cugccccucucacca

SEQ ID NO: 1731202 - RNA, 22 nt, Homo sapiens
cugcucguuuacacugcacauu

SEQ ID NO: 1731203 - RNA, 14 nt, Homo sapiens
cugcugcgcugcuu

SEQ ID NO: 1731204 - RNA, 12 nt, Homo sapiens
cugcugcuggug

SEQ ID NO: 1731205 - RNA, 17 nt, Homo sapiens
cugggccauguccaaag

SEQ ID NO: 1731206 - RNA, 18 nt, Homo sapiens
cugggccauguccaaaga

SEQ ID NO: 1731207 - RNA, 16 nt, Homo sapiens
cuggggggacccagug

SEQ ID NO: 1731208 - RNA, 19 nt, Homo sapiens
cuggggggacccagugcag

SEQ ID NO: 1731209 - RNA, 15 nt, Homo sapiens
cuguaauccuagcua

SEQ ID NO: 1731210 - RNA, 21 nt, Homo sapiens
cuguauuuuuauuuuugcaca

SEQ ID NO: 1731211 - RNA, 22 nt, Homo sapiens
cuguauuuuuauuuuugcacaa

SEQ ID NO: 1731212 - RNA, 17 nt, Homo sapiens
cugucccucuccuugcc

SEQ ID NO: 1731213 - RNA, 22 nt, Homo sapiens
cuguccguucacauguguggua

SEQ ID NO: 1731214 - RNA, 19 nt, Homo sapiens
cuguccuaaggaaccuucc

SEQ ID NO: 1731215 - RNA, 17 nt, Homo sapiens
cugucuguauagugucu

SEQ ID NO: 1731216 - RNA, 12 nt, Homo sapiens
cuguuagcacau

SEQ ID NO: 1731217 - RNA, 21 nt, Homo sapiens
cuguugaucucaguauuguca

SEQ ID NO: 1731218 - RNA, 14 nt, Homo sapiens
cuuaagaauugaau

SEQ ID NO: 1731219 - RNA, 18 nt, Homo sapiens
cuuacacacugucuguau

SEQ ID NO: 1731220 - RNA, 21 nt, Homo sapiens
cuuaugcaaucuauguuugca

SEQ ID NO: 1731221 - RNA, 13 nt, Homo sapiens
cuucacaacuagg

SEQ ID NO: 1731222 - RNA, 17 nt, Homo sapiens
cuucccagcaauuauua

SEQ ID NO: 1731223 - RNA, 22 nt, Homo sapiens
cuucuaauugcuguguguccca

SEQ ID NO: 1731224 - RNA, 14 nt, Homo sapiens
cuucuguugaucuc

SEQ ID NO: 1731225 - RNA, 15 nt, Homo sapiens
cuucuguugaucuca

SEQ ID NO: 1731226 - RNA, 12 nt, Homo sapiens
cuucuuacugau

SEQ ID NO: 1731227 - RNA, 21 nt, Homo sapiens
cuugaaaagcuaguguaccuc

SEQ ID NO: 1731228 - RNA, 16 nt, Homo sapiens
cuugagaccauuucaa

SEQ ID NO: 1731229 - RNA, 19 nt, Homo sapiens
cuugccuccaggugcagag

SEQ ID NO: 1731230 - RNA, 14 nt, Homo sapiens
cuuuaaacaccccc

SEQ ID NO: 1731231 - RNA, 16 nt, Homo sapiens
cuuuacaauuucacuu

SEQ ID NO: 1731232 - RNA, 18 nt, Homo sapiens
cuuugaagugcagcucau

SEQ ID NO: 1731233 - RNA, 12 nt, Homo sapiens
cuuugucugugg

SEQ ID NO: 1731234 - RNA, 19 nt, Homo sapiens
cuuuuaauuuaaaaacaca

SEQ ID NO: 1731235 - RNA, 16 nt, Homo sapiens
cuuuuuauuagagcuc

SEQ ID NO: 1731236 - RNA, 14 nt, Homo sapiens
gaaaagauuacuga

SEQ ID NO: 1731237 - RNA, 15 nt, Homo sapiens
gaaaaggcugguaca

SEQ ID NO: 1731238 - RNA, 20 nt, Homo sapiens
gaaaagugcauauuuaucca

SEQ ID NO: 1731239 - RNA, 15 nt, Homo sapiens
gaaauuaagacuuua

SEQ ID NO: 1731240 - RNA, 15 nt, Homo sapiens
gaaccaaccagggaa

SEQ ID NO: 1731241 - RNA, 22 nt, Homo sapiens
gaaccuguccuaaggaaccuuc

SEQ ID NO: 1731242 - RNA, 17 nt, Homo sapiens
gaauaaaaacuuuugag

SEQ ID NO: 1731243 - RNA, 13 nt, Homo sapiens
gaaucucucccuc

SEQ ID NO: 1731244 - RNA, 20 nt, Homo sapiens
gaauggguguuguaugggga

SEQ ID NO: 1731245 - RNA, 17 nt, Homo sapiens
gaauguuuaaagaucau

SEQ ID NO: 1731246 - RNA, 12 nt, Homo sapiens
gacaacugugaa

SEQ ID NO: 1731247 - RNA, 19 nt, Homo sapiens
gacagcaucuuccucccuc

SEQ ID NO: 1731248 - RNA, 19 nt, Homo sapiens
gacauacauuuaugcacau

SEQ ID NO: 1731249 - RNA, 15 nt, Homo sapiens
gaccacuuccagggg

SEQ ID NO: 1731250 - RNA, 23 nt, Homo sapiens
gaccacuuccaggggaaccugcc

SEQ ID NO: 1731251 - RNA, 13 nt, Homo sapiens
gacucagugcaga

SEQ ID NO: 1731252 - RNA, 14 nt, Homo sapiens
gacuccaucucuca

SEQ ID NO: 1731253 - RNA, 12 nt, Homo sapiens
gagacucuaggg

SEQ ID NO: 1731254 - RNA, 16 nt, Homo sapiens
gagacugucccugaaa

SEQ ID NO: 1731255 - RNA, 19 nt, Homo sapiens
gagaguauagcaugaaugu

SEQ ID NO: 1731256 - RNA, 18 nt, Homo sapiens
uaacccagagcuguauuu

SEQ ID NO: 1731257 - RNA, 24 nt, Homo sapiens
uaacgugugugucuuacauugcca

SEQ ID NO: 1731258 - RNA, 12 nt, Homo sapiens
uaacuacuucca

SEQ ID NO: 1731259 - RNA, 14 nt, Homo sapiens
uaacucaacauuug

SEQ ID NO: 1731260 - RNA, 17 nt, Homo sapiens
uaagagcagaacagauc

SEQ ID NO: 1731261 - RNA, 14 nt, Homo sapiens
uaauaacuacuucc

SEQ ID NO: 1731262 - RNA, 23 nt, Homo sapiens
uaauacugguauuuuuacuuaau

SEQ ID NO: 1731263 - RNA, 13 nt, Homo sapiens
uacagacauacau

SEQ ID NO: 1731264 - RNA, 14 nt, Homo sapiens
uacaggcauaaaau

SEQ ID NO: 1731265 - RNA, 14 nt, Homo sapiens
uacaugcauacaaa

SEQ ID NO: 1731266 - RNA, 13 nt, Homo sapiens
uacauuuaugcac

SEQ ID NO: 1731267 - RNA, 23 nt, Homo sapiens
uaccaucuuguauacacauauau

SEQ ID NO: 1731268 - RNA, 16 nt, Homo sapiens
uaccuauugcacucca

SEQ ID NO: 1731269 - RNA, 20 nt, Homo sapiens
uacugcccuuucaaagcacu

SEQ ID NO: 1731270 - RNA, 14 nt, Homo sapiens
uacuucuccacugu

SEQ ID NO: 1731271 - RNA, 14 nt, Homo sapiens
uagaagucauaugu

SEQ ID NO: 1731272 - RNA, 14 nt, Homo sapiens
uagagagagacuau

SEQ ID NO: 1731273 - RNA, 16 nt, Homo sapiens
uagagcucgccacgaa

SEQ ID NO: 1731274 - RNA, 21 nt, Homo sapiens
uagauuucuauaggauuuuuc

SEQ ID NO: 1731275 - RNA, 16 nt, Homo sapiens
uagcagaugguuucca

SEQ ID NO: 1731276 - RNA, 20 nt, Homo sapiens
uagcagcccacccugcugcu

SEQ ID NO: 1731277 - RNA, 22 nt, Homo sapiens
uaggguuacagagaccuaugua

SEQ ID NO: 1731278 - RNA, 20 nt, Homo sapiens
uauaaacagacaauauguga

SEQ ID NO: 1731279 - RNA, 15 nt, Homo sapiens
uauacaggcauaaaa

SEQ ID NO: 1731280 - RNA, 20 nt, Homo sapiens
uauaccuuuugcauuucuuu

SEQ ID NO: 1731281 - RNA, 20 nt, Homo sapiens
uauacuuugccacugcugua

SEQ ID NO: 1731282 - RNA, 22 nt, Homo sapiens
uaugugucccgaauccacaguc

SEQ ID NO: 1731283 - RNA, 22 nt, Homo sapiens
uauuaucuaaaagaaaccuucc

SEQ ID NO: 1731284 - RNA, 16 nt, Homo sapiens
uauuccucucacccca

SEQ ID NO: 1731285 - RNA, 23 nt, Homo sapiens
uauuucuucaaauaaaucucucc

SEQ ID NO: 1731286 - RNA, 13 nt, Homo sapiens
uauuuuugcacaa

SEQ ID NO: 1731287 - RNA, 15 nt, Homo sapiens
ucaaaauauuucuca

SEQ ID NO: 1731288 - RNA, 16 nt, Homo sapiens
ucaaaauauuucucau

SEQ ID NO: 1731289 - RNA, 22 nt, Homo sapiens
ucaaacuggagagaagcaagcc

SEQ ID NO: 1731290 - RNA, 21 nt, Homo sapiens
ucaaggucagcaugaggacag

SEQ ID NO: 1731291 - RNA, 23 nt, Homo sapiens
ucaaucuguccguucacaugugu

SEQ ID NO: 1731292 - RNA, 12 nt, Homo sapiens
ucacacccugac

SEQ ID NO: 1731293 - RNA, 13 nt, Homo sapiens
ucacuauuaucua

SEQ ID NO: 1731294 - RNA, 13 nt, Homo sapiens
ucagcuuaucucu

SEQ ID NO: 1731295 - RNA, 13 nt, Homo sapiens
ucauacaugcaua

SEQ ID NO: 1731296 - RNA, 12 nt, Homo sapiens
ucaucauucccu

SEQ ID NO: 1731297 - RNA, 16 nt, Homo sapiens
ucaucauucccucuca

SEQ ID NO: 1731298 - RNA, 13 nt, Homo sapiens
ucaugacauauga

SEQ ID NO: 1731299 - RNA, 23 nt, Homo sapiens
ucaugccuguaaucccagcacuu

SEQ ID NO: 1731300 - RNA, 17 nt, Homo sapiens
ucaugguagagaaucuc

SEQ ID NO: 1731301 - RNA, 19 nt, Homo sapiens
ucauguuuuuaacuuuuaa

SEQ ID NO: 1731302 - RNA, 13 nt, Homo sapiens
ucauuauguauga

SEQ ID NO: 1731303 - RNA, 22 nt, Homo sapiens
uccaaugcuucuguugaucuca

SEQ ID NO: 1731304 - RNA, 16 nt, Homo sapiens
uccaaugucaauguga

SEQ ID NO: 1731305 - RNA, 22 nt, Homo sapiens
uccacacccacuuuguccauuu

SEQ ID NO: 1731306 - RNA, 21 nt, Homo sapiens
uccaucucucauccuccagua

SEQ ID NO: 1731307 - RNA, 13 nt, Homo sapiens
ucccacuguauga

SEQ ID NO: 1731308 - RNA, 17 nt, Homo sapiens
ucccugaaaccuaguac

SEQ ID NO: 1731309 - RNA, 21 nt, Homo sapiens
ucccuucccagcgcugcuggu

SEQ ID NO: 1731310 - RNA, 20 nt, Homo sapiens
uccguagcucugcugcugau

SEQ ID NO: 1731311 - RNA, 15 nt, Homo sapiens
uccucagcuuaucuc

SEQ ID NO: 1731312 - RNA, 11 nt, Homo sapiens
uccucagggag

SEQ ID NO: 1731313 - RNA, 17 nt, Homo sapiens
uccugagaagcauguaa

SEQ ID NO: 1731314 - RNA, 19 nt, Homo sapiens
uccuugcccccagugccuc

SEQ ID NO: 1731315 - RNA, 15 nt, Homo sapiens
uccuuuaggaucuca

SEQ ID NO: 1731316 - RNA, 13 nt, Homo sapiens
ucuaauugcugug

SEQ ID NO: 1731317 - RNA, 21 nt, Homo sapiens
ucucagcuugagaccauuuca

SEQ ID NO: 1731318 - RNA, 22 nt, Homo sapiens
ucucaggcuucugcaguucuca

SEQ ID NO: 1731319 - RNA, 17 nt, Homo sapiens
ucucuguuggucugccu

SEQ ID NO: 1731320 - RNA, 20 nt, Homo sapiens
ucugaggcccugcccaauga

SEQ ID NO: 1731321 - RNA, 13 nt, Homo sapiens
ucugcaguucuca

SEQ ID NO: 1731322 - RNA, 16 nt, Homo sapiens
ucugccuguaucucuc

SEQ ID NO: 1731323 - RNA, 19 nt, Homo sapiens
ucugccuucugcugaaaga

SEQ ID NO: 1731324 - RNA, 22 nt, Homo sapiens
ucuggucuuauaaguaaagaca

SEQ ID NO: 1731325 - RNA, 14 nt, Homo sapiens
ucugucucaaaaca

SEQ ID NO: 1731326 - RNA, 18 nt, Homo sapiens
ucuuacacacugucugua

SEQ ID NO: 1731327 - RNA, 15 nt, Homo sapiens
ucuuacauugccaag

SEQ ID NO: 1731328 - RNA, 20 nt, Homo sapiens
ucuuacauugccaagucaga

SEQ ID NO: 1731329 - RNA, 15 nt, Homo sapiens
ucuucccagcaauua

SEQ ID NO: 1731330 - RNA, 16 nt, Homo sapiens
ucuuccugcacccaca

SEQ ID NO: 1731331 - RNA, 19 nt, Homo sapiens
ucuucuuggggcccagugc

SEQ ID NO: 1731332 - RNA, 13 nt, Homo sapiens
ugaaugccuaccu

SEQ ID NO: 1731333 - RNA, 14 nt, Homo sapiens
ugaaugcugccaca

SEQ ID NO: 1731334 - RNA, 14 nt, Homo sapiens
ugaauuuucccuga

SEQ ID NO: 1731335 - RNA, 21 nt, Homo sapiens
ugacaaccgagaagguuuauc

SEQ ID NO: 1731336 - RNA, 18 nt, Homo sapiens
ugacuuuccucccauuuu

SEQ ID NO: 1731337 - RNA, 22 nt, Homo sapiens
ugagaucguaccuauugcacuc

SEQ ID NO: 1731338 - RNA, 12 nt, Homo sapiens
gcacaugcacac

SEQ ID NO: 1731339 - RNA, 13 nt, Homo sapiens
gcaccaaccugca

SEQ ID NO: 1731340 - RNA, 13 nt, Homo sapiens
gcacuauguauau

SEQ ID NO: 1731341 - RNA, 16 nt, Homo sapiens
gcacuugugcuuucag

SEQ ID NO: 1731342 - RNA, 22 nt, Homo sapiens
gcagaacagaucuuuuacuuug

SEQ ID NO: 1731343 - RNA, 14 nt, Homo sapiens
gcagauacuuugaa

SEQ ID NO: 1731344 - RNA, 14 nt, Homo sapiens
gcaggcugggccau

SEQ ID NO: 1731345 - RNA, 16 nt, Homo sapiens
gcaguauucuugcacu

SEQ ID NO: 1731346 - RNA, 13 nt, Homo sapiens
gcaucaaggucag

SEQ ID NO: 1731347 - RNA, 19 nt, Homo sapiens
gccacauggcggagaguuu

SEQ ID NO: 1731348 - RNA, 14 nt, Homo sapiens
gccacugcuguauu

SEQ ID NO: 1731349 - RNA, 16 nt, Homo sapiens
gccagaggugcuucac

SEQ ID NO: 1731350 - RNA, 21 nt, Homo sapiens
gccagggggaugccacuccuc

SEQ ID NO: 1731351 - RNA, 14 nt, Homo sapiens
gccauguccaaaga

SEQ ID NO: 1731352 - RNA, 19 nt, Homo sapiens
gcccagugcaugguggcca

SEQ ID NO: 1731353 - RNA, 14 nt, Homo sapiens
gccccucucaccaa

SEQ ID NO: 1731354 - RNA, 21 nt, Homo sapiens
gcccugauguguccucaggga

SEQ ID NO: 1731355 - RNA, 16 nt, Homo sapiens
gcccuuuccuuccaga

SEQ ID NO: 1731356 - RNA, 20 nt, Homo sapiens
gccuggccaacauggugaaa

SEQ ID NO: 1731357 - RNA, 15 nt, Homo sapiens
gcuaauauacuugua

SEQ ID NO: 1731358 - RNA, 21 nt, Homo sapiens
gcuacagaaaccacagucuuc

SEQ ID NO: 1731359 - RNA, 15 nt, Homo sapiens
gcuaguguaccuccu

SEQ ID NO: 1731360 - RNA, 20 nt, Homo sapiens
gcucguuuacacugcacauu

SEQ ID NO: 1731361 - RNA, 23 nt, Homo sapiens
gcugacaugaagcuguuguguga

SEQ ID NO: 1731362 - RNA, 12 nt, Homo sapiens
gcuggaaccagc

SEQ ID NO: 1731363 - RNA, 15 nt, Homo sapiens
gcuggcaucaagagg

SEQ ID NO: 1731364 - RNA, 20 nt, Homo sapiens
gcuggccggggcucugggug

SEQ ID NO: 1731365 - RNA, 16 nt, Homo sapiens
gcugggccauguccaa

SEQ ID NO: 1731366 - RNA, 15 nt, Homo sapiens
gcuucuguugaucuc

SEQ ID NO: 1731367 - RNA, 17 nt, Homo sapiens
gcuucuguugaucucag

SEQ ID NO: 1731368 - RNA, 23 nt, Homo sapiens
gcuugccugcagggccauggcuc

SEQ ID NO: 1731369 - RNA, 15 nt, Homo sapiens
ggaaauuaagacuuu

SEQ ID NO: 1731370 - RNA, 17 nt, Homo sapiens
ggaaauuaagacuuuau

SEQ ID NO: 1731371 - RNA, 20 nt, Homo sapiens
ggaagcaaguuuucuuccau

SEQ ID NO: 1731372 - RNA, 21 nt, Homo sapiens
ggaaggaacagcaaugguguc

SEQ ID NO: 1731373 - RNA, 15 nt, Homo sapiens
ggaaucccacuguau

SEQ ID NO: 1731374 - RNA, 15 nt, Homo sapiens
ggacagaccacagag

SEQ ID NO: 1731375 - RNA, 16 nt, Homo sapiens
ggacaucacagggugg

SEQ ID NO: 1731376 - RNA, 14 nt, Homo sapiens
ggacccagugcaga

SEQ ID NO: 1731377 - RNA, 13 nt, Homo sapiens
ggacuacaaccaa

SEQ ID NO: 1731378 - RNA, 23 nt, Homo sapiens
ggacuccaucucucauccuccag

SEQ ID NO: 1731379 - RNA, 20 nt, Homo sapiens
ggacuuccuuuaggaucuca

SEQ ID NO: 1731380 - RNA, 21 nt, Homo sapiens
ggacuuccuuuaggaucucag

SEQ ID NO: 1731381 - RNA, 18 nt, Homo sapiens
ggagagaagcaagccagc

SEQ ID NO: 1731382 - RNA, 19 nt, Homo sapiens
ggcaauuucaccaccaaau

SEQ ID NO: 1731383 - RNA, 17 nt, Homo sapiens
ggcaccaaccugcauuu

SEQ ID NO: 1731384 - RNA, 15 nt, Homo sapiens
ggcaggcugggccau

SEQ ID NO: 1731385 - RNA, 20 nt, Homo sapiens
ggcaggcugggccaugucca

SEQ ID NO: 1731386 - RNA, 20 nt, Homo sapiens
ggcagggagcugggcccgac

SEQ ID NO: 1731387 - RNA, 18 nt, Homo sapiens
ggccauggcucagggugg

SEQ ID NO: 1731388 - RNA, 16 nt, Homo sapiens
ggccauguccaaagag

SEQ ID NO: 1731389 - RNA, 12 nt, Homo sapiens
ggcccagugcau

SEQ ID NO: 1731390 - RNA, 17 nt, Homo sapiens
ggccccucccacaccca

SEQ ID NO: 1731391 - RNA, 22 nt, Homo sapiens
ggcgugauggcaggugccugua

SEQ ID NO: 1731392 - RNA, 16 nt, Homo sapiens
ggcuggaaggggucca

SEQ ID NO: 1731393 - RNA, 17 nt, Homo sapiens
ggcuuucccacuuccca

SEQ ID NO: 1731394 - RNA, 14 nt, Homo sapiens
gggaacauguccua

SEQ ID NO: 1731395 - RNA, 21 nt, Homo sapiens
gggaggccccagggggucuca

SEQ ID NO: 1731396 - RNA, 12 nt, Homo sapiens
gggagugucuaa

SEQ ID NO: 1731397 - RNA, 18 nt, Homo sapiens
ggggcaggcugggccaug

SEQ ID NO: 1731398 - RNA, 16 nt, Homo sapiens
gguacugaaagccuua

SEQ ID NO: 1731399 - RNA, 14 nt, Homo sapiens
ggucauacaugcau

SEQ ID NO: 1731400 - RNA, 15 nt, Homo sapiens
ggucauacaugcaua

SEQ ID NO: 1731401 - RNA, 19 nt, Homo sapiens
ggugaaacagggcuugucc

SEQ ID NO: 1731402 - RNA, 13 nt, Homo sapiens
ggugcauagcaga

SEQ ID NO: 1731403 - RNA, 14 nt, Homo sapiens
gguguauguaugag

SEQ ID NO: 1731404 - RNA, 16 nt, Homo sapiens
gguguauguaugagua

SEQ ID NO: 1731405 - RNA, 13 nt, Homo sapiens
guaaauacaggua

SEQ ID NO: 1731406 - RNA, 14 nt, Homo sapiens
guaacgauguugua

SEQ ID NO: 1731407 - RNA, 18 nt, Homo sapiens
guaccuccucucaguguu

SEQ ID NO: 1731408 - RNA, 14 nt, Homo sapiens
guacggacuuccuu

SEQ ID NO: 1731409 - RNA, 13 nt, Homo sapiens
guagcccauccuu

SEQ ID NO: 1731410 - RNA, 21 nt, Homo sapiens
guagcucccauauauggagau

SEQ ID NO: 1731411 - RNA, 12 nt, Homo sapiens
guagcucugcug

SEQ ID NO: 1731412 - RNA, 16 nt, Homo sapiens
guauauacuuugccac

SEQ ID NO: 1731413 - RNA, 16 nt, Homo sapiens
guauguauauauacac

SEQ ID NO: 1731414 - RNA, 22 nt, Homo sapiens
guauuugguauauacuuugcca

SEQ ID NO: 1731415 - RNA, 20 nt, Homo sapiens
guauuuuuauuuuugcacaa

SEQ ID NO: 1731416 - RNA, 14 nt, Homo sapiens
gucuaaaagcagaa

SEQ ID NO: 1731417 - RNA, 19 nt, Homo sapiens
gucuguuuggacugcagaa

SEQ ID NO: 1731418 - RNA, 14 nt, Homo sapiens
gucuuacauugcca

SEQ ID NO: 1731419 - RNA, 21 nt, Homo sapiens
gugauauuucguguacugcaa

SEQ ID NO: 1731420 - RNA, 15 nt, Homo sapiens
gugccugggguguua

SEQ ID NO: 1731421 - RNA, 14 nt, Homo sapiens
gugccuuuugcaga

SEQ ID NO: 1731422 - RNA, 18 nt, Homo sapiens
ugaggacagaccacagag

SEQ ID NO: 1731423 - RNA, 23 nt, Homo sapiens
ugauaaaagcauuguuugugaua

SEQ ID NO: 1731424 - RNA, 15 nt, Homo sapiens
ugaucugcugcugag

SEQ ID NO: 1731425 - RNA, 16 nt, Homo sapiens
ugauguguccucaggg

SEQ ID NO: 1731426 - RNA, 16 nt, Homo sapiens
ugauuuagugaucaaa

SEQ ID NO: 1731427 - RNA, 20 nt, Homo sapiens
ugcacuauguauauacauau

SEQ ID NO: 1731428 - RNA, 18 nt, Homo sapiens
ugcaguauucuugcacug

SEQ ID NO: 1731429 - RNA, 19 nt, Homo sapiens
ugcauaauaacuacuucca

SEQ ID NO: 1731430 - RNA, 12 nt, Homo sapiens
ugccacaaccag

SEQ ID NO: 1731431 - RNA, 18 nt, Homo sapiens
ugcccaaugagacucuag

SEQ ID NO: 1731432 - RNA, 13 nt, Homo sapiens
ugccgcuaccucc

SEQ ID NO: 1731433 - RNA, 16 nt, Homo sapiens
ugccuaguuucuuaca

SEQ ID NO: 1731434 - RNA, 18 nt, Homo sapiens
ugccuaguuucuuacaca

SEQ ID NO: 1731435 - RNA, 15 nt, Homo sapiens
ugccuguaucucuca

SEQ ID NO: 1731436 - RNA, 14 nt, Homo sapiens
ugcgugcgcaucuu

SEQ ID NO: 1731437 - RNA, 22 nt, Homo sapiens
ugcugauacugggucugcgaug

SEQ ID NO: 1731438 - RNA, 12 nt, Homo sapiens
ugcugcugauac

SEQ ID NO: 1731439 - RNA, 23 nt, Homo sapiens
ugcuguauuuuuauuuuugcaca

SEQ ID NO: 1731440 - RNA, 14 nt, Homo sapiens
ugcuucaucauucc

SEQ ID NO: 1731441 - RNA, 13 nt, Homo sapiens
uggaaacuaagac

SEQ ID NO: 1731442 - RNA, 16 nt, Homo sapiens
uggaagaggaacagca

SEQ ID NO: 1731443 - RNA, 23 nt, Homo sapiens
uggaagaggaacagcacugggga

SEQ ID NO: 1731444 - RNA, 15 nt, Homo sapiens
uggaaucccacugua

SEQ ID NO: 1731445 - RNA, 21 nt, Homo sapiens
uggagaaggucacaacccuuc

SEQ ID NO: 1731446 - RNA, 20 nt, Homo sapiens
uggaggucauacaugcauac

SEQ ID NO: 1731447 - RNA, 21 nt, Homo sapiens
uggcuccggccucugccuuug

SEQ ID NO: 1731448 - RNA, 18 nt, Homo sapiens
ugggagcaggaacaauga

SEQ ID NO: 1731449 - RNA, 15 nt, Homo sapiens
ugggccauguccaaa

SEQ ID NO: 1731450 - RNA, 17 nt, Homo sapiens
ugggccauguccaaaga

SEQ ID NO: 1731451 - RNA, 19 nt, Homo sapiens
uggggcaggcugggccaug

SEQ ID NO: 1731452 - RNA, 19 nt, Homo sapiens
ugggggcucaugccuguaa

SEQ ID NO: 1731453 - RNA, 19 nt, Homo sapiens
uggguacugaaagccuuag

SEQ ID NO: 1731454 - RNA, 20 nt, Homo sapiens
uggugcuggaaccagcucuc

SEQ ID NO: 1731455 - RNA, 16 nt, Homo sapiens
uguaaaugaaacuuaa

SEQ ID NO: 1731456 - RNA, 19 nt, Homo sapiens
uguaaucccagcacuuugg

SEQ ID NO: 1731457 - RNA, 15 nt, Homo sapiens
uguacagacauacau

SEQ ID NO: 1731458 - RNA, 15 nt, Homo sapiens
uguacagagugcuuu

SEQ ID NO: 1731459 - RNA, 18 nt, Homo sapiens
uguaugcaguauucuugc

SEQ ID NO: 1731460 - RNA, 20 nt, Homo sapiens
uguauggaaucccacuguau

SEQ ID NO: 1731461 - RNA, 13 nt, Homo sapiens
uguauuugguaua

SEQ ID NO: 1731462 - RNA, 17 nt, Homo sapiens
ugucccuugcuugccug

SEQ ID NO: 1731463 - RNA, 11 nt, Homo sapiens
ugucuggucuu

SEQ ID NO: 1731464 - RNA, 12 nt, Homo sapiens
ugugccaguuua

SEQ ID NO: 1731465 - RNA, 16 nt, Homo sapiens
uguggauggucauugc

SEQ ID NO: 1731466 - RNA, 15 nt, Homo sapiens
uguguccucagggag

SEQ ID NO: 1731467 - RNA, 10 nt, Homo sapiens
ugugugcaca

SEQ ID NO: 1731468 - RNA, 11 nt, Homo sapiens
ugugugcacau

SEQ ID NO: 1731469 - RNA, 16 nt, Homo sapiens
ugugugcgugcgcauc

SEQ ID NO: 1731470 - RNA, 14 nt, Homo sapiens
uguguucugcaaua

SEQ ID NO: 1731471 - RNA, 18 nt, Homo sapiens
uguguuuuuaacauguca

SEQ ID NO: 1731472 - RNA, 23 nt, Homo sapiens
uguucuggggggacccagugcag

SEQ ID NO: 1731473 - RNA, 18 nt, Homo sapiens
uguugauaaaccauaaau

SEQ ID NO: 1731474 - RNA, 19 nt, Homo sapiens
uguuguagugaaauuauac

SEQ ID NO: 1731475 - RNA, 21 nt, Homo sapiens
uguuguguuuuuaacauguca

SEQ ID NO: 1731476 - RNA, 19 nt, Homo sapiens
uuaaaacuggaccuguaua

SEQ ID NO: 1731477 - RNA, 18 nt, Homo sapiens
uuacacacugucuguaua

SEQ ID NO: 1731478 - RNA, 22 nt, Homo sapiens
uuacuaaagguuuuaaccgcac

SEQ ID NO: 1731479 - RNA, 18 nt, Homo sapiens
uuacugucaaaauauuuc

SEQ ID NO: 1731480 - RNA, 21 nt, Homo sapiens
uuagugaucaaauugugcagu

SEQ ID NO: 1731481 - RNA, 17 nt, Homo sapiens
uuauaaguaaagacagc

SEQ ID NO: 1731482 - RNA, 15 nt, Homo sapiens
uuauaucauauguau

SEQ ID NO: 1731483 - RNA, 19 nt, Homo sapiens
uucacgcuguuuguuucau

SEQ ID NO: 1731484 - RNA, 15 nt, Homo sapiens
uucauauauacaggc

SEQ ID NO: 1731485 - RNA, 19 nt, Homo sapiens
uuccuuccagauccugggu

SEQ ID NO: 1731486 - RNA, 15 nt, Homo sapiens
uucguguacugcaaa

SEQ ID NO: 1731487 - RNA, 15 nt, Homo sapiens
uucucaugacuccua

SEQ ID NO: 1731488 - RNA, 19 nt, Homo sapiens
uucucugccgcuaccuccc

SEQ ID NO: 1731489 - RNA, 15 nt, Homo sapiens
uucugcaauaugccu

SEQ ID NO: 1731490 - RNA, 14 nt, Homo sapiens
uucuuacacacugu

SEQ ID NO: 1731491 - RNA, 20 nt, Homo sapiens
uugcucuaggaagacauuuu

SEQ ID NO: 1731492 - RNA, 20 nt, Homo sapiens
uuggaaagacuucucaaaga

SEQ ID NO: 1731493 - RNA, 21 nt, Homo sapiens
uuggaagaggaacagcacugg

SEQ ID NO: 1731494 - RNA, 18 nt, Homo sapiens
uuggaagguggguucugc

SEQ ID NO: 1731495 - RNA, 20 nt, Homo sapiens
uugguauauacuuugccacu

SEQ ID NO: 1731496 - RNA, 18 nt, Homo sapiens
uuguaaaugaaacuuaag

SEQ ID NO: 1731497 - RNA, 12 nt, Homo sapiens
uuguuauaccau

SEQ ID NO: 1731498 - RNA, 13 nt, Homo sapiens
uuguuauaccauu

SEQ ID NO: 1731499 - RNA, 21 nt, Homo sapiens
uuuacagcuaucgaacuucac

SEQ ID NO: 1731500 - RNA, 23 nt, Homo sapiens
uuuaccacuuuaaacacccccau

SEQ ID NO: 1731501 - RNA, 13 nt, Homo sapiens
uuuaguagccuca

SEQ ID NO: 1731502 - RNA, 11 nt, Homo sapiens
uuuaugcacau

SEQ ID NO: 1731503 - RNA, 11 nt, Homo sapiens
uuucauaccuu

SEQ ID NO: 1731504 - RNA, 13 nt, Homo sapiens
uuucuuccaugau

SEQ ID NO: 1731505 - RNA, 18 nt, Homo sapiens
uuuggggcaggaaauacu

SEQ ID NO: 1731506 - RNA, 13 nt, Homo sapiens
uuuuaacuuuuaa

SEQ ID NO: 1731507 - RNA, 15 nt, Homo sapiens
uuuuaugcuacugaa

SEQ ID NO: 1731508 - RNA, 12 nt, Homo sapiens
agacaccugguu

SEQ ID NO: 1731509 - RNA, 13 nt, Homo sapiens
agacucagugcag

SEQ ID NO: 1731510 - RNA, 13 nt, Homo sapiens
agacucugucuca

SEQ ID NO: 1731511 - RNA, 22 nt, Homo sapiens
agacucugucucaaaacaaaca

SEQ ID NO: 1731512 - RNA, 16 nt, Homo sapiens
agagacugucccugaa

SEQ ID NO: 1731513 - RNA, 15 nt, Homo sapiens
agaggaaaaggcugg

SEQ ID NO: 1731514 - RNA, 15 nt, Homo sapiens
agaggacuauuacau

SEQ ID NO: 1731515 - RNA, 17 nt, Homo sapiens
agaggcugccccucuca

SEQ ID NO: 1731516 - RNA, 16 nt, Homo sapiens
agauccuggguacuga

SEQ ID NO: 1731517 - RNA, 22 nt, Homo sapiens
agauguauuuguuguagacuua

SEQ ID NO: 1731518 - RNA, 16 nt, Homo sapiens
agcaaguuuucuucca

SEQ ID NO: 1731519 - RNA, 20 nt, Homo sapiens
agcaaucugccuguaucucu

SEQ ID NO: 1731520 - RNA, 17 nt, Homo sapiens
agcacuggggagucuuu

SEQ ID NO: 1731521 - RNA, 20 nt, Homo sapiens
agcagaacagaucuuuuacu

SEQ ID NO: 1731522 - RNA, 15 nt, Homo sapiens
agcagaugguuucca

SEQ ID NO: 1731523 - RNA, 19 nt, Homo sapiens
agcauauuuuaaugcaguu

SEQ ID NO: 1731524 - RNA, 19 nt, Homo sapiens
agccucaauucuccauuaa

SEQ ID NO: 1731525 - RNA, 16 nt, Homo sapiens
agccuggacugcuacc

SEQ ID NO: 1731526 - RNA, 17 nt, Homo sapiens
agcuacuuggcaggcua

SEQ ID NO: 1731527 - RNA, 20 nt, Homo sapiens
agcugggcccgacauggcuc

SEQ ID NO: 1731528 - RNA, 17 nt, Homo sapiens
agcuuaucucuuuuaua

SEQ ID NO: 1731529 - RNA, 20 nt, Homo sapiens
aggaaauacuuuguaacuuu

SEQ ID NO: 1731530 - RNA, 11 nt, Homo sapiens
aggaucucagg

SEQ ID NO: 1731531 - RNA, 18 nt, Homo sapiens
aggcagguccacagagag

SEQ ID NO: 1731532 - RNA, 17 nt, Homo sapiens
aggcccugcccaaugag

SEQ ID NO: 1731533 - RNA, 15 nt, Homo sapiens
aggcugccccucuca

SEQ ID NO: 1731534 - RNA, 18 nt, Homo sapiens
aggcugccccucucacca

SEQ ID NO: 1731535 - RNA, 12 nt, Homo sapiens
aggcugggccau

SEQ ID NO: 1731536 - RNA, 16 nt, Homo sapiens
aggcugggccaugucc

SEQ ID NO: 1731537 - RNA, 23 nt, Homo sapiens
aggcugggccauguccaaagagg

SEQ ID NO: 1731538 - RNA, 19 nt, Homo sapiens
aggcuucugcaguucucau

SEQ ID NO: 1731539 - RNA, 16 nt, Homo sapiens
agggcaccauccagcu

SEQ ID NO: 1731540 - RNA, 17 nt, Homo sapiens
agggcccuccgaccacu

SEQ ID NO: 1731541 - RNA, 21 nt, Homo sapiens
agggggaugccacuccucccu

SEQ ID NO: 1731542 - RNA, 22 nt, Homo sapiens
aggucugcccggagcagcagcu

SEQ ID NO: 1731543 - RNA, 21 nt, Homo sapiens
agguuuuaaccgcacaugcac

SEQ ID NO: 1731544 - RNA, 17 nt, Homo sapiens
aguccgcagaagcccug

SEQ ID NO: 1731545 - RNA, 17 nt, Homo sapiens
agucuagcauucugcaa

SEQ ID NO: 1731546 - RNA, 13 nt, Homo sapiens
agugacgcugcug

SEQ ID NO: 1731547 - RNA, 18 nt, Homo sapiens
aguggaaauuaagacuuu

SEQ ID NO: 1731548 - RNA, 21 nt, Homo sapiens
aguguuuuggacuccaucucu

SEQ ID NO: 1731549 - RNA, 17 nt, Homo sapiens
aguucucaugacuccua

SEQ ID NO: 1731550 - RNA, 19 nt, Homo sapiens
aguuucuuacacacugucu

SEQ ID NO: 1731551 - RNA, 19 nt, Homo sapiens
auaaauaaacuguugcucg

SEQ ID NO: 1731552 - RNA, 14 nt, Homo sapiens
auaaauacauucga

SEQ ID NO: 1731553 - RNA, 17 nt, Homo sapiens
auaaaucucuccuauaa

SEQ ID NO: 1731554 - RNA, 17 nt, Homo sapiens
auaauguuuugggaaac

SEQ ID NO: 1731555 - RNA, 18 nt, Homo sapiens
auacaugcauacaaagag

SEQ ID NO: 1731556 - RNA, 22 nt, Homo sapiens
auacugggucugcgaugcagcg

SEQ ID NO: 1731557 - RNA, 14 nt, Homo sapiens
auauaauuuauuga

SEQ ID NO: 1731558 - RNA, 14 nt, Homo sapiens
auauauaacauaua

SEQ ID NO: 1731559 - RNA, 13 nt, Homo sapiens
auauauacaggca

SEQ ID NO: 1731560 - RNA, 17 nt, Homo sapiens
auauauacccacaugua

SEQ ID NO: 1731561 - RNA, 16 nt, Homo sapiens
auauaugcacuaugua

SEQ ID NO: 1731562 - RNA, 17 nt, Homo sapiens
auauaugcacuauguau

SEQ ID NO: 1731563 - RNA, 18 nt, Homo sapiens
auaucaaaucuaccacug

SEQ ID NO: 1731564 - RNA, 19 nt, Homo sapiens
aucaacaacauccacuguu

SEQ ID NO: 1731565 - RNA, 20 nt, Homo sapiens
aucaucaaagcucacaccaa

SEQ ID NO: 1731566 - RNA, 16 nt, Homo sapiens
aucauucccucucauc

SEQ ID NO: 1731567 - RNA, 16 nt, Homo sapiens
auccaggcuuuguaca

SEQ ID NO: 1731568 - RNA, 13 nt, Homo sapiens
aucccacuguaug

SEQ ID NO: 1731569 - RNA, 19 nt, Homo sapiens
aucccgccgauagagggac

SEQ ID NO: 1731570 - RNA, 22 nt, Homo sapiens
auccugguuucauaacuuccug

SEQ ID NO: 1731571 - RNA, 20 nt, Homo sapiens
aucuguccguucacaugugu

SEQ ID NO: 1731572 - RNA, 13 nt, Homo sapiens
aucuucugaauuu

SEQ ID NO: 1731573 - RNA, 15 nt, Homo sapiens
augaaaucuucccag

SEQ ID NO: 1731574 - RNA, 18 nt, Homo sapiens
augacauaugacuugauc

SEQ ID NO: 1731575 - RNA, 22 nt, Homo sapiens
augaggaaggaacagcaauggu

SEQ ID NO: 1731576 - RNA, 15 nt, Homo sapiens
augcaaaagguuuau

SEQ ID NO: 1731577 - RNA, 15 nt, Homo sapiens
augcacugauguugu

SEQ ID NO: 1731578 - RNA, 18 nt, Homo sapiens
augccuaguuucuuacac

SEQ ID NO: 1731579 - RNA, 19 nt, Homo sapiens
auggaggucauacaugcau

SEQ ID NO: 1731580 - RNA, 22 nt, Homo sapiens
auggcuggaagggguccagccu

SEQ ID NO: 1731581 - RNA, 16 nt, Homo sapiens
auggggacacagauca

SEQ ID NO: 1731582 - RNA, 14 nt, Homo sapiens
augggugauucucu

SEQ ID NO: 1731583 - RNA, 16 nt, Homo sapiens
augguaaauccuuuug

SEQ ID NO: 1731584 - RNA, 15 nt, Homo sapiens
auguaagugggccca

SEQ ID NO: 1731585 - RNA, 14 nt, Homo sapiens
auguacaacugcac

SEQ ID NO: 1731586 - RNA, 20 nt, Homo sapiens
auguaguuuuuauauguugu

SEQ ID NO: 1731587 - RNA, 11 nt, Homo sapiens
auguccaaaga

SEQ ID NO: 1731588 - RNA, 12 nt, Homo sapiens
auguccaaagag

SEQ ID NO: 1731589 - RNA, 20 nt, Homo sapiens
auguccagcaccuugugccu

SEQ ID NO: 1731590 - RNA, 14 nt, Homo sapiens
auguuuaaagauca

SEQ ID NO: 1731591 - RNA, 13 nt, Homo sapiens
auguuuccauuug

SEQ ID NO: 1731592 - RNA, 18 nt, Homo sapiens
auguuugcacuugugcuu

SEQ ID NO: 1731593 - RNA, 17 nt, Homo sapiens
auguuuugggaaacacu

SEQ ID NO: 1731594 - RNA, 23 nt, Homo sapiens
auguuuuuagaggacuauuacau

SEQ ID NO: 1731595 - RNA, 23 nt, Homo sapiens
auuagauuucuauaggauuuuuc

SEQ ID NO: 1731596 - RNA, 23 nt, Homo sapiens
auucacgcuguuuguuucauaua

SEQ ID NO: 1731597 - RNA, 21 nt, Homo sapiens
auuccggaaacuaguguacau

SEQ ID NO: 1731598 - RNA, 14 nt, Homo sapiens
auucuuaacagugg

SEQ ID NO: 1731599 - RNA, 20 nt, Homo sapiens
auucuuaacagugguucaaa

SEQ ID NO: 1731600 - RNA, 12 nt, Homo sapiens
auucuugcacug

SEQ ID NO: 1731601 - RNA, 13 nt, Homo sapiens
auucuugcacuga

SEQ ID NO: 1731602 - RNA, 14 nt, Homo sapiens
auugaacucuacaa

SEQ ID NO: 1731603 - RNA, 18 nt, Homo sapiens
auugauaaaagcauuguu

SEQ ID NO: 1731604 - RNA, 15 nt, Homo sapiens
auugugcaguacuuu

SEQ ID NO: 1731605 - RNA, 22 nt, Homo sapiens
auuuagauccugguuucauaac

SEQ ID NO: 1731606 - RNA, 16 nt, Homo sapiens
auuucaccaccaaaug

SEQ ID NO: 1731607 - RNA, 19 nt, Homo sapiens
auuuccucagcuuaucucu

SEQ ID NO: 1731608 - RNA, 20 nt, Homo sapiens
uacaauuucacuuagucugu

SEQ ID NO: 1731609 - RNA, 23 nt, Homo sapiens
uacagacauacauuuaugcacau

SEQ ID NO: 1731610 - RNA, 19 nt, Homo sapiens
uacagauagaguuccauau

SEQ ID NO: 1731611 - RNA, 20 nt, Homo sapiens
uacagcuaucgaacuucaca

SEQ ID NO: 1731612 - RNA, 18 nt, Homo sapiens
uaccacuuuaaacacccc

SEQ ID NO: 1731613 - RNA, 14 nt, Homo sapiens
uacccacauguaca

SEQ ID NO: 1731614 - RNA, 21 nt, Homo sapiens
uacccacauguacagacauac

SEQ ID NO: 1731615 - RNA, 16 nt, Homo sapiens
uaccuucuuguugaua

SEQ ID NO: 1731616 - RNA, 16 nt, Homo sapiens
uacugauaauuuugcu

SEQ ID NO: 1731617 - RNA, 17 nt, Homo sapiens
uacuuugaagugcagcu

SEQ ID NO: 1731618 - RNA, 15 nt, Homo sapiens
uacuuugccacugcu

SEQ ID NO: 1731619 - RNA, 22 nt, Homo sapiens
uacuuuuucugguguguuaaca

SEQ ID NO: 1731620 - RNA, 13 nt, Homo sapiens
uagagcccucucc

SEQ ID NO: 1731621 - RNA, 17 nt, Homo sapiens
uagcaaucugccuguau

SEQ ID NO: 1731622 - RNA, 19 nt, Homo sapiens
uagccagugcuccaggcac

SEQ ID NO: 1731623 - RNA, 13 nt, Homo sapiens
uagcucugcugcu

SEQ ID NO: 1731624 - RNA, 15 nt, Homo sapiens
uagcucugcugcuga

SEQ ID NO: 1731625 - RNA, 17 nt, Homo sapiens
uaguuucuuacacacug

SEQ ID NO: 1731626 - RNA, 19 nt, Homo sapiens
uauaaauagaugcugugua

SEQ ID NO: 1731627 - RNA, 16 nt, Homo sapiens
uauaauuggugcauag

SEQ ID NO: 1731628 - RNA, 13 nt, Homo sapiens
uauacacauauau

SEQ ID NO: 1731629 - RNA, 14 nt, Homo sapiens
uauaccauuuccuc

SEQ ID NO: 1731630 - RNA, 17 nt, Homo sapiens
uauacuuugccacugcu

SEQ ID NO: 1731631 - RNA, 17 nt, Homo sapiens
uauauacccacauguac

SEQ ID NO: 1731632 - RNA, 20 nt, Homo sapiens
uauaugguauauauacauau

SEQ ID NO: 1731633 - RNA, 18 nt, Homo sapiens
uauauuuguaaagcuauu

SEQ ID NO: 1731634 - RNA, 15 nt, Homo sapiens
uaugcaaaagguuua

SEQ ID NO: 1731635 - RNA, 14 nt, Homo sapiens
uauguuuccauuug

SEQ ID NO: 1731636 - RNA, 18 nt, Homo sapiens
uauuaaagaauaagcugu

SEQ ID NO: 1731637 - RNA, 14 nt, Homo sapiens
uauucuugcacuga

SEQ ID NO: 1731638 - RNA, 20 nt, Homo sapiens
uauuuauccaaaauguguau

SEQ ID NO: 1731639 - RNA, 14 nt, Homo sapiens
uauuucguguacug

SEQ ID NO: 1731640 - RNA, 18 nt, Homo sapiens
uauuucucaucugcacua

SEQ ID NO: 1731641 - RNA, 19 nt, Homo sapiens
uauuuuuauuuuugcacaa

SEQ ID NO: 1731642 - RNA, 17 nt, Homo sapiens
ucaaaaagauauuguug

SEQ ID NO: 1731643 - RNA, 15 nt, Homo sapiens
ucacaguaacccaga

SEQ ID NO: 1731644 - RNA, 17 nt, Homo sapiens
ucaccaccaaaugccaa

SEQ ID NO: 1731645 - RNA, 23 nt, Homo sapiens
ucaccuuccaacacuccauuauu

SEQ ID NO: 1731646 - RNA, 20 nt, Homo sapiens
ucaggcuucugcaguucuca

SEQ ID NO: 1731647 - RNA, 22 nt, Homo sapiens
ucagguagaagguugacacagu

SEQ ID NO: 1731648 - RNA, 19 nt, Homo sapiens
ucaucauggaggucauaca

SEQ ID NO: 1731649 - RNA, 14 nt, Homo sapiens
ucaucugcacuaug

SEQ ID NO: 1731650 - RNA, 19 nt, Homo sapiens
ucaugacuccuacuuuuca

SEQ ID NO: 1731651 - RNA, 17 nt, Homo sapiens
ucauucccucucaucuc

SEQ ID NO: 1731652 - RNA, 20 nt, Homo sapiens
ucauucugguucccugcugc

SEQ ID NO: 1731653 - RNA, 15 nt, Homo sapiens
uccaugauuuagcaa

SEQ ID NO: 1731654 - RNA, 15 nt, Homo sapiens
uccccaacaauguga

SEQ ID NO: 1731655 - RNA, 14 nt, Homo sapiens
ucccgaauccacag

SEQ ID NO: 1731656 - RNA, 14 nt, Homo sapiens
ucccuugcuguaug

SEQ ID NO: 1731657 - RNA, 23 nt, Homo sapiens
ucccuugcuguaugcugaucauc

SEQ ID NO: 1731658 - RNA, 15 nt, Homo sapiens
ucccuugcuugccug

SEQ ID NO: 1731659 - RNA, 23 nt, Homo sapiens
uccgcagaagcccugaugugucc

SEQ ID NO: 1731660 - RNA, 16 nt, Homo sapiens
uccuagcuacuuggca

SEQ ID NO: 1731661 - RNA, 13 nt, Homo sapiens
uccuccaggguga

SEQ ID NO: 1731662 - RNA, 22 nt, Homo sapiens
uccuggguacugaaagccuuag

SEQ ID NO: 1731663 - RNA, 23 nt, Homo sapiens
uccuucagugaacuaagucccua

SEQ ID NO: 1731664 - RNA, 15 nt, Homo sapiens
ucgaacuucacaacu

SEQ ID NO: 1731665 - RNA, 16 nt, Homo sapiens
ucguuuugaugccauu

SEQ ID NO: 1731666 - RNA, 13 nt, Homo sapiens
ucuauguuugcac

SEQ ID NO: 1731667 - RNA, 22 nt, Homo sapiens
ucucauccuccaguaccuugcu

SEQ ID NO: 1731668 - RNA, 19 nt, Homo sapiens
ucuccagaauaauucuuaa

SEQ ID NO: 1731669 - RNA, 23 nt, Homo sapiens
ucucccaagcugauuuuauucaa

SEQ ID NO: 1731670 - RNA, 19 nt, Homo sapiens
ucucugucccuugcuguau

SEQ ID NO: 1731671 - RNA, 20 nt, Homo sapiens
ucugaaugcugccacaacca

SEQ ID NO: 1731672 - RNA, 14 nt, Homo sapiens
ucugacaacuguga

SEQ ID NO: 1731673 - RNA, 15 nt, Homo sapiens
ucugacaacugugaa

SEQ ID NO: 1731674 - RNA, 16 nt, Homo sapiens
ucugcacuauguuucc

SEQ ID NO: 1731675 - RNA, 14 nt, Homo sapiens
ucugccgcuaccuc

SEQ ID NO: 1731676 - RNA, 15 nt, Homo sapiens
ucugccuucugcuga

SEQ ID NO: 1731677 - RNA, 13 nt, Homo sapiens
ucuguacuguuac

SEQ ID NO: 1731678 - RNA, 13 nt, Homo sapiens
ucuguugaucuca

SEQ ID NO: 1731679 - RNA, 20 nt, Homo sapiens
ucuuacacacugucuguaua

SEQ ID NO: 1731680 - RNA, 19 nt, Homo sapiens
ucuuaccagugacgcugcu

SEQ ID NO: 1731681 - RNA, 16 nt, Homo sapiens
ucuuggggcccagugc

SEQ ID NO: 1731682 - RNA, 18 nt, Homo sapiens
ucuuggggcccagugcau

SEQ ID NO: 1731683 - RNA, 14 nt, Homo sapiens
ugaaagagccagac

SEQ ID NO: 1731684 - RNA, 13 nt, Homo sapiens
ugaaauauaccuu

SEQ ID NO: 1731685 - RNA, 19 nt, Homo sapiens
ugaaauuacggguaccuga

SEQ ID NO: 1731686 - RNA, 16 nt, Homo sapiens
ugaaauuauacagaua

SEQ ID NO: 1731687 - RNA, 21 nt, Homo sapiens
ugaaggaaauucuuauaacuc

SEQ ID NO: 1731688 - RNA, 22 nt, Homo sapiens
ugaaggaaauucuuauaacuca

SEQ ID NO: 1731689 - RNA, 16 nt, Homo sapiens
ugaaugcugccacaac

SEQ ID NO: 1731690 - RNA, 14 nt, Homo sapiens
ugacaacugugaag

SEQ ID NO: 1731691 - RNA, 20 nt, Homo sapiens
ugacaacugugaagccaccc

SEQ ID NO: 1731692 - RNA, 23 nt, Homo sapiens
ugacucccaaguuuccauagcaa

SEQ ID NO: 1731693 - RNA, 11 nt, Homo sapiens
ugacuggugcu

SEQ ID NO: 1731694 - RNA, 15 nt, Homo sapiens
ugagacucagugcag

SEQ ID NO: 1731695 - RNA, 16 nt, Homo sapiens
ugaggcccugcccaau

SEQ ID NO: 1731696 - RNA, 21 nt, Homo sapiens
ugaggguguuucuuccugcac

SEQ ID NO: 1731697 - RNA, 19 nt, Homo sapiens
ugaguaucuguauguauau

SEQ ID NO: 1731698 - RNA, 16 nt, Homo sapiens
ugaguucgaggacuac

SEQ ID NO: 1731699 - RNA, 22 nt, Homo sapiens
ugcaaacccgaaaauaaaagac

SEQ ID NO: 1731700 - RNA, 18 nt, Homo sapiens
ugcaacucuaacucugag

SEQ ID NO: 1731701 - RNA, 14 nt, Homo sapiens
ugcagauacuuuga

SEQ ID NO: 1731702 - RNA, 15 nt, Homo sapiens
ugcaguauucuugca

SEQ ID NO: 1731703 - RNA, 20 nt, Homo sapiens
ugcaguauucuugcacugag

SEQ ID NO: 1731704 - RNA, 21 nt, Homo sapiens
ugcauagcagaugguuuccac

SEQ ID NO: 1731705 - RNA, 14 nt, Homo sapiens
ugcauuauaucaaa

SEQ ID NO: 1731706 - RNA, 17 nt, Homo sapiens
ugcccuuucaaagcacu

SEQ ID NO: 1731707 - RNA, 21 nt, Homo sapiens
ugcgacccugggggcacagga

SEQ ID NO: 1731708 - RNA, 22 nt, Homo sapiens
ucuuaccagugacgcugcugac

SEQ ID NO: 1731709 - RNA, 20 nt, Homo sapiens
ucuuucaugggcaccaaccu

SEQ ID NO: 1731710 - RNA, 13 nt, Homo sapiens
ugaaaaugcaacu

SEQ ID NO: 1731711 - RNA, 19 nt, Homo sapiens
ugaaaccuacacacuguca

SEQ ID NO: 1731712 - RNA, 13 nt, Homo sapiens
ugaauggucucag

SEQ ID NO: 1731713 - RNA, 18 nt, Homo sapiens
ugacucccaaguuuccau

SEQ ID NO: 1731714 - RNA, 16 nt, Homo sapiens
ugagacucagugcaga

SEQ ID NO: 1731715 - RNA, 17 nt, Homo sapiens
ugagacucuagggucca

SEQ ID NO: 1731716 - RNA, 23 nt, Homo sapiens
ugagacucuaggguccaguggau

SEQ ID NO: 1731717 - RNA, 18 nt, Homo sapiens
ugagagcuguuuuugaca

SEQ ID NO: 1731718 - RNA, 16 nt, Homo sapiens
ugaggaaggaacagca

SEQ ID NO: 1731719 - RNA, 20 nt, Homo sapiens
ugaggcccugcccaaugaga

SEQ ID NO: 1731720 - RNA, 17 nt, Homo sapiens
ugagugucuuagcauau

SEQ ID NO: 1731721 - RNA, 15 nt, Homo sapiens
ugaugccauucuucc

SEQ ID NO: 1731722 - RNA, 18 nt, Homo sapiens
ugauucuaauggggacac

SEQ ID NO: 1731723 - RNA, 16 nt, Homo sapiens
ugcagaguugaaguuu

SEQ ID NO: 1731724 - RNA, 23 nt, Homo sapiens
ugcagauacuuugaagugcagcu

SEQ ID NO: 1731725 - RNA, 21 nt, Homo sapiens
ugcagcaccgaggggccuuug

SEQ ID NO: 1731726 - RNA, 16 nt, Homo sapiens
ugcauuauaucaaauc

SEQ ID NO: 1731727 - RNA, 14 nt, Homo sapiens
ugccaccauaccuc

SEQ ID NO: 1731728 - RNA, 14 nt, Homo sapiens
ugccccccaugagg

SEQ ID NO: 1731729 - RNA, 14 nt, Homo sapiens
ugccgcuaccuccc

SEQ ID NO: 1731730 - RNA, 14 nt, Homo sapiens
ugccuucugcugaa

SEQ ID NO: 1731731 - RNA, 22 nt, Homo sapiens
ugcgauuuuguuaacccagcga

SEQ ID NO: 1731732 - RNA, 14 nt, Homo sapiens
ugcugauacugggu

SEQ ID NO: 1731733 - RNA, 15 nt, Homo sapiens
ugcugcuggugcaca

SEQ ID NO: 1731734 - RNA, 21 nt, Homo sapiens
ugcuguauuuuuauuuuugca

SEQ ID NO: 1731735 - RNA, 18 nt, Homo sapiens
ugcuuuuguuccaauguc

SEQ ID NO: 1731736 - RNA, 20 nt, Homo sapiens
uggaacauauagaaugcaga

SEQ ID NO: 1731737 - RNA, 17 nt, Homo sapiens
uggaagaggaacagcac

SEQ ID NO: 1731738 - RNA, 15 nt, Homo sapiens
uggaagggguccagc

SEQ ID NO: 1731739 - RNA, 14 nt, Homo sapiens
uggcaggugccugu

SEQ ID NO: 1731740 - RNA, 16 nt, Homo sapiens
uggccagaggugucac

SEQ ID NO: 1731741 - RNA, 13 nt, Homo sapiens
uggcuagcaaucu

SEQ ID NO: 1731742 - RNA, 21 nt, Homo sapiens
uggcuagcaaucugccuguau

SEQ ID NO: 1731743 - RNA, 14 nt, Homo sapiens
ugggccauguccaa

SEQ ID NO: 1731744 - RNA, 22 nt, Homo sapiens
ugggcccacccggugggacccc

SEQ ID NO: 1731745 - RNA, 17 nt, Homo sapiens
ugggccccuggcacucu

SEQ ID NO: 1731746 - RNA, 19 nt, Homo sapiens
ugggccccuggcacucuug

SEQ ID NO: 1731747 - RNA, 23 nt, Homo sapiens
ugggcuacagaaaccacagucuu

SEQ ID NO: 1731748 - RNA, 12 nt, Homo sapiens
uggggggaccca

SEQ ID NO: 1731749 - RNA, 23 nt, Homo sapiens
uggguacugaaagccuuagggaa

SEQ ID NO: 1731750 - RNA, 19 nt, Homo sapiens
ugggugaucugcugcugag

SEQ ID NO: 1731751 - RNA, 14 nt, Homo sapiens
uggugucaguaucc

SEQ ID NO: 1731752 - RNA, 15 nt, Homo sapiens
ugguuuccacauuua

SEQ ID NO: 1731753 - RNA, 19 nt, Homo sapiens
uguaauccuagcuacuugg

SEQ ID NO: 1731754 - RNA, 22 nt, Homo sapiens
uguauauuuguuuuaugcuacu

SEQ ID NO: 1731755 - RNA, 17 nt, Homo sapiens
uguaugaaaaguaacug

SEQ ID NO: 1731756 - RNA, 12 nt, Homo sapiens
uguccaaagagg

SEQ ID NO: 1731757 - RNA, 14 nt, Homo sapiens
uguccagcaccuug

SEQ ID NO: 1731758 - RNA, 15 nt, Homo sapiens
ugucccuucccagcg

SEQ ID NO: 1731759 - RNA, 18 nt, Homo sapiens
uguccuuuuucaggagaa

SEQ ID NO: 1731760 - RNA, 10 nt, Homo sapiens
ugugcacauc

SEQ ID NO: 1731761 - RNA, 16 nt, Homo sapiens
ugugugugugcacauc

SEQ ID NO: 1731762 - RNA, 21 nt, Homo sapiens
uguucuggggggacccagugc

SEQ ID NO: 1731763 - RNA, 21 nt, Homo sapiens
uguuuccauuugugguccuga

SEQ ID NO: 1731764 - RNA, 22 nt, Homo sapiens
uguuucucugccgcuaccuccc

SEQ ID NO: 1731765 - RNA, 20 nt, Homo sapiens
uuacauauuuuuuguauauu

SEQ ID NO: 1731766 - RNA, 20 nt, Homo sapiens
uuauacagauagaguuccau

SEQ ID NO: 1731767 - RNA, 21 nt, Homo sapiens
uuauugaguucgaggacuaca

SEQ ID NO: 1731768 - RNA, 13 nt, Homo sapiens
uucaccaccaaau

SEQ ID NO: 1731769 - RNA, 21 nt, Homo sapiens
uucauccuagucuagcauucu

SEQ ID NO: 1731770 - RNA, 22 nt, Homo sapiens
uucaugcagaguugaaguuuac

SEQ ID NO: 1731771 - RNA, 18 nt, Homo sapiens
uucgaggacuacaaccaa

SEQ ID NO: 1731772 - RNA, 23 nt, Homo sapiens
uucuggggacagacaaggugccu

SEQ ID NO: 1731773 - RNA, 15 nt, Homo sapiens
uucuguugaucucag

SEQ ID NO: 1731774 - RNA, 16 nt, Homo sapiens
uucuguugaucucagu

SEQ ID NO: 1731775 - RNA, 11 nt, Homo sapiens
uucuguuuacu

SEQ ID NO: 1731776 - RNA, 15 nt, Homo sapiens
uugagaccauuucaa

SEQ ID NO: 1731777 - RNA, 15 nt, Homo sapiens
uugccacugcuguau

SEQ ID NO: 1731778 - RNA, 17 nt, Homo sapiens
uugcccugaauggucuc

SEQ ID NO: 1731779 - RNA, 14 nt, Homo sapiens
uugccuccaggugc

SEQ ID NO: 1731780 - RNA, 17 nt, Homo sapiens
uuggaaagacuucucaa

SEQ ID NO: 1731781 - RNA, 13 nt, Homo sapiens
uuuaaaaacacaa

SEQ ID NO: 1731782 - RNA, 21 nt, Homo sapiens
uuuaguagccucaauucucca

SEQ ID NO: 1731783 - RNA, 14 nt, Homo sapiens
uuuauuugagguca

SEQ ID NO: 1731784 - RNA, 15 nt, Homo sapiens
uuucaaagcacuuaa

SEQ ID NO: 1731785 - RNA, 15 nt, Homo sapiens
uuugccacugcugua

SEQ ID NO: 1731786 - RNA, 23 nt, Homo sapiens
uuuggugcuggaaccagcucucu

SEQ ID NO: 1731787 - RNA, 20 nt, Homo sapiens
uuugugauauuucguguacu

SEQ ID NO: 1731788 - RNA, 22 nt, Homo sapiens
uuuguggccuuggcugacauga

SEQ ID NO: 1731789 - RNA, 16 nt, Homo sapiens
uuuguuucauauauac

SEQ ID NO: 1731790 - RNA, 16 nt, Homo sapiens
uuuuaacuuauugaca

SEQ ID NO: 1731791 - RNA, 16 nt, Homo sapiens
uuuuaauuugggaaaa

SEQ ID NO: 1731792 - RNA, 17 nt, Homo sapiens
uuuuacugcccuuucaa

SEQ ID NO: 1731793 - RNA, 15 nt, Homo sapiens
uuuuauuaugcauua

SEQ ID NO: 1731794 - RNA, 21 nt, Homo sapiens
gcugaaagacucgagaaccaa

SEQ ID NO: 1731795 - RNA, 19 nt, Homo sapiens
gcugauacugggucugcga

SEQ ID NO: 1731796 - RNA, 14 nt, Homo sapiens
gcugccacaaccag

SEQ ID NO: 1731797 - RNA, 15 nt, Homo sapiens
gcugcuggugcacag

SEQ ID NO: 1731798 - RNA, 15 nt, Homo sapiens
gcuggaaggggucca

SEQ ID NO: 1731799 - RNA, 19 nt, Homo sapiens
gcugggccauguccaaaga

SEQ ID NO: 1731800 - RNA, 23 nt, Homo sapiens
gcuguauuuuuauuuuugcacaa

SEQ ID NO: 1731801 - RNA, 21 nt, Homo sapiens
ggaaaauaaauacauucgaag

SEQ ID NO: 1731802 - RNA, 14 nt, Homo sapiens
ggaaccagcucucu

SEQ ID NO: 1731803 - RNA, 13 nt, Homo sapiens
ggacccagugcag

SEQ ID NO: 1731804 - RNA, 13 nt, Homo sapiens
ggagaauuugaaa

SEQ ID NO: 1731805 - RNA, 17 nt, Homo sapiens
ggaggugauuccaguga

SEQ ID NO: 1731806 - RNA, 21 nt, Homo sapiens
ggaucaacaacauccacuguu

SEQ ID NO: 1731807 - RNA, 14 nt, Homo sapiens
ggcaccaaccugca

SEQ ID NO: 1731808 - RNA, 18 nt, Homo sapiens
ggcaggcugggccauguc

SEQ ID NO: 1731809 - RNA, 15 nt, Homo sapiens
ggcagguccacagag

SEQ ID NO: 1731810 - RNA, 20 nt, Homo sapiens
ggcaugagacucagugcaga

SEQ ID NO: 1731811 - RNA, 15 nt, Homo sapiens
ggccauguccaaaga

SEQ ID NO: 1731812 - RNA, 13 nt, Homo sapiens
ggcccagugcaug

SEQ ID NO: 1731813 - RNA, 23 nt, Homo sapiens
ggcgugggggcucaugccuguaa

SEQ ID NO: 1731814 - RNA, 20 nt, Homo sapiens
gggaaaagauuacugaaaua

SEQ ID NO: 1731815 - RNA, 21 nt, Homo sapiens
gggcaggcugggccaugucca

SEQ ID NO: 1731816 - RNA, 13 nt, Homo sapiens
gggccauggcuca

SEQ ID NO: 1731817 - RNA, 19 nt, Homo sapiens
gggccauggcucagggugg

SEQ ID NO: 1731818 - RNA, 14 nt, Homo sapiens
gggccauguccaaa

SEQ ID NO: 1731819 - RNA, 14 nt, Homo sapiens
ggggcccagugcau

SEQ ID NO: 1731820 - RNA, 16 nt, Homo sapiens
gguauauacuuugcca

SEQ ID NO: 1731821 - RNA, 13 nt, Homo sapiens
ggucauacaugca

SEQ ID NO: 1731822 - RNA, 11 nt, Homo sapiens
gguccacagag

SEQ ID NO: 1731823 - RNA, 10 nt, Homo sapiens
ggugcacagc

SEQ ID NO: 1731824 - RNA, 17 nt, Homo sapiens
ggugcacagccacuccc

SEQ ID NO: 1731825 - RNA, 15 nt, Homo sapiens
ggugcugcagcaccg

SEQ ID NO: 1731826 - RNA, 14 nt, Homo sapiens
gguguguucugcaa

SEQ ID NO: 1731827 - RNA, 20 nt, Homo sapiens
gguuuuaaccgcacaugcac

SEQ ID NO: 1731828 - RNA, 23 nt, Homo sapiens
guaaauccuuuuggaacauauag

SEQ ID NO: 1731829 - RNA, 16 nt, Homo sapiens
guaaucccagcacuuu

SEQ ID NO: 1731830 - RNA, 22 nt, Homo sapiens
guacugcaaaguguaugcagua

SEQ ID NO: 1731831 - RNA, 16 nt, Homo sapiens
guagcucugcugcuga

SEQ ID NO: 1731832 - RNA, 17 nt, Homo sapiens
gucaggggaacagagaa

SEQ ID NO: 1731833 - RNA, 11 nt, Homo sapiens
guccagcaccu

SEQ ID NO: 1731834 - RNA, 15 nt, Homo sapiens
gucccaggcagggag

SEQ ID NO: 1731835 - RNA, 22 nt, Homo sapiens
gucccuugcuugccugcagggc

SEQ ID NO: 1731836 - RNA, 12 nt, Homo sapiens
acccagugcaga

SEQ ID NO: 1731837 - RNA, 14 nt, Homo sapiens
accccugacucauc

SEQ ID NO: 1731838 - RNA, 15 nt, Homo sapiens
accuacacacuguca

SEQ ID NO: 1731839 - RNA, 16 nt, Homo sapiens
acgcuguuuguuucau

SEQ ID NO: 1731840 - RNA, 14 nt, Homo sapiens
acggaggccugcga

SEQ ID NO: 1731841 - RNA, 15 nt, Homo sapiens
acgugugugucuuac

SEQ ID NO: 1731842 - RNA, 14 nt, Homo sapiens
acguguuccagugu

SEQ ID NO: 1731843 - RNA, 20 nt, Homo sapiens
acuaacgugugugucuuaca

SEQ ID NO: 1731844 - RNA, 14 nt, Homo sapiens
acuaagacaccuga

SEQ ID NO: 1731845 - RNA, 16 nt, Homo sapiens
acuaauuuucucccaa

SEQ ID NO: 1731846 - RNA, 13 nt, Homo sapiens
acuauguuuccau

SEQ ID NO: 1731847 - RNA, 10 nt, Homo sapiens
acucagucuu

SEQ ID NO: 1731848 - RNA, 18 nt, Homo sapiens
acuccuacuuuucauccu

SEQ ID NO: 1731849 - RNA, 23 nt, Homo sapiens
acuccugacgucugaagcuugac

SEQ ID NO: 1731850 - RNA, 22 nt, Homo sapiens
augaucaguguuguugcucuag

SEQ ID NO: 1731851 - RNA, 19 nt, Homo sapiens
augauuuagugaucaaauu

SEQ ID NO: 1731852 - RNA, 19 nt, Homo sapiens
augcaguauucuugcacug

SEQ ID NO: 1731853 - RNA, 20 nt, Homo sapiens
augcaguauucuugcacuga

SEQ ID NO: 1731854 - RNA, 23 nt, Homo sapiens
augggagaguacacccuuuccag

SEQ ID NO: 1731855 - RNA, 13 nt, Homo sapiens
auggggacacaga

SEQ ID NO: 1731856 - RNA, 16 nt, Homo sapiens
augguacggacuuccu

SEQ ID NO: 1731857 - RNA, 15 nt, Homo sapiens
auguagcccauccuu

SEQ ID NO: 1731858 - RNA, 21 nt, Homo sapiens
auguauggaaucccacuguau

SEQ ID NO: 1731859 - RNA, 17 nt, Homo sapiens
auguccagcaccuugug

SEQ ID NO: 1731860 - RNA, 21 nt, Homo sapiens
augugagugccuuuugcagaa

SEQ ID NO: 1731861 - RNA, 12 nt, Homo sapiens
auguuauaucau

SEQ ID NO: 1731862 - RNA, 22 nt, Homo sapiens
auguuguguuuuuaacauguca

SEQ ID NO: 1731863 - RNA, 18 nt, Homo sapiens
auuaagacuuuauguagu

SEQ ID NO: 1731864 - RNA, 21 nt, Homo sapiens
auuacauauuuuuuguauauu

SEQ ID NO: 1731865 - RNA, 14 nt, Homo sapiens
ccuauuuauuugag

SEQ ID NO: 1731866 - RNA, 18 nt, Homo sapiens
ccuccagggugauuuuau

SEQ ID NO: 1731867 - RNA, 14 nt, Homo sapiens
ccugaauggucuca

SEQ ID NO: 1731868 - RNA, 14 nt, Homo sapiens
ccugcccaaugaga

SEQ ID NO: 1731869 - RNA, 22 nt, Homo sapiens
ccuggcacucuuguucccacac

SEQ ID NO: 1731870 - RNA, 20 nt, Homo sapiens
ccugggguguuaguggcacc

SEQ ID NO: 1731871 - RNA, 13 nt, Homo sapiens
ccuguaucucuca

SEQ ID NO: 1731872 - RNA, 18 nt, Homo sapiens
ccuucuccacacccacuu

SEQ ID NO: 1731873 - RNA, 15 nt, Homo sapiens
ccuuuaggaucucag

SEQ ID NO: 1731874 - RNA, 22 nt, Homo sapiens
cgaaggaaccuguguuaucaca

SEQ ID NO: 1731875 - RNA, 11 nt, Homo sapiens
cgacccauuca

SEQ ID NO: 1731876 - RNA, 22 nt, Homo sapiens
cgaggacuacaaccaauuuaca

SEQ ID NO: 1731877 - RNA, 13 nt, Homo sapiens
cgcacaugcacac

SEQ ID NO: 1731878 - RNA, 17 nt, Homo sapiens
cgccuccccaccuccag

SEQ ID NO: 1731879 - RNA, 17 nt, Homo sapiens
cggccucugccuuugca

SEQ ID NO: 1731880 - RNA, 14 nt, Homo sapiens
cggugguugucaca

SEQ ID NO: 1731881 - RNA, 16 nt, Homo sapiens
agcuaguguaccuccu

SEQ ID NO: 1731882 - RNA, 12 nt, Homo sapiens
agcucuucccac

SEQ ID NO: 1731883 - RNA, 24 nt, Homo sapiens
agcugccuaggauguucugggcua

SEQ ID NO: 1731884 - RNA, 13 nt, Homo sapiens
agcuggccugaga

SEQ ID NO: 1731885 - RNA, 14 nt, Homo sapiens
agcugucacuuuug

SEQ ID NO: 1731886 - RNA, 23 nt, Homo sapiens
agcugucccuugcuugccugcag

SEQ ID NO: 1731887 - RNA, 17 nt, Homo sapiens
agcuguugugugagguu

SEQ ID NO: 1731888 - RNA, 15 nt, Homo sapiens
aggaacagcacuggg

SEQ ID NO: 1731889 - RNA, 18 nt, Homo sapiens
aggaauccccaacaugca

SEQ ID NO: 1731890 - RNA, 16 nt, Homo sapiens
aggacagaccacagag

SEQ ID NO: 1731891 - RNA, 19 nt, Homo sapiens
aggcagugugccaguuuaa

SEQ ID NO: 1731892 - RNA, 16 nt, Homo sapiens
aggcugccccucucac

SEQ ID NO: 1731893 - RNA, 19 nt, Homo sapiens
aggcugccccucucaccaa

SEQ ID NO: 1731894 - RNA, 17 nt, Homo sapiens
aggcugggccaugucca

SEQ ID NO: 1731895 - RNA, 18 nt, Homo sapiens
aggcugggccauguccaa

SEQ ID NO: 1731896 - RNA, 15 nt, Homo sapiens
agggggagaaugggu

SEQ ID NO: 1731897 - RNA, 18 nt, Homo sapiens
agggggagaauggguguu

SEQ ID NO: 1731898 - RNA, 14 nt, Homo sapiens
agggguccagccuc

SEQ ID NO: 1731899 - RNA, 13 nt, Homo sapiens
aggguccagugga

SEQ ID NO: 1731900 - RNA, 14 nt, Homo sapiens
aggguccaguggau

SEQ ID NO: 1731901 - RNA, 12 nt, Homo sapiens
aggugccuguua

SEQ ID NO: 1731902 - RNA, 15 nt, Homo sapiens
aguacuuugugcauu

SEQ ID NO: 1731903 - RNA, 18 nt, Homo sapiens
aguagccucaauucucca

SEQ ID NO: 1731904 - RNA, 16 nt, Homo sapiens
aguauccaggcuuugu

SEQ ID NO: 1731905 - RNA, 23 nt, Homo sapiens
aguaucuguauguauauauacac

SEQ ID NO: 1731906 - RNA, 12 nt, Homo sapiens
aguauucuugca

SEQ ID NO: 1731907 - RNA, 15 nt, Homo sapiens
agucuagcauucugc

SEQ ID NO: 1731908 - RNA, 22 nt, Homo sapiens
agucuagcauucugcaacauuu

SEQ ID NO: 1731909 - RNA, 23 nt, Homo sapiens
agucugaaugcugccacaaccag

SEQ ID NO: 1731910 - RNA, 16 nt, Homo sapiens
agucuguacuucauca

SEQ ID NO: 1731911 - RNA, 18 nt, Homo sapiens
agucuucccagcaauuau

SEQ ID NO: 1731912 - RNA, 21 nt, Homo sapiens
agugccucaccuuccaacacu

SEQ ID NO: 1731913 - RNA, 23 nt, Homo sapiens
agugucugucugaggugacuuaa

SEQ ID NO: 1731914 - RNA, 15 nt, Homo sapiens
agugugccaguuuaa

SEQ ID NO: 1731915 - RNA, 16 nt, Homo sapiens
aguugaaaaugcaacu

SEQ ID NO: 1731916 - RNA, 17 nt, Homo sapiens
auaacuacuuccauccc

SEQ ID NO: 1731917 - RNA, 16 nt, Homo sapiens
auaauaacuacuucca

SEQ ID NO: 1731918 - RNA, 18 nt, Homo sapiens
auauauuuacucagucuu

SEQ ID NO: 1731919 - RNA, 14 nt, Homo sapiens
auauuuuauuuccu

SEQ ID NO: 1731920 - RNA, 15 nt, Homo sapiens
aucaacuaaugauuu

SEQ ID NO: 1731921 - RNA, 23 nt, Homo sapiens
aucaucaaagcucacaccaaauu

SEQ ID NO: 1731922 - RNA, 14 nt, Homo sapiens
auccgcgugugccu

SEQ ID NO: 1731923 - RNA, 21 nt, Homo sapiens
auccuggguacugaaagccuu

SEQ ID NO: 1731924 - RNA, 20 nt, Homo sapiens
aaaaauuuuagcucuuccca

SEQ ID NO: 1731925 - RNA, 13 nt, Homo sapiens
aaaagcauuguuu

SEQ ID NO: 1731926 - RNA, 16 nt, Homo sapiens
aaaagcgacccauuca

SEQ ID NO: 1731927 - RNA, 19 nt, Homo sapiens
aaaaugcaacucuaacucu

SEQ ID NO: 1731928 - RNA, 13 nt, Homo sapiens
aaacgcuaccucu

SEQ ID NO: 1731929 - RNA, 14 nt, Homo sapiens
aaagacagcuuuaa

SEQ ID NO: 1731930 - RNA, 15 nt, Homo sapiens
aaagaggcugccccu

SEQ ID NO: 1731931 - RNA, 17 nt, Homo sapiens
aaagcuaguguaccucc

SEQ ID NO: 1731932 - RNA, 22 nt, Homo sapiens
aaagcuaguguaccuccucuca

SEQ ID NO: 1731933 - RNA, 22 nt, Homo sapiens
aaagguuuuaaccgcacaugca

SEQ ID NO: 1731934 - RNA, 16 nt, Homo sapiens
aaaugaaaucuuccca

SEQ ID NO: 1731935 - RNA, 22 nt, Homo sapiens
aaauguacaacugcaccuguca

SEQ ID NO: 1731936 - RNA, 19 nt, Homo sapiens
aaauuuccuuucauaccuu

SEQ ID NO: 1731937 - RNA, 22 nt, Homo sapiens
aaauuuccuuucauaccuugaa

SEQ ID NO: 1731938 - RNA, 17 nt, Homo sapiens
aacaauucccccauccu

SEQ ID NO: 1731939 - RNA, 14 nt, Homo sapiens
aacauccacuguua

SEQ ID NO: 1731940 - RNA, 15 nt, Homo sapiens
aacauguccuaauuc

SEQ ID NO: 1731941 - RNA, 17 nt, Homo sapiens
aacauguccuaauucuu

SEQ ID NO: 1731942 - RNA, 16 nt, Homo sapiens
aaccacagucuuccca

SEQ ID NO: 1731943 - RNA, 16 nt, Homo sapiens
aaccgcacaugcacac

SEQ ID NO: 1731944 - RNA, 13 nt, Homo sapiens
aaccucaguugaa

SEQ ID NO: 1731945 - RNA, 23 nt, Homo sapiens
aaccuguccuaaggaaccuuccu

SEQ ID NO: 1731946 - RNA, 15 nt, Homo sapiens
aacguccacaugaaa

SEQ ID NO: 1731947 - RNA, 15 nt, Homo sapiens
aacuacuuccauccc

SEQ ID NO: 1731948 - RNA, 16 nt, Homo sapiens
aacuacuuccaucccu

SEQ ID NO: 1731949 - RNA, 11 nt, Homo sapiens
aacuguugcuc

SEQ ID NO: 1731950 - RNA, 20 nt, Homo sapiens
aagagccagacucugucuca

SEQ ID NO: 1731951 - RNA, 21 nt, Homo sapiens
aagaggcugccccucucacca

SEQ ID NO: 1731952 - RNA, 15 nt, Homo sapiens
aagaugggagccuuu

SEQ ID NO: 1731953 - RNA, 17 nt, Homo sapiens
aagauugcgguuuacag

SEQ ID NO: 1731954 - RNA, 19 nt, Homo sapiens
aagcaagccagccaauaga

SEQ ID NO: 1731955 - RNA, 17 nt, Homo sapiens
aagcaaguuuucuucca

SEQ ID NO: 1731956 - RNA, 19 nt, Homo sapiens
aagcggaaaguuagugcuu

SEQ ID NO: 1731957 - RNA, 18 nt, Homo sapiens
aagcugauuuuauucaau

SEQ ID NO: 1731958 - RNA, 15 nt, Homo sapiens
aaggaaauucuuaua

SEQ ID NO: 1731959 - RNA, 15 nt, Homo sapiens
aaggggagaagggaa

SEQ ID NO: 1731960 - RNA, 13 nt, Homo sapiens
aaguauguguuua

SEQ ID NO: 1731961 - RNA, 14 nt, Homo sapiens
aauaaauacauucg

SEQ ID NO: 1731962 - RNA, 14 nt, Homo sapiens
aauaauucuuaaca

SEQ ID NO: 1731963 - RNA, 23 nt, Homo sapiens
aauaugguuacguugguuaaaua

SEQ ID NO: 1731964 - RNA, 18 nt, Homo sapiens
aauccccaacaugcacug

SEQ ID NO: 1731965 - RNA, 22 nt, Homo sapiens
aaucugaagauugcgguuuaca

SEQ ID NO: 1731966 - RNA, 22 nt, Homo sapiens
aaugcauaauaacuacuuccau

SEQ ID NO: 1731967 - RNA, 17 nt, Homo sapiens
aaugcuucuagaguuuu

SEQ ID NO: 1731968 - RNA, 20 nt, Homo sapiens
aaugcuucuguugaucucag

SEQ ID NO: 1731969 - RNA, 16 nt, Homo sapiens
aauggucucagcuuga

SEQ ID NO: 1731970 - RNA, 16 nt, Homo sapiens
aauguuuaaagaucau

SEQ ID NO: 1731971 - RNA, 14 nt, Homo sapiens
aauuaagacuuuau

SEQ ID NO: 1731972 - RNA, 22 nt, Homo sapiens
aauuauacagauagaguuccau

SEQ ID NO: 1731973 - RNA, 20 nt, Homo sapiens
aauuuauugaguuuuuacaa

SEQ ID NO: 1731974 - RNA, 13 nt, Homo sapiens
acaaggugccugu

SEQ ID NO: 1731975 - RNA, 20 nt, Homo sapiens
acacagagcuuuggucugug

SEQ ID NO: 1731976 - RNA, 16 nt, Homo sapiens
acacugaaaugaaauc

SEQ ID NO: 1731977 - RNA, 22 nt, Homo sapiens
acacugucuguauagugucugu

SEQ ID NO: 1731978 - RNA, 21 nt, Homo sapiens
acagacaaggugccuguuaua

SEQ ID NO: 1731979 - RNA, 15 nt, Homo sapiens
acagacauacauuua

SEQ ID NO: 1731980 - RNA, 13 nt, Homo sapiens
acagucuucccag

SEQ ID NO: 1731981 - RNA, 19 nt, Homo sapiens
acauccgcgugugccugug

SEQ ID NO: 1731982 - RNA, 10 nt, Homo sapiens
acauugccaa

SEQ ID NO: 1731983 - RNA, 14 nt, Homo sapiens
acauuuucuuucau

SEQ ID NO: 1731984 - RNA, 18 nt, Homo sapiens
acauuuuuccguuugcuu

SEQ ID NO: 1731985 - RNA, 20 nt, Homo sapiens
acccugcugcuggugcacag

SEQ ID NO: 1731986 - RNA, 14 nt, Homo sapiens
accguuguuugcaa

SEQ ID NO: 1731987 - RNA, 17 nt, Homo sapiens
accuuccaacacuccau

SEQ ID NO: 1731988 - RNA, 13 nt, Homo sapiens
accuugugccugg

SEQ ID NO: 1731989 - RNA, 23 nt, Homo sapiens
acggacuuccuuuaggaucucag

SEQ ID NO: 1731990 - RNA, 18 nt, Homo sapiens
acggucuccugacuggug

SEQ ID NO: 1731991 - RNA, 11 nt, Homo sapiens
acucagugcag

SEQ ID NO: 1731992 - RNA, 15 nt, Homo sapiens
acuccauuauuccuc

SEQ ID NO: 1731993 - RNA, 16 nt, Homo sapiens
acuccauuauuccucu

SEQ ID NO: 1731994 - RNA, 21 nt, Homo sapiens
acugcccuuucaaagcacuua

SEQ ID NO: 1731995 - RNA, 12 nt, Homo sapiens
acugucuguaua

SEQ ID NO: 1731996 - RNA, 13 nt, Homo sapiens
acuuaacacuucu

SEQ ID NO: 1731997 - RNA, 19 nt, Homo sapiens
acuuccaggggaaccugcc

SEQ ID NO: 1731998 - RNA, 20 nt, Homo sapiens
acuuccaggggaaccugcca

SEQ ID NO: 1731999 - RNA, 20 nt, Homo sapiens
acuuuguauaugaaucaaaa

SEQ ID NO: 1732000 - RNA, 20 nt, Homo sapiens
agaacaaaagcgacccauuc

SEQ ID NO: 1732001 - RNA, 12 nt, Homo sapiens
agaagcccugau

SEQ ID NO: 1732002 - RNA, 19 nt, Homo sapiens
agaagucauauguugucuu

SEQ ID NO: 1732003 - RNA, 14 nt, Homo sapiens
agacaauaugugag

SEQ ID NO: 1732004 - RNA, 17 nt, Homo sapiens
gccuaguuucuuacaca

SEQ ID NO: 1732005 - RNA, 16 nt, Homo sapiens
gccugggcugguugga

SEQ ID NO: 1732006 - RNA, 16 nt, Homo sapiens
gcgcugcuugguguga

SEQ ID NO: 1732007 - RNA, 16 nt, Homo sapiens
gcgugugccugugugc

SEQ ID NO: 1732008 - RNA, 20 nt, Homo sapiens
gcucaggguggucucuucuu

SEQ ID NO: 1732009 - RNA, 16 nt, Homo sapiens
gcucaugccuguaauc

SEQ ID NO: 1732010 - RNA, 14 nt, Homo sapiens
gcucugcugcugau

SEQ ID NO: 1732011 - RNA, 16 nt, Homo sapiens
gcugagaucguaccua

SEQ ID NO: 1732012 - RNA, 17 nt, Homo sapiens
gcugggccauguccaaa

SEQ ID NO: 1732013 - RNA, 22 nt, Homo sapiens
gcuguauuuuuauuuuugcaca

SEQ ID NO: 1732014 - RNA, 14 nt, Homo sapiens
gcuguuuguuucau

SEQ ID NO: 1732015 - RNA, 22 nt, Homo sapiens
gcuguuuguuucauauauacag

SEQ ID NO: 1732016 - RNA, 17 nt, Homo sapiens
gcuucuagaguuuuaua

SEQ ID NO: 1732017 - RNA, 16 nt, Homo sapiens
gcuucugcaguucuca

SEQ ID NO: 1732018 - RNA, 17 nt, Homo sapiens
gcuucugcaguucucau

SEQ ID NO: 1732019 - RNA, 22 nt, Homo sapiens
gcuucugcaguucucaugacuc

SEQ ID NO: 1732020 - RNA, 19 nt, Homo sapiens
gcuuggcccuuuccuucca

SEQ ID NO: 1732021 - RNA, 19 nt, Homo sapiens
gcuuuaaaaucuguucacu

SEQ ID NO: 1732022 - RNA, 23 nt, Homo sapiens
ggaacagcacuggggagucuuug

SEQ ID NO: 1732023 - RNA, 20 nt, Homo sapiens
ggaacauauagaaugcagag

SEQ ID NO: 1732024 - RNA, 17 nt, Homo sapiens
ggaaccuguccuaagga

SEQ ID NO: 1732025 - RNA, 18 nt, Homo sapiens
ggaagcggcccuaaggga

SEQ ID NO: 1732026 - RNA, 15 nt, Homo sapiens
ggacaucacagggug

SEQ ID NO: 1732027 - RNA, 13 nt, Homo sapiens
ggacuccaucucu

SEQ ID NO: 1732028 - RNA, 22 nt, Homo sapiens
ggacuccaucucucauccucca

SEQ ID NO: 1732029 - RNA, 20 nt, Homo sapiens
ggagacagagguugcaguga

SEQ ID NO: 1732030 - RNA, 16 nt, Homo sapiens
ggaggucauacaugca

SEQ ID NO: 1732031 - RNA, 19 nt, Homo sapiens
ggaggucauacaugcauac

SEQ ID NO: 1732032 - RNA, 18 nt, Homo sapiens
ggaucucaggcuucugca

SEQ ID NO: 1732033 - RNA, 22 nt, Homo sapiens
ggaugaaagagccagacucugu

SEQ ID NO: 1732034 - RNA, 19 nt, Homo sapiens
ggaugccacagcccagcuu

SEQ ID NO: 1732035 - RNA, 19 nt, Homo sapiens
ggcaagugugggggguccu

SEQ ID NO: 1732036 - RNA, 18 nt, Homo sapiens
ggcaauuucaccaccaaa

SEQ ID NO: 1732037 - RNA, 22 nt, Homo sapiens
ggcaauuucaccaccaaaugcc

SEQ ID NO: 1732038 - RNA, 16 nt, Homo sapiens
ggcaugagacucagug

SEQ ID NO: 1732039 - RNA, 17 nt, Homo sapiens
ggccccuggcacucuug

SEQ ID NO: 1732040 - RNA, 16 nt, Homo sapiens
ggccggcccugugugc

SEQ ID NO: 1732041 - RNA, 22 nt, Homo sapiens
ggccugcgacccugggggcaca

SEQ ID NO: 1732042 - RNA, 22 nt, Homo sapiens
ggcgugggggcucaugccugua

SEQ ID NO: 1732043 - RNA, 16 nt, Homo sapiens
ggcuaauauacuugua

SEQ ID NO: 1732044 - RNA, 18 nt, Homo sapiens
ggcugacaugaagcuguu

SEQ ID NO: 1732045 - RNA, 19 nt, Homo sapiens
gggaagcggcccuaaggga

SEQ ID NO: 1732046 - RNA, 15 nt, Homo sapiens
gggacccagugcaga

SEQ ID NO: 1732047 - RNA, 20 nt, Homo sapiens
ggggaagcggcccuaaggga

SEQ ID NO: 1732048 - RNA, 18 nt, Homo sapiens
gggugaucugcugcugag

SEQ ID NO: 1732049 - RNA, 21 nt, Homo sapiens
ggucugugugugugugugugc

SEQ ID NO: 1732050 - RNA, 19 nt, Homo sapiens
gguucguucuguacuguua

SEQ ID NO: 1732051 - RNA, 22 nt, Homo sapiens
guaaaugaaacuuaagaauuga

SEQ ID NO: 1732052 - RNA, 18 nt, Homo sapiens
guacugaaagccuuaggg

SEQ ID NO: 1732053 - RNA, 16 nt, Homo sapiens
guagcccauccuuccc

SEQ ID NO: 1732054 - RNA, 16 nt, Homo sapiens
guagccucaauucucc

SEQ ID NO: 1732055 - RNA, 20 nt, Homo sapiens
guagccucaauucuccauua

SEQ ID NO: 1732056 - RNA, 15 nt, Homo sapiens
guagugaaauuauac

SEQ ID NO: 1732057 - RNA, 17 nt, Homo sapiens
guagugaaauuauacag

SEQ ID NO: 1732058 - RNA, 20 nt, Homo sapiens
guagugaaauuauacagaua

SEQ ID NO: 1732059 - RNA, 15 nt, Homo sapiens
guauauacuuugcca

SEQ ID NO: 1732060 - RNA, 21 nt, Homo sapiens
guauggggaggcaaguguggg

SEQ ID NO: 1732061 - RNA, 17 nt, Homo sapiens
guauuuuuauuuuugca

SEQ ID NO: 1732062 - RNA, 16 nt, Homo sapiens
gucaugcuucaucauu

SEQ ID NO: 1732063 - RNA, 13 nt, Homo sapiens
guccagcaccuug

SEQ ID NO: 1732064 - RNA, 20 nt, Homo sapiens
gucccuucccagcgcugcug

SEQ ID NO: 1732065 - RNA, 17 nt, Homo sapiens
gucucuacaaaaauaca

SEQ ID NO: 1732066 - RNA, 15 nt, Homo sapiens
gucugccuucugcug

SEQ ID NO: 1732067 - RNA, 21 nt, Homo sapiens
gucuuugcccugaauggucuc

SEQ ID NO: 1732068 - RNA, 22 nt, Homo sapiens
gucuuugcccugaauggucuca

SEQ ID NO: 1732069 - RNA, 12 nt, Homo sapiens
gugagggguccc

SEQ ID NO: 1732070 - RNA, 22 nt, Homo sapiens
gugcaguacuuugugcauucug

SEQ ID NO: 1732071 - RNA, 20 nt, Homo sapiens
gugcgugcgcaucuugccuc

SEQ ID NO: 1732072 - RNA, 20 nt, Homo sapiens
guguaccuccucucaguguu

SEQ ID NO: 1732073 - RNA, 12 nt, Homo sapiens
guguaugcagua

SEQ ID NO: 1732074 - RNA, 21 nt, Homo sapiens
guguccccgcugcugugcaac

SEQ ID NO: 1732075 - RNA, 21 nt, Homo sapiens
gugucuuacauugccaaguca

SEQ ID NO: 1732076 - RNA, 14 nt, Homo sapiens
gugugggggguccu

SEQ ID NO: 1732077 - RNA, 14 nt, Homo sapiens
gugugugugcacau

SEQ ID NO: 1732078 - RNA, 17 nt, Homo sapiens
guguuuuuaacauguca

SEQ ID NO: 1732079 - RNA, 18 nt, Homo sapiens
guucaaauuuccuuucau

SEQ ID NO: 1732080 - RNA, 16 nt, Homo sapiens
guucauuauguaugaa

SEQ ID NO: 1732081 - RNA, 13 nt, Homo sapiens
guucgcuuaucaa

SEQ ID NO: 1732082 - RNA, 20 nt, Homo sapiens
guucguucuguacuguuacu

SEQ ID NO: 1732083 - RNA, 19 nt, Homo sapiens
guugaaaggagaauuugaa

SEQ ID NO: 1732084 - RNA, 21 nt, Homo sapiens
guuggucugccuucugcugaa

SEQ ID NO: 1732085 - RNA, 22 nt, Homo sapiens
guuggucugccuucugcugaaa

SEQ ID NO: 1732086 - RNA, 11 nt, Homo sapiens
guuguuugcaa

SEQ ID NO: 1732087 - RNA, 19 nt, Homo sapiens
guuuacacugcacauugaa

SEQ ID NO: 1732088 - RNA, 12 nt, Homo sapiens
guuugugauauu

SEQ ID NO: 1732089 - RNA, 17 nt, Homo sapiens
guuuguuucauauauac

SEQ ID NO: 1732090 - RNA, 15 nt, Homo sapiens
guuuuaugcuacuga

SEQ ID NO: 1732091 - RNA, 19 nt, Homo sapiens
guuuuuuauuaugcauuau

SEQ ID NO: 1732092 - RNA, 20 nt, Homo sapiens
uaaaacuagugacagcuugu

SEQ ID NO: 1732093 - RNA, 14 nt, Homo sapiens
uaaaacuggaccug

SEQ ID NO: 1732094 - RNA, 22 nt, Homo sapiens
uaaagcuauuuaugggccccug

SEQ ID NO: 1732095 - RNA, 23 nt, Homo sapiens
uaaaggaagcaaguuuucuucca

SEQ ID NO: 1732096 - RNA, 22 nt, Homo sapiens
uaaaguguugccaccauaccuc

SEQ ID NO: 1732097 - RNA, 17 nt, Homo sapiens
uaaauagaugcugugua

SEQ ID NO: 1732098 - RNA, 17 nt, Homo sapiens
uaaccgcacaugcacac

SEQ ID NO: 1732099 - RNA, 22 nt, Homo sapiens
uaagaaaguaauuuaauuugua

SEQ ID NO: 1732100 - RNA, 20 nt, Homo sapiens
uaauguuauaucauauguau

SEQ ID NO: 1732101 - RNA, 15 nt, Homo sapiens
uaauucuuaacagug

SEQ ID NO: 1732102 - RNA, 20 nt, Homo sapiens
uacaacugcaccugucauca

SEQ ID NO: 1732103 - RNA, 22 nt, Homo sapiens
gagaucguaccuauugcacucc

SEQ ID NO: 1732104 - RNA, 14 nt, Homo sapiens
gagccugcagggaa

SEQ ID NO: 1732105 - RNA, 15 nt, Homo sapiens
gagccugcagggaag

SEQ ID NO: 1732106 - RNA, 15 nt, Homo sapiens
gagccuuuaccuuuu

SEQ ID NO: 1732107 - RNA, 19 nt, Homo sapiens
gaggaaggaacagcaaugg

SEQ ID NO: 1732108 - RNA, 18 nt, Homo sapiens
gaggcugccccucucacc

SEQ ID NO: 1732109 - RNA, 21 nt, Homo sapiens
gaggggccggcccugugugca

SEQ ID NO: 1732110 - RNA, 16 nt, Homo sapiens
gaguaaauacagguag

SEQ ID NO: 1732111 - RNA, 12 nt, Homo sapiens
gagugacucugg

SEQ ID NO: 1732112 - RNA, 19 nt, Homo sapiens
gaucaguguuguugcucua

SEQ ID NO: 1732113 - RNA, 18 nt, Homo sapiens
gaucaucgccagaggugc

SEQ ID NO: 1732114 - RNA, 17 nt, Homo sapiens
gaucucaguauugucag

SEQ ID NO: 1732115 - RNA, 15 nt, Homo sapiens
gaucugcugcugaga

SEQ ID NO: 1732116 - RNA, 19 nt, Homo sapiens
gauggcuggaaggggucca

SEQ ID NO: 1732117 - RNA, 20 nt, Homo sapiens
gaugguggcccugaaccuca

SEQ ID NO: 1732118 - RNA, 18 nt, Homo sapiens
gcaacuaauuuucuccca

SEQ ID NO: 1732119 - RNA, 22 nt, Homo sapiens
gucuagcauucugcaacauuua

SEQ ID NO: 1732120 - RNA, 20 nt, Homo sapiens
gucuguauuugguauauacu

SEQ ID NO: 1732121 - RNA, 15 nt, Homo sapiens
gugccucaccuucca

SEQ ID NO: 1732122 - RNA, 15 nt, Homo sapiens
guguaccuccucuca

SEQ ID NO: 1732123 - RNA, 14 nt, Homo sapiens
guguccucagggag

SEQ ID NO: 1732124 - RNA, 18 nt, Homo sapiens
gugucugucugaggugac

SEQ ID NO: 1732125 - RNA, 17 nt, Homo sapiens
gugucuuacauugccaa

SEQ ID NO: 1732126 - RNA, 21 nt, Homo sapiens
guguuaucacaguaacccaga

SEQ ID NO: 1732127 - RNA, 12 nt, Homo sapiens
guguuccagugu

SEQ ID NO: 1732128 - RNA, 16 nt, Homo sapiens
guguuuuuaacauguc

SEQ ID NO: 1732129 - RNA, 16 nt, Homo sapiens
guuacugggcccugag

SEQ ID NO: 1732130 - RNA, 23 nt, Homo sapiens
guucccacaccccaacacuucca

SEQ ID NO: 1732131 - RNA, 13 nt, Homo sapiens
guucucaugacuc

SEQ ID NO: 1732132 - RNA, 12 nt, Homo sapiens
guugacuuuccu

SEQ ID NO: 1732133 - RNA, 10 nt, Homo sapiens
guuggaagag

SEQ ID NO: 1732134 - RNA, 20 nt, Homo sapiens
guugguucguucuguacugu

SEQ ID NO: 1732135 - RNA, 18 nt, Homo sapiens
guuguaggguuacagaga

SEQ ID NO: 1732136 - RNA, 18 nt, Homo sapiens
guuucuuacacacugucu

SEQ ID NO: 1732137 - RNA, 16 nt, Homo sapiens
guuuguuucauauaua

SEQ ID NO: 1732138 - RNA, 15 nt, Homo sapiens
guuuguuuuugcaca

SEQ ID NO: 1732139 - RNA, 19 nt, Homo sapiens
guuuuccaugauuuagcaa

SEQ ID NO: 1732140 - RNA, 16 nt, Homo sapiens
guuuuuuauuaugcau

SEQ ID NO: 1732141 - RNA, 14 nt, Homo sapiens
uaaaacuucugcuc

SEQ ID NO: 1732142 - RNA, 16 nt, Homo sapiens
uaaaagaaaccuucca

SEQ ID NO: 1732143 - RNA, 20 nt, Homo sapiens
uaaaagcauuguuugugaua

SEQ ID NO: 1732144 - RNA, 16 nt, Homo sapiens
uaaaugaaacuuaaga

SEQ ID NO: 1732145 - RNA, 16 nt, Homo sapiens
uaaauuguguauuuaa

SEQ ID NO: 1732146 - RNA, 16 nt, Homo sapiens
uaaccgcacaugcaca

SEQ ID NO: 1732147 - RNA, 20 nt, Homo sapiens
uaauuaaaagugugggcugg

SEQ ID NO: 1732148 - RNA, 21 nt, Homo sapiens
uaauuugggaaaauaaauaca

SEQ ID NO: 1732149 - RNA, 13 nt, Homo sapiens
uaauuuguaaaac

SEQ ID NO: 1732150 - RNA, 16 nt, Homo sapiens
uaauuuuuaacuuauu

SEQ ID NO: 1732151 - RNA, 15 nt, Homo sapiens
uacaaauucuucuaa

SEQ ID NO: 1732152 - RNA, 12 nt, Homo sapiens
uacaauuucacu

SEQ ID NO: 1732153 - RNA, 13 nt, Homo sapiens
uacacacugucug

SEQ ID NO: 1732154 - RNA, 13 nt, Homo sapiens
uacacugccaucu

SEQ ID NO: 1732155 - RNA, 12 nt, Homo sapiens
uacagacauaca

SEQ ID NO: 1732156 - RNA, 17 nt, Homo sapiens
uacauuuaugcacauuc

SEQ ID NO: 1732157 - RNA, 17 nt, Homo sapiens
uaccaucuuguauacac

SEQ ID NO: 1732158 - RNA, 13 nt, Homo sapiens
uacccacauguac

SEQ ID NO: 1732159 - RNA, 23 nt, Homo sapiens
uacggacuuccuuuaggaucuca

SEQ ID NO: 1732160 - RNA, 20 nt, Homo sapiens
uacugggucugcgaugcagc

SEQ ID NO: 1732161 - RNA, 12 nt, Homo sapiens
uacuuugugcau

SEQ ID NO: 1732162 - RNA, 15 nt, Homo sapiens
uacuuugugcauucu

SEQ ID NO: 1732163 - RNA, 19 nt, Homo sapiens
uagaaucugugaccucuga

SEQ ID NO: 1732164 - RNA, 15 nt, Homo sapiens
uagaguuccauauau

SEQ ID NO: 1732165 - RNA, 16 nt, Homo sapiens
uagcucugcugcugau

SEQ ID NO: 1732166 - RNA, 13 nt, Homo sapiens
uaggagauuuauu

SEQ ID NO: 1732167 - RNA, 13 nt, Homo sapiens
uaguguaccuccu

SEQ ID NO: 1732168 - RNA, 20 nt, Homo sapiens
uaguguaccuccucucagug

SEQ ID NO: 1732169 - RNA, 12 nt, Homo sapiens
uauaacauauau

SEQ ID NO: 1732170 - RNA, 18 nt, Homo sapiens
uauaauuggugcauagca

SEQ ID NO: 1732171 - RNA, 16 nt, Homo sapiens
uauaccuuuugcauuu

SEQ ID NO: 1732172 - RNA, 13 nt, Homo sapiens
uauacuuugccac

SEQ ID NO: 1732173 - RNA, 12 nt, Homo sapiens
uauauacauaua

SEQ ID NO: 1732174 - RNA, 18 nt, Homo sapiens
uauauacuuugccacugc

SEQ ID NO: 1732175 - RNA, 13 nt, Homo sapiens
uauaucauaugua

SEQ ID NO: 1732176 - RNA, 16 nt, Homo sapiens
uauaugcacuauguau

SEQ ID NO: 1732177 - RNA, 18 nt, Homo sapiens
uaucacaguaacccagag

SEQ ID NO: 1732178 - RNA, 15 nt, Homo sapiens
uaugcauuauaucaa

SEQ ID NO: 1732179 - RNA, 13 nt, Homo sapiens
uauguauauacau

SEQ ID NO: 1732180 - RNA, 13 nt, Homo sapiens
uauguauauauac

SEQ ID NO: 1732181 - RNA, 16 nt, Homo sapiens
uauuuauuugagguca

SEQ ID NO: 1732182 - RNA, 13 nt, Homo sapiens
uauuugaggucag

SEQ ID NO: 1732183 - RNA, 21 nt, Homo sapiens
uauuugguauauacuuugcca

SEQ ID NO: 1732184 - RNA, 21 nt, Homo sapiens
ucaaauuuccuuucauaccuu

SEQ ID NO: 1732185 - RNA, 16 nt, Homo sapiens
ucagaguugacuuucc

SEQ ID NO: 1732186 - RNA, 22 nt, Homo sapiens
ucaguugaaaaugcaacucuaa

SEQ ID NO: 1732187 - RNA, 21 nt, Homo sapiens
ucaucauuuguggcagucccu

SEQ ID NO: 1732188 - RNA, 11 nt, Homo sapiens
ucaugccugua

SEQ ID NO: 1732189 - RNA, 22 nt, Homo sapiens
ucauucccucucaucucaggua

SEQ ID NO: 1732190 - RNA, 12 nt, Homo sapiens
uccaaagaggcu

SEQ ID NO: 1732191 - RNA, 15 nt, Homo sapiens
uccaaagaggcugcc

SEQ ID NO: 1732192 - RNA, 16 nt, Homo sapiens
uccacuguuagcacau

SEQ ID NO: 1732193 - RNA, 12 nt, Homo sapiens
uccaggugcaga

SEQ ID NO: 1732194 - RNA, 15 nt, Homo sapiens
uccauccugcagaua

SEQ ID NO: 1732195 - RNA, 22 nt, Homo sapiens
uccaugauuuuaaauugugauc

SEQ ID NO: 1732196 - RNA, 14 nt, Homo sapiens
uccccggcaugaga

SEQ ID NO: 1732197 - RNA, 15 nt, Homo sapiens
ucccuugcuguaugc

SEQ ID NO: 1732198 - RNA, 16 nt, Homo sapiens
ucccuugcuguaugcu

SEQ ID NO: 1732199 - RNA, 20 nt, Homo sapiens
ucccuugcuguaugcugauc

SEQ ID NO: 1732200 - RNA, 17 nt, Homo sapiens
uccggccucugccuuug

SEQ ID NO: 1732201 - RNA, 20 nt, Homo sapiens
uccguucacaugugugguac

SEQ ID NO: 1732202 - RNA, 13 nt, Homo sapiens
uccuccuccugcc

SEQ ID NO: 1732203 - RNA, 15 nt, Homo sapiens
ucgaaggaaccugug

SEQ ID NO: 1732204 - RNA, 13 nt, Homo sapiens
ucuaggguccagu

SEQ ID NO: 1732205 - RNA, 19 nt, Homo sapiens
ucuauaaauagaugcugug

SEQ ID NO: 1732206 - RNA, 12 nt, Homo sapiens
ucuauccaaauc

SEQ ID NO: 1732207 - RNA, 21 nt, Homo sapiens
ucucagguagaagguugacac

SEQ ID NO: 1732208 - RNA, 18 nt, Homo sapiens
ucuccacacccacuuugu

SEQ ID NO: 1732209 - RNA, 14 nt, Homo sapiens
ucuccauuaauuaa

SEQ ID NO: 1732210 - RNA, 15 nt, Homo sapiens
ucuccuaauauucca

SEQ ID NO: 1732211 - RNA, 22 nt, Homo sapiens
ucucugucccuugcuguaugcu

SEQ ID NO: 1732212 - RNA, 21 nt, Homo sapiens
ucugacaacugugaagccacc

SEQ ID NO: 1732213 - RNA, 16 nt, Homo sapiens
ucugccgcuaccuccc

SEQ ID NO: 1732214 - RNA, 23 nt, Homo sapiens
ucugccuguaucucucacuauua

SEQ ID NO: 1732215 - RNA, 16 nt, Homo sapiens
ucugccuucugcugaa

SEQ ID NO: 1732216 - RNA, 16 nt, Homo sapiens
ucugggcuaauauacu

SEQ ID NO: 1732217 - RNA, 22 nt, Homo sapiens
ucuggggacagacaaggugccu

SEQ ID NO: 1732218 - RNA, 20 nt, Homo sapiens
ucuggggggacccagugcag

SEQ ID NO: 1732219 - RNA, 18 nt, Homo sapiens
cuugccugcagggccaug

SEQ ID NO: 1732220 - RNA, 15 nt, Homo sapiens
cuuggggcccagugc

SEQ ID NO: 1732221 - RNA, 14 nt, Homo sapiens
cuuuaggaucucag

SEQ ID NO: 1732222 - RNA, 19 nt, Homo sapiens
cuuugcccugaauggucuc

SEQ ID NO: 1732223 - RNA, 23 nt, Homo sapiens
cuuuguucuggggggacccagug

SEQ ID NO: 1732224 - RNA, 22 nt, Homo sapiens
gaaaagcuaguguaccuccucu

SEQ ID NO: 1732225 - RNA, 19 nt, Homo sapiens
gaaacuaguguacauuucu

SEQ ID NO: 1732226 - RNA, 14 nt, Homo sapiens
gaaagccuuaggga

SEQ ID NO: 1732227 - RNA, 18 nt, Homo sapiens
gaaaugaaaucuucccag

SEQ ID NO: 1732228 - RNA, 17 nt, Homo sapiens
gaaauuaagacuuuaug

SEQ ID NO: 1732229 - RNA, 15 nt, Homo sapiens
gaacagcacugggga

SEQ ID NO: 1732230 - RNA, 16 nt, Homo sapiens
gaacuaggguaaggug

SEQ ID NO: 1732231 - RNA, 21 nt, Homo sapiens
gaagauugcgguuuacagcua

SEQ ID NO: 1732232 - RNA, 23 nt, Homo sapiens
gaagcccugauguguccucaggg

SEQ ID NO: 1732233 - RNA, 14 nt, Homo sapiens
gaaggaaauucuua

SEQ ID NO: 1732234 - RNA, 15 nt, Homo sapiens
gaagggaauccuccu

SEQ ID NO: 1732235 - RNA, 16 nt, Homo sapiens
gaauccccaacaugca

SEQ ID NO: 1732236 - RNA, 21 nt, Homo sapiens
gaauuagauuucuauaggauu

SEQ ID NO: 1732237 - RNA, 13 nt, Homo sapiens
gacaacugugaag

SEQ ID NO: 1732238 - RNA, 17 nt, Homo sapiens
gaccacuuccaggggaa

SEQ ID NO: 1732239 - RNA, 18 nt, Homo sapiens
gaccccugacucaucauu

SEQ ID NO: 1732240 - RNA, 13 nt, Homo sapiens
gacgcugcugaca

SEQ ID NO: 1732241 - RNA, 19 nt, Homo sapiens
gacguucauuauguaugaa

SEQ ID NO: 1732242 - RNA, 12 nt, Homo sapiens
gacuacaaccaa

SEQ ID NO: 1732243 - RNA, 20 nt, Homo sapiens
gacuuccuuuaggaucucag

SEQ ID NO: 1732244 - RNA, 14 nt, Homo sapiens
gagacucagugcag

SEQ ID NO: 1732245 - RNA, 13 nt, Homo sapiens
gagacucuagggu

SEQ ID NO: 1732246 - RNA, 23 nt, Homo sapiens
gagagggacauagaaucugugac

SEQ ID NO: 1732247 - RNA, 16 nt, Homo sapiens
gaggcugccccucuca

SEQ ID NO: 1732248 - RNA, 20 nt, Homo sapiens
gaggcugccccucucaccaa

SEQ ID NO: 1732249 - RNA, 22 nt, Homo sapiens
gagggcccuccgaccacuucca

SEQ ID NO: 1732250 - RNA, 18 nt, Homo sapiens
gauauuucguguacugca

SEQ ID NO: 1732251 - RNA, 17 nt, Homo sapiens
gaucaaauugugcagua

SEQ ID NO: 1732252 - RNA, 12 nt, Homo sapiens
gaucucaguauu

SEQ ID NO: 1732253 - RNA, 14 nt, Homo sapiens
gaucucaguauugu

SEQ ID NO: 1732254 - RNA, 14 nt, Homo sapiens
gaucugcugcugag

SEQ ID NO: 1732255 - RNA, 12 nt, Homo sapiens
gcaaaagguuua

SEQ ID NO: 1732256 - RNA, 23 nt, Homo sapiens
gcaauggugucaguauccaggcu

SEQ ID NO: 1732257 - RNA, 20 nt, Homo sapiens
gcacuuaaguguuagaucua

SEQ ID NO: 1732258 - RNA, 16 nt, Homo sapiens
gcaggcuaacgcagga

SEQ ID NO: 1732259 - RNA, 15 nt, Homo sapiens
gcaggcugggccaug

SEQ ID NO: 1732260 - RNA, 13 nt, Homo sapiens
gcaguacuuugug

SEQ ID NO: 1732261 - RNA, 15 nt, Homo sapiens
gcaguauucuugcac

SEQ ID NO: 1732262 - RNA, 18 nt, Homo sapiens
gcaguuuaagagcagaac

SEQ ID NO: 1732263 - RNA, 16 nt, Homo sapiens
gcauaauaacuacuuc

SEQ ID NO: 1732264 - RNA, 23 nt, Homo sapiens
gcauacaaagagguguacaggua

SEQ ID NO: 1732265 - RNA, 18 nt, Homo sapiens
gcauucugcaacauuuau

SEQ ID NO: 1732266 - RNA, 15 nt, Homo sapiens
gccauguccaaagag

SEQ ID NO: 1732267 - RNA, 16 nt, Homo sapiens
gccauguccaaagagg

SEQ ID NO: 1732268 - RNA, 22 nt, Homo sapiens
gccccacauguccagcaccuug

SEQ ID NO: 1732269 - RNA, 14 nt, Homo sapiens
gcccccagugccuc

SEQ ID NO: 1732270 - RNA, 16 nt, Homo sapiens
gccccuggcacucuug

SEQ ID NO: 1732271 - RNA, 20 nt, Homo sapiens
gcccugauguguccucaggg

SEQ ID NO: 1732272 - RNA, 15 nt, Homo sapiens
gcccuuuccuuccag

SEQ ID NO: 1732273 - RNA, 21 nt, Homo sapiens
gccggggcucugggugcugcc

SEQ ID NO: 1732274 - RNA, 17 nt, Homo sapiens
gccucugccuuugcacc

SEQ ID NO: 1732275 - RNA, 13 nt, Homo sapiens
gcucacaccaaau

SEQ ID NO: 1732276 - RNA, 11 nt, Homo sapiens
gcucaugccug

SEQ ID NO: 1732277 - RNA, 20 nt, Homo sapiens
aaaagcgacccauucagaga

SEQ ID NO: 1732278 - RNA, 15 nt, Homo sapiens
aaaauuuuagcucuu

SEQ ID NO: 1732279 - RNA, 17 nt, Homo sapiens
aaaccacagucuuccca

SEQ ID NO: 1732280 - RNA, 22 nt, Homo sapiens
aaagagccagacucugucucaa

SEQ ID NO: 1732281 - RNA, 22 nt, Homo sapiens
aaagaggcugccccucucacca

SEQ ID NO: 1732282 - RNA, 19 nt, Homo sapiens
aaaguaauuuaauuuguaa

SEQ ID NO: 1732283 - RNA, 18 nt, Homo sapiens
aaagugcauauuuaucca

SEQ ID NO: 1732284 - RNA, 20 nt, Homo sapiens
aaauagaguaaauacaggua

SEQ ID NO: 1732285 - RNA, 16 nt, Homo sapiens
aaaucuaccacuguau

SEQ ID NO: 1732286 - RNA, 22 nt, Homo sapiens
aaaugcauaauaacuacuucca

SEQ ID NO: 1732287 - RNA, 14 nt, Homo sapiens
aaauuaagacuuua

SEQ ID NO: 1732288 - RNA, 19 nt, Homo sapiens
aacaaaagcgacccauuca

SEQ ID NO: 1732289 - RNA, 16 nt, Homo sapiens
aacaacauccacuguu

SEQ ID NO: 1732290 - RNA, 22 nt, Homo sapiens
aacacuccauuauuccucucac

SEQ ID NO: 1732291 - RNA, 23 nt, Homo sapiens
aacacugaaaugaaaucuuccca

SEQ ID NO: 1732292 - RNA, 16 nt, Homo sapiens
aaccgagaagguuuau

SEQ ID NO: 1732293 - RNA, 23 nt, Homo sapiens
aaccuaguacugccccccaugag

SEQ ID NO: 1732294 - RNA, 19 nt, Homo sapiens
aagagccagacucugucuc

SEQ ID NO: 1732295 - RNA, 14 nt, Homo sapiens
aagcaaguuuucuu

SEQ ID NO: 1732296 - RNA, 21 nt, Homo sapiens
aagccucguuuugaugccauu

SEQ ID NO: 1732297 - RNA, 21 nt, Homo sapiens
aagcuaguguaccuccucuca

SEQ ID NO: 1732298 - RNA, 21 nt, Homo sapiens
aagguuuuaaccgcacaugca

SEQ ID NO: 1732299 - RNA, 15 nt, Homo sapiens
aagugcauauuuauc

SEQ ID NO: 1732300 - RNA, 18 nt, Homo sapiens
aagugggcccacccggug

SEQ ID NO: 1732301 - RNA, 19 nt, Homo sapiens
aaguguugccaccauaccu

SEQ ID NO: 1732302 - RNA, 19 nt, Homo sapiens
aaguuuucuuccaugauuu

SEQ ID NO: 1732303 - RNA, 13 nt, Homo sapiens
aauaaaggaagca

SEQ ID NO: 1732304 - RNA, 15 nt, Homo sapiens
aauaaauacauucga

SEQ ID NO: 1732305 - RNA, 14 nt, Homo sapiens
aauaacuacuucca

SEQ ID NO: 1732306 - RNA, 13 nt, Homo sapiens
aaucccagcacuu

SEQ ID NO: 1732307 - RNA, 19 nt, Homo sapiens
aauuauuacaauucuugaa

SEQ ID NO: 1732308 - RNA, 22 nt, Homo sapiens
aauucagaagaccccugacuca

SEQ ID NO: 1732309 - RNA, 21 nt, Homo sapiens
aauucuuauaacucaacauuu

SEQ ID NO: 1732310 - RNA, 17 nt, Homo sapiens
caugaggacagaccaca

SEQ ID NO: 1732311 - RNA, 13 nt, Homo sapiens
caugcacugaugu

SEQ ID NO: 1732312 - RNA, 17 nt, Homo sapiens
cauuaauuaaaagugug

SEQ ID NO: 1732313 - RNA, 17 nt, Homo sapiens
cauucccucucaucuca

SEQ ID NO: 1732314 - RNA, 15 nt, Homo sapiens
cauugcaguuuaaga

SEQ ID NO: 1732315 - RNA, 15 nt, Homo sapiens
cauuugugguccuga

SEQ ID NO: 1732316 - RNA, 22 nt, Homo sapiens
ccaaugcuucuguugaucucag

SEQ ID NO: 1732317 - RNA, 14 nt, Homo sapiens
ccacuguaugagug

SEQ ID NO: 1732318 - RNA, 19 nt, Homo sapiens
ccacuuuaaacacccccau

SEQ ID NO: 1732319 - RNA, 16 nt, Homo sapiens
ccagacucugucucaa

SEQ ID NO: 1732320 - RNA, 17 nt, Homo sapiens
ccaggccugggugaucu

SEQ ID NO: 1732321 - RNA, 18 nt, Homo sapiens
ccaggggaaccugccaug

SEQ ID NO: 1732322 - RNA, 23 nt, Homo sapiens
ccagugcuccaggcacccagcuu

SEQ ID NO: 1732323 - RNA, 14 nt, Homo sapiens
ccaguggaugccac

SEQ ID NO: 1732324 - RNA, 13 nt, Homo sapiens
ccauaacaauucc

SEQ ID NO: 1732325 - RNA, 21 nt, Homo sapiens
ccauccugcagauacuuugaa

SEQ ID NO: 1732326 - RNA, 19 nt, Homo sapiens
ccaugaggaaggaacagca

SEQ ID NO: 1732327 - RNA, 20 nt, Homo sapiens
ccaugaggaaggaacagcaa

SEQ ID NO: 1732328 - RNA, 21 nt, Homo sapiens
ccaugccaggaaccuguccua

SEQ ID NO: 1732329 - RNA, 14 nt, Homo sapiens
ccauguccaaagag

SEQ ID NO: 1732330 - RNA, 14 nt, Homo sapiens
cccaacaugcacug

SEQ ID NO: 1732331 - RNA, 19 nt, Homo sapiens
cccacaccccaacacuucc

SEQ ID NO: 1732332 - RNA, 13 nt, Homo sapiens
cccacuucccacc

SEQ ID NO: 1732333 - RNA, 20 nt, Homo sapiens
cccagggcaccauccagcuc

SEQ ID NO: 1732334 - RNA, 14 nt, Homo sapiens
ccccucucaccaaa

SEQ ID NO: 1732335 - RNA, 10 nt, Homo sapiens
cccuaaggga

SEQ ID NO: 1732336 - RNA, 21 nt, Homo sapiens
cccuagcagcccacccugcug

SEQ ID NO: 1732337 - RNA, 14 nt, Homo sapiens
cccucccacaccca

SEQ ID NO: 1732338 - RNA, 14 nt, Homo sapiens
cccuccgaccacuu

SEQ ID NO: 1732339 - RNA, 15 nt, Homo sapiens
cccugaauggucuca

SEQ ID NO: 1732340 - RNA, 16 nt, Homo sapiens
cccugacucaucauuu

SEQ ID NO: 1732341 - RNA, 22 nt, Homo sapiens
cccuugcuguaugcugaucauc

SEQ ID NO: 1732342 - RNA, 15 nt, Homo sapiens
ccggcccugugugca

SEQ ID NO: 1732343 - RNA, 16 nt, Homo sapiens
ccuaaggaaccuuccu

SEQ ID NO: 1732344 - RNA, 15 nt, Homo sapiens
ccuaagggagugucu

SEQ ID NO: 1732345 - RNA, 22 nt, Homo sapiens
ccucguuggaagaggaacagca

SEQ ID NO: 1732346 - RNA, 20 nt, Homo sapiens
ccugaauggucucagcuuga

SEQ ID NO: 1732347 - RNA, 16 nt, Homo sapiens
ccugacuggugcugca

SEQ ID NO: 1732348 - RNA, 14 nt, Homo sapiens
ccugauguguccuc

SEQ ID NO: 1732349 - RNA, 20 nt, Homo sapiens
ccugcgacccugggggcaca

SEQ ID NO: 1732350 - RNA, 17 nt, Homo sapiens
ccugcugcuggugcaca

SEQ ID NO: 1732351 - RNA, 21 nt, Homo sapiens
ccuuuaccuuuuaugcaaaag

SEQ ID NO: 1732352 - RNA, 19 nt, Homo sapiens
ccuuuaggaucucaggcuu

SEQ ID NO: 1732353 - RNA, 14 nt, Homo sapiens
ccuuucaaagcacu

SEQ ID NO: 1732354 - RNA, 19 nt, Homo sapiens
cgaccacuuccaggggaac

SEQ ID NO: 1732355 - RNA, 14 nt, Homo sapiens
cgcaucuugccucc

SEQ ID NO: 1732356 - RNA, 19 nt, Homo sapiens
cgcggcccgcgcagcugcc

SEQ ID NO: 1732357 - RNA, 17 nt, Homo sapiens
cgcuuaucaacuaauga

SEQ ID NO: 1732358 - RNA, 23 nt, Homo sapiens
cgugauggcaggugccuguaauc

SEQ ID NO: 1732359 - RNA, 24 nt, Homo sapiens
cgugcuccguagcucugcugcuga

SEQ ID NO: 1732360 - RNA, 20 nt, Homo sapiens
cgugggggcucaugccugua

SEQ ID NO: 1732361 - RNA, 13 nt, Homo sapiens
cguguacugcaaa

SEQ ID NO: 1732362 - RNA, 13 nt, Homo sapiens
cuaaggaaccuuc

SEQ ID NO: 1732363 - RNA, 16 nt, Homo sapiens
cuacuuuucauccuag

SEQ ID NO: 1732364 - RNA, 18 nt, Homo sapiens
cuaggaagacauuuuucc

SEQ ID NO: 1732365 - RNA, 14 nt, Homo sapiens
cuaguguaccuccu

SEQ ID NO: 1732366 - RNA, 17 nt, Homo sapiens
cucaaagagaauuguau

SEQ ID NO: 1732367 - RNA, 17 nt, Homo sapiens
aacacuuccagcauuua

SEQ ID NO: 1732368 - RNA, 17 nt, Homo sapiens
aacagcaauggugucag

SEQ ID NO: 1732369 - RNA, 14 nt, Homo sapiens
aaccagccaggcag

SEQ ID NO: 1732370 - RNA, 18 nt, Homo sapiens
aaccugccaugccaggaa

SEQ ID NO: 1732371 - RNA, 19 nt, Homo sapiens
aacgcaggagaaucacuug

SEQ ID NO: 1732372 - RNA, 17 nt, Homo sapiens
aacugcaccugucauca

SEQ ID NO: 1732373 - RNA, 14 nt, Homo sapiens
aagaggaacagcac

SEQ ID NO: 1732374 - RNA, 12 nt, Homo sapiens
aagccuuaggga

SEQ ID NO: 1732375 - RNA, 17 nt, Homo sapiens
aagcuaguguaccuccu

SEQ ID NO: 1732376 - RNA, 18 nt, Homo sapiens
aagcuaguguaccuccuc

SEQ ID NO: 1732377 - RNA, 13 nt, Homo sapiens
aaggaaauucuua

SEQ ID NO: 1732378 - RNA, 21 nt, Homo sapiens
aaggaagcaaguuuucuucca

SEQ ID NO: 1732379 - RNA, 13 nt, Homo sapiens
aaguacccuuuug

SEQ ID NO: 1732380 - RNA, 20 nt, Homo sapiens
aaguuuuuuauuaugcauua

SEQ ID NO: 1732381 - RNA, 15 nt, Homo sapiens
aaucuauguuugcac

SEQ ID NO: 1732382 - RNA, 19 nt, Homo sapiens
aaucugccuguaucucuca

SEQ ID NO: 1732383 - RNA, 20 nt, Homo sapiens
aaucuguccguucacaugug

SEQ ID NO: 1732384 - RNA, 21 nt, Homo sapiens
aaucuguccguucacaugugu

SEQ ID NO: 1732385 - RNA, 15 nt, Homo sapiens
aaugaaaucuuccca

SEQ ID NO: 1732386 - RNA, 16 nt, Homo sapiens
aaugaaaucuucccag

SEQ ID NO: 1732387 - RNA, 20 nt, Homo sapiens
aaugcauaauaacuacuucc

SEQ ID NO: 1732388 - RNA, 15 nt, Homo sapiens
aaugcuucuguugau

SEQ ID NO: 1732389 - RNA, 16 nt, Homo sapiens
aaugcuucuguugauc

SEQ ID NO: 1732390 - RNA, 14 nt, Homo sapiens
aauucuccauuaau

SEQ ID NO: 1732391 - RNA, 22 nt, Homo sapiens
aauugacuaccguuguuugcaa

SEQ ID NO: 1732392 - RNA, 16 nt, Homo sapiens
aauugugcaguacuuu

SEQ ID NO: 1732393 - RNA, 15 nt, Homo sapiens
aauuuauugaguuuu

SEQ ID NO: 1732394 - RNA, 20 nt, Homo sapiens
aauuucaccaccaaaugcca

SEQ ID NO: 1732395 - RNA, 17 nt, Homo sapiens
acaacauucugugggau

SEQ ID NO: 1732396 - RNA, 14 nt, Homo sapiens
acaaggugccuguu

SEQ ID NO: 1732397 - RNA, 13 nt, Homo sapiens
acacacgcuuucu

SEQ ID NO: 1732398 - RNA, 11 nt, Homo sapiens
acacacugucu

SEQ ID NO: 1732399 - RNA, 18 nt, Homo sapiens
acaccaaauuuuucuauc

SEQ ID NO: 1732400 - RNA, 13 nt, Homo sapiens
acacuaacgugug

SEQ ID NO: 1732401 - RNA, 18 nt, Homo sapiens
acacuccauuauuccucu

SEQ ID NO: 1732402 - RNA, 17 nt, Homo sapiens
acagcaauggugucagu

SEQ ID NO: 1732403 - RNA, 16 nt, Homo sapiens
acagcacuggggaguc

SEQ ID NO: 1732404 - RNA, 17 nt, Homo sapiens
acaggaggcaggcaugg

SEQ ID NO: 1732405 - RNA, 22 nt, Homo sapiens
acauauauacccacauguacag

SEQ ID NO: 1732406 - RNA, 14 nt, Homo sapiens
acauaugacuugau

SEQ ID NO: 1732407 - RNA, 18 nt, Homo sapiens
acauuuauauagacuguu

SEQ ID NO: 1732408 - RNA, 17 nt, Homo sapiens
acauuuaugcacauuca

SEQ ID NO: 1732409 - RNA, 20 nt, Homo sapiens
accacagagcugucacuuuu

SEQ ID NO: 1732410 - RNA, 21 nt, Homo sapiens
accacagucuucccagcaauu

SEQ ID NO: 1732411 - RNA, 12 nt, Homo sapiens
accacuuccagg

SEQ ID NO: 1732412 - RNA, 22 nt, Homo sapiens
accaggcagugugccaguuuaa

SEQ ID NO: 1732413 - RNA, 14 nt, Homo sapiens
acccacuuugucca

SEQ ID NO: 1732414 - RNA, 11 nt, Homo sapiens
acccagugcag

SEQ ID NO: 1732415 - RNA, 13 nt, Homo sapiens
acccagugcagaa

SEQ ID NO: 1732416 - RNA, 17 nt, Homo sapiens
acccauucagagacugu

SEQ ID NO: 1732417 - RNA, 15 nt, Homo sapiens
accccaacacuucca

SEQ ID NO: 1732418 - RNA, 17 nt, Homo sapiens
accccuguuucuggcac

SEQ ID NO: 1732419 - RNA, 19 nt, Homo sapiens
acccugcugcuggugcaca

SEQ ID NO: 1732420 - RNA, 23 nt, Homo sapiens
accuaguacugccccccaugagg

SEQ ID NO: 1732421 - RNA, 22 nt, Homo sapiens
accucaguugaaaaugcaacuc

SEQ ID NO: 1732422 - RNA, 23 nt, Homo sapiens
accuccaggcuuucccacuuccc

SEQ ID NO: 1732423 - RNA, 18 nt, Homo sapiens
accucccuccccgucuca

SEQ ID NO: 1732424 - RNA, 13 nt, Homo sapiens
accuuccaacacu

SEQ ID NO: 1732425 - RNA, 15 nt, Homo sapiens
accuuccaacacucc

SEQ ID NO: 1732426 - RNA, 17 nt, Homo sapiens
acgagcaggcauuucug

SEQ ID NO: 1732427 - RNA, 19 nt, Homo sapiens
acgcuuuucuuuguuauac

SEQ ID NO: 1732428 - RNA, 14 nt, Homo sapiens
acuccuacuuuuca

SEQ ID NO: 1732429 - RNA, 16 nt, Homo sapiens
acucuaggguccagug

SEQ ID NO: 1732430 - RNA, 20 nt, Homo sapiens
acucuaggguccaguggaug

SEQ ID NO: 1732431 - RNA, 18 nt, Homo sapiens
acuggggagucuuugugg

SEQ ID NO: 1732432 - RNA, 19 nt, Homo sapiens
acugucaaaauauuucuca

SEQ ID NO: 1732433 - RNA, 17 nt, Homo sapiens
acuguuagcacauugau

SEQ ID NO: 1732434 - RNA, 14 nt, Homo sapiens
acuuccagcauuua

SEQ ID NO: 1732435 - RNA, 19 nt, Homo sapiens
acuuccuuuaggaucucag

SEQ ID NO: 1732436 - RNA, 17 nt, Homo sapiens
acuucuggggacagaca

SEQ ID NO: 1732437 - RNA, 22 nt, Homo sapiens
acuuuauguaguuuuuauaugu

SEQ ID NO: 1732438 - RNA, 22 nt, Homo sapiens
acuuuccucccauuuuaccacu

SEQ ID NO: 1732439 - RNA, 13 nt, Homo sapiens
acuuugugcauuc

SEQ ID NO: 1732440 - RNA, 12 nt, Homo sapiens
agaaacucccau

SEQ ID NO: 1732441 - RNA, 21 nt, Homo sapiens
agaagaccccugacucaucau

SEQ ID NO: 1732442 - RNA, 20 nt, Homo sapiens
agaaucugugaccucugaca

SEQ ID NO: 1732443 - RNA, 16 nt, Homo sapiens
agaauuagauuucuau

SEQ ID NO: 1732444 - RNA, 23 nt, Homo sapiens
agaauucagaagaccccugacuc

SEQ ID NO: 1732445 - RNA, 15 nt, Homo sapiens
agacagcuacacaga

SEQ ID NO: 1732446 - RNA, 16 nt, Homo sapiens
agacgguuuccaggga

SEQ ID NO: 1732447 - RNA, 11 nt, Homo sapiens
agacuguugaa

SEQ ID NO: 1732448 - RNA, 15 nt, Homo sapiens
agacuuaacacuucu

SEQ ID NO: 1732449 - RNA, 13 nt, Homo sapiens
agaggaacagcac

SEQ ID NO: 1732450 - RNA, 18 nt, Homo sapiens
agaggcugccccucucac

SEQ ID NO: 1732451 - RNA, 20 nt, Homo sapiens
agaguacacccuuuccagga

SEQ ID NO: 1732452 - RNA, 21 nt, Homo sapiens
agaguugaaguuuacagagau

SEQ ID NO: 1732453 - RNA, 12 nt, Homo sapiens
agaugggugauu

SEQ ID NO: 1732454 - RNA, 21 nt, Homo sapiens
agaugguacggacuuccuuua

SEQ ID NO: 1732455 - RNA, 20 nt, Homo sapiens
agcaggcauuucugugaugu

SEQ ID NO: 1732456 - RNA, 23 nt, Homo sapiens
agcaugaggacagaccacagagc

SEQ ID NO: 1732457 - RNA, 21 nt, Homo sapiens
agccaauagaauggggugauu

SEQ ID NO: 1732458 - RNA, 17 nt, Homo sapiens
agcccacccugcugcug

SEQ ID NO: 1732459 - RNA, 18 nt, Homo sapiens
agccgugaauucaguugg

SEQ ID NO: 1732460 - RNA, 12 nt, Homo sapiens
agccuucuugau

SEQ ID NO: 1732461 - RNA, 17 nt, Homo sapiens
agcuaguguaccuccuc

SEQ ID NO: 1732462 - RNA, 14 nt, Homo sapiens
agcuucuccaggaa

SEQ ID NO: 1732463 - RNA, 22 nt, Homo sapiens
agcuugacucccaaguuuccau

SEQ ID NO: 1732464 - RNA, 16 nt, Homo sapiens
aggaaacgcuaccucu

SEQ ID NO: 1732465 - RNA, 13 nt, Homo sapiens
aggaacagcacug

SEQ ID NO: 1732466 - RNA, 15 nt, Homo sapiens
aggaaggaacagcaa

SEQ ID NO: 1732467 - RNA, 18 nt, Homo sapiens
cuaggccucaauuguucc

SEQ ID NO: 1732468 - RNA, 20 nt, Homo sapiens
cuauaaauagaugcugugua

SEQ ID NO: 1732469 - RNA, 13 nt, Homo sapiens
cucagcuuaucuc

SEQ ID NO: 1732470 - RNA, 10 nt, Homo sapiens
cucagugcag

SEQ ID NO: 1732471 - RNA, 18 nt, Homo sapiens
cucaguugaaaaugcaac

SEQ ID NO: 1732472 - RNA, 16 nt, Homo sapiens
cuccaacugcaggaaa

SEQ ID NO: 1732473 - RNA, 13 nt, Homo sapiens
cuccaggugcaga

SEQ ID NO: 1732474 - RNA, 17 nt, Homo sapiens
cuccaucucucauccuc

SEQ ID NO: 1732475 - RNA, 13 nt, Homo sapiens
cuccccaccucca

SEQ ID NO: 1732476 - RNA, 16 nt, Homo sapiens
cuccuuuaauuaaugg

SEQ ID NO: 1732477 - RNA, 16 nt, Homo sapiens
cucgccacgaacuagg

SEQ ID NO: 1732478 - RNA, 16 nt, Homo sapiens
cucucacuauuaucua

SEQ ID NO: 1732479 - RNA, 20 nt, Homo sapiens
cucugucucaaaacaaacaa

SEQ ID NO: 1732480 - RNA, 18 nt, Homo sapiens
cucuuguucccacacccc

SEQ ID NO: 1732481 - RNA, 23 nt, Homo sapiens
cugaagauugcgguuuacagcua

SEQ ID NO: 1732482 - RNA, 21 nt, Homo sapiens
cugaauguuuaaagaucauga

SEQ ID NO: 1732483 - RNA, 12 nt, Homo sapiens
cugcaccuguca

SEQ ID NO: 1732484 - RNA, 15 nt, Homo sapiens
cugccccccaugagg

SEQ ID NO: 1732485 - RNA, 15 nt, Homo sapiens
cugcugauacugggu

SEQ ID NO: 1732486 - RNA, 21 nt, Homo sapiens
cuggcacucuuguucccacac

SEQ ID NO: 1732487 - RNA, 10 nt, Homo sapiens
cugggccaug

SEQ ID NO: 1732488 - RNA, 16 nt, Homo sapiens
cugggccauguccaaa

SEQ ID NO: 1732489 - RNA, 23 nt, Homo sapiens
cuggguacugaaagccuuaggga

SEQ ID NO: 1732490 - RNA, 20 nt, Homo sapiens
cugucaugcuucaucauucc

SEQ ID NO: 1732491 - RNA, 22 nt, Homo sapiens
cugucuguauagugucuguauu

SEQ ID NO: 1732492 - RNA, 15 nt, Homo sapiens
cugugugcgugcgca

SEQ ID NO: 1732493 - RNA, 14 nt, Homo sapiens
cuuacacacugucu

SEQ ID NO: 1732494 - RNA, 18 nt, Homo sapiens
cuuauaacucaacauuug

SEQ ID NO: 1732495 - RNA, 23 nt, Homo sapiens
cuuauaaguaaagacagcuuuaa

SEQ ID NO: 1732496 - RNA, 18 nt, Homo sapiens
cuuaucaacuaaugauuu

SEQ ID NO: 1732497 - RNA, 23 nt, Homo sapiens
cuucagauccuuuuauucuccag

SEQ ID NO: 1732498 - RNA, 13 nt, Homo sapiens
cuuccagauccug

SEQ ID NO: 1732499 - RNA, 13 nt, Homo sapiens
cuucccaguauua

SEQ ID NO: 1732500 - RNA, 14 nt, Homo sapiens
cuucccaguauuau

SEQ ID NO: 1732501 - RNA, 23 nt, Homo sapiens
cuucuggggcaggcugggccaug

SEQ ID NO: 1732502 - RNA, 17 nt, Homo sapiens
cuucuguugaucucagu

SEQ ID NO: 1732503 - RNA, 20 nt, Homo sapiens
cuucuuggggcccagugcau

SEQ ID NO: 1732504 - RNA, 14 nt, Homo sapiens
cuugagaccauuuc

SEQ ID NO: 1732505 - RNA, 14 nt, Homo sapiens
cuuggcugacauga

SEQ ID NO: 1732506 - RNA, 15 nt, Homo sapiens
cuuuaaaaucuguuc

SEQ ID NO: 1732507 - RNA, 16 nt, Homo sapiens
cuuuaggagauuuauu

SEQ ID NO: 1732508 - RNA, 17 nt, Homo sapiens
cuuuaggaucucaggcu

SEQ ID NO: 1732509 - RNA, 13 nt, Homo sapiens
cuuucauaccuug

SEQ ID NO: 1732510 - RNA, 14 nt, Homo sapiens
cuuuuauucuccag

SEQ ID NO: 1732511 - RNA, 17 nt, Homo sapiens
cuuuucauccuagucua

SEQ ID NO: 1732512 - RNA, 21 nt, Homo sapiens
cuuuugagaguauagcaugaa

SEQ ID NO: 1732513 - RNA, 16 nt, Homo sapiens
gaaaagauuacugaaa

SEQ ID NO: 1732514 - RNA, 16 nt, Homo sapiens
gaaaagggcugacauu

SEQ ID NO: 1732515 - RNA, 14 nt, Homo sapiens
gaaaagugcauauu

SEQ ID NO: 1732516 - RNA, 23 nt, Homo sapiens
gaaaaugcaacucuaacucugag

SEQ ID NO: 1732517 - RNA, 18 nt, Homo sapiens
gaaaccacagucuuccca

SEQ ID NO: 1732518 - RNA, 18 nt, Homo sapiens
gaaaccuacacacuguca

SEQ ID NO: 1732519 - RNA, 12 nt, Homo sapiens
gaaaucuuccca

SEQ ID NO: 1732520 - RNA, 17 nt, Homo sapiens
gaaaugaaaucuuccca

SEQ ID NO: 1732521 - RNA, 16 nt, Homo sapiens
gaaccuguccuaagga

SEQ ID NO: 1732522 - RNA, 21 nt, Homo sapiens
gaaccuguguuaucacaguaa

SEQ ID NO: 1732523 - RNA, 19 nt, Homo sapiens
gaagcccugauguguccuc

SEQ ID NO: 1732524 - RNA, 16 nt, Homo sapiens
gaagcuggccugagag

SEQ ID NO: 1732525 - RNA, 14 nt, Homo sapiens
gaaggaaccugugu

SEQ ID NO: 1732526 - RNA, 23 nt, Homo sapiens
gaaucaucaaagcucacaccaaa

SEQ ID NO: 1732527 - RNA, 13 nt, Homo sapiens
gaauuccuaacuu

SEQ ID NO: 1732528 - RNA, 14 nt, Homo sapiens
gacaaggugccugu

SEQ ID NO: 1732529 - RNA, 18 nt, Homo sapiens
gacagcuuguggcuuuuu

SEQ ID NO: 1732530 - RNA, 12 nt, Homo sapiens
gacccagugcag

SEQ ID NO: 1732531 - RNA, 13 nt, Homo sapiens
gacuacaaccaau

SEQ ID NO: 1732532 - RNA, 20 nt, Homo sapiens
gacuacaaccaauuuacacu

SEQ ID NO: 1732533 - RNA, 12 nt, Homo sapiens
gacuccaucucu

SEQ ID NO: 1732534 - RNA, 18 nt, Homo sapiens
gacucuggauuuggugcu

SEQ ID NO: 1732535 - RNA, 21 nt, Homo sapiens
gacucugucucaaaacaaaca

SEQ ID NO: 1732536 - RNA, 21 nt, Homo sapiens
gacugaaguucgcauugaacu

SEQ ID NO: 1732537 - RNA, 14 nt, Homo sapiens
gacugcuaccuuuc

SEQ ID NO: 1732538 - RNA, 16 nt, Homo sapiens
gacugcuaccuuucaa

SEQ ID NO: 1732539 - RNA, 18 nt, Homo sapiens
gagacgguuuccagggag

SEQ ID NO: 1732540 - RNA, 16 nt, Homo sapiens
gagacucuagggucca

SEQ ID NO: 1732541 - RNA, 21 nt, Homo sapiens
gagaucguaccuauugcacuc

SEQ ID NO: 1732542 - RNA, 21 nt, Homo sapiens
gagaugguguguucugcaaua

SEQ ID NO: 1732543 - RNA, 15 nt, Homo sapiens
gagcaggaacaauga

SEQ ID NO: 1732544 - RNA, 18 nt, Homo sapiens
gaggcccugcccaaugag

SEQ ID NO: 1732545 - RNA, 21 nt, Homo sapiens
gagggacauagaaucugugac

SEQ ID NO: 1732546 - RNA, 23 nt, Homo sapiens
gaggucaggaguucaagaccagc

SEQ ID NO: 1732547 - RNA, 15 nt, Homo sapiens
gaguaaauacaggua

SEQ ID NO: 1732548 - RNA, 14 nt, Homo sapiens
gaguugacuuuccu

SEQ ID NO: 1732549 - RNA, 15 nt, Homo sapiens
gaugaaagagccaga

SEQ ID NO: 1732550 - RNA, 21 nt, Homo sapiens
gaugccaccuucagauccuuu

SEQ ID NO: 1732551 - RNA, 22 nt, Homo sapiens
gaugcugaggguguuucuuccu

SEQ ID NO: 1732552 - RNA, 14 nt, Homo sapiens
gauggcaggugccu

SEQ ID NO: 1732553 - RNA, 17 nt, Homo sapiens
gcaaucuauguuugcac

SEQ ID NO: 1732554 - RNA, 19 nt, Homo sapiens
gcacuauguuuccauuugu

SEQ ID NO: 1732555 - RNA, 12 nt, Homo sapiens
gcagaagcccug

SEQ ID NO: 1732556 - RNA, 16 nt, Homo sapiens
gcagaagcccugaugu

SEQ ID NO: 1732557 - RNA, 18 nt, Homo sapiens
gcaggaaauacuuuguaa

SEQ ID NO: 1732558 - RNA, 19 nt, Homo sapiens
gcaggcugggccaugucca

SEQ ID NO: 1732559 - RNA, 23 nt, Homo sapiens
gcaggcugggccauguccaaaga

SEQ ID NO: 1732560 - RNA, 12 nt, Homo sapiens
gcaggugcgauu

SEQ ID NO: 1732561 - RNA, 15 nt, Homo sapiens
gcagugagcugagau

SEQ ID NO: 1732562 - RNA, 14 nt, Homo sapiens
gcauucugcaacau

SEQ ID NO: 1732563 - RNA, 16 nt, Homo sapiens
gccagacucugucuca

SEQ ID NO: 1732564 - RNA, 15 nt, Homo sapiens
gccaggagcugucac

SEQ ID NO: 1732565 - RNA, 11 nt, Homo sapiens
gcccagugcau

SEQ ID NO: 1732566 - RNA, 17 nt, Homo sapiens
gcccuuucaaagcacuu

SEQ ID NO: 1732567 - RNA, 13 nt, Homo sapiens
gccgcuaccuccc

SEQ ID NO: 1732568 - RNA, 13 nt, Homo sapiens
auccuucagugaa

SEQ ID NO: 1732569 - RNA, 15 nt, Homo sapiens
auccuuuuauucucc

SEQ ID NO: 1732570 - RNA, 10 nt, Homo sapiens
aucuauccaa

SEQ ID NO: 1732571 - RNA, 17 nt, Homo sapiens
aucucaguauugucagg

SEQ ID NO: 1732572 - RNA, 13 nt, Homo sapiens
aucugccuguauc

SEQ ID NO: 1732573 - RNA, 15 nt, Homo sapiens
aucuguucacuuuca

SEQ ID NO: 1732574 - RNA, 18 nt, Homo sapiens
aucuugccuccaggugca

SEQ ID NO: 1732575 - RNA, 15 nt, Homo sapiens
augaaagagccagac

SEQ ID NO: 1732576 - RNA, 14 nt, Homo sapiens
augacuacuuuuuc

SEQ ID NO: 1732577 - RNA, 15 nt, Homo sapiens
augcaacucuaacuc

SEQ ID NO: 1732578 - RNA, 17 nt, Homo sapiens
augcauuauaucaaauc

SEQ ID NO: 1732579 - RNA, 20 nt, Homo sapiens
augccaccuucagauccuuu

SEQ ID NO: 1732580 - RNA, 12 nt, Homo sapiens
augccacuccuc

SEQ ID NO: 1732581 - RNA, 23 nt, Homo sapiens
augccuguaaucccagcacuuug

SEQ ID NO: 1732582 - RNA, 19 nt, Homo sapiens
augcuucuguugaucucag

SEQ ID NO: 1732583 - RNA, 14 nt, Homo sapiens
auggaggucauaca

SEQ ID NO: 1732584 - RNA, 15 nt, Homo sapiens
auggcaggugccugu

SEQ ID NO: 1732585 - RNA, 14 nt, Homo sapiens
auggcucagggugg

SEQ ID NO: 1732586 - RNA, 20 nt, Homo sapiens
auggcuccggccucugccuu

SEQ ID NO: 1732587 - RNA, 16 nt, Homo sapiens
auguaagaauucagaa

SEQ ID NO: 1732588 - RNA, 23 nt, Homo sapiens
auguacagacauacauuuaugca

SEQ ID NO: 1732589 - RNA, 21 nt, Homo sapiens
auguaguuuuuauauguugua

SEQ ID NO: 1732590 - RNA, 18 nt, Homo sapiens
auguauauauacacggua

SEQ ID NO: 1732591 - RNA, 15 nt, Homo sapiens
auguguccucaggga

SEQ ID NO: 1732592 - RNA, 18 nt, Homo sapiens
auguuaauguuauaucau

SEQ ID NO: 1732593 - RNA, 14 nt, Homo sapiens
auguuauaucauau

SEQ ID NO: 1732594 - RNA, 21 nt, Homo sapiens
auguuguguuuuuaacauguc

SEQ ID NO: 1732595 - RNA, 19 nt, Homo sapiens
auuaagacuuuauguaguu

SEQ ID NO: 1732596 - RNA, 14 nt, Homo sapiens
auuagccaggcgug

SEQ ID NO: 1732597 - RNA, 12 nt, Homo sapiens
auuauacagaua

SEQ ID NO: 1732598 - RNA, 18 nt, Homo sapiens
auucuaauggggacacag

SEQ ID NO: 1732599 - RNA, 20 nt, Homo sapiens
auugaguucgaggacuacaa

SEQ ID NO: 1732600 - RNA, 15 nt, Homo sapiens
auugaguuuuuacaa

SEQ ID NO: 1732601 - RNA, 15 nt, Homo sapiens
auugcacuccauccu

SEQ ID NO: 1732602 - RNA, 17 nt, Homo sapiens
auuggugcauagcagau

SEQ ID NO: 1732603 - RNA, 15 nt, Homo sapiens
auuguuugugauauu

SEQ ID NO: 1732604 - RNA, 14 nt, Homo sapiens
auuuacucagucuu

SEQ ID NO: 1732605 - RNA, 22 nt, Homo sapiens
auuuagugaucaaauugugcag

SEQ ID NO: 1732606 - RNA, 23 nt, Homo sapiens
auuuauccaaaauguguauuucu

SEQ ID NO: 1732607 - RNA, 15 nt, Homo sapiens
auuucuauaaauaga

SEQ ID NO: 1732608 - RNA, 23 nt, Homo sapiens
auuugguauauacuuugccacug

SEQ ID NO: 1732609 - RNA, 12 nt, Homo sapiens
auuuggugcugg

SEQ ID NO: 1732610 - RNA, 20 nt, Homo sapiens
auuuucuuuacaauuucacu

SEQ ID NO: 1732611 - RNA, 18 nt, Homo sapiens
auuuuuauuuuugcacaa

SEQ ID NO: 1732612 - RNA, 13 nt, Homo sapiens
auuuuucuaucaa

SEQ ID NO: 1732613 - RNA, 22 nt, Homo sapiens
caaaacuucuauuauccagagu

SEQ ID NO: 1732614 - RNA, 14 nt, Homo sapiens
caaaauauuucuca

SEQ ID NO: 1732615 - RNA, 16 nt, Homo sapiens
caaauuuuucuaucaa

SEQ ID NO: 1732616 - RNA, 24 nt, Homo sapiens
caacaacauccacuguuagcacau

SEQ ID NO: 1732617 - RNA, 21 nt, Homo sapiens
caacauccacuguuagcacau

SEQ ID NO: 1732618 - RNA, 23 nt, Homo sapiens
caacauuuauauagacuguugaa

SEQ ID NO: 1732619 - RNA, 22 nt, Homo sapiens
caaccagccaggcagguccaca

SEQ ID NO: 1732620 - RNA, 22 nt, Homo sapiens
caagaaaagggcugacauuuuc

SEQ ID NO: 1732621 - RNA, 19 nt, Homo sapiens
caaggaaacgcuaccucuc

SEQ ID NO: 1732622 - RNA, 13 nt, Homo sapiens
caaggugccuguu

SEQ ID NO: 1732623 - RNA, 18 nt, Homo sapiens
caaucuauguuugcacuu

SEQ ID NO: 1732624 - RNA, 18 nt, Homo sapiens
caaucugccuguaucucu

SEQ ID NO: 1732625 - RNA, 21 nt, Homo sapiens
aggacuacaaccaauuuacac

SEQ ID NO: 1732626 - RNA, 20 nt, Homo sapiens
aggagaaacucccauguaug

SEQ ID NO: 1732627 - RNA, 21 nt, Homo sapiens
aggagaggggaggucacucuu

SEQ ID NO: 1732628 - RNA, 21 nt, Homo sapiens
aggcaauuucaccaccaaaug

SEQ ID NO: 1732629 - RNA, 20 nt, Homo sapiens
aggcuuuguacagagugcuu

SEQ ID NO: 1732630 - RNA, 21 nt, Homo sapiens
aggcuuuguacagagugcuuu

SEQ ID NO: 1732631 - RNA, 14 nt, Homo sapiens
agggaagccgugaa

SEQ ID NO: 1732632 - RNA, 13 nt, Homo sapiens
agggaauccuccu

SEQ ID NO: 1732633 - RNA, 12 nt, Homo sapiens
agguccacagag

SEQ ID NO: 1732634 - RNA, 12 nt, Homo sapiens
aggugccuguaa

SEQ ID NO: 1732635 - RNA, 16 nt, Homo sapiens
aguacacccuuuccag

SEQ ID NO: 1732636 - RNA, 21 nt, Homo sapiens
aguaccuugcuucuuacugau

SEQ ID NO: 1732637 - RNA, 16 nt, Homo sapiens
aguauugguguaugua

SEQ ID NO: 1732638 - RNA, 23 nt, Homo sapiens
agucagaugguacggacuuccuu

SEQ ID NO: 1732639 - RNA, 13 nt, Homo sapiens
agucuagcauucu

SEQ ID NO: 1732640 - RNA, 18 nt, Homo sapiens
agucugaaugcugccaca

SEQ ID NO: 1732641 - RNA, 16 nt, Homo sapiens
agucuucccagcaauu

SEQ ID NO: 1732642 - RNA, 18 nt, Homo sapiens
agugaaauuauacagaua

SEQ ID NO: 1732643 - RNA, 14 nt, Homo sapiens
agugcaugguggcc

SEQ ID NO: 1732644 - RNA, 15 nt, Homo sapiens
agugccucaccuucc

SEQ ID NO: 1732645 - RNA, 12 nt, Homo sapiens
aguguaccuccu

SEQ ID NO: 1732646 - RNA, 17 nt, Homo sapiens
agugucuuagcauauuu

SEQ ID NO: 1732647 - RNA, 19 nt, Homo sapiens
aguguugccaccauaccuc

SEQ ID NO: 1732648 - RNA, 18 nt, Homo sapiens
aguuucuuacacacuguc

SEQ ID NO: 1732649 - RNA, 14 nt, Homo sapiens
auaaaagcauuguu

SEQ ID NO: 1732650 - RNA, 13 nt, Homo sapiens
auaacuacuucca

SEQ ID NO: 1732651 - RNA, 14 nt, Homo sapiens
auaauaacuacuuc

SEQ ID NO: 1732652 - RNA, 23 nt, Homo sapiens
auacacauauauacccacaugua

SEQ ID NO: 1732653 - RNA, 18 nt, Homo sapiens
auaccaggcagugugcca

SEQ ID NO: 1732654 - RNA, 15 nt, Homo sapiens
auacuuugaagugca

SEQ ID NO: 1732655 - RNA, 15 nt, Homo sapiens
auagaugcuguguau

SEQ ID NO: 1732656 - RNA, 18 nt, Homo sapiens
auauacuuugccacugcu

SEQ ID NO: 1732657 - RNA, 12 nt, Homo sapiens
auauauaugcac

SEQ ID NO: 1732658 - RNA, 15 nt, Homo sapiens
auauauuuacucagu

SEQ ID NO: 1732659 - RNA, 14 nt, Homo sapiens
auauuccacguuug

SEQ ID NO: 1732660 - RNA, 19 nt, Homo sapiens
auauuucucaucugcacua

SEQ ID NO: 1732661 - RNA, 17 nt, Homo sapiens
aucaacaacauccacug

SEQ ID NO: 1732662 - RNA, 16 nt, Homo sapiens
aucaguguuguugcuc

SEQ ID NO: 1732663 - RNA, 16 nt, Homo sapiens
auccgcgugugccugu

SEQ ID NO: 1732664 - RNA, 19 nt, Homo sapiens
auccuagcuacuuggcagg

SEQ ID NO: 1732665 - RNA, 19 nt, Homo sapiens
auccuuuuauucuccagaa

SEQ ID NO: 1732666 - RNA, 15 nt, Homo sapiens
aucuaacguguucca

SEQ ID NO: 1732667 - RNA, 14 nt, Homo sapiens
aucuaccacuguau

SEQ ID NO: 1732668 - RNA, 18 nt, Homo sapiens
aucuaccacuguaugagu

SEQ ID NO: 1732669 - RNA, 23 nt, Homo sapiens
aucucaggcuucugcaguucuca

SEQ ID NO: 1732670 - RNA, 17 nt, Homo sapiens
augacuccuacuuuuca

SEQ ID NO: 1732671 - RNA, 16 nt, Homo sapiens
augagacucagugcag

SEQ ID NO: 1732672 - RNA, 16 nt, Homo sapiens
augcaguauucuugca

SEQ ID NO: 1732673 - RNA, 16 nt, Homo sapiens
augccaggaaccuguc

SEQ ID NO: 1732674 - RNA, 13 nt, Homo sapiens
augccauucuucc

SEQ ID NO: 1732675 - RNA, 18 nt, Homo sapiens
augcuucuguugaucuca

SEQ ID NO: 1732676 - RNA, 16 nt, Homo sapiens
auggcaggugccugua

SEQ ID NO: 1732677 - RNA, 21 nt, Homo sapiens
augggagccuuuaccuuuuau

SEQ ID NO: 1732678 - RNA, 21 nt, Homo sapiens
auggggacacagaucauggua

SEQ ID NO: 1732679 - RNA, 23 nt, Homo sapiens
auggucucagcuugagaccauuu

SEQ ID NO: 1732680 - RNA, 15 nt, Homo sapiens
augguguguucugca

SEQ ID NO: 1732681 - RNA, 15 nt, Homo sapiens
auguacagacauaca

SEQ ID NO: 1732682 - RNA, 19 nt, Homo sapiens
auguauauauauauaugca

SEQ ID NO: 1732683 - RNA, 18 nt, Homo sapiens
augugagugccuuuugca

SEQ ID NO: 1732684 - RNA, 18 nt, Homo sapiens
auguuuuuagaggacuau

SEQ ID NO: 1732685 - RNA, 22 nt, Homo sapiens
auuauccagagucaugggagag

SEQ ID NO: 1732686 - RNA, 20 nt, Homo sapiens
auuaucuaaaagaaaccuuc

SEQ ID NO: 1732687 - RNA, 19 nt, Homo sapiens
auuccguugucuguggaug

SEQ ID NO: 1732688 - RNA, 12 nt, Homo sapiens
auucuccagaau

SEQ ID NO: 1732689 - RNA, 22 nt, Homo sapiens
auucuccauuaauuaaaagugu

SEQ ID NO: 1732690 - RNA, 21 nt, Homo sapiens
auucuuaacagugguucaaau

SEQ ID NO: 1732691 - RNA, 21 nt, Homo sapiens
auucuuauaacucaacauuug

SEQ ID NO: 1732692 - RNA, 16 nt, Homo sapiens
auuucguguacugcaa

SEQ ID NO: 1732693 - RNA, 14 nt, Homo sapiens
auuucuucaaauaa

SEQ ID NO: 1732694 - RNA, 14 nt, Homo sapiens
auuuguuucaaugg

SEQ ID NO: 1732695 - RNA, 15 nt, Homo sapiens
caaaacuucuauuau

SEQ ID NO: 1732696 - RNA, 17 nt, Homo sapiens
caaagaggcugccccuc

SEQ ID NO: 1732697 - RNA, 20 nt, Homo sapiens
caaagaggcugccccucuca

SEQ ID NO: 1732698 - RNA, 15 nt, Homo sapiens
caaagagguguacag

SEQ ID NO: 1732699 - RNA, 14 nt, Homo sapiens
caaaguguaugcag

SEQ ID NO: 1732700 - RNA, 16 nt, Homo sapiens
caaauauauuuuggaa

SEQ ID NO: 1732701 - RNA, 16 nt, Homo sapiens
caaaucuaccacugua

SEQ ID NO: 1732702 - RNA, 20 nt, Homo sapiens
caaauuuccuuucauaccuu

SEQ ID NO: 1732703 - RNA, 18 nt, Homo sapiens
caaccgagaagguuuauc

SEQ ID NO: 1732704 - RNA, 13 nt, Homo sapiens
caacuaggccuca

SEQ ID NO: 1732705 - RNA, 18 nt, Homo sapiens
caacugcaggaaaacccu

SEQ ID NO: 1732706 - RNA, 16 nt, Homo sapiens
caagcugguauuuuca

SEQ ID NO: 1732707 - RNA, 22 nt, Homo sapiens
caauaugccuaguuucuuacac

SEQ ID NO: 1732708 - RNA, 16 nt, Homo sapiens
caaugcuucuguugau

SEQ ID NO: 1732709 - RNA, 20 nt, Homo sapiens
caaugcuucuguugaucuca

SEQ ID NO: 1732710 - RNA, 15 nt, Homo sapiens
caaugucaaugugaa

SEQ ID NO: 1732711 - RNA, 22 nt, Homo sapiens
caauucccccauccuucaguga

SEQ ID NO: 1732712 - RNA, 10 nt, Homo sapiens
caauuucacu

SEQ ID NO: 1732713 - RNA, 21 nt, Homo sapiens
cacacacgcuuucuuaugcaa

SEQ ID NO: 1732714 - RNA, 18 nt, Homo sapiens
cacaccauuuuguaaaug

SEQ ID NO: 1732715 - RNA, 19 nt, Homo sapiens
cacacugucuguauagugu

SEQ ID NO: 1732716 - RNA, 20 nt, Homo sapiens
cacauggcggagaguuuuaa

SEQ ID NO: 1732717 - RNA, 21 nt, Homo sapiens
cacauuuagauccugguuuca

SEQ ID NO: 1732718 - RNA, 13 nt, Homo sapiens
cacccaugcaagc

SEQ ID NO: 1732719 - RNA, 16 nt, Homo sapiens
cacccccauaacaauu

SEQ ID NO: 1732720 - RNA, 14 nt, Homo sapiens
cacccuuuccagga

SEQ ID NO: 1732721 - RNA, 19 nt, Homo sapiens
cacgcuguuuguuucauau

SEQ ID NO: 1732722 - RNA, 14 nt, Homo sapiens
cacuauguauauac

SEQ ID NO: 1732723 - RNA, 18 nt, Homo sapiens
cacuuagucuguacuuca

SEQ ID NO: 1732724 - RNA, 12 nt, Homo sapiens
cagaagcccuga

SEQ ID NO: 1732725 - RNA, 13 nt, Homo sapiens
gccuggacugcua

SEQ ID NO: 1732726 - RNA, 21 nt, Homo sapiens
gccugggguguuaguggcacc

SEQ ID NO: 1732727 - RNA, 20 nt, Homo sapiens
gccuguaaucccagcacuuu

SEQ ID NO: 1732728 - RNA, 17 nt, Homo sapiens
gcgacccauucagagac

SEQ ID NO: 1732729 - RNA, 10 nt, Homo sapiens
gcuaccuccc

SEQ ID NO: 1732730 - RNA, 19 nt, Homo sapiens
gcuaguguaccuccucuca

SEQ ID NO: 1732731 - RNA, 13 nt, Homo sapiens
gcugggccauguc

SEQ ID NO: 1732732 - RNA, 18 nt, Homo sapiens
gcugggccauguccaaag

SEQ ID NO: 1732733 - RNA, 19 nt, Homo sapiens
gcugucccuugcuugccug

SEQ ID NO: 1732734 - RNA, 16 nt, Homo sapiens
gcuucuguugaucuca

SEQ ID NO: 1732735 - RNA, 18 nt, Homo sapiens
gcuucuguugaucucagu

SEQ ID NO: 1732736 - RNA, 15 nt, Homo sapiens
gcuuucccacuuccc

SEQ ID NO: 1732737 - RNA, 19 nt, Homo sapiens
ggaaacuaguguacauuuc

SEQ ID NO: 1732738 - RNA, 22 nt, Homo sapiens
ggaaauucuuauaacucaacau

SEQ ID NO: 1732739 - RNA, 21 nt, Homo sapiens
ggaagaggaacagcacugggg

SEQ ID NO: 1732740 - RNA, 20 nt, Homo sapiens
ggaagcuguccuggaggucc

SEQ ID NO: 1732741 - RNA, 16 nt, Homo sapiens
ggaaucuucugaauuu

SEQ ID NO: 1732742 - RNA, 15 nt, Homo sapiens
ggagaauuagauuuc

SEQ ID NO: 1732743 - RNA, 16 nt, Homo sapiens
ggagaggggaggucac

SEQ ID NO: 1732744 - RNA, 23 nt, Homo sapiens
ggagcugggcccgacauggcucc

SEQ ID NO: 1732745 - RNA, 21 nt, Homo sapiens
ggagggcccuccgaccacuuc

SEQ ID NO: 1732746 - RNA, 16 nt, Homo sapiens
ggaugaaagagccaga

SEQ ID NO: 1732747 - RNA, 16 nt, Homo sapiens
ggauuuggugcuggaa

SEQ ID NO: 1732748 - RNA, 20 nt, Homo sapiens
ggcaagugugggggguccuu

SEQ ID NO: 1732749 - RNA, 18 nt, Homo sapiens
ggcaggaaauacuuugua

SEQ ID NO: 1732750 - RNA, 14 nt, Homo sapiens
ggccauguccaaag

SEQ ID NO: 1732751 - RNA, 17 nt, Homo sapiens
ggccccagggggucuca

SEQ ID NO: 1732752 - RNA, 23 nt, Homo sapiens
ggccugcgacccugggggcacag

SEQ ID NO: 1732753 - RNA, 17 nt, Homo sapiens
ggcugccccucucacca

SEQ ID NO: 1732754 - RNA, 18 nt, Homo sapiens
ggcugccccucucaccaa

SEQ ID NO: 1732755 - RNA, 13 nt, Homo sapiens
ggcugggccaugu

SEQ ID NO: 1732756 - RNA, 17 nt, Homo sapiens
gggacaucacagggugg

SEQ ID NO: 1732757 - RNA, 20 nt, Homo sapiens
gggagacagagguugcagug

SEQ ID NO: 1732758 - RNA, 23 nt, Homo sapiens
gggaggcaagugugggggguccu

SEQ ID NO: 1732759 - RNA, 16 nt, Homo sapiens
gggcaggcugggccau

SEQ ID NO: 1732760 - RNA, 16 nt, Homo sapiens
gggccauguccaaaga

SEQ ID NO: 1732761 - RNA, 17 nt, Homo sapiens
gggccauguccaaagag

SEQ ID NO: 1732762 - RNA, 22 nt, Homo sapiens
gggugauuuuaugaucaguguu

SEQ ID NO: 1732763 - RNA, 21 nt, Homo sapiens
gguauauacuuugccacugcu

SEQ ID NO: 1732764 - RNA, 22 nt, Homo sapiens
gguauauacuuugccacugcug

SEQ ID NO: 1732765 - RNA, 22 nt, Homo sapiens
ggucccuggucggagagggaca

SEQ ID NO: 1732766 - RNA, 19 nt, Homo sapiens
ggucucuucuuggggccca

SEQ ID NO: 1732767 - RNA, 22 nt, Homo sapiens
gguggucucuucuuggggccca

SEQ ID NO: 1732768 - RNA, 21 nt, Homo sapiens
ggugucaguauccaggcuuug

SEQ ID NO: 1732769 - RNA, 17 nt, Homo sapiens
guacaugguguuugugg

SEQ ID NO: 1732770 - RNA, 11 nt, Homo sapiens
guacuguuacu

SEQ ID NO: 1732771 - RNA, 17 nt, Homo sapiens
guagcucugcugcugau

SEQ ID NO: 1732772 - RNA, 15 nt, Homo sapiens
guaucucucacuauu

SEQ ID NO: 1732773 - RNA, 15 nt, Homo sapiens
guauguauauauaca

SEQ ID NO: 1732774 - RNA, 22 nt, Homo sapiens
gucccugaaaccuaguacugcc

SEQ ID NO: 1732775 - RNA, 19 nt, Homo sapiens
gucccuugcuguaugcuga

SEQ ID NO: 1732776 - RNA, 15 nt, Homo sapiens
gucuagcauucugca

SEQ ID NO: 1732777 - RNA, 18 nt, Homo sapiens
gucucuucuuggggccca

SEQ ID NO: 1732778 - RNA, 17 nt, Homo sapiens
gucugccuucugcugaa

SEQ ID NO: 1732779 - RNA, 18 nt, Homo sapiens
gucuguuuggacugcaga

SEQ ID NO: 1732780 - RNA, 21 nt, Homo sapiens
gucuuaccagugacgcugcug

SEQ ID NO: 1732781 - RNA, 20 nt, Homo sapiens
gugaccucugacaacuguga

SEQ ID NO: 1732782 - RNA, 14 nt, Homo sapiens
gugacgcugcugac

SEQ ID NO: 1732783 - RNA, 15 nt, Homo sapiens
gugauuuacagggau

SEQ ID NO: 1732784 - RNA, 21 nt, Homo sapiens
gugcacauccgcgugugccug

SEQ ID NO: 1732785 - RNA, 20 nt, Homo sapiens
guguaugcaguauucuugca

SEQ ID NO: 1732786 - RNA, 22 nt, Homo sapiens
guguaugcaguauucuugcacu

SEQ ID NO: 1732787 - RNA, 17 nt, Homo sapiens
guguuuaguagccucaa

SEQ ID NO: 1732788 - RNA, 17 nt, Homo sapiens
guuaauguuauaucaua

SEQ ID NO: 1732789 - RNA, 14 nt, Homo sapiens
guuacaaguuuaua

SEQ ID NO: 1732790 - RNA, 18 nt, Homo sapiens
guuauaucauauguauau

SEQ ID NO: 1732791 - RNA, 19 nt, Homo sapiens
guuccaaugucaaugugaa

SEQ ID NO: 1732792 - RNA, 20 nt, Homo sapiens
guucgcauugaacucuacaa

SEQ ID NO: 1732793 - RNA, 21 nt, Homo sapiens
guugacuuuccucccauuuua

SEQ ID NO: 1732794 - RNA, 22 nt, Homo sapiens
guugguucguucuguacuguua

SEQ ID NO: 1732795 - RNA, 14 nt, Homo sapiens
guuuuaaauugaua

SEQ ID NO: 1732796 - RNA, 16 nt, Homo sapiens
guuuuaugcuacugaa

SEQ ID NO: 1732797 - RNA, 15 nt, Homo sapiens
guuuuuaacuuuuaa

SEQ ID NO: 1732798 - RNA, 14 nt, Homo sapiens
uaaaagaaaccuuc

SEQ ID NO: 1732799 - RNA, 23 nt, Homo sapiens
uaaaaguuuuuuauuaugcauua

SEQ ID NO: 1732800 - RNA, 12 nt, Homo sapiens
uaaaauagagua

SEQ ID NO: 1732801 - RNA, 17 nt, Homo sapiens
uaaagaucaugacauau

SEQ ID NO: 1732802 - RNA, 11 nt, Homo sapiens
uaaauacaggu

SEQ ID NO: 1732803 - RNA, 13 nt, Homo sapiens
uaaauacagguag

SEQ ID NO: 1732804 - RNA, 21 nt, Homo sapiens
uaacaauucccccauccuuca

SEQ ID NO: 1732805 - RNA, 17 nt, Homo sapiens
uaacgauguuguauuga

SEQ ID NO: 1732806 - RNA, 21 nt, Homo sapiens
uaacgcaggagaaucacuuga

SEQ ID NO: 1732807 - RNA, 20 nt, Homo sapiens
uaacuuuucaaugacauuuu

SEQ ID NO: 1732808 - RNA, 17 nt, Homo sapiens
uaauccuagcuacuugg

SEQ ID NO: 1732809 - RNA, 17 nt, Homo sapiens
uaauggggacacagauc

SEQ ID NO: 1732810 - RNA, 18 nt, Homo sapiens
uaauggggacacagauca

SEQ ID NO: 1732811 - RNA, 18 nt, Homo sapiens
uacauauuuuuuguauau

SEQ ID NO: 1732812 - RNA, 21 nt, Homo sapiens
uacauucgaaggaaccugugu

SEQ ID NO: 1732813 - RNA, 19 nt, Homo sapiens
uaccagugacgcugcugac

SEQ ID NO: 1732814 - RNA, 14 nt, Homo sapiens
uaccauuuccucag

SEQ ID NO: 1732815 - RNA, 23 nt, Homo sapiens
uacugcaaaguguaugcaguauu

SEQ ID NO: 1732816 - RNA, 18 nt, Homo sapiens
uacuucaucauuuugaca

SEQ ID NO: 1732817 - RNA, 16 nt, Homo sapiens
uagcuggccacauggc

SEQ ID NO: 1732818 - RNA, 20 nt, Homo sapiens
uaguauugguguauguauga

SEQ ID NO: 1732819 - RNA, 16 nt, Homo sapiens
uagucuguacuucauc

SEQ ID NO: 1732820 - RNA, 23 nt, Homo sapiens
uauacagauagaguuccauauau

SEQ ID NO: 1732821 - RNA, 16 nt, Homo sapiens
uauacaggcauaaaau

SEQ ID NO: 1732822 - RNA, 20 nt, Homo sapiens
uauacccacauguacagaca

SEQ ID NO: 1732823 - RNA, 13 nt, Homo sapiens
uauauuguucaaa

SEQ ID NO: 1732824 - RNA, 20 nt, Homo sapiens
aaaagacguucauuauguau

SEQ ID NO: 1732825 - RNA, 19 nt, Homo sapiens
aaaagggcugacauuuucu

SEQ ID NO: 1732826 - RNA, 14 nt, Homo sapiens
aaaaguuguuuguu

SEQ ID NO: 1732827 - RNA, 19 nt, Homo sapiens
aaaauuuuagcucuuccca

SEQ ID NO: 1732828 - RNA, 13 nt, Homo sapiens
aaaccccgucucu

SEQ ID NO: 1732829 - RNA, 15 nt, Homo sapiens
aaaccuaguacugcc

SEQ ID NO: 1732830 - RNA, 14 nt, Homo sapiens
aaagaaaccuucca

SEQ ID NO: 1732831 - RNA, 17 nt, Homo sapiens
aaagagccagacucugu

SEQ ID NO: 1732832 - RNA, 21 nt, Homo sapiens
aaaguuuuuuauuaugcauua

SEQ ID NO: 1732833 - RNA, 18 nt, Homo sapiens
aaauauauuuuggaaaac

SEQ ID NO: 1732834 - RNA, 19 nt, Homo sapiens
aaauucuucuaauugcugu

SEQ ID NO: 1732835 - RNA, 23 nt, Homo sapiens
aacaacauccacuguuagcacau

SEQ ID NO: 1732836 - RNA, 18 nt, Homo sapiens
aacauuugucuggucuua

SEQ ID NO: 1732837 - RNA, 17 nt, Homo sapiens
aaccaauuuacacugcc

SEQ ID NO: 1732838 - RNA, 14 nt, Homo sapiens
aaccuaguacugcc

SEQ ID NO: 1732839 - RNA, 19 nt, Homo sapiens
aaccuuccuuccugcuuga

SEQ ID NO: 1732840 - RNA, 15 nt, Homo sapiens
aacgugugugucuua

SEQ ID NO: 1732841 - RNA, 15 nt, Homo sapiens
aacguguuccagugu

SEQ ID NO: 1732842 - RNA, 16 nt, Homo sapiens
aagaaacuuuucugaa

SEQ ID NO: 1732843 - RNA, 16 nt, Homo sapiens
aagacuuuauguaguu

SEQ ID NO: 1732844 - RNA, 18 nt, Homo sapiens
aagaggcugccccucuca

SEQ ID NO: 1732845 - RNA, 18 nt, Homo sapiens
aagcaaguuuucuuccau

SEQ ID NO: 1732846 - RNA, 18 nt, Homo sapiens
aagcauuguuugugauau

SEQ ID NO: 1732847 - RNA, 23 nt, Homo sapiens
aagcccugauguguccucaggga

SEQ ID NO: 1732848 - RNA, 22 nt, Homo sapiens
aagcgacccauucagagacugu

SEQ ID NO: 1732849 - RNA, 16 nt, Homo sapiens
aaggaaauucuuauaa

SEQ ID NO: 1732850 - RNA, 18 nt, Homo sapiens
aaggaaccuguguuauca

SEQ ID NO: 1732851 - RNA, 17 nt, Homo sapiens
aaggaaccuuccuuccu

SEQ ID NO: 1732852 - RNA, 22 nt, Homo sapiens
aaggaagcaaguuuucuuccau

SEQ ID NO: 1732853 - RNA, 21 nt, Homo sapiens
aaggccugacuucugcuggca

SEQ ID NO: 1732854 - RNA, 14 nt, Homo sapiens
aagggaauccuccu

SEQ ID NO: 1732855 - RNA, 20 nt, Homo sapiens
aaguagaagucauauguugu

SEQ ID NO: 1732856 - RNA, 17 nt, Homo sapiens
aagugcauauuuaucca

SEQ ID NO: 1732857 - RNA, 18 nt, Homo sapiens
aauaauucuuaacagugg

SEQ ID NO: 1732858 - RNA, 20 nt, Homo sapiens
aauaugccuaguuucuuaca

SEQ ID NO: 1732859 - RNA, 15 nt, Homo sapiens
aaucuaccacuguau

SEQ ID NO: 1732860 - RNA, 16 nt, Homo sapiens
aauguacaacugcacc

SEQ ID NO: 1732861 - RNA, 14 nt, Homo sapiens
aauguuaauguuau

SEQ ID NO: 1732862 - RNA, 18 nt, Homo sapiens
aauguuaauguuauauca

SEQ ID NO: 1732863 - RNA, 20 nt, Homo sapiens
aauguuuaaagaucaugaca

SEQ ID NO: 1732864 - RNA, 15 nt, Homo sapiens
aauuuacacugccau

SEQ ID NO: 1732865 - RNA, 18 nt, Homo sapiens
aauuuguaaaacuucugc

SEQ ID NO: 1732866 - RNA, 15 nt, Homo sapiens
acaacauccacuguu

SEQ ID NO: 1732867 - RNA, 21 nt, Homo sapiens
acacaaaaaaaauuuuagcuc

SEQ ID NO: 1732868 - RNA, 19 nt, Homo sapiens
acacaguuguaggguuaca

SEQ ID NO: 1732869 - RNA, 20 nt, Homo sapiens
acacugaaaugaaaucuucc

SEQ ID NO: 1732870 - RNA, 16 nt, Homo sapiens
acacuuccagcauuua

SEQ ID NO: 1732871 - RNA, 21 nt, Homo sapiens
acagcacuggggagucuuugu

SEQ ID NO: 1732872 - RNA, 20 nt, Homo sapiens
acagcuaucgaacuucacaa

SEQ ID NO: 1732873 - RNA, 23 nt, Homo sapiens
acaggaaaaaaaaaaaucuaucc

SEQ ID NO: 1732874 - RNA, 14 nt, Homo sapiens
acagguaccaucuu

SEQ ID NO: 1732875 - RNA, 16 nt, Homo sapiens
acaguaacccagagcu

SEQ ID NO: 1732876 - RNA, 19 nt, Homo sapiens
acagucuucccagcaauua

SEQ ID NO: 1732877 - RNA, 18 nt, Homo sapiens
acauauauauuaauacug

SEQ ID NO: 1732878 - RNA, 23 nt, Homo sapiens
acauggcuccggccucugccuuu

SEQ ID NO: 1732879 - RNA, 13 nt, Homo sapiens
acauguacagaca

SEQ ID NO: 1732880 - RNA, 23 nt, Homo sapiens
acauuuuuuuuaacuacuauauu

SEQ ID NO: 1732881 - RNA, 20 nt, Homo sapiens
accacgggacaucacagggu

SEQ ID NO: 1732882 - RNA, 14 nt, Homo sapiens
acccagagcuguau

SEQ ID NO: 1732883 - RNA, 15 nt, Homo sapiens
acccagagcuguauu

SEQ ID NO: 1732884 - RNA, 23 nt, Homo sapiens
guggcaccgccuccccaccucca

SEQ ID NO: 1732885 - RNA, 20 nt, Homo sapiens
guggccuauuucaugcagag

SEQ ID NO: 1732886 - RNA, 19 nt, Homo sapiens
gugggacccccguggggca

SEQ ID NO: 1732887 - RNA, 14 nt, Homo sapiens
guguacauuucuau

SEQ ID NO: 1732888 - RNA, 14 nt, Homo sapiens
gugugugcacaucc

SEQ ID NO: 1732889 - RNA, 17 nt, Homo sapiens
guuauaucauauguaua

SEQ ID NO: 1732890 - RNA, 17 nt, Homo sapiens
guuccaaugucaaugug

SEQ ID NO: 1732891 - RNA, 21 nt, Homo sapiens
guucguucuguacuguuacug

SEQ ID NO: 1732892 - RNA, 19 nt, Homo sapiens
guucuggggggacccagug

SEQ ID NO: 1732893 - RNA, 23 nt, Homo sapiens
guucuggggggacccagugcaga

SEQ ID NO: 1732894 - RNA, 20 nt, Homo sapiens
guuggucugccuucugcuga

SEQ ID NO: 1732895 - RNA, 15 nt, Homo sapiens
guuuuuaacauguca

SEQ ID NO: 1732896 - RNA, 24 nt, Homo sapiens
uaaaagcggaaaguuagugcuugu

SEQ ID NO: 1732897 - RNA, 21 nt, Homo sapiens
uaaaaguuuuuuauuaugcau

SEQ ID NO: 1732898 - RNA, 22 nt, Homo sapiens
uaaaaguuuuuuauuaugcauu

SEQ ID NO: 1732899 - RNA, 12 nt, Homo sapiens
uaaauacauucg

SEQ ID NO: 1732900 - RNA, 22 nt, Homo sapiens
uaaaugaaacuuaagaauugaa

SEQ ID NO: 1732901 - RNA, 17 nt, Homo sapiens
cuagcaaucugccugua

SEQ ID NO: 1732902 - RNA, 19 nt, Homo sapiens
cuaguacugccccccauga

SEQ ID NO: 1732903 - RNA, 14 nt, Homo sapiens
cuaguguacauuuc

SEQ ID NO: 1732904 - RNA, 18 nt, Homo sapiens
cuaguguaccuccucuca

SEQ ID NO: 1732905 - RNA, 16 nt, Homo sapiens
cuaguuucuuacacac

SEQ ID NO: 1732906 - RNA, 14 nt, Homo sapiens
cuaucgaacuucac

SEQ ID NO: 1732907 - RNA, 12 nt, Homo sapiens
cucacccaugca

SEQ ID NO: 1732908 - RNA, 22 nt, Homo sapiens
cucagggagcagggaaggccug

SEQ ID NO: 1732909 - RNA, 22 nt, Homo sapiens
cucagguagaagguugacacag

SEQ ID NO: 1732910 - RNA, 21 nt, Homo sapiens
cucaguguuuuggacuccauc

SEQ ID NO: 1732911 - RNA, 21 nt, Homo sapiens
cucaguugaaaaugcaacucu

SEQ ID NO: 1732912 - RNA, 19 nt, Homo sapiens
cucaucugcacuauguuuc

SEQ ID NO: 1732913 - RNA, 20 nt, Homo sapiens
cucaugccuguaaucccagc

SEQ ID NO: 1732914 - RNA, 13 nt, Homo sapiens
cucucacuauuau

SEQ ID NO: 1732915 - RNA, 17 nt, Homo sapiens
cucugccgcuaccuccc

SEQ ID NO: 1732916 - RNA, 23 nt, Homo sapiens
cucuucuggggcaggcugggcca

SEQ ID NO: 1732917 - RNA, 21 nt, Homo sapiens
cucuucuuggggcccagugca

SEQ ID NO: 1732918 - RNA, 20 nt, Homo sapiens
cugaagauugcgguuuacag

SEQ ID NO: 1732919 - RNA, 13 nt, Homo sapiens
cugaauggucuca

SEQ ID NO: 1732920 - RNA, 17 nt, Homo sapiens
cugaggguguuucuucc

SEQ ID NO: 1732921 - RNA, 14 nt, Homo sapiens
cugaggugacuuaa

SEQ ID NO: 1732922 - RNA, 18 nt, Homo sapiens
cugauuuguauucuguga

SEQ ID NO: 1732923 - RNA, 23 nt, Homo sapiens
cugcagauacuuugaagugcagc

SEQ ID NO: 1732924 - RNA, 17 nt, Homo sapiens
cugccccucucaccaaa

SEQ ID NO: 1732925 - RNA, 19 nt, Homo sapiens
cugccuuugcaccacggga

SEQ ID NO: 1732926 - RNA, 21 nt, Homo sapiens
cugcgcccugccgcacccgcg

SEQ ID NO: 1732927 - RNA, 23 nt, Homo sapiens
cuggaaccagcucucuccuaaua

SEQ ID NO: 1732928 - RNA, 18 nt, Homo sapiens
cuggaagggguccagccu

SEQ ID NO: 1732929 - RNA, 17 nt, Homo sapiens
cuggcaccgcaguuuug

SEQ ID NO: 1732930 - RNA, 13 nt, Homo sapiens
cugggccaugucc

SEQ ID NO: 1732931 - RNA, 14 nt, Homo sapiens
cugggccaugucca

SEQ ID NO: 1732932 - RNA, 23 nt, Homo sapiens
cuggggacagacaaggugccugu

SEQ ID NO: 1732933 - RNA, 20 nt, Homo sapiens
cuggggggacccagugcaga

SEQ ID NO: 1732934 - RNA, 13 nt, Homo sapiens
cugggugaucugc

SEQ ID NO: 1732935 - RNA, 12 nt, Homo sapiens
cuguacuguuac

SEQ ID NO: 1732936 - RNA, 16 nt, Homo sapiens
cuguccguucacaugu

SEQ ID NO: 1732937 - RNA, 19 nt, Homo sapiens
cugugcaacggucuccuga

SEQ ID NO: 1732938 - RNA, 13 nt, Homo sapiens
cuguugaucucag

SEQ ID NO: 1732939 - RNA, 13 nt, Homo sapiens
cuucccagcaauu

SEQ ID NO: 1732940 - RNA, 21 nt, Homo sapiens
cuuccccgagugacucuggau

SEQ ID NO: 1732941 - RNA, 15 nt, Homo sapiens
cuuccuguacuugaa

SEQ ID NO: 1732942 - RNA, 16 nt, Homo sapiens
cuucuguugaucucag

SEQ ID NO: 1732943 - RNA, 14 nt, Homo sapiens
cuugaguucccaga

SEQ ID NO: 1732944 - RNA, 17 nt, Homo sapiens
cuugcccccagugccuc

SEQ ID NO: 1732945 - RNA, 17 nt, Homo sapiens
cuuggggcccagugcau

SEQ ID NO: 1732946 - RNA, 17 nt, Homo sapiens
cuuggugcccucgccuc

SEQ ID NO: 1732947 - RNA, 13 nt, Homo sapiens
cuuguucccacac

SEQ ID NO: 1732948 - RNA, 20 nt, Homo sapiens
cuuucuagaguagcucccau

SEQ ID NO: 1732949 - RNA, 17 nt, Homo sapiens
cuuuggagaugcugagg

SEQ ID NO: 1732950 - RNA, 16 nt, Homo sapiens
cuuuucauccuagucu

SEQ ID NO: 1732951 - RNA, 18 nt, Homo sapiens
cuuuugagaguauagcau

SEQ ID NO: 1732952 - RNA, 23 nt, Homo sapiens
gaaagaaguccuuucucuuuauu

SEQ ID NO: 1732953 - RNA, 13 nt, Homo sapiens
gaaauacuuugua

SEQ ID NO: 1732954 - RNA, 19 nt, Homo sapiens
gaacagcaauggugucagu

SEQ ID NO: 1732955 - RNA, 22 nt, Homo sapiens
gaacagcacuggggagucuuug

SEQ ID NO: 1732956 - RNA, 18 nt, Homo sapiens
gaagcaaguuuucuucca

SEQ ID NO: 1732957 - RNA, 18 nt, Homo sapiens
gaagcuacuucuccacug

SEQ ID NO: 1732958 - RNA, 22 nt, Homo sapiens
gaaggaacagcaauggugucag

SEQ ID NO: 1732959 - RNA, 18 nt, Homo sapiens
gaagucuaaaagcagaaa

SEQ ID NO: 1732960 - RNA, 17 nt, Homo sapiens
gaauccuccuccagggu

SEQ ID NO: 1732961 - RNA, 22 nt, Homo sapiens
gaauuugaaaaaugcauaauaa

SEQ ID NO: 1732962 - RNA, 22 nt, Homo sapiens
gacagaccacagagcugucacu

SEQ ID NO: 1732963 - RNA, 16 nt, Homo sapiens
gacagagguugcagug

SEQ ID NO: 1732964 - RNA, 20 nt, Homo sapiens
gacccccguggggcagggag

SEQ ID NO: 1732965 - RNA, 12 nt, Homo sapiens
gacgcugcugac

SEQ ID NO: 1732966 - RNA, 13 nt, Homo sapiens
gacuauuacauau

SEQ ID NO: 1732967 - RNA, 13 nt, Homo sapiens
gacuggugcugca

SEQ ID NO: 1732968 - RNA, 20 nt, Homo sapiens
gacuucucaaagagaauugu

SEQ ID NO: 1732969 - RNA, 15 nt, Homo sapiens
gagaagcaagccagc

SEQ ID NO: 1732970 - RNA, 15 nt, Homo sapiens
gagacucagugcaga

SEQ ID NO: 1732971 - RNA, 18 nt, Homo sapiens
gagacucuaggguccagu

SEQ ID NO: 1732972 - RNA, 16 nt, Homo sapiens
gagcaggaacaaugac

SEQ ID NO: 1732973 - RNA, 21 nt, Homo sapiens
gaggcaagugugggggguccu

SEQ ID NO: 1732974 - RNA, 15 nt, Homo sapiens
gaggucauacaugca

SEQ ID NO: 1732975 - RNA, 21 nt, Homo sapiens
gaggugggcagaucaccugag

SEQ ID NO: 1732976 - RNA, 14 nt, Homo sapiens
gagguguacaggua

SEQ ID NO: 1732977 - RNA, 15 nt, Homo sapiens
gagguguacagguac

SEQ ID NO: 1732978 - RNA, 22 nt, Homo sapiens
gaguuuuauagccuggacugcu

SEQ ID NO: 1732979 - RNA, 22 nt, Homo sapiens
gaucaaauugugcaguacuuug

SEQ ID NO: 1732980 - RNA, 21 nt, Homo sapiens
gaucaacaacauccacuguua

SEQ ID NO: 1732981 - RNA, 22 nt, Homo sapiens
gaucaucgccagaggugcuuca

SEQ ID NO: 1732982 - RNA, 16 nt, Homo sapiens
gauccuuuuauucucc

SEQ ID NO: 1732983 - RNA, 22 nt, Homo sapiens
gaugacgugcuccguagcucug

SEQ ID NO: 1732984 - RNA, 16 nt, Homo sapiens
gauggcaggugccugu

SEQ ID NO: 1732985 - RNA, 18 nt, Homo sapiens
gauggcaggugccuguaa

SEQ ID NO: 1732986 - RNA, 20 nt, Homo sapiens
gaugguguguucugcaauau

SEQ ID NO: 1732987 - RNA, 16 nt, Homo sapiens
gauguguccucaggga

SEQ ID NO: 1732988 - RNA, 19 nt, Homo sapiens
gauguuauuagauguuaca

SEQ ID NO: 1732989 - RNA, 17 nt, Homo sapiens
gcaacucuaacucugag

SEQ ID NO: 1732990 - RNA, 20 nt, Homo sapiens
gcacacacacacgcuuucuu

SEQ ID NO: 1732991 - RNA, 15 nt, Homo sapiens
gcaggcaauuucacc

SEQ ID NO: 1732992 - RNA, 18 nt, Homo sapiens
gcaggcugggccaugucc

SEQ ID NO: 1732993 - RNA, 16 nt, Homo sapiens
gcaggugccuguaauc

SEQ ID NO: 1732994 - RNA, 16 nt, Homo sapiens
gcagugagcugagauc

SEQ ID NO: 1732995 - RNA, 23 nt, Homo sapiens
gcauauuuauccaaaauguguau

SEQ ID NO: 1732996 - RNA, 18 nt, Homo sapiens
gcauauuuuaaugcaguu

SEQ ID NO: 1732997 - RNA, 13 nt, Homo sapiens
gccaugccaggaa

SEQ ID NO: 1732998 - RNA, 13 nt, Homo sapiens
gccauguccaaag

SEQ ID NO: 1732999 - RNA, 12 nt, Homo sapiens
gcccagugcaug

SEQ ID NO: 1733000 - RNA, 13 nt, Homo sapiens
gccccacaugucc

SEQ ID NO: 1733001 - RNA, 19 nt, Homo sapiens
aaccuccaccuucuggguu

SEQ ID NO: 1733002 - RNA, 18 nt, Homo sapiens
aaccuuauuguaccucuc

SEQ ID NO: 1733003 - RNA, 18 nt, Homo sapiens
aacuugaaugugucaggu

SEQ ID NO: 1733004 - RNA, 14 nt, Homo sapiens
aagaaauucugcaa

SEQ ID NO: 1733005 - RNA, 22 nt, Homo sapiens
aagauguagaggagaaacugga

SEQ ID NO: 1733006 - RNA, 15 nt, Homo sapiens
aagauuaugaucuca

SEQ ID NO: 1733007 - RNA, 21 nt, Homo sapiens
aagcaaagacuaugaggaaua

SEQ ID NO: 1733008 - RNA, 15 nt, Homo sapiens
aagcagaacagugau

SEQ ID NO: 1733009 - RNA, 20 nt, Homo sapiens
aagcagaacagugauuacca

SEQ ID NO: 1733010 - RNA, 22 nt, Homo sapiens
aagcagggacuugaacccauau

SEQ ID NO: 1733011 - RNA, 20 nt, Homo sapiens
aaggcuuagacccucaugcu

SEQ ID NO: 1733012 - RNA, 15 nt, Homo sapiens
aaggcuuuaucucag

SEQ ID NO: 1733013 - RNA, 21 nt, Homo sapiens
aagggucucccucuguugcca

SEQ ID NO: 1733014 - RNA, 12 nt, Homo sapiens
aaguauccuuca

SEQ ID NO: 1733015 - RNA, 14 nt, Homo sapiens
aagucuuccauaga

SEQ ID NO: 1733016 - RNA, 22 nt, Homo sapiens
aagucuuccauagagacuuugu

SEQ ID NO: 1733017 - RNA, 16 nt, Homo sapiens
aaguugcaccaacuuu

SEQ ID NO: 1733018 - RNA, 19 nt, Homo sapiens
aaguugcaccaacuuugaa

SEQ ID NO: 1733019 - RNA, 19 nt, Homo sapiens
aaguuuaugcauacaguaa

SEQ ID NO: 1733020 - RNA, 14 nt, Homo sapiens
aauaaaagcacuua

SEQ ID NO: 1733021 - RNA, 15 nt, Homo sapiens
aauagugucugauga

SEQ ID NO: 1733022 - RNA, 14 nt, Homo sapiens
aauauuguugacaa

SEQ ID NO: 1733023 - RNA, 20 nt, Homo sapiens
aauauuuauuauuuucaccu

SEQ ID NO: 1733024 - RNA, 17 nt, Homo sapiens
aauauuuuuaugugcaa

SEQ ID NO: 1733025 - RNA, 15 nt, Homo sapiens
aaucccagcuacuug

SEQ ID NO: 1733026 - RNA, 20 nt, Homo sapiens
aaucugagccagugcuuuaa

SEQ ID NO: 1733027 - RNA, 17 nt, Homo sapiens
aaucuucagaccuagaa

SEQ ID NO: 1733028 - RNA, 21 nt, Homo sapiens
aauuacaggcgugagccacca

SEQ ID NO: 1733029 - RNA, 21 nt, Homo sapiens
aauucuauuacgugcaauacu

SEQ ID NO: 1733030 - RNA, 13 nt, Homo sapiens
aauugacacuuaa

SEQ ID NO: 1733031 - RNA, 18 nt, Homo sapiens
aauuuauucaauuccucu

SEQ ID NO: 1733032 - RNA, 21 nt, Homo sapiens
acaaaaaaagcauuguaacuu

SEQ ID NO: 1733033 - RNA, 19 nt, Homo sapiens
acaagacccaaaaggcaga

SEQ ID NO: 1733034 - RNA, 19 nt, Homo sapiens
acaaggcuuuaucucaggg

SEQ ID NO: 1733035 - RNA, 22 nt, Homo sapiens
acacaugauccugcaauuccac

SEQ ID NO: 1733036 - RNA, 19 nt, Homo sapiens
acagccaggcggcuggaau

SEQ ID NO: 1733037 - RNA, 21 nt, Homo sapiens
acagcucugcauacucauuag

SEQ ID NO: 1733038 - RNA, 14 nt, Homo sapiens
acagucacauucca

SEQ ID NO: 1733039 - RNA, 15 nt, Homo sapiens
acauagcaucucagg

SEQ ID NO: 1733040 - RNA, 15 nt, Homo sapiens
acaucaacagauaaa

SEQ ID NO: 1733041 - RNA, 20 nt, Homo sapiens
acauuacaguuagagauuuu

SEQ ID NO: 1733042 - RNA, 20 nt, Homo sapiens
acauuguuugucugucuuca

SEQ ID NO: 1733043 - RNA, 20 nt, Homo sapiens
accaaacccggccugauuaa

SEQ ID NO: 1733044 - RNA, 19 nt, Homo sapiens
accaccacccuugccaugg

SEQ ID NO: 1733045 - RNA, 14 nt, Homo sapiens
acccaaaaggcaga

SEQ ID NO: 1733046 - RNA, 13 nt, Homo sapiens
accgcaaugugac

SEQ ID NO: 1733047 - RNA, 17 nt, Homo sapiens
accuuuggaugcacuuu

SEQ ID NO: 1733048 - RNA, 13 nt, Homo sapiens
acuagauacugaa

SEQ ID NO: 1733049 - RNA, 22 nt, Homo sapiens
acuccugguuccuaggugagca

SEQ ID NO: 1733050 - RNA, 18 nt, Homo sapiens
acugaauguaaacaaagg

SEQ ID NO: 1733051 - RNA, 19 nt, Homo sapiens
acuugggcgggacacaggc

SEQ ID NO: 1733052 - RNA, 19 nt, Homo sapiens
acuuuaacacagugucugg

SEQ ID NO: 1733053 - RNA, 12 nt, Homo sapiens
acuuugugaaaa

SEQ ID NO: 1733054 - RNA, 15 nt, Homo sapiens
acuuuuggcuuguaa

SEQ ID NO: 1733055 - RNA, 16 nt, Homo sapiens
acuuuuguguaaugaa

SEQ ID NO: 1733056 - RNA, 23 nt, Homo sapiens
agaaauuccaggaaaaucugcac

SEQ ID NO: 1733057 - RNA, 19 nt, Homo sapiens
agaauugcuugaacccagg

SEQ ID NO: 1733058 - RNA, 23 nt, Homo sapiens
agacauagaauuaacacaugauc

SEQ ID NO: 1733059 - RNA, 13 nt, Homo sapiens
agacucugucuca

SEQ ID NO: 1733060 - RNA, 14 nt, Homo sapiens
agagaaauuugcca

SEQ ID NO: 1733061 - RNA, 17 nt, Homo sapiens
agagacgggguuugcca

SEQ ID NO: 1733062 - RNA, 20 nt, Homo sapiens
agagacgggguuugccaugc

SEQ ID NO: 1733063 - RNA, 17 nt, Homo sapiens
agaggagaaacuggaac

SEQ ID NO: 1733064 - RNA, 17 nt, Homo sapiens
agauagguuaccaguaa

SEQ ID NO: 1733065 - RNA, 13 nt, Homo sapiens
agauguagaggag

SEQ ID NO: 1733066 - RNA, 16 nt, Homo sapiens
agauuucaugccuggu

SEQ ID NO: 1733067 - RNA, 18 nt, Homo sapiens
agcaagacucugucucaa

SEQ ID NO: 1733068 - RNA, 16 nt, Homo sapiens
agccacuucacuuuuu

SEQ ID NO: 1733069 - RNA, 12 nt, Homo sapiens
agccccaaaagg

SEQ ID NO: 1733070 - RNA, 22 nt, Homo sapiens
agcuuuucaaaauuggacuuaa

SEQ ID NO: 1733071 - RNA, 19 nt, Homo sapiens
aggagaaacuggaacucuc

SEQ ID NO: 1733072 - RNA, 15 nt, Homo sapiens
aggcuccaaacugga

SEQ ID NO: 1733073 - RNA, 23 nt, Homo sapiens
aggcuggucucgaacugcuggau

SEQ ID NO: 1733074 - RNA, 19 nt, Homo sapiens
agguauuuauugagcaccu

SEQ ID NO: 1733075 - RNA, 13 nt, Homo sapiens
aggucuccaaaau

SEQ ID NO: 1733076 - RNA, 20 nt, Homo sapiens
aguaauuuuaaguaauuuca

SEQ ID NO: 1733077 - RNA, 13 nt, Homo sapiens
aguacagacuuuu

SEQ ID NO: 1733078 - RNA, 20 nt, Homo sapiens
agugaaaaucuacacuccag

SEQ ID NO: 1733079 - RNA, 14 nt, Homo sapiens
aguggcauguauga

SEQ ID NO: 1733080 - RNA, 14 nt, Homo sapiens
agugggacaguucc

SEQ ID NO: 1733081 - RNA, 23 nt, Homo sapiens
aguuguaccgcaaugugacuuaa

SEQ ID NO: 1733082 - RNA, 18 nt, Homo sapiens
auaaaguguaaguucaca

SEQ ID NO: 1733083 - RNA, 22 nt, Homo sapiens
auaacuaggcguggacuuacua

SEQ ID NO: 1733084 - RNA, 15 nt, Homo sapiens
auaagcuguuuuuau

SEQ ID NO: 1733085 - RNA, 16 nt, Homo sapiens
auaauacuagucuuau

SEQ ID NO: 1733086 - RNA, 15 nt, Homo sapiens
auacuauccaguuac

SEQ ID NO: 1733087 - RNA, 16 nt, Homo sapiens
auacuauccaguuacu

SEQ ID NO: 1733088 - RNA, 12 nt, Homo sapiens
auagaauuaaca

SEQ ID NO: 1733089 - RNA, 15 nt, Homo sapiens
auaguuguaccgcaa

SEQ ID NO: 1733090 - RNA, 15 nt, Homo sapiens
auauccugugacugu

SEQ ID NO: 1733091 - RNA, 17 nt, Homo sapiens
auaugccugcaaucuga

SEQ ID NO: 1733092 - RNA, 21 nt, Homo sapiens
auauuugaauuuuaaaucuaa

SEQ ID NO: 1733093 - RNA, 18 nt, Homo sapiens
auauuuuuaugugcaaua

SEQ ID NO: 1733094 - RNA, 23 nt, Homo sapiens
auauuuuuuaugaaacauuacag

SEQ ID NO: 1733095 - RNA, 13 nt, Homo sapiens
aucauguauuuau

SEQ ID NO: 1733096 - RNA, 19 nt, Homo sapiens
auccagauagguuaccagu

SEQ ID NO: 1733097 - RNA, 21 nt, Homo sapiens
auccuaauaaaaaggugacca

SEQ ID NO: 1733098 - RNA, 19 nt, Homo sapiens
auccugcaauuccacuuau

SEQ ID NO: 1733099 - RNA, 17 nt, Homo sapiens
aucuacacuccagugag

SEQ ID NO: 1733100 - RNA, 15 nt, Homo sapiens
aucucacaagcacuu

SEQ ID NO: 1733101 - RNA, 16 nt, Homo sapiens
aucucacaagcacuuu

SEQ ID NO: 1733102 - RNA, 19 nt, Homo sapiens
aucuccgucucccaaagug

SEQ ID NO: 1733103 - RNA, 18 nt, Homo sapiens
augaaaagauuaugaucu

SEQ ID NO: 1733104 - RNA, 20 nt, Homo sapiens
augaaaagauuaugaucuca

SEQ ID NO: 1733105 - RNA, 20 nt, Homo sapiens
augaacacuuauaagugaag

SEQ ID NO: 1733106 - RNA, 19 nt, Homo sapiens
augauuccaccuacaugag

SEQ ID NO: 1733107 - RNA, 14 nt, Homo sapiens
augccugcaaucug

SEQ ID NO: 1733108 - RNA, 14 nt, Homo sapiens
auggagugacuuag

SEQ ID NO: 1733109 - RNA, 19 nt, Homo sapiens
augggagaaucacuugaac

SEQ ID NO: 1733110 - RNA, 22 nt, Homo sapiens
auuacaaggcuuuaucucaggg

SEQ ID NO: 1733111 - RNA, 17 nt, Homo sapiens
auuacaggcgugagcca

SEQ ID NO: 1733112 - RNA, 18 nt, Homo sapiens
auuacaggcgugagccac

SEQ ID NO: 1733113 - RNA, 17 nt, Homo sapiens
auuaccucugauaccuc

SEQ ID NO: 1733114 - RNA, 18 nt, Homo sapiens
auuagaggucuccaaaau

SEQ ID NO: 1733115 - RNA, 19 nt, Homo sapiens
auuccuauauccugugacu

SEQ ID NO: 1733116 - RNA, 18 nt, Homo sapiens
auucuauuacgugcaaua

SEQ ID NO: 1733117 - RNA, 15 nt, Homo sapiens
auucugcaagcuuuu

SEQ ID NO: 1733118 - RNA, 20 nt, Homo sapiens
auugagcaccugcaggcgug

SEQ ID NO: 1733119 - RNA, 23 nt, Homo sapiens
auuggacuuaaaaucuaauucaa

SEQ ID NO: 1733120 - RNA, 17 nt, Homo sapiens
auuguugacaacuguga

SEQ ID NO: 1733121 - RNA, 19 nt, Homo sapiens
auuguugacaacugugacu

SEQ ID NO: 1733122 - RNA, 18 nt, Homo sapiens
auuuaaaaaaaaaccuga

SEQ ID NO: 1733123 - RNA, 14 nt, Homo sapiens
auuuauuaccucug

SEQ ID NO: 1733124 - RNA, 14 nt, Homo sapiens
aauuaacacaugau

SEQ ID NO: 1733125 - RNA, 22 nt, Homo sapiens
aauuccuauauccugugacugu

SEQ ID NO: 1733126 - RNA, 16 nt, Homo sapiens
aauugacccacaagaa

SEQ ID NO: 1733127 - RNA, 19 nt, Homo sapiens
acaaauuuacagagacaga

SEQ ID NO: 1733128 - RNA, 15 nt, Homo sapiens
acaaugaacacuuau

SEQ ID NO: 1733129 - RNA, 17 nt, Homo sapiens
acacaggcuccaaacug

SEQ ID NO: 1733130 - RNA, 12 nt, Homo sapiens
acagaacuugaa

SEQ ID NO: 1733131 - RNA, 17 nt, Homo sapiens
acagagaaaagacauaa

SEQ ID NO: 1733132 - RNA, 11 nt, Homo sapiens
acagcucugca

SEQ ID NO: 1733133 - RNA, 16 nt, Homo sapiens
acagugucuggcacuu

SEQ ID NO: 1733134 - RNA, 19 nt, Homo sapiens
acauaagcaaagacuauga

SEQ ID NO: 1733135 - RNA, 20 nt, Homo sapiens
acauagaauuaacacaugau

SEQ ID NO: 1733136 - RNA, 14 nt, Homo sapiens
accagccaaccugg

SEQ ID NO: 1733137 - RNA, 12 nt, Homo sapiens
accagggacuga

SEQ ID NO: 1733138 - RNA, 19 nt, Homo sapiens
accaguaacggaacaguau

SEQ ID NO: 1733139 - RNA, 22 nt, Homo sapiens
acccucugggucucaguguccu

SEQ ID NO: 1733140 - RNA, 13 nt, Homo sapiens
acccuugccaugg

SEQ ID NO: 1733141 - RNA, 15 nt, Homo sapiens
accuguaaucccagc

SEQ ID NO: 1733142 - RNA, 19 nt, Homo sapiens
accuuuggaugcacuuuau

SEQ ID NO: 1733143 - RNA, 21 nt, Homo sapiens
acgccuguaaucccagcacuu

SEQ ID NO: 1733144 - RNA, 10 nt, Homo sapiens
acgugcaaua

SEQ ID NO: 1733145 - RNA, 16 nt, Homo sapiens
acuaaaaauacaaaaa

SEQ ID NO: 1733146 - RNA, 18 nt, Homo sapiens
acuaaauugacacuuaaa

SEQ ID NO: 1733147 - RNA, 16 nt, Homo sapiens
acuauccaguuacugc

SEQ ID NO: 1733148 - RNA, 12 nt, Homo sapiens
acucauugcaac

SEQ ID NO: 1733149 - RNA, 23 nt, Homo sapiens
acucauugcaaccuccaccuucu

SEQ ID NO: 1733150 - RNA, 14 nt, Homo sapiens
acugucucacuuaa

SEQ ID NO: 1733151 - RNA, 17 nt, Homo sapiens
acuuaaaaucuaauuca

SEQ ID NO: 1733152 - RNA, 16 nt, Homo sapiens
acuuaguguacaugaa

SEQ ID NO: 1733153 - RNA, 18 nt, Homo sapiens
acuuaugaaccuuuacau

SEQ ID NO: 1733154 - RNA, 22 nt, Homo sapiens
agaaauuccaggaaaaucugca

SEQ ID NO: 1733155 - RNA, 14 nt, Homo sapiens
agaacuugaaugug

SEQ ID NO: 1733156 - RNA, 22 nt, Homo sapiens
agaagugaaaaucuacacucca

SEQ ID NO: 1733157 - RNA, 15 nt, Homo sapiens
agaauuaacacauga

SEQ ID NO: 1733158 - RNA, 21 nt, Homo sapiens
agacaccaccacccuugccau

SEQ ID NO: 1733159 - RNA, 23 nt, Homo sapiens
agacaccaccacccuugccaugg

SEQ ID NO: 1733160 - RNA, 14 nt, Homo sapiens
agacagaacuugaa

SEQ ID NO: 1733161 - RNA, 15 nt, Homo sapiens
agacucugucucagu

SEQ ID NO: 1733162 - RNA, 23 nt, Homo sapiens
agagacagaaagcagaacaguga

SEQ ID NO: 1733163 - RNA, 22 nt, Homo sapiens
agcaagaucccauggguugugu

SEQ ID NO: 1733164 - RNA, 22 nt, Homo sapiens
agcauauguuuuuguaaguuua

SEQ ID NO: 1733165 - RNA, 12 nt, Homo sapiens
agcaucucagga

SEQ ID NO: 1733166 - RNA, 23 nt, Homo sapiens
agccaaccugggggcuuuaggga

SEQ ID NO: 1733167 - RNA, 14 nt, Homo sapiens
agccacuucacuuu

SEQ ID NO: 1733168 - RNA, 23 nt, Homo sapiens
agcuaaguugcaccaacuuugaa

SEQ ID NO: 1733169 - RNA, 14 nt, Homo sapiens
agcuguuuccauag

SEQ ID NO: 1733170 - RNA, 14 nt, Homo sapiens
agcuucucugugaa

SEQ ID NO: 1733171 - RNA, 19 nt, Homo sapiens
agcuugaaauagugucuga

SEQ ID NO: 1733172 - RNA, 13 nt, Homo sapiens
aggaauauuugca

SEQ ID NO: 1733173 - RNA, 20 nt, Homo sapiens
aggcuggagugcaguggcgc

SEQ ID NO: 1733174 - RNA, 15 nt, Homo sapiens
agguuaagcacuuua

SEQ ID NO: 1733175 - RNA, 19 nt, Homo sapiens
agugaacaaauuuacagag

SEQ ID NO: 1733176 - RNA, 15 nt, Homo sapiens
agugagcugauauca

SEQ ID NO: 1733177 - RNA, 17 nt, Homo sapiens
aguuacugccgguuuga

SEQ ID NO: 1733178 - RNA, 22 nt, Homo sapiens
auaauuccuauauccugugacu

SEQ ID NO: 1733179 - RNA, 12 nt, Homo sapiens
auacagugucuu

SEQ ID NO: 1733180 - RNA, 17 nt, Homo sapiens
auacuucaauacuucau

SEQ ID NO: 1733181 - RNA, 17 nt, Homo sapiens
auagcagcuuauucaca

SEQ ID NO: 1733182 - RNA, 13 nt, Homo sapiens
auagcaucucagg

SEQ ID NO: 1733183 - RNA, 21 nt, Homo sapiens
auagugucugaugaauguuaa

SEQ ID NO: 1733184 - RNA, 23 nt, Homo sapiens
auaucaugccccuguacuccagc

SEQ ID NO: 1733185 - RNA, 14 nt, Homo sapiens
auauccugugacug

SEQ ID NO: 1733186 - RNA, 21 nt, Homo sapiens
aucaauucuauuacgugcaau

SEQ ID NO: 1733187 - RNA, 23 nt, Homo sapiens
aucaauucuauuacgugcaauac

SEQ ID NO: 1733188 - RNA, 14 nt, Homo sapiens
aucaccaaggcuga

SEQ ID NO: 1733189 - RNA, 15 nt, Homo sapiens
aucagcuaaguugca

SEQ ID NO: 1733190 - RNA, 14 nt, Homo sapiens
aucuacacuccagu

SEQ ID NO: 1733191 - RNA, 13 nt, Homo sapiens
aucuauuuauuaa

SEQ ID NO: 1733192 - RNA, 22 nt, Homo sapiens
augaaaagauuaugaucucaga

SEQ ID NO: 1733193 - RNA, 17 nt, Homo sapiens
augaaguacucauacau

SEQ ID NO: 1733194 - RNA, 16 nt, Homo sapiens
augaauaaaguguaag

SEQ ID NO: 1733195 - RNA, 10 nt, Homo sapiens
augacuaugc

SEQ ID NO: 1733196 - RNA, 13 nt, Homo sapiens
augcauacaguaa

SEQ ID NO: 1733197 - RNA, 17 nt, Homo sapiens
auggagguuaagcacuu

SEQ ID NO: 1733198 - RNA, 17 nt, Homo sapiens
auggcagcuuuccucaa

SEQ ID NO: 1733199 - RNA, 16 nt, Homo sapiens
auggcuaguaucaaaa

SEQ ID NO: 1733200 - RNA, 19 nt, Homo sapiens
augucagacagaacuugaa

SEQ ID NO: 1733201 - RNA, 17 nt, Homo sapiens
augugauauguaccuaa

SEQ ID NO: 1733202 - RNA, 10 nt, Homo sapiens
augugcaaua

SEQ ID NO: 1733203 - RNA, 11 nt, Homo sapiens
augugcaauau

SEQ ID NO: 1733204 - RNA, 19 nt, Homo sapiens
auuacgugcaauacuucaa

SEQ ID NO: 1733205 - RNA, 18 nt, Homo sapiens
auuagccgggcauggugg

SEQ ID NO: 1733206 - RNA, 19 nt, Homo sapiens
auucuauuacgugcaauac

SEQ ID NO: 1733207 - RNA, 21 nt, Homo sapiens
auugaaucccuuaaacucagg

SEQ ID NO: 1733208 - RNA, 15 nt, Homo sapiens
auuguaacuuaugaa

SEQ ID NO: 1733209 - RNA, 17 nt, Homo sapiens
auuguaacuuaugaacc

SEQ ID NO: 1733210 - RNA, 14 nt, Homo sapiens
auuucacuugauga

SEQ ID NO: 1733211 - RNA, 11 nt, Homo sapiens
auuugagacag

SEQ ID NO: 1733212 - RNA, 15 nt, Homo sapiens
auuugcaagacauag

SEQ ID NO: 1733213 - RNA, 18 nt, Homo sapiens
auuuuaaguaauuucaga

SEQ ID NO: 1733214 - RNA, 20 nt, Homo sapiens
auuuuguguucaguacaauu

SEQ ID NO: 1733215 - RNA, 23 nt, Homo sapiens
auuuuuccccaaaaagaauggga

SEQ ID NO: 1733216 - RNA, 21 nt, Homo sapiens
auuuuuuaugaaacauuacag

SEQ ID NO: 1733217 - RNA, 17 nt, Homo sapiens
caaaacuucagacauag

SEQ ID NO: 1733218 - RNA, 23 nt, Homo sapiens
caaacaaacgaaaaacauuucaa

SEQ ID NO: 1733219 - RNA, 12 nt, Homo sapiens
caaacagaacua

SEQ ID NO: 1733220 - RNA, 19 nt, Homo sapiens
caaacgaaaaacauuucaa

SEQ ID NO: 1733221 - RNA, 13 nt, Homo sapiens
caaaucucuauua

SEQ ID NO: 1733222 - RNA, 19 nt, Homo sapiens
caacccaaauguucaucaa

SEQ ID NO: 1733223 - RNA, 18 nt, Homo sapiens
caaccuccaccuucuggg

SEQ ID NO: 1733224 - RNA, 20 nt, Homo sapiens
caagcuuuucaaaauuggac

SEQ ID NO: 1733225 - RNA, 14 nt, Homo sapiens
uaaaguacagacuu

SEQ ID NO: 1733226 - RNA, 20 nt, Homo sapiens
uaaauguaucuuauucacau

SEQ ID NO: 1733227 - RNA, 20 nt, Homo sapiens
uaagcacuuuaacacagugu

SEQ ID NO: 1733228 - RNA, 20 nt, Homo sapiens
uaaguugcaccaacuuugaa

SEQ ID NO: 1733229 - RNA, 14 nt, Homo sapiens
uaauuacuauguca

SEQ ID NO: 1733230 - RNA, 21 nt, Homo sapiens
uaauuuaucuugucucugggc

SEQ ID NO: 1733231 - RNA, 13 nt, Homo sapiens
uaauuucagaaga

SEQ ID NO: 1733232 - RNA, 14 nt, Homo sapiens
uacaaggcuuuauc

SEQ ID NO: 1733233 - RNA, 19 nt, Homo sapiens
uacaaggcuuuaucucagg

SEQ ID NO: 1733234 - RNA, 18 nt, Homo sapiens
uacagagaaaagacauaa

SEQ ID NO: 1733235 - RNA, 21 nt, Homo sapiens
uacauauuucuuugccuuuau

SEQ ID NO: 1733236 - RNA, 15 nt, Homo sapiens
uagaagcaucacagg

SEQ ID NO: 1733237 - RNA, 15 nt, Homo sapiens
uagaauuaauggaau

SEQ ID NO: 1733238 - RNA, 17 nt, Homo sapiens
uagagaaauuugccaau

SEQ ID NO: 1733239 - RNA, 20 nt, Homo sapiens
uagagugggacaguuccuga

SEQ ID NO: 1733240 - RNA, 13 nt, Homo sapiens
uagggaccugcug

SEQ ID NO: 1733241 - RNA, 23 nt, Homo sapiens
uauaagugaagugauacuaucca

SEQ ID NO: 1733242 - RNA, 23 nt, Homo sapiens
uaucucaggggccaacuaggcag

SEQ ID NO: 1733243 - RNA, 17 nt, Homo sapiens
uaugauuccaccuacau

SEQ ID NO: 1733244 - RNA, 15 nt, Homo sapiens
uaugcuaagugaaau

SEQ ID NO: 1733245 - RNA, 21 nt, Homo sapiens
uauguaaauagaaacguguau

SEQ ID NO: 1733246 - RNA, 14 nt, Homo sapiens
uaugugauguggca

SEQ ID NO: 1733247 - RNA, 21 nt, Homo sapiens
uauuuacugagcuucucugug

SEQ ID NO: 1733248 - RNA, 15 nt, Homo sapiens
uauuuauugcugaau

SEQ ID NO: 1733249 - RNA, 13 nt, Homo sapiens
uauuuauuuacug

SEQ ID NO: 1733250 - RNA, 15 nt, Homo sapiens
uauuucacuugauga

SEQ ID NO: 1733251 - RNA, 14 nt, Homo sapiens
uauuuuuaugugca

SEQ ID NO: 1733252 - RNA, 21 nt, Homo sapiens
ucaauuuaaaaaaaaaccuga

SEQ ID NO: 1733253 - RNA, 14 nt, Homo sapiens
ucaccuuccagugu

SEQ ID NO: 1733254 - RNA, 15 nt, Homo sapiens
ucagggagcauuuau

SEQ ID NO: 1733255 - RNA, 15 nt, Homo sapiens
ucaucaaugaaugaa

SEQ ID NO: 1733256 - RNA, 17 nt, Homo sapiens
uccaaauauuguugaca

SEQ ID NO: 1733257 - RNA, 18 nt, Homo sapiens
uccaagccucauguccac

SEQ ID NO: 1733258 - RNA, 21 nt, Homo sapiens
ucccaaagugcugggaauuac

SEQ ID NO: 1733259 - RNA, 19 nt, Homo sapiens
ucccucuaauuuaucuugu

SEQ ID NO: 1733260 - RNA, 15 nt, Homo sapiens
uccgaagucuuccau

SEQ ID NO: 1733261 - RNA, 21 nt, Homo sapiens
uccuagcgcagccaugugauu

SEQ ID NO: 1733262 - RNA, 22 nt, Homo sapiens
uccuagcgcagccaugugauua

SEQ ID NO: 1733263 - RNA, 23 nt, Homo sapiens
uccuagcgcagccaugugauuac

SEQ ID NO: 1733264 - RNA, 13 nt, Homo sapiens
uccuucagccuga

SEQ ID NO: 1733265 - RNA, 15 nt, Homo sapiens
ucucacaagcacuuu

SEQ ID NO: 1733266 - RNA, 20 nt, Homo sapiens
ucucaggggccaacuaggca

SEQ ID NO: 1733267 - RNA, 20 nt, Homo sapiens
ucucuacuaaaaauacaaaa

SEQ ID NO: 1733268 - RNA, 15 nt, Homo sapiens
ucucugccuugguau

SEQ ID NO: 1733269 - RNA, 18 nt, Homo sapiens
ucugccuugguauagcau

SEQ ID NO: 1733270 - RNA, 16 nt, Homo sapiens
ucugcuuuaauuucau

SEQ ID NO: 1733271 - RNA, 17 nt, Homo sapiens
ucuuggucucaguguca

SEQ ID NO: 1733272 - RNA, 21 nt, Homo sapiens
ucuuuuuagagaaauuugcca

SEQ ID NO: 1733273 - RNA, 22 nt, Homo sapiens
ugaaaaaaaauuuuauaguguc

SEQ ID NO: 1733274 - RNA, 21 nt, Homo sapiens
ugaaaaucuacacuccaguga

SEQ ID NO: 1733275 - RNA, 18 nt, Homo sapiens
ugaaagcagggacuugaa

SEQ ID NO: 1733276 - RNA, 19 nt, Homo sapiens
ugaaagcagggacuugaac

SEQ ID NO: 1733277 - RNA, 13 nt, Homo sapiens
ugaaauagugucu

SEQ ID NO: 1733278 - RNA, 22 nt, Homo sapiens
ugaauaaaguguaaguucacaa

SEQ ID NO: 1733279 - RNA, 15 nt, Homo sapiens
ugacccugaugaaaa

SEQ ID NO: 1733280 - RNA, 18 nt, Homo sapiens
ugacuuaguguacaugaa

SEQ ID NO: 1733281 - RNA, 20 nt, Homo sapiens
ugagagcccuucaugcauuu

SEQ ID NO: 1733282 - RNA, 23 nt, Homo sapiens
ugagaugggagaaucacuugaac

SEQ ID NO: 1733283 - RNA, 17 nt, Homo sapiens
ugaggaauauuugcaag

SEQ ID NO: 1733284 - RNA, 21 nt, Homo sapiens
ugaggcggguggaucacuuga

SEQ ID NO: 1733285 - RNA, 19 nt, Homo sapiens
ugagugccuguaaucacag

SEQ ID NO: 1733286 - RNA, 17 nt, Homo sapiens
ugauuacaaggcuuuau

SEQ ID NO: 1733287 - RNA, 13 nt, Homo sapiens
ugcauuugcacua

SEQ ID NO: 1733288 - RNA, 16 nt, Homo sapiens
ugccccagggaccuuu

SEQ ID NO: 1733289 - RNA, 22 nt, Homo sapiens
ugccuggaucucacaagcacuu

SEQ ID NO: 1733290 - RNA, 18 nt, Homo sapiens
ugccuugguauagcauau

SEQ ID NO: 1733291 - RNA, 20 nt, Homo sapiens
ugcuacaaauacucuuagga

SEQ ID NO: 1733292 - RNA, 13 nt, Homo sapiens
ugcugggaauuac

SEQ ID NO: 1733293 - RNA, 16 nt, Homo sapiens
uggaacucaaggaaau

SEQ ID NO: 1733294 - RNA, 18 nt, Homo sapiens
uggaauauguaaauagaa

SEQ ID NO: 1733295 - RNA, 19 nt, Homo sapiens
uggagcuugaaauaguguc

SEQ ID NO: 1733296 - RNA, 13 nt, Homo sapiens
uggauucaaguga

SEQ ID NO: 1733297 - RNA, 15 nt, Homo sapiens
uggauucaagugauc

SEQ ID NO: 1733298 - RNA, 16 nt, Homo sapiens
uggcacuugggacaaa

SEQ ID NO: 1733299 - RNA, 21 nt, Homo sapiens
uggcuaagcaaaaugugauau

SEQ ID NO: 1733300 - RNA, 18 nt, Homo sapiens
ugggagaaucacuugaac

SEQ ID NO: 1733301 - RNA, 12 nt, Homo sapiens
uggucucagugu

SEQ ID NO: 1733302 - RNA, 16 nt, Homo sapiens
uguaaaauggagacac

SEQ ID NO: 1733303 - RNA, 17 nt, Homo sapiens
uguaaguuuaugcauac

SEQ ID NO: 1733304 - RNA, 21 nt, Homo sapiens
uguauauuuuauaucaauuua

SEQ ID NO: 1733305 - RNA, 13 nt, Homo sapiens
ugugacuuuccua

SEQ ID NO: 1733306 - RNA, 16 nt, Homo sapiens
uguguggcauuuucac

SEQ ID NO: 1733307 - RNA, 18 nt, Homo sapiens
uguucacuuauugacuau

SEQ ID NO: 1733308 - RNA, 18 nt, Homo sapiens
uguuggaaaaugugcaau

SEQ ID NO: 1733309 - RNA, 19 nt, Homo sapiens
uguuggaaaaugugcaaua

SEQ ID NO: 1733310 - RNA, 13 nt, Homo sapiens
uguuuuuaagcug

SEQ ID NO: 1733311 - RNA, 23 nt, Homo sapiens
uuaaaauauuuuuaugugcaaua

SEQ ID NO: 1733312 - RNA, 19 nt, Homo sapiens
uuaaaauuaucaauaucua

SEQ ID NO: 1733313 - RNA, 22 nt, Homo sapiens
uuaauaaaccauuuuuacuugg

SEQ ID NO: 1733314 - RNA, 11 nt, Homo sapiens
uuaaucaccaa

SEQ ID NO: 1733315 - RNA, 18 nt, Homo sapiens
uuacagagaaaagacaua

SEQ ID NO: 1733316 - RNA, 12 nt, Homo sapiens
uuacgugcaaua

SEQ ID NO: 1733317 - RNA, 21 nt, Homo sapiens
uuacuauuuauugcugaauga

SEQ ID NO: 1733318 - RNA, 23 nt, Homo sapiens
uuacuauuuauugcugaaugacu

SEQ ID NO: 1733319 - RNA, 20 nt, Homo sapiens
uuacugagcuucucugugaa

SEQ ID NO: 1733320 - RNA, 14 nt, Homo sapiens
uuaguguacaugaa

SEQ ID NO: 1733321 - RNA, 12 nt, Homo sapiens
uuauaaucuuuu

SEQ ID NO: 1733322 - RNA, 11 nt, Homo sapiens
uuaugugcaau

SEQ ID NO: 1733323 - RNA, 12 nt, Homo sapiens
uuaugugcaaua

SEQ ID NO: 1733324 - RNA, 15 nt, Homo sapiens
uuauuaccucugaua

SEQ ID NO: 1733325 - RNA, 21 nt, Homo sapiens
uuauuaccucugauaccucaa

SEQ ID NO: 1733326 - RNA, 13 nt, Homo sapiens
cauagagacuuug

SEQ ID NO: 1733327 - RNA, 18 nt, Homo sapiens
cauagcagcuuauucaca

SEQ ID NO: 1733328 - RNA, 20 nt, Homo sapiens
cauauguuuuuguaaguuua

SEQ ID NO: 1733329 - RNA, 19 nt, Homo sapiens
caugugauuacccucuggg

SEQ ID NO: 1733330 - RNA, 21 nt, Homo sapiens
ccaaaagguauuuuaaucacc

SEQ ID NO: 1733331 - RNA, 12 nt, Homo sapiens
ccaaacuggagc

SEQ ID NO: 1733332 - RNA, 21 nt, Homo sapiens
ccaacagaagcuuccauucca

SEQ ID NO: 1733333 - RNA, 18 nt, Homo sapiens
ccaagaaugagaagaaug

SEQ ID NO: 1733334 - RNA, 14 nt, Homo sapiens
ccaauuuacuuugu

SEQ ID NO: 1733335 - RNA, 16 nt, Homo sapiens
ccacgcccagcuaauu

SEQ ID NO: 1733336 - RNA, 21 nt, Homo sapiens
ccucaguuuccugaccuauga

SEQ ID NO: 1733337 - RNA, 20 nt, Homo sapiens
ccuccaccuucuggguucaa

SEQ ID NO: 1733338 - RNA, 16 nt, Homo sapiens
ccucucuuauagaaua

SEQ ID NO: 1733339 - RNA, 18 nt, Homo sapiens
ccugaugaaaacauagca

SEQ ID NO: 1733340 - RNA, 19 nt, Homo sapiens
ccugcaggcgugaccugac

SEQ ID NO: 1733341 - RNA, 17 nt, Homo sapiens
ccuggacaguuuucugc

SEQ ID NO: 1733342 - RNA, 18 nt, Homo sapiens
ccuuuggaugcacuuuau

SEQ ID NO: 1733343 - RNA, 14 nt, Homo sapiens
cgcagccaugugau

SEQ ID NO: 1733344 - RNA, 21 nt, Homo sapiens
cggaucuggggcucugggaua

SEQ ID NO: 1733345 - RNA, 14 nt, Homo sapiens
cgggguuugccaug

SEQ ID NO: 1733346 - RNA, 20 nt, Homo sapiens
cgguuugaaaauaugccugc

SEQ ID NO: 1733347 - RNA, 15 nt, Homo sapiens
cuaaauuugguucua

SEQ ID NO: 1733348 - RNA, 13 nt, Homo sapiens
cuaauuaggcaag

SEQ ID NO: 1733349 - RNA, 20 nt, Homo sapiens
cuacuugggaggcugaggca

SEQ ID NO: 1733350 - RNA, 15 nt, Homo sapiens
cuauauccugugacu

SEQ ID NO: 1733351 - RNA, 16 nt, Homo sapiens
cuauuacgugcaauac

SEQ ID NO: 1733352 - RNA, 20 nt, Homo sapiens
cucaggggccaacuaggcag

SEQ ID NO: 1733353 - RNA, 18 nt, Homo sapiens
cucauuccccaaccacuu

SEQ ID NO: 1733354 - RNA, 21 nt, Homo sapiens
cucugcccauccugccccuga

SEQ ID NO: 1733355 - RNA, 14 nt, Homo sapiens
cucuucacagucac

SEQ ID NO: 1733356 - RNA, 12 nt, Homo sapiens
cugauaccucaa

SEQ ID NO: 1733357 - RNA, 21 nt, Homo sapiens
cugcaaucugagccagugcuu

SEQ ID NO: 1733358 - RNA, 22 nt, Homo sapiens
cugccuaagugcagccccgugg

SEQ ID NO: 1733359 - RNA, 20 nt, Homo sapiens
cuggagugcaguggcgcaau

SEQ ID NO: 1733360 - RNA, 20 nt, Homo sapiens
cuggaucucacaagcacuuu

SEQ ID NO: 1733361 - RNA, 21 nt, Homo sapiens
cuggauguggagggggcgcgu

SEQ ID NO: 1733362 - RNA, 21 nt, Homo sapiens
cuguaaucccagcuacuuggg

SEQ ID NO: 1733363 - RNA, 16 nt, Homo sapiens
cuuauaggaauugacc

SEQ ID NO: 1733364 - RNA, 14 nt, Homo sapiens
cuuauuguaccucu

SEQ ID NO: 1733365 - RNA, 16 nt, Homo sapiens
cuuccucagcuguaga

SEQ ID NO: 1733366 - RNA, 17 nt, Homo sapiens
cuucucuucacagucac

SEQ ID NO: 1733367 - RNA, 19 nt, Homo sapiens
cuucuuggucucaguguca

SEQ ID NO: 1733368 - RNA, 21 nt, Homo sapiens
cuugaaauagugucugaugaa

SEQ ID NO: 1733369 - RNA, 21 nt, Homo sapiens
cuugagaaaccuuauuguacc

SEQ ID NO: 1733370 - RNA, 15 nt, Homo sapiens
cuugggcgggacaca

SEQ ID NO: 1733371 - RNA, 18 nt, Homo sapiens
cuuuaacacagugucugg

SEQ ID NO: 1733372 - RNA, 11 nt, Homo sapiens
cuuuaucucag

SEQ ID NO: 1733373 - RNA, 15 nt, Homo sapiens
cuuugaagucugauu

SEQ ID NO: 1733374 - RNA, 15 nt, Homo sapiens
cuuuuauugccauga

SEQ ID NO: 1733375 - RNA, 11 nt, Homo sapiens
cuuuucucugc

SEQ ID NO: 1733376 - RNA, 22 nt, Homo sapiens
cuuuuggcuuguaaaguacaga

SEQ ID NO: 1733377 - RNA, 19 nt, Homo sapiens
gaaaaucugcacugugggc

SEQ ID NO: 1733378 - RNA, 22 nt, Homo sapiens
gaaagaaaaucaggcuggccaa

SEQ ID NO: 1733379 - RNA, 17 nt, Homo sapiens
gaaagcagggacuugaa

SEQ ID NO: 1733380 - RNA, 18 nt, Homo sapiens
gaaagcagggacuugaac

SEQ ID NO: 1733381 - RNA, 23 nt, Homo sapiens
gaaagcuugcccuggugccucac

SEQ ID NO: 1733382 - RNA, 14 nt, Homo sapiens
gaaauagugucuga

SEQ ID NO: 1733383 - RNA, 17 nt, Homo sapiens
gaaauagugucugauga

SEQ ID NO: 1733384 - RNA, 20 nt, Homo sapiens
gaaguugcagugagcugaua

SEQ ID NO: 1733385 - RNA, 18 nt, Homo sapiens
gaauauuuauuaccucug

SEQ ID NO: 1733386 - RNA, 17 nt, Homo sapiens
gaaugagaagaaugacu

SEQ ID NO: 1733387 - RNA, 15 nt, Homo sapiens
gaauuaacacaugau

SEQ ID NO: 1733388 - RNA, 16 nt, Homo sapiens
gaauuaacacaugauc

SEQ ID NO: 1733389 - RNA, 16 nt, Homo sapiens
gacaacugugacugua

SEQ ID NO: 1733390 - RNA, 22 nt, Homo sapiens
gaccaauaaccaugcccaagaa

SEQ ID NO: 1733391 - RNA, 21 nt, Homo sapiens
gaccacgcuuucuagcuguug

SEQ ID NO: 1733392 - RNA, 20 nt, Homo sapiens
gagauggaaguugcagugag

SEQ ID NO: 1733393 - RNA, 21 nt, Homo sapiens
gagccaccaaacccggccuga

SEQ ID NO: 1733394 - RNA, 15 nt, Homo sapiens
gaggagaaacuggaa

SEQ ID NO: 1733395 - RNA, 16 nt, Homo sapiens
gaggagaaacuggaac

SEQ ID NO: 1733396 - RNA, 23 nt, Homo sapiens
gaggauguguggcauuuucacuu

SEQ ID NO: 1733397 - RNA, 17 nt, Homo sapiens
gagguacugagagugaa

SEQ ID NO: 1733398 - RNA, 20 nt, Homo sapiens
gagugacuuaguguacauga

SEQ ID NO: 1733399 - RNA, 14 nt, Homo sapiens
gaguuuggccagaa

SEQ ID NO: 1733400 - RNA, 22 nt, Homo sapiens
gauagagugggacaguuccuga

SEQ ID NO: 1733401 - RNA, 17 nt, Homo sapiens
gaucucacaagcacuuu

SEQ ID NO: 1733402 - RNA, 14 nt, Homo sapiens
gauuucaugccugg

SEQ ID NO: 1733403 - RNA, 11 nt, Homo sapiens
gcaacccaaau

SEQ ID NO: 1733404 - RNA, 19 nt, Homo sapiens
gcaaccuuuggaugcacuu

SEQ ID NO: 1733405 - RNA, 14 nt, Homo sapiens
gcaccaacuuugaa

SEQ ID NO: 1733406 - RNA, 14 nt, Homo sapiens
gcagaagacaguau

SEQ ID NO: 1733407 - RNA, 17 nt, Homo sapiens
gcagaagcaacccaaau

SEQ ID NO: 1733408 - RNA, 15 nt, Homo sapiens
gcaggcgugaccuga

SEQ ID NO: 1733409 - RNA, 17 nt, Homo sapiens
gcauuguaacuuaugaa

SEQ ID NO: 1733410 - RNA, 15 nt, Homo sapiens
gcauuuucacuuuug

SEQ ID NO: 1733411 - RNA, 17 nt, Homo sapiens
gccagacaucaacagau

SEQ ID NO: 1733412 - RNA, 20 nt, Homo sapiens
gcccaucuccgucucccaaa

SEQ ID NO: 1733413 - RNA, 21 nt, Homo sapiens
gccuggaucucacaagcacuu

SEQ ID NO: 1733414 - RNA, 15 nt, Homo sapiens
gcgugagccaccaaa

SEQ ID NO: 1733415 - RNA, 13 nt, Homo sapiens
gcgugcaggcagc

SEQ ID NO: 1733416 - RNA, 20 nt, Homo sapiens
gcuggucucgaacugcugga

SEQ ID NO: 1733417 - RNA, 21 nt, Homo sapiens
gcuuauucacaagacccaaaa

SEQ ID NO: 1733418 - RNA, 12 nt, Homo sapiens
gcuuccuaacug

SEQ ID NO: 1733419 - RNA, 22 nt, Homo sapiens
gcuugaaauagugucugaugaa

SEQ ID NO: 1733420 - RNA, 24 nt, Homo sapiens
ggacuugggcgggacacaggcucc

SEQ ID NO: 1733421 - RNA, 15 nt, Homo sapiens
ggagaaucacuugaa

SEQ ID NO: 1733422 - RNA, 16 nt, Homo sapiens
ggagaaucacuugaac

SEQ ID NO: 1733423 - RNA, 21 nt, Homo sapiens
ggagcuugaaauagugucuga

SEQ ID NO: 1733424 - RNA, 22 nt, Homo sapiens
ggcagcaggauagagugggaca

SEQ ID NO: 1733425 - RNA, 15 nt, Homo sapiens
ggcugggaguggcau

SEQ ID NO: 1733426 - RNA, 17 nt, Homo sapiens
uuugcagcugugccaua

SEQ ID NO: 1733427 - RNA, 10 nt, Homo sapiens
uuugccaugc

SEQ ID NO: 1733428 - RNA, 18 nt, Homo sapiens
uuuuaugaaacauuacag

SEQ ID NO: 1733429 - RNA, 16 nt, Homo sapiens
uuuuuaugugcaauaa

SEQ ID NO: 1733430 - RNA, 18 nt, Homo sapiens
aauuaauggaauauguaa

SEQ ID NO: 1733431 - RNA, 13 nt, Homo sapiens
aauuccucuggga

SEQ ID NO: 1733432 - RNA, 19 nt, Homo sapiens
aauucuauuacgugcaaua

SEQ ID NO: 1733433 - RNA, 15 nt, Homo sapiens
aauucugcaagcuuu

SEQ ID NO: 1733434 - RNA, 14 nt, Homo sapiens
aauugacacuuaaa

SEQ ID NO: 1733435 - RNA, 12 nt, Homo sapiens
aauuuacuuugu

SEQ ID NO: 1733436 - RNA, 20 nt, Homo sapiens
aauuuaucuugucucugggc

SEQ ID NO: 1733437 - RNA, 12 nt, Homo sapiens
acaacugugacu

SEQ ID NO: 1733438 - RNA, 18 nt, Homo sapiens
acaaggcuuuaucucagg

SEQ ID NO: 1733439 - RNA, 16 nt, Homo sapiens
acagagaaaagacaua

SEQ ID NO: 1733440 - RNA, 20 nt, Homo sapiens
acagagcaagacucugucuc

SEQ ID NO: 1733441 - RNA, 22 nt, Homo sapiens
acaguauggcagcuuuccucaa

SEQ ID NO: 1733442 - RNA, 19 nt, Homo sapiens
acagugagacucugucuca

SEQ ID NO: 1733443 - RNA, 13 nt, Homo sapiens
acauagcaucuca

SEQ ID NO: 1733444 - RNA, 14 nt, Homo sapiens
acaugauccugcaa

SEQ ID NO: 1733445 - RNA, 20 nt, Homo sapiens
acaugauccugcaauuccac

SEQ ID NO: 1733446 - RNA, 18 nt, Homo sapiens
accaccacccuugccaug

SEQ ID NO: 1733447 - RNA, 20 nt, Homo sapiens
accacugcagaagacaguau

SEQ ID NO: 1733448 - RNA, 19 nt, Homo sapiens
accuacaugagguacugag

SEQ ID NO: 1733449 - RNA, 15 nt, Homo sapiens
acgaaaaacauuuca

SEQ ID NO: 1733450 - RNA, 14 nt, Homo sapiens
acuuuaacacagug

SEQ ID NO: 1733451 - RNA, 17 nt, Homo sapiens
agaaaauaaaagcacuu

SEQ ID NO: 1733452 - RNA, 20 nt, Homo sapiens
agaaaccuuauuguaccucu

SEQ ID NO: 1733453 - RNA, 19 nt, Homo sapiens
agaaauuugccaauuuacu

SEQ ID NO: 1733454 - RNA, 13 nt, Homo sapiens
agaaucacuugaa

SEQ ID NO: 1733455 - RNA, 16 nt, Homo sapiens
agaaucacuugaaccc

SEQ ID NO: 1733456 - RNA, 13 nt, Homo sapiens
agaauggaacuca

SEQ ID NO: 1733457 - RNA, 21 nt, Homo sapiens
agaauuuauucaauuccucug

SEQ ID NO: 1733458 - RNA, 20 nt, Homo sapiens
agacaccaccacccuugcca

SEQ ID NO: 1733459 - RNA, 21 nt, Homo sapiens
agacccucaugcugccaauau

SEQ ID NO: 1733460 - RNA, 18 nt, Homo sapiens
agacgggguuugccaugc

SEQ ID NO: 1733461 - RNA, 22 nt, Homo sapiens
agacuaugaggaauauuugcaa

SEQ ID NO: 1733462 - RNA, 14 nt, Homo sapiens
agacucugucucag

SEQ ID NO: 1733463 - RNA, 20 nt, Homo sapiens
agagcaagacucugucucaa

SEQ ID NO: 1733464 - RNA, 23 nt, Homo sapiens
agagcccuucaugcauuugcacu

SEQ ID NO: 1733465 - RNA, 13 nt, Homo sapiens
agcaaaaugugau

SEQ ID NO: 1733466 - RNA, 14 nt, Homo sapiens
agcaaaaugugaua

SEQ ID NO: 1733467 - RNA, 21 nt, Homo sapiens
agcacuuuaacacagugucug

SEQ ID NO: 1733468 - RNA, 14 nt, Homo sapiens
agcagaacagugau

SEQ ID NO: 1733469 - RNA, 18 nt, Homo sapiens
agcaggauagagugggac

SEQ ID NO: 1733470 - RNA, 14 nt, Homo sapiens
agcagggacuugaa

SEQ ID NO: 1733471 - RNA, 15 nt, Homo sapiens
agcaucucaggagau

SEQ ID NO: 1733472 - RNA, 15 nt, Homo sapiens
agccaccaaacccgg

SEQ ID NO: 1733473 - RNA, 15 nt, Homo sapiens
agcccauggcacucu

SEQ ID NO: 1733474 - RNA, 16 nt, Homo sapiens
agcccauggcacucua

SEQ ID NO: 1733475 - RNA, 21 nt, Homo sapiens
agcccccauuguggucacagg

SEQ ID NO: 1733476 - RNA, 17 nt, Homo sapiens
agccccgggaguggcgc

SEQ ID NO: 1733477 - RNA, 20 nt, Homo sapiens
agcccuucaugcauuugcac

SEQ ID NO: 1733478 - RNA, 12 nt, Homo sapiens
agcgacagugag

SEQ ID NO: 1733479 - RNA, 20 nt, Homo sapiens
agcuacuugggaggcugaga

SEQ ID NO: 1733480 - RNA, 19 nt, Homo sapiens
agcuguggccagcuuguua

SEQ ID NO: 1733481 - RNA, 16 nt, Homo sapiens
agcuguuuucccugac

SEQ ID NO: 1733482 - RNA, 17 nt, Homo sapiens
aggaaaaucugcacugu

SEQ ID NO: 1733483 - RNA, 20 nt, Homo sapiens
aggaaauauucuguaaucuu

SEQ ID NO: 1733484 - RNA, 21 nt, Homo sapiens
aggaauauuugcaagacauag

SEQ ID NO: 1733485 - RNA, 16 nt, Homo sapiens
aggagauuucaugccu

SEQ ID NO: 1733486 - RNA, 19 nt, Homo sapiens
aggcaaggcuaugugauua

SEQ ID NO: 1733487 - RNA, 20 nt, Homo sapiens
aggccgggcgcgguggcuca

SEQ ID NO: 1733488 - RNA, 21 nt, Homo sapiens
agggucucccucuguugccaa

SEQ ID NO: 1733489 - RNA, 16 nt, Homo sapiens
aggugacccugaugaa

SEQ ID NO: 1733490 - RNA, 14 nt, Homo sapiens
aguacagacuuuuu

SEQ ID NO: 1733491 - RNA, 15 nt, Homo sapiens
aguguaaguucacaa

SEQ ID NO: 1733492 - RNA, 23 nt, Homo sapiens
aguguccucaucuguaaaaugga

SEQ ID NO: 1733493 - RNA, 16 nt, Homo sapiens
agugucugaugaaugu

SEQ ID NO: 1733494 - RNA, 20 nt, Homo sapiens
aguguuggaaaaugugcaau

SEQ ID NO: 1733495 - RNA, 21 nt, Homo sapiens
aguguuggaaaaugugcaaua

SEQ ID NO: 1733496 - RNA, 20 nt, Homo sapiens
aguuuucugcuuuaauuuca

SEQ ID NO: 1733497 - RNA, 13 nt, Homo sapiens
auaaaagcacuua

SEQ ID NO: 1733498 - RNA, 21 nt, Homo sapiens
auaaauaguuuaugauuccac

SEQ ID NO: 1733499 - RNA, 14 nt, Homo sapiens
auaaauggacaaau

SEQ ID NO: 1733500 - RNA, 14 nt, Homo sapiens
auaaauuugguucu

SEQ ID NO: 1733501 - RNA, 17 nt, Homo sapiens
auaagcaaagacuauga

SEQ ID NO: 1733502 - RNA, 21 nt, Homo sapiens
auaccucaacccccauuucua

SEQ ID NO: 1733503 - RNA, 17 nt, Homo sapiens
auagaauuaacacauga

SEQ ID NO: 1733504 - RNA, 10 nt, Homo sapiens
auagugucuu

SEQ ID NO: 1733505 - RNA, 18 nt, Homo sapiens
auaucuaauauauaugaa

SEQ ID NO: 1733506 - RNA, 19 nt, Homo sapiens
auauuuuuaugugcaauaa

SEQ ID NO: 1733507 - RNA, 22 nt, Homo sapiens
aucaauucuauuacgugcaaua

SEQ ID NO: 1733508 - RNA, 23 nt, Homo sapiens
aucggaucuggggcucugggaua

SEQ ID NO: 1733509 - RNA, 22 nt, Homo sapiens
augaaaacauagcaucucagga

SEQ ID NO: 1733510 - RNA, 14 nt, Homo sapiens
augaaaaugaauau

SEQ ID NO: 1733511 - RNA, 14 nt, Homo sapiens
augaaugaauggcu

SEQ ID NO: 1733512 - RNA, 18 nt, Homo sapiens
augcaaccuuuggaugca

SEQ ID NO: 1733513 - RNA, 22 nt, Homo sapiens
augcaaccuuuggaugcacuuu

SEQ ID NO: 1733514 - RNA, 24 nt, Homo sapiens
augcaaccuuuggaugcacuuuau

SEQ ID NO: 1733515 - RNA, 16 nt, Homo sapiens
augcauuugcacuauu

SEQ ID NO: 1733516 - RNA, 23 nt, Homo sapiens
auggaaguugcagugagcugaua

SEQ ID NO: 1733517 - RNA, 18 nt, Homo sapiens
auggcuaguaucaaaaga

SEQ ID NO: 1733518 - RNA, 20 nt, Homo sapiens
augugauuacccucuggguc

SEQ ID NO: 1733519 - RNA, 22 nt, Homo sapiens
augugucaggugacccugauga

SEQ ID NO: 1733520 - RNA, 16 nt, Homo sapiens
auguguggcauuuuca

SEQ ID NO: 1733521 - RNA, 12 nt, Homo sapiens
auuaauucaccu

SEQ ID NO: 1733522 - RNA, 19 nt, Homo sapiens
auuacaaggcuuuaucuca

SEQ ID NO: 1733523 - RNA, 21 nt, Homo sapiens
auuacaaggcuuuaucucagg

SEQ ID NO: 1733524 - RNA, 13 nt, Homo sapiens
auuauagaaugga

SEQ ID NO: 1733525 - RNA, 16 nt, Homo sapiens
auucacaagacccaaa

SEQ ID NO: 1733526 - RNA, 19 nt, Homo sapiens
auucacaagacccaaaagg

SEQ ID NO: 1733527 - RNA, 22 nt, Homo sapiens
auucaccuuccagugucucgga

SEQ ID NO: 1733528 - RNA, 17 nt, Homo sapiens
auucugcaagcuuuuca

SEQ ID NO: 1733529 - RNA, 12 nt, Homo sapiens
auugagcaccug

SEQ ID NO: 1733530 - RNA, 20 nt, Homo sapiens
auugugccccugcacuccag

SEQ ID NO: 1733531 - RNA, 18 nt, Homo sapiens
auuguugacaacugugac

SEQ ID NO: 1733532 - RNA, 17 nt, Homo sapiens
auuuauuaccucugaua

SEQ ID NO: 1733533 - RNA, 14 nt, Homo sapiens
auuuauugagcacc

SEQ ID NO: 1733534 - RNA, 18 nt, Homo sapiens
auuuauugagcaccugca

SEQ ID NO: 1733535 - RNA, 17 nt, Homo sapiens
auuuauuuuuuuacuuc

SEQ ID NO: 1733536 - RNA, 20 nt, Homo sapiens
auuuauuuuuuuacuuccuc

SEQ ID NO: 1733537 - RNA, 18 nt, Homo sapiens
auuuguuaaaauuaucaa

SEQ ID NO: 1733538 - RNA, 16 nt, Homo sapiens
auuuuaaguaauuuca

SEQ ID NO: 1733539 - RNA, 20 nt, Homo sapiens
auuuucacuuuuggcuugua

SEQ ID NO: 1733540 - RNA, 17 nt, Homo sapiens
auuuuuagacucaucaa

SEQ ID NO: 1733541 - RNA, 17 nt, Homo sapiens
caaauguucaucaauga

SEQ ID NO: 1733542 - RNA, 13 nt, Homo sapiens
caaccaaauggag

SEQ ID NO: 1733543 - RNA, 11 nt, Homo sapiens
caagaaugaga

SEQ ID NO: 1733544 - RNA, 19 nt, Homo sapiens
caagacucugucucaaaaa

SEQ ID NO: 1733545 - RNA, 23 nt, Homo sapiens
caauaucuaauauauaugaauaa

SEQ ID NO: 1733546 - RNA, 15 nt, Homo sapiens
caauuccucugggaa

SEQ ID NO: 1733547 - RNA, 21 nt, Homo sapiens
caauucuauuacgugcaauac

SEQ ID NO: 1733548 - RNA, 18 nt, Homo sapiens
cacaggcuccaaacugga

SEQ ID NO: 1733549 - RNA, 14 nt, Homo sapiens
cacccuugccaugg

SEQ ID NO: 1733550 - RNA, 22 nt, Homo sapiens
cacccuugccauggagguuaag

SEQ ID NO: 1733551 - RNA, 14 nt, Homo sapiens
caccuguaauccca

SEQ ID NO: 1733552 - RNA, 19 nt, Homo sapiens
cacuaaauugacacuuaaa

SEQ ID NO: 1733553 - RNA, 12 nt, Homo sapiens
cacuucacuuuu

SEQ ID NO: 1733554 - RNA, 21 nt, Homo sapiens
gcagugagcugauaucaugcc

SEQ ID NO: 1733555 - RNA, 23 nt, Homo sapiens
gccagugcuuuaauggcauguca

SEQ ID NO: 1733556 - RNA, 19 nt, Homo sapiens
gccauaauuacuaugucau

SEQ ID NO: 1733557 - RNA, 20 nt, Homo sapiens
gccauaauuacuaugucauu

SEQ ID NO: 1733558 - RNA, 17 nt, Homo sapiens
gccugcuggauguggag

SEQ ID NO: 1733559 - RNA, 22 nt, Homo sapiens
gccuggaucucacaagcacuuu

SEQ ID NO: 1733560 - RNA, 16 nt, Homo sapiens
gccuugguauagcaua

SEQ ID NO: 1733561 - RNA, 21 nt, Homo sapiens
gcgcaaucuuaacucauugca

SEQ ID NO: 1733562 - RNA, 13 nt, Homo sapiens
gcgcagccaugug

SEQ ID NO: 1733563 - RNA, 16 nt, Homo sapiens
gcgcagccaugugauu

SEQ ID NO: 1733564 - RNA, 20 nt, Homo sapiens
gcuaaguugcaccaacuuug

SEQ ID NO: 1733565 - RNA, 15 nt, Homo sapiens
gcuaauuuguguauu

SEQ ID NO: 1733566 - RNA, 17 nt, Homo sapiens
gcucugggauagcugac

SEQ ID NO: 1733567 - RNA, 14 nt, Homo sapiens
gcuggagugcagug

SEQ ID NO: 1733568 - RNA, 19 nt, Homo sapiens
gcuggagugcaguggcgca

SEQ ID NO: 1733569 - RNA, 20 nt, Homo sapiens
gcuguuuccauagggugaca

SEQ ID NO: 1733570 - RNA, 13 nt, Homo sapiens
gcuuuaauuucau

SEQ ID NO: 1733571 - RNA, 16 nt, Homo sapiens
gcuuuaauuucaugaa

SEQ ID NO: 1733572 - RNA, 22 nt, Homo sapiens
ggaaaaugugcaauaugugaug

SEQ ID NO: 1733573 - RNA, 22 nt, Homo sapiens
ggaauauuugcaagacauagaa

SEQ ID NO: 1733574 - RNA, 15 nt, Homo sapiens
ggaauuuucuuccaa

SEQ ID NO: 1733575 - RNA, 16 nt, Homo sapiens
ggacuuacuauuuauu

SEQ ID NO: 1733576 - RNA, 14 nt, Homo sapiens
ggacuugggcggga

SEQ ID NO: 1733577 - RNA, 14 nt, Homo sapiens
ggccaacuaggcag

SEQ ID NO: 1733578 - RNA, 20 nt, Homo sapiens
ggcuggagugcaguggcgca

SEQ ID NO: 1733579 - RNA, 15 nt, Homo sapiens
ggcuuuaucucaggg

SEQ ID NO: 1733580 - RNA, 14 nt, Homo sapiens
ggcuuuuauugcca

SEQ ID NO: 1733581 - RNA, 19 nt, Homo sapiens
gguaucaaccaaauggagu

SEQ ID NO: 1733582 - RNA, 20 nt, Homo sapiens
ggucaauuuuguuauguaua

SEQ ID NO: 1733583 - RNA, 17 nt, Homo sapiens
gguccgaagucuuccau

SEQ ID NO: 1733584 - RNA, 15 nt, Homo sapiens
gguggcgcgcaccug

SEQ ID NO: 1733585 - RNA, 16 nt, Homo sapiens
guaaaauggagacacc

SEQ ID NO: 1733586 - RNA, 21 nt, Homo sapiens
guaaguuuaugcauacaguaa

SEQ ID NO: 1733587 - RNA, 16 nt, Homo sapiens
guaaucccagcacuuu

SEQ ID NO: 1733588 - RNA, 20 nt, Homo sapiens
guaaucccagcuacuuggga

SEQ ID NO: 1733589 - RNA, 20 nt, Homo sapiens
guacuccagccugggugaca

SEQ ID NO: 1733590 - RNA, 16 nt, Homo sapiens
gucucaguccaugaag

SEQ ID NO: 1733591 - RNA, 14 nt, Homo sapiens
gucucccaaagugc

SEQ ID NO: 1733592 - RNA, 21 nt, Homo sapiens
gugaccugacagcccaagggu

SEQ ID NO: 1733593 - RNA, 18 nt, Homo sapiens
gugagacagcucugcaua

SEQ ID NO: 1733594 - RNA, 21 nt, Homo sapiens
gugauuacccucugggucuca

SEQ ID NO: 1733595 - RNA, 13 nt, Homo sapiens
gugcaauauguga

SEQ ID NO: 1733596 - RNA, 20 nt, Homo sapiens
gugucuggcacuugggacaa

SEQ ID NO: 1733597 - RNA, 21 nt, Homo sapiens
uaaaauggagacaccaccacc

SEQ ID NO: 1733598 - RNA, 16 nt, Homo sapiens
uaaaugauuucauuca

SEQ ID NO: 1733599 - RNA, 14 nt, Homo sapiens
uaaauguaucuuau

SEQ ID NO: 1733600 - RNA, 17 nt, Homo sapiens
uaaauuugguucuaggc

SEQ ID NO: 1733601 - RNA, 12 nt, Homo sapiens
uaacuagaauuu

SEQ ID NO: 1733602 - RNA, 21 nt, Homo sapiens
uaagcacuuuaacacaguguc

SEQ ID NO: 1733603 - RNA, 18 nt, Homo sapiens
uaagugaagugauacuau

SEQ ID NO: 1733604 - RNA, 18 nt, Homo sapiens
uaaguugcaccaacuuug

SEQ ID NO: 1733605 - RNA, 15 nt, Homo sapiens
uaaugaaaaugaaua

SEQ ID NO: 1733606 - RNA, 20 nt, Homo sapiens
uaaugaaaaugaauaucuau

SEQ ID NO: 1733607 - RNA, 22 nt, Homo sapiens
uaauggaauauguaaauagaaa

SEQ ID NO: 1733608 - RNA, 15 nt, Homo sapiens
uaauucaaacuaaua

SEQ ID NO: 1733609 - RNA, 23 nt, Homo sapiens
uagaauauuuauuaccucugaua

SEQ ID NO: 1733610 - RNA, 16 nt, Homo sapiens
uagaauuaacacauga

SEQ ID NO: 1733611 - RNA, 12 nt, Homo sapiens
uagcaucucagg

SEQ ID NO: 1733612 - RNA, 15 nt, Homo sapiens
uagccacuucacuuu

SEQ ID NO: 1733613 - RNA, 19 nt, Homo sapiens
uaguguuggaaaaugugca

SEQ ID NO: 1733614 - RNA, 21 nt, Homo sapiens
uaguguuggaaaaugugcaau

SEQ ID NO: 1733615 - RNA, 23 nt, Homo sapiens
uaguguuggaaaaugugcaauau

SEQ ID NO: 1733616 - RNA, 19 nt, Homo sapiens
uaguuguaccgcaauguga

SEQ ID NO: 1733617 - RNA, 20 nt, Homo sapiens
uaguuucccuugcaugguuu

SEQ ID NO: 1733618 - RNA, 17 nt, Homo sapiens
uauagaauggaacucaa

SEQ ID NO: 1733619 - RNA, 12 nt, Homo sapiens
uauauccuguga

SEQ ID NO: 1733620 - RNA, 22 nt, Homo sapiens
uaucucaggggccaacuaggca

SEQ ID NO: 1733621 - RNA, 16 nt, Homo sapiens
aagcagaacagugauu

SEQ ID NO: 1733622 - RNA, 17 nt, Homo sapiens
aagcagaacagugauua

SEQ ID NO: 1733623 - RNA, 23 nt, Homo sapiens
aaggcuuagacccucaugcugcc

SEQ ID NO: 1733624 - RNA, 17 nt, Homo sapiens
aaggcuuuaucucaggg

SEQ ID NO: 1733625 - RNA, 19 nt, Homo sapiens
aagguauuuuaaucaccaa

SEQ ID NO: 1733626 - RNA, 12 nt, Homo sapiens
aaguacucauac

SEQ ID NO: 1733627 - RNA, 19 nt, Homo sapiens
aaguauccuucagccugaa

SEQ ID NO: 1733628 - RNA, 23 nt, Homo sapiens
aagucuuccauagagacuuugug

SEQ ID NO: 1733629 - RNA, 17 nt, Homo sapiens
aagugaaauaagccaga

SEQ ID NO: 1733630 - RNA, 14 nt, Homo sapiens
aaugaaguacucau

SEQ ID NO: 1733631 - RNA, 17 nt, Homo sapiens
aaugaaugaauggcuaa

SEQ ID NO: 1733632 - RNA, 21 nt, Homo sapiens
aaugagaagaaugacuaugca

SEQ ID NO: 1733633 - RNA, 23 nt, Homo sapiens
aaugugucaggugacccugauga

SEQ ID NO: 1733634 - RNA, 13 nt, Homo sapiens
aauuuucuuccaa

SEQ ID NO: 1733635 - RNA, 13 nt, Homo sapiens
acaacugugacug

SEQ ID NO: 1733636 - RNA, 13 nt, Homo sapiens
acagaacuaugga

SEQ ID NO: 1733637 - RNA, 20 nt, Homo sapiens
acagcuacuugggaggcuga

SEQ ID NO: 1733638 - RNA, 15 nt, Homo sapiens
acaggcgugagccac

SEQ ID NO: 1733639 - RNA, 15 nt, Homo sapiens
acagucacauuccaa

SEQ ID NO: 1733640 - RNA, 15 nt, Homo sapiens
acaguuccugagacc

SEQ ID NO: 1733641 - RNA, 22 nt, Homo sapiens
acaguuuucugcuuuaauuuca

SEQ ID NO: 1733642 - RNA, 19 nt, Homo sapiens
acauccagauagguuacca

SEQ ID NO: 1733643 - RNA, 22 nt, Homo sapiens
accagccuggucaacaugguga

SEQ ID NO: 1733644 - RNA, 17 nt, Homo sapiens
acccaaauguucaucaa

SEQ ID NO: 1733645 - RNA, 16 nt, Homo sapiens
accuaaauuugguucu

SEQ ID NO: 1733646 - RNA, 19 nt, Homo sapiens
accuguuuuuaagcuguuu

SEQ ID NO: 1733647 - RNA, 17 nt, Homo sapiens
accuuauuguaccucuc

SEQ ID NO: 1733648 - RNA, 20 nt, Homo sapiens
acgugacuggccugcuggau

SEQ ID NO: 1733649 - RNA, 20 nt, Homo sapiens
acuaauagaauuaauggaau

SEQ ID NO: 1733650 - RNA, 14 nt, Homo sapiens
acuaauuaggcaag

SEQ ID NO: 1733651 - RNA, 23 nt, Homo sapiens
acuaauuaggcaaggcuauguga

SEQ ID NO: 1733652 - RNA, 23 nt, Homo sapiens
acuccagccugagcgacagugag

SEQ ID NO: 1733653 - RNA, 12 nt, Homo sapiens
acugugacugua

SEQ ID NO: 1733654 - RNA, 18 nt, Homo sapiens
acuuaaaaucuaauucaa

SEQ ID NO: 1733655 - RNA, 15 nt, Homo sapiens
acuugaugauacaau

SEQ ID NO: 1733656 - RNA, 18 nt, Homo sapiens
acuugaugauacaaugaa

SEQ ID NO: 1733657 - RNA, 21 nt, Homo sapiens
agaaaccuuauuguaccucuc

SEQ ID NO: 1733658 - RNA, 16 nt, Homo sapiens
agaagaaugacuaugc

SEQ ID NO: 1733659 - RNA, 19 nt, Homo sapiens
agaauauuuauuaccucug

SEQ ID NO: 1733660 - RNA, 14 nt, Homo sapiens
agaaucacuugaac

SEQ ID NO: 1733661 - RNA, 14 nt, Homo sapiens
agacagaaagcaga

SEQ ID NO: 1733662 - RNA, 22 nt, Homo sapiens
agacagaaagcagaacagugau

SEQ ID NO: 1733663 - RNA, 15 nt, Homo sapiens
agacaucaacagaua

SEQ ID NO: 1733664 - RNA, 15 nt, Homo sapiens
agacgggguuugcca

SEQ ID NO: 1733665 - RNA, 15 nt, Homo sapiens
agagaaaagacauaa

SEQ ID NO: 1733666 - RNA, 19 nt, Homo sapiens
agagcaagacucugucuca

SEQ ID NO: 1733667 - RNA, 22 nt, Homo sapiens
agagcccuucaugcauuugcac

SEQ ID NO: 1733668 - RNA, 21 nt, Homo sapiens
agaggaaugaaguacucauac

SEQ ID NO: 1733669 - RNA, 13 nt, Homo sapiens
agauaaacaguag

SEQ ID NO: 1733670 - RNA, 13 nt, Homo sapiens
agauuaugaucuc

SEQ ID NO: 1733671 - RNA, 18 nt, Homo sapiens
agcaacccaaauguucau

SEQ ID NO: 1733672 - RNA, 22 nt, Homo sapiens
agcacuuucccucuuggugccu

SEQ ID NO: 1733673 - RNA, 15 nt, Homo sapiens
agcagaacagugauu

SEQ ID NO: 1733674 - RNA, 22 nt, Homo sapiens
agcagagacgggguuugccaug

SEQ ID NO: 1733675 - RNA, 15 nt, Homo sapiens
agcagggacuugaac

SEQ ID NO: 1733676 - RNA, 15 nt, Homo sapiens
agcaugggaagugac

SEQ ID NO: 1733677 - RNA, 22 nt, Homo sapiens
agcuugaaauagugucugauga

SEQ ID NO: 1733678 - RNA, 20 nt, Homo sapiens
aggagauggaaguugcagug

SEQ ID NO: 1733679 - RNA, 17 nt, Homo sapiens
aggauagagugggacag

SEQ ID NO: 1733680 - RNA, 22 nt, Homo sapiens
aggcagcaggauagagugggac

SEQ ID NO: 1733681 - RNA, 20 nt, Homo sapiens
aggcggguggaucacuugag

SEQ ID NO: 1733682 - RNA, 17 nt, Homo sapiens
aggcuagaaccaccugc

SEQ ID NO: 1733683 - RNA, 10 nt, Homo sapiens
aggcugcaaa

SEQ ID NO: 1733684 - RNA, 16 nt, Homo sapiens
aggcuuuaucucaggg

SEQ ID NO: 1733685 - RNA, 16 nt, Homo sapiens
agggauuccccuaacc

SEQ ID NO: 1733686 - RNA, 18 nt, Homo sapiens
agguacugagagugaaca

SEQ ID NO: 1733687 - RNA, 18 nt, Homo sapiens
aggugagcaggugaugcc

SEQ ID NO: 1733688 - RNA, 13 nt, Homo sapiens
agguuaagcacuu

SEQ ID NO: 1733689 - RNA, 17 nt, Homo sapiens
aguaacggaacaguauc

SEQ ID NO: 1733690 - RNA, 17 nt, Homo sapiens
aguacucauacauguua

SEQ ID NO: 1733691 - RNA, 18 nt, Homo sapiens
aguagauaugaggcauuu

SEQ ID NO: 1733692 - RNA, 20 nt, Homo sapiens
agugaacaaauuuacagaga

SEQ ID NO: 1733693 - RNA, 17 nt, Homo sapiens
uuauuuuuuuacuuccu

SEQ ID NO: 1733694 - RNA, 18 nt, Homo sapiens
uucaaacuaauagaauua

SEQ ID NO: 1733695 - RNA, 14 nt, Homo sapiens
uucacuuauugacu

SEQ ID NO: 1733696 - RNA, 16 nt, Homo sapiens
uucagccugaaagagg

SEQ ID NO: 1733697 - RNA, 21 nt, Homo sapiens
uucaugaaaagauuaugaucu

SEQ ID NO: 1733698 - RNA, 17 nt, Homo sapiens
uuccucaaaacuucaga

SEQ ID NO: 1733699 - RNA, 15 nt, Homo sapiens
uuccuggacaguuuu

SEQ ID NO: 1733700 - RNA, 22 nt, Homo sapiens
uucucuucacagucacauucca

SEQ ID NO: 1733701 - RNA, 21 nt, Homo sapiens
uucuucuuggucucaguguca

SEQ ID NO: 1733702 - RNA, 14 nt, Homo sapiens
uugaaauagugucu

SEQ ID NO: 1733703 - RNA, 20 nt, Homo sapiens
uugaaauagugucugaugaa

SEQ ID NO: 1733704 - RNA, 19 nt, Homo sapiens
uugaaucccuuaaacucag

SEQ ID NO: 1733705 - RNA, 20 nt, Homo sapiens
uugacacuuaaaaaugguuu

SEQ ID NO: 1733706 - RNA, 15 nt, Homo sapiens
uugcaagacauagaa

SEQ ID NO: 1733707 - RNA, 15 nt, Homo sapiens
uugcaccaacuuuga

SEQ ID NO: 1733708 - RNA, 16 nt, Homo sapiens
uuggaugcacuuuaua

SEQ ID NO: 1733709 - RNA, 17 nt, Homo sapiens
uuguaacuuaugaaccu

SEQ ID NO: 1733710 - RNA, 17 nt, Homo sapiens
uuguaccgcaaugugac

SEQ ID NO: 1733711 - RNA, 21 nt, Homo sapiens
uuguguaaugaaaaugaauau

SEQ ID NO: 1733712 - RNA, 21 nt, Homo sapiens
uuguguguuuauuucacuuga

SEQ ID NO: 1733713 - RNA, 13 nt, Homo sapiens
uuuaugcauacag

SEQ ID NO: 1733714 - RNA, 11 nt, Homo sapiens
uuuaugugcaa

SEQ ID NO: 1733715 - RNA, 12 nt, Homo sapiens
uuucugcuuuaa

SEQ ID NO: 1733716 - RNA, 20 nt, Homo sapiens
uuugaugauuaauucaccuu

SEQ ID NO: 1733717 - RNA, 17 nt, Homo sapiens
cacuuuaacacaguguc

SEQ ID NO: 1733718 - RNA, 15 nt, Homo sapiens
cagaaauuguaucuu

SEQ ID NO: 1733719 - RNA, 20 nt, Homo sapiens
cagagcaagacucugucuca

SEQ ID NO: 1733720 - RNA, 19 nt, Homo sapiens
cagccugggugacagagca

SEQ ID NO: 1733721 - RNA, 21 nt, Homo sapiens
cagccuggucaacauggugaa

SEQ ID NO: 1733722 - RNA, 22 nt, Homo sapiens
caggauagagugggacaguucc

SEQ ID NO: 1733723 - RNA, 15 nt, Homo sapiens
caggcuccaaacugg

SEQ ID NO: 1733724 - RNA, 14 nt, Homo sapiens
cagucacauuccaa

SEQ ID NO: 1733725 - RNA, 17 nt, Homo sapiens
cagucacauuccaagcc

SEQ ID NO: 1733726 - RNA, 19 nt, Homo sapiens
cagugagccgagauugugc

SEQ ID NO: 1733727 - RNA, 13 nt, Homo sapiens
caugaaagcguaa

SEQ ID NO: 1733728 - RNA, 12 nt, Homo sapiens
cauuuucacuuu

SEQ ID NO: 1733729 - RNA, 14 nt, Homo sapiens
ccaaggcuggagug

SEQ ID NO: 1733730 - RNA, 18 nt, Homo sapiens
ccaaggcuggagugcagu

SEQ ID NO: 1733731 - RNA, 17 nt, Homo sapiens
ccagugcuuuaauggca

SEQ ID NO: 1733732 - RNA, 17 nt, Homo sapiens
ccaugugauuacccucu

SEQ ID NO: 1733733 - RNA, 14 nt, Homo sapiens
ccgaagucuuccau

SEQ ID NO: 1733734 - RNA, 15 nt, Homo sapiens
ccuaaccucauuccc

SEQ ID NO: 1733735 - RNA, 20 nt, Homo sapiens
ccucaucuguaaaauggaga

SEQ ID NO: 1733736 - RNA, 20 nt, Homo sapiens
ccuggacaguuuucugcuuu

SEQ ID NO: 1733737 - RNA, 22 nt, Homo sapiens
ccuggcugggaguggcauguau

SEQ ID NO: 1733738 - RNA, 17 nt, Homo sapiens
ccuggucaacaugguga

SEQ ID NO: 1733739 - RNA, 13 nt, Homo sapiens
ccuguaaucacag

SEQ ID NO: 1733740 - RNA, 16 nt, Homo sapiens
ccugugacugucucac

SEQ ID NO: 1733741 - RNA, 23 nt, Homo sapiens
ccuuaaacucagggagcauuuau

SEQ ID NO: 1733742 - RNA, 21 nt, Homo sapiens
ccuuauuguaccucucuuaua

SEQ ID NO: 1733743 - RNA, 19 nt, Homo sapiens
ccuuuggaugcacuuuaua

SEQ ID NO: 1733744 - RNA, 12 nt, Homo sapiens
cggaacaguauc

SEQ ID NO: 1733745 - RNA, 9 nt, Homo sapiens
cgugcaaua

SEQ ID NO: 1733746 - RNA, 18 nt, Homo sapiens
cuaauagaauuaauggaa

SEQ ID NO: 1733747 - RNA, 22 nt, Homo sapiens
cuauauccugugacugucucac

SEQ ID NO: 1733748 - RNA, 15 nt, Homo sapiens
cuaugugauuacaag

SEQ ID NO: 1733749 - RNA, 22 nt, Homo sapiens
cuauguucuaagaagugaaaau

SEQ ID NO: 1733750 - RNA, 18 nt, Homo sapiens
cucugucucaguccauga

SEQ ID NO: 1733751 - RNA, 22 nt, Homo sapiens
cugaugaaaacauagcaucuca

SEQ ID NO: 1733752 - RNA, 22 nt, Homo sapiens
cugcaagcuuuucaaaauugga

SEQ ID NO: 1733753 - RNA, 19 nt, Homo sapiens
cugcaaucugagccagugc

SEQ ID NO: 1733754 - RNA, 19 nt, Homo sapiens
cugccuugguauagcauau

SEQ ID NO: 1733755 - RNA, 13 nt, Homo sapiens
cuggagcucugcc

SEQ ID NO: 1733756 - RNA, 16 nt, Homo sapiens
cuggcacuugggacaa

SEQ ID NO: 1733757 - RNA, 17 nt, Homo sapiens
cuggcacuugggacaaa

SEQ ID NO: 1733758 - RNA, 23 nt, Homo sapiens
cuggcugggaguggcauguauga

SEQ ID NO: 1733759 - RNA, 21 nt, Homo sapiens
cuguaaucccagcacuuuggg

SEQ ID NO: 1733760 - RNA, 23 nt, Homo sapiens
cuguaaucccagcacuuugggag

SEQ ID NO: 1733761 - RNA, 22 nt, Homo sapiens
cuguacuccagccugggugaca

SEQ ID NO: 1733762 - RNA, 21 nt, Homo sapiens
cuuagacccucaugcugccaa

SEQ ID NO: 1733763 - RNA, 13 nt, Homo sapiens
cuuaugaaccuuu

SEQ ID NO: 1733764 - RNA, 23 nt, Homo sapiens
cuugccauggagguuaagcacuu

SEQ ID NO: 1733765 - RNA, 14 nt, Homo sapiens
cuuggucucagugu

SEQ ID NO: 1733766 - RNA, 13 nt, Homo sapiens
cuuugaagucuga

SEQ ID NO: 1733767 - RNA, 19 nt, Homo sapiens
cuuuucaaaauuggacuua

SEQ ID NO: 1733768 - RNA, 16 nt, Homo sapiens
gaaaauaaaagcacuu

SEQ ID NO: 1733769 - RNA, 12 nt, Homo sapiens
gaaaauaugccu

SEQ ID NO: 1733770 - RNA, 14 nt, Homo sapiens
gaaaaugugcaaua

SEQ ID NO: 1733771 - RNA, 15 nt, Homo sapiens
gaaaaugugcaauau

SEQ ID NO: 1733772 - RNA, 20 nt, Homo sapiens
gaaaccuuauuguaccucuc

SEQ ID NO: 1733773 - RNA, 21 nt, Homo sapiens
gaacugcuggauucaagugau

SEQ ID NO: 1733774 - RNA, 15 nt, Homo sapiens
gaagcuuccauucca

SEQ ID NO: 1733775 - RNA, 12 nt, Homo sapiens
gaagucuuccau

SEQ ID NO: 1733776 - RNA, 16 nt, Homo sapiens
gaagucuuccauagag

SEQ ID NO: 1733777 - RNA, 18 nt, Homo sapiens
gaauaaauaaauguaucu

SEQ ID NO: 1733778 - RNA, 22 nt, Homo sapiens
gaauaguguuggaaaaugugca

SEQ ID NO: 1733779 - RNA, 16 nt, Homo sapiens
gaaucccuuaaacuca

SEQ ID NO: 1733780 - RNA, 13 nt, Homo sapiens
gaauuaauggaau

SEQ ID NO: 1733781 - RNA, 21 nt, Homo sapiens
gacacaggcuccaaacuggag

SEQ ID NO: 1733782 - RNA, 20 nt, Homo sapiens
gacaccaccacccuugccau

SEQ ID NO: 1733783 - RNA, 15 nt, Homo sapiens
gacaguuuucugcuu

SEQ ID NO: 1733784 - RNA, 15 nt, Homo sapiens
gaccugacagcccaa

SEQ ID NO: 1733785 - RNA, 15 nt, Homo sapiens
gacuaauuaggcaag

SEQ ID NO: 1733786 - RNA, 19 nt, Homo sapiens
gacuaugaggaauauuugc

SEQ ID NO: 1733787 - RNA, 22 nt, Homo sapiens
gagaaaccuuauuguaccucuc

SEQ ID NO: 1733788 - RNA, 18 nt, Homo sapiens
gagacgggguuugccaug

SEQ ID NO: 1733789 - RNA, 16 nt, Homo sapiens
gagacucugucucagu

SEQ ID NO: 1733790 - RNA, 16 nt, Homo sapiens
gagauuucaugccugg

SEQ ID NO: 1733791 - RNA, 19 nt, Homo sapiens
gagccaccaaacccggccu

SEQ ID NO: 1733792 - RNA, 12 nt, Homo sapiens
gagcgacaguga

SEQ ID NO: 1733793 - RNA, 23 nt, Homo sapiens
gagcuugaaauagugucugauga

SEQ ID NO: 1733794 - RNA, 20 nt, Homo sapiens
gaggcagagguugcagugag

SEQ ID NO: 1733795 - RNA, 17 nt, Homo sapiens
gagggggcgcgugcagg

SEQ ID NO: 1733796 - RNA, 20 nt, Homo sapiens
gauacaaugaacacuuauaa

SEQ ID NO: 1733797 - RNA, 21 nt, Homo sapiens
gauaccucaacccccauuucu

SEQ ID NO: 1733798 - RNA, 21 nt, Homo sapiens
gauagguuaccaguaacggaa

SEQ ID NO: 1733799 - RNA, 23 nt, Homo sapiens
gaugaaaacauagcaucucagga

SEQ ID NO: 1733800 - RNA, 21 nt, Homo sapiens
gaugccccagggaccuuugua

SEQ ID NO: 1733801 - RNA, 23 nt, Homo sapiens
gauuacaaggcuuuaucucaggg

SEQ ID NO: 1733802 - RNA, 15 nt, Homo sapiens
gauuacccucugggu

SEQ ID NO: 1733803 - RNA, 20 nt, Homo sapiens
gauugugccccugcacucca

SEQ ID NO: 1733804 - RNA, 12 nt, Homo sapiens
gauuucauucaa

SEQ ID NO: 1733805 - RNA, 16 nt, Homo sapiens
gcaauaaaauguauuu

SEQ ID NO: 1733806 - RNA, 13 nt, Homo sapiens
gcacucuauguuc

SEQ ID NO: 1733807 - RNA, 15 nt, Homo sapiens
gcacuugggacaaaa

SEQ ID NO: 1733808 - RNA, 17 nt, Homo sapiens
gcacuuuaacacagugu

SEQ ID NO: 1733809 - RNA, 19 nt, Homo sapiens
gcacuuuaacacagugucu

SEQ ID NO: 1733810 - RNA, 12 nt, Homo sapiens
gcagaacaguga

SEQ ID NO: 1733811 - RNA, 15 nt, Homo sapiens
gcagauaaacaguag

SEQ ID NO: 1733812 - RNA, 14 nt, Homo sapiens
gcagggacuugaac

SEQ ID NO: 1733813 - RNA, 19 nt, Homo sapiens
gccaaggcuggagugcagu

SEQ ID NO: 1733814 - RNA, 20 nt, Homo sapiens
gccaaggcuggagugcagug

SEQ ID NO: 1733815 - RNA, 18 nt, Homo sapiens
gccauaauuacuauguca

SEQ ID NO: 1733816 - RNA, 18 nt, Homo sapiens
gcccccauuguggucaca

SEQ ID NO: 1733817 - RNA, 20 nt, Homo sapiens
gccuguaaucccagcacuuu

SEQ ID NO: 1733818 - RNA, 16 nt, Homo sapiens
gcugaggcaagagaau

SEQ ID NO: 1733819 - RNA, 14 nt, Homo sapiens
gcugcucugugguc

SEQ ID NO: 1733820 - RNA, 14 nt, Homo sapiens
gcuuccuaacugcu

SEQ ID NO: 1733821 - RNA, 19 nt, Homo sapiens
ggacuugggcgggacacag

SEQ ID NO: 1733822 - RNA, 13 nt, Homo sapiens
ggagaaacuggaa

SEQ ID NO: 1733823 - RNA, 16 nt, Homo sapiens
ggaguggcauguauga

SEQ ID NO: 1733824 - RNA, 15 nt, Homo sapiens
ggauagagugggaca

SEQ ID NO: 1733825 - RNA, 16 nt, Homo sapiens
ggcauuuucacuuuug

SEQ ID NO: 1733826 - RNA, 10 nt, Homo sapiens
ggggcuuccu

SEQ ID NO: 1733827 - RNA, 19 nt, Homo sapiens
gguauuuauugagcaccug

SEQ ID NO: 1733828 - RNA, 14 nt, Homo sapiens
ggugugaccacugc

SEQ ID NO: 1733829 - RNA, 19 nt, Homo sapiens
gguuugccaugcuggccag

SEQ ID NO: 1733830 - RNA, 18 nt, Homo sapiens
guaaguuuaugcauacag

SEQ ID NO: 1733831 - RNA, 18 nt, Homo sapiens
guauuuauugagcaccug

SEQ ID NO: 1733832 - RNA, 22 nt, Homo sapiens
gucucaguguccucaucuguaa

SEQ ID NO: 1733833 - RNA, 14 nt, Homo sapiens
gugaaauaagccag

SEQ ID NO: 1733834 - RNA, 20 nt, Homo sapiens
gugaaauaagccagacauca

SEQ ID NO: 1733835 - RNA, 17 nt, Homo sapiens
gugagacagcucugcau

SEQ ID NO: 1733836 - RNA, 20 nt, Homo sapiens
gugauuacccucugggucuc

SEQ ID NO: 1733837 - RNA, 20 nt, Homo sapiens
gugcugggaauuacaggcgu

SEQ ID NO: 1733838 - RNA, 14 nt, Homo sapiens
guggcgacucuaua

SEQ ID NO: 1733839 - RNA, 22 nt, Homo sapiens
gugugaccacugcagaagacag

SEQ ID NO: 1733840 - RNA, 20 nt, Homo sapiens
guguuggaaaaugugcaaua

SEQ ID NO: 1733841 - RNA, 19 nt, Homo sapiens
auuuguuaaaauuaucaau

SEQ ID NO: 1733842 - RNA, 12 nt, Homo sapiens
auuuucuuccaa

SEQ ID NO: 1733843 - RNA, 15 nt, Homo sapiens
auuuuuaugugcaau

SEQ ID NO: 1733844 - RNA, 16 nt, Homo sapiens
auuuuuaugugcaaua

SEQ ID NO: 1733845 - RNA, 16 nt, Homo sapiens
caaauauuguugacaa

SEQ ID NO: 1733846 - RNA, 20 nt, Homo sapiens
caaccaaauggagugacuua

SEQ ID NO: 1733847 - RNA, 10 nt, Homo sapiens
caagacauag

SEQ ID NO: 1733848 - RNA, 19 nt, Homo sapiens
caagcuuuucaaaauugga

SEQ ID NO: 1733849 - RNA, 21 nt, Homo sapiens
caccaaacccggccugauuaa

SEQ ID NO: 1733850 - RNA, 14 nt, Homo sapiens
caccacgcccagcu
